United States Patent 7,655,785 (BIOINFORMATICALLY DETECTABLE GROUP OF NOVEL REGULATORY OLIGONUCLEOTIDES AND USES THEREOF) - sequence listing, part 23

SEQ ID NO: 926533 - RNA, 23 nt, Homo sapiens
guaagaacauguuacgugugcaa

SEQ ID NO: 926534 - RNA, 22 nt, Homo sapiens
guaagagucacaauuugcaaau

SEQ ID NO: 926535 - RNA, 22 nt, Homo sapiens
guacccaccugagcuuuggacg

SEQ ID NO: 926536 - RNA, 15 nt, Homo sapiens
guacccccccagggg

SEQ ID NO: 926537 - RNA, 15 nt, Homo sapiens
guaccuuucugacaa

SEQ ID NO: 926538 - RNA, 16 nt, Homo sapiens
guagcagcauuuacag

SEQ ID NO: 926539 - RNA, 15 nt, Homo sapiens
guagcuauucuuuga

SEQ ID NO: 926540 - RNA, 19 nt, Homo sapiens
guagcugagacuacaggug

SEQ ID NO: 926541 - RNA, 19 nt, Homo sapiens
guaguugggauuacaggug

SEQ ID NO: 926542 - RNA, 12 nt, Homo sapiens
guauaacaaaga

SEQ ID NO: 926543 - RNA, 22 nt, Homo sapiens
guaucuucguaacuucauauua

SEQ ID NO: 926544 - RNA, 17 nt, Homo sapiens
guaugagugcaagcaaa

SEQ ID NO: 926545 - RNA, 20 nt, Homo sapiens
guaugauggcaggagaauca

SEQ ID NO: 926546 - RNA, 20 nt, Homo sapiens
guauguccagcaaacucuug

SEQ ID NO: 926547 - RNA, 17 nt, Homo sapiens
guauuaaaccuuuccau

SEQ ID NO: 926548 - RNA, 21 nt, Homo sapiens
guauuauauuuuggccuuaca

SEQ ID NO: 926549 - RNA, 21 nt, Homo sapiens
guauuauuuuuuuauguucau

SEQ ID NO: 926550 - RNA, 19 nt, Homo sapiens
gucaauggacugcaccuug

SEQ ID NO: 926551 - RNA, 13 nt, Homo sapiens
gucacauuccauu

SEQ ID NO: 926552 - RNA, 20 nt, Homo sapiens
gucacuucgugggaucugcc

SEQ ID NO: 926553 - RNA, 20 nt, Homo sapiens
gucagauaaucggugcagcg

SEQ ID NO: 926554 - RNA, 14 nt, Homo sapiens
gucaggcacaguaa

SEQ ID NO: 926555 - RNA, 19 nt, Homo sapiens
gucaucaacaauuugacca

SEQ ID NO: 926556 - RNA, 19 nt, Homo sapiens
gucaucaaccgaugguccu

SEQ ID NO: 926557 - RNA, 13 nt, Homo sapiens
gucaugaguuuau

SEQ ID NO: 926558 - RNA, 22 nt, Homo sapiens
gucauuuuuuuuuucugugcug

SEQ ID NO: 926559 - RNA, 23 nt, Homo sapiens
guccagacgcacugaucuuugca

SEQ ID NO: 926560 - RNA, 12 nt, Homo sapiens
guccagcaaacu

SEQ ID NO: 926561 - RNA, 23 nt, Homo sapiens
guccagcaaacucuugcaugugg

SEQ ID NO: 926562 - RNA, 22 nt, Homo sapiens
gucccuauacagagguccugcc

SEQ ID NO: 926563 - RNA, 13 nt, Homo sapiens
guccuaugcgcuc

SEQ ID NO: 926564 - RNA, 14 nt, Homo sapiens
guccucuucuguga

SEQ ID NO: 926565 - RNA, 19 nt, Homo sapiens
gucgucaaugaugaguccu

SEQ ID NO: 926566 - RNA, 23 nt, Homo sapiens
gucuaguucuuuucauuuggaau

SEQ ID NO: 926567 - RNA, 19 nt, Homo sapiens
gucucauggcagucccaaa

SEQ ID NO: 926568 - RNA, 17 nt, Homo sapiens
gucuccaggggccugca

SEQ ID NO: 926569 - RNA, 21 nt, Homo sapiens
gucucucacccccacacuggg

SEQ ID NO: 926570 - RNA, 14 nt, Homo sapiens
gucugcugcuccca

SEQ ID NO: 926571 - RNA, 22 nt, Homo sapiens
gucugugaaagucuccuguauc

SEQ ID NO: 926572 - RNA, 21 nt, Homo sapiens
gucuuaaucguccugcugcug

SEQ ID NO: 926573 - RNA, 16 nt, Homo sapiens
gucuugaugacugcug

SEQ ID NO: 926574 - RNA, 20 nt, Homo sapiens
gucuuggccucccaaagugc

SEQ ID NO: 926575 - RNA, 23 nt, Homo sapiens
gugaaaucccaucugcauuugau

SEQ ID NO: 926576 - RNA, 14 nt, Homo sapiens
gugaagcaaaaacu

SEQ ID NO: 926577 - RNA, 13 nt, Homo sapiens
gugaauacuuuga

SEQ ID NO: 926578 - RNA, 17 nt, Homo sapiens
gugaccuaagaacaaaa

SEQ ID NO: 926579 - RNA, 17 nt, Homo sapiens
gugacuuacagugccaa

SEQ ID NO: 926580 - RNA, 15 nt, Homo sapiens
gugagccacugugcc

SEQ ID NO: 926581 - RNA, 18 nt, Homo sapiens
gugauaaguuccaaauau

SEQ ID NO: 926582 - RNA, 22 nt, Homo sapiens
gugauggcauuacucugcacua

SEQ ID NO: 926583 - RNA, 23 nt, Homo sapiens
gugcaauuucuucuguagcuauu

SEQ ID NO: 926584 - RNA, 14 nt, Homo sapiens
gugcaucaaccagg

SEQ ID NO: 926585 - RNA, 20 nt, Homo sapiens
gugccaccaacauaaaacaa

SEQ ID NO: 926586 - RNA, 14 nt, Homo sapiens
gugcccaccagccu

SEQ ID NO: 926587 - RNA, 12 nt, Homo sapiens
gugcccagugau

SEQ ID NO: 926588 - RNA, 17 nt, Homo sapiens
gugcugagaacacccca

SEQ ID NO: 926589 - RNA, 19 nt, Homo sapiens
gugcugagauuacaggugu

SEQ ID NO: 926590 - RNA, 18 nt, Homo sapiens
gugcugggauuacaggug

SEQ ID NO: 926591 - RNA, 22 nt, Homo sapiens
gugcugucuugaugacugcuga

SEQ ID NO: 926592 - RNA, 16 nt, Homo sapiens
gugcuuuugcaaaaga

SEQ ID NO: 926593 - RNA, 22 nt, Homo sapiens
guggagcacaaaagccucucau

SEQ ID NO: 926594 - RNA, 23 nt, Homo sapiens
gugguaaauauagaaccaugaau

SEQ ID NO: 926595 - RNA, 22 nt, Homo sapiens
guguaaaaaacaaacauuugaa

SEQ ID NO: 926596 - RNA, 16 nt, Homo sapiens
guguaggcaccaccuc

SEQ ID NO: 926597 - RNA, 18 nt, Homo sapiens
gugucaaagauuuuaccu

SEQ ID NO: 926598 - RNA, 15 nt, Homo sapiens
gugucacuuagugag

SEQ ID NO: 926599 - RNA, 16 nt, Homo sapiens
gugucuggucguuuga

SEQ ID NO: 926600 - RNA, 14 nt, Homo sapiens
gugucugucagugg

SEQ ID NO: 926601 - RNA, 13 nt, Homo sapiens
guguguccaugca

SEQ ID NO: 926602 - RNA, 12 nt, Homo sapiens
guguguguaaca

SEQ ID NO: 926603 - RNA, 18 nt, Homo sapiens
guguucuuuguuccacug

SEQ ID NO: 926604 - RNA, 17 nt, Homo sapiens
guuaauuuaaagcuguu

SEQ ID NO: 926605 - RNA, 19 nt, Homo sapiens
guuauauuaaaaacauaga

SEQ ID NO: 926606 - RNA, 16 nt, Homo sapiens
guuauuuguuacuaaa

SEQ ID NO: 926607 - RNA, 21 nt, Homo sapiens
guuccuaauauauuguuaaau

SEQ ID NO: 926608 - RNA, 14 nt, Homo sapiens
guucuaaugcugca

SEQ ID NO: 926609 - RNA, 14 nt, Homo sapiens
guucuccauuacag

SEQ ID NO: 926610 - RNA, 19 nt, Homo sapiens
guucucuccccuugcacug

SEQ ID NO: 926611 - RNA, 16 nt, Homo sapiens
guucuggaacauucug

SEQ ID NO: 926612 - RNA, 14 nt, Homo sapiens
guucuguguuugau

SEQ ID NO: 926613 - RNA, 15 nt, Homo sapiens
guugcagugagcuaa

SEQ ID NO: 926614 - RNA, 14 nt, Homo sapiens
guugugugugcuuu

SEQ ID NO: 926615 - RNA, 15 nt, Homo sapiens
guuuacagugaauaa

SEQ ID NO: 926616 - RNA, 18 nt, Homo sapiens
guuuacgguacuugguaa

SEQ ID NO: 926617 - RNA, 12 nt, Homo sapiens
guuuagauauau

SEQ ID NO: 926618 - RNA, 16 nt, Homo sapiens
guuuagcaacuuugau

SEQ ID NO: 926619 - RNA, 14 nt, Homo sapiens
guuucacuguucau

SEQ ID NO: 926620 - RNA, 18 nt, Homo sapiens
guuucaguaauagcugaa

SEQ ID NO: 926621 - RNA, 22 nt, Homo sapiens
guuuccagcuaagccugaugau

SEQ ID NO: 926622 - RNA, 15 nt, Homo sapiens
guuugucauuuugaa

SEQ ID NO: 926623 - RNA, 13 nt, Homo sapiens
guuugucuucucc

SEQ ID NO: 926624 - RNA, 21 nt, Homo sapiens
guuugugaagauuuaaucuca

SEQ ID NO: 926625 - RNA, 20 nt, Homo sapiens
guuuucccuguucuggacau

SEQ ID NO: 926626 - RNA, 12 nt, Homo sapiens
guuuuuaaucca

SEQ ID NO: 926627 - RNA, 22 nt, Homo sapiens
guuuuuaugauuuuuauuugaa

SEQ ID NO: 926628 - RNA, 18 nt, Homo sapiens
uaaaacucaaggcuuaua

SEQ ID NO: 926629 - RNA, 17 nt, Homo sapiens
uaaaacuuaucugaguc

SEQ ID NO: 926630 - RNA, 16 nt, Homo sapiens
uaaaagauaaguuugu

SEQ ID NO: 926631 - RNA, 17 nt, Homo sapiens
uaaaaggcacugcacau

SEQ ID NO: 926632 - RNA, 20 nt, Homo sapiens
uaaaaguuuuaaccucaggu

SEQ ID NO: 926633 - RNA, 20 nt, Homo sapiens
uaaaaucucacgcugccauu

SEQ ID NO: 926634 - RNA, 18 nt, Homo sapiens
uaaaaucugauuuacacu

SEQ ID NO: 926635 - RNA, 14 nt, Homo sapiens
uaaaaugcauuuaa

SEQ ID NO: 926636 - RNA, 17 nt, Homo sapiens
uaaacugcccugucuag

SEQ ID NO: 926637 - RNA, 14 nt, Homo sapiens
uaaacuuacuacaa

SEQ ID NO: 926638 - RNA, 18 nt, Homo sapiens
uaaagaaaugcauaaaag

SEQ ID NO: 926639 - RNA, 17 nt, Homo sapiens
uaaagaacauucuaaaa

SEQ ID NO: 926640 - RNA, 19 nt, Homo sapiens
uaaagagcagccuggcuaa

SEQ ID NO: 926641 - RNA, 14 nt, Homo sapiens
uaaagucaguaacu

SEQ ID NO: 926642 - RNA, 19 nt, Homo sapiens
uaaagugucauccaccagu

SEQ ID NO: 926643 - RNA, 13 nt, Homo sapiens
uaaaguuugcuaa

SEQ ID NO: 926644 - RNA, 21 nt, Homo sapiens
uaaauacuguacauagaugua

SEQ ID NO: 926645 - RNA, 17 nt, Homo sapiens
gcucugaacugcacaau

SEQ ID NO: 926646 - RNA, 20 nt, Homo sapiens
gcucugaacugcacaaugca

SEQ ID NO: 926647 - RNA, 14 nt, Homo sapiens
gcucuggggacuga

SEQ ID NO: 926648 - RNA, 17 nt, Homo sapiens
gcugagacuacagguga

SEQ ID NO: 926649 - RNA, 16 nt, Homo sapiens
gcugagauuacaggug

SEQ ID NO: 926650 - RNA, 16 nt, Homo sapiens
gcugagcacacaacag

SEQ ID NO: 926651 - RNA, 21 nt, Homo sapiens
gcugagcacacaacaggcugu

SEQ ID NO: 926652 - RNA, 13 nt, Homo sapiens
gcugauuuagacc

SEQ ID NO: 926653 - RNA, 21 nt, Homo sapiens
gcugcacccuguauggagcua

SEQ ID NO: 926654 - RNA, 20 nt, Homo sapiens
gcugccugcuuugugcaggg

SEQ ID NO: 926655 - RNA, 14 nt, Homo sapiens
gcugcuuugcacac

SEQ ID NO: 926656 - RNA, 14 nt, Homo sapiens
gcuggagugcagug

SEQ ID NO: 926657 - RNA, 20 nt, Homo sapiens
gcuggagugcaguggcacca

SEQ ID NO: 926658 - RNA, 15 nt, Homo sapiens
gcugggagagccaag

SEQ ID NO: 926659 - RNA, 13 nt, Homo sapiens
gcugggauuacag

SEQ ID NO: 926660 - RNA, 15 nt, Homo sapiens
gcuguacccuugaga

SEQ ID NO: 926661 - RNA, 20 nt, Homo sapiens
gcuguccaggaacuuuccag

SEQ ID NO: 926662 - RNA, 19 nt, Homo sapiens
gcugucccugcagggccau

SEQ ID NO: 926663 - RNA, 23 nt, Homo sapiens
gcugugaaaauuacacccaugca

SEQ ID NO: 926664 - RNA, 22 nt, Homo sapiens
gcuuaaagaucucaacauggaa

SEQ ID NO: 926665 - RNA, 11 nt, Homo sapiens
gcuuacaggaa

SEQ ID NO: 926666 - RNA, 20 nt, Homo sapiens
gcuuaggauugcaaugucaa

SEQ ID NO: 926667 - RNA, 21 nt, Homo sapiens
gcuucaaggauauacugcagc

SEQ ID NO: 926668 - RNA, 14 nt, Homo sapiens
gcuucuaggugccc

SEQ ID NO: 926669 - RNA, 12 nt, Homo sapiens
gcuugacacaaa

SEQ ID NO: 926670 - RNA, 22 nt, Homo sapiens
gcuugguuuccucaccuugaaa

SEQ ID NO: 926671 - RNA, 16 nt, Homo sapiens
gcuuuacuagugccaa

SEQ ID NO: 926672 - RNA, 16 nt, Homo sapiens
gcuuucugaacucgcu

SEQ ID NO: 926673 - RNA, 20 nt, Homo sapiens
gcuuuggacgcacacagcuu

SEQ ID NO: 926674 - RNA, 20 nt, Homo sapiens
gcuuuggcucgggacuucaa

SEQ ID NO: 926675 - RNA, 18 nt, Homo sapiens
ggaaaaaggcuucuccac

SEQ ID NO: 926676 - RNA, 21 nt, Homo sapiens
ggaaaaauccugucauggcuc

SEQ ID NO: 926677 - RNA, 16 nt, Homo sapiens
ggaaaaccgaguaucu

SEQ ID NO: 926678 - RNA, 22 nt, Homo sapiens
ggaaaggagggggcucaggcca

SEQ ID NO: 926679 - RNA, 12 nt, Homo sapiens
ggaaaucuccuc

SEQ ID NO: 926680 - RNA, 16 nt, Homo sapiens
ggaaauuccaacagau

SEQ ID NO: 926681 - RNA, 21 nt, Homo sapiens
ggaacucccaagaacagcagg

SEQ ID NO: 926682 - RNA, 21 nt, Homo sapiens
ggaacucuuccuggaaugcau

SEQ ID NO: 926683 - RNA, 16 nt, Homo sapiens
ggaacuuuccagcagu

SEQ ID NO: 926684 - RNA, 19 nt, Homo sapiens
ggaagacuccccugccucc

SEQ ID NO: 926685 - RNA, 22 nt, Homo sapiens
ggaagcuccaguccugcucucu

SEQ ID NO: 926686 - RNA, 18 nt, Homo sapiens
ggaaggugggaacagagg

SEQ ID NO: 926687 - RNA, 13 nt, Homo sapiens
ggaaugacuuggg

SEQ ID NO: 926688 - RNA, 11 nt, Homo sapiens
ggacacugggc

SEQ ID NO: 926689 - RNA, 10 nt, Homo sapiens
ggacagugau

SEQ ID NO: 926690 - RNA, 11 nt, Homo sapiens
ggacauuucau

SEQ ID NO: 926691 - RNA, 21 nt, Homo sapiens
ggaccaauuagcauuccauca

SEQ ID NO: 926692 - RNA, 20 nt, Homo sapiens
ggacuauugcaauacauuuc

SEQ ID NO: 926693 - RNA, 21 nt, Homo sapiens
ggacuauugcaauacauuucu

SEQ ID NO: 926694 - RNA, 18 nt, Homo sapiens
ggacugagcccaugacac

SEQ ID NO: 926695 - RNA, 14 nt, Homo sapiens
ggagacaauuacaa

SEQ ID NO: 926696 - RNA, 17 nt, Homo sapiens
ggagacacuguucccaa

SEQ ID NO: 926697 - RNA, 18 nt, Homo sapiens
ggagacauauuucaguga

SEQ ID NO: 926698 - RNA, 12 nt, Homo sapiens
ggagauacugau

SEQ ID NO: 926699 - RNA, 20 nt, Homo sapiens
ggagaucuuggggugcagca

SEQ ID NO: 926700 - RNA, 14 nt, Homo sapiens
ggagccacaggcag

SEQ ID NO: 926701 - RNA, 19 nt, Homo sapiens
ggaggaaauaaauugcaga

SEQ ID NO: 926702 - RNA, 19 nt, Homo sapiens
ggaggccccugguggcaug

SEQ ID NO: 926703 - RNA, 19 nt, Homo sapiens
ggagguugagaaugcagug

SEQ ID NO: 926704 - RNA, 22 nt, Homo sapiens
ggagguugcagugagcuaagau

SEQ ID NO: 926705 - RNA, 14 nt, Homo sapiens
ggagucaugccaag

SEQ ID NO: 926706 - RNA, 19 nt, Homo sapiens
ggauaguagaucuguggcg

SEQ ID NO: 926707 - RNA, 15 nt, Homo sapiens
ggauauacugcagcu

SEQ ID NO: 926708 - RNA, 13 nt, Homo sapiens
ggauccagccacu

SEQ ID NO: 926709 - RNA, 13 nt, Homo sapiens
ggaucugcagcuc

SEQ ID NO: 926710 - RNA, 19 nt, Homo sapiens
ggaugaggucaccagggga

SEQ ID NO: 926711 - RNA, 16 nt, Homo sapiens
ggauguauauugcuau

SEQ ID NO: 926712 - RNA, 20 nt, Homo sapiens
ggauucucgacucuuugcaa

SEQ ID NO: 926713 - RNA, 23 nt, Homo sapiens
ggauuuuuagauucccagugucu

SEQ ID NO: 926714 - RNA, 19 nt, Homo sapiens
ggcacccccuggcuugaac

SEQ ID NO: 926715 - RNA, 20 nt, Homo sapiens
ggcagcuucgugugcagcua

SEQ ID NO: 926716 - RNA, 16 nt, Homo sapiens
ggcagguugaucagug

SEQ ID NO: 926717 - RNA, 18 nt, Homo sapiens
ggcagguugaucagugag

SEQ ID NO: 926718 - RNA, 15 nt, Homo sapiens
ggcaguggcagggga

SEQ ID NO: 926719 - RNA, 12 nt, Homo sapiens
ggcauaugauuu

SEQ ID NO: 926720 - RNA, 19 nt, Homo sapiens
ggcaugguggugagcaccu

SEQ ID NO: 926721 - RNA, 21 nt, Homo sapiens
ggccacauucaccaaccaaag

SEQ ID NO: 926722 - RNA, 22 nt, Homo sapiens
ggccauccugucccaccaugca

SEQ ID NO: 926723 - RNA, 18 nt, Homo sapiens
ggccaucucugaacuuca

SEQ ID NO: 926724 - RNA, 23 nt, Homo sapiens
ggccaucugacugccaagccaga

SEQ ID NO: 926725 - RNA, 21 nt, Homo sapiens
ggccuaaagccagcauuuccu

SEQ ID NO: 926726 - RNA, 24 nt, Homo sapiens
ggccuccccuggggcuggcagcuu

SEQ ID NO: 926727 - RNA, 17 nt, Homo sapiens
ggccuucuccacaggga

SEQ ID NO: 926728 - RNA, 18 nt, Homo sapiens
ggccuucuccacagggac

SEQ ID NO: 926729 - RNA, 22 nt, Homo sapiens
ggccuuuugcccguugagguag

SEQ ID NO: 926730 - RNA, 21 nt, Homo sapiens
ggcgaagcugagcgggucuag

SEQ ID NO: 926731 - RNA, 15 nt, Homo sapiens
ggcucaacuagggag

SEQ ID NO: 926732 - RNA, 17 nt, Homo sapiens
ggcuccugcuuccccau

SEQ ID NO: 926733 - RNA, 18 nt, Homo sapiens
ggcugcaagcgcacuuga

SEQ ID NO: 926734 - RNA, 20 nt, Homo sapiens
ggcugcgaacugugcaguua

SEQ ID NO: 926735 - RNA, 19 nt, Homo sapiens
ggcuuauauuaagcaaaca

SEQ ID NO: 926736 - RNA, 17 nt, Homo sapiens
ggcuuuccucagcaccu

SEQ ID NO: 926737 - RNA, 18 nt, Homo sapiens
ggcuuuccucagcaccug

SEQ ID NO: 926738 - RNA, 18 nt, Homo sapiens
gggaaaagaagcacccag

SEQ ID NO: 926739 - RNA, 12 nt, Homo sapiens
gggaagaacucu

SEQ ID NO: 926740 - RNA, 19 nt, Homo sapiens
gggaaggcgauguggugac

SEQ ID NO: 926741 - RNA, 18 nt, Homo sapiens
gggacugagcccaugaca

SEQ ID NO: 926742 - RNA, 23 nt, Homo sapiens
gggacugcagguugugcccugug

SEQ ID NO: 926743 - RNA, 20 nt, Homo sapiens
gggaugaggucaccagggga

SEQ ID NO: 926744 - RNA, 20 nt, Homo sapiens
gggcaaacccuucucuucuc

SEQ ID NO: 926745 - RNA, 11 nt, Homo sapiens
gggcacagcug

SEQ ID NO: 926746 - RNA, 13 nt, Homo sapiens
gggcauaagcaaa

SEQ ID NO: 926747 - RNA, 16 nt, Homo sapiens
gggcauccaacugaga

SEQ ID NO: 926748 - RNA, 14 nt, Homo sapiens
ggggaaauggugcc

SEQ ID NO: 926749 - RNA, 17 nt, Homo sapiens
ggggcagcgcagccucc

SEQ ID NO: 926750 - RNA, 16 nt, Homo sapiens
ggggcccucugccuca

SEQ ID NO: 926751 - RNA, 12 nt, Homo sapiens
ggguaacagagu

SEQ ID NO: 926752 - RNA, 20 nt, Homo sapiens
gggucaaagugguacaggaa

SEQ ID NO: 926753 - RNA, 20 nt, Homo sapiens
gggucucccuauguugccca

SEQ ID NO: 926754 - RNA, 24 nt, Homo sapiens
gggugaagcugugaugugccuacu

SEQ ID NO: 926755 - RNA, 19 nt, Homo sapiens
gguauuggccgaugagcug

SEQ ID NO: 926756 - RNA, 17 nt, Homo sapiens
ggucccugcuaugcaga

SEQ ID NO: 926757 - RNA, 17 nt, Homo sapiens
ggucuagggaaugagac

SEQ ID NO: 926758 - RNA, 15 nt, Homo sapiens
ggucuccuaaccaag

SEQ ID NO: 926759 - RNA, 18 nt, Homo sapiens
ggucuguggccaguugac

SEQ ID NO: 926760 - RNA, 18 nt, Homo sapiens
ggucuuggucauuugcca

SEQ ID NO: 926761 - RNA, 18 nt, Homo sapiens
ggugauuuuccugugucc

SEQ ID NO: 926762 - RNA, 20 nt, Homo sapiens
gguggaaggugggaacagag

SEQ ID NO: 926763 - RNA, 15 nt, Homo sapiens
ggugugacacuuuug

SEQ ID NO: 926764 - RNA, 20 nt, Homo sapiens
gguuacaggacuucugugca

SEQ ID NO: 926765 - RNA, 15 nt, Homo sapiens
gguuacucauuuuau

SEQ ID NO: 926766 - RNA, 21 nt, Homo sapiens
gguucccagaaaacacauuuc

SEQ ID NO: 926767 - RNA, 20 nt, Homo sapiens
agcuaaggaggccguucagc

SEQ ID NO: 926768 - RNA, 20 nt, Homo sapiens
agcuacucuggaggcugaga

SEQ ID NO: 926769 - RNA, 18 nt, Homo sapiens
agcuagagcuuuaccuga

SEQ ID NO: 926770 - RNA, 24 nt, Homo sapiens
agcuagcucgugacuacauugaaa

SEQ ID NO: 926771 - RNA, 21 nt, Homo sapiens
agcuauuaagaaaaucacauu

SEQ ID NO: 926772 - RNA, 23 nt, Homo sapiens
agcugaacaguguuggcuuucau

SEQ ID NO: 926773 - RNA, 20 nt, Homo sapiens
agcugagaucacaccacugu

SEQ ID NO: 926774 - RNA, 18 nt, Homo sapiens
agcugcaggugcccauua

SEQ ID NO: 926775 - RNA, 22 nt, Homo sapiens
agcugcaggugcccauuagcaa

SEQ ID NO: 926776 - RNA, 15 nt, Homo sapiens
agcuggcaggagggu

SEQ ID NO: 926777 - RNA, 12 nt, Homo sapiens
agcuucaaauaa

SEQ ID NO: 926778 - RNA, 13 nt, Homo sapiens
agcuugaugccag

SEQ ID NO: 926779 - RNA, 13 nt, Homo sapiens
agcuuguaauugc

SEQ ID NO: 926780 - RNA, 22 nt, Homo sapiens
agcuuuaauguuacauaguaaa

SEQ ID NO: 926781 - RNA, 19 nt, Homo sapiens
agcuuuggacacacacagc

SEQ ID NO: 926782 - RNA, 22 nt, Homo sapiens
aggaaacuuuuuccaccuuucu

SEQ ID NO: 926783 - RNA, 16 nt, Homo sapiens
aggaaauauugagaga

SEQ ID NO: 926784 - RNA, 21 nt, Homo sapiens
aggaacagcaaaugcaaaaac

SEQ ID NO: 926785 - RNA, 14 nt, Homo sapiens
aggaagccacugcc

SEQ ID NO: 926786 - RNA, 13 nt, Homo sapiens
aggaauucagugc

SEQ ID NO: 926787 - RNA, 23 nt, Homo sapiens
aggaccucugggcuuugauucca

SEQ ID NO: 926788 - RNA, 13 nt, Homo sapiens
aggacgauuucac

SEQ ID NO: 926789 - RNA, 16 nt, Homo sapiens
aggacgcagacugacu

SEQ ID NO: 926790 - RNA, 17 nt, Homo sapiens
acuucagcuuuguguau

SEQ ID NO: 926791 - RNA, 16 nt, Homo sapiens
acuucuuccucgacau

SEQ ID NO: 926792 - RNA, 16 nt, Homo sapiens
acuugaacauuugcag

SEQ ID NO: 926793 - RNA, 18 nt, Homo sapiens
acuugaauucaaagcaug

SEQ ID NO: 926794 - RNA, 15 nt, Homo sapiens
acuugcaagucccau

SEQ ID NO: 926795 - RNA, 20 nt, Homo sapiens
acuuggcaguagaaauccag

SEQ ID NO: 926796 - RNA, 24 nt, Homo sapiens
acuugggugaaaaguauggcagug

SEQ ID NO: 926797 - RNA, 20 nt, Homo sapiens
acuuucaucuaaauuacuga

SEQ ID NO: 926798 - RNA, 16 nt, Homo sapiens
acuuugguccucugau

SEQ ID NO: 926799 - RNA, 23 nt, Homo sapiens
acuuugguccucugauuucacau

SEQ ID NO: 926800 - RNA, 16 nt, Homo sapiens
acuuuuagacaguggu

SEQ ID NO: 926801 - RNA, 21 nt, Homo sapiens
acuuuugcagcuuccuuccaa

SEQ ID NO: 926802 - RNA, 12 nt, Homo sapiens
acuuuuuccacc

SEQ ID NO: 926803 - RNA, 19 nt, Homo sapiens
agaaaaaggagcuuaccuc

SEQ ID NO: 926804 - RNA, 21 nt, Homo sapiens
agaaaauuuggucgugguaua

SEQ ID NO: 926805 - RNA, 11 nt, Homo sapiens
agaaaccauga

SEQ ID NO: 926806 - RNA, 20 nt, Homo sapiens
agaaacuccaccuauuuugc

SEQ ID NO: 926807 - RNA, 21 nt, Homo sapiens
agaaaggggcaggagcucaga

SEQ ID NO: 926808 - RNA, 17 nt, Homo sapiens
agaaauaugaagcacuu

SEQ ID NO: 926809 - RNA, 16 nt, Homo sapiens
agaaauccuuucauaa

SEQ ID NO: 926810 - RNA, 20 nt, Homo sapiens
agaaaugcauaaaagacaag

SEQ ID NO: 926811 - RNA, 14 nt, Homo sapiens
agaaaugccacuca

SEQ ID NO: 926812 - RNA, 17 nt, Homo sapiens
agaacaauggcuauuca

SEQ ID NO: 926813 - RNA, 21 nt, Homo sapiens
agaacuagugguggcucugag

SEQ ID NO: 926814 - RNA, 16 nt, Homo sapiens
agaagaaagacacaaa

SEQ ID NO: 926815 - RNA, 16 nt, Homo sapiens
agaagagaaucaaggc

SEQ ID NO: 926816 - RNA, 17 nt, Homo sapiens
agaagcaagacacgugg

SEQ ID NO: 926817 - RNA, 14 nt, Homo sapiens
agaagccagccaca

SEQ ID NO: 926818 - RNA, 14 nt, Homo sapiens
agaagcuauggaac

SEQ ID NO: 926819 - RNA, 15 nt, Homo sapiens
agaaucaagucugug

SEQ ID NO: 926820 - RNA, 17 nt, Homo sapiens
agaaugaagauaaguaa

SEQ ID NO: 926821 - RNA, 19 nt, Homo sapiens
agaaugcauugcaucauca

SEQ ID NO: 926822 - RNA, 16 nt, Homo sapiens
agaauguguguagaua

SEQ ID NO: 926823 - RNA, 17 nt, Homo sapiens
agaauuaucaucccaac

SEQ ID NO: 926824 - RNA, 13 nt, Homo sapiens
agaauuuagcuua

SEQ ID NO: 926825 - RNA, 15 nt, Homo sapiens
agacaaaccacugua

SEQ ID NO: 926826 - RNA, 17 nt, Homo sapiens
agacacauacagagugg

SEQ ID NO: 926827 - RNA, 18 nt, Homo sapiens
agacacguggccucguga

SEQ ID NO: 926828 - RNA, 17 nt, Homo sapiens
agacacuguucccaaag

SEQ ID NO: 926829 - RNA, 13 nt, Homo sapiens
agacauacuugua

SEQ ID NO: 926830 - RNA, 14 nt, Homo sapiens
agacaucaagauac

SEQ ID NO: 926831 - RNA, 15 nt, Homo sapiens
agacauggauuugau

SEQ ID NO: 926832 - RNA, 18 nt, Homo sapiens
agaccauuucacagaaaa

SEQ ID NO: 926833 - RNA, 17 nt, Homo sapiens
agacccaacaggugcug

SEQ ID NO: 926834 - RNA, 14 nt, Homo sapiens
agacccuugugcau

SEQ ID NO: 926835 - RNA, 21 nt, Homo sapiens
agaccuugauugcaccaacag

SEQ ID NO: 926836 - RNA, 13 nt, Homo sapiens
agacggagucuca

SEQ ID NO: 926837 - RNA, 14 nt, Homo sapiens
agacggagucucag

SEQ ID NO: 926838 - RNA, 13 nt, Homo sapiens
agacgugaugaag

SEQ ID NO: 926839 - RNA, 12 nt, Homo sapiens
agacuacaggug

SEQ ID NO: 926840 - RNA, 13 nt, Homo sapiens
agacuacagguga

SEQ ID NO: 926841 - RNA, 14 nt, Homo sapiens
agacuacuuuuaga

SEQ ID NO: 926842 - RNA, 21 nt, Homo sapiens
agacuggguuccucuccaagc

SEQ ID NO: 926843 - RNA, 15 nt, Homo sapiens
agacuugaacauuug

SEQ ID NO: 926844 - RNA, 13 nt, Homo sapiens
agagaacagggau

SEQ ID NO: 926845 - RNA, 19 nt, Homo sapiens
agagaacgggaguggccau

SEQ ID NO: 926846 - RNA, 22 nt, Homo sapiens
agagaagcugugucuuuagaca

SEQ ID NO: 926847 - RNA, 22 nt, Homo sapiens
agagaaggaauaaauuugucaa

SEQ ID NO: 926848 - RNA, 21 nt, Homo sapiens
agagaaguuguaaaguaugua

SEQ ID NO: 926849 - RNA, 13 nt, Homo sapiens
agagaccaaaaau

SEQ ID NO: 926850 - RNA, 14 nt, Homo sapiens
agagaccacaagca

SEQ ID NO: 926851 - RNA, 23 nt, Homo sapiens
agagagaaacucuauggguauca

SEQ ID NO: 926852 - RNA, 14 nt, Homo sapiens
agagagaagccagc

SEQ ID NO: 926853 - RNA, 22 nt, Homo sapiens
agagagguugugaaaacagcag

SEQ ID NO: 926854 - RNA, 14 nt, Homo sapiens
agagcuugaugcca

SEQ ID NO: 926855 - RNA, 16 nt, Homo sapiens
agaggcccaagcugcc

SEQ ID NO: 926856 - RNA, 14 nt, Homo sapiens
agagggagggagca

SEQ ID NO: 926857 - RNA, 14 nt, Homo sapiens
agagggaugcagug

SEQ ID NO: 926858 - RNA, 17 nt, Homo sapiens
agagucauuuucacuuu

SEQ ID NO: 926859 - RNA, 14 nt, Homo sapiens
agagucucauuauu

SEQ ID NO: 926860 - RNA, 23 nt, Homo sapiens
agaguguagaccgagauggugca

SEQ ID NO: 926861 - RNA, 20 nt, Homo sapiens
agaguguuggaaauaggcaa

SEQ ID NO: 926862 - RNA, 17 nt, Homo sapiens
agaguucuauccccaag

SEQ ID NO: 926863 - RNA, 23 nt, Homo sapiens
agauacaaccuuuuuauuuucac

SEQ ID NO: 926864 - RNA, 16 nt, Homo sapiens
agauaccgccagcucc

SEQ ID NO: 926865 - RNA, 22 nt, Homo sapiens
agauccuaccccaauuccuugu

SEQ ID NO: 926866 - RNA, 14 nt, Homo sapiens
agaucucaacaugg

SEQ ID NO: 926867 - RNA, 18 nt, Homo sapiens
agaugccucccugacccu

SEQ ID NO: 926868 - RNA, 17 nt, Homo sapiens
agaugguuaagucaauu

SEQ ID NO: 926869 - RNA, 16 nt, Homo sapiens
agauuaaaugaauaua

SEQ ID NO: 926870 - RNA, 13 nt, Homo sapiens
agauucccagugu

SEQ ID NO: 926871 - RNA, 18 nt, Homo sapiens
agauuccuuuccacucca

SEQ ID NO: 926872 - RNA, 17 nt, Homo sapiens
agauucuccacgguggu

SEQ ID NO: 926873 - RNA, 21 nt, Homo sapiens
agauuggaucauuuaacaaua

SEQ ID NO: 926874 - RNA, 14 nt, Homo sapiens
agauuucaguuacu

SEQ ID NO: 926875 - RNA, 15 nt, Homo sapiens
agauuuucuuuugcc

SEQ ID NO: 926876 - RNA, 13 nt, Homo sapiens
agcaaaaccaaag

SEQ ID NO: 926877 - RNA, 21 nt, Homo sapiens
agcaaacacuugaagugagaa

SEQ ID NO: 926878 - RNA, 14 nt, Homo sapiens
agcaaacucuugca

SEQ ID NO: 926879 - RNA, 20 nt, Homo sapiens
agcaaauuccaauacauuau

SEQ ID NO: 926880 - RNA, 22 nt, Homo sapiens
agcaaucuguguacugaacaua

SEQ ID NO: 926881 - RNA, 20 nt, Homo sapiens
agcacaggauuaggacugaa

SEQ ID NO: 926882 - RNA, 16 nt, Homo sapiens
agcaccuguaauccca

SEQ ID NO: 926883 - RNA, 14 nt, Homo sapiens
agcagcauuuacag

SEQ ID NO: 926884 - RNA, 22 nt, Homo sapiens
agcagugugucuccugcaugca

SEQ ID NO: 926885 - RNA, 24 nt, Homo sapiens
agcauagagaacgggaguggccau

SEQ ID NO: 926886 - RNA, 18 nt, Homo sapiens
agcauuuaauguagccau

SEQ ID NO: 926887 - RNA, 18 nt, Homo sapiens
agcauuuugcugcuuuau

SEQ ID NO: 926888 - RNA, 17 nt, Homo sapiens
agccaagaaaguccagu

SEQ ID NO: 926889 - RNA, 12 nt, Homo sapiens
agccaagaccca

SEQ ID NO: 926890 - RNA, 12 nt, Homo sapiens
agccacugugcc

SEQ ID NO: 926891 - RNA, 19 nt, Homo sapiens
agccacuuauuuccaugga

SEQ ID NO: 926892 - RNA, 22 nt, Homo sapiens
agccagaauucuggacaaccca

SEQ ID NO: 926893 - RNA, 13 nt, Homo sapiens
agcccggcaaaug

SEQ ID NO: 926894 - RNA, 15 nt, Homo sapiens
agcccugcugucaga

SEQ ID NO: 926895 - RNA, 22 nt, Homo sapiens
agcccugggugcaggacacugg

SEQ ID NO: 926896 - RNA, 13 nt, Homo sapiens
agcccuuugcacu

SEQ ID NO: 926897 - RNA, 19 nt, Homo sapiens
agccgaggucaugccacug

SEQ ID NO: 926898 - RNA, 13 nt, Homo sapiens
agccuacuuuuca

SEQ ID NO: 926899 - RNA, 14 nt, Homo sapiens
agccucaaacucaa

SEQ ID NO: 926900 - RNA, 14 nt, Homo sapiens
agccucaaccuccc

SEQ ID NO: 926901 - RNA, 18 nt, Homo sapiens
agccucagcaacagccag

SEQ ID NO: 926902 - RNA, 14 nt, Homo sapiens
agccuccugaguag

SEQ ID NO: 926903 - RNA, 16 nt, Homo sapiens
agccugaaacugaguu

SEQ ID NO: 926904 - RNA, 14 nt, Homo sapiens
agccugggccacug

SEQ ID NO: 926905 - RNA, 14 nt, Homo sapiens
agccugugggagaa

SEQ ID NO: 926906 - RNA, 17 nt, Homo sapiens
agccuucuuuuguacuu

SEQ ID NO: 926907 - RNA, 21 nt, Homo sapiens
agccuucuuuuguacuuuuca

SEQ ID NO: 926908 - RNA, 19 nt, Homo sapiens
agccuuuuauuaacauaua

SEQ ID NO: 926909 - RNA, 15 nt, Homo sapiens
agcgagauucugccu

SEQ ID NO: 926910 - RNA, 18 nt, Homo sapiens
agcgaucccuccccucag

SEQ ID NO: 926911 - RNA, 12 nt, Homo sapiens
agcgcaaagugc

SEQ ID NO: 926912 - RNA, 13 nt, Homo sapiens
agcgcacuugaug

SEQ ID NO: 926913 - RNA, 13 nt, Homo sapiens
agcgucaguauuu

SEQ ID NO: 926914 - RNA, 20 nt, Homo sapiens
accacauuugcuagagggag

SEQ ID NO: 926915 - RNA, 14 nt, Homo sapiens
accaccaccaucac

SEQ ID NO: 926916 - RNA, 23 nt, Homo sapiens
accacuuuuuuuuuuuucuuccc

SEQ ID NO: 926917 - RNA, 14 nt, Homo sapiens
accagagcaccuca

SEQ ID NO: 926918 - RNA, 15 nt, Homo sapiens
accagagcucuggag

SEQ ID NO: 926919 - RNA, 16 nt, Homo sapiens
accagccuuguccuaa

SEQ ID NO: 926920 - RNA, 18 nt, Homo sapiens
accauaaauuaauuugac

SEQ ID NO: 926921 - RNA, 20 nt, Homo sapiens
accauccuggcuaacacggu

SEQ ID NO: 926922 - RNA, 16 nt, Homo sapiens
accaugacgcacugcu

SEQ ID NO: 926923 - RNA, 13 nt, Homo sapiens
accaugaugcauu

SEQ ID NO: 926924 - RNA, 15 nt, Homo sapiens
accaugcaauuccau

SEQ ID NO: 926925 - RNA, 20 nt, Homo sapiens
accaugcagugccccuagcu

SEQ ID NO: 926926 - RNA, 16 nt, Homo sapiens
acccccacaccuggaa

SEQ ID NO: 926927 - RNA, 16 nt, Homo sapiens
accccuaugaacucuu

SEQ ID NO: 926928 - RNA, 22 nt, Homo sapiens
accccuugcucucaacccagga

SEQ ID NO: 926929 - RNA, 14 nt, Homo sapiens
acccgccuuggccu

SEQ ID NO: 926930 - RNA, 12 nt, Homo sapiens
acccuaccacag

SEQ ID NO: 926931 - RNA, 23 nt, Homo sapiens
acccugagccggccccaggcucg

SEQ ID NO: 926932 - RNA, 13 nt, Homo sapiens
acccugcagagau

SEQ ID NO: 926933 - RNA, 21 nt, Homo sapiens
acccuguggcaaaugccagga

SEQ ID NO: 926934 - RNA, 22 nt, Homo sapiens
acccuguuuuauugaguucuga

SEQ ID NO: 926935 - RNA, 14 nt, Homo sapiens
acccuuucuucaau

SEQ ID NO: 926936 - RNA, 19 nt, Homo sapiens
accgauuucagcacaugca

SEQ ID NO: 926937 - RNA, 22 nt, Homo sapiens
accgugauucuugaaaggugua

SEQ ID NO: 926938 - RNA, 16 nt, Homo sapiens
accgugcaacguguaa

SEQ ID NO: 926939 - RNA, 15 nt, Homo sapiens
accgugggucaugca

SEQ ID NO: 926940 - RNA, 16 nt, Homo sapiens
accuaaacguauuuca

SEQ ID NO: 926941 - RNA, 22 nt, Homo sapiens
accucaaaauauuuuuuuuaac

SEQ ID NO: 926942 - RNA, 22 nt, Homo sapiens
accucaagcaaccaugaacuca

SEQ ID NO: 926943 - RNA, 16 nt, Homo sapiens
accuccuccuccaguu

SEQ ID NO: 926944 - RNA, 21 nt, Homo sapiens
accuccuccuccaguucugau

SEQ ID NO: 926945 - RNA, 22 nt, Homo sapiens
accuccuccuccaguucugaug

SEQ ID NO: 926946 - RNA, 22 nt, Homo sapiens
accucuuuugagacuuugccca

SEQ ID NO: 926947 - RNA, 15 nt, Homo sapiens
accugacugccccag

SEQ ID NO: 926948 - RNA, 20 nt, Homo sapiens
accugcauguguuguacaau

SEQ ID NO: 926949 - RNA, 22 nt, Homo sapiens
accugcauguguuguacaauac

SEQ ID NO: 926950 - RNA, 15 nt, Homo sapiens
accuguaaucccagc

SEQ ID NO: 926951 - RNA, 19 nt, Homo sapiens
accuugaguugaguauuac

SEQ ID NO: 926952 - RNA, 18 nt, Homo sapiens
accuuuaaaaauguauaa

SEQ ID NO: 926953 - RNA, 12 nt, Homo sapiens
acgcacacagcu

SEQ ID NO: 926954 - RNA, 15 nt, Homo sapiens
acggagucucagucu

SEQ ID NO: 926955 - RNA, 20 nt, Homo sapiens
acgguggcucacgccuguaa

SEQ ID NO: 926956 - RNA, 21 nt, Homo sapiens
acgugcaauacggaacacugu

SEQ ID NO: 926957 - RNA, 13 nt, Homo sapiens
acguggcaaaauc

SEQ ID NO: 926958 - RNA, 18 nt, Homo sapiens
acguggcaaaaucccucu

SEQ ID NO: 926959 - RNA, 20 nt, Homo sapiens
acuaaacuacagaaaccuag

SEQ ID NO: 926960 - RNA, 15 nt, Homo sapiens
acuaaacuacauuau

SEQ ID NO: 926961 - RNA, 15 nt, Homo sapiens
acuaagauguauuaa

SEQ ID NO: 926962 - RNA, 20 nt, Homo sapiens
acuacccagauccauucccu

SEQ ID NO: 926963 - RNA, 22 nt, Homo sapiens
acuagaaccuucuaauccaugu

SEQ ID NO: 926964 - RNA, 18 nt, Homo sapiens
acuaggagauaccaccga

SEQ ID NO: 926965 - RNA, 20 nt, Homo sapiens
acuauauuuaauaccaccaa

SEQ ID NO: 926966 - RNA, 14 nt, Homo sapiens
acuaucaacacugc

SEQ ID NO: 926967 - RNA, 15 nt, Homo sapiens
acuauccuggcuuug

SEQ ID NO: 926968 - RNA, 19 nt, Homo sapiens
acuaugcaccuauaaauac

SEQ ID NO: 926969 - RNA, 13 nt, Homo sapiens
acuauucaugaga

SEQ ID NO: 926970 - RNA, 15 nt, Homo sapiens
acuauuuaguggaac

SEQ ID NO: 926971 - RNA, 17 nt, Homo sapiens
acucaagcagugugcug

SEQ ID NO: 926972 - RNA, 18 nt, Homo sapiens
acucaaggccuccagcca

SEQ ID NO: 926973 - RNA, 22 nt, Homo sapiens
acucagcuauaccucauucaca

SEQ ID NO: 926974 - RNA, 21 nt, Homo sapiens
acucauuucaaguuaugauuc

SEQ ID NO: 926975 - RNA, 23 nt, Homo sapiens
acucauuucaaguuaugauucag

SEQ ID NO: 926976 - RNA, 17 nt, Homo sapiens
acuccacugucuuuaaa

SEQ ID NO: 926977 - RNA, 19 nt, Homo sapiens
acuccagugcccaccagcc

SEQ ID NO: 926978 - RNA, 18 nt, Homo sapiens
acucccuaaguaauccca

SEQ ID NO: 926979 - RNA, 17 nt, Homo sapiens
acucgcacaaccaugac

SEQ ID NO: 926980 - RNA, 23 nt, Homo sapiens
acucgcuucucugugacugaugu

SEQ ID NO: 926981 - RNA, 22 nt, Homo sapiens
acucuauggguaucaaacagcu

SEQ ID NO: 926982 - RNA, 12 nt, Homo sapiens
acucucuacugg

SEQ ID NO: 926983 - RNA, 17 nt, Homo sapiens
acucuggaggcugagau

SEQ ID NO: 926984 - RNA, 19 nt, Homo sapiens
acucuggcauaugauuuau

SEQ ID NO: 926985 - RNA, 20 nt, Homo sapiens
acucuguccuuccaugcaaa

SEQ ID NO: 926986 - RNA, 18 nt, Homo sapiens
acucuugauaacaccaag

SEQ ID NO: 926987 - RNA, 19 nt, Homo sapiens
acucuugauaacaccaaga

SEQ ID NO: 926988 - RNA, 18 nt, Homo sapiens
acugacugaguagcucau

SEQ ID NO: 926989 - RNA, 19 nt, Homo sapiens
acugagaacagaucuccaa

SEQ ID NO: 926990 - RNA, 16 nt, Homo sapiens
acugcacaaugcauug

SEQ ID NO: 926991 - RNA, 22 nt, Homo sapiens
acugcucucaaaaugugaacug

SEQ ID NO: 926992 - RNA, 22 nt, Homo sapiens
acuggcacgcgacgaggacgca

SEQ ID NO: 926993 - RNA, 20 nt, Homo sapiens
acuggguuccucuccaagcu

SEQ ID NO: 926994 - RNA, 13 nt, Homo sapiens
acugguaaccaag

SEQ ID NO: 926995 - RNA, 20 nt, Homo sapiens
acugguaggaagagguacca

SEQ ID NO: 926996 - RNA, 17 nt, Homo sapiens
acuggucgagagccaaa

SEQ ID NO: 926997 - RNA, 23 nt, Homo sapiens
acuggucuccuaaccaaggugca

SEQ ID NO: 926998 - RNA, 17 nt, Homo sapiens
acugucugcauauccau

SEQ ID NO: 926999 - RNA, 21 nt, Homo sapiens
acugugcuggagccacuaacu

SEQ ID NO: 927000 - RNA, 13 nt, Homo sapiens
acuguucaugaau

SEQ ID NO: 927001 - RNA, 16 nt, Homo sapiens
acuguugagaaaaaag

SEQ ID NO: 927002 - RNA, 14 nt, Homo sapiens
acuguuugucuucu

SEQ ID NO: 927003 - RNA, 14 nt, Homo sapiens
acuuaaaauuacca

SEQ ID NO: 927004 - RNA, 14 nt, Homo sapiens
acuuacacaagacu

SEQ ID NO: 927005 - RNA, 15 nt, Homo sapiens
acuuacagugccaac

SEQ ID NO: 927006 - RNA, 21 nt, Homo sapiens
acuuacagugccaacauuuaa

SEQ ID NO: 927007 - RNA, 14 nt, Homo sapiens
acuuacuacaaucu

SEQ ID NO: 927008 - RNA, 20 nt, Homo sapiens
acuuaucugagucacuugaa

SEQ ID NO: 927009 - RNA, 21 nt, Homo sapiens
acuuauuauuccagaucugca

SEQ ID NO: 927010 - RNA, 15 nt, Homo sapiens
aauacggaacacugu

SEQ ID NO: 927011 - RNA, 18 nt, Homo sapiens
aauacggaacacugucaa

SEQ ID NO: 927012 - RNA, 12 nt, Homo sapiens
aauacuguacau

SEQ ID NO: 927013 - RNA, 15 nt, Homo sapiens
aauacuuaaugccaa

SEQ ID NO: 927014 - RNA, 14 nt, Homo sapiens
aauacuuugaacac

SEQ ID NO: 927015 - RNA, 18 nt, Homo sapiens
aauauauccugaaagcau

SEQ ID NO: 927016 - RNA, 15 nt, Homo sapiens
aauauauucaguaau

SEQ ID NO: 927017 - RNA, 19 nt, Homo sapiens
aauauauugaauaggcauu

SEQ ID NO: 927018 - RNA, 19 nt, Homo sapiens
aaucauagccaaaaacuuu

SEQ ID NO: 927019 - RNA, 21 nt, Homo sapiens
aaucauguuuuuaaaugcaua

SEQ ID NO: 927020 - RNA, 12 nt, Homo sapiens
aauccaguuuag

SEQ ID NO: 927021 - RNA, 22 nt, Homo sapiens
aauccccccagggcugggcacu

SEQ ID NO: 927022 - RNA, 23 nt, Homo sapiens
aauccuuucauaaagcaccagca

SEQ ID NO: 927023 - RNA, 21 nt, Homo sapiens
aaucucaucccaacaaacuuu

SEQ ID NO: 927024 - RNA, 22 nt, Homo sapiens
aaucugacaaagucaugaagcu

SEQ ID NO: 927025 - RNA, 13 nt, Homo sapiens
aaucugauuuaca

SEQ ID NO: 927026 - RNA, 18 nt, Homo sapiens
aaucugauuuacacuguu

SEQ ID NO: 927027 - RNA, 17 nt, Homo sapiens
aaucuguaauugcuuau

SEQ ID NO: 927028 - RNA, 20 nt, Homo sapiens
aaucuucaagguguaaaaua

SEQ ID NO: 927029 - RNA, 13 nt, Homo sapiens
aaucuuuuacugu

SEQ ID NO: 927030 - RNA, 12 nt, Homo sapiens
aaugaaacagac

SEQ ID NO: 927031 - RNA, 17 nt, Homo sapiens
aaugaaccaauaugaac

SEQ ID NO: 927032 - RNA, 13 nt, Homo sapiens
aaugaccugguga

SEQ ID NO: 927033 - RNA, 20 nt, Homo sapiens
aaugacugcgcagaguggau

SEQ ID NO: 927034 - RNA, 18 nt, Homo sapiens
aaugagagaguguggaaa

SEQ ID NO: 927035 - RNA, 15 nt, Homo sapiens
aaugauacugugaga

SEQ ID NO: 927036 - RNA, 15 nt, Homo sapiens
aaugcuauuugccaa

SEQ ID NO: 927037 - RNA, 23 nt, Homo sapiens
aauggaauuuuuuacccauacaa

SEQ ID NO: 927038 - RNA, 23 nt, Homo sapiens
aauggcucacuauggugccaaug

SEQ ID NO: 927039 - RNA, 13 nt, Homo sapiens
aaugguuacucau

SEQ ID NO: 927040 - RNA, 20 nt, Homo sapiens
aaugguuuguuuucuacauu

SEQ ID NO: 927041 - RNA, 22 nt, Homo sapiens
aaugguuuguuuucuacauuga

SEQ ID NO: 927042 - RNA, 19 nt, Homo sapiens
aauguacauuuaauugcaa

SEQ ID NO: 927043 - RNA, 15 nt, Homo sapiens
aauguuaaaugcaau

SEQ ID NO: 927044 - RNA, 16 nt, Homo sapiens
aauguuuuucaaugug

SEQ ID NO: 927045 - RNA, 18 nt, Homo sapiens
aauuaauuugaccaucuc

SEQ ID NO: 927046 - RNA, 14 nt, Homo sapiens
aauuacaugggauc

SEQ ID NO: 927047 - RNA, 19 nt, Homo sapiens
aauuaucccuuacagacuu

SEQ ID NO: 927048 - RNA, 15 nt, Homo sapiens
aauucauuccauuug

SEQ ID NO: 927049 - RNA, 21 nt, Homo sapiens
aauucccuguuauaauuugca

SEQ ID NO: 927050 - RNA, 18 nt, Homo sapiens
aauucuucuucucaagca

SEQ ID NO: 927051 - RNA, 20 nt, Homo sapiens
aauugauugaacguucucaa

SEQ ID NO: 927052 - RNA, 17 nt, Homo sapiens
aauugggcaacuauuca

SEQ ID NO: 927053 - RNA, 23 nt, Homo sapiens
aauugguagaaaaauaucuuuaa

SEQ ID NO: 927054 - RNA, 18 nt, Homo sapiens
aauugguuaaucacuuaa

SEQ ID NO: 927055 - RNA, 15 nt, Homo sapiens
aauuguugcuuuuac

SEQ ID NO: 927056 - RNA, 20 nt, Homo sapiens
aauuugaccaucucucuuau

SEQ ID NO: 927057 - RNA, 18 nt, Homo sapiens
aauuuggucgugguauaa

SEQ ID NO: 927058 - RNA, 17 nt, Homo sapiens
aauuuguagacauacuu

SEQ ID NO: 927059 - RNA, 18 nt, Homo sapiens
aauuuuauugcuggaauc

SEQ ID NO: 927060 - RNA, 22 nt, Homo sapiens
acaaaacaaaauguuaugauaa

SEQ ID NO: 927061 - RNA, 17 nt, Homo sapiens
acaaaaccaagccuugg

SEQ ID NO: 927062 - RNA, 16 nt, Homo sapiens
acaaaaggaaaccucu

SEQ ID NO: 927063 - RNA, 16 nt, Homo sapiens
acaaaccacuguacau

SEQ ID NO: 927064 - RNA, 16 nt, Homo sapiens
acaaaccuuauaaguc

SEQ ID NO: 927065 - RNA, 14 nt, Homo sapiens
acaaagaaguguau

SEQ ID NO: 927066 - RNA, 18 nt, Homo sapiens
acaaauguuuuaaacuca

SEQ ID NO: 927067 - RNA, 17 nt, Homo sapiens
acaacaucuguuacauu

SEQ ID NO: 927068 - RNA, 20 nt, Homo sapiens
acaaccuagggugccuuaaa

SEQ ID NO: 927069 - RNA, 12 nt, Homo sapiens
acaacgcugcug

SEQ ID NO: 927070 - RNA, 14 nt, Homo sapiens
acaagaauugcuaa

SEQ ID NO: 927071 - RNA, 15 nt, Homo sapiens
acaagagucuguauu

SEQ ID NO: 927072 - RNA, 19 nt, Homo sapiens
acaagcagucuuuuucuac

SEQ ID NO: 927073 - RNA, 23 nt, Homo sapiens
acaagcugaaaccccaucuccac

SEQ ID NO: 927074 - RNA, 17 nt, Homo sapiens
acaagugcucaguucca

SEQ ID NO: 927075 - RNA, 12 nt, Homo sapiens
acaagugucuaa

SEQ ID NO: 927076 - RNA, 16 nt, Homo sapiens
acaauucacaucccca

SEQ ID NO: 927077 - RNA, 21 nt, Homo sapiens
acaauucacauccccaaaggu

SEQ ID NO: 927078 - RNA, 15 nt, Homo sapiens
acaauuguauuccca

SEQ ID NO: 927079 - RNA, 18 nt, Homo sapiens
acaauuuucuaccacugg

SEQ ID NO: 927080 - RNA, 16 nt, Homo sapiens
acacaaccauagccug

SEQ ID NO: 927081 - RNA, 17 nt, Homo sapiens
acacaacuccacugucu

SEQ ID NO: 927082 - RNA, 15 nt, Homo sapiens
acacacacuagccuu

SEQ ID NO: 927083 - RNA, 14 nt, Homo sapiens
acacauggcuuccu

SEQ ID NO: 927084 - RNA, 22 nt, Homo sapiens
acaccagcuguucugucccuug

SEQ ID NO: 927085 - RNA, 13 nt, Homo sapiens
acacuagucugug

SEQ ID NO: 927086 - RNA, 17 nt, Homo sapiens
acacuaucaacacugca

SEQ ID NO: 927087 - RNA, 17 nt, Homo sapiens
acacugucaauggacug

SEQ ID NO: 927088 - RNA, 21 nt, Homo sapiens
acacugucaauggacugcacc

SEQ ID NO: 927089 - RNA, 23 nt, Homo sapiens
acacuuauuuucuaaccaaauac

SEQ ID NO: 927090 - RNA, 19 nt, Homo sapiens
acagaacugcuaaauacug

SEQ ID NO: 927091 - RNA, 22 nt, Homo sapiens
acagaacugcuaaauacuguac

SEQ ID NO: 927092 - RNA, 24 nt, Homo sapiens
acagaacugcuaaauacuguacau

SEQ ID NO: 927093 - RNA, 23 nt, Homo sapiens
acagagaaaagcuuggaaagcca

SEQ ID NO: 927094 - RNA, 15 nt, Homo sapiens
acagagggauuuauu

SEQ ID NO: 927095 - RNA, 15 nt, Homo sapiens
acagauuguucucaa

SEQ ID NO: 927096 - RNA, 15 nt, Homo sapiens
acagcagcaaugcaa

SEQ ID NO: 927097 - RNA, 22 nt, Homo sapiens
acagcccuggaggccgcugcug

SEQ ID NO: 927098 - RNA, 14 nt, Homo sapiens
acagcuauuucuca

SEQ ID NO: 927099 - RNA, 22 nt, Homo sapiens
acaggaacugugagagucuuug

SEQ ID NO: 927100 - RNA, 18 nt, Homo sapiens
acaggacuucugugcauu

SEQ ID NO: 927101 - RNA, 18 nt, Homo sapiens
acaggaguuugugugcaa

SEQ ID NO: 927102 - RNA, 16 nt, Homo sapiens
acaggcaccacugcuu

SEQ ID NO: 927103 - RNA, 20 nt, Homo sapiens
acaggggcuggugggcacca

SEQ ID NO: 927104 - RNA, 19 nt, Homo sapiens
acagguaaacagaaauccu

SEQ ID NO: 927105 - RNA, 19 nt, Homo sapiens
acaggucugggagaggcag

SEQ ID NO: 927106 - RNA, 16 nt, Homo sapiens
aacacaaccauagccu

SEQ ID NO: 927107 - RNA, 18 nt, Homo sapiens
aacacagucuggcaguug

SEQ ID NO: 927108 - RNA, 17 nt, Homo sapiens
aacacauggcuuccuaa

SEQ ID NO: 927109 - RNA, 20 nt, Homo sapiens
aacaccacgacuucugccca

SEQ ID NO: 927110 - RNA, 16 nt, Homo sapiens
aacacugcagcauuuu

SEQ ID NO: 927111 - RNA, 20 nt, Homo sapiens
aacacugucaauggacugca

SEQ ID NO: 927112 - RNA, 18 nt, Homo sapiens
aacagaaauuguauauug

SEQ ID NO: 927113 - RNA, 13 nt, Homo sapiens
aacagauucucca

SEQ ID NO: 927114 - RNA, 17 nt, Homo sapiens
aacaggacuugaauuca

SEQ ID NO: 927115 - RNA, 18 nt, Homo sapiens
aacagggaugcuaucucg

SEQ ID NO: 927116 - RNA, 18 nt, Homo sapiens
aacauaguagauugacau

SEQ ID NO: 927117 - RNA, 14 nt, Homo sapiens
aacaugcuaccuga

SEQ ID NO: 927118 - RNA, 15 nt, Homo sapiens
aacaugcuuaagggg

SEQ ID NO: 927119 - RNA, 16 nt, Homo sapiens
aacauggaaaaauccu

SEQ ID NO: 927120 - RNA, 14 nt, Homo sapiens
aacauuuacuuuug

SEQ ID NO: 927121 - RNA, 19 nt, Homo sapiens
aaccaaagggggacaguga

SEQ ID NO: 927122 - RNA, 20 nt, Homo sapiens
aaccaauaauguagcaguuc

SEQ ID NO: 927123 - RNA, 19 nt, Homo sapiens
aaccacccuaucaucaguu

SEQ ID NO: 927124 - RNA, 23 nt, Homo sapiens
aaccacgccucuugaccaggcug

SEQ ID NO: 927125 - RNA, 13 nt, Homo sapiens
aaccacuguacau

SEQ ID NO: 927126 - RNA, 12 nt, Homo sapiens
aaccaguucucu

SEQ ID NO: 927127 - RNA, 16 nt, Homo sapiens
aacccaggagcaucca

SEQ ID NO: 927128 - RNA, 21 nt, Homo sapiens
aacccugagggacuuggcagu

SEQ ID NO: 927129 - RNA, 18 nt, Homo sapiens
aaccgaugguccucacaa

SEQ ID NO: 927130 - RNA, 21 nt, Homo sapiens
aaccgaugguccucacaagcc

SEQ ID NO: 927131 - RNA, 21 nt, Homo sapiens
aaccuacuuguaaacuugaaa

SEQ ID NO: 927132 - RNA, 18 nt, Homo sapiens
aaccuagggugccuuaaa

SEQ ID NO: 927133 - RNA, 18 nt, Homo sapiens
aaccuugugugaguguga

SEQ ID NO: 927134 - RNA, 16 nt, Homo sapiens
aaccuuuuuauuuuca

SEQ ID NO: 927135 - RNA, 22 nt, Homo sapiens
aacgccuguaggaagaaaaagg

SEQ ID NO: 927136 - RNA, 23 nt, Homo sapiens
aacguuaucucauugcaaaaaua

SEQ ID NO: 927137 - RNA, 18 nt, Homo sapiens
aacuacagcuauaccuca

SEQ ID NO: 927138 - RNA, 20 nt, Homo sapiens
aacuacuauuuuucuuucca

SEQ ID NO: 927139 - RNA, 22 nt, Homo sapiens
aacucauuucaaguuaugauuc

SEQ ID NO: 927140 - RNA, 20 nt, Homo sapiens
aacuccaccuauuuugcaaa

SEQ ID NO: 927141 - RNA, 18 nt, Homo sapiens
aacuccuggagauuucag

SEQ ID NO: 927142 - RNA, 22 nt, Homo sapiens
aacucugggcacuuuugaacuc

SEQ ID NO: 927143 - RNA, 23 nt, Homo sapiens
aacucugggcacuuuugaacuca

SEQ ID NO: 927144 - RNA, 21 nt, Homo sapiens
aacugaauucugaacuuuuca

SEQ ID NO: 927145 - RNA, 13 nt, Homo sapiens
aacugaugaagga

SEQ ID NO: 927146 - RNA, 22 nt, Homo sapiens
aacugcccugucuaggucagua

SEQ ID NO: 927147 - RNA, 20 nt, Homo sapiens
aacuggcuucugcuugucau

SEQ ID NO: 927148 - RNA, 17 nt, Homo sapiens
aacuguaacugcauuag

SEQ ID NO: 927149 - RNA, 13 nt, Homo sapiens
aacuuagagucau

SEQ ID NO: 927150 - RNA, 13 nt, Homo sapiens
aacuucauauuaa

SEQ ID NO: 927151 - RNA, 22 nt, Homo sapiens
aacuuccucuuaggauguuuca

SEQ ID NO: 927152 - RNA, 18 nt, Homo sapiens
aacuugugcuuuugcaaa

SEQ ID NO: 927153 - RNA, 16 nt, Homo sapiens
aacuuuccagcaguau

SEQ ID NO: 927154 - RNA, 23 nt, Homo sapiens
aagaaauugauugaacguucuca

SEQ ID NO: 927155 - RNA, 21 nt, Homo sapiens
aagaacauugauuucauugaa

SEQ ID NO: 927156 - RNA, 22 nt, Homo sapiens
aagaauauaaugggaaguguac

SEQ ID NO: 927157 - RNA, 17 nt, Homo sapiens
aagaauuucaauaucaa

SEQ ID NO: 927158 - RNA, 16 nt, Homo sapiens
aagagagaugauacug

SEQ ID NO: 927159 - RNA, 14 nt, Homo sapiens
aagagggaccucca

SEQ ID NO: 927160 - RNA, 15 nt, Homo sapiens
aagagguuuucacaa

SEQ ID NO: 927161 - RNA, 20 nt, Homo sapiens
aagagucacaauuugcaaau

SEQ ID NO: 927162 - RNA, 14 nt, Homo sapiens
aagauccuacccca

SEQ ID NO: 927163 - RNA, 17 nt, Homo sapiens
aagaugucuucuguuca

SEQ ID NO: 927164 - RNA, 19 nt, Homo sapiens
aagauuccuuuccacucca

SEQ ID NO: 927165 - RNA, 20 nt, Homo sapiens
aagauuccuuuccacuccaa

SEQ ID NO: 927166 - RNA, 14 nt, Homo sapiens
aagauuuuaccugg

SEQ ID NO: 927167 - RNA, 19 nt, Homo sapiens
aagcaaauauguuugcauu

SEQ ID NO: 927168 - RNA, 14 nt, Homo sapiens
aagcagaucuuuag

SEQ ID NO: 927169 - RNA, 20 nt, Homo sapiens
aagcaguggccuuauugcau

SEQ ID NO: 927170 - RNA, 15 nt, Homo sapiens
aagcaucagacuggu

SEQ ID NO: 927171 - RNA, 23 nt, Homo sapiens
aagccagcauuuccucagucucc

SEQ ID NO: 927172 - RNA, 19 nt, Homo sapiens
aagccgccuagugcagaga

SEQ ID NO: 927173 - RNA, 21 nt, Homo sapiens
aagccucagcaacagccagug

SEQ ID NO: 927174 - RNA, 15 nt, Homo sapiens
aagccuugcccagca

SEQ ID NO: 927175 - RNA, 23 nt, Homo sapiens
aagcuaaaaugaaaaauagugug

SEQ ID NO: 927176 - RNA, 17 nt, Homo sapiens
aagcucuucuccucagc

SEQ ID NO: 927177 - RNA, 17 nt, Homo sapiens
aagcuguuuugagccag

SEQ ID NO: 927178 - RNA, 18 nt, Homo sapiens
aagcuuucaaauccuccc

SEQ ID NO: 927179 - RNA, 13 nt, Homo sapiens
aaggaaaucuccu

SEQ ID NO: 927180 - RNA, 19 nt, Homo sapiens
aaggaacaagaauugcuaa

SEQ ID NO: 927181 - RNA, 14 nt, Homo sapiens
aaggaccagugaga

SEQ ID NO: 927182 - RNA, 17 nt, Homo sapiens
aaggacucagauuguau

SEQ ID NO: 927183 - RNA, 12 nt, Homo sapiens
aaggacugaccu

SEQ ID NO: 927184 - RNA, 22 nt, Homo sapiens
aaggcaaggggugccugggaac

SEQ ID NO: 927185 - RNA, 20 nt, Homo sapiens
aaggcagagcgcaaagugcu

SEQ ID NO: 927186 - RNA, 22 nt, Homo sapiens
aaggccguguccccuuguucua

SEQ ID NO: 927187 - RNA, 18 nt, Homo sapiens
aaggcgauguggugaccc

SEQ ID NO: 927188 - RNA, 17 nt, Homo sapiens
aaggcuguuaaauuaca

SEQ ID NO: 927189 - RNA, 16 nt, Homo sapiens
aagggccgacuaagag

SEQ ID NO: 927190 - RNA, 21 nt, Homo sapiens
aaggucacuuugcguguguca

SEQ ID NO: 927191 - RNA, 15 nt, Homo sapiens
aagguuaagauauca

SEQ ID NO: 927192 - RNA, 14 nt, Homo sapiens
aaguaaacugcccu

SEQ ID NO: 927193 - RNA, 17 nt, Homo sapiens
aaguacucagauuugau

SEQ ID NO: 927194 - RNA, 18 nt, Homo sapiens
aaguacugcaaaaugcuu

SEQ ID NO: 927195 - RNA, 19 nt, Homo sapiens
aaguauggcagugggagac

SEQ ID NO: 927196 - RNA, 22 nt, Homo sapiens
aagucaaauauguagauugccu

SEQ ID NO: 927197 - RNA, 22 nt, Homo sapiens
aagucagcuuuacuagugccaa

SEQ ID NO: 927198 - RNA, 17 nt, Homo sapiens
aagucaugaagcucagu

SEQ ID NO: 927199 - RNA, 19 nt, Homo sapiens
aagucauucaagagucuca

SEQ ID NO: 927200 - RNA, 20 nt, Homo sapiens
cuccucccaaaauacuacac

SEQ ID NO: 927201 - RNA, 22 nt, Homo sapiens
cuccuccccuccccucacuucu

SEQ ID NO: 927202 - RNA, 22 nt, Homo sapiens
cuccucucugcuggguuuccac

SEQ ID NO: 927203 - RNA, 20 nt, Homo sapiens
cuccugaguagcugagacua

SEQ ID NO: 927204 - RNA, 15 nt, Homo sapiens
cuccugggagacaaa

SEQ ID NO: 927205 - RNA, 22 nt, Homo sapiens
cuccuguguggaguuauucacu

SEQ ID NO: 927206 - RNA, 17 nt, Homo sapiens
cuccuucuccauaaagc

SEQ ID NO: 927207 - RNA, 18 nt, Homo sapiens
cuccuugucuuaaucguc

SEQ ID NO: 927208 - RNA, 13 nt, Homo sapiens
cuccuugugagug

SEQ ID NO: 927209 - RNA, 18 nt, Homo sapiens
cuccuuucccaacacuuc

SEQ ID NO: 927210 - RNA, 16 nt, Homo sapiens
cuccuuuuaugcucac

SEQ ID NO: 927211 - RNA, 14 nt, Homo sapiens
cucgaaucacucau

SEQ ID NO: 927212 - RNA, 13 nt, Homo sapiens
cucgcuggaccaa

SEQ ID NO: 927213 - RNA, 21 nt, Homo sapiens
cucgcuggugaagacccagag

SEQ ID NO: 927214 - RNA, 12 nt, Homo sapiens
cucggcacgugg

SEQ ID NO: 927215 - RNA, 12 nt, Homo sapiens
cucuaaacacac

SEQ ID NO: 927216 - RNA, 17 nt, Homo sapiens
cucuacugcuucaggaa

SEQ ID NO: 927217 - RNA, 20 nt, Homo sapiens
cucuauggguaucaaacagc

SEQ ID NO: 927218 - RNA, 18 nt, Homo sapiens
cucucacccccacacugg

SEQ ID NO: 927219 - RNA, 16 nt, Homo sapiens
cucuccccaaauugcc

SEQ ID NO: 927220 - RNA, 21 nt, Homo sapiens
cucugaaauuggguuccauau

SEQ ID NO: 927221 - RNA, 22 nt, Homo sapiens
cucugauuucacauauugcaac

SEQ ID NO: 927222 - RNA, 15 nt, Homo sapiens
cucugcuccacagaa

SEQ ID NO: 927223 - RNA, 21 nt, Homo sapiens
acccaacagagaccagcuucu

SEQ ID NO: 927224 - RNA, 16 nt, Homo sapiens
acccacaagugucuaa

SEQ ID NO: 927225 - RNA, 17 nt, Homo sapiens
acccacccuaccacagu

SEQ ID NO: 927226 - RNA, 14 nt, Homo sapiens
acccagcauguaca

SEQ ID NO: 927227 - RNA, 16 nt, Homo sapiens
acccagcauguacaaa

SEQ ID NO: 927228 - RNA, 23 nt, Homo sapiens
acccaugcacagaacaagccaca

SEQ ID NO: 927229 - RNA, 16 nt, Homo sapiens
accccaaccccaggga

SEQ ID NO: 927230 - RNA, 15 nt, Homo sapiens
accccaccacaaaaa

SEQ ID NO: 927231 - RNA, 14 nt, Homo sapiens
accccagggacugc

SEQ ID NO: 927232 - RNA, 23 nt, Homo sapiens
accccuccucccuuuuuccuugu

SEQ ID NO: 927233 - RNA, 21 nt, Homo sapiens
accccuugcucucaacccagg

SEQ ID NO: 927234 - RNA, 17 nt, Homo sapiens
acccucacgaggugucu

SEQ ID NO: 927235 - RNA, 22 nt, Homo sapiens
acccucagcuggcggaaccugg

SEQ ID NO: 927236 - RNA, 21 nt, Homo sapiens
acccuccaggccucaguuucu

SEQ ID NO: 927237 - RNA, 22 nt, Homo sapiens
acccuuucuucaauacaaaaag

SEQ ID NO: 927238 - RNA, 20 nt, Homo sapiens
accggaggcaaaaggcagug

SEQ ID NO: 927239 - RNA, 18 nt, Homo sapiens
accgugggucaugcagcg

SEQ ID NO: 927240 - RNA, 21 nt, Homo sapiens
accuacaccaacugcucucaa

SEQ ID NO: 927241 - RNA, 17 nt, Homo sapiens
accuagcgucaguauuu

SEQ ID NO: 927242 - RNA, 22 nt, Homo sapiens
accuaguacuuuauuaguuuaa

SEQ ID NO: 927243 - RNA, 20 nt, Homo sapiens
accucagccucccaaaaugc

SEQ ID NO: 927244 - RNA, 17 nt, Homo sapiens
accucucacacuggcuc

SEQ ID NO: 927245 - RNA, 11 nt, Homo sapiens
accugagcuuu

SEQ ID NO: 927246 - RNA, 18 nt, Homo sapiens
accuggaauuguggggca

SEQ ID NO: 927247 - RNA, 16 nt, Homo sapiens
accugucccaccucaa

SEQ ID NO: 927248 - RNA, 12 nt, Homo sapiens
accugugaauca

SEQ ID NO: 927249 - RNA, 12 nt, Homo sapiens
accuucaaagcu

SEQ ID NO: 927250 - RNA, 23 nt, Homo sapiens
accuucuaauccaugugcugcug

SEQ ID NO: 927251 - RNA, 20 nt, Homo sapiens
accuucucuuuuauaaucug

SEQ ID NO: 927252 - RNA, 13 nt, Homo sapiens
accuucuuccaca

SEQ ID NO: 927253 - RNA, 16 nt, Homo sapiens
accuucuuccacagca

SEQ ID NO: 927254 - RNA, 22 nt, Homo sapiens
accuugaggagucuugugugca

SEQ ID NO: 927255 - RNA, 22 nt, Homo sapiens
accuugugaaggaaaaacaugc

SEQ ID NO: 927256 - RNA, 23 nt, Homo sapiens
accuuuuuuuuacggaauuccaa

SEQ ID NO: 927257 - RNA, 11 nt, Homo sapiens
acgaaacugcu

SEQ ID NO: 927258 - RNA, 14 nt, Homo sapiens
acgacuucugccca

SEQ ID NO: 927259 - RNA, 20 nt, Homo sapiens
acgacuucugcccauucucu

SEQ ID NO: 927260 - RNA, 20 nt, Homo sapiens
acggaaaugcaguacuguaa

SEQ ID NO: 927261 - RNA, 14 nt, Homo sapiens
acggaauuccaaua

SEQ ID NO: 927262 - RNA, 19 nt, Homo sapiens
acggcagccucaaccuccc

SEQ ID NO: 927263 - RNA, 16 nt, Homo sapiens
acguaaauccuggcca

SEQ ID NO: 927264 - RNA, 15 nt, Homo sapiens
acguguaacuugugc

SEQ ID NO: 927265 - RNA, 18 nt, Homo sapiens
acguucuggaacauucug

SEQ ID NO: 927266 - RNA, 21 nt, Homo sapiens
acguucuggaacauucuguca

SEQ ID NO: 927267 - RNA, 15 nt, Homo sapiens
acguuuguuccccac

SEQ ID NO: 927268 - RNA, 13 nt, Homo sapiens
acuaaagugucau

SEQ ID NO: 927269 - RNA, 17 nt, Homo sapiens
acuaaagugucauccac

SEQ ID NO: 927270 - RNA, 22 nt, Homo sapiens
acuaauuguaagguauugcaag

SEQ ID NO: 927271 - RNA, 17 nt, Homo sapiens
acuacagcuauaccuca

SEQ ID NO: 927272 - RNA, 18 nt, Homo sapiens
acuaucaacacugcagca

SEQ ID NO: 927273 - RNA, 14 nt, Homo sapiens
acuauuccauugac

SEQ ID NO: 927274 - RNA, 19 nt, Homo sapiens
acuauuuaguggaaccuug

SEQ ID NO: 927275 - RNA, 20 nt, Homo sapiens
acucagcuauaccucauuca

SEQ ID NO: 927276 - RNA, 21 nt, Homo sapiens
acucagcuauaccucauucac

SEQ ID NO: 927277 - RNA, 12 nt, Homo sapiens
acucccaaagag

SEQ ID NO: 927278 - RNA, 16 nt, Homo sapiens
acucgcuucucuguga

SEQ ID NO: 927279 - RNA, 13 nt, Homo sapiens
acucuccugccuc

SEQ ID NO: 927280 - RNA, 23 nt, Homo sapiens
acucuggcuccuucuccauaaag

SEQ ID NO: 927281 - RNA, 18 nt, Homo sapiens
acucuuccuggaaugcau

SEQ ID NO: 927282 - RNA, 21 nt, Homo sapiens
acucuugcugcacuuauguaa

SEQ ID NO: 927283 - RNA, 15 nt, Homo sapiens
acugaagacagaggu

SEQ ID NO: 927284 - RNA, 21 nt, Homo sapiens
acugacacugcgaacucucag

SEQ ID NO: 927285 - RNA, 15 nt, Homo sapiens
acugagaagcaauca

SEQ ID NO: 927286 - RNA, 23 nt, Homo sapiens
acugcaaccuccaccucccaggu

SEQ ID NO: 927287 - RNA, 20 nt, Homo sapiens
acugcacuccagccugggug

SEQ ID NO: 927288 - RNA, 16 nt, Homo sapiens
acugcagcauuuugcu

SEQ ID NO: 927289 - RNA, 22 nt, Homo sapiens
acugcagguugugcccuguggc

SEQ ID NO: 927290 - RNA, 20 nt, Homo sapiens
acugcagucaccccugucug

SEQ ID NO: 927291 - RNA, 21 nt, Homo sapiens
acugcauuagaaaccaugaaa

SEQ ID NO: 927292 - RNA, 22 nt, Homo sapiens
acuggaaaaguguuccuugcuc

SEQ ID NO: 927293 - RNA, 18 nt, Homo sapiens
acuggcauagcuggacau

SEQ ID NO: 927294 - RNA, 17 nt, Homo sapiens
acuggccuagagccuca

SEQ ID NO: 927295 - RNA, 19 nt, Homo sapiens
acuggcuucugcuugucau

SEQ ID NO: 927296 - RNA, 16 nt, Homo sapiens
acuguacauagaugua

SEQ ID NO: 927297 - RNA, 19 nt, Homo sapiens
acugucuuuaaaagucauu

SEQ ID NO: 927298 - RNA, 22 nt, Homo sapiens
acugucuuuaaaagucauucaa

SEQ ID NO: 927299 - RNA, 16 nt, Homo sapiens
acuguggcucuugccu

SEQ ID NO: 927300 - RNA, 18 nt, Homo sapiens
acuuaacuacuuaucucu

SEQ ID NO: 927301 - RNA, 20 nt, Homo sapiens
acuuauuauuccagaucugc

SEQ ID NO: 927302 - RNA, 17 nt, Homo sapiens
acuucauauuaauauaa

SEQ ID NO: 927303 - RNA, 18 nt, Homo sapiens
acuuccaguauccugaaa

SEQ ID NO: 927304 - RNA, 17 nt, Homo sapiens
acuugaaagugaacaau

SEQ ID NO: 927305 - RNA, 20 nt, Homo sapiens
acuugaaagugaacaaucag

SEQ ID NO: 927306 - RNA, 24 nt, Homo sapiens
acuugacaagucaggagacacugu

SEQ ID NO: 927307 - RNA, 18 nt, Homo sapiens
acuugcaagucccaugau

SEQ ID NO: 927308 - RNA, 17 nt, Homo sapiens
acuugcggauuuccacc

SEQ ID NO: 927309 - RNA, 14 nt, Homo sapiens
acuugggugaaaag

SEQ ID NO: 927310 - RNA, 16 nt, Homo sapiens
acuuguaaacuugaaa

SEQ ID NO: 927311 - RNA, 22 nt, Homo sapiens
acuuguaaacuugaaagcaaga

SEQ ID NO: 927312 - RNA, 16 nt, Homo sapiens
acuugugaacaugccu

SEQ ID NO: 927313 - RNA, 15 nt, Homo sapiens
acuuuauuaguuuaa

SEQ ID NO: 927314 - RNA, 16 nt, Homo sapiens
acuuuguggauuugau

SEQ ID NO: 927315 - RNA, 19 nt, Homo sapiens
acuuuugcuuucuaccuga

SEQ ID NO: 927316 - RNA, 15 nt, Homo sapiens
agaaaaacaugucau

SEQ ID NO: 927317 - RNA, 18 nt, Homo sapiens
agaaaaauagugaagacu

SEQ ID NO: 927318 - RNA, 16 nt, Homo sapiens
agaaaagccugaaacu

SEQ ID NO: 927319 - RNA, 22 nt, Homo sapiens
agaaaaggagcauccuuaccuc

SEQ ID NO: 927320 - RNA, 16 nt, Homo sapiens
agaaacaaaagugcau

SEQ ID NO: 927321 - RNA, 14 nt, Homo sapiens
cuucacacuaucaa

SEQ ID NO: 927322 - RNA, 23 nt, Homo sapiens
cuucaggguccugagauuuacac

SEQ ID NO: 927323 - RNA, 21 nt, Homo sapiens
cuucaucgcaguggacugugu

SEQ ID NO: 927324 - RNA, 15 nt, Homo sapiens
cuucccagagaacuu

SEQ ID NO: 927325 - RNA, 13 nt, Homo sapiens
cuucccuuugauu

SEQ ID NO: 927326 - RNA, 19 nt, Homo sapiens
cuuccugcccuaacucugc

SEQ ID NO: 927327 - RNA, 16 nt, Homo sapiens
cuuccugugccuguga

SEQ ID NO: 927328 - RNA, 22 nt, Homo sapiens
cuucgugugcagcuagagcuuu

SEQ ID NO: 927329 - RNA, 23 nt, Homo sapiens
cuucuccacaaccuccuccucca

SEQ ID NO: 927330 - RNA, 21 nt, Homo sapiens
cuucucugucucaugugugcu

SEQ ID NO: 927331 - RNA, 15 nt, Homo sapiens
cuucugaagauggaa

SEQ ID NO: 927332 - RNA, 13 nt, Homo sapiens
cuucugaagguaa

SEQ ID NO: 927333 - RNA, 22 nt, Homo sapiens
cuucugugcauuguaaacauaa

SEQ ID NO: 927334 - RNA, 19 nt, Homo sapiens
cuucugugcccagcucagu

SEQ ID NO: 927335 - RNA, 18 nt, Homo sapiens
cuucuuucuacaguauua

SEQ ID NO: 927336 - RNA, 16 nt, Homo sapiens
cuugaaagugaacaau

SEQ ID NO: 927337 - RNA, 18 nt, Homo sapiens
cuugaacuccuagacuca

SEQ ID NO: 927338 - RNA, 20 nt, Homo sapiens
cuugaagugaacaaauuuca

SEQ ID NO: 927339 - RNA, 19 nt, Homo sapiens
cuugagaccuggaaccaga

SEQ ID NO: 927340 - RNA, 23 nt, Homo sapiens
cuugccauuuucaagaaagcauu

SEQ ID NO: 927341 - RNA, 14 nt, Homo sapiens
cuugcggauuucca

SEQ ID NO: 927342 - RNA, 14 nt, Homo sapiens
cuuggacuuuauga

SEQ ID NO: 927343 - RNA, 13 nt, Homo sapiens
cuuggccucccaa

SEQ ID NO: 927344 - RNA, 13 nt, Homo sapiens
cuugggugaaaag

SEQ ID NO: 927345 - RNA, 12 nt, Homo sapiens
cuuggugccaca

SEQ ID NO: 927346 - RNA, 21 nt, Homo sapiens
agacguuccauacccccacau

SEQ ID NO: 927347 - RNA, 18 nt, Homo sapiens
agacuacacaagaggaaa

SEQ ID NO: 927348 - RNA, 17 nt, Homo sapiens
agacuauuuaguggaac

SEQ ID NO: 927349 - RNA, 22 nt, Homo sapiens
agacuccccugccuccccaggg

SEQ ID NO: 927350 - RNA, 21 nt, Homo sapiens
agacucuguccuuccaugcaa

SEQ ID NO: 927351 - RNA, 18 nt, Homo sapiens
agacuggaacacaaccau

SEQ ID NO: 927352 - RNA, 18 nt, Homo sapiens
agacuuagccccaugagu

SEQ ID NO: 927353 - RNA, 18 nt, Homo sapiens
agacuugaacauuugcag

SEQ ID NO: 927354 - RNA, 15 nt, Homo sapiens
agagaagcugugucu

SEQ ID NO: 927355 - RNA, 16 nt, Homo sapiens
agagaauguguguaga

SEQ ID NO: 927356 - RNA, 11 nt, Homo sapiens
agagagccugc

SEQ ID NO: 927357 - RNA, 13 nt, Homo sapiens
agagaugauacug

SEQ ID NO: 927358 - RNA, 14 nt, Homo sapiens
agagaugauacuga

SEQ ID NO: 927359 - RNA, 17 nt, Homo sapiens
agagcagugagcagggu

SEQ ID NO: 927360 - RNA, 17 nt, Homo sapiens
agagcauaucuguuaua

SEQ ID NO: 927361 - RNA, 20 nt, Homo sapiens
agaggaaaaaggcuucucca

SEQ ID NO: 927362 - RNA, 11 nt, Homo sapiens
agaggcccaag

SEQ ID NO: 927363 - RNA, 16 nt, Homo sapiens
agagggcaaagcugau

SEQ ID NO: 927364 - RNA, 13 nt, Homo sapiens
agagguaccacag

SEQ ID NO: 927365 - RNA, 13 nt, Homo sapiens
agagguccugcca

SEQ ID NO: 927366 - RNA, 14 nt, Homo sapiens
agagguuuucacaa

SEQ ID NO: 927367 - RNA, 18 nt, Homo sapiens
agagucacaauuugcaaa

SEQ ID NO: 927368 - RNA, 20 nt, Homo sapiens
agaguguggaaaaaaaaaga

SEQ ID NO: 927369 - RNA, 15 nt, Homo sapiens
agauacuugugaaca

SEQ ID NO: 927370 - RNA, 19 nt, Homo sapiens
agauaggauauacuguaug

SEQ ID NO: 927371 - RNA, 14 nt, Homo sapiens
agauaggauggaac

SEQ ID NO: 927372 - RNA, 20 nt, Homo sapiens
agauauuguuuggaucaaaa

SEQ ID NO: 927373 - RNA, 13 nt, Homo sapiens
agaucaaaacagu

SEQ ID NO: 927374 - RNA, 17 nt, Homo sapiens
agaucuguaauucacua

SEQ ID NO: 927375 - RNA, 20 nt, Homo sapiens
agaugauccacaacuugaga

SEQ ID NO: 927376 - RNA, 16 nt, Homo sapiens
agaugccagagcaaag

SEQ ID NO: 927377 - RNA, 21 nt, Homo sapiens
agauguagcaaauuccaauac

SEQ ID NO: 927378 - RNA, 22 nt, Homo sapiens
agauguauuaaccuaccuguga

SEQ ID NO: 927379 - RNA, 19 nt, Homo sapiens
agauguuccauccuguaca

SEQ ID NO: 927380 - RNA, 17 nt, Homo sapiens
agauuaaacugagugaa

SEQ ID NO: 927381 - RNA, 16 nt, Homo sapiens
agauuaacacacugaa

SEQ ID NO: 927382 - RNA, 21 nt, Homo sapiens
agauuacaggugugagccacu

SEQ ID NO: 927383 - RNA, 16 nt, Homo sapiens
agauuagaaagacuuu

SEQ ID NO: 927384 - RNA, 19 nt, Homo sapiens
agauuccauuuuauaucca

SEQ ID NO: 927385 - RNA, 23 nt, Homo sapiens
agauuccuuuccacuccaaccag

SEQ ID NO: 927386 - RNA, 12 nt, Homo sapiens
agauuguucuca

SEQ ID NO: 927387 - RNA, 12 nt, Homo sapiens
agcaaaaccaaa

SEQ ID NO: 927388 - RNA, 12 nt, Homo sapiens
agcaaaugagau

SEQ ID NO: 927389 - RNA, 16 nt, Homo sapiens
agcaacagccagugga

SEQ ID NO: 927390 - RNA, 15 nt, Homo sapiens
agcaauucauucucu

SEQ ID NO: 927391 - RNA, 16 nt, Homo sapiens
agcacaagaaguggga

SEQ ID NO: 927392 - RNA, 11 nt, Homo sapiens
agcacugacac

SEQ ID NO: 927393 - RNA, 12 nt, Homo sapiens
agcacugacacu

SEQ ID NO: 927394 - RNA, 15 nt, Homo sapiens
agcagaaacccaugu

SEQ ID NO: 927395 - RNA, 18 nt, Homo sapiens
agcagccucaggcccaau

SEQ ID NO: 927396 - RNA, 19 nt, Homo sapiens
agcauugccagcucuucca

SEQ ID NO: 927397 - RNA, 16 nt, Homo sapiens
agcauuuccucagucu

SEQ ID NO: 927398 - RNA, 18 nt, Homo sapiens
agcauuuugaaugaagug

SEQ ID NO: 927399 - RNA, 20 nt, Homo sapiens
agccaacuguuucccugcug

SEQ ID NO: 927400 - RNA, 21 nt, Homo sapiens
agccaagaaaguccaguuuau

SEQ ID NO: 927401 - RNA, 19 nt, Homo sapiens
agccacaggaauaauaguu

SEQ ID NO: 927402 - RNA, 17 nt, Homo sapiens
agccaccugucccaccu

SEQ ID NO: 927403 - RNA, 17 nt, Homo sapiens
agccaguggggaugagg

SEQ ID NO: 927404 - RNA, 21 nt, Homo sapiens
agccaugggaccaaaccuagc

SEQ ID NO: 927405 - RNA, 11 nt, Homo sapiens
agcccuaggcu

SEQ ID NO: 927406 - RNA, 20 nt, Homo sapiens
agcccuggagucaugccaag

SEQ ID NO: 927407 - RNA, 12 nt, Homo sapiens
agccgaggucau

SEQ ID NO: 927408 - RNA, 13 nt, Homo sapiens
agccucagccacc

SEQ ID NO: 927409 - RNA, 15 nt, Homo sapiens
agccugaugauggaa

SEQ ID NO: 927410 - RNA, 12 nt, Homo sapiens
agccugcugauu

SEQ ID NO: 927411 - RNA, 19 nt, Homo sapiens
agccugugcccugauccaa

SEQ ID NO: 927412 - RNA, 12 nt, Homo sapiens
agcgcacuugau

SEQ ID NO: 927413 - RNA, 17 nt, Homo sapiens
agcgggcggaggggauc

SEQ ID NO: 927414 - RNA, 14 nt, Homo sapiens
agcggguaaaaaga

SEQ ID NO: 927415 - RNA, 17 nt, Homo sapiens
agcgggucuaguggaaa

SEQ ID NO: 927416 - RNA, 19 nt, Homo sapiens
agcguuuccuuucuucccu

SEQ ID NO: 927417 - RNA, 22 nt, Homo sapiens
agcuaagaucacaucacugcac

SEQ ID NO: 927418 - RNA, 15 nt, Homo sapiens
agcuaagccugauga

SEQ ID NO: 927419 - RNA, 19 nt, Homo sapiens
agcuagcucgugacuacau

SEQ ID NO: 927420 - RNA, 20 nt, Homo sapiens
agcucacauagauaugacuu

SEQ ID NO: 927421 - RNA, 17 nt, Homo sapiens
agcucacggcagccuca

SEQ ID NO: 927422 - RNA, 13 nt, Homo sapiens
agcuccugggaag

SEQ ID NO: 927423 - RNA, 18 nt, Homo sapiens
agcugaaccuguucaaaa

SEQ ID NO: 927424 - RNA, 14 nt, Homo sapiens
agcugauuugguca

SEQ ID NO: 927425 - RNA, 16 nt, Homo sapiens
agcugcugacucacuu

SEQ ID NO: 927426 - RNA, 11 nt, Homo sapiens
agcuguucuca

SEQ ID NO: 927427 - RNA, 20 nt, Homo sapiens
agcuuauacaauucagagaa

SEQ ID NO: 927428 - RNA, 18 nt, Homo sapiens
agcuuguucacacuuugc

SEQ ID NO: 927429 - RNA, 20 nt, Homo sapiens
agcuuuggacgcacacagcu

SEQ ID NO: 927430 - RNA, 19 nt, Homo sapiens
aggaaaauaggugaauaau

SEQ ID NO: 927431 - RNA, 19 nt, Homo sapiens
aggaaaccucugacuugcu

SEQ ID NO: 927432 - RNA, 22 nt, Homo sapiens
aggaaagaaucucuugagacau

SEQ ID NO: 927433 - RNA, 22 nt, Homo sapiens
aggaagaucacuuugcucugau

SEQ ID NO: 927434 - RNA, 17 nt, Homo sapiens
aggacagcauggugcau

SEQ ID NO: 927435 - RNA, 20 nt, Homo sapiens
aggacgauuucacugacacu

SEQ ID NO: 927436 - RNA, 18 nt, Homo sapiens
aggacuggcuuuguccca

SEQ ID NO: 927437 - RNA, 22 nt, Homo sapiens
aggacuugugccucuugggaga

SEQ ID NO: 927438 - RNA, 18 nt, Homo sapiens
aggagaagaggaacaucc

SEQ ID NO: 927439 - RNA, 21 nt, Homo sapiens
aggagcauuuugugucuuaag

SEQ ID NO: 927440 - RNA, 20 nt, Homo sapiens
aggaggcuuacaacuccugc

SEQ ID NO: 927441 - RNA, 18 nt, Homo sapiens
aggagggggcucaggcca

SEQ ID NO: 927442 - RNA, 14 nt, Homo sapiens
aggaggguggcacu

SEQ ID NO: 927443 - RNA, 16 nt, Homo sapiens
gaauuagcucacuugg

SEQ ID NO: 927444 - RNA, 18 nt, Homo sapiens
gaauuagcucacuuggug

SEQ ID NO: 927445 - RNA, 19 nt, Homo sapiens
gaauuauaggcgugcacca

SEQ ID NO: 927446 - RNA, 17 nt, Homo sapiens
gaauucagugccuucaa

SEQ ID NO: 927447 - RNA, 16 nt, Homo sapiens
gacaaagacauuauuu

SEQ ID NO: 927448 - RNA, 21 nt, Homo sapiens
gacaaagacauuauuucucau

SEQ ID NO: 927449 - RNA, 18 nt, Homo sapiens
gacaagaugguuaaguca

SEQ ID NO: 927450 - RNA, 19 nt, Homo sapiens
gacaaggucgagacauucc

SEQ ID NO: 927451 - RNA, 12 nt, Homo sapiens
gacacauuugaa

SEQ ID NO: 927452 - RNA, 22 nt, Homo sapiens
gacagaauggagcuauggacgu

SEQ ID NO: 927453 - RNA, 18 nt, Homo sapiens
gacaggaguuugugugca

SEQ ID NO: 927454 - RNA, 22 nt, Homo sapiens
gacagugauuuucaaaaccagc

SEQ ID NO: 927455 - RNA, 23 nt, Homo sapiens
gacauguucccuucuccuuccaa

SEQ ID NO: 927456 - RNA, 15 nt, Homo sapiens
gacauuaauuaucua

SEQ ID NO: 927457 - RNA, 17 nt, Homo sapiens
gacauuuauaauacaaa

SEQ ID NO: 927458 - RNA, 20 nt, Homo sapiens
gacauuucauauaaauggaa

SEQ ID NO: 927459 - RNA, 16 nt, Homo sapiens
gacauuuguccugcag

SEQ ID NO: 927460 - RNA, 21 nt, Homo sapiens
gaccacagcagggauugggau

SEQ ID NO: 927461 - RNA, 17 nt, Homo sapiens
gaccagagcaccucagc

SEQ ID NO: 927462 - RNA, 22 nt, Homo sapiens
gaccagagcucuggagccaccu

SEQ ID NO: 927463 - RNA, 18 nt, Homo sapiens
gaccccgcacccggcucg

SEQ ID NO: 927464 - RNA, 16 nt, Homo sapiens
gaccucugggcuuuga

SEQ ID NO: 927465 - RNA, 14 nt, Homo sapiens
gacucagcagaaca

SEQ ID NO: 927466 - RNA, 13 nt, Homo sapiens
gacucccuacccc

SEQ ID NO: 927467 - RNA, 17 nt, Homo sapiens
gacugaaggacaucuga

SEQ ID NO: 927468 - RNA, 23 nt, Homo sapiens
gacugacuggcaccaacacuuug

SEQ ID NO: 927469 - RNA, 14 nt, Homo sapiens
gacugaugucaucu

SEQ ID NO: 927470 - RNA, 16 nt, Homo sapiens
gacugaugucaucuug

SEQ ID NO: 927471 - RNA, 22 nt, Homo sapiens
agguaggcauucugagcagggg

SEQ ID NO: 927472 - RNA, 15 nt, Homo sapiens
aggucaaaaacaaac

SEQ ID NO: 927473 - RNA, 22 nt, Homo sapiens
aggucaguacccaccugagcuu

SEQ ID NO: 927474 - RNA, 14 nt, Homo sapiens
agguccugccaugg

SEQ ID NO: 927475 - RNA, 17 nt, Homo sapiens
aggucgagacauuccug

SEQ ID NO: 927476 - RNA, 20 nt, Homo sapiens
agguuggccacagucaccac

SEQ ID NO: 927477 - RNA, 14 nt, Homo sapiens
agguuuacagugaa

SEQ ID NO: 927478 - RNA, 17 nt, Homo sapiens
aguaaaaacacuaccuc

SEQ ID NO: 927479 - RNA, 16 nt, Homo sapiens
aguaaagaaaugcaua

SEQ ID NO: 927480 - RNA, 12 nt, Homo sapiens
aguaaagacagg

SEQ ID NO: 927481 - RNA, 14 nt, Homo sapiens
aguaacaaugcaug

SEQ ID NO: 927482 - RNA, 16 nt, Homo sapiens
aguaacaaugcaugcu

SEQ ID NO: 927483 - RNA, 21 nt, Homo sapiens
aguacccaccugagcuuugga

SEQ ID NO: 927484 - RNA, 14 nt, Homo sapiens
aguacugcaaaaug

SEQ ID NO: 927485 - RNA, 20 nt, Homo sapiens
aguagaugcaucuaagcagg

SEQ ID NO: 927486 - RNA, 14 nt, Homo sapiens
aguagggaccugcc

SEQ ID NO: 927487 - RNA, 13 nt, Homo sapiens
aguauuacacauu

SEQ ID NO: 927488 - RNA, 21 nt, Homo sapiens
agucaaauauguagauugccu

SEQ ID NO: 927489 - RNA, 13 nt, Homo sapiens
agucaugccaagc

SEQ ID NO: 927490 - RNA, 23 nt, Homo sapiens
agucauuuuuguuucuaccuccc

SEQ ID NO: 927491 - RNA, 12 nt, Homo sapiens
aguccaguuuau

SEQ ID NO: 927492 - RNA, 19 nt, Homo sapiens
agucccuauacagaggucc

SEQ ID NO: 927493 - RNA, 10 nt, Homo sapiens
aguccucuaa

SEQ ID NO: 927494 - RNA, 20 nt, Homo sapiens
agucuuugagcgagcccauu

SEQ ID NO: 927495 - RNA, 14 nt, Homo sapiens
agugagacugucuc

SEQ ID NO: 927496 - RNA, 16 nt, Homo sapiens
agugagcuaagaucac

SEQ ID NO: 927497 - RNA, 20 nt, Homo sapiens
agugauaagaauucuuaaca

SEQ ID NO: 927498 - RNA, 15 nt, Homo sapiens
agugaucucagcuca

SEQ ID NO: 927499 - RNA, 15 nt, Homo sapiens
agugcaaagugcccu

SEQ ID NO: 927500 - RNA, 18 nt, Homo sapiens
agugcaccuacaccaacu

SEQ ID NO: 927501 - RNA, 21 nt, Homo sapiens
agugccucuccuggcccugaa

SEQ ID NO: 927502 - RNA, 18 nt, Homo sapiens
agugcuaauaaaguuaaa

SEQ ID NO: 927503 - RNA, 19 nt, Homo sapiens
agugcugagauuacaggug

SEQ ID NO: 927504 - RNA, 20 nt, Homo sapiens
agugcugggauuacaggugu

SEQ ID NO: 927505 - RNA, 13 nt, Homo sapiens
aguggaggcauug

SEQ ID NO: 927506 - RNA, 15 nt, Homo sapiens
aguggccaucuggaa

SEQ ID NO: 927507 - RNA, 18 nt, Homo sapiens
aguggggagacaccucag

SEQ ID NO: 927508 - RNA, 14 nt, Homo sapiens
aguguggucaagca

SEQ ID NO: 927509 - RNA, 19 nt, Homo sapiens
aguguuuggaugaaaaaag

SEQ ID NO: 927510 - RNA, 22 nt, Homo sapiens
aguguuuuuccuguguauuaaa

SEQ ID NO: 927511 - RNA, 14 nt, Homo sapiens
aguuacuuaccugc

SEQ ID NO: 927512 - RNA, 21 nt, Homo sapiens
aguuauuucaaaaauuugcau

SEQ ID NO: 927513 - RNA, 20 nt, Homo sapiens
aguuccauuuaaauugacuu

SEQ ID NO: 927514 - RNA, 18 nt, Homo sapiens
aguucucacuuguuucca

SEQ ID NO: 927515 - RNA, 16 nt, Homo sapiens
aguucugaugucuuag

SEQ ID NO: 927516 - RNA, 22 nt, Homo sapiens
aguucuuagaagcucacgccuu

SEQ ID NO: 927517 - RNA, 15 nt, Homo sapiens
aguugacuuccuuau

SEQ ID NO: 927518 - RNA, 13 nt, Homo sapiens
aguuguaaugugu

SEQ ID NO: 927519 - RNA, 20 nt, Homo sapiens
aguuuagaaaguaacuuaau

SEQ ID NO: 927520 - RNA, 14 nt, Homo sapiens
aguuucacugccaa

SEQ ID NO: 927521 - RNA, 17 nt, Homo sapiens
aguuucuucaccuguaa

SEQ ID NO: 927522 - RNA, 15 nt, Homo sapiens
auaaaaaacauucaa

SEQ ID NO: 927523 - RNA, 18 nt, Homo sapiens
auaaaacuaugcuauuaa

SEQ ID NO: 927524 - RNA, 11 nt, Homo sapiens
auaaaccaaaa

SEQ ID NO: 927525 - RNA, 20 nt, Homo sapiens
auaaacugcuauuacuuuua

SEQ ID NO: 927526 - RNA, 14 nt, Homo sapiens
auaaaguacugcaa

SEQ ID NO: 927527 - RNA, 16 nt, Homo sapiens
auaaaguuaaauugca

SEQ ID NO: 927528 - RNA, 23 nt, Homo sapiens
auaaaguuaaauugcacgugcaa

SEQ ID NO: 927529 - RNA, 15 nt, Homo sapiens
auaaaguuugcuaag

SEQ ID NO: 927530 - RNA, 19 nt, Homo sapiens
auaaauuaugaauauuaaa

SEQ ID NO: 927531 - RNA, 21 nt, Homo sapiens
auaacaccaagaguagcaccu

SEQ ID NO: 927532 - RNA, 15 nt, Homo sapiens
auaacugaugaagga

SEQ ID NO: 927533 - RNA, 20 nt, Homo sapiens
auaagaagcuuucaguauua

SEQ ID NO: 927534 - RNA, 14 nt, Homo sapiens
auaaguuuuugcca

SEQ ID NO: 927535 - RNA, 21 nt, Homo sapiens
auaauacaaauaacugaugaa

SEQ ID NO: 927536 - RNA, 18 nt, Homo sapiens
auaauacauggcuaucau

SEQ ID NO: 927537 - RNA, 20 nt, Homo sapiens
auaaucugacaaagucauga

SEQ ID NO: 927538 - RNA, 15 nt, Homo sapiens
auaaucuuagaacag

SEQ ID NO: 927539 - RNA, 22 nt, Homo sapiens
auaauuuauaguuaauguuaaa

SEQ ID NO: 927540 - RNA, 14 nt, Homo sapiens
auacacauauuugc

SEQ ID NO: 927541 - RNA, 15 nt, Homo sapiens
auacacauauuugca

SEQ ID NO: 927542 - RNA, 20 nt, Homo sapiens
auacacucauccuacuucaa

SEQ ID NO: 927543 - RNA, 14 nt, Homo sapiens
auacagcacuuuga

SEQ ID NO: 927544 - RNA, 14 nt, Homo sapiens
auacaguuauuaaa

SEQ ID NO: 927545 - RNA, 19 nt, Homo sapiens
auacauuauuggacuucca

SEQ ID NO: 927546 - RNA, 19 nt, Homo sapiens
auacauuucuuccuucaaa

SEQ ID NO: 927547 - RNA, 23 nt, Homo sapiens
auaccaccgacauuuuucaauaa

SEQ ID NO: 927548 - RNA, 15 nt, Homo sapiens
auaccagaucacuca

SEQ ID NO: 927549 - RNA, 21 nt, Homo sapiens
auacccauaaagaaugcucau

SEQ ID NO: 927550 - RNA, 15 nt, Homo sapiens
auacggaacacuguc

SEQ ID NO: 927551 - RNA, 16 nt, Homo sapiens
auacuccacugcucau

SEQ ID NO: 927552 - RNA, 19 nt, Homo sapiens
auagagaauuccuauuuaa

SEQ ID NO: 927553 - RNA, 16 nt, Homo sapiens
auagccaaaaacuuuu

SEQ ID NO: 927554 - RNA, 14 nt, Homo sapiens
auagcuggacaucc

SEQ ID NO: 927555 - RNA, 14 nt, Homo sapiens
auaggagacuugua

SEQ ID NO: 927556 - RNA, 15 nt, Homo sapiens
auaggauauacugua

SEQ ID NO: 927557 - RNA, 17 nt, Homo sapiens
auaguaacguguuacug

SEQ ID NO: 927558 - RNA, 23 nt, Homo sapiens
auauacugcagcuuuacugccuu

SEQ ID NO: 927559 - RNA, 20 nt, Homo sapiens
auauaguaccuuugcucuug

SEQ ID NO: 927560 - RNA, 17 nt, Homo sapiens
auauauguccuauucau

SEQ ID NO: 927561 - RNA, 20 nt, Homo sapiens
auauauuuauaaauauguga

SEQ ID NO: 927562 - RNA, 21 nt, Homo sapiens
auaucuaccugcccucucuca

SEQ ID NO: 927563 - RNA, 15 nt, Homo sapiens
auauggugucuugau

SEQ ID NO: 927564 - RNA, 18 nt, Homo sapiens
auaugugauuuucucuaa

SEQ ID NO: 927565 - RNA, 20 nt, Homo sapiens
guguuuuguauuuaaagcau

SEQ ID NO: 927566 - RNA, 16 nt, Homo sapiens
guuaaaucuuuuggca

SEQ ID NO: 927567 - RNA, 22 nt, Homo sapiens
guuaauauuaauuuauauuugu

SEQ ID NO: 927568 - RNA, 23 nt, Homo sapiens
guuagaaucccauggauguuucu

SEQ ID NO: 927569 - RNA, 16 nt, Homo sapiens
guuauaauuugcacaa

SEQ ID NO: 927570 - RNA, 17 nt, Homo sapiens
guuaugcggucuaggga

SEQ ID NO: 927571 - RNA, 13 nt, Homo sapiens
guucaaaguuuaa

SEQ ID NO: 927572 - RNA, 12 nt, Homo sapiens
guucacugugag

SEQ ID NO: 927573 - RNA, 21 nt, Homo sapiens
guucccagaaaacacauuucu

SEQ ID NO: 927574 - RNA, 20 nt, Homo sapiens
guucuggaacauucugucau

SEQ ID NO: 927575 - RNA, 22 nt, Homo sapiens
guugccugggggcuuuugccac

SEQ ID NO: 927576 - RNA, 12 nt, Homo sapiens
guugcuuuuacg

SEQ ID NO: 927577 - RNA, 23 nt, Homo sapiens
guuguaauguguaugucugguaa

SEQ ID NO: 927578 - RNA, 18 nt, Homo sapiens
guugugugugcuuucuaa

SEQ ID NO: 927579 - RNA, 21 nt, Homo sapiens
guuuaagcaauucauucucuc

SEQ ID NO: 927580 - RNA, 20 nt, Homo sapiens
guuuacggccuaugagauga

SEQ ID NO: 927581 - RNA, 19 nt, Homo sapiens
guuuagaaauuacaaguuu

SEQ ID NO: 927582 - RNA, 18 nt, Homo sapiens
guuuagaaucaagucugu

SEQ ID NO: 927583 - RNA, 20 nt, Homo sapiens
guuuagaaucaagucuguga

SEQ ID NO: 927584 - RNA, 16 nt, Homo sapiens
guuuauaauuguuaua

SEQ ID NO: 927585 - RNA, 17 nt, Homo sapiens
guuuauguaacuaucaa

SEQ ID NO: 927586 - RNA, 15 nt, Homo sapiens
guuucugaagucuca

SEQ ID NO: 927587 - RNA, 16 nt, Homo sapiens
guuucuuuuauguggu

SEQ ID NO: 927588 - RNA, 18 nt, Homo sapiens
guuugaaauauguuaaac

SEQ ID NO: 927589 - RNA, 17 nt, Homo sapiens
guuugcuuugcuuugua

SEQ ID NO: 927590 - RNA, 15 nt, Homo sapiens
guuuuuggagggguu

SEQ ID NO: 927591 - RNA, 22 nt, Homo sapiens
guuuuugggggguuuucuugcc

SEQ ID NO: 927592 - RNA, 14 nt, Homo sapiens
uaaaaaaugagcuu

SEQ ID NO: 927593 - RNA, 17 nt, Homo sapiens
uaaaaauuguuuuugga

SEQ ID NO: 927594 - RNA, 14 nt, Homo sapiens
uaaaacaucucugu

SEQ ID NO: 927595 - RNA, 18 nt, Homo sapiens
uaaaacuuaucugaguca

SEQ ID NO: 927596 - RNA, 23 nt, Homo sapiens
uaaaacuucugauuucucuucag

SEQ ID NO: 927597 - RNA, 16 nt, Homo sapiens
uaaaagacaagcacuu

SEQ ID NO: 927598 - RNA, 15 nt, Homo sapiens
uaaaagcuguucuca

SEQ ID NO: 927599 - RNA, 18 nt, Homo sapiens
uaaaaguauuuaguugau

SEQ ID NO: 927600 - RNA, 13 nt, Homo sapiens
uaaaagucauuca

SEQ ID NO: 927601 - RNA, 14 nt, Homo sapiens
uaaaaguugcaaag

SEQ ID NO: 927602 - RNA, 22 nt, Homo sapiens
uaaaauaauuauauaacuguau

SEQ ID NO: 927603 - RNA, 22 nt, Homo sapiens
uaaaauacuugagaaauuugug

SEQ ID NO: 927604 - RNA, 17 nt, Homo sapiens
uaaaaucugauuuacac

SEQ ID NO: 927605 - RNA, 23 nt, Homo sapiens
uaaaauuaaguuguaucauuuca

SEQ ID NO: 927606 - RNA, 15 nt, Homo sapiens
uaaaauuaccaaaug

SEQ ID NO: 927607 - RNA, 14 nt, Homo sapiens
uaaacacuauguaa

SEQ ID NO: 927608 - RNA, 19 nt, Homo sapiens
uaaaccgauauuuacguaa

SEQ ID NO: 927609 - RNA, 14 nt, Homo sapiens
uaaacuacauuaua

SEQ ID NO: 927610 - RNA, 17 nt, Homo sapiens
uaaagaaaauugccaaa

SEQ ID NO: 927611 - RNA, 12 nt, Homo sapiens
uaaauuacugau

SEQ ID NO: 927612 - RNA, 17 nt, Homo sapiens
uaaauugcacgugcaau

SEQ ID NO: 927613 - RNA, 21 nt, Homo sapiens
uaacaaagaaguguauuuaca

SEQ ID NO: 927614 - RNA, 17 nt, Homo sapiens
uaacaaugcaugcuuug

SEQ ID NO: 927615 - RNA, 14 nt, Homo sapiens
uaacaauguuaaau

SEQ ID NO: 927616 - RNA, 19 nt, Homo sapiens
uaacaauguuaaaugcaau

SEQ ID NO: 927617 - RNA, 22 nt, Homo sapiens
uaacaucuuuuaauuguuucca

SEQ ID NO: 927618 - RNA, 21 nt, Homo sapiens
uagaauauccuacuucuccag

SEQ ID NO: 927619 - RNA, 17 nt, Homo sapiens
uagaaucaagucuguga

SEQ ID NO: 927620 - RNA, 19 nt, Homo sapiens
uagaaucaagucugugaaa

SEQ ID NO: 927621 - RNA, 19 nt, Homo sapiens
uagacauuuuaagcauuuu

SEQ ID NO: 927622 - RNA, 17 nt, Homo sapiens
uagacuuagccccauga

SEQ ID NO: 927623 - RNA, 16 nt, Homo sapiens
uagagaaaauggaaca

SEQ ID NO: 927624 - RNA, 20 nt, Homo sapiens
uagagaacgggaguggccau

SEQ ID NO: 927625 - RNA, 20 nt, Homo sapiens
uagagcagcccuggagucau

SEQ ID NO: 927626 - RNA, 15 nt, Homo sapiens
uagagguacuuucca

SEQ ID NO: 927627 - RNA, 16 nt, Homo sapiens
uagagguacuuuccac

SEQ ID NO: 927628 - RNA, 20 nt, Homo sapiens
uagauuagaaagacuuucua

SEQ ID NO: 927629 - RNA, 17 nt, Homo sapiens
uagauuauguucaauga

SEQ ID NO: 927630 - RNA, 13 nt, Homo sapiens
uagauucuuuauu

SEQ ID NO: 927631 - RNA, 18 nt, Homo sapiens
uagauugccuuuggcaau

SEQ ID NO: 927632 - RNA, 23 nt, Homo sapiens
uagauugccuuuggcaauucuuc

SEQ ID NO: 927633 - RNA, 14 nt, Homo sapiens
uagcacucacaugc

SEQ ID NO: 927634 - RNA, 18 nt, Homo sapiens
uagccacccaacuuuguc

SEQ ID NO: 927635 - RNA, 13 nt, Homo sapiens
uagccauuugccc

SEQ ID NO: 927636 - RNA, 14 nt, Homo sapiens
uagcuauccuaaau

SEQ ID NO: 927637 - RNA, 17 nt, Homo sapiens
uagcuauucuuugacca

SEQ ID NO: 927638 - RNA, 20 nt, Homo sapiens
uaggaaauaaaauuaaugaa

SEQ ID NO: 927639 - RNA, 18 nt, Homo sapiens
uaggagauaccaccgaca

SEQ ID NO: 927640 - RNA, 19 nt, Homo sapiens
uaguacuuuauuaguuuaa

SEQ ID NO: 927641 - RNA, 19 nt, Homo sapiens
uaguauacuuucaucuaaa

SEQ ID NO: 927642 - RNA, 15 nt, Homo sapiens
uaguucauaaagguu

SEQ ID NO: 927643 - RNA, 17 nt, Homo sapiens
uaguucccucaguguga

SEQ ID NO: 927644 - RNA, 19 nt, Homo sapiens
uaguuuaaaaagaaauuga

SEQ ID NO: 927645 - RNA, 23 nt, Homo sapiens
uauaaagcaguauuuuucuugac

SEQ ID NO: 927646 - RNA, 16 nt, Homo sapiens
uauaaauggaaucaca

SEQ ID NO: 927647 - RNA, 16 nt, Homo sapiens
uauaacuguauuugaa

SEQ ID NO: 927648 - RNA, 13 nt, Homo sapiens
uauaagaaauaca

SEQ ID NO: 927649 - RNA, 13 nt, Homo sapiens
uauacuauauuac

SEQ ID NO: 927650 - RNA, 15 nt, Homo sapiens
uauagaaccaugaau

SEQ ID NO: 927651 - RNA, 18 nt, Homo sapiens
uauagaaccaugaauucu

SEQ ID NO: 927652 - RNA, 16 nt, Homo sapiens
uauauucauaccuguu

SEQ ID NO: 927653 - RNA, 20 nt, Homo sapiens
uauauugguuuuuccagcua

SEQ ID NO: 927654 - RNA, 22 nt, Homo sapiens
uaucagcgccuccuuuacuucc

SEQ ID NO: 927655 - RNA, 16 nt, Homo sapiens
uaucugagucacuuga

SEQ ID NO: 927656 - RNA, 20 nt, Homo sapiens
uaugaccaaaacuauuccau

SEQ ID NO: 927657 - RNA, 22 nt, Homo sapiens
uaugagauguagcaaauuccaa

SEQ ID NO: 927658 - RNA, 20 nt, Homo sapiens
uaugaugcuggaaauaugaa

SEQ ID NO: 927659 - RNA, 21 nt, Homo sapiens
uaugauguauacccauaaaga

SEQ ID NO: 927660 - RNA, 17 nt, Homo sapiens
uaugcuuacucuugcuu

SEQ ID NO: 927661 - RNA, 14 nt, Homo sapiens
uauggaauuuugca

SEQ ID NO: 927662 - RNA, 21 nt, Homo sapiens
uauggaccaauuagcauucca

SEQ ID NO: 927663 - RNA, 14 nt, Homo sapiens
uauguaaacaauca

SEQ ID NO: 927664 - RNA, 13 nt, Homo sapiens
uauguucaugagu

SEQ ID NO: 927665 - RNA, 21 nt, Homo sapiens
uauguucuccccuacauuagu

SEQ ID NO: 927666 - RNA, 20 nt, Homo sapiens
uauguuucucuacagcaccu

SEQ ID NO: 927667 - RNA, 18 nt, Homo sapiens
uauuaaaaaaaaagaagg

SEQ ID NO: 927668 - RNA, 20 nt, Homo sapiens
uauuagugaaguaugcacua

SEQ ID NO: 927669 - RNA, 17 nt, Homo sapiens
uauucauaccuguugua

SEQ ID NO: 927670 - RNA, 14 nt, Homo sapiens
uauucccagccuag

SEQ ID NO: 927671 - RNA, 20 nt, Homo sapiens
uauuccuaggcaacuauuaa

SEQ ID NO: 927672 - RNA, 14 nt, Homo sapiens
uauugaguucugaa

SEQ ID NO: 927673 - RNA, 16 nt, Homo sapiens
uauugcaaccuaguac

SEQ ID NO: 927674 - RNA, 13 nt, Homo sapiens
uauuuaaagcauu

SEQ ID NO: 927675 - RNA, 18 nt, Homo sapiens
ucaugacguuccugucua

SEQ ID NO: 927676 - RNA, 13 nt, Homo sapiens
ucaugagaauuga

SEQ ID NO: 927677 - RNA, 18 nt, Homo sapiens
ucauggcucugaacugca

SEQ ID NO: 927678 - RNA, 21 nt, Homo sapiens
ucauggcucugaacugcacaa

SEQ ID NO: 927679 - RNA, 16 nt, Homo sapiens
ucauguagguugucua

SEQ ID NO: 927680 - RNA, 15 nt, Homo sapiens
ucauguugaagucaa

SEQ ID NO: 927681 - RNA, 20 nt, Homo sapiens
ucauuaagaggcaggucuua

SEQ ID NO: 927682 - RNA, 23 nt, Homo sapiens
ucauuaccgucugugauugccau

SEQ ID NO: 927683 - RNA, 15 nt, Homo sapiens
ucauucuaaaccaaa

SEQ ID NO: 927684 - RNA, 13 nt, Homo sapiens
ucauuuauuucca

SEQ ID NO: 927685 - RNA, 18 nt, Homo sapiens
ucauuugcagcugcuggu

SEQ ID NO: 927686 - RNA, 14 nt, Homo sapiens
uccaaacuguguca

SEQ ID NO: 927687 - RNA, 20 nt, Homo sapiens
uccaaacugugucacgcagg

SEQ ID NO: 927688 - RNA, 21 nt, Homo sapiens
uccaacaacugucagaauaaa

SEQ ID NO: 927689 - RNA, 20 nt, Homo sapiens
uccaacgaauagcuccucua

SEQ ID NO: 927690 - RNA, 20 nt, Homo sapiens
uccaacuccuggagauuuca

SEQ ID NO: 927691 - RNA, 21 nt, Homo sapiens
uccaacugcugccccaaagga

SEQ ID NO: 927692 - RNA, 22 nt, Homo sapiens
uccaagucuuccugaccaccuu

SEQ ID NO: 927693 - RNA, 16 nt, Homo sapiens
uccaccaaauucugaa

SEQ ID NO: 927694 - RNA, 15 nt, Homo sapiens
uccagccaccaccua

SEQ ID NO: 927695 - RNA, 18 nt, Homo sapiens
uccagcuaagccugauga

SEQ ID NO: 927696 - RNA, 14 nt, Homo sapiens
uccaggaugucaac

SEQ ID NO: 927697 - RNA, 15 nt, Homo sapiens
uccaggauugagcag

SEQ ID NO: 927698 - RNA, 17 nt, Homo sapiens
uccaggccucaguuucu

SEQ ID NO: 927699 - RNA, 14 nt, Homo sapiens
uccaguaucuucac

SEQ ID NO: 927700 - RNA, 14 nt, Homo sapiens
uccaguucugauga

SEQ ID NO: 927701 - RNA, 21 nt, Homo sapiens
uccauuuugugucugugaaca

SEQ ID NO: 927702 - RNA, 20 nt, Homo sapiens
ucccaaagugcugggauuac

SEQ ID NO: 927703 - RNA, 15 nt, Homo sapiens
ucccaacagccaaga

SEQ ID NO: 927704 - RNA, 18 nt, Homo sapiens
ucccaugguagacuguga

SEQ ID NO: 927705 - RNA, 23 nt, Homo sapiens
uccccaaaacacugucugcauau

SEQ ID NO: 927706 - RNA, 19 nt, Homo sapiens
uccccaacuccuuccucuu

SEQ ID NO: 927707 - RNA, 16 nt, Homo sapiens
uccccacucugaguga

SEQ ID NO: 927708 - RNA, 21 nt, Homo sapiens
uccccagaagcagccauaaaa

SEQ ID NO: 927709 - RNA, 18 nt, Homo sapiens
uccccuccccucacuucu

SEQ ID NO: 927710 - RNA, 21 nt, Homo sapiens
uccccucguuaacacauggcu

SEQ ID NO: 927711 - RNA, 20 nt, Homo sapiens
ucccgaguaguugggauuac

SEQ ID NO: 927712 - RNA, 19 nt, Homo sapiens
ucccggaguucuccugcuc

SEQ ID NO: 927713 - RNA, 16 nt, Homo sapiens
ucccuauaaugcugga

SEQ ID NO: 927714 - RNA, 13 nt, Homo sapiens
ucccuuccugcuu

SEQ ID NO: 927715 - RNA, 21 nt, Homo sapiens
ucccuuuguuuaaaaugucau

SEQ ID NO: 927716 - RNA, 14 nt, Homo sapiens
uccgccagaccuca

SEQ ID NO: 927717 - RNA, 15 nt, Homo sapiens
uccgccagaccucaa

SEQ ID NO: 927718 - RNA, 19 nt, Homo sapiens
uccuaauaaacugcuauua

SEQ ID NO: 927719 - RNA, 18 nt, Homo sapiens
uccuacaguacaaucagc

SEQ ID NO: 927720 - RNA, 16 nt, Homo sapiens
uccuagacucaaguga

SEQ ID NO: 927721 - RNA, 13 nt, Homo sapiens
uccucauucuucu

SEQ ID NO: 927722 - RNA, 19 nt, Homo sapiens
uccucccaaaauacuacac

SEQ ID NO: 927723 - RNA, 15 nt, Homo sapiens
uccucccuacuucca

SEQ ID NO: 927724 - RNA, 15 nt, Homo sapiens
uccuccggggcucag

SEQ ID NO: 927725 - RNA, 13 nt, Homo sapiens
uccucgacaucuu

SEQ ID NO: 927726 - RNA, 22 nt, Homo sapiens
uccucugauuucacauauugca

SEQ ID NO: 927727 - RNA, 14 nt, Homo sapiens
uccucuguccucau

SEQ ID NO: 927728 - RNA, 21 nt, Homo sapiens
uccugaaauagggagacugac

SEQ ID NO: 927729 - RNA, 20 nt, Homo sapiens
uccuguaccgucgacaagaa

SEQ ID NO: 927730 - RNA, 12 nt, Homo sapiens
uccugucauggc

SEQ ID NO: 927731 - RNA, 19 nt, Homo sapiens
uccugucccaccaugcagu

SEQ ID NO: 927732 - RNA, 15 nt, Homo sapiens
uccugucguccugcc

SEQ ID NO: 927733 - RNA, 19 nt, Homo sapiens
uccuugucucucauucucu

SEQ ID NO: 927734 - RNA, 12 nt, Homo sapiens
ucgagagccaaa

SEQ ID NO: 927735 - RNA, 18 nt, Homo sapiens
ggccggugcgacccaguu

SEQ ID NO: 927736 - RNA, 21 nt, Homo sapiens
ggccucugcucuccugggaga

SEQ ID NO: 927737 - RNA, 13 nt, Homo sapiens
ggccugaccucaa

SEQ ID NO: 927738 - RNA, 21 nt, Homo sapiens
ggccugucccuggccaucucu

SEQ ID NO: 927739 - RNA, 23 nt, Homo sapiens
ggcgauaugagagggaugcagug

SEQ ID NO: 927740 - RNA, 19 nt, Homo sapiens
ggcuggacuuuugcagcuu

SEQ ID NO: 927741 - RNA, 22 nt, Homo sapiens
ggcuuuaauacaaaaagcaaaa

SEQ ID NO: 927742 - RNA, 12 nt, Homo sapiens
ggcuuuugccac

SEQ ID NO: 927743 - RNA, 15 nt, Homo sapiens
gggacugaugucauc

SEQ ID NO: 927744 - RNA, 23 nt, Homo sapiens
gggagagccaaggccuaugccac

SEQ ID NO: 927745 - RNA, 15 nt, Homo sapiens
gggaggccaaggugg

SEQ ID NO: 927746 - RNA, 20 nt, Homo sapiens
gggagguggagguugcagug

SEQ ID NO: 927747 - RNA, 18 nt, Homo sapiens
gggcaaaggaaaaccgag

SEQ ID NO: 927748 - RNA, 16 nt, Homo sapiens
gggcaacuauucauga

SEQ ID NO: 927749 - RNA, 22 nt, Homo sapiens
gggcaaggugagggaugccaua

SEQ ID NO: 927750 - RNA, 22 nt, Homo sapiens
gggcacuggccuagagccucac

SEQ ID NO: 927751 - RNA, 11 nt, Homo sapiens
gggcaggugac

SEQ ID NO: 927752 - RNA, 22 nt, Homo sapiens
gggccaucugacugccaagcca

SEQ ID NO: 927753 - RNA, 19 nt, Homo sapiens
gggcccagaggcacagccg

SEQ ID NO: 927754 - RNA, 16 nt, Homo sapiens
gggcccucugccucau

SEQ ID NO: 927755 - RNA, 23 nt, Homo sapiens
gggccucaggcucugcacagaca

SEQ ID NO: 927756 - RNA, 16 nt, Homo sapiens
gggccugcagaaggaa

SEQ ID NO: 927757 - RNA, 16 nt, Homo sapiens
gggcucaggccaucca

SEQ ID NO: 927758 - RNA, 13 nt, Homo sapiens
ggggacagugauu

SEQ ID NO: 927759 - RNA, 18 nt, Homo sapiens
ggggaucagaacucuccu

SEQ ID NO: 927760 - RNA, 13 nt, Homo sapiens
ggggcucccugug

SEQ ID NO: 927761 - RNA, 16 nt, Homo sapiens
gggugaagcuggggac

SEQ ID NO: 927762 - RNA, 21 nt, Homo sapiens
gguaaauauagaaccaugaau

SEQ ID NO: 927763 - RNA, 21 nt, Homo sapiens
gguaccugcccucuauuuauu

SEQ ID NO: 927764 - RNA, 20 nt, Homo sapiens
gguacugugaggaagagcag

SEQ ID NO: 927765 - RNA, 20 nt, Homo sapiens
ggucaggagauggagaccau

SEQ ID NO: 927766 - RNA, 16 nt, Homo sapiens
ggucagggaaauauga

SEQ ID NO: 927767 - RNA, 11 nt, Homo sapiens
ggucaugccac

SEQ ID NO: 927768 - RNA, 24 nt, Homo sapiens
gguccagauuguagcucuuagucc

SEQ ID NO: 927769 - RNA, 16 nt, Homo sapiens
ggucccagcuaaagag

SEQ ID NO: 927770 - RNA, 15 nt, Homo sapiens
ggugaagacccagag

SEQ ID NO: 927771 - RNA, 16 nt, Homo sapiens
ggugauauguccuaua

SEQ ID NO: 927772 - RNA, 15 nt, Homo sapiens
ggugcaggacacugg

SEQ ID NO: 927773 - RNA, 20 nt, Homo sapiens
gguggccccuccccaacucc

SEQ ID NO: 927774 - RNA, 23 nt, Homo sapiens
ggugggaggccccugguggcaug

SEQ ID NO: 927775 - RNA, 18 nt, Homo sapiens
gguguaaaauaucuaccu

SEQ ID NO: 927776 - RNA, 18 nt, Homo sapiens
gguuaaaagaacaacacu

SEQ ID NO: 927777 - RNA, 11 nt, Homo sapiens
gguugcaguga

SEQ ID NO: 927778 - RNA, 14 nt, Homo sapiens
gguuuuuccagcua

SEQ ID NO: 927779 - RNA, 16 nt, Homo sapiens
guaaauagguauuaua

SEQ ID NO: 927780 - RNA, 21 nt, Homo sapiens
guaaauuuuggaaacaguaca

SEQ ID NO: 927781 - RNA, 14 nt, Homo sapiens
guaacaauguuugu

SEQ ID NO: 927782 - RNA, 18 nt, Homo sapiens
guaaggacuugugccucu

SEQ ID NO: 927783 - RNA, 17 nt, Homo sapiens
guaaggcagcucugucg

SEQ ID NO: 927784 - RNA, 21 nt, Homo sapiens
guaauaaaacccagcauguac

SEQ ID NO: 927785 - RNA, 13 nt, Homo sapiens
uugcaaagauuua

SEQ ID NO: 927786 - RNA, 23 nt, Homo sapiens
uugcaauacauuucuuccuucaa

SEQ ID NO: 927787 - RNA, 13 nt, Homo sapiens
uugcacgugcaau

SEQ ID NO: 927788 - RNA, 14 nt, Homo sapiens
uugcacgugcaaua

SEQ ID NO: 927789 - RNA, 20 nt, Homo sapiens
uugcaguugucaccaaauac

SEQ ID NO: 927790 - RNA, 16 nt, Homo sapiens
uugccagcucuuccaa

SEQ ID NO: 927791 - RNA, 15 nt, Homo sapiens
uugcccuaugacauu

SEQ ID NO: 927792 - RNA, 18 nt, Homo sapiens
uugcccucuuauguauuu

SEQ ID NO: 927793 - RNA, 16 nt, Homo sapiens
uugcucucaaugcagg

SEQ ID NO: 927794 - RNA, 13 nt, Homo sapiens
uuggacuuuggac

SEQ ID NO: 927795 - RNA, 18 nt, Homo sapiens
uuggagaacucauuucaa

SEQ ID NO: 927796 - RNA, 17 nt, Homo sapiens
uuguaagucccaugaau

SEQ ID NO: 927797 - RNA, 12 nt, Homo sapiens
uuguacugugac

SEQ ID NO: 927798 - RNA, 14 nt, Homo sapiens
uugucaccaaauac

SEQ ID NO: 927799 - RNA, 21 nt, Homo sapiens
uugucauuuugaaauacuuaa

SEQ ID NO: 927800 - RNA, 16 nt, Homo sapiens
uugugagugugugcac

SEQ ID NO: 927801 - RNA, 13 nt, Homo sapiens
uugugauuugccc

SEQ ID NO: 927802 - RNA, 16 nt, Homo sapiens
uugugcuuuugcaaaa

SEQ ID NO: 927803 - RNA, 20 nt, Homo sapiens
uuguguaaaggaacaacuga

SEQ ID NO: 927804 - RNA, 21 nt, Homo sapiens
uugugucuaccuuguuauuaa

SEQ ID NO: 927805 - RNA, 18 nt, Homo sapiens
uuguuagugauuugcuau

SEQ ID NO: 927806 - RNA, 12 nt, Homo sapiens
uuguucucagaa

SEQ ID NO: 927807 - RNA, 23 nt, Homo sapiens
uuuaaaaaaugagcuuccauuaa

SEQ ID NO: 927808 - RNA, 18 nt, Homo sapiens
uuuaaaugucaguugaaa

SEQ ID NO: 927809 - RNA, 23 nt, Homo sapiens
uuuaaauuuuuuaagcaacugga

SEQ ID NO: 927810 - RNA, 19 nt, Homo sapiens
uuuaagaaaaacaugucau

SEQ ID NO: 927811 - RNA, 14 nt, Homo sapiens
uuuacaguggaauc

SEQ ID NO: 927812 - RNA, 13 nt, Homo sapiens
uuuaccaggguag

SEQ ID NO: 927813 - RNA, 18 nt, Homo sapiens
uuuagauucccagugucu

SEQ ID NO: 927814 - RNA, 17 nt, Homo sapiens
uuuaguacauccagaaa

SEQ ID NO: 927815 - RNA, 17 nt, Homo sapiens
uuuaugcucaccugaca

SEQ ID NO: 927816 - RNA, 18 nt, Homo sapiens
uuuauggguuuugcuuaa

SEQ ID NO: 927817 - RNA, 20 nt, Homo sapiens
uuuauuuugacugugauuua

SEQ ID NO: 927818 - RNA, 21 nt, Homo sapiens
uuucaaaaccagcucccaugu

SEQ ID NO: 927819 - RNA, 19 nt, Homo sapiens
uuucaagaaagcauugcca

SEQ ID NO: 927820 - RNA, 15 nt, Homo sapiens
uuucaauagcacaua

SEQ ID NO: 927821 - RNA, 16 nt, Homo sapiens
uuucaccaaggaaaua

SEQ ID NO: 927822 - RNA, 12 nt, Homo sapiens
uuucacugacac

SEQ ID NO: 927823 - RNA, 18 nt, Homo sapiens
uuucagaugcaaucacuu

SEQ ID NO: 927824 - RNA, 11 nt, Homo sapiens
uuucaguaaua

SEQ ID NO: 927825 - RNA, 18 nt, Homo sapiens
uuucauggcagcaagugu

SEQ ID NO: 927826 - RNA, 22 nt, Homo sapiens
uuucauuuggaaugaauacagc

SEQ ID NO: 927827 - RNA, 23 nt, Homo sapiens
uuucccauuuaaaaauaucugaa

SEQ ID NO: 927828 - RNA, 12 nt, Homo sapiens
uuuccuguguau

SEQ ID NO: 927829 - RNA, 18 nt, Homo sapiens
uuuccuugucucucauuc

SEQ ID NO: 927830 - RNA, 17 nt, Homo sapiens
uuucuauucagcaaaag

SEQ ID NO: 927831 - RNA, 15 nt, Homo sapiens
uuucuggaauggaaa

SEQ ID NO: 927832 - RNA, 15 nt, Homo sapiens
uuucuguuguuucuu

SEQ ID NO: 927833 - RNA, 20 nt, Homo sapiens
uuucuuaaugcuauuugcca

SEQ ID NO: 927834 - RNA, 15 nt, Homo sapiens
uuucuuuugaauaau

SEQ ID NO: 927835 - RNA, 18 nt, Homo sapiens
uuugaacuccgcugccuu

SEQ ID NO: 927836 - RNA, 14 nt, Homo sapiens
uuugaaugaagugu

SEQ ID NO: 927837 - RNA, 11 nt, Homo sapiens
uuugcauaaag

SEQ ID NO: 927838 - RNA, 15 nt, Homo sapiens
uuugcugcagacuca

SEQ ID NO: 927839 - RNA, 12 nt, Homo sapiens
uuuggauuuucc

SEQ ID NO: 927840 - RNA, 14 nt, Homo sapiens
uuugggagagacca

SEQ ID NO: 927841 - RNA, 21 nt, Homo sapiens
uuugguccucugauuucacau

SEQ ID NO: 927842 - RNA, 18 nt, Homo sapiens
uuuguaaaauaaaaccac

SEQ ID NO: 927843 - RNA, 22 nt, Homo sapiens
uuuguaacaugacacauuugaa

SEQ ID NO: 927844 - RNA, 23 nt, Homo sapiens
uuugucauuuugaaauacuuaau

SEQ ID NO: 927845 - RNA, 19 nt, Homo sapiens
uuuuaacaaaugauuuaca

SEQ ID NO: 927846 - RNA, 20 nt, Homo sapiens
uuuuagauucccagugucua

SEQ ID NO: 927847 - RNA, 12 nt, Homo sapiens
uuuucuacacag

SEQ ID NO: 927848 - RNA, 14 nt, Homo sapiens
uuuucugucucucu

SEQ ID NO: 927849 - RNA, 15 nt, Homo sapiens
uuuugccacauuagc

SEQ ID NO: 927850 - RNA, 22 nt, Homo sapiens
uuuuggaucuaucaccugucau

SEQ ID NO: 927851 - RNA, 14 nt, Homo sapiens
uuuuggggcuguau

SEQ ID NO: 927852 - RNA, 16 nt, Homo sapiens
uuuuguauguaugugu

SEQ ID NO: 927853 - RNA, 12 nt, Homo sapiens
uuuugugucugu

SEQ ID NO: 927854 - RNA, 19 nt, Homo sapiens
uuuuuaagucacaauuuca

SEQ ID NO: 927855 - RNA, 15 nt, Homo sapiens
uuuuugaacuuggua

SEQ ID NO: 927856 - RNA, 13 nt, Homo sapiens
aggugucucucac

SEQ ID NO: 927857 - RNA, 16 nt, Homo sapiens
agguuggaggcccuag

SEQ ID NO: 927858 - RNA, 13 nt, Homo sapiens
agguugugaaaac

SEQ ID NO: 927859 - RNA, 21 nt, Homo sapiens
agguugugcccuguggcugcc

SEQ ID NO: 927860 - RNA, 18 nt, Homo sapiens
aguaaauuaguaauguac

SEQ ID NO: 927861 - RNA, 17 nt, Homo sapiens
aguacccaccugagcuu

SEQ ID NO: 927862 - RNA, 20 nt, Homo sapiens
aguacccaccugagcuuugg

SEQ ID NO: 927863 - RNA, 23 nt, Homo sapiens
aguacuugggaggccaaggcagg

SEQ ID NO: 927864 - RNA, 18 nt, Homo sapiens
aguacuuuauuaguuuaa

SEQ ID NO: 927865 - RNA, 19 nt, Homo sapiens
aguagagacaggauuucac

SEQ ID NO: 927866 - RNA, 22 nt, Homo sapiens
aguagcugagacuacaggugag

SEQ ID NO: 927867 - RNA, 21 nt, Homo sapiens
aguaguugggauuacagguga

SEQ ID NO: 927868 - RNA, 22 nt, Homo sapiens
aguaugcacuaaucaauacuuu

SEQ ID NO: 927869 - RNA, 13 nt, Homo sapiens
aguaugugucuag

SEQ ID NO: 927870 - RNA, 12 nt, Homo sapiens
aguauugcuaau

SEQ ID NO: 927871 - RNA, 21 nt, Homo sapiens
agucaaauuuggauuuuccac

SEQ ID NO: 927872 - RNA, 23 nt, Homo sapiens
agucaauucuguuaaaacucaag

SEQ ID NO: 927873 - RNA, 21 nt, Homo sapiens
agucagcuuuacuagugccaa

SEQ ID NO: 927874 - RNA, 14 nt, Homo sapiens
agucccccaugaca

SEQ ID NO: 927875 - RNA, 14 nt, Homo sapiens
aguccgcucuucca

SEQ ID NO: 927876 - RNA, 16 nt, Homo sapiens
agucuguauuccugau

SEQ ID NO: 927877 - RNA, 22 nt, Homo sapiens
agugaacaaauuucaaaaucuu

SEQ ID NO: 927878 - RNA, 19 nt, Homo sapiens
agugaacaaucagcggcau

SEQ ID NO: 927879 - RNA, 19 nt, Homo sapiens
agugaacaccguccucgau

SEQ ID NO: 927880 - RNA, 19 nt, Homo sapiens
agugaauaaaaggauauca

SEQ ID NO: 927881 - RNA, 20 nt, Homo sapiens
agugaauaaaaggauaucau

SEQ ID NO: 927882 - RNA, 12 nt, Homo sapiens
agugaauacuuu

SEQ ID NO: 927883 - RNA, 18 nt, Homo sapiens
agugaggaccugacacaa

SEQ ID NO: 927884 - RNA, 21 nt, Homo sapiens
agugaucucagcucacugcaa

SEQ ID NO: 927885 - RNA, 12 nt, Homo sapiens
agugaugggagu

SEQ ID NO: 927886 - RNA, 23 nt, Homo sapiens
agugcaccuacaccaacugcucu

SEQ ID NO: 927887 - RNA, 17 nt, Homo sapiens
agugccaccacacucag

SEQ ID NO: 927888 - RNA, 13 nt, Homo sapiens
agugcccagugau

SEQ ID NO: 927889 - RNA, 15 nt, Homo sapiens
agugccccuagcuua

SEQ ID NO: 927890 - RNA, 16 nt, Homo sapiens
aguggccaucuggaaa

SEQ ID NO: 927891 - RNA, 22 nt, Homo sapiens
agugguaaauauagaaccauga

SEQ ID NO: 927892 - RNA, 21 nt, Homo sapiens
aguguagaccgagauggugca

SEQ ID NO: 927893 - RNA, 19 nt, Homo sapiens
agugucuaauucccuguua

SEQ ID NO: 927894 - RNA, 19 nt, Homo sapiens
aguguuggaaauaggcaau

SEQ ID NO: 927895 - RNA, 15 nt, Homo sapiens
aguguuggcuuucau

SEQ ID NO: 927896 - RNA, 17 nt, Homo sapiens
aguuaccuuucuagguc

SEQ ID NO: 927897 - RNA, 19 nt, Homo sapiens
aguuacuauccuggcuuug

SEQ ID NO: 927898 - RNA, 14 nt, Homo sapiens
aguugggauuacag

SEQ ID NO: 927899 - RNA, 18 nt, Homo sapiens
aguugggauuacagguga

SEQ ID NO: 927900 - RNA, 16 nt, Homo sapiens
aguugucaccaaauac

SEQ ID NO: 927901 - RNA, 23 nt, Homo sapiens
aguuuaugagcugauuuggucac

SEQ ID NO: 927902 - RNA, 22 nt, Homo sapiens
aguuuccagcuaagccugauga

SEQ ID NO: 927903 - RNA, 23 nt, Homo sapiens
aguuuccagcuaagccugaugau

SEQ ID NO: 927904 - RNA, 12 nt, Homo sapiens
aguuuguauuaa

SEQ ID NO: 927905 - RNA, 22 nt, Homo sapiens
aguuuugaaaggcuuuccucag

SEQ ID NO: 927906 - RNA, 16 nt, Homo sapiens
aguuuugagaaacaaa

SEQ ID NO: 927907 - RNA, 16 nt, Homo sapiens
auaaaacaaaaccaag

SEQ ID NO: 927908 - RNA, 17 nt, Homo sapiens
auaaaaccaccaaaguc

SEQ ID NO: 927909 - RNA, 14 nt, Homo sapiens
auaaaacucuccuu

SEQ ID NO: 927910 - RNA, 23 nt, Homo sapiens
auaaaauccaaugcuucugcaua

SEQ ID NO: 927911 - RNA, 13 nt, Homo sapiens
auaaaaugcauuu

SEQ ID NO: 927912 - RNA, 20 nt, Homo sapiens
auaaaaugcauuuaaacuca

SEQ ID NO: 927913 - RNA, 17 nt, Homo sapiens
auaaagaaauccagauc

SEQ ID NO: 927914 - RNA, 13 nt, Homo sapiens
auaaagaacauuc

SEQ ID NO: 927915 - RNA, 22 nt, Homo sapiens
auaaagcaccagcaguguuuaa

SEQ ID NO: 927916 - RNA, 21 nt, Homo sapiens
auaaagcaguauuuuucuuga

SEQ ID NO: 927917 - RNA, 12 nt, Homo sapiens
auaaagccuuuu

SEQ ID NO: 927918 - RNA, 18 nt, Homo sapiens
auaaaguuauuacucuga

SEQ ID NO: 927919 - RNA, 17 nt, Homo sapiens
auaaauacaauauugca

SEQ ID NO: 927920 - RNA, 23 nt, Homo sapiens
auaaauaugugauuaucauuuau

SEQ ID NO: 927921 - RNA, 18 nt, Homo sapiens
auaaauggugagaauuaa

SEQ ID NO: 927922 - RNA, 23 nt, Homo sapiens
auaaccuuuggccuuauggauuu

SEQ ID NO: 927923 - RNA, 14 nt, Homo sapiens
auaaggauucugaa

SEQ ID NO: 927924 - RNA, 20 nt, Homo sapiens
auaaggggaagagucauuuu

SEQ ID NO: 927925 - RNA, 18 nt, Homo sapiens
auaagguuaagauaucau

SEQ ID NO: 927926 - RNA, 17 nt, Homo sapiens
auaauaaaauucauucc

SEQ ID NO: 927927 - RNA, 19 nt, Homo sapiens
auaauaaaauucauuccau

SEQ ID NO: 927928 - RNA, 20 nt, Homo sapiens
auaaucuaaacaccaaaaac

SEQ ID NO: 927929 - RNA, 18 nt, Homo sapiens
auaauguuuuuaugauuu

SEQ ID NO: 927930 - RNA, 22 nt, Homo sapiens
auaauugccuacagagggauuu

SEQ ID NO: 927931 - RNA, 17 nt, Homo sapiens
auacaaauaacugauga

SEQ ID NO: 927932 - RNA, 18 nt, Homo sapiens
auacacaacuccacuguc

SEQ ID NO: 927933 - RNA, 17 nt, Homo sapiens
auacagagguccugcca

SEQ ID NO: 927934 - RNA, 17 nt, Homo sapiens
auacauacuauagauuc

SEQ ID NO: 927935 - RNA, 24 nt, Homo sapiens
auacauggguagcuucugaccuca

SEQ ID NO: 927936 - RNA, 13 nt, Homo sapiens
auaccaccaacaa

SEQ ID NO: 927937 - RNA, 17 nt, Homo sapiens
auaccacuacuaaaaau

SEQ ID NO: 927938 - RNA, 16 nt, Homo sapiens
auaccagaucacucaa

SEQ ID NO: 927939 - RNA, 15 nt, Homo sapiens
auacccaaauccucu

SEQ ID NO: 927940 - RNA, 13 nt, Homo sapiens
auaccucauucac

SEQ ID NO: 927941 - RNA, 15 nt, Homo sapiens
auaccuguuguacac

SEQ ID NO: 927942 - RNA, 20 nt, Homo sapiens
auacuccugcccaugaucca

SEQ ID NO: 927943 - RNA, 22 nt, Homo sapiens
auacuguaugccggcuccuuca

SEQ ID NO: 927944 - RNA, 19 nt, Homo sapiens
auacuugugaacaugccuu

SEQ ID NO: 927945 - RNA, 17 nt, Homo sapiens
auagaauaaauacaaua

SEQ ID NO: 927946 - RNA, 13 nt, Homo sapiens
auagaaugaacca

SEQ ID NO: 927947 - RNA, 17 nt, Homo sapiens
auagacuuagccccaug

SEQ ID NO: 927948 - RNA, 15 nt, Homo sapiens
auagacuuuugugac

SEQ ID NO: 927949 - RNA, 21 nt, Homo sapiens
auagagaacgggaguggccau

SEQ ID NO: 927950 - RNA, 18 nt, Homo sapiens
auagcccgaagucucaug

SEQ ID NO: 927951 - RNA, 18 nt, Homo sapiens
auagcuuguacacauaua

SEQ ID NO: 927952 - RNA, 15 nt, Homo sapiens
auauauuaauaugca

SEQ ID NO: 927953 - RNA, 19 nt, Homo sapiens
auauauucaguaaugaaga

SEQ ID NO: 927954 - RNA, 20 nt, Homo sapiens
auauauucuuuccaugcagu

SEQ ID NO: 927955 - RNA, 23 nt, Homo sapiens
auauauuguauuuuuauuugaua

SEQ ID NO: 927956 - RNA, 13 nt, Homo sapiens
auaucuaccugcc

SEQ ID NO: 927957 - RNA, 14 nt, Homo sapiens
auaugaucaaauac

SEQ ID NO: 927958 - RNA, 15 nt, Homo sapiens
auauguaaacaguga

SEQ ID NO: 927959 - RNA, 17 nt, Homo sapiens
auauuacugauuuacaa

SEQ ID NO: 927960 - RNA, 16 nt, Homo sapiens
auauuaguuguauaua

SEQ ID NO: 927961 - RNA, 23 nt, Homo sapiens
auauugauuucugccuuccuugc

SEQ ID NO: 927962 - RNA, 21 nt, Homo sapiens
auauugcucuauauguaauau

SEQ ID NO: 927963 - RNA, 17 nt, Homo sapiens
auauuuauaauuaaaga

SEQ ID NO: 927964 - RNA, 23 nt, Homo sapiens
auauuuguccaacaacugucaga

SEQ ID NO: 927965 - RNA, 20 nt, Homo sapiens
auauuuguguaaaguaugca

SEQ ID NO: 927966 - RNA, 20 nt, Homo sapiens
auauuuuuauccuguucuca

SEQ ID NO: 927967 - RNA, 20 nt, Homo sapiens
aucaacccaauaauucugua

SEQ ID NO: 927968 - RNA, 16 nt, Homo sapiens
aucaagugcaccuaca

SEQ ID NO: 927969 - RNA, 16 nt, Homo sapiens
aucacaaacucaucca

SEQ ID NO: 927970 - RNA, 23 nt, Homo sapiens
aucacaagaaaaaggaagccacu

SEQ ID NO: 927971 - RNA, 16 nt, Homo sapiens
aucacaucacugcacu

SEQ ID NO: 927972 - RNA, 21 nt, Homo sapiens
aucaccccgugaagcaaucau

SEQ ID NO: 927973 - RNA, 19 nt, Homo sapiens
aucacucauuuauuuccau

SEQ ID NO: 927974 - RNA, 13 nt, Homo sapiens
aucacuuuuggac

SEQ ID NO: 927975 - RNA, 14 nt, Homo sapiens
aucagcagugauug

SEQ ID NO: 927976 - RNA, 15 nt, Homo sapiens
aucagccucuggcca

SEQ ID NO: 927977 - RNA, 18 nt, Homo sapiens
cauuugggacugucuuga

SEQ ID NO: 927978 - RNA, 22 nt, Homo sapiens
cauuuugcugcuuuaucaaaau

SEQ ID NO: 927979 - RNA, 23 nt, Homo sapiens
cauuuuuccaaaggaagugcuaa

SEQ ID NO: 927980 - RNA, 14 nt, Homo sapiens
ccaaaaaaauccau

SEQ ID NO: 927981 - RNA, 20 nt, Homo sapiens
ccaaaacacugucugcauau

SEQ ID NO: 927982 - RNA, 14 nt, Homo sapiens
ccaaaguagggaug

SEQ ID NO: 927983 - RNA, 22 nt, Homo sapiens
ccaaagugcugggauuacaggu

SEQ ID NO: 927984 - RNA, 14 nt, Homo sapiens
ccaaauacauuaac

SEQ ID NO: 927985 - RNA, 15 nt, Homo sapiens
ccaaaugcuucuaaa

SEQ ID NO: 927986 - RNA, 17 nt, Homo sapiens
ccaaauucuccuccuga

SEQ ID NO: 927987 - RNA, 14 nt, Homo sapiens
ccaacaacugucag

SEQ ID NO: 927988 - RNA, 15 nt, Homo sapiens
ccaacaacugucaga

SEQ ID NO: 927989 - RNA, 11 nt, Homo sapiens
ccaacacuuca

SEQ ID NO: 927990 - RNA, 12 nt, Homo sapiens
ccaacacuuugg

SEQ ID NO: 927991 - RNA, 21 nt, Homo sapiens
ccaacuccuggagauuucagu

SEQ ID NO: 927992 - RNA, 21 nt, Homo sapiens
ccaagaaaguccaguuuauga

SEQ ID NO: 927993 - RNA, 18 nt, Homo sapiens
ccaagaacagcaggccca

SEQ ID NO: 927994 - RNA, 18 nt, Homo sapiens
ccaagcuggccacuauca

SEQ ID NO: 927995 - RNA, 19 nt, Homo sapiens
ccaaggacacgacacacag

SEQ ID NO: 927996 - RNA, 12 nt, Homo sapiens
ccaagucuuccu

SEQ ID NO: 927997 - RNA, 16 nt, Homo sapiens
ccaagugaaugaguuu

SEQ ID NO: 927998 - RNA, 20 nt, Homo sapiens
ccaauauuuauaauuaaaga

SEQ ID NO: 927999 - RNA, 14 nt, Homo sapiens
ccaauccucaccua

SEQ ID NO: 928000 - RNA, 13 nt, Homo sapiens
ccaaucuccauca

SEQ ID NO: 928001 - RNA, 19 nt, Homo sapiens
ccaauucuucugcugccau

SEQ ID NO: 928002 - RNA, 21 nt, Homo sapiens
ccacaacuaauaggaccucaa

SEQ ID NO: 928003 - RNA, 12 nt, Homo sapiens
ccacacugggac

SEQ ID NO: 928004 - RNA, 17 nt, Homo sapiens
ccacaugccaauuucag

SEQ ID NO: 928005 - RNA, 21 nt, Homo sapiens
ccacauggggcguacuauuuu

SEQ ID NO: 928006 - RNA, 15 nt, Homo sapiens
ccacccuaccacagu

SEQ ID NO: 928007 - RNA, 15 nt, Homo sapiens
ccaccuccuucucug

SEQ ID NO: 928008 - RNA, 13 nt, Homo sapiens
ccaccuugcacua

SEQ ID NO: 928009 - RNA, 14 nt, Homo sapiens
ccacggccacugca

SEQ ID NO: 928010 - RNA, 15 nt, Homo sapiens
ccacugacaggcuuu

SEQ ID NO: 928011 - RNA, 22 nt, Homo sapiens
ccacuucccugggcaaaugaau

SEQ ID NO: 928012 - RNA, 14 nt, Homo sapiens
ccacuugauuuugc

SEQ ID NO: 928013 - RNA, 22 nt, Homo sapiens
ccagaaaguuguguaggcacca

SEQ ID NO: 928014 - RNA, 11 nt, Homo sapiens
ccagaccucaa

SEQ ID NO: 928015 - RNA, 21 nt, Homo sapiens
ccagauuaaaugaauauacug

SEQ ID NO: 928016 - RNA, 16 nt, Homo sapiens
ccagauucugugccaa

SEQ ID NO: 928017 - RNA, 14 nt, Homo sapiens
ccagcauguacaaa

SEQ ID NO: 928018 - RNA, 21 nt, Homo sapiens
ccaggaacagcaaaugcaaaa

SEQ ID NO: 928019 - RNA, 17 nt, Homo sapiens
ccaggacgcagacugac

SEQ ID NO: 928020 - RNA, 17 nt, Homo sapiens
ccaggcugcggugggca

SEQ ID NO: 928021 - RNA, 19 nt, Homo sapiens
ccaggcuggagugaucuca

SEQ ID NO: 928022 - RNA, 20 nt, Homo sapiens
ccagguagagagaccacaag

SEQ ID NO: 928023 - RNA, 19 nt, Homo sapiens
ccaguaaggcagcucuguc

SEQ ID NO: 928024 - RNA, 20 nt, Homo sapiens
ccaguguguguaacaggguc

SEQ ID NO: 928025 - RNA, 13 nt, Homo sapiens
ccaguucuuuuaa

SEQ ID NO: 928026 - RNA, 17 nt, Homo sapiens
ccaguuuauuacauuua

SEQ ID NO: 928027 - RNA, 23 nt, Homo sapiens
ccauaaagaaugcucauauuaau

SEQ ID NO: 928028 - RNA, 15 nt, Homo sapiens
ccauaagauuugcaa

SEQ ID NO: 928029 - RNA, 19 nt, Homo sapiens
ccauagguaauacaaaaag

SEQ ID NO: 928030 - RNA, 19 nt, Homo sapiens
ccauaugcaguuuacuuug

SEQ ID NO: 928031 - RNA, 16 nt, Homo sapiens
ccauccugaccagcug

SEQ ID NO: 928032 - RNA, 16 nt, Homo sapiens
ccaucuguacuuuggu

SEQ ID NO: 928033 - RNA, 21 nt, Homo sapiens
ccaugacgcacugcucaagaa

SEQ ID NO: 928034 - RNA, 13 nt, Homo sapiens
ccaugaugcauug

SEQ ID NO: 928035 - RNA, 11 nt, Homo sapiens
ccaugcaguua

SEQ ID NO: 928036 - RNA, 18 nt, Homo sapiens
ccaugguagacugugaca

SEQ ID NO: 928037 - RNA, 17 nt, Homo sapiens
ccauguggguguggcag

SEQ ID NO: 928038 - RNA, 22 nt, Homo sapiens
ccauguggguguggcaguuaca

SEQ ID NO: 928039 - RNA, 15 nt, Homo sapiens
ccauuagaagauauu

SEQ ID NO: 928040 - RNA, 22 nt, Homo sapiens
ccauuucagaugcaaucacuuu

SEQ ID NO: 928041 - RNA, 15 nt, Homo sapiens
ccauuuugugucugu

SEQ ID NO: 928042 - RNA, 18 nt, Homo sapiens
cccaacacaaggugggca

SEQ ID NO: 928043 - RNA, 22 nt, Homo sapiens
cccaaggacacgacacacagua

SEQ ID NO: 928044 - RNA, 15 nt, Homo sapiens
cccaaugcacagggc

SEQ ID NO: 928045 - RNA, 21 nt, Homo sapiens
cccacacagaucuguaauuca

SEQ ID NO: 928046 - RNA, 19 nt, Homo sapiens
cccacacuccuacaccuaa

SEQ ID NO: 928047 - RNA, 18 nt, Homo sapiens
cccacaugccaauuucag

SEQ ID NO: 928048 - RNA, 24 nt, Homo sapiens
cccagauccauucccuacaauuca

SEQ ID NO: 928049 - RNA, 15 nt, Homo sapiens
cccagcauguacaaa

SEQ ID NO: 928050 - RNA, 14 nt, Homo sapiens
cccagccucuaggg

SEQ ID NO: 928051 - RNA, 15 nt, Homo sapiens
cccagcuacucugga

SEQ ID NO: 928052 - RNA, 23 nt, Homo sapiens
cccaggagguugagaaugcagug

SEQ ID NO: 928053 - RNA, 22 nt, Homo sapiens
cccagugauggcauuacucugc

SEQ ID NO: 928054 - RNA, 12 nt, Homo sapiens
cccaucugcauu

SEQ ID NO: 928055 - RNA, 13 nt, Homo sapiens
cccaucugcauuu

SEQ ID NO: 928056 - RNA, 13 nt, Homo sapiens
cccaugaauacac

SEQ ID NO: 928057 - RNA, 18 nt, Homo sapiens
cccauuucuuaaucagug

SEQ ID NO: 928058 - RNA, 21 nt, Homo sapiens
cccccauuaaccagggcacca

SEQ ID NO: 928059 - RNA, 15 nt, Homo sapiens
ccccuaauagccuuu

SEQ ID NO: 928060 - RNA, 20 nt, Homo sapiens
ccccucuuagcuuacaggaa

SEQ ID NO: 928061 - RNA, 19 nt, Homo sapiens
ccccugaaguagaucauaa

SEQ ID NO: 928062 - RNA, 22 nt, Homo sapiens
ccccuuaggucgcgcucuugca

SEQ ID NO: 928063 - RNA, 22 nt, Homo sapiens
cccgagucgucauccccggagu

SEQ ID NO: 928064 - RNA, 19 nt, Homo sapiens
cccggcucguguauuuauu

SEQ ID NO: 928065 - RNA, 22 nt, Homo sapiens
cccuaugaacucuugauaacac

SEQ ID NO: 928066 - RNA, 23 nt, Homo sapiens
cccucacacuuugccauuugcuu

SEQ ID NO: 928067 - RNA, 13 nt, Homo sapiens
cccucagacuggg

SEQ ID NO: 928068 - RNA, 23 nt, Homo sapiens
cccucuuucagggguccuaagcc

SEQ ID NO: 928069 - RNA, 20 nt, Homo sapiens
cccugcuucaauacccaaau

SEQ ID NO: 928070 - RNA, 22 nt, Homo sapiens
cccugggcaaaugaauggcuca

SEQ ID NO: 928071 - RNA, 21 nt, Homo sapiens
cccugggugcaggacacuggu

SEQ ID NO: 928072 - RNA, 21 nt, Homo sapiens
ccgcaaauauccuccacuuuc

SEQ ID NO: 928073 - RNA, 21 nt, Homo sapiens
ccgcugcauccgugagcagug

SEQ ID NO: 928074 - RNA, 19 nt, Homo sapiens
ccggaggcaaaaggcagug

SEQ ID NO: 928075 - RNA, 16 nt, Homo sapiens
ccgguugcuucuggga

SEQ ID NO: 928076 - RNA, 23 nt, Homo sapiens
ccgguuggagccugcucuuugaa

SEQ ID NO: 928077 - RNA, 12 nt, Homo sapiens
ccguuguuguuu

SEQ ID NO: 928078 - RNA, 18 nt, Homo sapiens
ccuaacugaaaugagaug

SEQ ID NO: 928079 - RNA, 19 nt, Homo sapiens
ccuaagaacaaaacuguaa

SEQ ID NO: 928080 - RNA, 14 nt, Homo sapiens
ccuaccacaguccg

SEQ ID NO: 928081 - RNA, 11 nt, Homo sapiens
ccuauucucaa

SEQ ID NO: 928082 - RNA, 18 nt, Homo sapiens
ccuauuuuggacguguga

SEQ ID NO: 928083 - RNA, 17 nt, Homo sapiens
ccucagcaccugggacc

SEQ ID NO: 928084 - RNA, 21 nt, Homo sapiens
ccucaguuucuucaccuguaa

SEQ ID NO: 928085 - RNA, 15 nt, Homo sapiens
ccucauucuucucuc

SEQ ID NO: 928086 - RNA, 21 nt, Homo sapiens
ccucgaacuccugggcucaag

SEQ ID NO: 928087 - RNA, 18 nt, Homo sapiens
ccucguuaacacauggcu

SEQ ID NO: 928088 - RNA, 13 nt, Homo sapiens
ccucugauuucac

SEQ ID NO: 928089 - RNA, 14 nt, Homo sapiens
ccucugcggagaua

SEQ ID NO: 928090 - RNA, 14 nt, Homo sapiens
ccucuggggcucag

SEQ ID NO: 928091 - RNA, 17 nt, Homo sapiens
ccucuguccccauagcu

SEQ ID NO: 928092 - RNA, 14 nt, Homo sapiens
ccucuuauguauuu

SEQ ID NO: 928093 - RNA, 14 nt, Homo sapiens
ccucuucugugagu

SEQ ID NO: 928094 - RNA, 23 nt, Homo sapiens
ccugaacccuccaaauuugucua

SEQ ID NO: 928095 - RNA, 16 nt, Homo sapiens
ccugcaggguaggggg

SEQ ID NO: 928096 - RNA, 22 nt, Homo sapiens
ccugcaggucacugaaacuuca

SEQ ID NO: 928097 - RNA, 12 nt, Homo sapiens
ccugcuaccugu

SEQ ID NO: 928098 - RNA, 13 nt, Homo sapiens
ccuggaugagaaa

SEQ ID NO: 928099 - RNA, 16 nt, Homo sapiens
aguaaaaauaaaucaa

SEQ ID NO: 928100 - RNA, 23 nt, Homo sapiens
aguaaaacaaaaauucacaagcu

SEQ ID NO: 928101 - RNA, 12 nt, Homo sapiens
aguaaagccacg

SEQ ID NO: 928102 - RNA, 17 nt, Homo sapiens
aguacagauuguucuca

SEQ ID NO: 928103 - RNA, 12 nt, Homo sapiens
aguagcauauau

SEQ ID NO: 928104 - RNA, 21 nt, Homo sapiens
aguagcucauucuugugacuu

SEQ ID NO: 928105 - RNA, 16 nt, Homo sapiens
aguagguagacacaaa

SEQ ID NO: 928106 - RNA, 18 nt, Homo sapiens
aguaugaaaaugauuuau

SEQ ID NO: 928107 - RNA, 22 nt, Homo sapiens
aguauguauuauuuacauuuaa

SEQ ID NO: 928108 - RNA, 14 nt, Homo sapiens
aguaugugugguuu

SEQ ID NO: 928109 - RNA, 15 nt, Homo sapiens
aguauuuuucuugac

SEQ ID NO: 928110 - RNA, 13 nt, Homo sapiens
agucaugaagcuc

SEQ ID NO: 928111 - RNA, 16 nt, Homo sapiens
aguccuugaaucaccu

SEQ ID NO: 928112 - RNA, 17 nt, Homo sapiens
aguccuugaaucaccug

SEQ ID NO: 928113 - RNA, 15 nt, Homo sapiens
agucuaagcauacgu

SEQ ID NO: 928114 - RNA, 18 nt, Homo sapiens
agucucaagaacugccau

SEQ ID NO: 928115 - RNA, 22 nt, Homo sapiens
agucugccugccucggggacac

SEQ ID NO: 928116 - RNA, 16 nt, Homo sapiens
agucuuguacugugac

SEQ ID NO: 928117 - RNA, 14 nt, Homo sapiens
agugacuccugcug

SEQ ID NO: 928118 - RNA, 21 nt, Homo sapiens
agugagaaauggcagucugcc

SEQ ID NO: 928119 - RNA, 12 nt, Homo sapiens
agugauggcauu

SEQ ID NO: 928120 - RNA, 22 nt, Homo sapiens
agugcaauuucuucuguagcua

SEQ ID NO: 928121 - RNA, 20 nt, Homo sapiens
agugccaccacacucagcua

SEQ ID NO: 928122 - RNA, 20 nt, Homo sapiens
agugcugagauuacaggugu

SEQ ID NO: 928123 - RNA, 18 nt, Homo sapiens
aguggcagcaacaaagga

SEQ ID NO: 928124 - RNA, 19 nt, Homo sapiens
aguggcaucugaaaacaau

SEQ ID NO: 928125 - RNA, 12 nt, Homo sapiens
agugggccucau

SEQ ID NO: 928126 - RNA, 21 nt, Homo sapiens
aguggggaaaacuauggugga

SEQ ID NO: 928127 - RNA, 13 nt, Homo sapiens
agugguacaggaa

SEQ ID NO: 928128 - RNA, 16 nt, Homo sapiens
aguggugagacuguau

SEQ ID NO: 928129 - RNA, 20 nt, Homo sapiens
aguguauuuuauaagcauuu

SEQ ID NO: 928130 - RNA, 15 nt, Homo sapiens
agugucuaaaauacu

SEQ ID NO: 928131 - RNA, 18 nt, Homo sapiens
agugucuaaaauacuuga

SEQ ID NO: 928132 - RNA, 18 nt, Homo sapiens
aguguucaaauacuucaa

SEQ ID NO: 928133 - RNA, 11 nt, Homo sapiens
aguuacagggc

SEQ ID NO: 928134 - RNA, 17 nt, Homo sapiens
aguuaguuuguauauau

SEQ ID NO: 928135 - RNA, 16 nt, Homo sapiens
aguucauguugcucag

SEQ ID NO: 928136 - RNA, 11 nt, Homo sapiens
aguucugauga

SEQ ID NO: 928137 - RNA, 16 nt, Homo sapiens
aguugauuacuuuuca

SEQ ID NO: 928138 - RNA, 11 nt, Homo sapiens
aguuguugaaa

SEQ ID NO: 928139 - RNA, 22 nt, Homo sapiens
aguuucuugagaucugcugaca

SEQ ID NO: 928140 - RNA, 16 nt, Homo sapiens
aguuuguauauauuau

SEQ ID NO: 928141 - RNA, 13 nt, Homo sapiens
aguuuucccacau

SEQ ID NO: 928142 - RNA, 21 nt, Homo sapiens
auaaaaagauguucagucauu

SEQ ID NO: 928143 - RNA, 15 nt, Homo sapiens
auaaaaccaccaaag

SEQ ID NO: 928144 - RNA, 18 nt, Homo sapiens
auaaaagacaagcacuuu

SEQ ID NO: 928145 - RNA, 15 nt, Homo sapiens
auaaaaggauaucau

SEQ ID NO: 928146 - RNA, 18 nt, Homo sapiens
auaaaauucauuccauuu

SEQ ID NO: 928147 - RNA, 20 nt, Homo sapiens
auaaagcacuguuuggauau

SEQ ID NO: 928148 - RNA, 15 nt, Homo sapiens
auaaaguacugcaaa

SEQ ID NO: 928149 - RNA, 14 nt, Homo sapiens
auaaaugcauuaaa

SEQ ID NO: 928150 - RNA, 21 nt, Homo sapiens
auaaauuaauuugaccaucuc

SEQ ID NO: 928151 - RNA, 19 nt, Homo sapiens
auaacuggaaaaagugaaa

SEQ ID NO: 928152 - RNA, 22 nt, Homo sapiens
auaacuggcuucugcuugucau

SEQ ID NO: 928153 - RNA, 22 nt, Homo sapiens
auaacuguauuugaaauaagaa

SEQ ID NO: 928154 - RNA, 16 nt, Homo sapiens
auaacuucagauacuu

SEQ ID NO: 928155 - RNA, 23 nt, Homo sapiens
auaacuucagauacuugugaaca

SEQ ID NO: 928156 - RNA, 11 nt, Homo sapiens
auaagcauuua

SEQ ID NO: 928157 - RNA, 13 nt, Homo sapiens
auaauacaaauaa

SEQ ID NO: 928158 - RNA, 17 nt, Homo sapiens
auaauagaagacaaaga

SEQ ID NO: 928159 - RNA, 21 nt, Homo sapiens
auaauuaaaaaaaaaacuuca

SEQ ID NO: 928160 - RNA, 16 nt, Homo sapiens
auaauucuguauuaac

SEQ ID NO: 928161 - RNA, 17 nt, Homo sapiens
auacagguccugcacau

SEQ ID NO: 928162 - RNA, 19 nt, Homo sapiens
auacaugaaucauagccaa

SEQ ID NO: 928163 - RNA, 18 nt, Homo sapiens
auacauggguagcuucug

SEQ ID NO: 928164 - RNA, 19 nt, Homo sapiens
auacauggguagcuucuga

SEQ ID NO: 928165 - RNA, 16 nt, Homo sapiens
auacauuuacagcaau

SEQ ID NO: 928166 - RNA, 19 nt, Homo sapiens
auaccauuuucaauggaaa

SEQ ID NO: 928167 - RNA, 14 nt, Homo sapiens
auacuaaauaugaa

SEQ ID NO: 928168 - RNA, 13 nt, Homo sapiens
auagaaccaugaa

SEQ ID NO: 928169 - RNA, 17 nt, Homo sapiens
auagccaauacauuuac

SEQ ID NO: 928170 - RNA, 14 nt, Homo sapiens
auagccauuugccc

SEQ ID NO: 928171 - RNA, 19 nt, Homo sapiens
auaggagacuuguacaguu

SEQ ID NO: 928172 - RNA, 14 nt, Homo sapiens
auaguguguccaug

SEQ ID NO: 928173 - RNA, 21 nt, Homo sapiens
auaguuaauaacuggaaaaag

SEQ ID NO: 928174 - RNA, 22 nt, Homo sapiens
auauaagaagcuuucaguauua

SEQ ID NO: 928175 - RNA, 19 nt, Homo sapiens
auauccauaagauuugcaa

SEQ ID NO: 928176 - RNA, 15 nt, Homo sapiens
auaugaaauguauuu

SEQ ID NO: 928177 - RNA, 14 nt, Homo sapiens
auaugaagcacuuu

SEQ ID NO: 928178 - RNA, 15 nt, Homo sapiens
auauggaauuuugca

SEQ ID NO: 928179 - RNA, 17 nt, Homo sapiens
auauguagauugccuuu

SEQ ID NO: 928180 - RNA, 23 nt, Homo sapiens
auauguagauugccuuuggcaau

SEQ ID NO: 928181 - RNA, 15 nt, Homo sapiens
auauguccuauucau

SEQ ID NO: 928182 - RNA, 17 nt, Homo sapiens
auauguuuauguaacua

SEQ ID NO: 928183 - RNA, 22 nt, Homo sapiens
auauguuugcauuaaaugcuuu

SEQ ID NO: 928184 - RNA, 23 nt, Homo sapiens
auauguuuguucuuggacuuuau

SEQ ID NO: 928185 - RNA, 24 nt, Homo sapiens
auauuaaaaucacaaacucaucca

SEQ ID NO: 928186 - RNA, 16 nt, Homo sapiens
auauuaaggaaaaaag

SEQ ID NO: 928187 - RNA, 17 nt, Homo sapiens
auauuauaucacuccca

SEQ ID NO: 928188 - RNA, 12 nt, Homo sapiens
auauucccaugg

SEQ ID NO: 928189 - RNA, 14 nt, Homo sapiens
auauuugagacaaa

SEQ ID NO: 928190 - RNA, 18 nt, Homo sapiens
auauuuucugaguagcau

SEQ ID NO: 928191 - RNA, 21 nt, Homo sapiens
aucaaccaggaagaguucuau

SEQ ID NO: 928192 - RNA, 22 nt, Homo sapiens
aucaagucugugaaagucuccu

SEQ ID NO: 928193 - RNA, 20 nt, Homo sapiens
aucaccaccaccauggacaa

SEQ ID NO: 928194 - RNA, 18 nt, Homo sapiens
aucaccccgugaagcaau

SEQ ID NO: 928195 - RNA, 19 nt, Homo sapiens
aucaccugcgugucccauc

SEQ ID NO: 928196 - RNA, 12 nt, Homo sapiens
aucaccuguggg

SEQ ID NO: 928197 - RNA, 18 nt, Homo sapiens
aucacucauuuauuucca

SEQ ID NO: 928198 - RNA, 23 nt, Homo sapiens
aucacucggcuguggagaacaaa

SEQ ID NO: 928199 - RNA, 16 nt, Homo sapiens
aucagaccacauuuga

SEQ ID NO: 928200 - RNA, 17 nt, Homo sapiens
aucagaccacauuugaa

SEQ ID NO: 928201 - RNA, 16 nt, Homo sapiens
auccagcuuccuucug

SEQ ID NO: 928202 - RNA, 11 nt, Homo sapiens
auccaguuuag

SEQ ID NO: 928203 - RNA, 14 nt, Homo sapiens
auccaugugcugcu

SEQ ID NO: 928204 - RNA, 20 nt, Homo sapiens
auccaugugcugcuguggca

SEQ ID NO: 928205 - RNA, 21 nt, Homo sapiens
auccaugugcugcuguggcau

SEQ ID NO: 928206 - RNA, 15 nt, Homo sapiens
aucccaacacuuugg

SEQ ID NO: 928207 - RNA, 15 nt, Homo sapiens
aucccaauucauuuc

SEQ ID NO: 928208 - RNA, 20 nt, Homo sapiens
cucccaaagugcuaagauua

SEQ ID NO: 928209 - RNA, 17 nt, Homo sapiens
cuccccccaacacaauc

SEQ ID NO: 928210 - RNA, 12 nt, Homo sapiens
cucccuggcuca

SEQ ID NO: 928211 - RNA, 19 nt, Homo sapiens
cuccuagacucaagugauc

SEQ ID NO: 928212 - RNA, 22 nt, Homo sapiens
cuccugggagacaaagcaauaa

SEQ ID NO: 928213 - RNA, 14 nt, Homo sapiens
cucgagagugagaa

SEQ ID NO: 928214 - RNA, 20 nt, Homo sapiens
cucuaucauguugaagucaa

SEQ ID NO: 928215 - RNA, 21 nt, Homo sapiens
cucuaucauguugaagucaaa

SEQ ID NO: 928216 - RNA, 13 nt, Homo sapiens
cucucacacuggc

SEQ ID NO: 928217 - RNA, 16 nt, Homo sapiens
cucugacucccaaaga

SEQ ID NO: 928218 - RNA, 14 nt, Homo sapiens
cucugcacagacaa

SEQ ID NO: 928219 - RNA, 19 nt, Homo sapiens
cucugcacuauagccauuu

SEQ ID NO: 928220 - RNA, 17 nt, Homo sapiens
cucugccuuuguucacu

SEQ ID NO: 928221 - RNA, 15 nt, Homo sapiens
cucugugcucugaau

SEQ ID NO: 928222 - RNA, 18 nt, Homo sapiens
cucuuagauuauguucaa

SEQ ID NO: 928223 - RNA, 17 nt, Homo sapiens
cucuuagcuuacaggaa

SEQ ID NO: 928224 - RNA, 15 nt, Homo sapiens
cucuucagugacucc

SEQ ID NO: 928225 - RNA, 16 nt, Homo sapiens
cucuuccaaucuccau

SEQ ID NO: 928226 - RNA, 16 nt, Homo sapiens
cucuugcugcacuuau

SEQ ID NO: 928227 - RNA, 12 nt, Homo sapiens
cucuuguagcca

SEQ ID NO: 928228 - RNA, 19 nt, Homo sapiens
cucuuugagucaagucaaa

SEQ ID NO: 928229 - RNA, 19 nt, Homo sapiens
cugaacagcagaaacccau

SEQ ID NO: 928230 - RNA, 20 nt, Homo sapiens
cugaacaguguuggcuuuca

SEQ ID NO: 928231 - RNA, 20 nt, Homo sapiens
cugaacauaguagauugaca

SEQ ID NO: 928232 - RNA, 16 nt, Homo sapiens
cugaagacaaaccacu

SEQ ID NO: 928233 - RNA, 22 nt, Homo sapiens
cugaagucucaagaacugccau

SEQ ID NO: 928234 - RNA, 19 nt, Homo sapiens
cugaccccgaccucagaga

SEQ ID NO: 928235 - RNA, 22 nt, Homo sapiens
cugaccucaagcaaccaugaac

SEQ ID NO: 928236 - RNA, 18 nt, Homo sapiens
cugacgaggcugggccaa

SEQ ID NO: 928237 - RNA, 17 nt, Homo sapiens
cugacugccaagccaga

SEQ ID NO: 928238 - RNA, 16 nt, Homo sapiens
cugacuguugcuguaa

SEQ ID NO: 928239 - RNA, 17 nt, Homo sapiens
cugacuguugcuguaaa

SEQ ID NO: 928240 - RNA, 20 nt, Homo sapiens
cugacuugguucugaagcca

SEQ ID NO: 928241 - RNA, 22 nt, Homo sapiens
cugagaacagaucuccaaagcu

SEQ ID NO: 928242 - RNA, 16 nt, Homo sapiens
cugagcaggggaacaa

SEQ ID NO: 928243 - RNA, 17 nt, Homo sapiens
cugagcccuaaacacac

SEQ ID NO: 928244 - RNA, 22 nt, Homo sapiens
cugagcuuuggacgcacacagc

SEQ ID NO: 928245 - RNA, 18 nt, Homo sapiens
cugagucccagcaauucu

SEQ ID NO: 928246 - RNA, 20 nt, Homo sapiens
cugauauacuugagugugca

SEQ ID NO: 928247 - RNA, 21 nt, Homo sapiens
ucaccugcacagggcccucug

SEQ ID NO: 928248 - RNA, 21 nt, Homo sapiens
ucaccugcgcagggcccucug

SEQ ID NO: 928249 - RNA, 21 nt, Homo sapiens
ucaccugugcagggcccucug

SEQ ID NO: 928250 - RNA, 15 nt, Homo sapiens
ucacuaggaggucau

SEQ ID NO: 928251 - RNA, 17 nt, Homo sapiens
ucacuauggugccaaug

SEQ ID NO: 928252 - RNA, 16 nt, Homo sapiens
ucacugaaacuucaag

SEQ ID NO: 928253 - RNA, 11 nt, Homo sapiens
ucacugugagu

SEQ ID NO: 928254 - RNA, 17 nt, Homo sapiens
ucagacugcaagugagc

SEQ ID NO: 928255 - RNA, 18 nt, Homo sapiens
ucagacuuaaaauuccac

SEQ ID NO: 928256 - RNA, 15 nt, Homo sapiens
ucagagcuacuuggg

SEQ ID NO: 928257 - RNA, 15 nt, Homo sapiens
ucagaggccuaguca

SEQ ID NO: 928258 - RNA, 20 nt, Homo sapiens
ucagauacuugugaacaugc

SEQ ID NO: 928259 - RNA, 16 nt, Homo sapiens
ucagcaccugggaccc

SEQ ID NO: 928260 - RNA, 23 nt, Homo sapiens
ucagcauagugacuaaacuacau

SEQ ID NO: 928261 - RNA, 14 nt, Homo sapiens
ucagcccugagcua

SEQ ID NO: 928262 - RNA, 19 nt, Homo sapiens
ucagcucuggagaacagug

SEQ ID NO: 928263 - RNA, 18 nt, Homo sapiens
ucagcucuggcucacaga

SEQ ID NO: 928264 - RNA, 19 nt, Homo sapiens
ucaggaaaggaagauguaa

SEQ ID NO: 928265 - RNA, 21 nt, Homo sapiens
ucaggacacccuacacaaaau

SEQ ID NO: 928266 - RNA, 11 nt, Homo sapiens
ucaggccaaag

SEQ ID NO: 928267 - RNA, 15 nt, Homo sapiens
ucaguaaauuuugga

SEQ ID NO: 928268 - RNA, 23 nt, Homo sapiens
ucaguaauagcugaaccuguuca

SEQ ID NO: 928269 - RNA, 17 nt, Homo sapiens
ucaguacccaccugagc

SEQ ID NO: 928270 - RNA, 19 nt, Homo sapiens
ucauaaagguuuacaguga

SEQ ID NO: 928271 - RNA, 21 nt, Homo sapiens
ucauaaagguuuacagugaau

SEQ ID NO: 928272 - RNA, 20 nt, Homo sapiens
ucauaccuguuguacacuug

SEQ ID NO: 928273 - RNA, 18 nt, Homo sapiens
ucauagccaaaaacuuuu

SEQ ID NO: 928274 - RNA, 13 nt, Homo sapiens
ucauaucaagaaa

SEQ ID NO: 928275 - RNA, 19 nt, Homo sapiens
ucaucaccccgugaagcaa

SEQ ID NO: 928276 - RNA, 14 nt, Homo sapiens
ucauccuuagcaac

SEQ ID NO: 928277 - RNA, 18 nt, Homo sapiens
ucaucguucuaaaaucaa

SEQ ID NO: 928278 - RNA, 19 nt, Homo sapiens
ucaugccacugcacugcag

SEQ ID NO: 928279 - RNA, 15 nt, Homo sapiens
ucauggcagucccaa

SEQ ID NO: 928280 - RNA, 12 nt, Homo sapiens
ucauguucucau

SEQ ID NO: 928281 - RNA, 15 nt, Homo sapiens
ucauguuugugcaug

SEQ ID NO: 928282 - RNA, 19 nt, Homo sapiens
ucauuauuacguggcaaaa

SEQ ID NO: 928283 - RNA, 17 nt, Homo sapiens
ucauucaagagucucau

SEQ ID NO: 928284 - RNA, 22 nt, Homo sapiens
ucauuccaccauggcuaaggca

SEQ ID NO: 928285 - RNA, 17 nt, Homo sapiens
uccaaaggaagugcuaa

SEQ ID NO: 928286 - RNA, 14 nt, Homo sapiens
uccaagccaaauac

SEQ ID NO: 928287 - RNA, 16 nt, Homo sapiens
uccaaucuccaucacc

SEQ ID NO: 928288 - RNA, 14 nt, Homo sapiens
uccacaacaguccc

SEQ ID NO: 928289 - RNA, 17 nt, Homo sapiens
uccaccccacucacaga

SEQ ID NO: 928290 - RNA, 22 nt, Homo sapiens
uccacgagaccaugaugcauug

SEQ ID NO: 928291 - RNA, 14 nt, Homo sapiens
uccacugucuuuaa

SEQ ID NO: 928292 - RNA, 17 nt, Homo sapiens
uccaggaaaguggccaa

SEQ ID NO: 928293 - RNA, 23 nt, Homo sapiens
uccaggggcuucacccaugaaau

SEQ ID NO: 928294 - RNA, 17 nt, Homo sapiens
uccaguccugcucucua

SEQ ID NO: 928295 - RNA, 20 nt, Homo sapiens
uccaguguguguaacagggu

SEQ ID NO: 928296 - RNA, 15 nt, Homo sapiens
uccauaaagcacauu

SEQ ID NO: 928297 - RNA, 18 nt, Homo sapiens
uccauagccaauacauuu

SEQ ID NO: 928298 - RNA, 18 nt, Homo sapiens
uccauguucuauuucagu

SEQ ID NO: 928299 - RNA, 19 nt, Homo sapiens
uccauuuugugucugugaa

SEQ ID NO: 928300 - RNA, 22 nt, Homo sapiens
ucccaaaauacuacacauccaa

SEQ ID NO: 928301 - RNA, 15 nt, Homo sapiens
ucccaaauacauuaa

SEQ ID NO: 928302 - RNA, 16 nt, Homo sapiens
ucccaauucauuucau

SEQ ID NO: 928303 - RNA, 21 nt, Homo sapiens
ucccaccgguugcuucuggga

SEQ ID NO: 928304 - RNA, 23 nt, Homo sapiens
ucccaccgguugcuucugggaag

SEQ ID NO: 928305 - RNA, 23 nt, Homo sapiens
ucccagugucuaauucccuguua

SEQ ID NO: 928306 - RNA, 14 nt, Homo sapiens
ucccaucugcauuu

SEQ ID NO: 928307 - RNA, 17 nt, Homo sapiens
ucccaucugcauuugau

SEQ ID NO: 928308 - RNA, 13 nt, Homo sapiens
ucccaugauuucu

SEQ ID NO: 928309 - RNA, 21 nt, Homo sapiens
uccccaggguucaguccucaa

SEQ ID NO: 928310 - RNA, 14 nt, Homo sapiens
uccccuggacauau

SEQ ID NO: 928311 - RNA, 15 nt, Homo sapiens
uccccuggacauauu

SEQ ID NO: 928312 - RNA, 15 nt, Homo sapiens
uccccuggcaacugc

SEQ ID NO: 928313 - RNA, 18 nt, Homo sapiens
ucccuacagggugucugu

SEQ ID NO: 928314 - RNA, 21 nt, Homo sapiens
ucccuauacagagguccugcc

SEQ ID NO: 928315 - RNA, 15 nt, Homo sapiens
ucccucauguucuca

SEQ ID NO: 928316 - RNA, 20 nt, Homo sapiens
ucccugccaagaacucuggg

SEQ ID NO: 928317 - RNA, 22 nt, Homo sapiens
uccuagcugugugcagucucuc

SEQ ID NO: 928318 - RNA, 21 nt, Homo sapiens
uccuaugcgcucaugagcguc

SEQ ID NO: 928319 - RNA, 20 nt, Homo sapiens
uccuauucugggcaaauaga

SEQ ID NO: 928320 - RNA, 18 nt, Homo sapiens
uccucaaagauucugcau

SEQ ID NO: 928321 - RNA, 23 nt, Homo sapiens
uccucgacaucuuccuccucuac

SEQ ID NO: 928322 - RNA, 14 nt, Homo sapiens
uccucuacugguaa

SEQ ID NO: 928323 - RNA, 13 nt, Homo sapiens
uccucuccaagcu

SEQ ID NO: 928324 - RNA, 15 nt, Homo sapiens
uccugcccgcccucc

SEQ ID NO: 928325 - RNA, 15 nt, Homo sapiens
uccugcgcauggugc

SEQ ID NO: 928326 - RNA, 19 nt, Homo sapiens
uccugcgcauggugcagug

SEQ ID NO: 928327 - RNA, 16 nt, Homo sapiens
uccuggaaugcauuca

SEQ ID NO: 928328 - RNA, 20 nt, Homo sapiens
uccuggccacauucaccaac

SEQ ID NO: 928329 - RNA, 16 nt, Homo sapiens
cuucuaauccaugugc

SEQ ID NO: 928330 - RNA, 15 nt, Homo sapiens
cuucucaagcacuga

SEQ ID NO: 928331 - RNA, 19 nt, Homo sapiens
cuucucaagcacugacacu

SEQ ID NO: 928332 - RNA, 14 nt, Homo sapiens
cuucuccacaggga

SEQ ID NO: 928333 - RNA, 15 nt, Homo sapiens
cuucuccacagggac

SEQ ID NO: 928334 - RNA, 18 nt, Homo sapiens
cuucuccccuccaaguga

SEQ ID NO: 928335 - RNA, 19 nt, Homo sapiens
cuugaaagugaacaaucag

SEQ ID NO: 928336 - RNA, 15 nt, Homo sapiens
cuugaauacuuugag

SEQ ID NO: 928337 - RNA, 22 nt, Homo sapiens
cuugaaucaggaggagauuaac

SEQ ID NO: 928338 - RNA, 23 nt, Homo sapiens
cuugaguugaguauuacacauua

SEQ ID NO: 928339 - RNA, 17 nt, Homo sapiens
cuugcacaaacuccauc

SEQ ID NO: 928340 - RNA, 16 nt, Homo sapiens
cuugccccaaaucuca

SEQ ID NO: 928341 - RNA, 17 nt, Homo sapiens
cuugcucucaaugcagg

SEQ ID NO: 928342 - RNA, 23 nt, Homo sapiens
cuuggaauagcuuguacacauau

SEQ ID NO: 928343 - RNA, 13 nt, Homo sapiens
cuugggaaacuuc

SEQ ID NO: 928344 - RNA, 16 nt, Homo sapiens
cuuggucauuugccaa

SEQ ID NO: 928345 - RNA, 16 nt, Homo sapiens
cuuggugccacagagg

SEQ ID NO: 928346 - RNA, 22 nt, Homo sapiens
cuugguggccgggggugggggc

SEQ ID NO: 928347 - RNA, 20 nt, Homo sapiens
cuugguugucuggcaaggac

SEQ ID NO: 928348 - RNA, 23 nt, Homo sapiens
cuuguacacauauacauaugauc

SEQ ID NO: 928349 - RNA, 19 nt, Homo sapiens
cuuguaccauuucacaaac

SEQ ID NO: 928350 - RNA, 17 nt, Homo sapiens
cuuguuuucuacuuugc

SEQ ID NO: 928351 - RNA, 19 nt, Homo sapiens
cuuguuuucuacuuugcca

SEQ ID NO: 928352 - RNA, 20 nt, Homo sapiens
cuuguuuucuacuuugccac

SEQ ID NO: 928353 - RNA, 17 nt, Homo sapiens
cuuuaaucacauucaau

SEQ ID NO: 928354 - RNA, 16 nt, Homo sapiens
cuuuccaagucauuuu

SEQ ID NO: 928355 - RNA, 18 nt, Homo sapiens
cuuuccagcaguauccuc

SEQ ID NO: 928356 - RNA, 12 nt, Homo sapiens
cuuucuaccuga

SEQ ID NO: 928357 - RNA, 16 nt, Homo sapiens
cuuucuccugugccca

SEQ ID NO: 928358 - RNA, 20 nt, Homo sapiens
cuuucuucaauacaaaaagc

SEQ ID NO: 928359 - RNA, 17 nt, Homo sapiens
cuuugagcgagcccauu

SEQ ID NO: 928360 - RNA, 20 nt, Homo sapiens
cuuugguccucugauuucac

SEQ ID NO: 928361 - RNA, 19 nt, Homo sapiens
cuuugugcaggguccuccg

SEQ ID NO: 928362 - RNA, 20 nt, Homo sapiens
cuuuugaauaauguagugca

SEQ ID NO: 928363 - RNA, 13 nt, Homo sapiens
cuuuugccuuuug

SEQ ID NO: 928364 - RNA, 23 nt, Homo sapiens
cuuuuuagguacaguaaaacaau

SEQ ID NO: 928365 - RNA, 18 nt, Homo sapiens
cuuuuuguuuuuuagcau

SEQ ID NO: 928366 - RNA, 13 nt, Homo sapiens
gaaaaaagcaagu

SEQ ID NO: 928367 - RNA, 20 nt, Homo sapiens
gaaaaacaaaaacuacuuug

SEQ ID NO: 928368 - RNA, 12 nt, Homo sapiens
gaaaaaccuguu

SEQ ID NO: 928369 - RNA, 18 nt, Homo sapiens
gaaaaauaguguguccau

SEQ ID NO: 928370 - RNA, 20 nt, Homo sapiens
gaaaaccgaguaucuggccu

SEQ ID NO: 928371 - RNA, 22 nt, Homo sapiens
ucugaaccauauccauguugcu

SEQ ID NO: 928372 - RNA, 13 nt, Homo sapiens
ucugaacugcaca

SEQ ID NO: 928373 - RNA, 13 nt, Homo sapiens
ucugacaguacca

SEQ ID NO: 928374 - RNA, 15 nt, Homo sapiens
ucugacucccaaaga

SEQ ID NO: 928375 - RNA, 22 nt, Homo sapiens
ucugacucccaaagagcugccu

SEQ ID NO: 928376 - RNA, 19 nt, Homo sapiens
ucugauuucacauauugca

SEQ ID NO: 928377 - RNA, 19 nt, Homo sapiens
ucugcauauccauaagaau

SEQ ID NO: 928378 - RNA, 16 nt, Homo sapiens
ucugcauuuucugggu

SEQ ID NO: 928379 - RNA, 22 nt, Homo sapiens
ucugccgugagagcccaaucac

SEQ ID NO: 928380 - RNA, 15 nt, Homo sapiens
ucugccucauggcaa

SEQ ID NO: 928381 - RNA, 14 nt, Homo sapiens
ucugccuuuguuca

SEQ ID NO: 928382 - RNA, 18 nt, Homo sapiens
ucuggaacauucugucau

SEQ ID NO: 928383 - RNA, 13 nt, Homo sapiens
ucuggacacuggg

SEQ ID NO: 928384 - RNA, 13 nt, Homo sapiens
ucuggacauuuca

SEQ ID NO: 928385 - RNA, 18 nt, Homo sapiens
ucuggagugugugggggu

SEQ ID NO: 928386 - RNA, 15 nt, Homo sapiens
ucuggcccacacaga

SEQ ID NO: 928387 - RNA, 21 nt, Homo sapiens
ucuggcccuguugugggggug

SEQ ID NO: 928388 - RNA, 20 nt, Homo sapiens
ucuggcuccuguguggaguu

SEQ ID NO: 928389 - RNA, 20 nt, Homo sapiens
ucugguugguaaagccucag

SEQ ID NO: 928390 - RNA, 18 nt, Homo sapiens
ucuguaauucacuaggcu

SEQ ID NO: 928391 - RNA, 23 nt, Homo sapiens
ucugucagugggccucaugguaa

SEQ ID NO: 928392 - RNA, 20 nt, Homo sapiens
ucuuagaacagauggcugug

SEQ ID NO: 928393 - RNA, 16 nt, Homo sapiens
ucuuagcuuacaggaa

SEQ ID NO: 928394 - RNA, 21 nt, Homo sapiens
ucuuauccugucccuccucca

SEQ ID NO: 928395 - RNA, 20 nt, Homo sapiens
ucuucaauacaaaaagccaa

SEQ ID NO: 928396 - RNA, 22 nt, Homo sapiens
ucuucacacuaucaacacugca

SEQ ID NO: 928397 - RNA, 22 nt, Homo sapiens
ucuucauuuauuuugacuguga

SEQ ID NO: 928398 - RNA, 22 nt, Homo sapiens
ucuuccaaucuccaucaccuuu

SEQ ID NO: 928399 - RNA, 17 nt, Homo sapiens
ucuuccuggaaugcauu

SEQ ID NO: 928400 - RNA, 16 nt, Homo sapiens
ucuucggagguggcag

SEQ ID NO: 928401 - RNA, 19 nt, Homo sapiens
ucuucuaucuacgcccuuc

SEQ ID NO: 928402 - RNA, 16 nt, Homo sapiens
ucuucucaagcacuga

SEQ ID NO: 928403 - RNA, 23 nt, Homo sapiens
ucuucugagcuaaggcagccuuc

SEQ ID NO: 928404 - RNA, 19 nt, Homo sapiens
ucuucuuucuacaguauua

SEQ ID NO: 928405 - RNA, 19 nt, Homo sapiens
ucuugagcccaggaguuca

SEQ ID NO: 928406 - RNA, 10 nt, Homo sapiens
ucuugccuug

SEQ ID NO: 928407 - RNA, 15 nt, Homo sapiens
ucuugggaaaauauc

SEQ ID NO: 928408 - RNA, 16 nt, Homo sapiens
ucuuguaaaccuggag

SEQ ID NO: 928409 - RNA, 14 nt, Homo sapiens
ucuuguacugugac

SEQ ID NO: 928410 - RNA, 18 nt, Homo sapiens
ucuugugugcauugcugu

SEQ ID NO: 928411 - RNA, 12 nt, Homo sapiens
ucuuuaaucaca

SEQ ID NO: 928412 - RNA, 19 nt, Homo sapiens
ucuuuaguguucaaauacu

SEQ ID NO: 928413 - RNA, 21 nt, Homo sapiens
ugaaaacagcagcaaugcaau

SEQ ID NO: 928414 - RNA, 22 nt, Homo sapiens
ugaaaagagaggauauguucac

SEQ ID NO: 928415 - RNA, 15 nt, Homo sapiens
ugaaaauuauggcug

SEQ ID NO: 928416 - RNA, 14 nt, Homo sapiens
ugaaaccccaucuc

SEQ ID NO: 928417 - RNA, 21 nt, Homo sapiens
ugaaaccccaucuccacuaaa

SEQ ID NO: 928418 - RNA, 21 nt, Homo sapiens
ugaaacuugguucccagaaaa

SEQ ID NO: 928419 - RNA, 19 nt, Homo sapiens
ugaaauaauauugauuucu

SEQ ID NO: 928420 - RNA, 15 nt, Homo sapiens
ugaaauaugugauuu

SEQ ID NO: 928421 - RNA, 21 nt, Homo sapiens
ugaaaucccaucugcauuuga

SEQ ID NO: 928422 - RNA, 20 nt, Homo sapiens
ugaacaacucgaaucacuca

SEQ ID NO: 928423 - RNA, 19 nt, Homo sapiens
ugaacaaucagcggcauuu

SEQ ID NO: 928424 - RNA, 16 nt, Homo sapiens
ugaacacaaagccugu

SEQ ID NO: 928425 - RNA, 19 nt, Homo sapiens
ugaaccaauaugaacugca

SEQ ID NO: 928426 - RNA, 14 nt, Homo sapiens
ugaacucagcuauu

SEQ ID NO: 928427 - RNA, 16 nt, Homo sapiens
ugaacugcacaaugca

SEQ ID NO: 928428 - RNA, 14 nt, Homo sapiens
ugaagacaaaccac

SEQ ID NO: 928429 - RNA, 18 nt, Homo sapiens
ugaagacgaagaagcaag

SEQ ID NO: 928430 - RNA, 14 nt, Homo sapiens
ugaagcaaucauuu

SEQ ID NO: 928431 - RNA, 11 nt, Homo sapiens
ugaagcacuuu

SEQ ID NO: 928432 - RNA, 19 nt, Homo sapiens
ugaagccugucguguucuc

SEQ ID NO: 928433 - RNA, 18 nt, Homo sapiens
ugaaguagaguguuggaa

SEQ ID NO: 928434 - RNA, 15 nt, Homo sapiens
ugaaguauugcuaau

SEQ ID NO: 928435 - RNA, 16 nt, Homo sapiens
ugaagugccagaucaa

SEQ ID NO: 928436 - RNA, 17 nt, Homo sapiens
ugaauaauguagugcag

SEQ ID NO: 928437 - RNA, 21 nt, Homo sapiens
ugaaugccucgcucccuucaa

SEQ ID NO: 928438 - RNA, 19 nt, Homo sapiens
ugaauucaaagcaugucaa

SEQ ID NO: 928439 - RNA, 16 nt, Homo sapiens
ugacaccaaaccugcc

SEQ ID NO: 928440 - RNA, 21 nt, Homo sapiens
ugaccccuuccugucuggccc

SEQ ID NO: 928441 - RNA, 15 nt, Homo sapiens
ugaccuucucuuaga

SEQ ID NO: 928442 - RNA, 15 nt, Homo sapiens
ugacuaauucaggga

SEQ ID NO: 928443 - RNA, 17 nt, Homo sapiens
ugacugaaggacaucug

SEQ ID NO: 928444 - RNA, 18 nt, Homo sapiens
ugacugaaggacaucuga

SEQ ID NO: 928445 - RNA, 16 nt, Homo sapiens
ugacugccaagccaga

SEQ ID NO: 928446 - RNA, 16 nt, Homo sapiens
ugacuuacagugccaa

SEQ ID NO: 928447 - RNA, 17 nt, Homo sapiens
ugacuuccuuauugguu

SEQ ID NO: 928448 - RNA, 19 nt, Homo sapiens
ugacuucuaguccaaauau

SEQ ID NO: 928449 - RNA, 13 nt, Homo sapiens
ugagaaaacagau

SEQ ID NO: 928450 - RNA, 13 nt, Homo sapiens
ugagaaacagcuc

SEQ ID NO: 928451 - RNA, 18 nt, Homo sapiens
ugagaauauuaauugugg

SEQ ID NO: 928452 - RNA, 17 nt, Homo sapiens
ugagaauucagcugccc

SEQ ID NO: 928453 - RNA, 20 nt, Homo sapiens
ugagacagccggaucuugga

SEQ ID NO: 928454 - RNA, 14 nt, Homo sapiens
ugagacuacaggug

SEQ ID NO: 928455 - RNA, 13 nt, Homo sapiens
ugagauggggaca

SEQ ID NO: 928456 - RNA, 12 nt, Homo sapiens
ugagcaccugua

SEQ ID NO: 928457 - RNA, 13 nt, Homo sapiens
ugagccacuggag

SEQ ID NO: 928458 - RNA, 20 nt, Homo sapiens
ugagcuaaggcagccuucag

SEQ ID NO: 928459 - RNA, 20 nt, Homo sapiens
ugagcugagaucacaccacu

SEQ ID NO: 928460 - RNA, 22 nt, Homo sapiens
ugagcuuuggacgcacacagcu

SEQ ID NO: 928461 - RNA, 20 nt, Homo sapiens
ugaggagucuugugugcauu

SEQ ID NO: 928462 - RNA, 13 nt, Homo sapiens
ugaguacccaaaa

SEQ ID NO: 928463 - RNA, 13 nt, Homo sapiens
ugagucacuugaa

SEQ ID NO: 928464 - RNA, 13 nt, Homo sapiens
ugauaaaccaaaa

SEQ ID NO: 928465 - RNA, 15 nt, Homo sapiens
ugaucgcacaaggac

SEQ ID NO: 928466 - RNA, 21 nt, Homo sapiens
ugauggcuuaaaaauacuuaa

SEQ ID NO: 928467 - RNA, 14 nt, Homo sapiens
ugauuccauuuuaa

SEQ ID NO: 928468 - RNA, 18 nt, Homo sapiens
ugauucgaaggaugaaga

SEQ ID NO: 928469 - RNA, 21 nt, Homo sapiens
ugauuuaucuaucaccauuac

SEQ ID NO: 928470 - RNA, 18 nt, Homo sapiens
ugcaaaaagguaccaaaa

SEQ ID NO: 928471 - RNA, 12 nt, Homo sapiens
ugcaaagcugcu

SEQ ID NO: 928472 - RNA, 14 nt, Homo sapiens
ugcaacagcacuug

SEQ ID NO: 928473 - RNA, 18 nt, Homo sapiens
ugcaaccuaguacuuuau

SEQ ID NO: 928474 - RNA, 23 nt, Homo sapiens
ugcaagauuccuuuccacuccaa

SEQ ID NO: 928475 - RNA, 15 nt, Homo sapiens
ugcacaaguacagua

SEQ ID NO: 928476 - RNA, 15 nt, Homo sapiens
ugcacuauagccauu

SEQ ID NO: 928477 - RNA, 21 nt, Homo sapiens
ugcagaaacuaccagauuuga

SEQ ID NO: 928478 - RNA, 21 nt, Homo sapiens
ugcagacguuaugaucuugcu

SEQ ID NO: 928479 - RNA, 14 nt, Homo sapiens
ugcagagacagcug

SEQ ID NO: 928480 - RNA, 22 nt, Homo sapiens
ugcagcauuuugcugcuuuauc

SEQ ID NO: 928481 - RNA, 14 nt, Homo sapiens
ugcaggacauguau

SEQ ID NO: 928482 - RNA, 12 nt, Homo sapiens
ugcagggccauc

SEQ ID NO: 928483 - RNA, 17 nt, Homo sapiens
ugcagugagcuaagauc

SEQ ID NO: 928484 - RNA, 17 nt, Homo sapiens
ugcagugccccuagcuu

SEQ ID NO: 928485 - RNA, 18 nt, Homo sapiens
ugcaguugucaccaaaua

SEQ ID NO: 928486 - RNA, 21 nt, Homo sapiens
ugcauaaaagacaagcacuuu

SEQ ID NO: 928487 - RNA, 21 nt, Homo sapiens
ugcaucccaccagccugagca

SEQ ID NO: 928488 - RNA, 21 nt, Homo sapiens
ugcaugcuuuucucuugcuaa

SEQ ID NO: 928489 - RNA, 21 nt, Homo sapiens
ugcauuucuucacgcaccucg

SEQ ID NO: 928490 - RNA, 16 nt, Homo sapiens
ugccaacccuguguca

SEQ ID NO: 928491 - RNA, 12 nt, Homo sapiens
ugccaagccaga

SEQ ID NO: 928492 - RNA, 17 nt, Homo sapiens
ugcccaaccucagcaac

SEQ ID NO: 928493 - RNA, 21 nt, Homo sapiens
ugcccagcaguuucccagaau

SEQ ID NO: 928494 - RNA, 16 nt, Homo sapiens
gaaaaggcacgcuggc

SEQ ID NO: 928495 - RNA, 14 nt, Homo sapiens
gaaaauugccaaaa

SEQ ID NO: 928496 - RNA, 23 nt, Homo sapiens
gaaacauuuacuuuugcuuucua

SEQ ID NO: 928497 - RNA, 22 nt, Homo sapiens
gaaacccuguuuuauugaguuc

SEQ ID NO: 928498 - RNA, 22 nt, Homo sapiens
gaaacuccaccuauuuugcaaa

SEQ ID NO: 928499 - RNA, 16 nt, Homo sapiens
gaaacuucaagcacca

SEQ ID NO: 928500 - RNA, 18 nt, Homo sapiens
gaaagaggcaccaggaag

SEQ ID NO: 928501 - RNA, 13 nt, Homo sapiens
gaaagcauugcca

SEQ ID NO: 928502 - RNA, 23 nt, Homo sapiens
gaaagggagcagagaaggccagg

SEQ ID NO: 928503 - RNA, 13 nt, Homo sapiens
gaaaguacuauga

SEQ ID NO: 928504 - RNA, 21 nt, Homo sapiens
gaaagugcaaagugcccucau

SEQ ID NO: 928505 - RNA, 19 nt, Homo sapiens
gaaaguuacuguuaagggu

SEQ ID NO: 928506 - RNA, 23 nt, Homo sapiens
gaaauaagaauucagacaucuga

SEQ ID NO: 928507 - RNA, 17 nt, Homo sapiens
gaaauacuuaaugccaa

SEQ ID NO: 928508 - RNA, 13 nt, Homo sapiens
gaaauaugugauu

SEQ ID NO: 928509 - RNA, 15 nt, Homo sapiens
gaaaugguuuccauc

SEQ ID NO: 928510 - RNA, 23 nt, Homo sapiens
gaaaugguuuccaucuguacuuu

SEQ ID NO: 928511 - RNA, 17 nt, Homo sapiens
gaacacaggcaaugacu

SEQ ID NO: 928512 - RNA, 13 nt, Homo sapiens
gaaccagcaguug

SEQ ID NO: 928513 - RNA, 15 nt, Homo sapiens
gaaccuggcugcgaa

SEQ ID NO: 928514 - RNA, 17 nt, Homo sapiens
gaacucugggcacuuuu

SEQ ID NO: 928515 - RNA, 15 nt, Homo sapiens
gaagaaagacacaaa

SEQ ID NO: 928516 - RNA, 17 nt, Homo sapiens
gaagacccuugugcauu

SEQ ID NO: 928517 - RNA, 23 nt, Homo sapiens
gaagaccucguuuucuaaaggcu

SEQ ID NO: 928518 - RNA, 13 nt, Homo sapiens
gaagagucauuuu

SEQ ID NO: 928519 - RNA, 18 nt, Homo sapiens
gaagagucccccaugaca

SEQ ID NO: 928520 - RNA, 10 nt, Homo sapiens
gaagcacuuu

SEQ ID NO: 928521 - RNA, 23 nt, Homo sapiens
gaagcacuuucucuuaacuuaau

SEQ ID NO: 928522 - RNA, 17 nt, Homo sapiens
gaagccagccacagacc

SEQ ID NO: 928523 - RNA, 18 nt, Homo sapiens
gaaggcaguggcagggga

SEQ ID NO: 928524 - RNA, 14 nt, Homo sapiens
gaaggcucugggau

SEQ ID NO: 928525 - RNA, 12 nt, Homo sapiens
gaaggugccacu

SEQ ID NO: 928526 - RNA, 22 nt, Homo sapiens
gaagugaugauuguaaguccca

SEQ ID NO: 928527 - RNA, 18 nt, Homo sapiens
gaaguguuuguaauccca

SEQ ID NO: 928528 - RNA, 12 nt, Homo sapiens
gaauagcaguuu

SEQ ID NO: 928529 - RNA, 18 nt, Homo sapiens
gaauaggcauuaaaugca

SEQ ID NO: 928530 - RNA, 24 nt, Homo sapiens
gaaucacgauuuucuacaccuguc

SEQ ID NO: 928531 - RNA, 20 nt, Homo sapiens
gaaucacucauuuauuucca

SEQ ID NO: 928532 - RNA, 19 nt, Homo sapiens
gaaucauauguuguaggaa

SEQ ID NO: 928533 - RNA, 15 nt, Homo sapiens
gaaugacccugucaa

SEQ ID NO: 928534 - RNA, 17 nt, Homo sapiens
gaaugaguuuccagcua

SEQ ID NO: 928535 - RNA, 22 nt, Homo sapiens
gaaugaguuuccagcuaagccu

SEQ ID NO: 928536 - RNA, 22 nt, Homo sapiens
gaaugcauugcaucaucaccau

SEQ ID NO: 928537 - RNA, 17 nt, Homo sapiens
gaauggccuuucaccuu

SEQ ID NO: 928538 - RNA, 20 nt, Homo sapiens
gaauggccuuucaccuucuc

SEQ ID NO: 928539 - RNA, 15 nt, Homo sapiens
gaauggggaccuggg

SEQ ID NO: 928540 - RNA, 15 nt, Homo sapiens
gaauucugaacuuuu

SEQ ID NO: 928541 - RNA, 11 nt, Homo sapiens
gacaaaccucu

SEQ ID NO: 928542 - RNA, 15 nt, Homo sapiens
gacacacacagcuuc

SEQ ID NO: 928543 - RNA, 22 nt, Homo sapiens
gacacagggcauccaacugaga

SEQ ID NO: 928544 - RNA, 14 nt, Homo sapiens
gacagaaaugccac

SEQ ID NO: 928545 - RNA, 11 nt, Homo sapiens
gacagcaguuu

SEQ ID NO: 928546 - RNA, 19 nt, Homo sapiens
gacaggacagcauggugca

SEQ ID NO: 928547 - RNA, 18 nt, Homo sapiens
gacaggauuucacugugu

SEQ ID NO: 928548 - RNA, 16 nt, Homo sapiens
gacaucuggacacugg

SEQ ID NO: 928549 - RNA, 17 nt, Homo sapiens
gacaucuggacacuggg

SEQ ID NO: 928550 - RNA, 17 nt, Homo sapiens
gacauuuuaagcauuuu

SEQ ID NO: 928551 - RNA, 18 nt, Homo sapiens
gaccaauuagcauuccau

SEQ ID NO: 928552 - RNA, 15 nt, Homo sapiens
gaccaccuugcacua

SEQ ID NO: 928553 - RNA, 21 nt, Homo sapiens
gaccggaggcaaaaggcagug

SEQ ID NO: 928554 - RNA, 20 nt, Homo sapiens
gaccuaaaauuugcccuccc

SEQ ID NO: 928555 - RNA, 23 nt, Homo sapiens
gaccuaacugccgcucagagugu

SEQ ID NO: 928556 - RNA, 14 nt, Homo sapiens
gaccucccacuuug

SEQ ID NO: 928557 - RNA, 13 nt, Homo sapiens
gaccugacacaau

SEQ ID NO: 928558 - RNA, 13 nt, Homo sapiens
gaccuggaaccag

SEQ ID NO: 928559 - RNA, 15 nt, Homo sapiens
gacgugugaggaugu

SEQ ID NO: 928560 - RNA, 12 nt, Homo sapiens
gacuacauugaa

SEQ ID NO: 928561 - RNA, 14 nt, Homo sapiens
gacuacauugaaac

SEQ ID NO: 928562 - RNA, 13 nt, Homo sapiens
gacuaggucaauu

SEQ ID NO: 928563 - RNA, 20 nt, Homo sapiens
gacucaagugauccuccugu

SEQ ID NO: 928564 - RNA, 18 nt, Homo sapiens
gacucuuugcaacagcac

SEQ ID NO: 928565 - RNA, 15 nt, Homo sapiens
gacugccaagccaga

SEQ ID NO: 928566 - RNA, 20 nt, Homo sapiens
gacugcuuuuuugccucaca

SEQ ID NO: 928567 - RNA, 14 nt, Homo sapiens
gacuucacacagca

SEQ ID NO: 928568 - RNA, 19 nt, Homo sapiens
gagaaaacagauaaugaua

SEQ ID NO: 928569 - RNA, 21 nt, Homo sapiens
gagaagcaaauauguuugcau

SEQ ID NO: 928570 - RNA, 20 nt, Homo sapiens
gagacacacuuaacuacuua

SEQ ID NO: 928571 - RNA, 17 nt, Homo sapiens
gagaccuggaaccagag

SEQ ID NO: 928572 - RNA, 19 nt, Homo sapiens
ugggcuuggggacagaaau

SEQ ID NO: 928573 - RNA, 12 nt, Homo sapiens
uggggaacucaa

SEQ ID NO: 928574 - RNA, 20 nt, Homo sapiens
uggggacagaaaugccacuc

SEQ ID NO: 928575 - RNA, 17 nt, Homo sapiens
uggggauguaaccaagc

SEQ ID NO: 928576 - RNA, 16 nt, Homo sapiens
ugggggaaauggugcc

SEQ ID NO: 928577 - RNA, 14 nt, Homo sapiens
ugggucccagcuaa

SEQ ID NO: 928578 - RNA, 14 nt, Homo sapiens
ugggugaaggugac

SEQ ID NO: 928579 - RNA, 12 nt, Homo sapiens
ugggugagaaau

SEQ ID NO: 928580 - RNA, 18 nt, Homo sapiens
ugggugcaggacacuggu

SEQ ID NO: 928581 - RNA, 19 nt, Homo sapiens
uggucacgacuucuucgga

SEQ ID NO: 928582 - RNA, 21 nt, Homo sapiens
uggucaggcacugaagcuccu

SEQ ID NO: 928583 - RNA, 23 nt, Homo sapiens
uggucugccucugagccacugga

SEQ ID NO: 928584 - RNA, 14 nt, Homo sapiens
uggugagcaccugu

SEQ ID NO: 928585 - RNA, 21 nt, Homo sapiens
uggugccuauuuauucauuca

SEQ ID NO: 928586 - RNA, 17 nt, Homo sapiens
ugguguaaaaaacaaac

SEQ ID NO: 928587 - RNA, 13 nt, Homo sapiens
ugguucccagaaa

SEQ ID NO: 928588 - RNA, 19 nt, Homo sapiens
ugguuuggcuuccuauucu

SEQ ID NO: 928589 - RNA, 21 nt, Homo sapiens
uguaaaaaacaaacauuugaa

SEQ ID NO: 928590 - RNA, 19 nt, Homo sapiens
uguaaacaaucagaccaca

SEQ ID NO: 928591 - RNA, 21 nt, Homo sapiens
uguaaaggaacaacugauaua

SEQ ID NO: 928592 - RNA, 14 nt, Homo sapiens
uguaaauacaauuc

SEQ ID NO: 928593 - RNA, 20 nt, Homo sapiens
uguaacaugacacauuugaa

SEQ ID NO: 928594 - RNA, 16 nt, Homo sapiens
uguaacugcauuagaa

SEQ ID NO: 928595 - RNA, 12 nt, Homo sapiens
uguacagccuuu

SEQ ID NO: 928596 - RNA, 15 nt, Homo sapiens
uguacucuacugaua

SEQ ID NO: 928597 - RNA, 15 nt, Homo sapiens
uguacugugcugauu

SEQ ID NO: 928598 - RNA, 18 nt, Homo sapiens
uguacuuaaauuacacau

SEQ ID NO: 928599 - RNA, 15 nt, Homo sapiens
uguagauaaagcacu

SEQ ID NO: 928600 - RNA, 19 nt, Homo sapiens
uguagccagggacucccca

SEQ ID NO: 928601 - RNA, 18 nt, Homo sapiens
uguaggaaaagcuguucc

SEQ ID NO: 928602 - RNA, 19 nt, Homo sapiens
uguagguggagagguggaa

SEQ ID NO: 928603 - RNA, 14 nt, Homo sapiens
uguaguuuguauua

SEQ ID NO: 928604 - RNA, 13 nt, Homo sapiens
uguaugauaaaca

SEQ ID NO: 928605 - RNA, 17 nt, Homo sapiens
uguauuaaccuaccugu

SEQ ID NO: 928606 - RNA, 20 nt, Homo sapiens
uguauuuuggucauauugcc

SEQ ID NO: 928607 - RNA, 23 nt, Homo sapiens
ugucaaccuugugugagugugac

SEQ ID NO: 928608 - RNA, 17 nt, Homo sapiens
ugucaauggacugcacc

SEQ ID NO: 928609 - RNA, 18 nt, Homo sapiens
ugucagaauaaagaacau

SEQ ID NO: 928610 - RNA, 20 nt, Homo sapiens
ugucagugggccucauggua

SEQ ID NO: 928611 - RNA, 14 nt, Homo sapiens
ugucauccaccagu

SEQ ID NO: 928612 - RNA, 17 nt, Homo sapiens
ugucaucugucacuaua

SEQ ID NO: 928613 - RNA, 19 nt, Homo sapiens
ugucauggcucugaacugc

SEQ ID NO: 928614 - RNA, 22 nt, Homo sapiens
ugucuaagaauaaugacguauu

SEQ ID NO: 928615 - RNA, 20 nt, Homo sapiens
ugucugcugcucccagccac

SEQ ID NO: 928616 - RNA, 21 nt, Homo sapiens
ugugaccccuccccagugccu

SEQ ID NO: 928617 - RNA, 19 nt, Homo sapiens
ugugacggggguuggggug

SEQ ID NO: 928618 - RNA, 16 nt, Homo sapiens
gaugccuccucugucc

SEQ ID NO: 928619 - RNA, 14 nt, Homo sapiens
gaugccugcagugc

SEQ ID NO: 928620 - RNA, 14 nt, Homo sapiens
gaugcuuaggugaa

SEQ ID NO: 928621 - RNA, 15 nt, Homo sapiens
gauguagacauuuua

SEQ ID NO: 928622 - RNA, 14 nt, Homo sapiens
gaugucuaagacag

SEQ ID NO: 928623 - RNA, 20 nt, Homo sapiens
gauguuucaccaaggaaaua

SEQ ID NO: 928624 - RNA, 15 nt, Homo sapiens
gauuacaggugugag

SEQ ID NO: 928625 - RNA, 12 nt, Homo sapiens
gauuauucugua

SEQ ID NO: 928626 - RNA, 13 nt, Homo sapiens
gauucaacacaua

SEQ ID NO: 928627 - RNA, 15 nt, Homo sapiens
gauuccccuggacau

SEQ ID NO: 928628 - RNA, 17 nt, Homo sapiens
gauuccuuuccacucca

SEQ ID NO: 928629 - RNA, 23 nt, Homo sapiens
gauuccuuuccacuccaaccaga

SEQ ID NO: 928630 - RNA, 20 nt, Homo sapiens
gauugcaaagggacauugaa

SEQ ID NO: 928631 - RNA, 20 nt, Homo sapiens
gauuguaagucccaugaaua

SEQ ID NO: 928632 - RNA, 15 nt, Homo sapiens
gauuuaaaacaucuc

SEQ ID NO: 928633 - RNA, 15 nt, Homo sapiens
gauuucaaagcaagu

SEQ ID NO: 928634 - RNA, 15 nt, Homo sapiens
gauuucacugacacu

SEQ ID NO: 928635 - RNA, 18 nt, Homo sapiens
gauuucaguuacuuaccu

SEQ ID NO: 928636 - RNA, 21 nt, Homo sapiens
gauuucaguuacuuaccugca

SEQ ID NO: 928637 - RNA, 15 nt, Homo sapiens
gauuuugaacauacu

SEQ ID NO: 928638 - RNA, 15 nt, Homo sapiens
gauuuuuauuugaaa

SEQ ID NO: 928639 - RNA, 17 nt, Homo sapiens
gcaaaaaacuaauguga

SEQ ID NO: 928640 - RNA, 14 nt, Homo sapiens
gcaaaaccaaagaa

SEQ ID NO: 928641 - RNA, 17 nt, Homo sapiens
gcaaaugaauggcucac

SEQ ID NO: 928642 - RNA, 16 nt, Homo sapiens
gcaaauuccaauacau

SEQ ID NO: 928643 - RNA, 15 nt, Homo sapiens
gcaaccuaguacuuu

SEQ ID NO: 928644 - RNA, 21 nt, Homo sapiens
gcaacguguaacuugugcuuu

SEQ ID NO: 928645 - RNA, 11 nt, Homo sapiens
gcaacuggaaa

SEQ ID NO: 928646 - RNA, 19 nt, Homo sapiens
gcaagaccuugauugcacc

SEQ ID NO: 928647 - RNA, 17 nt, Homo sapiens
gcaagauuccuuuccac

SEQ ID NO: 928648 - RNA, 16 nt, Homo sapiens
gcaagcaaagaaccca

SEQ ID NO: 928649 - RNA, 14 nt, Homo sapiens
gcaagcgcacuuga

SEQ ID NO: 928650 - RNA, 19 nt, Homo sapiens
gcaauacggaacacuguca

SEQ ID NO: 928651 - RNA, 20 nt, Homo sapiens
gcaauacggaacacugucaa

SEQ ID NO: 928652 - RNA, 19 nt, Homo sapiens
gcaauugucuuguaccuug

SEQ ID NO: 928653 - RNA, 16 nt, Homo sapiens
gcacaaaagccucuca

SEQ ID NO: 928654 - RNA, 16 nt, Homo sapiens
gcacaaggacauuugg

SEQ ID NO: 928655 - RNA, 15 nt, Homo sapiens
gcacagcuaauucua

SEQ ID NO: 928656 - RNA, 18 nt, Homo sapiens
gcacccagccucuaggga

SEQ ID NO: 928657 - RNA, 16 nt, Homo sapiens
gcaccucugugcugca

SEQ ID NO: 928658 - RNA, 18 nt, Homo sapiens
gcacgcuggcuugugauc

SEQ ID NO: 928659 - RNA, 12 nt, Homo sapiens
gcacgugcaaua

SEQ ID NO: 928660 - RNA, 22 nt, Homo sapiens
gcacuaaucaauacuuugaaca

SEQ ID NO: 928661 - RNA, 23 nt, Homo sapiens
gcacucagcuauaccucauucac

SEQ ID NO: 928662 - RNA, 13 nt, Homo sapiens
gcacugacacuca

SEQ ID NO: 928663 - RNA, 17 nt, Homo sapiens
gcagcuccgccuggcac

SEQ ID NO: 928664 - RNA, 14 nt, Homo sapiens
gcagcugaacagug

SEQ ID NO: 928665 - RNA, 19 nt, Homo sapiens
gcagcuucgugugcagcua

SEQ ID NO: 928666 - RNA, 13 nt, Homo sapiens
gcaggacacuggu

SEQ ID NO: 928667 - RNA, 19 nt, Homo sapiens
gcaggcaaagucugaaguc

SEQ ID NO: 928668 - RNA, 15 nt, Homo sapiens
gcaggcagccuugac

SEQ ID NO: 928669 - RNA, 17 nt, Homo sapiens
gcaggcugagugcacug

SEQ ID NO: 928670 - RNA, 18 nt, Homo sapiens
gcagggaaggacaggacc

SEQ ID NO: 928671 - RNA, 23 nt, Homo sapiens
gcaggggcugggcagaggggaga

SEQ ID NO: 928672 - RNA, 18 nt, Homo sapiens
gcaggugcuccucgagag

SEQ ID NO: 928673 - RNA, 15 nt, Homo sapiens
gcagguugaucagug

SEQ ID NO: 928674 - RNA, 20 nt, Homo sapiens
gcagucugccugccucgggg

SEQ ID NO: 928675 - RNA, 15 nt, Homo sapiens
gcaguucauacugaa

SEQ ID NO: 928676 - RNA, 14 nt, Homo sapiens
gcauagcuggacau

SEQ ID NO: 928677 - RNA, 17 nt, Homo sapiens
gcaucagccucuggcca

SEQ ID NO: 928678 - RNA, 12 nt, Homo sapiens
gcauccacagga

SEQ ID NO: 928679 - RNA, 16 nt, Homo sapiens
gcaugaggaucaguuu

SEQ ID NO: 928680 - RNA, 22 nt, Homo sapiens
gcaugguggugagcaccuguaa

SEQ ID NO: 928681 - RNA, 23 nt, Homo sapiens
gcauguauauuacugauuuacaa

SEQ ID NO: 928682 - RNA, 14 nt, Homo sapiens
gcauuaaaugcuuu

SEQ ID NO: 928683 - RNA, 23 nt, Homo sapiens
gcauuacucugcacuauagccau

SEQ ID NO: 928684 - RNA, 18 nt, Homo sapiens
gcauuagaaaccaugaaa

SEQ ID NO: 928685 - RNA, 15 nt, Homo sapiens
gcauucaauuuacag

SEQ ID NO: 928686 - RNA, 21 nt, Homo sapiens
gcauucugagcaggggaacaa

SEQ ID NO: 928687 - RNA, 15 nt, Homo sapiens
gcauuuaauguagcc

SEQ ID NO: 928688 - RNA, 18 nt, Homo sapiens
gcauuucuucacgcaccu

SEQ ID NO: 928689 - RNA, 21 nt, Homo sapiens
gccaaccagaauaaaauaacc

SEQ ID NO: 928690 - RNA, 23 nt, Homo sapiens
gccaacuuuuagugggugagaaa

SEQ ID NO: 928691 - RNA, 18 nt, Homo sapiens
gccaaguaacaaugcaug

SEQ ID NO: 928692 - RNA, 17 nt, Homo sapiens
gccacaucccagucaca

SEQ ID NO: 928693 - RNA, 14 nt, Homo sapiens
gccaccaacauaaa

SEQ ID NO: 928694 - RNA, 17 nt, Homo sapiens
ucgggacuucaaaauca

SEQ ID NO: 928695 - RNA, 15 nt, Homo sapiens
ucuaaaauacuugag

SEQ ID NO: 928696 - RNA, 22 nt, Homo sapiens
ucuaaauaauaauaaaacaaca

SEQ ID NO: 928697 - RNA, 17 nt, Homo sapiens
ucuaaaucucuaucucu

SEQ ID NO: 928698 - RNA, 16 nt, Homo sapiens
ucuaacccacccucac

SEQ ID NO: 928699 - RNA, 14 nt, Homo sapiens
ucuaauccaugugc

SEQ ID NO: 928700 - RNA, 21 nt, Homo sapiens
ucuaauccaugugcugcugug

SEQ ID NO: 928701 - RNA, 13 nt, Homo sapiens
ucuacuacagggu

SEQ ID NO: 928702 - RNA, 22 nt, Homo sapiens
ucuacuagaaccuucuaaucca

SEQ ID NO: 928703 - RNA, 12 nt, Homo sapiens
ucuagauuugau

SEQ ID NO: 928704 - RNA, 22 nt, Homo sapiens
ucuaggucaguacccaccugag

SEQ ID NO: 928705 - RNA, 14 nt, Homo sapiens
ucuauauaguguau

SEQ ID NO: 928706 - RNA, 15 nt, Homo sapiens
ucuauauccauaacu

SEQ ID NO: 928707 - RNA, 14 nt, Homo sapiens
ucuaucaccuguca

SEQ ID NO: 928708 - RNA, 17 nt, Homo sapiens
ucuauggcauauugaua

SEQ ID NO: 928709 - RNA, 22 nt, Homo sapiens
ucuaugggguucguuaugccaa

SEQ ID NO: 928710 - RNA, 18 nt, Homo sapiens
ucuauggguaucaaacag

SEQ ID NO: 928711 - RNA, 17 nt, Homo sapiens
ucuauuucagugccaau

SEQ ID NO: 928712 - RNA, 20 nt, Homo sapiens
ucucaaacuccugaccucag

SEQ ID NO: 928713 - RNA, 22 nt, Homo sapiens
ucucaacuucucagacguucca

SEQ ID NO: 928714 - RNA, 15 nt, Homo sapiens
ucucaagaacugcca

SEQ ID NO: 928715 - RNA, 17 nt, Homo sapiens
ucucaagaacugccaua

SEQ ID NO: 928716 - RNA, 21 nt, Homo sapiens
ucucaagcacugacacucauu

SEQ ID NO: 928717 - RNA, 14 nt, Homo sapiens
ucucaauauauuca

SEQ ID NO: 928718 - RNA, 18 nt, Homo sapiens
ucucacgcugccauuucc

SEQ ID NO: 928719 - RNA, 17 nt, Homo sapiens
ucucauuuuguauguau

SEQ ID NO: 928720 - RNA, 13 nt, Homo sapiens
ucuccacagggac

SEQ ID NO: 928721 - RNA, 14 nt, Homo sapiens
ucuccaggggccug

SEQ ID NO: 928722 - RNA, 13 nt, Homo sapiens
ucuccaucaccuu

SEQ ID NO: 928723 - RNA, 19 nt, Homo sapiens
ucuccccucguuaacacau

SEQ ID NO: 928724 - RNA, 23 nt, Homo sapiens
ucuccuaaccaaggugcacugag

SEQ ID NO: 928725 - RNA, 13 nt, Homo sapiens
ucuccugugccca

SEQ ID NO: 928726 - RNA, 16 nt, Homo sapiens
ucucgaagcaguauuc

SEQ ID NO: 928727 - RNA, 22 nt, Homo sapiens
ucucgaagcaguauucuaguga

SEQ ID NO: 928728 - RNA, 17 nt, Homo sapiens
ucucgcuagccauauau

SEQ ID NO: 928729 - RNA, 17 nt, Homo sapiens
ucucuacuaaaaauaca

SEQ ID NO: 928730 - RNA, 13 nt, Homo sapiens
ucucuacugguag

SEQ ID NO: 928731 - RNA, 21 nt, Homo sapiens
ucucuaucauguugaagucaa

SEQ ID NO: 928732 - RNA, 21 nt, Homo sapiens
ucucucugaacacacauugcu

SEQ ID NO: 928733 - RNA, 16 nt, Homo sapiens
ucucuucggaagaccu

SEQ ID NO: 928734 - RNA, 19 nt, Homo sapiens
ucucuuugagucaagucaa

SEQ ID NO: 928735 - RNA, 14 nt, Homo sapiens
ucucuuuuaaucua

SEQ ID NO: 928736 - RNA, 17 nt, Homo sapiens
ucucuuuuccacugaca

SEQ ID NO: 928737 - RNA, 19 nt, Homo sapiens
ucugaacugcacaaugcau

SEQ ID NO: 928738 - RNA, 12 nt, Homo sapiens
ucugaccucagc

SEQ ID NO: 928739 - RNA, 16 nt, Homo sapiens
ucugacucccaaagag

SEQ ID NO: 928740 - RNA, 19 nt, Homo sapiens
ucugacucccaaagagcug

SEQ ID NO: 928741 - RNA, 16 nt, Homo sapiens
ucugcuaauacagguc

SEQ ID NO: 928742 - RNA, 21 nt, Homo sapiens
ucugcuaauacagguccugca

SEQ ID NO: 928743 - RNA, 23 nt, Homo sapiens
ucugcugccaugagaaaagggaa

SEQ ID NO: 928744 - RNA, 12 nt, Homo sapiens
ucuggacacugg

SEQ ID NO: 928745 - RNA, 14 nt, Homo sapiens
ucuggacauuucau

SEQ ID NO: 928746 - RNA, 20 nt, Homo sapiens
ucuggcccuguugugggggu

SEQ ID NO: 928747 - RNA, 15 nt, Homo sapiens
ucugguagcuccaca

SEQ ID NO: 928748 - RNA, 20 nt, Homo sapiens
ucugguagcuccacaagaga

SEQ ID NO: 928749 - RNA, 15 nt, Homo sapiens
ucuggugggaaaaug

SEQ ID NO: 928750 - RNA, 14 nt, Homo sapiens
ucuguaauucacua

SEQ ID NO: 928751 - RNA, 21 nt, Homo sapiens
ucuguagcuauucuuugacca

SEQ ID NO: 928752 - RNA, 17 nt, Homo sapiens
ucuguccucuucuguga

SEQ ID NO: 928753 - RNA, 17 nt, Homo sapiens
ugcuugcccccaugugg

SEQ ID NO: 928754 - RNA, 16 nt, Homo sapiens
uggaaaaauccuguca

SEQ ID NO: 928755 - RNA, 18 nt, Homo sapiens
uggaaagcauauacuaua

SEQ ID NO: 928756 - RNA, 15 nt, Homo sapiens
uggaaaguacuauga

SEQ ID NO: 928757 - RNA, 22 nt, Homo sapiens
uggaaauggccaccaccauucu

SEQ ID NO: 928758 - RNA, 17 nt, Homo sapiens
uggaacugcugccauga

SEQ ID NO: 928759 - RNA, 18 nt, Homo sapiens
uggaagggccuucuccac

SEQ ID NO: 928760 - RNA, 15 nt, Homo sapiens
uggaaugaauacagc

SEQ ID NO: 928761 - RNA, 16 nt, Homo sapiens
uggaaugccauuugca

SEQ ID NO: 928762 - RNA, 16 nt, Homo sapiens
uggagaaagagcugcc

SEQ ID NO: 928763 - RNA, 23 nt, Homo sapiens
uggagaagggugguuuccugcca

SEQ ID NO: 928764 - RNA, 23 nt, Homo sapiens
uggagccaccugucccaccucaa

SEQ ID NO: 928765 - RNA, 18 nt, Homo sapiens
uggagugaucucagcuca

SEQ ID NO: 928766 - RNA, 20 nt, Homo sapiens
uggaugggggaaauggugcc

SEQ ID NO: 928767 - RNA, 17 nt, Homo sapiens
uggauugggagauuuca

SEQ ID NO: 928768 - RNA, 20 nt, Homo sapiens
uggauuuaauaccauuuuca

SEQ ID NO: 928769 - RNA, 21 nt, Homo sapiens
uggcacuugcaagucccauga

SEQ ID NO: 928770 - RNA, 23 nt, Homo sapiens
uggcauucgcagugcccagugau

SEQ ID NO: 928771 - RNA, 22 nt, Homo sapiens
uggccaagaagcaguggccuua

SEQ ID NO: 928772 - RNA, 14 nt, Homo sapiens
uggccgcuucccua

SEQ ID NO: 928773 - RNA, 13 nt, Homo sapiens
uggccucaccugg

SEQ ID NO: 928774 - RNA, 14 nt, Homo sapiens
uggcggaaccuggc

SEQ ID NO: 928775 - RNA, 18 nt, Homo sapiens
uggcggaaccuggcugcg

SEQ ID NO: 928776 - RNA, 15 nt, Homo sapiens
uggcucacaccugua

SEQ ID NO: 928777 - RNA, 17 nt, Homo sapiens
uggcucacuauggugcc

SEQ ID NO: 928778 - RNA, 15 nt, Homo sapiens
uggcucugaacugca

SEQ ID NO: 928779 - RNA, 17 nt, Homo sapiens
uggcucugaacugcaca

SEQ ID NO: 928780 - RNA, 14 nt, Homo sapiens
uggcugauuuagac

SEQ ID NO: 928781 - RNA, 20 nt, Homo sapiens
uggcugccugcaccccagga

SEQ ID NO: 928782 - RNA, 19 nt, Homo sapiens
uggcuucugcuugucaucc

SEQ ID NO: 928783 - RNA, 18 nt, Homo sapiens
ugggaaggaaacaaccau

SEQ ID NO: 928784 - RNA, 16 nt, Homo sapiens
ugggaagggguuucua

SEQ ID NO: 928785 - RNA, 14 nt, Homo sapiens
ugggaaguguacag

SEQ ID NO: 928786 - RNA, 18 nt, Homo sapiens
ugggacgggaugguucug

SEQ ID NO: 928787 - RNA, 17 nt, Homo sapiens
ugggacugaugucaucu

SEQ ID NO: 928788 - RNA, 17 nt, Homo sapiens
ugggagacaaagcaaua

SEQ ID NO: 928789 - RNA, 17 nt, Homo sapiens
ugggauccgcauccagc

SEQ ID NO: 928790 - RNA, 18 nt, Homo sapiens
ugggauguauauugcuau

SEQ ID NO: 928791 - RNA, 13 nt, Homo sapiens
ugggauuacaggu

SEQ ID NO: 928792 - RNA, 23 nt, Homo sapiens
ugggauuacaggugugagccacc

SEQ ID NO: 928793 - RNA, 15 nt, Homo sapiens
ugggccaaucacuga

SEQ ID NO: 928794 - RNA, 20 nt, Homo sapiens
ugggcccagaggcacagccg

SEQ ID NO: 928795 - RNA, 15 nt, Homo sapiens
ugggcuuggggacag

SEQ ID NO: 928796 - RNA, 23 nt, Homo sapiens
uggggaacucaaaggacugaccu

SEQ ID NO: 928797 - RNA, 21 nt, Homo sapiens
uggggaauucugaggaggaaa

SEQ ID NO: 928798 - RNA, 14 nt, Homo sapiens
uggggacuaaggga

SEQ ID NO: 928799 - RNA, 17 nt, Homo sapiens
uggggagaucggggcca

SEQ ID NO: 928800 - RNA, 18 nt, Homo sapiens
uggggcuccugcuucccc

SEQ ID NO: 928801 - RNA, 12 nt, Homo sapiens
ugggggauuuca

SEQ ID NO: 928802 - RNA, 16 nt, Homo sapiens
uggggugugacacuuu

SEQ ID NO: 928803 - RNA, 13 nt, Homo sapiens
uggguaacagagu

SEQ ID NO: 928804 - RNA, 16 nt, Homo sapiens
ugggugcccacagccc

SEQ ID NO: 928805 - RNA, 15 nt, Homo sapiens
ugguagacugugaca

SEQ ID NO: 928806 - RNA, 20 nt, Homo sapiens
uggucaggaaguuugcagau

SEQ ID NO: 928807 - RNA, 20 nt, Homo sapiens
uggucugccucugagccacu

SEQ ID NO: 928808 - RNA, 21 nt, Homo sapiens
ugguguuuuuuuuccaaaaac

SEQ ID NO: 928809 - RNA, 23 nt, Homo sapiens
ugguucuuuuaccccacgaagac

SEQ ID NO: 928810 - RNA, 14 nt, Homo sapiens
ugguuuaaaccaaa

SEQ ID NO: 928811 - RNA, 17 nt, Homo sapiens
ugguuucuauacaugaa

SEQ ID NO: 928812 - RNA, 21 nt, Homo sapiens
uguaaaauaaaaccaccaaag

SEQ ID NO: 928813 - RNA, 22 nt, Homo sapiens
uguaacacagucuggcaguugc

SEQ ID NO: 928814 - RNA, 15 nt, Homo sapiens
uguaacuugugcuuu

SEQ ID NO: 928815 - RNA, 22 nt, Homo sapiens
uguaagucccaugaauacacaa

SEQ ID NO: 928816 - RNA, 18 nt, Homo sapiens
uguaaucccaguacuugg

SEQ ID NO: 928817 - RNA, 21 nt, Homo sapiens
uguaauuaguaauaaaaccca

SEQ ID NO: 928818 - RNA, 17 nt, Homo sapiens
uguacugugaccuaaga

SEQ ID NO: 928819 - RNA, 15 nt, Homo sapiens
uguauucccagccug

SEQ ID NO: 928820 - RNA, 13 nt, Homo sapiens
uguccuaugcgcu

SEQ ID NO: 928821 - RNA, 19 nt, Homo sapiens
uuaguguucaaauacuuca

SEQ ID NO: 928822 - RNA, 20 nt, Homo sapiens
uuaguguucaaauacuucaa

SEQ ID NO: 928823 - RNA, 14 nt, Homo sapiens
uuauaagcauuuaa

SEQ ID NO: 928824 - RNA, 22 nt, Homo sapiens
uuaugauucagugcauuuucaa

SEQ ID NO: 928825 - RNA, 21 nt, Homo sapiens
uuaugcucaccugacauuaau

SEQ ID NO: 928826 - RNA, 17 nt, Homo sapiens
uuauuacuccuugccau

SEQ ID NO: 928827 - RNA, 15 nt, Homo sapiens
uuauuaucuucuuaa

SEQ ID NO: 928828 - RNA, 18 nt, Homo sapiens
uuauucuagggucuuacu

SEQ ID NO: 928829 - RNA, 13 nt, Homo sapiens
uuauuuaacccuu

SEQ ID NO: 928830 - RNA, 15 nt, Homo sapiens
uucaaacaauucaau

SEQ ID NO: 928831 - RNA, 21 nt, Homo sapiens
uucaaauccucccuacuucca

SEQ ID NO: 928832 - RNA, 18 nt, Homo sapiens
uucaaccacauuugcuag

SEQ ID NO: 928833 - RNA, 22 nt, Homo sapiens
uucaagcgacucuccugccuca

SEQ ID NO: 928834 - RNA, 22 nt, Homo sapiens
uucaagggcugcuucaaacuca

SEQ ID NO: 928835 - RNA, 13 nt, Homo sapiens
uucaauacccaaa

SEQ ID NO: 928836 - RNA, 19 nt, Homo sapiens
uucaaucaaagcuaccuuu

SEQ ID NO: 928837 - RNA, 12 nt, Homo sapiens
uucaauuuacag

SEQ ID NO: 928838 - RNA, 17 nt, Homo sapiens
uucacacuauccagcua

SEQ ID NO: 928839 - RNA, 22 nt, Homo sapiens
uucacacuuugcccuaugacau

SEQ ID NO: 928840 - RNA, 13 nt, Homo sapiens
uucacauauugca

SEQ ID NO: 928841 - RNA, 16 nt, Homo sapiens
uucacuaggaggucau

SEQ ID NO: 928842 - RNA, 19 nt, Homo sapiens
uucacucuggcauaugauu

SEQ ID NO: 928843 - RNA, 15 nt, Homo sapiens
uucagauacuuguga

SEQ ID NO: 928844 - RNA, 23 nt, Homo sapiens
uuccacacccccaccccuugcuc

SEQ ID NO: 928845 - RNA, 17 nt, Homo sapiens
uuccacuccaaccagaa

SEQ ID NO: 928846 - RNA, 14 nt, Homo sapiens
uuccaucaauuuua

SEQ ID NO: 928847 - RNA, 15 nt, Homo sapiens
uuccaucuguacuuu

SEQ ID NO: 928848 - RNA, 18 nt, Homo sapiens
uuccauggauuccccugg

SEQ ID NO: 928849 - RNA, 15 nt, Homo sapiens
uucccaaauacauua

SEQ ID NO: 928850 - RNA, 15 nt, Homo sapiens
uucccaaggccaguc

SEQ ID NO: 928851 - RNA, 21 nt, Homo sapiens
uucccuggaccagaugcugaa

SEQ ID NO: 928852 - RNA, 19 nt, Homo sapiens
uuccuccauggcccaucac

SEQ ID NO: 928853 - RNA, 14 nt, Homo sapiens
uuccuccuuauccu

SEQ ID NO: 928854 - RNA, 23 nt, Homo sapiens
uuccugcgcauggugcagugccg

SEQ ID NO: 928855 - RNA, 17 nt, Homo sapiens
uuccuggaaugcauuca

SEQ ID NO: 928856 - RNA, 21 nt, Homo sapiens
uuccugugccugugacucucc

SEQ ID NO: 928857 - RNA, 18 nt, Homo sapiens
uuccuucaaauccugcca

SEQ ID NO: 928858 - RNA, 15 nt, Homo sapiens
uucgcugagucccag

SEQ ID NO: 928859 - RNA, 12 nt, Homo sapiens
uucggaagaccu

SEQ ID NO: 928860 - RNA, 13 nt, Homo sapiens
uucuacaguauua

SEQ ID NO: 928861 - RNA, 13 nt, Homo sapiens
uucuacuuugcca

SEQ ID NO: 928862 - RNA, 13 nt, Homo sapiens
uucuaggugcccg

SEQ ID NO: 928863 - RNA, 21 nt, Homo sapiens
uucuaggugcccgaguagcau

SEQ ID NO: 928864 - RNA, 14 nt, Homo sapiens
uucuauucagcaaa

SEQ ID NO: 928865 - RNA, 19 nt, Homo sapiens
uucuccauuacaguguaaa

SEQ ID NO: 928866 - RNA, 19 nt, Homo sapiens
uucuccuguguaucuuuga

SEQ ID NO: 928867 - RNA, 19 nt, Homo sapiens
uucucgacucuuugcaaca

SEQ ID NO: 928868 - RNA, 20 nt, Homo sapiens
uucucuacagcaccuuaaaa

SEQ ID NO: 928869 - RNA, 13 nt, Homo sapiens
uucucuugcuaau

SEQ ID NO: 928870 - RNA, 18 nt, Homo sapiens
uucuuggaugauugcagu

SEQ ID NO: 928871 - RNA, 23 nt, Homo sapiens
uucuugggaaaauaucacuuugu

SEQ ID NO: 928872 - RNA, 17 nt, Homo sapiens
uucuuuaaucacauuca

SEQ ID NO: 928873 - RNA, 20 nt, Homo sapiens
uucuuucaacauuucuugaa

SEQ ID NO: 928874 - RNA, 12 nt, Homo sapiens
uugaacauacuu

SEQ ID NO: 928875 - RNA, 12 nt, Homo sapiens
uugaaccuucaa

SEQ ID NO: 928876 - RNA, 23 nt, Homo sapiens
uugaaccuucaaagcuuuuguaa

SEQ ID NO: 928877 - RNA, 14 nt, Homo sapiens
uugaacuccugacc

SEQ ID NO: 928878 - RNA, 18 nt, Homo sapiens
uugaagacuuagugcugu

SEQ ID NO: 928879 - RNA, 14 nt, Homo sapiens
uugaauacuuugag

SEQ ID NO: 928880 - RNA, 19 nt, Homo sapiens
uugaauccgaagaaugaca

SEQ ID NO: 928881 - RNA, 19 nt, Homo sapiens
uugagaccuggaaccagag

SEQ ID NO: 928882 - RNA, 18 nt, Homo sapiens
uugagcccaggaguucaa

SEQ ID NO: 928883 - RNA, 20 nt, Homo sapiens
uugagggacgaggucaagga

SEQ ID NO: 928884 - RNA, 17 nt, Homo sapiens
uugaguugaguauuaca

SEQ ID NO: 928885 - RNA, 13 nt, Homo sapiens
uugaugaauuugg

SEQ ID NO: 928886 - RNA, 14 nt, Homo sapiens
uugauucuaugacu

SEQ ID NO: 928887 - RNA, 18 nt, Homo sapiens
uugcaaccuaguacuuua

SEQ ID NO: 928888 - RNA, 17 nt, Homo sapiens
uugcaguuauuucaaaa

SEQ ID NO: 928889 - RNA, 21 nt, Homo sapiens
uugcccaggcuggagugcagu

SEQ ID NO: 928890 - RNA, 20 nt, Homo sapiens
uugccugggggcuuuugcca

SEQ ID NO: 928891 - RNA, 14 nt, Homo sapiens
uugccuugagcucu

SEQ ID NO: 928892 - RNA, 23 nt, Homo sapiens
uugcuaaauauaaaaacauaaau

SEQ ID NO: 928893 - RNA, 20 nt, Homo sapiens
uugcuacaaauagugcuaau

SEQ ID NO: 928894 - RNA, 20 nt, Homo sapiens
uuugaaaauuugcugauucu

SEQ ID NO: 928895 - RNA, 20 nt, Homo sapiens
uuugaacaacucgaaucacu

SEQ ID NO: 928896 - RNA, 11 nt, Homo sapiens
uuugaacacaa

SEQ ID NO: 928897 - RNA, 11 nt, Homo sapiens
uuugaccaguu

SEQ ID NO: 928898 - RNA, 22 nt, Homo sapiens
uuugacuacauauagcaagagu

SEQ ID NO: 928899 - RNA, 14 nt, Homo sapiens
uuugauccuuuuga

SEQ ID NO: 928900 - RNA, 18 nt, Homo sapiens
uuuggcucgggacuucaa

SEQ ID NO: 928901 - RNA, 21 nt, Homo sapiens
uuugguauucaauuugauucu

SEQ ID NO: 928902 - RNA, 20 nt, Homo sapiens
uuuguuauagagaucucagc

SEQ ID NO: 928903 - RNA, 18 nt, Homo sapiens
uuuguuuucuacauugau

SEQ ID NO: 928904 - RNA, 22 nt, Homo sapiens
uuuguuuucuacauugauggaa

SEQ ID NO: 928905 - RNA, 13 nt, Homo sapiens
uuuuaacuugaaa

SEQ ID NO: 928906 - RNA, 22 nt, Homo sapiens
uuuuaagaaacaaaagugcaua

SEQ ID NO: 928907 - RNA, 20 nt, Homo sapiens
uuuuaagcauuuucuacaca

SEQ ID NO: 928908 - RNA, 21 nt, Homo sapiens
uuuuaaugauacugucuaaga

SEQ ID NO: 928909 - RNA, 13 nt, Homo sapiens
uuuuccuuaccau

SEQ ID NO: 928910 - RNA, 19 nt, Homo sapiens
uuuucuugccuugguuguc

SEQ ID NO: 928911 - RNA, 13 nt, Homo sapiens
uuuugaacauacu

SEQ ID NO: 928912 - RNA, 19 nt, Homo sapiens
uuuugccaacccuguguca

SEQ ID NO: 928913 - RNA, 14 nt, Homo sapiens
uuuugcugcuuuau

SEQ ID NO: 928914 - RNA, 21 nt, Homo sapiens
uuuuguauuuaaagcauuuug

SEQ ID NO: 928915 - RNA, 20 nt, Homo sapiens
uuuuugccaacccuguguca

SEQ ID NO: 928916 - RNA, 18 nt, Homo sapiens
uuuuuggccuaaagccag

SEQ ID NO: 928917 - RNA, 22 nt, Homo sapiens
uuuuugggaccuugcgugaaga

SEQ ID NO: 928918 - RNA, 23 nt, Homo sapiens
uuuuuucuuucaguccaaaauag

SEQ ID NO: 928919 - RNA, 13 nt, Homo sapiens
ugauugaaguauc

SEQ ID NO: 928920 - RNA, 18 nt, Homo sapiens
ugauugcaccaacagguc

SEQ ID NO: 928921 - RNA, 23 nt, Homo sapiens
ugauugccaacaguggcuaauaa

SEQ ID NO: 928922 - RNA, 16 nt, Homo sapiens
ugauuguucauaucaa

SEQ ID NO: 928923 - RNA, 21 nt, Homo sapiens
cgcaaggugguagcaggaaaa

SEQ ID NO: 928924 - RNA, 12 nt, Homo sapiens
cgcacccggcuc

SEQ ID NO: 928925 - RNA, 21 nt, Homo sapiens
cgcacuugauggucaggaagu

SEQ ID NO: 928926 - RNA, 18 nt, Homo sapiens
cgcaggcugagugcacug

SEQ ID NO: 928927 - RNA, 16 nt, Homo sapiens
cgccugugucacgagc

SEQ ID NO: 928928 - RNA, 17 nt, Homo sapiens
cgcuggccucuuccucc

SEQ ID NO: 928929 - RNA, 18 nt, Homo sapiens
cggcaaaugcgcacgacc

SEQ ID NO: 928930 - RNA, 21 nt, Homo sapiens
cggcagcgggcggaggggauc

SEQ ID NO: 928931 - RNA, 17 nt, Homo sapiens
cggcggagauugcagug

SEQ ID NO: 928932 - RNA, 13 nt, Homo sapiens
cgggaguggccau

SEQ ID NO: 928933 - RNA, 12 nt, Homo sapiens
cgguuucacucc

SEQ ID NO: 928934 - RNA, 21 nt, Homo sapiens
cgucauccccggagucccuau

SEQ ID NO: 928935 - RNA, 9 nt, Homo sapiens
cgugcccuc

SEQ ID NO: 928936 - RNA, 19 nt, Homo sapiens
cgugcugagcacacaacag

SEQ ID NO: 928937 - RNA, 18 nt, Homo sapiens
cguuaauaucgcugauau

SEQ ID NO: 928938 - RNA, 23 nt, Homo sapiens
cugcauuuucuggguucugggug

SEQ ID NO: 928939 - RNA, 15 nt, Homo sapiens
cugcccucuauuuau

SEQ ID NO: 928940 - RNA, 23 nt, Homo sapiens
cugccucggggacacuagugaca

SEQ ID NO: 928941 - RNA, 15 nt, Homo sapiens
cugccucugagccac

SEQ ID NO: 928942 - RNA, 16 nt, Homo sapiens
cugcgccgucugcucg

SEQ ID NO: 928943 - RNA, 22 nt, Homo sapiens
cugcguaggagagaacagggau

SEQ ID NO: 928944 - RNA, 14 nt, Homo sapiens
cugcugauuuucug

SEQ ID NO: 928945 - RNA, 15 nt, Homo sapiens
cugcugccccaaagg

SEQ ID NO: 928946 - RNA, 23 nt, Homo sapiens
cuggaacacaaccauagccuguu

SEQ ID NO: 928947 - RNA, 15 nt, Homo sapiens
cuggaaugcauucac

SEQ ID NO: 928948 - RNA, 14 nt, Homo sapiens
cuggagaguggcau

SEQ ID NO: 928949 - RNA, 13 nt, Homo sapiens
cuggagugaucuc

SEQ ID NO: 928950 - RNA, 16 nt, Homo sapiens
cuggcaccaacacuuu

SEQ ID NO: 928951 - RNA, 22 nt, Homo sapiens
cuggccgcccgcgccaggagcc

SEQ ID NO: 928952 - RNA, 23 nt, Homo sapiens
cuggccuauuuuggacgugugag

SEQ ID NO: 928953 - RNA, 16 nt, Homo sapiens
cuggccucagacucau

SEQ ID NO: 928954 - RNA, 13 nt, Homo sapiens
cuggcuguuaaaa

SEQ ID NO: 928955 - RNA, 14 nt, Homo sapiens
cugggaacucccaa

SEQ ID NO: 928956 - RNA, 16 nt, Homo sapiens
cugggaacucccaaga

SEQ ID NO: 928957 - RNA, 21 nt, Homo sapiens
cugggaacucccaagaacagc

SEQ ID NO: 928958 - RNA, 15 nt, Homo sapiens
cugggguggggauca

SEQ ID NO: 928959 - RNA, 23 nt, Homo sapiens
cuggucuccuaaccaaggugcac

SEQ ID NO: 928960 - RNA, 23 nt, Homo sapiens
cuggucuccucccaaaauacuac

SEQ ID NO: 928961 - RNA, 15 nt, Homo sapiens
cuggucuugaacucc

SEQ ID NO: 928962 - RNA, 17 nt, Homo sapiens
cuggugcacaugacauu

SEQ ID NO: 928963 - RNA, 17 nt, Homo sapiens
cuguaaucccaguacuu

SEQ ID NO: 928964 - RNA, 22 nt, Homo sapiens
cuguauauuugaaacugcuaau

SEQ ID NO: 928965 - RNA, 18 nt, Homo sapiens
cuguauuaacugaauucu

SEQ ID NO: 928966 - RNA, 22 nt, Homo sapiens
cuguauuuuuuuuuuccauuag

SEQ ID NO: 928967 - RNA, 13 nt, Homo sapiens
cugucacuuguga

SEQ ID NO: 928968 - RNA, 21 nt, Homo sapiens
cuguccaggaacuuuccagca

SEQ ID NO: 928969 - RNA, 18 nt, Homo sapiens
cuguccuucccacggcca

SEQ ID NO: 928970 - RNA, 19 nt, Homo sapiens
cugucuucauccuuagcaa

SEQ ID NO: 928971 - RNA, 20 nt, Homo sapiens
cugucuuuaaaagucauuca

SEQ ID NO: 928972 - RNA, 14 nt, Homo sapiens
cugugaguucugau

SEQ ID NO: 928973 - RNA, 23 nt, Homo sapiens
cugugauugccauuucuucccaa

SEQ ID NO: 928974 - RNA, 15 nt, Homo sapiens
cugugcccagcaguu

SEQ ID NO: 928975 - RNA, 14 nt, Homo sapiens
cugugccugugacu

SEQ ID NO: 928976 - RNA, 20 nt, Homo sapiens
cuguuaaagccuaugaaugc

SEQ ID NO: 928977 - RNA, 15 nt, Homo sapiens
cuguuugucuucucc

SEQ ID NO: 928978 - RNA, 17 nt, Homo sapiens
cuuaaaagcuguucuca

SEQ ID NO: 928979 - RNA, 18 nt, Homo sapiens
cuuaaacaaaacuggaac

SEQ ID NO: 928980 - RNA, 17 nt, Homo sapiens
cuuaaggggguguaaug

SEQ ID NO: 928981 - RNA, 13 nt, Homo sapiens
cuuaaguuuagaa

SEQ ID NO: 928982 - RNA, 13 nt, Homo sapiens
cuuacagugccaa

SEQ ID NO: 928983 - RNA, 20 nt, Homo sapiens
cuuacauuauuacuccuugc

SEQ ID NO: 928984 - RNA, 23 nt, Homo sapiens
cuuagauuauguucaaugaauau

SEQ ID NO: 928985 - RNA, 12 nt, Homo sapiens
cuuagcaacagc

SEQ ID NO: 928986 - RNA, 19 nt, Homo sapiens
cuuaucugagucacuugaa

SEQ ID NO: 928987 - RNA, 24 nt, Homo sapiens
cuuauguaaacaaucagaccacau

SEQ ID NO: 928988 - RNA, 20 nt, Homo sapiens
cuuauugguugaaggucaca

SEQ ID NO: 928989 - RNA, 17 nt, Homo sapiens
cuucagcuuugaaaagg

SEQ ID NO: 928990 - RNA, 19 nt, Homo sapiens
cuucaggaaggacauggac

SEQ ID NO: 928991 - RNA, 19 nt, Homo sapiens
cuucauccuuagcaacagc

SEQ ID NO: 928992 - RNA, 10 nt, Homo sapiens
cuucauucua

SEQ ID NO: 928993 - RNA, 18 nt, Homo sapiens
cuuccaucagcagugauu

SEQ ID NO: 928994 - RNA, 17 nt, Homo sapiens
cuuccccaucccggagu

SEQ ID NO: 928995 - RNA, 19 nt, Homo sapiens
cuuccuccucuacugguaa

SEQ ID NO: 928996 - RNA, 22 nt, Homo sapiens
cuuccuggaaugcauucacuca

SEQ ID NO: 928997 - RNA, 15 nt, Homo sapiens
cuuccugucuggccc

SEQ ID NO: 928998 - RNA, 19 nt, Homo sapiens
cuuccugugccugugacuc

SEQ ID NO: 928999 - RNA, 17 nt, Homo sapiens
cuucucaagcacugaca

SEQ ID NO: 929000 - RNA, 21 nt, Homo sapiens
cuucucaagcacugacacuca

SEQ ID NO: 929001 - RNA, 17 nt, Homo sapiens
cuucuccacaaccuccu

SEQ ID NO: 929002 - RNA, 12 nt, Homo sapiens
cuucuccauaaa

SEQ ID NO: 929003 - RNA, 13 nt, Homo sapiens
cuucucucuucaa

SEQ ID NO: 929004 - RNA, 22 nt, Homo sapiens
cuucugauuucucuucagcuuu

SEQ ID NO: 929005 - RNA, 23 nt, Homo sapiens
cuucuguccucuucugugaguca

SEQ ID NO: 929006 - RNA, 22 nt, Homo sapiens
cuucuguucauccugaacauuu

SEQ ID NO: 929007 - RNA, 14 nt, Homo sapiens
cuucuuccacagca

SEQ ID NO: 929008 - RNA, 14 nt, Homo sapiens
cuucuucucaagca

SEQ ID NO: 929009 - RNA, 13 nt, Homo sapiens
cuugaacugagac

SEQ ID NO: 929010 - RNA, 21 nt, Homo sapiens
cuugagugugcaagcaaagaa

SEQ ID NO: 929011 - RNA, 16 nt, Homo sapiens
cuugaguugaguauua

SEQ ID NO: 929012 - RNA, 13 nt, Homo sapiens
cuugauaugacua

SEQ ID NO: 929013 - RNA, 14 nt, Homo sapiens
cuugcaagucccau

SEQ ID NO: 929014 - RNA, 12 nt, Homo sapiens
cuugcacuauug

SEQ ID NO: 929015 - RNA, 14 nt, Homo sapiens
cuugccauuuucaa

SEQ ID NO: 929016 - RNA, 23 nt, Homo sapiens
cuugguguguucguggagccaca

SEQ ID NO: 929017 - RNA, 13 nt, Homo sapiens
cuugguuuccuca

SEQ ID NO: 929018 - RNA, 15 nt, Homo sapiens
cuuguaaacuugaaa

SEQ ID NO: 929019 - RNA, 14 nt, Homo sapiens
cuuguacagccuuu

SEQ ID NO: 929020 - RNA, 17 nt, Homo sapiens
cuuguaccuugaguuga

SEQ ID NO: 929021 - RNA, 23 nt, Homo sapiens
cuuguaccuugaguugaguauua

SEQ ID NO: 929022 - RNA, 12 nt, Homo sapiens
cuugucauccac

SEQ ID NO: 929023 - RNA, 12 nt, Homo sapiens
cuugucucucau

SEQ ID NO: 929024 - RNA, 16 nt, Homo sapiens
cuugugagugugugca

SEQ ID NO: 929025 - RNA, 16 nt, Homo sapiens
cuuuaaaagucauuca

SEQ ID NO: 929026 - RNA, 17 nt, Homo sapiens
cuuuacuagugccaaac

SEQ ID NO: 929027 - RNA, 21 nt, Homo sapiens
cuuuaguguucaaauacuuca

SEQ ID NO: 929028 - RNA, 22 nt, Homo sapiens
cuuuaguguucaaauacuucaa

SEQ ID NO: 929029 - RNA, 22 nt, Homo sapiens
cuuuauuuauuaagaaugucau

SEQ ID NO: 929030 - RNA, 15 nt, Homo sapiens
cuuuccaaauugaug

SEQ ID NO: 929031 - RNA, 15 nt, Homo sapiens
cuuuccaagucauuu

SEQ ID NO: 929032 - RNA, 19 nt, Homo sapiens
cuuuccacuccaaccagaa

SEQ ID NO: 929033 - RNA, 12 nt, Homo sapiens
cuuuccaugcag

SEQ ID NO: 929034 - RNA, 15 nt, Homo sapiens
cuuuccccauucauu

SEQ ID NO: 929035 - RNA, 18 nt, Homo sapiens
cuuuccucagcaccuggg

SEQ ID NO: 929036 - RNA, 15 nt, Homo sapiens
cuuucugucugugaa

SEQ ID NO: 929037 - RNA, 15 nt, Homo sapiens
cuuucuucaauacaa

SEQ ID NO: 929038 - RNA, 22 nt, Homo sapiens
cuuucuuuguaacaugacacau

SEQ ID NO: 929039 - RNA, 21 nt, Homo sapiens
cuuugauuuuuugcugcagac

SEQ ID NO: 929040 - RNA, 20 nt, Homo sapiens
cuuugcaaaggagacuuaau

SEQ ID NO: 929041 - RNA, 14 nt, Homo sapiens
cuuugccacagauu

SEQ ID NO: 929042 - RNA, 15 nt, Homo sapiens
cuuuggcaauucuuc

SEQ ID NO: 929043 - RNA, 17 nt, Homo sapiens
cuuugucccacagcuug

SEQ ID NO: 929044 - RNA, 14 nt, Homo sapiens
cuuuguucacugug

SEQ ID NO: 929045 - RNA, 15 nt, Homo sapiens
cuuuguuccacugga

SEQ ID NO: 929046 - RNA, 14 nt, Homo sapiens
cuuuuaguacccac

SEQ ID NO: 929047 - RNA, 18 nt, Homo sapiens
cuuuucugguagguucug

SEQ ID NO: 929048 - RNA, 17 nt, Homo sapiens
agacucauacagaaggu

SEQ ID NO: 929049 - RNA, 20 nt, Homo sapiens
agacugacugaguagcucau

SEQ ID NO: 929050 - RNA, 16 nt, Homo sapiens
agagacaggauuucac

SEQ ID NO: 929051 - RNA, 12 nt, Homo sapiens
agagaccaaaaa

SEQ ID NO: 929052 - RNA, 23 nt, Homo sapiens
agagccacccaggccacugaccu

SEQ ID NO: 929053 - RNA, 15 nt, Homo sapiens
agagccuccuaaaau

SEQ ID NO: 929054 - RNA, 14 nt, Homo sapiens
agaggcaccaggaa

SEQ ID NO: 929055 - RNA, 22 nt, Homo sapiens
agaggccacacuuucugggaaa

SEQ ID NO: 929056 - RNA, 16 nt, Homo sapiens
agaguucuauccccaa

SEQ ID NO: 929057 - RNA, 23 nt, Homo sapiens
agauauuaaaaauugaaaacuuu

SEQ ID NO: 929058 - RNA, 15 nt, Homo sapiens
agaucacaucacugc

SEQ ID NO: 929059 - RNA, 22 nt, Homo sapiens
acccuaacugagcugccagugg

SEQ ID NO: 929060 - RNA, 11 nt, Homo sapiens
acccugucaag

SEQ ID NO: 929061 - RNA, 13 nt, Homo sapiens
acccuguccuccc

SEQ ID NO: 929062 - RNA, 17 nt, Homo sapiens
acccuugugcauugugu

SEQ ID NO: 929063 - RNA, 20 nt, Homo sapiens
acccuuucuucaauacaaaa

SEQ ID NO: 929064 - RNA, 23 nt, Homo sapiens
acccuuucuucaauacaaaaagc

SEQ ID NO: 929065 - RNA, 15 nt, Homo sapiens
accgaugguccucac

SEQ ID NO: 929066 - RNA, 20 nt, Homo sapiens
accgucacacucuucaguga

SEQ ID NO: 929067 - RNA, 18 nt, Homo sapiens
accguuguuguuuuacau

SEQ ID NO: 929068 - RNA, 18 nt, Homo sapiens
accuaacugaaaugagau

SEQ ID NO: 929069 - RNA, 18 nt, Homo sapiens
aaugguuauuuguuacua

SEQ ID NO: 929070 - RNA, 14 nt, Homo sapiens
aauguaacuuccuc

SEQ ID NO: 929071 - RNA, 18 nt, Homo sapiens
aauguacuuaaauuacac

SEQ ID NO: 929072 - RNA, 18 nt, Homo sapiens
aauguauucauauuacaa

SEQ ID NO: 929073 - RNA, 23 nt, Homo sapiens
aaugucauuuguugagcaagagu

SEQ ID NO: 929074 - RNA, 16 nt, Homo sapiens
aauguccccuuagguc

SEQ ID NO: 929075 - RNA, 16 nt, Homo sapiens
aauuaaaauuuauucu

SEQ ID NO: 929076 - RNA, 20 nt, Homo sapiens
aauuaaugagacacacuuaa

SEQ ID NO: 929077 - RNA, 19 nt, Homo sapiens
uucuuuuuccccaauaaau

SEQ ID NO: 929078 - RNA, 14 nt, Homo sapiens
uauuuauuagccaa

SEQ ID NO: 929079 - RNA, 15 nt, Homo sapiens
uauuuuauaagcauu

SEQ ID NO: 929080 - RNA, 18 nt, Homo sapiens
uauuuucccaugccaguu

SEQ ID NO: 929081 - RNA, 18 nt, Homo sapiens
uauuuucuaaccaaauac

SEQ ID NO: 929082 - RNA, 21 nt, Homo sapiens
uauuuuuuuuaacugcauucu

SEQ ID NO: 929083 - RNA, 16 nt, Homo sapiens
ucaaaaaacaagucuu

SEQ ID NO: 929084 - RNA, 13 nt, Homo sapiens
ucaaaaauuugca

SEQ ID NO: 929085 - RNA, 16 nt, Homo sapiens
ucaaaaggaauucagu

SEQ ID NO: 929086 - RNA, 21 nt, Homo sapiens
ucaaaaucuuaaccugaugcu

SEQ ID NO: 929087 - RNA, 15 nt, Homo sapiens
ucaaaaugguuuauu

SEQ ID NO: 929088 - RNA, 22 nt, Homo sapiens
ucaaaauuguuacccauuugaa

SEQ ID NO: 929089 - RNA, 18 nt, Homo sapiens
ucaaagauucugcauuuu

SEQ ID NO: 929090 - RNA, 15 nt, Homo sapiens
ucaaagcaagucaac

SEQ ID NO: 929091 - RNA, 22 nt, Homo sapiens
ucaaauauguagauugccuuug

SEQ ID NO: 929092 - RNA, 21 nt, Homo sapiens
ucaacccaauaauucuguauu

SEQ ID NO: 929093 - RNA, 14 nt, Homo sapiens
ucaagaacugccau

SEQ ID NO: 929094 - RNA, 15 nt, Homo sapiens
ucaagauacacuugu

SEQ ID NO: 929095 - RNA, 19 nt, Homo sapiens
ucaagauuaaacugaguga

SEQ ID NO: 929096 - RNA, 13 nt, Homo sapiens
ucaagcuucauua

SEQ ID NO: 929097 - RNA, 16 nt, Homo sapiens
ucaaggauauacugca

SEQ ID NO: 929098 - RNA, 17 nt, Homo sapiens
ucaagggcugcuucaaa

SEQ ID NO: 929099 - RNA, 22 nt, Homo sapiens
ucaaucacuugaaagugaacaa

SEQ ID NO: 929100 - RNA, 15 nt, Homo sapiens
ucaauuuucuucaca

SEQ ID NO: 929101 - RNA, 19 nt, Homo sapiens
ucacaaaaguauauucaaa

SEQ ID NO: 929102 - RNA, 18 nt, Homo sapiens
ucacacuaucaacacugc

SEQ ID NO: 929103 - RNA, 15 nt, Homo sapiens
ucaccaaccaaaggg

SEQ ID NO: 929104 - RNA, 12 nt, Homo sapiens
ucaccaggggag

SEQ ID NO: 929105 - RNA, 18 nt, Homo sapiens
ucacgggaggaaucuuuu

SEQ ID NO: 929106 - RNA, 13 nt, Homo sapiens
ucacuauggugcc

SEQ ID NO: 929107 - RNA, 17 nt, Homo sapiens
ucacucaaaaaggugug

SEQ ID NO: 929108 - RNA, 14 nt, Homo sapiens
ucacucuggcauau

SEQ ID NO: 929109 - RNA, 14 nt, Homo sapiens
ucacugcaaccucc

SEQ ID NO: 929110 - RNA, 16 nt, Homo sapiens
ucacugcaaccuccac

SEQ ID NO: 929111 - RNA, 21 nt, Homo sapiens
ucacuuagugaggaccugaca

SEQ ID NO: 929112 - RNA, 19 nt, Homo sapiens
ucagaaguuaguuuguaua

SEQ ID NO: 929113 - RNA, 15 nt, Homo sapiens
ucagacguuccauac

SEQ ID NO: 929114 - RNA, 15 nt, Homo sapiens
ucagcaccugggacc

SEQ ID NO: 929115 - RNA, 17 nt, Homo sapiens
ucagcuggagauacuga

SEQ ID NO: 929116 - RNA, 20 nt, Homo sapiens
ucaggaauucagugccuuca

SEQ ID NO: 929117 - RNA, 16 nt, Homo sapiens
ucaggagauggagacc

SEQ ID NO: 929118 - RNA, 20 nt, Homo sapiens
ucaggcauuuuuccaaagga

SEQ ID NO: 929119 - RNA, 19 nt, Homo sapiens
ucagggcuauggauggggc

SEQ ID NO: 929120 - RNA, 15 nt, Homo sapiens
ucaggggaauuucag

SEQ ID NO: 929121 - RNA, 13 nt, Homo sapiens
ucaguggggacag

SEQ ID NO: 929122 - RNA, 19 nt, Homo sapiens
ucaguuucuucaccuguaa

SEQ ID NO: 929123 - RNA, 17 nt, Homo sapiens
ucaucgcucuacaccug

SEQ ID NO: 929124 - RNA, 23 nt, Homo sapiens
ucaugaagcucaguuuggcugua

SEQ ID NO: 929125 - RNA, 11 nt, Homo sapiens
ucaugauuuca

SEQ ID NO: 929126 - RNA, 18 nt, Homo sapiens
ucaugccacugcacugca

SEQ ID NO: 929127 - RNA, 17 nt, Homo sapiens
ucauggcucacugcagc

SEQ ID NO: 929128 - RNA, 18 nt, Homo sapiens
ucaugguaagagucacaa

SEQ ID NO: 929129 - RNA, 11 nt, Homo sapiens
ucauguucuca

SEQ ID NO: 929130 - RNA, 22 nt, Homo sapiens
ucauuaccgucugugauugcca

SEQ ID NO: 929131 - RNA, 16 nt, Homo sapiens
ucauucuugugacuua

SEQ ID NO: 929132 - RNA, 18 nt, Homo sapiens
ucauuuacccuagagguu

SEQ ID NO: 929133 - RNA, 23 nt, Homo sapiens
ucauuuggaaugaauacagcauu

SEQ ID NO: 929134 - RNA, 14 nt, Homo sapiens
uccaaucuccauca

SEQ ID NO: 929135 - RNA, 15 nt, Homo sapiens
uccaaucuccaucac

SEQ ID NO: 929136 - RNA, 18 nt, Homo sapiens
uccaaugugcccagucau

SEQ ID NO: 929137 - RNA, 19 nt, Homo sapiens
uccacaaacaccaucuuca

SEQ ID NO: 929138 - RNA, 20 nt, Homo sapiens
uccacaacuugagaagacau

SEQ ID NO: 929139 - RNA, 21 nt, Homo sapiens
uccacacagccugucuucaga

SEQ ID NO: 929140 - RNA, 18 nt, Homo sapiens
uccacaucaaguguucca

SEQ ID NO: 929141 - RNA, 15 nt, Homo sapiens
uccacaucuaacaaa

SEQ ID NO: 929142 - RNA, 20 nt, Homo sapiens
uccacugcaaauaaagccuu

SEQ ID NO: 929143 - RNA, 14 nt, Homo sapiens
uccagccacuuccc

SEQ ID NO: 929144 - RNA, 18 nt, Homo sapiens
uccagcuucccuuugauu

SEQ ID NO: 929145 - RNA, 18 nt, Homo sapiens
uccauaagauuugcaaag

SEQ ID NO: 929146 - RNA, 20 nt, Homo sapiens
uccauacccccacaugccaa

SEQ ID NO: 929147 - RNA, 14 nt, Homo sapiens
uccauguugcugac

SEQ ID NO: 929148 - RNA, 13 nt, Homo sapiens
ucccaaagugcug

SEQ ID NO: 929149 - RNA, 14 nt, Homo sapiens
ucccaacacuuugg

SEQ ID NO: 929150 - RNA, 20 nt, Homo sapiens
ucccaagcuguauguacuuc

SEQ ID NO: 929151 - RNA, 21 nt, Homo sapiens
ucccacggccacugcagucac

SEQ ID NO: 929152 - RNA, 18 nt, Homo sapiens
ucccagaggcuccuggag

SEQ ID NO: 929153 - RNA, 17 nt, Homo sapiens
ucccagcugaaggcagu

SEQ ID NO: 929154 - RNA, 17 nt, Homo sapiens
ucccaguucauguugcu

SEQ ID NO: 929155 - RNA, 15 nt, Homo sapiens
ucccaucugcauuug

SEQ ID NO: 929156 - RNA, 18 nt, Homo sapiens
ucccaugaauacacaacu

SEQ ID NO: 929157 - RNA, 21 nt, Homo sapiens
ucccaugguagacugugacac

SEQ ID NO: 929158 - RNA, 21 nt, Homo sapiens
uccccaagcuggccacuauca

SEQ ID NO: 929159 - RNA, 16 nt, Homo sapiens
uccccaccuccugucg

SEQ ID NO: 929160 - RNA, 16 nt, Homo sapiens
ucccccgugaucuccc

SEQ ID NO: 929161 - RNA, 14 nt, Homo sapiens
uccccuccaaguga

SEQ ID NO: 929162 - RNA, 20 nt, Homo sapiens
uccccucucagagcuacuug

SEQ ID NO: 929163 - RNA, 15 nt, Homo sapiens
uccccucucuuugag

SEQ ID NO: 929164 - RNA, 16 nt, Homo sapiens
ucccuaggcaccucug

SEQ ID NO: 929165 - RNA, 22 nt, Homo sapiens
ucccucauguucucauguuugu

SEQ ID NO: 929166 - RNA, 14 nt, Homo sapiens
ucccugcacacggc

SEQ ID NO: 929167 - RNA, 13 nt, Homo sapiens
ucccugugucagg

SEQ ID NO: 929168 - RNA, 12 nt, Homo sapiens
ucccuguuauaa

SEQ ID NO: 929169 - RNA, 22 nt, Homo sapiens
ucccuguucuggacauuucaua

SEQ ID NO: 929170 - RNA, 21 nt, Homo sapiens
uccuaaguuaccuuucuaggu

SEQ ID NO: 929171 - RNA, 20 nt, Homo sapiens
uccucaaagauucugcauuu

SEQ ID NO: 929172 - RNA, 18 nt, Homo sapiens
uccuccaguucugaugag

SEQ ID NO: 929173 - RNA, 20 nt, Homo sapiens
uccucuuaggauguuucacc

SEQ ID NO: 929174 - RNA, 17 nt, Homo sapiens
uccugaaagcauuauuu

SEQ ID NO: 929175 - RNA, 20 nt, Homo sapiens
uccugaggcagaaccuggug

SEQ ID NO: 929176 - RNA, 20 nt, Homo sapiens
uccugaguagcugagacuac

SEQ ID NO: 929177 - RNA, 17 nt, Homo sapiens
uccuggggaggucugag

SEQ ID NO: 929178 - RNA, 13 nt, Homo sapiens
uccugucauggcu

SEQ ID NO: 929179 - RNA, 12 nt, Homo sapiens
uccuguucaaga

SEQ ID NO: 929180 - RNA, 20 nt, Homo sapiens
uccuuacaacugcucuagau

SEQ ID NO: 929181 - RNA, 16 nt, Homo sapiens
uccuucaagcugcuga

SEQ ID NO: 929182 - RNA, 12 nt, Homo sapiens
ucgaaucacuca

SEQ ID NO: 929183 - RNA, 16 nt, Homo sapiens
ucgacuaagacuuuuu

SEQ ID NO: 929184 - RNA, 13 nt, Homo sapiens
ucgagacauuccu

SEQ ID NO: 929185 - RNA, 14 nt, Homo sapiens
ucgagagugagaaa

SEQ ID NO: 929186 - RNA, 18 nt, Homo sapiens
ucgagauuaacggugcua

SEQ ID NO: 929187 - RNA, 20 nt, Homo sapiens
ucgaucuguacgaaauguga

SEQ ID NO: 929188 - RNA, 23 nt, Homo sapiens
ucgaucuguacgaaaugugaaau

SEQ ID NO: 929189 - RNA, 13 nt, Homo sapiens
ucguccugccugg

SEQ ID NO: 929190 - RNA, 15 nt, Homo sapiens
ucgugacuacauuga

SEQ ID NO: 929191 - RNA, 16 nt, Homo sapiens
ucuaaagugagcucua

SEQ ID NO: 929192 - RNA, 14 nt, Homo sapiens
ucuaaauaugaagg

SEQ ID NO: 929193 - RNA, 16 nt, Homo sapiens
ucuaacaggacuugaa

SEQ ID NO: 929194 - RNA, 16 nt, Homo sapiens
ucuaauccaugugcug

SEQ ID NO: 929195 - RNA, 16 nt, Homo sapiens
aaaauggccagugaga

SEQ ID NO: 929196 - RNA, 16 nt, Homo sapiens
aaacaccaggauuuaa

SEQ ID NO: 929197 - RNA, 14 nt, Homo sapiens
aaacauguauguaa

SEQ ID NO: 929198 - RNA, 21 nt, Homo sapiens
aaacauugguucuuguauuaa

SEQ ID NO: 929199 - RNA, 16 nt, Homo sapiens
aaacuaguuacuaaac

SEQ ID NO: 929200 - RNA, 19 nt, Homo sapiens
aaacuuucacaccccagac

SEQ ID NO: 929201 - RNA, 14 nt, Homo sapiens
aaagcaugugagac

SEQ ID NO: 929202 - RNA, 19 nt, Homo sapiens
aaauaaaauuuuuauguaa

SEQ ID NO: 929203 - RNA, 15 nt, Homo sapiens
aaauaccagccagua

SEQ ID NO: 929204 - RNA, 13 nt, Homo sapiens
aaauguacagcaa

SEQ ID NO: 929205 - RNA, 19 nt, Homo sapiens
aacaugccagccacuguga

SEQ ID NO: 929206 - RNA, 20 nt, Homo sapiens
aaccguuugugauugccauu

SEQ ID NO: 929207 - RNA, 18 nt, Homo sapiens
aacugccaucauuuacuu

SEQ ID NO: 929208 - RNA, 22 nt, Homo sapiens
aacuguuauuuauaaucacuuu

SEQ ID NO: 929209 - RNA, 22 nt, Homo sapiens
aagacugaguacguugugcauu

SEQ ID NO: 929210 - RNA, 12 nt, Homo sapiens
aaggaaacuggg

SEQ ID NO: 929211 - RNA, 21 nt, Homo sapiens
aaggaaacuggguuccugcaa

SEQ ID NO: 929212 - RNA, 15 nt, Homo sapiens
aagggaccucuccau

SEQ ID NO: 929213 - RNA, 18 nt, Homo sapiens
aauacaccacuacauucu

SEQ ID NO: 929214 - RNA, 20 nt, Homo sapiens
aauauaaauuuaucauuuag

SEQ ID NO: 929215 - RNA, 15 nt, Homo sapiens
aauauauaaccagug

SEQ ID NO: 929216 - RNA, 13 nt, Homo sapiens
aaucuaaauggaa

SEQ ID NO: 929217 - RNA, 14 nt, Homo sapiens
aauggccagugaga

SEQ ID NO: 929218 - RNA, 20 nt, Homo sapiens
aaugguaguuuuacaguguu

SEQ ID NO: 929219 - RNA, 21 nt, Homo sapiens
aauguucuccagucauuaugu

SEQ ID NO: 929220 - RNA, 22 nt, Homo sapiens
aauuaaggguaugauuaacucu

SEQ ID NO: 929221 - RNA, 18 nt, Homo sapiens
aauucccuggccuuucau

SEQ ID NO: 929222 - RNA, 20 nt, Homo sapiens
acacugcauguuugugauug

SEQ ID NO: 929223 - RNA, 14 nt, Homo sapiens
acaggcaaauuccu

SEQ ID NO: 929224 - RNA, 19 nt, Homo sapiens
acaguuuugguugcuuuaa

SEQ ID NO: 929225 - RNA, 14 nt, Homo sapiens
acaucucugcaauc

SEQ ID NO: 929226 - RNA, 16 nt, Homo sapiens
acauuuuaugucuuuc

SEQ ID NO: 929227 - RNA, 17 nt, Homo sapiens
accacuuuuugcagcuu

SEQ ID NO: 929228 - RNA, 20 nt, Homo sapiens
accccagacgaugucuucau

SEQ ID NO: 929229 - RNA, 23 nt, Homo sapiens
accucccauucacagauaccucu

SEQ ID NO: 929230 - RNA, 13 nt, Homo sapiens
accuccuccuuca

SEQ ID NO: 929231 - RNA, 12 nt, Homo sapiens
accuccugccuc

SEQ ID NO: 929232 - RNA, 22 nt, Homo sapiens
accucuccaugaucccaccucc

SEQ ID NO: 929233 - RNA, 17 nt, Homo sapiens
accucuugagccuugaa

SEQ ID NO: 929234 - RNA, 14 nt, Homo sapiens
accugcuucuauua

SEQ ID NO: 929235 - RNA, 21 nt, Homo sapiens
accuuucagauaacuguuauu

SEQ ID NO: 929236 - RNA, 18 nt, Homo sapiens
accuuuuuuauacauaaa

SEQ ID NO: 929237 - RNA, 17 nt, Homo sapiens
acgcauggaaaaguuuc

SEQ ID NO: 929238 - RNA, 13 nt, Homo sapiens
acguugugcauuu

SEQ ID NO: 929239 - RNA, 22 nt, Homo sapiens
acucuacaaaauauagcuuuca

SEQ ID NO: 929240 - RNA, 16 nt, Homo sapiens
acuguaauuugugaua

SEQ ID NO: 929241 - RNA, 13 nt, Homo sapiens
acuuugaccucug

SEQ ID NO: 929242 - RNA, 16 nt, Homo sapiens
agaaaauggccaguga

SEQ ID NO: 929243 - RNA, 17 nt, Homo sapiens
agacauacuaaccagca

SEQ ID NO: 929244 - RNA, 23 nt, Homo sapiens
agauaacuguuauuuauaaucac

SEQ ID NO: 929245 - RNA, 15 nt, Homo sapiens
agauaauacaccacu

SEQ ID NO: 929246 - RNA, 16 nt, Homo sapiens
agaucucuaacuucac

SEQ ID NO: 929247 - RNA, 14 nt, Homo sapiens
agcacacacuuuug

SEQ ID NO: 929248 - RNA, 15 nt, Homo sapiens
agcaucacaguuuug

SEQ ID NO: 929249 - RNA, 13 nt, Homo sapiens
agccacugugaua

SEQ ID NO: 929250 - RNA, 16 nt, Homo sapiens
agccucuauugccaug

SEQ ID NO: 929251 - RNA, 14 nt, Homo sapiens
agcuaagauauaau

SEQ ID NO: 929252 - RNA, 22 nt, Homo sapiens
aggaaacuggguuccugcaaug

SEQ ID NO: 929253 - RNA, 17 nt, Homo sapiens
aggauuuuaugcuuuaa

SEQ ID NO: 929254 - RNA, 16 nt, Homo sapiens
aggcaggggaauguau

SEQ ID NO: 929255 - RNA, 23 nt, Homo sapiens
cacguuucuaaaggcuaccuuug

SEQ ID NO: 929256 - RNA, 21 nt, Homo sapiens
cacuggcuguuaaucuuucaa

SEQ ID NO: 929257 - RNA, 14 nt, Homo sapiens
cagaaauguguuau

SEQ ID NO: 929258 - RNA, 17 nt, Homo sapiens
cagccucagcucucagu

SEQ ID NO: 929259 - RNA, 13 nt, Homo sapiens
caggcaucgccau

SEQ ID NO: 929260 - RNA, 18 nt, Homo sapiens
cagggaaauguaugugug

SEQ ID NO: 929261 - RNA, 23 nt, Homo sapiens
cagggaaauguaugugugucuau

SEQ ID NO: 929262 - RNA, 21 nt, Homo sapiens
cauacacaccccggacuccuc

SEQ ID NO: 929263 - RNA, 21 nt, Homo sapiens
caucaaugauaaugcuaauuu

SEQ ID NO: 929264 - RNA, 21 nt, Homo sapiens
caugaucccaccucccauuca

SEQ ID NO: 929265 - RNA, 12 nt, Homo sapiens
caugcucuccaa

SEQ ID NO: 929266 - RNA, 18 nt, Homo sapiens
caugucagccacugugau

SEQ ID NO: 929267 - RNA, 16 nt, Homo sapiens
cauuuaauccucucaa

SEQ ID NO: 929268 - RNA, 15 nt, Homo sapiens
cauuuuuuaaaugca

SEQ ID NO: 929269 - RNA, 20 nt, Homo sapiens
ccagggcuugugugcacaua

SEQ ID NO: 929270 - RNA, 16 nt, Homo sapiens
ccaguguuguggauuu

SEQ ID NO: 929271 - RNA, 18 nt, Homo sapiens
cccauucacagauaccuc

SEQ ID NO: 929272 - RNA, 16 nt, Homo sapiens
cccuagcccuuacguc

SEQ ID NO: 929273 - RNA, 15 nt, Homo sapiens
cccuuggacauuuua

SEQ ID NO: 929274 - RNA, 14 nt, Homo sapiens
ccuacugugucuca

SEQ ID NO: 929275 - RNA, 12 nt, Homo sapiens
ccucaccucuca

SEQ ID NO: 929276 - RNA, 18 nt, Homo sapiens
ccuuagcccaucuuucaa

SEQ ID NO: 929277 - RNA, 21 nt, Homo sapiens
cggucacuuuacuguccccau

SEQ ID NO: 929278 - RNA, 17 nt, Homo sapiens
cguuugugauugccauu

SEQ ID NO: 929279 - RNA, 14 nt, Homo sapiens
cuaaaauguucuaa

SEQ ID NO: 929280 - RNA, 19 nt, Homo sapiens
cuaaauaucccuuggacau

SEQ ID NO: 929281 - RNA, 13 nt, Homo sapiens
cuacaauuguaaa

SEQ ID NO: 929282 - RNA, 19 nt, Homo sapiens
cuacaauuguaaacuaguu

SEQ ID NO: 929283 - RNA, 13 nt, Homo sapiens
cuagauacuguau

SEQ ID NO: 929284 - RNA, 15 nt, Homo sapiens
cuauuauauucauuc

SEQ ID NO: 929285 - RNA, 17 nt, Homo sapiens
cucaccucucaccuccc

SEQ ID NO: 929286 - RNA, 21 nt, Homo sapiens
cucacuuugaagagugugagg

SEQ ID NO: 929287 - RNA, 21 nt, Homo sapiens
cucagcuaaugaaguguuuag

SEQ ID NO: 929288 - RNA, 17 nt, Homo sapiens
cuccagccucagcucuc

SEQ ID NO: 929289 - RNA, 23 nt, Homo sapiens
cucccauucacagauaccucucu

SEQ ID NO: 929290 - RNA, 12 nt, Homo sapiens
cuccgcauccuc

SEQ ID NO: 929291 - RNA, 14 nt, Homo sapiens
cuccuccuucaugg

SEQ ID NO: 929292 - RNA, 13 nt, Homo sapiens
cuccuuguguuac

SEQ ID NO: 929293 - RNA, 17 nt, Homo sapiens
cucuaccugcacacugu

SEQ ID NO: 929294 - RNA, 20 nt, Homo sapiens
cucucaguugcagcccugcu

SEQ ID NO: 929295 - RNA, 23 nt, Homo sapiens
cucuccaugaucccaccucccau

SEQ ID NO: 929296 - RNA, 16 nt, Homo sapiens
cucuggaagccucuau

SEQ ID NO: 929297 - RNA, 22 nt, Homo sapiens
cucuuguagcucucugaccucc

SEQ ID NO: 929298 - RNA, 11 nt, Homo sapiens
cugacugcuag

SEQ ID NO: 929299 - RNA, 17 nt, Homo sapiens
cugaguacguugugcau

SEQ ID NO: 929300 - RNA, 19 nt, Homo sapiens
cugaguacguugugcauuu

SEQ ID NO: 929301 - RNA, 18 nt, Homo sapiens
cugggcaagggaccugcu

SEQ ID NO: 929302 - RNA, 14 nt, Homo sapiens
cuggguuccugcaa

SEQ ID NO: 929303 - RNA, 17 nt, Homo sapiens
cugucacggucacuuua

SEQ ID NO: 929304 - RNA, 19 nt, Homo sapiens
cuguuauuuuaucugcuau

SEQ ID NO: 929305 - RNA, 23 nt, Homo sapiens
cuuaaaggaagguucugguguga

SEQ ID NO: 929306 - RNA, 21 nt, Homo sapiens
cuuaauuauugauguuuucau

SEQ ID NO: 929307 - RNA, 13 nt, Homo sapiens
cuuacguccuucc

SEQ ID NO: 929308 - RNA, 18 nt, Homo sapiens
cuuacucuugauuguggg

SEQ ID NO: 929309 - RNA, 13 nt, Homo sapiens
cuugaauuguagg

SEQ ID NO: 929310 - RNA, 21 nt, Homo sapiens
cuugauugugggauacuauuu

SEQ ID NO: 929311 - RNA, 20 nt, Homo sapiens
cuuguagcucucugaccucc

SEQ ID NO: 929312 - RNA, 21 nt, Homo sapiens
cuuguagcucucugaccuccu

SEQ ID NO: 929313 - RNA, 22 nt, Homo sapiens
cuuguagcucucugaccuccuc

SEQ ID NO: 929314 - RNA, 19 nt, Homo sapiens
cuuucaagggaccucucca

SEQ ID NO: 929315 - RNA, 18 nt, Homo sapiens
cuuugauuuuauaugcua

SEQ ID NO: 929316 - RNA, 15 nt, Homo sapiens
cuuuuaaacuuugau

SEQ ID NO: 929317 - RNA, 11 nt, Homo sapiens
cuuuugugcau

SEQ ID NO: 929318 - RNA, 19 nt, Homo sapiens
cuuuuuccagguuccugag

SEQ ID NO: 929319 - RNA, 21 nt, Homo sapiens
gaaaacaugcuacacacugca

SEQ ID NO: 929320 - RNA, 15 nt, Homo sapiens
gaagauucuauguua

SEQ ID NO: 929321 - RNA, 16 nt, Homo sapiens
gaagccucuauugcca

SEQ ID NO: 929322 - RNA, 19 nt, Homo sapiens
gaagccucuauugccauga

SEQ ID NO: 929323 - RNA, 16 nt, Homo sapiens
gaauauauuuccuuau

SEQ ID NO: 929324 - RNA, 18 nt, Homo sapiens
gacauuuuaugucuuucu

SEQ ID NO: 929325 - RNA, 20 nt, Homo sapiens
gagaauuuccuuacucuuga

SEQ ID NO: 929326 - RNA, 15 nt, Homo sapiens
gagagagcuuggaau

SEQ ID NO: 929327 - RNA, 17 nt, Homo sapiens
gagcgcuaccucuccag

SEQ ID NO: 929328 - RNA, 16 nt, Homo sapiens
gaggagccugcaacau

SEQ ID NO: 929329 - RNA, 20 nt, Homo sapiens
gauauuuauugauguuuuca

SEQ ID NO: 929330 - RNA, 13 nt, Homo sapiens
gauucuauguuaa

SEQ ID NO: 929331 - RNA, 16 nt, Homo sapiens
gcaaauggccaaugag

SEQ ID NO: 929332 - RNA, 17 nt, Homo sapiens
gcaaauggccaaugaga

SEQ ID NO: 929333 - RNA, 21 nt, Homo sapiens
gcaacaugccagccacuguga

SEQ ID NO: 929334 - RNA, 20 nt, Homo sapiens
gcaaucuucucagaaggcaa

SEQ ID NO: 929335 - RNA, 19 nt, Homo sapiens
gcauacugccuuguuuaau

SEQ ID NO: 929336 - RNA, 15 nt, Homo sapiens
gcauguuugugauug

SEQ ID NO: 929337 - RNA, 22 nt, Homo sapiens
gccaguaaaugggggugcauuu

SEQ ID NO: 929338 - RNA, 13 nt, Homo sapiens
gcccuagcauuuc

SEQ ID NO: 929339 - RNA, 19 nt, Homo sapiens
gcccugcccuuacaggaac

SEQ ID NO: 929340 - RNA, 13 nt, Homo sapiens
gccucuauugcca

SEQ ID NO: 929341 - RNA, 14 nt, Homo sapiens
gcuaugcauuugaa

SEQ ID NO: 929342 - RNA, 13 nt, Homo sapiens
gcuaugcuauuga

SEQ ID NO: 929343 - RNA, 20 nt, Homo sapiens
gcuguuauuuuaucugcuau

SEQ ID NO: 929344 - RNA, 21 nt, Homo sapiens
gcuuaauuauugauguuuuca

SEQ ID NO: 929345 - RNA, 14 nt, Homo sapiens
gcuuuugugcauua

SEQ ID NO: 929346 - RNA, 22 nt, Homo sapiens
ggaaaaaacaccaggauuuaag

SEQ ID NO: 929347 - RNA, 21 nt, Homo sapiens
ggaagccaaaccucugugagc

SEQ ID NO: 929348 - RNA, 21 nt, Homo sapiens
uuuuagaagauucuauguuaa

SEQ ID NO: 929349 - RNA, 15 nt, Homo sapiens
uuuucccucuucacu

SEQ ID NO: 929350 - RNA, 19 nt, Homo sapiens
uuuuuaagugcugcauuua

SEQ ID NO: 929351 - RNA, 14 nt, Homo sapiens
uaguggugugauuu

SEQ ID NO: 929352 - RNA, 14 nt, Homo sapiens
uaucccuacuguaa

SEQ ID NO: 929353 - RNA, 16 nt, Homo sapiens
uaucuauguagaauau

SEQ ID NO: 929354 - RNA, 15 nt, Homo sapiens
uaucuucacuuuuau

SEQ ID NO: 929355 - RNA, 22 nt, Homo sapiens
uaugcaugaaguaauaugcaca

SEQ ID NO: 929356 - RNA, 11 nt, Homo sapiens
uaugcauuuga

SEQ ID NO: 929357 - RNA, 17 nt, Homo sapiens
uauggcuuuugugcauu

SEQ ID NO: 929358 - RNA, 18 nt, Homo sapiens
uauggcuuuugugcauua

SEQ ID NO: 929359 - RNA, 21 nt, Homo sapiens
uauguaaauagcuaagauaua

SEQ ID NO: 929360 - RNA, 12 nt, Homo sapiens
uaugugcacauc

SEQ ID NO: 929361 - RNA, 22 nt, Homo sapiens
uauguuaauauuuuauguguaa

SEQ ID NO: 929362 - RNA, 20 nt, Homo sapiens
uauguuagagaauuuccuua

SEQ ID NO: 929363 - RNA, 20 nt, Homo sapiens
uauugauguuuucacaaaga

SEQ ID NO: 929364 - RNA, 13 nt, Homo sapiens
uauuucacuuuag

SEQ ID NO: 929365 - RNA, 23 nt, Homo sapiens
uauuuccaagaaauauuccuuaa

SEQ ID NO: 929366 - RNA, 13 nt, Homo sapiens
uauuuuaggucaa

SEQ ID NO: 929367 - RNA, 20 nt, Homo sapiens
ucaaagauauuuugcuuugu

SEQ ID NO: 929368 - RNA, 17 nt, Homo sapiens
ucaauguuuagcagauu

SEQ ID NO: 929369 - RNA, 20 nt, Homo sapiens
ucaauguuuagcagauuuaa

SEQ ID NO: 929370 - RNA, 14 nt, Homo sapiens
ucacuggcuguuaa

SEQ ID NO: 929371 - RNA, 15 nt, Homo sapiens
ucacuggcuguuaau

SEQ ID NO: 929372 - RNA, 17 nt, Homo sapiens
ucagaaauguguuauca

SEQ ID NO: 929373 - RNA, 17 nt, Homo sapiens
ucagaucucuaacuuca

SEQ ID NO: 929374 - RNA, 15 nt, Homo sapiens
ucauaagaauucugu

SEQ ID NO: 929375 - RNA, 14 nt, Homo sapiens
ucaucacccagcac

SEQ ID NO: 929376 - RNA, 22 nt, Homo sapiens
ucaucaguauugaagcauuuua

SEQ ID NO: 929377 - RNA, 21 nt, Homo sapiens
ucauucuuuuugaaaugucaa

SEQ ID NO: 929378 - RNA, 19 nt, Homo sapiens
uccaaaguacacuguuuca

SEQ ID NO: 929379 - RNA, 17 nt, Homo sapiens
ucccaccucccauucac

SEQ ID NO: 929380 - RNA, 13 nt, Homo sapiens
ucccuuggacauu

SEQ ID NO: 929381 - RNA, 23 nt, Homo sapiens
uccucucaaccaccuuucagaua

SEQ ID NO: 929382 - RNA, 21 nt, Homo sapiens
uccuggauuccucacuuugaa

SEQ ID NO: 929383 - RNA, 16 nt, Homo sapiens
ucuaugacacaugcaa

SEQ ID NO: 929384 - RNA, 17 nt, Homo sapiens
ucuaugagggcuaauau

SEQ ID NO: 929385 - RNA, 12 nt, Homo sapiens
ucuauguuaaua

SEQ ID NO: 929386 - RNA, 21 nt, Homo sapiens
ucucaaccaccuuucagauaa

SEQ ID NO: 929387 - RNA, 17 nt, Homo sapiens
ucuggcuaugcauuuga

SEQ ID NO: 929388 - RNA, 17 nt, Homo sapiens
ucuuaauucuuagcuca

SEQ ID NO: 929389 - RNA, 13 nt, Homo sapiens
ucuucacuugguu

SEQ ID NO: 929390 - RNA, 19 nt, Homo sapiens
ucuuuuuccagguuccuga

SEQ ID NO: 929391 - RNA, 21 nt, Homo sapiens
ugaaccguuugugauugccau

SEQ ID NO: 929392 - RNA, 16 nt, Homo sapiens
ugaacuaaacuuucac

SEQ ID NO: 929393 - RNA, 14 nt, Homo sapiens
ugaagacaaugacu

SEQ ID NO: 929394 - RNA, 19 nt, Homo sapiens
ugaagguagaauguuuuca

SEQ ID NO: 929395 - RNA, 17 nt, Homo sapiens
ugaaguaauaugcacac

SEQ ID NO: 929396 - RNA, 22 nt, Homo sapiens
ugacaaggggcaguggugguuu

SEQ ID NO: 929397 - RNA, 22 nt, Homo sapiens
ugacugcuaguuuauauagaaa

SEQ ID NO: 929398 - RNA, 15 nt, Homo sapiens
ugagaucaaugugac

SEQ ID NO: 929399 - RNA, 19 nt, Homo sapiens
ugauuuuauaugcuauuua

SEQ ID NO: 929400 - RNA, 23 nt, Homo sapiens
ugcaacaugccagccacugugau

SEQ ID NO: 929401 - RNA, 14 nt, Homo sapiens
ugcacacucuccca

SEQ ID NO: 929402 - RNA, 23 nt, Homo sapiens
ugcauaccacuuuuguucuuggu

SEQ ID NO: 929403 - RNA, 14 nt, Homo sapiens
ugcauuuaauuaga

SEQ ID NO: 929404 - RNA, 15 nt, Homo sapiens
ugcauuuggugguuu

SEQ ID NO: 929405 - RNA, 17 nt, Homo sapiens
ugcccuaaaguguauuu

SEQ ID NO: 929406 - RNA, 13 nt, Homo sapiens
ugcuaugcuauug

SEQ ID NO: 929407 - RNA, 18 nt, Homo sapiens
uggaagccucuauugcca

SEQ ID NO: 929408 - RNA, 21 nt, Homo sapiens
uggauucaauuuuaaggcaua

SEQ ID NO: 929409 - RNA, 16 nt, Homo sapiens
uggauuccucacuuug

SEQ ID NO: 929410 - RNA, 18 nt, Homo sapiens
uggauuccucacuuugaa

SEQ ID NO: 929411 - RNA, 19 nt, Homo sapiens
uggccagugagaucaaugu

SEQ ID NO: 929412 - RNA, 15 nt, Homo sapiens
uggcuuuugugcauu

SEQ ID NO: 929413 - RNA, 21 nt, Homo sapiens
uguaaacuaguuacuaaacau

SEQ ID NO: 929414 - RNA, 16 nt, Homo sapiens
uguaaauagcuaagau

SEQ ID NO: 929415 - RNA, 15 nt, Homo sapiens
uguaacuguaaagau

SEQ ID NO: 929416 - RNA, 18 nt, Homo sapiens
uguacucugaaaguuuug

SEQ ID NO: 929417 - RNA, 12 nt, Homo sapiens
uguagcucucug

SEQ ID NO: 929418 - RNA, 23 nt, Homo sapiens
ugugaaacuggauuaaacuuaau

SEQ ID NO: 929419 - RNA, 23 nt, Homo sapiens
ugugcauuaucuagauacuguau

SEQ ID NO: 929420 - RNA, 19 nt, Homo sapiens
uguguggucaacauuucuc

SEQ ID NO: 929421 - RNA, 15 nt, Homo sapiens
uguuaucuucacuuu

SEQ ID NO: 929422 - RNA, 23 nt, Homo sapiens
uuaaauaaaauuuuuauguaauu

SEQ ID NO: 929423 - RNA, 16 nt, Homo sapiens
uuaacaaaauuugaau

SEQ ID NO: 929424 - RNA, 20 nt, Homo sapiens
uuaaggauuuuaugcuuuaa

SEQ ID NO: 929425 - RNA, 15 nt, Homo sapiens
uuaauauuucugagg

SEQ ID NO: 929426 - RNA, 23 nt, Homo sapiens
uuauauuuccaagaaauauuccu

SEQ ID NO: 929427 - RNA, 12 nt, Homo sapiens
uuaucugcuaug

SEQ ID NO: 929428 - RNA, 13 nt, Homo sapiens
uuaucuucacuuu

SEQ ID NO: 929429 - RNA, 16 nt, Homo sapiens
uuaugacuucauuaau

SEQ ID NO: 929430 - RNA, 17 nt, Homo sapiens
uuauuauggcacaucag

SEQ ID NO: 929431 - RNA, 15 nt, Homo sapiens
uuauuuuaucugcua

SEQ ID NO: 929432 - RNA, 14 nt, Homo sapiens
uuccugacugcuag

SEQ ID NO: 929433 - RNA, 23 nt, Homo sapiens
uucucuaguucaaguucaccaga

SEQ ID NO: 929434 - RNA, 15 nt, Homo sapiens
uucuuguaaggcaua

SEQ ID NO: 929435 - RNA, 22 nt, Homo sapiens
uugaauuguaggugacuauuau

SEQ ID NO: 929436 - RNA, 20 nt, Homo sapiens
uugagaaauuaaguaucuga

SEQ ID NO: 929437 - RNA, 17 nt, Homo sapiens
uugauuuuauaugcuau

SEQ ID NO: 929438 - RNA, 24 nt, Homo sapiens
uuguaacuguaaagaugaauguca

SEQ ID NO: 929439 - RNA, 12 nt, Homo sapiens
uugugcauuugg

SEQ ID NO: 929440 - RNA, 16 nt, Homo sapiens
uuuaaaugcaccugga

SEQ ID NO: 929441 - RNA, 22 nt, Homo sapiens
uuuagcauaguaccucugcuau

SEQ ID NO: 929442 - RNA, 13 nt, Homo sapiens
uuuauaugcuauu

SEQ ID NO: 929443 - RNA, 12 nt, Homo sapiens
uuucaaacuuua

SEQ ID NO: 929444 - RNA, 16 nt, Homo sapiens
uuucuucgugaugaca

SEQ ID NO: 929445 - RNA, 11 nt, Homo sapiens
uuugagcucug

SEQ ID NO: 929446 - RNA, 20 nt, Homo sapiens
uuugcagauauucucuaguc

SEQ ID NO: 929447 - RNA, 22 nt, Homo sapiens
uuugcagcuuucucuaguucaa

SEQ ID NO: 929448 - RNA, 19 nt, Homo sapiens
gaaaauaguggugugauuu

SEQ ID NO: 929449 - RNA, 14 nt, Homo sapiens
gaaaguuuuggaaa

SEQ ID NO: 929450 - RNA, 14 nt, Homo sapiens
gaaauauuccuuaa

SEQ ID NO: 929451 - RNA, 20 nt, Homo sapiens
gaaccguuugugauugccau

SEQ ID NO: 929452 - RNA, 21 nt, Homo sapiens
gaaccguuugugauugccauu

SEQ ID NO: 929453 - RNA, 23 nt, Homo sapiens
gaagaaaauaguggugugauuug

SEQ ID NO: 929454 - RNA, 17 nt, Homo sapiens
gaagacaaugacuuacu

SEQ ID NO: 929455 - RNA, 17 nt, Homo sapiens
gaagauucuauguuaau

SEQ ID NO: 929456 - RNA, 17 nt, Homo sapiens
gaagccucuauugccau

SEQ ID NO: 929457 - RNA, 16 nt, Homo sapiens
gaaggcaaaugacuuu

SEQ ID NO: 929458 - RNA, 17 nt, Homo sapiens
gacacaugcaaggucau

SEQ ID NO: 929459 - RNA, 19 nt, Homo sapiens
gauacuauuuaauuauuuc

SEQ ID NO: 929460 - RNA, 21 nt, Homo sapiens
gcaguguuucccucuguguua

SEQ ID NO: 929461 - RNA, 19 nt, Homo sapiens
gcauuuggugguuucagaa

SEQ ID NO: 929462 - RNA, 13 nt, Homo sapiens
gcauuuguuugaa

SEQ ID NO: 929463 - RNA, 19 nt, Homo sapiens
gccaugagaguucugucac

SEQ ID NO: 929464 - RNA, 13 nt, Homo sapiens
gccauucuugcug

SEQ ID NO: 929465 - RNA, 14 nt, Homo sapiens
gcccugccaugcuc

SEQ ID NO: 929466 - RNA, 16 nt, Homo sapiens
gcccugccaugcucuc

SEQ ID NO: 929467 - RNA, 19 nt, Homo sapiens
gccuggauggcugccucac

SEQ ID NO: 929468 - RNA, 14 nt, Homo sapiens
gccuuguuuaaugu

SEQ ID NO: 929469 - RNA, 17 nt, Homo sapiens
gcggauccaagcaaaug

SEQ ID NO: 929470 - RNA, 16 nt, Homo sapiens
gcuaccucuccagccu

SEQ ID NO: 929471 - RNA, 19 nt, Homo sapiens
gcuauuuauuaaguauuuu

SEQ ID NO: 929472 - RNA, 22 nt, Homo sapiens
gcugaguguuucacaccuuauc

SEQ ID NO: 929473 - RNA, 14 nt, Homo sapiens
gcuuagaacaaagg

SEQ ID NO: 929474 - RNA, 19 nt, Homo sapiens
ggaaauguaugugugucua

SEQ ID NO: 929475 - RNA, 19 nt, Homo sapiens
ggaagguucuggugugaac

SEQ ID NO: 929476 - RNA, 15 nt, Homo sapiens
ggaccucuccaugau

SEQ ID NO: 929477 - RNA, 15 nt, Homo sapiens
ggcuugugugcacau

SEQ ID NO: 929478 - RNA, 11 nt, Homo sapiens
gggaccucucc

SEQ ID NO: 929479 - RNA, 12 nt, Homo sapiens
gguaugauuaac

SEQ ID NO: 929480 - RNA, 20 nt, Homo sapiens
guaauuugugauacaaugcu

SEQ ID NO: 929481 - RNA, 23 nt, Homo sapiens
guaauuuuuuuaucgucacugcu

SEQ ID NO: 929482 - RNA, 19 nt, Homo sapiens
guacaucaaugauaaugcu

SEQ ID NO: 929483 - RNA, 15 nt, Homo sapiens
guagcguacaucaau

SEQ ID NO: 929484 - RNA, 14 nt, Homo sapiens
guaugaggcauuug

SEQ ID NO: 929485 - RNA, 15 nt, Homo sapiens
guaugaggcauuugu

SEQ ID NO: 929486 - RNA, 21 nt, Homo sapiens
gucaaacccaaguuaguucaa

SEQ ID NO: 929487 - RNA, 14 nt, Homo sapiens
gucauuauguuaau

SEQ ID NO: 929488 - RNA, 15 nt, Homo sapiens
gucggaaaacaugcu

SEQ ID NO: 929489 - RNA, 14 nt, Homo sapiens
gugcacauauccuu

SEQ ID NO: 929490 - RNA, 22 nt, Homo sapiens
guuugcagauauucucuaguca

SEQ ID NO: 929491 - RNA, 15 nt, Homo sapiens
guuugugauugccau

SEQ ID NO: 929492 - RNA, 21 nt, Homo sapiens
guuuuacaguguuucuggcuu

SEQ ID NO: 929493 - RNA, 21 nt, Homo sapiens
guuuucacaaagaacaggaaa

SEQ ID NO: 929494 - RNA, 22 nt, Homo sapiens
guuuuuauggcuuuugugcauu

SEQ ID NO: 929495 - RNA, 16 nt, Homo sapiens
uaaagaugaaugucag

SEQ ID NO: 929496 - RNA, 19 nt, Homo sapiens
uaaaugggggugcauuuga

SEQ ID NO: 929497 - RNA, 16 nt, Homo sapiens
uaacaaugacuuguac

SEQ ID NO: 929498 - RNA, 19 nt, Homo sapiens
uaaccaguguuguggauuu

SEQ ID NO: 929499 - RNA, 18 nt, Homo sapiens
uaacucuaccugcacacu

SEQ ID NO: 929500 - RNA, 19 nt, Homo sapiens
uaagaaaaaggaugcacag

SEQ ID NO: 929501 - RNA, 14 nt, Homo sapiens
uaaggaaacugggu

SEQ ID NO: 929502 - RNA, 16 nt, Homo sapiens
uaaguaucagcuacaa

SEQ ID NO: 929503 - RNA, 14 nt, Homo sapiens
uaauaucaucagua

SEQ ID NO: 929504 - RNA, 21 nt, Homo sapiens
uaaugguaguuuuacaguguu

SEQ ID NO: 929505 - RNA, 18 nt, Homo sapiens
uacaaaauauagcuuuca

SEQ ID NO: 929506 - RNA, 17 nt, Homo sapiens
uacuguccccaucauca

SEQ ID NO: 929507 - RNA, 13 nt, Homo sapiens
uagaagauucuau

SEQ ID NO: 929508 - RNA, 15 nt, Homo sapiens
uagagaauuuccuua

SEQ ID NO: 929509 - RNA, 16 nt, Homo sapiens
uagagaauuuccuuac

SEQ ID NO: 929510 - RNA, 15 nt, Homo sapiens
uagcccuuacguccu

SEQ ID NO: 929511 - RNA, 16 nt, Homo sapiens
uaguaccucugcuauu

SEQ ID NO: 929512 - RNA, 17 nt, Homo sapiens
uaguaugaggcauuugu

SEQ ID NO: 929513 - RNA, 11 nt, Homo sapiens
uaguuagcuuu

SEQ ID NO: 929514 - RNA, 19 nt, Homo sapiens
uaguucaauccugauucau

SEQ ID NO: 929515 - RNA, 17 nt, Homo sapiens
uauauaugugaugaucu

SEQ ID NO: 929516 - RNA, 15 nt, Homo sapiens
uaucagcuacaauug

SEQ ID NO: 929517 - RNA, 14 nt, Homo sapiens
uaucuucacuuuua

SEQ ID NO: 929518 - RNA, 22 nt, Homo sapiens
uaugaggcauuuguuugaacug

SEQ ID NO: 929519 - RNA, 18 nt, Homo sapiens
uaugcuauugaaguuuug

SEQ ID NO: 929520 - RNA, 21 nt, Homo sapiens
uaugcuauuuauuaaguauuu

SEQ ID NO: 929521 - RNA, 20 nt, Homo sapiens
uauuuauugauguuuucaca

SEQ ID NO: 929522 - RNA, 16 nt, Homo sapiens
uauuuuaucugcuaug

SEQ ID NO: 929523 - RNA, 22 nt, Homo sapiens
ucaaacccaaguuaguucaauc

SEQ ID NO: 929524 - RNA, 12 nt, Homo sapiens
ucaaauguucuc

SEQ ID NO: 929525 - RNA, 14 nt, Homo sapiens
ucacagauaccucu

SEQ ID NO: 929526 - RNA, 20 nt, Homo sapiens
ucacuggcuguuaaucuuuc

SEQ ID NO: 929527 - RNA, 18 nt, Homo sapiens
ucagaaggcaaaugacuu

SEQ ID NO: 929528 - RNA, 15 nt, Homo sapiens
ucaggugugcccuga

SEQ ID NO: 929529 - RNA, 13 nt, Homo sapiens
uccucacuuugaa

SEQ ID NO: 929530 - RNA, 12 nt, Homo sapiens
uccugcaaugaa

SEQ ID NO: 929531 - RNA, 18 nt, Homo sapiens
uccuuagcccaucuuuca

SEQ ID NO: 929532 - RNA, 16 nt, Homo sapiens
uccuuauucagaauuu

SEQ ID NO: 929533 - RNA, 22 nt, Homo sapiens
uccuucauggcaggcaucgcca

SEQ ID NO: 929534 - RNA, 17 nt, Homo sapiens
uccuuccacuuccaaga

SEQ ID NO: 929535 - RNA, 17 nt, Homo sapiens
ucgccauucuugcugaa

SEQ ID NO: 929536 - RNA, 18 nt, Homo sapiens
ucuaaaggcuaccuuugu

SEQ ID NO: 929537 - RNA, 16 nt, Homo sapiens
ucuagauacuguauca

SEQ ID NO: 929538 - RNA, 15 nt, Homo sapiens
ucuaugacacaugca

SEQ ID NO: 929539 - RNA, 12 nt, Homo sapiens
ucuauugccaug

SEQ ID NO: 929540 - RNA, 22 nt, Homo sapiens
ucucaauguuuagcagauuuaa

SEQ ID NO: 929541 - RNA, 14 nt, Homo sapiens
ucucaguugcagcc

SEQ ID NO: 929542 - RNA, 18 nt, Homo sapiens
ucuccauggcccugccau

SEQ ID NO: 929543 - RNA, 19 nt, Homo sapiens
ucucuagucauuuguuaau

SEQ ID NO: 929544 - RNA, 13 nt, Homo sapiens
ucugcuaugcuau

SEQ ID NO: 929545 - RNA, 19 nt, Homo sapiens
ucuggaagccucuauugcc

SEQ ID NO: 929546 - RNA, 14 nt, Homo sapiens
ucuucauaccuaca

SEQ ID NO: 929547 - RNA, 22 nt, Homo sapiens
ucuugaaauauaggaacuuaaa

SEQ ID NO: 929548 - RNA, 21 nt, Homo sapiens
ugaagcuuuaagaacuaaaau

SEQ ID NO: 929549 - RNA, 18 nt, Homo sapiens
ugaagucucugaagugaa

SEQ ID NO: 929550 - RNA, 13 nt, Homo sapiens
ugacuuacuguac

SEQ ID NO: 929551 - RNA, 18 nt, Homo sapiens
ugaguacguugugcauuu

SEQ ID NO: 929552 - RNA, 15 nt, Homo sapiens
ugauuucacagugug

SEQ ID NO: 929553 - RNA, 21 nt, Homo sapiens
ugcaguguuucccucuguguu

SEQ ID NO: 929554 - RNA, 22 nt, Homo sapiens
ugcauaggugaucucauuuaau

SEQ ID NO: 929555 - RNA, 17 nt, Homo sapiens
ugcaugaaguaauaugc

SEQ ID NO: 929556 - RNA, 18 nt, Homo sapiens
ugcaugaaguaauaugca

SEQ ID NO: 929557 - RNA, 18 nt, Homo sapiens
ugccaccuccugccucag

SEQ ID NO: 929558 - RNA, 15 nt, Homo sapiens
ugcgccuaauguguu

SEQ ID NO: 929559 - RNA, 16 nt, Homo sapiens
ugcuaguuuauauaga

SEQ ID NO: 929560 - RNA, 22 nt, Homo sapiens
ugcugaaccguuugugauugcc

SEQ ID NO: 929561 - RNA, 14 nt, Homo sapiens
uggaaacguauuca

SEQ ID NO: 929562 - RNA, 19 nt, Homo sapiens
uggaagccucuauugccau

SEQ ID NO: 929563 - RNA, 15 nt, Homo sapiens
uggauggcugccuca

SEQ ID NO: 929564 - RNA, 23 nt, Homo sapiens
uggauugugccuaauguguuuga

SEQ ID NO: 929565 - RNA, 15 nt, Homo sapiens
uggcaggcaucgcca

SEQ ID NO: 929566 - RNA, 12 nt, Homo sapiens
uggccuuucaua

SEQ ID NO: 929567 - RNA, 23 nt, Homo sapiens
ugggauacuauuuaauuauuuca

SEQ ID NO: 929568 - RNA, 21 nt, Homo sapiens
ugguaguuuuacaguguuucu

SEQ ID NO: 929569 - RNA, 11 nt, Homo sapiens
uggugugauuu

SEQ ID NO: 929570 - RNA, 21 nt, Homo sapiens
uguauguaaauagcuaagaua

SEQ ID NO: 929571 - RNA, 17 nt, Homo sapiens
uguccgcuauccaccaa

SEQ ID NO: 929572 - RNA, 12 nt, Homo sapiens
ugugauugccau

SEQ ID NO: 929573 - RNA, 21 nt, Homo sapiens
ugugucucaggugugcccuga

SEQ ID NO: 929574 - RNA, 19 nt, Homo sapiens
uguuuccuagcacacacuu

SEQ ID NO: 929575 - RNA, 19 nt, Homo sapiens
uuaaggaugcuuguacaua

SEQ ID NO: 929576 - RNA, 19 nt, Homo sapiens
uuaauaucaucaguauuga

SEQ ID NO: 929577 - RNA, 20 nt, Homo sapiens
uuacguccuuccacuuccaa

SEQ ID NO: 929578 - RNA, 21 nt, Homo sapiens
uuacuaaacauguauguaaau

SEQ ID NO: 929579 - RNA, 15 nt, Homo sapiens
uuagaugaaugucag

SEQ ID NO: 929580 - RNA, 16 nt, Homo sapiens
uuagcccaucuuucaa

SEQ ID NO: 929581 - RNA, 16 nt, Homo sapiens
uuaguaugugcauuua

SEQ ID NO: 929582 - RNA, 16 nt, Homo sapiens
uuauaguaaugugacu

SEQ ID NO: 929583 - RNA, 14 nt, Homo sapiens
uuauauucauucuu

SEQ ID NO: 929584 - RNA, 13 nt, Homo sapiens
uuauucagaauuu

SEQ ID NO: 929585 - RNA, 16 nt, Homo sapiens
uuauugauguuuucau

SEQ ID NO: 929586 - RNA, 12 nt, Homo sapiens
uuauuucacuuu

SEQ ID NO: 929587 - RNA, 12 nt, Homo sapiens
uucaaacuuuac

SEQ ID NO: 929588 - RNA, 15 nt, Homo sapiens
uucaaauguucucca

SEQ ID NO: 929589 - RNA, 22 nt, Homo sapiens
auauccuuagcccaucuuucaa

SEQ ID NO: 929590 - RNA, 23 nt, Homo sapiens
aucacaguuuugguugcuuuaau

SEQ ID NO: 929591 - RNA, 20 nt, Homo sapiens
aucauuuacuuuuaaacuuu

SEQ ID NO: 929592 - RNA, 13 nt, Homo sapiens
aucccuacuguaa

SEQ ID NO: 929593 - RNA, 20 nt, Homo sapiens
aucgucacugcuuaacuuca

SEQ ID NO: 929594 - RNA, 15 nt, Homo sapiens
aucuagauacuguau

SEQ ID NO: 929595 - RNA, 14 nt, Homo sapiens
aucugcuaugcuau

SEQ ID NO: 929596 - RNA, 20 nt, Homo sapiens
aucuuucaagggaccucucc

SEQ ID NO: 929597 - RNA, 22 nt, Homo sapiens
aucuuucaagggaccucuccau

SEQ ID NO: 929598 - RNA, 11 nt, Homo sapiens
augauguuuca

SEQ ID NO: 929599 - RNA, 15 nt, Homo sapiens
augcaaggucauuuu

SEQ ID NO: 929600 - RNA, 14 nt, Homo sapiens
augcuauuuauuaa

SEQ ID NO: 929601 - RNA, 11 nt, Homo sapiens
augcucuccaa

SEQ ID NO: 929602 - RNA, 15 nt, Homo sapiens
augcuuguacauaau

SEQ ID NO: 929603 - RNA, 14 nt, Homo sapiens
auggcaaacugcca

SEQ ID NO: 929604 - RNA, 17 nt, Homo sapiens
auggcaggcaucgccau

SEQ ID NO: 929605 - RNA, 16 nt, Homo sapiens
augggggugcauuuga

SEQ ID NO: 929606 - RNA, 19 nt, Homo sapiens
augguaguuuuacaguguu

SEQ ID NO: 929607 - RNA, 16 nt, Homo sapiens
augucagccacuguga

SEQ ID NO: 929608 - RNA, 19 nt, Homo sapiens
augucagccacugugauag

SEQ ID NO: 929609 - RNA, 14 nt, Homo sapiens
augugaugaucuac

SEQ ID NO: 929610 - RNA, 20 nt, Homo sapiens
auguuagagaauuuccuuac

SEQ ID NO: 929611 - RNA, 20 nt, Homo sapiens
auuaacuuuuauaaacuuua

SEQ ID NO: 929612 - RNA, 19 nt, Homo sapiens
auucucuccuguaccucuu

SEQ ID NO: 929613 - RNA, 21 nt, Homo sapiens
auugccaugagaguucuguca

SEQ ID NO: 929614 - RNA, 15 nt, Homo sapiens
auuuaagauauguaa

SEQ ID NO: 929615 - RNA, 14 nt, Homo sapiens
auuuaaguuucaca

SEQ ID NO: 929616 - RNA, 22 nt, Homo sapiens
auuuaauuacuucuuaguaugu

SEQ ID NO: 929617 - RNA, 18 nt, Homo sapiens
auuucuaaaucuccaaaa

SEQ ID NO: 929618 - RNA, 22 nt, Homo sapiens
auuucugaggagccugcaacau

SEQ ID NO: 929619 - RNA, 15 nt, Homo sapiens
auuuuauuaugcaug

SEQ ID NO: 929620 - RNA, 17 nt, Homo sapiens
auuuuuuuucuguuaua

SEQ ID NO: 929621 - RNA, 17 nt, Homo sapiens
caaaauauagcuuucau

SEQ ID NO: 929622 - RNA, 19 nt, Homo sapiens
caacaugccagccacugug

SEQ ID NO: 929623 - RNA, 18 nt, Homo sapiens
caagaaaauggccaguga

SEQ ID NO: 929624 - RNA, 20 nt, Homo sapiens
caagaucuuuuuccagguuc

SEQ ID NO: 929625 - RNA, 14 nt, Homo sapiens
caagcaaauggcca

SEQ ID NO: 929626 - RNA, 16 nt, Homo sapiens
caauccugauucauau

SEQ ID NO: 929627 - RNA, 16 nt, Homo sapiens
caaugacuuacuguac

SEQ ID NO: 929628 - RNA, 17 nt, Homo sapiens
caaugagaucauuguga

SEQ ID NO: 929629 - RNA, 22 nt, Homo sapiens
cacaccccagacgaugucuuca

SEQ ID NO: 929630 - RNA, 22 nt, Homo sapiens
cacacucucccauuauauuuau

SEQ ID NO: 929631 - RNA, 17 nt, Homo sapiens
cacaugcaaggucauuu

SEQ ID NO: 929632 - RNA, 22 nt, Homo sapiens
cacaugucagccacugugauag

SEQ ID NO: 929633 - RNA, 24 nt, Homo sapiens
cacugcuuaacuucacauauugau

SEQ ID NO: 929634 - RNA, 19 nt, Homo sapiens
cagaaaugccuuacccuca

SEQ ID NO: 929635 - RNA, 17 nt, Homo sapiens
cagauauucucuaguca

SEQ ID NO: 929636 - RNA, 18 nt, Homo sapiens
cagcucucaguugcagcc

SEQ ID NO: 929637 - RNA, 16 nt, Homo sapiens
caggauuuaaguuuca

SEQ ID NO: 929638 - RNA, 17 nt, Homo sapiens
caggauuuaaguuucac

SEQ ID NO: 929639 - RNA, 17 nt, Homo sapiens
cauaguaccucugcuau

SEQ ID NO: 929640 - RNA, 16 nt, Homo sapiens
cauauuaccacagaca

SEQ ID NO: 929641 - RNA, 23 nt, Homo sapiens
cauauuuaacaaaauuugaauag

SEQ ID NO: 929642 - RNA, 18 nt, Homo sapiens
caucaguauugaagcauu

SEQ ID NO: 929643 - RNA, 11 nt, Homo sapiens
caucucugcaa

SEQ ID NO: 929644 - RNA, 13 nt, Homo sapiens
caucucugcaauc

SEQ ID NO: 929645 - RNA, 18 nt, Homo sapiens
caucuuucaagggaccuc

SEQ ID NO: 929646 - RNA, 19 nt, Homo sapiens
caugaaguaauaugcacac

SEQ ID NO: 929647 - RNA, 16 nt, Homo sapiens
cauguauuuguuugca

SEQ ID NO: 929648 - RNA, 16 nt, Homo sapiens
caugucagccacugug

SEQ ID NO: 929649 - RNA, 23 nt, Homo sapiens
cauucacagauaccucucuugua

SEQ ID NO: 929650 - RNA, 19 nt, Homo sapiens
cauucuccuuguguuacua

SEQ ID NO: 929651 - RNA, 21 nt, Homo sapiens
ccaguaaaugggggugcauuu

SEQ ID NO: 929652 - RNA, 18 nt, Homo sapiens
ccagugagaucaauguga

SEQ ID NO: 929653 - RNA, 21 nt, Homo sapiens
ccagugagaucaaugugacgg

SEQ ID NO: 929654 - RNA, 20 nt, Homo sapiens
ccauaaccccggaagccaaa

SEQ ID NO: 929655 - RNA, 15 nt, Homo sapiens
ccaugagaguucugu

SEQ ID NO: 929656 - RNA, 22 nt, Homo sapiens
ccaugagaguucugucacgguc

SEQ ID NO: 929657 - RNA, 21 nt, Homo sapiens
cccagggcuugugugcacaua

SEQ ID NO: 929658 - RNA, 15 nt, Homo sapiens
cccuggccuagcaua

SEQ ID NO: 929659 - RNA, 18 nt, Homo sapiens
cccuuggacauuuuaugu

SEQ ID NO: 929660 - RNA, 12 nt, Homo sapiens
ccggaagccaaa

SEQ ID NO: 929661 - RNA, 17 nt, Homo sapiens
ccuagcacacacuuuug

SEQ ID NO: 929662 - RNA, 16 nt, Homo sapiens
ccucaccucucaccuc

SEQ ID NO: 929663 - RNA, 20 nt, Homo sapiens
ccugagcccuacugugucuc

SEQ ID NO: 929664 - RNA, 18 nt, Homo sapiens
ccuuauucagaauuucua

SEQ ID NO: 929665 - RNA, 14 nt, Homo sapiens
cguugugcauuugg

SEQ ID NO: 929666 - RNA, 19 nt, Homo sapiens
cguuucuaugacacaugca

SEQ ID NO: 929667 - RNA, 16 nt, Homo sapiens
cguuugugauugccau

SEQ ID NO: 929668 - RNA, 17 nt, Homo sapiens
cuaaacauguauguaaa

SEQ ID NO: 929669 - RNA, 19 nt, Homo sapiens
cuacaaaauauagcuuuca

SEQ ID NO: 929670 - RNA, 19 nt, Homo sapiens
cuagaaaacaggcaaauuc

SEQ ID NO: 929671 - RNA, 14 nt, Homo sapiens
cuagauagucaaua

SEQ ID NO: 929672 - RNA, 19 nt, Homo sapiens
cuagcccuuacguccuucc

SEQ ID NO: 929673 - RNA, 13 nt, Homo sapiens
cuauuauauucau

SEQ ID NO: 929674 - RNA, 14 nt, Homo sapiens
cuauuauauucauu

SEQ ID NO: 929675 - RNA, 21 nt, Homo sapiens
cuauuuauuuauuuauucauu

SEQ ID NO: 929676 - RNA, 19 nt, Homo sapiens
cuauuuuuuuucuguuaua

SEQ ID NO: 929677 - RNA, 21 nt, Homo sapiens
cucaauguuuagcagauuuaa

SEQ ID NO: 929678 - RNA, 13 nt, Homo sapiens
cucagaaggcaaa

SEQ ID NO: 929679 - RNA, 16 nt, Homo sapiens
cuccaauuaaggauuu

SEQ ID NO: 929680 - RNA, 23 nt, Homo sapiens
cucugaccuccuccuucauggca

SEQ ID NO: 929681 - RNA, 21 nt, Homo sapiens
cugaaaccccagggcuugugu

SEQ ID NO: 929682 - RNA, 15 nt, Homo sapiens
cugaaccguuuguga

SEQ ID NO: 929683 - RNA, 22 nt, Homo sapiens
cugaaccguuugugauugccau

SEQ ID NO: 929684 - RNA, 23 nt, Homo sapiens
cugcaacaugccagccacuguga

SEQ ID NO: 929685 - RNA, 23 nt, Homo sapiens
cugcaaucuucucagaaggcaaa

SEQ ID NO: 929686 - RNA, 20 nt, Homo sapiens
cugccucagguguccgcuau

SEQ ID NO: 929687 - RNA, 22 nt, Homo sapiens
cugcuaugcuauugaaguuuug

SEQ ID NO: 929688 - RNA, 14 nt, Homo sapiens
cuguaucaugacaa

SEQ ID NO: 929689 - RNA, 16 nt, Homo sapiens
cugugucucaggugug

SEQ ID NO: 929690 - RNA, 21 nt, Homo sapiens
cugugucucaggugugcccug

SEQ ID NO: 929691 - RNA, 14 nt, Homo sapiens
cuguucuuucuggc

SEQ ID NO: 929692 - RNA, 18 nt, Homo sapiens
cuuaguaugugcauuuaa

SEQ ID NO: 929693 - RNA, 16 nt, Homo sapiens
cuuccacuuccaagau

SEQ ID NO: 929694 - RNA, 23 nt, Homo sapiens
cuugcaaaguaucccuacuguaa

SEQ ID NO: 929695 - RNA, 21 nt, Homo sapiens
cuuguacauaaugcgugcaua

SEQ ID NO: 929696 - RNA, 20 nt, Homo sapiens
cuuuacuguccccaucauca

SEQ ID NO: 929697 - RNA, 23 nt, Homo sapiens
cuuucaagggaccucuccaugau

SEQ ID NO: 929698 - RNA, 19 nt, Homo sapiens
cuuucagauaacuguuauu

SEQ ID NO: 929699 - RNA, 13 nt, Homo sapiens
gaaaacaggcaaa

SEQ ID NO: 929700 - RNA, 20 nt, Homo sapiens
gaaaaguuucccagucuuca

SEQ ID NO: 929701 - RNA, 15 nt, Homo sapiens
uuuagaugaauguca

SEQ ID NO: 929702 - RNA, 18 nt, Homo sapiens
uuuaucugcuaugcuauu

SEQ ID NO: 929703 - RNA, 13 nt, Homo sapiens
uuuaugcuuuaaa

SEQ ID NO: 929704 - RNA, 21 nt, Homo sapiens
uuuccagguuccugagcccua

SEQ ID NO: 929705 - RNA, 19 nt, Homo sapiens
uuucuggcuaugcauuuga

SEQ ID NO: 929706 - RNA, 16 nt, Homo sapiens
uuugaagagugugagg

SEQ ID NO: 929707 - RNA, 16 nt, Homo sapiens
uuugaagauagaaggu

SEQ ID NO: 929708 - RNA, 13 nt, Homo sapiens
uuugguugcuuua

SEQ ID NO: 929709 - RNA, 22 nt, Homo sapiens
uuuguuaguaugaggcauuugu

SEQ ID NO: 929710 - RNA, 15 nt, Homo sapiens
uuuuaaaugcaccug

SEQ ID NO: 929711 - RNA, 16 nt, Homo sapiens
uuuugguugcuuuaau

SEQ ID NO: 929712 - RNA, 21 nt, Homo sapiens
uuuugguugcuuuaauaucau

SEQ ID NO: 929713 - RNA, 19 nt, Homo sapiens
aaaaaacaccaggauuuaa

SEQ ID NO: 929714 - RNA, 19 nt, Homo sapiens
uuguauucucuccuguacc

SEQ ID NO: 929715 - RNA, 20 nt, Homo sapiens
uugugauacaaugcugugcc

SEQ ID NO: 929716 - RNA, 18 nt, Homo sapiens
uugugugcacauauccuu

SEQ ID NO: 929717 - RNA, 19 nt, Homo sapiens
uuguuugcauaggugaucu

SEQ ID NO: 929718 - RNA, 20 nt, Homo sapiens
uuuagcagauuuaagauaug

SEQ ID NO: 929719 - RNA, 23 nt, Homo sapiens
uuuccacauaaggaaacuggguu

SEQ ID NO: 929720 - RNA, 16 nt, Homo sapiens
uuuccagguuccugag

SEQ ID NO: 929721 - RNA, 18 nt, Homo sapiens
uuucuggaggucucugaa

SEQ ID NO: 929722 - RNA, 23 nt, Homo sapiens
uuucuuguaaggcauacugccuu

SEQ ID NO: 929723 - RNA, 18 nt, Homo sapiens
uuugaagguagaauguuu

SEQ ID NO: 929724 - RNA, 14 nt, Homo sapiens
uuugagcucuggaa

SEQ ID NO: 929725 - RNA, 14 nt, Homo sapiens
uuuuaaacuuugau

SEQ ID NO: 929726 - RNA, 13 nt, Homo sapiens
uuuuaguugucaa

SEQ ID NO: 929727 - RNA, 20 nt, Homo sapiens
uuuucacaaagaacaggaaa

SEQ ID NO: 929728 - RNA, 14 nt, Homo sapiens
uuuugaaaugucaa

SEQ ID NO: 929729 - RNA, 15 nt, Homo sapiens
gauauucucuaguca

SEQ ID NO: 929730 - RNA, 15 nt, Homo sapiens
gaugaaugucaguug

SEQ ID NO: 929731 - RNA, 13 nt, Homo sapiens
gauuaaacuuaau

SEQ ID NO: 929732 - RNA, 16 nt, Homo sapiens
gauuccucacuuugaa

SEQ ID NO: 929733 - RNA, 15 nt, Homo sapiens
gauuucuguuuagau

SEQ ID NO: 929734 - RNA, 15 nt, Homo sapiens
gauuuuaugcuuuaa

SEQ ID NO: 929735 - RNA, 21 nt, Homo sapiens
gcaaacugccaucauuuacuu

SEQ ID NO: 929736 - RNA, 20 nt, Homo sapiens
gcaacaugccagccacugug

SEQ ID NO: 929737 - RNA, 18 nt, Homo sapiens
gcaugaaguaauaugcac

SEQ ID NO: 929738 - RNA, 22 nt, Homo sapiens
gccaggaaucacuggcuguuaa

SEQ ID NO: 929739 - RNA, 15 nt, Homo sapiens
gccagugagaucaau

SEQ ID NO: 929740 - RNA, 23 nt, Homo sapiens
gcccaucuuucaagggaccucuc

SEQ ID NO: 929741 - RNA, 13 nt, Homo sapiens
gccucaccucuca

SEQ ID NO: 929742 - RNA, 14 nt, Homo sapiens
gcucucugaccucc

SEQ ID NO: 929743 - RNA, 15 nt, Homo sapiens
gcuugugugcacaua

SEQ ID NO: 929744 - RNA, 20 nt, Homo sapiens
ggaaauauuuuaauguuucu

SEQ ID NO: 929745 - RNA, 16 nt, Homo sapiens
ggaaggcaacauacac

SEQ ID NO: 929746 - RNA, 18 nt, Homo sapiens
ggaaucacuggcuguuaa

SEQ ID NO: 929747 - RNA, 14 nt, Homo sapiens
ggagccugcaacau

SEQ ID NO: 929748 - RNA, 15 nt, Homo sapiens
ggauacuauuuaauu

SEQ ID NO: 929749 - RNA, 15 nt, Homo sapiens
ggauucaauuuuaag

SEQ ID NO: 929750 - RNA, 13 nt, Homo sapiens
ggcuuuugugcau

SEQ ID NO: 929751 - RNA, 23 nt, Homo sapiens
ggucacuuuacuguccccaucau

SEQ ID NO: 929752 - RNA, 16 nt, Homo sapiens
guaaauagcuaagaua

SEQ ID NO: 929753 - RNA, 19 nt, Homo sapiens
guaaauagcuaagauauaa

SEQ ID NO: 929754 - RNA, 21 nt, Homo sapiens
guaaaugggggugcauuugag

SEQ ID NO: 929755 - RNA, 23 nt, Homo sapiens
guaacuguaaagaugaaugucag

SEQ ID NO: 929756 - RNA, 21 nt, Homo sapiens
guacacuguuucaaacuuuac

SEQ ID NO: 929757 - RNA, 15 nt, Homo sapiens
guacguugugcauuu

SEQ ID NO: 929758 - RNA, 17 nt, Homo sapiens
guacguugugcauuugg

SEQ ID NO: 929759 - RNA, 18 nt, Homo sapiens
guagcucucugaccuccu

SEQ ID NO: 929760 - RNA, 22 nt, Homo sapiens
guagcucucugaccuccuccuu

SEQ ID NO: 929761 - RNA, 18 nt, Homo sapiens
guauucaaacaauuugaa

SEQ ID NO: 929762 - RNA, 12 nt, Homo sapiens
gucaacauuucu

SEQ ID NO: 929763 - RNA, 15 nt, Homo sapiens
gucacuuuacugucc

SEQ ID NO: 929764 - RNA, 16 nt, Homo sapiens
guccuauuauauucau

SEQ ID NO: 929765 - RNA, 23 nt, Homo sapiens
gugaagacaaugacuuacuguac

SEQ ID NO: 929766 - RNA, 18 nt, Homo sapiens
guuaaguaucagcuacaa

SEQ ID NO: 929767 - RNA, 18 nt, Homo sapiens
guuagagaauuuccuuac

SEQ ID NO: 929768 - RNA, 21 nt, Homo sapiens
guucaaucuggauucauauuu

SEQ ID NO: 929769 - RNA, 23 nt, Homo sapiens
guuuagcauaguaccucugcuau

SEQ ID NO: 929770 - RNA, 15 nt, Homo sapiens
guuuuuaagccuuaa

SEQ ID NO: 929771 - RNA, 23 nt, Homo sapiens
guuuuuauggcuuuugugcauua

SEQ ID NO: 929772 - RNA, 15 nt, Homo sapiens
uaaagaucauguaaa

SEQ ID NO: 929773 - RNA, 16 nt, Homo sapiens
uaacagaaauguacag

SEQ ID NO: 929774 - RNA, 19 nt, Homo sapiens
uaagucuguuuuaugacuu

SEQ ID NO: 929775 - RNA, 13 nt, Homo sapiens
uaaucaacugggc

SEQ ID NO: 929776 - RNA, 19 nt, Homo sapiens
uaaugaaguguuuagcaua

SEQ ID NO: 929777 - RNA, 17 nt, Homo sapiens
uaauuauuucacuuuag

SEQ ID NO: 929778 - RNA, 17 nt, Homo sapiens
uacauaaugcgugcaua

SEQ ID NO: 929779 - RNA, 22 nt, Homo sapiens
uaccucugcuauuugcuguuau

SEQ ID NO: 929780 - RNA, 14 nt, Homo sapiens
uaccugcacacugu

SEQ ID NO: 929781 - RNA, 16 nt, Homo sapiens
uacguugugcauuugg

SEQ ID NO: 929782 - RNA, 20 nt, Homo sapiens
uagaaaacaggcaaauuccu

SEQ ID NO: 929783 - RNA, 14 nt, Homo sapiens
uagaguugauacua

SEQ ID NO: 929784 - RNA, 19 nt, Homo sapiens
uagaugaagaagcuagaaa

SEQ ID NO: 929785 - RNA, 17 nt, Homo sapiens
uaguuacuaaacaugua

SEQ ID NO: 929786 - RNA, 18 nt, Homo sapiens
uaguuacuaaacauguau

SEQ ID NO: 929787 - RNA, 22 nt, Homo sapiens
uaguuacuaaacauguauguaa

SEQ ID NO: 929788 - RNA, 13 nt, Homo sapiens
uaguuagcuuucu

SEQ ID NO: 929789 - RNA, 17 nt, Homo sapiens
uauacauaaacaagacc

SEQ ID NO: 929790 - RNA, 13 nt, Homo sapiens
uauauuuccuuau

SEQ ID NO: 929791 - RNA, 14 nt, Homo sapiens
uaucaucaguauug

SEQ ID NO: 929792 - RNA, 14 nt, Homo sapiens
uaugaggcauuugu

SEQ ID NO: 929793 - RNA, 15 nt, Homo sapiens
uaugugcacaucugu

SEQ ID NO: 929794 - RNA, 22 nt, Homo sapiens
uauugaaaugauuucacagugu

SEQ ID NO: 929795 - RNA, 21 nt, Homo sapiens
ucaaacccaaguuaguucaau

SEQ ID NO: 929796 - RNA, 20 nt, Homo sapiens
ucacaguuuugguugcuuua

SEQ ID NO: 929797 - RNA, 21 nt, Homo sapiens
ucacaguuuugguugcuuuaa

SEQ ID NO: 929798 - RNA, 22 nt, Homo sapiens
ucaccaucaauuuuaguuguca

SEQ ID NO: 929799 - RNA, 16 nt, Homo sapiens
ucacugcuuaacuuca

SEQ ID NO: 929800 - RNA, 13 nt, Homo sapiens
ucacuuuacuguc

SEQ ID NO: 929801 - RNA, 17 nt, Homo sapiens
ucagcagagaaguuuuc

SEQ ID NO: 929802 - RNA, 20 nt, Homo sapiens
agggcuugugugcacauauc

SEQ ID NO: 929803 - RNA, 17 nt, Homo sapiens
agguuccugagcccuac

SEQ ID NO: 929804 - RNA, 18 nt, Homo sapiens
agguuuuuaagccuuaaa

SEQ ID NO: 929805 - RNA, 14 nt, Homo sapiens
aguaccucugcuau

SEQ ID NO: 929806 - RNA, 14 nt, Homo sapiens
aguaguuagcuuuc

SEQ ID NO: 929807 - RNA, 20 nt, Homo sapiens
agucuucagcagagaaguuu

SEQ ID NO: 929808 - RNA, 13 nt, Homo sapiens
agucuucuauuua

SEQ ID NO: 929809 - RNA, 20 nt, Homo sapiens
aguucuaugagggcuaauau

SEQ ID NO: 929810 - RNA, 17 nt, Homo sapiens
auaaaauuuuuauguaa

SEQ ID NO: 929811 - RNA, 14 nt, Homo sapiens
auaaagcagcguuu

SEQ ID NO: 929812 - RNA, 21 nt, Homo sapiens
auaaugcgugcauaccacuuu

SEQ ID NO: 929813 - RNA, 16 nt, Homo sapiens
auaauuuuagacauuc

SEQ ID NO: 929814 - RNA, 21 nt, Homo sapiens
auacauaaacaagaccacguu

SEQ ID NO: 929815 - RNA, 13 nt, Homo sapiens
auagacaauuuau

SEQ ID NO: 929816 - RNA, 19 nt, Homo sapiens
auauaaaaauaaagcacuu

SEQ ID NO: 929817 - RNA, 19 nt, Homo sapiens
auauauuuccuuauucaga

SEQ ID NO: 929818 - RNA, 18 nt, Homo sapiens
aucacaguuuugguugcu

SEQ ID NO: 929819 - RNA, 23 nt, Homo sapiens
aucauuuacuuuuaaacuuugau

SEQ ID NO: 929820 - RNA, 14 nt, Homo sapiens
aucuacuugcacac

SEQ ID NO: 929821 - RNA, 17 nt, Homo sapiens
aucugacaucucugcaa

SEQ ID NO: 929822 - RNA, 19 nt, Homo sapiens
aucugacaucucugcaauc

SEQ ID NO: 929823 - RNA, 14 nt, Homo sapiens
aucuucacuuuuau

SEQ ID NO: 929824 - RNA, 21 nt, Homo sapiens
aucuuucaaagugucuugaau

SEQ ID NO: 929825 - RNA, 14 nt, Homo sapiens
augacaaagacuga

SEQ ID NO: 929826 - RNA, 13 nt, Homo sapiens
augaggcauuugu

SEQ ID NO: 929827 - RNA, 22 nt, Homo sapiens
augcaguguuucccucuguguu

SEQ ID NO: 929828 - RNA, 19 nt, Homo sapiens
augccagccacugugauag

SEQ ID NO: 929829 - RNA, 20 nt, Homo sapiens
augcuuuaaacauugguucu

SEQ ID NO: 929830 - RNA, 16 nt, Homo sapiens
auggcuuuugugcauu

SEQ ID NO: 929831 - RNA, 17 nt, Homo sapiens
auguaauuauauauacu

SEQ ID NO: 929832 - RNA, 16 nt, Homo sapiens
auguauguaaauagcu

SEQ ID NO: 929833 - RNA, 16 nt, Homo sapiens
auguuuagcagauuua

SEQ ID NO: 929834 - RNA, 21 nt, Homo sapiens
auuaacuuuuauaaacuuuac

SEQ ID NO: 929835 - RNA, 16 nt, Homo sapiens
auugaaaugauuucac

SEQ ID NO: 929836 - RNA, 18 nt, Homo sapiens
auugacuauagugugagc

SEQ ID NO: 929837 - RNA, 13 nt, Homo sapiens
auuuaagauaugu

SEQ ID NO: 929838 - RNA, 16 nt, Homo sapiens
auuuaucauuuaguua

SEQ ID NO: 929839 - RNA, 21 nt, Homo sapiens
auuuauugaaaugauuucaca

SEQ ID NO: 929840 - RNA, 22 nt, Homo sapiens
auuuccaagaaauauuccuuaa

SEQ ID NO: 929841 - RNA, 15 nt, Homo sapiens
auuuuaucugcuaug

SEQ ID NO: 929842 - RNA, 15 nt, Homo sapiens
auuuuaugcuuuaaa

SEQ ID NO: 929843 - RNA, 23 nt, Homo sapiens
caaagacugaguacguugugcau

SEQ ID NO: 929844 - RNA, 15 nt, Homo sapiens
caaguuaguucaauc

SEQ ID NO: 929845 - RNA, 17 nt, Homo sapiens
caaguuguuugagaaau

SEQ ID NO: 929846 - RNA, 20 nt, Homo sapiens
caaucuucucagaaggcaaa

SEQ ID NO: 929847 - RNA, 16 nt, Homo sapiens
caaugaagucucugaa

SEQ ID NO: 929848 - RNA, 14 nt, Homo sapiens
caaugauaaugcua

SEQ ID NO: 929849 - RNA, 15 nt, Homo sapiens
caaugauaaugcuaa

SEQ ID NO: 929850 - RNA, 19 nt, Homo sapiens
caauguuuagcagauuuaa

SEQ ID NO: 929851 - RNA, 18 nt, Homo sapiens
caauuauuugaagauuua

SEQ ID NO: 929852 - RNA, 17 nt, Homo sapiens
cacaccccagacgaugu

SEQ ID NO: 929853 - RNA, 14 nt, Homo sapiens
cacagaguuguuac

SEQ ID NO: 929854 - RNA, 17 nt, Homo sapiens
caccuccugccucaggu

SEQ ID NO: 929855 - RNA, 20 nt, Homo sapiens
cacuugguucuuguacucua

SEQ ID NO: 929856 - RNA, 15 nt, Homo sapiens
cacuuuagaaagcug

SEQ ID NO: 929857 - RNA, 16 nt, Homo sapiens
cagugagaucaaugug

SEQ ID NO: 929858 - RNA, 17 nt, Homo sapiens
cagugagaucaauguga

SEQ ID NO: 929859 - RNA, 19 nt, Homo sapiens
cauaaccccggaagccaaa

SEQ ID NO: 929860 - RNA, 15 nt, Homo sapiens
cauaagaauucuguu

SEQ ID NO: 929861 - RNA, 15 nt, Homo sapiens
cauaaugcgugcaua

SEQ ID NO: 929862 - RNA, 13 nt, Homo sapiens
caucacaguuuug

SEQ ID NO: 929863 - RNA, 21 nt, Homo sapiens
caucuuucaagggaccucucc

SEQ ID NO: 929864 - RNA, 16 nt, Homo sapiens
caugcuacacacugca

SEQ ID NO: 929865 - RNA, 16 nt, Homo sapiens
cauucacagauaccuc

SEQ ID NO: 929866 - RNA, 19 nt, Homo sapiens
cauucacagauaccucucu

SEQ ID NO: 929867 - RNA, 17 nt, Homo sapiens
cauucuccuuguguuac

SEQ ID NO: 929868 - RNA, 20 nt, Homo sapiens
cauucuuuuugaaaugucaa

SEQ ID NO: 929869 - RNA, 20 nt, Homo sapiens
ccaaugagaucauugugaag

SEQ ID NO: 929870 - RNA, 15 nt, Homo sapiens
ccacuuuuugcagcu

SEQ ID NO: 929871 - RNA, 18 nt, Homo sapiens
ccagggcuugugugcaca

SEQ ID NO: 929872 - RNA, 17 nt, Homo sapiens
ccagucauuauguuaau

SEQ ID NO: 929873 - RNA, 15 nt, Homo sapiens
ccaucauuuacuuuu

SEQ ID NO: 929874 - RNA, 22 nt, Homo sapiens
ccaucuuucaagggaccucucc

SEQ ID NO: 929875 - RNA, 19 nt, Homo sapiens
ccauuauauuuauuguuua

SEQ ID NO: 929876 - RNA, 19 nt, Homo sapiens
cccagggcuugugugcaca

SEQ ID NO: 929877 - RNA, 13 nt, Homo sapiens
cccaucaucaccc

SEQ ID NO: 929878 - RNA, 22 nt, Homo sapiens
ccuccuccuucauggcaggcau

SEQ ID NO: 929879 - RNA, 16 nt, Homo sapiens
aaaaaggaugcacaga

SEQ ID NO: 929880 - RNA, 17 nt, Homo sapiens
aaaaauaaagcacuuau

SEQ ID NO: 929881 - RNA, 16 nt, Homo sapiens
aaaauaccagccagua

SEQ ID NO: 929882 - RNA, 22 nt, Homo sapiens
aaacauguauguaaauagcuaa

SEQ ID NO: 929883 - RNA, 14 nt, Homo sapiens
aaaccuauguuugc

SEQ ID NO: 929884 - RNA, 19 nt, Homo sapiens
aaacuggguuccugcaaug

SEQ ID NO: 929885 - RNA, 18 nt, Homo sapiens
aaaggaugcacagaguug

SEQ ID NO: 929886 - RNA, 14 nt, Homo sapiens
aaaguaaaggcaaa

SEQ ID NO: 929887 - RNA, 18 nt, Homo sapiens
aaaugauuucacagugug

SEQ ID NO: 929888 - RNA, 18 nt, Homo sapiens
aaaugggggugcauuuga

SEQ ID NO: 929889 - RNA, 19 nt, Homo sapiens
aaauucccuggccuuucau

SEQ ID NO: 929890 - RNA, 15 nt, Homo sapiens
aaauuuuuauguaau

SEQ ID NO: 929891 - RNA, 21 nt, Homo sapiens
aacaccaggauuuaaguuuca

SEQ ID NO: 929892 - RNA, 20 nt, Homo sapiens
aacaugccagccacugugau

SEQ ID NO: 929893 - RNA, 14 nt, Homo sapiens
aacauguauguaaa

SEQ ID NO: 929894 - RNA, 16 nt, Homo sapiens
aacgucccuagcccuu

SEQ ID NO: 929895 - RNA, 13 nt, Homo sapiens
aacuaaaauguuc

SEQ ID NO: 929896 - RNA, 16 nt, Homo sapiens
aacucuaccugcacac

SEQ ID NO: 929897 - RNA, 18 nt, Homo sapiens
aacuggguuccugcaaug

SEQ ID NO: 929898 - RNA, 22 nt, Homo sapiens
aacuuuuauaaacuuuaccuuu

SEQ ID NO: 929899 - RNA, 14 nt, Homo sapiens
aagaaauauuccuu

SEQ ID NO: 929900 - RNA, 18 nt, Homo sapiens
aagaacuaaaauguucua

SEQ ID NO: 929901 - RNA, 20 nt, Homo sapiens
aagauauguaacaacaauua

SEQ ID NO: 929902 - RNA, 23 nt, Homo sapiens
aagcauuuuauaaaucgcuuuug

SEQ ID NO: 929903 - RNA, 19 nt, Homo sapiens
aagccucuauugccaugag

SEQ ID NO: 929904 - RNA, 18 nt, Homo sapiens
aaggaaacuggguuccug

SEQ ID NO: 929905 - RNA, 13 nt, Homo sapiens
aaggaagguucug

SEQ ID NO: 929906 - RNA, 19 nt, Homo sapiens
aaggauuuuaugcuuuaaa

SEQ ID NO: 929907 - RNA, 17 nt, Homo sapiens
aaguaucccuacuguaa

SEQ ID NO: 929908 - RNA, 21 nt, Homo sapiens
aagucuguuuuaugacuucau

SEQ ID NO: 929909 - RNA, 17 nt, Homo sapiens
aagugaagacaaugacu

SEQ ID NO: 929910 - RNA, 23 nt, Homo sapiens
aauaucccuuggacauuuuaugu

SEQ ID NO: 929911 - RNA, 15 nt, Homo sapiens
aauaucuuaucuucc

SEQ ID NO: 929912 - RNA, 23 nt, Homo sapiens
aaucacuggcuguuaaucuuuca

SEQ ID NO: 929913 - RNA, 20 nt, Homo sapiens
aaucuaaauggaaccacucu

SEQ ID NO: 929914 - RNA, 20 nt, Homo sapiens
aaucuuucaaagugucuuga

SEQ ID NO: 929915 - RNA, 21 nt, Homo sapiens
aaugacuuacuguacaugaaa

SEQ ID NO: 929916 - RNA, 23 nt, Homo sapiens
aaugauuucacagugugugguca

SEQ ID NO: 929917 - RNA, 14 nt, Homo sapiens
aauguaugugcaca

SEQ ID NO: 929918 - RNA, 15 nt, Homo sapiens
aauguaugugcacau

SEQ ID NO: 929919 - RNA, 18 nt, Homo sapiens
aauguuuagcagauuuaa

SEQ ID NO: 929920 - RNA, 17 nt, Homo sapiens
aauuauauauacuauau

SEQ ID NO: 929921 - RNA, 16 nt, Homo sapiens
aauuauuucacuuuag

SEQ ID NO: 929922 - RNA, 18 nt, Homo sapiens
aauuauuugaagauuuaa

SEQ ID NO: 929923 - RNA, 14 nt, Homo sapiens
aauuuuaguuguca

SEQ ID NO: 929924 - RNA, 17 nt, Homo sapiens
acaaugacuuacuguac

SEQ ID NO: 929925 - RNA, 18 nt, Homo sapiens
acacauuuuucuuaggga

SEQ ID NO: 929926 - RNA, 21 nt, Homo sapiens
acacauuuuuuaaaugcaccu

SEQ ID NO: 929927 - RNA, 18 nt, Homo sapiens
acacuguuaucuucacuu

SEQ ID NO: 929928 - RNA, 13 nt, Homo sapiens
acagauaccucuc

SEQ ID NO: 929929 - RNA, 19 nt, Homo sapiens
acaggaggggaaggcaaca

SEQ ID NO: 929930 - RNA, 19 nt, Homo sapiens
ugugaacuaaacuuucaca

SEQ ID NO: 929931 - RNA, 20 nt, Homo sapiens
ugugaaggcaggggaaugua

SEQ ID NO: 929932 - RNA, 19 nt, Homo sapiens
uguuagagaauuuccuuac

SEQ ID NO: 929933 - RNA, 14 nt, Homo sapiens
uguuagagcagaga

SEQ ID NO: 929934 - RNA, 20 nt, Homo sapiens
uuaaauaaugugaaacugga

SEQ ID NO: 929935 - RNA, 12 nt, Homo sapiens
uuaagccuuaaa

SEQ ID NO: 929936 - RNA, 19 nt, Homo sapiens
uuaaggauuuuaugcuuua

SEQ ID NO: 929937 - RNA, 20 nt, Homo sapiens
uuaauuacuucuuaguaugu

SEQ ID NO: 929938 - RNA, 18 nt, Homo sapiens
uuaggaguaccauaauuc

SEQ ID NO: 929939 - RNA, 21 nt, Homo sapiens
uuaggaguaccauaauucugg

SEQ ID NO: 929940 - RNA, 15 nt, Homo sapiens
uuauaaaucgcuuuu

SEQ ID NO: 929941 - RNA, 13 nt, Homo sapiens
uuauaugcuauuu

SEQ ID NO: 929942 - RNA, 20 nt, Homo sapiens
uuaucugcuaugcuauugaa

SEQ ID NO: 929943 - RNA, 18 nt, Homo sapiens
uuauggcuuuugugcauu

SEQ ID NO: 929944 - RNA, 15 nt, Homo sapiens
uucaauccugauuca

SEQ ID NO: 929945 - RNA, 16 nt, Homo sapiens
uucacagcacuuacaa

SEQ ID NO: 929946 - RNA, 18 nt, Homo sapiens
uucagcagagaaguuuuc

SEQ ID NO: 929947 - RNA, 14 nt, Homo sapiens
uucauaacaucgaa

SEQ ID NO: 929948 - RNA, 18 nt, Homo sapiens
uuccaguaguuagcuuuc

SEQ ID NO: 929949 - RNA, 21 nt, Homo sapiens
uuccuauaauuuuagacauuc

SEQ ID NO: 929950 - RNA, 11 nt, Homo sapiens
uuccugcaaug

SEQ ID NO: 929951 - RNA, 21 nt, Homo sapiens
uuccugcaaugaagucucuga

SEQ ID NO: 929952 - RNA, 21 nt, Homo sapiens
uucuuaaauaauaaagaucau

SEQ ID NO: 929953 - RNA, 18 nt, Homo sapiens
uucuuuuugaaaugucaa

SEQ ID NO: 929954 - RNA, 17 nt, Homo sapiens
uugaaaugauuucacag

SEQ ID NO: 929955 - RNA, 13 nt, Homo sapiens
uugaacuuugacc

SEQ ID NO: 929956 - RNA, 21 nt, Homo sapiens
uuguacauaaugcgugcauac

SEQ ID NO: 929957 - RNA, 15 nt, Homo sapiens
uuguagcucucugac

SEQ ID NO: 929958 - RNA, 21 nt, Homo sapiens
uugugcauuaucuagauacug

SEQ ID NO: 929959 - RNA, 21 nt, Homo sapiens
uuuagcauaguaccucugcua

SEQ ID NO: 929960 - RNA, 23 nt, Homo sapiens
uuuagcauaguaccucugcuauu

SEQ ID NO: 929961 - RNA, 22 nt, Homo sapiens
uuucaagggaccucuccaugau

SEQ ID NO: 929962 - RNA, 20 nt, Homo sapiens
uuucauaagaauucuguuga

SEQ ID NO: 929963 - RNA, 18 nt, Homo sapiens
uuucuaugacacaugcaa

SEQ ID NO: 929964 - RNA, 17 nt, Homo sapiens
uuuguagcguacaucaa

SEQ ID NO: 929965 - RNA, 14 nt, Homo sapiens
uuugugauugccau

SEQ ID NO: 929966 - RNA, 21 nt, Homo sapiens
uuuuaagaaaaaggaugcaca

SEQ ID NO: 929967 - RNA, 19 nt, Homo sapiens
uuuuauggcuuuugugcau

SEQ ID NO: 929968 - RNA, 20 nt, Homo sapiens
uuuugaagauucuauguuaa

SEQ ID NO: 929969 - RNA, 17 nt, Homo sapiens
uuuuuccagguuccuga

SEQ ID NO: 929970 - RNA, 11 nt, Homo sapiens
uuuuugcagcu

SEQ ID NO: 929971 - RNA, 20 nt, Homo sapiens
aggcauacugccuuguuuaa

SEQ ID NO: 929972 - RNA, 14 nt, Homo sapiens
aggccaccuggauu

SEQ ID NO: 929973 - RNA, 17 nt, Homo sapiens
aggggaaggcaacauac

SEQ ID NO: 929974 - RNA, 14 nt, Homo sapiens
aggggcaguggugg

SEQ ID NO: 929975 - RNA, 14 nt, Homo sapiens
aguacguugugcau

SEQ ID NO: 929976 - RNA, 16 nt, Homo sapiens
aguaugaggcauuugu

SEQ ID NO: 929977 - RNA, 22 nt, Homo sapiens
agucucugaagugaaacugcuu

SEQ ID NO: 929978 - RNA, 17 nt, Homo sapiens
aguucaccagacucuau

SEQ ID NO: 929979 - RNA, 19 nt, Homo sapiens
aguuuuggaaacguauuca

SEQ ID NO: 929980 - RNA, 22 nt, Homo sapiens
aguuuuuauggcuuuugugcau

SEQ ID NO: 929981 - RNA, 20 nt, Homo sapiens
auacuauuuaauuauuucac

SEQ ID NO: 929982 - RNA, 17 nt, Homo sapiens
auagaagguuugcagau

SEQ ID NO: 929983 - RNA, 16 nt, Homo sapiens
auaguaccucugcuau

SEQ ID NO: 929984 - RNA, 12 nt, Homo sapiens
auauauuuuaga

SEQ ID NO: 929985 - RNA, 15 nt, Homo sapiens
auauccuuagcccau

SEQ ID NO: 929986 - RNA, 14 nt, Homo sapiens
auauucucuaguca

SEQ ID NO: 929987 - RNA, 22 nt, Homo sapiens
auauuuccaagaaauauuccuu

SEQ ID NO: 929988 - RNA, 19 nt, Homo sapiens
auauuuugcuuugugauuu

SEQ ID NO: 929989 - RNA, 23 nt, Homo sapiens
aucaccaucaauuuuaguuguca

SEQ ID NO: 929990 - RNA, 17 nt, Homo sapiens
aucucauuuaauccucu

SEQ ID NO: 929991 - RNA, 18 nt, Homo sapiens
augacauaucacauguca

SEQ ID NO: 929992 - RNA, 14 nt, Homo sapiens
augacuuacuguac

SEQ ID NO: 929993 - RNA, 15 nt, Homo sapiens
augauuucacagugu

SEQ ID NO: 929994 - RNA, 17 nt, Homo sapiens
augcuaauuuuauuaua

SEQ ID NO: 929995 - RNA, 22 nt, Homo sapiens
auggccagugagaucaauguga

SEQ ID NO: 929996 - RNA, 20 nt, Homo sapiens
auguaacaacaauuauuuga

SEQ ID NO: 929997 - RNA, 21 nt, Homo sapiens
auguagaauauauuuccuuau

SEQ ID NO: 929998 - RNA, 12 nt, Homo sapiens
auguuuucacaa

SEQ ID NO: 929999 - RNA, 18 nt, Homo sapiens
auuaucuagauacuguau

SEQ ID NO: 930000 - RNA, 16 nt, Homo sapiens
auucacagauaccucu

SEQ ID NO: 930001 - RNA, 23 nt, Homo sapiens
auucagaauuucuaaaaguuuaa

SEQ ID NO: 930002 - RNA, 19 nt, Homo sapiens
auucuuuuugaaaugucaa

SEQ ID NO: 930003 - RNA, 17 nt, Homo sapiens
auuuaauuugaagauag

SEQ ID NO: 930004 - RNA, 13 nt, Homo sapiens
auuucacagugug

SEQ ID NO: 930005 - RNA, 14 nt, Homo sapiens
auuuuaucugcuau

SEQ ID NO: 930006 - RNA, 17 nt, Homo sapiens
caaaccucugugagcau

SEQ ID NO: 930007 - RNA, 11 nt, Homo sapiens
caaauguucuc

SEQ ID NO: 930008 - RNA, 18 nt, Homo sapiens
caacaugccagccacugu

SEQ ID NO: 930009 - RNA, 13 nt, Homo sapiens
caagggaccucuc

SEQ ID NO: 930010 - RNA, 19 nt, Homo sapiens
caauaaagcagcguuucua

SEQ ID NO: 930011 - RNA, 16 nt, Homo sapiens
caaugagaucauugug

SEQ ID NO: 930012 - RNA, 22 nt, Homo sapiens
caauuaaggauuuuaugcuuua

SEQ ID NO: 930013 - RNA, 16 nt, Homo sapiens
caauuauuugaagauu

SEQ ID NO: 930014 - RNA, 16 nt, Homo sapiens
caauuugaauauaaau

SEQ ID NO: 930015 - RNA, 19 nt, Homo sapiens
cacaguuuugguugcuuua

SEQ ID NO: 930016 - RNA, 21 nt, Homo sapiens
cacaguuuugguugcuuuaau

SEQ ID NO: 930017 - RNA, 22 nt, Homo sapiens
caccauauuaccacagacauac

SEQ ID NO: 930018 - RNA, 23 nt, Homo sapiens
ggaauauguuagagaauuuccuu

SEQ ID NO: 930019 - RNA, 22 nt, Homo sapiens
ggaaucacuggcuguuaaucuu

SEQ ID NO: 930020 - RNA, 17 nt, Homo sapiens
ggagauuuacaacuggg

SEQ ID NO: 930021 - RNA, 16 nt, Homo sapiens
ggcaagggaccugcuu

SEQ ID NO: 930022 - RNA, 21 nt, Homo sapiens
ggccagugagaucaaugugac

SEQ ID NO: 930023 - RNA, 23 nt, Homo sapiens
ggcccuggccuagcauacguaca

SEQ ID NO: 930024 - RNA, 16 nt, Homo sapiens
gggaccucuccaugau

SEQ ID NO: 930025 - RNA, 16 nt, Homo sapiens
gggcaagggaccugcu

SEQ ID NO: 930026 - RNA, 24 nt, Homo sapiens
ggugaucucauuuaauccucucaa

SEQ ID NO: 930027 - RNA, 18 nt, Homo sapiens
guaaaugggggugcauuu

SEQ ID NO: 930028 - RNA, 20 nt, Homo sapiens
guaaaugggggugcauuuga

SEQ ID NO: 930029 - RNA, 23 nt, Homo sapiens
guaacuguuuagaugaaugucag

SEQ ID NO: 930030 - RNA, 23 nt, Homo sapiens
guaccucugcuauuugcuguuau

SEQ ID NO: 930031 - RNA, 22 nt, Homo sapiens
gucaaacccaaguuaguucaau

SEQ ID NO: 930032 - RNA, 22 nt, Homo sapiens
gucaaccccaaguuaguucaau

SEQ ID NO: 930033 - RNA, 13 nt, Homo sapiens
gugauacaaugcu

SEQ ID NO: 930034 - RNA, 20 nt, Homo sapiens
guuauuuauaaucacuuuuu

SEQ ID NO: 930035 - RNA, 22 nt, Homo sapiens
guugauggaaauacacuguuau

SEQ ID NO: 930036 - RNA, 13 nt, Homo sapiens
guuuaauguuaau

SEQ ID NO: 930037 - RNA, 17 nt, Homo sapiens
guuuagaugaaugucag

SEQ ID NO: 930038 - RNA, 15 nt, Homo sapiens
guuuagcagauuuaa

SEQ ID NO: 930039 - RNA, 14 nt, Homo sapiens
guuugugauugcca

SEQ ID NO: 930040 - RNA, 22 nt, Homo sapiens
uaaaaauauauagcgacauccu

SEQ ID NO: 930041 - RNA, 22 nt, Homo sapiens
uaaacauugguucuuguauuaa

SEQ ID NO: 930042 - RNA, 20 nt, Homo sapiens
uaaauucccuggccuuucau

SEQ ID NO: 930043 - RNA, 14 nt, Homo sapiens
uaacagaaauguac

SEQ ID NO: 930044 - RNA, 19 nt, Homo sapiens
uaagaacuaaaauguucua

SEQ ID NO: 930045 - RNA, 18 nt, Homo sapiens
uaauaucaucaguauuga

SEQ ID NO: 930046 - RNA, 14 nt, Homo sapiens
uaaugugacuugga

SEQ ID NO: 930047 - RNA, 21 nt, Homo sapiens
uacaaaauauagcuuucauaa

SEQ ID NO: 930048 - RNA, 20 nt, Homo sapiens
uacacuguuaucuucacuuu

SEQ ID NO: 930049 - RNA, 20 nt, Homo sapiens
uacaggaacagaagaggaaa

SEQ ID NO: 930050 - RNA, 12 nt, Homo sapiens
uacguugugcau

SEQ ID NO: 930051 - RNA, 13 nt, Homo sapiens
uacguugugcauu

SEQ ID NO: 930052 - RNA, 14 nt, Homo sapiens
uacguugugcauuu

SEQ ID NO: 930053 - RNA, 17 nt, Homo sapiens
uacuuuuaaacuuugau

SEQ ID NO: 930054 - RNA, 21 nt, Homo sapiens
uagaauauauuuccuuauuca

SEQ ID NO: 930055 - RNA, 12 nt, Homo sapiens
uagauacuguau

SEQ ID NO: 930056 - RNA, 20 nt, Homo sapiens
uagcauaguaccucugcuau

SEQ ID NO: 930057 - RNA, 21 nt, Homo sapiens
uagcauaguaccucugcuauu

SEQ ID NO: 930058 - RNA, 21 nt, Homo sapiens
uagcucucugaccuccuccuu

SEQ ID NO: 930059 - RNA, 16 nt, Homo sapiens
uaguaugugcauuuaa

SEQ ID NO: 930060 - RNA, 16 nt, Homo sapiens
acuguccccaucauca

SEQ ID NO: 930061 - RNA, 20 nt, Homo sapiens
acuguuuagaugaaugucag

SEQ ID NO: 930062 - RNA, 11 nt, Homo sapiens
acuuacuguac

SEQ ID NO: 930063 - RNA, 12 nt, Homo sapiens
acuuuaccuuuu

SEQ ID NO: 930064 - RNA, 15 nt, Homo sapiens
acuuuacugucccca

SEQ ID NO: 930065 - RNA, 23 nt, Homo sapiens
acuuugaccucugcagcaauaaa

SEQ ID NO: 930066 - RNA, 16 nt, Homo sapiens
acuuuuaaacuuugau

SEQ ID NO: 930067 - RNA, 14 nt, Homo sapiens
agaaauguguuauc

SEQ ID NO: 930068 - RNA, 22 nt, Homo sapiens
agaaauuaaguaucugacaucu

SEQ ID NO: 930069 - RNA, 18 nt, Homo sapiens
agaauauaaaaauaaagc

SEQ ID NO: 930070 - RNA, 20 nt, Homo sapiens
agacugaguacguugugcau

SEQ ID NO: 930071 - RNA, 13 nt, Homo sapiens
agagaauuuccuu

SEQ ID NO: 930072 - RNA, 22 nt, Homo sapiens
agaguucugucacggucacuuu

SEQ ID NO: 930073 - RNA, 21 nt, Homo sapiens
agauauuuugcuuugugauuu

SEQ ID NO: 930074 - RNA, 13 nt, Homo sapiens
agaugaaugucag

SEQ ID NO: 930075 - RNA, 19 nt, Homo sapiens
agcccuuacguccuuccac

SEQ ID NO: 930076 - RNA, 17 nt, Homo sapiens
agccucuauugccauga

SEQ ID NO: 930077 - RNA, 21 nt, Homo sapiens
aggaggggaaggcaacauaca

SEQ ID NO: 930078 - RNA, 15 nt, Homo sapiens
aggauuuaaguuuca

SEQ ID NO: 930079 - RNA, 16 nt, Homo sapiens
aguaaaggcaaacuua

SEQ ID NO: 930080 - RNA, 14 nt, Homo sapiens
aguaauaugcacac

SEQ ID NO: 930081 - RNA, 14 nt, Homo sapiens
agucuucuauuuau

SEQ ID NO: 930082 - RNA, 12 nt, Homo sapiens
auaacuguuauu

SEQ ID NO: 930083 - RNA, 13 nt, Homo sapiens
auaaucacuuuuu

SEQ ID NO: 930084 - RNA, 19 nt, Homo sapiens
auaccucucuuguagcucu

SEQ ID NO: 930085 - RNA, 23 nt, Homo sapiens
auacuauuuaauuauuucacuuu

SEQ ID NO: 930086 - RNA, 17 nt, Homo sapiens
auaguaccucugcuauu

SEQ ID NO: 930087 - RNA, 14 nt, Homo sapiens
ccuccugcuuccuc

SEQ ID NO: 930088 - RNA, 14 nt, Homo sapiens
ccucuauugccaug

SEQ ID NO: 930089 - RNA, 16 nt, Homo sapiens
ccucugcuauuugcug

SEQ ID NO: 930090 - RNA, 17 nt, Homo sapiens
ccuggauggcugccuca

SEQ ID NO: 930091 - RNA, 18 nt, Homo sapiens
ccuggauuccucacuuug

SEQ ID NO: 930092 - RNA, 11 nt, Homo sapiens
cggaagccaaa

SEQ ID NO: 930093 - RNA, 15 nt, Homo sapiens
cguuugugauugcca

SEQ ID NO: 930094 - RNA, 18 nt, Homo sapiens
cuaaacuuucacacccca

SEQ ID NO: 930095 - RNA, 12 nt, Homo sapiens
cuaccucuccag

SEQ ID NO: 930096 - RNA, 18 nt, Homo sapiens
cuacuguaauuugugaua

SEQ ID NO: 930097 - RNA, 17 nt, Homo sapiens
cuagaaaacaggcaaau

SEQ ID NO: 930098 - RNA, 15 nt, Homo sapiens
cuagcccuuacgucc

SEQ ID NO: 930099 - RNA, 20 nt, Homo sapiens
cuaucaaguauuauaccuuu

SEQ ID NO: 930100 - RNA, 12 nt, Homo sapiens
cuaugcauuuga

SEQ ID NO: 930101 - RNA, 21 nt, Homo sapiens
cuauguuaauauuuuaugugu

SEQ ID NO: 930102 - RNA, 13 nt, Homo sapiens
cuauugccaugag

SEQ ID NO: 930103 - RNA, 16 nt, Homo sapiens
cucaaccaccuuucag

SEQ ID NO: 930104 - RNA, 15 nt, Homo sapiens
cucccaacgucccua

SEQ ID NO: 930105 - RNA, 21 nt, Homo sapiens
cuccgcauccuccuccugcuu

SEQ ID NO: 930106 - RNA, 23 nt, Homo sapiens
cuccuucauggcaggcaucgcca

SEQ ID NO: 930107 - RNA, 12 nt, Homo sapiens
cucuauugccau

SEQ ID NO: 930108 - RNA, 15 nt, Homo sapiens
cucuccaugauccca

SEQ ID NO: 930109 - RNA, 19 nt, Homo sapiens
cucugcuauuugcuguuau

SEQ ID NO: 930110 - RNA, 14 nt, Homo sapiens
cucuggaagccucu

SEQ ID NO: 930111 - RNA, 21 nt, Homo sapiens
cucuggaagccucuauugcca

SEQ ID NO: 930112 - RNA, 13 nt, Homo sapiens
cugaacacuccaa

SEQ ID NO: 930113 - RNA, 16 nt, Homo sapiens
cugaccuccuccuuca

SEQ ID NO: 930114 - RNA, 20 nt, Homo sapiens
cugagcccuacugugucuca

SEQ ID NO: 930115 - RNA, 22 nt, Homo sapiens
cugaggagccugcaacaugcca

SEQ ID NO: 930116 - RNA, 12 nt, Homo sapiens
cugcacacuguc

SEQ ID NO: 930117 - RNA, 21 nt, Homo sapiens
cugcacacuguccuauuauau

SEQ ID NO: 930118 - RNA, 20 nt, Homo sapiens
cugccaucauuuacuuuuaa

SEQ ID NO: 930119 - RNA, 13 nt, Homo sapiens
cugccucaccucu

SEQ ID NO: 930120 - RNA, 20 nt, Homo sapiens
cugccuuguuuaauguuaau

SEQ ID NO: 930121 - RNA, 19 nt, Homo sapiens
cugcuaguuuauauagaaa

SEQ ID NO: 930122 - RNA, 20 nt, Homo sapiens
cuggaagccucuauugccau

SEQ ID NO: 930123 - RNA, 23 nt, Homo sapiens
cuggaagccucuauugccaugag

SEQ ID NO: 930124 - RNA, 17 nt, Homo sapiens
cugggcugaacacucca

SEQ ID NO: 930125 - RNA, 16 nt, Homo sapiens
cuggguuccugcaaug

SEQ ID NO: 930126 - RNA, 17 nt, Homo sapiens
cuguccuauuauauuca

SEQ ID NO: 930127 - RNA, 14 nt, Homo sapiens
cugugauagaggcu

SEQ ID NO: 930128 - RNA, 22 nt, Homo sapiens
cugugucucaggugugcccuga

SEQ ID NO: 930129 - RNA, 18 nt, Homo sapiens
cuguuaucuucacuuuua

SEQ ID NO: 930130 - RNA, 21 nt, Homo sapiens
cuuacguccuuccacuuccaa

SEQ ID NO: 930131 - RNA, 16 nt, Homo sapiens
cuuccuauaauuuuag

SEQ ID NO: 930132 - RNA, 21 nt, Homo sapiens
cuucgugaugacauaucacau

SEQ ID NO: 930133 - RNA, 13 nt, Homo sapiens
cuuuugugcauua

SEQ ID NO: 930134 - RNA, 18 nt, Homo sapiens
cuuuuuccagguuccuga

SEQ ID NO: 930135 - RNA, 23 nt, Homo sapiens
gaaauacacuguuaucuucacuu

SEQ ID NO: 930136 - RNA, 13 nt, Homo sapiens
gaaauaggaaaua

SEQ ID NO: 930137 - RNA, 19 nt, Homo sapiens
gaaccguuugugauugcca

SEQ ID NO: 930138 - RNA, 15 nt, Homo sapiens
gaagucuucuauuua

SEQ ID NO: 930139 - RNA, 17 nt, Homo sapiens
gaaucacuggcuguuaa

SEQ ID NO: 930140 - RNA, 15 nt, Homo sapiens
gaauguaugugcaca

SEQ ID NO: 930141 - RNA, 20 nt, Homo sapiens
gaauguuuucaaauguucuc

SEQ ID NO: 930142 - RNA, 19 nt, Homo sapiens
gaauuguaggugacuauua

SEQ ID NO: 930143 - RNA, 12 nt, Homo sapiens
gaauuuccuuac

SEQ ID NO: 930144 - RNA, 20 nt, Homo sapiens
gacaggaggggaaggcaaca

SEQ ID NO: 930145 - RNA, 21 nt, Homo sapiens
gaccauaaccccggaagccaa

SEQ ID NO: 930146 - RNA, 15 nt, Homo sapiens
gaccuccuccuucau

SEQ ID NO: 930147 - RNA, 15 nt, Homo sapiens
gaguaccauaauucu

SEQ ID NO: 930148 - RNA, 22 nt, Homo sapiens
gauacuguaucaugacaaagac

SEQ ID NO: 930149 - RNA, 15 nt, Homo sapiens
gauauuaacugagaa

SEQ ID NO: 930150 - RNA, 13 nt, Homo sapiens
ucagccacuguga

SEQ ID NO: 930151 - RNA, 14 nt, Homo sapiens
ucagccacugugau

SEQ ID NO: 930152 - RNA, 19 nt, Homo sapiens
ucagcucucaguugcagcc

SEQ ID NO: 930153 - RNA, 14 nt, Homo sapiens
ucauuauguuaaua

SEQ ID NO: 930154 - RNA, 17 nt, Homo sapiens
uccaaaguacacuguuu

SEQ ID NO: 930155 - RNA, 17 nt, Homo sapiens
uccaguaguuagcuuuc

SEQ ID NO: 930156 - RNA, 22 nt, Homo sapiens
ucccuauuuuuuuucuguuaua

SEQ ID NO: 930157 - RNA, 22 nt, Homo sapiens
uccugauucauauuuaauuuga

SEQ ID NO: 930158 - RNA, 19 nt, Homo sapiens
uccuuccacuuccaagauc

SEQ ID NO: 930159 - RNA, 16 nt, Homo sapiens
ucucaaccaccuuuca

SEQ ID NO: 930160 - RNA, 23 nt, Homo sapiens
ucuccaaaccacuuuuugcagcu

SEQ ID NO: 930161 - RNA, 20 nt, Homo sapiens
ucuccagucauuauguuaau

SEQ ID NO: 930162 - RNA, 16 nt, Homo sapiens
ucugaccuccuccuuc

SEQ ID NO: 930163 - RNA, 13 nt, Homo sapiens
ucuggugugaacu

SEQ ID NO: 930164 - RNA, 14 nt, Homo sapiens
ucuuaauucuuagc

SEQ ID NO: 930165 - RNA, 19 nt, Homo sapiens
ucuuaguaugugcauuuaa

SEQ ID NO: 930166 - RNA, 13 nt, Homo sapiens
ucuuggggaauau

SEQ ID NO: 930167 - RNA, 19 nt, Homo sapiens
ucuuucaagggaccucucc

SEQ ID NO: 930168 - RNA, 20 nt, Homo sapiens
ugaaccguuugugauugcca

SEQ ID NO: 930169 - RNA, 22 nt, Homo sapiens
ugaagauagaagguuugcagau

SEQ ID NO: 930170 - RNA, 22 nt, Homo sapiens
ugacuauuauauuuccaagaaa

SEQ ID NO: 930171 - RNA, 16 nt, Homo sapiens
ugacuuguacucugaa

SEQ ID NO: 930172 - RNA, 15 nt, Homo sapiens
ugagaucauugugaa

SEQ ID NO: 930173 - RNA, 16 nt, Homo sapiens
ugaguacguugugcau

SEQ ID NO: 930174 - RNA, 17 nt, Homo sapiens
ugaguacguugugcauu

SEQ ID NO: 930175 - RNA, 15 nt, Homo sapiens
ugauuaaauucuugc

SEQ ID NO: 930176 - RNA, 12 nt, Homo sapiens
ugauugccauuu

SEQ ID NO: 930177 - RNA, 20 nt, Homo sapiens
ugauugugggauacuauuua

SEQ ID NO: 930178 - RNA, 13 nt, Homo sapiens
ugcaaggucauuu

SEQ ID NO: 930179 - RNA, 13 nt, Homo sapiens
ugcagauauucuc

SEQ ID NO: 930180 - RNA, 15 nt, Homo sapiens
ugccaugagaguucu

SEQ ID NO: 930181 - RNA, 15 nt, Homo sapiens
ugcccuuacaggaac

SEQ ID NO: 930182 - RNA, 16 nt, Homo sapiens
ugcuauuugcuguuau

SEQ ID NO: 930183 - RNA, 21 nt, Homo sapiens
ugcuguuauuuuaucugcuau

SEQ ID NO: 930184 - RNA, 13 nt, Homo sapiens
ugcuuugugauuu

SEQ ID NO: 930185 - RNA, 16 nt, Homo sapiens
uggaaauacacuguua

SEQ ID NO: 930186 - RNA, 21 nt, Homo sapiens
uggaagccucuauugccauga

SEQ ID NO: 930187 - RNA, 23 nt, Homo sapiens
uggaccauaaccccggaagccaa

SEQ ID NO: 930188 - RNA, 20 nt, Homo sapiens
uggauuaaacuuaaucuaaa

SEQ ID NO: 930189 - RNA, 13 nt, Homo sapiens
uggccaaugagau

SEQ ID NO: 930190 - RNA, 13 nt, Homo sapiens
uggccagugagau

SEQ ID NO: 930191 - RNA, 14 nt, Homo sapiens
uggcuuuugugcau

SEQ ID NO: 930192 - RNA, 16 nt, Homo sapiens
uggcuuuugugcauua

SEQ ID NO: 930193 - RNA, 20 nt, Homo sapiens
uguaauuugugauacaaugc

SEQ ID NO: 930194 - RNA, 19 nt, Homo sapiens
uguagaauauauuuccuua

SEQ ID NO: 930195 - RNA, 12 nt, Homo sapiens
uguaucaugaca

SEQ ID NO: 930196 - RNA, 16 nt, Homo sapiens
ugucagccacugugau

SEQ ID NO: 930197 - RNA, 20 nt, Homo sapiens
ugugauugacgggacuguug

SEQ ID NO: 930198 - RNA, 18 nt, Homo sapiens
uguuaucuucacuuuuau

SEQ ID NO: 930199 - RNA, 18 nt, Homo sapiens
uguuauuuuaucugcuau

SEQ ID NO: 930200 - RNA, 12 nt, Homo sapiens
uguuugugauug

SEQ ID NO: 930201 - RNA, 16 nt, Homo sapiens
uuaagcuuucagcuca

SEQ ID NO: 930202 - RNA, 23 nt, Homo sapiens
uuagagaauuuccuuacucuuga

SEQ ID NO: 930203 - RNA, 16 nt, Homo sapiens
uuauuuauuuauucau

SEQ ID NO: 930204 - RNA, 15 nt, Homo sapiens
uucaagggaccucuc

SEQ ID NO: 930205 - RNA, 17 nt, Homo sapiens
uucaagggaccucucca

SEQ ID NO: 930206 - RNA, 16 nt, Homo sapiens
uucaaucuggauucau

SEQ ID NO: 930207 - RNA, 17 nt, Homo sapiens
uucagauaacuguuauu

SEQ ID NO: 930208 - RNA, 20 nt, Homo sapiens
uucagcucagcuaaugaagu

SEQ ID NO: 930209 - RNA, 19 nt, Homo sapiens
uucauucuuuuugaaaugu

SEQ ID NO: 930210 - RNA, 14 nt, Homo sapiens
uuccucacuuugaa

SEQ ID NO: 930211 - RNA, 15 nt, Homo sapiens
uuccucacuuugaag

SEQ ID NO: 930212 - RNA, 16 nt, Homo sapiens
uucuaaaggcuaccuu

SEQ ID NO: 930213 - RNA, 19 nt, Homo sapiens
uucugucacggucacuuua

SEQ ID NO: 930214 - RNA, 12 nt, Homo sapiens
uugaaaugucaa

SEQ ID NO: 930215 - RNA, 20 nt, Homo sapiens
uugauaaucaacugggcuga

SEQ ID NO: 930216 - RNA, 15 nt, Homo sapiens
uugauguuuucacaa

SEQ ID NO: 930217 - RNA, 17 nt, Homo sapiens
acaggcaaauuccugac

SEQ ID NO: 930218 - RNA, 14 nt, Homo sapiens
acauucuguuaauc

SEQ ID NO: 930219 - RNA, 23 nt, Homo sapiens
acauuuuuaagugcugcauuuaa

SEQ ID NO: 930220 - RNA, 20 nt, Homo sapiens
accaucaauuuuaguuguca

SEQ ID NO: 930221 - RNA, 18 nt, Homo sapiens
accguuugugauugccau

SEQ ID NO: 930222 - RNA, 20 nt, Homo sapiens
accucccaacgucccuagcc

SEQ ID NO: 930223 - RNA, 14 nt, Homo sapiens
accucuccaugauc

SEQ ID NO: 930224 - RNA, 17 nt, Homo sapiens
acggcagggaaauguau

SEQ ID NO: 930225 - RNA, 22 nt, Homo sapiens
acggucacuuuacuguccccau

SEQ ID NO: 930226 - RNA, 22 nt, Homo sapiens
acguuucuaaaggcuaccuuug

SEQ ID NO: 930227 - RNA, 17 nt, Homo sapiens
acugccaucauuuacuu

SEQ ID NO: 930228 - RNA, 20 nt, Homo sapiens
acuggcuguuaaucuuucaa

SEQ ID NO: 930229 - RNA, 20 nt, Homo sapiens
acuguccuauuauauucauu

SEQ ID NO: 930230 - RNA, 18 nt, Homo sapiens
acuguuauuuauaaucac

SEQ ID NO: 930231 - RNA, 13 nt, Homo sapiens
acuuuuauaagaa

SEQ ID NO: 930232 - RNA, 20 nt, Homo sapiens
agaaaauaguggugugauuu

SEQ ID NO: 930233 - RNA, 18 nt, Homo sapiens
agaagaaaauaguggugu

SEQ ID NO: 930234 - RNA, 13 nt, Homo sapiens
agaauauauuucc

SEQ ID NO: 930235 - RNA, 21 nt, Homo sapiens
agaauguuuucaaauguucuc

SEQ ID NO: 930236 - RNA, 12 nt, Homo sapiens
agacaaugacuu

SEQ ID NO: 930237 - RNA, 19 nt, Homo sapiens
agacaaugacuuacuguac

SEQ ID NO: 930238 - RNA, 17 nt, Homo sapiens
agagaauaaaaaaugua

SEQ ID NO: 930239 - RNA, 12 nt, Homo sapiens
agauaccucucu

SEQ ID NO: 930240 - RNA, 13 nt, Homo sapiens
agcagaaaugccu

SEQ ID NO: 930241 - RNA, 14 nt, Homo sapiens
agcagaaaugccuu

SEQ ID NO: 930242 - RNA, 21 nt, Homo sapiens
agcagauuuaagauauguaac

SEQ ID NO: 930243 - RNA, 16 nt, Homo sapiens
agcauacguacacauu

SEQ ID NO: 930244 - RNA, 21 nt, Homo sapiens
agcauacguacacauuuuauu

SEQ ID NO: 930245 - RNA, 20 nt, Homo sapiens
agcauaguaccucugcuauu

SEQ ID NO: 930246 - RNA, 15 nt, Homo sapiens
agccucuauugccau

SEQ ID NO: 930247 - RNA, 19 nt, Homo sapiens
agcuagaaaacaggcaaau

SEQ ID NO: 930248 - RNA, 17 nt, Homo sapiens
aggaugcuuguacauaa

SEQ ID NO: 930249 - RNA, 21 nt, Homo sapiens
agggcuugugugcacauaucc

SEQ ID NO: 930250 - RNA, 19 nt, Homo sapiens
agguucuggugugaacuaa

SEQ ID NO: 930251 - RNA, 17 nt, Homo sapiens
aguaauaugcacacauu

SEQ ID NO: 930252 - RNA, 23 nt, Homo sapiens
aguacacuguuucaaacuuuacu

SEQ ID NO: 930253 - RNA, 18 nt, Homo sapiens
aguacguugugcauuugg

SEQ ID NO: 930254 - RNA, 16 nt, Homo sapiens
aguaucccuacuguaa

SEQ ID NO: 930255 - RNA, 15 nt, Homo sapiens
aguaugugcauuuaa

SEQ ID NO: 930256 - RNA, 17 nt, Homo sapiens
agucuguuuuaugacuu

SEQ ID NO: 930257 - RNA, 22 nt, Homo sapiens
auaaaucgcuuuugauaaucaa

SEQ ID NO: 930258 - RNA, 17 nt, Homo sapiens
auaauaaagaucaugua

SEQ ID NO: 930259 - RNA, 14 nt, Homo sapiens
auaaucaacugggc

SEQ ID NO: 930260 - RNA, 21 nt, Homo sapiens
auacuauuuaauuauuucacu

SEQ ID NO: 930261 - RNA, 23 nt, Homo sapiens
auacugccuuguuuaauguuaau

SEQ ID NO: 930262 - RNA, 23 nt, Homo sapiens
auaggaaauauuuuaauguuucu

SEQ ID NO: 930263 - RNA, 15 nt, Homo sapiens
auaguggugugauuu

SEQ ID NO: 930264 - RNA, 13 nt, Homo sapiens
auauaaauuuauc

SEQ ID NO: 930265 - RNA, 13 nt, Homo sapiens
auauauacuauau

SEQ ID NO: 930266 - RNA, 17 nt, Homo sapiens
auaucacaugucagcca

SEQ ID NO: 930267 - RNA, 15 nt, Homo sapiens
auauuuuauguguaa

SEQ ID NO: 930268 - RNA, 15 nt, Homo sapiens
aucaucacccagcac

SEQ ID NO: 930269 - RNA, 13 nt, Homo sapiens
auccuccuccugc

SEQ ID NO: 930270 - RNA, 23 nt, Homo sapiens
auccugauucauauuuaauuuga

SEQ ID NO: 930271 - RNA, 18 nt, Homo sapiens
aucgcuuuugauaaucaa

SEQ ID NO: 930272 - RNA, 21 nt, Homo sapiens
aucgucacugcuuaacuucac

SEQ ID NO: 930273 - RNA, 20 nt, Homo sapiens
aucuccaaaauaaaacuuuu

SEQ ID NO: 930274 - RNA, 12 nt, Homo sapiens
augauuucacag

SEQ ID NO: 930275 - RNA, 16 nt, Homo sapiens
augauuucacagugug

SEQ ID NO: 930276 - RNA, 17 nt, Homo sapiens
augcucuccaaaccacu

SEQ ID NO: 930277 - RNA, 15 nt, Homo sapiens
auggcuuuugugcau

SEQ ID NO: 930278 - RNA, 17 nt, Homo sapiens
auguuuagcagauuuaa

SEQ ID NO: 930279 - RNA, 22 nt, Homo sapiens
auguuugccgcuuaagcuuuca

SEQ ID NO: 930280 - RNA, 22 nt, Homo sapiens
auuaaggauuuuaugcuuuaaa

SEQ ID NO: 930281 - RNA, 16 nt, Homo sapiens
auuauauauacuauau

SEQ ID NO: 930282 - RNA, 14 nt, Homo sapiens
auuauauucauucu

SEQ ID NO: 930283 - RNA, 23 nt, Homo sapiens
auucauucuuuuugaaaugucaa

SEQ ID NO: 930284 - RNA, 15 nt, Homo sapiens
auuccucacuuugaa

SEQ ID NO: 930285 - RNA, 14 nt, Homo sapiens
auucucuccuguac

SEQ ID NO: 930286 - RNA, 13 nt, Homo sapiens
auucuuuuaguuu

SEQ ID NO: 930287 - RNA, 18 nt, Homo sapiens
auugaaguuuuggcaauu

SEQ ID NO: 930288 - RNA, 19 nt, Homo sapiens
auuuaacagaaauguacag

SEQ ID NO: 930289 - RNA, 15 nt, Homo sapiens
auuuaauccucucaa

SEQ ID NO: 930290 - RNA, 17 nt, Homo sapiens
auuuauaaucacuuuuu

SEQ ID NO: 930291 - RNA, 17 nt, Homo sapiens
auuuauugaaaugauuu

SEQ ID NO: 930292 - RNA, 14 nt, Homo sapiens
auuuauuuauucau

SEQ ID NO: 930293 - RNA, 14 nt, Homo sapiens
auuugaagauuuaa

SEQ ID NO: 930294 - RNA, 21 nt, Homo sapiens
auuugagcucuggaagccucu

SEQ ID NO: 930295 - RNA, 17 nt, Homo sapiens
auuuuaaggcauauuua

SEQ ID NO: 930296 - RNA, 15 nt, Homo sapiens
auuuuagcuacuaua

SEQ ID NO: 930297 - RNA, 22 nt, Homo sapiens
caacaauuauuugaagauuuaa

SEQ ID NO: 930298 - RNA, 22 nt, Homo sapiens
caacauacacaccccggacucc

SEQ ID NO: 930299 - RNA, 16 nt, Homo sapiens
caagaccacguuucua

SEQ ID NO: 930300 - RNA, 13 nt, Homo sapiens
caaucuucucaga

SEQ ID NO: 930301 - RNA, 19 nt, Homo sapiens
caauuauuugaagauuuaa

SEQ ID NO: 930302 - RNA, 16 nt, Homo sapiens
cacacuguccuauuau

SEQ ID NO: 930303 - RNA, 19 nt, Homo sapiens
caccuuaucuauguagaau

SEQ ID NO: 930304 - RNA, 16 nt, Homo sapiens
cacugcuuaacuucac

SEQ ID NO: 930305 - RNA, 18 nt, Homo sapiens
cacuguuaucuucacuuu

SEQ ID NO: 930306 - RNA, 19 nt, Homo sapiens
cacuguuaucuucacuuuu

SEQ ID NO: 930307 - RNA, 12 nt, Homo sapiens
cacuuacaauuu

SEQ ID NO: 930308 - RNA, 15 nt, Homo sapiens
cagcacuuacaauuu

SEQ ID NO: 930309 - RNA, 22 nt, Homo sapiens
cagcguuucuaugacacaugca

SEQ ID NO: 930310 - RNA, 15 nt, Homo sapiens
cagcuacaauuguaa

SEQ ID NO: 930311 - RNA, 16 nt, Homo sapiens
caguaguuagcuuucu

SEQ ID NO: 930312 - RNA, 22 nt, Homo sapiens
cauagagaauauaaaaauaaag

SEQ ID NO: 930313 - RNA, 19 nt, Homo sapiens
cauaguaccucugcuauuu

SEQ ID NO: 930314 - RNA, 18 nt, Homo sapiens
cauaucacaugucagcca

SEQ ID NO: 930315 - RNA, 12 nt, Homo sapiens
caucuuucaagg

SEQ ID NO: 930316 - RNA, 19 nt, Homo sapiens
caucuuucaagggaccucu

SEQ ID NO: 930317 - RNA, 16 nt, Homo sapiens
caugaucccaccuccc

SEQ ID NO: 930318 - RNA, 22 nt, Homo sapiens
caugaucccaccucccauucac

SEQ ID NO: 930319 - RNA, 14 nt, Homo sapiens
cauggcccugccau

SEQ ID NO: 930320 - RNA, 20 nt, Homo sapiens
cauuaauaauaaauucccug

SEQ ID NO: 930321 - RNA, 19 nt, Homo sapiens
cauuaucuagauacuguau

SEQ ID NO: 930322 - RNA, 16 nt, Homo sapiens
cauuucucauguugaa

SEQ ID NO: 930323 - RNA, 22 nt, Homo sapiens
cauuugagcucuggaagccucu

SEQ ID NO: 930324 - RNA, 19 nt, Homo sapiens
ccaagaaaauggccaguga

SEQ ID NO: 930325 - RNA, 19 nt, Homo sapiens
ccaaugagaucauugugaa

SEQ ID NO: 930326 - RNA, 19 nt, Homo sapiens
ccagcacggggcuaagcau

SEQ ID NO: 930327 - RNA, 14 nt, Homo sapiens
ccagccacugugau

SEQ ID NO: 930328 - RNA, 20 nt, Homo sapiens
ccaguaaaugggggugcauu

SEQ ID NO: 930329 - RNA, 18 nt, Homo sapiens
ccaugagaguucugucac

SEQ ID NO: 930330 - RNA, 22 nt, Homo sapiens
ccaugaucccaccucccauuca

SEQ ID NO: 930331 - RNA, 13 nt, Homo sapiens
ccauuugagcucu

SEQ ID NO: 930332 - RNA, 17 nt, Homo sapiens
ccccaaguuaguucaau

SEQ ID NO: 930333 - RNA, 21 nt, Homo sapiens
cccugccaugcucuccaaacc

SEQ ID NO: 930334 - RNA, 14 nt, Homo sapiens
ccucucaaccaccu

SEQ ID NO: 930335 - RNA, 19 nt, Homo sapiens
ccuggauuccucacuuuga

SEQ ID NO: 930336 - RNA, 18 nt, Homo sapiens
cgagcgcuaccucuccag

SEQ ID NO: 930337 - RNA, 16 nt, Homo sapiens
cgcuaccucuccagcc

SEQ ID NO: 930338 - RNA, 14 nt, Homo sapiens
cgcuuaagcuuuca

SEQ ID NO: 930339 - RNA, 16 nt, Homo sapiens
cggcagggaaauguau

SEQ ID NO: 930340 - RNA, 21 nt, Homo sapiens
cuaaaguguauuuuuuuacua

SEQ ID NO: 930341 - RNA, 12 nt, Homo sapiens
cuacuugcacac

SEQ ID NO: 930342 - RNA, 20 nt, Homo sapiens
cuagcccuuacguccuucca

SEQ ID NO: 930343 - RNA, 21 nt, Homo sapiens
cuauuuaauuauuucacuuua

SEQ ID NO: 930344 - RNA, 22 nt, Homo sapiens
cuauuuaauuauuucacuuuag

SEQ ID NO: 930345 - RNA, 22 nt, Homo sapiens
cuauuuauuuauuuauucauua

SEQ ID NO: 930346 - RNA, 23 nt, Homo sapiens
cucccuauuuuuuuucuguuaua

SEQ ID NO: 930347 - RNA, 18 nt, Homo sapiens
cucgaggcccuagcauuu

SEQ ID NO: 930348 - RNA, 14 nt, Homo sapiens
cucucugaccuccu

SEQ ID NO: 930349 - RNA, 14 nt, Homo sapiens
cucucuuguagcuc

SEQ ID NO: 930350 - RNA, 22 nt, Homo sapiens
cucuggaagccucuauugccau

SEQ ID NO: 930351 - RNA, 15 nt, Homo sapiens
cucuuguagcucucu

SEQ ID NO: 930352 - RNA, 17 nt, Homo sapiens
cugaccuccuccuucau

SEQ ID NO: 930353 - RNA, 23 nt, Homo sapiens
acucuauaaauaaaaccugacag

SEQ ID NO: 930354 - RNA, 19 nt, Homo sapiens
cugaggagccugcaacaug

SEQ ID NO: 930355 - RNA, 18 nt, Homo sapiens
cugcuauuugcuguuauu

SEQ ID NO: 930356 - RNA, 13 nt, Homo sapiens
cuggaagccucua

SEQ ID NO: 930357 - RNA, 20 nt, Homo sapiens
cuggauugcgccuaaugugu

SEQ ID NO: 930358 - RNA, 16 nt, Homo sapiens
cuggcuaugcauuuga

SEQ ID NO: 930359 - RNA, 16 nt, Homo sapiens
cuguuaucuucacuuu

SEQ ID NO: 930360 - RNA, 15 nt, Homo sapiens
cuguucuuuccaaag

SEQ ID NO: 930361 - RNA, 19 nt, Homo sapiens
cuguuuagaugaaugucag

SEQ ID NO: 930362 - RNA, 12 nt, Homo sapiens
cuuaagcuuuca

SEQ ID NO: 930363 - RNA, 20 nt, Homo sapiens
cuuacguccuuccacuucca

SEQ ID NO: 930364 - RNA, 15 nt, Homo sapiens
cuuacuguacaugaa

SEQ ID NO: 930365 - RNA, 12 nt, Homo sapiens
cuuagaacaaag

SEQ ID NO: 930366 - RNA, 17 nt, Homo sapiens
cuuagcccaucuuucaa

SEQ ID NO: 930367 - RNA, 22 nt, Homo sapiens
cuuauugguggcuguuccugaa

SEQ ID NO: 930368 - RNA, 20 nt, Homo sapiens
cuucagaucucuaacuucac

SEQ ID NO: 930369 - RNA, 22 nt, Homo sapiens
cuucucagaaggcaaaugacuu

SEQ ID NO: 930370 - RNA, 19 nt, Homo sapiens
cuuguaaggcauacugccu

SEQ ID NO: 930371 - RNA, 17 nt, Homo sapiens
cuugugugcacauaucc

SEQ ID NO: 930372 - RNA, 15 nt, Homo sapiens
cuuuaagaacuaaaa

SEQ ID NO: 930373 - RNA, 22 nt, Homo sapiens
cuuucaagggaccucuccauga

SEQ ID NO: 930374 - RNA, 20 nt, Homo sapiens
cuuucagcucagcuaaugaa

SEQ ID NO: 930375 - RNA, 20 nt, Homo sapiens
cuuuuauaaacuuuaccuuu

SEQ ID NO: 930376 - RNA, 23 nt, Homo sapiens
gaaacguauucaaacaauuugaa

SEQ ID NO: 930377 - RNA, 17 nt, Homo sapiens
gaaagcugaguguuuca

SEQ ID NO: 930378 - RNA, 14 nt, Homo sapiens
gaaaugauuucaca

SEQ ID NO: 930379 - RNA, 21 nt, Homo sapiens
gaaccacucuaucaaguauua

SEQ ID NO: 930380 - RNA, 22 nt, Homo sapiens
gaagcauuuuauaaaucgcuuu

SEQ ID NO: 930381 - RNA, 17 nt, Homo sapiens
gaaugucaguuguuauu

SEQ ID NO: 930382 - RNA, 22 nt, Homo sapiens
gaccauaaccccggaagccaaa

SEQ ID NO: 930383 - RNA, 12 nt, Homo sapiens
gaccugcuucua

SEQ ID NO: 930384 - RNA, 22 nt, Homo sapiens
gacugaguacguugugcauuug

SEQ ID NO: 930385 - RNA, 23 nt, Homo sapiens
gagcaucacaguuuugguugcuu

SEQ ID NO: 930386 - RNA, 14 nt, Homo sapiens
gagggcuaauaucu

SEQ ID NO: 930387 - RNA, 19 nt, Homo sapiens
gauauucucuagucauuug

SEQ ID NO: 930388 - RNA, 13 nt, Homo sapiens
gaucauugugaag

SEQ ID NO: 930389 - RNA, 15 nt, Homo sapiens
gauguuucauaagaa

SEQ ID NO: 930390 - RNA, 19 nt, Homo sapiens
gauugugggauacuauuua

SEQ ID NO: 930391 - RNA, 16 nt, Homo sapiens
gauuuuaugcuuuaaa

SEQ ID NO: 930392 - RNA, 20 nt, Homo sapiens
gcaaaguaucccuacuguaa

SEQ ID NO: 930393 - RNA, 21 nt, Homo sapiens
gcaaucuucucagaaggcaaa

SEQ ID NO: 930394 - RNA, 14 nt, Homo sapiens
gcagauuuaagaua

SEQ ID NO: 930395 - RNA, 13 nt, Homo sapiens
gcaggcaucgcca

SEQ ID NO: 930396 - RNA, 17 nt, Homo sapiens
gcauacugccuuguuua

SEQ ID NO: 930397 - RNA, 18 nt, Homo sapiens
gcauaguaccucugcuau

SEQ ID NO: 930398 - RNA, 13 nt, Homo sapiens
gcuaugcauuuga

SEQ ID NO: 930399 - RNA, 14 nt, Homo sapiens
ggaaauacacuguu

SEQ ID NO: 930400 - RNA, 15 nt, Homo sapiens
ggaaaugauguuuca

SEQ ID NO: 930401 - RNA, 18 nt, Homo sapiens
ggaagccucuauugccau

SEQ ID NO: 930402 - RNA, 17 nt, Homo sapiens
ggaauguaugugcacau

SEQ ID NO: 930403 - RNA, 14 nt, Homo sapiens
ggcccugccaugcu

SEQ ID NO: 930404 - RNA, 20 nt, Homo sapiens
ggcccugccaugcucuccaa

SEQ ID NO: 930405 - RNA, 19 nt, Homo sapiens
gguugcuuuaauaucauca

SEQ ID NO: 930406 - RNA, 17 nt, Homo sapiens
guauggcaaacugccau

SEQ ID NO: 930407 - RNA, 14 nt, Homo sapiens
guauuauaccuuuu

SEQ ID NO: 930408 - RNA, 19 nt, Homo sapiens
gucacuuuacuguccccau

SEQ ID NO: 930409 - RNA, 13 nt, Homo sapiens
gucauuuguuaau

SEQ ID NO: 930410 - RNA, 21 nt, Homo sapiens
gucucugaagugaaacugcuu

SEQ ID NO: 930411 - RNA, 23 nt, Homo sapiens
guuaguucaauccugauucauau

SEQ ID NO: 930412 - RNA, 17 nt, Homo sapiens
guuauuuuaucugcuau

SEQ ID NO: 930413 - RNA, 21 nt, Homo sapiens
guucuccagucauuauguuaa

SEQ ID NO: 930414 - RNA, 16 nt, Homo sapiens
guuuugguugcuuuaa

SEQ ID NO: 930415 - RNA, 12 nt, Homo sapiens
uaaauagcuaag

SEQ ID NO: 930416 - RNA, 17 nt, Homo sapiens
uaaaugggggugcauuu

SEQ ID NO: 930417 - RNA, 20 nt, Homo sapiens
uaacaaaauuugaauagccc

SEQ ID NO: 930418 - RNA, 18 nt, Homo sapiens
uaaccagcagaaaugccu

SEQ ID NO: 930419 - RNA, 13 nt, Homo sapiens
uaagaaugaaaua

SEQ ID NO: 930420 - RNA, 19 nt, Homo sapiens
uaagauauuaacugagaag

SEQ ID NO: 930421 - RNA, 19 nt, Homo sapiens
uaaguuucacagcacuuac

SEQ ID NO: 930422 - RNA, 15 nt, Homo sapiens
uaauuauuucacuuu

SEQ ID NO: 930423 - RNA, 15 nt, Homo sapiens
uaauuuuauuauagu

SEQ ID NO: 930424 - RNA, 15 nt, Homo sapiens
uacaaaagcauguga

SEQ ID NO: 930425 - RNA, 14 nt, Homo sapiens
uacuauauauguga

SEQ ID NO: 930426 - RNA, 18 nt, Homo sapiens
uacuguaauuugugauac

SEQ ID NO: 930427 - RNA, 19 nt, Homo sapiens
uagaaagcugaguguuuca

SEQ ID NO: 930428 - RNA, 15 nt, Homo sapiens
uagacauucuuuauc

SEQ ID NO: 930429 - RNA, 16 nt, Homo sapiens
uagaggcugaggaauc

SEQ ID NO: 930430 - RNA, 14 nt, Homo sapiens
uagaugaaugucag

SEQ ID NO: 930431 - RNA, 18 nt, Homo sapiens
uagcagauuuaagauaug

SEQ ID NO: 930432 - RNA, 13 nt, Homo sapiens
uagcuaagauaua

SEQ ID NO: 930433 - RNA, 19 nt, Homo sapiens
uaguucaaucuggauucau

SEQ ID NO: 930434 - RNA, 17 nt, Homo sapiens
uauaauuuaaacgugau

SEQ ID NO: 930435 - RNA, 16 nt, Homo sapiens
uaucuagauacuguau

SEQ ID NO: 930436 - RNA, 11 nt, Homo sapiens
uaucugcuaug

SEQ ID NO: 930437 - RNA, 20 nt, Homo sapiens
uaugcaugaaguaauaugca

SEQ ID NO: 930438 - RNA, 14 nt, Homo sapiens
uauguaaauagcua

SEQ ID NO: 930439 - RNA, 21 nt, Homo sapiens
uauguagaauauauuuccuua

SEQ ID NO: 930440 - RNA, 15 nt, Homo sapiens
uauuuauaaucacuu

SEQ ID NO: 930441 - RNA, 22 nt, Homo sapiens
uauuuauugaaaugauuucaca

SEQ ID NO: 930442 - RNA, 18 nt, Homo sapiens
ucaaauguucuccaguca

SEQ ID NO: 930443 - RNA, 17 nt, Homo sapiens
ucaaucuggauucauau

SEQ ID NO: 930444 - RNA, 20 nt, Homo sapiens
ucacagauaccucucuugua

SEQ ID NO: 930445 - RNA, 15 nt, Homo sapiens
ucaccucucaccucc

SEQ ID NO: 930446 - RNA, 23 nt, Homo sapiens
ucaguuguuauuuauugaaauga

SEQ ID NO: 930447 - RNA, 22 nt, Homo sapiens
ucauuuacuuuuaaacuuugau

SEQ ID NO: 930448 - RNA, 13 nt, Homo sapiens
ucauuuguuaaua

SEQ ID NO: 930449 - RNA, 21 nt, Homo sapiens
uccaagaucuuuuuccagguu

SEQ ID NO: 930450 - RNA, 24 nt, Homo sapiens
uccaauuaaggauuuuaugcuuua

SEQ ID NO: 930451 - RNA, 18 nt, Homo sapiens
uccauggcccugccaugc

SEQ ID NO: 930452 - RNA, 15 nt, Homo sapiens
ucccauucacagaua

SEQ ID NO: 930453 - RNA, 19 nt, Homo sapiens
ucccauucacagauaccuc

SEQ ID NO: 930454 - RNA, 21 nt, Homo sapiens
uccgcauccuccuccugcuuc

SEQ ID NO: 930455 - RNA, 20 nt, Homo sapiens
uccucgaggcccuagcauuu

SEQ ID NO: 930456 - RNA, 20 nt, Homo sapiens
uccucucaaccaccuuucag

SEQ ID NO: 930457 - RNA, 15 nt, Homo sapiens
uccuggauuccucac

SEQ ID NO: 930458 - RNA, 14 nt, Homo sapiens
uccuuacucuugau

SEQ ID NO: 930459 - RNA, 16 nt, Homo sapiens
ucuacaaaauauagcu

SEQ ID NO: 930460 - RNA, 14 nt, Homo sapiens
ucuaugacacaugc

SEQ ID NO: 930461 - RNA, 11 nt, Homo sapiens
ucuauguuaau

SEQ ID NO: 930462 - RNA, 13 nt, Homo sapiens
ucuccagccucag

SEQ ID NO: 930463 - RNA, 19 nt, Homo sapiens
ucuccaugaucccaccucc

SEQ ID NO: 930464 - RNA, 19 nt, Homo sapiens
ucucugaccuccuccuuca

SEQ ID NO: 930465 - RNA, 16 nt, Homo sapiens
ucucuuguagcucucu

SEQ ID NO: 930466 - RNA, 18 nt, Homo sapiens
ucugcuaugcuauugaag

SEQ ID NO: 930467 - RNA, 18 nt, Homo sapiens
ucugcuauuugcuguuau

SEQ ID NO: 930468 - RNA, 21 nt, Homo sapiens
ucuggaagccucuauugccau

SEQ ID NO: 930469 - RNA, 16 nt, Homo sapiens
ucuggaggucucugaa

SEQ ID NO: 930470 - RNA, 21 nt, Homo sapiens
ucuugaauuguaggugacuau

SEQ ID NO: 930471 - RNA, 23 nt, Homo sapiens
ucuuucaagggaccucuccauga

SEQ ID NO: 930472 - RNA, 19 nt, Homo sapiens
ugaaaugauuucacagugu

SEQ ID NO: 930473 - RNA, 15 nt, Homo sapiens
ugacauaucacaugu

SEQ ID NO: 930474 - RNA, 16 nt, Homo sapiens
ugacaucucugcaauc

SEQ ID NO: 930475 - RNA, 21 nt, Homo sapiens
ugauggaaauacacuguuauc

SEQ ID NO: 930476 - RNA, 16 nt, Homo sapiens
ugauuuuauaugcuau

SEQ ID NO: 930477 - RNA, 21 nt, Homo sapiens
ugcaaucuucucagaaggcaa

SEQ ID NO: 930478 - RNA, 23 nt, Homo sapiens
ugcacacauuuuuuaaaugcacc

SEQ ID NO: 930479 - RNA, 19 nt, Homo sapiens
ugcagaggccaccuggauu

SEQ ID NO: 930480 - RNA, 16 nt, Homo sapiens
ugccagccacugugau

SEQ ID NO: 930481 - RNA, 18 nt, Homo sapiens
ugccaucauuuacuuuua

SEQ ID NO: 930482 - RNA, 15 nt, Homo sapiens
ugccauuugagcucu

SEQ ID NO: 930483 - RNA, 21 nt, Homo sapiens
ugccucaccucucaccuccca

SEQ ID NO: 930484 - RNA, 17 nt, Homo sapiens
ugccuuguuuaauguua

SEQ ID NO: 930485 - RNA, 14 nt, Homo sapiens
ugcugccugccugg

SEQ ID NO: 930486 - RNA, 16 nt, Homo sapiens
ugcuuguacauaaugc

SEQ ID NO: 930487 - RNA, 21 nt, Homo sapiens
uggccaaugagaucauuguga

SEQ ID NO: 930488 - RNA, 21 nt, Homo sapiens
uggccagugagaucaauguga

SEQ ID NO: 930489 - RNA, 22 nt, Homo sapiens
ugggcaagggaccugcuucuau

SEQ ID NO: 930490 - RNA, 17 nt, Homo sapiens
ugucagccacugugaua

SEQ ID NO: 930491 - RNA, 18 nt, Homo sapiens
aaaccacuuuuugcagcu

SEQ ID NO: 930492 - RNA, 17 nt, Homo sapiens
aaagcugaguguuucac

SEQ ID NO: 930493 - RNA, 23 nt, Homo sapiens
aaauacacuguuaucuucacuuu

SEQ ID NO: 930494 - RNA, 22 nt, Homo sapiens
aaauacuguuugagguuuuuaa

SEQ ID NO: 930495 - RNA, 13 nt, Homo sapiens
aaccaccuuucag

SEQ ID NO: 930496 - RNA, 13 nt, Homo sapiens
aagaaauauuccu

SEQ ID NO: 930497 - RNA, 16 nt, Homo sapiens
aagauucuauguuaau

SEQ ID NO: 930498 - RNA, 17 nt, Homo sapiens
aagcaugugagacuggu

SEQ ID NO: 930499 - RNA, 13 nt, Homo sapiens
aaggagauuuaca

SEQ ID NO: 930500 - RNA, 23 nt, Homo sapiens
aaguuuuuauggcuuuugugcau

SEQ ID NO: 930501 - RNA, 22 nt, Homo sapiens
aauaaauucccuggccuuucau

SEQ ID NO: 930502 - RNA, 14 nt, Homo sapiens
aauauauauuuuag

SEQ ID NO: 930503 - RNA, 18 nt, Homo sapiens
aaucacuggcuguuaauc

SEQ ID NO: 930504 - RNA, 23 nt, Homo sapiens
aauccaagaaaauggccagugag

SEQ ID NO: 930505 - RNA, 18 nt, Homo sapiens
aauccugauucauauuua

SEQ ID NO: 930506 - RNA, 16 nt, Homo sapiens
aaugagaucauuguga

SEQ ID NO: 930507 - RNA, 17 nt, Homo sapiens
aaugauuucacagugug

SEQ ID NO: 930508 - RNA, 18 nt, Homo sapiens
aaugauuucacagugugu

SEQ ID NO: 930509 - RNA, 16 nt, Homo sapiens
aauuauauauacuaua

SEQ ID NO: 930510 - RNA, 16 nt, Homo sapiens
aauuauugauguuuuc

SEQ ID NO: 930511 - RNA, 20 nt, Homo sapiens
aauucucuaguuugauuaaa

SEQ ID NO: 930512 - RNA, 18 nt, Homo sapiens
aauuuccuuacucuugau

SEQ ID NO: 930513 - RNA, 17 nt, Homo sapiens
aauuuucccucuucacu

SEQ ID NO: 930514 - RNA, 13 nt, Homo sapiens
acaaaauauagcu

SEQ ID NO: 930515 - RNA, 19 nt, Homo sapiens
acaaugacuuguacucuga

SEQ ID NO: 930516 - RNA, 20 nt, Homo sapiens
acacauuuuuuaaaugcacc

SEQ ID NO: 930517 - RNA, 19 nt, Homo sapiens
acacugcauguuugugauu

SEQ ID NO: 930518 - RNA, 16 nt, Homo sapiens
acacuguuaucuucac

SEQ ID NO: 930519 - RNA, 15 nt, Homo sapiens
acaguguuucuggcu

SEQ ID NO: 930520 - RNA, 20 nt, Homo sapiens
acaguuuugguugcuuuaau

SEQ ID NO: 930521 - RNA, 17 nt, Homo sapiens
acauaaggaaacugggu

SEQ ID NO: 930522 - RNA, 17 nt, Homo sapiens
acauaaugcgugcauac

SEQ ID NO: 930523 - RNA, 18 nt, Homo sapiens
acaugccagccacuguga

SEQ ID NO: 930524 - RNA, 18 nt, Homo sapiens
acaugucagccacuguga

SEQ ID NO: 930525 - RNA, 14 nt, Homo sapiens
accucuccagccuc

SEQ ID NO: 930526 - RNA, 18 nt, Homo sapiens
acggucacuuuacugucc

SEQ ID NO: 930527 - RNA, 17 nt, Homo sapiens
acuaaacauguauguaa

SEQ ID NO: 930528 - RNA, 19 nt, Homo sapiens
acugaguacguugugcauu

SEQ ID NO: 930529 - RNA, 22 nt, Homo sapiens
acugaguacguugugcauuugg

SEQ ID NO: 930530 - RNA, 12 nt, Homo sapiens
acuguacaugaa

SEQ ID NO: 930531 - RNA, 21 nt, Homo sapiens
acuucuuaguaugugcauuua

SEQ ID NO: 930532 - RNA, 20 nt, Homo sapiens
acuuugauuuuauaugcuau

SEQ ID NO: 930533 - RNA, 13 nt, Homo sapiens
acuuuuugcagcu

SEQ ID NO: 930534 - RNA, 17 nt, Homo sapiens
agaaaaaggaugcacag

SEQ ID NO: 930535 - RNA, 19 nt, Homo sapiens
agaaaacaggcaaauuccu

SEQ ID NO: 930536 - RNA, 16 nt, Homo sapiens
agaaauuaaguaucug

SEQ ID NO: 930537 - RNA, 15 nt, Homo sapiens
agaauauauuuccuu

SEQ ID NO: 930538 - RNA, 13 nt, Homo sapiens
agaauguuuucaa

SEQ ID NO: 930539 - RNA, 15 nt, Homo sapiens
agauaccucucuugu

SEQ ID NO: 930540 - RNA, 14 nt, Homo sapiens
agaugaaugucagu

SEQ ID NO: 930541 - RNA, 14 nt, Homo sapiens
agccucagcucuca

SEQ ID NO: 930542 - RNA, 19 nt, Homo sapiens
agccucuauugccaugaga

SEQ ID NO: 930543 - RNA, 15 nt, Homo sapiens
agcucucaguugcag

SEQ ID NO: 930544 - RNA, 17 nt, Homo sapiens
agcucucaguugcagcc

SEQ ID NO: 930545 - RNA, 15 nt, Homo sapiens
agcuuucucuaguuc

SEQ ID NO: 930546 - RNA, 17 nt, Homo sapiens
agcuuucucuaguucaa

SEQ ID NO: 930547 - RNA, 15 nt, Homo sapiens
aggaaagauuuuguu

SEQ ID NO: 930548 - RNA, 19 nt, Homo sapiens
aggaaggaggaagcuuauu

SEQ ID NO: 930549 - RNA, 21 nt, Homo sapiens
agggaccucuccaugauccca

SEQ ID NO: 930550 - RNA, 16 nt, Homo sapiens
uucacagauaccucuc

SEQ ID NO: 930551 - RNA, 17 nt, Homo sapiens
uucauaccuacauguau

SEQ ID NO: 930552 - RNA, 15 nt, Homo sapiens
uucgugaugacauau

SEQ ID NO: 930553 - RNA, 16 nt, Homo sapiens
uucuuguacucuacaa

SEQ ID NO: 930554 - RNA, 20 nt, Homo sapiens
uugaaauauaggaacuuaaa

SEQ ID NO: 930555 - RNA, 13 nt, Homo sapiens
uugaagauucuau

SEQ ID NO: 930556 - RNA, 21 nt, Homo sapiens
uugcaaaguaucccuacugua

SEQ ID NO: 930557 - RNA, 21 nt, Homo sapiens
uugccaugagaguucugucac

SEQ ID NO: 930558 - RNA, 15 nt, Homo sapiens
uugugggauacuauu

SEQ ID NO: 930559 - RNA, 21 nt, Homo sapiens
uuguuaguaugaggcauuugu

SEQ ID NO: 930560 - RNA, 22 nt, Homo sapiens
uuguuugagaaauuaaguaucu

SEQ ID NO: 930561 - RNA, 12 nt, Homo sapiens
uuuaaacuuuga

SEQ ID NO: 930562 - RNA, 18 nt, Homo sapiens
uuuaaaguaaaggcaaac

SEQ ID NO: 930563 - RNA, 21 nt, Homo sapiens
uuuaagaaaaaggaugcacag

SEQ ID NO: 930564 - RNA, 12 nt, Homo sapiens
uuuacaacuggg

SEQ ID NO: 930565 - RNA, 11 nt, Homo sapiens
uuuacaguguu

SEQ ID NO: 930566 - RNA, 18 nt, Homo sapiens
uuuagaagauucuauguu

SEQ ID NO: 930567 - RNA, 15 nt, Homo sapiens
aaaacaggcaaauuc

SEQ ID NO: 930568 - RNA, 13 nt, Homo sapiens
aaagauacaguua

SEQ ID NO: 930569 - RNA, 18 nt, Homo sapiens
aaagcugaguguuucaca

SEQ ID NO: 930570 - RNA, 19 nt, Homo sapiens
aaaugauuucacagugugu

SEQ ID NO: 930571 - RNA, 16 nt, Homo sapiens
aaauggccaaugagau

SEQ ID NO: 930572 - RNA, 21 nt, Homo sapiens
aacaaugacuuguacucugaa

SEQ ID NO: 930573 - RNA, 19 nt, Homo sapiens
aaccguuugugauugccau

SEQ ID NO: 930574 - RNA, 15 nt, Homo sapiens
aacuaaaauguucua

SEQ ID NO: 930575 - RNA, 14 nt, Homo sapiens
aacuaaacuuucac

SEQ ID NO: 930576 - RNA, 19 nt, Homo sapiens
aagaaaauggccagugaga

SEQ ID NO: 930577 - RNA, 21 nt, Homo sapiens
aagacugaguacguugugcau

SEQ ID NO: 930578 - RNA, 22 nt, Homo sapiens
aagaucuuuuuccagguuccug

SEQ ID NO: 930579 - RNA, 14 nt, Homo sapiens
aagcaaauggccaa

SEQ ID NO: 930580 - RNA, 16 nt, Homo sapiens
aagccucuauugccau

SEQ ID NO: 930581 - RNA, 17 nt, Homo sapiens
aagccucuauugccaug

SEQ ID NO: 930582 - RNA, 23 nt, Homo sapiens
aaggaaacuggguuccugcaaug

SEQ ID NO: 930583 - RNA, 23 nt, Homo sapiens
aaggaagguucuggugugaacua

SEQ ID NO: 930584 - RNA, 13 nt, Homo sapiens
aagugaaacugcu

SEQ ID NO: 930585 - RNA, 14 nt, Homo sapiens
aauacacuguuauc

SEQ ID NO: 930586 - RNA, 23 nt, Homo sapiens
aauauagcuuucauaacaucgaa

SEQ ID NO: 930587 - RNA, 22 nt, Homo sapiens
aauccaagaaaauggccaguga

SEQ ID NO: 930588 - RNA, 13 nt, Homo sapiens
aaucuggauucau

SEQ ID NO: 930589 - RNA, 15 nt, Homo sapiens
aaugauuucacagug

SEQ ID NO: 930590 - RNA, 13 nt, Homo sapiens
aaugcaccuggaa

SEQ ID NO: 930591 - RNA, 15 nt, Homo sapiens
aaugggggugcauuu

SEQ ID NO: 930592 - RNA, 23 nt, Homo sapiens
aauguuaauuaugcaguguuucc

SEQ ID NO: 930593 - RNA, 17 nt, Homo sapiens
aauguucuccagucauu

SEQ ID NO: 930594 - RNA, 12 nt, Homo sapiens
aauuauuugaag

SEQ ID NO: 930595 - RNA, 20 nt, Homo sapiens
acaauuauuugaagauuuaa

SEQ ID NO: 930596 - RNA, 20 nt, Homo sapiens
acaccaggauuuaaguuuca

SEQ ID NO: 930597 - RNA, 14 nt, Homo sapiens
acagaguuguuaca

SEQ ID NO: 930598 - RNA, 17 nt, Homo sapiens
acauaucacaugucagc

SEQ ID NO: 930599 - RNA, 17 nt, Homo sapiens
acauauccuuagcccau

SEQ ID NO: 930600 - RNA, 16 nt, Homo sapiens
acauguauguaaauag

SEQ ID NO: 930601 - RNA, 16 nt, Homo sapiens
acaugucagccacugu

SEQ ID NO: 930602 - RNA, 12 nt, Homo sapiens
accaccuuucag

SEQ ID NO: 930603 - RNA, 23 nt, Homo sapiens
acccaaguuaguucaauccugau

SEQ ID NO: 930604 - RNA, 20 nt, Homo sapiens
accccggaagccaaaccucu

SEQ ID NO: 930605 - RNA, 13 nt, Homo sapiens
accucucaccucc

SEQ ID NO: 930606 - RNA, 12 nt, Homo sapiens
accucuccauga

SEQ ID NO: 930607 - RNA, 20 nt, Homo sapiens
accucucuuguagcucucug

SEQ ID NO: 930608 - RNA, 22 nt, Homo sapiens
accuuuguauucucuccuguac

SEQ ID NO: 930609 - RNA, 14 nt, Homo sapiens
acuaaaauguucua

SEQ ID NO: 930610 - RNA, 15 nt, Homo sapiens
aggcccaaauuauca

SEQ ID NO: 930611 - RNA, 23 nt, Homo sapiens
aggcuuggaaccguaggacccaa

SEQ ID NO: 930612 - RNA, 18 nt, Homo sapiens
agggcucacagaauucau

SEQ ID NO: 930613 - RNA, 16 nt, Homo sapiens
agggguaugucuuuau

SEQ ID NO: 930614 - RNA, 20 nt, Homo sapiens
aggguuuuccaaugugacua

SEQ ID NO: 930615 - RNA, 14 nt, Homo sapiens
agguaaaagcauca

SEQ ID NO: 930616 - RNA, 16 nt, Homo sapiens
aguaacuaaagcuuua

SEQ ID NO: 930617 - RNA, 19 nt, Homo sapiens
agucacauggccuaugcac

SEQ ID NO: 930618 - RNA, 12 nt, Homo sapiens
agucacugugag

SEQ ID NO: 930619 - RNA, 19 nt, Homo sapiens
agucauuugcugagcaugu

SEQ ID NO: 930620 - RNA, 20 nt, Homo sapiens
agucccauccucuugucagg

SEQ ID NO: 930621 - RNA, 16 nt, Homo sapiens
agucggaucuagucca

SEQ ID NO: 930622 - RNA, 14 nt, Homo sapiens
agugaaggauuuau

SEQ ID NO: 930623 - RNA, 22 nt, Homo sapiens
agugauugauagaguguuauca

SEQ ID NO: 930624 - RNA, 23 nt, Homo sapiens
aguguggccacgugggcaaacag

SEQ ID NO: 930625 - RNA, 14 nt, Homo sapiens
aguguggccugagu

SEQ ID NO: 930626 - RNA, 22 nt, Homo sapiens
aguguuaucagucauaacuaaa

SEQ ID NO: 930627 - RNA, 14 nt, Homo sapiens
aguucaaauugccu

SEQ ID NO: 930628 - RNA, 16 nt, Homo sapiens
aguucauauguaccau

SEQ ID NO: 930629 - RNA, 17 nt, Homo sapiens
aguucauauguaccaug

SEQ ID NO: 930630 - RNA, 15 nt, Homo sapiens
aguucuugugccaua

SEQ ID NO: 930631 - RNA, 13 nt, Homo sapiens
aguugaaacaaga

SEQ ID NO: 930632 - RNA, 19 nt, Homo sapiens
aguugcguggacucugcac

SEQ ID NO: 930633 - RNA, 21 nt, Homo sapiens
aguugcguggacucugcacau

SEQ ID NO: 930634 - RNA, 20 nt, Homo sapiens
aguugcuuguaaaauuucac

SEQ ID NO: 930635 - RNA, 13 nt, Homo sapiens
aguuugauuucau

SEQ ID NO: 930636 - RNA, 20 nt, Homo sapiens
aguuuugcccuuuuuaagga

SEQ ID NO: 930637 - RNA, 22 nt, Homo sapiens
auaacgauaaaagacagugaaa

SEQ ID NO: 930638 - RNA, 19 nt, Homo sapiens
auaaguucuaguugcuugu

SEQ ID NO: 930639 - RNA, 21 nt, Homo sapiens
auaauguuacauuauuaucaa

SEQ ID NO: 930640 - RNA, 12 nt, Homo sapiens
auacacugugac

SEQ ID NO: 930641 - RNA, 13 nt, Homo sapiens
auacagaauuuua

SEQ ID NO: 930642 - RNA, 14 nt, Homo sapiens
auacucuucaagga

SEQ ID NO: 930643 - RNA, 22 nt, Homo sapiens
auacugugugcuaaaacaagca

SEQ ID NO: 930644 - RNA, 19 nt, Homo sapiens
auagauaggucagugcaaa

SEQ ID NO: 930645 - RNA, 16 nt, Homo sapiens
auauacucuucaagga

SEQ ID NO: 930646 - RNA, 17 nt, Homo sapiens
auauggacucugcacau

SEQ ID NO: 930647 - RNA, 17 nt, Homo sapiens
aucaaaggagagucaca

SEQ ID NO: 930648 - RNA, 20 nt, Homo sapiens
aucacuuccuauaugcacuu

SEQ ID NO: 930649 - RNA, 16 nt, Homo sapiens
aucaggaccuccaagc

SEQ ID NO: 930650 - RNA, 18 nt, Homo sapiens
aucaggaccuccaagcca

SEQ ID NO: 930651 - RNA, 23 nt, Homo sapiens
aucauauaauaaauguacauuaa

SEQ ID NO: 930652 - RNA, 15 nt, Homo sapiens
auccacuucuuucag

SEQ ID NO: 930653 - RNA, 16 nt, Homo sapiens
auccagucucccaacu

SEQ ID NO: 930654 - RNA, 19 nt, Homo sapiens
aucucugcagggccgccag

SEQ ID NO: 930655 - RNA, 17 nt, Homo sapiens
aucugcuuuugguuaua

SEQ ID NO: 930656 - RNA, 15 nt, Homo sapiens
augaacucuuaauca

SEQ ID NO: 930657 - RNA, 17 nt, Homo sapiens
augagaccacuguuauc

SEQ ID NO: 930658 - RNA, 21 nt, Homo sapiens
augcacauauggacucugcac

SEQ ID NO: 930659 - RNA, 15 nt, Homo sapiens
augcagucuguccag

SEQ ID NO: 930660 - RNA, 21 nt, Homo sapiens
augccaaccggucacccagga

SEQ ID NO: 930661 - RNA, 20 nt, Homo sapiens
auggccucaagaucaaugaa

SEQ ID NO: 930662 - RNA, 17 nt, Homo sapiens
augggaaccccuucauc

SEQ ID NO: 930663 - RNA, 18 nt, Homo sapiens
augggugaaggcuggcau

SEQ ID NO: 930664 - RNA, 18 nt, Homo sapiens
auguacaugaagaagcua

SEQ ID NO: 930665 - RNA, 17 nt, Homo sapiens
augucuuggacacugua

SEQ ID NO: 930666 - RNA, 16 nt, Homo sapiens
auguucacuuccaaga

SEQ ID NO: 930667 - RNA, 21 nt, Homo sapiens
auuaacugaggcauccacuuc

SEQ ID NO: 930668 - RNA, 17 nt, Homo sapiens
auuacaaauccaaugaa

SEQ ID NO: 930669 - RNA, 13 nt, Homo sapiens
auuagaugaacuc

SEQ ID NO: 930670 - RNA, 17 nt, Homo sapiens
auuauaauauacuauau

SEQ ID NO: 930671 - RNA, 20 nt, Homo sapiens
auuauauuuacaaaugggaa

SEQ ID NO: 930672 - RNA, 20 nt, Homo sapiens
auuaucuaaaguaugaagca

SEQ ID NO: 930673 - RNA, 14 nt, Homo sapiens
auucaggcuuugga

SEQ ID NO: 930674 - RNA, 17 nt, Homo sapiens
auuccaccugcaaucaa

SEQ ID NO: 930675 - RNA, 13 nt, Homo sapiens
auucuaguacuug

SEQ ID NO: 930676 - RNA, 18 nt, Homo sapiens
auugugaucagaccauaa

SEQ ID NO: 930677 - RNA, 19 nt, Homo sapiens
auuuacuguggcuucuuaa

SEQ ID NO: 930678 - RNA, 21 nt, Homo sapiens
auuuacuguggcuucuuaauc

SEQ ID NO: 930679 - RNA, 23 nt, Homo sapiens
auuuacuguggcuucuuaaucuu

SEQ ID NO: 930680 - RNA, 20 nt, Homo sapiens
auuucaugauuucauuucaa

SEQ ID NO: 930681 - RNA, 22 nt, Homo sapiens
auuucuuucaauaaacuaaaga

SEQ ID NO: 930682 - RNA, 17 nt, Homo sapiens
caaaauaaagugacaga

SEQ ID NO: 930683 - RNA, 14 nt, Homo sapiens
caaagagugaagga

SEQ ID NO: 930684 - RNA, 18 nt, Homo sapiens
caaagcacgaaauguuau

SEQ ID NO: 930685 - RNA, 20 nt, Homo sapiens
caacuuguauuaaagacaga

SEQ ID NO: 930686 - RNA, 22 nt, Homo sapiens
caagaccugauuucugagcauu

SEQ ID NO: 930687 - RNA, 13 nt, Homo sapiens
caagcaagacuga

SEQ ID NO: 930688 - RNA, 17 nt, Homo sapiens
caagccacugagcaaug

SEQ ID NO: 930689 - RNA, 13 nt, Homo sapiens
caauaaacuaaag

SEQ ID NO: 930690 - RNA, 22 nt, Homo sapiens
cacacauccacgcacaugcgac

SEQ ID NO: 930691 - RNA, 19 nt, Homo sapiens
cacagaauucauucacuca

SEQ ID NO: 930692 - RNA, 13 nt, Homo sapiens
cacauaugcaccu

SEQ ID NO: 930693 - RNA, 13 nt, Homo sapiens
cacauauggacuc

SEQ ID NO: 930694 - RNA, 19 nt, Homo sapiens
cacaugucuuguacaugug

SEQ ID NO: 930695 - RNA, 20 nt, Homo sapiens
cacaugucuuguacaugugu

SEQ ID NO: 930696 - RNA, 17 nt, Homo sapiens
cacaugugacacauaug

SEQ ID NO: 930697 - RNA, 18 nt, Homo sapiens
cacaugugacacauaugc

SEQ ID NO: 930698 - RNA, 12 nt, Homo sapiens
cacccacaugug

SEQ ID NO: 930699 - RNA, 13 nt, Homo sapiens
cacccacauguga

SEQ ID NO: 930700 - RNA, 15 nt, Homo sapiens
caccuugugucugua

SEQ ID NO: 930701 - RNA, 14 nt, Homo sapiens
cacgacacacuuug

SEQ ID NO: 930702 - RNA, 21 nt, Homo sapiens
cacgcaguaacuaaagcuuua

SEQ ID NO: 930703 - RNA, 19 nt, Homo sapiens
cacguucuggacugucuuc

SEQ ID NO: 930704 - RNA, 20 nt, Homo sapiens
cacucagugauugcaauuug

SEQ ID NO: 930705 - RNA, 16 nt, Homo sapiens
cacugagcaauguaua

SEQ ID NO: 930706 - RNA, 12 nt, Homo sapiens
cacugugacuua

SEQ ID NO: 930707 - RNA, 18 nt, Homo sapiens
cacuuccuauaugcacuu

SEQ ID NO: 930708 - RNA, 14 nt, Homo sapiens
cagaaguuccucaa

SEQ ID NO: 930709 - RNA, 20 nt, Homo sapiens
cagaauuuuaugcggcauuu

SEQ ID NO: 930710 - RNA, 19 nt, Homo sapiens
cagacggcuccacuaggac

SEQ ID NO: 930711 - RNA, 20 nt, Homo sapiens
cagacugaucaggaccucca

SEQ ID NO: 930712 - RNA, 22 nt, Homo sapiens
cagcuaaacaccacgucacuuc

SEQ ID NO: 930713 - RNA, 20 nt, Homo sapiens
cagcucagcuuccccaacac

SEQ ID NO: 930714 - RNA, 14 nt, Homo sapiens
cagcuccucacuca

SEQ ID NO: 930715 - RNA, 21 nt, Homo sapiens
caggacacgacuuguaaugaa

SEQ ID NO: 930716 - RNA, 21 nt, Homo sapiens
caggagacuuuacauggaugc

SEQ ID NO: 930717 - RNA, 19 nt, Homo sapiens
caggagagacagugaggcu

SEQ ID NO: 930718 - RNA, 20 nt, Homo sapiens
caggaguguggccacguggg

SEQ ID NO: 930719 - RNA, 15 nt, Homo sapiens
caggcuuuuuuccag

SEQ ID NO: 930720 - RNA, 13 nt, Homo sapiens
cagucacugugag

SEQ ID NO: 930721 - RNA, 18 nt, Homo sapiens
cagugaggcugcacccac

SEQ ID NO: 930722 - RNA, 13 nt, Homo sapiens
caguggcccugag

SEQ ID NO: 930723 - RNA, 22 nt, Homo sapiens
cauaugaaaaggcuaagcuuca

SEQ ID NO: 930724 - RNA, 16 nt, Homo sapiens
caucagcuaaacacca

SEQ ID NO: 930725 - RNA, 17 nt, Homo sapiens
cauccagaaguuccuca

SEQ ID NO: 930726 - RNA, 23 nt, Homo sapiens
caugaaucccacccacaugugac

SEQ ID NO: 930727 - RNA, 13 nt, Homo sapiens
caugauccaagca

SEQ ID NO: 930728 - RNA, 14 nt, Homo sapiens
cauggccuaugcac

SEQ ID NO: 930729 - RNA, 15 nt, Homo sapiens
cauggccuaugcaca

SEQ ID NO: 930730 - RNA, 16 nt, Homo sapiens
cauggccuaugcacau

SEQ ID NO: 930731 - RNA, 19 nt, Homo sapiens
cauggccuaugcacauaug

SEQ ID NO: 930732 - RNA, 12 nt, Homo sapiens
cauguacaugaa

SEQ ID NO: 930733 - RNA, 18 nt, Homo sapiens
caugucuuguacaugugu

SEQ ID NO: 930734 - RNA, 20 nt, Homo sapiens
caugugacacauaugcaccu

SEQ ID NO: 930735 - RNA, 17 nt, Homo sapiens
cauucuaguacuuggga

SEQ ID NO: 930736 - RNA, 21 nt, Homo sapiens
cauuggaggugaacaagcaaa

SEQ ID NO: 930737 - RNA, 11 nt, Homo sapiens
cauuuacugug

SEQ ID NO: 930738 - RNA, 10 nt, Homo sapiens
cauuuugcca

SEQ ID NO: 930739 - RNA, 11 nt, Homo sapiens
cauuuugccaa

SEQ ID NO: 930740 - RNA, 21 nt, Homo sapiens
ccaacacugcugcuccagugc

SEQ ID NO: 930741 - RNA, 23 nt, Homo sapiens
ccaagaccucagggcacaaagau

SEQ ID NO: 930742 - RNA, 20 nt, Homo sapiens
ccacagaccuaggauuucau

SEQ ID NO: 930743 - RNA, 20 nt, Homo sapiens
ccacaugugacacauaugca

SEQ ID NO: 930744 - RNA, 13 nt, Homo sapiens
ccacccacaugug

SEQ ID NO: 930745 - RNA, 21 nt, Homo sapiens
ccaccuacuuuucuuuccuca

SEQ ID NO: 930746 - RNA, 17 nt, Homo sapiens
ccacgucacuucaugca

SEQ ID NO: 930747 - RNA, 20 nt, Homo sapiens
ccacgugggcaaacaggcag

SEQ ID NO: 930748 - RNA, 15 nt, Homo sapiens
ccagaggcaccucaa

SEQ ID NO: 930749 - RNA, 20 nt, Homo sapiens
ccagcccagaaagucucuca

SEQ ID NO: 930750 - RNA, 16 nt, Homo sapiens
ccagcguggcgcagug

SEQ ID NO: 930751 - RNA, 23 nt, Homo sapiens
ccagcugcgccugcgcugcagga

SEQ ID NO: 930752 - RNA, 18 nt, Homo sapiens
ccaggacacgacuuguaa

SEQ ID NO: 930753 - RNA, 16 nt, Homo sapiens
ccaguaauugguccga

SEQ ID NO: 930754 - RNA, 17 nt, Homo sapiens
ccagucacugugagcuc

SEQ ID NO: 930755 - RNA, 16 nt, Homo sapiens
ccauguacaugaagaa

SEQ ID NO: 930756 - RNA, 13 nt, Homo sapiens
ccauuuccugaga

SEQ ID NO: 930757 - RNA, 16 nt, Homo sapiens
cccaagcagagaagcu

SEQ ID NO: 930758 - RNA, 18 nt, Homo sapiens
cccacauccugugccucc

SEQ ID NO: 930759 - RNA, 14 nt, Homo sapiens
cccacccacaugug

SEQ ID NO: 930760 - RNA, 22 nt, Homo sapiens
cccagaaagucucucauucuag

SEQ ID NO: 930761 - RNA, 13 nt, Homo sapiens
cccaggacacgac

SEQ ID NO: 930762 - RNA, 18 nt, Homo sapiens
cccugcccuuggcaccca

SEQ ID NO: 930763 - RNA, 23 nt, Homo sapiens
cccugggccuggcagcucagcuu

SEQ ID NO: 930764 - RNA, 22 nt, Homo sapiens
ccgucgucucuucugggcaccc

SEQ ID NO: 930765 - RNA, 13 nt, Homo sapiens
ccuaaagcagcca

SEQ ID NO: 930766 - RNA, 20 nt, Homo sapiens
ccuacacgagauacagaauu

SEQ ID NO: 930767 - RNA, 15 nt, Homo sapiens
ccuccaagccacuga

SEQ ID NO: 930768 - RNA, 22 nt, Homo sapiens
ccugauuaacugaggcauccac

SEQ ID NO: 930769 - RNA, 13 nt, Homo sapiens
ccugcacaagcca

SEQ ID NO: 930770 - RNA, 18 nt, Homo sapiens
ccugcaccccugcaguuu

SEQ ID NO: 930771 - RNA, 19 nt, Homo sapiens
ccuggagcccauccagucu

SEQ ID NO: 930772 - RNA, 16 nt, Homo sapiens
ccugguccacagggca

SEQ ID NO: 930773 - RNA, 17 nt, Homo sapiens
ccuuggcacccaagacc

SEQ ID NO: 930774 - RNA, 19 nt, Homo sapiens
ccuuguaauucuaaaugaa

SEQ ID NO: 930775 - RNA, 21 nt, Homo sapiens
cgggcaaaauaaagugacaga

SEQ ID NO: 930776 - RNA, 23 nt, Homo sapiens
cguaacaccugauuaacugaggc

SEQ ID NO: 930777 - RNA, 21 nt, Homo sapiens
cguggacucugcacaugucuu

SEQ ID NO: 930778 - RNA, 22 nt, Homo sapiens
cguggacucugcacaugucuug

SEQ ID NO: 930779 - RNA, 15 nt, Homo sapiens
cuaaaauuagaugaa

SEQ ID NO: 930780 - RNA, 19 nt, Homo sapiens
cuaaaauuagaugaacuca

SEQ ID NO: 930781 - RNA, 21 nt, Homo sapiens
cuaaacaccacgucacuucau

SEQ ID NO: 930782 - RNA, 14 nt, Homo sapiens
cuaaagccauugua

SEQ ID NO: 930783 - RNA, 22 nt, Homo sapiens
cuaaagcuuuaggaugacugua

SEQ ID NO: 930784 - RNA, 14 nt, Homo sapiens
cuaauaaaauauca

SEQ ID NO: 930785 - RNA, 16 nt, Homo sapiens
cuaauaaaauaucauu

SEQ ID NO: 930786 - RNA, 15 nt, Homo sapiens
cuaauaccucugugu

SEQ ID NO: 930787 - RNA, 19 nt, Homo sapiens
cuagagauuugguguacaa

SEQ ID NO: 930788 - RNA, 20 nt, Homo sapiens
cuagguucuaaaaauuguga

SEQ ID NO: 930789 - RNA, 23 nt, Homo sapiens
cuagguucuaaaaauugugauca

SEQ ID NO: 930790 - RNA, 20 nt, Homo sapiens
cuauaauuuaaauauaugcu

SEQ ID NO: 930791 - RNA, 20 nt, Homo sapiens
cuaucuauugauaauuuaga

SEQ ID NO: 930792 - RNA, 14 nt, Homo sapiens
cuaugcacauaugg

SEQ ID NO: 930793 - RNA, 15 nt, Homo sapiens
cucagugauugcaau

SEQ ID NO: 930794 - RNA, 11 nt, Homo sapiens
cucagugcagg

SEQ ID NO: 930795 - RNA, 23 nt, Homo sapiens
cuccacaauagcagacaguguuu

SEQ ID NO: 930796 - RNA, 21 nt, Homo sapiens
cuccagccugacuuggggaga

SEQ ID NO: 930797 - RNA, 11 nt, Homo sapiens
cuccugaggga

SEQ ID NO: 930798 - RNA, 20 nt, Homo sapiens
cuccuggcccaggugagucc

SEQ ID NO: 930799 - RNA, 18 nt, Homo sapiens
cugauauuggacaguaaa

SEQ ID NO: 930800 - RNA, 20 nt, Homo sapiens
cugauuaacugaggcaucca

SEQ ID NO: 930801 - RNA, 23 nt, Homo sapiens
cugcacaugucuuguacaugugu

SEQ ID NO: 930802 - RNA, 16 nt, Homo sapiens
cugcacccacccagga

SEQ ID NO: 930803 - RNA, 12 nt, Homo sapiens
cuggacugaccu

SEQ ID NO: 930804 - RNA, 19 nt, Homo sapiens
cugugacuuaagaagccuu

SEQ ID NO: 930805 - RNA, 21 nt, Homo sapiens
cugugacuuaagaagccuuac

SEQ ID NO: 930806 - RNA, 18 nt, Homo sapiens
cugugccuccaucagcua

SEQ ID NO: 930807 - RNA, 16 nt, Homo sapiens
cuguuagucauuugcu

SEQ ID NO: 930808 - RNA, 14 nt, Homo sapiens
cuuaauaaugugua

SEQ ID NO: 930809 - RNA, 14 nt, Homo sapiens
cuuauucucaagaa

SEQ ID NO: 930810 - RNA, 22 nt, Homo sapiens
cuucauccucugagugugacca

SEQ ID NO: 930811 - RNA, 22 nt, Homo sapiens
cuucaugcaggugaaacccagu

SEQ ID NO: 930812 - RNA, 20 nt, Homo sapiens
cuuccuggcuccaacacugc

SEQ ID NO: 930813 - RNA, 14 nt, Homo sapiens
cuuccuguccuccc

SEQ ID NO: 930814 - RNA, 22 nt, Homo sapiens
cuugauuuuuuucauuuugcca

SEQ ID NO: 930815 - RNA, 18 nt, Homo sapiens
cuugggagaccuguaauc

SEQ ID NO: 930816 - RNA, 20 nt, Homo sapiens
cuugguuugaguuucucuca

SEQ ID NO: 930817 - RNA, 19 nt, Homo sapiens
cuugugacuagugcugaag

SEQ ID NO: 930818 - RNA, 16 nt, Homo sapiens
cuugugccauagucac

SEQ ID NO: 930819 - RNA, 19 nt, Homo sapiens
cuuuauauggccucaagau

SEQ ID NO: 930820 - RNA, 16 nt, Homo sapiens
cuuucagcagacugau

SEQ ID NO: 930821 - RNA, 12 nt, Homo sapiens
cuuucauuuacu

SEQ ID NO: 930822 - RNA, 16 nt, Homo sapiens
cuuucauuuacugugg

SEQ ID NO: 930823 - RNA, 15 nt, Homo sapiens
cuuuggugcuuucca

SEQ ID NO: 930824 - RNA, 19 nt, Homo sapiens
cuuuucuggaauguaauca

SEQ ID NO: 930825 - RNA, 22 nt, Homo sapiens
cuuuuugaaaucagcauacuca

SEQ ID NO: 930826 - RNA, 23 nt, Homo sapiens
gaaaagcuccauuuuuagugaaa

SEQ ID NO: 930827 - RNA, 19 nt, Homo sapiens
gaaaguuuccccaccagug

SEQ ID NO: 930828 - RNA, 16 nt, Homo sapiens
gaacaagcaaacccag

SEQ ID NO: 930829 - RNA, 17 nt, Homo sapiens
gaacaagcaaacccaga

SEQ ID NO: 930830 - RNA, 21 nt, Homo sapiens
gaaccguaggacccaagcaga

SEQ ID NO: 930831 - RNA, 22 nt, Homo sapiens
gaagaggggcauaaacuuuccu

SEQ ID NO: 930832 - RNA, 14 nt, Homo sapiens
gaauaauaccuaag

SEQ ID NO: 930833 - RNA, 17 nt, Homo sapiens
gaauacaaagaaccaag

SEQ ID NO: 930834 - RNA, 20 nt, Homo sapiens
gaaucccacccacaugugac

SEQ ID NO: 930835 - RNA, 22 nt, Homo sapiens
gaaugaagacucgcaauuucac

SEQ ID NO: 930836 - RNA, 17 nt, Homo sapiens
gacacaggccugcucuc

SEQ ID NO: 930837 - RNA, 11 nt, Homo sapiens
gacagugaaag

SEQ ID NO: 930838 - RNA, 21 nt, Homo sapiens
gacauugaguucaaauugccu

SEQ ID NO: 930839 - RNA, 18 nt, Homo sapiens
gaccucagggcacaaaga

SEQ ID NO: 930840 - RNA, 12 nt, Homo sapiens
gaccuggcacug

SEQ ID NO: 930841 - RNA, 16 nt, Homo sapiens
gaccugguccacaggg

SEQ ID NO: 930842 - RNA, 22 nt, Homo sapiens
gacgggcaaaauaaagugacag

SEQ ID NO: 930843 - RNA, 16 nt, Homo sapiens
gacucugcacaugucu

SEQ ID NO: 930844 - RNA, 18 nt, Homo sapiens
gacucugcacaugucuug

SEQ ID NO: 930845 - RNA, 14 nt, Homo sapiens
gacugcagggacac

SEQ ID NO: 930846 - RNA, 23 nt, Homo sapiens
gagaaguuacuuuccauugcuau

SEQ ID NO: 930847 - RNA, 17 nt, Homo sapiens
gagacuuuacauggaug

SEQ ID NO: 930848 - RNA, 22 nt, Homo sapiens
gagagucgcaucucagugcagg

SEQ ID NO: 930849 - RNA, 16 nt, Homo sapiens
gagauuugguguacaa

SEQ ID NO: 930850 - RNA, 15 nt, Homo sapiens
gagcccauccagucu

SEQ ID NO: 930851 - RNA, 17 nt, Homo sapiens
gagcccauccagucucc

SEQ ID NO: 930852 - RNA, 14 nt, Homo sapiens
gaggcaccucaaga

SEQ ID NO: 930853 - RNA, 23 nt, Homo sapiens
gagugccuuuucgagacuggcag

SEQ ID NO: 930854 - RNA, 19 nt, Homo sapiens
gaucacuuccuauaugcac

SEQ ID NO: 930855 - RNA, 20 nt, Homo sapiens
gauuuaauccuagagauuug

SEQ ID NO: 930856 - RNA, 17 nt, Homo sapiens
gcacccucccacccggc

SEQ ID NO: 930857 - RNA, 15 nt, Homo sapiens
gcacugacugggcau

SEQ ID NO: 930858 - RNA, 13 nt, Homo sapiens
gcacuuauucuca

SEQ ID NO: 930859 - RNA, 22 nt, Homo sapiens
gcagacuugaccccgacgccac

SEQ ID NO: 930860 - RNA, 16 nt, Homo sapiens
gcagggcagccgucac

SEQ ID NO: 930861 - RNA, 20 nt, Homo sapiens
gcaggugaaacccagucacu

SEQ ID NO: 930862 - RNA, 22 nt, Homo sapiens
gccacgugggcaaacaggcagu

SEQ ID NO: 930863 - RNA, 16 nt, Homo sapiens
gccagaggacugugau

SEQ ID NO: 930864 - RNA, 14 nt, Homo sapiens
gccagccgugagug

SEQ ID NO: 930865 - RNA, 17 nt, Homo sapiens
gccagcguggcgcagug

SEQ ID NO: 930866 - RNA, 19 nt, Homo sapiens
gccucaagaugaaggcaaa

SEQ ID NO: 930867 - RNA, 18 nt, Homo sapiens
gccuccuggcccagguga

SEQ ID NO: 930868 - RNA, 19 nt, Homo sapiens
gccuccuggcccaggugag

SEQ ID NO: 930869 - RNA, 17 nt, Homo sapiens
gccugaagccaggccau

SEQ ID NO: 930870 - RNA, 13 nt, Homo sapiens
gccuucauuuuau

SEQ ID NO: 930871 - RNA, 13 nt, Homo sapiens
gcgacacugggag

SEQ ID NO: 930872 - RNA, 22 nt, Homo sapiens
gcuacugacuauggcuaccaaa

SEQ ID NO: 930873 - RNA, 15 nt, Homo sapiens
gcuauucuccaugua

SEQ ID NO: 930874 - RNA, 17 nt, Homo sapiens
gcuccagugcaggagac

SEQ ID NO: 930875 - RNA, 12 nt, Homo sapiens
gcucccaggugc

SEQ ID NO: 930876 - RNA, 14 nt, Homo sapiens
gcuccccaaagggu

SEQ ID NO: 930877 - RNA, 18 nt, Homo sapiens
gcuccucacucaccuuca

SEQ ID NO: 930878 - RNA, 21 nt, Homo sapiens
gcucuaaaaaguuuugcccuu

SEQ ID NO: 930879 - RNA, 13 nt, Homo sapiens
gcugcuccagugc

SEQ ID NO: 930880 - RNA, 16 nt, Homo sapiens
gcugcuccagugcagg

SEQ ID NO: 930881 - RNA, 22 nt, Homo sapiens
ggaaaaaauaacaaugaaaguu

SEQ ID NO: 930882 - RNA, 22 nt, Homo sapiens
ggaaccguaggacccaagcaga

SEQ ID NO: 930883 - RNA, 19 nt, Homo sapiens
ggaccaugcgacacuggga

SEQ ID NO: 930884 - RNA, 14 nt, Homo sapiens
ggaccucaguuuua

SEQ ID NO: 930885 - RNA, 17 nt, Homo sapiens
ggaccuccaagccacug

SEQ ID NO: 930886 - RNA, 18 nt, Homo sapiens
ggagaccuggacacaggc

SEQ ID NO: 930887 - RNA, 15 nt, Homo sapiens
ggagaccuggcacug

SEQ ID NO: 930888 - RNA, 23 nt, Homo sapiens
ggagcuagccagaggacugugau

SEQ ID NO: 930889 - RNA, 15 nt, Homo sapiens
ggaggaccagagcua

SEQ ID NO: 930890 - RNA, 14 nt, Homo sapiens
ggaggccagugagc

SEQ ID NO: 930891 - RNA, 21 nt, Homo sapiens
ggaugccaaccggucacccag

SEQ ID NO: 930892 - RNA, 23 nt, Homo sapiens
ggaugccaaccggucacccagga

SEQ ID NO: 930893 - RNA, 14 nt, Homo sapiens
ggcaaacaggcagu

SEQ ID NO: 930894 - RNA, 17 nt, Homo sapiens
ggcaaaggguccagaag

SEQ ID NO: 930895 - RNA, 19 nt, Homo sapiens
ggcaugauccaagcaagac

SEQ ID NO: 930896 - RNA, 20 nt, Homo sapiens
ggccuccuggcccaggugag

SEQ ID NO: 930897 - RNA, 15 nt, Homo sapiens
ggccuggcagcucag

SEQ ID NO: 930898 - RNA, 16 nt, Homo sapiens
ggcuccaacacugcug

SEQ ID NO: 930899 - RNA, 14 nt, Homo sapiens
ggcuccccaaaggg

SEQ ID NO: 930900 - RNA, 18 nt, Homo sapiens
ggcugcacccacccagga

SEQ ID NO: 930901 - RNA, 11 nt, Homo sapiens
ggcuggcacug

SEQ ID NO: 930902 - RNA, 16 nt, Homo sapiens
gggcuggcacugacug

SEQ ID NO: 930903 - RNA, 13 nt, Homo sapiens
ggggcagggcagc

SEQ ID NO: 930904 - RNA, 16 nt, Homo sapiens
ggggugccaguuugaa

SEQ ID NO: 930905 - RNA, 15 nt, Homo sapiens
gguccagaaggagac

SEQ ID NO: 930906 - RNA, 13 nt, Homo sapiens
ggugaaacccagu

SEQ ID NO: 930907 - RNA, 16 nt, Homo sapiens
ggugaacaagcaaacc

SEQ ID NO: 930908 - RNA, 24 nt, Homo sapiens
ggugcagccagaggcaccucaaga

SEQ ID NO: 930909 - RNA, 18 nt, Homo sapiens
gguucuggaaacauucag

SEQ ID NO: 930910 - RNA, 21 nt, Homo sapiens
guaaaagcaucacaugaacuu

SEQ ID NO: 930911 - RNA, 17 nt, Homo sapiens
guacacguguccuguag

SEQ ID NO: 930912 - RNA, 16 nt, Homo sapiens
guagccugugcaugua

SEQ ID NO: 930913 - RNA, 11 nt, Homo sapiens
guagcugugcg

SEQ ID NO: 930914 - RNA, 18 nt, Homo sapiens
gucacauggccuaugcac

SEQ ID NO: 930915 - RNA, 19 nt, Homo sapiens
gucacuucaugcaggugaa

SEQ ID NO: 930916 - RNA, 20 nt, Homo sapiens
guccagaaggagacaggcag

SEQ ID NO: 930917 - RNA, 15 nt, Homo sapiens
guccgaucuuugacu

SEQ ID NO: 930918 - RNA, 17 nt, Homo sapiens
guccuagagcuacaggg

SEQ ID NO: 930919 - RNA, 14 nt, Homo sapiens
gucgcaucucagug

SEQ ID NO: 930920 - RNA, 18 nt, Homo sapiens
gucgcaucucagugcagg

SEQ ID NO: 930921 - RNA, 11 nt, Homo sapiens
gucgucucuuc

SEQ ID NO: 930922 - RNA, 20 nt, Homo sapiens
gucucuuuauauggccucaa

SEQ ID NO: 930923 - RNA, 15 nt, Homo sapiens
gucuguacacguguc

SEQ ID NO: 930924 - RNA, 18 nt, Homo sapiens
gucuuggacacuguacaa

SEQ ID NO: 930925 - RNA, 22 nt, Homo sapiens
gugaaggcuggcaugauccaag

SEQ ID NO: 930926 - RNA, 16 nt, Homo sapiens
gugccaguuugaaugc

SEQ ID NO: 930927 - RNA, 17 nt, Homo sapiens
guggcuucuuaaucuuu

SEQ ID NO: 930928 - RNA, 17 nt, Homo sapiens
guguacacgugacagag

SEQ ID NO: 930929 - RNA, 20 nt, Homo sapiens
gugucuguacacguguccug

SEQ ID NO: 930930 - RNA, 14 nt, Homo sapiens
guguugcaugcagc

SEQ ID NO: 930931 - RNA, 18 nt, Homo sapiens
guuccaaguauuuugcca

SEQ ID NO: 930932 - RNA, 18 nt, Homo sapiens
guuuccuuccagcccaga

SEQ ID NO: 930933 - RNA, 15 nt, Homo sapiens
guuuccuuucauuua

SEQ ID NO: 930934 - RNA, 18 nt, Homo sapiens
guuuccuuucauuuacug

SEQ ID NO: 930935 - RNA, 23 nt, Homo sapiens
guuucuuuagcaguuuugugaua

SEQ ID NO: 930936 - RNA, 19 nt, Homo sapiens
uaaaacaagcacuaaacaa

SEQ ID NO: 930937 - RNA, 15 nt, Homo sapiens
uaaaagacagugaaa

SEQ ID NO: 930938 - RNA, 15 nt, Homo sapiens
uaaaauuucacuuaa

SEQ ID NO: 930939 - RNA, 23 nt, Homo sapiens
uaaacuuuccucuuccugccuag

SEQ ID NO: 930940 - RNA, 20 nt, Homo sapiens
uaaauuaugggaaucaagau

SEQ ID NO: 930941 - RNA, 16 nt, Homo sapiens
uaacaauaaaagacaa

SEQ ID NO: 930942 - RNA, 21 nt, Homo sapiens
uaagaagccuuaccacgcagu

SEQ ID NO: 930943 - RNA, 18 nt, Homo sapiens
uaaguaaguuugauuuca

SEQ ID NO: 930944 - RNA, 15 nt, Homo sapiens
uaaguuuccuuccag

SEQ ID NO: 930945 - RNA, 20 nt, Homo sapiens
uaaguuuccuuccagcccag

SEQ ID NO: 930946 - RNA, 22 nt, Homo sapiens
uaauguguacauuagucauuca

SEQ ID NO: 930947 - RNA, 15 nt, Homo sapiens
uacaaagaaccaaga

SEQ ID NO: 930948 - RNA, 15 nt, Homo sapiens
uacaaaugcauuucu

SEQ ID NO: 930949 - RNA, 21 nt, Homo sapiens
uaccauuucuugagguaaaag

SEQ ID NO: 930950 - RNA, 23 nt, Homo sapiens
uacuguggcuucuuaaucuuuuc

SEQ ID NO: 930951 - RNA, 19 nt, Homo sapiens
uacuugggagaccuguaau

SEQ ID NO: 930952 - RNA, 20 nt, Homo sapiens
uagaaagaaacugcucuaau

SEQ ID NO: 930953 - RNA, 18 nt, Homo sapiens
uagaguguuaucagucau

SEQ ID NO: 930954 - RNA, 23 nt, Homo sapiens
uaguacuugggagaccuguaauc

SEQ ID NO: 930955 - RNA, 17 nt, Homo sapiens
uagugcugaagcuuauu

SEQ ID NO: 930956 - RNA, 21 nt, Homo sapiens
uauaauuuaaaauaugcucua

SEQ ID NO: 930957 - RNA, 14 nt, Homo sapiens
uauagcuacuaauu

SEQ ID NO: 930958 - RNA, 18 nt, Homo sapiens
uaucuagacccaucuucu

SEQ ID NO: 930959 - RNA, 14 nt, Homo sapiens
uaugcacauaugga

SEQ ID NO: 930960 - RNA, 14 nt, Homo sapiens
uaugcucuaaacau

SEQ ID NO: 930961 - RNA, 14 nt, Homo sapiens
uauggacucugcac

SEQ ID NO: 930962 - RNA, 19 nt, Homo sapiens
uauguaccauguacaugaa

SEQ ID NO: 930963 - RNA, 18 nt, Homo sapiens
uaugucuuggacacugua

SEQ ID NO: 930964 - RNA, 20 nt, Homo sapiens
uaugucuuggacacuguaca

SEQ ID NO: 930965 - RNA, 17 nt, Homo sapiens
uauuauucuucauaaca

SEQ ID NO: 930966 - RNA, 13 nt, Homo sapiens
ucaaauagcauaa

SEQ ID NO: 930967 - RNA, 18 nt, Homo sapiens
ucaaggacuuucugaagc

SEQ ID NO: 930968 - RNA, 18 nt, Homo sapiens
ucaauaaauuguaauugu

SEQ ID NO: 930969 - RNA, 20 nt, Homo sapiens
ucacauggccuaugcacaua

SEQ ID NO: 930970 - RNA, 21 nt, Homo sapiens
ucacugccauauacucuucaa

SEQ ID NO: 930971 - RNA, 18 nt, Homo sapiens
ucacuuccaagagccuuu

SEQ ID NO: 930972 - RNA, 14 nt, Homo sapiens
ucagugcaggagag

SEQ ID NO: 930973 - RNA, 18 nt, Homo sapiens
ucaguuauuauauuuaca

SEQ ID NO: 930974 - RNA, 17 nt, Homo sapiens
ucauaagcgaucacuuc

SEQ ID NO: 930975 - RNA, 16 nt, Homo sapiens
ucauguuguaaacauu

SEQ ID NO: 930976 - RNA, 20 nt, Homo sapiens
ucauucaauaaauuguaauu

SEQ ID NO: 930977 - RNA, 13 nt, Homo sapiens
ucauuuacugugg

SEQ ID NO: 930978 - RNA, 21 nt, Homo sapiens
ucauuuacuguggcuucuuaa

SEQ ID NO: 930979 - RNA, 21 nt, Homo sapiens
ucauuuugccaaaaaggggua

SEQ ID NO: 930980 - RNA, 14 nt, Homo sapiens
uccaagccacugag

SEQ ID NO: 930981 - RNA, 13 nt, Homo sapiens
uccaaugugacua

SEQ ID NO: 930982 - RNA, 16 nt, Homo sapiens
uccacuaggacuucaa

SEQ ID NO: 930983 - RNA, 17 nt, Homo sapiens
ucccaaacagcugccuc

SEQ ID NO: 930984 - RNA, 16 nt, Homo sapiens
ucccacccacauguga

SEQ ID NO: 930985 - RNA, 16 nt, Homo sapiens
ucccauagccaggaaa

SEQ ID NO: 930986 - RNA, 17 nt, Homo sapiens
uccuccacaauagcaga

SEQ ID NO: 930987 - RNA, 17 nt, Homo sapiens
uccugccgcaacaguuu

SEQ ID NO: 930988 - RNA, 15 nt, Homo sapiens
uccuggcccagguga

SEQ ID NO: 930989 - RNA, 18 nt, Homo sapiens
uccuggcccaggugaguc

SEQ ID NO: 930990 - RNA, 15 nt, Homo sapiens
ucgaggagugccgug

SEQ ID NO: 930991 - RNA, 17 nt, Homo sapiens
ucgcaucucagugcagg

SEQ ID NO: 930992 - RNA, 14 nt, Homo sapiens
ucuaggguuuucca

SEQ ID NO: 930993 - RNA, 22 nt, Homo sapiens
ucucaagaagaacaucuuuaug

SEQ ID NO: 930994 - RNA, 12 nt, Homo sapiens
ucucagugcagg

SEQ ID NO: 930995 - RNA, 15 nt, Homo sapiens
ucucgguagcugugc

SEQ ID NO: 930996 - RNA, 18 nt, Homo sapiens
ucucgguagcugugcgug

SEQ ID NO: 930997 - RNA, 15 nt, Homo sapiens
ucucuccagccugac

SEQ ID NO: 930998 - RNA, 13 nt, Homo sapiens
ucugagcauuuaa

SEQ ID NO: 930999 - RNA, 13 nt, Homo sapiens
ucugcccaccuac

SEQ ID NO: 931000 - RNA, 15 nt, Homo sapiens
ucuuuagcaguuuug

SEQ ID NO: 931001 - RNA, 12 nt, Homo sapiens
ucuuugccaagu

SEQ ID NO: 931002 - RNA, 15 nt, Homo sapiens
ugaaagaaaauaacg

SEQ ID NO: 931003 - RNA, 20 nt, Homo sapiens
ugaaagcaaccuucuugccu

SEQ ID NO: 931004 - RNA, 18 nt, Homo sapiens
ugaacaagcaaacccaga

SEQ ID NO: 931005 - RNA, 18 nt, Homo sapiens
ugaagacucgcaauuuca

SEQ ID NO: 931006 - RNA, 13 nt, Homo sapiens
ugacacauaugca

SEQ ID NO: 931007 - RNA, 15 nt, Homo sapiens
ugacacauaugcacc

SEQ ID NO: 931008 - RNA, 18 nt, Homo sapiens
ugacagaagcuucugccc

SEQ ID NO: 931009 - RNA, 17 nt, Homo sapiens
ugagaccacuguuauca

SEQ ID NO: 931010 - RNA, 13 nt, Homo sapiens
ugagaccuggcag

SEQ ID NO: 931011 - RNA, 22 nt, Homo sapiens
ugagcaauguauaaccccaaag

SEQ ID NO: 931012 - RNA, 21 nt, Homo sapiens
ugagcucccaggugcagccag

SEQ ID NO: 931013 - RNA, 17 nt, Homo sapiens
ugaggggcuggcacuga

SEQ ID NO: 931014 - RNA, 16 nt, Homo sapiens
ugagguggacucucac

SEQ ID NO: 931015 - RNA, 15 nt, Homo sapiens
ugaucaggaccucca

SEQ ID NO: 931016 - RNA, 23 nt, Homo sapiens
ugaugucauaagcgaucacuucc

SEQ ID NO: 931017 - RNA, 20 nt, Homo sapiens
ugcacaugucuuguacaugu

SEQ ID NO: 931018 - RNA, 21 nt, Homo sapiens
ugcaccuugugucuguacacg

SEQ ID NO: 931019 - RNA, 15 nt, Homo sapiens
ugccaaccggucacc

SEQ ID NO: 931020 - RNA, 21 nt, Homo sapiens
ugcccugcccuuggcacccaa

SEQ ID NO: 931021 - RNA, 20 nt, Homo sapiens
ugccuuuccauaaucacuca

SEQ ID NO: 931022 - RNA, 14 nt, Homo sapiens
ugcguggacucugc

SEQ ID NO: 931023 - RNA, 19 nt, Homo sapiens
ugcuaagggcaggcccaaa

SEQ ID NO: 931024 - RNA, 18 nt, Homo sapiens
ugcuccagugcaggagac

SEQ ID NO: 931025 - RNA, 23 nt, Homo sapiens
ugcucucuuuuucuccaggguca

SEQ ID NO: 931026 - RNA, 17 nt, Homo sapiens
ugcugcuccagugcagg

SEQ ID NO: 931027 - RNA, 20 nt, Homo sapiens
ugcuuguaaaauuucacuua

SEQ ID NO: 931028 - RNA, 18 nt, Homo sapiens
uggaauaauccuaaacau

SEQ ID NO: 931029 - RNA, 14 nt, Homo sapiens
uggacucugcacau

SEQ ID NO: 931030 - RNA, 13 nt, Homo sapiens
uggcacccaagac

SEQ ID NO: 931031 - RNA, 16 nt, Homo sapiens
uggcacugacugggca

SEQ ID NO: 931032 - RNA, 23 nt, Homo sapiens
uggcagcucagcuuccccaacac

SEQ ID NO: 931033 - RNA, 20 nt, Homo sapiens
uggccacgcagccaggacac

SEQ ID NO: 931034 - RNA, 22 nt, Homo sapiens
uggccacgugggcaaacaggca

SEQ ID NO: 931035 - RNA, 23 nt, Homo sapiens
uggccagagagccuggugcugcu

SEQ ID NO: 931036 - RNA, 19 nt, Homo sapiens
uggcuccaacacugcugcu

SEQ ID NO: 931037 - RNA, 15 nt, Homo sapiens
uggcucccaggacac

SEQ ID NO: 931038 - RNA, 18 nt, Homo sapiens
uggcucccaggacacgac

SEQ ID NO: 931039 - RNA, 16 nt, Homo sapiens
ugggcaaacaggcagu

SEQ ID NO: 931040 - RNA, 18 nt, Homo sapiens
ugggcauucuuguuucaa

SEQ ID NO: 931041 - RNA, 13 nt, Homo sapiens
ugggcccacaaag

SEQ ID NO: 931042 - RNA, 14 nt, Homo sapiens
ugguccgaucuuug

SEQ ID NO: 931043 - RNA, 15 nt, Homo sapiens
uggugugugccucau

SEQ ID NO: 931044 - RNA, 17 nt, Homo sapiens
ugguguuaaucauuuca

SEQ ID NO: 931045 - RNA, 17 nt, Homo sapiens
uguaaaauuucacuuaa

SEQ ID NO: 931046 - RNA, 14 nt, Homo sapiens
uguagccugugcau

SEQ ID NO: 931047 - RNA, 18 nt, Homo sapiens
uguauacugugugcuaaa

SEQ ID NO: 931048 - RNA, 15 nt, Homo sapiens
ugucuucucccugca

SEQ ID NO: 931049 - RNA, 15 nt, Homo sapiens
uauggacucugcaca

SEQ ID NO: 931050 - RNA, 14 nt, Homo sapiens
uaugucuuggacac

SEQ ID NO: 931051 - RNA, 19 nt, Homo sapiens
uaugucuuggacacuguac

SEQ ID NO: 931052 - RNA, 18 nt, Homo sapiens
uauuauucuucauaacaa

SEQ ID NO: 931053 - RNA, 12 nt, Homo sapiens
uauucucaagaa

SEQ ID NO: 931054 - RNA, 15 nt, Homo sapiens
uauucuucauaacaa

SEQ ID NO: 931055 - RNA, 14 nt, Homo sapiens
uauuugaugcuaca

SEQ ID NO: 931056 - RNA, 12 nt, Homo sapiens
ucaacuuugaca

SEQ ID NO: 931057 - RNA, 22 nt, Homo sapiens
ucaagaagaagaggggcauaaa

SEQ ID NO: 931058 - RNA, 14 nt, Homo sapiens
ucaauaaacuaaag

SEQ ID NO: 931059 - RNA, 15 nt, Homo sapiens
ucaauaaacuaaaga

SEQ ID NO: 931060 - RNA, 19 nt, Homo sapiens
ucaaugaaaugaugucaua

SEQ ID NO: 931061 - RNA, 18 nt, Homo sapiens
ucacaugaacuuguaaag

SEQ ID NO: 931062 - RNA, 23 nt, Homo sapiens
ucacauggccuaugcacauaugg

SEQ ID NO: 931063 - RNA, 14 nt, Homo sapiens
ucacccaggaggau

SEQ ID NO: 931064 - RNA, 19 nt, Homo sapiens
ucacucagugauugcaauu

SEQ ID NO: 931065 - RNA, 15 nt, Homo sapiens
ucacuuccuauaugc

SEQ ID NO: 931066 - RNA, 19 nt, Homo sapiens
ucacuuccuauaugcacuu

SEQ ID NO: 931067 - RNA, 22 nt, Homo sapiens
ucaggaccuccaagccacugag

SEQ ID NO: 931068 - RNA, 16 nt, Homo sapiens
ucaugaguaacugauu

SEQ ID NO: 931069 - RNA, 16 nt, Homo sapiens
uccaacacugcugcuc

SEQ ID NO: 931070 - RNA, 11 nt, Homo sapiens
uccagugcagg

SEQ ID NO: 931071 - RNA, 13 nt, Homo sapiens
uccaucagcuaaa

SEQ ID NO: 931072 - RNA, 17 nt, Homo sapiens
ucccacccacaugugac

SEQ ID NO: 931073 - RNA, 21 nt, Homo sapiens
ucccacccacaugugacacau

SEQ ID NO: 931074 - RNA, 16 nt, Homo sapiens
ucccgcccccuuggcu

SEQ ID NO: 931075 - RNA, 18 nt, Homo sapiens
uccuagagauuuggugua

SEQ ID NO: 931076 - RNA, 19 nt, Homo sapiens
uccucaagggccaggacuu

SEQ ID NO: 931077 - RNA, 16 nt, Homo sapiens
uccucacucaccuuca

SEQ ID NO: 931078 - RNA, 14 nt, Homo sapiens
uccugagggagcuc

SEQ ID NO: 931079 - RNA, 23 nt, Homo sapiens
uccugagggagcuccaacucaga

SEQ ID NO: 931080 - RNA, 16 nt, Homo sapiens
uccuuucauuuacugu

SEQ ID NO: 931081 - RNA, 22 nt, Homo sapiens
ucucugcagggccgccagggag

SEQ ID NO: 931082 - RNA, 15 nt, Homo sapiens
ucugcacaugucuug

SEQ ID NO: 931083 - RNA, 19 nt, Homo sapiens
ucugcagggccgccaggga

SEQ ID NO: 931084 - RNA, 22 nt, Homo sapiens
ucuuguuucaauuccaccugca

SEQ ID NO: 931085 - RNA, 20 nt, Homo sapiens
ucuuuauauggccucaagau

SEQ ID NO: 931086 - RNA, 13 nt, Homo sapiens
ucuuuucacaaau

SEQ ID NO: 931087 - RNA, 21 nt, Homo sapiens
ucuuuucuggaauguaaucaa

SEQ ID NO: 931088 - RNA, 14 nt, Homo sapiens
ucuuuuugaaauca

SEQ ID NO: 931089 - RNA, 13 nt, Homo sapiens
ugaaacccaguca

SEQ ID NO: 931090 - RNA, 21 nt, Homo sapiens
ugaauacaaagaaccaagaaa

SEQ ID NO: 931091 - RNA, 22 nt, Homo sapiens
ugaaugaaagucuugugacuag

SEQ ID NO: 931092 - RNA, 14 nt, Homo sapiens
ugacuagugcugaa

SEQ ID NO: 931093 - RNA, 23 nt, Homo sapiens
ugagacaggagaccuggcacugg

SEQ ID NO: 931094 - RNA, 16 nt, Homo sapiens
ugagcucccaggugca

SEQ ID NO: 931095 - RNA, 13 nt, Homo sapiens
ugaguuucucuca

SEQ ID NO: 931096 - RNA, 22 nt, Homo sapiens
ugauccaagcaagacugagggg

SEQ ID NO: 931097 - RNA, 20 nt, Homo sapiens
ugauuuuuuucauuuugcca

SEQ ID NO: 931098 - RNA, 14 nt, Homo sapiens
ugcacaagccaggg

SEQ ID NO: 931099 - RNA, 22 nt, Homo sapiens
ugcacauauggacucugcacau

SEQ ID NO: 931100 - RNA, 14 nt, Homo sapiens
ugcacuuauucuca

SEQ ID NO: 931101 - RNA, 17 nt, Homo sapiens
ugcagaaacaguucacc

SEQ ID NO: 931102 - RNA, 17 nt, Homo sapiens
ugcaggagagacaguga

SEQ ID NO: 931103 - RNA, 18 nt, Homo sapiens
ugcagggccgccagggag

SEQ ID NO: 931104 - RNA, 16 nt, Homo sapiens
ugccauauacucuuca

SEQ ID NO: 931105 - RNA, 18 nt, Homo sapiens
ugccugaagccaggccau

SEQ ID NO: 931106 - RNA, 15 nt, Homo sapiens
ugcuccccucugcac

SEQ ID NO: 931107 - RNA, 23 nt, Homo sapiens
uggaauaauccuaaacauaugaa

SEQ ID NO: 931108 - RNA, 15 nt, Homo sapiens
uggacucugcacaug

SEQ ID NO: 931109 - RNA, 19 nt, Homo sapiens
uggaugcagaaacaguuca

SEQ ID NO: 931110 - RNA, 22 nt, Homo sapiens
uggaugccaaccggucacccag

SEQ ID NO: 931111 - RNA, 17 nt, Homo sapiens
uggcacuggaugcagaa

SEQ ID NO: 931112 - RNA, 17 nt, Homo sapiens
uggcagcucagcuuccc

SEQ ID NO: 931113 - RNA, 19 nt, Homo sapiens
uggcaugauccaagcaaga

SEQ ID NO: 931114 - RNA, 19 nt, Homo sapiens
uggccacgcagccaggaca

SEQ ID NO: 931115 - RNA, 12 nt, Homo sapiens
uggcccagguga

SEQ ID NO: 931116 - RNA, 14 nt, Homo sapiens
uggccuaugcacau

SEQ ID NO: 931117 - RNA, 22 nt, Homo sapiens
uggccuaugcacauauggacuc

SEQ ID NO: 931118 - RNA, 13 nt, Homo sapiens
uggccuggcacac

SEQ ID NO: 931119 - RNA, 18 nt, Homo sapiens
uggccuggcacacaucag

SEQ ID NO: 931120 - RNA, 20 nt, Homo sapiens
uggcuccaacacugcugcuc

SEQ ID NO: 931121 - RNA, 23 nt, Homo sapiens
ugggaccucaguuuuaucauuuu

SEQ ID NO: 931122 - RNA, 19 nt, Homo sapiens
ugggagcccaguuucacug

SEQ ID NO: 931123 - RNA, 15 nt, Homo sapiens
ugggaggccagugag

SEQ ID NO: 931124 - RNA, 14 nt, Homo sapiens
ugggcccacaaagg

SEQ ID NO: 931125 - RNA, 14 nt, Homo sapiens
ugguaaaauacuuc

SEQ ID NO: 931126 - RNA, 13 nt, Homo sapiens
uguaccauguaca

SEQ ID NO: 931127 - RNA, 18 nt, Homo sapiens
uguauuaaagacagaggc

SEQ ID NO: 931128 - RNA, 18 nt, Homo sapiens
ugucaauucuugccaaau

SEQ ID NO: 931129 - RNA, 14 nt, Homo sapiens
ugucuuugccaagu

SEQ ID NO: 931130 - RNA, 13 nt, Homo sapiens
ugugacacauaug

SEQ ID NO: 931131 - RNA, 14 nt, Homo sapiens
ugugacacauaugc

SEQ ID NO: 931132 - RNA, 15 nt, Homo sapiens
ugugacacauaugca

SEQ ID NO: 931133 - RNA, 19 nt, Homo sapiens
uguggagugugugucuuuc

SEQ ID NO: 931134 - RNA, 13 nt, Homo sapiens
uguggcuucuuaa

SEQ ID NO: 931135 - RNA, 22 nt, Homo sapiens
uguguacauuagucauucaaua

SEQ ID NO: 931136 - RNA, 15 nt, Homo sapiens
uguguagccugugca

SEQ ID NO: 931137 - RNA, 13 nt, Homo sapiens
uguguugcaugca

SEQ ID NO: 931138 - RNA, 14 nt, Homo sapiens
uguuaucagucaua

SEQ ID NO: 931139 - RNA, 12 nt, Homo sapiens
uguuucuuuagc

SEQ ID NO: 931140 - RNA, 15 nt, Homo sapiens
uguuuggacuuuuau

SEQ ID NO: 931141 - RNA, 17 nt, Homo sapiens
uuaaggaaggcacuaaa

SEQ ID NO: 931142 - RNA, 13 nt, Homo sapiens
uuaauaaugugua

SEQ ID NO: 931143 - RNA, 15 nt, Homo sapiens
uuaaucuuuucacaa

SEQ ID NO: 931144 - RNA, 22 nt, Homo sapiens
uuagcaguuuugugauaaguuc

SEQ ID NO: 931145 - RNA, 18 nt, Homo sapiens
uuauuaaaggaacacaua

SEQ ID NO: 931146 - RNA, 14 nt, Homo sapiens
uucaugcaggugaa

SEQ ID NO: 931147 - RNA, 18 nt, Homo sapiens
uuccaaguauuuugccac

SEQ ID NO: 931148 - RNA, 16 nt, Homo sapiens
uuccuauaugcacuua

SEQ ID NO: 931149 - RNA, 17 nt, Homo sapiens
uuccuuucauuuacugu

SEQ ID NO: 931150 - RNA, 15 nt, Homo sapiens
uucgaggagugccgu

SEQ ID NO: 931151 - RNA, 15 nt, Homo sapiens
uucucaagaagaaca

SEQ ID NO: 931152 - RNA, 19 nt, Homo sapiens
uugaaaucagcauacucaa

SEQ ID NO: 931153 - RNA, 13 nt, Homo sapiens
uugaauacaaaga

SEQ ID NO: 931154 - RNA, 23 nt, Homo sapiens
uugccaaaaagggguaugucuuu

SEQ ID NO: 931155 - RNA, 23 nt, Homo sapiens
uugccacguucuggacugucuuc

SEQ ID NO: 931156 - RNA, 21 nt, Homo sapiens
uugccuuuccauaaucacuca

SEQ ID NO: 931157 - RNA, 17 nt, Homo sapiens
uugcguggacucugcac

SEQ ID NO: 931158 - RNA, 14 nt, Homo sapiens
uuggugcuuuccag

SEQ ID NO: 931159 - RNA, 15 nt, Homo sapiens
uugugacuagugcug

SEQ ID NO: 931160 - RNA, 17 nt, Homo sapiens
uuuaaguuuccuuccag

SEQ ID NO: 931161 - RNA, 13 nt, Homo sapiens
uuucacugccaua

SEQ ID NO: 931162 - RNA, 13 nt, Homo sapiens
uuucauuuugcca

SEQ ID NO: 931163 - RNA, 22 nt, Homo sapiens
uuucauuuugccaaaaaggggu

SEQ ID NO: 931164 - RNA, 21 nt, Homo sapiens
uuuccauaaucacucagugau

SEQ ID NO: 931165 - RNA, 21 nt, Homo sapiens
uuuccuguguacacgugacag

SEQ ID NO: 931166 - RNA, 15 nt, Homo sapiens
uuucuggcucuccca

SEQ ID NO: 931167 - RNA, 13 nt, Homo sapiens
uuucuuuccucag

SEQ ID NO: 931168 - RNA, 22 nt, Homo sapiens
uuugccuuuccauaaucacuca

SEQ ID NO: 931169 - RNA, 18 nt, Homo sapiens
uuuuaaguuuccuuccag

SEQ ID NO: 931170 - RNA, 17 nt, Homo sapiens
uuuuagaaucucuuucg

SEQ ID NO: 931171 - RNA, 13 nt, Homo sapiens
uuuucuccagggu

SEQ ID NO: 931172 - RNA, 21 nt, Homo sapiens
uuuuugaaaucagcauacuca

SEQ ID NO: 931173 - RNA, 21 nt, Homo sapiens
uuuuuucauuuugccaaaaag

SEQ ID NO: 931174 - RNA, 16 nt, Homo sapiens
cuaagcuucacuguaa

SEQ ID NO: 931175 - RNA, 23 nt, Homo sapiens
cuaagggcaggcccaaauuauca

SEQ ID NO: 931176 - RNA, 22 nt, Homo sapiens
cuaagucuuauauauuguagau

SEQ ID NO: 931177 - RNA, 17 nt, Homo sapiens
cuacacacauccacgca

SEQ ID NO: 931178 - RNA, 15 nt, Homo sapiens
cuagagcuacagggg

SEQ ID NO: 931179 - RNA, 19 nt, Homo sapiens
cuagccagaggacugugau

SEQ ID NO: 931180 - RNA, 18 nt, Homo sapiens
cuaggaagaucucugcag

SEQ ID NO: 931181 - RNA, 16 nt, Homo sapiens
cucaagaugaaggcaa

SEQ ID NO: 931182 - RNA, 18 nt, Homo sapiens
cucacuugugcaguguug

SEQ ID NO: 931183 - RNA, 16 nt, Homo sapiens
cuccauguacuggcaa

SEQ ID NO: 931184 - RNA, 19 nt, Homo sapiens
cuccucacucaccuucagu

SEQ ID NO: 931185 - RNA, 14 nt, Homo sapiens
cuccuuggugccug

SEQ ID NO: 931186 - RNA, 12 nt, Homo sapiens
cucugcacaugu

SEQ ID NO: 931187 - RNA, 15 nt, Homo sapiens
cucugcauucuagua

SEQ ID NO: 931188 - RNA, 16 nt, Homo sapiens
cugaagccucacuuau

SEQ ID NO: 931189 - RNA, 18 nt, Homo sapiens
cugcacaugucuuguaca

SEQ ID NO: 931190 - RNA, 17 nt, Homo sapiens
cugcacccacccaggag

SEQ ID NO: 931191 - RNA, 23 nt, Homo sapiens
cugcagucccauccucuugucag

SEQ ID NO: 931192 - RNA, 15 nt, Homo sapiens
cugcauacccgggca

SEQ ID NO: 931193 - RNA, 15 nt, Homo sapiens
cuggaaacauucagg

SEQ ID NO: 931194 - RNA, 19 nt, Homo sapiens
cuggaaacauucaggagcu

SEQ ID NO: 931195 - RNA, 20 nt, Homo sapiens
cuggaauguaaucaauguuu

SEQ ID NO: 931196 - RNA, 19 nt, Homo sapiens
cuggcagggacgaggacaa

SEQ ID NO: 931197 - RNA, 14 nt, Homo sapiens
cuggccacgcagcc

SEQ ID NO: 931198 - RNA, 17 nt, Homo sapiens
cugggccuggcagcuca

SEQ ID NO: 931199 - RNA, 23 nt, Homo sapiens
cuggugugugccucauugcuugg

SEQ ID NO: 931200 - RNA, 20 nt, Homo sapiens
cugugacuuaagaagccuua

SEQ ID NO: 931201 - RNA, 15 nt, Homo sapiens
cuguggcuucuuaau

SEQ ID NO: 931202 - RNA, 13 nt, Homo sapiens
cuuaaucuuuuca

SEQ ID NO: 931203 - RNA, 20 nt, Homo sapiens
cuuauaauuuaaaauaugcu

SEQ ID NO: 931204 - RNA, 19 nt, Homo sapiens
cuucuuaaucuuuucacaa

SEQ ID NO: 931205 - RNA, 21 nt, Homo sapiens
cuucuuaaucuuuucacaaau

SEQ ID NO: 931206 - RNA, 22 nt, Homo sapiens
cuugaagaaccucucacuucac

SEQ ID NO: 931207 - RNA, 15 nt, Homo sapiens
cuugagccaguaauu

SEQ ID NO: 931208 - RNA, 18 nt, Homo sapiens
cuugccaaauauaaauaa

SEQ ID NO: 931209 - RNA, 21 nt, Homo sapiens
cuuggccagcguggcgcagug

SEQ ID NO: 931210 - RNA, 18 nt, Homo sapiens
cuuguaaaauuucacuua

SEQ ID NO: 931211 - RNA, 18 nt, Homo sapiens
cuuguaauucuaaaugaa

SEQ ID NO: 931212 - RNA, 16 nt, Homo sapiens
cuugucucacuugugc

SEQ ID NO: 931213 - RNA, 16 nt, Homo sapiens
cuuuacauggaugcca

SEQ ID NO: 931214 - RNA, 18 nt, Homo sapiens
cuuuacuguuagucauuu

SEQ ID NO: 931215 - RNA, 19 nt, Homo sapiens
cuuuacuguuagucauuug

SEQ ID NO: 931216 - RNA, 22 nt, Homo sapiens
cuuuauauggccucaagaucaa

SEQ ID NO: 931217 - RNA, 16 nt, Homo sapiens
cuuuccucagaucauc

SEQ ID NO: 931218 - RNA, 19 nt, Homo sapiens
cuuuccucagaucauccag

SEQ ID NO: 931219 - RNA, 13 nt, Homo sapiens
cuuuuaaguugcu

SEQ ID NO: 931220 - RNA, 14 nt, Homo sapiens
cuuuucacaaauaa

SEQ ID NO: 931221 - RNA, 15 nt, Homo sapiens
cuuuucuuuccucag

SEQ ID NO: 931222 - RNA, 18 nt, Homo sapiens
gaaacaaaaggauaauga

SEQ ID NO: 931223 - RNA, 19 nt, Homo sapiens
gaaauaauuuuuagaaucu

SEQ ID NO: 931224 - RNA, 14 nt, Homo sapiens
gaaccccaggagau

SEQ ID NO: 931225 - RNA, 18 nt, Homo sapiens
gaaugcagucuguccagg

SEQ ID NO: 931226 - RNA, 17 nt, Homo sapiens
gaauguuuacacucuuu

SEQ ID NO: 931227 - RNA, 18 nt, Homo sapiens
gacaaggaaaaaauaaca

SEQ ID NO: 931228 - RNA, 15 nt, Homo sapiens
gacacauaugcaccu

SEQ ID NO: 931229 - RNA, 17 nt, Homo sapiens
gacacugggaggccagu

SEQ ID NO: 931230 - RNA, 22 nt, Homo sapiens
gaccuccaagccacugagcaau

SEQ ID NO: 931231 - RNA, 23 nt, Homo sapiens
gacgggcaaaauaaagugacaga

SEQ ID NO: 931232 - RNA, 10 nt, Homo sapiens
gacucugcac

SEQ ID NO: 931233 - RNA, 14 nt, Homo sapiens
gacucugcacaugu

SEQ ID NO: 931234 - RNA, 15 nt, Homo sapiens
gacucugcacauguc

SEQ ID NO: 931235 - RNA, 22 nt, Homo sapiens
gacuuucugaagccucacuuau

SEQ ID NO: 931236 - RNA, 13 nt, Homo sapiens
gagcccaguuuca

SEQ ID NO: 931237 - RNA, 17 nt, Homo sapiens
gaggcaccucaagaaga

SEQ ID NO: 931238 - RNA, 20 nt, Homo sapiens
gagucgcaucucagugcagg

SEQ ID NO: 931239 - RNA, 15 nt, Homo sapiens
gagugugugucuuuc

SEQ ID NO: 931240 - RNA, 22 nt, Homo sapiens
gaguucuugugccauagucaca

SEQ ID NO: 931241 - RNA, 16 nt, Homo sapiens
gauaaaagacagugaa

SEQ ID NO: 931242 - RNA, 15 nt, Homo sapiens
gauugcaauuugcac

SEQ ID NO: 931243 - RNA, 20 nt, Homo sapiens
gauuuuuuucauuuugccaa

SEQ ID NO: 931244 - RNA, 12 nt, Homo sapiens
gcaacaguuuuu

SEQ ID NO: 931245 - RNA, 23 nt, Homo sapiens
gcaaucaaguccuacaagcuaaa

SEQ ID NO: 931246 - RNA, 19 nt, Homo sapiens
gcacaugcgaccccgagga

SEQ ID NO: 931247 - RNA, 20 nt, Homo sapiens
gcacaugucuuguacaugug

SEQ ID NO: 931248 - RNA, 19 nt, Homo sapiens
gcacccaagaccucagggc

SEQ ID NO: 931249 - RNA, 13 nt, Homo sapiens
gcagccaggacac

SEQ ID NO: 931250 - RNA, 17 nt, Homo sapiens
gcagccaggacaccggg

SEQ ID NO: 931251 - RNA, 21 nt, Homo sapiens
gcaguuuugugauaaguucua

SEQ ID NO: 931252 - RNA, 15 nt, Homo sapiens
gcaucucagugcagg

SEQ ID NO: 931253 - RNA, 15 nt, Homo sapiens
gccagaggcaccuca

SEQ ID NO: 931254 - RNA, 20 nt, Homo sapiens
gcccucaccacccacuugau

SEQ ID NO: 931255 - RNA, 13 nt, Homo sapiens
gccgccagggaga

SEQ ID NO: 931256 - RNA, 16 nt, Homo sapiens
gccuaugcacauaugg

SEQ ID NO: 931257 - RNA, 23 nt, Homo sapiens
gccucacuuaugagaugccugaa

SEQ ID NO: 931258 - RNA, 14 nt, Homo sapiens
gccucauugcuugg

SEQ ID NO: 931259 - RNA, 22 nt, Homo sapiens
gccugacuuggggagauggagu

SEQ ID NO: 931260 - RNA, 16 nt, Homo sapiens
gcguggacucugcaca

SEQ ID NO: 931261 - RNA, 20 nt, Homo sapiens
gcuaaaauuagaugaacuca

SEQ ID NO: 931262 - RNA, 14 nt, Homo sapiens
gcuccacuaggacu

SEQ ID NO: 931263 - RNA, 13 nt, Homo sapiens
gcuccagugcagg

SEQ ID NO: 931264 - RNA, 15 nt, Homo sapiens
gcuccucacucaccu

SEQ ID NO: 931265 - RNA, 18 nt, Homo sapiens
gcuucuuaaucuuuucac

SEQ ID NO: 931266 - RNA, 13 nt, Homo sapiens
gcuuuaccuuuau

SEQ ID NO: 931267 - RNA, 22 nt, Homo sapiens
ggaauaauccuaaacauaugaa

SEQ ID NO: 931268 - RNA, 11 nt, Homo sapiens
ggacacuguac

SEQ ID NO: 931269 - RNA, 18 nt, Homo sapiens
ggaccaugcgacacuggg

SEQ ID NO: 931270 - RNA, 17 nt, Homo sapiens
ggacuuuuauuuuggca

SEQ ID NO: 931271 - RNA, 13 nt, Homo sapiens
ggagcuccaacuc

SEQ ID NO: 931272 - RNA, 18 nt, Homo sapiens
ggaguguggccacguggg

SEQ ID NO: 931273 - RNA, 11 nt, Homo sapiens
ggcacccaaga

SEQ ID NO: 931274 - RNA, 17 nt, Homo sapiens
ggcaugauccaagcaag

SEQ ID NO: 931275 - RNA, 15 nt, Homo sapiens
ggccacgcagccagg

SEQ ID NO: 931276 - RNA, 16 nt, Homo sapiens
ggccagugagccacuc

SEQ ID NO: 931277 - RNA, 22 nt, Homo sapiens
ggccaucugguuaggauggcag

SEQ ID NO: 931278 - RNA, 18 nt, Homo sapiens
ggcucccggggcagggca

SEQ ID NO: 931279 - RNA, 17 nt, Homo sapiens
ggcugcacccacccagg

SEQ ID NO: 931280 - RNA, 22 nt, Homo sapiens
ggcuucuuaaucuuuucacaaa

SEQ ID NO: 931281 - RNA, 14 nt, Homo sapiens
ggcuuuaccuuuau

SEQ ID NO: 931282 - RNA, 14 nt, Homo sapiens
gggcuccugaggga

SEQ ID NO: 931283 - RNA, 15 nt, Homo sapiens
ggggguuggauuuga

SEQ ID NO: 931284 - RNA, 19 nt, Homo sapiens
gguaaaagcaucacaugaa

SEQ ID NO: 931285 - RNA, 12 nt, Homo sapiens
ggucacccagga

SEQ ID NO: 931286 - RNA, 22 nt, Homo sapiens
ggugaaacccagucacugugag

SEQ ID NO: 931287 - RNA, 12 nt, Homo sapiens
ggugcuuuccag

SEQ ID NO: 931288 - RNA, 21 nt, Homo sapiens
gguucauuagcgauccaugua

SEQ ID NO: 931289 - RNA, 23 nt, Homo sapiens
guaauucuaaaugaauguuuaca

SEQ ID NO: 931290 - RNA, 18 nt, Homo sapiens
guacauuagucauucaau

SEQ ID NO: 931291 - RNA, 16 nt, Homo sapiens
guaggacccaagcaga

SEQ ID NO: 931292 - RNA, 18 nt, Homo sapiens
guaugucuuuaucaaagg

SEQ ID NO: 931293 - RNA, 13 nt, Homo sapiens
guauuaaagacag

SEQ ID NO: 931294 - RNA, 11 nt, Homo sapiens
guauuuugcca

SEQ ID NO: 931295 - RNA, 23 nt, Homo sapiens
gucacauggccuaugcacauaug

SEQ ID NO: 931296 - RNA, 18 nt, Homo sapiens
gucucucauucuaggccu

SEQ ID NO: 931297 - RNA, 16 nt, Homo sapiens
gucuugugacuagugc

SEQ ID NO: 931298 - RNA, 13 nt, Homo sapiens
gugacacauaugc

SEQ ID NO: 931299 - RNA, 22 nt, Homo sapiens
gugaucagaccauaauguuaca

SEQ ID NO: 931300 - RNA, 22 nt, Homo sapiens
guggcuucuuaaucuuuucaca

SEQ ID NO: 931301 - RNA, 21 nt, Homo sapiens
guguuaucagucauaacuaaa

SEQ ID NO: 931302 - RNA, 14 nt, Homo sapiens
guuaaucauuucau

SEQ ID NO: 931303 - RNA, 20 nt, Homo sapiens
guugcguggacucugcacau

SEQ ID NO: 931304 - RNA, 16 nt, Homo sapiens
guuuccuuucauuuac

SEQ ID NO: 931305 - RNA, 22 nt, Homo sapiens
guuucucucacauuacuguaua

SEQ ID NO: 931306 - RNA, 20 nt, Homo sapiens
guuuggacuuuuauuuuggc

SEQ ID NO: 931307 - RNA, 18 nt, Homo sapiens
guuuggggacaugugauu

SEQ ID NO: 931308 - RNA, 17 nt, Homo sapiens
guuuuccaaugugacua

SEQ ID NO: 931309 - RNA, 17 nt, Homo sapiens
guuuuucuuuucauuua

SEQ ID NO: 931310 - RNA, 16 nt, Homo sapiens
uaaaagcaucacauga

SEQ ID NO: 931311 - RNA, 17 nt, Homo sapiens
uaaaagcaucacaugaa

SEQ ID NO: 931312 - RNA, 12 nt, Homo sapiens
uaaaauaucauu

SEQ ID NO: 931313 - RNA, 19 nt, Homo sapiens
uaaacauuucuuucaauaa

SEQ ID NO: 931314 - RNA, 21 nt, Homo sapiens
uaaacuuaccugggcauucuu

SEQ ID NO: 931315 - RNA, 14 nt, Homo sapiens
uaaauguacauuaa

SEQ ID NO: 931316 - RNA, 20 nt, Homo sapiens
uaaccguuuccuuucauuua

SEQ ID NO: 931317 - RNA, 15 nt, Homo sapiens
uaacgauaaaagaca

SEQ ID NO: 931318 - RNA, 24 nt, Homo sapiens
uaagaguggaaccaacacuaacau

SEQ ID NO: 931319 - RNA, 15 nt, Homo sapiens
uaaguuugauuucau

SEQ ID NO: 931320 - RNA, 19 nt, Homo sapiens
uaauaauguguacauuagu

SEQ ID NO: 931321 - RNA, 15 nt, Homo sapiens
uaauacagggcauuu

SEQ ID NO: 931322 - RNA, 17 nt, Homo sapiens
uaaucacucagugauug

SEQ ID NO: 931323 - RNA, 16 nt, Homo sapiens
uuaaauagucuagacu

SEQ ID NO: 931324 - RNA, 20 nt, Homo sapiens
uuaauacagggcauuuuggu

SEQ ID NO: 931325 - RNA, 17 nt, Homo sapiens
uuaaucuuuucacaaau

SEQ ID NO: 931326 - RNA, 22 nt, Homo sapiens
uuaccugggcauucuuguuuca

SEQ ID NO: 931327 - RNA, 11 nt, Homo sapiens
uuacuuuccau

SEQ ID NO: 931328 - RNA, 19 nt, Homo sapiens
uuauuaggaaguaugguuu

SEQ ID NO: 931329 - RNA, 14 nt, Homo sapiens
uucauuuacugugg

SEQ ID NO: 931330 - RNA, 12 nt, Homo sapiens
uucauuuugcca

SEQ ID NO: 931331 - RNA, 14 nt, Homo sapiens
uuccccaccaguga

SEQ ID NO: 931332 - RNA, 20 nt, Homo sapiens
uuccuggcuccaacacugcu

SEQ ID NO: 931333 - RNA, 19 nt, Homo sapiens
uuccuuucauuuacugugg

SEQ ID NO: 931334 - RNA, 16 nt, Homo sapiens
uucuaguugcuuguaa

SEQ ID NO: 931335 - RNA, 12 nt, Homo sapiens
uucugagcauuu

SEQ ID NO: 931336 - RNA, 16 nt, Homo sapiens
uucuggaaacauucag

SEQ ID NO: 931337 - RNA, 14 nt, Homo sapiens
uucuggaauguaau

SEQ ID NO: 931338 - RNA, 19 nt, Homo sapiens
uucugggcacccucccacc

SEQ ID NO: 931339 - RNA, 21 nt, Homo sapiens
uucuuaaucuuuucacaaaua

SEQ ID NO: 931340 - RNA, 19 nt, Homo sapiens
uugaaugcagucuguccag

SEQ ID NO: 931341 - RNA, 19 nt, Homo sapiens
uugacaguucauauguacc

SEQ ID NO: 931342 - RNA, 19 nt, Homo sapiens
uugagguggacucucacca

SEQ ID NO: 931343 - RNA, 16 nt, Homo sapiens
uugaugcuacaggauu

SEQ ID NO: 931344 - RNA, 15 nt, Homo sapiens
uugccaaguucucca

SEQ ID NO: 931345 - RNA, 20 nt, Homo sapiens
uugcuacagggcucacagaa

SEQ ID NO: 931346 - RNA, 21 nt, Homo sapiens
uugcuuguaaaauuucacuua

SEQ ID NO: 931347 - RNA, 13 nt, Homo sapiens
uuggcacccaaga

SEQ ID NO: 931348 - RNA, 20 nt, Homo sapiens
uuggcaggcuuuuuuccaga

SEQ ID NO: 931349 - RNA, 16 nt, Homo sapiens
uuggggacaugugauu

SEQ ID NO: 931350 - RNA, 18 nt, Homo sapiens
uugucucgaagucucuuu

SEQ ID NO: 931351 - RNA, 18 nt, Homo sapiens
uuuaaauauaugcuaagu

SEQ ID NO: 931352 - RNA, 14 nt, Homo sapiens
uuuaucaaaggaga

SEQ ID NO: 931353 - RNA, 17 nt, Homo sapiens
uuuccccaccagugaau

SEQ ID NO: 931354 - RNA, 14 nt, Homo sapiens
uuugacaaccauga

SEQ ID NO: 931355 - RNA, 19 nt, Homo sapiens
uuuggcaggcuuuuuucca

SEQ ID NO: 931356 - RNA, 20 nt, Homo sapiens
uuuggcaggcuuuuuuccag

SEQ ID NO: 931357 - RNA, 17 nt, Homo sapiens
uuuggggacaugugauu

SEQ ID NO: 931358 - RNA, 15 nt, Homo sapiens
uuuggugcuuuccag

SEQ ID NO: 931359 - RNA, 13 nt, Homo sapiens
cauuggaggugaa

SEQ ID NO: 931360 - RNA, 13 nt, Homo sapiens
cauuuacuguggc

SEQ ID NO: 931361 - RNA, 19 nt, Homo sapiens
cauuuacuguggcuucuua

SEQ ID NO: 931362 - RNA, 20 nt, Homo sapiens
cauuuacuguggcuucuuaa

SEQ ID NO: 931363 - RNA, 18 nt, Homo sapiens
cauuuuaugauaaauaau

SEQ ID NO: 931364 - RNA, 12 nt, Homo sapiens
ccaaauuaucaa

SEQ ID NO: 931365 - RNA, 17 nt, Homo sapiens
ccaaccggucacccagg

SEQ ID NO: 931366 - RNA, 15 nt, Homo sapiens
ccaagcaagacugag

SEQ ID NO: 931367 - RNA, 14 nt, Homo sapiens
ccaaucauuuuaau

SEQ ID NO: 931368 - RNA, 12 nt, Homo sapiens
ccaaugaaauga

SEQ ID NO: 931369 - RNA, 21 nt, Homo sapiens
ccacaauagcagacaguguuu

SEQ ID NO: 931370 - RNA, 19 nt, Homo sapiens
ccacaugugacacauaugc

SEQ ID NO: 931371 - RNA, 11 nt, Homo sapiens
ccaccagugaa

SEQ ID NO: 931372 - RNA, 19 nt, Homo sapiens
ccacgugggcaaacaggca

SEQ ID NO: 931373 - RNA, 21 nt, Homo sapiens
ccacgugggcaaacaggcagu

SEQ ID NO: 931374 - RNA, 20 nt, Homo sapiens
ccagagagccuggugcugcu

SEQ ID NO: 931375 - RNA, 18 nt, Homo sapiens
ccagaggcaccucaagaa

SEQ ID NO: 931376 - RNA, 13 nt, Homo sapiens
ccagcguggcgca

SEQ ID NO: 931377 - RNA, 18 nt, Homo sapiens
ccagcuccucacucaccu

SEQ ID NO: 931378 - RNA, 20 nt, Homo sapiens
ccagucacugugagcuccca

SEQ ID NO: 931379 - RNA, 14 nt, Homo sapiens
ccauaauguuacau

SEQ ID NO: 931380 - RNA, 15 nt, Homo sapiens
ccauagucacauggc

SEQ ID NO: 931381 - RNA, 16 nt, Homo sapiens
ccauagucacauggcc

SEQ ID NO: 931382 - RNA, 19 nt, Homo sapiens
ccaucagcuaaacaccacg

SEQ ID NO: 931383 - RNA, 19 nt, Homo sapiens
ccauguaaucugacgucau

SEQ ID NO: 931384 - RNA, 16 nt, Homo sapiens
ccauuuuuagugaaau

SEQ ID NO: 931385 - RNA, 23 nt, Homo sapiens
cccacaugugacacauaugcacc

SEQ ID NO: 931386 - RNA, 16 nt, Homo sapiens
cccaggugaguccuag

SEQ ID NO: 931387 - RNA, 15 nt, Homo sapiens
cccagucacugugag

SEQ ID NO: 931388 - RNA, 17 nt, Homo sapiens
ccccacuggacugaccu

SEQ ID NO: 931389 - RNA, 20 nt, Homo sapiens
cccuacaaaaccacuggaaa

SEQ ID NO: 931390 - RNA, 15 nt, Homo sapiens
ccuaaacauaugaau

SEQ ID NO: 931391 - RNA, 15 nt, Homo sapiens
ccuauaugcacuuau

SEQ ID NO: 931392 - RNA, 16 nt, Homo sapiens
ccuaugcacauaugga

SEQ ID NO: 931393 - RNA, 16 nt, Homo sapiens
ccucagggcacaaaga

SEQ ID NO: 931394 - RNA, 17 nt, Homo sapiens
ccucaguuuuaucauuu

SEQ ID NO: 931395 - RNA, 15 nt, Homo sapiens
ccuccuuggugccug

SEQ ID NO: 931396 - RNA, 16 nt, Homo sapiens
ccugauuaacugaggc

SEQ ID NO: 931397 - RNA, 21 nt, Homo sapiens
ccugcaccccugcaguuugag

SEQ ID NO: 931398 - RNA, 22 nt, Homo sapiens
ccuggcagccacaacugcaguc

SEQ ID NO: 931399 - RNA, 18 nt, Homo sapiens
ccuggccuggcacacauc

SEQ ID NO: 931400 - RNA, 12 nt, Homo sapiens
ccugugccucca

SEQ ID NO: 931401 - RNA, 17 nt, Homo sapiens
ccuuucauuuacugugg

SEQ ID NO: 931402 - RNA, 23 nt, Homo sapiens
ccuuuuuaaggaaggcacuaaaa

SEQ ID NO: 931403 - RNA, 23 nt, Homo sapiens
ccuuuuuuugaaaaaaagcuuuu

SEQ ID NO: 931404 - RNA, 21 nt, Homo sapiens
cgaggagugccguguguugca

SEQ ID NO: 931405 - RNA, 22 nt, Homo sapiens
cgcaauuucacgacacacuuug

SEQ ID NO: 931406 - RNA, 15 nt, Homo sapiens
cgcaucucagugcag

SEQ ID NO: 931407 - RNA, 18 nt, Homo sapiens
cggaccaugcgacacugg

SEQ ID NO: 931408 - RNA, 17 nt, Homo sapiens
cguggacucugcacaug

SEQ ID NO: 931409 - RNA, 21 nt, Homo sapiens
cgugggcugggcccacaaagg

SEQ ID NO: 931410 - RNA, 14 nt, Homo sapiens
cuaaaagauugaga

SEQ ID NO: 931411 - RNA, 22 nt, Homo sapiens
cuaaagcagccagccgugagug

SEQ ID NO: 931412 - RNA, 18 nt, Homo sapiens
cuaaaugaauguuuacac

SEQ ID NO: 931413 - RNA, 19 nt, Homo sapiens
cuaagaaauaugcacaaua

SEQ ID NO: 931414 - RNA, 19 nt, Homo sapiens
cuacacgagauacagaauu

SEQ ID NO: 931415 - RNA, 18 nt, Homo sapiens
cuacaggauuugaaauug

SEQ ID NO: 931416 - RNA, 16 nt, Homo sapiens
cuagagcuacaggggu

SEQ ID NO: 931417 - RNA, 15 nt, Homo sapiens
cuagugcugaagcuu

SEQ ID NO: 931418 - RNA, 12 nt, Homo sapiens
cuaguugcuugu

SEQ ID NO: 931419 - RNA, 18 nt, Homo sapiens
cucaccaaaugagaagaa

SEQ ID NO: 931420 - RNA, 14 nt, Homo sapiens
cucacucaccuuca

SEQ ID NO: 931421 - RNA, 15 nt, Homo sapiens
cucagggcacaaaga

SEQ ID NO: 931422 - RNA, 12 nt, Homo sapiens
cucauugcuugg

SEQ ID NO: 931423 - RNA, 14 nt, Homo sapiens
cucugcacaugucu

SEQ ID NO: 931424 - RNA, 18 nt, Homo sapiens
cucugcacaugucuugua

SEQ ID NO: 931425 - RNA, 20 nt, Homo sapiens
cucugcacaugucuuguaca

SEQ ID NO: 931426 - RNA, 13 nt, Homo sapiens
cucugccacugac

SEQ ID NO: 931427 - RNA, 14 nt, Homo sapiens
cucuucaaggacuu

SEQ ID NO: 931428 - RNA, 17 nt, Homo sapiens
cucuuuuucuccagggu

SEQ ID NO: 931429 - RNA, 21 nt, Homo sapiens
cugaagcuuauuaaugcuaag

SEQ ID NO: 931430 - RNA, 14 nt, Homo sapiens
cugaggcauccacu

SEQ ID NO: 931431 - RNA, 17 nt, Homo sapiens
cugcacaugucuuguac

SEQ ID NO: 931432 - RNA, 19 nt, Homo sapiens
cugcacaugucuuguacau

SEQ ID NO: 931433 - RNA, 17 nt, Homo sapiens
cugcccuuggcacccaa

SEQ ID NO: 931434 - RNA, 16 nt, Homo sapiens
cugcuccagugcagga

SEQ ID NO: 931435 - RNA, 16 nt, Homo sapiens
cugcuccccucugcac

SEQ ID NO: 931436 - RNA, 22 nt, Homo sapiens
cugcugagagacagagcuauuc

SEQ ID NO: 931437 - RNA, 16 nt, Homo sapiens
cugcugcuccagugca

SEQ ID NO: 931438 - RNA, 21 nt, Homo sapiens
cugcuguggcgugagggugag

SEQ ID NO: 931439 - RNA, 20 nt, Homo sapiens
cuggagcccauccagucucc

SEQ ID NO: 931440 - RNA, 22 nt, Homo sapiens
cugguccacagggcaccugcca

SEQ ID NO: 931441 - RNA, 18 nt, Homo sapiens
cugugacuuaagaagccu

SEQ ID NO: 931442 - RNA, 20 nt, Homo sapiens
cugugagcucccaggugcag

SEQ ID NO: 931443 - RNA, 23 nt, Homo sapiens
cuguggcuucuuaaucuuuucac

SEQ ID NO: 931444 - RNA, 18 nt, Homo sapiens
cuguguacacgugacaga

SEQ ID NO: 931445 - RNA, 14 nt, Homo sapiens
cuuaaucuuuucac

SEQ ID NO: 931446 - RNA, 17 nt, Homo sapiens
cuucacccuggagccca

SEQ ID NO: 931447 - RNA, 14 nt, Homo sapiens
cuucaugcagguga

SEQ ID NO: 931448 - RNA, 16 nt, Homo sapiens
cuucuuaaucuuuuca

SEQ ID NO: 931449 - RNA, 21 nt, Homo sapiens
cuugaccccgacgccacagcc

SEQ ID NO: 931450 - RNA, 20 nt, Homo sapiens
cuugagccaguaauuggucc

SEQ ID NO: 931451 - RNA, 21 nt, Homo sapiens
cuugauuuuuuucauuuugcc

SEQ ID NO: 931452 - RNA, 11 nt, Homo sapiens
cuugugacuag

SEQ ID NO: 931453 - RNA, 16 nt, Homo sapiens
cuuucuugaauugcau

SEQ ID NO: 931454 - RNA, 23 nt, Homo sapiens
cuuugccuuuccauaaucacuca

SEQ ID NO: 931455 - RNA, 13 nt, Homo sapiens
cuuuucacaaaua

SEQ ID NO: 931456 - RNA, 15 nt, Homo sapiens
gaacacauaccuuug

SEQ ID NO: 931457 - RNA, 12 nt, Homo sapiens
gaagaagcuaaa

SEQ ID NO: 931458 - RNA, 11 nt, Homo sapiens
gaagcugugcg

SEQ ID NO: 931459 - RNA, 15 nt, Homo sapiens
gaaggagacaggcag

SEQ ID NO: 931460 - RNA, 11 nt, Homo sapiens
gaagucucuuu

SEQ ID NO: 931461 - RNA, 17 nt, Homo sapiens
gaaguuacuuuccauug

SEQ ID NO: 931462 - RNA, 12 nt, Homo sapiens
gaaguuccucaa

SEQ ID NO: 931463 - RNA, 13 nt, Homo sapiens
gacacauaugcac

SEQ ID NO: 931464 - RNA, 19 nt, Homo sapiens
gacacauaugcaccuugug

SEQ ID NO: 931465 - RNA, 15 nt, Homo sapiens
gacgcggcucccggg

SEQ ID NO: 931466 - RNA, 20 nt, Homo sapiens
gacucugcacaugucuugua

SEQ ID NO: 931467 - RNA, 13 nt, Homo sapiens
gacugcagggaca

SEQ ID NO: 931468 - RNA, 22 nt, Homo sapiens
gagaagaaaauggaaccaggcu

SEQ ID NO: 931469 - RNA, 14 nt, Homo sapiens
gagacagugaggcu

SEQ ID NO: 931470 - RNA, 13 nt, Homo sapiens
gagauggaguucu

SEQ ID NO: 931471 - RNA, 21 nt, Homo sapiens
gagccgggccgcagacuugac

SEQ ID NO: 931472 - RNA, 21 nt, Homo sapiens
gagggugaggggcuggcacug

SEQ ID NO: 931473 - RNA, 12 nt, Homo sapiens
gauaaaagacag

SEQ ID NO: 931474 - RNA, 18 nt, Homo sapiens
gauaaaagacagugaaag

SEQ ID NO: 931475 - RNA, 20 nt, Homo sapiens
gauaaguaaguuugauuuca

SEQ ID NO: 931476 - RNA, 22 nt, Homo sapiens
gauaauuuagacauugaguuca

SEQ ID NO: 931477 - RNA, 15 nt, Homo sapiens
gaucuuugacucuuu

SEQ ID NO: 931478 - RNA, 21 nt, Homo sapiens
gauuaaugucaauucuugcca

SEQ ID NO: 931479 - RNA, 19 nt, Homo sapiens
gauugauagaguguuauca

SEQ ID NO: 931480 - RNA, 23 nt, Homo sapiens
gauuguaaauaaaggaugauggc

SEQ ID NO: 931481 - RNA, 15 nt, Homo sapiens
gauuucaugauuuca

SEQ ID NO: 931482 - RNA, 13 nt, Homo sapiens
gcaaacaggcagu

SEQ ID NO: 931483 - RNA, 18 nt, Homo sapiens
gcagccagaggcaccuca

SEQ ID NO: 931484 - RNA, 21 nt, Homo sapiens
gcagccagaggcaccucaaga

SEQ ID NO: 931485 - RNA, 21 nt, Homo sapiens
gcagccuggcucccaggacac

SEQ ID NO: 931486 - RNA, 16 nt, Homo sapiens
gcaggugaaacccagu

SEQ ID NO: 931487 - RNA, 16 nt, Homo sapiens
gcagucuguccaggcu

SEQ ID NO: 931488 - RNA, 19 nt, Homo sapiens
gcauaagaaaacuaagaaa

SEQ ID NO: 931489 - RNA, 17 nt, Homo sapiens
gccaaccggucacccag

SEQ ID NO: 931490 - RNA, 21 nt, Homo sapiens
gccacagaccuaggauuucau

SEQ ID NO: 931491 - RNA, 14 nt, Homo sapiens
gccacgugggcaaa

SEQ ID NO: 931492 - RNA, 13 nt, Homo sapiens
gccagaggcaccu

SEQ ID NO: 931493 - RNA, 24 nt, Homo sapiens
gccagcaccugcgggagcugcacu

SEQ ID NO: 931494 - RNA, 18 nt, Homo sapiens
gccagccgugagugcaga

SEQ ID NO: 931495 - RNA, 18 nt, Homo sapiens
gcccaguuucacugccau

SEQ ID NO: 931496 - RNA, 20 nt, Homo sapiens
gcccaguuucacugccauau

SEQ ID NO: 931497 - RNA, 14 nt, Homo sapiens
gcccauccagucuc

SEQ ID NO: 931498 - RNA, 19 nt, Homo sapiens
gccuaugcacauauggacu

SEQ ID NO: 931499 - RNA, 18 nt, Homo sapiens
gccuccaucagcuaaaca

SEQ ID NO: 931500 - RNA, 13 nt, Homo sapiens
gccugugcaugua

SEQ ID NO: 931501 - RNA, 20 nt, Homo sapiens
gccugugcauguaugucuug

SEQ ID NO: 931502 - RNA, 20 nt, Homo sapiens
gcguggacucugcacauguc

SEQ ID NO: 931503 - RNA, 14 nt, Homo sapiens
gcuacaaaugcauu

SEQ ID NO: 931504 - RNA, 15 nt, Homo sapiens
ugcacuuauucucaa

SEQ ID NO: 931505 - RNA, 17 nt, Homo sapiens
ugcacuuauucucaaga

SEQ ID NO: 931506 - RNA, 14 nt, Homo sapiens
ugcauacccgggca

SEQ ID NO: 931507 - RNA, 21 nt, Homo sapiens
ugccaaccggucacccaggag

SEQ ID NO: 931508 - RNA, 20 nt, Homo sapiens
ugccacguucuggacugucu

SEQ ID NO: 931509 - RNA, 15 nt, Homo sapiens
ugcgaaagacccaca

SEQ ID NO: 931510 - RNA, 14 nt, Homo sapiens
ugcuccagugcagg

SEQ ID NO: 931511 - RNA, 15 nt, Homo sapiens
ugcugagcauguacu

SEQ ID NO: 931512 - RNA, 16 nt, Homo sapiens
ugcugcuccagugcag

SEQ ID NO: 931513 - RNA, 17 nt, Homo sapiens
uggaguucuugugccau

SEQ ID NO: 931514 - RNA, 17 nt, Homo sapiens
uggaugccaaccgguca

SEQ ID NO: 931515 - RNA, 15 nt, Homo sapiens
uggcaugauccaagc

SEQ ID NO: 931516 - RNA, 12 nt, Homo sapiens
uggccacgcagc

SEQ ID NO: 931517 - RNA, 18 nt, Homo sapiens
uggccuaugcacauaugg

SEQ ID NO: 931518 - RNA, 15 nt, Homo sapiens
uggcuccaacacugc

SEQ ID NO: 931519 - RNA, 20 nt, Homo sapiens
uggcuucuuaaucuuuucac

SEQ ID NO: 931520 - RNA, 17 nt, Homo sapiens
ugggaagcaggagccca

SEQ ID NO: 931521 - RNA, 21 nt, Homo sapiens
ugguccacagggcaccugcca

SEQ ID NO: 931522 - RNA, 20 nt, Homo sapiens
ugguccaugggccauaugaa

SEQ ID NO: 931523 - RNA, 15 nt, Homo sapiens
ugguuauaauguguu

SEQ ID NO: 931524 - RNA, 12 nt, Homo sapiens
uguaaacauuuc

SEQ ID NO: 931525 - RNA, 22 nt, Homo sapiens
ugucauaagcgaucacuuccua

SEQ ID NO: 931526 - RNA, 21 nt, Homo sapiens
ugugcaguguugacaguucau

SEQ ID NO: 931527 - RNA, 16 nt, Homo sapiens
ugugucuguacacgug

SEQ ID NO: 931528 - RNA, 14 nt, Homo sapiens
uguguuuuuaauua

SEQ ID NO: 931529 - RNA, 15 nt, Homo sapiens
uguuugaaagcuuua

SEQ ID NO: 931530 - RNA, 14 nt, Homo sapiens
uuaaauuaugggaa

SEQ ID NO: 931531 - RNA, 16 nt, Homo sapiens
uuaaguuuccuuccag

SEQ ID NO: 931532 - RNA, 14 nt, Homo sapiens
uuaaucuuuucaca

SEQ ID NO: 931533 - RNA, 22 nt, Homo sapiens
uuagucauucaauaaauuguaa

SEQ ID NO: 931534 - RNA, 14 nt, Homo sapiens
uuaucagucauaac

SEQ ID NO: 931535 - RNA, 20 nt, Homo sapiens
uuaugagaugccugaagcca

SEQ ID NO: 931536 - RNA, 12 nt, Homo sapiens
uuauucucaaga

SEQ ID NO: 931537 - RNA, 15 nt, Homo sapiens
uucaauaaauuguaa

SEQ ID NO: 931538 - RNA, 13 nt, Homo sapiens
uucaugcagguga

SEQ ID NO: 931539 - RNA, 15 nt, Homo sapiens
uucauuuacuguggc

SEQ ID NO: 931540 - RNA, 13 nt, Homo sapiens
uucauuuugccaa

SEQ ID NO: 931541 - RNA, 17 nt, Homo sapiens
uuccaaguauuuugcca

SEQ ID NO: 931542 - RNA, 22 nt, Homo sapiens
uuccaaugugacuaaugaccac

SEQ ID NO: 931543 - RNA, 23 nt, Homo sapiens
uuccuauaugcacuuauucucaa

SEQ ID NO: 931544 - RNA, 13 nt, Homo sapiens
uuccucagaucau

SEQ ID NO: 931545 - RNA, 16 nt, Homo sapiens
uuccugagaccacaga

SEQ ID NO: 931546 - RNA, 13 nt, Homo sapiens
uuccuuucauuua

SEQ ID NO: 931547 - RNA, 23 nt, Homo sapiens
uucuaaaugaauguuuacacucu

SEQ ID NO: 931548 - RNA, 17 nt, Homo sapiens
uucugaagccucacuua

SEQ ID NO: 931549 - RNA, 17 nt, Homo sapiens
uucuuaaucuuuucaca

SEQ ID NO: 931550 - RNA, 18 nt, Homo sapiens
uugagaaguuacuuucca

SEQ ID NO: 931551 - RNA, 21 nt, Homo sapiens
uugauaauuuagacauugagu

SEQ ID NO: 931552 - RNA, 20 nt, Homo sapiens
uugcauaguaccaaucauuu

SEQ ID NO: 931553 - RNA, 17 nt, Homo sapiens
uuggugcuuuccagaau

SEQ ID NO: 931554 - RNA, 19 nt, Homo sapiens
uugguuugaguuucucuca

SEQ ID NO: 931555 - RNA, 19 nt, Homo sapiens
uuguaaacauuucuuucaa

SEQ ID NO: 931556 - RNA, 20 nt, Homo sapiens
uuguaagaguggaaccaaca

SEQ ID NO: 931557 - RNA, 21 nt, Homo sapiens
uuguacauagugaggagcuuu

SEQ ID NO: 931558 - RNA, 15 nt, Homo sapiens
uugugucuguacacg

SEQ ID NO: 931559 - RNA, 15 nt, Homo sapiens
uuuaaaauaugcucu

SEQ ID NO: 931560 - RNA, 17 nt, Homo sapiens
uuucauuuacuguggcu

SEQ ID NO: 931561 - RNA, 14 nt, Homo sapiens
uuucauuuugccaa

SEQ ID NO: 931562 - RNA, 15 nt, Homo sapiens
uuuccuuucauuuac

SEQ ID NO: 931563 - RNA, 21 nt, Homo sapiens
uuugaauacaaagaaccaaga

SEQ ID NO: 931564 - RNA, 21 nt, Homo sapiens
uuugaaugcagucuguccagg

SEQ ID NO: 931565 - RNA, 14 nt, Homo sapiens
uuugagacaggaga

SEQ ID NO: 931566 - RNA, 18 nt, Homo sapiens
uuugcccuuuuuaaggaa

SEQ ID NO: 931567 - RNA, 19 nt, Homo sapiens
uuuuaaaaaaauuccaagu

SEQ ID NO: 931568 - RNA, 16 nt, Homo sapiens
auugauaauuuagaca

SEQ ID NO: 931569 - RNA, 18 nt, Homo sapiens
auugauagaguguuauca

SEQ ID NO: 931570 - RNA, 22 nt, Homo sapiens
auuggaggugaacaagcaaacc

SEQ ID NO: 931571 - RNA, 20 nt, Homo sapiens
auuguaguccuguaauggaa

SEQ ID NO: 931572 - RNA, 13 nt, Homo sapiens
auuguaugguggg

SEQ ID NO: 931573 - RNA, 12 nt, Homo sapiens
auuugguguaca

SEQ ID NO: 931574 - RNA, 14 nt, Homo sapiens
auuuuauagcuacu

SEQ ID NO: 931575 - RNA, 17 nt, Homo sapiens
caaagaugggugaaggc

SEQ ID NO: 931576 - RNA, 23 nt, Homo sapiens
caacacugcugcuccagugcagg

SEQ ID NO: 931577 - RNA, 14 nt, Homo sapiens
caagcaagacugag

SEQ ID NO: 931578 - RNA, 22 nt, Homo sapiens
caagcuaaaauuagaugaacuc

SEQ ID NO: 931579 - RNA, 15 nt, Homo sapiens
caaguauuuugccac

SEQ ID NO: 931580 - RNA, 13 nt, Homo sapiens
cacaacugcaguc

SEQ ID NO: 931581 - RNA, 17 nt, Homo sapiens
cacagggcaccugccac

SEQ ID NO: 931582 - RNA, 22 nt, Homo sapiens
cacauauggacucugcacauga

SEQ ID NO: 931583 - RNA, 15 nt, Homo sapiens
cacauggccuaugca

SEQ ID NO: 931584 - RNA, 16 nt, Homo sapiens
cacauggccuaugcac

SEQ ID NO: 931585 - RNA, 18 nt, Homo sapiens
cacauggccuaugcacau

SEQ ID NO: 931586 - RNA, 19 nt, Homo sapiens
cacauggccuaugcacaua

SEQ ID NO: 931587 - RNA, 21 nt, Homo sapiens
cacauggccuaugcacauaug

SEQ ID NO: 931588 - RNA, 22 nt, Homo sapiens
cacaugucuuguacauguguag

SEQ ID NO: 931589 - RNA, 15 nt, Homo sapiens
caccacccacuugau

SEQ ID NO: 931590 - RNA, 15 nt, Homo sapiens
caccacgucacuuca

SEQ ID NO: 931591 - RNA, 20 nt, Homo sapiens
cacugcugcuccagugcagg

SEQ ID NO: 931592 - RNA, 14 nt, Homo sapiens
cacuggaaaguuua

SEQ ID NO: 931593 - RNA, 13 nt, Homo sapiens
cacugugagcucc

SEQ ID NO: 931594 - RNA, 23 nt, Homo sapiens
cacuuaugagaugccugaagcca

SEQ ID NO: 931595 - RNA, 16 nt, Homo sapiens
cacuuccaagagccuu

SEQ ID NO: 931596 - RNA, 20 nt, Homo sapiens
cacuuccugcugcgaaagac

SEQ ID NO: 931597 - RNA, 12 nt, Homo sapiens
cacuucuuucag

SEQ ID NO: 931598 - RNA, 21 nt, Homo sapiens
cagaaucccguaacaccugau

SEQ ID NO: 931599 - RNA, 19 nt, Homo sapiens
cagagagccuggugcugcu

SEQ ID NO: 931600 - RNA, 13 nt, Homo sapiens
cagcaagucucuu

SEQ ID NO: 931601 - RNA, 20 nt, Homo sapiens
cagcaccugcgggagcugca

SEQ ID NO: 931602 - RNA, 18 nt, Homo sapiens
cagccagaggcaccucaa

SEQ ID NO: 931603 - RNA, 14 nt, Homo sapiens
cagccagccgugag

SEQ ID NO: 931604 - RNA, 22 nt, Homo sapiens
cagccuggcucccaggacacga

SEQ ID NO: 931605 - RNA, 20 nt, Homo sapiens
cagcugccucugccacugac

SEQ ID NO: 931606 - RNA, 22 nt, Homo sapiens
caggagaccuggcacuggaugc

SEQ ID NO: 931607 - RNA, 14 nt, Homo sapiens
caggcucgucauug

SEQ ID NO: 931608 - RNA, 20 nt, Homo sapiens
caggugaaacccagucacug

SEQ ID NO: 931609 - RNA, 15 nt, Homo sapiens
caggugcagccagag

SEQ ID NO: 931610 - RNA, 17 nt, Homo sapiens
caguaacuaaagcuuua

SEQ ID NO: 931611 - RNA, 18 nt, Homo sapiens
caguggcccugagcagua

SEQ ID NO: 931612 - RNA, 19 nt, Homo sapiens
cauaaacuuuccucuuccu

SEQ ID NO: 931613 - RNA, 21 nt, Homo sapiens
cauaaacuuuccucuuccugc

SEQ ID NO: 931614 - RNA, 17 nt, Homo sapiens
cauaagcgaucacuucc

SEQ ID NO: 931615 - RNA, 18 nt, Homo sapiens
cauaauguuacauuauua

SEQ ID NO: 931616 - RNA, 22 nt, Homo sapiens
cauagucacauggccuaugcac

SEQ ID NO: 931617 - RNA, 13 nt, Homo sapiens
cauauaauguugu

SEQ ID NO: 931618 - RNA, 19 nt, Homo sapiens
cauauggacucugcacaug

SEQ ID NO: 931619 - RNA, 19 nt, Homo sapiens
cauauuuauuuagaugcua

SEQ ID NO: 931620 - RNA, 17 nt, Homo sapiens
cauccuccacaauagca

SEQ ID NO: 931621 - RNA, 22 nt, Homo sapiens
caugaaucccacccacauguga

SEQ ID NO: 931622 - RNA, 18 nt, Homo sapiens
caugagaccacuguuauc

SEQ ID NO: 931623 - RNA, 19 nt, Homo sapiens
caugagaccacuguuauca

SEQ ID NO: 931624 - RNA, 15 nt, Homo sapiens
caugauccaagcaag

SEQ ID NO: 931625 - RNA, 22 nt, Homo sapiens
caugcaggugaaacccagucac

SEQ ID NO: 931626 - RNA, 17 nt, Homo sapiens
cauguaugucuuggaca

SEQ ID NO: 931627 - RNA, 18 nt, Homo sapiens
caugugacacauaugcac

SEQ ID NO: 931628 - RNA, 18 nt, Homo sapiens
cauuuacuguggcuucuu

SEQ ID NO: 931629 - RNA, 16 nt, Homo sapiens
cauuucuuucaauaaa

SEQ ID NO: 931630 - RNA, 16 nt, Homo sapiens
ccaaauuaucaagcua

SEQ ID NO: 931631 - RNA, 19 nt, Homo sapiens
ccaagcagagaagcucucg

SEQ ID NO: 931632 - RNA, 18 nt, Homo sapiens
ccaagcaggaaccccagg

SEQ ID NO: 931633 - RNA, 12 nt, Homo sapiens
ccacaacaugaa

SEQ ID NO: 931634 - RNA, 18 nt, Homo sapiens
ccacagagagaggggaga

SEQ ID NO: 931635 - RNA, 22 nt, Homo sapiens
ccacaugugacacauaugcacc

SEQ ID NO: 931636 - RNA, 15 nt, Homo sapiens
ccacuaggacuucaa

SEQ ID NO: 931637 - RNA, 15 nt, Homo sapiens
ccagaaguuccucaa

SEQ ID NO: 931638 - RNA, 14 nt, Homo sapiens
ccagacggcuccac

SEQ ID NO: 931639 - RNA, 16 nt, Homo sapiens
ccagagcuacugacua

SEQ ID NO: 931640 - RNA, 15 nt, Homo sapiens
ccagaggacugugau

SEQ ID NO: 931641 - RNA, 15 nt, Homo sapiens
ccagccgugagugca

SEQ ID NO: 931642 - RNA, 15 nt, Homo sapiens
ccagcuccucacuca

SEQ ID NO: 931643 - RNA, 14 nt, Homo sapiens
ccagucacugugag

SEQ ID NO: 931644 - RNA, 13 nt, Homo sapiens
ccauaaucacuca

SEQ ID NO: 931645 - RNA, 13 nt, Homo sapiens
ccauaauguuaca

SEQ ID NO: 931646 - RNA, 18 nt, Homo sapiens
ccauauacucuucaagga

SEQ ID NO: 931647 - RNA, 23 nt, Homo sapiens
ccauaugaaaaggcuaagcuuca

SEQ ID NO: 931648 - RNA, 19 nt, Homo sapiens
cccacaugugacacauaug

SEQ ID NO: 931649 - RNA, 17 nt, Homo sapiens
cccacccacaugugaca

SEQ ID NO: 931650 - RNA, 16 nt, Homo sapiens
cccaggaguguggcca

SEQ ID NO: 931651 - RNA, 17 nt, Homo sapiens
cccugcaguuugagaca

SEQ ID NO: 931652 - RNA, 20 nt, Homo sapiens
cccuggagcccauccagucu

SEQ ID NO: 931653 - RNA, 23 nt, Homo sapiens
ccgcaacaguuuuuuaugcuaau

SEQ ID NO: 931654 - RNA, 15 nt, Homo sapiens
ccgugggaguacaaa

SEQ ID NO: 931655 - RNA, 17 nt, Homo sapiens
ccuaaacauaugaauua

SEQ ID NO: 931656 - RNA, 19 nt, Homo sapiens
ccuacuuuucuuuccucag

SEQ ID NO: 931657 - RNA, 14 nt, Homo sapiens
ccuaugcacauaug

SEQ ID NO: 931658 - RNA, 18 nt, Homo sapiens
ccucaagggccaggacuu

SEQ ID NO: 931659 - RNA, 20 nt, Homo sapiens
ccucaguuuuaucauuuuca

SEQ ID NO: 931660 - RNA, 14 nt, Homo sapiens
ccucugccacugac

SEQ ID NO: 931661 - RNA, 15 nt, Homo sapiens
ccugagggagcucca

SEQ ID NO: 931662 - RNA, 17 nt, Homo sapiens
ccugcaccccugcaguu

SEQ ID NO: 931663 - RNA, 14 nt, Homo sapiens
ccugcccuuggcac

SEQ ID NO: 931664 - RNA, 15 nt, Homo sapiens
ccuggcacacaucag

SEQ ID NO: 931665 - RNA, 13 nt, Homo sapiens
ccuggugcugcug

SEQ ID NO: 931666 - RNA, 22 nt, Homo sapiens
ccuuaccacgcaguaacuaaag

SEQ ID NO: 931667 - RNA, 14 nt, Homo sapiens
ccuugugucuguac

SEQ ID NO: 931668 - RNA, 15 nt, Homo sapiens
ccuuucauuuacugu

SEQ ID NO: 931669 - RNA, 13 nt, Homo sapiens
ccuuuuuaaggaa

SEQ ID NO: 931670 - RNA, 22 nt, Homo sapiens
cgauccauguaaucugacguca

SEQ ID NO: 931671 - RNA, 13 nt, Homo sapiens
cgcaacaguuuuu

SEQ ID NO: 931672 - RNA, 17 nt, Homo sapiens
cggcugcauacccgggc

SEQ ID NO: 931673 - RNA, 14 nt, Homo sapiens
cgggagcugcacua

SEQ ID NO: 931674 - RNA, 22 nt, Homo sapiens
cgggcuaggaagaucucugcag

SEQ ID NO: 931675 - RNA, 21 nt, Homo sapiens
cggugagcuacaaaugcauuu

SEQ ID NO: 931676 - RNA, 17 nt, Homo sapiens
cgucaaagcugaaaugg

SEQ ID NO: 931677 - RNA, 14 nt, Homo sapiens
cguggacucugcac

SEQ ID NO: 931678 - RNA, 20 nt, Homo sapiens
cguuccaaguauuuugccac

SEQ ID NO: 931679 - RNA, 23 nt, Homo sapiens
cguuuccuuucauuuacuguggc

SEQ ID NO: 931680 - RNA, 15 nt, Homo sapiens
cuaaacaccacguca

SEQ ID NO: 931681 - RNA, 18 nt, Homo sapiens
cuaaauccuuuacuguua

SEQ ID NO: 931682 - RNA, 22 nt, Homo sapiens
ucuggugguguuaaucauuuca

SEQ ID NO: 931683 - RNA, 12 nt, Homo sapiens
ucuuaaucuuuu

SEQ ID NO: 931684 - RNA, 18 nt, Homo sapiens
ucuuaaucuuuucacaaa

SEQ ID NO: 931685 - RNA, 22 nt, Homo sapiens
ucuuccuggcuccaacacugcu

SEQ ID NO: 931686 - RNA, 21 nt, Homo sapiens
ucuuuguaagaguggaaccaa

SEQ ID NO: 931687 - RNA, 15 nt, Homo sapiens
ucuuuucacaaauaa

SEQ ID NO: 931688 - RNA, 15 nt, Homo sapiens
ugaagccucacuuau

SEQ ID NO: 931689 - RNA, 18 nt, Homo sapiens
ugaauacaaagaaccaag

SEQ ID NO: 931690 - RNA, 19 nt, Homo sapiens
ugaccugguccacagggca

SEQ ID NO: 931691 - RNA, 15 nt, Homo sapiens
ugacgucaucuuguc

SEQ ID NO: 931692 - RNA, 17 nt, Homo sapiens
ugacuauggcuaccaaa

SEQ ID NO: 931693 - RNA, 19 nt, Homo sapiens
ugacuauggcuaccaaaaa

SEQ ID NO: 931694 - RNA, 18 nt, Homo sapiens
ugagaaguuacuuuccau

SEQ ID NO: 931695 - RNA, 18 nt, Homo sapiens
ugagaccuggcagccaca

SEQ ID NO: 931696 - RNA, 15 nt, Homo sapiens
ugagcucccaggugc

SEQ ID NO: 931697 - RNA, 14 nt, Homo sapiens
ugauuucauuucaa

SEQ ID NO: 931698 - RNA, 14 nt, Homo sapiens
ugcaauuugcacaa

SEQ ID NO: 931699 - RNA, 23 nt, Homo sapiens
ugcacaugucuuguacaugugua

SEQ ID NO: 931700 - RNA, 15 nt, Homo sapiens
ugcacccacccagga

SEQ ID NO: 931701 - RNA, 18 nt, Homo sapiens
ugcagaccccuuggccag

SEQ ID NO: 931702 - RNA, 11 nt, Homo sapiens
ugcagccagag

SEQ ID NO: 931703 - RNA, 20 nt, Homo sapiens
ugccaaccggucacccagga

SEQ ID NO: 931704 - RNA, 20 nt, Homo sapiens
ugccuccaucagcuaaacac

SEQ ID NO: 931705 - RNA, 21 nt, Homo sapiens
ugccucucccgucgucucuuc

SEQ ID NO: 931706 - RNA, 15 nt, Homo sapiens
ugccuggccuggcac

SEQ ID NO: 931707 - RNA, 16 nt, Homo sapiens
ugccuggccuggcaca

SEQ ID NO: 931708 - RNA, 15 nt, Homo sapiens
ugcguggacucugca

SEQ ID NO: 931709 - RNA, 16 nt, Homo sapiens
ugcguggacucugcac

SEQ ID NO: 931710 - RNA, 21 nt, Homo sapiens
ugcuaaucagggaggucauuu

SEQ ID NO: 931711 - RNA, 21 nt, Homo sapiens
ugcuacagggcucacagaauu

SEQ ID NO: 931712 - RNA, 22 nt, Homo sapiens
uggaaacauucaggagcuuccu

SEQ ID NO: 931713 - RNA, 23 nt, Homo sapiens
uggaaccaacacuaacauauaau

SEQ ID NO: 931714 - RNA, 13 nt, Homo sapiens
uggaauguaauca

SEQ ID NO: 931715 - RNA, 17 nt, Homo sapiens
uggacucugcacauguc

SEQ ID NO: 931716 - RNA, 19 nt, Homo sapiens
uggagcccauccagucucc

SEQ ID NO: 931717 - RNA, 16 nt, Homo sapiens
uggcacuggaugcaga

SEQ ID NO: 931718 - RNA, 13 nt, Homo sapiens
uggccuaugcaca

SEQ ID NO: 931719 - RNA, 16 nt, Homo sapiens
uggccuaugcacauau

SEQ ID NO: 931720 - RNA, 12 nt, Homo sapiens
uggccuggcaca

SEQ ID NO: 931721 - RNA, 14 nt, Homo sapiens
uggcucccaggaca

SEQ ID NO: 931722 - RNA, 17 nt, Homo sapiens
uggcuccccaaagggug

SEQ ID NO: 931723 - RNA, 22 nt, Homo sapiens
ugggaaguuggcuggugucccu

SEQ ID NO: 931724 - RNA, 15 nt, Homo sapiens
uggggagauggaguu

SEQ ID NO: 931725 - RNA, 18 nt, Homo sapiens
uguaaacauuucuuucaa

SEQ ID NO: 931726 - RNA, 14 nt, Homo sapiens
uguaaucauauaau

SEQ ID NO: 931727 - RNA, 20 nt, Homo sapiens
uguacauguguagccugugc

SEQ ID NO: 931728 - RNA, 22 nt, Homo sapiens
uguacauguguagccugugcau

SEQ ID NO: 931729 - RNA, 17 nt, Homo sapiens
uguacauuagucauuca

SEQ ID NO: 931730 - RNA, 16 nt, Homo sapiens
ugucacuuugcuacag

SEQ ID NO: 931731 - RNA, 16 nt, Homo sapiens
uguccucccagcuccu

SEQ ID NO: 931732 - RNA, 18 nt, Homo sapiens
ugucuuggacacuguaca

SEQ ID NO: 931733 - RNA, 16 nt, Homo sapiens
ugucuuuaucaaagga

SEQ ID NO: 931734 - RNA, 17 nt, Homo sapiens
ugugcauguaugucuug

SEQ ID NO: 931735 - RNA, 19 nt, Homo sapiens
uguggcuucuuaaucuuuu

SEQ ID NO: 931736 - RNA, 14 nt, Homo sapiens
uguuaaucauuuca

SEQ ID NO: 931737 - RNA, 15 nt, Homo sapiens
uguucacuuccaaga

SEQ ID NO: 931738 - RNA, 20 nt, Homo sapiens
uuaaaauaugcucuaaacau

SEQ ID NO: 931739 - RNA, 13 nt, Homo sapiens
uuacuguggcuuc

SEQ ID NO: 931740 - RNA, 14 nt, Homo sapiens
uuauaauauacuau

SEQ ID NO: 931741 - RNA, 13 nt, Homo sapiens
uuaugcggcauuu

SEQ ID NO: 931742 - RNA, 14 nt, Homo sapiens
uuauucucaagaag

SEQ ID NO: 931743 - RNA, 16 nt, Homo sapiens
uucaauaaacuaaaga

SEQ ID NO: 931744 - RNA, 16 nt, Homo sapiens
uucacucaacaaacau

SEQ ID NO: 931745 - RNA, 21 nt, Homo sapiens
uucacuuaauaauguguacau

SEQ ID NO: 931746 - RNA, 20 nt, Homo sapiens
uucauauguaccauguacau

SEQ ID NO: 931747 - RNA, 19 nt, Homo sapiens
uucaugcaggugaaaccca

SEQ ID NO: 931748 - RNA, 18 nt, Homo sapiens
uucauuaauacagggcau

SEQ ID NO: 931749 - RNA, 22 nt, Homo sapiens
uucauuagcgauccauguaauc

SEQ ID NO: 931750 - RNA, 19 nt, Homo sapiens
uucauucacucaacaaaca

SEQ ID NO: 931751 - RNA, 22 nt, Homo sapiens
uucauuuacuguggcuucuuaa

SEQ ID NO: 931752 - RNA, 21 nt, Homo sapiens
uucauuuuuacccuuacuugg

SEQ ID NO: 931753 - RNA, 16 nt, Homo sapiens
uuccucagaucaucca

SEQ ID NO: 931754 - RNA, 12 nt, Homo sapiens
uuccuuccagcc

SEQ ID NO: 931755 - RNA, 17 nt, Homo sapiens
uugacaaccaugagacc

SEQ ID NO: 931756 - RNA, 14 nt, Homo sapiens
uugagacaggagac

SEQ ID NO: 931757 - RNA, 16 nt, Homo sapiens
uugauaauuuagacau

SEQ ID NO: 931758 - RNA, 15 nt, Homo sapiens
uugauuucauuaaua

SEQ ID NO: 931759 - RNA, 19 nt, Homo sapiens
uugccauuaaacuuaccug

SEQ ID NO: 931760 - RNA, 19 nt, Homo sapiens
uuguaaaauuucacuuaau

SEQ ID NO: 931761 - RNA, 14 nt, Homo sapiens
uuguaaacauuucu

SEQ ID NO: 931762 - RNA, 15 nt, Homo sapiens
uuuaauccuagagau

SEQ ID NO: 931763 - RNA, 13 nt, Homo sapiens
uuuaauuaucuaa

SEQ ID NO: 931764 - RNA, 19 nt, Homo sapiens
uuucacuuaauaaugugua

SEQ ID NO: 931765 - RNA, 15 nt, Homo sapiens
uuucauuuacugugg

SEQ ID NO: 931766 - RNA, 16 nt, Homo sapiens
uuuccauaaucacuca

SEQ ID NO: 931767 - RNA, 15 nt, Homo sapiens
uuucuccagggucag

SEQ ID NO: 931768 - RNA, 15 nt, Homo sapiens
uuugaguuucucuca

SEQ ID NO: 931769 - RNA, 14 nt, Homo sapiens
uuuucacaaauaaa

SEQ ID NO: 931770 - RNA, 16 nt, Homo sapiens
gagagucgcaucucag

SEQ ID NO: 931771 - RNA, 14 nt, Homo sapiens
gagcucccaggugc

SEQ ID NO: 931772 - RNA, 21 nt, Homo sapiens
gagcucccaggugcagccaga

SEQ ID NO: 931773 - RNA, 20 nt, Homo sapiens
gaggcugcacccacccagga

SEQ ID NO: 931774 - RNA, 16 nt, Homo sapiens
gaggugaacaagcaaa

SEQ ID NO: 931775 - RNA, 23 nt, Homo sapiens
gaggugaacaagcaaacccagac

SEQ ID NO: 931776 - RNA, 16 nt, Homo sapiens
gaguucaaauugccuu

SEQ ID NO: 931777 - RNA, 20 nt, Homo sapiens
gauaaguucuaguugcuugu

SEQ ID NO: 931778 - RNA, 13 nt, Homo sapiens
gauccaagcaaga

SEQ ID NO: 931779 - RNA, 19 nt, Homo sapiens
gauggcuuuaccuuuauua

SEQ ID NO: 931780 - RNA, 19 nt, Homo sapiens
gauuuuuuucauuuugcca

SEQ ID NO: 931781 - RNA, 11 nt, Homo sapiens
gcaaacccaga

SEQ ID NO: 931782 - RNA, 23 nt, Homo sapiens
gcaauuucacgacacacuuugau

SEQ ID NO: 931783 - RNA, 12 nt, Homo sapiens
gcacaaagaugg

SEQ ID NO: 931784 - RNA, 21 nt, Homo sapiens
gcacauauggacucugcacau

SEQ ID NO: 931785 - RNA, 15 nt, Homo sapiens
gcacaugucuuguac

SEQ ID NO: 931786 - RNA, 14 nt, Homo sapiens
gcaccucaagaaga

SEQ ID NO: 931787 - RNA, 24 nt, Homo sapiens
gcaccuugugucuguacacguguc

SEQ ID NO: 931788 - RNA, 22 nt, Homo sapiens
gcaguugaaacaagaagccaca

SEQ ID NO: 931789 - RNA, 16 nt, Homo sapiens
gcauaaguuucuggga

SEQ ID NO: 931790 - RNA, 21 nt, Homo sapiens
gcauaaguuucugggaccuca

SEQ ID NO: 931791 - RNA, 17 nt, Homo sapiens
gcaugauccaagcaaga

SEQ ID NO: 931792 - RNA, 24 nt, Homo sapiens
gcauguaugucuuggacacuguac

SEQ ID NO: 931793 - RNA, 18 nt, Homo sapiens
gccaaccggucacccagg

SEQ ID NO: 931794 - RNA, 19 nt, Homo sapiens
gccaaccggucacccagga

SEQ ID NO: 931795 - RNA, 16 nt, Homo sapiens
gccagaggcaccucaa

SEQ ID NO: 931796 - RNA, 17 nt, Homo sapiens
gcccagaaagucucuca

SEQ ID NO: 931797 - RNA, 14 nt, Homo sapiens
gccucaagaucaau

SEQ ID NO: 931798 - RNA, 18 nt, Homo sapiens
gcguggacucugcacaug

SEQ ID NO: 931799 - RNA, 19 nt, Homo sapiens
gcuccauuuuuagugaaau

SEQ ID NO: 931800 - RNA, 13 nt, Homo sapiens
gcuccccaaaggg

SEQ ID NO: 931801 - RNA, 20 nt, Homo sapiens
gcucucuuuuucuccagggu

SEQ ID NO: 931802 - RNA, 21 nt, Homo sapiens
gcugaugaacucuuaaucaaa

SEQ ID NO: 931803 - RNA, 16 nt, Homo sapiens
gcugcacccacccagg

SEQ ID NO: 931804 - RNA, 22 nt, Homo sapiens
gcuucuuaaucuuuucacaaau

SEQ ID NO: 931805 - RNA, 21 nt, Homo sapiens
gcuuguaaaauuucacuuaau

SEQ ID NO: 931806 - RNA, 19 nt, Homo sapiens
gcuuuugguuauaaugugu

SEQ ID NO: 931807 - RNA, 18 nt, Homo sapiens
ggaaaaaauaacaaugaa

SEQ ID NO: 931808 - RNA, 19 nt, Homo sapiens
ggaaccguaggacccaagc

SEQ ID NO: 931809 - RNA, 20 nt, Homo sapiens
ggaccaugcgacacugggag

SEQ ID NO: 931810 - RNA, 13 nt, Homo sapiens
ggaccuccaagcc

SEQ ID NO: 931811 - RNA, 13 nt, Homo sapiens
ggacucugcacau

SEQ ID NO: 931812 - RNA, 14 nt, Homo sapiens
ggagaccuggcacu

SEQ ID NO: 931813 - RNA, 14 nt, Homo sapiens
ggaucuaguccagc

SEQ ID NO: 931814 - RNA, 22 nt, Homo sapiens
ggaugccaaccggucacccagg

SEQ ID NO: 931815 - RNA, 22 nt, Homo sapiens
ggauuaaugucaauucuugcca

SEQ ID NO: 931816 - RNA, 12 nt, Homo sapiens
ggcaaacaggca

SEQ ID NO: 931817 - RNA, 21 nt, Homo sapiens
ggcacacaucaggaguucaau

SEQ ID NO: 931818 - RNA, 13 nt, Homo sapiens
ggcacccaagacc

SEQ ID NO: 931819 - RNA, 16 nt, Homo sapiens
ggcagccacaacugca

SEQ ID NO: 931820 - RNA, 18 nt, Homo sapiens
ggcagccacaacugcagu

SEQ ID NO: 931821 - RNA, 21 nt, Homo sapiens
ggcauuuucuucucacauuua

SEQ ID NO: 931822 - RNA, 21 nt, Homo sapiens
ggccagcguggcgcaguggcc

SEQ ID NO: 931823 - RNA, 13 nt, Homo sapiens
ggcccaggugagu

SEQ ID NO: 931824 - RNA, 17 nt, Homo sapiens
ggccuaugcacauaugg

SEQ ID NO: 931825 - RNA, 16 nt, Homo sapiens
ggcucccacagagaca

SEQ ID NO: 931826 - RNA, 20 nt, Homo sapiens
ggcuucuuaaucuuuucaca

SEQ ID NO: 931827 - RNA, 20 nt, Homo sapiens
gggaggccagugagccacuc

SEQ ID NO: 931828 - RNA, 23 nt, Homo sapiens
gggauaaguaaguuugauuucau

SEQ ID NO: 931829 - RNA, 13 nt, Homo sapiens
gggcccacaaagg

SEQ ID NO: 931830 - RNA, 21 nt, Homo sapiens
ggguaugucuuuaucaaagga

SEQ ID NO: 931831 - RNA, 21 nt, Homo sapiens
ggucagaaacaggaccgggug

SEQ ID NO: 931832 - RNA, 20 nt, Homo sapiens
ggugaacaagcaaacccaga

SEQ ID NO: 931833 - RNA, 17 nt, Homo sapiens
ggugaggggcuggcacu

SEQ ID NO: 931834 - RNA, 17 nt, Homo sapiens
guagccugugcauguau

SEQ ID NO: 931835 - RNA, 13 nt, Homo sapiens
guaggacccaagc

SEQ ID NO: 931836 - RNA, 19 nt, Homo sapiens
guaugucuuggacacugua

SEQ ID NO: 931837 - RNA, 11 nt, Homo sapiens
gucacugugag

SEQ ID NO: 931838 - RNA, 20 nt, Homo sapiens
gucauguuguaaacauuucu

SEQ ID NO: 931839 - RNA, 15 nt, Homo sapiens
gucauuggaggugaa

SEQ ID NO: 931840 - RNA, 17 nt, Homo sapiens
guccacagggcaccugc

SEQ ID NO: 931841 - RNA, 16 nt, Homo sapiens
gucucuuuuuuuggcc

SEQ ID NO: 931842 - RNA, 15 nt, Homo sapiens
gucuuggacacugua

SEQ ID NO: 931843 - RNA, 17 nt, Homo sapiens
gugggcaaacaggcagu

SEQ ID NO: 931844 - RNA, 16 nt, Homo sapiens
guguacacgugacaga

SEQ ID NO: 931845 - RNA, 12 nt, Homo sapiens
guuauaaugugu

SEQ ID NO: 931846 - RNA, 23 nt, Homo sapiens
guuuaucguauuugaugcuacag

SEQ ID NO: 931847 - RNA, 17 nt, Homo sapiens
guuuccccaccagugaa

SEQ ID NO: 931848 - RNA, 23 nt, Homo sapiens
guuuuugugaaaagcuccauuuu

SEQ ID NO: 931849 - RNA, 23 nt, Homo sapiens
uaaaaauugugaucagaccauaa

SEQ ID NO: 931850 - RNA, 14 nt, Homo sapiens
uaaaagacagugaa

SEQ ID NO: 931851 - RNA, 18 nt, Homo sapiens
uaaaauuucacuuaauaa

SEQ ID NO: 931852 - RNA, 11 nt, Homo sapiens
uaaacauuucu

SEQ ID NO: 931853 - RNA, 16 nt, Homo sapiens
uaaacauuucuuucaa

SEQ ID NO: 931854 - RNA, 13 nt, Homo sapiens
uaaagcagccagc

SEQ ID NO: 931855 - RNA, 21 nt, Homo sapiens
aggccuccuggcccaggugag

SEQ ID NO: 931856 - RNA, 11 nt, Homo sapiens
agggcacaaag

SEQ ID NO: 931857 - RNA, 14 nt, Homo sapiens
agggcaggcccaaa

SEQ ID NO: 931858 - RNA, 22 nt, Homo sapiens
agggccgcccgggcccagagga

SEQ ID NO: 931859 - RNA, 20 nt, Homo sapiens
agggguucuggaaacauuca

SEQ ID NO: 931860 - RNA, 23 nt, Homo sapiens
aggugaaacccagucacugugag

SEQ ID NO: 931861 - RNA, 21 nt, Homo sapiens
aggugaacaagcaaacccaga

SEQ ID NO: 931862 - RNA, 13 nt, Homo sapiens
aguauuuugccac

SEQ ID NO: 931863 - RNA, 21 nt, Homo sapiens
agucauuugcugagcauguac

SEQ ID NO: 931864 - RNA, 17 nt, Homo sapiens
aguccuacaagcuaaaa

SEQ ID NO: 931865 - RNA, 21 nt, Homo sapiens
agugaggcugcacccacccag

SEQ ID NO: 931866 - RNA, 17 nt, Homo sapiens
agugauugauagagugu

SEQ ID NO: 931867 - RNA, 13 nt, Homo sapiens
agugugugucuuu

SEQ ID NO: 931868 - RNA, 22 nt, Homo sapiens
aguucuccacuagcuauggugu

SEQ ID NO: 931869 - RNA, 21 nt, Homo sapiens
aguuguuucuacuacauggaa

SEQ ID NO: 931870 - RNA, 22 nt, Homo sapiens
auaaaguguuugaaagcuuuau

SEQ ID NO: 931871 - RNA, 22 nt, Homo sapiens
auaacaauaaaagacaaggaaa

SEQ ID NO: 931872 - RNA, 12 nt, Homo sapiens
auaacaaugaaa

SEQ ID NO: 931873 - RNA, 13 nt, Homo sapiens
auaauaacuggga

SEQ ID NO: 931874 - RNA, 17 nt, Homo sapiens
auacaaagaaccaagaa

SEQ ID NO: 931875 - RNA, 18 nt, Homo sapiens
auagcaguugaaacaaga

SEQ ID NO: 931876 - RNA, 16 nt, Homo sapiens
auauggacucugcaca

SEQ ID NO: 931877 - RNA, 14 nt, Homo sapiens
auauguaccaugua

SEQ ID NO: 931878 - RNA, 14 nt, Homo sapiens
aucaaguccuacaa

SEQ ID NO: 931879 - RNA, 22 nt, Homo sapiens
aucacuuccuauaugcacuuau

SEQ ID NO: 931880 - RNA, 16 nt, Homo sapiens
aucagucauaacuaaa

SEQ ID NO: 931881 - RNA, 23 nt, Homo sapiens
aucugcuuuugguuauaaugugu

SEQ ID NO: 931882 - RNA, 16 nt, Homo sapiens
augaacucuuaaucaa

SEQ ID NO: 931883 - RNA, 23 nt, Homo sapiens
augauccaagcaagacugagggg

SEQ ID NO: 931884 - RNA, 20 nt, Homo sapiens
augcacauauggacucugca

SEQ ID NO: 931885 - RNA, 18 nt, Homo sapiens
augcaccuugugucugua

SEQ ID NO: 931886 - RNA, 18 nt, Homo sapiens
augccaaccggucaccca

SEQ ID NO: 931887 - RNA, 12 nt, Homo sapiens
auggacucugca

SEQ ID NO: 931888 - RNA, 18 nt, Homo sapiens
auggaguucuugugccau

SEQ ID NO: 931889 - RNA, 19 nt, Homo sapiens
auggccacaacaugaaaac

SEQ ID NO: 931890 - RNA, 14 nt, Homo sapiens
auggcucuaaaaag

SEQ ID NO: 931891 - RNA, 20 nt, Homo sapiens
augucuuggacacuguacaa

SEQ ID NO: 931892 - RNA, 17 nt, Homo sapiens
augucuuguacaugugu

SEQ ID NO: 931893 - RNA, 16 nt, Homo sapiens
auuacuguauauacuu

SEQ ID NO: 931894 - RNA, 15 nt, Homo sapiens
auucuaggccuccug

SEQ ID NO: 931895 - RNA, 21 nt, Homo sapiens
auugauaauuuagacauugag

SEQ ID NO: 931896 - RNA, 15 nt, Homo sapiens
auuuuauagcuacua

SEQ ID NO: 931897 - RNA, 17 nt, Homo sapiens
auuuugcauaguaccaa

SEQ ID NO: 931898 - RNA, 22 nt, Homo sapiens
caaacaggcaguuggccagaga

SEQ ID NO: 931899 - RNA, 22 nt, Homo sapiens
caaaugcauuucuaaagccauu

SEQ ID NO: 931900 - RNA, 16 nt, Homo sapiens
caaauuaucaagcuaa

SEQ ID NO: 931901 - RNA, 22 nt, Homo sapiens
caacacugcugcuccagugcag

SEQ ID NO: 931902 - RNA, 18 nt, Homo sapiens
caacaguuuuuuaugcua

SEQ ID NO: 931903 - RNA, 20 nt, Homo sapiens
caagcaggaaccccaggaga

SEQ ID NO: 931904 - RNA, 19 nt, Homo sapiens
caagcuaauaaaauaucau

SEQ ID NO: 931905 - RNA, 14 nt, Homo sapiens
caaguauuuugcca

SEQ ID NO: 931906 - RNA, 16 nt, Homo sapiens
caaugaaaugauguca

SEQ ID NO: 931907 - RNA, 20 nt, Homo sapiens
caauguauaaccccaaagaa

SEQ ID NO: 931908 - RNA, 21 nt, Homo sapiens
cacagagacaaggagggcaca

SEQ ID NO: 931909 - RNA, 17 nt, Homo sapiens
cacauauggacucugca

SEQ ID NO: 931910 - RNA, 16 nt, Homo sapiens
cacaugucuuguacau

SEQ ID NO: 931911 - RNA, 15 nt, Homo sapiens
cacaugugacacaua

SEQ ID NO: 931912 - RNA, 20 nt, Homo sapiens
cacaugugacacauaugcac

SEQ ID NO: 931913 - RNA, 17 nt, Homo sapiens
caccuugugucuguaca

SEQ ID NO: 931914 - RNA, 14 nt, Homo sapiens
cacgcagccaggac

SEQ ID NO: 931915 - RNA, 20 nt, Homo sapiens
cacgcaggagcacacccagc

SEQ ID NO: 931916 - RNA, 15 nt, Homo sapiens
cacggaccaugcgac

SEQ ID NO: 931917 - RNA, 20 nt, Homo sapiens
cacgugggcaaacaggcagu

SEQ ID NO: 931918 - RNA, 20 nt, Homo sapiens
cacuguacaagguaccccuu

SEQ ID NO: 931919 - RNA, 22 nt, Homo sapiens
cacugugacuuaagaagccuua

SEQ ID NO: 931920 - RNA, 16 nt, Homo sapiens
cacuuauucucaagaa

SEQ ID NO: 931921 - RNA, 23 nt, Homo sapiens
cacuugauuuuuuucauuuugcc

SEQ ID NO: 931922 - RNA, 19 nt, Homo sapiens
cagaaacaguucaccuuga

SEQ ID NO: 931923 - RNA, 16 nt, Homo sapiens
cagaaucccguaacac

SEQ ID NO: 931924 - RNA, 23 nt, Homo sapiens
cagagaagcucucgggcuaggaa

SEQ ID NO: 931925 - RNA, 21 nt, Homo sapiens
cagagcugcuccccucugcac

SEQ ID NO: 931926 - RNA, 14 nt, Homo sapiens
cagaggcaccucaa

SEQ ID NO: 931927 - RNA, 14 nt, Homo sapiens
cagccacaacugca

SEQ ID NO: 931928 - RNA, 16 nt, Homo sapiens
cagccgugagugcaga

SEQ ID NO: 931929 - RNA, 19 nt, Homo sapiens
cagccuggccacgcagcca

SEQ ID NO: 931930 - RNA, 20 nt, Homo sapiens
cagcuaaacaccacgucacu

SEQ ID NO: 931931 - RNA, 19 nt, Homo sapiens
cagcugccucugccacuga

SEQ ID NO: 931932 - RNA, 17 nt, Homo sapiens
caggacacgacuuguaa

SEQ ID NO: 931933 - RNA, 15 nt, Homo sapiens
caggaccuccaagcc

SEQ ID NO: 931934 - RNA, 22 nt, Homo sapiens
caggaccuccaagccacugagc

SEQ ID NO: 931935 - RNA, 17 nt, Homo sapiens
caggagaccuggcacug

SEQ ID NO: 931936 - RNA, 15 nt, Homo sapiens
caggaggauggcaaa

SEQ ID NO: 931937 - RNA, 16 nt, Homo sapiens
cagggcaccugccacc

SEQ ID NO: 931938 - RNA, 18 nt, Homo sapiens
cagggcauuuugguccaa

SEQ ID NO: 931939 - RNA, 15 nt, Homo sapiens
caggugaaacccagu

SEQ ID NO: 931940 - RNA, 21 nt, Homo sapiens
caggugcagccagaggcaccu

SEQ ID NO: 931941 - RNA, 19 nt, Homo sapiens
caguaacccccacuggacu

SEQ ID NO: 931942 - RNA, 15 nt, Homo sapiens
caguaacuaaagcuu

SEQ ID NO: 931943 - RNA, 15 nt, Homo sapiens
cagucacugugagcu

SEQ ID NO: 931944 - RNA, 18 nt, Homo sapiens
cagugcaaauacucuggu

SEQ ID NO: 931945 - RNA, 16 nt, Homo sapiens
cauaauguuacauuau

SEQ ID NO: 931946 - RNA, 21 nt, Homo sapiens
cauaauguuacauuauuauca

SEQ ID NO: 931947 - RNA, 19 nt, Homo sapiens
cauauaauguuguuauuua

SEQ ID NO: 931948 - RNA, 15 nt, Homo sapiens
cauauggacucugca

SEQ ID NO: 931949 - RNA, 20 nt, Homo sapiens
cauauggacucugcacauga

SEQ ID NO: 931950 - RNA, 21 nt, Homo sapiens
caugaacuuguaaaggaauuu

SEQ ID NO: 931951 - RNA, 16 nt, Homo sapiens
caugauuucauuucaa

SEQ ID NO: 931952 - RNA, 22 nt, Homo sapiens
caugauuucauuucaacuguuu

SEQ ID NO: 931953 - RNA, 16 nt, Homo sapiens
cauggcucuaaaaagu

SEQ ID NO: 931954 - RNA, 13 nt, Homo sapiens
cauguaugucuug

SEQ ID NO: 931955 - RNA, 22 nt, Homo sapiens
cauguaugucuuggacacugua

SEQ ID NO: 931956 - RNA, 15 nt, Homo sapiens
cauuaaacuuaccug

SEQ ID NO: 931957 - RNA, 20 nt, Homo sapiens
cauuagcgauccauguaauc

SEQ ID NO: 931958 - RNA, 20 nt, Homo sapiens
cauucaggagcuuccugucc

SEQ ID NO: 931959 - RNA, 19 nt, Homo sapiens
cauucuaggccuccuggcc

SEQ ID NO: 931960 - RNA, 14 nt, Homo sapiens
cauuuaauauggau

SEQ ID NO: 931961 - RNA, 12 nt, Homo sapiens
cauuuacugugg

SEQ ID NO: 931962 - RNA, 19 nt, Homo sapiens
cauuuuuuaaaacaagaaa

SEQ ID NO: 931963 - RNA, 16 nt, Homo sapiens
ccaacucagaagggag

SEQ ID NO: 931964 - RNA, 12 nt, Homo sapiens
ccaagaccucag

SEQ ID NO: 931965 - RNA, 19 nt, Homo sapiens
ccaagcaagacugaggggu

SEQ ID NO: 931966 - RNA, 15 nt, Homo sapiens
ccaaguauuuugcca

SEQ ID NO: 931967 - RNA, 16 nt, Homo sapiens
ccaaguauuuugccac

SEQ ID NO: 931968 - RNA, 19 nt, Homo sapiens
ccagucacugugagcuccc

SEQ ID NO: 931969 - RNA, 21 nt, Homo sapiens
ccauauacucuucaaggacuu

SEQ ID NO: 931970 - RNA, 19 nt, Homo sapiens
cccaagcagagaagcucuc

SEQ ID NO: 931971 - RNA, 16 nt, Homo sapiens
cccagacggcuccacu

SEQ ID NO: 931972 - RNA, 19 nt, Homo sapiens
cccagucacugugagcucc

SEQ ID NO: 931973 - RNA, 14 nt, Homo sapiens
ccccaacacgcagg

SEQ ID NO: 931974 - RNA, 12 nt, Homo sapiens
ccccaccaguga

SEQ ID NO: 931975 - RNA, 23 nt, Homo sapiens
ccccacuggacugaccuggucca

SEQ ID NO: 931976 - RNA, 14 nt, Homo sapiens
ccguaacaccugau

SEQ ID NO: 931977 - RNA, 16 nt, Homo sapiens
ccuacuuucauaauaa

SEQ ID NO: 931978 - RNA, 20 nt, Homo sapiens
ccuacuuuucuuuccucaga

SEQ ID NO: 931979 - RNA, 20 nt, Homo sapiens
ccuaggauuucaugauuuca

SEQ ID NO: 931980 - RNA, 13 nt, Homo sapiens
ccuauaugcacuu

SEQ ID NO: 931981 - RNA, 20 nt, Homo sapiens
ccuggcacuggaugcagaaa

SEQ ID NO: 931982 - RNA, 21 nt, Homo sapiens
ccuggcuccaacacugcugcu

SEQ ID NO: 931983 - RNA, 15 nt, Homo sapiens
ccuggugcugcugcu

SEQ ID NO: 931984 - RNA, 15 nt, Homo sapiens
ccugugccuccauca

SEQ ID NO: 931985 - RNA, 18 nt, Homo sapiens
ccuuggccgcaccuaaag

SEQ ID NO: 931986 - RNA, 14 nt, Homo sapiens
ccuuucauuuacug

SEQ ID NO: 931987 - RNA, 18 nt, Homo sapiens
ccuuucauuuacuguggc

SEQ ID NO: 931988 - RNA, 21 nt, Homo sapiens
ccuuucucuccagccugacuu

SEQ ID NO: 931989 - RNA, 23 nt, Homo sapiens
cgacacugggaggccagugagcc

SEQ ID NO: 931990 - RNA, 17 nt, Homo sapiens
cgauaaaagacagugaa

SEQ ID NO: 931991 - RNA, 16 nt, Homo sapiens
cgcaucucagugcagg

SEQ ID NO: 931992 - RNA, 13 nt, Homo sapiens
cggcucccggggc

SEQ ID NO: 931993 - RNA, 13 nt, Homo sapiens
cguggacucugca

SEQ ID NO: 931994 - RNA, 18 nt, Homo sapiens
cgugggcaaacaggcagu

SEQ ID NO: 931995 - RNA, 17 nt, Homo sapiens
cguuuccuuucauuuac

SEQ ID NO: 931996 - RNA, 17 nt, Homo sapiens
cuaagcuucacuguaaa

SEQ ID NO: 931997 - RNA, 17 nt, Homo sapiens
cuacaaaaccacuggaa

SEQ ID NO: 931998 - RNA, 19 nt, Homo sapiens
cuacagggcucacagaauu

SEQ ID NO: 931999 - RNA, 18 nt, Homo sapiens
cuacuuuucuuuccucag

SEQ ID NO: 932000 - RNA, 18 nt, Homo sapiens
cuagccagaggacuguga

SEQ ID NO: 932001 - RNA, 14 nt, Homo sapiens
cuauaugcacuuau

SEQ ID NO: 932002 - RNA, 23 nt, Homo sapiens
cuaugcacauauggacucugcac

SEQ ID NO: 932003 - RNA, 20 nt, Homo sapiens
gcuccccucugcacggacca

SEQ ID NO: 932004 - RNA, 11 nt, Homo sapiens
gcucccggggc

SEQ ID NO: 932005 - RNA, 12 nt, Homo sapiens
gcuccucacuca

SEQ ID NO: 932006 - RNA, 17 nt, Homo sapiens
gcugcacccacccagga

SEQ ID NO: 932007 - RNA, 16 nt, Homo sapiens
gcuggcuccccaaagg

SEQ ID NO: 932008 - RNA, 13 nt, Homo sapiens
gcuucuuaaucuu

SEQ ID NO: 932009 - RNA, 20 nt, Homo sapiens
ggaccuccaagccacugagc

SEQ ID NO: 932010 - RNA, 18 nt, Homo sapiens
ggacuuucugaagccuca

SEQ ID NO: 932011 - RNA, 17 nt, Homo sapiens
ggagaccuggcacugga

SEQ ID NO: 932012 - RNA, 16 nt, Homo sapiens
ggagacuuuacaugga

SEQ ID NO: 932013 - RNA, 14 nt, Homo sapiens
ggagcuagccagag

SEQ ID NO: 932014 - RNA, 23 nt, Homo sapiens
ggagcuuccuguccucccagcuc

SEQ ID NO: 932015 - RNA, 17 nt, Homo sapiens
ggcaaaauaaagugaca

SEQ ID NO: 932016 - RNA, 22 nt, Homo sapiens
ggcaaagagagucgcaucucag

SEQ ID NO: 932017 - RNA, 16 nt, Homo sapiens
ggcacaaagaugggug

SEQ ID NO: 932018 - RNA, 13 nt, Homo sapiens
ggccuaugcacau

SEQ ID NO: 932019 - RNA, 13 nt, Homo sapiens
ggcucccaggaca

SEQ ID NO: 932020 - RNA, 14 nt, Homo sapiens
ggcucccaggacac

SEQ ID NO: 932021 - RNA, 13 nt, Homo sapiens
ggcuggcacugac

SEQ ID NO: 932022 - RNA, 21 nt, Homo sapiens
gggcggggcuccugagggagc

SEQ ID NO: 932023 - RNA, 17 nt, Homo sapiens
ggggcauaaacuuuccu

SEQ ID NO: 932024 - RNA, 11 nt, Homo sapiens
gguaugucuuu

SEQ ID NO: 932025 - RNA, 13 nt, Homo sapiens
ggugcagccagag

SEQ ID NO: 932026 - RNA, 22 nt, Homo sapiens
gguguuaaucauuucauuuuua

SEQ ID NO: 932027 - RNA, 13 nt, Homo sapiens
gguuauaaugugu

SEQ ID NO: 932028 - RNA, 16 nt, Homo sapiens
gguuggauuugaagac

SEQ ID NO: 932029 - RNA, 12 nt, Homo sapiens
guauuuugccac

SEQ ID NO: 932030 - RNA, 17 nt, Homo sapiens
gucacauggccuaugca

SEQ ID NO: 932031 - RNA, 11 nt, Homo sapiens
gucucuuuaua

SEQ ID NO: 932032 - RNA, 15 nt, Homo sapiens
gucuuuaucaaagga

SEQ ID NO: 932033 - RNA, 13 nt, Homo sapiens
gugaacaagcaaa

SEQ ID NO: 932034 - RNA, 12 nt, Homo sapiens
gugacacauaug

SEQ ID NO: 932035 - RNA, 14 nt, Homo sapiens
gugagaccuggcag

SEQ ID NO: 932036 - RNA, 18 nt, Homo sapiens
gugccuggccuggcacac

SEQ ID NO: 932037 - RNA, 20 nt, Homo sapiens
gugcuccuccuuggugccug

SEQ ID NO: 932038 - RNA, 18 nt, Homo sapiens
guggaaccaacacuaaca

SEQ ID NO: 932039 - RNA, 19 nt, Homo sapiens
gugguguuaaucauuucau

SEQ ID NO: 932040 - RNA, 14 nt, Homo sapiens
guguagccugugca

SEQ ID NO: 932041 - RNA, 13 nt, Homo sapiens
gugugugccucau

SEQ ID NO: 932042 - RNA, 17 nt, Homo sapiens
guuccaaguauuuugcc

SEQ ID NO: 932043 - RNA, 22 nt, Homo sapiens
guucugauauuggacaguaaaa

SEQ ID NO: 932044 - RNA, 21 nt, Homo sapiens
guuuggacuuuuauuuuggca

SEQ ID NO: 932045 - RNA, 18 nt, Homo sapiens
uaaaaaaauuccaaguga

SEQ ID NO: 932046 - RNA, 22 nt, Homo sapiens
uaaaaagagcuguccugguauc

SEQ ID NO: 932047 - RNA, 15 nt, Homo sapiens
uaaaaauugugauca

SEQ ID NO: 932048 - RNA, 13 nt, Homo sapiens
uaaaagacaagga

SEQ ID NO: 932049 - RNA, 13 nt, Homo sapiens
uaaaagacaguga

SEQ ID NO: 932050 - RNA, 18 nt, Homo sapiens
uaaaauuagaugaacuca

SEQ ID NO: 932051 - RNA, 14 nt, Homo sapiens
uaaaauuucacuua

SEQ ID NO: 932052 - RNA, 18 nt, Homo sapiens
uaaacauuucuuucaaua

SEQ ID NO: 932053 - RNA, 18 nt, Homo sapiens
uaaaguguuugaaagcuu

SEQ ID NO: 932054 - RNA, 15 nt, Homo sapiens
uaacaauaaaagaca

SEQ ID NO: 932055 - RNA, 23 nt, Homo sapiens
uaaccguuuccuuucauuuacug

SEQ ID NO: 932056 - RNA, 20 nt, Homo sapiens
uaacgauaaaagacagugaa

SEQ ID NO: 932057 - RNA, 14 nt, Homo sapiens
uaaguuucugggac

SEQ ID NO: 932058 - RNA, 17 nt, Homo sapiens
uaauaggcguaacuaau

SEQ ID NO: 932059 - RNA, 23 nt, Homo sapiens
uaauaucagcaagucucuuuaua

SEQ ID NO: 932060 - RNA, 12 nt, Homo sapiens
uaauccuaaaca

SEQ ID NO: 932061 - RNA, 18 nt, Homo sapiens
uaauccuaaacauaugaa

SEQ ID NO: 932062 - RNA, 21 nt, Homo sapiens
uaauguguuuuuaauuaucua

SEQ ID NO: 932063 - RNA, 20 nt, Homo sapiens
uacaaaaccacuggaaaguu

SEQ ID NO: 932064 - RNA, 17 nt, Homo sapiens
uacaauucaggcuuugg

SEQ ID NO: 932065 - RNA, 13 nt, Homo sapiens
uacacgugacaga

SEQ ID NO: 932066 - RNA, 15 nt, Homo sapiens
uacacgugacagagu

SEQ ID NO: 932067 - RNA, 15 nt, Homo sapiens
uacacguguccugua

SEQ ID NO: 932068 - RNA, 16 nt, Homo sapiens
uacauguguagccugu

SEQ ID NO: 932069 - RNA, 16 nt, Homo sapiens
uacuguauauacuuug

SEQ ID NO: 932070 - RNA, 14 nt, Homo sapiens
uacuguggcuucuu

SEQ ID NO: 932071 - RNA, 17 nt, Homo sapiens
uacuuuucuuuccucag

SEQ ID NO: 932072 - RNA, 18 nt, Homo sapiens
uagaaagaaacugcucua

SEQ ID NO: 932073 - RNA, 18 nt, Homo sapiens
uagagauuugguguacaa

SEQ ID NO: 932074 - RNA, 15 nt, Homo sapiens
uagcgauccauguaa

SEQ ID NO: 932075 - RNA, 17 nt, Homo sapiens
uaggaagaucucugcag

SEQ ID NO: 932076 - RNA, 21 nt, Homo sapiens
uaggccuccuggcccagguga

SEQ ID NO: 932077 - RNA, 12 nt, Homo sapiens
uagucacauggc

SEQ ID NO: 932078 - RNA, 21 nt, Homo sapiens
uagucacauggccuaugcaca

SEQ ID NO: 932079 - RNA, 22 nt, Homo sapiens
uagucacauggccuaugcacau

SEQ ID NO: 932080 - RNA, 20 nt, Homo sapiens
uaguugcguggacucugcac

SEQ ID NO: 932081 - RNA, 17 nt, Homo sapiens
uauagcuacuaauuuua

SEQ ID NO: 932082 - RNA, 14 nt, Homo sapiens
uaucauucagcaac

SEQ ID NO: 932083 - RNA, 16 nt, Homo sapiens
uauggccucaagauca

SEQ ID NO: 932084 - RNA, 20 nt, Homo sapiens
uauuaaaggaacacauaccu

SEQ ID NO: 932085 - RNA, 16 nt, Homo sapiens
uauuuuauagcuacua

SEQ ID NO: 932086 - RNA, 18 nt, Homo sapiens
uauuuugcauaguaccaa

SEQ ID NO: 932087 - RNA, 22 nt, Homo sapiens
uauuuugcauaguaccaaucau

SEQ ID NO: 932088 - RNA, 22 nt, Homo sapiens
ucaaaggagagucacagaacaa

SEQ ID NO: 932089 - RNA, 14 nt, Homo sapiens
ucaaauagcauaag

SEQ ID NO: 932090 - RNA, 22 nt, Homo sapiens
ucaagcuaauaaaauaucauuc

SEQ ID NO: 932091 - RNA, 19 nt, Homo sapiens
ucaaguccuacaagcuaaa

SEQ ID NO: 932092 - RNA, 18 nt, Homo sapiens
ucacauggccuaugcaca

SEQ ID NO: 932093 - RNA, 22 nt, Homo sapiens
ucacauggccuaugcacauaug

SEQ ID NO: 932094 - RNA, 12 nt, Homo sapiens
ucacuguaaaau

SEQ ID NO: 932095 - RNA, 12 nt, Homo sapiens
ucacuucacccu

SEQ ID NO: 932096 - RNA, 12 nt, Homo sapiens
ucacuucaugca

SEQ ID NO: 932097 - RNA, 19 nt, Homo sapiens
ucagaagggagcuagccag

SEQ ID NO: 932098 - RNA, 14 nt, Homo sapiens
ucagcuaaacacca

SEQ ID NO: 932099 - RNA, 22 nt, Homo sapiens
ucagugauugcaauuugcacaa

SEQ ID NO: 932100 - RNA, 16 nt, Homo sapiens
ucaugauuucauuuca

SEQ ID NO: 932101 - RNA, 13 nt, Homo sapiens
ucaugcaggugaa

SEQ ID NO: 932102 - RNA, 15 nt, Homo sapiens
ucauucacucaacaa

SEQ ID NO: 932103 - RNA, 14 nt, Homo sapiens
ucauuuacuguggc

SEQ ID NO: 932104 - RNA, 15 nt, Homo sapiens
uccaaguauuuugcc

SEQ ID NO: 932105 - RNA, 13 nt, Homo sapiens
uccagugcaggag

SEQ ID NO: 932106 - RNA, 17 nt, Homo sapiens
uccauuuuuagugaaau

SEQ ID NO: 932107 - RNA, 21 nt, Homo sapiens
ucccaacuuguauuaaagaca

SEQ ID NO: 932108 - RNA, 19 nt, Homo sapiens
ucccacccacaugugacac

SEQ ID NO: 932109 - RNA, 17 nt, Homo sapiens
ucccacccggcugcaua

SEQ ID NO: 932110 - RNA, 20 nt, Homo sapiens
ucccaggacacgacuuguaa

SEQ ID NO: 932111 - RNA, 12 nt, Homo sapiens
uccccaaagggu

SEQ ID NO: 932112 - RNA, 14 nt, Homo sapiens
uccuacaagcuaaa

SEQ ID NO: 932113 - RNA, 15 nt, Homo sapiens
uccuauaugcacuua

SEQ ID NO: 932114 - RNA, 20 nt, Homo sapiens
uccucaguuuuugugaaaag

SEQ ID NO: 932115 - RNA, 15 nt, Homo sapiens
uccuuucauuuacug

SEQ ID NO: 932116 - RNA, 18 nt, Homo sapiens
uccuuucauuuacugugg

SEQ ID NO: 932117 - RNA, 19 nt, Homo sapiens
ucgacuucgggcuggccau

SEQ ID NO: 932118 - RNA, 14 nt, Homo sapiens
ucuagacuaaaaga

SEQ ID NO: 932119 - RNA, 15 nt, Homo sapiens
ucuaggguuuuccaa

SEQ ID NO: 932120 - RNA, 23 nt, Homo sapiens
ucucaagaagaacaucuuuaugg

SEQ ID NO: 932121 - RNA, 14 nt, Homo sapiens
ucucacuugucuca

SEQ ID NO: 932122 - RNA, 21 nt, Homo sapiens
ucucuuuauauggccucaaga

SEQ ID NO: 932123 - RNA, 17 nt, Homo sapiens
ucugaagccucacuuau

SEQ ID NO: 932124 - RNA, 22 nt, Homo sapiens
ucugccugcaccccugcaguuu

SEQ ID NO: 932125 - RNA, 16 nt, Homo sapiens
ucuuaaucuuuucaca

SEQ ID NO: 932126 - RNA, 13 nt, Homo sapiens
ucuuggacacugu

SEQ ID NO: 932127 - RNA, 15 nt, Homo sapiens
ucuuuccucccugaa

SEQ ID NO: 932128 - RNA, 22 nt, Homo sapiens
ucuuuccucccugaagcugugc

SEQ ID NO: 932129 - RNA, 13 nt, Homo sapiens
ugaaaaaaagcuu

SEQ ID NO: 932130 - RNA, 20 nt, Homo sapiens
ugaaacccagucacugugag

SEQ ID NO: 932131 - RNA, 15 nt, Homo sapiens
ugaaagaaaauaaca

SEQ ID NO: 932132 - RNA, 17 nt, Homo sapiens
ugaagaauacacuguga

SEQ ID NO: 932133 - RNA, 19 nt, Homo sapiens
ugaagaauacacugugacu

SEQ ID NO: 932134 - RNA, 20 nt, Homo sapiens
ugaagacuuuuaaguuuccu

SEQ ID NO: 932135 - RNA, 16 nt, Homo sapiens
ugaaugaaagucuugu

SEQ ID NO: 932136 - RNA, 14 nt, Homo sapiens
ugacacauaugcac

SEQ ID NO: 932137 - RNA, 16 nt, Homo sapiens
ugacacauaugcaccu

SEQ ID NO: 932138 - RNA, 13 nt, Homo sapiens
ugacagagugccu

SEQ ID NO: 932139 - RNA, 22 nt, Homo sapiens
ugaccaggcauccuccacaaua

SEQ ID NO: 932140 - RNA, 17 nt, Homo sapiens
ugagaaguuacuuucca

SEQ ID NO: 932141 - RNA, 23 nt, Homo sapiens
ugagcucccaggugcagccagag

SEQ ID NO: 932142 - RNA, 21 nt, Homo sapiens
ugaggcauccacuucuuucag

SEQ ID NO: 932143 - RNA, 14 nt, Homo sapiens
ugaggcugcaccca

SEQ ID NO: 932144 - RNA, 16 nt, Homo sapiens
ugauagaguguuauca

SEQ ID NO: 932145 - RNA, 23 nt, Homo sapiens
ugaucaggaccuccaagccacug

SEQ ID NO: 932146 - RNA, 13 nt, Homo sapiens
ugcacaugaaucc

SEQ ID NO: 932147 - RNA, 22 nt, Homo sapiens
ugcaccuugugucuguacacgu

SEQ ID NO: 932148 - RNA, 19 nt, Homo sapiens
ugcacuacagcccuggccu

SEQ ID NO: 932149 - RNA, 13 nt, Homo sapiens
uaaucuuuucaca

SEQ ID NO: 932150 - RNA, 19 nt, Homo sapiens
uaauggaagcaucuagcau

SEQ ID NO: 932151 - RNA, 15 nt, Homo sapiens
uaaugucaauucuug

SEQ ID NO: 932152 - RNA, 13 nt, Homo sapiens
uaauguuacauua

SEQ ID NO: 932153 - RNA, 12 nt, Homo sapiens
uaauuagugaac

SEQ ID NO: 932154 - RNA, 13 nt, Homo sapiens
uacagaugggcaa

SEQ ID NO: 932155 - RNA, 14 nt, Homo sapiens
uacauggcucuaaa

SEQ ID NO: 932156 - RNA, 15 nt, Homo sapiens
uacauuaauuaccuu

SEQ ID NO: 932157 - RNA, 19 nt, Homo sapiens
uacauuagucauucaauaa

SEQ ID NO: 932158 - RNA, 14 nt, Homo sapiens
uaccaaucauuuua

SEQ ID NO: 932159 - RNA, 21 nt, Homo sapiens
uacccgggcagggcucccaca

SEQ ID NO: 932160 - RNA, 13 nt, Homo sapiens
uaccugggcauuc

SEQ ID NO: 932161 - RNA, 15 nt, Homo sapiens
uagagauuuggugua

SEQ ID NO: 932162 - RNA, 21 nt, Homo sapiens
uagagauuugguguacaauuc

SEQ ID NO: 932163 - RNA, 18 nt, Homo sapiens
uagccagaggacugugau

SEQ ID NO: 932164 - RNA, 16 nt, Homo sapiens
uaggaagaucucugca

SEQ ID NO: 932165 - RNA, 20 nt, Homo sapiens
uaggguuuuccaaugugacu

SEQ ID NO: 932166 - RNA, 23 nt, Homo sapiens
uagucuagacuaaaagauugaga

SEQ ID NO: 932167 - RNA, 22 nt, Homo sapiens
uaguugcguggacucugcacau

SEQ ID NO: 932168 - RNA, 18 nt, Homo sapiens
uauaaaggauuaauguca

SEQ ID NO: 932169 - RNA, 14 nt, Homo sapiens
uaucagucauaacu

SEQ ID NO: 932170 - RNA, 21 nt, Homo sapiens
uaugcaccuugugucuguaca

SEQ ID NO: 932171 - RNA, 12 nt, Homo sapiens
uauggacucugc

SEQ ID NO: 932172 - RNA, 17 nt, Homo sapiens
aaaaaauaacaaugaaa

SEQ ID NO: 932173 - RNA, 19 nt, Homo sapiens
aaaacaccuuguacuuuau

SEQ ID NO: 932174 - RNA, 16 nt, Homo sapiens
aaaauccuacuuucau

SEQ ID NO: 932175 - RNA, 17 nt, Homo sapiens
aaaauugugaucagacc

SEQ ID NO: 932176 - RNA, 21 nt, Homo sapiens
aaaauuucacuuaauaaugug

SEQ ID NO: 932177 - RNA, 22 nt, Homo sapiens
aaacaggcaguuggccagagag

SEQ ID NO: 932178 - RNA, 17 nt, Homo sapiens
aaacgcgaccuuggccg

SEQ ID NO: 932179 - RNA, 20 nt, Homo sapiens
aaacuaaagaaaaauuauua

SEQ ID NO: 932180 - RNA, 18 nt, Homo sapiens
aaagagagucgcaucuca

SEQ ID NO: 932181 - RNA, 20 nt, Homo sapiens
aaaguguuugaaagcuuuau

SEQ ID NO: 932182 - RNA, 19 nt, Homo sapiens
aaauacuucuugaagccga

SEQ ID NO: 932183 - RNA, 22 nt, Homo sapiens
aaauguuauuuuuuaauuauua

SEQ ID NO: 932184 - RNA, 15 nt, Homo sapiens
aaauuguauuacaaa

SEQ ID NO: 932185 - RNA, 15 nt, Homo sapiens
aacaccacgucacuu

SEQ ID NO: 932186 - RNA, 21 nt, Homo sapiens
aacauguuuaucguauuugau

SEQ ID NO: 932187 - RNA, 16 nt, Homo sapiens
aaccaagaaaaaggaa

SEQ ID NO: 932188 - RNA, 22 nt, Homo sapiens
aaccaugagaccacuguuauca

SEQ ID NO: 932189 - RNA, 16 nt, Homo sapiens
aaccggucacccagga

SEQ ID NO: 932190 - RNA, 14 nt, Homo sapiens
aacuaaauaaagcu

SEQ ID NO: 932191 - RNA, 23 nt, Homo sapiens
aacuuugacaaccaugagaccac

SEQ ID NO: 932192 - RNA, 23 nt, Homo sapiens
aagaaaguuuccccaccagugaa

SEQ ID NO: 932193 - RNA, 15 nt, Homo sapiens
aagaagccacagacc

SEQ ID NO: 932194 - RNA, 20 nt, Homo sapiens
aagaugggagcccaguuuca

SEQ ID NO: 932195 - RNA, 20 nt, Homo sapiens
aagcuaaaauuagaugaacu

SEQ ID NO: 932196 - RNA, 15 nt, Homo sapiens
aagcuuuaggaugac

SEQ ID NO: 932197 - RNA, 20 nt, Homo sapiens
aagcuuuaggaugacuguau

SEQ ID NO: 932198 - RNA, 20 nt, Homo sapiens
aaggauaaugaauacuuuau

SEQ ID NO: 932199 - RNA, 18 nt, Homo sapiens
aaggcacuaaaaagagcu

SEQ ID NO: 932200 - RNA, 19 nt, Homo sapiens
aaguguuugaaagcuuuau

SEQ ID NO: 932201 - RNA, 22 nt, Homo sapiens
aauaaaacaccuuguacuuuau

SEQ ID NO: 932202 - RNA, 14 nt, Homo sapiens
aauaauaccuaagc

SEQ ID NO: 932203 - RNA, 13 nt, Homo sapiens
aaucaaauagcau

SEQ ID NO: 932204 - RNA, 22 nt, Homo sapiens
aaucacucagugauugcaauuu

SEQ ID NO: 932205 - RNA, 19 nt, Homo sapiens
aaucauauaauaaauguac

SEQ ID NO: 932206 - RNA, 14 nt, Homo sapiens
aaucuuuucacaaa

SEQ ID NO: 932207 - RNA, 17 nt, Homo sapiens
aaucuuuucacaaauaa

SEQ ID NO: 932208 - RNA, 21 nt, Homo sapiens
aaugaagacucgcaauuucac

SEQ ID NO: 932209 - RNA, 16 nt, Homo sapiens
aaugcagucuguccag

SEQ ID NO: 932210 - RNA, 14 nt, Homo sapiens
aaugcuaagggcag

SEQ ID NO: 932211 - RNA, 19 nt, Homo sapiens
aaugucaauucuugccaaa

SEQ ID NO: 932212 - RNA, 14 nt, Homo sapiens
aauuagaugaacuc

SEQ ID NO: 932213 - RNA, 14 nt, Homo sapiens
aauuauuaaaggaa

SEQ ID NO: 932214 - RNA, 19 nt, Homo sapiens
aauugugaucagaccauaa

SEQ ID NO: 932215 - RNA, 15 nt, Homo sapiens
acaagcaaacccaga

SEQ ID NO: 932216 - RNA, 18 nt, Homo sapiens
acaauaacgauaaaagac

SEQ ID NO: 932217 - RNA, 18 nt, Homo sapiens
acaauagugauugauaga

SEQ ID NO: 932218 - RNA, 19 nt, Homo sapiens
acaccugauuaacugaggc

SEQ ID NO: 932219 - RNA, 20 nt, Homo sapiens
acacugcugcuccagugcag

SEQ ID NO: 932220 - RNA, 12 nt, Homo sapiens
acacugugacuu

SEQ ID NO: 932221 - RNA, 15 nt, Homo sapiens
acaggagaccuggca

SEQ ID NO: 932222 - RNA, 20 nt, Homo sapiens
acaguucggugagcuacaaa

SEQ ID NO: 932223 - RNA, 16 nt, Homo sapiens
acauauggacucugca

SEQ ID NO: 932224 - RNA, 15 nt, Homo sapiens
acaucaggaguucaa

SEQ ID NO: 932225 - RNA, 16 nt, Homo sapiens
acauccugugccucca

SEQ ID NO: 932226 - RNA, 17 nt, Homo sapiens
acauccugugccuccau

SEQ ID NO: 932227 - RNA, 18 nt, Homo sapiens
acaugaaucccacccaca

SEQ ID NO: 932228 - RNA, 14 nt, Homo sapiens
acauggccuaugca

SEQ ID NO: 932229 - RNA, 16 nt, Homo sapiens
acauggccuaugcaca

SEQ ID NO: 932230 - RNA, 19 nt, Homo sapiens
acaugucuuguacaugugu

SEQ ID NO: 932231 - RNA, 22 nt, Homo sapiens
acauguguagccugugcaugua

SEQ ID NO: 932232 - RNA, 14 nt, Homo sapiens
acauuagucauuca

SEQ ID NO: 932233 - RNA, 12 nt, Homo sapiens
accagugaauga

SEQ ID NO: 932234 - RNA, 19 nt, Homo sapiens
accaugagaccacuguuau

SEQ ID NO: 932235 - RNA, 13 nt, Homo sapiens
accauguacauga

SEQ ID NO: 932236 - RNA, 12 nt, Homo sapiens
acccacccagga

SEQ ID NO: 932237 - RNA, 16 nt, Homo sapiens
accguaggacccaagc

SEQ ID NO: 932238 - RNA, 20 nt, Homo sapiens
accuacuuuucuuuccucag

SEQ ID NO: 932239 - RNA, 14 nt, Homo sapiens
accuccaagccacu

SEQ ID NO: 932240 - RNA, 16 nt, Homo sapiens
accuccaagccacuga

SEQ ID NO: 932241 - RNA, 17 nt, Homo sapiens
accugauuaacugaggc

SEQ ID NO: 932242 - RNA, 16 nt, Homo sapiens
accugcgggagcugca

SEQ ID NO: 932243 - RNA, 19 nt, Homo sapiens
accuggcagccacaacugc

SEQ ID NO: 932244 - RNA, 19 nt, Homo sapiens
accuugaagaaccucucac

SEQ ID NO: 932245 - RNA, 15 nt, Homo sapiens
accuugugucuguac

SEQ ID NO: 932246 - RNA, 18 nt, Homo sapiens
accuuuggugcuuuccag

SEQ ID NO: 932247 - RNA, 17 nt, Homo sapiens
acgagauacagaauuuu

SEQ ID NO: 932248 - RNA, 17 nt, Homo sapiens
acgauaaaagacaguga

SEQ ID NO: 932249 - RNA, 12 nt, Homo sapiens
acgcagccagga

SEQ ID NO: 932250 - RNA, 16 nt, Homo sapiens
acgcaguaacuaaagc

SEQ ID NO: 932251 - RNA, 19 nt, Homo sapiens
acggaccaugcgacacugg

SEQ ID NO: 932252 - RNA, 14 nt, Homo sapiens
acuaaaagauugag

SEQ ID NO: 932253 - RNA, 16 nt, Homo sapiens
acucagugauugcaau

SEQ ID NO: 932254 - RNA, 14 nt, Homo sapiens
acucugcacaugaa

SEQ ID NO: 932255 - RNA, 19 nt, Homo sapiens
acugcugcuccagugcagg

SEQ ID NO: 932256 - RNA, 22 nt, Homo sapiens
acuggcagggacgaggacaaau

SEQ ID NO: 932257 - RNA, 17 nt, Homo sapiens
acuguauauacuuugcc

SEQ ID NO: 932258 - RNA, 19 nt, Homo sapiens
acugugagcucccaggugc

SEQ ID NO: 932259 - RNA, 24 nt, Homo sapiens
acuguggcuucuuaaucuuuucac

SEQ ID NO: 932260 - RNA, 17 nt, Homo sapiens
acuuaauaauguguaca

SEQ ID NO: 932261 - RNA, 18 nt, Homo sapiens
acuuccuauaugcacuua

SEQ ID NO: 932262 - RNA, 19 nt, Homo sapiens
acuuccuauaugcacuuau

SEQ ID NO: 932263 - RNA, 22 nt, Homo sapiens
acuugauuuuuuucauuuugcc

SEQ ID NO: 932264 - RNA, 18 nt, Homo sapiens
acuuuuaaguuuccuucc

SEQ ID NO: 932265 - RNA, 21 nt, Homo sapiens
agaaaauaacgauaaaagaca

SEQ ID NO: 932266 - RNA, 23 nt, Homo sapiens
agaauucauucacucaacaaaca

SEQ ID NO: 932267 - RNA, 13 nt, Homo sapiens
agacagugaaaga

SEQ ID NO: 932268 - RNA, 19 nt, Homo sapiens
agacaguguuuucugggau

SEQ ID NO: 932269 - RNA, 14 nt, Homo sapiens
agaccauaauguua

SEQ ID NO: 932270 - RNA, 16 nt, Homo sapiens
agaccauaauguuaca

SEQ ID NO: 932271 - RNA, 21 nt, Homo sapiens
agaccuggcacuggaugcaga

SEQ ID NO: 932272 - RNA, 20 nt, Homo sapiens
agacuuuacauggaugccaa

SEQ ID NO: 932273 - RNA, 13 nt, Homo sapiens
agagagccuggug

SEQ ID NO: 932274 - RNA, 14 nt, Homo sapiens
agagucgcaucuca

SEQ ID NO: 932275 - RNA, 20 nt, Homo sapiens
agaucauccagaaguuccuc

SEQ ID NO: 932276 - RNA, 20 nt, Homo sapiens
agaugggagcccaguuucac

SEQ ID NO: 932277 - RNA, 22 nt, Homo sapiens
agaugggcaaauuaaggcauaa

SEQ ID NO: 932278 - RNA, 21 nt, Homo sapiens
agauugagaaguuacuuucca

SEQ ID NO: 932279 - RNA, 22 nt, Homo sapiens
agauuuaauccuagagauuugg

SEQ ID NO: 932280 - RNA, 16 nt, Homo sapiens
agcaaccuucuugccu

SEQ ID NO: 932281 - RNA, 14 nt, Homo sapiens
agcaguaguggcau

SEQ ID NO: 932282 - RNA, 17 nt, Homo sapiens
agccagaggacugugau

SEQ ID NO: 932283 - RNA, 17 nt, Homo sapiens
agccagaggcaccucaa

SEQ ID NO: 932284 - RNA, 12 nt, Homo sapiens
agccucacuuau

SEQ ID NO: 932285 - RNA, 22 nt, Homo sapiens
agccugugcauguaugucuugg

SEQ ID NO: 932286 - RNA, 17 nt, Homo sapiens
agcuaauaaaauaucau

SEQ ID NO: 932287 - RNA, 12 nt, Homo sapiens
agcuagccagag

SEQ ID NO: 932288 - RNA, 14 nt, Homo sapiens
agcugcacuacagc

SEQ ID NO: 932289 - RNA, 14 nt, Homo sapiens
agcuugcaacaaaa

SEQ ID NO: 932290 - RNA, 18 nt, Homo sapiens
aggaaguaugguuuuauu

SEQ ID NO: 932291 - RNA, 11 nt, Homo sapiens
aggacccaagc

SEQ ID NO: 932292 - RNA, 22 nt, Homo sapiens
aggagaccuggcacuggaugca

SEQ ID NO: 932293 - RNA, 21 nt, Homo sapiens
aggagacuuuacauggaugcc

SEQ ID NO: 932294 - RNA, 13 nt, Homo sapiens
aggaugacuguau

SEQ ID NO: 932295 - RNA, 22 nt, Homo sapiens
aggaugauggccacaacaugaa

SEQ ID NO: 932296 - RNA, 14 nt, Homo sapiens
aggauggcaaagag

SEQ ID NO: 932297 - RNA, 20 nt, Homo sapiens
aggauugggaaaaaguaauu

SEQ ID NO: 932298 - RNA, 17 nt, Homo sapiens
aggcaguuggccagaga

SEQ ID NO: 932299 - RNA, 14 nt, Homo sapiens
agggccgcccgggc

SEQ ID NO: 932300 - RNA, 19 nt, Homo sapiens
agguaaaagcaucacauga

SEQ ID NO: 932301 - RNA, 14 nt, Homo sapiens
aggugaaacccagu

SEQ ID NO: 932302 - RNA, 20 nt, Homo sapiens
aggugaaacccagucacugu

SEQ ID NO: 932303 - RNA, 13 nt, Homo sapiens
aggugcagccaga

SEQ ID NO: 932304 - RNA, 22 nt, Homo sapiens
aguaaguuugauuucauuaaua

SEQ ID NO: 932305 - RNA, 22 nt, Homo sapiens
agucacauggccuaugcacaua

SEQ ID NO: 932306 - RNA, 24 nt, Homo sapiens
agugaaugaaagucuugugacuag

SEQ ID NO: 932307 - RNA, 18 nt, Homo sapiens
agugcaggagagacagug

SEQ ID NO: 932308 - RNA, 14 nt, Homo sapiens
agugugugucuuuc

SEQ ID NO: 932309 - RNA, 17 nt, Homo sapiens
aguguuaucagucauaa

SEQ ID NO: 932310 - RNA, 17 nt, Homo sapiens
aguguuugaaagcuuua

SEQ ID NO: 932311 - RNA, 19 nt, Homo sapiens
aguuacuuuccauugcuau

SEQ ID NO: 932312 - RNA, 18 nt, Homo sapiens
aguucauauguaccaugu

SEQ ID NO: 932313 - RNA, 17 nt, Homo sapiens
aguucggugagcuacaa

SEQ ID NO: 932314 - RNA, 18 nt, Homo sapiens
aguugcguggacucugca

SEQ ID NO: 932315 - RNA, 16 nt, Homo sapiens
aguugcugaugaacuc

SEQ ID NO: 932316 - RNA, 20 nt, Homo sapiens
aguuuccuuccagcccagaa

SEQ ID NO: 932317 - RNA, 13 nt, Homo sapiens
aguuugagacagg

SEQ ID NO: 932318 - RNA, 20 nt, Homo sapiens
aguuugagacaggagaccug

SEQ ID NO: 932319 - RNA, 15 nt, Homo sapiens
auaaaagacagugaa

SEQ ID NO: 932320 - RNA, 22 nt, Homo sapiens
auaaccguuuccuuucauuuac

SEQ ID NO: 932321 - RNA, 23 nt, Homo sapiens
auaaccguuuccuuucauuuacu

SEQ ID NO: 932322 - RNA, 17 nt, Homo sapiens
auaauguuacauuauua

SEQ ID NO: 932323 - RNA, 15 nt, Homo sapiens
auacucuucaaggac

SEQ ID NO: 932324 - RNA, 17 nt, Homo sapiens
auacucuucaaggacuu

SEQ ID NO: 932325 - RNA, 16 nt, Homo sapiens
auacugugugcuaaaa

SEQ ID NO: 932326 - RNA, 23 nt, Homo sapiens
auagcaguugaaacaagaagcca

SEQ ID NO: 932327 - RNA, 23 nt, Homo sapiens
auagucacauggccuaugcacau

SEQ ID NO: 932328 - RNA, 23 nt, Homo sapiens
auagugauugauagaguguuauc

SEQ ID NO: 932329 - RNA, 21 nt, Homo sapiens
auaugcacuuauucucaagaa

SEQ ID NO: 932330 - RNA, 13 nt, Homo sapiens
auauggcuugagu

SEQ ID NO: 932331 - RNA, 18 nt, Homo sapiens
aucaaugaaaugauguca

SEQ ID NO: 932332 - RNA, 17 nt, Homo sapiens
aucacuuccuauaugca

SEQ ID NO: 932333 - RNA, 22 nt, Homo sapiens
aucagaccauaauguuacauua

SEQ ID NO: 932334 - RNA, 16 nt, Homo sapiens
aucagcuaaacaccac

SEQ ID NO: 932335 - RNA, 20 nt, Homo sapiens
aucaggaccuccaagccacu

SEQ ID NO: 932336 - RNA, 19 nt, Homo sapiens
aucauccagaaguuccuca

SEQ ID NO: 932337 - RNA, 15 nt, Homo sapiens
auccugugccuccau

SEQ ID NO: 932338 - RNA, 15 nt, Homo sapiens
auccuuuacuguuag

SEQ ID NO: 932339 - RNA, 12 nt, Homo sapiens
aucucagugcag

SEQ ID NO: 932340 - RNA, 22 nt, Homo sapiens
aucugcuuuugguuauaaugug

SEQ ID NO: 932341 - RNA, 21 nt, Homo sapiens
augaaucccacccacauguga

SEQ ID NO: 932342 - RNA, 21 nt, Homo sapiens
augagaagaaaauggaaccag

SEQ ID NO: 932343 - RNA, 16 nt, Homo sapiens
augagguggagagugg

SEQ ID NO: 932344 - RNA, 20 nt, Homo sapiens
augauggcuuuaccuuuauu

SEQ ID NO: 932345 - RNA, 14 nt, Homo sapiens
augcacauauggac

SEQ ID NO: 932346 - RNA, 18 nt, Homo sapiens
augcagucuguccaggcu

SEQ ID NO: 932347 - RNA, 13 nt, Homo sapiens
auggacucugcac

SEQ ID NO: 932348 - RNA, 22 nt, Homo sapiens
auggaugccgugggaguacaaa

SEQ ID NO: 932349 - RNA, 20 nt, Homo sapiens
augggcaaauuaaggcauaa

SEQ ID NO: 932350 - RNA, 21 nt, Homo sapiens
auguacaugaagaagcuaaau

SEQ ID NO: 932351 - RNA, 17 nt, Homo sapiens
augucuuuaucaaagga

SEQ ID NO: 932352 - RNA, 17 nt, Homo sapiens
auguguucauucuggaa

SEQ ID NO: 932353 - RNA, 17 nt, Homo sapiens
auuacauggcucuaaaa

SEQ ID NO: 932354 - RNA, 16 nt, Homo sapiens
auuagaugaacucaac

SEQ ID NO: 932355 - RNA, 20 nt, Homo sapiens
auucuaaaugaauguuuaca

SEQ ID NO: 932356 - RNA, 21 nt, Homo sapiens
auugguccgaucuuugacucu

SEQ ID NO: 932357 - RNA, 11 nt, Homo sapiens
auuuacugugg

SEQ ID NO: 932358 - RNA, 12 nt, Homo sapiens
auuuacuguggc

SEQ ID NO: 932359 - RNA, 17 nt, Homo sapiens
auuuacuguggcuucuu

SEQ ID NO: 932360 - RNA, 12 nt, Homo sapiens
auuuauauaugu

SEQ ID NO: 932361 - RNA, 18 nt, Homo sapiens
auuucauuuuuacccuua

SEQ ID NO: 932362 - RNA, 19 nt, Homo sapiens
auuugcugagcauguacug

SEQ ID NO: 932363 - RNA, 15 nt, Homo sapiens
auuugguguacaauu

SEQ ID NO: 932364 - RNA, 14 nt, Homo sapiens
auuuucaguuauua

SEQ ID NO: 932365 - RNA, 18 nt, Homo sapiens
caaaaggauaaugaauac

SEQ ID NO: 932366 - RNA, 13 nt, Homo sapiens
caaacaggcaguu

SEQ ID NO: 932367 - RNA, 21 nt, Homo sapiens
caaacuggugugugccucauu

SEQ ID NO: 932368 - RNA, 15 nt, Homo sapiens
caaauuaaggcauaa

SEQ ID NO: 932369 - RNA, 14 nt, Homo sapiens
caacacugcugcuc

SEQ ID NO: 932370 - RNA, 18 nt, Homo sapiens
caaccggucacccaggag

SEQ ID NO: 932371 - RNA, 12 nt, Homo sapiens
caacuuugacaa

SEQ ID NO: 932372 - RNA, 18 nt, Homo sapiens
caagcuaauaaaauauca

SEQ ID NO: 932373 - RNA, 13 nt, Homo sapiens
caagggagaguga

SEQ ID NO: 932374 - RNA, 15 nt, Homo sapiens
caauguuacuaucug

SEQ ID NO: 932375 - RNA, 20 nt, Homo sapiens
cacaauagcaguugaaacaa

SEQ ID NO: 932376 - RNA, 14 nt, Homo sapiens
cacagcccagccac

SEQ ID NO: 932377 - RNA, 18 nt, Homo sapiens
cacauauggacucugcac

SEQ ID NO: 932378 - RNA, 23 nt, Homo sapiens
cacaugaaucccacccacaugug

SEQ ID NO: 932379 - RNA, 15 nt, Homo sapiens
cacaugcuacaagac

SEQ ID NO: 932380 - RNA, 19 nt, Homo sapiens
cacaugugacacauaugca

SEQ ID NO: 932381 - RNA, 16 nt, Homo sapiens
caccacgucacuucau

SEQ ID NO: 932382 - RNA, 14 nt, Homo sapiens
cacccacccaggag

SEQ ID NO: 932383 - RNA, 19 nt, Homo sapiens
cacccagcccccacauccu

SEQ ID NO: 932384 - RNA, 13 nt, Homo sapiens
caccccugcaguu

SEQ ID NO: 932385 - RNA, 19 nt, Homo sapiens
caccuuuggugcuuuccag

SEQ ID NO: 932386 - RNA, 13 nt, Homo sapiens
cacguguccugua

SEQ ID NO: 932387 - RNA, 14 nt, Homo sapiens
cacuggaugcagaa

SEQ ID NO: 932388 - RNA, 11 nt, Homo sapiens
cacuguacaag

SEQ ID NO: 932389 - RNA, 21 nt, Homo sapiens
cacuugugcaguguugacagu

SEQ ID NO: 932390 - RNA, 18 nt, Homo sapiens
cagaaucccguaacaccu

SEQ ID NO: 932391 - RNA, 22 nt, Homo sapiens
cagagagaggggagaagccugg

SEQ ID NO: 932392 - RNA, 14 nt, Homo sapiens
cagaggacugugau

SEQ ID NO: 932393 - RNA, 12 nt, Homo sapiens
cagcagacugau

SEQ ID NO: 932394 - RNA, 18 nt, Homo sapiens
caggagaccuggcacugg

SEQ ID NO: 932395 - RNA, 19 nt, Homo sapiens
caggagaccuggcacugga

SEQ ID NO: 932396 - RNA, 19 nt, Homo sapiens
caggaguucaauaaauguc

SEQ ID NO: 932397 - RNA, 21 nt, Homo sapiens
caggcuuuuuuccagacucua

SEQ ID NO: 932398 - RNA, 13 nt, Homo sapiens
cagggcacaaaga

SEQ ID NO: 932399 - RNA, 21 nt, Homo sapiens
cagucauaacuaaauaaagcu

SEQ ID NO: 932400 - RNA, 16 nt, Homo sapiens
caguucaccuugaaga

SEQ ID NO: 932401 - RNA, 16 nt, Homo sapiens
cauaagaaaacuaaga

SEQ ID NO: 932402 - RNA, 16 nt, Homo sapiens
cauagguuuaauaauu

SEQ ID NO: 932403 - RNA, 18 nt, Homo sapiens
cauauacucuucaaggac

SEQ ID NO: 932404 - RNA, 16 nt, Homo sapiens
cauauggacucugcac

SEQ ID NO: 932405 - RNA, 17 nt, Homo sapiens
cauauguaccauguaca

SEQ ID NO: 932406 - RNA, 21 nt, Homo sapiens
caucaagucuuucacauuuaa

SEQ ID NO: 932407 - RNA, 13 nt, Homo sapiens
caucucagugcag

SEQ ID NO: 932408 - RNA, 14 nt, Homo sapiens
caucucagugcagg

SEQ ID NO: 932409 - RNA, 15 nt, Homo sapiens
caucucagugcagga

SEQ ID NO: 932410 - RNA, 21 nt, Homo sapiens
caugauccaagcaagacugag

SEQ ID NO: 932411 - RNA, 12 nt, Homo sapiens
cauggaugccaa

SEQ ID NO: 932412 - RNA, 17 nt, Homo sapiens
cauggccuaugcacaua

SEQ ID NO: 932413 - RNA, 21 nt, Homo sapiens
cauggcuauaaacaauuacau

SEQ ID NO: 932414 - RNA, 15 nt, Homo sapiens
caugugacacauaug

SEQ ID NO: 932415 - RNA, 19 nt, Homo sapiens
caugugacacauaugcacc

SEQ ID NO: 932416 - RNA, 22 nt, Homo sapiens
caugugacacauaugcaccuug

SEQ ID NO: 932417 - RNA, 18 nt, Homo sapiens
cauguguagccugugcau

SEQ ID NO: 932418 - RNA, 12 nt, Homo sapiens
aaaaaagcuuuu

SEQ ID NO: 932419 - RNA, 12 nt, Homo sapiens
aaaaauuauuaa

SEQ ID NO: 932420 - RNA, 19 nt, Homo sapiens
aaaagcaucacaugaacuu

SEQ ID NO: 932421 - RNA, 20 nt, Homo sapiens
aaaaggcuaagcuucacugu

SEQ ID NO: 932422 - RNA, 18 nt, Homo sapiens
aaacaccuuguacuuuau

SEQ ID NO: 932423 - RNA, 22 nt, Homo sapiens
aaacauguuuaucguauuugau

SEQ ID NO: 932424 - RNA, 12 nt, Homo sapiens
aaagacagugaa

SEQ ID NO: 932425 - RNA, 20 nt, Homo sapiens
aaaguugauaaguacaugau

SEQ ID NO: 932426 - RNA, 15 nt, Homo sapiens
aaauaaugauuuaac

SEQ ID NO: 932427 - RNA, 15 nt, Homo sapiens
aaauacuucuugaag

SEQ ID NO: 932428 - RNA, 16 nt, Homo sapiens
aaauguacauuaauua

SEQ ID NO: 932429 - RNA, 15 nt, Homo sapiens
aaauuucagcagcug

SEQ ID NO: 932430 - RNA, 13 nt, Homo sapiens
aacacugcugcuc

SEQ ID NO: 932431 - RNA, 21 nt, Homo sapiens
aacacugcugcuccagugcag

SEQ ID NO: 932432 - RNA, 12 nt, Homo sapiens
aacaggcaguug

SEQ ID NO: 932433 - RNA, 17 nt, Homo sapiens
aacccagucacugugag

SEQ ID NO: 932434 - RNA, 17 nt, Homo sapiens
aacuaagaaauaugcac

SEQ ID NO: 932435 - RNA, 16 nt, Homo sapiens
aagaacaucuuuaugg

SEQ ID NO: 932436 - RNA, 13 nt, Homo sapiens
aagaaccucucac

SEQ ID NO: 932437 - RNA, 22 nt, Homo sapiens
aagaauacacugugacuuaaga

SEQ ID NO: 932438 - RNA, 17 nt, Homo sapiens
aagagagucgcaucuca

SEQ ID NO: 932439 - RNA, 23 nt, Homo sapiens
aagagagucgcaucucagugcag

SEQ ID NO: 932440 - RNA, 14 nt, Homo sapiens
aagaguggaaccaa

SEQ ID NO: 932441 - RNA, 13 nt, Homo sapiens
aagcaaacccaga

SEQ ID NO: 932442 - RNA, 14 nt, Homo sapiens
aaggcuaagcuuca

SEQ ID NO: 932443 - RNA, 17 nt, Homo sapiens
aagggagcuagccagag

SEQ ID NO: 932444 - RNA, 17 nt, Homo sapiens
aagggauggggugccag

SEQ ID NO: 932445 - RNA, 19 nt, Homo sapiens
aaguaauuccguagguuau

SEQ ID NO: 932446 - RNA, 14 nt, Homo sapiens
aagucucuuuauau

SEQ ID NO: 932447 - RNA, 17 nt, Homo sapiens
aaguugcugaugaacuc

SEQ ID NO: 932448 - RNA, 20 nt, Homo sapiens
aaguugcugaugaacucuua

SEQ ID NO: 932449 - RNA, 14 nt, Homo sapiens
aaguuuaugguugu

SEQ ID NO: 932450 - RNA, 19 nt, Homo sapiens
aaguuuccccaccagugaa

SEQ ID NO: 932451 - RNA, 14 nt, Homo sapiens
aaguuuccuuccag

SEQ ID NO: 932452 - RNA, 19 nt, Homo sapiens
aaguuuggggacaugugau

SEQ ID NO: 932453 - RNA, 13 nt, Homo sapiens
aauaaacuaaaga

SEQ ID NO: 932454 - RNA, 13 nt, Homo sapiens
aauaaaggaugau

SEQ ID NO: 932455 - RNA, 16 nt, Homo sapiens
aauaauguguacauua

SEQ ID NO: 932456 - RNA, 18 nt, Homo sapiens
aauaauuuuuagaaucuc

SEQ ID NO: 932457 - RNA, 14 nt, Homo sapiens
aaucaagauuuaau

SEQ ID NO: 932458 - RNA, 14 nt, Homo sapiens
aaucacucagugau

SEQ ID NO: 932459 - RNA, 17 nt, Homo sapiens
aaucauuuuaauuauua

SEQ ID NO: 932460 - RNA, 17 nt, Homo sapiens
aaucccacccacaugug

SEQ ID NO: 932461 - RNA, 15 nt, Homo sapiens
aauccuuuacuguua

SEQ ID NO: 932462 - RNA, 19 nt, Homo sapiens
aauccuuuacuguuaguca

SEQ ID NO: 932463 - RNA, 20 nt, Homo sapiens
aaucugacgucaucuugucu

SEQ ID NO: 932464 - RNA, 14 nt, Homo sapiens
aaugaauacuuuau

SEQ ID NO: 932465 - RNA, 14 nt, Homo sapiens
aaugaauguuuaca

SEQ ID NO: 932466 - RNA, 15 nt, Homo sapiens
aaugcagucugucca

SEQ ID NO: 932467 - RNA, 12 nt, Homo sapiens
aauggaaccagg

SEQ ID NO: 932468 - RNA, 15 nt, Homo sapiens
aauguuacauuauua

SEQ ID NO: 932469 - RNA, 16 nt, Homo sapiens
aauguuacauuauuau

SEQ ID NO: 932470 - RNA, 18 nt, Homo sapiens
aauguuacauuauuauca

SEQ ID NO: 932471 - RNA, 21 nt, Homo sapiens
aauguuauuuuuuaauuauua

SEQ ID NO: 932472 - RNA, 22 nt, Homo sapiens
aauguuauuuuuuaauuauuau

SEQ ID NO: 932473 - RNA, 14 nt, Homo sapiens
aauguuuacacucu

SEQ ID NO: 932474 - RNA, 21 nt, Homo sapiens
aauuucacgacacacuuugau

SEQ ID NO: 932475 - RNA, 14 nt, Homo sapiens
acaaaaccacugga

SEQ ID NO: 932476 - RNA, 13 nt, Homo sapiens
aaaagacagugaa

SEQ ID NO: 932477 - RNA, 22 nt, Homo sapiens
aaaaggcuaagcuucacuguaa

SEQ ID NO: 932478 - RNA, 15 nt, Homo sapiens
aaaaucuuauaauuu

SEQ ID NO: 932479 - RNA, 14 nt, Homo sapiens
aaacauuucuuuca

SEQ ID NO: 932480 - RNA, 16 nt, Homo sapiens
aaacccagucacugug

SEQ ID NO: 932481 - RNA, 20 nt, Homo sapiens
aaacuuuccucuuccugccu

SEQ ID NO: 932482 - RNA, 18 nt, Homo sapiens
aaagagugaaggauuuau

SEQ ID NO: 932483 - RNA, 22 nt, Homo sapiens
aaagauugagaaguuacuuucc

SEQ ID NO: 932484 - RNA, 21 nt, Homo sapiens
aaagcuccauuuuuagugaaa

SEQ ID NO: 932485 - RNA, 22 nt, Homo sapiens
aaaggcuaagcuucacuguaaa

SEQ ID NO: 932486 - RNA, 21 nt, Homo sapiens
aaaguuuccccaccagugaau

SEQ ID NO: 932487 - RNA, 15 nt, Homo sapiens
aaaugucuugcuuga

SEQ ID NO: 932488 - RNA, 13 nt, Homo sapiens
aaauuucacuuaa

SEQ ID NO: 932489 - RNA, 16 nt, Homo sapiens
aacaagcaaacccaga

SEQ ID NO: 932490 - RNA, 22 nt, Homo sapiens
aacaguuuuuuaugcuaaucag

SEQ ID NO: 932491 - RNA, 14 nt, Homo sapiens
aaccaacacuaaca

SEQ ID NO: 932492 - RNA, 14 nt, Homo sapiens
aacccagucacugu

SEQ ID NO: 932493 - RNA, 22 nt, Homo sapiens
aacccagucacugugagcuccc

SEQ ID NO: 932494 - RNA, 20 nt, Homo sapiens
aaccguuuccuuucauuuac

SEQ ID NO: 932495 - RNA, 19 nt, Homo sapiens
aacgauaaaagacagugaa

SEQ ID NO: 932496 - RNA, 22 nt, Homo sapiens
aacuaaagcuuuaggaugacug

SEQ ID NO: 932497 - RNA, 19 nt, Homo sapiens
aacuaagaaauaugcacaa

SEQ ID NO: 932498 - RNA, 23 nt, Homo sapiens
aacugcugagagacagagcuauu

SEQ ID NO: 932499 - RNA, 16 nt, Homo sapiens
aagaauacacugugac

SEQ ID NO: 932500 - RNA, 22 nt, Homo sapiens
aagacucuacccauauuacaga

SEQ ID NO: 932501 - RNA, 23 nt, Homo sapiens
aagacuucgcgcauaucacuaau

SEQ ID NO: 932502 - RNA, 13 nt, Homo sapiens
aagccacugagca

SEQ ID NO: 932503 - RNA, 22 nt, Homo sapiens
aagcuaaauccuuuacuguuag

SEQ ID NO: 932504 - RNA, 18 nt, Homo sapiens
aaggaacacauaccuuug

SEQ ID NO: 932505 - RNA, 17 nt, Homo sapiens
aaguaaguuugauuuca

SEQ ID NO: 932506 - RNA, 16 nt, Homo sapiens
aagucggaucuagucc

SEQ ID NO: 932507 - RNA, 14 nt, Homo sapiens
aaguuacuuuccau

SEQ ID NO: 932508 - RNA, 17 nt, Homo sapiens
aaguugcauagguuuaa

SEQ ID NO: 932509 - RNA, 14 nt, Homo sapiens
aauaaacuaaagaa

SEQ ID NO: 932510 - RNA, 14 nt, Homo sapiens
aauaaagcuugcaa

SEQ ID NO: 932511 - RNA, 16 nt, Homo sapiens
aauaaauguacauuaa

SEQ ID NO: 932512 - RNA, 16 nt, Homo sapiens
aauaacaauaaaagac

SEQ ID NO: 932513 - RNA, 16 nt, Homo sapiens
aauaacgauaaaagac

SEQ ID NO: 932514 - RNA, 23 nt, Homo sapiens
aauaauccucaguuuuugugaaa

SEQ ID NO: 932515 - RNA, 19 nt, Homo sapiens
aauaugcacaauagcaguu

SEQ ID NO: 932516 - RNA, 15 nt, Homo sapiens
aaucacucagugauu

SEQ ID NO: 932517 - RNA, 15 nt, Homo sapiens
aaugaaaugaguuuu

SEQ ID NO: 932518 - RNA, 17 nt, Homo sapiens
aaugcauuauggguggu

SEQ ID NO: 932519 - RNA, 13 nt, Homo sapiens
aauuagaugaacu

SEQ ID NO: 932520 - RNA, 17 nt, Homo sapiens
aauugccuucauuuuau

SEQ ID NO: 932521 - RNA, 12 nt, Homo sapiens
aauuucacuuaa

SEQ ID NO: 932522 - RNA, 12 nt, Homo sapiens
acaagaagccac

SEQ ID NO: 932523 - RNA, 13 nt, Homo sapiens
acaauaaaagaca

SEQ ID NO: 932524 - RNA, 17 nt, Homo sapiens
acacaucaggaguucaa

SEQ ID NO: 932525 - RNA, 15 nt, Homo sapiens
acacguguccuguag

SEQ ID NO: 932526 - RNA, 15 nt, Homo sapiens
acacuaacauauaau

SEQ ID NO: 932527 - RNA, 18 nt, Homo sapiens
acacuaacauauaauguu

SEQ ID NO: 932528 - RNA, 12 nt, Homo sapiens
acacugcugcuc

SEQ ID NO: 932529 - RNA, 19 nt, Homo sapiens
acacugcugcuccagugca

SEQ ID NO: 932530 - RNA, 15 nt, Homo sapiens
acagggcaccugcca

SEQ ID NO: 932531 - RNA, 14 nt, Homo sapiens
acaguaaaauccac

SEQ ID NO: 932532 - RNA, 14 nt, Homo sapiens
acagugaggcugca

SEQ ID NO: 932533 - RNA, 20 nt, Homo sapiens
acauauggacucugcacaug

SEQ ID NO: 932534 - RNA, 17 nt, Homo sapiens
acauggccuaugcacau

SEQ ID NO: 932535 - RNA, 19 nt, Homo sapiens
acauggccuaugcacauau

SEQ ID NO: 932536 - RNA, 15 nt, Homo sapiens
acaugugacacauau

SEQ ID NO: 932537 - RNA, 13 nt, Homo sapiens
acauuucuuucaa

SEQ ID NO: 932538 - RNA, 13 nt, Homo sapiens
accauaauguuac

SEQ ID NO: 932539 - RNA, 21 nt, Homo sapiens
accaugagaccacuguuauca

SEQ ID NO: 932540 - RNA, 15 nt, Homo sapiens
acccagucacuguga

SEQ ID NO: 932541 - RNA, 21 nt, Homo sapiens
acccuggagcccauccagucu

SEQ ID NO: 932542 - RNA, 23 nt, Homo sapiens
acccuggagcccauccagucucc

SEQ ID NO: 932543 - RNA, 23 nt, Homo sapiens
acccugggccuggcagcucagcu

SEQ ID NO: 932544 - RNA, 16 nt, Homo sapiens
accggguggaagggau

SEQ ID NO: 932545 - RNA, 13 nt, Homo sapiens
accuaggauuuca

SEQ ID NO: 932546 - RNA, 17 nt, Homo sapiens
accucagggcacaaaga

SEQ ID NO: 932547 - RNA, 12 nt, Homo sapiens
accucaguuuua

SEQ ID NO: 932548 - RNA, 22 nt, Homo sapiens
acgcacaugcgaccccgaggaa

SEQ ID NO: 932549 - RNA, 15 nt, Homo sapiens
acgcagccaggacac

SEQ ID NO: 932550 - RNA, 14 nt, Homo sapiens
acgucacuucaugc

SEQ ID NO: 932551 - RNA, 15 nt, Homo sapiens
acuaagaaauaugca

SEQ ID NO: 932552 - RNA, 21 nt, Homo sapiens
acucagugauugcaauuugca

SEQ ID NO: 932553 - RNA, 13 nt, Homo sapiens
acucgcaauuuca

SEQ ID NO: 932554 - RNA, 12 nt, Homo sapiens
acucugcacaug

SEQ ID NO: 932555 - RNA, 19 nt, Homo sapiens
acucugcacaugucuugua

SEQ ID NO: 932556 - RNA, 15 nt, Homo sapiens
acugaggcauccacu

SEQ ID NO: 932557 - RNA, 11 nt, Homo sapiens
acuguggcuuc

SEQ ID NO: 932558 - RNA, 15 nt, Homo sapiens
acuguggcuucuuaa

SEQ ID NO: 932559 - RNA, 23 nt, Homo sapiens
acuguggcuucuuaaucuuuuca

SEQ ID NO: 932560 - RNA, 15 nt, Homo sapiens
acuuaagaagccuua

SEQ ID NO: 932561 - RNA, 20 nt, Homo sapiens
acuuaauaauguguacauua

SEQ ID NO: 932562 - RNA, 15 nt, Homo sapiens
acuuauucucaagaa

SEQ ID NO: 932563 - RNA, 23 nt, Homo sapiens
acuuggggagauggaguucuugu

SEQ ID NO: 932564 - RNA, 21 nt, Homo sapiens
acuuucugaagccucacuuau

SEQ ID NO: 932565 - RNA, 17 nt, Homo sapiens
acuuuuaaguugcugau

SEQ ID NO: 932566 - RNA, 22 nt, Homo sapiens
acuuuuaaguugcugaugaacu

SEQ ID NO: 932567 - RNA, 20 nt, Homo sapiens
agaaaauaacaauaaaagac

SEQ ID NO: 932568 - RNA, 20 nt, Homo sapiens
agaaaauaacgauaaaagac

SEQ ID NO: 932569 - RNA, 22 nt, Homo sapiens
agaaaguuuccccaccagugaa

SEQ ID NO: 932570 - RNA, 13 nt, Homo sapiens
agaaguuccucaa

SEQ ID NO: 932571 - RNA, 15 nt, Homo sapiens
agaccacuguuauca

SEQ ID NO: 932572 - RNA, 13 nt, Homo sapiens
agaccucagggca

SEQ ID NO: 932573 - RNA, 19 nt, Homo sapiens
agaccuguaaucauauaau

SEQ ID NO: 932574 - RNA, 19 nt, Homo sapiens
agagagccuggugcugcug

SEQ ID NO: 932575 - RNA, 19 nt, Homo sapiens
agaucaaugaaaugauguc

SEQ ID NO: 932576 - RNA, 22 nt, Homo sapiens
agaucaaugaaaugaugucaua

SEQ ID NO: 932577 - RNA, 12 nt, Homo sapiens
agcaaacccaga

SEQ ID NO: 932578 - RNA, 13 nt, Homo sapiens
agcaauguauaac

SEQ ID NO: 932579 - RNA, 21 nt, Homo sapiens
agcaguugaaacaagaagcca

SEQ ID NO: 932580 - RNA, 18 nt, Homo sapiens
agcauaaguuucugggac

SEQ ID NO: 932581 - RNA, 16 nt, Homo sapiens
agcaugucgucaaagc

SEQ ID NO: 932582 - RNA, 21 nt, Homo sapiens
agcaugucgucaaagcugaaa

SEQ ID NO: 932583 - RNA, 15 nt, Homo sapiens
agccacaacugcagu

SEQ ID NO: 932584 - RNA, 16 nt, Homo sapiens
agcccauccagucucc

SEQ ID NO: 932585 - RNA, 19 nt, Homo sapiens
agccuggcucccaggacac

SEQ ID NO: 932586 - RNA, 15 nt, Homo sapiens
agccuggugcugcug

SEQ ID NO: 932587 - RNA, 16 nt, Homo sapiens
agccuggugcugcugc

SEQ ID NO: 932588 - RNA, 14 nt, Homo sapiens
agcuacugacuaug

SEQ ID NO: 932589 - RNA, 13 nt, Homo sapiens
agcuccucacuca

SEQ ID NO: 932590 - RNA, 18 nt, Homo sapiens
agcugcuccccucugcac

SEQ ID NO: 932591 - RNA, 22 nt, Homo sapiens
aggacuuuaucuaauaccucug

SEQ ID NO: 932592 - RNA, 18 nt, Homo sapiens
aggauggcaaagagaguc

SEQ ID NO: 932593 - RNA, 17 nt, Homo sapiens
aggcaccucaagaagaa

SEQ ID NO: 932594 - RNA, 13 nt, Homo sapiens
aggcacuaaaaag

SEQ ID NO: 932595 - RNA, 19 nt, Homo sapiens
ugucuuggacacuguacaa

SEQ ID NO: 932596 - RNA, 22 nt, Homo sapiens
uguggcuucuuaaucuuuucac

SEQ ID NO: 932597 - RNA, 19 nt, Homo sapiens
uguguacauuagucauuca

SEQ ID NO: 932598 - RNA, 12 nt, Homo sapiens
ugugucuguaca

SEQ ID NO: 932599 - RNA, 13 nt, Homo sapiens
ugugucuguacac

SEQ ID NO: 932600 - RNA, 20 nt, Homo sapiens
uguuaucagucauaacuaaa

SEQ ID NO: 932601 - RNA, 18 nt, Homo sapiens
uuaaacuuaccugggcau

SEQ ID NO: 932602 - RNA, 16 nt, Homo sapiens
auaauguuacauuauu

SEQ ID NO: 932603 - RNA, 17 nt, Homo sapiens
auagauaggucagugca

SEQ ID NO: 932604 - RNA, 21 nt, Homo sapiens
auaggucagugcaaauacucu

SEQ ID NO: 932605 - RNA, 15 nt, Homo sapiens
auagucacauggccu

SEQ ID NO: 932606 - RNA, 21 nt, Homo sapiens
auaugcacaauagcaguugaa

SEQ ID NO: 932607 - RNA, 18 nt, Homo sapiens
auaugcaccuugugucug

SEQ ID NO: 932608 - RNA, 19 nt, Homo sapiens
auaugcacuuauucucaag

SEQ ID NO: 932609 - RNA, 21 nt, Homo sapiens
auauggacucugcacaugaau

SEQ ID NO: 932610 - RNA, 17 nt, Homo sapiens
auauggcuugaguuuaa

SEQ ID NO: 932611 - RNA, 16 nt, Homo sapiens
auauuuugcauaguac

SEQ ID NO: 932612 - RNA, 22 nt, Homo sapiens
aucaagauuuaauccuagagau

SEQ ID NO: 932613 - RNA, 16 nt, Homo sapiens
aucaaugaaaugaugu

SEQ ID NO: 932614 - RNA, 12 nt, Homo sapiens
aucaauguuucu

SEQ ID NO: 932615 - RNA, 16 nt, Homo sapiens
aucagaccauaauguu

SEQ ID NO: 932616 - RNA, 17 nt, Homo sapiens
aucagggaggucauuuu

SEQ ID NO: 932617 - RNA, 17 nt, Homo sapiens
aucccacccacauguga

SEQ ID NO: 932618 - RNA, 22 nt, Homo sapiens
auccucugagugugaccaggca

SEQ ID NO: 932619 - RNA, 13 nt, Homo sapiens
auccuuuacuguu

SEQ ID NO: 932620 - RNA, 15 nt, Homo sapiens
aucuuuucacaaaua

SEQ ID NO: 932621 - RNA, 16 nt, Homo sapiens
aucuuuucacaaauaa

SEQ ID NO: 932622 - RNA, 22 nt, Homo sapiens
augaacuuguaaaggaauuuaa

SEQ ID NO: 932623 - RNA, 23 nt, Homo sapiens
augaauguuuacacucuuuguaa

SEQ ID NO: 932624 - RNA, 16 nt, Homo sapiens
augagaccacuguuau

SEQ ID NO: 932625 - RNA, 22 nt, Homo sapiens
augauccaagcaagacugaggg

SEQ ID NO: 932626 - RNA, 21 nt, Homo sapiens
augcuacaagacgggcaaaau

SEQ ID NO: 932627 - RNA, 12 nt, Homo sapiens
auggaagcaucu

SEQ ID NO: 932628 - RNA, 13 nt, Homo sapiens
auggccucaagau

SEQ ID NO: 932629 - RNA, 16 nt, Homo sapiens
auggcuaccaaaaaga

SEQ ID NO: 932630 - RNA, 20 nt, Homo sapiens
auggcuauaaacaauuacau

SEQ ID NO: 932631 - RNA, 22 nt, Homo sapiens
auguaugucuuggacacuguac

SEQ ID NO: 932632 - RNA, 18 nt, Homo sapiens
auguguagccugugcaug

SEQ ID NO: 932633 - RNA, 14 nt, Homo sapiens
auuaaagacagagg

SEQ ID NO: 932634 - RNA, 16 nt, Homo sapiens
auuaucuaaaguauga

SEQ ID NO: 932635 - RNA, 18 nt, Homo sapiens
auuauuauucuucauaac

SEQ ID NO: 932636 - RNA, 21 nt, Homo sapiens
auucuccauguacuggcaaga

SEQ ID NO: 932637 - RNA, 16 nt, Homo sapiens
aaaaauccuacuuuca

SEQ ID NO: 932638 - RNA, 20 nt, Homo sapiens
aaaaccacuggaaaguuuau

SEQ ID NO: 932639 - RNA, 18 nt, Homo sapiens
aaacauucaggagcuucc

SEQ ID NO: 932640 - RNA, 19 nt, Homo sapiens
aaagagagucgcaucucag

SEQ ID NO: 932641 - RNA, 21 nt, Homo sapiens
aaaggauaaugaauacuuuau

SEQ ID NO: 932642 - RNA, 15 nt, Homo sapiens
aaagucuugugacua

SEQ ID NO: 932643 - RNA, 18 nt, Homo sapiens
aaauagucuagacuaaaa

SEQ ID NO: 932644 - RNA, 21 nt, Homo sapiens
aaauuucacuuaauaaugugu

SEQ ID NO: 932645 - RNA, 17 nt, Homo sapiens
aacaauuacauggcucu

SEQ ID NO: 932646 - RNA, 21 nt, Homo sapiens
aacaauuacauggcucuaaaa

SEQ ID NO: 932647 - RNA, 23 nt, Homo sapiens
aacaauuuuaggaggaccagagc

SEQ ID NO: 932648 - RNA, 17 nt, Homo sapiens
aacaccacgucacuuca

SEQ ID NO: 932649 - RNA, 18 nt, Homo sapiens
aacaccacgucacuucau

SEQ ID NO: 932650 - RNA, 21 nt, Homo sapiens
aacaccugauuaacugaggca

SEQ ID NO: 932651 - RNA, 23 nt, Homo sapiens
aaccguuuccuuucauuuacugu

SEQ ID NO: 932652 - RNA, 16 nt, Homo sapiens
aacucaacuuugacaa

SEQ ID NO: 932653 - RNA, 18 nt, Homo sapiens
aacuuguauuaaagacag

SEQ ID NO: 932654 - RNA, 18 nt, Homo sapiens
aagaaacugcucuaauau

SEQ ID NO: 932655 - RNA, 15 nt, Homo sapiens
aagaauacacuguga

SEQ ID NO: 932656 - RNA, 19 nt, Homo sapiens
aagaauacacugugacuua

SEQ ID NO: 932657 - RNA, 16 nt, Homo sapiens
aagacucgcaauuuca

SEQ ID NO: 932658 - RNA, 13 nt, Homo sapiens
aagaucucugcag

SEQ ID NO: 932659 - RNA, 22 nt, Homo sapiens
aagcuaaaauuagaugaacuca

SEQ ID NO: 932660 - RNA, 15 nt, Homo sapiens
aagcuuauuaaugcu

SEQ ID NO: 932661 - RNA, 20 nt, Homo sapiens
aagcuuuuuuugaaucauca

SEQ ID NO: 932662 - RNA, 21 nt, Homo sapiens
aaggacuuucugaagccucac

SEQ ID NO: 932663 - RNA, 15 nt, Homo sapiens
aagggcaggcccaaa

SEQ ID NO: 932664 - RNA, 12 nt, Homo sapiens
aaguauuuugcc

SEQ ID NO: 932665 - RNA, 14 nt, Homo sapiens
aaguauuuugccac

SEQ ID NO: 932666 - RNA, 19 nt, Homo sapiens
aaguccuacaagcuaaaau

SEQ ID NO: 932667 - RNA, 19 nt, Homo sapiens
aagucuugugacuagugcu

SEQ ID NO: 932668 - RNA, 20 nt, Homo sapiens
aaguuacuuuccauugcuau

SEQ ID NO: 932669 - RNA, 23 nt, Homo sapiens
aauaacgauaaaagacagugaaa

SEQ ID NO: 932670 - RNA, 12 nt, Homo sapiens
aauaaugauuua

SEQ ID NO: 932671 - RNA, 18 nt, Homo sapiens
aauacaaagaaccaagaa

SEQ ID NO: 932672 - RNA, 18 nt, Homo sapiens
aauccuuuacuguuaguc

SEQ ID NO: 932673 - RNA, 13 nt, Homo sapiens
aaucuuuucacaa

SEQ ID NO: 932674 - RNA, 19 nt, Homo sapiens
aaugcauuucuaaagccau

SEQ ID NO: 932675 - RNA, 20 nt, Homo sapiens
aauggagggaauaauaccua

SEQ ID NO: 932676 - RNA, 17 nt, Homo sapiens
aauuaucaagcuaauaa

SEQ ID NO: 932677 - RNA, 21 nt, Homo sapiens
aauuaucuaaaguaugaagca

SEQ ID NO: 932678 - RNA, 21 nt, Homo sapiens
aauuauuauuuauauauguau

SEQ ID NO: 932679 - RNA, 13 nt, Homo sapiens
aauucuugccaaa

SEQ ID NO: 932680 - RNA, 19 nt, Homo sapiens
aauuguauuacaaauccaa

SEQ ID NO: 932681 - RNA, 17 nt, Homo sapiens
aauugugaucagaccau

SEQ ID NO: 932682 - RNA, 14 nt, Homo sapiens
aauuuaaaaauccu

SEQ ID NO: 932683 - RNA, 17 nt, Homo sapiens
aauuuaaaauaugcucu

SEQ ID NO: 932684 - RNA, 20 nt, Homo sapiens
aauuucacuuaauaaugugu

SEQ ID NO: 932685 - RNA, 22 nt, Homo sapiens
acaaauccaaugaaaugaguuu

SEQ ID NO: 932686 - RNA, 18 nt, Homo sapiens
acaagcacuaaacaaaga

SEQ ID NO: 932687 - RNA, 19 nt, Homo sapiens
acaauaacgauaaaagaca

SEQ ID NO: 932688 - RNA, 13 nt, Homo sapiens
acacauaugcacc

SEQ ID NO: 932689 - RNA, 23 nt, Homo sapiens
acacccuauauuuugcauaguac

SEQ ID NO: 932690 - RNA, 14 nt, Homo sapiens
acacuaacauauaa

SEQ ID NO: 932691 - RNA, 18 nt, Homo sapiens
acacugcugcuccagugc

SEQ ID NO: 932692 - RNA, 14 nt, Homo sapiens
acacugugacuuaa

SEQ ID NO: 932693 - RNA, 20 nt, Homo sapiens
acagaccuaggauuucauga

SEQ ID NO: 932694 - RNA, 17 nt, Homo sapiens
acagcugccucugccac

SEQ ID NO: 932695 - RNA, 23 nt, Homo sapiens
acauccugugccuccaucagcua

SEQ ID NO: 932696 - RNA, 23 nt, Homo sapiens
acaugaaucccacccacauguga

SEQ ID NO: 932697 - RNA, 17 nt, Homo sapiens
acaugugacacauaugc

SEQ ID NO: 932698 - RNA, 18 nt, Homo sapiens
acaugugacacauaugca

SEQ ID NO: 932699 - RNA, 19 nt, Homo sapiens
acauguguagccugugcau

SEQ ID NO: 932700 - RNA, 15 nt, Homo sapiens
acauuagucauucaa

SEQ ID NO: 932701 - RNA, 20 nt, Homo sapiens
acauucaggagcuuccuguc

SEQ ID NO: 932702 - RNA, 14 nt, Homo sapiens
accauaauguuaca

SEQ ID NO: 932703 - RNA, 22 nt, Homo sapiens
accaugagaccacuguuaucaa

SEQ ID NO: 932704 - RNA, 20 nt, Homo sapiens
accauguacaugaagaagcu

SEQ ID NO: 932705 - RNA, 15 nt, Homo sapiens
acccaagaccucagg

SEQ ID NO: 932706 - RNA, 23 nt, Homo sapiens
acccacaugugacacauaugcac

SEQ ID NO: 932707 - RNA, 17 nt, Homo sapiens
acccaggaguguggcca

SEQ ID NO: 932708 - RNA, 16 nt, Homo sapiens
acccagucacugugag

SEQ ID NO: 932709 - RNA, 14 nt, Homo sapiens
acccauauuacaga

SEQ ID NO: 932710 - RNA, 15 nt, Homo sapiens
accccaagcaggaac

SEQ ID NO: 932711 - RNA, 14 nt, Homo sapiens
accguaggacccaa

SEQ ID NO: 932712 - RNA, 21 nt, Homo sapiens
accguuuccuuucauuuacug

SEQ ID NO: 932713 - RNA, 22 nt, Homo sapiens
accucaguuuuaucauuuucaa

SEQ ID NO: 932714 - RNA, 19 nt, Homo sapiens
accuccaagccacugagca

SEQ ID NO: 932715 - RNA, 15 nt, Homo sapiens
acgaucuuccuggcu

SEQ ID NO: 932716 - RNA, 13 nt, Homo sapiens
acgcaguaacuaa

SEQ ID NO: 932717 - RNA, 21 nt, Homo sapiens
acgucacuucaugcaggugaa

SEQ ID NO: 932718 - RNA, 19 nt, Homo sapiens
acgugggcaaacaggcagu

SEQ ID NO: 932719 - RNA, 18 nt, Homo sapiens
acguucuggacugucuuc

SEQ ID NO: 932720 - RNA, 23 nt, Homo sapiens
acuaaaagauugagaaguuacuu

SEQ ID NO: 932721 - RNA, 23 nt, Homo sapiens
acucagaagggagcuagccagag

SEQ ID NO: 932722 - RNA, 18 nt, Homo sapiens
acucucaccaaaugagaa

SEQ ID NO: 932723 - RNA, 14 nt, Homo sapiens
acucugcacauguc

SEQ ID NO: 932724 - RNA, 15 nt, Homo sapiens
acucugcacaugucu

SEQ ID NO: 932725 - RNA, 18 nt, Homo sapiens
acucugcacaugucuugu

SEQ ID NO: 932726 - RNA, 20 nt, Homo sapiens
acucugcacaugucuuguac

SEQ ID NO: 932727 - RNA, 23 nt, Homo sapiens
acugaucaggaccuccaagccac

SEQ ID NO: 932728 - RNA, 20 nt, Homo sapiens
acugccauauacucuucaag

SEQ ID NO: 932729 - RNA, 16 nt, Homo sapiens
acugucuucucccugc

SEQ ID NO: 932730 - RNA, 20 nt, Homo sapiens
acuguuagucauuugcugag

SEQ ID NO: 932731 - RNA, 16 nt, Homo sapiens
acuucaugcaggugaa

SEQ ID NO: 932732 - RNA, 23 nt, Homo sapiens
acuucaugcaggugaaacccagu

SEQ ID NO: 932733 - RNA, 19 nt, Homo sapiens
acuucuuucagcagacuga

SEQ ID NO: 932734 - RNA, 18 nt, Homo sapiens
acuuuaucuaauaccucu

SEQ ID NO: 932735 - RNA, 14 nt, Homo sapiens
acuuuccauugcua

SEQ ID NO: 932736 - RNA, 21 nt, Homo sapiens
acuuuucuuuccucagaucau

SEQ ID NO: 932737 - RNA, 12 nt, Homo sapiens
agaaaaauuauu

SEQ ID NO: 932738 - RNA, 13 nt, Homo sapiens
agaaacugcucua

SEQ ID NO: 932739 - RNA, 17 nt, Homo sapiens
agaauacacugugacuu

SEQ ID NO: 932740 - RNA, 13 nt, Homo sapiens
agaccccuuggcc

SEQ ID NO: 932741 - RNA, 16 nt, Homo sapiens
agaccuaggauuucau

SEQ ID NO: 932742 - RNA, 22 nt, Homo sapiens
agacuggcagggacgaggacaa

SEQ ID NO: 932743 - RNA, 23 nt, Homo sapiens
agagagucgcaucucagugcagg

SEQ ID NO: 932744 - RNA, 16 nt, Homo sapiens
agagugaaggauuuau

SEQ ID NO: 932745 - RNA, 22 nt, Homo sapiens
agaguggaaccaacacuaacau

SEQ ID NO: 932746 - RNA, 17 nt, Homo sapiens
agauaauuauaauauac

SEQ ID NO: 932747 - RNA, 12 nt, Homo sapiens
agauggaguucu

SEQ ID NO: 932748 - RNA, 20 nt, Homo sapiens
agauggaguucuugugccau

SEQ ID NO: 932749 - RNA, 21 nt, Homo sapiens
agcaccugcgggagcugcacu

SEQ ID NO: 932750 - RNA, 18 nt, Homo sapiens
agcaggaaccccaggaga

SEQ ID NO: 932751 - RNA, 18 nt, Homo sapiens
agcccauccagucuccca

SEQ ID NO: 932752 - RNA, 22 nt, Homo sapiens
agccuggcucccaggacacgac

SEQ ID NO: 932753 - RNA, 10 nt, Homo sapiens
agcuccucac

SEQ ID NO: 932754 - RNA, 18 nt, Homo sapiens
agcugcgccugcgcugca

SEQ ID NO: 932755 - RNA, 20 nt, Homo sapiens
agcuuccuguccucccagcu

SEQ ID NO: 932756 - RNA, 16 nt, Homo sapiens
aggaaccccaggagau

SEQ ID NO: 932757 - RNA, 16 nt, Homo sapiens
aggaaguaugguuuua

SEQ ID NO: 932758 - RNA, 13 nt, Homo sapiens
aggaccagagcua

SEQ ID NO: 932759 - RNA, 17 nt, Homo sapiens
aggacccaagcagagaa

SEQ ID NO: 932760 - RNA, 15 nt, Homo sapiens
aggaugauggccaca

SEQ ID NO: 932761 - RNA, 19 nt, Homo sapiens
aggcauaagaaaacuaaga

SEQ ID NO: 932762 - RNA, 24 nt, Homo sapiens
aggccuugaagaauacacugugac

SEQ ID NO: 932763 - RNA, 16 nt, Homo sapiens
agggagcuagccagag

SEQ ID NO: 932764 - RNA, 14 nt, Homo sapiens
aggggcuggcacug

SEQ ID NO: 932765 - RNA, 22 nt, Homo sapiens
aguaacccccacuggacugacc

SEQ ID NO: 932766 - RNA, 21 nt, Homo sapiens
agucacauggccuaugcacau

SEQ ID NO: 932767 - RNA, 19 nt, Homo sapiens
agucgcaucucagugcagg

SEQ ID NO: 932768 - RNA, 15 nt, Homo sapiens
agucucucauucuag

SEQ ID NO: 932769 - RNA, 12 nt, Homo sapiens
agugaaggauuu

SEQ ID NO: 932770 - RNA, 19 nt, Homo sapiens
agugcagaccccuuggcca

SEQ ID NO: 932771 - RNA, 23 nt, Homo sapiens
agugugugucuuuccucccugaa

SEQ ID NO: 932772 - RNA, 19 nt, Homo sapiens
aguucaauaaaugucuguu

SEQ ID NO: 932773 - RNA, 20 nt, Homo sapiens
aguugcguggacucugcaca

SEQ ID NO: 932774 - RNA, 17 nt, Homo sapiens
aguugcugaugaacucu

SEQ ID NO: 932775 - RNA, 18 nt, Homo sapiens
aguuucucucacauuacu

SEQ ID NO: 932776 - RNA, 13 nt, Homo sapiens
auaaacuaaagaa

SEQ ID NO: 932777 - RNA, 16 nt, Homo sapiens
auaaacuuuccucuuc

SEQ ID NO: 932778 - RNA, 13 nt, Homo sapiens
auaaagugacaga

SEQ ID NO: 932779 - RNA, 17 nt, Homo sapiens
auaaauguacauuaauu

SEQ ID NO: 932780 - RNA, 21 nt, Homo sapiens
auaauccuaaacauaugaauu

SEQ ID NO: 932781 - RNA, 14 nt, Homo sapiens
uaaagugacagaug

SEQ ID NO: 932782 - RNA, 14 nt, Homo sapiens
uaagaaaacuaaga

SEQ ID NO: 932783 - RNA, 22 nt, Homo sapiens
uaaguuuccuuccagcccagaa

SEQ ID NO: 932784 - RNA, 20 nt, Homo sapiens
uaaucacucagugauugcaa

SEQ ID NO: 932785 - RNA, 22 nt, Homo sapiens
uaaucagggaggucauuuuggu

SEQ ID NO: 932786 - RNA, 16 nt, Homo sapiens
uaauuuagacauugag

SEQ ID NO: 932787 - RNA, 22 nt, Homo sapiens
uaauuuagacauugaguucaaa

SEQ ID NO: 932788 - RNA, 13 nt, Homo sapiens
uaccaaucauuuu

SEQ ID NO: 932789 - RNA, 21 nt, Homo sapiens
uaccugggcauucuuguuuca

SEQ ID NO: 932790 - RNA, 17 nt, Homo sapiens
uaccuugagccaguaau

SEQ ID NO: 932791 - RNA, 21 nt, Homo sapiens
uacucaauguuacuaucugcu

SEQ ID NO: 932792 - RNA, 20 nt, Homo sapiens
uagaaaacgcgaccuuggcc

SEQ ID NO: 932793 - RNA, 13 nt, Homo sapiens
uagaguguuauca

SEQ ID NO: 932794 - RNA, 14 nt, Homo sapiens
uagcagacaguguu

SEQ ID NO: 932795 - RNA, 21 nt, Homo sapiens
uagcaucuuugaauacaaaga

SEQ ID NO: 932796 - RNA, 16 nt, Homo sapiens
uaggacccaagcagag

SEQ ID NO: 932797 - RNA, 19 nt, Homo sapiens
uagucacauggccuaugca

SEQ ID NO: 932798 - RNA, 20 nt, Homo sapiens
uagucacauggccuaugcac

SEQ ID NO: 932799 - RNA, 23 nt, Homo sapiens
uagucacauggccuaugcacaua

SEQ ID NO: 932800 - RNA, 19 nt, Homo sapiens
uaguugcguggacucugca

SEQ ID NO: 932801 - RNA, 15 nt, Homo sapiens
uauacucuucaagga

SEQ ID NO: 932802 - RNA, 16 nt, Homo sapiens
uauacucuucaaggac

SEQ ID NO: 932803 - RNA, 23 nt, Homo sapiens
uauacuuugccuuuccauaauca

SEQ ID NO: 932804 - RNA, 13 nt, Homo sapiens
uauaugcacuuau

SEQ ID NO: 932805 - RNA, 16 nt, Homo sapiens
uauaugcuaagucuua

SEQ ID NO: 932806 - RNA, 13 nt, Homo sapiens
uauauggccucaa

SEQ ID NO: 932807 - RNA, 15 nt, Homo sapiens
uauauggccucaaga

SEQ ID NO: 932808 - RNA, 15 nt, Homo sapiens
uaugagaugccugaa

SEQ ID NO: 932809 - RNA, 17 nt, Homo sapiens
uaugagaugccugaagc

SEQ ID NO: 932810 - RNA, 18 nt, Homo sapiens
uauggugucauaggcucu

SEQ ID NO: 932811 - RNA, 18 nt, Homo sapiens
uauuacaaauccaaugaa

SEQ ID NO: 932812 - RNA, 21 nt, Homo sapiens
uauuggacaguaaaauccaca

SEQ ID NO: 932813 - RNA, 11 nt, Homo sapiens
uauuuugccac

SEQ ID NO: 932814 - RNA, 17 nt, Homo sapiens
ucaagucggaucuaguc

SEQ ID NO: 932815 - RNA, 20 nt, Homo sapiens
ucaauuccaccugcaaucaa

SEQ ID NO: 932816 - RNA, 17 nt, Homo sapiens
ucacauggccuaugcac

SEQ ID NO: 932817 - RNA, 16 nt, Homo sapiens
ucacugccauauacuc

SEQ ID NO: 932818 - RNA, 21 nt, Homo sapiens
ucacuuaauaauguguacauu

SEQ ID NO: 932819 - RNA, 20 nt, Homo sapiens
ucacuugugcaguguugaca

SEQ ID NO: 932820 - RNA, 13 nt, Homo sapiens
ucacuuugcuaca

SEQ ID NO: 932821 - RNA, 21 nt, Homo sapiens
ucagaagggagcuagccagag

SEQ ID NO: 932822 - RNA, 16 nt, Homo sapiens
ucaggcuuuggauguu

SEQ ID NO: 932823 - RNA, 19 nt, Homo sapiens
ucaguaacccccacuggac

SEQ ID NO: 932824 - RNA, 12 nt, Homo sapiens
ucauuuugccaa

SEQ ID NO: 932825 - RNA, 18 nt, Homo sapiens
uccaagcaagacugaggg

SEQ ID NO: 932826 - RNA, 23 nt, Homo sapiens
uccagaaucccguaacaccugau

SEQ ID NO: 932827 - RNA, 15 nt, Homo sapiens
uccagugcaggagac

SEQ ID NO: 932828 - RNA, 20 nt, Homo sapiens
uccaugggccauaugaaaag

SEQ ID NO: 932829 - RNA, 20 nt, Homo sapiens
ucccacccacaugugacaca

SEQ ID NO: 932830 - RNA, 20 nt, Homo sapiens
ucccauuuccugagaccaca

SEQ ID NO: 932831 - RNA, 16 nt, Homo sapiens
uccuggcccaggugag

SEQ ID NO: 932832 - RNA, 16 nt, Homo sapiens
ucgcaucucagugcag

SEQ ID NO: 932833 - RNA, 19 nt, Homo sapiens
ucgcaucucagugcaggag

SEQ ID NO: 932834 - RNA, 23 nt, Homo sapiens
ucgggcuaggaagaucucugcag

SEQ ID NO: 932835 - RNA, 12 nt, Homo sapiens
ucuagacuaaaa

SEQ ID NO: 932836 - RNA, 18 nt, Homo sapiens
ucucacuugugcaguguu

SEQ ID NO: 932837 - RNA, 14 nt, Homo sapiens
ucucuccagccuga

SEQ ID NO: 932838 - RNA, 21 nt, Homo sapiens
ucucugcagggccgccaggga

SEQ ID NO: 932839 - RNA, 15 nt, Homo sapiens
cucaagaucaaugaa

SEQ ID NO: 932840 - RNA, 16 nt, Homo sapiens
cucauugcuuggaauu

SEQ ID NO: 932841 - RNA, 17 nt, Homo sapiens
cuccaagccacugagca

SEQ ID NO: 932842 - RNA, 17 nt, Homo sapiens
cuccagggucagaaaca

SEQ ID NO: 932843 - RNA, 12 nt, Homo sapiens
cuccagugcagg

SEQ ID NO: 932844 - RNA, 18 nt, Homo sapiens
cuccucacucaccuucag

SEQ ID NO: 932845 - RNA, 16 nt, Homo sapiens
cuccugagggagcucc

SEQ ID NO: 932846 - RNA, 15 nt, Homo sapiens
cucgggcuaggaaga

SEQ ID NO: 932847 - RNA, 13 nt, Homo sapiens
cucugcacauguc

SEQ ID NO: 932848 - RNA, 17 nt, Homo sapiens
cucuuaaucaaauagca

SEQ ID NO: 932849 - RNA, 12 nt, Homo sapiens
cucuucaaggac

SEQ ID NO: 932850 - RNA, 21 nt, Homo sapiens
cugaaauggacuuuuguacau

SEQ ID NO: 932851 - RNA, 14 nt, Homo sapiens
cugaccugguccac

SEQ ID NO: 932852 - RNA, 15 nt, Homo sapiens
cugagggagcuccaa

SEQ ID NO: 932853 - RNA, 16 nt, Homo sapiens
cugaucaggaccucca

SEQ ID NO: 932854 - RNA, 15 nt, Homo sapiens
cugauuucugagcau

SEQ ID NO: 932855 - RNA, 19 nt, Homo sapiens
cugcaccccugcaguuuga

SEQ ID NO: 932856 - RNA, 15 nt, Homo sapiens
cugccacugacugca

SEQ ID NO: 932857 - RNA, 21 nt, Homo sapiens
cugccucugccacugacugca

SEQ ID NO: 932858 - RNA, 14 nt, Homo sapiens
cugcuccagugcag

SEQ ID NO: 932859 - RNA, 15 nt, Homo sapiens
cugcuccagugcagg

SEQ ID NO: 932860 - RNA, 14 nt, Homo sapiens
cugcucuaauauca

SEQ ID NO: 932861 - RNA, 18 nt, Homo sapiens
cugcugcuccagugcagg

SEQ ID NO: 932862 - RNA, 12 nt, Homo sapiens
cuggcacugacu

SEQ ID NO: 932863 - RNA, 14 nt, Homo sapiens
cuggcaugauccaa

SEQ ID NO: 932864 - RNA, 14 nt, Homo sapiens
cuggcccaggugag

SEQ ID NO: 932865 - RNA, 14 nt, Homo sapiens
cuggcucccaggac

SEQ ID NO: 932866 - RNA, 15 nt, Homo sapiens
cugggcccacaaagg

SEQ ID NO: 932867 - RNA, 22 nt, Homo sapiens
cuguaguugcguggacucugca

SEQ ID NO: 932868 - RNA, 23 nt, Homo sapiens
cuguaguugcguggacucugcac

SEQ ID NO: 932869 - RNA, 17 nt, Homo sapiens
cuuaauaauguguacau

SEQ ID NO: 932870 - RNA, 16 nt, Homo sapiens
cuuaaucuuuucacaa

SEQ ID NO: 932871 - RNA, 17 nt, Homo sapiens
cuuaaucuuuucacaaa

SEQ ID NO: 932872 - RNA, 19 nt, Homo sapiens
cuuaaucuuuucacaaaua

SEQ ID NO: 932873 - RNA, 21 nt, Homo sapiens
cuucauccucugagugugacc

SEQ ID NO: 932874 - RNA, 18 nt, Homo sapiens
cuugaguuuaaauuguaa

SEQ ID NO: 932875 - RNA, 23 nt, Homo sapiens
cuugauuuuuuucauuuugccaa

SEQ ID NO: 932876 - RNA, 20 nt, Homo sapiens
cuuggcacccaagaccucag

SEQ ID NO: 932877 - RNA, 20 nt, Homo sapiens
cuuggggagauggaguucuu

SEQ ID NO: 932878 - RNA, 19 nt, Homo sapiens
cuuguaaaauuucacuuaa

SEQ ID NO: 932879 - RNA, 18 nt, Homo sapiens
cuugugacuagugcugaa

SEQ ID NO: 932880 - RNA, 11 nt, Homo sapiens
cuugugccaua

SEQ ID NO: 932881 - RNA, 19 nt, Homo sapiens
cuuuagcaguuuugugaua

SEQ ID NO: 932882 - RNA, 16 nt, Homo sapiens
cuuuaggaugacugua

SEQ ID NO: 932883 - RNA, 18 nt, Homo sapiens
cuuuaucuaauaccucug

SEQ ID NO: 932884 - RNA, 17 nt, Homo sapiens
cuuucauuuacuguggc

SEQ ID NO: 932885 - RNA, 19 nt, Homo sapiens
cuuugccuuuccauaauca

SEQ ID NO: 932886 - RNA, 23 nt, Homo sapiens
cuuuuaaguugcugaugaacucu

SEQ ID NO: 932887 - RNA, 12 nt, Homo sapiens
cuuuucacaaau

SEQ ID NO: 932888 - RNA, 15 nt, Homo sapiens
gaaaauggaaccagg

SEQ ID NO: 932889 - RNA, 18 nt, Homo sapiens
gaagggagcuagccagag

SEQ ID NO: 932890 - RNA, 15 nt, Homo sapiens
gacagugaggcugca

SEQ ID NO: 932891 - RNA, 17 nt, Homo sapiens
gacaguguuuucuggga

SEQ ID NO: 932892 - RNA, 20 nt, Homo sapiens
gacauugaguucaaauugcc

SEQ ID NO: 932893 - RNA, 17 nt, Homo sapiens
gaccacuguuaucaaaa

SEQ ID NO: 932894 - RNA, 17 nt, Homo sapiens
gaccaugcgacacuggg

SEQ ID NO: 932895 - RNA, 15 nt, Homo sapiens
gaccuaggauuucau

SEQ ID NO: 932896 - RNA, 14 nt, Homo sapiens
gaccuggacacagg

SEQ ID NO: 932897 - RNA, 17 nt, Homo sapiens
gaccuguaaucauauaa

SEQ ID NO: 932898 - RNA, 13 nt, Homo sapiens
gacuagugcugaa

SEQ ID NO: 932899 - RNA, 17 nt, Homo sapiens
gacuauggcuaccaaaa

SEQ ID NO: 932900 - RNA, 16 nt, Homo sapiens
gacuuaagaagccuua

SEQ ID NO: 932901 - RNA, 17 nt, Homo sapiens
gagagccuggugcugcu

SEQ ID NO: 932902 - RNA, 22 nt, Homo sapiens
gagaggcccugggguucucccc

SEQ ID NO: 932903 - RNA, 19 nt, Homo sapiens
acaaaggcaaaggguccag

SEQ ID NO: 932904 - RNA, 22 nt, Homo sapiens
acaaauauggaugagguggaga

SEQ ID NO: 932905 - RNA, 21 nt, Homo sapiens
acaaccaugagaccacuguua

SEQ ID NO: 932906 - RNA, 22 nt, Homo sapiens
acaagaagccacagaccuagga

SEQ ID NO: 932907 - RNA, 18 nt, Homo sapiens
acacaggccugcucucuu

SEQ ID NO: 932908 - RNA, 13 nt, Homo sapiens
acacgacuuguaa

SEQ ID NO: 932909 - RNA, 12 nt, Homo sapiens
acacgugacaga

SEQ ID NO: 932910 - RNA, 21 nt, Homo sapiens
acacugcugcuccagugcagg

SEQ ID NO: 932911 - RNA, 22 nt, Homo sapiens
acacugcugcuccagugcagga

SEQ ID NO: 932912 - RNA, 12 nt, Homo sapiens
acacuguacaag

SEQ ID NO: 932913 - RNA, 23 nt, Homo sapiens
acagaagcuucugcccaccuacu

SEQ ID NO: 932914 - RNA, 22 nt, Homo sapiens
acagaauuuuaugcggcauuuu

SEQ ID NO: 932915 - RNA, 12 nt, Homo sapiens
acauaugcaccu

SEQ ID NO: 932916 - RNA, 17 nt, Homo sapiens
acauauggacucugcac

SEQ ID NO: 932917 - RNA, 18 nt, Homo sapiens
acauccugugccuccauc

SEQ ID NO: 932918 - RNA, 14 nt, Homo sapiens
acaugaagaagcua

SEQ ID NO: 932919 - RNA, 15 nt, Homo sapiens
acauggaugccaacc

SEQ ID NO: 932920 - RNA, 21 nt, Homo sapiens
acauggccuaugcacauaugg

SEQ ID NO: 932921 - RNA, 20 nt, Homo sapiens
acauguguagccugugcaug

SEQ ID NO: 932922 - RNA, 20 nt, Homo sapiens
acauuacuguauauacuuug

SEQ ID NO: 932923 - RNA, 14 nt, Homo sapiens
accacccacuugau

SEQ ID NO: 932924 - RNA, 16 nt, Homo sapiens
accaugcgacacuggg

SEQ ID NO: 932925 - RNA, 17 nt, Homo sapiens
accaugcgacacuggga

SEQ ID NO: 932926 - RNA, 21 nt, Homo sapiens
acccaagcagagaagcucucg

SEQ ID NO: 932927 - RNA, 21 nt, Homo sapiens
acccacaugugacacauaugc

SEQ ID NO: 932928 - RNA, 17 nt, Homo sapiens
accguaggacccaagca

SEQ ID NO: 932929 - RNA, 23 nt, Homo sapiens
accguuuccuuucauuuacugug

SEQ ID NO: 932930 - RNA, 19 nt, Homo sapiens
accuacuuuucuuuccuca

SEQ ID NO: 932931 - RNA, 20 nt, Homo sapiens
accuggucccugcucucagu

SEQ ID NO: 932932 - RNA, 16 nt, Homo sapiens
accuguaaucauauaa

SEQ ID NO: 932933 - RNA, 17 nt, Homo sapiens
accuugugucuguacac

SEQ ID NO: 932934 - RNA, 12 nt, Homo sapiens
acuaaagcuuua

SEQ ID NO: 932935 - RNA, 13 nt, Homo sapiens
acuaaugaccaca

SEQ ID NO: 932936 - RNA, 17 nt, Homo sapiens
acugaucaggaccucca

SEQ ID NO: 932937 - RNA, 17 nt, Homo sapiens
acugcugcuccagugca

SEQ ID NO: 932938 - RNA, 12 nt, Homo sapiens
acugugacuuaa

SEQ ID NO: 932939 - RNA, 14 nt, Homo sapiens
acuuaauaaugugu

SEQ ID NO: 932940 - RNA, 17 nt, Homo sapiens
acuuuccucuuccugcc

SEQ ID NO: 932941 - RNA, 23 nt, Homo sapiens
acuuuuaaguugcugaugaacuc

SEQ ID NO: 932942 - RNA, 16 nt, Homo sapiens
agaaaauaacaauaaa

SEQ ID NO: 932943 - RNA, 19 nt, Homo sapiens
agaaacugcucuaauauca

SEQ ID NO: 932944 - RNA, 14 nt, Homo sapiens
agaaagucucucau

SEQ ID NO: 932945 - RNA, 23 nt, Homo sapiens
agaaaguuuccccaccagugaau

SEQ ID NO: 932946 - RNA, 23 nt, Homo sapiens
agaagcuaaauccuuuacuguua

SEQ ID NO: 932947 - RNA, 10 nt, Homo sapiens
agacagugaa

SEQ ID NO: 932948 - RNA, 15 nt, Homo sapiens
agaccauaauguuac

SEQ ID NO: 932949 - RNA, 14 nt, Homo sapiens
agaccccuuggcca

SEQ ID NO: 932950 - RNA, 14 nt, Homo sapiens
agaccuggacacag

SEQ ID NO: 932951 - RNA, 15 nt, Homo sapiens
agaccuggcacugga

SEQ ID NO: 932952 - RNA, 23 nt, Homo sapiens
agacgggcaaaauaaagugacag

SEQ ID NO: 932953 - RNA, 15 nt, Homo sapiens
agacucgcaauuuca

SEQ ID NO: 932954 - RNA, 14 nt, Homo sapiens
agacuuuacaugga

SEQ ID NO: 932955 - RNA, 16 nt, Homo sapiens
agagagucgcaucuca

SEQ ID NO: 932956 - RNA, 22 nt, Homo sapiens
agagagucgcaucucagugcag

SEQ ID NO: 932957 - RNA, 17 nt, Homo sapiens
agagccuggugcugcug

SEQ ID NO: 932958 - RNA, 13 nt, Homo sapiens
agaggacugugau

SEQ ID NO: 932959 - RNA, 21 nt, Homo sapiens
agagucgcaucucagugcagg

SEQ ID NO: 932960 - RNA, 19 nt, Homo sapiens
agaguguuaucagucauaa

SEQ ID NO: 932961 - RNA, 20 nt, Homo sapiens
agauagauaggucagugcaa

SEQ ID NO: 932962 - RNA, 14 nt, Homo sapiens
agauggaguucuug

SEQ ID NO: 932963 - RNA, 21 nt, Homo sapiens
agauggaguucuugugccaua

SEQ ID NO: 932964 - RNA, 15 nt, Homo sapiens
agcaagacugagggg

SEQ ID NO: 932965 - RNA, 24 nt, Homo sapiens
agcaagucucuuuauauggccuca

SEQ ID NO: 932966 - RNA, 15 nt, Homo sapiens
agcagcugcagcuca

SEQ ID NO: 932967 - RNA, 13 nt, Homo sapiens
agcaguuuuguga

SEQ ID NO: 932968 - RNA, 18 nt, Homo sapiens
agcccagaaagucucuca

SEQ ID NO: 932969 - RNA, 16 nt, Homo sapiens
agccucaagaugaagg

SEQ ID NO: 932970 - RNA, 20 nt, Homo sapiens
agcuaauaaaauaucauuca

SEQ ID NO: 932971 - RNA, 22 nt, Homo sapiens
agcuauucuccauguacuggca

SEQ ID NO: 932972 - RNA, 19 nt, Homo sapiens
agcugccucugccacugac

SEQ ID NO: 932973 - RNA, 18 nt, Homo sapiens
agcuucugcccaccuacu

SEQ ID NO: 932974 - RNA, 20 nt, Homo sapiens
aggagaccuggcacuggaug

SEQ ID NO: 932975 - RNA, 23 nt, Homo sapiens
aggagacuuuacauggaugccaa

SEQ ID NO: 932976 - RNA, 15 nt, Homo sapiens
aggauuucaugauuu

SEQ ID NO: 932977 - RNA, 16 nt, Homo sapiens
aggccagugagccacu

SEQ ID NO: 932978 - RNA, 22 nt, Homo sapiens
acaguucaauucucauuuguca

SEQ ID NO: 932979 - RNA, 22 nt, Homo sapiens
acaguugaaaaacagcugaggg

SEQ ID NO: 932980 - RNA, 23 nt, Homo sapiens
acaucaacugcaucaagauguga

SEQ ID NO: 932981 - RNA, 19 nt, Homo sapiens
acaucuugcucugcugaca

SEQ ID NO: 932982 - RNA, 18 nt, Homo sapiens
acaucuuggucagauuug

SEQ ID NO: 932983 - RNA, 23 nt, Homo sapiens
acaucuuggucagauuugaacuc

SEQ ID NO: 932984 - RNA, 20 nt, Homo sapiens
acaugccucucucaggccaa

SEQ ID NO: 932985 - RNA, 18 nt, Homo sapiens
accaacauacucccaucu

SEQ ID NO: 932986 - RNA, 15 nt, Homo sapiens
accacaugugcacau

SEQ ID NO: 932987 - RNA, 18 nt, Homo sapiens
accaccaaccacugcgac

SEQ ID NO: 932988 - RNA, 15 nt, Homo sapiens
accaccaccaucacc

SEQ ID NO: 932989 - RNA, 21 nt, Homo sapiens
accagcagagcaccuuagaca

SEQ ID NO: 932990 - RNA, 18 nt, Homo sapiens
accagcgugugacuacuc

SEQ ID NO: 932991 - RNA, 16 nt, Homo sapiens
accaguuguugauaac

SEQ ID NO: 932992 - RNA, 14 nt, Homo sapiens
accaucaagccacc

SEQ ID NO: 932993 - RNA, 20 nt, Homo sapiens
accauuuagcacacugcuug

SEQ ID NO: 932994 - RNA, 19 nt, Homo sapiens
accauuuugggguacccac

SEQ ID NO: 932995 - RNA, 21 nt, Homo sapiens
acccacugcuuuuggucugug

SEQ ID NO: 932996 - RNA, 17 nt, Homo sapiens
acccaguuagcucucaa

SEQ ID NO: 932997 - RNA, 22 nt, Homo sapiens
accccagugcuuguuccucuca

SEQ ID NO: 932998 - RNA, 22 nt, Homo sapiens
acccuccuuucaccacaugugc

SEQ ID NO: 932999 - RNA, 16 nt, Homo sapiens
acccugcuucaaauau

SEQ ID NO: 933000 - RNA, 21 nt, Homo sapiens
accgggcacucagaagacacu

SEQ ID NO: 933001 - RNA, 22 nt, Homo sapiens
accuagguggggccugggguag

SEQ ID NO: 933002 - RNA, 20 nt, Homo sapiens
accucaggugagaagcagag

SEQ ID NO: 933003 - RNA, 13 nt, Homo sapiens
accucucucacuc

SEQ ID NO: 933004 - RNA, 15 nt, Homo sapiens
accucugcacaagcu

SEQ ID NO: 933005 - RNA, 17 nt, Homo sapiens
accucugccugaaguca

SEQ ID NO: 933006 - RNA, 20 nt, Homo sapiens
accucugccugaagucacac

SEQ ID NO: 933007 - RNA, 23 nt, Homo sapiens
accucugccugaagucacacagu

SEQ ID NO: 933008 - RNA, 17 nt, Homo sapiens
accucuugagccuugaa

SEQ ID NO: 933009 - RNA, 11 nt, Homo sapiens
accugaagucu

SEQ ID NO: 933010 - RNA, 19 nt, Homo sapiens
accugccaggaagccagca

SEQ ID NO: 933011 - RNA, 18 nt, Homo sapiens
accuugaaugaugccaug

SEQ ID NO: 933012 - RNA, 18 nt, Homo sapiens
accuuuuuuauacauaaa

SEQ ID NO: 933013 - RNA, 11 nt, Homo sapiens
acgccacugca

SEQ ID NO: 933014 - RNA, 12 nt, Homo sapiens
acgcgugcacac

SEQ ID NO: 933015 - RNA, 20 nt, Homo sapiens
acgcgugcacacaccagagc

SEQ ID NO: 933016 - RNA, 15 nt, Homo sapiens
acuauguugcccagg

SEQ ID NO: 933017 - RNA, 16 nt, Homo sapiens
aaaagaggcuauguga

SEQ ID NO: 933018 - RNA, 13 nt, Homo sapiens
aaaagcugggcag

SEQ ID NO: 933019 - RNA, 16 nt, Homo sapiens
aaaaggggggugggag

SEQ ID NO: 933020 - RNA, 18 nt, Homo sapiens
aaaaguuuaaaaagcuca

SEQ ID NO: 933021 - RNA, 14 nt, Homo sapiens
aaacagcugagggu

SEQ ID NO: 933022 - RNA, 15 nt, Homo sapiens
aaaccgaauuuucac

SEQ ID NO: 933023 - RNA, 16 nt, Homo sapiens
aaaccuguuucugcag

SEQ ID NO: 933024 - RNA, 19 nt, Homo sapiens
aaacuacccucuggagaua

SEQ ID NO: 933025 - RNA, 12 nt, Homo sapiens
aaagcagugcau

SEQ ID NO: 933026 - RNA, 14 nt, Homo sapiens
aaagcaugugagac

SEQ ID NO: 933027 - RNA, 20 nt, Homo sapiens
aaagcuuaccaaggggaaug

SEQ ID NO: 933028 - RNA, 13 nt, Homo sapiens
aaaggaggggaua

SEQ ID NO: 933029 - RNA, 18 nt, Homo sapiens
aaaggaugcacagaguug

SEQ ID NO: 933030 - RNA, 16 nt, Homo sapiens
aaaggugaccaaugau

SEQ ID NO: 933031 - RNA, 16 nt, Homo sapiens
aaagguugaagcacca

SEQ ID NO: 933032 - RNA, 12 nt, Homo sapiens
aaauaacacugu

SEQ ID NO: 933033 - RNA, 19 nt, Homo sapiens
aaauaacacuguacugcaa

SEQ ID NO: 933034 - RNA, 15 nt, Homo sapiens
aaauaccagccagua

SEQ ID NO: 933035 - RNA, 14 nt, Homo sapiens
aaauauaauugaca

SEQ ID NO: 933036 - RNA, 12 nt, Homo sapiens
aaaugccagugu

SEQ ID NO: 933037 - RNA, 14 nt, Homo sapiens
aaauggaagacagc

SEQ ID NO: 933038 - RNA, 18 nt, Homo sapiens
aaaugggggugcauuuga

SEQ ID NO: 933039 - RNA, 16 nt, Homo sapiens
aaauucaugcugcuua

SEQ ID NO: 933040 - RNA, 16 nt, Homo sapiens
aaauuuguaugcucaa

SEQ ID NO: 933041 - RNA, 15 nt, Homo sapiens
aacaacugaccaguu

SEQ ID NO: 933042 - RNA, 20 nt, Homo sapiens
aacacaaacgggcucagcaa

SEQ ID NO: 933043 - RNA, 13 nt, Homo sapiens
aacacaacaucuu

SEQ ID NO: 933044 - RNA, 14 nt, Homo sapiens
aacacauacaggaa

SEQ ID NO: 933045 - RNA, 23 nt, Homo sapiens
aacacuaaugaggaaacugcacu

SEQ ID NO: 933046 - RNA, 21 nt, Homo sapiens
aacagguuuaaaaauccccaa

SEQ ID NO: 933047 - RNA, 21 nt, Homo sapiens
aacaucuuggucagauuugaa

SEQ ID NO: 933048 - RNA, 19 nt, Homo sapiens
aacauguaauuaaguacua

SEQ ID NO: 933049 - RNA, 19 nt, Homo sapiens
aaccacuaagagucucuau

SEQ ID NO: 933050 - RNA, 22 nt, Homo sapiens
aaccacuucagcugacuuuucu

SEQ ID NO: 933051 - RNA, 16 nt, Homo sapiens
aaccccaucucuacaa

SEQ ID NO: 933052 - RNA, 12 nt, Homo sapiens
aacguggcugcu

SEQ ID NO: 933053 - RNA, 16 nt, Homo sapiens
aacucaaacucuuaaa

SEQ ID NO: 933054 - RNA, 19 nt, Homo sapiens
aacucugauuaugaauaca

SEQ ID NO: 933055 - RNA, 15 nt, Homo sapiens
aacugaccaguuguu

SEQ ID NO: 933056 - RNA, 20 nt, Homo sapiens
aacuugauguguuaucucuu

SEQ ID NO: 933057 - RNA, 20 nt, Homo sapiens
aacuuuguuuagcccaaaac

SEQ ID NO: 933058 - RNA, 22 nt, Homo sapiens
aacuuuuauaaacuuuaccuuu

SEQ ID NO: 933059 - RNA, 21 nt, Homo sapiens
aagaaccuuuugagugccuua

SEQ ID NO: 933060 - RNA, 12 nt, Homo sapiens
aagaaugcucuu

SEQ ID NO: 933061 - RNA, 19 nt, Homo sapiens
aagaauugaaaaaccauuu

SEQ ID NO: 933062 - RNA, 22 nt, Homo sapiens
cacagugagucgaggacaggga

SEQ ID NO: 933063 - RNA, 17 nt, Homo sapiens
cacaugcaaggucauuu

SEQ ID NO: 933064 - RNA, 14 nt, Homo sapiens
cacaugcacgugug

SEQ ID NO: 933065 - RNA, 18 nt, Homo sapiens
cacaugccucucucaggc

SEQ ID NO: 933066 - RNA, 16 nt, Homo sapiens
cacaugugcacaugca

SEQ ID NO: 933067 - RNA, 15 nt, Homo sapiens
caccaaccacugcga

SEQ ID NO: 933068 - RNA, 14 nt, Homo sapiens
caccaccaaccacu

SEQ ID NO: 933069 - RNA, 22 nt, Homo sapiens
caccauauuaccacagacauac

SEQ ID NO: 933070 - RNA, 16 nt, Homo sapiens
cacgaauauugcugau

SEQ ID NO: 933071 - RNA, 22 nt, Homo sapiens
cacgaauauugcugauggugca

SEQ ID NO: 933072 - RNA, 13 nt, Homo sapiens
cacgcgugcacac

SEQ ID NO: 933073 - RNA, 16 nt, Homo sapiens
cacgcuggagugcagu

SEQ ID NO: 933074 - RNA, 19 nt, Homo sapiens
cacuaaugaggaaacugca

SEQ ID NO: 933075 - RNA, 20 nt, Homo sapiens
cacuauaauguaagcucuac

SEQ ID NO: 933076 - RNA, 19 nt, Homo sapiens
cacuauagccuaggugaca

SEQ ID NO: 933077 - RNA, 21 nt, Homo sapiens
cacuauagccuaggugacaga

SEQ ID NO: 933078 - RNA, 21 nt, Homo sapiens
cacucacauuuauucugcuca

SEQ ID NO: 933079 - RNA, 11 nt, Homo sapiens
cacuccaugag

SEQ ID NO: 933080 - RNA, 12 nt, Homo sapiens
cacuccaugagu

SEQ ID NO: 933081 - RNA, 21 nt, Homo sapiens
cacugcaccgggccacagaga

SEQ ID NO: 933082 - RNA, 15 nt, Homo sapiens
cacugcgaccacaag

SEQ ID NO: 933083 - RNA, 24 nt, Homo sapiens
cacugcuuaacuucacauauugau

SEQ ID NO: 933084 - RNA, 19 nt, Homo sapiens
cacugugccaugugccagg

SEQ ID NO: 933085 - RNA, 14 nt, Homo sapiens
cacuguugcccagg

SEQ ID NO: 933086 - RNA, 23 nt, Homo sapiens
cacuguuuuauuuuaauucaguu

SEQ ID NO: 933087 - RNA, 13 nt, Homo sapiens
cacuugacaucaa

SEQ ID NO: 933088 - RNA, 21 nt, Homo sapiens
cacuugcagacucuacagagg

SEQ ID NO: 933089 - RNA, 16 nt, Homo sapiens
cacuuugauaccauug

SEQ ID NO: 933090 - RNA, 15 nt, Homo sapiens
cagaagaaacuaccc

SEQ ID NO: 933091 - RNA, 21 nt, Homo sapiens
cagaaguuugagaucagccug

SEQ ID NO: 933092 - RNA, 15 nt, Homo sapiens
cagaaucucaaauaa

SEQ ID NO: 933093 - RNA, 21 nt, Homo sapiens
cagacuacuucuuccccagau

SEQ ID NO: 933094 - RNA, 20 nt, Homo sapiens
cagacucuacagaggccaug

SEQ ID NO: 933095 - RNA, 14 nt, Homo sapiens
cagagauggccaug

SEQ ID NO: 933096 - RNA, 12 nt, Homo sapiens
cagagucucacu

SEQ ID NO: 933097 - RNA, 20 nt, Homo sapiens
cagagugagacucugucuca

SEQ ID NO: 933098 - RNA, 14 nt, Homo sapiens
cagaugcaccagcc

SEQ ID NO: 933099 - RNA, 19 nt, Homo sapiens
cagauugcaacaggcuggg

SEQ ID NO: 933100 - RNA, 16 nt, Homo sapiens
cagcaggcucucaggc

SEQ ID NO: 933101 - RNA, 15 nt, Homo sapiens
cagccucacaguccu

SEQ ID NO: 933102 - RNA, 20 nt, Homo sapiens
cagccucccgaauagcuggg

SEQ ID NO: 933103 - RNA, 19 nt, Homo sapiens
cagccucccgaguagcugg

SEQ ID NO: 933104 - RNA, 20 nt, Homo sapiens
cagccugggugacagagcaa

SEQ ID NO: 933105 - RNA, 16 nt, Homo sapiens
cagcgagcccuggugg

SEQ ID NO: 933106 - RNA, 14 nt, Homo sapiens
cagcuaaugggaca

SEQ ID NO: 933107 - RNA, 15 nt, Homo sapiens
cagcucugcaagaau

SEQ ID NO: 933108 - RNA, 24 nt, Homo sapiens
cagcugacuuuucuguccgagcuu

SEQ ID NO: 933109 - RNA, 23 nt, Homo sapiens
cagcuuuguuuguugucagcuga

SEQ ID NO: 933110 - RNA, 21 nt, Homo sapiens
caggaagccagcaggcucuca

SEQ ID NO: 933111 - RNA, 17 nt, Homo sapiens
caggcacccaccaucau

SEQ ID NO: 933112 - RNA, 15 nt, Homo sapiens
caggcauguucucug

SEQ ID NO: 933113 - RNA, 19 nt, Homo sapiens
caggccaaacucaccugcc

SEQ ID NO: 933114 - RNA, 18 nt, Homo sapiens
caggccuccccagcaccu

SEQ ID NO: 933115 - RNA, 14 nt, Homo sapiens
caggcucucaggcc

SEQ ID NO: 933116 - RNA, 20 nt, Homo sapiens
caggcugggcuucaguggca

SEQ ID NO: 933117 - RNA, 21 nt, Homo sapiens
cagggucucacuauguugccc

SEQ ID NO: 933118 - RNA, 17 nt, Homo sapiens
caggugccucaagagaa

SEQ ID NO: 933119 - RNA, 14 nt, Homo sapiens
caggugugagucac

SEQ ID NO: 933120 - RNA, 15 nt, Homo sapiens
cagguuuuuggucug

SEQ ID NO: 933121 - RNA, 16 nt, Homo sapiens
caguccauagcagaga

SEQ ID NO: 933122 - RNA, 15 nt, Homo sapiens
cagugguaugaucac

SEQ ID NO: 933123 - RNA, 14 nt, Homo sapiens
caguguacauggaa

SEQ ID NO: 933124 - RNA, 18 nt, Homo sapiens
caguuaagagaaaugagc

SEQ ID NO: 933125 - RNA, 17 nt, Homo sapiens
cauaagauaaaugugcu

SEQ ID NO: 933126 - RNA, 19 nt, Homo sapiens
cauaaugacuuaagcacac

SEQ ID NO: 933127 - RNA, 17 nt, Homo sapiens
caucaagaugugacaug

SEQ ID NO: 933128 - RNA, 14 nt, Homo sapiens
caucaugucuggcu

SEQ ID NO: 933129 - RNA, 22 nt, Homo sapiens
caucuugcucugcugacagaca

SEQ ID NO: 933130 - RNA, 15 nt, Homo sapiens
caugcugcccuguga

SEQ ID NO: 933131 - RNA, 19 nt, Homo sapiens
cauguaauuaaguacuaug

SEQ ID NO: 933132 - RNA, 15 nt, Homo sapiens
cauguauuaccugaa

SEQ ID NO: 933133 - RNA, 18 nt, Homo sapiens
cauguguguucaugcaca

SEQ ID NO: 933134 - RNA, 19 nt, Homo sapiens
cauuaucuagauacuguau

SEQ ID NO: 933135 - RNA, 18 nt, Homo sapiens
cauuccuguucccaugag

SEQ ID NO: 933136 - RNA, 21 nt, Homo sapiens
cauuuaggugaggaagcaaaa

SEQ ID NO: 933137 - RNA, 20 nt, Homo sapiens
cauuucugagaucaaaacgg

SEQ ID NO: 933138 - RNA, 15 nt, Homo sapiens
cauuuuuuaaaugca

SEQ ID NO: 933139 - RNA, 18 nt, Homo sapiens
ccaaacacauacaggaag

SEQ ID NO: 933140 - RNA, 15 nt, Homo sapiens
ccaaaucagcugcua

SEQ ID NO: 933141 - RNA, 20 nt, Homo sapiens
ccaacaucaacaucuugguc

SEQ ID NO: 933142 - RNA, 12 nt, Homo sapiens
ccaagcucugcu

SEQ ID NO: 933143 - RNA, 18 nt, Homo sapiens
ccaaggguacuaaggaau

SEQ ID NO: 933144 - RNA, 17 nt, Homo sapiens
ccaauauuuaccagacc

SEQ ID NO: 933145 - RNA, 15 nt, Homo sapiens
ccaaugggagcucau

SEQ ID NO: 933146 - RNA, 18 nt, Homo sapiens
ccaccaccaucaccagac

SEQ ID NO: 933147 - RNA, 20 nt, Homo sapiens
ccacccuccuuucaccacau

SEQ ID NO: 933148 - RNA, 18 nt, Homo sapiens
ccaccucucucacuccuu

SEQ ID NO: 933149 - RNA, 19 nt, Homo sapiens
ccacugugaagagaaccau

SEQ ID NO: 933150 - RNA, 19 nt, Homo sapiens
ccagagaggguggugaccu

SEQ ID NO: 933151 - RNA, 20 nt, Homo sapiens
ccagagaggguggugaccuc

SEQ ID NO: 933152 - RNA, 13 nt, Homo sapiens
ccagaugccaggg

SEQ ID NO: 933153 - RNA, 12 nt, Homo sapiens
ccagauugcaac

SEQ ID NO: 933154 - RNA, 20 nt, Homo sapiens
ccagccugggugacagagca

SEQ ID NO: 933155 - RNA, 12 nt, Homo sapiens
ccagccuugacc

SEQ ID NO: 933156 - RNA, 14 nt, Homo sapiens
ccagcuuaucucag

SEQ ID NO: 933157 - RNA, 20 nt, Homo sapiens
ccagguuuuuggucugaccc

SEQ ID NO: 933158 - RNA, 21 nt, Homo sapiens
ccaguaaaugggggugcauuu

SEQ ID NO: 933159 - RNA, 20 nt, Homo sapiens
ccagugaggcucugcccuug

SEQ ID NO: 933160 - RNA, 13 nt, Homo sapiens
ccaucaagccacc

SEQ ID NO: 933161 - RNA, 12 nt, Homo sapiens
ccaucaccagac

SEQ ID NO: 933162 - RNA, 14 nt, Homo sapiens
ccaucaccagacag

SEQ ID NO: 933163 - RNA, 19 nt, Homo sapiens
ccauuuagcacacugcuug

SEQ ID NO: 933164 - RNA, 16 nt, Homo sapiens
cccaaacccuucagug

SEQ ID NO: 933165 - RNA, 22 nt, Homo sapiens
cccaagggccuggccugagcug

SEQ ID NO: 933166 - RNA, 17 nt, Homo sapiens
cccaauauuuaccagac

SEQ ID NO: 933167 - RNA, 19 nt, Homo sapiens
cccacgcuggagugcagug

SEQ ID NO: 933168 - RNA, 16 nt, Homo sapiens
cccacugcucugguua

SEQ ID NO: 933169 - RNA, 20 nt, Homo sapiens
cccagcccacuucugccaua

SEQ ID NO: 933170 - RNA, 20 nt, Homo sapiens
cccagcucugguccauagag

SEQ ID NO: 933171 - RNA, 20 nt, Homo sapiens
cccaggccuccccagcaccu

SEQ ID NO: 933172 - RNA, 16 nt, Homo sapiens
cccaguuagcucucaa

SEQ ID NO: 933173 - RNA, 23 nt, Homo sapiens
ccccaggcugggcuguucacucu

SEQ ID NO: 933174 - RNA, 15 nt, Homo sapiens
ccccuguucuggcag

SEQ ID NO: 933175 - RNA, 13 nt, Homo sapiens
cccugcccggcug

SEQ ID NO: 933176 - RNA, 18 nt, Homo sapiens
ccgcauuuggauuggaug

SEQ ID NO: 933177 - RNA, 12 nt, Homo sapiens
ccggcugcgugg

SEQ ID NO: 933178 - RNA, 19 nt, Homo sapiens
ccgugaggccagagacaca

SEQ ID NO: 933179 - RNA, 15 nt, Homo sapiens
ccuaauccucuagga

SEQ ID NO: 933180 - RNA, 23 nt, Homo sapiens
ccuacaguugaaaaacagcugag

SEQ ID NO: 933181 - RNA, 16 nt, Homo sapiens
ccuauauuguuuucag

SEQ ID NO: 933182 - RNA, 23 nt, Homo sapiens
ccucagggucccugguggcagcu

SEQ ID NO: 933183 - RNA, 19 nt, Homo sapiens
ccucauuagcauuuugcua

SEQ ID NO: 933184 - RNA, 21 nt, Homo sapiens
ccucccaaagugcugggauua

SEQ ID NO: 933185 - RNA, 13 nt, Homo sapiens
ccucucucaggcc

SEQ ID NO: 933186 - RNA, 17 nt, Homo sapiens
ccucuuagaaaaaccac

SEQ ID NO: 933187 - RNA, 21 nt, Homo sapiens
uuaugagaaaugccagugugc

SEQ ID NO: 933188 - RNA, 12 nt, Homo sapiens
uucaaacuuuac

SEQ ID NO: 933189 - RNA, 15 nt, Homo sapiens
uucaaccccaugaga

SEQ ID NO: 933190 - RNA, 15 nt, Homo sapiens
uucacagccaugauu

SEQ ID NO: 933191 - RNA, 23 nt, Homo sapiens
uucacaguucucuccuucuuccc

SEQ ID NO: 933192 - RNA, 16 nt, Homo sapiens
uucagccaagaauucu

SEQ ID NO: 933193 - RNA, 16 nt, Homo sapiens
uucaguguacauggaa

SEQ ID NO: 933194 - RNA, 23 nt, Homo sapiens
uucauuuggcauuccccacuuga

SEQ ID NO: 933195 - RNA, 18 nt, Homo sapiens
uuccaaugcuuugauccc

SEQ ID NO: 933196 - RNA, 17 nt, Homo sapiens
uuccacaaguuaaauaa

SEQ ID NO: 933197 - RNA, 14 nt, Homo sapiens
uuccccacuugaga

SEQ ID NO: 933198 - RNA, 21 nt, Homo sapiens
uucccuuuuuuggcugcugaa

SEQ ID NO: 933199 - RNA, 18 nt, Homo sapiens
uuccucauuagcauuuug

SEQ ID NO: 933200 - RNA, 12 nt, Homo sapiens
uuccugaggcug

SEQ ID NO: 933201 - RNA, 23 nt, Homo sapiens
uucgaauccagagagcagugugg

SEQ ID NO: 933202 - RNA, 15 nt, Homo sapiens
uucucucuucuccac

SEQ ID NO: 933203 - RNA, 22 nt, Homo sapiens
uucucuugagaggguggaauau

SEQ ID NO: 933204 - RNA, 20 nt, Homo sapiens
uucuguccgagcuuugaaaa

SEQ ID NO: 933205 - RNA, 13 nt, Homo sapiens
uucuuccacaaga

SEQ ID NO: 933206 - RNA, 22 nt, Homo sapiens
uucuuccccccaaaacugauua

SEQ ID NO: 933207 - RNA, 23 nt, Homo sapiens
uugaagacuuuucuuucagccaa

SEQ ID NO: 933208 - RNA, 13 nt, Homo sapiens
uugacaggauuau

SEQ ID NO: 933209 - RNA, 17 nt, Homo sapiens
uugaccgugaggccaga

SEQ ID NO: 933210 - RNA, 13 nt, Homo sapiens
uugagacagaguu

SEQ ID NO: 933211 - RNA, 20 nt, Homo sapiens
uugagcucaggaguuugaga

SEQ ID NO: 933212 - RNA, 20 nt, Homo sapiens
uugaguccagaaguuugaga

SEQ ID NO: 933213 - RNA, 15 nt, Homo sapiens
uugauguucuuucac

SEQ ID NO: 933214 - RNA, 21 nt, Homo sapiens
uugcaaaguaucccuacugua

SEQ ID NO: 933215 - RNA, 22 nt, Homo sapiens
uugcccacacuugggagcaaaa

SEQ ID NO: 933216 - RNA, 13 nt, Homo sapiens
uugcggacagcca

SEQ ID NO: 933217 - RNA, 16 nt, Homo sapiens
uugcugucccuuuucc

SEQ ID NO: 933218 - RNA, 15 nt, Homo sapiens
uuggaauuuugugcc

SEQ ID NO: 933219 - RNA, 16 nt, Homo sapiens
uugggcuggugucacc

SEQ ID NO: 933220 - RNA, 10 nt, Homo sapiens
uuggggacca

SEQ ID NO: 933221 - RNA, 20 nt, Homo sapiens
uugugauacaaugcugugcc

SEQ ID NO: 933222 - RNA, 18 nt, Homo sapiens
uuguuucaaccaguuuga

SEQ ID NO: 933223 - RNA, 12 nt, Homo sapiens
uuuacaacuggg

SEQ ID NO: 933224 - RNA, 15 nt, Homo sapiens
uuucaaccaguuuga

SEQ ID NO: 933225 - RNA, 23 nt, Homo sapiens
uuucaguggcuaccuacauacaa

SEQ ID NO: 933226 - RNA, 18 nt, Homo sapiens
uuucauuuaggugaggaa

SEQ ID NO: 933227 - RNA, 18 nt, Homo sapiens
uuucuaugacacaugcaa

SEQ ID NO: 933228 - RNA, 18 nt, Homo sapiens
uuugcuaagugaggauga

SEQ ID NO: 933229 - RNA, 21 nt, Homo sapiens
uuugucauauaagauucauau

SEQ ID NO: 933230 - RNA, 21 nt, Homo sapiens
uuuuaaaaaaaucccauuuaa

SEQ ID NO: 933231 - RNA, 23 nt, Homo sapiens
uuuuaugagaaaugccagugugc

SEQ ID NO: 933232 - RNA, 14 nt, Homo sapiens
uuuuccugccaggc

SEQ ID NO: 933233 - RNA, 18 nt, Homo sapiens
uuuuguuccacaaguuaa

SEQ ID NO: 933234 - RNA, 14 nt, Homo sapiens
aguagagacagggu

SEQ ID NO: 933235 - RNA, 15 nt, Homo sapiens
aguagagucacugga

SEQ ID NO: 933236 - RNA, 14 nt, Homo sapiens
aguagcugggacua

SEQ ID NO: 933237 - RNA, 16 nt, Homo sapiens
aguaucccuacuguaa

SEQ ID NO: 933238 - RNA, 15 nt, Homo sapiens
agucucuugauucau

SEQ ID NO: 933239 - RNA, 13 nt, Homo sapiens
agugagacccugu

SEQ ID NO: 933240 - RNA, 15 nt, Homo sapiens
agugagcaucaugga

SEQ ID NO: 933241 - RNA, 19 nt, Homo sapiens
agugauccucccaccucag

SEQ ID NO: 933242 - RNA, 20 nt, Homo sapiens
agugggagcugaguggggga

SEQ ID NO: 933243 - RNA, 19 nt, Homo sapiens
aguggggcuggaagcagaa

SEQ ID NO: 933244 - RNA, 19 nt, Homo sapiens
agugggugaauaauacagu

SEQ ID NO: 933245 - RNA, 21 nt, Homo sapiens
aguggugcgaucuggguucac

SEQ ID NO: 933246 - RNA, 22 nt, Homo sapiens
agugguggugaacagaacaaaa

SEQ ID NO: 933247 - RNA, 15 nt, Homo sapiens
aguucaucuugaauu

SEQ ID NO: 933248 - RNA, 13 nt, Homo sapiens
aguugaagacaga

SEQ ID NO: 933249 - RNA, 14 nt, Homo sapiens
aguugccagucacc

SEQ ID NO: 933250 - RNA, 18 nt, Homo sapiens
aguuggucccccuuccau

SEQ ID NO: 933251 - RNA, 19 nt, Homo sapiens
aguuugagaccaaccuggg

SEQ ID NO: 933252 - RNA, 11 nt, Homo sapiens
aguuugcaguu

SEQ ID NO: 933253 - RNA, 12 nt, Homo sapiens
aguuuuaugaga

SEQ ID NO: 933254 - RNA, 23 nt, Homo sapiens
auaaaguuucuguugauaaucau

SEQ ID NO: 933255 - RNA, 18 nt, Homo sapiens
auaaaguuuuaugagaaa

SEQ ID NO: 933256 - RNA, 13 nt, Homo sapiens
auaaaucauaaaa

SEQ ID NO: 933257 - RNA, 14 nt, Homo sapiens
auaaccuagccuua

SEQ ID NO: 933258 - RNA, 23 nt, Homo sapiens
auaagaaccuuuugagugccuua

SEQ ID NO: 933259 - RNA, 20 nt, Homo sapiens
auaaugacuuaagcacacuu

SEQ ID NO: 933260 - RNA, 15 nt, Homo sapiens
auaauuaguuccuca

SEQ ID NO: 933261 - RNA, 16 nt, Homo sapiens
auaauucuacuuugag

SEQ ID NO: 933262 - RNA, 13 nt, Homo sapiens
auacacuuacacu

SEQ ID NO: 933263 - RNA, 20 nt, Homo sapiens
auacagacagagauggccau

SEQ ID NO: 933264 - RNA, 14 nt, Homo sapiens
auacaguaucucag

SEQ ID NO: 933265 - RNA, 16 nt, Homo sapiens
auacaguaucucaggg

SEQ ID NO: 933266 - RNA, 15 nt, Homo sapiens
auacauuugauaaag

SEQ ID NO: 933267 - RNA, 13 nt, Homo sapiens
auacccaucccau

SEQ ID NO: 933268 - RNA, 17 nt, Homo sapiens
auaccugucccccugac

SEQ ID NO: 933269 - RNA, 17 nt, Homo sapiens
auagccaaggccaaagg

SEQ ID NO: 933270 - RNA, 13 nt, Homo sapiens
auauaacuuuuuc

SEQ ID NO: 933271 - RNA, 15 nt, Homo sapiens
auauauaagccaaaa

SEQ ID NO: 933272 - RNA, 15 nt, Homo sapiens
auauguggaguucau

SEQ ID NO: 933273 - RNA, 21 nt, Homo sapiens
auauuaaggaagacaauguga

SEQ ID NO: 933274 - RNA, 17 nt, Homo sapiens
auauugccauuucuucc

SEQ ID NO: 933275 - RNA, 18 nt, Homo sapiens
auauugccauuucuucca

SEQ ID NO: 933276 - RNA, 17 nt, Homo sapiens
auauugcugauggugca

SEQ ID NO: 933277 - RNA, 17 nt, Homo sapiens
auauuuaccagaccaca

SEQ ID NO: 933278 - RNA, 11 nt, Homo sapiens
aucaccagaca

SEQ ID NO: 933279 - RNA, 17 nt, Homo sapiens
aucacggcucacugcag

SEQ ID NO: 933280 - RNA, 22 nt, Homo sapiens
aucacggcucacugcagccuca

SEQ ID NO: 933281 - RNA, 16 nt, Homo sapiens
aucauaaaacuugaug

SEQ ID NO: 933282 - RNA, 16 nt, Homo sapiens
auccacccaccucagc

SEQ ID NO: 933283 - RNA, 13 nt, Homo sapiens
auccacugugcca

SEQ ID NO: 933284 - RNA, 18 nt, Homo sapiens
auccagagagcagugugg

SEQ ID NO: 933285 - RNA, 15 nt, Homo sapiens
aucccaugagccuca

SEQ ID NO: 933286 - RNA, 14 nt, Homo sapiens
aucccucauccuca

SEQ ID NO: 933287 - RNA, 15 nt, Homo sapiens
auccuagcacuuugg

SEQ ID NO: 933288 - RNA, 17 nt, Homo sapiens
aucgaugcagugcuucc

SEQ ID NO: 933289 - RNA, 20 nt, Homo sapiens
aucgucacugcuuaacuuca

SEQ ID NO: 933290 - RNA, 21 nt, Homo sapiens
aucgucacugcuuaacuucac

SEQ ID NO: 933291 - RNA, 14 nt, Homo sapiens
aucugaaaauguau

SEQ ID NO: 933292 - RNA, 18 nt, Homo sapiens
aucuuccaaggguacuaa

SEQ ID NO: 933293 - RNA, 22 nt, Homo sapiens
aucuuccaaggguacuaaggaa

SEQ ID NO: 933294 - RNA, 12 nt, Homo sapiens
aucuuugcagac

SEQ ID NO: 933295 - RNA, 14 nt, Homo sapiens
augaaaauucuuga

SEQ ID NO: 933296 - RNA, 16 nt, Homo sapiens
augaaacauuuuguca

SEQ ID NO: 933297 - RNA, 14 nt, Homo sapiens
augacaucagcaau

SEQ ID NO: 933298 - RNA, 17 nt, Homo sapiens
augacaucugucuagga

SEQ ID NO: 933299 - RNA, 14 nt, Homo sapiens
augagaaaugccag

SEQ ID NO: 933300 - RNA, 16 nt, Homo sapiens
augaguaacaggaaaa

SEQ ID NO: 933301 - RNA, 22 nt, Homo sapiens
augauccuaggcauuugcugaa

SEQ ID NO: 933302 - RNA, 23 nt, Homo sapiens
augaugccaugaggaacaaggca

SEQ ID NO: 933303 - RNA, 9 nt, Homo sapiens
augcacaaa

SEQ ID NO: 933304 - RNA, 18 nt, Homo sapiens
augcacagcuaacaugga

SEQ ID NO: 933305 - RNA, 19 nt, Homo sapiens
augcacagcuaacauggaa

SEQ ID NO: 933306 - RNA, 16 nt, Homo sapiens
augccagcuuaucuca

SEQ ID NO: 933307 - RNA, 19 nt, Homo sapiens
augccagcuuaucucaggg

SEQ ID NO: 933308 - RNA, 19 nt, Homo sapiens
augccucucucaggccaaa

SEQ ID NO: 933309 - RNA, 20 nt, Homo sapiens
augccucucucaggccaaac

SEQ ID NO: 933310 - RNA, 16 nt, Homo sapiens
augcuggcuguuggcu

SEQ ID NO: 933311 - RNA, 18 nt, Homo sapiens
auggcugccaaugggagc

SEQ ID NO: 933312 - RNA, 23 nt, Homo sapiens
auggcugccaaugggagcucaug

SEQ ID NO: 933313 - RNA, 16 nt, Homo sapiens
auggcuuuugugcauu

SEQ ID NO: 933314 - RNA, 16 nt, Homo sapiens
augggggugcauuuga

SEQ ID NO: 933315 - RNA, 23 nt, Homo sapiens
augugagaccauuuagcacacug

SEQ ID NO: 933316 - RNA, 22 nt, Homo sapiens
augugauaaaaccccaucucua

SEQ ID NO: 933317 - RNA, 14 nt, Homo sapiens
augugcacaugcac

SEQ ID NO: 933318 - RNA, 15 nt, Homo sapiens
auguguguucaugca

SEQ ID NO: 933319 - RNA, 14 nt, Homo sapiens
auguguuuccauau

SEQ ID NO: 933320 - RNA, 17 nt, Homo sapiens
auguucucugaggacac

SEQ ID NO: 933321 - RNA, 17 nt, Homo sapiens
auguucuuucacccuuu

SEQ ID NO: 933322 - RNA, 21 nt, Homo sapiens
auuacaacugcuacagagcag

SEQ ID NO: 933323 - RNA, 19 nt, Homo sapiens
auuacaggaaguacuggag

SEQ ID NO: 933324 - RNA, 23 nt, Homo sapiens
auuacaggugugaaccaccacac

SEQ ID NO: 933325 - RNA, 18 nt, Homo sapiens
auuauaauuaguuccuca

SEQ ID NO: 933326 - RNA, 14 nt, Homo sapiens
auucagcucugcaa

SEQ ID NO: 933327 - RNA, 16 nt, Homo sapiens
auucauaaugacuuaa

SEQ ID NO: 933328 - RNA, 17 nt, Homo sapiens
auucauauuuacuucuu

SEQ ID NO: 933329 - RNA, 17 nt, Homo sapiens
auucgcugugucagcau

SEQ ID NO: 933330 - RNA, 17 nt, Homo sapiens
auucucauuugucacac

SEQ ID NO: 933331 - RNA, 19 nt, Homo sapiens
auucucauuugucacacac

SEQ ID NO: 933332 - RNA, 15 nt, Homo sapiens
auucuccugccucag

SEQ ID NO: 933333 - RNA, 14 nt, Homo sapiens
auucucuccuguac

SEQ ID NO: 933334 - RNA, 19 nt, Homo sapiens
auucucuccuguaccucuu

SEQ ID NO: 933335 - RNA, 21 nt, Homo sapiens
auucuucuccacuuucuagcc

SEQ ID NO: 933336 - RNA, 13 nt, Homo sapiens
auugaaaaaccau

SEQ ID NO: 933337 - RNA, 15 nt, Homo sapiens
auugauaagaaccuu

SEQ ID NO: 933338 - RNA, 23 nt, Homo sapiens
auuuccugugucuuuuuucacua

SEQ ID NO: 933339 - RNA, 19 nt, Homo sapiens
auuugaacucuucaaucuc

SEQ ID NO: 933340 - RNA, 16 nt, Homo sapiens
auuugcugaauacaga

SEQ ID NO: 933341 - RNA, 20 nt, Homo sapiens
auuuugggguacccacugcu

SEQ ID NO: 933342 - RNA, 19 nt, Homo sapiens
auuuuguuuuugucuuaaa

SEQ ID NO: 933343 - RNA, 13 nt, Homo sapiens
caaaaacaacaac

SEQ ID NO: 933344 - RNA, 17 nt, Homo sapiens
caaaacauuuuacuuua

SEQ ID NO: 933345 - RNA, 15 nt, Homo sapiens
caaacucaccugccc

SEQ ID NO: 933346 - RNA, 15 nt, Homo sapiens
caaaggaagcacaug

SEQ ID NO: 933347 - RNA, 14 nt, Homo sapiens
caaaugcccagcuu

SEQ ID NO: 933348 - RNA, 24 nt, Homo sapiens
caacacucacauuuauucugcuca

SEQ ID NO: 933349 - RNA, 22 nt, Homo sapiens
caaccacugcgaccacaagaag

SEQ ID NO: 933350 - RNA, 13 nt, Homo sapiens
caaccccaugaga

SEQ ID NO: 933351 - RNA, 11 nt, Homo sapiens
caaggccaaag

SEQ ID NO: 933352 - RNA, 20 nt, Homo sapiens
caaggccaaaggaagcacau

SEQ ID NO: 933353 - RNA, 22 nt, Homo sapiens
caaguccucagugguuggcaau

SEQ ID NO: 933354 - RNA, 20 nt, Homo sapiens
cacaaaauguaggguuauaa

SEQ ID NO: 933355 - RNA, 22 nt, Homo sapiens
cacacccagcccacuucugcca

SEQ ID NO: 933356 - RNA, 19 nt, Homo sapiens
cacagaaaauggaagacag

SEQ ID NO: 933357 - RNA, 15 nt, Homo sapiens
cacagcuaacaugga

SEQ ID NO: 933358 - RNA, 20 nt, Homo sapiens
cacagcuucauuuccugugu

SEQ ID NO: 933359 - RNA, 23 nt, Homo sapiens
cacaguauuacuucugcuacaua

SEQ ID NO: 933360 - RNA, 20 nt, Homo sapiens
cuuuaagagaaaugagcugc

SEQ ID NO: 933361 - RNA, 15 nt, Homo sapiens
cuuuagcgcccaguu

SEQ ID NO: 933362 - RNA, 18 nt, Homo sapiens
cuuucccucccuuccucu

SEQ ID NO: 933363 - RNA, 14 nt, Homo sapiens
cuuuguacagacaa

SEQ ID NO: 933364 - RNA, 20 nt, Homo sapiens
cuuuuauaaacuuuaccuuu

SEQ ID NO: 933365 - RNA, 15 nt, Homo sapiens
cuuuucauaaccuag

SEQ ID NO: 933366 - RNA, 11 nt, Homo sapiens
cuuuugugcau

SEQ ID NO: 933367 - RNA, 18 nt, Homo sapiens
gaaaaaauaacacuguac

SEQ ID NO: 933368 - RNA, 12 nt, Homo sapiens
gaaaacacuguu

SEQ ID NO: 933369 - RNA, 22 nt, Homo sapiens
gaaaagaggggaagagacuugg

SEQ ID NO: 933370 - RNA, 20 nt, Homo sapiens
gaaaagcugcugacaguguu

SEQ ID NO: 933371 - RNA, 13 nt, Homo sapiens
gaaaugccagugu

SEQ ID NO: 933372 - RNA, 13 nt, Homo sapiens
gaagacaauguga

SEQ ID NO: 933373 - RNA, 21 nt, Homo sapiens
gaagccagcaggcucucaggc

SEQ ID NO: 933374 - RNA, 20 nt, Homo sapiens
gaagguucuacgccagggga

SEQ ID NO: 933375 - RNA, 19 nt, Homo sapiens
gaagucacacaguauuacu

SEQ ID NO: 933376 - RNA, 16 nt, Homo sapiens
gaauccagacccggcu

SEQ ID NO: 933377 - RNA, 14 nt, Homo sapiens
gaauguuugccucu

SEQ ID NO: 933378 - RNA, 16 nt, Homo sapiens
gaauuuuuacugggga

SEQ ID NO: 933379 - RNA, 17 nt, Homo sapiens
gacaccuugacagggca

SEQ ID NO: 933380 - RNA, 22 nt, Homo sapiens
gacagccacggccaggccagag

SEQ ID NO: 933381 - RNA, 14 nt, Homo sapiens
gacaggaccaggga

SEQ ID NO: 933382 - RNA, 19 nt, Homo sapiens
gacaguuaagagaaaugag

SEQ ID NO: 933383 - RNA, 18 nt, Homo sapiens
gacauugcggacagccac

SEQ ID NO: 933384 - RNA, 18 nt, Homo sapiens
gaccagggauuuccauga

SEQ ID NO: 933385 - RNA, 13 nt, Homo sapiens
gaccaucccugaa

SEQ ID NO: 933386 - RNA, 18 nt, Homo sapiens
gaccucugccugaaguca

SEQ ID NO: 933387 - RNA, 14 nt, Homo sapiens
gacuuggaaauggg

SEQ ID NO: 933388 - RNA, 13 nt, Homo sapiens
gagaaaugagcug

SEQ ID NO: 933389 - RNA, 17 nt, Homo sapiens
gagaaaugccagugugc

SEQ ID NO: 933390 - RNA, 18 nt, Homo sapiens
gagaagagaaugcacaaa

SEQ ID NO: 933391 - RNA, 21 nt, Homo sapiens
gagacagcacaggcagcccca

SEQ ID NO: 933392 - RNA, 16 nt, Homo sapiens
gagagggggauguuuc

SEQ ID NO: 933393 - RNA, 18 nt, Homo sapiens
gagauagccaaggccaaa

SEQ ID NO: 933394 - RNA, 21 nt, Homo sapiens
gagaucacgccacugcacuau

SEQ ID NO: 933395 - RNA, 17 nt, Homo sapiens
gagccuccugcccuuac

SEQ ID NO: 933396 - RNA, 16 nt, Homo sapiens
gagccuggcaagaaug

SEQ ID NO: 933397 - RNA, 11 nt, Homo sapiens
gagcugggaug

SEQ ID NO: 933398 - RNA, 15 nt, Homo sapiens
gaggaaagcaaagga

SEQ ID NO: 933399 - RNA, 15 nt, Homo sapiens
gaggccucgacccac

SEQ ID NO: 933400 - RNA, 11 nt, Homo sapiens
gaggcuaugug

SEQ ID NO: 933401 - RNA, 22 nt, Homo sapiens
gaggcugggcucccuucccacc

SEQ ID NO: 933402 - RNA, 14 nt, Homo sapiens
gagggagugacaga

SEQ ID NO: 933403 - RNA, 15 nt, Homo sapiens
gaggugggauccucc

SEQ ID NO: 933404 - RNA, 18 nt, Homo sapiens
gaguacuacaguccuccc

SEQ ID NO: 933405 - RNA, 19 nt, Homo sapiens
gagugagacucugucucaa

SEQ ID NO: 933406 - RNA, 19 nt, Homo sapiens
gagugggcccaaugcacuu

SEQ ID NO: 933407 - RNA, 21 nt, Homo sapiens
gaguuauuuuuauuuauuuaa

SEQ ID NO: 933408 - RNA, 14 nt, Homo sapiens
gauacccaucccau

SEQ ID NO: 933409 - RNA, 20 nt, Homo sapiens
gauacccaucccauaugccu

SEQ ID NO: 933410 - RNA, 20 nt, Homo sapiens
gauagauauaugcucugcau

SEQ ID NO: 933411 - RNA, 23 nt, Homo sapiens
gaucacagccucugaaaaccaau

SEQ ID NO: 933412 - RNA, 19 nt, Homo sapiens
gaucagccugggcaaugug

SEQ ID NO: 933413 - RNA, 18 nt, Homo sapiens
gaucauccacugugccau

SEQ ID NO: 933414 - RNA, 16 nt, Homo sapiens
gauccacccaccucag

SEQ ID NO: 933415 - RNA, 16 nt, Homo sapiens
gaugauaaaacacaaa

SEQ ID NO: 933416 - RNA, 15 nt, Homo sapiens
gaugcagugcuucca

SEQ ID NO: 933417 - RNA, 13 nt, Homo sapiens
gauuaaacuuaau

SEQ ID NO: 933418 - RNA, 18 nt, Homo sapiens
gauuaauuaaaacacaac

SEQ ID NO: 933419 - RNA, 21 nt, Homo sapiens
gauuaauuaaaacacaacauc

SEQ ID NO: 933420 - RNA, 18 nt, Homo sapiens
gauuacaggugugaacca

SEQ ID NO: 933421 - RNA, 14 nt, Homo sapiens
gauucauaaugacu

SEQ ID NO: 933422 - RNA, 18 nt, Homo sapiens
gcaaaagcaucuauguga

SEQ ID NO: 933423 - RNA, 19 nt, Homo sapiens
gcacagacccugcccugug

SEQ ID NO: 933424 - RNA, 21 nt, Homo sapiens
gcacuauaauguaagcucuac

SEQ ID NO: 933425 - RNA, 21 nt, Homo sapiens
gcacugacauuguuggccaaa

SEQ ID NO: 933426 - RNA, 20 nt, Homo sapiens
gcagaaggaagacuucaucc

SEQ ID NO: 933427 - RNA, 19 nt, Homo sapiens
gcagagguugggaggccau

SEQ ID NO: 933428 - RNA, 22 nt, Homo sapiens
gcagcagggagggcuucugcca

SEQ ID NO: 933429 - RNA, 18 nt, Homo sapiens
gcagccuggggucugaca

SEQ ID NO: 933430 - RNA, 19 nt, Homo sapiens
gcagccuggggucugacaa

SEQ ID NO: 933431 - RNA, 20 nt, Homo sapiens
gcauggcugccaaugggagc

SEQ ID NO: 933432 - RNA, 19 nt, Homo sapiens
gcauuuacuuuguguucac

SEQ ID NO: 933433 - RNA, 20 nt, Homo sapiens
gccaagcagagguugggagg

SEQ ID NO: 933434 - RNA, 17 nt, Homo sapiens
gccagcaggcucucagg

SEQ ID NO: 933435 - RNA, 13 nt, Homo sapiens
gccaggaagccag

SEQ ID NO: 933436 - RNA, 23 nt, Homo sapiens
gccaggccagagggagugacaga

SEQ ID NO: 933437 - RNA, 21 nt, Homo sapiens
gccaguuggucccccuuccau

SEQ ID NO: 933438 - RNA, 18 nt, Homo sapiens
gccaugggccuccugugu

SEQ ID NO: 933439 - RNA, 12 nt, Homo sapiens
gcccacacuugg

SEQ ID NO: 933440 - RNA, 18 nt, Homo sapiens
gcccaguuggguggaugc

SEQ ID NO: 933441 - RNA, 15 nt, Homo sapiens
gccccugcccggcug

SEQ ID NO: 933442 - RNA, 23 nt, Homo sapiens
gcccugugggcccccaaauggaa

SEQ ID NO: 933443 - RNA, 21 nt, Homo sapiens
gccgagauagccaaggccaaa

SEQ ID NO: 933444 - RNA, 21 nt, Homo sapiens
gccgagaucacgccacugcac

SEQ ID NO: 933445 - RNA, 13 nt, Homo sapiens
gccucacaguccu

SEQ ID NO: 933446 - RNA, 13 nt, Homo sapiens
gccucagugccac

SEQ ID NO: 933447 - RNA, 15 nt, Homo sapiens
gccuccccagcaccu

SEQ ID NO: 933448 - RNA, 16 nt, Homo sapiens
gccucugcacuccccu

SEQ ID NO: 933449 - RNA, 14 nt, Homo sapiens
gccugccucuucuc

SEQ ID NO: 933450 - RNA, 16 nt, Homo sapiens
gccuggucguuuucaa

SEQ ID NO: 933451 - RNA, 14 nt, Homo sapiens
gccugguggcagcu

SEQ ID NO: 933452 - RNA, 11 nt, Homo sapiens
gccuuacacaa

SEQ ID NO: 933453 - RNA, 20 nt, Homo sapiens
gcgaucuggguucacugcaa

SEQ ID NO: 933454 - RNA, 13 nt, Homo sapiens
gcggcuggcagcc

SEQ ID NO: 933455 - RNA, 18 nt, Homo sapiens
gcgggggagcaggcagug

SEQ ID NO: 933456 - RNA, 16 nt, Homo sapiens
gcgugagccacugcac

SEQ ID NO: 933457 - RNA, 14 nt, Homo sapiens
gcuaggaacacucc

SEQ ID NO: 933458 - RNA, 23 nt, Homo sapiens
uaucuaauauguaacaagccacc

SEQ ID NO: 933459 - RNA, 22 nt, Homo sapiens
uaucuugaagacuuuucuuuca

SEQ ID NO: 933460 - RNA, 18 nt, Homo sapiens
uauucaguaauaacucua

SEQ ID NO: 933461 - RNA, 13 nt, Homo sapiens
uauuuaccagacc

SEQ ID NO: 933462 - RNA, 18 nt, Homo sapiens
uauuucccucaccuuucc

SEQ ID NO: 933463 - RNA, 16 nt, Homo sapiens
uauuuuuagacagagu

SEQ ID NO: 933464 - RNA, 17 nt, Homo sapiens
ucaaaauaaaaaugagg

SEQ ID NO: 933465 - RNA, 22 nt, Homo sapiens
ucaaaauaaaaaugagguacuc

SEQ ID NO: 933466 - RNA, 20 nt, Homo sapiens
ucaaagauauuuugcuuugu

SEQ ID NO: 933467 - RNA, 16 nt, Homo sapiens
ucaaggcugcagugag

SEQ ID NO: 933468 - RNA, 18 nt, Homo sapiens
ucaccaaaucagcugcua

SEQ ID NO: 933469 - RNA, 19 nt, Homo sapiens
ucaccaacgucugugccau

SEQ ID NO: 933470 - RNA, 18 nt, Homo sapiens
ucaccucaccccacugug

SEQ ID NO: 933471 - RNA, 17 nt, Homo sapiens
ucagaaauguguuauca

SEQ ID NO: 933472 - RNA, 17 nt, Homo sapiens
ucagaucucuaacuuca

SEQ ID NO: 933473 - RNA, 22 nt, Homo sapiens
ucagccauuccuguucccauga

SEQ ID NO: 933474 - RNA, 14 nt, Homo sapiens
ucagccucccaaag

SEQ ID NO: 933475 - RNA, 13 nt, Homo sapiens
ucagggucccugg

SEQ ID NO: 933476 - RNA, 15 nt, Homo sapiens
ucaguaauaacucua

SEQ ID NO: 933477 - RNA, 13 nt, Homo sapiens
ucauucaacccac

SEQ ID NO: 933478 - RNA, 20 nt, Homo sapiens
ucauugaccugaggcccuuc

SEQ ID NO: 933479 - RNA, 17 nt, Homo sapiens
uccaaaguacacuguuu

SEQ ID NO: 933480 - RNA, 12 nt, Homo sapiens
uccagacacaug

SEQ ID NO: 933481 - RNA, 14 nt, Homo sapiens
uccagacccggcug

SEQ ID NO: 933482 - RNA, 15 nt, Homo sapiens
uccagcucaccagcc

SEQ ID NO: 933483 - RNA, 19 nt, Homo sapiens
uccaugauguuuuccauga

SEQ ID NO: 933484 - RNA, 15 nt, Homo sapiens
ucccacucaguccau

SEQ ID NO: 933485 - RNA, 9 nt, Homo sapiens
ucccagugc

SEQ ID NO: 933486 - RNA, 15 nt, Homo sapiens
ucccaucacuucccu

SEQ ID NO: 933487 - RNA, 16 nt, Homo sapiens
ucccaucucacacaug

SEQ ID NO: 933488 - RNA, 15 nt, Homo sapiens
ucccaucugugaaag

SEQ ID NO: 933489 - RNA, 20 nt, Homo sapiens
augagaggaaaucaccgaaa

SEQ ID NO: 933490 - RNA, 13 nt, Homo sapiens
augagaugaugcc

SEQ ID NO: 933491 - RNA, 20 nt, Homo sapiens
augagccuggcaagaaugug

SEQ ID NO: 933492 - RNA, 13 nt, Homo sapiens
augaggcauuugu

SEQ ID NO: 933493 - RNA, 20 nt, Homo sapiens
augagguacucuccuggaaa

SEQ ID NO: 933494 - RNA, 18 nt, Homo sapiens
augcauucccuacagauu

SEQ ID NO: 933495 - RNA, 18 nt, Homo sapiens
augccagcuuaucucagg

SEQ ID NO: 933496 - RNA, 20 nt, Homo sapiens
augcuugcuucaaccccaug

SEQ ID NO: 933497 - RNA, 18 nt, Homo sapiens
auggacaugaucuucuuu

SEQ ID NO: 933498 - RNA, 15 nt, Homo sapiens
auggcuuuugugcau

SEQ ID NO: 933499 - RNA, 17 nt, Homo sapiens
ccacaucuugcucugcu

SEQ ID NO: 933500 - RNA, 17 nt, Homo sapiens
ccaccuuggcucaaguc

SEQ ID NO: 933501 - RNA, 15 nt, Homo sapiens
ccacggccaggccag

SEQ ID NO: 933502 - RNA, 19 nt, Homo sapiens
ccacuuucuagccagagga

SEQ ID NO: 933503 - RNA, 13 nt, Homo sapiens
ccagacccggcug

SEQ ID NO: 933504 - RNA, 13 nt, Homo sapiens
ccagagcugccac

SEQ ID NO: 933505 - RNA, 14 nt, Homo sapiens
ccaggaagccagca

SEQ ID NO: 933506 - RNA, 15 nt, Homo sapiens
ccaggagcagccaca

SEQ ID NO: 933507 - RNA, 18 nt, Homo sapiens
ccaggcaggucuugaacu

SEQ ID NO: 933508 - RNA, 22 nt, Homo sapiens
ccaggugcuaggaacacuccuu

SEQ ID NO: 933509 - RNA, 20 nt, Homo sapiens
ccaguaaaugggggugcauu

SEQ ID NO: 933510 - RNA, 13 nt, Homo sapiens
ccaguaucuugaa

SEQ ID NO: 933511 - RNA, 16 nt, Homo sapiens
ccaugagaugaugcca

SEQ ID NO: 933512 - RNA, 17 nt, Homo sapiens
ccauggacccaauauuu

SEQ ID NO: 933513 - RNA, 17 nt, Homo sapiens
cccacuguggcugauuu

SEQ ID NO: 933514 - RNA, 20 nt, Homo sapiens
cccacuguggcugauuugga

SEQ ID NO: 933515 - RNA, 20 nt, Homo sapiens
cccagagaggguggugaccu

SEQ ID NO: 933516 - RNA, 17 nt, Homo sapiens
cccagagugaacacucu

SEQ ID NO: 933517 - RNA, 21 nt, Homo sapiens
cccagauagcuggcugggugg

SEQ ID NO: 933518 - RNA, 12 nt, Homo sapiens
cccagauugcaa

SEQ ID NO: 933519 - RNA, 23 nt, Homo sapiens
cccauguaagcaccccuucauuu

SEQ ID NO: 933520 - RNA, 16 nt, Homo sapiens
cccauugauguacuuu

SEQ ID NO: 933521 - RNA, 16 nt, Homo sapiens
ccccaggguccuguag

SEQ ID NO: 933522 - RNA, 22 nt, Homo sapiens
ccccgcacugggcuuggggacc

SEQ ID NO: 933523 - RNA, 12 nt, Homo sapiens
cccggcccagug

SEQ ID NO: 933524 - RNA, 11 nt, Homo sapiens
cccuacaugga

SEQ ID NO: 933525 - RNA, 15 nt, Homo sapiens
cccuggccuagcaua

SEQ ID NO: 933526 - RNA, 16 nt, Homo sapiens
cccugguggcagcuca

SEQ ID NO: 933527 - RNA, 14 nt, Homo sapiens
cccugucucaaaaa

SEQ ID NO: 933528 - RNA, 16 nt, Homo sapiens
ccgugaggccagagac

SEQ ID NO: 933529 - RNA, 20 nt, Homo sapiens
ccuagcacuuugggaggcca

SEQ ID NO: 933530 - RNA, 15 nt, Homo sapiens
ccuaggcauuugcug

SEQ ID NO: 933531 - RNA, 17 nt, Homo sapiens
ccuaggcauuugcugaa

SEQ ID NO: 933532 - RNA, 16 nt, Homo sapiens
ccuaguuccaccauca

SEQ ID NO: 933533 - RNA, 13 nt, Homo sapiens
ccucauuagcauu

SEQ ID NO: 933534 - RNA, 23 nt, Homo sapiens
ccuccuccagccgccaugcuccu

SEQ ID NO: 933535 - RNA, 13 nt, Homo sapiens
ccucuuucccucc

SEQ ID NO: 933536 - RNA, 20 nt, Homo sapiens
ccucuuucccucccuuccuc

SEQ ID NO: 933537 - RNA, 13 nt, Homo sapiens
ccugaagucacac

SEQ ID NO: 933538 - RNA, 20 nt, Homo sapiens
ccugaagucacacagugagu

SEQ ID NO: 933539 - RNA, 23 nt, Homo sapiens
ccugacaacacucauugaccuga

SEQ ID NO: 933540 - RNA, 21 nt, Homo sapiens
ccugcccuuaccugccaggaa

SEQ ID NO: 933541 - RNA, 22 nt, Homo sapiens
ccuggaugcagccucacagucc

SEQ ID NO: 933542 - RNA, 14 nt, Homo sapiens
ccuggccucaagug

SEQ ID NO: 933543 - RNA, 17 nt, Homo sapiens
ccuggguaacuagggaa

SEQ ID NO: 933544 - RNA, 18 nt, Homo sapiens
ccuggguaacuagggaag

SEQ ID NO: 933545 - RNA, 20 nt, Homo sapiens
ccugugaguacuacaguccu

SEQ ID NO: 933546 - RNA, 13 nt, Homo sapiens
ccuguucccauga

SEQ ID NO: 933547 - RNA, 19 nt, Homo sapiens
ccuugaaaacacuguucuc

SEQ ID NO: 933548 - RNA, 20 nt, Homo sapiens
ccuuucaccacaugugcaca

SEQ ID NO: 933549 - RNA, 22 nt, Homo sapiens
ccuuuccaaaugcccagcuuaa

SEQ ID NO: 933550 - RNA, 16 nt, Homo sapiens
ccuuuugagugccuua

SEQ ID NO: 933551 - RNA, 21 nt, Homo sapiens
cgagcaugccuggauggggcu

SEQ ID NO: 933552 - RNA, 15 nt, Homo sapiens
cgaguuacagacaaa

SEQ ID NO: 933553 - RNA, 21 nt, Homo sapiens
cgcccagucuggaaugcagug

SEQ ID NO: 933554 - RNA, 22 nt, Homo sapiens
cgcuaaaugaaaaucgugacaa

SEQ ID NO: 933555 - RNA, 18 nt, Homo sapiens
cgcugugucagcauagaa

SEQ ID NO: 933556 - RNA, 19 nt, Homo sapiens
cgggcacucagaagacacu

SEQ ID NO: 933557 - RNA, 16 nt, Homo sapiens
cgugcacacaccagag

SEQ ID NO: 933558 - RNA, 19 nt, Homo sapiens
cguuucuaugacacaugca

SEQ ID NO: 933559 - RNA, 21 nt, Homo sapiens
cuaaaaggugaccaaugaugg

SEQ ID NO: 933560 - RNA, 21 nt, Homo sapiens
cuaaaguguauuuuuuuacua

SEQ ID NO: 933561 - RNA, 16 nt, Homo sapiens
cuaagagucucuauua

SEQ ID NO: 933562 - RNA, 17 nt, Homo sapiens
cuaauauguaacaagcc

SEQ ID NO: 933563 - RNA, 13 nt, Homo sapiens
cuacagagcagac

SEQ ID NO: 933564 - RNA, 19 nt, Homo sapiens
cuacagagcagacaguuaa

SEQ ID NO: 933565 - RNA, 18 nt, Homo sapiens
cuacucgaguuacagaca

SEQ ID NO: 933566 - RNA, 16 nt, Homo sapiens
cuacugaggugcuaug

SEQ ID NO: 933567 - RNA, 20 nt, Homo sapiens
cuagcacuuugggaggccaa

SEQ ID NO: 933568 - RNA, 20 nt, Homo sapiens
cuaucaaguauuauaccuuu

SEQ ID NO: 933569 - RNA, 19 nt, Homo sapiens
cucaaacucuuaaaaccca

SEQ ID NO: 933570 - RNA, 22 nt, Homo sapiens
cucaaacucuugaccucaggug

SEQ ID NO: 933571 - RNA, 15 nt, Homo sapiens
cucaaugcacugaca

SEQ ID NO: 933572 - RNA, 22 nt, Homo sapiens
cucacacggacacucaaaagcu

SEQ ID NO: 933573 - RNA, 12 nt, Homo sapiens
cucacgccugua

SEQ ID NO: 933574 - RNA, 18 nt, Homo sapiens
cucagcaggggaggguag

SEQ ID NO: 933575 - RNA, 13 nt, Homo sapiens
cucauuugucaca

SEQ ID NO: 933576 - RNA, 17 nt, Homo sapiens
cuccaugagugcagcuc

SEQ ID NO: 933577 - RNA, 16 nt, Homo sapiens
cuccuggcccacugca

SEQ ID NO: 933578 - RNA, 18 nt, Homo sapiens
cuccugggcuaagugauc

SEQ ID NO: 933579 - RNA, 20 nt, Homo sapiens
cuccuucaccuuugucccca

SEQ ID NO: 933580 - RNA, 14 nt, Homo sapiens
cucuacucuaggga

SEQ ID NO: 933581 - RNA, 13 nt, Homo sapiens
cucugcacaagcu

SEQ ID NO: 933582 - RNA, 14 nt, Homo sapiens
cucugccugaaguc

SEQ ID NO: 933583 - RNA, 22 nt, Homo sapiens
cucugccugaagucacacagug

SEQ ID NO: 933584 - RNA, 16 nt, Homo sapiens
cucuucaaucucuugc

SEQ ID NO: 933585 - RNA, 22 nt, Homo sapiens
cucuugauucauaaugacuuaa

SEQ ID NO: 933586 - RNA, 15 nt, Homo sapiens
cucuuuaaugucaca

SEQ ID NO: 933587 - RNA, 19 nt, Homo sapiens
cugaaaaccaauguucucu

SEQ ID NO: 933588 - RNA, 13 nt, Homo sapiens
cugaagucacaca

SEQ ID NO: 933589 - RNA, 18 nt, Homo sapiens
cugagugggggaucacag

SEQ ID NO: 933590 - RNA, 21 nt, Homo sapiens
cugaucauccacugugccaug

SEQ ID NO: 933591 - RNA, 15 nt, Homo sapiens
cugauggugcaauga

SEQ ID NO: 933592 - RNA, 15 nt, Homo sapiens
cugcacuccaugagu

SEQ ID NO: 933593 - RNA, 21 nt, Homo sapiens
cugcacuccaugagugcagcu

SEQ ID NO: 933594 - RNA, 14 nt, Homo sapiens
cugcacuugcagac

SEQ ID NO: 933595 - RNA, 23 nt, Homo sapiens
cugcagagggcacagaaaaugga

SEQ ID NO: 933596 - RNA, 14 nt, Homo sapiens
cugcccuccaagac

SEQ ID NO: 933597 - RNA, 17 nt, Homo sapiens
cugcgugguugaugauc

SEQ ID NO: 933598 - RNA, 12 nt, Homo sapiens
cugcuccagcug

SEQ ID NO: 933599 - RNA, 16 nt, Homo sapiens
cugcuucaaauauuuc

SEQ ID NO: 933600 - RNA, 19 nt, Homo sapiens
cuggagaaaauggacgugu

SEQ ID NO: 933601 - RNA, 19 nt, Homo sapiens
cuggccagaugcaccagcc

SEQ ID NO: 933602 - RNA, 17 nt, Homo sapiens
cugggagaaccaaaaag

SEQ ID NO: 933603 - RNA, 18 nt, Homo sapiens
cugggagaaccaaaaaga

SEQ ID NO: 933604 - RNA, 17 nt, Homo sapiens
cugggagagccuuccag

SEQ ID NO: 933605 - RNA, 20 nt, Homo sapiens
cugggagagccuuccagggg

SEQ ID NO: 933606 - RNA, 18 nt, Homo sapiens
cugggauuacaagcguga

SEQ ID NO: 933607 - RNA, 15 nt, Homo sapiens
cugggauuacaggug

SEQ ID NO: 933608 - RNA, 20 nt, Homo sapiens
cugggauuacaggugugaac

SEQ ID NO: 933609 - RNA, 21 nt, Homo sapiens
cugggcagaaggaagacuuca

SEQ ID NO: 933610 - RNA, 17 nt, Homo sapiens
cugguguggaagagcuc

SEQ ID NO: 933611 - RNA, 14 nt, Homo sapiens
cuguaucaugacaa

SEQ ID NO: 933612 - RNA, 22 nt, Homo sapiens
cugugggucgcgugaugcgcau

SEQ ID NO: 933613 - RNA, 13 nt, Homo sapiens
cuguucccaugag

SEQ ID NO: 933614 - RNA, 18 nt, Homo sapiens
ugaucacggcucacugca

SEQ ID NO: 933615 - RNA, 14 nt, Homo sapiens
ugauuuaaaucagc

SEQ ID NO: 933616 - RNA, 13 nt, Homo sapiens
ugcacacaccaga

SEQ ID NO: 933617 - RNA, 23 nt, Homo sapiens
ugcacacauuuuuuaaaugcacc

SEQ ID NO: 933618 - RNA, 17 nt, Homo sapiens
ugcacagcuaacaugga

SEQ ID NO: 933619 - RNA, 14 nt, Homo sapiens
ugcaccacugcacu

SEQ ID NO: 933620 - RNA, 21 nt, Homo sapiens
ugcagaaagaccgugugugaa

SEQ ID NO: 933621 - RNA, 23 nt, Homo sapiens
ugcagccucacaguccuuaccag

SEQ ID NO: 933622 - RNA, 13 nt, Homo sapiens
ugcagugcuucca

SEQ ID NO: 933623 - RNA, 23 nt, Homo sapiens
ugcauaccacuuuuguucuuggu

SEQ ID NO: 933624 - RNA, 19 nt, Homo sapiens
ugcaucguuucaucuucca

SEQ ID NO: 933625 - RNA, 15 nt, Homo sapiens
ugccaaaaacaacaa

SEQ ID NO: 933626 - RNA, 16 nt, Homo sapiens
ugccaggaagccagca

SEQ ID NO: 933627 - RNA, 23 nt, Homo sapiens
ugccaugccagcuuaucucaggg

SEQ ID NO: 933628 - RNA, 22 nt, Homo sapiens
ugcccacacuugggagcaaaag

SEQ ID NO: 933629 - RNA, 20 nt, Homo sapiens
ugcccaggcuggcgugcagu

SEQ ID NO: 933630 - RNA, 22 nt, Homo sapiens
ugccccucaacucuccuccaga

SEQ ID NO: 933631 - RNA, 17 nt, Homo sapiens
ugcccuaaaguguauuu

SEQ ID NO: 933632 - RNA, 17 nt, Homo sapiens
ugcccuccaagaccuuc

SEQ ID NO: 933633 - RNA, 14 nt, Homo sapiens
ugccuuggggacaa

SEQ ID NO: 933634 - RNA, 17 nt, Homo sapiens
ugcgaucuggguucacu

SEQ ID NO: 933635 - RNA, 18 nt, Homo sapiens
ugcggccuuuggcuucac

SEQ ID NO: 933636 - RNA, 16 nt, Homo sapiens
ugcuugagcucaggag

SEQ ID NO: 933637 - RNA, 16 nt, Homo sapiens
uggaagacagcucuua

SEQ ID NO: 933638 - RNA, 19 nt, Homo sapiens
uggaagagcuccuugauau

SEQ ID NO: 933639 - RNA, 20 nt, Homo sapiens
uggaugcagccucacagucc

SEQ ID NO: 933640 - RNA, 18 nt, Homo sapiens
uggcaugggaaugaaugu

SEQ ID NO: 933641 - RNA, 13 nt, Homo sapiens
uggccaaagccaa

SEQ ID NO: 933642 - RNA, 18 nt, Homo sapiens
uggccaggcuggucucaa

SEQ ID NO: 933643 - RNA, 15 nt, Homo sapiens
uggccucaagugauu

SEQ ID NO: 933644 - RNA, 14 nt, Homo sapiens
uggcuaaauucaug

SEQ ID NO: 933645 - RNA, 18 nt, Homo sapiens
ugggacaugggaaagggg

SEQ ID NO: 933646 - RNA, 16 nt, Homo sapiens
ugggaggccaaggugg

SEQ ID NO: 933647 - RNA, 17 nt, Homo sapiens
ugggauuacagguguga

SEQ ID NO: 933648 - RNA, 21 nt, Homo sapiens
ugggcagagcagagaccaucc

SEQ ID NO: 933649 - RNA, 15 nt, Homo sapiens
uggggaccucaggcc

SEQ ID NO: 933650 - RNA, 22 nt, Homo sapiens
ugggucgcgugaugcgcauguc

SEQ ID NO: 933651 - RNA, 20 nt, Homo sapiens
ugggugucaagagggucuga

SEQ ID NO: 933652 - RNA, 14 nt, Homo sapiens
uggucuacacugug

SEQ ID NO: 933653 - RNA, 14 nt, Homo sapiens
ugguggacaugcac

SEQ ID NO: 933654 - RNA, 20 nt, Homo sapiens
ugguggacaugcacagcuaa

SEQ ID NO: 933655 - RNA, 23 nt, Homo sapiens
ugguggcagaguggauucuugaa

SEQ ID NO: 933656 - RNA, 11 nt, Homo sapiens
uggugugauuu

SEQ ID NO: 933657 - RNA, 15 nt, Homo sapiens
ugguugagguuucaa

SEQ ID NO: 933658 - RNA, 22 nt, Homo sapiens
ugguuuuuaaaaaacugcugac

SEQ ID NO: 933659 - RNA, 17 nt, Homo sapiens
uguaagcaccccuucau

SEQ ID NO: 933660 - RNA, 17 nt, Homo sapiens
uguccuacucuguguca

SEQ ID NO: 933661 - RNA, 17 nt, Homo sapiens
ugugaaauucucuuucc

SEQ ID NO: 933662 - RNA, 15 nt, Homo sapiens
ugugcgccuacagga

SEQ ID NO: 933663 - RNA, 19 nt, Homo sapiens
ugugugaaauucucuuucc

SEQ ID NO: 933664 - RNA, 20 nt, Homo sapiens
uguucugacccugcuucaaa

SEQ ID NO: 933665 - RNA, 13 nt, Homo sapiens
uguucugggacac

SEQ ID NO: 933666 - RNA, 20 nt, Homo sapiens
uguuggccaaagccaaagcu

SEQ ID NO: 933667 - RNA, 18 nt, Homo sapiens
uguuuagcccaaaaccaa

SEQ ID NO: 933668 - RNA, 14 nt, Homo sapiens
uguuuucucuugag

SEQ ID NO: 933669 - RNA, 22 nt, Homo sapiens
uuaaaacaacacucacauuuau

SEQ ID NO: 933670 - RNA, 18 nt, Homo sapiens
uuaacuuccaauuuacau

SEQ ID NO: 933671 - RNA, 17 nt, Homo sapiens
uuaagcacacuugacau

SEQ ID NO: 933672 - RNA, 16 nt, Homo sapiens
uuacuuuguguucacc

SEQ ID NO: 933673 - RNA, 14 nt, Homo sapiens
uuagaagucacaca

SEQ ID NO: 933674 - RNA, 15 nt, Homo sapiens
uuagacagucccugc

SEQ ID NO: 933675 - RNA, 13 nt, Homo sapiens
uuaucucaggggu

SEQ ID NO: 933676 - RNA, 13 nt, Homo sapiens
uuaugacuccaga

SEQ ID NO: 933677 - RNA, 18 nt, Homo sapiens
uuauggcuuuugugcauu

SEQ ID NO: 933678 - RNA, 14 nt, Homo sapiens
uucaaccaguuuga

SEQ ID NO: 933679 - RNA, 12 nt, Homo sapiens
uucaaucucuug

SEQ ID NO: 933680 - RNA, 17 nt, Homo sapiens
uucaccacaugugcaca

SEQ ID NO: 933681 - RNA, 21 nt, Homo sapiens
uucagagacuccugcaggcag

SEQ ID NO: 933682 - RNA, 14 nt, Homo sapiens
uucagcucugcaag

SEQ ID NO: 933683 - RNA, 13 nt, Homo sapiens
uucaguaauaacu

SEQ ID NO: 933684 - RNA, 19 nt, Homo sapiens
uucagugccaaaaacaaca

SEQ ID NO: 933685 - RNA, 22 nt, Homo sapiens
uucaguggcuaccuacauacaa

SEQ ID NO: 933686 - RNA, 16 nt, Homo sapiens
uucauacccuguuacc

SEQ ID NO: 933687 - RNA, 13 nt, Homo sapiens
uucaugcugcuua

SEQ ID NO: 933688 - RNA, 22 nt, Homo sapiens
uucauuuaggugaggaagcaaa

SEQ ID NO: 933689 - RNA, 15 nt, Homo sapiens
uuccaaacacauaca

SEQ ID NO: 933690 - RNA, 20 nt, Homo sapiens
uuccaauuuacauacucugc

SEQ ID NO: 933691 - RNA, 15 nt, Homo sapiens
uuccauggacuuugu

SEQ ID NO: 933692 - RNA, 17 nt, Homo sapiens
uuccccccaaaacugau

SEQ ID NO: 933693 - RNA, 17 nt, Homo sapiens
uucccuacaguugaaaa

SEQ ID NO: 933694 - RNA, 23 nt, Homo sapiens
uuccucauuagcauuuugcuaaa

SEQ ID NO: 933695 - RNA, 17 nt, Homo sapiens
uuccucuuccacuuuga

SEQ ID NO: 933696 - RNA, 17 nt, Homo sapiens
uuccugaaccgaugaga

SEQ ID NO: 933697 - RNA, 21 nt, Homo sapiens
uucgaauccagagagcagugu

SEQ ID NO: 933698 - RNA, 16 nt, Homo sapiens
uucuaaaggcuaccuu

SEQ ID NO: 933699 - RNA, 14 nt, Homo sapiens
uucuacccaggugc

SEQ ID NO: 933700 - RNA, 22 nt, Homo sapiens
uucuacucgaguuacagacaaa

SEQ ID NO: 933701 - RNA, 17 nt, Homo sapiens
uucuccaagcaggacau

SEQ ID NO: 933702 - RNA, 20 nt, Homo sapiens
uucuccacuuucuagccaga

SEQ ID NO: 933703 - RNA, 13 nt, Homo sapiens
uucugcucacaua

SEQ ID NO: 933704 - RNA, 16 nt, Homo sapiens
uucuucccuacaguug

SEQ ID NO: 933705 - RNA, 20 nt, Homo sapiens
uugaaauauaggaacuuaaa

SEQ ID NO: 933706 - RNA, 22 nt, Homo sapiens
uugaagacuuuucuuucagcca

SEQ ID NO: 933707 - RNA, 20 nt, Homo sapiens
uugagaauuacccuuuugcc

SEQ ID NO: 933708 - RNA, 17 nt, Homo sapiens
uugaggauuuugaucca

SEQ ID NO: 933709 - RNA, 18 nt, Homo sapiens
uugcaggaccucagguga

SEQ ID NO: 933710 - RNA, 13 nt, Homo sapiens
uugcaugaggcua

SEQ ID NO: 933711 - RNA, 14 nt, Homo sapiens
uugggcuucauccu

SEQ ID NO: 933712 - RNA, 20 nt, Homo sapiens
uuggggaugagaaagguuga

SEQ ID NO: 933713 - RNA, 16 nt, Homo sapiens
uuggucccccuuccau

SEQ ID NO: 933714 - RNA, 19 nt, Homo sapiens
uuguauucucuccuguacc

SEQ ID NO: 933715 - RNA, 21 nt, Homo sapiens
uugugcauuaucuagauacug

SEQ ID NO: 933716 - RNA, 11 nt, Homo sapiens
uuucaccacau

SEQ ID NO: 933717 - RNA, 17 nt, Homo sapiens
uuucaccacaugugcac

SEQ ID NO: 933718 - RNA, 18 nt, Homo sapiens
uuucauaaccuagccuua

SEQ ID NO: 933719 - RNA, 20 nt, Homo sapiens
uuuccuguagucccauugau

SEQ ID NO: 933720 - RNA, 18 nt, Homo sapiens
uuuccuucauucaaccca

SEQ ID NO: 933721 - RNA, 13 nt, Homo sapiens
uuucuugcaugag

SEQ ID NO: 933722 - RNA, 21 nt, Homo sapiens
uuugcuaaaugugaaugauga

SEQ ID NO: 933723 - RNA, 15 nt, Homo sapiens
uuuuaaaugcaccug

SEQ ID NO: 933724 - RNA, 19 nt, Homo sapiens
uuuuagacccuauugcugc

SEQ ID NO: 933725 - RNA, 19 nt, Homo sapiens
uuuuauggcuuuugugcau

SEQ ID NO: 933726 - RNA, 18 nt, Homo sapiens
uuuuuaaaaaacugcuga

SEQ ID NO: 933727 - RNA, 12 nt, Homo sapiens
uuacacaauggu

SEQ ID NO: 933728 - RNA, 17 nt, Homo sapiens
uuagacagagucucacu

SEQ ID NO: 933729 - RNA, 19 nt, Homo sapiens
uuagugguuacccaguuag

SEQ ID NO: 933730 - RNA, 19 nt, Homo sapiens
uuaucaaucucuaguuguc

SEQ ID NO: 933731 - RNA, 17 nt, Homo sapiens
uuauuauggcacaucag

SEQ ID NO: 933732 - RNA, 12 nt, Homo sapiens
uucacuacauua

SEQ ID NO: 933733 - RNA, 20 nt, Homo sapiens
uucagcuccagcucaccagc

SEQ ID NO: 933734 - RNA, 16 nt, Homo sapiens
uucagugccaaaaaca

SEQ ID NO: 933735 - RNA, 14 nt, Homo sapiens
uucaguggcagcug

SEQ ID NO: 933736 - RNA, 21 nt, Homo sapiens
uucauuuaggugaggaagcaa

SEQ ID NO: 933737 - RNA, 23 nt, Homo sapiens
uucauuuaggugaggaagcaaaa

SEQ ID NO: 933738 - RNA, 19 nt, Homo sapiens
uuccaaugcuuugaucccu

SEQ ID NO: 933739 - RNA, 14 nt, Homo sapiens
uuccaauuuacaua

SEQ ID NO: 933740 - RNA, 14 nt, Homo sapiens
uuccagugaggcuc

SEQ ID NO: 933741 - RNA, 20 nt, Homo sapiens
uucccaucuuccaaggguac

SEQ ID NO: 933742 - RNA, 22 nt, Homo sapiens
uucccuacaguugaaaaacagc

SEQ ID NO: 933743 - RNA, 16 nt, Homo sapiens
uuccuacugggggcaa

SEQ ID NO: 933744 - RNA, 22 nt, Homo sapiens
uuccugaagaauugaaaaacca

SEQ ID NO: 933745 - RNA, 22 nt, Homo sapiens
uuccuggcacugcuuccaguga

SEQ ID NO: 933746 - RNA, 17 nt, Homo sapiens
uuccuguucccaugaga

SEQ ID NO: 933747 - RNA, 15 nt, Homo sapiens
uucgaauccagagag

SEQ ID NO: 933748 - RNA, 23 nt, Homo sapiens
uucuaccuuccugcaacaccuug

SEQ ID NO: 933749 - RNA, 20 nt, Homo sapiens
uucuacucgaguuacagaca

SEQ ID NO: 933750 - RNA, 21 nt, Homo sapiens
uucucagaaucucaaauaacu

SEQ ID NO: 933751 - RNA, 15 nt, Homo sapiens
uucucauuugucaca

SEQ ID NO: 933752 - RNA, 17 nt, Homo sapiens
uucuccaccugccaggg

SEQ ID NO: 933753 - RNA, 16 nt, Homo sapiens
uucucccucagucugg

SEQ ID NO: 933754 - RNA, 23 nt, Homo sapiens
uucugacccaugcugcccuguga

SEQ ID NO: 933755 - RNA, 16 nt, Homo sapiens
uucugaggauugcaga

SEQ ID NO: 933756 - RNA, 18 nt, Homo sapiens
uucuugaacaaacuggaa

SEQ ID NO: 933757 - RNA, 21 nt, Homo sapiens
uugaaaaaaaaaaacacaaaa

SEQ ID NO: 933758 - RNA, 20 nt, Homo sapiens
uugaaagaucaaaagguuaa

SEQ ID NO: 933759 - RNA, 13 nt, Homo sapiens
uugaacaaacugg

SEQ ID NO: 933760 - RNA, 21 nt, Homo sapiens
uugaagacagagcuacacagg

SEQ ID NO: 933761 - RNA, 13 nt, Homo sapiens
uugaaugaugcca

SEQ ID NO: 933762 - RNA, 14 nt, Homo sapiens
uugcaauggcagcc

SEQ ID NO: 933763 - RNA, 20 nt, Homo sapiens
uugcaggaccucaggugaga

SEQ ID NO: 933764 - RNA, 14 nt, Homo sapiens
uugccauguuggcc

SEQ ID NO: 933765 - RNA, 16 nt, Homo sapiens
uuggaauuuugugccc

SEQ ID NO: 933766 - RNA, 14 nt, Homo sapiens
uuggagaaaggauu

SEQ ID NO: 933767 - RNA, 16 nt, Homo sapiens
uugggaggccauuugu

SEQ ID NO: 933768 - RNA, 23 nt, Homo sapiens
uugguggcagaguggauucuuga

SEQ ID NO: 933769 - RNA, 21 nt, Homo sapiens
uuguacauaaugcgugcauac

SEQ ID NO: 933770 - RNA, 21 nt, Homo sapiens
uuguagagccagggucucacu

SEQ ID NO: 933771 - RNA, 22 nt, Homo sapiens
uuguguuuauauauaagccaaa

SEQ ID NO: 933772 - RNA, 21 nt, Homo sapiens
uuguuaguaugaggcauuugu

SEQ ID NO: 933773 - RNA, 17 nt, Homo sapiens
uuguuggccaaagccaa

SEQ ID NO: 933774 - RNA, 12 nt, Homo sapiens
uuucaaacuuua

SEQ ID NO: 933775 - RNA, 10 nt, Homo sapiens
uuuccaugau

SEQ ID NO: 933776 - RNA, 24 nt, Homo sapiens
uuuccuggcacugcuuccagugag

SEQ ID NO: 933777 - RNA, 12 nt, Homo sapiens
uuucuacccagc

SEQ ID NO: 933778 - RNA, 14 nt, Homo sapiens
uuugauucagacag

SEQ ID NO: 933779 - RNA, 14 nt, Homo sapiens
uuugcagacaggca

SEQ ID NO: 933780 - RNA, 19 nt, Homo sapiens
uuugcuaaaugugaaugau

SEQ ID NO: 933781 - RNA, 22 nt, Homo sapiens
uuuguuaguaugaggcauuugu

SEQ ID NO: 933782 - RNA, 21 nt, Homo sapiens
uuuuaagaaaaaggaugcaca

SEQ ID NO: 933783 - RNA, 19 nt, Homo sapiens
uuuuacuggggauucuuga

SEQ ID NO: 933784 - RNA, 13 nt, Homo sapiens
uuuuagacagagu

SEQ ID NO: 933785 - RNA, 23 nt, Homo sapiens
uuuuauuuuuagacagagucuca

SEQ ID NO: 933786 - RNA, 18 nt, Homo sapiens
uuuugcccacacuuggga

SEQ ID NO: 933787 - RNA, 18 nt, Homo sapiens
aauccccaaaaaagcgaa

SEQ ID NO: 933788 - RNA, 14 nt, Homo sapiens
aaucucuugcacuc

SEQ ID NO: 933789 - RNA, 22 nt, Homo sapiens
aaugaaaccugugucucugaga

SEQ ID NO: 933790 - RNA, 17 nt, Homo sapiens
aaugaggaaacugcacu

SEQ ID NO: 933791 - RNA, 13 nt, Homo sapiens
aaugccagugugc

SEQ ID NO: 933792 - RNA, 15 nt, Homo sapiens
aaugggagacggggg

SEQ ID NO: 933793 - RNA, 17 nt, Homo sapiens
aaugucagugugacuga

SEQ ID NO: 933794 - RNA, 18 nt, Homo sapiens
aauuccaaacacauacag

SEQ ID NO: 933795 - RNA, 13 nt, Homo sapiens
aauucuacuuuga

SEQ ID NO: 933796 - RNA, 16 nt, Homo sapiens
acaagcugcacccuca

SEQ ID NO: 933797 - RNA, 14 nt, Homo sapiens
acaaguccucagug

SEQ ID NO: 933798 - RNA, 13 nt, Homo sapiens
acaaugugaaaag

SEQ ID NO: 933799 - RNA, 20 nt, Homo sapiens
acacaaacgggcucagcaaa

SEQ ID NO: 933800 - RNA, 18 nt, Homo sapiens
acacauuuuucuuaggga

SEQ ID NO: 933801 - RNA, 11 nt, Homo sapiens
acacccuguga

SEQ ID NO: 933802 - RNA, 19 nt, Homo sapiens
acaccuugacagggcacac

SEQ ID NO: 933803 - RNA, 15 nt, Homo sapiens
acacuguacugcaau

SEQ ID NO: 933804 - RNA, 15 nt, Homo sapiens
acacuuacacuuuau

SEQ ID NO: 933805 - RNA, 15 nt, Homo sapiens
acacuugcacccaug

SEQ ID NO: 933806 - RNA, 23 nt, Homo sapiens
acagaagaaacuacccucuggag

SEQ ID NO: 933807 - RNA, 16 nt, Homo sapiens
acagacuggaagcaca

SEQ ID NO: 933808 - RNA, 14 nt, Homo sapiens
acagaguuguuaca

SEQ ID NO: 933809 - RNA, 14 nt, Homo sapiens
acagcuaacaugga

SEQ ID NO: 933810 - RNA, 16 nt, Homo sapiens
acagcuccuucugucc

SEQ ID NO: 933811 - RNA, 15 nt, Homo sapiens
acaggaucaaaguug

SEQ ID NO: 933812 - RNA, 14 nt, Homo sapiens
acaggcaagcaccu

SEQ ID NO: 933813 - RNA, 19 nt, Homo sapiens
acaggcccggcuccaggcu

SEQ ID NO: 933814 - RNA, 12 nt, Homo sapiens
acaguaucucag

SEQ ID NO: 933815 - RNA, 21 nt, Homo sapiens
acagugagucgaggacaggga

SEQ ID NO: 933816 - RNA, 20 nt, Homo sapiens
acaguuaagagaaaugagcu

SEQ ID NO: 933817 - RNA, 17 nt, Homo sapiens
acauaaugcgugcauac

SEQ ID NO: 933818 - RNA, 14 nt, Homo sapiens
acauacucccaucu

SEQ ID NO: 933819 - RNA, 21 nt, Homo sapiens
acauacucugcuuagaauuug

SEQ ID NO: 933820 - RNA, 13 nt, Homo sapiens
acauaucugucau

SEQ ID NO: 933821 - RNA, 17 nt, Homo sapiens
acaugccucucucaggc

SEQ ID NO: 933822 - RNA, 16 nt, Homo sapiens
acaugugcacaugcac

SEQ ID NO: 933823 - RNA, 23 nt, Homo sapiens
acauuuuuaagugcugcauuuaa

SEQ ID NO: 933824 - RNA, 12 nt, Homo sapiens
accaaccacugc

SEQ ID NO: 933825 - RNA, 14 nt, Homo sapiens
accaaccacugcga

SEQ ID NO: 933826 - RNA, 18 nt, Homo sapiens
accacaucuugcucugcu

SEQ ID NO: 933827 - RNA, 12 nt, Homo sapiens
accaucccugaa

SEQ ID NO: 933828 - RNA, 21 nt, Homo sapiens
accaucucuccuccuuuucac

SEQ ID NO: 933829 - RNA, 22 nt, Homo sapiens
accauucuccaccugccaggga

SEQ ID NO: 933830 - RNA, 18 nt, Homo sapiens
accauuuagcacacugcu

SEQ ID NO: 933831 - RNA, 12 nt, Homo sapiens
acccaccucagc

SEQ ID NO: 933832 - RNA, 16 nt, Homo sapiens
acccaguuagcucuca

SEQ ID NO: 933833 - RNA, 15 nt, Homo sapiens
acccucuggagauaa

SEQ ID NO: 933834 - RNA, 19 nt, Homo sapiens
acccucuggagauaaaaua

SEQ ID NO: 933835 - RNA, 19 nt, Homo sapiens
acccucuuagaaaaaccac

SEQ ID NO: 933836 - RNA, 23 nt, Homo sapiens
acccuggugaccagcaccaucuc

SEQ ID NO: 933837 - RNA, 21 nt, Homo sapiens
acccugucuaaugaaaccugu

SEQ ID NO: 933838 - RNA, 21 nt, Homo sapiens
accucaccccacuguggcuga

SEQ ID NO: 933839 - RNA, 19 nt, Homo sapiens
accucagccucccaaagug

SEQ ID NO: 933840 - RNA, 23 nt, Homo sapiens
accucaggccugggggcugggca

SEQ ID NO: 933841 - RNA, 22 nt, Homo sapiens
accucugccugaagucacacag

SEQ ID NO: 933842 - RNA, 15 nt, Homo sapiens
accugaaacaaccca

SEQ ID NO: 933843 - RNA, 20 nt, Homo sapiens
accuuuaagagaaaugagcu

SEQ ID NO: 933844 - RNA, 12 nt, Homo sapiens
acggacacucaa

SEQ ID NO: 933845 - RNA, 17 nt, Homo sapiens
acggacacucaaaagcu

SEQ ID NO: 933846 - RNA, 14 nt, Homo sapiens
acggcucacugcag

SEQ ID NO: 933847 - RNA, 14 nt, Homo sapiens
acgggcucagcaaa

SEQ ID NO: 933848 - RNA, 13 nt, Homo sapiens
acguugugcauuu

SEQ ID NO: 933849 - RNA, 17 nt, Homo sapiens
acuaaggugugcucuga

SEQ ID NO: 933850 - RNA, 22 nt, Homo sapiens
acuaaggugugcucugaucauc

SEQ ID NO: 933851 - RNA, 23 nt, Homo sapiens
acuaaugaggaaacugcacuguu

SEQ ID NO: 933852 - RNA, 22 nt, Homo sapiens
acuauagccuaggugacagagu

SEQ ID NO: 933853 - RNA, 18 nt, Homo sapiens
acuauguugcccaggcag

SEQ ID NO: 933854 - RNA, 16 nt, Homo sapiens
acucagaagacacuga

SEQ ID NO: 933855 - RNA, 21 nt, Homo sapiens
acuccagaauuucccaaagca

SEQ ID NO: 933856 - RNA, 18 nt, Homo sapiens
acucuagggaaaaaccag

SEQ ID NO: 933857 - RNA, 22 nt, Homo sapiens
acucuauuuuuguaaaaaggga

SEQ ID NO: 933858 - RNA, 20 nt, Homo sapiens
acugagugagcaucauggag

SEQ ID NO: 933859 - RNA, 20 nt, Homo sapiens
acugcacuauagccuaggug

SEQ ID NO: 933860 - RNA, 13 nt, Homo sapiens
acugcagcuuugu

SEQ ID NO: 933861 - RNA, 20 nt, Homo sapiens
acugcaucaagaugugacau

SEQ ID NO: 933862 - RNA, 22 nt, Homo sapiens
acugcaucguuucaucuuccaa

SEQ ID NO: 933863 - RNA, 12 nt, Homo sapiens
acugggggcaac

SEQ ID NO: 933864 - RNA, 16 nt, Homo sapiens
acuguaauuugugaua

SEQ ID NO: 933865 - RNA, 12 nt, Homo sapiens
acuguacaugaa

SEQ ID NO: 933866 - RNA, 14 nt, Homo sapiens
acuguccuacccac

SEQ ID NO: 933867 - RNA, 18 nt, Homo sapiens
acugugccaugugccagg

SEQ ID NO: 933868 - RNA, 13 nt, Homo sapiens
acuuaagcacacu

SEQ ID NO: 933869 - RNA, 19 nt, Homo sapiens
acuuaagcacacuugacau

SEQ ID NO: 933870 - RNA, 11 nt, Homo sapiens
acuuacuguac

SEQ ID NO: 933871 - RNA, 16 nt, Homo sapiens
acuuccacugccaucc

SEQ ID NO: 933872 - RNA, 17 nt, Homo sapiens
acuugacaucaacugca

SEQ ID NO: 933873 - RNA, 14 nt, Homo sapiens
acuuguggacacag

SEQ ID NO: 933874 - RNA, 18 nt, Homo sapiens
acuuguggacacagcucu

SEQ ID NO: 933875 - RNA, 15 nt, Homo sapiens
acuuuccucuuccac

SEQ ID NO: 933876 - RNA, 14 nt, Homo sapiens
acuuuguguucacc

SEQ ID NO: 933877 - RNA, 17 nt, Homo sapiens
agaaaauggaagacagc

SEQ ID NO: 933878 - RNA, 22 nt, Homo sapiens
agaaaguacuucuccacccugc

SEQ ID NO: 933879 - RNA, 19 nt, Homo sapiens
agaaauaucugaaaaugua

SEQ ID NO: 933880 - RNA, 18 nt, Homo sapiens
agaagaaaauaguggugu

SEQ ID NO: 933881 - RNA, 11 nt, Homo sapiens
agaaugcacaa

SEQ ID NO: 933882 - RNA, 11 nt, Homo sapiens
agaaugcucuu

SEQ ID NO: 933883 - RNA, 21 nt, Homo sapiens
agaauuauaauuaguuccuca

SEQ ID NO: 933884 - RNA, 12 nt, Homo sapiens
agacaaugacuu

SEQ ID NO: 933885 - RNA, 17 nt, Homo sapiens
agacaccuugacagggc

SEQ ID NO: 933886 - RNA, 17 nt, Homo sapiens
agaccaucccugaaggc

SEQ ID NO: 933887 - RNA, 15 nt, Homo sapiens
agaccgugugugaaa

SEQ ID NO: 933888 - RNA, 20 nt, Homo sapiens
agacucgauaguggugguga

SEQ ID NO: 933889 - RNA, 17 nt, Homo sapiens
agacuggaagcacagcu

SEQ ID NO: 933890 - RNA, 14 nt, Homo sapiens
agagaaaugagcuu

SEQ ID NO: 933891 - RNA, 14 nt, Homo sapiens
agagaaggggccca

SEQ ID NO: 933892 - RNA, 15 nt, Homo sapiens
agagaugugccccca

SEQ ID NO: 933893 - RNA, 16 nt, Homo sapiens
agagcaguguggaaaa

SEQ ID NO: 933894 - RNA, 13 nt, Homo sapiens
agagccagggucu

SEQ ID NO: 933895 - RNA, 19 nt, Homo sapiens
agaggcagggucucacucu

SEQ ID NO: 933896 - RNA, 20 nt, Homo sapiens
agaggggaacagacuggaag

SEQ ID NO: 933897 - RNA, 14 nt, Homo sapiens
agaguagagucacu

SEQ ID NO: 933898 - RNA, 14 nt, Homo sapiens
agauaaaugugcug

SEQ ID NO: 933899 - RNA, 18 nt, Homo sapiens
agauagccaaggccaaag

SEQ ID NO: 933900 - RNA, 19 nt, Homo sapiens
agauagccaaggccaaagg

SEQ ID NO: 933901 - RNA, 20 nt, Homo sapiens
agauagccaaggccaaagga

SEQ ID NO: 933902 - RNA, 21 nt, Homo sapiens
agaucagccugggcaauguga

SEQ ID NO: 933903 - RNA, 22 nt, Homo sapiens
agaugaugccaugggcccucuc

SEQ ID NO: 933904 - RNA, 16 nt, Homo sapiens
agauguauauauuucc

SEQ ID NO: 933905 - RNA, 18 nt, Homo sapiens
agcaccuuagacaguccc

SEQ ID NO: 933906 - RNA, 14 nt, Homo sapiens
agcagagguuggga

SEQ ID NO: 933907 - RNA, 16 nt, Homo sapiens
agcauacguacacauu

SEQ ID NO: 933908 - RNA, 21 nt, Homo sapiens
agcauacguacacauuuuauu

SEQ ID NO: 933909 - RNA, 14 nt, Homo sapiens
agcauggcugccaa

SEQ ID NO: 933910 - RNA, 20 nt, Homo sapiens
agcauuuugcuaaaugugaa

SEQ ID NO: 933911 - RNA, 16 nt, Homo sapiens
agccaaggccaaagga

SEQ ID NO: 933912 - RNA, 21 nt, Homo sapiens
auuccaaacacauacaggaag

SEQ ID NO: 933913 - RNA, 19 nt, Homo sapiens
auuccuguucccaugagau

SEQ ID NO: 933914 - RNA, 16 nt, Homo sapiens
auucucauuugucaca

SEQ ID NO: 933915 - RNA, 18 nt, Homo sapiens
auucuguuggccagugug

SEQ ID NO: 933916 - RNA, 23 nt, Homo sapiens
auucuuaaauauguggaguucau

SEQ ID NO: 933917 - RNA, 13 nt, Homo sapiens
auucuucugcuuc

SEQ ID NO: 933918 - RNA, 12 nt, Homo sapiens
auucuucuguac

SEQ ID NO: 933919 - RNA, 16 nt, Homo sapiens
auugaauauaacuuuu

SEQ ID NO: 933920 - RNA, 17 nt, Homo sapiens
auugauaugcuuauaca

SEQ ID NO: 933921 - RNA, 14 nt, Homo sapiens
auugauguacuuua

SEQ ID NO: 933922 - RNA, 14 nt, Homo sapiens
auuguuucuuucaa

SEQ ID NO: 933923 - RNA, 22 nt, Homo sapiens
auuguuuucaguguacauggaa

SEQ ID NO: 933924 - RNA, 18 nt, Homo sapiens
auuuuagagacagaagaa

SEQ ID NO: 933925 - RNA, 15 nt, Homo sapiens
auuuuauuaugcaug

SEQ ID NO: 933926 - RNA, 15 nt, Homo sapiens
auuuugauccaagcu

SEQ ID NO: 933927 - RNA, 19 nt, Homo sapiens
auuuugcuaaaugugaaug

SEQ ID NO: 933928 - RNA, 18 nt, Homo sapiens
auuuuuuugagacagagu

SEQ ID NO: 933929 - RNA, 12 nt, Homo sapiens
caaaaaacaacu

SEQ ID NO: 933930 - RNA, 18 nt, Homo sapiens
caaaaagaggcuauguga

SEQ ID NO: 933931 - RNA, 21 nt, Homo sapiens
caaaaagaggcuaugugagca

SEQ ID NO: 933932 - RNA, 15 nt, Homo sapiens
caaaagauucuacaa

SEQ ID NO: 933933 - RNA, 16 nt, Homo sapiens
caaaaguuuaaaaagc

SEQ ID NO: 933934 - RNA, 20 nt, Homo sapiens
caaaaguuuaaaaagcucac

SEQ ID NO: 933935 - RNA, 23 nt, Homo sapiens
caaagcucuuuugagcauuuaga

SEQ ID NO: 933936 - RNA, 19 nt, Homo sapiens
caaccaguuugaaccaaga

SEQ ID NO: 933937 - RNA, 14 nt, Homo sapiens
caaggcugcaguga

SEQ ID NO: 933938 - RNA, 19 nt, Homo sapiens
caaggcugggggaagaagc

SEQ ID NO: 933939 - RNA, 22 nt, Homo sapiens
caauaaggggagaguaacccug

SEQ ID NO: 933940 - RNA, 16 nt, Homo sapiens
caaugacuuacuguac

SEQ ID NO: 933941 - RNA, 19 nt, Homo sapiens
caauuacaggaaguacugg

SEQ ID NO: 933942 - RNA, 13 nt, Homo sapiens
caauuauuuugca

SEQ ID NO: 933943 - RNA, 13 nt, Homo sapiens
cacacacauacac

SEQ ID NO: 933944 - RNA, 14 nt, Homo sapiens
cacacgcgugcaca

SEQ ID NO: 933945 - RNA, 23 nt, Homo sapiens
cacagcuaacauggaaguacuau

SEQ ID NO: 933946 - RNA, 23 nt, Homo sapiens
cacagcugggguggggaccucag

SEQ ID NO: 933947 - RNA, 18 nt, Homo sapiens
cacaggcagguccagggu

SEQ ID NO: 933948 - RNA, 12 nt, Homo sapiens
cacauuccugau

SEQ ID NO: 933949 - RNA, 15 nt, Homo sapiens
caccacaugugcaca

SEQ ID NO: 933950 - RNA, 18 nt, Homo sapiens
caccaucaccagacaggu

SEQ ID NO: 933951 - RNA, 13 nt, Homo sapiens
caccucugcacaa

SEQ ID NO: 933952 - RNA, 14 nt, Homo sapiens
caccuugacagggc

SEQ ID NO: 933953 - RNA, 19 nt, Homo sapiens
cacgacugcccggcagggu

SEQ ID NO: 933954 - RNA, 18 nt, Homo sapiens
cacguacacacacauaca

SEQ ID NO: 933955 - RNA, 19 nt, Homo sapiens
cacgugguccuaaucuucu

SEQ ID NO: 933956 - RNA, 23 nt, Homo sapiens
cacguuucuaaaggcuaccuuug

SEQ ID NO: 933957 - RNA, 16 nt, Homo sapiens
cacuaaccacgcugga

SEQ ID NO: 933958 - RNA, 19 nt, Homo sapiens
cacuauaauguaagcucua

SEQ ID NO: 933959 - RNA, 23 nt, Homo sapiens
cacugugaagagaaccauaucaa

SEQ ID NO: 933960 - RNA, 17 nt, Homo sapiens
cacuguugcccaggcug

SEQ ID NO: 933961 - RNA, 19 nt, Homo sapiens
cagaaagaccgugugugaa

SEQ ID NO: 933962 - RNA, 19 nt, Homo sapiens
cagaaaugccuuacccuca

SEQ ID NO: 933963 - RNA, 14 nt, Homo sapiens
cagaaauguguuau

SEQ ID NO: 933964 - RNA, 16 nt, Homo sapiens
cagaaguuugagauca

SEQ ID NO: 933965 - RNA, 18 nt, Homo sapiens
cagacacaggcccggcuc

SEQ ID NO: 933966 - RNA, 16 nt, Homo sapiens
cagacaggaccaggga

SEQ ID NO: 933967 - RNA, 17 nt, Homo sapiens
cagacccugcccugugg

SEQ ID NO: 933968 - RNA, 15 nt, Homo sapiens
cagagaccaucccug

SEQ ID NO: 933969 - RNA, 16 nt, Homo sapiens
cagagagcagugugga

SEQ ID NO: 933970 - RNA, 16 nt, Homo sapiens
cagagaugugccccca

SEQ ID NO: 933971 - RNA, 13 nt, Homo sapiens
cagagcaagugag

SEQ ID NO: 933972 - RNA, 17 nt, Homo sapiens
cagagcugccaccugcc

SEQ ID NO: 933973 - RNA, 18 nt, Homo sapiens
cagagcugccaccugccu

SEQ ID NO: 933974 - RNA, 20 nt, Homo sapiens
cagagugaacacucuuggua

SEQ ID NO: 933975 - RNA, 17 nt, Homo sapiens
cagauagauauaugcuc

SEQ ID NO: 933976 - RNA, 18 nt, Homo sapiens
cagcaagugagagcuggg

SEQ ID NO: 933977 - RNA, 19 nt, Homo sapiens
cagccucccgaauagcugg

SEQ ID NO: 933978 - RNA, 19 nt, Homo sapiens
cagccugggugacagagca

SEQ ID NO: 933979 - RNA, 22 nt, Homo sapiens
cagcguuucuaugacacaugca

SEQ ID NO: 933980 - RNA, 21 nt, Homo sapiens
cagcuaacauggaaguacuau

SEQ ID NO: 933981 - RNA, 15 nt, Homo sapiens
cagcuccuucugucc

SEQ ID NO: 933982 - RNA, 11 nt, Homo sapiens
cagcucugcaa

SEQ ID NO: 933983 - RNA, 19 nt, Homo sapiens
cagcugcgguccacccagg

SEQ ID NO: 933984 - RNA, 13 nt, Homo sapiens
cagcuuaucucag

SEQ ID NO: 933985 - RNA, 22 nt, Homo sapiens
cagcuuaucucaggggugugcg

SEQ ID NO: 933986 - RNA, 19 nt, Homo sapiens
cagcuuguaaauagcucag

SEQ ID NO: 933987 - RNA, 17 nt, Homo sapiens
caggaaaggcuccagga

SEQ ID NO: 933988 - RNA, 14 nt, Homo sapiens
caggaaguacugga

SEQ ID NO: 933989 - RNA, 13 nt, Homo sapiens
caggcaagcaccu

SEQ ID NO: 933990 - RNA, 16 nt, Homo sapiens
caggcaagcaccuccu

SEQ ID NO: 933991 - RNA, 16 nt, Homo sapiens
caggcagguccagggu

SEQ ID NO: 933992 - RNA, 13 nt, Homo sapiens
caggccagcugcu

SEQ ID NO: 933993 - RNA, 15 nt, Homo sapiens
cagggugagcacucu

SEQ ID NO: 933994 - RNA, 21 nt, Homo sapiens
caggguuuugccauguuggcc

SEQ ID NO: 933995 - RNA, 16 nt, Homo sapiens
caggugugaaccacca

SEQ ID NO: 933996 - RNA, 16 nt, Homo sapiens
cagugccaaaaacaac

SEQ ID NO: 933997 - RNA, 22 nt, Homo sapiens
cagugguuggcaauuguuucaa

SEQ ID NO: 933998 - RNA, 14 nt, Homo sapiens
caguuagcucucaa

SEQ ID NO: 933999 - RNA, 22 nt, Homo sapiens
caguuguugauaaccacuaaga

SEQ ID NO: 934000 - RNA, 18 nt, Homo sapiens
cauaaguuaacuuccaau

SEQ ID NO: 934001 - RNA, 18 nt, Homo sapiens
cauacaauuccaaacaca

SEQ ID NO: 934002 - RNA, 13 nt, Homo sapiens
cauacucaccuca

SEQ ID NO: 934003 - RNA, 21 nt, Homo sapiens
cauaguaugguggcuggguug

SEQ ID NO: 934004 - RNA, 16 nt, Homo sapiens
cauauuaccacagaca

SEQ ID NO: 934005 - RNA, 19 nt, Homo sapiens
cauauucaggaagcucagg

SEQ ID NO: 934006 - RNA, 21 nt, Homo sapiens
cauauucaggaagcucagggc

SEQ ID NO: 934007 - RNA, 16 nt, Homo sapiens
cauauucuguuggcca

SEQ ID NO: 934008 - RNA, 20 nt, Homo sapiens
caucauccuaagcuauucag

SEQ ID NO: 934009 - RNA, 22 nt, Homo sapiens
caucauggagggagaagaaaga

SEQ ID NO: 934010 - RNA, 16 nt, Homo sapiens
cauccacugugccaug

SEQ ID NO: 934011 - RNA, 13 nt, Homo sapiens
cauccaguaucuu

SEQ ID NO: 934012 - RNA, 22 nt, Homo sapiens
caucuaugugagaccauuuagc

SEQ ID NO: 934013 - RNA, 13 nt, Homo sapiens
caucucuacaaaa

SEQ ID NO: 934014 - RNA, 11 nt, Homo sapiens
caucuuccaag

SEQ ID NO: 934015 - RNA, 23 nt, Homo sapiens
caucuugcucugcugacagacac

SEQ ID NO: 934016 - RNA, 23 nt, Homo sapiens
caucuuggucagauuugaacucu

SEQ ID NO: 934017 - RNA, 21 nt, Homo sapiens
caugagccucagcauccuggc

SEQ ID NO: 934018 - RNA, 17 nt, Homo sapiens
caugauguuuuccauga

SEQ ID NO: 934019 - RNA, 13 nt, Homo sapiens
cauggaaguacua

SEQ ID NO: 934020 - RNA, 17 nt, Homo sapiens
caugggaaugaauguca

SEQ ID NO: 934021 - RNA, 21 nt, Homo sapiens
caugggaaugaaugucagugu

SEQ ID NO: 934022 - RNA, 14 nt, Homo sapiens
cauguccaagaagc

SEQ ID NO: 934023 - RNA, 19 nt, Homo sapiens
caugucuuuucuugcauga

SEQ ID NO: 934024 - RNA, 14 nt, Homo sapiens
caugugcacaugca

SEQ ID NO: 934025 - RNA, 19 nt, Homo sapiens
cauuccuguucccaugaga

SEQ ID NO: 934026 - RNA, 17 nt, Homo sapiens
cauucuccuuguguuac

SEQ ID NO: 934027 - RNA, 14 nt, Homo sapiens
ccaaacucaccugc

SEQ ID NO: 934028 - RNA, 14 nt, Homo sapiens
ccaaggccaaagga

SEQ ID NO: 934029 - RNA, 15 nt, Homo sapiens
ccaaggccaaaggaa

SEQ ID NO: 934030 - RNA, 18 nt, Homo sapiens
ccacaaccgaccagaugc

SEQ ID NO: 934031 - RNA, 18 nt, Homo sapiens
ccacagggugagcacucu

SEQ ID NO: 934032 - RNA, 17 nt, Homo sapiens
ccacauuccugaugcuu

SEQ ID NO: 934033 - RNA, 15 nt, Homo sapiens
ccaccaucaccagac

SEQ ID NO: 934034 - RNA, 18 nt, Homo sapiens
ccacgcuggagugcagug

SEQ ID NO: 934035 - RNA, 12 nt, Homo sapiens
ccagaauuuccc

SEQ ID NO: 934036 - RNA, 13 nt, Homo sapiens
guccgagcuuuga

SEQ ID NO: 934037 - RNA, 18 nt, Homo sapiens
guccuacucugugucagg

SEQ ID NO: 934038 - RNA, 17 nt, Homo sapiens
gucuaggaaucaugugc

SEQ ID NO: 934039 - RNA, 18 nt, Homo sapiens
gucuaugggacucaaugc

SEQ ID NO: 934040 - RNA, 14 nt, Homo sapiens
gucucauacucacc

SEQ ID NO: 934041 - RNA, 12 nt, Homo sapiens
gucugacaggca

SEQ ID NO: 934042 - RNA, 12 nt, Homo sapiens
gucuugaacucc

SEQ ID NO: 934043 - RNA, 16 nt, Homo sapiens
gucuuuguacagacaa

SEQ ID NO: 934044 - RNA, 23 nt, Homo sapiens
gugagcaauccugcaagaacaag

SEQ ID NO: 934045 - RNA, 15 nt, Homo sapiens
gugagcacuaaggug

SEQ ID NO: 934046 - RNA, 18 nt, Homo sapiens
gugauccacccaccucag

SEQ ID NO: 934047 - RNA, 18 nt, Homo sapiens
gugauccucccaccucag

SEQ ID NO: 934048 - RNA, 15 nt, Homo sapiens
gugauguguuuccau

SEQ ID NO: 934049 - RNA, 20 nt, Homo sapiens
gugccuuauggaacacucug

SEQ ID NO: 934050 - RNA, 21 nt, Homo sapiens
gugcugggauuacagguguga

SEQ ID NO: 934051 - RNA, 17 nt, Homo sapiens
guggcagcucaccucuc

SEQ ID NO: 934052 - RNA, 15 nt, Homo sapiens
guggucuaaacaaaa

SEQ ID NO: 934053 - RNA, 17 nt, Homo sapiens
guggugaacagaacaaa

SEQ ID NO: 934054 - RNA, 22 nt, Homo sapiens
gugugugcacguacacacacau

SEQ ID NO: 934055 - RNA, 20 nt, Homo sapiens
guuacagacaaagcguggug

SEQ ID NO: 934056 - RNA, 18 nt, Homo sapiens
guuaucuaauauguaaca

SEQ ID NO: 934057 - RNA, 15 nt, Homo sapiens
guucuacccaggugc

SEQ ID NO: 934058 - RNA, 19 nt, Homo sapiens
guucuggcucuuccaggcu

SEQ ID NO: 934059 - RNA, 19 nt, Homo sapiens
guuuauugucaaaguggug

SEQ ID NO: 934060 - RNA, 11 nt, Homo sapiens
guuuucagugu

SEQ ID NO: 934061 - RNA, 23 nt, Homo sapiens
guuuuuauggcuuuugugcauua

SEQ ID NO: 934062 - RNA, 22 nt, Homo sapiens
uaaaauaaauuuguaugcucaa

SEQ ID NO: 934063 - RNA, 12 nt, Homo sapiens
uaaagcugccag

SEQ ID NO: 934064 - RNA, 12 nt, Homo sapiens
uaaaugugaaug

SEQ ID NO: 934065 - RNA, 15 nt, Homo sapiens
uaaauucaugcugcu

SEQ ID NO: 934066 - RNA, 14 nt, Homo sapiens
uaacaccaugauua

SEQ ID NO: 934067 - RNA, 14 nt, Homo sapiens
uaacacuguacugc

SEQ ID NO: 934068 - RNA, 14 nt, Homo sapiens
uaacagaaauguac

SEQ ID NO: 934069 - RNA, 17 nt, Homo sapiens
uaacauggaaguacuau

SEQ ID NO: 934070 - RNA, 13 nt, Homo sapiens
uaagaaagacuau

SEQ ID NO: 934071 - RNA, 22 nt, Homo sapiens
uaagaaccuuuugagugccuua

SEQ ID NO: 934072 - RNA, 12 nt, Homo sapiens
uaagagaaauga

SEQ ID NO: 934073 - RNA, 21 nt, Homo sapiens
uaagagggagggagggcucca

SEQ ID NO: 934074 - RNA, 20 nt, Homo sapiens
uaagcacacuugacaucaac

SEQ ID NO: 934075 - RNA, 13 nt, Homo sapiens
uaaguacuaugua

SEQ ID NO: 934076 - RNA, 17 nt, Homo sapiens
uaauaauaaaacaacag

SEQ ID NO: 934077 - RNA, 17 nt, Homo sapiens
uaaugaaaccugugucu

SEQ ID NO: 934078 - RNA, 22 nt, Homo sapiens
uaaugaaagacuguacaaagua

SEQ ID NO: 934079 - RNA, 19 nt, Homo sapiens
uaaugacuuaagcacacuu

SEQ ID NO: 934080 - RNA, 21 nt, Homo sapiens
uaaugacuuaagcacacuuga

SEQ ID NO: 934081 - RNA, 15 nt, Homo sapiens
uaauuaaaacacaac

SEQ ID NO: 934082 - RNA, 20 nt, Homo sapiens
uaauuuuuuugagacagagu

SEQ ID NO: 934083 - RNA, 19 nt, Homo sapiens
uacagacaacaaaccuguu

SEQ ID NO: 934084 - RNA, 20 nt, Homo sapiens
uacagauagauauaugcucu

SEQ ID NO: 934085 - RNA, 19 nt, Homo sapiens
uacaggaagguagaaauau

SEQ ID NO: 934086 - RNA, 13 nt, Homo sapiens
uacaggaaguacu

SEQ ID NO: 934087 - RNA, 14 nt, Homo sapiens
uacaggugugaguc

SEQ ID NO: 934088 - RNA, 20 nt, Homo sapiens
uacauggaauaacauguaau

SEQ ID NO: 934089 - RNA, 22 nt, Homo sapiens
uaccugaagucuuuguacagac

SEQ ID NO: 934090 - RNA, 16 nt, Homo sapiens
uacguugugcauuugg

SEQ ID NO: 934091 - RNA, 17 nt, Homo sapiens
uacuaaggaaucuuucu

SEQ ID NO: 934092 - RNA, 18 nt, Homo sapiens
uacucgaguuacagacaa

SEQ ID NO: 934093 - RNA, 19 nt, Homo sapiens
uacucgaguuacagacaaa

SEQ ID NO: 934094 - RNA, 21 nt, Homo sapiens
uacucgaguuacagacaaagc

SEQ ID NO: 934095 - RNA, 22 nt, Homo sapiens
uacugaggugcuauguucuuag

SEQ ID NO: 934096 - RNA, 23 nt, Homo sapiens
uacugcagcuuuguuuguuguca

SEQ ID NO: 934097 - RNA, 18 nt, Homo sapiens
uacuguaauuugugauac

SEQ ID NO: 934098 - RNA, 17 nt, Homo sapiens
uacuucauggacuucca

SEQ ID NO: 934099 - RNA, 12 nt, Homo sapiens
uagaaaaaccac

SEQ ID NO: 934100 - RNA, 15 nt, Homo sapiens
uagauauaugcucug

SEQ ID NO: 934101 - RNA, 22 nt, Homo sapiens
uagcagcagggagggcuucugc

SEQ ID NO: 934102 - RNA, 18 nt, Homo sapiens
uagcagggaaacagcuaa

SEQ ID NO: 934103 - RNA, 14 nt, Homo sapiens
uagccaaggccaaa

SEQ ID NO: 934104 - RNA, 15 nt, Homo sapiens
uagccaaguguggua

SEQ ID NO: 934105 - RNA, 17 nt, Homo sapiens
uagccuuagaagucaca

SEQ ID NO: 934106 - RNA, 16 nt, Homo sapiens
uagcugggacuacagg

SEQ ID NO: 934107 - RNA, 17 nt, Homo sapiens
uagcugggacuacaggc

SEQ ID NO: 934108 - RNA, 17 nt, Homo sapiens
uagcugggacuacaggu

SEQ ID NO: 934109 - RNA, 20 nt, Homo sapiens
uaggagggcuggcaacuuag

SEQ ID NO: 934110 - RNA, 15 nt, Homo sapiens
uaggcauuugcugaa

SEQ ID NO: 934111 - RNA, 20 nt, Homo sapiens
uaggugacagagugagacuc

SEQ ID NO: 934112 - RNA, 21 nt, Homo sapiens
uagucccauugauguacuuua

SEQ ID NO: 934113 - RNA, 22 nt, Homo sapiens
uagucccauugauguacuuuac

SEQ ID NO: 934114 - RNA, 14 nt, Homo sapiens
uaguggugugauuu

SEQ ID NO: 934115 - RNA, 14 nt, Homo sapiens
uaucagaauucuca

SEQ ID NO: 934116 - RNA, 14 nt, Homo sapiens
uaucaggugcugcc

SEQ ID NO: 934117 - RNA, 15 nt, Homo sapiens
uaugacaucagcaau

SEQ ID NO: 934118 - RNA, 16 nt, Homo sapiens
uaugacuccagaauuu

SEQ ID NO: 934119 - RNA, 20 nt, Homo sapiens
uaugcaugaaguaauaugca

SEQ ID NO: 934120 - RNA, 22 nt, Homo sapiens
uaugcaugaaguaauaugcaca

SEQ ID NO: 934121 - RNA, 18 nt, Homo sapiens
uauggcuuuugugcauua

SEQ ID NO: 934122 - RNA, 11 nt, Homo sapiens
uaugugagcac

SEQ ID NO: 934123 - RNA, 12 nt, Homo sapiens
uauguugcccag

SEQ ID NO: 934124 - RNA, 15 nt, Homo sapiens
ucaacucuccuccag

SEQ ID NO: 934125 - RNA, 15 nt, Homo sapiens
ucaagaugugacaug

SEQ ID NO: 934126 - RNA, 15 nt, Homo sapiens
ucaaggcugcaguga

SEQ ID NO: 934127 - RNA, 13 nt, Homo sapiens
ucaaucucuaguu

SEQ ID NO: 934128 - RNA, 14 nt, Homo sapiens
ucacagccucugaa

SEQ ID NO: 934129 - RNA, 18 nt, Homo sapiens
ucacauuuauucugcuca

SEQ ID NO: 934130 - RNA, 19 nt, Homo sapiens
ucacauuuauucugcucac

SEQ ID NO: 934131 - RNA, 16 nt, Homo sapiens
ucaccacaugugcaca

SEQ ID NO: 934132 - RNA, 17 nt, Homo sapiens
ucaccacaugugcacau

SEQ ID NO: 934133 - RNA, 14 nt, Homo sapiens
ucacgccacugcac

SEQ ID NO: 934134 - RNA, 17 nt, Homo sapiens
ucacucuuauugcccac

SEQ ID NO: 934135 - RNA, 15 nt, Homo sapiens
ucacugcagccucaa

SEQ ID NO: 934136 - RNA, 18 nt, Homo sapiens
ucacuucccuacauggag

SEQ ID NO: 934137 - RNA, 15 nt, Homo sapiens
ucagcugaaccuggg

SEQ ID NO: 934138 - RNA, 16 nt, Homo sapiens
ucaggaagcucagggc

SEQ ID NO: 934139 - RNA, 21 nt, Homo sapiens
ucagugccaaaaacaacaaca

SEQ ID NO: 934140 - RNA, 21 nt, Homo sapiens
ucagugccuuauggaacacuc

SEQ ID NO: 934141 - RNA, 15 nt, Homo sapiens
ucaguguacauggaa

SEQ ID NO: 934142 - RNA, 13 nt, Homo sapiens
ucauaaugacuua

SEQ ID NO: 934143 - RNA, 14 nt, Homo sapiens
ucauaaugacuuaa

SEQ ID NO: 934144 - RNA, 15 nt, Homo sapiens
ucauacucaccucac

SEQ ID NO: 934145 - RNA, 16 nt, Homo sapiens
ucauccacugugccau

SEQ ID NO: 934146 - RNA, 17 nt, Homo sapiens
aaaacacaaaaguuucu

SEQ ID NO: 934147 - RNA, 23 nt, Homo sapiens
aaaaccaccaccaucaccagaca

SEQ ID NO: 934148 - RNA, 22 nt, Homo sapiens
aaaacuugauguguuaucucuu

SEQ ID NO: 934149 - RNA, 16 nt, Homo sapiens
aaaagcaucuauguga

SEQ ID NO: 934150 - RNA, 15 nt, Homo sapiens
aaaauuacugaugca

SEQ ID NO: 934151 - RNA, 14 nt, Homo sapiens
aaacucaccugccc

SEQ ID NO: 934152 - RNA, 23 nt, Homo sapiens
aaacuggaaaguacguuaugaua

SEQ ID NO: 934153 - RNA, 20 nt, Homo sapiens
aaacuuuucuaauacucuac

SEQ ID NO: 934154 - RNA, 16 nt, Homo sapiens
aaagaagauucugugg

SEQ ID NO: 934155 - RNA, 17 nt, Homo sapiens
aaagacuguacaaagua

SEQ ID NO: 934156 - RNA, 20 nt, Homo sapiens
aaagacuguacaaaguagaa

SEQ ID NO: 934157 - RNA, 18 nt, Homo sapiens
aaagaggggaagagacuu

SEQ ID NO: 934158 - RNA, 15 nt, Homo sapiens
aaagaguaggaagac

SEQ ID NO: 934159 - RNA, 23 nt, Homo sapiens
aaagcagugcaugcugucccuua

SEQ ID NO: 934160 - RNA, 18 nt, Homo sapiens
aaagcaucuaugugagac

SEQ ID NO: 934161 - RNA, 19 nt, Homo sapiens
aaagcgugguggacaugca

SEQ ID NO: 934162 - RNA, 21 nt, Homo sapiens
aaagcgugguggacaugcaca

SEQ ID NO: 934163 - RNA, 21 nt, Homo sapiens
aaagguagcuuuucccaaacu

SEQ ID NO: 934164 - RNA, 14 nt, Homo sapiens
aaaguacuucucca

SEQ ID NO: 934165 - RNA, 21 nt, Homo sapiens
aaaguggugagaggcauccag

SEQ ID NO: 934166 - RNA, 19 nt, Homo sapiens
aaaguuuaaaaagcucaca

SEQ ID NO: 934167 - RNA, 15 nt, Homo sapiens
aaauaacacuguacu

SEQ ID NO: 934168 - RNA, 20 nt, Homo sapiens
aaaucagcugcuacuacucc

SEQ ID NO: 934169 - RNA, 21 nt, Homo sapiens
aaauucuguuuuucuaggccu

SEQ ID NO: 934170 - RNA, 12 nt, Homo sapiens
aaauucuuucag

SEQ ID NO: 934171 - RNA, 13 nt, Homo sapiens
aacaccucugcac

SEQ ID NO: 934172 - RNA, 15 nt, Homo sapiens
aacacuguacugcaa

SEQ ID NO: 934173 - RNA, 19 nt, Homo sapiens
aacagguuuuccugaagaa

SEQ ID NO: 934174 - RNA, 18 nt, Homo sapiens
aaccacugcgaccacaag

SEQ ID NO: 934175 - RNA, 14 nt, Homo sapiens
aaccacuucagcug

SEQ ID NO: 934176 - RNA, 21 nt, Homo sapiens
aaccuuuugagugccuuacac

SEQ ID NO: 934177 - RNA, 16 nt, Homo sapiens
aacuacccucuggaga

SEQ ID NO: 934178 - RNA, 14 nt, Homo sapiens
aacucuuaaaaccc

SEQ ID NO: 934179 - RNA, 16 nt, Homo sapiens
aacucuugaccucagg

SEQ ID NO: 934180 - RNA, 19 nt, Homo sapiens
aacuggguacuuguggaca

SEQ ID NO: 934181 - RNA, 13 nt, Homo sapiens
aagaaacuacccu

SEQ ID NO: 934182 - RNA, 22 nt, Homo sapiens
aagaagcccaggaaaggcucca

SEQ ID NO: 934183 - RNA, 15 nt, Homo sapiens
aagaagcucucuccu

SEQ ID NO: 934184 - RNA, 18 nt, Homo sapiens
aagaccuucuccuucacc

SEQ ID NO: 934185 - RNA, 22 nt, Homo sapiens
aagagacuuggaaaugggagac

SEQ ID NO: 934186 - RNA, 14 nt, Homo sapiens
aagaggcagggucu

SEQ ID NO: 934187 - RNA, 16 nt, Homo sapiens
aagagggucugaggaa

SEQ ID NO: 934188 - RNA, 18 nt, Homo sapiens
aagaguaggaagacuuug

SEQ ID NO: 934189 - RNA, 20 nt, Homo sapiens
aagauucauauuuacuucuu

SEQ ID NO: 934190 - RNA, 13 nt, Homo sapiens
aagcacacuugac

SEQ ID NO: 934191 - RNA, 20 nt, Homo sapiens
aagcacaugccucucucagg

SEQ ID NO: 934192 - RNA, 21 nt, Homo sapiens
aagcacaugccucucucaggc

SEQ ID NO: 934193 - RNA, 19 nt, Homo sapiens
aagccagcaggcucucagg

SEQ ID NO: 934194 - RNA, 15 nt, Homo sapiens
aagccgugauuuuca

SEQ ID NO: 934195 - RNA, 22 nt, Homo sapiens
aagcgugguggacaugcacagc

SEQ ID NO: 934196 - RNA, 22 nt, Homo sapiens
aagcugagaugggacaggauca

SEQ ID NO: 934197 - RNA, 20 nt, Homo sapiens
aagcugggagaaccaaaaag

SEQ ID NO: 934198 - RNA, 16 nt, Homo sapiens
aaggggcccaagagag

SEQ ID NO: 934199 - RNA, 15 nt, Homo sapiens
aaggguaucugguga

SEQ ID NO: 934200 - RNA, 17 nt, Homo sapiens
aaguaucccuacuguaa

SEQ ID NO: 934201 - RNA, 17 nt, Homo sapiens
aagugaagacaaugacu

SEQ ID NO: 934202 - RNA, 13 nt, Homo sapiens
aagugaggaugaa

SEQ ID NO: 934203 - RNA, 23 nt, Homo sapiens
aagugcugggauuacagguguga

SEQ ID NO: 934204 - RNA, 23 nt, Homo sapiens
aagugggggaguggccacagaaa

SEQ ID NO: 934205 - RNA, 23 nt, Homo sapiens
aaguuuuuauggcuuuugugcau

SEQ ID NO: 934206 - RNA, 21 nt, Homo sapiens
aauacagacuacuucuucccc

SEQ ID NO: 934207 - RNA, 23 nt, Homo sapiens
aauagcugggacuacagguguga

SEQ ID NO: 934208 - RNA, 14 nt, Homo sapiens
aauauugcugaugg

SEQ ID NO: 934209 - RNA, 20 nt, Homo sapiens
aaucuaaauggaaccacucu

SEQ ID NO: 934210 - RNA, 18 nt, Homo sapiens
aaucucaaauaacuaaaa

SEQ ID NO: 934211 - RNA, 22 nt, Homo sapiens
aaugcacugacauuguuggcca

SEQ ID NO: 934212 - RNA, 13 nt, Homo sapiens
aaugcacuuuguu

SEQ ID NO: 934213 - RNA, 21 nt, Homo sapiens
aaugcccagccccuucugacc

SEQ ID NO: 934214 - RNA, 16 nt, Homo sapiens
aaugcucuuuacuuca

SEQ ID NO: 934215 - RNA, 15 nt, Homo sapiens
aaugggggugcauuu

SEQ ID NO: 934216 - RNA, 23 nt, Homo sapiens
aaugugacuugagcccagaguga

SEQ ID NO: 934217 - RNA, 14 nt, Homo sapiens
aauucuacuuugag

SEQ ID NO: 934218 - RNA, 16 nt, Homo sapiens
aauucucagaaucuca

SEQ ID NO: 934219 - RNA, 20 nt, Homo sapiens
aauucucuaguuugauuaaa

SEQ ID NO: 934220 - RNA, 21 nt, Homo sapiens
aauucucuuauccaacaucaa

SEQ ID NO: 934221 - RNA, 16 nt, Homo sapiens
aauugcuucaagcauu

SEQ ID NO: 934222 - RNA, 20 nt, Homo sapiens
aauuucccaaagcagugcau

SEQ ID NO: 934223 - RNA, 15 nt, Homo sapiens
acaaaaaacaacuga

SEQ ID NO: 934224 - RNA, 23 nt, Homo sapiens
acaaagcgugguggacaugcaca

SEQ ID NO: 934225 - RNA, 24 nt, Homo sapiens
acaaagcgugguggacaugcacag

SEQ ID NO: 934226 - RNA, 24 nt, Homo sapiens
acaaaggagagcuagcagcaggga

SEQ ID NO: 934227 - RNA, 23 nt, Homo sapiens
acaagaucacaagucagcacuac

SEQ ID NO: 934228 - RNA, 17 nt, Homo sapiens
acaaugacuuacuguac

SEQ ID NO: 934229 - RNA, 12 nt, Homo sapiens
acacacagcucu

SEQ ID NO: 934230 - RNA, 13 nt, Homo sapiens
acacugcuuguga

SEQ ID NO: 934231 - RNA, 20 nt, Homo sapiens
acagagugagacucugucuc

SEQ ID NO: 934232 - RNA, 15 nt, Homo sapiens
acagcuaacauggaa

SEQ ID NO: 934233 - RNA, 14 nt, Homo sapiens
acagcucuucucca

SEQ ID NO: 934234 - RNA, 13 nt, Homo sapiens
acaggugugaacc

SEQ ID NO: 934235 - RNA, 15 nt, Homo sapiens
acaguauuacuucug

SEQ ID NO: 934236 - RNA, 15 nt, Homo sapiens
acaguccucccaucu

SEQ ID NO: 934237 - RNA, 13 nt, Homo sapiens
acaucaacugcau

SEQ ID NO: 934238 - RNA, 17 nt, Homo sapiens
acauuccugaugcuucu

SEQ ID NO: 934239 - RNA, 14 nt, Homo sapiens
acauucuguuaauc

SEQ ID NO: 934240 - RNA, 18 nt, Homo sapiens
acauuuauucugcucaca

SEQ ID NO: 934241 - RNA, 17 nt, Homo sapiens
accaaaucagcugcuac

SEQ ID NO: 934242 - RNA, 13 nt, Homo sapiens
accaauguucucu

SEQ ID NO: 934243 - RNA, 16 nt, Homo sapiens
accacaaaacuuuucu

SEQ ID NO: 934244 - RNA, 18 nt, Homo sapiens
accacaugugcacaugca

SEQ ID NO: 934245 - RNA, 13 nt, Homo sapiens
accagagcugcca

SEQ ID NO: 934246 - RNA, 21 nt, Homo sapiens
accaguuugaaccaagaacuu

SEQ ID NO: 934247 - RNA, 20 nt, Homo sapiens
accaugauuaaccacuucag

SEQ ID NO: 934248 - RNA, 10 nt, Homo sapiens
acccaagggc

SEQ ID NO: 934249 - RNA, 14 nt, Homo sapiens
acccaccccagugc

SEQ ID NO: 934250 - RNA, 14 nt, Homo sapiens
acccaccucagccu

SEQ ID NO: 934251 - RNA, 16 nt, Homo sapiens
accccucaacaccucu

SEQ ID NO: 934252 - RNA, 17 nt, Homo sapiens
acccugcucuccgacca

SEQ ID NO: 934253 - RNA, 18 nt, Homo sapiens
accuggccucugcacucc

SEQ ID NO: 934254 - RNA, 16 nt, Homo sapiens
accugucccccugaca

SEQ ID NO: 934255 - RNA, 13 nt, Homo sapiens
accuguuucugca

SEQ ID NO: 934256 - RNA, 22 nt, Homo sapiens
accuuuguauucucuccuguac

SEQ ID NO: 934257 - RNA, 20 nt, Homo sapiens
acgccagauucuuuccugag

SEQ ID NO: 934258 - RNA, 14 nt, Homo sapiens
acgucugacaggca

SEQ ID NO: 934259 - RNA, 20 nt, Homo sapiens
acuaaugaggaaacugcacu

SEQ ID NO: 934260 - RNA, 18 nt, Homo sapiens
acuauaauguaagcucua

SEQ ID NO: 934261 - RNA, 17 nt, Homo sapiens
acucagaagacacugau

SEQ ID NO: 934262 - RNA, 19 nt, Homo sapiens
acuccuguaggaagguuaa

SEQ ID NO: 934263 - RNA, 12 nt, Homo sapiens
acucugugucag

SEQ ID NO: 934264 - RNA, 11 nt, Homo sapiens
acugaccaguu

SEQ ID NO: 934265 - RNA, 19 nt, Homo sapiens
acugaguacguugugcauu

SEQ ID NO: 934266 - RNA, 19 nt, Homo sapiens
acugaugggcaacccccag

SEQ ID NO: 934267 - RNA, 20 nt, Homo sapiens
acugcacuccagccugggug

SEQ ID NO: 934268 - RNA, 15 nt, Homo sapiens
acugccaugccagcu

SEQ ID NO: 934269 - RNA, 15 nt, Homo sapiens
acugcuuuuggucug

SEQ ID NO: 934270 - RNA, 15 nt, Homo sapiens
acuggaagcacagcu

SEQ ID NO: 934271 - RNA, 20 nt, Homo sapiens
ucaugcugcuuagaugacau

SEQ ID NO: 934272 - RNA, 16 nt, Homo sapiens
uccaaaugcccagcuu

SEQ ID NO: 934273 - RNA, 19 nt, Homo sapiens
uccaaggauggaccacaca

SEQ ID NO: 934274 - RNA, 14 nt, Homo sapiens
uccaaggguacuaa

SEQ ID NO: 934275 - RNA, 14 nt, Homo sapiens
uccacugugccaug

SEQ ID NO: 934276 - RNA, 12 nt, Homo sapiens
ucccaaacccuu

SEQ ID NO: 934277 - RNA, 14 nt, Homo sapiens
ucccaccucagccu

SEQ ID NO: 934278 - RNA, 18 nt, Homo sapiens
ucccccugacaacacuca

SEQ ID NO: 934279 - RNA, 14 nt, Homo sapiens
ucccugcaaccuga

SEQ ID NO: 934280 - RNA, 17 nt, Homo sapiens
uccuaguuccaccauca

SEQ ID NO: 934281 - RNA, 12 nt, Homo sapiens
uccuccaggugc

SEQ ID NO: 934282 - RNA, 14 nt, Homo sapiens
uccucccaccucag

SEQ ID NO: 934283 - RNA, 21 nt, Homo sapiens
uccucugacagaagaacccca

SEQ ID NO: 934284 - RNA, 21 nt, Homo sapiens
uaacuaaaagguaugcaauca

SEQ ID NO: 934285 - RNA, 19 nt, Homo sapiens
uaagaaaaaggaugcacag

SEQ ID NO: 934286 - RNA, 16 nt, Homo sapiens
uaagagaaaugagcug

SEQ ID NO: 934287 - RNA, 14 nt, Homo sapiens
uaagagucucuauu

SEQ ID NO: 934288 - RNA, 19 nt, Homo sapiens
uaagccaaaaaaugcuugc

SEQ ID NO: 934289 - RNA, 19 nt, Homo sapiens
uaauuuaccugaagucuuu

SEQ ID NO: 934290 - RNA, 14 nt, Homo sapiens
uacaagcgugagcc

SEQ ID NO: 934291 - RNA, 21 nt, Homo sapiens
uacacuaaaaggugaccaaug

SEQ ID NO: 934292 - RNA, 15 nt, Homo sapiens
uacaggagugagcac

SEQ ID NO: 934293 - RNA, 15 nt, Homo sapiens
uacccucuggagaua

SEQ ID NO: 934294 - RNA, 13 nt, Homo sapiens
uacgccaggggaa

SEQ ID NO: 934295 - RNA, 13 nt, Homo sapiens
uacgggaggguaa

SEQ ID NO: 934296 - RNA, 20 nt, Homo sapiens
uacguuaugauaguguccca

SEQ ID NO: 934297 - RNA, 12 nt, Homo sapiens
uacguugugcau

SEQ ID NO: 934298 - RNA, 13 nt, Homo sapiens
uacguugugcauu

SEQ ID NO: 934299 - RNA, 14 nt, Homo sapiens
uacguugugcauuu

SEQ ID NO: 934300 - RNA, 16 nt, Homo sapiens
uacuaaggaaucuuuc

SEQ ID NO: 934301 - RNA, 16 nt, Homo sapiens
uacucaccucacccca

SEQ ID NO: 934302 - RNA, 22 nt, Homo sapiens
uacucaccucaccccacugugg

SEQ ID NO: 934303 - RNA, 23 nt, Homo sapiens
uacucccaucugugaaaggaaag

SEQ ID NO: 934304 - RNA, 16 nt, Homo sapiens
uacucgaguuacagac

SEQ ID NO: 934305 - RNA, 19 nt, Homo sapiens
uacuggagaaaauggacgu

SEQ ID NO: 934306 - RNA, 14 nt, Homo sapiens
uacuuguggacaca

SEQ ID NO: 934307 - RNA, 13 nt, Homo sapiens
uagaaaaaccacc

SEQ ID NO: 934308 - RNA, 12 nt, Homo sapiens
uagaagucacac

SEQ ID NO: 934309 - RNA, 16 nt, Homo sapiens
uagaagucacacagua

SEQ ID NO: 934310 - RNA, 21 nt, Homo sapiens
uagacgagcaggcuucuuccc

SEQ ID NO: 934311 - RNA, 18 nt, Homo sapiens
uagagccagggucucacu

SEQ ID NO: 934312 - RNA, 17 nt, Homo sapiens
uagauguauauauuucc

SEQ ID NO: 934313 - RNA, 15 nt, Homo sapiens
uagcauggcugccaa

SEQ ID NO: 934314 - RNA, 18 nt, Homo sapiens
uagccuuagaagucacac

SEQ ID NO: 934315 - RNA, 15 nt, Homo sapiens
uaggaagacuuugga

SEQ ID NO: 934316 - RNA, 22 nt, Homo sapiens
uaggccuggggacggcuuuuac

SEQ ID NO: 934317 - RNA, 17 nt, Homo sapiens
uaggugaggaagcaaaa

SEQ ID NO: 934318 - RNA, 17 nt, Homo sapiens
uaguaugaggcauuugu

SEQ ID NO: 934319 - RNA, 15 nt, Homo sapiens
uagugugugcaauuu

SEQ ID NO: 934320 - RNA, 21 nt, Homo sapiens
uaguugucacuuuccucuucc

SEQ ID NO: 934321 - RNA, 13 nt, Homo sapiens
uauaagaaauaca

SEQ ID NO: 934322 - RNA, 17 nt, Homo sapiens
uauaauguaagcucuac

SEQ ID NO: 934323 - RNA, 20 nt, Homo sapiens
uauaguuaucaaucucuagu

SEQ ID NO: 934324 - RNA, 16 nt, Homo sapiens
uauauaagccaaaaaa

SEQ ID NO: 934325 - RNA, 19 nt, Homo sapiens
uauauuguuuucaguguac

SEQ ID NO: 934326 - RNA, 20 nt, Homo sapiens
uaucaaugaguaacaggaaa

SEQ ID NO: 934327 - RNA, 14 nt, Homo sapiens
uaugaggcauuugu

SEQ ID NO: 934328 - RNA, 17 nt, Homo sapiens
uaugaucacggcucacu

SEQ ID NO: 934329 - RNA, 11 nt, Homo sapiens
uaugcauuuga

SEQ ID NO: 934330 - RNA, 13 nt, Homo sapiens
uauguguaaguau

SEQ ID NO: 934331 - RNA, 20 nt, Homo sapiens
uauuaaggaagacaauguga

SEQ ID NO: 934332 - RNA, 22 nt, Homo sapiens
uauucuguuggccagugugaca

SEQ ID NO: 934333 - RNA, 16 nt, Homo sapiens
uauuuaccagaccaca

SEQ ID NO: 934334 - RNA, 19 nt, Homo sapiens
ucaaacucuugaccucagg

SEQ ID NO: 934335 - RNA, 14 nt, Homo sapiens
ucaaauaacuaaaa

SEQ ID NO: 934336 - RNA, 16 nt, Homo sapiens
ucaacaccucugcaca

SEQ ID NO: 934337 - RNA, 22 nt, Homo sapiens
ucaacaucuuggucagauuuga

SEQ ID NO: 934338 - RNA, 14 nt, Homo sapiens
ucaagaugugacau

SEQ ID NO: 934339 - RNA, 18 nt, Homo sapiens
ucaauuacaggaaguacu

SEQ ID NO: 934340 - RNA, 19 nt, Homo sapiens
ucacaagucagcacuaccu

SEQ ID NO: 934341 - RNA, 12 nt, Homo sapiens
ucaccaagccca

SEQ ID NO: 934342 - RNA, 15 nt, Homo sapiens
ucaccaagcccaguu

SEQ ID NO: 934343 - RNA, 16 nt, Homo sapiens
ucacggcucacugcag

SEQ ID NO: 934344 - RNA, 14 nt, Homo sapiens
ucacugcaaccucc

SEQ ID NO: 934345 - RNA, 19 nt, Homo sapiens
ucagcaauacagacuacuu

SEQ ID NO: 934346 - RNA, 19 nt, Homo sapiens
ucagccucccgaauagcug

SEQ ID NO: 934347 - RNA, 19 nt, Homo sapiens
ucagcuuguaaauagcuca

SEQ ID NO: 934348 - RNA, 16 nt, Homo sapiens
ucagguggggcagcuu

SEQ ID NO: 934349 - RNA, 22 nt, Homo sapiens
ucauaaugacuuaagcacacuu

SEQ ID NO: 934350 - RNA, 14 nt, Homo sapiens
ucauacucaccuca

SEQ ID NO: 934351 - RNA, 16 nt, Homo sapiens
ucauacucaccucacc

SEQ ID NO: 934352 - RNA, 19 nt, Homo sapiens
ucauacucaccucacccca

SEQ ID NO: 934353 - RNA, 22 nt, Homo sapiens
ucauuuaggugaggaagcaaaa

SEQ ID NO: 934354 - RNA, 17 nt, Homo sapiens
uccaaggguacuaagga

SEQ ID NO: 934355 - RNA, 20 nt, Homo sapiens
uccaauauucgcugugucag

SEQ ID NO: 934356 - RNA, 15 nt, Homo sapiens
uccacugugccaugu

SEQ ID NO: 934357 - RNA, 17 nt, Homo sapiens
uccagagagcagugugg

SEQ ID NO: 934358 - RNA, 13 nt, Homo sapiens
uccagccccugga

SEQ ID NO: 934359 - RNA, 15 nt, Homo sapiens
ucccaacucacccca

SEQ ID NO: 934360 - RNA, 22 nt, Homo sapiens
ucccagacccccuugcccaggc

SEQ ID NO: 934361 - RNA, 22 nt, Homo sapiens
ucccaucacuucccuacaugga

SEQ ID NO: 934362 - RNA, 14 nt, Homo sapiens
ucccauuugcuccu

SEQ ID NO: 934363 - RNA, 14 nt, Homo sapiens
ucccccuuccaugg

SEQ ID NO: 934364 - RNA, 20 nt, Homo sapiens
ucccuacauggaguauaugu

SEQ ID NO: 934365 - RNA, 15 nt, Homo sapiens
ucccuucuuacuuaa

SEQ ID NO: 934366 - RNA, 13 nt, Homo sapiens
ucccuuucuuccc

SEQ ID NO: 934367 - RNA, 13 nt, Homo sapiens
uccuagcacuuug

SEQ ID NO: 934368 - RNA, 18 nt, Homo sapiens
uccuaggcauuugcugaa

SEQ ID NO: 934369 - RNA, 16 nt, Homo sapiens
uccuggccucaaguga

SEQ ID NO: 934370 - RNA, 16 nt, Homo sapiens
uccuguagucccauug

SEQ ID NO: 934371 - RNA, 22 nt, Homo sapiens
uccuuaccagcagagcaccuua

SEQ ID NO: 934372 - RNA, 19 nt, Homo sapiens
uccuucacagaugggugcu

SEQ ID NO: 934373 - RNA, 22 nt, Homo sapiens
ucgaauccagagagcagugugg

SEQ ID NO: 934374 - RNA, 14 nt, Homo sapiens
ucuaaagcugccag

SEQ ID NO: 934375 - RNA, 17 nt, Homo sapiens
ucuagcauggcugccaa

SEQ ID NO: 934376 - RNA, 15 nt, Homo sapiens
ucuauauccauaacu

SEQ ID NO: 934377 - RNA, 18 nt, Homo sapiens
ucucaaguuaucagggua

SEQ ID NO: 934378 - RNA, 18 nt, Homo sapiens
ucucacuauguugcccag

SEQ ID NO: 934379 - RNA, 20 nt, Homo sapiens
ucucacucugucgcccaguc

SEQ ID NO: 934380 - RNA, 13 nt, Homo sapiens
ucucaggccaaac

SEQ ID NO: 934381 - RNA, 16 nt, Homo sapiens
ucucaggccagcugcu

SEQ ID NO: 934382 - RNA, 14 nt, Homo sapiens
ucucccuucauccu

SEQ ID NO: 934383 - RNA, 14 nt, Homo sapiens
ucucucuucuccac

SEQ ID NO: 934384 - RNA, 17 nt, Homo sapiens
ucucugaggacacuaac

SEQ ID NO: 934385 - RNA, 16 nt, Homo sapiens
ucucugcccuccaaga

SEQ ID NO: 934386 - RNA, 22 nt, Homo sapiens
ucugaucauccacugugccaug

SEQ ID NO: 934387 - RNA, 17 nt, Homo sapiens
ucugccugaagucacac

SEQ ID NO: 934388 - RNA, 18 nt, Homo sapiens
ucuggagguacgaaaaga

SEQ ID NO: 934389 - RNA, 11 nt, Homo sapiens
ucuggcagcuc

SEQ ID NO: 934390 - RNA, 17 nt, Homo sapiens
ucuggcuaugcauuuga

SEQ ID NO: 934391 - RNA, 17 nt, Homo sapiens
ucuguuggccaguguga

SEQ ID NO: 934392 - RNA, 14 nt, Homo sapiens
ucuuaauucuuagc

SEQ ID NO: 934393 - RNA, 21 nt, Homo sapiens
ucuuauccaacaucaacaucu

SEQ ID NO: 934394 - RNA, 15 nt, Homo sapiens
ucuuccacuuugaua

SEQ ID NO: 934395 - RNA, 19 nt, Homo sapiens
ucuucuccacuuucuagcc

SEQ ID NO: 934396 - RNA, 13 nt, Homo sapiens
ucuucucuacucu

SEQ ID NO: 934397 - RNA, 13 nt, Homo sapiens
ucuuuauaauucu

SEQ ID NO: 934398 - RNA, 9 nt, Homo sapiens
ucuuuccau

SEQ ID NO: 934399 - RNA, 23 nt, Homo sapiens
ucuuuccuguagucccauugaug

SEQ ID NO: 934400 - RNA, 16 nt, Homo sapiens
ucuuuugagcauuuag

SEQ ID NO: 934401 - RNA, 13 nt, Homo sapiens
ugaaccacaucuu

SEQ ID NO: 934402 - RNA, 20 nt, Homo sapiens
ugaagacagagcuacacagg

SEQ ID NO: 934403 - RNA, 16 nt, Homo sapiens
ugaauaauacaguauc

SEQ ID NO: 934404 - RNA, 22 nt, Homo sapiens
ugaauaauacaguaucucaggg

SEQ ID NO: 934405 - RNA, 16 nt, Homo sapiens
ugacagacacaggccc

SEQ ID NO: 934406 - RNA, 18 nt, Homo sapiens
ugacaucagcaauacaga

SEQ ID NO: 934407 - RNA, 16 nt, Homo sapiens
ugaccaguuguugaua

SEQ ID NO: 934408 - RNA, 18 nt, Homo sapiens
ugagaggggaacagacug

SEQ ID NO: 934409 - RNA, 20 nt, Homo sapiens
uuuaugagaaaugccagugu

SEQ ID NO: 934410 - RNA, 19 nt, Homo sapiens
uuuauuuuuguagagccag

SEQ ID NO: 934411 - RNA, 12 nt, Homo sapiens
uuucauugcugg

SEQ ID NO: 934412 - RNA, 19 nt, Homo sapiens
uuuccuguagucccauuga

SEQ ID NO: 934413 - RNA, 20 nt, Homo sapiens
uuuccuucauucaacccacc

SEQ ID NO: 934414 - RNA, 13 nt, Homo sapiens
uuucuacucgagu

SEQ ID NO: 934415 - RNA, 19 nt, Homo sapiens
uuucuggcuaugcauuuga

SEQ ID NO: 934416 - RNA, 22 nt, Homo sapiens
uuuggcauuccccacuugagaa

SEQ ID NO: 934417 - RNA, 21 nt, Homo sapiens
uuuguagagccagggucucac

SEQ ID NO: 934418 - RNA, 19 nt, Homo sapiens
uuuugucuaugggacucaa

SEQ ID NO: 934419 - RNA, 19 nt, Homo sapiens
uuuuuaagugcugcauuua

SEQ ID NO: 934420 - RNA, 14 nt, Homo sapiens
agaaaguacuucuu

SEQ ID NO: 934421 - RNA, 18 nt, Homo sapiens
agaaaugagcugcacucc

SEQ ID NO: 934422 - RNA, 14 nt, Homo sapiens
agaaauguguuauc

SEQ ID NO: 934423 - RNA, 15 nt, Homo sapiens
agaaccaaaaagagg

SEQ ID NO: 934424 - RNA, 14 nt, Homo sapiens
agaacuuuccagga

SEQ ID NO: 934425 - RNA, 23 nt, Homo sapiens
agaagcccuucuaccuuccugca

SEQ ID NO: 934426 - RNA, 19 nt, Homo sapiens
agaauuucccaaagcagug

SEQ ID NO: 934427 - RNA, 18 nt, Homo sapiens
agacaggguuuugccaug

SEQ ID NO: 934428 - RNA, 12 nt, Homo sapiens
agacccggcugc

SEQ ID NO: 934429 - RNA, 22 nt, Homo sapiens
agacucgauagugguggugaac

SEQ ID NO: 934430 - RNA, 14 nt, Homo sapiens
agacucugucucaa

SEQ ID NO: 934431 - RNA, 20 nt, Homo sapiens
agacugaguacguugugcau

SEQ ID NO: 934432 - RNA, 14 nt, Homo sapiens
agagaaaugagcug

SEQ ID NO: 934433 - RNA, 21 nt, Homo sapiens
agagacaggguuuugccaugu

SEQ ID NO: 934434 - RNA, 12 nt, Homo sapiens
agagcagugugg

SEQ ID NO: 934435 - RNA, 16 nt, Homo sapiens
agagcugggugucaag

SEQ ID NO: 934436 - RNA, 23 nt, Homo sapiens
agagucacuggaacacuaaugag

SEQ ID NO: 934437 - RNA, 15 nt, Homo sapiens
agauaauacaccacu

SEQ ID NO: 934438 - RNA, 21 nt, Homo sapiens
agauauuuugcuuugugauuu

SEQ ID NO: 934439 - RNA, 12 nt, Homo sapiens
agaucacgccac

SEQ ID NO: 934440 - RNA, 18 nt, Homo sapiens
agcaauacagacuacuuc

SEQ ID NO: 934441 - RNA, 18 nt, Homo sapiens
agcacacugcuugugaaa

SEQ ID NO: 934442 - RNA, 17 nt, Homo sapiens
agcacacuugacaucaa

SEQ ID NO: 934443 - RNA, 16 nt, Homo sapiens
agcaccauaacuuugu

SEQ ID NO: 934444 - RNA, 15 nt, Homo sapiens
agcaggacauggaca

SEQ ID NO: 934445 - RNA, 18 nt, Homo sapiens
agcaggcucucaggccag

SEQ ID NO: 934446 - RNA, 20 nt, Homo sapiens
agccaagaauucuuaaauau

SEQ ID NO: 934447 - RNA, 23 nt, Homo sapiens
agccaagaauucuuaaauaugug

SEQ ID NO: 934448 - RNA, 23 nt, Homo sapiens
agccacuauuguuagucucuuga

SEQ ID NO: 934449 - RNA, 19 nt, Homo sapiens
agccagcaggcucucaggc

SEQ ID NO: 934450 - RNA, 18 nt, Homo sapiens
agccauuccuguucccau

SEQ ID NO: 934451 - RNA, 22 nt, Homo sapiens
agccauuccuguucccaugaga

SEQ ID NO: 934452 - RNA, 19 nt, Homo sapiens
agcccaccccucaacaccu

SEQ ID NO: 934453 - RNA, 16 nt, Homo sapiens
agcccaccuuggcuca

SEQ ID NO: 934454 - RNA, 18 nt, Homo sapiens
agcccagagugaacacuc

SEQ ID NO: 934455 - RNA, 20 nt, Homo sapiens
agccccaucccaaacccuuc

SEQ ID NO: 934456 - RNA, 21 nt, Homo sapiens
agccgagaucacgccacugca

SEQ ID NO: 934457 - RNA, 20 nt, Homo sapiens
agccgagauugcaccacugc

SEQ ID NO: 934458 - RNA, 14 nt, Homo sapiens
agccucacaguccu

SEQ ID NO: 934459 - RNA, 14 nt, Homo sapiens
agccuggacccugu

SEQ ID NO: 934460 - RNA, 16 nt, Homo sapiens
agcgugagccacugca

SEQ ID NO: 934461 - RNA, 22 nt, Homo sapiens
agcuacuguuuauuauuuuauu

SEQ ID NO: 934462 - RNA, 16 nt, Homo sapiens
agcucaccucucccuu

SEQ ID NO: 934463 - RNA, 22 nt, Homo sapiens
agcucaggugucccugcacuug

SEQ ID NO: 934464 - RNA, 23 nt, Homo sapiens
agcuccuucuguccuacucugug

SEQ ID NO: 934465 - RNA, 13 nt, Homo sapiens
agcugaaccuggg

SEQ ID NO: 934466 - RNA, 15 nt, Homo sapiens
agcugccaccugccu

SEQ ID NO: 934467 - RNA, 18 nt, Homo sapiens
agcugccugggaucccuc

SEQ ID NO: 934468 - RNA, 18 nt, Homo sapiens
agcugggacuacaggcac

SEQ ID NO: 934469 - RNA, 17 nt, Homo sapiens
agcugggacuacaggug

SEQ ID NO: 934470 - RNA, 19 nt, Homo sapiens
agcugggagaaccaaaaag

SEQ ID NO: 934471 - RNA, 20 nt, Homo sapiens
agcugggagaaccaaaaaga

SEQ ID NO: 934472 - RNA, 21 nt, Homo sapiens
agcuugaccgugaggccagag

SEQ ID NO: 934473 - RNA, 16 nt, Homo sapiens
aggaaacugcacuguu

SEQ ID NO: 934474 - RNA, 14 nt, Homo sapiens
aggaaaggcuccag

SEQ ID NO: 934475 - RNA, 20 nt, Homo sapiens
aggacauugcggacagccac

SEQ ID NO: 934476 - RNA, 19 nt, Homo sapiens
aggaggggugugggcaccc

SEQ ID NO: 934477 - RNA, 21 nt, Homo sapiens
aggaugaaagugaccauguuu

SEQ ID NO: 934478 - RNA, 22 nt, Homo sapiens
aggaugaucuaggaagacuuug

SEQ ID NO: 934479 - RNA, 14 nt, Homo sapiens
aggcagggucucac

SEQ ID NO: 934480 - RNA, 20 nt, Homo sapiens
aggccagagggagugacaga

SEQ ID NO: 934481 - RNA, 21 nt, Homo sapiens
aggccagagggagugacagag

SEQ ID NO: 934482 - RNA, 16 nt, Homo sapiens
aggcccuucucuccag

SEQ ID NO: 934483 - RNA, 18 nt, Homo sapiens
aggccuggccagaugcac

SEQ ID NO: 934484 - RNA, 16 nt, Homo sapiens
aggcucucaggccagc

SEQ ID NO: 934485 - RNA, 20 nt, Homo sapiens
aggcugggagagccuuccag

SEQ ID NO: 934486 - RNA, 19 nt, Homo sapiens
aggcugucaauuacaggaa

SEQ ID NO: 934487 - RNA, 19 nt, Homo sapiens
agggagggcuccagacaca

SEQ ID NO: 934488 - RNA, 16 nt, Homo sapiens
aggggaagagacuugg

SEQ ID NO: 934489 - RNA, 15 nt, Homo sapiens
aggguaaggcugugg

SEQ ID NO: 934490 - RNA, 13 nt, Homo sapiens
agggugacggggg

SEQ ID NO: 934491 - RNA, 13 nt, Homo sapiens
aggguggugaccu

SEQ ID NO: 934492 - RNA, 16 nt, Homo sapiens
aggugauccacccacc

SEQ ID NO: 934493 - RNA, 21 nt, Homo sapiens
agguuuuccugaagaauugaa

SEQ ID NO: 934494 - RNA, 16 nt, Homo sapiens
agguuuuuggucugac

SEQ ID NO: 934495 - RNA, 14 nt, Homo sapiens
aguaauaugcacac

SEQ ID NO: 934496 - RNA, 14 nt, Homo sapiens
aguacguugugcau

SEQ ID NO: 934497 - RNA, 18 nt, Homo sapiens
aguacguugugcauuugg

SEQ ID NO: 934498 - RNA, 14 nt, Homo sapiens
aguagagucacugg

SEQ ID NO: 934499 - RNA, 18 nt, Homo sapiens
aguaggaagacuuuggaa

SEQ ID NO: 934500 - RNA, 16 nt, Homo sapiens
aguaugaggcauuugu

SEQ ID NO: 934501 - RNA, 16 nt, Homo sapiens
agugaagcugggagaa

SEQ ID NO: 934502 - RNA, 19 nt, Homo sapiens
agugagucgaggacaggga

SEQ ID NO: 934503 - RNA, 21 nt, Homo sapiens
agugcugggauuacaggugug

SEQ ID NO: 934504 - RNA, 13 nt, Homo sapiens
agugggugaauaa

SEQ ID NO: 934505 - RNA, 14 nt, Homo sapiens
agugguggugaaca

SEQ ID NO: 934506 - RNA, 23 nt, Homo sapiens
agugguggugaacagaacaaaag

SEQ ID NO: 934507 - RNA, 15 nt, Homo sapiens
agugugacugaucuc

SEQ ID NO: 934508 - RNA, 19 nt, Homo sapiens
aguucauacccuguuacca

SEQ ID NO: 934509 - RNA, 19 nt, Homo sapiens
aguugaugaaauaucaaga

SEQ ID NO: 934510 - RNA, 14 nt, Homo sapiens
aguugauucagcuc

SEQ ID NO: 934511 - RNA, 22 nt, Homo sapiens
auacacacacacgcgugcacac

SEQ ID NO: 934512 - RNA, 15 nt, Homo sapiens
auacaguaucucagg

SEQ ID NO: 934513 - RNA, 16 nt, Homo sapiens
auacucccaucuguga

SEQ ID NO: 934514 - RNA, 20 nt, Homo sapiens
auagauauaugcucugcaug

SEQ ID NO: 934515 - RNA, 16 nt, Homo sapiens
auaucugaaaauguau

SEQ ID NO: 934516 - RNA, 16 nt, Homo sapiens
auauuguuuucagugu

SEQ ID NO: 934517 - RNA, 16 nt, Homo sapiens
aucaagaugugacaug

SEQ ID NO: 934518 - RNA, 14 nt, Homo sapiens
aucacaagucagca

SEQ ID NO: 934519 - RNA, 16 nt, Homo sapiens
aucacagccucugaaa

SEQ ID NO: 934520 - RNA, 21 nt, Homo sapiens
aucagccugggcaaugugaua

SEQ ID NO: 934521 - RNA, 19 nt, Homo sapiens
aucauccacugugccaugu

SEQ ID NO: 934522 - RNA, 14 nt, Homo sapiens
auccuaggcauuug

SEQ ID NO: 934523 - RNA, 14 nt, Homo sapiens
auccucccaccuca

SEQ ID NO: 934524 - RNA, 14 nt, Homo sapiens
auccuggaguucug

SEQ ID NO: 934525 - RNA, 23 nt, Homo sapiens
aucuacccuccgauuguuccuga

SEQ ID NO: 934526 - RNA, 16 nt, Homo sapiens
aucuaggaagacuuug

SEQ ID NO: 934527 - RNA, 19 nt, Homo sapiens
aucucuugcacucaaagcu

SEQ ID NO: 934528 - RNA, 17 nt, Homo sapiens
aucuggguucacugcaa

SEQ ID NO: 934529 - RNA, 13 nt, Homo sapiens
aucuuccaagggu

SEQ ID NO: 934530 - RNA, 17 nt, Homo sapiens
aucuugcucugcugaca

SEQ ID NO: 934531 - RNA, 15 nt, Homo sapiens
aucuuuucauuuagg

SEQ ID NO: 934532 - RNA, 14 nt, Homo sapiens
augacaaagacuga

SEQ ID NO: 934533 - RNA, 19 nt, Homo sapiens
augacaucagcaauacaga

SEQ ID NO: 934534 - RNA, 17 nt, Homo sapiens
uuaaauaaaucauaaaa

SEQ ID NO: 934535 - RNA, 20 nt, Homo sapiens
uuaaauaaugugaaacugga

SEQ ID NO: 934536 - RNA, 18 nt, Homo sapiens
uuaacauggacaugaucu

SEQ ID NO: 934537 - RNA, 21 nt, Homo sapiens
uuaacuuccaauuuacauacu

SEQ ID NO: 934538 - RNA, 17 nt, Homo sapiens
uuaagagaaaugagcuu

SEQ ID NO: 934539 - RNA, 21 nt, Homo sapiens
uuaccugccaggaagccagca

SEQ ID NO: 934540 - RNA, 13 nt, Homo sapiens
uuagaaaaaccac

SEQ ID NO: 934541 - RNA, 19 nt, Homo sapiens
uuagaaaaaccaccaccau

SEQ ID NO: 934542 - RNA, 15 nt, Homo sapiens
uuagcauuuugcuaa

SEQ ID NO: 934543 - RNA, 20 nt, Homo sapiens
uuaugagaaaugccagugug

SEQ ID NO: 934544 - RNA, 13 nt, Homo sapiens
gagacucugucuc

SEQ ID NO: 934545 - RNA, 14 nt, Homo sapiens
gagauggccaugua

SEQ ID NO: 934546 - RNA, 18 nt, Homo sapiens
gagcaagugagacccugu

SEQ ID NO: 934547 - RNA, 23 nt, Homo sapiens
gagcccacgcccccacuggugac

SEQ ID NO: 934548 - RNA, 14 nt, Homo sapiens
gagcccuuaugaca

SEQ ID NO: 934549 - RNA, 21 nt, Homo sapiens
gagccgagauugcaccacugc

SEQ ID NO: 934550 - RNA, 14 nt, Homo sapiens
gagcuuucugcuau

SEQ ID NO: 934551 - RNA, 19 nt, Homo sapiens
gaggauugcuugagcucag

SEQ ID NO: 934552 - RNA, 14 nt, Homo sapiens
gaggcaugugauga

SEQ ID NO: 934553 - RNA, 14 nt, Homo sapiens
gagguacgaaaaga

SEQ ID NO: 934554 - RNA, 17 nt, Homo sapiens
gagucucacuguugccc

SEQ ID NO: 934555 - RNA, 16 nt, Homo sapiens
gaguuacagacaaagc

SEQ ID NO: 934556 - RNA, 21 nt, Homo sapiens
gaguugauucagcucugcaag

SEQ ID NO: 934557 - RNA, 22 nt, Homo sapiens
gauacuguaucaugacaaagac

SEQ ID NO: 934558 - RNA, 15 nt, Homo sapiens
gauauaagaaauaca

SEQ ID NO: 934559 - RNA, 22 nt, Homo sapiens
gauauaugcucugcauguuaca

SEQ ID NO: 934560 - RNA, 16 nt, Homo sapiens
gaucaaaguugaugaa

SEQ ID NO: 934561 - RNA, 17 nt, Homo sapiens
gaucacgccacugcacu

SEQ ID NO: 934562 - RNA, 20 nt, Homo sapiens
gaucagccugggcaauguga

SEQ ID NO: 934563 - RNA, 12 nt, Homo sapiens
gauccuccaggu

SEQ ID NO: 934564 - RNA, 16 nt, Homo sapiens
gauccucccaccucag

SEQ ID NO: 934565 - RNA, 13 nt, Homo sapiens
gaugauaaaacac

SEQ ID NO: 934566 - RNA, 22 nt, Homo sapiens
gauuacaagcgugagccacugc

SEQ ID NO: 934567 - RNA, 19 nt, Homo sapiens
gauugugcgugcaugugug

SEQ ID NO: 934568 - RNA, 15 nt, Homo sapiens
gauuucuguuuagau

SEQ ID NO: 934569 - RNA, 21 nt, Homo sapiens
gcacacuugcacccaugugua

SEQ ID NO: 934570 - RNA, 21 nt, Homo sapiens
gcacagcugggguggggaccu

SEQ ID NO: 934571 - RNA, 17 nt, Homo sapiens
gcacagggucucuacca

SEQ ID NO: 934572 - RNA, 22 nt, Homo sapiens
gcacaugccucucucaggccaa

SEQ ID NO: 934573 - RNA, 21 nt, Homo sapiens
gcacccccggcccagugcccc

SEQ ID NO: 934574 - RNA, 18 nt, Homo sapiens
gcaccgggccacagagaa

SEQ ID NO: 934575 - RNA, 18 nt, Homo sapiens
gcacucaaagcuuguuaa

SEQ ID NO: 934576 - RNA, 22 nt, Homo sapiens
gcacuuuguucuggcucuucca

SEQ ID NO: 934577 - RNA, 16 nt, Homo sapiens
gcagccacauuccuga

SEQ ID NO: 934578 - RNA, 16 nt, Homo sapiens
gcaggcucucaggcca

SEQ ID NO: 934579 - RNA, 12 nt, Homo sapiens
gcaguguggaaa

SEQ ID NO: 934580 - RNA, 18 nt, Homo sapiens
gcauaaguuaacuuccaa

SEQ ID NO: 934581 - RNA, 15 nt, Homo sapiens
gcaucaagaugugac

SEQ ID NO: 934582 - RNA, 16 nt, Homo sapiens
gcaucaagaugugaca

SEQ ID NO: 934583 - RNA, 13 nt, Homo sapiens
gcauguguguuca

SEQ ID NO: 934584 - RNA, 23 nt, Homo sapiens
gcauuuagacucucgacuggcca

SEQ ID NO: 934585 - RNA, 19 nt, Homo sapiens
gcauuuggugguuucagaa

SEQ ID NO: 934586 - RNA, 15 nt, Homo sapiens
gccaccuuugaagaa

SEQ ID NO: 934587 - RNA, 17 nt, Homo sapiens
gccagcuuaucucaggg

SEQ ID NO: 934588 - RNA, 14 nt, Homo sapiens
gccagggucucacu

SEQ ID NO: 934589 - RNA, 17 nt, Homo sapiens
gccauccucccaagggg

SEQ ID NO: 934590 - RNA, 14 nt, Homo sapiens
gcccaaugcacuuu

SEQ ID NO: 934591 - RNA, 20 nt, Homo sapiens
gcccacgcuggagugcagug

SEQ ID NO: 934592 - RNA, 21 nt, Homo sapiens
gcccaggaaaggcuccaggag

SEQ ID NO: 934593 - RNA, 17 nt, Homo sapiens
gcccaggcaggucuuga

SEQ ID NO: 934594 - RNA, 14 nt, Homo sapiens
gcccuuaccugcca

SEQ ID NO: 934595 - RNA, 21 nt, Homo sapiens
gccgagauugcaccacugcac

SEQ ID NO: 934596 - RNA, 15 nt, Homo sapiens
gccucucccaucacu

SEQ ID NO: 934597 - RNA, 15 nt, Homo sapiens
gccugaagucacaca

SEQ ID NO: 934598 - RNA, 14 nt, Homo sapiens
gccuggacccugug

SEQ ID NO: 934599 - RNA, 17 nt, Homo sapiens
gccuggggucugacaau

SEQ ID NO: 934600 - RNA, 14 nt, Homo sapiens
gcuaugcauuugaa

SEQ ID NO: 934601 - RNA, 14 nt, Homo sapiens
gcucucaggccagc

SEQ ID NO: 934602 - RNA, 14 nt, Homo sapiens
gcucugccucccau

SEQ ID NO: 934603 - RNA, 14 nt, Homo sapiens
gcuggagugcagug

SEQ ID NO: 934604 - RNA, 15 nt, Homo sapiens
gcuggagugcaguga

SEQ ID NO: 934605 - RNA, 20 nt, Homo sapiens
gcuggcgugcaguggugcga

SEQ ID NO: 934606 - RNA, 17 nt, Homo sapiens
gcugggagagccuucca

SEQ ID NO: 934607 - RNA, 15 nt, Homo sapiens
gcuucaaccccauga

SEQ ID NO: 934608 - RNA, 16 nt, Homo sapiens
gcuucauuuccugugu

SEQ ID NO: 934609 - RNA, 18 nt, Homo sapiens
gcuugaccgugaggccag

SEQ ID NO: 934610 - RNA, 15 nt, Homo sapiens
gcuuugaaaauucag

SEQ ID NO: 934611 - RNA, 13 nt, Homo sapiens
ggaaaugggagac

SEQ ID NO: 934612 - RNA, 21 nt, Homo sapiens
ggaagcacaugccucucucag

SEQ ID NO: 934613 - RNA, 20 nt, Homo sapiens
ggaagccagcaggcucucag

SEQ ID NO: 934614 - RNA, 15 nt, Homo sapiens
ggacaggcauguucu

SEQ ID NO: 934615 - RNA, 12 nt, Homo sapiens
ggacucaaugca

SEQ ID NO: 934616 - RNA, 23 nt, Homo sapiens
ggacucaaugcacugacauuguu

SEQ ID NO: 934617 - RNA, 13 nt, Homo sapiens
ggagaaaauggac

SEQ ID NO: 934618 - RNA, 20 nt, Homo sapiens
ggagcaaaaucgaugcagug

SEQ ID NO: 934619 - RNA, 15 nt, Homo sapiens
ggagggcuccagaca

SEQ ID NO: 934620 - RNA, 20 nt, Homo sapiens
ggaggugaccccagguuucu

SEQ ID NO: 934621 - RNA, 19 nt, Homo sapiens
ggaugcagccucacagucc

SEQ ID NO: 934622 - RNA, 20 nt, Homo sapiens
ggaugcauucccuacagauu

SEQ ID NO: 934623 - RNA, 21 nt, Homo sapiens
ggauugcuacuguccuaccca

SEQ ID NO: 934624 - RNA, 15 nt, Homo sapiens
ggcacaccgggcacu

SEQ ID NO: 934625 - RNA, 19 nt, Homo sapiens
ggcacccggccccugcugg

SEQ ID NO: 934626 - RNA, 19 nt, Homo sapiens
ggcacucagaagacacuga

SEQ ID NO: 934627 - RNA, 14 nt, Homo sapiens
ggcagcucagagag

SEQ ID NO: 934628 - RNA, 13 nt, Homo sapiens
ggcauccaguauc

SEQ ID NO: 934629 - RNA, 12 nt, Homo sapiens
ggccauguauua

SEQ ID NO: 934630 - RNA, 14 nt, Homo sapiens
ggccccucaggguc

SEQ ID NO: 934631 - RNA, 16 nt, Homo sapiens
ggcccugccuccuuug

SEQ ID NO: 934632 - RNA, 16 nt, Homo sapiens
ggccuggccagaugca

SEQ ID NO: 934633 - RNA, 13 nt, Homo sapiens
ggcuaccuacaua

SEQ ID NO: 934634 - RNA, 19 nt, Homo sapiens
ggcucagcggggacagcuc

SEQ ID NO: 934635 - RNA, 22 nt, Homo sapiens
ggcugggggccucagugccacu

SEQ ID NO: 934636 - RNA, 14 nt, Homo sapiens
ggcuuggggaccag

SEQ ID NO: 934637 - RNA, 13 nt, Homo sapiens
ggcuuuugugcau

SEQ ID NO: 934638 - RNA, 16 nt, Homo sapiens
gggcaacccuggugac

SEQ ID NO: 934639 - RNA, 20 nt, Homo sapiens
gggcacagaaaauggaagac

SEQ ID NO: 934640 - RNA, 22 nt, Homo sapiens
gggccaguuggucccccuucca

SEQ ID NO: 934641 - RNA, 21 nt, Homo sapiens
gggcccaaauucuuucagugg

SEQ ID NO: 934642 - RNA, 12 nt, Homo sapiens
gggcucagcaaa

SEQ ID NO: 934643 - RNA, 16 nt, Homo sapiens
gggcuguucacucucu

SEQ ID NO: 934644 - RNA, 21 nt, Homo sapiens
ggguguggcgcagcauauuca

SEQ ID NO: 934645 - RNA, 13 nt, Homo sapiens
gguagaagcccuu

SEQ ID NO: 934646 - RNA, 15 nt, Homo sapiens
ggugaccagcaccau

SEQ ID NO: 934647 - RNA, 13 nt, Homo sapiens
ggugccuugggga

SEQ ID NO: 934648 - RNA, 19 nt, Homo sapiens
gguggaaugcgggggagca

SEQ ID NO: 934649 - RNA, 18 nt, Homo sapiens
agccuaggugacagagug

SEQ ID NO: 934650 - RNA, 17 nt, Homo sapiens
agccugcuccagcuguu

SEQ ID NO: 934651 - RNA, 15 nt, Homo sapiens
agccugggcaaugug

SEQ ID NO: 934652 - RNA, 14 nt, Homo sapiens
agccuuagaaguca

SEQ ID NO: 934653 - RNA, 19 nt, Homo sapiens
agccuuagaagucacacag

SEQ ID NO: 934654 - RNA, 11 nt, Homo sapiens
agccuuccagg

SEQ ID NO: 934655 - RNA, 23 nt, Homo sapiens
agcggcuggcagcccaccccuca

SEQ ID NO: 934656 - RNA, 18 nt, Homo sapiens
agcuaggccuggccagau

SEQ ID NO: 934657 - RNA, 22 nt, Homo sapiens
agcuaggccuggccagaugcac

SEQ ID NO: 934658 - RNA, 20 nt, Homo sapiens
agcucacauagauaugacuu

SEQ ID NO: 934659 - RNA, 12 nt, Homo sapiens
agcucaccagcc

SEQ ID NO: 934660 - RNA, 18 nt, Homo sapiens
agcuccgcuuucuaccca

SEQ ID NO: 934661 - RNA, 14 nt, Homo sapiens
agcugccaccugcc

SEQ ID NO: 934662 - RNA, 20 nt, Homo sapiens
agcugcuugggcuucauccu

SEQ ID NO: 934663 - RNA, 22 nt, Homo sapiens
agcugggguggggaccucaggc

SEQ ID NO: 934664 - RNA, 20 nt, Homo sapiens
agcuguaaaguugcagguug

SEQ ID NO: 934665 - RNA, 13 nt, Homo sapiens
agcuguucagcug

SEQ ID NO: 934666 - RNA, 16 nt, Homo sapiens
agcuuugaaaauucag

SEQ ID NO: 934667 - RNA, 14 nt, Homo sapiens
aggaagacuuugga

SEQ ID NO: 934668 - RNA, 23 nt, Homo sapiens
aggaagccagcaggcucucaggc

SEQ ID NO: 934669 - RNA, 20 nt, Homo sapiens
aggaagccucccacgacugc

SEQ ID NO: 934670 - RNA, 21 nt, Homo sapiens
aggacagggaggugaccccag

SEQ ID NO: 934671 - RNA, 13 nt, Homo sapiens
aggacauggacaa

SEQ ID NO: 934672 - RNA, 17 nt, Homo sapiens
aggaggggugugggcac

SEQ ID NO: 934673 - RNA, 18 nt, Homo sapiens
aggaguuugagaccaacc

SEQ ID NO: 934674 - RNA, 22 nt, Homo sapiens
aggauccugagccagauuucac

SEQ ID NO: 934675 - RNA, 14 nt, Homo sapiens
aggauguucuagca

SEQ ID NO: 934676 - RNA, 14 nt, Homo sapiens
aggauugcuacugu

SEQ ID NO: 934677 - RNA, 15 nt, Homo sapiens
aggauuuugauccaa

SEQ ID NO: 934678 - RNA, 13 nt, Homo sapiens
aggcaacugcauu

SEQ ID NO: 934679 - RNA, 20 nt, Homo sapiens
aggcagggucucacucuguc

SEQ ID NO: 934680 - RNA, 18 nt, Homo sapiens
aggcauccaguaucuuga

SEQ ID NO: 934681 - RNA, 21 nt, Homo sapiens
aggccaaaggaagcacaugcc

SEQ ID NO: 934682 - RNA, 20 nt, Homo sapiens
aggccuggccagaugcacca

SEQ ID NO: 934683 - RNA, 23 nt, Homo sapiens
aggccuggccagaugcaccagcc

SEQ ID NO: 934684 - RNA, 17 nt, Homo sapiens
aggcuaugugagcacaa

SEQ ID NO: 934685 - RNA, 20 nt, Homo sapiens
aggcuccaggagcagccaca

SEQ ID NO: 934686 - RNA, 15 nt, Homo sapiens
aggcucgagcaugcc

SEQ ID NO: 934687 - RNA, 21 nt, Homo sapiens
aggcuucuuccccccaaaacu

SEQ ID NO: 934688 - RNA, 13 nt, Homo sapiens
agggaaaaaccag

SEQ ID NO: 934689 - RNA, 14 nt, Homo sapiens
aggggcaguggugg

SEQ ID NO: 934690 - RNA, 22 nt, Homo sapiens
aggggcccaaauucuuucagug

SEQ ID NO: 934691 - RNA, 22 nt, Homo sapiens
aggucagagccugcaguuauua

SEQ ID NO: 934692 - RNA, 15 nt, Homo sapiens
aggucauugguggca

SEQ ID NO: 934693 - RNA, 21 nt, Homo sapiens
aggugcuauguucuuagugga

SEQ ID NO: 934694 - RNA, 19 nt, Homo sapiens
aguaacccugucuaaugaa

SEQ ID NO: 934695 - RNA, 20 nt, Homo sapiens
aguagcugggacuacaggca

SEQ ID NO: 934696 - RNA, 15 nt, Homo sapiens
aguaggaagacuuug

SEQ ID NO: 934697 - RNA, 18 nt, Homo sapiens
agucccaccuuggcugca

SEQ ID NO: 934698 - RNA, 20 nt, Homo sapiens
aguccucagugguuggcaau

SEQ ID NO: 934699 - RNA, 16 nt, Homo sapiens
agucucuugauucaua

SEQ ID NO: 934700 - RNA, 17 nt, Homo sapiens
agucuuuguacagacaa

SEQ ID NO: 934701 - RNA, 22 nt, Homo sapiens
agugaagcugggagaaccaaaa

SEQ ID NO: 934702 - RNA, 11 nt, Homo sapiens
agugacagagg

SEQ ID NO: 934703 - RNA, 21 nt, Homo sapiens
agugcagugagccgagaucac

SEQ ID NO: 934704 - RNA, 15 nt, Homo sapiens
agugggggaucacag

SEQ ID NO: 934705 - RNA, 13 nt, Homo sapiens
agugguuacccag

SEQ ID NO: 934706 - RNA, 12 nt, Homo sapiens
aguguacaugga

SEQ ID NO: 934707 - RNA, 13 nt, Homo sapiens
aguuacacuaaaa

SEQ ID NO: 934708 - RNA, 21 nt, Homo sapiens
aguucagccugggugugugaa

SEQ ID NO: 934709 - RNA, 14 nt, Homo sapiens
aguucaucuugaau

SEQ ID NO: 934710 - RNA, 21 nt, Homo sapiens
aguuccucauuagcauuuugc

SEQ ID NO: 934711 - RNA, 14 nt, Homo sapiens
aguuugaaccaaga

SEQ ID NO: 934712 - RNA, 20 nt, Homo sapiens
aguuugggguaugggagaga

SEQ ID NO: 934713 - RNA, 18 nt, Homo sapiens
aguuuuauuuuuguagag

SEQ ID NO: 934714 - RNA, 17 nt, Homo sapiens
auaaaaccccaucucua

SEQ ID NO: 934715 - RNA, 19 nt, Homo sapiens
auaacacuguacugcaaua

SEQ ID NO: 934716 - RNA, 23 nt, Homo sapiens
auaacucuacccuggcacuauaa

SEQ ID NO: 934717 - RNA, 14 nt, Homo sapiens
auaacuuuuuccaa

SEQ ID NO: 934718 - RNA, 16 nt, Homo sapiens
auaaguuaacuuccaa

SEQ ID NO: 934719 - RNA, 16 nt, Homo sapiens
auaauacaguaucuca

SEQ ID NO: 934720 - RNA, 17 nt, Homo sapiens
auaauacaguaucucag

SEQ ID NO: 934721 - RNA, 23 nt, Homo sapiens
auaauauuaaggaagacaaugug

SEQ ID NO: 934722 - RNA, 21 nt, Homo sapiens
auaaugcgugcauaccacuuu

SEQ ID NO: 934723 - RNA, 19 nt, Homo sapiens
auacaauuccaaacacaua

SEQ ID NO: 934724 - RNA, 15 nt, Homo sapiens
auacacuuacacuuu

SEQ ID NO: 934725 - RNA, 13 nt, Homo sapiens
auagacaauuuau

SEQ ID NO: 934726 - RNA, 15 nt, Homo sapiens
auagccaaggccaaa

SEQ ID NO: 934727 - RNA, 23 nt, Homo sapiens
auagugguggugaacagaacaaa

SEQ ID NO: 934728 - RNA, 15 nt, Homo sapiens
auaguggugugauuu

SEQ ID NO: 934729 - RNA, 16 nt, Homo sapiens
auagugucccacggug

SEQ ID NO: 934730 - RNA, 20 nt, Homo sapiens
auaugcuuauacacuuacac

SEQ ID NO: 934731 - RNA, 19 nt, Homo sapiens
auauuuugcuuugugauuu

SEQ ID NO: 934732 - RNA, 23 nt, Homo sapiens
aucacggcucacugcagccucaa

SEQ ID NO: 934733 - RNA, 18 nt, Homo sapiens
aucacuucccuacaugga

SEQ ID NO: 934734 - RNA, 15 nt, Homo sapiens
auccacccaccucag

SEQ ID NO: 934735 - RNA, 18 nt, Homo sapiens
aucccauaugccugggca

SEQ ID NO: 934736 - RNA, 13 nt, Homo sapiens
aucccuacuguaa

SEQ ID NO: 934737 - RNA, 14 nt, Homo sapiens
auccuagcacuuug

SEQ ID NO: 934738 - RNA, 19 nt, Homo sapiens
aucuaggaagacuuuggaa

SEQ ID NO: 934739 - RNA, 21 nt, Homo sapiens
aucuuccaaggguacuaagga

SEQ ID NO: 934740 - RNA, 22 nt, Homo sapiens
aucuucuuuauaauucuacuuu

SEQ ID NO: 934741 - RNA, 21 nt, Homo sapiens
augaaaccugugucucugaga

SEQ ID NO: 934742 - RNA, 13 nt, Homo sapiens
augaauacagaua

SEQ ID NO: 934743 - RNA, 21 nt, Homo sapiens
augaccuugaaugaugccaug

SEQ ID NO: 934744 - RNA, 23 nt, Homo sapiens
augacuccagaauuucccaaagc

SEQ ID NO: 934745 - RNA, 14 nt, Homo sapiens
augacuuacuguac

SEQ ID NO: 934746 - RNA, 21 nt, Homo sapiens
augagccucagcauccuggca

SEQ ID NO: 934747 - RNA, 20 nt, Homo sapiens
augagcugcacuccaugagu

SEQ ID NO: 934748 - RNA, 16 nt, Homo sapiens
augaggaaacugcacu

SEQ ID NO: 934749 - RNA, 15 nt, Homo sapiens
augagguacucuccu

SEQ ID NO: 934750 - RNA, 20 nt, Homo sapiens
augaucacggcucacugcag

SEQ ID NO: 934751 - RNA, 15 nt, Homo sapiens
augcaaggucauuuu

SEQ ID NO: 934752 - RNA, 18 nt, Homo sapiens
augcagugguaugaucac

SEQ ID NO: 934753 - RNA, 21 nt, Homo sapiens
augccaugggcccucucagca

SEQ ID NO: 934754 - RNA, 15 nt, Homo sapiens
augccucucucaggc

SEQ ID NO: 934755 - RNA, 15 nt, Homo sapiens
augcugucccuuacg

SEQ ID NO: 934756 - RNA, 23 nt, Homo sapiens
augcuugcuucaaccccaugaga

SEQ ID NO: 934757 - RNA, 15 nt, Homo sapiens
auggacaaugaccca

SEQ ID NO: 934758 - RNA, 12 nt, Homo sapiens
auggacuuuguu

SEQ ID NO: 934759 - RNA, 16 nt, Homo sapiens
auggaguauaugucaa

SEQ ID NO: 934760 - RNA, 14 nt, Homo sapiens
auggauuuccagcc

SEQ ID NO: 934761 - RNA, 19 nt, Homo sapiens
auggcuuggggggcuccag

SEQ ID NO: 934762 - RNA, 20 nt, Homo sapiens
augucucuuuaaugucacag

SEQ ID NO: 934763 - RNA, 21 nt, Homo sapiens
augugacuugagcccagagug

SEQ ID NO: 934764 - RNA, 16 nt, Homo sapiens
auguguguucaugcac

SEQ ID NO: 934765 - RNA, 14 nt, Homo sapiens
auguucugggacac

SEQ ID NO: 934766 - RNA, 17 nt, Homo sapiens
auguugaaagaucaaaa

SEQ ID NO: 934767 - RNA, 20 nt, Homo sapiens
auguuuuucuucucccucag

SEQ ID NO: 934768 - RNA, 23 nt, Homo sapiens
auuacaagcgugagccacugcac

SEQ ID NO: 934769 - RNA, 23 nt, Homo sapiens
auuagccaagugugguagagugu

SEQ ID NO: 934770 - RNA, 18 nt, Homo sapiens
ccaggcuggcgugcagug

SEQ ID NO: 934771 - RNA, 20 nt, Homo sapiens
ccaggcuggcgugcaguggu

SEQ ID NO: 934772 - RNA, 16 nt, Homo sapiens
ccaguguuguggauuu

SEQ ID NO: 934773 - RNA, 12 nt, Homo sapiens
ccauccagguuc

SEQ ID NO: 934774 - RNA, 19 nt, Homo sapiens
ccaucucuacaaaaagcau

SEQ ID NO: 934775 - RNA, 20 nt, Homo sapiens
ccauguaagcaccccuucau

SEQ ID NO: 934776 - RNA, 21 nt, Homo sapiens
cccacgacugcccggcagggu

SEQ ID NO: 934777 - RNA, 19 nt, Homo sapiens
cccacuggaggcaugugau

SEQ ID NO: 934778 - RNA, 20 nt, Homo sapiens
cccacuggaggcaugugaug

SEQ ID NO: 934779 - RNA, 21 nt, Homo sapiens
cccagccccuucugacccaug

SEQ ID NO: 934780 - RNA, 19 nt, Homo sapiens
cccaggccuccccagcacc

SEQ ID NO: 934781 - RNA, 22 nt, Homo sapiens
cccaggugguuauggagagggu

SEQ ID NO: 934782 - RNA, 17 nt, Homo sapiens
cccauaugccugggcag

SEQ ID NO: 934783 - RNA, 16 nt, Homo sapiens
ccccaggcugggcugu

SEQ ID NO: 934784 - RNA, 18 nt, Homo sapiens
cccucaacaccucugcac

SEQ ID NO: 934785 - RNA, 23 nt, Homo sapiens
cccucaacaccucugcacaagcu

SEQ ID NO: 934786 - RNA, 18 nt, Homo sapiens
cccugagcuuucugcuau

SEQ ID NO: 934787 - RNA, 21 nt, Homo sapiens
cccuucauccuucuggaauaa

SEQ ID NO: 934788 - RNA, 22 nt, Homo sapiens
cccuuuuuuggcugcugaaggc

SEQ ID NO: 934789 - RNA, 22 nt, Homo sapiens
ccgagcuuugaaaauucagugg

SEQ ID NO: 934790 - RNA, 21 nt, Homo sapiens
aauuaguuccucauuagcauu

SEQ ID NO: 934791 - RNA, 23 nt, Homo sapiens
aauucucuuuccuguagucccau

SEQ ID NO: 934792 - RNA, 14 nt, Homo sapiens
aauugaaaaaccau

SEQ ID NO: 934793 - RNA, 15 nt, Homo sapiens
aauuguuuggggaug

SEQ ID NO: 934794 - RNA, 20 nt, Homo sapiens
acaagcgugagccacugcac

SEQ ID NO: 934795 - RNA, 21 nt, Homo sapiens
acacaggcccggcuccaggcu

SEQ ID NO: 934796 - RNA, 17 nt, Homo sapiens
acacaguauuacuucug

SEQ ID NO: 934797 - RNA, 16 nt, Homo sapiens
acacaguucaauucuc

SEQ ID NO: 934798 - RNA, 20 nt, Homo sapiens
acacauuuuuuaaaugcacc

SEQ ID NO: 934799 - RNA, 21 nt, Homo sapiens
acacauuuuuuaaaugcaccu

SEQ ID NO: 934800 - RNA, 15 nt, Homo sapiens
ccagcucugguccau

SEQ ID NO: 934801 - RNA, 13 nt, Homo sapiens
ccagcugcuuggg

SEQ ID NO: 934802 - RNA, 13 nt, Homo sapiens
ccaggcugggcug

SEQ ID NO: 934803 - RNA, 13 nt, Homo sapiens
ccagggucucacu

SEQ ID NO: 934804 - RNA, 13 nt, Homo sapiens
ccaguucuuuuaa

SEQ ID NO: 934805 - RNA, 10 nt, Homo sapiens
ccauggacuu

SEQ ID NO: 934806 - RNA, 17 nt, Homo sapiens
ccauguuggccaggcug

SEQ ID NO: 934807 - RNA, 17 nt, Homo sapiens
ccauuucugagaucaaa

SEQ ID NO: 934808 - RNA, 23 nt, Homo sapiens
cccaaacccauuuuagagacaga

SEQ ID NO: 934809 - RNA, 18 nt, Homo sapiens
cccaaauucuuucagugg

SEQ ID NO: 934810 - RNA, 15 nt, Homo sapiens
cccaccaucaugucu

SEQ ID NO: 934811 - RNA, 21 nt, Homo sapiens
cccacccuccuuucaccacau

SEQ ID NO: 934812 - RNA, 15 nt, Homo sapiens
cccacuucugccaua

SEQ ID NO: 934813 - RNA, 19 nt, Homo sapiens
cccaggcuggcgugcagug

SEQ ID NO: 934814 - RNA, 19 nt, Homo sapiens
cccagucuggaaugcagug

SEQ ID NO: 934815 - RNA, 13 nt, Homo sapiens
cccaucucuacaa

SEQ ID NO: 934816 - RNA, 15 nt, Homo sapiens
ccccagugcccacag

SEQ ID NO: 934817 - RNA, 15 nt, Homo sapiens
cccccuuccauggac

SEQ ID NO: 934818 - RNA, 14 nt, Homo sapiens
ccccgaugggaugg

SEQ ID NO: 934819 - RNA, 18 nt, Homo sapiens
ccccucaacaccucugca

SEQ ID NO: 934820 - RNA, 22 nt, Homo sapiens
ccccuguagagugggagcugag

SEQ ID NO: 934821 - RNA, 19 nt, Homo sapiens
ccccuucauuuggcauucc

SEQ ID NO: 934822 - RNA, 21 nt, Homo sapiens
cccuauugcugcuugaggcaa

SEQ ID NO: 934823 - RNA, 23 nt, Homo sapiens
cccugguggaaugcgggggagca

SEQ ID NO: 934824 - RNA, 17 nt, Homo sapiens
ccgaauagcugggacua

SEQ ID NO: 934825 - RNA, 16 nt, Homo sapiens
ccgcacugggcuuggg

SEQ ID NO: 934826 - RNA, 14 nt, Homo sapiens
ccuacucuguguca

SEQ ID NO: 934827 - RNA, 21 nt, Homo sapiens
ccuagccuuagaagucacaca

SEQ ID NO: 934828 - RNA, 18 nt, Homo sapiens
ccucaaccuccugggcua

SEQ ID NO: 934829 - RNA, 15 nt, Homo sapiens
ccuccaggugcacaa

SEQ ID NO: 934830 - RNA, 21 nt, Homo sapiens
ccucucagauuguaccauuga

SEQ ID NO: 934831 - RNA, 14 nt, Homo sapiens
ccucugaaaaccaa

SEQ ID NO: 934832 - RNA, 21 nt, Homo sapiens
ccucuucucuacucuagggaa

SEQ ID NO: 934833 - RNA, 17 nt, Homo sapiens
ccugaaacaacccaaag

SEQ ID NO: 934834 - RNA, 14 nt, Homo sapiens
ccugaagucacaca

SEQ ID NO: 934835 - RNA, 21 nt, Homo sapiens
ccugcaaccugauugugucuc

SEQ ID NO: 934836 - RNA, 22 nt, Homo sapiens
ccugcccuuaccugccaggaag

SEQ ID NO: 934837 - RNA, 15 nt, Homo sapiens
ccugggcaaugugau

SEQ ID NO: 934838 - RNA, 18 nt, Homo sapiens
ccugggugugugaagcug

SEQ ID NO: 934839 - RNA, 19 nt, Homo sapiens
ccugugaguacuacagucc

SEQ ID NO: 934840 - RNA, 15 nt, Homo sapiens
ccuuagaagucacac

SEQ ID NO: 934841 - RNA, 13 nt, Homo sapiens
ccuuagacagucc

SEQ ID NO: 934842 - RNA, 20 nt, Homo sapiens
ccuuagcagggaaacagcua

SEQ ID NO: 934843 - RNA, 14 nt, Homo sapiens
cgaguuacagacaa

SEQ ID NO: 934844 - RNA, 17 nt, Homo sapiens
cgauagugguggugaac

SEQ ID NO: 934845 - RNA, 12 nt, Homo sapiens
cgaucuggguuc

SEQ ID NO: 934846 - RNA, 20 nt, Homo sapiens
cgaucuggguucacugcaac

SEQ ID NO: 934847 - RNA, 19 nt, Homo sapiens
cgccagauucuuuccugag

SEQ ID NO: 934848 - RNA, 20 nt, Homo sapiens
cgcuacccgggaagggggcu

SEQ ID NO: 934849 - RNA, 21 nt, Homo sapiens
cggccccugcugguucagggu

SEQ ID NO: 934850 - RNA, 17 nt, Homo sapiens
cgugcacacaccagagc

SEQ ID NO: 934851 - RNA, 18 nt, Homo sapiens
cguuaugauaguguccca

SEQ ID NO: 934852 - RNA, 16 nt, Homo sapiens
cuaaaagguaugcaau

SEQ ID NO: 934853 - RNA, 13 nt, Homo sapiens
cuaaagcugccag

SEQ ID NO: 934854 - RNA, 17 nt, Homo sapiens
cuaacuugucuuuggac

SEQ ID NO: 934855 - RNA, 15 nt, Homo sapiens
cuaacuuuccuucau

SEQ ID NO: 934856 - RNA, 23 nt, Homo sapiens
cuaacuuuccuucauucaaccca

SEQ ID NO: 934857 - RNA, 23 nt, Homo sapiens
cuaagagggagggagggcuccag

SEQ ID NO: 934858 - RNA, 16 nt, Homo sapiens
cuaagcuauucaguaa

SEQ ID NO: 934859 - RNA, 18 nt, Homo sapiens
cuaagcuauucaguaaua

SEQ ID NO: 934860 - RNA, 13 nt, Homo sapiens
cuagauacuguau

SEQ ID NO: 934861 - RNA, 16 nt, Homo sapiens
cuagcauggcugccaa

SEQ ID NO: 934862 - RNA, 19 nt, Homo sapiens
cuaggaaucaugugccaag

SEQ ID NO: 934863 - RNA, 14 nt, Homo sapiens
cuaggaggucucua

SEQ ID NO: 934864 - RNA, 17 nt, Homo sapiens
cuaggcauuugcugaau

SEQ ID NO: 934865 - RNA, 14 nt, Homo sapiens
cuaugugagcacaa

SEQ ID NO: 934866 - RNA, 13 nt, Homo sapiens
cuauguucuuagu

SEQ ID NO: 934867 - RNA, 16 nt, Homo sapiens
cuauuguuucuuucaa

SEQ ID NO: 934868 - RNA, 22 nt, Homo sapiens
cucaaccuccugggcuaaguga

SEQ ID NO: 934869 - RNA, 15 nt, Homo sapiens
cucacauaucuguca

SEQ ID NO: 934870 - RNA, 17 nt, Homo sapiens
cucacauaucugucauu

SEQ ID NO: 934871 - RNA, 19 nt, Homo sapiens
cucacauuuauucugcuca

SEQ ID NO: 934872 - RNA, 17 nt, Homo sapiens
cucagagagggugggag

SEQ ID NO: 934873 - RNA, 13 nt, Homo sapiens
cucagcaaaagau

SEQ ID NO: 934874 - RNA, 18 nt, Homo sapiens
cucagccucccaaagugc

SEQ ID NO: 934875 - RNA, 22 nt, Homo sapiens
cucaucuuagguuggcaaaaag

SEQ ID NO: 934876 - RNA, 19 nt, Homo sapiens
cucauuugucacacacuuu

SEQ ID NO: 934877 - RNA, 16 nt, Homo sapiens
cuccauguuugaugua

SEQ ID NO: 934878 - RNA, 18 nt, Homo sapiens
cuccccagcaagugagag

SEQ ID NO: 934879 - RNA, 19 nt, Homo sapiens
cuccgcuuucuacccagcg

SEQ ID NO: 934880 - RNA, 16 nt, Homo sapiens
cuccucuccccagcaa

SEQ ID NO: 934881 - RNA, 18 nt, Homo sapiens
cuccugugucuugcaaug

SEQ ID NO: 934882 - RNA, 13 nt, Homo sapiens
cuccuuguguuac

SEQ ID NO: 934883 - RNA, 16 nt, Homo sapiens
cucgaguuacagacaa

SEQ ID NO: 934884 - RNA, 12 nt, Homo sapiens
cucuacaaaaag

SEQ ID NO: 934885 - RNA, 13 nt, Homo sapiens
cucuacaaaaagc

SEQ ID NO: 934886 - RNA, 14 nt, Homo sapiens
cucuacaaaaagca

SEQ ID NO: 934887 - RNA, 20 nt, Homo sapiens
cucuacccuggcacuauaau

SEQ ID NO: 934888 - RNA, 22 nt, Homo sapiens
cucuacugaggugcuauguucu

SEQ ID NO: 934889 - RNA, 14 nt, Homo sapiens
cucucaggccagcu

SEQ ID NO: 934890 - RNA, 19 nt, Homo sapiens
cucugagacucgcgacaau

SEQ ID NO: 934891 - RNA, 21 nt, Homo sapiens
cucugagacucgcgacaaugc

SEQ ID NO: 934892 - RNA, 21 nt, Homo sapiens
cucugagaguagagucacugg

SEQ ID NO: 934893 - RNA, 22 nt, Homo sapiens
cucugcacaagcugcacccuca

SEQ ID NO: 934894 - RNA, 20 nt, Homo sapiens
cucuggacaggcauguucuc

SEQ ID NO: 934895 - RNA, 16 nt, Homo sapiens
cucuuagaaaaaccac

SEQ ID NO: 934896 - RNA, 15 nt, Homo sapiens
cucuuauauugccau

SEQ ID NO: 934897 - RNA, 22 nt, Homo sapiens
cucuuccacuuugauaccauug

SEQ ID NO: 934898 - RNA, 21 nt, Homo sapiens
cucuugagccugggaggucaa

SEQ ID NO: 934899 - RNA, 13 nt, Homo sapiens
cucuugcacucaa

SEQ ID NO: 934900 - RNA, 15 nt, Homo sapiens
cugaaugguuuucaa

SEQ ID NO: 934901 - RNA, 19 nt, Homo sapiens
cugaauuucucacaaagga

SEQ ID NO: 934902 - RNA, 21 nt, Homo sapiens
cugacccaugcugcccuguga

SEQ ID NO: 934903 - RNA, 12 nt, Homo sapiens
cugaggugggag

SEQ ID NO: 934904 - RNA, 20 nt, Homo sapiens
cugaggugggaggaucucuu

SEQ ID NO: 934905 - RNA, 17 nt, Homo sapiens
cugaguacguugugcau

SEQ ID NO: 934906 - RNA, 19 nt, Homo sapiens
cugaguacguugugcauuu

SEQ ID NO: 934907 - RNA, 14 nt, Homo sapiens
cugaugcagaaaga

SEQ ID NO: 934908 - RNA, 19 nt, Homo sapiens
cugaugcagaaagaccgug

SEQ ID NO: 934909 - RNA, 13 nt, Homo sapiens
cugcacuccauga

SEQ ID NO: 934910 - RNA, 18 nt, Homo sapiens
cugcagagggcacagaaa

SEQ ID NO: 934911 - RNA, 15 nt, Homo sapiens
cugcaucaagaugug

SEQ ID NO: 934912 - RNA, 15 nt, Homo sapiens
cugcauguuacauaa

SEQ ID NO: 934913 - RNA, 16 nt, Homo sapiens
cugccacccuggggag

SEQ ID NO: 934914 - RNA, 18 nt, Homo sapiens
cugccauuucugagauca

SEQ ID NO: 934915 - RNA, 16 nt, Homo sapiens
cugcccuuaccugcca

SEQ ID NO: 934916 - RNA, 16 nt, Homo sapiens
cugccugaagucacac

SEQ ID NO: 934917 - RNA, 17 nt, Homo sapiens
cugccugaagucacaca

SEQ ID NO: 934918 - RNA, 13 nt, Homo sapiens
cugcugacagugu

SEQ ID NO: 934919 - RNA, 15 nt, Homo sapiens
cuggaugcagccuca

SEQ ID NO: 934920 - RNA, 15 nt, Homo sapiens
cuggcaagaaugugu

SEQ ID NO: 934921 - RNA, 19 nt, Homo sapiens
cuggcacugcuuccaguga

SEQ ID NO: 934922 - RNA, 20 nt, Homo sapiens
cuggcacugcuuccagugag

SEQ ID NO: 934923 - RNA, 23 nt, Homo sapiens
cuggcugcaaaggguaucaggug

SEQ ID NO: 934924 - RNA, 16 nt, Homo sapiens
gccucucucaggccaa

SEQ ID NO: 934925 - RNA, 17 nt, Homo sapiens
gccucucucaggccaaa

SEQ ID NO: 934926 - RNA, 17 nt, Homo sapiens
gccuggccccucagggu

SEQ ID NO: 934927 - RNA, 15 nt, Homo sapiens
gccugggaucccuca

SEQ ID NO: 934928 - RNA, 12 nt, Homo sapiens
gcgugcacacac

SEQ ID NO: 934929 - RNA, 12 nt, Homo sapiens
gcuaaagggaaa

SEQ ID NO: 934930 - RNA, 17 nt, Homo sapiens
gcuaccuacauacaauu

SEQ ID NO: 934931 - RNA, 13 nt, Homo sapiens
gcuaugcauuuga

SEQ ID NO: 934932 - RNA, 16 nt, Homo sapiens
gcuaugugagcacaaa

SEQ ID NO: 934933 - RNA, 18 nt, Homo sapiens
gcucacauaucugucauu

SEQ ID NO: 934934 - RNA, 22 nt, Homo sapiens
gcucagcaaaagaugcuucuca

SEQ ID NO: 934935 - RNA, 19 nt, Homo sapiens
gcucagcggggacagcucc

SEQ ID NO: 934936 - RNA, 20 nt, Homo sapiens
gcucaggugucccugcacuu

SEQ ID NO: 934937 - RNA, 15 nt, Homo sapiens
gcuccuucuguccua

SEQ ID NO: 934938 - RNA, 18 nt, Homo sapiens
gcucugaucauccacugu

SEQ ID NO: 934939 - RNA, 16 nt, Homo sapiens
gcucugcugacagaca

SEQ ID NO: 934940 - RNA, 14 nt, Homo sapiens
gcucuggacaggca

SEQ ID NO: 934941 - RNA, 15 nt, Homo sapiens
gcugcacuccaugag

SEQ ID NO: 934942 - RNA, 13 nt, Homo sapiens
gcugccugggauc

SEQ ID NO: 934943 - RNA, 18 nt, Homo sapiens
gcugcuacuacuccugua

SEQ ID NO: 934944 - RNA, 14 nt, Homo sapiens
gcuggcgugcagug

SEQ ID NO: 934945 - RNA, 16 nt, Homo sapiens
gcugggacuacaggug

SEQ ID NO: 934946 - RNA, 18 nt, Homo sapiens
gcugggcuucaguggcag

SEQ ID NO: 934947 - RNA, 21 nt, Homo sapiens
gcuuauacacuuacacuuuau

SEQ ID NO: 934948 - RNA, 18 nt, Homo sapiens
gcuucaguggcagcugcu

SEQ ID NO: 934949 - RNA, 14 nt, Homo sapiens
gcuuuugugcauua

SEQ ID NO: 934950 - RNA, 15 nt, Homo sapiens
ggaaacugcacuguu

SEQ ID NO: 934951 - RNA, 19 nt, Homo sapiens
ggaagccacagggugagca

SEQ ID NO: 934952 - RNA, 23 nt, Homo sapiens
ggacaaggaugaucuaggaagac

SEQ ID NO: 934953 - RNA, 15 nt, Homo sapiens
ggaccagagcugcca

SEQ ID NO: 934954 - RNA, 13 nt, Homo sapiens
ggacuacaggcac

SEQ ID NO: 934955 - RNA, 22 nt, Homo sapiens
ggacucaaugcacugacauugu

SEQ ID NO: 934956 - RNA, 10 nt, Homo sapiens
ggacuuuguu

SEQ ID NO: 934957 - RNA, 14 nt, Homo sapiens
ggagacgggggcag

SEQ ID NO: 934958 - RNA, 13 nt, Homo sapiens
ggagaggggcaca

SEQ ID NO: 934959 - RNA, 22 nt, Homo sapiens
ggagaguaacccugucuaauga

SEQ ID NO: 934960 - RNA, 18 nt, Homo sapiens
ggagauaaaauaaaaaga

SEQ ID NO: 934961 - RNA, 17 nt, Homo sapiens
ggagauuuacaacuggg

SEQ ID NO: 934962 - RNA, 12 nt, Homo sapiens
ggaggauguucu

SEQ ID NO: 934963 - RNA, 20 nt, Homo sapiens
ggaggauguucugggacaca

SEQ ID NO: 934964 - RNA, 22 nt, Homo sapiens
ggagggcuccagacacaugucc

SEQ ID NO: 934965 - RNA, 18 nt, Homo sapiens
ggagggucugcagggaau

SEQ ID NO: 934966 - RNA, 16 nt, Homo sapiens
ggauguucugggacac

SEQ ID NO: 934967 - RNA, 20 nt, Homo sapiens
ggcacucagaagacacugau

SEQ ID NO: 934968 - RNA, 19 nt, Homo sapiens
ggccagagggagugacaga

SEQ ID NO: 934969 - RNA, 17 nt, Homo sapiens
ggccaggcuggucucaa

SEQ ID NO: 934970 - RNA, 11 nt, Homo sapiens
ggccaguguga

SEQ ID NO: 934971 - RNA, 16 nt, Homo sapiens
ggcccaaugcacuuug

SEQ ID NO: 934972 - RNA, 23 nt, Homo sapiens
ggcccuggccuagcauacguaca

SEQ ID NO: 934973 - RNA, 12 nt, Homo sapiens
ggcucucaggcc

SEQ ID NO: 934974 - RNA, 16 nt, Homo sapiens
ggcucucaggccagcu

SEQ ID NO: 934975 - RNA, 15 nt, Homo sapiens
ggcuguaucccauga

SEQ ID NO: 934976 - RNA, 13 nt, Homo sapiens
ggcuuggggacca

SEQ ID NO: 934977 - RNA, 22 nt, Homo sapiens
gggaaugaaugucagugugacu

SEQ ID NO: 934978 - RNA, 15 nt, Homo sapiens
gggaggggaagaaaa

SEQ ID NO: 934979 - RNA, 20 nt, Homo sapiens
gggaggucaaggcugcagug

SEQ ID NO: 934980 - RNA, 20 nt, Homo sapiens
gggcucccuucccaccucuc

SEQ ID NO: 934981 - RNA, 18 nt, Homo sapiens
ggggaagaaaaacucuau

SEQ ID NO: 934982 - RNA, 20 nt, Homo sapiens
gggucucacuauguugccca

SEQ ID NO: 934983 - RNA, 19 nt, Homo sapiens
gggugacagagcaagugag

SEQ ID NO: 934984 - RNA, 19 nt, Homo sapiens
ggguuucuaaagcugccag

SEQ ID NO: 934985 - RNA, 14 nt, Homo sapiens
ggucugugugauga

SEQ ID NO: 934986 - RNA, 14 nt, Homo sapiens
ggugugugaagcug

SEQ ID NO: 934987 - RNA, 13 nt, Homo sapiens
guaaaaagggaaa

SEQ ID NO: 934988 - RNA, 17 nt, Homo sapiens
guaaauagcucaggugu

SEQ ID NO: 934989 - RNA, 22 nt, Homo sapiens
guaagcucuacugaggugcuau

SEQ ID NO: 934990 - RNA, 21 nt, Homo sapiens
guacacuguuucaaacuuuac

SEQ ID NO: 934991 - RNA, 15 nt, Homo sapiens
guagagucacuggaa

SEQ ID NO: 934992 - RNA, 22 nt, Homo sapiens
guagucaggugccucaagagaa

SEQ ID NO: 934993 - RNA, 16 nt, Homo sapiens
guaucaggugcugcca

SEQ ID NO: 934994 - RNA, 18 nt, Homo sapiens
guaucccaugagccucag

SEQ ID NO: 934995 - RNA, 14 nt, Homo sapiens
guaugaggcauuug

SEQ ID NO: 934996 - RNA, 17 nt, Homo sapiens
guaugaucacggcucac

SEQ ID NO: 934997 - RNA, 14 nt, Homo sapiens
guauuauaccuuuu

SEQ ID NO: 934998 - RNA, 20 nt, Homo sapiens
gucagauuugaacucuucaa

SEQ ID NO: 934999 - RNA, 16 nt, Homo sapiens
gucccauugauguacu

SEQ ID NO: 935000 - RNA, 15 nt, Homo sapiens
gucggaaaacaugcu

SEQ ID NO: 935001 - RNA, 12 nt, Homo sapiens
gucuacacugug

SEQ ID NO: 935002 - RNA, 17 nt, Homo sapiens
gucucauacucaccuca

SEQ ID NO: 935003 - RNA, 15 nt, Homo sapiens
gugaagcugggagaa

SEQ ID NO: 935004 - RNA, 23 nt, Homo sapiens
gugaagcugggagaaccaaaaag

SEQ ID NO: 935005 - RNA, 20 nt, Homo sapiens
gugagcaauccugcaagaac

SEQ ID NO: 935006 - RNA, 14 nt, Homo sapiens
gugaggaagcaaaa

SEQ ID NO: 935007 - RNA, 15 nt, Homo sapiens
gugaggaagcaaaag

SEQ ID NO: 935008 - RNA, 21 nt, Homo sapiens
gugagggaacagagagguuaa

SEQ ID NO: 935009 - RNA, 13 nt, Homo sapiens
gugauacaaugcu

SEQ ID NO: 935010 - RNA, 17 nt, Homo sapiens
gugauuuucauugcugg

SEQ ID NO: 935011 - RNA, 14 nt, Homo sapiens
gugcagcucuggag

SEQ ID NO: 935012 - RNA, 20 nt, Homo sapiens
gugcagugagccgagaucac

SEQ ID NO: 935013 - RNA, 13 nt, Homo sapiens
gugcccccaugua

SEQ ID NO: 935014 - RNA, 14 nt, Homo sapiens
gugccuuacacaau

SEQ ID NO: 935015 - RNA, 23 nt, Homo sapiens
gugcuaggaacacuccuucacag

SEQ ID NO: 935016 - RNA, 18 nt, Homo sapiens
gugcugggauuacaggug

SEQ ID NO: 935017 - RNA, 21 nt, Homo sapiens
guggcagcugcuuuugucuau

SEQ ID NO: 935018 - RNA, 20 nt, Homo sapiens
guggugaacagaacaaaagg

SEQ ID NO: 935019 - RNA, 17 nt, Homo sapiens
guggugagaggcaucca

SEQ ID NO: 935020 - RNA, 15 nt, Homo sapiens
guguuuauugucaaa

SEQ ID NO: 935021 - RNA, 23 nt, Homo sapiens
guguuuccuggcacugcuuccag

SEQ ID NO: 935022 - RNA, 19 nt, Homo sapiens
guuaauaaaggaacauuaa

SEQ ID NO: 935023 - RNA, 14 nt, Homo sapiens
guuacauaagauaa

SEQ ID NO: 935024 - RNA, 22 nt, Homo sapiens
guuacauaagauaaaugugcug

SEQ ID NO: 935025 - RNA, 23 nt, Homo sapiens
guucaauucucauuugucacaca

SEQ ID NO: 935026 - RNA, 12 nt, Homo sapiens
guucccauuugc

SEQ ID NO: 935027 - RNA, 15 nt, Homo sapiens
guucugggacacagu

SEQ ID NO: 935028 - RNA, 17 nt, Homo sapiens
guucuuaguuugcaguu

SEQ ID NO: 935029 - RNA, 22 nt, Homo sapiens
guuggccagugugacaaggauu

SEQ ID NO: 935030 - RNA, 16 nt, Homo sapiens
guuggucccccuucca

SEQ ID NO: 935031 - RNA, 14 nt, Homo sapiens
guugugugugcuuu

SEQ ID NO: 935032 - RNA, 18 nt, Homo sapiens
guugugugugcuuucuaa

SEQ ID NO: 935033 - RNA, 22 nt, Homo sapiens
guuguuugauucagacagcugc

SEQ ID NO: 935034 - RNA, 19 nt, Homo sapiens
guuuaaaaauccccaaaaa

SEQ ID NO: 935035 - RNA, 21 nt, Homo sapiens
guuucuuuuuucggcuaaaaa

SEQ ID NO: 935036 - RNA, 22 nt, Homo sapiens
guuugaagaugccgcauuugga

SEQ ID NO: 935037 - RNA, 16 nt, Homo sapiens
guuugguucaugguga

SEQ ID NO: 935038 - RNA, 22 nt, Homo sapiens
guuuuaugagaaaugccagugu

SEQ ID NO: 935039 - RNA, 14 nt, Homo sapiens
guuuucaguguaca

SEQ ID NO: 935040 - RNA, 14 nt, Homo sapiens
uaaaacacaacauc

SEQ ID NO: 935041 - RNA, 16 nt, Homo sapiens
uaaaacccaagugccu

SEQ ID NO: 935042 - RNA, 16 nt, Homo sapiens
uaaaauuacugaugca

SEQ ID NO: 935043 - RNA, 22 nt, Homo sapiens
uaaaugucucuuuaaugucaca

SEQ ID NO: 935044 - RNA, 21 nt, Homo sapiens
uaaaugugaaugaugauccua

SEQ ID NO: 935045 - RNA, 16 nt, Homo sapiens
uaacagaaauguacag

SEQ ID NO: 935046 - RNA, 16 nt, Homo sapiens
uaacaggcagauacag

SEQ ID NO: 935047 - RNA, 20 nt, Homo sapiens
uaacauguaauuaaguacua

SEQ ID NO: 935048 - RNA, 13 nt, Homo sapiens
aaaacauuuuacu

SEQ ID NO: 935049 - RNA, 23 nt, Homo sapiens
aaaacauuuuacuuuaaaaggag

SEQ ID NO: 935050 - RNA, 17 nt, Homo sapiens
aaaaccagcgugugacu

SEQ ID NO: 935051 - RNA, 22 nt, Homo sapiens
acugaguacguugugcauuugg

SEQ ID NO: 935052 - RNA, 17 nt, Homo sapiens
acuggaacacuaaugag

SEQ ID NO: 935053 - RNA, 21 nt, Homo sapiens
acuggaacacuaaugaggaaa

SEQ ID NO: 935054 - RNA, 14 nt, Homo sapiens
acuggcugcaaagg

SEQ ID NO: 935055 - RNA, 15 nt, Homo sapiens
acuuaaccugaagcu

SEQ ID NO: 935056 - RNA, 16 nt, Homo sapiens
acuucccuacauggag

SEQ ID NO: 935057 - RNA, 19 nt, Homo sapiens
acuucuuauacauuugaua

SEQ ID NO: 935058 - RNA, 16 nt, Homo sapiens
acuugagaauuacccu

SEQ ID NO: 935059 - RNA, 20 nt, Homo sapiens
acuugggccacugugaagag

SEQ ID NO: 935060 - RNA, 12 nt, Homo sapiens
acuuuaccuuuu

SEQ ID NO: 935061 - RNA, 13 nt, Homo sapiens
acuuugaccucug

SEQ ID NO: 935062 - RNA, 23 nt, Homo sapiens
acuuugaccucugcagcaauaaa

SEQ ID NO: 935063 - RNA, 17 nt, Homo sapiens
agaaaaaggaugcacag

SEQ ID NO: 935064 - RNA, 19 nt, Homo sapiens
agaaccaaaaagaggcuau

SEQ ID NO: 935065 - RNA, 14 nt, Homo sapiens
agaagaaacuaccc

SEQ ID NO: 935066 - RNA, 17 nt, Homo sapiens
agaauugaaaaaccauu

SEQ ID NO: 935067 - RNA, 18 nt, Homo sapiens
agaauugaaaaaccauuu

SEQ ID NO: 935068 - RNA, 22 nt, Homo sapiens
agacaaugugaaaagaaaaaug

SEQ ID NO: 935069 - RNA, 17 nt, Homo sapiens
agacacaggcccggcuc

SEQ ID NO: 935070 - RNA, 20 nt, Homo sapiens
agacagaguuuucacucuua

SEQ ID NO: 935071 - RNA, 22 nt, Homo sapiens
agacagaguuuucacucuuauu

SEQ ID NO: 935072 - RNA, 23 nt, Homo sapiens
agacagucccugccaauggacua

SEQ ID NO: 935073 - RNA, 23 nt, Homo sapiens
agacuuuuccaacccucaucacc

SEQ ID NO: 935074 - RNA, 20 nt, Homo sapiens
agagaaugcacaaacagagg

SEQ ID NO: 935075 - RNA, 13 nt, Homo sapiens
agagacagaagaa

SEQ ID NO: 935076 - RNA, 17 nt, Homo sapiens
agagaggguggugaccu

SEQ ID NO: 935077 - RNA, 12 nt, Homo sapiens
agagccuuccag

SEQ ID NO: 935078 - RNA, 18 nt, Homo sapiens
agagcuacacaggggaaa

SEQ ID NO: 935079 - RNA, 17 nt, Homo sapiens
agaguaggaagacuuug

SEQ ID NO: 935080 - RNA, 15 nt, Homo sapiens
agaguugaagacaga

SEQ ID NO: 935081 - RNA, 13 nt, Homo sapiens
agauaaaugugcu

SEQ ID NO: 935082 - RNA, 13 nt, Homo sapiens
agauauaugcucu

SEQ ID NO: 935083 - RNA, 17 nt, Homo sapiens
agaucacgccacugcac

SEQ ID NO: 935084 - RNA, 16 nt, Homo sapiens
agaucucuaacuucac

SEQ ID NO: 935085 - RNA, 13 nt, Homo sapiens
agauggccaugua

SEQ ID NO: 935086 - RNA, 18 nt, Homo sapiens
agcacaaagguagcuuuu

SEQ ID NO: 935087 - RNA, 20 nt, Homo sapiens
agcacaugccucucucaggc

SEQ ID NO: 935088 - RNA, 23 nt, Homo sapiens
agcacuaaggugugcucugauca

SEQ ID NO: 935089 - RNA, 13 nt, Homo sapiens
agcagaaaugccu

SEQ ID NO: 935090 - RNA, 14 nt, Homo sapiens
agcagaaaugccuu

SEQ ID NO: 935091 - RNA, 13 nt, Homo sapiens
agcagugugauug

SEQ ID NO: 935092 - RNA, 16 nt, Homo sapiens
agcaucuaugugagac

SEQ ID NO: 935093 - RNA, 15 nt, Homo sapiens
agcauuuagacucuc

SEQ ID NO: 935094 - RNA, 22 nt, Homo sapiens
agccaaggccaaaggaagcaca

SEQ ID NO: 935095 - RNA, 14 nt, Homo sapiens
agccagggucucac

SEQ ID NO: 935096 - RNA, 20 nt, Homo sapiens
agccccuggaugcagccuca

SEQ ID NO: 935097 - RNA, 16 nt, Homo sapiens
agccuaggugacagag

SEQ ID NO: 935098 - RNA, 23 nt, Homo sapiens
agccugcaguuauuaacacuaac

SEQ ID NO: 935099 - RNA, 13 nt, Homo sapiens
agcgugagccacu

SEQ ID NO: 935100 - RNA, 22 nt, Homo sapiens
agcuaacauggaaguacuauaa

SEQ ID NO: 935101 - RNA, 14 nt, Homo sapiens
agcucuacugaggu

SEQ ID NO: 935102 - RNA, 19 nt, Homo sapiens
agcucugcuccucucccca

SEQ ID NO: 935103 - RNA, 15 nt, Homo sapiens
agcucuuuugagcau

SEQ ID NO: 935104 - RNA, 13 nt, Homo sapiens
agcugcacccuca

SEQ ID NO: 935105 - RNA, 23 nt, Homo sapiens
agcugggguggggaccucaggcc

SEQ ID NO: 935106 - RNA, 12 nt, Homo sapiens
agcuuaucucag

SEQ ID NO: 935107 - RNA, 20 nt, Homo sapiens
agcuugaccgugaggccaga

SEQ ID NO: 935108 - RNA, 19 nt, Homo sapiens
agcuuucugcuaucaaaga

SEQ ID NO: 935109 - RNA, 12 nt, Homo sapiens
agcuuuucccaa

SEQ ID NO: 935110 - RNA, 12 nt, Homo sapiens
aggaagcucagg

SEQ ID NO: 935111 - RNA, 21 nt, Homo sapiens
aggacacuagaagauuuugaa

SEQ ID NO: 935112 - RNA, 18 nt, Homo sapiens
aggacagggaggugaccc

SEQ ID NO: 935113 - RNA, 21 nt, Homo sapiens
aggauauaguuaucaaucucu

SEQ ID NO: 935114 - RNA, 23 nt, Homo sapiens
aggauauaguuaucaaucucuag

SEQ ID NO: 935115 - RNA, 21 nt, Homo sapiens
aggaucaaaguugaugaaaua

SEQ ID NO: 935116 - RNA, 22 nt, Homo sapiens
aggcauccaguaucuugaagac

SEQ ID NO: 935117 - RNA, 13 nt, Homo sapiens
aggcggugagcaa

SEQ ID NO: 935118 - RNA, 12 nt, Homo sapiens
aggcucucaggc

SEQ ID NO: 935119 - RNA, 13 nt, Homo sapiens
aggcuggucucaa

SEQ ID NO: 935120 - RNA, 15 nt, Homo sapiens
agggagaagaaagaa

SEQ ID NO: 935121 - RNA, 18 nt, Homo sapiens
aggggagaguaacccugu

SEQ ID NO: 935122 - RNA, 21 nt, Homo sapiens
aggggauagagagagaccacu

SEQ ID NO: 935123 - RNA, 13 nt, Homo sapiens
aggggcacagggu

SEQ ID NO: 935124 - RNA, 20 nt, Homo sapiens
aggguaucaggugcugccau

SEQ ID NO: 935125 - RNA, 19 nt, Homo sapiens
aggguugggcuggugucac

SEQ ID NO: 935126 - RNA, 18 nt, Homo sapiens
agguaaggaauaccuguc

SEQ ID NO: 935127 - RNA, 15 nt, Homo sapiens
agguacgaaaagagg

SEQ ID NO: 935128 - RNA, 20 nt, Homo sapiens
agguacgaaaagaggggaag

SEQ ID NO: 935129 - RNA, 20 nt, Homo sapiens
aggucauugguggcagagug

SEQ ID NO: 935130 - RNA, 17 nt, Homo sapiens
aggugaggaagcaaaag

SEQ ID NO: 935131 - RNA, 20 nt, Homo sapiens
aggugauccacccaccucag

SEQ ID NO: 935132 - RNA, 20 nt, Homo sapiens
aggugggaggauugcuugag

SEQ ID NO: 935133 - RNA, 14 nt, Homo sapiens
agguuggcaaaaag

SEQ ID NO: 935134 - RNA, 20 nt, Homo sapiens
aguaacccugucuaaugaaa

SEQ ID NO: 935135 - RNA, 23 nt, Homo sapiens
aguacacuguuucaaacuuuacu

SEQ ID NO: 935136 - RNA, 20 nt, Homo sapiens
aagacccuuguggucccacc

SEQ ID NO: 935137 - RNA, 22 nt, Homo sapiens
aagacugaguacguugugcauu

SEQ ID NO: 935138 - RNA, 19 nt, Homo sapiens
aagacuuuggaaagacuuu

SEQ ID NO: 935139 - RNA, 19 nt, Homo sapiens
aagagaaaaaauauuuucc

SEQ ID NO: 935140 - RNA, 15 nt, Homo sapiens
aagagaaaugagcug

SEQ ID NO: 935141 - RNA, 16 nt, Homo sapiens
aagagaaccauaucaa

SEQ ID NO: 935142 - RNA, 19 nt, Homo sapiens
aagaguaggaagacuuugg

SEQ ID NO: 935143 - RNA, 14 nt, Homo sapiens
aagauaaaugugcu

SEQ ID NO: 935144 - RNA, 22 nt, Homo sapiens
aagaugcuucucacugccaugc

SEQ ID NO: 935145 - RNA, 22 nt, Homo sapiens
aagcagugcaugcugucccuua

SEQ ID NO: 935146 - RNA, 20 nt, Homo sapiens
aagcauaaaaauuagccaag

SEQ ID NO: 935147 - RNA, 13 nt, Homo sapiens
aagcauucuucaa

SEQ ID NO: 935148 - RNA, 14 nt, Homo sapiens
aagcauuuacuuug

SEQ ID NO: 935149 - RNA, 18 nt, Homo sapiens
aagccagcaggcucucag

SEQ ID NO: 935150 - RNA, 23 nt, Homo sapiens
aagcucugcuccucuccccagca

SEQ ID NO: 935151 - RNA, 16 nt, Homo sapiens
aagcugggagaaccaa

SEQ ID NO: 935152 - RNA, 17 nt, Homo sapiens
aaggaaagaggcucugg

SEQ ID NO: 935153 - RNA, 18 nt, Homo sapiens
aaggacacuagaagauuu

SEQ ID NO: 935154 - RNA, 15 nt, Homo sapiens
aaggaugcccaaaga

SEQ ID NO: 935155 - RNA, 13 nt, Homo sapiens
aaggauggaccac

SEQ ID NO: 935156 - RNA, 18 nt, Homo sapiens
aaggggcccaaauucuuu

SEQ ID NO: 935157 - RNA, 12 nt, Homo sapiens
aagguaugcaau

SEQ ID NO: 935158 - RNA, 16 nt, Homo sapiens
aagguaugcaaucaaa

SEQ ID NO: 935159 - RNA, 15 nt, Homo sapiens
aaguaaggcaugguu

SEQ ID NO: 935160 - RNA, 12 nt, Homo sapiens
aagucacacagu

SEQ ID NO: 935161 - RNA, 22 nt, Homo sapiens
aagugagacccugucucaaaaa

SEQ ID NO: 935162 - RNA, 19 nt, Homo sapiens
aagugauccucccaccuca

SEQ ID NO: 935163 - RNA, 20 nt, Homo sapiens
aagugauccucccaccucag

SEQ ID NO: 935164 - RNA, 21 nt, Homo sapiens
aagugcugggauuacaggugu

SEQ ID NO: 935165 - RNA, 13 nt, Homo sapiens
aaguuugagauca

SEQ ID NO: 935166 - RNA, 12 nt, Homo sapiens
aauaaaacaaca

SEQ ID NO: 935167 - RNA, 12 nt, Homo sapiens
aauaacacugua

SEQ ID NO: 935168 - RNA, 13 nt, Homo sapiens
aauaacacuguac

SEQ ID NO: 935169 - RNA, 23 nt, Homo sapiens
aauaacuaaaagguaugcaauca

SEQ ID NO: 935170 - RNA, 20 nt, Homo sapiens
aauaauacaguaucucaggg

SEQ ID NO: 935171 - RNA, 18 nt, Homo sapiens
aauacagauauaagaaau

SEQ ID NO: 935172 - RNA, 19 nt, Homo sapiens
aaucauaaaacuugaugug

SEQ ID NO: 935173 - RNA, 16 nt, Homo sapiens
aauccagacccggcug

SEQ ID NO: 935174 - RNA, 19 nt, Homo sapiens
aauccagagagcagugugg

SEQ ID NO: 935175 - RNA, 12 nt, Homo sapiens
aaucucuaguug

SEQ ID NO: 935176 - RNA, 16 nt, Homo sapiens
aaucucuugcacucaa

SEQ ID NO: 935177 - RNA, 20 nt, Homo sapiens
aaugacuuaagcacacuuga

SEQ ID NO: 935178 - RNA, 15 nt, Homo sapiens
aaugagccuggcaag

SEQ ID NO: 935179 - RNA, 21 nt, Homo sapiens
aaugagcugcacuccaugagu

SEQ ID NO: 935180 - RNA, 19 nt, Homo sapiens
aaugaugauccuaggcauu

SEQ ID NO: 935181 - RNA, 13 nt, Homo sapiens
aaugcaccuggaa

SEQ ID NO: 935182 - RNA, 13 nt, Homo sapiens
aauggaagacagc

SEQ ID NO: 935183 - RNA, 22 nt, Homo sapiens
aaugguuuucuuguguguuuau

SEQ ID NO: 935184 - RNA, 17 nt, Homo sapiens
aauucucauuugucaca

SEQ ID NO: 935185 - RNA, 18 nt, Homo sapiens
aauucucauuugucacac

SEQ ID NO: 935186 - RNA, 20 nt, Homo sapiens
aauucucauuugucacacac

SEQ ID NO: 935187 - RNA, 12 nt, Homo sapiens
aauucuucucca

SEQ ID NO: 935188 - RNA, 15 nt, Homo sapiens
aauucuuucaguggc

SEQ ID NO: 935189 - RNA, 13 nt, Homo sapiens
aauugacaggauu

SEQ ID NO: 935190 - RNA, 19 nt, Homo sapiens
aauuuagaaauauaauuga

SEQ ID NO: 935191 - RNA, 18 nt, Homo sapiens
aauuuucacagccaugau

SEQ ID NO: 935192 - RNA, 21 nt, Homo sapiens
acaacaaaccuguuucugcag

SEQ ID NO: 935193 - RNA, 20 nt, Homo sapiens
acacagcucuucuccaggcu

SEQ ID NO: 935194 - RNA, 21 nt, Homo sapiens
acacagcucuucuccaggcug

SEQ ID NO: 935195 - RNA, 15 nt, Homo sapiens
acaccuugacagggc

SEQ ID NO: 935196 - RNA, 14 nt, Homo sapiens
acacgcgugcacac

SEQ ID NO: 935197 - RNA, 15 nt, Homo sapiens
acacuaaaaggugac

SEQ ID NO: 935198 - RNA, 15 nt, Homo sapiens
acacucuugguagaa

SEQ ID NO: 935199 - RNA, 16 nt, Homo sapiens
acacucuugguagaag

SEQ ID NO: 935200 - RNA, 19 nt, Homo sapiens
acacugcauguuugugauu

SEQ ID NO: 935201 - RNA, 20 nt, Homo sapiens
acacugcauguuugugauug

SEQ ID NO: 935202 - RNA, 14 nt, Homo sapiens
acacugcuugugaa

SEQ ID NO: 935203 - RNA, 17 nt, Homo sapiens
acacuguacugcaauaa

SEQ ID NO: 935204 - RNA, 19 nt, Homo sapiens
acacuugacaucaacugca

SEQ ID NO: 935205 - RNA, 13 nt, Homo sapiens
acagaaaauggaa

SEQ ID NO: 935206 - RNA, 12 nt, Homo sapiens
acagacaaagcg

SEQ ID NO: 935207 - RNA, 22 nt, Homo sapiens
acagacaaagcgugguggacau

SEQ ID NO: 935208 - RNA, 18 nt, Homo sapiens
acagacaacaaaccuguu

SEQ ID NO: 935209 - RNA, 19 nt, Homo sapiens
acagcugggguggggaccu

SEQ ID NO: 935210 - RNA, 23 nt, Homo sapiens
acaggaagguagaaauaucugaa

SEQ ID NO: 935211 - RNA, 20 nt, Homo sapiens
acaggaaguacuggagaaaa

SEQ ID NO: 935212 - RNA, 19 nt, Homo sapiens
acaggauuauuggaaauuu

SEQ ID NO: 935213 - RNA, 23 nt, Homo sapiens
acaggcaaugcuggcuguuggcu

SEQ ID NO: 935214 - RNA, 13 nt, Homo sapiens
acagggugagcac

SEQ ID NO: 935215 - RNA, 15 nt, Homo sapiens
acagggugagcacuc

SEQ ID NO: 935216 - RNA, 15 nt, Homo sapiens
acaggugugagucac

SEQ ID NO: 935217 - RNA, 15 nt, Homo sapiens
ugacuuaagcacacu

SEQ ID NO: 935218 - RNA, 23 nt, Homo sapiens
ugacuuaagcacacuugacauca

SEQ ID NO: 935219 - RNA, 15 nt, Homo sapiens
ugagaccaaccuggg

SEQ ID NO: 935220 - RNA, 19 nt, Homo sapiens
ugagcacaaagguagcuuu

SEQ ID NO: 935221 - RNA, 16 nt, Homo sapiens
ugaguacguugugcau

SEQ ID NO: 935222 - RNA, 17 nt, Homo sapiens
ugaguacguugugcauu

SEQ ID NO: 935223 - RNA, 14 nt, Homo sapiens
ugagucgaggacag

SEQ ID NO: 935224 - RNA, 15 nt, Homo sapiens
ugagugggugaauaa

SEQ ID NO: 935225 - RNA, 23 nt, Homo sapiens
ugauagugucccacggugccuug

SEQ ID NO: 935226 - RNA, 18 nt, Homo sapiens
gccaaaaaaugcuugcuu

SEQ ID NO: 935227 - RNA, 18 nt, Homo sapiens
gccaggcaugguggccca

SEQ ID NO: 935228 - RNA, 22 nt, Homo sapiens
gccaguaaaugggggugcauuu

SEQ ID NO: 935229 - RNA, 18 nt, Homo sapiens
gccaugaggaacaaggca

SEQ ID NO: 935230 - RNA, 16 nt, Homo sapiens
gcccacuucugccaua

SEQ ID NO: 935231 - RNA, 20 nt, Homo sapiens
gcccaggcuggcgugcagug

SEQ ID NO: 935232 - RNA, 15 nt, Homo sapiens
gcccccugguggaau

SEQ ID NO: 935233 - RNA, 20 nt, Homo sapiens
gcccuucuaccuuccugcaa

SEQ ID NO: 935234 - RNA, 21 nt, Homo sapiens
gccguacucuuuggggcagcu

SEQ ID NO: 935235 - RNA, 20 nt, Homo sapiens
gccgugauuuucauugcugg

SEQ ID NO: 935236 - RNA, 14 nt, Homo sapiens
gccucucucaggcc

SEQ ID NO: 935237 - RNA, 12 nt, Homo sapiens
gccugcccuccc

SEQ ID NO: 935238 - RNA, 22 nt, Homo sapiens
gccugggggcugggcagaggaa

SEQ ID NO: 935239 - RNA, 23 nt, Homo sapiens
gccuggggucugacaauaccucg

SEQ ID NO: 935240 - RNA, 20 nt, Homo sapiens
gcgagcccugguggcagugg

SEQ ID NO: 935241 - RNA, 14 nt, Homo sapiens
gcgcgguggcucac

SEQ ID NO: 935242 - RNA, 18 nt, Homo sapiens
gcucaccagccccagugc

SEQ ID NO: 935243 - RNA, 14 nt, Homo sapiens
gcucacugcagccu

SEQ ID NO: 935244 - RNA, 23 nt, Homo sapiens
gcugagggugagugggugaauaa

SEQ ID NO: 935245 - RNA, 17 nt, Homo sapiens
gcugauggugcaaugac

SEQ ID NO: 935246 - RNA, 14 nt, Homo sapiens
gcugggagaaccaa

SEQ ID NO: 935247 - RNA, 20 nt, Homo sapiens
gcugggcagaggaaagcaaa

SEQ ID NO: 935248 - RNA, 15 nt, Homo sapiens
gcugggcuucagugg

SEQ ID NO: 935249 - RNA, 19 nt, Homo sapiens
gcuguucacucucucgucu

SEQ ID NO: 935250 - RNA, 18 nt, Homo sapiens
gcuuaaaacaacacucac

SEQ ID NO: 935251 - RNA, 19 nt, Homo sapiens
gcuuccuccugguguggaa

SEQ ID NO: 935252 - RNA, 21 nt, Homo sapiens
gcuuccuccugguguggaaga

SEQ ID NO: 935253 - RNA, 11 nt, Homo sapiens
gcuucugccau

SEQ ID NO: 935254 - RNA, 19 nt, Homo sapiens
gcuugaccuuuaagagaaa

SEQ ID NO: 935255 - RNA, 15 nt, Homo sapiens
gcuugggcuucaucc

SEQ ID NO: 935256 - RNA, 20 nt, Homo sapiens
gcuuguaaauagcucaggug

SEQ ID NO: 935257 - RNA, 16 nt, Homo sapiens
gcuuucuacccagcga

SEQ ID NO: 935258 - RNA, 20 nt, Homo sapiens
ggaaaagcugcugacagugu

SEQ ID NO: 935259 - RNA, 22 nt, Homo sapiens
ggaaaauuuuaaaaauacagau

SEQ ID NO: 935260 - RNA, 16 nt, Homo sapiens
ggaaaggcuccaggag

SEQ ID NO: 935261 - RNA, 21 nt, Homo sapiens
ggaaauauuaagaaagacuau

SEQ ID NO: 935262 - RNA, 16 nt, Homo sapiens
ggaacacucugagacu

SEQ ID NO: 935263 - RNA, 15 nt, Homo sapiens
ggaagacaaugugaa

SEQ ID NO: 935264 - RNA, 21 nt, Homo sapiens
ggaagcuccgcuuucuaccca

SEQ ID NO: 935265 - RNA, 22 nt, Homo sapiens
ggaaggagaggagaggggcaca

SEQ ID NO: 935266 - RNA, 17 nt, Homo sapiens
ggaagggggcugggaca

SEQ ID NO: 935267 - RNA, 17 nt, Homo sapiens
ggaagguucuacgccag

SEQ ID NO: 935268 - RNA, 16 nt, Homo sapiens
ggaaugaaugucagug

SEQ ID NO: 935269 - RNA, 15 nt, Homo sapiens
ggacagggaggugac

SEQ ID NO: 935270 - RNA, 18 nt, Homo sapiens
ggacauugcggacagcca

SEQ ID NO: 935271 - RNA, 16 nt, Homo sapiens
ggaccagagcugccac

SEQ ID NO: 935272 - RNA, 18 nt, Homo sapiens
ggaggccauuuguguuua

SEQ ID NO: 935273 - RNA, 17 nt, Homo sapiens
ggagguacgaaaagagg

SEQ ID NO: 935274 - RNA, 13 nt, Homo sapiens
ggauguucuagca

SEQ ID NO: 935275 - RNA, 17 nt, Homo sapiens
ggauucuuauggacaau

SEQ ID NO: 935276 - RNA, 18 nt, Homo sapiens
ggcacucagaagacacug

SEQ ID NO: 935277 - RNA, 14 nt, Homo sapiens
ggcagggucucacu

SEQ ID NO: 935278 - RNA, 18 nt, Homo sapiens
ggcaugggaaugaauguc

SEQ ID NO: 935279 - RNA, 22 nt, Homo sapiens
ggcccagagggccugcaaggga

SEQ ID NO: 935280 - RNA, 16 nt, Homo sapiens
ggccuccugugugugc

SEQ ID NO: 935281 - RNA, 12 nt, Homo sapiens
ggcuaagugauc

SEQ ID NO: 935282 - RNA, 14 nt, Homo sapiens
ggcuggguggcacc

SEQ ID NO: 935283 - RNA, 22 nt, Homo sapiens
ggcugguuagagguucccuuug

SEQ ID NO: 935284 - RNA, 16 nt, Homo sapiens
ggcuucaguggcagcu

SEQ ID NO: 935285 - RNA, 16 nt, Homo sapiens
ggcuucauccuccuca

SEQ ID NO: 935286 - RNA, 17 nt, Homo sapiens
gggaccagagcugccac

SEQ ID NO: 935287 - RNA, 13 nt, Homo sapiens
gggaccucaggcc

SEQ ID NO: 935288 - RNA, 15 nt, Homo sapiens
gggagagccuuccag

SEQ ID NO: 935289 - RNA, 21 nt, Homo sapiens
gggcucccuucccaccucucu

SEQ ID NO: 935290 - RNA, 17 nt, Homo sapiens
gggggcuccagggggug

SEQ ID NO: 935291 - RNA, 13 nt, Homo sapiens
gggguaugggaga

SEQ ID NO: 935292 - RNA, 14 nt, Homo sapiens
ggguaucuggugac

SEQ ID NO: 935293 - RNA, 23 nt, Homo sapiens
gguaugaucacggcucacugcag

SEQ ID NO: 935294 - RNA, 13 nt, Homo sapiens
ggugaacagaaca

SEQ ID NO: 935295 - RNA, 12 nt, Homo sapiens
gguggacaugca

SEQ ID NO: 935296 - RNA, 13 nt, Homo sapiens
gguggaugccugg

SEQ ID NO: 935297 - RNA, 19 nt, Homo sapiens
gguuccuaauccucuagga

SEQ ID NO: 935298 - RNA, 16 nt, Homo sapiens
gguucuacccaggugc

SEQ ID NO: 935299 - RNA, 12 nt, Homo sapiens
gguuucauucug

SEQ ID NO: 935300 - RNA, 20 nt, Homo sapiens
guaaaugggggugcauuuga

SEQ ID NO: 935301 - RNA, 21 nt, Homo sapiens
guacauggaauaacauguaau

SEQ ID NO: 935302 - RNA, 17 nt, Homo sapiens
guacguugugcauuugg

SEQ ID NO: 935303 - RNA, 13 nt, Homo sapiens
guacuacaguccu

SEQ ID NO: 935304 - RNA, 18 nt, Homo sapiens
guacuacaguccucccau

SEQ ID NO: 935305 - RNA, 19 nt, Homo sapiens
guagcugggacuacaggca

SEQ ID NO: 935306 - RNA, 21 nt, Homo sapiens
guagcuuuucccaaacugauc

SEQ ID NO: 935307 - RNA, 14 nt, Homo sapiens
guaucaaugaguaa

SEQ ID NO: 935308 - RNA, 21 nt, Homo sapiens
guaugcucaauuauuuugcau

SEQ ID NO: 935309 - RNA, 20 nt, Homo sapiens
guauuuuguuuuugucuuaa

SEQ ID NO: 935310 - RNA, 15 nt, Homo sapiens
gucacucuggcagcu

SEQ ID NO: 935311 - RNA, 14 nt, Homo sapiens
gucacuuuccucuu

SEQ ID NO: 935312 - RNA, 19 nt, Homo sapiens
gucaggugccucaagagaa

SEQ ID NO: 935313 - RNA, 15 nt, Homo sapiens
gucccauugauguac

SEQ ID NO: 935314 - RNA, 21 nt, Homo sapiens
guccucccaucucacacauga

SEQ ID NO: 935315 - RNA, 17 nt, Homo sapiens
gucucacuauguugccc

SEQ ID NO: 935316 - RNA, 21 nt, Homo sapiens
gucucuuuaaugucacaggca

SEQ ID NO: 935317 - RNA, 16 nt, Homo sapiens
gucuggaaugcagugg

SEQ ID NO: 935318 - RNA, 15 nt, Homo sapiens
gucuuagauguauau

SEQ ID NO: 935319 - RNA, 15 nt, Homo sapiens
gugaaaggaaagagg

SEQ ID NO: 935320 - RNA, 17 nt, Homo sapiens
gugaacagaacaaaagg

SEQ ID NO: 935321 - RNA, 23 nt, Homo sapiens
gugaaccaccacacccagcccac

SEQ ID NO: 935322 - RNA, 19 nt, Homo sapiens
gugacaacacuuguguuau

SEQ ID NO: 935323 - RNA, 21 nt, Homo sapiens
gugaccucugccugaagucac

SEQ ID NO: 935324 - RNA, 15 nt, Homo sapiens
gugagcacaaaggua

SEQ ID NO: 935325 - RNA, 13 nt, Homo sapiens
gugauccacccac

SEQ ID NO: 935326 - RNA, 21 nt, Homo sapiens
gugaugaugaaaugaggucag

SEQ ID NO: 935327 - RNA, 22 nt, Homo sapiens
gugccucugggacuggacaauu

SEQ ID NO: 935328 - RNA, 19 nt, Homo sapiens
gugcugggauuacaggugu

SEQ ID NO: 935329 - RNA, 14 nt, Homo sapiens
gugggauccuccag

SEQ ID NO: 935330 - RNA, 21 nt, Homo sapiens
guggguuucuaaagcugccag

SEQ ID NO: 935331 - RNA, 18 nt, Homo sapiens
guggugaacagaacaaaa

SEQ ID NO: 935332 - RNA, 14 nt, Homo sapiens
gugucgggcaugac

SEQ ID NO: 935333 - RNA, 19 nt, Homo sapiens
gugugggggaagcaccaua

SEQ ID NO: 935334 - RNA, 18 nt, Homo sapiens
guuaagagaaaugagcuu

SEQ ID NO: 935335 - RNA, 23 nt, Homo sapiens
guucaucauccuaagcuauucag

SEQ ID NO: 935336 - RNA, 16 nt, Homo sapiens
guugaugaaauaucaa

SEQ ID NO: 935337 - RNA, 19 nt, Homo sapiens
guugauucagcucugcaag

SEQ ID NO: 935338 - RNA, 17 nt, Homo sapiens
guuuccuggcacugcuu

SEQ ID NO: 935339 - RNA, 13 nt, Homo sapiens
guuucuccaagca

SEQ ID NO: 935340 - RNA, 18 nt, Homo sapiens
guuugguucauggugaag

SEQ ID NO: 935341 - RNA, 22 nt, Homo sapiens
guuuuaagaggcagggucucac

SEQ ID NO: 935342 - RNA, 14 nt, Homo sapiens
guuuuacugcagcu

SEQ ID NO: 935343 - RNA, 19 nt, Homo sapiens
guuuuuaaaaaacugcuga

SEQ ID NO: 935344 - RNA, 20 nt, Homo sapiens
uaaaacaacacucacauuua

SEQ ID NO: 935345 - RNA, 16 nt, Homo sapiens
uaaaagguaugcaauc

SEQ ID NO: 935346 - RNA, 17 nt, Homo sapiens
uaaaugggggugcauuu

SEQ ID NO: 935347 - RNA, 16 nt, Homo sapiens
uaacaggaaaauuuua

SEQ ID NO: 935348 - RNA, 16 nt, Homo sapiens
uaacauggaaguacua

SEQ ID NO: 935349 - RNA, 21 nt, Homo sapiens
uaacauguaauuaaguacuau

SEQ ID NO: 935350 - RNA, 18 nt, Homo sapiens
uaaccagcagaaaugccu

SEQ ID NO: 935351 - RNA, 22 nt, Homo sapiens
ccugaagucuuuguacagacaa

SEQ ID NO: 935352 - RNA, 15 nt, Homo sapiens
ccugccaggaagcca

SEQ ID NO: 935353 - RNA, 16 nt, Homo sapiens
ccugcggugcuaucuc

SEQ ID NO: 935354 - RNA, 20 nt, Homo sapiens
ccuggcccacugcaucguuu

SEQ ID NO: 935355 - RNA, 16 nt, Homo sapiens
ccuggccccucagggu

SEQ ID NO: 935356 - RNA, 14 nt, Homo sapiens
ccugggcaauguga

SEQ ID NO: 935357 - RNA, 22 nt, Homo sapiens
ccugggugacagagcaagugag

SEQ ID NO: 935358 - RNA, 22 nt, Homo sapiens
ccuucagugccaaaaacaacaa

SEQ ID NO: 935359 - RNA, 17 nt, Homo sapiens
ccuuccaggggugggac

SEQ ID NO: 935360 - RNA, 22 nt, Homo sapiens
ccuucuuacuuaaccugaagcu

SEQ ID NO: 935361 - RNA, 19 nt, Homo sapiens
ccuuucaauaggaaaaacu

SEQ ID NO: 935362 - RNA, 16 nt, Homo sapiens
ccuuucaccacaugug

SEQ ID NO: 935363 - RNA, 16 nt, Homo sapiens
ccuuucccaucuucca

SEQ ID NO: 935364 - RNA, 19 nt, Homo sapiens
cgaggacagggaggugacc

SEQ ID NO: 935365 - RNA, 11 nt, Homo sapiens
cgaguuacaga

SEQ ID NO: 935366 - RNA, 18 nt, Homo sapiens
cgaucuggguucacugca

SEQ ID NO: 935367 - RNA, 21 nt, Homo sapiens
cgcaaccaccaccaaccacug

SEQ ID NO: 935368 - RNA, 20 nt, Homo sapiens
cggaaugaaccacaucuugc

SEQ ID NO: 935369 - RNA, 23 nt, Homo sapiens
cggagacggagucccaccuuggc

SEQ ID NO: 935370 - RNA, 22 nt, Homo sapiens
cgggaggauguucugggacaca

SEQ ID NO: 935371 - RNA, 14 nt, Homo sapiens
cguguuaugacucc

SEQ ID NO: 935372 - RNA, 14 nt, Homo sapiens
cguugugcauuugg

SEQ ID NO: 935373 - RNA, 21 nt, Homo sapiens
cuaaaugaaaaucgugacaac

SEQ ID NO: 935374 - RNA, 14 nt, Homo sapiens
cuaaggugugcucu

SEQ ID NO: 935375 - RNA, 15 nt, Homo sapiens
cuaaugaaaccugug

SEQ ID NO: 935376 - RNA, 14 nt, Homo sapiens
cuacagaggccaug

SEQ ID NO: 935377 - RNA, 16 nt, Homo sapiens
augggacucaaugcac

SEQ ID NO: 935378 - RNA, 22 nt, Homo sapiens
auguccaagaagcccaggaaag

SEQ ID NO: 935379 - RNA, 13 nt, Homo sapiens
auguguguucaug

SEQ ID NO: 935380 - RNA, 16 nt, Homo sapiens
auguucugggacacag

SEQ ID NO: 935381 - RNA, 14 nt, Homo sapiens
auguugcccaggca

SEQ ID NO: 935382 - RNA, 16 nt, Homo sapiens
auuaaccacuucagcu

SEQ ID NO: 935383 - RNA, 21 nt, Homo sapiens
auuaacuuuuauaaacuuuac

SEQ ID NO: 935384 - RNA, 18 nt, Homo sapiens
auuagcauuuugcuaaau

SEQ ID NO: 935385 - RNA, 17 nt, Homo sapiens
auuagccaaguguggua

SEQ ID NO: 935386 - RNA, 23 nt, Homo sapiens
auucaacagguuuuccugaagaa

SEQ ID NO: 935387 - RNA, 22 nt, Homo sapiens
auucauauuuacuucuuauaca

SEQ ID NO: 935388 - RNA, 13 nt, Homo sapiens
auucaugcugcuu

SEQ ID NO: 935389 - RNA, 16 nt, Homo sapiens
auuccccacccugaaa

SEQ ID NO: 935390 - RNA, 18 nt, Homo sapiens
auuccuguucccaugaga

SEQ ID NO: 935391 - RNA, 14 nt, Homo sapiens
auuguuagucucuu

SEQ ID NO: 935392 - RNA, 14 nt, Homo sapiens
auuguuuucagugu

SEQ ID NO: 935393 - RNA, 20 nt, Homo sapiens
auuuacauacucugcuuaga

SEQ ID NO: 935394 - RNA, 13 nt, Homo sapiens
auuuauucugcuc

SEQ ID NO: 935395 - RNA, 16 nt, Homo sapiens
auuuuuagacagaguc

SEQ ID NO: 935396 - RNA, 15 nt, Homo sapiens
auuuuuuugagacag

SEQ ID NO: 935397 - RNA, 16 nt, Homo sapiens
caaaaaaagaaaaaga

SEQ ID NO: 935398 - RNA, 21 nt, Homo sapiens
caaaaaagcgaaccgugagga

SEQ ID NO: 935399 - RNA, 17 nt, Homo sapiens
caaaaagaggcuaugug

SEQ ID NO: 935400 - RNA, 23 nt, Homo sapiens
caaagacugaguacguugugcau

SEQ ID NO: 935401 - RNA, 13 nt, Homo sapiens
caaagcagugcau

SEQ ID NO: 935402 - RNA, 21 nt, Homo sapiens
caaagcgugguggacaugcac

SEQ ID NO: 935403 - RNA, 14 nt, Homo sapiens
caaaggaagcacau

SEQ ID NO: 935404 - RNA, 21 nt, Homo sapiens
caaaucagcugcuacuacucc

SEQ ID NO: 935405 - RNA, 20 nt, Homo sapiens
caaccccuucgcuccugugu

SEQ ID NO: 935406 - RNA, 13 nt, Homo sapiens
caacugaccaguu

SEQ ID NO: 935407 - RNA, 19 nt, Homo sapiens
caacugcaucaagauguga

SEQ ID NO: 935408 - RNA, 16 nt, Homo sapiens
caagaccacguuucua

SEQ ID NO: 935409 - RNA, 20 nt, Homo sapiens
caagacgcugugcugcccug

SEQ ID NO: 935410 - RNA, 17 nt, Homo sapiens
caagagagacagcacag

SEQ ID NO: 935411 - RNA, 14 nt, Homo sapiens
caagaugugacaug

SEQ ID NO: 935412 - RNA, 11 nt, Homo sapiens
caagcucugcu

SEQ ID NO: 935413 - RNA, 16 nt, Homo sapiens
caaggauccugagcca

SEQ ID NO: 935414 - RNA, 16 nt, Homo sapiens
caaggcaaggcuguca

SEQ ID NO: 935415 - RNA, 18 nt, Homo sapiens
caagucaagugaaaaagg

SEQ ID NO: 935416 - RNA, 18 nt, Homo sapiens
caagucagcacuaccucc

SEQ ID NO: 935417 - RNA, 13 nt, Homo sapiens
cacacugcuugug

SEQ ID NO: 935418 - RNA, 17 nt, Homo sapiens
cacacuugggagcaaaa

SEQ ID NO: 935419 - RNA, 18 nt, Homo sapiens
cacacuugggagcaaaag

SEQ ID NO: 935420 - RNA, 20 nt, Homo sapiens
cacagaaaauggaagacagc

SEQ ID NO: 935421 - RNA, 16 nt, Homo sapiens
cacagacccugcccug

SEQ ID NO: 935422 - RNA, 13 nt, Homo sapiens
cacagaggcugcc

SEQ ID NO: 935423 - RNA, 14 nt, Homo sapiens
cacaucuugcucug

SEQ ID NO: 935424 - RNA, 19 nt, Homo sapiens
cacauguccaagaagccca

SEQ ID NO: 935425 - RNA, 14 nt, Homo sapiens
cacaugugcacaug

SEQ ID NO: 935426 - RNA, 17 nt, Homo sapiens
cacaugugcacaugcac

SEQ ID NO: 935427 - RNA, 14 nt, Homo sapiens
caccaagcccaguu

SEQ ID NO: 935428 - RNA, 14 nt, Homo sapiens
caccacaugugcac

SEQ ID NO: 935429 - RNA, 13 nt, Homo sapiens
caccagcagccug

SEQ ID NO: 935430 - RNA, 12 nt, Homo sapiens
caccccacugug

SEQ ID NO: 935431 - RNA, 22 nt, Homo sapiens
cacccuccuuucaccacaugug

SEQ ID NO: 935432 - RNA, 17 nt, Homo sapiens
cacgcuggagugcagug

SEQ ID NO: 935433 - RNA, 22 nt, Homo sapiens
cacggacgacgcgagggcccca

SEQ ID NO: 935434 - RNA, 16 nt, Homo sapiens
cacuaaggugugcucu

SEQ ID NO: 935435 - RNA, 18 nt, Homo sapiens
cacuaauggggcggugag

SEQ ID NO: 935436 - RNA, 17 nt, Homo sapiens
cacucuggcagcucaga

SEQ ID NO: 935437 - RNA, 18 nt, Homo sapiens
cacugaugggcaaccccc

SEQ ID NO: 935438 - RNA, 22 nt, Homo sapiens
cacugugcugagucugaaggcu

SEQ ID NO: 935439 - RNA, 16 nt, Homo sapiens
cacuucccuacaugga

SEQ ID NO: 935440 - RNA, 18 nt, Homo sapiens
cacuugggagcaaaagau

SEQ ID NO: 935441 - RNA, 17 nt, Homo sapiens
cagaaucucaaauaacu

SEQ ID NO: 935442 - RNA, 20 nt, Homo sapiens
cagaauucucagaaucucaa

SEQ ID NO: 935443 - RNA, 20 nt, Homo sapiens
cagagaauucucuuauccaa

SEQ ID NO: 935444 - RNA, 16 nt, Homo sapiens
cagaguugaagacaga

SEQ ID NO: 935445 - RNA, 16 nt, Homo sapiens
cagccaugauucuuuu

SEQ ID NO: 935446 - RNA, 15 nt, Homo sapiens
cagccugcuccagcu

SEQ ID NO: 935447 - RNA, 18 nt, Homo sapiens
cagccugggcaaugugau

SEQ ID NO: 935448 - RNA, 12 nt, Homo sapiens
cagcuaacaugg

SEQ ID NO: 935449 - RNA, 19 nt, Homo sapiens
cagcuaacauggaaguacu

SEQ ID NO: 935450 - RNA, 17 nt, Homo sapiens
cagcucuguccugggag

SEQ ID NO: 935451 - RNA, 21 nt, Homo sapiens
cagcugcuugggcuucauccu

SEQ ID NO: 935452 - RNA, 22 nt, Homo sapiens
cagcuuguaaauagcucaggug

SEQ ID NO: 935453 - RNA, 13 nt, Homo sapiens
caggaagcucagg

SEQ ID NO: 935454 - RNA, 14 nt, Homo sapiens
caggccccugccac

SEQ ID NO: 935455 - RNA, 18 nt, Homo sapiens
caggcccggcuccaggcu

SEQ ID NO: 935456 - RNA, 21 nt, Homo sapiens
caggcucucaggccagcugcu

SEQ ID NO: 935457 - RNA, 20 nt, Homo sapiens
caggguuuugccauguuggc

SEQ ID NO: 935458 - RNA, 21 nt, Homo sapiens
caggugauccacccaccucag

SEQ ID NO: 935459 - RNA, 19 nt, Homo sapiens
cagugccaaaaacaacaac

SEQ ID NO: 935460 - RNA, 14 nt, Homo sapiens
caguggcuaccuac

SEQ ID NO: 935461 - RNA, 16 nt, Homo sapiens
cagugguuggcaauug

SEQ ID NO: 935462 - RNA, 13 nt, Homo sapiens
caguguacaugga

SEQ ID NO: 935463 - RNA, 18 nt, Homo sapiens
cauaaugacuuaagcaca

SEQ ID NO: 935464 - RNA, 15 nt, Homo sapiens
cauaaugcgugcaua

SEQ ID NO: 935465 - RNA, 16 nt, Homo sapiens
cauaauuguucuuagu

SEQ ID NO: 935466 - RNA, 13 nt, Homo sapiens
cauacaauuccaa

SEQ ID NO: 935467 - RNA, 22 nt, Homo sapiens
cauacacacacacgcgugcaca

SEQ ID NO: 935468 - RNA, 15 nt, Homo sapiens
cauacccuguuacca

SEQ ID NO: 935469 - RNA, 17 nt, Homo sapiens
cauacucugcuuagaau

SEQ ID NO: 935470 - RNA, 13 nt, Homo sapiens
cauauuuacuucu

SEQ ID NO: 935471 - RNA, 17 nt, Homo sapiens
caucacuucccuacaug

SEQ ID NO: 935472 - RNA, 16 nt, Homo sapiens
cauccaguaucuugaa

SEQ ID NO: 935473 - RNA, 13 nt, Homo sapiens
caucuaugugaga

SEQ ID NO: 935474 - RNA, 19 nt, Homo sapiens
caugaaguaauaugcacac

SEQ ID NO: 935475 - RNA, 19 nt, Homo sapiens
caugcacagcuaacaugga

SEQ ID NO: 935476 - RNA, 16 nt, Homo sapiens
caugcuacacacugca

SEQ ID NO: 935477 - RNA, 22 nt, Homo sapiens
caugcuccuggcccacugcauc

SEQ ID NO: 935478 - RNA, 22 nt, Homo sapiens
cauggaaguacuauaauuuacc

SEQ ID NO: 935479 - RNA, 19 nt, Homo sapiens
cauggacaaggaugaucua

SEQ ID NO: 935480 - RNA, 12 nt, Homo sapiens
cauggugaaggu

SEQ ID NO: 935481 - RNA, 22 nt, Homo sapiens
caugugccagguuuuuggucug

SEQ ID NO: 935482 - RNA, 16 nt, Homo sapiens
cauguguguucaugca

SEQ ID NO: 935483 - RNA, 22 nt, Homo sapiens
cauguguguucaugcacacuug

SEQ ID NO: 935484 - RNA, 17 nt, Homo sapiens
cauguuuuucuucuccc

SEQ ID NO: 935485 - RNA, 17 nt, Homo sapiens
cauucugccugcccagg

SEQ ID NO: 935486 - RNA, 16 nt, Homo sapiens
cauuucugagaucaaa

SEQ ID NO: 935487 - RNA, 22 nt, Homo sapiens
cauuuuggauucuuauggacaa

SEQ ID NO: 935488 - RNA, 21 nt, Homo sapiens
cauuuuuaguagagacagggu

SEQ ID NO: 935489 - RNA, 20 nt, Homo sapiens
ccaaaaaaugcuugcuucaa

SEQ ID NO: 935490 - RNA, 15 nt, Homo sapiens
ccaaacucaccugcc

SEQ ID NO: 935491 - RNA, 18 nt, Homo sapiens
ccaaaggaagcacaugcc

SEQ ID NO: 935492 - RNA, 17 nt, Homo sapiens
cuguucucugcccucca

SEQ ID NO: 935493 - RNA, 14 nt, Homo sapiens
cuguucuuucuggc

SEQ ID NO: 935494 - RNA, 20 nt, Homo sapiens
cuuacacuuuaugcacaaaa

SEQ ID NO: 935495 - RNA, 11 nt, Homo sapiens
cuuaccugcca

SEQ ID NO: 935496 - RNA, 15 nt, Homo sapiens
cuuacuuaggugugg

SEQ ID NO: 935497 - RNA, 19 nt, Homo sapiens
cuuagaauuugggggaaaa

SEQ ID NO: 935498 - RNA, 15 nt, Homo sapiens
cuuagugugugcaau

SEQ ID NO: 935499 - RNA, 14 nt, Homo sapiens
cuuauacauuugau

SEQ ID NO: 935500 - RNA, 13 nt, Homo sapiens
cuuauauacagac

SEQ ID NO: 935501 - RNA, 16 nt, Homo sapiens
cuucaaccccaugaga

SEQ ID NO: 935502 - RNA, 20 nt, Homo sapiens
cuucagaucucuaacuucac

SEQ ID NO: 935503 - RNA, 17 nt, Homo sapiens
cuucuguccuacucugu

SEQ ID NO: 935504 - RNA, 19 nt, Homo sapiens
cuucuuccccccgcuguca

SEQ ID NO: 935505 - RNA, 16 nt, Homo sapiens
cuugaaugaugccaug

SEQ ID NO: 935506 - RNA, 21 nt, Homo sapiens
cuugagaauuacccuuuugcc

SEQ ID NO: 935507 - RNA, 22 nt, Homo sapiens
cuugagaggguggaauauccaa

SEQ ID NO: 935508 - RNA, 23 nt, Homo sapiens
cuugcaaaguaucccuacuguaa

SEQ ID NO: 935509 - RNA, 15 nt, Homo sapiens
cuugcacccaugugu

SEQ ID NO: 935510 - RNA, 19 nt, Homo sapiens
cuugcuucaaccccaugag

SEQ ID NO: 935511 - RNA, 20 nt, Homo sapiens
cuuggugucgggcaugacac

SEQ ID NO: 935512 - RNA, 23 nt, Homo sapiens
cuuguaaauagcucagguguccc

SEQ ID NO: 935513 - RNA, 15 nt, Homo sapiens
cuuguguuaugaagc

SEQ ID NO: 935514 - RNA, 20 nt, Homo sapiens
cuuuacuucauggacuucca

SEQ ID NO: 935515 - RNA, 18 nt, Homo sapiens
cuuucugcuaucaaagag

SEQ ID NO: 935516 - RNA, 19 nt, Homo sapiens
cuuucugcuaucaaagagg

SEQ ID NO: 935517 - RNA, 13 nt, Homo sapiens
cuuuggacacuca

SEQ ID NO: 935518 - RNA, 21 nt, Homo sapiens
cuuuguuuagcccaaaaccaa

SEQ ID NO: 935519 - RNA, 19 nt, Homo sapiens
cuuuucgcaggauucuucc

SEQ ID NO: 935520 - RNA, 21 nt, Homo sapiens
cuuuucuguccgagcuuugaa

SEQ ID NO: 935521 - RNA, 16 nt, Homo sapiens
cuuuugagugccuuac

SEQ ID NO: 935522 - RNA, 13 nt, Homo sapiens
cuuuugugcauua

SEQ ID NO: 935523 - RNA, 16 nt, Homo sapiens
gaaaaaauaacacugu

SEQ ID NO: 935524 - RNA, 17 nt, Homo sapiens
gaaaacacuguucucug

SEQ ID NO: 935525 - RNA, 21 nt, Homo sapiens
gaacacuaaugaggaaacugc

SEQ ID NO: 935526 - RNA, 23 nt, Homo sapiens
gaacacuaaugaggaaacugcac

SEQ ID NO: 935527 - RNA, 21 nt, Homo sapiens
gaacagguuuaaaaaucccca

SEQ ID NO: 935528 - RNA, 20 nt, Homo sapiens
gaacauguuuuucuucuccc

SEQ ID NO: 935529 - RNA, 17 nt, Homo sapiens
gaaccaaaaagaggcua

SEQ ID NO: 935530 - RNA, 13 nt, Homo sapiens
gaagaaaaaggau

SEQ ID NO: 935531 - RNA, 23 nt, Homo sapiens
gaagaaaauaguggugugauuug

SEQ ID NO: 935532 - RNA, 15 nt, Homo sapiens
gaagaacgaagccac

SEQ ID NO: 935533 - RNA, 22 nt, Homo sapiens
gaagacagcucuuauauugcca

SEQ ID NO: 935534 - RNA, 14 nt, Homo sapiens
gaagacuucauccc

SEQ ID NO: 935535 - RNA, 23 nt, Homo sapiens
gaagagccuugcggaagguucua

SEQ ID NO: 935536 - RNA, 15 nt, Homo sapiens
gaagcauuuacuuug

SEQ ID NO: 935537 - RNA, 19 nt, Homo sapiens
gaagugacaccaguucuuu

SEQ ID NO: 935538 - RNA, 18 nt, Homo sapiens
gaauauaacuuuuuccaa

SEQ ID NO: 935539 - RNA, 20 nt, Homo sapiens
gaaugaaugucagugugacu

SEQ ID NO: 935540 - RNA, 19 nt, Homo sapiens
gaaugcagagaugugcccc

SEQ ID NO: 935541 - RNA, 20 nt, Homo sapiens
gaauuauaauuaguuccuca

SEQ ID NO: 935542 - RNA, 21 nt, Homo sapiens
gaauuucccaaagcagugcau

SEQ ID NO: 935543 - RNA, 21 nt, Homo sapiens
gacacagcucuucuccaggcu

SEQ ID NO: 935544 - RNA, 21 nt, Homo sapiens
gacacucacacggacacucaa

SEQ ID NO: 935545 - RNA, 14 nt, Homo sapiens
gacagagucucacu

SEQ ID NO: 935546 - RNA, 19 nt, Homo sapiens
gacagagugagacucuguc

SEQ ID NO: 935547 - RNA, 19 nt, Homo sapiens
gacagucccugccaaugga

SEQ ID NO: 935548 - RNA, 16 nt, Homo sapiens
gacaucugucuaggaa

SEQ ID NO: 935549 - RNA, 16 nt, Homo sapiens
gacauuguuggccaaa

SEQ ID NO: 935550 - RNA, 14 nt, Homo sapiens
gaccagagcugcca

SEQ ID NO: 935551 - RNA, 19 nt, Homo sapiens
gaccaguuguugauaacca

SEQ ID NO: 935552 - RNA, 23 nt, Homo sapiens
gacccacggagcccuuaugacau

SEQ ID NO: 935553 - RNA, 15 nt, Homo sapiens
gaccgugugugaaau

SEQ ID NO: 935554 - RNA, 22 nt, Homo sapiens
gaccucaggugauccacccacc

SEQ ID NO: 935555 - RNA, 20 nt, Homo sapiens
gaccuucuccuucaccuuug

SEQ ID NO: 935556 - RNA, 19 nt, Homo sapiens
gaccuuuaagagaaaugag

SEQ ID NO: 935557 - RNA, 17 nt, Homo sapiens
gacguguuaugacucca

SEQ ID NO: 935558 - RNA, 12 nt, Homo sapiens
gacucaaugcac

SEQ ID NO: 935559 - RNA, 22 nt, Homo sapiens
gacuggccaagguuuggggaag

SEQ ID NO: 935560 - RNA, 20 nt, Homo sapiens
gacuuaagcacacuugacau

SEQ ID NO: 935561 - RNA, 9 nt, Homo sapiens
gacuuggaa

SEQ ID NO: 935562 - RNA, 23 nt, Homo sapiens
gagaaaaaauauuuuccugccag

SEQ ID NO: 935563 - RNA, 15 nt, Homo sapiens
gagaccaucccugaa

SEQ ID NO: 935564 - RNA, 13 nt, Homo sapiens
gagagccuuccag

SEQ ID NO: 935565 - RNA, 13 nt, Homo sapiens
gagcaggcuucuu

SEQ ID NO: 935566 - RNA, 18 nt, Homo sapiens
gagccagauuucacucuc

SEQ ID NO: 935567 - RNA, 23 nt, Homo sapiens
gagccuccugcccuuaccugcca

SEQ ID NO: 935568 - RNA, 16 nt, Homo sapiens
gaggaaacugcacugu

SEQ ID NO: 935569 - RNA, 18 nt, Homo sapiens
gaggacacuaaccacgcu

SEQ ID NO: 935570 - RNA, 22 nt, Homo sapiens
gaggcagccccauucugccugc

SEQ ID NO: 935571 - RNA, 20 nt, Homo sapiens
gaggcaggaggaucacuuga

SEQ ID NO: 935572 - RNA, 21 nt, Homo sapiens
gagggcacagaaaauggaaga

SEQ ID NO: 935573 - RNA, 13 nt, Homo sapiens
gagguacucuccu

SEQ ID NO: 935574 - RNA, 20 nt, Homo sapiens
gaggucaaggcugcagugag

SEQ ID NO: 935575 - RNA, 16 nt, Homo sapiens
gaguaggaagacuuug

SEQ ID NO: 935576 - RNA, 13 nt, Homo sapiens
gagugagcugguu

SEQ ID NO: 935577 - RNA, 16 nt, Homo sapiens
gaguucaucuugaauu

SEQ ID NO: 935578 - RNA, 14 nt, Homo sapiens
gaguugaagacaga

SEQ ID NO: 935579 - RNA, 23 nt, Homo sapiens
gauaaaauaaaaagaugaagcug

SEQ ID NO: 935580 - RNA, 19 nt, Homo sapiens
gauacaggaaaagcugcug

SEQ ID NO: 935581 - RNA, 15 nt, Homo sapiens
gauagauauaugcuc

SEQ ID NO: 935582 - RNA, 15 nt, Homo sapiens
gauagccaaggccaa

SEQ ID NO: 935583 - RNA, 13 nt, Homo sapiens
gauauaugcucug

SEQ ID NO: 935584 - RNA, 19 nt, Homo sapiens
gaucccccgccccauccuc

SEQ ID NO: 935585 - RNA, 14 nt, Homo sapiens
gauccuccaggugc

SEQ ID NO: 935586 - RNA, 17 nt, Homo sapiens
gaucuaggaagacuuug

SEQ ID NO: 935587 - RNA, 18 nt, Homo sapiens
gaucuaggaagacuuugg

SEQ ID NO: 935588 - RNA, 19 nt, Homo sapiens
gaugaccuugaaugaugcc

SEQ ID NO: 935589 - RNA, 21 nt, Homo sapiens
gaugaucuaggaagacuuugg

SEQ ID NO: 935590 - RNA, 21 nt, Homo sapiens
gauggccauguauuaccugaa

SEQ ID NO: 935591 - RNA, 23 nt, Homo sapiens
gauguacuuuaccugaaacaacc

SEQ ID NO: 935592 - RNA, 15 nt, Homo sapiens
gauguucugggacac

SEQ ID NO: 935593 - RNA, 15 nt, Homo sapiens
gauguuuccaaugcu

SEQ ID NO: 935594 - RNA, 21 nt, Homo sapiens
gauuauuggaaauuuguuaua

SEQ ID NO: 935595 - RNA, 21 nt, Homo sapiens
gauucauauuuacuucuuaua

SEQ ID NO: 935596 - RNA, 17 nt, Homo sapiens
gcaagugagacccuguc

SEQ ID NO: 935597 - RNA, 17 nt, Homo sapiens
gcaauacagacuacuuc

SEQ ID NO: 935598 - RNA, 17 nt, Homo sapiens
gcaauccugcaagaaca

SEQ ID NO: 935599 - RNA, 22 nt, Homo sapiens
gcacacugcuugugaaaggaaa

SEQ ID NO: 935600 - RNA, 18 nt, Homo sapiens
gcacagacccugcccugu

SEQ ID NO: 935601 - RNA, 17 nt, Homo sapiens
gcacagcuaacauggaa

SEQ ID NO: 935602 - RNA, 16 nt, Homo sapiens
gcacaugccucucuca

SEQ ID NO: 935603 - RNA, 20 nt, Homo sapiens
gcaccacugcacuccagccu

SEQ ID NO: 935604 - RNA, 13 nt, Homo sapiens
gcacuccaugagu

SEQ ID NO: 935605 - RNA, 19 nt, Homo sapiens
gcacugggcuuggggacca

SEQ ID NO: 935606 - RNA, 18 nt, Homo sapiens
gcagacaguuaagagaaa

SEQ ID NO: 935607 - RNA, 19 nt, Homo sapiens
gcagauacaggaaaagcug

SEQ ID NO: 935608 - RNA, 20 nt, Homo sapiens
gcagccucacaguccuuacc

SEQ ID NO: 935609 - RNA, 12 nt, Homo sapiens
gcaggaccucag

SEQ ID NO: 935610 - RNA, 13 nt, Homo sapiens
gcaggauucuucc

SEQ ID NO: 935611 - RNA, 23 nt, Homo sapiens
gcauaaagucagggguucccuuu

SEQ ID NO: 935612 - RNA, 18 nt, Homo sapiens
gcauccuggcacccggcc

SEQ ID NO: 935613 - RNA, 18 nt, Homo sapiens
gcaugaaguaauaugcac

SEQ ID NO: 935614 - RNA, 21 nt, Homo sapiens
gcaugacacgaauauugcuga

SEQ ID NO: 935615 - RNA, 15 nt, Homo sapiens
gcauguuugugauug

SEQ ID NO: 935616 - RNA, 13 nt, Homo sapiens
uacaggugugaac

SEQ ID NO: 935617 - RNA, 16 nt, Homo sapiens
uacaggugugagucac

SEQ ID NO: 935618 - RNA, 16 nt, Homo sapiens
uacaguaucucagggc

SEQ ID NO: 935619 - RNA, 17 nt, Homo sapiens
uacauaaugcgugcaua

SEQ ID NO: 935620 - RNA, 11 nt, Homo sapiens
uacauggaaua

SEQ ID NO: 935621 - RNA, 18 nt, Homo sapiens
uacuucuuauacauuuga

SEQ ID NO: 935622 - RNA, 17 nt, Homo sapiens
uacuuguggacacagcu

SEQ ID NO: 935623 - RNA, 14 nt, Homo sapiens
uagaaauuccccac

SEQ ID NO: 935624 - RNA, 17 nt, Homo sapiens
uagaagucuuagaugua

SEQ ID NO: 935625 - RNA, 21 nt, Homo sapiens
uagagacaggguuuugccaug

SEQ ID NO: 935626 - RNA, 23 nt, Homo sapiens
uagauuuuagacccuauugcugc

SEQ ID NO: 935627 - RNA, 16 nt, Homo sapiens
uagcacagacccugcc

SEQ ID NO: 935628 - RNA, 15 nt, Homo sapiens
uagcugggacuacag

SEQ ID NO: 935629 - RNA, 18 nt, Homo sapiens
uagcugggacuacaggug

SEQ ID NO: 935630 - RNA, 18 nt, Homo sapiens
uaggaggaacagguuuaa

SEQ ID NO: 935631 - RNA, 14 nt, Homo sapiens
uaggcauuugcuga

SEQ ID NO: 935632 - RNA, 21 nt, Homo sapiens
uaggcauuugcugaauacaga

SEQ ID NO: 935633 - RNA, 14 nt, Homo sapiens
uagggaaaaaccag

SEQ ID NO: 935634 - RNA, 17 nt, Homo sapiens
uagucucuugauucaua

SEQ ID NO: 935635 - RNA, 13 nt, Homo sapiens
uauaagccaaaaa

SEQ ID NO: 935636 - RNA, 11 nt, Homo sapiens
uauaugcucug

SEQ ID NO: 935637 - RNA, 15 nt, Homo sapiens
uaucagaauucucag

SEQ ID NO: 935638 - RNA, 16 nt, Homo sapiens
uaucuagauacuguau

SEQ ID NO: 935639 - RNA, 22 nt, Homo sapiens
uaugaggcauuuguuugaacug

SEQ ID NO: 935640 - RNA, 17 nt, Homo sapiens
uauggcuuuugugcauu

SEQ ID NO: 935641 - RNA, 14 nt, Homo sapiens
uaugugagcacaaa

SEQ ID NO: 935642 - RNA, 20 nt, Homo sapiens
uauguggaguucaucuugaa

SEQ ID NO: 935643 - RNA, 17 nt, Homo sapiens
uauuuaccagaccacaa

SEQ ID NO: 935644 - RNA, 21 nt, Homo sapiens
uauuuuuagacagagucucac

SEQ ID NO: 935645 - RNA, 22 nt, Homo sapiens
ucaaaagguuaauaaaguaauu

SEQ ID NO: 935646 - RNA, 12 nt, Homo sapiens
ucaaccccauga

SEQ ID NO: 935647 - RNA, 15 nt, Homo sapiens
ucaaccccaugagac

SEQ ID NO: 935648 - RNA, 21 nt, Homo sapiens
ucaaccuccugggcuaaguga

SEQ ID NO: 935649 - RNA, 13 nt, Homo sapiens
ucaagaugugaca

SEQ ID NO: 935650 - RNA, 21 nt, Homo sapiens
ucacaggcagguccaggguuu

SEQ ID NO: 935651 - RNA, 19 nt, Homo sapiens
ucaccaaaucagcugcuac

SEQ ID NO: 935652 - RNA, 16 nt, Homo sapiens
ucacugcuuaacuuca

SEQ ID NO: 935653 - RNA, 14 nt, Homo sapiens
ucacuggaacacua

SEQ ID NO: 935654 - RNA, 22 nt, Homo sapiens
ucagaagacacugaugggcaac

SEQ ID NO: 935655 - RNA, 19 nt, Homo sapiens
ucagacagcugccugggau

SEQ ID NO: 935656 - RNA, 19 nt, Homo sapiens
ucagcaaaagaugcuucuc

SEQ ID NO: 935657 - RNA, 22 nt, Homo sapiens
ucaggugucccugcacuugcag

SEQ ID NO: 935658 - RNA, 14 nt, Homo sapiens
ucaguguacaugga

SEQ ID NO: 935659 - RNA, 22 nt, Homo sapiens
ucauaguggcuuaaaacaacac

SEQ ID NO: 935660 - RNA, 20 nt, Homo sapiens
ucauggagggagaagaaaga

SEQ ID NO: 935661 - RNA, 17 nt, Homo sapiens
ucauuagcauuuugcua

SEQ ID NO: 935662 - RNA, 19 nt, Homo sapiens
uccaaaguacacuguuuca

SEQ ID NO: 935663 - RNA, 15 nt, Homo sapiens
uccaccugccaggga

SEQ ID NO: 935664 - RNA, 20 nt, Homo sapiens
uccaggggugggacacccug

SEQ ID NO: 935665 - RNA, 23 nt, Homo sapiens
uccaggggugggacacccuguga

SEQ ID NO: 935666 - RNA, 16 nt, Homo sapiens
uccaugauguuuucca

SEQ ID NO: 935667 - RNA, 20 nt, Homo sapiens
uccauguuugauguaucuga

SEQ ID NO: 935668 - RNA, 16 nt, Homo sapiens
ucccaaagcagugcau

SEQ ID NO: 935669 - RNA, 22 nt, Homo sapiens
ucccacuggaggcaugugauga

SEQ ID NO: 935670 - RNA, 17 nt, Homo sapiens
ucccccagcagccuggg

SEQ ID NO: 935671 - RNA, 13 nt, Homo sapiens
ucccucauccuca

SEQ ID NO: 935672 - RNA, 19 nt, Homo sapiens
ucccuuugacgccauccca

SEQ ID NO: 935673 - RNA, 18 nt, Homo sapiens
uccuacucugugucaggu

SEQ ID NO: 935674 - RNA, 21 nt, Homo sapiens
uccucauuagcauuuugcuaa

SEQ ID NO: 935675 - RNA, 16 nt, Homo sapiens
uccugggagugagcug

SEQ ID NO: 935676 - RNA, 22 nt, Homo sapiens
ucgcuccugugucuugcaaugg

SEQ ID NO: 935677 - RNA, 15 nt, Homo sapiens
ucgugacaacacuug

SEQ ID NO: 935678 - RNA, 23 nt, Homo sapiens
ucuaaugaaaccugugucucuga

SEQ ID NO: 935679 - RNA, 15 nt, Homo sapiens
ucuacccuggcacua

SEQ ID NO: 935680 - RNA, 16 nt, Homo sapiens
ucuacugaggugcuau

SEQ ID NO: 935681 - RNA, 16 nt, Homo sapiens
ucuagauacuguauca

SEQ ID NO: 935682 - RNA, 18 nt, Homo sapiens
ucuagcauggcugccaau

SEQ ID NO: 935683 - RNA, 16 nt, Homo sapiens
ucuagggaaaaaccag

SEQ ID NO: 935684 - RNA, 14 nt, Homo sapiens
ucuaugacacaugc

SEQ ID NO: 935685 - RNA, 15 nt, Homo sapiens
ucuaugacacaugca

SEQ ID NO: 935686 - RNA, 16 nt, Homo sapiens
ucuaugacacaugcaa

SEQ ID NO: 935687 - RNA, 18 nt, Homo sapiens
ucuaugggacucaaugca

SEQ ID NO: 935688 - RNA, 20 nt, Homo sapiens
ucucacuauguugcccaggc

SEQ ID NO: 935689 - RNA, 15 nt, Homo sapiens
ucucauuugucacac

SEQ ID NO: 935690 - RNA, 22 nt, Homo sapiens
ucuccauguuugauguaucuga

SEQ ID NO: 935691 - RNA, 13 nt, Homo sapiens
ucucucuucucca

SEQ ID NO: 935692 - RNA, 12 nt, Homo sapiens
ucucuugauuca

SEQ ID NO: 935693 - RNA, 23 nt, Homo sapiens
ucucuugauucauaaugacuuaa

SEQ ID NO: 935694 - RNA, 15 nt, Homo sapiens
ucugacccacugcuu

SEQ ID NO: 935695 - RNA, 19 nt, Homo sapiens
ucugcauguuacauaagau

SEQ ID NO: 935696 - RNA, 14 nt, Homo sapiens
ucugccucugacac

SEQ ID NO: 935697 - RNA, 16 nt, Homo sapiens
ucugccugaagucaca

SEQ ID NO: 935698 - RNA, 20 nt, Homo sapiens
ucugcucacauaucugucau

SEQ ID NO: 935699 - RNA, 23 nt, Homo sapiens
ucugcuuuuuaaagaaugcucuu

SEQ ID NO: 935700 - RNA, 21 nt, Homo sapiens
ucuggagauaaaauaaaaaga

SEQ ID NO: 935701 - RNA, 12 nt, Homo sapiens
ucuggcagcuca

SEQ ID NO: 935702 - RNA, 18 nt, Homo sapiens
ucuguacgucugacaggc

SEQ ID NO: 935703 - RNA, 17 nt, Homo sapiens
ucuguccuacucugugu

SEQ ID NO: 935704 - RNA, 16 nt, Homo sapiens
ucuuagaaaaaccacc

SEQ ID NO: 935705 - RNA, 14 nt, Homo sapiens
ucuuaguuugcagu

SEQ ID NO: 935706 - RNA, 23 nt, Homo sapiens
ucuuauauugccauuucuuccac

SEQ ID NO: 935707 - RNA, 23 nt, Homo sapiens
ucuuauuuaaugaaagacuguac

SEQ ID NO: 935708 - RNA, 14 nt, Homo sapiens
ucuucucuacucua

SEQ ID NO: 935709 - RNA, 17 nt, Homo sapiens
ucuuuaaugucacaggc

SEQ ID NO: 935710 - RNA, 22 nt, Homo sapiens
ucuuucagccaagaauucuuaa

SEQ ID NO: 935711 - RNA, 21 nt, Homo sapiens
ucuuucaguggcuaccuacau

SEQ ID NO: 935712 - RNA, 19 nt, Homo sapiens
ucuuuucuugcaugaggcu

SEQ ID NO: 935713 - RNA, 21 nt, Homo sapiens
ugaaaaaaaaaaacacaaaaa

SEQ ID NO: 935714 - RNA, 19 nt, Homo sapiens
ugaaaaaauaacacuguac

SEQ ID NO: 935715 - RNA, 22 nt, Homo sapiens
ugaaaauguauguguaaguauu

SEQ ID NO: 935716 - RNA, 22 nt, Homo sapiens
ugaaacgcaaccaccaccaacc

SEQ ID NO: 935717 - RNA, 23 nt, Homo sapiens
ugaaaggaaagaggcucuggcua

SEQ ID NO: 935718 - RNA, 13 nt, Homo sapiens
ugaacacucuugg

SEQ ID NO: 935719 - RNA, 15 nt, Homo sapiens
ugaacacucuuggua

SEQ ID NO: 935720 - RNA, 18 nt, Homo sapiens
ugaacucuucaaucucuu

SEQ ID NO: 935721 - RNA, 22 nt, Homo sapiens
ugaacuggguacuuguggacac

SEQ ID NO: 935722 - RNA, 14 nt, Homo sapiens
ugaagacaaugacu

SEQ ID NO: 935723 - RNA, 21 nt, Homo sapiens
ugaagcugggagaaccaaaaa

SEQ ID NO: 935724 - RNA, 15 nt, Homo sapiens
ugaagucacacagug

SEQ ID NO: 935725 - RNA, 13 nt, Homo sapiens
ugaauaauacagu

SEQ ID NO: 935726 - RNA, 20 nt, Homo sapiens
ugaauaauacaguaucucag

SEQ ID NO: 935727 - RNA, 17 nt, Homo sapiens
ugaauuguaaggaauga

SEQ ID NO: 935728 - RNA, 16 nt, Homo sapiens
ugaauuuuggcugugu

SEQ ID NO: 935729 - RNA, 14 nt, Homo sapiens
ugacauuguuggcc

SEQ ID NO: 935730 - RNA, 19 nt, Homo sapiens
ugaccuugaaugaugccau

SEQ ID NO: 935731 - RNA, 20 nt, Homo sapiens
cugugucuugcaauggcagc

SEQ ID NO: 935732 - RNA, 20 nt, Homo sapiens
cugugucuuuuuucacuaca

SEQ ID NO: 935733 - RNA, 13 nt, Homo sapiens
cugugugaugaug

SEQ ID NO: 935734 - RNA, 23 nt, Homo sapiens
cuuaaaccgccaaggcuggggga

SEQ ID NO: 935735 - RNA, 20 nt, Homo sapiens
cuuaaauauguggaguucau

SEQ ID NO: 935736 - RNA, 21 nt, Homo sapiens
cuuaagcacacuugacaucaa

SEQ ID NO: 935737 - RNA, 18 nt, Homo sapiens
cuuacacuuuaugcacaa

SEQ ID NO: 935738 - RNA, 15 nt, Homo sapiens
cuuaccugccaggaa

SEQ ID NO: 935739 - RNA, 15 nt, Homo sapiens
cuuacuuaaccugaa

SEQ ID NO: 935740 - RNA, 13 nt, Homo sapiens
cuuagacaguccc

SEQ ID NO: 935741 - RNA, 15 nt, Homo sapiens
cuuauacauuugaua

SEQ ID NO: 935742 - RNA, 16 nt, Homo sapiens
cuuauuuaaugaaaga

SEQ ID NO: 935743 - RNA, 15 nt, Homo sapiens
cuucaaauauuuccc

SEQ ID NO: 935744 - RNA, 21 nt, Homo sapiens
cuucagugccaaaaacaacaa

SEQ ID NO: 935745 - RNA, 11 nt, Homo sapiens
cuuccaaggau

SEQ ID NO: 935746 - RNA, 21 nt, Homo sapiens
cuuccaauuuacauacucugc

SEQ ID NO: 935747 - RNA, 15 nt, Homo sapiens
cuuccccccaaaacu

SEQ ID NO: 935748 - RNA, 15 nt, Homo sapiens
cuucccuacauggag

SEQ ID NO: 935749 - RNA, 17 nt, Homo sapiens
cuucuaccuuccugcaa

SEQ ID NO: 935750 - RNA, 10 nt, Homo sapiens
cuucugccau

SEQ ID NO: 935751 - RNA, 18 nt, Homo sapiens
cuugaccgugaggccaga

SEQ ID NO: 935752 - RNA, 13 nt, Homo sapiens
cuugggagcaaaa

SEQ ID NO: 935753 - RNA, 21 nt, Homo sapiens
cuuggggaccagagcugccac

SEQ ID NO: 935754 - RNA, 21 nt, Homo sapiens
cuuguacauaaugcgugcaua

SEQ ID NO: 935755 - RNA, 18 nt, Homo sapiens
gcuaggaacacuccuuca

SEQ ID NO: 935756 - RNA, 17 nt, Homo sapiens
gcucuuuugagcauuua

SEQ ID NO: 935757 - RNA, 14 nt, Homo sapiens
gcugcacuccauga

SEQ ID NO: 935758 - RNA, 16 nt, Homo sapiens
gcugggauuacaggug

SEQ ID NO: 935759 - RNA, 17 nt, Homo sapiens
gcugguugagguuucaa

SEQ ID NO: 935760 - RNA, 20 nt, Homo sapiens
gcuuaaaggggcuagaguga

SEQ ID NO: 935761 - RNA, 15 nt, Homo sapiens
gcuucaguggcagcu

SEQ ID NO: 935762 - RNA, 22 nt, Homo sapiens
gcuucucacugccaugccagcu

SEQ ID NO: 935763 - RNA, 16 nt, Homo sapiens
gcuugggcuucauccu

SEQ ID NO: 935764 - RNA, 20 nt, Homo sapiens
ggaaacagcuaaugggacac

SEQ ID NO: 935765 - RNA, 10 nt, Homo sapiens
ggaagagcuc

SEQ ID NO: 935766 - RNA, 23 nt, Homo sapiens
ggaagcacaugccucucucaggc

SEQ ID NO: 935767 - RNA, 22 nt, Homo sapiens
ggaagccucccacgacugcccg

SEQ ID NO: 935768 - RNA, 17 nt, Homo sapiens
ggaauccagacccggcu

SEQ ID NO: 935769 - RNA, 20 nt, Homo sapiens
ggacaaggaugaucuaggaa

SEQ ID NO: 935770 - RNA, 17 nt, Homo sapiens
ggacuacaggcacccac

SEQ ID NO: 935771 - RNA, 15 nt, Homo sapiens
ggacuuggaagcucc

SEQ ID NO: 935772 - RNA, 19 nt, Homo sapiens
ggagcugccuguucagcuc

SEQ ID NO: 935773 - RNA, 16 nt, Homo sapiens
ggagggagaagaaaga

SEQ ID NO: 935774 - RNA, 22 nt, Homo sapiens
ggagugggcccaaugcacuuug

SEQ ID NO: 935775 - RNA, 20 nt, Homo sapiens
ggaucaaaguugaugaaaua

SEQ ID NO: 935776 - RNA, 24 nt, Homo sapiens
ggauccuccaggugcacaagcucc

SEQ ID NO: 935777 - RNA, 20 nt, Homo sapiens
ggaugaaaaaauaacacugu

SEQ ID NO: 935778 - RNA, 22 nt, Homo sapiens
ggaugaaaaaauaacacuguac

SEQ ID NO: 935779 - RNA, 23 nt, Homo sapiens
ggauguucuagcauggcugccaa

SEQ ID NO: 935780 - RNA, 14 nt, Homo sapiens
ggcaugguggccca

SEQ ID NO: 935781 - RNA, 18 nt, Homo sapiens
ggccagagggagugacag

SEQ ID NO: 935782 - RNA, 14 nt, Homo sapiens
ugggccuggcuccc

SEQ ID NO: 935783 - RNA, 19 nt, Homo sapiens
uggggaccagagcugccac

SEQ ID NO: 935784 - RNA, 16 nt, Homo sapiens
uggggagaaaguacuu

SEQ ID NO: 935785 - RNA, 20 nt, Homo sapiens
uggggcagcuugaggguugg

SEQ ID NO: 935786 - RNA, 22 nt, Homo sapiens
ugggggaucacagccucugaaa

SEQ ID NO: 935787 - RNA, 14 nt, Homo sapiens
ugggguaugggaga

SEQ ID NO: 935788 - RNA, 20 nt, Homo sapiens
ugggugaauaauacaguauc

SEQ ID NO: 935789 - RNA, 22 nt, Homo sapiens
uggucaccaaaucagcugcuac

SEQ ID NO: 935790 - RNA, 20 nt, Homo sapiens
ugguccauagagagcaagac

SEQ ID NO: 935791 - RNA, 20 nt, Homo sapiens
ugguuaucuaauauguaaca

SEQ ID NO: 935792 - RNA, 20 nt, Homo sapiens
uguaauuugugauacaaugc

SEQ ID NO: 935793 - RNA, 10 nt, Homo sapiens
uguagagugg

SEQ ID NO: 935794 - RNA, 18 nt, Homo sapiens
ugucucuuuaaugucaca

SEQ ID NO: 935795 - RNA, 15 nt, Homo sapiens
ugugaaccaccacac

SEQ ID NO: 935796 - RNA, 23 nt, Homo sapiens
ugugaaugaugauccuaggcauu

SEQ ID NO: 935797 - RNA, 13 nt, Homo sapiens
ugugacugaucuc

SEQ ID NO: 935798 - RNA, 13 nt, Homo sapiens
ugugauaaaaccc

SEQ ID NO: 935799 - RNA, 20 nt, Homo sapiens
ugugauugacgggacuguug

SEQ ID NO: 935800 - RNA, 23 nt, Homo sapiens
ugugcauuaucuagauacuguau

SEQ ID NO: 935801 - RNA, 14 nt, Homo sapiens
ugugccaugugcca

SEQ ID NO: 935802 - RNA, 13 nt, Homo sapiens
uguggacacagcu

SEQ ID NO: 935803 - RNA, 12 nt, Homo sapiens
ugugucagcaua

SEQ ID NO: 935804 - RNA, 21 nt, Homo sapiens
ugugugcacguacacacacau

SEQ ID NO: 935805 - RNA, 15 nt, Homo sapiens
uguguucaugcacac

SEQ ID NO: 935806 - RNA, 20 nt, Homo sapiens
uguguucaugcacacuugca

SEQ ID NO: 935807 - RNA, 17 nt, Homo sapiens
uguucagcuccagcuca

SEQ ID NO: 935808 - RNA, 20 nt, Homo sapiens
uguuccugaaccgaugagaa

SEQ ID NO: 935809 - RNA, 16 nt, Homo sapiens
uguucucugaggacac

SEQ ID NO: 935810 - RNA, 16 nt, Homo sapiens
uguucugggacacagu

SEQ ID NO: 935811 - RNA, 20 nt, Homo sapiens
uguuucugcagccacuauug

SEQ ID NO: 935812 - RNA, 12 nt, Homo sapiens
uguuugugauug

SEQ ID NO: 935813 - RNA, 12 nt, Homo sapiens
uguuuuccauga

SEQ ID NO: 935814 - RNA, 24 nt, Homo sapiens
uuaaaucagccguguaaccaugga

SEQ ID NO: 935815 - RNA, 20 nt, Homo sapiens
uuaagcacacuugacaucaa

SEQ ID NO: 935816 - RNA, 17 nt, Homo sapiens
ccaaagugcugggauua

SEQ ID NO: 935817 - RNA, 18 nt, Homo sapiens
ccaacgucugugccauuu

SEQ ID NO: 935818 - RNA, 18 nt, Homo sapiens
ccaaggauggaccacaca

SEQ ID NO: 935819 - RNA, 16 nt, Homo sapiens
ccaauauuuaccagac

SEQ ID NO: 935820 - RNA, 21 nt, Homo sapiens
ccaauauuuaccagaccacaa

SEQ ID NO: 935821 - RNA, 14 nt, Homo sapiens
ccaaugauggucac

SEQ ID NO: 935822 - RNA, 11 nt, Homo sapiens
ccaaugcuuug

SEQ ID NO: 935823 - RNA, 14 nt, Homo sapiens
ccaauuuacauacu

SEQ ID NO: 935824 - RNA, 22 nt, Homo sapiens
ccacaagacccuugugguccca

SEQ ID NO: 935825 - RNA, 13 nt, Homo sapiens
ccacagggugagc

SEQ ID NO: 935826 - RNA, 20 nt, Homo sapiens
aaaaacaacugaccaguugu

SEQ ID NO: 935827 - RNA, 16 nt, Homo sapiens
aaaaaggaugcacaga

SEQ ID NO: 935828 - RNA, 15 nt, Homo sapiens
aaaaauaacacugua

SEQ ID NO: 935829 - RNA, 22 nt, Homo sapiens
aaaaaugcuugcuucaacccca

SEQ ID NO: 935830 - RNA, 24 nt, Homo sapiens
aaaaccaauguucucucuucucca

SEQ ID NO: 935831 - RNA, 23 nt, Homo sapiens
aaaaccccaucucuacaaaaagc

SEQ ID NO: 935832 - RNA, 18 nt, Homo sapiens
aaaacuuuucuaauacuc

SEQ ID NO: 935833 - RNA, 19 nt, Homo sapiens
aaaaucagccugcuccagc

SEQ ID NO: 935834 - RNA, 14 nt, Homo sapiens
aaaaugagguacuc

SEQ ID NO: 935835 - RNA, 21 nt, Homo sapiens
aaaauggacguguuaugacuc

SEQ ID NO: 935836 - RNA, 18 nt, Homo sapiens
aaacuacccucuggagau

SEQ ID NO: 935837 - RNA, 13 nt, Homo sapiens
aaacucaccugcc

SEQ ID NO: 935838 - RNA, 20 nt, Homo sapiens
aaacucuugaccucagguga

SEQ ID NO: 935839 - RNA, 19 nt, Homo sapiens
aaacugauuacaacugcua

SEQ ID NO: 935840 - RNA, 12 nt, Homo sapiens
aaacugcacugu

SEQ ID NO: 935841 - RNA, 16 nt, Homo sapiens
aaagaaugcucuuuac

SEQ ID NO: 935842 - RNA, 19 nt, Homo sapiens
aaagacuguacaaaguaga

SEQ ID NO: 935843 - RNA, 15 nt, Homo sapiens
aaagaggcuauguga

SEQ ID NO: 935844 - RNA, 17 nt, Homo sapiens
aaagaggcuaugugagc

SEQ ID NO: 935845 - RNA, 18 nt, Homo sapiens
aaagaugaagcugagaug

SEQ ID NO: 935846 - RNA, 17 nt, Homo sapiens
aaagauucuacaaagcu

SEQ ID NO: 935847 - RNA, 13 nt, Homo sapiens
aaagcagugcaug

SEQ ID NO: 935848 - RNA, 13 nt, Homo sapiens
aaagcugcugaca

SEQ ID NO: 935849 - RNA, 17 nt, Homo sapiens
aaagcugcugacagugu

SEQ ID NO: 935850 - RNA, 17 nt, Homo sapiens
aaauauguggaguucau

SEQ ID NO: 935851 - RNA, 15 nt, Homo sapiens
aaauauuucccucac

SEQ ID NO: 935852 - RNA, 21 nt, Homo sapiens
aaaucgugacaacacuugugu

SEQ ID NO: 935853 - RNA, 21 nt, Homo sapiens
aaaugucucuuuaaugucaca

SEQ ID NO: 935854 - RNA, 23 nt, Homo sapiens
aaauucuucuccacuuucuagcc

SEQ ID NO: 935855 - RNA, 20 nt, Homo sapiens
aacaucuuuuucuacucgag

SEQ ID NO: 935856 - RNA, 15 nt, Homo sapiens
aacccauuuuagaga

SEQ ID NO: 935857 - RNA, 18 nt, Homo sapiens
aaccuuuugagugccuua

SEQ ID NO: 935858 - RNA, 22 nt, Homo sapiens
aacgccuguaggaagaaaaagg

SEQ ID NO: 935859 - RNA, 20 nt, Homo sapiens
aacucaaacucuuaaaaccc

SEQ ID NO: 935860 - RNA, 22 nt, Homo sapiens
aacugcaucaagaugugacaug

SEQ ID NO: 935861 - RNA, 12 nt, Homo sapiens
aacuugggccac

SEQ ID NO: 935862 - RNA, 12 nt, Homo sapiens
aacuuuccuuca

SEQ ID NO: 935863 - RNA, 20 nt, Homo sapiens
aacuuuccuucauucaaccc

SEQ ID NO: 935864 - RNA, 12 nt, Homo sapiens
aagaaacuaccc

SEQ ID NO: 935865 - RNA, 14 nt, Homo sapiens
aagaaagacuaucu

SEQ ID NO: 935866 - RNA, 18 nt, Homo sapiens
aagaauguguuuaaacuu

SEQ ID NO: 935867 - RNA, 16 nt, Homo sapiens
aagacuuuucuuucag

SEQ ID NO: 935868 - RNA, 14 nt, Homo sapiens
aagagaaaugagcu

SEQ ID NO: 935869 - RNA, 14 nt, Homo sapiens
aagagucucuauua

SEQ ID NO: 935870 - RNA, 12 nt, Homo sapiens
aagaugaagcug

SEQ ID NO: 935871 - RNA, 21 nt, Homo sapiens
aagauucauauuuacuucuua

SEQ ID NO: 935872 - RNA, 17 nt, Homo sapiens
aagcaugugagacuggu

SEQ ID NO: 935873 - RNA, 17 nt, Homo sapiens
aagcgugagccacugca

SEQ ID NO: 935874 - RNA, 18 nt, Homo sapiens
aagcgugagccacugcac

SEQ ID NO: 935875 - RNA, 18 nt, Homo sapiens
aagcgugguggacaugca

SEQ ID NO: 935876 - RNA, 12 nt, Homo sapiens
aagcugggagaa

SEQ ID NO: 935877 - RNA, 21 nt, Homo sapiens
aagcugggagaaccaaaaaga

SEQ ID NO: 935878 - RNA, 17 nt, Homo sapiens
aaggaagacaaugugaa

SEQ ID NO: 935879 - RNA, 17 nt, Homo sapiens
aaggaagacuucauccc

SEQ ID NO: 935880 - RNA, 23 nt, Homo sapiens
aaggaugaucuaggaagacuuug

SEQ ID NO: 935881 - RNA, 20 nt, Homo sapiens
aaggcugucaauuacaggaa

SEQ ID NO: 935882 - RNA, 24 nt, Homo sapiens
aaggugugcucugaucauccacug

SEQ ID NO: 935883 - RNA, 19 nt, Homo sapiens
aagugagacccugucucaa

SEQ ID NO: 935884 - RNA, 23 nt, Homo sapiens
aaguuuuaugagaaaugccagug

SEQ ID NO: 935885 - RNA, 22 nt, Homo sapiens
aauaaauuuguaugcucaauua

SEQ ID NO: 935886 - RNA, 17 nt, Homo sapiens
aauaacacuguacugca

SEQ ID NO: 935887 - RNA, 18 nt, Homo sapiens
aauacaccacuacauucu

SEQ ID NO: 935888 - RNA, 20 nt, Homo sapiens
aauacagauagauauaugcu

SEQ ID NO: 935889 - RNA, 23 nt, Homo sapiens
aauacagauagauauaugcucug

SEQ ID NO: 935890 - RNA, 17 nt, Homo sapiens
aauacaguaucucaggg

SEQ ID NO: 935891 - RNA, 15 nt, Homo sapiens
aauauauaaccagug

SEQ ID NO: 935892 - RNA, 18 nt, Homo sapiens
aauaucaagagagguuaa

SEQ ID NO: 935893 - RNA, 16 nt, Homo sapiens
aaucauaaaacuugau

SEQ ID NO: 935894 - RNA, 17 nt, Homo sapiens
aauccagagagcagugu

SEQ ID NO: 935895 - RNA, 11 nt, Homo sapiens
agccagaggag

SEQ ID NO: 935896 - RNA, 13 nt, Homo sapiens
agcccaccccuca

SEQ ID NO: 935897 - RNA, 14 nt, Homo sapiens
agccccauccucug

SEQ ID NO: 935898 - RNA, 16 nt, Homo sapiens
agccucugaaaaccaa

SEQ ID NO: 935899 - RNA, 24 nt, Homo sapiens
agcgugcauaaguuaacuuccaau

SEQ ID NO: 935900 - RNA, 16 nt, Homo sapiens
agcgugugacuacucc

SEQ ID NO: 935901 - RNA, 12 nt, Homo sapiens
agcucagguguc

SEQ ID NO: 935902 - RNA, 17 nt, Homo sapiens
agcugcacuccaugagu

SEQ ID NO: 935903 - RNA, 17 nt, Homo sapiens
agcugggguggggaccu

SEQ ID NO: 935904 - RNA, 14 nt, Homo sapiens
agcuuaucucaggg

SEQ ID NO: 935905 - RNA, 17 nt, Homo sapiens
agcuuguaaauagcuca

SEQ ID NO: 935906 - RNA, 13 nt, Homo sapiens
aggaacacuccuu

SEQ ID NO: 935907 - RNA, 15 nt, Homo sapiens
aggaagacaauguga

SEQ ID NO: 935908 - RNA, 23 nt, Homo sapiens
aggaagcaaaagcaucuauguga

SEQ ID NO: 935909 - RNA, 15 nt, Homo sapiens
aggaagcacaugccu

SEQ ID NO: 935910 - RNA, 21 nt, Homo sapiens
aggaagguagaaauaucugaa

SEQ ID NO: 935911 - RNA, 14 nt, Homo sapiens
aggaauaccugucc

SEQ ID NO: 935912 - RNA, 20 nt, Homo sapiens
aggagagcuagcagcaggga

SEQ ID NO: 935913 - RNA, 18 nt, Homo sapiens
aggagaggggcacagggu

SEQ ID NO: 935914 - RNA, 21 nt, Homo sapiens
aggaguuugggguaugggaga

SEQ ID NO: 935915 - RNA, 17 nt, Homo sapiens
aggaugcuuguacauaa

SEQ ID NO: 935916 - RNA, 17 nt, Homo sapiens
aggauguucugggacac

SEQ ID NO: 935917 - RNA, 20 nt, Homo sapiens
aggcaggaggaucacuugag

SEQ ID NO: 935918 - RNA, 18 nt, Homo sapiens
aggccaaacucaccugcc

SEQ ID NO: 935919 - RNA, 16 nt, Homo sapiens
aggccauuuguguuua

SEQ ID NO: 935920 - RNA, 12 nt, Homo sapiens
aggcggugagca

SEQ ID NO: 935921 - RNA, 13 nt, Homo sapiens
aggcuaugugagc

SEQ ID NO: 935922 - RNA, 23 nt, Homo sapiens
aggggagcaaaaucgaugcagug

SEQ ID NO: 935923 - RNA, 23 nt, Homo sapiens
aggggcccaaauucuuucagugg

SEQ ID NO: 935924 - RNA, 16 nt, Homo sapiens
aggggcccaagagaga

SEQ ID NO: 935925 - RNA, 15 nt, Homo sapiens
agggggugcccuccc

SEQ ID NO: 935926 - RNA, 13 nt, Homo sapiens
aggggugggacac

SEQ ID NO: 935927 - RNA, 19 nt, Homo sapiens
agguagaaauaucugaaaa

SEQ ID NO: 935928 - RNA, 18 nt, Homo sapiens
agguaugcaaucaaaucu

SEQ ID NO: 935929 - RNA, 13 nt, Homo sapiens
aggugacagagug

SEQ ID NO: 935930 - RNA, 16 nt, Homo sapiens
aggugaggaagcaaaa

SEQ ID NO: 935931 - RNA, 20 nt, Homo sapiens
aggugggaggaucucuugag

SEQ ID NO: 935932 - RNA, 14 nt, Homo sapiens
agguggggcagcuu

SEQ ID NO: 935933 - RNA, 15 nt, Homo sapiens
agguggggucacucu

SEQ ID NO: 935934 - RNA, 22 nt, Homo sapiens
agguuuuuggucugacccacug

SEQ ID NO: 935935 - RNA, 17 nt, Homo sapiens
aguaauaugcacacauu

SEQ ID NO: 935936 - RNA, 21 nt, Homo sapiens
aguagagucacuggaacacua

SEQ ID NO: 935937 - RNA, 16 nt, Homo sapiens
agucccauugauguac

SEQ ID NO: 935938 - RNA, 23 nt, Homo sapiens
agucgaggacagggaggugaccc

SEQ ID NO: 935939 - RNA, 16 nt, Homo sapiens
agucucacuguugccc

SEQ ID NO: 935940 - RNA, 17 nt, Homo sapiens
agucugauucccaagcu

SEQ ID NO: 935941 - RNA, 18 nt, Homo sapiens
agugccaaaaacaacaac

SEQ ID NO: 935942 - RNA, 17 nt, Homo sapiens
agugcuuguuccucuca

SEQ ID NO: 935943 - RNA, 22 nt, Homo sapiens
agugcuuguuccucucaucucc

SEQ ID NO: 935944 - RNA, 18 nt, Homo sapiens
aguggcuaccuacauaca

SEQ ID NO: 935945 - RNA, 20 nt, Homo sapiens
aguggcuaccuacauacaau

SEQ ID NO: 935946 - RNA, 18 nt, Homo sapiens
agugggcccaaugcacuu

SEQ ID NO: 935947 - RNA, 13 nt, Homo sapiens
aguguacauggaa

SEQ ID NO: 935948 - RNA, 14 nt, Homo sapiens
aguuccaccaucaa

SEQ ID NO: 935949 - RNA, 15 nt, Homo sapiens
aguugauucagcucu

SEQ ID NO: 935950 - RNA, 22 nt, Homo sapiens
aguuuuuauggcuuuugugcau

SEQ ID NO: 935951 - RNA, 14 nt, Homo sapiens
auaaagcagcguuu

SEQ ID NO: 935952 - RNA, 21 nt, Homo sapiens
auaacacuguacugcaauaag

SEQ ID NO: 935953 - RNA, 20 nt, Homo sapiens
auaacuuuguuuagcccaaa

SEQ ID NO: 935954 - RNA, 17 nt, Homo sapiens
auaaugacuuaagcaca

SEQ ID NO: 935955 - RNA, 19 nt, Homo sapiens
auaauguuaacauggacau

SEQ ID NO: 935956 - RNA, 13 nt, Homo sapiens
auacaauuccaaa

SEQ ID NO: 935957 - RNA, 16 nt, Homo sapiens
auacagauagauauau

SEQ ID NO: 935958 - RNA, 21 nt, Homo sapiens
auacauaaacaagaccacguu

SEQ ID NO: 935959 - RNA, 13 nt, Homo sapiens
auacucaccucac

SEQ ID NO: 935960 - RNA, 18 nt, Homo sapiens
auacucaccucaccccac

SEQ ID NO: 935961 - RNA, 17 nt, Homo sapiens
auagccuaggugacaga

SEQ ID NO: 935962 - RNA, 14 nt, Homo sapiens
auauauaagccaaa

SEQ ID NO: 935963 - RNA, 21 nt, Homo sapiens
auauguuuuaagaggcagggu

SEQ ID NO: 935964 - RNA, 21 nt, Homo sapiens
auauuaagaaagacuaucuaa

SEQ ID NO: 935965 - RNA, 23 nt, Homo sapiens
aucaaaucugcuuuuuaaagaau

SEQ ID NO: 935966 - RNA, 18 nt, Homo sapiens
aucaacaucuuggucaga

SEQ ID NO: 935967 - RNA, 21 nt, Homo sapiens
aucaacugcaucaagauguga

SEQ ID NO: 935968 - RNA, 15 nt, Homo sapiens
aucaagaugugacau

SEQ ID NO: 935969 - RNA, 13 nt, Homo sapiens
aucaaucucuagu

SEQ ID NO: 935970 - RNA, 20 nt, Homo sapiens
aucacaagucagcacuaccu

SEQ ID NO: 935971 - RNA, 21 nt, Homo sapiens
aucacaagucagcacuaccuc

SEQ ID NO: 935972 - RNA, 15 nt, Homo sapiens
aucacgccacugcac

SEQ ID NO: 935973 - RNA, 17 nt, Homo sapiens
aucagccugcuccagcu

SEQ ID NO: 935974 - RNA, 14 nt, Homo sapiens
aucagcugcuacua

SEQ ID NO: 935975 - RNA, 14 nt, Homo sapiens
auccacccaccuca

SEQ ID NO: 935976 - RNA, 15 nt, Homo sapiens
auccacugugccaug

SEQ ID NO: 935977 - RNA, 15 nt, Homo sapiens
auccagacccggcug

SEQ ID NO: 935978 - RNA, 16 nt, Homo sapiens
aucccuuaccucggug

SEQ ID NO: 935979 - RNA, 15 nt, Homo sapiens
auccuaggcauuugc

SEQ ID NO: 935980 - RNA, 15 nt, Homo sapiens
auccucccaccucag

SEQ ID NO: 935981 - RNA, 15 nt, Homo sapiens
aucuagauacuguau

SEQ ID NO: 935982 - RNA, 20 nt, Homo sapiens
aucuccaaaauaaaacuuuu

SEQ ID NO: 935983 - RNA, 21 nt, Homo sapiens
aucuugaauuguaaggaauga

SEQ ID NO: 935984 - RNA, 18 nt, Homo sapiens
augaaaaaauaacacugu

SEQ ID NO: 935985 - RNA, 22 nt, Homo sapiens
augaaaugaggucagagccugc

SEQ ID NO: 935986 - RNA, 11 nt, Homo sapiens
augacacgaau

SEQ ID NO: 935987 - RNA, 20 nt, Homo sapiens
augaccuugaaugaugccau

SEQ ID NO: 935988 - RNA, 14 nt, Homo sapiens
augauagcuacugu

SEQ ID NO: 935989 - RNA, 14 nt, Homo sapiens
augaucacggcuca

SEQ ID NO: 935990 - RNA, 18 nt, Homo sapiens
augaucuaggaagacuuu

SEQ ID NO: 935991 - RNA, 20 nt, Homo sapiens
augaucuuugcagacaggca

SEQ ID NO: 935992 - RNA, 15 nt, Homo sapiens
augcagugcuuccaa

SEQ ID NO: 935993 - RNA, 17 nt, Homo sapiens
augccagcuuaucucag

SEQ ID NO: 935994 - RNA, 12 nt, Homo sapiens
augccagugugc

SEQ ID NO: 935995 - RNA, 20 nt, Homo sapiens
augccaugaggaacaaggca

SEQ ID NO: 935996 - RNA, 17 nt, Homo sapiens
augccugguggcagcug

SEQ ID NO: 935997 - RNA, 16 nt, Homo sapiens
augcucugcauguuac

SEQ ID NO: 935998 - RNA, 17 nt, Homo sapiens
augcucugcauguuaca

SEQ ID NO: 935999 - RNA, 16 nt, Homo sapiens
augcucuuuacuucau

SEQ ID NO: 936000 - RNA, 15 nt, Homo sapiens
augcuuguacauaau

SEQ ID NO: 936001 - RNA, 20 nt, Homo sapiens
auggacuuccacugccaucc

SEQ ID NO: 936002 - RNA, 15 nt, Homo sapiens
auggagggagaagaa

SEQ ID NO: 936003 - RNA, 23 nt, Homo sapiens
augggauggcuuggggggcucca

SEQ ID NO: 936004 - RNA, 15 nt, Homo sapiens
auguaagcucuacug

SEQ ID NO: 936005 - RNA, 18 nt, Homo sapiens
auguaucaaugaguaaca

SEQ ID NO: 936006 - RNA, 14 nt, Homo sapiens
augucaagccauaa

SEQ ID NO: 936007 - RNA, 16 nt, Homo sapiens
augucagugugacuga

SEQ ID NO: 936008 - RNA, 19 nt, Homo sapiens
augucucuuuaaugucaca

SEQ ID NO: 936009 - RNA, 20 nt, Homo sapiens
augugagaccauuuagcaca

SEQ ID NO: 936010 - RNA, 22 nt, Homo sapiens
augugcugaaugguuuucaaaa

SEQ ID NO: 936011 - RNA, 20 nt, Homo sapiens
auguucugggacacaguuca

SEQ ID NO: 936012 - RNA, 20 nt, Homo sapiens
auuaacuuuuauaaacuuua

SEQ ID NO: 936013 - RNA, 18 nt, Homo sapiens
auuaagaaagacuaucua

SEQ ID NO: 936014 - RNA, 14 nt, Homo sapiens
auuacuucugcuac

SEQ ID NO: 936015 - RNA, 18 nt, Homo sapiens
auuaucuagauacuguau

SEQ ID NO: 936016 - RNA, 21 nt, Homo sapiens
auucacuagguucgaauccag

SEQ ID NO: 936017 - RNA, 19 nt, Homo sapiens
auucauaaugacuuaagca

SEQ ID NO: 936018 - RNA, 22 nt, Homo sapiens
auucaugcugcuuagaugacau

SEQ ID NO: 936019 - RNA, 15 nt, Homo sapiens
cugggcuugucugua

SEQ ID NO: 936020 - RNA, 16 nt, Homo sapiens
cugggggccucagugc

SEQ ID NO: 936021 - RNA, 19 nt, Homo sapiens
cuggugaccagcaccaucu

SEQ ID NO: 936022 - RNA, 17 nt, Homo sapiens
cuguacaaaguagaagu

SEQ ID NO: 936023 - RNA, 23 nt, Homo sapiens
cuguacaaaguagaagucuuaga

SEQ ID NO: 936024 - RNA, 14 nt, Homo sapiens
cugucgcccagucu

SEQ ID NO: 936025 - RNA, 17 nt, Homo sapiens
cuguucagcugguugag

SEQ ID NO: 936026 - RNA, 14 nt, Homo sapiens
cuguucccaugaga

SEQ ID NO: 936027 - RNA, 16 nt, Homo sapiens
cuguuggccaguguga

SEQ ID NO: 936028 - RNA, 19 nt, Homo sapiens
cuguuggccagugugacaa

SEQ ID NO: 936029 - RNA, 19 nt, Homo sapiens
cuguuucugcagccacuau

SEQ ID NO: 936030 - RNA, 19 nt, Homo sapiens
cuuacuuaaccugaagcua

SEQ ID NO: 936031 - RNA, 14 nt, Homo sapiens
cuuagaaaaaccac

SEQ ID NO: 936032 - RNA, 17 nt, Homo sapiens
cuuagguuggcaaaaag

SEQ ID NO: 936033 - RNA, 15 nt, Homo sapiens
cuucauggacuucca

SEQ ID NO: 936034 - RNA, 22 nt, Homo sapiens
cuucuuccccccaaaacugauu

SEQ ID NO: 936035 - RNA, 18 nt, Homo sapiens
cuugaaaacacuguucuc

SEQ ID NO: 936036 - RNA, 14 nt, Homo sapiens
cuugacagggcaca

SEQ ID NO: 936037 - RNA, 20 nt, Homo sapiens
cuugaccucaggugauccac

SEQ ID NO: 936038 - RNA, 16 nt, Homo sapiens
cuugaggcaacucauc

SEQ ID NO: 936039 - RNA, 19 nt, Homo sapiens
cuugauucauaaugacuua

SEQ ID NO: 936040 - RNA, 16 nt, Homo sapiens
cuugccgucuaccuga

SEQ ID NO: 936041 - RNA, 18 nt, Homo sapiens
cuugucuuuggacccuga

SEQ ID NO: 936042 - RNA, 23 nt, Homo sapiens
cuuuccaggaaggcuaaagggaa

SEQ ID NO: 936043 - RNA, 23 nt, Homo sapiens
cuuucccucccuuccucuuucca

SEQ ID NO: 936044 - RNA, 17 nt, Homo sapiens
cuuuccuguagucccau

SEQ ID NO: 936045 - RNA, 19 nt, Homo sapiens
cuuuccuguagucccauug

SEQ ID NO: 936046 - RNA, 14 nt, Homo sapiens
cuuuccuucauuca

SEQ ID NO: 936047 - RNA, 15 nt, Homo sapiens
cuuuccuucauucaa

SEQ ID NO: 936048 - RNA, 14 nt, Homo sapiens
cuuucuacccagcg

SEQ ID NO: 936049 - RNA, 11 nt, Homo sapiens
cuuucuucccu

SEQ ID NO: 936050 - RNA, 12 nt, Homo sapiens
cuuugagugaag

SEQ ID NO: 936051 - RNA, 21 nt, Homo sapiens
cuuuguuuguugucagcugaa

SEQ ID NO: 936052 - RNA, 17 nt, Homo sapiens
cuuuucccaaacugauc

SEQ ID NO: 936053 - RNA, 21 nt, Homo sapiens
cuuuugagugccuuacacaau

SEQ ID NO: 936054 - RNA, 18 nt, Homo sapiens
cuuuuuaaagaaugcucu

SEQ ID NO: 936055 - RNA, 20 nt, Homo sapiens
cuuuuuaauauugauaugcu

SEQ ID NO: 936056 - RNA, 19 nt, Homo sapiens
gaaaaaccaccaccaucac

SEQ ID NO: 936057 - RNA, 15 nt, Homo sapiens
gaaaagcugcugaca

SEQ ID NO: 936058 - RNA, 19 nt, Homo sapiens
gaaaauaguggugugauuu

SEQ ID NO: 936059 - RNA, 17 nt, Homo sapiens
gaaaguacguuaugaua

SEQ ID NO: 936060 - RNA, 20 nt, Homo sapiens
gaacagguuuaaaaaucccc

SEQ ID NO: 936061 - RNA, 21 nt, Homo sapiens
gaaccaagaacuuuccaggaa

SEQ ID NO: 936062 - RNA, 15 nt, Homo sapiens
gaacgaagccaccuu

SEQ ID NO: 936063 - RNA, 16 nt, Homo sapiens
gaagacuucaucccuc

SEQ ID NO: 936064 - RNA, 16 nt, Homo sapiens
gaagagcuccuugaua

SEQ ID NO: 936065 - RNA, 17 nt, Homo sapiens
gaagcauuuacuuugug

SEQ ID NO: 936066 - RNA, 18 nt, Homo sapiens
gaauaauacaguaucuca

SEQ ID NO: 936067 - RNA, 23 nt, Homo sapiens
gaauccagagagcaguguggaaa

SEQ ID NO: 936068 - RNA, 19 nt, Homo sapiens
gaaugaaugucagugugac

SEQ ID NO: 936069 - RNA, 22 nt, Homo sapiens
gaaugaaugucagugugacuga

SEQ ID NO: 936070 - RNA, 21 nt, Homo sapiens
gaaugauuaauuaaaacacaa

SEQ ID NO: 936071 - RNA, 16 nt, Homo sapiens
gaaugcagugguauga

SEQ ID NO: 936072 - RNA, 21 nt, Homo sapiens
gaaugcucuuuacuucaugga

SEQ ID NO: 936073 - RNA, 12 nt, Homo sapiens
gaauuucucaca

SEQ ID NO: 936074 - RNA, 22 nt, Homo sapiens
gacaaagcgugguggacaugca

SEQ ID NO: 936075 - RNA, 16 nt, Homo sapiens
gacacaggcccggcuc

SEQ ID NO: 936076 - RNA, 15 nt, Homo sapiens
gacagagcaagugag

SEQ ID NO: 936077 - RNA, 19 nt, Homo sapiens
gaccagggauuuccaugau

SEQ ID NO: 936078 - RNA, 18 nt, Homo sapiens
gacccaugcugcccugug

SEQ ID NO: 936079 - RNA, 14 nt, Homo sapiens
gaccuucuccuuca

SEQ ID NO: 936080 - RNA, 18 nt, Homo sapiens
gaccuugaaugaugccau

SEQ ID NO: 936081 - RNA, 17 nt, Homo sapiens
gacuacaggcacccacc

SEQ ID NO: 936082 - RNA, 12 nt, Homo sapiens
gacuacaggugu

SEQ ID NO: 936083 - RNA, 17 nt, Homo sapiens
gacucaaugcacugaca

SEQ ID NO: 936084 - RNA, 17 nt, Homo sapiens
gacucuuuggacacuca

SEQ ID NO: 936085 - RNA, 22 nt, Homo sapiens
gacugaguacguugugcauuug

SEQ ID NO: 936086 - RNA, 12 nt, Homo sapiens
gagaaaugagcu

SEQ ID NO: 936087 - RNA, 20 nt, Homo sapiens
gagaaggcaaccuugacucu

SEQ ID NO: 936088 - RNA, 19 nt, Homo sapiens
gagacagaguuuucacucu

SEQ ID NO: 936089 - RNA, 15 nt, Homo sapiens
gagacagcacaggca

SEQ ID NO: 936090 - RNA, 12 nt, Homo sapiens
gagacaggguuu

SEQ ID NO: 936091 - RNA, 15 nt, Homo sapiens
gagagaaggggccca

SEQ ID NO: 936092 - RNA, 13 nt, Homo sapiens
gagagcagugugg

SEQ ID NO: 936093 - RNA, 19 nt, Homo sapiens
gagcaaaaucgaugcagug

SEQ ID NO: 936094 - RNA, 18 nt, Homo sapiens
gagccacugcaccgggcc

SEQ ID NO: 936095 - RNA, 12 nt, Homo sapiens
gagccugcaguu

SEQ ID NO: 936096 - RNA, 14 nt, Homo sapiens
gagccuuccagggg

SEQ ID NO: 936097 - RNA, 17 nt, Homo sapiens
gaggacuuuucuuugug

SEQ ID NO: 936098 - RNA, 17 nt, Homo sapiens
gagucgaggacagggag

SEQ ID NO: 936099 - RNA, 23 nt, Homo sapiens
gagugggcccaaugcacuuuguu

SEQ ID NO: 936100 - RNA, 20 nt, Homo sapiens
gaguucauacccuguuacca

SEQ ID NO: 936101 - RNA, 18 nt, Homo sapiens
gauacaggaaaagcugcu

SEQ ID NO: 936102 - RNA, 14 nt, Homo sapiens
gauccaagcugguc

SEQ ID NO: 936103 - RNA, 17 nt, Homo sapiens
gauccuaguuccaccau

SEQ ID NO: 936104 - RNA, 19 nt, Homo sapiens
gaugaaaaaauaacacugu

SEQ ID NO: 936105 - RNA, 16 nt, Homo sapiens
gaugagaggaaaucac

SEQ ID NO: 936106 - RNA, 16 nt, Homo sapiens
gaugccagggacccac

SEQ ID NO: 936107 - RNA, 13 nt, Homo sapiens
gauggauuuccag

SEQ ID NO: 936108 - RNA, 24 nt, Homo sapiens
gaugggauggcuuggggggcucca

SEQ ID NO: 936109 - RNA, 20 nt, Homo sapiens
gauguucugacccugcuuca

SEQ ID NO: 936110 - RNA, 20 nt, Homo sapiens
gauuuugaaauuuuuauuaa

SEQ ID NO: 936111 - RNA, 20 nt, Homo sapiens
gcaaaguaucccuacuguaa

SEQ ID NO: 936112 - RNA, 22 nt, Homo sapiens
gcaauacagacuacuucuuccc

SEQ ID NO: 936113 - RNA, 19 nt, Homo sapiens
gcacaugccucucucaggc

SEQ ID NO: 936114 - RNA, 21 nt, Homo sapiens
gcacaugccucucucaggcca

SEQ ID NO: 936115 - RNA, 19 nt, Homo sapiens
gcacucagaagacacugau

SEQ ID NO: 936116 - RNA, 19 nt, Homo sapiens
gcacuccaugagugcagcu

SEQ ID NO: 936117 - RNA, 21 nt, Homo sapiens
gcagacucuacagaggccaug

SEQ ID NO: 936118 - RNA, 22 nt, Homo sapiens
gcagagcagagaccaucccuga

SEQ ID NO: 936119 - RNA, 22 nt, Homo sapiens
gcagaguugaagacagagcuac

SEQ ID NO: 936120 - RNA, 18 nt, Homo sapiens
gcaggacuaaaugucuag

SEQ ID NO: 936121 - RNA, 14 nt, Homo sapiens
gcaggcucucaggc

SEQ ID NO: 936122 - RNA, 17 nt, Homo sapiens
gcaggcucucaggccag

SEQ ID NO: 936123 - RNA, 18 nt, Homo sapiens
gcaggcucucaggccagc

SEQ ID NO: 936124 - RNA, 23 nt, Homo sapiens
gcaggcuucuuccccccaaaacu

SEQ ID NO: 936125 - RNA, 15 nt, Homo sapiens
gcagggaaacagcua

SEQ ID NO: 936126 - RNA, 23 nt, Homo sapiens
gcagguuggugggggccucggug

SEQ ID NO: 936127 - RNA, 21 nt, Homo sapiens
gcaugugaugagaggaaauca

SEQ ID NO: 936128 - RNA, 13 nt, Homo sapiens
gcauuuguuugaa

SEQ ID NO: 936129 - RNA, 23 nt, Homo sapiens
gccaagguuuggggaagaacgaa

SEQ ID NO: 936130 - RNA, 16 nt, Homo sapiens
gccaaugggagcucau

SEQ ID NO: 936131 - RNA, 17 nt, Homo sapiens
gccacagggugagcacu

SEQ ID NO: 936132 - RNA, 19 nt, Homo sapiens
gccaccaacauacucccau

SEQ ID NO: 936133 - RNA, 18 nt, Homo sapiens
gccagcaggcucucaggc

SEQ ID NO: 936134 - RNA, 19 nt, Homo sapiens
gccagcuuaucucaggggu

SEQ ID NO: 936135 - RNA, 22 nt, Homo sapiens
gccauauucuguuggccagugu

SEQ ID NO: 936136 - RNA, 16 nt, Homo sapiens
gcccaaauucuuucag

SEQ ID NO: 936137 - RNA, 16 nt, Homo sapiens
gcccacacuugggagc

SEQ ID NO: 936138 - RNA, 19 nt, Homo sapiens
gccuacaggagugagcacu

SEQ ID NO: 936139 - RNA, 14 nt, Homo sapiens
gccuaggugacaga

SEQ ID NO: 936140 - RNA, 20 nt, Homo sapiens
gccuccccagcaccuaggug

SEQ ID NO: 936141 - RNA, 13 nt, Homo sapiens
gccucucucaggc

SEQ ID NO: 936142 - RNA, 12 nt, Homo sapiens
caaauauuuccc

SEQ ID NO: 936143 - RNA, 15 nt, Homo sapiens
caaaucagcugcuac

SEQ ID NO: 936144 - RNA, 22 nt, Homo sapiens
caacaccucugcacaagcugca

SEQ ID NO: 936145 - RNA, 18 nt, Homo sapiens
caacaggguuuuuuucca

SEQ ID NO: 936146 - RNA, 13 nt, Homo sapiens
caacucaucuuag

SEQ ID NO: 936147 - RNA, 23 nt, Homo sapiens
caacugcaucaagaugugacaug

SEQ ID NO: 936148 - RNA, 20 nt, Homo sapiens
caagacucuuuggacacuca

SEQ ID NO: 936149 - RNA, 21 nt, Homo sapiens
caagcuggucccacucagucc

SEQ ID NO: 936150 - RNA, 15 nt, Homo sapiens
caaggcugcagugag

SEQ ID NO: 936151 - RNA, 15 nt, Homo sapiens
caagugccuuagcaa

SEQ ID NO: 936152 - RNA, 19 nt, Homo sapiens
caauaaagcagcguuucua

SEQ ID NO: 936153 - RNA, 17 nt, Homo sapiens
caaugaguaacaggaaa

SEQ ID NO: 936154 - RNA, 16 nt, Homo sapiens
caaugcuuugaucccu

SEQ ID NO: 936155 - RNA, 22 nt, Homo sapiens
caauuauuuauuaaaugcccag

SEQ ID NO: 936156 - RNA, 20 nt, Homo sapiens
cacacaguauuacuucugcu

SEQ ID NO: 936157 - RNA, 16 nt, Homo sapiens
cacacgcgugcacaca

SEQ ID NO: 936158 - RNA, 14 nt, Homo sapiens
cacagaguuguuac

SEQ ID NO: 936159 - RNA, 19 nt, Homo sapiens
cacagcugggguggggacc

SEQ ID NO: 936160 - RNA, 14 nt, Homo sapiens
cacaggcccggcuc

SEQ ID NO: 936161 - RNA, 19 nt, Homo sapiens
cacaugcacgugugugcac

SEQ ID NO: 936162 - RNA, 19 nt, Homo sapiens
cacauuuauucugcucaca

SEQ ID NO: 936163 - RNA, 23 nt, Homo sapiens
caccaaaucagcugcuacuacuc

SEQ ID NO: 936164 - RNA, 15 nt, Homo sapiens
cacccugaaagcccu

SEQ ID NO: 936165 - RNA, 16 nt, Homo sapiens
caccucugcacaagcu

SEQ ID NO: 936166 - RNA, 19 nt, Homo sapiens
caccucugcacaagcugca

SEQ ID NO: 936167 - RNA, 17 nt, Homo sapiens
cacuaaggugugcucug

SEQ ID NO: 936168 - RNA, 23 nt, Homo sapiens
cacuauagccuaggugacagagu

SEQ ID NO: 936169 - RNA, 21 nt, Homo sapiens
cacucacacggacacucaaaa

SEQ ID NO: 936170 - RNA, 22 nt, Homo sapiens
cacucuuauugcccacgcugga

SEQ ID NO: 936171 - RNA, 19 nt, Homo sapiens
cacugcacuauagccuagg

SEQ ID NO: 936172 - RNA, 16 nt, Homo sapiens
cacugcuuaacuucac

SEQ ID NO: 936173 - RNA, 18 nt, Homo sapiens
cacuuacacuuuaugcac

SEQ ID NO: 936174 - RNA, 17 nt, Homo sapiens
cacuucccuacauggag

SEQ ID NO: 936175 - RNA, 17 nt, Homo sapiens
cagaaggaagacuucau

SEQ ID NO: 936176 - RNA, 20 nt, Homo sapiens
cagaaggaagacuucauccc

SEQ ID NO: 936177 - RNA, 21 nt, Homo sapiens
cagacucuacagaggccaugg

SEQ ID NO: 936178 - RNA, 14 nt, Homo sapiens
cagagaaaguacuu

SEQ ID NO: 936179 - RNA, 15 nt, Homo sapiens
cagagacacaagccu

SEQ ID NO: 936180 - RNA, 11 nt, Homo sapiens
cagagcugcca

SEQ ID NO: 936181 - RNA, 13 nt, Homo sapiens
cagagcugccacc

SEQ ID NO: 936182 - RNA, 18 nt, Homo sapiens
cagaggagagaggacccc

SEQ ID NO: 936183 - RNA, 18 nt, Homo sapiens
cagagucucacuguugcc

SEQ ID NO: 936184 - RNA, 19 nt, Homo sapiens
cagagucucacuguugccc

SEQ ID NO: 936185 - RNA, 17 nt, Homo sapiens
cagaguggauucuugaa

SEQ ID NO: 936186 - RNA, 12 nt, Homo sapiens
cagauacuuggg

SEQ ID NO: 936187 - RNA, 18 nt, Homo sapiens
cagauagauauaugcucu

SEQ ID NO: 936188 - RNA, 17 nt, Homo sapiens
cagauuguaccauugag

SEQ ID NO: 936189 - RNA, 14 nt, Homo sapiens
cagcaggcucucag

SEQ ID NO: 936190 - RNA, 16 nt, Homo sapiens
cagccccagugcccac

SEQ ID NO: 936191 - RNA, 20 nt, Homo sapiens
cagccucccgaguagcuggg

SEQ ID NO: 936192 - RNA, 22 nt, Homo sapiens
cagccucugaaaaccaauguuc

SEQ ID NO: 936193 - RNA, 18 nt, Homo sapiens
cagcugcuugggcuucau

SEQ ID NO: 936194 - RNA, 15 nt, Homo sapiens
caggaagguagaaau

SEQ ID NO: 936195 - RNA, 13 nt, Homo sapiens
caggaaguacugg

SEQ ID NO: 936196 - RNA, 14 nt, Homo sapiens
cagggaggugaccc

SEQ ID NO: 936197 - RNA, 12 nt, Homo sapiens
cagggucucacu

SEQ ID NO: 936198 - RNA, 20 nt, Homo sapiens
cagggucucacuauguugcc

SEQ ID NO: 936199 - RNA, 19 nt, Homo sapiens
cagggucucacucugucgc

SEQ ID NO: 936200 - RNA, 21 nt, Homo sapiens
cagggucucacucugucgccc

SEQ ID NO: 936201 - RNA, 14 nt, Homo sapiens
caggugcugccauc

SEQ ID NO: 936202 - RNA, 15 nt, Homo sapiens
caggugcugccaucc

SEQ ID NO: 936203 - RNA, 19 nt, Homo sapiens
caggugugaaccaccacac

SEQ ID NO: 936204 - RNA, 15 nt, Homo sapiens
cagguuggugggggc

SEQ ID NO: 936205 - RNA, 22 nt, Homo sapiens
cagugcccacaggaucagucug

SEQ ID NO: 936206 - RNA, 15 nt, Homo sapiens
cagugcccccuggug

SEQ ID NO: 936207 - RNA, 21 nt, Homo sapiens
cagugguuggcaauuguuuca

SEQ ID NO: 936208 - RNA, 12 nt, Homo sapiens
cagugugacaag

SEQ ID NO: 936209 - RNA, 14 nt, Homo sapiens
cauaacucugauua

SEQ ID NO: 936210 - RNA, 22 nt, Homo sapiens
cauagagagcaagacgcugugc

SEQ ID NO: 936211 - RNA, 14 nt, Homo sapiens
caucaagaugugac

SEQ ID NO: 936212 - RNA, 14 nt, Homo sapiens
cauccacugugcca

SEQ ID NO: 936213 - RNA, 16 nt, Homo sapiens
cauccagguucagcuu

SEQ ID NO: 936214 - RNA, 21 nt, Homo sapiens
caucccucuggggcuguucac

SEQ ID NO: 936215 - RNA, 14 nt, Homo sapiens
caucccugaaggcc

SEQ ID NO: 936216 - RNA, 11 nt, Homo sapiens
caucuauguga

SEQ ID NO: 936217 - RNA, 14 nt, Homo sapiens
caucuuccaacuca

SEQ ID NO: 936218 - RNA, 16 nt, Homo sapiens
caucuugaauuguaag

SEQ ID NO: 936219 - RNA, 20 nt, Homo sapiens
caugacacgaauauugcuga

SEQ ID NO: 936220 - RNA, 14 nt, Homo sapiens
caugagaugaugcc

SEQ ID NO: 936221 - RNA, 17 nt, Homo sapiens
caugccucucucaggcc

SEQ ID NO: 936222 - RNA, 20 nt, Homo sapiens
caugccucucucaggccaaa

SEQ ID NO: 936223 - RNA, 17 nt, Homo sapiens
caugccuggauggggcu

SEQ ID NO: 936224 - RNA, 14 nt, Homo sapiens
cauggaaguacuau

SEQ ID NO: 936225 - RNA, 17 nt, Homo sapiens
caugugcacaugcacgu

SEQ ID NO: 936226 - RNA, 22 nt, Homo sapiens
cauguuggccaggcuggucuca

SEQ ID NO: 936227 - RNA, 20 nt, Homo sapiens
cauuccuguucccaugagau

SEQ ID NO: 936228 - RNA, 19 nt, Homo sapiens
cauucuccuuguguuacua

SEQ ID NO: 936229 - RNA, 18 nt, Homo sapiens
cauuuaaaaaaaaucccu

SEQ ID NO: 936230 - RNA, 14 nt, Homo sapiens
ccaaaggaagcaca

SEQ ID NO: 936231 - RNA, 17 nt, Homo sapiens
ccaaaggaagcacaugc

SEQ ID NO: 936232 - RNA, 17 nt, Homo sapiens
ccaaagggccccuuucu

SEQ ID NO: 936233 - RNA, 12 nt, Homo sapiens
ccaaggugggag

SEQ ID NO: 936234 - RNA, 13 nt, Homo sapiens
ccaaugaugguca

SEQ ID NO: 936235 - RNA, 22 nt, Homo sapiens
ccaauuuaaagaaaacuguuaa

SEQ ID NO: 936236 - RNA, 16 nt, Homo sapiens
ccacaaccgaccagau

SEQ ID NO: 936237 - RNA, 21 nt, Homo sapiens
ccacaucuugcucugcugaca

SEQ ID NO: 936238 - RNA, 14 nt, Homo sapiens
ccacaugugcacau

SEQ ID NO: 936239 - RNA, 15 nt, Homo sapiens
ccaccaacauacucc

SEQ ID NO: 936240 - RNA, 15 nt, Homo sapiens
ccacugcgaccacaa

SEQ ID NO: 936241 - RNA, 12 nt, Homo sapiens
ccacuucugcca

SEQ ID NO: 936242 - RNA, 15 nt, Homo sapiens
ccacuuugauaccau

SEQ ID NO: 936243 - RNA, 16 nt, Homo sapiens
ccagacacauguccaa

SEQ ID NO: 936244 - RNA, 18 nt, Homo sapiens
ccagcaggcucucaggcc

SEQ ID NO: 936245 - RNA, 22 nt, Homo sapiens
ccagccugcuaauuccccagau

SEQ ID NO: 936246 - RNA, 18 nt, Homo sapiens
ccagcgugugacuacucc

SEQ ID NO: 936247 - RNA, 17 nt, Homo sapiens
acaccaugauuaaccac

SEQ ID NO: 936248 - RNA, 23 nt, Homo sapiens
acacuaacgauuuguuaaugaua

SEQ ID NO: 936249 - RNA, 16 nt, Homo sapiens
acacucaaaagcuggg

SEQ ID NO: 936250 - RNA, 15 nt, Homo sapiens
acacucacauuuauu

SEQ ID NO: 936251 - RNA, 22 nt, Homo sapiens
acacugugcugagucugaaggc

SEQ ID NO: 936252 - RNA, 16 nt, Homo sapiens
acacuugggagcaaaa

SEQ ID NO: 936253 - RNA, 17 nt, Homo sapiens
acacuugggagcaaaag

SEQ ID NO: 936254 - RNA, 21 nt, Homo sapiens
acagauuuuuggagaaaggau

SEQ ID NO: 936255 - RNA, 12 nt, Homo sapiens
acagccaugauu

SEQ ID NO: 936256 - RNA, 22 nt, Homo sapiens
acagccaugauucuuuugccca

SEQ ID NO: 936257 - RNA, 18 nt, Homo sapiens
acagccucugaaaaccaa

SEQ ID NO: 936258 - RNA, 18 nt, Homo sapiens
acagcucuucuccaggcu

SEQ ID NO: 936259 - RNA, 13 nt, Homo sapiens
acaggcacccacc

SEQ ID NO: 936260 - RNA, 15 nt, Homo sapiens
acagggaggugaccc

SEQ ID NO: 936261 - RNA, 22 nt, Homo sapiens
acaggguuuugccauguuggcc

SEQ ID NO: 936262 - RNA, 14 nt, Homo sapiens
acaguaucucaggg

SEQ ID NO: 936263 - RNA, 21 nt, Homo sapiens
acaguuaagagaaaugagcuu

SEQ ID NO: 936264 - RNA, 23 nt, Homo sapiens
acaguucaauucucauuugucac

SEQ ID NO: 936265 - RNA, 20 nt, Homo sapiens
acauacaauuccaaacacau

SEQ ID NO: 936266 - RNA, 12 nt, Homo sapiens
acauacucccau

SEQ ID NO: 936267 - RNA, 18 nt, Homo sapiens
acaucuugcucugcugac

SEQ ID NO: 936268 - RNA, 18 nt, Homo sapiens
acaugaucuucuuuauaa

SEQ ID NO: 936269 - RNA, 17 nt, Homo sapiens
acaugcacagcuaacau

SEQ ID NO: 936270 - RNA, 15 nt, Homo sapiens
acaugcacgugugug

SEQ ID NO: 936271 - RNA, 18 nt, Homo sapiens
acaugccucucucaggcc

SEQ ID NO: 936272 - RNA, 18 nt, Homo sapiens
acauggaauaacauguaa

SEQ ID NO: 936273 - RNA, 19 nt, Homo sapiens
acauguaauuaaguacuau

SEQ ID NO: 936274 - RNA, 12 nt, Homo sapiens
acaugugcacau

SEQ ID NO: 936275 - RNA, 13 nt, Homo sapiens
acaugugcacaug

SEQ ID NO: 936276 - RNA, 22 nt, Homo sapiens
acauguuuuucuucucccucag

SEQ ID NO: 936277 - RNA, 11 nt, Homo sapiens
accaaccuggg

SEQ ID NO: 936278 - RNA, 17 nt, Homo sapiens
accacaagaaggaugau

SEQ ID NO: 936279 - RNA, 14 nt, Homo sapiens
accaccaaccacug

SEQ ID NO: 936280 - RNA, 14 nt, Homo sapiens
accacuucagcuga

SEQ ID NO: 936281 - RNA, 14 nt, Homo sapiens
accagagcugccac

SEQ ID NO: 936282 - RNA, 19 nt, Homo sapiens
accagagcugccaccugcc

SEQ ID NO: 936283 - RNA, 23 nt, Homo sapiens
accaugauuaaccacuucagcug

SEQ ID NO: 936284 - RNA, 24 nt, Homo sapiens
accaugauuaaccacuucagcuga

SEQ ID NO: 936285 - RNA, 21 nt, Homo sapiens
accauuuugggguacccacug

SEQ ID NO: 936286 - RNA, 19 nt, Homo sapiens
acccaauauuuaccagacc

SEQ ID NO: 936287 - RNA, 16 nt, Homo sapiens
acccaccaucaugucu

SEQ ID NO: 936288 - RNA, 21 nt, Homo sapiens
acccccugaauuucucacaaa

SEQ ID NO: 936289 - RNA, 21 nt, Homo sapiens
accuagccuuagaagucacac

SEQ ID NO: 936290 - RNA, 13 nt, Homo sapiens
accuuguuucccu

SEQ ID NO: 936291 - RNA, 19 nt, Homo sapiens
acgcaaccaccaccaacca

SEQ ID NO: 936292 - RNA, 21 nt, Homo sapiens
acgccacugcacuauagccua

SEQ ID NO: 936293 - RNA, 16 nt, Homo sapiens
acgccuguaauccuag

SEQ ID NO: 936294 - RNA, 20 nt, Homo sapiens
acgugugugcacguacacac

SEQ ID NO: 936295 - RNA, 19 nt, Homo sapiens
acguguuaugacuccagaa

SEQ ID NO: 936296 - RNA, 22 nt, Homo sapiens
acguuucuaaaggcuaccuuug

SEQ ID NO: 936297 - RNA, 19 nt, Homo sapiens
acuaaaagguaugcaauca

SEQ ID NO: 936298 - RNA, 16 nt, Homo sapiens
acuaaaaggugaccaa

SEQ ID NO: 936299 - RNA, 15 nt, Homo sapiens
acuaagagucucuau

SEQ ID NO: 936300 - RNA, 16 nt, Homo sapiens
acuaaggaaucuuucu

SEQ ID NO: 936301 - RNA, 21 nt, Homo sapiens
acucacacggacacucaaaag

SEQ ID NO: 936302 - RNA, 23 nt, Homo sapiens
acucacacggacacucaaaagcu

SEQ ID NO: 936303 - RNA, 22 nt, Homo sapiens
acucauucuucuguacgucuga

SEQ ID NO: 936304 - RNA, 23 nt, Homo sapiens
acucuauuuuuguaaaaagggaa

SEQ ID NO: 936305 - RNA, 16 nt, Homo sapiens
acugacauuguuggcc

SEQ ID NO: 936306 - RNA, 20 nt, Homo sapiens
acugcaccgggccacagaga

SEQ ID NO: 936307 - RNA, 21 nt, Homo sapiens
acugcacuauagccuagguga

SEQ ID NO: 936308 - RNA, 21 nt, Homo sapiens
acugcauaugaaaggacacua

SEQ ID NO: 936309 - RNA, 16 nt, Homo sapiens
acuguccuacccaccc

SEQ ID NO: 936310 - RNA, 22 nt, Homo sapiens
acugugaagagaaccauaucaa

SEQ ID NO: 936311 - RNA, 13 nt, Homo sapiens
acuguugcccagg

SEQ ID NO: 936312 - RNA, 17 nt, Homo sapiens
acuucuuauacauuuga

SEQ ID NO: 936313 - RNA, 18 nt, Homo sapiens
acuucuuauacauuugau

SEQ ID NO: 936314 - RNA, 19 nt, Homo sapiens
acuugauguguuaucucuu

SEQ ID NO: 936315 - RNA, 16 nt, Homo sapiens
acuugcacccaugugu

SEQ ID NO: 936316 - RNA, 14 nt, Homo sapiens
acuugggagcaaaa

SEQ ID NO: 936317 - RNA, 22 nt, Homo sapiens
acuuuguuuagcccaaaaccaa

SEQ ID NO: 936318 - RNA, 11 nt, Homo sapiens
agaaaaaccac

SEQ ID NO: 936319 - RNA, 20 nt, Homo sapiens
agaaaauaguggugugauuu

SEQ ID NO: 936320 - RNA, 15 nt, Homo sapiens
agaaagacuaucuaa

SEQ ID NO: 936321 - RNA, 23 nt, Homo sapiens
agaaccaaaaagaggcuauguga

SEQ ID NO: 936322 - RNA, 18 nt, Homo sapiens
agaaccuuuugagugccu

SEQ ID NO: 936323 - RNA, 16 nt, Homo sapiens
agaacgaagccaccuu

SEQ ID NO: 936324 - RNA, 19 nt, Homo sapiens
agaagacacugaugggcaa

SEQ ID NO: 936325 - RNA, 13 nt, Homo sapiens
agaaguuucugcc

SEQ ID NO: 936326 - RNA, 14 nt, Homo sapiens
agaaucucaaauaa

SEQ ID NO: 936327 - RNA, 19 nt, Homo sapiens
agacaaugacuuacuguac

SEQ ID NO: 936328 - RNA, 18 nt, Homo sapiens
agacaccuugacagggca

SEQ ID NO: 936329 - RNA, 19 nt, Homo sapiens
agacaggguuuugccaugu

SEQ ID NO: 936330 - RNA, 17 nt, Homo sapiens
agacauacuaaccagca

SEQ ID NO: 936331 - RNA, 15 nt, Homo sapiens
agaccuucuccuuca

SEQ ID NO: 936332 - RNA, 20 nt, Homo sapiens
agacucuacagaggccaugg

SEQ ID NO: 936333 - RNA, 15 nt, Homo sapiens
agacuggaagcacag

SEQ ID NO: 936334 - RNA, 14 nt, Homo sapiens
agacuucaucccuc

SEQ ID NO: 936335 - RNA, 16 nt, Homo sapiens
agagaaaguacuucuc

SEQ ID NO: 936336 - RNA, 15 nt, Homo sapiens
agagaaggggcccaa

SEQ ID NO: 936337 - RNA, 20 nt, Homo sapiens
agagaauucucuuauccaac

SEQ ID NO: 936338 - RNA, 14 nt, Homo sapiens
agagcaguguggaa

SEQ ID NO: 936339 - RNA, 11 nt, Homo sapiens
agagcugccac

SEQ ID NO: 936340 - RNA, 14 nt, Homo sapiens
agaguaacccuguc

SEQ ID NO: 936341 - RNA, 21 nt, Homo sapiens
agaguaacccugucuaaugaa

SEQ ID NO: 936342 - RNA, 14 nt, Homo sapiens
agagucacuggaac

SEQ ID NO: 936343 - RNA, 20 nt, Homo sapiens
agagugagacucugucucaa

SEQ ID NO: 936344 - RNA, 16 nt, Homo sapiens
agauagauauaugcuc

SEQ ID NO: 936345 - RNA, 17 nt, Homo sapiens
agauagccaaggccaaa

SEQ ID NO: 936346 - RNA, 15 nt, Homo sapiens
agaucacgccacugc

SEQ ID NO: 936347 - RNA, 17 nt, Homo sapiens
agauguauauauuuccu

SEQ ID NO: 936348 - RNA, 14 nt, Homo sapiens
agcaaaagauucua

SEQ ID NO: 936349 - RNA, 17 nt, Homo sapiens
agcaauccugcaagaac

SEQ ID NO: 936350 - RNA, 21 nt, Homo sapiens
agcaccuuagacagucccugc

SEQ ID NO: 936351 - RNA, 19 nt, Homo sapiens
agcacuaaggugugcucug

SEQ ID NO: 936352 - RNA, 22 nt, Homo sapiens
agcagagcaccuuagacagucc

SEQ ID NO: 936353 - RNA, 15 nt, Homo sapiens
agcaggcucucaggc

SEQ ID NO: 936354 - RNA, 20 nt, Homo sapiens
agccacagggugagcacucu

SEQ ID NO: 936355 - RNA, 22 nt, Homo sapiens
agccccauucugccugcccagg

SEQ ID NO: 936356 - RNA, 15 nt, Homo sapiens
agcccugagcuuucu

SEQ ID NO: 936357 - RNA, 16 nt, Homo sapiens
agcccuuagcagggaa

SEQ ID NO: 936358 - RNA, 17 nt, Homo sapiens
auucagcucugcaagaa

SEQ ID NO: 936359 - RNA, 22 nt, Homo sapiens
auucuccaccugccagggacag

SEQ ID NO: 936360 - RNA, 18 nt, Homo sapiens
auuggaaauuuguuauaa

SEQ ID NO: 936361 - RNA, 18 nt, Homo sapiens
auuguaaggaaugauuaa

SEQ ID NO: 936362 - RNA, 21 nt, Homo sapiens
auuguuagucucuugauucau

SEQ ID NO: 936363 - RNA, 17 nt, Homo sapiens
auuguuuucaguguaca

SEQ ID NO: 936364 - RNA, 19 nt, Homo sapiens
auuuaacagaaauguacag

SEQ ID NO: 936365 - RNA, 17 nt, Homo sapiens
auuuaccugaagucuuu

SEQ ID NO: 936366 - RNA, 18 nt, Homo sapiens
auuucuaaaucuccaaaa

SEQ ID NO: 936367 - RNA, 21 nt, Homo sapiens
auuuuguuuuugucuuaaaaa

SEQ ID NO: 936368 - RNA, 19 nt, Homo sapiens
auuuuuguagagccagggu

SEQ ID NO: 936369 - RNA, 19 nt, Homo sapiens
caaaaaaaggcggugagca

SEQ ID NO: 936370 - RNA, 17 nt, Homo sapiens
caaaaaacaacugacca

SEQ ID NO: 936371 - RNA, 23 nt, Homo sapiens
caaagccuccuccagccgccaug

SEQ ID NO: 936372 - RNA, 18 nt, Homo sapiens
caaagcgugguggacaug

SEQ ID NO: 936373 - RNA, 23 nt, Homo sapiens
caaagcgugguggacaugcacag

SEQ ID NO: 936374 - RNA, 15 nt, Homo sapiens
caaaguagaagucuu

SEQ ID NO: 936375 - RNA, 12 nt, Homo sapiens
aaaaaaaagggg

SEQ ID NO: 936376 - RNA, 12 nt, Homo sapiens
aaaaaaaauccc

SEQ ID NO: 936377 - RNA, 21 nt, Homo sapiens
aaaaauagccugccucuucuc

SEQ ID NO: 936378 - RNA, 15 nt, Homo sapiens
aaaaaucccuuaccu

SEQ ID NO: 936379 - RNA, 12 nt, Homo sapiens
aaaacacaacau

SEQ ID NO: 936380 - RNA, 23 nt, Homo sapiens
aaaacuuuucuaauacucuaccc

SEQ ID NO: 936381 - RNA, 18 nt, Homo sapiens
aaaagaugaagcugagau

SEQ ID NO: 936382 - RNA, 23 nt, Homo sapiens
aaaagaugcuucucacugccaug

SEQ ID NO: 936383 - RNA, 19 nt, Homo sapiens
aaaagcaucuaugugagac

SEQ ID NO: 936384 - RNA, 16 nt, Homo sapiens
aaaauaccagccagua

SEQ ID NO: 936385 - RNA, 22 nt, Homo sapiens
aaacacauacaggaagguagaa

SEQ ID NO: 936386 - RNA, 18 nt, Homo sapiens
aaacucuccucugcugcu

SEQ ID NO: 936387 - RNA, 22 nt, Homo sapiens
aaacugauuacaacugcuacag

SEQ ID NO: 936388 - RNA, 23 nt, Homo sapiens
aaagaccgugugugaaauucucu

SEQ ID NO: 936389 - RNA, 13 nt, Homo sapiens
aaagauacaguua

SEQ ID NO: 936390 - RNA, 11 nt, Homo sapiens
aaagcugccag

SEQ ID NO: 936391 - RNA, 16 nt, Homo sapiens
aaaggaugcccaaaga

SEQ ID NO: 936392 - RNA, 18 nt, Homo sapiens
aaagggcccagagagggu

SEQ ID NO: 936393 - RNA, 17 nt, Homo sapiens
aaaguuucucuuuucaa

SEQ ID NO: 936394 - RNA, 23 nt, Homo sapiens
aaaguuuuaugagaaaugccagu

SEQ ID NO: 936395 - RNA, 13 nt, Homo sapiens
aaauaacacugua

SEQ ID NO: 936396 - RNA, 23 nt, Homo sapiens
aaauaacuaaaagguaugcaauc

SEQ ID NO: 936397 - RNA, 17 nt, Homo sapiens
aaauacagauagauaua

SEQ ID NO: 936398 - RNA, 17 nt, Homo sapiens
aaaucagcugcuacuac

SEQ ID NO: 936399 - RNA, 14 nt, Homo sapiens
aaaugccagugugc

SEQ ID NO: 936400 - RNA, 23 nt, Homo sapiens
aaaugcccagcuuaaaggggcua

SEQ ID NO: 936401 - RNA, 23 nt, Homo sapiens
aaauggacguguuaugacuccag

SEQ ID NO: 936402 - RNA, 13 nt, Homo sapiens
aaauguacagcaa

SEQ ID NO: 936403 - RNA, 14 nt, Homo sapiens
aaauucaugcugcu

SEQ ID NO: 936404 - RNA, 21 nt, Homo sapiens
aaauucucuuuccuguagucc

SEQ ID NO: 936405 - RNA, 12 nt, Homo sapiens
aaauucuugaua

SEQ ID NO: 936406 - RNA, 23 nt, Homo sapiens
aacacucacauuuauucugcuca

SEQ ID NO: 936407 - RNA, 14 nt, Homo sapiens
aacauggaaguacu

SEQ ID NO: 936408 - RNA, 17 nt, Homo sapiens
aaccaccaccaaccacu

SEQ ID NO: 936409 - RNA, 22 nt, Homo sapiens
aaccuagccuuagaagucacac

SEQ ID NO: 936410 - RNA, 20 nt, Homo sapiens
aaccuggguaacuagggaag

SEQ ID NO: 936411 - RNA, 19 nt, Homo sapiens
aacuagggaagauaauauu

SEQ ID NO: 936412 - RNA, 20 nt, Homo sapiens
aacucuacccuggcacuaua

SEQ ID NO: 936413 - RNA, 14 nt, Homo sapiens
aacucuugaccuca

SEQ ID NO: 936414 - RNA, 22 nt, Homo sapiens
aacuggaaaguacguuaugaua

SEQ ID NO: 936415 - RNA, 11 nt, Homo sapiens
aacuggcugca

SEQ ID NO: 936416 - RNA, 15 nt, Homo sapiens
aacuuccaauuuaca

SEQ ID NO: 936417 - RNA, 23 nt, Homo sapiens
aacuuuguuuagcccaaaaccaa

SEQ ID NO: 936418 - RNA, 21 nt, Homo sapiens
aagacugaguacguugugcau

SEQ ID NO: 936419 - RNA, 13 nt, Homo sapiens
aagacuucauccc

SEQ ID NO: 936420 - RNA, 15 nt, Homo sapiens
aagagaaaugagcuu

SEQ ID NO: 936421 - RNA, 20 nt, Homo sapiens
aagagggagggagggcucca

SEQ ID NO: 936422 - RNA, 21 nt, Homo sapiens
aagagguuuuaaaaaaauccc

SEQ ID NO: 936423 - RNA, 19 nt, Homo sapiens
aagauaaaugugcugaaug

SEQ ID NO: 936424 - RNA, 20 nt, Homo sapiens
aagaugcuucucacugccau

SEQ ID NO: 936425 - RNA, 19 nt, Homo sapiens
aagcacaugccucucucag

SEQ ID NO: 936426 - RNA, 19 nt, Homo sapiens
aagcaggacuaaaugucua

SEQ ID NO: 936427 - RNA, 20 nt, Homo sapiens
aagccagcaggcucucaggc

SEQ ID NO: 936428 - RNA, 14 nt, Homo sapiens
aaggaagcacaugc

SEQ ID NO: 936429 - RNA, 13 nt, Homo sapiens
aaggagauuuaca

SEQ ID NO: 936430 - RNA, 19 nt, Homo sapiens
aaggaugaucuaggaagac

SEQ ID NO: 936431 - RNA, 15 nt, Homo sapiens
aaggcggugagcaau

SEQ ID NO: 936432 - RNA, 18 nt, Homo sapiens
aaggggagaguaacccug

SEQ ID NO: 936433 - RNA, 18 nt, Homo sapiens
aaguacuucuccacccug

SEQ ID NO: 936434 - RNA, 16 nt, Homo sapiens
aagucagcacuaccuc

SEQ ID NO: 936435 - RNA, 20 nt, Homo sapiens
aagugagacccugucucaaa

SEQ ID NO: 936436 - RNA, 16 nt, Homo sapiens
aagugagagaggggga

SEQ ID NO: 936437 - RNA, 19 nt, Homo sapiens
aagugguacuaacuuuccu

SEQ ID NO: 936438 - RNA, 15 nt, Homo sapiens
aaguuaacuuccaau

SEQ ID NO: 936439 - RNA, 18 nt, Homo sapiens
aauaaauuuguaugcuca

SEQ ID NO: 936440 - RNA, 19 nt, Homo sapiens
aauaacacuguacugcaau

SEQ ID NO: 936441 - RNA, 13 nt, Homo sapiens
aauaacauguaau

SEQ ID NO: 936442 - RNA, 14 nt, Homo sapiens
aauacaguaucuca

SEQ ID NO: 936443 - RNA, 21 nt, Homo sapiens
aauagcugggacuacaggugu

SEQ ID NO: 936444 - RNA, 14 nt, Homo sapiens
aauauuuaccagac

SEQ ID NO: 936445 - RNA, 20 nt, Homo sapiens
aauauuucccucaccuuucc

SEQ ID NO: 936446 - RNA, 20 nt, Homo sapiens
aaucagcugcuacuacuccu

SEQ ID NO: 936447 - RNA, 13 nt, Homo sapiens
aaucuaaauggaa

SEQ ID NO: 936448 - RNA, 16 nt, Homo sapiens
aaucucuaguugucac

SEQ ID NO: 936449 - RNA, 17 nt, Homo sapiens
aaugaaugucaguguga

SEQ ID NO: 936450 - RNA, 16 nt, Homo sapiens
aaugacuuaagcacac

SEQ ID NO: 936451 - RNA, 21 nt, Homo sapiens
aaugacuuacuguacaugaaa

SEQ ID NO: 936452 - RNA, 16 nt, Homo sapiens
aaugaggaaacugcac

SEQ ID NO: 936453 - RNA, 19 nt, Homo sapiens
aaugaggaaacugcacugu

SEQ ID NO: 936454 - RNA, 11 nt, Homo sapiens
aaugcagagau

SEQ ID NO: 936455 - RNA, 20 nt, Homo sapiens
aaugcucuuuacuucaugga

SEQ ID NO: 936456 - RNA, 18 nt, Homo sapiens
aaugucagugugacugau

SEQ ID NO: 936457 - RNA, 22 nt, Homo sapiens
aaugugacuugagcccagagug

SEQ ID NO: 936458 - RNA, 16 nt, Homo sapiens
aauuacaggaaguacu

SEQ ID NO: 936459 - RNA, 18 nt, Homo sapiens
gaagucuuuguacagaca

SEQ ID NO: 936460 - RNA, 15 nt, Homo sapiens
gaaugcgggggagca

SEQ ID NO: 936461 - RNA, 19 nt, Homo sapiens
gaauucuuaaauaugugga

SEQ ID NO: 936462 - RNA, 17 nt, Homo sapiens
gaauuucucacaaagga

SEQ ID NO: 936463 - RNA, 17 nt, Homo sapiens
gacacaugcaaggucau

SEQ ID NO: 936464 - RNA, 16 nt, Homo sapiens
gacacauguccaagaa

SEQ ID NO: 936465 - RNA, 19 nt, Homo sapiens
gacagaagaaacuacccuc

SEQ ID NO: 936466 - RNA, 12 nt, Homo sapiens
gacagcucuuau

SEQ ID NO: 936467 - RNA, 17 nt, Homo sapiens
gacagcugccugggauc

SEQ ID NO: 936468 - RNA, 21 nt, Homo sapiens
gacaguuaagagaaaugagcu

SEQ ID NO: 936469 - RNA, 17 nt, Homo sapiens
gaccaguuguugauaac

SEQ ID NO: 936470 - RNA, 13 nt, Homo sapiens
gacccaugcugcc

SEQ ID NO: 936471 - RNA, 14 nt, Homo sapiens
gacccuauugcugc

SEQ ID NO: 936472 - RNA, 15 nt, Homo sapiens
gaccgugaggccaga

SEQ ID NO: 936473 - RNA, 11 nt, Homo sapiens
gaccucaggug

SEQ ID NO: 936474 - RNA, 20 nt, Homo sapiens
gaccucaggugauccaccca

SEQ ID NO: 936475 - RNA, 22 nt, Homo sapiens
gacgccaucccagccccaauga

SEQ ID NO: 936476 - RNA, 22 nt, Homo sapiens
gacucgauagugguggugaaca

SEQ ID NO: 936477 - RNA, 17 nt, Homo sapiens
gacucuacagaggccau

SEQ ID NO: 936478 - RNA, 21 nt, Homo sapiens
gacuugagcccagagugaaca

SEQ ID NO: 936479 - RNA, 13 nt, Homo sapiens
gagaaggggccca

SEQ ID NO: 936480 - RNA, 15 nt, Homo sapiens
cuacucgaguuacag

SEQ ID NO: 936481 - RNA, 17 nt, Homo sapiens
cuacucgaguuacagac

SEQ ID NO: 936482 - RNA, 20 nt, Homo sapiens
cuacucuagggaaaaaccag

SEQ ID NO: 936483 - RNA, 18 nt, Homo sapiens
cuacugggggcaacccug

SEQ ID NO: 936484 - RNA, 15 nt, Homo sapiens
cuaugugagcacaaa

SEQ ID NO: 936485 - RNA, 14 nt, Homo sapiens
cuauguugcccagg

SEQ ID NO: 936486 - RNA, 21 nt, Homo sapiens
cucaaaagcugggcagguugg

SEQ ID NO: 936487 - RNA, 15 nt, Homo sapiens
cucaaauaacuaaaa

SEQ ID NO: 936488 - RNA, 10 nt, Homo sapiens
cucacuccuu

SEQ ID NO: 936489 - RNA, 22 nt, Homo sapiens
cucagaagacacugaugggcaa

SEQ ID NO: 936490 - RNA, 11 nt, Homo sapiens
cucagugccac

SEQ ID NO: 936491 - RNA, 13 nt, Homo sapiens
cucauaguauggu

SEQ ID NO: 936492 - RNA, 15 nt, Homo sapiens
cucauccucauaccc

SEQ ID NO: 936493 - RNA, 17 nt, Homo sapiens
cuccacuuucuagccag

SEQ ID NO: 936494 - RNA, 21 nt, Homo sapiens
cuccacuuucuagccagagga

SEQ ID NO: 936495 - RNA, 16 nt, Homo sapiens
cuccagcucaccagcc

SEQ ID NO: 936496 - RNA, 22 nt, Homo sapiens
cuccagcucaccagccccagug

SEQ ID NO: 936497 - RNA, 14 nt, Homo sapiens
cuccagggggugcc

SEQ ID NO: 936498 - RNA, 14 nt, Homo sapiens
cuccauguuugaug

SEQ ID NO: 936499 - RNA, 19 nt, Homo sapiens
cucccaaagugcugggauu

SEQ ID NO: 936500 - RNA, 19 nt, Homo sapiens
cuccugguguggaagagcu

SEQ ID NO: 936501 - RNA, 17 nt, Homo sapiens
cucgcgacaaugcaaac

SEQ ID NO: 936502 - RNA, 17 nt, Homo sapiens
cucuccccagcaaguga

SEQ ID NO: 936503 - RNA, 15 nt, Homo sapiens
cucugacacacagcu

SEQ ID NO: 936504 - RNA, 19 nt, Homo sapiens
cucuggcuaaauucaugcu

SEQ ID NO: 936505 - RNA, 20 nt, Homo sapiens
cucuuccacuuugauaccau

SEQ ID NO: 936506 - RNA, 17 nt, Homo sapiens
cucuuuucaaaacauuu

SEQ ID NO: 936507 - RNA, 18 nt, Homo sapiens
cugaagucuuuguacaga

SEQ ID NO: 936508 - RNA, 20 nt, Homo sapiens
cugaagucuuuguacagaca

SEQ ID NO: 936509 - RNA, 18 nt, Homo sapiens
cugacacacagcucuguc

SEQ ID NO: 936510 - RNA, 20 nt, Homo sapiens
cugagaugggacaggaucaa

SEQ ID NO: 936511 - RNA, 13 nt, Homo sapiens
cugauggugcaau

SEQ ID NO: 936512 - RNA, 16 nt, Homo sapiens
cugauggugcaaugac

SEQ ID NO: 936513 - RNA, 23 nt, Homo sapiens
cugcacuauagccuaggugacag

SEQ ID NO: 936514 - RNA, 20 nt, Homo sapiens
cugcaucaagaugugacaug

SEQ ID NO: 936515 - RNA, 19 nt, Homo sapiens
cugccagccgagauagcca

SEQ ID NO: 936516 - RNA, 15 nt, Homo sapiens
cugccaugccagcuu

SEQ ID NO: 936517 - RNA, 15 nt, Homo sapiens
cugccucugacacac

SEQ ID NO: 936518 - RNA, 18 nt, Homo sapiens
cugcgucucauacucacc

SEQ ID NO: 936519 - RNA, 18 nt, Homo sapiens
cugcucuccgaccagaca

SEQ ID NO: 936520 - RNA, 14 nt, Homo sapiens
cugcugacaguguu

SEQ ID NO: 936521 - RNA, 17 nt, Homo sapiens
cuggcacuauaauguaa

SEQ ID NO: 936522 - RNA, 20 nt, Homo sapiens
cuggcaugggaaugaauguc

SEQ ID NO: 936523 - RNA, 21 nt, Homo sapiens
cuggcaugggaaugaauguca

SEQ ID NO: 936524 - RNA, 16 nt, Homo sapiens
cuggcuaugcauuuga

SEQ ID NO: 936525 - RNA, 21 nt, Homo sapiens
cugggguggggaccucaggcc

SEQ ID NO: 936526 - RNA, 16 nt, Homo sapiens
cuggucccacucaguc

SEQ ID NO: 936527 - RNA, 21 nt, Homo sapiens
cuguaauccuagcacuuuggg

SEQ ID NO: 936528 - RNA, 16 nt, Homo sapiens
cugucaauuacaggaa

SEQ ID NO: 936529 - RNA, 23 nt, Homo sapiens
cuguggguuucuaaagcugccag

SEQ ID NO: 936530 - RNA, 15 nt, Homo sapiens
cuguucuuuccaaag

SEQ ID NO: 936531 - RNA, 21 nt, Homo sapiens
cuguuggccagugugacaagg

SEQ ID NO: 936532 - RNA, 17 nt, Homo sapiens
cuguuucugcagccacu

SEQ ID NO: 936533 - RNA, 23 nt, Homo sapiens
cuuaccagcagagcaccuuagac

SEQ ID NO: 936534 - RNA, 21 nt, Homo sapiens
cuuaccugccaggaagccagc

SEQ ID NO: 936535 - RNA, 15 nt, Homo sapiens
cuuacuguacaugaa

SEQ ID NO: 936536 - RNA, 16 nt, Homo sapiens
cuuagacagucccugc

SEQ ID NO: 936537 - RNA, 17 nt, Homo sapiens
cuucaaccccaugagac

SEQ ID NO: 936538 - RNA, 19 nt, Homo sapiens
cuucaaucucuugcacuca

SEQ ID NO: 936539 - RNA, 21 nt, Homo sapiens
cuucaaucucuugcacucaaa

SEQ ID NO: 936540 - RNA, 21 nt, Homo sapiens
cuuccaacucaaacucuuaaa

SEQ ID NO: 936541 - RNA, 19 nt, Homo sapiens
cuuccaaggguacuaagga

SEQ ID NO: 936542 - RNA, 23 nt, Homo sapiens
cuucccacuggaggcaugugaug

SEQ ID NO: 936543 - RNA, 15 nt, Homo sapiens
cuucuguccuacucu

SEQ ID NO: 936544 - RNA, 17 nt, Homo sapiens
cuugaaugaugccauga

SEQ ID NO: 936545 - RNA, 21 nt, Homo sapiens
cuugaccgugaggccagagac

SEQ ID NO: 936546 - RNA, 19 nt, Homo sapiens
cuugaccucaggugaucca

SEQ ID NO: 936547 - RNA, 18 nt, Homo sapiens
cuugagcccagagugaac

SEQ ID NO: 936548 - RNA, 16 nt, Homo sapiens
cuuggcgcugccccug

SEQ ID NO: 936549 - RNA, 16 nt, Homo sapiens
cuugguucccauuugc

SEQ ID NO: 936550 - RNA, 19 nt, Homo sapiens
cuuucaccacaugugcaca

SEQ ID NO: 936551 - RNA, 16 nt, Homo sapiens
cuuucccaucuuccaa

SEQ ID NO: 936552 - RNA, 17 nt, Homo sapiens
cuuucuagccagaggag

SEQ ID NO: 936553 - RNA, 20 nt, Homo sapiens
cuuucuucccuacaguugaa

SEQ ID NO: 936554 - RNA, 18 nt, Homo sapiens
cuuuucauaaccuagccu

SEQ ID NO: 936555 - RNA, 21 nt, Homo sapiens
cuuuucgcaggauucuuccuc

SEQ ID NO: 936556 - RNA, 15 nt, Homo sapiens
cuuuugagugccuua

SEQ ID NO: 936557 - RNA, 22 nt, Homo sapiens
cuuuugcccacacuugggagca

SEQ ID NO: 936558 - RNA, 21 nt, Homo sapiens
cuuuuuuggcugcugaaggcu

SEQ ID NO: 936559 - RNA, 21 nt, Homo sapiens
gaaaacaugcuacacacugca

SEQ ID NO: 936560 - RNA, 22 nt, Homo sapiens
gaaaaucgugacaacacuugug

SEQ ID NO: 936561 - RNA, 16 nt, Homo sapiens
gaaaauggaagacagc

SEQ ID NO: 936562 - RNA, 13 nt, Homo sapiens
gaaacugcacugu

SEQ ID NO: 936563 - RNA, 18 nt, Homo sapiens
gaaagaccgugugugaaa

SEQ ID NO: 936564 - RNA, 15 nt, Homo sapiens
gaaagugaccauguu

SEQ ID NO: 936565 - RNA, 17 nt, Homo sapiens
gaaaugagcugcacucc

SEQ ID NO: 936566 - RNA, 14 nt, Homo sapiens
gaacacuccuucac

SEQ ID NO: 936567 - RNA, 12 nt, Homo sapiens
gaaccaagaacu

SEQ ID NO: 936568 - RNA, 21 nt, Homo sapiens
gaaccacucuaucaaguauua

SEQ ID NO: 936569 - RNA, 12 nt, Homo sapiens
gaaccauaucaa

SEQ ID NO: 936570 - RNA, 21 nt, Homo sapiens
gaacucuucaaucucuugcac

SEQ ID NO: 936571 - RNA, 16 nt, Homo sapiens
gaacuggguacuugug

SEQ ID NO: 936572 - RNA, 17 nt, Homo sapiens
gaagaauugaaaaacca

SEQ ID NO: 936573 - RNA, 17 nt, Homo sapiens
gaagacaaugacuuacu

SEQ ID NO: 936574 - RNA, 12 nt, Homo sapiens
gaagcacagcuu

SEQ ID NO: 936575 - RNA, 22 nt, Homo sapiens
gaagcacaugccucucucaggc

SEQ ID NO: 936576 - RNA, 12 nt, Homo sapiens
gaagcauuuacu

SEQ ID NO: 936577 - RNA, 14 nt, Homo sapiens
gaagucacacagua

SEQ ID NO: 936578 - RNA, 16 nt, Homo sapiens
gaagucuuuguacaga

SEQ ID NO: 936579 - RNA, 15 nt, Homo sapiens
aaaaagaaugcagag

SEQ ID NO: 936580 - RNA, 20 nt, Homo sapiens
aaaaaggaugcauucccuac

SEQ ID NO: 936581 - RNA, 11 nt, Homo sapiens
gguggggaccu

SEQ ID NO: 936582 - RNA, 20 nt, Homo sapiens
ggugugaaccaccacaccca

SEQ ID NO: 936583 - RNA, 15 nt, Homo sapiens
guaaggaauaccugu

SEQ ID NO: 936584 - RNA, 20 nt, Homo sapiens
guaauuaaguacuauguauc

SEQ ID NO: 936585 - RNA, 20 nt, Homo sapiens
guaauuugugauacaaugcu

SEQ ID NO: 936586 - RNA, 23 nt, Homo sapiens
guaauuuuuuuaucgucacugcu

SEQ ID NO: 936587 - RNA, 22 nt, Homo sapiens
guacauggaauaacauguaauu

SEQ ID NO: 936588 - RNA, 15 nt, Homo sapiens
guacguugugcauuu

SEQ ID NO: 936589 - RNA, 16 nt, Homo sapiens
guacuauguaucaaug

SEQ ID NO: 936590 - RNA, 13 nt, Homo sapiens
guacucuccugga

SEQ ID NO: 936591 - RNA, 19 nt, Homo sapiens
guacuggagaaaauggacg

SEQ ID NO: 936592 - RNA, 20 nt, Homo sapiens
guacuggagaaaauggacgu

SEQ ID NO: 936593 - RNA, 15 nt, Homo sapiens
guaggaagacuuugg

SEQ ID NO: 936594 - RNA, 14 nt, Homo sapiens
gucagcacuaccuc

SEQ ID NO: 936595 - RNA, 13 nt, Homo sapiens
gucccccuuccau

SEQ ID NO: 936596 - RNA, 16 nt, Homo sapiens
guccccgcacugggcu

SEQ ID NO: 936597 - RNA, 22 nt, Homo sapiens
uccugugugugcgccuacagga

SEQ ID NO: 936598 - RNA, 16 nt, Homo sapiens
uccuguucccaugaga

SEQ ID NO: 936599 - RNA, 15 nt, Homo sapiens
uccuucauucaaccc

SEQ ID NO: 936600 - RNA, 17 nt, Homo sapiens
uccuucauucaacccac

SEQ ID NO: 936601 - RNA, 11 nt, Homo sapiens
uccuucuuccc

SEQ ID NO: 936602 - RNA, 17 nt, Homo sapiens
uccuuuagcgcccaguu

SEQ ID NO: 936603 - RNA, 14 nt, Homo sapiens
uccuuucaccacau

SEQ ID NO: 936604 - RNA, 21 nt, Homo sapiens
ucgagccacaaccgaccagau

SEQ ID NO: 936605 - RNA, 23 nt, Homo sapiens
ucggcgccuuaaggauguucuag

SEQ ID NO: 936606 - RNA, 12 nt, Homo sapiens
ucuaaagcugcc

SEQ ID NO: 936607 - RNA, 18 nt, Homo sapiens
ucuaaaggcuaccuuugu

SEQ ID NO: 936608 - RNA, 23 nt, Homo sapiens
ucuaugggacucaaugcacugac

SEQ ID NO: 936609 - RNA, 20 nt, Homo sapiens
ucucaaacucuugaccucag

SEQ ID NO: 936610 - RNA, 17 nt, Homo sapiens
ucucaacugagugagca

SEQ ID NO: 936611 - RNA, 16 nt, Homo sapiens
ucucacuguugcccag

SEQ ID NO: 936612 - RNA, 19 nt, Homo sapiens
ucucagauuguaccauuga

SEQ ID NO: 936613 - RNA, 21 nt, Homo sapiens
ucugagacucgcgacaaugca

SEQ ID NO: 936614 - RNA, 22 nt, Homo sapiens
ucugauccuaguuccaccauca

SEQ ID NO: 936615 - RNA, 19 nt, Homo sapiens
ucugccucugacacacagc

SEQ ID NO: 936616 - RNA, 20 nt, Homo sapiens
ucuguuggccagugugacaa

SEQ ID NO: 936617 - RNA, 17 nt, Homo sapiens
ucuuaauucuuagcuca

SEQ ID NO: 936618 - RNA, 21 nt, Homo sapiens
ucuuagauguauauauuuccu

SEQ ID NO: 936619 - RNA, 14 nt, Homo sapiens
ucuuauauugccau

SEQ ID NO: 936620 - RNA, 13 nt, Homo sapiens
ucuuccccagaua

SEQ ID NO: 936621 - RNA, 13 nt, Homo sapiens
ucuugaagacuuu

SEQ ID NO: 936622 - RNA, 22 nt, Homo sapiens
ucuugaccucaggugauccacc

SEQ ID NO: 936623 - RNA, 17 nt, Homo sapiens
ucuugauucauaaugac

SEQ ID NO: 936624 - RNA, 21 nt, Homo sapiens
ucuuucagccaagaauucuua

SEQ ID NO: 936625 - RNA, 20 nt, Homo sapiens
ucuuugcagacaggcaagca

SEQ ID NO: 936626 - RNA, 14 nt, Homo sapiens
ucuuuggacccuga

SEQ ID NO: 936627 - RNA, 17 nt, Homo sapiens
ugaaaaaauaacacugu

SEQ ID NO: 936628 - RNA, 13 nt, Homo sapiens
ugaaaacacuguu

SEQ ID NO: 936629 - RNA, 16 nt, Homo sapiens
ugaaaauucuugauaa

SEQ ID NO: 936630 - RNA, 15 nt, Homo sapiens
ugaaacaacccaaag

SEQ ID NO: 936631 - RNA, 21 nt, Homo sapiens
ugaaauaucaagagagguuaa

SEQ ID NO: 936632 - RNA, 21 nt, Homo sapiens
ugaacuccuggccucaaguga

SEQ ID NO: 936633 - RNA, 13 nt, Homo sapiens
ugaagcugagaug

SEQ ID NO: 936634 - RNA, 16 nt, Homo sapiens
ugaagucacacaguga

SEQ ID NO: 936635 - RNA, 15 nt, Homo sapiens
ugaaugaugccauga

SEQ ID NO: 936636 - RNA, 18 nt, Homo sapiens
ugaaugaugccaugagga

SEQ ID NO: 936637 - RNA, 17 nt, Homo sapiens
ugaauuuuggcuguguc

SEQ ID NO: 936638 - RNA, 22 nt, Homo sapiens
ugacaaggggcaguggugguuu

SEQ ID NO: 936639 - RNA, 13 nt, Homo sapiens
ugacacacagcuc

SEQ ID NO: 936640 - RNA, 14 nt, Homo sapiens
ugacaggcaaugcu

SEQ ID NO: 936641 - RNA, 21 nt, Homo sapiens
ugacccaugcugcccugugag

SEQ ID NO: 936642 - RNA, 18 nt, Homo sapiens
ugagaaaugccagugugc

SEQ ID NO: 936643 - RNA, 20 nt, Homo sapiens
ugagucaccaagcccaguua

SEQ ID NO: 936644 - RNA, 15 nt, Homo sapiens
ugaguccuggcaugg

SEQ ID NO: 936645 - RNA, 17 nt, Homo sapiens
ugauccacccaccucag

SEQ ID NO: 936646 - RNA, 15 nt, Homo sapiens
ugauuaugaauacag

SEQ ID NO: 936647 - RNA, 22 nt, Homo sapiens
ugauucuccugccucagccucc

SEQ ID NO: 936648 - RNA, 13 nt, Homo sapiens
ugcaaggucauuu

SEQ ID NO: 936649 - RNA, 13 nt, Homo sapiens
ugcacccaugugu

SEQ ID NO: 936650 - RNA, 16 nt, Homo sapiens
ugcacuccagccuggg

SEQ ID NO: 936651 - RNA, 20 nt, Homo sapiens
ugcagacucuacagaggcca

SEQ ID NO: 936652 - RNA, 23 nt, Homo sapiens
ugcagcucuggagguacgaaaag

SEQ ID NO: 936653 - RNA, 16 nt, Homo sapiens
ugcaugcugucccuua

SEQ ID NO: 936654 - RNA, 15 nt, Homo sapiens
ugcauuuggugguuu

SEQ ID NO: 936655 - RNA, 19 nt, Homo sapiens
ugccagcuuaucucagggg

SEQ ID NO: 936656 - RNA, 20 nt, Homo sapiens
ugccagcuuaucucaggggu

SEQ ID NO: 936657 - RNA, 18 nt, Homo sapiens
ugccauauucuguuggcc

SEQ ID NO: 936658 - RNA, 23 nt, Homo sapiens
ugccauccucccaaggggcccaa

SEQ ID NO: 936659 - RNA, 19 nt, Homo sapiens
ugcccacgcuggagugcag

SEQ ID NO: 936660 - RNA, 20 nt, Homo sapiens
ugcccacgcuggagugcagu

SEQ ID NO: 936661 - RNA, 18 nt, Homo sapiens
ugccgucuaccugagggg

SEQ ID NO: 936662 - RNA, 18 nt, Homo sapiens
ugccucgaacuggcugca

SEQ ID NO: 936663 - RNA, 13 nt, Homo sapiens
ugccucucucagg

SEQ ID NO: 936664 - RNA, 17 nt, Homo sapiens
ugccucugccucugaca

SEQ ID NO: 936665 - RNA, 22 nt, Homo sapiens
ugccuuauggaacacucugaga

SEQ ID NO: 936666 - RNA, 21 nt, Homo sapiens
ugcuuuuuaaagaaugcucuu

SEQ ID NO: 936667 - RNA, 18 nt, Homo sapiens
uggaaagaguaggaagac

SEQ ID NO: 936668 - RNA, 11 nt, Homo sapiens
uggaagacagc

SEQ ID NO: 936669 - RNA, 14 nt, Homo sapiens
uggaauaacaugua

SEQ ID NO: 936670 - RNA, 17 nt, Homo sapiens
uggaauaaggagaauga

SEQ ID NO: 936671 - RNA, 22 nt, Homo sapiens
uggaauuuugugcccccaugua

SEQ ID NO: 936672 - RNA, 13 nt, Homo sapiens
uggauguucugac

SEQ ID NO: 936673 - RNA, 13 nt, Homo sapiens
uggcccacgcacu

SEQ ID NO: 936674 - RNA, 16 nt, Homo sapiens
uggcccacgcacuucg

SEQ ID NO: 936675 - RNA, 14 nt, Homo sapiens
uggcuuuugugcau

SEQ ID NO: 936676 - RNA, 12 nt, Homo sapiens
ugggacacaguu

SEQ ID NO: 936677 - RNA, 15 nt, Homo sapiens
ugggacacccuguga

SEQ ID NO: 936678 - RNA, 16 nt, Homo sapiens
ugggacacccugugau

SEQ ID NO: 936679 - RNA, 15 nt, Homo sapiens
ugggagaaccaaaaa

SEQ ID NO: 936680 - RNA, 16 nt, Homo sapiens
ugggcagagcagagac

SEQ ID NO: 936681 - RNA, 18 nt, Homo sapiens
ugggcccaaugcacuuug

SEQ ID NO: 936682 - RNA, 19 nt, Homo sapiens
ugggcuggugucaccugaa

SEQ ID NO: 936683 - RNA, 18 nt, Homo sapiens
ugggguacccacugcucu

SEQ ID NO: 936684 - RNA, 18 nt, Homo sapiens
uggguacuuguggacaca

SEQ ID NO: 936685 - RNA, 20 nt, Homo sapiens
ugggugacagagcaagugag

SEQ ID NO: 936686 - RNA, 23 nt, Homo sapiens
uggguugcaggaccucaggugag

SEQ ID NO: 936687 - RNA, 12 nt, Homo sapiens
ugguaugaucac

SEQ ID NO: 936688 - RNA, 14 nt, Homo sapiens
uggucagauuugaa

SEQ ID NO: 936689 - RNA, 15 nt, Homo sapiens
uggucccccuuccau

SEQ ID NO: 936690 - RNA, 20 nt, Homo sapiens
uggucguuuucaacagaauu

SEQ ID NO: 936691 - RNA, 16 nt, Homo sapiens
ugguggacaugcacag

SEQ ID NO: 936692 - RNA, 14 nt, Homo sapiens
ugguucaggguugg

SEQ ID NO: 936693 - RNA, 15 nt, Homo sapiens
ugguucccauuugcu

SEQ ID NO: 936694 - RNA, 22 nt, Homo sapiens
uguaagcucuacugaggugcua

SEQ ID NO: 936695 - RNA, 18 nt, Homo sapiens
uguacgucugacaggcaa

SEQ ID NO: 936696 - RNA, 12 nt, Homo sapiens
uguaucaugaca

SEQ ID NO: 936697 - RNA, 24 nt, Homo sapiens
ugucacuuuccucuuccacuuuga

SEQ ID NO: 936698 - RNA, 16 nt, Homo sapiens
ugucccugcacuugca

SEQ ID NO: 936699 - RNA, 17 nt, Homo sapiens
uguccuacccacccucc

SEQ ID NO: 936700 - RNA, 18 nt, Homo sapiens
ugucuuuuuucacuacau

SEQ ID NO: 936701 - RNA, 23 nt, Homo sapiens
ugugaaacuggauuaaacuuaau

SEQ ID NO: 936702 - RNA, 17 nt, Homo sapiens
ugugccugaagucccag

SEQ ID NO: 936703 - RNA, 17 nt, Homo sapiens
uguggaugauaaaacac

SEQ ID NO: 936704 - RNA, 14 nt, Homo sapiens
uguggcgcagcaua

SEQ ID NO: 936705 - RNA, 15 nt, Homo sapiens
uguuacugucuucag

SEQ ID NO: 936706 - RNA, 17 nt, Homo sapiens
uguuagugguuacccag

SEQ ID NO: 936707 - RNA, 17 nt, Homo sapiens
uguucaugcacacuugc

SEQ ID NO: 936708 - RNA, 19 nt, Homo sapiens
uguuucugcagccacuauu

SEQ ID NO: 936709 - RNA, 22 nt, Homo sapiens
uuaaaauaaauuuguaugcuca

SEQ ID NO: 936710 - RNA, 16 nt, Homo sapiens
acuuagguguggggga

SEQ ID NO: 936711 - RNA, 17 nt, Homo sapiens
acuugauguguuaucuc

SEQ ID NO: 936712 - RNA, 17 nt, Homo sapiens
acuuggaaaugggagac

SEQ ID NO: 936713 - RNA, 16 nt, Homo sapiens
acuuguggacacagcu

SEQ ID NO: 936714 - RNA, 16 nt, Homo sapiens
acuuuaccugaaacaa

SEQ ID NO: 936715 - RNA, 12 nt, Homo sapiens
acuuugauacca

SEQ ID NO: 936716 - RNA, 20 nt, Homo sapiens
acuuuucuuucagccaagaa

SEQ ID NO: 936717 - RNA, 16 nt, Homo sapiens
agaaaaaggaugcauu

SEQ ID NO: 936718 - RNA, 15 nt, Homo sapiens
agaaaacuguuaaua

SEQ ID NO: 936719 - RNA, 19 nt, Homo sapiens
agaaaauggacguguuaug

SEQ ID NO: 936720 - RNA, 14 nt, Homo sapiens
agaaaguacuucuc

SEQ ID NO: 936721 - RNA, 18 nt, Homo sapiens
ccgugugugaaauucucu

SEQ ID NO: 936722 - RNA, 19 nt, Homo sapiens
ccuauauuguuuucagugu

SEQ ID NO: 936723 - RNA, 15 nt, Homo sapiens
ccucaccccacugug

SEQ ID NO: 936724 - RNA, 22 nt, Homo sapiens
ccucagccucccaaagugcugg

SEQ ID NO: 936725 - RNA, 14 nt, Homo sapiens
ccucaggcaggugg

SEQ ID NO: 936726 - RNA, 17 nt, Homo sapiens
ccucaggcaggugggau

SEQ ID NO: 936727 - RNA, 13 nt, Homo sapiens
ccucaggugaucc

SEQ ID NO: 936728 - RNA, 20 nt, Homo sapiens
ccucauuagcauuuugcuaa

SEQ ID NO: 936729 - RNA, 13 nt, Homo sapiens
ccucuuccacuuu

SEQ ID NO: 936730 - RNA, 17 nt, Homo sapiens
ccucuuugagugaagcu

SEQ ID NO: 936731 - RNA, 20 nt, Homo sapiens
ccugaauuucucacaaagga

SEQ ID NO: 936732 - RNA, 21 nt, Homo sapiens
ccugcaguuauuaacacuaac

SEQ ID NO: 936733 - RNA, 12 nt, Homo sapiens
ccuggcaagaau

SEQ ID NO: 936734 - RNA, 19 nt, Homo sapiens
ccuguagucccauugaugu

SEQ ID NO: 936735 - RNA, 14 nt, Homo sapiens
ccuuagacaguccc

SEQ ID NO: 936736 - RNA, 22 nt, Homo sapiens
ccuugaaaacacuguucucugc

SEQ ID NO: 936737 - RNA, 19 nt, Homo sapiens
cgaaaagaggggaagagac

SEQ ID NO: 936738 - RNA, 23 nt, Homo sapiens
cgaauuuucacagccaugauucu

SEQ ID NO: 936739 - RNA, 13 nt, Homo sapiens
cgaccagacaccu

SEQ ID NO: 936740 - RNA, 22 nt, Homo sapiens
cgagauagccaaggccaaagga

SEQ ID NO: 936741 - RNA, 19 nt, Homo sapiens
cgagaucacgccacugcac

SEQ ID NO: 936742 - RNA, 20 nt, Homo sapiens
cgagauugcaccacugcacu

SEQ ID NO: 936743 - RNA, 17 nt, Homo sapiens
cgaugcagugcuuccaa

SEQ ID NO: 936744 - RNA, 18 nt, Homo sapiens
cgauuguuccugaaccga

SEQ ID NO: 936745 - RNA, 23 nt, Homo sapiens
cgccagauucuuuccugaggcug

SEQ ID NO: 936746 - RNA, 11 nt, Homo sapiens
cgcgugcacac

SEQ ID NO: 936747 - RNA, 16 nt, Homo sapiens
cgcuggaccuugaacu

SEQ ID NO: 936748 - RNA, 15 nt, Homo sapiens
cgcuggagugcagug

SEQ ID NO: 936749 - RNA, 15 nt, Homo sapiens
cgugugacuacuccc

SEQ ID NO: 936750 - RNA, 22 nt, Homo sapiens
cuaaaugugaaugaugauccua

SEQ ID NO: 936751 - RNA, 18 nt, Homo sapiens
cuaacuuuccuucauuca

SEQ ID NO: 936752 - RNA, 23 nt, Homo sapiens
cuaagugaggaugaaaaaauaac

SEQ ID NO: 936753 - RNA, 23 nt, Homo sapiens
cuaagugauccucccaccucagc

SEQ ID NO: 936754 - RNA, 12 nt, Homo sapiens
cuaaugggacac

SEQ ID NO: 936755 - RNA, 19 nt, Homo sapiens
cuacauggaguauauguca

SEQ ID NO: 936756 - RNA, 16 nt, Homo sapiens
cuacccuggcacuaua

SEQ ID NO: 936757 - RNA, 18 nt, Homo sapiens
cuacuguaauuugugaua

SEQ ID NO: 936758 - RNA, 16 nt, Homo sapiens
cuagguucgaauccag

SEQ ID NO: 936759 - RNA, 16 nt, Homo sapiens
cuaguugucacuuucc

SEQ ID NO: 936760 - RNA, 18 nt, Homo sapiens
cuauagccuaggugacag

SEQ ID NO: 936761 - RNA, 23 nt, Homo sapiens
cuauagccuaggugacagaguga

SEQ ID NO: 936762 - RNA, 12 nt, Homo sapiens
cuaugcauuuga

SEQ ID NO: 936763 - RNA, 11 nt, Homo sapiens
cuaugggacuc

SEQ ID NO: 936764 - RNA, 19 nt, Homo sapiens
cuauguugcccaggcaggu

SEQ ID NO: 936765 - RNA, 20 nt, Homo sapiens
cucaaacucuugaccucagg

SEQ ID NO: 936766 - RNA, 22 nt, Homo sapiens
cucaagugauucuccugccuca

SEQ ID NO: 936767 - RNA, 17 nt, Homo sapiens
cucacauuuauucugcu

SEQ ID NO: 936768 - RNA, 14 nt, Homo sapiens
cucaccugccccuc

SEQ ID NO: 936769 - RNA, 18 nt, Homo sapiens
cucaggaguuugagacca

SEQ ID NO: 936770 - RNA, 14 nt, Homo sapiens
cucauacucaccuc

SEQ ID NO: 936771 - RNA, 18 nt, Homo sapiens
cuccaagaccuucuccuu

SEQ ID NO: 936772 - RNA, 14 nt, Homo sapiens
cucccacaaaggag

SEQ ID NO: 936773 - RNA, 16 nt, Homo sapiens
cucccaggcauucccc

SEQ ID NO: 936774 - RNA, 14 nt, Homo sapiens
cuccccgggcagca

SEQ ID NO: 936775 - RNA, 19 nt, Homo sapiens
cuccccgggcagcagagag

SEQ ID NO: 936776 - RNA, 20 nt, Homo sapiens
cuccuggccucaagugauuc

SEQ ID NO: 936777 - RNA, 21 nt, Homo sapiens
cuccugguguggaagagcucc

SEQ ID NO: 936778 - RNA, 24 nt, Homo sapiens
cuccuuucaccacaugugcacaug

SEQ ID NO: 936779 - RNA, 22 nt, Homo sapiens
cucuacccucuuagaaaaacca

SEQ ID NO: 936780 - RNA, 21 nt, Homo sapiens
cucuacucuagggaaaaacca

SEQ ID NO: 936781 - RNA, 16 nt, Homo sapiens
cucuauuaaaauuacu

SEQ ID NO: 936782 - RNA, 15 nt, Homo sapiens
cucucaggccaaacu

SEQ ID NO: 936783 - RNA, 18 nt, Homo sapiens
cucucaggccaaacucac

SEQ ID NO: 936784 - RNA, 15 nt, Homo sapiens
cucuccgaccagaca

SEQ ID NO: 936785 - RNA, 13 nt, Homo sapiens
cucugaaaaccaa

SEQ ID NO: 936786 - RNA, 21 nt, Homo sapiens
cucugaggacacuaaccacgc

SEQ ID NO: 936787 - RNA, 14 nt, Homo sapiens
cucugcauguuaca

SEQ ID NO: 936788 - RNA, 18 nt, Homo sapiens
cucuggcuaaauucaugc

SEQ ID NO: 936789 - RNA, 14 nt, Homo sapiens
cucugguccauaga

SEQ ID NO: 936790 - RNA, 14 nt, Homo sapiens
cucugugucaggug

SEQ ID NO: 936791 - RNA, 17 nt, Homo sapiens
cucuuauccaacaucaa

SEQ ID NO: 936792 - RNA, 23 nt, Homo sapiens
cucuucuccaccucccacaaagg

SEQ ID NO: 936793 - RNA, 19 nt, Homo sapiens
cucuuucccucccuuccuc

SEQ ID NO: 936794 - RNA, 18 nt, Homo sapiens
cucuuugggccuggcucc

SEQ ID NO: 936795 - RNA, 11 nt, Homo sapiens
cugaaaaccaa

SEQ ID NO: 936796 - RNA, 21 nt, Homo sapiens
cugaagucuuuguacagacaa

SEQ ID NO: 936797 - RNA, 13 nt, Homo sapiens
cugacccacugcu

SEQ ID NO: 936798 - RNA, 19 nt, Homo sapiens
cugacccugcuucaaauau

SEQ ID NO: 936799 - RNA, 20 nt, Homo sapiens
cugaucucucgugauugaua

SEQ ID NO: 936800 - RNA, 19 nt, Homo sapiens
cugauucccaagcucugcu

SEQ ID NO: 936801 - RNA, 14 nt, Homo sapiens
cugcacuccagccu

SEQ ID NO: 936802 - RNA, 21 nt, Homo sapiens
cugcagcuuuguuuguuguca

SEQ ID NO: 936803 - RNA, 16 nt, Homo sapiens
cugcaucaagauguga

SEQ ID NO: 936804 - RNA, 18 nt, Homo sapiens
cugcaucaagaugugaca

SEQ ID NO: 936805 - RNA, 12 nt, Homo sapiens
cugcauguuaca

SEQ ID NO: 936806 - RNA, 19 nt, Homo sapiens
cugccauauucuguuggcc

SEQ ID NO: 936807 - RNA, 15 nt, Homo sapiens
cugccugaagucaca

SEQ ID NO: 936808 - RNA, 18 nt, Homo sapiens
cugccuguugggccagga

SEQ ID NO: 936809 - RNA, 17 nt, Homo sapiens
cugcuuccagugaggcu

SEQ ID NO: 936810 - RNA, 13 nt, Homo sapiens
cuggagugcagug

SEQ ID NO: 936811 - RNA, 22 nt, Homo sapiens
cuggaugcagccucacaguccu

SEQ ID NO: 936812 - RNA, 20 nt, Homo sapiens
cuggcagaguugaagacaga

SEQ ID NO: 936813 - RNA, 21 nt, Homo sapiens
cuggccccucagggucccugg

SEQ ID NO: 936814 - RNA, 13 nt, Homo sapiens
cuggcgugcagug

SEQ ID NO: 936815 - RNA, 20 nt, Homo sapiens
cuggcgugcaguggugcgau

SEQ ID NO: 936816 - RNA, 17 nt, Homo sapiens
cugggacuacaggugug

SEQ ID NO: 936817 - RNA, 18 nt, Homo sapiens
cugggauuacagguguga

SEQ ID NO: 936818 - RNA, 22 nt, Homo sapiens
cugggcagaggaaagcaaagga

SEQ ID NO: 936819 - RNA, 12 nt, Homo sapiens
cuggggugggag

SEQ ID NO: 936820 - RNA, 13 nt, Homo sapiens
cugugauggggcc

SEQ ID NO: 936821 - RNA, 18 nt, Homo sapiens
cuguggaugauaaaacac

SEQ ID NO: 936822 - RNA, 16 nt, Homo sapiens
ggccccugcccggcug

SEQ ID NO: 936823 - RNA, 19 nt, Homo sapiens
ggccgggcgcgguggcuca

SEQ ID NO: 936824 - RNA, 17 nt, Homo sapiens
ggccuggucguuuucaa

SEQ ID NO: 936825 - RNA, 13 nt, Homo sapiens
ggcggugagcaau

SEQ ID NO: 936826 - RNA, 15 nt, Homo sapiens
ggcuaugugagcaca

SEQ ID NO: 936827 - RNA, 16 nt, Homo sapiens
gggacucaaugcacug

SEQ ID NO: 936828 - RNA, 22 nt, Homo sapiens
gggccuggccugagcugggaug

SEQ ID NO: 936829 - RNA, 15 nt, Homo sapiens
gggcuggaagcagaa

SEQ ID NO: 936830 - RNA, 22 nt, Homo sapiens
ggggcccaaauucuuucagugg

SEQ ID NO: 936831 - RNA, 11 nt, Homo sapiens
ggggugcccuc

SEQ ID NO: 936832 - RNA, 13 nt, Homo sapiens
ggguucacugcaa

SEQ ID NO: 936833 - RNA, 13 nt, Homo sapiens
gguaucaggugcu

SEQ ID NO: 936834 - RNA, 18 nt, Homo sapiens
gguaugaucacggcucac

SEQ ID NO: 936835 - RNA, 21 nt, Homo sapiens
gguggaugccugguggcagcu

SEQ ID NO: 936836 - RNA, 20 nt, Homo sapiens
ggugggagugggcccaaugc

SEQ ID NO: 936837 - RNA, 16 nt, Homo sapiens
gguuucuaaagcugcc

SEQ ID NO: 936838 - RNA, 15 nt, Homo sapiens
gguuuuacugcagcu

SEQ ID NO: 936839 - RNA, 18 nt, Homo sapiens
guaaaugggggugcauuu

SEQ ID NO: 936840 - RNA, 21 nt, Homo sapiens
guaaaugggggugcauuugag

SEQ ID NO: 936841 - RNA, 13 nt, Homo sapiens
guaacuuacuuag

SEQ ID NO: 936842 - RNA, 14 nt, Homo sapiens
guaagcucuacuga

SEQ ID NO: 936843 - RNA, 12 nt, Homo sapiens
guaaggcugugg

SEQ ID NO: 936844 - RNA, 14 nt, Homo sapiens
guacgggaggguaa

SEQ ID NO: 936845 - RNA, 20 nt, Homo sapiens
guagagacaggguuuugcca

SEQ ID NO: 936846 - RNA, 22 nt, Homo sapiens
guagagacaggguuuugccaug

SEQ ID NO: 936847 - RNA, 15 nt, Homo sapiens
guaugaggcauuugu

SEQ ID NO: 936848 - RNA, 14 nt, Homo sapiens
guaugguaggguaa

SEQ ID NO: 936849 - RNA, 15 nt, Homo sapiens
guauucuuauuuaau

SEQ ID NO: 936850 - RNA, 18 nt, Homo sapiens
gucacacacuuuggcuau

SEQ ID NO: 936851 - RNA, 22 nt, Homo sapiens
gucaccaaaucagcugcuacua

SEQ ID NO: 936852 - RNA, 18 nt, Homo sapiens
gucacuuuccucuuccac

SEQ ID NO: 936853 - RNA, 17 nt, Homo sapiens
gucuugcaauggcagcc

SEQ ID NO: 936854 - RNA, 23 nt, Homo sapiens
gugaagacaaugacuuacuguac

SEQ ID NO: 936855 - RNA, 21 nt, Homo sapiens
gugagcacuaaggugugcucu

SEQ ID NO: 936856 - RNA, 13 nt, Homo sapiens
gugauccucccac

SEQ ID NO: 936857 - RNA, 18 nt, Homo sapiens
gugcacguacacacacau

SEQ ID NO: 936858 - RNA, 23 nt, Homo sapiens
gugccaagcagagguugggaggc

SEQ ID NO: 936859 - RNA, 20 nt, Homo sapiens
gugcccccacccccacccuc

SEQ ID NO: 936860 - RNA, 17 nt, Homo sapiens
gugcucugaucauccac

SEQ ID NO: 936861 - RNA, 17 nt, Homo sapiens
gugggaggggaagaaaa

SEQ ID NO: 936862 - RNA, 20 nt, Homo sapiens
guguuuauauauaagccaaa

SEQ ID NO: 936863 - RNA, 14 nt, Homo sapiens
guuacugucuucag

SEQ ID NO: 936864 - RNA, 22 nt, Homo sapiens
guuauaauaauguuaacaugga

SEQ ID NO: 936865 - RNA, 16 nt, Homo sapiens
guucagguaacaggca

SEQ ID NO: 936866 - RNA, 16 nt, Homo sapiens
guucaugcacacuugc

SEQ ID NO: 936867 - RNA, 13 nt, Homo sapiens
guucccaugagau

SEQ ID NO: 936868 - RNA, 15 nt, Homo sapiens
guugaaagaucaaaa

SEQ ID NO: 936869 - RNA, 19 nt, Homo sapiens
guugcaggaccucagguga

SEQ ID NO: 936870 - RNA, 18 nt, Homo sapiens
guuuagcccaaaaccaag

SEQ ID NO: 936871 - RNA, 16 nt, Homo sapiens
guuugaaccaagaacu

SEQ ID NO: 936872 - RNA, 22 nt, Homo sapiens
guuuuuauggcuuuugugcauu

SEQ ID NO: 936873 - RNA, 15 nt, Homo sapiens
uaaaaauccccaaaa

SEQ ID NO: 936874 - RNA, 18 nt, Homo sapiens
uaaaacccaagugccuua

SEQ ID NO: 936875 - RNA, 22 nt, Homo sapiens
uaaaguuucuguugauaaucau

SEQ ID NO: 936876 - RNA, 12 nt, Homo sapiens
uaaauagcucag

SEQ ID NO: 936877 - RNA, 19 nt, Homo sapiens
uaaaugggggugcauuuga

SEQ ID NO: 936878 - RNA, 19 nt, Homo sapiens
uaacaccaugauuaaccac

SEQ ID NO: 936879 - RNA, 19 nt, Homo sapiens
uaaccaguguuguggauuu

SEQ ID NO: 936880 - RNA, 15 nt, Homo sapiens
uaagagaaaugagcu

SEQ ID NO: 936881 - RNA, 12 nt, Homo sapiens
uaagccaaaaaa

SEQ ID NO: 936882 - RNA, 20 nt, Homo sapiens
uaagcucuacugaggugcua

SEQ ID NO: 936883 - RNA, 20 nt, Homo sapiens
uaaguacuauguaucaauga

SEQ ID NO: 936884 - RNA, 23 nt, Homo sapiens
uaaguacuauguaucaaugagua

SEQ ID NO: 936885 - RNA, 23 nt, Homo sapiens
uaagugaggaugaaaaaauaaca

SEQ ID NO: 936886 - RNA, 13 nt, Homo sapiens
uaaugggacacua

SEQ ID NO: 936887 - RNA, 14 nt, Homo sapiens
uaauguaagcucua

SEQ ID NO: 936888 - RNA, 15 nt, Homo sapiens
uacaaaagcauguga

SEQ ID NO: 936889 - RNA, 22 nt, Homo sapiens
uacaaaaguuuaaaaagcucac

SEQ ID NO: 936890 - RNA, 23 nt, Homo sapiens
uacagacaaagcgugguggacau

SEQ ID NO: 936891 - RNA, 17 nt, Homo sapiens
uacaggugugagucacc

SEQ ID NO: 936892 - RNA, 23 nt, Homo sapiens
uaccugaagucuuuguacagaca

SEQ ID NO: 936893 - RNA, 18 nt, Homo sapiens
uacgugaguccuggcaug

SEQ ID NO: 936894 - RNA, 20 nt, Homo sapiens
uacuaacuuuccuucauuca

SEQ ID NO: 936895 - RNA, 19 nt, Homo sapiens
uacuacaguccucccaucu

SEQ ID NO: 936896 - RNA, 20 nt, Homo sapiens
uacucaccucaccccacugu

SEQ ID NO: 936897 - RNA, 21 nt, Homo sapiens
uacugaugcagaaagaccgug

SEQ ID NO: 936898 - RNA, 20 nt, Homo sapiens
uagaauuugggggaaaauuu

SEQ ID NO: 936899 - RNA, 16 nt, Homo sapiens
uagacagagucucacu

SEQ ID NO: 936900 - RNA, 14 nt, Homo sapiens
uagaguugauacua

SEQ ID NO: 936901 - RNA, 12 nt, Homo sapiens
uagauacuguau

SEQ ID NO: 936902 - RNA, 14 nt, Homo sapiens
uagcccaaaaccaa

SEQ ID NO: 936903 - RNA, 22 nt, Homo sapiens
uagccugccucuucucuacucu

SEQ ID NO: 936904 - RNA, 16 nt, Homo sapiens
uaggaacacuccuuca

SEQ ID NO: 936905 - RNA, 19 nt, Homo sapiens
uaggaagguuaauguucau

SEQ ID NO: 936906 - RNA, 14 nt, Homo sapiens
uagugguuacccag

SEQ ID NO: 936907 - RNA, 19 nt, Homo sapiens
uaguuugcaguuacacuaa

SEQ ID NO: 936908 - RNA, 19 nt, Homo sapiens
uauaagauucauauuuacu

SEQ ID NO: 936909 - RNA, 16 nt, Homo sapiens
uauaauguaagcucua

SEQ ID NO: 936910 - RNA, 23 nt, Homo sapiens
uauacacuuacacuuuaugcaca

SEQ ID NO: 936911 - RNA, 17 nt, Homo sapiens
uauacauaaacaagacc

SEQ ID NO: 936912 - RNA, 12 nt, Homo sapiens
uauacauuugau

SEQ ID NO: 936913 - RNA, 13 nt, Homo sapiens
uauauaagccaaa

SEQ ID NO: 936914 - RNA, 15 nt, Homo sapiens
uaucaggguauucca

SEQ ID NO: 936915 - RNA, 14 nt, Homo sapiens
uaucccuacuguaa

SEQ ID NO: 936916 - RNA, 18 nt, Homo sapiens
uaagagaaaugagcugca

SEQ ID NO: 936917 - RNA, 15 nt, Homo sapiens
uaaggaauaccuguc

SEQ ID NO: 936918 - RNA, 22 nt, Homo sapiens
uaaguacuauguaucaaugagu

SEQ ID NO: 936919 - RNA, 17 nt, Homo sapiens
uaaugacuuaagcacac

SEQ ID NO: 936920 - RNA, 15 nt, Homo sapiens
uaaugauagcuacug

SEQ ID NO: 936921 - RNA, 14 nt, Homo sapiens
uaauuaguuccuca

SEQ ID NO: 936922 - RNA, 21 nt, Homo sapiens
uacacacacacgcgugcacac

SEQ ID NO: 936923 - RNA, 13 nt, Homo sapiens
uacagacaacaaa

SEQ ID NO: 936924 - RNA, 15 nt, Homo sapiens
uacagauagauauau

SEQ ID NO: 936925 - RNA, 14 nt, Homo sapiens
uacaggaaguacug

SEQ ID NO: 936926 - RNA, 16 nt, Homo sapiens
uccccaagcaguguga

SEQ ID NO: 936927 - RNA, 15 nt, Homo sapiens
ucccugccaauggac

SEQ ID NO: 936928 - RNA, 16 nt, Homo sapiens
uccuaagcuauucagu

SEQ ID NO: 936929 - RNA, 15 nt, Homo sapiens
uccucccaccucagc

SEQ ID NO: 936930 - RNA, 19 nt, Homo sapiens
uccucuccccagcaaguga

SEQ ID NO: 936931 - RNA, 17 nt, Homo sapiens
uccugggcuaagugauc

SEQ ID NO: 936932 - RNA, 20 nt, Homo sapiens
uccugugucuugcaauggca

SEQ ID NO: 936933 - RNA, 17 nt, Homo sapiens
ucgaugcagugcuucca

SEQ ID NO: 936934 - RNA, 14 nt, Homo sapiens
ucgcgugaugcgca

SEQ ID NO: 936935 - RNA, 22 nt, Homo sapiens
ucuaaacaaaaaaaggcgguga

SEQ ID NO: 936936 - RNA, 13 nt, Homo sapiens
ucuaaagcugcca

SEQ ID NO: 936937 - RNA, 22 nt, Homo sapiens
ucuaaauaauaauaaaacaaca

SEQ ID NO: 936938 - RNA, 14 nt, Homo sapiens
ucuacagaggccau

SEQ ID NO: 936939 - RNA, 13 nt, Homo sapiens
ucuacccaggugc

SEQ ID NO: 936940 - RNA, 14 nt, Homo sapiens
ucuacgccagggga

SEQ ID NO: 936941 - RNA, 15 nt, Homo sapiens
ucuacugaggugcua

SEQ ID NO: 936942 - RNA, 18 nt, Homo sapiens
ucucacacaugagcauca

SEQ ID NO: 936943 - RNA, 18 nt, Homo sapiens
ucucacuguugcccaggc

SEQ ID NO: 936944 - RNA, 12 nt, Homo sapiens
ucucaggccagc

SEQ ID NO: 936945 - RNA, 17 nt, Homo sapiens
ucucauacucaccucac

SEQ ID NO: 936946 - RNA, 17 nt, Homo sapiens
ucuccaccugccaggga

SEQ ID NO: 936947 - RNA, 22 nt, Homo sapiens
ucucgugauugauaagaaccuu

SEQ ID NO: 936948 - RNA, 14 nt, Homo sapiens
ucucucgugauuga

SEQ ID NO: 936949 - RNA, 18 nt, Homo sapiens
ucucuugcacucaaagcu

SEQ ID NO: 936950 - RNA, 12 nt, Homo sapiens
ucugaaaaccaa

SEQ ID NO: 936951 - RNA, 13 nt, Homo sapiens
ucugacacacagc

SEQ ID NO: 936952 - RNA, 14 nt, Homo sapiens
ucugacacacagcu

SEQ ID NO: 936953 - RNA, 18 nt, Homo sapiens
ucugcugacagacacagg

SEQ ID NO: 936954 - RNA, 15 nt, Homo sapiens
ucuggcucuuccagg

SEQ ID NO: 936955 - RNA, 23 nt, Homo sapiens
ucuguggguuucuaaagcugcca

SEQ ID NO: 936956 - RNA, 20 nt, Homo sapiens
ucuguggucuaaacaaaaaa

SEQ ID NO: 936957 - RNA, 16 nt, Homo sapiens
ucuuauuuaaugaaag

SEQ ID NO: 936958 - RNA, 23 nt, Homo sapiens
ucuucuccaggcuguaucccaug

SEQ ID NO: 936959 - RNA, 22 nt, Homo sapiens
ucuugaaauauaggaacuuaaa

SEQ ID NO: 936960 - RNA, 15 nt, Homo sapiens
ucuuuguacagacaa

SEQ ID NO: 936961 - RNA, 13 nt, Homo sapiens
ugaaaaaauaaca

SEQ ID NO: 936962 - RNA, 13 nt, Homo sapiens
ugaaaauucuuga

SEQ ID NO: 936963 - RNA, 15 nt, Homo sapiens
ugaaaauucuugaua

SEQ ID NO: 936964 - RNA, 13 nt, Homo sapiens
ugaacagaacaaa

SEQ ID NO: 936965 - RNA, 15 nt, Homo sapiens
ugaacagaacaaaag

SEQ ID NO: 936966 - RNA, 17 nt, Homo sapiens
ugaaguaauaugcacac

SEQ ID NO: 936967 - RNA, 14 nt, Homo sapiens
ugaagucacacagu

SEQ ID NO: 936968 - RNA, 19 nt, Homo sapiens
ugaagucccagauacuugg

SEQ ID NO: 936969 - RNA, 15 nt, Homo sapiens
ugaaugucaguguga

SEQ ID NO: 936970 - RNA, 12 nt, Homo sapiens
ugacacacagcu

SEQ ID NO: 936971 - RNA, 14 nt, Homo sapiens
ugaccucaggugau

SEQ ID NO: 936972 - RNA, 16 nt, Homo sapiens
ugacuuaagcacacuu

SEQ ID NO: 936973 - RNA, 13 nt, Homo sapiens
ugacuuacuguac

SEQ ID NO: 936974 - RNA, 16 nt, Homo sapiens
ugagacccugucucaa

SEQ ID NO: 936975 - RNA, 17 nt, Homo sapiens
ugagacucugucucaaa

SEQ ID NO: 936976 - RNA, 15 nt, Homo sapiens
ugaggcugggcuccc

SEQ ID NO: 936977 - RNA, 18 nt, Homo sapiens
ugaguacguugugcauuu

SEQ ID NO: 936978 - RNA, 19 nt, Homo sapiens
ugaguacuacaguccuccc

SEQ ID NO: 936979 - RNA, 19 nt, Homo sapiens
ugaucacggcucacugcag

SEQ ID NO: 936980 - RNA, 18 nt, Homo sapiens
ugaucccuucuuacuuaa

SEQ ID NO: 936981 - RNA, 19 nt, Homo sapiens
ugauccuaggcauuugcug

SEQ ID NO: 936982 - RNA, 14 nt, Homo sapiens
ugaucuuugcagac

SEQ ID NO: 936983 - RNA, 13 nt, Homo sapiens
ugaugaucuuugc

SEQ ID NO: 936984 - RNA, 15 nt, Homo sapiens
ugauuaaauucuugc

SEQ ID NO: 936985 - RNA, 16 nt, Homo sapiens
ugauucagacagcugc

SEQ ID NO: 936986 - RNA, 14 nt, Homo sapiens
ugcacaaacagagg

SEQ ID NO: 936987 - RNA, 23 nt, Homo sapiens
ugcacagcuaacauggaaguacu

SEQ ID NO: 936988 - RNA, 16 nt, Homo sapiens
ugcagccucaaccucc

SEQ ID NO: 936989 - RNA, 16 nt, Homo sapiens
ugcaggaccucaggug

SEQ ID NO: 936990 - RNA, 18 nt, Homo sapiens
ugcagugguaugaucacg

SEQ ID NO: 936991 - RNA, 18 nt, Homo sapiens
ugcaucaagaugugacau

SEQ ID NO: 936992 - RNA, 18 nt, Homo sapiens
ugcaugaaguaauaugca

SEQ ID NO: 936993 - RNA, 21 nt, Homo sapiens
ugcauguuacauaagauaaau

SEQ ID NO: 936994 - RNA, 14 nt, Homo sapiens
ugccaaaaacaaca

SEQ ID NO: 936995 - RNA, 16 nt, Homo sapiens
ugccagcuuaucucag

SEQ ID NO: 936996 - RNA, 13 nt, Homo sapiens
ugcccacacuugg

SEQ ID NO: 936997 - RNA, 18 nt, Homo sapiens
ugcccggcaggguccuag

SEQ ID NO: 936998 - RNA, 22 nt, Homo sapiens
ugccucagccucccaaagugcu

SEQ ID NO: 936999 - RNA, 18 nt, Homo sapiens
ugccucugacacacagcu

SEQ ID NO: 937000 - RNA, 20 nt, Homo sapiens
ugccucugacacacagcucu

SEQ ID NO: 937001 - RNA, 21 nt, Homo sapiens
ugcgaucuggguucacugcaa

SEQ ID NO: 937002 - RNA, 20 nt, Homo sapiens
ugcggaaugaaccacaucuu

SEQ ID NO: 937003 - RNA, 16 nt, Homo sapiens
ugcgucucauacucac

SEQ ID NO: 937004 - RNA, 13 nt, Homo sapiens
ugcuaaaugugaa

SEQ ID NO: 937005 - RNA, 19 nt, Homo sapiens
ugcucacauaucugucauu

SEQ ID NO: 937006 - RNA, 18 nt, Homo sapiens
ugcuucaaccccaugaga

SEQ ID NO: 937007 - RNA, 13 nt, Homo sapiens
ugcuuugugauuu

SEQ ID NO: 937008 - RNA, 14 nt, Homo sapiens
uggaacacuaauga

SEQ ID NO: 937009 - RNA, 12 nt, Homo sapiens
uggacacagcuc

SEQ ID NO: 937010 - RNA, 20 nt, Homo sapiens
uggauuaaacuuaaucuaaa

SEQ ID NO: 937011 - RNA, 13 nt, Homo sapiens
uggcagcucagag

SEQ ID NO: 937012 - RNA, 17 nt, Homo sapiens
uggccccugcccggcug

SEQ ID NO: 937013 - RNA, 19 nt, Homo sapiens
uggcugggggccucagugc

SEQ ID NO: 937014 - RNA, 15 nt, Homo sapiens
uggcuuuugugcauu

SEQ ID NO: 937015 - RNA, 14 nt, Homo sapiens
ugggcaaugugaua

SEQ ID NO: 937016 - RNA, 12 nt, Homo sapiens
ugggcagaggaa

SEQ ID NO: 937017 - RNA, 19 nt, Homo sapiens
ugggcccccaaauggaaau

SEQ ID NO: 937018 - RNA, 22 nt, Homo sapiens
ugagcaauccugcaagaacaag

SEQ ID NO: 937019 - RNA, 20 nt, Homo sapiens
ugagcauuuagacucucgac

SEQ ID NO: 937020 - RNA, 13 nt, Homo sapiens
ugagccacugcac

SEQ ID NO: 937021 - RNA, 17 nt, Homo sapiens
ugaggaaacugcacugu

SEQ ID NO: 937022 - RNA, 23 nt, Homo sapiens
ugaggaugaaaaaauaacacugu

SEQ ID NO: 937023 - RNA, 20 nt, Homo sapiens
ugaggauuuugauccaagcu

SEQ ID NO: 937024 - RNA, 16 nt, Homo sapiens
ugaguacuacaguccu

SEQ ID NO: 937025 - RNA, 12 nt, Homo sapiens
ugagugccuuac

SEQ ID NO: 937026 - RNA, 14 nt, Homo sapiens
ugauaaccacuaag

SEQ ID NO: 937027 - RNA, 21 nt, Homo sapiens
ugaugccaugggcccucucag

SEQ ID NO: 937028 - RNA, 21 nt, Homo sapiens
ugauucuuuugcccacacuug

SEQ ID NO: 937029 - RNA, 22 nt, Homo sapiens
ugcaagaauugaagcaggacua

SEQ ID NO: 937030 - RNA, 17 nt, Homo sapiens
ugcacaugcacgugugu

SEQ ID NO: 937031 - RNA, 14 nt, Homo sapiens
ugcacgugugugca

SEQ ID NO: 937032 - RNA, 14 nt, Homo sapiens
ugcacuccaugagu

SEQ ID NO: 937033 - RNA, 24 nt, Homo sapiens
ugcacuuuguucuggcucuuccag

SEQ ID NO: 937034 - RNA, 23 nt, Homo sapiens
ugcagugguaugaucacggcuca

SEQ ID NO: 937035 - RNA, 17 nt, Homo sapiens
ugcaugaaguaauaugc

SEQ ID NO: 937036 - RNA, 15 nt, Homo sapiens
ugccaugccagcuua

SEQ ID NO: 937037 - RNA, 12 nt, Homo sapiens
ugccgcauuugg

SEQ ID NO: 937038 - RNA, 15 nt, Homo sapiens
ugccugaagucacac

SEQ ID NO: 937039 - RNA, 16 nt, Homo sapiens
ugccugguggcagcug

SEQ ID NO: 937040 - RNA, 19 nt, Homo sapiens
ugcugcuugaggcaacuca

SEQ ID NO: 937041 - RNA, 13 nt, Homo sapiens
ugcuucagccucc

SEQ ID NO: 937042 - RNA, 16 nt, Homo sapiens
ugcuuguacauaaugc

SEQ ID NO: 937043 - RNA, 14 nt, Homo sapiens
uggaagcacagcuu

SEQ ID NO: 937044 - RNA, 15 nt, Homo sapiens
uggaagcacagcuuc

SEQ ID NO: 937045 - RNA, 16 nt, Homo sapiens
uggacaugcacagcua

SEQ ID NO: 937046 - RNA, 19 nt, Homo sapiens
uggacccugaggcccagag

SEQ ID NO: 937047 - RNA, 19 nt, Homo sapiens
uggacuuccacugccaucc

SEQ ID NO: 937048 - RNA, 20 nt, Homo sapiens
uggagaaaauggacguguua

SEQ ID NO: 937049 - RNA, 19 nt, Homo sapiens
uggaggggggaggugggau

SEQ ID NO: 937050 - RNA, 22 nt, Homo sapiens
uggauguucugacccugcuuca

SEQ ID NO: 937051 - RNA, 12 nt, Homo sapiens
uggcaccagcag

SEQ ID NO: 937052 - RNA, 21 nt, Homo sapiens
uggcagugggagcugccuguu

SEQ ID NO: 937053 - RNA, 13 nt, Homo sapiens
uggcccacugcau

SEQ ID NO: 937054 - RNA, 15 nt, Homo sapiens
uggccucccaacuca

SEQ ID NO: 937055 - RNA, 16 nt, Homo sapiens
uggcuuuugugcauua

SEQ ID NO: 937056 - RNA, 14 nt, Homo sapiens
ugggacuacaggca

SEQ ID NO: 937057 - RNA, 22 nt, Homo sapiens
ugggacuacaggugugagucac

SEQ ID NO: 937058 - RNA, 15 nt, Homo sapiens
ugggaggccauuugu

SEQ ID NO: 937059 - RNA, 15 nt, Homo sapiens
ugggauggauuucca

SEQ ID NO: 937060 - RNA, 19 nt, Homo sapiens
ugggauuacaggugugaac

SEQ ID NO: 937061 - RNA, 14 nt, Homo sapiens
ugggccacugugaa

SEQ ID NO: 937062 - RNA, 16 nt, Homo sapiens
uggggauaugauuuaa

SEQ ID NO: 937063 - RNA, 16 nt, Homo sapiens
uggggcuggaagcaga

SEQ ID NO: 937064 - RNA, 21 nt, Homo sapiens
ugggguacccacugcucuggu

SEQ ID NO: 937065 - RNA, 13 nt, Homo sapiens
uggucaccaaauc

SEQ ID NO: 937066 - RNA, 18 nt, Homo sapiens
uggucccccuuccaugga

SEQ ID NO: 937067 - RNA, 13 nt, Homo sapiens
uggucugacccac

SEQ ID NO: 937068 - RNA, 12 nt, Homo sapiens
ugguggcagcuc

SEQ ID NO: 937069 - RNA, 15 nt, Homo sapiens
uguacagacaacaaa

SEQ ID NO: 937070 - RNA, 17 nt, Homo sapiens
uguacauggaauaacau

SEQ ID NO: 937071 - RNA, 21 nt, Homo sapiens
ugucagccauuccuguuccca

SEQ ID NO: 937072 - RNA, 17 nt, Homo sapiens
ugucauauaagauucau

SEQ ID NO: 937073 - RNA, 19 nt, Homo sapiens
uguccggucccugucccag

SEQ ID NO: 937074 - RNA, 24 nt, Homo sapiens
ugugcucugaucauccacugugcc

SEQ ID NO: 937075 - RNA, 18 nt, Homo sapiens
uguggaugauaaaacaca

SEQ ID NO: 937076 - RNA, 13 nt, Homo sapiens
uguggguuucuaa

SEQ ID NO: 937077 - RNA, 16 nt, Homo sapiens
ugugugcacguacaca

SEQ ID NO: 937078 - RNA, 14 nt, Homo sapiens
uguguuaucucuua

SEQ ID NO: 937079 - RNA, 18 nt, Homo sapiens
uguuaacauggacaugau

SEQ ID NO: 937080 - RNA, 21 nt, Homo sapiens
uguuaacauggacaugaucuu

SEQ ID NO: 937081 - RNA, 12 nt, Homo sapiens
uguuaugacucc

SEQ ID NO: 937082 - RNA, 16 nt, Homo sapiens
uguucaugcacacuug

SEQ ID NO: 937083 - RNA, 21 nt, Homo sapiens
uguucaugcacacuugcaccc

SEQ ID NO: 937084 - RNA, 13 nt, Homo sapiens
uguucccaugaga

SEQ ID NO: 937085 - RNA, 15 nt, Homo sapiens
uguuggccaguguga

SEQ ID NO: 937086 - RNA, 15 nt, Homo sapiens
uguuucugaaaggga

SEQ ID NO: 937087 - RNA, 20 nt, Homo sapiens
uuaaaacaacacucacauuu

SEQ ID NO: 937088 - RNA, 23 nt, Homo sapiens
uuaaauaaaucauaaaacuugau

SEQ ID NO: 937089 - RNA, 14 nt, Homo sapiens
uuaagagaaaugag

SEQ ID NO: 937090 - RNA, 17 nt, Homo sapiens
uuaagagaaaugagcug

SEQ ID NO: 937091 - RNA, 20 nt, Homo sapiens
uuaagaggcagggucucacu

SEQ ID NO: 937092 - RNA, 19 nt, Homo sapiens
uuaaggaugcuuguacaua

SEQ ID NO: 937093 - RNA, 16 nt, Homo sapiens
uuagaagucacacagu

SEQ ID NO: 937094 - RNA, 15 nt, Homo sapiens
uuagcccaaaaccaa

SEQ ID NO: 937095 - RNA, 13 nt, Homo sapiens
uuauacauuugau

SEQ ID NO: 937096 - RNA, 19 nt, Homo sapiens
uuauauauaagccaaaaaa

SEQ ID NO: 937097 - RNA, 22 nt, Homo sapiens
uuauauugccauuucuuccaca

SEQ ID NO: 937098 - RNA, 17 nt, Homo sapiens
uuaucagaauucucaga

SEQ ID NO: 937099 - RNA, 17 nt, Homo sapiens
uuaugacuccagaauuu

SEQ ID NO: 937100 - RNA, 22 nt, Homo sapiens
uucaaccaguuugaaccaagaa

SEQ ID NO: 937101 - RNA, 23 nt, Homo sapiens
uucaauauccccaagcaguguga

SEQ ID NO: 937102 - RNA, 22 nt, Homo sapiens
uucaauucucauuugucacaca

SEQ ID NO: 937103 - RNA, 18 nt, Homo sapiens
uucaccacaugugcacau

SEQ ID NO: 937104 - RNA, 15 nt, Homo sapiens
uucagcugguugagg

SEQ ID NO: 937105 - RNA, 22 nt, Homo sapiens
uucaguguacauggaauaacau

SEQ ID NO: 937106 - RNA, 16 nt, Homo sapiens
uuccaaacacauacag

SEQ ID NO: 937107 - RNA, 19 nt, Homo sapiens
uuccaaacacauacaggaa

SEQ ID NO: 937108 - RNA, 19 nt, Homo sapiens
uuccaaggguacuaaggaa

SEQ ID NO: 937109 - RNA, 17 nt, Homo sapiens
uuccacuuugauaccau

SEQ ID NO: 937110 - RNA, 13 nt, Homo sapiens
uucccaaacugau

SEQ ID NO: 937111 - RNA, 18 nt, Homo sapiens
uuccucuuuccaucuacc

SEQ ID NO: 937112 - RNA, 15 nt, Homo sapiens
uuccuguagucccau

SEQ ID NO: 937113 - RNA, 20 nt, Homo sapiens
uucgcaggauucuuccuccc

SEQ ID NO: 937114 - RNA, 18 nt, Homo sapiens
uucuagcauggcugccaa

SEQ ID NO: 937115 - RNA, 24 nt, Homo sapiens
uucuccaagcaggacauggacaag

SEQ ID NO: 937116 - RNA, 14 nt, Homo sapiens
uucucugaaggaca

SEQ ID NO: 937117 - RNA, 13 nt, Homo sapiens
uucugaaagggac

SEQ ID NO: 937118 - RNA, 11 nt, Homo sapiens
uucugagauca

SEQ ID NO: 937119 - RNA, 13 nt, Homo sapiens
uucugggacacag

SEQ ID NO: 937120 - RNA, 16 nt, Homo sapiens
uucugggacacaguuc

SEQ ID NO: 937121 - RNA, 19 nt, Homo sapiens
uucuucagagacuccugca

SEQ ID NO: 937122 - RNA, 21 nt, Homo sapiens
uucuugauaaagaagauucug

SEQ ID NO: 937123 - RNA, 12 nt, Homo sapiens
uucuuuccugag

SEQ ID NO: 937124 - RNA, 19 nt, Homo sapiens
uucuuuuuccccaauaaau

SEQ ID NO: 937125 - RNA, 13 nt, Homo sapiens
uugaacuuugacc

SEQ ID NO: 937126 - RNA, 12 nt, Homo sapiens
uugaccucaggu

SEQ ID NO: 937127 - RNA, 14 nt, Homo sapiens
uugauguacuuuac

SEQ ID NO: 937128 - RNA, 14 nt, Homo sapiens
uugcaccacugcac

SEQ ID NO: 937129 - RNA, 14 nt, Homo sapiens
uugcagacaggcaa

SEQ ID NO: 937130 - RNA, 21 nt, Homo sapiens
uugcccacacuugggagcaaa

SEQ ID NO: 937131 - RNA, 17 nt, Homo sapiens
uuggagggugucccaaa

SEQ ID NO: 937132 - RNA, 15 nt, Homo sapiens
uuggauuguccccga

SEQ ID NO: 937133 - RNA, 15 nt, Homo sapiens
uuggccagugugaca

SEQ ID NO: 937134 - RNA, 17 nt, Homo sapiens
uuguaaauagcucaggu

SEQ ID NO: 937135 - RNA, 16 nt, Homo sapiens
uuguacagacaacaaa

SEQ ID NO: 937136 - RNA, 15 nt, Homo sapiens
uuguaugagguuuga

SEQ ID NO: 937137 - RNA, 18 nt, Homo sapiens
uugucacuuuccucuucc

SEQ ID NO: 937138 - RNA, 12 nt, Homo sapiens
uugugcauuugg

SEQ ID NO: 937139 - RNA, 14 nt, Homo sapiens
uugugguuaaucug

SEQ ID NO: 937140 - RNA, 16 nt, Homo sapiens
uuuaaaugcaccugga

SEQ ID NO: 937141 - RNA, 21 nt, Homo sapiens
uuuaagaaaaaggaugcacag

SEQ ID NO: 937142 - RNA, 18 nt, Homo sapiens
uuuaagagaaaugagcug

SEQ ID NO: 937143 - RNA, 18 nt, Homo sapiens
agaaugugggauauuucc

SEQ ID NO: 937144 - RNA, 13 nt, Homo sapiens
agacaagaacuau

SEQ ID NO: 937145 - RNA, 22 nt, Homo sapiens
agacacggagcccagcccuccc

SEQ ID NO: 937146 - RNA, 21 nt, Homo sapiens
agacagacuagaaguuccuag

SEQ ID NO: 937147 - RNA, 16 nt, Homo sapiens
agacaucagauccugg

SEQ ID NO: 937148 - RNA, 22 nt, Homo sapiens
agacaugaaauaaaagcuuugc

SEQ ID NO: 937149 - RNA, 13 nt, Homo sapiens
agaccccaugccu

SEQ ID NO: 937150 - RNA, 14 nt, Homo sapiens
agacccccauccag

SEQ ID NO: 937151 - RNA, 17 nt, Homo sapiens
agacgguguuuugccau

SEQ ID NO: 937152 - RNA, 22 nt, Homo sapiens
agacuccccugccuccccaggg

SEQ ID NO: 937153 - RNA, 22 nt, Homo sapiens
agacuugcuaggaggccuuagc

SEQ ID NO: 937154 - RNA, 19 nt, Homo sapiens
agagaacucgcgcucagua

SEQ ID NO: 937155 - RNA, 14 nt, Homo sapiens
agagagcacaguga

SEQ ID NO: 937156 - RNA, 16 nt, Homo sapiens
agagagguuuuucuga

SEQ ID NO: 937157 - RNA, 19 nt, Homo sapiens
agagaucuuucuuuccaaa

SEQ ID NO: 937158 - RNA, 22 nt, Homo sapiens
agagaucuuucuuuccaaaaca

SEQ ID NO: 937159 - RNA, 11 nt, Homo sapiens
agagcacauuu

SEQ ID NO: 937160 - RNA, 16 nt, Homo sapiens
agagcacucauuccuu

SEQ ID NO: 937161 - RNA, 20 nt, Homo sapiens
agagccuucacugguucugc

SEQ ID NO: 937162 - RNA, 20 nt, Homo sapiens
agagcgagauucugccucaa

SEQ ID NO: 937163 - RNA, 18 nt, Homo sapiens
agagcgaggaaaggauuu

SEQ ID NO: 937164 - RNA, 22 nt, Homo sapiens
agagcggaaggagggagcucug

SEQ ID NO: 937165 - RNA, 18 nt, Homo sapiens
agaggcugccccucucac

SEQ ID NO: 937166 - RNA, 16 nt, Homo sapiens
agaggcuuucuccagg

SEQ ID NO: 937167 - RNA, 13 nt, Homo sapiens
agagguccugcca

SEQ ID NO: 937168 - RNA, 16 nt, Homo sapiens
agagguggaguucuua

SEQ ID NO: 937169 - RNA, 14 nt, Homo sapiens
agauaggaucacuu

SEQ ID NO: 937170 - RNA, 15 nt, Homo sapiens
agaugacaaaccaua

SEQ ID NO: 937171 - RNA, 23 nt, Homo sapiens
agaugacaaaccauaacugacaa

SEQ ID NO: 937172 - RNA, 17 nt, Homo sapiens
agaugacgaguaacucc

SEQ ID NO: 937173 - RNA, 13 nt, Homo sapiens
agaugaucucucc

SEQ ID NO: 937174 - RNA, 14 nt, Homo sapiens
agaugucucugcaa

SEQ ID NO: 937175 - RNA, 19 nt, Homo sapiens
agauguucuggauaccauu

SEQ ID NO: 937176 - RNA, 22 nt, Homo sapiens
agauucugaccuuaaaugcaac

SEQ ID NO: 937177 - RNA, 15 nt, Homo sapiens
agauuuaacauuauc

SEQ ID NO: 937178 - RNA, 23 nt, Homo sapiens
agauuucggaggccauccugcca

SEQ ID NO: 937179 - RNA, 22 nt, Homo sapiens
agauuuggaugcacucauuuaa

SEQ ID NO: 937180 - RNA, 16 nt, Homo sapiens
agcaaagauuaaaugu

SEQ ID NO: 937181 - RNA, 19 nt, Homo sapiens
agcaaagauuaaauguguc

SEQ ID NO: 937182 - RNA, 17 nt, Homo sapiens
agcaagacauacuuaau

SEQ ID NO: 937183 - RNA, 15 nt, Homo sapiens
agcaaguuagaacua

SEQ ID NO: 937184 - RNA, 12 nt, Homo sapiens
agcacagugauc

SEQ ID NO: 937185 - RNA, 15 nt, Homo sapiens
agcacccuacaggga

SEQ ID NO: 937186 - RNA, 21 nt, Homo sapiens
agcaccugaagugaccuggaa

SEQ ID NO: 937187 - RNA, 22 nt, Homo sapiens
agcacucucgcacacacaguga

SEQ ID NO: 937188 - RNA, 18 nt, Homo sapiens
agcaggucaggacucaga

SEQ ID NO: 937189 - RNA, 22 nt, Homo sapiens
agcaucaaaauauuucagugaa

SEQ ID NO: 937190 - RNA, 19 nt, Homo sapiens
agcaugguacuuggccuuu

SEQ ID NO: 937191 - RNA, 20 nt, Homo sapiens
agcauguuuuguugcucagu

SEQ ID NO: 937192 - RNA, 15 nt, Homo sapiens
agcauuacccuccuc

SEQ ID NO: 937193 - RNA, 18 nt, Homo sapiens
agcauuuaccaugugcua

SEQ ID NO: 937194 - RNA, 19 nt, Homo sapiens
agcauuuaccaugugcuaa

SEQ ID NO: 937195 - RNA, 22 nt, Homo sapiens
agcauuugacccuugcugugaa

SEQ ID NO: 937196 - RNA, 16 nt, Homo sapiens
agccacuggcugcuaa

SEQ ID NO: 937197 - RNA, 14 nt, Homo sapiens
agccagguauggug

SEQ ID NO: 937198 - RNA, 19 nt, Homo sapiens
agccagguaugguggcaua

SEQ ID NO: 937199 - RNA, 19 nt, Homo sapiens
agcccaggauacuggcaca

SEQ ID NO: 937200 - RNA, 13 nt, Homo sapiens
agcccgucucagu

SEQ ID NO: 937201 - RNA, 15 nt, Homo sapiens
agcccucaacuauuc

SEQ ID NO: 937202 - RNA, 23 nt, Homo sapiens
agcccugggugcaggacacuggu

SEQ ID NO: 937203 - RNA, 19 nt, Homo sapiens
agccgaagggcaauaucua

SEQ ID NO: 937204 - RNA, 15 nt, Homo sapiens
agccgagaucaugcc

SEQ ID NO: 937205 - RNA, 16 nt, Homo sapiens
agccgagaucaugcca

SEQ ID NO: 937206 - RNA, 19 nt, Homo sapiens
agccgagaucaugccauug

SEQ ID NO: 937207 - RNA, 19 nt, Homo sapiens
agccgaggucaugccacug

SEQ ID NO: 937208 - RNA, 15 nt, Homo sapiens
agccguauuuuacau

SEQ ID NO: 937209 - RNA, 15 nt, Homo sapiens
agccucacaauccca

SEQ ID NO: 937210 - RNA, 13 nt, Homo sapiens
agccucacugggg

SEQ ID NO: 937211 - RNA, 20 nt, Homo sapiens
agccucacuggggcagacaa

SEQ ID NO: 937212 - RNA, 21 nt, Homo sapiens
agccucacuggggcagacaau

SEQ ID NO: 937213 - RNA, 16 nt, Homo sapiens
agccucuggcauuaga

SEQ ID NO: 937214 - RNA, 19 nt, Homo sapiens
agccuggccaacaugguga

SEQ ID NO: 937215 - RNA, 19 nt, Homo sapiens
agccugggcucacugugcu

SEQ ID NO: 937216 - RNA, 17 nt, Homo sapiens
agccuggguuaaguauu

SEQ ID NO: 937217 - RNA, 18 nt, Homo sapiens
agccuugcucaggugcaa

SEQ ID NO: 937218 - RNA, 21 nt, Homo sapiens
agccuugugugaacucaccaa

SEQ ID NO: 937219 - RNA, 21 nt, Homo sapiens
agcgccaaaacaagccaaaga

SEQ ID NO: 937220 - RNA, 17 nt, Homo sapiens
agcgcuacccaccucca

SEQ ID NO: 937221 - RNA, 14 nt, Homo sapiens
agcgugaguggugg

SEQ ID NO: 937222 - RNA, 23 nt, Homo sapiens
agcuaacccucacaagcaugaag

SEQ ID NO: 937223 - RNA, 19 nt, Homo sapiens
agcuaauaacaugugaaaa

SEQ ID NO: 937224 - RNA, 14 nt, Homo sapiens
agcuaccauuuauc

SEQ ID NO: 937225 - RNA, 19 nt, Homo sapiens
agcuaucugucaucucucu

SEQ ID NO: 937226 - RNA, 18 nt, Homo sapiens
agcugaauuaucuauaca

SEQ ID NO: 937227 - RNA, 16 nt, Homo sapiens
agcuggcucugugagg

SEQ ID NO: 937228 - RNA, 21 nt, Homo sapiens
agcuguggucaaggcuacaga

SEQ ID NO: 937229 - RNA, 21 nt, Homo sapiens
agcuuaacaaugcaacuuuua

SEQ ID NO: 937230 - RNA, 23 nt, Homo sapiens
agcuucagugauugggggaggaa

SEQ ID NO: 937231 - RNA, 19 nt, Homo sapiens
agcuugggcaacagagcaa

SEQ ID NO: 937232 - RNA, 14 nt, Homo sapiens
agcuuucagacucc

SEQ ID NO: 937233 - RNA, 21 nt, Homo sapiens
aggaaagaugauggugacuua

SEQ ID NO: 937234 - RNA, 16 nt, Homo sapiens
aggaaaggauuuuacc

SEQ ID NO: 937235 - RNA, 15 nt, Homo sapiens
aggaacaaagacagg

SEQ ID NO: 937236 - RNA, 15 nt, Homo sapiens
aggaacaggacugca

SEQ ID NO: 937237 - RNA, 14 nt, Homo sapiens
aggaacugcaauaa

SEQ ID NO: 937238 - RNA, 23 nt, Homo sapiens
aggaacugcaauaauaucaaaac

SEQ ID NO: 937239 - RNA, 17 nt, Homo sapiens
aggaacugcaggucaag

SEQ ID NO: 937240 - RNA, 16 nt, Homo sapiens
aggaagcccucgucuc

SEQ ID NO: 937241 - RNA, 14 nt, Homo sapiens
aggaagguguuuca

SEQ ID NO: 937242 - RNA, 23 nt, Homo sapiens
aggacgccacucauuucaucuca

SEQ ID NO: 937243 - RNA, 13 nt, Homo sapiens
aggacucagaaca

SEQ ID NO: 937244 - RNA, 11 nt, Homo sapiens
aggagcaggca

SEQ ID NO: 937245 - RNA, 16 nt, Homo sapiens
aggagccucacugggg

SEQ ID NO: 937246 - RNA, 17 nt, Homo sapiens
aggagccucacuggggc

SEQ ID NO: 937247 - RNA, 14 nt, Homo sapiens
aggagcgaucucag

SEQ ID NO: 937248 - RNA, 12 nt, Homo sapiens
aggagcugcuaa

SEQ ID NO: 937249 - RNA, 22 nt, Homo sapiens
aggaggcaaagguucuaucugc

SEQ ID NO: 937250 - RNA, 18 nt, Homo sapiens
aggagggggcucaggcca

SEQ ID NO: 937251 - RNA, 22 nt, Homo sapiens
cauccacaggguuuugacacuu

SEQ ID NO: 937252 - RNA, 23 nt, Homo sapiens
cauccaugcugugcuguguuauu

SEQ ID NO: 937253 - RNA, 20 nt, Homo sapiens
cauccuaccccuuugcacuu

SEQ ID NO: 937254 - RNA, 14 nt, Homo sapiens
cauccucacaguga

SEQ ID NO: 937255 - RNA, 21 nt, Homo sapiens
cauccuggcuaacacggugaa

SEQ ID NO: 937256 - RNA, 14 nt, Homo sapiens
caucuggacacugg

SEQ ID NO: 937257 - RNA, 15 nt, Homo sapiens
caucuguguaaagug

SEQ ID NO: 937258 - RNA, 14 nt, Homo sapiens
caugaauucuguca

SEQ ID NO: 937259 - RNA, 16 nt, Homo sapiens
caugaugaacucaccu

SEQ ID NO: 937260 - RNA, 14 nt, Homo sapiens
caugcccaugauga

SEQ ID NO: 937261 - RNA, 16 nt, Homo sapiens
caugcccuguguggcu

SEQ ID NO: 937262 - RNA, 17 nt, Homo sapiens
caugccgcagacaugaa

SEQ ID NO: 937263 - RNA, 16 nt, Homo sapiens
caugcguccuggucaa

SEQ ID NO: 937264 - RNA, 15 nt, Homo sapiens
caugcuacaguuauu

SEQ ID NO: 937265 - RNA, 19 nt, Homo sapiens
cauggaaaacccccuuccu

SEQ ID NO: 937266 - RNA, 19 nt, Homo sapiens
cauggagagccccugcuaa

SEQ ID NO: 937267 - RNA, 18 nt, Homo sapiens
cauguaaauguaaacuca

SEQ ID NO: 937268 - RNA, 19 nt, Homo sapiens
cauguaaauguaaacucag

SEQ ID NO: 937269 - RNA, 16 nt, Homo sapiens
cauguacauacccugg

SEQ ID NO: 937270 - RNA, 17 nt, Homo sapiens
caugugcaaaugugcug

SEQ ID NO: 937271 - RNA, 18 nt, Homo sapiens
caugugcgcgcgugcaug

SEQ ID NO: 937272 - RNA, 22 nt, Homo sapiens
caugugcgcgcgugcaugugug

SEQ ID NO: 937273 - RNA, 23 nt, Homo sapiens
cauguguccccucacucugucag

SEQ ID NO: 937274 - RNA, 18 nt, Homo sapiens
cauguuuuguugcucagu

SEQ ID NO: 937275 - RNA, 22 nt, Homo sapiens
cauuccuugggacucaggagcu

SEQ ID NO: 937276 - RNA, 15 nt, Homo sapiens
cauucuucagauaua

SEQ ID NO: 937277 - RNA, 19 nt, Homo sapiens
cauugauuugcucuuacua

SEQ ID NO: 937278 - RNA, 14 nt, Homo sapiens
cauugcacaaggca

SEQ ID NO: 937279 - RNA, 23 nt, Homo sapiens
cauugcucagcccgcuuggccac

SEQ ID NO: 937280 - RNA, 16 nt, Homo sapiens
cauuggccgacaucac

SEQ ID NO: 937281 - RNA, 17 nt, Homo sapiens
cauuggccgacaucaca

SEQ ID NO: 937282 - RNA, 15 nt, Homo sapiens
cauuuaccaguauag

SEQ ID NO: 937283 - RNA, 23 nt, Homo sapiens
cauuucucaucaguaguucacau

SEQ ID NO: 937284 - RNA, 17 nt, Homo sapiens
cauuuguagcaauuuaa

SEQ ID NO: 937285 - RNA, 21 nt, Homo sapiens
cauuuuggugugcaacccugu

SEQ ID NO: 937286 - RNA, 14 nt, Homo sapiens
cauuuuguaauaau

SEQ ID NO: 937287 - RNA, 15 nt, Homo sapiens
ccaaaauucauuucu

SEQ ID NO: 937288 - RNA, 13 nt, Homo sapiens
ccaaacagugacu

SEQ ID NO: 937289 - RNA, 22 nt, Homo sapiens
ccaaagcaucaauacaaccagc

SEQ ID NO: 937290 - RNA, 11 nt, Homo sapiens
ccaacacaaag

SEQ ID NO: 937291 - RNA, 14 nt, Homo sapiens
ccaagguaggcaga

SEQ ID NO: 937292 - RNA, 16 nt, Homo sapiens
ccaagucuguaccuca

SEQ ID NO: 937293 - RNA, 19 nt, Homo sapiens
ccaauaaagugaucugugu

SEQ ID NO: 937294 - RNA, 18 nt, Homo sapiens
ccaauagugucauccuca

SEQ ID NO: 937295 - RNA, 16 nt, Homo sapiens
ccaauauaacuaucuc

SEQ ID NO: 937296 - RNA, 16 nt, Homo sapiens
ccaauucagugucugu

SEQ ID NO: 937297 - RNA, 18 nt, Homo sapiens
ccaauuuuuuaagugaaa

SEQ ID NO: 937298 - RNA, 16 nt, Homo sapiens
ccacacccaaugcugc

SEQ ID NO: 937299 - RNA, 15 nt, Homo sapiens
ccacacuugguggga

SEQ ID NO: 937300 - RNA, 16 nt, Homo sapiens
ccacagggccuugaau

SEQ ID NO: 937301 - RNA, 14 nt, Homo sapiens
ccacagucacugga

SEQ ID NO: 937302 - RNA, 12 nt, Homo sapiens
ccacauaccucu

SEQ ID NO: 937303 - RNA, 17 nt, Homo sapiens
ccacaugccaauuucag

SEQ ID NO: 937304 - RNA, 19 nt, Homo sapiens
ccaccaaaugugcuuugag

SEQ ID NO: 937305 - RNA, 17 nt, Homo sapiens
ccaccaagaagcacugg

SEQ ID NO: 937306 - RNA, 23 nt, Homo sapiens
ccaccaagaagcacugggugacc

SEQ ID NO: 937307 - RNA, 17 nt, Homo sapiens
ccacuaagcuaauucca

SEQ ID NO: 937308 - RNA, 20 nt, Homo sapiens
ccacuagaagcaacuaggaa

SEQ ID NO: 937309 - RNA, 17 nt, Homo sapiens
ccacucauuucaucuca

SEQ ID NO: 937310 - RNA, 22 nt, Homo sapiens
ccacucuggagcauuucucauc

SEQ ID NO: 937311 - RNA, 14 nt, Homo sapiens
ccagaaaagcaaua

SEQ ID NO: 937312 - RNA, 12 nt, Homo sapiens
ccagaaugcugc

SEQ ID NO: 937313 - RNA, 19 nt, Homo sapiens
ccagaaugcugcaggacuu

SEQ ID NO: 937314 - RNA, 19 nt, Homo sapiens
ccagacaucuggacacugg

SEQ ID NO: 937315 - RNA, 17 nt, Homo sapiens
ccagacucucacaugca

SEQ ID NO: 937316 - RNA, 20 nt, Homo sapiens
ccagacucucacaugcagua

SEQ ID NO: 937317 - RNA, 21 nt, Homo sapiens
ccagaguuggagacucagcau

SEQ ID NO: 937318 - RNA, 16 nt, Homo sapiens
ccagcacuuugggagg

SEQ ID NO: 937319 - RNA, 17 nt, Homo sapiens
ccagccacuggcugcua

SEQ ID NO: 937320 - RNA, 18 nt, Homo sapiens
ccagcccuccucugucaa

SEQ ID NO: 937321 - RNA, 16 nt, Homo sapiens
ccagccguauuuuaca

SEQ ID NO: 937322 - RNA, 15 nt, Homo sapiens
ccagccuuggcgaca

SEQ ID NO: 937323 - RNA, 22 nt, Homo sapiens
ccagcgugaggagcgaucucag

SEQ ID NO: 937324 - RNA, 14 nt, Homo sapiens
ccagcuaucuguca

SEQ ID NO: 937325 - RNA, 15 nt, Homo sapiens
ccaggagcuacucag

SEQ ID NO: 937326 - RNA, 18 nt, Homo sapiens
ccaggccugggaauggau

SEQ ID NO: 937327 - RNA, 20 nt, Homo sapiens
ccaggccugggaauggauua

SEQ ID NO: 937328 - RNA, 22 nt, Homo sapiens
ccaggcugccuggucacugccc

SEQ ID NO: 937329 - RNA, 20 nt, Homo sapiens
ccagggagcacccugcccac

SEQ ID NO: 937330 - RNA, 22 nt, Homo sapiens
ccaguacccuugggugcagauc

SEQ ID NO: 937331 - RNA, 20 nt, Homo sapiens
ccaguucauugcacuuugau

SEQ ID NO: 937332 - RNA, 19 nt, Homo sapiens
ccaguuguaauagugccaa

SEQ ID NO: 937333 - RNA, 14 nt, Homo sapiens
ccaucaugaagaag

SEQ ID NO: 937334 - RNA, 17 nt, Homo sapiens
ccaucccggaguucucc

SEQ ID NO: 937335 - RNA, 17 nt, Homo sapiens
ccaucccuuuuuuuaca

SEQ ID NO: 937336 - RNA, 22 nt, Homo sapiens
ccauccuggcuaacacggugaa

SEQ ID NO: 937337 - RNA, 23 nt, Homo sapiens
ccaugaacaucuuuagugucuga

SEQ ID NO: 937338 - RNA, 14 nt, Homo sapiens
ccauggugagcucu

SEQ ID NO: 937339 - RNA, 10 nt, Homo sapiens
ccauguccaa

SEQ ID NO: 937340 - RNA, 21 nt, Homo sapiens
ccauguccaaagaggcugccc

SEQ ID NO: 937341 - RNA, 23 nt, Homo sapiens
ccauucgguguggugcaguguga

SEQ ID NO: 937342 - RNA, 12 nt, Homo sapiens
cccaaaucucaa

SEQ ID NO: 937343 - RNA, 12 nt, Homo sapiens
cccaacaccauu

SEQ ID NO: 937344 - RNA, 21 nt, Homo sapiens
cccaaccuucuugucauugaa

SEQ ID NO: 937345 - RNA, 21 nt, Homo sapiens
cccaaugggcucaaacuucua

SEQ ID NO: 937346 - RNA, 18 nt, Homo sapiens
cccacaugccaauuucag

SEQ ID NO: 937347 - RNA, 17 nt, Homo sapiens
cccacccccacugccag

SEQ ID NO: 937348 - RNA, 21 nt, Homo sapiens
cccacuagaagcaacuaggaa

SEQ ID NO: 937349 - RNA, 15 nt, Homo sapiens
cccagacacagccca

SEQ ID NO: 937350 - RNA, 14 nt, Homo sapiens
cccagagcccguca

SEQ ID NO: 937351 - RNA, 14 nt, Homo sapiens
cccagccccuucca

SEQ ID NO: 937352 - RNA, 20 nt, Homo sapiens
cccaggagccucacuggggc

SEQ ID NO: 937353 - RNA, 14 nt, Homo sapiens
cccaggaguuugag

SEQ ID NO: 937354 - RNA, 15 nt, Homo sapiens
cccaggauacuggca

SEQ ID NO: 937355 - RNA, 17 nt, Homo sapiens
cccaggauacuggcaca

SEQ ID NO: 937356 - RNA, 23 nt, Homo sapiens
cccaguaaaaucaaaugugcauc

SEQ ID NO: 937357 - RNA, 21 nt, Homo sapiens
cccaguucauugcacuuugau

SEQ ID NO: 937358 - RNA, 23 nt, Homo sapiens
cccauaacaaccugggcauuccu

SEQ ID NO: 937359 - RNA, 15 nt, Homo sapiens
uuaacacucaugaag

SEQ ID NO: 937360 - RNA, 18 nt, Homo sapiens
uuaacauuaucuaguuca

SEQ ID NO: 937361 - RNA, 9 nt, Homo sapiens
uuaacuuug

SEQ ID NO: 937362 - RNA, 21 nt, Homo sapiens
uuaagaagcaguuguaccaag

SEQ ID NO: 937363 - RNA, 21 nt, Homo sapiens
uuaaggagaggagaaacugag

SEQ ID NO: 937364 - RNA, 17 nt, Homo sapiens
uuaaguacaugugccag

SEQ ID NO: 937365 - RNA, 21 nt, Homo sapiens
uuaagucccaguauaccucau

SEQ ID NO: 937366 - RNA, 17 nt, Homo sapiens
uuaauggggaggacaaa

SEQ ID NO: 937367 - RNA, 18 nt, Homo sapiens
uuaauggugaugggguaa

SEQ ID NO: 937368 - RNA, 15 nt, Homo sapiens
uuaauuaaaaagaau

SEQ ID NO: 937369 - RNA, 19 nt, Homo sapiens
uuaauuuuuauacugacaa

SEQ ID NO: 937370 - RNA, 20 nt, Homo sapiens
uuacacuuuuuggaagugaa

SEQ ID NO: 937371 - RNA, 19 nt, Homo sapiens
uuacaugcugcuauacaca

SEQ ID NO: 937372 - RNA, 16 nt, Homo sapiens
uuacauguaauuugau

SEQ ID NO: 937373 - RNA, 14 nt, Homo sapiens
uuacauuguucaau

SEQ ID NO: 937374 - RNA, 15 nt, Homo sapiens
uuaccaaagcaucaa

SEQ ID NO: 937375 - RNA, 20 nt, Homo sapiens
uuaccaaagcaucaauacaa

SEQ ID NO: 937376 - RNA, 16 nt, Homo sapiens
uuacuguguaaacuca

SEQ ID NO: 937377 - RNA, 19 nt, Homo sapiens
uuagaauuaaaaaagcaua

SEQ ID NO: 937378 - RNA, 16 nt, Homo sapiens
uuagccagauuugucu

SEQ ID NO: 937379 - RNA, 20 nt, Homo sapiens
uuagccuugcucaggugcaa

SEQ ID NO: 937380 - RNA, 23 nt, Homo sapiens
uuaggauuuucacauucuuggcu

SEQ ID NO: 937381 - RNA, 20 nt, Homo sapiens
uuagguuucagcagagcuga

SEQ ID NO: 937382 - RNA, 15 nt, Homo sapiens
uuagugaaaaacugc

SEQ ID NO: 937383 - RNA, 18 nt, Homo sapiens
uuauaaaauccugugcaa

SEQ ID NO: 937384 - RNA, 17 nt, Homo sapiens
uuaucuguuuccugaca

SEQ ID NO: 937385 - RNA, 24 nt, Homo sapiens
uuaugucuggggcagaaacacuca

SEQ ID NO: 937386 - RNA, 11 nt, Homo sapiens
uuauuacauaa

SEQ ID NO: 937387 - RNA, 19 nt, Homo sapiens
uuauucugauaaaaauaau

SEQ ID NO: 937388 - RNA, 16 nt, Homo sapiens
uuauugacucauacac

SEQ ID NO: 937389 - RNA, 22 nt, Homo sapiens
uuauugguguaagguacuuuca

SEQ ID NO: 937390 - RNA, 14 nt, Homo sapiens
uuauuguuaauaca

SEQ ID NO: 937391 - RNA, 15 nt, Homo sapiens
uuauuuaacuauuca

SEQ ID NO: 937392 - RNA, 14 nt, Homo sapiens
uuauuuaugcguaa

SEQ ID NO: 937393 - RNA, 17 nt, Homo sapiens
uuauuucugucacagua

SEQ ID NO: 937394 - RNA, 17 nt, Homo sapiens
uuauuuuuguucauaua

SEQ ID NO: 937395 - RNA, 21 nt, Homo sapiens
uucaaaaagggaaguaagcaa

SEQ ID NO: 937396 - RNA, 18 nt, Homo sapiens
uucaaaccacaauaucca

SEQ ID NO: 937397 - RNA, 21 nt, Homo sapiens
uucaaaggccacauaccucuc

SEQ ID NO: 937398 - RNA, 15 nt, Homo sapiens
uucaagagugagcua

SEQ ID NO: 937399 - RNA, 15 nt, Homo sapiens
uucacuuaaguauug

SEQ ID NO: 937400 - RNA, 15 nt, Homo sapiens
uucagauauacugga

SEQ ID NO: 937401 - RNA, 20 nt, Homo sapiens
uucagaugcuguuaguaccu

SEQ ID NO: 937402 - RNA, 17 nt, Homo sapiens
uucaggaauacuuggac

SEQ ID NO: 937403 - RNA, 17 nt, Homo sapiens
uucaguguuaagguaau

SEQ ID NO: 937404 - RNA, 17 nt, Homo sapiens
uucauauuaugaugcca

SEQ ID NO: 937405 - RNA, 12 nt, Homo sapiens
uucauauuucaa

SEQ ID NO: 937406 - RNA, 19 nt, Homo sapiens
uucauguauuuuacacaaa

SEQ ID NO: 937407 - RNA, 13 nt, Homo sapiens
uucauugcacuuu

SEQ ID NO: 937408 - RNA, 16 nt, Homo sapiens
uucauugcacuuugau

SEQ ID NO: 937409 - RNA, 12 nt, Homo sapiens
uuccacaccccu

SEQ ID NO: 937410 - RNA, 15 nt, Homo sapiens
uuccacagaggacac

SEQ ID NO: 937411 - RNA, 18 nt, Homo sapiens
uuccacuaucauucccau

SEQ ID NO: 937412 - RNA, 16 nt, Homo sapiens
uucccauuuuugcuua

SEQ ID NO: 937413 - RNA, 17 nt, Homo sapiens
uucccauuuuugcuuag

SEQ ID NO: 937414 - RNA, 15 nt, Homo sapiens
uuccccaacagggca

SEQ ID NO: 937415 - RNA, 16 nt, Homo sapiens
uucccccugcaaaaag

SEQ ID NO: 937416 - RNA, 19 nt, Homo sapiens
uuccccuuuucccaaccug

SEQ ID NO: 937417 - RNA, 20 nt, Homo sapiens
uucccuugccuauuugcuga

SEQ ID NO: 937418 - RNA, 21 nt, Homo sapiens
uuccucccaggaagcccagga

SEQ ID NO: 937419 - RNA, 15 nt, Homo sapiens
uuccuguucaguaau

SEQ ID NO: 937420 - RNA, 14 nt, Homo sapiens
uuccuguuugucua

SEQ ID NO: 937421 - RNA, 18 nt, Homo sapiens
uuccuucucugaaagugg

SEQ ID NO: 937422 - RNA, 19 nt, Homo sapiens
uucgagacuagccugggaa

SEQ ID NO: 937423 - RNA, 17 nt, Homo sapiens
uucgauuucuaccucag

SEQ ID NO: 937424 - RNA, 13 nt, Homo sapiens
uucuaacccugac

SEQ ID NO: 937425 - RNA, 18 nt, Homo sapiens
uucuauucuagccugcau

SEQ ID NO: 937426 - RNA, 14 nt, Homo sapiens
uucucaguggugca

SEQ ID NO: 937427 - RNA, 23 nt, Homo sapiens
uucucaucaguaguucacauaca

SEQ ID NO: 937428 - RNA, 21 nt, Homo sapiens
uucuccaccuagacuguaaac

SEQ ID NO: 937429 - RNA, 16 nt, Homo sapiens
uucucccucgacauuu

SEQ ID NO: 937430 - RNA, 16 nt, Homo sapiens
uucucguuuucacagg

SEQ ID NO: 937431 - RNA, 16 nt, Homo sapiens
uucucuauacucaggu

SEQ ID NO: 937432 - RNA, 15 nt, Homo sapiens
uucugaauuguccuu

SEQ ID NO: 937433 - RNA, 20 nt, Homo sapiens
uucugauaaaaauaauauua

SEQ ID NO: 937434 - RNA, 22 nt, Homo sapiens
uucugcuguugccucucuuuga

SEQ ID NO: 937435 - RNA, 16 nt, Homo sapiens
uucuggacagacagau

SEQ ID NO: 937436 - RNA, 22 nt, Homo sapiens
uucuuaaaacaaagccaugcca

SEQ ID NO: 937437 - RNA, 12 nt, Homo sapiens
uucuuacacugu

SEQ ID NO: 937438 - RNA, 13 nt, Homo sapiens
uucuuagaccucc

SEQ ID NO: 937439 - RNA, 18 nt, Homo sapiens
uucuucagauauacugga

SEQ ID NO: 937440 - RNA, 20 nt, Homo sapiens
uucuuuauuuucuucuccag

SEQ ID NO: 937441 - RNA, 15 nt, Homo sapiens
uucuuuuaccacuga

SEQ ID NO: 937442 - RNA, 13 nt, Homo sapiens
uucuuuuugccaa

SEQ ID NO: 937443 - RNA, 19 nt, Homo sapiens
uugaaaaggguaggcacga

SEQ ID NO: 937444 - RNA, 16 nt, Homo sapiens
uugaaaugaaagggaa

SEQ ID NO: 937445 - RNA, 13 nt, Homo sapiens
uugaagucuuuaa

SEQ ID NO: 937446 - RNA, 11 nt, Homo sapiens
uugacaaugau

SEQ ID NO: 937447 - RNA, 19 nt, Homo sapiens
uugacccuugcugugaauu

SEQ ID NO: 937448 - RNA, 12 nt, Homo sapiens
uugacuuucuaa

SEQ ID NO: 937449 - RNA, 19 nt, Homo sapiens
uugagguucucuauauucg

SEQ ID NO: 937450 - RNA, 16 nt, Homo sapiens
uugaugugauguggca

SEQ ID NO: 937451 - RNA, 23 nt, Homo sapiens
uugauuuaagcuuuccuguugaa

SEQ ID NO: 937452 - RNA, 21 nt, Homo sapiens
uugcaaaaugagacuuucuaa

SEQ ID NO: 937453 - RNA, 18 nt, Homo sapiens
uugcacauuaaucagauu

SEQ ID NO: 937454 - RNA, 12 nt, Homo sapiens
uugcaccaaaga

SEQ ID NO: 937455 - RNA, 22 nt, Homo sapiens
uugccaauagugucauccucac

SEQ ID NO: 937456 - RNA, 14 nt, Homo sapiens
uugcuacauucuaa

SEQ ID NO: 937457 - RNA, 13 nt, Homo sapiens
uuggaaacagaga

SEQ ID NO: 937458 - RNA, 19 nt, Homo sapiens
uuggaaauugagucugaag

SEQ ID NO: 937459 - RNA, 15 nt, Homo sapiens
uuggagaaaguauuu

SEQ ID NO: 937460 - RNA, 12 nt, Homo sapiens
uuggccacagac

SEQ ID NO: 937461 - RNA, 17 nt, Homo sapiens
uuggccucugcuaaggu

SEQ ID NO: 937462 - RNA, 13 nt, Homo sapiens
uugggauuuuucu

SEQ ID NO: 937463 - RNA, 14 nt, Homo sapiens
uugggcaacagagc

SEQ ID NO: 937464 - RNA, 13 nt, Homo sapiens
uuggugcuagaaa

SEQ ID NO: 937465 - RNA, 20 nt, Homo sapiens
uuguaaaacaaaauuugacu

SEQ ID NO: 937466 - RNA, 22 nt, Homo sapiens
uuguaacgacuucuccaucucc

SEQ ID NO: 937467 - RNA, 14 nt, Homo sapiens
uuguaauagugcca

SEQ ID NO: 937468 - RNA, 14 nt, Homo sapiens
cgugccaugaucug

SEQ ID NO: 937469 - RNA, 18 nt, Homo sapiens
cguguguguucacguguu

SEQ ID NO: 937470 - RNA, 17 nt, Homo sapiens
cguuccaccccaagaga

SEQ ID NO: 937471 - RNA, 12 nt, Homo sapiens
cuaaagccucaa

SEQ ID NO: 937472 - RNA, 18 nt, Homo sapiens
cuaaauguuuggcaugua

SEQ ID NO: 937473 - RNA, 19 nt, Homo sapiens
cuaacaagucaccaaaaga

SEQ ID NO: 937474 - RNA, 21 nt, Homo sapiens
cuaacacggugaaaccccuua

SEQ ID NO: 937475 - RNA, 22 nt, Homo sapiens
cuaacccccacccccacugcca

SEQ ID NO: 937476 - RNA, 18 nt, Homo sapiens
cuaaccuggauaacugua

SEQ ID NO: 937477 - RNA, 13 nt, Homo sapiens
cuaagcagcuuau

SEQ ID NO: 937478 - RNA, 16 nt, Homo sapiens
cuaagggguacuccuc

SEQ ID NO: 937479 - RNA, 14 nt, Homo sapiens
cuaauagagauuaa

SEQ ID NO: 937480 - RNA, 17 nt, Homo sapiens
cuaauagucuuugccag

SEQ ID NO: 937481 - RNA, 16 nt, Homo sapiens
cuaaucaucugcaguu

SEQ ID NO: 937482 - RNA, 12 nt, Homo sapiens
cuaaugguguug

SEQ ID NO: 937483 - RNA, 19 nt, Homo sapiens
cuacaguauuacucuuaca

SEQ ID NO: 937484 - RNA, 23 nt, Homo sapiens
cuacaucuucugccuuagucuca

SEQ ID NO: 937485 - RNA, 18 nt, Homo sapiens
cuacccccaguaaaauca

SEQ ID NO: 937486 - RNA, 22 nt, Homo sapiens
cuaccuguaggaucagggucua

SEQ ID NO: 937487 - RNA, 12 nt, Homo sapiens
cuacugacgucc

SEQ ID NO: 937488 - RNA, 20 nt, Homo sapiens
cuacugagucacaauaaaga

SEQ ID NO: 937489 - RNA, 14 nt, Homo sapiens
cuagcugugggggu

SEQ ID NO: 937490 - RNA, 19 nt, Homo sapiens
cuaggaaaaucacuugcca

SEQ ID NO: 937491 - RNA, 14 nt, Homo sapiens
cuaggcugagcaau

SEQ ID NO: 937492 - RNA, 17 nt, Homo sapiens
cuaggugcuauuuguca

SEQ ID NO: 937493 - RNA, 17 nt, Homo sapiens
cuagguuuuauucauac

SEQ ID NO: 937494 - RNA, 15 nt, Homo sapiens
cuagucaccagagac

SEQ ID NO: 937495 - RNA, 15 nt, Homo sapiens
cuagugaacugcaac

SEQ ID NO: 937496 - RNA, 20 nt, Homo sapiens
cuaucucuacugaaugucau

SEQ ID NO: 937497 - RNA, 22 nt, Homo sapiens
cuaugcgggggugccuaaggag

SEQ ID NO: 937498 - RNA, 23 nt, Homo sapiens
cuauugggauauccuuucacucu

SEQ ID NO: 937499 - RNA, 17 nt, Homo sapiens
cuauuucuccaaagccu

SEQ ID NO: 937500 - RNA, 19 nt, Homo sapiens
cuauuuuaagacgugaaug

SEQ ID NO: 937501 - RNA, 21 nt, Homo sapiens
cucaaaauuuaacaguuaccu

SEQ ID NO: 937502 - RNA, 23 nt, Homo sapiens
cucaaagaagucggaaugucaua

SEQ ID NO: 937503 - RNA, 17 nt, Homo sapiens
cucaagcaggggauccu

SEQ ID NO: 937504 - RNA, 14 nt, Homo sapiens
cucaccaaacacaa

SEQ ID NO: 937505 - RNA, 17 nt, Homo sapiens
cucacccagucuucuac

SEQ ID NO: 937506 - RNA, 20 nt, Homo sapiens
cucacccagucuucuacaca

SEQ ID NO: 937507 - RNA, 12 nt, Homo sapiens
cucacucuguca

SEQ ID NO: 937508 - RNA, 21 nt, Homo sapiens
cucacuggggcagacaauaaa

SEQ ID NO: 937509 - RNA, 17 nt, Homo sapiens
cucagaccaaucaucaa

SEQ ID NO: 937510 - RNA, 16 nt, Homo sapiens
cucagacguuccauac

SEQ ID NO: 937511 - RNA, 15 nt, Homo sapiens
cucaggaaaacagcu

SEQ ID NO: 937512 - RNA, 16 nt, Homo sapiens
cucaggaaaacagcua

SEQ ID NO: 937513 - RNA, 18 nt, Homo sapiens
cucaguuugugugucuua

SEQ ID NO: 937514 - RNA, 15 nt, Homo sapiens
cucauaaaaagcaaa

SEQ ID NO: 937515 - RNA, 20 nt, Homo sapiens
cucauaaaauggaagcaauu

SEQ ID NO: 937516 - RNA, 15 nt, Homo sapiens
cucaugccuguaauc

SEQ ID NO: 937517 - RNA, 20 nt, Homo sapiens
cucaugucuucucacaagcc

SEQ ID NO: 937518 - RNA, 13 nt, Homo sapiens
cucauuucaucuc

SEQ ID NO: 937519 - RNA, 14 nt, Homo sapiens
cucauuucaucuca

SEQ ID NO: 937520 - RNA, 19 nt, Homo sapiens
cuccaagucuguaccucaa

SEQ ID NO: 937521 - RNA, 13 nt, Homo sapiens
cuccacauauuuc

SEQ ID NO: 937522 - RNA, 18 nt, Homo sapiens
cuccaccuagacuguaaa

SEQ ID NO: 937523 - RNA, 19 nt, Homo sapiens
cuccagaccccaugccuua

SEQ ID NO: 937524 - RNA, 19 nt, Homo sapiens
cuccaguuuuuuguuauau

SEQ ID NO: 937525 - RNA, 16 nt, Homo sapiens
cuccaucucaaaaaag

SEQ ID NO: 937526 - RNA, 23 nt, Homo sapiens
cuccccagacaucuggacacugg

SEQ ID NO: 937527 - RNA, 21 nt, Homo sapiens
cuccccagaugugacuacuga

SEQ ID NO: 937528 - RNA, 13 nt, Homo sapiens
cuccccaggggag

SEQ ID NO: 937529 - RNA, 21 nt, Homo sapiens
cuccccaguucauugcacuuu

SEQ ID NO: 937530 - RNA, 12 nt, Homo sapiens
cuccccauggag

SEQ ID NO: 937531 - RNA, 15 nt, Homo sapiens
cuccccuguaccuuu

SEQ ID NO: 937532 - RNA, 13 nt, Homo sapiens
cucccucucucuu

SEQ ID NO: 937533 - RNA, 16 nt, Homo sapiens
cucccucuuucuuccc

SEQ ID NO: 937534 - RNA, 19 nt, Homo sapiens
cucccuggcaggaugcuga

SEQ ID NO: 937535 - RNA, 14 nt, Homo sapiens
cuccucucaucccc

SEQ ID NO: 937536 - RNA, 19 nt, Homo sapiens
cuggcagacucgggaccaa

SEQ ID NO: 937537 - RNA, 20 nt, Homo sapiens
cuggcaggaagggacugcca

SEQ ID NO: 937538 - RNA, 21 nt, Homo sapiens
cuggcaggaagggacugccaa

SEQ ID NO: 937539 - RNA, 18 nt, Homo sapiens
cuggccuauguggucuaa

SEQ ID NO: 937540 - RNA, 20 nt, Homo sapiens
cuggcucugcccccuccccc

SEQ ID NO: 937541 - RNA, 22 nt, Homo sapiens
cuggcucuugaggcauuuccag

SEQ ID NO: 937542 - RNA, 12 nt, Homo sapiens
cuggcugcuaac

SEQ ID NO: 937543 - RNA, 18 nt, Homo sapiens
cuggcuggaaaaagguga

SEQ ID NO: 937544 - RNA, 12 nt, Homo sapiens
cugggagacaaa

SEQ ID NO: 937545 - RNA, 14 nt, Homo sapiens
cugggccaugucca

SEQ ID NO: 937546 - RNA, 18 nt, Homo sapiens
cugggccauguccaaaga

SEQ ID NO: 937547 - RNA, 17 nt, Homo sapiens
cugggcuucgggcuaug

SEQ ID NO: 937548 - RNA, 19 nt, Homo sapiens
cuggggaauauacgugcuu

SEQ ID NO: 937549 - RNA, 21 nt, Homo sapiens
cuggggccaacuggaaccauu

SEQ ID NO: 937550 - RNA, 15 nt, Homo sapiens
cuggggccuccagaa

SEQ ID NO: 937551 - RNA, 16 nt, Homo sapiens
cuggucaguacccacu

SEQ ID NO: 937552 - RNA, 15 nt, Homo sapiens
cuggucgagagccaa

SEQ ID NO: 937553 - RNA, 16 nt, Homo sapiens
cugguggcaccagaug

SEQ ID NO: 937554 - RNA, 12 nt, Homo sapiens
cuguaaauaugu

SEQ ID NO: 937555 - RNA, 14 nt, Homo sapiens
cuguaaucccagcu

SEQ ID NO: 937556 - RNA, 11 nt, Homo sapiens
cuguaccucaa

SEQ ID NO: 937557 - RNA, 16 nt, Homo sapiens
cuguaccucaaaugaa

SEQ ID NO: 937558 - RNA, 20 nt, Homo sapiens
cuguacuguucugugucuuu

SEQ ID NO: 937559 - RNA, 18 nt, Homo sapiens
cuguagauucagguaaua

SEQ ID NO: 937560 - RNA, 21 nt, Homo sapiens
cuguauaaucuauuuacauaa

SEQ ID NO: 937561 - RNA, 12 nt, Homo sapiens
cuguauugccau

SEQ ID NO: 937562 - RNA, 18 nt, Homo sapiens
cugucaggguugucuacc

SEQ ID NO: 937563 - RNA, 18 nt, Homo sapiens
cugucauaacauccagag

SEQ ID NO: 937564 - RNA, 12 nt, Homo sapiens
cuguggaugcuu

SEQ ID NO: 937565 - RNA, 22 nt, Homo sapiens
cugugucauucuguuagauacu

SEQ ID NO: 937566 - RNA, 20 nt, Homo sapiens
cuguguguguguguguaugu

SEQ ID NO: 937567 - RNA, 18 nt, Homo sapiens
cuguuacacuuuuuggaa

SEQ ID NO: 937568 - RNA, 12 nt, Homo sapiens
cuguucugcaca

SEQ ID NO: 937569 - RNA, 23 nt, Homo sapiens
cuguuuaaucauaguuacugugu

SEQ ID NO: 937570 - RNA, 17 nt, Homo sapiens
cuguuuagaacaccaaa

SEQ ID NO: 937571 - RNA, 14 nt, Homo sapiens
cuguuuuuucucca

SEQ ID NO: 937572 - RNA, 13 nt, Homo sapiens
cuuaaacucuguu

SEQ ID NO: 937573 - RNA, 18 nt, Homo sapiens
cuuagaaauucagcauuu

SEQ ID NO: 937574 - RNA, 13 nt, Homo sapiens
cuuagaauccaaa

SEQ ID NO: 937575 - RNA, 22 nt, Homo sapiens
cuuaguuauauagcaucuggaa

SEQ ID NO: 937576 - RNA, 14 nt, Homo sapiens
cuuaguugaaauga

SEQ ID NO: 937577 - RNA, 14 nt, Homo sapiens
cuuauacaccuuau

SEQ ID NO: 937578 - RNA, 19 nt, Homo sapiens
cuuauuacaugcugcuaua

SEQ ID NO: 937579 - RNA, 22 nt, Homo sapiens
cuuauuagggagaaaauucaau

SEQ ID NO: 937580 - RNA, 19 nt, Homo sapiens
cuuauuguuucucugaaag

SEQ ID NO: 937581 - RNA, 13 nt, Homo sapiens
cuucaaguaauac

SEQ ID NO: 937582 - RNA, 17 nt, Homo sapiens
cuucaauuguauuauau

SEQ ID NO: 937583 - RNA, 12 nt, Homo sapiens
cuucagacaccc

SEQ ID NO: 937584 - RNA, 13 nt, Homo sapiens
cuucagcaaguua

SEQ ID NO: 937585 - RNA, 14 nt, Homo sapiens
cuuccuccagggaa

SEQ ID NO: 937586 - RNA, 15 nt, Homo sapiens
cuucuccaucuccug

SEQ ID NO: 937587 - RNA, 16 nt, Homo sapiens
cuucugaguugcacau

SEQ ID NO: 937588 - RNA, 17 nt, Homo sapiens
cuucugcaacaucuuaa

SEQ ID NO: 937589 - RNA, 13 nt, Homo sapiens
cuucugcuucccu

SEQ ID NO: 937590 - RNA, 14 nt, Homo sapiens
cuugaaacauuaua

SEQ ID NO: 937591 - RNA, 17 nt, Homo sapiens
cuugaaaugaaagggaa

SEQ ID NO: 937592 - RNA, 21 nt, Homo sapiens
cuugaaauucucaucagucca

SEQ ID NO: 937593 - RNA, 20 nt, Homo sapiens
cuugagccacagucacugga

SEQ ID NO: 937594 - RNA, 16 nt, Homo sapiens
cuugccccaaaucuca

SEQ ID NO: 937595 - RNA, 19 nt, Homo sapiens
cuuguaacaguuuugugua

SEQ ID NO: 937596 - RNA, 15 nt, Homo sapiens
cuuguaacuaaaaua

SEQ ID NO: 937597 - RNA, 23 nt, Homo sapiens
cuuguccgcugggugguacccuc

SEQ ID NO: 937598 - RNA, 17 nt, Homo sapiens
cuuguguuauauagcca

SEQ ID NO: 937599 - RNA, 19 nt, Homo sapiens
cuuguguuauuuaaugagu

SEQ ID NO: 937600 - RNA, 15 nt, Homo sapiens
cuuuaaugcuuuuau

SEQ ID NO: 937601 - RNA, 15 nt, Homo sapiens
cuuuacuaauggugu

SEQ ID NO: 937602 - RNA, 15 nt, Homo sapiens
cuuucagagccagcc

SEQ ID NO: 937603 - RNA, 19 nt, Homo sapiens
cuuucaggguuuucuaacc

SEQ ID NO: 937604 - RNA, 18 nt, Homo sapiens
gaggagcgaucucagcag

SEQ ID NO: 937605 - RNA, 21 nt, Homo sapiens
gaggcaacccgugcucagcug

SEQ ID NO: 937606 - RNA, 20 nt, Homo sapiens
gaggcaggagagucacuuga

SEQ ID NO: 937607 - RNA, 17 nt, Homo sapiens
gaggcaggcggaucaug

SEQ ID NO: 937608 - RNA, 14 nt, Homo sapiens
gaggccauccugcc

SEQ ID NO: 937609 - RNA, 16 nt, Homo sapiens
gaggcugccccucuca

SEQ ID NO: 937610 - RNA, 21 nt, Homo sapiens
gagggagcgacacuugaaugu

SEQ ID NO: 937611 - RNA, 11 nt, Homo sapiens
gagggggcuca

SEQ ID NO: 937612 - RNA, 16 nt, Homo sapiens
gagguuaggucuuagg

SEQ ID NO: 937613 - RNA, 22 nt, Homo sapiens
gaguauacaaacauuuaagcug

SEQ ID NO: 937614 - RNA, 16 nt, Homo sapiens
gagucacaauaaagau

SEQ ID NO: 937615 - RNA, 21 nt, Homo sapiens
gaguguguuugugugcaugaa

SEQ ID NO: 937616 - RNA, 21 nt, Homo sapiens
gaguugcauagagauuuguau

SEQ ID NO: 937617 - RNA, 20 nt, Homo sapiens
gaguuuaaaaaugguaucaa

SEQ ID NO: 937618 - RNA, 16 nt, Homo sapiens
gauaaaugcaauauuc

SEQ ID NO: 937619 - RNA, 14 nt, Homo sapiens
gaucaacaauaccu

SEQ ID NO: 937620 - RNA, 15 nt, Homo sapiens
gaucagcgacccuga

SEQ ID NO: 937621 - RNA, 12 nt, Homo sapiens
gaucccugacau

SEQ ID NO: 937622 - RNA, 18 nt, Homo sapiens
gaucggcggccacugcgc

SEQ ID NO: 937623 - RNA, 20 nt, Homo sapiens
gaucuagccuccaucaugaa

SEQ ID NO: 937624 - RNA, 15 nt, Homo sapiens
gaucugauaagcaag

SEQ ID NO: 937625 - RNA, 16 nt, Homo sapiens
gaucugauaagcaaga

SEQ ID NO: 937626 - RNA, 20 nt, Homo sapiens
gaucugauaaggaucuagga

SEQ ID NO: 937627 - RNA, 15 nt, Homo sapiens
gaucuucccacagga

SEQ ID NO: 937628 - RNA, 17 nt, Homo sapiens
gaucuuucuuuccaaaa

SEQ ID NO: 937629 - RNA, 23 nt, Homo sapiens
gaugauacuuggaugcagcucuu

SEQ ID NO: 937630 - RNA, 23 nt, Homo sapiens
gaugauuuuguaaaaguggcauu

SEQ ID NO: 937631 - RNA, 17 nt, Homo sapiens
gaugcacuucaaauuca

SEQ ID NO: 937632 - RNA, 16 nt, Homo sapiens
gaugcagcucuuggga

SEQ ID NO: 937633 - RNA, 20 nt, Homo sapiens
gaugcagcucuugggaccgu

SEQ ID NO: 937634 - RNA, 23 nt, Homo sapiens
gaugggguaaucuauaacacauc

SEQ ID NO: 937635 - RNA, 18 nt, Homo sapiens
gauguuuccagacuuccu

SEQ ID NO: 937636 - RNA, 12 nt, Homo sapiens
gauucagcaaaa

SEQ ID NO: 937637 - RNA, 13 nt, Homo sapiens
gauucugccucaa

SEQ ID NO: 937638 - RNA, 14 nt, Homo sapiens
gauugaaaagaccu

SEQ ID NO: 937639 - RNA, 22 nt, Homo sapiens
gauuuaugaugcacuuauucaa

SEQ ID NO: 937640 - RNA, 20 nt, Homo sapiens
gauuucuacauuaacuugaa

SEQ ID NO: 937641 - RNA, 22 nt, Homo sapiens
gauuucuuucuuugcaccaaag

SEQ ID NO: 937642 - RNA, 23 nt, Homo sapiens
gauuucuuucuuugcaccaaaga

SEQ ID NO: 937643 - RNA, 13 nt, Homo sapiens
gauuuggugacca

SEQ ID NO: 937644 - RNA, 15 nt, Homo sapiens
gauuuggugaccaac

SEQ ID NO: 937645 - RNA, 13 nt, Homo sapiens
gauuuuaccaaag

SEQ ID NO: 937646 - RNA, 15 nt, Homo sapiens
gauuuuaccaaagca

SEQ ID NO: 937647 - RNA, 14 nt, Homo sapiens
gcaaaaaucuccca

SEQ ID NO: 937648 - RNA, 20 nt, Homo sapiens
gcaaacuuggugaaacuaca

SEQ ID NO: 937649 - RNA, 18 nt, Homo sapiens
gcaaagaccuaccuccag

SEQ ID NO: 937650 - RNA, 18 nt, Homo sapiens
gcaaagugccuugcucau

SEQ ID NO: 937651 - RNA, 23 nt, Homo sapiens
gcaaagugccuugcucauuugaa

SEQ ID NO: 937652 - RNA, 19 nt, Homo sapiens
gcaaauuuucagcauuaag

SEQ ID NO: 937653 - RNA, 18 nt, Homo sapiens
gcaacaagaccaccacuu

SEQ ID NO: 937654 - RNA, 22 nt, Homo sapiens
gcaacaagaccaccacuucgaa

SEQ ID NO: 937655 - RNA, 21 nt, Homo sapiens
gcaacagauaaguuugcaguu

SEQ ID NO: 937656 - RNA, 11 nt, Homo sapiens
gcaacaucucu

SEQ ID NO: 937657 - RNA, 22 nt, Homo sapiens
gcaagaugaaugcagauuacac

SEQ ID NO: 937658 - RNA, 17 nt, Homo sapiens
gcaauaauaagugaugu

SEQ ID NO: 937659 - RNA, 18 nt, Homo sapiens
gcaauaucuacguguuuu

SEQ ID NO: 937660 - RNA, 22 nt, Homo sapiens
gcaaucuccuuacuguguuuca

SEQ ID NO: 937661 - RNA, 23 nt, Homo sapiens
gcaaucucucucugugucuuucu

SEQ ID NO: 937662 - RNA, 20 nt, Homo sapiens
gcaauggaagcccucaaaga

SEQ ID NO: 937663 - RNA, 20 nt, Homo sapiens
gcaauuuuucaagagcuccu

SEQ ID NO: 937664 - RNA, 17 nt, Homo sapiens
gcacaauaaacauaaca

SEQ ID NO: 937665 - RNA, 15 nt, Homo sapiens
gcacacacagugauu

SEQ ID NO: 937666 - RNA, 17 nt, Homo sapiens
gcacagaaauuuucaau

SEQ ID NO: 937667 - RNA, 21 nt, Homo sapiens
gcacaggcgcaucccaggccu

SEQ ID NO: 937668 - RNA, 21 nt, Homo sapiens
gcacagggagugcacauaucc

SEQ ID NO: 937669 - RNA, 21 nt, Homo sapiens
gcaccuguaaucccagcuacu

SEQ ID NO: 937670 - RNA, 21 nt, Homo sapiens
gcacucucgcacacacaguga

SEQ ID NO: 937671 - RNA, 22 nt, Homo sapiens
gcacuggggagcccgucucagu

SEQ ID NO: 937672 - RNA, 22 nt, Homo sapiens
gcagacaauaaacccucagagc

SEQ ID NO: 937673 - RNA, 21 nt, Homo sapiens
gcagcagcaaggaaagcucac

SEQ ID NO: 937674 - RNA, 19 nt, Homo sapiens
gcagcuaaaggaagugaau

SEQ ID NO: 937675 - RNA, 13 nt, Homo sapiens
gcagcucuuggga

SEQ ID NO: 937676 - RNA, 17 nt, Homo sapiens
gcaggagaauagccuga

SEQ ID NO: 937677 - RNA, 23 nt, Homo sapiens
gcaggcugggccauguccaaaga

SEQ ID NO: 937678 - RNA, 15 nt, Homo sapiens
gcaggucaggacuca

SEQ ID NO: 937679 - RNA, 22 nt, Homo sapiens
gcaguccuuaucaccagccuca

SEQ ID NO: 937680 - RNA, 21 nt, Homo sapiens
gcaguuuugcuaucugggcug

SEQ ID NO: 937681 - RNA, 20 nt, Homo sapiens
gcauacuuucccucauccau

SEQ ID NO: 937682 - RNA, 18 nt, Homo sapiens
gcauauguguuacuucaa

SEQ ID NO: 937683 - RNA, 21 nt, Homo sapiens
gcaucaaaauauuucagugaa

SEQ ID NO: 937684 - RNA, 19 nt, Homo sapiens
gcaucaauacaaccagccc

SEQ ID NO: 937685 - RNA, 21 nt, Homo sapiens
gcaucaauacaaccagcccaa

SEQ ID NO: 937686 - RNA, 23 nt, Homo sapiens
gcaucacggauggugcaugggcu

SEQ ID NO: 937687 - RNA, 15 nt, Homo sapiens
gcaucaucaaaaacu

SEQ ID NO: 937688 - RNA, 18 nt, Homo sapiens
gcaucugcaacaaaaagu

SEQ ID NO: 937689 - RNA, 20 nt, Homo sapiens
gcaugaaagagaaagacuga

SEQ ID NO: 937690 - RNA, 14 nt, Homo sapiens
gcauuccagccuug

SEQ ID NO: 937691 - RNA, 17 nt, Homo sapiens
gccaaaacaagccaaag

SEQ ID NO: 937692 - RNA, 13 nt, Homo sapiens
gccaaaaugccau

SEQ ID NO: 937693 - RNA, 18 nt, Homo sapiens
gccaagagugaagggaag

SEQ ID NO: 937694 - RNA, 20 nt, Homo sapiens
gccaagguaggcagaucacc

SEQ ID NO: 937695 - RNA, 17 nt, Homo sapiens
gccaauauaacuaucuc

SEQ ID NO: 937696 - RNA, 14 nt, Homo sapiens
gccacuaugagcuu

SEQ ID NO: 937697 - RNA, 15 nt, Homo sapiens
gccacuggcugcuaa

SEQ ID NO: 937698 - RNA, 14 nt, Homo sapiens
gccagccucagaag

SEQ ID NO: 937699 - RNA, 16 nt, Homo sapiens
gccaguuuuacuguga

SEQ ID NO: 937700 - RNA, 19 nt, Homo sapiens
gcccaggcuggagugcagu

SEQ ID NO: 937701 - RNA, 13 nt, Homo sapiens
gcccauggcauuu

SEQ ID NO: 937702 - RNA, 20 nt, Homo sapiens
gcccauggugagcucuggga

SEQ ID NO: 937703 - RNA, 17 nt, Homo sapiens
gccccucugaccugcac

SEQ ID NO: 937704 - RNA, 19 nt, Homo sapiens
gccccucugaccugcacug

SEQ ID NO: 937705 - RNA, 15 nt, Homo sapiens
gccccuuccauggua

SEQ ID NO: 937706 - RNA, 17 nt, Homo sapiens
gcccuagaugcacgugg

SEQ ID NO: 937707 - RNA, 17 nt, Homo sapiens
gcccugaggccuagacu

SEQ ID NO: 937708 - RNA, 17 nt, Homo sapiens
gcccugccccaccccau

SEQ ID NO: 937709 - RNA, 22 nt, Homo sapiens
gcccugggugcaggacacuggu

SEQ ID NO: 937710 - RNA, 19 nt, Homo sapiens
gcccuucccccugcaaaaa

SEQ ID NO: 937711 - RNA, 21 nt, Homo sapiens
gccgagaucacgucacugcac

SEQ ID NO: 937712 - RNA, 15 nt, Homo sapiens
gccgagugcacugca

SEQ ID NO: 937713 - RNA, 22 nt, Homo sapiens
gccgcacaucuggucucggagc

SEQ ID NO: 937714 - RNA, 16 nt, Homo sapiens
gccuagugaacugcaa

SEQ ID NO: 937715 - RNA, 20 nt, Homo sapiens
gccucaccuccucugugauu

SEQ ID NO: 937716 - RNA, 12 nt, Homo sapiens
gccucacugggg

SEQ ID NO: 937717 - RNA, 21 nt, Homo sapiens
gccucacuggggcagacaaua

SEQ ID NO: 937718 - RNA, 13 nt, Homo sapiens
gccuccagggcau

SEQ ID NO: 937719 - RNA, 20 nt, Homo sapiens
gccuccagggcauugcucag

SEQ ID NO: 937720 - RNA, 14 nt, Homo sapiens
gccucccaccagag

SEQ ID NO: 937721 - RNA, 20 nt, Homo sapiens
gccucccccucagaugaucu

SEQ ID NO: 937722 - RNA, 13 nt, Homo sapiens
gccuccuggccag

SEQ ID NO: 937723 - RNA, 18 nt, Homo sapiens
gccucuccuacuaugcaa

SEQ ID NO: 937724 - RNA, 17 nt, Homo sapiens
gccucucggugaccucc

SEQ ID NO: 937725 - RNA, 18 nt, Homo sapiens
gccucucggugaccuccg

SEQ ID NO: 937726 - RNA, 21 nt, Homo sapiens
gccugcacagugaagugcugg

SEQ ID NO: 937727 - RNA, 13 nt, Homo sapiens
gccuguggcauuc

SEQ ID NO: 937728 - RNA, 23 nt, Homo sapiens
gccuguucuuuuaccacugacag

SEQ ID NO: 937729 - RNA, 19 nt, Homo sapiens
gccuuaaucccagcacuuu

SEQ ID NO: 937730 - RNA, 19 nt, Homo sapiens
gccuuggcaggcugcugga

SEQ ID NO: 937731 - RNA, 21 nt, Homo sapiens
gcgcccuuaacugcauccagc

SEQ ID NO: 937732 - RNA, 20 nt, Homo sapiens
gcgcuguuuucucagcucca

SEQ ID NO: 937733 - RNA, 15 nt, Homo sapiens
gcgucaucuguguaa

SEQ ID NO: 937734 - RNA, 17 nt, Homo sapiens
gcgugggcgcuugcacc

SEQ ID NO: 937735 - RNA, 16 nt, Homo sapiens
gcguguuggugugcac

SEQ ID NO: 937736 - RNA, 16 nt, Homo sapiens
gcguuaaauaagcaaa

SEQ ID NO: 937737 - RNA, 19 nt, Homo sapiens
gcuaaacucuuucaucccc

SEQ ID NO: 937738 - RNA, 20 nt, Homo sapiens
gcuaaauauuuaccuugaaa

SEQ ID NO: 937739 - RNA, 15 nt, Homo sapiens
gcuaacaagucacca

SEQ ID NO: 937740 - RNA, 17 nt, Homo sapiens
gcuacaguuauuaaucu

SEQ ID NO: 937741 - RNA, 18 nt, Homo sapiens
gcuaccaacuuguaucca

SEQ ID NO: 937742 - RNA, 22 nt, Homo sapiens
gcuacuacgguugaucuugcaa

SEQ ID NO: 937743 - RNA, 20 nt, Homo sapiens
gcuauaguuauacaucaauu

SEQ ID NO: 937744 - RNA, 16 nt, Homo sapiens
gcuauugucuguaaua

SEQ ID NO: 937745 - RNA, 17 nt, Homo sapiens
gcucagauuguaauaug

SEQ ID NO: 937746 - RNA, 23 nt, Homo sapiens
gcucaguaaacgggaacaugccc

SEQ ID NO: 937747 - RNA, 21 nt, Homo sapiens
gcucaguguuuuugugaauug

SEQ ID NO: 937748 - RNA, 21 nt, Homo sapiens
gcucauaaaauggaagcaauu

SEQ ID NO: 937749 - RNA, 19 nt, Homo sapiens
gcucccagacggucaggaa

SEQ ID NO: 937750 - RNA, 18 nt, Homo sapiens
gcucccugacagcaccug

SEQ ID NO: 937751 - RNA, 20 nt, Homo sapiens
ucagucaacaacuuacacuu

SEQ ID NO: 937752 - RNA, 17 nt, Homo sapiens
ucagugauuacugucaa

SEQ ID NO: 937753 - RNA, 15 nt, Homo sapiens
ucaguuauuacaugu

SEQ ID NO: 937754 - RNA, 17 nt, Homo sapiens
ucaguuucuaggcaccu

SEQ ID NO: 937755 - RNA, 12 nt, Homo sapiens
ucauacugaaaa

SEQ ID NO: 937756 - RNA, 20 nt, Homo sapiens
ucauauuuuaaacagaggau

SEQ ID NO: 937757 - RNA, 18 nt, Homo sapiens
ucaucaggugcauagcaa

SEQ ID NO: 937758 - RNA, 23 nt, Homo sapiens
ucaucaggugcauagcaagugaa

SEQ ID NO: 937759 - RNA, 22 nt, Homo sapiens
ucaucaguccauugcucuugag

SEQ ID NO: 937760 - RNA, 13 nt, Homo sapiens
ucauccaccccau

SEQ ID NO: 937761 - RNA, 18 nt, Homo sapiens
ucauccauccuugccaau

SEQ ID NO: 937762 - RNA, 19 nt, Homo sapiens
ucaugccacugcacugcag

SEQ ID NO: 937763 - RNA, 16 nt, Homo sapiens
ucaugcggacccucac

SEQ ID NO: 937764 - RNA, 16 nt, Homo sapiens
ucauguaugucagaag

SEQ ID NO: 937765 - RNA, 18 nt, Homo sapiens
ucauucgcuacuaugauu

SEQ ID NO: 937766 - RNA, 15 nt, Homo sapiens
ucauugcacuuugau

SEQ ID NO: 937767 - RNA, 15 nt, Homo sapiens
ucauugccacacuug

SEQ ID NO: 937768 - RNA, 14 nt, Homo sapiens
ucauuuaagggaaa

SEQ ID NO: 937769 - RNA, 18 nt, Homo sapiens
uccaaaaauguguaagaa

SEQ ID NO: 937770 - RNA, 15 nt, Homo sapiens
uccaaagaggcugcc

SEQ ID NO: 937771 - RNA, 22 nt, Homo sapiens
uccaaagaggcugccccucuca

SEQ ID NO: 937772 - RNA, 16 nt, Homo sapiens
uccaacacaucucccu

SEQ ID NO: 937773 - RNA, 17 nt, Homo sapiens
uccaccaaaugugcuuu

SEQ ID NO: 937774 - RNA, 16 nt, Homo sapiens
uccaccuagacuguaa

SEQ ID NO: 937775 - RNA, 18 nt, Homo sapiens
uccagagacaacagguaa

SEQ ID NO: 937776 - RNA, 15 nt, Homo sapiens
uccagccaccaccua

SEQ ID NO: 937777 - RNA, 19 nt, Homo sapiens
uccagccacuggcugcuaa

SEQ ID NO: 937778 - RNA, 19 nt, Homo sapiens
uccagcuugggcaacagag

SEQ ID NO: 937779 - RNA, 13 nt, Homo sapiens
uccaggaacugca

SEQ ID NO: 937780 - RNA, 20 nt, Homo sapiens
uccaggaacugcaggucaag

SEQ ID NO: 937781 - RNA, 17 nt, Homo sapiens
uccagggcauugcucag

SEQ ID NO: 937782 - RNA, 22 nt, Homo sapiens
uccaguuuuauaaaaaguggag

SEQ ID NO: 937783 - RNA, 15 nt, Homo sapiens
uccaucucaaaaaag

SEQ ID NO: 937784 - RNA, 15 nt, Homo sapiens
uccauguuugcaccu

SEQ ID NO: 937785 - RNA, 21 nt, Homo sapiens
uccauucugucuuccuaggaa

SEQ ID NO: 937786 - RNA, 15 nt, Homo sapiens
ucccacccagcuaaa

SEQ ID NO: 937787 - RNA, 18 nt, Homo sapiens
ucccagguuuagugaaaa

SEQ ID NO: 937788 - RNA, 19 nt, Homo sapiens
ucccauaacaaccugggca

SEQ ID NO: 937789 - RNA, 22 nt, Homo sapiens
ucccauuuuugcuuagcucaau

SEQ ID NO: 937790 - RNA, 16 nt, Homo sapiens
uccccaccuccugucg

SEQ ID NO: 937791 - RNA, 13 nt, Homo sapiens
ucccccaguuccu

SEQ ID NO: 937792 - RNA, 21 nt, Homo sapiens
ucccccaguuccucccaggaa

SEQ ID NO: 937793 - RNA, 14 nt, Homo sapiens
uccccucacucugu

SEQ ID NO: 937794 - RNA, 21 nt, Homo sapiens
uccccuguagcagucacugac

SEQ ID NO: 937795 - RNA, 20 nt, Homo sapiens
ucccgaguugcugggauuac

SEQ ID NO: 937796 - RNA, 19 nt, Homo sapiens
ucccggaguucuccugcuc

SEQ ID NO: 937797 - RNA, 18 nt, Homo sapiens
ucccucagaucccaguuc

SEQ ID NO: 937798 - RNA, 20 nt, Homo sapiens
ucccuccccaguucauugca

SEQ ID NO: 937799 - RNA, 18 nt, Homo sapiens
ucccucgacauuuucucc

SEQ ID NO: 937800 - RNA, 22 nt, Homo sapiens
ucccucuuuggcuccccuguac

SEQ ID NO: 937801 - RNA, 14 nt, Homo sapiens
ucccugacuguaaa

SEQ ID NO: 937802 - RNA, 15 nt, Homo sapiens
ucccugacuguaaau

SEQ ID NO: 937803 - RNA, 16 nt, Homo sapiens
ucccugggccaacaga

SEQ ID NO: 937804 - RNA, 18 nt, Homo sapiens
ucccugggccaacagacc

SEQ ID NO: 937805 - RNA, 24 nt, Homo sapiens
uccuaaagaaaaauaucuuggccu

SEQ ID NO: 937806 - RNA, 13 nt, Homo sapiens
uccuaaccaguga

SEQ ID NO: 937807 - RNA, 20 nt, Homo sapiens
uccuaccuguuuugugguca

SEQ ID NO: 937808 - RNA, 20 nt, Homo sapiens
uccuauggguugucaccaag

SEQ ID NO: 937809 - RNA, 14 nt, Homo sapiens
uccucccccaguuc

SEQ ID NO: 937810 - RNA, 14 nt, Homo sapiens
uccucucugcacac

SEQ ID NO: 937811 - RNA, 17 nt, Homo sapiens
uccucugugcaaaggga

SEQ ID NO: 937812 - RNA, 19 nt, Homo sapiens
uccuguucacaccagagaa

SEQ ID NO: 937813 - RNA, 14 nt, Homo sapiens
uccuuaggccucug

SEQ ID NO: 937814 - RNA, 20 nt, Homo sapiens
uccuugacccugcuuuuugc

SEQ ID NO: 937815 - RNA, 21 nt, Homo sapiens
uccuugugccuucuuuguaua

SEQ ID NO: 937816 - RNA, 22 nt, Homo sapiens
uccuuuacuaaugguguugagu

SEQ ID NO: 937817 - RNA, 23 nt, Homo sapiens
uccuuucacccgcuccuacagcu

SEQ ID NO: 937818 - RNA, 21 nt, Homo sapiens
uccuuucagcaauccaugaga

SEQ ID NO: 937819 - RNA, 12 nt, Homo sapiens
ucgagagccaaa

SEQ ID NO: 937820 - RNA, 16 nt, Homo sapiens
ucgcccacaaacugau

SEQ ID NO: 937821 - RNA, 22 nt, Homo sapiens
ucuggcaggaagggacugccaa

SEQ ID NO: 937822 - RNA, 14 nt, Homo sapiens
ucuggcucuugagg

SEQ ID NO: 937823 - RNA, 12 nt, Homo sapiens
ucuguaccucaa

SEQ ID NO: 937824 - RNA, 16 nt, Homo sapiens
ucuguacuaaaguauu

SEQ ID NO: 937825 - RNA, 17 nt, Homo sapiens
ucuguaggaaacccaac

SEQ ID NO: 937826 - RNA, 15 nt, Homo sapiens
ucuguaucugccaug

SEQ ID NO: 937827 - RNA, 20 nt, Homo sapiens
ucuguauucgaaaugagcuc

SEQ ID NO: 937828 - RNA, 21 nt, Homo sapiens
ucuguauugggguacaggaau

SEQ ID NO: 937829 - RNA, 17 nt, Homo sapiens
ucugucaacaucaaaga

SEQ ID NO: 937830 - RNA, 14 nt, Homo sapiens
ucugucuguggcaa

SEQ ID NO: 937831 - RNA, 15 nt, Homo sapiens
ucugucuguggcaaa

SEQ ID NO: 937832 - RNA, 22 nt, Homo sapiens
ucuguggcaaaaguuuaaucag

SEQ ID NO: 937833 - RNA, 17 nt, Homo sapiens
ucuuacuacagcuucag

SEQ ID NO: 937834 - RNA, 20 nt, Homo sapiens
ucuuacuacagcuucaguga

SEQ ID NO: 937835 - RNA, 14 nt, Homo sapiens
ucuuagugugccaa

SEQ ID NO: 937836 - RNA, 20 nt, Homo sapiens
ucuuagugugccaagaguuc

SEQ ID NO: 937837 - RNA, 18 nt, Homo sapiens
ucuuauuaguuccccaaa

SEQ ID NO: 937838 - RNA, 22 nt, Homo sapiens
ucuuauuuucaaagcaguauag

SEQ ID NO: 937839 - RNA, 18 nt, Homo sapiens
ucuucaagacgacagcuc

SEQ ID NO: 937840 - RNA, 22 nt, Homo sapiens
ucuucaagacgacagcucugua

SEQ ID NO: 937841 - RNA, 15 nt, Homo sapiens
ucuucucguuuucac

SEQ ID NO: 937842 - RNA, 18 nt, Homo sapiens
ucuugcaacucuguaaau

SEQ ID NO: 937843 - RNA, 23 nt, Homo sapiens
ucuuuccuggcacuaacguugag

SEQ ID NO: 937844 - RNA, 20 nt, Homo sapiens
ucuuucuuugcaccaaagac

SEQ ID NO: 937845 - RNA, 15 nt, Homo sapiens
ucuuugcaccaaaga

SEQ ID NO: 937846 - RNA, 17 nt, Homo sapiens
ucuuugccagucauuca

SEQ ID NO: 937847 - RNA, 13 nt, Homo sapiens
ucuuugugugaca

SEQ ID NO: 937848 - RNA, 13 nt, Homo sapiens
ucuuuugccauua

SEQ ID NO: 937849 - RNA, 22 nt, Homo sapiens
ugaaaauggacagaaugugucu

SEQ ID NO: 937850 - RNA, 16 nt, Homo sapiens
ugaaacuacaucucca

SEQ ID NO: 937851 - RNA, 17 nt, Homo sapiens
ugaaacuccagaugcca

SEQ ID NO: 937852 - RNA, 20 nt, Homo sapiens
ugaaagaccugaauaccacu

SEQ ID NO: 937853 - RNA, 16 nt, Homo sapiens
ugaaagggaaacuggg

SEQ ID NO: 937854 - RNA, 23 nt, Homo sapiens
ugaaauacuauuuaaagccuccu

SEQ ID NO: 937855 - RNA, 14 nt, Homo sapiens
ugaaaugaaaggga

SEQ ID NO: 937856 - RNA, 15 nt, Homo sapiens
ugaaaugaaagggaa

SEQ ID NO: 937857 - RNA, 16 nt, Homo sapiens
ugaaaugaaagggaaa

SEQ ID NO: 937858 - RNA, 13 nt, Homo sapiens
ugaaauguuacaa

SEQ ID NO: 937859 - RNA, 17 nt, Homo sapiens
ugaacuaggcugagcaa

SEQ ID NO: 937860 - RNA, 19 nt, Homo sapiens
ugaagugcuuaguguacuu

SEQ ID NO: 937861 - RNA, 17 nt, Homo sapiens
ugaaguuuugauuuauu

SEQ ID NO: 937862 - RNA, 18 nt, Homo sapiens
ugaauaccacuuaccuca

SEQ ID NO: 937863 - RNA, 21 nt, Homo sapiens
ugaaucauuguauguggucau

SEQ ID NO: 937864 - RNA, 18 nt, Homo sapiens
ugaauccuggccuggaau

SEQ ID NO: 937865 - RNA, 22 nt, Homo sapiens
ugaauguuacaacgaauuuaca

SEQ ID NO: 937866 - RNA, 22 nt, Homo sapiens
ugacaaaccauaacugacaaga

SEQ ID NO: 937867 - RNA, 12 nt, Homo sapiens
ugacaacaucgc

SEQ ID NO: 937868 - RNA, 16 nt, Homo sapiens
ugacaacaucgcaaua

SEQ ID NO: 937869 - RNA, 16 nt, Homo sapiens
ugacaccaaaccugcc

SEQ ID NO: 937870 - RNA, 19 nt, Homo sapiens
ugacacccaugccagagag

SEQ ID NO: 937871 - RNA, 19 nt, Homo sapiens
ugacauugauuugcucuua

SEQ ID NO: 937872 - RNA, 18 nt, Homo sapiens
ugaccuggaaucagugaa

SEQ ID NO: 937873 - RNA, 19 nt, Homo sapiens
ugaccuggaaucagugaag

SEQ ID NO: 937874 - RNA, 12 nt, Homo sapiens
ugacugugguag

SEQ ID NO: 937875 - RNA, 22 nt, Homo sapiens
ugagagcaauauuuaaauucuc

SEQ ID NO: 937876 - RNA, 23 nt, Homo sapiens
ugagaggcugucuguuguauuca

SEQ ID NO: 937877 - RNA, 18 nt, Homo sapiens
ugagcaagacauacuuaa

SEQ ID NO: 937878 - RNA, 20 nt, Homo sapiens
ugagcagggagaccaugccu

SEQ ID NO: 937879 - RNA, 19 nt, Homo sapiens
ugagcaggucaggacucag

SEQ ID NO: 937880 - RNA, 18 nt, Homo sapiens
ugagccaucaucauggca

SEQ ID NO: 937881 - RNA, 21 nt, Homo sapiens
ugagccccuggaggcacugaa

SEQ ID NO: 937882 - RNA, 18 nt, Homo sapiens
ugagccgaggucaugcca

SEQ ID NO: 937883 - RNA, 13 nt, Homo sapiens
ugagcucugggaa

SEQ ID NO: 937884 - RNA, 18 nt, Homo sapiens
ugaggacgcuggggaaua

SEQ ID NO: 937885 - RNA, 18 nt, Homo sapiens
ugaggaggguacuuuucc

SEQ ID NO: 937886 - RNA, 22 nt, Homo sapiens
ugaggcugcgagagaaagggag

SEQ ID NO: 937887 - RNA, 19 nt, Homo sapiens
ugagggcagcuuugcaaaa

SEQ ID NO: 937888 - RNA, 15 nt, Homo sapiens
ugagggcaguucuga

SEQ ID NO: 937889 - RNA, 22 nt, Homo sapiens
ugagggcaguucugaguguuua

SEQ ID NO: 937890 - RNA, 17 nt, Homo sapiens
ugagugaaccuguauaa

SEQ ID NO: 937891 - RNA, 14 nt, Homo sapiens
ugaguggucuucaa

SEQ ID NO: 937892 - RNA, 15 nt, Homo sapiens
ugcgagagaaaggga

SEQ ID NO: 937893 - RNA, 16 nt, Homo sapiens
ugcgagagaaagggag

SEQ ID NO: 937894 - RNA, 20 nt, Homo sapiens
ugcgcccuucauugccacac

SEQ ID NO: 937895 - RNA, 19 nt, Homo sapiens
ugcgcucuggggacugagc

SEQ ID NO: 937896 - RNA, 22 nt, Homo sapiens
ugcgggcucccuggcaggaugc

SEQ ID NO: 937897 - RNA, 21 nt, Homo sapiens
ugcguguguguucacguguuc

SEQ ID NO: 937898 - RNA, 17 nt, Homo sapiens
ugcguuaaauaagcaaa

SEQ ID NO: 937899 - RNA, 16 nt, Homo sapiens
ugcuaacaagucacca

SEQ ID NO: 937900 - RNA, 16 nt, Homo sapiens
ugcuaauaaguuugaa

SEQ ID NO: 937901 - RNA, 14 nt, Homo sapiens
ugcuacaauucauu

SEQ ID NO: 937902 - RNA, 18 nt, Homo sapiens
ugcuauacacaagcaaug

SEQ ID NO: 937903 - RNA, 15 nt, Homo sapiens
ugcuauuugucaucu

SEQ ID NO: 937904 - RNA, 20 nt, Homo sapiens
ugcucaguguuuuugugaau

SEQ ID NO: 937905 - RNA, 15 nt, Homo sapiens
ugcuccagucauugc

SEQ ID NO: 937906 - RNA, 17 nt, Homo sapiens
ugcuccagucauugcac

SEQ ID NO: 937907 - RNA, 20 nt, Homo sapiens
ugcuccauaguuuggcauuu

SEQ ID NO: 937908 - RNA, 20 nt, Homo sapiens
ugcuccccuaaagccucaaa

SEQ ID NO: 937909 - RNA, 23 nt, Homo sapiens
ugcucucggacucccuaccccaa

SEQ ID NO: 937910 - RNA, 14 nt, Homo sapiens
ugcucuugagucuu

SEQ ID NO: 937911 - RNA, 19 nt, Homo sapiens
ugcucuugagucuuugcag

SEQ ID NO: 937912 - RNA, 24 nt, Homo sapiens
ugcugucuaugauuguacuuugaa

SEQ ID NO: 937913 - RNA, 20 nt, Homo sapiens
ugcugucucaucacauaaaa

SEQ ID NO: 937914 - RNA, 21 nt, Homo sapiens
uggaacagcauuacccuccuc

SEQ ID NO: 937915 - RNA, 20 nt, Homo sapiens
uggaagaaggaaacaccgag

SEQ ID NO: 937916 - RNA, 19 nt, Homo sapiens
uggagggaaugcucagaaa

SEQ ID NO: 937917 - RNA, 19 nt, Homo sapiens
uggaggggagggaucuccu

SEQ ID NO: 937918 - RNA, 22 nt, Homo sapiens
uggagguggaaaagcaacauuc

SEQ ID NO: 937919 - RNA, 15 nt, Homo sapiens
uggauaaauugcaca

SEQ ID NO: 937920 - RNA, 17 nt, Homo sapiens
uggauaccauuauaugu

SEQ ID NO: 937921 - RNA, 13 nt, Homo sapiens
uggaugcagcucu

SEQ ID NO: 937922 - RNA, 23 nt, Homo sapiens
uggcaaguugcaucagaaagcuu

SEQ ID NO: 937923 - RNA, 15 nt, Homo sapiens
uggcaccagaugcaa

SEQ ID NO: 937924 - RNA, 20 nt, Homo sapiens
uggcccuaccagacacugcu

SEQ ID NO: 937925 - RNA, 21 nt, Homo sapiens
uggccucugugccuucuuuug

SEQ ID NO: 937926 - RNA, 16 nt, Homo sapiens
uggccugugugauaca

SEQ ID NO: 937927 - RNA, 20 nt, Homo sapiens
uggcguuuggacccaguuca

SEQ ID NO: 937928 - RNA, 21 nt, Homo sapiens
uggcuaaagagcuuugugaua

SEQ ID NO: 937929 - RNA, 20 nt, Homo sapiens
uggcucaugccuguaauccc

SEQ ID NO: 937930 - RNA, 15 nt, Homo sapiens
uggcucaugccuuaa

SEQ ID NO: 937931 - RNA, 13 nt, Homo sapiens
uggcucugggaau

SEQ ID NO: 937932 - RNA, 20 nt, Homo sapiens
uggcugcugucauaacaucc

SEQ ID NO: 937933 - RNA, 19 nt, Homo sapiens
ugggaaucaacagcauauu

SEQ ID NO: 937934 - RNA, 13 nt, Homo sapiens
ugggacagaggag

SEQ ID NO: 937935 - RNA, 15 nt, Homo sapiens
ugggaguaggugcua

SEQ ID NO: 937936 - RNA, 23 nt, Homo sapiens
ugggauauccuuucacucugcau

SEQ ID NO: 937937 - RNA, 18 nt, Homo sapiens
ugggcaacagagcaagac

SEQ ID NO: 937938 - RNA, 12 nt, Homo sapiens
ugggcaggugaa

SEQ ID NO: 937939 - RNA, 16 nt, Homo sapiens
ugggcauuccuuggga

SEQ ID NO: 937940 - RNA, 14 nt, Homo sapiens
ugggcugucuguca

SEQ ID NO: 937941 - RNA, 19 nt, Homo sapiens
ugggcugugggcaagccua

SEQ ID NO: 937942 - RNA, 16 nt, Homo sapiens
ugggcuugaaacauua

SEQ ID NO: 937943 - RNA, 20 nt, Homo sapiens
uggggcagaaacacucaagu

SEQ ID NO: 937944 - RNA, 19 nt, Homo sapiens
uggggcaggcugggccaug

SEQ ID NO: 937945 - RNA, 21 nt, Homo sapiens
uggggccaaacccaccugcua

SEQ ID NO: 937946 - RNA, 15 nt, Homo sapiens
uggggccaacuggaa

SEQ ID NO: 937947 - RNA, 14 nt, Homo sapiens
uggguuaaguauua

SEQ ID NO: 937948 - RNA, 14 nt, Homo sapiens
uggguugucaccaa

SEQ ID NO: 937949 - RNA, 12 nt, Homo sapiens
ugguacaaggaa

SEQ ID NO: 937950 - RNA, 14 nt, Homo sapiens
ugguacaaggaaua

SEQ ID NO: 937951 - RNA, 22 nt, Homo sapiens
uggucacaacuugauggcugcg

SEQ ID NO: 937952 - RNA, 20 nt, Homo sapiens
uggucagugguggucuucaa

SEQ ID NO: 937953 - RNA, 16 nt, Homo sapiens
uggugaccuuucacga

SEQ ID NO: 937954 - RNA, 19 nt, Homo sapiens
ugguucacauccuaccccu

SEQ ID NO: 937955 - RNA, 16 nt, Homo sapiens
uguaaaagggcucucu

SEQ ID NO: 937956 - RNA, 13 nt, Homo sapiens
uguaacacugugu

SEQ ID NO: 937957 - RNA, 19 nt, Homo sapiens
uguaagaacaacuaccuga

SEQ ID NO: 937958 - RNA, 18 nt, Homo sapiens
uguaauggacuaugcaca

SEQ ID NO: 937959 - RNA, 19 nt, Homo sapiens
uguaauggacuaugcacac

SEQ ID NO: 937960 - RNA, 15 nt, Homo sapiens
uguacacaacaaucc

SEQ ID NO: 937961 - RNA, 16 nt, Homo sapiens
uguaccaagugaaauu

SEQ ID NO: 937962 - RNA, 20 nt, Homo sapiens
uguagauucagguaauacaa

SEQ ID NO: 937963 - RNA, 21 nt, Homo sapiens
uguagauucagguaauacaaa

SEQ ID NO: 937964 - RNA, 15 nt, Homo sapiens
uguagcugugucaug

SEQ ID NO: 937965 - RNA, 14 nt, Homo sapiens
uguaggcauuuuaa

SEQ ID NO: 937966 - RNA, 18 nt, Homo sapiens
uguagucccagcuaccca

SEQ ID NO: 937967 - RNA, 11 nt, Homo sapiens
uguauauccaa

SEQ ID NO: 937968 - RNA, 14 nt, Homo sapiens
uguauauugucuag

SEQ ID NO: 937969 - RNA, 18 nt, Homo sapiens
uguauuaaacucuucaca

SEQ ID NO: 937970 - RNA, 22 nt, Homo sapiens
uguauuuucuuacacuguguca

SEQ ID NO: 937971 - RNA, 13 nt, Homo sapiens
ugucaacaucaaa

SEQ ID NO: 937972 - RNA, 22 nt, Homo sapiens
ugucaccaggauuacuagucaa

SEQ ID NO: 937973 - RNA, 14 nt, Homo sapiens
ugucaccuugauga

SEQ ID NO: 937974 - RNA, 15 nt, Homo sapiens
ugucauccucacagu

SEQ ID NO: 937975 - RNA, 21 nt, Homo sapiens
ugucauucuguuagauacuaa

SEQ ID NO: 937976 - RNA, 15 nt, Homo sapiens
ugucauuucaaagac

SEQ ID NO: 937977 - RNA, 15 nt, Homo sapiens
ugucccugacuguaa

SEQ ID NO: 937978 - RNA, 17 nt, Homo sapiens
ugucuaaacaaugcuga

SEQ ID NO: 937979 - RNA, 18 nt, Homo sapiens
ugucuacgggggcacuug

SEQ ID NO: 937980 - RNA, 19 nt, Homo sapiens
ugucucaggaaaacagcua

SEQ ID NO: 937981 - RNA, 14 nt, Homo sapiens
ugucuccugagcac

SEQ ID NO: 937982 - RNA, 17 nt, Homo sapiens
ugucugucaccagcuau

SEQ ID NO: 937983 - RNA, 19 nt, Homo sapiens
ugucuuaauuuucuuucac

SEQ ID NO: 937984 - RNA, 13 nt, Homo sapiens
ugucuucagagaa

SEQ ID NO: 937985 - RNA, 15 nt, Homo sapiens
ugucuuuagugcucc

SEQ ID NO: 937986 - RNA, 15 nt, Homo sapiens
ugugauagcacuuuc

SEQ ID NO: 937987 - RNA, 20 nt, Homo sapiens
ugugcaggcaccugauacuu

SEQ ID NO: 937988 - RNA, 22 nt, Homo sapiens
ugugcauacuuucccucaucca

SEQ ID NO: 937989 - RNA, 17 nt, Homo sapiens
ugugcccuguggcugcc

SEQ ID NO: 937990 - RNA, 14 nt, Homo sapiens
ugugcuacaauuca

SEQ ID NO: 937991 - RNA, 18 nt, Homo sapiens
ugugcuccagucauugca

SEQ ID NO: 937992 - RNA, 15 nt, Homo sapiens
ugugguggcucaugc

SEQ ID NO: 937993 - RNA, 19 nt, Homo sapiens
uguguaagaaauacagacu

SEQ ID NO: 937994 - RNA, 23 nt, Homo sapiens
uguguauccaugcaccuaccuua

SEQ ID NO: 937995 - RNA, 13 nt, Homo sapiens
ugugucauguaua

SEQ ID NO: 937996 - RNA, 22 nt, Homo sapiens
uguguccccucacucugucagc

SEQ ID NO: 937997 - RNA, 14 nt, Homo sapiens
uguuaccuguagau

SEQ ID NO: 937998 - RNA, 18 nt, Homo sapiens
uguuagauauuuuucaua

SEQ ID NO: 937999 - RNA, 23 nt, Homo sapiens
uguuauauagggaucaaccagcu

SEQ ID NO: 938000 - RNA, 23 nt, Homo sapiens
ucauugaugagcaagacauacuu

SEQ ID NO: 938001 - RNA, 14 nt, Homo sapiens
ucauugcauuccag

SEQ ID NO: 938002 - RNA, 15 nt, Homo sapiens
ucauuggaagccauc

SEQ ID NO: 938003 - RNA, 13 nt, Homo sapiens
ucauuucaucuca

SEQ ID NO: 938004 - RNA, 19 nt, Homo sapiens
ucauuuguuuacauuugau

SEQ ID NO: 938005 - RNA, 22 nt, Homo sapiens
ucauuuuuacagaguuugugaa

SEQ ID NO: 938006 - RNA, 14 nt, Homo sapiens
uccaaaacauuucu

SEQ ID NO: 938007 - RNA, 19 nt, Homo sapiens
uccaaaaccuaaagaggaa

SEQ ID NO: 938008 - RNA, 12 nt, Homo sapiens
uccaaagaggcu

SEQ ID NO: 938009 - RNA, 15 nt, Homo sapiens
uccaaccuucccaaa

SEQ ID NO: 938010 - RNA, 15 nt, Homo sapiens
uccaaucaugaaaag

SEQ ID NO: 938011 - RNA, 13 nt, Homo sapiens
uccaauuucaaga

SEQ ID NO: 938012 - RNA, 20 nt, Homo sapiens
uccaauuuuuuaagugaaaa

SEQ ID NO: 938013 - RNA, 15 nt, Homo sapiens
uccacaccugggcau

SEQ ID NO: 938014 - RNA, 17 nt, Homo sapiens
uccacaccugggcauuu

SEQ ID NO: 938015 - RNA, 12 nt, Homo sapiens
uccacauguuac

SEQ ID NO: 938016 - RNA, 14 nt, Homo sapiens
uccaccgcacagac

SEQ ID NO: 938017 - RNA, 15 nt, Homo sapiens
uccaccuagacugua

SEQ ID NO: 938018 - RNA, 15 nt, Homo sapiens
uccacugucaggguu

SEQ ID NO: 938019 - RNA, 11 nt, Homo sapiens
uccacuuguau

SEQ ID NO: 938020 - RNA, 13 nt, Homo sapiens
uccagacuucaaa

SEQ ID NO: 938021 - RNA, 15 nt, Homo sapiens
uccagccuccagggc

SEQ ID NO: 938022 - RNA, 20 nt, Homo sapiens
uccauacccccacaugccaa

SEQ ID NO: 938023 - RNA, 18 nt, Homo sapiens
uccaugagauagcuauua

SEQ ID NO: 938024 - RNA, 22 nt, Homo sapiens
uccauguuugcaccugugcauu

SEQ ID NO: 938025 - RNA, 16 nt, Homo sapiens
uccauugcucuugagu

SEQ ID NO: 938026 - RNA, 15 nt, Homo sapiens
ucccaguauaccuca

SEQ ID NO: 938027 - RNA, 16 nt, Homo sapiens
ucccaguauaccucau

SEQ ID NO: 938028 - RNA, 16 nt, Homo sapiens
uccccagaugugacua

SEQ ID NO: 938029 - RNA, 21 nt, Homo sapiens
uccccaguucauugcacuuug

SEQ ID NO: 938030 - RNA, 14 nt, Homo sapiens
uccccucaccuccu

SEQ ID NO: 938031 - RNA, 16 nt, Homo sapiens
uccccuucaguaccac

SEQ ID NO: 938032 - RNA, 13 nt, Homo sapiens
ucccuacuccaug

SEQ ID NO: 938033 - RNA, 19 nt, Homo sapiens
ucccuuuuuauuugcagaa

SEQ ID NO: 938034 - RNA, 19 nt, Homo sapiens
ucccuuuuuuuacauuuca

SEQ ID NO: 938035 - RNA, 13 nt, Homo sapiens
uccgaguguuugc

SEQ ID NO: 938036 - RNA, 20 nt, Homo sapiens
uccgcuccugcgcucugcca

SEQ ID NO: 938037 - RNA, 17 nt, Homo sapiens
uccucccaggaagccca

SEQ ID NO: 938038 - RNA, 14 nt, Homo sapiens
uccucccuugggaa

SEQ ID NO: 938039 - RNA, 19 nt, Homo sapiens
uccucucgagcccagaugg

SEQ ID NO: 938040 - RNA, 17 nt, Homo sapiens
uccugagcacccagaac

SEQ ID NO: 938041 - RNA, 17 nt, Homo sapiens
uccugcgcucugccacu

SEQ ID NO: 938042 - RNA, 13 nt, Homo sapiens
uccuggcacuaac

SEQ ID NO: 938043 - RNA, 19 nt, Homo sapiens
uccuggcacuaacguugag

SEQ ID NO: 938044 - RNA, 21 nt, Homo sapiens
uccuggcaucuauuuccucug

SEQ ID NO: 938045 - RNA, 16 nt, Homo sapiens
uccugguuuuugccua

SEQ ID NO: 938046 - RNA, 15 nt, Homo sapiens
uccuguuugucuaca

SEQ ID NO: 938047 - RNA, 18 nt, Homo sapiens
uccuuccaguguccuuag

SEQ ID NO: 938048 - RNA, 14 nt, Homo sapiens
uccuucucugaaag

SEQ ID NO: 938049 - RNA, 23 nt, Homo sapiens
uccuugagaagugggagcacccu

SEQ ID NO: 938050 - RNA, 18 nt, Homo sapiens
uccuuuuuugcaugugca

SEQ ID NO: 938051 - RNA, 15 nt, Homo sapiens
ucgauuucuaccuca

SEQ ID NO: 938052 - RNA, 20 nt, Homo sapiens
ucgcccacaaacugauuucu

SEQ ID NO: 938053 - RNA, 21 nt, Homo sapiens
ucgcuuucuaaaggaaaucaa

SEQ ID NO: 938054 - RNA, 17 nt, Homo sapiens
ucggagcggcgucccuu

SEQ ID NO: 938055 - RNA, 19 nt, Homo sapiens
ucggauuugccauagccuu

SEQ ID NO: 938056 - RNA, 15 nt, Homo sapiens
ucguggacugugcug

SEQ ID NO: 938057 - RNA, 15 nt, Homo sapiens
ucuaaaggaaaucaa

SEQ ID NO: 938058 - RNA, 20 nt, Homo sapiens
ucuaaaggaaaucaaaugaa

SEQ ID NO: 938059 - RNA, 13 nt, Homo sapiens
ucuaaauguuugg

SEQ ID NO: 938060 - RNA, 21 nt, Homo sapiens
ucuacacagauggaaucucuu

SEQ ID NO: 938061 - RNA, 14 nt, Homo sapiens
ucuacauaugaucu

SEQ ID NO: 938062 - RNA, 19 nt, Homo sapiens
ucuacugaaugucauugaa

SEQ ID NO: 938063 - RNA, 16 nt, Homo sapiens
ucuaguugcaguauug

SEQ ID NO: 938064 - RNA, 23 nt, Homo sapiens
ucucaaagaaauauuaagcaugu

SEQ ID NO: 938065 - RNA, 18 nt, Homo sapiens
ucucaagcaggggauccu

SEQ ID NO: 938066 - RNA, 12 nt, Homo sapiens
ucucacaugcag

SEQ ID NO: 938067 - RNA, 16 nt, Homo sapiens
ucucaucaguaguuca

SEQ ID NO: 938068 - RNA, 15 nt, Homo sapiens
ucucauuuaagggaa

SEQ ID NO: 938069 - RNA, 18 nt, Homo sapiens
ucuccuacuaugcaauuu

SEQ ID NO: 938070 - RNA, 18 nt, Homo sapiens
ucuccuuggccacagacu

SEQ ID NO: 938071 - RNA, 16 nt, Homo sapiens
acuaauugacuugcaa

SEQ ID NO: 938072 - RNA, 17 nt, Homo sapiens
acuaauugacuugcaaa

SEQ ID NO: 938073 - RNA, 20 nt, Homo sapiens
acuaauuuaguaauagccug

SEQ ID NO: 938074 - RNA, 19 nt, Homo sapiens
acuaauuuauaacuauuau

SEQ ID NO: 938075 - RNA, 13 nt, Homo sapiens
acuacuaccucuu

SEQ ID NO: 938076 - RNA, 14 nt, Homo sapiens
acuaguagagagag

SEQ ID NO: 938077 - RNA, 19 nt, Homo sapiens
acuaugaggacugccuuau

SEQ ID NO: 938078 - RNA, 19 nt, Homo sapiens
acuauuuuuguaaaagaca

SEQ ID NO: 938079 - RNA, 23 nt, Homo sapiens
acucaaaacgcuacugagucaca

SEQ ID NO: 938080 - RNA, 16 nt, Homo sapiens
acucaguuucuaggca

SEQ ID NO: 938081 - RNA, 15 nt, Homo sapiens
acucaugaagcauac

SEQ ID NO: 938082 - RNA, 21 nt, Homo sapiens
acuccagcuugggcaacagag

SEQ ID NO: 938083 - RNA, 16 nt, Homo sapiens
acucccagugaugcug

SEQ ID NO: 938084 - RNA, 12 nt, Homo sapiens
acuccggcuccu

SEQ ID NO: 938085 - RNA, 19 nt, Homo sapiens
acuccuuuuuugcaugugc

SEQ ID NO: 938086 - RNA, 12 nt, Homo sapiens
acucugaaaaug

SEQ ID NO: 938087 - RNA, 16 nt, Homo sapiens
acucuggagcauuucu

SEQ ID NO: 938088 - RNA, 14 nt, Homo sapiens
acugaaagcacuag

SEQ ID NO: 938089 - RNA, 15 nt, Homo sapiens
acugacagggagcag

SEQ ID NO: 938090 - RNA, 17 nt, Homo sapiens
acugcagugaccacuua

SEQ ID NO: 938091 - RNA, 18 nt, Homo sapiens
acugcagugaccacuuau

SEQ ID NO: 938092 - RNA, 20 nt, Homo sapiens
acugcuaggaugaagcccua

SEQ ID NO: 938093 - RNA, 19 nt, Homo sapiens
acugcucguggacugugcu

SEQ ID NO: 938094 - RNA, 18 nt, Homo sapiens
acuggacauuuaacuuuu

SEQ ID NO: 938095 - RNA, 21 nt, Homo sapiens
acuggcacagagguagucuca

SEQ ID NO: 938096 - RNA, 22 nt, Homo sapiens
acugggaaccuagcuacacuga

SEQ ID NO: 938097 - RNA, 20 nt, Homo sapiens
acugggugaaucuggcagga

SEQ ID NO: 938098 - RNA, 12 nt, Homo sapiens
acugggugacca

SEQ ID NO: 938099 - RNA, 17 nt, Homo sapiens
acuggucgagagccaaa

SEQ ID NO: 938100 - RNA, 16 nt, Homo sapiens
acugguucacauccua

SEQ ID NO: 938101 - RNA, 17 nt, Homo sapiens
acuguguuucaaguuca

SEQ ID NO: 938102 - RNA, 13 nt, Homo sapiens
acuuaacuaguua

SEQ ID NO: 938103 - RNA, 12 nt, Homo sapiens
acuuaccucaaa

SEQ ID NO: 938104 - RNA, 20 nt, Homo sapiens
acuucaaaaggaaugaacuu

SEQ ID NO: 938105 - RNA, 14 nt, Homo sapiens
acuucaaauucaaa

SEQ ID NO: 938106 - RNA, 20 nt, Homo sapiens
acuucaugcuggccugugug

SEQ ID NO: 938107 - RNA, 15 nt, Homo sapiens
acuugcagcauucau

SEQ ID NO: 938108 - RNA, 22 nt, Homo sapiens
acuuuaauccuuccacuaucau

SEQ ID NO: 938109 - RNA, 19 nt, Homo sapiens
acuuuacuuguguuauaua

SEQ ID NO: 938110 - RNA, 20 nt, Homo sapiens
acuuucccguuuuauuccag

SEQ ID NO: 938111 - RNA, 18 nt, Homo sapiens
acuuuuaaaaacauaaca

SEQ ID NO: 938112 - RNA, 14 nt, Homo sapiens
acuuuuucccucac

SEQ ID NO: 938113 - RNA, 17 nt, Homo sapiens
agaaaacagcucuggca

SEQ ID NO: 938114 - RNA, 22 nt, Homo sapiens
agaaaaguagaaaggagguuag

SEQ ID NO: 938115 - RNA, 20 nt, Homo sapiens
agaaagcugcacuggugcua

SEQ ID NO: 938116 - RNA, 21 nt, Homo sapiens
agaaauaauagaaaugucuca

SEQ ID NO: 938117 - RNA, 19 nt, Homo sapiens
agaaauacaguacuguuuc

SEQ ID NO: 938118 - RNA, 20 nt, Homo sapiens
agaacauuaauuauauguau

SEQ ID NO: 938119 - RNA, 12 nt, Homo sapiens
agaacauuuuaa

SEQ ID NO: 938120 - RNA, 23 nt, Homo sapiens
agaacguggugaccuuucacgaa

SEQ ID NO: 938121 - RNA, 20 nt, Homo sapiens
agaacuagccaaaccaggac

SEQ ID NO: 938122 - RNA, 19 nt, Homo sapiens
agaagagaugacaaaccau

SEQ ID NO: 938123 - RNA, 14 nt, Homo sapiens
agaagggcuaucau

SEQ ID NO: 938124 - RNA, 23 nt, Homo sapiens
agaagugcagaauuggggcacuu

SEQ ID NO: 938125 - RNA, 22 nt, Homo sapiens
agaaguucuuguucuucaggag

SEQ ID NO: 938126 - RNA, 20 nt, Homo sapiens
agaaguuuggcugcugucau

SEQ ID NO: 938127 - RNA, 23 nt, Homo sapiens
agaauaaaagaauuacauaugaa

SEQ ID NO: 938128 - RNA, 23 nt, Homo sapiens
agaaugugucucaggaaaacagc

SEQ ID NO: 938129 - RNA, 19 nt, Homo sapiens
agacaauaaacccucagag

SEQ ID NO: 938130 - RNA, 22 nt, Homo sapiens
agacaggcaaauguacuucuca

SEQ ID NO: 938131 - RNA, 19 nt, Homo sapiens
agacaucuggacacugggc

SEQ ID NO: 938132 - RNA, 13 nt, Homo sapiens
agacauuccacca

SEQ ID NO: 938133 - RNA, 22 nt, Homo sapiens
agacauuuuaaaaaauggucac

SEQ ID NO: 938134 - RNA, 17 nt, Homo sapiens
agacccgauuccaccaa

SEQ ID NO: 938135 - RNA, 12 nt, Homo sapiens
agacgccuguua

SEQ ID NO: 938136 - RNA, 19 nt, Homo sapiens
agacguccuuucccuacuc

SEQ ID NO: 938137 - RNA, 16 nt, Homo sapiens
agacuacauuugugaa

SEQ ID NO: 938138 - RNA, 22 nt, Homo sapiens
agacuauguagcaauauaucag

SEQ ID NO: 938139 - RNA, 16 nt, Homo sapiens
agacuauucuaaugaa

SEQ ID NO: 938140 - RNA, 18 nt, Homo sapiens
agacucugucuaccuggu

SEQ ID NO: 938141 - RNA, 16 nt, Homo sapiens
agagaaccucagauca

SEQ ID NO: 938142 - RNA, 22 nt, Homo sapiens
agagaaccucagaucaggugca

SEQ ID NO: 938143 - RNA, 19 nt, Homo sapiens
agagacgguguuuugccau

SEQ ID NO: 938144 - RNA, 16 nt, Homo sapiens
agagacuauguagcaa

SEQ ID NO: 938145 - RNA, 16 nt, Homo sapiens
agagagcacagugauc

SEQ ID NO: 938146 - RNA, 20 nt, Homo sapiens
agagagcacagugaucacca

SEQ ID NO: 938147 - RNA, 15 nt, Homo sapiens
agagagcaucugcaa

SEQ ID NO: 938148 - RNA, 18 nt, Homo sapiens
agagagcaucugcaacaa

SEQ ID NO: 938149 - RNA, 22 nt, Homo sapiens
agagagcaucugcaacaaaaag

SEQ ID NO: 938150 - RNA, 21 nt, Homo sapiens
agagaggcgucugcugucuca

SEQ ID NO: 938151 - RNA, 17 nt, Homo sapiens
agagaugacaaaccaua

SEQ ID NO: 938152 - RNA, 19 nt, Homo sapiens
agagcaagacuccaucuca

SEQ ID NO: 938153 - RNA, 20 nt, Homo sapiens
agagcaagacuccaucucaa

SEQ ID NO: 938154 - RNA, 14 nt, Homo sapiens
agagccaagcccug

SEQ ID NO: 938155 - RNA, 21 nt, Homo sapiens
agagccuucacugguucugca

SEQ ID NO: 938156 - RNA, 14 nt, Homo sapiens
agaggaggggacca

SEQ ID NO: 938157 - RNA, 19 nt, Homo sapiens
agaggaugcugggcucugu

SEQ ID NO: 938158 - RNA, 21 nt, Homo sapiens
agaguccuggagcuggcucua

SEQ ID NO: 938159 - RNA, 22 nt, Homo sapiens
agaguccuggagcuggcucuau

SEQ ID NO: 938160 - RNA, 18 nt, Homo sapiens
agagugcuauaaaagacu

SEQ ID NO: 938161 - RNA, 15 nt, Homo sapiens
agaguuuguuaccua

SEQ ID NO: 938162 - RNA, 14 nt, Homo sapiens
agauauagcauuaa

SEQ ID NO: 938163 - RNA, 17 nt, Homo sapiens
agauauuaauguuaaca

SEQ ID NO: 938164 - RNA, 15 nt, Homo sapiens
agaucauuuugaaau

SEQ ID NO: 938165 - RNA, 19 nt, Homo sapiens
agaucgccccacugcacuc

SEQ ID NO: 938166 - RNA, 17 nt, Homo sapiens
agaucucgguuugccaa

SEQ ID NO: 938167 - RNA, 14 nt, Homo sapiens
agaugacaguauuu

SEQ ID NO: 938168 - RNA, 16 nt, Homo sapiens
agaugccaugugcagg

SEQ ID NO: 938169 - RNA, 14 nt, Homo sapiens
agauggcacuuuga

SEQ ID NO: 938170 - RNA, 22 nt, Homo sapiens
auuugggcagauauagcauuaa

SEQ ID NO: 938171 - RNA, 21 nt, Homo sapiens
auuuguauugguucagggaac

SEQ ID NO: 938172 - RNA, 19 nt, Homo sapiens
auuugucugaaacauuuca

SEQ ID NO: 938173 - RNA, 13 nt, Homo sapiens
auuuguuuuuacc

SEQ ID NO: 938174 - RNA, 13 nt, Homo sapiens
auuuuaccaaagc

SEQ ID NO: 938175 - RNA, 17 nt, Homo sapiens
auuuuauaagaugacug

SEQ ID NO: 938176 - RNA, 15 nt, Homo sapiens
auuuuauaugaagau

SEQ ID NO: 938177 - RNA, 15 nt, Homo sapiens
auuuuccuguuguca

SEQ ID NO: 938178 - RNA, 21 nt, Homo sapiens
auuuucuuacacugugucauu

SEQ ID NO: 938179 - RNA, 16 nt, Homo sapiens
auuuuguaaaaguggc

SEQ ID NO: 938180 - RNA, 21 nt, Homo sapiens
auuuuuaauguuuguacacaa

SEQ ID NO: 938181 - RNA, 22 nt, Homo sapiens
auuuuuaugucuggggcagaaa

SEQ ID NO: 938182 - RNA, 20 nt, Homo sapiens
auuuuucuuagugugccaag

SEQ ID NO: 938183 - RNA, 20 nt, Homo sapiens
auuuuuuaauccuaccucaa

SEQ ID NO: 938184 - RNA, 12 nt, Homo sapiens
caaaaacuuugg

SEQ ID NO: 938185 - RNA, 17 nt, Homo sapiens
caaaaauguccagccac

SEQ ID NO: 938186 - RNA, 20 nt, Homo sapiens
caaaaauguguaagaacaac

SEQ ID NO: 938187 - RNA, 12 nt, Homo sapiens
caaaacuacuga

SEQ ID NO: 938188 - RNA, 15 nt, Homo sapiens
caaaagcacauauau

SEQ ID NO: 938189 - RNA, 14 nt, Homo sapiens
caaaauccaaggca

SEQ ID NO: 938190 - RNA, 18 nt, Homo sapiens
caaaaugagacuuucuaa

SEQ ID NO: 938191 - RNA, 11 nt, Homo sapiens
caaacuuuuca

SEQ ID NO: 938192 - RNA, 18 nt, Homo sapiens
caaagaaugggcuugaaa

SEQ ID NO: 938193 - RNA, 16 nt, Homo sapiens
caaagauuaaaugugu

SEQ ID NO: 938194 - RNA, 20 nt, Homo sapiens
caaagccaagggcaacagau

SEQ ID NO: 938195 - RNA, 23 nt, Homo sapiens
caaaggccuaauucuaugccugu

SEQ ID NO: 938196 - RNA, 23 nt, Homo sapiens
caaaugaauggaggaacuuucca

SEQ ID NO: 938197 - RNA, 20 nt, Homo sapiens
caacaaagaaugggcuugaa

SEQ ID NO: 938198 - RNA, 19 nt, Homo sapiens
caacaacuuacacuuauuu

SEQ ID NO: 938199 - RNA, 14 nt, Homo sapiens
caacaaugacuuaa

SEQ ID NO: 938200 - RNA, 15 nt, Homo sapiens
caacagaaaccagaa

SEQ ID NO: 938201 - RNA, 20 nt, Homo sapiens
caacagaagggaaauuucaa

SEQ ID NO: 938202 - RNA, 21 nt, Homo sapiens
caacagucuugcugaauuaag

SEQ ID NO: 938203 - RNA, 16 nt, Homo sapiens
caacaucgcaauaguu

SEQ ID NO: 938204 - RNA, 18 nt, Homo sapiens
caacauggcccuaccaga

SEQ ID NO: 938205 - RNA, 22 nt, Homo sapiens
caaccaguuuauccaccaagaa

SEQ ID NO: 938206 - RNA, 19 nt, Homo sapiens
caacccacucccuguagug

SEQ ID NO: 938207 - RNA, 13 nt, Homo sapiens
caagaauagcauu

SEQ ID NO: 938208 - RNA, 21 nt, Homo sapiens
caagagaacucgcgcucagua

SEQ ID NO: 938209 - RNA, 16 nt, Homo sapiens
caagaugaaugcagau

SEQ ID NO: 938210 - RNA, 18 nt, Homo sapiens
caagaugaaugcagauua

SEQ ID NO: 938211 - RNA, 18 nt, Homo sapiens
caagcauuuaccaugugc

SEQ ID NO: 938212 - RNA, 18 nt, Homo sapiens
caagccugucuucagaga

SEQ ID NO: 938213 - RNA, 14 nt, Homo sapiens
caagcuaggugcua

SEQ ID NO: 938214 - RNA, 16 nt, Homo sapiens
caaggaaagaaauaca

SEQ ID NO: 938215 - RNA, 21 nt, Homo sapiens
caaguacugguugacuuucua

SEQ ID NO: 938216 - RNA, 16 nt, Homo sapiens
caagucuguaccucaa

SEQ ID NO: 938217 - RNA, 22 nt, Homo sapiens
caaguguaaaauauuuugaauc

SEQ ID NO: 938218 - RNA, 14 nt, Homo sapiens
caaguucaauccua

SEQ ID NO: 938219 - RNA, 16 nt, Homo sapiens
caaguugcaucagaaa

SEQ ID NO: 938220 - RNA, 14 nt, Homo sapiens
caauaaacccucag

SEQ ID NO: 938221 - RNA, 12 nt, Homo sapiens
caauaauaucaa

SEQ ID NO: 938222 - RNA, 15 nt, Homo sapiens
caauagugucauccu

SEQ ID NO: 938223 - RNA, 21 nt, Homo sapiens
caaucaucaacuaccauucua

SEQ ID NO: 938224 - RNA, 14 nt, Homo sapiens
caauccaugagaua

SEQ ID NO: 938225 - RNA, 19 nt, Homo sapiens
caaugaucaccgacugaaa

SEQ ID NO: 938226 - RNA, 19 nt, Homo sapiens
caaugggcucaaacuucua

SEQ ID NO: 938227 - RNA, 22 nt, Homo sapiens
caauguacaguugaaauaacug

SEQ ID NO: 938228 - RNA, 15 nt, Homo sapiens
caauuguaacgacuu

SEQ ID NO: 938229 - RNA, 17 nt, Homo sapiens
caauuuaaaaagcaaaa

SEQ ID NO: 938230 - RNA, 20 nt, Homo sapiens
caauuuuucaagagcuccuu

SEQ ID NO: 938231 - RNA, 22 nt, Homo sapiens
caauuuuucaagagcuccuuga

SEQ ID NO: 938232 - RNA, 19 nt, Homo sapiens
cacaaaugaagggauauaa

SEQ ID NO: 938233 - RNA, 13 nt, Homo sapiens
cacaacagugaaa

SEQ ID NO: 938234 - RNA, 16 nt, Homo sapiens
cacaagcaaugcaaga

SEQ ID NO: 938235 - RNA, 16 nt, Homo sapiens
cacaaguggaccuuag

SEQ ID NO: 938236 - RNA, 14 nt, Homo sapiens
cacaaugcugaaua

SEQ ID NO: 938237 - RNA, 13 nt, Homo sapiens
cacaccacccucc

SEQ ID NO: 938238 - RNA, 16 nt, Homo sapiens
cacagaaauuuucaau

SEQ ID NO: 938239 - RNA, 14 nt, Homo sapiens
cacagaaggaauaa

SEQ ID NO: 938240 - RNA, 14 nt, Homo sapiens
cacagaggacacag

SEQ ID NO: 938241 - RNA, 17 nt, Homo sapiens
cacagcaacaaugacuu

SEQ ID NO: 938242 - RNA, 18 nt, Homo sapiens
cacagcuaagaugccaug

SEQ ID NO: 938243 - RNA, 19 nt, Homo sapiens
cacaggaagccugcagucc

SEQ ID NO: 938244 - RNA, 14 nt, Homo sapiens
cacagucacuggau

SEQ ID NO: 938245 - RNA, 17 nt, Homo sapiens
cacaugcccaugaugag

SEQ ID NO: 938246 - RNA, 12 nt, Homo sapiens
cacaugcugucu

SEQ ID NO: 938247 - RNA, 14 nt, Homo sapiens
caccacacacacac

SEQ ID NO: 938248 - RNA, 20 nt, Homo sapiens
cacccagaacuccauaccau

SEQ ID NO: 938249 - RNA, 16 nt, Homo sapiens
cacccaugccagagag

SEQ ID NO: 938250 - RNA, 12 nt, Homo sapiens
caccccaagaga

SEQ ID NO: 938251 - RNA, 23 nt, Homo sapiens
caccuaccuuagaaaacaaguau

SEQ ID NO: 938252 - RNA, 13 nt, Homo sapiens
caccuagacugua

SEQ ID NO: 938253 - RNA, 17 nt, Homo sapiens
caccuccucugugauuu

SEQ ID NO: 938254 - RNA, 20 nt, Homo sapiens
caccugcagcccauggugag

SEQ ID NO: 938255 - RNA, 18 nt, Homo sapiens
caccuugaugacuuccua

SEQ ID NO: 938256 - RNA, 20 nt, Homo sapiens
cacgcagugcggauccggga

SEQ ID NO: 938257 - RNA, 16 nt, Homo sapiens
cacggauggugcaugg

SEQ ID NO: 938258 - RNA, 20 nt, Homo sapiens
cacgucacugcacuccagcu

SEQ ID NO: 938259 - RNA, 18 nt, Homo sapiens
cacuaaggccgugucucu

SEQ ID NO: 938260 - RNA, 19 nt, Homo sapiens
cacuaauuuauaacuauua

SEQ ID NO: 938261 - RNA, 21 nt, Homo sapiens
cacuauuguuccagcaguuuu

SEQ ID NO: 938262 - RNA, 22 nt, Homo sapiens
cacucaguggcccauggcauuu

SEQ ID NO: 938263 - RNA, 16 nt, Homo sapiens
cacucauuucaucuca

SEQ ID NO: 938264 - RNA, 14 nt, Homo sapiens
cacucuggagcauu

SEQ ID NO: 938265 - RNA, 14 nt, Homo sapiens
cacugcacugcaug

SEQ ID NO: 938266 - RNA, 14 nt, Homo sapiens
cacugcagugcuga

SEQ ID NO: 938267 - RNA, 22 nt, Homo sapiens
cacuggauugacuuugcuguca

SEQ ID NO: 938268 - RNA, 17 nt, Homo sapiens
cacugggugaccagcug

SEQ ID NO: 938269 - RNA, 22 nt, Homo sapiens
aauucauuguguuaccuguaga

SEQ ID NO: 938270 - RNA, 15 nt, Homo sapiens
aauucccaagcuuuu

SEQ ID NO: 938271 - RNA, 15 nt, Homo sapiens
aauucugagccugau

SEQ ID NO: 938272 - RNA, 19 nt, Homo sapiens
aauucuggcaggaccucac

SEQ ID NO: 938273 - RNA, 21 nt, Homo sapiens
aauucuuauugacucauacac

SEQ ID NO: 938274 - RNA, 12 nt, Homo sapiens
aauugacuugca

SEQ ID NO: 938275 - RNA, 17 nt, Homo sapiens
aauuggagaagauuuau

SEQ ID NO: 938276 - RNA, 15 nt, Homo sapiens
aauugggcaggugaa

SEQ ID NO: 938277 - RNA, 20 nt, Homo sapiens
aauuguuuagugauauuaca

SEQ ID NO: 938278 - RNA, 22 nt, Homo sapiens
cagacaauaaacccucagagcc

SEQ ID NO: 938279 - RNA, 18 nt, Homo sapiens
cagaccccacgcugacca

SEQ ID NO: 938280 - RNA, 16 nt, Homo sapiens
cagaccccaugccuua

SEQ ID NO: 938281 - RNA, 21 nt, Homo sapiens
cagacuagaaguuccuaguga

SEQ ID NO: 938282 - RNA, 14 nt, Homo sapiens
cagacucgggacca

SEQ ID NO: 938283 - RNA, 18 nt, Homo sapiens
cagacucgggaccaauac

SEQ ID NO: 938284 - RNA, 20 nt, Homo sapiens
cagacugaacucgcagggaa

SEQ ID NO: 938285 - RNA, 21 nt, Homo sapiens
cagagagcugcccuucagcga

SEQ ID NO: 938286 - RNA, 18 nt, Homo sapiens
cagagcccucaacuauuc

SEQ ID NO: 938287 - RNA, 20 nt, Homo sapiens
cagagcgagauucugccuca

SEQ ID NO: 938288 - RNA, 16 nt, Homo sapiens
cagaggaaauucuuuc

SEQ ID NO: 938289 - RNA, 14 nt, Homo sapiens
cagaggacacagag

SEQ ID NO: 938290 - RNA, 14 nt, Homo sapiens
cagaggccaagagu

SEQ ID NO: 938291 - RNA, 18 nt, Homo sapiens
cagaucaacaauaccuuu

SEQ ID NO: 938292 - RNA, 14 nt, Homo sapiens
cagaugaucucucc

SEQ ID NO: 938293 - RNA, 21 nt, Homo sapiens
cagaugcuguuaguaccuaca

SEQ ID NO: 938294 - RNA, 14 nt, Homo sapiens
cagaugugcugaca

SEQ ID NO: 938295 - RNA, 21 nt, Homo sapiens
cagauuaaacuucauauguaa

SEQ ID NO: 938296 - RNA, 17 nt, Homo sapiens
cagauucacacaugcca

SEQ ID NO: 938297 - RNA, 18 nt, Homo sapiens
cagauuuggaugcacuca

SEQ ID NO: 938298 - RNA, 13 nt, Homo sapiens
cagauuuguaaca

SEQ ID NO: 938299 - RNA, 19 nt, Homo sapiens
cagauuuuuuccucugcau

SEQ ID NO: 938300 - RNA, 14 nt, Homo sapiens
cagcaaacuuggug

SEQ ID NO: 938301 - RNA, 13 nt, Homo sapiens
cagcaacaaugac

SEQ ID NO: 938302 - RNA, 17 nt, Homo sapiens
cagcaaggaaagcucac

SEQ ID NO: 938303 - RNA, 19 nt, Homo sapiens
cagcaggcucaggcacaua

SEQ ID NO: 938304 - RNA, 15 nt, Homo sapiens
cagcaggugcucaau

SEQ ID NO: 938305 - RNA, 21 nt, Homo sapiens
cagcaguagcaaacuuuucac

SEQ ID NO: 938306 - RNA, 12 nt, Homo sapiens
cagcauuugacc

SEQ ID NO: 938307 - RNA, 20 nt, Homo sapiens
cagccaccaccuacagccca

SEQ ID NO: 938308 - RNA, 19 nt, Homo sapiens
cagccacuugccugugcua

SEQ ID NO: 938309 - RNA, 19 nt, Homo sapiens
cagccuccagggcauugcu

SEQ ID NO: 938310 - RNA, 20 nt, Homo sapiens
cagccuccagggcauugcuc

SEQ ID NO: 938311 - RNA, 19 nt, Homo sapiens
cagcgaccuuccucaucca

SEQ ID NO: 938312 - RNA, 21 nt, Homo sapiens
cagcgugaggagcgaucucag

SEQ ID NO: 938313 - RNA, 18 nt, Homo sapiens
cagcuaacaaacuagaaa

SEQ ID NO: 938314 - RNA, 16 nt, Homo sapiens
cagcuaagaugccaug

SEQ ID NO: 938315 - RNA, 20 nt, Homo sapiens
cagcuaucugucaucucucu

SEQ ID NO: 938316 - RNA, 23 nt, Homo sapiens
cagcucauaaaauggaagcaauu

SEQ ID NO: 938317 - RNA, 21 nt, Homo sapiens
cagcucuguaucugccaugug

SEQ ID NO: 938318 - RNA, 18 nt, Homo sapiens
cagcuggagguugagcuc

SEQ ID NO: 938319 - RNA, 22 nt, Homo sapiens
caggaaaccuuggccucugcua

SEQ ID NO: 938320 - RNA, 13 nt, Homo sapiens
caggaacaaacag

SEQ ID NO: 938321 - RNA, 14 nt, Homo sapiens
caggaacucuggac

SEQ ID NO: 938322 - RNA, 17 nt, Homo sapiens
caggaauacuuggaccu

SEQ ID NO: 938323 - RNA, 16 nt, Homo sapiens
caggaauguguggccu

SEQ ID NO: 938324 - RNA, 11 nt, Homo sapiens
caggacacugg

SEQ ID NO: 938325 - RNA, 15 nt, Homo sapiens
caggacuuccaucug

SEQ ID NO: 938326 - RNA, 17 nt, Homo sapiens
caggagaugauucuguu

SEQ ID NO: 938327 - RNA, 18 nt, Homo sapiens
caggagccucacuggggc

SEQ ID NO: 938328 - RNA, 16 nt, Homo sapiens
caggauuacuagucaa

SEQ ID NO: 938329 - RNA, 17 nt, Homo sapiens
caggcaaggaugucuga

SEQ ID NO: 938330 - RNA, 12 nt, Homo sapiens
caggcacgggug

SEQ ID NO: 938331 - RNA, 14 nt, Homo sapiens
caggccaaugucag

SEQ ID NO: 938332 - RNA, 20 nt, Homo sapiens
caggcgcaguggcucaugcc

SEQ ID NO: 938333 - RNA, 21 nt, Homo sapiens
caggcgcaguggcucaugccu

SEQ ID NO: 938334 - RNA, 20 nt, Homo sapiens
caggcugggccauguccaaa

SEQ ID NO: 938335 - RNA, 22 nt, Homo sapiens
caggcugggccauguccaaaga

SEQ ID NO: 938336 - RNA, 23 nt, Homo sapiens
caggcugggccauguccaaagag

SEQ ID NO: 938337 - RNA, 18 nt, Homo sapiens
caggcuggucuugaacuc

SEQ ID NO: 938338 - RNA, 19 nt, Homo sapiens
cagggagugcacauaucca

SEQ ID NO: 938339 - RNA, 17 nt, Homo sapiens
cagggaugacagauuug

SEQ ID NO: 938340 - RNA, 14 nt, Homo sapiens
cagggcauugcuca

SEQ ID NO: 938341 - RNA, 23 nt, Homo sapiens
caggguuuacccagugggacaga

SEQ ID NO: 938342 - RNA, 12 nt, Homo sapiens
cagguaauacaa

SEQ ID NO: 938343 - RNA, 17 nt, Homo sapiens
cagguaccucuuucagg

SEQ ID NO: 938344 - RNA, 17 nt, Homo sapiens
caggugaaaaggguaca

SEQ ID NO: 938345 - RNA, 20 nt, Homo sapiens
caguaaaaucaaaugugcau

SEQ ID NO: 938346 - RNA, 21 nt, Homo sapiens
caguaaaaucaaaugugcauc

SEQ ID NO: 938347 - RNA, 20 nt, Homo sapiens
caguaaacgggaacaugccc

SEQ ID NO: 938348 - RNA, 15 nt, Homo sapiens
caguaauggaaugaa

SEQ ID NO: 938349 - RNA, 13 nt, Homo sapiens
caguauaccucau

SEQ ID NO: 938350 - RNA, 17 nt, Homo sapiens
caguaugggaucugaua

SEQ ID NO: 938351 - RNA, 13 nt, Homo sapiens
caguccauugcuc

SEQ ID NO: 938352 - RNA, 23 nt, Homo sapiens
cagucuugcugaauuaagcagaa

SEQ ID NO: 938353 - RNA, 19 nt, Homo sapiens
cagugacaacaucgcaaua

SEQ ID NO: 938354 - RNA, 17 nt, Homo sapiens
cagugagccgagaucau

SEQ ID NO: 938355 - RNA, 21 nt, Homo sapiens
cagugagccgagaucaugcca

SEQ ID NO: 938356 - RNA, 15 nt, Homo sapiens
caguggcucauaaaa

SEQ ID NO: 938357 - RNA, 15 nt, Homo sapiens
caguggcucaugccu

SEQ ID NO: 938358 - RNA, 14 nt, Homo sapiens
caguguuaagguaa

SEQ ID NO: 938359 - RNA, 14 nt, Homo sapiens
caguucagugaggu

SEQ ID NO: 938360 - RNA, 15 nt, Homo sapiens
caguuccucccagga

SEQ ID NO: 938361 - RNA, 17 nt, Homo sapiens
caguugaaaacuuguaa

SEQ ID NO: 938362 - RNA, 18 nt, Homo sapiens
caguuucuaggcaccuca

SEQ ID NO: 938363 - RNA, 12 nt, Homo sapiens
cauaacugacaa

SEQ ID NO: 938364 - RNA, 20 nt, Homo sapiens
cauaagagcuuaagaaccau

SEQ ID NO: 938365 - RNA, 21 nt, Homo sapiens
cauacagagguaacuaucaau

SEQ ID NO: 938366 - RNA, 17 nt, Homo sapiens
cauacaugucacauuua

SEQ ID NO: 938367 - RNA, 16 nt, Homo sapiens
cauacuuaaugcauau

SEQ ID NO: 938368 - RNA, 13 nt, Homo sapiens
cauagucaauauu

SEQ ID NO: 938369 - RNA, 23 nt, Homo sapiens
cauagucuuuggagaaaugcuua

SEQ ID NO: 938370 - RNA, 14 nt, Homo sapiens
cauaguuacugugu

SEQ ID NO: 938371 - RNA, 22 nt, Homo sapiens
cauaguuacuguguaaacucau

SEQ ID NO: 938372 - RNA, 15 nt, Homo sapiens
cauauuucauauuca

SEQ ID NO: 938373 - RNA, 16 nt, Homo sapiens
cauauuucauauucau

SEQ ID NO: 938374 - RNA, 16 nt, Homo sapiens
caucacaagaaaguca

SEQ ID NO: 938375 - RNA, 23 nt, Homo sapiens
caucacggauggugcaugggcuc

SEQ ID NO: 938376 - RNA, 11 nt, Homo sapiens
caucaguccau

SEQ ID NO: 938377 - RNA, 13 nt, Homo sapiens
accuguaauccca

SEQ ID NO: 938378 - RNA, 22 nt, Homo sapiens
accuguuaauuuuuauacugac

SEQ ID NO: 938379 - RNA, 14 nt, Homo sapiens
accuuugguuuuaa

SEQ ID NO: 938380 - RNA, 14 nt, Homo sapiens
accuuuuacuguga

SEQ ID NO: 938381 - RNA, 19 nt, Homo sapiens
acgagacccccauccagcc

SEQ ID NO: 938382 - RNA, 19 nt, Homo sapiens
acgccacucauuucaucuc

SEQ ID NO: 938383 - RNA, 21 nt, Homo sapiens
acgccacucauuucaucucau

SEQ ID NO: 938384 - RNA, 14 nt, Homo sapiens
acgcuacugaguca

SEQ ID NO: 938385 - RNA, 14 nt, Homo sapiens
acgcuuucaugaau

SEQ ID NO: 938386 - RNA, 17 nt, Homo sapiens
agggcaguucugagugu

SEQ ID NO: 938387 - RNA, 14 nt, Homo sapiens
agggcauugcucag

SEQ ID NO: 938388 - RNA, 15 nt, Homo sapiens
aggggagggaucucc

SEQ ID NO: 938389 - RNA, 17 nt, Homo sapiens
agggggugggauuccac

SEQ ID NO: 938390 - RNA, 18 nt, Homo sapiens
agggguuauagcuucagg

SEQ ID NO: 938391 - RNA, 23 nt, Homo sapiens
aggguacagaugugcuguagcag

SEQ ID NO: 938392 - RNA, 23 nt, Homo sapiens
agggugacccugaagugagcaca

SEQ ID NO: 938393 - RNA, 15 nt, Homo sapiens
aggucaggacucaga

SEQ ID NO: 938394 - RNA, 21 nt, Homo sapiens
agguccuuaggccucugagaa

SEQ ID NO: 938395 - RNA, 21 nt, Homo sapiens
aggucuuaggaauugaauuaa

SEQ ID NO: 938396 - RNA, 16 nt, Homo sapiens
aggugaaagaaaccac

SEQ ID NO: 938397 - RNA, 18 nt, Homo sapiens
aggugaugggggacgagg

SEQ ID NO: 938398 - RNA, 18 nt, Homo sapiens
aggugcauagcaagugaa

SEQ ID NO: 938399 - RNA, 13 nt, Homo sapiens
aggugccaugaug

SEQ ID NO: 938400 - RNA, 17 nt, Homo sapiens
agguuauuuugauguaa

SEQ ID NO: 938401 - RNA, 14 nt, Homo sapiens
agguucagccugaa

SEQ ID NO: 938402 - RNA, 14 nt, Homo sapiens
aguaaaaucaaaug

SEQ ID NO: 938403 - RNA, 16 nt, Homo sapiens
aguaaaaucaaaugug

SEQ ID NO: 938404 - RNA, 19 nt, Homo sapiens
aguaaaaucaaaugugcau

SEQ ID NO: 938405 - RNA, 19 nt, Homo sapiens
aguaaacgggaacaugccc

SEQ ID NO: 938406 - RNA, 20 nt, Homo sapiens
aguaaaggcaguaaugccuu

SEQ ID NO: 938407 - RNA, 14 nt, Homo sapiens
aguaauacaaacua

SEQ ID NO: 938408 - RNA, 18 nt, Homo sapiens
aguacaucucuacuaaaa

SEQ ID NO: 938409 - RNA, 24 nt, Homo sapiens
aguaccaguauaagcaucugccau

SEQ ID NO: 938410 - RNA, 21 nt, Homo sapiens
aguaccuagcuggcucuguga

SEQ ID NO: 938411 - RNA, 16 nt, Homo sapiens
aguagaggcuauggac

SEQ ID NO: 938412 - RNA, 18 nt, Homo sapiens
aguauaagcaucugccau

SEQ ID NO: 938413 - RNA, 12 nt, Homo sapiens
aguauaccucau

SEQ ID NO: 938414 - RNA, 15 nt, Homo sapiens
aguauauaggugcug

SEQ ID NO: 938415 - RNA, 14 nt, Homo sapiens
aguaugggaucuga

SEQ ID NO: 938416 - RNA, 15 nt, Homo sapiens
aguauugcaugcuca

SEQ ID NO: 938417 - RNA, 19 nt, Homo sapiens
aguauugucaccaggauua

SEQ ID NO: 938418 - RNA, 20 nt, Homo sapiens
aguauugucgguuaccucug

SEQ ID NO: 938419 - RNA, 17 nt, Homo sapiens
agucacugacaguuaau

SEQ ID NO: 938420 - RNA, 13 nt, Homo sapiens
agucauugcacaa

SEQ ID NO: 938421 - RNA, 17 nt, Homo sapiens
aguccuugaaucaccug

SEQ ID NO: 938422 - RNA, 18 nt, Homo sapiens
agucucucucugccaugg

SEQ ID NO: 938423 - RNA, 14 nt, Homo sapiens
agucugaagcacuc

SEQ ID NO: 938424 - RNA, 14 nt, Homo sapiens
agucuguugauuaa

SEQ ID NO: 938425 - RNA, 20 nt, Homo sapiens
agucuugaaaugaaagggaa

SEQ ID NO: 938426 - RNA, 13 nt, Homo sapiens
agucuuugccagu

SEQ ID NO: 938427 - RNA, 22 nt, Homo sapiens
agugaaaauuguuuagugauau

SEQ ID NO: 938428 - RNA, 19 nt, Homo sapiens
agugaacugcaaccucaaa

SEQ ID NO: 938429 - RNA, 17 nt, Homo sapiens
agugaagccaaagggac

SEQ ID NO: 938430 - RNA, 18 nt, Homo sapiens
agugacaacaucgcaaua

SEQ ID NO: 938431 - RNA, 21 nt, Homo sapiens
agugaccuggaaucagugaag

SEQ ID NO: 938432 - RNA, 16 nt, Homo sapiens
agugagccaucaucau

SEQ ID NO: 938433 - RNA, 20 nt, Homo sapiens
agugagccaucaucauggca

SEQ ID NO: 938434 - RNA, 21 nt, Homo sapiens
agugagccaucaucauggcau

SEQ ID NO: 938435 - RNA, 17 nt, Homo sapiens
agugagucauaucuuaa

SEQ ID NO: 938436 - RNA, 17 nt, Homo sapiens
agugcuuaguguacuug

SEQ ID NO: 938437 - RNA, 17 nt, Homo sapiens
aguggacgugguaugaa

SEQ ID NO: 938438 - RNA, 18 nt, Homo sapiens
aguggacgugguaugaaa

SEQ ID NO: 938439 - RNA, 15 nt, Homo sapiens
aguggaggcacuuua

SEQ ID NO: 938440 - RNA, 17 nt, Homo sapiens
aguggcccauggcauuu

SEQ ID NO: 938441 - RNA, 14 nt, Homo sapiens
aguggcucaugccu

SEQ ID NO: 938442 - RNA, 16 nt, Homo sapiens
agugguggucuucaag

SEQ ID NO: 938443 - RNA, 20 nt, Homo sapiens
agugucauccucacagugaa

SEQ ID NO: 938444 - RNA, 15 nt, Homo sapiens
aguguggcuaaccaa

SEQ ID NO: 938445 - RNA, 20 nt, Homo sapiens
aguguguaucuagcuucuuc

SEQ ID NO: 938446 - RNA, 17 nt, Homo sapiens
aguguguguaguuuuac

SEQ ID NO: 938447 - RNA, 16 nt, Homo sapiens
aguuaaagaagcaauc

SEQ ID NO: 938448 - RNA, 13 nt, Homo sapiens
aguuaauucucau

SEQ ID NO: 938449 - RNA, 21 nt, Homo sapiens
aguuaauucucauuaauacuc

SEQ ID NO: 938450 - RNA, 18 nt, Homo sapiens
aguuacuagguaacuuca

SEQ ID NO: 938451 - RNA, 21 nt, Homo sapiens
aguuagccagguaugguggca

SEQ ID NO: 938452 - RNA, 16 nt, Homo sapiens
aguuauuaaucuggac

SEQ ID NO: 938453 - RNA, 15 nt, Homo sapiens
aguucacauacaaau

SEQ ID NO: 938454 - RNA, 17 nt, Homo sapiens
aguucacauacaaauca

SEQ ID NO: 938455 - RNA, 21 nt, Homo sapiens
aguucacauacaaaucaucca

SEQ ID NO: 938456 - RNA, 13 nt, Homo sapiens
aguucaccaucuc

SEQ ID NO: 938457 - RNA, 14 nt, Homo sapiens
aguuccucccagga

SEQ ID NO: 938458 - RNA, 20 nt, Homo sapiens
aguugaagcugacucaaaaa

SEQ ID NO: 938459 - RNA, 14 nt, Homo sapiens
aguugcacauuaau

SEQ ID NO: 938460 - RNA, 22 nt, Homo sapiens
aguugcauagagauuuguauug

SEQ ID NO: 938461 - RNA, 19 nt, Homo sapiens
aguuguaccaagugaaauu

SEQ ID NO: 938462 - RNA, 16 nt, Homo sapiens
aguugucuuuugccau

SEQ ID NO: 938463 - RNA, 17 nt, Homo sapiens
aguuucuggcucuugag

SEQ ID NO: 938464 - RNA, 20 nt, Homo sapiens
aguuuguuuuagaaccagcc

SEQ ID NO: 938465 - RNA, 20 nt, Homo sapiens
auaaaagaauuacauaugaa

SEQ ID NO: 938466 - RNA, 16 nt, Homo sapiens
auaaaagacuauucua

SEQ ID NO: 938467 - RNA, 20 nt, Homo sapiens
auaaacaaaguuacuaggua

SEQ ID NO: 938468 - RNA, 18 nt, Homo sapiens
auaaacccucagagccuc

SEQ ID NO: 938469 - RNA, 14 nt, Homo sapiens
auaaauaacacuug

SEQ ID NO: 938470 - RNA, 20 nt, Homo sapiens
auaacaaccugggcauuccu

SEQ ID NO: 938471 - RNA, 16 nt, Homo sapiens
auaacauccagagcuu

SEQ ID NO: 938472 - RNA, 13 nt, Homo sapiens
auaaguaggccau

SEQ ID NO: 938473 - RNA, 15 nt, Homo sapiens
auaaucaucaaguaa

SEQ ID NO: 938474 - RNA, 19 nt, Homo sapiens
auaaucuuguagacacuua

SEQ ID NO: 938475 - RNA, 21 nt, Homo sapiens
auaaucuuguagacacuuacu

SEQ ID NO: 938476 - RNA, 17 nt, Homo sapiens
auaaugcaugaugaacu

SEQ ID NO: 938477 - RNA, 19 nt, Homo sapiens
auaauuggagaagauuuau

SEQ ID NO: 938478 - RNA, 16 nt, Homo sapiens
auaauuuuaugcugga

SEQ ID NO: 938479 - RNA, 14 nt, Homo sapiens
auacaagguauaau

SEQ ID NO: 938480 - RNA, 13 nt, Homo sapiens
auacacaagcaau

SEQ ID NO: 938481 - RNA, 22 nt, Homo sapiens
auacauccacaggguuuugaca

SEQ ID NO: 938482 - RNA, 21 nt, Homo sapiens
auaccagguuuuacacuugca

SEQ ID NO: 938483 - RNA, 14 nt, Homo sapiens
cguagcacagccaa

SEQ ID NO: 938484 - RNA, 21 nt, Homo sapiens
cgucauccccggagucccuau

SEQ ID NO: 938485 - RNA, 12 nt, Homo sapiens
cguccuggucaa

SEQ ID NO: 938486 - RNA, 16 nt, Homo sapiens
cgugaguggucuucaa

SEQ ID NO: 938487 - RNA, 18 nt, Homo sapiens
cguggugaccuuucacga

SEQ ID NO: 938488 - RNA, 22 nt, Homo sapiens
cguuauacacauauaguguaca

SEQ ID NO: 938489 - RNA, 22 nt, Homo sapiens
cguuucuccaccuagacuguaa

SEQ ID NO: 938490 - RNA, 16 nt, Homo sapiens
cuaaacaaugcugauu

SEQ ID NO: 938491 - RNA, 20 nt, Homo sapiens
cuaaacaaugcugauuuggu

SEQ ID NO: 938492 - RNA, 15 nt, Homo sapiens
cuaaacucuuucauc

SEQ ID NO: 938493 - RNA, 19 nt, Homo sapiens
cuaaagccucaaaacaaag

SEQ ID NO: 938494 - RNA, 15 nt, Homo sapiens
uccugucguccugcc

SEQ ID NO: 938495 - RNA, 11 nt, Homo sapiens
uccugugcaau

SEQ ID NO: 938496 - RNA, 23 nt, Homo sapiens
uccuguucacaccagagaaccag

SEQ ID NO: 938497 - RNA, 12 nt, Homo sapiens
uccuuacauuuu

SEQ ID NO: 938498 - RNA, 22 nt, Homo sapiens
uccuucccacccccaguccugu

SEQ ID NO: 938499 - RNA, 18 nt, Homo sapiens
uccuucuauucuagccug

SEQ ID NO: 938500 - RNA, 20 nt, Homo sapiens
uccuugccuaaggugucuga

SEQ ID NO: 938501 - RNA, 15 nt, Homo sapiens
uccuuggccacagac

SEQ ID NO: 938502 - RNA, 15 nt, Homo sapiens
uccuuucacucugca

SEQ ID NO: 938503 - RNA, 20 nt, Homo sapiens
uccuuugaaaagagaauauu

SEQ ID NO: 938504 - RNA, 23 nt, Homo sapiens
uccuuuucccaacuccucauguc

SEQ ID NO: 938505 - RNA, 13 nt, Homo sapiens
ucgaaaugagcuc

SEQ ID NO: 938506 - RNA, 16 nt, Homo sapiens
ucgauuuaugccucag

SEQ ID NO: 938507 - RNA, 15 nt, Homo sapiens
ucgcacacacaguga

SEQ ID NO: 938508 - RNA, 16 nt, Homo sapiens
ucgcacacacagugau

SEQ ID NO: 938509 - RNA, 20 nt, Homo sapiens
ucggagaaacgggugagcug

SEQ ID NO: 938510 - RNA, 20 nt, Homo sapiens
ucggauuugccauagccuug

SEQ ID NO: 938511 - RNA, 16 nt, Homo sapiens
ucggccccagcacaug

SEQ ID NO: 938512 - RNA, 16 nt, Homo sapiens
ucguuaaaaacagauu

SEQ ID NO: 938513 - RNA, 22 nt, Homo sapiens
ucuaaaucaaaccaggugcaau

SEQ ID NO: 938514 - RNA, 18 nt, Homo sapiens
ucuaauucggauuugcca

SEQ ID NO: 938515 - RNA, 20 nt, Homo sapiens
ucuacacagauggaaucucu

SEQ ID NO: 938516 - RNA, 18 nt, Homo sapiens
ucuacauuucacauuauu

SEQ ID NO: 938517 - RNA, 13 nt, Homo sapiens
ucuaccucaggca

SEQ ID NO: 938518 - RNA, 15 nt, Homo sapiens
ucuacugaaugucau

SEQ ID NO: 938519 - RNA, 15 nt, Homo sapiens
ucuagcugugggggu

SEQ ID NO: 938520 - RNA, 22 nt, Homo sapiens
ucuagcuucuucagagaucaag

SEQ ID NO: 938521 - RNA, 19 nt, Homo sapiens
ucuauacucagguaccucu

SEQ ID NO: 938522 - RNA, 18 nt, Homo sapiens
ucuauucuagccugcauu

SEQ ID NO: 938523 - RNA, 13 nt, Homo sapiens
ucuauugggauau

SEQ ID NO: 938524 - RNA, 20 nt, Homo sapiens
ucuauuuauggauaucacac

SEQ ID NO: 938525 - RNA, 20 nt, Homo sapiens
ucucacccucaucacuagga

SEQ ID NO: 938526 - RNA, 17 nt, Homo sapiens
ucucagcuccaauuuca

SEQ ID NO: 938527 - RNA, 16 nt, Homo sapiens
ucucaucaguccauug

SEQ ID NO: 938528 - RNA, 14 nt, Homo sapiens
ucuccaaugugcuu

SEQ ID NO: 938529 - RNA, 21 nt, Homo sapiens
ucucccagugacaacaucgca

SEQ ID NO: 938530 - RNA, 14 nt, Homo sapiens
ucucggacucccua

SEQ ID NO: 938531 - RNA, 16 nt, Homo sapiens
ucucuacugaauguca

SEQ ID NO: 938532 - RNA, 21 nt, Homo sapiens
ucucuccacgguagcacuuga

SEQ ID NO: 938533 - RNA, 19 nt, Homo sapiens
ucucuccccagaugugacu

SEQ ID NO: 938534 - RNA, 16 nt, Homo sapiens
ucucuccuuggccaca

SEQ ID NO: 938535 - RNA, 20 nt, Homo sapiens
ucucucggcuccccaugugu

SEQ ID NO: 938536 - RNA, 17 nt, Homo sapiens
ucucugcaaaccaacag

SEQ ID NO: 938537 - RNA, 22 nt, Homo sapiens
ucucugggaaucaacagcauau

SEQ ID NO: 938538 - RNA, 22 nt, Homo sapiens
ucucugggcuucgggcuaugca

SEQ ID NO: 938539 - RNA, 15 nt, Homo sapiens
ucugaagacagucuu

SEQ ID NO: 938540 - RNA, 14 nt, Homo sapiens
ucugcaaaccaaca

SEQ ID NO: 938541 - RNA, 20 nt, Homo sapiens
ucugcaacaaaaagucauuu

SEQ ID NO: 938542 - RNA, 22 nt, Homo sapiens
ucugcauggaacagcauuaccc

SEQ ID NO: 938543 - RNA, 20 nt, Homo sapiens
ucugcuuuucccauugccau

SEQ ID NO: 938544 - RNA, 13 nt, Homo sapiens
ucuggaaucugga

SEQ ID NO: 938545 - RNA, 12 nt, Homo sapiens
ucuggagcauuu

SEQ ID NO: 938546 - RNA, 14 nt, Homo sapiens
ucuggaguggaaaa

SEQ ID NO: 938547 - RNA, 19 nt, Homo sapiens
ucuggcaagccugucuuca

SEQ ID NO: 938548 - RNA, 19 nt, Homo sapiens
ucuggcauuccuuuuccca

SEQ ID NO: 938549 - RNA, 11 nt, Homo sapiens
ucugggcuccu

SEQ ID NO: 938550 - RNA, 16 nt, Homo sapiens
ucugguaggaggcaaa

SEQ ID NO: 938551 - RNA, 11 nt, Homo sapiens
ucuguaucugc

SEQ ID NO: 938552 - RNA, 20 nt, Homo sapiens
ucuguauugggguacaggaa

SEQ ID NO: 938553 - RNA, 13 nt, Homo sapiens
ucugucaacauca

SEQ ID NO: 938554 - RNA, 13 nt, Homo sapiens
ucugucaccaacu

SEQ ID NO: 938555 - RNA, 18 nt, Homo sapiens
ucugucaccaacugaagu

SEQ ID NO: 938556 - RNA, 21 nt, Homo sapiens
ucugucaccagcuaucuguca

SEQ ID NO: 938557 - RNA, 16 nt, Homo sapiens
ucuguggagguggaaa

SEQ ID NO: 938558 - RNA, 14 nt, Homo sapiens
ucuuacaacuuuca

SEQ ID NO: 938559 - RNA, 19 nt, Homo sapiens
ucuuccuuccuaauaggca

SEQ ID NO: 938560 - RNA, 14 nt, Homo sapiens
ucuuccuuuuauca

SEQ ID NO: 938561 - RNA, 14 nt, Homo sapiens
ucuucucguuuuca

SEQ ID NO: 938562 - RNA, 17 nt, Homo sapiens
ucuugcaacucuguaaa

SEQ ID NO: 938563 - RNA, 17 nt, Homo sapiens
ucuuggcuuaaucauuu

SEQ ID NO: 938564 - RNA, 14 nt, Homo sapiens
ucuuuagugucuga

SEQ ID NO: 938565 - RNA, 18 nt, Homo sapiens
ucuuuccaaaacauuucu

SEQ ID NO: 938566 - RNA, 14 nt, Homo sapiens
ucuuuccuggcacu

SEQ ID NO: 938567 - RNA, 20 nt, Homo sapiens
ucuuucucaaagaaauauua

SEQ ID NO: 938568 - RNA, 15 nt, Homo sapiens
ucuuucucugaggac

SEQ ID NO: 938569 - RNA, 17 nt, Homo sapiens
ucuuucugucaggggcu

SEQ ID NO: 938570 - RNA, 15 nt, Homo sapiens
ucuuugugugacaug

SEQ ID NO: 938571 - RNA, 23 nt, Homo sapiens
ugaaaaaagguuguguagcugug

SEQ ID NO: 938572 - RNA, 13 nt, Homo sapiens
ugaaaacuuguaa

SEQ ID NO: 938573 - RNA, 18 nt, Homo sapiens
ugaaaagaauagaagcua

SEQ ID NO: 938574 - RNA, 15 nt, Homo sapiens
ugaaaaucauaggca

SEQ ID NO: 938575 - RNA, 19 nt, Homo sapiens
ugaaaccccaaacagugac

SEQ ID NO: 938576 - RNA, 17 nt, Homo sapiens
ugaaacuacaucuccaa

SEQ ID NO: 938577 - RNA, 19 nt, Homo sapiens
ugaaacucauagacacuga

SEQ ID NO: 938578 - RNA, 21 nt, Homo sapiens
ugaaacucauagacacugauc

SEQ ID NO: 938579 - RNA, 18 nt, Homo sapiens
ugaaacuccagaugccac

SEQ ID NO: 938580 - RNA, 15 nt, Homo sapiens
ugaaauucucaucag

SEQ ID NO: 938581 - RNA, 23 nt, Homo sapiens
ugaacacucaguggcccauggca

SEQ ID NO: 938582 - RNA, 16 nt, Homo sapiens
ugaacccuaaggugag

SEQ ID NO: 938583 - RNA, 22 nt, Homo sapiens
gauagcaagguuuggugcaaag

SEQ ID NO: 938584 - RNA, 12 nt, Homo sapiens
gauagcacuuuc

SEQ ID NO: 938585 - RNA, 18 nt, Homo sapiens
gauagcuuggagggaugg

SEQ ID NO: 938586 - RNA, 18 nt, Homo sapiens
gauauaaaaauaauguca

SEQ ID NO: 938587 - RNA, 23 nt, Homo sapiens
gauauccuuucacucugcauggu

SEQ ID NO: 938588 - RNA, 14 nt, Homo sapiens
gauauuacauuuau

SEQ ID NO: 938589 - RNA, 20 nt, Homo sapiens
gauauuggggccaugaguaa

SEQ ID NO: 938590 - RNA, 23 nt, Homo sapiens
gauccgggcuguuguugaugcau

SEQ ID NO: 938591 - RNA, 15 nt, Homo sapiens
gauccuccacagaga

SEQ ID NO: 938592 - RNA, 17 nt, Homo sapiens
gaucuucauuaccaaua

SEQ ID NO: 938593 - RNA, 21 nt, Homo sapiens
gaugccacuucucacucacca

SEQ ID NO: 938594 - RNA, 17 nt, Homo sapiens
gaugggaccagggaugg

SEQ ID NO: 938595 - RNA, 20 nt, Homo sapiens
gauguguauacguaggaauu

SEQ ID NO: 938596 - RNA, 19 nt, Homo sapiens
gauguuuccagacuuccuu

SEQ ID NO: 938597 - RNA, 14 nt, Homo sapiens
gauuaauauuauua

SEQ ID NO: 938598 - RNA, 17 nt, Homo sapiens
gauucuauuuaauugaa

SEQ ID NO: 938599 - RNA, 20 nt, Homo sapiens
gauucugcuagccuguucuu

SEQ ID NO: 938600 - RNA, 16 nt, Homo sapiens
gauuuaugaugcacuu

SEQ ID NO: 938601 - RNA, 14 nt, Homo sapiens
gauuucuaccucag

SEQ ID NO: 938602 - RNA, 15 nt, Homo sapiens
uguaaaugugacauu

SEQ ID NO: 938603 - RNA, 22 nt, Homo sapiens
uguaagaaauacagacuggaug

SEQ ID NO: 938604 - RNA, 12 nt, Homo sapiens
uguaagaacaac

SEQ ID NO: 938605 - RNA, 16 nt, Homo sapiens
uguaagcauacuuugu

SEQ ID NO: 938606 - RNA, 17 nt, Homo sapiens
uguaagguacuuucaua

SEQ ID NO: 938607 - RNA, 17 nt, Homo sapiens
uguaauaaaacauguuc

SEQ ID NO: 938608 - RNA, 16 nt, Homo sapiens
uguaauacuucaccuc

SEQ ID NO: 938609 - RNA, 19 nt, Homo sapiens
uguaaucccagcacuuugg

SEQ ID NO: 938610 - RNA, 21 nt, Homo sapiens
uguaaucgcccuacuauucag

SEQ ID NO: 938611 - RNA, 14 nt, Homo sapiens
uguaaugcugcaca

SEQ ID NO: 938612 - RNA, 14 nt, Homo sapiens
uguacagauuuuau

SEQ ID NO: 938613 - RNA, 13 nt, Homo sapiens
uguagacacuuac

SEQ ID NO: 938614 - RNA, 23 nt, Homo sapiens
uguaucuagcuucuucagagauc

SEQ ID NO: 938615 - RNA, 20 nt, Homo sapiens
uguaugugggaguacucuca

SEQ ID NO: 938616 - RNA, 22 nt, Homo sapiens
ugucaacaucaaagagcacauu

SEQ ID NO: 938617 - RNA, 17 nt, Homo sapiens
ugucaccuugaugacuu

SEQ ID NO: 938618 - RNA, 18 nt, Homo sapiens
ugucagauucacacaugc

SEQ ID NO: 938619 - RNA, 14 nt, Homo sapiens
ugucauaacaucca

SEQ ID NO: 938620 - RNA, 11 nt, Homo sapiens
uguccaaagag

SEQ ID NO: 938621 - RNA, 17 nt, Homo sapiens
uguccaaagaggcugcc

SEQ ID NO: 938622 - RNA, 13 nt, Homo sapiens
uguccccuacccc

SEQ ID NO: 938623 - RNA, 19 nt, Homo sapiens
uguccuaaggcccauuuga

SEQ ID NO: 938624 - RNA, 17 nt, Homo sapiens
ugucgauuuaugccuca

SEQ ID NO: 938625 - RNA, 18 nt, Homo sapiens
ugucgguuaccucugcau

SEQ ID NO: 938626 - RNA, 16 nt, Homo sapiens
ugucguauuuggcaca

SEQ ID NO: 938627 - RNA, 12 nt, Homo sapiens
ugucguccugcc

SEQ ID NO: 938628 - RNA, 11 nt, Homo sapiens
ugucuaccugg

SEQ ID NO: 938629 - RNA, 13 nt, Homo sapiens
ugucuccugagca

SEQ ID NO: 938630 - RNA, 15 nt, Homo sapiens
ugucugucaccagcu

SEQ ID NO: 938631 - RNA, 19 nt, Homo sapiens
ugucuguggcaaaaguuua

SEQ ID NO: 938632 - RNA, 13 nt, Homo sapiens
ugucuuuugccau

SEQ ID NO: 938633 - RNA, 17 nt, Homo sapiens
ugugaacucaccaaaca

SEQ ID NO: 938634 - RNA, 14 nt, Homo sapiens
ugugaagagacucu

SEQ ID NO: 938635 - RNA, 12 nt, Homo sapiens
ugugacuacuga

SEQ ID NO: 938636 - RNA, 15 nt, Homo sapiens
ugugcaaaugugcug

SEQ ID NO: 938637 - RNA, 14 nt, Homo sapiens
ugugcaggcaccug

SEQ ID NO: 938638 - RNA, 21 nt, Homo sapiens
ugugccauacuuguucuguau

SEQ ID NO: 938639 - RNA, 19 nt, Homo sapiens
ugugcuccagucauugcac

SEQ ID NO: 938640 - RNA, 21 nt, Homo sapiens
uguggcaggagggcaguggug

SEQ ID NO: 938641 - RNA, 12 nt, Homo sapiens
uguggcauucau

SEQ ID NO: 938642 - RNA, 13 nt, Homo sapiens
uguguaaacucau

SEQ ID NO: 938643 - RNA, 9 nt, Homo sapiens
uguguaugu

SEQ ID NO: 938644 - RNA, 19 nt, Homo sapiens
uguguuauuuaaugaguca

SEQ ID NO: 938645 - RNA, 14 nt, Homo sapiens
uguguucugucacc

SEQ ID NO: 938646 - RNA, 21 nt, Homo sapiens
uguuaacacucaugaagcaua

SEQ ID NO: 938647 - RNA, 15 nt, Homo sapiens
uguuaauguucauau

SEQ ID NO: 938648 - RNA, 15 nt, Homo sapiens
uguuauuuaacagcu

SEQ ID NO: 938649 - RNA, 14 nt, Homo sapiens
uguucaaggcagug

SEQ ID NO: 938650 - RNA, 19 nt, Homo sapiens
uguucacaacagugaaaag

SEQ ID NO: 938651 - RNA, 21 nt, Homo sapiens
uguuccacacccaaugcugcu

SEQ ID NO: 938652 - RNA, 19 nt, Homo sapiens
uguucucaacuucaaaagu

SEQ ID NO: 938653 - RNA, 19 nt, Homo sapiens
uguucuccggguguggccu

SEQ ID NO: 938654 - RNA, 17 nt, Homo sapiens
uguuguacauacagagg

SEQ ID NO: 938655 - RNA, 20 nt, Homo sapiens
uguuuugccauguuggccag

SEQ ID NO: 938656 - RNA, 20 nt, Homo sapiens
uuaaaaacuagagcacagaa

SEQ ID NO: 938657 - RNA, 20 nt, Homo sapiens
uuaaaaguuugaaaagcaau

SEQ ID NO: 938658 - RNA, 17 nt, Homo sapiens
uuaaacaaauaauuuag

SEQ ID NO: 938659 - RNA, 15 nt, Homo sapiens
uuaaacaccuccuca

SEQ ID NO: 938660 - RNA, 22 nt, Homo sapiens
uuaaacuucauauguaaucucu

SEQ ID NO: 938661 - RNA, 13 nt, Homo sapiens
uuaaagccuccuc

SEQ ID NO: 938662 - RNA, 16 nt, Homo sapiens
uuaaaguauucuucuc

SEQ ID NO: 938663 - RNA, 15 nt, Homo sapiens
uuaacugcauccagc

SEQ ID NO: 938664 - RNA, 22 nt, Homo sapiens
uuaacugugcguuaaauaagca

SEQ ID NO: 938665 - RNA, 21 nt, Homo sapiens
uuaacuugaaaauuuuuuaac

SEQ ID NO: 938666 - RNA, 16 nt, Homo sapiens
uuaauaaaccuuugca

SEQ ID NO: 938667 - RNA, 18 nt, Homo sapiens
uuaauagggaauauaucu

SEQ ID NO: 938668 - RNA, 21 nt, Homo sapiens
uuaauaggugcagucuuugag

SEQ ID NO: 938669 - RNA, 14 nt, Homo sapiens
uuaauccuaccuca

SEQ ID NO: 938670 - RNA, 22 nt, Homo sapiens
uuaaugaucagcuauauacuau

SEQ ID NO: 938671 - RNA, 17 nt, Homo sapiens
uuaaugcacuuucuauc

SEQ ID NO: 938672 - RNA, 18 nt, Homo sapiens
uuaauguuaacaagacaa

SEQ ID NO: 938673 - RNA, 17 nt, Homo sapiens
uuacacugugucauucu

SEQ ID NO: 938674 - RNA, 19 nt, Homo sapiens
uuacacugugucauucugu

SEQ ID NO: 938675 - RNA, 18 nt, Homo sapiens
uuacaguccaaaauacug

SEQ ID NO: 938676 - RNA, 21 nt, Homo sapiens
uuacauuagccauucauguau

SEQ ID NO: 938677 - RNA, 19 nt, Homo sapiens
uuaccaaagcaucaauaca

SEQ ID NO: 938678 - RNA, 17 nt, Homo sapiens
uuaccaugugcuaauaa

SEQ ID NO: 938679 - RNA, 15 nt, Homo sapiens
uuaccugagagauuu

SEQ ID NO: 938680 - RNA, 12 nt, Homo sapiens
uuagaaauucag

SEQ ID NO: 938681 - RNA, 20 nt, Homo sapiens
uuagauguaauuuuguguaa

SEQ ID NO: 938682 - RNA, 20 nt, Homo sapiens
uuagcaauaaauaacacuug

SEQ ID NO: 938683 - RNA, 15 nt, Homo sapiens
uuagcagcagccuuu

SEQ ID NO: 938684 - RNA, 17 nt, Homo sapiens
uuagcaugcuacaguua

SEQ ID NO: 938685 - RNA, 21 nt, Homo sapiens
uuagccauugaaaugucaaau

SEQ ID NO: 938686 - RNA, 18 nt, Homo sapiens
uuaggauuuucacauucu

SEQ ID NO: 938687 - RNA, 15 nt, Homo sapiens
uuagugauauuacau

SEQ ID NO: 938688 - RNA, 18 nt, Homo sapiens
uuaguuuuaaaaagggaa

SEQ ID NO: 938689 - RNA, 17 nt, Homo sapiens
uuauaagucuuacauaa

SEQ ID NO: 938690 - RNA, 16 nt, Homo sapiens
gguaauacaaacuaua

SEQ ID NO: 938691 - RNA, 23 nt, Homo sapiens
gguaguuuguuuuagaaccagcc

SEQ ID NO: 938692 - RNA, 22 nt, Homo sapiens
gguaugucauucgcuacuauga

SEQ ID NO: 938693 - RNA, 21 nt, Homo sapiens
ggucagugguggucuucaaga

SEQ ID NO: 938694 - RNA, 11 nt, Homo sapiens
ggucaugccac

SEQ ID NO: 938695 - RNA, 18 nt, Homo sapiens
ggucgcagcuacauaaga

SEQ ID NO: 938696 - RNA, 22 nt, Homo sapiens
ggucuaagcaccuuggugcuua

SEQ ID NO: 938697 - RNA, 15 nt, Homo sapiens
ggucuaggacacagu

SEQ ID NO: 938698 - RNA, 16 nt, Homo sapiens
ggugcuaaccuggaua

SEQ ID NO: 938699 - RNA, 22 nt, Homo sapiens
gguggagcagcaaacuugguga

SEQ ID NO: 938700 - RNA, 20 nt, Homo sapiens
ggugggauuccacucgugug

SEQ ID NO: 938701 - RNA, 15 nt, Homo sapiens
gguuaauucauuugg

SEQ ID NO: 938702 - RNA, 21 nt, Homo sapiens
gguuagguagcaacaacagaa

SEQ ID NO: 938703 - RNA, 17 nt, Homo sapiens
gguugagcucuucuuaa

SEQ ID NO: 938704 - RNA, 15 nt, Homo sapiens
gguugggcagccaga

SEQ ID NO: 938705 - RNA, 16 nt, Homo sapiens
gguuggguuugggagu

SEQ ID NO: 938706 - RNA, 12 nt, Homo sapiens
guaaaacagggc

SEQ ID NO: 938707 - RNA, 20 nt, Homo sapiens
guaaacagauggcacuuuga

SEQ ID NO: 938708 - RNA, 20 nt, Homo sapiens
guaaagaacguggucagagu

SEQ ID NO: 938709 - RNA, 12 nt, Homo sapiens
guaaaggcagua

SEQ ID NO: 938710 - RNA, 19 nt, Homo sapiens
guaacuccccucagggaua

SEQ ID NO: 938711 - RNA, 17 nt, Homo sapiens
agccucacaaucccaca

SEQ ID NO: 938712 - RNA, 22 nt, Homo sapiens
agccucagaaggccccagagag

SEQ ID NO: 938713 - RNA, 19 nt, Homo sapiens
agccuccagggcauugcuc

SEQ ID NO: 938714 - RNA, 17 nt, Homo sapiens
agccuccaucaugaaga

SEQ ID NO: 938715 - RNA, 21 nt, Homo sapiens
agccucccccucagaugaucu

SEQ ID NO: 938716 - RNA, 22 nt, Homo sapiens
agccucccccucagaugaucuc

SEQ ID NO: 938717 - RNA, 23 nt, Homo sapiens
agccugaaacucauagacacuga

SEQ ID NO: 938718 - RNA, 20 nt, Homo sapiens
agccugcauugagcuugcau

SEQ ID NO: 938719 - RNA, 22 nt, Homo sapiens
agccuguggcuggcuggaaaaa

SEQ ID NO: 938720 - RNA, 18 nt, Homo sapiens
agcggagagagccaagac

SEQ ID NO: 938721 - RNA, 20 nt, Homo sapiens
agcgugaggagcgaucucag

SEQ ID NO: 938722 - RNA, 23 nt, Homo sapiens
agcgugaggagcgaucucagcag

SEQ ID NO: 938723 - RNA, 15 nt, Homo sapiens
agcuaggugcuauuu

SEQ ID NO: 938724 - RNA, 17 nt, Homo sapiens
agcuaggugcuauuugu

SEQ ID NO: 938725 - RNA, 17 nt, Homo sapiens
agcuccaauuucaagag

SEQ ID NO: 938726 - RNA, 22 nt, Homo sapiens
agcucuggcaggaagggacugc

SEQ ID NO: 938727 - RNA, 17 nt, Homo sapiens
agcucuugaccaaguau

SEQ ID NO: 938728 - RNA, 14 nt, Homo sapiens
agcugaacaauagg

SEQ ID NO: 938729 - RNA, 14 nt, Homo sapiens
agcugcaauaggaa

SEQ ID NO: 938730 - RNA, 21 nt, Homo sapiens
agcuggcagacucgggaccaa

SEQ ID NO: 938731 - RNA, 21 nt, Homo sapiens
agcuggcagagagcacaguga

SEQ ID NO: 938732 - RNA, 22 nt, Homo sapiens
agcuggcagagagcacagugau

SEQ ID NO: 938733 - RNA, 22 nt, Homo sapiens
agcuggggaccugguacccucc

SEQ ID NO: 938734 - RNA, 13 nt, Homo sapiens
agcugugcucaga

SEQ ID NO: 938735 - RNA, 18 nt, Homo sapiens
agcuuaagaaccauugau

SEQ ID NO: 938736 - RNA, 22 nt, Homo sapiens
agcuuggaguucucuauacuca

SEQ ID NO: 938737 - RNA, 22 nt, Homo sapiens
agcuuguugucuccacuuguau

SEQ ID NO: 938738 - RNA, 23 nt, Homo sapiens
agcuuugcaaaaugagacuuucu

SEQ ID NO: 938739 - RNA, 18 nt, Homo sapiens
agcuuuuggagggugaua

SEQ ID NO: 938740 - RNA, 13 nt, Homo sapiens
aggaaaaggcccc

SEQ ID NO: 938741 - RNA, 15 nt, Homo sapiens
aggaacuagaaagaa

SEQ ID NO: 938742 - RNA, 22 nt, Homo sapiens
aggaacugcaauaauaucaaaa

SEQ ID NO: 938743 - RNA, 11 nt, Homo sapiens
aggaagcccag

SEQ ID NO: 938744 - RNA, 22 nt, Homo sapiens
aggaauuacgugcucugugggu

SEQ ID NO: 938745 - RNA, 15 nt, Homo sapiens
aggaauugaauuaau

SEQ ID NO: 938746 - RNA, 13 nt, Homo sapiens
aggacaacacuuc

SEQ ID NO: 938747 - RNA, 17 nt, Homo sapiens
aggagaagaagguuucu

SEQ ID NO: 938748 - RNA, 18 nt, Homo sapiens
aggagaauuuaaacaaug

SEQ ID NO: 938749 - RNA, 15 nt, Homo sapiens
aggagcgcuacccac

SEQ ID NO: 938750 - RNA, 18 nt, Homo sapiens
aggaggcaaagguucuau

SEQ ID NO: 938751 - RNA, 18 nt, Homo sapiens
aggaucaaagaacugaaa

SEQ ID NO: 938752 - RNA, 22 nt, Homo sapiens
aggauuaauaaagauggcacuu

SEQ ID NO: 938753 - RNA, 19 nt, Homo sapiens
aggcaaaaauguccagcca

SEQ ID NO: 938754 - RNA, 15 nt, Homo sapiens
aggcaaggaugucug

SEQ ID NO: 938755 - RNA, 19 nt, Homo sapiens
aggcaaggaugucugagac

SEQ ID NO: 938756 - RNA, 23 nt, Homo sapiens
aggcaauaauaagugaugugcug

SEQ ID NO: 938757 - RNA, 16 nt, Homo sapiens
aggcaguuaauucuca

SEQ ID NO: 938758 - RNA, 15 nt, Homo sapiens
aggcccgcucuacau

SEQ ID NO: 938759 - RNA, 21 nt, Homo sapiens
aggcgcaguggcucaugccug

SEQ ID NO: 938760 - RNA, 16 nt, Homo sapiens
aggcuaucaacaaaga

SEQ ID NO: 938761 - RNA, 15 nt, Homo sapiens
aggcugaagcaggau

SEQ ID NO: 938762 - RNA, 20 nt, Homo sapiens
aggcugagauaggaucacuu

SEQ ID NO: 938763 - RNA, 15 nt, Homo sapiens
aggcugccccucuca

SEQ ID NO: 938764 - RNA, 22 nt, Homo sapiens
aggcugcuggaaggcagcuugu

SEQ ID NO: 938765 - RNA, 12 nt, Homo sapiens
aggcugggccau

SEQ ID NO: 938766 - RNA, 23 nt, Homo sapiens
aggcugggccauguccaaagagg

SEQ ID NO: 938767 - RNA, 20 nt, Homo sapiens
agggaacccaacagucauga

SEQ ID NO: 938768 - RNA, 20 nt, Homo sapiens
agggaacucuggcauuccuu

SEQ ID NO: 938769 - RNA, 17 nt, Homo sapiens
agggaaugcagcaggaa

SEQ ID NO: 938770 - RNA, 21 nt, Homo sapiens
agggacaugcccuguguggcu

SEQ ID NO: 938771 - RNA, 22 nt, Homo sapiens
agggacugcagguugugcccug

SEQ ID NO: 938772 - RNA, 18 nt, Homo sapiens
agggagcucugaugagca

SEQ ID NO: 938773 - RNA, 18 nt, Homo sapiens
agggcucucucuccccac

SEQ ID NO: 938774 - RNA, 13 nt, Homo sapiens
aggggaauggagg

SEQ ID NO: 938775 - RNA, 21 nt, Homo sapiens
aggggagggagaaguuucugu

SEQ ID NO: 938776 - RNA, 12 nt, Homo sapiens
aggggcucccac

SEQ ID NO: 938777 - RNA, 19 nt, Homo sapiens
agggggcccucugccucau

SEQ ID NO: 938778 - RNA, 21 nt, Homo sapiens
ggucacguuuggugcuucuca

SEQ ID NO: 938779 - RNA, 20 nt, Homo sapiens
ggucaggagauggagaccau

SEQ ID NO: 938780 - RNA, 15 nt, Homo sapiens
ggucaggcgcagugg

SEQ ID NO: 938781 - RNA, 17 nt, Homo sapiens
ggucccuuggucaggag

SEQ ID NO: 938782 - RNA, 14 nt, Homo sapiens
ggugacaccucccc

SEQ ID NO: 938783 - RNA, 16 nt, Homo sapiens
ggugcaggacacuggu

SEQ ID NO: 938784 - RNA, 17 nt, Homo sapiens
gguggauuccaugccgc

SEQ ID NO: 938785 - RNA, 18 nt, Homo sapiens
gguggauuccaugccgca

SEQ ID NO: 938786 - RNA, 15 nt, Homo sapiens
ggugggauuccacuc

SEQ ID NO: 938787 - RNA, 11 nt, Homo sapiens
ggugggguccu

SEQ ID NO: 938788 - RNA, 13 nt, Homo sapiens
gguguggccucag

SEQ ID NO: 938789 - RNA, 12 nt, Homo sapiens
gguugacuuucu

SEQ ID NO: 938790 - RNA, 23 nt, Homo sapiens
gguuuccgaaggguuuugcuaca

SEQ ID NO: 938791 - RNA, 23 nt, Homo sapiens
gguuugucacacgauaaagggau

SEQ ID NO: 938792 - RNA, 16 nt, Homo sapiens
guaaacaggauuauua

SEQ ID NO: 938793 - RNA, 14 nt, Homo sapiens
guaaaugcuccauu

SEQ ID NO: 938794 - RNA, 23 nt, Homo sapiens
guaacauacuggccuggacuguu

SEQ ID NO: 938795 - RNA, 23 nt, Homo sapiens
guaacaugaggggacauuuuggu

SEQ ID NO: 938796 - RNA, 16 nt, Homo sapiens
guaacauuaguuuuaa

SEQ ID NO: 938797 - RNA, 21 nt, Homo sapiens
guaagacccuuauugcugucc

SEQ ID NO: 938798 - RNA, 17 nt, Homo sapiens
guaaguauaaaugaauu

SEQ ID NO: 938799 - RNA, 23 nt, Homo sapiens
guaauaauuggagaagauuuaug

SEQ ID NO: 938800 - RNA, 13 nt, Homo sapiens
guaauacaaacua

SEQ ID NO: 938801 - RNA, 15 nt, Homo sapiens
guaauggacuaugca

SEQ ID NO: 938802 - RNA, 22 nt, Homo sapiens
guaccaauucagugucuguucc

SEQ ID NO: 938803 - RNA, 12 nt, Homo sapiens
guaccauuuaau

SEQ ID NO: 938804 - RNA, 14 nt, Homo sapiens
guacccucucagcu

SEQ ID NO: 938805 - RNA, 16 nt, Homo sapiens
guagcaaacuuuucac

SEQ ID NO: 938806 - RNA, 19 nt, Homo sapiens
guagccugggcucacugug

SEQ ID NO: 938807 - RNA, 23 nt, Homo sapiens
guagccugggcucacugugcugg

SEQ ID NO: 938808 - RNA, 13 nt, Homo sapiens
guaguuuguuuua

SEQ ID NO: 938809 - RNA, 13 nt, Homo sapiens
guauaaacacucu

SEQ ID NO: 938810 - RNA, 19 nt, Homo sapiens
guauaaguggaggcacuuu

SEQ ID NO: 938811 - RNA, 18 nt, Homo sapiens
guaugugcaggcaccuga

SEQ ID NO: 938812 - RNA, 17 nt, Homo sapiens
guauuaucaaagggaua

SEQ ID NO: 938813 - RNA, 19 nt, Homo sapiens
guauugauuuuaaauggau

SEQ ID NO: 938814 - RNA, 21 nt, Homo sapiens
guauugucgguuaccucugca

SEQ ID NO: 938815 - RNA, 23 nt, Homo sapiens
gucaacgcaacgucuaacuggac

SEQ ID NO: 938816 - RNA, 18 nt, Homo sapiens
gucaccagcuaucuguca

SEQ ID NO: 938817 - RNA, 13 nt, Homo sapiens
gucaccugcagcc

SEQ ID NO: 938818 - RNA, 18 nt, Homo sapiens
gucacguuuggugcuucu

SEQ ID NO: 938819 - RNA, 16 nt, Homo sapiens
gucacugacaguuaau

SEQ ID NO: 938820 - RNA, 18 nt, Homo sapiens
gucaggaguuccagacca

SEQ ID NO: 938821 - RNA, 18 nt, Homo sapiens
gucauuagacgguaccaa

SEQ ID NO: 938822 - RNA, 16 nt, Homo sapiens
gucauuauuuuuguua

SEQ ID NO: 938823 - RNA, 21 nt, Homo sapiens
gucauuauuuuuguuagcaaa

SEQ ID NO: 938824 - RNA, 23 nt, Homo sapiens
gucauuauuuuuguuagcaaaga

SEQ ID NO: 938825 - RNA, 23 nt, Homo sapiens
gucauucgcuacuaugauuuaau

SEQ ID NO: 938826 - RNA, 21 nt, Homo sapiens
guccauugauuuuaaccaaug

SEQ ID NO: 938827 - RNA, 14 nt, Homo sapiens
gucccagcuaccca

SEQ ID NO: 938828 - RNA, 17 nt, Homo sapiens
gucccaguauaccucau

SEQ ID NO: 938829 - RNA, 12 nt, Homo sapiens
guccccuacccc

SEQ ID NO: 938830 - RNA, 21 nt, Homo sapiens
guccccuacccccaguaaaau

SEQ ID NO: 938831 - RNA, 23 nt, Homo sapiens
guccccucauucuacuaauguga

SEQ ID NO: 938832 - RNA, 18 nt, Homo sapiens
gucccuggggcuccugcu

SEQ ID NO: 938833 - RNA, 12 nt, Homo sapiens
guccucagaucc

SEQ ID NO: 938834 - RNA, 21 nt, Homo sapiens
guccuuaucaccagccucaca

SEQ ID NO: 938835 - RNA, 20 nt, Homo sapiens
gucucaugcggacccucaca

SEQ ID NO: 938836 - RNA, 13 nt, Homo sapiens
gucugaggacuga

SEQ ID NO: 938837 - RNA, 19 nt, Homo sapiens
gucugguugggcagccaga

SEQ ID NO: 938838 - RNA, 19 nt, Homo sapiens
gucuguaaauacuggugca

SEQ ID NO: 938839 - RNA, 14 nt, Homo sapiens
gucuuuagugcucc

SEQ ID NO: 938840 - RNA, 23 nt, Homo sapiens
gugaaaaggguacagaugugcug

SEQ ID NO: 938841 - RNA, 19 nt, Homo sapiens
gugaaaauuacaguccaaa

SEQ ID NO: 938842 - RNA, 21 nt, Homo sapiens
gugaacauugguucuuucauu

SEQ ID NO: 938843 - RNA, 19 nt, Homo sapiens
gugagccgaggucaugcca

SEQ ID NO: 938844 - RNA, 15 nt, Homo sapiens
gugagggugcugacu

SEQ ID NO: 938845 - RNA, 15 nt, Homo sapiens
gugagguucuugggu

SEQ ID NO: 938846 - RNA, 19 nt, Homo sapiens
gugauauacugguucacau

SEQ ID NO: 938847 - RNA, 21 nt, Homo sapiens
uaauuaaauucugagccugau

SEQ ID NO: 938848 - RNA, 16 nt, Homo sapiens
uaauucggauuugcca

SEQ ID NO: 938849 - RNA, 17 nt, Homo sapiens
uaauuuaaacaccuccu

SEQ ID NO: 938850 - RNA, 17 nt, Homo sapiens
uacaaaaauaaacuaua

SEQ ID NO: 938851 - RNA, 13 nt, Homo sapiens
uacaaaucaucca

SEQ ID NO: 938852 - RNA, 17 nt, Homo sapiens
uacaaugaucaccgacu

SEQ ID NO: 938853 - RNA, 19 nt, Homo sapiens
uacacacacacgcacacaa

SEQ ID NO: 938854 - RNA, 20 nt, Homo sapiens
uacacaucacacccauuuaa

SEQ ID NO: 938855 - RNA, 22 nt, Homo sapiens
uacaccucgucaagagcaugca

SEQ ID NO: 938856 - RNA, 14 nt, Homo sapiens
uacagauucugcua

SEQ ID NO: 938857 - RNA, 19 nt, Homo sapiens
uacaguuaaagaagcaauc

SEQ ID NO: 938858 - RNA, 21 nt, Homo sapiens
uacaucaauuuaaaaagcaaa

SEQ ID NO: 938859 - RNA, 14 nt, Homo sapiens
uacaugucacauuu

SEQ ID NO: 938860 - RNA, 17 nt, Homo sapiens
uacauuauguugcuuaa

SEQ ID NO: 938861 - RNA, 14 nt, Homo sapiens
uacauuucauacaa

SEQ ID NO: 938862 - RNA, 12 nt, Homo sapiens
uaccaacuuuac

SEQ ID NO: 938863 - RNA, 19 nt, Homo sapiens
uacccacucuggagcauuu

SEQ ID NO: 938864 - RNA, 18 nt, Homo sapiens
uacccccaguaaaaucaa

SEQ ID NO: 938865 - RNA, 15 nt, Homo sapiens
uaccuacaucaguca

SEQ ID NO: 938866 - RNA, 18 nt, Homo sapiens
uaccuccuguguggaaga

SEQ ID NO: 938867 - RNA, 20 nt, Homo sapiens
uaccugcuguggaugcuuca

SEQ ID NO: 938868 - RNA, 16 nt, Homo sapiens
uaccuucaaacuuuag

SEQ ID NO: 938869 - RNA, 20 nt, Homo sapiens
uacgugauccucucaccuca

SEQ ID NO: 938870 - RNA, 17 nt, Homo sapiens
uacuacagcuucaguga

SEQ ID NO: 938871 - RNA, 15 nt, Homo sapiens
uacugugauguuugu

SEQ ID NO: 938872 - RNA, 15 nt, Homo sapiens
uacuuuguuaggauu

SEQ ID NO: 938873 - RNA, 20 nt, Homo sapiens
uagaaagaaggacccagaac

SEQ ID NO: 938874 - RNA, 18 nt, Homo sapiens
uagaaauucagcauuuga

SEQ ID NO: 938875 - RNA, 18 nt, Homo sapiens
uagaacuagccaaaccag

SEQ ID NO: 938876 - RNA, 23 nt, Homo sapiens
uagaaguuuggcugcugucauaa

SEQ ID NO: 938877 - RNA, 13 nt, Homo sapiens
uagaaucaauuua

SEQ ID NO: 938878 - RNA, 11 nt, Homo sapiens
uagaauggugc

SEQ ID NO: 938879 - RNA, 18 nt, Homo sapiens
uagaauuaucaagcuuuu

SEQ ID NO: 938880 - RNA, 14 nt, Homo sapiens
uagacaccuagaaa

SEQ ID NO: 938881 - RNA, 20 nt, Homo sapiens
uagagacgguguuuugccau

SEQ ID NO: 938882 - RNA, 16 nt, Homo sapiens
uagagaugcugggacu

SEQ ID NO: 938883 - RNA, 13 nt, Homo sapiens
uagaucuuucuag

SEQ ID NO: 938884 - RNA, 15 nt, Homo sapiens
uagcaaacuuuucac

SEQ ID NO: 938885 - RNA, 17 nt, Homo sapiens
uggagagccccugcuaa

SEQ ID NO: 938886 - RNA, 16 nt, Homo sapiens
uggaggaacuuuccaa

SEQ ID NO: 938887 - RNA, 21 nt, Homo sapiens
uggaggaccuggcgugcucag

SEQ ID NO: 938888 - RNA, 21 nt, Homo sapiens
uggaggcacugaagugcuuag

SEQ ID NO: 938889 - RNA, 16 nt, Homo sapiens
uggaguauuggggucu

SEQ ID NO: 938890 - RNA, 21 nt, Homo sapiens
uggauaacuguaaaagggcuc

SEQ ID NO: 938891 - RNA, 17 nt, Homo sapiens
uggauugccaguuacau

SEQ ID NO: 938892 - RNA, 12 nt, Homo sapiens
uggcacuuugaa

SEQ ID NO: 938893 - RNA, 19 nt, Homo sapiens
uggcacuuugaaggggccu

SEQ ID NO: 938894 - RNA, 19 nt, Homo sapiens
uggcagagagcacagugau

SEQ ID NO: 938895 - RNA, 23 nt, Homo sapiens
uggcagagagcacagugaucacc

SEQ ID NO: 938896 - RNA, 19 nt, Homo sapiens
uggcaggaagggacugcca

SEQ ID NO: 938897 - RNA, 20 nt, Homo sapiens
uggcaggaagggacugccaa

SEQ ID NO: 938898 - RNA, 22 nt, Homo sapiens
uggcaggagggcagugguggag

SEQ ID NO: 938899 - RNA, 12 nt, Homo sapiens
uggcaggcccac

SEQ ID NO: 938900 - RNA, 13 nt, Homo sapiens
uggcaucauugca

SEQ ID NO: 938901 - RNA, 22 nt, Homo sapiens
uggcauucauauuucauauuca

SEQ ID NO: 938902 - RNA, 23 nt, Homo sapiens
uggcauuuuauaggcauaccucc

SEQ ID NO: 938903 - RNA, 14 nt, Homo sapiens
uggccacagacuga

SEQ ID NO: 938904 - RNA, 15 nt, Homo sapiens
uggccucaugucaaa

SEQ ID NO: 938905 - RNA, 22 nt, Homo sapiens
uggcucuugaggcauuuccaga

SEQ ID NO: 938906 - RNA, 20 nt, Homo sapiens
uggcugccugcaccccagga

SEQ ID NO: 938907 - RNA, 16 nt, Homo sapiens
uggcuuucagagccag

SEQ ID NO: 938908 - RNA, 23 nt, Homo sapiens
uggcuuuuaguacugaagccaaa

SEQ ID NO: 938909 - RNA, 14 nt, Homo sapiens
ugggacugcuaaau

SEQ ID NO: 938910 - RNA, 14 nt, Homo sapiens
ugggagcugccaag

SEQ ID NO: 938911 - RNA, 21 nt, Homo sapiens
ugggcaacagagcaagacucc

SEQ ID NO: 938912 - RNA, 18 nt, Homo sapiens
ugggcagggugacccuga

SEQ ID NO: 938913 - RNA, 21 nt, Homo sapiens
ugggcauuccuugggacucag

SEQ ID NO: 938914 - RNA, 14 nt, Homo sapiens
ugggccauguccaa

SEQ ID NO: 938915 - RNA, 15 nt, Homo sapiens
ugggccauguccaaa

SEQ ID NO: 938916 - RNA, 17 nt, Homo sapiens
ugggccauguccaaaga

SEQ ID NO: 938917 - RNA, 18 nt, Homo sapiens
ugggccauguccaaagag

SEQ ID NO: 938918 - RNA, 15 nt, Homo sapiens
ugggccucaguucaa

SEQ ID NO: 938919 - RNA, 15 nt, Homo sapiens
ugggccuguggcauu

SEQ ID NO: 938920 - RNA, 22 nt, Homo sapiens
ugggcgcuguuuucucagcucc

SEQ ID NO: 938921 - RNA, 14 nt, Homo sapiens
ugggcugggaacca

SEQ ID NO: 938922 - RNA, 15 nt, Homo sapiens
uggggaauauacgug

SEQ ID NO: 938923 - RNA, 21 nt, Homo sapiens
uggggauccccgccuggccag

SEQ ID NO: 938924 - RNA, 14 nt, Homo sapiens
uggggcagacaaua

SEQ ID NO: 938925 - RNA, 12 nt, Homo sapiens
uggggucuguaa

SEQ ID NO: 938926 - RNA, 18 nt, Homo sapiens
ugggugcaggacacuggu

SEQ ID NO: 938927 - RNA, 17 nt, Homo sapiens
uggguuuugugccuuug

SEQ ID NO: 938928 - RNA, 14 nt, Homo sapiens
ugguaaaguuacac

SEQ ID NO: 938929 - RNA, 20 nt, Homo sapiens
uggucacccuucaacgcucc

SEQ ID NO: 938930 - RNA, 12 nt, Homo sapiens
uggugacugucc

SEQ ID NO: 938931 - RNA, 14 nt, Homo sapiens
ugguggcaccagau

SEQ ID NO: 938932 - RNA, 17 nt, Homo sapiens
uguaaauguaaacucag

SEQ ID NO: 938933 - RNA, 13 nt, Homo sapiens
uguaaaugugaca

SEQ ID NO: 938934 - RNA, 17 nt, Homo sapiens
uguaacccagauuuugc

SEQ ID NO: 938935 - RNA, 15 nt, Homo sapiens
uguaacgcugccacu

SEQ ID NO: 938936 - RNA, 19 nt, Homo sapiens
uguacguggccauguauga

SEQ ID NO: 938937 - RNA, 23 nt, Homo sapiens
uguacuguucugugucuuucaca

SEQ ID NO: 938938 - RNA, 19 nt, Homo sapiens
uguagaaaaaaaaauucac

SEQ ID NO: 938939 - RNA, 23 nt, Homo sapiens
uguagaaaaaaaaauucacauga

SEQ ID NO: 938940 - RNA, 17 nt, Homo sapiens
uguagacacuuacuuga

SEQ ID NO: 938941 - RNA, 15 nt, Homo sapiens
uguagcaauauauca

SEQ ID NO: 938942 - RNA, 12 nt, Homo sapiens
uguaggccucag

SEQ ID NO: 938943 - RNA, 18 nt, Homo sapiens
uguaguuuuacuuuccua

SEQ ID NO: 938944 - RNA, 16 nt, Homo sapiens
uguaguuuucagauac

SEQ ID NO: 938945 - RNA, 13 nt, Homo sapiens
uguauccaugcac

SEQ ID NO: 938946 - RNA, 19 nt, Homo sapiens
uguauguuguacaaucaaa

SEQ ID NO: 938947 - RNA, 21 nt, Homo sapiens
ugucacauuuagcugugcuca

SEQ ID NO: 938948 - RNA, 22 nt, Homo sapiens
ugucaccagcuaucugucaucu

SEQ ID NO: 938949 - RNA, 14 nt, Homo sapiens
ugucaggggcuccc

SEQ ID NO: 938950 - RNA, 13 nt, Homo sapiens
ugucauaguucug

SEQ ID NO: 938951 - RNA, 21 nt, Homo sapiens
ugugaaaauuacaguccaaaa

SEQ ID NO: 938952 - RNA, 22 nt, Homo sapiens
ugugaauuguuuuuguacaguu

SEQ ID NO: 938953 - RNA, 18 nt, Homo sapiens
ugugauagcacuuucuac

SEQ ID NO: 938954 - RNA, 16 nt, Homo sapiens
ugugcuaauaaguuug

SEQ ID NO: 938955 - RNA, 17 nt, Homo sapiens
uuguaaugcugcacaga

SEQ ID NO: 938956 - RNA, 24 nt, Homo sapiens
uuguauaaagcauuuguagcaauu

SEQ ID NO: 938957 - RNA, 22 nt, Homo sapiens
uuguauauauggaucagaggag

SEQ ID NO: 938958 - RNA, 21 nt, Homo sapiens
uugucagauucacacaugcca

SEQ ID NO: 938959 - RNA, 19 nt, Homo sapiens
uugucauugaaauuuggca

SEQ ID NO: 938960 - RNA, 18 nt, Homo sapiens
uuguccccacuuacagau

SEQ ID NO: 938961 - RNA, 16 nt, Homo sapiens
uugucgguuaccucug

SEQ ID NO: 938962 - RNA, 15 nt, Homo sapiens
uugugauagcacuuu

SEQ ID NO: 938963 - RNA, 13 nt, Homo sapiens
uuguugugcuauu

SEQ ID NO: 938964 - RNA, 19 nt, Homo sapiens
uuuaaaaaauauuuucucu

SEQ ID NO: 938965 - RNA, 15 nt, Homo sapiens
uuuaaaauucaauua

SEQ ID NO: 938966 - RNA, 13 nt, Homo sapiens
uuuaacagccucu

SEQ ID NO: 938967 - RNA, 18 nt, Homo sapiens
uuuaacaugguauuauca

SEQ ID NO: 938968 - RNA, 19 nt, Homo sapiens
uuuaacauuguugauuuca

SEQ ID NO: 938969 - RNA, 18 nt, Homo sapiens
uuuaacuauucauaagau

SEQ ID NO: 938970 - RNA, 23 nt, Homo sapiens
uuuaagggauugcuuucaucuaa

SEQ ID NO: 938971 - RNA, 21 nt, Homo sapiens
uuuaauagggaauauaucucu

SEQ ID NO: 938972 - RNA, 15 nt, Homo sapiens
uuuaauccuaccuca

SEQ ID NO: 938973 - RNA, 19 nt, Homo sapiens
uuuaauguaauagggaaaa

SEQ ID NO: 938974 - RNA, 14 nt, Homo sapiens
uuuacauacuuuau

SEQ ID NO: 938975 - RNA, 12 nt, Homo sapiens
uuuacauuugau

SEQ ID NO: 938976 - RNA, 20 nt, Homo sapiens
uuuacuuuuuauuugcaacu

SEQ ID NO: 938977 - RNA, 22 nt, Homo sapiens
uuucaaaggccacauaccucuc

SEQ ID NO: 938978 - RNA, 20 nt, Homo sapiens
uuucaagagugagcuaucaa

SEQ ID NO: 938979 - RNA, 12 nt, Homo sapiens
uuucaagucucu

SEQ ID NO: 938980 - RNA, 17 nt, Homo sapiens
uuucagucaaaacuuua

SEQ ID NO: 938981 - RNA, 13 nt, Homo sapiens
uuuccaagcugcg

SEQ ID NO: 938982 - RNA, 19 nt, Homo sapiens
uuuccagacuuccuugaga

SEQ ID NO: 938983 - RNA, 15 nt, Homo sapiens
uuucuccuucacagc

SEQ ID NO: 938984 - RNA, 19 nt, Homo sapiens
uuucucuaguguauuauca

SEQ ID NO: 938985 - RNA, 21 nt, Homo sapiens
uuucugucaggggcucccaca

SEQ ID NO: 938986 - RNA, 21 nt, Homo sapiens
uuucugucguuaaaaacagau

SEQ ID NO: 938987 - RNA, 18 nt, Homo sapiens
uuugacccuugcugugaa

SEQ ID NO: 938988 - RNA, 17 nt, Homo sapiens
uuugcaaaauaaguaaa

SEQ ID NO: 938989 - RNA, 13 nt, Homo sapiens
uuugcaaacguuc

SEQ ID NO: 938990 - RNA, 21 nt, Homo sapiens
uuugcuauaguuauacaucaa

SEQ ID NO: 938991 - RNA, 15 nt, Homo sapiens
uuugcucuuacuaca

SEQ ID NO: 938992 - RNA, 20 nt, Homo sapiens
aucuaggagaagggucucau

SEQ ID NO: 938993 - RNA, 15 nt, Homo sapiens
aucucuacuaaaaau

SEQ ID NO: 938994 - RNA, 15 nt, Homo sapiens
aucugaaauguuaca

SEQ ID NO: 938995 - RNA, 16 nt, Homo sapiens
aucugcaacaaaaagu

SEQ ID NO: 938996 - RNA, 14 nt, Homo sapiens
aucugccaugugaa

SEQ ID NO: 938997 - RNA, 15 nt, Homo sapiens
aucuggacacugggc

SEQ ID NO: 938998 - RNA, 14 nt, Homo sapiens
aucuuugugacagg

SEQ ID NO: 938999 - RNA, 19 nt, Homo sapiens
augaaagggaaacugggaa

SEQ ID NO: 939000 - RNA, 16 nt, Homo sapiens
augaaauuauuuguca

SEQ ID NO: 939001 - RNA, 21 nt, Homo sapiens
augaacaucuuuagugucuga

SEQ ID NO: 939002 - RNA, 16 nt, Homo sapiens
augaagcccuaaagaa

SEQ ID NO: 939003 - RNA, 12 nt, Homo sapiens
augacaaaccau

SEQ ID NO: 939004 - RNA, 15 nt, Homo sapiens
augacuuaaccauau

SEQ ID NO: 939005 - RNA, 18 nt, Homo sapiens
augagagggaugaggcaa

SEQ ID NO: 939006 - RNA, 16 nt, Homo sapiens
augagcucaaauugau

SEQ ID NO: 939007 - RNA, 13 nt, Homo sapiens
augagucagucaa

SEQ ID NO: 939008 - RNA, 22 nt, Homo sapiens
augauacuuggaugcagcucuu

SEQ ID NO: 939009 - RNA, 13 nt, Homo sapiens
augaucuagccuc

SEQ ID NO: 939010 - RNA, 14 nt, Homo sapiens
augcaaaagcacau

SEQ ID NO: 939011 - RNA, 17 nt, Homo sapiens
augcagcaggaaggaac

SEQ ID NO: 939012 - RNA, 22 nt, Homo sapiens
augcagcaggaaggaacaaaga

SEQ ID NO: 939013 - RNA, 21 nt, Homo sapiens
augccagcuacuuccuccucc

SEQ ID NO: 939014 - RNA, 13 nt, Homo sapiens
augcccugugugg

SEQ ID NO: 939015 - RNA, 17 nt, Homo sapiens
augccuguaaucccagc

SEQ ID NO: 939016 - RNA, 20 nt, Homo sapiens
augccuuacgaaccaugccu

SEQ ID NO: 939017 - RNA, 16 nt, Homo sapiens
augcgucaggggccua

SEQ ID NO: 939018 - RNA, 15 nt, Homo sapiens
augcugcacagaaau

SEQ ID NO: 939019 - RNA, 17 nt, Homo sapiens
augcuguacacauauuu

SEQ ID NO: 939020 - RNA, 17 nt, Homo sapiens
augcuugcucaggcuca

SEQ ID NO: 939021 - RNA, 20 nt, Homo sapiens
auggaacagcauuacccucc

SEQ ID NO: 939022 - RNA, 20 nt, Homo sapiens
auggcaaaggcuugccccaa

SEQ ID NO: 939023 - RNA, 19 nt, Homo sapiens
auggcaucauugcauucca

SEQ ID NO: 939024 - RNA, 13 nt, Homo sapiens
auggggaggacaa

SEQ ID NO: 939025 - RNA, 23 nt, Homo sapiens
auguagaauaggcagggggcccu

SEQ ID NO: 939026 - RNA, 13 nt, Homo sapiens
auguaugucagaa

SEQ ID NO: 939027 - RNA, 12 nt, Homo sapiens
augucacauuua

SEQ ID NO: 939028 - RNA, 18 nt, Homo sapiens
augucagcacacacuuac

SEQ ID NO: 939029 - RNA, 20 nt, Homo sapiens
augucauagguaagaaacac

SEQ ID NO: 939030 - RNA, 11 nt, Homo sapiens
auguccaaaga

SEQ ID NO: 939031 - RNA, 21 nt, Homo sapiens
augucuccugagcacccagaa

SEQ ID NO: 939032 - RNA, 13 nt, Homo sapiens
augugcaggcacc

SEQ ID NO: 939033 - RNA, 18 nt, Homo sapiens
augugcaggcaccugaua

SEQ ID NO: 939034 - RNA, 21 nt, Homo sapiens
auguggucuaagguucagccu

SEQ ID NO: 939035 - RNA, 22 nt, Homo sapiens
auguguaagaacaacuaccuga

SEQ ID NO: 939036 - RNA, 13 nt, Homo sapiens
auguuaacacuca

SEQ ID NO: 939037 - RNA, 22 nt, Homo sapiens
auguuccuuuaagguacugaag

SEQ ID NO: 939038 - RNA, 21 nt, Homo sapiens
auguuucgaguaaacuugaaa

SEQ ID NO: 939039 - RNA, 22 nt, Homo sapiens
auuaaaagaugucucugcaaac

SEQ ID NO: 939040 - RNA, 19 nt, Homo sapiens
auuaaauucugagccugau

SEQ ID NO: 939041 - RNA, 17 nt, Homo sapiens
auuaaguacaugugcca

SEQ ID NO: 939042 - RNA, 15 nt, Homo sapiens
auuaauaucauuuau

SEQ ID NO: 939043 - RNA, 21 nt, Homo sapiens
auuacaguccaaaauacuguu

SEQ ID NO: 939044 - RNA, 19 nt, Homo sapiens
auuacccccuccuucagac

SEQ ID NO: 939045 - RNA, 18 nt, Homo sapiens
auuagagagcaucugcaa

SEQ ID NO: 939046 - RNA, 18 nt, Homo sapiens
auuauuaaaagaugucuc

SEQ ID NO: 939047 - RNA, 18 nt, Homo sapiens
auuauuccaaaccaaauu

SEQ ID NO: 939048 - RNA, 23 nt, Homo sapiens
auuauucugggcaccacaaaaua

SEQ ID NO: 939049 - RNA, 20 nt, Homo sapiens
auuauuugucauucauucaa

SEQ ID NO: 939050 - RNA, 20 nt, Homo sapiens
auuauuuuuguuagcaaaga

SEQ ID NO: 939051 - RNA, 23 nt, Homo sapiens
auucagguaauacaaacuauaua

SEQ ID NO: 939052 - RNA, 17 nt, Homo sapiens
auucagugauuacuguc

SEQ ID NO: 939053 - RNA, 18 nt, Homo sapiens
auucauaguaagauugau

SEQ ID NO: 939054 - RNA, 17 nt, Homo sapiens
auucauagucuuuggag

SEQ ID NO: 939055 - RNA, 19 nt, Homo sapiens
auucauuguguuaccugua

SEQ ID NO: 939056 - RNA, 21 nt, Homo sapiens
auucauuguguuaccuguaga

SEQ ID NO: 939057 - RNA, 18 nt, Homo sapiens
auucccaagcuuuuggag

SEQ ID NO: 939058 - RNA, 23 nt, Homo sapiens
auuccccuguagcagucacugac

SEQ ID NO: 939059 - RNA, 20 nt, Homo sapiens
auuccuauuggaaacagaga

SEQ ID NO: 939060 - RNA, 14 nt, Homo sapiens
uuugcuuagcucaa

SEQ ID NO: 939061 - RNA, 16 nt, Homo sapiens
uuuggaaagacuggac

SEQ ID NO: 939062 - RNA, 19 nt, Homo sapiens
uuuggaguccccucaccuc

SEQ ID NO: 939063 - RNA, 20 nt, Homo sapiens
uuuguaaugcugcacagaaa

SEQ ID NO: 939064 - RNA, 22 nt, Homo sapiens
uuuguauauaggcuucucacgg

SEQ ID NO: 939065 - RNA, 17 nt, Homo sapiens
uuuguauauuuacaugc

SEQ ID NO: 939066 - RNA, 17 nt, Homo sapiens
uuuguccccacuuacag

SEQ ID NO: 939067 - RNA, 13 nt, Homo sapiens
uuuguucuguaua

SEQ ID NO: 939068 - RNA, 22 nt, Homo sapiens
uuuguuguuugauucagcaaaa

SEQ ID NO: 939069 - RNA, 21 nt, Homo sapiens
uuuuaaagcauauuggugcua

SEQ ID NO: 939070 - RNA, 15 nt, Homo sapiens
uuuuaauccuaccuc

SEQ ID NO: 939071 - RNA, 17 nt, Homo sapiens
uuuuaaugcuauuugaa

SEQ ID NO: 939072 - RNA, 19 nt, Homo sapiens
uuuuaauuuauuucaucca

SEQ ID NO: 939073 - RNA, 12 nt, Homo sapiens
uuuuacauuuca

SEQ ID NO: 939074 - RNA, 22 nt, Homo sapiens
uuuuaccaaagcaucaauacaa

SEQ ID NO: 939075 - RNA, 22 nt, Homo sapiens
uuuuagaauuaaaaaagcauac

SEQ ID NO: 939076 - RNA, 22 nt, Homo sapiens
uuuuauggacaguaaguccagu

SEQ ID NO: 939077 - RNA, 22 nt, Homo sapiens
uuuuauugcuucuuuuuggaga

SEQ ID NO: 939078 - RNA, 16 nt, Homo sapiens
uuuucaaguaccuaua

SEQ ID NO: 939079 - RNA, 14 nt, Homo sapiens
uuuucucaauugua

SEQ ID NO: 939080 - RNA, 21 nt, Homo sapiens
uuuucuccagaccccaugccu

SEQ ID NO: 939081 - RNA, 21 nt, Homo sapiens
uuuugagcacuuuucaaacaa

SEQ ID NO: 939082 - RNA, 19 nt, Homo sapiens
uuuuguacaguuaucauga

SEQ ID NO: 939083 - RNA, 14 nt, Homo sapiens
uuuuuccucugcau

SEQ ID NO: 939084 - RNA, 22 nt, Homo sapiens
uuuuucuccagaccccaugccu

SEQ ID NO: 939085 - RNA, 19 nt, Homo sapiens
uagcucaauuaguguggcu

SEQ ID NO: 939086 - RNA, 23 nt, Homo sapiens
uagcugugucauguauauaccuu

SEQ ID NO: 939087 - RNA, 15 nt, Homo sapiens
uaggaaaaucacuug

SEQ ID NO: 939088 - RNA, 23 nt, Homo sapiens
uaggaacgucugguccuaaccag

SEQ ID NO: 939089 - RNA, 22 nt, Homo sapiens
uaggaagcccucgucucuacaa

SEQ ID NO: 939090 - RNA, 18 nt, Homo sapiens
uaggagaagggucucaug

SEQ ID NO: 939091 - RNA, 21 nt, Homo sapiens
uaggagcccuagggccuggaa

SEQ ID NO: 939092 - RNA, 15 nt, Homo sapiens
uaggaggccuuagca

SEQ ID NO: 939093 - RNA, 19 nt, Homo sapiens
uaggcaccuuuuacuguga

SEQ ID NO: 939094 - RNA, 17 nt, Homo sapiens
uagucccagcuacuccg

SEQ ID NO: 939095 - RNA, 19 nt, Homo sapiens
uagucccagcuacuccgga

SEQ ID NO: 939096 - RNA, 15 nt, Homo sapiens
uagugaaaugccaca

SEQ ID NO: 939097 - RNA, 22 nt, Homo sapiens
uagugguagagguggugagaag

SEQ ID NO: 939098 - RNA, 14 nt, Homo sapiens
uaguguacuuggag

SEQ ID NO: 939099 - RNA, 20 nt, Homo sapiens
uagugucauccucacaguga

SEQ ID NO: 939100 - RNA, 15 nt, Homo sapiens
uaguuaucaguauuu

SEQ ID NO: 939101 - RNA, 21 nt, Homo sapiens
uaguugaauguugcaauguga

SEQ ID NO: 939102 - RNA, 15 nt, Homo sapiens
uauaaauguugcuau

SEQ ID NO: 939103 - RNA, 21 nt, Homo sapiens
uauaaucaucaaguaauacaa

SEQ ID NO: 939104 - RNA, 22 nt, Homo sapiens
uauaaucaucaaguaauacaaa

SEQ ID NO: 939105 - RNA, 15 nt, Homo sapiens
uauaggaacaauucu

SEQ ID NO: 939106 - RNA, 22 nt, Homo sapiens
uauaggcuucucacggcgacca

SEQ ID NO: 939107 - RNA, 12 nt, Homo sapiens
uauauagccaau

SEQ ID NO: 939108 - RNA, 21 nt, Homo sapiens
uauauagggaucaaccagcua

SEQ ID NO: 939109 - RNA, 20 nt, Homo sapiens
uauaugugauuuacauuuca

SEQ ID NO: 939110 - RNA, 13 nt, Homo sapiens
uaucaagcuuuua

SEQ ID NO: 939111 - RNA, 16 nt, Homo sapiens
uauccauugaacuaaa

SEQ ID NO: 939112 - RNA, 16 nt, Homo sapiens
uaucugucaucucucu

SEQ ID NO: 939113 - RNA, 22 nt, Homo sapiens
uaugcauguaauggacuaugca

SEQ ID NO: 939114 - RNA, 18 nt, Homo sapiens
uauggaaccuucccucca

SEQ ID NO: 939115 - RNA, 19 nt, Homo sapiens
uauggcuuuuaguacugaa

SEQ ID NO: 939116 - RNA, 17 nt, Homo sapiens
uaugguccucagauccc

SEQ ID NO: 939117 - RNA, 22 nt, Homo sapiens
uauuaacuuuuaauggugaugg

SEQ ID NO: 939118 - RNA, 19 nt, Homo sapiens
uauuaaucuggacauucga

SEQ ID NO: 939119 - RNA, 16 nt, Homo sapiens
uauuccaaaccaaauu

SEQ ID NO: 939120 - RNA, 15 nt, Homo sapiens
uauucuagccugcau

SEQ ID NO: 939121 - RNA, 17 nt, Homo sapiens
uauugcugcaaacacuu

SEQ ID NO: 939122 - RNA, 13 nt, Homo sapiens
uauuggugcuaga

SEQ ID NO: 939123 - RNA, 23 nt, Homo sapiens
uauugguucagggaacucuggca

SEQ ID NO: 939124 - RNA, 21 nt, Homo sapiens
uauugucgguuaccucugcau

SEQ ID NO: 939125 - RNA, 14 nt, Homo sapiens
uauuuaagauguga

SEQ ID NO: 939126 - RNA, 18 nt, Homo sapiens
uauuucaagucucucacc

SEQ ID NO: 939127 - RNA, 21 nt, Homo sapiens
uauuuccucugugcaaaggga

SEQ ID NO: 939128 - RNA, 22 nt, Homo sapiens
uauuuccucugugcaaagggaa

SEQ ID NO: 939129 - RNA, 11 nt, Homo sapiens
uauuugucauu

SEQ ID NO: 939130 - RNA, 17 nt, Homo sapiens
ucaaaacaaguacuggu

SEQ ID NO: 939131 - RNA, 19 nt, Homo sapiens
ucaaaacacacuacuaccu

SEQ ID NO: 939132 - RNA, 21 nt, Homo sapiens
ucaaaacacacuacuaccucu

SEQ ID NO: 939133 - RNA, 19 nt, Homo sapiens
ucaaaaguuuguuugcuua

SEQ ID NO: 939134 - RNA, 14 nt, Homo sapiens
ucaaaauuacauau

SEQ ID NO: 939135 - RNA, 16 nt, Homo sapiens
ucaaaauuuaacaguu

SEQ ID NO: 939136 - RNA, 18 nt, Homo sapiens
ucaaaccacaauauccag

SEQ ID NO: 939137 - RNA, 17 nt, Homo sapiens
ucaaaccaggugcaauu

SEQ ID NO: 939138 - RNA, 21 nt, Homo sapiens
ucaaauacauuuaaaacauua

SEQ ID NO: 939139 - RNA, 11 nt, Homo sapiens
ucaacagucuu

SEQ ID NO: 939140 - RNA, 19 nt, Homo sapiens
ucaaccucuucuggcucaa

SEQ ID NO: 939141 - RNA, 22 nt, Homo sapiens
ucaaccugguggcaccagaugc

SEQ ID NO: 939142 - RNA, 20 nt, Homo sapiens
ucaacgcucccagacgguca

SEQ ID NO: 939143 - RNA, 16 nt, Homo sapiens
ucaagagcuccuugac

SEQ ID NO: 939144 - RNA, 19 nt, Homo sapiens
ucaagauacugcuacugua

SEQ ID NO: 939145 - RNA, 15 nt, Homo sapiens
ucaagcuccccucac

SEQ ID NO: 939146 - RNA, 13 nt, Homo sapiens
ucaagucucucac

SEQ ID NO: 939147 - RNA, 21 nt, Homo sapiens
ucaauaaaaguaaagacugua

SEQ ID NO: 939148 - RNA, 18 nt, Homo sapiens
ucaauaauauauuuucug

SEQ ID NO: 939149 - RNA, 12 nt, Homo sapiens
ucaauagcuguc

SEQ ID NO: 939150 - RNA, 13 nt, Homo sapiens
ucacaagcaugaa

SEQ ID NO: 939151 - RNA, 19 nt, Homo sapiens
ucacaagcaugaagugcug

SEQ ID NO: 939152 - RNA, 14 nt, Homo sapiens
ucacacaugccacu

SEQ ID NO: 939153 - RNA, 19 nt, Homo sapiens
ucacacaugccacuaugag

SEQ ID NO: 939154 - RNA, 19 nt, Homo sapiens
ucacagcuaagaugccaug

SEQ ID NO: 939155 - RNA, 20 nt, Homo sapiens
uguggaggcuaucaacaaag

SEQ ID NO: 939156 - RNA, 15 nt, Homo sapiens
uguggucccagauac

SEQ ID NO: 939157 - RNA, 13 nt, Homo sapiens
uguguucugucac

SEQ ID NO: 939158 - RNA, 18 nt, Homo sapiens
uguguucugucaccaacu

SEQ ID NO: 939159 - RNA, 22 nt, Homo sapiens
uguguuuuuaagauuaguugaa

SEQ ID NO: 939160 - RNA, 13 nt, Homo sapiens
uguuaacacucau

SEQ ID NO: 939161 - RNA, 22 nt, Homo sapiens
uguuauuuaaugagucagucaa

SEQ ID NO: 939162 - RNA, 18 nt, Homo sapiens
uguucccauuuuugcuua

SEQ ID NO: 939163 - RNA, 18 nt, Homo sapiens
uguuccuuauauuuacuc

SEQ ID NO: 939164 - RNA, 18 nt, Homo sapiens
uguuguagguuucaggga

SEQ ID NO: 939165 - RNA, 17 nt, Homo sapiens
uguuucaguucagauaa

SEQ ID NO: 939166 - RNA, 19 nt, Homo sapiens
uguuucgaguaaacuugaa

SEQ ID NO: 939167 - RNA, 21 nt, Homo sapiens
uguuucuuucucugaggacaa

SEQ ID NO: 939168 - RNA, 20 nt, Homo sapiens
uguuuuacccuauacaucca

SEQ ID NO: 939169 - RNA, 17 nt, Homo sapiens
uguuuuccccaguugua

SEQ ID NO: 939170 - RNA, 19 nt, Homo sapiens
uuaaaaaaauuacugugaa

SEQ ID NO: 939171 - RNA, 13 nt, Homo sapiens
uuaaaaagcaaaa

SEQ ID NO: 939172 - RNA, 16 nt, Homo sapiens
uuaaaaagcacagggg

SEQ ID NO: 939173 - RNA, 16 nt, Homo sapiens
uuaaaaaguuagccag

SEQ ID NO: 939174 - RNA, 13 nt, Homo sapiens
uuaaaauucaauu

SEQ ID NO: 939175 - RNA, 15 nt, Homo sapiens
uuaaaauucaauuag

SEQ ID NO: 939176 - RNA, 15 nt, Homo sapiens
uuaaagaauaugacu

SEQ ID NO: 939177 - RNA, 19 nt, Homo sapiens
uuaaagcauauuggugcua

SEQ ID NO: 939178 - RNA, 14 nt, Homo sapiens
uuaaagccuccuca

SEQ ID NO: 939179 - RNA, 16 nt, Homo sapiens
uuaaauaaaagcacaa

SEQ ID NO: 939180 - RNA, 19 nt, Homo sapiens
uuaaauuauuuuuguucau

SEQ ID NO: 939181 - RNA, 23 nt, Homo sapiens
uuaaccucugcuuuuaucucaga

SEQ ID NO: 939182 - RNA, 19 nt, Homo sapiens
uuaagauccacaaaugaag

SEQ ID NO: 939183 - RNA, 13 nt, Homo sapiens
uuaaguggcagaa

SEQ ID NO: 939184 - RNA, 20 nt, Homo sapiens
uuaauaauaaagcuaccauu

SEQ ID NO: 939185 - RNA, 12 nt, Homo sapiens
uuaauccagcug

SEQ ID NO: 939186 - RNA, 19 nt, Homo sapiens
uuaaugaucagcuauauac

SEQ ID NO: 939187 - RNA, 13 nt, Homo sapiens
uuaauuaagcaaa

SEQ ID NO: 939188 - RNA, 22 nt, Homo sapiens
uuacacuuuuuggaagugaaaa

SEQ ID NO: 939189 - RNA, 17 nt, Homo sapiens
uuacaugaagcuguaua

SEQ ID NO: 939190 - RNA, 18 nt, Homo sapiens
uuacauuucauacaacag

SEQ ID NO: 939191 - RNA, 19 nt, Homo sapiens
uuacuacagcuucagugau

SEQ ID NO: 939192 - RNA, 12 nt, Homo sapiens
uuacugugaauu

SEQ ID NO: 939193 - RNA, 13 nt, Homo sapiens
uuacugugauuca

SEQ ID NO: 939194 - RNA, 17 nt, Homo sapiens
uuagaaauucagcauuu

SEQ ID NO: 939195 - RNA, 21 nt, Homo sapiens
uuagaauaguguucugcaaaa

SEQ ID NO: 939196 - RNA, 19 nt, Homo sapiens
uuagccaaucuuucuagau

SEQ ID NO: 939197 - RNA, 23 nt, Homo sapiens
uuagccagagaugcaauauaucc

SEQ ID NO: 939198 - RNA, 15 nt, Homo sapiens
uuagucaaucacugc

SEQ ID NO: 939199 - RNA, 18 nt, Homo sapiens
uuauaauaaauauauaca

SEQ ID NO: 939200 - RNA, 21 nt, Homo sapiens
uuauccaccaagaacauaaga

SEQ ID NO: 939201 - RNA, 18 nt, Homo sapiens
uuaugaugccacuuuucu

SEQ ID NO: 939202 - RNA, 20 nt, Homo sapiens
uuauguaugaaaauuauucu

SEQ ID NO: 939203 - RNA, 14 nt, Homo sapiens
uuauuaaauacaaa

SEQ ID NO: 939204 - RNA, 13 nt, Homo sapiens
uuauuacauguaa

SEQ ID NO: 939205 - RNA, 19 nt, Homo sapiens
uuauuacauguaauuugau

SEQ ID NO: 939206 - RNA, 17 nt, Homo sapiens
uuauuccuuucagcaau

SEQ ID NO: 939207 - RNA, 20 nt, Homo sapiens
uucaaagauuuuuauuuuga

SEQ ID NO: 939208 - RNA, 20 nt, Homo sapiens
uucaaccugguggcaccaga

SEQ ID NO: 939209 - RNA, 16 nt, Homo sapiens
uucaaucauaauaccu

SEQ ID NO: 939210 - RNA, 19 nt, Homo sapiens
uucacaugaugcacuucaa

SEQ ID NO: 939211 - RNA, 15 nt, Homo sapiens
uucagagaacccacu

SEQ ID NO: 939212 - RNA, 16 nt, Homo sapiens
uucagcagagcugaaa

SEQ ID NO: 939213 - RNA, 16 nt, Homo sapiens
uucaggacaacacuuc

SEQ ID NO: 939214 - RNA, 17 nt, Homo sapiens
uucauauuucauauuca

SEQ ID NO: 939215 - RNA, 17 nt, Homo sapiens
uucauguaaagugucag

SEQ ID NO: 939216 - RNA, 18 nt, Homo sapiens
uucaugugcugccugcaa

SEQ ID NO: 939217 - RNA, 17 nt, Homo sapiens
uucauucagcuaacaaa

SEQ ID NO: 939218 - RNA, 16 nt, Homo sapiens
uucauugagaaacugg

SEQ ID NO: 939219 - RNA, 18 nt, Homo sapiens
uucauuguguuaccugua

SEQ ID NO: 939220 - RNA, 14 nt, Homo sapiens
uuccaaucaugaaa

SEQ ID NO: 939221 - RNA, 19 nt, Homo sapiens
uuccaccaaaugugcuuug

SEQ ID NO: 939222 - RNA, 22 nt, Homo sapiens
uuccaucacaagaaagucauua

SEQ ID NO: 939223 - RNA, 21 nt, Homo sapiens
uuccauuaaguacaugugcca

SEQ ID NO: 939224 - RNA, 18 nt, Homo sapiens
uucccaagcgucaucugu

SEQ ID NO: 939225 - RNA, 17 nt, Homo sapiens
uucccccugcaaaaaga

SEQ ID NO: 939226 - RNA, 12 nt, Homo sapiens
uuccccucugcu

SEQ ID NO: 939227 - RNA, 13 nt, Homo sapiens
uucccuacuccau

SEQ ID NO: 939228 - RNA, 22 nt, Homo sapiens
uucccucucccggcaacaucuc

SEQ ID NO: 939229 - RNA, 15 nt, Homo sapiens
uucccuuugugcaca

SEQ ID NO: 939230 - RNA, 20 nt, Homo sapiens
uuccucccaggaagcccagg

SEQ ID NO: 939231 - RNA, 16 nt, Homo sapiens
uuccucccccaguucc

SEQ ID NO: 939232 - RNA, 21 nt, Homo sapiens
uuccucccccaguuccuccca

SEQ ID NO: 939233 - RNA, 18 nt, Homo sapiens
uuccuguugaaugacaaa

SEQ ID NO: 939234 - RNA, 18 nt, Homo sapiens
uuccuuaauccagcugau

SEQ ID NO: 939235 - RNA, 22 nt, Homo sapiens
uuccuucuguacuaaaguauug

SEQ ID NO: 939236 - RNA, 14 nt, Homo sapiens
uucggauuugccau

SEQ ID NO: 939237 - RNA, 19 nt, Homo sapiens
uucuaaacugcaucuggau

SEQ ID NO: 939238 - RNA, 11 nt, Homo sapiens
uucuaccucag

SEQ ID NO: 939239 - RNA, 23 nt, Homo sapiens
uucucuccugcuuccuccaggga

SEQ ID NO: 939240 - RNA, 16 nt, Homo sapiens
uucugauaaacacaau

SEQ ID NO: 939241 - RNA, 17 nt, Homo sapiens
uucugggcugggaacca

SEQ ID NO: 939242 - RNA, 13 nt, Homo sapiens
uucugucuuccua

SEQ ID NO: 939243 - RNA, 22 nt, Homo sapiens
uucuguuuuguuguuugauuca

SEQ ID NO: 939244 - RNA, 22 nt, Homo sapiens
uucuguuuuuaaugcuauuuga

SEQ ID NO: 939245 - RNA, 23 nt, Homo sapiens
uucuugaguugucuuuugccauu

SEQ ID NO: 939246 - RNA, 12 nt, Homo sapiens
uucuuucaggaa

SEQ ID NO: 939247 - RNA, 16 nt, Homo sapiens
uugaagcugacucaaa

SEQ ID NO: 939248 - RNA, 21 nt, Homo sapiens
uugacauaggcaauaauaagu

SEQ ID NO: 939249 - RNA, 12 nt, Homo sapiens
uugagauccaaa

SEQ ID NO: 939250 - RNA, 17 nt, Homo sapiens
uugagcucuucuuaaag

SEQ ID NO: 939251 - RNA, 16 nt, Homo sapiens
uugcaacucuguaaau

SEQ ID NO: 939252 - RNA, 18 nt, Homo sapiens
uugcaccaaagacaucag

SEQ ID NO: 939253 - RNA, 20 nt, Homo sapiens
uugcaucucuaauagagauu

SEQ ID NO: 939254 - RNA, 19 nt, Homo sapiens
uugcguuuguauauccaaa

SEQ ID NO: 939255 - RNA, 23 nt, Homo sapiens
uuggauuuuugacucuggcaaag

SEQ ID NO: 939256 - RNA, 17 nt, Homo sapiens
uuggcguuuggacccag

SEQ ID NO: 939257 - RNA, 23 nt, Homo sapiens
uugggauauccuuucacucugca

SEQ ID NO: 939258 - RNA, 14 nt, Homo sapiens
uuggucacauauca

SEQ ID NO: 939259 - RNA, 19 nt, Homo sapiens
uuggugugugugacaauuc

SEQ ID NO: 939260 - RNA, 14 nt, Homo sapiens
uugguuugacccag

SEQ ID NO: 939261 - RNA, 14 nt, Homo sapiens
uuguaaaagcauuu

SEQ ID NO: 939262 - RNA, 21 nt, Homo sapiens
uuguaacgacuucuccaucuc

SEQ ID NO: 939263 - RNA, 22 nt, Homo sapiens
acuuucuuaucccaugagagag

SEQ ID NO: 939264 - RNA, 22 nt, Homo sapiens
acuuugcugucaaaacuacuga

SEQ ID NO: 939265 - RNA, 17 nt, Homo sapiens
acuuuuauuuccuguau

SEQ ID NO: 939266 - RNA, 18 nt, Homo sapiens
acuuuugaggacgcuggg

SEQ ID NO: 939267 - RNA, 17 nt, Homo sapiens
agaaaagcaauacuguu

SEQ ID NO: 939268 - RNA, 12 nt, Homo sapiens
agaaacugagaa

SEQ ID NO: 939269 - RNA, 19 nt, Homo sapiens
agaaagaccaggccaaugu

SEQ ID NO: 939270 - RNA, 23 nt, Homo sapiens
agaaagcuagaggugaacuagua

SEQ ID NO: 939271 - RNA, 19 nt, Homo sapiens
agaaaggaacugcaauaau

SEQ ID NO: 939272 - RNA, 13 nt, Homo sapiens
agaaaggcucuau

SEQ ID NO: 939273 - RNA, 17 nt, Homo sapiens
agaaagguuuuauucua

SEQ ID NO: 939274 - RNA, 16 nt, Homo sapiens
agaaauacaguacugu

SEQ ID NO: 939275 - RNA, 14 nt, Homo sapiens
agaaaugucucaag

SEQ ID NO: 939276 - RNA, 16 nt, Homo sapiens
agaaauucagcauuug

SEQ ID NO: 939277 - RNA, 15 nt, Homo sapiens
agaacauuaauuaua

SEQ ID NO: 939278 - RNA, 23 nt, Homo sapiens
agaacauuuuaauucaucccaac

SEQ ID NO: 939279 - RNA, 19 nt, Homo sapiens
agaaccccugaaguauuuu

SEQ ID NO: 939280 - RNA, 15 nt, Homo sapiens
agaacguggugaccu

SEQ ID NO: 939281 - RNA, 20 nt, Homo sapiens
agaacuuccccucccuuccc

SEQ ID NO: 939282 - RNA, 18 nt, Homo sapiens
agaagcacugggugacca

SEQ ID NO: 939283 - RNA, 20 nt, Homo sapiens
agaagccacgcuguccucuc

SEQ ID NO: 939284 - RNA, 20 nt, Homo sapiens
agaagcugaggcuaguucca

SEQ ID NO: 939285 - RNA, 20 nt, Homo sapiens
agaagguuucuggagcagug

SEQ ID NO: 939286 - RNA, 22 nt, Homo sapiens
agaaguuccuagugauggcuua

SEQ ID NO: 939287 - RNA, 21 nt, Homo sapiens
agaaguuuggcugcugucaua

SEQ ID NO: 939288 - RNA, 16 nt, Homo sapiens
agacaaccuuguccca

SEQ ID NO: 939289 - RNA, 21 nt, Homo sapiens
agacaaccuugucccaaggaa

SEQ ID NO: 939290 - RNA, 14 nt, Homo sapiens
agacaauaaacccu

SEQ ID NO: 939291 - RNA, 22 nt, Homo sapiens
agacaucagucuccaacauguu

SEQ ID NO: 939292 - RNA, 18 nt, Homo sapiens
agacaucuggacacuggg

SEQ ID NO: 939293 - RNA, 15 nt, Homo sapiens
agacccccauccagc

SEQ ID NO: 939294 - RNA, 16 nt, Homo sapiens
agacccugucucaaaa

SEQ ID NO: 939295 - RNA, 22 nt, Homo sapiens
agacccuuauugcuguccugga

SEQ ID NO: 939296 - RNA, 17 nt, Homo sapiens
agaccugaauaccacuu

SEQ ID NO: 939297 - RNA, 20 nt, Homo sapiens
agacgguaccaauucagugu

SEQ ID NO: 939298 - RNA, 21 nt, Homo sapiens
agacguuccauacccccacau

SEQ ID NO: 939299 - RNA, 14 nt, Homo sapiens
agacuccaucucaa

SEQ ID NO: 939300 - RNA, 17 nt, Homo sapiens
agacucugucuaccugg

SEQ ID NO: 939301 - RNA, 14 nt, Homo sapiens
agacuggcuuuuau

SEQ ID NO: 939302 - RNA, 12 nt, Homo sapiens
agagaaagggag

SEQ ID NO: 939303 - RNA, 16 nt, Homo sapiens
agagagaggcauuuag

SEQ ID NO: 939304 - RNA, 15 nt, Homo sapiens
agagagcacagugau

SEQ ID NO: 939305 - RNA, 17 nt, Homo sapiens
agagagcaucugcaaca

SEQ ID NO: 939306 - RNA, 17 nt, Homo sapiens
agagaggaggggaccaa

SEQ ID NO: 939307 - RNA, 14 nt, Homo sapiens
agagcaucugcaac

SEQ ID NO: 939308 - RNA, 15 nt, Homo sapiens
agagcaucugcaaca

SEQ ID NO: 939309 - RNA, 15 nt, Homo sapiens
agagcaugcacaugc

SEQ ID NO: 939310 - RNA, 17 nt, Homo sapiens
agagcgaggaaaggauu

SEQ ID NO: 939311 - RNA, 13 nt, Homo sapiens
agaggaaauucuu

SEQ ID NO: 939312 - RNA, 17 nt, Homo sapiens
agaggcugccccucuca

SEQ ID NO: 939313 - RNA, 21 nt, Homo sapiens
agaggcugccccucucaccaa

SEQ ID NO: 939314 - RNA, 15 nt, Homo sapiens
agagguaacuaucaa

SEQ ID NO: 939315 - RNA, 16 nt, Homo sapiens
agaguagagaugcugg

SEQ ID NO: 939316 - RNA, 18 nt, Homo sapiens
agagucagcauggagagc

SEQ ID NO: 939317 - RNA, 22 nt, Homo sapiens
agagucuaauagucuuugccag

SEQ ID NO: 939318 - RNA, 19 nt, Homo sapiens
agagugcuccuguauugaa

SEQ ID NO: 939319 - RNA, 19 nt, Homo sapiens
agaguuggagacucagcau

SEQ ID NO: 939320 - RNA, 20 nt, Homo sapiens
agauaacuguaaaugugaca

SEQ ID NO: 939321 - RNA, 22 nt, Homo sapiens
agauaaguuugcaguuggcuaa

SEQ ID NO: 939322 - RNA, 13 nt, Homo sapiens
agauaauuggcaa

SEQ ID NO: 939323 - RNA, 14 nt, Homo sapiens
agauaauuggcaac

SEQ ID NO: 939324 - RNA, 14 nt, Homo sapiens
agaucaacaauacc

SEQ ID NO: 939325 - RNA, 11 nt, Homo sapiens
agaucaugcca

SEQ ID NO: 939326 - RNA, 14 nt, Homo sapiens
agaugacaaaccau

SEQ ID NO: 939327 - RNA, 20 nt, Homo sapiens
agaugccucgcucuuuucaa

SEQ ID NO: 939328 - RNA, 13 nt, Homo sapiens
agauguaguuuuc

SEQ ID NO: 939329 - RNA, 17 nt, Homo sapiens
agauucagguaauacaa

SEQ ID NO: 939330 - RNA, 17 nt, Homo sapiens
agauuuaugaugcacuu

SEQ ID NO: 939331 - RNA, 18 nt, Homo sapiens
agauuucucaagaaggaa

SEQ ID NO: 939332 - RNA, 15 nt, Homo sapiens
agauuuggaugcacu

SEQ ID NO: 939333 - RNA, 23 nt, Homo sapiens
agggggcccucugccucauggca

SEQ ID NO: 939334 - RNA, 22 nt, Homo sapiens
aggguaggcacgaagcaauuug

SEQ ID NO: 939335 - RNA, 16 nt, Homo sapiens
agggucuaagcaccuu

SEQ ID NO: 939336 - RNA, 15 nt, Homo sapiens
aggguuuugacacuu

SEQ ID NO: 939337 - RNA, 14 nt, Homo sapiens
agguaaaacagggc

SEQ ID NO: 939338 - RNA, 20 nt, Homo sapiens
agguccuuaggccucugaga

SEQ ID NO: 939339 - RNA, 19 nt, Homo sapiens
aggugcauagcaagugaaa

SEQ ID NO: 939340 - RNA, 20 nt, Homo sapiens
agguggaaaagcaacauuca

SEQ ID NO: 939341 - RNA, 18 nt, Homo sapiens
agguugagcucuucuuaa

SEQ ID NO: 939342 - RNA, 21 nt, Homo sapiens
agguugugcccuguggcugcc

SEQ ID NO: 939343 - RNA, 12 nt, Homo sapiens
aguaaacuugaa

SEQ ID NO: 939344 - RNA, 13 nt, Homo sapiens
aguaaacuugaaa

SEQ ID NO: 939345 - RNA, 20 nt, Homo sapiens
aguaaguuaauguauauaaa

SEQ ID NO: 939346 - RNA, 18 nt, Homo sapiens
aguaauugggaaaaaagc

SEQ ID NO: 939347 - RNA, 12 nt, Homo sapiens
aguacaucucua

SEQ ID NO: 939348 - RNA, 15 nt, Homo sapiens
aguacaucucuacua

SEQ ID NO: 939349 - RNA, 17 nt, Homo sapiens
aguacaucucuacuaaa

SEQ ID NO: 939350 - RNA, 22 nt, Homo sapiens
aguaccaccccucucuccccac

SEQ ID NO: 939351 - RNA, 21 nt, Homo sapiens
aguacccacucuggagcauuu

SEQ ID NO: 939352 - RNA, 18 nt, Homo sapiens
aguaccuacaucagucaa

SEQ ID NO: 939353 - RNA, 16 nt, Homo sapiens
aguauaaacaaaguua

SEQ ID NO: 939354 - RNA, 17 nt, Homo sapiens
aguauugucgguuaccu

SEQ ID NO: 939355 - RNA, 22 nt, Homo sapiens
aguauuuuuuaauccuaccuca

SEQ ID NO: 939356 - RNA, 16 nt, Homo sapiens
agucacagaggagcug

SEQ ID NO: 939357 - RNA, 23 nt, Homo sapiens
agucauuguuguuuuaaccuccc

SEQ ID NO: 939358 - RNA, 23 nt, Homo sapiens
agucauuuuucuggaguggaaaa

SEQ ID NO: 939359 - RNA, 17 nt, Homo sapiens
aguccaaaauacuguuc

SEQ ID NO: 939360 - RNA, 20 nt, Homo sapiens
aguccccucaccuccucuaa

SEQ ID NO: 939361 - RNA, 17 nt, Homo sapiens
aguccuuaucaccagcc

SEQ ID NO: 939362 - RNA, 16 nt, Homo sapiens
aguccuugaaucaccu

SEQ ID NO: 939363 - RNA, 15 nt, Homo sapiens
agucucucucugcca

SEQ ID NO: 939364 - RNA, 13 nt, Homo sapiens
agucuguaccuca

SEQ ID NO: 939365 - RNA, 22 nt, Homo sapiens
agucugucucuuggcuuuguca

SEQ ID NO: 939366 - RNA, 14 nt, Homo sapiens
agugaacacucagu

SEQ ID NO: 939367 - RNA, 14 nt, Homo sapiens
agugaaucuguauu

SEQ ID NO: 939368 - RNA, 18 nt, Homo sapiens
agugagccaucaucaugg

SEQ ID NO: 939369 - RNA, 15 nt, Homo sapiens
agugauucucuugcc

SEQ ID NO: 939370 - RNA, 20 nt, Homo sapiens
agugcacaggcgcaucccag

SEQ ID NO: 939371 - RNA, 21 nt, Homo sapiens
agugcacugcauuccugugcc

SEQ ID NO: 939372 - RNA, 13 nt, Homo sapiens
agugccuugcuca

SEQ ID NO: 939373 - RNA, 17 nt, Homo sapiens
gcuccuacuuucaggaa

SEQ ID NO: 939374 - RNA, 23 nt, Homo sapiens
gcuccugugucggggcugaccuc

SEQ ID NO: 939375 - RNA, 18 nt, Homo sapiens
gcuccuguucacaccaga

SEQ ID NO: 939376 - RNA, 17 nt, Homo sapiens
gcucuccugggagacaa

SEQ ID NO: 939377 - RNA, 21 nt, Homo sapiens
gcucugcaauuccccucugcu

SEQ ID NO: 939378 - RNA, 16 nt, Homo sapiens
gcucugccacuguccg

SEQ ID NO: 939379 - RNA, 18 nt, Homo sapiens
gcugaagaguaaaggaaa

SEQ ID NO: 939380 - RNA, 15 nt, Homo sapiens
gcugagauuacucug

SEQ ID NO: 939381 - RNA, 18 nt, Homo sapiens
gcugagauuacucugaaa

SEQ ID NO: 939382 - RNA, 16 nt, Homo sapiens
gcugagcaaucugacc

SEQ ID NO: 939383 - RNA, 20 nt, Homo sapiens
gcugagcaaucugacccuau

SEQ ID NO: 939384 - RNA, 21 nt, Homo sapiens
gcugaggcugaggcacuggcg

SEQ ID NO: 939385 - RNA, 20 nt, Homo sapiens
gcugcuauacacaagcaaug

SEQ ID NO: 939386 - RNA, 17 nt, Homo sapiens
gcuggaaaaaggugaau

SEQ ID NO: 939387 - RNA, 23 nt, Homo sapiens
gcuggccaaggaggcuccugggg

SEQ ID NO: 939388 - RNA, 15 nt, Homo sapiens
gcugggagcaggacu

SEQ ID NO: 939389 - RNA, 18 nt, Homo sapiens
gcugggcaugguggcgca

SEQ ID NO: 939390 - RNA, 18 nt, Homo sapiens
gcugggccauguccaaag

SEQ ID NO: 939391 - RNA, 19 nt, Homo sapiens
gcugggccauguccaaaga

SEQ ID NO: 939392 - RNA, 23 nt, Homo sapiens
gcugucucaucacauaaaaggcu

SEQ ID NO: 939393 - RNA, 14 nt, Homo sapiens
gcuuagaaauucag

SEQ ID NO: 939394 - RNA, 20 nt, Homo sapiens
gcuuagaaauucagcauuug

SEQ ID NO: 939395 - RNA, 21 nt, Homo sapiens
gcuuugucacuuuuccuuuuc

SEQ ID NO: 939396 - RNA, 15 nt, Homo sapiens
gcuuugucuacuuca

SEQ ID NO: 939397 - RNA, 15 nt, Homo sapiens
ggaaagaaauacagu

SEQ ID NO: 939398 - RNA, 17 nt, Homo sapiens
ggaaagaugauggugac

SEQ ID NO: 939399 - RNA, 22 nt, Homo sapiens
ggaaaggagggggcucaggcca

SEQ ID NO: 939400 - RNA, 23 nt, Homo sapiens
ggaaaggagggggcucaggccau

SEQ ID NO: 939401 - RNA, 22 nt, Homo sapiens
ggaaauuucaauaaccuuucac

SEQ ID NO: 939402 - RNA, 13 nt, Homo sapiens
ggaaccccuccug

SEQ ID NO: 939403 - RNA, 19 nt, Homo sapiens
ggaagcccaggagccucac

SEQ ID NO: 939404 - RNA, 20 nt, Homo sapiens
ggaagccccugggcccagua

SEQ ID NO: 939405 - RNA, 16 nt, Homo sapiens
ggaaguuuuaaucucu

SEQ ID NO: 939406 - RNA, 17 nt, Homo sapiens
ggaauauacgugcuugg

SEQ ID NO: 939407 - RNA, 13 nt, Homo sapiens
ggaaucagugaag

SEQ ID NO: 939408 - RNA, 20 nt, Homo sapiens
ggaauuacgugcucuguggg

SEQ ID NO: 939409 - RNA, 16 nt, Homo sapiens
ggacaugcccugugug

SEQ ID NO: 939410 - RNA, 18 nt, Homo sapiens
ggaccuggcgugcucaga

SEQ ID NO: 939411 - RNA, 23 nt, Homo sapiens
ggaccuggcgugcucagacccaa

SEQ ID NO: 939412 - RNA, 18 nt, Homo sapiens
ggacgccacucauuucau

SEQ ID NO: 939413 - RNA, 17 nt, Homo sapiens
ggacucagaacagucug

SEQ ID NO: 939414 - RNA, 16 nt, Homo sapiens
ggagaaaauucaauug

SEQ ID NO: 939415 - RNA, 16 nt, Homo sapiens
ggagagagccaagacg

SEQ ID NO: 939416 - RNA, 21 nt, Homo sapiens
ggagaguaugguccucagauc

SEQ ID NO: 939417 - RNA, 15 nt, Homo sapiens
ggagccucacugggg

SEQ ID NO: 939418 - RNA, 13 nt, Homo sapiens
ggagcgcuaccca

SEQ ID NO: 939419 - RNA, 14 nt, Homo sapiens
ggagcuggaccugc

SEQ ID NO: 939420 - RNA, 14 nt, Homo sapiens
ggaggaucaaagaa

SEQ ID NO: 939421 - RNA, 20 nt, Homo sapiens
ggaggcggagguugcaauga

SEQ ID NO: 939422 - RNA, 12 nt, Homo sapiens
ggaggggaccaa

SEQ ID NO: 939423 - RNA, 14 nt, Homo sapiens
ggagguugcaguga

SEQ ID NO: 939424 - RNA, 16 nt, Homo sapiens
ggagucagacauuuua

SEQ ID NO: 939425 - RNA, 20 nt, Homo sapiens
ggauauccuuucacucugca

SEQ ID NO: 939426 - RNA, 17 nt, Homo sapiens
ggauccuccacagagag

SEQ ID NO: 939427 - RNA, 12 nt, Homo sapiens
ggaucugaggga

SEQ ID NO: 939428 - RNA, 13 nt, Homo sapiens
ggaucuucccaca

SEQ ID NO: 939429 - RNA, 21 nt, Homo sapiens
ggaugauacuuggaugcagcu

SEQ ID NO: 939430 - RNA, 19 nt, Homo sapiens
ggauugacuuugcugucaa

SEQ ID NO: 939431 - RNA, 19 nt, Homo sapiens
ggauugcuugagcccagaa

SEQ ID NO: 939432 - RNA, 19 nt, Homo sapiens
ggcaacguagccugggcuc

SEQ ID NO: 939433 - RNA, 21 nt, Homo sapiens
ggcaagccugucuucagagaa

SEQ ID NO: 939434 - RNA, 11 nt, Homo sapiens
ggcacuuugaa

SEQ ID NO: 939435 - RNA, 16 nt, Homo sapiens
ggcagauauagcauua

SEQ ID NO: 939436 - RNA, 14 nt, Homo sapiens
ggcagcuuugcaaa

SEQ ID NO: 939437 - RNA, 18 nt, Homo sapiens
ggcaggaacaaacagggc

SEQ ID NO: 939438 - RNA, 14 nt, Homo sapiens
ggcaggagagucac

SEQ ID NO: 939439 - RNA, 22 nt, Homo sapiens
ggcaggcggaucaugaggucag

SEQ ID NO: 939440 - RNA, 15 nt, Homo sapiens
ggcaggcugggccau

SEQ ID NO: 939441 - RNA, 16 nt, Homo sapiens
ggcaggugaaaagggu

SEQ ID NO: 939442 - RNA, 14 nt, Homo sapiens
gugauuuacauuuc

SEQ ID NO: 939443 - RNA, 19 nt, Homo sapiens
gugauuucuuucuuugcac

SEQ ID NO: 939444 - RNA, 20 nt, Homo sapiens
gugcaagaugaaugcagauu

SEQ ID NO: 939445 - RNA, 15 nt, Homo sapiens
gugcaccugggagaa

SEQ ID NO: 939446 - RNA, 17 nt, Homo sapiens
gugcaccuguaauccca

SEQ ID NO: 939447 - RNA, 21 nt, Homo sapiens
gugcaucacggauggugcaug

SEQ ID NO: 939448 - RNA, 15 nt, Homo sapiens
gugcgcgcgugcaug

SEQ ID NO: 939449 - RNA, 18 nt, Homo sapiens
gugcguuaaauaagcaaa

SEQ ID NO: 939450 - RNA, 20 nt, Homo sapiens
gugcucgcccacaaacugau

SEQ ID NO: 939451 - RNA, 14 nt, Homo sapiens
guggaagaaggaaa

SEQ ID NO: 939452 - RNA, 22 nt, Homo sapiens
gugggcgcuugcaccacuuccg

SEQ ID NO: 939453 - RNA, 16 nt, Homo sapiens
guguaaacucaucuga

SEQ ID NO: 939454 - RNA, 20 nt, Homo sapiens
guguaagaacaacuaccuga

SEQ ID NO: 939455 - RNA, 16 nt, Homo sapiens
guguaucaugguguuc

SEQ ID NO: 939456 - RNA, 17 nt, Homo sapiens
guguauuaucacugucu

SEQ ID NO: 939457 - RNA, 19 nt, Homo sapiens
guguccccucacucuguca

SEQ ID NO: 939458 - RNA, 22 nt, Homo sapiens
gugucuuucucucucucucuuc

SEQ ID NO: 939459 - RNA, 18 nt, Homo sapiens
guguucacaacagugaaa

SEQ ID NO: 939460 - RNA, 12 nt, Homo sapiens
guguuuugccau

SEQ ID NO: 939461 - RNA, 15 nt, Homo sapiens
guuaaagaagcaauc

SEQ ID NO: 939462 - RNA, 14 nt, Homo sapiens
guuaaauaagcaaa

SEQ ID NO: 939463 - RNA, 17 nt, Homo sapiens
guuaauaaaccuuugca

SEQ ID NO: 939464 - RNA, 17 nt, Homo sapiens
guuaccucugcauggaa

SEQ ID NO: 939465 - RNA, 13 nt, Homo sapiens
guuaccuuuucau

SEQ ID NO: 939466 - RNA, 15 nt, Homo sapiens
guuagugguagaggu

SEQ ID NO: 939467 - RNA, 23 nt, Homo sapiens
guuauugguguaagguacuuuca

SEQ ID NO: 939468 - RNA, 18 nt, Homo sapiens
guuauuuaaugagucagu

SEQ ID NO: 939469 - RNA, 22 nt, Homo sapiens
guucacaccagagaaccaggcu

SEQ ID NO: 939470 - RNA, 15 nt, Homo sapiens
guucagaaagcaaua

SEQ ID NO: 939471 - RNA, 16 nt, Homo sapiens
guucauugcacuuuga

SEQ ID NO: 939472 - RNA, 20 nt, Homo sapiens
guuccacacccaaugcugcu

SEQ ID NO: 939473 - RNA, 20 nt, Homo sapiens
guuccucccaggaagcccag

SEQ ID NO: 939474 - RNA, 18 nt, Homo sapiens
guuccucccccaguuccu

SEQ ID NO: 939475 - RNA, 17 nt, Homo sapiens
guucgauuucuaccuca

SEQ ID NO: 939476 - RNA, 21 nt, Homo sapiens
guugagggcccuucacuucca

SEQ ID NO: 939477 - RNA, 15 nt, Homo sapiens
guugccucucuuuga

SEQ ID NO: 939478 - RNA, 14 nt, Homo sapiens
guuggagacucagc

SEQ ID NO: 939479 - RNA, 20 nt, Homo sapiens
guugguggcaagcugcaaag

SEQ ID NO: 939480 - RNA, 21 nt, Homo sapiens
caugaauuuuaaauaauguau

SEQ ID NO: 939481 - RNA, 17 nt, Homo sapiens
caugagauagcuauuau

SEQ ID NO: 939482 - RNA, 16 nt, Homo sapiens
caugcuacaguuauua

SEQ ID NO: 939483 - RNA, 23 nt, Homo sapiens
caugcugcuauacacaagcaaug

SEQ ID NO: 939484 - RNA, 21 nt, Homo sapiens
caugcuggccugugugauaca

SEQ ID NO: 939485 - RNA, 17 nt, Homo sapiens
cauggauaaauugcaca

SEQ ID NO: 939486 - RNA, 23 nt, Homo sapiens
cauggcccuaccagacacugcug

SEQ ID NO: 939487 - RNA, 13 nt, Homo sapiens
cauggugagcucu

SEQ ID NO: 939488 - RNA, 14 nt, Homo sapiens
cauguaauggacua

SEQ ID NO: 939489 - RNA, 17 nt, Homo sapiens
cauguacauacccuggc

SEQ ID NO: 939490 - RNA, 21 nt, Homo sapiens
cauguagcccccuggccucug

SEQ ID NO: 939491 - RNA, 21 nt, Homo sapiens
cauguaugucagaagugcaga

SEQ ID NO: 939492 - RNA, 14 nt, Homo sapiens
cauguauuuuacac

SEQ ID NO: 939493 - RNA, 17 nt, Homo sapiens
cauguauuuuacacaaa

SEQ ID NO: 939494 - RNA, 19 nt, Homo sapiens
caugugcaaaugugcuggu

SEQ ID NO: 939495 - RNA, 22 nt, Homo sapiens
caugugcaaaugugcuggucac

SEQ ID NO: 939496 - RNA, 13 nt, Homo sapiens
caugugcuaauaa

SEQ ID NO: 939497 - RNA, 19 nt, Homo sapiens
cauuaucuaguucauugaa

SEQ ID NO: 939498 - RNA, 22 nt, Homo sapiens
cauuauuuuuguuagcaaagau

SEQ ID NO: 939499 - RNA, 22 nt, Homo sapiens
cauucagugauuacugucaagg

SEQ ID NO: 939500 - RNA, 15 nt, Homo sapiens
cauucccugggccaa

SEQ ID NO: 939501 - RNA, 14 nt, Homo sapiens
cauuccuucccacc

SEQ ID NO: 939502 - RNA, 13 nt, Homo sapiens
cauuccuuuuccc

SEQ ID NO: 939503 - RNA, 16 nt, Homo sapiens
cauucgcuacuaugau

SEQ ID NO: 939504 - RNA, 17 nt, Homo sapiens
cauucuguuagauacua

SEQ ID NO: 939505 - RNA, 22 nt, Homo sapiens
cauugaagacccugucucaaaa

SEQ ID NO: 939506 - RNA, 17 nt, Homo sapiens
cauugauuuaauguaau

SEQ ID NO: 939507 - RNA, 17 nt, Homo sapiens
cauugcacaaggcagaa

SEQ ID NO: 939508 - RNA, 23 nt, Homo sapiens
cauugguucuuucauuugcuuug

SEQ ID NO: 939509 - RNA, 22 nt, Homo sapiens
cauuguagccucaaucgaguga

SEQ ID NO: 939510 - RNA, 19 nt, Homo sapiens
cauuguauguggucaugga

SEQ ID NO: 939511 - RNA, 22 nt, Homo sapiens
cauugucguauaggcauguaaa

SEQ ID NO: 939512 - RNA, 20 nt, Homo sapiens
cauuguuguuuuaaccuccc

SEQ ID NO: 939513 - RNA, 12 nt, Homo sapiens
cauuuaaaacau

SEQ ID NO: 939514 - RNA, 19 nt, Homo sapiens
cauuuaaaacauuaaaaua

SEQ ID NO: 939515 - RNA, 14 nt, Homo sapiens
cauuuaccaguaua

SEQ ID NO: 939516 - RNA, 12 nt, Homo sapiens
cauuucaucuca

SEQ ID NO: 939517 - RNA, 16 nt, Homo sapiens
cauuuccuggucagug

SEQ ID NO: 939518 - RNA, 21 nt, Homo sapiens
cauuucuucucguuuucacag

SEQ ID NO: 939519 - RNA, 15 nt, Homo sapiens
cauuuucauugauga

SEQ ID NO: 939520 - RNA, 13 nt, Homo sapiens
ccaaaacauuucu

SEQ ID NO: 939521 - RNA, 21 nt, Homo sapiens
ccaaaaugccauuuagcaaua

SEQ ID NO: 939522 - RNA, 15 nt, Homo sapiens
ccaaaauucaucugu

SEQ ID NO: 939523 - RNA, 17 nt, Homo sapiens
ccaaaccaaauuuuaau

SEQ ID NO: 939524 - RNA, 16 nt, Homo sapiens
ccaaacccaccugcua

SEQ ID NO: 939525 - RNA, 21 nt, Homo sapiens
ccaaagagaagggcacuguaa

SEQ ID NO: 939526 - RNA, 10 nt, Homo sapiens
ccaaagggac

SEQ ID NO: 939527 - RNA, 16 nt, Homo sapiens
ccaaaugaaacucaaa

SEQ ID NO: 939528 - RNA, 21 nt, Homo sapiens
ccaacaugaaaacaauucuua

SEQ ID NO: 939529 - RNA, 23 nt, Homo sapiens
ccaacgcgccucgccggaucuga

SEQ ID NO: 939530 - RNA, 16 nt, Homo sapiens
ccaacuccucaugucu

SEQ ID NO: 939531 - RNA, 14 nt, Homo sapiens
ccaaguaccaguau

SEQ ID NO: 939532 - RNA, 23 nt, Homo sapiens
ccaaguaugacaaccucuuugag

SEQ ID NO: 939533 - RNA, 13 nt, Homo sapiens
ccaauacuacuga

SEQ ID NO: 939534 - RNA, 21 nt, Homo sapiens
ccaaugacacccaugccagag

SEQ ID NO: 939535 - RNA, 24 nt, Homo sapiens
ccaauuaauuccuguuugucuaca

SEQ ID NO: 939536 - RNA, 20 nt, Homo sapiens
ccaauuuuuuaagugaaaau

SEQ ID NO: 939537 - RNA, 16 nt, Homo sapiens
ccacaccugggcauuu

SEQ ID NO: 939538 - RNA, 14 nt, Homo sapiens
ccacccccagcuca

SEQ ID NO: 939539 - RNA, 14 nt, Homo sapiens
ccacugcucgugga

SEQ ID NO: 939540 - RNA, 22 nt, Homo sapiens
ccacuuacagaucuaucuccuc

SEQ ID NO: 939541 - RNA, 14 nt, Homo sapiens
ccacuuaccucaaa

SEQ ID NO: 939542 - RNA, 22 nt, Homo sapiens
ccacuugccugugcuacaauuc

SEQ ID NO: 939543 - RNA, 20 nt, Homo sapiens
ccagaaaaccucuccugacc

SEQ ID NO: 939544 - RNA, 21 nt, Homo sapiens
ccagaaguucgagacuagccu

SEQ ID NO: 939545 - RNA, 14 nt, Homo sapiens
ccagacggucagga

SEQ ID NO: 939546 - RNA, 18 nt, Homo sapiens
ccagacucucacaugcag

SEQ ID NO: 939547 - RNA, 22 nt, Homo sapiens
ccagaguagagaugcugggacu

SEQ ID NO: 939548 - RNA, 22 nt, Homo sapiens
ccagauuggauauggacucuuu

SEQ ID NO: 939549 - RNA, 12 nt, Homo sapiens
ccagcacccucu

SEQ ID NO: 939550 - RNA, 12 nt, Homo sapiens
ccagcacuuugg

SEQ ID NO: 939551 - RNA, 17 nt, Homo sapiens
ccagccguauuuuacau

SEQ ID NO: 939552 - RNA, 20 nt, Homo sapiens
ccagccguauuuuacaugaa

SEQ ID NO: 939553 - RNA, 20 nt, Homo sapiens
ccagccugggcaacagagca

SEQ ID NO: 939554 - RNA, 15 nt, Homo sapiens
ccaggaccucuuaag

SEQ ID NO: 939555 - RNA, 18 nt, Homo sapiens
ccaggagcaggcacgggu

SEQ ID NO: 939556 - RNA, 19 nt, Homo sapiens
ccaggagcuacucaggaag

SEQ ID NO: 939557 - RNA, 22 nt, Homo sapiens
ccaggaguuugaggcugcagug

SEQ ID NO: 939558 - RNA, 14 nt, Homo sapiens
ccaggauacuggca

SEQ ID NO: 939559 - RNA, 15 nt, Homo sapiens
ccaggccugggaaug

SEQ ID NO: 939560 - RNA, 19 nt, Homo sapiens
ccagggggcccucugccuc

SEQ ID NO: 939561 - RNA, 21 nt, Homo sapiens
ccagguaugggccagcaguuu

SEQ ID NO: 939562 - RNA, 23 nt, Homo sapiens
ccagguugguggcaagcugcaaa

SEQ ID NO: 939563 - RNA, 13 nt, Homo sapiens
ccaguaaaaucaa

SEQ ID NO: 939564 - RNA, 19 nt, Homo sapiens
ccaguaaaaucaaaugugc

SEQ ID NO: 939565 - RNA, 13 nt, Homo sapiens
ccagucauugcac

SEQ ID NO: 939566 - RNA, 21 nt, Homo sapiens
ccagugggccuguggcauuca

SEQ ID NO: 939567 - RNA, 16 nt, Homo sapiens
ccauaguaccauuuau

SEQ ID NO: 939568 - RNA, 14 nt, Homo sapiens
ccauccagccagac

SEQ ID NO: 939569 - RNA, 16 nt, Homo sapiens
ccaugcugauaaacug

SEQ ID NO: 939570 - RNA, 13 nt, Homo sapiens
ccaugcugugcug

SEQ ID NO: 939571 - RNA, 16 nt, Homo sapiens
ccaugcugugcugugu

SEQ ID NO: 939572 - RNA, 20 nt, Homo sapiens
ccauggucuuuccacuuuca

SEQ ID NO: 939573 - RNA, 13 nt, Homo sapiens
ccauguccaaaga

SEQ ID NO: 939574 - RNA, 20 nt, Homo sapiens
ccauucugucuuccuaggaa

SEQ ID NO: 939575 - RNA, 12 nt, Homo sapiens
cccaaacaguga

SEQ ID NO: 939576 - RNA, 19 nt, Homo sapiens
cccaaacuggagugcagug

SEQ ID NO: 939577 - RNA, 16 nt, Homo sapiens
cccaaccuucuuguca

SEQ ID NO: 939578 - RNA, 19 nt, Homo sapiens
agaguuuguuaccuaccuu

SEQ ID NO: 939579 - RNA, 22 nt, Homo sapiens
agauaaauauugagcagaucua

SEQ ID NO: 939580 - RNA, 22 nt, Homo sapiens
agauaauuggcaacugggugaa

SEQ ID NO: 939581 - RNA, 13 nt, Homo sapiens
agaucaacagauc

SEQ ID NO: 939582 - RNA, 17 nt, Homo sapiens
agaucacgucacugcac

SEQ ID NO: 939583 - RNA, 18 nt, Homo sapiens
agaucacgucacugcacu

SEQ ID NO: 939584 - RNA, 19 nt, Homo sapiens
agaucagcgacccugagga

SEQ ID NO: 939585 - RNA, 23 nt, Homo sapiens
agaucaugccauugcauuccagc

SEQ ID NO: 939586 - RNA, 13 nt, Homo sapiens
agaugauggugac

SEQ ID NO: 939587 - RNA, 15 nt, Homo sapiens
agaugcaaccucacu

SEQ ID NO: 939588 - RNA, 17 nt, Homo sapiens
gaagaaaccguauccau

SEQ ID NO: 939589 - RNA, 16 nt, Homo sapiens
gaagaaggaaacaccg

SEQ ID NO: 939590 - RNA, 23 nt, Homo sapiens
gaagaugacgaguaacuccccuc

SEQ ID NO: 939591 - RNA, 17 nt, Homo sapiens
gaagcaacuaggaaaau

SEQ ID NO: 939592 - RNA, 18 nt, Homo sapiens
gaagcggagagagccaag

SEQ ID NO: 939593 - RNA, 17 nt, Homo sapiens
gaaggauccaucuuugu

SEQ ID NO: 939594 - RNA, 14 nt, Homo sapiens
gaaggccuucagga

SEQ ID NO: 939595 - RNA, 18 nt, Homo sapiens
gaagguuuucauuugcca

SEQ ID NO: 939596 - RNA, 18 nt, Homo sapiens
gaaguaaacagauggcac

SEQ ID NO: 939597 - RNA, 16 nt, Homo sapiens
gaagucaauaugugga

SEQ ID NO: 939598 - RNA, 17 nt, Homo sapiens
gaagugaaaacuuugua

SEQ ID NO: 939599 - RNA, 21 nt, Homo sapiens
gaagugaccuggaaucaguga

SEQ ID NO: 939600 - RNA, 18 nt, Homo sapiens
gaaguguuuguaauccca

SEQ ID NO: 939601 - RNA, 14 nt, Homo sapiens
gaauaccaccuaau

SEQ ID NO: 939602 - RNA, 13 nt, Homo sapiens
gaauagcuuuaau

SEQ ID NO: 939603 - RNA, 20 nt, Homo sapiens
gaauauccuuuaaaauuuaa

SEQ ID NO: 939604 - RNA, 22 nt, Homo sapiens
gaaucuggcaggaaucuaucca

SEQ ID NO: 939605 - RNA, 19 nt, Homo sapiens
gaaugucauagucuugaaa

SEQ ID NO: 939606 - RNA, 23 nt, Homo sapiens
gaauguguggccugcacagugaa

SEQ ID NO: 939607 - RNA, 16 nt, Homo sapiens
gaauguugcaauguga

SEQ ID NO: 939608 - RNA, 14 nt, Homo sapiens
gaauuaagcagaaa

SEQ ID NO: 939609 - RNA, 16 nt, Homo sapiens
gaauucaaacuggggc

SEQ ID NO: 939610 - RNA, 21 nt, Homo sapiens
gaauuuaaaaaaacgagcaau

SEQ ID NO: 939611 - RNA, 22 nt, Homo sapiens
gaauuuaguauuaucaaaggga

SEQ ID NO: 939612 - RNA, 13 nt, Homo sapiens
gacaacaucgcaa

SEQ ID NO: 939613 - RNA, 19 nt, Homo sapiens
gacaauguuguaguguccc

SEQ ID NO: 939614 - RNA, 18 nt, Homo sapiens
gacacccaugccagagag

SEQ ID NO: 939615 - RNA, 21 nt, Homo sapiens
gacagcacugggaaccuagcu

SEQ ID NO: 939616 - RNA, 20 nt, Homo sapiens
gacagggacaugcccugugu

SEQ ID NO: 939617 - RNA, 17 nt, Homo sapiens
gacauacuuaaugcaua

SEQ ID NO: 939618 - RNA, 13 nt, Homo sapiens
gacaugcccugug

SEQ ID NO: 939619 - RNA, 23 nt, Homo sapiens
gacccugauaguuucccauaaca

SEQ ID NO: 939620 - RNA, 16 nt, Homo sapiens
gacccugcaagaccac

SEQ ID NO: 939621 - RNA, 17 nt, Homo sapiens
gaccuuaggccuuccuc

SEQ ID NO: 939622 - RNA, 23 nt, Homo sapiens
gaccuuuuuuuuuuuaauggcaa

SEQ ID NO: 939623 - RNA, 20 nt, Homo sapiens
gacgaagcggagagagccaa

SEQ ID NO: 939624 - RNA, 21 nt, Homo sapiens
gacgccacucauuucaucuca

SEQ ID NO: 939625 - RNA, 19 nt, Homo sapiens
gacguccucccugauccca

SEQ ID NO: 939626 - RNA, 20 nt, Homo sapiens
gacuacauuugugaacaaaa

SEQ ID NO: 939627 - RNA, 13 nt, Homo sapiens
gacuccaucucaa

SEQ ID NO: 939628 - RNA, 13 nt, Homo sapiens
gacucgggaccaa

SEQ ID NO: 939629 - RNA, 11 nt, Homo sapiens
gacugauuacc

SEQ ID NO: 939630 - RNA, 22 nt, Homo sapiens
gacugccaaaguuaggagcccu

SEQ ID NO: 939631 - RNA, 16 nt, Homo sapiens
gacuguaaaugcucca

SEQ ID NO: 939632 - RNA, 14 nt, Homo sapiens
gacuuccacuuugu

SEQ ID NO: 939633 - RNA, 18 nt, Homo sapiens
gacuuccaucugugccau

SEQ ID NO: 939634 - RNA, 16 nt, Homo sapiens
gacuugaaauucucau

SEQ ID NO: 939635 - RNA, 17 nt, Homo sapiens
gacuuugguuugaccca

SEQ ID NO: 939636 - RNA, 23 nt, Homo sapiens
gagaaaggauugauuugaacuua

SEQ ID NO: 939637 - RNA, 21 nt, Homo sapiens
gagaaagggagugcaugugcg

SEQ ID NO: 939638 - RNA, 14 nt, Homo sapiens
gagacaacagguaa

SEQ ID NO: 939639 - RNA, 16 nt, Homo sapiens
gagacuagccugggaa

SEQ ID NO: 939640 - RNA, 18 nt, Homo sapiens
gagagauuagaauaucug

SEQ ID NO: 939641 - RNA, 15 nt, Homo sapiens
gagaggaggggacca

SEQ ID NO: 939642 - RNA, 20 nt, Homo sapiens
gagaucacgucacugcacuc

SEQ ID NO: 939643 - RNA, 12 nt, Homo sapiens
gagaucaugcca

SEQ ID NO: 939644 - RNA, 22 nt, Homo sapiens
gagaugacaaaccauaacugac

SEQ ID NO: 939645 - RNA, 13 nt, Homo sapiens
gagauugcaguga

SEQ ID NO: 939646 - RNA, 16 nt, Homo sapiens
gagcacccuacaggga

SEQ ID NO: 939647 - RNA, 15 nt, Homo sapiens
gagcaucugcaacaa

SEQ ID NO: 939648 - RNA, 22 nt, Homo sapiens
gagcaucugcaacaaaaaguca

SEQ ID NO: 939649 - RNA, 14 nt, Homo sapiens
gagcaugcacaugc

SEQ ID NO: 939650 - RNA, 16 nt, Homo sapiens
gagccccagcuacccu

SEQ ID NO: 939651 - RNA, 19 nt, Homo sapiens
gagccgagaucaugccauu

SEQ ID NO: 939652 - RNA, 21 nt, Homo sapiens
gagccucacuggggcagacaa

SEQ ID NO: 939653 - RNA, 23 nt, Homo sapiens
gagccucacuggggcagacaaua

SEQ ID NO: 939654 - RNA, 20 nt, Homo sapiens
gagcucuggcuuugcaaggg

SEQ ID NO: 939655 - RNA, 22 nt, Homo sapiens
gagcugccaagagugaagggaa

SEQ ID NO: 939656 - RNA, 20 nt, Homo sapiens
gagcugcuaaacucuuucau

SEQ ID NO: 939657 - RNA, 17 nt, Homo sapiens
gagcuggaccugccugc

SEQ ID NO: 939658 - RNA, 23 nt, Homo sapiens
gagcuuggcguuuggacccaguu

SEQ ID NO: 939659 - RNA, 20 nt, Homo sapiens
gagcuugucuuuucugcuga

SEQ ID NO: 939660 - RNA, 14 nt, Homo sapiens
gaggagaaacugag

SEQ ID NO: 939661 - RNA, 23 nt, Homo sapiens
gaggagcaagguuuaaauuuguu

SEQ ID NO: 939662 - RNA, 18 nt, Homo sapiens
gaggaggggguaggugau

SEQ ID NO: 939663 - RNA, 16 nt, Homo sapiens
gaggcaggcggaucau

SEQ ID NO: 939664 - RNA, 14 nt, Homo sapiens
gaggccuuagcaau

SEQ ID NO: 939665 - RNA, 20 nt, Homo sapiens
gaggccuuagcaauaaucca

SEQ ID NO: 939666 - RNA, 17 nt, Homo sapiens
gaggcugaggcacuggc

SEQ ID NO: 939667 - RNA, 18 nt, Homo sapiens
gaggcugccccucucacc

SEQ ID NO: 939668 - RNA, 23 nt, Homo sapiens
gaggcuuucuccaggaggauuag

SEQ ID NO: 939669 - RNA, 13 nt, Homo sapiens
gaggggugcucau

SEQ ID NO: 939670 - RNA, 15 nt, Homo sapiens
gagucuuugcagaga

SEQ ID NO: 939671 - RNA, 13 nt, Homo sapiens
gaguggaaaagcu

SEQ ID NO: 939672 - RNA, 13 nt, Homo sapiens
gaguggucuucaa

SEQ ID NO: 939673 - RNA, 23 nt, Homo sapiens
gaguuuauuggaggaucaaagaa

SEQ ID NO: 939674 - RNA, 23 nt, Homo sapiens
gaguuucuggcucuugaggcauu

SEQ ID NO: 939675 - RNA, 20 nt, Homo sapiens
gauacuaacauuuucauuga

SEQ ID NO: 939676 - RNA, 17 nt, Homo sapiens
gauagcaaauggccuca

SEQ ID NO: 939677 - RNA, 18 nt, Homo sapiens
ucccuucuuucaggaaua

SEQ ID NO: 939678 - RNA, 18 nt, Homo sapiens
ucccuugggaagggcagg

SEQ ID NO: 939679 - RNA, 18 nt, Homo sapiens
uccgauuccccuguagca

SEQ ID NO: 939680 - RNA, 23 nt, Homo sapiens
uccuaaagaaaaauaucuuggcc

SEQ ID NO: 939681 - RNA, 18 nt, Homo sapiens
uccuaaguauauuaauau

SEQ ID NO: 939682 - RNA, 17 nt, Homo sapiens
uccuaccccuuugcacu

SEQ ID NO: 939683 - RNA, 16 nt, Homo sapiens
uccuaugucaccuuga

SEQ ID NO: 939684 - RNA, 20 nt, Homo sapiens
uccuauuucuccaaagccuu

SEQ ID NO: 939685 - RNA, 13 nt, Homo sapiens
uccucauguacau

SEQ ID NO: 939686 - RNA, 16 nt, Homo sapiens
uccucccccaguuccu

SEQ ID NO: 939687 - RNA, 13 nt, Homo sapiens
uccucucaucccc

SEQ ID NO: 939688 - RNA, 16 nt, Homo sapiens
uccucuguaaacuuuu

SEQ ID NO: 939689 - RNA, 12 nt, Homo sapiens
uccucugugauu

SEQ ID NO: 939690 - RNA, 23 nt, Homo sapiens
uccucuuuguaauuuaaugaaaa

SEQ ID NO: 939691 - RNA, 15 nt, Homo sapiens
uccugagcacccaga

SEQ ID NO: 939692 - RNA, 19 nt, Homo sapiens
uccugccuaagguugucua

SEQ ID NO: 939693 - RNA, 19 nt, Homo sapiens
uccugcgcucugccacugu

SEQ ID NO: 939694 - RNA, 23 nt, Homo sapiens
uccugcucucuggaggacgguca

SEQ ID NO: 939695 - RNA, 17 nt, Homo sapiens
uccuguccuaucacucu

SEQ ID NO: 939696 - RNA, 22 nt, Homo sapiens
gcucggagcggcgucccuucca

SEQ ID NO: 939697 - RNA, 19 nt, Homo sapiens
gcucugcccccucccccau

SEQ ID NO: 939698 - RNA, 18 nt, Homo sapiens
gcucuugaggcauuucca

SEQ ID NO: 939699 - RNA, 14 nt, Homo sapiens
gcugaauuaagcag

SEQ ID NO: 939700 - RNA, 15 nt, Homo sapiens
gcugaccacacuccg

SEQ ID NO: 939701 - RNA, 21 nt, Homo sapiens
gcuggagguugagcucuucuu

SEQ ID NO: 939702 - RNA, 18 nt, Homo sapiens
gcuggcaaccacuaagaa

SEQ ID NO: 939703 - RNA, 21 nt, Homo sapiens
gcuggcagagagcacagugau

SEQ ID NO: 939704 - RNA, 15 nt, Homo sapiens
gcuggccugugugau

SEQ ID NO: 939705 - RNA, 20 nt, Homo sapiens
gcuggcuggaaaaaggugaa

SEQ ID NO: 939706 - RNA, 22 nt, Homo sapiens
gcuggcuggaaaaaggugaaug

SEQ ID NO: 939707 - RNA, 13 nt, Homo sapiens
gcugggccauguc

SEQ ID NO: 939708 - RNA, 17 nt, Homo sapiens
gcugggccauguccaaa

SEQ ID NO: 939709 - RNA, 13 nt, Homo sapiens
gcuggugaauauu

SEQ ID NO: 939710 - RNA, 19 nt, Homo sapiens
gcugucaaaacuacugaca

SEQ ID NO: 939711 - RNA, 16 nt, Homo sapiens
gcugucuugugaucac

SEQ ID NO: 939712 - RNA, 21 nt, Homo sapiens
gcuuaaaaaaauuacugugaa

SEQ ID NO: 939713 - RNA, 16 nt, Homo sapiens
gcuuaacaaugcaacu

SEQ ID NO: 939714 - RNA, 23 nt, Homo sapiens
gcuuaaggagaggagaaacugag

SEQ ID NO: 939715 - RNA, 15 nt, Homo sapiens
gcuucggacaaaaua

SEQ ID NO: 939716 - RNA, 16 nt, Homo sapiens
gcuucgggcuaugcaa

SEQ ID NO: 939717 - RNA, 21 nt, Homo sapiens
gcuucucagauuucugaggaa

SEQ ID NO: 939718 - RNA, 18 nt, Homo sapiens
gcuuggggcaacagauug

SEQ ID NO: 939719 - RNA, 21 nt, Homo sapiens
gcuuguugucuccacuuguau

SEQ ID NO: 939720 - RNA, 16 nt, Homo sapiens
gcuuguuguuugcgca

SEQ ID NO: 939721 - RNA, 15 nt, Homo sapiens
gcuuuuugcuucuug

SEQ ID NO: 939722 - RNA, 21 nt, Homo sapiens
ggaaaggauuuuaccaaagca

SEQ ID NO: 939723 - RNA, 20 nt, Homo sapiens
ggaaccauguauaugagcuu

SEQ ID NO: 939724 - RNA, 13 nt, Homo sapiens
ggaacugcaauaa

SEQ ID NO: 939725 - RNA, 13 nt, Homo sapiens
ggaagcccucguc

SEQ ID NO: 939726 - RNA, 13 nt, Homo sapiens
ggaagcccugggu

SEQ ID NO: 939727 - RNA, 16 nt, Homo sapiens
ggacacuaucacucau

SEQ ID NO: 939728 - RNA, 11 nt, Homo sapiens
ggacacugggc

SEQ ID NO: 939729 - RNA, 13 nt, Homo sapiens
ggacagaaugugu

SEQ ID NO: 939730 - RNA, 17 nt, Homo sapiens
ggacauuuaaaauucaa

SEQ ID NO: 939731 - RNA, 19 nt, Homo sapiens
ggacauuuaaaauucaauu

SEQ ID NO: 939732 - RNA, 19 nt, Homo sapiens
ggacuuccaucugugccau

SEQ ID NO: 939733 - RNA, 17 nt, Homo sapiens
ggagaaaucacauaacc

SEQ ID NO: 939734 - RNA, 11 nt, Homo sapiens
ggagacucagc

SEQ ID NO: 939735 - RNA, 15 nt, Homo sapiens
ggagcgaucucagca

SEQ ID NO: 939736 - RNA, 14 nt, Homo sapiens
ggagcuacucagga

SEQ ID NO: 939737 - RNA, 21 nt, Homo sapiens
ggagcugccuuggcucagaca

SEQ ID NO: 939738 - RNA, 14 nt, Homo sapiens
ggagggagcucuga

SEQ ID NO: 939739 - RNA, 15 nt, Homo sapiens
ggauccuccacagag

SEQ ID NO: 939740 - RNA, 19 nt, Homo sapiens
ggaugcugggcucuguucu

SEQ ID NO: 939741 - RNA, 18 nt, Homo sapiens
ggauggccaaacccaaga

SEQ ID NO: 939742 - RNA, 17 nt, Homo sapiens
ggauuuuaccaaagcau

SEQ ID NO: 939743 - RNA, 20 nt, Homo sapiens
ggcaacagagcaagacucca

SEQ ID NO: 939744 - RNA, 16 nt, Homo sapiens
ggcaacagauugaaaa

SEQ ID NO: 939745 - RNA, 17 nt, Homo sapiens
ggcaacagauugaaaag

SEQ ID NO: 939746 - RNA, 22 nt, Homo sapiens
ggcacauacaccucgucaagag

SEQ ID NO: 939747 - RNA, 17 nt, Homo sapiens
ggcacuugaugugaugu

SEQ ID NO: 939748 - RNA, 23 nt, Homo sapiens
ggcagcccagcccuccucuguca

SEQ ID NO: 939749 - RNA, 22 nt, Homo sapiens
ggcaggaaucuauccauugaac

SEQ ID NO: 939750 - RNA, 20 nt, Homo sapiens
ggcaggagaaucucuugaac

SEQ ID NO: 939751 - RNA, 13 nt, Homo sapiens
ggcaggaugcuga

SEQ ID NO: 939752 - RNA, 21 nt, Homo sapiens
ggcaggcuuagagucaggcau

SEQ ID NO: 939753 - RNA, 21 nt, Homo sapiens
ggcagggaauggggacggugu

SEQ ID NO: 939754 - RNA, 24 nt, Homo sapiens
ggcaggugaaaaggguacagaugu

SEQ ID NO: 939755 - RNA, 22 nt, Homo sapiens
ggcaucuauuuccucugugcaa

SEQ ID NO: 939756 - RNA, 21 nt, Homo sapiens
ggcauucauauuucauauuca

SEQ ID NO: 939757 - RNA, 12 nt, Homo sapiens
ggcauugcucag

SEQ ID NO: 939758 - RNA, 23 nt, Homo sapiens
ggcccccaaugacacccaugcca

SEQ ID NO: 939759 - RNA, 21 nt, Homo sapiens
ggcccuaccagacacugcugc

SEQ ID NO: 939760 - RNA, 15 nt, Homo sapiens
ggcccuucacuucca

SEQ ID NO: 939761 - RNA, 23 nt, Homo sapiens
ggccuggaauuugggcagauaua

SEQ ID NO: 939762 - RNA, 20 nt, Homo sapiens
ggccuucugguuuuaggaaa

SEQ ID NO: 939763 - RNA, 21 nt, Homo sapiens
ggccuuggcaggcugcuggaa

SEQ ID NO: 939764 - RNA, 17 nt, Homo sapiens
ggcgaggagagggcgcu

SEQ ID NO: 939765 - RNA, 17 nt, Homo sapiens
ggcuccugcuuccccau

SEQ ID NO: 939766 - RNA, 18 nt, Homo sapiens
ggcugccccucucaccaa

SEQ ID NO: 939767 - RNA, 22 nt, Homo sapiens
ggcugcuaacaagucaccaaaa

SEQ ID NO: 939768 - RNA, 21 nt, Homo sapiens
ggcuucauugagaaacuggga

SEQ ID NO: 939769 - RNA, 12 nt, Homo sapiens
ggcuugaugucc

SEQ ID NO: 939770 - RNA, 18 nt, Homo sapiens
gggaaaggaaucagagag

SEQ ID NO: 939771 - RNA, 18 nt, Homo sapiens
gggaagagacagcccagg

SEQ ID NO: 939772 - RNA, 12 nt, Homo sapiens
gggaauggggac

SEQ ID NO: 939773 - RNA, 15 nt, Homo sapiens
gggacugagcccaug

SEQ ID NO: 939774 - RNA, 18 nt, Homo sapiens
gggacugagcccaugaca

SEQ ID NO: 939775 - RNA, 21 nt, Homo sapiens
gggagagagccaagcccugug

SEQ ID NO: 939776 - RNA, 18 nt, Homo sapiens
gggagcgacacuugaaug

SEQ ID NO: 939777 - RNA, 14 nt, Homo sapiens
gggcaacuguagaa

SEQ ID NO: 939778 - RNA, 22 nt, Homo sapiens
gggcuccugcuuccccaucccg

SEQ ID NO: 939779 - RNA, 23 nt, Homo sapiens
ggggaaaagaagcacccagaccc

SEQ ID NO: 939780 - RNA, 18 nt, Homo sapiens
ggggcaggcugggccaug

SEQ ID NO: 939781 - RNA, 17 nt, Homo sapiens
ggggguuuuuaaucuuu

SEQ ID NO: 939782 - RNA, 15 nt, Homo sapiens
ggguacagaugugcu

SEQ ID NO: 939783 - RNA, 24 nt, Homo sapiens
uggggcaggcugggccauguccaa

SEQ ID NO: 939784 - RNA, 16 nt, Homo sapiens
uggggccaacuggaac

SEQ ID NO: 939785 - RNA, 18 nt, Homo sapiens
uggggccuccagaacuca

SEQ ID NO: 939786 - RNA, 22 nt, Homo sapiens
uggggccucuccuacuaugcaa

SEQ ID NO: 939787 - RNA, 18 nt, Homo sapiens
uggggcuccugcuucccc

SEQ ID NO: 939788 - RNA, 17 nt, Homo sapiens
ugggucuaggacacagu

SEQ ID NO: 939789 - RNA, 15 nt, Homo sapiens
uggguuaaguauuau

SEQ ID NO: 939790 - RNA, 20 nt, Homo sapiens
ugguacuccacauauuucag

SEQ ID NO: 939791 - RNA, 18 nt, Homo sapiens
ugguacuguagcagggga

SEQ ID NO: 939792 - RNA, 22 nt, Homo sapiens
ugguaucauuuucuagcaauaa

SEQ ID NO: 939793 - RNA, 21 nt, Homo sapiens
uggucauuggccgacaucaca

SEQ ID NO: 939794 - RNA, 20 nt, Homo sapiens
uggucuaagguucagccuga

SEQ ID NO: 939795 - RNA, 22 nt, Homo sapiens
uggucuaagguucagccugaaa

SEQ ID NO: 939796 - RNA, 21 nt, Homo sapiens
uggucuucaagacgacagcuc

SEQ ID NO: 939797 - RNA, 20 nt, Homo sapiens
uggugagcucugggaagugu

SEQ ID NO: 939798 - RNA, 17 nt, Homo sapiens
ugguggcauuguuuaca

SEQ ID NO: 939799 - RNA, 17 nt, Homo sapiens
ugguuugacucaucuua

SEQ ID NO: 939800 - RNA, 13 nt, Homo sapiens
uguaaaagggcuc

SEQ ID NO: 939801 - RNA, 23 nt, Homo sapiens
uguaaagauguucuggauaccau

SEQ ID NO: 939802 - RNA, 16 nt, Homo sapiens
uguaaauguaaacuca

SEQ ID NO: 939803 - RNA, 19 nt, Homo sapiens
uucccuacuccaugggcug

SEQ ID NO: 939804 - RNA, 23 nt, Homo sapiens
uucccuucuuucaggaauacuug

SEQ ID NO: 939805 - RNA, 19 nt, Homo sapiens
uuccucccccaguuccucc

SEQ ID NO: 939806 - RNA, 13 nt, Homo sapiens
uuccugggaacau

SEQ ID NO: 939807 - RNA, 22 nt, Homo sapiens
uuccuggggaaaagaagcaccc

SEQ ID NO: 939808 - RNA, 15 nt, Homo sapiens
uuccuggguuuccug

SEQ ID NO: 939809 - RNA, 18 nt, Homo sapiens
uuccuggguuuccugcag

SEQ ID NO: 939810 - RNA, 16 nt, Homo sapiens
uucgauuucuaccuca

SEQ ID NO: 939811 - RNA, 17 nt, Homo sapiens
uucggacaaaauaucuc

SEQ ID NO: 939812 - RNA, 21 nt, Homo sapiens
uucguuuuuuuaaaucacaag

SEQ ID NO: 939813 - RNA, 21 nt, Homo sapiens
uucuaaaggaaaucaaaugaa

SEQ ID NO: 939814 - RNA, 21 nt, Homo sapiens
uucuaaaucaaaccaggugca

SEQ ID NO: 939815 - RNA, 15 nt, Homo sapiens
uucuaauuaaccuua

SEQ ID NO: 939816 - RNA, 13 nt, Homo sapiens
uucuacagauauu

SEQ ID NO: 939817 - RNA, 14 nt, Homo sapiens
uucuaggauagcua

SEQ ID NO: 939818 - RNA, 13 nt, Homo sapiens
uucuauugggaua

SEQ ID NO: 939819 - RNA, 21 nt, Homo sapiens
uucucaucaguaguucacaua

SEQ ID NO: 939820 - RNA, 23 nt, Homo sapiens
uucugcaacaucuuaagauccac

SEQ ID NO: 939821 - RNA, 17 nt, Homo sapiens
uucuggugucugcucag

SEQ ID NO: 939822 - RNA, 10 nt, Homo sapiens
uucugucacc

SEQ ID NO: 939823 - RNA, 16 nt, Homo sapiens
uucuuaucccaugaga

SEQ ID NO: 939824 - RNA, 16 nt, Homo sapiens
uucuuugcaccaaaga

SEQ ID NO: 939825 - RNA, 18 nt, Homo sapiens
uugacaauugggagcugc

SEQ ID NO: 939826 - RNA, 16 nt, Homo sapiens
uugaccaaguaugaca

SEQ ID NO: 939827 - RNA, 14 nt, Homo sapiens
uugacuuucuaauu

SEQ ID NO: 939828 - RNA, 19 nt, Homo sapiens
uugaggcauuuccagacuu

SEQ ID NO: 939829 - RNA, 21 nt, Homo sapiens
uugaggcugcagugagccauc

SEQ ID NO: 939830 - RNA, 23 nt, Homo sapiens
uugauaagcuauugucuguaaua

SEQ ID NO: 939831 - RNA, 13 nt, Homo sapiens
uugauuugcucuu

SEQ ID NO: 939832 - RNA, 20 nt, Homo sapiens
uugauuugcucuuacuacag

SEQ ID NO: 939833 - RNA, 22 nt, Homo sapiens
uugauuuuuuaauuucuaugaa

SEQ ID NO: 939834 - RNA, 20 nt, Homo sapiens
uugcagagaaccucagauca

SEQ ID NO: 939835 - RNA, 20 nt, Homo sapiens
uugccuauuugcugaccaca

SEQ ID NO: 939836 - RNA, 12 nt, Homo sapiens
uugcuacauucu

SEQ ID NO: 939837 - RNA, 20 nt, Homo sapiens
uugcuaggaggccuuagcaa

SEQ ID NO: 939838 - RNA, 13 nt, Homo sapiens
uugcugugaauua

SEQ ID NO: 939839 - RNA, 21 nt, Homo sapiens
uugcuuuccugcaucucugug

SEQ ID NO: 939840 - RNA, 20 nt, Homo sapiens
uuggaagugaaaacuuugua

SEQ ID NO: 939841 - RNA, 15 nt, Homo sapiens
uuggaggaucaaaga

SEQ ID NO: 939842 - RNA, 13 nt, Homo sapiens
uugggacucagga

SEQ ID NO: 939843 - RNA, 18 nt, Homo sapiens
uugggaggauacagagga

SEQ ID NO: 939844 - RNA, 16 nt, Homo sapiens
uuggggcuuuacauac

SEQ ID NO: 939845 - RNA, 21 nt, Homo sapiens
uuggugaaacuacaucuccaa

SEQ ID NO: 939846 - RNA, 15 nt, Homo sapiens
uuguaaauaggauuu

SEQ ID NO: 939847 - RNA, 16 nt, Homo sapiens
uuguaacuucaaauau

SEQ ID NO: 939848 - RNA, 18 nt, Homo sapiens
uugucuaaacaaugcuga

SEQ ID NO: 939849 - RNA, 20 nt, Homo sapiens
uugugacaggaaagcccucc

SEQ ID NO: 939850 - RNA, 20 nt, Homo sapiens
uugugcugugggcagcaccc

SEQ ID NO: 939851 - RNA, 16 nt, Homo sapiens
uugugucagauuacca

SEQ ID NO: 939852 - RNA, 11 nt, Homo sapiens
uuguucaauua

SEQ ID NO: 939853 - RNA, 23 nt, Homo sapiens
uuguuccagcaguuuucaaguca

SEQ ID NO: 939854 - RNA, 17 nt, Homo sapiens
uuguucgggugugcaau

SEQ ID NO: 939855 - RNA, 10 nt, Homo sapiens
uuguucugua

SEQ ID NO: 939856 - RNA, 15 nt, Homo sapiens
uuguuggaugaaauu

SEQ ID NO: 939857 - RNA, 12 nt, Homo sapiens
uuguuugcuuac

SEQ ID NO: 939858 - RNA, 14 nt, Homo sapiens
uuguuuggugaauu

SEQ ID NO: 939859 - RNA, 14 nt, Homo sapiens
uuguuuuuguacag

SEQ ID NO: 939860 - RNA, 14 nt, Homo sapiens
uuuaaagccuccuc

SEQ ID NO: 939861 - RNA, 12 nt, Homo sapiens
uuuaaaguugau

SEQ ID NO: 939862 - RNA, 17 nt, Homo sapiens
uuuaaauaaaagcacaa

SEQ ID NO: 939863 - RNA, 18 nt, Homo sapiens
uuuaaauaaaagcacaag

SEQ ID NO: 939864 - RNA, 14 nt, Homo sapiens
uuuaacagcugaau

SEQ ID NO: 939865 - RNA, 13 nt, Homo sapiens
uuuaacuuugaaa

SEQ ID NO: 939866 - RNA, 18 nt, Homo sapiens
uuuaagcuuuccuguuga

SEQ ID NO: 939867 - RNA, 13 nt, Homo sapiens
uuuaagguacuga

SEQ ID NO: 939868 - RNA, 21 nt, Homo sapiens
uuuaagguacugaagcuuuau

SEQ ID NO: 939869 - RNA, 21 nt, Homo sapiens
uuuaaguggcauuucuaugca

SEQ ID NO: 939870 - RNA, 19 nt, Homo sapiens
uuuaaucucuaacagugga

SEQ ID NO: 939871 - RNA, 17 nt, Homo sapiens
uuuaaugagucagucaa

SEQ ID NO: 939872 - RNA, 21 nt, Homo sapiens
uuuaauuuugucagauucaca

SEQ ID NO: 939873 - RNA, 16 nt, Homo sapiens
uuuacauuucauacaa

SEQ ID NO: 939874 - RNA, 20 nt, Homo sapiens
uuuacccuauacauccacag

SEQ ID NO: 939875 - RNA, 17 nt, Homo sapiens
uuuaccuucaaacuuua

SEQ ID NO: 939876 - RNA, 14 nt, Homo sapiens
uuuagaacaccaaa

SEQ ID NO: 939877 - RNA, 21 nt, Homo sapiens
uuuauaacuauuauauuauca

SEQ ID NO: 939878 - RNA, 17 nt, Homo sapiens
uuuauaggcauaccucc

SEQ ID NO: 939879 - RNA, 19 nt, Homo sapiens
uuuauaggcauaccuccua

SEQ ID NO: 939880 - RNA, 18 nt, Homo sapiens
uuuaucuguuuccugaca

SEQ ID NO: 939881 - RNA, 17 nt, Homo sapiens
uuuauuaugcaaccagu

SEQ ID NO: 939882 - RNA, 17 nt, Homo sapiens
uuuauuguuuucaacuc

SEQ ID NO: 939883 - RNA, 13 nt, Homo sapiens
uuucaaguucaau

SEQ ID NO: 939884 - RNA, 16 nt, Homo sapiens
uuucacauucuuggcu

SEQ ID NO: 939885 - RNA, 15 nt, Homo sapiens
uuucagcaauccaug

SEQ ID NO: 939886 - RNA, 13 nt, Homo sapiens
uuucauacaacag

SEQ ID NO: 939887 - RNA, 15 nt, Homo sapiens
uuuccacuccauugu

SEQ ID NO: 939888 - RNA, 17 nt, Homo sapiens
uuuccaucucugguaaa

SEQ ID NO: 939889 - RNA, 15 nt, Homo sapiens
uaaaaaaauuacugu

SEQ ID NO: 939890 - RNA, 17 nt, Homo sapiens
uaaaaaaauuacuguga

SEQ ID NO: 939891 - RNA, 17 nt, Homo sapiens
uaaaagcacaaguacuu

SEQ ID NO: 939892 - RNA, 13 nt, Homo sapiens
uaaaagcauuuug

SEQ ID NO: 939893 - RNA, 18 nt, Homo sapiens
uaaaagccaaccuucaaa

SEQ ID NO: 939894 - RNA, 16 nt, Homo sapiens
uaaaaggcuucacuuu

SEQ ID NO: 939895 - RNA, 19 nt, Homo sapiens
uaaaauauaaucucuauaa

SEQ ID NO: 939896 - RNA, 18 nt, Homo sapiens
uaaaauauuuaucugauu

SEQ ID NO: 939897 - RNA, 22 nt, Homo sapiens
uaaaauauuuaucugauuaagu

SEQ ID NO: 939898 - RNA, 16 nt, Homo sapiens
uaaaauggaagcaauu

SEQ ID NO: 939899 - RNA, 19 nt, Homo sapiens
uaaacagauggcacuuuga

SEQ ID NO: 939900 - RNA, 20 nt, Homo sapiens
uaaacagauggcacuuugaa

SEQ ID NO: 939901 - RNA, 18 nt, Homo sapiens
uaaacagccucuuuuuga

SEQ ID NO: 939902 - RNA, 15 nt, Homo sapiens
uaaacgggaacaugc

SEQ ID NO: 939903 - RNA, 12 nt, Homo sapiens
uaaagaauacac

SEQ ID NO: 939904 - RNA, 23 nt, Homo sapiens
uaaagagccuucacugguucugc

SEQ ID NO: 939905 - RNA, 18 nt, Homo sapiens
uaaagcauauuggugcua

SEQ ID NO: 939906 - RNA, 19 nt, Homo sapiens
uaaagcauauuggugcuag

SEQ ID NO: 939907 - RNA, 16 nt, Homo sapiens
uaaauaaaagcacaag

SEQ ID NO: 939908 - RNA, 14 nt, Homo sapiens
uaaauauugucaua

SEQ ID NO: 939909 - RNA, 22 nt, Homo sapiens
uaaauauuuauuuaacuauuca

SEQ ID NO: 939910 - RNA, 20 nt, Homo sapiens
uaaaugugacauugauuugc

SEQ ID NO: 939911 - RNA, 12 nt, Homo sapiens
uaaauugcacac

SEQ ID NO: 939912 - RNA, 17 nt, Homo sapiens
gcucgcccacaaacuga

SEQ ID NO: 939913 - RNA, 10 nt, Homo sapiens
gcucugggaa

SEQ ID NO: 939914 - RNA, 22 nt, Homo sapiens
gcucuugaccaaguaugacaac

SEQ ID NO: 939915 - RNA, 17 nt, Homo sapiens
gcugaacaauaggcugu

SEQ ID NO: 939916 - RNA, 22 nt, Homo sapiens
gcugacaaggcacuucauguaa

SEQ ID NO: 939917 - RNA, 21 nt, Homo sapiens
gcugagauuacucugaaaaug

SEQ ID NO: 939918 - RNA, 17 nt, Homo sapiens
gcugcagugagccauca

SEQ ID NO: 939919 - RNA, 19 nt, Homo sapiens
gcuggaccugccugcugca

SEQ ID NO: 939920 - RNA, 21 nt, Homo sapiens
gcuggagcgaagccuucugca

SEQ ID NO: 939921 - RNA, 22 nt, Homo sapiens
gcugugggcaagccuaagggau

SEQ ID NO: 939922 - RNA, 15 nt, Homo sapiens
gcuguuccuguucag

SEQ ID NO: 939923 - RNA, 12 nt, Homo sapiens
gcuuaacaguuu

SEQ ID NO: 939924 - RNA, 16 nt, Homo sapiens
gcuuggaguucucuau

SEQ ID NO: 939925 - RNA, 22 nt, Homo sapiens
ggaaagacguuuuugugcugug

SEQ ID NO: 939926 - RNA, 19 nt, Homo sapiens
ggaagacuccccugccucc

SEQ ID NO: 939927 - RNA, 22 nt, Homo sapiens
ggaagaguuuguuaccuaccuu

SEQ ID NO: 939928 - RNA, 16 nt, Homo sapiens
ggaagcccucaaagaa

SEQ ID NO: 939929 - RNA, 18 nt, Homo sapiens
ggaaggagaguauggucc

SEQ ID NO: 939930 - RNA, 15 nt, Homo sapiens
ggaagggacugccaa

SEQ ID NO: 939931 - RNA, 14 nt, Homo sapiens
ggaaguaagcaaac

SEQ ID NO: 939932 - RNA, 23 nt, Homo sapiens
ggaaucagugaagccaaagggac

SEQ ID NO: 939933 - RNA, 11 nt, Homo sapiens
ggaaugucaua

SEQ ID NO: 939934 - RNA, 10 nt, Homo sapiens
ggacaugccc

SEQ ID NO: 939935 - RNA, 12 nt, Homo sapiens
ggaccagggaug

SEQ ID NO: 939936 - RNA, 14 nt, Homo sapiens
ggacccuguccaau

SEQ ID NO: 939937 - RNA, 20 nt, Homo sapiens
ggacuggaaggggaagggac

SEQ ID NO: 939938 - RNA, 13 nt, Homo sapiens
ggacuuccaucug

SEQ ID NO: 939939 - RNA, 12 nt, Homo sapiens
ggagagagccaa

SEQ ID NO: 939940 - RNA, 23 nt, Homo sapiens
ggagaugccacuucucacucacc

SEQ ID NO: 939941 - RNA, 13 nt, Homo sapiens
ggagcaggacuga

SEQ ID NO: 939942 - RNA, 18 nt, Homo sapiens
ggagcugggugcccagua

SEQ ID NO: 939943 - RNA, 18 nt, Homo sapiens
ggagguuaggucuuagga

SEQ ID NO: 939944 - RNA, 15 nt, Homo sapiens
ggauacgacacaugc

SEQ ID NO: 939945 - RNA, 21 nt, Homo sapiens
ggaucugauaaggaucuagga

SEQ ID NO: 939946 - RNA, 17 nt, Homo sapiens
ggaugaagcccuaaaga

SEQ ID NO: 939947 - RNA, 15 nt, Homo sapiens
ggauuuuaccaaagc

SEQ ID NO: 939948 - RNA, 19 nt, Homo sapiens
ggcaacagagcaagacucc

SEQ ID NO: 939949 - RNA, 14 nt, Homo sapiens
ggcaaggaugucug

SEQ ID NO: 939950 - RNA, 21 nt, Homo sapiens
ggcagaaacacucaaguugau

SEQ ID NO: 939951 - RNA, 17 nt, Homo sapiens
ggcagacucgggaccaa

SEQ ID NO: 939952 - RNA, 21 nt, Homo sapiens
ggcaggaagggacugccaaag

SEQ ID NO: 939953 - RNA, 14 nt, Homo sapiens
ggcaucuauuuccu

SEQ ID NO: 939954 - RNA, 16 nt, Homo sapiens
ggcauucauauuucau

SEQ ID NO: 939955 - RNA, 13 nt, Homo sapiens
ggcauugcucagc

SEQ ID NO: 939956 - RNA, 21 nt, Homo sapiens
ggccacauagaugcugaugga

SEQ ID NO: 939957 - RNA, 16 nt, Homo sapiens
ggccauguccaaagag

SEQ ID NO: 939958 - RNA, 15 nt, Homo sapiens
ggcccucugccucau

SEQ ID NO: 939959 - RNA, 11 nt, Homo sapiens
ggccucaggug

SEQ ID NO: 939960 - RNA, 11 nt, Homo sapiens
ggccuccagaa

SEQ ID NO: 939961 - RNA, 19 nt, Homo sapiens
ggccucugagaagcucuga

SEQ ID NO: 939962 - RNA, 14 nt, Homo sapiens
ggccugugugauac

SEQ ID NO: 939963 - RNA, 13 nt, Homo sapiens
ggccuuguaagac

SEQ ID NO: 939964 - RNA, 19 nt, Homo sapiens
ggcgagcucuggcuuugca

SEQ ID NO: 939965 - RNA, 20 nt, Homo sapiens
ggcggagguugcaaugagcc

SEQ ID NO: 939966 - RNA, 13 nt, Homo sapiens
ggcgugggcgcuu

SEQ ID NO: 939967 - RNA, 23 nt, Homo sapiens
ggcguuuggacccaguucaguga

SEQ ID NO: 939968 - RNA, 16 nt, Homo sapiens
ggcuaucaacuuaaua

SEQ ID NO: 939969 - RNA, 20 nt, Homo sapiens
ggcucagauuguaauaugua

SEQ ID NO: 939970 - RNA, 21 nt, Homo sapiens
ggcucagccuagugaacugca

SEQ ID NO: 939971 - RNA, 14 nt, Homo sapiens
ggcuggcaugguga

SEQ ID NO: 939972 - RNA, 18 nt, Homo sapiens
ggcugugggcaagccuaa

SEQ ID NO: 939973 - RNA, 11 nt, Homo sapiens
ggcuucucacg

SEQ ID NO: 939974 - RNA, 10 nt, Homo sapiens
ggcuuggaag

SEQ ID NO: 939975 - RNA, 13 nt, Homo sapiens
gggaaacugggaa

SEQ ID NO: 939976 - RNA, 21 nt, Homo sapiens
gggaacccaacagucaugacc

SEQ ID NO: 939977 - RNA, 15 nt, Homo sapiens
gggaaguaagcaaac

SEQ ID NO: 939978 - RNA, 20 nt, Homo sapiens
gggagacacuggccccucaa

SEQ ID NO: 939979 - RNA, 13 nt, Homo sapiens
gggagcugccaag

SEQ ID NO: 939980 - RNA, 23 nt, Homo sapiens
gggaggaaaaggccccugcaaug

SEQ ID NO: 939981 - RNA, 21 nt, Homo sapiens
gggcauuccuugggacucagg

SEQ ID NO: 939982 - RNA, 14 nt, Homo sapiens
gggccauguccaaa

SEQ ID NO: 939983 - RNA, 17 nt, Homo sapiens
gggccauguccaaagag

SEQ ID NO: 939984 - RNA, 16 nt, Homo sapiens
gggcccucugccucau

SEQ ID NO: 939985 - RNA, 22 nt, Homo sapiens
gggcucccuggcaggaugcuga

SEQ ID NO: 939986 - RNA, 22 nt, Homo sapiens
gggcugacuccugcucucugga

SEQ ID NO: 939987 - RNA, 16 nt, Homo sapiens
ggggcccucugccuca

SEQ ID NO: 939988 - RNA, 13 nt, Homo sapiens
ggggccuccagaa

SEQ ID NO: 939989 - RNA, 12 nt, Homo sapiens
gggggaaggugg

SEQ ID NO: 939990 - RNA, 17 nt, Homo sapiens
ggguacagaugugcugu

SEQ ID NO: 939991 - RNA, 18 nt, Homo sapiens
gggugacccugaagugag

SEQ ID NO: 939992 - RNA, 16 nt, Homo sapiens
gguagagguggugaga

SEQ ID NO: 939993 - RNA, 21 nt, Homo sapiens
gguaucaaaauuacauauacu

SEQ ID NO: 939994 - RNA, 13 nt, Homo sapiens
ggucagcauguac

SEQ ID NO: 939995 - RNA, 20 nt, Homo sapiens
ggucaggacucagaacaguc

SEQ ID NO: 939996 - RNA, 12 nt, Homo sapiens
ggucaguccaug

SEQ ID NO: 939997 - RNA, 20 nt, Homo sapiens
gguccuaaccagugagcacu

SEQ ID NO: 939998 - RNA, 12 nt, Homo sapiens
ggucuucaagac

SEQ ID NO: 939999 - RNA, 20 nt, Homo sapiens
ggucuucaagacgacagcuc

SEQ ID NO: 940000 - RNA, 17 nt, Homo sapiens
ggucuuuccacuuucau

SEQ ID NO: 940001 - RNA, 15 nt, Homo sapiens
ggugcaggacacugg

SEQ ID NO: 940002 - RNA, 19 nt, Homo sapiens
ggugcauagcaagugaaag

SEQ ID NO: 940003 - RNA, 19 nt, Homo sapiens
ggugcaugggcucgccgug

SEQ ID NO: 940004 - RNA, 16 nt, Homo sapiens
ggugggcccccaauga

SEQ ID NO: 940005 - RNA, 22 nt, Homo sapiens
ggugggcccccaaugacaccca

SEQ ID NO: 940006 - RNA, 13 nt, Homo sapiens
gguguuuugccau

SEQ ID NO: 940007 - RNA, 20 nt, Homo sapiens
gguuagguagcaacaacaga

SEQ ID NO: 940008 - RNA, 17 nt, Homo sapiens
gguuauagcuucaggag

SEQ ID NO: 940009 - RNA, 13 nt, Homo sapiens
gguuuccugccac

SEQ ID NO: 940010 - RNA, 11 nt, Homo sapiens
guaaaauaugu

SEQ ID NO: 940011 - RNA, 18 nt, Homo sapiens
guaaaaucaaaugugcau

SEQ ID NO: 940012 - RNA, 20 nt, Homo sapiens
guaaagccuuaaguggcaga

SEQ ID NO: 940013 - RNA, 21 nt, Homo sapiens
guaaaucauguugaucaugua

SEQ ID NO: 940014 - RNA, 15 nt, Homo sapiens
guaaauguaaacuca

SEQ ID NO: 940015 - RNA, 21 nt, Homo sapiens
guaacaugaggggacauuuug

SEQ ID NO: 940016 - RNA, 13 nt, Homo sapiens
guaauagugccaa

SEQ ID NO: 940017 - RNA, 18 nt, Homo sapiens
guaauauuuuacuuugag

SEQ ID NO: 940018 - RNA, 23 nt, Homo sapiens
guaauuuaauggggucuguaaau

SEQ ID NO: 940019 - RNA, 19 nt, Homo sapiens
guacaggaaugaaccuucu

SEQ ID NO: 940020 - RNA, 17 nt, Homo sapiens
guacauugggagucugu

SEQ ID NO: 940021 - RNA, 18 nt, Homo sapiens
uagccugggcucacugug

SEQ ID NO: 940022 - RNA, 23 nt, Homo sapiens
uagccuguucuuuuaccacugac

SEQ ID NO: 940023 - RNA, 12 nt, Homo sapiens
uaggaagcccuc

SEQ ID NO: 940024 - RNA, 15 nt, Homo sapiens
uaggaggcaaagguu

SEQ ID NO: 940025 - RNA, 17 nt, Homo sapiens
uaggagggagacacugg

SEQ ID NO: 940026 - RNA, 22 nt, Homo sapiens
uaggcaccuuuuacugugaugu

SEQ ID NO: 940027 - RNA, 14 nt, Homo sapiens
uaggcauaccuccu

SEQ ID NO: 940028 - RNA, 13 nt, Homo sapiens
uagggcuguaaaa

SEQ ID NO: 940029 - RNA, 17 nt, Homo sapiens
uagguagcaacaacaga

SEQ ID NO: 940030 - RNA, 16 nt, Homo sapiens
uaggugcuaaccugga

SEQ ID NO: 940031 - RNA, 22 nt, Homo sapiens
uagucaauauuugguauuucaa

SEQ ID NO: 940032 - RNA, 21 nt, Homo sapiens
uagucuugaaaugaaagggaa

SEQ ID NO: 940033 - RNA, 13 nt, Homo sapiens
uagucuuugccag

SEQ ID NO: 940034 - RNA, 14 nt, Homo sapiens
uagugucauccuca

SEQ ID NO: 940035 - RNA, 12 nt, Homo sapiens
uagugugaauua

SEQ ID NO: 940036 - RNA, 22 nt, Homo sapiens
uauaaaugaauuugcauaccag

SEQ ID NO: 940037 - RNA, 14 nt, Homo sapiens
uauaacgucaugug

SEQ ID NO: 940038 - RNA, 22 nt, Homo sapiens
uauaaucuuguagacacuuacu

SEQ ID NO: 940039 - RNA, 17 nt, Homo sapiens
uauaauguccauaugcu

SEQ ID NO: 940040 - RNA, 16 nt, Homo sapiens
uauaauuaauugucau

SEQ ID NO: 940041 - RNA, 16 nt, Homo sapiens
uauacaaaacuuuauc

SEQ ID NO: 940042 - RNA, 18 nt, Homo sapiens
uauacucagguaccucuu

SEQ ID NO: 940043 - RNA, 16 nt, Homo sapiens
uauaguuauacaucaa

SEQ ID NO: 940044 - RNA, 19 nt, Homo sapiens
uauauuguauuaagggcau

SEQ ID NO: 940045 - RNA, 18 nt, Homo sapiens
uauauugucuaguaauug

SEQ ID NO: 940046 - RNA, 20 nt, Homo sapiens
uaucaaaacaaguacugguu

SEQ ID NO: 940047 - RNA, 15 nt, Homo sapiens
uaucaaauacauuua

SEQ ID NO: 940048 - RNA, 14 nt, Homo sapiens
uaucacacauauca

SEQ ID NO: 940049 - RNA, 13 nt, Homo sapiens
uauccaccaagaa

SEQ ID NO: 940050 - RNA, 13 nt, Homo sapiens
uauccaugcaccu

SEQ ID NO: 940051 - RNA, 18 nt, Homo sapiens
uaucccuagugcuccaua

SEQ ID NO: 940052 - RNA, 14 nt, Homo sapiens
uauccuuucacucu

SEQ ID NO: 940053 - RNA, 15 nt, Homo sapiens
uaucuaguucauuga

SEQ ID NO: 940054 - RNA, 14 nt, Homo sapiens
uaucugccauguga

SEQ ID NO: 940055 - RNA, 19 nt, Homo sapiens
uaucuuuauuaaucacuau

SEQ ID NO: 940056 - RNA, 21 nt, Homo sapiens
uaugacaaccucuuugagacg

SEQ ID NO: 940057 - RNA, 13 nt, Homo sapiens
uauuauaauccuc

SEQ ID NO: 940058 - RNA, 21 nt, Homo sapiens
uauucugggcaccacaaaaua

SEQ ID NO: 940059 - RNA, 17 nt, Homo sapiens
uauuuauggauaucaca

SEQ ID NO: 940060 - RNA, 21 nt, Homo sapiens
uauuucauauucauauuucaa

SEQ ID NO: 940061 - RNA, 21 nt, Homo sapiens
uauuuucuucuccagugguca

SEQ ID NO: 940062 - RNA, 14 nt, Homo sapiens
ucaaaaauaugugu

SEQ ID NO: 940063 - RNA, 16 nt, Homo sapiens
ucaaaacaaguacugg

SEQ ID NO: 940064 - RNA, 18 nt, Homo sapiens
ucaaaauauuucagugaa

SEQ ID NO: 940065 - RNA, 15 nt, Homo sapiens
ucaaaucguccagcg

SEQ ID NO: 940066 - RNA, 17 nt, Homo sapiens
ucaacagaucaacaaua

SEQ ID NO: 940067 - RNA, 15 nt, Homo sapiens
ucaacauuacuguua

SEQ ID NO: 940068 - RNA, 17 nt, Homo sapiens
ucaagcauuuaccaugu

SEQ ID NO: 940069 - RNA, 20 nt, Homo sapiens
ucaagcauuuaccaugugcu

SEQ ID NO: 940070 - RNA, 22 nt, Homo sapiens
ucaagcauuuaccaugugcuaa

SEQ ID NO: 940071 - RNA, 19 nt, Homo sapiens
ucaaggcaguuaauucuca

SEQ ID NO: 940072 - RNA, 15 nt, Homo sapiens
ucaaggguauuuuaa

SEQ ID NO: 940073 - RNA, 16 nt, Homo sapiens
ucaagucucucacccu

SEQ ID NO: 940074 - RNA, 14 nt, Homo sapiens
ucaauacuaccucu

SEQ ID NO: 940075 - RNA, 21 nt, Homo sapiens
ucaauauuugguauuucaaua

SEQ ID NO: 940076 - RNA, 18 nt, Homo sapiens
ucaaucauaauaccugcu

SEQ ID NO: 940077 - RNA, 15 nt, Homo sapiens
ucacacaugccacua

SEQ ID NO: 940078 - RNA, 21 nt, Homo sapiens
ucacagcaauauuuaacaauu

SEQ ID NO: 940079 - RNA, 16 nt, Homo sapiens
ucacaugaugcacuuc

SEQ ID NO: 940080 - RNA, 20 nt, Homo sapiens
ucaccaacugaaguggcuaa

SEQ ID NO: 940081 - RNA, 18 nt, Homo sapiens
ucaccagcuaucugucau

SEQ ID NO: 940082 - RNA, 14 nt, Homo sapiens
ucaccccugagcag

SEQ ID NO: 940083 - RNA, 18 nt, Homo sapiens
ucaccccugcuauaacua

SEQ ID NO: 940084 - RNA, 18 nt, Homo sapiens
ucacccuaccaacuuuac

SEQ ID NO: 940085 - RNA, 14 nt, Homo sapiens
ucacccuuugccua

SEQ ID NO: 940086 - RNA, 15 nt, Homo sapiens
ucaccuccucuguga

SEQ ID NO: 940087 - RNA, 17 nt, Homo sapiens
ucaccuccucugugauu

SEQ ID NO: 940088 - RNA, 15 nt, Homo sapiens
ucacuauuacuugaa

SEQ ID NO: 940089 - RNA, 22 nt, Homo sapiens
ucacugcacugcaugcaaacaa

SEQ ID NO: 940090 - RNA, 22 nt, Homo sapiens
ucagaaggagcuacaaaaccua

SEQ ID NO: 940091 - RNA, 20 nt, Homo sapiens
ucagaaggccccagagagac

SEQ ID NO: 940092 - RNA, 12 nt, Homo sapiens
ucagaaggugac

SEQ ID NO: 940093 - RNA, 19 nt, Homo sapiens
ucagaaggugacaaguacu

SEQ ID NO: 940094 - RNA, 20 nt, Homo sapiens
ucagagcccucaacuauucu

SEQ ID NO: 940095 - RNA, 15 nt, Homo sapiens
ucagagggaccucac

SEQ ID NO: 940096 - RNA, 17 nt, Homo sapiens
ucagaggucucugcuag

SEQ ID NO: 940097 - RNA, 23 nt, Homo sapiens
ucagaugcuguuaguaccuacau

SEQ ID NO: 940098 - RNA, 22 nt, Homo sapiens
ucagauucacacaugccacuau

SEQ ID NO: 940099 - RNA, 23 nt, Homo sapiens
ucagauugcugggaggacuggac

SEQ ID NO: 940100 - RNA, 21 nt, Homo sapiens
ucagauuuuuuccucugcauu

SEQ ID NO: 940101 - RNA, 16 nt, Homo sapiens
ucagcacccaacugag

SEQ ID NO: 940102 - RNA, 17 nt, Homo sapiens
ucagcacccaacugaga

SEQ ID NO: 940103 - RNA, 21 nt, Homo sapiens
ucagccaauccgauugccuua

SEQ ID NO: 940104 - RNA, 22 nt, Homo sapiens
ucagccacuugccugugcuaca

SEQ ID NO: 940105 - RNA, 13 nt, Homo sapiens
ucagcuauauacu

SEQ ID NO: 940106 - RNA, 20 nt, Homo sapiens
ucaggacucagaacagucug

SEQ ID NO: 940107 - RNA, 22 nt, Homo sapiens
ucaggcgcaguggcucaugccu

SEQ ID NO: 940108 - RNA, 12 nt, Homo sapiens
ucagggucuaag

SEQ ID NO: 940109 - RNA, 13 nt, Homo sapiens
ucagguaauacaa

SEQ ID NO: 940110 - RNA, 20 nt, Homo sapiens
ucaguaaagaacguggucag

SEQ ID NO: 940111 - RNA, 19 nt, Homo sapiens
ucaguaauaaaaccgguca

SEQ ID NO: 940112 - RNA, 22 nt, Homo sapiens
ucaguacccacucuggagcauu

SEQ ID NO: 940113 - RNA, 15 nt, Homo sapiens
ucaguccaugucucg

SEQ ID NO: 940114 - RNA, 19 nt, Homo sapiens
ucaguguuuuugugaauug

SEQ ID NO: 940115 - RNA, 18 nt, Homo sapiens
ucauaaaauggaagcaau

SEQ ID NO: 940116 - RNA, 18 nt, Homo sapiens
ucauaaguuaugccucug

SEQ ID NO: 940117 - RNA, 20 nt, Homo sapiens
ucauaccuacaucagacaaa

SEQ ID NO: 940118 - RNA, 20 nt, Homo sapiens
ucauaggauuaagcaguuua

SEQ ID NO: 940119 - RNA, 22 nt, Homo sapiens
ucauaggcaccuuuuacuguga

SEQ ID NO: 940120 - RNA, 15 nt, Homo sapiens
ucauaguaagauuga

SEQ ID NO: 940121 - RNA, 17 nt, Homo sapiens
ucauaguuacuguguaa

SEQ ID NO: 940122 - RNA, 21 nt, Homo sapiens
ucauaucuuaauauauuucua

SEQ ID NO: 940123 - RNA, 18 nt, Homo sapiens
ucaucauggcaucauugc

SEQ ID NO: 940124 - RNA, 22 nt, Homo sapiens
ucaucugaaauguuacaaaaau

SEQ ID NO: 940125 - RNA, 17 nt, Homo sapiens
ucaugaagaagcucuug

SEQ ID NO: 940126 - RNA, 18 nt, Homo sapiens
ucaugccacugcacugca

SEQ ID NO: 940127 - RNA, 19 nt, Homo sapiens
ucaugccauugcauuccag

SEQ ID NO: 940128 - RNA, 19 nt, Homo sapiens
ucaugcuggccugugugau

SEQ ID NO: 940129 - RNA, 19 nt, Homo sapiens
ugcuaggaugaagcccuaa

SEQ ID NO: 940130 - RNA, 14 nt, Homo sapiens
ugcuagugugaauu

SEQ ID NO: 940131 - RNA, 20 nt, Homo sapiens
ugcuauaacuaugaccaugc

SEQ ID NO: 940132 - RNA, 14 nt, Homo sapiens
ugcuaugugccuua

SEQ ID NO: 940133 - RNA, 16 nt, Homo sapiens
ugcuccagucauugca

SEQ ID NO: 940134 - RNA, 17 nt, Homo sapiens
ugcucccugacagcacc

SEQ ID NO: 940135 - RNA, 15 nt, Homo sapiens
ugcuccuacuuucag

SEQ ID NO: 940136 - RNA, 22 nt, Homo sapiens
ugcucuccugggagacaaagca

SEQ ID NO: 940137 - RNA, 23 nt, Homo sapiens
ugcucugucccuauuauuugccc

SEQ ID NO: 940138 - RNA, 20 nt, Homo sapiens
ugcucuuaucuuucuugacu

SEQ ID NO: 940139 - RNA, 18 nt, Homo sapiens
ugcucuugagucuuugca

SEQ ID NO: 940140 - RNA, 22 nt, Homo sapiens
ugcugaaacaucauuacagauu

SEQ ID NO: 940141 - RNA, 19 nt, Homo sapiens
ugcugagagaaauauggaa

SEQ ID NO: 940142 - RNA, 23 nt, Homo sapiens
ugcuguagaaaaaaaaauucaca

SEQ ID NO: 940143 - RNA, 18 nt, Homo sapiens
ugcuuaguguacuuggag

SEQ ID NO: 940144 - RNA, 16 nt, Homo sapiens
ugcuuuucccauugcc

SEQ ID NO: 940145 - RNA, 19 nt, Homo sapiens
uggaaaagcaacauucaua

SEQ ID NO: 940146 - RNA, 23 nt, Homo sapiens
uggaaucagugaagccaaaggga

SEQ ID NO: 940147 - RNA, 17 nt, Homo sapiens
uggaaugaagguaauau

SEQ ID NO: 940148 - RNA, 15 nt, Homo sapiens
uggagaaaguauuua

SEQ ID NO: 940149 - RNA, 20 nt, Homo sapiens
uggagaaaugaaaacagugu

SEQ ID NO: 940150 - RNA, 23 nt, Homo sapiens
uggagaagggugguuuccugcca

SEQ ID NO: 940151 - RNA, 22 nt, Homo sapiens
uggagacagacugauguguaua

SEQ ID NO: 940152 - RNA, 17 nt, Homo sapiens
uggagcauuucucauca

SEQ ID NO: 940153 - RNA, 18 nt, Homo sapiens
uggaggacggucagucca

SEQ ID NO: 940154 - RNA, 19 nt, Homo sapiens
uggaggaucaaagaacuga

SEQ ID NO: 940155 - RNA, 16 nt, Homo sapiens
uggagggaaugcucag

SEQ ID NO: 940156 - RNA, 20 nt, Homo sapiens
uggagggguguggcuccuuc

SEQ ID NO: 940157 - RNA, 23 nt, Homo sapiens
uggagguggaaaagcaacauuca

SEQ ID NO: 940158 - RNA, 22 nt, Homo sapiens
uggaguccccucaccuccucua

SEQ ID NO: 940159 - RNA, 13 nt, Homo sapiens
uggauaaauugca

SEQ ID NO: 940160 - RNA, 11 nt, Homo sapiens
uggcacuuuga

SEQ ID NO: 940161 - RNA, 17 nt, Homo sapiens
uggcaggaaucuaucca

SEQ ID NO: 940162 - RNA, 17 nt, Homo sapiens
uggcagucugcccugca

SEQ ID NO: 940163 - RNA, 14 nt, Homo sapiens
uggcaucauugcau

SEQ ID NO: 940164 - RNA, 17 nt, Homo sapiens
uggcauuuccuggucag

SEQ ID NO: 940165 - RNA, 19 nt, Homo sapiens
uggcgugcucagacccaac

SEQ ID NO: 940166 - RNA, 17 nt, Homo sapiens
ugggagacaaagcaaua

SEQ ID NO: 940167 - RNA, 22 nt, Homo sapiens
ugggcauuccuugggacucagg

SEQ ID NO: 940168 - RNA, 20 nt, Homo sapiens
ugggccucagucacagagga

SEQ ID NO: 940169 - RNA, 17 nt, Homo sapiens
ugggcuccuggggcuca

SEQ ID NO: 940170 - RNA, 14 nt, Homo sapiens
uggggucuguaaau

SEQ ID NO: 940171 - RNA, 14 nt, Homo sapiens
ugguagagcaauaa

SEQ ID NO: 940172 - RNA, 20 nt, Homo sapiens
ugguaugcuggccagcaccc

SEQ ID NO: 940173 - RNA, 15 nt, Homo sapiens
uggucaggagccucu

SEQ ID NO: 940174 - RNA, 15 nt, Homo sapiens
uggugcacuucuuac

SEQ ID NO: 940175 - RNA, 18 nt, Homo sapiens
ugguggcauuguuuacag

SEQ ID NO: 940176 - RNA, 19 nt, Homo sapiens
uggugggcccccaaugaca

SEQ ID NO: 940177 - RNA, 15 nt, Homo sapiens
ugguuagguagcaac

SEQ ID NO: 940178 - RNA, 12 nt, Homo sapiens
ugguucuuucau

SEQ ID NO: 940179 - RNA, 16 nt, Homo sapiens
ugguuuuaaaagagaa

SEQ ID NO: 940180 - RNA, 17 nt, Homo sapiens
uguaaacaaaaugaagc

SEQ ID NO: 940181 - RNA, 20 nt, Homo sapiens
uguaaacuuuuugugcugaa

SEQ ID NO: 940182 - RNA, 21 nt, Homo sapiens
uguaacacuguguacaccuca

SEQ ID NO: 940183 - RNA, 22 nt, Homo sapiens
uguaaucaaggccagugcuaaa

SEQ ID NO: 940184 - RNA, 16 nt, Homo sapiens
uguaauggacuaugca

SEQ ID NO: 940185 - RNA, 18 nt, Homo sapiens
uguacaaaauaacucucc

SEQ ID NO: 940186 - RNA, 20 nt, Homo sapiens
uguaccaccaacuacuaccu

SEQ ID NO: 940187 - RNA, 13 nt, Homo sapiens
uguagaaggccag

SEQ ID NO: 940188 - RNA, 22 nt, Homo sapiens
uguagagacgguguuuugccau

SEQ ID NO: 940189 - RNA, 15 nt, Homo sapiens
uguagauucagguaa

SEQ ID NO: 940190 - RNA, 15 nt, Homo sapiens
uguagcagucacuga

SEQ ID NO: 940191 - RNA, 17 nt, Homo sapiens
ugucaaaacuacugaca

SEQ ID NO: 940192 - RNA, 20 nt, Homo sapiens
ugucaagaauagcauuguaa

SEQ ID NO: 940193 - RNA, 19 nt, Homo sapiens
ugucacacgauaaagggau

SEQ ID NO: 940194 - RNA, 23 nt, Homo sapiens
ugucaccaacugaaguggcuaaa

SEQ ID NO: 940195 - RNA, 22 nt, Homo sapiens
ugucaccaagcuaggugcuauu

SEQ ID NO: 940196 - RNA, 16 nt, Homo sapiens
ugucaccuugaugacu

SEQ ID NO: 940197 - RNA, 17 nt, Homo sapiens
ugucagauuaccaguua

SEQ ID NO: 940198 - RNA, 22 nt, Homo sapiens
ugucaggggcucccacaggauc

SEQ ID NO: 940199 - RNA, 23 nt, Homo sapiens
ugucauaggauuaagcaguuuaa

SEQ ID NO: 940200 - RNA, 21 nt, Homo sapiens
ugucaucugcuccuguucaca

SEQ ID NO: 940201 - RNA, 12 nt, Homo sapiens
uguccaaagagg

SEQ ID NO: 940202 - RNA, 19 nt, Homo sapiens
uguccccacuuacagaucu

SEQ ID NO: 940203 - RNA, 14 nt, Homo sapiens
uguccccuaccccc

SEQ ID NO: 940204 - RNA, 19 nt, Homo sapiens
uguccuagaaguucuuuga

SEQ ID NO: 940205 - RNA, 18 nt, Homo sapiens
ugucguauaggcauguaa

SEQ ID NO: 940206 - RNA, 14 nt, Homo sapiens
ugucugcuguagaa

SEQ ID NO: 940207 - RNA, 19 nt, Homo sapiens
ugugacauugauuugcucu

SEQ ID NO: 940208 - RNA, 17 nt, Homo sapiens
ugugcaccuguaauccc

SEQ ID NO: 940209 - RNA, 15 nt, Homo sapiens
ugugcaccuuuacac

SEQ ID NO: 940210 - RNA, 20 nt, Homo sapiens
ugugcaugaaagagaaagac

SEQ ID NO: 940211 - RNA, 13 nt, Homo sapiens
uguggcauucaua

SEQ ID NO: 940212 - RNA, 16 nt, Homo sapiens
ugugguggcucaugcc

SEQ ID NO: 940213 - RNA, 13 nt, Homo sapiens
uguguuacuucaa

SEQ ID NO: 940214 - RNA, 22 nt, Homo sapiens
uguguucugucaccaacugaag

SEQ ID NO: 940215 - RNA, 12 nt, Homo sapiens
uguuaacacuca

SEQ ID NO: 940216 - RNA, 23 nt, Homo sapiens
uguuaaccucugcuuuuaucuca

SEQ ID NO: 940217 - RNA, 22 nt, Homo sapiens
uguuaccuguagauucagguaa

SEQ ID NO: 940218 - RNA, 22 nt, Homo sapiens
uguuacucucuuccacauguua

SEQ ID NO: 940219 - RNA, 11 nt, Homo sapiens
uguuacuucaa

SEQ ID NO: 940220 - RNA, 11 nt, Homo sapiens
uguuagauauu

SEQ ID NO: 940221 - RNA, 19 nt, Homo sapiens
uguuauauagccaauauaa

SEQ ID NO: 940222 - RNA, 20 nt, Homo sapiens
uguuccuuuaagguacugaa

SEQ ID NO: 940223 - RNA, 14 nt, Homo sapiens
uguucucaguggug

SEQ ID NO: 940224 - RNA, 18 nt, Homo sapiens
uguuucgaguaaacuuga

SEQ ID NO: 940225 - RNA, 23 nt, Homo sapiens
uguuuuaaagaauaugacuuuuu

SEQ ID NO: 940226 - RNA, 20 nt, Homo sapiens
uguuuuuguacaguuaucau

SEQ ID NO: 940227 - RNA, 17 nt, Homo sapiens
uuaaaaaaauuacugug

SEQ ID NO: 940228 - RNA, 15 nt, Homo sapiens
uuaaaaacauaacau

SEQ ID NO: 940229 - RNA, 18 nt, Homo sapiens
uuaaaagaugucucugca

SEQ ID NO: 940230 - RNA, 22 nt, Homo sapiens
uuaaaagguuaaauauugucau

SEQ ID NO: 940231 - RNA, 14 nt, Homo sapiens
uuaaacaccuccuc

SEQ ID NO: 940232 - RNA, 16 nt, Homo sapiens
uuaaacuucauaugua

SEQ ID NO: 940233 - RNA, 13 nt, Homo sapiens
uuaaagaagcaau

SEQ ID NO: 940234 - RNA, 13 nt, Homo sapiens
uuaaauaagcaaa

SEQ ID NO: 940235 - RNA, 15 nt, Homo sapiens
uuaaauuaauaucuu

SEQ ID NO: 940236 - RNA, 14 nt, Homo sapiens
uuaaauuacaauuu

SEQ ID NO: 940237 - RNA, 22 nt, Homo sapiens
aacccacuagaagcaacuagga

SEQ ID NO: 940238 - RNA, 14 nt, Homo sapiens
aacccggagagugc

SEQ ID NO: 940239 - RNA, 15 nt, Homo sapiens
aacccucuaaaccau

SEQ ID NO: 940240 - RNA, 17 nt, Homo sapiens
aaccuacccucagugag

SEQ ID NO: 940241 - RNA, 23 nt, Homo sapiens
aaccucauuggccagcucauaaa

SEQ ID NO: 940242 - RNA, 20 nt, Homo sapiens
aaccucucgaacaguauuca

SEQ ID NO: 940243 - RNA, 24 nt, Homo sapiens
aaccugggcauuccuugggacuca

SEQ ID NO: 940244 - RNA, 13 nt, Homo sapiens
aaccuuaauugac

SEQ ID NO: 940245 - RNA, 14 nt, Homo sapiens
aaccuuucccucac

SEQ ID NO: 940246 - RNA, 16 nt, Homo sapiens
aacgccgagugcacug

SEQ ID NO: 940247 - RNA, 17 nt, Homo sapiens
aacgccgagugcacugc

SEQ ID NO: 940248 - RNA, 17 nt, Homo sapiens
aacgucugguccuaacc

SEQ ID NO: 940249 - RNA, 21 nt, Homo sapiens
aacgucugguccuaaccagug

SEQ ID NO: 940250 - RNA, 19 nt, Homo sapiens
aacguggcaggacuuccau

SEQ ID NO: 940251 - RNA, 20 nt, Homo sapiens
aacguucgauuucuaccuca

SEQ ID NO: 940252 - RNA, 16 nt, Homo sapiens
aacuagagcacagaag

SEQ ID NO: 940253 - RNA, 20 nt, Homo sapiens
aacuagagcacagaaggaau

SEQ ID NO: 940254 - RNA, 12 nt, Homo sapiens
aacuagccaaac

SEQ ID NO: 940255 - RNA, 22 nt, Homo sapiens
aacuaucucuacugaaugucau

SEQ ID NO: 940256 - RNA, 20 nt, Homo sapiens
aacucaucugaaauguuaca

SEQ ID NO: 940257 - RNA, 14 nt, Homo sapiens
aacuccucaugucu

SEQ ID NO: 940258 - RNA, 12 nt, Homo sapiens
aacucuggaccc

SEQ ID NO: 940259 - RNA, 16 nt, Homo sapiens
aacugaaaauggaccu

SEQ ID NO: 940260 - RNA, 16 nt, Homo sapiens
aacuguaaaugugaca

SEQ ID NO: 940261 - RNA, 13 nt, Homo sapiens
aacugugcaucuc

SEQ ID NO: 940262 - RNA, 20 nt, Homo sapiens
aacuucaugcuggccugugu

SEQ ID NO: 940263 - RNA, 21 nt, Homo sapiens
aagaaacacagcaacaaugac

SEQ ID NO: 940264 - RNA, 22 nt, Homo sapiens
aagaaaccaccgaaaucccuca

SEQ ID NO: 940265 - RNA, 22 nt, Homo sapiens
aagaaauaauagaaaugucuca

SEQ ID NO: 940266 - RNA, 21 nt, Homo sapiens
aagaacauuaauuauauguau

SEQ ID NO: 940267 - RNA, 19 nt, Homo sapiens
aagaagcacugggugacca

SEQ ID NO: 940268 - RNA, 20 nt, Homo sapiens
aagaagucggaaugucauag

SEQ ID NO: 940269 - RNA, 13 nt, Homo sapiens
aagaauacacaau

SEQ ID NO: 940270 - RNA, 16 nt, Homo sapiens
aagaauagcauuguaa

SEQ ID NO: 940271 - RNA, 12 nt, Homo sapiens
aagaauuacaua

SEQ ID NO: 940272 - RNA, 16 nt, Homo sapiens
aagaauuacauaugaa

SEQ ID NO: 940273 - RNA, 14 nt, Homo sapiens
aagaauucuuccac

SEQ ID NO: 940274 - RNA, 13 nt, Homo sapiens
aagaccaccacuu

SEQ ID NO: 940275 - RNA, 22 nt, Homo sapiens
aagaccaggccaaugucagggu

SEQ ID NO: 940276 - RNA, 14 nt, Homo sapiens
aagacccugucuca

SEQ ID NO: 940277 - RNA, 13 nt, Homo sapiens
aagaccuaccucc

SEQ ID NO: 940278 - RNA, 22 nt, Homo sapiens
aagaccuaccuccagacuucaa

SEQ ID NO: 940279 - RNA, 15 nt, Homo sapiens
aagacuccaucucaa

SEQ ID NO: 940280 - RNA, 21 nt, Homo sapiens
aagagaaaaagcagaggccaa

SEQ ID NO: 940281 - RNA, 13 nt, Homo sapiens
aagagaagcauca

SEQ ID NO: 940282 - RNA, 22 nt, Homo sapiens
aagagaggcgucugcugucuca

SEQ ID NO: 940283 - RNA, 16 nt, Homo sapiens
aagagauaacuguaaa

SEQ ID NO: 940284 - RNA, 19 nt, Homo sapiens
aagagaucuuucuuuccaa

SEQ ID NO: 940285 - RNA, 19 nt, Homo sapiens
aagauccagccucauaccu

SEQ ID NO: 940286 - RNA, 17 nt, Homo sapiens
aagauccagcugccuau

SEQ ID NO: 940287 - RNA, 13 nt, Homo sapiens
aagaugacugugu

SEQ ID NO: 940288 - RNA, 20 nt, Homo sapiens
aagaugggaggauugcuuga

SEQ ID NO: 940289 - RNA, 17 nt, Homo sapiens
aagaugugaaaauuaca

SEQ ID NO: 940290 - RNA, 23 nt, Homo sapiens
aagauucugaccuuaaaugcaac

SEQ ID NO: 940291 - RNA, 15 nt, Homo sapiens
aagauuuaugaugca

SEQ ID NO: 940292 - RNA, 22 nt, Homo sapiens
aagauuuuuuuuguaacuucaa

SEQ ID NO: 940293 - RNA, 23 nt, Homo sapiens
aagcacucucgcacacacaguga

SEQ ID NO: 940294 - RNA, 20 nt, Homo sapiens
aagcagaaagggccuugaau

SEQ ID NO: 940295 - RNA, 21 nt, Homo sapiens
aagcaguuguaccaagugaaa

SEQ ID NO: 940296 - RNA, 13 nt, Homo sapiens
aagcauacuucua

SEQ ID NO: 940297 - RNA, 12 nt, Homo sapiens
aagcauacuuug

SEQ ID NO: 940298 - RNA, 19 nt, Homo sapiens
aagccagccaacucuuucu

SEQ ID NO: 940299 - RNA, 21 nt, Homo sapiens
aagcccaauuuugacccuggu

SEQ ID NO: 940300 - RNA, 20 nt, Homo sapiens
aagcccaggagccucacugg

SEQ ID NO: 940301 - RNA, 23 nt, Homo sapiens
aagcccugggugcaggacacugg

SEQ ID NO: 940302 - RNA, 12 nt, Homo sapiens
aagccuccucau

SEQ ID NO: 940303 - RNA, 13 nt, Homo sapiens
aagcuaauuccac

SEQ ID NO: 940304 - RNA, 16 nt, Homo sapiens
aagcuaccauuuauca

SEQ ID NO: 940305 - RNA, 16 nt, Homo sapiens
aagcugacucaaaaau

SEQ ID NO: 940306 - RNA, 12 nt, Homo sapiens
aaggaaagcuca

SEQ ID NO: 940307 - RNA, 21 nt, Homo sapiens
aaggacauuuaaaauucaauu

SEQ ID NO: 940308 - RNA, 21 nt, Homo sapiens
aaggaucuaggagaagggucu

SEQ ID NO: 940309 - RNA, 14 nt, Homo sapiens
aaggcacacuguua

SEQ ID NO: 940310 - RNA, 16 nt, Homo sapiens
aagggaaacugggaaa

SEQ ID NO: 940311 - RNA, 23 nt, Homo sapiens
aagggaaccauguauaugagcuu

SEQ ID NO: 940312 - RNA, 23 nt, Homo sapiens
aaggggauuuuuaugucuggggc

SEQ ID NO: 940313 - RNA, 21 nt, Homo sapiens
aaggguaggcacgaagcaauu

SEQ ID NO: 940314 - RNA, 15 nt, Homo sapiens
aagguuuucauuugc

SEQ ID NO: 940315 - RNA, 18 nt, Homo sapiens
aagguuuucuucauucau

SEQ ID NO: 940316 - RNA, 15 nt, Homo sapiens
aaguaauacaaacua

SEQ ID NO: 940317 - RNA, 15 nt, Homo sapiens
aaguagauugccagc

SEQ ID NO: 940318 - RNA, 13 nt, Homo sapiens
aaguauaaaugaa

SEQ ID NO: 940319 - RNA, 15 nt, Homo sapiens
aaguaugacaaccuc

SEQ ID NO: 940320 - RNA, 23 nt, Homo sapiens
aaguauuuuuuaauccuaccuca

SEQ ID NO: 940321 - RNA, 19 nt, Homo sapiens
aagucccaguauaccucau

SEQ ID NO: 940322 - RNA, 16 nt, Homo sapiens
aagucuguaccucaaa

SEQ ID NO: 940323 - RNA, 13 nt, Homo sapiens
aagugaaagcaag

SEQ ID NO: 940324 - RNA, 18 nt, Homo sapiens
aagugcuggcaaccacua

SEQ ID NO: 940325 - RNA, 13 nt, Homo sapiens
aagugcuguggcu

SEQ ID NO: 940326 - RNA, 19 nt, Homo sapiens
aaguucgagucaaaguuga

SEQ ID NO: 940327 - RNA, 13 nt, Homo sapiens
aaguugugcuuga

SEQ ID NO: 940328 - RNA, 16 nt, Homo sapiens
aaguuuaaucagagga

SEQ ID NO: 940329 - RNA, 18 nt, Homo sapiens
aauaaacugaaaauggac

SEQ ID NO: 940330 - RNA, 16 nt, Homo sapiens
aauaaauauuuaauga

SEQ ID NO: 940331 - RNA, 12 nt, Homo sapiens
aauaauccagua

SEQ ID NO: 940332 - RNA, 13 nt, Homo sapiens
aauaaucuuauua

SEQ ID NO: 940333 - RNA, 23 nt, Homo sapiens
aauaaugcaugaugaacucaccu

SEQ ID NO: 940334 - RNA, 13 nt, Homo sapiens
aauacaaccagcc

SEQ ID NO: 940335 - RNA, 14 nt, Homo sapiens
aauaccacuuaccu

SEQ ID NO: 940336 - RNA, 17 nt, Homo sapiens
aauaccacuuaccucaa

SEQ ID NO: 940337 - RNA, 23 nt, Homo sapiens
aauacuaccucugaauguuacaa

SEQ ID NO: 940338 - RNA, 19 nt, Homo sapiens
aauacuauuuaagauguga

SEQ ID NO: 940339 - RNA, 19 nt, Homo sapiens
aauacuggugcacuucuua

SEQ ID NO: 940340 - RNA, 14 nt, Homo sapiens
aauagacacauaca

SEQ ID NO: 940341 - RNA, 20 nt, Homo sapiens
aauagcauuguaaaagcauu

SEQ ID NO: 940342 - RNA, 11 nt, Homo sapiens
aauagugccaa

SEQ ID NO: 940343 - RNA, 16 nt, Homo sapiens
aauagugucauccuca

SEQ ID NO: 940344 - RNA, 21 nt, Homo sapiens
aauauagcuaauaacauguga

SEQ ID NO: 940345 - RNA, 15 nt, Homo sapiens
aggaucagaggcugg

SEQ ID NO: 940346 - RNA, 17 nt, Homo sapiens
aggauggcaaguugcau

SEQ ID NO: 940347 - RNA, 23 nt, Homo sapiens
aggaugguagaaguuuggcugcu

SEQ ID NO: 940348 - RNA, 19 nt, Homo sapiens
aggcaccuuuuacugugau

SEQ ID NO: 940349 - RNA, 12 nt, Homo sapiens
aggcagcucaag

SEQ ID NO: 940350 - RNA, 21 nt, Homo sapiens
aggcaggaacaaacagggcug

SEQ ID NO: 940351 - RNA, 19 nt, Homo sapiens
aggcgcaguggcucaugcc

SEQ ID NO: 940352 - RNA, 19 nt, Homo sapiens
aggcucacugcaacuucug

SEQ ID NO: 940353 - RNA, 15 nt, Homo sapiens
aggcucagauuguaa

SEQ ID NO: 940354 - RNA, 16 nt, Homo sapiens
aggcugccccucucac

SEQ ID NO: 940355 - RNA, 19 nt, Homo sapiens
aggcugccccucucaccaa

SEQ ID NO: 940356 - RNA, 17 nt, Homo sapiens
aggcugggccaugucca

SEQ ID NO: 940357 - RNA, 16 nt, Homo sapiens
aggcuuaaaaacugaa

SEQ ID NO: 940358 - RNA, 19 nt, Homo sapiens
aggcuuaaggagaggagaa

SEQ ID NO: 940359 - RNA, 23 nt, Homo sapiens
aggcuucucacggcgaccaauaa

SEQ ID NO: 940360 - RNA, 20 nt, Homo sapiens
aggcuugccccaaaucucaa

SEQ ID NO: 940361 - RNA, 13 nt, Homo sapiens
agggaaugcucag

SEQ ID NO: 940362 - RNA, 19 nt, Homo sapiens
agggagggguuauagcuuc

SEQ ID NO: 940363 - RNA, 21 nt, Homo sapiens
agggauuuuuuuuuucagggc

SEQ ID NO: 940364 - RNA, 14 nt, Homo sapiens
agggcaacagauca

SEQ ID NO: 940365 - RNA, 15 nt, Homo sapiens
agggcaacuguagaa

SEQ ID NO: 940366 - RNA, 22 nt, Homo sapiens
agggcacccuaguucuaccuca

SEQ ID NO: 940367 - RNA, 20 nt, Homo sapiens
agggcaguucugaguguuua

SEQ ID NO: 940368 - RNA, 15 nt, Homo sapiens
agggcauugcucagc

SEQ ID NO: 940369 - RNA, 16 nt, Homo sapiens
agggcauugcucagcc

SEQ ID NO: 940370 - RNA, 23 nt, Homo sapiens
agggccacauagaugcugaugga

SEQ ID NO: 940371 - RNA, 14 nt, Homo sapiens
agggccuugaaucc

SEQ ID NO: 940372 - RNA, 18 nt, Homo sapiens
aggguacagaugugcugu

SEQ ID NO: 940373 - RNA, 17 nt, Homo sapiens
agggugguuuccugcca

SEQ ID NO: 940374 - RNA, 14 nt, Homo sapiens
agguccugccaugg

SEQ ID NO: 940375 - RNA, 19 nt, Homo sapiens
agguggggauccugccuaa

SEQ ID NO: 940376 - RNA, 10 nt, Homo sapiens
aggugucuga

SEQ ID NO: 940377 - RNA, 17 nt, Homo sapiens
agguuuuacacuugcau

SEQ ID NO: 940378 - RNA, 22 nt, Homo sapiens
aguaacaugaggggacauuuug

SEQ ID NO: 940379 - RNA, 19 nt, Homo sapiens
aguaauauagcugagacua

SEQ ID NO: 940380 - RNA, 22 nt, Homo sapiens
aguaaucuaaaggaaagaugau

SEQ ID NO: 940381 - RNA, 22 nt, Homo sapiens
aguaguucacauacaaaucauc

SEQ ID NO: 940382 - RNA, 14 nt, Homo sapiens
aguauaaucuuuuc

SEQ ID NO: 940383 - RNA, 21 nt, Homo sapiens
aguauagcuugcauagucaau

SEQ ID NO: 940384 - RNA, 16 nt, Homo sapiens
aguauauuaauaucau

SEQ ID NO: 940385 - RNA, 16 nt, Homo sapiens
agucauaucuuaauau

SEQ ID NO: 940386 - RNA, 23 nt, Homo sapiens
agucauucagcagcaaauuuuca

SEQ ID NO: 940387 - RNA, 17 nt, Homo sapiens
aguccaguaaagccuua

SEQ ID NO: 940388 - RNA, 19 nt, Homo sapiens
agucccuauacagaggucc

SEQ ID NO: 940389 - RNA, 15 nt, Homo sapiens
aguccuagcuacuca

SEQ ID NO: 940390 - RNA, 21 nt, Homo sapiens
aguccuggagcuggcucuaua

SEQ ID NO: 940391 - RNA, 16 nt, Homo sapiens
agucucucacccucau

SEQ ID NO: 940392 - RNA, 21 nt, Homo sapiens
agucuggcgucuccagacucu

SEQ ID NO: 940393 - RNA, 15 nt, Homo sapiens
agugaaaacuuugua

SEQ ID NO: 940394 - RNA, 17 nt, Homo sapiens
agugaacacucaguggc

SEQ ID NO: 940395 - RNA, 17 nt, Homo sapiens
agugaauuugcacuguu

SEQ ID NO: 940396 - RNA, 16 nt, Homo sapiens
agugagccgagaucau

SEQ ID NO: 940397 - RNA, 17 nt, Homo sapiens
agugagccgagaucaug

SEQ ID NO: 940398 - RNA, 20 nt, Homo sapiens
agugagccgagaucaugcca

SEQ ID NO: 940399 - RNA, 18 nt, Homo sapiens
agugaucuugagaaccuu

SEQ ID NO: 940400 - RNA, 21 nt, Homo sapiens
agugccuuaaacucuguuaca

SEQ ID NO: 940401 - RNA, 14 nt, Homo sapiens
aguggagacagacu

SEQ ID NO: 940402 - RNA, 19 nt, Homo sapiens
aguggccugugcuuuucag

SEQ ID NO: 940403 - RNA, 15 nt, Homo sapiens
agugguggucuucaa

SEQ ID NO: 940404 - RNA, 21 nt, Homo sapiens
agugucuguuccuggcaucua

SEQ ID NO: 940405 - RNA, 16 nt, Homo sapiens
aguguuaaaacaugaa

SEQ ID NO: 940406 - RNA, 17 nt, Homo sapiens
aguuaccagugccuuaa

SEQ ID NO: 940407 - RNA, 14 nt, Homo sapiens
aguuaucaguauuu

SEQ ID NO: 940408 - RNA, 20 nt, Homo sapiens
aguuauuacauguaauuuga

SEQ ID NO: 940409 - RNA, 21 nt, Homo sapiens
aguucuugagggccuccccac

SEQ ID NO: 940410 - RNA, 14 nt, Homo sapiens
aguuguuagauuaa

SEQ ID NO: 940411 - RNA, 22 nt, Homo sapiens
aguuugaggcugcagugagcca

SEQ ID NO: 940412 - RNA, 14 nt, Homo sapiens
aguuugagggagaa

SEQ ID NO: 940413 - RNA, 21 nt, Homo sapiens
auaaaaauguuucuacagaua

SEQ ID NO: 940414 - RNA, 18 nt, Homo sapiens
auaaaauccugugcaaua

SEQ ID NO: 940415 - RNA, 20 nt, Homo sapiens
auaaagcuaccauuuaucaa

SEQ ID NO: 940416 - RNA, 13 nt, Homo sapiens
auaaggcccagag

SEQ ID NO: 940417 - RNA, 19 nt, Homo sapiens
auaaguuauugcaguuuau

SEQ ID NO: 940418 - RNA, 20 nt, Homo sapiens
auaaucaucaaguaauacaa

SEQ ID NO: 940419 - RNA, 16 nt, Homo sapiens
auaauccaguaaucua

SEQ ID NO: 940420 - RNA, 17 nt, Homo sapiens
auaaucuuguagacacu

SEQ ID NO: 940421 - RNA, 16 nt, Homo sapiens
auaauguauuuacuuu

SEQ ID NO: 940422 - RNA, 17 nt, Homo sapiens
auaauguauuuacuuuu

SEQ ID NO: 940423 - RNA, 19 nt, Homo sapiens
auaauuuuccucaaucaca

SEQ ID NO: 940424 - RNA, 13 nt, Homo sapiens
auacaagugauaa

SEQ ID NO: 940425 - RNA, 14 nt, Homo sapiens
auacacaagcaaug

SEQ ID NO: 940426 - RNA, 22 nt, Homo sapiens
auacaucaauuuaaaaagcaaa

SEQ ID NO: 940427 - RNA, 16 nt, Homo sapiens
auacauuuuugucaga

SEQ ID NO: 940428 - RNA, 15 nt, Homo sapiens
auaccauuauauguu

SEQ ID NO: 940429 - RNA, 14 nt, Homo sapiens
auaccuccuauggg

SEQ ID NO: 940430 - RNA, 16 nt, Homo sapiens
auaccuuuuuguguca

SEQ ID NO: 940431 - RNA, 19 nt, Homo sapiens
auacuaacauuuucauuga

SEQ ID NO: 940432 - RNA, 15 nt, Homo sapiens
auacuauuuauauac

SEQ ID NO: 940433 - RNA, 15 nt, Homo sapiens
auacugcuacuguaa

SEQ ID NO: 940434 - RNA, 19 nt, Homo sapiens
auacuggccuggacuguuu

SEQ ID NO: 940435 - RNA, 13 nt, Homo sapiens
auacuguuuccau

SEQ ID NO: 940436 - RNA, 15 nt, Homo sapiens
auacuuuugcuuuca

SEQ ID NO: 940437 - RNA, 21 nt, Homo sapiens
auacuuuugcuuucagggaaa

SEQ ID NO: 940438 - RNA, 13 nt, Homo sapiens
auagcuucaggag

SEQ ID NO: 940439 - RNA, 19 nt, Homo sapiens
auagcuugcauagucaaua

SEQ ID NO: 940440 - RNA, 16 nt, Homo sapiens
auaguguuaacuguca

SEQ ID NO: 940441 - RNA, 20 nt, Homo sapiens
auauaaaaauaaugucauag

SEQ ID NO: 940442 - RNA, 13 nt, Homo sapiens
auauaacuaucuc

SEQ ID NO: 940443 - RNA, 18 nt, Homo sapiens
auauacuauuuauauaca

SEQ ID NO: 940444 - RNA, 18 nt, Homo sapiens
auauacugguucacaucc

SEQ ID NO: 940445 - RNA, 13 nt, Homo sapiens
auauagccaauau

SEQ ID NO: 940446 - RNA, 23 nt, Homo sapiens
auauaggcuucucacggcgacca

SEQ ID NO: 940447 - RNA, 19 nt, Homo sapiens
auaucauuuauccuuacau

SEQ ID NO: 940448 - RNA, 13 nt, Homo sapiens
auauguaaucucu

SEQ ID NO: 940449 - RNA, 12 nt, Homo sapiens
auauuaacuuuu

SEQ ID NO: 940450 - RNA, 20 nt, Homo sapiens
auauuaacuuuuaaugguga

SEQ ID NO: 940451 - RNA, 12 nt, Homo sapiens
auauuaaucacc

SEQ ID NO: 940452 - RNA, 12 nt, Homo sapiens
auauuuacaugc

SEQ ID NO: 940453 - RNA, 15 nt, Homo sapiens
caccaaguaccagua

SEQ ID NO: 940454 - RNA, 21 nt, Homo sapiens
caccacuuuacuuguguuaua

SEQ ID NO: 940455 - RNA, 15 nt, Homo sapiens
cacccaugccagaga

SEQ ID NO: 940456 - RNA, 14 nt, Homo sapiens
cacccccacugcca

SEQ ID NO: 940457 - RNA, 14 nt, Homo sapiens
cacccccagcucaa

SEQ ID NO: 940458 - RNA, 18 nt, Homo sapiens
caccccgccugcccucau

SEQ ID NO: 940459 - RNA, 22 nt, Homo sapiens
caccuaagaucucgguuugcca

SEQ ID NO: 940460 - RNA, 20 nt, Homo sapiens
caccuccucauguacauacc

SEQ ID NO: 940461 - RNA, 20 nt, Homo sapiens
caccuccuguguugugcugg

SEQ ID NO: 940462 - RNA, 11 nt, Homo sapiens
caccuguaauc

SEQ ID NO: 940463 - RNA, 20 nt, Homo sapiens
caccuuggaauucgcuuucu

SEQ ID NO: 940464 - RNA, 15 nt, Homo sapiens
caccuuuuacuguga

SEQ ID NO: 940465 - RNA, 15 nt, Homo sapiens
cacguggggcccacu

SEQ ID NO: 940466 - RNA, 20 nt, Homo sapiens
cacuaagaauucaaacuggg

SEQ ID NO: 940467 - RNA, 13 nt, Homo sapiens
cacuacuaccucu

SEQ ID NO: 940468 - RNA, 19 nt, Homo sapiens
cacucaugucggucccuga

SEQ ID NO: 940469 - RNA, 22 nt, Homo sapiens
cacucccuguagugaauccucu

SEQ ID NO: 940470 - RNA, 15 nt, Homo sapiens
cacuccuuuuuugca

SEQ ID NO: 940471 - RNA, 19 nt, Homo sapiens
cacuccuuuuuugcaugug

SEQ ID NO: 940472 - RNA, 15 nt, Homo sapiens
cacucuggagcauuu

SEQ ID NO: 940473 - RNA, 16 nt, Homo sapiens
cacucuggagcauuuc

SEQ ID NO: 940474 - RNA, 17 nt, Homo sapiens
cacucuggagcauuucu

SEQ ID NO: 940475 - RNA, 15 nt, Homo sapiens
cacugcacuccagcu

SEQ ID NO: 940476 - RNA, 23 nt, Homo sapiens
cacuggauccaucuugagccaca

SEQ ID NO: 940477 - RNA, 18 nt, Homo sapiens
cacuggucgagagccaaa

SEQ ID NO: 940478 - RNA, 20 nt, Homo sapiens
cacugguuaguacugguccc

SEQ ID NO: 940479 - RNA, 21 nt, Homo sapiens
cacuguuuaaucauaguuacu

SEQ ID NO: 940480 - RNA, 16 nt, Homo sapiens
cacuuagccauugaaa

SEQ ID NO: 940481 - RNA, 16 nt, Homo sapiens
cacuuccaucacaaga

SEQ ID NO: 940482 - RNA, 23 nt, Homo sapiens
cacuuuuagccagagaugcaaua

SEQ ID NO: 940483 - RNA, 18 nt, Homo sapiens
cagaaacacucaaguuga

SEQ ID NO: 940484 - RNA, 14 nt, Homo sapiens
cagaaagggccuug

SEQ ID NO: 940485 - RNA, 11 nt, Homo sapiens
cagaaggugac

SEQ ID NO: 940486 - RNA, 22 nt, Homo sapiens
cagaaguucgagacuagccugg

SEQ ID NO: 940487 - RNA, 17 nt, Homo sapiens
cagacaauaaacccuca

SEQ ID NO: 940488 - RNA, 18 nt, Homo sapiens
cagacaauaaacccucag

SEQ ID NO: 940489 - RNA, 19 nt, Homo sapiens
cagacaucuggacacuggg

SEQ ID NO: 940490 - RNA, 15 nt, Homo sapiens
cagacgauuguucuu

SEQ ID NO: 940491 - RNA, 16 nt, Homo sapiens
cagacgauuguucuua

SEQ ID NO: 940492 - RNA, 13 nt, Homo sapiens
cagagacuaugua

SEQ ID NO: 940493 - RNA, 20 nt, Homo sapiens
cagagagguggggauccugc

SEQ ID NO: 940494 - RNA, 20 nt, Homo sapiens
cagagcaagacuccaucuca

SEQ ID NO: 940495 - RNA, 20 nt, Homo sapiens
cagagcgaggaaaggauuuu

SEQ ID NO: 940496 - RNA, 16 nt, Homo sapiens
cagagcgcacagggag

SEQ ID NO: 940497 - RNA, 23 nt, Homo sapiens
cagagcggaaggagggagcucug

SEQ ID NO: 940498 - RNA, 14 nt, Homo sapiens
cagagucugucucu

SEQ ID NO: 940499 - RNA, 13 nt, Homo sapiens
cagaguuguucug

SEQ ID NO: 940500 - RNA, 13 nt, Homo sapiens
cagauaccugguu

SEQ ID NO: 940501 - RNA, 16 nt, Homo sapiens
cagauauagcauuaau

SEQ ID NO: 940502 - RNA, 12 nt, Homo sapiens
cagaucaugccc

SEQ ID NO: 940503 - RNA, 12 nt, Homo sapiens
cagaugaucucu

SEQ ID NO: 940504 - RNA, 17 nt, Homo sapiens
cagauggcacuuugaag

SEQ ID NO: 940505 - RNA, 23 nt, Homo sapiens
cagauguauuaaaaaaagauuug

SEQ ID NO: 940506 - RNA, 11 nt, Homo sapiens
cagauguuaaa

SEQ ID NO: 940507 - RNA, 16 nt, Homo sapiens
cagauuuugcuguaua

SEQ ID NO: 940508 - RNA, 18 nt, Homo sapiens
cagcaaaaugucuccuga

SEQ ID NO: 940509 - RNA, 15 nt, Homo sapiens
cagcaauccaugaga

SEQ ID NO: 940510 - RNA, 19 nt, Homo sapiens
cagcacucccuuuuuuaua

SEQ ID NO: 940511 - RNA, 23 nt, Homo sapiens
cagcauauguguaaagauuuaua

SEQ ID NO: 940512 - RNA, 14 nt, Homo sapiens
cagcaucggaaaga

SEQ ID NO: 940513 - RNA, 13 nt, Homo sapiens
cagccaagcccua

SEQ ID NO: 940514 - RNA, 19 nt, Homo sapiens
cagccagcgccucccucca

SEQ ID NO: 940515 - RNA, 21 nt, Homo sapiens
cagccaguuuuacugugauuc

SEQ ID NO: 940516 - RNA, 23 nt, Homo sapiens
cagcccauggugagcucugggaa

SEQ ID NO: 940517 - RNA, 17 nt, Homo sapiens
cagcccuccucugucaa

SEQ ID NO: 940518 - RNA, 13 nt, Homo sapiens
cagccuccagggc

SEQ ID NO: 940519 - RNA, 19 nt, Homo sapiens
cagccuggccaacauggca

SEQ ID NO: 940520 - RNA, 17 nt, Homo sapiens
cagcuaagaugccaugu

SEQ ID NO: 940521 - RNA, 17 nt, Homo sapiens
caggaacaaacagggcu

SEQ ID NO: 940522 - RNA, 17 nt, Homo sapiens
caggaagcccaggagcc

SEQ ID NO: 940523 - RNA, 20 nt, Homo sapiens
caggaaggaacaaagacagg

SEQ ID NO: 940524 - RNA, 18 nt, Homo sapiens
caggagagucacuugaac

SEQ ID NO: 940525 - RNA, 22 nt, Homo sapiens
caggauuacuagucaaacaaaa

SEQ ID NO: 940526 - RNA, 13 nt, Homo sapiens
caggcagcucaag

SEQ ID NO: 940527 - RNA, 17 nt, Homo sapiens
caggcgcaguggcucau

SEQ ID NO: 940528 - RNA, 18 nt, Homo sapiens
caggcugggccaugucca

SEQ ID NO: 940529 - RNA, 18 nt, Homo sapiens
cagggaacucuggcauuc

SEQ ID NO: 940530 - RNA, 16 nt, Homo sapiens
cagggcaacuguagaa

SEQ ID NO: 940531 - RNA, 16 nt, Homo sapiens
cagggcauugcucagc

SEQ ID NO: 940532 - RNA, 12 nt, Homo sapiens
caguaaaaucaa

SEQ ID NO: 940533 - RNA, 15 nt, Homo sapiens
caguaaaaucaaaug

SEQ ID NO: 940534 - RNA, 18 nt, Homo sapiens
caguaaaaucaaaugugc

SEQ ID NO: 940535 - RNA, 14 nt, Homo sapiens
caguaauggaauga

SEQ ID NO: 940536 - RNA, 16 nt, Homo sapiens
caguacccucucagcu

SEQ ID NO: 940537 - RNA, 18 nt, Homo sapiens
caguacccucucagcucc

SEQ ID NO: 940538 - RNA, 19 nt, Homo sapiens
caguagcaaacuuuucaca

SEQ ID NO: 940539 - RNA, 21 nt, Homo sapiens
caguaguucacauacaaauca

SEQ ID NO: 940540 - RNA, 13 nt, Homo sapiens
caguccaugucuc

SEQ ID NO: 940541 - RNA, 21 nt, Homo sapiens
cagugagccaucaucauggca

SEQ ID NO: 940542 - RNA, 18 nt, Homo sapiens
cagugggccuguggcauu

SEQ ID NO: 940543 - RNA, 20 nt, Homo sapiens
caguuaauaaaccuuugcaa

SEQ ID NO: 940544 - RNA, 23 nt, Homo sapiens
caguuauuaaucuggacauucga

SEQ ID NO: 940545 - RNA, 12 nt, Homo sapiens
caguucagauaa

SEQ ID NO: 940546 - RNA, 12 nt, Homo sapiens
caguucagugag

SEQ ID NO: 940547 - RNA, 19 nt, Homo sapiens
caguuccucccccaguucc

SEQ ID NO: 940548 - RNA, 21 nt, Homo sapiens
caguuccuuuagaaagcaguu

SEQ ID NO: 940549 - RNA, 19 nt, Homo sapiens
caguuucuaggcaccucag

SEQ ID NO: 940550 - RNA, 21 nt, Homo sapiens
cauaaacaaguucgagucaaa

SEQ ID NO: 940551 - RNA, 21 nt, Homo sapiens
cauaagaauuuuuuauaagua

SEQ ID NO: 940552 - RNA, 20 nt, Homo sapiens
cauaaguuaugccucugaca

SEQ ID NO: 940553 - RNA, 20 nt, Homo sapiens
cauauacuuguggucccaga

SEQ ID NO: 940554 - RNA, 13 nt, Homo sapiens
cauaucuuuauua

SEQ ID NO: 940555 - RNA, 17 nt, Homo sapiens
cauauuucaaaccacaa

SEQ ID NO: 940556 - RNA, 22 nt, Homo sapiens
caucagauccugggcacauucu

SEQ ID NO: 940557 - RNA, 15 nt, Homo sapiens
caucagucaacaacu

SEQ ID NO: 940558 - RNA, 16 nt, Homo sapiens
caucagucaacaacuu

SEQ ID NO: 940559 - RNA, 18 nt, Homo sapiens
caucagucuccaacaugu

SEQ ID NO: 940560 - RNA, 15 nt, Homo sapiens
caucauugcauucca

SEQ ID NO: 940561 - RNA, 19 nt, Homo sapiens
cuuuuaaaaugcaauguaa

SEQ ID NO: 940562 - RNA, 13 nt, Homo sapiens
cuuuuuucuuaac

SEQ ID NO: 940563 - RNA, 19 nt, Homo sapiens
gaaaaaauuagcugggcau

SEQ ID NO: 940564 - RNA, 17 nt, Homo sapiens
gaaaaauaucuuggccu

SEQ ID NO: 940565 - RNA, 17 nt, Homo sapiens
gaaaaccucuccugacc

SEQ ID NO: 940566 - RNA, 17 nt, Homo sapiens
gaaaagaagcacccaga

SEQ ID NO: 940567 - RNA, 15 nt, Homo sapiens
gaaaagcaacauuca

SEQ ID NO: 940568 - RNA, 18 nt, Homo sapiens
gaaaaucacuugccaaaa

SEQ ID NO: 940569 - RNA, 18 nt, Homo sapiens
gaaacacccacucacuuu

SEQ ID NO: 940570 - RNA, 18 nt, Homo sapiens
gaaaccagaaaagcaaua

SEQ ID NO: 940571 - RNA, 16 nt, Homo sapiens
gaaacguggcaggacu

SEQ ID NO: 940572 - RNA, 15 nt, Homo sapiens
gaaacucucuguuca

SEQ ID NO: 940573 - RNA, 14 nt, Homo sapiens
gaaagcaauaacuu

SEQ ID NO: 940574 - RNA, 18 nt, Homo sapiens
gaaaguuaacucuucaaa

SEQ ID NO: 940575 - RNA, 17 nt, Homo sapiens
gaaaguuuuguucugua

SEQ ID NO: 940576 - RNA, 15 nt, Homo sapiens
gaaaucuaaauuucu

SEQ ID NO: 940577 - RNA, 16 nt, Homo sapiens
gaaaugaaaacagugu

SEQ ID NO: 940578 - RNA, 15 nt, Homo sapiens
gaaaugaaagggaaa

SEQ ID NO: 940579 - RNA, 23 nt, Homo sapiens
gaaaugaaagggaaacugggaaa

SEQ ID NO: 940580 - RNA, 14 nt, Homo sapiens
gaaauucuuuccca

SEQ ID NO: 940581 - RNA, 13 nt, Homo sapiens
gaaauuuggcaaa

SEQ ID NO: 940582 - RNA, 22 nt, Homo sapiens
gaacaugguuugacucaucuua

SEQ ID NO: 940583 - RNA, 21 nt, Homo sapiens
gaaccagcuucugauaaacac

SEQ ID NO: 940584 - RNA, 19 nt, Homo sapiens
gaacucucugccuguaaau

SEQ ID NO: 940585 - RNA, 14 nt, Homo sapiens
gaacugcaaccuca

SEQ ID NO: 940586 - RNA, 23 nt, Homo sapiens
gaagacacugcagugaccacuua

SEQ ID NO: 940587 - RNA, 18 nt, Homo sapiens
gaagagaugacaaaccau

SEQ ID NO: 940588 - RNA, 17 nt, Homo sapiens
gaagcaauuuguugcug

SEQ ID NO: 940589 - RNA, 18 nt, Homo sapiens
gaagcccugggugcagga

SEQ ID NO: 940590 - RNA, 17 nt, Homo sapiens
gaagcggagagagccaa

SEQ ID NO: 940591 - RNA, 14 nt, Homo sapiens
gaaggccagcugaa

SEQ ID NO: 940592 - RNA, 19 nt, Homo sapiens
gaagggacacacaagaaga

SEQ ID NO: 940593 - RNA, 11 nt, Homo sapiens
gaagugaaaac

SEQ ID NO: 940594 - RNA, 14 nt, Homo sapiens
gaaguugaaaauca

SEQ ID NO: 940595 - RNA, 22 nt, Homo sapiens
gaauacuuggaccucagccaac

SEQ ID NO: 940596 - RNA, 15 nt, Homo sapiens
gaauaucugguuucu

SEQ ID NO: 940597 - RNA, 21 nt, Homo sapiens
gaaucagugaagccaaaggga

SEQ ID NO: 940598 - RNA, 14 nt, Homo sapiens
gaaugacaaaguau

SEQ ID NO: 940599 - RNA, 18 nt, Homo sapiens
gaaugagagguuccuaag

SEQ ID NO: 940600 - RNA, 21 nt, Homo sapiens
gaauggagggaaugcucagaa

SEQ ID NO: 940601 - RNA, 20 nt, Homo sapiens
gaaugggcuugaaacauuau

SEQ ID NO: 940602 - RNA, 21 nt, Homo sapiens
gaaugggcuugaaacauuaua

SEQ ID NO: 940603 - RNA, 13 nt, Homo sapiens
gaaugugucucag

SEQ ID NO: 940604 - RNA, 15 nt, Homo sapiens
gaaugugucucagga

SEQ ID NO: 940605 - RNA, 19 nt, Homo sapiens
gaaugugucucaggaaaac

SEQ ID NO: 940606 - RNA, 17 nt, Homo sapiens
gaauuaaaaaagcauac

SEQ ID NO: 940607 - RNA, 20 nt, Homo sapiens
gaauuauuuaaacaaaaacu

SEQ ID NO: 940608 - RNA, 21 nt, Homo sapiens
gaauuuacagucuaguacuua

SEQ ID NO: 940609 - RNA, 14 nt, Homo sapiens
gaauuuguccaauu

SEQ ID NO: 940610 - RNA, 21 nt, Homo sapiens
gacaauaaacccucagagccu

SEQ ID NO: 940611 - RNA, 15 nt, Homo sapiens
gacacauacauguca

SEQ ID NO: 940612 - RNA, 22 nt, Homo sapiens
gacacauacaugucacauuuag

SEQ ID NO: 940613 - RNA, 21 nt, Homo sapiens
gacaccuagaaaggaacugca

SEQ ID NO: 940614 - RNA, 21 nt, Homo sapiens
gacacucaaaacgcuacugag

SEQ ID NO: 940615 - RNA, 16 nt, Homo sapiens
gacagaaugugucuca

SEQ ID NO: 940616 - RNA, 15 nt, Homo sapiens
gacagggacaugccc

SEQ ID NO: 940617 - RNA, 16 nt, Homo sapiens
gacaucuggacacugg

SEQ ID NO: 940618 - RNA, 17 nt, Homo sapiens
gacaucuggacacuggg

SEQ ID NO: 940619 - RNA, 13 nt, Homo sapiens
gacauuccaccau

SEQ ID NO: 940620 - RNA, 13 nt, Homo sapiens
gaccaauacuacu

SEQ ID NO: 940621 - RNA, 20 nt, Homo sapiens
gaccaaucaucaacuaccau

SEQ ID NO: 940622 - RNA, 18 nt, Homo sapiens
gaccacagggccuugaau

SEQ ID NO: 940623 - RNA, 15 nt, Homo sapiens
gacccuugcugugaa

SEQ ID NO: 940624 - RNA, 23 nt, Homo sapiens
gaccugaauaccacuuaccucaa

SEQ ID NO: 940625 - RNA, 23 nt, Homo sapiens
gacgaagcggagagagccaagac

SEQ ID NO: 940626 - RNA, 16 nt, Homo sapiens
gacgaguaacuccccu

SEQ ID NO: 940627 - RNA, 22 nt, Homo sapiens
gacgccacucauuucaucucau

SEQ ID NO: 940628 - RNA, 13 nt, Homo sapiens
gacggucagucca

SEQ ID NO: 940629 - RNA, 17 nt, Homo sapiens
gacguuuaacugcaguu

SEQ ID NO: 940630 - RNA, 16 nt, Homo sapiens
gacuagauacuacuuu

SEQ ID NO: 940631 - RNA, 19 nt, Homo sapiens
gacucaggagcugcuaaac

SEQ ID NO: 940632 - RNA, 17 nt, Homo sapiens
gacucaguggguuaaca

SEQ ID NO: 940633 - RNA, 16 nt, Homo sapiens
gacuccagcugugaag

SEQ ID NO: 940634 - RNA, 13 nt, Homo sapiens
gacucccuacccc

SEQ ID NO: 940635 - RNA, 17 nt, Homo sapiens
gacuggauguaccacca

SEQ ID NO: 940636 - RNA, 16 nt, Homo sapiens
gacuggcuuuuauuaa

SEQ ID NO: 940637 - RNA, 17 nt, Homo sapiens
gacugugguagccagca

SEQ ID NO: 940638 - RNA, 14 nt, Homo sapiens
gacugugucugccu

SEQ ID NO: 940639 - RNA, 23 nt, Homo sapiens
gacuugaaauucucaucagucca

SEQ ID NO: 940640 - RNA, 20 nt, Homo sapiens
gagaaaugcuuagaaauuca

SEQ ID NO: 940641 - RNA, 14 nt, Homo sapiens
gagaagacacugca

SEQ ID NO: 940642 - RNA, 18 nt, Homo sapiens
gagacgguguuuugccau

SEQ ID NO: 940643 - RNA, 13 nt, Homo sapiens
gagagaaagggag

SEQ ID NO: 940644 - RNA, 13 nt, Homo sapiens
gagagcacaguga

SEQ ID NO: 940645 - RNA, 14 nt, Homo sapiens
gagagcacagugau

SEQ ID NO: 940646 - RNA, 20 nt, Homo sapiens
gagagcacagugaucaccag

SEQ ID NO: 940647 - RNA, 22 nt, Homo sapiens
gagaucacgucacugcacucca

SEQ ID NO: 940648 - RNA, 21 nt, Homo sapiens
gagaucuuucuuuccaaaaca

SEQ ID NO: 940649 - RNA, 23 nt, Homo sapiens
gagaugacaaaccauaacugaca

SEQ ID NO: 940650 - RNA, 13 nt, Homo sapiens
gagcaagacucca

SEQ ID NO: 940651 - RNA, 20 nt, Homo sapiens
gagcacccagaacuccauac

SEQ ID NO: 940652 - RNA, 14 nt, Homo sapiens
gagcacccugccca

SEQ ID NO: 940653 - RNA, 18 nt, Homo sapiens
gagcacucauuccuuccc

SEQ ID NO: 940654 - RNA, 17 nt, Homo sapiens
gagcauuucucaucagu

SEQ ID NO: 940655 - RNA, 17 nt, Homo sapiens
gagccgagaucaugcca

SEQ ID NO: 940656 - RNA, 20 nt, Homo sapiens
gagccgagaucaugccauug

SEQ ID NO: 940657 - RNA, 13 nt, Homo sapiens
gagcgcacaggga

SEQ ID NO: 940658 - RNA, 17 nt, Homo sapiens
gagcugggugcccagua

SEQ ID NO: 940659 - RNA, 15 nt, Homo sapiens
gaggaaauucuuucc

SEQ ID NO: 940660 - RNA, 21 nt, Homo sapiens
gaggauugcuugagcccagaa

SEQ ID NO: 940661 - RNA, 15 nt, Homo sapiens
gaggcaaagguucua

SEQ ID NO: 940662 - RNA, 20 nt, Homo sapiens
gaggcggagguugcaaugag

SEQ ID NO: 940663 - RNA, 20 nt, Homo sapiens
gaggcugccccucucaccaa

SEQ ID NO: 940664 - RNA, 20 nt, Homo sapiens
gaggcugggccccugggaug

SEQ ID NO: 940665 - RNA, 14 nt, Homo sapiens
gagggcagggacca

SEQ ID NO: 940666 - RNA, 14 nt, Homo sapiens
gagucucuguauaa

SEQ ID NO: 940667 - RNA, 18 nt, Homo sapiens
gagucuucacuaaccuuu

SEQ ID NO: 940668 - RNA, 16 nt, Homo sapiens
gagugcaguggcacaa

SEQ ID NO: 940669 - RNA, 23 nt, Homo sapiens
aagcuaccauuuaucaagcauuu

SEQ ID NO: 940670 - RNA, 18 nt, Homo sapiens
aagcuauugucuguaaua

SEQ ID NO: 940671 - RNA, 12 nt, Homo sapiens
aaggaaaucaaa

SEQ ID NO: 940672 - RNA, 22 nt, Homo sapiens
aaggagggagcucugaugagca

SEQ ID NO: 940673 - RNA, 15 nt, Homo sapiens
aaggauaugauuaau

SEQ ID NO: 940674 - RNA, 16 nt, Homo sapiens
aaggauuuuaccaaag

SEQ ID NO: 940675 - RNA, 17 nt, Homo sapiens
aaggauuuuaccaaagc

SEQ ID NO: 940676 - RNA, 18 nt, Homo sapiens
aaggauuuuaccaaagca

SEQ ID NO: 940677 - RNA, 19 nt, Homo sapiens
aaggauuuuaccaaagcau

SEQ ID NO: 940678 - RNA, 22 nt, Homo sapiens
aaggauuuuaccaaagcaucaa

SEQ ID NO: 940679 - RNA, 17 nt, Homo sapiens
aaggcagaaaacagcuc

SEQ ID NO: 940680 - RNA, 16 nt, Homo sapiens
aaggccacauaccucu

SEQ ID NO: 940681 - RNA, 13 nt, Homo sapiens
aaggccagcugaa

SEQ ID NO: 940682 - RNA, 16 nt, Homo sapiens
aaggccccugcaaugu

SEQ ID NO: 940683 - RNA, 21 nt, Homo sapiens
aaggcucagucgcuagcauuu

SEQ ID NO: 940684 - RNA, 20 nt, Homo sapiens
aaggcugcuuagaauccaaa

SEQ ID NO: 940685 - RNA, 20 nt, Homo sapiens
aagggaaauuucaauaaccu

SEQ ID NO: 940686 - RNA, 23 nt, Homo sapiens
aaggggccucaccgagugggggc

SEQ ID NO: 940687 - RNA, 13 nt, Homo sapiens
aaggggcugagga

SEQ ID NO: 940688 - RNA, 14 nt, Homo sapiens
aaggggcugaggac

SEQ ID NO: 940689 - RNA, 16 nt, Homo sapiens
aagguaagaucauuua

SEQ ID NO: 940690 - RNA, 16 nt, Homo sapiens
aagguacugaagcuuu

SEQ ID NO: 940691 - RNA, 20 nt, Homo sapiens
aagguuauguucauuuuuca

SEQ ID NO: 940692 - RNA, 22 nt, Homo sapiens
aagguuguguagcugugucaug

SEQ ID NO: 940693 - RNA, 19 nt, Homo sapiens
aaguacaucucuacuaaaa

SEQ ID NO: 940694 - RNA, 21 nt, Homo sapiens
aaguacugguugacuuucuaa

SEQ ID NO: 940695 - RNA, 22 nt, Homo sapiens
aaguauuuuuuaauccuaccuc

SEQ ID NO: 940696 - RNA, 18 nt, Homo sapiens
aagucccaguauaccuca

SEQ ID NO: 940697 - RNA, 21 nt, Homo sapiens
aaguccccguggagguucugu

SEQ ID NO: 940698 - RNA, 14 nt, Homo sapiens
aagucgcauuccau

SEQ ID NO: 940699 - RNA, 16 nt, Homo sapiens
aagugaugucauuuga

SEQ ID NO: 940700 - RNA, 23 nt, Homo sapiens
aagugugugccaccaugccucac

SEQ ID NO: 940701 - RNA, 14 nt, Homo sapiens
aaguuacacuuuua

SEQ ID NO: 940702 - RNA, 23 nt, Homo sapiens
aaguugaaaaucauaggcaccuu

SEQ ID NO: 940703 - RNA, 19 nt, Homo sapiens
aaguugauuagaaagacca

SEQ ID NO: 940704 - RNA, 22 nt, Homo sapiens
aaguugcaucagaaagcuuuau

SEQ ID NO: 940705 - RNA, 14 nt, Homo sapiens
aauaaaaccuguua

SEQ ID NO: 940706 - RNA, 15 nt, Homo sapiens
aauaaaaguaaagac

SEQ ID NO: 940707 - RNA, 16 nt, Homo sapiens
aauaaaaucauguagu

SEQ ID NO: 940708 - RNA, 14 nt, Homo sapiens
aauaaacuaugagg

SEQ ID NO: 940709 - RNA, 21 nt, Homo sapiens
aauaagauauuuaguaauauu

SEQ ID NO: 940710 - RNA, 21 nt, Homo sapiens
aauaauaaagaauagcuuuaa

SEQ ID NO: 940711 - RNA, 11 nt, Homo sapiens
aauacacaauu

SEQ ID NO: 940712 - RNA, 19 nt, Homo sapiens
aauacauuguacuuauaca

SEQ ID NO: 940713 - RNA, 19 nt, Homo sapiens
aauacauuuaaaacauuaa

SEQ ID NO: 940714 - RNA, 13 nt, Homo sapiens
aauacuaccucug

SEQ ID NO: 940715 - RNA, 20 nt, Homo sapiens
aauacuacugacguccuccc

SEQ ID NO: 940716 - RNA, 13 nt, Homo sapiens
aauacuguuucca

SEQ ID NO: 940717 - RNA, 14 nt, Homo sapiens
aauaggcaucucca

SEQ ID NO: 940718 - RNA, 19 nt, Homo sapiens
aauauauuauuuccuuuau

SEQ ID NO: 940719 - RNA, 16 nt, Homo sapiens
aauaucaaaacaagua

SEQ ID NO: 940720 - RNA, 12 nt, Homo sapiens
aauaucuuggcc

SEQ ID NO: 940721 - RNA, 17 nt, Homo sapiens
aauauuuaucugauuaa

SEQ ID NO: 940722 - RNA, 14 nt, Homo sapiens
aaucaaaugugcau

SEQ ID NO: 940723 - RNA, 15 nt, Homo sapiens
aaucaaaugugcauc

SEQ ID NO: 940724 - RNA, 18 nt, Homo sapiens
aaucaaggccagugcuaa

SEQ ID NO: 940725 - RNA, 21 nt, Homo sapiens
aaucagugaagccaaagggac

SEQ ID NO: 940726 - RNA, 15 nt, Homo sapiens
aaucauaguuacugu

SEQ ID NO: 940727 - RNA, 13 nt, Homo sapiens
aaucaucaaguaa

SEQ ID NO: 940728 - RNA, 21 nt, Homo sapiens
aaucauuuguuuacauuugau

SEQ ID NO: 940729 - RNA, 17 nt, Homo sapiens
aauccuuccacuaucau

SEQ ID NO: 940730 - RNA, 19 nt, Homo sapiens
aauccuucuauucuagccu

SEQ ID NO: 940731 - RNA, 21 nt, Homo sapiens
aaucuaaaggaaagaugaugg

SEQ ID NO: 940732 - RNA, 16 nt, Homo sapiens
aaucuaagcagcuuau

SEQ ID NO: 940733 - RNA, 21 nt, Homo sapiens
aaucuauccauugaacuaaaa

SEQ ID NO: 940734 - RNA, 13 nt, Homo sapiens
aaucucccaguga

SEQ ID NO: 940735 - RNA, 21 nt, Homo sapiens
aaugaaaacaguguguaaaca

SEQ ID NO: 940736 - RNA, 19 nt, Homo sapiens
aaugaacuuguuacuugca

SEQ ID NO: 940737 - RNA, 21 nt, Homo sapiens
aaugacacccaugccagagag

SEQ ID NO: 940738 - RNA, 18 nt, Homo sapiens
aaugacauguuccuuuaa

SEQ ID NO: 940739 - RNA, 17 nt, Homo sapiens
aaugacugugucugccu

SEQ ID NO: 940740 - RNA, 21 nt, Homo sapiens
aaugagacuuucuaaaucaaa

SEQ ID NO: 940741 - RNA, 13 nt, Homo sapiens
aaugcaaccauuu

SEQ ID NO: 940742 - RNA, 13 nt, Homo sapiens
aaugcacuuucua

SEQ ID NO: 940743 - RNA, 18 nt, Homo sapiens
aaugcuugcucaggcuca

SEQ ID NO: 940744 - RNA, 22 nt, Homo sapiens
aauggaggaacuuuccaaacac

SEQ ID NO: 940745 - RNA, 17 nt, Homo sapiens
aauguaucaaauacauu

SEQ ID NO: 940746 - RNA, 13 nt, Homo sapiens
aauguauuuacuu

SEQ ID NO: 940747 - RNA, 18 nt, Homo sapiens
aaugucauagucuugaaa

SEQ ID NO: 940748 - RNA, 12 nt, Homo sapiens
aauguccagcca

SEQ ID NO: 940749 - RNA, 14 nt, Homo sapiens
aauguccauaugcu

SEQ ID NO: 940750 - RNA, 14 nt, Homo sapiens
aaugugcuuucuaa

SEQ ID NO: 940751 - RNA, 15 nt, Homo sapiens
aauguugcaauguga

SEQ ID NO: 940752 - RNA, 16 nt, Homo sapiens
aauguugggacugcua

SEQ ID NO: 940753 - RNA, 17 nt, Homo sapiens
aauuaaaaaagcauacu

SEQ ID NO: 940754 - RNA, 15 nt, Homo sapiens
aauuaaccuuacuaa

SEQ ID NO: 940755 - RNA, 17 nt, Homo sapiens
aauuacggaaaaugccu

SEQ ID NO: 940756 - RNA, 15 nt, Homo sapiens
aauuacugugaauug

SEQ ID NO: 940757 - RNA, 20 nt, Homo sapiens
aauuagagagcaucugcaac

SEQ ID NO: 940758 - RNA, 19 nt, Homo sapiens
aauuaguguggcuaaccaa

SEQ ID NO: 940759 - RNA, 16 nt, Homo sapiens
aauuauacuacuuugu

SEQ ID NO: 940760 - RNA, 17 nt, Homo sapiens
aauuauauuguccuccc

SEQ ID NO: 940761 - RNA, 13 nt, Homo sapiens
aauuaugaccaug

SEQ ID NO: 940762 - RNA, 16 nt, Homo sapiens
aauuauuucugucaca

SEQ ID NO: 940763 - RNA, 17 nt, Homo sapiens
aauuauuuuuguucaua

SEQ ID NO: 940764 - RNA, 15 nt, Homo sapiens
aauucagaugcuguu

SEQ ID NO: 940765 - RNA, 12 nt, Homo sapiens
aauucagugucu

SEQ ID NO: 940766 - RNA, 23 nt, Homo sapiens
aauucauuguguuaccuguagau

SEQ ID NO: 940767 - RNA, 20 nt, Homo sapiens
aauuccugauggaaaaugca

SEQ ID NO: 940768 - RNA, 18 nt, Homo sapiens
aauucugagccugauauu

SEQ ID NO: 940769 - RNA, 18 nt, Homo sapiens
aaaauucauuucuaauua

SEQ ID NO: 940770 - RNA, 22 nt, Homo sapiens
aaaauuuaaaaaguuagccagg

SEQ ID NO: 940771 - RNA, 14 nt, Homo sapiens
aaacaagccaaaga

SEQ ID NO: 940772 - RNA, 18 nt, Homo sapiens
aaacacacuacuaccucu

SEQ ID NO: 940773 - RNA, 14 nt, Homo sapiens
aaacaccuccucau

SEQ ID NO: 940774 - RNA, 23 nt, Homo sapiens
aaacacucuugaauagacuucca

SEQ ID NO: 940775 - RNA, 21 nt, Homo sapiens
aaacagggcugccuucuggcc

SEQ ID NO: 940776 - RNA, 22 nt, Homo sapiens
aaacagggcugccuucuggccu

SEQ ID NO: 940777 - RNA, 22 nt, Homo sapiens
aaacauuaaaauauaaucucua

SEQ ID NO: 940778 - RNA, 15 nt, Homo sapiens
aaaccagaaaagcaa

SEQ ID NO: 940779 - RNA, 17 nt, Homo sapiens
aaaccagaaaagcaaua

SEQ ID NO: 940780 - RNA, 18 nt, Homo sapiens
aaacccagagcggaagga

SEQ ID NO: 940781 - RNA, 19 nt, Homo sapiens
aaaccccaucuuuacuaaa

SEQ ID NO: 940782 - RNA, 20 nt, Homo sapiens
aaaccugccccuuggcugcu

SEQ ID NO: 940783 - RNA, 18 nt, Homo sapiens
aaaccuuggccucugcua

SEQ ID NO: 940784 - RNA, 16 nt, Homo sapiens
aaacgggaacaugccc

SEQ ID NO: 940785 - RNA, 12 nt, Homo sapiens
aaacuaaggauu

SEQ ID NO: 940786 - RNA, 22 nt, Homo sapiens
aaacuaauuuaguaauagccug

SEQ ID NO: 940787 - RNA, 15 nt, Homo sapiens
aaacucagcaucaaa

SEQ ID NO: 940788 - RNA, 16 nt, Homo sapiens
aaacuccagaugccac

SEQ ID NO: 940789 - RNA, 19 nt, Homo sapiens
aaacuguuccaaucaugaa

SEQ ID NO: 940790 - RNA, 17 nt, Homo sapiens
aaacuuauuuacaaaua

SEQ ID NO: 940791 - RNA, 14 nt, Homo sapiens
aaacuucauaugua

SEQ ID NO: 940792 - RNA, 16 nt, Homo sapiens
aaagaaaagaaaaaga

SEQ ID NO: 940793 - RNA, 15 nt, Homo sapiens
aaagaaaaguagaaa

SEQ ID NO: 940794 - RNA, 18 nt, Homo sapiens
aaagaaauacaguacugu

SEQ ID NO: 940795 - RNA, 17 nt, Homo sapiens
aaagaacgcugauuuaa

SEQ ID NO: 940796 - RNA, 21 nt, Homo sapiens
aaagaagcaaucuccuuacug

SEQ ID NO: 940797 - RNA, 23 nt, Homo sapiens
aaagaagcaaucuccuuacugug

SEQ ID NO: 940798 - RNA, 22 nt, Homo sapiens
aaagaauuggccaggcauggug

SEQ ID NO: 940799 - RNA, 14 nt, Homo sapiens
aaagaccaggccaa

SEQ ID NO: 940800 - RNA, 20 nt, Homo sapiens
aaagaccugaauaccacuua

SEQ ID NO: 940801 - RNA, 12 nt, Homo sapiens
acaauaaacccu

SEQ ID NO: 940802 - RNA, 23 nt, Homo sapiens
acaauaaagauuguuuuaaagag

SEQ ID NO: 940803 - RNA, 15 nt, Homo sapiens
acaaucaaaacacac

SEQ ID NO: 940804 - RNA, 18 nt, Homo sapiens
acaaucggcugcauugaa

SEQ ID NO: 940805 - RNA, 12 nt, Homo sapiens
acaaugcugauu

SEQ ID NO: 940806 - RNA, 14 nt, Homo sapiens
acaauucauugugu

SEQ ID NO: 940807 - RNA, 17 nt, Homo sapiens
acacaaaccacaccaca

SEQ ID NO: 940808 - RNA, 13 nt, Homo sapiens
acacacacaccaa

SEQ ID NO: 940809 - RNA, 13 nt, Homo sapiens
acacacagugauu

SEQ ID NO: 940810 - RNA, 17 nt, Homo sapiens
acacagcaacaaugacu

SEQ ID NO: 940811 - RNA, 11 nt, Homo sapiens
acacagugauu

SEQ ID NO: 940812 - RNA, 18 nt, Homo sapiens
acaccuguagucccagcu

SEQ ID NO: 940813 - RNA, 15 nt, Homo sapiens
acacggacugugcau

SEQ ID NO: 940814 - RNA, 23 nt, Homo sapiens
acacucaaaacgcuacugaguca

SEQ ID NO: 940815 - RNA, 18 nt, Homo sapiens
acacuuguuguccaguug

SEQ ID NO: 940816 - RNA, 18 nt, Homo sapiens
acagaagggaaauuucaa

SEQ ID NO: 940817 - RNA, 13 nt, Homo sapiens
acagaaugugucu

SEQ ID NO: 940818 - RNA, 16 nt, Homo sapiens
acagacugauguguau

SEQ ID NO: 940819 - RNA, 20 nt, Homo sapiens
acagagcaagacuccaucuc

SEQ ID NO: 940820 - RNA, 22 nt, Homo sapiens
acagaggagaugccacuucuca

SEQ ID NO: 940821 - RNA, 23 nt, Homo sapiens
acagauucugcuagccuguucuu

SEQ ID NO: 940822 - RNA, 21 nt, Homo sapiens
acagcuaguagacaugaauuu

SEQ ID NO: 940823 - RNA, 22 nt, Homo sapiens
acagcuaguagacaugaauuuu

SEQ ID NO: 940824 - RNA, 21 nt, Homo sapiens
acaggaggaagacaggcaaau

SEQ ID NO: 940825 - RNA, 17 nt, Homo sapiens
acaguaagaacaucaua

SEQ ID NO: 940826 - RNA, 17 nt, Homo sapiens
acaguaaguccaguaaa

SEQ ID NO: 940827 - RNA, 12 nt, Homo sapiens
acaguaccugau

SEQ ID NO: 940828 - RNA, 13 nt, Homo sapiens
acagugacuguac

SEQ ID NO: 940829 - RNA, 13 nt, Homo sapiens
acaguggacaaag

SEQ ID NO: 940830 - RNA, 18 nt, Homo sapiens
acaguuaaagaagcaauc

SEQ ID NO: 940831 - RNA, 22 nt, Homo sapiens
acauacaccucgucaagagcau

SEQ ID NO: 940832 - RNA, 20 nt, Homo sapiens
acauacagagguaacuauca

SEQ ID NO: 940833 - RNA, 19 nt, Homo sapiens
acauacuuuaucaaugugu

SEQ ID NO: 940834 - RNA, 14 nt, Homo sapiens
acauauaguguaca

SEQ ID NO: 940835 - RNA, 17 nt, Homo sapiens
acauaugaucugucugu

SEQ ID NO: 940836 - RNA, 11 nt, Homo sapiens
acaucauaaaa

SEQ ID NO: 940837 - RNA, 22 nt, Homo sapiens
acaucauuacagauucugcuag

SEQ ID NO: 940838 - RNA, 23 nt, Homo sapiens
acaucucccuuuuccaugacugu

SEQ ID NO: 940839 - RNA, 15 nt, Homo sapiens
acaucuggacacugg

SEQ ID NO: 940840 - RNA, 20 nt, Homo sapiens
acaucuuuagugucugagcu

SEQ ID NO: 940841 - RNA, 14 nt, Homo sapiens
acaugccaauuuca

SEQ ID NO: 940842 - RNA, 20 nt, Homo sapiens
acauuauaaaaauugacaau

SEQ ID NO: 940843 - RNA, 16 nt, Homo sapiens
acauugggagucugua

SEQ ID NO: 940844 - RNA, 16 nt, Homo sapiens
acauugguucuuucau

SEQ ID NO: 940845 - RNA, 16 nt, Homo sapiens
acauuuaaaccuuuua

SEQ ID NO: 940846 - RNA, 21 nt, Homo sapiens
acauuuagcugugcucagaag

SEQ ID NO: 940847 - RNA, 13 nt, Homo sapiens
accaaaugugcuu

SEQ ID NO: 940848 - RNA, 23 nt, Homo sapiens
accaacaggcuaccaacuuguau

SEQ ID NO: 940849 - RNA, 17 nt, Homo sapiens
accaacuacuaccugua

SEQ ID NO: 940850 - RNA, 22 nt, Homo sapiens
accaacugaaguggcuaaagag

SEQ ID NO: 940851 - RNA, 17 nt, Homo sapiens
accaagagauaacugua

SEQ ID NO: 940852 - RNA, 14 nt, Homo sapiens
accaccuaauccuu

SEQ ID NO: 940853 - RNA, 16 nt, Homo sapiens
accacuaccagccagc

SEQ ID NO: 940854 - RNA, 21 nt, Homo sapiens
accacugacagcuagacaccu

SEQ ID NO: 940855 - RNA, 14 nt, Homo sapiens
accacuuaccucaa

SEQ ID NO: 940856 - RNA, 20 nt, Homo sapiens
accagccguauuuuacauga

SEQ ID NO: 940857 - RNA, 21 nt, Homo sapiens
accagccguauuuuacaugaa

SEQ ID NO: 940858 - RNA, 13 nt, Homo sapiens
accagccucacaa

SEQ ID NO: 940859 - RNA, 14 nt, Homo sapiens
accauaacugacaa

SEQ ID NO: 940860 - RNA, 15 nt, Homo sapiens
acccaugccagagag

SEQ ID NO: 940861 - RNA, 16 nt, Homo sapiens
acccauuucaaugugu

SEQ ID NO: 940862 - RNA, 16 nt, Homo sapiens
accccaaccccaggga

SEQ ID NO: 940863 - RNA, 21 nt, Homo sapiens
accccaggcaaggaugucuga

SEQ ID NO: 940864 - RNA, 13 nt, Homo sapiens
acccccagcucaa

SEQ ID NO: 940865 - RNA, 15 nt, Homo sapiens
acccccagcucaaug

SEQ ID NO: 940866 - RNA, 13 nt, Homo sapiens
acccgauuccacc

SEQ ID NO: 940867 - RNA, 16 nt, Homo sapiens
acccggagagugcucc

SEQ ID NO: 940868 - RNA, 22 nt, Homo sapiens
acccuccaagucuguaccucaa

SEQ ID NO: 940869 - RNA, 22 nt, Homo sapiens
acccuccagagacaacagguaa

SEQ ID NO: 940870 - RNA, 13 nt, Homo sapiens
acccucucagcuc

SEQ ID NO: 940871 - RNA, 21 nt, Homo sapiens
acccugacacggacugugcau

SEQ ID NO: 940872 - RNA, 18 nt, Homo sapiens
acccugcuuuuugcuucu

SEQ ID NO: 940873 - RNA, 15 nt, Homo sapiens
accgaaaucccucag

SEQ ID NO: 940874 - RNA, 23 nt, Homo sapiens
accuagucagguuagcugaaccg

SEQ ID NO: 940875 - RNA, 15 nt, Homo sapiens
accucaaaggagcaa

SEQ ID NO: 940876 - RNA, 22 nt, Homo sapiens
accucaaaggagcaagccuuga

SEQ ID NO: 940877 - RNA, 21 nt, Homo sapiens
accucccccuuucacacugga

SEQ ID NO: 940878 - RNA, 13 nt, Homo sapiens
accuccucuguga

SEQ ID NO: 940879 - RNA, 17 nt, Homo sapiens
accuccuguguggaaga

SEQ ID NO: 940880 - RNA, 14 nt, Homo sapiens
accucucacugccu

SEQ ID NO: 940881 - RNA, 15 nt, Homo sapiens
accucuuucaggguu

SEQ ID NO: 940882 - RNA, 11 nt, Homo sapiens
accugauacuu

SEQ ID NO: 940883 - RNA, 16 nt, Homo sapiens
accuggauaacuguaa

SEQ ID NO: 940884 - RNA, 15 nt, Homo sapiens
accugggcauuccuu

SEQ ID NO: 940885 - RNA, 13 nt, Homo sapiens
accuuggugcuua

SEQ ID NO: 940886 - RNA, 21 nt, Homo sapiens
accuuucacgaacaugggcau

SEQ ID NO: 940887 - RNA, 18 nt, Homo sapiens
accuuuggcugguagcag

SEQ ID NO: 940888 - RNA, 17 nt, Homo sapiens
acgagacccccauccag

SEQ ID NO: 940889 - RNA, 15 nt, Homo sapiens
acgagggucccgauc

SEQ ID NO: 940890 - RNA, 15 nt, Homo sapiens
acgccuccuggccag

SEQ ID NO: 940891 - RNA, 13 nt, Homo sapiens
acgcucauuacua

SEQ ID NO: 940892 - RNA, 18 nt, Homo sapiens
acgcucauuacuacccuc

SEQ ID NO: 940893 - RNA, 15 nt, Homo sapiens
acggauggugcaugg

SEQ ID NO: 940894 - RNA, 15 nt, Homo sapiens
acgguguuuugccau

SEQ ID NO: 940895 - RNA, 20 nt, Homo sapiens
acgguuucgaagucauuaaa

SEQ ID NO: 940896 - RNA, 14 nt, Homo sapiens
acgucacugcacuc

SEQ ID NO: 940897 - RNA, 22 nt, Homo sapiens
acguccuuucccuacuccaugg

SEQ ID NO: 940898 - RNA, 15 nt, Homo sapiens
acgucgggcauucau

SEQ ID NO: 940899 - RNA, 20 nt, Homo sapiens
acgugauccucucaccucag

SEQ ID NO: 940900 - RNA, 17 nt, Homo sapiens
acguuuuggucacauau

SEQ ID NO: 940901 - RNA, 17 nt, Homo sapiens
acuaaaaaguauugcau

SEQ ID NO: 940902 - RNA, 20 nt, Homo sapiens
acuaauuauacuacuuuguu

SEQ ID NO: 940903 - RNA, 17 nt, Homo sapiens
acuagaagcaacuagga

SEQ ID NO: 940904 - RNA, 23 nt, Homo sapiens
acuaguuuuuccuaucauguuaa

SEQ ID NO: 940905 - RNA, 15 nt, Homo sapiens
acuauauuaaucacc

SEQ ID NO: 940906 - RNA, 21 nt, Homo sapiens
acuauuuaaagccuccucauc

SEQ ID NO: 940907 - RNA, 23 nt, Homo sapiens
acucaagguggacgugcguucug

SEQ ID NO: 940908 - RNA, 16 nt, Homo sapiens
auuuugaaaaaugaga

SEQ ID NO: 940909 - RNA, 18 nt, Homo sapiens
auuuuguaauaauaaaga

SEQ ID NO: 940910 - RNA, 15 nt, Homo sapiens
auuuuuagaauuaaa

SEQ ID NO: 940911 - RNA, 14 nt, Homo sapiens
auuuuucaagagau

SEQ ID NO: 940912 - RNA, 17 nt, Homo sapiens
auuuuuguuagcaaaga

SEQ ID NO: 940913 - RNA, 21 nt, Homo sapiens
auuuuuguuagcaaagauuaa

SEQ ID NO: 940914 - RNA, 18 nt, Homo sapiens
auuuuuuaauccuaccuc

SEQ ID NO: 940915 - RNA, 19 nt, Homo sapiens
auuuuuuuuguaacuucaa

SEQ ID NO: 940916 - RNA, 18 nt, Homo sapiens
caaaacaauuaaucauuu

SEQ ID NO: 940917 - RNA, 19 nt, Homo sapiens
caaaaccuacccucaguga

SEQ ID NO: 940918 - RNA, 20 nt, Homo sapiens
caaaaccuacccucagugag

SEQ ID NO: 940919 - RNA, 16 nt, Homo sapiens
caaaauauuucaguga

SEQ ID NO: 940920 - RNA, 21 nt, Homo sapiens
caaacaccacuuuacuugugu

SEQ ID NO: 940921 - RNA, 17 nt, Homo sapiens
caaaccacaauauccag

SEQ ID NO: 940922 - RNA, 21 nt, Homo sapiens
caaacuuggugaaacuacauc

SEQ ID NO: 940923 - RNA, 18 nt, Homo sapiens
caaagacaucagucucca

SEQ ID NO: 940924 - RNA, 15 nt, Homo sapiens
caaagaccuaccucc

SEQ ID NO: 940925 - RNA, 17 nt, Homo sapiens
caaagaggcugccccuc

SEQ ID NO: 940926 - RNA, 14 nt, Homo sapiens
caaagccaugccaa

SEQ ID NO: 940927 - RNA, 17 nt, Homo sapiens
caaagugccuugcucau

SEQ ID NO: 940928 - RNA, 18 nt, Homo sapiens
caaauauuaggcuuaaaa

SEQ ID NO: 940929 - RNA, 20 nt, Homo sapiens
caaaucauccauccuugcca

SEQ ID NO: 940930 - RNA, 20 nt, Homo sapiens
caaaugugcuggucacccuu

SEQ ID NO: 940931 - RNA, 17 nt, Homo sapiens
caaauugaugugcccua

SEQ ID NO: 940932 - RNA, 15 nt, Homo sapiens
caacaagaaauaaua

SEQ ID NO: 940933 - RNA, 18 nt, Homo sapiens
caacagaaaccagaaaag

SEQ ID NO: 940934 - RNA, 21 nt, Homo sapiens
caacauggcaaaaccccaucu

SEQ ID NO: 940935 - RNA, 15 nt, Homo sapiens
caacauucauagucu

SEQ ID NO: 940936 - RNA, 16 nt, Homo sapiens
caacauuguagccuca

SEQ ID NO: 940937 - RNA, 16 nt, Homo sapiens
caaccucaaaggagca

SEQ ID NO: 940938 - RNA, 15 nt, Homo sapiens
caaccugggcauucc

SEQ ID NO: 940939 - RNA, 14 nt, Homo sapiens
caaccuuucccuca

SEQ ID NO: 940940 - RNA, 14 nt, Homo sapiens
caacgcucccagac

SEQ ID NO: 940941 - RNA, 11 nt, Homo sapiens
caacuaccuga

SEQ ID NO: 940942 - RNA, 12 nt, Homo sapiens
caacuaccugag

SEQ ID NO: 940943 - RNA, 15 nt, Homo sapiens
caacucauuuuuaca

SEQ ID NO: 940944 - RNA, 22 nt, Homo sapiens
caacucuguaaauauguaugua

SEQ ID NO: 940945 - RNA, 21 nt, Homo sapiens
caagacuccaucucaaaaaag

SEQ ID NO: 940946 - RNA, 17 nt, Homo sapiens
caagagcguugucuacc

SEQ ID NO: 940947 - RNA, 18 nt, Homo sapiens
caagaguggacucagugg

SEQ ID NO: 940948 - RNA, 21 nt, Homo sapiens
caagauacugcuacuguaauu

SEQ ID NO: 940949 - RNA, 16 nt, Homo sapiens
caagccugucuucaga

SEQ ID NO: 940950 - RNA, 17 nt, Homo sapiens
caagccugucuucagag

SEQ ID NO: 940951 - RNA, 19 nt, Homo sapiens
caaggaugucugagaccac

SEQ ID NO: 940952 - RNA, 18 nt, Homo sapiens
caaggcacuucauguaaa

SEQ ID NO: 940953 - RNA, 21 nt, Homo sapiens
caaguauugucgguuaccucu

SEQ ID NO: 940954 - RNA, 13 nt, Homo sapiens
caagucaccugca

SEQ ID NO: 940955 - RNA, 17 nt, Homo sapiens
caagucuguaccucaaa

SEQ ID NO: 940956 - RNA, 14 nt, Homo sapiens
caauaaaaguguga

SEQ ID NO: 940957 - RNA, 15 nt, Homo sapiens
caauaaacauaacag

SEQ ID NO: 940958 - RNA, 16 nt, Homo sapiens
caauaaagugaucugu

SEQ ID NO: 940959 - RNA, 12 nt, Homo sapiens
caauacuacuga

SEQ ID NO: 940960 - RNA, 21 nt, Homo sapiens
caauagugaaaugccacaccu

SEQ ID NO: 940961 - RNA, 15 nt, Homo sapiens
caaucucucucugug

SEQ ID NO: 940962 - RNA, 12 nt, Homo sapiens
caaucucuuaau

SEQ ID NO: 940963 - RNA, 14 nt, Homo sapiens
caaucuuugacaau

SEQ ID NO: 940964 - RNA, 17 nt, Homo sapiens
caaugacacccaugcca

SEQ ID NO: 940965 - RNA, 19 nt, Homo sapiens
caaugacuuaaccauauaa

SEQ ID NO: 940966 - RNA, 18 nt, Homo sapiens
caauugacauaggcaaua

SEQ ID NO: 940967 - RNA, 14 nt, Homo sapiens
caauuuauucugau

SEQ ID NO: 940968 - RNA, 14 nt, Homo sapiens
cacaacagugaaaa

SEQ ID NO: 940969 - RNA, 15 nt, Homo sapiens
cacaagcaugaagug

SEQ ID NO: 940970 - RNA, 15 nt, Homo sapiens
cacaauuauuccaaa

SEQ ID NO: 940971 - RNA, 12 nt, Homo sapiens
cacacacaguga

SEQ ID NO: 940972 - RNA, 20 nt, Homo sapiens
cacacaccaaguaccaguau

SEQ ID NO: 940973 - RNA, 19 nt, Homo sapiens
cacacaugccacuaugagc

SEQ ID NO: 940974 - RNA, 23 nt, Homo sapiens
cacaccccuguacccccccaggg

SEQ ID NO: 940975 - RNA, 22 nt, Homo sapiens
cacaccugggcauuuggugaga

SEQ ID NO: 940976 - RNA, 12 nt, Homo sapiens
cacagauaagua

SEQ ID NO: 940977 - RNA, 18 nt, Homo sapiens
caugaaaauaaacuugaa

SEQ ID NO: 940978 - RNA, 11 nt, Homo sapiens
caugacugugg

SEQ ID NO: 940979 - RNA, 16 nt, Homo sapiens
caugcaguaugugcag

SEQ ID NO: 940980 - RNA, 21 nt, Homo sapiens
caugccuuaaucccagcacuu

SEQ ID NO: 940981 - RNA, 21 nt, Homo sapiens
cauggaacagcauuacccucc

SEQ ID NO: 940982 - RNA, 22 nt, Homo sapiens
cauggcccuaccagacacugcu

SEQ ID NO: 940983 - RNA, 23 nt, Homo sapiens
cauggccuuggcaggcugcugga

SEQ ID NO: 940984 - RNA, 15 nt, Homo sapiens
caugggccucaguca

SEQ ID NO: 940985 - RNA, 13 nt, Homo sapiens
caugucacauuua

SEQ ID NO: 940986 - RNA, 14 nt, Homo sapiens
caugugaagagaau

SEQ ID NO: 940987 - RNA, 19 nt, Homo sapiens
caugugcgcgcgugcaugu

SEQ ID NO: 940988 - RNA, 20 nt, Homo sapiens
caugugcggcggcuaccuga

SEQ ID NO: 940989 - RNA, 15 nt, Homo sapiens
caugugcugccugca

SEQ ID NO: 940990 - RNA, 23 nt, Homo sapiens
cauguuuauaaaucuuaugcucu

SEQ ID NO: 940991 - RNA, 15 nt, Homo sapiens
cauguuugcaccugu

SEQ ID NO: 940992 - RNA, 19 nt, Homo sapiens
cauguuugcaccugugcau

SEQ ID NO: 940993 - RNA, 21 nt, Homo sapiens
cauguuuuccgugaaaacgga

SEQ ID NO: 940994 - RNA, 13 nt, Homo sapiens
cauuaacuugaaa

SEQ ID NO: 940995 - RNA, 15 nt, Homo sapiens
cauuaaucagauuag

SEQ ID NO: 940996 - RNA, 15 nt, Homo sapiens
cauuacagauucugc

SEQ ID NO: 940997 - RNA, 22 nt, Homo sapiens
cauuccagccacuggcugcuaa

SEQ ID NO: 940998 - RNA, 14 nt, Homo sapiens
cauuccugacaaag

SEQ ID NO: 940999 - RNA, 21 nt, Homo sapiens
cauucuauuccauguuugcac

SEQ ID NO: 941000 - RNA, 22 nt, Homo sapiens
cauucuuuucuucugcuucccu

SEQ ID NO: 941001 - RNA, 23 nt, Homo sapiens
cauugaugagcaagacauacuua

SEQ ID NO: 941002 - RNA, 17 nt, Homo sapiens
cauugcucuugagucuu

SEQ ID NO: 941003 - RNA, 13 nt, Homo sapiens
cauuggaagccau

SEQ ID NO: 941004 - RNA, 14 nt, Homo sapiens
cauuguaaaagcau

SEQ ID NO: 941005 - RNA, 20 nt, Homo sapiens
cauuguaaaagcauuuugua

SEQ ID NO: 941006 - RNA, 14 nt, Homo sapiens
cauuguagccucaa

SEQ ID NO: 941007 - RNA, 16 nt, Homo sapiens
cauuguagccucaauc

SEQ ID NO: 941008 - RNA, 18 nt, Homo sapiens
cauuguggucauagcacc

SEQ ID NO: 941009 - RNA, 17 nt, Homo sapiens
cauuuaauaucuuugau

SEQ ID NO: 941010 - RNA, 21 nt, Homo sapiens
cauuucugggcuccuggggcu

SEQ ID NO: 941011 - RNA, 15 nt, Homo sapiens
ccaaaaucucuuaaa

SEQ ID NO: 941012 - RNA, 23 nt, Homo sapiens
ccaaacaggacagcacugggaac

SEQ ID NO: 941013 - RNA, 20 nt, Homo sapiens
ccaaauaauuguugugugua

SEQ ID NO: 941014 - RNA, 15 nt, Homo sapiens
ccaaccuggacuugu

SEQ ID NO: 941015 - RNA, 23 nt, Homo sapiens
ccaacguucgauuucuaccucag

SEQ ID NO: 941016 - RNA, 16 nt, Homo sapiens
ccaacucuuucucucu

SEQ ID NO: 941017 - RNA, 20 nt, Homo sapiens
ccaacuuuccccacguuaaa

SEQ ID NO: 941018 - RNA, 22 nt, Homo sapiens
ccaagagaacucgcgcucagua

SEQ ID NO: 941019 - RNA, 22 nt, Homo sapiens
ccaaggaaucagcaggaugugu

SEQ ID NO: 941020 - RNA, 18 nt, Homo sapiens
ccaagggcagaggggugc

SEQ ID NO: 941021 - RNA, 19 nt, Homo sapiens
ccaaugacacccaugccag

SEQ ID NO: 941022 - RNA, 16 nt, Homo sapiens
ccaccaaaugugcuuu

SEQ ID NO: 941023 - RNA, 12 nt, Homo sapiens
ccaccccaagag

SEQ ID NO: 941024 - RNA, 13 nt, Homo sapiens
ccaccccaagaga

SEQ ID NO: 941025 - RNA, 14 nt, Homo sapiens
ccaccccaagagaa

SEQ ID NO: 941026 - RNA, 13 nt, Homo sapiens
ccaccuagacugu

SEQ ID NO: 941027 - RNA, 13 nt, Homo sapiens
ccacgcugaccau

SEQ ID NO: 941028 - RNA, 14 nt, Homo sapiens
ccacuaagaauuca

SEQ ID NO: 941029 - RNA, 21 nt, Homo sapiens
ccacuaccagccagccucaga

SEQ ID NO: 941030 - RNA, 16 nt, Homo sapiens
ccacucacuuugcaau

SEQ ID NO: 941031 - RNA, 19 nt, Homo sapiens
ccacuguccggaaauucau

SEQ ID NO: 941032 - RNA, 13 nt, Homo sapiens
ccacuuaccucaa

SEQ ID NO: 941033 - RNA, 18 nt, Homo sapiens
ccacuucucacucaccac

SEQ ID NO: 941034 - RNA, 20 nt, Homo sapiens
ccacuuuucugcuguugccu

SEQ ID NO: 941035 - RNA, 21 nt, Homo sapiens
ccagaaaaccucuccugaccc

SEQ ID NO: 941036 - RNA, 22 nt, Homo sapiens
ccagaaugcugcaggacuugag

SEQ ID NO: 941037 - RNA, 22 nt, Homo sapiens
ccagacaucuggacacugggca

SEQ ID NO: 941038 - RNA, 12 nt, Homo sapiens
ccagacuucaaa

SEQ ID NO: 941039 - RNA, 22 nt, Homo sapiens
ccagagcggaaggagggagcuc

SEQ ID NO: 941040 - RNA, 21 nt, Homo sapiens
ccagcaguuuccugccagaua

SEQ ID NO: 941041 - RNA, 18 nt, Homo sapiens
ccagccuccagggcauug

SEQ ID NO: 941042 - RNA, 22 nt, Homo sapiens
ccagccuccagggcauugcuca

SEQ ID NO: 941043 - RNA, 20 nt, Homo sapiens
ccagccuggccaacauggca

SEQ ID NO: 941044 - RNA, 22 nt, Homo sapiens
ccagccuggccaacauggugaa

SEQ ID NO: 941045 - RNA, 15 nt, Homo sapiens
ccagcuauuuacaca

SEQ ID NO: 941046 - RNA, 13 nt, Homo sapiens
ccagcuggcagac

SEQ ID NO: 941047 - RNA, 12 nt, Homo sapiens
ccaggagccuca

SEQ ID NO: 941048 - RNA, 14 nt, Homo sapiens
ccaggagccucacu

SEQ ID NO: 941049 - RNA, 17 nt, Homo sapiens
ccaggagccucacuggg

SEQ ID NO: 941050 - RNA, 18 nt, Homo sapiens
ccaggauuacuagucaaa

SEQ ID NO: 941051 - RNA, 14 nt, Homo sapiens
ccaggccaauguca

SEQ ID NO: 941052 - RNA, 15 nt, Homo sapiens
ccaggccaaugucag

SEQ ID NO: 941053 - RNA, 18 nt, Homo sapiens
ccagggaacccaacaguc

SEQ ID NO: 941054 - RNA, 23 nt, Homo sapiens
ccagggaugggggaugggccagg

SEQ ID NO: 941055 - RNA, 16 nt, Homo sapiens
ccagggcauugcucag

SEQ ID NO: 941056 - RNA, 12 nt, Homo sapiens
ccaggugcaauu

SEQ ID NO: 941057 - RNA, 23 nt, Homo sapiens
ccagguuuuacacuugcaucucu

SEQ ID NO: 941058 - RNA, 22 nt, Homo sapiens
ccaguaaaaucaaaugugcauc

SEQ ID NO: 941059 - RNA, 14 nt, Homo sapiens
ccaguaaagccuua

SEQ ID NO: 941060 - RNA, 22 nt, Homo sapiens
ccaguaaggucaugugcuucca

SEQ ID NO: 941061 - RNA, 23 nt, Homo sapiens
ccaguaauggaaugaagguaaua

SEQ ID NO: 941062 - RNA, 14 nt, Homo sapiens
ccagugacaacauc

SEQ ID NO: 941063 - RNA, 19 nt, Homo sapiens
ccaguucauugcacuuuga

SEQ ID NO: 941064 - RNA, 12 nt, Homo sapiens
ccauaacaaccu

SEQ ID NO: 941065 - RNA, 19 nt, Homo sapiens
ccauacccccacaugccaa

SEQ ID NO: 941066 - RNA, 18 nt, Homo sapiens
ccauccagccaccaccua

SEQ ID NO: 941067 - RNA, 17 nt, Homo sapiens
ccaugcguccuggucaa

SEQ ID NO: 941068 - RNA, 13 nt, Homo sapiens
ccauggugagcuc

SEQ ID NO: 941069 - RNA, 19 nt, Homo sapiens
ccauggugagcucugggaa

SEQ ID NO: 941070 - RNA, 21 nt, Homo sapiens
ccauguaugaagccaaauauu

SEQ ID NO: 941071 - RNA, 15 nt, Homo sapiens
ccauucugucuuccu

SEQ ID NO: 941072 - RNA, 16 nt, Homo sapiens
ccauugcauuccagcc

SEQ ID NO: 941073 - RNA, 13 nt, Homo sapiens
ccauugcucuuga

SEQ ID NO: 941074 - RNA, 15 nt, Homo sapiens
cccaacccaaugggc

SEQ ID NO: 941075 - RNA, 23 nt, Homo sapiens
cccaagauuauuaaaagaugucu

SEQ ID NO: 941076 - RNA, 18 nt, Homo sapiens
cccagaacuccauaccau

SEQ ID NO: 941077 - RNA, 20 nt, Homo sapiens
cccagacaucuggacacugg

SEQ ID NO: 941078 - RNA, 23 nt, Homo sapiens
cccagagcgaggaaaggauuuua

SEQ ID NO: 941079 - RNA, 18 nt, Homo sapiens
cccagccauccagggggc

SEQ ID NO: 941080 - RNA, 13 nt, Homo sapiens
cccagccucuggc

SEQ ID NO: 941081 - RNA, 20 nt, Homo sapiens
cccagggacugcagguugug

SEQ ID NO: 941082 - RNA, 22 nt, Homo sapiens
cccaguaaaaucaaaugugcau

SEQ ID NO: 941083 - RNA, 23 nt, Homo sapiens
cccaguaaggucaugugcuucca

SEQ ID NO: 941084 - RNA, 16 nt, Homo sapiens
cuuucccuacuccaug

SEQ ID NO: 941085 - RNA, 14 nt, Homo sapiens
cuuucccucaucca

SEQ ID NO: 941086 - RNA, 23 nt, Homo sapiens
cuuucuaggagggagacacuggc

SEQ ID NO: 941087 - RNA, 14 nt, Homo sapiens
cuuucuucccauga

SEQ ID NO: 941088 - RNA, 18 nt, Homo sapiens
cuuucuuuagcaugcuac

SEQ ID NO: 941089 - RNA, 23 nt, Homo sapiens
cuuugagaaggauaggccuucau

SEQ ID NO: 941090 - RNA, 11 nt, Homo sapiens
cuuugcacuug

SEQ ID NO: 941091 - RNA, 14 nt, Homo sapiens
cuuugcagcacagc

SEQ ID NO: 941092 - RNA, 20 nt, Homo sapiens
cuuuggagaaaugcuuagaa

SEQ ID NO: 941093 - RNA, 18 nt, Homo sapiens
cuuuguauuguauauuac

SEQ ID NO: 941094 - RNA, 14 nt, Homo sapiens
cuuuguuaggauuu

SEQ ID NO: 941095 - RNA, 17 nt, Homo sapiens
cuuuucccauugccaug

SEQ ID NO: 941096 - RNA, 18 nt, Homo sapiens
cuuuucccauugccaugc

SEQ ID NO: 941097 - RNA, 22 nt, Homo sapiens
cuuuucucugagacauuccacc

SEQ ID NO: 941098 - RNA, 21 nt, Homo sapiens
cuuuugguuaugaauacuuug

SEQ ID NO: 941099 - RNA, 15 nt, Homo sapiens
cuuuuuggagagugc

SEQ ID NO: 941100 - RNA, 19 nt, Homo sapiens
gaaaaaagcaacugguuag

SEQ ID NO: 941101 - RNA, 19 nt, Homo sapiens
gaaaagagaauauuuacaa

SEQ ID NO: 941102 - RNA, 23 nt, Homo sapiens
gaaaagcuuaaaaaaauuacugu

SEQ ID NO: 941103 - RNA, 13 nt, Homo sapiens
gaaaaguagaaag

SEQ ID NO: 941104 - RNA, 13 nt, Homo sapiens
gaaaaugcaaaag

SEQ ID NO: 941105 - RNA, 20 nt, Homo sapiens
gaaaauggacagaauguguc

SEQ ID NO: 941106 - RNA, 18 nt, Homo sapiens
gaaacggaggccagagag

SEQ ID NO: 941107 - RNA, 13 nt, Homo sapiens
gaaagaccaggcc

SEQ ID NO: 941108 - RNA, 20 nt, Homo sapiens
gaaagaccaggccaauguca

SEQ ID NO: 941109 - RNA, 17 nt, Homo sapiens
gaaagacuggacucuaa

SEQ ID NO: 941110 - RNA, 16 nt, Homo sapiens
gaaaggaacugcaaua

SEQ ID NO: 941111 - RNA, 20 nt, Homo sapiens
gaaaggauuuuaccaaagca

SEQ ID NO: 941112 - RNA, 18 nt, Homo sapiens
gaaaguuuuguucuguau

SEQ ID NO: 941113 - RNA, 18 nt, Homo sapiens
gaaauaaaagcuuugcaa

SEQ ID NO: 941114 - RNA, 18 nt, Homo sapiens
gaaauacaguacuguuuc

SEQ ID NO: 941115 - RNA, 22 nt, Homo sapiens
gaaauauggaacuuacauuguu

SEQ ID NO: 941116 - RNA, 14 nt, Homo sapiens
gaaaugaaagggaa

SEQ ID NO: 941117 - RNA, 18 nt, Homo sapiens
gaaaugagcucaaauuga

SEQ ID NO: 941118 - RNA, 23 nt, Homo sapiens
gaaaugcugauguauccuuucau

SEQ ID NO: 941119 - RNA, 20 nt, Homo sapiens
gaaaugcuugcucaggcuca

SEQ ID NO: 941120 - RNA, 21 nt, Homo sapiens
gaacagcauuacccuccucuc

SEQ ID NO: 941121 - RNA, 18 nt, Homo sapiens
gaacauugguucuuucau

SEQ ID NO: 941122 - RNA, 19 nt, Homo sapiens
gaacauuuuaauucauccc

SEQ ID NO: 941123 - RNA, 24 nt, Homo sapiens
gaaccuaacaugcuggugaauauu

SEQ ID NO: 941124 - RNA, 14 nt, Homo sapiens
gaacucacuggggc

SEQ ID NO: 941125 - RNA, 17 nt, Homo sapiens
gaacuuaaccuugcaaa

SEQ ID NO: 941126 - RNA, 18 nt, Homo sapiens
gaagaagagaugacaaac

SEQ ID NO: 941127 - RNA, 17 nt, Homo sapiens
gaagauuuaugaugcac

SEQ ID NO: 941128 - RNA, 18 nt, Homo sapiens
gaagcaucauuuccccaa

SEQ ID NO: 941129 - RNA, 18 nt, Homo sapiens
gaagcccaggagccucac

SEQ ID NO: 941130 - RNA, 14 nt, Homo sapiens
gaagccugcugauu

SEQ ID NO: 941131 - RNA, 21 nt, Homo sapiens
gaagcggagagagccaagacg

SEQ ID NO: 941132 - RNA, 17 nt, Homo sapiens
gaagcuguauaauuaau

SEQ ID NO: 941133 - RNA, 15 nt, Homo sapiens
gaaggccccagagag

SEQ ID NO: 941134 - RNA, 12 nt, Homo sapiens
gaaguaagcaaa

SEQ ID NO: 941135 - RNA, 19 nt, Homo sapiens
gaagugcuggcaaccacua

SEQ ID NO: 941136 - RNA, 13 nt, Homo sapiens
gaaguggccagag

SEQ ID NO: 941137 - RNA, 20 nt, Homo sapiens
gaauccuuggugugguuucu

SEQ ID NO: 941138 - RNA, 21 nt, Homo sapiens
gaaucuauccauugaacuaaa

SEQ ID NO: 941139 - RNA, 12 nt, Homo sapiens
gaaugucucagc

SEQ ID NO: 941140 - RNA, 21 nt, Homo sapiens
gaauuaacaauaaaaguguga

SEQ ID NO: 941141 - RNA, 15 nt, Homo sapiens
gaauuacgugcucug

SEQ ID NO: 941142 - RNA, 14 nt, Homo sapiens
gaauuggugauucu

SEQ ID NO: 941143 - RNA, 19 nt, Homo sapiens
gaauuguuuuuguacaguu

SEQ ID NO: 941144 - RNA, 18 nt, Homo sapiens
gacaaaccauaacugaca

SEQ ID NO: 941145 - RNA, 15 nt, Homo sapiens
gacaaauauuuucau

SEQ ID NO: 941146 - RNA, 21 nt, Homo sapiens
gacacagcuuaacaaugcaac

SEQ ID NO: 941147 - RNA, 12 nt, Homo sapiens
gacacugcagug

SEQ ID NO: 941148 - RNA, 18 nt, Homo sapiens
gacagcucuguaucugcc

SEQ ID NO: 941149 - RNA, 17 nt, Homo sapiens
gacaggccagaugaacu

SEQ ID NO: 941150 - RNA, 21 nt, Homo sapiens
gacagggacaugcccugugug

SEQ ID NO: 941151 - RNA, 12 nt, Homo sapiens
gacaguaccuga

SEQ ID NO: 941152 - RNA, 14 nt, Homo sapiens
gacaguccacaggg

SEQ ID NO: 941153 - RNA, 18 nt, Homo sapiens
gacaguccacaggggcca

SEQ ID NO: 941154 - RNA, 15 nt, Homo sapiens
gacauacuuaaugca

SEQ ID NO: 941155 - RNA, 15 nt, Homo sapiens
gacaugcccugugug

SEQ ID NO: 941156 - RNA, 20 nt, Homo sapiens
gacauuuuggaagcugagau

SEQ ID NO: 941157 - RNA, 15 nt, Homo sapiens
gaccaccacuucgaa

SEQ ID NO: 941158 - RNA, 20 nt, Homo sapiens
gaccaguugaagcugacuca

SEQ ID NO: 941159 - RNA, 17 nt, Homo sapiens
gaccccagccauccagg

SEQ ID NO: 941160 - RNA, 15 nt, Homo sapiens
gacccugcaagacca

SEQ ID NO: 941161 - RNA, 18 nt, Homo sapiens
gaccgcccccuccucuag

SEQ ID NO: 941162 - RNA, 22 nt, Homo sapiens
gaccugaauaccacuuaccuca

SEQ ID NO: 941163 - RNA, 17 nt, Homo sapiens
gaccuggaaucagugaa

SEQ ID NO: 941164 - RNA, 13 nt, Homo sapiens
gaccuuaaaugca

SEQ ID NO: 941165 - RNA, 18 nt, Homo sapiens
gaccuuaggccuuccucu

SEQ ID NO: 941166 - RNA, 23 nt, Homo sapiens
gacgguaccaauucagugucugu

SEQ ID NO: 941167 - RNA, 14 nt, Homo sapiens
gacggucaguccau

SEQ ID NO: 941168 - RNA, 22 nt, Homo sapiens
gacggucaguccaugucucgga

SEQ ID NO: 941169 - RNA, 20 nt, Homo sapiens
gacguccucccugaucccac

SEQ ID NO: 941170 - RNA, 15 nt, Homo sapiens
gacuauguagcaaua

SEQ ID NO: 941171 - RNA, 20 nt, Homo sapiens
gacucuaaagucuguugauu

SEQ ID NO: 941172 - RNA, 14 nt, Homo sapiens
gacugauguguaua

SEQ ID NO: 941173 - RNA, 20 nt, Homo sapiens
gacuuguuuuaaacuugccu

SEQ ID NO: 941174 - RNA, 17 nt, Homo sapiens
gacuuuauguugaaaua

SEQ ID NO: 941175 - RNA, 19 nt, Homo sapiens
gacuuuguccccacuuaca

SEQ ID NO: 941176 - RNA, 17 nt, Homo sapiens
gagaaagggagugcaug

SEQ ID NO: 941177 - RNA, 12 nt, Homo sapiens
gagaaccaggcu

SEQ ID NO: 941178 - RNA, 15 nt, Homo sapiens
gagaaccucagauca

SEQ ID NO: 941179 - RNA, 17 nt, Homo sapiens
gagaagauuuaugucag

SEQ ID NO: 941180 - RNA, 17 nt, Homo sapiens
gagaagcaucauuuccc

SEQ ID NO: 941181 - RNA, 16 nt, Homo sapiens
gagaauuuaaacaaug

SEQ ID NO: 941182 - RNA, 13 nt, Homo sapiens
gagagccaagacg

SEQ ID NO: 941183 - RNA, 16 nt, Homo sapiens
gagaggcgucugcugu

SEQ ID NO: 941184 - RNA, 18 nt, Homo sapiens
gagaguaugguccucaga

SEQ ID NO: 941185 - RNA, 18 nt, Homo sapiens
gagaugccacuucucacu

SEQ ID NO: 941186 - RNA, 12 nt, Homo sapiens
gagcacagugau

SEQ ID NO: 941187 - RNA, 21 nt, Homo sapiens
gagcacccugcccaccaagaa

SEQ ID NO: 941188 - RNA, 19 nt, Homo sapiens
gagcagggagaccaugccu

SEQ ID NO: 941189 - RNA, 15 nt, Homo sapiens
gagccugaacaugcc

SEQ ID NO: 941190 - RNA, 19 nt, Homo sapiens
gagcuugcaugcuugcaua

SEQ ID NO: 941191 - RNA, 22 nt, Homo sapiens
gaggaaaaggccccugcaaugu

SEQ ID NO: 941192 - RNA, 21 nt, Homo sapiens
ucgccccaggcccucccugac

SEQ ID NO: 941193 - RNA, 13 nt, Homo sapiens
ucgcucuuuucaa

SEQ ID NO: 941194 - RNA, 16 nt, Homo sapiens
ucggugaccuccgucc

SEQ ID NO: 941195 - RNA, 18 nt, Homo sapiens
ucuagauuauggagcuuu

SEQ ID NO: 941196 - RNA, 12 nt, Homo sapiens
ucuaggaacucc

SEQ ID NO: 941197 - RNA, 14 nt, Homo sapiens
ucuaguucauugaa

SEQ ID NO: 941198 - RNA, 14 nt, Homo sapiens
ucuauaacacauca

SEQ ID NO: 941199 - RNA, 16 nt, Homo sapiens
ucuauccucuguaaac

SEQ ID NO: 941200 - RNA, 17 nt, Homo sapiens
ucuaucugcuuagcaac

SEQ ID NO: 941201 - RNA, 18 nt, Homo sapiens
ucuaugauuguacuuuga

SEQ ID NO: 941202 - RNA, 12 nt, Homo sapiens
ucuauucuagcc

SEQ ID NO: 941203 - RNA, 21 nt, Homo sapiens
ucuauuuacauaaaaugggug

SEQ ID NO: 941204 - RNA, 21 nt, Homo sapiens
ucuauuuuaagacugauuuua

SEQ ID NO: 941205 - RNA, 21 nt, Homo sapiens
ucucaaggcaguuaauucuca

SEQ ID NO: 941206 - RNA, 23 nt, Homo sapiens
ucucaccccugcuauaacuauga

SEQ ID NO: 941207 - RNA, 12 nt, Homo sapiens
ucucagccucug

SEQ ID NO: 941208 - RNA, 15 nt, Homo sapiens
ucucaguucuugagg

SEQ ID NO: 941209 - RNA, 14 nt, Homo sapiens
ucucaucaguccau

SEQ ID NO: 941210 - RNA, 20 nt, Homo sapiens
ucuccacgguagcacuugac

SEQ ID NO: 941211 - RNA, 23 nt, Homo sapiens
ucucccggcaacaucucugggaa

SEQ ID NO: 941212 - RNA, 12 nt, Homo sapiens
ucuccugacccc

SEQ ID NO: 941213 - RNA, 23 nt, Homo sapiens
ucuccugcgcccuucauugccac

SEQ ID NO: 941214 - RNA, 17 nt, Homo sapiens
ucucgagcccagaugga

SEQ ID NO: 941215 - RNA, 19 nt, Homo sapiens
ucucgcacacacagugauu

SEQ ID NO: 941216 - RNA, 15 nt, Homo sapiens
ucucgguuugccaaa

SEQ ID NO: 941217 - RNA, 17 nt, Homo sapiens
ucucuaacaguggacaa

SEQ ID NO: 941218 - RNA, 22 nt, Homo sapiens
ucucuauauucggaauguaacu

SEQ ID NO: 941219 - RNA, 23 nt, Homo sapiens
ucugagaccacuugggcgcuguu

SEQ ID NO: 941220 - RNA, 22 nt, Homo sapiens
ucugauaaacacaaucugcuag

SEQ ID NO: 941221 - RNA, 13 nt, Homo sapiens
ucugauaagcaag

SEQ ID NO: 941222 - RNA, 19 nt, Homo sapiens
ucugcauggaacagcauua

SEQ ID NO: 941223 - RNA, 23 nt, Homo sapiens
ucugccagcgccaaaacaagcca

SEQ ID NO: 941224 - RNA, 20 nt, Homo sapiens
ucugcuccccuaaagccuca

SEQ ID NO: 941225 - RNA, 15 nt, Homo sapiens
ucugcuccuguucac

SEQ ID NO: 941226 - RNA, 17 nt, Homo sapiens
ucugcugucucaucaca

SEQ ID NO: 941227 - RNA, 18 nt, Homo sapiens
ucugcuucccuugccuau

SEQ ID NO: 941228 - RNA, 21 nt, Homo sapiens
ucuggaccauauaccaucucc

SEQ ID NO: 941229 - RNA, 20 nt, Homo sapiens
ugagugguggaggaggacac

SEQ ID NO: 941230 - RNA, 15 nt, Homo sapiens
ugaguugcacauuaa

SEQ ID NO: 941231 - RNA, 16 nt, Homo sapiens
ugaguuuuguucacaa

SEQ ID NO: 941232 - RNA, 20 nt, Homo sapiens
ugauacuggaggaacacuug

SEQ ID NO: 941233 - RNA, 17 nt, Homo sapiens
ugauagcagaaugugcu

SEQ ID NO: 941234 - RNA, 16 nt, Homo sapiens
ugauuuggugaccaac

SEQ ID NO: 941235 - RNA, 14 nt, Homo sapiens
ugauuuuguaaaag

SEQ ID NO: 941236 - RNA, 22 nt, Homo sapiens
ugauuuuuugcauuccugacaa

SEQ ID NO: 941237 - RNA, 17 nt, Homo sapiens
ugcaaagaccuaccucc

SEQ ID NO: 941238 - RNA, 19 nt, Homo sapiens
ugcaaagugccuugcucau

SEQ ID NO: 941239 - RNA, 16 nt, Homo sapiens
ugcaagaagcuuuauu

SEQ ID NO: 941240 - RNA, 18 nt, Homo sapiens
ugcaauagacacauacau

SEQ ID NO: 941241 - RNA, 13 nt, Homo sapiens
ugcaaugucugag

SEQ ID NO: 941242 - RNA, 15 nt, Homo sapiens
ugcaauguggugaca

SEQ ID NO: 941243 - RNA, 19 nt, Homo sapiens
ugcaauugacauaggcaau

SEQ ID NO: 941244 - RNA, 15 nt, Homo sapiens
ugcaauuuuucaaga

SEQ ID NO: 941245 - RNA, 16 nt, Homo sapiens
ugcaccuguaauccca

SEQ ID NO: 941246 - RNA, 20 nt, Homo sapiens
ugcacuucuuacgacuuuuu

SEQ ID NO: 941247 - RNA, 20 nt, Homo sapiens
ugcacuuguggcaacagaua

SEQ ID NO: 941248 - RNA, 12 nt, Homo sapiens
ugcacuuucuau

SEQ ID NO: 941249 - RNA, 20 nt, Homo sapiens
ugcagcucuugggaccgugu

SEQ ID NO: 941250 - RNA, 13 nt, Homo sapiens
ugcaggacacugg

SEQ ID NO: 941251 - RNA, 20 nt, Homo sapiens
ugcaggacuugagaagaccu

SEQ ID NO: 941252 - RNA, 17 nt, Homo sapiens
ugcauagcaagugaaag

SEQ ID NO: 941253 - RNA, 15 nt, Homo sapiens
ugccaauagugucau

SEQ ID NO: 941254 - RNA, 17 nt, Homo sapiens
ugccaauagugucaucc

SEQ ID NO: 941255 - RNA, 17 nt, Homo sapiens
ugccauggaaccuuccc

SEQ ID NO: 941256 - RNA, 12 nt, Homo sapiens
ugccaugugaag

SEQ ID NO: 941257 - RNA, 16 nt, Homo sapiens
ugccauugcauuccag

SEQ ID NO: 941258 - RNA, 15 nt, Homo sapiens
ugccauuuagcaaua

SEQ ID NO: 941259 - RNA, 23 nt, Homo sapiens
ugcccagaauaaguuauugcagu

SEQ ID NO: 941260 - RNA, 16 nt, Homo sapiens
ugccccaccccaucca

SEQ ID NO: 941261 - RNA, 14 nt, Homo sapiens
ugccccucucacca

SEQ ID NO: 941262 - RNA, 14 nt, Homo sapiens
ugcccuguguggcu

SEQ ID NO: 941263 - RNA, 21 nt, Homo sapiens
ugccucaacccaaggggauuu

SEQ ID NO: 941264 - RNA, 17 nt, Homo sapiens
ugccuuaaucccagcac

SEQ ID NO: 941265 - RNA, 15 nt, Homo sapiens
ugccuuagucucagu

SEQ ID NO: 941266 - RNA, 14 nt, Homo sapiens
uguuuagugauauu

SEQ ID NO: 941267 - RNA, 20 nt, Homo sapiens
uguuuucaggacaacacuuc

SEQ ID NO: 941268 - RNA, 18 nt, Homo sapiens
uuaaaagaacucauucau

SEQ ID NO: 941269 - RNA, 17 nt, Homo sapiens
uuaaaagagaagcauca

SEQ ID NO: 941270 - RNA, 22 nt, Homo sapiens
uuaaaauauuuaucugauuaag

SEQ ID NO: 941271 - RNA, 15 nt, Homo sapiens
uuaaacaaaaacuag

SEQ ID NO: 941272 - RNA, 17 nt, Homo sapiens
uuaaauuacaauuuuau

SEQ ID NO: 941273 - RNA, 23 nt, Homo sapiens
uuaacauuaucuaguucauugaa

SEQ ID NO: 941274 - RNA, 15 nt, Homo sapiens
uuaacuuugaaaguu

SEQ ID NO: 941275 - RNA, 20 nt, Homo sapiens
uuaagcuuuuuuuuuuugaa

SEQ ID NO: 941276 - RNA, 14 nt, Homo sapiens
uuaaguauugucac

SEQ ID NO: 941277 - RNA, 20 nt, Homo sapiens
uuaagucccaguauaccuca

SEQ ID NO: 941278 - RNA, 13 nt, Homo sapiens
uuaagugauguca

SEQ ID NO: 941279 - RNA, 23 nt, Homo sapiens
uuaauaggugcagucuuugagau

SEQ ID NO: 941280 - RNA, 14 nt, Homo sapiens
uuaauaucugaggu

SEQ ID NO: 941281 - RNA, 19 nt, Homo sapiens
uuaaucacuauuguuccag

SEQ ID NO: 941282 - RNA, 19 nt, Homo sapiens
uuaaucauaguuacugugu

SEQ ID NO: 941283 - RNA, 15 nt, Homo sapiens
uuaaucccagcacuu

SEQ ID NO: 941284 - RNA, 17 nt, Homo sapiens
uuaaugagucagucaau

SEQ ID NO: 941285 - RNA, 16 nt, Homo sapiens
uuaauggggaggacaa

SEQ ID NO: 941286 - RNA, 16 nt, Homo sapiens
uuaauguuaacaagac

SEQ ID NO: 941287 - RNA, 15 nt, Homo sapiens
uuaauuauauguaua

SEQ ID NO: 941288 - RNA, 14 nt, Homo sapiens
uuaauuucuaugaa

SEQ ID NO: 941289 - RNA, 22 nt, Homo sapiens
uuacaaugaucaccgacugaaa

SEQ ID NO: 941290 - RNA, 20 nt, Homo sapiens
uuacaguuaaagaagcaauc

SEQ ID NO: 941291 - RNA, 14 nt, Homo sapiens
uuacauacuuuauc

SEQ ID NO: 941292 - RNA, 20 nt, Homo sapiens
uuacauuuauuuauccagaa

SEQ ID NO: 941293 - RNA, 10 nt, Homo sapiens
uuaccaaagc

SEQ ID NO: 941294 - RNA, 17 nt, Homo sapiens
uuacuaauuauacuacu

SEQ ID NO: 941295 - RNA, 13 nt, Homo sapiens
uuagaaaauauuc

SEQ ID NO: 941296 - RNA, 16 nt, Homo sapiens
uuagaaauacugcaag

SEQ ID NO: 941297 - RNA, 12 nt, Homo sapiens
uuagaauaucug

SEQ ID NO: 941298 - RNA, 22 nt, Homo sapiens
uuagaaucuuuuaaauacauuc

SEQ ID NO: 941299 - RNA, 20 nt, Homo sapiens
uuagagagcaucugcaacaa

SEQ ID NO: 941300 - RNA, 22 nt, Homo sapiens
uuagauauuuuucauaaacaag

SEQ ID NO: 941301 - RNA, 18 nt, Homo sapiens
uuagccagagaugcaaua

SEQ ID NO: 941302 - RNA, 12 nt, Homo sapiens
uuagccauucau

SEQ ID NO: 941303 - RNA, 16 nt, Homo sapiens
uuaggaaggccuucag

SEQ ID NO: 941304 - RNA, 13 nt, Homo sapiens
uuaggagcccuag

SEQ ID NO: 941305 - RNA, 16 nt, Homo sapiens
uuagguagcaacaaca

SEQ ID NO: 941306 - RNA, 21 nt, Homo sapiens
uuagguuucagcagagcugaa

SEQ ID NO: 941307 - RNA, 18 nt, Homo sapiens
uuaguguggcuaaccaag

SEQ ID NO: 941308 - RNA, 16 nt, Homo sapiens
uuaguuccacugagac

SEQ ID NO: 941309 - RNA, 23 nt, Homo sapiens
uuaguuccccaaauacaaaguua

SEQ ID NO: 941310 - RNA, 16 nt, Homo sapiens
uuaguuuguguuauua

SEQ ID NO: 941311 - RNA, 21 nt, Homo sapiens
uuauaaauuucgcuucuuaga

SEQ ID NO: 941312 - RNA, 14 nt, Homo sapiens
uuauacuacuuugu

SEQ ID NO: 941313 - RNA, 15 nt, Homo sapiens
uuauaggcauaccuc

SEQ ID NO: 941314 - RNA, 19 nt, Homo sapiens
uuauccagaaaacugugau

SEQ ID NO: 941315 - RNA, 22 nt, Homo sapiens
uuauuaaaagaugucucugcaa

SEQ ID NO: 941316 - RNA, 14 nt, Homo sapiens
uuauuacauguaau

SEQ ID NO: 941317 - RNA, 13 nt, Homo sapiens
uuauugcaguuua

SEQ ID NO: 941318 - RNA, 17 nt, Homo sapiens
uuauuguuguacauacg

SEQ ID NO: 941319 - RNA, 22 nt, Homo sapiens
uuauuuguguuuaaaugcugcu

SEQ ID NO: 941320 - RNA, 19 nt, Homo sapiens
uuauuuuuguuagcaaaga

SEQ ID NO: 941321 - RNA, 20 nt, Homo sapiens
uucaaaccacaauauccagc

SEQ ID NO: 941322 - RNA, 23 nt, Homo sapiens
uucaaaugggagacucuuugaaa

SEQ ID NO: 941323 - RNA, 21 nt, Homo sapiens
uucaaccuguccuuucaggga

SEQ ID NO: 941324 - RNA, 12 nt, Homo sapiens
uucaaguguaaa

SEQ ID NO: 941325 - RNA, 15 nt, Homo sapiens
uucaauaaagcauuu

SEQ ID NO: 941326 - RNA, 21 nt, Homo sapiens
uucacauacaaaucauccauc

SEQ ID NO: 941327 - RNA, 14 nt, Homo sapiens
uucagaaagcaaua

SEQ ID NO: 941328 - RNA, 17 nt, Homo sapiens
uucagagaucaaguccu

SEQ ID NO: 941329 - RNA, 20 nt, Homo sapiens
uucagaggcucagauuguaa

SEQ ID NO: 941330 - RNA, 19 nt, Homo sapiens
uucagcaauccaugagaua

SEQ ID NO: 941331 - RNA, 21 nt, Homo sapiens
uucagcaguccuuaucaccag

SEQ ID NO: 941332 - RNA, 17 nt, Homo sapiens
uucagucaaaacuuuaa

SEQ ID NO: 941333 - RNA, 21 nt, Homo sapiens
uucaguucagauaauuggcaa

SEQ ID NO: 941334 - RNA, 13 nt, Homo sapiens
uucauacaacaga

SEQ ID NO: 941335 - RNA, 19 nt, Homo sapiens
uucauauuucaaaccacaa

SEQ ID NO: 941336 - RNA, 20 nt, Homo sapiens
uucauauuucaaaccacaau

SEQ ID NO: 941337 - RNA, 22 nt, Homo sapiens
uucauccaguuuguucuccggg

SEQ ID NO: 941338 - RNA, 12 nt, Homo sapiens
uucaugccagcu

SEQ ID NO: 941339 - RNA, 21 nt, Homo sapiens
uucaugcuggccugugugaua

SEQ ID NO: 941340 - RNA, 22 nt, Homo sapiens
uucauuaacaaaauguaugucu

SEQ ID NO: 941341 - RNA, 14 nt, Homo sapiens
uucauucaaacugc

SEQ ID NO: 941342 - RNA, 20 nt, Homo sapiens
uucauuguguuaccuguaga

SEQ ID NO: 941343 - RNA, 12 nt, Homo sapiens
uuccaaacacca

SEQ ID NO: 941344 - RNA, 19 nt, Homo sapiens
uuccagacuuccuugagac

SEQ ID NO: 941345 - RNA, 22 nt, Homo sapiens
uuccaguguccuuagaacauuu

SEQ ID NO: 941346 - RNA, 20 nt, Homo sapiens
uuccauaguguuaacuguca

SEQ ID NO: 941347 - RNA, 20 nt, Homo sapiens
uuccaugccgcagacaugaa

SEQ ID NO: 941348 - RNA, 21 nt, Homo sapiens
uucccaacuccucaugucuuc

SEQ ID NO: 941349 - RNA, 19 nt, Homo sapiens
uucccaucgcugucacagg

SEQ ID NO: 941350 - RNA, 20 nt, Homo sapiens
uuccccaacagggcaacugu

SEQ ID NO: 941351 - RNA, 19 nt, Homo sapiens
uucccuaccauucagugau

SEQ ID NO: 941352 - RNA, 17 nt, Homo sapiens
uuccucccccaguuccu

SEQ ID NO: 941353 - RNA, 11 nt, Homo sapiens
uuccucugcau

SEQ ID NO: 941354 - RNA, 18 nt, Homo sapiens
uuccugcaucucugugaa

SEQ ID NO: 941355 - RNA, 18 nt, Homo sapiens
uuccuggggaaaagaagc

SEQ ID NO: 941356 - RNA, 13 nt, Homo sapiens
uuccuguugucaa

SEQ ID NO: 941357 - RNA, 21 nt, Homo sapiens
uuccuugccuaaggugucuga

SEQ ID NO: 941358 - RNA, 16 nt, Homo sapiens
uucuaggcucacugca

SEQ ID NO: 941359 - RNA, 14 nt, Homo sapiens
uucuauugggauau

SEQ ID NO: 941360 - RNA, 18 nt, Homo sapiens
uucuauugggauauccuu

SEQ ID NO: 941361 - RNA, 22 nt, Homo sapiens
uucucauuaaaguuguuuccca

SEQ ID NO: 941362 - RNA, 22 nt, Homo sapiens
uucugcaacaucuuaagaucca

SEQ ID NO: 941363 - RNA, 14 nt, Homo sapiens
uucuggauaccauu

SEQ ID NO: 941364 - RNA, 18 nt, Homo sapiens
uucuuacacugugucauu

SEQ ID NO: 941365 - RNA, 15 nt, Homo sapiens
uucuugaggucuuga

SEQ ID NO: 941366 - RNA, 19 nt, Homo sapiens
uucuugaguugucuuuugc

SEQ ID NO: 941367 - RNA, 22 nt, Homo sapiens
uucuuugcaccaaagacaucag

SEQ ID NO: 941368 - RNA, 12 nt, Homo sapiens
uugaaaaacuaa

SEQ ID NO: 941369 - RNA, 19 nt, Homo sapiens
uugaaaaaugagagcugua

SEQ ID NO: 941370 - RNA, 18 nt, Homo sapiens
uugaacuaggcugagcaa

SEQ ID NO: 941371 - RNA, 22 nt, Homo sapiens
uugaagauuuaugaugcacuua

SEQ ID NO: 941372 - RNA, 15 nt, Homo sapiens
uugaagucuuuaaua

SEQ ID NO: 941373 - RNA, 15 nt, Homo sapiens
uaguacugaagccaa

SEQ ID NO: 941374 - RNA, 21 nt, Homo sapiens
uagucaauauuugguauuuca

SEQ ID NO: 941375 - RNA, 18 nt, Homo sapiens
uaguucacauacaaauca

SEQ ID NO: 941376 - RNA, 22 nt, Homo sapiens
uaguucacauacaaaucaucca

SEQ ID NO: 941377 - RNA, 14 nt, Homo sapiens
uaguuccacugaga

SEQ ID NO: 941378 - RNA, 16 nt, Homo sapiens
uaguucuguguugacc

SEQ ID NO: 941379 - RNA, 14 nt, Homo sapiens
uaguugcaguauug

SEQ ID NO: 941380 - RNA, 15 nt, Homo sapiens
uaguugucuuuccug

SEQ ID NO: 941381 - RNA, 21 nt, Homo sapiens
uaguuuguuuuagaaccagcc

SEQ ID NO: 941382 - RNA, 14 nt, Homo sapiens
uauaaaaaguggag

SEQ ID NO: 941383 - RNA, 15 nt, Homo sapiens
uauaaaugaauuugc

SEQ ID NO: 941384 - RNA, 22 nt, Homo sapiens
uauaaggcagccuugaguugca

SEQ ID NO: 941385 - RNA, 15 nt, Homo sapiens
uauacaaaacuuuau

SEQ ID NO: 941386 - RNA, 17 nt, Homo sapiens
uauaccaucuccagcua

SEQ ID NO: 941387 - RNA, 20 nt, Homo sapiens
uauacugguucacauccuac

SEQ ID NO: 941388 - RNA, 21 nt, Homo sapiens
uauacuuguggucccagauac

SEQ ID NO: 941389 - RNA, 20 nt, Homo sapiens
uauagcuugcauagucaaua

SEQ ID NO: 941390 - RNA, 12 nt, Homo sapiens
uauauaaccaau

SEQ ID NO: 941391 - RNA, 13 nt, Homo sapiens
uauauacaaguga

SEQ ID NO: 941392 - RNA, 20 nt, Homo sapiens
uauauuguguugacuuuaua

SEQ ID NO: 941393 - RNA, 19 nt, Homo sapiens
uauauuugugauagcacuu

SEQ ID NO: 941394 - RNA, 19 nt, Homo sapiens
uaucauuuauccuuacauu

SEQ ID NO: 941395 - RNA, 16 nt, Homo sapiens
uauccccacuacucaa

SEQ ID NO: 941396 - RNA, 16 nt, Homo sapiens
agauuaaaaagcacag

SEQ ID NO: 941397 - RNA, 23 nt, Homo sapiens
agauuagccuguauucucuucag

SEQ ID NO: 941398 - RNA, 19 nt, Homo sapiens
agauucagguaauacaaac

SEQ ID NO: 941399 - RNA, 15 nt, Homo sapiens
agauucugaccuuaa

SEQ ID NO: 941400 - RNA, 14 nt, Homo sapiens
agcaaauggccuca

SEQ ID NO: 941401 - RNA, 18 nt, Homo sapiens
agcaacaacagaagggaa

SEQ ID NO: 941402 - RNA, 19 nt, Homo sapiens
agcaacauucauagucuuu

SEQ ID NO: 941403 - RNA, 20 nt, Homo sapiens
agcaagacauacuuaaugca

SEQ ID NO: 941404 - RNA, 22 nt, Homo sapiens
agcaaguguucacaacagugaa

SEQ ID NO: 941405 - RNA, 9 nt, Homo sapiens
agcaauacu

SEQ ID NO: 941406 - RNA, 21 nt, Homo sapiens
agcaauuugaagagaaucuuu

SEQ ID NO: 941407 - RNA, 16 nt, Homo sapiens
agcacagccaagcccu

SEQ ID NO: 941408 - RNA, 20 nt, Homo sapiens
agcacagggggaagaagaag

SEQ ID NO: 941409 - RNA, 19 nt, Homo sapiens
agcacccauuucaaugugu

SEQ ID NO: 941410 - RNA, 19 nt, Homo sapiens
agcacccugcccaccaaga

SEQ ID NO: 941411 - RNA, 15 nt, Homo sapiens
agcacugggugacca

SEQ ID NO: 941412 - RNA, 19 nt, Homo sapiens
agcacugggugaccagcug

SEQ ID NO: 941413 - RNA, 18 nt, Homo sapiens
agcagaaaagaugaauuu

SEQ ID NO: 941414 - RNA, 16 nt, Homo sapiens
agcaguagcaaacuuu

SEQ ID NO: 941415 - RNA, 22 nt, Homo sapiens
agcagucacugacaguuaauaa

SEQ ID NO: 941416 - RNA, 22 nt, Homo sapiens
agcaguccuuaucaccagccuc

SEQ ID NO: 941417 - RNA, 21 nt, Homo sapiens
agcaguuguaccaagugaaau

SEQ ID NO: 941418 - RNA, 18 nt, Homo sapiens
agcaucugcaacaaaaag

SEQ ID NO: 941419 - RNA, 15 nt, Homo sapiens
agcauguacuccccu

SEQ ID NO: 941420 - RNA, 23 nt, Homo sapiens
agcauuacccuccucucucccca

SEQ ID NO: 941421 - RNA, 20 nt, Homo sapiens
agccaaauauuaggcuuaaa

SEQ ID NO: 941422 - RNA, 22 nt, Homo sapiens
agccacuugccugugcuacaau

SEQ ID NO: 941423 - RNA, 16 nt, Homo sapiens
agccagagaugcaaua

SEQ ID NO: 941424 - RNA, 22 nt, Homo sapiens
agccaguuaauuuuaagaauuu

SEQ ID NO: 941425 - RNA, 20 nt, Homo sapiens
agccaucccuuuuuuuacau

SEQ ID NO: 941426 - RNA, 20 nt, Homo sapiens
agcccagcccuccucuguca

SEQ ID NO: 941427 - RNA, 13 nt, Homo sapiens
agccccgacucca

SEQ ID NO: 941428 - RNA, 22 nt, Homo sapiens
agccccugggcccaguaccuag

SEQ ID NO: 941429 - RNA, 14 nt, Homo sapiens
agcccgcuuggcca

SEQ ID NO: 941430 - RNA, 18 nt, Homo sapiens
agcccuaaagaaugcaac

SEQ ID NO: 941431 - RNA, 18 nt, Homo sapiens
agcccuguccccuacccc

SEQ ID NO: 941432 - RNA, 21 nt, Homo sapiens
agccuccagggcauugcucag

SEQ ID NO: 941433 - RNA, 17 nt, Homo sapiens
agccucucaaguaauau

SEQ ID NO: 941434 - RNA, 17 nt, Homo sapiens
agccugauauugauaug

SEQ ID NO: 941435 - RNA, 22 nt, Homo sapiens
agcgaccgcccccuccucuagc

SEQ ID NO: 941436 - RNA, 15 nt, Homo sapiens
agcgagauucugccu

SEQ ID NO: 941437 - RNA, 19 nt, Homo sapiens
agcgcugagcuaucuccua

SEQ ID NO: 941438 - RNA, 14 nt, Homo sapiens
agcgugaugaucua

SEQ ID NO: 941439 - RNA, 20 nt, Homo sapiens
agcuaacccucacaagcaug

SEQ ID NO: 941440 - RNA, 17 nt, Homo sapiens
agcuagaauaccaccua

SEQ ID NO: 941441 - RNA, 15 nt, Homo sapiens
agcuccaauuucaag

SEQ ID NO: 941442 - RNA, 17 nt, Homo sapiens
agcuccccucacucugu

SEQ ID NO: 941443 - RNA, 21 nt, Homo sapiens
agcuccucccacaaugcugaa

SEQ ID NO: 941444 - RNA, 21 nt, Homo sapiens
agcuccugggaagcccugggu

SEQ ID NO: 941445 - RNA, 21 nt, Homo sapiens
agcucugcuccccuaaagccu

SEQ ID NO: 941446 - RNA, 16 nt, Homo sapiens
agcugaccccugcuga

SEQ ID NO: 941447 - RNA, 22 nt, Homo sapiens
agcugagacuacaagugugugc

SEQ ID NO: 941448 - RNA, 16 nt, Homo sapiens
agcugccuuggcucag

SEQ ID NO: 941449 - RNA, 22 nt, Homo sapiens
agcugccuuggcucagacaugu

SEQ ID NO: 941450 - RNA, 23 nt, Homo sapiens
agcuguauaauuaauugucauua

SEQ ID NO: 941451 - RNA, 17 nt, Homo sapiens
agcuguuccuguucagu

SEQ ID NO: 941452 - RNA, 22 nt, Homo sapiens
agcuucaggagggaaccagcuu

SEQ ID NO: 941453 - RNA, 21 nt, Homo sapiens
aggaaaaggccccugcaaugu

SEQ ID NO: 941454 - RNA, 16 nt, Homo sapiens
aggaaaucuacuuccu

SEQ ID NO: 941455 - RNA, 14 nt, Homo sapiens
aggaacaaagacag

SEQ ID NO: 941456 - RNA, 18 nt, Homo sapiens
aggaacaggacugcaaaa

SEQ ID NO: 941457 - RNA, 22 nt, Homo sapiens
aggaacgucugguccuaaccag

SEQ ID NO: 941458 - RNA, 21 nt, Homo sapiens
aggaauagucgcgcaagcauc

SEQ ID NO: 941459 - RNA, 14 nt, Homo sapiens
aggaauuacgugcu

SEQ ID NO: 941460 - RNA, 14 nt, Homo sapiens
aggaccaagggcag

SEQ ID NO: 941461 - RNA, 17 nt, Homo sapiens
aggacuucugcagcuau

SEQ ID NO: 941462 - RNA, 13 nt, Homo sapiens
aggagaaacugag

SEQ ID NO: 941463 - RNA, 19 nt, Homo sapiens
aggagaugccacuucucac

SEQ ID NO: 941464 - RNA, 17 nt, Homo sapiens
aggagcaggcacgggug

SEQ ID NO: 941465 - RNA, 19 nt, Homo sapiens
aggagccucacuggggcag

SEQ ID NO: 941466 - RNA, 15 nt, Homo sapiens
aggagcuacucagga

SEQ ID NO: 941467 - RNA, 21 nt, Homo sapiens
aggagcugcuaaacucuuuca

SEQ ID NO: 941468 - RNA, 16 nt, Homo sapiens
aggagggcaguggugg

SEQ ID NO: 941469 - RNA, 15 nt, Homo sapiens
aggagucccuaacuu

SEQ ID NO: 941470 - RNA, 17 nt, Homo sapiens
aggaucaaagaacugaa

SEQ ID NO: 941471 - RNA, 15 nt, Homo sapiens
aggauccaucuuugu

SEQ ID NO: 941472 - RNA, 16 nt, Homo sapiens
aggauuacuagucaaa

SEQ ID NO: 941473 - RNA, 21 nt, Homo sapiens
aggauuuucacauucuuggcu

SEQ ID NO: 941474 - RNA, 15 nt, Homo sapiens
aggcaaagguucuau

SEQ ID NO: 941475 - RNA, 21 nt, Homo sapiens
aggcaauuccugauggaaaau

SEQ ID NO: 941476 - RNA, 16 nt, Homo sapiens
aggcacauacaccucg

SEQ ID NO: 941477 - RNA, 15 nt, Homo sapiens
aggcacgaagcaauu

SEQ ID NO: 941478 - RNA, 16 nt, Homo sapiens
aggcaugguggcucau

SEQ ID NO: 941479 - RNA, 16 nt, Homo sapiens
aggccacauaccucuc

SEQ ID NO: 941480 - RNA, 20 nt, Homo sapiens
aggccccugcaaugugguga

SEQ ID NO: 941481 - RNA, 10 nt, Homo sapiens
aggcccuccc

SEQ ID NO: 941482 - RNA, 23 nt, Homo sapiens
aggccuagacucugucuaccugg

SEQ ID NO: 941483 - RNA, 15 nt, Homo sapiens
aggccuguacagaug

SEQ ID NO: 941484 - RNA, 20 nt, Homo sapiens
aggcgcaguggcucaugccu

SEQ ID NO: 941485 - RNA, 23 nt, Homo sapiens
aggcggccucgugccaugaucug

SEQ ID NO: 941486 - RNA, 18 nt, Homo sapiens
aggcgucugcugucucau

SEQ ID NO: 941487 - RNA, 20 nt, Homo sapiens
aggcuaccaacuuguaucca

SEQ ID NO: 941488 - RNA, 16 nt, Homo sapiens
aggcugggccaugucc

SEQ ID NO: 941489 - RNA, 21 nt, Homo sapiens
aggcugggccauguccaaaga

SEQ ID NO: 941490 - RNA, 14 nt, Homo sapiens
agggaaacugggaa

SEQ ID NO: 941491 - RNA, 13 nt, Homo sapiens
agggaaauuucaa

SEQ ID NO: 941492 - RNA, 12 nt, Homo sapiens
agggagugcaug

SEQ ID NO: 941493 - RNA, 15 nt, Homo sapiens
agggcagcuuugcaa

SEQ ID NO: 941494 - RNA, 17 nt, Homo sapiens
agggcagcuuugcaaaa

SEQ ID NO: 941495 - RNA, 17 nt, Homo sapiens
aggggcugaggacgaga

SEQ ID NO: 941496 - RNA, 17 nt, Homo sapiens
agggggaagaagaagag

SEQ ID NO: 941497 - RNA, 23 nt, Homo sapiens
agguauccaaaaauguguaagaa

SEQ ID NO: 941498 - RNA, 13 nt, Homo sapiens
agguaugguggca

SEQ ID NO: 941499 - RNA, 14 nt, Homo sapiens
agguaugguggcau

SEQ ID NO: 941500 - RNA, 13 nt, Homo sapiens
aggucaggacuca

SEQ ID NO: 941501 - RNA, 14 nt, Homo sapiens
aggucaugccacug

SEQ ID NO: 941502 - RNA, 15 nt, Homo sapiens
aggugcagucuuuga

SEQ ID NO: 941503 - RNA, 21 nt, Homo sapiens
aauucuguuuuuaaugcuauu

SEQ ID NO: 941504 - RNA, 17 nt, Homo sapiens
aauugacaaugauuuau

SEQ ID NO: 941505 - RNA, 13 nt, Homo sapiens
aauugacuaaaaa

SEQ ID NO: 941506 - RNA, 17 nt, Homo sapiens
aauuggccgcugucacu

SEQ ID NO: 941507 - RNA, 20 nt, Homo sapiens
aauuuaaugaaaagguacaa

SEQ ID NO: 941508 - RNA, 15 nt, Homo sapiens
aauuugagauucuac

SEQ ID NO: 941509 - RNA, 16 nt, Homo sapiens
aauuugugccacuuua

SEQ ID NO: 941510 - RNA, 16 nt, Homo sapiens
aauuuuaagaauuuca

SEQ ID NO: 941511 - RNA, 22 nt, Homo sapiens
aauuuuauugacacaguaccau

SEQ ID NO: 941512 - RNA, 15 nt, Homo sapiens
aauuuucagcauuaa

SEQ ID NO: 941513 - RNA, 23 nt, Homo sapiens
aauuuuuauuguuguacauacga

SEQ ID NO: 941514 - RNA, 14 nt, Homo sapiens
acaaagccaugcca

SEQ ID NO: 941515 - RNA, 16 nt, Homo sapiens
acaaaugcaguauaua

SEQ ID NO: 941516 - RNA, 16 nt, Homo sapiens
acaacaauccuucuau

SEQ ID NO: 941517 - RNA, 17 nt, Homo sapiens
acaacagaauaaugcau

SEQ ID NO: 941518 - RNA, 13 nt, Homo sapiens
acaacagugaaaa

SEQ ID NO: 941519 - RNA, 17 nt, Homo sapiens
acaacauuguagccuca

SEQ ID NO: 941520 - RNA, 12 nt, Homo sapiens
acaaccuugucc

SEQ ID NO: 941521 - RNA, 12 nt, Homo sapiens
acaacuaccuga

SEQ ID NO: 941522 - RNA, 15 nt, Homo sapiens
acaagaccaccacuu

SEQ ID NO: 941523 - RNA, 19 nt, Homo sapiens
acaagagaggcgucugcug

SEQ ID NO: 941524 - RNA, 19 nt, Homo sapiens
acaagaguggacucagugg

SEQ ID NO: 941525 - RNA, 22 nt, Homo sapiens
acaaguacugguugacuuucua

SEQ ID NO: 941526 - RNA, 23 nt, Homo sapiens
acaagucaccaaaagacacugca

SEQ ID NO: 941527 - RNA, 15 nt, Homo sapiens
acaaugaaguugaaa

SEQ ID NO: 941528 - RNA, 11 nt, Homo sapiens
acaaugcugau

SEQ ID NO: 941529 - RNA, 16 nt, Homo sapiens
acaauuugacauacaa

SEQ ID NO: 941530 - RNA, 16 nt, Homo sapiens
acacagcaacaaugac

SEQ ID NO: 941531 - RNA, 15 nt, Homo sapiens
acacagcuuaacaau

SEQ ID NO: 941532 - RNA, 19 nt, Homo sapiens
acaccaaguaccaguauaa

SEQ ID NO: 941533 - RNA, 19 nt, Homo sapiens
acaccauuucugggcuccu

SEQ ID NO: 941534 - RNA, 17 nt, Homo sapiens
acacccaugccagagag

SEQ ID NO: 941535 - RNA, 15 nt, Homo sapiens
acacgauaaagggau

SEQ ID NO: 941536 - RNA, 15 nt, Homo sapiens
acacuacuaccucuu

SEQ ID NO: 941537 - RNA, 13 nt, Homo sapiens
acacucaugaagc

SEQ ID NO: 941538 - RNA, 14 nt, Homo sapiens
acacucaugaagca

SEQ ID NO: 941539 - RNA, 14 nt, Homo sapiens
acacugaucuggcu

SEQ ID NO: 941540 - RNA, 21 nt, Homo sapiens
acacugaucuuauguguuaca

SEQ ID NO: 941541 - RNA, 13 nt, Homo sapiens
acacugugucauu

SEQ ID NO: 941542 - RNA, 20 nt, Homo sapiens
acagaaaccagaaaagcaau

SEQ ID NO: 941543 - RNA, 21 nt, Homo sapiens
acagagcaagacuccaucuca

SEQ ID NO: 941544 - RNA, 17 nt, Homo sapiens
acagagguccugccaug

SEQ ID NO: 941545 - RNA, 15 nt, Homo sapiens
acagauuuggaaaga

SEQ ID NO: 941546 - RNA, 13 nt, Homo sapiens
acagcaaaggaac

SEQ ID NO: 941547 - RNA, 22 nt, Homo sapiens
acagcaugggccucaccuccuc

SEQ ID NO: 941548 - RNA, 18 nt, Homo sapiens
acagcuaagaugccaugu

SEQ ID NO: 941549 - RNA, 22 nt, Homo sapiens
acaggcaaauguacuucucacc

SEQ ID NO: 941550 - RNA, 15 nt, Homo sapiens
acagggagugcacau

SEQ ID NO: 941551 - RNA, 18 nt, Homo sapiens
acaguccacaggggccac

SEQ ID NO: 941552 - RNA, 12 nt, Homo sapiens
acauacaaauca

SEQ ID NO: 941553 - RNA, 13 nt, Homo sapiens
acauacuuuugca

SEQ ID NO: 941554 - RNA, 20 nt, Homo sapiens
acaucaaagagcacauuuac

SEQ ID NO: 941555 - RNA, 17 nt, Homo sapiens
acaucagauccugggca

SEQ ID NO: 941556 - RNA, 19 nt, Homo sapiens
acaucagauccugggcaca

SEQ ID NO: 941557 - RNA, 14 nt, Homo sapiens
acaucagucuccaa

SEQ ID NO: 941558 - RNA, 17 nt, Homo sapiens
acaucagucuccaacau

SEQ ID NO: 941559 - RNA, 22 nt, Homo sapiens
acauccuaccccuuugcacuug

SEQ ID NO: 941560 - RNA, 23 nt, Homo sapiens
acaucuucugccuuagucucagu

SEQ ID NO: 941561 - RNA, 13 nt, Homo sapiens
acaugcccugugu

SEQ ID NO: 941562 - RNA, 17 nt, Homo sapiens
acaugcccuguguggcu

SEQ ID NO: 941563 - RNA, 15 nt, Homo sapiens
acauguaauuugaug

SEQ ID NO: 941564 - RNA, 22 nt, Homo sapiens
acauguuccuuuaagguacuga

SEQ ID NO: 941565 - RNA, 21 nt, Homo sapiens
acauucccugggccaacagac

SEQ ID NO: 941566 - RNA, 12 nt, Homo sapiens
acauuguagccu

SEQ ID NO: 941567 - RNA, 23 nt, Homo sapiens
acauugugucagauuaccaguua

SEQ ID NO: 941568 - RNA, 16 nt, Homo sapiens
acauuuaaaauucaau

SEQ ID NO: 941569 - RNA, 19 nt, Homo sapiens
acauuuagccaaucuuucu

SEQ ID NO: 941570 - RNA, 21 nt, Homo sapiens
acauuuuugucagagugcaca

SEQ ID NO: 941571 - RNA, 16 nt, Homo sapiens
accaaagacaucaguc

SEQ ID NO: 941572 - RNA, 20 nt, Homo sapiens
accaaagacaucagucucca

SEQ ID NO: 941573 - RNA, 15 nt, Homo sapiens
accaaagcaucaaua

SEQ ID NO: 941574 - RNA, 17 nt, Homo sapiens
accaagaacauaagaau

SEQ ID NO: 941575 - RNA, 18 nt, Homo sapiens
accaagaacauaagaauu

SEQ ID NO: 941576 - RNA, 19 nt, Homo sapiens
accaagggcagaggggugc

SEQ ID NO: 941577 - RNA, 19 nt, Homo sapiens
accaauucuggacagacag

SEQ ID NO: 941578 - RNA, 20 nt, Homo sapiens
accaauucuggacagacaga

SEQ ID NO: 941579 - RNA, 14 nt, Homo sapiens
accacagggccuug

SEQ ID NO: 941580 - RNA, 11 nt, Homo sapiens
accacugacag

SEQ ID NO: 941581 - RNA, 13 nt, Homo sapiens
accagacacugcu

SEQ ID NO: 941582 - RNA, 17 nt, Homo sapiens
accagccguauuuuaca

SEQ ID NO: 941583 - RNA, 21 nt, Homo sapiens
accagcuucugauaaacacaa

SEQ ID NO: 941584 - RNA, 16 nt, Homo sapiens
accaggacuagggcug

SEQ ID NO: 941585 - RNA, 13 nt, Homo sapiens
accaggcuacaag

SEQ ID NO: 941586 - RNA, 20 nt, Homo sapiens
accauccuggcuaacacggu

SEQ ID NO: 941587 - RNA, 18 nt, Homo sapiens
accaugccuuccucagua

SEQ ID NO: 941588 - RNA, 21 nt, Homo sapiens
accauguauaugagcuuauaa

SEQ ID NO: 941589 - RNA, 23 nt, Homo sapiens
accauuuaauggggaggacaaaa

SEQ ID NO: 941590 - RNA, 19 nt, Homo sapiens
acccaccugcuagugugaa

SEQ ID NO: 941591 - RNA, 15 nt, Homo sapiens
accccaaaccuggca

SEQ ID NO: 941592 - RNA, 19 nt, Homo sapiens
accccaucuuuacuaaaaa

SEQ ID NO: 941593 - RNA, 20 nt, Homo sapiens
acccccacccccagcucaau

SEQ ID NO: 941594 - RNA, 13 nt, Homo sapiens
accccuuugcacu

SEQ ID NO: 941595 - RNA, 13 nt, Homo sapiens
acccucacauggg

SEQ ID NO: 941596 - RNA, 19 nt, Homo sapiens
acccugauaguuucccaua

SEQ ID NO: 941597 - RNA, 15 nt, Homo sapiens
acccugcaagaccac

SEQ ID NO: 941598 - RNA, 13 nt, Homo sapiens
acccuucaacgcu

SEQ ID NO: 941599 - RNA, 19 nt, Homo sapiens
accguauccauaaagaccc

SEQ ID NO: 941600 - RNA, 16 nt, Homo sapiens
accuacagacuaagaa

SEQ ID NO: 941601 - RNA, 19 nt, Homo sapiens
accuagaaaggaacugcaa

SEQ ID NO: 941602 - RNA, 15 nt, Homo sapiens
accuccagggagcac

SEQ ID NO: 941603 - RNA, 23 nt, Homo sapiens
accuccccucuccccgggaccgc

SEQ ID NO: 941604 - RNA, 15 nt, Homo sapiens
accugaauaccacuu

SEQ ID NO: 941605 - RNA, 17 nt, Homo sapiens
accuggaaucagugaag

SEQ ID NO: 941606 - RNA, 16 nt, Homo sapiens
accuggcgugcucaga

SEQ ID NO: 941607 - RNA, 21 nt, Homo sapiens
accuguagauucagguaauac

SEQ ID NO: 941608 - RNA, 19 nt, Homo sapiens
accuuccagcuccuguaac

SEQ ID NO: 941609 - RNA, 12 nt, Homo sapiens
accuuccucauc

SEQ ID NO: 941610 - RNA, 13 nt, Homo sapiens
accuuucccucac

SEQ ID NO: 941611 - RNA, 16 nt, Homo sapiens
aaaggccccugcaaug

SEQ ID NO: 941612 - RNA, 16 nt, Homo sapiens
aaagguucuaucugcu

SEQ ID NO: 941613 - RNA, 19 nt, Homo sapiens
aaagguuuucuucauucau

SEQ ID NO: 941614 - RNA, 19 nt, Homo sapiens
aaaguauucuucucuuccu

SEQ ID NO: 941615 - RNA, 23 nt, Homo sapiens
aaaguauuuucuucucugugaga

SEQ ID NO: 941616 - RNA, 22 nt, Homo sapiens
aaagucugaguaagaaacuuca

SEQ ID NO: 941617 - RNA, 17 nt, Homo sapiens
aaaguguguaucuagcu

SEQ ID NO: 941618 - RNA, 23 nt, Homo sapiens
aaaguuguucgccgcguggaaug

SEQ ID NO: 941619 - RNA, 23 nt, Homo sapiens
aaaguuuuauaacuuguguuauu

SEQ ID NO: 941620 - RNA, 11 nt, Homo sapiens
aaauaagcaaa

SEQ ID NO: 941621 - RNA, 16 nt, Homo sapiens
aaauacaaaacuucca

SEQ ID NO: 941622 - RNA, 18 nt, Homo sapiens
aaauaucuuggccuaaac

SEQ ID NO: 941623 - RNA, 16 nt, Homo sapiens
aaauauggaacuuaca

SEQ ID NO: 941624 - RNA, 22 nt, Homo sapiens
aaauauuguauaaagcauuugu

SEQ ID NO: 941625 - RNA, 21 nt, Homo sapiens
aaauauuuauaaaacuucuca

SEQ ID NO: 941626 - RNA, 15 nt, Homo sapiens
aaauauuucagugaa

SEQ ID NO: 941627 - RNA, 20 nt, Homo sapiens
aaauauuuuguaaugcugca

SEQ ID NO: 941628 - RNA, 14 nt, Homo sapiens
aaaucaaaugugca

SEQ ID NO: 941629 - RNA, 13 nt, Homo sapiens
aaaucacuugcca

SEQ ID NO: 941630 - RNA, 22 nt, Homo sapiens
aaaugaaagggaaacugggaaa

SEQ ID NO: 941631 - RNA, 16 nt, Homo sapiens
aaaugaagggauauaa

SEQ ID NO: 941632 - RNA, 19 nt, Homo sapiens
aaaugaaguuuugauuuau

SEQ ID NO: 941633 - RNA, 17 nt, Homo sapiens
aaaugccauuuagcaau

SEQ ID NO: 941634 - RNA, 13 nt, Homo sapiens
aaauggaagcaau

SEQ ID NO: 941635 - RNA, 21 nt, Homo sapiens
aaauggucacguuuggugcuu

SEQ ID NO: 941636 - RNA, 22 nt, Homo sapiens
aaauguggaggcuaucaacaaa

SEQ ID NO: 941637 - RNA, 22 nt, Homo sapiens
aaaugugucauuggaagccauc

SEQ ID NO: 941638 - RNA, 15 nt, Homo sapiens
aaauguuaacacuca

SEQ ID NO: 941639 - RNA, 22 nt, Homo sapiens
aaauguuaacacucaugaagca

SEQ ID NO: 941640 - RNA, 13 nt, Homo sapiens
aaauguuucuaca

SEQ ID NO: 941641 - RNA, 17 nt, Homo sapiens
aaauuaugaccauggua

SEQ ID NO: 941642 - RNA, 22 nt, Homo sapiens
aaauuauuguuaaagaauacac

SEQ ID NO: 941643 - RNA, 21 nt, Homo sapiens
aaauuauuuuuguucauauaa

SEQ ID NO: 941644 - RNA, 19 nt, Homo sapiens
aaauucaaauaaaaauccu

SEQ ID NO: 941645 - RNA, 15 nt, Homo sapiens
aaauucagaugcugu

SEQ ID NO: 941646 - RNA, 16 nt, Homo sapiens
aaauugaugugcccua

SEQ ID NO: 941647 - RNA, 14 nt, Homo sapiens
aaauuucaauaacc

SEQ ID NO: 941648 - RNA, 13 nt, Homo sapiens
aacaaaaagucau

SEQ ID NO: 941649 - RNA, 13 nt, Homo sapiens
aacaaacagggcu

SEQ ID NO: 941650 - RNA, 12 nt, Homo sapiens
aacaaagacagg

SEQ ID NO: 941651 - RNA, 14 nt, Homo sapiens
aacaaauauugcca

SEQ ID NO: 941652 - RNA, 16 nt, Homo sapiens
aacaacuuacacuuau

SEQ ID NO: 941653 - RNA, 16 nt, Homo sapiens
aacaaugcaacuuuua

SEQ ID NO: 941654 - RNA, 13 nt, Homo sapiens
aacaaugcauuuu

SEQ ID NO: 941655 - RNA, 21 nt, Homo sapiens
aacaauucuuauugacucaua

SEQ ID NO: 941656 - RNA, 13 nt, Homo sapiens
aacaccuccucau

SEQ ID NO: 941657 - RNA, 21 nt, Homo sapiens
aacagaaaccagaaaagcaau

SEQ ID NO: 941658 - RNA, 22 nt, Homo sapiens
aacagcauuacccuccucucuc

SEQ ID NO: 941659 - RNA, 19 nt, Homo sapiens
aacaggacagcacugggaa

SEQ ID NO: 941660 - RNA, 14 nt, Homo sapiens
aacaguggacaaag

SEQ ID NO: 941661 - RNA, 12 nt, Homo sapiens
aacaucaaagag

SEQ ID NO: 941662 - RNA, 20 nt, Homo sapiens
aacauuucuggacaguaccu

SEQ ID NO: 941663 - RNA, 23 nt, Homo sapiens
aaccacauaguucguuuaccuuc

SEQ ID NO: 941664 - RNA, 22 nt, Homo sapiens
aaccacuaagaauucaaacugg

SEQ ID NO: 941665 - RNA, 23 nt, Homo sapiens
aaccagcuucugauaaacacaau

SEQ ID NO: 941666 - RNA, 14 nt, Homo sapiens
aaccaguuuaucca

SEQ ID NO: 941667 - RNA, 18 nt, Homo sapiens
aaccaucgguccacaccu

SEQ ID NO: 941668 - RNA, 16 nt, Homo sapiens
aaccccaaacagugac

SEQ ID NO: 941669 - RNA, 23 nt, Homo sapiens
aacccccacccccacugccaggu

SEQ ID NO: 941670 - RNA, 14 nt, Homo sapiens
aaccccugaaguau

SEQ ID NO: 941671 - RNA, 23 nt, Homo sapiens
aacccuaaggugagugugcagua

SEQ ID NO: 941672 - RNA, 20 nt, Homo sapiens
aacccuagucaaaacuauuu

SEQ ID NO: 941673 - RNA, 20 nt, Homo sapiens
aacccucacaagcaugaagu

SEQ ID NO: 941674 - RNA, 22 nt, Homo sapiens
aacccuuuauuugaacaaugaa

SEQ ID NO: 941675 - RNA, 19 nt, Homo sapiens
aaccugguggcaccagaug

SEQ ID NO: 941676 - RNA, 22 nt, Homo sapiens
aaccuuacuaauuauacuacuu

SEQ ID NO: 941677 - RNA, 21 nt, Homo sapiens
aacguucgauuucuaccucag

SEQ ID NO: 941678 - RNA, 21 nt, Homo sapiens
aacuaggaaaaucacuugcca

SEQ ID NO: 941679 - RNA, 16 nt, Homo sapiens
aacuauucuguuccac

SEQ ID NO: 941680 - RNA, 17 nt, Homo sapiens
aacucaguuucuaggca

SEQ ID NO: 941681 - RNA, 14 nt, Homo sapiens
aacugauuuaucua

SEQ ID NO: 941682 - RNA, 22 nt, Homo sapiens
aacugugcguuaaauaagcaaa

SEQ ID NO: 941683 - RNA, 18 nt, Homo sapiens
aacuguuuuagaccuaua

SEQ ID NO: 941684 - RNA, 20 nt, Homo sapiens
aacuuuaguuuguguuauua

SEQ ID NO: 941685 - RNA, 17 nt, Homo sapiens
aacuuuguaguaugaua

SEQ ID NO: 941686 - RNA, 16 nt, Homo sapiens
aacuuuucuaccauuu

SEQ ID NO: 941687 - RNA, 14 nt, Homo sapiens
aagaaaaauaucuu

SEQ ID NO: 941688 - RNA, 17 nt, Homo sapiens
aagaaauacagacugga

SEQ ID NO: 941689 - RNA, 15 nt, Homo sapiens
aagaagcuuuauuuc

SEQ ID NO: 941690 - RNA, 18 nt, Homo sapiens
aagaagucggaaugucau

SEQ ID NO: 941691 - RNA, 14 nt, Homo sapiens
aagaauagcuuuaa

SEQ ID NO: 941692 - RNA, 17 nt, Homo sapiens
aagaauaugacuuuuua

SEQ ID NO: 941693 - RNA, 15 nt, Homo sapiens
aagaauuacauauga

SEQ ID NO: 941694 - RNA, 23 nt, Homo sapiens
aagaauucaaacuggggccucca

SEQ ID NO: 941695 - RNA, 13 nt, Homo sapiens
aagaauuggccag

SEQ ID NO: 941696 - RNA, 21 nt, Homo sapiens
aagacaucagauccugggcac

SEQ ID NO: 941697 - RNA, 17 nt, Homo sapiens
aagaccagccuggccaa

SEQ ID NO: 941698 - RNA, 23 nt, Homo sapiens
aagacugauuuuaauagggaaua

SEQ ID NO: 941699 - RNA, 16 nt, Homo sapiens
aagacuuuguccccac

SEQ ID NO: 941700 - RNA, 19 nt, Homo sapiens
aagacuuuguccccacuua

SEQ ID NO: 941701 - RNA, 21 nt, Homo sapiens
aagagaacucgcgcucaguaa

SEQ ID NO: 941702 - RNA, 16 nt, Homo sapiens
aagagaucuuucuuuc

SEQ ID NO: 941703 - RNA, 17 nt, Homo sapiens
aagagaucuuucuuucc

SEQ ID NO: 941704 - RNA, 16 nt, Homo sapiens
aagagcuuaagaacca

SEQ ID NO: 941705 - RNA, 23 nt, Homo sapiens
aagagcuuugugauauacugguu

SEQ ID NO: 941706 - RNA, 14 nt, Homo sapiens
aagagucagcaugg

SEQ ID NO: 941707 - RNA, 18 nt, Homo sapiens
aagaucucgguuugccaa

SEQ ID NO: 941708 - RNA, 13 nt, Homo sapiens
aagauucuauuua

SEQ ID NO: 941709 - RNA, 19 nt, Homo sapiens
aagauuuauacaguugaaa

SEQ ID NO: 941710 - RNA, 19 nt, Homo sapiens
aagauuuaugaugcacuua

SEQ ID NO: 941711 - RNA, 20 nt, Homo sapiens
aagcaaacaaauauugccaa

SEQ ID NO: 941712 - RNA, 16 nt, Homo sapiens
aagcaauacuguuucc

SEQ ID NO: 941713 - RNA, 15 nt, Homo sapiens
aagcaauuuguugcu

SEQ ID NO: 941714 - RNA, 17 nt, Homo sapiens
aagcacaaguacuuuug

SEQ ID NO: 941715 - RNA, 22 nt, Homo sapiens
aagcagcgaccgcccccuccuc

SEQ ID NO: 941716 - RNA, 16 nt, Homo sapiens
aagcaggggauccugg

SEQ ID NO: 941717 - RNA, 16 nt, Homo sapiens
aagcaucauuucccca

SEQ ID NO: 941718 - RNA, 18 nt, Homo sapiens
ccuggccaacauggcaaa

SEQ ID NO: 941719 - RNA, 19 nt, Homo sapiens
ccuggcuaacacggugaaa

SEQ ID NO: 941720 - RNA, 17 nt, Homo sapiens
ccugggcugucugucac

SEQ ID NO: 941721 - RNA, 12 nt, Homo sapiens
ccugguggcuuc

SEQ ID NO: 941722 - RNA, 20 nt, Homo sapiens
ccuguaaagucugaguaaga

SEQ ID NO: 941723 - RNA, 15 nt, Homo sapiens
ccuguagucccagcu

SEQ ID NO: 941724 - RNA, 21 nt, Homo sapiens
ccugucuuaauuuucuuucac

SEQ ID NO: 941725 - RNA, 14 nt, Homo sapiens
ccugugcauuuucu

SEQ ID NO: 941726 - RNA, 17 nt, Homo sapiens
ccugugcuacaauucau

SEQ ID NO: 941727 - RNA, 22 nt, Homo sapiens
ccuguugucaagaauagcauug

SEQ ID NO: 941728 - RNA, 17 nt, Homo sapiens
ccuguuugucuacauau

SEQ ID NO: 941729 - RNA, 19 nt, Homo sapiens
ccuuagaaaacaaguauug

SEQ ID NO: 941730 - RNA, 13 nt, Homo sapiens
ccuuaguugaaau

SEQ ID NO: 941731 - RNA, 12 nt, Homo sapiens
ccuucacagcua

SEQ ID NO: 941732 - RNA, 16 nt, Homo sapiens
ccuucagcgauuauuu

SEQ ID NO: 941733 - RNA, 17 nt, Homo sapiens
ccuucccccugcaaaaa

SEQ ID NO: 941734 - RNA, 23 nt, Homo sapiens
ccuucuccaccgcacagacuggg

SEQ ID NO: 941735 - RNA, 19 nt, Homo sapiens
ccuucugggcaacauggcc

SEQ ID NO: 941736 - RNA, 24 nt, Homo sapiens
ccuugaugacuuccuauccauucu

SEQ ID NO: 941737 - RNA, 19 nt, Homo sapiens
ccuuguucucaguggugca

SEQ ID NO: 941738 - RNA, 21 nt, Homo sapiens
cgaaaccugggauucaggaau

SEQ ID NO: 941739 - RNA, 21 nt, Homo sapiens
cgaaaugcuugcucaggcuca

SEQ ID NO: 941740 - RNA, 16 nt, Homo sapiens
cgaccacagggccuug

SEQ ID NO: 941741 - RNA, 18 nt, Homo sapiens
cgacuccacgcuguccuu

SEQ ID NO: 941742 - RNA, 17 nt, Homo sapiens
cgaggagcuccugggaa

SEQ ID NO: 941743 - RNA, 14 nt, Homo sapiens
cgaguguuugccag

SEQ ID NO: 941744 - RNA, 20 nt, Homo sapiens
cgauuuaugccucagccacu

SEQ ID NO: 941745 - RNA, 15 nt, Homo sapiens
cgcacacacagugau

SEQ ID NO: 941746 - RNA, 16 nt, Homo sapiens
cgccaaaacaagccaa

SEQ ID NO: 941747 - RNA, 20 nt, Homo sapiens
cgcccaaacuggagugcagu

SEQ ID NO: 941748 - RNA, 19 nt, Homo sapiens
cgcccugggcugucuguca

SEQ ID NO: 941749 - RNA, 19 nt, Homo sapiens
cgcuacccaccuccaggga

SEQ ID NO: 941750 - RNA, 19 nt, Homo sapiens
cgcugaagcgccuccccca

SEQ ID NO: 941751 - RNA, 16 nt, Homo sapiens
cgcuggcuggugggcc

SEQ ID NO: 941752 - RNA, 22 nt, Homo sapiens
cgcuugcaccacuuccguccca

SEQ ID NO: 941753 - RNA, 15 nt, Homo sapiens
cggccggguguggug

SEQ ID NO: 941754 - RNA, 21 nt, Homo sapiens
cggguaauucuauugggauau

SEQ ID NO: 941755 - RNA, 23 nt, Homo sapiens
cgggugagcugagcuuggcguuu

SEQ ID NO: 941756 - RNA, 21 nt, Homo sapiens
cguauuuggcacacagcagag

SEQ ID NO: 941757 - RNA, 16 nt, Homo sapiens
cguauuuuacaugaag

SEQ ID NO: 941758 - RNA, 18 nt, Homo sapiens
cagaaaaaugguggucau

SEQ ID NO: 941759 - RNA, 17 nt, Homo sapiens
cagaaaaccucuccuga

SEQ ID NO: 941760 - RNA, 17 nt, Homo sapiens
cagaaggccccagagag

SEQ ID NO: 941761 - RNA, 17 nt, Homo sapiens
cagaagggaaauuucaa

SEQ ID NO: 941762 - RNA, 22 nt, Homo sapiens
cagaaugcugcaggacuugaga

SEQ ID NO: 941763 - RNA, 18 nt, Homo sapiens
cagaaugugucucaggaa

SEQ ID NO: 941764 - RNA, 17 nt, Homo sapiens
cagacacugcugcugcc

SEQ ID NO: 941765 - RNA, 15 nt, Homo sapiens
cagacucucacaugc

SEQ ID NO: 941766 - RNA, 15 nt, Homo sapiens
cagacuuccuugaga

SEQ ID NO: 941767 - RNA, 15 nt, Homo sapiens
cagagagcacaguga

SEQ ID NO: 941768 - RNA, 16 nt, Homo sapiens
cagagagcacagugau

SEQ ID NO: 941769 - RNA, 18 nt, Homo sapiens
cagagaggaggggaccaa

SEQ ID NO: 941770 - RNA, 20 nt, Homo sapiens
cagaggauaucggcauuugu

SEQ ID NO: 941771 - RNA, 15 nt, Homo sapiens
cagauaaguuugcag

SEQ ID NO: 941772 - RNA, 14 nt, Homo sapiens
cagauaauuggcaa

SEQ ID NO: 941773 - RNA, 16 nt, Homo sapiens
cagaucgcucacuguu

SEQ ID NO: 941774 - RNA, 14 nt, Homo sapiens
cagauggcacuuug

SEQ ID NO: 941775 - RNA, 16 nt, Homo sapiens
cagauggcacuuugaa

SEQ ID NO: 941776 - RNA, 23 nt, Homo sapiens
cagauugaaaagaccuacagacu

SEQ ID NO: 941777 - RNA, 23 nt, Homo sapiens
cagauuuguaacauuaguuuuaa

SEQ ID NO: 941778 - RNA, 18 nt, Homo sapiens
cagauuuuuuccucugca

SEQ ID NO: 941779 - RNA, 16 nt, Homo sapiens
cagcaaaaugucuccu

SEQ ID NO: 941780 - RNA, 18 nt, Homo sapiens
cagcaauccaugagauag

SEQ ID NO: 941781 - RNA, 17 nt, Homo sapiens
cagcagcaaauuuucag

SEQ ID NO: 941782 - RNA, 22 nt, Homo sapiens
cagcccagcccuccucugucaa

SEQ ID NO: 941783 - RNA, 23 nt, Homo sapiens
cagcccaggucccuccgcggcug

SEQ ID NO: 941784 - RNA, 17 nt, Homo sapiens
cagccuagugaacugca

SEQ ID NO: 941785 - RNA, 22 nt, Homo sapiens
cagccuccagggcauugcucag

SEQ ID NO: 941786 - RNA, 14 nt, Homo sapiens
cagccucugccagc

SEQ ID NO: 941787 - RNA, 12 nt, Homo sapiens
cagcguggggga

SEQ ID NO: 941788 - RNA, 18 nt, Homo sapiens
cagcuaacccuagucaaa

SEQ ID NO: 941789 - RNA, 18 nt, Homo sapiens
cagcuaucugucaucucu

SEQ ID NO: 941790 - RNA, 14 nt, Homo sapiens
cagcuccuguaaca

SEQ ID NO: 941791 - RNA, 21 nt, Homo sapiens
cagcuccuguaacauacuggc

SEQ ID NO: 941792 - RNA, 21 nt, Homo sapiens
cagcuucugauaaacacaauc

SEQ ID NO: 941793 - RNA, 14 nt, Homo sapiens
cagcuuugcaaaau

SEQ ID NO: 941794 - RNA, 21 nt, Homo sapiens
caggaagcccaggagccucac

SEQ ID NO: 941795 - RNA, 21 nt, Homo sapiens
caggaagggggccgacuccac

SEQ ID NO: 941796 - RNA, 12 nt, Homo sapiens
caggacacuggu

SEQ ID NO: 941797 - RNA, 22 nt, Homo sapiens
caggacuuccaucugugccaua

SEQ ID NO: 941798 - RNA, 20 nt, Homo sapiens
caggacuugagaagaccuca

SEQ ID NO: 941799 - RNA, 15 nt, Homo sapiens
caggagagucacuug

SEQ ID NO: 941800 - RNA, 17 nt, Homo sapiens
caggagcaggcacgggu

SEQ ID NO: 941801 - RNA, 22 nt, Homo sapiens
caggauacuggcacagagguag

SEQ ID NO: 941802 - RNA, 13 nt, Homo sapiens
caggccaauguca

SEQ ID NO: 941803 - RNA, 20 nt, Homo sapiens
caggcuauguauaaaauaca

SEQ ID NO: 941804 - RNA, 14 nt, Homo sapiens
caggcugggccaug

SEQ ID NO: 941805 - RNA, 17 nt, Homo sapiens
caggcugggccaugucc

SEQ ID NO: 941806 - RNA, 19 nt, Homo sapiens
caggcugggccauguccaa

SEQ ID NO: 941807 - RNA, 15 nt, Homo sapiens
cagggccacauagau

SEQ ID NO: 941808 - RNA, 15 nt, Homo sapiens
cagggccucugcucu

SEQ ID NO: 941809 - RNA, 18 nt, Homo sapiens
cagggccuugaauccuuu

SEQ ID NO: 941810 - RNA, 13 nt, Homo sapiens
caggggcucccac

SEQ ID NO: 941811 - RNA, 20 nt, Homo sapiens
cagggugacccugaagugag

SEQ ID NO: 941812 - RNA, 15 nt, Homo sapiens
cagguaaaacagggc

SEQ ID NO: 941813 - RNA, 19 nt, Homo sapiens
cagguaaagggcaaauaau

SEQ ID NO: 941814 - RNA, 19 nt, Homo sapiens
cagguaccucuuucagggu

SEQ ID NO: 941815 - RNA, 20 nt, Homo sapiens
cagguaugguggcauauacu

SEQ ID NO: 941816 - RNA, 18 nt, Homo sapiens
caguaaaaauaaaauacu

SEQ ID NO: 941817 - RNA, 13 nt, Homo sapiens
caguaaacgggaa

SEQ ID NO: 941818 - RNA, 19 nt, Homo sapiens
caguaaacgggaacaugcc

SEQ ID NO: 941819 - RNA, 22 nt, Homo sapiens
caguacccacucuggagcauuu

SEQ ID NO: 941820 - RNA, 23 nt, Homo sapiens
caguacccacucuggagcauuuc

SEQ ID NO: 941821 - RNA, 16 nt, Homo sapiens
caguaccuagcuggcu

SEQ ID NO: 941822 - RNA, 16 nt, Homo sapiens
caguagagcucuacug

SEQ ID NO: 941823 - RNA, 22 nt, Homo sapiens
caguagagcucuacugccucaa

SEQ ID NO: 941824 - RNA, 22 nt, Homo sapiens
caguauaagcaucugccaucug

SEQ ID NO: 941825 - RNA, 16 nt, Homo sapiens
caguauccacacauaa

SEQ ID NO: 941826 - RNA, 17 nt, Homo sapiens
uugacacuuguugucca

SEQ ID NO: 941827 - RNA, 16 nt, Homo sapiens
uugagugucuucuaac

SEQ ID NO: 941828 - RNA, 22 nt, Homo sapiens
uugcaacuuuaguuuguguuau

SEQ ID NO: 941829 - RNA, 12 nt, Homo sapiens
uugcacauuaau

SEQ ID NO: 941830 - RNA, 20 nt, Homo sapiens
uugcacauuaaucagauuag

SEQ ID NO: 941831 - RNA, 19 nt, Homo sapiens
uugcagucucucucugcca

SEQ ID NO: 941832 - RNA, 14 nt, Homo sapiens
uugcaugcuugcau

SEQ ID NO: 941833 - RNA, 20 nt, Homo sapiens
uugcauuccagccugggcaa

SEQ ID NO: 941834 - RNA, 16 nt, Homo sapiens
uugcccuugugcucca

SEQ ID NO: 941835 - RNA, 22 nt, Homo sapiens
uugcugaccauuuuggauguca

SEQ ID NO: 941836 - RNA, 11 nt, Homo sapiens
uugcuguauau

SEQ ID NO: 941837 - RNA, 22 nt, Homo sapiens
uuggcuacgaaaugcuugcuca

SEQ ID NO: 941838 - RNA, 17 nt, Homo sapiens
uugggaagggcagggaa

SEQ ID NO: 941839 - RNA, 14 nt, Homo sapiens
uugggagcugccaa

SEQ ID NO: 941840 - RNA, 17 nt, Homo sapiens
uugggaguaggugcuaa

SEQ ID NO: 941841 - RNA, 23 nt, Homo sapiens
uugggaguaggugcuaaccugga

SEQ ID NO: 941842 - RNA, 20 nt, Homo sapiens
uugggauauccuuucacucu

SEQ ID NO: 941843 - RNA, 16 nt, Homo sapiens
uuggggcagaccccag

SEQ ID NO: 941844 - RNA, 15 nt, Homo sapiens
uuggugauucugaau

SEQ ID NO: 941845 - RNA, 15 nt, Homo sapiens
uuguaauaauaaaga

SEQ ID NO: 941846 - RNA, 17 nt, Homo sapiens
uuguaauguaucaaaua

SEQ ID NO: 941847 - RNA, 15 nt, Homo sapiens
uugucuaccuucuuu

SEQ ID NO: 941848 - RNA, 19 nt, Homo sapiens
uuguguaagaaauacagac

SEQ ID NO: 941849 - RNA, 16 nt, Homo sapiens
uuguguauccaugcac

SEQ ID NO: 941850 - RNA, 14 nt, Homo sapiens
uuguguuaccugua

SEQ ID NO: 941851 - RNA, 19 nt, Homo sapiens
uuguucgccgcguggaaug

SEQ ID NO: 941852 - RNA, 22 nt, Homo sapiens
uuguucgccgcguggaauguga

SEQ ID NO: 941853 - RNA, 13 nt, Homo sapiens
uuguucuguauau

SEQ ID NO: 941854 - RNA, 14 nt, Homo sapiens
uuguucuucaggag

SEQ ID NO: 941855 - RNA, 14 nt, Homo sapiens
uuguugcugucaag

SEQ ID NO: 941856 - RNA, 16 nt, Homo sapiens
uuguugcugucaagau

SEQ ID NO: 941857 - RNA, 16 nt, Homo sapiens
uuguuucccccucuuu

SEQ ID NO: 941858 - RNA, 19 nt, Homo sapiens
uuguuuuacccuauacauc

SEQ ID NO: 941859 - RNA, 22 nt, Homo sapiens
uuuaaagcauauuggugcuaga

SEQ ID NO: 941860 - RNA, 22 nt, Homo sapiens
uuuaaauuacaauuuuaucugu

SEQ ID NO: 941861 - RNA, 19 nt, Homo sapiens
uuuaacaugguauuaucaa

SEQ ID NO: 941862 - RNA, 20 nt, Homo sapiens
uuuaacucaguuucuaggca

SEQ ID NO: 941863 - RNA, 20 nt, Homo sapiens
uuuaagcuuuccuguugaau

SEQ ID NO: 941864 - RNA, 21 nt, Homo sapiens
uuuaauaggugcagucuuuga

SEQ ID NO: 941865 - RNA, 16 nt, Homo sapiens
uuuaaucaaguugaau

SEQ ID NO: 941866 - RNA, 16 nt, Homo sapiens
uuuaauccuaccucaa

SEQ ID NO: 941867 - RNA, 14 nt, Homo sapiens
uuuaaucucuaaca

SEQ ID NO: 941868 - RNA, 12 nt, Homo sapiens
uuuaaugaguca

SEQ ID NO: 941869 - RNA, 15 nt, Homo sapiens
uuuaauuucuaugaa

SEQ ID NO: 941870 - RNA, 18 nt, Homo sapiens
uuuaccuucaaacuuuag

SEQ ID NO: 941871 - RNA, 22 nt, Homo sapiens
uuuaggaaugguucucucaaca

SEQ ID NO: 941872 - RNA, 21 nt, Homo sapiens
uuuaguaauauuuuacuuuga

SEQ ID NO: 941873 - RNA, 15 nt, Homo sapiens
uuuauacaguugaaa

SEQ ID NO: 941874 - RNA, 20 nt, Homo sapiens
uuuaucauucaaguguaaaa

SEQ ID NO: 941875 - RNA, 16 nt, Homo sapiens
uuuauuuaacuauuca

SEQ ID NO: 941876 - RNA, 16 nt, Homo sapiens
uuucaacagucuugcu

SEQ ID NO: 941877 - RNA, 23 nt, Homo sapiens
uuucaauaaaaguaaagacugua

SEQ ID NO: 941878 - RNA, 14 nt, Homo sapiens
uuucauacaacaga

SEQ ID NO: 941879 - RNA, 12 nt, Homo sapiens
uuuccaaaacau

SEQ ID NO: 941880 - RNA, 16 nt, Homo sapiens
uuuccaaaacauuucu

SEQ ID NO: 941881 - RNA, 14 nt, Homo sapiens
uuucccaacacaaa

SEQ ID NO: 941882 - RNA, 22 nt, Homo sapiens
uuuccuaucauguuaaccucug

SEQ ID NO: 941883 - RNA, 20 nt, Homo sapiens
uuuccucugugcaaagggaa

SEQ ID NO: 941884 - RNA, 23 nt, Homo sapiens
uuuccuguauguuguacaaucaa

SEQ ID NO: 941885 - RNA, 20 nt, Homo sapiens
uuucuacaaugugaacuuua

SEQ ID NO: 941886 - RNA, 20 nt, Homo sapiens
uuucucccucuuucuuccca

SEQ ID NO: 941887 - RNA, 18 nt, Homo sapiens
uuucucgggugcauuuga

SEQ ID NO: 941888 - RNA, 16 nt, Homo sapiens
uuucuuagugugccaa

SEQ ID NO: 941889 - RNA, 18 nt, Homo sapiens
uuucuuuagcaugcuaca

SEQ ID NO: 941890 - RNA, 17 nt, Homo sapiens
uuucuuugcaccaaaga

SEQ ID NO: 941891 - RNA, 12 nt, Homo sapiens
uuugcagucucu

SEQ ID NO: 941892 - RNA, 19 nt, Homo sapiens
uuuggaaauugagucugaa

SEQ ID NO: 941893 - RNA, 16 nt, Homo sapiens
uuuggacccaguucag

SEQ ID NO: 941894 - RNA, 15 nt, Homo sapiens
uuuggagagugcuau

SEQ ID NO: 941895 - RNA, 13 nt, Homo sapiens
uuuggcauguaaa

SEQ ID NO: 941896 - RNA, 13 nt, Homo sapiens
uuugguuugaccc

SEQ ID NO: 941897 - RNA, 15 nt, Homo sapiens
uuuguaaugcugcac

SEQ ID NO: 941898 - RNA, 15 nt, Homo sapiens
uuuuaagugauguca

SEQ ID NO: 941899 - RNA, 19 nt, Homo sapiens
uuuuaauaagaacauuaau

SEQ ID NO: 941900 - RNA, 15 nt, Homo sapiens
uuuuacacuugcauc

SEQ ID NO: 941901 - RNA, 17 nt, Homo sapiens
uuuuacauuucauacaa

SEQ ID NO: 941902 - RNA, 15 nt, Homo sapiens
uuuuacugugauuca

SEQ ID NO: 941903 - RNA, 13 nt, Homo sapiens
uuuuauuguugua

SEQ ID NO: 941904 - RNA, 19 nt, Homo sapiens
uuuucaauuugagauucua

SEQ ID NO: 941905 - RNA, 23 nt, Homo sapiens
uuuucucccgucaccacccagua

SEQ ID NO: 941906 - RNA, 13 nt, Homo sapiens
uuuucugaagaca

SEQ ID NO: 941907 - RNA, 15 nt, Homo sapiens
uuuugcuacauucua

SEQ ID NO: 941908 - RNA, 18 nt, Homo sapiens
uuuuggguguuccuggca

SEQ ID NO: 941909 - RNA, 22 nt, Homo sapiens
uuuugucagaggcuccaaauag

SEQ ID NO: 941910 - RNA, 11 nt, Homo sapiens
uuuuugcugaa

SEQ ID NO: 941911 - RNA, 18 nt, Homo sapiens
uuuuuggcauuccaccuc

SEQ ID NO: 941912 - RNA, 21 nt, Homo sapiens
ucuuuguauauuuacaugcuu

SEQ ID NO: 941913 - RNA, 22 nt, Homo sapiens
ugaaaaaagguuguguagcugu

SEQ ID NO: 941914 - RNA, 16 nt, Homo sapiens
ugaaaacaaaggugcc

SEQ ID NO: 941915 - RNA, 15 nt, Homo sapiens
ugaaaacagugugua

SEQ ID NO: 941916 - RNA, 13 nt, Homo sapiens
ugaaaacuuugua

SEQ ID NO: 941917 - RNA, 20 nt, Homo sapiens
ugaaaauauuucucuagugu

SEQ ID NO: 941918 - RNA, 23 nt, Homo sapiens
ugaaaauuauuuuggaaauugag

SEQ ID NO: 941919 - RNA, 18 nt, Homo sapiens
ugaaaccccaaacaguga

SEQ ID NO: 941920 - RNA, 13 nt, Homo sapiens
ugaaagaaaccac

SEQ ID NO: 941921 - RNA, 16 nt, Homo sapiens
ugaaaugacauguucc

SEQ ID NO: 941922 - RNA, 21 nt, Homo sapiens
ugaaauucacccccuuuccug

SEQ ID NO: 941923 - RNA, 18 nt, Homo sapiens
ugaaccugaauauugcca

SEQ ID NO: 941924 - RNA, 16 nt, Homo sapiens
ugaaccuucugcaaca

SEQ ID NO: 941925 - RNA, 19 nt, Homo sapiens
ugaagauuuaugaugcacu

SEQ ID NO: 941926 - RNA, 22 nt, Homo sapiens
ugaauaaacugaaaauggaccu

SEQ ID NO: 941927 - RNA, 19 nt, Homo sapiens
ugaauaccacuuaccucaa

SEQ ID NO: 941928 - RNA, 19 nt, Homo sapiens
ugaauaugaugacaaucag

SEQ ID NO: 941929 - RNA, 19 nt, Homo sapiens
ugaauuaauaauaaagcua

SEQ ID NO: 941930 - RNA, 13 nt, Homo sapiens
ugaauuuguccaa

SEQ ID NO: 941931 - RNA, 17 nt, Homo sapiens
ugacaaaccauaacuga

SEQ ID NO: 941932 - RNA, 17 nt, Homo sapiens
ugacaaaguaugugguu

SEQ ID NO: 941933 - RNA, 20 nt, Homo sapiens
ugacaaggcacuucauguaa

SEQ ID NO: 941934 - RNA, 16 nt, Homo sapiens
ugacaggaaagcccuc

SEQ ID NO: 941935 - RNA, 17 nt, Homo sapiens
ugacaguccacaggggc

SEQ ID NO: 941936 - RNA, 18 nt, Homo sapiens
ugacccuugcugugaauu

SEQ ID NO: 941937 - RNA, 22 nt, Homo sapiens
ugaccuggaaucagugaagcca

SEQ ID NO: 941938 - RNA, 16 nt, Homo sapiens
ugacuccugcucucug

SEQ ID NO: 941939 - RNA, 20 nt, Homo sapiens
ugacuguguuguaccaaaau

SEQ ID NO: 941940 - RNA, 23 nt, Homo sapiens
ugagaaaugggacuuaacuccuu

SEQ ID NO: 941941 - RNA, 12 nt, Homo sapiens
ugagagcaauau

SEQ ID NO: 941942 - RNA, 16 nt, Homo sapiens
ugagauaggaucacuu

SEQ ID NO: 941943 - RNA, 17 nt, Homo sapiens
ugagauaggaucacuug

SEQ ID NO: 941944 - RNA, 15 nt, Homo sapiens
ugagcaagacauacu

SEQ ID NO: 941945 - RNA, 16 nt, Homo sapiens
ugagccaucaucaugg

SEQ ID NO: 941946 - RNA, 20 nt, Homo sapiens
ugagccccuggaggcacuga

SEQ ID NO: 941947 - RNA, 18 nt, Homo sapiens
ugagccgagaucaugcca

SEQ ID NO: 941948 - RNA, 23 nt, Homo sapiens
ugaggacgagacccccauccagc

SEQ ID NO: 941949 - RNA, 18 nt, Homo sapiens
ugaggccuagacucuguc

SEQ ID NO: 941950 - RNA, 15 nt, Homo sapiens
ugagucauaucuuaa

SEQ ID NO: 941951 - RNA, 19 nt, Homo sapiens
ugagugucuucuaacuuua

SEQ ID NO: 941952 - RNA, 13 nt, Homo sapiens
ugaguguguuugu

SEQ ID NO: 941953 - RNA, 22 nt, Homo sapiens
ugauaagcuauugucuguaaua

SEQ ID NO: 941954 - RNA, 13 nt, Homo sapiens
ugauagcacuuuc

SEQ ID NO: 941955 - RNA, 23 nt, Homo sapiens
ugauagcacuuucuacaauguga

SEQ ID NO: 941956 - RNA, 23 nt, Homo sapiens
ugauaguuucccauaacaaccug

SEQ ID NO: 941957 - RNA, 20 nt, Homo sapiens
ugaugacuuccuauccauuc

SEQ ID NO: 941958 - RNA, 14 nt, Homo sapiens
ugaugagcacgguu

SEQ ID NO: 941959 - RNA, 21 nt, Homo sapiens
ugauguauuucaagucucuca

SEQ ID NO: 941960 - RNA, 20 nt, Homo sapiens
ugauguuuguguauguggga

SEQ ID NO: 941961 - RNA, 23 nt, Homo sapiens
ugauuagaaagaccaggccaaug

SEQ ID NO: 941962 - RNA, 13 nt, Homo sapiens
ugcaaaccaacag

SEQ ID NO: 941963 - RNA, 17 nt, Homo sapiens
ugcaacuuuuaauuacu

SEQ ID NO: 941964 - RNA, 15 nt, Homo sapiens
ugcaauguaagcaua

SEQ ID NO: 941965 - RNA, 14 nt, Homo sapiens
ugcacaccuuggaa

SEQ ID NO: 941966 - RNA, 21 nt, Homo sapiens
ugcacaccuuggaauucgcuu

SEQ ID NO: 941967 - RNA, 20 nt, Homo sapiens
ugcacagauaaguaggccau

SEQ ID NO: 941968 - RNA, 11 nt, Homo sapiens
ugcaccaaaga

SEQ ID NO: 941969 - RNA, 18 nt, Homo sapiens
ugcaccaaagacaucagu

SEQ ID NO: 941970 - RNA, 20 nt, Homo sapiens
ugcaccacuuccgucccauc

SEQ ID NO: 941971 - RNA, 19 nt, Homo sapiens
ugcaccccaggaaaggagg

SEQ ID NO: 941972 - RNA, 12 nt, Homo sapiens
ugcaccuaccuu

SEQ ID NO: 941973 - RNA, 15 nt, Homo sapiens
ugcaccugugcauuu

SEQ ID NO: 941974 - RNA, 15 nt, Homo sapiens
ugcacuucaaauuca

SEQ ID NO: 941975 - RNA, 20 nt, Homo sapiens
ugcacuucaaauucaaauaa

SEQ ID NO: 941976 - RNA, 20 nt, Homo sapiens
ugcauacuuucccucaucca

SEQ ID NO: 941977 - RNA, 21 nt, Homo sapiens
ugcauacuuucccucauccau

SEQ ID NO: 941978 - RNA, 12 nt, Homo sapiens
ugcaucagaaag

SEQ ID NO: 941979 - RNA, 14 nt, Homo sapiens
ugcaugcuugcaua

SEQ ID NO: 941980 - RNA, 11 nt, Homo sapiens
ugcaugggcuc

SEQ ID NO: 941981 - RNA, 20 nt, Homo sapiens
ugcauuccagccugggcaac

SEQ ID NO: 941982 - RNA, 20 nt, Homo sapiens
accuuuugggaauguuuuaa

SEQ ID NO: 941983 - RNA, 14 nt, Homo sapiens
acgaaaugcuugcu

SEQ ID NO: 941984 - RNA, 15 nt, Homo sapiens
acgccacucauuuca

SEQ ID NO: 941985 - RNA, 20 nt, Homo sapiens
acgccacucauuucaucuca

SEQ ID NO: 941986 - RNA, 21 nt, Homo sapiens
acgcuggggaauauacgugcu

SEQ ID NO: 941987 - RNA, 22 nt, Homo sapiens
acgguaccaauucagugucugu

SEQ ID NO: 941988 - RNA, 19 nt, Homo sapiens
acguauuuaugucccugac

SEQ ID NO: 941989 - RNA, 19 nt, Homo sapiens
acuaauuauacuacuuugu

SEQ ID NO: 941990 - RNA, 19 nt, Homo sapiens
aguauaaaugaauuugcau

SEQ ID NO: 941991 - RNA, 14 nt, Homo sapiens
aguaugacaaccuc

SEQ ID NO: 941992 - RNA, 15 nt, Homo sapiens
aguaugacaaccucu

SEQ ID NO: 941993 - RNA, 23 nt, Homo sapiens
aguauuuuuuaauccuaccucaa

SEQ ID NO: 941994 - RNA, 18 nt, Homo sapiens
agucccaguauaccucau

SEQ ID NO: 941995 - RNA, 20 nt, Homo sapiens
aguccuuaucaccagccuca

SEQ ID NO: 941996 - RNA, 14 nt, Homo sapiens
agucggaaugucau

SEQ ID NO: 941997 - RNA, 19 nt, Homo sapiens
agucuggcgucuccagacu

SEQ ID NO: 941998 - RNA, 14 nt, Homo sapiens
agucuguaccucaa

SEQ ID NO: 941999 - RNA, 15 nt, Homo sapiens
agucuguaccucaaa

SEQ ID NO: 942000 - RNA, 20 nt, Homo sapiens
agucugucgauuuaugccuc

SEQ ID NO: 942001 - RNA, 16 nt, Homo sapiens
agucuucacuaaccuu

SEQ ID NO: 942002 - RNA, 13 nt, Homo sapiens
agugaaucuguau

SEQ ID NO: 942003 - RNA, 13 nt, Homo sapiens
agugagacagacu

SEQ ID NO: 942004 - RNA, 18 nt, Homo sapiens
agugaucuguguucaaaa

SEQ ID NO: 942005 - RNA, 21 nt, Homo sapiens
agugauggcuuaugauagcaa

SEQ ID NO: 942006 - RNA, 14 nt, Homo sapiens
agugauuacuguca

SEQ ID NO: 942007 - RNA, 16 nt, Homo sapiens
agugcauuugugcuag

SEQ ID NO: 942008 - RNA, 16 nt, Homo sapiens
aguggaggcacuuuag

SEQ ID NO: 942009 - RNA, 12 nt, Homo sapiens
aguggucuucaa

SEQ ID NO: 942010 - RNA, 17 nt, Homo sapiens
aguguauuaucacuguc

SEQ ID NO: 942011 - RNA, 18 nt, Homo sapiens
aguguauuaucacugucu

SEQ ID NO: 942012 - RNA, 15 nt, Homo sapiens
aguuaguuccacuga

SEQ ID NO: 942013 - RNA, 21 nt, Homo sapiens
aguuauaggaacaauucucuu

SEQ ID NO: 942014 - RNA, 20 nt, Homo sapiens
aguuaugccucugacagucc

SEQ ID NO: 942015 - RNA, 15 nt, Homo sapiens
aguuccccaaauaca

SEQ ID NO: 942016 - RNA, 22 nt, Homo sapiens
aguucgagacuagccugggaaa

SEQ ID NO: 942017 - RNA, 13 nt, Homo sapiens
aguugcaguauug

SEQ ID NO: 942018 - RNA, 19 nt, Homo sapiens
aguuguucgccgcguggaa

SEQ ID NO: 942019 - RNA, 22 nt, Homo sapiens
aguuuggcugcugucauaacau

SEQ ID NO: 942020 - RNA, 18 nt, Homo sapiens
auaaacggcaguguuaaa

SEQ ID NO: 942021 - RNA, 22 nt, Homo sapiens
auaaacugauuuaucuauuuaa

SEQ ID NO: 942022 - RNA, 12 nt, Homo sapiens
auaaauguaucu

SEQ ID NO: 942023 - RNA, 21 nt, Homo sapiens
auaacaaccugggcauuccuu

SEQ ID NO: 942024 - RNA, 23 nt, Homo sapiens
auaaccagcugaaguugcagaug

SEQ ID NO: 942025 - RNA, 15 nt, Homo sapiens
auaaccuuucacuua

SEQ ID NO: 942026 - RNA, 14 nt, Homo sapiens
auaacucuccagua

SEQ ID NO: 942027 - RNA, 22 nt, Homo sapiens
auaacuguaaaugugacauuga

SEQ ID NO: 942028 - RNA, 14 nt, Homo sapiens
auaagagucagcau

SEQ ID NO: 942029 - RNA, 16 nt, Homo sapiens
auaaguagaaagaauu

SEQ ID NO: 942030 - RNA, 16 nt, Homo sapiens
auaaguuugcaguugg

SEQ ID NO: 942031 - RNA, 17 nt, Homo sapiens
auaaguuuuagaaucuu

SEQ ID NO: 942032 - RNA, 17 nt, Homo sapiens
auaauaaugaugaugau

SEQ ID NO: 942033 - RNA, 20 nt, Homo sapiens
auaauuuuccucaaucacac

SEQ ID NO: 942034 - RNA, 21 nt, Homo sapiens
auaauuuuccucaaucacacu

SEQ ID NO: 942035 - RNA, 14 nt, Homo sapiens
auacaaaucaucca

SEQ ID NO: 942036 - RNA, 13 nt, Homo sapiens
auacacauauagu

SEQ ID NO: 942037 - RNA, 17 nt, Homo sapiens
auacaccuuauuaauga

SEQ ID NO: 942038 - RNA, 17 nt, Homo sapiens
auacauuguacuuauac

SEQ ID NO: 942039 - RNA, 14 nt, Homo sapiens
auaccaacuguaca

SEQ ID NO: 942040 - RNA, 12 nt, Homo sapiens
auacuaccucug

SEQ ID NO: 942041 - RNA, 22 nt, Homo sapiens
auacuauuuaaagccuccucau

SEQ ID NO: 942042 - RNA, 22 nt, Homo sapiens
auacuauuuaagaugugaaaau

SEQ ID NO: 942043 - RNA, 23 nt, Homo sapiens
auacucagguaccucuuucaggg

SEQ ID NO: 942044 - RNA, 14 nt, Homo sapiens
auacuuggaccuca

SEQ ID NO: 942045 - RNA, 15 nt, Homo sapiens
auacuuggaccucag

SEQ ID NO: 942046 - RNA, 19 nt, Homo sapiens
auacuuggaugcagcucuu

SEQ ID NO: 942047 - RNA, 15 nt, Homo sapiens
auagaaaugucucaa

SEQ ID NO: 942048 - RNA, 16 nt, Homo sapiens
auagcaaauggccuca

SEQ ID NO: 942049 - RNA, 14 nt, Homo sapiens
auagcaagugaaag

SEQ ID NO: 942050 - RNA, 17 nt, Homo sapiens
auaggacauugugucag

SEQ ID NO: 942051 - RNA, 17 nt, Homo sapiens
auaggccuucauuaaca

SEQ ID NO: 942052 - RNA, 22 nt, Homo sapiens
auagugucauccucacagugaa

SEQ ID NO: 942053 - RNA, 16 nt, Homo sapiens
auaguuucccauaaca

SEQ ID NO: 942054 - RNA, 15 nt, Homo sapiens
auauacaaaacuuua

SEQ ID NO: 942055 - RNA, 16 nt, Homo sapiens
auauacaaaacuuuau

SEQ ID NO: 942056 - RNA, 22 nt, Homo sapiens
auauaccacucuuuaccuuuau

SEQ ID NO: 942057 - RNA, 12 nt, Homo sapiens
auauaccaucuc

SEQ ID NO: 942058 - RNA, 19 nt, Homo sapiens
auauaccuuuuugugucaa

SEQ ID NO: 942059 - RNA, 12 nt, Homo sapiens
auauagcauuaa

SEQ ID NO: 942060 - RNA, 15 nt, Homo sapiens
auauaggcuucucac

SEQ ID NO: 942061 - RNA, 13 nt, Homo sapiens
auauauaaucauc

SEQ ID NO: 942062 - RNA, 20 nt, Homo sapiens
auauauuuacaaggaguuau

SEQ ID NO: 942063 - RNA, 11 nt, Homo sapiens
auaucuuggcc

SEQ ID NO: 942064 - RNA, 15 nt, Homo sapiens
auauuaaaagaacuc

SEQ ID NO: 942065 - RNA, 19 nt, Homo sapiens
auauuaagacaauagcacu

SEQ ID NO: 942066 - RNA, 23 nt, Homo sapiens
auauuucucuaguguauuaucac

SEQ ID NO: 942067 - RNA, 22 nt, Homo sapiens
aucaaaacacacuacuaccucu

SEQ ID NO: 942068 - RNA, 14 nt, Homo sapiens
aucaagagggauaa

SEQ ID NO: 942069 - RNA, 13 nt, Homo sapiens
aucaaguaauaca

SEQ ID NO: 942070 - RNA, 18 nt, Homo sapiens
aucacccuaccaacuuua

SEQ ID NO: 942071 - RNA, 13 nt, Homo sapiens
aucacgaggucag

SEQ ID NO: 942072 - RNA, 22 nt, Homo sapiens
aucacgucacugcacuccagcu

SEQ ID NO: 942073 - RNA, 15 nt, Homo sapiens
aucagaaggugacaa

SEQ ID NO: 942074 - RNA, 19 nt, Homo sapiens
aucagcucuugaugccuuu

SEQ ID NO: 942075 - RNA, 21 nt, Homo sapiens
aucaggugcauagcaagugaa

SEQ ID NO: 942076 - RNA, 18 nt, Homo sapiens
aucaguauuuaauaucug

SEQ ID NO: 942077 - RNA, 19 nt, Homo sapiens
aucaucaaguaauacaaac

SEQ ID NO: 942078 - RNA, 19 nt, Homo sapiens
aucaucauccuacaacuca

SEQ ID NO: 942079 - RNA, 16 nt, Homo sapiens
aucaucauggcaucau

SEQ ID NO: 942080 - RNA, 20 nt, Homo sapiens
aucauuuccccaacagggca

SEQ ID NO: 942081 - RNA, 19 nt, Homo sapiens
auccagcaaaaugucuccu

SEQ ID NO: 942082 - RNA, 16 nt, Homo sapiens
auccagccuccagggc

SEQ ID NO: 942083 - RNA, 24 nt, Homo sapiens
auccauccuugccaauagugucau

SEQ ID NO: 942084 - RNA, 15 nt, Homo sapiens
auccauugaacuaaa

SEQ ID NO: 942085 - RNA, 15 nt, Homo sapiens
aucccuagugcucca

SEQ ID NO: 942086 - RNA, 22 nt, Homo sapiens
aucccugacaucuggaaucugg

SEQ ID NO: 942087 - RNA, 13 nt, Homo sapiens
auccuaacauuca

SEQ ID NO: 942088 - RNA, 21 nt, Homo sapiens
auccuaccccuuugcacuugu

SEQ ID NO: 942089 - RNA, 23 nt, Homo sapiens
auccugugcaauagacacauaca

SEQ ID NO: 942090 - RNA, 16 nt, Homo sapiens
auccuuccacuaucau

SEQ ID NO: 942091 - RNA, 21 nt, Homo sapiens
aaaacacacuacuaccucuua

SEQ ID NO: 942092 - RNA, 17 nt, Homo sapiens
aaaacaguguguaaaca

SEQ ID NO: 942093 - RNA, 20 nt, Homo sapiens
aaaaccccaucuuuacuaaa

SEQ ID NO: 942094 - RNA, 18 nt, Homo sapiens
aaaaccuacccucaguga

SEQ ID NO: 942095 - RNA, 22 nt, Homo sapiens
aaaaccuacccucagugagcau

SEQ ID NO: 942096 - RNA, 11 nt, Homo sapiens
aaaacuacuga

SEQ ID NO: 942097 - RNA, 18 nt, Homo sapiens
aaaacuacugacagggag

SEQ ID NO: 942098 - RNA, 18 nt, Homo sapiens
cuaaagucuguugauuaa

SEQ ID NO: 942099 - RNA, 19 nt, Homo sapiens
cuaaauguuuggcauguaa

SEQ ID NO: 942100 - RNA, 18 nt, Homo sapiens
cuaacccucacaagcaug

SEQ ID NO: 942101 - RNA, 19 nt, Homo sapiens
cuaaccuggauaacuguaa

SEQ ID NO: 942102 - RNA, 17 nt, Homo sapiens
cuaagguucagccugaa

SEQ ID NO: 942103 - RNA, 18 nt, Homo sapiens
cuaagguuuagauaaaua

SEQ ID NO: 942104 - RNA, 18 nt, Homo sapiens
cuaauuauacuacuuugu

SEQ ID NO: 942105 - RNA, 18 nt, Homo sapiens
cuaauuuauaacuauuau

SEQ ID NO: 942106 - RNA, 14 nt, Homo sapiens
cuacagaugugcug

SEQ ID NO: 942107 - RNA, 14 nt, Homo sapiens
cuacagcccagugg

SEQ ID NO: 942108 - RNA, 19 nt, Homo sapiens
cuacagggacacuaucacu

SEQ ID NO: 942109 - RNA, 17 nt, Homo sapiens
cuacauaugaucugucu

SEQ ID NO: 942110 - RNA, 23 nt, Homo sapiens
cuacaucuccaaugugcuuucua

SEQ ID NO: 942111 - RNA, 13 nt, Homo sapiens
cuacccucaguga

SEQ ID NO: 942112 - RNA, 17 nt, Homo sapiens
cuaccuccagacuucaa

SEQ ID NO: 942113 - RNA, 12 nt, Homo sapiens
cuacuaccucuu

SEQ ID NO: 942114 - RNA, 23 nt, Homo sapiens
cuacucaggaaggugggagagag

SEQ ID NO: 942115 - RNA, 14 nt, Homo sapiens
cuacugaaugucau

SEQ ID NO: 942116 - RNA, 18 nt, Homo sapiens
cuagaaaggaacugcaau

SEQ ID NO: 942117 - RNA, 19 nt, Homo sapiens
cuagaaaggaacugcaaua

SEQ ID NO: 942118 - RNA, 21 nt, Homo sapiens
cuaggaaaaucacuugccaaa

SEQ ID NO: 942119 - RNA, 22 nt, Homo sapiens
cuaggcaccucagaccaaucau

SEQ ID NO: 942120 - RNA, 21 nt, Homo sapiens
cuaguaauugggaaaaaagca

SEQ ID NO: 942121 - RNA, 16 nt, Homo sapiens
cuaguacuuauuacau

SEQ ID NO: 942122 - RNA, 18 nt, Homo sapiens
cuaguuaucagauccuuu

SEQ ID NO: 942123 - RNA, 13 nt, Homo sapiens
cuaguucuaccuc

SEQ ID NO: 942124 - RNA, 14 nt, Homo sapiens
cuaguuuucaauca

SEQ ID NO: 942125 - RNA, 12 nt, Homo sapiens
cuauaacacauc

SEQ ID NO: 942126 - RNA, 15 nt, Homo sapiens
cuauacacaagcaau

SEQ ID NO: 942127 - RNA, 17 nt, Homo sapiens
cuauaguuauacaucaa

SEQ ID NO: 942128 - RNA, 23 nt, Homo sapiens
cuauauauaaucaucaaguaaua

SEQ ID NO: 942129 - RNA, 14 nt, Homo sapiens
cuauauuuagcccc

SEQ ID NO: 942130 - RNA, 14 nt, Homo sapiens
cuaucucuacugaa

SEQ ID NO: 942131 - RNA, 16 nt, Homo sapiens
cuaucugcuuagcaac

SEQ ID NO: 942132 - RNA, 22 nt, Homo sapiens
cuaugcaggcagcacagcagac

SEQ ID NO: 942133 - RNA, 12 nt, Homo sapiens
cuauuaagguga

SEQ ID NO: 942134 - RNA, 14 nt, Homo sapiens
cuauugucuguaau

SEQ ID NO: 942135 - RNA, 15 nt, Homo sapiens
cuauugucuguaaua

SEQ ID NO: 942136 - RNA, 13 nt, Homo sapiens
cuauuuauauaca

SEQ ID NO: 942137 - RNA, 16 nt, Homo sapiens
cuauuucuccaaagcc

SEQ ID NO: 942138 - RNA, 19 nt, Homo sapiens
cucaaucgagugagacaga

SEQ ID NO: 942139 - RNA, 15 nt, Homo sapiens
cucacaagcaugaag

SEQ ID NO: 942140 - RNA, 16 nt, Homo sapiens
cucacaagcaugaagu

SEQ ID NO: 942141 - RNA, 15 nt, Homo sapiens
cucaccacuaccagc

SEQ ID NO: 942142 - RNA, 15 nt, Homo sapiens
cucacucuguuuccu

SEQ ID NO: 942143 - RNA, 14 nt, Homo sapiens
cucagacccaacag

SEQ ID NO: 942144 - RNA, 13 nt, Homo sapiens
cucagaugaucuc

SEQ ID NO: 942145 - RNA, 14 nt, Homo sapiens
cucagcaucaaaau

SEQ ID NO: 942146 - RNA, 16 nt, Homo sapiens
cucaguuucuaggcac

SEQ ID NO: 942147 - RNA, 18 nt, Homo sapiens
cucauaccuacaucagac

SEQ ID NO: 942148 - RNA, 15 nt, Homo sapiens
cucaucacauaaaag

SEQ ID NO: 942149 - RNA, 16 nt, Homo sapiens
cucaucacauaaaagg

SEQ ID NO: 942150 - RNA, 17 nt, Homo sapiens
cucaucacuacaguauu

SEQ ID NO: 942151 - RNA, 18 nt, Homo sapiens
cucaucaguaguucacau

SEQ ID NO: 942152 - RNA, 18 nt, Homo sapiens
cucaucugaaauguuaca

SEQ ID NO: 942153 - RNA, 18 nt, Homo sapiens
cucaugccuguaauccca

SEQ ID NO: 942154 - RNA, 13 nt, Homo sapiens
cucaugccuuaau

SEQ ID NO: 942155 - RNA, 19 nt, Homo sapiens
cucaugccuuaaucccagc

SEQ ID NO: 942156 - RNA, 17 nt, Homo sapiens
cucaugucggucccuga

SEQ ID NO: 942157 - RNA, 16 nt, Homo sapiens
cucauuaauacucuuu

SEQ ID NO: 942158 - RNA, 15 nt, Homo sapiens
cucauuuaagggaaa

SEQ ID NO: 942159 - RNA, 18 nt, Homo sapiens
cuccaagucuguaccuca

SEQ ID NO: 942160 - RNA, 16 nt, Homo sapiens
cuccaccuagacugua

SEQ ID NO: 942161 - RNA, 17 nt, Homo sapiens
cuccaccuagacuguaa

SEQ ID NO: 942162 - RNA, 19 nt, Homo sapiens
cuccacgguagcacuugac

SEQ ID NO: 942163 - RNA, 13 nt, Homo sapiens
cuccagggcauug

SEQ ID NO: 942164 - RNA, 22 nt, Homo sapiens
cuccagguggcucugaggugcc

SEQ ID NO: 942165 - RNA, 16 nt, Homo sapiens
cuccaguaacagccua

SEQ ID NO: 942166 - RNA, 20 nt, Homo sapiens
cuccccacuuguccgcuggg

SEQ ID NO: 942167 - RNA, 23 nt, Homo sapiens
cuccccaguucauugcacuuuga

SEQ ID NO: 942168 - RNA, 13 nt, Homo sapiens
cucccccaguucc

SEQ ID NO: 942169 - RNA, 14 nt, Homo sapiens
cucccccaguuccu

SEQ ID NO: 942170 - RNA, 22 nt, Homo sapiens
cucccccaguuccucccaggaa

SEQ ID NO: 942171 - RNA, 20 nt, Homo sapiens
cucccuggcaggaugcugag

SEQ ID NO: 942172 - RNA, 15 nt, Homo sapiens
cuccuacuaugcaau

SEQ ID NO: 942173 - RNA, 13 nt, Homo sapiens
cuccugcuuccuc

SEQ ID NO: 942174 - RNA, 15 nt, Homo sapiens
cuccugggagacaaa

SEQ ID NO: 942175 - RNA, 15 nt, Homo sapiens
cuccuucagacaccc

SEQ ID NO: 942176 - RNA, 20 nt, Homo sapiens
cuccuuuuuugcaugugcaa

SEQ ID NO: 942177 - RNA, 14 nt, Homo sapiens
cucuccugcuuccu

SEQ ID NO: 942178 - RNA, 18 nt, Homo sapiens
cucucgcacacacaguga

SEQ ID NO: 942179 - RNA, 12 nt, Homo sapiens
cucucugccaug

SEQ ID NO: 942180 - RNA, 13 nt, Homo sapiens
cucucugccaugg

SEQ ID NO: 942181 - RNA, 15 nt, Homo sapiens
cucugacaguccaca

SEQ ID NO: 942182 - RNA, 22 nt, Homo sapiens
cucugacaguccacaggggcca

SEQ ID NO: 942183 - RNA, 15 nt, Homo sapiens
cucugaccugcacug

SEQ ID NO: 942184 - RNA, 17 nt, Homo sapiens
cucugaccugcacuggg

SEQ ID NO: 942185 - RNA, 15 nt, Homo sapiens
cucugcaaaccaaca

SEQ ID NO: 942186 - RNA, 17 nt, Homo sapiens
cucugcaaaccaacagg

SEQ ID NO: 942187 - RNA, 17 nt, Homo sapiens
cucuggaccauauacca

SEQ ID NO: 942188 - RNA, 21 nt, Homo sapiens
cucuggcauuccuuuucccaa

SEQ ID NO: 942189 - RNA, 14 nt, Homo sapiens
cucugucaacauca

SEQ ID NO: 942190 - RNA, 18 nt, Homo sapiens
cucugucaacaucaaaga

SEQ ID NO: 942191 - RNA, 19 nt, Homo sapiens
cucuguucagaaagcaaua

SEQ ID NO: 942192 - RNA, 18 nt, Homo sapiens
cucuuaaaagaugccuua

SEQ ID NO: 942193 - RNA, 23 nt, Homo sapiens
cucuuaagucccaguauaccuca

SEQ ID NO: 942194 - RNA, 17 nt, Homo sapiens
cucuugaccaaguauga

SEQ ID NO: 942195 - RNA, 22 nt, Homo sapiens
cucuuuggcuccccuguaccuu

SEQ ID NO: 942196 - RNA, 20 nt, Homo sapiens
cugaauaccacuuaccucaa

SEQ ID NO: 942197 - RNA, 20 nt, Homo sapiens
cugaauucuuuuucauuuga

SEQ ID NO: 942198 - RNA, 15 nt, Homo sapiens
cugacagcuagacac

SEQ ID NO: 942199 - RNA, 19 nt, Homo sapiens
cugagcaggucaggacuca

SEQ ID NO: 942200 - RNA, 12 nt, Homo sapiens
cugauaagcaag

SEQ ID NO: 942201 - RNA, 17 nt, Homo sapiens
cugauggaaaaugcaaa

SEQ ID NO: 942202 - RNA, 13 nt, Homo sapiens
cugcaagaccacg

SEQ ID NO: 942203 - RNA, 15 nt, Homo sapiens
cugcaauaauaucaa

SEQ ID NO: 942204 - RNA, 17 nt, Homo sapiens
cugcaauaauaucaaaa

SEQ ID NO: 942205 - RNA, 14 nt, Homo sapiens
cugcaugcaaacaa

SEQ ID NO: 942206 - RNA, 15 nt, Homo sapiens
cugcccguagcacag

SEQ ID NO: 942207 - RNA, 15 nt, Homo sapiens
gaaaguggugcuaua

SEQ ID NO: 942208 - RNA, 20 nt, Homo sapiens
gaaauauggaacuuacauug

SEQ ID NO: 942209 - RNA, 14 nt, Homo sapiens
gaaaugcuuagaaa

SEQ ID NO: 942210 - RNA, 19 nt, Homo sapiens
gaaauucucaucaguccau

SEQ ID NO: 942211 - RNA, 23 nt, Homo sapiens
gaaauuuucaauuugagauucua

SEQ ID NO: 942212 - RNA, 13 nt, Homo sapiens
gaacaaacagggc

SEQ ID NO: 942213 - RNA, 22 nt, Homo sapiens
gaacaggacugcaaaaauccuu

SEQ ID NO: 942214 - RNA, 17 nt, Homo sapiens
gaacauccaaccuuccc

SEQ ID NO: 942215 - RNA, 20 nt, Homo sapiens
gaacaugcccccugcagaca

SEQ ID NO: 942216 - RNA, 23 nt, Homo sapiens
gaaccagccguauuuuacaugaa

SEQ ID NO: 942217 - RNA, 18 nt, Homo sapiens
gaacuagccaaaccagga

SEQ ID NO: 942218 - RNA, 18 nt, Homo sapiens
gaacugaaagcacuagag

SEQ ID NO: 942219 - RNA, 14 nt, Homo sapiens
gaacuuuaagcaac

SEQ ID NO: 942220 - RNA, 24 nt, Homo sapiens
gaacuuuaagcaacaagaccacca

SEQ ID NO: 942221 - RNA, 23 nt, Homo sapiens
gaagagacucuguuugcuugugu

SEQ ID NO: 942222 - RNA, 20 nt, Homo sapiens
gaagcaauuuguugcugcuu

SEQ ID NO: 942223 - RNA, 22 nt, Homo sapiens
gaagcccaggagccucacuggg

SEQ ID NO: 942224 - RNA, 14 nt, Homo sapiens
gaagcucuugacca

SEQ ID NO: 942225 - RNA, 14 nt, Homo sapiens
gaaggauccaucuu

SEQ ID NO: 942226 - RNA, 15 nt, Homo sapiens
gaaggcagcuugugg

SEQ ID NO: 942227 - RNA, 15 nt, Homo sapiens
gaagggcaauaucua

SEQ ID NO: 942228 - RNA, 21 nt, Homo sapiens
gaaggguuuugcuacauucua

SEQ ID NO: 942229 - RNA, 16 nt, Homo sapiens
gaagguuuucauuugc

SEQ ID NO: 942230 - RNA, 16 nt, Homo sapiens
gaaguugaaaaucaua

SEQ ID NO: 942231 - RNA, 21 nt, Homo sapiens
gaauaaaagaauuacauauga

SEQ ID NO: 942232 - RNA, 17 nt, Homo sapiens
gaauaccacuuaccuca

SEQ ID NO: 942233 - RNA, 22 nt, Homo sapiens
gaaucagugaagccaaagggac

SEQ ID NO: 942234 - RNA, 18 nt, Homo sapiens
gaaucucgcaguguuucu

SEQ ID NO: 942235 - RNA, 14 nt, Homo sapiens
gaaucuggagacca

SEQ ID NO: 942236 - RNA, 16 nt, Homo sapiens
gaaugaagguaauauu

SEQ ID NO: 942237 - RNA, 15 nt, Homo sapiens
gaauuaaaguacuuu

SEQ ID NO: 942238 - RNA, 19 nt, Homo sapiens
gaauuacggaaaaugccug

SEQ ID NO: 942239 - RNA, 13 nt, Homo sapiens
gaauucaaacugg

SEQ ID NO: 942240 - RNA, 17 nt, Homo sapiens
gaauucugucauuucaa

SEQ ID NO: 942241 - RNA, 19 nt, Homo sapiens
gaauucuuuuucauuugag

SEQ ID NO: 942242 - RNA, 18 nt, Homo sapiens
gaauuggccgcugucacu

SEQ ID NO: 942243 - RNA, 13 nt, Homo sapiens
gaauuggguuucu

SEQ ID NO: 942244 - RNA, 16 nt, Homo sapiens
gaauuuaaacaaugca

SEQ ID NO: 942245 - RNA, 22 nt, Homo sapiens
gaauuugcacuguuuaaucaua

SEQ ID NO: 942246 - RNA, 19 nt, Homo sapiens
gacaaaccauaacugacaa

SEQ ID NO: 942247 - RNA, 23 nt, Homo sapiens
gacaaagagauugagguucucua

SEQ ID NO: 942248 - RNA, 12 nt, Homo sapiens
gacaacacuuca

SEQ ID NO: 942249 - RNA, 16 nt, Homo sapiens
gacaauaaacccucag

SEQ ID NO: 942250 - RNA, 17 nt, Homo sapiens
gacacauacaugucaca

SEQ ID NO: 942251 - RNA, 15 nt, Homo sapiens
gacacuaucacucau

SEQ ID NO: 942252 - RNA, 17 nt, Homo sapiens
gacagagagaggcauuu

SEQ ID NO: 942253 - RNA, 20 nt, Homo sapiens
gacagauuuggaugcacuca

SEQ ID NO: 942254 - RNA, 18 nt, Homo sapiens
gacaucagauccugggca

SEQ ID NO: 942255 - RNA, 16 nt, Homo sapiens
gaccaguaggacucaa

SEQ ID NO: 942256 - RNA, 18 nt, Homo sapiens
gaccaugguauauuccua

SEQ ID NO: 942257 - RNA, 23 nt, Homo sapiens
gacccaggggucagccuuaggaa

SEQ ID NO: 942258 - RNA, 16 nt, Homo sapiens
gaccucaccuagaaau

SEQ ID NO: 942259 - RNA, 14 nt, Homo sapiens
gaccuuaaaugcaa

SEQ ID NO: 942260 - RNA, 15 nt, Homo sapiens
gaccuuccucaucca

SEQ ID NO: 942261 - RNA, 22 nt, Homo sapiens
gacgaagcggagagagccaaga

SEQ ID NO: 942262 - RNA, 15 nt, Homo sapiens
gacggaauuggguuu

SEQ ID NO: 942263 - RNA, 16 nt, Homo sapiens
gacuaugcacacuuuu

SEQ ID NO: 942264 - RNA, 14 nt, Homo sapiens
gacuauucuaauga

SEQ ID NO: 942265 - RNA, 18 nt, Homo sapiens
gacucauacaccagguca

SEQ ID NO: 942266 - RNA, 22 nt, Homo sapiens
gacuccacgcuguccuuuggga

SEQ ID NO: 942267 - RNA, 16 nt, Homo sapiens
gacucugucuaccugg

SEQ ID NO: 942268 - RNA, 14 nt, Homo sapiens
gacugagcccauga

SEQ ID NO: 942269 - RNA, 20 nt, Homo sapiens
gacugagggcagcuuugcaa

SEQ ID NO: 942270 - RNA, 22 nt, Homo sapiens
gacugugcauacuuucccucau

SEQ ID NO: 942271 - RNA, 21 nt, Homo sapiens
gacuugcaaagaccuaccucc

SEQ ID NO: 942272 - RNA, 22 nt, Homo sapiens
gacuugcaaagaccuaccucca

SEQ ID NO: 942273 - RNA, 23 nt, Homo sapiens
gacuuucuaauuagagagcaucu

SEQ ID NO: 942274 - RNA, 20 nt, Homo sapiens
gagaagcucugaagaacucu

SEQ ID NO: 942275 - RNA, 21 nt, Homo sapiens
gagaagggugguuuccugcca

SEQ ID NO: 942276 - RNA, 17 nt, Homo sapiens
gagacuuucuaaaucaa

SEQ ID NO: 942277 - RNA, 19 nt, Homo sapiens
gagagagucuuacucugcc

SEQ ID NO: 942278 - RNA, 20 nt, Homo sapiens
gagagauuuaacauuaucua

SEQ ID NO: 942279 - RNA, 21 nt, Homo sapiens
gagagcacagugaucaccagc

SEQ ID NO: 942280 - RNA, 15 nt, Homo sapiens
gagagccaagcccug

SEQ ID NO: 942281 - RNA, 13 nt, Homo sapiens
gagagucacuuga

SEQ ID NO: 942282 - RNA, 17 nt, Homo sapiens
gagaucuuucuuuccaa

SEQ ID NO: 942283 - RNA, 22 nt, Homo sapiens
gagaugccacuucucacucacc

SEQ ID NO: 942284 - RNA, 15 nt, Homo sapiens
gagcaagaccucguc

SEQ ID NO: 942285 - RNA, 16 nt, Homo sapiens
gagcacagaaggaaua

SEQ ID NO: 942286 - RNA, 20 nt, Homo sapiens
gagcacauuuaccaguauag

SEQ ID NO: 942287 - RNA, 13 nt, Homo sapiens
gagccaagcccug

SEQ ID NO: 942288 - RNA, 15 nt, Homo sapiens
gagccagcucccucu

SEQ ID NO: 942289 - RNA, 23 nt, Homo sapiens
gagccucccccucagaugaucuc

SEQ ID NO: 942290 - RNA, 19 nt, Homo sapiens
gagcgagauucugccucaa

SEQ ID NO: 942291 - RNA, 17 nt, Homo sapiens
gaggaagacaggcaaau

SEQ ID NO: 942292 - RNA, 15 nt, Homo sapiens
gaggaauuggccgcu

SEQ ID NO: 942293 - RNA, 14 nt, Homo sapiens
gaggaggggaccaa

SEQ ID NO: 942294 - RNA, 10 nt, Homo sapiens
gaggcauuuc

SEQ ID NO: 942295 - RNA, 14 nt, Homo sapiens
gaggcuggggccaa

SEQ ID NO: 942296 - RNA, 12 nt, Homo sapiens
gaggucaugcca

SEQ ID NO: 942297 - RNA, 14 nt, Homo sapiens
gaguaaacuugaaa

SEQ ID NO: 942298 - RNA, 18 nt, Homo sapiens
gaguucuccugcucccca

SEQ ID NO: 942299 - RNA, 19 nt, Homo sapiens
gaguuuauuggaggaucaa

SEQ ID NO: 942300 - RNA, 23 nt, Homo sapiens
gauaaacugauuuaucuauuuaa

SEQ ID NO: 942301 - RNA, 13 nt, Homo sapiens
gauacuacuuucu

SEQ ID NO: 942302 - RNA, 13 nt, Homo sapiens
augugcuggucac

SEQ ID NO: 942303 - RNA, 13 nt, Homo sapiens
auguggucaugga

SEQ ID NO: 942304 - RNA, 23 nt, Homo sapiens
augugucucaggaaaacagcuag

SEQ ID NO: 942305 - RNA, 22 nt, Homo sapiens
auguuaauugggcaggugaaaa

SEQ ID NO: 942306 - RNA, 20 nt, Homo sapiens
auguuaggccuaagaggcuu

SEQ ID NO: 942307 - RNA, 17 nt, Homo sapiens
auguucccccuguuuca

SEQ ID NO: 942308 - RNA, 14 nt, Homo sapiens
auguugcaauguga

SEQ ID NO: 942309 - RNA, 15 nt, Homo sapiens
auguuucuacagaua

SEQ ID NO: 942310 - RNA, 15 nt, Homo sapiens
auuaaucaccuucuu

SEQ ID NO: 942311 - RNA, 13 nt, Homo sapiens
auuaauguuaaca

SEQ ID NO: 942312 - RNA, 17 nt, Homo sapiens
auuaauugucauuauuu

SEQ ID NO: 942313 - RNA, 22 nt, Homo sapiens
auuacacugaucuuauguguua

SEQ ID NO: 942314 - RNA, 20 nt, Homo sapiens
auuacaguuaaagaagcaau

SEQ ID NO: 942315 - RNA, 15 nt, Homo sapiens
gauuucggaggccau

SEQ ID NO: 942316 - RNA, 13 nt, Homo sapiens
gauuucuaccuca

SEQ ID NO: 942317 - RNA, 19 nt, Homo sapiens
gcaaaacaaaaauuaggua

SEQ ID NO: 942318 - RNA, 12 nt, Homo sapiens
gcaaaggaacua

SEQ ID NO: 942319 - RNA, 14 nt, Homo sapiens
gcaaagggaaccau

SEQ ID NO: 942320 - RNA, 15 nt, Homo sapiens
gcaaauguacuucuc

SEQ ID NO: 942321 - RNA, 23 nt, Homo sapiens
gcaaaugugcuggucacccuuca

SEQ ID NO: 942322 - RNA, 15 nt, Homo sapiens
gcaacaaaaagucau

SEQ ID NO: 942323 - RNA, 13 nt, Homo sapiens
gcaacaaugacuu

SEQ ID NO: 942324 - RNA, 15 nt, Homo sapiens
gcaacagagcaagac

SEQ ID NO: 942325 - RNA, 16 nt, Homo sapiens
gcaacaucucugggaa

SEQ ID NO: 942326 - RNA, 14 nt, Homo sapiens
gcaaccacuaagaa

SEQ ID NO: 942327 - RNA, 14 nt, Homo sapiens
gcaacucuguaaau

SEQ ID NO: 942328 - RNA, 14 nt, Homo sapiens
gcaacuuuaguuug

SEQ ID NO: 942329 - RNA, 16 nt, Homo sapiens
gcaagccugucuucag

SEQ ID NO: 942330 - RNA, 14 nt, Homo sapiens
gcaaguuagaacua

SEQ ID NO: 942331 - RNA, 20 nt, Homo sapiens
gcaaguuagaacuagccaaa

SEQ ID NO: 942332 - RNA, 14 nt, Homo sapiens
gcaauaauccagua

SEQ ID NO: 942333 - RNA, 19 nt, Homo sapiens
gcaauagacacauacaugu

SEQ ID NO: 942334 - RNA, 15 nt, Homo sapiens
gcaaucucucucugu

SEQ ID NO: 942335 - RNA, 15 nt, Homo sapiens
gcaaucugacccuau

SEQ ID NO: 942336 - RNA, 21 nt, Homo sapiens
gcaauggaagcccucaaagaa

SEQ ID NO: 942337 - RNA, 12 nt, Homo sapiens
gcacaaguacuu

SEQ ID NO: 942338 - RNA, 22 nt, Homo sapiens
gcacacccuccagagacaacag

SEQ ID NO: 942339 - RNA, 23 nt, Homo sapiens
gcacauauccaggcaccaggacu

SEQ ID NO: 942340 - RNA, 22 nt, Homo sapiens
gcacccugcccaccaagaagca

SEQ ID NO: 942341 - RNA, 21 nt, Homo sapiens
gcaccuaccuuagaaaacaag

SEQ ID NO: 942342 - RNA, 20 nt, Homo sapiens
gcacuguuuaaucauaguua

SEQ ID NO: 942343 - RNA, 14 nt, Homo sapiens
gcagaaaacagcuc

SEQ ID NO: 942344 - RNA, 15 nt, Homo sapiens
gcagaaagggccuug

SEQ ID NO: 942345 - RNA, 17 nt, Homo sapiens
gcagacaauaaacccuc

SEQ ID NO: 942346 - RNA, 16 nt, Homo sapiens
gcagaccccaggcaag

SEQ ID NO: 942347 - RNA, 15 nt, Homo sapiens
gcagcaaauuuucag

SEQ ID NO: 942348 - RNA, 21 nt, Homo sapiens
gcagcaaggaaagcucacgaa

SEQ ID NO: 942349 - RNA, 15 nt, Homo sapiens
gcaggcugggccaug

SEQ ID NO: 942350 - RNA, 21 nt, Homo sapiens
gcagugagccgagaucaugcc

SEQ ID NO: 942351 - RNA, 23 nt, Homo sapiens
gcaguucugaguguuuaauuuca

SEQ ID NO: 942352 - RNA, 17 nt, Homo sapiens
gcaguuguaccaaguga

SEQ ID NO: 942353 - RNA, 19 nt, Homo sapiens
gcaguuguaccaagugaaa

SEQ ID NO: 942354 - RNA, 13 nt, Homo sapiens
gcauaaugcaauc

SEQ ID NO: 942355 - RNA, 16 nt, Homo sapiens
gcauacuuucccucau

SEQ ID NO: 942356 - RNA, 21 nt, Homo sapiens
gcauauguguaaagauuuaua

SEQ ID NO: 942357 - RNA, 23 nt, Homo sapiens
gcauauuuauuucagauguuucg

SEQ ID NO: 942358 - RNA, 18 nt, Homo sapiens
gcaucaauacaaccagcc

SEQ ID NO: 942359 - RNA, 21 nt, Homo sapiens
gcaucauuuccccaacagggc

SEQ ID NO: 942360 - RNA, 23 nt, Homo sapiens
gcaucuauuuccucugugcaaag

SEQ ID NO: 942361 - RNA, 14 nt, Homo sapiens
gcauggaacagcau

SEQ ID NO: 942362 - RNA, 21 nt, Homo sapiens
gcauucauauuucauauucau

SEQ ID NO: 942363 - RNA, 12 nt, Homo sapiens
gcauugcucagc

SEQ ID NO: 942364 - RNA, 18 nt, Homo sapiens
gcauuguaaaagcauuuu

SEQ ID NO: 942365 - RNA, 19 nt, Homo sapiens
gcauuuaccaugugcuaau

SEQ ID NO: 942366 - RNA, 19 nt, Homo sapiens
gcauuuggugagagucaaa

SEQ ID NO: 942367 - RNA, 14 nt, Homo sapiens
gccaaaaugccauu

SEQ ID NO: 942368 - RNA, 13 nt, Homo sapiens
gccaaaccaggac

SEQ ID NO: 942369 - RNA, 18 nt, Homo sapiens
gccaaaggucccucccca

SEQ ID NO: 942370 - RNA, 20 nt, Homo sapiens
gccaauaaagugaucugugu

SEQ ID NO: 942371 - RNA, 14 nt, Homo sapiens
gccaauagugucau

SEQ ID NO: 942372 - RNA, 13 nt, Homo sapiens
gccaauauaacua

SEQ ID NO: 942373 - RNA, 16 nt, Homo sapiens
gccacagucacuggau

SEQ ID NO: 942374 - RNA, 21 nt, Homo sapiens
gccaccaccuacagcccagug

SEQ ID NO: 942375 - RNA, 20 nt, Homo sapiens
gccacuguccggaaauucau

SEQ ID NO: 942376 - RNA, 21 nt, Homo sapiens
gccacuguccggaaauucaug

SEQ ID NO: 942377 - RNA, 23 nt, Homo sapiens
gccagaccagcaggcuggccuau

SEQ ID NO: 942378 - RNA, 13 nt, Homo sapiens
gccagccucagaa

SEQ ID NO: 942379 - RNA, 15 nt, Homo sapiens
gccagcucuucucaa

SEQ ID NO: 942380 - RNA, 22 nt, Homo sapiens
gccagcugaagaguaaaggaaa

SEQ ID NO: 942381 - RNA, 15 nt, Homo sapiens
gccaggagcaggcac

SEQ ID NO: 942382 - RNA, 17 nt, Homo sapiens
gccaggaggccugcuag

SEQ ID NO: 942383 - RNA, 18 nt, Homo sapiens
gccagguaugguggcaua

SEQ ID NO: 942384 - RNA, 18 nt, Homo sapiens
gccaucaucauggcauca

SEQ ID NO: 942385 - RNA, 21 nt, Homo sapiens
gccauugaaaugucaaauuga

SEQ ID NO: 942386 - RNA, 15 nt, Homo sapiens
gccauugcauuccag

SEQ ID NO: 942387 - RNA, 22 nt, Homo sapiens
gcccaggagccucacuggggca

SEQ ID NO: 942388 - RNA, 16 nt, Homo sapiens
gccccagcacauggaa

SEQ ID NO: 942389 - RNA, 13 nt, Homo sapiens
gccccgacuccag

SEQ ID NO: 942390 - RNA, 16 nt, Homo sapiens
gccccuacccuggacu

SEQ ID NO: 942391 - RNA, 14 nt, Homo sapiens
gcccucugccucau

SEQ ID NO: 942392 - RNA, 21 nt, Homo sapiens
gcccugggugcaggacacugg

SEQ ID NO: 942393 - RNA, 23 nt, Homo sapiens
gcccuguccccuacccccaguaa

SEQ ID NO: 942394 - RNA, 18 nt, Homo sapiens
gcccuucccccugcaaaa

SEQ ID NO: 942395 - RNA, 17 nt, Homo sapiens
gcccuugugcuccaguc

SEQ ID NO: 942396 - RNA, 14 nt, Homo sapiens
gccgcagacaugaa

SEQ ID NO: 942397 - RNA, 16 nt, Homo sapiens
gccuaaggugucugag

SEQ ID NO: 942398 - RNA, 21 nt, Homo sapiens
gccuccagggcauugcucagc

SEQ ID NO: 942399 - RNA, 17 nt, Homo sapiens
gccucgugccaugaucu

SEQ ID NO: 942400 - RNA, 18 nt, Homo sapiens
gccucugcucuccuggga

SEQ ID NO: 942401 - RNA, 16 nt, Homo sapiens
gccugaacaugccccu

SEQ ID NO: 942402 - RNA, 15 nt, Homo sapiens
gccugcaccccagga

SEQ ID NO: 942403 - RNA, 22 nt, Homo sapiens
gccuggacuguuuucucucggc

SEQ ID NO: 942404 - RNA, 18 nt, Homo sapiens
gccuggccaacaugguga

SEQ ID NO: 942405 - RNA, 20 nt, Homo sapiens
gccuggccaacauggugaaa

SEQ ID NO: 942406 - RNA, 14 nt, Homo sapiens
gccuguaaucccag

SEQ ID NO: 942407 - RNA, 21 nt, Homo sapiens
gccugucuuaauuuucuuuca

SEQ ID NO: 942408 - RNA, 14 nt, Homo sapiens
gccugucuucagag

SEQ ID NO: 942409 - RNA, 15 nt, Homo sapiens
gccuguggcauucau

SEQ ID NO: 942410 - RNA, 19 nt, Homo sapiens
caagccugcugucuuguga

SEQ ID NO: 942411 - RNA, 18 nt, Homo sapiens
caagcgucaucuguguaa

SEQ ID NO: 942412 - RNA, 20 nt, Homo sapiens
caaggcugcuuagaauccaa

SEQ ID NO: 942413 - RNA, 16 nt, Homo sapiens
caaguaauacaaacua

SEQ ID NO: 942414 - RNA, 15 nt, Homo sapiens
caaguaugacaaccu

SEQ ID NO: 942415 - RNA, 22 nt, Homo sapiens
caagugauaauacagauuugua

SEQ ID NO: 942416 - RNA, 22 nt, Homo sapiens
caaguggaccuuaggccuuccu

SEQ ID NO: 942417 - RNA, 20 nt, Homo sapiens
caaguugcaucagaaagcuu

SEQ ID NO: 942418 - RNA, 15 nt, Homo sapiens
caauaaacccucaga

SEQ ID NO: 942419 - RNA, 14 nt, Homo sapiens
caauacaaccagcc

SEQ ID NO: 942420 - RNA, 15 nt, Homo sapiens
caauacuguuuccau

SEQ ID NO: 942421 - RNA, 20 nt, Homo sapiens
caauacuguuuccauuuuaa

SEQ ID NO: 942422 - RNA, 17 nt, Homo sapiens
caauagugucauccuca

SEQ ID NO: 942423 - RNA, 22 nt, Homo sapiens
gcuaucaucauccuacaacuca

SEQ ID NO: 942424 - RNA, 15 nt, Homo sapiens
gcuaucuccuaacuu

SEQ ID NO: 942425 - RNA, 22 nt, Homo sapiens
gcucacugugcuggggcacggc

SEQ ID NO: 942426 - RNA, 18 nt, Homo sapiens
gcucagauuguaauaugu

SEQ ID NO: 942427 - RNA, 22 nt, Homo sapiens
gcucccucuauuuauguuugca

SEQ ID NO: 942428 - RNA, 15 nt, Homo sapiens
gcucccuuccugggg

SEQ ID NO: 942429 - RNA, 24 nt, Homo sapiens
gcuccuaugucaccuugaugacuu

SEQ ID NO: 942430 - RNA, 19 nt, Homo sapiens
gcuccuguucacaccagag

SEQ ID NO: 942431 - RNA, 16 nt, Homo sapiens
gcucguggacugugcu

SEQ ID NO: 942432 - RNA, 14 nt, Homo sapiens
gcucuacaucuucu

SEQ ID NO: 942433 - RNA, 14 nt, Homo sapiens
gcucuggggacuga

SEQ ID NO: 942434 - RNA, 13 nt, Homo sapiens
gcugacuuuggga

SEQ ID NO: 942435 - RNA, 22 nt, Homo sapiens
gcugagcuugucuuuucugcug

SEQ ID NO: 942436 - RNA, 17 nt, Homo sapiens
gcugcaggacuugagaa

SEQ ID NO: 942437 - RNA, 17 nt, Homo sapiens
gcugccuuggcucagac

SEQ ID NO: 942438 - RNA, 18 nt, Homo sapiens
gcugcgagagaaagggag

SEQ ID NO: 942439 - RNA, 17 nt, Homo sapiens
gcuggaaggcagcuugu

SEQ ID NO: 942440 - RNA, 13 nt, Homo sapiens
gcuggcaaccacu

SEQ ID NO: 942441 - RNA, 14 nt, Homo sapiens
gcuggccuguguga

SEQ ID NO: 942442 - RNA, 16 nt, Homo sapiens
gcugggccauguccaa

SEQ ID NO: 942443 - RNA, 16 nt, Homo sapiens
gcuggggccaacugga

SEQ ID NO: 942444 - RNA, 14 nt, Homo sapiens
gcuguggaugcuuc

SEQ ID NO: 942445 - RNA, 13 nt, Homo sapiens
gcuuaccccuuca

SEQ ID NO: 942446 - RNA, 15 nt, Homo sapiens
gcuuaccugaucuca

SEQ ID NO: 942447 - RNA, 24 nt, Homo sapiens
gcuucaugugcugccugcaagcuu

SEQ ID NO: 942448 - RNA, 16 nt, Homo sapiens
gcuugcaccacuuccg

SEQ ID NO: 942449 - RNA, 15 nt, Homo sapiens
gcuugcaugcuugca

SEQ ID NO: 942450 - RNA, 19 nt, Homo sapiens
gcuugcucaggcucagagg

SEQ ID NO: 942451 - RNA, 14 nt, Homo sapiens
gcuuucagagccag

SEQ ID NO: 942452 - RNA, 22 nt, Homo sapiens
gcuuugcaaaaugagacuuucu

SEQ ID NO: 942453 - RNA, 18 nt, Homo sapiens
ggaaaaucacuugccaaa

SEQ ID NO: 942454 - RNA, 19 nt, Homo sapiens
ggaaacauaggaagcccuc

SEQ ID NO: 942455 - RNA, 16 nt, Homo sapiens
ggaaaguuuuguucug

SEQ ID NO: 942456 - RNA, 16 nt, Homo sapiens
ggaacaucacauuccu

SEQ ID NO: 942457 - RNA, 23 nt, Homo sapiens
ggaacuagaaagaaggacccaga

SEQ ID NO: 942458 - RNA, 14 nt, Homo sapiens
ggaaggaacaaaga

SEQ ID NO: 942459 - RNA, 18 nt, Homo sapiens
ggaagugaaaacuuugua

SEQ ID NO: 942460 - RNA, 12 nt, Homo sapiens
ggaaucagagag

SEQ ID NO: 942461 - RNA, 16 nt, Homo sapiens
ggaaugguucucucaa

SEQ ID NO: 942462 - RNA, 16 nt, Homo sapiens
ggaauuacgugcucug

SEQ ID NO: 942463 - RNA, 14 nt, Homo sapiens
ggacaacacuucau

SEQ ID NO: 942464 - RNA, 20 nt, Homo sapiens
ggacagaaugugucucagga

SEQ ID NO: 942465 - RNA, 21 nt, Homo sapiens
ggacgaagcggagagagccaa

SEQ ID NO: 942466 - RNA, 22 nt, Homo sapiens
ggacgauagcuuggagggaugg

SEQ ID NO: 942467 - RNA, 10 nt, Homo sapiens
ggacucagga

SEQ ID NO: 942468 - RNA, 18 nt, Homo sapiens
ggacugagcccaugacac

SEQ ID NO: 942469 - RNA, 16 nt, Homo sapiens
ggacuucugcagcuau

SEQ ID NO: 942470 - RNA, 11 nt, Homo sapiens
ggacuugccuc

SEQ ID NO: 942471 - RNA, 17 nt, Homo sapiens
ggagaaacgggugagcu

SEQ ID NO: 942472 - RNA, 19 nt, Homo sapiens
ggagacacuggccccucaa

SEQ ID NO: 942473 - RNA, 14 nt, Homo sapiens
ggagagagccaaga

SEQ ID NO: 942474 - RNA, 22 nt, Homo sapiens
ggagaggcggccucgugccaug

SEQ ID NO: 942475 - RNA, 15 nt, Homo sapiens
ggagagucacuugaa

SEQ ID NO: 942476 - RNA, 18 nt, Homo sapiens
ggagccucccccucagau

SEQ ID NO: 942477 - RNA, 22 nt, Homo sapiens
ggaggaaaaggccccugcaaug

SEQ ID NO: 942478 - RNA, 12 nt, Homo sapiens
ggaggcacuuua

SEQ ID NO: 942479 - RNA, 20 nt, Homo sapiens
ggaggcggagguugcaguga

SEQ ID NO: 942480 - RNA, 17 nt, Homo sapiens
ggagggccagcgcugug

SEQ ID NO: 942481 - RNA, 22 nt, Homo sapiens
ggaguaggugcuaaccuggaua

SEQ ID NO: 942482 - RNA, 17 nt, Homo sapiens
ggagugcaguggcacaa

SEQ ID NO: 942483 - RNA, 13 nt, Homo sapiens
ggauacuggcaca

SEQ ID NO: 942484 - RNA, 19 nt, Homo sapiens
ggauauaaaaauaauguca

SEQ ID NO: 942485 - RNA, 16 nt, Homo sapiens
ggauauccuuucacuc

SEQ ID NO: 942486 - RNA, 18 nt, Homo sapiens
ggaucacuugggcccagg

SEQ ID NO: 942487 - RNA, 20 nt, Homo sapiens
ggauccaauuuuaauauuaa

SEQ ID NO: 942488 - RNA, 23 nt, Homo sapiens
ggaucuucccacaggagggccag

SEQ ID NO: 942489 - RNA, 14 nt, Homo sapiens
ggauuuuaccaaag

SEQ ID NO: 942490 - RNA, 15 nt, Homo sapiens
ggauuuucacauucu

SEQ ID NO: 942491 - RNA, 23 nt, Homo sapiens
ggcaagaggaauuacgugcucug

SEQ ID NO: 942492 - RNA, 22 nt, Homo sapiens
ggcaagucaccugcagcccaug

SEQ ID NO: 942493 - RNA, 16 nt, Homo sapiens
ggcaaguugcaucaga

SEQ ID NO: 942494 - RNA, 14 nt, Homo sapiens
ggcaccugauacuu

SEQ ID NO: 942495 - RNA, 17 nt, Homo sapiens
ggcaccugauacuucug

SEQ ID NO: 942496 - RNA, 15 nt, Homo sapiens
ggcagaaaacagcuc

SEQ ID NO: 942497 - RNA, 16 nt, Homo sapiens
ggcagcuuugcaaaau

SEQ ID NO: 942498 - RNA, 20 nt, Homo sapiens
ggcaggagagucacuugaac

SEQ ID NO: 942499 - RNA, 18 nt, Homo sapiens
ggcaggcugggccauguc

SEQ ID NO: 942500 - RNA, 20 nt, Homo sapiens
ggcaggcugggccaugucca

SEQ ID NO: 942501 - RNA, 21 nt, Homo sapiens
ggcauguaaauguaaacucag

SEQ ID NO: 942502 - RNA, 17 nt, Homo sapiens
ggccaacggcaacagca

SEQ ID NO: 942503 - RNA, 12 nt, Homo sapiens
ggccaaugucag

SEQ ID NO: 942504 - RNA, 10 nt, Homo sapiens
ggccacagac

SEQ ID NO: 942505 - RNA, 22 nt, Homo sapiens
ggccagagagggcgugggcgcu

SEQ ID NO: 942506 - RNA, 16 nt, Homo sapiens
ggcccacccccagugg

SEQ ID NO: 942507 - RNA, 15 nt, Homo sapiens
ggcccauggcauuuu

SEQ ID NO: 942508 - RNA, 12 nt, Homo sapiens
ggccgacuccac

SEQ ID NO: 942509 - RNA, 19 nt, Homo sapiens
ggccgggugugguggcuca

SEQ ID NO: 942510 - RNA, 14 nt, Homo sapiens
ggccuacagcuuug

SEQ ID NO: 942511 - RNA, 16 nt, Homo sapiens
ggccucugagaagcuc

SEQ ID NO: 942512 - RNA, 21 nt, Homo sapiens
ggccucugcucuccugggaga

SEQ ID NO: 942513 - RNA, 19 nt, Homo sapiens
ggccuuccucucuccagau

SEQ ID NO: 942514 - RNA, 21 nt, Homo sapiens
ggcgcaguggcucaugccugu

SEQ ID NO: 942515 - RNA, 23 nt, Homo sapiens
ggcgucugcugucucaucacaua

SEQ ID NO: 942516 - RNA, 17 nt, Homo sapiens
ggcucagacauguuuuc

SEQ ID NO: 942517 - RNA, 19 nt, Homo sapiens
cagugagguucuuggguuu

SEQ ID NO: 942518 - RNA, 17 nt, Homo sapiens
cagugagucauaucuua

SEQ ID NO: 942519 - RNA, 16 nt, Homo sapiens
cagugcccaugggcua

SEQ ID NO: 942520 - RNA, 18 nt, Homo sapiens
caguggcccauggcauuu

SEQ ID NO: 942521 - RNA, 13 nt, Homo sapiens
cagugguggagcu

SEQ ID NO: 942522 - RNA, 19 nt, Homo sapiens
cagugguggucuucaagac

SEQ ID NO: 942523 - RNA, 20 nt, Homo sapiens
cagugugugugggugaaaug

SEQ ID NO: 942524 - RNA, 19 nt, Homo sapiens
caguguuucugugaauaga

SEQ ID NO: 942525 - RNA, 16 nt, Homo sapiens
caguuauuaaucugga

SEQ ID NO: 942526 - RNA, 18 nt, Homo sapiens
caguucauugcacuuuga

SEQ ID NO: 942527 - RNA, 18 nt, Homo sapiens
caguuguaccaagugaaa

SEQ ID NO: 942528 - RNA, 19 nt, Homo sapiens
caguuuuauaaaaagugga

SEQ ID NO: 942529 - RNA, 21 nt, Homo sapiens
cauaacaaccugggcauuccu

SEQ ID NO: 942530 - RNA, 23 nt, Homo sapiens
cauaacaaccugggcauuccuug

SEQ ID NO: 942531 - RNA, 16 nt, Homo sapiens
gggccauguccaaaga

SEQ ID NO: 942532 - RNA, 22 nt, Homo sapiens
gggcccugccccaccccaucca

SEQ ID NO: 942533 - RNA, 16 nt, Homo sapiens
gggcccugggccucag

SEQ ID NO: 942534 - RNA, 21 nt, Homo sapiens
gggcucaaacuucuaaggggu

SEQ ID NO: 942535 - RNA, 15 nt, Homo sapiens
gggcucagccuagug

SEQ ID NO: 942536 - RNA, 17 nt, Homo sapiens
gggcucaggccauccag

SEQ ID NO: 942537 - RNA, 22 nt, Homo sapiens
gggcucccacaggaucagaggc

SEQ ID NO: 942538 - RNA, 23 nt, Homo sapiens
gggcucucucuccccacugucuc

SEQ ID NO: 942539 - RNA, 13 nt, Homo sapiens
ggggaaguggcca

SEQ ID NO: 942540 - RNA, 20 nt, Homo sapiens
ggggcagacaauaaacccuc

SEQ ID NO: 942541 - RNA, 22 nt, Homo sapiens
gggggcucaggccauccagcca

SEQ ID NO: 942542 - RNA, 21 nt, Homo sapiens
gggguaggugaugggggacga

SEQ ID NO: 942543 - RNA, 15 nt, Homo sapiens
ggguaccuggcuaug

SEQ ID NO: 942544 - RNA, 14 nt, Homo sapiens
gggugguacccucu

SEQ ID NO: 942545 - RNA, 14 nt, Homo sapiens
ggguuuugcuacau

SEQ ID NO: 942546 - RNA, 23 nt, Homo sapiens
ggguuuuuaaucuuugugacagg

SEQ ID NO: 942547 - RNA, 13 nt, Homo sapiens
gguaaaacagggc

SEQ ID NO: 942548 - RNA, 11 nt, Homo sapiens
gguacuuucau

SEQ ID NO: 942549 - RNA, 18 nt, Homo sapiens
ggucacccuucaacgcuc

SEQ ID NO: 942550 - RNA, 14 nt, Homo sapiens
ggucaggacucaga

SEQ ID NO: 942551 - RNA, 16 nt, Homo sapiens
ggucuaagguucagcc

SEQ ID NO: 942552 - RNA, 15 nt, Homo sapiens
ggucuuaggaauuga

SEQ ID NO: 942553 - RNA, 16 nt, Homo sapiens
ggucuuuugguuauga

SEQ ID NO: 942554 - RNA, 19 nt, Homo sapiens
ggugaccuccguccucucc

SEQ ID NO: 942555 - RNA, 12 nt, Homo sapiens
ggugagugugca

SEQ ID NO: 942556 - RNA, 15 nt, Homo sapiens
ggugagugugcagua

SEQ ID NO: 942557 - RNA, 17 nt, Homo sapiens
ggugcuucucagauuuc

SEQ ID NO: 942558 - RNA, 23 nt, Homo sapiens
gguggagcagcaaacuuggugaa

SEQ ID NO: 942559 - RNA, 17 nt, Homo sapiens
ggugugcaccuguaauc

SEQ ID NO: 942560 - RNA, 14 nt, Homo sapiens
gguugaucuugcaa

SEQ ID NO: 942561 - RNA, 16 nt, Homo sapiens
gguugucaccaagcua

SEQ ID NO: 942562 - RNA, 21 nt, Homo sapiens
gguuugccaaaauucauuucu

SEQ ID NO: 942563 - RNA, 15 nt, Homo sapiens
gguuuucauuugcca

SEQ ID NO: 942564 - RNA, 21 nt, Homo sapiens
guaaacagauggcacuuugaa

SEQ ID NO: 942565 - RNA, 17 nt, Homo sapiens
guaaacgggaacaugcc

SEQ ID NO: 942566 - RNA, 23 nt, Homo sapiens
guaaaugugacauugauuugcuc

SEQ ID NO: 942567 - RNA, 20 nt, Homo sapiens
guaaauugaaucaguauaaa

SEQ ID NO: 942568 - RNA, 17 nt, Homo sapiens
guaacuccccucaggga

SEQ ID NO: 942569 - RNA, 12 nt, Homo sapiens
guaagcaaacaa

SEQ ID NO: 942570 - RNA, 11 nt, Homo sapiens
guaaguauuuu

SEQ ID NO: 942571 - RNA, 16 nt, Homo sapiens
guaaucccagcacuuu

SEQ ID NO: 942572 - RNA, 17 nt, Homo sapiens
guaaugcugcacagaaa

SEQ ID NO: 942573 - RNA, 12 nt, Homo sapiens
guacacaacaau

SEQ ID NO: 942574 - RNA, 15 nt, Homo sapiens
guacauacgauuuaa

SEQ ID NO: 942575 - RNA, 21 nt, Homo sapiens
guacccacucuggagcauuuc

SEQ ID NO: 942576 - RNA, 18 nt, Homo sapiens
guacugguugacuuucua

SEQ ID NO: 942577 - RNA, 15 nt, Homo sapiens
guacuucucacccag

SEQ ID NO: 942578 - RNA, 21 nt, Homo sapiens
guacuuuuaaaaacauaacau

SEQ ID NO: 942579 - RNA, 20 nt, Homo sapiens
guagagacgguguuuugcca

SEQ ID NO: 942580 - RNA, 21 nt, Homo sapiens
guagagacgguguuuugccau

SEQ ID NO: 942581 - RNA, 15 nt, Homo sapiens
guaggagcugccuug

SEQ ID NO: 942582 - RNA, 22 nt, Homo sapiens
guaguuuguuuuagaaccagcc

SEQ ID NO: 942583 - RNA, 14 nt, Homo sapiens
guauaagcaucugc

SEQ ID NO: 942584 - RNA, 18 nt, Homo sapiens
guauauuacaaugaucac

SEQ ID NO: 942585 - RNA, 18 nt, Homo sapiens
guaucaaauacauuuaaa

SEQ ID NO: 942586 - RNA, 13 nt, Homo sapiens
guaugcuggccag

SEQ ID NO: 942587 - RNA, 18 nt, Homo sapiens
guaugcuggccagcaccc

SEQ ID NO: 942588 - RNA, 13 nt, Homo sapiens
guaugggaucuga

SEQ ID NO: 942589 - RNA, 19 nt, Homo sapiens
guauugucaccaggauuac

SEQ ID NO: 942590 - RNA, 14 nt, Homo sapiens
gucaaaacuacuga

SEQ ID NO: 942591 - RNA, 16 nt, Homo sapiens
gucaaaaggacauuua

SEQ ID NO: 942592 - RNA, 14 nt, Homo sapiens
gucaaggcucaguc

SEQ ID NO: 942593 - RNA, 18 nt, Homo sapiens
gucacacgauaaagggau

SEQ ID NO: 942594 - RNA, 19 nt, Homo sapiens
gucacauuuagcugugcuc

SEQ ID NO: 942595 - RNA, 12 nt, Homo sapiens
gucagcauguac

SEQ ID NO: 942596 - RNA, 18 nt, Homo sapiens
gucagcauguacuccccu

SEQ ID NO: 942597 - RNA, 19 nt, Homo sapiens
gucaggaaaacuguuccaa

SEQ ID NO: 942598 - RNA, 20 nt, Homo sapiens
gucauuggccgacaucacag

SEQ ID NO: 942599 - RNA, 19 nt, Homo sapiens
gucauuucaaagacucuca

SEQ ID NO: 942600 - RNA, 17 nt, Homo sapiens
guccccucaccuccucu

SEQ ID NO: 942601 - RNA, 18 nt, Homo sapiens
guccccucacucugucag

SEQ ID NO: 942602 - RNA, 22 nt, Homo sapiens
gucccuauacagagguccugcc

SEQ ID NO: 942603 - RNA, 19 nt, Homo sapiens
guccuaaccagugagcacu

SEQ ID NO: 942604 - RNA, 20 nt, Homo sapiens
gucggaacccaagcuuagaa

SEQ ID NO: 942605 - RNA, 14 nt, Homo sapiens
gucggucccugaga

SEQ ID NO: 942606 - RNA, 13 nt, Homo sapiens
gucuccagacucu

SEQ ID NO: 942607 - RNA, 16 nt, Homo sapiens
gucuccagacucucac

SEQ ID NO: 942608 - RNA, 23 nt, Homo sapiens
gucuccugagcacccagaacucc

SEQ ID NO: 942609 - RNA, 14 nt, Homo sapiens
gucugcuguagaaa

SEQ ID NO: 942610 - RNA, 13 nt, Homo sapiens
gucuguaccucaa

SEQ ID NO: 942611 - RNA, 14 nt, Homo sapiens
gucuuugcagagaa

SEQ ID NO: 942612 - RNA, 20 nt, Homo sapiens
gugaagaaaccguauccaua

SEQ ID NO: 942613 - RNA, 23 nt, Homo sapiens
gugaauuaagcccaauuaauucc

SEQ ID NO: 942614 - RNA, 13 nt, Homo sapiens
gugauagcacuuu

SEQ ID NO: 942615 - RNA, 18 nt, Homo sapiens
gugaucuugagaaccuuu

SEQ ID NO: 942616 - RNA, 18 nt, Homo sapiens
gugauuucuuucuuugca

SEQ ID NO: 942617 - RNA, 11 nt, Homo sapiens
gugcaaaggga

SEQ ID NO: 942618 - RNA, 15 nt, Homo sapiens
gugcagaucuuugaa

SEQ ID NO: 942619 - RNA, 14 nt, Homo sapiens
gugcaggacacugg

SEQ ID NO: 942620 - RNA, 22 nt, Homo sapiens
gugccacuuuaauccuuccacu

SEQ ID NO: 942621 - RNA, 20 nt, Homo sapiens
gugccauacuuguucuguau

SEQ ID NO: 942622 - RNA, 13 nt, Homo sapiens
gugccaugaucug

SEQ ID NO: 942623 - RNA, 15 nt, Homo sapiens
gugccccccuccucc

SEQ ID NO: 942624 - RNA, 13 nt, Homo sapiens
cccaggaagccca

SEQ ID NO: 942625 - RNA, 13 nt, Homo sapiens
cccaguaaaauca

SEQ ID NO: 942626 - RNA, 21 nt, Homo sapiens
cccaguaaaaucaaaugugca

SEQ ID NO: 942627 - RNA, 15 nt, Homo sapiens
cccaguauaccucau

SEQ ID NO: 942628 - RNA, 15 nt, Homo sapiens
cccauccagccagac

SEQ ID NO: 942629 - RNA, 23 nt, Homo sapiens
cccaugaccccaaagccaagggc

SEQ ID NO: 942630 - RNA, 22 nt, Homo sapiens
cccaugggcuaucaacuuaaua

SEQ ID NO: 942631 - RNA, 22 nt, Homo sapiens
ccccaaaccuggcaagucaccu

SEQ ID NO: 942632 - RNA, 22 nt, Homo sapiens
ccccaccuccugucguccugcc

SEQ ID NO: 942633 - RNA, 14 nt, Homo sapiens
ccccacgcugacca

SEQ ID NO: 942634 - RNA, 23 nt, Homo sapiens
ccccaguaaaaucaaaugugcau

SEQ ID NO: 942635 - RNA, 21 nt, Homo sapiens
ccccaguuccucccaggaagc

SEQ ID NO: 942636 - RNA, 21 nt, Homo sapiens
cccccaguuccucccaggaag

SEQ ID NO: 942637 - RNA, 19 nt, Homo sapiens
cccccaugggcuguguccu

SEQ ID NO: 942638 - RNA, 17 nt, Homo sapiens
cccccggagcagggguc

SEQ ID NO: 942639 - RNA, 20 nt, Homo sapiens
guucagugagguucuugggu

SEQ ID NO: 942640 - RNA, 15 nt, Homo sapiens
guuccagaccagccu

SEQ ID NO: 942641 - RNA, 20 nt, Homo sapiens
guucccauuuuugcuuagcu

SEQ ID NO: 942642 - RNA, 15 nt, Homo sapiens
guucccccuguuuca

SEQ ID NO: 942643 - RNA, 20 nt, Homo sapiens
guuccucccccaguuccucc

SEQ ID NO: 942644 - RNA, 21 nt, Homo sapiens
guucgccgcguggaaugugag

SEQ ID NO: 942645 - RNA, 11 nt, Homo sapiens
guucugcagcc

SEQ ID NO: 942646 - RNA, 22 nt, Homo sapiens
guucuguauucgaaaugagcuc

SEQ ID NO: 942647 - RNA, 12 nt, Homo sapiens
guucuuguucuu

SEQ ID NO: 942648 - RNA, 18 nt, Homo sapiens
guuggucaggcgcagugg

SEQ ID NO: 942649 - RNA, 13 nt, Homo sapiens
guuuagugauauu

SEQ ID NO: 942650 - RNA, 22 nt, Homo sapiens
guuucccauaacaaccugggca

SEQ ID NO: 942651 - RNA, 23 nt, Homo sapiens
guuuccgaaggguuuugcuacau

SEQ ID NO: 942652 - RNA, 21 nt, Homo sapiens
guuucgaagaauaaaauauga

SEQ ID NO: 942653 - RNA, 17 nt, Homo sapiens
guuucuaggcaccucag

SEQ ID NO: 942654 - RNA, 12 nt, Homo sapiens
guuuuagaacca

SEQ ID NO: 942655 - RNA, 19 nt, Homo sapiens
guuuucaagucaaauuaau

SEQ ID NO: 942656 - RNA, 12 nt, Homo sapiens
guuuucauuugc

SEQ ID NO: 942657 - RNA, 16 nt, Homo sapiens
guuuugcuacauucua

SEQ ID NO: 942658 - RNA, 14 nt, Homo sapiens
guuuugugccuuug

SEQ ID NO: 942659 - RNA, 13 nt, Homo sapiens
guuuuuucuccag

SEQ ID NO: 942660 - RNA, 16 nt, Homo sapiens
uaaaaagauaaucuca

SEQ ID NO: 942661 - RNA, 19 nt, Homo sapiens
uaaaacucaacauuacugu

SEQ ID NO: 942662 - RNA, 16 nt, Homo sapiens
uaaaauaaaagccaac

SEQ ID NO: 942663 - RNA, 18 nt, Homo sapiens
uaaaaucaaaugugcauc

SEQ ID NO: 942664 - RNA, 18 nt, Homo sapiens
uaaaauuaaaaguuugaa

SEQ ID NO: 942665 - RNA, 17 nt, Homo sapiens
uaaaauucagaugcugu

SEQ ID NO: 942666 - RNA, 15 nt, Homo sapiens
uaaacaccuccucau

SEQ ID NO: 942667 - RNA, 17 nt, Homo sapiens
uaaacagauggcacuuu

SEQ ID NO: 942668 - RNA, 22 nt, Homo sapiens
uaaacauugaagacccugucuc

SEQ ID NO: 942669 - RNA, 13 nt, Homo sapiens
uaaacccucagag

SEQ ID NO: 942670 - RNA, 23 nt, Homo sapiens
uaaacuggaauccuuucacccgc

SEQ ID NO: 942671 - RNA, 15 nt, Homo sapiens
uaaagaauagcuuua

SEQ ID NO: 942672 - RNA, 15 nt, Homo sapiens
uaaagcauauuggug

SEQ ID NO: 942673 - RNA, 14 nt, Homo sapiens
uaaagccuccucau

SEQ ID NO: 942674 - RNA, 15 nt, Homo sapiens
uaaaguugguauuaa

SEQ ID NO: 942675 - RNA, 13 nt, Homo sapiens
uaaauacuggugc

SEQ ID NO: 942676 - RNA, 14 nt, Homo sapiens
uaaaugcaauauuc

SEQ ID NO: 942677 - RNA, 23 nt, Homo sapiens
uaaauuuguuauuguguauuaug

SEQ ID NO: 942678 - RNA, 23 nt, Homo sapiens
uaaauuuuuuugcaauccuuucc

SEQ ID NO: 942679 - RNA, 18 nt, Homo sapiens
uaacaaaauguaugucug

SEQ ID NO: 942680 - RNA, 12 nt, Homo sapiens
uaacaaccuggg

SEQ ID NO: 942681 - RNA, 15 nt, Homo sapiens
uaacacucaugaagc

SEQ ID NO: 942682 - RNA, 20 nt, Homo sapiens
uaacaucaguuuuguuuacu

SEQ ID NO: 942683 - RNA, 15 nt, Homo sapiens
uaacaugugaaaaga

SEQ ID NO: 942684 - RNA, 17 nt, Homo sapiens
uaacauuaucuaguuca

SEQ ID NO: 942685 - RNA, 20 nt, Homo sapiens
uaacauuccagccacuggcu

SEQ ID NO: 942686 - RNA, 20 nt, Homo sapiens
uaaccaagagauaacuguaa

SEQ ID NO: 942687 - RNA, 13 nt, Homo sapiens
uaacuaucaauau

SEQ ID NO: 942688 - RNA, 18 nt, Homo sapiens
uaacuaugaccaugcuga

SEQ ID NO: 942689 - RNA, 13 nt, Homo sapiens
uaacucccaguga

SEQ ID NO: 942690 - RNA, 18 nt, Homo sapiens
uaacugaggacuguuugc

SEQ ID NO: 942691 - RNA, 22 nt, Homo sapiens
uaacugaggacuguuugcaauu

SEQ ID NO: 942692 - RNA, 17 nt, Homo sapiens
uaacuuucuuaucccau

SEQ ID NO: 942693 - RNA, 19 nt, Homo sapiens
uaagaauucaaacuggggc

SEQ ID NO: 942694 - RNA, 17 nt, Homo sapiens
uaagaggcuuucuccag

SEQ ID NO: 942695 - RNA, 15 nt, Homo sapiens
uaagaugacuguguu

SEQ ID NO: 942696 - RNA, 21 nt, Homo sapiens
uaagcauauguguuacuucaa

SEQ ID NO: 942697 - RNA, 14 nt, Homo sapiens
uaagcaucugccau

SEQ ID NO: 942698 - RNA, 16 nt, Homo sapiens
uaaggacuucugcagc

SEQ ID NO: 942699 - RNA, 20 nt, Homo sapiens
uaaggagaggagaaacugag

SEQ ID NO: 942700 - RNA, 20 nt, Homo sapiens
uaaguauuuuccuguuguca

SEQ ID NO: 942701 - RNA, 15 nt, Homo sapiens
uaagugucucacuaa

SEQ ID NO: 942702 - RNA, 22 nt, Homo sapiens
uaaguugucuaaacaaugcuga

SEQ ID NO: 942703 - RNA, 21 nt, Homo sapiens
uaauaaaaccggucacugaug

SEQ ID NO: 942704 - RNA, 14 nt, Homo sapiens
uaauacaaacuaua

SEQ ID NO: 942705 - RNA, 23 nt, Homo sapiens
uaauagccuggguuaaguauuau

SEQ ID NO: 942706 - RNA, 16 nt, Homo sapiens
uaauagucuuugccag

SEQ ID NO: 942707 - RNA, 13 nt, Homo sapiens
uaauagugccaag

SEQ ID NO: 942708 - RNA, 14 nt, Homo sapiens
uaaucaucaaguaa

SEQ ID NO: 942709 - RNA, 17 nt, Homo sapiens
uaaucaucaaguaauac

SEQ ID NO: 942710 - RNA, 15 nt, Homo sapiens
uaauccuucuggcaa

SEQ ID NO: 942711 - RNA, 20 nt, Homo sapiens
uaaucucuaggaagucaaua

SEQ ID NO: 942712 - RNA, 15 nt, Homo sapiens
uaaugaaaacauuaa

SEQ ID NO: 942713 - RNA, 17 nt, Homo sapiens
uaauggcaauaggacau

SEQ ID NO: 942714 - RNA, 22 nt, Homo sapiens
uaaugucauagguaagaaacac

SEQ ID NO: 942715 - RNA, 17 nt, Homo sapiens
uaauguccauaugcuaa

SEQ ID NO: 942716 - RNA, 17 nt, Homo sapiens
uaauuauacuacuuugu

SEQ ID NO: 942717 - RNA, 23 nt, Homo sapiens
uaauugggcaggugaaaagggua

SEQ ID NO: 942718 - RNA, 14 nt, Homo sapiens
uaauuuuacauguu

SEQ ID NO: 942719 - RNA, 18 nt, Homo sapiens
uaauuuuguaauguauca

SEQ ID NO: 942720 - RNA, 17 nt, Homo sapiens
uaauuuugucagauuca

SEQ ID NO: 942721 - RNA, 13 nt, Homo sapiens
uacaaacauuuaa

SEQ ID NO: 942722 - RNA, 13 nt, Homo sapiens
uacaacagaauaa

SEQ ID NO: 942723 - RNA, 14 nt, Homo sapiens
uacaaccagcccaa

SEQ ID NO: 942724 - RNA, 20 nt, Homo sapiens
uacaacgccgagugcacugc

SEQ ID NO: 942725 - RNA, 14 nt, Homo sapiens
uacaacucacauua

SEQ ID NO: 942726 - RNA, 20 nt, Homo sapiens
uacaaugugaacuuuauuaa

SEQ ID NO: 942727 - RNA, 13 nt, Homo sapiens
uacaauucauugu

SEQ ID NO: 942728 - RNA, 16 nt, Homo sapiens
uacagcaggugcucaa

SEQ ID NO: 942729 - RNA, 14 nt, Homo sapiens
uacagcuucaguga

SEQ ID NO: 942730 - RNA, 20 nt, Homo sapiens
uacagggacacuaucacuca

SEQ ID NO: 942731 - RNA, 17 nt, Homo sapiens
cggauguaacgcugcca

SEQ ID NO: 942732 - RNA, 14 nt, Homo sapiens
cggcaacaucucug

SEQ ID NO: 942733 - RNA, 16 nt, Homo sapiens
cgggugguuaguggua

SEQ ID NO: 942734 - RNA, 16 nt, Homo sapiens
cggucucauuucuucu

SEQ ID NO: 942735 - RNA, 14 nt, Homo sapiens
cgguguuuugccau

SEQ ID NO: 942736 - RNA, 15 nt, Homo sapiens
cgguuaccucugcau

SEQ ID NO: 942737 - RNA, 15 nt, Homo sapiens
cgugaugaucuagcc

SEQ ID NO: 942738 - RNA, 22 nt, Homo sapiens
cgugcucugugggucuccccca

SEQ ID NO: 942739 - RNA, 19 nt, Homo sapiens
cguucgauuucuaccucag

SEQ ID NO: 942740 - RNA, 21 nt, Homo sapiens
cuaaaauaauuuuauuaugca

SEQ ID NO: 942741 - RNA, 19 nt, Homo sapiens
cuaaaauguaucuaagaau

SEQ ID NO: 942742 - RNA, 22 nt, Homo sapiens
cuaaacuaguuuuuccuaucau

SEQ ID NO: 942743 - RNA, 19 nt, Homo sapiens
cuaaacucuuucauccccu

SEQ ID NO: 942744 - RNA, 20 nt, Homo sapiens
cuaaacucuuucauccccug

SEQ ID NO: 942745 - RNA, 21 nt, Homo sapiens
cuaaagaaaaauaucuuggcc

SEQ ID NO: 942746 - RNA, 21 nt, Homo sapiens
cuaaaggaaagaugaugguga

SEQ ID NO: 942747 - RNA, 18 nt, Homo sapiens
cuaaaugccccauauuaa

SEQ ID NO: 942748 - RNA, 24 nt, Homo sapiens
uacuaacauuuucauugaugagca

SEQ ID NO: 942749 - RNA, 16 nt, Homo sapiens
uacuagucaaacaaaa

SEQ ID NO: 942750 - RNA, 17 nt, Homo sapiens
uacuagucaccagagac

SEQ ID NO: 942751 - RNA, 14 nt, Homo sapiens
uacuccaugggcug

SEQ ID NO: 942752 - RNA, 15 nt, Homo sapiens
uacucuuacaagagu

SEQ ID NO: 942753 - RNA, 16 nt, Homo sapiens
uacuggcuguggacca

SEQ ID NO: 942754 - RNA, 19 nt, Homo sapiens
uacuuccuacagagccaaa

SEQ ID NO: 942755 - RNA, 16 nt, Homo sapiens
uacuuuaucaaugugu

SEQ ID NO: 942756 - RNA, 16 nt, Homo sapiens
uacuuucccucaucca

SEQ ID NO: 942757 - RNA, 19 nt, Homo sapiens
uacuuuuuauuugcaacuu

SEQ ID NO: 942758 - RNA, 17 nt, Homo sapiens
uagaaaggaacugcaau

SEQ ID NO: 942759 - RNA, 15 nt, Homo sapiens
uagaaaugucucaag

SEQ ID NO: 942760 - RNA, 23 nt, Homo sapiens
uagaaaugucucaaggcaguuaa

SEQ ID NO: 942761 - RNA, 22 nt, Homo sapiens
uagaacaguggaaacuaugugu

SEQ ID NO: 942762 - RNA, 11 nt, Homo sapiens
uagaaccagcc

SEQ ID NO: 942763 - RNA, 22 nt, Homo sapiens
uagaagcaacuaggaaaaucac

SEQ ID NO: 942764 - RNA, 11 nt, Homo sapiens
uagaauaccac

SEQ ID NO: 942765 - RNA, 17 nt, Homo sapiens
uagacacauacauguca

SEQ ID NO: 942766 - RNA, 19 nt, Homo sapiens
uagaugcacguggggccca

SEQ ID NO: 942767 - RNA, 15 nt, Homo sapiens
uagauuaauacucua

SEQ ID NO: 942768 - RNA, 19 nt, Homo sapiens
uagauucagguaauacaaa

SEQ ID NO: 942769 - RNA, 16 nt, Homo sapiens
uagauuucuacauuaa

SEQ ID NO: 942770 - RNA, 23 nt, Homo sapiens
uagcaaagauuaaaugugucauu

SEQ ID NO: 942771 - RNA, 14 nt, Homo sapiens
uagcaauauaucag

SEQ ID NO: 942772 - RNA, 13 nt, Homo sapiens
uagcagucacuga

SEQ ID NO: 942773 - RNA, 20 nt, Homo sapiens
uagccaaaccaggacccugu

SEQ ID NO: 942774 - RNA, 20 nt, Homo sapiens
uagccagguaugguggcaua

SEQ ID NO: 942775 - RNA, 16 nt, Homo sapiens
uaggacauugugucag

SEQ ID NO: 942776 - RNA, 12 nt, Homo sapiens
uaggcagaucac

SEQ ID NO: 942777 - RNA, 12 nt, Homo sapiens
uaggcauguaaa

SEQ ID NO: 942778 - RNA, 16 nt, Homo sapiens
uaggugcuauuuguca

SEQ ID NO: 942779 - RNA, 18 nt, Homo sapiens
uaguagacaugaauuuua

SEQ ID NO: 942780 - RNA, 14 nt, Homo sapiens
uagucaccagagac

SEQ ID NO: 942781 - RNA, 20 nt, Homo sapiens
uaguggccugugcuuuucag

SEQ ID NO: 942782 - RNA, 21 nt, Homo sapiens
uaguguauuaucacugucugu

SEQ ID NO: 942783 - RNA, 22 nt, Homo sapiens
uaguuccccaaauacaaaguua

SEQ ID NO: 942784 - RNA, 13 nt, Homo sapiens
uaguucuaccuca

SEQ ID NO: 942785 - RNA, 20 nt, Homo sapiens
uaguuuuuccuaucauguua

SEQ ID NO: 942786 - RNA, 20 nt, Homo sapiens
uauaaaaauauuaagacaau

SEQ ID NO: 942787 - RNA, 21 nt, Homo sapiens
uauaacuuaggccuagccucu

SEQ ID NO: 942788 - RNA, 22 nt, Homo sapiens
uauaacuuaggccuagccucuu

SEQ ID NO: 942789 - RNA, 16 nt, Homo sapiens
uauaagcaucugccau

SEQ ID NO: 942790 - RNA, 21 nt, Homo sapiens
uauacaaauuagaaaauguua

SEQ ID NO: 942791 - RNA, 15 nt, Homo sapiens
uauacaagugauaau

SEQ ID NO: 942792 - RNA, 12 nt, Homo sapiens
uauagcauuaau

SEQ ID NO: 942793 - RNA, 17 nt, Homo sapiens
uauagccaauauaacua

SEQ ID NO: 942794 - RNA, 20 nt, Homo sapiens
uauagcuaauaacaugugaa

SEQ ID NO: 942795 - RNA, 17 nt, Homo sapiens
uauauccccacuacuca

SEQ ID NO: 942796 - RNA, 16 nt, Homo sapiens
uauaugggaaaccaug

SEQ ID NO: 942797 - RNA, 18 nt, Homo sapiens
uauauguauauugucuag

SEQ ID NO: 942798 - RNA, 13 nt, Homo sapiens
uauauuaauauca

SEQ ID NO: 942799 - RNA, 21 nt, Homo sapiens
uauauugcuuaccugaucuca

SEQ ID NO: 942800 - RNA, 20 nt, Homo sapiens
uauauuugugauagcacuuu

SEQ ID NO: 942801 - RNA, 20 nt, Homo sapiens
uauauuuuuuuaaaauguua

SEQ ID NO: 942802 - RNA, 16 nt, Homo sapiens
uaucaaauacauuuaa

SEQ ID NO: 942803 - RNA, 14 nt, Homo sapiens
uaucaagcuuuuaa

SEQ ID NO: 942804 - RNA, 14 nt, Homo sapiens
uaucugucaucucu

SEQ ID NO: 942805 - RNA, 20 nt, Homo sapiens
uaucuuuauuaaucacuauu

SEQ ID NO: 942806 - RNA, 17 nt, Homo sapiens
uaucuuugugugacaug

SEQ ID NO: 942807 - RNA, 14 nt, Homo sapiens
uaugauacguguau

SEQ ID NO: 942808 - RNA, 19 nt, Homo sapiens
uaugcaaccaguuuaucca

SEQ ID NO: 942809 - RNA, 22 nt, Homo sapiens
uaugcuggacucuggaccauau

SEQ ID NO: 942810 - RNA, 12 nt, Homo sapiens
uaugcuggccag

SEQ ID NO: 942811 - RNA, 22 nt, Homo sapiens
uaugugcaggcaccugauacuu

SEQ ID NO: 942812 - RNA, 18 nt, Homo sapiens
uaugugggaguacucuca

SEQ ID NO: 942813 - RNA, 16 nt, Homo sapiens
uauguuaccuuuucau

SEQ ID NO: 942814 - RNA, 19 nt, Homo sapiens
uauguucccccuguuucag

SEQ ID NO: 942815 - RNA, 20 nt, Homo sapiens
uauuauuuguguuuccuaaa

SEQ ID NO: 942816 - RNA, 16 nt, Homo sapiens
uauucauuaagcuuuu

SEQ ID NO: 942817 - RNA, 20 nt, Homo sapiens
uauugauuuuaaauggaugu

SEQ ID NO: 942818 - RNA, 15 nt, Homo sapiens
uauugcaguuuauca

SEQ ID NO: 942819 - RNA, 19 nt, Homo sapiens
uauugcaugcucaacuuag

SEQ ID NO: 942820 - RNA, 16 nt, Homo sapiens
uauuguauaaagcauu

SEQ ID NO: 942821 - RNA, 23 nt, Homo sapiens
uauugucauaggauuaagcaguu

SEQ ID NO: 942822 - RNA, 18 nt, Homo sapiens
uauuuaaagccuccucau

SEQ ID NO: 942823 - RNA, 20 nt, Homo sapiens
uauuuaaauuguuuuggacg

SEQ ID NO: 942824 - RNA, 16 nt, Homo sapiens
uauuucauccaguuug

SEQ ID NO: 942825 - RNA, 17 nt, Homo sapiens
uauuuccucugugcaaa

SEQ ID NO: 942826 - RNA, 17 nt, Homo sapiens
uauuugcuaaaugcugu

SEQ ID NO: 942827 - RNA, 15 nt, Homo sapiens
uauuuuaagacguga

SEQ ID NO: 942828 - RNA, 17 nt, Homo sapiens
uauuuuaagacgugaau

SEQ ID NO: 942829 - RNA, 21 nt, Homo sapiens
uauuuuguaaugcugcacaga

SEQ ID NO: 942830 - RNA, 16 nt, Homo sapiens
uauuuuucauaaacaa

SEQ ID NO: 942831 - RNA, 16 nt, Homo sapiens
uauuuuuguacguuau

SEQ ID NO: 942832 - RNA, 23 nt, Homo sapiens
ucaaaaaagaaaaaagaaaagaa

SEQ ID NO: 942833 - RNA, 21 nt, Homo sapiens
ucaaaaagggaaguaagcaaa

SEQ ID NO: 942834 - RNA, 16 nt, Homo sapiens
ucaaaccacaauaucc

SEQ ID NO: 942835 - RNA, 17 nt, Homo sapiens
ucaaaggccacauaccu

SEQ ID NO: 942836 - RNA, 14 nt, Homo sapiens
ucaaaugcauuuug

SEQ ID NO: 942837 - RNA, 13 nt, Homo sapiens
ucaaaugugcauc

SEQ ID NO: 942838 - RNA, 11 nt, Homo sapiens
cugccaagagu

SEQ ID NO: 942839 - RNA, 16 nt, Homo sapiens
cugccccuacccugga

SEQ ID NO: 942840 - RNA, 18 nt, Homo sapiens
cugcggaccccucgucau

SEQ ID NO: 942841 - RNA, 22 nt, Homo sapiens
cugcuaacaagucaccaaaaga

SEQ ID NO: 942842 - RNA, 22 nt, Homo sapiens
cugcuccuguucacaccagaga

SEQ ID NO: 942843 - RNA, 15 nt, Homo sapiens
cuggaaccauuggca

SEQ ID NO: 942844 - RNA, 15 nt, Homo sapiens
cuggagcaguggacu

SEQ ID NO: 942845 - RNA, 15 nt, Homo sapiens
cuggaggaacacuug

SEQ ID NO: 942846 - RNA, 17 nt, Homo sapiens
cuggaggacggucaguc

SEQ ID NO: 942847 - RNA, 15 nt, Homo sapiens
cuggauaacuguaaa

SEQ ID NO: 942848 - RNA, 19 nt, Homo sapiens
cuggcaagccugucuucag

SEQ ID NO: 942849 - RNA, 18 nt, Homo sapiens
cuggcacaggccgaggca

SEQ ID NO: 942850 - RNA, 21 nt, Homo sapiens
cuggcagagagcacagugauc

SEQ ID NO: 942851 - RNA, 22 nt, Homo sapiens
cuggcaggaagggacugccaaa

SEQ ID NO: 942852 - RNA, 17 nt, Homo sapiens
cuggcaggaugcugagc

SEQ ID NO: 942853 - RNA, 16 nt, Homo sapiens
cuggccagcacccucu

SEQ ID NO: 942854 - RNA, 14 nt, Homo sapiens
cuggcuugcuccua

SEQ ID NO: 942855 - RNA, 13 nt, Homo sapiens
cugggaaacuggg

SEQ ID NO: 942856 - RNA, 20 nt, Homo sapiens
ucacagcuaagaugccaugu

SEQ ID NO: 942857 - RNA, 14 nt, Homo sapiens
ucacauaaccuuaa

SEQ ID NO: 942858 - RNA, 20 nt, Homo sapiens
ucacauacaaaucauccauc

SEQ ID NO: 942859 - RNA, 21 nt, Homo sapiens
ucaccaaaagacacugcagaa

SEQ ID NO: 942860 - RNA, 17 nt, Homo sapiens
ucaccaaacacaagaaa

SEQ ID NO: 942861 - RNA, 18 nt, Homo sapiens
ucaccuccucugugauuu

SEQ ID NO: 942862 - RNA, 15 nt, Homo sapiens
ucacuaaagcaugaa

SEQ ID NO: 942863 - RNA, 14 nt, Homo sapiens
ucacucauugcuga

SEQ ID NO: 942864 - RNA, 23 nt, Homo sapiens
ucacuccuuuuuugcaugugcaa

SEQ ID NO: 942865 - RNA, 17 nt, Homo sapiens
ucacucugucagccagc

SEQ ID NO: 942866 - RNA, 14 nt, Homo sapiens
ucacugacaguuaa

SEQ ID NO: 942867 - RNA, 13 nt, Homo sapiens
ucacugcacucca

SEQ ID NO: 942868 - RNA, 17 nt, Homo sapiens
ucacugccccucucuca

SEQ ID NO: 942869 - RNA, 17 nt, Homo sapiens
ucacuggggcagacaau

SEQ ID NO: 942870 - RNA, 15 nt, Homo sapiens
ucagacccaacagca

SEQ ID NO: 942871 - RNA, 15 nt, Homo sapiens
ucagacguuccauac

SEQ ID NO: 942872 - RNA, 17 nt, Homo sapiens
ucagagcacucauuccu

SEQ ID NO: 942873 - RNA, 18 nt, Homo sapiens
ucagagcccucaacuauu

SEQ ID NO: 942874 - RNA, 22 nt, Homo sapiens
ucagaucccccuucucuccugc

SEQ ID NO: 942875 - RNA, 23 nt, Homo sapiens
ucagauuaccaguuauaggaaca

SEQ ID NO: 942876 - RNA, 18 nt, Homo sapiens
ucagauuuugguugcuaa

SEQ ID NO: 942877 - RNA, 21 nt, Homo sapiens
ucagcaaaaaucucccaguga

SEQ ID NO: 942878 - RNA, 23 nt, Homo sapiens
ucagcaggaguaauaaauuuacu

SEQ ID NO: 942879 - RNA, 18 nt, Homo sapiens
ucagccuagugaacugca

SEQ ID NO: 942880 - RNA, 14 nt, Homo sapiens
ucagccuuaggaag

SEQ ID NO: 942881 - RNA, 15 nt, Homo sapiens
ucaggacgccuggag

SEQ ID NO: 942882 - RNA, 23 nt, Homo sapiens
ucaggagaaccuaacaugcuggu

SEQ ID NO: 942883 - RNA, 16 nt, Homo sapiens
ucaggagauggagacc

SEQ ID NO: 942884 - RNA, 20 nt, Homo sapiens
ucaggcucagagggaccuca

SEQ ID NO: 942885 - RNA, 21 nt, Homo sapiens
ucaggguaccuggggccaaac

SEQ ID NO: 942886 - RNA, 15 nt, Homo sapiens
ucaguaguucacaua

SEQ ID NO: 942887 - RNA, 18 nt, Homo sapiens
ucaguaguucacauacaa

SEQ ID NO: 942888 - RNA, 14 nt, Homo sapiens
ucagucaacaacuu

SEQ ID NO: 942889 - RNA, 21 nt, Homo sapiens
ucagucaacaacuuacacuua

SEQ ID NO: 942890 - RNA, 22 nt, Homo sapiens
ucaguccauugcucuugagucu

SEQ ID NO: 942891 - RNA, 17 nt, Homo sapiens
ucagucgcuagcauuuc

SEQ ID NO: 942892 - RNA, 16 nt, Homo sapiens
ucagugauuacuguca

SEQ ID NO: 942893 - RNA, 17 nt, Homo sapiens
ucagugguggucuucaa

SEQ ID NO: 942894 - RNA, 20 nt, Homo sapiens
ucauagcaccuaacaacauu

SEQ ID NO: 942895 - RNA, 15 nt, Homo sapiens
ucauaguuacugugu

SEQ ID NO: 942896 - RNA, 22 nt, Homo sapiens
ucauaguuacuguguaaacuca

SEQ ID NO: 942897 - RNA, 15 nt, Homo sapiens
ucauauguaaucucu

SEQ ID NO: 942898 - RNA, 16 nt, Homo sapiens
ucauauuucaaaccac

SEQ ID NO: 942899 - RNA, 17 nt, Homo sapiens
ucaucaaaaacuuugga

SEQ ID NO: 942900 - RNA, 19 nt, Homo sapiens
ucaucaacuaccauucuau

SEQ ID NO: 942901 - RNA, 14 nt, Homo sapiens
ucaucaaguaauac

SEQ ID NO: 942902 - RNA, 15 nt, Homo sapiens
ucaucaggugcauag

SEQ ID NO: 942903 - RNA, 18 nt, Homo sapiens
ucaugccuguaaucccag

SEQ ID NO: 942904 - RNA, 17 nt, Homo sapiens
ucaugccuuaaucccag

SEQ ID NO: 942905 - RNA, 21 nt, Homo sapiens
ucauggcaucauugcauucca

SEQ ID NO: 942906 - RNA, 20 nt, Homo sapiens
ucaugucggucccugagauc

SEQ ID NO: 942907 - RNA, 18 nt, Homo sapiens
ucauucauucaaguaaua

SEQ ID NO: 942908 - RNA, 18 nt, Homo sapiens
ucauucuguuagauacua

SEQ ID NO: 942909 - RNA, 16 nt, Homo sapiens
ucauugagaaacuggg

SEQ ID NO: 942910 - RNA, 11 nt, Homo sapiens
ucauugcugag

SEQ ID NO: 942911 - RNA, 17 nt, Homo sapiens
ucauugcugagccucug

SEQ ID NO: 942912 - RNA, 20 nt, Homo sapiens
ucauuggccagcucauaaaa

SEQ ID NO: 942913 - RNA, 13 nt, Homo sapiens
uccaaaacauuuc

SEQ ID NO: 942914 - RNA, 21 nt, Homo sapiens
uccaaagagaagggcacugua

SEQ ID NO: 942915 - RNA, 19 nt, Homo sapiens
uccaaauggcuuugcagaa

SEQ ID NO: 942916 - RNA, 18 nt, Homo sapiens
uccaaggcacacuguuaa

SEQ ID NO: 942917 - RNA, 23 nt, Homo sapiens
uccaagucuaggaacucccucag

SEQ ID NO: 942918 - RNA, 17 nt, Homo sapiens
uccaagucuguaccuca

SEQ ID NO: 942919 - RNA, 17 nt, Homo sapiens
uccaauauuuucuuuaa

SEQ ID NO: 942920 - RNA, 23 nt, Homo sapiens
uccaauuuuaauauuaacuuuua

SEQ ID NO: 942921 - RNA, 17 nt, Homo sapiens
uccacucguguguuucu

SEQ ID NO: 942922 - RNA, 21 nt, Homo sapiens
uccagacuugaaauucucauc

SEQ ID NO: 942923 - RNA, 14 nt, Homo sapiens
uccagcuccuguaa

SEQ ID NO: 942924 - RNA, 16 nt, Homo sapiens
uccagggcauugcuca

SEQ ID NO: 942925 - RNA, 18 nt, Homo sapiens
uccagggcauugcucagc

SEQ ID NO: 942926 - RNA, 14 nt, Homo sapiens
uccaguauaaccag

SEQ ID NO: 942927 - RNA, 16 nt, Homo sapiens
uccaucugugccauac

SEQ ID NO: 942928 - RNA, 20 nt, Homo sapiens
uccaugcaccuaccuuagaa

SEQ ID NO: 942929 - RNA, 11 nt, Homo sapiens
uccaugucucg

SEQ ID NO: 942930 - RNA, 17 nt, Homo sapiens
uccauguuugcaccugu

SEQ ID NO: 942931 - RNA, 18 nt, Homo sapiens
ucccaagauaaaugguac

SEQ ID NO: 942932 - RNA, 23 nt, Homo sapiens
ucccacccccacccccagcucaa

SEQ ID NO: 942933 - RNA, 23 nt, Homo sapiens
ucccagacggucaggaaaacugu

SEQ ID NO: 942934 - RNA, 14 nt, Homo sapiens
ucccaggaagccca

SEQ ID NO: 942935 - RNA, 16 nt, Homo sapiens
ucccagugaugcugua

SEQ ID NO: 942936 - RNA, 15 nt, Homo sapiens
ucccaguuccuuuag

SEQ ID NO: 942937 - RNA, 20 nt, Homo sapiens
ucccauuuuugcuuagcuca

SEQ ID NO: 942938 - RNA, 22 nt, Homo sapiens
uccccagacaucuggacacugg

SEQ ID NO: 942939 - RNA, 16 nt, Homo sapiens
ucccccugcaaaaaga

SEQ ID NO: 942940 - RNA, 21 nt, Homo sapiens
uccccugaggaauaugucaua

SEQ ID NO: 942941 - RNA, 16 nt, Homo sapiens
uccccuucugggcaac

SEQ ID NO: 942942 - RNA, 21 nt, Homo sapiens
ucccuauacagagguccugcc

SEQ ID NO: 942943 - RNA, 20 nt, Homo sapiens
ucccucaggucccuugguca

SEQ ID NO: 942944 - RNA, 18 nt, Homo sapiens
ucccuggggcuccugcuu

SEQ ID NO: 942945 - RNA, 23 nt, Homo sapiens
gaaacuccagaugccacaaugga

SEQ ID NO: 942946 - RNA, 18 nt, Homo sapiens
gaaacugggaaacugggu

SEQ ID NO: 942947 - RNA, 19 nt, Homo sapiens
gaaaggauuuuaccaaagc

SEQ ID NO: 942948 - RNA, 18 nt, Homo sapiens
gaaagggaaacugggaaa

SEQ ID NO: 942949 - RNA, 23 nt, Homo sapiens
gaaagguuuuauucuauauugcu

SEQ ID NO: 942950 - RNA, 21 nt, Homo sapiens
gaaaguuuuguucuguauauu

SEQ ID NO: 942951 - RNA, 16 nt, Homo sapiens
gaaauaaaagcuuugc

SEQ ID NO: 942952 - RNA, 14 nt, Homo sapiens
gaaauaauagcaau

SEQ ID NO: 942953 - RNA, 19 nt, Homo sapiens
gaaauagucggugaagaaa

SEQ ID NO: 942954 - RNA, 20 nt, Homo sapiens
gaaauauauuauuuccuuua

SEQ ID NO: 942955 - RNA, 22 nt, Homo sapiens
gaaaucuaccaagcuugcaaga

SEQ ID NO: 942956 - RNA, 22 nt, Homo sapiens
gaaaugaaagggaaacugggaa

SEQ ID NO: 942957 - RNA, 11 nt, Homo sapiens
gaaaugagcuc

SEQ ID NO: 942958 - RNA, 14 nt, Homo sapiens
gaacaacuaccuga

SEQ ID NO: 942959 - RNA, 22 nt, Homo sapiens
gaacagucuggcgucuccagac

SEQ ID NO: 942960 - RNA, 14 nt, Homo sapiens
gaacaucacauucc

SEQ ID NO: 942961 - RNA, 20 nt, Homo sapiens
gaacccaacagucaugaccc

SEQ ID NO: 942962 - RNA, 22 nt, Homo sapiens
gaacccaagcuuagaacuuuaa

SEQ ID NO: 942963 - RNA, 15 nt, Homo sapiens
uuuucaagagcuccu

SEQ ID NO: 942964 - RNA, 21 nt, Homo sapiens
uuuucaaucauaauaccugcu

SEQ ID NO: 942965 - RNA, 12 nt, Homo sapiens
uuuucauuugag

SEQ ID NO: 942966 - RNA, 14 nt, Homo sapiens
uuuugauaauggcu

SEQ ID NO: 942967 - RNA, 15 nt, Homo sapiens
uuuugauaauggcuu

SEQ ID NO: 942968 - RNA, 22 nt, Homo sapiens
uuuugugucaaaaggacauuua

SEQ ID NO: 942969 - RNA, 17 nt, Homo sapiens
uuuuguucucaacuuca

SEQ ID NO: 942970 - RNA, 19 nt, Homo sapiens
uuuuguucucaacuucaaa

SEQ ID NO: 942971 - RNA, 22 nt, Homo sapiens
uuuuucaagagcuccuugaccc

SEQ ID NO: 942972 - RNA, 13 nt, Homo sapiens
uuuuucuccagcu

SEQ ID NO: 942973 - RNA, 12 nt, Homo sapiens
uuuuugugucaa

SEQ ID NO: 942974 - RNA, 13 nt, Homo sapiens
uuuuuguuauuaa

SEQ ID NO: 942975 - RNA, 14 nt, Homo sapiens
guacguggccaugu

SEQ ID NO: 942976 - RNA, 23 nt, Homo sapiens
guagaaguuuggcugcugucaua

SEQ ID NO: 942977 - RNA, 13 nt, Homo sapiens
guagaauugcugu

SEQ ID NO: 942978 - RNA, 18 nt, Homo sapiens
guagagcucuacugccuc

SEQ ID NO: 942979 - RNA, 21 nt, Homo sapiens
guagcagagaaaggauugauu

SEQ ID NO: 942980 - RNA, 22 nt, Homo sapiens
guagcugugucauguauauacc

SEQ ID NO: 942981 - RNA, 15 nt, Homo sapiens
guauaaucuuuucau

SEQ ID NO: 942982 - RNA, 23 nt, Homo sapiens
guauauuugugauagcacuuucu

SEQ ID NO: 942983 - RNA, 22 nt, Homo sapiens
guaugucuacacguaaguauaa

SEQ ID NO: 942984 - RNA, 16 nt, Homo sapiens
guauucuuguuagaau

SEQ ID NO: 942985 - RNA, 17 nt, Homo sapiens
guauuucaagucucuca

SEQ ID NO: 942986 - RNA, 23 nt, Homo sapiens
guauuuucuuacacugugucauu

SEQ ID NO: 942987 - RNA, 16 nt, Homo sapiens
gucaaaacuacugaca

SEQ ID NO: 942988 - RNA, 12 nt, Homo sapiens
gucaacaucaaa

SEQ ID NO: 942989 - RNA, 15 nt, Homo sapiens
gucaacaucaaagag

SEQ ID NO: 942990 - RNA, 17 nt, Homo sapiens
gucaagaauagcauugu

SEQ ID NO: 942991 - RNA, 17 nt, Homo sapiens
gucaccaaaagacacug

SEQ ID NO: 942992 - RNA, 22 nt, Homo sapiens
gucacgcuuucaugaauucugu

SEQ ID NO: 942993 - RNA, 17 nt, Homo sapiens
gucagaaggagcuacaa

SEQ ID NO: 942994 - RNA, 14 nt, Homo sapiens
gucaggacucagaa

SEQ ID NO: 942995 - RNA, 23 nt, Homo sapiens
gucaggcgcaguggcucaugccu

SEQ ID NO: 942996 - RNA, 13 nt, Homo sapiens
gucauaacaucca

SEQ ID NO: 942997 - RNA, 13 nt, Homo sapiens
gucauggaugucc

SEQ ID NO: 942998 - RNA, 13 nt, Homo sapiens
gucauucauucaa

SEQ ID NO: 942999 - RNA, 14 nt, Homo sapiens
gucauucauucaag

SEQ ID NO: 943000 - RNA, 19 nt, Homo sapiens
gucauugcacaaggcagaa

SEQ ID NO: 943001 - RNA, 19 nt, Homo sapiens
gucauuggccgacaucaca

SEQ ID NO: 943002 - RNA, 14 nt, Homo sapiens
gucauuucaaagac

SEQ ID NO: 943003 - RNA, 19 nt, Homo sapiens
gucccagauacuugggagg

SEQ ID NO: 943004 - RNA, 14 nt, Homo sapiens
guccccuaccccca

SEQ ID NO: 943005 - RNA, 13 nt, Homo sapiens
guccuaaggccca

SEQ ID NO: 943006 - RNA, 12 nt, Homo sapiens
guccuggucaag

SEQ ID NO: 943007 - RNA, 19 nt, Homo sapiens
gucuaagguucagccugaa

SEQ ID NO: 943008 - RNA, 19 nt, Homo sapiens
gucuaauagucuuugccag

SEQ ID NO: 943009 - RNA, 19 nt, Homo sapiens
gucucuuggcuuugucacu

SEQ ID NO: 943010 - RNA, 20 nt, Homo sapiens
gucuggcgucuccagacucu

SEQ ID NO: 943011 - RNA, 14 nt, Homo sapiens
gucugucaccagcu

SEQ ID NO: 943012 - RNA, 22 nt, Homo sapiens
gucuuuuuuucccuaccauuca

SEQ ID NO: 943013 - RNA, 15 nt, Homo sapiens
gugaacugcaaccuc

SEQ ID NO: 943014 - RNA, 17 nt, Homo sapiens
gugaagccaaagggacu

SEQ ID NO: 943015 - RNA, 18 nt, Homo sapiens
gugaauugaauggugcau

SEQ ID NO: 943016 - RNA, 19 nt, Homo sapiens
gugaccuggaaucagugaa

SEQ ID NO: 943017 - RNA, 13 nt, Homo sapiens
gugagcucuggga

SEQ ID NO: 943018 - RNA, 23 nt, Homo sapiens
gugauauacugguucacauccua

SEQ ID NO: 943019 - RNA, 16 nt, Homo sapiens
gugaucccguuuuccc

SEQ ID NO: 943020 - RNA, 15 nt, Homo sapiens
gugaugcuguacaca

SEQ ID NO: 943021 - RNA, 12 nt, Homo sapiens
gugcaaagggaa

SEQ ID NO: 943022 - RNA, 13 nt, Homo sapiens
gugcaaagggaac

SEQ ID NO: 943023 - RNA, 17 nt, Homo sapiens
gugcagaagaauccgag

SEQ ID NO: 943024 - RNA, 21 nt, Homo sapiens
gugcagaauuggggcacuuaa

SEQ ID NO: 943025 - RNA, 14 nt, Homo sapiens
gugcagaucuuuga

SEQ ID NO: 943026 - RNA, 13 nt, Homo sapiens
gugcagucuuuga

SEQ ID NO: 943027 - RNA, 19 nt, Homo sapiens
gugcccuagaugcacgugg

SEQ ID NO: 943028 - RNA, 17 nt, Homo sapiens
gugccuugcucauuuga

SEQ ID NO: 943029 - RNA, 15 nt, Homo sapiens
gugcuggggcacggc

SEQ ID NO: 943030 - RNA, 13 nt, Homo sapiens
guggacucagugg

SEQ ID NO: 943031 - RNA, 14 nt, Homo sapiens
guggacugugcugg

SEQ ID NO: 943032 - RNA, 22 nt, Homo sapiens
guggcgagaaauaaaguuugcu

SEQ ID NO: 943033 - RNA, 21 nt, Homo sapiens
gugggcccccaaugacaccca

SEQ ID NO: 943034 - RNA, 23 nt, Homo sapiens
guggucacaacuugauggcugcg

SEQ ID NO: 943035 - RNA, 22 nt, Homo sapiens
guggucuaagguucagccugaa

SEQ ID NO: 943036 - RNA, 14 nt, Homo sapiens
guggugacaccucc

SEQ ID NO: 943037 - RNA, 14 nt, Homo sapiens
gugguggucuucaa

SEQ ID NO: 943038 - RNA, 20 nt, Homo sapiens
guguaaacaaaaugaagcug

SEQ ID NO: 943039 - RNA, 14 nt, Homo sapiens
guguaaacaggauu

SEQ ID NO: 943040 - RNA, 13 nt, Homo sapiens
guguauccaugca

SEQ ID NO: 943041 - RNA, 22 nt, Homo sapiens
guguauccaugcaccuaccuua

SEQ ID NO: 943042 - RNA, 18 nt, Homo sapiens
gugucauuggaagccauc

SEQ ID NO: 943043 - RNA, 15 nt, Homo sapiens
gugucuuaauuauua

SEQ ID NO: 943044 - RNA, 18 nt, Homo sapiens
gugucuuucacagcuccu

SEQ ID NO: 943045 - RNA, 21 nt, Homo sapiens
gugugaacucaccaaacacaa

SEQ ID NO: 943046 - RNA, 15 nt, Homo sapiens
gugugugacaauucu

SEQ ID NO: 943047 - RNA, 19 nt, Homo sapiens
guguguuugugugcaugaa

SEQ ID NO: 943048 - RNA, 14 nt, Homo sapiens
guuaaauauuguca

SEQ ID NO: 943049 - RNA, 20 nt, Homo sapiens
guuaauaaaccuuugcaaac

SEQ ID NO: 943050 - RNA, 19 nt, Homo sapiens
guuaauaagugguaucuga

SEQ ID NO: 943051 - RNA, 19 nt, Homo sapiens
guuacaaaaauaaacuaua

SEQ ID NO: 943052 - RNA, 10 nt, Homo sapiens
guuacauuuc

SEQ ID NO: 943053 - RNA, 14 nt, Homo sapiens
guuaccucugcaug

SEQ ID NO: 943054 - RNA, 17 nt, Homo sapiens
guuacuguguaaacuca

SEQ ID NO: 943055 - RNA, 23 nt, Homo sapiens
guuacuguguaaacucaucugaa

SEQ ID NO: 943056 - RNA, 23 nt, Homo sapiens
guuagcugaaccgacacucaaaa

SEQ ID NO: 943057 - RNA, 22 nt, Homo sapiens
guucagaaagcaauaacuuugu

SEQ ID NO: 943058 - RNA, 17 nt, Homo sapiens
guucauauuaugaugcc

SEQ ID NO: 943059 - RNA, 21 nt, Homo sapiens
guuccauacccccacaugcca

SEQ ID NO: 943060 - RNA, 15 nt, Homo sapiens
guuccccuucaguac

SEQ ID NO: 943061 - RNA, 19 nt, Homo sapiens
guucgauguuagcguuuac

SEQ ID NO: 943062 - RNA, 18 nt, Homo sapiens
guucgauuucuaccucag

SEQ ID NO: 943063 - RNA, 21 nt, Homo sapiens
guucuaccucaggcagcucaa

SEQ ID NO: 943064 - RNA, 13 nt, Homo sapiens
guucucuauacuc

SEQ ID NO: 943065 - RNA, 21 nt, Homo sapiens
guucuggauaccauuauaugu

SEQ ID NO: 943066 - RNA, 21 nt, Homo sapiens
guuguaccaaaauucaucugu

SEQ ID NO: 943067 - RNA, 21 nt, Homo sapiens
guuguauucauuguggucaua

SEQ ID NO: 943068 - RNA, 14 nt, Homo sapiens
guugucaccaagcu

SEQ ID NO: 943069 - RNA, 19 nt, Homo sapiens
guuguucgccgcguggaau

SEQ ID NO: 943070 - RNA, 20 nt, Homo sapiens
guuuagugaaaaacugcugu

SEQ ID NO: 943071 - RNA, 18 nt, Homo sapiens
guuucagcagagcugaaa

SEQ ID NO: 943072 - RNA, 12 nt, Homo sapiens
guuuccugguca

SEQ ID NO: 943073 - RNA, 15 nt, Homo sapiens
guuugacucaucuua

SEQ ID NO: 943074 - RNA, 15 nt, Homo sapiens
guuugauucagcaaa

SEQ ID NO: 943075 - RNA, 21 nt, Homo sapiens
guuuggacccaguucagugag

SEQ ID NO: 943076 - RNA, 19 nt, Homo sapiens
guuuggagguccuagguca

SEQ ID NO: 943077 - RNA, 16 nt, Homo sapiens
guuuguuaccuaccuu

SEQ ID NO: 943078 - RNA, 22 nt, Homo sapiens
guuuuaaaagagaagcaucauu

SEQ ID NO: 943079 - RNA, 16 nt, Homo sapiens
guuuuagaaccagccg

SEQ ID NO: 943080 - RNA, 15 nt, Homo sapiens
guuuugcuacauucu

SEQ ID NO: 943081 - RNA, 18 nt, Homo sapiens
guuuuuuuacaacauuca

SEQ ID NO: 943082 - RNA, 16 nt, Homo sapiens
uaaaaaaauuacugug

SEQ ID NO: 943083 - RNA, 18 nt, Homo sapiens
ucauggauaaauugcaca

SEQ ID NO: 943084 - RNA, 20 nt, Homo sapiens
ucauggcaucauugcauucc

SEQ ID NO: 943085 - RNA, 14 nt, Homo sapiens
ucauguauauaccu

SEQ ID NO: 943086 - RNA, 19 nt, Homo sapiens
ucaugugcugccugcaagc

SEQ ID NO: 943087 - RNA, 12 nt, Homo sapiens
ucauuaccaaua

SEQ ID NO: 943088 - RNA, 15 nt, Homo sapiens
ucauuacuacccucc

SEQ ID NO: 943089 - RNA, 15 nt, Homo sapiens
ucauucagcuaacaa

SEQ ID NO: 943090 - RNA, 14 nt, Homo sapiens
ucauugcacuuuga

SEQ ID NO: 943091 - RNA, 16 nt, Homo sapiens
ucauuguaugugguca

SEQ ID NO: 943092 - RNA, 23 nt, Homo sapiens
uccaacaugaaaacaauucuuau

SEQ ID NO: 943093 - RNA, 18 nt, Homo sapiens
uccaacccgccggucuca

SEQ ID NO: 943094 - RNA, 18 nt, Homo sapiens
uccaagucuguaccucaa

SEQ ID NO: 943095 - RNA, 17 nt, Homo sapiens
uccaaugugcuuucuaa

SEQ ID NO: 943096 - RNA, 12 nt, Homo sapiens
uccacagaggac

SEQ ID NO: 943097 - RNA, 18 nt, Homo sapiens
uccacauauuucagugag

SEQ ID NO: 943098 - RNA, 12 nt, Homo sapiens
uccagacucuca

SEQ ID NO: 943099 - RNA, 20 nt, Homo sapiens
uccagacuuccuugagacac

SEQ ID NO: 943100 - RNA, 20 nt, Homo sapiens
uccagcaaaaugucuccuga

SEQ ID NO: 943101 - RNA, 20 nt, Homo sapiens
uccagccugggcaacagagc

SEQ ID NO: 943102 - RNA, 20 nt, Homo sapiens
uccagcuugggcaacagagc

SEQ ID NO: 943103 - RNA, 14 nt, Homo sapiens
uccagucauugcac

SEQ ID NO: 943104 - RNA, 23 nt, Homo sapiens
uccaguuuuauaaaaaguggaga

SEQ ID NO: 943105 - RNA, 15 nt, Homo sapiens
uccaucugugccaua

SEQ ID NO: 943106 - RNA, 18 nt, Homo sapiens
uccaucugugccauacuu

SEQ ID NO: 943107 - RNA, 16 nt, Homo sapiens
uccaugggcuggcaug

SEQ ID NO: 943108 - RNA, 21 nt, Homo sapiens
uccaugggcuggcauggugag

SEQ ID NO: 943109 - RNA, 16 nt, Homo sapiens
uccauuaaguacaugu

SEQ ID NO: 943110 - RNA, 23 nt, Homo sapiens
ucccaacuccucaugucuucuca

SEQ ID NO: 943111 - RNA, 18 nt, Homo sapiens
ucccagacggucaggaaa

SEQ ID NO: 943112 - RNA, 16 nt, Homo sapiens
ucccaucgcugucaca

SEQ ID NO: 943113 - RNA, 16 nt, Homo sapiens
ucccaugaccccaaag

SEQ ID NO: 943114 - RNA, 12 nt, Homo sapiens
ucccauugccau

SEQ ID NO: 943115 - RNA, 13 nt, Homo sapiens
ucccauugccaug

SEQ ID NO: 943116 - RNA, 20 nt, Homo sapiens
uccccacuuacagaucuauc

SEQ ID NO: 943117 - RNA, 20 nt, Homo sapiens
uccccauucgguguggugca

SEQ ID NO: 943118 - RNA, 14 nt, Homo sapiens
ucccccucuuugca

SEQ ID NO: 943119 - RNA, 19 nt, Homo sapiens
ucccccuuucacacuggau

SEQ ID NO: 943120 - RNA, 20 nt, Homo sapiens
uccccguuccaccccaagag

SEQ ID NO: 943121 - RNA, 21 nt, Homo sapiens
uccccuacccccaguaaaauc

SEQ ID NO: 943122 - RNA, 22 nt, Homo sapiens
uccccucagggauacgacacau

SEQ ID NO: 943123 - RNA, 20 nt, Homo sapiens
ucccucucccggcaacaucu

SEQ ID NO: 943124 - RNA, 16 nt, Homo sapiens
ucccucuuucuuccca

SEQ ID NO: 943125 - RNA, 12 nt, Homo sapiens
ucccugacagca

SEQ ID NO: 943126 - RNA, 16 nt, Homo sapiens
ucccugacuguaaaug

SEQ ID NO: 943127 - RNA, 22 nt, Homo sapiens
ucccuugccuauuugcugacca

SEQ ID NO: 943128 - RNA, 21 nt, Homo sapiens
ucccuugggaagggcagggaa

SEQ ID NO: 943129 - RNA, 17 nt, Homo sapiens
uccggaggcugaggcag

SEQ ID NO: 943130 - RNA, 19 nt, Homo sapiens
uccuaaggaauuaccaaga

SEQ ID NO: 943131 - RNA, 19 nt, Homo sapiens
uccuacagcuaacccucac

SEQ ID NO: 943132 - RNA, 13 nt, Homo sapiens
uccuauccauucu

SEQ ID NO: 943133 - RNA, 14 nt, Homo sapiens
uccuauuuaucaua

SEQ ID NO: 943134 - RNA, 13 nt, Homo sapiens
uccucacagugaa

SEQ ID NO: 943135 - RNA, 23 nt, Homo sapiens
uccuccagggaacccaacaguca

SEQ ID NO: 943136 - RNA, 17 nt, Homo sapiens
uccucccccaguuccuc

SEQ ID NO: 943137 - RNA, 19 nt, Homo sapiens
uccucuagcugugggggug

SEQ ID NO: 943138 - RNA, 10 nt, Homo sapiens
uccucugcau

SEQ ID NO: 943139 - RNA, 15 nt, Homo sapiens
uccucugcauuuaca

SEQ ID NO: 943140 - RNA, 17 nt, Homo sapiens
uccucugcauuuacaca

SEQ ID NO: 943141 - RNA, 13 nt, Homo sapiens
uccugggagacaa

SEQ ID NO: 943142 - RNA, 13 nt, Homo sapiens
uccuguguggaag

SEQ ID NO: 943143 - RNA, 19 nt, Homo sapiens
uccuguguggaagaaggaa

SEQ ID NO: 943144 - RNA, 17 nt, Homo sapiens
uccuguucacaccagag

SEQ ID NO: 943145 - RNA, 17 nt, Homo sapiens
uccuuaggccucugaga

SEQ ID NO: 943146 - RNA, 15 nt, Homo sapiens
uccuugggacucagg

SEQ ID NO: 943147 - RNA, 18 nt, Homo sapiens
uccuuucacccgcuccua

SEQ ID NO: 943148 - RNA, 22 nt, Homo sapiens
uccuuucccuacuccaugggcu

SEQ ID NO: 943149 - RNA, 17 nt, Homo sapiens
uccuuuuuugcaugugc

SEQ ID NO: 943150 - RNA, 21 nt, Homo sapiens
uccuuuuuuguuuucaacagu

SEQ ID NO: 943151 - RNA, 18 nt, Homo sapiens
ucgaaaccugggauucag

SEQ ID NO: 943152 - RNA, 16 nt, Homo sapiens
ucgaguaaacuugaaa

SEQ ID NO: 943153 - RNA, 16 nt, Homo sapiens
ucgauuucuaccucag

SEQ ID NO: 943154 - RNA, 20 nt, Homo sapiens
ucgcaucuugugucgcugaa

SEQ ID NO: 943155 - RNA, 12 nt, Homo sapiens
ucggaaugucau

SEQ ID NO: 943156 - RNA, 22 nt, Homo sapiens
ucggaggccauccugccagggg

SEQ ID NO: 943157 - RNA, 14 nt, Homo sapiens
ucggccccagcaca

SEQ ID NO: 943158 - RNA, 20 nt, Homo sapiens
ucggcuccccauguguccug

SEQ ID NO: 943159 - RNA, 19 nt, Homo sapiens
ucgucaagagcaugcacau

SEQ ID NO: 943160 - RNA, 18 nt, Homo sapiens
ucgucaucaggugcauag

SEQ ID NO: 943161 - RNA, 13 nt, Homo sapiens
ucguccugccugg

SEQ ID NO: 943162 - RNA, 14 nt, Homo sapiens
ucguuaaaaacaga

SEQ ID NO: 943163 - RNA, 23 nt, Homo sapiens
ucuaaaggaaagaugauggugac

SEQ ID NO: 943164 - RNA, 15 nt, Homo sapiens
ucuaaugcauguauu

SEQ ID NO: 943165 - RNA, 20 nt, Homo sapiens
ucuaccucaggcagcucaag

SEQ ID NO: 943166 - RNA, 17 nt, Homo sapiens
ucuaguucauugaauca

SEQ ID NO: 943167 - RNA, 14 nt, Homo sapiens
ucuauuuuaaucuu

SEQ ID NO: 943168 - RNA, 18 nt, Homo sapiens
ucuauuuuaaucuugcua

SEQ ID NO: 943169 - RNA, 22 nt, Homo sapiens
ucucaacuucucagacguucca

SEQ ID NO: 943170 - RNA, 15 nt, Homo sapiens
ucucaaggcaguuaa

SEQ ID NO: 943171 - RNA, 16 nt, Homo sapiens
ucucaaggcaguuaau

SEQ ID NO: 943172 - RNA, 21 nt, Homo sapiens
ucucaccugccgugcguacug

SEQ ID NO: 943173 - RNA, 21 nt, Homo sapiens
ucucagagcccucaacuauuc

SEQ ID NO: 943174 - RNA, 18 nt, Homo sapiens
ucucagcgagguguaaag

SEQ ID NO: 943175 - RNA, 21 nt, Homo sapiens
ucucaggaaaacagcuaguag

SEQ ID NO: 943176 - RNA, 14 nt, Homo sapiens
ucucaucacuacag

SEQ ID NO: 943177 - RNA, 14 nt, Homo sapiens
ucuccuuacugugu

SEQ ID NO: 943178 - RNA, 16 nt, Homo sapiens
ucucgggugcauuuga

SEQ ID NO: 943179 - RNA, 15 nt, Homo sapiens
ucucucucugccaug

SEQ ID NO: 943180 - RNA, 18 nt, Homo sapiens
ucucucugccauggccuu

SEQ ID NO: 943181 - RNA, 9 nt, Homo sapiens
ucucucuuu

SEQ ID NO: 943182 - RNA, 22 nt, Homo sapiens
ucucugccauggccuuggcagg

SEQ ID NO: 943183 - RNA, 15 nt, Homo sapiens
ucugagacauuccac

SEQ ID NO: 943184 - RNA, 15 nt, Homo sapiens
ucugcaacaaaaagu

SEQ ID NO: 943185 - RNA, 15 nt, Homo sapiens
ucugccucauggcaa

SEQ ID NO: 943186 - RNA, 18 nt, Homo sapiens
ucuggaaucuggagacca

SEQ ID NO: 943187 - RNA, 12 nt, Homo sapiens
ucuggacacugg

SEQ ID NO: 943188 - RNA, 20 nt, Homo sapiens
ucuggaggacggucagucca

SEQ ID NO: 943189 - RNA, 21 nt, Homo sapiens
ucuggauggccaaacccaaga

SEQ ID NO: 943190 - RNA, 19 nt, Homo sapiens
ucuggcucuugaggcauuu

SEQ ID NO: 943191 - RNA, 22 nt, Homo sapiens
ucugguuuuaggaaacuuguag

SEQ ID NO: 943192 - RNA, 18 nt, Homo sapiens
agauuuggaugcacucau

SEQ ID NO: 943193 - RNA, 22 nt, Homo sapiens
agauuuuuuccucugcauuuac

SEQ ID NO: 943194 - RNA, 21 nt, Homo sapiens
agauuuuuuuuguaacuucaa

SEQ ID NO: 943195 - RNA, 21 nt, Homo sapiens
agcaaauggccucaugucaaa

SEQ ID NO: 943196 - RNA, 15 nt, Homo sapiens
agcaacaagaccacc

SEQ ID NO: 943197 - RNA, 12 nt, Homo sapiens
agcaacaaugac

SEQ ID NO: 943198 - RNA, 20 nt, Homo sapiens
agcaacauucauagucuuug

SEQ ID NO: 943199 - RNA, 22 nt, Homo sapiens
agcaauaauccaguaaucuaaa

SEQ ID NO: 943200 - RNA, 16 nt, Homo sapiens
agcaauacuguuucca

SEQ ID NO: 943201 - RNA, 21 nt, Homo sapiens
agcacagaggacuuauucaac

SEQ ID NO: 943202 - RNA, 17 nt, Homo sapiens
agcacugggugaccagc

SEQ ID NO: 943203 - RNA, 14 nt, Homo sapiens
agcaggcacgggug

SEQ ID NO: 943204 - RNA, 15 nt, Homo sapiens
agcaggucaggacuc

SEQ ID NO: 943205 - RNA, 12 nt, Homo sapiens
agcauacuuugu

SEQ ID NO: 943206 - RNA, 18 nt, Homo sapiens
agcauauguguuacuuca

SEQ ID NO: 943207 - RNA, 13 nt, Homo sapiens
agcaucaauacaa

SEQ ID NO: 943208 - RNA, 19 nt, Homo sapiens
agcaucaauacaaccagcc

SEQ ID NO: 943209 - RNA, 14 nt, Homo sapiens
agcaugaggcaaaa

SEQ ID NO: 943210 - RNA, 12 nt, Homo sapiens
agcaugcacaug

SEQ ID NO: 943211 - RNA, 13 nt, Homo sapiens
agcaugcuacagu

SEQ ID NO: 943212 - RNA, 21 nt, Homo sapiens
agcauggagagccccugcuaa

SEQ ID NO: 943213 - RNA, 17 nt, Homo sapiens
agcauuaauaaaacugu

SEQ ID NO: 943214 - RNA, 13 nt, Homo sapiens
agccaaagagccu

SEQ ID NO: 943215 - RNA, 12 nt, Homo sapiens
agccaaagggac

SEQ ID NO: 943216 - RNA, 22 nt, Homo sapiens
agccaaagggacuggcagucug

SEQ ID NO: 943217 - RNA, 21 nt, Homo sapiens
agccaagaucgccccacugca

SEQ ID NO: 943218 - RNA, 12 nt, Homo sapiens
agccaagcccug

SEQ ID NO: 943219 - RNA, 23 nt, Homo sapiens
agccacuggcugcuaacaaguca

SEQ ID NO: 943220 - RNA, 18 nt, Homo sapiens
agccaggaggccugcuag

SEQ ID NO: 943221 - RNA, 11 nt, Homo sapiens
agccauccagg

SEQ ID NO: 943222 - RNA, 23 nt, Homo sapiens
agccaucccuuuuuuuacauuuc

SEQ ID NO: 943223 - RNA, 15 nt, Homo sapiens
agcccagauggaaag

SEQ ID NO: 943224 - RNA, 15 nt, Homo sapiens
agcccaggagccuca

SEQ ID NO: 943225 - RNA, 21 nt, Homo sapiens
agcccaggagccucacugggg

SEQ ID NO: 943226 - RNA, 16 nt, Homo sapiens
agcccuccucugucaa

SEQ ID NO: 943227 - RNA, 22 nt, Homo sapiens
agcccugggugcaggacacugg

SEQ ID NO: 943228 - RNA, 12 nt, Homo sapiens
agccgaggucau

SEQ ID NO: 943229 - RNA, 22 nt, Homo sapiens
agccuagugaacugcaaccuca

SEQ ID NO: 943230 - RNA, 18 nt, Homo sapiens
aguggcauuuccugguca

SEQ ID NO: 943231 - RNA, 19 nt, Homo sapiens
aguggcauuuccuggucag

SEQ ID NO: 943232 - RNA, 19 nt, Homo sapiens
aguggcccauggcauuuua

SEQ ID NO: 943233 - RNA, 13 nt, Homo sapiens
agugguaucugac

SEQ ID NO: 943234 - RNA, 13 nt, Homo sapiens
agugguggagcug

SEQ ID NO: 943235 - RNA, 18 nt, Homo sapiens
aguguucacaacagugaa

SEQ ID NO: 943236 - RNA, 16 nt, Homo sapiens
aguguuuuugugaauu

SEQ ID NO: 943237 - RNA, 18 nt, Homo sapiens
aguuacuguguaaacuca

SEQ ID NO: 943238 - RNA, 19 nt, Homo sapiens
aguuacuguguaaacucau

SEQ ID NO: 943239 - RNA, 17 nt, Homo sapiens
aguuagaacuagccaaa

SEQ ID NO: 943240 - RNA, 19 nt, Homo sapiens
aguuccagaaaaccucucc

SEQ ID NO: 943241 - RNA, 20 nt, Homo sapiens
aguucccuuuuuauuugcag

SEQ ID NO: 943242 - RNA, 15 nt, Homo sapiens
aguuccucccaggaa

SEQ ID NO: 943243 - RNA, 17 nt, Homo sapiens
aguuccucccccaguuc

SEQ ID NO: 943244 - RNA, 16 nt, Homo sapiens
aguucuuguucuucag

SEQ ID NO: 943245 - RNA, 20 nt, Homo sapiens
aguugcagauguuagauauu

SEQ ID NO: 943246 - RNA, 17 nt, Homo sapiens
aguuguaauagugccaa

SEQ ID NO: 943247 - RNA, 17 nt, Homo sapiens
aguugucuuuccuggca

SEQ ID NO: 943248 - RNA, 19 nt, Homo sapiens
aguuucccauaacaaccug

SEQ ID NO: 943249 - RNA, 15 nt, Homo sapiens
aguuuccugccagau

SEQ ID NO: 943250 - RNA, 16 nt, Homo sapiens
aguuuccugccagaua

SEQ ID NO: 943251 - RNA, 13 nt, Homo sapiens
aguuuucaaguca

SEQ ID NO: 943252 - RNA, 19 nt, Homo sapiens
auaaaaagauaaucucagu

SEQ ID NO: 943253 - RNA, 18 nt, Homo sapiens
auaaaaauugacaaugau

SEQ ID NO: 943254 - RNA, 17 nt, Homo sapiens
auaaaauccugugcaau

SEQ ID NO: 943255 - RNA, 17 nt, Homo sapiens
auaaaauggaagcaauu

SEQ ID NO: 943256 - RNA, 20 nt, Homo sapiens
auaaacaguggcucauaaaa

SEQ ID NO: 943257 - RNA, 16 nt, Homo sapiens
auaaacugauuuaucu

SEQ ID NO: 943258 - RNA, 19 nt, Homo sapiens
auaaauacauuuuugucag

SEQ ID NO: 943259 - RNA, 24 nt, Homo sapiens
auaaauuuuuuugcaauccuuucc

SEQ ID NO: 943260 - RNA, 19 nt, Homo sapiens
auaagauauuuaguaauau

SEQ ID NO: 943261 - RNA, 18 nt, Homo sapiens
auaauaucaaaacaagua

SEQ ID NO: 943262 - RNA, 14 nt, Homo sapiens
auaaugcaaucaaa

SEQ ID NO: 943263 - RNA, 18 nt, Homo sapiens
auaauuggcuugaugucc

SEQ ID NO: 943264 - RNA, 23 nt, Homo sapiens
auacaaaucauccauccuugcca

SEQ ID NO: 943265 - RNA, 18 nt, Homo sapiens
auacaacagaaaccagaa

SEQ ID NO: 943266 - RNA, 12 nt, Homo sapiens
auacaaccagcc

SEQ ID NO: 943267 - RNA, 21 nt, Homo sapiens
auacaagugauaauacagauu

SEQ ID NO: 943268 - RNA, 19 nt, Homo sapiens
auacagagguaacuaucaa

SEQ ID NO: 943269 - RNA, 17 nt, Homo sapiens
auacagagguccugcca

SEQ ID NO: 943270 - RNA, 15 nt, Homo sapiens
auacauagugaaaau

SEQ ID NO: 943271 - RNA, 17 nt, Homo sapiens
auacauaucuuuauuaa

SEQ ID NO: 943272 - RNA, 22 nt, Homo sapiens
auacauuguacuuauacaccuu

SEQ ID NO: 943273 - RNA, 21 nt, Homo sapiens
auaccaacuguacaaaauaac

SEQ ID NO: 943274 - RNA, 16 nt, Homo sapiens
auaccacuuaccucaa

SEQ ID NO: 943275 - RNA, 11 nt, Homo sapiens
auacuaccucu

SEQ ID NO: 943276 - RNA, 15 nt, Homo sapiens
auacuuaaugcauau

SEQ ID NO: 943277 - RNA, 20 nt, Homo sapiens
auacuuggaugcagcucuug

SEQ ID NO: 943278 - RNA, 18 nt, Homo sapiens
auagacacauacauguca

SEQ ID NO: 943279 - RNA, 18 nt, Homo sapiens
auagacacugaucuggcu

SEQ ID NO: 943280 - RNA, 15 nt, Homo sapiens
auagcaagugaaagc

SEQ ID NO: 943281 - RNA, 11 nt, Homo sapiens
auagcacuuuc

SEQ ID NO: 943282 - RNA, 18 nt, Homo sapiens
auagccuggguuaaguau

SEQ ID NO: 943283 - RNA, 13 nt, Homo sapiens
auaggaucacuug

SEQ ID NO: 943284 - RNA, 19 nt, Homo sapiens
auaggaucacuugggccca

SEQ ID NO: 943285 - RNA, 23 nt, Homo sapiens
auagucuugaaaugaaagggaaa

SEQ ID NO: 943286 - RNA, 18 nt, Homo sapiens
auagucuuugccagucau

SEQ ID NO: 943287 - RNA, 17 nt, Homo sapiens
auaguuuuuuacuucuc

SEQ ID NO: 943288 - RNA, 14 nt, Homo sapiens
auauaacuaucucu

SEQ ID NO: 943289 - RNA, 19 nt, Homo sapiens
auauaauucccaagcuuuu

SEQ ID NO: 943290 - RNA, 17 nt, Homo sapiens
auauacaaaacuuuauc

SEQ ID NO: 943291 - RNA, 16 nt, Homo sapiens
auauacaagugauaau

SEQ ID NO: 943292 - RNA, 19 nt, Homo sapiens
auauacagcaggugcucaa

SEQ ID NO: 943293 - RNA, 18 nt, Homo sapiens
auauccaggcaccaggac

SEQ ID NO: 943294 - RNA, 16 nt, Homo sapiens
auauccccacuacuca

SEQ ID NO: 943295 - RNA, 15 nt, Homo sapiens
auauccuuucacucu

SEQ ID NO: 943296 - RNA, 17 nt, Homo sapiens
auauccuuucacucugc

SEQ ID NO: 943297 - RNA, 20 nt, Homo sapiens
auaucuuuaugggcucuguu

SEQ ID NO: 943298 - RNA, 16 nt, Homo sapiens
auaucuuuauuaauca

SEQ ID NO: 943299 - RNA, 18 nt, Homo sapiens
auaugcuuguaacuaaaa

SEQ ID NO: 943300 - RNA, 19 nt, Homo sapiens
auauguggaagcaaccaag

SEQ ID NO: 943301 - RNA, 18 nt, Homo sapiens
auauguguaaagauuuau

SEQ ID NO: 943302 - RNA, 18 nt, Homo sapiens
auauuauuguaaccaaua

SEQ ID NO: 943303 - RNA, 17 nt, Homo sapiens
auauuggggccaugagu

SEQ ID NO: 943304 - RNA, 19 nt, Homo sapiens
auauuguguugacuuuaua

SEQ ID NO: 943305 - RNA, 18 nt, Homo sapiens
aucaaaauauuucaguga

SEQ ID NO: 943306 - RNA, 16 nt, Homo sapiens
aucaaagaacugaaag

SEQ ID NO: 943307 - RNA, 18 nt, Homo sapiens
aucaacagaucaacaaua

SEQ ID NO: 943308 - RNA, 23 nt, Homo sapiens
aucaagcauuuaccaugugcuaa

SEQ ID NO: 943309 - RNA, 18 nt, Homo sapiens
aucacacuacacaucaca

SEQ ID NO: 943310 - RNA, 17 nt, Homo sapiens
aucacucuaauucggau

SEQ ID NO: 943311 - RNA, 15 nt, Homo sapiens
aucagagacuaugua

SEQ ID NO: 943312 - RNA, 24 nt, Homo sapiens
aucagagagcugcccuucagcgau

SEQ ID NO: 943313 - RNA, 18 nt, Homo sapiens
aucagucuccaacauguu

SEQ ID NO: 943314 - RNA, 21 nt, Homo sapiens
aucagugaagccaaagggacu

SEQ ID NO: 943315 - RNA, 23 nt, Homo sapiens
aucauaguuacuguguaaacuca

SEQ ID NO: 943316 - RNA, 15 nt, Homo sapiens
aucaucaaguaauac

SEQ ID NO: 943317 - RNA, 15 nt, Homo sapiens
aucauucccauuuug

SEQ ID NO: 943318 - RNA, 21 nt, Homo sapiens
aucauuuguuuacauuugaug

SEQ ID NO: 943319 - RNA, 20 nt, Homo sapiens
auccacaaaugaagggauau

SEQ ID NO: 943320 - RNA, 19 nt, Homo sapiens
auccaccaagaacauaaga

SEQ ID NO: 943321 - RNA, 15 nt, Homo sapiens
auccagccagacccc

SEQ ID NO: 943322 - RNA, 17 nt, Homo sapiens
auccaggcaccaggacu

SEQ ID NO: 943323 - RNA, 18 nt, Homo sapiens
auccaucuugagccacag

SEQ ID NO: 943324 - RNA, 17 nt, Homo sapiens
auccaugcaccuaccuu

SEQ ID NO: 943325 - RNA, 15 nt, Homo sapiens
auccaugcugugcug

SEQ ID NO: 943326 - RNA, 18 nt, Homo sapiens
auccauugaacuaaaaua

SEQ ID NO: 943327 - RNA, 17 nt, Homo sapiens
aucccccucuuugcaca

SEQ ID NO: 943328 - RNA, 19 nt, Homo sapiens
aucccuuuuuuuacauuuc

SEQ ID NO: 943329 - RNA, 19 nt, Homo sapiens
auccgauuccccuguagca

SEQ ID NO: 943330 - RNA, 14 nt, Homo sapiens
auccucacagugaa

SEQ ID NO: 943331 - RNA, 20 nt, Homo sapiens
auccucacagugaacacuca

SEQ ID NO: 943332 - RNA, 17 nt, Homo sapiens
auccucaugguucccaa

SEQ ID NO: 943333 - RNA, 15 nt, Homo sapiens
auccuccacagagag

SEQ ID NO: 943334 - RNA, 16 nt, Homo sapiens
auccuggcuaacacgg

SEQ ID NO: 943335 - RNA, 21 nt, Homo sapiens
auccuuccacuaucauuccca

SEQ ID NO: 943336 - RNA, 16 nt, Homo sapiens
aucggcugcauugaag

SEQ ID NO: 943337 - RNA, 22 nt, Homo sapiens
aucguccagcgaccuuccucau

SEQ ID NO: 943338 - RNA, 20 nt, Homo sapiens
ggcauuccuugggacucagg

SEQ ID NO: 943339 - RNA, 17 nt, Homo sapiens
ggccacauagaugcuga

SEQ ID NO: 943340 - RNA, 20 nt, Homo sapiens
ggccaggcuggucuugaacu

SEQ ID NO: 943341 - RNA, 14 nt, Homo sapiens
ggccauguccaaag

SEQ ID NO: 943342 - RNA, 15 nt, Homo sapiens
ggccauguccaaaga

SEQ ID NO: 943343 - RNA, 19 nt, Homo sapiens
ggcccugggccucaguuca

SEQ ID NO: 943344 - RNA, 20 nt, Homo sapiens
ggcccuggggaucuucccac

SEQ ID NO: 943345 - RNA, 16 nt, Homo sapiens
ggcccuucacuuccau

SEQ ID NO: 943346 - RNA, 22 nt, Homo sapiens
ggcgcuugcaccacuuccgucc

SEQ ID NO: 943347 - RNA, 16 nt, Homo sapiens
ggcgucccuuccaacc

SEQ ID NO: 943348 - RNA, 19 nt, Homo sapiens
ggcuaugcgggggugccua

SEQ ID NO: 943349 - RNA, 19 nt, Homo sapiens
ggcucagauuguaauaugu

SEQ ID NO: 943350 - RNA, 17 nt, Homo sapiens
ggcuccuucccaucgcu

SEQ ID NO: 943351 - RNA, 16 nt, Homo sapiens
ggcugcagugagccau

SEQ ID NO: 943352 - RNA, 18 nt, Homo sapiens
ggcugcgagagaaaggga

SEQ ID NO: 943353 - RNA, 19 nt, Homo sapiens
ggcuggcauggugaggcuu

SEQ ID NO: 943354 - RNA, 21 nt, Homo sapiens
ggcugucugucaccagcuauc

SEQ ID NO: 943355 - RNA, 23 nt, Homo sapiens
ggcuuaaggagaggagaaacuga

SEQ ID NO: 943356 - RNA, 15 nt, Homo sapiens
ggcuuucagagccag

SEQ ID NO: 943357 - RNA, 12 nt, Homo sapiens
gggaacaugccc

SEQ ID NO: 943358 - RNA, 20 nt, Homo sapiens
gggaaccauguauaugagcu

SEQ ID NO: 943359 - RNA, 14 nt, Homo sapiens
gggaccagggaugg

SEQ ID NO: 943360 - RNA, 14 nt, Homo sapiens
gggauccugggaga

SEQ ID NO: 943361 - RNA, 13 nt, Homo sapiens
gggcagacaauaa

SEQ ID NO: 943362 - RNA, 16 nt, Homo sapiens
gggcaggcugggccau

SEQ ID NO: 943363 - RNA, 21 nt, Homo sapiens
gggcaggcugggccaugucca

SEQ ID NO: 943364 - RNA, 22 nt, Homo sapiens
gggcauuccuugggacucagga

SEQ ID NO: 943365 - RNA, 11 nt, Homo sapiens
gggccucaguc

SEQ ID NO: 943366 - RNA, 17 nt, Homo sapiens
gggcgugggcgcuugca

SEQ ID NO: 943367 - RNA, 16 nt, Homo sapiens
gggcucaggccaucca

SEQ ID NO: 943368 - RNA, 16 nt, Homo sapiens
ggggauuuuuaugucu

SEQ ID NO: 943369 - RNA, 15 nt, Homo sapiens
ggggcagacaauaaa

SEQ ID NO: 943370 - RNA, 15 nt, Homo sapiens
ggggcguucgcugcg

SEQ ID NO: 943371 - RNA, 16 nt, Homo sapiens
ggguuaauucauuugg

SEQ ID NO: 943372 - RNA, 18 nt, Homo sapiens
gguaauucuauugggaua

SEQ ID NO: 943373 - RNA, 20 nt, Homo sapiens
gguaccaauucagugucugu

SEQ ID NO: 943374 - RNA, 15 nt, Homo sapiens
gguagcaacaacaga

SEQ ID NO: 943375 - RNA, 17 nt, Homo sapiens
gguauccugggggaccc

SEQ ID NO: 943376 - RNA, 18 nt, Homo sapiens
gguauuuuaagugauguc

SEQ ID NO: 943377 - RNA, 18 nt, Homo sapiens
acggacaaagagauugag

SEQ ID NO: 943378 - RNA, 23 nt, Homo sapiens
acggggcugacuccugcucucug

SEQ ID NO: 943379 - RNA, 17 nt, Homo sapiens
acggucaggaaaacugu

SEQ ID NO: 943380 - RNA, 13 nt, Homo sapiens
acggucaguccau

SEQ ID NO: 943381 - RNA, 16 nt, Homo sapiens
acggucaguccauguc

SEQ ID NO: 943382 - RNA, 18 nt, Homo sapiens
acggucaguccaugucuc

SEQ ID NO: 943383 - RNA, 16 nt, Homo sapiens
acguuccauaccccca

SEQ ID NO: 943384 - RNA, 14 nt, Homo sapiens
acuaauugguacuu

SEQ ID NO: 943385 - RNA, 15 nt, Homo sapiens
acuaauuuuacaugu

SEQ ID NO: 943386 - RNA, 20 nt, Homo sapiens
acuacaucuccaaugugcuu

SEQ ID NO: 943387 - RNA, 19 nt, Homo sapiens
acuacauuugugaacaaaa

SEQ ID NO: 943388 - RNA, 18 nt, Homo sapiens
acuaccauucuauuccau

SEQ ID NO: 943389 - RNA, 19 nt, Homo sapiens
acuacgguugaucuugcaa

SEQ ID NO: 943390 - RNA, 20 nt, Homo sapiens
acuagaaagaaggacccaga

SEQ ID NO: 943391 - RNA, 16 nt, Homo sapiens
acuaguuuucaaucau

SEQ ID NO: 943392 - RNA, 23 nt, Homo sapiens
acuaugauuuaauuugaaauaug

SEQ ID NO: 943393 - RNA, 22 nt, Homo sapiens
acuauucuaaugaaaacauuaa

SEQ ID NO: 943394 - RNA, 21 nt, Homo sapiens
acucaaaaauccuaacauuca

SEQ ID NO: 943395 - RNA, 15 nt, Homo sapiens
acucaccaaacacaa

SEQ ID NO: 943396 - RNA, 18 nt, Homo sapiens
acucaugaagcauacccc

SEQ ID NO: 943397 - RNA, 21 nt, Homo sapiens
acucaugcugguggcauuguu

SEQ ID NO: 943398 - RNA, 13 nt, Homo sapiens
acucauugcugag

SEQ ID NO: 943399 - RNA, 15 nt, Homo sapiens
acucauuucaucuca

SEQ ID NO: 943400 - RNA, 18 nt, Homo sapiens
acucuggaccauauacca

SEQ ID NO: 943401 - RNA, 18 nt, Homo sapiens
acucuggcaaagcuuuua

SEQ ID NO: 943402 - RNA, 23 nt, Homo sapiens
acucuuacaagaguggacucagu

SEQ ID NO: 943403 - RNA, 19 nt, Homo sapiens
acucuugaauagacuucca

SEQ ID NO: 943404 - RNA, 21 nt, Homo sapiens
acugaggacuguuugcaauug

SEQ ID NO: 943405 - RNA, 19 nt, Homo sapiens
acugaucuuauguguuaca

SEQ ID NO: 943406 - RNA, 16 nt, Homo sapiens
acugcagaaacccuga

SEQ ID NO: 943407 - RNA, 15 nt, Homo sapiens
acugcuguaaacaca

SEQ ID NO: 943408 - RNA, 22 nt, Homo sapiens
acuggaccguuuccaagcugcg

SEQ ID NO: 943409 - RNA, 21 nt, Homo sapiens
acugggaaacuggguuucuca

SEQ ID NO: 943410 - RNA, 23 nt, Homo sapiens
acuggggccuccagaacucacug

SEQ ID NO: 943411 - RNA, 19 nt, Homo sapiens
acuguagaaggccagcuga

SEQ ID NO: 943412 - RNA, 22 nt, Homo sapiens
acuguguuguaccaaaauucau

SEQ ID NO: 943413 - RNA, 14 nt, Homo sapiens
acuguuuaaucaua

SEQ ID NO: 943414 - RNA, 14 nt, Homo sapiens
acuuaaccuugcaa

SEQ ID NO: 943415 - RNA, 18 nt, Homo sapiens
acuuccaucugugccaua

SEQ ID NO: 943416 - RNA, 14 nt, Homo sapiens
acuucgaaaccugg

SEQ ID NO: 943417 - RNA, 16 nt, Homo sapiens
acuucgaaaccuggga

SEQ ID NO: 943418 - RNA, 23 nt, Homo sapiens
acuucuguugcccuugugcucca

SEQ ID NO: 943419 - RNA, 22 nt, Homo sapiens
acuucuuuaagcggacccgcua

SEQ ID NO: 943420 - RNA, 14 nt, Homo sapiens
acuugccucugcac

SEQ ID NO: 943421 - RNA, 16 nt, Homo sapiens
acuugccugugcuaca

SEQ ID NO: 943422 - RNA, 14 nt, Homo sapiens
acuuguucauuugg

SEQ ID NO: 943423 - RNA, 14 nt, Homo sapiens
acuuucuaaaucaa

SEQ ID NO: 943424 - RNA, 24 nt, Homo sapiens
acuuucuaauuagagagcaucugc

SEQ ID NO: 943425 - RNA, 20 nt, Homo sapiens
acuuugaaaguuaacucuuc

SEQ ID NO: 943426 - RNA, 23 nt, Homo sapiens
acuuugaaaguuaacucuucaaa

SEQ ID NO: 943427 - RNA, 17 nt, Homo sapiens
agaaaaauaucuuggcc

SEQ ID NO: 943428 - RNA, 19 nt, Homo sapiens
agaaaagcaauacuguuuc

SEQ ID NO: 943429 - RNA, 20 nt, Homo sapiens
agaaaaggcagcuaaaggaa

SEQ ID NO: 943430 - RNA, 19 nt, Homo sapiens
agaaaaucaaauauauaac

SEQ ID NO: 943431 - RNA, 19 nt, Homo sapiens
agaaaccagaaaagcaaua

SEQ ID NO: 943432 - RNA, 19 nt, Homo sapiens
agaaagaauuggccaggca

SEQ ID NO: 943433 - RNA, 13 nt, Homo sapiens
agaaagggccuug

SEQ ID NO: 943434 - RNA, 11 nt, Homo sapiens
agaaaucacau

SEQ ID NO: 943435 - RNA, 15 nt, Homo sapiens
agaacaacuaccuga

SEQ ID NO: 943436 - RNA, 22 nt, Homo sapiens
agaacauuaauuauauguauau

SEQ ID NO: 943437 - RNA, 16 nt, Homo sapiens
agaacauuuuaauuca

SEQ ID NO: 943438 - RNA, 15 nt, Homo sapiens
agaaccucagaucag

SEQ ID NO: 943439 - RNA, 19 nt, Homo sapiens
agaacguuuuuuccucagu

SEQ ID NO: 943440 - RNA, 23 nt, Homo sapiens
agaacguuuuuuccucagugcau

SEQ ID NO: 943441 - RNA, 15 nt, Homo sapiens
agaacuaagcacuuu

SEQ ID NO: 943442 - RNA, 15 nt, Homo sapiens
agaacucacuggggc

SEQ ID NO: 943443 - RNA, 21 nt, Homo sapiens
agaagcaguuguaccaaguga

SEQ ID NO: 943444 - RNA, 22 nt, Homo sapiens
agaauacauuguacuuauacac

SEQ ID NO: 943445 - RNA, 19 nt, Homo sapiens
agaauaccaccuaauccuu

SEQ ID NO: 943446 - RNA, 11 nt, Homo sapiens
agaauccaaac

SEQ ID NO: 943447 - RNA, 21 nt, Homo sapiens
agaaucuuuuaaauacauucc

SEQ ID NO: 943448 - RNA, 22 nt, Homo sapiens
agaaugcugcaggacuugagaa

SEQ ID NO: 943449 - RNA, 18 nt, Homo sapiens
agaauuaaaaaagcauac

SEQ ID NO: 943450 - RNA, 19 nt, Homo sapiens
agaauuaagaggaugcugg

SEQ ID NO: 943451 - RNA, 23 nt, Homo sapiens
agaauuggggcacuuaaugguca

SEQ ID NO: 943452 - RNA, 22 nt, Homo sapiens
agacaaguaaaauuauccucuu

SEQ ID NO: 943453 - RNA, 13 nt, Homo sapiens
agacaauaaaccc

SEQ ID NO: 943454 - RNA, 17 nt, Homo sapiens
agacaauaaacccucag

SEQ ID NO: 943455 - RNA, 15 nt, Homo sapiens
agacacugaucuggc

SEQ ID NO: 943456 - RNA, 12 nt, Homo sapiens
agacacugcugc

SEQ ID NO: 943457 - RNA, 13 nt, Homo sapiens
agaccagauuaaa

SEQ ID NO: 943458 - RNA, 23 nt, Homo sapiens
agacuuuaggaaugguucucuca

SEQ ID NO: 943459 - RNA, 18 nt, Homo sapiens
agacuuucuaaaucaaac

SEQ ID NO: 943460 - RNA, 15 nt, Homo sapiens
agagaaccucagauc

SEQ ID NO: 943461 - RNA, 21 nt, Homo sapiens
agagaagcaucauuuccccaa

SEQ ID NO: 943462 - RNA, 18 nt, Homo sapiens
agagacgguguuuugcca

SEQ ID NO: 943463 - RNA, 15 nt, Homo sapiens
agagagccaagcccu

SEQ ID NO: 943464 - RNA, 19 nt, Homo sapiens
agagaucagcgacccugag

SEQ ID NO: 943465 - RNA, 20 nt, Homo sapiens
agagaucagcgacccugagg

SEQ ID NO: 943466 - RNA, 21 nt, Homo sapiens
agagaucuuucuuuccaaaac

SEQ ID NO: 943467 - RNA, 17 nt, Homo sapiens
agagauuagaauaucug

SEQ ID NO: 943468 - RNA, 13 nt, Homo sapiens
agagcacagugau

SEQ ID NO: 943469 - RNA, 21 nt, Homo sapiens
agagcaucugcaacaaaaagu

SEQ ID NO: 943470 - RNA, 15 nt, Homo sapiens
agaggaggggaccaa

SEQ ID NO: 943471 - RNA, 21 nt, Homo sapiens
agagggcgugggcgcuugcac

SEQ ID NO: 943472 - RNA, 21 nt, Homo sapiens
agagguagucucacugcuuga

SEQ ID NO: 943473 - RNA, 22 nt, Homo sapiens
agaguagagaugcugggacuga

SEQ ID NO: 943474 - RNA, 17 nt, Homo sapiens
agaguuggagacucagc

SEQ ID NO: 943475 - RNA, 18 nt, Homo sapiens
caucaucaaaaacuuugg

SEQ ID NO: 943476 - RNA, 18 nt, Homo sapiens
caucaugaagaagcucuu

SEQ ID NO: 943477 - RNA, 20 nt, Homo sapiens
cauccuacaacucacauuag

SEQ ID NO: 943478 - RNA, 18 nt, Homo sapiens
cauccuaccccuuugcac

SEQ ID NO: 943479 - RNA, 21 nt, Homo sapiens
caucuauuuccucugugcaaa

SEQ ID NO: 943480 - RNA, 18 nt, Homo sapiens
caucugaaauguuacaaa

SEQ ID NO: 943481 - RNA, 18 nt, Homo sapiens
caucugcuccuguucaca

SEQ ID NO: 943482 - RNA, 22 nt, Homo sapiens
caucugcuuuucccauugccau

SEQ ID NO: 943483 - RNA, 19 nt, Homo sapiens
caucuuauaugggaaacca

SEQ ID NO: 943484 - RNA, 18 nt, Homo sapiens
cccauaacaaccugggca

SEQ ID NO: 943485 - RNA, 15 nt, Homo sapiens
cccauuucaaugugu

SEQ ID NO: 943486 - RNA, 20 nt, Homo sapiens
cccauuuuugcuuagcucaa

SEQ ID NO: 943487 - RNA, 23 nt, Homo sapiens
ccccaagagaacucgcgcucagu

SEQ ID NO: 943488 - RNA, 20 nt, Homo sapiens
ccccaguuccucccccaguu

SEQ ID NO: 943489 - RNA, 21 nt, Homo sapiens
cccccaaugacacccaugcca

SEQ ID NO: 943490 - RNA, 24 nt, Homo sapiens
cccccaguaaaaucaaaugugcau

SEQ ID NO: 943491 - RNA, 22 nt, Homo sapiens
cccccaguccuguccuaucacu

SEQ ID NO: 943492 - RNA, 16 nt, Homo sapiens
ccccucagaugaucuc

SEQ ID NO: 943493 - RNA, 23 nt, Homo sapiens
ccccucauccgauuccccuguag

SEQ ID NO: 943494 - RNA, 14 nt, Homo sapiens
ccccucucaccaaa

SEQ ID NO: 943495 - RNA, 21 nt, Homo sapiens
ccccucuuugcacagcaugag

SEQ ID NO: 943496 - RNA, 19 nt, Homo sapiens
ccccugcaauguggugaca

SEQ ID NO: 943497 - RNA, 14 nt, Homo sapiens
ccccuguaccuuuu

SEQ ID NO: 943498 - RNA, 16 nt, Homo sapiens
ccccuuucacacugga

SEQ ID NO: 943499 - RNA, 22 nt, Homo sapiens
cccgagucgucauccccggagu

SEQ ID NO: 943500 - RNA, 21 nt, Homo sapiens
cccuaacuuucuuaucccaug

SEQ ID NO: 943501 - RNA, 18 nt, Homo sapiens
cccuacccccaguaaaau

SEQ ID NO: 943502 - RNA, 15 nt, Homo sapiens
cccuauuauuugccc

SEQ ID NO: 943503 - RNA, 16 nt, Homo sapiens
cccucaacuauucugu

SEQ ID NO: 943504 - RNA, 15 nt, Homo sapiens
cccucugucuuguga

SEQ ID NO: 943505 - RNA, 21 nt, Homo sapiens
cccugacaucuggaaucugga

SEQ ID NO: 943506 - RNA, 19 nt, Homo sapiens
cccugauaguuucccauaa

SEQ ID NO: 943507 - RNA, 23 nt, Homo sapiens
cccugcccaccaagaagcacugg

SEQ ID NO: 943508 - RNA, 18 nt, Homo sapiens
cccugguggcuucagcag

SEQ ID NO: 943509 - RNA, 14 nt, Homo sapiens
cccugucucaaaaa

SEQ ID NO: 943510 - RNA, 18 nt, Homo sapiens
cccuuaacugcauccagc

SEQ ID NO: 943511 - RNA, 12 nt, Homo sapiens
ccgacaucacag

SEQ ID NO: 943512 - RNA, 22 nt, Homo sapiens
ccuaaagaaugcaaccuaguca

SEQ ID NO: 943513 - RNA, 21 nt, Homo sapiens
ccuaagaucucgguuugccaa

SEQ ID NO: 943514 - RNA, 15 nt, Homo sapiens
ccuaccagacacugc

SEQ ID NO: 943515 - RNA, 21 nt, Homo sapiens
ccuagcuggcucugugagggu

SEQ ID NO: 943516 - RNA, 19 nt, Homo sapiens
ccuaggaacgucugguccu

SEQ ID NO: 943517 - RNA, 13 nt, Homo sapiens
ccuauauuuagcc

SEQ ID NO: 943518 - RNA, 20 nt, Homo sapiens
ccuauauuuagccccaacac

SEQ ID NO: 943519 - RNA, 14 nt, Homo sapiens
ccuauuaucagaag

SEQ ID NO: 943520 - RNA, 17 nt, Homo sapiens
ccucaaaacaaaggccu

SEQ ID NO: 943521 - RNA, 18 nt, Homo sapiens
ccucaaagaagucggaau

SEQ ID NO: 943522 - RNA, 13 nt, Homo sapiens
ccucaaaggagca

SEQ ID NO: 943523 - RNA, 16 nt, Homo sapiens
ccucaacccaagggga

SEQ ID NO: 943524 - RNA, 19 nt, Homo sapiens
ccucacuggggcagacaau

SEQ ID NO: 943525 - RNA, 14 nt, Homo sapiens
ccucaggcagcuca

SEQ ID NO: 943526 - RNA, 12 nt, Homo sapiens
ccucagugcauu

SEQ ID NO: 943527 - RNA, 18 nt, Homo sapiens
ccucaugucuucucacaa

SEQ ID NO: 943528 - RNA, 13 nt, Homo sapiens
ccuccagaacuca

SEQ ID NO: 943529 - RNA, 12 nt, Homo sapiens
ccucccaggaag

SEQ ID NO: 943530 - RNA, 22 nt, Homo sapiens
ccucuaaaccauggcacuugau

SEQ ID NO: 943531 - RNA, 19 nt, Homo sapiens
ccucucucccggagguugg

SEQ ID NO: 943532 - RNA, 19 nt, Homo sapiens
ccucugucaacaucaaaga

SEQ ID NO: 943533 - RNA, 16 nt, Homo sapiens
ccucugugcaaaggga

SEQ ID NO: 943534 - RNA, 12 nt, Homo sapiens
ccugaaguauuu

SEQ ID NO: 943535 - RNA, 21 nt, Homo sapiens
ccugaauaccacuuaccucaa

SEQ ID NO: 943536 - RNA, 21 nt, Homo sapiens
ccugaauucuuuuucauuuga

SEQ ID NO: 943537 - RNA, 17 nt, Homo sapiens
ccugacuguaaaugcuc

SEQ ID NO: 943538 - RNA, 21 nt, Homo sapiens
ccugagcacccagaacuccau

SEQ ID NO: 943539 - RNA, 13 nt, Homo sapiens
ccugagcuaaaua

SEQ ID NO: 943540 - RNA, 17 nt, Homo sapiens
ccugcagcccaugguga

SEQ ID NO: 943541 - RNA, 22 nt, Homo sapiens
ccugcagcccauggugagcucu

SEQ ID NO: 943542 - RNA, 15 nt, Homo sapiens
ccugcccaugugucc

SEQ ID NO: 943543 - RNA, 12 nt, Homo sapiens
ccuggcaguuua

SEQ ID NO: 943544 - RNA, 13 nt, Homo sapiens
ccugggcauuccu

SEQ ID NO: 943545 - RNA, 15 nt, Homo sapiens
ccuggggguggcagg

SEQ ID NO: 943546 - RNA, 15 nt, Homo sapiens
ccuguaaagucugag

SEQ ID NO: 943547 - RNA, 22 nt, Homo sapiens
ccugugugauacaagagucagc

SEQ ID NO: 943548 - RNA, 16 nt, Homo sapiens
ccuguuucccacccag

SEQ ID NO: 943549 - RNA, 14 nt, Homo sapiens
ccuuaacugcaucc

SEQ ID NO: 943550 - RNA, 21 nt, Homo sapiens
ccuuacaacgccgagugcacu

SEQ ID NO: 943551 - RNA, 23 nt, Homo sapiens
ccuuagaugccucgcucuuuuca

SEQ ID NO: 943552 - RNA, 15 nt, Homo sapiens
ccuuaucaccagccu

SEQ ID NO: 943553 - RNA, 17 nt, Homo sapiens
ccuuauccuaaugaugc

SEQ ID NO: 943554 - RNA, 23 nt, Homo sapiens
ccuucacagcuaagaugccaugu

SEQ ID NO: 943555 - RNA, 20 nt, Homo sapiens
ccuucauuaacaaaauguau

SEQ ID NO: 943556 - RNA, 14 nt, Homo sapiens
ccuucauugccaca

SEQ ID NO: 943557 - RNA, 13 nt, Homo sapiens
ccuuccuugccua

SEQ ID NO: 943558 - RNA, 18 nt, Homo sapiens
ccuucucccucgacauuu

SEQ ID NO: 943559 - RNA, 16 nt, Homo sapiens
ccuucuugucauugaa

SEQ ID NO: 943560 - RNA, 17 nt, Homo sapiens
ccuugccuauuugcuga

SEQ ID NO: 943561 - RNA, 16 nt, Homo sapiens
ccuuggccucugcuaa

SEQ ID NO: 943562 - RNA, 17 nt, Homo sapiens
ccuuucccuacuccaug

SEQ ID NO: 943563 - RNA, 16 nt, Homo sapiens
ccuuuuuugcaugugc

SEQ ID NO: 943564 - RNA, 18 nt, Homo sapiens
ccuuuuuuuacauuucau

SEQ ID NO: 943565 - RNA, 12 nt, Homo sapiens
cgaaaugagcuc

SEQ ID NO: 943566 - RNA, 18 nt, Homo sapiens
cgaagcggagagagccaa

SEQ ID NO: 943567 - RNA, 18 nt, Homo sapiens
cgaccgcccccuccucua

SEQ ID NO: 943568 - RNA, 14 nt, Homo sapiens
cgagcaggguguuu

SEQ ID NO: 943569 - RNA, 23 nt, Homo sapiens
cgaggaaaggauuuuaccaaagc

SEQ ID NO: 943570 - RNA, 20 nt, Homo sapiens
cgcccaggcuggagugcagu

SEQ ID NO: 943571 - RNA, 21 nt, Homo sapiens
cggaaggagggagcucugaug

SEQ ID NO: 943572 - RNA, 15 nt, Homo sapiens
cggacucccuacccc

SEQ ID NO: 943573 - RNA, 20 nt, Homo sapiens
cggagaaacgggugagcuga

SEQ ID NO: 943574 - RNA, 20 nt, Homo sapiens
cggagcaggggucugagcca

SEQ ID NO: 943575 - RNA, 12 nt, Homo sapiens
cggauggugcau

SEQ ID NO: 943576 - RNA, 17 nt, Homo sapiens
cggcggagauugcagug

SEQ ID NO: 943577 - RNA, 19 nt, Homo sapiens
cggcggcuaccugagcuga

SEQ ID NO: 943578 - RNA, 18 nt, Homo sapiens
cgggagcaguagucauug

SEQ ID NO: 943579 - RNA, 16 nt, Homo sapiens
cgguguguaacacugu

SEQ ID NO: 943580 - RNA, 14 nt, Homo sapiens
cgguuaccucugca

SEQ ID NO: 943581 - RNA, 18 nt, Homo sapiens
aggcucagagggaccuca

SEQ ID NO: 943582 - RNA, 17 nt, Homo sapiens
aggcucccuuccugggg

SEQ ID NO: 943583 - RNA, 12 nt, Homo sapiens
aggcuccugggg

SEQ ID NO: 943584 - RNA, 18 nt, Homo sapiens
aggcugccccucucacca

SEQ ID NO: 943585 - RNA, 20 nt, Homo sapiens
aggcugcgagagaaagggag

SEQ ID NO: 943586 - RNA, 18 nt, Homo sapiens
aggcugggccauguccaa

SEQ ID NO: 943587 - RNA, 21 nt, Homo sapiens
aggcuuuucaaguaccuauau

SEQ ID NO: 943588 - RNA, 21 nt, Homo sapiens
agggaccacacccuguacugu

SEQ ID NO: 943589 - RNA, 14 nt, Homo sapiens
agggagaccaugcc

SEQ ID NO: 943590 - RNA, 15 nt, Homo sapiens
agggagaccaugccu

SEQ ID NO: 943591 - RNA, 18 nt, Homo sapiens
agggagugcacauaucca

SEQ ID NO: 943592 - RNA, 17 nt, Homo sapiens
ugaccaaguaugacaac

SEQ ID NO: 943593 - RNA, 21 nt, Homo sapiens
ugacccuaugggucuaggaca

SEQ ID NO: 943594 - RNA, 17 nt, Homo sapiens
ugaccuuaaaugcaacc

SEQ ID NO: 943595 - RNA, 22 nt, Homo sapiens
ugacuugcaaagaccuaccucc

SEQ ID NO: 943596 - RNA, 14 nt, Homo sapiens
ugagaaacugggaa

SEQ ID NO: 943597 - RNA, 20 nt, Homo sapiens
ugagaagacaucagauccug

SEQ ID NO: 943598 - RNA, 22 nt, Homo sapiens
ugagacuacaagugugugccac

SEQ ID NO: 943599 - RNA, 16 nt, Homo sapiens
ugagcaagacauacuu

SEQ ID NO: 943600 - RNA, 20 nt, Homo sapiens
ugagcaggucaggacucaga

SEQ ID NO: 943601 - RNA, 14 nt, Homo sapiens
ugagcuggggaccu

SEQ ID NO: 943602 - RNA, 17 nt, Homo sapiens
ugaggagcgaucucagc

SEQ ID NO: 943603 - RNA, 16 nt, Homo sapiens
ugaggcauuuccagac

SEQ ID NO: 943604 - RNA, 20 nt, Homo sapiens
ugaggcauuuccagacuuga

SEQ ID NO: 943605 - RNA, 12 nt, Homo sapiens
ugagggugcuga

SEQ ID NO: 943606 - RNA, 18 nt, Homo sapiens
ugagggugcugacuggcu

SEQ ID NO: 943607 - RNA, 16 nt, Homo sapiens
ugaguuacagccuguu

SEQ ID NO: 943608 - RNA, 19 nt, Homo sapiens
ugaguuucuggcucuugag

SEQ ID NO: 943609 - RNA, 16 nt, Homo sapiens
ugaugggcuguucuaa

SEQ ID NO: 943610 - RNA, 21 nt, Homo sapiens
ugauuuuaaccaauguagcac

SEQ ID NO: 943611 - RNA, 13 nt, Homo sapiens
ugcaacaaaaagu

SEQ ID NO: 943612 - RNA, 16 nt, Homo sapiens
ugcaacaaaaagucau

SEQ ID NO: 943613 - RNA, 19 nt, Homo sapiens
ugcaacccugucauuacgu

SEQ ID NO: 943614 - RNA, 14 nt, Homo sapiens
ugcaacuucugccu

SEQ ID NO: 943615 - RNA, 16 nt, Homo sapiens
ugcaauguaagcauac

SEQ ID NO: 943616 - RNA, 18 nt, Homo sapiens
ugcaauuuuucaagagcu

SEQ ID NO: 943617 - RNA, 12 nt, Homo sapiens
ugcaccaaagac

SEQ ID NO: 943618 - RNA, 13 nt, Homo sapiens
ugcaccaaagaca

SEQ ID NO: 943619 - RNA, 16 nt, Homo sapiens
ugcacguggggcccac

SEQ ID NO: 943620 - RNA, 19 nt, Homo sapiens
ugcacuccagccuggcaau

SEQ ID NO: 943621 - RNA, 20 nt, Homo sapiens
ugcacuccagcuugggcaac

SEQ ID NO: 943622 - RNA, 23 nt, Homo sapiens
ugcacuuguggcaacagauaagu

SEQ ID NO: 943623 - RNA, 12 nt, Homo sapiens
ugcagcaggaac

SEQ ID NO: 943624 - RNA, 16 nt, Homo sapiens
ugcaggacuugagaag

SEQ ID NO: 943625 - RNA, 23 nt, Homo sapiens
ugcaguucuuuuuguacacuuaa

SEQ ID NO: 943626 - RNA, 19 nt, Homo sapiens
ugccagccccgccacgcuu

SEQ ID NO: 943627 - RNA, 20 nt, Homo sapiens
ugccccaccccauccagcca

SEQ ID NO: 943628 - RNA, 14 nt, Homo sapiens
ugcccccuccccca

SEQ ID NO: 943629 - RNA, 21 nt, Homo sapiens
ugccccucggccccagcacau

SEQ ID NO: 943630 - RNA, 15 nt, Homo sapiens
ugccccucucucagu

SEQ ID NO: 943631 - RNA, 14 nt, Homo sapiens
ugcccuagaucaac

SEQ ID NO: 943632 - RNA, 13 nt, Homo sapiens
ugcccucauggcc

SEQ ID NO: 943633 - RNA, 22 nt, Homo sapiens
ugccuaaggugucugaguuucu

SEQ ID NO: 943634 - RNA, 21 nt, Homo sapiens
ugccuucuccuauuucuccaa

SEQ ID NO: 943635 - RNA, 22 nt, Homo sapiens
ugcgagagaaagggagugcaug

SEQ ID NO: 943636 - RNA, 11 nt, Homo sapiens
ugcgcccuuca

SEQ ID NO: 943637 - RNA, 20 nt, Homo sapiens
ugcuacaguuauuaaucugg

SEQ ID NO: 943638 - RNA, 12 nt, Homo sapiens
ugcuaucugggc

SEQ ID NO: 943639 - RNA, 17 nt, Homo sapiens
ugcucagacccaacagc

SEQ ID NO: 943640 - RNA, 17 nt, Homo sapiens
ugcucaggcucagaggg

SEQ ID NO: 943641 - RNA, 21 nt, Homo sapiens
ugcuccaagucuaggaacucc

SEQ ID NO: 943642 - RNA, 16 nt, Homo sapiens
ugcucuugagucuuug

SEQ ID NO: 943643 - RNA, 20 nt, Homo sapiens
ugcucuugagucuuugcaga

SEQ ID NO: 943644 - RNA, 22 nt, Homo sapiens
ugcugauguauuucaagucucu

SEQ ID NO: 943645 - RNA, 13 nt, Homo sapiens
ugcuggugcauca

SEQ ID NO: 943646 - RNA, 15 nt, Homo sapiens
ugcuugaacuaggcu

SEQ ID NO: 943647 - RNA, 19 nt, Homo sapiens
ugcuugacaugguuuccaa

SEQ ID NO: 943648 - RNA, 16 nt, Homo sapiens
ugcuugagcccagaag

SEQ ID NO: 943649 - RNA, 13 nt, Homo sapiens
ugcuuucaucuaa

SEQ ID NO: 943650 - RNA, 20 nt, Homo sapiens
ugcuuucuccuucacagcua

SEQ ID NO: 943651 - RNA, 12 nt, Homo sapiens
ugcuuugcugac

SEQ ID NO: 943652 - RNA, 18 nt, Homo sapiens
uggaaaaugcaaaagcac

SEQ ID NO: 943653 - RNA, 14 nt, Homo sapiens
uggaaccauuggca

SEQ ID NO: 943654 - RNA, 13 nt, Homo sapiens
uggaagauucuau

SEQ ID NO: 943655 - RNA, 13 nt, Homo sapiens
uggaaucagugaa

SEQ ID NO: 943656 - RNA, 16 nt, Homo sapiens
uggacuaugcacacuu

SEQ ID NO: 943657 - RNA, 18 nt, Homo sapiens
uggacugugcuggugcau

SEQ ID NO: 943658 - RNA, 16 nt, Homo sapiens
uggacuuaacuaguua

SEQ ID NO: 943659 - RNA, 12 nt, Homo sapiens
uggagacucagc

SEQ ID NO: 943660 - RNA, 13 nt, Homo sapiens
uggaggcacuuua

SEQ ID NO: 943661 - RNA, 15 nt, Homo sapiens
uggaugcagcucuug

SEQ ID NO: 943662 - RNA, 22 nt, Homo sapiens
uggcaagucaccugcagcccau

SEQ ID NO: 943663 - RNA, 10 nt, Homo sapiens
uggcacuuug

SEQ ID NO: 943664 - RNA, 17 nt, Homo sapiens
uggcauucauauuucau

SEQ ID NO: 943665 - RNA, 14 nt, Homo sapiens
uggccuuguaagac

SEQ ID NO: 943666 - RNA, 22 nt, Homo sapiens
uggcuacgaaaugcuugcucag

SEQ ID NO: 943667 - RNA, 12 nt, Homo sapiens
uggcucaugccu

SEQ ID NO: 943668 - RNA, 14 nt, Homo sapiens
uggcucaugccugu

SEQ ID NO: 943669 - RNA, 20 nt, Homo sapiens
uggcucuugaggcauuucca

SEQ ID NO: 943670 - RNA, 13 nt, Homo sapiens
uggcuugaugucc

SEQ ID NO: 943671 - RNA, 19 nt, Homo sapiens
uggcuuggggcaacagauu

SEQ ID NO: 943672 - RNA, 12 nt, Homo sapiens
ugggaaaccaug

SEQ ID NO: 943673 - RNA, 16 nt, Homo sapiens
ugggaagggcagggaa

SEQ ID NO: 943674 - RNA, 17 nt, Homo sapiens
ugggagacucuuugaaa

SEQ ID NO: 943675 - RNA, 15 nt, Homo sapiens
ugggcugucugucac

SEQ ID NO: 943676 - RNA, 13 nt, Homo sapiens
uggggacggugua

SEQ ID NO: 943677 - RNA, 17 nt, Homo sapiens
uggggagcccgucucag

SEQ ID NO: 943678 - RNA, 21 nt, Homo sapiens
uggggcaacagauugaaaaga

SEQ ID NO: 943679 - RNA, 12 nt, Homo sapiens
uggggcagacaa

SEQ ID NO: 943680 - RNA, 22 nt, Homo sapiens
uggggcagacaauaaacccuca

SEQ ID NO: 943681 - RNA, 21 nt, Homo sapiens
gccuucccaaguugugcuuga

SEQ ID NO: 943682 - RNA, 20 nt, Homo sapiens
gcgcgugaguggucuucaaa

SEQ ID NO: 943683 - RNA, 18 nt, Homo sapiens
gcgcucugccacuguccg

SEQ ID NO: 943684 - RNA, 22 nt, Homo sapiens
gcggaccccucgucaucaggug

SEQ ID NO: 943685 - RNA, 15 nt, Homo sapiens
gcggagagagccaag

SEQ ID NO: 943686 - RNA, 17 nt, Homo sapiens
gcggagguugcaaugag

SEQ ID NO: 943687 - RNA, 13 nt, Homo sapiens
gcggagguugcag

SEQ ID NO: 943688 - RNA, 12 nt, Homo sapiens
gcggccacugcg

SEQ ID NO: 943689 - RNA, 21 nt, Homo sapiens
gcggccucgugccaugaucug

SEQ ID NO: 943690 - RNA, 17 nt, Homo sapiens
gcggguaggacggagau

SEQ ID NO: 943691 - RNA, 23 nt, Homo sapiens
gcuacaguuauuaaucuggacau

SEQ ID NO: 943692 - RNA, 11 nt, Homo sapiens
gcuaccaacuu

SEQ ID NO: 943693 - RNA, 21 nt, Homo sapiens
gcuaccauuuaucaagcauuu

SEQ ID NO: 943694 - RNA, 16 nt, Homo sapiens
gcuaccugagcugacc

SEQ ID NO: 943695 - RNA, 20 nt, Homo sapiens
gcuacgaaaugcuugcucag

SEQ ID NO: 943696 - RNA, 17 nt, Homo sapiens
gcuauacacaagcaaug

SEQ ID NO: 943697 - RNA, 18 nt, Homo sapiens
gcucaugccuuaauccca

SEQ ID NO: 943698 - RNA, 15 nt, Homo sapiens
gcucauuugaaaaug

SEQ ID NO: 943699 - RNA, 14 nt, Homo sapiens
gcuccccugaggaa

SEQ ID NO: 943700 - RNA, 14 nt, Homo sapiens
gcuccuguucacac

SEQ ID NO: 943701 - RNA, 18 nt, Homo sapiens
guuuauuaaauugcaaga

SEQ ID NO: 943702 - RNA, 18 nt, Homo sapiens
guuucgaguaaacuugaa

SEQ ID NO: 943703 - RNA, 20 nt, Homo sapiens
guuugcaguuggcuaagaga

SEQ ID NO: 943704 - RNA, 20 nt, Homo sapiens
guuuuaaaaagggaaaguuu

SEQ ID NO: 943705 - RNA, 15 nt, Homo sapiens
guuuuaaacuugccu

SEQ ID NO: 943706 - RNA, 14 nt, Homo sapiens
guuuucaagucaaa

SEQ ID NO: 943707 - RNA, 19 nt, Homo sapiens
guuuucaggacaacacuuc

SEQ ID NO: 943708 - RNA, 13 nt, Homo sapiens
guuuugauuuauu

SEQ ID NO: 943709 - RNA, 17 nt, Homo sapiens
guuuuucugaagacagu

SEQ ID NO: 943710 - RNA, 17 nt, Homo sapiens
uaaaacaaaauuugacu

SEQ ID NO: 943711 - RNA, 18 nt, Homo sapiens
uaaaacaaagccaugcca

SEQ ID NO: 943712 - RNA, 15 nt, Homo sapiens
uaaaagaauuacaua

SEQ ID NO: 943713 - RNA, 20 nt, Homo sapiens
uaaaagcacaaguacuuuug

SEQ ID NO: 943714 - RNA, 19 nt, Homo sapiens
uaaaagcauuuuguaauaa

SEQ ID NO: 943715 - RNA, 22 nt, Homo sapiens
uaaaagguuaaauauugucaua

SEQ ID NO: 943716 - RNA, 22 nt, Homo sapiens
uaaaauauuuuguaaugcugca

SEQ ID NO: 943717 - RNA, 19 nt, Homo sapiens
uaaaauucagaugcuguua

SEQ ID NO: 943718 - RNA, 22 nt, Homo sapiens
uaaaccucaguuauuacaugua

SEQ ID NO: 943719 - RNA, 13 nt, Homo sapiens
uaaacgggaacau

SEQ ID NO: 943720 - RNA, 16 nt, Homo sapiens
uaaacugaaaauggac

SEQ ID NO: 943721 - RNA, 19 nt, Homo sapiens
uaaacuggaauccuuucac

SEQ ID NO: 943722 - RNA, 18 nt, Homo sapiens
uaaacuuauuuacaaaua

SEQ ID NO: 943723 - RNA, 16 nt, Homo sapiens
uaaacuugccuguuca

SEQ ID NO: 943724 - RNA, 17 nt, Homo sapiens
uaaagaaaaaaauacua

SEQ ID NO: 943725 - RNA, 13 nt, Homo sapiens
uaaagaagcaauc

SEQ ID NO: 943726 - RNA, 21 nt, Homo sapiens
uaaagaaugcaaccuagucag

SEQ ID NO: 943727 - RNA, 18 nt, Homo sapiens
uaaagagcuuugugauau

SEQ ID NO: 943728 - RNA, 12 nt, Homo sapiens
uaaagauuuaua

SEQ ID NO: 943729 - RNA, 21 nt, Homo sapiens
uaaagcaugaaaugugaauuu

SEQ ID NO: 943730 - RNA, 15 nt, Homo sapiens
uaaaguacaucucua

SEQ ID NO: 943731 - RNA, 16 nt, Homo sapiens
uaaauaaaauuuguug

SEQ ID NO: 943732 - RNA, 18 nt, Homo sapiens
uaaauaauguauuuacuu

SEQ ID NO: 943733 - RNA, 21 nt, Homo sapiens
uaaaucaaaccaggugcaauu

SEQ ID NO: 943734 - RNA, 22 nt, Homo sapiens
uaaaucaaaccaggugcaauua

SEQ ID NO: 943735 - RNA, 23 nt, Homo sapiens
uaaaucauguugaucauguacuu

SEQ ID NO: 943736 - RNA, 21 nt, Homo sapiens
uaaaugauucuuagugacuuu

SEQ ID NO: 943737 - RNA, 14 nt, Homo sapiens
uaaauguaaacuca

SEQ ID NO: 943738 - RNA, 18 nt, Homo sapiens
uaaauguuuggcauguaa

SEQ ID NO: 943739 - RNA, 17 nt, Homo sapiens
uaaauuuuuaagagaaa

SEQ ID NO: 943740 - RNA, 17 nt, Homo sapiens
uaacaauuuauucugau

SEQ ID NO: 943741 - RNA, 15 nt, Homo sapiens
uaacagccucuguga

SEQ ID NO: 943742 - RNA, 13 nt, Homo sapiens
uaacaugugaaaa

SEQ ID NO: 943743 - RNA, 18 nt, Homo sapiens
uaacauuaucuaguucau

SEQ ID NO: 943744 - RNA, 14 nt, Homo sapiens
uaacgucaugugca

SEQ ID NO: 943745 - RNA, 13 nt, Homo sapiens
uaacuauucauaa

SEQ ID NO: 943746 - RNA, 14 nt, Homo sapiens
uaacucccagugau

SEQ ID NO: 943747 - RNA, 13 nt, Homo sapiens
uaacuucaaauau

SEQ ID NO: 943748 - RNA, 9 nt, Homo sapiens
uaacuuuga

SEQ ID NO: 943749 - RNA, 11 nt, Homo sapiens
uaacuuugaaa

SEQ ID NO: 943750 - RNA, 17 nt, Homo sapiens
uaagaaauagacagcau

SEQ ID NO: 943751 - RNA, 18 nt, Homo sapiens
uaagagcuuaagaaccau

SEQ ID NO: 943752 - RNA, 13 nt, Homo sapiens
uaagauccacaaa

SEQ ID NO: 943753 - RNA, 19 nt, Homo sapiens
uaagaucucgguuugccaa

SEQ ID NO: 943754 - RNA, 13 nt, Homo sapiens
uaagaugccaugu

SEQ ID NO: 943755 - RNA, 16 nt, Homo sapiens
uaagaugccaugugca

SEQ ID NO: 943756 - RNA, 16 nt, Homo sapiens
uaagcuuuccuguuga

SEQ ID NO: 943757 - RNA, 15 nt, Homo sapiens
uaaggaauuaccaag

SEQ ID NO: 943758 - RNA, 14 nt, Homo sapiens
uaagggguacuccu

SEQ ID NO: 943759 - RNA, 13 nt, Homo sapiens
uaagguacugaag

SEQ ID NO: 943760 - RNA, 15 nt, Homo sapiens
uaaguacaugugcca

SEQ ID NO: 943761 - RNA, 15 nt, Homo sapiens
uaaguauugucacca

SEQ ID NO: 943762 - RNA, 19 nt, Homo sapiens
uaauaaaaaggaguauaca

SEQ ID NO: 943763 - RNA, 23 nt, Homo sapiens
uaauagagauuaaaaacaacaaa

SEQ ID NO: 943764 - RNA, 16 nt, Homo sapiens
uaauaggcaucuccag

SEQ ID NO: 943765 - RNA, 19 nt, Homo sapiens
uaauauacaaaacaauuaa

SEQ ID NO: 943766 - RNA, 18 nt, Homo sapiens
uaaucaucaaguaauaca

SEQ ID NO: 943767 - RNA, 23 nt, Homo sapiens
uaaucaucaaguaauacaaacua

SEQ ID NO: 943768 - RNA, 15 nt, Homo sapiens
uaaucccagcacuuu

SEQ ID NO: 943769 - RNA, 14 nt, Homo sapiens
uaauccuaccucaa

SEQ ID NO: 943770 - RNA, 21 nt, Homo sapiens
uaaugcugaaacaucauuaca

SEQ ID NO: 943771 - RNA, 14 nt, Homo sapiens
uaauggaaugaagg

SEQ ID NO: 943772 - RNA, 18 nt, Homo sapiens
ucacauacaaaucaucca

SEQ ID NO: 943773 - RNA, 22 nt, Homo sapiens
ucacauccuaccccuuugcacu

SEQ ID NO: 943774 - RNA, 20 nt, Homo sapiens
ucacaugggcagaaaaaugg

SEQ ID NO: 943775 - RNA, 18 nt, Homo sapiens
ucacauuccucugcccuu

SEQ ID NO: 943776 - RNA, 19 nt, Homo sapiens
ucaccaagcuaggugcuau

SEQ ID NO: 943777 - RNA, 16 nt, Homo sapiens
ucaccacuaccagcca

SEQ ID NO: 943778 - RNA, 16 nt, Homo sapiens
ucaccagagacuuuag

SEQ ID NO: 943779 - RNA, 18 nt, Homo sapiens
ucaccagccucacaaucc

SEQ ID NO: 943780 - RNA, 19 nt, Homo sapiens
ucaccuugaugacuuccua

SEQ ID NO: 943781 - RNA, 15 nt, Homo sapiens
ucacuaugguaugcu

SEQ ID NO: 943782 - RNA, 12 nt, Homo sapiens
ucacucugucag

SEQ ID NO: 943783 - RNA, 23 nt, Homo sapiens
ucacugaugggaaaacugccaau

SEQ ID NO: 943784 - RNA, 18 nt, Homo sapiens
ucacugccccucucucag

SEQ ID NO: 943785 - RNA, 18 nt, Homo sapiens
ucacuggggcagacaaua

SEQ ID NO: 943786 - RNA, 16 nt, Homo sapiens
ucacuugaaccgggga

SEQ ID NO: 943787 - RNA, 13 nt, Homo sapiens
ucagaaagcaaua

SEQ ID NO: 943788 - RNA, 16 nt, Homo sapiens
ucagaaggagcuacaa

SEQ ID NO: 943789 - RNA, 18 nt, Homo sapiens
ucagaaggccccagagag

SEQ ID NO: 943790 - RNA, 22 nt, Homo sapiens
ucagaggcuggggccaacugga

SEQ ID NO: 943791 - RNA, 13 nt, Homo sapiens
ucagaucaugccc

SEQ ID NO: 943792 - RNA, 21 nt, Homo sapiens
ucagauccugggcacauucuu

SEQ ID NO: 943793 - RNA, 16 nt, Homo sapiens
ucagaugaucucucca

SEQ ID NO: 943794 - RNA, 19 nt, Homo sapiens
ucagauucacacaugccac

SEQ ID NO: 943795 - RNA, 21 nt, Homo sapiens
ucagcaaguuagaacuagcca

SEQ ID NO: 943796 - RNA, 22 nt, Homo sapiens
ucagcaauccaugagauagcua

SEQ ID NO: 943797 - RNA, 20 nt, Homo sapiens
ucagcaguccuuaucaccag

SEQ ID NO: 943798 - RNA, 19 nt, Homo sapiens
ucagccacuugccugugcu

SEQ ID NO: 943799 - RNA, 13 nt, Homo sapiens
ucagcccucagaa

SEQ ID NO: 943800 - RNA, 20 nt, Homo sapiens
ucagcuaacaaacuagaaaa

SEQ ID NO: 943801 - RNA, 19 nt, Homo sapiens
ucagcuguaguccucauaa

SEQ ID NO: 943802 - RNA, 20 nt, Homo sapiens
ucaggaaaacuguuccaauc

SEQ ID NO: 943803 - RNA, 18 nt, Homo sapiens
ucaggagcugcuaaacuc

SEQ ID NO: 943804 - RNA, 13 nt, Homo sapiens
ucaggcagcucaa

SEQ ID NO: 943805 - RNA, 12 nt, Homo sapiens
ucaggggcuccc

SEQ ID NO: 943806 - RNA, 16 nt, Homo sapiens
ucaggguaccuggggc

SEQ ID NO: 943807 - RNA, 17 nt, Homo sapiens
ucagguaauacaaacua

SEQ ID NO: 943808 - RNA, 17 nt, Homo sapiens
ucaguauccacacauaa

SEQ ID NO: 943809 - RNA, 17 nt, Homo sapiens
auuccuguuugucuaca

SEQ ID NO: 943810 - RNA, 20 nt, Homo sapiens
auuccuguuugucuacauau

SEQ ID NO: 943811 - RNA, 22 nt, Homo sapiens
auuccuugggacucaggagcug

SEQ ID NO: 943812 - RNA, 16 nt, Homo sapiens
auucucaucaguccau

SEQ ID NO: 943813 - RNA, 18 nt, Homo sapiens
auucucaucaguccauug

SEQ ID NO: 943814 - RNA, 22 nt, Homo sapiens
auucugaaucagaaucucgcag

SEQ ID NO: 943815 - RNA, 21 nt, Homo sapiens
auucugagccugauauugaua

SEQ ID NO: 943816 - RNA, 17 nt, Homo sapiens
auucuggcaggaccuca

SEQ ID NO: 943817 - RNA, 18 nt, Homo sapiens
auucuguuccacacccaa

SEQ ID NO: 943818 - RNA, 16 nt, Homo sapiens
auucuuuaucuugcaa

SEQ ID NO: 943819 - RNA, 15 nt, Homo sapiens
auugaaguguauaau

SEQ ID NO: 943820 - RNA, 13 nt, Homo sapiens
auugacucauaca

SEQ ID NO: 943821 - RNA, 16 nt, Homo sapiens
auugcacaccuuggaa

SEQ ID NO: 943822 - RNA, 21 nt, Homo sapiens
auugucaccaggauuacuagu

SEQ ID NO: 943823 - RNA, 20 nt, Homo sapiens
auugucgguuaccucugcau

SEQ ID NO: 943824 - RNA, 16 nt, Homo sapiens
auuuaaacaccuccuc

SEQ ID NO: 943825 - RNA, 15 nt, Homo sapiens
auuuaaagccuccuc

SEQ ID NO: 943826 - RNA, 20 nt, Homo sapiens
auuuaacauuaucuaguuca

SEQ ID NO: 943827 - RNA, 21 nt, Homo sapiens
auuuaugucccugacuguaaa

SEQ ID NO: 943828 - RNA, 17 nt, Homo sapiens
auuuauuuacagaugaa

SEQ ID NO: 943829 - RNA, 16 nt, Homo sapiens
auuuauuucauccagu

SEQ ID NO: 943830 - RNA, 21 nt, Homo sapiens
auuucaaaccacaauauccag

SEQ ID NO: 943831 - RNA, 15 nt, Homo sapiens
auuucaauaaccuuu

SEQ ID NO: 943832 - RNA, 20 nt, Homo sapiens
auuucagugaauuugcacug

SEQ ID NO: 943833 - RNA, 22 nt, Homo sapiens
auuucauacaacagaaaccaga

SEQ ID NO: 943834 - RNA, 17 nt, Homo sapiens
auuuccuuuauuccuuu

SEQ ID NO: 943835 - RNA, 13 nt, Homo sapiens
auuucuaccucag

SEQ ID NO: 943836 - RNA, 18 nt, Homo sapiens
auuugacauacaaaaagg

SEQ ID NO: 943837 - RNA, 20 nt, Homo sapiens
auuugagagaagccacgcug

SEQ ID NO: 943838 - RNA, 13 nt, Homo sapiens
auuugcaacuuua

SEQ ID NO: 943839 - RNA, 14 nt, Homo sapiens
auuugggcagauau

SEQ ID NO: 943840 - RNA, 18 nt, Homo sapiens
auuugggcagauauagca

SEQ ID NO: 943841 - RNA, 17 nt, Homo sapiens
auuugucauucauucaa

SEQ ID NO: 943842 - RNA, 13 nt, Homo sapiens
auuuguccaauug

SEQ ID NO: 943843 - RNA, 16 nt, Homo sapiens
auuuuaaacagaggau

SEQ ID NO: 943844 - RNA, 23 nt, Homo sapiens
auuuuaauagggaauauaucucu

SEQ ID NO: 943845 - RNA, 18 nt, Homo sapiens
auuuuaccaaagcaucaa

SEQ ID NO: 943846 - RNA, 21 nt, Homo sapiens
auuuuaugcuggacucuggac

SEQ ID NO: 943847 - RNA, 16 nt, Homo sapiens
auuuucuuucacuuaa

SEQ ID NO: 943848 - RNA, 19 nt, Homo sapiens
aaaaaaagaaaagugugua

SEQ ID NO: 943849 - RNA, 19 nt, Homo sapiens
aaaaaauucacaugaugca

SEQ ID NO: 943850 - RNA, 22 nt, Homo sapiens
aaaaauauaaaguacaucucua

SEQ ID NO: 943851 - RNA, 16 nt, Homo sapiens
aaaaaucucccaguga

SEQ ID NO: 943852 - RNA, 15 nt, Homo sapiens
aaaaaugaaguuuau

SEQ ID NO: 943853 - RNA, 12 nt, Homo sapiens
aaaaaugguacu

SEQ ID NO: 943854 - RNA, 15 nt, Homo sapiens
aaaaauuacugugaa

SEQ ID NO: 943855 - RNA, 19 nt, Homo sapiens
aaaacaaaacaaaccuuaa

SEQ ID NO: 943856 - RNA, 14 nt, Homo sapiens
aaaacaaguacugg

SEQ ID NO: 943857 - RNA, 16 nt, Homo sapiens
aaaacaaguacugguu

SEQ ID NO: 943858 - RNA, 19 nt, Homo sapiens
aaaaccuacccucagugag

SEQ ID NO: 943859 - RNA, 16 nt, Homo sapiens
aaaacuuaugaccucu

SEQ ID NO: 943860 - RNA, 16 nt, Homo sapiens
aaaagcacaaguacuu

SEQ ID NO: 943861 - RNA, 19 nt, Homo sapiens
aaaagguuaaauauuguca

SEQ ID NO: 943862 - RNA, 20 nt, Homo sapiens
aaaagguuaaauauugucau

SEQ ID NO: 943863 - RNA, 23 nt, Homo sapiens
aaaaguauucuuguuagaaucug

SEQ ID NO: 943864 - RNA, 17 nt, Homo sapiens
aaaauaaaacugucacu

SEQ ID NO: 943865 - RNA, 21 nt, Homo sapiens
aaaauacuauuuaagauguga

SEQ ID NO: 943866 - RNA, 13 nt, Homo sapiens
aaaauccaaggca

SEQ ID NO: 943867 - RNA, 17 nt, Homo sapiens
aaaaugcaaaagcacau

SEQ ID NO: 943868 - RNA, 14 nt, Homo sapiens
aaaauugacaauga

SEQ ID NO: 943869 - RNA, 15 nt, Homo sapiens
aaaauugacaaugau

SEQ ID NO: 943870 - RNA, 21 nt, Homo sapiens
aaacaaaaugaagcugcccua

SEQ ID NO: 943871 - RNA, 23 nt, Homo sapiens
aaacaacuuucuccuacucuucc

SEQ ID NO: 943872 - RNA, 21 nt, Homo sapiens
aaacacagcaacaaugacuua

SEQ ID NO: 943873 - RNA, 19 nt, Homo sapiens
aaacagauggcacuuugaa

SEQ ID NO: 943874 - RNA, 17 nt, Homo sapiens
aaacauaggaagcccuc

SEQ ID NO: 943875 - RNA, 14 nt, Homo sapiens
aaacaucauuacag

SEQ ID NO: 943876 - RNA, 23 nt, Homo sapiens
aaacauguuccuuauauuuacuc

SEQ ID NO: 943877 - RNA, 14 nt, Homo sapiens
aaaccucuccugac

SEQ ID NO: 943878 - RNA, 19 nt, Homo sapiens
aaacguggcaggacuucca

SEQ ID NO: 943879 - RNA, 20 nt, Homo sapiens
aaacucuguuacacuuuuug

SEQ ID NO: 943880 - RNA, 20 nt, Homo sapiens
aaacuguuccaaucaugaaa

SEQ ID NO: 943881 - RNA, 19 nt, Homo sapiens
aaagaaaaauaucuuggcc

SEQ ID NO: 943882 - RNA, 19 nt, Homo sapiens
aaagaaauauuaagcaugu

SEQ ID NO: 943883 - RNA, 22 nt, Homo sapiens
aaagaacguggucagaguagaa

SEQ ID NO: 943884 - RNA, 18 nt, Homo sapiens
aaagaacugaaagcacua

SEQ ID NO: 943885 - RNA, 14 nt, Homo sapiens
aaagaauucuucca

SEQ ID NO: 943886 - RNA, 14 nt, Homo sapiens
aaagaccuaccucc

SEQ ID NO: 943887 - RNA, 19 nt, Homo sapiens
aaagaccugaauaccacuu

SEQ ID NO: 943888 - RNA, 21 nt, Homo sapiens
aaagcaucaauacaaccagcc

SEQ ID NO: 943889 - RNA, 13 nt, Homo sapiens
aaagccuccucau

SEQ ID NO: 943890 - RNA, 17 nt, Homo sapiens
aaagcuaccauuuauca

SEQ ID NO: 943891 - RNA, 13 nt, Homo sapiens
aaaggaaugaacu

SEQ ID NO: 943892 - RNA, 13 nt, Homo sapiens
aaagguuguguag

SEQ ID NO: 943893 - RNA, 15 nt, Homo sapiens
aaaguaaagacugua

SEQ ID NO: 943894 - RNA, 19 nt, Homo sapiens
aaaguacaucucuacuaaa

SEQ ID NO: 943895 - RNA, 17 nt, Homo sapiens
aaagucccaacccaaug

SEQ ID NO: 943896 - RNA, 13 nt, Homo sapiens
aaaguuacacuuu

SEQ ID NO: 943897 - RNA, 16 nt, Homo sapiens
aaaguugagcgucauu

SEQ ID NO: 943898 - RNA, 16 nt, Homo sapiens
aaauaaaaaucucuuu

SEQ ID NO: 943899 - RNA, 17 nt, Homo sapiens
aaauaaagauauuguuc

SEQ ID NO: 943900 - RNA, 18 nt, Homo sapiens
aaauacagacuggaugua

SEQ ID NO: 943901 - RNA, 16 nt, Homo sapiens
aaauaccaacuguaca

SEQ ID NO: 943902 - RNA, 13 nt, Homo sapiens
aaauacuggugca

SEQ ID NO: 943903 - RNA, 22 nt, Homo sapiens
aaauauauauuauauauuuaca

SEQ ID NO: 943904 - RNA, 23 nt, Homo sapiens
aaauauauauuauauauuuacaa

SEQ ID NO: 943905 - RNA, 15 nt, Homo sapiens
aaauaugagagcaau

SEQ ID NO: 943906 - RNA, 20 nt, Homo sapiens
aaauauugucauaggauuaa

SEQ ID NO: 943907 - RNA, 17 nt, Homo sapiens
aaauauuuaccuugaaa

SEQ ID NO: 943908 - RNA, 17 nt, Homo sapiens
aaaucaaaccaggugca

SEQ ID NO: 943909 - RNA, 24 nt, Homo sapiens
aaaucccuuguucucaguggugca

SEQ ID NO: 943910 - RNA, 16 nt, Homo sapiens
aaaugaaaacagugug

SEQ ID NO: 943911 - RNA, 21 nt, Homo sapiens
aaaugaaagggaaacugggaa

SEQ ID NO: 943912 - RNA, 22 nt, Homo sapiens
aaaugcaauguaagcauacuuu

SEQ ID NO: 943913 - RNA, 18 nt, Homo sapiens
aaaugcuugcucaggcuc

SEQ ID NO: 943914 - RNA, 14 nt, Homo sapiens
aaauggaagcaauu

SEQ ID NO: 943915 - RNA, 11 nt, Homo sapiens
aaauggugguc

SEQ ID NO: 943916 - RNA, 21 nt, Homo sapiens
aaauuaauaucuuucugcaca

SEQ ID NO: 943917 - RNA, 19 nt, Homo sapiens
aaauuagcugggcauggug

SEQ ID NO: 943918 - RNA, 17 nt, Homo sapiens
aaauucagcauuugacc

SEQ ID NO: 943919 - RNA, 16 nt, Homo sapiens
aaauugguaauauaca

SEQ ID NO: 943920 - RNA, 16 nt, Homo sapiens
aaauuguuuagugaua

SEQ ID NO: 943921 - RNA, 20 nt, Homo sapiens
aaauuuacucacagcacuug

SEQ ID NO: 943922 - RNA, 13 nt, Homo sapiens
aacaacuaccuga

SEQ ID NO: 943923 - RNA, 24 nt, Homo sapiens
aacacucaguggcccauggcauuu

SEQ ID NO: 943924 - RNA, 12 nt, Homo sapiens
aacacucaugaa

SEQ ID NO: 943925 - RNA, 22 nt, Homo sapiens
aacagaagggaaauuucaauaa

SEQ ID NO: 943926 - RNA, 21 nt, Homo sapiens
aacagagcaagacuccaucuc

SEQ ID NO: 943927 - RNA, 21 nt, Homo sapiens
aacagauuuggaaagacugga

SEQ ID NO: 943928 - RNA, 21 nt, Homo sapiens
aacagcaugggccucaccucc

SEQ ID NO: 943929 - RNA, 21 nt, Homo sapiens
aacagccuaucuuugugugac

SEQ ID NO: 943930 - RNA, 17 nt, Homo sapiens
aacaguuuuagaauaca

SEQ ID NO: 943931 - RNA, 20 nt, Homo sapiens
aacauacuggccuggacugu

SEQ ID NO: 943932 - RNA, 10 nt, Homo sapiens
aacaucaaag

SEQ ID NO: 943933 - RNA, 14 nt, Homo sapiens
aacaucucugggaa

SEQ ID NO: 943934 - RNA, 15 nt, Homo sapiens
aacauucauagucuu

SEQ ID NO: 943935 - RNA, 20 nt, Homo sapiens
aaccaauagugaaaugccac

SEQ ID NO: 943936 - RNA, 17 nt, Homo sapiens
aaccacaauauccagca

SEQ ID NO: 943937 - RNA, 18 nt, Homo sapiens
aaccacaauauccagcaa

SEQ ID NO: 943938 - RNA, 17 nt, Homo sapiens
aaccaggacccugucca

SEQ ID NO: 943939 - RNA, 14 nt, Homo sapiens
aaccaggugcaauu

SEQ ID NO: 943940 - RNA, 16 nt, Homo sapiens
aaccaggugcaauuau

SEQ ID NO: 943941 - RNA, 13 nt, Homo sapiens
aaccaucucucuu

SEQ ID NO: 943942 - RNA, 15 nt, Homo sapiens
aaccauggcacuuga

SEQ ID NO: 943943 - RNA, 18 nt, Homo sapiens
aaccauggcacuugaugu

SEQ ID NO: 943944 - RNA, 18 nt, Homo sapiens
aaccauguauaugagcuu

SEQ ID NO: 943945 - RNA, 23 nt, Homo sapiens
aaccauguauaugagcuuauaaa

SEQ ID NO: 943946 - RNA, 14 nt, Homo sapiens
acccagaacuccau

SEQ ID NO: 943947 - RNA, 20 nt, Homo sapiens
acccagucuucuacacagau

SEQ ID NO: 943948 - RNA, 14 nt, Homo sapiens
acccaguucaguga

SEQ ID NO: 943949 - RNA, 15 nt, Homo sapiens
accccacgcugacca

SEQ ID NO: 943950 - RNA, 16 nt, Homo sapiens
accccagccauccagg

SEQ ID NO: 943951 - RNA, 14 nt, Homo sapiens
accccagggacugc

SEQ ID NO: 943952 - RNA, 17 nt, Homo sapiens
accccaucuuuacuaaa

SEQ ID NO: 943953 - RNA, 15 nt, Homo sapiens
acccccaggcaucug

SEQ ID NO: 943954 - RNA, 19 nt, Homo sapiens
acccccaguaaaaucaaau

SEQ ID NO: 943955 - RNA, 12 nt, Homo sapiens
accccugcugag

SEQ ID NO: 943956 - RNA, 19 nt, Homo sapiens
acccucacaagcaugaagu

SEQ ID NO: 943957 - RNA, 16 nt, Homo sapiens
acccucaucacuagga

SEQ ID NO: 943958 - RNA, 23 nt, Homo sapiens
acccuccguuuuucuacuagaua

SEQ ID NO: 943959 - RNA, 16 nt, Homo sapiens
acccugcccaccaaga

SEQ ID NO: 943960 - RNA, 23 nt, Homo sapiens
acccuuauaaaauccugugcaau

SEQ ID NO: 943961 - RNA, 15 nt, Homo sapiens
acccuugcugugaau

SEQ ID NO: 943962 - RNA, 21 nt, Homo sapiens
accggggaggcggagguugca

SEQ ID NO: 943963 - RNA, 17 nt, Homo sapiens
accuaccuuacuauuua

SEQ ID NO: 943964 - RNA, 14 nt, Homo sapiens
accuagacuguaaa

SEQ ID NO: 943965 - RNA, 15 nt, Homo sapiens
accucaaaugaauuc

SEQ ID NO: 943966 - RNA, 18 nt, Homo sapiens
accucaguuauuacaugu

SEQ ID NO: 943967 - RNA, 21 nt, Homo sapiens
accucauuuuucauacugaaa

SEQ ID NO: 943968 - RNA, 20 nt, Homo sapiens
accuccuauggguugucacc

SEQ ID NO: 943969 - RNA, 19 nt, Homo sapiens
accucgucaagagcaugca

SEQ ID NO: 943970 - RNA, 22 nt, Homo sapiens
accucgucaagagcaugcacau

SEQ ID NO: 943971 - RNA, 19 nt, Homo sapiens
accugguacccuccuggcu

SEQ ID NO: 943972 - RNA, 19 nt, Homo sapiens
accuggucugguugggcag

SEQ ID NO: 943973 - RNA, 15 nt, Homo sapiens
accuguaaucccagc

SEQ ID NO: 943974 - RNA, 14 nt, Homo sapiens
accuguagauucag

SEQ ID NO: 943975 - RNA, 16 nt, Homo sapiens
accuguagucccagcu

SEQ ID NO: 943976 - RNA, 22 nt, Homo sapiens
accuuauuaaugaucagcuaua

SEQ ID NO: 943977 - RNA, 21 nt, Homo sapiens
accuuggaauucgcuuucuaa

SEQ ID NO: 943978 - RNA, 21 nt, Homo sapiens
accuuugguuuuaaaagagaa

SEQ ID NO: 943979 - RNA, 10 nt, Homo sapiens
accuuuucau

SEQ ID NO: 943980 - RNA, 22 nt, Homo sapiens
accuuuugaggagccccagcua

SEQ ID NO: 943981 - RNA, 13 nt, Homo sapiens
acgauaaagggau

SEQ ID NO: 943982 - RNA, 18 nt, Homo sapiens
acggaaaaugccuguaaa

SEQ ID NO: 943983 - RNA, 20 nt, Homo sapiens
acggacugugcauacuuucc

SEQ ID NO: 943984 - RNA, 22 nt, Homo sapiens
acguagccugggcucacugugc

SEQ ID NO: 943985 - RNA, 20 nt, Homo sapiens
acgugguaugaaaugucuga

SEQ ID NO: 943986 - RNA, 15 nt, Homo sapiens
acguguaaacaggau

SEQ ID NO: 943987 - RNA, 20 nt, Homo sapiens
acguucgauuucuaccucag

SEQ ID NO: 943988 - RNA, 22 nt, Homo sapiens
acuaauugacuugcaaagaccu

SEQ ID NO: 943989 - RNA, 19 nt, Homo sapiens
acuacaguauuacucuuac

SEQ ID NO: 943990 - RNA, 12 nt, Homo sapiens
acuacuaccucu

SEQ ID NO: 943991 - RNA, 15 nt, Homo sapiens
acuagauacuacuuu

SEQ ID NO: 943992 - RNA, 18 nt, Homo sapiens
acuagccaaaccaggacc

SEQ ID NO: 943993 - RNA, 14 nt, Homo sapiens
acuauucauaagau

SEQ ID NO: 943994 - RNA, 18 nt, Homo sapiens
acuauuuaaagccuccuc

SEQ ID NO: 943995 - RNA, 14 nt, Homo sapiens
acuauuuauauaca

SEQ ID NO: 943996 - RNA, 16 nt, Homo sapiens
acucaauacuaccucu

SEQ ID NO: 943997 - RNA, 21 nt, Homo sapiens
acucaccacuaccagccagcc

SEQ ID NO: 943998 - RNA, 18 nt, Homo sapiens
acucaucugaaauguuac

SEQ ID NO: 943999 - RNA, 21 nt, Homo sapiens
acucaucugaaauguuacaaa

SEQ ID NO: 944000 - RNA, 16 nt, Homo sapiens
acucauuucaucucau

SEQ ID NO: 944001 - RNA, 15 nt, Homo sapiens
acuccagcugugaag

SEQ ID NO: 944002 - RNA, 22 nt, Homo sapiens
acuccagcuugggcaacagagc

SEQ ID NO: 944003 - RNA, 21 nt, Homo sapiens
acucgggaccaauacuacuga

SEQ ID NO: 944004 - RNA, 22 nt, Homo sapiens
acucgggaccaauacuacugac

SEQ ID NO: 944005 - RNA, 21 nt, Homo sapiens
acucuaaagucuguugauuaa

SEQ ID NO: 944006 - RNA, 17 nt, Homo sapiens
acucucgcacacacagu

SEQ ID NO: 944007 - RNA, 20 nt, Homo sapiens
acucucgcacacacagugau

SEQ ID NO: 944008 - RNA, 12 nt, Homo sapiens
acucucuguuca

SEQ ID NO: 944009 - RNA, 18 nt, Homo sapiens
acucuguuuccuggucag

SEQ ID NO: 944010 - RNA, 21 nt, Homo sapiens
acucuuccuuccuaauaggca

SEQ ID NO: 944011 - RNA, 15 nt, Homo sapiens
acugaggguggagca

SEQ ID NO: 944012 - RNA, 22 nt, Homo sapiens
acugauuaccuccuguguggaa

SEQ ID NO: 944013 - RNA, 14 nt, Homo sapiens
acugauuuaucuau

SEQ ID NO: 944014 - RNA, 19 nt, Homo sapiens
acugcacuccagccuggca

SEQ ID NO: 944015 - RNA, 16 nt, Homo sapiens
acuggaaccauuggca

SEQ ID NO: 944016 - RNA, 13 nt, Homo sapiens
acuggauguacca

SEQ ID NO: 944017 - RNA, 21 nt, Homo sapiens
acuggcagaucgcucacuguu

SEQ ID NO: 944018 - RNA, 20 nt, Homo sapiens
acugucaaggcugcuuagaa

SEQ ID NO: 944019 - RNA, 23 nt, Homo sapiens
acugugucauucuguuagauacu

SEQ ID NO: 944020 - RNA, 19 nt, Homo sapiens
acuguuucuggacccuuau

SEQ ID NO: 944021 - RNA, 16 nt, Homo sapiens
acuuaaauuccucaac

SEQ ID NO: 944022 - RNA, 19 nt, Homo sapiens
acuuacagaucuaucuccu

SEQ ID NO: 944023 - RNA, 19 nt, Homo sapiens
acuuaccucaaauuaagca

SEQ ID NO: 944024 - RNA, 15 nt, Homo sapiens
acuuagccauugaaa

SEQ ID NO: 944025 - RNA, 17 nt, Homo sapiens
acuucauauguaaucuc

SEQ ID NO: 944026 - RNA, 18 nt, Homo sapiens
acuucauauugcugagag

SEQ ID NO: 944027 - RNA, 18 nt, Homo sapiens
acuucucacucaccacua

SEQ ID NO: 944028 - RNA, 17 nt, Homo sapiens
acuugaaauucucauca

SEQ ID NO: 944029 - RNA, 20 nt, Homo sapiens
acuugaaauucucaucaguc

SEQ ID NO: 944030 - RNA, 21 nt, Homo sapiens
acuugccuguucagagcacuc

SEQ ID NO: 944031 - RNA, 20 nt, Homo sapiens
acuuggugggaccaugaaca

SEQ ID NO: 944032 - RNA, 19 nt, Homo sapiens
acuuguguuauauagccaa

SEQ ID NO: 944033 - RNA, 17 nt, Homo sapiens
acuuuaguuuguguuau

SEQ ID NO: 944034 - RNA, 15 nt, Homo sapiens
acuuuccaaacacca

SEQ ID NO: 944035 - RNA, 23 nt, Homo sapiens
acuuugcugucaaaacuacugac

SEQ ID NO: 944036 - RNA, 21 nt, Homo sapiens
acuuuggaguccccucaccuc

SEQ ID NO: 944037 - RNA, 18 nt, Homo sapiens
acuuuuuauuugcaacuu

SEQ ID NO: 944038 - RNA, 22 nt, Homo sapiens
agaaaaccucuccugaccccug

SEQ ID NO: 944039 - RNA, 14 nt, Homo sapiens
agaaaacugugauu

SEQ ID NO: 944040 - RNA, 17 nt, Homo sapiens
agaaaagggaguuuaaa

SEQ ID NO: 944041 - RNA, 22 nt, Homo sapiens
agaaaaugauguguacccaaac

SEQ ID NO: 944042 - RNA, 15 nt, Homo sapiens
agaaagaccaggcca

SEQ ID NO: 944043 - RNA, 19 nt, Homo sapiens
agaaauauggaacuuacau

SEQ ID NO: 944044 - RNA, 22 nt, Homo sapiens
agaaauugacacaaguggaccu

SEQ ID NO: 944045 - RNA, 20 nt, Homo sapiens
agaacguggugaccuuucac

SEQ ID NO: 944046 - RNA, 15 nt, Homo sapiens
agaacucauucauag

SEQ ID NO: 944047 - RNA, 14 nt, Homo sapiens
agaacuccauacca

SEQ ID NO: 944048 - RNA, 18 nt, Homo sapiens
agaacucgcgcucaguaa

SEQ ID NO: 944049 - RNA, 15 nt, Homo sapiens
agaagggcacuguaa

SEQ ID NO: 944050 - RNA, 16 nt, Homo sapiens
agaagucggaauguca

SEQ ID NO: 944051 - RNA, 13 nt, Homo sapiens
agaauaugacuuu

SEQ ID NO: 944052 - RNA, 18 nt, Homo sapiens
agaaucucuugaaccugg

SEQ ID NO: 944053 - RNA, 21 nt, Homo sapiens
agaauggugcucuuaucuuuc

SEQ ID NO: 944054 - RNA, 15 nt, Homo sapiens
auucuguauugccau

SEQ ID NO: 944055 - RNA, 15 nt, Homo sapiens
auucuuagugacuuu

SEQ ID NO: 944056 - RNA, 17 nt, Homo sapiens
auucuugaggucuugag

SEQ ID NO: 944057 - RNA, 20 nt, Homo sapiens
auugaaaagaccuacagacu

SEQ ID NO: 944058 - RNA, 23 nt, Homo sapiens
auugaauuacggaaaaugccugu

SEQ ID NO: 944059 - RNA, 21 nt, Homo sapiens
auugcucagcccgcuuggcca

SEQ ID NO: 944060 - RNA, 21 nt, Homo sapiens
auugcugggaggacuggaccg

SEQ ID NO: 944061 - RNA, 21 nt, Homo sapiens
auugcuguccuggaggggcug

SEQ ID NO: 944062 - RNA, 14 nt, Homo sapiens
auugcuugagccca

SEQ ID NO: 944063 - RNA, 17 nt, Homo sapiens
auugcuugagcccagaa

SEQ ID NO: 944064 - RNA, 13 nt, Homo sapiens
auuguaacgacuu

SEQ ID NO: 944065 - RNA, 17 nt, Homo sapiens
auugucgguuaccucug

SEQ ID NO: 944066 - RNA, 20 nt, Homo sapiens
auuguggucacaacuugaug

SEQ ID NO: 944067 - RNA, 23 nt, Homo sapiens
auuuaaauuacaauuuuaucugu

SEQ ID NO: 944068 - RNA, 15 nt, Homo sapiens
auuuaacauuaucua

SEQ ID NO: 944069 - RNA, 17 nt, Homo sapiens
auuuaagaugugaaaau

SEQ ID NO: 944070 - RNA, 18 nt, Homo sapiens
auuuacuuuuuauuugca

SEQ ID NO: 944071 - RNA, 18 nt, Homo sapiens
auuuagguuuuuauuagu

SEQ ID NO: 944072 - RNA, 19 nt, Homo sapiens
auuuauaaaacuucucaag

SEQ ID NO: 944073 - RNA, 21 nt, Homo sapiens
auuuauaaaacuucucaagau

SEQ ID NO: 944074 - RNA, 21 nt, Homo sapiens
auuuauauacaagugauaaua

SEQ ID NO: 944075 - RNA, 22 nt, Homo sapiens
auuuaucaagcauuuaccaugu

SEQ ID NO: 944076 - RNA, 15 nt, Homo sapiens
auuuaugaugcacuu

SEQ ID NO: 944077 - RNA, 22 nt, Homo sapiens
auuuaugaugcacuuauucaau

SEQ ID NO: 944078 - RNA, 15 nt, Homo sapiens
auuuaugucccugac

SEQ ID NO: 944079 - RNA, 17 nt, Homo sapiens
auuucaguaagcugugu

SEQ ID NO: 944080 - RNA, 24 nt, Homo sapiens
auuucuaaauguuuggcauguaaa

SEQ ID NO: 944081 - RNA, 20 nt, Homo sapiens
auuucuuuauuuucuucucc

SEQ ID NO: 944082 - RNA, 23 nt, Homo sapiens
auuucuuucuuugcaccaaagac

SEQ ID NO: 944083 - RNA, 14 nt, Homo sapiens
auuugaaaauggac

SEQ ID NO: 944084 - RNA, 23 nt, Homo sapiens
auuugaaaccccuguaggccuca

SEQ ID NO: 944085 - RNA, 16 nt, Homo sapiens
auuugaaauauggucu

SEQ ID NO: 944086 - RNA, 14 nt, Homo sapiens
auuugaugcauguc

SEQ ID NO: 944087 - RNA, 14 nt, Homo sapiens
auuugcugaccaca

SEQ ID NO: 944088 - RNA, 20 nt, Homo sapiens
auuugcuuuggaaguuuuaa

SEQ ID NO: 944089 - RNA, 18 nt, Homo sapiens
auuuguuucuuucucuga

SEQ ID NO: 944090 - RNA, 16 nt, Homo sapiens
auuuuaaggauaugau

SEQ ID NO: 944091 - RNA, 19 nt, Homo sapiens
auuuuaccaaagcaucaau

SEQ ID NO: 944092 - RNA, 21 nt, Homo sapiens
auuuuauaggcauaccuccua

SEQ ID NO: 944093 - RNA, 22 nt, Homo sapiens
auuuucaagagucuaauagucu

SEQ ID NO: 944094 - RNA, 14 nt, Homo sapiens
auuuucagcauuaa

SEQ ID NO: 944095 - RNA, 22 nt, Homo sapiens
auuuucucccucuuucuuccca

SEQ ID NO: 944096 - RNA, 17 nt, Homo sapiens
auuuugguuuguguauc

SEQ ID NO: 944097 - RNA, 21 nt, Homo sapiens
auuuuguaauaauaaagaaua

SEQ ID NO: 944098 - RNA, 17 nt, Homo sapiens
auuuuguguaagaaaua

SEQ ID NO: 944099 - RNA, 17 nt, Homo sapiens
auuuuucaagagcuccu

SEQ ID NO: 944100 - RNA, 15 nt, Homo sapiens
auuuuugcuuagcuc

SEQ ID NO: 944101 - RNA, 13 nt, Homo sapiens
caaaaacuuugga

SEQ ID NO: 944102 - RNA, 19 nt, Homo sapiens
caaaaagggaaguaagcaa

SEQ ID NO: 944103 - RNA, 12 nt, Homo sapiens
caaaacaauuaa

SEQ ID NO: 944104 - RNA, 18 nt, Homo sapiens
caaaacgcuacugaguca

SEQ ID NO: 944105 - RNA, 23 nt, Homo sapiens
caaaauauuucagugaauuugca

SEQ ID NO: 944106 - RNA, 21 nt, Homo sapiens
caaaaugccauuuagcaauaa

SEQ ID NO: 944107 - RNA, 18 nt, Homo sapiens
caaaauguaugucugguu

SEQ ID NO: 944108 - RNA, 16 nt, Homo sapiens
caaaccaggugcaauu

SEQ ID NO: 944109 - RNA, 15 nt, Homo sapiens
caaagaaacuugaag

SEQ ID NO: 944110 - RNA, 24 nt, Homo sapiens
caaagaacugaaagcacuagagca

SEQ ID NO: 944111 - RNA, 20 nt, Homo sapiens
caaagaaugggcuugaaaca

SEQ ID NO: 944112 - RNA, 13 nt, Homo sapiens
caaagaggcugcc

SEQ ID NO: 944113 - RNA, 21 nt, Homo sapiens
caaagauuaaaugugucauug

SEQ ID NO: 944114 - RNA, 14 nt, Homo sapiens
caaauaaaaauccu

SEQ ID NO: 944115 - RNA, 22 nt, Homo sapiens
caaaucguccagcgaccuuccu

SEQ ID NO: 944116 - RNA, 14 nt, Homo sapiens
caaauggccucaug

SEQ ID NO: 944117 - RNA, 23 nt, Homo sapiens
caaaugugcuggucacccuucaa

SEQ ID NO: 944118 - RNA, 22 nt, Homo sapiens
caacaaugacuuaaccauauaa

SEQ ID NO: 944119 - RNA, 14 nt, Homo sapiens
caacagcaaaggaa

SEQ ID NO: 944120 - RNA, 13 nt, Homo sapiens
caacauuacuguu

SEQ ID NO: 944121 - RNA, 20 nt, Homo sapiens
caacauuacuguuaacugug

SEQ ID NO: 944122 - RNA, 18 nt, Homo sapiens
caaccauuugaaaccccu

SEQ ID NO: 944123 - RNA, 17 nt, Homo sapiens
caaccugggcauuccuu

SEQ ID NO: 944124 - RNA, 21 nt, Homo sapiens
caacguucgauuucuaccuca

SEQ ID NO: 944125 - RNA, 22 nt, Homo sapiens
caacguucgauuucuaccucag

SEQ ID NO: 944126 - RNA, 16 nt, Homo sapiens
caacuccucaugucuu

SEQ ID NO: 944127 - RNA, 18 nt, Homo sapiens
caacuuuuaauuacuguu

SEQ ID NO: 944128 - RNA, 20 nt, Homo sapiens
caagaaguucuuguucuuca

SEQ ID NO: 944129 - RNA, 19 nt, Homo sapiens
caagagaucuuucuuucca

SEQ ID NO: 944130 - RNA, 13 nt, Homo sapiens
caagagcaugcac

SEQ ID NO: 944131 - RNA, 16 nt, Homo sapiens
caagagcaugcacaug

SEQ ID NO: 944132 - RNA, 20 nt, Homo sapiens
caagaucgccccacugcacu

SEQ ID NO: 944133 - RNA, 16 nt, Homo sapiens
caagcaugaagugcug

SEQ ID NO: 944134 - RNA, 13 nt, Homo sapiens
caaggcaguuaau

SEQ ID NO: 944135 - RNA, 15 nt, Homo sapiens
caaggccagugcuaa

SEQ ID NO: 944136 - RNA, 12 nt, Homo sapiens
caaguaauacaa

SEQ ID NO: 944137 - RNA, 19 nt, Homo sapiens
caaguaauacguuuugaca

SEQ ID NO: 944138 - RNA, 23 nt, Homo sapiens
caagucgcuccuagguucuuaag

SEQ ID NO: 944139 - RNA, 15 nt, Homo sapiens
caagucuguaccuca

SEQ ID NO: 944140 - RNA, 15 nt, Homo sapiens
caaguugcaucagaa

SEQ ID NO: 944141 - RNA, 13 nt, Homo sapiens
caauaaacccuca

SEQ ID NO: 944142 - RNA, 19 nt, Homo sapiens
caauaaacccucagagccu

SEQ ID NO: 944143 - RNA, 13 nt, Homo sapiens
caauacuaccucu

SEQ ID NO: 944144 - RNA, 17 nt, Homo sapiens
caauagugaaaugccac

SEQ ID NO: 944145 - RNA, 17 nt, Homo sapiens
caauauuugguauuuca

SEQ ID NO: 944146 - RNA, 17 nt, Homo sapiens
caaucauaauaccugcu

SEQ ID NO: 944147 - RNA, 16 nt, Homo sapiens
caaucuccuuacugug

SEQ ID NO: 944148 - RNA, 17 nt, Homo sapiens
caaucuccuuacugugu

SEQ ID NO: 944149 - RNA, 22 nt, Homo sapiens
caaucuccuuacuguguuucag

SEQ ID NO: 944150 - RNA, 17 nt, Homo sapiens
caaugugaacuuuauua

SEQ ID NO: 944151 - RNA, 20 nt, Homo sapiens
caaugugcuuucuaaucucc

SEQ ID NO: 944152 - RNA, 18 nt, Homo sapiens
caauucuggacagacaga

SEQ ID NO: 944153 - RNA, 13 nt, Homo sapiens
caauuugaagaga

SEQ ID NO: 944154 - RNA, 11 nt, Homo sapiens
cacaacaaucc

SEQ ID NO: 944155 - RNA, 23 nt, Homo sapiens
cacaagaaguucuuguucuucag

SEQ ID NO: 944156 - RNA, 18 nt, Homo sapiens
cacaccaaguaccaguau

SEQ ID NO: 944157 - RNA, 23 nt, Homo sapiens
cacaccuuuguccacugucaggg

SEQ ID NO: 944158 - RNA, 21 nt, Homo sapiens
cacauaucagcaggaguaaua

SEQ ID NO: 944159 - RNA, 23 nt, Homo sapiens
cacauucuuuucuucugcuuccc

SEQ ID NO: 944160 - RNA, 14 nt, Homo sapiens
caccaaaugugcuu

SEQ ID NO: 944161 - RNA, 11 nt, Homo sapiens
cccauccagcc

SEQ ID NO: 944162 - RNA, 19 nt, Homo sapiens
cccaugaccccaaagccaa

SEQ ID NO: 944163 - RNA, 14 nt, Homo sapiens
ccccagccauccag

SEQ ID NO: 944164 - RNA, 22 nt, Homo sapiens
ccccaggcaucuguuagcagag

SEQ ID NO: 944165 - RNA, 19 nt, Homo sapiens
ccccaguuccucccaggaa

SEQ ID NO: 944166 - RNA, 22 nt, Homo sapiens
ccccauccagccuccagggcau

SEQ ID NO: 944167 - RNA, 18 nt, Homo sapiens
cccccauucacuuuguca

SEQ ID NO: 944168 - RNA, 12 nt, Homo sapiens
ccccggcccacc

SEQ ID NO: 944169 - RNA, 18 nt, Homo sapiens
ccccucacucuguuuccu

SEQ ID NO: 944170 - RNA, 22 nt, Homo sapiens
ccccugaaguauuuuuuaaucc

SEQ ID NO: 944171 - RNA, 16 nt, Homo sapiens
ccccuguagcagucac

SEQ ID NO: 944172 - RNA, 17 nt, Homo sapiens
ccccuuauccuucuccc

SEQ ID NO: 944173 - RNA, 23 nt, Homo sapiens
cccgcuauuaucagaucaugccc

SEQ ID NO: 944174 - RNA, 21 nt, Homo sapiens
cccggggcggcaggaaggggg

SEQ ID NO: 944175 - RNA, 13 nt, Homo sapiens
cccuaccagacac

SEQ ID NO: 944176 - RNA, 21 nt, Homo sapiens
cccuaccagacacugcugcug

SEQ ID NO: 944177 - RNA, 18 nt, Homo sapiens
cccuacuauucaguggcg

SEQ ID NO: 944178 - RNA, 13 nt, Homo sapiens
cccucagagccuc

SEQ ID NO: 944179 - RNA, 21 nt, Homo sapiens
cccuccaagucuguaccucaa

SEQ ID NO: 944180 - RNA, 16 nt, Homo sapiens
cccucucucaguguca

SEQ ID NO: 944181 - RNA, 22 nt, Homo sapiens
cccugcccuucccccugcaaaa

SEQ ID NO: 944182 - RNA, 15 nt, Homo sapiens
cccugggccaacaga

SEQ ID NO: 944183 - RNA, 21 nt, Homo sapiens
cccugggugcaggacacuggu

SEQ ID NO: 944184 - RNA, 14 nt, Homo sapiens
cccuguguccccaa

SEQ ID NO: 944185 - RNA, 19 nt, Homo sapiens
cccuucucuccugcuuccu

SEQ ID NO: 944186 - RNA, 12 nt, Homo sapiens
cccuucugggca

SEQ ID NO: 944187 - RNA, 16 nt, Homo sapiens
cccuuucacacuggau

SEQ ID NO: 944188 - RNA, 19 nt, Homo sapiens
ccgaggagcuggggcgggc

SEQ ID NO: 944189 - RNA, 15 nt, Homo sapiens
ccgauuccaccaaau

SEQ ID NO: 944190 - RNA, 12 nt, Homo sapiens
ccuaacuuucuu

SEQ ID NO: 944191 - RNA, 20 nt, Homo sapiens
ccuaacuuuucuacguauaa

SEQ ID NO: 944192 - RNA, 14 nt, Homo sapiens
ccuaaggugucuga

SEQ ID NO: 944193 - RNA, 18 nt, Homo sapiens
ccuacaacucacauuaga

SEQ ID NO: 944194 - RNA, 15 nt, Homo sapiens
ccuaccaacuuuacu

SEQ ID NO: 944195 - RNA, 14 nt, Homo sapiens
ccuaccacuuuucu

SEQ ID NO: 944196 - RNA, 19 nt, Homo sapiens
ccuacccccaguaaaauca

SEQ ID NO: 944197 - RNA, 21 nt, Homo sapiens
ccuaccuuagaaaacaaguau

SEQ ID NO: 944198 - RNA, 19 nt, Homo sapiens
ccuacuagucaccagagac

SEQ ID NO: 944199 - RNA, 21 nt, Homo sapiens
ccuagaaaggaacugcaauaa

SEQ ID NO: 944200 - RNA, 23 nt, Homo sapiens
ccuagagguggaguucuuagcua

SEQ ID NO: 944201 - RNA, 17 nt, Homo sapiens
ccuagggauauaauucu

SEQ ID NO: 944202 - RNA, 14 nt, Homo sapiens
ccuaucauguuaac

SEQ ID NO: 944203 - RNA, 23 nt, Homo sapiens
ccucaaaggagcaagccuugaaa

SEQ ID NO: 944204 - RNA, 16 nt, Homo sapiens
ccucaaauuaagcaua

SEQ ID NO: 944205 - RNA, 19 nt, Homo sapiens
ccucaacuauucuguucca

SEQ ID NO: 944206 - RNA, 13 nt, Homo sapiens
ccucacuggggca

SEQ ID NO: 944207 - RNA, 20 nt, Homo sapiens
ccucaggugaaacuccagau

SEQ ID NO: 944208 - RNA, 19 nt, Homo sapiens
ccucauccaugcugugcug

SEQ ID NO: 944209 - RNA, 22 nt, Homo sapiens
ccucaugucuucucacaagcca

SEQ ID NO: 944210 - RNA, 20 nt, Homo sapiens
ccuccaagucuguaccucaa

SEQ ID NO: 944211 - RNA, 19 nt, Homo sapiens
ccuccaucaugaagaagcu

SEQ ID NO: 944212 - RNA, 13 nt, Homo sapiens
ccuccccaguuca

SEQ ID NO: 944213 - RNA, 16 nt, Homo sapiens
ccucccccaguguccc

SEQ ID NO: 944214 - RNA, 18 nt, Homo sapiens
ccuccuauggguugucac

SEQ ID NO: 944215 - RNA, 13 nt, Homo sapiens
ccucuaagguugg

SEQ ID NO: 944216 - RNA, 12 nt, Homo sapiens
ccucucaccaaa

SEQ ID NO: 944217 - RNA, 22 nt, Homo sapiens
ccucucagauucuuaucuggca

SEQ ID NO: 944218 - RNA, 16 nt, Homo sapiens
ccucucggugaccucc

SEQ ID NO: 944219 - RNA, 16 nt, Homo sapiens
ccucucucagugucaa

SEQ ID NO: 944220 - RNA, 12 nt, Homo sapiens
ccucucuuugac

SEQ ID NO: 944221 - RNA, 17 nt, Homo sapiens
ccucuuucuucccauga

SEQ ID NO: 944222 - RNA, 18 nt, Homo sapiens
ccugacacggacugugca

SEQ ID NO: 944223 - RNA, 15 nt, Homo sapiens
ccugaggaagaugac

SEQ ID NO: 944224 - RNA, 23 nt, Homo sapiens
ccugcacuggggagcccgucuca

SEQ ID NO: 944225 - RNA, 23 nt, Homo sapiens
ccugcugcagucacguguaaaca

SEQ ID NO: 944226 - RNA, 21 nt, Homo sapiens
ccugcuuccuccagggaaccc

SEQ ID NO: 944227 - RNA, 15 nt, Homo sapiens
ccuggaggcacugaa

SEQ ID NO: 944228 - RNA, 15 nt, Homo sapiens
ccuggauaacuguaa

SEQ ID NO: 944229 - RNA, 22 nt, Homo sapiens
ccuggauaacuguaaaagggcu

SEQ ID NO: 944230 - RNA, 18 nt, Homo sapiens
ccuggcacuaacguugag

SEQ ID NO: 944231 - RNA, 19 nt, Homo sapiens
ccuggcuaagaucaugucu

SEQ ID NO: 944232 - RNA, 13 nt, Homo sapiens
ccugggaacauca

SEQ ID NO: 944233 - RNA, 18 nt, Homo sapiens
ccugggcauuccuuggga

SEQ ID NO: 944234 - RNA, 23 nt, Homo sapiens
ccugggcugucugucaccagcua

SEQ ID NO: 944235 - RNA, 19 nt, Homo sapiens
ccugggguucuuuuugcca

SEQ ID NO: 944236 - RNA, 22 nt, Homo sapiens
ccuggucagugguggucuucaa

SEQ ID NO: 944237 - RNA, 17 nt, Homo sapiens
ccugguggcaccagaug

SEQ ID NO: 944238 - RNA, 22 nt, Homo sapiens
ccugguggcuucagcaguccuu

SEQ ID NO: 944239 - RNA, 15 nt, Homo sapiens
ccuguaaucccagcu

SEQ ID NO: 944240 - RNA, 23 nt, Homo sapiens
ccuguauaaguggaggcacuuua

SEQ ID NO: 944241 - RNA, 15 nt, Homo sapiens
ccuguccuaucacuc

SEQ ID NO: 944242 - RNA, 18 nt, Homo sapiens
ccugugucugcuguagaa

SEQ ID NO: 944243 - RNA, 17 nt, Homo sapiens
ccuguguugugcuggga

SEQ ID NO: 944244 - RNA, 19 nt, Homo sapiens
ccuguucagagcacucauu

SEQ ID NO: 944245 - RNA, 18 nt, Homo sapiens
ccuuaaucccagcacuuu

SEQ ID NO: 944246 - RNA, 19 nt, Homo sapiens
ccuuauuaaugaucagcua

SEQ ID NO: 944247 - RNA, 22 nt, Homo sapiens
ccuucacuuccaucacaagaaa

SEQ ID NO: 944248 - RNA, 16 nt, Homo sapiens
ccuucagacacccuca

SEQ ID NO: 944249 - RNA, 21 nt, Homo sapiens
ccuucauugccacacuuggug

SEQ ID NO: 944250 - RNA, 15 nt, Homo sapiens
ccuucccccugcaaa

SEQ ID NO: 944251 - RNA, 18 nt, Homo sapiens
ccuucccccugcaaaaag

SEQ ID NO: 944252 - RNA, 19 nt, Homo sapiens
ccuucucuacacucuugua

SEQ ID NO: 944253 - RNA, 18 nt, Homo sapiens
ccuucugguuuuaggaaa

SEQ ID NO: 944254 - RNA, 16 nt, Homo sapiens
ccuugagaagugggag

SEQ ID NO: 944255 - RNA, 17 nt, Homo sapiens
ccuuggggucacuccuu

SEQ ID NO: 944256 - RNA, 20 nt, Homo sapiens
ccuuugguuuuaaaagagaa

SEQ ID NO: 944257 - RNA, 18 nt, Homo sapiens
ccuuuuccaugacugugg

SEQ ID NO: 944258 - RNA, 17 nt, Homo sapiens
ccuuuuuccauaguguu

SEQ ID NO: 944259 - RNA, 19 nt, Homo sapiens
cgaaccaugccuuccucag

SEQ ID NO: 944260 - RNA, 23 nt, Homo sapiens
cgagagaaagggagugcaugugc

SEQ ID NO: 944261 - RNA, 21 nt, Homo sapiens
cgagaucaugccauugcauuc

SEQ ID NO: 944262 - RNA, 22 nt, Homo sapiens
cgaggucaggagauggagacca

SEQ ID NO: 944263 - RNA, 21 nt, Homo sapiens
cgaggucaugccacugcacug

SEQ ID NO: 944264 - RNA, 14 nt, Homo sapiens
cgaguaacuccccu

SEQ ID NO: 944265 - RNA, 15 nt, Homo sapiens
cgagugcacugcauu

SEQ ID NO: 944266 - RNA, 18 nt, Homo sapiens
cgcacacacagugauucc

SEQ ID NO: 944267 - RNA, 14 nt, Homo sapiens
cgccacgcuugugu

SEQ ID NO: 944268 - RNA, 17 nt, Homo sapiens
cgccugcgccgcugugc

SEQ ID NO: 944269 - RNA, 23 nt, Homo sapiens
cugaggacgagacccccauccag

SEQ ID NO: 944270 - RNA, 19 nt, Homo sapiens
cugaggaggguacuuuucc

SEQ ID NO: 944271 - RNA, 23 nt, Homo sapiens
cugagggcagcuuugcaaaauga

SEQ ID NO: 944272 - RNA, 17 nt, Homo sapiens
cugagucacaauaaaga

SEQ ID NO: 944273 - RNA, 17 nt, Homo sapiens
cugaguguuuaauuuca

SEQ ID NO: 944274 - RNA, 13 nt, Homo sapiens
cugauaaacacaa

SEQ ID NO: 944275 - RNA, 15 nt, Homo sapiens
cugaugggaaaacug

SEQ ID NO: 944276 - RNA, 11 nt, Homo sapiens
cugcaaaaaga

SEQ ID NO: 944277 - RNA, 19 nt, Homo sapiens
cugcaaccucaaaggagca

SEQ ID NO: 944278 - RNA, 20 nt, Homo sapiens
cugcacagaaauuuucaauu

SEQ ID NO: 944279 - RNA, 20 nt, Homo sapiens
cugcaguaugggaucugaua

SEQ ID NO: 944280 - RNA, 18 nt, Homo sapiens
cugccagauauugcccag

SEQ ID NO: 944281 - RNA, 15 nt, Homo sapiens
cugccccucucacca

SEQ ID NO: 944282 - RNA, 17 nt, Homo sapiens
cugccccucucaccaaa

SEQ ID NO: 944283 - RNA, 15 nt, Homo sapiens
cugcuaacaagucac

SEQ ID NO: 944284 - RNA, 19 nt, Homo sapiens
cugcuaacaagucaccaaa

SEQ ID NO: 944285 - RNA, 16 nt, Homo sapiens
cugcuauaacuaugac

SEQ ID NO: 944286 - RNA, 22 nt, Homo sapiens
cugcucccugacagcaccugaa

SEQ ID NO: 944287 - RNA, 14 nt, Homo sapiens
cugcucuccuggga

SEQ ID NO: 944288 - RNA, 21 nt, Homo sapiens
cugcuggaaggcagcuugugg

SEQ ID NO: 944289 - RNA, 15 nt, Homo sapiens
cuggaaaaaggugaa

SEQ ID NO: 944290 - RNA, 17 nt, Homo sapiens
cuggaaucuggagacca

SEQ ID NO: 944291 - RNA, 13 nt, Homo sapiens
cuggacacugggc

SEQ ID NO: 944292 - RNA, 16 nt, Homo sapiens
cuggacauucgaggaa

SEQ ID NO: 944293 - RNA, 19 nt, Homo sapiens
cuggagugcaguggcgcau

SEQ ID NO: 944294 - RNA, 19 nt, Homo sapiens
cuggcagagagcacaguga

SEQ ID NO: 944295 - RNA, 20 nt, Homo sapiens
cuggcagagagcacagugau

SEQ ID NO: 944296 - RNA, 22 nt, Homo sapiens
cuggcagagagcacagugauca

SEQ ID NO: 944297 - RNA, 15 nt, Homo sapiens
cuggcaggaugcuga

SEQ ID NO: 944298 - RNA, 14 nt, Homo sapiens
cuggcuguggacca

SEQ ID NO: 944299 - RNA, 22 nt, Homo sapiens
cugggcaacagagcaagaccuc

SEQ ID NO: 944300 - RNA, 10 nt, Homo sapiens
cugggccaug

SEQ ID NO: 944301 - RNA, 15 nt, Homo sapiens
cugggcucacugugc

SEQ ID NO: 944302 - RNA, 21 nt, Homo sapiens
cugggcugucugucaccagcu

SEQ ID NO: 944303 - RNA, 21 nt, Homo sapiens
cuggggaucuucccacaggag

SEQ ID NO: 944304 - RNA, 17 nt, Homo sapiens
cuggggcagaaacacuc

SEQ ID NO: 944305 - RNA, 15 nt, Homo sapiens
cugggguggggauca

SEQ ID NO: 944306 - RNA, 18 nt, Homo sapiens
cugggugcaggacacugg

SEQ ID NO: 944307 - RNA, 21 nt, Homo sapiens
cuggucagcauguacuccccu

SEQ ID NO: 944308 - RNA, 24 nt, Homo sapiens
cugguccuaaccagugagcacugg

SEQ ID NO: 944309 - RNA, 22 nt, Homo sapiens
cuguaaucccagcuacuccggg

SEQ ID NO: 944310 - RNA, 23 nt, Homo sapiens
cuguaaucccagcuacuccggga

SEQ ID NO: 944311 - RNA, 22 nt, Homo sapiens
cuguagaaaaaaaaauucacau

SEQ ID NO: 944312 - RNA, 15 nt, Homo sapiens
cugucauaacaucca

SEQ ID NO: 944313 - RNA, 15 nt, Homo sapiens
cugucauuacgucaa

SEQ ID NO: 944314 - RNA, 16 nt, Homo sapiens
cuguccccuaccccca

SEQ ID NO: 944315 - RNA, 14 nt, Homo sapiens
cugucucaucacau

SEQ ID NO: 944316 - RNA, 19 nt, Homo sapiens
cugucugucaccagcuauc

SEQ ID NO: 944317 - RNA, 22 nt, Homo sapiens
cugugauguuuguguauguggg

SEQ ID NO: 944318 - RNA, 13 nt, Homo sapiens
cugugcuuuucag

SEQ ID NO: 944319 - RNA, 13 nt, Homo sapiens
cuguggaugcuuc

SEQ ID NO: 944320 - RNA, 16 nt, Homo sapiens
cugugggcaagccuaa

SEQ ID NO: 944321 - RNA, 19 nt, Homo sapiens
cuguguaaacucaucugaa

SEQ ID NO: 944322 - RNA, 22 nt, Homo sapiens
cuguguauuuucagucaaaacu

SEQ ID NO: 944323 - RNA, 22 nt, Homo sapiens
cuguguccccaaggagucccua

SEQ ID NO: 944324 - RNA, 17 nt, Homo sapiens
cuguucagagcacucau

SEQ ID NO: 944325 - RNA, 19 nt, Homo sapiens
cuguuuaaucauaguuacu

SEQ ID NO: 944326 - RNA, 15 nt, Homo sapiens
cuguuuucucucggc

SEQ ID NO: 944327 - RNA, 23 nt, Homo sapiens
cuuaaaaaaauagaaauuauucu

SEQ ID NO: 944328 - RNA, 17 nt, Homo sapiens
cuuaaaacaaagccaug

SEQ ID NO: 944329 - RNA, 14 nt, Homo sapiens
cuuaacaguuuuag

SEQ ID NO: 944330 - RNA, 22 nt, Homo sapiens
cuuaauaagauauuuaguaaua

SEQ ID NO: 944331 - RNA, 21 nt, Homo sapiens
cuuacaacgccgagugcacug

SEQ ID NO: 944332 - RNA, 20 nt, Homo sapiens
cuuagaacauuuuaauucau

SEQ ID NO: 944333 - RNA, 13 nt, Homo sapiens
cuuagagggguga

SEQ ID NO: 944334 - RNA, 20 nt, Homo sapiens
cuuaggaaggccuucaggag

SEQ ID NO: 944335 - RNA, 23 nt, Homo sapiens
cuuaggccuuccucucuccagau

SEQ ID NO: 944336 - RNA, 17 nt, Homo sapiens
cuuaguuaucaguauuu

SEQ ID NO: 944337 - RNA, 13 nt, Homo sapiens
cuucaaacuuuag

SEQ ID NO: 944338 - RNA, 22 nt, Homo sapiens
cuucacagcuaagaugccaugu

SEQ ID NO: 944339 - RNA, 20 nt, Homo sapiens
cuuccaacccgccggucuca

SEQ ID NO: 944340 - RNA, 16 nt, Homo sapiens
cuuccaguguccuuag

SEQ ID NO: 944341 - RNA, 16 nt, Homo sapiens
cuucccccugcaaaaa

SEQ ID NO: 944342 - RNA, 12 nt, Homo sapiens
cuuccuauccau

SEQ ID NO: 944343 - RNA, 19 nt, Homo sapiens
cuuccuuagccuugcucag

SEQ ID NO: 944344 - RNA, 15 nt, Homo sapiens
cuucuauggggucua

SEQ ID NO: 944345 - RNA, 19 nt, Homo sapiens
cuucucaaauuagcugcaa

SEQ ID NO: 944346 - RNA, 19 nt, Homo sapiens
cuucucagauuucugagga

SEQ ID NO: 944347 - RNA, 20 nt, Homo sapiens
cuucucagauuucugaggaa

SEQ ID NO: 944348 - RNA, 16 nt, Homo sapiens
cuucugauaaacacaa

SEQ ID NO: 944349 - RNA, 14 nt, Homo sapiens
cuucugcaacaucu

SEQ ID NO: 944350 - RNA, 22 nt, Homo sapiens
cuucuguugcccuugugcucca

SEQ ID NO: 944351 - RNA, 16 nt, Homo sapiens
cuugaugauuuuuaac

SEQ ID NO: 944352 - RNA, 21 nt, Homo sapiens
cuugcaaagaccuaccuccag

SEQ ID NO: 944353 - RNA, 15 nt, Homo sapiens
cuugcauagucaaua

SEQ ID NO: 944354 - RNA, 20 nt, Homo sapiens
cuugcaugcuugcauaagag

SEQ ID NO: 944355 - RNA, 16 nt, Homo sapiens
cuugcuuuccugcauc

SEQ ID NO: 944356 - RNA, 17 nt, Homo sapiens
cuuggggaaauggggcu

SEQ ID NO: 944357 - RNA, 20 nt, Homo sapiens
cuuguauauauggaucagag

SEQ ID NO: 944358 - RNA, 18 nt, Homo sapiens
cuuguaucccuagugcuc

SEQ ID NO: 944359 - RNA, 22 nt, Homo sapiens
cuuguauuaaacucuucacaaa

SEQ ID NO: 944360 - RNA, 21 nt, Homo sapiens
cuugugcuccagucauugcac

SEQ ID NO: 944361 - RNA, 13 nt, Homo sapiens
cuuguugucucca

SEQ ID NO: 944362 - RNA, 23 nt, Homo sapiens
cuuguuucagcuucucugcuaga

SEQ ID NO: 944363 - RNA, 20 nt, Homo sapiens
cuuuaaugauaugcuuguaa

SEQ ID NO: 944364 - RNA, 15 nt, Homo sapiens
cuuuauuccuuucag

SEQ ID NO: 944365 - RNA, 21 nt, Homo sapiens
cuuucacccgcuccuacagcu

SEQ ID NO: 944366 - RNA, 10 nt, Homo sapiens
cuuucaggaa

SEQ ID NO: 944367 - RNA, 18 nt, Homo sapiens
cuuucauuugcuuuggaa

SEQ ID NO: 944368 - RNA, 16 nt, Homo sapiens
cuuuccaaacaccacu

SEQ ID NO: 944369 - RNA, 18 nt, Homo sapiens
cuuucuaaaggaaaucaa

SEQ ID NO: 944370 - RNA, 13 nt, Homo sapiens
cuuucuaaaucaa

SEQ ID NO: 944371 - RNA, 11 nt, Homo sapiens
cuuugaaauga

SEQ ID NO: 944372 - RNA, 22 nt, Homo sapiens
cuuugaucccugacaucuggaa

SEQ ID NO: 944373 - RNA, 14 nt, Homo sapiens
cuuugcaccaaaga

SEQ ID NO: 944374 - RNA, 18 nt, Homo sapiens
cuuuuaaaaacauaacau

SEQ ID NO: 944375 - RNA, 19 nt, Homo sapiens
cuuuuaaaaacauaacaua

SEQ ID NO: 944376 - RNA, 22 nt, Homo sapiens
cuuuuaaaaacuagagcacaga

SEQ ID NO: 944377 - RNA, 19 nt, Homo sapiens
aauauguggaagcaaccaa

SEQ ID NO: 944378 - RNA, 15 nt, Homo sapiens
aauauuuaucugauu

SEQ ID NO: 944379 - RNA, 15 nt, Homo sapiens
aauauuuauuuaacu

SEQ ID NO: 944380 - RNA, 21 nt, Homo sapiens
aauauuuauuuaacuauucau

SEQ ID NO: 944381 - RNA, 14 nt, Homo sapiens
aauauuucagugaa

SEQ ID NO: 944382 - RNA, 18 nt, Homo sapiens
aauauuuucucuguacuu

SEQ ID NO: 944383 - RNA, 15 nt, Homo sapiens
aaucaccuccugugu

SEQ ID NO: 944384 - RNA, 19 nt, Homo sapiens
aaucaccugugggacuuga

SEQ ID NO: 944385 - RNA, 17 nt, Homo sapiens
aaucagauuagccugua

SEQ ID NO: 944386 - RNA, 20 nt, Homo sapiens
aaucauuguauguggucaug

SEQ ID NO: 944387 - RNA, 13 nt, Homo sapiens
aaucccagcacuu

SEQ ID NO: 944388 - RNA, 21 nt, Homo sapiens
aauccgaaaacuuccauugua

SEQ ID NO: 944389 - RNA, 17 nt, Homo sapiens
aaucuaccucugaaaaa

SEQ ID NO: 944390 - RNA, 13 nt, Homo sapiens
aaucuuaugcucu

SEQ ID NO: 944391 - RNA, 14 nt, Homo sapiens
aaugaaaacagugu

SEQ ID NO: 944392 - RNA, 13 nt, Homo sapiens
aaugaaagggaaa

SEQ ID NO: 944393 - RNA, 19 nt, Homo sapiens
aaugaaagggaaacuggga

SEQ ID NO: 944394 - RNA, 21 nt, Homo sapiens
aaugaaagggaaacugggaaa

SEQ ID NO: 944395 - RNA, 22 nt, Homo sapiens
aaugaaccuucugcaacaucuu

SEQ ID NO: 944396 - RNA, 22 nt, Homo sapiens
aaugaagacuacauuugugaac

SEQ ID NO: 944397 - RNA, 15 nt, Homo sapiens
aaugaauucaguuuc

SEQ ID NO: 944398 - RNA, 16 nt, Homo sapiens
aaugaucagcuauaua

SEQ ID NO: 944399 - RNA, 20 nt, Homo sapiens
aaugcugcaggacuugagaa

SEQ ID NO: 944400 - RNA, 16 nt, Homo sapiens
aaugcuuagaaauuca

SEQ ID NO: 944401 - RNA, 13 nt, Homo sapiens
aauggaagcaauu

SEQ ID NO: 944402 - RNA, 14 nt, Homo sapiens
aauguaagcauacu

SEQ ID NO: 944403 - RNA, 14 nt, Homo sapiens
aaugucauagguaa

SEQ ID NO: 944404 - RNA, 14 nt, Homo sapiens
aaugucauagucuu

SEQ ID NO: 944405 - RNA, 21 nt, Homo sapiens
aauguuaacacucaugaagca

SEQ ID NO: 944406 - RNA, 22 nt, Homo sapiens
aauuaaaaauaccaacuguaca

SEQ ID NO: 944407 - RNA, 21 nt, Homo sapiens
aauuaaucacccuaccaacuu

SEQ ID NO: 944408 - RNA, 22 nt, Homo sapiens
aauuagaauaguguucugcaaa

SEQ ID NO: 944409 - RNA, 13 nt, Homo sapiens
aauucaaacuggg

SEQ ID NO: 944410 - RNA, 14 nt, Homo sapiens
aauucaaacugggg

SEQ ID NO: 944411 - RNA, 14 nt, Homo sapiens
aauucccaagcuuu

SEQ ID NO: 944412 - RNA, 23 nt, Homo sapiens
aauucuaacccagguauccaaaa

SEQ ID NO: 944413 - RNA, 20 nt, Homo sapiens
aauucugucauuucaaagac

SEQ ID NO: 944414 - RNA, 17 nt, Homo sapiens
aauugaaacacagaguu

SEQ ID NO: 944415 - RNA, 20 nt, Homo sapiens
aauugacuuauacucuugag

SEQ ID NO: 944416 - RNA, 13 nt, Homo sapiens
aauugacuugcaa

SEQ ID NO: 944417 - RNA, 20 nt, Homo sapiens
aauugggaaaaaagcaacug

SEQ ID NO: 944418 - RNA, 22 nt, Homo sapiens
aauuggggcacuuaauggucac

SEQ ID NO: 944419 - RNA, 21 nt, Homo sapiens
aauuuaaaaaguuagccaggu

SEQ ID NO: 944420 - RNA, 23 nt, Homo sapiens
aauuuaaaaaguuagccagguau

SEQ ID NO: 944421 - RNA, 18 nt, Homo sapiens
aauuugugccacuuuaau

SEQ ID NO: 944422 - RNA, 19 nt, Homo sapiens
aauuuuguuuucuguggag

SEQ ID NO: 944423 - RNA, 13 nt, Homo sapiens
acaaaugcaguau

SEQ ID NO: 944424 - RNA, 14 nt, Homo sapiens
acaacaucgcaaua

SEQ ID NO: 944425 - RNA, 18 nt, Homo sapiens
acaaccugggcauuccuu

SEQ ID NO: 944426 - RNA, 11 nt, Homo sapiens
acaacuuucaa

SEQ ID NO: 944427 - RNA, 23 nt, Homo sapiens
acaacuuucuccuacucuuccuu

SEQ ID NO: 944428 - RNA, 14 nt, Homo sapiens
acaagcaaugcaag

SEQ ID NO: 944429 - RNA, 13 nt, Homo sapiens
acaagccaaagag

SEQ ID NO: 944430 - RNA, 18 nt, Homo sapiens
acaagugauaauacagau

SEQ ID NO: 944431 - RNA, 14 nt, Homo sapiens
acaauaaacccuca

SEQ ID NO: 944432 - RNA, 16 nt, Homo sapiens
acaauaguucuguggg

SEQ ID NO: 944433 - RNA, 23 nt, Homo sapiens
acaauccuucuauucuagccugc

SEQ ID NO: 944434 - RNA, 21 nt, Homo sapiens
acaaucggcugcauugaagau

SEQ ID NO: 944435 - RNA, 11 nt, Homo sapiens
acaaugcauuu

SEQ ID NO: 944436 - RNA, 14 nt, Homo sapiens
acaauuuuuauuuc

SEQ ID NO: 944437 - RNA, 23 nt, Homo sapiens
acacauaauuucuuaauuuucac

SEQ ID NO: 944438 - RNA, 23 nt, Homo sapiens
acacaucucccuuuuccaugacu

SEQ ID NO: 944439 - RNA, 16 nt, Homo sapiens
acacaugcccaugaug

SEQ ID NO: 944440 - RNA, 17 nt, Homo sapiens
acaccauuucugggcuc

SEQ ID NO: 944441 - RNA, 15 nt, Homo sapiens
acacccaaugcugcu

SEQ ID NO: 944442 - RNA, 15 nt, Homo sapiens
acaccuguaguccca

SEQ ID NO: 944443 - RNA, 19 nt, Homo sapiens
acaccuuauuaaugaucag

SEQ ID NO: 944444 - RNA, 16 nt, Homo sapiens
acacguaaguauaaau

SEQ ID NO: 944445 - RNA, 22 nt, Homo sapiens
acacucuggcugcucccugaca

SEQ ID NO: 944446 - RNA, 19 nt, Homo sapiens
acacugcagugaccacuua

SEQ ID NO: 944447 - RNA, 13 nt, Homo sapiens
acacuggauccau

SEQ ID NO: 944448 - RNA, 18 nt, Homo sapiens
acagagaggaggggacca

SEQ ID NO: 944449 - RNA, 16 nt, Homo sapiens
acagaucuaucuccuc

SEQ ID NO: 944450 - RNA, 15 nt, Homo sapiens
acagcagacuaguua

SEQ ID NO: 944451 - RNA, 14 nt, Homo sapiens
acagccaagcccua

SEQ ID NO: 944452 - RNA, 21 nt, Homo sapiens
acagcccaggauacuggcaca

SEQ ID NO: 944453 - RNA, 22 nt, Homo sapiens
acagcuagaaagcugcacuggu

SEQ ID NO: 944454 - RNA, 23 nt, Homo sapiens
acaggcaaauguacuucucaccc

SEQ ID NO: 944455 - RNA, 21 nt, Homo sapiens
acaggcccccuugaguggggu

SEQ ID NO: 944456 - RNA, 16 nt, Homo sapiens
acagguaaaacagggc

SEQ ID NO: 944457 - RNA, 14 nt, Homo sapiens
acagucuugcugaa

SEQ ID NO: 944458 - RNA, 22 nt, Homo sapiens
acaguggacaaaguuaccagug

SEQ ID NO: 944459 - RNA, 18 nt, Homo sapiens
acauacuggccuggacug

SEQ ID NO: 944460 - RNA, 13 nt, Homo sapiens
acauagugaaaau

SEQ ID NO: 944461 - RNA, 11 nt, Homo sapiens
acaucaaagag

SEQ ID NO: 944462 - RNA, 16 nt, Homo sapiens
acaucuggacacuggg

SEQ ID NO: 944463 - RNA, 14 nt, Homo sapiens
acaugccacuauga

SEQ ID NO: 944464 - RNA, 15 nt, Homo sapiens
acaugccacuaugag

SEQ ID NO: 944465 - RNA, 22 nt, Homo sapiens
acauucauagucuuuggagaaa

SEQ ID NO: 944466 - RNA, 22 nt, Homo sapiens
acauugauuugcucuuacuaca

SEQ ID NO: 944467 - RNA, 19 nt, Homo sapiens
acauuguacuuauacaccu

SEQ ID NO: 944468 - RNA, 23 nt, Homo sapiens
acauuguacuuauacaccuuauu

SEQ ID NO: 944469 - RNA, 14 nt, Homo sapiens
acauuuucauugau

SEQ ID NO: 944470 - RNA, 14 nt, Homo sapiens
accaaagacaucag

SEQ ID NO: 944471 - RNA, 23 nt, Homo sapiens
accaacuacuaccuguaaugaca

SEQ ID NO: 944472 - RNA, 15 nt, Homo sapiens
accaacuguacaaaa

SEQ ID NO: 944473 - RNA, 15 nt, Homo sapiens
accaacuuuacuguc

SEQ ID NO: 944474 - RNA, 12 nt, Homo sapiens
accaagggcaga

SEQ ID NO: 944475 - RNA, 17 nt, Homo sapiens
accaaguaccaguauaa

SEQ ID NO: 944476 - RNA, 21 nt, Homo sapiens
accacuaagaauucaaacugg

SEQ ID NO: 944477 - RNA, 16 nt, Homo sapiens
accagaaaagcaauac

SEQ ID NO: 944478 - RNA, 16 nt, Homo sapiens
accagauuaaacuuca

SEQ ID NO: 944479 - RNA, 21 nt, Homo sapiens
accagcuaucugucaucucuc

SEQ ID NO: 944480 - RNA, 11 nt, Homo sapiens
accagggaugg

SEQ ID NO: 944481 - RNA, 16 nt, Homo sapiens
accauauaccaucucc

SEQ ID NO: 944482 - RNA, 20 nt, Homo sapiens
accauauaccaucuccagcu

SEQ ID NO: 944483 - RNA, 21 nt, Homo sapiens
accaucuccagcuauuuacac

SEQ ID NO: 944484 - RNA, 18 nt, Homo sapiens
accaucucuucauucaaa

SEQ ID NO: 944485 - RNA, 13 nt, Homo sapiens
auauuuaucugau

SEQ ID NO: 944486 - RNA, 20 nt, Homo sapiens
auauuuauuuaacuauucau

SEQ ID NO: 944487 - RNA, 18 nt, Homo sapiens
auauuuuguuaccuuuua

SEQ ID NO: 944488 - RNA, 21 nt, Homo sapiens
aucaaaccaggugcaauuauu

SEQ ID NO: 944489 - RNA, 13 nt, Homo sapiens
aucaaaugugcau

SEQ ID NO: 944490 - RNA, 15 nt, Homo sapiens
aucacauaaccuuaa

SEQ ID NO: 944491 - RNA, 17 nt, Homo sapiens
aucacauuccucugccc

SEQ ID NO: 944492 - RNA, 23 nt, Homo sapiens
aucaccagccucacaaucccaca

SEQ ID NO: 944493 - RNA, 16 nt, Homo sapiens
aucaccuccuguguug

SEQ ID NO: 944494 - RNA, 17 nt, Homo sapiens
aucacggauggugcaug

SEQ ID NO: 944495 - RNA, 21 nt, Homo sapiens
aucacgucacugcacuccagc

SEQ ID NO: 944496 - RNA, 15 nt, Homo sapiens
aucagaaagcuuuau

SEQ ID NO: 944497 - RNA, 19 nt, Homo sapiens
aucagaggaaauucuuucc

SEQ ID NO: 944498 - RNA, 17 nt, Homo sapiens
aucagcaggaguaauaa

SEQ ID NO: 944499 - RNA, 18 nt, Homo sapiens
aucaguccauugcucuug

SEQ ID NO: 944500 - RNA, 20 nt, Homo sapiens
aucagugaagccaaagggac

SEQ ID NO: 944501 - RNA, 21 nt, Homo sapiens
aucaguuuccaugaaagaccu

SEQ ID NO: 944502 - RNA, 20 nt, Homo sapiens
aucauaaaacuuuuguguca

SEQ ID NO: 944503 - RNA, 23 nt, Homo sapiens
aucauaggcaccuuuuacuguga

SEQ ID NO: 944504 - RNA, 13 nt, Homo sapiens
aucauuacagauu

SEQ ID NO: 944505 - RNA, 17 nt, Homo sapiens
aucauucaaguguaaaa

SEQ ID NO: 944506 - RNA, 23 nt, Homo sapiens
auccaaaaauguguaagaacaac

SEQ ID NO: 944507 - RNA, 18 nt, Homo sapiens
auccaccaagaacauaag

SEQ ID NO: 944508 - RNA, 16 nt, Homo sapiens
auccagccaccaccua

SEQ ID NO: 944509 - RNA, 13 nt, Homo sapiens
auccagccuccag

SEQ ID NO: 944510 - RNA, 16 nt, Homo sapiens
auccaggccugggaau

SEQ ID NO: 944511 - RNA, 15 nt, Homo sapiens
auccaugagauagcu

SEQ ID NO: 944512 - RNA, 18 nt, Homo sapiens
auccaugcaccuaccuua

SEQ ID NO: 944513 - RNA, 19 nt, Homo sapiens
auccaugcaccuaccuuag

SEQ ID NO: 944514 - RNA, 23 nt, Homo sapiens
auccauucugucuuccuaggaac

SEQ ID NO: 944515 - RNA, 14 nt, Homo sapiens
auccccugguggcu

SEQ ID NO: 944516 - RNA, 15 nt, Homo sapiens
aucccuuguucucag

SEQ ID NO: 944517 - RNA, 16 nt, Homo sapiens
aucccuuuuuuuacau

SEQ ID NO: 944518 - RNA, 20 nt, Homo sapiens
auccuaccccuuugcacuug

SEQ ID NO: 944519 - RNA, 13 nt, Homo sapiens
auccuccacagag

SEQ ID NO: 944520 - RNA, 12 nt, Homo sapiens
auccugugcaau

SEQ ID NO: 944521 - RNA, 22 nt, Homo sapiens
auccuugccaauagugucaucc

SEQ ID NO: 944522 - RNA, 17 nt, Homo sapiens
aucucauuuaagggaaa

SEQ ID NO: 944523 - RNA, 18 nt, Homo sapiens
aucucccagugacaacau

SEQ ID NO: 944524 - RNA, 16 nt, Homo sapiens
aucucuaggaagucaa

SEQ ID NO: 944525 - RNA, 20 nt, Homo sapiens
aucuggacauucgaggaauu

SEQ ID NO: 944526 - RNA, 14 nt, Homo sapiens
aucuuaagauccac

SEQ ID NO: 944527 - RNA, 19 nt, Homo sapiens
aucuuauaugggaaaccau

SEQ ID NO: 944528 - RNA, 18 nt, Homo sapiens
aucuugcaacucuguaaa

SEQ ID NO: 944529 - RNA, 17 nt, Homo sapiens
augaaaacuaaggauuu

SEQ ID NO: 944530 - RNA, 13 nt, Homo sapiens
augaagguaauau

SEQ ID NO: 944531 - RNA, 14 nt, Homo sapiens
augaagguaauauu

SEQ ID NO: 944532 - RNA, 19 nt, Homo sapiens
augaaguugaaaaucauag

SEQ ID NO: 944533 - RNA, 19 nt, Homo sapiens
augaauacuuugcagcaca

SEQ ID NO: 944534 - RNA, 15 nt, Homo sapiens
augaaugcagauuac

SEQ ID NO: 944535 - RNA, 13 nt, Homo sapiens
augaauuugucca

SEQ ID NO: 944536 - RNA, 15 nt, Homo sapiens
augacaaucaguuau

SEQ ID NO: 944537 - RNA, 13 nt, Homo sapiens
augacauguuccu

SEQ ID NO: 944538 - RNA, 22 nt, Homo sapiens
augagagagguguguaaaggag

SEQ ID NO: 944539 - RNA, 23 nt, Homo sapiens
augaggcaacccgugcucagcug

SEQ ID NO: 944540 - RNA, 13 nt, Homo sapiens
augaugcacuuau

SEQ ID NO: 944541 - RNA, 17 nt, Homo sapiens
augaugggcuguucuaa

SEQ ID NO: 944542 - RNA, 16 nt, Homo sapiens
augauuguacuuugaa

SEQ ID NO: 944543 - RNA, 21 nt, Homo sapiens
augauuuuguaaaaguggcau

SEQ ID NO: 944544 - RNA, 17 nt, Homo sapiens
augcaauuuuucaagag

SEQ ID NO: 944545 - RNA, 17 nt, Homo sapiens
augcagauuacacugau

SEQ ID NO: 944546 - RNA, 19 nt, Homo sapiens
augccaauaaagugaucug

SEQ ID NO: 944547 - RNA, 17 nt, Homo sapiens
augccauuuagcaauaa

SEQ ID NO: 944548 - RNA, 14 nt, Homo sapiens
augcgggggugccu

SEQ ID NO: 944549 - RNA, 16 nt, Homo sapiens
augcuguacacauauu

SEQ ID NO: 944550 - RNA, 20 nt, Homo sapiens
augcuugacaaauauuuuca

SEQ ID NO: 944551 - RNA, 15 nt, Homo sapiens
auggaacagcauuac

SEQ ID NO: 944552 - RNA, 19 nt, Homo sapiens
auggacagaaugugucuca

SEQ ID NO: 944553 - RNA, 19 nt, Homo sapiens
auggagaggcggccucgug

SEQ ID NO: 944554 - RNA, 18 nt, Homo sapiens
auggaucccuggggccaa

SEQ ID NO: 944555 - RNA, 23 nt, Homo sapiens
auggcaaaaccccaucuuuacua

SEQ ID NO: 944556 - RNA, 14 nt, Homo sapiens
augggaccagggau

SEQ ID NO: 944557 - RNA, 15 nt, Homo sapiens
augggacuuaacucc

SEQ ID NO: 944558 - RNA, 16 nt, Homo sapiens
auggggacgguguaug

SEQ ID NO: 944559 - RNA, 14 nt, Homo sapiens
augggucuaggaca

SEQ ID NO: 944560 - RNA, 17 nt, Homo sapiens
augggucuaggacacag

SEQ ID NO: 944561 - RNA, 14 nt, Homo sapiens
augguagagcaaua

SEQ ID NO: 944562 - RNA, 21 nt, Homo sapiens
augguaugcuggccagcaccc

SEQ ID NO: 944563 - RNA, 13 nt, Homo sapiens
auggugagcucug

SEQ ID NO: 944564 - RNA, 16 nt, Homo sapiens
augguggcauauacuu

SEQ ID NO: 944565 - RNA, 17 nt, Homo sapiens
augguucccaagcguca

SEQ ID NO: 944566 - RNA, 18 nt, Homo sapiens
augguucccaagcgucau

SEQ ID NO: 944567 - RNA, 15 nt, Homo sapiens
augguuugacucauc

SEQ ID NO: 944568 - RNA, 19 nt, Homo sapiens
auguaaaaagauucccaaa

SEQ ID NO: 944569 - RNA, 13 nt, Homo sapiens
auguaaaugguau

SEQ ID NO: 944570 - RNA, 18 nt, Homo sapiens
auguagcagugagucaua

SEQ ID NO: 944571 - RNA, 17 nt, Homo sapiens
augucagaagugcagaa

SEQ ID NO: 944572 - RNA, 14 nt, Homo sapiens
augugaaaagaaua

SEQ ID NO: 944573 - RNA, 22 nt, Homo sapiens
augugcgcgcgugcaugugugc

SEQ ID NO: 944574 - RNA, 19 nt, Homo sapiens
augugucauuggaagccau

SEQ ID NO: 944575 - RNA, 15 nt, Homo sapiens
augugucucaggaaa

SEQ ID NO: 944576 - RNA, 23 nt, Homo sapiens
auguuaauugggcaggugaaaag

SEQ ID NO: 944577 - RNA, 16 nt, Homo sapiens
auguuugcacuuguga

SEQ ID NO: 944578 - RNA, 23 nt, Homo sapiens
auuaaacuucauauguaaucucu

SEQ ID NO: 944579 - RNA, 14 nt, Homo sapiens
auuaaaugugucau

SEQ ID NO: 944580 - RNA, 22 nt, Homo sapiens
auuaaccuuacuaauuauacua

SEQ ID NO: 944581 - RNA, 21 nt, Homo sapiens
auuaagcccaauuaauuccug

SEQ ID NO: 944582 - RNA, 20 nt, Homo sapiens
auuaauaaagauggcacuuu

SEQ ID NO: 944583 - RNA, 22 nt, Homo sapiens
auuaaugaucagcuauauacua

SEQ ID NO: 944584 - RNA, 21 nt, Homo sapiens
auuacaguuaaagaagcaauc

SEQ ID NO: 944585 - RNA, 21 nt, Homo sapiens
auucacacaugccacuaugag

SEQ ID NO: 944586 - RNA, 22 nt, Homo sapiens
auucagcaaaaaucucccagug

SEQ ID NO: 944587 - RNA, 17 nt, Homo sapiens
auuccagccugggcaac

SEQ ID NO: 944588 - RNA, 14 nt, Homo sapiens
auucccaagcuuuu

SEQ ID NO: 944589 - RNA, 18 nt, Homo sapiens
auuccuucucgugcacug

SEQ ID NO: 944590 - RNA, 21 nt, Homo sapiens
auuccuugaggacagaccuua

SEQ ID NO: 944591 - RNA, 15 nt, Homo sapiens
auucggauuugccau

SEQ ID NO: 944592 - RNA, 22 nt, Homo sapiens
auucuauugggauauccuuuca

SEQ ID NO: 944593 - RNA, 17 nt, Homo sapiens
cgcgccccagucacuuc

SEQ ID NO: 944594 - RNA, 15 nt, Homo sapiens
cgcuagcauuuccca

SEQ ID NO: 944595 - RNA, 13 nt, Homo sapiens
cggagagagccaa

SEQ ID NO: 944596 - RNA, 17 nt, Homo sapiens
cggagagagccaagacg

SEQ ID NO: 944597 - RNA, 18 nt, Homo sapiens
cggauguaacgcugccac

SEQ ID NO: 944598 - RNA, 13 nt, Homo sapiens
cggcaacaucucu

SEQ ID NO: 944599 - RNA, 18 nt, Homo sapiens
cggccucucaguucuuga

SEQ ID NO: 944600 - RNA, 18 nt, Homo sapiens
cgggaccaauacuacuga

SEQ ID NO: 944601 - RNA, 13 nt, Homo sapiens
cgggcgcugccag

SEQ ID NO: 944602 - RNA, 17 nt, Homo sapiens
cgguuaccucugcaugg

SEQ ID NO: 944603 - RNA, 21 nt, Homo sapiens
cgucaagagcaugcacaugcu

SEQ ID NO: 944604 - RNA, 15 nt, Homo sapiens
cgucccuggggcucc

SEQ ID NO: 944605 - RNA, 21 nt, Homo sapiens
cguccuuucccuacuccaugg

SEQ ID NO: 944606 - RNA, 12 nt, Homo sapiens
cgugaguggucu

SEQ ID NO: 944607 - RNA, 19 nt, Homo sapiens
cgugguaugaaaugucuga

SEQ ID NO: 944608 - RNA, 15 nt, Homo sapiens
cgugucacacuugug

SEQ ID NO: 944609 - RNA, 17 nt, Homo sapiens
cguuccuguugggcuga

SEQ ID NO: 944610 - RNA, 13 nt, Homo sapiens
cguuuuauuccag

SEQ ID NO: 944611 - RNA, 14 nt, Homo sapiens
cuaaaucaaaccag

SEQ ID NO: 944612 - RNA, 20 nt, Homo sapiens
cuaagaucucgguuugccaa

SEQ ID NO: 944613 - RNA, 14 nt, Homo sapiens
cuaagcuaauucca

SEQ ID NO: 944614 - RNA, 16 nt, Homo sapiens
cuaaggagccuggaaa

SEQ ID NO: 944615 - RNA, 13 nt, Homo sapiens
cuaaguauauuaa

SEQ ID NO: 944616 - RNA, 16 nt, Homo sapiens
cuaauaacaugugaaa

SEQ ID NO: 944617 - RNA, 23 nt, Homo sapiens
cuaaugaagguuuucauuugcca

SEQ ID NO: 944618 - RNA, 22 nt, Homo sapiens
cuaauuagagagcaucugcaac

SEQ ID NO: 944619 - RNA, 15 nt, Homo sapiens
cuaauuccacacccc

SEQ ID NO: 944620 - RNA, 17 nt, Homo sapiens
cuaauucggauuugcca

SEQ ID NO: 944621 - RNA, 23 nt, Homo sapiens
cuaauucggauuugccauagccu

SEQ ID NO: 944622 - RNA, 22 nt, Homo sapiens
cuaauucuggcaggaccucacc

SEQ ID NO: 944623 - RNA, 13 nt, Homo sapiens
cuacaauucauug

SEQ ID NO: 944624 - RNA, 19 nt, Homo sapiens
cuacagauauuaauguuaa

SEQ ID NO: 944625 - RNA, 19 nt, Homo sapiens
cuacagcuaacccucacaa

SEQ ID NO: 944626 - RNA, 18 nt, Homo sapiens
cuacaguauuacucuuac

SEQ ID NO: 944627 - RNA, 15 nt, Homo sapiens
cuacauucuaaugca

SEQ ID NO: 944628 - RNA, 21 nt, Homo sapiens
cuaccaacuuguauccaggcc

SEQ ID NO: 944629 - RNA, 18 nt, Homo sapiens
cuaccucaggcagcucaa

SEQ ID NO: 944630 - RNA, 22 nt, Homo sapiens
cuacgaaaugcuugcucaggcu

SEQ ID NO: 944631 - RNA, 17 nt, Homo sapiens
cuacugacagggagcag

SEQ ID NO: 944632 - RNA, 19 nt, Homo sapiens
cuacugagggcaguucuga

SEQ ID NO: 944633 - RNA, 18 nt, Homo sapiens
cuagaaaaggcagcuaaa

SEQ ID NO: 944634 - RNA, 22 nt, Homo sapiens
cuagaaagcugcacuggugcua

SEQ ID NO: 944635 - RNA, 14 nt, Homo sapiens
cuagacaaguaaaa

SEQ ID NO: 944636 - RNA, 22 nt, Homo sapiens
cuagcauuucccaacacaaaga

SEQ ID NO: 944637 - RNA, 15 nt, Homo sapiens
cuaggaggagggggu

SEQ ID NO: 944638 - RNA, 16 nt, Homo sapiens
cuauaaaauagauaua

SEQ ID NO: 944639 - RNA, 13 nt, Homo sapiens
cuaucaacaaaga

SEQ ID NO: 944640 - RNA, 19 nt, Homo sapiens
cuaucugggcugugggcaa

SEQ ID NO: 944641 - RNA, 23 nt, Homo sapiens
cuaugcaauuuuucaagagcucc

SEQ ID NO: 944642 - RNA, 18 nt, Homo sapiens
cuauguagcaauauauca

SEQ ID NO: 944643 - RNA, 22 nt, Homo sapiens
cuauuuauggauaucacacaua

SEQ ID NO: 944644 - RNA, 18 nt, Homo sapiens
cuauuuccucugugcaaa

SEQ ID NO: 944645 - RNA, 15 nt, Homo sapiens
cuauuugaacaagug

SEQ ID NO: 944646 - RNA, 22 nt, Homo sapiens
cucaaagaagucggaaugucau

SEQ ID NO: 944647 - RNA, 12 nt, Homo sapiens
cucaaaugaauu

SEQ ID NO: 944648 - RNA, 21 nt, Homo sapiens
cucaacuucucagacguucca

SEQ ID NO: 944649 - RNA, 15 nt, Homo sapiens
cucacagcacuuguu

SEQ ID NO: 944650 - RNA, 23 nt, Homo sapiens
cucacuggggccuacagcuuuga

SEQ ID NO: 944651 - RNA, 17 nt, Homo sapiens
cucagaacaauccgauu

SEQ ID NO: 944652 - RNA, 17 nt, Homo sapiens
cucagaaggccccagag

SEQ ID NO: 944653 - RNA, 14 nt, Homo sapiens
cucagccucugcca

SEQ ID NO: 944654 - RNA, 23 nt, Homo sapiens
cucaggaaaacagcuaguagaca

SEQ ID NO: 944655 - RNA, 19 nt, Homo sapiens
cucaguuugugugucuuaa

SEQ ID NO: 944656 - RNA, 13 nt, Homo sapiens
cucaucacuagga

SEQ ID NO: 944657 - RNA, 22 nt, Homo sapiens
cucauccuccaggaacugcagg

SEQ ID NO: 944658 - RNA, 23 nt, Homo sapiens
cucaucugaaauguuacaaaaau

SEQ ID NO: 944659 - RNA, 14 nt, Homo sapiens
cucaugaagcauac

SEQ ID NO: 944660 - RNA, 20 nt, Homo sapiens
cucaugccuguaaucccagc

SEQ ID NO: 944661 - RNA, 16 nt, Homo sapiens
cucaugccuuaauccc

SEQ ID NO: 944662 - RNA, 23 nt, Homo sapiens
cucaugccuuaaucccagcacuu

SEQ ID NO: 944663 - RNA, 16 nt, Homo sapiens
cucauuacuacccucc

SEQ ID NO: 944664 - RNA, 18 nt, Homo sapiens
cuccaauuucaagaguga

SEQ ID NO: 944665 - RNA, 12 nt, Homo sapiens
cuccacuuguau

SEQ ID NO: 944666 - RNA, 13 nt, Homo sapiens
cuccagacucuca

SEQ ID NO: 944667 - RNA, 20 nt, Homo sapiens
cuccagcugggcucugcaau

SEQ ID NO: 944668 - RNA, 20 nt, Homo sapiens
cuccagcuugggcaacagag

SEQ ID NO: 944669 - RNA, 17 nt, Homo sapiens
cucccaggaagcccagg

SEQ ID NO: 944670 - RNA, 16 nt, Homo sapiens
cucccagugaugcugu

SEQ ID NO: 944671 - RNA, 18 nt, Homo sapiens
cucccccuuucacacugg

SEQ ID NO: 944672 - RNA, 24 nt, Homo sapiens
cucccucuuucuucccaugacccc

SEQ ID NO: 944673 - RNA, 23 nt, Homo sapiens
cucccuugggaagggcagggaau

SEQ ID NO: 944674 - RNA, 16 nt, Homo sapiens
cuccugccagcucuuc

SEQ ID NO: 944675 - RNA, 23 nt, Homo sapiens
cuccugcgcccuucauugccaca

SEQ ID NO: 944676 - RNA, 20 nt, Homo sapiens
cuccugcuuccuccagggaa

SEQ ID NO: 944677 - RNA, 13 nt, Homo sapiens
cuccuuccagugu

SEQ ID NO: 944678 - RNA, 15 nt, Homo sapiens
cuccuuggccacaga

SEQ ID NO: 944679 - RNA, 16 nt, Homo sapiens
cucgugccaugaucug

SEQ ID NO: 944680 - RNA, 17 nt, Homo sapiens
cucuaaaccauggcacu

SEQ ID NO: 944681 - RNA, 15 nt, Homo sapiens
cucuauuugagaaua

SEQ ID NO: 944682 - RNA, 16 nt, Homo sapiens
cucuauuuuuacauuu

SEQ ID NO: 944683 - RNA, 12 nt, Homo sapiens
cucucacaugca

SEQ ID NO: 944684 - RNA, 13 nt, Homo sapiens
cucucacccucau

SEQ ID NO: 944685 - RNA, 19 nt, Homo sapiens
cucucgcacacacagugau

SEQ ID NO: 944686 - RNA, 21 nt, Homo sapiens
cucucgcacacacagugauuc

SEQ ID NO: 944687 - RNA, 15 nt, Homo sapiens
cucucggugaccucc

SEQ ID NO: 944688 - RNA, 12 nt, Homo sapiens
cucugacagucc

SEQ ID NO: 944689 - RNA, 23 nt, Homo sapiens
cucuggcugcucccugacagcac

SEQ ID NO: 944690 - RNA, 15 nt, Homo sapiens
cucugggaagugugg

SEQ ID NO: 944691 - RNA, 12 nt, Homo sapiens
cucugucagcca

SEQ ID NO: 944692 - RNA, 23 nt, Homo sapiens
cucuucuggggcaggcugggcca

SEQ ID NO: 944693 - RNA, 22 nt, Homo sapiens
cucuuguaucccuagugcucca

SEQ ID NO: 944694 - RNA, 23 nt, Homo sapiens
cucuuguauuaaacucuucacaa

SEQ ID NO: 944695 - RNA, 21 nt, Homo sapiens
cugaaacucauagacacugau

SEQ ID NO: 944696 - RNA, 13 nt, Homo sapiens
cugaagugcuuag

SEQ ID NO: 944697 - RNA, 23 nt, Homo sapiens
cugacaguuaauaaaccuuugca

SEQ ID NO: 944698 - RNA, 12 nt, Homo sapiens
cugacuguaaau

SEQ ID NO: 944699 - RNA, 19 nt, Homo sapiens
cugagcacccagaacucca

SEQ ID NO: 944700 - RNA, 22 nt, Homo sapiens
cugagcuuggcguuuggaccca

SEQ ID NO: 944701 - RNA, 15 nt, Homo sapiens
uugucacacgauaaa

SEQ ID NO: 944702 - RNA, 20 nt, Homo sapiens
uugucuuuccuggcacuaac

SEQ ID NO: 944703 - RNA, 20 nt, Homo sapiens
uugugaauugcuugguugua

SEQ ID NO: 944704 - RNA, 17 nt, Homo sapiens
uuguguuaccuguagau

SEQ ID NO: 944705 - RNA, 23 nt, Homo sapiens
uuguucgccgcguggaaugugag

SEQ ID NO: 944706 - RNA, 13 nt, Homo sapiens
uuguuuacucauc

SEQ ID NO: 944707 - RNA, 13 nt, Homo sapiens
uuuaaaaagcaaa

SEQ ID NO: 944708 - RNA, 17 nt, Homo sapiens
uuuaagccgaagggcaa

SEQ ID NO: 944709 - RNA, 23 nt, Homo sapiens
uuuaagccgaagggcaauaucua

SEQ ID NO: 944710 - RNA, 23 nt, Homo sapiens
uuuaauggcaauaggacauugug

SEQ ID NO: 944711 - RNA, 22 nt, Homo sapiens
uuuaauuuugucagauucacac

SEQ ID NO: 944712 - RNA, 20 nt, Homo sapiens
uuuacaauuugacauacaaa

SEQ ID NO: 944713 - RNA, 11 nt, Homo sapiens
uuuacauuuca

SEQ ID NO: 944714 - RNA, 11 nt, Homo sapiens
uuuaccaaagc

SEQ ID NO: 944715 - RNA, 13 nt, Homo sapiens
uuuagaaccagcc

SEQ ID NO: 944716 - RNA, 19 nt, Homo sapiens
uuuauaaaucuuaugcucu

SEQ ID NO: 944717 - RNA, 12 nt, Homo sapiens
uuuauauauaua

SEQ ID NO: 944718 - RNA, 15 nt, Homo sapiens
uuuauuuaacuauuc

SEQ ID NO: 944719 - RNA, 13 nt, Homo sapiens
uuuauuucucggg

SEQ ID NO: 944720 - RNA, 12 nt, Homo sapiens
uuucaagagauc

SEQ ID NO: 944721 - RNA, 19 nt, Homo sapiens
uuucaagagugagcuauca

SEQ ID NO: 944722 - RNA, 12 nt, Homo sapiens
uuucaagucaaa

SEQ ID NO: 944723 - RNA, 18 nt, Homo sapiens
uuucaauuugagauucua

SEQ ID NO: 944724 - RNA, 22 nt, Homo sapiens
uuucacacuggauccaucuuga

SEQ ID NO: 944725 - RNA, 13 nt, Homo sapiens
uuucacucugcau

SEQ ID NO: 944726 - RNA, 23 nt, Homo sapiens
uuucagugaauuugcacuguuua

SEQ ID NO: 944727 - RNA, 18 nt, Homo sapiens
uuucauugaugagcaaga

SEQ ID NO: 944728 - RNA, 12 nt, Homo sapiens
uuucauuugcca

SEQ ID NO: 944729 - RNA, 22 nt, Homo sapiens
uuuccucagugcauuugugcua

SEQ ID NO: 944730 - RNA, 19 nt, Homo sapiens
uuuccucugugcaaaggga

SEQ ID NO: 944731 - RNA, 20 nt, Homo sapiens
uuuccuggucagcauguacu

SEQ ID NO: 944732 - RNA, 12 nt, Homo sapiens
uuucuaccucag

SEQ ID NO: 944733 - RNA, 17 nt, Homo sapiens
uuucuagaugucucuga

SEQ ID NO: 944734 - RNA, 23 nt, Homo sapiens
uuugaaaaaugagagcuguaacu

SEQ ID NO: 944735 - RNA, 15 nt, Homo sapiens
uuugaacaaugaagu

SEQ ID NO: 944736 - RNA, 20 nt, Homo sapiens
uuugaacaaugaaguugaaa

SEQ ID NO: 944737 - RNA, 15 nt, Homo sapiens
uuugacucuggcaaa

SEQ ID NO: 944738 - RNA, 21 nt, Homo sapiens
uuugagcuccaucaaggguau

SEQ ID NO: 944739 - RNA, 15 nt, Homo sapiens
uuugauucagcaaaa

SEQ ID NO: 944740 - RNA, 16 nt, Homo sapiens
uuugauucagcaaaaa

SEQ ID NO: 944741 - RNA, 20 nt, Homo sapiens
uuugauucagcaaaaaucuc

SEQ ID NO: 944742 - RNA, 17 nt, Homo sapiens
uuugccaaaauucauuu

SEQ ID NO: 944743 - RNA, 23 nt, Homo sapiens
uuugcccccauucacuuugucag

SEQ ID NO: 944744 - RNA, 14 nt, Homo sapiens
uuugcuacauucua

SEQ ID NO: 944745 - RNA, 15 nt, Homo sapiens
uuugcuaucugggcu

SEQ ID NO: 944746 - RNA, 14 nt, Homo sapiens
uuugcuuucaggga

SEQ ID NO: 944747 - RNA, 19 nt, Homo sapiens
uuuggagaaaugcuuagaa

SEQ ID NO: 944748 - RNA, 16 nt, Homo sapiens
uuuguaaugcugcaca

SEQ ID NO: 944749 - RNA, 16 nt, Homo sapiens
uuugucagagugcaca

SEQ ID NO: 944750 - RNA, 20 nt, Homo sapiens
uuugucagauucacacaugc

SEQ ID NO: 944751 - RNA, 19 nt, Homo sapiens
uuugugauagcacuuucua

SEQ ID NO: 944752 - RNA, 18 nt, Homo sapiens
uuugugucaaaaggacau

SEQ ID NO: 944753 - RNA, 21 nt, Homo sapiens
uuuguucuccggguguggccu

SEQ ID NO: 944754 - RNA, 16 nt, Homo sapiens
uuuguuuccagcauga

SEQ ID NO: 944755 - RNA, 19 nt, Homo sapiens
uuuuaaaguacugguguca

SEQ ID NO: 944756 - RNA, 19 nt, Homo sapiens
uuuuaaauaaaagcacaag

SEQ ID NO: 944757 - RNA, 15 nt, Homo sapiens
uuuuaauggugaugg

SEQ ID NO: 944758 - RNA, 21 nt, Homo sapiens
uuuuacauuucauacaacaga

SEQ ID NO: 944759 - RNA, 20 nt, Homo sapiens
uuuuauaggcauaccuccua

SEQ ID NO: 944760 - RNA, 14 nt, Homo sapiens
uuuuauucuauauu

SEQ ID NO: 944761 - RNA, 17 nt, Homo sapiens
uuuuauuugcaacuuua

SEQ ID NO: 944762 - RNA, 15 nt, Homo sapiens
uuuucauacugaaaa

SEQ ID NO: 944763 - RNA, 22 nt, Homo sapiens
uuuucccaacuccucaugucuu

SEQ ID NO: 944764 - RNA, 21 nt, Homo sapiens
uuuucuaccuauaacacucua

SEQ ID NO: 944765 - RNA, 13 nt, Homo sapiens
uuuucuucauuca

SEQ ID NO: 944766 - RNA, 20 nt, Homo sapiens
uuuugcauaaugcaaucaaa

SEQ ID NO: 944767 - RNA, 22 nt, Homo sapiens
uuuuguccuaaaacaccuggua

SEQ ID NO: 944768 - RNA, 14 nt, Homo sapiens
uuuuguugcucagu

SEQ ID NO: 944769 - RNA, 13 nt, Homo sapiens
uuuuuaacuuuga

SEQ ID NO: 944770 - RNA, 21 nt, Homo sapiens
uuuuuaauggcaauaggacau

SEQ ID NO: 944771 - RNA, 12 nt, Homo sapiens
uuuuuacuauua

SEQ ID NO: 944772 - RNA, 13 nt, Homo sapiens
uuuuucaagagcu

SEQ ID NO: 944773 - RNA, 14 nt, Homo sapiens
uuuuucaagagcuc

SEQ ID NO: 944774 - RNA, 17 nt, Homo sapiens
uuuuucuccagacccca

SEQ ID NO: 944775 - RNA, 12 nt, Homo sapiens
uuuuuuccuuaa

SEQ ID NO: 944776 - RNA, 18 nt, Homo sapiens
aauuugagauucuacagu

SEQ ID NO: 944777 - RNA, 21 nt, Homo sapiens
aauuugggcagauauagcauu

SEQ ID NO: 944778 - RNA, 13 nt, Homo sapiens
aauuuucuuucac

SEQ ID NO: 944779 - RNA, 19 nt, Homo sapiens
acaaaaaagaaaaguagaa

SEQ ID NO: 944780 - RNA, 18 nt, Homo sapiens
acaaacauuuaagcugug

SEQ ID NO: 944781 - RNA, 14 nt, Homo sapiens
acaaaccacaccac

SEQ ID NO: 944782 - RNA, 20 nt, Homo sapiens
acaacagguaaaacagggcc

SEQ ID NO: 944783 - RNA, 22 nt, Homo sapiens
acaaccucuuugagacguccuu

SEQ ID NO: 944784 - RNA, 22 nt, Homo sapiens
acaagaaagucauuagacggua

SEQ ID NO: 944785 - RNA, 14 nt, Homo sapiens
acaauaguucugug

SEQ ID NO: 944786 - RNA, 16 nt, Homo sapiens
acaaugcaacuuuuaa

SEQ ID NO: 944787 - RNA, 12 nt, Homo sapiens
acacacagugau

SEQ ID NO: 944788 - RNA, 20 nt, Homo sapiens
acacacgcacacaaaccaca

SEQ ID NO: 944789 - RNA, 19 nt, Homo sapiens
acaccaaaccugccccuug

SEQ ID NO: 944790 - RNA, 23 nt, Homo sapiens
acaccacuuuacuuguguuauau

SEQ ID NO: 944791 - RNA, 18 nt, Homo sapiens
acaccauuucugggcucc

SEQ ID NO: 944792 - RNA, 13 nt, Homo sapiens
acacccuguacug

SEQ ID NO: 944793 - RNA, 22 nt, Homo sapiens
acaccuagaaaggaacugcaau

SEQ ID NO: 944794 - RNA, 23 nt, Homo sapiens
acaccucccccuuucacacugga

SEQ ID NO: 944795 - RNA, 24 nt, Homo sapiens
acaccucccccuuucacacuggau

SEQ ID NO: 944796 - RNA, 20 nt, Homo sapiens
acacuuuuuggaagugaaaa

SEQ ID NO: 944797 - RNA, 17 nt, Homo sapiens
acagacccacacacuua

SEQ ID NO: 944798 - RNA, 17 nt, Homo sapiens
acagaccuuaguugaaa

SEQ ID NO: 944799 - RNA, 20 nt, Homo sapiens
acagagcaagaccucgucuc

SEQ ID NO: 944800 - RNA, 18 nt, Homo sapiens
acagagccaaaaugccau

SEQ ID NO: 944801 - RNA, 16 nt, Homo sapiens
acagaggagaugccac

SEQ ID NO: 944802 - RNA, 16 nt, Homo sapiens
acagaugugcugacaa

SEQ ID NO: 944803 - RNA, 15 nt, Homo sapiens
acagauuuguaacau

SEQ ID NO: 944804 - RNA, 13 nt, Homo sapiens
acagcaacaauga

SEQ ID NO: 944805 - RNA, 17 nt, Homo sapiens
acagccgccaggagcua

SEQ ID NO: 944806 - RNA, 22 nt, Homo sapiens
acaggaagccugcaguccugga

SEQ ID NO: 944807 - RNA, 15 nt, Homo sapiens
acaggcaaauguacu

SEQ ID NO: 944808 - RNA, 19 nt, Homo sapiens
acagggacaugcccugugu

SEQ ID NO: 944809 - RNA, 20 nt, Homo sapiens
acagggacaugcccugugug

SEQ ID NO: 944810 - RNA, 12 nt, Homo sapiens
acagucacugga

SEQ ID NO: 944811 - RNA, 13 nt, Homo sapiens
acaguccacaggg

SEQ ID NO: 944812 - RNA, 15 nt, Homo sapiens
acagucuaguacuua

SEQ ID NO: 944813 - RNA, 14 nt, Homo sapiens
acagugaacacuca

SEQ ID NO: 944814 - RNA, 12 nt, Homo sapiens
acagugacugua

SEQ ID NO: 944815 - RNA, 17 nt, Homo sapiens
acaguucuuggugacug

SEQ ID NO: 944816 - RNA, 17 nt, Homo sapiens
acaguuuuagaauacau

SEQ ID NO: 944817 - RNA, 15 nt, Homo sapiens
acauacuuaaugcau

SEQ ID NO: 944818 - RNA, 23 nt, Homo sapiens
acauagaaauggaaauuuugcua

SEQ ID NO: 944819 - RNA, 15 nt, Homo sapiens
acauaggaagcccuc

SEQ ID NO: 944820 - RNA, 17 nt, Homo sapiens
acaucaaagagcacauu

SEQ ID NO: 944821 - RNA, 13 nt, Homo sapiens
acaucucugggaa

SEQ ID NO: 944822 - RNA, 22 nt, Homo sapiens
acaugaauuuuaaauaauguau

SEQ ID NO: 944823 - RNA, 17 nt, Homo sapiens
acaugaugcacuucaaa

SEQ ID NO: 944824 - RNA, 16 nt, Homo sapiens
acaugccaauuucagc

SEQ ID NO: 944825 - RNA, 18 nt, Homo sapiens
acaugcccuguguggcug

SEQ ID NO: 944826 - RNA, 21 nt, Homo sapiens
acauguuccuuauauuuacuc

SEQ ID NO: 944827 - RNA, 12 nt, Homo sapiens
acauucuuggcu

SEQ ID NO: 944828 - RNA, 18 nt, Homo sapiens
acauuuagccaaucuuuc

SEQ ID NO: 944829 - RNA, 22 nt, Homo sapiens
acauuucuggacaguaccugau

SEQ ID NO: 944830 - RNA, 16 nt, Homo sapiens
acauuuucauugauga

SEQ ID NO: 944831 - RNA, 19 nt, Homo sapiens
acauuuuuuucuaccuaua

SEQ ID NO: 944832 - RNA, 23 nt, Homo sapiens
accaagggcagaggggugcucau

SEQ ID NO: 944833 - RNA, 18 nt, Homo sapiens
accaaguaugacaaccuc

SEQ ID NO: 944834 - RNA, 13 nt, Homo sapiens
accaauaaacagc

SEQ ID NO: 944835 - RNA, 14 nt, Homo sapiens
accaauacuacuga

SEQ ID NO: 944836 - RNA, 19 nt, Homo sapiens
accaauacuacugacgucc

SEQ ID NO: 944837 - RNA, 15 nt, Homo sapiens
accacugacagcuag

SEQ ID NO: 944838 - RNA, 14 nt, Homo sapiens
accacugggugaga

SEQ ID NO: 944839 - RNA, 15 nt, Homo sapiens
accacuuaccucaaa

SEQ ID NO: 944840 - RNA, 17 nt, Homo sapiens
accacuucgaaaccugg

SEQ ID NO: 944841 - RNA, 17 nt, Homo sapiens
accagaaaagcaauacu

SEQ ID NO: 944842 - RNA, 15 nt, Homo sapiens
accagagacuuuagg

SEQ ID NO: 944843 - RNA, 19 nt, Homo sapiens
accagaguuggagacucag

SEQ ID NO: 944844 - RNA, 14 nt, Homo sapiens
accagcccaaccau

SEQ ID NO: 944845 - RNA, 18 nt, Homo sapiens
accaggauuacuagucaa

SEQ ID NO: 944846 - RNA, 22 nt, Homo sapiens
accaggauuacuagucaaacaa

SEQ ID NO: 944847 - RNA, 16 nt, Homo sapiens
accaggccaaugucag

SEQ ID NO: 944848 - RNA, 15 nt, Homo sapiens
accaguauaagcauc

SEQ ID NO: 944849 - RNA, 13 nt, Homo sapiens
accagugagcacu

SEQ ID NO: 944850 - RNA, 15 nt, Homo sapiens
accauaguaccauuu

SEQ ID NO: 944851 - RNA, 15 nt, Homo sapiens
accauauaccaucuc

SEQ ID NO: 944852 - RNA, 16 nt, Homo sapiens
accauguagcagugag

SEQ ID NO: 944853 - RNA, 21 nt, Homo sapiens
acccaguaaggucaugugcuu

SEQ ID NO: 944854 - RNA, 15 nt, Homo sapiens
acccaguucagugag

SEQ ID NO: 944855 - RNA, 12 nt, Homo sapiens
acccaugccaga

SEQ ID NO: 944856 - RNA, 23 nt, Homo sapiens
accccaggacgccacucauuuca

SEQ ID NO: 944857 - RNA, 14 nt, Homo sapiens
acccccagcucaau

SEQ ID NO: 944858 - RNA, 13 nt, Homo sapiens
acccccauccagc

SEQ ID NO: 944859 - RNA, 14 nt, Homo sapiens
accccguguucaaa

SEQ ID NO: 944860 - RNA, 16 nt, Homo sapiens
acccgcuccuacagcu

SEQ ID NO: 944861 - RNA, 20 nt, Homo sapiens
acccuaguucuaccucaggc

SEQ ID NO: 944862 - RNA, 23 nt, Homo sapiens
acccuccgcuccugcgcucugcc

SEQ ID NO: 944863 - RNA, 22 nt, Homo sapiens
acccugauaguuucccauaaca

SEQ ID NO: 944864 - RNA, 18 nt, Homo sapiens
acccugcaagaccacgga

SEQ ID NO: 944865 - RNA, 22 nt, Homo sapiens
accgggagccucccccucagau

SEQ ID NO: 944866 - RNA, 11 nt, Homo sapiens
accguuuccaa

SEQ ID NO: 944867 - RNA, 16 nt, Homo sapiens
accuagcuacacugag

SEQ ID NO: 944868 - RNA, 16 nt, Homo sapiens
accucaggcagcucaa

SEQ ID NO: 944869 - RNA, 23 nt, Homo sapiens
accucauuggccagcucauaaaa

SEQ ID NO: 944870 - RNA, 11 nt, Homo sapiens
accuccucaug

SEQ ID NO: 944871 - RNA, 10 nt, Homo sapiens
accucugcau

SEQ ID NO: 944872 - RNA, 22 nt, Homo sapiens
accugaauaccacuuaccucaa

SEQ ID NO: 944873 - RNA, 17 nt, Homo sapiens
accugcagcccauggug

SEQ ID NO: 944874 - RNA, 21 nt, Homo sapiens
accugcagcccauggugagcu

SEQ ID NO: 944875 - RNA, 21 nt, Homo sapiens
cacugggugagagaggaauaa

SEQ ID NO: 944876 - RNA, 17 nt, Homo sapiens
cacuggucgagagccaa

SEQ ID NO: 944877 - RNA, 17 nt, Homo sapiens
cacuuuagggcuguaaa

SEQ ID NO: 944878 - RNA, 22 nt, Homo sapiens
cagaaaagcaauacuguuucca

SEQ ID NO: 944879 - RNA, 17 nt, Homo sapiens
cagaaagggccuugaau

SEQ ID NO: 944880 - RNA, 22 nt, Homo sapiens
cagaaagggccuugaauccugg

SEQ ID NO: 944881 - RNA, 12 nt, Homo sapiens
cagaacuccaua

SEQ ID NO: 944882 - RNA, 14 nt, Homo sapiens
cagaagaacugugu

SEQ ID NO: 944883 - RNA, 17 nt, Homo sapiens
cagaauauaauucccaa

SEQ ID NO: 944884 - RNA, 15 nt, Homo sapiens
agaugccacuucuca

SEQ ID NO: 944885 - RNA, 15 nt, Homo sapiens
agaugucucugcaaa

SEQ ID NO: 944886 - RNA, 20 nt, Homo sapiens
agauuauuaaaagaugucuc

SEQ ID NO: 944887 - RNA, 12 nt, Homo sapiens
agauucugcuag

SEQ ID NO: 944888 - RNA, 18 nt, Homo sapiens
agauugaaccugaauauu

SEQ ID NO: 944889 - RNA, 15 nt, Homo sapiens
agauuuuuuccucug

SEQ ID NO: 944890 - RNA, 23 nt, Homo sapiens
agcaaacuuggugaaacuacauc

SEQ ID NO: 944891 - RNA, 19 nt, Homo sapiens
agcaaauggccucauguca

SEQ ID NO: 944892 - RNA, 16 nt, Homo sapiens
agcaaauuuucagcau

SEQ ID NO: 944893 - RNA, 16 nt, Homo sapiens
agcaacuaggaaaauc

SEQ ID NO: 944894 - RNA, 15 nt, Homo sapiens
agcaaguguucacaa

SEQ ID NO: 944895 - RNA, 15 nt, Homo sapiens
agcaauaaauaacac

SEQ ID NO: 944896 - RNA, 21 nt, Homo sapiens
agcaauaaauaacacuuguca

SEQ ID NO: 944897 - RNA, 15 nt, Homo sapiens
agcaauaauccagua

SEQ ID NO: 944898 - RNA, 22 nt, Homo sapiens
agcaauccaugagauagcuauu

SEQ ID NO: 944899 - RNA, 20 nt, Homo sapiens
agcacccugcccaccaagaa

SEQ ID NO: 944900 - RNA, 14 nt, Homo sapiens
agcacucauuccuu

SEQ ID NO: 944901 - RNA, 23 nt, Homo sapiens
agcacucucgcacacacagugau

SEQ ID NO: 944902 - RNA, 19 nt, Homo sapiens
agcacugggaaccuagcua

SEQ ID NO: 944903 - RNA, 23 nt, Homo sapiens
agcagaccaccccgccugcccuc

SEQ ID NO: 944904 - RNA, 17 nt, Homo sapiens
agcaggucaggacucag

SEQ ID NO: 944905 - RNA, 23 nt, Homo sapiens
agcaguaguuuguuguagguuuc

SEQ ID NO: 944906 - RNA, 23 nt, Homo sapiens
agcaguccuuaucaccagccuca

SEQ ID NO: 944907 - RNA, 19 nt, Homo sapiens
agcauauguguuacuucaa

SEQ ID NO: 944908 - RNA, 18 nt, Homo sapiens
agcaucaaaauauuucag

SEQ ID NO: 944909 - RNA, 12 nt, Homo sapiens
agcaucugcaac

SEQ ID NO: 944910 - RNA, 14 nt, Homo sapiens
agcaucugcaacaa

SEQ ID NO: 944911 - RNA, 18 nt, Homo sapiens
agccauucauguauguca

SEQ ID NO: 944912 - RNA, 17 nt, Homo sapiens
agcccaauuaauuccug

SEQ ID NO: 944913 - RNA, 17 nt, Homo sapiens
agcccaggagccucacu

SEQ ID NO: 944914 - RNA, 22 nt, Homo sapiens
agcccauggugagcucugggaa

SEQ ID NO: 944915 - RNA, 18 nt, Homo sapiens
agcccucaacuauucugu

SEQ ID NO: 944916 - RNA, 19 nt, Homo sapiens
agcccuguccccuaccccc

SEQ ID NO: 944917 - RNA, 16 nt, Homo sapiens
agccgaggucaugcca

SEQ ID NO: 944918 - RNA, 21 nt, Homo sapiens
agccgggcguguuggugugca

SEQ ID NO: 944919 - RNA, 16 nt, Homo sapiens
agccuagugaacugca

SEQ ID NO: 944920 - RNA, 22 nt, Homo sapiens
agccucacuggggcagacaaua

SEQ ID NO: 944921 - RNA, 16 nt, Homo sapiens
agccucagaaggcccc

SEQ ID NO: 944922 - RNA, 20 nt, Homo sapiens
agccuccagggcauugcuca

SEQ ID NO: 944923 - RNA, 12 nt, Homo sapiens
agccugcauuga

SEQ ID NO: 944924 - RNA, 19 nt, Homo sapiens
agccugggcaacagagcaa

SEQ ID NO: 944925 - RNA, 22 nt, Homo sapiens
agccuuaggaaggccuucagga

SEQ ID NO: 944926 - RNA, 13 nt, Homo sapiens
agcgcacagggag

SEQ ID NO: 944927 - RNA, 20 nt, Homo sapiens
agcgcccccagagcccguca

SEQ ID NO: 944928 - RNA, 15 nt, Homo sapiens
agcggagagagccaa

SEQ ID NO: 944929 - RNA, 19 nt, Homo sapiens
agcggagagagccaagacg

SEQ ID NO: 944930 - RNA, 15 nt, Homo sapiens
agcgugaguggugga

SEQ ID NO: 944931 - RNA, 14 nt, Homo sapiens
agcuaagaugccau

SEQ ID NO: 944932 - RNA, 14 nt, Homo sapiens
agcuagaauaccac

SEQ ID NO: 944933 - RNA, 16 nt, Homo sapiens
agcuaucugucaucuc

SEQ ID NO: 944934 - RNA, 20 nt, Homo sapiens
agcucccgcggaaaacugcu

SEQ ID NO: 944935 - RNA, 18 nt, Homo sapiens
agcuccugggaagcccug

SEQ ID NO: 944936 - RNA, 17 nt, Homo sapiens
agcucuguaucugccau

SEQ ID NO: 944937 - RNA, 12 nt, Homo sapiens
agcucuucucaa

SEQ ID NO: 944938 - RNA, 18 nt, Homo sapiens
agcugaacaauaggcugu

SEQ ID NO: 944939 - RNA, 19 nt, Homo sapiens
agcuggccuucugcuucug

SEQ ID NO: 944940 - RNA, 14 nt, Homo sapiens
agcuggcucuguga

SEQ ID NO: 944941 - RNA, 17 nt, Homo sapiens
agcugggcucugcaauu

SEQ ID NO: 944942 - RNA, 14 nt, Homo sapiens
agcuuaagaaccau

SEQ ID NO: 944943 - RNA, 15 nt, Homo sapiens
agcuuaagaaccauu

SEQ ID NO: 944944 - RNA, 21 nt, Homo sapiens
agcuucaggagggaaccagcu

SEQ ID NO: 944945 - RNA, 18 nt, Homo sapiens
agcuugcauagucaauau

SEQ ID NO: 944946 - RNA, 14 nt, Homo sapiens
agcuuggagggaug

SEQ ID NO: 944947 - RNA, 15 nt, Homo sapiens
agcuuggagggaugg

SEQ ID NO: 944948 - RNA, 15 nt, Homo sapiens
agcuuuaaugauaug

SEQ ID NO: 944949 - RNA, 23 nt, Homo sapiens
agcuuucagacuccagcugugaa

SEQ ID NO: 944950 - RNA, 20 nt, Homo sapiens
agcuuuuagaaauacugcaa

SEQ ID NO: 944951 - RNA, 15 nt, Homo sapiens
aggaaaacagcuagu

SEQ ID NO: 944952 - RNA, 14 nt, Homo sapiens
aggaaaagucccaa

SEQ ID NO: 944953 - RNA, 14 nt, Homo sapiens
aggaaagcccuccc

SEQ ID NO: 944954 - RNA, 22 nt, Homo sapiens
aggaaaggauuuuaccaaagca

SEQ ID NO: 944955 - RNA, 15 nt, Homo sapiens
aggaacaaacagggc

SEQ ID NO: 944956 - RNA, 17 nt, Homo sapiens
aggaacuagaaagaagg

SEQ ID NO: 944957 - RNA, 20 nt, Homo sapiens
aggaauuggccgcugucacu

SEQ ID NO: 944958 - RNA, 22 nt, Homo sapiens
aggacgagacccccauccagcc

SEQ ID NO: 944959 - RNA, 18 nt, Homo sapiens
aggacucagaacagucug

SEQ ID NO: 944960 - RNA, 14 nt, Homo sapiens
aggacuuccaucug

SEQ ID NO: 944961 - RNA, 15 nt, Homo sapiens
aggagaagggucuca

SEQ ID NO: 944962 - RNA, 15 nt, Homo sapiens
aggagauuccuuucc

SEQ ID NO: 944963 - RNA, 14 nt, Homo sapiens
aggagccucacugg

SEQ ID NO: 944964 - RNA, 15 nt, Homo sapiens
aggagccucacuggg

SEQ ID NO: 944965 - RNA, 17 nt, Homo sapiens
aggagggcaguggugga

SEQ ID NO: 944966 - RNA, 23 nt, Homo sapiens
aggagggccagcgcuguggaccu

SEQ ID NO: 944967 - RNA, 23 nt, Homo sapiens
aggagguccuuaggccucugaga

SEQ ID NO: 944968 - RNA, 20 nt, Homo sapiens
aggaugucugagaccacuug

SEQ ID NO: 944969 - RNA, 14 nt, Homo sapiens
aggauuguggucac

SEQ ID NO: 944970 - RNA, 14 nt, Homo sapiens
aggauuuuaccaaa

SEQ ID NO: 944971 - RNA, 16 nt, Homo sapiens
aggauuuuaccaaagc

SEQ ID NO: 944972 - RNA, 17 nt, Homo sapiens
aggcaggagaaucucuu

SEQ ID NO: 944973 - RNA, 13 nt, Homo sapiens
aggcaggaggagc

SEQ ID NO: 944974 - RNA, 15 nt, Homo sapiens
aggcaguaaugccuu

SEQ ID NO: 944975 - RNA, 18 nt, Homo sapiens
aggcagugcugagaggga

SEQ ID NO: 944976 - RNA, 14 nt, Homo sapiens
aggcauuuccagac

SEQ ID NO: 944977 - RNA, 15 nt, Homo sapiens
aggccacauaccucu

SEQ ID NO: 944978 - RNA, 12 nt, Homo sapiens
aggccagugcua

SEQ ID NO: 944979 - RNA, 15 nt, Homo sapiens
aggccuagacucugu

SEQ ID NO: 944980 - RNA, 13 nt, Homo sapiens
aggccucugagaa

SEQ ID NO: 944981 - RNA, 12 nt, Homo sapiens
aggccuguccaa

SEQ ID NO: 944982 - RNA, 13 nt, Homo sapiens
cccaagcgucauc

SEQ ID NO: 944983 - RNA, 17 nt, Homo sapiens
cccaccuggugugacuu

SEQ ID NO: 944984 - RNA, 20 nt, Homo sapiens
cccacgcugaccaugcguca

SEQ ID NO: 944985 - RNA, 13 nt, Homo sapiens
cccagcacuuugg

SEQ ID NO: 944986 - RNA, 22 nt, Homo sapiens
cccaggacgccacucauuucau

SEQ ID NO: 944987 - RNA, 17 nt, Homo sapiens
cccaggagccucacugg

SEQ ID NO: 944988 - RNA, 21 nt, Homo sapiens
cccaggccuguacagauguau

SEQ ID NO: 944989 - RNA, 17 nt, Homo sapiens
cccagggggcggggugc

SEQ ID NO: 944990 - RNA, 17 nt, Homo sapiens
cccagugacaacaucgc

SEQ ID NO: 944991 - RNA, 19 nt, Homo sapiens
cccagugacaacaucgcaa

SEQ ID NO: 944992 - RNA, 19 nt, Homo sapiens
cccaguucauugcacuuug

SEQ ID NO: 944993 - RNA, 14 nt, Homo sapiens
gauuuuaccaaagc

SEQ ID NO: 944994 - RNA, 19 nt, Homo sapiens
gauuuuugacucuggcaaa

SEQ ID NO: 944995 - RNA, 17 nt, Homo sapiens
gauuuuuuccucugcau

SEQ ID NO: 944996 - RNA, 18 nt, Homo sapiens
gauuuuuuccucugcauu

SEQ ID NO: 944997 - RNA, 22 nt, Homo sapiens
gauuuuuugcauuccugacaaa

SEQ ID NO: 944998 - RNA, 19 nt, Homo sapiens
gauuuuuuuguaaauauga

SEQ ID NO: 944999 - RNA, 18 nt, Homo sapiens
gcaacauucauagucuuu

SEQ ID NO: 945000 - RNA, 23 nt, Homo sapiens
gcaacuaggaaaaucacuugcca

SEQ ID NO: 945001 - RNA, 20 nt, Homo sapiens
gcaacuuuaguuuguguuau

SEQ ID NO: 945002 - RNA, 19 nt, Homo sapiens
gcaauaaauaacacuuguc

SEQ ID NO: 945003 - RNA, 21 nt, Homo sapiens
gcaauagacacauacauguca

SEQ ID NO: 945004 - RNA, 21 nt, Homo sapiens
gcaauuuuucaagagcuccuu

SEQ ID NO: 945005 - RNA, 17 nt, Homo sapiens
gcacacccuccagagac

SEQ ID NO: 945006 - RNA, 10 nt, Homo sapiens
gcaccaaaga

SEQ ID NO: 945007 - RNA, 11 nt, Homo sapiens
gcaccaaagac

SEQ ID NO: 945008 - RNA, 17 nt, Homo sapiens
gcaccaaagacaucagu

SEQ ID NO: 945009 - RNA, 22 nt, Homo sapiens
gcacucucgcacacacagugau

SEQ ID NO: 945010 - RNA, 15 nt, Homo sapiens
gcacuucaaauucaa

SEQ ID NO: 945011 - RNA, 13 nt, Homo sapiens
gcacuucauguaa

SEQ ID NO: 945012 - RNA, 21 nt, Homo sapiens
gcacuucauguaaagugucag

SEQ ID NO: 945013 - RNA, 18 nt, Homo sapiens
gcagaaagggccuugaau

SEQ ID NO: 945014 - RNA, 16 nt, Homo sapiens
gcagagagcacaguga

SEQ ID NO: 945015 - RNA, 18 nt, Homo sapiens
gcagagagcacagugauc

SEQ ID NO: 945016 - RNA, 16 nt, Homo sapiens
gcagaggggugcucau

SEQ ID NO: 945017 - RNA, 13 nt, Homo sapiens
gcagauauagcau

SEQ ID NO: 945018 - RNA, 19 nt, Homo sapiens
gcagaucgcucacuguugu

SEQ ID NO: 945019 - RNA, 20 nt, Homo sapiens
gcagcacagcagacuaguua

SEQ ID NO: 945020 - RNA, 20 nt, Homo sapiens
gcagcuaaaggaagugaauc

SEQ ID NO: 945021 - RNA, 23 nt, Homo sapiens
gcagcuggcagagagcacaguga

SEQ ID NO: 945022 - RNA, 16 nt, Homo sapiens
gcaggaccucaccaaa

SEQ ID NO: 945023 - RNA, 17 nt, Homo sapiens
gcaggacuggauuuuaa

SEQ ID NO: 945024 - RNA, 14 nt, Homo sapiens
gcaggauaaucgcu

SEQ ID NO: 945025 - RNA, 16 nt, Homo sapiens
gcaggcccacucccca

SEQ ID NO: 945026 - RNA, 14 nt, Homo sapiens
gcaggcugggccau

SEQ ID NO: 945027 - RNA, 18 nt, Homo sapiens
gcaggcugggccaugucc

SEQ ID NO: 945028 - RNA, 20 nt, Homo sapiens
gcaggggaauucccuccccc

SEQ ID NO: 945029 - RNA, 23 nt, Homo sapiens
gcaguauauaggugcuggaugua

SEQ ID NO: 945030 - RNA, 21 nt, Homo sapiens
gcaguauuggacaaagagcau

SEQ ID NO: 945031 - RNA, 16 nt, Homo sapiens
gcaguggcucaugccu

SEQ ID NO: 945032 - RNA, 20 nt, Homo sapiens
gcaucuagauuauggagcuu

SEQ ID NO: 945033 - RNA, 20 nt, Homo sapiens
gcaucuauuuccucugugca

SEQ ID NO: 945034 - RNA, 14 nt, Homo sapiens
gcaucugcaacaaa

SEQ ID NO: 945035 - RNA, 21 nt, Homo sapiens
gcaugugcggcggcuaccuga

SEQ ID NO: 945036 - RNA, 18 nt, Homo sapiens
gcauuuaccaugugcuaa

SEQ ID NO: 945037 - RNA, 15 nt, Homo sapiens
gcauuuccagacuug

SEQ ID NO: 945038 - RNA, 21 nt, Homo sapiens
gcauuuuauaggcauaccucc

SEQ ID NO: 945039 - RNA, 13 nt, Homo sapiens
gccaagguaggca

SEQ ID NO: 945040 - RNA, 15 nt, Homo sapiens
gccacagucacugga

SEQ ID NO: 945041 - RNA, 12 nt, Homo sapiens
gccacuucucac

SEQ ID NO: 945042 - RNA, 15 nt, Homo sapiens
gccagagaugcaaua

SEQ ID NO: 945043 - RNA, 22 nt, Homo sapiens
gccagccccgccacgcuugugu

SEQ ID NO: 945044 - RNA, 18 nt, Homo sapiens
gccagccucagaaggccc

SEQ ID NO: 945045 - RNA, 18 nt, Homo sapiens
gccaggcaugguggcuca

SEQ ID NO: 945046 - RNA, 22 nt, Homo sapiens
gccagguaugggccagcaguuu

SEQ ID NO: 945047 - RNA, 15 nt, Homo sapiens
gccaguuaauuuuaa

SEQ ID NO: 945048 - RNA, 23 nt, Homo sapiens
gccaucccuuuuuuuacauuuca

SEQ ID NO: 945049 - RNA, 13 nt, Homo sapiens
gccauguccaaag

SEQ ID NO: 945050 - RNA, 14 nt, Homo sapiens
gccauguccaaaga

SEQ ID NO: 945051 - RNA, 15 nt, Homo sapiens
gccauguccaaagag

SEQ ID NO: 945052 - RNA, 16 nt, Homo sapiens
gccauguccaaagagg

SEQ ID NO: 945053 - RNA, 13 nt, Homo sapiens
gccauucaugucc

SEQ ID NO: 945054 - RNA, 18 nt, Homo sapiens
gccauugcauuccagccu

SEQ ID NO: 945055 - RNA, 20 nt, Homo sapiens
gcccaaguaccacgcagugc

SEQ ID NO: 945056 - RNA, 20 nt, Homo sapiens
gcccaggcuggagugcagug

SEQ ID NO: 945057 - RNA, 19 nt, Homo sapiens
gcccaugaugagaagcaga

SEQ ID NO: 945058 - RNA, 16 nt, Homo sapiens
gcccccuccucuagcu

SEQ ID NO: 945059 - RNA, 14 nt, Homo sapiens
gccccucucaccaa

SEQ ID NO: 945060 - RNA, 17 nt, Homo sapiens
gcccucaacuauucugu

SEQ ID NO: 945061 - RNA, 16 nt, Homo sapiens
gcccucagaacaaucc

SEQ ID NO: 945062 - RNA, 18 nt, Homo sapiens
gcccugcagggaguaccg

SEQ ID NO: 945063 - RNA, 23 nt, Homo sapiens
gcccugcuuuugcauaaugcaau

SEQ ID NO: 945064 - RNA, 17 nt, Homo sapiens
gcccuucacuuccauca

SEQ ID NO: 945065 - RNA, 16 nt, Homo sapiens
gcccuucauugccaca

SEQ ID NO: 945066 - RNA, 16 nt, Homo sapiens
gcccuucccccugcaa

SEQ ID NO: 945067 - RNA, 22 nt, Homo sapiens
gccgaccacagggccuugaauc

SEQ ID NO: 945068 - RNA, 16 nt, Homo sapiens
gccggaucugagggag

SEQ ID NO: 945069 - RNA, 19 nt, Homo sapiens
gccuauuugcugaccacac

SEQ ID NO: 945070 - RNA, 22 nt, Homo sapiens
gccuauuugcugaccacacucc

SEQ ID NO: 945071 - RNA, 13 nt, Homo sapiens
gccucacuggggc

SEQ ID NO: 945072 - RNA, 22 nt, Homo sapiens
gccucacuggggcagacaauaa

SEQ ID NO: 945073 - RNA, 11 nt, Homo sapiens
gccuccagggc

SEQ ID NO: 945074 - RNA, 21 nt, Homo sapiens
gccucccccucagaugaucuc

SEQ ID NO: 945075 - RNA, 18 nt, Homo sapiens
gccucgugccaugaucug

SEQ ID NO: 945076 - RNA, 14 nt, Homo sapiens
gccucugugccuuc

SEQ ID NO: 945077 - RNA, 13 nt, Homo sapiens
gccugcaagcuuc

SEQ ID NO: 945078 - RNA, 13 nt, Homo sapiens
gccuguaauccca

SEQ ID NO: 945079 - RNA, 22 nt, Homo sapiens
gccuguaaucccagcacuuugg

SEQ ID NO: 945080 - RNA, 21 nt, Homo sapiens
gccuuaaguggcagaauauaa

SEQ ID NO: 945081 - RNA, 18 nt, Homo sapiens
gccuuagucucaguuugu

SEQ ID NO: 945082 - RNA, 13 nt, Homo sapiens
ugaaccuguauaa

SEQ ID NO: 945083 - RNA, 20 nt, Homo sapiens
ugaacucucugccuguaaau

SEQ ID NO: 945084 - RNA, 18 nt, Homo sapiens
ugaagagcgauugugagg

SEQ ID NO: 945085 - RNA, 23 nt, Homo sapiens
ugaagcauaccccggccucucag

SEQ ID NO: 945086 - RNA, 15 nt, Homo sapiens
ugaagccaaagggac

SEQ ID NO: 945087 - RNA, 21 nt, Homo sapiens
ugaagccaaaugaaacucaaa

SEQ ID NO: 945088 - RNA, 18 nt, Homo sapiens
ugaagggucuuucucaaa

SEQ ID NO: 945089 - RNA, 23 nt, Homo sapiens
ugaagugaccuggaaucagugaa

SEQ ID NO: 945090 - RNA, 16 nt, Homo sapiens
ugaagugcuguggcug

SEQ ID NO: 945091 - RNA, 16 nt, Homo sapiens
ugaauaccacuuaccu

SEQ ID NO: 945092 - RNA, 16 nt, Homo sapiens
ugaaugagagguuccu

SEQ ID NO: 945093 - RNA, 22 nt, Homo sapiens
ugaaugucauugaaaaacuaaa

SEQ ID NO: 945094 - RNA, 18 nt, Homo sapiens
ugaauucugucauuucaa

SEQ ID NO: 945095 - RNA, 20 nt, Homo sapiens
ugaauuguuuuuguacaguu

SEQ ID NO: 945096 - RNA, 17 nt, Homo sapiens
ugaauuugcacuguuua

SEQ ID NO: 945097 - RNA, 20 nt, Homo sapiens
ugacaaaccauaacugacaa

SEQ ID NO: 945098 - RNA, 18 nt, Homo sapiens
ugacacaaguggaccuua

SEQ ID NO: 945099 - RNA, 19 nt, Homo sapiens
ugacaguccacaggggcca

SEQ ID NO: 945100 - RNA, 22 nt, Homo sapiens
ugacaguuaauaaaccuuugca

SEQ ID NO: 945101 - RNA, 14 nt, Homo sapiens
guaagacaggccag

SEQ ID NO: 945102 - RNA, 17 nt, Homo sapiens
guaauacaaacuauaua

SEQ ID NO: 945103 - RNA, 19 nt, Homo sapiens
guaaucucuaggaagucaa

SEQ ID NO: 945104 - RNA, 19 nt, Homo sapiens
guacaacagaauaaugcau

SEQ ID NO: 945105 - RNA, 16 nt, Homo sapiens
guacaggaaugaaccu

SEQ ID NO: 945106 - RNA, 15 nt, Homo sapiens
guaccaagugaaauu

SEQ ID NO: 945107 - RNA, 14 nt, Homo sapiens
guaccaauucagug

SEQ ID NO: 945108 - RNA, 15 nt, Homo sapiens
guacccccccagggg

SEQ ID NO: 945109 - RNA, 22 nt, Homo sapiens
guacugguccccuucugggcaa

SEQ ID NO: 945110 - RNA, 18 nt, Homo sapiens
guacuuuuaaaaacauaa

SEQ ID NO: 945111 - RNA, 21 nt, Homo sapiens
guagcaacaacagaagggaaa

SEQ ID NO: 945112 - RNA, 21 nt, Homo sapiens
guagccugggcucacugugcu

SEQ ID NO: 945113 - RNA, 21 nt, Homo sapiens
guaggagcugccuuggcucag

SEQ ID NO: 945114 - RNA, 17 nt, Homo sapiens
guaggcacgaagcaauu

SEQ ID NO: 945115 - RNA, 15 nt, Homo sapiens
guaggugcuaaccug

SEQ ID NO: 945116 - RNA, 21 nt, Homo sapiens
guauaaguggaggcacuuuag

SEQ ID NO: 945117 - RNA, 21 nt, Homo sapiens
guauaaucuuguagacacuua

SEQ ID NO: 945118 - RNA, 23 nt, Homo sapiens
guauccaugcaccuaccuuagaa

SEQ ID NO: 945119 - RNA, 14 nt, Homo sapiens
guaugacaaccucu

SEQ ID NO: 945120 - RNA, 15 nt, Homo sapiens
gucaacaacuuacac

SEQ ID NO: 945121 - RNA, 22 nt, Homo sapiens
gucaacaucaaagagcacauuu

SEQ ID NO: 945122 - RNA, 13 nt, Homo sapiens
gucaaucacugca

SEQ ID NO: 945123 - RNA, 12 nt, Homo sapiens
gucaccagagac

SEQ ID NO: 945124 - RNA, 22 nt, Homo sapiens
gucaccaggauuacuagucaaa

SEQ ID NO: 945125 - RNA, 23 nt, Homo sapiens
gucacgcuuucaugaauucuguc

SEQ ID NO: 945126 - RNA, 15 nt, Homo sapiens
gucacucauugcuga

SEQ ID NO: 945127 - RNA, 15 nt, Homo sapiens
gucacuccacgcagc

SEQ ID NO: 945128 - RNA, 18 nt, Homo sapiens
gucagugguggucuucaa

SEQ ID NO: 945129 - RNA, 17 nt, Homo sapiens
gucaucaggugcauagc

SEQ ID NO: 945130 - RNA, 14 nt, Homo sapiens
guccacugucaggg

SEQ ID NO: 945131 - RNA, 20 nt, Homo sapiens
guccuuaucaccagccucac

SEQ ID NO: 945132 - RNA, 23 nt, Homo sapiens
guccuuucccuucaguacccucu

SEQ ID NO: 945133 - RNA, 15 nt, Homo sapiens
gucuccugagcaccc

SEQ ID NO: 945134 - RNA, 14 nt, Homo sapiens
gucugagaccacuu

SEQ ID NO: 945135 - RNA, 20 nt, Homo sapiens
gucuuaggaauugaauuaau

SEQ ID NO: 945136 - RNA, 16 nt, Homo sapiens
gucuucucacaagcca

SEQ ID NO: 945137 - RNA, 15 nt, Homo sapiens
gucuugugaaggcag

SEQ ID NO: 945138 - RNA, 20 nt, Homo sapiens
gucuuucacagcuccuccca

SEQ ID NO: 945139 - RNA, 19 nt, Homo sapiens
gucuuugccagucauucag

SEQ ID NO: 945140 - RNA, 21 nt, Homo sapiens
gucuuuuuuucccuaccauuc

SEQ ID NO: 945141 - RNA, 21 nt, Homo sapiens
gugaaauuauuuuggagauua

SEQ ID NO: 945142 - RNA, 17 nt, Homo sapiens
gugaauuaaaguacuuu

SEQ ID NO: 945143 - RNA, 19 nt, Homo sapiens
gugagccaucaucauggca

SEQ ID NO: 945144 - RNA, 14 nt, Homo sapiens
gugaugucauuuga

SEQ ID NO: 945145 - RNA, 18 nt, Homo sapiens
gugcaaaugugcugguca

SEQ ID NO: 945146 - RNA, 23 nt, Homo sapiens
gugcaauagacacauacauguca

SEQ ID NO: 945147 - RNA, 18 nt, Homo sapiens
gugcacaggcgcauccca

SEQ ID NO: 945148 - RNA, 16 nt, Homo sapiens
gugcaggacacugguc

SEQ ID NO: 945149 - RNA, 19 nt, Homo sapiens
gugcaguggcgcauucuag

SEQ ID NO: 945150 - RNA, 18 nt, Homo sapiens
gugcaugugcgcgcgugc

SEQ ID NO: 945151 - RNA, 13 nt, Homo sapiens
gugcuacaauuca

SEQ ID NO: 945152 - RNA, 19 nt, Homo sapiens
gugcuccagucauugcaca

SEQ ID NO: 945153 - RNA, 15 nt, Homo sapiens
gugcuugagccagga

SEQ ID NO: 945154 - RNA, 16 nt, Homo sapiens
gugcuuucuaaucucc

SEQ ID NO: 945155 - RNA, 19 nt, Homo sapiens
guggacugugcuggugcau

SEQ ID NO: 945156 - RNA, 19 nt, Homo sapiens
guggccucagcccucagaa

SEQ ID NO: 945157 - RNA, 20 nt, Homo sapiens
guggggaccgggcucugaca

SEQ ID NO: 945158 - RNA, 13 nt, Homo sapiens
gugguaugaaaug

SEQ ID NO: 945159 - RNA, 18 nt, Homo sapiens
gugguaugaaaugucuga

SEQ ID NO: 945160 - RNA, 16 nt, Homo sapiens
gugguccccguuccac

SEQ ID NO: 945161 - RNA, 17 nt, Homo sapiens
guggugacaccuccccc

SEQ ID NO: 945162 - RNA, 18 nt, Homo sapiens
gugucucaggaaaacagc

SEQ ID NO: 945163 - RNA, 18 nt, Homo sapiens
gugucucugaggacguca

SEQ ID NO: 945164 - RNA, 18 nt, Homo sapiens
gugugccaagaguucgau

SEQ ID NO: 945165 - RNA, 11 nt, Homo sapiens
gugugguggcu

SEQ ID NO: 945166 - RNA, 20 nt, Homo sapiens
guuaauaagugguaucugac

SEQ ID NO: 945167 - RNA, 16 nt, Homo sapiens
guuaaugcugaaacau

SEQ ID NO: 945168 - RNA, 20 nt, Homo sapiens
guuaggggaauggagggaau

SEQ ID NO: 945169 - RNA, 14 nt, Homo sapiens
guuauagcuucagg

SEQ ID NO: 945170 - RNA, 16 nt, Homo sapiens
guuccacagaggacac

SEQ ID NO: 945171 - RNA, 22 nt, Homo sapiens
guuccauacccccacaugccaa

SEQ ID NO: 945172 - RNA, 20 nt, Homo sapiens
guucccaagcgucaucugug

SEQ ID NO: 945173 - RNA, 21 nt, Homo sapiens
guuccccaguagagcucuacu

SEQ ID NO: 945174 - RNA, 15 nt, Homo sapiens
guuccucccaggaag

SEQ ID NO: 945175 - RNA, 17 nt, Homo sapiens
guugaauguugcaaugu

SEQ ID NO: 945176 - RNA, 19 nt, Homo sapiens
guugaucugauaagcaaga

SEQ ID NO: 945177 - RNA, 20 nt, Homo sapiens
guugcccuugugcuccaguc

SEQ ID NO: 945178 - RNA, 21 nt, Homo sapiens
guuggagacucagcauugggg

SEQ ID NO: 945179 - RNA, 15 nt, Homo sapiens
guuguacaaucaaaa

SEQ ID NO: 945180 - RNA, 17 nt, Homo sapiens
guugucuccacuuguau

SEQ ID NO: 945181 - RNA, 13 nt, Homo sapiens
guuuccuggucag

SEQ ID NO: 945182 - RNA, 14 nt, Homo sapiens
guuucuggcucuug

SEQ ID NO: 945183 - RNA, 22 nt, Homo sapiens
guuugacccaggggucagccuu

SEQ ID NO: 945184 - RNA, 22 nt, Homo sapiens
guuugucacacgauaaagggau

SEQ ID NO: 945185 - RNA, 15 nt, Homo sapiens
guuuuagaaccagcc

SEQ ID NO: 945186 - RNA, 14 nt, Homo sapiens
guuuucuucauuca

SEQ ID NO: 945187 - RNA, 16 nt, Homo sapiens
uuauauacaagugaua

SEQ ID NO: 945188 - RNA, 22 nt, Homo sapiens
uuaucaagcauuuaccaugugc

SEQ ID NO: 945189 - RNA, 22 nt, Homo sapiens
uuaugaccaugguauauuccua

SEQ ID NO: 945190 - RNA, 23 nt, Homo sapiens
uuaugcauguaauggacuaugca

SEQ ID NO: 945191 - RNA, 20 nt, Homo sapiens
uuaugucccugacuguaaau

SEQ ID NO: 945192 - RNA, 21 nt, Homo sapiens
uuaugucuggggcagaaacac

SEQ ID NO: 945193 - RNA, 19 nt, Homo sapiens
uucaaaccacaauauccag

SEQ ID NO: 945194 - RNA, 18 nt, Homo sapiens
uucaauuguaaauugaau

SEQ ID NO: 945195 - RNA, 17 nt, Homo sapiens
uucacgaacaugggcau

SEQ ID NO: 945196 - RNA, 19 nt, Homo sapiens
uucacuuaaguuaguucca

SEQ ID NO: 945197 - RNA, 13 nt, Homo sapiens
uucagagcacuca

SEQ ID NO: 945198 - RNA, 19 nt, Homo sapiens
uucaggagggaaccagcuu

SEQ ID NO: 945199 - RNA, 18 nt, Homo sapiens
uucagguaauacaaacua

SEQ ID NO: 945200 - RNA, 13 nt, Homo sapiens
uucauauaacguc

SEQ ID NO: 945201 - RNA, 17 nt, Homo sapiens
uucauauuuuaaacaga

SEQ ID NO: 945202 - RNA, 18 nt, Homo sapiens
uucauauuuuaaacagag

SEQ ID NO: 945203 - RNA, 23 nt, Homo sapiens
uucaugcuggccugugugauaca

SEQ ID NO: 945204 - RNA, 23 nt, Homo sapiens
uucauuccuaaagaaaaauaucu

SEQ ID NO: 945205 - RNA, 15 nt, Homo sapiens
uuccaaaacauuucu

SEQ ID NO: 945206 - RNA, 16 nt, Homo sapiens
uuccagcuccuguaac

SEQ ID NO: 945207 - RNA, 16 nt, Homo sapiens
uuccaucugugccaua

SEQ ID NO: 945208 - RNA, 23 nt, Homo sapiens
uucccaagcgucaucuguguaaa

SEQ ID NO: 945209 - RNA, 12 nt, Homo sapiens
gaguuuguuacc

SEQ ID NO: 945210 - RNA, 16 nt, Homo sapiens
gauaauacagauuugu

SEQ ID NO: 945211 - RNA, 21 nt, Homo sapiens
gauacuuggaugcagcucuug

SEQ ID NO: 945212 - RNA, 17 nt, Homo sapiens
gaucaaagaacugaaag

SEQ ID NO: 945213 - RNA, 15 nt, Homo sapiens
gaucaacaauaccuu

SEQ ID NO: 945214 - RNA, 19 nt, Homo sapiens
gaucaacagaucaacaaua

SEQ ID NO: 945215 - RNA, 18 nt, Homo sapiens
gaucagagcgcacaggga

SEQ ID NO: 945216 - RNA, 17 nt, Homo sapiens
gauccagccucauaccu

SEQ ID NO: 945217 - RNA, 19 nt, Homo sapiens
gauccucaugguucccaag

SEQ ID NO: 945218 - RNA, 23 nt, Homo sapiens
gaucugauaaggaucuaggagaa

SEQ ID NO: 945219 - RNA, 16 nt, Homo sapiens
gaucuugagaaccuuu

SEQ ID NO: 945220 - RNA, 17 nt, Homo sapiens
gaugaaauuauuuguca

SEQ ID NO: 945221 - RNA, 17 nt, Homo sapiens
gaugagcaagacauacu

SEQ ID NO: 945222 - RNA, 21 nt, Homo sapiens
gaugagcuuugucuacuucaa

SEQ ID NO: 945223 - RNA, 17 nt, Homo sapiens
gaugcacguggggccca

SEQ ID NO: 945224 - RNA, 23 nt, Homo sapiens
gauucuuauuaguuccccaaaua

SEQ ID NO: 945225 - RNA, 19 nt, Homo sapiens
gauuuuaccaaagcaucaa

SEQ ID NO: 945226 - RNA, 18 nt, Homo sapiens
gcaaaaugagacuuucua

SEQ ID NO: 945227 - RNA, 21 nt, Homo sapiens
gcaacaagaccaccacuucga

SEQ ID NO: 945228 - RNA, 21 nt, Homo sapiens
gcaacagagcaagacuccauc

SEQ ID NO: 945229 - RNA, 16 nt, Homo sapiens
gcaagguuuggugcaa

SEQ ID NO: 945230 - RNA, 15 nt, Homo sapiens
gcaagugaaagcaag

SEQ ID NO: 945231 - RNA, 22 nt, Homo sapiens
gcaauaauccaguaaucuaaag

SEQ ID NO: 945232 - RNA, 21 nt, Homo sapiens
gcaaucaaaaauauguguuuu

SEQ ID NO: 945233 - RNA, 23 nt, Homo sapiens
gcaauccaugagauagcuauuau

SEQ ID NO: 945234 - RNA, 16 nt, Homo sapiens
gcaaucuccuuacugu

SEQ ID NO: 945235 - RNA, 13 nt, Homo sapiens
gcacacacaguga

SEQ ID NO: 945236 - RNA, 14 nt, Homo sapiens
gcacacacagugau

SEQ ID NO: 945237 - RNA, 14 nt, Homo sapiens
gcacagugaucacc

SEQ ID NO: 945238 - RNA, 21 nt, Homo sapiens
gcacauauccaggcaccagga

SEQ ID NO: 945239 - RNA, 22 nt, Homo sapiens
gcacauauccaggcaccaggac

SEQ ID NO: 945240 - RNA, 23 nt, Homo sapiens
gcaccaaagacaucagucuccaa

SEQ ID NO: 945241 - RNA, 18 nt, Homo sapiens
gcacccauuucaaugugu

SEQ ID NO: 945242 - RNA, 13 nt, Homo sapiens
gcacccuacaggg

SEQ ID NO: 945243 - RNA, 19 nt, Homo sapiens
gcacccuaguucuaccuca

SEQ ID NO: 945244 - RNA, 17 nt, Homo sapiens
gcacccugcccaccaag

SEQ ID NO: 945245 - RNA, 18 nt, Homo sapiens
gcacccugcccaccaaga

SEQ ID NO: 945246 - RNA, 21 nt, Homo sapiens
gcacuuugaaggggccucacc

SEQ ID NO: 945247 - RNA, 18 nt, Homo sapiens
gcacuuuucaaacaauca

SEQ ID NO: 945248 - RNA, 19 nt, Homo sapiens
gcagaaagggccuugaauc

SEQ ID NO: 945249 - RNA, 19 nt, Homo sapiens
gcagacaauaaacccucag

SEQ ID NO: 945250 - RNA, 15 nt, Homo sapiens
gcagacucgggacca

SEQ ID NO: 945251 - RNA, 16 nt, Homo sapiens
gcagacucgggaccaa

SEQ ID NO: 945252 - RNA, 17 nt, Homo sapiens
gcagagagcacagugau

SEQ ID NO: 945253 - RNA, 13 nt, Homo sapiens
gcagcuuugcaaa

SEQ ID NO: 945254 - RNA, 14 nt, Homo sapiens
gcaggaaggaacaa

SEQ ID NO: 945255 - RNA, 13 nt, Homo sapiens
gcaggacacuggu

SEQ ID NO: 945256 - RNA, 21 nt, Homo sapiens
gcaggacuugagaagaccuca

SEQ ID NO: 945257 - RNA, 18 nt, Homo sapiens
gcaggagagucacuugaa

SEQ ID NO: 945258 - RNA, 19 nt, Homo sapiens
gcaggcugggccaugucca

SEQ ID NO: 945259 - RNA, 14 nt, Homo sapiens
gcaguauagacaau

SEQ ID NO: 945260 - RNA, 20 nt, Homo sapiens
gcagucucucucugccaugg

SEQ ID NO: 945261 - RNA, 17 nt, Homo sapiens
gcagugugaaaaguccu

SEQ ID NO: 945262 - RNA, 20 nt, Homo sapiens
gcauaagagcuuaagaacca

SEQ ID NO: 945263 - RNA, 17 nt, Homo sapiens
gcaucaauacaaccagc

SEQ ID NO: 945264 - RNA, 19 nt, Homo sapiens
gcaucaucaaaaacuuugg

SEQ ID NO: 945265 - RNA, 21 nt, Homo sapiens
gcaucuauuuccucugugcaa

SEQ ID NO: 945266 - RNA, 15 nt, Homo sapiens
gcaucuggaagauca

SEQ ID NO: 945267 - RNA, 17 nt, Homo sapiens
gcauggaacagcauuac

SEQ ID NO: 945268 - RNA, 17 nt, Homo sapiens
gcauuccagccugggca

SEQ ID NO: 945269 - RNA, 18 nt, Homo sapiens
gcauuuccuggucagugg

SEQ ID NO: 945270 - RNA, 20 nt, Homo sapiens
gccaaaggucccuccccaga

SEQ ID NO: 945271 - RNA, 20 nt, Homo sapiens
gccaagaucgccccacugca

SEQ ID NO: 945272 - RNA, 14 nt, Homo sapiens
gccacauaccucuc

SEQ ID NO: 945273 - RNA, 21 nt, Homo sapiens
gccacccccaggcaucuguua

SEQ ID NO: 945274 - RNA, 23 nt, Homo sapiens
gccagccucagaaggccccagag

SEQ ID NO: 945275 - RNA, 14 nt, Homo sapiens
gccagcuacuuccu

SEQ ID NO: 945276 - RNA, 20 nt, Homo sapiens
gccaggaucccccucuuugc

SEQ ID NO: 945277 - RNA, 19 nt, Homo sapiens
gcccaaacuggagugcagu

SEQ ID NO: 945278 - RNA, 15 nt, Homo sapiens
gcccaggagccucac

SEQ ID NO: 945279 - RNA, 20 nt, Homo sapiens
gcccaggagccucacugggg

SEQ ID NO: 945280 - RNA, 21 nt, Homo sapiens
gcccaugacaccaaaccugcc

SEQ ID NO: 945281 - RNA, 21 nt, Homo sapiens
gcccauggugagcucugggaa

SEQ ID NO: 945282 - RNA, 16 nt, Homo sapiens
gccccagccccuucca

SEQ ID NO: 945283 - RNA, 14 nt, Homo sapiens
gccccucugaccug

SEQ ID NO: 945284 - RNA, 15 nt, Homo sapiens
gcccuccucugucaa

SEQ ID NO: 945285 - RNA, 15 nt, Homo sapiens
gcccuugugcuccag

SEQ ID NO: 945286 - RNA, 22 nt, Homo sapiens
gccgugcucgcccacaaacuga

SEQ ID NO: 945287 - RNA, 15 nt, Homo sapiens
gccucacaaucccac

SEQ ID NO: 945288 - RNA, 21 nt, Homo sapiens
gccucucggugaccuccgucc

SEQ ID NO: 945289 - RNA, 17 nt, Homo sapiens
gccugggaauggauuag

SEQ ID NO: 945290 - RNA, 19 nt, Homo sapiens
gccuguaaucccagcacuu

SEQ ID NO: 945291 - RNA, 23 nt, Homo sapiens
gccuguuggcaggcccacucccc

SEQ ID NO: 945292 - RNA, 23 nt, Homo sapiens
gccuuaaucccagcacuuuggga

SEQ ID NO: 945293 - RNA, 18 nt, Homo sapiens
gccuuagcaauaauccag

SEQ ID NO: 945294 - RNA, 18 nt, Homo sapiens
gccuuguaagacccuuau

SEQ ID NO: 945295 - RNA, 20 nt, Homo sapiens
gccuugugugaacucaccaa

SEQ ID NO: 945296 - RNA, 13 nt, Homo sapiens
gcgagguguaaag

SEQ ID NO: 945297 - RNA, 21 nt, Homo sapiens
gcggaaggagggagcucugau

SEQ ID NO: 945298 - RNA, 19 nt, Homo sapiens
gcggcaggaagggggccga

SEQ ID NO: 945299 - RNA, 15 nt, Homo sapiens
gcggcgucccuucca

SEQ ID NO: 945300 - RNA, 23 nt, Homo sapiens
gcguuuggacccaguucagugag

SEQ ID NO: 945301 - RNA, 13 nt, Homo sapiens
gcuaaauauuuac

SEQ ID NO: 945302 - RNA, 18 nt, Homo sapiens
gcuacuguaauuuuauau

SEQ ID NO: 945303 - RNA, 16 nt, Homo sapiens
gcuauaaguuuuagaa

SEQ ID NO: 945304 - RNA, 21 nt, Homo sapiens
gcuauguauaaaauacauagu

SEQ ID NO: 945305 - RNA, 14 nt, Homo sapiens
gcuauuugucaucu

SEQ ID NO: 945306 - RNA, 15 nt, Homo sapiens
gcucagaaaggaaau

SEQ ID NO: 945307 - RNA, 17 nt, Homo sapiens
gcucagagggaccucac

SEQ ID NO: 945308 - RNA, 15 nt, Homo sapiens
gcucaggcacauaca

SEQ ID NO: 945309 - RNA, 13 nt, Homo sapiens
gcucaggugcaag

SEQ ID NO: 945310 - RNA, 22 nt, Homo sapiens
gcucaguaaacgggaacaugcc

SEQ ID NO: 945311 - RNA, 19 nt, Homo sapiens
gcucagucgcuagcauuuc

SEQ ID NO: 945312 - RNA, 18 nt, Homo sapiens
gcuccagucauugcacaa

SEQ ID NO: 945313 - RNA, 16 nt, Homo sapiens
gcuccccucacucugu

SEQ ID NO: 945314 - RNA, 23 nt, Homo sapiens
gcuccccugaggaauaugucaua

SEQ ID NO: 945315 - RNA, 21 nt, Homo sapiens
gcucccucuauuuauguuugc

SEQ ID NO: 945316 - RNA, 13 nt, Homo sapiens
uaaaaaagcauac

SEQ ID NO: 945317 - RNA, 14 nt, Homo sapiens
uaaaaacauaacau

SEQ ID NO: 945318 - RNA, 19 nt, Homo sapiens
uaaaaaguuagccagguau

SEQ ID NO: 945319 - RNA, 16 nt, Homo sapiens
uaaaaauugacaauga

SEQ ID NO: 945320 - RNA, 16 nt, Homo sapiens
uaaaacaaaauuugac

SEQ ID NO: 945321 - RNA, 22 nt, Homo sapiens
uaaaacaaaauuugacuaauuu

SEQ ID NO: 945322 - RNA, 18 nt, Homo sapiens
uaaaagagaagcaucauu

SEQ ID NO: 945323 - RNA, 13 nt, Homo sapiens
uaaaaguggcauu

SEQ ID NO: 945324 - RNA, 16 nt, Homo sapiens
uaaaaucaaaugugca

SEQ ID NO: 945325 - RNA, 17 nt, Homo sapiens
uaaaaucaaaugugcau

SEQ ID NO: 945326 - RNA, 12 nt, Homo sapiens
uaaacagaggau

SEQ ID NO: 945327 - RNA, 18 nt, Homo sapiens
uaaacagauggcacuuug

SEQ ID NO: 945328 - RNA, 19 nt, Homo sapiens
uaaacuauaaaacaaaaau

SEQ ID NO: 945329 - RNA, 17 nt, Homo sapiens
uaaacuaugaggacugc

SEQ ID NO: 945330 - RNA, 22 nt, Homo sapiens
uaaacucaucugaaauguuaca

SEQ ID NO: 945331 - RNA, 14 nt, Homo sapiens
uaaacugauuuauc

SEQ ID NO: 945332 - RNA, 20 nt, Homo sapiens
uaaagaaaaaaauacuauuu

SEQ ID NO: 945333 - RNA, 15 nt, Homo sapiens
uaaagauggcacuuu

SEQ ID NO: 945334 - RNA, 17 nt, Homo sapiens
uaaagcaugaaauguga

SEQ ID NO: 945335 - RNA, 22 nt, Homo sapiens
uaaaguauuuucuucucuguga

SEQ ID NO: 945336 - RNA, 17 nt, Homo sapiens
uaaagucuguugauuaa

SEQ ID NO: 945337 - RNA, 16 nt, Homo sapiens
uaaaguugguauuaau

SEQ ID NO: 945338 - RNA, 13 nt, Homo sapiens
uaaaucaaaccag

SEQ ID NO: 945339 - RNA, 22 nt, Homo sapiens
uaaauuauuuuuguucauauaa

SEQ ID NO: 945340 - RNA, 19 nt, Homo sapiens
uaacaaccugggcauuccu

SEQ ID NO: 945341 - RNA, 20 nt, Homo sapiens
uaacaguuuuagaauacauu

SEQ ID NO: 945342 - RNA, 22 nt, Homo sapiens
uaacauuaucuaguucauugaa

SEQ ID NO: 945343 - RNA, 12 nt, Homo sapiens
uaacccuuuuuc

SEQ ID NO: 945344 - RNA, 21 nt, Homo sapiens
uaaccuuucacuuaaguauug

SEQ ID NO: 945345 - RNA, 19 nt, Homo sapiens
uaacgacuucuccaucucc

SEQ ID NO: 945346 - RNA, 18 nt, Homo sapiens
uaacuagaggagaauuua

SEQ ID NO: 945347 - RNA, 11 nt, Homo sapiens
uaacuauucau

SEQ ID NO: 945348 - RNA, 14 nt, Homo sapiens
uaacugcauccagc

SEQ ID NO: 945349 - RNA, 16 nt, Homo sapiens
uaacuuuuaaugguga

SEQ ID NO: 945350 - RNA, 17 nt, Homo sapiens
uaagaacaucauaaaau

SEQ ID NO: 945351 - RNA, 14 nt, Homo sapiens
uaagauccacaaau

SEQ ID NO: 945352 - RNA, 18 nt, Homo sapiens
uaagauugauaucuauaa

SEQ ID NO: 945353 - RNA, 14 nt, Homo sapiens
uaagcauacuuugu

SEQ ID NO: 945354 - RNA, 22 nt, Homo sapiens
uaagcuguggucaaggcuacag

SEQ ID NO: 945355 - RNA, 13 nt, Homo sapiens
uaagguaaugguu

SEQ ID NO: 945356 - RNA, 15 nt, Homo sapiens
uaagucuuacauaaa

SEQ ID NO: 945357 - RNA, 19 nt, Homo sapiens
uaagugaugugcugaauuu

SEQ ID NO: 945358 - RNA, 18 nt, Homo sapiens
uaaguuaauguauauaaa

SEQ ID NO: 945359 - RNA, 20 nt, Homo sapiens
uaauaagauauuuaguaaua

SEQ ID NO: 945360 - RNA, 22 nt, Homo sapiens
uaauaauuggagaagauuuaug

SEQ ID NO: 945361 - RNA, 19 nt, Homo sapiens
uaaucaaggccagugcuaa

SEQ ID NO: 945362 - RNA, 22 nt, Homo sapiens
uaaucauaguuacuguguaaac

SEQ ID NO: 945363 - RNA, 20 nt, Homo sapiens
uaaucaucaaguaauacaaa

SEQ ID NO: 945364 - RNA, 20 nt, Homo sapiens
uaaucuccugccagcucuuc

SEQ ID NO: 945365 - RNA, 16 nt, Homo sapiens
uaaugagugaauugaa

SEQ ID NO: 945366 - RNA, 15 nt, Homo sapiens
uaauggggaggacaa

SEQ ID NO: 945367 - RNA, 16 nt, Homo sapiens
uaauguccauaugcua

SEQ ID NO: 945368 - RNA, 15 nt, Homo sapiens
uaauuaauugucauu

SEQ ID NO: 945369 - RNA, 21 nt, Homo sapiens
uacaaaaccuacccucaguga

SEQ ID NO: 945370 - RNA, 18 nt, Homo sapiens
uacaaaacuuccaggcua

SEQ ID NO: 945371 - RNA, 23 nt, Homo sapiens
uacaaaucauccauccuugccaa

SEQ ID NO: 945372 - RNA, 11 nt, Homo sapiens
uacaaccagcc

SEQ ID NO: 945373 - RNA, 21 nt, Homo sapiens
uacaacgccgagugcacugca

SEQ ID NO: 945374 - RNA, 19 nt, Homo sapiens
uacaagugauaauacagau

SEQ ID NO: 945375 - RNA, 16 nt, Homo sapiens
uacaauuugacauaca

SEQ ID NO: 945376 - RNA, 18 nt, Homo sapiens
uacaccucgucaagagca

SEQ ID NO: 945377 - RNA, 20 nt, Homo sapiens
uacacuuauuuuacuaguuu

SEQ ID NO: 945378 - RNA, 20 nt, Homo sapiens
uacacuuuuuggaagugaaa

SEQ ID NO: 945379 - RNA, 16 nt, Homo sapiens
uacagagguccugcca

SEQ ID NO: 945380 - RNA, 14 nt, Homo sapiens
uacagaugugcuga

SEQ ID NO: 945381 - RNA, 13 nt, Homo sapiens
uacagcccagugg

SEQ ID NO: 945382 - RNA, 20 nt, Homo sapiens
uacagcuaacccucacaagc

SEQ ID NO: 945383 - RNA, 15 nt, Homo sapiens
uacauacagagguaa

SEQ ID NO: 945384 - RNA, 11 nt, Homo sapiens
uacaucuccaa

SEQ ID NO: 945385 - RNA, 20 nt, Homo sapiens
uacauuguacuuauacaccu

SEQ ID NO: 945386 - RNA, 14 nt, Homo sapiens
uaccaaagcaucaa

SEQ ID NO: 945387 - RNA, 20 nt, Homo sapiens
uaccacucuuuaccuuuauu

SEQ ID NO: 945388 - RNA, 14 nt, Homo sapiens
uaccacuuaccuca

SEQ ID NO: 945389 - RNA, 15 nt, Homo sapiens
uaccacuuaccucaa

SEQ ID NO: 945390 - RNA, 17 nt, Homo sapiens
uaccaguauaagcaucu

SEQ ID NO: 945391 - RNA, 22 nt, Homo sapiens
uaccaguauaagcaucugccau

SEQ ID NO: 945392 - RNA, 15 nt, Homo sapiens
uaccaugugcuaaua

SEQ ID NO: 945393 - RNA, 22 nt, Homo sapiens
uaccauuuaauggggaggacaa

SEQ ID NO: 945394 - RNA, 13 nt, Homo sapiens
uacccaaacguga

SEQ ID NO: 945395 - RNA, 11 nt, Homo sapiens
uacccucucag

SEQ ID NO: 945396 - RNA, 23 nt, Homo sapiens
uacccugacacaagaaguucuug

SEQ ID NO: 945397 - RNA, 13 nt, Homo sapiens
uaccuacaucaga

SEQ ID NO: 945398 - RNA, 16 nt, Homo sapiens
uaccucuuucaggguu

SEQ ID NO: 945399 - RNA, 14 nt, Homo sapiens
uacgaaccaugccu

SEQ ID NO: 945400 - RNA, 15 nt, Homo sapiens
uacguggccauguau

SEQ ID NO: 945401 - RNA, 18 nt, Homo sapiens
uacuaacauuuucauuga

SEQ ID NO: 945402 - RNA, 19 nt, Homo sapiens
uacuaacauuuucauugau

SEQ ID NO: 945403 - RNA, 14 nt, Homo sapiens
uacuaccguuauac

SEQ ID NO: 945404 - RNA, 14 nt, Homo sapiens
uacuaguuuucaau

SEQ ID NO: 945405 - RNA, 16 nt, Homo sapiens
uacuaguuuucaauca

SEQ ID NO: 945406 - RNA, 14 nt, Homo sapiens
uacugguugacuuu

SEQ ID NO: 945407 - RNA, 14 nt, Homo sapiens
uacuuaaugcauau

SEQ ID NO: 945408 - RNA, 18 nt, Homo sapiens
uacuuuguaaauaggauu

SEQ ID NO: 945409 - RNA, 19 nt, Homo sapiens
uacuuuuaaaaacauaaca

SEQ ID NO: 945410 - RNA, 15 nt, Homo sapiens
uacuuuuuaguaauu

SEQ ID NO: 945411 - RNA, 19 nt, Homo sapiens
uagaaaaaaaaauucacau

SEQ ID NO: 945412 - RNA, 21 nt, Homo sapiens
uagaaaaggcagcuaaaggaa

SEQ ID NO: 945413 - RNA, 13 nt, Homo sapiens
uagaaaccucauu

SEQ ID NO: 945414 - RNA, 18 nt, Homo sapiens
uagaaguuccuagugaug

SEQ ID NO: 945415 - RNA, 19 nt, Homo sapiens
uagaauaggcagggggccc

SEQ ID NO: 945416 - RNA, 13 nt, Homo sapiens
uagaaucuuuuaa

SEQ ID NO: 945417 - RNA, 19 nt, Homo sapiens
uagagcucuacugccucaa

SEQ ID NO: 945418 - RNA, 12 nt, Homo sapiens
uagaggugguga

SEQ ID NO: 945419 - RNA, 21 nt, Homo sapiens
uagaugccucgcucuuuucaa

SEQ ID NO: 945420 - RNA, 17 nt, Homo sapiens
uagauuaagaaauagac

SEQ ID NO: 945421 - RNA, 20 nt, Homo sapiens
uagcacuuucuacaauguga

SEQ ID NO: 945422 - RNA, 18 nt, Homo sapiens
uagcagaaugugcuucuc

SEQ ID NO: 945423 - RNA, 20 nt, Homo sapiens
uagcauuguaaaagcauuuu

SEQ ID NO: 945424 - RNA, 20 nt, Homo sapiens
uagccauugaaaugucaaau

SEQ ID NO: 945425 - RNA, 23 nt, Homo sapiens
ucugucaccaacugaaguggcua

SEQ ID NO: 945426 - RNA, 14 nt, Homo sapiens
ucugucaccagcua

SEQ ID NO: 945427 - RNA, 14 nt, Homo sapiens
ucugucucuuggcu

SEQ ID NO: 945428 - RNA, 15 nt, Homo sapiens
ucuguguuaggggua

SEQ ID NO: 945429 - RNA, 21 nt, Homo sapiens
ucuguguugacccuuugucca

SEQ ID NO: 945430 - RNA, 21 nt, Homo sapiens
ucuguuuccuggucagcaugu

SEQ ID NO: 945431 - RNA, 22 nt, Homo sapiens
ucuuaagauccacaaaugaagg

SEQ ID NO: 945432 - RNA, 17 nt, Homo sapiens
ucuuaggaauugaauua

SEQ ID NO: 945433 - RNA, 16 nt, Homo sapiens
ucuuauugacucauac

SEQ ID NO: 945434 - RNA, 20 nt, Homo sapiens
ucuucaagucccaucauaga

SEQ ID NO: 945435 - RNA, 12 nt, Homo sapiens
ucuucagugaau

SEQ ID NO: 945436 - RNA, 17 nt, Homo sapiens
ucuugaauagacuucca

SEQ ID NO: 945437 - RNA, 17 nt, Homo sapiens
ucuuggccuaaaccuca

SEQ ID NO: 945438 - RNA, 19 nt, Homo sapiens
ucuuucuuugcaccaaaga

SEQ ID NO: 945439 - RNA, 22 nt, Homo sapiens
ucuuucuuugcaccaaagacau

SEQ ID NO: 945440 - RNA, 23 nt, Homo sapiens
ucuuugaaaacaaaggugccaug

SEQ ID NO: 945441 - RNA, 14 nt, Homo sapiens
ucuuugcaccaaag

SEQ ID NO: 945442 - RNA, 14 nt, Homo sapiens
ucuuuuaacagccu

SEQ ID NO: 945443 - RNA, 19 nt, Homo sapiens
ucuuuuccugaccaaucuu

SEQ ID NO: 945444 - RNA, 18 nt, Homo sapiens
ucuuuucuucuauggggu

SEQ ID NO: 945445 - RNA, 14 nt, Homo sapiens
ugaaaaaaaaaugg

SEQ ID NO: 945446 - RNA, 24 nt, Homo sapiens
ugaaaacaauucuuauugacucau

SEQ ID NO: 945447 - RNA, 20 nt, Homo sapiens
ugaaaacaguguguaaacaa

SEQ ID NO: 945448 - RNA, 20 nt, Homo sapiens
ugaaaaggguacagaugugc

SEQ ID NO: 945449 - RNA, 14 nt, Homo sapiens
ugaaaauauagcua

SEQ ID NO: 945450 - RNA, 16 nt, Homo sapiens
ugaaagcaaguguuca

SEQ ID NO: 945451 - RNA, 23 nt, Homo sapiens
ugaaaugaaagggaaacugggaa

SEQ ID NO: 945452 - RNA, 19 nt, Homo sapiens
ugaaauuauuugucauuca

SEQ ID NO: 945453 - RNA, 15 nt, Homo sapiens
ugaaauuuggcaaag

SEQ ID NO: 945454 - RNA, 22 nt, Homo sapiens
ugaacuuuccaaaaccuaaaga

SEQ ID NO: 945455 - RNA, 16 nt, Homo sapiens
ugaagaagcucuugac

SEQ ID NO: 945456 - RNA, 15 nt, Homo sapiens
ugaagaguaaaggaa

SEQ ID NO: 945457 - RNA, 14 nt, Homo sapiens
ugaauacuugcuau

SEQ ID NO: 945458 - RNA, 17 nt, Homo sapiens
ugaauauugccauuaug

SEQ ID NO: 945459 - RNA, 17 nt, Homo sapiens
ugaauguugcaauguga

SEQ ID NO: 945460 - RNA, 15 nt, Homo sapiens
ugaauuaagcccaau

SEQ ID NO: 945461 - RNA, 19 nt, Homo sapiens
ugacaauugggagcugcca

SEQ ID NO: 945462 - RNA, 14 nt, Homo sapiens
ugacacccaugcca

SEQ ID NO: 945463 - RNA, 20 nt, Homo sapiens
ugacagggacaugcccugug

SEQ ID NO: 945464 - RNA, 17 nt, Homo sapiens
ugacauaggcaauaaua

SEQ ID NO: 945465 - RNA, 21 nt, Homo sapiens
ugaccaaguaugacaaccucu

SEQ ID NO: 945466 - RNA, 21 nt, Homo sapiens
ugacucuggcaaagcuuuuag

SEQ ID NO: 945467 - RNA, 15 nt, Homo sapiens
ugacuuaaccauaua

SEQ ID NO: 945468 - RNA, 21 nt, Homo sapiens
ugacuuugggaaagagggacc

SEQ ID NO: 945469 - RNA, 12 nt, Homo sapiens
ugagacagacua

SEQ ID NO: 945470 - RNA, 15 nt, Homo sapiens
ugagacagucuugcu

SEQ ID NO: 945471 - RNA, 15 nt, Homo sapiens
ugagacguccuuucc

SEQ ID NO: 945472 - RNA, 18 nt, Homo sapiens
ugagacuuucuaaaucaa

SEQ ID NO: 945473 - RNA, 14 nt, Homo sapiens
ugagagucaaagcu

SEQ ID NO: 945474 - RNA, 18 nt, Homo sapiens
ugagcacccagaacucca

SEQ ID NO: 945475 - RNA, 19 nt, Homo sapiens
ugagccacagucacuggau

SEQ ID NO: 945476 - RNA, 19 nt, Homo sapiens
ugagccgagaucaugccau

SEQ ID NO: 945477 - RNA, 21 nt, Homo sapiens
ugagcuaucuccuaacuuugg

SEQ ID NO: 945478 - RNA, 18 nt, Homo sapiens
ugagcugaccccugcuga

SEQ ID NO: 945479 - RNA, 19 nt, Homo sapiens
ugaggcauuuccagacuug

SEQ ID NO: 945480 - RNA, 17 nt, Homo sapiens
ugaggccuagacucugu

SEQ ID NO: 945481 - RNA, 20 nt, Homo sapiens
ugagggcagcuuugcaaaau

SEQ ID NO: 945482 - RNA, 16 nt, Homo sapiens
ugaggugccuguccca

SEQ ID NO: 945483 - RNA, 12 nt, Homo sapiens
ugagugguggag

SEQ ID NO: 945484 - RNA, 22 nt, Homo sapiens
ugaguuucuggcucuugaggca

SEQ ID NO: 945485 - RNA, 15 nt, Homo sapiens
ugauacaagagucag

SEQ ID NO: 945486 - RNA, 17 nt, Homo sapiens
ugauauuggggccauga

SEQ ID NO: 945487 - RNA, 17 nt, Homo sapiens
ugaucugucuguggcaa

SEQ ID NO: 945488 - RNA, 21 nt, Homo sapiens
ugaugaaaacuaaggauuuuu

SEQ ID NO: 945489 - RNA, 23 nt, Homo sapiens
ugaugaucuagccuccaucauga

SEQ ID NO: 945490 - RNA, 19 nt, Homo sapiens
ugaugcaugggccucaguc

SEQ ID NO: 945491 - RNA, 13 nt, Homo sapiens
ugauuuacauuuc

SEQ ID NO: 945492 - RNA, 20 nt, Homo sapiens
ugauuucaggagaaccuaac

SEQ ID NO: 945493 - RNA, 18 nt, Homo sapiens
ugauuucuuucuuugcac

SEQ ID NO: 945494 - RNA, 18 nt, Homo sapiens
ugauuuuaaauggauguc

SEQ ID NO: 945495 - RNA, 18 nt, Homo sapiens
ugcaacaaaaagucauuu

SEQ ID NO: 945496 - RNA, 16 nt, Homo sapiens
ugcaaccucacuaugg

SEQ ID NO: 945497 - RNA, 19 nt, Homo sapiens
ugcaacuuuuaauuacugu

SEQ ID NO: 945498 - RNA, 19 nt, Homo sapiens
ugcaagaaaaaaacuuacu

SEQ ID NO: 945499 - RNA, 22 nt, Homo sapiens
ugcacagugaagugcuggcaac

SEQ ID NO: 945500 - RNA, 22 nt, Homo sapiens
ugcaccugggagaaagacuuug

SEQ ID NO: 945501 - RNA, 13 nt, Homo sapiens
ugcacugcauucc

SEQ ID NO: 945502 - RNA, 22 nt, Homo sapiens
ugcacuggggagcccgucucag

SEQ ID NO: 945503 - RNA, 15 nt, Homo sapiens
ugcacuuauucaaua

SEQ ID NO: 945504 - RNA, 15 nt, Homo sapiens
ugcacuuguggcaac

SEQ ID NO: 945505 - RNA, 14 nt, Homo sapiens
ugcaggacacuggu

SEQ ID NO: 945506 - RNA, 22 nt, Homo sapiens
ugcaggacuugagaagaccuca

SEQ ID NO: 945507 - RNA, 22 nt, Homo sapiens
ugcaggcaggaacaaacagggc

SEQ ID NO: 945508 - RNA, 17 nt, Homo sapiens
ugcaguaugggaucuga

SEQ ID NO: 945509 - RNA, 13 nt, Homo sapiens
ugcagugagccau

SEQ ID NO: 945510 - RNA, 21 nt, Homo sapiens
ugcaucacggauggugcaugg

SEQ ID NO: 945511 - RNA, 13 nt, Homo sapiens
ugcaucucuaaua

SEQ ID NO: 945512 - RNA, 19 nt, Homo sapiens
ugcauguaauggacuaugc

SEQ ID NO: 945513 - RNA, 21 nt, Homo sapiens
ugcauguaauggacuaugcac

SEQ ID NO: 945514 - RNA, 12 nt, Homo sapiens
ugcauuccagcc

SEQ ID NO: 945515 - RNA, 20 nt, Homo sapiens
ugccaaaauccaaggcaauu

SEQ ID NO: 945516 - RNA, 21 nt, Homo sapiens
ugccaauuucagcacccaacu

SEQ ID NO: 945517 - RNA, 10 nt, Homo sapiens
ugccagguau

SEQ ID NO: 945518 - RNA, 15 nt, Homo sapiens
ugccaugaugggcug

SEQ ID NO: 945519 - RNA, 18 nt, Homo sapiens
ugcccagaauaaguuauu

SEQ ID NO: 945520 - RNA, 14 nt, Homo sapiens
ugcccaugggcuau

SEQ ID NO: 945521 - RNA, 21 nt, Homo sapiens
ugcccccucccccaugggcug

SEQ ID NO: 945522 - RNA, 20 nt, Homo sapiens
ugcccuagaucaacagauca

SEQ ID NO: 945523 - RNA, 22 nt, Homo sapiens
ugccucucggugaccuccgucc

SEQ ID NO: 945524 - RNA, 16 nt, Homo sapiens
ugccuuaaacucuguu

SEQ ID NO: 945525 - RNA, 20 nt, Homo sapiens
ugccuuccucaguauccaca

SEQ ID NO: 945526 - RNA, 13 nt, Homo sapiens
ugccuugcucauu

SEQ ID NO: 945527 - RNA, 14 nt, Homo sapiens
ugcgaacagcaaac

SEQ ID NO: 945528 - RNA, 15 nt, Homo sapiens
ugcgcaauguggcau

SEQ ID NO: 945529 - RNA, 15 nt, Homo sapiens
ugcggagacccugag

SEQ ID NO: 945530 - RNA, 20 nt, Homo sapiens
ugcuaacaagucaccaaaag

SEQ ID NO: 945531 - RNA, 22 nt, Homo sapiens
ugcuaaccuggauaacuguaaa

SEQ ID NO: 945532 - RNA, 18 nt, Homo sapiens
ugcuacauucuaaugcau

SEQ ID NO: 945533 - RNA, 15 nt, Homo sapiens
aaaaaggaguauaca

SEQ ID NO: 945534 - RNA, 14 nt, Homo sapiens
aaaaaguauugcau

SEQ ID NO: 945535 - RNA, 22 nt, Homo sapiens
aaaaauaaaagucgcauuccau

SEQ ID NO: 945536 - RNA, 21 nt, Homo sapiens
aaaaauaaacggaaguuacau

SEQ ID NO: 945537 - RNA, 16 nt, Homo sapiens
aaaaaucaaguuuaau

SEQ ID NO: 945538 - RNA, 14 nt, Homo sapiens
aaaaauuuacuuga

SEQ ID NO: 945539 - RNA, 17 nt, Homo sapiens
aaaacaaaggccuaauu

SEQ ID NO: 945540 - RNA, 14 nt, Homo sapiens
aaaacaccaugaaa

SEQ ID NO: 945541 - RNA, 21 nt, Homo sapiens
aaaaccccaucuuuacuaaaa

SEQ ID NO: 945542 - RNA, 21 nt, Homo sapiens
aaaagaccuacagacuaagaa

SEQ ID NO: 945543 - RNA, 16 nt, Homo sapiens
aaaagcaauacuguuu

SEQ ID NO: 945544 - RNA, 22 nt, Homo sapiens
aaaagcuuaaaaaaauuacugu

SEQ ID NO: 945545 - RNA, 14 nt, Homo sapiens
aaaaggaguauaca

SEQ ID NO: 945546 - RNA, 18 nt, Homo sapiens
aaaagggaaguaagcaaa

SEQ ID NO: 945547 - RNA, 14 nt, Homo sapiens
aaaaguggcauuuc

SEQ ID NO: 945548 - RNA, 15 nt, Homo sapiens
aaaauauuucaguga

SEQ ID NO: 945549 - RNA, 16 nt, Homo sapiens
aaaaucccuuguucuc

SEQ ID NO: 945550 - RNA, 16 nt, Homo sapiens
aaaauccuaacauuca

SEQ ID NO: 945551 - RNA, 16 nt, Homo sapiens
aaaaugacaccaucuu

SEQ ID NO: 945552 - RNA, 18 nt, Homo sapiens
aaaaugagagcuguaacu

SEQ ID NO: 945553 - RNA, 19 nt, Homo sapiens
aaaauguuucuacagauau

SEQ ID NO: 945554 - RNA, 14 nt, Homo sapiens
aaaauuaugaccau

SEQ ID NO: 945555 - RNA, 14 nt, Homo sapiens
aaaauucacaugau

SEQ ID NO: 945556 - RNA, 13 nt, Homo sapiens
aaaauucaucugu

SEQ ID NO: 945557 - RNA, 19 nt, Homo sapiens
cacagccaagcccuaccuc

SEQ ID NO: 945558 - RNA, 17 nt, Homo sapiens
cacagggagugcacaua

SEQ ID NO: 945559 - RNA, 19 nt, Homo sapiens
cacaugccacuaugagcuu

SEQ ID NO: 945560 - RNA, 13 nt, Homo sapiens
cacaugcccauga

SEQ ID NO: 945561 - RNA, 16 nt, Homo sapiens
cacaugcccaugauga

SEQ ID NO: 945562 - RNA, 22 nt, Homo sapiens
cacaugggcagaaaaauggugg

SEQ ID NO: 945563 - RNA, 15 nt, Homo sapiens
cacauuuaccaguau

SEQ ID NO: 945564 - RNA, 15 nt, Homo sapiens
caccaaagacaucag

SEQ ID NO: 945565 - RNA, 22 nt, Homo sapiens
caccaaguaccaguauaagcau

SEQ ID NO: 945566 - RNA, 16 nt, Homo sapiens
caccacccucccgcug

SEQ ID NO: 945567 - RNA, 16 nt, Homo sapiens
caccagcuaucuguca

SEQ ID NO: 945568 - RNA, 21 nt, Homo sapiens
caccuagaaaggaacugcaau

SEQ ID NO: 945569 - RNA, 15 nt, Homo sapiens
caccuagacuguaaa

SEQ ID NO: 945570 - RNA, 16 nt, Homo sapiens
caccuagacuguaaac

SEQ ID NO: 945571 - RNA, 11 nt, Homo sapiens
caccuccucau

SEQ ID NO: 945572 - RNA, 15 nt, Homo sapiens
caccuccucuaaggu

SEQ ID NO: 945573 - RNA, 12 nt, Homo sapiens
caccuccugucg

SEQ ID NO: 945574 - RNA, 21 nt, Homo sapiens
caccuuccagcuccuguaaca

SEQ ID NO: 945575 - RNA, 23 nt, Homo sapiens
caccuugaugacuuccuauccau

SEQ ID NO: 945576 - RNA, 12 nt, Homo sapiens
cacgaagcaauu

SEQ ID NO: 945577 - RNA, 15 nt, Homo sapiens
cacgcagcuggcaga

SEQ ID NO: 945578 - RNA, 16 nt, Homo sapiens
cacuaaagcaugaaau

SEQ ID NO: 945579 - RNA, 19 nt, Homo sapiens
cacuaagcuaauuccacac

SEQ ID NO: 945580 - RNA, 17 nt, Homo sapiens
cacuaugagcuuucaga

SEQ ID NO: 945581 - RNA, 14 nt, Homo sapiens
cacuccggcuccua

SEQ ID NO: 945582 - RNA, 17 nt, Homo sapiens
cacugcagaaacccuga

SEQ ID NO: 945583 - RNA, 17 nt, Homo sapiens
cacugccccucucucag

SEQ ID NO: 945584 - RNA, 22 nt, Homo sapiens
cacugccucucggugaccuccg

SEQ ID NO: 945585 - RNA, 23 nt, Homo sapiens
cacugcgcccuuaacugcaucca

SEQ ID NO: 945586 - RNA, 22 nt, Homo sapiens
cacuggccccucaaaucgucca

SEQ ID NO: 945587 - RNA, 16 nt, Homo sapiens
cacuggggcagacaau

SEQ ID NO: 945588 - RNA, 19 nt, Homo sapiens
cacuggggcagacaauaaa

SEQ ID NO: 945589 - RNA, 18 nt, Homo sapiens
cacuguguacaccucaaa

SEQ ID NO: 945590 - RNA, 16 nt, Homo sapiens
cacugugucauucugu

SEQ ID NO: 945591 - RNA, 19 nt, Homo sapiens
cacuuauucuguauugcca

SEQ ID NO: 945592 - RNA, 17 nt, Homo sapiens
cacuucauguaaagugu

SEQ ID NO: 945593 - RNA, 21 nt, Homo sapiens
cacuugaugugauguggcagg

SEQ ID NO: 945594 - RNA, 17 nt, Homo sapiens
cacuugccugugcuaca

SEQ ID NO: 945595 - RNA, 23 nt, Homo sapiens
cacuuuuaauuuugucagauuca

SEQ ID NO: 945596 - RNA, 16 nt, Homo sapiens
aaguuucugucuuccu

SEQ ID NO: 945597 - RNA, 15 nt, Homo sapiens
aauaaaacugugcau

SEQ ID NO: 945598 - RNA, 13 nt, Homo sapiens
aauaaaagcacaa

SEQ ID NO: 945599 - RNA, 20 nt, Homo sapiens
aauaaaauaugagagcaaua

SEQ ID NO: 945600 - RNA, 12 nt, Homo sapiens
aauaaacccuca

SEQ ID NO: 945601 - RNA, 13 nt, Homo sapiens
aauaaacccucag

SEQ ID NO: 945602 - RNA, 18 nt, Homo sapiens
aauaaacccucagagccu

SEQ ID NO: 945603 - RNA, 20 nt, Homo sapiens
aauaaagcuaccauuuauca

SEQ ID NO: 945604 - RNA, 13 nt, Homo sapiens
aauaaagugaucu

SEQ ID NO: 945605 - RNA, 14 nt, Homo sapiens
aauaacacuuguca

SEQ ID NO: 945606 - RNA, 13 nt, Homo sapiens
aauaaccuuucac

SEQ ID NO: 945607 - RNA, 18 nt, Homo sapiens
aauaacucuccaguaaca

SEQ ID NO: 945608 - RNA, 15 nt, Homo sapiens
aauaagauauuuagu

SEQ ID NO: 945609 - RNA, 20 nt, Homo sapiens
aauaauuggagaagauuuau

SEQ ID NO: 945610 - RNA, 18 nt, Homo sapiens
aauaauuuuauuaugcaa

SEQ ID NO: 945611 - RNA, 15 nt, Homo sapiens
aauagucuuugccag

SEQ ID NO: 945612 - RNA, 15 nt, Homo sapiens
aauagugucauccuc

SEQ ID NO: 945613 - RNA, 20 nt, Homo sapiens
aauauauccccacuacucaa

SEQ ID NO: 945614 - RNA, 16 nt, Homo sapiens
aauauguaaaugguau

SEQ ID NO: 945615 - RNA, 19 nt, Homo sapiens
aauauuuuguaaugcugca

SEQ ID NO: 945616 - RNA, 16 nt, Homo sapiens
aaucaaaugugcaucc

SEQ ID NO: 945617 - RNA, 14 nt, Homo sapiens
aaucagcaggaugu

SEQ ID NO: 945618 - RNA, 20 nt, Homo sapiens
aaucagugaagccaaaggga

SEQ ID NO: 945619 - RNA, 22 nt, Homo sapiens
aaucauaggcaccuuuuacugu

SEQ ID NO: 945620 - RNA, 18 nt, Homo sapiens
aaucaucaaguaauacaa

SEQ ID NO: 945621 - RNA, 22 nt, Homo sapiens
aaucauccauccuugccaauag

SEQ ID NO: 945622 - RNA, 15 nt, Homo sapiens
aaucaugaaaagggg

SEQ ID NO: 945623 - RNA, 20 nt, Homo sapiens
aaucauuuucauuccuaaag

SEQ ID NO: 945624 - RNA, 18 nt, Homo sapiens
aauccaugagauagcuau

SEQ ID NO: 945625 - RNA, 15 nt, Homo sapiens
aauccuaacauucag

SEQ ID NO: 945626 - RNA, 15 nt, Homo sapiens
aaucuauccauugaa

SEQ ID NO: 945627 - RNA, 19 nt, Homo sapiens
aaucucuaggaagucaaua

SEQ ID NO: 945628 - RNA, 21 nt, Homo sapiens
aaucuggcaggaaucuaucca

SEQ ID NO: 945629 - RNA, 14 nt, Homo sapiens
aaucuuaugcucuc

SEQ ID NO: 945630 - RNA, 16 nt, Homo sapiens
aaugaaccuucugcaa

SEQ ID NO: 945631 - RNA, 18 nt, Homo sapiens
aaugaaguugaaaaucau

SEQ ID NO: 945632 - RNA, 17 nt, Homo sapiens
aaugagccgagaucacg

SEQ ID NO: 945633 - RNA, 10 nt, Homo sapiens
aaugagucag

SEQ ID NO: 945634 - RNA, 23 nt, Homo sapiens
aaugcagcaggaaggaacaaaga

SEQ ID NO: 945635 - RNA, 15 nt, Homo sapiens
aauggaacaguaaga

SEQ ID NO: 945636 - RNA, 22 nt, Homo sapiens
aauggagaauuaaaaauaccaa

SEQ ID NO: 945637 - RNA, 23 nt, Homo sapiens
aaugggaagauuaaaaagcacag

SEQ ID NO: 945638 - RNA, 15 nt, Homo sapiens
aaugugaugcuuuca

SEQ ID NO: 945639 - RNA, 20 nt, Homo sapiens
aauguuaauugggcagguga

SEQ ID NO: 945640 - RNA, 13 nt, Homo sapiens
aauuacaguuaaa

SEQ ID NO: 945641 - RNA, 19 nt, Homo sapiens
aauuacaguuaaagaagca

SEQ ID NO: 945642 - RNA, 14 nt, Homo sapiens
aauuaucaagcuuu

SEQ ID NO: 945643 - RNA, 23 nt, Homo sapiens
aauuaugaguuugcccucuuucc

SEQ ID NO: 945644 - RNA, 20 nt, Homo sapiens
aauucacaugaugcacuuca

SEQ ID NO: 945645 - RNA, 13 nt, Homo sapiens
aauucagcauuug

SEQ ID NO: 945646 - RNA, 14 nt, Homo sapiens
aauucagcauuuga

SEQ ID NO: 945647 - RNA, 19 nt, Homo sapiens
aauucuaugccugucuuaa

SEQ ID NO: 945648 - RNA, 20 nt, Homo sapiens
aauucuuauugacucauaca

SEQ ID NO: 945649 - RNA, 21 nt, Homo sapiens
aauucuuucccagucugucga

SEQ ID NO: 945650 - RNA, 13 nt, Homo sapiens
aauugacaaugau

SEQ ID NO: 945651 - RNA, 15 nt, Homo sapiens
aauugacuaaaaagu

SEQ ID NO: 945652 - RNA, 23 nt, Homo sapiens
aauuguaacgacuucuccaucuc

SEQ ID NO: 945653 - RNA, 14 nt, Homo sapiens
aauuguugugugua

SEQ ID NO: 945654 - RNA, 22 nt, Homo sapiens
aauuguuuuuguacaguuauca

SEQ ID NO: 945655 - RNA, 12 nt, Homo sapiens
aauuuacuugau

SEQ ID NO: 945656 - RNA, 13 nt, Homo sapiens
aauuugacauaca

SEQ ID NO: 945657 - RNA, 15 nt, Homo sapiens
aauuugcacuguuua

SEQ ID NO: 945658 - RNA, 16 nt, Homo sapiens
aauuuucaauuugaga

SEQ ID NO: 945659 - RNA, 17 nt, Homo sapiens
aauuuuguaauguauca

SEQ ID NO: 945660 - RNA, 23 nt, Homo sapiens
aauuuugucagauucacacaugc

SEQ ID NO: 945661 - RNA, 22 nt, Homo sapiens
acaaaauaacucuccaguaaca

SEQ ID NO: 945662 - RNA, 11 nt, Homo sapiens
acaaacagggc

SEQ ID NO: 945663 - RNA, 18 nt, Homo sapiens
acaaacuauauauaauca

SEQ ID NO: 945664 - RNA, 18 nt, Homo sapiens
acaacgccgagugcacug

SEQ ID NO: 945665 - RNA, 17 nt, Homo sapiens
acaagaaaaucaaauau

SEQ ID NO: 945666 - RNA, 15 nt, Homo sapiens
acaagccagccaacu

SEQ ID NO: 945667 - RNA, 21 nt, Homo sapiens
acaaguacugguugacuuucu

SEQ ID NO: 945668 - RNA, 16 nt, Homo sapiens
acaagugauaauacag

SEQ ID NO: 945669 - RNA, 17 nt, Homo sapiens
acucaauacuaccucug

SEQ ID NO: 945670 - RNA, 22 nt, Homo sapiens
acucagguaccucuuucagggu

SEQ ID NO: 945671 - RNA, 20 nt, Homo sapiens
acucaucugaaauguuacaa

SEQ ID NO: 945672 - RNA, 14 nt, Homo sapiens
acuccagaugccac

SEQ ID NO: 945673 - RNA, 20 nt, Homo sapiens
acucuaaaccccguguucaa

SEQ ID NO: 945674 - RNA, 17 nt, Homo sapiens
acucucaucacuacagu

SEQ ID NO: 945675 - RNA, 19 nt, Homo sapiens
acucucgcacacacaguga

SEQ ID NO: 945676 - RNA, 23 nt, Homo sapiens
acucucugccuguaaauguuccc

SEQ ID NO: 945677 - RNA, 19 nt, Homo sapiens
acucuggcugcucccugac

SEQ ID NO: 945678 - RNA, 15 nt, Homo sapiens
acucugucuaccugg

SEQ ID NO: 945679 - RNA, 21 nt, Homo sapiens
acucuuuuuuaugccuauucu

SEQ ID NO: 945680 - RNA, 19 nt, Homo sapiens
acugaaaaaucugguucau

SEQ ID NO: 945681 - RNA, 14 nt, Homo sapiens
acugaaguggcuaa

SEQ ID NO: 945682 - RNA, 12 nt, Homo sapiens
acugaaugucau

SEQ ID NO: 945683 - RNA, 14 nt, Homo sapiens
acugauuaccuccu

SEQ ID NO: 945684 - RNA, 22 nt, Homo sapiens
acugcagguugugcccuguggc

SEQ ID NO: 945685 - RNA, 12 nt, Homo sapiens
acugccagguau

SEQ ID NO: 945686 - RNA, 15 nt, Homo sapiens
acuggggcagacaau

SEQ ID NO: 945687 - RNA, 16 nt, Homo sapiens
acuggugcacuucuua

SEQ ID NO: 945688 - RNA, 20 nt, Homo sapiens
acugguugacuuucuaauua

SEQ ID NO: 945689 - RNA, 12 nt, Homo sapiens
acugucaggguu

SEQ ID NO: 945690 - RNA, 13 nt, Homo sapiens
acugugguagcca

SEQ ID NO: 945691 - RNA, 17 nt, Homo sapiens
acuguguacaccucaaa

SEQ ID NO: 945692 - RNA, 15 nt, Homo sapiens
acuuacagaucuauc

SEQ ID NO: 945693 - RNA, 13 nt, Homo sapiens
acuucaaauucaa

SEQ ID NO: 945694 - RNA, 13 nt, Homo sapiens
acuuccacuuugu

SEQ ID NO: 945695 - RNA, 14 nt, Homo sapiens
acuucucaagauac

SEQ ID NO: 945696 - RNA, 14 nt, Homo sapiens
acuucugcagcuau

SEQ ID NO: 945697 - RNA, 21 nt, Homo sapiens
acuugaugauuuuuaacuuuu

SEQ ID NO: 945698 - RNA, 16 nt, Homo sapiens
acuugccucugcacac

SEQ ID NO: 945699 - RNA, 21 nt, Homo sapiens
acuugccugugcuacaauuca

SEQ ID NO: 945700 - RNA, 22 nt, Homo sapiens
acuugccugugcuacaauucau

SEQ ID NO: 945701 - RNA, 18 nt, Homo sapiens
acuuggaccucagccaac

SEQ ID NO: 945702 - RNA, 19 nt, Homo sapiens
acuuguuuuaaacuugccu

SEQ ID NO: 945703 - RNA, 15 nt, Homo sapiens
acuuuaucaaugugu

SEQ ID NO: 945704 - RNA, 15 nt, Homo sapiens
acuuucccucaucca

SEQ ID NO: 945705 - RNA, 19 nt, Homo sapiens
cagucacguguaaacagga

SEQ ID NO: 945706 - RNA, 16 nt, Homo sapiens
cagucacugacaguua

SEQ ID NO: 945707 - RNA, 19 nt, Homo sapiens
cagucacugacaguuaaua

SEQ ID NO: 945708 - RNA, 15 nt, Homo sapiens
cagucaugacccuga

SEQ ID NO: 945709 - RNA, 19 nt, Homo sapiens
cagucucucucugccaugg

SEQ ID NO: 945710 - RNA, 20 nt, Homo sapiens
cagucucucucugccauggc

SEQ ID NO: 945711 - RNA, 14 nt, Homo sapiens
cagugacaacaucg

SEQ ID NO: 945712 - RNA, 19 nt, Homo sapiens
cagugccuuaaacucuguu

SEQ ID NO: 945713 - RNA, 23 nt, Homo sapiens
cagugcuaaaauucagaugcugu

SEQ ID NO: 945714 - RNA, 17 nt, Homo sapiens
caguggaauuggugauu

SEQ ID NO: 945715 - RNA, 16 nt, Homo sapiens
caguggcucauaaaaa

SEQ ID NO: 945716 - RNA, 14 nt, Homo sapiens
cagugguggagcug

SEQ ID NO: 945717 - RNA, 16 nt, Homo sapiens
caguuacccaacagaa

SEQ ID NO: 945718 - RNA, 17 nt, Homo sapiens
caguugaagcugacuca

SEQ ID NO: 945719 - RNA, 15 nt, Homo sapiens
cauacaaaucaucca

SEQ ID NO: 945720 - RNA, 18 nt, Homo sapiens
cauacaugucacauuuag

SEQ ID NO: 945721 - RNA, 17 nt, Homo sapiens
cauacccccacaugcca

SEQ ID NO: 945722 - RNA, 18 nt, Homo sapiens
cauacuggccuggacugu

SEQ ID NO: 945723 - RNA, 13 nt, Homo sapiens
cauacuuguucug

SEQ ID NO: 945724 - RNA, 18 nt, Homo sapiens
cauagcgggcgcugccag

SEQ ID NO: 945725 - RNA, 20 nt, Homo sapiens
cauaggcaccuuuuacugug

SEQ ID NO: 945726 - RNA, 20 nt, Homo sapiens
cauaguaccauuuauacaaa

SEQ ID NO: 945727 - RNA, 19 nt, Homo sapiens
cauaguguuaacugucagu

SEQ ID NO: 945728 - RNA, 13 nt, Homo sapiens
cauaguuacugug

SEQ ID NO: 945729 - RNA, 21 nt, Homo sapiens
cauaguuacuguguaaacuca

SEQ ID NO: 945730 - RNA, 18 nt, Homo sapiens
cauauaacgucaugugca

SEQ ID NO: 945731 - RNA, 18 nt, Homo sapiens
cauaugaucugucugugg

SEQ ID NO: 945732 - RNA, 20 nt, Homo sapiens
cauaugaucugucuguggca

SEQ ID NO: 945733 - RNA, 17 nt, Homo sapiens
cauauguguuacuucaa

SEQ ID NO: 945734 - RNA, 23 nt, Homo sapiens
cauauuuugguuuguguauccau

SEQ ID NO: 945735 - RNA, 14 nt, Homo sapiens
caucaauacaacca

SEQ ID NO: 945736 - RNA, 15 nt, Homo sapiens
caucaguccauugcu

SEQ ID NO: 945737 - RNA, 13 nt, Homo sapiens
caucauuacagau

SEQ ID NO: 945738 - RNA, 15 nt, Homo sapiens
caucauuacagauuc

SEQ ID NO: 945739 - RNA, 16 nt, Homo sapiens
caucccuuuuuuuaca

SEQ ID NO: 945740 - RNA, 20 nt, Homo sapiens
caucuauuuccucugugcaa

SEQ ID NO: 945741 - RNA, 13 nt, Homo sapiens
caucuccagcuau

SEQ ID NO: 945742 - RNA, 15 nt, Homo sapiens
caucuccagcuauuu

SEQ ID NO: 945743 - RNA, 16 nt, Homo sapiens
caucuggacacugggc

SEQ ID NO: 945744 - RNA, 18 nt, Homo sapiens
caucuugagccacaguca

SEQ ID NO: 945745 - RNA, 11 nt, Homo sapiens
cuccucuguca

SEQ ID NO: 945746 - RNA, 22 nt, Homo sapiens
cuccuucacagcuaagaugcca

SEQ ID NO: 945747 - RNA, 22 nt, Homo sapiens
cucggagaaacgggugagcuga

SEQ ID NO: 945748 - RNA, 13 nt, Homo sapiens
cucggugaccucc

SEQ ID NO: 945749 - RNA, 19 nt, Homo sapiens
cucuaauucggauuugcca

SEQ ID NO: 945750 - RNA, 19 nt, Homo sapiens
cucuacaucuucugccuua

SEQ ID NO: 945751 - RNA, 17 nt, Homo sapiens
cucucugccuguaaaug

SEQ ID NO: 945752 - RNA, 19 nt, Homo sapiens
cucucuuccagcugcuuca

SEQ ID NO: 945753 - RNA, 18 nt, Homo sapiens
cucugacaguccacaggg

SEQ ID NO: 945754 - RNA, 16 nt, Homo sapiens
cucuggaccauauacc

SEQ ID NO: 945755 - RNA, 15 nt, Homo sapiens
cucuguacuuuucau

SEQ ID NO: 945756 - RNA, 18 nt, Homo sapiens
cucuuacaagaguggacu

SEQ ID NO: 945757 - RNA, 16 nt, Homo sapiens
cucuuccuaaguauau

SEQ ID NO: 945758 - RNA, 14 nt, Homo sapiens
cugaaaguggugcu

SEQ ID NO: 945759 - RNA, 14 nt, Homo sapiens
cugaaguggcuaaa

SEQ ID NO: 945760 - RNA, 19 nt, Homo sapiens
cugaauaccacuuaccuca

SEQ ID NO: 945761 - RNA, 17 nt, Homo sapiens
cugaauguuacaacgaa

SEQ ID NO: 945762 - RNA, 23 nt, Homo sapiens
cugacaagagaggcgucugcugu

SEQ ID NO: 945763 - RNA, 22 nt, Homo sapiens
cugacagggacaugcccugugu

SEQ ID NO: 945764 - RNA, 17 nt, Homo sapiens
cugagauuacucugaaa

SEQ ID NO: 945765 - RNA, 20 nt, Homo sapiens
cugagcuaucuccuaacuuu

SEQ ID NO: 945766 - RNA, 23 nt, Homo sapiens
cugaggacaagagaaaaaagcca

SEQ ID NO: 945767 - RNA, 22 nt, Homo sapiens
cugaggcaggagagucacuuga

SEQ ID NO: 945768 - RNA, 19 nt, Homo sapiens
cugaguuucuggcucuuga

SEQ ID NO: 945769 - RNA, 18 nt, Homo sapiens
cugauaaggaucuaggag

SEQ ID NO: 945770 - RNA, 16 nt, Homo sapiens
cugauaguuucccaua

SEQ ID NO: 945771 - RNA, 14 nt, Homo sapiens
cugcaacaaaaagu

SEQ ID NO: 945772 - RNA, 18 nt, Homo sapiens
cugcacacccuccagaga

SEQ ID NO: 945773 - RNA, 13 nt, Homo sapiens
cugcacagugaag

SEQ ID NO: 945774 - RNA, 16 nt, Homo sapiens
cugcauuuacacacac

SEQ ID NO: 945775 - RNA, 19 nt, Homo sapiens
cugcccuucccccugcaaa

SEQ ID NO: 945776 - RNA, 18 nt, Homo sapiens
cugccucucggugaccuc

SEQ ID NO: 945777 - RNA, 21 nt, Homo sapiens
cugccuguuggcaggcccacu

SEQ ID NO: 945778 - RNA, 21 nt, Homo sapiens
cugcuaacaagucaccaaaag

SEQ ID NO: 945779 - RNA, 12 nt, Homo sapiens
cugcuauaacua

SEQ ID NO: 945780 - RNA, 18 nt, Homo sapiens
cugcucuccugggagaca

SEQ ID NO: 945781 - RNA, 22 nt, Homo sapiens
cugcuguagaaaaaaaaauuca

SEQ ID NO: 945782 - RNA, 18 nt, Homo sapiens
cugcuuuuugcuucuuga

SEQ ID NO: 945783 - RNA, 21 nt, Homo sapiens
cuggagaccagggagccuuug

SEQ ID NO: 945784 - RNA, 17 nt, Homo sapiens
cuggcaagucaccugca

SEQ ID NO: 945785 - RNA, 14 nt, Homo sapiens
ucucgaacaguauu

SEQ ID NO: 945786 - RNA, 14 nt, Homo sapiens
ucucgguuugccaa

SEQ ID NO: 945787 - RNA, 17 nt, Homo sapiens
ucucugaaaguggugcu

SEQ ID NO: 945788 - RNA, 13 nt, Homo sapiens
ucucugaggacaa

SEQ ID NO: 945789 - RNA, 17 nt, Homo sapiens
ucucugaggacaagaga

SEQ ID NO: 945790 - RNA, 15 nt, Homo sapiens
ucucuguucagaaag

SEQ ID NO: 945791 - RNA, 18 nt, Homo sapiens
ucucuuccacauguuacu

SEQ ID NO: 945792 - RNA, 20 nt, Homo sapiens
ucugaaaaauuuguaguuua

SEQ ID NO: 945793 - RNA, 20 nt, Homo sapiens
ucugagugaaccuguauaag

SEQ ID NO: 945794 - RNA, 14 nt, Homo sapiens
ucugcacaccuacu

SEQ ID NO: 945795 - RNA, 11 nt, Homo sapiens
ucugcauuuac

SEQ ID NO: 945796 - RNA, 12 nt, Homo sapiens
ucugcuguagaa

SEQ ID NO: 945797 - RNA, 17 nt, Homo sapiens
ucugcuuuucccauugc

SEQ ID NO: 945798 - RNA, 19 nt, Homo sapiens
ucugcuuuucccauugcca

SEQ ID NO: 945799 - RNA, 18 nt, Homo sapiens
ucuggaagaucauuuuga

SEQ ID NO: 945800 - RNA, 13 nt, Homo sapiens
ucuggacacuggg

SEQ ID NO: 945801 - RNA, 21 nt, Homo sapiens
ucuggaggacggucaguccau

SEQ ID NO: 945802 - RNA, 23 nt, Homo sapiens
ucuggagggguguggcuccuucc

SEQ ID NO: 945803 - RNA, 20 nt, Homo sapiens
ucuggauaccauuauauguu

SEQ ID NO: 945804 - RNA, 19 nt, Homo sapiens
ucuggcaggaaucuaucca

SEQ ID NO: 945805 - RNA, 19 nt, Homo sapiens
ucugggaaucaacagcaua

SEQ ID NO: 945806 - RNA, 14 nt, Homo sapiens
ucugucaacaucaa

SEQ ID NO: 945807 - RNA, 12 nt, Homo sapiens
ucugucaccagc

SEQ ID NO: 945808 - RNA, 19 nt, Homo sapiens
ucugucaggggcucccaca

SEQ ID NO: 945809 - RNA, 16 nt, Homo sapiens
ucugucaucucucugg

SEQ ID NO: 945810 - RNA, 13 nt, Homo sapiens
ucugucuaccugg

SEQ ID NO: 945811 - RNA, 14 nt, Homo sapiens
ucuguguuaggggu

SEQ ID NO: 945812 - RNA, 13 nt, Homo sapiens
ucuuaggaauuga

SEQ ID NO: 945813 - RNA, 12 nt, Homo sapiens
ucuuaucuuucu

SEQ ID NO: 945814 - RNA, 22 nt, Homo sapiens
ucuucccucuccccauucggug

SEQ ID NO: 945815 - RNA, 16 nt, Homo sapiens
ucuugaggcauuucca

SEQ ID NO: 945816 - RNA, 15 nt, Homo sapiens
ucuugcaacucugua

SEQ ID NO: 945817 - RNA, 16 nt, Homo sapiens
ucuuggccuaaaccuc

SEQ ID NO: 945818 - RNA, 17 nt, Homo sapiens
ucuuuagcaugcuacag

SEQ ID NO: 945819 - RNA, 13 nt, Homo sapiens
ucuuuccaaaaca

SEQ ID NO: 945820 - RNA, 13 nt, Homo sapiens
ucuuucuuuccaa

SEQ ID NO: 945821 - RNA, 17 nt, Homo sapiens
ucuuugcaccaaagaca

SEQ ID NO: 945822 - RNA, 20 nt, Homo sapiens
ucuuugcaccaaagacauca

SEQ ID NO: 945823 - RNA, 20 nt, Homo sapiens
ugccaauagugucauccuca

SEQ ID NO: 945824 - RNA, 12 nt, Homo sapiens
ugccaugaucug

SEQ ID NO: 945825 - RNA, 16 nt, Homo sapiens
ugccauggaaccuucc

SEQ ID NO: 945826 - RNA, 23 nt, Homo sapiens
ugccccaaaucucaacuucucag

SEQ ID NO: 945827 - RNA, 19 nt, Homo sapiens
ugccccccagccucuggca

SEQ ID NO: 945828 - RNA, 15 nt, Homo sapiens
ugccccuuggcugcu

SEQ ID NO: 945829 - RNA, 19 nt, Homo sapiens
ugcccuagaucaacagauc

SEQ ID NO: 945830 - RNA, 21 nt, Homo sapiens
ugccucccccuaaauuaauga

SEQ ID NO: 945831 - RNA, 15 nt, Homo sapiens
ugccugcaccccagg

SEQ ID NO: 945832 - RNA, 21 nt, Homo sapiens
ugccuguaaagucugaguaag

SEQ ID NO: 945833 - RNA, 14 nt, Homo sapiens
ugccuguaauccca

SEQ ID NO: 945834 - RNA, 13 nt, Homo sapiens
ugccugugcuaca

SEQ ID NO: 945835 - RNA, 18 nt, Homo sapiens
ugccugugcuacaauuca

SEQ ID NO: 945836 - RNA, 13 nt, Homo sapiens
ugccuucuccuau

SEQ ID NO: 945837 - RNA, 14 nt, Homo sapiens
ugccuucuggccuu

SEQ ID NO: 945838 - RNA, 17 nt, Homo sapiens
ugcgcgcgugcaugugu

SEQ ID NO: 945839 - RNA, 17 nt, Homo sapiens
ugcuaaacucuuucauc

SEQ ID NO: 945840 - RNA, 21 nt, Homo sapiens
ugcuaaacucuuucauccccu

SEQ ID NO: 945841 - RNA, 14 nt, Homo sapiens
ugcuauaaguuuua

SEQ ID NO: 945842 - RNA, 11 nt, Homo sapiens
ugcuccaguca

SEQ ID NO: 945843 - RNA, 23 nt, Homo sapiens
ugcuccagucauugcacaaggca

SEQ ID NO: 945844 - RNA, 19 nt, Homo sapiens
ugcucuuacuacagcuuca

SEQ ID NO: 945845 - RNA, 15 nt, Homo sapiens
ugcugauuuggugac

SEQ ID NO: 945846 - RNA, 15 nt, Homo sapiens
ugcugcaaacacuua

SEQ ID NO: 945847 - RNA, 23 nt, Homo sapiens
ugcugcacagaaauuuucaauuu

SEQ ID NO: 945848 - RNA, 13 nt, Homo sapiens
ugcuggacucugg

SEQ ID NO: 945849 - RNA, 18 nt, Homo sapiens
ugcugggggaaguggcca

SEQ ID NO: 945850 - RNA, 14 nt, Homo sapiens
ugcugucauaacau

SEQ ID NO: 945851 - RNA, 17 nt, Homo sapiens
ugcuuaccuacuuucuu

SEQ ID NO: 945852 - RNA, 16 nt, Homo sapiens
ugcuuaccugaucuca

SEQ ID NO: 945853 - RNA, 14 nt, Homo sapiens
ugcuuagaaauuca

SEQ ID NO: 945854 - RNA, 23 nt, Homo sapiens
uggaaacacccacucacuuugca

SEQ ID NO: 945855 - RNA, 19 nt, Homo sapiens
uggaaagcggcuagguuuu

SEQ ID NO: 945856 - RNA, 21 nt, Homo sapiens
uggaagcugagauuacucuga

SEQ ID NO: 945857 - RNA, 16 nt, Homo sapiens
uggaaugaagguaaua

SEQ ID NO: 945858 - RNA, 11 nt, Homo sapiens
uggacuucuua

SEQ ID NO: 945859 - RNA, 12 nt, Homo sapiens
uggacuucuuag

SEQ ID NO: 945860 - RNA, 21 nt, Homo sapiens
uggacuucuuaguuguuucuc

SEQ ID NO: 945861 - RNA, 12 nt, Homo sapiens
aaaaaaauuacu

SEQ ID NO: 945862 - RNA, 13 nt, Homo sapiens
aaaaagcauacuu

SEQ ID NO: 945863 - RNA, 12 nt, Homo sapiens
aaaaaucucuca

SEQ ID NO: 945864 - RNA, 17 nt, Homo sapiens
agguguguaaaggagaa

SEQ ID NO: 945865 - RNA, 15 nt, Homo sapiens
agguucagccugaaa

SEQ ID NO: 945866 - RNA, 18 nt, Homo sapiens
agguuccacagaggacac

SEQ ID NO: 945867 - RNA, 17 nt, Homo sapiens
aguaaaaucaaaugugc

SEQ ID NO: 945868 - RNA, 20 nt, Homo sapiens
aguaaaaucaaaugugcauc

SEQ ID NO: 945869 - RNA, 15 nt, Homo sapiens
aguaacuccccucag

SEQ ID NO: 945870 - RNA, 18 nt, Homo sapiens
aguacugguugacuuucu

SEQ ID NO: 945871 - RNA, 14 nt, Homo sapiens
aaaacucaacauua

SEQ ID NO: 945872 - RNA, 11 nt, Homo sapiens
aaaacuuguaa

SEQ ID NO: 945873 - RNA, 14 nt, Homo sapiens
aaaagcaauacugu

SEQ ID NO: 945874 - RNA, 16 nt, Homo sapiens
aaaaggcuucacuuuu

SEQ ID NO: 945875 - RNA, 16 nt, Homo sapiens
aaaagggaaguaagca

SEQ ID NO: 945876 - RNA, 23 nt, Homo sapiens
aaaagucccaacccaaugggcuc

SEQ ID NO: 945877 - RNA, 22 nt, Homo sapiens
aaaaguggcauuuccuggucag

SEQ ID NO: 945878 - RNA, 22 nt, Homo sapiens
aaaaguuggucaggcgcagugg

SEQ ID NO: 945879 - RNA, 12 nt, Homo sapiens
aaaauaauauua

SEQ ID NO: 945880 - RNA, 14 nt, Homo sapiens
aaaauacauaguga

SEQ ID NO: 945881 - RNA, 22 nt, Homo sapiens
aaaauacuuuugcuuucaggga

SEQ ID NO: 945882 - RNA, 22 nt, Homo sapiens
aaaauauuaagacaauagcacu

SEQ ID NO: 945883 - RNA, 15 nt, Homo sapiens
aaaaucaaaugugca

SEQ ID NO: 945884 - RNA, 23 nt, Homo sapiens
aaaauccuuuuggcauguuccca

SEQ ID NO: 945885 - RNA, 16 nt, Homo sapiens
aaaaucuaagcagcuu

SEQ ID NO: 945886 - RNA, 20 nt, Homo sapiens
aaaaugaaguuuugauuuau

SEQ ID NO: 945887 - RNA, 14 nt, Homo sapiens
aaaaugcaaaagca

SEQ ID NO: 945888 - RNA, 21 nt, Homo sapiens
aaaauggucacguuuggugcu

SEQ ID NO: 945889 - RNA, 14 nt, Homo sapiens
aaaauucagaugcu

SEQ ID NO: 945890 - RNA, 17 nt, Homo sapiens
aaacaaaauuugacuaa

SEQ ID NO: 945891 - RNA, 21 nt, Homo sapiens
aaacaaguacugguugacuuu

SEQ ID NO: 945892 - RNA, 22 nt, Homo sapiens
aaacagccucuuuuugauacug

SEQ ID NO: 945893 - RNA, 21 nt, Homo sapiens
aaacauuaaaauauaaucucu

SEQ ID NO: 945894 - RNA, 20 nt, Homo sapiens
aaacauuauaaaaauugaca

SEQ ID NO: 945895 - RNA, 12 nt, Homo sapiens
aaacauugaaga

SEQ ID NO: 945896 - RNA, 14 nt, Homo sapiens
aaacauuucuggac

SEQ ID NO: 945897 - RNA, 15 nt, Homo sapiens
aaaccaucucucuuc

SEQ ID NO: 945898 - RNA, 17 nt, Homo sapiens
aaaccuacccucaguga

SEQ ID NO: 945899 - RNA, 13 nt, Homo sapiens
aaacgcuacugag

SEQ ID NO: 945900 - RNA, 21 nt, Homo sapiens
aaacuaauuuaguaauagccu

SEQ ID NO: 945901 - RNA, 18 nt, Homo sapiens
aaacuaugaggacugccu

SEQ ID NO: 945902 - RNA, 13 nt, Homo sapiens
aaacugauuuauc

SEQ ID NO: 945903 - RNA, 20 nt, Homo sapiens
aaacugauuuaucuauuuaa

SEQ ID NO: 945904 - RNA, 18 nt, Homo sapiens
aaagaacguggucagagu

SEQ ID NO: 945905 - RNA, 20 nt, Homo sapiens
aaagaagaagagaugacaaa

SEQ ID NO: 945906 - RNA, 18 nt, Homo sapiens
aaagaagcaaucuccuua

SEQ ID NO: 945907 - RNA, 13 nt, Homo sapiens
aaagacacugcag

SEQ ID NO: 945908 - RNA, 11 nt, Homo sapiens
aaagacaucag

SEQ ID NO: 945909 - RNA, 12 nt, Homo sapiens
aaagacaucagu

SEQ ID NO: 945910 - RNA, 17 nt, Homo sapiens
aaagacaucagucucca

SEQ ID NO: 945911 - RNA, 20 nt, Homo sapiens
aaagagaagcaucauuuccc

SEQ ID NO: 945912 - RNA, 16 nt, Homo sapiens
aaagagaauauuuaca

SEQ ID NO: 945913 - RNA, 18 nt, Homo sapiens
aaagagcuuugugauaua

SEQ ID NO: 945914 - RNA, 16 nt, Homo sapiens
aaagauccagccucau

SEQ ID NO: 945915 - RNA, 17 nt, Homo sapiens
aaagauuguuggaugaa

SEQ ID NO: 945916 - RNA, 22 nt, Homo sapiens
aaagccuugugugaacucacca

SEQ ID NO: 945917 - RNA, 16 nt, Homo sapiens
aaagcuaccauuuauc

SEQ ID NO: 945918 - RNA, 16 nt, Homo sapiens
aaaggaaaaggucuga

SEQ ID NO: 945919 - RNA, 15 nt, Homo sapiens
aaaggaacugcaaua

SEQ ID NO: 945920 - RNA, 18 nt, Homo sapiens
aaaggucccuccccagac

SEQ ID NO: 945921 - RNA, 15 nt, Homo sapiens
aaaguaaucuaccuc

SEQ ID NO: 945922 - RNA, 17 nt, Homo sapiens
aaaguccauaccuuaua

SEQ ID NO: 945923 - RNA, 14 nt, Homo sapiens
aaaguggugcuaua

SEQ ID NO: 945924 - RNA, 20 nt, Homo sapiens
aaaguuacuagguaacuuca

SEQ ID NO: 945925 - RNA, 20 nt, Homo sapiens
aaauaaaaaucucuuuucca

SEQ ID NO: 945926 - RNA, 19 nt, Homo sapiens
aaauaauagaaaugucuca

SEQ ID NO: 945927 - RNA, 17 nt, Homo sapiens
aaauaauguauuuacuu

SEQ ID NO: 945928 - RNA, 20 nt, Homo sapiens
aaauaauuuuauuaugcaac

SEQ ID NO: 945929 - RNA, 22 nt, Homo sapiens
aaauauagcuaauaacauguga

SEQ ID NO: 945930 - RNA, 12 nt, Homo sapiens
aaauauugucau

SEQ ID NO: 945931 - RNA, 16 nt, Homo sapiens
aaauauuuagauguaa

SEQ ID NO: 945932 - RNA, 13 nt, Homo sapiens
aaaucaaaugugc

SEQ ID NO: 945933 - RNA, 15 nt, Homo sapiens
aaaucaaaugugcau

SEQ ID NO: 945934 - RNA, 16 nt, Homo sapiens
aaaucccuuguucuca

SEQ ID NO: 945935 - RNA, 22 nt, Homo sapiens
aaaugaauggaggaacuuucca

SEQ ID NO: 945936 - RNA, 10 nt, Homo sapiens
aaaugagcuc

SEQ ID NO: 945937 - RNA, 15 nt, Homo sapiens
aaaugauagcagaau

SEQ ID NO: 945938 - RNA, 18 nt, Homo sapiens
aaaugauguguacccaaa

SEQ ID NO: 945939 - RNA, 22 nt, Homo sapiens
aaauggaaaaauaaacacuaca

SEQ ID NO: 945940 - RNA, 15 nt, Homo sapiens
aaaugugcuggucac

SEQ ID NO: 945941 - RNA, 16 nt, Homo sapiens
aaauguguaagaacaa

SEQ ID NO: 945942 - RNA, 14 nt, Homo sapiens
aaauuauuugucau

SEQ ID NO: 945943 - RNA, 18 nt, Homo sapiens
aaauucaauuaggauuaa

SEQ ID NO: 945944 - RNA, 17 nt, Homo sapiens
aaauucagaugcuguua

SEQ ID NO: 945945 - RNA, 15 nt, Homo sapiens
aaauucagcauuuga

SEQ ID NO: 945946 - RNA, 17 nt, Homo sapiens
aaauuccucaacagugu

SEQ ID NO: 945947 - RNA, 18 nt, Homo sapiens
aaauuuuaaaaaucuaag

SEQ ID NO: 945948 - RNA, 20 nt, Homo sapiens
aacaaaaaagaaaaguagaa

SEQ ID NO: 945949 - RNA, 12 nt, Homo sapiens
aacaaacagggc

SEQ ID NO: 945950 - RNA, 15 nt, Homo sapiens
aacaacuuacacuua

SEQ ID NO: 945951 - RNA, 13 nt, Homo sapiens
aacaaugacuuaa

SEQ ID NO: 945952 - RNA, 15 nt, Homo sapiens
aacacucaugaagca

SEQ ID NO: 945953 - RNA, 19 nt, Homo sapiens
aacacuguguacaccucaa

SEQ ID NO: 945954 - RNA, 15 nt, Homo sapiens
aacacuucauuuuca

SEQ ID NO: 945955 - RNA, 19 nt, Homo sapiens
aacagaauggauugccagu

SEQ ID NO: 945956 - RNA, 15 nt, Homo sapiens
aacaggcuaccaacu

SEQ ID NO: 945957 - RNA, 15 nt, Homo sapiens
aacagggcaacugua

SEQ ID NO: 945958 - RNA, 17 nt, Homo sapiens
aacagguaaaacagggc

SEQ ID NO: 945959 - RNA, 18 nt, Homo sapiens
aacagguaaaacagggcc

SEQ ID NO: 945960 - RNA, 19 nt, Homo sapiens
aacagucuggcgucuccag

SEQ ID NO: 945961 - RNA, 18 nt, Homo sapiens
aacaguuaccugagagau

SEQ ID NO: 945962 - RNA, 23 nt, Homo sapiens
aacauccuggcuuuugagcacuu

SEQ ID NO: 945963 - RNA, 19 nt, Homo sapiens
aacaucuuaagauccacaa

SEQ ID NO: 945964 - RNA, 22 nt, Homo sapiens
aacauguuccuuauauuuacuc

SEQ ID NO: 945965 - RNA, 18 nt, Homo sapiens
aacauuaauuauauguau

SEQ ID NO: 945966 - RNA, 17 nt, Homo sapiens
aacauuaucuaguucau

SEQ ID NO: 945967 - RNA, 17 nt, Homo sapiens
aacauugguucuuucau

SEQ ID NO: 945968 - RNA, 16 nt, Homo sapiens
aacauuguugauuuca

SEQ ID NO: 945969 - RNA, 21 nt, Homo sapiens
aaccaagagauaacuguaaau

SEQ ID NO: 945970 - RNA, 22 nt, Homo sapiens
aaccagaguuggagacucagca

SEQ ID NO: 945971 - RNA, 14 nt, Homo sapiens
aaccagugagcacu

SEQ ID NO: 945972 - RNA, 14 nt, Homo sapiens
aucuaguucauuga

SEQ ID NO: 945973 - RNA, 18 nt, Homo sapiens
aucuauaaaauagauaua

SEQ ID NO: 945974 - RNA, 18 nt, Homo sapiens
aucucccuuuuccaugac

SEQ ID NO: 945975 - RNA, 17 nt, Homo sapiens
aucuccugcgcccuuca

SEQ ID NO: 945976 - RNA, 18 nt, Homo sapiens
aucucucagagcccucaa

SEQ ID NO: 945977 - RNA, 19 nt, Homo sapiens
aucugcuguuaacugcaac

SEQ ID NO: 945978 - RNA, 14 nt, Homo sapiens
aucuggacacuggg

SEQ ID NO: 945979 - RNA, 16 nt, Homo sapiens
aucuuaagauccacaa

SEQ ID NO: 945980 - RNA, 13 nt, Homo sapiens
aucuuucuaggag

SEQ ID NO: 945981 - RNA, 19 nt, Homo sapiens
aucuuucugcacacaaaua

SEQ ID NO: 945982 - RNA, 23 nt, Homo sapiens
aucuuucuuuccaaaacauuucu

SEQ ID NO: 945983 - RNA, 15 nt, Homo sapiens
augaccaugcugaua

SEQ ID NO: 945984 - RNA, 13 nt, Homo sapiens
augagaagcagaa

SEQ ID NO: 945985 - RNA, 17 nt, Homo sapiens
augagacuuucuaaauc

SEQ ID NO: 945986 - RNA, 19 nt, Homo sapiens
augauacuuggaugcagcu

SEQ ID NO: 945987 - RNA, 20 nt, Homo sapiens
augauagcaaauggccucau

SEQ ID NO: 945988 - RNA, 20 nt, Homo sapiens
augauccucaugguucccaa

SEQ ID NO: 945989 - RNA, 16 nt, Homo sapiens
augaucuagccuccau

SEQ ID NO: 945990 - RNA, 21 nt, Homo sapiens
augaugaaaacuaaggauuuu

SEQ ID NO: 945991 - RNA, 16 nt, Homo sapiens
augaugagaagcagaa

SEQ ID NO: 945992 - RNA, 14 nt, Homo sapiens
augcaaccuaguca

SEQ ID NO: 945993 - RNA, 22 nt, Homo sapiens
augcacguggggcccacugcuc

SEQ ID NO: 945994 - RNA, 23 nt, Homo sapiens
augcaggcagcacagcagacuag

SEQ ID NO: 945995 - RNA, 15 nt, Homo sapiens
augcaguaugugcag

SEQ ID NO: 945996 - RNA, 13 nt, Homo sapiens
augccacuaugag

SEQ ID NO: 945997 - RNA, 14 nt, Homo sapiens
augccacuucucac

SEQ ID NO: 945998 - RNA, 17 nt, Homo sapiens
augccaugugcaggugg

SEQ ID NO: 945999 - RNA, 17 nt, Homo sapiens
augccuuaaucccagca

SEQ ID NO: 946000 - RNA, 15 nt, Homo sapiens
augcugaaacaucau

SEQ ID NO: 946001 - RNA, 22 nt, Homo sapiens
augcugaaacaucauuacagau

SEQ ID NO: 946002 - RNA, 18 nt, Homo sapiens
augcugcaggacuugaga

SEQ ID NO: 946003 - RNA, 16 nt, Homo sapiens
augcuuagagggguga

SEQ ID NO: 946004 - RNA, 14 nt, Homo sapiens
augcuucaugugcu

SEQ ID NO: 946005 - RNA, 15 nt, Homo sapiens
augcuucaugugcug

SEQ ID NO: 946006 - RNA, 15 nt, Homo sapiens
auggaggaacuuucc

SEQ ID NO: 946007 - RNA, 18 nt, Homo sapiens
auggagggaaugcucaga

SEQ ID NO: 946008 - RNA, 15 nt, Homo sapiens
auggcccuaccagac

SEQ ID NO: 946009 - RNA, 16 nt, Homo sapiens
augggcagaaaaaugg

SEQ ID NO: 946010 - RNA, 17 nt, Homo sapiens
augggcuaucaacuuaa

SEQ ID NO: 946011 - RNA, 20 nt, Homo sapiens
augguagaaguuuggcugcu

SEQ ID NO: 946012 - RNA, 16 nt, Homo sapiens
auggucuuuccacuuu

SEQ ID NO: 946013 - RNA, 12 nt, Homo sapiens
auggugagcucu

SEQ ID NO: 946014 - RNA, 17 nt, Homo sapiens
auggugagcucugggaa

SEQ ID NO: 946015 - RNA, 23 nt, Homo sapiens
auggugcaccgagugauuuccau

SEQ ID NO: 946016 - RNA, 14 nt, Homo sapiens
auguaaagugucag

SEQ ID NO: 946017 - RNA, 17 nt, Homo sapiens
auguaauggacuaugca

SEQ ID NO: 946018 - RNA, 17 nt, Homo sapiens
auguacagggguaguuu

SEQ ID NO: 946019 - RNA, 14 nt, Homo sapiens
auguacuucucacc

SEQ ID NO: 946020 - RNA, 15 nt, Homo sapiens
auguauauugucuag

SEQ ID NO: 946021 - RNA, 23 nt, Homo sapiens
auguauuuacuuuuuauuugcaa

SEQ ID NO: 946022 - RNA, 21 nt, Homo sapiens
auguauuuauuugggagaccg

SEQ ID NO: 946023 - RNA, 19 nt, Homo sapiens
augucaaauugaugugccc

SEQ ID NO: 946024 - RNA, 13 nt, Homo sapiens
augucucugcaaa

SEQ ID NO: 946025 - RNA, 21 nt, Homo sapiens
augugaaaauuacaguccaaa

SEQ ID NO: 946026 - RNA, 13 nt, Homo sapiens
auguguaaagauu

SEQ ID NO: 946027 - RNA, 16 nt, Homo sapiens
auguguaaagauuuau

SEQ ID NO: 946028 - RNA, 18 nt, Homo sapiens
auguguccccucacucug

SEQ ID NO: 946029 - RNA, 21 nt, Homo sapiens
auguguccccucacucuguca

SEQ ID NO: 946030 - RNA, 22 nt, Homo sapiens
auguguccccucacucugucag

SEQ ID NO: 946031 - RNA, 15 nt, Homo sapiens
auguguuacuucaag

SEQ ID NO: 946032 - RNA, 22 nt, Homo sapiens
auguuaacacucaugaagcaua

SEQ ID NO: 946033 - RNA, 15 nt, Homo sapiens
auguugaucauguac

SEQ ID NO: 946034 - RNA, 16 nt, Homo sapiens
auguuguacaaucaaa

SEQ ID NO: 946035 - RNA, 21 nt, Homo sapiens
auguuuauaaaucuuaugcuc

SEQ ID NO: 946036 - RNA, 20 nt, Homo sapiens
auuaaaaagaauucuuccac

SEQ ID NO: 946037 - RNA, 20 nt, Homo sapiens
auuaaaagaugucucugcaa

SEQ ID NO: 946038 - RNA, 14 nt, Homo sapiens
auuaacaaaaugua

SEQ ID NO: 946039 - RNA, 16 nt, Homo sapiens
auuaagaggaugcugg

SEQ ID NO: 946040 - RNA, 23 nt, Homo sapiens
auuaagcauguuuuguugcucag

SEQ ID NO: 946041 - RNA, 19 nt, Homo sapiens
auuaagcccaauuaauucc

SEQ ID NO: 946042 - RNA, 18 nt, Homo sapiens
auuaauaaucuuauuagg

SEQ ID NO: 946043 - RNA, 15 nt, Homo sapiens
auuaaugcacuuucu

SEQ ID NO: 946044 - RNA, 17 nt, Homo sapiens
auuacagauucugcuag

SEQ ID NO: 946045 - RNA, 12 nt, Homo sapiens
auuaccuucuau

SEQ ID NO: 946046 - RNA, 19 nt, Homo sapiens
auuauggggacuuugguuu

SEQ ID NO: 946047 - RNA, 11 nt, Homo sapiens
auuauuugccc

SEQ ID NO: 946048 - RNA, 18 nt, Homo sapiens
auucagcaaaaaucuccc

SEQ ID NO: 946049 - RNA, 15 nt, Homo sapiens
auucagguaauacaa

SEQ ID NO: 946050 - RNA, 18 nt, Homo sapiens
auucauaggaagguguuu

SEQ ID NO: 946051 - RNA, 15 nt, Homo sapiens
auucauuguggucau

SEQ ID NO: 946052 - RNA, 17 nt, Homo sapiens
auucauuguggucauag

SEQ ID NO: 946053 - RNA, 16 nt, Homo sapiens
auucauuguguuaccu

SEQ ID NO: 946054 - RNA, 22 nt, Homo sapiens
auuccagccacuggcugcuaac

SEQ ID NO: 946055 - RNA, 21 nt, Homo sapiens
auuccccuguagcagucacug

SEQ ID NO: 946056 - RNA, 19 nt, Homo sapiens
auuccuauuggaaacagag

SEQ ID NO: 946057 - RNA, 24 nt, Homo sapiens
auuccuuucagcaauccaugagau

SEQ ID NO: 946058 - RNA, 19 nt, Homo sapiens
auucucaucaguccauugc

SEQ ID NO: 946059 - RNA, 14 nt, Homo sapiens
auucugucauuuca

SEQ ID NO: 946060 - RNA, 18 nt, Homo sapiens
auucuguuuuuaaugcua

SEQ ID NO: 946061 - RNA, 20 nt, Homo sapiens
auucuucagauauacuggaa

SEQ ID NO: 946062 - RNA, 13 nt, Homo sapiens
auugaaacucucu

SEQ ID NO: 946063 - RNA, 20 nt, Homo sapiens
auugaauuaauaauaaagcu

SEQ ID NO: 946064 - RNA, 12 nt, Homo sapiens
auugagguucuc

SEQ ID NO: 946065 - RNA, 17 nt, Homo sapiens
auugauuuuaaccaaug

SEQ ID NO: 946066 - RNA, 20 nt, Homo sapiens
auugcauuccagccugggca

SEQ ID NO: 946067 - RNA, 18 nt, Homo sapiens
auugcuuaccugaucuca

SEQ ID NO: 946068 - RNA, 17 nt, Homo sapiens
auuggagaagauuuaug

SEQ ID NO: 946069 - RNA, 15 nt, Homo sapiens
auugggcaggugaaa

SEQ ID NO: 946070 - RNA, 13 nt, Homo sapiens
auuguagccucaa

SEQ ID NO: 946071 - RNA, 14 nt, Homo sapiens
auuguagccucaau

SEQ ID NO: 946072 - RNA, 20 nt, Homo sapiens
auuuaaaaaaacgagcaauu

SEQ ID NO: 946073 - RNA, 19 nt, Homo sapiens
auuuaaaacguuuugguca

SEQ ID NO: 946074 - RNA, 15 nt, Homo sapiens
auuuaaaauucaauu

SEQ ID NO: 946075 - RNA, 15 nt, Homo sapiens
auuuacaaggaguua

SEQ ID NO: 946076 - RNA, 19 nt, Homo sapiens
auuuacuuuuuauuugcaa

SEQ ID NO: 946077 - RNA, 16 nt, Homo sapiens
auuuagcugugcucag

SEQ ID NO: 946078 - RNA, 17 nt, Homo sapiens
auuuauaaaacuucuca

SEQ ID NO: 946079 - RNA, 18 nt, Homo sapiens
auuucaauaaaaguaaag

SEQ ID NO: 946080 - RNA, 20 nt, Homo sapiens
aacccuuuuaaaguugauau

SEQ ID NO: 946081 - RNA, 14 nt, Homo sapiens
aaccuacccucagu

SEQ ID NO: 946082 - RNA, 22 nt, Homo sapiens
aaccuagucagguuagcugaac

SEQ ID NO: 946083 - RNA, 16 nt, Homo sapiens
aaccucaaaggagcaa

SEQ ID NO: 946084 - RNA, 17 nt, Homo sapiens
aaccucuucuggcucaa

SEQ ID NO: 946085 - RNA, 13 nt, Homo sapiens
aacgccgagugca

SEQ ID NO: 946086 - RNA, 22 nt, Homo sapiens
aacgucugguccuaaccaguga

SEQ ID NO: 946087 - RNA, 18 nt, Homo sapiens
aacuagccaaaccaggac

SEQ ID NO: 946088 - RNA, 15 nt, Homo sapiens
aacuaggaaaaucac

SEQ ID NO: 946089 - RNA, 19 nt, Homo sapiens
aacuaguagagagagacuu

SEQ ID NO: 946090 - RNA, 15 nt, Homo sapiens
aacucaaaaccaucu

SEQ ID NO: 946091 - RNA, 22 nt, Homo sapiens
aacuccccucagggauacgaca

SEQ ID NO: 946092 - RNA, 11 nt, Homo sapiens
aacucuuucau

SEQ ID NO: 946093 - RNA, 23 nt, Homo sapiens
aacugaggacuguuugcaauuga

SEQ ID NO: 946094 - RNA, 15 nt, Homo sapiens
aacugcaaccucaaa

SEQ ID NO: 946095 - RNA, 14 nt, Homo sapiens
aacuucauauguaa

SEQ ID NO: 946096 - RNA, 22 nt, Homo sapiens
aacuucugccucccaugcuuac

SEQ ID NO: 946097 - RNA, 22 nt, Homo sapiens
aacuuuacuguccuaacauggu

SEQ ID NO: 946098 - RNA, 20 nt, Homo sapiens
aacuuuggaguccccucacc

SEQ ID NO: 946099 - RNA, 16 nt, Homo sapiens
aagaaaaaaacuuacu

SEQ ID NO: 946100 - RNA, 17 nt, Homo sapiens
aagaaaaaaacuuacug

SEQ ID NO: 946101 - RNA, 21 nt, Homo sapiens
aagaaaaaaugacaccaucuu

SEQ ID NO: 946102 - RNA, 14 nt, Homo sapiens
aagaacucucugga

SEQ ID NO: 946103 - RNA, 18 nt, Homo sapiens
aagaaugcaaccuaguca

SEQ ID NO: 946104 - RNA, 22 nt, Homo sapiens
aagacaggcaaauguacuucuc

SEQ ID NO: 946105 - RNA, 15 nt, Homo sapiens
aagacaucagucucc

SEQ ID NO: 946106 - RNA, 23 nt, Homo sapiens
aagacuggacauuuaacuuuucu

SEQ ID NO: 946107 - RNA, 21 nt, Homo sapiens
aagaggcugccccucucacca

SEQ ID NO: 946108 - RNA, 18 nt, Homo sapiens
aagaucauuuaauaucuu

SEQ ID NO: 946109 - RNA, 21 nt, Homo sapiens
aagaugacgaguaacuccccu

SEQ ID NO: 946110 - RNA, 20 nt, Homo sapiens
aagaugagcuuugucuacuu

SEQ ID NO: 946111 - RNA, 19 nt, Homo sapiens
aagaugccuuaauccauuc

SEQ ID NO: 946112 - RNA, 19 nt, Homo sapiens
aagcaaguguucacaacag

SEQ ID NO: 946113 - RNA, 14 nt, Homo sapiens
aagcaauaacuuug

SEQ ID NO: 946114 - RNA, 13 nt, Homo sapiens
aagcauacuuugu

SEQ ID NO: 946115 - RNA, 12 nt, Homo sapiens
aagcaucugcca

SEQ ID NO: 946116 - RNA, 23 nt, Homo sapiens
aagcauguuuuguugcucagugu

SEQ ID NO: 946117 - RNA, 13 nt, Homo sapiens
aagcccaggagcc

SEQ ID NO: 946118 - RNA, 21 nt, Homo sapiens
aagcccaggagccucacuggg

SEQ ID NO: 946119 - RNA, 23 nt, Homo sapiens
aagcuaaauauuuaacauuguug

SEQ ID NO: 946120 - RNA, 17 nt, Homo sapiens
aagcuagaggugaacua

SEQ ID NO: 946121 - RNA, 22 nt, Homo sapiens
aaggaacugcaauaauaucaaa

SEQ ID NO: 946122 - RNA, 15 nt, Homo sapiens
aaggaaucauuguuc

SEQ ID NO: 946123 - RNA, 19 nt, Homo sapiens
aaggacuagauacuacuuu

SEQ ID NO: 946124 - RNA, 23 nt, Homo sapiens
aaggcaauuccugauggaaaaug

SEQ ID NO: 946125 - RNA, 21 nt, Homo sapiens
aagggaaaguuuuguucugua

SEQ ID NO: 946126 - RNA, 22 nt, Homo sapiens
aagggaaccauguauaugagcu

SEQ ID NO: 946127 - RNA, 13 nt, Homo sapiens
aagggagugcaug

SEQ ID NO: 946128 - RNA, 19 nt, Homo sapiens
aagggcaacagaucaguaa

SEQ ID NO: 946129 - RNA, 15 nt, Homo sapiens
aagggccuugaaucc

SEQ ID NO: 946130 - RNA, 18 nt, Homo sapiens
aaggguacagaugugcug

SEQ ID NO: 946131 - RNA, 13 nt, Homo sapiens
aagguuuuauuca

SEQ ID NO: 946132 - RNA, 16 nt, Homo sapiens
aaguaauacaaacuaa

SEQ ID NO: 946133 - RNA, 11 nt, Homo sapiens
aaguacaucuc

SEQ ID NO: 946134 - RNA, 16 nt, Homo sapiens
aaguaugacaaccucu

SEQ ID NO: 946135 - RNA, 13 nt, Homo sapiens
aagucucucaccc

SEQ ID NO: 946136 - RNA, 15 nt, Homo sapiens
aagucuguaccucaa

SEQ ID NO: 946137 - RNA, 20 nt, Homo sapiens
aaguguucacaacagugaaa

SEQ ID NO: 946138 - RNA, 15 nt, Homo sapiens
aaguuaacucuucaa

SEQ ID NO: 946139 - RNA, 14 nt, Homo sapiens
aaguuacauuguua

SEQ ID NO: 946140 - RNA, 20 nt, Homo sapiens
aaguuacuagguaacuucau

SEQ ID NO: 946141 - RNA, 18 nt, Homo sapiens
aaguuaguuccacugaga

SEQ ID NO: 946142 - RNA, 13 nt, Homo sapiens
aauaaaacugugc

SEQ ID NO: 946143 - RNA, 18 nt, Homo sapiens
aauaaauauuuaaugaau

SEQ ID NO: 946144 - RNA, 17 nt, Homo sapiens
aauaaccuuucacuuaa

SEQ ID NO: 946145 - RNA, 15 nt, Homo sapiens
aauaaggcccagagc

SEQ ID NO: 946146 - RNA, 15 nt, Homo sapiens
aauaauaagugaugu

SEQ ID NO: 946147 - RNA, 15 nt, Homo sapiens
aauaauagcaauuca

SEQ ID NO: 946148 - RNA, 12 nt, Homo sapiens
aauacaaacuau

SEQ ID NO: 946149 - RNA, 17 nt, Homo sapiens
aauacagauuuguaaca

SEQ ID NO: 946150 - RNA, 15 nt, Homo sapiens
aauacaguacuguuu

SEQ ID NO: 946151 - RNA, 23 nt, Homo sapiens
aauacuuugcagcacagcugaga

SEQ ID NO: 946152 - RNA, 19 nt, Homo sapiens
aauagacacauacauguca

SEQ ID NO: 946153 - RNA, 15 nt, Homo sapiens
aauagugaaaugcca

SEQ ID NO: 946154 - RNA, 14 nt, Homo sapiens
aauagugucauccu

SEQ ID NO: 946155 - RNA, 15 nt, Homo sapiens
aauaguguucugcaa

SEQ ID NO: 946156 - RNA, 19 nt, Homo sapiens
aauauauccccacuacuca

SEQ ID NO: 946157 - RNA, 21 nt, Homo sapiens
aauauuuuguaaugcugcaca

SEQ ID NO: 946158 - RNA, 19 nt, Homo sapiens
aaucacuugccaaaaucca

SEQ ID NO: 946159 - RNA, 16 nt, Homo sapiens
aaucaucaaguaauac

SEQ ID NO: 946160 - RNA, 21 nt, Homo sapiens
aaucauguugaucauguacuu

SEQ ID NO: 946161 - RNA, 18 nt, Homo sapiens
aaucauuuucauuccuaa

SEQ ID NO: 946162 - RNA, 20 nt, Homo sapiens
aauccaguaaucuaaaggaa

SEQ ID NO: 946163 - RNA, 21 nt, Homo sapiens
aauccaugagauagcuauuau

SEQ ID NO: 946164 - RNA, 22 nt, Homo sapiens
aauccuuucacccgcuccuaca

SEQ ID NO: 946165 - RNA, 21 nt, Homo sapiens
aaucguccagcgaccuuccuc

SEQ ID NO: 946166 - RNA, 22 nt, Homo sapiens
aaucucccagugacaacaucgc

SEQ ID NO: 946167 - RNA, 10 nt, Homo sapiens
aaucucucuc

SEQ ID NO: 946168 - RNA, 14 nt, Homo sapiens
aaucuuugugacag

SEQ ID NO: 946169 - RNA, 16 nt, Homo sapiens
aaugacuuaaccauau

SEQ ID NO: 946170 - RNA, 16 nt, Homo sapiens
aaugcaugaugaacuc

SEQ ID NO: 946171 - RNA, 20 nt, Homo sapiens
aauggacguuauccucucag

SEQ ID NO: 946172 - RNA, 16 nt, Homo sapiens
aaugggcucaaacuuc

SEQ ID NO: 946173 - RNA, 16 nt, Homo sapiens
aauggggaggacaaaa

SEQ ID NO: 946174 - RNA, 23 nt, Homo sapiens
aauguccauaugcuaauagugau

SEQ ID NO: 946175 - RNA, 17 nt, Homo sapiens
aaugucugugaauuuca

SEQ ID NO: 946176 - RNA, 14 nt, Homo sapiens
aaugugacauugau

SEQ ID NO: 946177 - RNA, 16 nt, Homo sapiens
aaugugucucaggaaa

SEQ ID NO: 946178 - RNA, 21 nt, Homo sapiens
aauguuaauugggcaggugaa

SEQ ID NO: 946179 - RNA, 15 nt, Homo sapiens
aauguuucuacagau

SEQ ID NO: 946180 - RNA, 19 nt, Homo sapiens
aauguuugaaauaguucaa

SEQ ID NO: 946181 - RNA, 16 nt, Homo sapiens
aauuaaaaaagcauac

SEQ ID NO: 946182 - RNA, 23 nt, Homo sapiens
aauuaaaaguuugaaaagcaaua

SEQ ID NO: 946183 - RNA, 14 nt, Homo sapiens
aauuaaaguacuuu

SEQ ID NO: 946184 - RNA, 21 nt, Homo sapiens
aauuacauaugaaaaacccuc

SEQ ID NO: 946185 - RNA, 22 nt, Homo sapiens
aauucacaugaugcacuucaaa

SEQ ID NO: 946186 - RNA, 20 nt, Homo sapiens
aauucacccccuuuccugga

SEQ ID NO: 946187 - RNA, 22 nt, Homo sapiens
auuucaauaaccuuucacuuaa

SEQ ID NO: 946188 - RNA, 19 nt, Homo sapiens
auuucaggagaaccuaaca

SEQ ID NO: 946189 - RNA, 23 nt, Homo sapiens
auuucauacaacagaaaccagaa

SEQ ID NO: 946190 - RNA, 19 nt, Homo sapiens
auuucucaucaguaguuca

SEQ ID NO: 946191 - RNA, 16 nt, Homo sapiens
auuucuccaaagccuu

SEQ ID NO: 946192 - RNA, 14 nt, Homo sapiens
auuucugggcuccu

SEQ ID NO: 946193 - RNA, 22 nt, Homo sapiens
auuucuguuauggggacuuuau

SEQ ID NO: 946194 - RNA, 24 nt, Homo sapiens
auuucuuucuuugcaccaaagaca

SEQ ID NO: 946195 - RNA, 19 nt, Homo sapiens
auuuggaauugaacucucu

SEQ ID NO: 946196 - RNA, 20 nt, Homo sapiens
cugcccuucccccugcaaaa

SEQ ID NO: 946197 - RNA, 16 nt, Homo sapiens
cugccgcugcaccacg

SEQ ID NO: 946198 - RNA, 17 nt, Homo sapiens
cugcgagagaaagggag

SEQ ID NO: 946199 - RNA, 20 nt, Homo sapiens
cugcuaacaagucaccaaaa

SEQ ID NO: 946200 - RNA, 21 nt, Homo sapiens
cugcugagcgugaugaucuag

SEQ ID NO: 946201 - RNA, 15 nt, Homo sapiens
cugcugucauaacau

SEQ ID NO: 946202 - RNA, 16 nt, Homo sapiens
cugcugucauaacauc

SEQ ID NO: 946203 - RNA, 18 nt, Homo sapiens
cugcugucucaucacaua

SEQ ID NO: 946204 - RNA, 17 nt, Homo sapiens
cugcuuuucccauugcc

SEQ ID NO: 946205 - RNA, 14 nt, Homo sapiens
cuggacuucuuagu

SEQ ID NO: 946206 - RNA, 22 nt, Homo sapiens
cuggaguggaaaagcuuaaaaa

SEQ ID NO: 946207 - RNA, 21 nt, Homo sapiens
cuggauaacuguaaaagggcu

SEQ ID NO: 946208 - RNA, 20 nt, Homo sapiens
cuggauggccaaacccaaga

SEQ ID NO: 946209 - RNA, 14 nt, Homo sapiens
cuggauguauguaa

SEQ ID NO: 946210 - RNA, 14 nt, Homo sapiens
cuggcacagaggua

SEQ ID NO: 946211 - RNA, 14 nt, Homo sapiens
cuggcugcuaacaa

SEQ ID NO: 946212 - RNA, 15 nt, Homo sapiens
cuggcuggaaaaagg

SEQ ID NO: 946213 - RNA, 13 nt, Homo sapiens
cuggcuuugcaag

SEQ ID NO: 946214 - RNA, 16 nt, Homo sapiens
cugggccauguccaaa

SEQ ID NO: 946215 - RNA, 17 nt, Homo sapiens
cugggccauguccaaag

SEQ ID NO: 946216 - RNA, 23 nt, Homo sapiens
cugggcccaguaccuagcuggcu

SEQ ID NO: 946217 - RNA, 15 nt, Homo sapiens
cugggccucaguuca

SEQ ID NO: 946218 - RNA, 17 nt, Homo sapiens
cugggcucacugugcug

SEQ ID NO: 946219 - RNA, 16 nt, Homo sapiens
cuggggccaacuggaa

SEQ ID NO: 946220 - RNA, 20 nt, Homo sapiens
cuggggccuacagcuuugau

SEQ ID NO: 946221 - RNA, 16 nt, Homo sapiens
cuggucgagagccaaa

SEQ ID NO: 946222 - RNA, 20 nt, Homo sapiens
cuguacaaaauaacucucca

SEQ ID NO: 946223 - RNA, 21 nt, Homo sapiens
cuguagauucagguaauacaa

SEQ ID NO: 946224 - RNA, 16 nt, Homo sapiens
cugucaacaucaaaga

SEQ ID NO: 946225 - RNA, 22 nt, Homo sapiens
cugucaggggcucccacaggau

SEQ ID NO: 946226 - RNA, 12 nt, Homo sapiens
cugucauaacau

SEQ ID NO: 946227 - RNA, 16 nt, Homo sapiens
cugucauaacauccag

SEQ ID NO: 946228 - RNA, 16 nt, Homo sapiens
cugugaauuaagccca

SEQ ID NO: 946229 - RNA, 21 nt, Homo sapiens
cugugauuucuuucuuugcac

SEQ ID NO: 946230 - RNA, 14 nt, Homo sapiens
cugugcaaagggaa

SEQ ID NO: 946231 - RNA, 20 nt, Homo sapiens
cugugcauacuuucccucau

SEQ ID NO: 946232 - RNA, 19 nt, Homo sapiens
cugugcccuagaugcacgu

SEQ ID NO: 946233 - RNA, 20 nt, Homo sapiens
cuguggcauucauauuucau

SEQ ID NO: 946234 - RNA, 19 nt, Homo sapiens
cugugucugccugucccca

SEQ ID NO: 946235 - RNA, 18 nt, Homo sapiens
cuguuauggggacuuuau

SEQ ID NO: 946236 - RNA, 14 nt, Homo sapiens
cuguuccacaccca

SEQ ID NO: 946237 - RNA, 19 nt, Homo sapiens
cuguuccacacccaaugcu

SEQ ID NO: 946238 - RNA, 21 nt, Homo sapiens
cuguuccacacccaaugcugc

SEQ ID NO: 946239 - RNA, 18 nt, Homo sapiens
cuguugugaaucaccaaa

SEQ ID NO: 946240 - RNA, 20 nt, Homo sapiens
cuguuugcccccauucacuu

SEQ ID NO: 946241 - RNA, 14 nt, Homo sapiens
cuguuugcuugugu

SEQ ID NO: 946242 - RNA, 19 nt, Homo sapiens
cuguuuucuuuugguaaag

SEQ ID NO: 946243 - RNA, 14 nt, Homo sapiens
cuguuuuguuguuu

SEQ ID NO: 946244 - RNA, 15 nt, Homo sapiens
cuuaaguauugucac

SEQ ID NO: 946245 - RNA, 12 nt, Homo sapiens
cuuacacauaau

SEQ ID NO: 946246 - RNA, 18 nt, Homo sapiens
cuuagacucgggugguua

SEQ ID NO: 946247 - RNA, 17 nt, Homo sapiens
cuuagccauugaaaugu

SEQ ID NO: 946248 - RNA, 20 nt, Homo sapiens
cuuauacucuugagaaugaa

SEQ ID NO: 946249 - RNA, 12 nt, Homo sapiens
cuuaucccauga

SEQ ID NO: 946250 - RNA, 22 nt, Homo sapiens
cuuaugauagcaaauggccuca

SEQ ID NO: 946251 - RNA, 16 nt, Homo sapiens
cuuauugacucauaca

SEQ ID NO: 946252 - RNA, 21 nt, Homo sapiens
cuucaagacgacagcucugua

SEQ ID NO: 946253 - RNA, 22 nt, Homo sapiens
cuucagugaauuuugauaaugg

SEQ ID NO: 946254 - RNA, 14 nt, Homo sapiens
cuucaugugcugcc

SEQ ID NO: 946255 - RNA, 19 nt, Homo sapiens
cuuccaugguacuguagca

SEQ ID NO: 946256 - RNA, 17 nt, Homo sapiens
cuuccccaucccggagu

SEQ ID NO: 946257 - RNA, 22 nt, Homo sapiens
cuucuaggauagcuaacuguaa

SEQ ID NO: 946258 - RNA, 20 nt, Homo sapiens
cuucucaaauuagcugcaau

SEQ ID NO: 946259 - RNA, 15 nt, Homo sapiens
cuucuccagugguca

SEQ ID NO: 946260 - RNA, 17 nt, Homo sapiens
cuucucuccugcuuccu

SEQ ID NO: 946261 - RNA, 23 nt, Homo sapiens
cuucuggggcaggcugggccaug

SEQ ID NO: 946262 - RNA, 15 nt, Homo sapiens
cuucuucagagauca

SEQ ID NO: 946263 - RNA, 20 nt, Homo sapiens
cuugcaccacuuccguccca

SEQ ID NO: 946264 - RNA, 18 nt, Homo sapiens
cuugccuauuugcugacc

SEQ ID NO: 946265 - RNA, 21 nt, Homo sapiens
cuugccugugcuacaauucau

SEQ ID NO: 946266 - RNA, 15 nt, Homo sapiens
cuugggacucaggag

SEQ ID NO: 946267 - RNA, 21 nt, Homo sapiens
cuuggugaaacuacaucucca

SEQ ID NO: 946268 - RNA, 15 nt, Homo sapiens
cuugugcuccaguca

SEQ ID NO: 946269 - RNA, 10 nt, Homo sapiens
cuuguuucag

SEQ ID NO: 946270 - RNA, 22 nt, Homo sapiens
cuuguuuuacccuauacaucca

SEQ ID NO: 946271 - RNA, 19 nt, Homo sapiens
cuuuaaaaacuguuuuaga

SEQ ID NO: 946272 - RNA, 16 nt, Homo sapiens
cuuuagaaagcaguua

SEQ ID NO: 946273 - RNA, 18 nt, Homo sapiens
cuuuagugucugagcuuc

SEQ ID NO: 946274 - RNA, 20 nt, Homo sapiens
cuuuauuuaaaaagaaugga

SEQ ID NO: 946275 - RNA, 18 nt, Homo sapiens
cuuuauuugaacaaugaa

SEQ ID NO: 946276 - RNA, 18 nt, Homo sapiens
cuuucccucauccaugcu

SEQ ID NO: 946277 - RNA, 19 nt, Homo sapiens
cuuucccuucaguacccuc

SEQ ID NO: 946278 - RNA, 15 nt, Homo sapiens
cuuucuaaucuccug

SEQ ID NO: 946279 - RNA, 22 nt, Homo sapiens
cuuucuaggagggagacacugg

SEQ ID NO: 946280 - RNA, 17 nt, Homo sapiens
cuuucugcacacaaaua

SEQ ID NO: 946281 - RNA, 18 nt, Homo sapiens
cuuucuuuguauuuuccu

SEQ ID NO: 946282 - RNA, 11 nt, Homo sapiens
cuuugcaaaau

SEQ ID NO: 946283 - RNA, 15 nt, Homo sapiens
cuuugcaccaaagac

SEQ ID NO: 946284 - RNA, 20 nt, Homo sapiens
cuuugcagagaaccucagau

SEQ ID NO: 946285 - RNA, 21 nt, Homo sapiens
cuuugcugucaaaacuacuga

SEQ ID NO: 946286 - RNA, 21 nt, Homo sapiens
cuuuguauauaggcuucucac

SEQ ID NO: 946287 - RNA, 21 nt, Homo sapiens
cuuuguccacugucaggguug

SEQ ID NO: 946288 - RNA, 17 nt, Homo sapiens
cuuuuaaaagcacguau

SEQ ID NO: 946289 - RNA, 21 nt, Homo sapiens
cuuuuaauggugaugggguaa

SEQ ID NO: 946290 - RNA, 12 nt, Homo sapiens
cuuuuacuguga

SEQ ID NO: 946291 - RNA, 21 nt, Homo sapiens
cuuuuagaaauacugcaagaa

SEQ ID NO: 946292 - RNA, 19 nt, Homo sapiens
cuuuuauuaaugcacuuuc

SEQ ID NO: 946293 - RNA, 22 nt, Homo sapiens
auaccagguuuuacacuugcau

SEQ ID NO: 946294 - RNA, 15 nt, Homo sapiens
auaccuuuuuguguc

SEQ ID NO: 946295 - RNA, 17 nt, Homo sapiens
auacuauuuauauacaa

SEQ ID NO: 946296 - RNA, 18 nt, Homo sapiens
auacuuggaccucagcca

SEQ ID NO: 946297 - RNA, 22 nt, Homo sapiens
auacuuugcagcacagcugaga

SEQ ID NO: 946298 - RNA, 22 nt, Homo sapiens
auagcauuaauaaaacugugca

SEQ ID NO: 946299 - RNA, 12 nt, Homo sapiens
auagcuucagga

SEQ ID NO: 946300 - RNA, 13 nt, Homo sapiens
auaggcaauaaua

SEQ ID NO: 946301 - RNA, 21 nt, Homo sapiens
auaggcuucucacggcgacca

SEQ ID NO: 946302 - RNA, 19 nt, Homo sapiens
auaguaccauuuauacaaa

SEQ ID NO: 946303 - RNA, 14 nt, Homo sapiens
auagucuuugccag

SEQ ID NO: 946304 - RNA, 22 nt, Homo sapiens
auaguuacuguguaaacucauc

SEQ ID NO: 946305 - RNA, 18 nt, Homo sapiens
auauaaaguacaucucua

SEQ ID NO: 946306 - RNA, 18 nt, Homo sapiens
auauacaaaacaauuaau

SEQ ID NO: 946307 - RNA, 21 nt, Homo sapiens
auauacuuguggucccagaua

SEQ ID NO: 946308 - RNA, 19 nt, Homo sapiens
auauagggaucaaccagcu

SEQ ID NO: 946309 - RNA, 21 nt, Homo sapiens
auauauuguguugacuuuaua

SEQ ID NO: 946310 - RNA, 19 nt, Homo sapiens
auaugggaaaccauguagc

SEQ ID NO: 946311 - RNA, 15 nt, Homo sapiens
auaugguagagcaau

SEQ ID NO: 946312 - RNA, 21 nt, Homo sapiens
auauguauauugucuaguaau

SEQ ID NO: 946313 - RNA, 19 nt, Homo sapiens
auaugugauuuacauuuca

SEQ ID NO: 946314 - RNA, 14 nt, Homo sapiens
auauuguuuuacaa

SEQ ID NO: 946315 - RNA, 16 nt, Homo sapiens
auauuuaaauauuacc

SEQ ID NO: 946316 - RNA, 19 nt, Homo sapiens
auauuuauuuaacuauuca

SEQ ID NO: 946317 - RNA, 15 nt, Homo sapiens
auauuucaaaccaca

SEQ ID NO: 946318 - RNA, 23 nt, Homo sapiens
aucaaaacacacuacuaccucuu

SEQ ID NO: 946319 - RNA, 20 nt, Homo sapiens
aucaaaauauuucagugaau

SEQ ID NO: 946320 - RNA, 15 nt, Homo sapiens
aucaaagagcacauu

SEQ ID NO: 946321 - RNA, 12 nt, Homo sapiens
aucaacaaagaa

SEQ ID NO: 946322 - RNA, 22 nt, Homo sapiens
aucaagcuuuuaaaaacuagag

SEQ ID NO: 946323 - RNA, 11 nt, Homo sapiens
aucaaguaaua

SEQ ID NO: 946324 - RNA, 16 nt, Homo sapiens
aucaauacaaccagcc

SEQ ID NO: 946325 - RNA, 10 nt, Homo sapiens
aucaaugugu

SEQ ID NO: 946326 - RNA, 13 nt, Homo sapiens
aucacacauauca

SEQ ID NO: 946327 - RNA, 12 nt, Homo sapiens
aucaccuguggg

SEQ ID NO: 946328 - RNA, 23 nt, Homo sapiens
aucacgucacugcacuccagcuu

SEQ ID NO: 946329 - RNA, 23 nt, Homo sapiens
aucacucuaauucggauuugcca

SEQ ID NO: 946330 - RNA, 22 nt, Homo sapiens
aucagauccugggcacauucuu

SEQ ID NO: 946331 - RNA, 18 nt, Homo sapiens
aucagggucuaagcaccu

SEQ ID NO: 946332 - RNA, 15 nt, Homo sapiens
aucagucaacaacuu

SEQ ID NO: 946333 - RNA, 23 nt, Homo sapiens
aucagucaacaacuuacacuuau

SEQ ID NO: 946334 - RNA, 16 nt, Homo sapiens
aucauaguuacugugu

SEQ ID NO: 946335 - RNA, 19 nt, Homo sapiens
aucaucaaaaacuuuggag

SEQ ID NO: 946336 - RNA, 23 nt, Homo sapiens
aucaucaacuaccauucuauucc

SEQ ID NO: 946337 - RNA, 22 nt, Homo sapiens
aucaugaagaagcucuugacca

SEQ ID NO: 946338 - RNA, 18 nt, Homo sapiens
aucauggcaucauugcau

SEQ ID NO: 946339 - RNA, 23 nt, Homo sapiens
auccagccagaccccacgcugac

SEQ ID NO: 946340 - RNA, 20 nt, Homo sapiens
auccaugcaccuaccuuaga

SEQ ID NO: 946341 - RNA, 20 nt, Homo sapiens
auccccggggcggcaggaag

SEQ ID NO: 946342 - RNA, 19 nt, Homo sapiens
aucccggaguucuccugcu

SEQ ID NO: 946343 - RNA, 20 nt, Homo sapiens
aucccuuuuuuuacauuuca

SEQ ID NO: 946344 - RNA, 22 nt, Homo sapiens
auccugggggacccaauguagg

SEQ ID NO: 946345 - RNA, 15 nt, Homo sapiens
aucuaagcagcuuau

SEQ ID NO: 946346 - RNA, 14 nt, Homo sapiens
aucuagccuccauc

SEQ ID NO: 946347 - RNA, 22 nt, Homo sapiens
aucuagcuucuucagagaucaa

SEQ ID NO: 946348 - RNA, 17 nt, Homo sapiens
aucuaugcgccuguagu

SEQ ID NO: 946349 - RNA, 14 nt, Homo sapiens
aucugauaagcaag

SEQ ID NO: 946350 - RNA, 19 nt, Homo sapiens
aucugcaacaaaaagucau

SEQ ID NO: 946351 - RNA, 15 nt, Homo sapiens
aucugccaucugcuu

SEQ ID NO: 946352 - RNA, 13 nt, Homo sapiens
aucuggacacugg

SEQ ID NO: 946353 - RNA, 18 nt, Homo sapiens
aucugggcugugggcaag

SEQ ID NO: 946354 - RNA, 20 nt, Homo sapiens
aucuggguuaauucauuugg

SEQ ID NO: 946355 - RNA, 17 nt, Homo sapiens
aucugguccaacaugaa

SEQ ID NO: 946356 - RNA, 15 nt, Homo sapiens
aucugucaucucucu

SEQ ID NO: 946357 - RNA, 12 nt, Homo sapiens
aucuguguaaag

SEQ ID NO: 946358 - RNA, 15 nt, Homo sapiens
aucuucugccuuagu

SEQ ID NO: 946359 - RNA, 22 nt, Homo sapiens
aucuugagccacagucacugga

SEQ ID NO: 946360 - RNA, 17 nt, Homo sapiens
aucuuucuuuccaaaac

SEQ ID NO: 946361 - RNA, 18 nt, Homo sapiens
augaaaaaaaaaugggaa

SEQ ID NO: 946362 - RNA, 13 nt, Homo sapiens
augaaaacaauuc

SEQ ID NO: 946363 - RNA, 18 nt, Homo sapiens
augaaguuuugauuuauu

SEQ ID NO: 946364 - RNA, 20 nt, Homo sapiens
augaauaugaugacaaucag

SEQ ID NO: 946365 - RNA, 13 nt, Homo sapiens
augaaugcagauu

SEQ ID NO: 946366 - RNA, 21 nt, Homo sapiens
augaaugcagauuacacugau

SEQ ID NO: 946367 - RNA, 19 nt, Homo sapiens
augaauucugucauuucaa

SEQ ID NO: 946368 - RNA, 19 nt, Homo sapiens
augauagcaaauggccuca

SEQ ID NO: 946369 - RNA, 20 nt, Homo sapiens
augaugaaaacuaaggauuu

SEQ ID NO: 946370 - RNA, 16 nt, Homo sapiens
augauggugacuuaga

SEQ ID NO: 946371 - RNA, 19 nt, Homo sapiens
augcaauguaagcauacuu

SEQ ID NO: 946372 - RNA, 16 nt, Homo sapiens
augcaauuuuucaaga

SEQ ID NO: 946373 - RNA, 16 nt, Homo sapiens
augcacuuauucaaua

SEQ ID NO: 946374 - RNA, 21 nt, Homo sapiens
augcauguaauggacuaugca

SEQ ID NO: 946375 - RNA, 14 nt, Homo sapiens
augccagcuacuuc

SEQ ID NO: 946376 - RNA, 22 nt, Homo sapiens
augcuaccccacuaugacagag

SEQ ID NO: 946377 - RNA, 13 nt, Homo sapiens
augcucagaaagg

SEQ ID NO: 946378 - RNA, 17 nt, Homo sapiens
augcugauaaacugauu

SEQ ID NO: 946379 - RNA, 17 nt, Homo sapiens
augcugggcucuguucu

SEQ ID NO: 946380 - RNA, 21 nt, Homo sapiens
augcuguuaguaccuacauca

SEQ ID NO: 946381 - RNA, 18 nt, Homo sapiens
auggaaaaauaaacacua

SEQ ID NO: 946382 - RNA, 18 nt, Homo sapiens
auggaagcaauugcucau

SEQ ID NO: 946383 - RNA, 22 nt, Homo sapiens
auggacguuauccucucagauu

SEQ ID NO: 946384 - RNA, 21 nt, Homo sapiens
auggaggggagggaucuccug

SEQ ID NO: 946385 - RNA, 16 nt, Homo sapiens
auggcccuaccagaca

SEQ ID NO: 946386 - RNA, 18 nt, Homo sapiens
auggcuucggacaaaaua

SEQ ID NO: 946387 - RNA, 15 nt, Homo sapiens
augggccucagucac

SEQ ID NO: 946388 - RNA, 17 nt, Homo sapiens
augggcuggcaugguga

SEQ ID NO: 946389 - RNA, 22 nt, Homo sapiens
auggugaugggguaaucuauaa

SEQ ID NO: 946390 - RNA, 15 nt, Homo sapiens
augguggcauauacu

SEQ ID NO: 946391 - RNA, 17 nt, Homo sapiens
auguaaauguaaacuca

SEQ ID NO: 946392 - RNA, 22 nt, Homo sapiens
auguaccaccaacuacuaccug

SEQ ID NO: 946393 - RNA, 12 nt, Homo sapiens
auguccaaagag

SEQ ID NO: 946394 - RNA, 16 nt, Homo sapiens
augucuccugagcacc

SEQ ID NO: 946395 - RNA, 12 nt, Homo sapiens
augucucugcaa

SEQ ID NO: 946396 - RNA, 22 nt, Homo sapiens
augucuggggcagaaacacuca

SEQ ID NO: 946397 - RNA, 13 nt, Homo sapiens
augugacuacuga

SEQ ID NO: 946398 - RNA, 17 nt, Homo sapiens
augugauuuacauuuca

SEQ ID NO: 946399 - RNA, 20 nt, Homo sapiens
augugcugacaaggcacuuc

SEQ ID NO: 946400 - RNA, 20 nt, Homo sapiens
cuuuucacaugcuaaugugc

SEQ ID NO: 946401 - RNA, 21 nt, Homo sapiens
gaaaagcaauacuguuuccau

SEQ ID NO: 946402 - RNA, 13 nt, Homo sapiens
gaaacccaaccuu

SEQ ID NO: 946403 - RNA, 17 nt, Homo sapiens
gaaagaaggacccagaa

SEQ ID NO: 946404 - RNA, 23 nt, Homo sapiens
gaaagaccaggccaaugucaggg

SEQ ID NO: 946405 - RNA, 18 nt, Homo sapiens
gaaagcaaguguucacaa

SEQ ID NO: 946406 - RNA, 21 nt, Homo sapiens
gaaagcaaguguucacaacag

SEQ ID NO: 946407 - RNA, 13 nt, Homo sapiens
gaaagcuagaggu

SEQ ID NO: 946408 - RNA, 13 nt, Homo sapiens
gaaaggaacugca

SEQ ID NO: 946409 - RNA, 22 nt, Homo sapiens
gaaaggagguuaggucuuagga

SEQ ID NO: 946410 - RNA, 20 nt, Homo sapiens
gaaaggauugauuugaacuu

SEQ ID NO: 946411 - RNA, 17 nt, Homo sapiens
gaaaggauuuuaccaaa

SEQ ID NO: 946412 - RNA, 19 nt, Homo sapiens
auuaccuccuguguggaag

SEQ ID NO: 946413 - RNA, 13 nt, Homo sapiens
auuacugugaauu

SEQ ID NO: 946414 - RNA, 19 nt, Homo sapiens
auuagaaaauuuuauggac

SEQ ID NO: 946415 - RNA, 21 nt, Homo sapiens
auuagagagcaucugcaacaa

SEQ ID NO: 946416 - RNA, 16 nt, Homo sapiens
auuagguuucagcaga

SEQ ID NO: 946417 - RNA, 14 nt, Homo sapiens
auuaucaagcuuuu

SEQ ID NO: 946418 - RNA, 13 nt, Homo sapiens
auuauuaauugca

SEQ ID NO: 946419 - RNA, 14 nt, Homo sapiens
auucacacaugcca

SEQ ID NO: 946420 - RNA, 17 nt, Homo sapiens
auucacaugaugcacuu

SEQ ID NO: 946421 - RNA, 14 nt, Homo sapiens
auucagguaauaca

SEQ ID NO: 946422 - RNA, 14 nt, Homo sapiens
auuccacaccccug

SEQ ID NO: 946423 - RNA, 15 nt, Homo sapiens
auuccaccaaaugug

SEQ ID NO: 946424 - RNA, 21 nt, Homo sapiens
auuccaugccgcagacaugaa

SEQ ID NO: 946425 - RNA, 21 nt, Homo sapiens
auuccugauggaaaaugcaaa

SEQ ID NO: 946426 - RNA, 18 nt, Homo sapiens
auuccuguuugucuacau

SEQ ID NO: 946427 - RNA, 16 nt, Homo sapiens
auuccuugggacucag

SEQ ID NO: 946428 - RNA, 15 nt, Homo sapiens
auuccuuucagcaau

SEQ ID NO: 946429 - RNA, 15 nt, Homo sapiens
auuccuuuucccaac

SEQ ID NO: 946430 - RNA, 19 nt, Homo sapiens
auucgcuacuaugauuuaa

SEQ ID NO: 946431 - RNA, 22 nt, Homo sapiens
auucuaacccagguauccaaaa

SEQ ID NO: 946432 - RNA, 22 nt, Homo sapiens
auucuuauuaguuccccaaaua

SEQ ID NO: 946433 - RNA, 17 nt, Homo sapiens
auugaaacacagaguug

SEQ ID NO: 946434 - RNA, 15 nt, Homo sapiens
auugaugagcaagac

SEQ ID NO: 946435 - RNA, 16 nt, Homo sapiens
auugcucuugagucuu

SEQ ID NO: 946436 - RNA, 21 nt, Homo sapiens
auugcucuugagucuuugcag

SEQ ID NO: 946437 - RNA, 23 nt, Homo sapiens
auugggaaaugaaaaaaaaaugg

SEQ ID NO: 946438 - RNA, 12 nt, Homo sapiens
auuguagccuca

SEQ ID NO: 946439 - RNA, 22 nt, Homo sapiens
auugucauaggauuaagcaguu

SEQ ID NO: 946440 - RNA, 18 nt, Homo sapiens
auuuaaacaccuccucau

SEQ ID NO: 946441 - RNA, 14 nt, Homo sapiens
auuuaacuauucau

SEQ ID NO: 946442 - RNA, 19 nt, Homo sapiens
auuuaaugaauacuugcua

SEQ ID NO: 946443 - RNA, 15 nt, Homo sapiens
auuuacaauuugaca

SEQ ID NO: 946444 - RNA, 19 nt, Homo sapiens
auuuacagucuaguacuua

SEQ ID NO: 946445 - RNA, 12 nt, Homo sapiens
auuuaguaauag

SEQ ID NO: 946446 - RNA, 16 nt, Homo sapiens
auuuaucaagcauuua

SEQ ID NO: 946447 - RNA, 19 nt, Homo sapiens
auuuaucaagcauuuacca

SEQ ID NO: 946448 - RNA, 20 nt, Homo sapiens
auuuauccagaaaacuguga

SEQ ID NO: 946449 - RNA, 16 nt, Homo sapiens
auuuaugaugcacuua

SEQ ID NO: 946450 - RNA, 17 nt, Homo sapiens
auuuauggauaucacac

SEQ ID NO: 946451 - RNA, 12 nt, Homo sapiens
auuuauucugau

SEQ ID NO: 946452 - RNA, 18 nt, Homo sapiens
auuuauuuaacuauucau

SEQ ID NO: 946453 - RNA, 15 nt, Homo sapiens
auuucaagucucuca

SEQ ID NO: 946454 - RNA, 17 nt, Homo sapiens
auuucaauaaccuuuca

SEQ ID NO: 946455 - RNA, 17 nt, Homo sapiens
auuucccaacacaaaga

SEQ ID NO: 946456 - RNA, 22 nt, Homo sapiens
auuuccccucuuacaacuuuca

SEQ ID NO: 946457 - RNA, 19 nt, Homo sapiens
auuuccuuuauuccuuuca

SEQ ID NO: 946458 - RNA, 14 nt, Homo sapiens
auuucuccaaagcc

SEQ ID NO: 946459 - RNA, 21 nt, Homo sapiens
auuugaauuauuucugucaca

SEQ ID NO: 946460 - RNA, 15 nt, Homo sapiens
auuugccauagccuu

SEQ ID NO: 946461 - RNA, 15 nt, Homo sapiens
auuuguagcaauuua

SEQ ID NO: 946462 - RNA, 16 nt, Homo sapiens
auuuguagcaauuuaa

SEQ ID NO: 946463 - RNA, 15 nt, Homo sapiens
auuugugccacuuua

SEQ ID NO: 946464 - RNA, 20 nt, Homo sapiens
auuugugcuagaaauuuuca

SEQ ID NO: 946465 - RNA, 23 nt, Homo sapiens
auuuuauaaagaucagaaugaua

SEQ ID NO: 946466 - RNA, 18 nt, Homo sapiens
auuuuauaggcauaccuc

SEQ ID NO: 946467 - RNA, 21 nt, Homo sapiens
auuuuauuuaugcguaauuua

SEQ ID NO: 946468 - RNA, 20 nt, Homo sapiens
auuuucagucaaaacuuuaa

SEQ ID NO: 946469 - RNA, 21 nt, Homo sapiens
auuuuccuguugucaagaaua

SEQ ID NO: 946470 - RNA, 20 nt, Homo sapiens
auuuuguaauguaucaaaua

SEQ ID NO: 946471 - RNA, 15 nt, Homo sapiens
auuuugucagauuca

SEQ ID NO: 946472 - RNA, 18 nt, Homo sapiens
auuuuguuuucuguggag

SEQ ID NO: 946473 - RNA, 21 nt, Homo sapiens
auuuuuuaauaagaacauuaa

SEQ ID NO: 946474 - RNA, 19 nt, Homo sapiens
caaaacacacuacuaccuc

SEQ ID NO: 946475 - RNA, 14 nt, Homo sapiens
caaaacuacugaca

SEQ ID NO: 946476 - RNA, 17 nt, Homo sapiens
caaaaguuuguuugcuu

SEQ ID NO: 946477 - RNA, 16 nt, Homo sapiens
caaaauaaguaaauaa

SEQ ID NO: 946478 - RNA, 18 nt, Homo sapiens
caaaauauuucagugaau

SEQ ID NO: 946479 - RNA, 17 nt, Homo sapiens
caaaaugagacuuucua

SEQ ID NO: 946480 - RNA, 14 nt, Homo sapiens
caaaauucaucugu

SEQ ID NO: 946481 - RNA, 23 nt, Homo sapiens
caaacaccacuuuacuuguguua

SEQ ID NO: 946482 - RNA, 13 nt, Homo sapiens
caaacaccuucca

SEQ ID NO: 946483 - RNA, 15 nt, Homo sapiens
caaacagugacugua

SEQ ID NO: 946484 - RNA, 15 nt, Homo sapiens
caaaccaggugcaau

SEQ ID NO: 946485 - RNA, 17 nt, Homo sapiens
caaaccaggugcaauua

SEQ ID NO: 946486 - RNA, 23 nt, Homo sapiens
caaacuggggccuccagaacuca

SEQ ID NO: 946487 - RNA, 14 nt, Homo sapiens
caaagaaugggcuu

SEQ ID NO: 946488 - RNA, 16 nt, Homo sapiens
caaagagcacauuuac

SEQ ID NO: 946489 - RNA, 20 nt, Homo sapiens
caaagaggcugccccucuca

SEQ ID NO: 946490 - RNA, 23 nt, Homo sapiens
caaaggcuugccccaaaucucaa

SEQ ID NO: 946491 - RNA, 16 nt, Homo sapiens
caaaguugaaaauuca

SEQ ID NO: 946492 - RNA, 21 nt, Homo sapiens
caaaucauccauccuugccaa

SEQ ID NO: 946493 - RNA, 11 nt, Homo sapiens
caaaugugcug

SEQ ID NO: 946494 - RNA, 15 nt, Homo sapiens
caacaagaccaccac

SEQ ID NO: 946495 - RNA, 20 nt, Homo sapiens
caacaagcccugcuuuugca

SEQ ID NO: 946496 - RNA, 23 nt, Homo sapiens
caacaauccuucuauucuagccu

SEQ ID NO: 946497 - RNA, 20 nt, Homo sapiens
caacacaucucccuuuucca

SEQ ID NO: 946498 - RNA, 23 nt, Homo sapiens
caacagaaaccagaaaagcaaua

SEQ ID NO: 946499 - RNA, 18 nt, Homo sapiens
caacagguaaaacagggc

SEQ ID NO: 946500 - RNA, 11 nt, Homo sapiens
caacagucuug

SEQ ID NO: 946501 - RNA, 17 nt, Homo sapiens
caacauggcccuaccag

SEQ ID NO: 946502 - RNA, 10 nt, Homo sapiens
caacauucau

SEQ ID NO: 946503 - RNA, 12 nt, Homo sapiens
caacucacauua

SEQ ID NO: 946504 - RNA, 16 nt, Homo sapiens
caagagggauaaaaca

SEQ ID NO: 946505 - RNA, 15 nt, Homo sapiens
caagauuugacugua

SEQ ID NO: 946506 - RNA, 13 nt, Homo sapiens
caagcaaugcaag

SEQ ID NO: 946507 - RNA, 18 nt, Homo sapiens
gauagcaaauggccucau

SEQ ID NO: 946508 - RNA, 16 nt, Homo sapiens
gauauuuaguaauauu

SEQ ID NO: 946509 - RNA, 21 nt, Homo sapiens
gauccccggggcggcaggaag

SEQ ID NO: 946510 - RNA, 16 nt, Homo sapiens
gaucucgguuugccaa

SEQ ID NO: 946511 - RNA, 19 nt, Homo sapiens
gaucuuucuuuccaaaaca

SEQ ID NO: 946512 - RNA, 18 nt, Homo sapiens
gaugaaaguacauuggga

SEQ ID NO: 946513 - RNA, 18 nt, Homo sapiens
gaugagcaagacauacuu

SEQ ID NO: 946514 - RNA, 17 nt, Homo sapiens
gaugcacuuauucaaua

SEQ ID NO: 946515 - RNA, 19 nt, Homo sapiens
gaugccucgcucuuuucaa

SEQ ID NO: 946516 - RNA, 12 nt, Homo sapiens
gaugucauuuga

SEQ ID NO: 946517 - RNA, 20 nt, Homo sapiens
gaugucucugcaaaccaaca

SEQ ID NO: 946518 - RNA, 14 nt, Homo sapiens
gauguuuccagacu

SEQ ID NO: 946519 - RNA, 22 nt, Homo sapiens
gauguuucgaguaaacuugaaa

SEQ ID NO: 946520 - RNA, 18 nt, Homo sapiens
caauauuugguauuucaa

SEQ ID NO: 946521 - RNA, 12 nt, Homo sapiens
caauccaugaga

SEQ ID NO: 946522 - RNA, 15 nt, Homo sapiens
caaucggcugcauug

SEQ ID NO: 946523 - RNA, 16 nt, Homo sapiens
caaucucucucugugu

SEQ ID NO: 946524 - RNA, 20 nt, Homo sapiens
caaugaaguugaaaaucaua

SEQ ID NO: 946525 - RNA, 14 nt, Homo sapiens
caauguaagcauac

SEQ ID NO: 946526 - RNA, 13 nt, Homo sapiens
caauuaaucauuu

SEQ ID NO: 946527 - RNA, 23 nt, Homo sapiens
caauuaauuccuguuugucuaca

SEQ ID NO: 946528 - RNA, 16 nt, Homo sapiens
caauugggagcugcca

SEQ ID NO: 946529 - RNA, 22 nt, Homo sapiens
caauuugagauucuacaguaag

SEQ ID NO: 946530 - RNA, 13 nt, Homo sapiens
cacacacagugau

SEQ ID NO: 946531 - RNA, 15 nt, Homo sapiens
cacaccugggcauuu

SEQ ID NO: 946532 - RNA, 16 nt, Homo sapiens
cacacgauaaagggau

SEQ ID NO: 946533 - RNA, 19 nt, Homo sapiens
cacagaaggaauaagguca

SEQ ID NO: 946534 - RNA, 15 nt, Homo sapiens
cacagcaacaaugac

SEQ ID NO: 946535 - RNA, 12 nt, Homo sapiens
cacagggccuug

SEQ ID NO: 946536 - RNA, 13 nt, Homo sapiens
cacauacaaauca

SEQ ID NO: 946537 - RNA, 19 nt, Homo sapiens
cacauacaugucacauuua

SEQ ID NO: 946538 - RNA, 19 nt, Homo sapiens
caccaacugaaguggcuaa

SEQ ID NO: 946539 - RNA, 17 nt, Homo sapiens
caccaagcuaggugcua

SEQ ID NO: 946540 - RNA, 23 nt, Homo sapiens
caccacuuccgucccauccuugc

SEQ ID NO: 946541 - RNA, 21 nt, Homo sapiens
caccccaagagaacucgcgcu

SEQ ID NO: 946542 - RNA, 20 nt, Homo sapiens
caccuagaaaggaacugcaa

SEQ ID NO: 946543 - RNA, 22 nt, Homo sapiens
caccuagaaaggaacugcaaua

SEQ ID NO: 946544 - RNA, 23 nt, Homo sapiens
caccucccccuuucacacuggau

SEQ ID NO: 946545 - RNA, 16 nt, Homo sapiens
caccuccucauguaca

SEQ ID NO: 946546 - RNA, 14 nt, Homo sapiens
caccuguaauccca

SEQ ID NO: 946547 - RNA, 16 nt, Homo sapiens
caccuuggaauucgcu

SEQ ID NO: 946548 - RNA, 17 nt, Homo sapiens
cacggcguuuuuuuaca

SEQ ID NO: 946549 - RNA, 18 nt, Homo sapiens
cacuaauugguacuuuua

SEQ ID NO: 946550 - RNA, 22 nt, Homo sapiens
cacuacaguauuacucuuacaa

SEQ ID NO: 946551 - RNA, 21 nt, Homo sapiens
cacuacucaauacuaccucug

SEQ ID NO: 946552 - RNA, 15 nt, Homo sapiens
cacuaugagcuuuca

SEQ ID NO: 946553 - RNA, 22 nt, Homo sapiens
cacucaaaacgcuacugaguca

SEQ ID NO: 946554 - RNA, 16 nt, Homo sapiens
cacucaugaagcauac

SEQ ID NO: 946555 - RNA, 17 nt, Homo sapiens
cacucauuucaucucau

SEQ ID NO: 946556 - RNA, 14 nt, Homo sapiens
cacucuuguaauaa

SEQ ID NO: 946557 - RNA, 15 nt, Homo sapiens
cacugacaguuaaua

SEQ ID NO: 946558 - RNA, 18 nt, Homo sapiens
cacuggggcagacaauaa

SEQ ID NO: 946559 - RNA, 12 nt, Homo sapiens
cacugguucugc

SEQ ID NO: 946560 - RNA, 13 nt, Homo sapiens
cacuucaaauuca

SEQ ID NO: 946561 - RNA, 14 nt, Homo sapiens
cacuucaaauucaa

SEQ ID NO: 946562 - RNA, 22 nt, Homo sapiens
cacuugccugugcuacaauuca

SEQ ID NO: 946563 - RNA, 20 nt, Homo sapiens
cacuuugaaggggccucacc

SEQ ID NO: 946564 - RNA, 17 nt, Homo sapiens
cagaaaagcaauacugu

SEQ ID NO: 946565 - RNA, 20 nt, Homo sapiens
cagaacguggugaccuuuca

SEQ ID NO: 946566 - RNA, 13 nt, Homo sapiens
cagaacuccauac

SEQ ID NO: 946567 - RNA, 15 nt, Homo sapiens
cagaacuccauacca

SEQ ID NO: 946568 - RNA, 18 nt, Homo sapiens
cagaaugcugcaggacuu

SEQ ID NO: 946569 - RNA, 16 nt, Homo sapiens
cagaaugugucucagg

SEQ ID NO: 946570 - RNA, 14 nt, Homo sapiens
cagacaauaaaccc

SEQ ID NO: 946571 - RNA, 15 nt, Homo sapiens
cagacucgggaccaa

SEQ ID NO: 946572 - RNA, 16 nt, Homo sapiens
cagacucucacaugca

SEQ ID NO: 946573 - RNA, 14 nt, Homo sapiens
cagagaaaggauug

SEQ ID NO: 946574 - RNA, 15 nt, Homo sapiens
cagagagaggcauuu

SEQ ID NO: 946575 - RNA, 19 nt, Homo sapiens
cagagguccugccauggaa

SEQ ID NO: 946576 - RNA, 17 nt, Homo sapiens
cagaguuggagacucag

SEQ ID NO: 946577 - RNA, 21 nt, Homo sapiens
cagaucccccuucucuccugc

SEQ ID NO: 946578 - RNA, 22 nt, Homo sapiens
cagcaaaaaucucccagugaca

SEQ ID NO: 946579 - RNA, 20 nt, Homo sapiens
cagcaccccccauuuuuuca

SEQ ID NO: 946580 - RNA, 11 nt, Homo sapiens
cagcacccucc

SEQ ID NO: 946581 - RNA, 22 nt, Homo sapiens
cagcacugggaaccuagcuaca

SEQ ID NO: 946582 - RNA, 23 nt, Homo sapiens
cagcacuuugggaggucaagaug

SEQ ID NO: 946583 - RNA, 21 nt, Homo sapiens
cagcaggaaggaacaaagaca

SEQ ID NO: 946584 - RNA, 16 nt, Homo sapiens
cagcaguuuccugcca

SEQ ID NO: 946585 - RNA, 17 nt, Homo sapiens
cagccacuggcugcuaa

SEQ ID NO: 946586 - RNA, 15 nt, Homo sapiens
cagcccgcuuggcca

SEQ ID NO: 946587 - RNA, 15 nt, Homo sapiens
cagccguauuuuaca

SEQ ID NO: 946588 - RNA, 21 nt, Homo sapiens
cagccuggccaacauggugaa

SEQ ID NO: 946589 - RNA, 19 nt, Homo sapiens
cagccugggcaacagagca

SEQ ID NO: 946590 - RNA, 13 nt, Homo sapiens
cagcucauaaaau

SEQ ID NO: 946591 - RNA, 18 nt, Homo sapiens
cagcucuguaucugccau

SEQ ID NO: 946592 - RNA, 18 nt, Homo sapiens
cagcugggcucugcaauu

SEQ ID NO: 946593 - RNA, 22 nt, Homo sapiens
caggaaaacagcuaguagacau

SEQ ID NO: 946594 - RNA, 21 nt, Homo sapiens
caggaagggacugccaaaguu

SEQ ID NO: 946595 - RNA, 22 nt, Homo sapiens
caggacacuggucgagagccaa

SEQ ID NO: 946596 - RNA, 20 nt, Homo sapiens
caggacgccuggagaagggu

SEQ ID NO: 946597 - RNA, 17 nt, Homo sapiens
caggagccucacugggg

SEQ ID NO: 946598 - RNA, 14 nt, Homo sapiens
caggagcugcuaaa

SEQ ID NO: 946599 - RNA, 19 nt, Homo sapiens
cagggacacuaucacucau

SEQ ID NO: 946600 - RNA, 13 nt, Homo sapiens
cagggcauugcuc

SEQ ID NO: 946601 - RNA, 14 nt, Homo sapiens
cagggggaaggugg

SEQ ID NO: 946602 - RNA, 16 nt, Homo sapiens
cagguaaaacagggcc

SEQ ID NO: 946603 - RNA, 16 nt, Homo sapiens
cagguaauacaaacua

SEQ ID NO: 946604 - RNA, 14 nt, Homo sapiens
caggugcauagcaa

SEQ ID NO: 946605 - RNA, 19 nt, Homo sapiens
caguaagaacaucauaaaa

SEQ ID NO: 946606 - RNA, 22 nt, Homo sapiens
caguaaggucaugugcuuccac

SEQ ID NO: 946607 - RNA, 15 nt, Homo sapiens
caguagagcucuacu

SEQ ID NO: 946608 - RNA, 18 nt, Homo sapiens
caguagcaaacuuuucac

SEQ ID NO: 946609 - RNA, 17 nt, Homo sapiens
caguauaaucuuuucau

SEQ ID NO: 946610 - RNA, 16 nt, Homo sapiens
cagucacguguaaaca

SEQ ID NO: 946611 - RNA, 18 nt, Homo sapiens
cagucuggcgucuccaga

SEQ ID NO: 946612 - RNA, 13 nt, Homo sapiens
cagugaacacuca

SEQ ID NO: 946613 - RNA, 23 nt, Homo sapiens
cagugagcacugguuaguacugg

SEQ ID NO: 946614 - RNA, 20 nt, Homo sapiens
cagugagccgagaucaugcc

SEQ ID NO: 946615 - RNA, 18 nt, Homo sapiens
gccuguggcuggcuggaa

SEQ ID NO: 946616 - RNA, 16 nt, Homo sapiens
gcgagagaaagggagu

SEQ ID NO: 946617 - RNA, 15 nt, Homo sapiens
gcgggcgcgugagug

SEQ ID NO: 946618 - RNA, 14 nt, Homo sapiens
gcggggugcagaag

SEQ ID NO: 946619 - RNA, 12 nt, Homo sapiens
gcguccugguca

SEQ ID NO: 946620 - RNA, 15 nt, Homo sapiens
gcgucuccagacucu

SEQ ID NO: 946621 - RNA, 21 nt, Homo sapiens
gcuaaagagcuuugugauaua

SEQ ID NO: 946622 - RNA, 16 nt, Homo sapiens
gcuaaaggaagugaau

SEQ ID NO: 946623 - RNA, 18 nt, Homo sapiens
gcuaaaggaagugaaucu

SEQ ID NO: 946624 - RNA, 15 nt, Homo sapiens
gcuaauagugaucaa

SEQ ID NO: 946625 - RNA, 13 nt, Homo sapiens
gcuacaaaaccua

SEQ ID NO: 946626 - RNA, 15 nt, Homo sapiens
gcuaccaacuuguau

SEQ ID NO: 946627 - RNA, 15 nt, Homo sapiens
gcuaggaacuuggga

SEQ ID NO: 946628 - RNA, 17 nt, Homo sapiens
gcuauaaguuuuagaau

SEQ ID NO: 946629 - RNA, 21 nt, Homo sapiens
cauaagguuuuauucauauau

SEQ ID NO: 946630 - RNA, 13 nt, Homo sapiens
cauacaacagaaa

SEQ ID NO: 946631 - RNA, 16 nt, Homo sapiens
cauacaacagaaacca

SEQ ID NO: 946632 - RNA, 19 nt, Homo sapiens
cauacccccacaugccaau

SEQ ID NO: 946633 - RNA, 17 nt, Homo sapiens
cauagcaccuaacaaca

SEQ ID NO: 946634 - RNA, 16 nt, Homo sapiens
cauauaccaucuccag

SEQ ID NO: 946635 - RNA, 19 nt, Homo sapiens
cauauccaggcaccaggac

SEQ ID NO: 946636 - RNA, 14 nt, Homo sapiens
cauauguaaucucu

SEQ ID NO: 946637 - RNA, 19 nt, Homo sapiens
cauauguguaaagauuuau

SEQ ID NO: 946638 - RNA, 16 nt, Homo sapiens
cauauucauauuucaa

SEQ ID NO: 946639 - RNA, 10 nt, Homo sapiens
cauauuucaa

SEQ ID NO: 946640 - RNA, 21 nt, Homo sapiens
caucaaaauauuucagugaau

SEQ ID NO: 946641 - RNA, 11 nt, Homo sapiens
caucacacaag

SEQ ID NO: 946642 - RNA, 14 nt, Homo sapiens
caucaguaguucac

SEQ ID NO: 946643 - RNA, 19 nt, Homo sapiens
caucaguuuuguuuacuca

SEQ ID NO: 946644 - RNA, 20 nt, Homo sapiens
caucgcaauaguuuuuuacu

SEQ ID NO: 946645 - RNA, 17 nt, Homo sapiens
caucugcaacaaaaagu

SEQ ID NO: 946646 - RNA, 15 nt, Homo sapiens
caucuggaaucugga

SEQ ID NO: 946647 - RNA, 15 nt, Homo sapiens
caucuggacacuggg

SEQ ID NO: 946648 - RNA, 22 nt, Homo sapiens
caugaacaucuuuagugucuga

SEQ ID NO: 946649 - RNA, 17 nt, Homo sapiens
caugccacuaugagcuu

SEQ ID NO: 946650 - RNA, 12 nt, Homo sapiens
caugcccugugu

SEQ ID NO: 946651 - RNA, 14 nt, Homo sapiens
caugcugugcugug

SEQ ID NO: 946652 - RNA, 23 nt, Homo sapiens
caugcuugcauaagagcuuaaga

SEQ ID NO: 946653 - RNA, 14 nt, Homo sapiens
caugguuugacuca

SEQ ID NO: 946654 - RNA, 13 nt, Homo sapiens
cauguaauggacu

SEQ ID NO: 946655 - RNA, 15 nt, Homo sapiens
caugucggucccuga

SEQ ID NO: 946656 - RNA, 15 nt, Homo sapiens
caugugcaaaugugc

SEQ ID NO: 946657 - RNA, 13 nt, Homo sapiens
caugugcuuccac

SEQ ID NO: 946658 - RNA, 21 nt, Homo sapiens
cauuaaaggaaacguggcagg

SEQ ID NO: 946659 - RNA, 20 nt, Homo sapiens
cauucagugauuacugucaa

SEQ ID NO: 946660 - RNA, 16 nt, Homo sapiens
cauucauauuucauau

SEQ ID NO: 946661 - RNA, 14 nt, Homo sapiens
cauucugaaucaga

SEQ ID NO: 946662 - RNA, 18 nt, Homo sapiens
cauugauuugcucuuacu

SEQ ID NO: 946663 - RNA, 14 nt, Homo sapiens
cauugcacuuugau

SEQ ID NO: 946664 - RNA, 16 nt, Homo sapiens
cauugggagucuguag

SEQ ID NO: 946665 - RNA, 15 nt, Homo sapiens
cauuguacuuauaca

SEQ ID NO: 946666 - RNA, 16 nt, Homo sapiens
cauuuaaaauucaauu

SEQ ID NO: 946667 - RNA, 13 nt, Homo sapiens
cauuucaaugugu

SEQ ID NO: 946668 - RNA, 18 nt, Homo sapiens
cauuucauacaacagaaa

SEQ ID NO: 946669 - RNA, 21 nt, Homo sapiens
cauuucaucucauuuaaggga

SEQ ID NO: 946670 - RNA, 22 nt, Homo sapiens
cauuucucaucaguaguucaca

SEQ ID NO: 946671 - RNA, 20 nt, Homo sapiens
cauuucuggacaguaccuga

SEQ ID NO: 946672 - RNA, 19 nt, Homo sapiens
cauuugacccuugcuguga

SEQ ID NO: 946673 - RNA, 12 nt, Homo sapiens
cauuuguagcaa

SEQ ID NO: 946674 - RNA, 20 nt, Homo sapiens
cauuuuugucagagugcaca

SEQ ID NO: 946675 - RNA, 18 nt, Homo sapiens
ccaaaacaagccaaagag

SEQ ID NO: 946676 - RNA, 14 nt, Homo sapiens
ccaaagacaucagu

SEQ ID NO: 946677 - RNA, 13 nt, Homo sapiens
ccaaagcaucaau

SEQ ID NO: 946678 - RNA, 18 nt, Homo sapiens
ccaaaucucaacuucuca

SEQ ID NO: 946679 - RNA, 21 nt, Homo sapiens
ccaaccuucuugucauugaaa

SEQ ID NO: 946680 - RNA, 15 nt, Homo sapiens
ccaacggcaacagca

SEQ ID NO: 946681 - RNA, 22 nt, Homo sapiens
ccaacguucgauuucuaccuca

SEQ ID NO: 946682 - RNA, 15 nt, Homo sapiens
ccaagagugaaggga

SEQ ID NO: 946683 - RNA, 20 nt, Homo sapiens
ccaaguaugacaaccucuuu

SEQ ID NO: 946684 - RNA, 17 nt, Homo sapiens
ccaagucuguaccucaa

SEQ ID NO: 946685 - RNA, 23 nt, Homo sapiens
ccaaucccuuuauuacccccucc

SEQ ID NO: 946686 - RNA, 20 nt, Homo sapiens
ccaaugcugcuccacccucc

SEQ ID NO: 946687 - RNA, 12 nt, Homo sapiens
ccacaaacugau

SEQ ID NO: 946688 - RNA, 16 nt, Homo sapiens
ccacccccagcucaau

SEQ ID NO: 946689 - RNA, 20 nt, Homo sapiens
ccaccuaauccuucuggcaa

SEQ ID NO: 946690 - RNA, 11 nt, Homo sapiens
ccacuucucac

SEQ ID NO: 946691 - RNA, 18 nt, Homo sapiens
ccacuugccugugcuaca

SEQ ID NO: 946692 - RNA, 20 nt, Homo sapiens
ccacuugccugugcuacaau

SEQ ID NO: 946693 - RNA, 24 nt, Homo sapiens
ccacuugccugugcuacaauucau

SEQ ID NO: 946694 - RNA, 20 nt, Homo sapiens
ccagaaguucgagacuagcc

SEQ ID NO: 946695 - RNA, 18 nt, Homo sapiens
ccagauguuuccagacuu

SEQ ID NO: 946696 - RNA, 16 nt, Homo sapiens
ccagcccuguccccua

SEQ ID NO: 946697 - RNA, 19 nt, Homo sapiens
ccagccuggccaacauggc

SEQ ID NO: 946698 - RNA, 21 nt, Homo sapiens
ccagcuacccaggaggcugaa

SEQ ID NO: 946699 - RNA, 18 nt, Homo sapiens
ccagcucuucucaagcag

SEQ ID NO: 946700 - RNA, 13 nt, Homo sapiens
ccaggagccucac

SEQ ID NO: 946701 - RNA, 18 nt, Homo sapiens
ccaggagcuacucaggaa

SEQ ID NO: 946702 - RNA, 16 nt, Homo sapiens
ccaggauuacuaguca

SEQ ID NO: 946703 - RNA, 13 nt, Homo sapiens
ccaggugcaauua

SEQ ID NO: 946704 - RNA, 20 nt, Homo sapiens
ccaguaaaaucaaaugugca

SEQ ID NO: 946705 - RNA, 14 nt, Homo sapiens
ccaguauaccucau

SEQ ID NO: 946706 - RNA, 14 nt, Homo sapiens
ccaguccuguccua

SEQ ID NO: 946707 - RNA, 21 nt, Homo sapiens
ccaguuccucccccaguuccu

SEQ ID NO: 946708 - RNA, 18 nt, Homo sapiens
ccauacccccacaugcca

SEQ ID NO: 946709 - RNA, 23 nt, Homo sapiens
ccauauaccaucuccagcuauuu

SEQ ID NO: 946710 - RNA, 19 nt, Homo sapiens
ccaucaugaagaagcucuu

SEQ ID NO: 946711 - RNA, 22 nt, Homo sapiens
ccaucccuuuuuuuacauuuca

SEQ ID NO: 946712 - RNA, 22 nt, Homo sapiens
ccauccuugccaauagugucau

SEQ ID NO: 946713 - RNA, 14 nt, Homo sapiens
ccauguccaaagag

SEQ ID NO: 946714 - RNA, 20 nt, Homo sapiens
ccauugauuuaauguaauag

SEQ ID NO: 946715 - RNA, 18 nt, Homo sapiens
cccaaacuggagugcagu

SEQ ID NO: 946716 - RNA, 17 nt, Homo sapiens
cccaacuccucaugucu

SEQ ID NO: 946717 - RNA, 19 nt, Homo sapiens
cccaaugacacccaugcca

SEQ ID NO: 946718 - RNA, 15 nt, Homo sapiens
cccaaugcugcucca

SEQ ID NO: 946719 - RNA, 19 nt, Homo sapiens
cccacaugccaauuucagc

SEQ ID NO: 946720 - RNA, 13 nt, Homo sapiens
cccaccccaucca

SEQ ID NO: 946721 - RNA, 14 nt, Homo sapiens
cccacucauuccuu

SEQ ID NO: 946722 - RNA, 13 nt, Homo sapiens
cccagaacuccau

SEQ ID NO: 946723 - RNA, 15 nt, Homo sapiens
ggcucagccuaguga

SEQ ID NO: 946724 - RNA, 20 nt, Homo sapiens
ggcucagucgcuagcauuuc

SEQ ID NO: 946725 - RNA, 17 nt, Homo sapiens
ggcugccccucucacca

SEQ ID NO: 946726 - RNA, 20 nt, Homo sapiens
ggcuggagugcaguggcgca

SEQ ID NO: 946727 - RNA, 13 nt, Homo sapiens
ggcugggccaugu

SEQ ID NO: 946728 - RNA, 17 nt, Homo sapiens
ggcuguuguugaugcau

SEQ ID NO: 946729 - RNA, 18 nt, Homo sapiens
gggaaaagaagcacccag

SEQ ID NO: 946730 - RNA, 14 nt, Homo sapiens
gggaaacugggaaa

SEQ ID NO: 946731 - RNA, 15 nt, Homo sapiens
gggaauucccucccc

SEQ ID NO: 946732 - RNA, 19 nt, Homo sapiens
gggaccucaccccugagca

SEQ ID NO: 946733 - RNA, 23 nt, Homo sapiens
gggacugcagguugugcccugug

SEQ ID NO: 946734 - RNA, 20 nt, Homo sapiens
gggaggcggagguugcaaug

SEQ ID NO: 946735 - RNA, 20 nt, Homo sapiens
gggaggcggagguugcagug

SEQ ID NO: 946736 - RNA, 13 nt, Homo sapiens
gggaucuucccac

SEQ ID NO: 946737 - RNA, 20 nt, Homo sapiens
gggcaacauggcccuaccag

SEQ ID NO: 946738 - RNA, 19 nt, Homo sapiens
ccccuacccccaguaaaau

SEQ ID NO: 946739 - RNA, 15 nt, Homo sapiens
ccccucacucuguca

SEQ ID NO: 946740 - RNA, 19 nt, Homo sapiens
ccccucggccccagcacau

SEQ ID NO: 946741 - RNA, 13 nt, Homo sapiens
ccccucucaccaa

SEQ ID NO: 946742 - RNA, 17 nt, Homo sapiens
ccccucugucuugugaa

SEQ ID NO: 946743 - RNA, 14 nt, Homo sapiens
ccccuuguccuuuc

SEQ ID NO: 946744 - RNA, 19 nt, Homo sapiens
cccggagguugggugggcc

SEQ ID NO: 946745 - RNA, 15 nt, Homo sapiens
cccgucgugcuuccu

SEQ ID NO: 946746 - RNA, 18 nt, Homo sapiens
cccguggagguucuguau

SEQ ID NO: 946747 - RNA, 23 nt, Homo sapiens
cccuaaagaaugcaaccuaguca

SEQ ID NO: 946748 - RNA, 21 nt, Homo sapiens
cccuaaggugagugugcagua

SEQ ID NO: 946749 - RNA, 19 nt, Homo sapiens
cccuacccccaguaaaauc

SEQ ID NO: 946750 - RNA, 20 nt, Homo sapiens
cccuacccccaguaaaauca

SEQ ID NO: 946751 - RNA, 15 nt, Homo sapiens
cccuagaucaacaga

SEQ ID NO: 946752 - RNA, 19 nt, Homo sapiens
cccucaaagaagucggaau

SEQ ID NO: 946753 - RNA, 21 nt, Homo sapiens
cccucacuaauugguacuuuu

SEQ ID NO: 946754 - RNA, 16 nt, Homo sapiens
cccucgacauuuucuc

SEQ ID NO: 946755 - RNA, 22 nt, Homo sapiens
cccugagcaggucaggacucag

SEQ ID NO: 946756 - RNA, 13 nt, Homo sapiens
cccugcaaaaaga

SEQ ID NO: 946757 - RNA, 17 nt, Homo sapiens
cccugcaauguggugac

SEQ ID NO: 946758 - RNA, 15 nt, Homo sapiens
cccugcccaccaaga

SEQ ID NO: 946759 - RNA, 23 nt, Homo sapiens
cccugguuuguuuuccccaguug

SEQ ID NO: 946760 - RNA, 18 nt, Homo sapiens
cccuucccccugcaaaaa

SEQ ID NO: 946761 - RNA, 13 nt, Homo sapiens
ccgagugcacugc

SEQ ID NO: 946762 - RNA, 15 nt, Homo sapiens
ccguuuccaagcugc

SEQ ID NO: 946763 - RNA, 20 nt, Homo sapiens
ccuaaaacaccugguaggag

SEQ ID NO: 946764 - RNA, 20 nt, Homo sapiens
ccuaaagaggaaaagugcaa

SEQ ID NO: 946765 - RNA, 20 nt, Homo sapiens
ccuaaagccucaaaacaaag

SEQ ID NO: 946766 - RNA, 20 nt, Homo sapiens
ccuaaggugagugugcagua

SEQ ID NO: 946767 - RNA, 15 nt, Homo sapiens
ccuacagacuaagaa

SEQ ID NO: 946768 - RNA, 21 nt, Homo sapiens
ccuacagggacacuaucacuc

SEQ ID NO: 946769 - RNA, 17 nt, Homo sapiens
ccuagaaguucuuugau

SEQ ID NO: 946770 - RNA, 21 nt, Homo sapiens
ccuagugaacugcaaccucaa

SEQ ID NO: 946771 - RNA, 20 nt, Homo sapiens
ccuaugggucuaggacacag

SEQ ID NO: 946772 - RNA, 16 nt, Homo sapiens
ccuaugucaccuugau

SEQ ID NO: 946773 - RNA, 18 nt, Homo sapiens
ccuaugucaccuugauga

SEQ ID NO: 946774 - RNA, 21 nt, Homo sapiens
ccuauuaucagaaggugacaa

SEQ ID NO: 946775 - RNA, 14 nt, Homo sapiens
ccucacaagcauga

SEQ ID NO: 946776 - RNA, 16 nt, Homo sapiens
ccucacaaucccacag

SEQ ID NO: 946777 - RNA, 22 nt, Homo sapiens
ccucacucuguuuccuggucag

SEQ ID NO: 946778 - RNA, 20 nt, Homo sapiens
ccucagagcauuuaaggaaa

SEQ ID NO: 946779 - RNA, 11 nt, Homo sapiens
ccucagaugau

SEQ ID NO: 946780 - RNA, 22 nt, Homo sapiens
ccucauucuacuaaugugaugc

SEQ ID NO: 946781 - RNA, 13 nt, Homo sapiens
ccucccaccagag

SEQ ID NO: 946782 - RNA, 14 nt, Homo sapiens
ccucccaccagagc

SEQ ID NO: 946783 - RNA, 20 nt, Homo sapiens
ccucccccuuucacacugga

SEQ ID NO: 946784 - RNA, 14 nt, Homo sapiens
ccuccucuagcugu

SEQ ID NO: 946785 - RNA, 17 nt, Homo sapiens
ccucucggugaccuccg

SEQ ID NO: 946786 - RNA, 11 nt, Homo sapiens
ccucugcauuu

SEQ ID NO: 946787 - RNA, 20 nt, Homo sapiens
ccucugccagcgccaaaaca

SEQ ID NO: 946788 - RNA, 18 nt, Homo sapiens
ccucugcuaagguguauu

SEQ ID NO: 946789 - RNA, 18 nt, Homo sapiens
ccucugguaggaggcaaa

SEQ ID NO: 946790 - RNA, 19 nt, Homo sapiens
ccucuuacaacuuucaaac

SEQ ID NO: 946791 - RNA, 17 nt, Homo sapiens
ccugacacggacugugc

SEQ ID NO: 946792 - RNA, 23 nt, Homo sapiens
ccugagagauuuaacauuaucua

SEQ ID NO: 946793 - RNA, 19 nt, Homo sapiens
ccugagcacccagaacucc

SEQ ID NO: 946794 - RNA, 15 nt, Homo sapiens
ccugcccaccaagaa

SEQ ID NO: 946795 - RNA, 20 nt, Homo sapiens
ccuggggguggcaggcacac

SEQ ID NO: 946796 - RNA, 22 nt, Homo sapiens
ccugggguggggaucaccaggg

SEQ ID NO: 946797 - RNA, 19 nt, Homo sapiens
ccugggugcaggacacugg

SEQ ID NO: 946798 - RNA, 17 nt, Homo sapiens
ccuguagcagucacuga

SEQ ID NO: 946799 - RNA, 21 nt, Homo sapiens
ccuguccccuacccccaguaa

SEQ ID NO: 946800 - RNA, 19 nt, Homo sapiens
ccugugcccuagaugcacg

SEQ ID NO: 946801 - RNA, 18 nt, Homo sapiens
ccuguguccccaaggagu

SEQ ID NO: 946802 - RNA, 21 nt, Homo sapiens
ccugugucggggcugaccucu

SEQ ID NO: 946803 - RNA, 22 nt, Homo sapiens
ccugugucggggcugaccucuc

SEQ ID NO: 946804 - RNA, 23 nt, Homo sapiens
ccugugucggggcugaccucuca

SEQ ID NO: 946805 - RNA, 19 nt, Homo sapiens
ccuguugaaugacaaagua

SEQ ID NO: 946806 - RNA, 15 nt, Homo sapiens
ccuguugucaagaau

SEQ ID NO: 946807 - RNA, 17 nt, Homo sapiens
ccuuccagcuccuguaa

SEQ ID NO: 946808 - RNA, 17 nt, Homo sapiens
ccuucuggcaagccugu

SEQ ID NO: 946809 - RNA, 18 nt, Homo sapiens
ccuugccaauagugucau

SEQ ID NO: 946810 - RNA, 17 nt, Homo sapiens
ccuugguaucauuuucu

SEQ ID NO: 946811 - RNA, 16 nt, Homo sapiens
ccuuuauuccuuucag

SEQ ID NO: 946812 - RNA, 21 nt, Homo sapiens
ccuuuauugauaucuccauga

SEQ ID NO: 946813 - RNA, 15 nt, Homo sapiens
ccuuucacacuggau

SEQ ID NO: 946814 - RNA, 15 nt, Homo sapiens
ccuuucacucugcau

SEQ ID NO: 946815 - RNA, 20 nt, Homo sapiens
ccuuucagcaauccaugaga

SEQ ID NO: 946816 - RNA, 18 nt, Homo sapiens
ccuuuuggcauguuccca

SEQ ID NO: 946817 - RNA, 21 nt, Homo sapiens
cgagaucacgucacugcacuc

SEQ ID NO: 946818 - RNA, 13 nt, Homo sapiens
cgagggccaggca

SEQ ID NO: 946819 - RNA, 19 nt, Homo sapiens
cgaguaacuccccucaggg

SEQ ID NO: 946820 - RNA, 12 nt, Homo sapiens
cgauaaagggau

SEQ ID NO: 946821 - RNA, 14 nt, Homo sapiens
cgauaaagggauuu

SEQ ID NO: 946822 - RNA, 15 nt, Homo sapiens
cgauuucuaccucag

SEQ ID NO: 946823 - RNA, 21 nt, Homo sapiens
cgcuaaauauuuaccuugaaa

SEQ ID NO: 946824 - RNA, 17 nt, Homo sapiens
cgcugccacucaugucg

SEQ ID NO: 946825 - RNA, 14 nt, Homo sapiens
cgcugggugguacc

SEQ ID NO: 946826 - RNA, 13 nt, Homo sapiens
cggaauguaacuu

SEQ ID NO: 946827 - RNA, 21 nt, Homo sapiens
cggaaugucauagucuugaaa

SEQ ID NO: 946828 - RNA, 14 nt, Homo sapiens
cggaggccagagag

SEQ ID NO: 946829 - RNA, 16 nt, Homo sapiens
cggagguugcagugag

SEQ ID NO: 946830 - RNA, 19 nt, Homo sapiens
gugcguuaaauaagcaaau

SEQ ID NO: 946831 - RNA, 16 nt, Homo sapiens
gugcugggcauuuuua

SEQ ID NO: 946832 - RNA, 18 nt, Homo sapiens
gugcugugggcagcaccc

SEQ ID NO: 946833 - RNA, 18 nt, Homo sapiens
guggaccgcccuuuuccc

SEQ ID NO: 946834 - RNA, 13 nt, Homo sapiens
guggaggcacuuu

SEQ ID NO: 946835 - RNA, 13 nt, Homo sapiens
guggagguucugu

SEQ ID NO: 946836 - RNA, 22 nt, Homo sapiens
guggcucaugccuguaauccca

SEQ ID NO: 946837 - RNA, 21 nt, Homo sapiens
guggcucaugccuuaauccca

SEQ ID NO: 946838 - RNA, 20 nt, Homo sapiens
guggcugccugcaccccagg

SEQ ID NO: 946839 - RNA, 13 nt, Homo sapiens
gugucucaggaaa

SEQ ID NO: 946840 - RNA, 16 nt, Homo sapiens
guguguaacacugugu

SEQ ID NO: 946841 - RNA, 17 nt, Homo sapiens
guuaacacucaugaagc

SEQ ID NO: 946842 - RNA, 21 nt, Homo sapiens
guuaauugggcaggugaaaag

SEQ ID NO: 946843 - RNA, 16 nt, Homo sapiens
guuaccucugcaugga

SEQ ID NO: 946844 - RNA, 16 nt, Homo sapiens
guuagaacuagccaaa

SEQ ID NO: 946845 - RNA, 15 nt, Homo sapiens
guucacaacagugaa

SEQ ID NO: 946846 - RNA, 23 nt, Homo sapiens
cuaaaugcuguucuuacacauaa

SEQ ID NO: 946847 - RNA, 15 nt, Homo sapiens
cuaacaacauuguag

SEQ ID NO: 946848 - RNA, 20 nt, Homo sapiens
cuaacaagucaccaaaagac

SEQ ID NO: 946849 - RNA, 21 nt, Homo sapiens
cuaacaagucaccaaaagaca

SEQ ID NO: 946850 - RNA, 15 nt, Homo sapiens
cuaacaguggacaaa

SEQ ID NO: 946851 - RNA, 12 nt, Homo sapiens
cuaaccaagaga

SEQ ID NO: 946852 - RNA, 23 nt, Homo sapiens
cuaacccccacccccacugccag

SEQ ID NO: 946853 - RNA, 18 nt, Homo sapiens
cuaagaauucaaacuggg

SEQ ID NO: 946854 - RNA, 22 nt, Homo sapiens
cuaagguuuagauaaauauuga

SEQ ID NO: 946855 - RNA, 18 nt, Homo sapiens
cuaaguauauuaauauca

SEQ ID NO: 946856 - RNA, 16 nt, Homo sapiens
cuaauagucuuugcca

SEQ ID NO: 946857 - RNA, 16 nt, Homo sapiens
cuacacguaaguauaa

SEQ ID NO: 946858 - RNA, 19 nt, Homo sapiens
cuacacugagcagggagac

SEQ ID NO: 946859 - RNA, 12 nt, Homo sapiens
cuacaguuauua

SEQ ID NO: 946860 - RNA, 17 nt, Homo sapiens
cuaccuauaacacucua

SEQ ID NO: 946861 - RNA, 16 nt, Homo sapiens
cuaccugagcuaaaua

SEQ ID NO: 946862 - RNA, 20 nt, Homo sapiens
cuaccuuagaaaacaaguau

SEQ ID NO: 946863 - RNA, 19 nt, Homo sapiens
cuacucaauacuaccucug

SEQ ID NO: 946864 - RNA, 18 nt, Homo sapiens
cuacucaggaagguggga

SEQ ID NO: 946865 - RNA, 12 nt, Homo sapiens
cuagacuauaaa

SEQ ID NO: 946866 - RNA, 15 nt, Homo sapiens
cuagaucaacagauc

SEQ ID NO: 946867 - RNA, 13 nt, Homo sapiens
cuagaugcacgug

SEQ ID NO: 946868 - RNA, 17 nt, Homo sapiens
cuagauuuaacucaguu

SEQ ID NO: 946869 - RNA, 20 nt, Homo sapiens
cuagccugggaaacauagga

SEQ ID NO: 946870 - RNA, 16 nt, Homo sapiens
cuaggaugaagcccua

SEQ ID NO: 946871 - RNA, 19 nt, Homo sapiens
cuauaacuaugaccaugcu

SEQ ID NO: 946872 - RNA, 14 nt, Homo sapiens
cuauaaguuuuaga

SEQ ID NO: 946873 - RNA, 16 nt, Homo sapiens
cuauacacaagcaaug

SEQ ID NO: 946874 - RNA, 16 nt, Homo sapiens
cuauaguuauacauca

SEQ ID NO: 946875 - RNA, 18 nt, Homo sapiens
cuauauugcuuaccugau

SEQ ID NO: 946876 - RNA, 21 nt, Homo sapiens
cuaucaucauccuacaacuca

SEQ ID NO: 946877 - RNA, 12 nt, Homo sapiens
cuaucucuacug

SEQ ID NO: 946878 - RNA, 12 nt, Homo sapiens
cuauuggucucc

SEQ ID NO: 946879 - RNA, 19 nt, Homo sapiens
cucaauaaaugauucuuag

SEQ ID NO: 946880 - RNA, 19 nt, Homo sapiens
cucaccuagccugaugaga

SEQ ID NO: 946881 - RNA, 16 nt, Homo sapiens
cucacugcagugcuga

SEQ ID NO: 946882 - RNA, 19 nt, Homo sapiens
cucacugccucucggugac

SEQ ID NO: 946883 - RNA, 17 nt, Homo sapiens
cucacuggggcagacaa

SEQ ID NO: 946884 - RNA, 19 nt, Homo sapiens
cucagaaggccccagagag

SEQ ID NO: 946885 - RNA, 12 nt, Homo sapiens
cucagaccugaa

SEQ ID NO: 946886 - RNA, 18 nt, Homo sapiens
cucagacguuccauaccc

SEQ ID NO: 946887 - RNA, 15 nt, Homo sapiens
cucagccacuugccu

SEQ ID NO: 946888 - RNA, 21 nt, Homo sapiens
cucagccacuugccugugcua

SEQ ID NO: 946889 - RNA, 19 nt, Homo sapiens
cucaggcucagagggaccu

SEQ ID NO: 946890 - RNA, 21 nt, Homo sapiens
cucaguaaacgggaacaugcc

SEQ ID NO: 946891 - RNA, 22 nt, Homo sapiens
cucaguaaacgggaacaugccc

SEQ ID NO: 946892 - RNA, 23 nt, Homo sapiens
cucaguuauuacauguaauuuga

SEQ ID NO: 946893 - RNA, 22 nt, Homo sapiens
cucaguucuugagggccucccc

SEQ ID NO: 946894 - RNA, 15 nt, Homo sapiens
cucaguuucuaggca

SEQ ID NO: 946895 - RNA, 15 nt, Homo sapiens
cucauuucaucucau

SEQ ID NO: 946896 - RNA, 19 nt, Homo sapiens
cuccagaugccacaaugga

SEQ ID NO: 946897 - RNA, 20 nt, Homo sapiens
cuccagauguuuccagacuu

SEQ ID NO: 946898 - RNA, 17 nt, Homo sapiens
cuccagucauugcacaa

SEQ ID NO: 946899 - RNA, 20 nt, Homo sapiens
cucccaaagugcugggauua

SEQ ID NO: 946900 - RNA, 17 nt, Homo sapiens
cucccacaaugcugaau

SEQ ID NO: 946901 - RNA, 16 nt, Homo sapiens
cucccaggaagcccag

SEQ ID NO: 946902 - RNA, 22 nt, Homo sapiens
cuccccgggaccgcgcuagggc

SEQ ID NO: 946903 - RNA, 22 nt, Homo sapiens
cuccugggagacaaagcaauaa

SEQ ID NO: 946904 - RNA, 23 nt, Homo sapiens
cuccuggggcucagccuagugaa

SEQ ID NO: 946905 - RNA, 20 nt, Homo sapiens
cuccuggguucaagugauuc

SEQ ID NO: 946906 - RNA, 20 nt, Homo sapiens
cuccuguucacaccagagaa

SEQ ID NO: 946907 - RNA, 16 nt, Homo sapiens
cuccuuggccacagac

SEQ ID NO: 946908 - RNA, 17 nt, Homo sapiens
cucgcacacacagugau

SEQ ID NO: 946909 - RNA, 17 nt, Homo sapiens
cucgccggaucugaggg

SEQ ID NO: 946910 - RNA, 21 nt, Homo sapiens
cucgggugcauuugagagaag

SEQ ID NO: 946911 - RNA, 11 nt, Homo sapiens
cucgugccaug

SEQ ID NO: 946912 - RNA, 16 nt, Homo sapiens
cucuacugaaugucau

SEQ ID NO: 946913 - RNA, 14 nt, Homo sapiens
cucuacugccucaa

SEQ ID NO: 946914 - RNA, 17 nt, Homo sapiens
cucuccuuggccacaga

SEQ ID NO: 946915 - RNA, 15 nt, Homo sapiens
cucucggacucccua

SEQ ID NO: 946916 - RNA, 18 nt, Homo sapiens
cucugcauggaacagcau

SEQ ID NO: 946917 - RNA, 14 nt, Homo sapiens
cucugccauggccu

SEQ ID NO: 946918 - RNA, 23 nt, Homo sapiens
cucugugagggugcugacuggcu

SEQ ID NO: 946919 - RNA, 19 nt, Homo sapiens
cucuuguaauaaaaugucu

SEQ ID NO: 946920 - RNA, 13 nt, Homo sapiens
cucuuuggggcua

SEQ ID NO: 946921 - RNA, 23 nt, Homo sapiens
cugaaauuuaucuuuucuucuau

SEQ ID NO: 946922 - RNA, 17 nt, Homo sapiens
cugaacccuaaggugag

SEQ ID NO: 946923 - RNA, 15 nt, Homo sapiens
cugaagccaaaugaa

SEQ ID NO: 946924 - RNA, 12 nt, Homo sapiens
cugaagugcuua

SEQ ID NO: 946925 - RNA, 12 nt, Homo sapiens
cugaauauugcc

SEQ ID NO: 946926 - RNA, 14 nt, Homo sapiens
cugaccacacuccg

SEQ ID NO: 946927 - RNA, 15 nt, Homo sapiens
cugaccuuaaaugca

SEQ ID NO: 946928 - RNA, 17 nt, Homo sapiens
cugaccuuaaaugcaac

SEQ ID NO: 946929 - RNA, 14 nt, Homo sapiens
cugagcccaugaca

SEQ ID NO: 946930 - RNA, 18 nt, Homo sapiens
cugagcgugaugaucuag

SEQ ID NO: 946931 - RNA, 23 nt, Homo sapiens
cugagcgugaugaucuagccucc

SEQ ID NO: 946932 - RNA, 21 nt, Homo sapiens
cugagcuaucuccuaacuuug

SEQ ID NO: 946933 - RNA, 15 nt, Homo sapiens
cugagggcaguucug

SEQ ID NO: 946934 - RNA, 15 nt, Homo sapiens
cugaugagcacgguu

SEQ ID NO: 946935 - RNA, 22 nt, Homo sapiens
cugauuaccuccuguguggaag

SEQ ID NO: 946936 - RNA, 19 nt, Homo sapiens
cugcacuccagccuggcaa

SEQ ID NO: 946937 - RNA, 21 nt, Homo sapiens
uacaguuauuaaucuggacau

SEQ ID NO: 946938 - RNA, 20 nt, Homo sapiens
uacauacuuuaucaaugugu

SEQ ID NO: 946939 - RNA, 21 nt, Homo sapiens
uacauguuuauaaaucuuaug

SEQ ID NO: 946940 - RNA, 22 nt, Homo sapiens
uacauuugaugcaugucuuuua

SEQ ID NO: 946941 - RNA, 18 nt, Homo sapiens
uacauuugugaacaaaaa

SEQ ID NO: 946942 - RNA, 19 nt, Homo sapiens
uaccaaagcaucaauacaa

SEQ ID NO: 946943 - RNA, 15 nt, Homo sapiens
uaccccaaccccagg

SEQ ID NO: 946944 - RNA, 16 nt, Homo sapiens
uaccccuuugcacuug

SEQ ID NO: 946945 - RNA, 14 nt, Homo sapiens
uacccuauacaucc

SEQ ID NO: 946946 - RNA, 23 nt, Homo sapiens
uacccuccaagucuguaccucaa

SEQ ID NO: 946947 - RNA, 18 nt, Homo sapiens
uacccuuuuucuccagcu

SEQ ID NO: 946948 - RNA, 19 nt, Homo sapiens
uaccuagcuggcucuguga

SEQ ID NO: 946949 - RNA, 18 nt, Homo sapiens
uaccuggggccaaaccca

SEQ ID NO: 946950 - RNA, 23 nt, Homo sapiens
uaccuguuuuguggucagcugua

SEQ ID NO: 946951 - RNA, 23 nt, Homo sapiens
uaccuugaaaaaaagaaaagugu

SEQ ID NO: 946952 - RNA, 13 nt, Homo sapiens
uacgaaccaugcc

SEQ ID NO: 946953 - RNA, 17 nt, Homo sapiens
uacguggccauguauga

SEQ ID NO: 946954 - RNA, 21 nt, Homo sapiens
cugggcauuuggugagaguca

SEQ ID NO: 946955 - RNA, 13 nt, Homo sapiens
cugggccaugucc

SEQ ID NO: 946956 - RNA, 15 nt, Homo sapiens
cugggccauguccaa

SEQ ID NO: 946957 - RNA, 16 nt, Homo sapiens
cugggcugucugucac

SEQ ID NO: 946958 - RNA, 20 nt, Homo sapiens
cugggcuucgggcuaugcaa

SEQ ID NO: 946959 - RNA, 16 nt, Homo sapiens
cuggggcagacaauaa

SEQ ID NO: 946960 - RNA, 23 nt, Homo sapiens
cuggggcagacaauaaacccuca

SEQ ID NO: 946961 - RNA, 16 nt, Homo sapiens
cuggucagcauguacu

SEQ ID NO: 946962 - RNA, 20 nt, Homo sapiens
cugguggcaccagaugcaac

SEQ ID NO: 946963 - RNA, 16 nt, Homo sapiens
cugguugacuuucuaa

SEQ ID NO: 946964 - RNA, 21 nt, Homo sapiens
cuguaauaguuuuauauuguu

SEQ ID NO: 946965 - RNA, 21 nt, Homo sapiens
cuguaaucccagcacuuuggg

SEQ ID NO: 946966 - RNA, 16 nt, Homo sapiens
cuguacacauauuuga

SEQ ID NO: 946967 - RNA, 13 nt, Homo sapiens
cuguauaagugga

SEQ ID NO: 946968 - RNA, 16 nt, Homo sapiens
cugucaaaacuacuga

SEQ ID NO: 946969 - RNA, 17 nt, Homo sapiens
cugucaaggcugcuuag

SEQ ID NO: 946970 - RNA, 15 nt, Homo sapiens
cuguccccuaccccc

SEQ ID NO: 946971 - RNA, 17 nt, Homo sapiens
cugucuggcccugggga

SEQ ID NO: 946972 - RNA, 16 nt, Homo sapiens
cugucugucaccagcu

SEQ ID NO: 946973 - RNA, 17 nt, Homo sapiens
cugucugucaccagcua

SEQ ID NO: 946974 - RNA, 19 nt, Homo sapiens
cugucuucagagaacccac

SEQ ID NO: 946975 - RNA, 15 nt, Homo sapiens
cugugcaaagggaac

SEQ ID NO: 946976 - RNA, 23 nt, Homo sapiens
cugugcaauagacacauacaugu

SEQ ID NO: 946977 - RNA, 15 nt, Homo sapiens
cugugggcagcaccc

SEQ ID NO: 946978 - RNA, 16 nt, Homo sapiens
cugugggggugagggu

SEQ ID NO: 946979 - RNA, 18 nt, Homo sapiens
cuguguaaacucaucuga

SEQ ID NO: 946980 - RNA, 20 nt, Homo sapiens
cugugucggggcugaccucu

SEQ ID NO: 946981 - RNA, 13 nt, Homo sapiens
cuguguuaggggu

SEQ ID NO: 946982 - RNA, 21 nt, Homo sapiens
cuguuguuggucgcagcuaca

SEQ ID NO: 946983 - RNA, 17 nt, Homo sapiens
cuuaaaagaugccuuaa

SEQ ID NO: 946984 - RNA, 16 nt, Homo sapiens
cuuaaacucuguuaca

SEQ ID NO: 946985 - RNA, 20 nt, Homo sapiens
cuuaaguauugucaccagga

SEQ ID NO: 946986 - RNA, 21 nt, Homo sapiens
cuuaaguauugucaccaggau

SEQ ID NO: 946987 - RNA, 22 nt, Homo sapiens
cuuaagucccaguauaccucau

SEQ ID NO: 946988 - RNA, 15 nt, Homo sapiens
cuuaauuauuauaaa

SEQ ID NO: 946989 - RNA, 21 nt, Homo sapiens
cuuacaagaguggacucagug

SEQ ID NO: 946990 - RNA, 18 nt, Homo sapiens
cuuagaaaacaaguauug

SEQ ID NO: 946991 - RNA, 22 nt, Homo sapiens
cuuagcuauccuuggcuuucag

SEQ ID NO: 946992 - RNA, 11 nt, Homo sapiens
cuuaguugaaa

SEQ ID NO: 946993 - RNA, 16 nt, Homo sapiens
cuuauucaaccugucc

SEQ ID NO: 946994 - RNA, 13 nt, Homo sapiens
cuucaaauucaaa

SEQ ID NO: 946995 - RNA, 21 nt, Homo sapiens
cuucaagucccaucauagaaa

SEQ ID NO: 946996 - RNA, 19 nt, Homo sapiens
cuucacaaaaucuguuuag

SEQ ID NO: 946997 - RNA, 14 nt, Homo sapiens
cuucccccugcaaa

SEQ ID NO: 946998 - RNA, 23 nt, Homo sapiens
cuuccuaggaacgucugguccua

SEQ ID NO: 946999 - RNA, 19 nt, Homo sapiens
cuugagccacagucacugg

SEQ ID NO: 947000 - RNA, 22 nt, Homo sapiens
cuuggagaaaugaaaacagugu

SEQ ID NO: 947001 - RNA, 21 nt, Homo sapiens
cuuggcucacugcaaccucua

SEQ ID NO: 947002 - RNA, 14 nt, Homo sapiens
cuugggaccguguu

SEQ ID NO: 947003 - RNA, 23 nt, Homo sapiens
cuugggacucaggagcugcuaaa

SEQ ID NO: 947004 - RNA, 15 nt, Homo sapiens
cuuggggucacuccu

SEQ ID NO: 947005 - RNA, 22 nt, Homo sapiens
cuuggugaaacuacaucuccaa

SEQ ID NO: 947006 - RNA, 23 nt, Homo sapiens
cuuguaacuaaaauaauuuugua

SEQ ID NO: 947007 - RNA, 14 nt, Homo sapiens
cuugucagauguau

SEQ ID NO: 947008 - RNA, 14 nt, Homo sapiens
cuugugaucacuua

SEQ ID NO: 947009 - RNA, 14 nt, Homo sapiens
cuuguggucccaga

SEQ ID NO: 947010 - RNA, 22 nt, Homo sapiens
cuugugucugcggggaucagag

SEQ ID NO: 947011 - RNA, 21 nt, Homo sapiens
cuugugucuuuagugcuccaa

SEQ ID NO: 947012 - RNA, 18 nt, Homo sapiens
cuuguuuuacccuauaca

SEQ ID NO: 947013 - RNA, 13 nt, Homo sapiens
cuuuagcaugcua

SEQ ID NO: 947014 - RNA, 13 nt, Homo sapiens
cuuuagugcucca

SEQ ID NO: 947015 - RNA, 16 nt, Homo sapiens
cuuuauuaaauacaaa

SEQ ID NO: 947016 - RNA, 15 nt, Homo sapiens
cuuucacacuggauc

SEQ ID NO: 947017 - RNA, 22 nt, Homo sapiens
cuuucaugaauucugucauuuc

SEQ ID NO: 947018 - RNA, 20 nt, Homo sapiens
cuuuccaaaaccuaaagagg

SEQ ID NO: 947019 - RNA, 22 nt, Homo sapiens
cuuucuaaaggaaaucaaauga

SEQ ID NO: 947020 - RNA, 20 nt, Homo sapiens
cuuucuuuccaaaacauuuc

SEQ ID NO: 947021 - RNA, 18 nt, Homo sapiens
cuuucuuugcaccaaaga

SEQ ID NO: 947022 - RNA, 22 nt, Homo sapiens
cuuucuuuuuuaaaaauggaaa

SEQ ID NO: 947023 - RNA, 21 nt, Homo sapiens
cuuugaaaagagaauauuuac

SEQ ID NO: 947024 - RNA, 14 nt, Homo sapiens
cuuugagacguccu

SEQ ID NO: 947025 - RNA, 17 nt, Homo sapiens
cuuugcaccaaagacau

SEQ ID NO: 947026 - RNA, 19 nt, Homo sapiens
cuuuuaaauacauucccug

SEQ ID NO: 947027 - RNA, 16 nt, Homo sapiens
cuuuuaccacugacag

SEQ ID NO: 947028 - RNA, 17 nt, Homo sapiens
cuuuuagaaauacugca

SEQ ID NO: 947029 - RNA, 16 nt, Homo sapiens
cuuuuccacuccauug

SEQ ID NO: 947030 - RNA, 14 nt, Homo sapiens
gaaaaaaaaauuca

SEQ ID NO: 947031 - RNA, 15 nt, Homo sapiens
gaaaaauaaacacua

SEQ ID NO: 947032 - RNA, 12 nt, Homo sapiens
gaaaaauacuuu

SEQ ID NO: 947033 - RNA, 17 nt, Homo sapiens
gaaaaaugguggucauu

SEQ ID NO: 947034 - RNA, 12 nt, Homo sapiens
gaaaacaauucu

SEQ ID NO: 947035 - RNA, 22 nt, Homo sapiens
gaaaagaccuacagacuaagaa

SEQ ID NO: 947036 - RNA, 14 nt, Homo sapiens
gaaaagaugaauuu

SEQ ID NO: 947037 - RNA, 21 nt, Homo sapiens
gaaaaggucugaggacugagc

SEQ ID NO: 947038 - RNA, 23 nt, Homo sapiens
gaaaaguguguaucuagcuucuu

SEQ ID NO: 947039 - RNA, 14 nt, Homo sapiens
gaaaaucauaggca

SEQ ID NO: 947040 - RNA, 15 nt, Homo sapiens
gaaaauuacagucca

SEQ ID NO: 947041 - RNA, 21 nt, Homo sapiens
gaaaauuguuuagugauauua

SEQ ID NO: 947042 - RNA, 18 nt, Homo sapiens
gaaacacagcaacaauga

SEQ ID NO: 947043 - RNA, 18 nt, Homo sapiens
gaaacaccgagucucugu

SEQ ID NO: 947044 - RNA, 13 nt, Homo sapiens
ucaaauuaagcau

SEQ ID NO: 947045 - RNA, 19 nt, Homo sapiens
ucaaauuaagcauaugugu

SEQ ID NO: 947046 - RNA, 19 nt, Homo sapiens
ucaaauucaaauaaaaauc

SEQ ID NO: 947047 - RNA, 21 nt, Homo sapiens
ucaaccugguggcaccagaug

SEQ ID NO: 947048 - RNA, 19 nt, Homo sapiens
ucaacuuuuucccucacua

SEQ ID NO: 947049 - RNA, 14 nt, Homo sapiens
ucaagaauagcauu

SEQ ID NO: 947050 - RNA, 22 nt, Homo sapiens
ucaagagaucuuucuuuccaaa

SEQ ID NO: 947051 - RNA, 19 nt, Homo sapiens
ucaagauuuuuuuugucag

SEQ ID NO: 947052 - RNA, 11 nt, Homo sapiens
ucaaguaauaa

SEQ ID NO: 947053 - RNA, 17 nt, Homo sapiens
ucaaguaauacaaacua

SEQ ID NO: 947054 - RNA, 19 nt, Homo sapiens
ucaauaaccuuucacuuaa

SEQ ID NO: 947055 - RNA, 15 nt, Homo sapiens
ucaauacaaccagcc

SEQ ID NO: 947056 - RNA, 16 nt, Homo sapiens
ucaaucaaguuuacau

SEQ ID NO: 947057 - RNA, 21 nt, Homo sapiens
ucaaucauaauaccugcugug

SEQ ID NO: 947058 - RNA, 15 nt, Homo sapiens
ucaauggacuggaag

SEQ ID NO: 947059 - RNA, 22 nt, Homo sapiens
ucaaugugucuuucuaagaaau

SEQ ID NO: 947060 - RNA, 13 nt, Homo sapiens
ucacaacagugaa

SEQ ID NO: 947061 - RNA, 17 nt, Homo sapiens
ucacacgauaaagggau

SEQ ID NO: 947062 - RNA, 16 nt, Homo sapiens
uaacaguggacaaagu

SEQ ID NO: 947063 - RNA, 12 nt, Homo sapiens
uaacauccagag

SEQ ID NO: 947064 - RNA, 16 nt, Homo sapiens
uaaccagugagcacug

SEQ ID NO: 947065 - RNA, 21 nt, Homo sapiens
uaacccucacaagcaugaagu

SEQ ID NO: 947066 - RNA, 19 nt, Homo sapiens
uaagaaaucaaguaaugaa

SEQ ID NO: 947067 - RNA, 14 nt, Homo sapiens
uaagaaggaaaaga

SEQ ID NO: 947068 - RNA, 17 nt, Homo sapiens
uaagauauuuaguaaua

SEQ ID NO: 947069 - RNA, 18 nt, Homo sapiens
uaagauauuuaguaauau

SEQ ID NO: 947070 - RNA, 19 nt, Homo sapiens
uaagaucauuuaauaucuu

SEQ ID NO: 947071 - RNA, 19 nt, Homo sapiens
uaagauccacaaaugaagg

SEQ ID NO: 947072 - RNA, 13 nt, Homo sapiens
uaagaugugaaaa

SEQ ID NO: 947073 - RNA, 21 nt, Homo sapiens
uaagcaucugccaucugcuuu

SEQ ID NO: 947074 - RNA, 16 nt, Homo sapiens
uaagcuaauuccacac

SEQ ID NO: 947075 - RNA, 14 nt, Homo sapiens
uaaggauuuuucaa

SEQ ID NO: 947076 - RNA, 20 nt, Homo sapiens
uaagguugucuacgggggca

SEQ ID NO: 947077 - RNA, 19 nt, Homo sapiens
uaagucccaguauaccuca

SEQ ID NO: 947078 - RNA, 18 nt, Homo sapiens
uaauaaaaaggaguauac

SEQ ID NO: 947079 - RNA, 22 nt, Homo sapiens
uaauaaaaguauucuuguuaga

SEQ ID NO: 947080 - RNA, 15 nt, Homo sapiens
uaauaagaacauuaa

SEQ ID NO: 947081 - RNA, 15 nt, Homo sapiens
uaauacaaacuaauu

SEQ ID NO: 947082 - RNA, 17 nt, Homo sapiens
uaauagucuuugccagu

SEQ ID NO: 947083 - RNA, 22 nt, Homo sapiens
uaauauugauaagcuauugucu

SEQ ID NO: 947084 - RNA, 20 nt, Homo sapiens
uaaucacuauuguuccagca

SEQ ID NO: 947085 - RNA, 23 nt, Homo sapiens
uaaucauuuguuuacauuugaug

SEQ ID NO: 947086 - RNA, 15 nt, Homo sapiens
uaaugcugaaacauc

SEQ ID NO: 947087 - RNA, 12 nt, Homo sapiens
uaaugcuuuuau

SEQ ID NO: 947088 - RNA, 20 nt, Homo sapiens
uaauggagaggaaaccagau

SEQ ID NO: 947089 - RNA, 19 nt, Homo sapiens
uaauucauuugguucaaau

SEQ ID NO: 947090 - RNA, 21 nt, Homo sapiens
uaauugggaaaaaagcaacug

SEQ ID NO: 947091 - RNA, 16 nt, Homo sapiens
uaauuuauuucaucca

SEQ ID NO: 947092 - RNA, 14 nt, Homo sapiens
uaauuuucuuucac

SEQ ID NO: 947093 - RNA, 13 nt, Homo sapiens
uaauuuugucaga

SEQ ID NO: 947094 - RNA, 22 nt, Homo sapiens
uacaacgccgagugcacugcau

SEQ ID NO: 947095 - RNA, 17 nt, Homo sapiens
uacaacuuucaaaccag

SEQ ID NO: 947096 - RNA, 13 nt, Homo sapiens
uacacaagcaaug

SEQ ID NO: 947097 - RNA, 18 nt, Homo sapiens
uacaccucaaauaccacc

SEQ ID NO: 947098 - RNA, 23 nt, Homo sapiens
uacagaauaaaagaauuacauau

SEQ ID NO: 947099 - RNA, 16 nt, Homo sapiens
uacagcuaacccucac

SEQ ID NO: 947100 - RNA, 23 nt, Homo sapiens
uacagugugugugggugaaaugg

SEQ ID NO: 947101 - RNA, 21 nt, Homo sapiens
uacauaagacuggacauuuaa

SEQ ID NO: 947102 - RNA, 13 nt, Homo sapiens
uacauagugaaaa

SEQ ID NO: 947103 - RNA, 16 nt, Homo sapiens
uacauaucuuuauuaa

SEQ ID NO: 947104 - RNA, 17 nt, Homo sapiens
uacaucucuacuaaaaa

SEQ ID NO: 947105 - RNA, 16 nt, Homo sapiens
uacauguaauuugaug

SEQ ID NO: 947106 - RNA, 22 nt, Homo sapiens
uacaugucacauuuagcugugc

SEQ ID NO: 947107 - RNA, 16 nt, Homo sapiens
uacauuaacuugaaaa

SEQ ID NO: 947108 - RNA, 14 nt, Homo sapiens
uacauuauguugcu

SEQ ID NO: 947109 - RNA, 18 nt, Homo sapiens
uaccaguauagcuugcau

SEQ ID NO: 947110 - RNA, 16 nt, Homo sapiens
uacccagugggacaga

SEQ ID NO: 947111 - RNA, 22 nt, Homo sapiens
uacccccacaugccaauuucag

SEQ ID NO: 947112 - RNA, 16 nt, Homo sapiens
uacccuauacauccac

SEQ ID NO: 947113 - RNA, 17 nt, Homo sapiens
uaccuccuguguggaag

SEQ ID NO: 947114 - RNA, 14 nt, Homo sapiens
uaccugagagauuu

SEQ ID NO: 947115 - RNA, 13 nt, Homo sapiens
uacuaaaguauug

SEQ ID NO: 947116 - RNA, 16 nt, Homo sapiens
uacuaccuguaaugac

SEQ ID NO: 947117 - RNA, 17 nt, Homo sapiens
uacucaauacuaccucu

SEQ ID NO: 947118 - RNA, 16 nt, Homo sapiens
uacuccucucaucccc

SEQ ID NO: 947119 - RNA, 20 nt, Homo sapiens
uacugaagccaaaugaaacu

SEQ ID NO: 947120 - RNA, 13 nt, Homo sapiens
uacugaagcuuua

SEQ ID NO: 947121 - RNA, 16 nt, Homo sapiens
uacugaaugucauuga

SEQ ID NO: 947122 - RNA, 17 nt, Homo sapiens
uacugguugacuuucua

SEQ ID NO: 947123 - RNA, 12 nt, Homo sapiens
uacuguuuccau

SEQ ID NO: 947124 - RNA, 20 nt, Homo sapiens
uacuugggaggcugagauag

SEQ ID NO: 947125 - RNA, 15 nt, Homo sapiens
uacuuguucauuugg

SEQ ID NO: 947126 - RNA, 13 nt, Homo sapiens
uacuuguucugua

SEQ ID NO: 947127 - RNA, 21 nt, Homo sapiens
uagaaaaaaaaauucacauga

SEQ ID NO: 947128 - RNA, 15 nt, Homo sapiens
uagaaagggugcugc

SEQ ID NO: 947129 - RNA, 16 nt, Homo sapiens
uagacacuuacuugau

SEQ ID NO: 947130 - RNA, 13 nt, Homo sapiens
uagagagagacuu

SEQ ID NO: 947131 - RNA, 16 nt, Homo sapiens
uagaucaacagaucaa

SEQ ID NO: 947132 - RNA, 21 nt, Homo sapiens
uagcagcaggcucaggcacau

SEQ ID NO: 947133 - RNA, 22 nt, Homo sapiens
uagcagcaggcucaggcacaua

SEQ ID NO: 947134 - RNA, 19 nt, Homo sapiens
uagcauuucccaacacaaa

SEQ ID NO: 947135 - RNA, 21 nt, Homo sapiens
uagccagauuugucuuuuugu

SEQ ID NO: 947136 - RNA, 14 nt, Homo sapiens
uagcuaauaacaug

SEQ ID NO: 947137 - RNA, 20 nt, Homo sapiens
uagcuaauaacaugugaaaa

SEQ ID NO: 947138 - RNA, 18 nt, Homo sapiens
uagcugaaccgacacuca

SEQ ID NO: 947139 - RNA, 14 nt, Homo sapiens
uagcugugcucaga

SEQ ID NO: 947140 - RNA, 21 nt, Homo sapiens
uagcuuagcuaugucagccaa

SEQ ID NO: 947141 - RNA, 19 nt, Homo sapiens
uagcuucuucagagaucaa

SEQ ID NO: 947142 - RNA, 20 nt, Homo sapiens
uagcuuggagggauggagag

SEQ ID NO: 947143 - RNA, 18 nt, Homo sapiens
uaggaaugguucucucaa

SEQ ID NO: 947144 - RNA, 14 nt, Homo sapiens
uaggauaagcacua

SEQ ID NO: 947145 - RNA, 15 nt, Homo sapiens
uaggauuaauaaaga

SEQ ID NO: 947146 - RNA, 15 nt, Homo sapiens
uagguagcaacaaca

SEQ ID NO: 947147 - RNA, 23 nt, Homo sapiens
uuuccauuaaguacaugugccag

SEQ ID NO: 947148 - RNA, 17 nt, Homo sapiens
uuuccauuuuaaggaua

SEQ ID NO: 947149 - RNA, 13 nt, Homo sapiens
uuucccauugcca

SEQ ID NO: 947150 - RNA, 16 nt, Homo sapiens
uuuccucagugcauuu

SEQ ID NO: 947151 - RNA, 12 nt, Homo sapiens
uuuccucugcau

SEQ ID NO: 947152 - RNA, 14 nt, Homo sapiens
uuuccucugugcaa

SEQ ID NO: 947153 - RNA, 13 nt, Homo sapiens
uuucucauuaaau

SEQ ID NO: 947154 - RNA, 15 nt, Homo sapiens
uuucucgggugcauu

SEQ ID NO: 947155 - RNA, 17 nt, Homo sapiens
uuucugaaugucuguga

SEQ ID NO: 947156 - RNA, 23 nt, Homo sapiens
uuucuggacaguaccugauugua

SEQ ID NO: 947157 - RNA, 12 nt, Homo sapiens
uuucuggcucuu

SEQ ID NO: 947158 - RNA, 21 nt, Homo sapiens
uuugcaggagaaaaguaucaa

SEQ ID NO: 947159 - RNA, 15 nt, Homo sapiens
uuuggucacauauca

SEQ ID NO: 947160 - RNA, 19 nt, Homo sapiens
uuuguaauaauaaagaaua

SEQ ID NO: 947161 - RNA, 13 nt, Homo sapiens
uuuguaaugcugc

SEQ ID NO: 947162 - RNA, 14 nt, Homo sapiens
uuuguaaugcugca

SEQ ID NO: 947163 - RNA, 14 nt, Homo sapiens
uuuguuagcaaaga

SEQ ID NO: 947164 - RNA, 15 nt, Homo sapiens
uuuguuagcaaagau

SEQ ID NO: 947165 - RNA, 13 nt, Homo sapiens
uuuuaacuuugaa

SEQ ID NO: 947166 - RNA, 21 nt, Homo sapiens
uuuuaauuuaaacaccuccuc

SEQ ID NO: 947167 - RNA, 21 nt, Homo sapiens
uuuuaccaaagcaucaauaca

SEQ ID NO: 947168 - RNA, 20 nt, Homo sapiens
uuuuacccuauacauccaca

SEQ ID NO: 947169 - RNA, 11 nt, Homo sapiens
uuuuaugcugg

SEQ ID NO: 947170 - RNA, 17 nt, Homo sapiens
uuuucaaagcaguauag

SEQ ID NO: 947171 - RNA, 16 nt, Homo sapiens
uaucugguuucucuag

SEQ ID NO: 947172 - RNA, 12 nt, Homo sapiens
uaugaugcacuu

SEQ ID NO: 947173 - RNA, 13 nt, Homo sapiens
uaugaugcacuua

SEQ ID NO: 947174 - RNA, 18 nt, Homo sapiens
uaugcauguaauggacua

SEQ ID NO: 947175 - RNA, 17 nt, Homo sapiens
uaugcgcaauguggcau

SEQ ID NO: 947176 - RNA, 14 nt, Homo sapiens
uaugcuaauaguga

SEQ ID NO: 947177 - RNA, 20 nt, Homo sapiens
uauggacaguaaguccagua

SEQ ID NO: 947178 - RNA, 18 nt, Homo sapiens
uauggaggggagggaucu

SEQ ID NO: 947179 - RNA, 16 nt, Homo sapiens
uaugggaucugauaag

SEQ ID NO: 947180 - RNA, 22 nt, Homo sapiens
uaugggggauggugagcuguga

SEQ ID NO: 947181 - RNA, 15 nt, Homo sapiens
uaugguccucagauc

SEQ ID NO: 947182 - RNA, 12 nt, Homo sapiens
uaugguggcaua

SEQ ID NO: 947183 - RNA, 20 nt, Homo sapiens
uauuaguguuuuaugcaugu

SEQ ID NO: 947184 - RNA, 23 nt, Homo sapiens
uauuaucagagacuauguagcaa

SEQ ID NO: 947185 - RNA, 15 nt, Homo sapiens
uauucauauauauac

SEQ ID NO: 947186 - RNA, 19 nt, Homo sapiens
uauugcuuaccugaucuca

SEQ ID NO: 947187 - RNA, 22 nt, Homo sapiens
uauuuaaagccuccucaucccg

SEQ ID NO: 947188 - RNA, 21 nt, Homo sapiens
uauuuauccagaaaacuguga

SEQ ID NO: 947189 - RNA, 18 nt, Homo sapiens
uauuuauguuugcacuug

SEQ ID NO: 947190 - RNA, 18 nt, Homo sapiens
uauuucagugaauuugca

SEQ ID NO: 947191 - RNA, 18 nt, Homo sapiens
uauuugcagaagcuguga

SEQ ID NO: 947192 - RNA, 17 nt, Homo sapiens
uauuugcugaccacacu

SEQ ID NO: 947193 - RNA, 20 nt, Homo sapiens
uauuuguuuggugaauuugu

SEQ ID NO: 947194 - RNA, 22 nt, Homo sapiens
uauuuuccuucuuuguuucccc

SEQ ID NO: 947195 - RNA, 20 nt, Homo sapiens
uauuuucuucuccagugguc

SEQ ID NO: 947196 - RNA, 22 nt, Homo sapiens
uauuuucuucuccaguggucau

SEQ ID NO: 947197 - RNA, 17 nt, Homo sapiens
uauuuuguaaugcugca

SEQ ID NO: 947198 - RNA, 19 nt, Homo sapiens
ucaaaaauccuaacauuca

SEQ ID NO: 947199 - RNA, 15 nt, Homo sapiens
ucaaaccacaauauc

SEQ ID NO: 947200 - RNA, 19 nt, Homo sapiens
ucaaaggccacauaccucu

SEQ ID NO: 947201 - RNA, 11 nt, Homo sapiens
ucaaaugugca

SEQ ID NO: 947202 - RNA, 12 nt, Homo sapiens
ucaaaugugcau

SEQ ID NO: 947203 - RNA, 14 nt, Homo sapiens
ucaaaugugcaucc

SEQ ID NO: 947204 - RNA, 14 nt, Homo sapiens
ucaaauuaagcaua

SEQ ID NO: 947205 - RNA, 17 nt, Homo sapiens
ucaacagucuugcugaa

SEQ ID NO: 947206 - RNA, 14 nt, Homo sapiens
ucaacauuacuguu

SEQ ID NO: 947207 - RNA, 17 nt, Homo sapiens
ucaagaauagcauugua

SEQ ID NO: 947208 - RNA, 23 nt, Homo sapiens
ucaagagaucuuucuuuccaaaa

SEQ ID NO: 947209 - RNA, 16 nt, Homo sapiens
ucaagagcaugcacau

SEQ ID NO: 947210 - RNA, 14 nt, Homo sapiens
ucaagagugagcua

SEQ ID NO: 947211 - RNA, 22 nt, Homo sapiens
ucaagcuuuuaaaaacuagagc

SEQ ID NO: 947212 - RNA, 15 nt, Homo sapiens
ucaaguaauacaaac

SEQ ID NO: 947213 - RNA, 19 nt, Homo sapiens
ucaauacaaccagcccaac

SEQ ID NO: 947214 - RNA, 12 nt, Homo sapiens
ucaauacuaccu

SEQ ID NO: 947215 - RNA, 22 nt, Homo sapiens
ucaauguuugaaauaguucaaa

SEQ ID NO: 947216 - RNA, 15 nt, Homo sapiens
ucacaacagugaaaa

SEQ ID NO: 947217 - RNA, 20 nt, Homo sapiens
ucacaagcaugaagugcugu

SEQ ID NO: 947218 - RNA, 22 nt, Homo sapiens
ucacacaugccacuaugagcuu

SEQ ID NO: 947219 - RNA, 16 nt, Homo sapiens
ucacagcuccucccac

SEQ ID NO: 947220 - RNA, 16 nt, Homo sapiens
ucacagugaacacuca

SEQ ID NO: 947221 - RNA, 13 nt, Homo sapiens
ucacauacaaauc

SEQ ID NO: 947222 - RNA, 14 nt, Homo sapiens
ucacauucuuggcu

SEQ ID NO: 947223 - RNA, 20 nt, Homo sapiens
ucaccaagcuaggugcuauu

SEQ ID NO: 947224 - RNA, 21 nt, Homo sapiens
ucaccaagcuaggugcuauuu

SEQ ID NO: 947225 - RNA, 21 nt, Homo sapiens
ucacguuuggugcuucucaga

SEQ ID NO: 947226 - RNA, 18 nt, Homo sapiens
ucacugcaacuucugccu

SEQ ID NO: 947227 - RNA, 23 nt, Homo sapiens
ucacuugccaaaauccaaggcaa

SEQ ID NO: 947228 - RNA, 13 nt, Homo sapiens
ucagaacagucug

SEQ ID NO: 947229 - RNA, 14 nt, Homo sapiens
ucagaagugcagaa

SEQ ID NO: 947230 - RNA, 18 nt, Homo sapiens
ucagacuccagcugugaa

SEQ ID NO: 947231 - RNA, 20 nt, Homo sapiens
ucagagacuauguagcaaua

SEQ ID NO: 947232 - RNA, 20 nt, Homo sapiens
ucagauccugggcacauucu

SEQ ID NO: 947233 - RNA, 15 nt, Homo sapiens
ucagcacacacuuac

SEQ ID NO: 947234 - RNA, 20 nt, Homo sapiens
ucagccaauccgauugccuu

SEQ ID NO: 947235 - RNA, 20 nt, Homo sapiens
ucagccucugccagcgccaa

SEQ ID NO: 947236 - RNA, 14 nt, Homo sapiens
ucaggagcugcuaa

SEQ ID NO: 947237 - RNA, 14 nt, Homo sapiens
ucagggaacucugg

SEQ ID NO: 947238 - RNA, 19 nt, Homo sapiens
ucagggucuaagcaccuug

SEQ ID NO: 947239 - RNA, 17 nt, Homo sapiens
ucaguauuuaauaucug

SEQ ID NO: 947240 - RNA, 17 nt, Homo sapiens
ucagucaaaacuuuaaa

SEQ ID NO: 947241 - RNA, 19 nt, Homo sapiens
ucagugaagccaaagggac

SEQ ID NO: 947242 - RNA, 12 nt, Homo sapiens
ucaguggugguc

SEQ ID NO: 947243 - RNA, 19 nt, Homo sapiens
ucagugguggucuucaaga

SEQ ID NO: 947244 - RNA, 14 nt, Homo sapiens
ucaucaggugcaua

SEQ ID NO: 947245 - RNA, 22 nt, Homo sapiens
ucaucaguaguucacauacaaa

SEQ ID NO: 947246 - RNA, 14 nt, Homo sapiens
ucaucauccuacaa

SEQ ID NO: 947247 - RNA, 20 nt, Homo sapiens
ucaucauggcaucauugcau

SEQ ID NO: 947248 - RNA, 20 nt, Homo sapiens
ucauccuccaggaacugcag

SEQ ID NO: 947249 - RNA, 10 nt, Homo sapiens
ucaugaaauu

SEQ ID NO: 947250 - RNA, 18 nt, Homo sapiens
ucaugccuuaaucccagc

SEQ ID NO: 947251 - RNA, 16 nt, Homo sapiens
ucauggcaucauugca

SEQ ID NO: 947252 - RNA, 18 nt, Homo sapiens
ucauguugaucauguacu

SEQ ID NO: 947253 - RNA, 22 nt, Homo sapiens
ucauuauuuuuguuagcaaaga

SEQ ID NO: 947254 - RNA, 13 nt, Homo sapiens
ucauucauggcua

SEQ ID NO: 947255 - RNA, 23 nt, Homo sapiens
ucauucccauuuuguuacauuuc

SEQ ID NO: 947256 - RNA, 19 nt, Homo sapiens
aagccaaagagccucccac

SEQ ID NO: 947257 - RNA, 16 nt, Homo sapiens
aagcccaggagccuca

SEQ ID NO: 947258 - RNA, 20 nt, Homo sapiens
aagccuaagggauccugccu

SEQ ID NO: 947259 - RNA, 23 nt, Homo sapiens
aagccuuaaguggcagaauauaa

SEQ ID NO: 947260 - RNA, 13 nt, Homo sapiens
aagccuucugcag

SEQ ID NO: 947261 - RNA, 17 nt, Homo sapiens
aagccuugaaacaguug

SEQ ID NO: 947262 - RNA, 16 nt, Homo sapiens
aagcggagagagccaa

SEQ ID NO: 947263 - RNA, 16 nt, Homo sapiens
aagcgucaucugugua

SEQ ID NO: 947264 - RNA, 16 nt, Homo sapiens
aaagacuggcuuuuau

SEQ ID NO: 947265 - RNA, 19 nt, Homo sapiens
aaagaggaaaagugcaaug

SEQ ID NO: 947266 - RNA, 15 nt, Homo sapiens
aaagaggcugccccu

SEQ ID NO: 947267 - RNA, 20 nt, Homo sapiens
aaagaggcugccccucucac

SEQ ID NO: 947268 - RNA, 23 nt, Homo sapiens
aaagauccagccucauaccuaca

SEQ ID NO: 947269 - RNA, 14 nt, Homo sapiens
aaagauuaaaugug

SEQ ID NO: 947270 - RNA, 19 nt, Homo sapiens
aaagauuaaaugugucauu

SEQ ID NO: 947271 - RNA, 24 nt, Homo sapiens
aaagcaacugguuagguagcaaca

SEQ ID NO: 947272 - RNA, 15 nt, Homo sapiens
aaagcaaguugccug

SEQ ID NO: 947273 - RNA, 22 nt, Homo sapiens
aaagcaauuauauuguccuccc

SEQ ID NO: 947274 - RNA, 20 nt, Homo sapiens
aaagcaucaauacaaccagc

SEQ ID NO: 947275 - RNA, 21 nt, Homo sapiens
aaagccaagggcaacagauca

SEQ ID NO: 947276 - RNA, 22 nt, Homo sapiens
aaagccagguuccacagaggac

SEQ ID NO: 947277 - RNA, 17 nt, Homo sapiens
aaagccuccucaucccg

SEQ ID NO: 947278 - RNA, 21 nt, Homo sapiens
aaagcuuuuagaaauacugca

SEQ ID NO: 947279 - RNA, 17 nt, Homo sapiens
aaagggaaacugggaaa

SEQ ID NO: 947280 - RNA, 16 nt, Homo sapiens
aaagggagugcaugug

SEQ ID NO: 947281 - RNA, 22 nt, Homo sapiens
aaaggugaauguugagggcccu

SEQ ID NO: 947282 - RNA, 13 nt, Homo sapiens
aaaguacuuuaau

SEQ ID NO: 947283 - RNA, 23 nt, Homo sapiens
aaagucugaguaagaaacuucau

SEQ ID NO: 947284 - RNA, 19 nt, Homo sapiens
aaagucuguugauuaaaga

SEQ ID NO: 947285 - RNA, 15 nt, Homo sapiens
aaagugaucuugaga

SEQ ID NO: 947286 - RNA, 16 nt, Homo sapiens
aaauaaauauaccacu

SEQ ID NO: 947287 - RNA, 18 nt, Homo sapiens
aaauauacaaaacuuuau

SEQ ID NO: 947288 - RNA, 19 nt, Homo sapiens
aaaugaaagggaaacuggg

SEQ ID NO: 947289 - RNA, 16 nt, Homo sapiens
aaaugagacuuucuaa

SEQ ID NO: 947290 - RNA, 13 nt, Homo sapiens
aaaugguauguca

SEQ ID NO: 947291 - RNA, 22 nt, Homo sapiens
aaauguaugucugguuccccag

SEQ ID NO: 947292 - RNA, 23 nt, Homo sapiens
aaaugucaaauugaugugcccua

SEQ ID NO: 947293 - RNA, 21 nt, Homo sapiens
aaaugugucauuggaagccau

SEQ ID NO: 947294 - RNA, 18 nt, Homo sapiens
aaauuaaacuuauuuaca

SEQ ID NO: 947295 - RNA, 21 nt, Homo sapiens
aaauucacaugaugcacuuca

SEQ ID NO: 947296 - RNA, 19 nt, Homo sapiens
aaauuuaacaguuaccuga

SEQ ID NO: 947297 - RNA, 14 nt, Homo sapiens
aacaaagaaugggc

SEQ ID NO: 947298 - RNA, 15 nt, Homo sapiens
aacaaauaauuuaga

SEQ ID NO: 947299 - RNA, 13 nt, Homo sapiens
aacaaccugggca

SEQ ID NO: 947300 - RNA, 15 nt, Homo sapiens
aacaagccaaagagc

SEQ ID NO: 947301 - RNA, 20 nt, Homo sapiens
aacaaugcugauuuggugac

SEQ ID NO: 947302 - RNA, 19 nt, Homo sapiens
aacacagcaacaaugacuu

SEQ ID NO: 947303 - RNA, 20 nt, Homo sapiens
aacacagcaacaaugacuua

SEQ ID NO: 947304 - RNA, 22 nt, Homo sapiens
aacagaaauguuuuuuggcauu

SEQ ID NO: 947305 - RNA, 17 nt, Homo sapiens
aacagauggcacuuuga

SEQ ID NO: 947306 - RNA, 15 nt, Homo sapiens
aacagauugaaaaga

SEQ ID NO: 947307 - RNA, 20 nt, Homo sapiens
aacagcuaguagacaugaau

SEQ ID NO: 947308 - RNA, 22 nt, Homo sapiens
aacagcuaguagacaugaauuu

SEQ ID NO: 947309 - RNA, 21 nt, Homo sapiens
aacagggcugccuucuggccu

SEQ ID NO: 947310 - RNA, 19 nt, Homo sapiens
aacaguggaaacuaugugu

SEQ ID NO: 947311 - RNA, 17 nt, Homo sapiens
aacaguuaccugagaga

SEQ ID NO: 947312 - RNA, 16 nt, Homo sapiens
aacaucuuuagugucu

SEQ ID NO: 947313 - RNA, 15 nt, Homo sapiens
aacaugaaaacaauu

SEQ ID NO: 947314 - RNA, 16 nt, Homo sapiens
aacaugcuggugaaua

SEQ ID NO: 947315 - RNA, 12 nt, Homo sapiens
aacaugugaaaa

SEQ ID NO: 947316 - RNA, 22 nt, Homo sapiens
aacauuaucuaguucauugaau

SEQ ID NO: 947317 - RNA, 23 nt, Homo sapiens
aacauuccagccacuggcugcua

SEQ ID NO: 947318 - RNA, 22 nt, Homo sapiens
aaccaagccugcugucuuguga

SEQ ID NO: 947319 - RNA, 14 nt, Homo sapiens
aaccaauguagcac

SEQ ID NO: 947320 - RNA, 16 nt, Homo sapiens
aaccagaaaagcaaua

SEQ ID NO: 947321 - RNA, 15 nt, Homo sapiens
aaccagcccaaccau

SEQ ID NO: 947322 - RNA, 23 nt, Homo sapiens
aaccaugccuuccucaguaucca

SEQ ID NO: 947323 - RNA, 19 nt, Homo sapiens
aaccauuuuuguuacucuc

SEQ ID NO: 947324 - RNA, 15 nt, Homo sapiens
aaccccaaacaguga

SEQ ID NO: 947325 - RNA, 18 nt, Homo sapiens
aacccucacaagcaugaa

SEQ ID NO: 947326 - RNA, 21 nt, Homo sapiens
aaccucaguuauuacauguaa

SEQ ID NO: 947327 - RNA, 17 nt, Homo sapiens
aaccugguggcaccaga

SEQ ID NO: 947328 - RNA, 15 nt, Homo sapiens
aacgccgagugcacu

SEQ ID NO: 947329 - RNA, 17 nt, Homo sapiens
aacuaucucuacugaau

SEQ ID NO: 947330 - RNA, 23 nt, Homo sapiens
aacuccacugcuuaccuacuuuc

SEQ ID NO: 947331 - RNA, 12 nt, Homo sapiens
aacucuguuaca

SEQ ID NO: 947332 - RNA, 14 nt, Homo sapiens
aacugaaagcacua

SEQ ID NO: 947333 - RNA, 13 nt, Homo sapiens
aacugcaaccuca

SEQ ID NO: 947334 - RNA, 21 nt, Homo sapiens
aacuguaaaugugacauugau

SEQ ID NO: 947335 - RNA, 14 nt, Homo sapiens
aacugucacucauu

SEQ ID NO: 947336 - RNA, 20 nt, Homo sapiens
aacugucacucauugcugag

SEQ ID NO: 947337 - RNA, 16 nt, Homo sapiens
aacuuuccaaacacca

SEQ ID NO: 947338 - RNA, 16 nt, Homo sapiens
aagaaaaugcuugaca

SEQ ID NO: 947339 - RNA, 12 nt, Homo sapiens
aagaaacuugaa

SEQ ID NO: 947340 - RNA, 15 nt, Homo sapiens
aagaaccauugauuu

SEQ ID NO: 947341 - RNA, 19 nt, Homo sapiens
aagaauuaagaggaugcug

SEQ ID NO: 947342 - RNA, 23 nt, Homo sapiens
aagagaucuuucuuuccaaaaca

SEQ ID NO: 947343 - RNA, 20 nt, Homo sapiens
aagagccuucacugguucug

SEQ ID NO: 947344 - RNA, 18 nt, Homo sapiens
aagaggcugccccucuca

SEQ ID NO: 947345 - RNA, 14 nt, Homo sapiens
aagaguuuguuacc

SEQ ID NO: 947346 - RNA, 16 nt, Homo sapiens
aagaugucucugcaaa

SEQ ID NO: 947347 - RNA, 16 nt, Homo sapiens
aagauuaaaaagcaca

SEQ ID NO: 947348 - RNA, 14 nt, Homo sapiens
aagauuaaaugugu

SEQ ID NO: 947349 - RNA, 18 nt, Homo sapiens
aagauuuuuuuugucaga

SEQ ID NO: 947350 - RNA, 12 nt, Homo sapiens
aagcaacauuca

SEQ ID NO: 947351 - RNA, 15 nt, Homo sapiens
aagcacaaguacuuu

SEQ ID NO: 947352 - RNA, 13 nt, Homo sapiens
aagcacuuuguua

SEQ ID NO: 947353 - RNA, 22 nt, Homo sapiens
aagcaguuguaccaagugaaau

SEQ ID NO: 947354 - RNA, 14 nt, Homo sapiens
aagcauacuuugua

SEQ ID NO: 947355 - RNA, 23 nt, Homo sapiens
aagcaucauuuccccaacagggc

SEQ ID NO: 947356 - RNA, 22 nt, Homo sapiens
aagcaucccgcuggugccuccc

SEQ ID NO: 947357 - RNA, 15 nt, Homo sapiens
aagcauuuguagcaa

SEQ ID NO: 947358 - RNA, 13 nt, Homo sapiens
aagccaaccuuca

SEQ ID NO: 947359 - RNA, 22 nt, Homo sapiens
aagcccaggagccucacugggg

SEQ ID NO: 947360 - RNA, 15 nt, Homo sapiens
aagcuaccauuuauc

SEQ ID NO: 947361 - RNA, 22 nt, Homo sapiens
aagcuuuuggagggugauauaa

SEQ ID NO: 947362 - RNA, 14 nt, Homo sapiens
aaggaaacuagaca

SEQ ID NO: 947363 - RNA, 14 nt, Homo sapiens
aaggaacugcaaua

SEQ ID NO: 947364 - RNA, 21 nt, Homo sapiens
aaggaacugcaauaauaucaa

SEQ ID NO: 947365 - RNA, 13 nt, Homo sapiens
aaggauccaucuu

SEQ ID NO: 947366 - RNA, 23 nt, Homo sapiens
aagguuuggugcaaaguauugua

SEQ ID NO: 947367 - RNA, 20 nt, Homo sapiens
aaguacuggcucuuuauuca

SEQ ID NO: 947368 - RNA, 20 nt, Homo sapiens
aagucccaguauaccucauu

SEQ ID NO: 947369 - RNA, 23 nt, Homo sapiens
aaguuagccagguaugguggcau

SEQ ID NO: 947370 - RNA, 18 nt, Homo sapiens
aaguucgagacuagccug

SEQ ID NO: 947371 - RNA, 23 nt, Homo sapiens
cccagugggccuguggcauucau

SEQ ID NO: 947372 - RNA, 21 nt, Homo sapiens
cccaguuccucccccaguucc

SEQ ID NO: 947373 - RNA, 22 nt, Homo sapiens
ccccaaugacacccaugccaga

SEQ ID NO: 947374 - RNA, 12 nt, Homo sapiens
ccccagcucaau

SEQ ID NO: 947375 - RNA, 20 nt, Homo sapiens
ccccaggcaaggaugucuga

SEQ ID NO: 947376 - RNA, 15 nt, Homo sapiens
ccccauccagccaga

SEQ ID NO: 947377 - RNA, 23 nt, Homo sapiens
cccccaguaaaaucaaaugugca

SEQ ID NO: 947378 - RNA, 17 nt, Homo sapiens
cccccuuucacacugga

SEQ ID NO: 947379 - RNA, 14 nt, Homo sapiens
ccccugcaaaaaga

SEQ ID NO: 947380 - RNA, 14 nt, Homo sapiens
ccccuucugggcaa

SEQ ID NO: 947381 - RNA, 14 nt, Homo sapiens
ccccuucuguguca

SEQ ID NO: 947382 - RNA, 18 nt, Homo sapiens
cccuagaucaacagauca

SEQ ID NO: 947383 - RNA, 16 nt, Homo sapiens
cccuagaugcacgugg

SEQ ID NO: 947384 - RNA, 20 nt, Homo sapiens
cccuagaugcacguggggcc

SEQ ID NO: 947385 - RNA, 18 nt, Homo sapiens
cccuccuggcucuugaua

SEQ ID NO: 947386 - RNA, 21 nt, Homo sapiens
cccucgucaucaggugcauag

SEQ ID NO: 947387 - RNA, 22 nt, Homo sapiens
cccugcugagcgugaugaucua

SEQ ID NO: 947388 - RNA, 22 nt, Homo sapiens
cccugcuuuuugcuucuugagu

SEQ ID NO: 947389 - RNA, 20 nt, Homo sapiens
cccugguggcuucagcaguc

SEQ ID NO: 947390 - RNA, 18 nt, Homo sapiens
cccugugucugcuguaga

SEQ ID NO: 947391 - RNA, 17 nt, Homo sapiens
cccuuaacugcauccag

SEQ ID NO: 947392 - RNA, 16 nt, Homo sapiens
cccuuauccuucuccc

SEQ ID NO: 947393 - RNA, 20 nt, Homo sapiens
cccuucaguacccucucagc

SEQ ID NO: 947394 - RNA, 19 nt, Homo sapiens
cccuuuuucuccagcuggg

SEQ ID NO: 947395 - RNA, 18 nt, Homo sapiens
cccuuuuuuuacauuuca

SEQ ID NO: 947396 - RNA, 18 nt, Homo sapiens
ccgaaggguuuugcuaca

SEQ ID NO: 947397 - RNA, 12 nt, Homo sapiens
ccgcguggaaug

SEQ ID NO: 947398 - RNA, 13 nt, Homo sapiens
ccggacggcgggu

SEQ ID NO: 947399 - RNA, 19 nt, Homo sapiens
ccggcaacaucucugggaa

SEQ ID NO: 947400 - RNA, 22 nt, Homo sapiens
ccgugcucgcccacaaacugau

SEQ ID NO: 947401 - RNA, 18 nt, Homo sapiens
ccguuuuccccaugacaa

SEQ ID NO: 947402 - RNA, 20 nt, Homo sapiens
ccuagaaaggaacugcaaua

SEQ ID NO: 947403 - RNA, 20 nt, Homo sapiens
ccuagacucugucuaccugg

SEQ ID NO: 947404 - RNA, 15 nt, Homo sapiens
ccuauacauccacag

SEQ ID NO: 947405 - RNA, 22 nt, Homo sapiens
ccucaaagaagucggaauguca

SEQ ID NO: 947406 - RNA, 23 nt, Homo sapiens
ccucaaagaagucggaaugucau

SEQ ID NO: 947407 - RNA, 22 nt, Homo sapiens
ccucaccuagccugaugagauu

SEQ ID NO: 947408 - RNA, 20 nt, Homo sapiens
ccucacuggggcagacaaua

SEQ ID NO: 947409 - RNA, 19 nt, Homo sapiens
ccucagaaggccccagaga

SEQ ID NO: 947410 - RNA, 20 nt, Homo sapiens
ccucagaaggccccagagag

SEQ ID NO: 947411 - RNA, 14 nt, Homo sapiens
ccucagaugaucuc

SEQ ID NO: 947412 - RNA, 12 nt, Homo sapiens
ccuccacagaga

SEQ ID NO: 947413 - RNA, 23 nt, Homo sapiens
ccuccacagagaggaggggacca

SEQ ID NO: 947414 - RNA, 15 nt, Homo sapiens
ccucccccaguuccu

SEQ ID NO: 947415 - RNA, 15 nt, Homo sapiens
ccucccccaugggcu

SEQ ID NO: 947416 - RNA, 16 nt, Homo sapiens
ccucccccaugggcug

SEQ ID NO: 947417 - RNA, 20 nt, Homo sapiens
ccucccuuccccuuuuccca

SEQ ID NO: 947418 - RNA, 22 nt, Homo sapiens
ccuccuauggguugucaccaag

SEQ ID NO: 947419 - RNA, 14 nt, Homo sapiens
ccuccuugugccuu

SEQ ID NO: 947420 - RNA, 21 nt, Homo sapiens
ccucgucaagagcaugcacau

SEQ ID NO: 947421 - RNA, 18 nt, Homo sapiens
ccucucccggcaacaucu

SEQ ID NO: 947422 - RNA, 17 nt, Homo sapiens
ccucugaccugcacugg

SEQ ID NO: 947423 - RNA, 22 nt, Homo sapiens
ccucugcauggaacagcauuac

SEQ ID NO: 947424 - RNA, 14 nt, Homo sapiens
ccucugcauuuaca

SEQ ID NO: 947425 - RNA, 20 nt, Homo sapiens
ccucugucaacaucaaagag

SEQ ID NO: 947426 - RNA, 16 nt, Homo sapiens
ccucuuacaacuuuca

SEQ ID NO: 947427 - RNA, 22 nt, Homo sapiens
ccugaauucuuuuucauuugag

SEQ ID NO: 947428 - RNA, 16 nt, Homo sapiens
ccugagagauuuaaca

SEQ ID NO: 947429 - RNA, 20 nt, Homo sapiens
ccugagcacccagaacucca

SEQ ID NO: 947430 - RNA, 15 nt, Homo sapiens
ccugagcagaaagag

SEQ ID NO: 947431 - RNA, 13 nt, Homo sapiens
ccugaugagauuu

SEQ ID NO: 947432 - RNA, 12 nt, Homo sapiens
ccugcaaaaaga

SEQ ID NO: 947433 - RNA, 18 nt, Homo sapiens
ccugcaauguggugacac

SEQ ID NO: 947434 - RNA, 17 nt, Homo sapiens
ccugcaggcaggaacaa

SEQ ID NO: 947435 - RNA, 16 nt, Homo sapiens
ccugcccaccaagaag

SEQ ID NO: 947436 - RNA, 20 nt, Homo sapiens
ccugccccaccccauccagc

SEQ ID NO: 947437 - RNA, 16 nt, Homo sapiens
ccuggacacucagacc

SEQ ID NO: 947438 - RNA, 15 nt, Homo sapiens
aaaaacuagagcaca

SEQ ID NO: 947439 - RNA, 21 nt, Homo sapiens
aaaaauauuuauaaaacuucu

SEQ ID NO: 947440 - RNA, 17 nt, Homo sapiens
aaaaaucccuuguucuc

SEQ ID NO: 947441 - RNA, 18 nt, Homo sapiens
aaaaaucccuuguucuca

SEQ ID NO: 947442 - RNA, 15 nt, Homo sapiens
aaaaauguccagcca

SEQ ID NO: 947443 - RNA, 21 nt, Homo sapiens
aaaacaaagccaugccaauaa

SEQ ID NO: 947444 - RNA, 11 nt, Homo sapiens
aaaacauuucu

SEQ ID NO: 947445 - RNA, 13 nt, Homo sapiens
aaaaccuacccuc

SEQ ID NO: 947446 - RNA, 21 nt, Homo sapiens
aaaacuuuggaguccccucac

SEQ ID NO: 947447 - RNA, 14 nt, Homo sapiens
aaaagacacugcag

SEQ ID NO: 947448 - RNA, 15 nt, Homo sapiens
aaaagacacugcaga

SEQ ID NO: 947449 - RNA, 23 nt, Homo sapiens
aaaagcgcucccccgucgugcuu

SEQ ID NO: 947450 - RNA, 20 nt, Homo sapiens
aaaaggguacagaugugcug

SEQ ID NO: 947451 - RNA, 21 nt, Homo sapiens
aaaaggucugaggacugagcc

SEQ ID NO: 947452 - RNA, 19 nt, Homo sapiens
aaaagguuuucuucauuca

SEQ ID NO: 947453 - RNA, 15 nt, Homo sapiens
aaaaguagaaaggag

SEQ ID NO: 947454 - RNA, 18 nt, Homo sapiens
aaaauaaaauacuuugag

SEQ ID NO: 947455 - RNA, 16 nt, Homo sapiens
aaaauaaacacuacag

SEQ ID NO: 947456 - RNA, 14 nt, Homo sapiens
aaaauacuguucuu

SEQ ID NO: 947457 - RNA, 13 nt, Homo sapiens
aaaaucaaaugug

SEQ ID NO: 947458 - RNA, 16 nt, Homo sapiens
aaaaucaaaugugcau

SEQ ID NO: 947459 - RNA, 20 nt, Homo sapiens
aaaauccaaggcaauuccug

SEQ ID NO: 947460 - RNA, 21 nt, Homo sapiens
aaaaucucccagugacaacau

SEQ ID NO: 947461 - RNA, 18 nt, Homo sapiens
aaaaugaagcugcccuaa

SEQ ID NO: 947462 - RNA, 16 nt, Homo sapiens
aaaaugagacuuucua

SEQ ID NO: 947463 - RNA, 20 nt, Homo sapiens
aaaaugcaauguaagcauac

SEQ ID NO: 947464 - RNA, 14 nt, Homo sapiens
aaaauguaugucug

SEQ ID NO: 947465 - RNA, 13 nt, Homo sapiens
aaaauucacauga

SEQ ID NO: 947466 - RNA, 19 nt, Homo sapiens
aaaauuguuuagugauauu

SEQ ID NO: 947467 - RNA, 21 nt, Homo sapiens
aaaauuuacaauuugacauac

SEQ ID NO: 947468 - RNA, 19 nt, Homo sapiens
aaacaauucuuauugacuc

SEQ ID NO: 947469 - RNA, 13 nt, Homo sapiens
aaacacacuacua

SEQ ID NO: 947470 - RNA, 16 nt, Homo sapiens
aaacagcuaguagaca

SEQ ID NO: 947471 - RNA, 17 nt, Homo sapiens
aaacaguggcucauaaa

SEQ ID NO: 947472 - RNA, 16 nt, Homo sapiens
aaaccaacaggcuacc

SEQ ID NO: 947473 - RNA, 16 nt, Homo sapiens
aaaccaggugcaauua

SEQ ID NO: 947474 - RNA, 14 nt, Homo sapiens
aaaccauaacugac

SEQ ID NO: 947475 - RNA, 18 nt, Homo sapiens
aaaccauguagcagugag

SEQ ID NO: 947476 - RNA, 20 nt, Homo sapiens
aaaccccaucuuuacuaaaa

SEQ ID NO: 947477 - RNA, 18 nt, Homo sapiens
aaaccuacccucagugag

SEQ ID NO: 947478 - RNA, 22 nt, Homo sapiens
aaaccuggcaagucaccugcag

SEQ ID NO: 947479 - RNA, 13 nt, Homo sapiens
aaaccuuugcaaa

SEQ ID NO: 947480 - RNA, 17 nt, Homo sapiens
aaacggaggccagagag

SEQ ID NO: 947481 - RNA, 20 nt, Homo sapiens
aaacguggcaggacuuccau

SEQ ID NO: 947482 - RNA, 14 nt, Homo sapiens
aaacuacaucucca

SEQ ID NO: 947483 - RNA, 12 nt, Homo sapiens
aaacucaucuga

SEQ ID NO: 947484 - RNA, 21 nt, Homo sapiens
aaacuucauauguaaucucua

SEQ ID NO: 947485 - RNA, 23 nt, Homo sapiens
aaagaaaaauaucuuggccuaaa

SEQ ID NO: 947486 - RNA, 17 nt, Homo sapiens
aaagaacguggucagag

SEQ ID NO: 947487 - RNA, 17 nt, Homo sapiens
aaagacaggcaaacggc

SEQ ID NO: 947488 - RNA, 17 nt, Homo sapiens
aaagacugauuaccucc

SEQ ID NO: 947489 - RNA, 22 nt, Homo sapiens
aaagaggcugccccucucacca

SEQ ID NO: 947490 - RNA, 14 nt, Homo sapiens
aaagcaaguguuca

SEQ ID NO: 947491 - RNA, 21 nt, Homo sapiens
aaagcauauuggugcuagaaa

SEQ ID NO: 947492 - RNA, 23 nt, Homo sapiens
aaagcauuuuguaauaauaaaga

SEQ ID NO: 947493 - RNA, 15 nt, Homo sapiens
aaaggauuuuaccaa

SEQ ID NO: 947494 - RNA, 18 nt, Homo sapiens
aaaggauuuuaccaaagc

SEQ ID NO: 947495 - RNA, 20 nt, Homo sapiens
aaaggauuuuaccaaagcau

SEQ ID NO: 947496 - RNA, 19 nt, Homo sapiens
uccauugcauucauguacu

SEQ ID NO: 947497 - RNA, 14 nt, Homo sapiens
uccauuucugcuca

SEQ ID NO: 947498 - RNA, 16 nt, Homo sapiens
ucccaaagcagugcau

SEQ ID NO: 947499 - RNA, 16 nt, Homo sapiens
ucccaacaagugcucu

SEQ ID NO: 947500 - RNA, 22 nt, Homo sapiens
ucccaacaagugcucuuuccac

SEQ ID NO: 947501 - RNA, 13 nt, Homo sapiens
ucccaagacugcu

SEQ ID NO: 947502 - RNA, 15 nt, Homo sapiens
ucccaagacugcucc

SEQ ID NO: 947503 - RNA, 15 nt, Homo sapiens
ucccaagaugcagaa

SEQ ID NO: 947504 - RNA, 17 nt, Homo sapiens
ucccaaggaaaauggac

SEQ ID NO: 947505 - RNA, 15 nt, Homo sapiens
ucccagcucacugca

SEQ ID NO: 947506 - RNA, 19 nt, Homo sapiens
ucccaggggacaugaguaa

SEQ ID NO: 947507 - RNA, 21 nt, Homo sapiens
ucccauggaaugcagcaguaa

SEQ ID NO: 947508 - RNA, 12 nt, Homo sapiens
uccccaauucau

SEQ ID NO: 947509 - RNA, 15 nt, Homo sapiens
uccccaugucaccac

SEQ ID NO: 947510 - RNA, 15 nt, Homo sapiens
ucccuaaaaauucca

SEQ ID NO: 947511 - RNA, 12 nt, Homo sapiens
ucccuggcuuga

SEQ ID NO: 947512 - RNA, 21 nt, Homo sapiens
ucccuguaaugcacuccugcc

SEQ ID NO: 947513 - RNA, 18 nt, Homo sapiens
ucccuuaaaucaugguau

SEQ ID NO: 947514 - RNA, 15 nt, Homo sapiens
ucccuuucacacugu

SEQ ID NO: 947515 - RNA, 23 nt, Homo sapiens
uccgcauacaggcguacacaugc

SEQ ID NO: 947516 - RNA, 16 nt, Homo sapiens
uccgugacagcacuuu

SEQ ID NO: 947517 - RNA, 14 nt, Homo sapiens
uccuauuugcacac

SEQ ID NO: 947518 - RNA, 21 nt, Homo sapiens
uccucaaagggugccuucuag

SEQ ID NO: 947519 - RNA, 19 nt, Homo sapiens
uccucaaugaaugggaugu

SEQ ID NO: 947520 - RNA, 14 nt, Homo sapiens
uccucacauucaca

SEQ ID NO: 947521 - RNA, 16 nt, Homo sapiens
uccuccagcuccugcc

SEQ ID NO: 947522 - RNA, 19 nt, Homo sapiens
uccuccccucuccuagcag

SEQ ID NO: 947523 - RNA, 15 nt, Homo sapiens
uccucugcuugucau

SEQ ID NO: 947524 - RNA, 23 nt, Homo sapiens
uccucugcuugucauucugcuaa

SEQ ID NO: 947525 - RNA, 19 nt, Homo sapiens
uccugugaugucaugaaag

SEQ ID NO: 947526 - RNA, 17 nt, Homo sapiens
uccuguggaaauaugca

SEQ ID NO: 947527 - RNA, 23 nt, Homo sapiens
uccuucccgcagcaccagccuga

SEQ ID NO: 947528 - RNA, 14 nt, Homo sapiens
uccuucuccuccac

SEQ ID NO: 947529 - RNA, 16 nt, Homo sapiens
uccuugccucugcucu

SEQ ID NO: 947530 - RNA, 11 nt, Homo sapiens
uccuugucauu

SEQ ID NO: 947531 - RNA, 14 nt, Homo sapiens
uccuuucccagaaa

SEQ ID NO: 947532 - RNA, 20 nt, Homo sapiens
uccuuugguuaguguacuuu

SEQ ID NO: 947533 - RNA, 20 nt, Homo sapiens
uccuuuugcuucaucuggag

SEQ ID NO: 947534 - RNA, 16 nt, Homo sapiens
ucgaguccaaaaucau

SEQ ID NO: 947535 - RNA, 18 nt, Homo sapiens
ucggaaauacacuacaaa

SEQ ID NO: 947536 - RNA, 20 nt, Homo sapiens
ucggggcaggaagucccuga

SEQ ID NO: 947537 - RNA, 18 nt, Homo sapiens
ucguacuuucacaucucu

SEQ ID NO: 947538 - RNA, 15 nt, Homo sapiens
ucgucucuuuacaga

SEQ ID NO: 947539 - RNA, 18 nt, Homo sapiens
ucguuucacaucuguaua

SEQ ID NO: 947540 - RNA, 14 nt, Homo sapiens
ucuaaaaaauaacu

SEQ ID NO: 947541 - RNA, 19 nt, Homo sapiens
ucuaagaaauccagcuuca

SEQ ID NO: 947542 - RNA, 18 nt, Homo sapiens
ucuaagcuuauuucuaac

SEQ ID NO: 947543 - RNA, 11 nt, Homo sapiens
ucuaauaaccu

SEQ ID NO: 947544 - RNA, 11 nt, Homo sapiens
ucuaccaagcu

SEQ ID NO: 947545 - RNA, 15 nt, Homo sapiens
ucuagagaacaugcc

SEQ ID NO: 947546 - RNA, 18 nt, Homo sapiens
ucuaggcuaccagaagag

SEQ ID NO: 947547 - RNA, 21 nt, Homo sapiens
ucuagugauugugagugccuu

SEQ ID NO: 947548 - RNA, 18 nt, Homo sapiens
ucuaucuucauguacuca

SEQ ID NO: 947549 - RNA, 23 nt, Homo sapiens
ucuaugaacuagagacucuguga

SEQ ID NO: 947550 - RNA, 15 nt, Homo sapiens
ucuauuacaccuuua

SEQ ID NO: 947551 - RNA, 15 nt, Homo sapiens
ucuauuuuauaaggg

SEQ ID NO: 947552 - RNA, 13 nt, Homo sapiens
ucucauaccucug

SEQ ID NO: 947553 - RNA, 18 nt, Homo sapiens
ucucauaccucugggaaa

SEQ ID NO: 947554 - RNA, 21 nt, Homo sapiens
ucuccacugucauaaucucuu

SEQ ID NO: 947555 - RNA, 21 nt, Homo sapiens
ucuccagccaauuucaaagaa

SEQ ID NO: 947556 - RNA, 20 nt, Homo sapiens
ucuccauccuuaacugucca

SEQ ID NO: 947557 - RNA, 19 nt, Homo sapiens
ucucccaacaagugcucuu

SEQ ID NO: 947558 - RNA, 21 nt, Homo sapiens
ucucccccagacgccugauau

SEQ ID NO: 947559 - RNA, 15 nt, Homo sapiens
ucucccuucuccuga

SEQ ID NO: 947560 - RNA, 14 nt, Homo sapiens
ucucucgugauuga

SEQ ID NO: 947561 - RNA, 16 nt, Homo sapiens
ucucugucuggcugua

SEQ ID NO: 947562 - RNA, 12 nt, Homo sapiens
ucucuugauuca

SEQ ID NO: 947563 - RNA, 24 nt, Homo sapiens
ucugaaaauauuuuuuucuagcua

SEQ ID NO: 947564 - RNA, 19 nt, Homo sapiens
ucugaaaucuacaacauaa

SEQ ID NO: 947565 - RNA, 15 nt, Homo sapiens
ucugagugaauguua

SEQ ID NO: 947566 - RNA, 15 nt, Homo sapiens
ucugcucugugcacu

SEQ ID NO: 947567 - RNA, 13 nt, Homo sapiens
ucugcugagcucu

SEQ ID NO: 947568 - RNA, 12 nt, Homo sapiens
ucuguagcaccu

SEQ ID NO: 947569 - RNA, 15 nt, Homo sapiens
ucuguauaucagcuc

SEQ ID NO: 947570 - RNA, 20 nt, Homo sapiens
ucugucauaauuaaaucaua

SEQ ID NO: 947571 - RNA, 14 nt, Homo sapiens
ucugucuuguaaua

SEQ ID NO: 947572 - RNA, 21 nt, Homo sapiens
ucugugcaaggaaauuugcaa

SEQ ID NO: 947573 - RNA, 14 nt, Homo sapiens
ucuguggcugccau

SEQ ID NO: 947574 - RNA, 17 nt, Homo sapiens
ucuguguaaucucugau

SEQ ID NO: 947575 - RNA, 18 nt, Homo sapiens
ucuguuugauacaguauu

SEQ ID NO: 947576 - RNA, 18 nt, Homo sapiens
ucuuacaguguuuggaca

SEQ ID NO: 947577 - RNA, 13 nt, Homo sapiens
ucuucaacuaauu

SEQ ID NO: 947578 - RNA, 21 nt, Homo sapiens
ucuucagaauauggacaaaga

SEQ ID NO: 947579 - RNA, 17 nt, Homo sapiens
ucuuccagcccagacau

SEQ ID NO: 947580 - RNA, 19 nt, Homo sapiens
ucuuccaucaugggguuca

SEQ ID NO: 947581 - RNA, 20 nt, Homo sapiens
ucuuccuaccaaauauaaac

SEQ ID NO: 947582 - RNA, 14 nt, Homo sapiens
ucuugaagaauauu

SEQ ID NO: 947583 - RNA, 19 nt, Homo sapiens
ucuugaucagacauucaga

SEQ ID NO: 947584 - RNA, 17 nt, Homo sapiens
ucuugauucauaaugac

SEQ ID NO: 947585 - RNA, 22 nt, Homo sapiens
ucuuuaaaauguauuuuucaca

SEQ ID NO: 947586 - RNA, 18 nt, Homo sapiens
ucuuuaacauacaucuaa

SEQ ID NO: 947587 - RNA, 14 nt, Homo sapiens
ucuuuaaucaaaag

SEQ ID NO: 947588 - RNA, 19 nt, Homo sapiens
ucuuuacugggucuaaagg

SEQ ID NO: 947589 - RNA, 16 nt, Homo sapiens
ucuuuccuauuugcac

SEQ ID NO: 947590 - RNA, 21 nt, Homo sapiens
ucuuucuauguagaacuguuc

SEQ ID NO: 947591 - RNA, 18 nt, Homo sapiens
ucuuucucuucccaugca

SEQ ID NO: 947592 - RNA, 13 nt, Homo sapiens
ucuuugcagugaa

SEQ ID NO: 947593 - RNA, 22 nt, Homo sapiens
ucuuuucaaaauaauuagcuau

SEQ ID NO: 947594 - RNA, 19 nt, Homo sapiens
ucuuuugaaagaugguaau

SEQ ID NO: 947595 - RNA, 17 nt, Homo sapiens
ugaaaaaauaacacugu

SEQ ID NO: 947596 - RNA, 14 nt, Homo sapiens
ugaaacaaaacugg

SEQ ID NO: 947597 - RNA, 15 nt, Homo sapiens
ugaaacuuacuaaaa

SEQ ID NO: 947598 - RNA, 14 nt, Homo sapiens
ugaaagaagucaaa

SEQ ID NO: 947599 - RNA, 16 nt, Homo sapiens
ugaaaggucaucucau

SEQ ID NO: 947600 - RNA, 15 nt, Homo sapiens
ugaaauauuugcuua

SEQ ID NO: 947601 - RNA, 15 nt, Homo sapiens
ugaaauccaaaauag

SEQ ID NO: 947602 - RNA, 15 nt, Homo sapiens
ugaacaccacuuugu

SEQ ID NO: 947603 - RNA, 23 nt, Homo sapiens
ugaacaccacuuugucucugaga

SEQ ID NO: 947604 - RNA, 13 nt, Homo sapiens
ugaagauguguaa

SEQ ID NO: 947605 - RNA, 19 nt, Homo sapiens
ugaagauuauaaaagccaa

SEQ ID NO: 947606 - RNA, 15 nt, Homo sapiens
ugaagcauccaggca

SEQ ID NO: 947607 - RNA, 19 nt, Homo sapiens
ugaaguggugugaucccag

SEQ ID NO: 947608 - RNA, 15 nt, Homo sapiens
ugaagugugcuguga

SEQ ID NO: 947609 - RNA, 16 nt, Homo sapiens
ugaauauuauacuucu

SEQ ID NO: 947610 - RNA, 18 nt, Homo sapiens
ugaaucaaagacauuuca

SEQ ID NO: 947611 - RNA, 18 nt, Homo sapiens
ugaaucuguuucuauguc

SEQ ID NO: 947612 - RNA, 15 nt, Homo sapiens
ugaaugcauguguga

SEQ ID NO: 947613 - RNA, 16 nt, Homo sapiens
ugaauguuaacaugcg

SEQ ID NO: 947614 - RNA, 12 nt, Homo sapiens
ugaauugucaau

SEQ ID NO: 947615 - RNA, 20 nt, Homo sapiens
ugaauuguuuaacccuggau

SEQ ID NO: 947616 - RNA, 18 nt, Homo sapiens
ugaauuuuaaaaugcaaa

SEQ ID NO: 947617 - RNA, 17 nt, Homo sapiens
ugacaagccaaugugaa

SEQ ID NO: 947618 - RNA, 20 nt, Homo sapiens
ugacaccccacuuagccuuu

SEQ ID NO: 947619 - RNA, 15 nt, Homo sapiens
ugacagaugauucac

SEQ ID NO: 947620 - RNA, 21 nt, Homo sapiens
ugacauauuacaacacuuuaa

SEQ ID NO: 947621 - RNA, 19 nt, Homo sapiens
ugacccuggagcccggcag

SEQ ID NO: 947622 - RNA, 12 nt, Homo sapiens
ugacucacauag

SEQ ID NO: 947623 - RNA, 14 nt, Homo sapiens
ugacucagcacugu

SEQ ID NO: 947624 - RNA, 15 nt, Homo sapiens
ugacucaucuucuca

SEQ ID NO: 947625 - RNA, 16 nt, Homo sapiens
ugacuuaagcacacuu

SEQ ID NO: 947626 - RNA, 14 nt, Homo sapiens
ugagaaaaaaacag

SEQ ID NO: 947627 - RNA, 14 nt, Homo sapiens
ugagaaacauugcu

SEQ ID NO: 947628 - RNA, 15 nt, Homo sapiens
ugagaaaucaugccu

SEQ ID NO: 947629 - RNA, 20 nt, Homo sapiens
ugagaaauuacagguuccuu

SEQ ID NO: 947630 - RNA, 18 nt, Homo sapiens
ugagaaauugugccaaag

SEQ ID NO: 947631 - RNA, 21 nt, Homo sapiens
ugagaagaagcacgaagcagu

SEQ ID NO: 947632 - RNA, 15 nt, Homo sapiens
caaaugaaugccuuu

SEQ ID NO: 947633 - RNA, 23 nt, Homo sapiens
caaauucaaugaaucaaauccaa

SEQ ID NO: 947634 - RNA, 16 nt, Homo sapiens
caaauucucugagaug

SEQ ID NO: 947635 - RNA, 21 nt, Homo sapiens
caaauuguuaagaguaucaug

SEQ ID NO: 947636 - RNA, 23 nt, Homo sapiens
caaauuguuaagaguaucaugua

SEQ ID NO: 947637 - RNA, 22 nt, Homo sapiens
caacaaagugcuuccuuuucag

SEQ ID NO: 947638 - RNA, 17 nt, Homo sapiens
caacagggcaaccaaua

SEQ ID NO: 947639 - RNA, 16 nt, Homo sapiens
caacaggucacuugau

SEQ ID NO: 947640 - RNA, 18 nt, Homo sapiens
caacauuacaaacaaagg

SEQ ID NO: 947641 - RNA, 16 nt, Homo sapiens
caaccaaagaugcuua

SEQ ID NO: 947642 - RNA, 17 nt, Homo sapiens
caaccauagaacugucc

SEQ ID NO: 947643 - RNA, 18 nt, Homo sapiens
caaccucgcuccaacucc

SEQ ID NO: 947644 - RNA, 21 nt, Homo sapiens
caaccuguucuuccuaccaaa

SEQ ID NO: 947645 - RNA, 23 nt, Homo sapiens
caaccuguucuuccuaccaaaua

SEQ ID NO: 947646 - RNA, 19 nt, Homo sapiens
caacugcaucaagauguga

SEQ ID NO: 947647 - RNA, 23 nt, Homo sapiens
caacugcaucaagaugugacaug

SEQ ID NO: 947648 - RNA, 12 nt, Homo sapiens
caacugccaaau

SEQ ID NO: 947649 - RNA, 16 nt, Homo sapiens
caacuguauaccgugu

SEQ ID NO: 947650 - RNA, 14 nt, Homo sapiens
caacuguugccagg

SEQ ID NO: 947651 - RNA, 23 nt, Homo sapiens
caacuguuuuugaagaagggaaa

SEQ ID NO: 947652 - RNA, 13 nt, Homo sapiens
caagaacauucaa

SEQ ID NO: 947653 - RNA, 23 nt, Homo sapiens
caagagucaacaggucacuugau

SEQ ID NO: 947654 - RNA, 12 nt, Homo sapiens
caagcucuguca

SEQ ID NO: 947655 - RNA, 14 nt, Homo sapiens
caaggaaaauggac

SEQ ID NO: 947656 - RNA, 15 nt, Homo sapiens
caaggaaauuugcaa

SEQ ID NO: 947657 - RNA, 21 nt, Homo sapiens
caaggccccaccuucuaucua

SEQ ID NO: 947658 - RNA, 20 nt, Homo sapiens
caagggugcuuguggucaca

SEQ ID NO: 947659 - RNA, 15 nt, Homo sapiens
caaggucucaugacc

SEQ ID NO: 947660 - RNA, 18 nt, Homo sapiens
caagucagcacuaccucc

SEQ ID NO: 947661 - RNA, 14 nt, Homo sapiens
caagucccaucuca

SEQ ID NO: 947662 - RNA, 15 nt, Homo sapiens
caagucuugagcaau

SEQ ID NO: 947663 - RNA, 21 nt, Homo sapiens
caagugugcauuaccacacuc

SEQ ID NO: 947664 - RNA, 12 nt, Homo sapiens
caaguucauuca

SEQ ID NO: 947665 - RNA, 14 nt, Homo sapiens
caaguuuagugcau

SEQ ID NO: 947666 - RNA, 16 nt, Homo sapiens
caaguuucaaugguga

SEQ ID NO: 947667 - RNA, 17 nt, Homo sapiens
caauaaaagugucacua

SEQ ID NO: 947668 - RNA, 23 nt, Homo sapiens
caauaaaccagugaacaguguga

SEQ ID NO: 947669 - RNA, 13 nt, Homo sapiens
caauacagucuag

SEQ ID NO: 947670 - RNA, 13 nt, Homo sapiens
caauaggugaucu

SEQ ID NO: 947671 - RNA, 19 nt, Homo sapiens
caaugaaauauuugcuuau

SEQ ID NO: 947672 - RNA, 18 nt, Homo sapiens
caauguggcaguccugug

SEQ ID NO: 947673 - RNA, 19 nt, Homo sapiens
caauuacaggaaguacugg

SEQ ID NO: 947674 - RNA, 19 nt, Homo sapiens
caauucaguuuuaguuuca

SEQ ID NO: 947675 - RNA, 20 nt, Homo sapiens
caauuccucugugcucuccu

SEQ ID NO: 947676 - RNA, 23 nt, Homo sapiens
caauuuuaaaaaauaacauauuc

SEQ ID NO: 947677 - RNA, 12 nt, Homo sapiens
cacaaaaugcaa

SEQ ID NO: 947678 - RNA, 17 nt, Homo sapiens
cacaagcuaggccaaug

SEQ ID NO: 947679 - RNA, 15 nt, Homo sapiens
cacaauauccaauga

SEQ ID NO: 947680 - RNA, 13 nt, Homo sapiens
cacacacaugcac

SEQ ID NO: 947681 - RNA, 15 nt, Homo sapiens
cacacacaugcacac

SEQ ID NO: 947682 - RNA, 14 nt, Homo sapiens
cacacaugcauccu

SEQ ID NO: 947683 - RNA, 14 nt, Homo sapiens
cacacccauucaca

SEQ ID NO: 947684 - RNA, 14 nt, Homo sapiens
cacacguccauguu

SEQ ID NO: 947685 - RNA, 18 nt, Homo sapiens
cacacugcacacaugcac

SEQ ID NO: 947686 - RNA, 20 nt, Homo sapiens
cacacugcacacaugcacac

SEQ ID NO: 947687 - RNA, 14 nt, Homo sapiens
cacagaaucuccau

SEQ ID NO: 947688 - RNA, 13 nt, Homo sapiens
cacagagaccccc

SEQ ID NO: 947689 - RNA, 20 nt, Homo sapiens
cacagaucacacacaugcac

SEQ ID NO: 947690 - RNA, 21 nt, Homo sapiens
cacagauggaaucuuguuuaa

SEQ ID NO: 947691 - RNA, 16 nt, Homo sapiens
cacagcacaugcacac

SEQ ID NO: 947692 - RNA, 20 nt, Homo sapiens
cacagcacuaacacaugcac

SEQ ID NO: 947693 - RNA, 23 nt, Homo sapiens
cacagcuaacauggaaguacuau

SEQ ID NO: 947694 - RNA, 12 nt, Homo sapiens
cacagcugugag

SEQ ID NO: 947695 - RNA, 21 nt, Homo sapiens
cacauacacaagugcacagac

SEQ ID NO: 947696 - RNA, 20 nt, Homo sapiens
cacauugaaaaauguccaca

SEQ ID NO: 947697 - RNA, 15 nt, Homo sapiens
cacauuuaacgacag

SEQ ID NO: 947698 - RNA, 21 nt, Homo sapiens
caccaaauacuuucugagaug

SEQ ID NO: 947699 - RNA, 15 nt, Homo sapiens
caccacuuugucucu

SEQ ID NO: 947700 - RNA, 20 nt, Homo sapiens
caccacuuugucucugagaa

SEQ ID NO: 947701 - RNA, 15 nt, Homo sapiens
caccagcugccaaaa

SEQ ID NO: 947702 - RNA, 14 nt, Homo sapiens
caccagguccugug

SEQ ID NO: 947703 - RNA, 17 nt, Homo sapiens
cacccucuccuugucac

SEQ ID NO: 947704 - RNA, 18 nt, Homo sapiens
cacccucuccuugucaca

SEQ ID NO: 947705 - RNA, 14 nt, Homo sapiens
caccugaaacacuu

SEQ ID NO: 947706 - RNA, 17 nt, Homo sapiens
caccugcucuuuccucc

SEQ ID NO: 947707 - RNA, 17 nt, Homo sapiens
caccuguucuuuccucc

SEQ ID NO: 947708 - RNA, 17 nt, Homo sapiens
cacgggguuacacuguu

SEQ ID NO: 947709 - RNA, 13 nt, Homo sapiens
cacggucuucaca

SEQ ID NO: 947710 - RNA, 16 nt, Homo sapiens
cacuacagaucuccca

SEQ ID NO: 947711 - RNA, 14 nt, Homo sapiens
cacuagaagcacag

SEQ ID NO: 947712 - RNA, 17 nt, Homo sapiens
cacuaugggugagcaua

SEQ ID NO: 947713 - RNA, 17 nt, Homo sapiens
cacucagcaccacucaa

SEQ ID NO: 947714 - RNA, 18 nt, Homo sapiens
cacucuuguugugcucuu

SEQ ID NO: 947715 - RNA, 19 nt, Homo sapiens
cacucuuguugugcucuuu

SEQ ID NO: 947716 - RNA, 20 nt, Homo sapiens
cacugaaaccucuguucuca

SEQ ID NO: 947717 - RNA, 15 nt, Homo sapiens
cacugaacaugcuca

SEQ ID NO: 947718 - RNA, 12 nt, Homo sapiens
cacugcacacau

SEQ ID NO: 947719 - RNA, 20 nt, Homo sapiens
cacugccugcagcugagauu

SEQ ID NO: 947720 - RNA, 17 nt, Homo sapiens
cacuggcuuuacauggg

SEQ ID NO: 947721 - RNA, 18 nt, Homo sapiens
cacuguauguguugcacg

SEQ ID NO: 947722 - RNA, 23 nt, Homo sapiens
cacuguuuuauuuuaauucaguu

SEQ ID NO: 947723 - RNA, 21 nt, Homo sapiens
cacuuaaagccuuuuccugaa

SEQ ID NO: 947724 - RNA, 17 nt, Homo sapiens
cacuugcaaaugaaugc

SEQ ID NO: 947725 - RNA, 20 nt, Homo sapiens
cacuuuaccuucagcaguua

SEQ ID NO: 947726 - RNA, 15 nt, Homo sapiens
cacuuuccuguugca

SEQ ID NO: 947727 - RNA, 17 nt, Homo sapiens
cacuuuuccccaauuca

SEQ ID NO: 947728 - RNA, 18 nt, Homo sapiens
cacuuuuccccaauucau

SEQ ID NO: 947729 - RNA, 18 nt, Homo sapiens
cacuuuuuguuguucauu

SEQ ID NO: 947730 - RNA, 20 nt, Homo sapiens
cacuuuuuguuguucauuau

SEQ ID NO: 947731 - RNA, 22 nt, Homo sapiens
cagaaaaaaauaaaaacauaaa

SEQ ID NO: 947732 - RNA, 15 nt, Homo sapiens
cagaaaaccuguuca

SEQ ID NO: 947733 - RNA, 13 nt, Homo sapiens
cagaaaagacacu

SEQ ID NO: 947734 - RNA, 23 nt, Homo sapiens
cagaaauugaccugauuuccauu

SEQ ID NO: 947735 - RNA, 14 nt, Homo sapiens
cagaacuccuuucu

SEQ ID NO: 947736 - RNA, 17 nt, Homo sapiens
cagaauacaauucaguu

SEQ ID NO: 947737 - RNA, 17 nt, Homo sapiens
cagaauauggacaaaga

SEQ ID NO: 947738 - RNA, 16 nt, Homo sapiens
cagacauccugugaug

SEQ ID NO: 947739 - RNA, 13 nt, Homo sapiens
cagacgugugaga

SEQ ID NO: 947740 - RNA, 15 nt, Homo sapiens
cagagacccccgugc

SEQ ID NO: 947741 - RNA, 15 nt, Homo sapiens
cagagagaccugcug

SEQ ID NO: 947742 - RNA, 14 nt, Homo sapiens
cagagccauccacc

SEQ ID NO: 947743 - RNA, 20 nt, Homo sapiens
cagagcucagcacagccuca

SEQ ID NO: 947744 - RNA, 13 nt, Homo sapiens
cagagcugagucg

SEQ ID NO: 947745 - RNA, 22 nt, Homo sapiens
cagaggcucagacucacuguua

SEQ ID NO: 947746 - RNA, 23 nt, Homo sapiens
cagaggguggagaugucagucug

SEQ ID NO: 947747 - RNA, 14 nt, Homo sapiens
cagaugauccauuu

SEQ ID NO: 947748 - RNA, 14 nt, Homo sapiens
cagauucagucuug

SEQ ID NO: 947749 - RNA, 15 nt, Homo sapiens
cagauuccccaggaa

SEQ ID NO: 947750 - RNA, 12 nt, Homo sapiens
cagauugcugca

SEQ ID NO: 947751 - RNA, 14 nt, Homo sapiens
cagcacacucccga

SEQ ID NO: 947752 - RNA, 14 nt, Homo sapiens
cagcacagccucac

SEQ ID NO: 947753 - RNA, 14 nt, Homo sapiens
cagcacaugcacac

SEQ ID NO: 947754 - RNA, 15 nt, Homo sapiens
cagcaccagccugag

SEQ ID NO: 947755 - RNA, 17 nt, Homo sapiens
cagcacguaguuugcau

SEQ ID NO: 947756 - RNA, 22 nt, Homo sapiens
cagcacuuuccuguugcacuga

SEQ ID NO: 947757 - RNA, 16 nt, Homo sapiens
cagcagccucacugca

SEQ ID NO: 947758 - RNA, 18 nt, Homo sapiens
gcagugcagcaaccagag

SEQ ID NO: 947759 - RNA, 12 nt, Homo sapiens
gcaguugcaaug

SEQ ID NO: 947760 - RNA, 22 nt, Homo sapiens
gcauaaaucuguuagcauuauu

SEQ ID NO: 947761 - RNA, 14 nt, Homo sapiens
gcauaccacuugaa

SEQ ID NO: 947762 - RNA, 16 nt, Homo sapiens
gcauacucugugcaag

SEQ ID NO: 947763 - RNA, 16 nt, Homo sapiens
gcauaguauuggcaau

SEQ ID NO: 947764 - RNA, 12 nt, Homo sapiens
gcauagugccug

SEQ ID NO: 947765 - RNA, 15 nt, Homo sapiens
gcaucaagaugugac

SEQ ID NO: 947766 - RNA, 19 nt, Homo sapiens
gcaucauggaucaaccaag

SEQ ID NO: 947767 - RNA, 21 nt, Homo sapiens
gcaucauuuccccucccgcuu

SEQ ID NO: 947768 - RNA, 14 nt, Homo sapiens
gcaucuccauuuca

SEQ ID NO: 947769 - RNA, 17 nt, Homo sapiens
gcaucuuucucuuccca

SEQ ID NO: 947770 - RNA, 14 nt, Homo sapiens
gcaugaagcacauu

SEQ ID NO: 947771 - RNA, 16 nt, Homo sapiens
gcaugaucacagcuca

SEQ ID NO: 947772 - RNA, 18 nt, Homo sapiens
gcaugauugugaccucca

SEQ ID NO: 947773 - RNA, 14 nt, Homo sapiens
gcauggaguauuau

SEQ ID NO: 947774 - RNA, 16 nt, Homo sapiens
gcaugguuugcaugac

SEQ ID NO: 947775 - RNA, 18 nt, Homo sapiens
gcaugugcagacacucaa

SEQ ID NO: 947776 - RNA, 16 nt, Homo sapiens
gcauuaccacacucag

SEQ ID NO: 947777 - RNA, 18 nt, Homo sapiens
gcauuaccacacucagcu

SEQ ID NO: 947778 - RNA, 18 nt, Homo sapiens
gcauuccagcgucugcug

SEQ ID NO: 947779 - RNA, 12 nt, Homo sapiens
gcauugcagcuc

SEQ ID NO: 947780 - RNA, 21 nt, Homo sapiens
gcauuuuguggcugauuucaa

SEQ ID NO: 947781 - RNA, 20 nt, Homo sapiens
gccaaggcucacaugcuccu

SEQ ID NO: 947782 - RNA, 17 nt, Homo sapiens
gccacagcacucggccu

SEQ ID NO: 947783 - RNA, 23 nt, Homo sapiens
gccaccuagaaaggggcccauuc

SEQ ID NO: 947784 - RNA, 16 nt, Homo sapiens
gccagcagaacugaag

SEQ ID NO: 947785 - RNA, 18 nt, Homo sapiens
gccagggucucgucagga

SEQ ID NO: 947786 - RNA, 22 nt, Homo sapiens
ggucaccucacucagcaccacu

SEQ ID NO: 947787 - RNA, 13 nt, Homo sapiens
ggucaguugccaa

SEQ ID NO: 947788 - RNA, 10 nt, Homo sapiens
ggucaucuca

SEQ ID NO: 947789 - RNA, 22 nt, Homo sapiens
gguccacuuugguaauguguca

SEQ ID NO: 947790 - RNA, 18 nt, Homo sapiens
ggucccgaauggagucca

SEQ ID NO: 947791 - RNA, 18 nt, Homo sapiens
gguccuucuguagugcca

SEQ ID NO: 947792 - RNA, 23 nt, Homo sapiens
ggucucacucuguugaccaggcu

SEQ ID NO: 947793 - RNA, 21 nt, Homo sapiens
ggugccugugaccgggguccu

SEQ ID NO: 947794 - RNA, 16 nt, Homo sapiens
gguggccagggcucca

SEQ ID NO: 947795 - RNA, 14 nt, Homo sapiens
ggugugugaagcug

SEQ ID NO: 947796 - RNA, 17 nt, Homo sapiens
gguguuaaaaaccauua

SEQ ID NO: 947797 - RNA, 16 nt, Homo sapiens
gguguugccagcgugg

SEQ ID NO: 947798 - RNA, 13 nt, Homo sapiens
gguguugucaagu

SEQ ID NO: 947799 - RNA, 12 nt, Homo sapiens
gguuacacuguu

SEQ ID NO: 947800 - RNA, 22 nt, Homo sapiens
gguucacaaggcuuggaccugc

SEQ ID NO: 947801 - RNA, 14 nt, Homo sapiens
gguucccccaggac

SEQ ID NO: 947802 - RNA, 23 nt, Homo sapiens
gguucuuauucacugagucucau

SEQ ID NO: 947803 - RNA, 15 nt, Homo sapiens
guaaagagaugucaa

SEQ ID NO: 947804 - RNA, 12 nt, Homo sapiens
guaacuguucuu

SEQ ID NO: 947805 - RNA, 16 nt, Homo sapiens
guaagagucuguguua

SEQ ID NO: 947806 - RNA, 14 nt, Homo sapiens
guaauaacugauga

SEQ ID NO: 947807 - RNA, 12 nt, Homo sapiens
guaaucucugau

SEQ ID NO: 947808 - RNA, 21 nt, Homo sapiens
guaauuucuucccccccaaga

SEQ ID NO: 947809 - RNA, 17 nt, Homo sapiens
guacaguuauacauacc

SEQ ID NO: 947810 - RNA, 19 nt, Homo sapiens
guaccauauguagcauuaa

SEQ ID NO: 947811 - RNA, 22 nt, Homo sapiens
guacccuacccugcacauuguu

SEQ ID NO: 947812 - RNA, 19 nt, Homo sapiens
guacuauugugaccacagg

SEQ ID NO: 947813 - RNA, 15 nt, Homo sapiens
guacuuacacugaaa

SEQ ID NO: 947814 - RNA, 14 nt, Homo sapiens
guacuuucuucccu

SEQ ID NO: 947815 - RNA, 18 nt, Homo sapiens
guagcagagucauuguua

SEQ ID NO: 947816 - RNA, 13 nt, Homo sapiens
guaggaguggcug

SEQ ID NO: 947817 - RNA, 22 nt, Homo sapiens
guauaguucacuuacucuuaca

SEQ ID NO: 947818 - RNA, 12 nt, Homo sapiens
guauaucagcuc

SEQ ID NO: 947819 - RNA, 16 nt, Homo sapiens
guauccagaggugagg

SEQ ID NO: 947820 - RNA, 20 nt, Homo sapiens
guauccagucugaagauguu

SEQ ID NO: 947821 - RNA, 16 nt, Homo sapiens
guaucucuacuuuccu

SEQ ID NO: 947822 - RNA, 18 nt, Homo sapiens
guauguagacaugcacac

SEQ ID NO: 947823 - RNA, 21 nt, Homo sapiens
guauucagguaacucauuuac

SEQ ID NO: 947824 - RNA, 21 nt, Homo sapiens
guauuuauauuagagugcccu

SEQ ID NO: 947825 - RNA, 14 nt, Homo sapiens
guauuuuggcagag

SEQ ID NO: 947826 - RNA, 16 nt, Homo sapiens
guauuuuucacaaagg

SEQ ID NO: 947827 - RNA, 17 nt, Homo sapiens
gucaaagcuuugcccuu

SEQ ID NO: 947828 - RNA, 19 nt, Homo sapiens
gucaaugagguuaugagaa

SEQ ID NO: 947829 - RNA, 11 nt, Homo sapiens
gucacaugaug

SEQ ID NO: 947830 - RNA, 17 nt, Homo sapiens
gucaccagcugccaaaa

SEQ ID NO: 947831 - RNA, 16 nt, Homo sapiens
gucaucccggggccau

SEQ ID NO: 947832 - RNA, 20 nt, Homo sapiens
gucauguuucugcaguauuc

SEQ ID NO: 947833 - RNA, 15 nt, Homo sapiens
guccaauguaccaug

SEQ ID NO: 947834 - RNA, 18 nt, Homo sapiens
guccacacggucuucaca

SEQ ID NO: 947835 - RNA, 16 nt, Homo sapiens
gucccugaagugccag

SEQ ID NO: 947836 - RNA, 11 nt, Homo sapiens
gucccuggaau

SEQ ID NO: 947837 - RNA, 17 nt, Homo sapiens
gucccuuucacacugug

SEQ ID NO: 947838 - RNA, 13 nt, Homo sapiens
guccuccaaaaca

SEQ ID NO: 947839 - RNA, 20 nt, Homo sapiens
gucucccaacaagugcucuu

SEQ ID NO: 947840 - RNA, 20 nt, Homo sapiens
gucucucuaaacccaaauaa

SEQ ID NO: 947841 - RNA, 16 nt, Homo sapiens
gucugagaacucaggc

SEQ ID NO: 947842 - RNA, 16 nt, Homo sapiens
gucugcugcugugcag

SEQ ID NO: 947843 - RNA, 17 nt, Homo sapiens
gucugcuguugauucca

SEQ ID NO: 947844 - RNA, 13 nt, Homo sapiens
gucugcuuaccaa

SEQ ID NO: 947845 - RNA, 22 nt, Homo sapiens
gucugcuuuggggcuuaucaga

SEQ ID NO: 947846 - RNA, 21 nt, Homo sapiens
gucuuccuccuaaauuuccag

SEQ ID NO: 947847 - RNA, 22 nt, Homo sapiens
gucuuccuccucagucuucuca

SEQ ID NO: 947848 - RNA, 18 nt, Homo sapiens
gucuuguguacacugcuc

SEQ ID NO: 947849 - RNA, 15 nt, Homo sapiens
gucuuuagaugcuau

SEQ ID NO: 947850 - RNA, 16 nt, Homo sapiens
gucuuuuuccaaacaa

SEQ ID NO: 947851 - RNA, 16 nt, Homo sapiens
gugaaaggucaucuca

SEQ ID NO: 947852 - RNA, 23 nt, Homo sapiens
gugaaauuuacaguuacugccua

SEQ ID NO: 947853 - RNA, 21 nt, Homo sapiens
gugaauccuuuguacugauga

SEQ ID NO: 947854 - RNA, 17 nt, Homo sapiens
gugacaagccaauguga

SEQ ID NO: 947855 - RNA, 16 nt, Homo sapiens
gugaccugacaccugc

SEQ ID NO: 947856 - RNA, 14 nt, Homo sapiens
gugagcuacuuugu

SEQ ID NO: 947857 - RNA, 20 nt, Homo sapiens
gugagugacaucgguucagg

SEQ ID NO: 947858 - RNA, 12 nt, Homo sapiens
gugauguuauag

SEQ ID NO: 947859 - RNA, 14 nt, Homo sapiens
gugauuaguaugcu

SEQ ID NO: 947860 - RNA, 23 nt, Homo sapiens
gugauuuccagcuguagcauuca

SEQ ID NO: 947861 - RNA, 18 nt, Homo sapiens
gugcauaguauuggcaau

SEQ ID NO: 947862 - RNA, 23 nt, Homo sapiens
gugcauuaccacacucagcuaau

SEQ ID NO: 947863 - RNA, 20 nt, Homo sapiens
gugccuuauggaacacucug

SEQ ID NO: 947864 - RNA, 16 nt, Homo sapiens
gugcucuucuguucuc

SEQ ID NO: 947865 - RNA, 20 nt, Homo sapiens
gugcugagaauaaaaccagc

SEQ ID NO: 947866 - RNA, 21 nt, Homo sapiens
gugcugggauuacagguguga

SEQ ID NO: 947867 - RNA, 14 nt, Homo sapiens
guggaaauaugcaa

SEQ ID NO: 947868 - RNA, 13 nt, Homo sapiens
guggacagcagcu

SEQ ID NO: 947869 - RNA, 14 nt, Homo sapiens
guggacagcagcug

SEQ ID NO: 947870 - RNA, 17 nt, Homo sapiens
guggagggugcccagca

SEQ ID NO: 947871 - RNA, 19 nt, Homo sapiens
guggcucaacacaugagaa

SEQ ID NO: 947872 - RNA, 14 nt, Homo sapiens
guggcugauuucaa

SEQ ID NO: 947873 - RNA, 20 nt, Homo sapiens
guggcuuucauuucuuauua

SEQ ID NO: 947874 - RNA, 22 nt, Homo sapiens
gugguaaaaccuguucuccaua

SEQ ID NO: 947875 - RNA, 21 nt, Homo sapiens
guguacauuugauuugauaua

SEQ ID NO: 947876 - RNA, 16 nt, Homo sapiens
guguacuuucuucccu

SEQ ID NO: 947877 - RNA, 22 nt, Homo sapiens
gugugaagauuauaaaagccaa

SEQ ID NO: 947878 - RNA, 15 nt, Homo sapiens
gugugaccugacacc

SEQ ID NO: 947879 - RNA, 19 nt, Homo sapiens
gugugcauuaccacacuca

SEQ ID NO: 947880 - RNA, 11 nt, Homo sapiens
gugugccaaac

SEQ ID NO: 947881 - RNA, 17 nt, Homo sapiens
guguguagaaacacagc

SEQ ID NO: 947882 - RNA, 23 nt, Homo sapiens
guguuccuccuccccucuccuag

SEQ ID NO: 947883 - RNA, 11 nt, Homo sapiens
guguugaucag

SEQ ID NO: 947884 - RNA, 20 nt, Homo sapiens
guguugcccaggcuggucuu

SEQ ID NO: 947885 - RNA, 16 nt, Homo sapiens
guguuuugucuucaac

SEQ ID NO: 947886 - RNA, 17 nt, Homo sapiens
uagccugaaaauccaaa

SEQ ID NO: 947887 - RNA, 22 nt, Homo sapiens
uagcuauuuauguucaucuuca

SEQ ID NO: 947888 - RNA, 14 nt, Homo sapiens
uagcuguguccuca

SEQ ID NO: 947889 - RNA, 14 nt, Homo sapiens
uaggaacccggcau

SEQ ID NO: 947890 - RNA, 17 nt, Homo sapiens
uaggaagacgcagagca

SEQ ID NO: 947891 - RNA, 19 nt, Homo sapiens
uaggcaugugcaauuuguc

SEQ ID NO: 947892 - RNA, 23 nt, Homo sapiens
uaggccacacagcacaugcacac

SEQ ID NO: 947893 - RNA, 16 nt, Homo sapiens
uaggccucaguguccu

SEQ ID NO: 947894 - RNA, 15 nt, Homo sapiens
uaggcugcugcugug

SEQ ID NO: 947895 - RNA, 14 nt, Homo sapiens
uaggugugccaaac

SEQ ID NO: 947896 - RNA, 16 nt, Homo sapiens
uagguguguccacaga

SEQ ID NO: 947897 - RNA, 17 nt, Homo sapiens
uagguuucaacauauga

SEQ ID NO: 947898 - RNA, 17 nt, Homo sapiens
uaguaaagcuugcacau

SEQ ID NO: 947899 - RNA, 23 nt, Homo sapiens
uaguaaauaaugauucaauguga

SEQ ID NO: 947900 - RNA, 18 nt, Homo sapiens
uaguagcagagucauugu

SEQ ID NO: 947901 - RNA, 14 nt, Homo sapiens
uaguauaauaugca

SEQ ID NO: 947902 - RNA, 22 nt, Homo sapiens
uagucaacugcuguuuuauguc

SEQ ID NO: 947903 - RNA, 20 nt, Homo sapiens
uaguccagaaaucuauuaca

SEQ ID NO: 947904 - RNA, 18 nt, Homo sapiens
uagugcaugcaucucuuu

SEQ ID NO: 947905 - RNA, 11 nt, Homo sapiens
uaguugcaaag

SEQ ID NO: 947906 - RNA, 19 nt, Homo sapiens
uaguugcuuugcggcaucu

SEQ ID NO: 947907 - RNA, 21 nt, Homo sapiens
uaguuguugaaacaaaacugg

SEQ ID NO: 947908 - RNA, 17 nt, Homo sapiens
uaguuuuuccugugcaa

SEQ ID NO: 947909 - RNA, 17 nt, Homo sapiens
uauaaauguuucaugaa

SEQ ID NO: 947910 - RNA, 13 nt, Homo sapiens
uauaauuacuuaa

SEQ ID NO: 947911 - RNA, 14 nt, Homo sapiens
uauaauuacuuaau

SEQ ID NO: 947912 - RNA, 21 nt, Homo sapiens
uauacaucuagcacagcugug

SEQ ID NO: 947913 - RNA, 18 nt, Homo sapiens
uauacauuuaguuaacac

SEQ ID NO: 947914 - RNA, 12 nt, Homo sapiens
uauaccagcaga

SEQ ID NO: 947915 - RNA, 14 nt, Homo sapiens
uauacuaaccauuu

SEQ ID NO: 947916 - RNA, 13 nt, Homo sapiens
uauagucacauuu

SEQ ID NO: 947917 - RNA, 16 nt, Homo sapiens
uauauaacuacauuaa

SEQ ID NO: 947918 - RNA, 16 nt, Homo sapiens
uauauaucaguuugau

SEQ ID NO: 947919 - RNA, 22 nt, Homo sapiens
uauauauucucaaauugcucua

SEQ ID NO: 947920 - RNA, 22 nt, Homo sapiens
uauauauuugaaagaagucaaa

SEQ ID NO: 947921 - RNA, 14 nt, Homo sapiens
uaucaaaucauuca

SEQ ID NO: 947922 - RNA, 20 nt, Homo sapiens
uaucaaugcccaacagggca

SEQ ID NO: 947923 - RNA, 15 nt, Homo sapiens
uaucacacuugcaaa

SEQ ID NO: 947924 - RNA, 19 nt, Homo sapiens
uaucauuuggccgagucag

SEQ ID NO: 947925 - RNA, 15 nt, Homo sapiens
aauguaguugaugua

SEQ ID NO: 947926 - RNA, 17 nt, Homo sapiens
aauguauuuuucacaaa

SEQ ID NO: 947927 - RNA, 17 nt, Homo sapiens
aaugucagugugacuga

SEQ ID NO: 947928 - RNA, 22 nt, Homo sapiens
aaugugaaauaaagaguucucc

SEQ ID NO: 947929 - RNA, 16 nt, Homo sapiens
aauguuaacaugcgca

SEQ ID NO: 947930 - RNA, 16 nt, Homo sapiens
aauguuauagguuugu

SEQ ID NO: 947931 - RNA, 18 nt, Homo sapiens
aauuaaaaaauaguugca

SEQ ID NO: 947932 - RNA, 22 nt, Homo sapiens
aauuaaauuuuuaaacuaugug

SEQ ID NO: 947933 - RNA, 17 nt, Homo sapiens
aauuacuuaaugugaug

SEQ ID NO: 947934 - RNA, 23 nt, Homo sapiens
aauuacuuacucaaauucaauga

SEQ ID NO: 947935 - RNA, 20 nt, Homo sapiens
aauuagagcaagaacauuca

SEQ ID NO: 947936 - RNA, 21 nt, Homo sapiens
aauuagagcaagaacauucaa

SEQ ID NO: 947937 - RNA, 13 nt, Homo sapiens
aauuauaccauga

SEQ ID NO: 947938 - RNA, 18 nt, Homo sapiens
aauuauuacacuguaaga

SEQ ID NO: 947939 - RNA, 14 nt, Homo sapiens
aauuauucuaguca

SEQ ID NO: 947940 - RNA, 22 nt, Homo sapiens
aauuauuucagucaucaucuca

SEQ ID NO: 947941 - RNA, 22 nt, Homo sapiens
aauuauuuuaggcaaaguccau

SEQ ID NO: 947942 - RNA, 22 nt, Homo sapiens
aauucaaugaaucaaauccaau

SEQ ID NO: 947943 - RNA, 22 nt, Homo sapiens
aauucagcuuuguccaaaggaa

SEQ ID NO: 947944 - RNA, 19 nt, Homo sapiens
aauucccaucugcuuuauu

SEQ ID NO: 947945 - RNA, 16 nt, Homo sapiens
aauucuagucucugau

SEQ ID NO: 947946 - RNA, 14 nt, Homo sapiens
aauugaacugcuua

SEQ ID NO: 947947 - RNA, 21 nt, Homo sapiens
aauugaagacacguucuugcc

SEQ ID NO: 947948 - RNA, 17 nt, Homo sapiens
aauugccuaacaugugg

SEQ ID NO: 947949 - RNA, 22 nt, Homo sapiens
aauugcuucacagccuuggcca

SEQ ID NO: 947950 - RNA, 14 nt, Homo sapiens
aauuggacaauuau

SEQ ID NO: 947951 - RNA, 18 nt, Homo sapiens
aauuguuaagaguaucau

SEQ ID NO: 947952 - RNA, 15 nt, Homo sapiens
aauuuaacugcauau

SEQ ID NO: 947953 - RNA, 19 nt, Homo sapiens
aauuuaugaagauaguuua

SEQ ID NO: 947954 - RNA, 13 nt, Homo sapiens
aauuuccaugaua

SEQ ID NO: 947955 - RNA, 12 nt, Homo sapiens
aauuugaauuca

SEQ ID NO: 947956 - RNA, 15 nt, Homo sapiens
aauuugaauucaauu

SEQ ID NO: 947957 - RNA, 15 nt, Homo sapiens
aauuuuauaauguca

SEQ ID NO: 947958 - RNA, 12 nt, Homo sapiens
acaaaaugcaag

SEQ ID NO: 947959 - RNA, 23 nt, Homo sapiens
acaaagcgugguggacaugcaca

SEQ ID NO: 947960 - RNA, 17 nt, Homo sapiens
acaaagcuggguuugau

SEQ ID NO: 947961 - RNA, 15 nt, Homo sapiens
acaaaggauuugaaa

SEQ ID NO: 947962 - RNA, 18 nt, Homo sapiens
acaaagggcaggccuguu

SEQ ID NO: 947963 - RNA, 14 nt, Homo sapiens
acaaauguaaauag

SEQ ID NO: 947964 - RNA, 17 nt, Homo sapiens
acaacuguuuuugaaga

SEQ ID NO: 947965 - RNA, 14 nt, Homo sapiens
acaacuuaaugugc

SEQ ID NO: 947966 - RNA, 14 nt, Homo sapiens
acaacuuccagauu

SEQ ID NO: 947967 - RNA, 16 nt, Homo sapiens
acaacuugaauuacaa

SEQ ID NO: 947968 - RNA, 17 nt, Homo sapiens
acaagaaagcuguggcu

SEQ ID NO: 947969 - RNA, 15 nt, Homo sapiens
acaagugcucuuucc

SEQ ID NO: 947970 - RNA, 18 nt, Homo sapiens
acaauaaaaaugcugcau

SEQ ID NO: 947971 - RNA, 14 nt, Homo sapiens
acaauucaguuuua

SEQ ID NO: 947972 - RNA, 22 nt, Homo sapiens
acaauuuucaucccacaauuga

SEQ ID NO: 947973 - RNA, 15 nt, Homo sapiens
acacaagugcacaga

SEQ ID NO: 947974 - RNA, 15 nt, Homo sapiens
acacagcacaugcac

SEQ ID NO: 947975 - RNA, 12 nt, Homo sapiens
acacagcagcuc

SEQ ID NO: 947976 - RNA, 23 nt, Homo sapiens
acaccaaauucuguggcugccau

SEQ ID NO: 947977 - RNA, 15 nt, Homo sapiens
acaccuuuaucucaa

SEQ ID NO: 947978 - RNA, 18 nt, Homo sapiens
acacgcgugcaugcacac

SEQ ID NO: 947979 - RNA, 18 nt, Homo sapiens
acacgggguuacacuguu

SEQ ID NO: 947980 - RNA, 15 nt, Homo sapiens
acacguuugccaaau

SEQ ID NO: 947981 - RNA, 14 nt, Homo sapiens
acacuaccaguuuc

SEQ ID NO: 947982 - RNA, 15 nt, Homo sapiens
acacuguacugcaau

SEQ ID NO: 947983 - RNA, 14 nt, Homo sapiens
acacugucaaugag

SEQ ID NO: 947984 - RNA, 16 nt, Homo sapiens
acagaaaauagcuuuu

SEQ ID NO: 947985 - RNA, 15 nt, Homo sapiens
acagaagguugccag

SEQ ID NO: 947986 - RNA, 22 nt, Homo sapiens
acagaaucuccauuucugcuca

SEQ ID NO: 947987 - RNA, 23 nt, Homo sapiens
acagaaucuccauuucugcucag

SEQ ID NO: 947988 - RNA, 14 nt, Homo sapiens
acagagaucagaau

SEQ ID NO: 947989 - RNA, 19 nt, Homo sapiens
acagagaucagaauugaac

SEQ ID NO: 947990 - RNA, 17 nt, Homo sapiens
acagaggaccagcacac

SEQ ID NO: 947991 - RNA, 20 nt, Homo sapiens
acagaggaccagcacacucc

SEQ ID NO: 947992 - RNA, 20 nt, Homo sapiens
acagaucacacacaugcaca

SEQ ID NO: 947993 - RNA, 21 nt, Homo sapiens
acagauuuuuggagaaaggau

SEQ ID NO: 947994 - RNA, 16 nt, Homo sapiens
acagcaaauguuauag

SEQ ID NO: 947995 - RNA, 21 nt, Homo sapiens
acagcacuaacacaugcacac

SEQ ID NO: 947996 - RNA, 21 nt, Homo sapiens
acagcacuguauguguugcac

SEQ ID NO: 947997 - RNA, 20 nt, Homo sapiens
acagcacuuuccuguugcac

SEQ ID NO: 947998 - RNA, 14 nt, Homo sapiens
acagcagcuggacu

SEQ ID NO: 947999 - RNA, 17 nt, Homo sapiens
acagcaugaaccuuuag

SEQ ID NO: 948000 - RNA, 23 nt, Homo sapiens
acagccuuggccauccuggcuca

SEQ ID NO: 948001 - RNA, 14 nt, Homo sapiens
acagcuaacaugga

SEQ ID NO: 948002 - RNA, 19 nt, Homo sapiens
acagcuccuccccugcuac

SEQ ID NO: 948003 - RNA, 23 nt, Homo sapiens
acaggcaacauuacaaacaaagg

SEQ ID NO: 948004 - RNA, 17 nt, Homo sapiens
acaggguccucagcuca

SEQ ID NO: 948005 - RNA, 14 nt, Homo sapiens
acagggucucacug

SEQ ID NO: 948006 - RNA, 16 nt, Homo sapiens
acagggucucacugug

SEQ ID NO: 948007 - RNA, 13 nt, Homo sapiens
acaguauacacau

SEQ ID NO: 948008 - RNA, 18 nt, Homo sapiens
acaguauuuacugugcua

SEQ ID NO: 948009 - RNA, 21 nt, Homo sapiens
acaguauuuacugugcuaaug

SEQ ID NO: 948010 - RNA, 20 nt, Homo sapiens
acagucaggaagccuccugc

SEQ ID NO: 948011 - RNA, 15 nt, Homo sapiens
acagucauaaugugu

SEQ ID NO: 948012 - RNA, 19 nt, Homo sapiens
acagucauuuccuacccuu

SEQ ID NO: 948013 - RNA, 19 nt, Homo sapiens
acaguccaaacuguucuga

SEQ ID NO: 948014 - RNA, 22 nt, Homo sapiens
acaguccaaacuguucugagaa

SEQ ID NO: 948015 - RNA, 21 nt, Homo sapiens
acagugggccugcuggugggc

SEQ ID NO: 948016 - RNA, 13 nt, Homo sapiens
acaguugugaugu

SEQ ID NO: 948017 - RNA, 22 nt, Homo sapiens
acauaccccgaaggucuaggaa

SEQ ID NO: 948018 - RNA, 22 nt, Homo sapiens
acauaccucucucuauauauac

SEQ ID NO: 948019 - RNA, 13 nt, Homo sapiens
acauauaucugau

SEQ ID NO: 948020 - RNA, 13 nt, Homo sapiens
acaucauguaaua

SEQ ID NO: 948021 - RNA, 16 nt, Homo sapiens
acauccagaguucugu

SEQ ID NO: 948022 - RNA, 20 nt, Homo sapiens
acaugaauacgucuugauca

SEQ ID NO: 948023 - RNA, 21 nt, Homo sapiens
acaugcacacaggugcacaga

SEQ ID NO: 948024 - RNA, 18 nt, Homo sapiens
acauguacacgugcacag

SEQ ID NO: 948025 - RNA, 16 nt, Homo sapiens
acauuaggcuguggug

SEQ ID NO: 948026 - RNA, 21 nt, Homo sapiens
acauuauccauccucugagau

SEQ ID NO: 948027 - RNA, 15 nt, Homo sapiens
acauucccccaacau

SEQ ID NO: 948028 - RNA, 23 nt, Homo sapiens
acauugcaggaagagaugcucua

SEQ ID NO: 948029 - RNA, 20 nt, Homo sapiens
acauuucuaacuaaggacag

SEQ ID NO: 948030 - RNA, 20 nt, Homo sapiens
accaaauacuuucugagaug

SEQ ID NO: 948031 - RNA, 23 nt, Homo sapiens
accaacuuuaccucuucuucucc

SEQ ID NO: 948032 - RNA, 13 nt, Homo sapiens
accaagaaugucu

SEQ ID NO: 948033 - RNA, 23 nt, Homo sapiens
accaagaguguguccacugagaa

SEQ ID NO: 948034 - RNA, 14 nt, Homo sapiens
accacaagugugca

SEQ ID NO: 948035 - RNA, 22 nt, Homo sapiens
accacaagugugcauuaccaca

SEQ ID NO: 948036 - RNA, 14 nt, Homo sapiens
accacucaagacca

SEQ ID NO: 948037 - RNA, 18 nt, Homo sapiens
accagagcgugcacuugu

SEQ ID NO: 948038 - RNA, 21 nt, Homo sapiens
accagccuugaacuguggcca

SEQ ID NO: 948039 - RNA, 20 nt, Homo sapiens
accagguguuaaaaaccauu

SEQ ID NO: 948040 - RNA, 21 nt, Homo sapiens
accaguauggccccaccugcu

SEQ ID NO: 948041 - RNA, 14 nt, Homo sapiens
accaucuggcagac

SEQ ID NO: 948042 - RNA, 14 nt, Homo sapiens
acccacugcugcac

SEQ ID NO: 948043 - RNA, 20 nt, Homo sapiens
acccagguaaagucaaagcu

SEQ ID NO: 948044 - RNA, 18 nt, Homo sapiens
acccauuucuuaccaugc

SEQ ID NO: 948045 - RNA, 18 nt, Homo sapiens
accccuccaugauuccaa

SEQ ID NO: 948046 - RNA, 20 nt, Homo sapiens
accccugggggaggcuucca

SEQ ID NO: 948047 - RNA, 15 nt, Homo sapiens
acccgagaagcacuu

SEQ ID NO: 948048 - RNA, 17 nt, Homo sapiens
acccuacgaaagcacag

SEQ ID NO: 948049 - RNA, 11 nt, Homo sapiens
acccuagccuc

SEQ ID NO: 948050 - RNA, 19 nt, Homo sapiens
acccucuccuugucacaga

SEQ ID NO: 948051 - RNA, 13 nt, Homo sapiens
acccucugcugca

SEQ ID NO: 948052 - RNA, 18 nt, Homo sapiens
acccugagagucugagaa

SEQ ID NO: 948053 - RNA, 15 nt, Homo sapiens
acccuggaguggcau

SEQ ID NO: 948054 - RNA, 18 nt, Homo sapiens
acccuggauaagucacuu

SEQ ID NO: 948055 - RNA, 20 nt, Homo sapiens
acccuguaccauccauggag

SEQ ID NO: 948056 - RNA, 14 nt, Homo sapiens
accgugaacuggaa

SEQ ID NO: 948057 - RNA, 22 nt, Homo sapiens
accuaaaaauguaggcuuucau

SEQ ID NO: 948058 - RNA, 13 nt, Homo sapiens
accuagagcagag

SEQ ID NO: 948059 - RNA, 17 nt, Homo sapiens
agagggguauaggacaa

SEQ ID NO: 948060 - RNA, 21 nt, Homo sapiens
agaguaacccugucuaaugaa

SEQ ID NO: 948061 - RNA, 16 nt, Homo sapiens
agaguaucauguacua

SEQ ID NO: 948062 - RNA, 21 nt, Homo sapiens
agaguucuccuuguacuugaa

SEQ ID NO: 948063 - RNA, 13 nt, Homo sapiens
agauauggaguua

SEQ ID NO: 948064 - RNA, 22 nt, Homo sapiens
agauauuuuucagcuacagcaa

SEQ ID NO: 948065 - RNA, 19 nt, Homo sapiens
agaucacaaauaguguuga

SEQ ID NO: 948066 - RNA, 24 nt, Homo sapiens
agaucagcauucaaaauaguucua

SEQ ID NO: 948067 - RNA, 21 nt, Homo sapiens
agauccuggucugcaccucua

SEQ ID NO: 948068 - RNA, 13 nt, Homo sapiens
agauccuguccca

SEQ ID NO: 948069 - RNA, 18 nt, Homo sapiens
agauuacagucauuuccu

SEQ ID NO: 948070 - RNA, 17 nt, Homo sapiens
agauuacauuguaguua

SEQ ID NO: 948071 - RNA, 18 nt, Homo sapiens
augcaacacccucuucua

SEQ ID NO: 948072 - RNA, 11 nt, Homo sapiens
augcaguauug

SEQ ID NO: 948073 - RNA, 14 nt, Homo sapiens
augcaguccaguga

SEQ ID NO: 948074 - RNA, 17 nt, Homo sapiens
augcauuacuaucagug

SEQ ID NO: 948075 - RNA, 20 nt, Homo sapiens
augccaugaggaacaaggca

SEQ ID NO: 948076 - RNA, 22 nt, Homo sapiens
augccuaguuauucauuguuaa

SEQ ID NO: 948077 - RNA, 17 nt, Homo sapiens
augcuaugcuauggaau

SEQ ID NO: 948078 - RNA, 20 nt, Homo sapiens
augcugccaaccagcuuguc

SEQ ID NO: 948079 - RNA, 19 nt, Homo sapiens
augcugggacccucggggc

SEQ ID NO: 948080 - RNA, 17 nt, Homo sapiens
augcuuucucuccucuu

SEQ ID NO: 948081 - RNA, 22 nt, Homo sapiens
auggaaauuauuacucugucau

SEQ ID NO: 948082 - RNA, 17 nt, Homo sapiens
auggaauauacauguaa

SEQ ID NO: 948083 - RNA, 20 nt, Homo sapiens
auggaauauacauguaaaaa

SEQ ID NO: 948084 - RNA, 14 nt, Homo sapiens
auggaaugccaaaa

SEQ ID NO: 948085 - RNA, 13 nt, Homo sapiens
auggagaguucag

SEQ ID NO: 948086 - RNA, 20 nt, Homo sapiens
auggauccgugacagcacuu

SEQ ID NO: 948087 - RNA, 16 nt, Homo sapiens
auggccccaccugcuc

SEQ ID NO: 948088 - RNA, 16 nt, Homo sapiens
augggggcuccuggca

SEQ ID NO: 948089 - RNA, 15 nt, Homo sapiens
auggugcugcucugu

SEQ ID NO: 948090 - RNA, 18 nt, Homo sapiens
auguaccauguugcccag

SEQ ID NO: 948091 - RNA, 20 nt, Homo sapiens
auguagaauuauaacuaauu

SEQ ID NO: 948092 - RNA, 16 nt, Homo sapiens
auguaguugauguauc

SEQ ID NO: 948093 - RNA, 13 nt, Homo sapiens
auguauccaacaa

SEQ ID NO: 948094 - RNA, 17 nt, Homo sapiens
augucuguucuaagucc

SEQ ID NO: 948095 - RNA, 18 nt, Homo sapiens
augucuguucuaagucca

SEQ ID NO: 948096 - RNA, 17 nt, Homo sapiens
augugcuaguccaugac

SEQ ID NO: 948097 - RNA, 14 nt, Homo sapiens
auguggacuuuuac

SEQ ID NO: 948098 - RNA, 15 nt, Homo sapiens
auguggacuuuuaca

SEQ ID NO: 948099 - RNA, 17 nt, Homo sapiens
auguggcacacaauccu

SEQ ID NO: 948100 - RNA, 17 nt, Homo sapiens
augugguugauaaugau

SEQ ID NO: 948101 - RNA, 14 nt, Homo sapiens
auguguuuccauau

SEQ ID NO: 948102 - RNA, 14 nt, Homo sapiens
auguuaucagucuc

SEQ ID NO: 948103 - RNA, 23 nt, Homo sapiens
auguugcaaagaacuccagaguc

SEQ ID NO: 948104 - RNA, 16 nt, Homo sapiens
auguuuauccauguac

SEQ ID NO: 948105 - RNA, 20 nt, Homo sapiens
auuaaaccaaggagucugau

SEQ ID NO: 948106 - RNA, 17 nt, Homo sapiens
auuaaucucuaaaauuc

SEQ ID NO: 948107 - RNA, 15 nt, Homo sapiens
auuaaugacauauug

SEQ ID NO: 948108 - RNA, 17 nt, Homo sapiens
auuacaaccgguuauca

SEQ ID NO: 948109 - RNA, 18 nt, Homo sapiens
auuacaccuuuaucucaa

SEQ ID NO: 948110 - RNA, 14 nt, Homo sapiens
auuaguauccuguu

SEQ ID NO: 948111 - RNA, 22 nt, Homo sapiens
auuaguuguauuuugugcaagc

SEQ ID NO: 948112 - RNA, 14 nt, Homo sapiens
auuaguuucaggca

SEQ ID NO: 948113 - RNA, 15 nt, Homo sapiens
auuaguuucaggcaa

SEQ ID NO: 948114 - RNA, 18 nt, Homo sapiens
auuauagucuguacuuca

SEQ ID NO: 948115 - RNA, 20 nt, Homo sapiens
auuaucaaagcauugcugag

SEQ ID NO: 948116 - RNA, 18 nt, Homo sapiens
auuaugcccuugagucua

SEQ ID NO: 948117 - RNA, 13 nt, Homo sapiens
auuauguauaaca

SEQ ID NO: 948118 - RNA, 15 nt, Homo sapiens
auuauuuugauugau

SEQ ID NO: 948119 - RNA, 17 nt, Homo sapiens
auucaauucugauucca

SEQ ID NO: 948120 - RNA, 22 nt, Homo sapiens
auucauaaaaauaaccaaaaaa

SEQ ID NO: 948121 - RNA, 17 nt, Homo sapiens
auucauuuaagaacaag

SEQ ID NO: 948122 - RNA, 18 nt, Homo sapiens
auucauuuacaacuucca

SEQ ID NO: 948123 - RNA, 11 nt, Homo sapiens
auucauuucau

SEQ ID NO: 948124 - RNA, 14 nt, Homo sapiens
auucuaaaacauuc

SEQ ID NO: 948125 - RNA, 14 nt, Homo sapiens
auucuauguuauca

SEQ ID NO: 948126 - RNA, 17 nt, Homo sapiens
auucugaucaguugcca

SEQ ID NO: 948127 - RNA, 18 nt, Homo sapiens
auucuguagccaacuuaa

SEQ ID NO: 948128 - RNA, 15 nt, Homo sapiens
auucugugcauaaaa

SEQ ID NO: 948129 - RNA, 22 nt, Homo sapiens
auucuuuuauauaacuacauua

SEQ ID NO: 948130 - RNA, 19 nt, Homo sapiens
auugagaaauaaagcacau

SEQ ID NO: 948131 - RNA, 15 nt, Homo sapiens
auugcuuuagacaaa

SEQ ID NO: 948132 - RNA, 22 nt, Homo sapiens
auugcuuuagacaaauuguuaa

SEQ ID NO: 948133 - RNA, 19 nt, Homo sapiens
auuggccugguauggcugc

SEQ ID NO: 948134 - RNA, 18 nt, Homo sapiens
auugguaauuaaggcauc

SEQ ID NO: 948135 - RNA, 18 nt, Homo sapiens
auuguacauuuuuuacuu

SEQ ID NO: 948136 - RNA, 15 nt, Homo sapiens
auugucaauauauua

SEQ ID NO: 948137 - RNA, 18 nt, Homo sapiens
auugucugcugccuccaa

SEQ ID NO: 948138 - RNA, 18 nt, Homo sapiens
auuguuacagguguacua

SEQ ID NO: 948139 - RNA, 21 nt, Homo sapiens
auuguuacagguguacuaugg

SEQ ID NO: 948140 - RNA, 14 nt, Homo sapiens
auuguuagucucuu

SEQ ID NO: 948141 - RNA, 17 nt, Homo sapiens
auuguuaugcacuuuuc

SEQ ID NO: 948142 - RNA, 15 nt, Homo sapiens
auuuaaaaagcccaa

SEQ ID NO: 948143 - RNA, 13 nt, Homo sapiens
auuuaaaaaucuu

SEQ ID NO: 948144 - RNA, 18 nt, Homo sapiens
auuuaaaggaaaguucua

SEQ ID NO: 948145 - RNA, 14 nt, Homo sapiens
auuuaacugcauau

SEQ ID NO: 948146 - RNA, 17 nt, Homo sapiens
auuuaagaaaaaucaua

SEQ ID NO: 948147 - RNA, 16 nt, Homo sapiens
auuuaauauacugcau

SEQ ID NO: 948148 - RNA, 16 nt, Homo sapiens
auuuaauuguguaacu

SEQ ID NO: 948149 - RNA, 19 nt, Homo sapiens
auuuacaagcaucauggau

SEQ ID NO: 948150 - RNA, 17 nt, Homo sapiens
auuuacaguuacugccu

SEQ ID NO: 948151 - RNA, 13 nt, Homo sapiens
auuuaccaaaaaa

SEQ ID NO: 948152 - RNA, 18 nt, Homo sapiens
auuuagcccauaaucucu

SEQ ID NO: 948153 - RNA, 14 nt, Homo sapiens
auuuauaagcuagc

SEQ ID NO: 948154 - RNA, 17 nt, Homo sapiens
auuuauucauguguaca

SEQ ID NO: 948155 - RNA, 20 nt, Homo sapiens
auuuauucauguguacagaa

SEQ ID NO: 948156 - RNA, 22 nt, Homo sapiens
auuucaaaugcaguccagugag

SEQ ID NO: 948157 - RNA, 21 nt, Homo sapiens
auuucaauaguacccaaccaa

SEQ ID NO: 948158 - RNA, 13 nt, Homo sapiens
auuucaaugauug

SEQ ID NO: 948159 - RNA, 19 nt, Homo sapiens
auuucacgggcaacacuca

SEQ ID NO: 948160 - RNA, 16 nt, Homo sapiens
auuuccaugauacaaa

SEQ ID NO: 948161 - RNA, 16 nt, Homo sapiens
auuucuaucugcaaau

SEQ ID NO: 948162 - RNA, 16 nt, Homo sapiens
auuucucuuccuaaau

SEQ ID NO: 948163 - RNA, 13 nt, Homo sapiens
auuucugcucaga

SEQ ID NO: 948164 - RNA, 16 nt, Homo sapiens
auuucuuaccaugcau

SEQ ID NO: 948165 - RNA, 19 nt, Homo sapiens
auuugaauucaauucugau

SEQ ID NO: 948166 - RNA, 16 nt, Homo sapiens
auuugacucagcacug

SEQ ID NO: 948167 - RNA, 14 nt, Homo sapiens
auuugauauacaga

SEQ ID NO: 948168 - RNA, 13 nt, Homo sapiens
auuugcauauuca

SEQ ID NO: 948169 - RNA, 13 nt, Homo sapiens
auuugccauagca

SEQ ID NO: 948170 - RNA, 16 nt, Homo sapiens
auuugugauacuuccu

SEQ ID NO: 948171 - RNA, 17 nt, Homo sapiens
auuugugauacuuccuc

SEQ ID NO: 948172 - RNA, 22 nt, Homo sapiens
auuuuagcacaaagaugugcaa

SEQ ID NO: 948173 - RNA, 23 nt, Homo sapiens
auuuuagcacaaagaugugcaaa

SEQ ID NO: 948174 - RNA, 23 nt, Homo sapiens
auuuuaucacuugccgugucauc

SEQ ID NO: 948175 - RNA, 22 nt, Homo sapiens
auuuucagugcuuugcccuuga

SEQ ID NO: 948176 - RNA, 12 nt, Homo sapiens
auuuucauccca

SEQ ID NO: 948177 - RNA, 13 nt, Homo sapiens
auuuuccaaaaau

SEQ ID NO: 948178 - RNA, 15 nt, Homo sapiens
auuuucuccaugucu

SEQ ID NO: 948179 - RNA, 20 nt, Homo sapiens
auuuugcuaagacauaaucu

SEQ ID NO: 948180 - RNA, 13 nt, Homo sapiens
auuuugcuuccuu

SEQ ID NO: 948181 - RNA, 15 nt, Homo sapiens
auuuuggcagagaug

SEQ ID NO: 948182 - RNA, 19 nt, Homo sapiens
auuuuggcauuuuggcuca

SEQ ID NO: 948183 - RNA, 20 nt, Homo sapiens
auuuuucuuauuuagcccau

SEQ ID NO: 948184 - RNA, 16 nt, Homo sapiens
auuuuuuacuacauaa

SEQ ID NO: 948185 - RNA, 18 nt, Homo sapiens
caaaagagcccaaaugac

SEQ ID NO: 948186 - RNA, 23 nt, Homo sapiens
caaaaggcuggaugugcuuucau

SEQ ID NO: 948187 - RNA, 16 nt, Homo sapiens
caaaaguuuaaaaagc

SEQ ID NO: 948188 - RNA, 16 nt, Homo sapiens
caaaaugguuuacuua

SEQ ID NO: 948189 - RNA, 22 nt, Homo sapiens
caaacacccaagcacaaacugu

SEQ ID NO: 948190 - RNA, 15 nt, Homo sapiens
caaaccaucauuuaa

SEQ ID NO: 948191 - RNA, 18 nt, Homo sapiens
caaacucaacaagugcuc

SEQ ID NO: 948192 - RNA, 17 nt, Homo sapiens
caaacuccugaguucaa

SEQ ID NO: 948193 - RNA, 20 nt, Homo sapiens
caaagaaaggagacuuuaug

SEQ ID NO: 948194 - RNA, 20 nt, Homo sapiens
caaagaacuccagagucagu

SEQ ID NO: 948195 - RNA, 22 nt, Homo sapiens
caaagaaggcacagguguaaau

SEQ ID NO: 948196 - RNA, 18 nt, Homo sapiens
caaagaggccaguacuuu

SEQ ID NO: 948197 - RNA, 13 nt, Homo sapiens
caaagaugugcaa

SEQ ID NO: 948198 - RNA, 16 nt, Homo sapiens
caaagaugugcaaaga

SEQ ID NO: 948199 - RNA, 15 nt, Homo sapiens
caaaggaaacccaau

SEQ ID NO: 948200 - RNA, 14 nt, Homo sapiens
caaaguauguuuca

SEQ ID NO: 948201 - RNA, 23 nt, Homo sapiens
caaaguguacaauuuucauccca

SEQ ID NO: 948202 - RNA, 17 nt, Homo sapiens
caaauaaauguguaaau

SEQ ID NO: 948203 - RNA, 19 nt, Homo sapiens
caaauaguaggcuaaaaac

SEQ ID NO: 948204 - RNA, 21 nt, Homo sapiens
aacagaggaccagcacacucc

SEQ ID NO: 948205 - RNA, 18 nt, Homo sapiens
aacagaugauccauuuga

SEQ ID NO: 948206 - RNA, 18 nt, Homo sapiens
aacagauuuuguauauac

SEQ ID NO: 948207 - RNA, 12 nt, Homo sapiens
aacagccagcuu

SEQ ID NO: 948208 - RNA, 18 nt, Homo sapiens
aacaggccgcacaucuca

SEQ ID NO: 948209 - RNA, 21 nt, Homo sapiens
aacaggccgcacaucucacuu

SEQ ID NO: 948210 - RNA, 17 nt, Homo sapiens
aacaggcugcuuagauu

SEQ ID NO: 948211 - RNA, 20 nt, Homo sapiens
aacagguguuccuccucccc

SEQ ID NO: 948212 - RNA, 20 nt, Homo sapiens
aacaguccaaacuguucuga

SEQ ID NO: 948213 - RNA, 23 nt, Homo sapiens
aacaguugguuggguaguagguu

SEQ ID NO: 948214 - RNA, 17 nt, Homo sapiens
aacaugcucauguguac

SEQ ID NO: 948215 - RNA, 22 nt, Homo sapiens
aacauguggacuuuuacaauaa

SEQ ID NO: 948216 - RNA, 16 nt, Homo sapiens
aacauuaggcuguggu

SEQ ID NO: 948217 - RNA, 14 nt, Homo sapiens
aacauugagacugc

SEQ ID NO: 948218 - RNA, 18 nt, Homo sapiens
aacauugcuuuagacaaa

SEQ ID NO: 948219 - RNA, 22 nt, Homo sapiens
aacauuugccaccucuaaauau

SEQ ID NO: 948220 - RNA, 16 nt, Homo sapiens
aaccaacuuuaccucu

SEQ ID NO: 948221 - RNA, 15 nt, Homo sapiens
aaccaagcacuacca

SEQ ID NO: 948222 - RNA, 11 nt, Homo sapiens
aacccaaauaa

SEQ ID NO: 948223 - RNA, 20 nt, Homo sapiens
aacccagguggcggagguug

SEQ ID NO: 948224 - RNA, 15 nt, Homo sapiens
aacccauuuuagaga

SEQ ID NO: 948225 - RNA, 17 nt, Homo sapiens
aacccugcccugcaccu

SEQ ID NO: 948226 - RNA, 19 nt, Homo sapiens
aacccuggauaagucacuu

SEQ ID NO: 948227 - RNA, 22 nt, Homo sapiens
aacccuggauaagucacuuaaa

SEQ ID NO: 948228 - RNA, 18 nt, Homo sapiens
aaccuuuugagugccuua

SEQ ID NO: 948229 - RNA, 21 nt, Homo sapiens
aaccuuuugagugccuuacac

SEQ ID NO: 948230 - RNA, 22 nt, Homo sapiens
aacuaaggacaggauggcugug

SEQ ID NO: 948231 - RNA, 17 nt, Homo sapiens
aacuacuucucuugcau

SEQ ID NO: 948232 - RNA, 14 nt, Homo sapiens
accucccccaggga

SEQ ID NO: 948233 - RNA, 17 nt, Homo sapiens
accucuuccuccugaca

SEQ ID NO: 948234 - RNA, 19 nt, Homo sapiens
accugaggcaggagggcau

SEQ ID NO: 948235 - RNA, 22 nt, Homo sapiens
accugccaagagucaacagguc

SEQ ID NO: 948236 - RNA, 18 nt, Homo sapiens
accuguagcaaaacagcu

SEQ ID NO: 948237 - RNA, 16 nt, Homo sapiens
accuguccguguuaca

SEQ ID NO: 948238 - RNA, 21 nt, Homo sapiens
accuguucuuccuaccaaaua

SEQ ID NO: 948239 - RNA, 13 nt, Homo sapiens
accuguuucugca

SEQ ID NO: 948240 - RNA, 19 nt, Homo sapiens
accuuacuuaaagcuuguu

SEQ ID NO: 948241 - RNA, 14 nt, Homo sapiens
accuucacucucca

SEQ ID NO: 948242 - RNA, 18 nt, Homo sapiens
accuugaaugaugccaug

SEQ ID NO: 948243 - RNA, 23 nt, Homo sapiens
accuuuucucgcugaaagcacua

SEQ ID NO: 948244 - RNA, 19 nt, Homo sapiens
acgacagaagguugccagg

SEQ ID NO: 948245 - RNA, 19 nt, Homo sapiens
acgcaaccaccaccaacca

SEQ ID NO: 948246 - RNA, 21 nt, Homo sapiens
acgcaccaccgcgccuaccuu

SEQ ID NO: 948247 - RNA, 10 nt, Homo sapiens
acgccuccau

SEQ ID NO: 948248 - RNA, 20 nt, Homo sapiens
acgccuggcuuccagcagag

SEQ ID NO: 948249 - RNA, 13 nt, Homo sapiens
acggacccugugu

SEQ ID NO: 948250 - RNA, 16 nt, Homo sapiens
ucuucacaauauccaa

SEQ ID NO: 948251 - RNA, 21 nt, Homo sapiens
ucuucagauccuggucugcac

SEQ ID NO: 948252 - RNA, 14 nt, Homo sapiens
ucuucauguucagu

SEQ ID NO: 948253 - RNA, 17 nt, Homo sapiens
ucuuccaaguucauuca

SEQ ID NO: 948254 - RNA, 13 nt, Homo sapiens
ucuucuuaucaca

SEQ ID NO: 948255 - RNA, 16 nt, Homo sapiens
ucuugaacucuuggcc

SEQ ID NO: 948256 - RNA, 17 nt, Homo sapiens
ucuugaacucuuggccu

SEQ ID NO: 948257 - RNA, 13 nt, Homo sapiens
ucuugaagacuuu

SEQ ID NO: 948258 - RNA, 18 nt, Homo sapiens
ucuugcggcaccgcccac

SEQ ID NO: 948259 - RNA, 22 nt, Homo sapiens
ucuuguaaauaaugcuuaacau

SEQ ID NO: 948260 - RNA, 14 nt, Homo sapiens
ucuuuaacauacau

SEQ ID NO: 948261 - RNA, 20 nt, Homo sapiens
ucuuuccuauuugcacacgu

SEQ ID NO: 948262 - RNA, 15 nt, Homo sapiens
ucuuuguacagacaa

SEQ ID NO: 948263 - RNA, 22 nt, Homo sapiens
ucuuuucuucuccgccaguaug

SEQ ID NO: 948264 - RNA, 15 nt, Homo sapiens
ucuuuuuucaaugua

SEQ ID NO: 948265 - RNA, 13 nt, Homo sapiens
ugaaaaaauaaca

SEQ ID NO: 948266 - RNA, 15 nt, Homo sapiens
ugaaaagucauucag

SEQ ID NO: 948267 - RNA, 16 nt, Homo sapiens
ugaaaauuuaaucuua

SEQ ID NO: 948268 - RNA, 12 nt, Homo sapiens
ugaaagaacaag

SEQ ID NO: 948269 - RNA, 21 nt, Homo sapiens
ugaaauaucaagagagguuaa

SEQ ID NO: 948270 - RNA, 13 nt, Homo sapiens
ugaaauccaaaau

SEQ ID NO: 948271 - RNA, 23 nt, Homo sapiens
ugaaaucuacaacauaaugauac

SEQ ID NO: 948272 - RNA, 18 nt, Homo sapiens
ugaaauguuuccaggcau

SEQ ID NO: 948273 - RNA, 21 nt, Homo sapiens
ugaacaaacuuagaaagggaa

SEQ ID NO: 948274 - RNA, 17 nt, Homo sapiens
ugaaccauguguggcaa

SEQ ID NO: 948275 - RNA, 19 nt, Homo sapiens
ugaacuagagacucuguga

SEQ ID NO: 948276 - RNA, 22 nt, Homo sapiens
ugaagaaggucucauuaucucc

SEQ ID NO: 948277 - RNA, 15 nt, Homo sapiens
ugaagacacugucaa

SEQ ID NO: 948278 - RNA, 13 nt, Homo sapiens
ugaagcugagaug

SEQ ID NO: 948279 - RNA, 13 nt, Homo sapiens
ugaagcugcucac

SEQ ID NO: 948280 - RNA, 19 nt, Homo sapiens
ugaagcugcucacugcuca

SEQ ID NO: 948281 - RNA, 22 nt, Homo sapiens
ugaaguccagcucccuugcuaa

SEQ ID NO: 948282 - RNA, 13 nt, Homo sapiens
ugaagugugcugu

SEQ ID NO: 948283 - RNA, 17 nt, Homo sapiens
ugaauauuauacuucuu

SEQ ID NO: 948284 - RNA, 17 nt, Homo sapiens
ugaaucuguuucuaugu

SEQ ID NO: 948285 - RNA, 17 nt, Homo sapiens
ugaaucuugucucacua

SEQ ID NO: 948286 - RNA, 15 nt, Homo sapiens
ugaauuggaaaggaa

SEQ ID NO: 948287 - RNA, 14 nt, Homo sapiens
cagaauuacaggaa

SEQ ID NO: 948288 - RNA, 19 nt, Homo sapiens
cagaccuagggauccugag

SEQ ID NO: 948289 - RNA, 15 nt, Homo sapiens
cagacggacgggaca

SEQ ID NO: 948290 - RNA, 23 nt, Homo sapiens
cagacuaaguugcuaaccucaau

SEQ ID NO: 948291 - RNA, 18 nt, Homo sapiens
cagagacccccgugccaa

SEQ ID NO: 948292 - RNA, 22 nt, Homo sapiens
cagagauggcagagccauccac

SEQ ID NO: 948293 - RNA, 14 nt, Homo sapiens
cagagcacuguaua

SEQ ID NO: 948294 - RNA, 11 nt, Homo sapiens
cagaggaccag

SEQ ID NO: 948295 - RNA, 17 nt, Homo sapiens
cagaggggcggggccag

SEQ ID NO: 948296 - RNA, 20 nt, Homo sapiens
cagaguggaaauucaugaga

SEQ ID NO: 948297 - RNA, 15 nt, Homo sapiens
cagaguucugugaca

SEQ ID NO: 948298 - RNA, 17 nt, Homo sapiens
cagaucucccaguaauu

SEQ ID NO: 948299 - RNA, 22 nt, Homo sapiens
cagauuacagucauuuccuacc

SEQ ID NO: 948300 - RNA, 16 nt, Homo sapiens
cagauucagucuugcc

SEQ ID NO: 948301 - RNA, 23 nt, Homo sapiens
cagauuccccccaucuccauugc

SEQ ID NO: 948302 - RNA, 13 nt, Homo sapiens
cagauugcugcaa

SEQ ID NO: 948303 - RNA, 18 nt, Homo sapiens
cagcacaucucugagguu

SEQ ID NO: 948304 - RNA, 15 nt, Homo sapiens
cagcacuguaugugu

SEQ ID NO: 948305 - RNA, 12 nt, Homo sapiens
cagcauagagcu

SEQ ID NO: 948306 - RNA, 18 nt, Homo sapiens
cagcauugugaucaaaga

SEQ ID NO: 948307 - RNA, 19 nt, Homo sapiens
cagccucgucucuuuacag

SEQ ID NO: 948308 - RNA, 22 nt, Homo sapiens
cagccucuuccuccccauguca

SEQ ID NO: 948309 - RNA, 19 nt, Homo sapiens
cagccuugaacuguggcca

SEQ ID NO: 948310 - RNA, 16 nt, Homo sapiens
cagcggagaggacccc

SEQ ID NO: 948311 - RNA, 17 nt, Homo sapiens
cagcguggggguggcca

SEQ ID NO: 948312 - RNA, 12 nt, Homo sapiens
cagcuaacaugg

SEQ ID NO: 948313 - RNA, 16 nt, Homo sapiens
cagcuacagcaaauaa

SEQ ID NO: 948314 - RNA, 17 nt, Homo sapiens
cagcuacgugugccccu

SEQ ID NO: 948315 - RNA, 22 nt, Homo sapiens
cagcuacgugugccccucucau

SEQ ID NO: 948316 - RNA, 22 nt, Homo sapiens
cagcuccucugccuuugugcuc

SEQ ID NO: 948317 - RNA, 22 nt, Homo sapiens
cagcucuucagguuugcaaggg

SEQ ID NO: 948318 - RNA, 17 nt, Homo sapiens
cagcuucauaauuucca

SEQ ID NO: 948319 - RNA, 17 nt, Homo sapiens
caggaaaguaucucuac

SEQ ID NO: 948320 - RNA, 17 nt, Homo sapiens
caggaaaugcaaaccau

SEQ ID NO: 948321 - RNA, 15 nt, Homo sapiens
caggacacauuucca

SEQ ID NO: 948322 - RNA, 17 nt, Homo sapiens
caggacggucugugccc

SEQ ID NO: 948323 - RNA, 18 nt, Homo sapiens
caggagauggaauaucaa

SEQ ID NO: 948324 - RNA, 20 nt, Homo sapiens
caggaggugugaaugcacgu

SEQ ID NO: 948325 - RNA, 15 nt, Homo sapiens
caggcacgugcacau

SEQ ID NO: 948326 - RNA, 16 nt, Homo sapiens
caggccgcacaucuca

SEQ ID NO: 948327 - RNA, 17 nt, Homo sapiens
caggcguacacaugcac

SEQ ID NO: 948328 - RNA, 22 nt, Homo sapiens
cagggagcccugggguuuccac

SEQ ID NO: 948329 - RNA, 20 nt, Homo sapiens
cagggauaauuaaaaccauc

SEQ ID NO: 948330 - RNA, 14 nt, Homo sapiens
cagggcaaccaaua

SEQ ID NO: 948331 - RNA, 15 nt, Homo sapiens
cagggcaaucaucua

SEQ ID NO: 948332 - RNA, 16 nt, Homo sapiens
cagggcaggugcccaa

SEQ ID NO: 948333 - RNA, 21 nt, Homo sapiens
caggggcugacucuccaggga

SEQ ID NO: 948334 - RNA, 17 nt, Homo sapiens
cagguaagucugguuuu

SEQ ID NO: 948335 - RNA, 20 nt, Homo sapiens
caguaaaguucauccuuuga

SEQ ID NO: 948336 - RNA, 16 nt, Homo sapiens
caguaggauccaaaga

SEQ ID NO: 948337 - RNA, 18 nt, Homo sapiens
caguauacacauacacaa

SEQ ID NO: 948338 - RNA, 20 nt, Homo sapiens
caguauaccuaucugcugca

SEQ ID NO: 948339 - RNA, 21 nt, Homo sapiens
caguauaccuaucugcugcac

SEQ ID NO: 948340 - RNA, 23 nt, Homo sapiens
cagucaagggcaagcuggaguua

SEQ ID NO: 948341 - RNA, 17 nt, Homo sapiens
cagucacaugugcucuc

SEQ ID NO: 948342 - RNA, 12 nt, Homo sapiens
caguccagugau

SEQ ID NO: 948343 - RNA, 16 nt, Homo sapiens
cagucuacacucacaa

SEQ ID NO: 948344 - RNA, 16 nt, Homo sapiens
cagugaagauguguaa

SEQ ID NO: 948345 - RNA, 15 nt, Homo sapiens
cagugcuccaguaua

SEQ ID NO: 948346 - RNA, 15 nt, Homo sapiens
caguuaauucuugcc

SEQ ID NO: 948347 - RNA, 17 nt, Homo sapiens
caguuaugauaaccaag

SEQ ID NO: 948348 - RNA, 17 nt, Homo sapiens
caguugggcccccaucc

SEQ ID NO: 948349 - RNA, 16 nt, Homo sapiens
caguuguggccucauu

SEQ ID NO: 948350 - RNA, 15 nt, Homo sapiens
caguuucacauauuu

SEQ ID NO: 948351 - RNA, 14 nt, Homo sapiens
ugcuucuagugauu

SEQ ID NO: 948352 - RNA, 23 nt, Homo sapiens
ugcuugauauaauaauuacuuaa

SEQ ID NO: 948353 - RNA, 22 nt, Homo sapiens
ugcuuguggucacacuguggaa

SEQ ID NO: 948354 - RNA, 16 nt, Homo sapiens
ugcuuuacagcacugu

SEQ ID NO: 948355 - RNA, 17 nt, Homo sapiens
ugcuuucucaugcauag

SEQ ID NO: 948356 - RNA, 18 nt, Homo sapiens
ugcuuuggggcuuaucag

SEQ ID NO: 948357 - RNA, 20 nt, Homo sapiens
uggaaauaugcaaccugugc

SEQ ID NO: 948358 - RNA, 14 nt, Homo sapiens
uggaacacuaauga

SEQ ID NO: 948359 - RNA, 12 nt, Homo sapiens
uggaagcacugc

SEQ ID NO: 948360 - RNA, 15 nt, Homo sapiens
uggaauauacaugua

SEQ ID NO: 948361 - RNA, 19 nt, Homo sapiens
uggaauaucaaugcccaac

SEQ ID NO: 948362 - RNA, 16 nt, Homo sapiens
uggaccacagcaugaa

SEQ ID NO: 948363 - RNA, 16 nt, Homo sapiens
uggaccuggggucccc

SEQ ID NO: 948364 - RNA, 18 nt, Homo sapiens
uggacucuguggggccac

SEQ ID NO: 948365 - RNA, 14 nt, Homo sapiens
uggagcugcuucca

SEQ ID NO: 948366 - RNA, 12 nt, Homo sapiens
uggaguggcaug

SEQ ID NO: 948367 - RNA, 21 nt, Homo sapiens
uggauaagucacuuaaacuca

SEQ ID NO: 948368 - RNA, 22 nt, Homo sapiens
uggauccgugacagcacuuucc

SEQ ID NO: 948369 - RNA, 19 nt, Homo sapiens
uggauuauaaacaacagaa

SEQ ID NO: 948370 - RNA, 13 nt, Homo sapiens
uggauuucaucac

SEQ ID NO: 948371 - RNA, 18 nt, Homo sapiens
uggcaaauaaaagcauuu

SEQ ID NO: 948372 - RNA, 15 nt, Homo sapiens
uggcaaccuguucuu

SEQ ID NO: 948373 - RNA, 14 nt, Homo sapiens
uggcagacuuacaa

SEQ ID NO: 948374 - RNA, 15 nt, Homo sapiens
uggccaaaguguaca

SEQ ID NO: 948375 - RNA, 14 nt, Homo sapiens
uggccaaugugcau

SEQ ID NO: 948376 - RNA, 12 nt, Homo sapiens
uggccacuccug

SEQ ID NO: 948377 - RNA, 14 nt, Homo sapiens
uggcccuguuucuc

SEQ ID NO: 948378 - RNA, 17 nt, Homo sapiens
uggccgagucagcacgu

SEQ ID NO: 948379 - RNA, 20 nt, Homo sapiens
uggcucagaguccaauguac

SEQ ID NO: 948380 - RNA, 18 nt, Homo sapiens
uggcugauuucaaaugca

SEQ ID NO: 948381 - RNA, 21 nt, Homo sapiens
uggcugauuucaaaugcaguc

SEQ ID NO: 948382 - RNA, 16 nt, Homo sapiens
uggcuuggcauuuucu

SEQ ID NO: 948383 - RNA, 18 nt, Homo sapiens
ugggagaugcugggaccc

SEQ ID NO: 948384 - RNA, 15 nt, Homo sapiens
ugggaggccaaacac

SEQ ID NO: 948385 - RNA, 18 nt, Homo sapiens
ugggagugaacauuucua

SEQ ID NO: 948386 - RNA, 15 nt, Homo sapiens
auguguaguguugcu

SEQ ID NO: 948387 - RNA, 23 nt, Homo sapiens
auguguugugaaaauuuaaucuu

SEQ ID NO: 948388 - RNA, 13 nt, Homo sapiens
auguuaacaugcg

SEQ ID NO: 948389 - RNA, 20 nt, Homo sapiens
auguucagucacaugugcuc

SEQ ID NO: 948390 - RNA, 17 nt, Homo sapiens
auguucaucuucaaaaa

SEQ ID NO: 948391 - RNA, 13 nt, Homo sapiens
auguugcaaagaa

SEQ ID NO: 948392 - RNA, 15 nt, Homo sapiens
auuaaucuaccauuu

SEQ ID NO: 948393 - RNA, 20 nt, Homo sapiens
auuacaccuuuaucucaaga

SEQ ID NO: 948394 - RNA, 17 nt, Homo sapiens
auuacaggaaaugcaaa

SEQ ID NO: 948395 - RNA, 21 nt, Homo sapiens
auuacauccucugcuugucau

SEQ ID NO: 948396 - RNA, 23 nt, Homo sapiens
auuagauagaaaagguccaaaac

SEQ ID NO: 948397 - RNA, 18 nt, Homo sapiens
auuagcucucaucuaguu

SEQ ID NO: 948398 - RNA, 13 nt, Homo sapiens
auuaugcuaacaa

SEQ ID NO: 948399 - RNA, 18 nt, Homo sapiens
auuauggagugucaccag

SEQ ID NO: 948400 - RNA, 21 nt, Homo sapiens
auuauuucagucaucaucuca

SEQ ID NO: 948401 - RNA, 21 nt, Homo sapiens
auuauuuuugcucugcucugu

SEQ ID NO: 948402 - RNA, 13 nt, Homo sapiens
auucacaguaucu

SEQ ID NO: 948403 - RNA, 19 nt, Homo sapiens
auucaggagaucacugcuc

SEQ ID NO: 948404 - RNA, 16 nt, Homo sapiens
auucauaccugacuag

SEQ ID NO: 948405 - RNA, 18 nt, Homo sapiens
auucauauuuaugaaucu

SEQ ID NO: 948406 - RNA, 19 nt, Homo sapiens
auucaucaaacucuuugcc

SEQ ID NO: 948407 - RNA, 19 nt, Homo sapiens
auuccagaacgcccugugu

SEQ ID NO: 948408 - RNA, 21 nt, Homo sapiens
auuccagcgucugcuguugau

SEQ ID NO: 948409 - RNA, 17 nt, Homo sapiens
auucccagccuguggca

SEQ ID NO: 948410 - RNA, 16 nt, Homo sapiens
auucuagucucugauu

SEQ ID NO: 948411 - RNA, 14 nt, Homo sapiens
auucuauaaauuca

SEQ ID NO: 948412 - RNA, 20 nt, Homo sapiens
auucuaugccuguauuucca

SEQ ID NO: 948413 - RNA, 14 nt, Homo sapiens
auucuccaucucaa

SEQ ID NO: 948414 - RNA, 16 nt, Homo sapiens
auucuccaucucaaga

SEQ ID NO: 948415 - RNA, 14 nt, Homo sapiens
auucucuagacaaa

SEQ ID NO: 948416 - RNA, 16 nt, Homo sapiens
auucuguuacacaaua

SEQ ID NO: 948417 - RNA, 19 nt, Homo sapiens
auucuuuuggcaguucuga

SEQ ID NO: 948418 - RNA, 12 nt, Homo sapiens
auugagcacaua

SEQ ID NO: 948419 - RNA, 14 nt, Homo sapiens
auugcugcaaagau

SEQ ID NO: 948420 - RNA, 13 nt, Homo sapiens
auugucacaugau

SEQ ID NO: 948421 - RNA, 15 nt, Homo sapiens
auugugacaccagau

SEQ ID NO: 948422 - RNA, 21 nt, Homo sapiens
auuguuagucucuugauucau

SEQ ID NO: 948423 - RNA, 17 nt, Homo sapiens
auuuaacugcauauaga

SEQ ID NO: 948424 - RNA, 18 nt, Homo sapiens
auuuacaacuuccagauu

SEQ ID NO: 948425 - RNA, 14 nt, Homo sapiens
auuuacaagcauca

SEQ ID NO: 948426 - RNA, 14 nt, Homo sapiens
auuuaucugugaau

SEQ ID NO: 948427 - RNA, 20 nt, Homo sapiens
auuuauuugacucagcacug

SEQ ID NO: 948428 - RNA, 21 nt, Homo sapiens
auuuauuugacucagcacugu

SEQ ID NO: 948429 - RNA, 12 nt, Homo sapiens
auuucugcucag

SEQ ID NO: 948430 - RNA, 17 nt, Homo sapiens
auuuggggacagauuca

SEQ ID NO: 948431 - RNA, 19 nt, Homo sapiens
auuugucuagcaugcugag

SEQ ID NO: 948432 - RNA, 18 nt, Homo sapiens
auuuuagagacagaagaa

SEQ ID NO: 948433 - RNA, 17 nt, Homo sapiens
auuuuaggcaaagucca

SEQ ID NO: 948434 - RNA, 19 nt, Homo sapiens
auuuuaggcaaaguccaua

SEQ ID NO: 948435 - RNA, 14 nt, Homo sapiens
auuuuaggcuauua

SEQ ID NO: 948436 - RNA, 18 nt, Homo sapiens
auuuucagugcuuugccc

SEQ ID NO: 948437 - RNA, 19 nt, Homo sapiens
auuuucagugcuuugcccu

SEQ ID NO: 948438 - RNA, 13 nt, Homo sapiens
auuuugauugauu

SEQ ID NO: 948439 - RNA, 17 nt, Homo sapiens
auuuuguaucaccucuu

SEQ ID NO: 948440 - RNA, 18 nt, Homo sapiens
auuuuguaucaccucuuc

SEQ ID NO: 948441 - RNA, 12 nt, Homo sapiens
auuuuucacaaa

SEQ ID NO: 948442 - RNA, 15 nt, Homo sapiens
auuuuucucaucucc

SEQ ID NO: 948443 - RNA, 20 nt, Homo sapiens
auuuuuguauuuuggcagag

SEQ ID NO: 948444 - RNA, 21 nt, Homo sapiens
caaaaagaaauauuaauaugu

SEQ ID NO: 948445 - RNA, 17 nt, Homo sapiens
caaaaagcugcuaucca

SEQ ID NO: 948446 - RNA, 18 nt, Homo sapiens
caaaagauaaaacuaauu

SEQ ID NO: 948447 - RNA, 17 nt, Homo sapiens
caaaagugauguuauag

SEQ ID NO: 948448 - RNA, 22 nt, Homo sapiens
caaaauaguucuauuucuaucu

SEQ ID NO: 948449 - RNA, 17 nt, Homo sapiens
caaaauucauaccugac

SEQ ID NO: 948450 - RNA, 18 nt, Homo sapiens
caaacaaaaugaugggaa

SEQ ID NO: 948451 - RNA, 17 nt, Homo sapiens
caaacacccaagcacaa

SEQ ID NO: 948452 - RNA, 19 nt, Homo sapiens
caaacacugcuuaaggaaa

SEQ ID NO: 948453 - RNA, 16 nt, Homo sapiens
caaacuugcaguuuaa

SEQ ID NO: 948454 - RNA, 19 nt, Homo sapiens
caaagacuugaaggcauua

SEQ ID NO: 948455 - RNA, 16 nt, Homo sapiens
caaagagaugaggaaa

SEQ ID NO: 948456 - RNA, 22 nt, Homo sapiens
caaagaggccaguacuuugcca

SEQ ID NO: 948457 - RNA, 14 nt, Homo sapiens
caaagaugugcaaa

SEQ ID NO: 948458 - RNA, 17 nt, Homo sapiens
caaagcuuaugugacau

SEQ ID NO: 948459 - RNA, 15 nt, Homo sapiens
caaagcuugccacuu

SEQ ID NO: 948460 - RNA, 23 nt, Homo sapiens
caaagcuuuccuguuuccagggu

SEQ ID NO: 948461 - RNA, 16 nt, Homo sapiens
caaaguccauacuccu

SEQ ID NO: 948462 - RNA, 19 nt, Homo sapiens
caaaguguacaauuuucau

SEQ ID NO: 948463 - RNA, 17 nt, Homo sapiens
caaaguguaugugacca

SEQ ID NO: 948464 - RNA, 15 nt, Homo sapiens
caaaugaccuagaaa

SEQ ID NO: 948465 - RNA, 17 nt, Homo sapiens
caaaugaccuagaaaca

SEQ ID NO: 948466 - RNA, 17 nt, Homo sapiens
caaaugcaguccaguga

SEQ ID NO: 948467 - RNA, 20 nt, Homo sapiens
caaaugcaguccagugagaa

SEQ ID NO: 948468 - RNA, 16 nt, Homo sapiens
caaaugcuaaaugcaa

SEQ ID NO: 948469 - RNA, 17 nt, Homo sapiens
caaauguuguauuucaa

SEQ ID NO: 948470 - RNA, 16 nt, Homo sapiens
caaauuauucuaguca

SEQ ID NO: 948471 - RNA, 19 nt, Homo sapiens
caaauuguuaagaguauca

SEQ ID NO: 948472 - RNA, 19 nt, Homo sapiens
caacacuugcacaaucacg

SEQ ID NO: 948473 - RNA, 13 nt, Homo sapiens
caacauccacucu

SEQ ID NO: 948474 - RNA, 12 nt, Homo sapiens
caacaugcacac

SEQ ID NO: 948475 - RNA, 21 nt, Homo sapiens
caacauuacuccauuacuaaa

SEQ ID NO: 948476 - RNA, 23 nt, Homo sapiens
caacauuacuccauuacuaaaga

SEQ ID NO: 948477 - RNA, 16 nt, Homo sapiens
caacauuauccugugu

SEQ ID NO: 948478 - RNA, 15 nt, Homo sapiens
caaccagagcacugu

SEQ ID NO: 948479 - RNA, 17 nt, Homo sapiens
caaccagagcacuguau

SEQ ID NO: 948480 - RNA, 13 nt, Homo sapiens
caaccgguuauca

SEQ ID NO: 948481 - RNA, 18 nt, Homo sapiens
caacuaaaguagaauuau

SEQ ID NO: 948482 - RNA, 22 nt, Homo sapiens
caacuaaaguagaauuaucucu

SEQ ID NO: 948483 - RNA, 15 nt, Homo sapiens
caacugagauguuaa

SEQ ID NO: 948484 - RNA, 10 nt, Homo sapiens
caacugauga

SEQ ID NO: 948485 - RNA, 19 nt, Homo sapiens
caacuggguggcacugcug

SEQ ID NO: 948486 - RNA, 19 nt, Homo sapiens
caacuuaaaccugugcuuu

SEQ ID NO: 948487 - RNA, 14 nt, Homo sapiens
caagaugugacaug

SEQ ID NO: 948488 - RNA, 17 nt, Homo sapiens
caagcauucugugcaua

SEQ ID NO: 948489 - RNA, 21 nt, Homo sapiens
caagcuggaguuaauaaucua

SEQ ID NO: 948490 - RNA, 15 nt, Homo sapiens
caaggaaaauggaca

SEQ ID NO: 948491 - RNA, 16 nt, Homo sapiens
caaggaaaauggacau

SEQ ID NO: 948492 - RNA, 16 nt, Homo sapiens
caaggauccugagcca

SEQ ID NO: 948493 - RNA, 20 nt, Homo sapiens
caaggcaguugcuuguguuu

SEQ ID NO: 948494 - RNA, 16 nt, Homo sapiens
caaggcucacaugcuc

SEQ ID NO: 948495 - RNA, 23 nt, Homo sapiens
caaggcucugcuauacagucuau

SEQ ID NO: 948496 - RNA, 18 nt, Homo sapiens
caagggccaguugguguu

SEQ ID NO: 948497 - RNA, 20 nt, Homo sapiens
caaggucaaggcaccagcaa

SEQ ID NO: 948498 - RNA, 16 nt, Homo sapiens
caagguccaugucacc

SEQ ID NO: 948499 - RNA, 23 nt, Homo sapiens
cacaaaaggcuggaugugcuuuc

SEQ ID NO: 948500 - RNA, 22 nt, Homo sapiens
cacaaacugucgucuuuuucca

SEQ ID NO: 948501 - RNA, 17 nt, Homo sapiens
cacaaagggaauugccu

SEQ ID NO: 948502 - RNA, 14 nt, Homo sapiens
cacaaauauaguug

SEQ ID NO: 948503 - RNA, 14 nt, Homo sapiens
cacaagugcacaga

SEQ ID NO: 948504 - RNA, 19 nt, Homo sapiens
cacaagugugcauuaccac

SEQ ID NO: 948505 - RNA, 15 nt, Homo sapiens
cacacagcacaugca

SEQ ID NO: 948506 - RNA, 16 nt, Homo sapiens
cacacagcacaugcac

SEQ ID NO: 948507 - RNA, 13 nt, Homo sapiens
cacacaugcacac

SEQ ID NO: 948508 - RNA, 17 nt, Homo sapiens
cacacccccuuuccauc

SEQ ID NO: 948509 - RNA, 11 nt, Homo sapiens
cacaccuguaa

SEQ ID NO: 948510 - RNA, 14 nt, Homo sapiens
cacagcacaugcac

SEQ ID NO: 948511 - RNA, 18 nt, Homo sapiens
cacagcucacuacaguuu

SEQ ID NO: 948512 - RNA, 18 nt, Homo sapiens
cacaggauucucuucuca

SEQ ID NO: 948513 - RNA, 15 nt, Homo sapiens
cacagguacauagcu

SEQ ID NO: 948514 - RNA, 18 nt, Homo sapiens
cacauagagguugagcca

SEQ ID NO: 948515 - RNA, 19 nt, Homo sapiens
cacaucccuacgugcccac

SEQ ID NO: 948516 - RNA, 19 nt, Homo sapiens
cacaucucuguagauacag

SEQ ID NO: 948517 - RNA, 16 nt, Homo sapiens
cacauucauguacaau

SEQ ID NO: 948518 - RNA, 19 nt, Homo sapiens
cacauuuaacgacagaagg

SEQ ID NO: 948519 - RNA, 19 nt, Homo sapiens
cacauuuggaccacagcau

SEQ ID NO: 948520 - RNA, 15 nt, Homo sapiens
caccagccugagcca

SEQ ID NO: 948521 - RNA, 19 nt, Homo sapiens
caccaguuaugauaaccaa

SEQ ID NO: 948522 - RNA, 19 nt, Homo sapiens
cacccaggcuggagugcag

SEQ ID NO: 948523 - RNA, 15 nt, Homo sapiens
cacccaggugauguu

SEQ ID NO: 948524 - RNA, 22 nt, Homo sapiens
caccuguauagaccaugcacag

SEQ ID NO: 948525 - RNA, 19 nt, Homo sapiens
caccuucacucuccagggu

SEQ ID NO: 948526 - RNA, 17 nt, Homo sapiens
cacgaaaauacccagcg

SEQ ID NO: 948527 - RNA, 15 nt, Homo sapiens
cacgccuccauccac

SEQ ID NO: 948528 - RNA, 17 nt, Homo sapiens
cacgcgugcaugcacac

SEQ ID NO: 948529 - RNA, 14 nt, Homo sapiens
cacggacccugugu

SEQ ID NO: 948530 - RNA, 13 nt, Homo sapiens
cacgugcacagau

SEQ ID NO: 948531 - RNA, 14 nt, Homo sapiens
cacguuaguaauac

SEQ ID NO: 948532 - RNA, 14 nt, Homo sapiens
cacguuugccaaau

SEQ ID NO: 948533 - RNA, 23 nt, Homo sapiens
cacuacagaucucccaguaauuu

SEQ ID NO: 948534 - RNA, 14 nt, Homo sapiens
cacuacauucugaa

SEQ ID NO: 948535 - RNA, 18 nt, Homo sapiens
cacuaguaugugugcgug

SEQ ID NO: 948536 - RNA, 16 nt, Homo sapiens
cacucagcaccacuca

SEQ ID NO: 948537 - RNA, 16 nt, Homo sapiens
cacugaacaugcucau

SEQ ID NO: 948538 - RNA, 19 nt, Homo sapiens
cacugaacaugcucaugug

SEQ ID NO: 948539 - RNA, 15 nt, Homo sapiens
cacugagucucaugg

SEQ ID NO: 948540 - RNA, 15 nt, Homo sapiens
cacugcgaccacaag

SEQ ID NO: 948541 - RNA, 17 nt, Homo sapiens
cacuggauucauuucau

SEQ ID NO: 948542 - RNA, 20 nt, Homo sapiens
cacuguggaacacuaaagag

SEQ ID NO: 948543 - RNA, 15 nt, Homo sapiens
cacuguuucuucuca

SEQ ID NO: 948544 - RNA, 21 nt, Homo sapiens
cacuucucuagagaacaugcc

SEQ ID NO: 948545 - RNA, 13 nt, Homo sapiens
cacuugacaucaa

SEQ ID NO: 948546 - RNA, 22 nt, Homo sapiens
cacuuuaaauaugaaagccuag

SEQ ID NO: 948547 - RNA, 16 nt, Homo sapiens
cacuuugguaaugugu

SEQ ID NO: 948548 - RNA, 13 nt, Homo sapiens
cagaaaaccuguu

SEQ ID NO: 948549 - RNA, 19 nt, Homo sapiens
cagaaauaugaaaagucau

SEQ ID NO: 948550 - RNA, 23 nt, Homo sapiens
cagaacaaaagauaaaacuaauu

SEQ ID NO: 948551 - RNA, 16 nt, Homo sapiens
cagaacuuauucucca

SEQ ID NO: 948552 - RNA, 15 nt, Homo sapiens
cagaagaaacuaccc

SEQ ID NO: 948553 - RNA, 14 nt, Homo sapiens
cagaauacaauuca

SEQ ID NO: 948554 - RNA, 14 nt, Homo sapiens
cagacacgcacuuc

SEQ ID NO: 948555 - RNA, 22 nt, Homo sapiens
cagacacgcacuucuggggcca

SEQ ID NO: 948556 - RNA, 16 nt, Homo sapiens
cagacuaugcagcuca

SEQ ID NO: 948557 - RNA, 22 nt, Homo sapiens
cagacucuugggccguccccau

SEQ ID NO: 948558 - RNA, 16 nt, Homo sapiens
cagagcaaaugagcuc

SEQ ID NO: 948559 - RNA, 15 nt, Homo sapiens
cagagcacuguauac

SEQ ID NO: 948560 - RNA, 14 nt, Homo sapiens
cagagcagaaccaa

SEQ ID NO: 948561 - RNA, 21 nt, Homo sapiens
cagagcucagcacagccucac

SEQ ID NO: 948562 - RNA, 19 nt, Homo sapiens
cagaggguggagaugucag

SEQ ID NO: 948563 - RNA, 16 nt, Homo sapiens
cagaguucugugacac

SEQ ID NO: 948564 - RNA, 19 nt, Homo sapiens
cagaugauccauuugaaca

SEQ ID NO: 948565 - RNA, 23 nt, Homo sapiens
cagauguggaguauuagugacac

SEQ ID NO: 948566 - RNA, 20 nt, Homo sapiens
cagauuccccccaucuccau

SEQ ID NO: 948567 - RNA, 21 nt, Homo sapiens
cagcaagcccgucaucuuccc

SEQ ID NO: 948568 - RNA, 13 nt, Homo sapiens
cagcacacaugca

SEQ ID NO: 948569 - RNA, 20 nt, Homo sapiens
cagcacuaacacaugcacac

SEQ ID NO: 948570 - RNA, 19 nt, Homo sapiens
cagcacuguauguguugca

SEQ ID NO: 948571 - RNA, 20 nt, Homo sapiens
cagcacuguauguguugcac

SEQ ID NO: 948572 - RNA, 14 nt, Homo sapiens
cagcacuguuuuca

SEQ ID NO: 948573 - RNA, 19 nt, Homo sapiens
cagcacuguuuucaucaca

SEQ ID NO: 948574 - RNA, 19 nt, Homo sapiens
cagcacuuuccuguugcac

SEQ ID NO: 948575 - RNA, 19 nt, Homo sapiens
cagcagacguggugugaga

SEQ ID NO: 948576 - RNA, 18 nt, Homo sapiens
cagcagccucacugcauc

SEQ ID NO: 948577 - RNA, 14 nt, Homo sapiens
cagccuccugagua

SEQ ID NO: 948578 - RNA, 19 nt, Homo sapiens
cagcuaacauggaaguacu

SEQ ID NO: 948579 - RNA, 21 nt, Homo sapiens
cagcuaacauggaaguacuau

SEQ ID NO: 948580 - RNA, 14 nt, Homo sapiens
cagcugcaggcaca

SEQ ID NO: 948581 - RNA, 17 nt, Homo sapiens
cagcuuauaugugacac

SEQ ID NO: 948582 - RNA, 21 nt, Homo sapiens
caggaagcaggggguccccau

SEQ ID NO: 948583 - RNA, 17 nt, Homo sapiens
caggacacauuuccacu

SEQ ID NO: 948584 - RNA, 22 nt, Homo sapiens
caggagcaaacucuucaggcuc

SEQ ID NO: 948585 - RNA, 21 nt, Homo sapiens
caggaggguauggugcugcuc

SEQ ID NO: 948586 - RNA, 14 nt, Homo sapiens
caggcagagcucag

SEQ ID NO: 948587 - RNA, 22 nt, Homo sapiens
caggcaggaggccauuccagga

SEQ ID NO: 948588 - RNA, 21 nt, Homo sapiens
caggcgggggguugucucagc

SEQ ID NO: 948589 - RNA, 21 nt, Homo sapiens
cagggcucacccacugcugca

SEQ ID NO: 948590 - RNA, 15 nt, Homo sapiens
caggggcaaaaguca

SEQ ID NO: 948591 - RNA, 12 nt, Homo sapiens
cagggucucacu

SEQ ID NO: 948592 - RNA, 20 nt, Homo sapiens
cagggucucacuguguugcc

SEQ ID NO: 948593 - RNA, 11 nt, Homo sapiens
caguacaugac

SEQ ID NO: 948594 - RNA, 15 nt, Homo sapiens
caguaugaagacacu

SEQ ID NO: 948595 - RNA, 20 nt, Homo sapiens
caguaugugugcucuuaucc

SEQ ID NO: 948596 - RNA, 20 nt, Homo sapiens
caguauuucaagaggcauuc

SEQ ID NO: 948597 - RNA, 12 nt, Homo sapiens
cagucacaugug

SEQ ID NO: 948598 - RNA, 14 nt, Homo sapiens
cagucaucaucuca

SEQ ID NO: 948599 - RNA, 16 nt, Homo sapiens
caguccuuaucugcuc

SEQ ID NO: 948600 - RNA, 15 nt, Homo sapiens
caguguccucaucua

SEQ ID NO: 948601 - RNA, 13 nt, Homo sapiens
caguguuuggaca

SEQ ID NO: 948602 - RNA, 15 nt, Homo sapiens
caguuaaugugccaa

SEQ ID NO: 948603 - RNA, 18 nt, Homo sapiens
caguuagagacucuguca

SEQ ID NO: 948604 - RNA, 15 nt, Homo sapiens
caguuguuauauuca

SEQ ID NO: 948605 - RNA, 17 nt, Homo sapiens
caguuuaaucuucacaa

SEQ ID NO: 948606 - RNA, 23 nt, Homo sapiens
caguuuaaucuucacaauaucca

SEQ ID NO: 948607 - RNA, 13 nt, Homo sapiens
cauaaaaucacag

SEQ ID NO: 948608 - RNA, 21 nt, Homo sapiens
cauaaagagguaaaaaacugu

SEQ ID NO: 948609 - RNA, 13 nt, Homo sapiens
cauaaaucugucu

SEQ ID NO: 948610 - RNA, 14 nt, Homo sapiens
cauaaauguuauau

SEQ ID NO: 948611 - RNA, 16 nt, Homo sapiens
cauaagauuauauaca

SEQ ID NO: 948612 - RNA, 23 nt, Homo sapiens
cauaagccacaggccccaguuau

SEQ ID NO: 948613 - RNA, 15 nt, Homo sapiens
cauaaucucuuucca

SEQ ID NO: 948614 - RNA, 13 nt, Homo sapiens
cauaccacuugaa

SEQ ID NO: 948615 - RNA, 19 nt, Homo sapiens
caucucaaacacugcuuaa

SEQ ID NO: 948616 - RNA, 18 nt, Homo sapiens
caucuccauugcauucau

SEQ ID NO: 948617 - RNA, 20 nt, Homo sapiens
caucucuuuagauccaaaau

SEQ ID NO: 948618 - RNA, 21 nt, Homo sapiens
caucugaaaagaaaugcuaau

SEQ ID NO: 948619 - RNA, 19 nt, Homo sapiens
caucuguuugauacaguau

SEQ ID NO: 948620 - RNA, 16 nt, Homo sapiens
caucuugaauuguaag

SEQ ID NO: 948621 - RNA, 19 nt, Homo sapiens
caugacccggaugaacuca

SEQ ID NO: 948622 - RNA, 16 nt, Homo sapiens
caugaucacagcucac

SEQ ID NO: 948623 - RNA, 12 nt, Homo sapiens
caugaugacucu

SEQ ID NO: 948624 - RNA, 19 nt, Homo sapiens
caugcacagcuaacaugga

SEQ ID NO: 948625 - RNA, 15 nt, Homo sapiens
caugcagaaauugac

SEQ ID NO: 948626 - RNA, 17 nt, Homo sapiens
caugccuaguuauucau

SEQ ID NO: 948627 - RNA, 18 nt, Homo sapiens
caugcuauccaaucucau

SEQ ID NO: 948628 - RNA, 17 nt, Homo sapiens
caugcucauguguacac

SEQ ID NO: 948629 - RNA, 22 nt, Homo sapiens
caugcuccuugccucugcucug

SEQ ID NO: 948630 - RNA, 17 nt, Homo sapiens
caugcugagucaugucu

SEQ ID NO: 948631 - RNA, 13 nt, Homo sapiens
cauggaaguacua

SEQ ID NO: 948632 - RNA, 16 nt, Homo sapiens
cauggagggugcccag

SEQ ID NO: 948633 - RNA, 20 nt, Homo sapiens
cauggauaauugcuucacag

SEQ ID NO: 948634 - RNA, 19 nt, Homo sapiens
cauguaaagucaucaucaa

SEQ ID NO: 948635 - RNA, 16 nt, Homo sapiens
caugugcacagguucu

SEQ ID NO: 948636 - RNA, 15 nt, Homo sapiens
cauguguugcaaauu

SEQ ID NO: 948637 - RNA, 16 nt, Homo sapiens
cauguucagucacaug

SEQ ID NO: 948638 - RNA, 18 nt, Homo sapiens
cauguucagucacaugug

SEQ ID NO: 948639 - RNA, 19 nt, Homo sapiens
cauguucagucacaugugc

SEQ ID NO: 948640 - RNA, 23 nt, Homo sapiens
cauguugacauaugucuaugucc

SEQ ID NO: 948641 - RNA, 16 nt, Homo sapiens
cauuaggaacagagua

SEQ ID NO: 948642 - RNA, 18 nt, Homo sapiens
cauuaggaacagaguaua

SEQ ID NO: 948643 - RNA, 16 nt, Homo sapiens
cauuaguuucaggcaa

SEQ ID NO: 948644 - RNA, 15 nt, Homo sapiens
cauuauuuugauuga

SEQ ID NO: 948645 - RNA, 17 nt, Homo sapiens
cauuauuuugucauaaa

SEQ ID NO: 948646 - RNA, 16 nt, Homo sapiens
cauugaaauaauaaua

SEQ ID NO: 948647 - RNA, 14 nt, Homo sapiens
cauuuacagucaua

SEQ ID NO: 948648 - RNA, 20 nt, Homo sapiens
cauuucuuaccaugcauuuc

SEQ ID NO: 948649 - RNA, 17 nt, Homo sapiens
cauuuggaccacagcau

SEQ ID NO: 948650 - RNA, 12 nt, Homo sapiens
cauuuucuuuca

SEQ ID NO: 948651 - RNA, 18 nt, Homo sapiens
ccaaaaacuaaaauucaa

SEQ ID NO: 948652 - RNA, 17 nt, Homo sapiens
ccaaagcuuaugugaca

SEQ ID NO: 948653 - RNA, 17 nt, Homo sapiens
ccaaagcuugccacuuu

SEQ ID NO: 948654 - RNA, 19 nt, Homo sapiens
ccaaauaaaauguuuacau

SEQ ID NO: 948655 - RNA, 19 nt, Homo sapiens
ccaaauauaaacuugugua

SEQ ID NO: 948656 - RNA, 18 nt, Homo sapiens
ccaacaacuccaggaaaa

SEQ ID NO: 948657 - RNA, 19 nt, Homo sapiens
ccaacaagugcucuuucca

SEQ ID NO: 948658 - RNA, 20 nt, Homo sapiens
ccaagaguguguccacugag

SEQ ID NO: 948659 - RNA, 18 nt, Homo sapiens
ccaagccaaccacuuuca

SEQ ID NO: 948660 - RNA, 22 nt, Homo sapiens
ccaagccaucacaggcucugca

SEQ ID NO: 948661 - RNA, 14 nt, Homo sapiens
ccaagggucuuccu

SEQ ID NO: 948662 - RNA, 19 nt, Homo sapiens
ccaagucuuagaccaguga

SEQ ID NO: 948663 - RNA, 15 nt, Homo sapiens
ccaagugcaaaagaa

SEQ ID NO: 948664 - RNA, 22 nt, Homo sapiens
ccaauaaaagugucacuaagaa

SEQ ID NO: 948665 - RNA, 12 nt, Homo sapiens
ccacaagugugc

SEQ ID NO: 948666 - RNA, 14 nt, Homo sapiens
ccacacacagcagc

SEQ ID NO: 948667 - RNA, 16 nt, Homo sapiens
ccacacacagcagcuc

SEQ ID NO: 948668 - RNA, 16 nt, Homo sapiens
ccacagaguuuuucag

SEQ ID NO: 948669 - RNA, 15 nt, Homo sapiens
ccacauagcacacau

SEQ ID NO: 948670 - RNA, 18 nt, Homo sapiens
ccacuggcccuguuucuc

SEQ ID NO: 948671 - RNA, 15 nt, Homo sapiens
ccacuugaacaaaau

SEQ ID NO: 948672 - RNA, 22 nt, Homo sapiens
ccagaacaaaccucuauauguu

SEQ ID NO: 948673 - RNA, 12 nt, Homo sapiens
ccagaauuuccc

SEQ ID NO: 948674 - RNA, 21 nt, Homo sapiens
ccagacuggucucccaaguga

SEQ ID NO: 948675 - RNA, 16 nt, Homo sapiens
ccagagaccugcucca

SEQ ID NO: 948676 - RNA, 15 nt, Homo sapiens
ccagagcgugcacuu

SEQ ID NO: 948677 - RNA, 19 nt, Homo sapiens
ccagcgagucuggagacca

SEQ ID NO: 948678 - RNA, 23 nt, Homo sapiens
ccagcuucauaauuuccaugaua

SEQ ID NO: 948679 - RNA, 22 nt, Homo sapiens
ccagcuuuguuuuuggcauuuc

SEQ ID NO: 948680 - RNA, 19 nt, Homo sapiens
ccaggacgcagggagaccc

SEQ ID NO: 948681 - RNA, 15 nt, Homo sapiens
ccaggcccugcucau

SEQ ID NO: 948682 - RNA, 21 nt, Homo sapiens
ccaggccgacaggaggccaug

SEQ ID NO: 948683 - RNA, 15 nt, Homo sapiens
ccaggcuggagugca

SEQ ID NO: 948684 - RNA, 21 nt, Homo sapiens
ccagguaaagucaaagcuuug

SEQ ID NO: 948685 - RNA, 13 nt, Homo sapiens
ccagguccuguga

SEQ ID NO: 948686 - RNA, 23 nt, Homo sapiens
ccaguuauugugaaaacagaaga

SEQ ID NO: 948687 - RNA, 13 nt, Homo sapiens
ccaguucuuuuaa

SEQ ID NO: 948688 - RNA, 20 nt, Homo sapiens
ccaguuuuacaaaccuuuaa

SEQ ID NO: 948689 - RNA, 23 nt, Homo sapiens
ccaucagugaauccugaaacugg

SEQ ID NO: 948690 - RNA, 20 nt, Homo sapiens
ccauccacacacagcagcuc

SEQ ID NO: 948691 - RNA, 13 nt, Homo sapiens
ccaucccacugau

SEQ ID NO: 948692 - RNA, 19 nt, Homo sapiens
ccauccuucccgcagcacc

SEQ ID NO: 948693 - RNA, 23 nt, Homo sapiens
ccaucgucuuguguacacugcuc

SEQ ID NO: 948694 - RNA, 13 nt, Homo sapiens
ccaucucauuaca

SEQ ID NO: 948695 - RNA, 12 nt, Homo sapiens
ccaucugcugag

SEQ ID NO: 948696 - RNA, 18 nt, Homo sapiens
ccaugugggcugaaggau

SEQ ID NO: 948697 - RNA, 15 nt, Homo sapiens
ccauguucaccaaga

SEQ ID NO: 948698 - RNA, 19 nt, Homo sapiens
ccauguuuuugcaaauacu

SEQ ID NO: 948699 - RNA, 18 nt, Homo sapiens
ccauuagcaugacugcuu

SEQ ID NO: 948700 - RNA, 23 nt, Homo sapiens
ccauucauacuaaauaaaacaau

SEQ ID NO: 948701 - RNA, 13 nt, Homo sapiens
ccauucauuuaca

SEQ ID NO: 948702 - RNA, 21 nt, Homo sapiens
ccauuggaauggaccuuucag

SEQ ID NO: 948703 - RNA, 17 nt, Homo sapiens
ccauuucuuaccaugca

SEQ ID NO: 948704 - RNA, 14 nt, Homo sapiens
ccauuugugauacu

SEQ ID NO: 948705 - RNA, 19 nt, Homo sapiens
cccaaaugaccaaauccau

SEQ ID NO: 948706 - RNA, 15 nt, Homo sapiens
cccaagauagaguca

SEQ ID NO: 948707 - RNA, 16 nt, Homo sapiens
cccaagauagagucaa

SEQ ID NO: 948708 - RNA, 11 nt, Homo sapiens
cccaagcacaa

SEQ ID NO: 948709 - RNA, 21 nt, Homo sapiens
cccaaggaaaauggacauauu

SEQ ID NO: 948710 - RNA, 22 nt, Homo sapiens
cccacuuucgccuccuccagcu

SEQ ID NO: 948711 - RNA, 22 nt, Homo sapiens
cccagaaagccucagaguccug

SEQ ID NO: 948712 - RNA, 19 nt, Homo sapiens
cccagccucccccaggcug

SEQ ID NO: 948713 - RNA, 22 nt, Homo sapiens
cccaggcaggggcuucccacag

SEQ ID NO: 948714 - RNA, 14 nt, Homo sapiens
cccaguucauccca

SEQ ID NO: 948715 - RNA, 19 nt, Homo sapiens
cccaucguuacccauuucu

SEQ ID NO: 948716 - RNA, 17 nt, Homo sapiens
cccaucuccauugcauu

SEQ ID NO: 948717 - RNA, 18 nt, Homo sapiens
cccauuuguaauguaucu

SEQ ID NO: 948718 - RNA, 20 nt, Homo sapiens
ccccacuuuuuguuguucau

SEQ ID NO: 948719 - RNA, 16 nt, Homo sapiens
cccccuccuuuuccca

SEQ ID NO: 948720 - RNA, 18 nt, Homo sapiens
cccgaaaggucaccucac

SEQ ID NO: 948721 - RNA, 16 nt, Homo sapiens
cccgguguaugcagug

SEQ ID NO: 948722 - RNA, 14 nt, Homo sapiens
cccucucaugguca

SEQ ID NO: 948723 - RNA, 18 nt, Homo sapiens
cccuggcuugagugaucc

SEQ ID NO: 948724 - RNA, 23 nt, Homo sapiens
cccuucuauacuuucucacaugu

SEQ ID NO: 948725 - RNA, 12 nt, Homo sapiens
cccuuuugccca

SEQ ID NO: 948726 - RNA, 20 nt, Homo sapiens
ccgacggagccacuggggug

SEQ ID NO: 948727 - RNA, 16 nt, Homo sapiens
ccgagagcugggacuc

SEQ ID NO: 948728 - RNA, 15 nt, Homo sapiens
ccgagccgagcucuc

SEQ ID NO: 948729 - RNA, 20 nt, Homo sapiens
ccgcaccccuccuccuugcu

SEQ ID NO: 948730 - RNA, 23 nt, Homo sapiens
ccgcugcuugaguggacagcagc

SEQ ID NO: 948731 - RNA, 14 nt, Homo sapiens
ccgugaagucugcu

SEQ ID NO: 948732 - RNA, 23 nt, Homo sapiens
cuugaucagacauucagagauua

SEQ ID NO: 948733 - RNA, 17 nt, Homo sapiens
cuugcacacaugcacac

SEQ ID NO: 948734 - RNA, 15 nt, Homo sapiens
cuugcauagugccug

SEQ ID NO: 948735 - RNA, 16 nt, Homo sapiens
cuuggcuaacauagca

SEQ ID NO: 948736 - RNA, 22 nt, Homo sapiens
cuuguguuguuuucucugauca

SEQ ID NO: 948737 - RNA, 21 nt, Homo sapiens
cuuguuuuuuauccugccuca

SEQ ID NO: 948738 - RNA, 13 nt, Homo sapiens
cuuuacagcacug

SEQ ID NO: 948739 - RNA, 16 nt, Homo sapiens
cuuuauucacaguauc

SEQ ID NO: 948740 - RNA, 13 nt, Homo sapiens
cuuucacaucucu

SEQ ID NO: 948741 - RNA, 18 nt, Homo sapiens
cuuucauccaacuggaag

SEQ ID NO: 948742 - RNA, 19 nt, Homo sapiens
cuuuccaucuuacuugccc

SEQ ID NO: 948743 - RNA, 16 nt, Homo sapiens
cuuucucauucuugcc

SEQ ID NO: 948744 - RNA, 13 nt, Homo sapiens
cuuugaaauucau

SEQ ID NO: 948745 - RNA, 11 nt, Homo sapiens
cuuugcaguga

SEQ ID NO: 948746 - RNA, 18 nt, Homo sapiens
cuuugcuuuacagcacug

SEQ ID NO: 948747 - RNA, 19 nt, Homo sapiens
cuuugcuuuacagcacugu

SEQ ID NO: 948748 - RNA, 22 nt, Homo sapiens
cuuugggagaguuguuggcaag

SEQ ID NO: 948749 - RNA, 14 nt, Homo sapiens
cuuuguacagacaa

SEQ ID NO: 948750 - RNA, 13 nt, Homo sapiens
cuuugucaguaua

SEQ ID NO: 948751 - RNA, 22 nt, Homo sapiens
cuuuuccugaauuggaaaggaa

SEQ ID NO: 948752 - RNA, 15 nt, Homo sapiens
cuuuugagugccuua

SEQ ID NO: 948753 - RNA, 16 nt, Homo sapiens
cuuuugagugccuuac

SEQ ID NO: 948754 - RNA, 16 nt, Homo sapiens
cuuuuggcaguucuga

SEQ ID NO: 948755 - RNA, 15 nt, Homo sapiens
cuuuuuccucaauga

SEQ ID NO: 948756 - RNA, 18 nt, Homo sapiens
gaaaaaauaacacuguac

SEQ ID NO: 948757 - RNA, 14 nt, Homo sapiens
gaaaaauaugugaa

SEQ ID NO: 948758 - RNA, 13 nt, Homo sapiens
gaaaaaucauaac

SEQ ID NO: 948759 - RNA, 22 nt, Homo sapiens
gaaaaaucauaacucacuuuaa

SEQ ID NO: 948760 - RNA, 21 nt, Homo sapiens
gaaaagaggcccaagugcaaa

SEQ ID NO: 948761 - RNA, 16 nt, Homo sapiens
gaaaaugcuuucucau

SEQ ID NO: 948762 - RNA, 16 nt, Homo sapiens
gaaaauguaaguuaug

SEQ ID NO: 948763 - RNA, 13 nt, Homo sapiens
gaaaauguucacu

SEQ ID NO: 948764 - RNA, 20 nt, Homo sapiens
gaaaauuuccuccacauuca

SEQ ID NO: 948765 - RNA, 23 nt, Homo sapiens
gaaacagaccuuuuucucucuua

SEQ ID NO: 948766 - RNA, 10 nt, Homo sapiens
gaaaccagug

SEQ ID NO: 948767 - RNA, 20 nt, Homo sapiens
gaaacccuacgaaagcacag

SEQ ID NO: 948768 - RNA, 16 nt, Homo sapiens
gaaacccugagagucu

SEQ ID NO: 948769 - RNA, 19 nt, Homo sapiens
gaaaccuaaggcaacauuu

SEQ ID NO: 948770 - RNA, 20 nt, Homo sapiens
gaaagagaaaaugcuuucuc

SEQ ID NO: 948771 - RNA, 23 nt, Homo sapiens
gaaagagcuggcaaacugugaau

SEQ ID NO: 948772 - RNA, 20 nt, Homo sapiens
gaaagccucagaguccugcc

SEQ ID NO: 948773 - RNA, 14 nt, Homo sapiens
gaaauaaagcacau

SEQ ID NO: 948774 - RNA, 12 nt, Homo sapiens
gaaauaguucca

SEQ ID NO: 948775 - RNA, 18 nt, Homo sapiens
gaaaucagccuugcacaa

SEQ ID NO: 948776 - RNA, 16 nt, Homo sapiens
gaaauguauaugcuac

SEQ ID NO: 948777 - RNA, 23 nt, Homo sapiens
gaaauguguucuguaauggggac

SEQ ID NO: 948778 - RNA, 13 nt, Homo sapiens
gaaauuuucuaca

SEQ ID NO: 948779 - RNA, 21 nt, Homo sapiens
gaacagaaauuucuccaggga

SEQ ID NO: 948780 - RNA, 22 nt, Homo sapiens
gaacauagaugcuacaguauuu

SEQ ID NO: 948781 - RNA, 17 nt, Homo sapiens
gaaccauguguggcaaa

SEQ ID NO: 948782 - RNA, 18 nt, Homo sapiens
gaacccgcucucccagac

SEQ ID NO: 948783 - RNA, 15 nt, Homo sapiens
gaacccuucucagac

SEQ ID NO: 948784 - RNA, 12 nt, Homo sapiens
gaacucuuggcc

SEQ ID NO: 948785 - RNA, 23 nt, Homo sapiens
gaacuggacuagugaaaaaucua

SEQ ID NO: 948786 - RNA, 21 nt, Homo sapiens
gaacuuauucuccaucucaag

SEQ ID NO: 948787 - RNA, 13 nt, Homo sapiens
gaagaaaaaggau

SEQ ID NO: 948788 - RNA, 20 nt, Homo sapiens
gaagaaguuaucaacaugca

SEQ ID NO: 948789 - RNA, 19 nt, Homo sapiens
gaagaauuuaucugugaau

SEQ ID NO: 948790 - RNA, 14 nt, Homo sapiens
gaagagaugcucua

SEQ ID NO: 948791 - RNA, 18 nt, Homo sapiens
gaagauuauaaaagccaa

SEQ ID NO: 948792 - RNA, 14 nt, Homo sapiens
gaagauucgaacag

SEQ ID NO: 948793 - RNA, 13 nt, Homo sapiens
gaagcacugccau

SEQ ID NO: 948794 - RNA, 14 nt, Homo sapiens
gaagcucaacuguu

SEQ ID NO: 948795 - RNA, 12 nt, Homo sapiens
gaaggccagcuu

SEQ ID NO: 948796 - RNA, 21 nt, Homo sapiens
gaaggucccgaauggagucca

SEQ ID NO: 948797 - RNA, 17 nt, Homo sapiens
gaaggugcccaaccuaa

SEQ ID NO: 948798 - RNA, 22 nt, Homo sapiens
gaaguuaccuuuuauaagacaa

SEQ ID NO: 948799 - RNA, 16 nt, Homo sapiens
gaauaagcaaaauuca

SEQ ID NO: 948800 - RNA, 20 nt, Homo sapiens
gaauagguuucaacauauga

SEQ ID NO: 948801 - RNA, 24 nt, Homo sapiens
gaauaguauucugaucaguugcca

SEQ ID NO: 948802 - RNA, 13 nt, Homo sapiens
gaauauuguuaaa

SEQ ID NO: 948803 - RNA, 22 nt, Homo sapiens
gaaucaaagacauuucauccac

SEQ ID NO: 948804 - RNA, 15 nt, Homo sapiens
gaaucacugcacuua

SEQ ID NO: 948805 - RNA, 13 nt, Homo sapiens
gaaugagcucucu

SEQ ID NO: 948806 - RNA, 20 nt, Homo sapiens
gaaugcauacucugugcaag

SEQ ID NO: 948807 - RNA, 12 nt, Homo sapiens
gaaugcaugugu

SEQ ID NO: 948808 - RNA, 15 nt, Homo sapiens
gaauuagguaaugga

SEQ ID NO: 948809 - RNA, 19 nt, Homo sapiens
gaauucuuaaauaugugga

SEQ ID NO: 948810 - RNA, 16 nt, Homo sapiens
gaauuuaucugugaau

SEQ ID NO: 948811 - RNA, 18 nt, Homo sapiens
gacaaaauccaucaggga

SEQ ID NO: 948812 - RNA, 17 nt, Homo sapiens
gacacgcacuucugggg

SEQ ID NO: 948813 - RNA, 15 nt, Homo sapiens
gacacguucuugcca

SEQ ID NO: 948814 - RNA, 18 nt, Homo sapiens
gacacuaaccagagucag

SEQ ID NO: 948815 - RNA, 17 nt, Homo sapiens
gacagaagguugccagg

SEQ ID NO: 948816 - RNA, 15 nt, Homo sapiens
gacagacagaaggca

SEQ ID NO: 948817 - RNA, 15 nt, Homo sapiens
gacagagauggcaga

SEQ ID NO: 948818 - RNA, 20 nt, Homo sapiens
gacaggcuucgucucagaag

SEQ ID NO: 948819 - RNA, 14 nt, Homo sapiens
gacagggucucacu

SEQ ID NO: 948820 - RNA, 18 nt, Homo sapiens
gacagggucucacugugu

SEQ ID NO: 948821 - RNA, 17 nt, Homo sapiens
gaccaaaauacccaggu

SEQ ID NO: 948822 - RNA, 21 nt, Homo sapiens
gacccugggagagugagguca

SEQ ID NO: 948823 - RNA, 20 nt, Homo sapiens
gaccucccuggcuugaguga

SEQ ID NO: 948824 - RNA, 17 nt, Homo sapiens
gacggagccacuggggu

SEQ ID NO: 948825 - RNA, 17 nt, Homo sapiens
gacguguuaugacucca

SEQ ID NO: 948826 - RNA, 23 nt, Homo sapiens
gacuaaauuuggggacagauuca

SEQ ID NO: 948827 - RNA, 18 nt, Homo sapiens
gacuacuugauauaauua

SEQ ID NO: 948828 - RNA, 13 nt, Homo sapiens
gacucagcacugu

SEQ ID NO: 948829 - RNA, 18 nt, Homo sapiens
gacuuaauuaugcuaaca

SEQ ID NO: 948830 - RNA, 17 nt, Homo sapiens
gacuuauauauuugaaa

SEQ ID NO: 948831 - RNA, 20 nt, Homo sapiens
gagaaauaaagcacauuuga

SEQ ID NO: 948832 - RNA, 19 nt, Homo sapiens
gagaaauacaucauuugca

SEQ ID NO: 948833 - RNA, 16 nt, Homo sapiens
gagaagccucauggga

SEQ ID NO: 948834 - RNA, 18 nt, Homo sapiens
gagacccccgugccaaau

SEQ ID NO: 948835 - RNA, 19 nt, Homo sapiens
gagagccucuaugugcaag

SEQ ID NO: 948836 - RNA, 23 nt, Homo sapiens
gagauaaacugaaauuugcuaua

SEQ ID NO: 948837 - RNA, 15 nt, Homo sapiens
gagaucugugccaua

SEQ ID NO: 948838 - RNA, 14 nt, Homo sapiens
gagauggaauauca

SEQ ID NO: 948839 - RNA, 18 nt, Homo sapiens
gagcaaagugcagguuau

SEQ ID NO: 948840 - RNA, 15 nt, Homo sapiens
gagcaagaacauuca

SEQ ID NO: 948841 - RNA, 21 nt, Homo sapiens
gagcacacugcacacaugcac

SEQ ID NO: 948842 - RNA, 21 nt, Homo sapiens
gagcacaggcaacauuacaaa

SEQ ID NO: 948843 - RNA, 17 nt, Homo sapiens
gagcacuagaagcacag

SEQ ID NO: 948844 - RNA, 16 nt, Homo sapiens
gagcauaccacuugaa

SEQ ID NO: 948845 - RNA, 18 nt, Homo sapiens
gagccaaagcuuauguga

SEQ ID NO: 948846 - RNA, 21 nt, Homo sapiens
gagccaaagcuuaugugacau

SEQ ID NO: 948847 - RNA, 18 nt, Homo sapiens
gagcccaaaugaccaaau

SEQ ID NO: 948848 - RNA, 23 nt, Homo sapiens
gagcccaauguauuaugaucucu

SEQ ID NO: 948849 - RNA, 20 nt, Homo sapiens
gagcccaggggaggcacaaa

SEQ ID NO: 948850 - RNA, 15 nt, Homo sapiens
gagccgagcucuccu

SEQ ID NO: 948851 - RNA, 13 nt, Homo sapiens
gagcgggggcuaa

SEQ ID NO: 948852 - RNA, 18 nt, Homo sapiens
gagcucuccugggccagg

SEQ ID NO: 948853 - RNA, 13 nt, Homo sapiens
gaggaaccucaaa

SEQ ID NO: 948854 - RNA, 22 nt, Homo sapiens
gaggacggggagauagaacugu

SEQ ID NO: 948855 - RNA, 14 nt, Homo sapiens
gaggcacaaagggc

SEQ ID NO: 948856 - RNA, 19 nt, Homo sapiens
gaggcacgcaccaccgcgc

SEQ ID NO: 948857 - RNA, 22 nt, Homo sapiens
gaggccugggugugaccugaca

SEQ ID NO: 948858 - RNA, 17 nt, Homo sapiens
gaggcuggaccaacugc

SEQ ID NO: 948859 - RNA, 12 nt, Homo sapiens
gaggguuuccac

SEQ ID NO: 948860 - RNA, 20 nt, Homo sapiens
gagguauggguuuuacugau

SEQ ID NO: 948861 - RNA, 21 nt, Homo sapiens
gaggugggcguaucaccugag

SEQ ID NO: 948862 - RNA, 18 nt, Homo sapiens
gcuauuauaauauagaaa

SEQ ID NO: 948863 - RNA, 16 nt, Homo sapiens
gcucacuggcuuuagc

SEQ ID NO: 948864 - RNA, 19 nt, Homo sapiens
gcucagagcagaaccaaag

SEQ ID NO: 948865 - RNA, 20 nt, Homo sapiens
gcucauuucacuauucuguu

SEQ ID NO: 948866 - RNA, 18 nt, Homo sapiens
gcuccaggagcagcgugc

SEQ ID NO: 948867 - RNA, 22 nt, Homo sapiens
gcuccugggccugggcuuuagu

SEQ ID NO: 948868 - RNA, 20 nt, Homo sapiens
gcucugagcaguuguuauau

SEQ ID NO: 948869 - RNA, 17 nt, Homo sapiens
gcucugcauaagauuau

SEQ ID NO: 948870 - RNA, 23 nt, Homo sapiens
gcugaacaggccgcacaucucac

SEQ ID NO: 948871 - RNA, 14 nt, Homo sapiens
gcugauuucaaaug

SEQ ID NO: 948872 - RNA, 11 nt, Homo sapiens
gcugcacagua

SEQ ID NO: 948873 - RNA, 20 nt, Homo sapiens
gcugcaccuucacucuccag

SEQ ID NO: 948874 - RNA, 15 nt, Homo sapiens
gcuggagaauuccag

SEQ ID NO: 948875 - RNA, 17 nt, Homo sapiens
gcuggcaaacugugaau

SEQ ID NO: 948876 - RNA, 15 nt, Homo sapiens
gcuggcaggagacac

SEQ ID NO: 948877 - RNA, 19 nt, Homo sapiens
gcuguccucuuaagacacu

SEQ ID NO: 948878 - RNA, 13 nt, Homo sapiens
gcuguuagcacgu

SEQ ID NO: 948879 - RNA, 15 nt, Homo sapiens
gcuguuccacuucuc

SEQ ID NO: 948880 - RNA, 18 nt, Homo sapiens
gcuugcacacaugcacac

SEQ ID NO: 948881 - RNA, 18 nt, Homo sapiens
gcuuguggucacacugug

SEQ ID NO: 948882 - RNA, 14 nt, Homo sapiens
gcuuucaggacuug

SEQ ID NO: 948883 - RNA, 15 nt, Homo sapiens
ggaaagaaccgaaga

SEQ ID NO: 948884 - RNA, 21 nt, Homo sapiens
ggaaaguaucucuacuuuccu

SEQ ID NO: 948885 - RNA, 16 nt, Homo sapiens
ggaaauacacuacaaa

SEQ ID NO: 948886 - RNA, 16 nt, Homo sapiens
ggaacacucugagacu

SEQ ID NO: 948887 - RNA, 17 nt, Homo sapiens
ggaagccuccugcugag

SEQ ID NO: 948888 - RNA, 14 nt, Homo sapiens
ggaaggacauuucc

SEQ ID NO: 948889 - RNA, 15 nt, Homo sapiens
ggaauaucaaugccc

SEQ ID NO: 948890 - RNA, 23 nt, Homo sapiens
ggaauggggaacccgcucuccca

SEQ ID NO: 948891 - RNA, 19 nt, Homo sapiens
ggacaggcuucgucucaga

SEQ ID NO: 948892 - RNA, 23 nt, Homo sapiens
ggaccacuguuucuugcuuguac

SEQ ID NO: 948893 - RNA, 19 nt, Homo sapiens
ggaccuccaccugggagau

SEQ ID NO: 948894 - RNA, 17 nt, Homo sapiens
ggaccugcgcaaagggc

SEQ ID NO: 948895 - RNA, 14 nt, Homo sapiens
ggaccugggguccc

SEQ ID NO: 948896 - RNA, 18 nt, Homo sapiens
ggacuguggccucaggag

SEQ ID NO: 948897 - RNA, 13 nt, Homo sapiens
ggagaaaauggac

SEQ ID NO: 948898 - RNA, 16 nt, Homo sapiens
ggagagaaguugcccu

SEQ ID NO: 948899 - RNA, 17 nt, Homo sapiens
ggagagguuacccgaga

SEQ ID NO: 948900 - RNA, 20 nt, Homo sapiens
ggagcacgaggccuucagaa

SEQ ID NO: 948901 - RNA, 14 nt, Homo sapiens
ggagccaugcucuu

SEQ ID NO: 948902 - RNA, 12 nt, Homo sapiens
ggagcucauucu

SEQ ID NO: 948903 - RNA, 16 nt, Homo sapiens
ggagggagaagaaaga

SEQ ID NO: 948904 - RNA, 11 nt, Homo sapiens
ggaggggccca

SEQ ID NO: 948905 - RNA, 15 nt, Homo sapiens
ggagugaacauuucu

SEQ ID NO: 948906 - RNA, 15 nt, Homo sapiens
ggagugcagaagcau

SEQ ID NO: 948907 - RNA, 11 nt, Homo sapiens
ggaguggcaug

SEQ ID NO: 948908 - RNA, 19 nt, Homo sapiens
ggauaauaacuagaucucc

SEQ ID NO: 948909 - RNA, 19 nt, Homo sapiens
ggauccgugacagcacuuu

SEQ ID NO: 948910 - RNA, 18 nt, Homo sapiens
ggaugaacucaaugcaug

SEQ ID NO: 948911 - RNA, 23 nt, Homo sapiens
ggaugaggaaccucaaacugggu

SEQ ID NO: 948912 - RNA, 12 nt, Homo sapiens
ggauuaaucucu

SEQ ID NO: 948913 - RNA, 16 nt, Homo sapiens
ggauucacagccuuug

SEQ ID NO: 948914 - RNA, 22 nt, Homo sapiens
ggauuuggguuuggaaauggag

SEQ ID NO: 948915 - RNA, 17 nt, Homo sapiens
ggcaaauaaaagcauuu

SEQ ID NO: 948916 - RNA, 14 nt, Homo sapiens
ggcagagccaucca

SEQ ID NO: 948917 - RNA, 14 nt, Homo sapiens
ggcaggaagucccu

SEQ ID NO: 948918 - RNA, 19 nt, Homo sapiens
ggcaggagggcaugugcag

SEQ ID NO: 948919 - RNA, 14 nt, Homo sapiens
ggcagggucucacu

SEQ ID NO: 948920 - RNA, 21 nt, Homo sapiens
ggcauaaagcugggaggccaa

SEQ ID NO: 948921 - RNA, 18 nt, Homo sapiens
ggcauagccacuugcuca

SEQ ID NO: 948922 - RNA, 15 nt, Homo sapiens
ggcauagccauucau

SEQ ID NO: 948923 - RNA, 13 nt, Homo sapiens
ggcauccaguauc

SEQ ID NO: 948924 - RNA, 18 nt, Homo sapiens
ggccaaguguacauuuga

SEQ ID NO: 948925 - RNA, 20 nt, Homo sapiens
ggccagggucucgucaggag

SEQ ID NO: 948926 - RNA, 19 nt, Homo sapiens
ggccauuugugauacuucc

SEQ ID NO: 948927 - RNA, 20 nt, Homo sapiens
ggcccagaggggcggggcca

SEQ ID NO: 948928 - RNA, 22 nt, Homo sapiens
ggccccgccugcucuuuccucc

SEQ ID NO: 948929 - RNA, 20 nt, Homo sapiens
ggcccuccucagcacggugc

SEQ ID NO: 948930 - RNA, 24 nt, Homo sapiens
ggccgcuucagacacgcacuucug

SEQ ID NO: 948931 - RNA, 22 nt, Homo sapiens
ggccuguucccugaggaccugc

SEQ ID NO: 948932 - RNA, 23 nt, Homo sapiens
ggccuuacucauauauugccuuc

SEQ ID NO: 948933 - RNA, 19 nt, Homo sapiens
ggccuucagaaaagacacu

SEQ ID NO: 948934 - RNA, 22 nt, Homo sapiens
ggccuucagaaaagacacuuca

SEQ ID NO: 948935 - RNA, 21 nt, Homo sapiens
ggccuuugcuuuacagcacug

SEQ ID NO: 948936 - RNA, 16 nt, Homo sapiens
ggcuaaaaacauuuua

SEQ ID NO: 948937 - RNA, 14 nt, Homo sapiens
ggcuaacauagcac

SEQ ID NO: 948938 - RNA, 22 nt, Homo sapiens
ggcucacgaggcuuggaccugg

SEQ ID NO: 948939 - RNA, 16 nt, Homo sapiens
ggcuccuggcagugac

SEQ ID NO: 948940 - RNA, 24 nt, Homo sapiens
ggcucugcgucccacugagucuca

SEQ ID NO: 948941 - RNA, 21 nt, Homo sapiens
ggcuuaucagaacuccuuucu

SEQ ID NO: 948942 - RNA, 17 nt, Homo sapiens
ggcuugaagcugcucac

SEQ ID NO: 948943 - RNA, 23 nt, Homo sapiens
ggcuuuacauggguucaauugga

SEQ ID NO: 948944 - RNA, 17 nt, Homo sapiens
gggaaauucacacugug

SEQ ID NO: 948945 - RNA, 16 nt, Homo sapiens
gggaaggccugaggga

SEQ ID NO: 948946 - RNA, 13 nt, Homo sapiens
gggauuggaagaa

SEQ ID NO: 948947 - RNA, 14 nt, Homo sapiens
gggccgccuccucc

SEQ ID NO: 948948 - RNA, 19 nt, Homo sapiens
gggccgccuccuccagacu

SEQ ID NO: 948949 - RNA, 20 nt, Homo sapiens
gggcugagccccuccucucc

SEQ ID NO: 948950 - RNA, 14 nt, Homo sapiens
gggcuggccugaca

SEQ ID NO: 948951 - RNA, 20 nt, Homo sapiens
gggcuguuuuaagaccagag

SEQ ID NO: 948952 - RNA, 14 nt, Homo sapiens
ggggcacuguuucu

SEQ ID NO: 948953 - RNA, 14 nt, Homo sapiens
gggguucaugagga

SEQ ID NO: 948954 - RNA, 20 nt, Homo sapiens
gggucucacuguguugccca

SEQ ID NO: 948955 - RNA, 13 nt, Homo sapiens
ggguuacacuguu

SEQ ID NO: 948956 - RNA, 12 nt, Homo sapiens
ggguugggcucu

SEQ ID NO: 948957 - RNA, 20 nt, Homo sapiens
ggguuucaccauguugccca

SEQ ID NO: 948958 - RNA, 21 nt, Homo sapiens
gguaaauaaagccacuuuccu

SEQ ID NO: 948959 - RNA, 18 nt, Homo sapiens
gguauuucuuauuugaaa

SEQ ID NO: 948960 - RNA, 16 nt, Homo sapiens
ggucaguuuucacaga

SEQ ID NO: 948961 - RNA, 21 nt, Homo sapiens
ggucauuucuuagauggagaa

SEQ ID NO: 948962 - RNA, 21 nt, Homo sapiens
ggucccgaauggaguccagac

SEQ ID NO: 948963 - RNA, 14 nt, Homo sapiens
gguccuuuggacag

SEQ ID NO: 948964 - RNA, 21 nt, Homo sapiens
ggucucccaacaagugcucuu

SEQ ID NO: 948965 - RNA, 14 nt, Homo sapiens
gguuaaaacauaag

SEQ ID NO: 948966 - RNA, 17 nt, Homo sapiens
gguuccuuuugaagcuc

SEQ ID NO: 948967 - RNA, 20 nt, Homo sapiens
guaaauuuuauaaugucaua

SEQ ID NO: 948968 - RNA, 15 nt, Homo sapiens
guaaugcacuccugc

SEQ ID NO: 948969 - RNA, 17 nt, Homo sapiens
guaaugugucaaagaga

SEQ ID NO: 948970 - RNA, 21 nt, Homo sapiens
guaauucccaucugcuuuauu

SEQ ID NO: 948971 - RNA, 14 nt, Homo sapiens
guaauuguuacaau

SEQ ID NO: 948972 - RNA, 22 nt, Homo sapiens
guacaaugauguaaauauuuca

SEQ ID NO: 948973 - RNA, 16 nt, Homo sapiens
guacaauuuucauccc

SEQ ID NO: 948974 - RNA, 17 nt, Homo sapiens
guacaauuuucauccca

SEQ ID NO: 948975 - RNA, 14 nt, Homo sapiens
guacacgugcacag

SEQ ID NO: 948976 - RNA, 14 nt, Homo sapiens
guaccuuguguacu

SEQ ID NO: 948977 - RNA, 19 nt, Homo sapiens
guacgucugguguucucaa

SEQ ID NO: 948978 - RNA, 19 nt, Homo sapiens
guacuggagaaaauggacg

SEQ ID NO: 948979 - RNA, 22 nt, Homo sapiens
guacugucuuuacaaguagcua

SEQ ID NO: 948980 - RNA, 16 nt, Homo sapiens
guacuuucacaucucu

SEQ ID NO: 948981 - RNA, 23 nt, Homo sapiens
guagacaugcacacccauucaca

SEQ ID NO: 948982 - RNA, 19 nt, Homo sapiens
guagagcauaccacuugaa

SEQ ID NO: 948983 - RNA, 15 nt, Homo sapiens
guagagucacuggaa

SEQ ID NO: 948984 - RNA, 22 nt, Homo sapiens
guagauacaggggcaaaaguca

SEQ ID NO: 948985 - RNA, 16 nt, Homo sapiens
guagcaaguacuuugg

SEQ ID NO: 948986 - RNA, 20 nt, Homo sapiens
guagcuaggugcacauauac

SEQ ID NO: 948987 - RNA, 16 nt, Homo sapiens
guaggugaaagaacaa

SEQ ID NO: 948988 - RNA, 17 nt, Homo sapiens
guauagaccaugcacag

SEQ ID NO: 948989 - RNA, 16 nt, Homo sapiens
guaucaccucuucaca

SEQ ID NO: 948990 - RNA, 21 nt, Homo sapiens
guauccuggcaaauaauacua

SEQ ID NO: 948991 - RNA, 15 nt, Homo sapiens
guaucucuacuuucc

SEQ ID NO: 948992 - RNA, 22 nt, Homo sapiens
guaugaagacacugucaaugag

SEQ ID NO: 948993 - RNA, 19 nt, Homo sapiens
guauuagugacaccacaca

SEQ ID NO: 948994 - RNA, 17 nt, Homo sapiens
guauuauggugauacuc

SEQ ID NO: 948995 - RNA, 23 nt, Homo sapiens
guauucuucugacagagccauau

SEQ ID NO: 948996 - RNA, 14 nt, Homo sapiens
cuccaugucuguag

SEQ ID NO: 948997 - RNA, 17 nt, Homo sapiens
cuccauugcauucaugu

SEQ ID NO: 948998 - RNA, 19 nt, Homo sapiens
cucccaacaagugcucuuu

SEQ ID NO: 948999 - RNA, 18 nt, Homo sapiens
cucccaggucacaugcac

SEQ ID NO: 949000 - RNA, 15 nt, Homo sapiens
cuccccggcaucauu

SEQ ID NO: 949001 - RNA, 23 nt, Homo sapiens
cuccccucuccugcgugugccca

SEQ ID NO: 949002 - RNA, 22 nt, Homo sapiens
cucccugcuuggcuuaugaaaa

SEQ ID NO: 949003 - RNA, 21 nt, Homo sapiens
cucccuguaaugcacuccugc

SEQ ID NO: 949004 - RNA, 16 nt, Homo sapiens
uguaaauuuaacugca

SEQ ID NO: 949005 - RNA, 18 nt, Homo sapiens
uguaaauuuaacugcaua

SEQ ID NO: 949006 - RNA, 16 nt, Homo sapiens
uguaacaacuaaagua

SEQ ID NO: 949007 - RNA, 14 nt, Homo sapiens
uguaauauacaguu

SEQ ID NO: 949008 - RNA, 17 nt, Homo sapiens
uguaauauauaaucaaa

SEQ ID NO: 949009 - RNA, 17 nt, Homo sapiens
uguaaugcacuccugcc

SEQ ID NO: 949010 - RNA, 15 nt, Homo sapiens
uguacagacaacaaa

SEQ ID NO: 949011 - RNA, 15 nt, Homo sapiens
uguaccuuguguacu

SEQ ID NO: 949012 - RNA, 12 nt, Homo sapiens
uguacuauccag

SEQ ID NO: 949013 - RNA, 16 nt, Homo sapiens
uguacucacugaguaa

SEQ ID NO: 949014 - RNA, 19 nt, Homo sapiens
uguagaauuauaacuaauu

SEQ ID NO: 949015 - RNA, 21 nt, Homo sapiens
uguaggacuaaauaaugaucu

SEQ ID NO: 949016 - RNA, 21 nt, Homo sapiens
uguagugccaugguagaagaa

SEQ ID NO: 949017 - RNA, 17 nt, Homo sapiens
uguaucaccucuucaca

SEQ ID NO: 949018 - RNA, 14 nt, Homo sapiens
uguauccagucuga

SEQ ID NO: 949019 - RNA, 23 nt, Homo sapiens
uguaucuuuaggucuuugccuuc

SEQ ID NO: 949020 - RNA, 19 nt, Homo sapiens
uguaugacugaaguaauaa

SEQ ID NO: 949021 - RNA, 13 nt, Homo sapiens
uguaugugcuugc

SEQ ID NO: 949022 - RNA, 19 nt, Homo sapiens
uguauuccucacauucaca

SEQ ID NO: 949023 - RNA, 19 nt, Homo sapiens
ugucaaugagguuaugaga

SEQ ID NO: 949024 - RNA, 18 nt, Homo sapiens
ugucaccagcugccaaaa

SEQ ID NO: 949025 - RNA, 14 nt, Homo sapiens
ugucacucacaaaa

SEQ ID NO: 949026 - RNA, 13 nt, Homo sapiens
ugucagucugucc

SEQ ID NO: 949027 - RNA, 18 nt, Homo sapiens
ugucauaaucucuuucca

SEQ ID NO: 949028 - RNA, 19 nt, Homo sapiens
ugucaugauuucaaugauu

SEQ ID NO: 949029 - RNA, 18 nt, Homo sapiens
ugucauugguuacaaauu

SEQ ID NO: 949030 - RNA, 20 nt, Homo sapiens
uguccacacuaccaguuuca

SEQ ID NO: 949031 - RNA, 17 nt, Homo sapiens
ugucccuuucacacugu

SEQ ID NO: 949032 - RNA, 17 nt, Homo sapiens
uguccucacucucgcca

SEQ ID NO: 949033 - RNA, 18 nt, Homo sapiens
uguccucacucucgccau

SEQ ID NO: 949034 - RNA, 17 nt, Homo sapiens
uguccuggucaguuuuc

SEQ ID NO: 949035 - RNA, 18 nt, Homo sapiens
ugucuaguuugcauacuu

SEQ ID NO: 949036 - RNA, 13 nt, Homo sapiens
ugucugauucuau

SEQ ID NO: 949037 - RNA, 21 nt, Homo sapiens
ugucuguucuaaguccacuua

SEQ ID NO: 949038 - RNA, 18 nt, Homo sapiens
ugugaaaauuuaaucuua

SEQ ID NO: 949039 - RNA, 15 nt, Homo sapiens
ugugacacugcagca

SEQ ID NO: 949040 - RNA, 13 nt, Homo sapiens
ugugacugaucuc

SEQ ID NO: 949041 - RNA, 17 nt, Homo sapiens
ugugagccacagcacuc

SEQ ID NO: 949042 - RNA, 15 nt, Homo sapiens
ugugaguucugggcu

SEQ ID NO: 949043 - RNA, 11 nt, Homo sapiens
ugugcaaaaau

SEQ ID NO: 949044 - RNA, 23 nt, Homo sapiens
ugugccaaacuaccguucccaaa

SEQ ID NO: 949045 - RNA, 12 nt, Homo sapiens
ugugccaaagau

SEQ ID NO: 949046 - RNA, 22 nt, Homo sapiens
ugugcucucgggugcccugcau

SEQ ID NO: 949047 - RNA, 13 nt, Homo sapiens
ugugcugugacaa

SEQ ID NO: 949048 - RNA, 14 nt, Homo sapiens
ugugcuuucauguu

SEQ ID NO: 949049 - RNA, 13 nt, Homo sapiens
uguggaugcucuu

SEQ ID NO: 949050 - RNA, 15 nt, Homo sapiens
uguggauucuauauu

SEQ ID NO: 949051 - RNA, 20 nt, Homo sapiens
uguggcaaacuugcaguuua

SEQ ID NO: 949052 - RNA, 15 nt, Homo sapiens
uguggcuuaguaaua

SEQ ID NO: 949053 - RNA, 19 nt, Homo sapiens
ugugggaaaaauaugugaa

SEQ ID NO: 949054 - RNA, 18 nt, Homo sapiens
ugugggcagaauccuugu

SEQ ID NO: 949055 - RNA, 15 nt, Homo sapiens
uguggucacacugug

SEQ ID NO: 949056 - RNA, 18 nt, Homo sapiens
ugugguuauuuucuccau

SEQ ID NO: 949057 - RNA, 21 nt, Homo sapiens
uguguacagaaacaacugcca

SEQ ID NO: 949058 - RNA, 22 nt, Homo sapiens
uguguacagaaacaacugccaa

SEQ ID NO: 949059 - RNA, 21 nt, Homo sapiens
uguguauucuguggauucuau

SEQ ID NO: 949060 - RNA, 15 nt, Homo sapiens
uguguccacagaguu

SEQ ID NO: 949061 - RNA, 18 nt, Homo sapiens
uguguggcaaacuugcag

SEQ ID NO: 949062 - RNA, 22 nt, Homo sapiens
uguuaacagaugauccauuuga

SEQ ID NO: 949063 - RNA, 16 nt, Homo sapiens
uguuagacuaggcaaa

SEQ ID NO: 949064 - RNA, 16 nt, Homo sapiens
uguucaugucagcuua

SEQ ID NO: 949065 - RNA, 17 nt, Homo sapiens
uguucuaaguccacuua

SEQ ID NO: 949066 - RNA, 22 nt, Homo sapiens
uguucucaaaugcuaaaugcaa

SEQ ID NO: 949067 - RNA, 18 nt, Homo sapiens
uguugaaacaaaacugga

SEQ ID NO: 949068 - RNA, 21 nt, Homo sapiens
uguugacaauuugccauagca

SEQ ID NO: 949069 - RNA, 15 nt, Homo sapiens
uguugauuccacuga

SEQ ID NO: 949070 - RNA, 21 nt, Homo sapiens
uguuggucaaaugaccuagaa

SEQ ID NO: 949071 - RNA, 14 nt, Homo sapiens
uguugucaagugau

SEQ ID NO: 949072 - RNA, 11 nt, Homo sapiens
uguuguucacg

SEQ ID NO: 949073 - RNA, 14 nt, Homo sapiens
uguuuaacugugaa

SEQ ID NO: 949074 - RNA, 12 nt, Homo sapiens
uguuucuauacu

SEQ ID NO: 949075 - RNA, 16 nt, Homo sapiens
uguuucugaaugacau

SEQ ID NO: 949076 - RNA, 19 nt, Homo sapiens
uguuucugcagccacuauu

SEQ ID NO: 949077 - RNA, 20 nt, Homo sapiens
uguuucugcagccacuauug

SEQ ID NO: 949078 - RNA, 18 nt, Homo sapiens
uguuuuggcugcucucca

SEQ ID NO: 949079 - RNA, 16 nt, Homo sapiens
uguuuuggggcuguau

SEQ ID NO: 949080 - RNA, 14 nt, Homo sapiens
uuaaaaaaauaaca

SEQ ID NO: 949081 - RNA, 15 nt, Homo sapiens
uuaaaaaaauaacau

SEQ ID NO: 949082 - RNA, 14 nt, Homo sapiens
uuaaaaaauaacau

SEQ ID NO: 949083 - RNA, 18 nt, Homo sapiens
uuaaaaagcccaaccucu

SEQ ID NO: 949084 - RNA, 23 nt, Homo sapiens
uuaaaaagcugacuacuugauau

SEQ ID NO: 949085 - RNA, 13 nt, Homo sapiens
uuaaaaaucuuuc

SEQ ID NO: 949086 - RNA, 18 nt, Homo sapiens
uuaaaauauuguguaaga

SEQ ID NO: 949087 - RNA, 19 nt, Homo sapiens
uuaaaauguauuuuucaca

SEQ ID NO: 949088 - RNA, 14 nt, Homo sapiens
uuaaaauucauauu

SEQ ID NO: 949089 - RNA, 22 nt, Homo sapiens
uuaaacuaugaugcguauuuau

SEQ ID NO: 949090 - RNA, 22 nt, Homo sapiens
uuaaaguuucauuagucauauu

SEQ ID NO: 949091 - RNA, 24 nt, Homo sapiens
uuaaccuuucaggaaaguaucucu

SEQ ID NO: 949092 - RNA, 20 nt, Homo sapiens
uuaacuuggcuaacauagca

SEQ ID NO: 949093 - RNA, 15 nt, Homo sapiens
ucaguuuaggacuau

SEQ ID NO: 949094 - RNA, 16 nt, Homo sapiens
ucauaaaaugcuauuu

SEQ ID NO: 949095 - RNA, 21 nt, Homo sapiens
ucauaacuagaguauaaagua

SEQ ID NO: 949096 - RNA, 13 nt, Homo sapiens
ucauaaugacuua

SEQ ID NO: 949097 - RNA, 12 nt, Homo sapiens
ucauaaugcaau

SEQ ID NO: 949098 - RNA, 16 nt, Homo sapiens
ucauaauuaaaucaua

SEQ ID NO: 949099 - RNA, 20 nt, Homo sapiens
ucauaauuuccaugauacaa

SEQ ID NO: 949100 - RNA, 12 nt, Homo sapiens
ucauacuuucca

SEQ ID NO: 949101 - RNA, 22 nt, Homo sapiens
ucauaguuacuuacugccuuag

SEQ ID NO: 949102 - RNA, 14 nt, Homo sapiens
ucauauccaguuua

SEQ ID NO: 949103 - RNA, 15 nt, Homo sapiens
ucaucacaacuuguu

SEQ ID NO: 949104 - RNA, 20 nt, Homo sapiens
ucaucuguugacaauuugcc

SEQ ID NO: 949105 - RNA, 18 nt, Homo sapiens
ucaucuucaaaaaauuau

SEQ ID NO: 949106 - RNA, 22 nt, Homo sapiens
ucaucuuguaaauaaugcuuaa

SEQ ID NO: 949107 - RNA, 23 nt, Homo sapiens
ucaugauuucaaugauuguuuaa

SEQ ID NO: 949108 - RNA, 24 nt, Homo sapiens
ucauguacuacccucagucuacac

SEQ ID NO: 949109 - RNA, 23 nt, Homo sapiens
ucaugucagcuuauaugugacac

SEQ ID NO: 949110 - RNA, 15 nt, Homo sapiens
ucauguucagucaca

SEQ ID NO: 949111 - RNA, 12 nt, Homo sapiens
ucauuaucucca

SEQ ID NO: 949112 - RNA, 14 nt, Homo sapiens
ucauucaauuugcg

SEQ ID NO: 949113 - RNA, 13 nt, Homo sapiens
ucauucagcagaa

SEQ ID NO: 949114 - RNA, 17 nt, Homo sapiens
ucauucauacucaaaga

SEQ ID NO: 949115 - RNA, 23 nt, Homo sapiens
ucauucucuagacaaaauccauc

SEQ ID NO: 949116 - RNA, 23 nt, Homo sapiens
ucauuuggccgagucagcacgua

SEQ ID NO: 949117 - RNA, 22 nt, Homo sapiens
uccaaaauaaauggacugaagu

SEQ ID NO: 949118 - RNA, 20 nt, Homo sapiens
uccaaacaauuuagccagaa

SEQ ID NO: 949119 - RNA, 23 nt, Homo sapiens
uccaaaggaucuuuguuccucug

SEQ ID NO: 949120 - RNA, 20 nt, Homo sapiens
uccaaauaaguugcgcuuaa

SEQ ID NO: 949121 - RNA, 17 nt, Homo sapiens
uccaacaaacuuacugu

SEQ ID NO: 949122 - RNA, 14 nt, Homo sapiens
uccaagguggcaua

SEQ ID NO: 949123 - RNA, 22 nt, Homo sapiens
uccaaugaagauaaaugcuuua

SEQ ID NO: 949124 - RNA, 16 nt, Homo sapiens
uccaaugugugcauag

SEQ ID NO: 949125 - RNA, 14 nt, Homo sapiens
uccagcgucugcug

SEQ ID NO: 949126 - RNA, 19 nt, Homo sapiens
uccagggucugagugcaag

SEQ ID NO: 949127 - RNA, 15 nt, Homo sapiens
uccaguuguauuuga

SEQ ID NO: 949128 - RNA, 18 nt, Homo sapiens
uccaguuuaaucuucaca

SEQ ID NO: 949129 - RNA, 19 nt, Homo sapiens
uccauaucagcucugcaua

SEQ ID NO: 949130 - RNA, 23 nt, Homo sapiens
uccauccacacacagcagcucca

SEQ ID NO: 949131 - RNA, 12 nt, Homo sapiens
uccaugauucca

SEQ ID NO: 949132 - RNA, 19 nt, Homo sapiens
uccauguuuauccauguac

SEQ ID NO: 949133 - RNA, 13 nt, Homo sapiens
uccauugcauuca

SEQ ID NO: 949134 - RNA, 22 nt, Homo sapiens
aauugaagaaagucagcucuug

SEQ ID NO: 949135 - RNA, 18 nt, Homo sapiens
aauugagagccucuaugu

SEQ ID NO: 949136 - RNA, 19 nt, Homo sapiens
aauugagagccucuaugug

SEQ ID NO: 949137 - RNA, 17 nt, Homo sapiens
aauugaggaugucccug

SEQ ID NO: 949138 - RNA, 12 nt, Homo sapiens
aauugugccaaa

SEQ ID NO: 949139 - RNA, 17 nt, Homo sapiens
aauugugcgacuucaca

SEQ ID NO: 949140 - RNA, 19 nt, Homo sapiens
aauuguuuaacccuggaua

SEQ ID NO: 949141 - RNA, 16 nt, Homo sapiens
aauuuaaaaacaugau

SEQ ID NO: 949142 - RNA, 17 nt, Homo sapiens
aauuuaauauacugcau

SEQ ID NO: 949143 - RNA, 16 nt, Homo sapiens
aauuuaugaagauagu

SEQ ID NO: 949144 - RNA, 20 nt, Homo sapiens
aauuucccaaagcagugcau

SEQ ID NO: 949145 - RNA, 13 nt, Homo sapiens
aauuucuccaaag

SEQ ID NO: 949146 - RNA, 13 nt, Homo sapiens
aauuugaauucaa

SEQ ID NO: 949147 - RNA, 19 nt, Homo sapiens
aauuuucuacaguacauga

SEQ ID NO: 949148 - RNA, 19 nt, Homo sapiens
aauuuuuaaaucauuucau

SEQ ID NO: 949149 - RNA, 18 nt, Homo sapiens
aauuuuuaacuuaucucc

SEQ ID NO: 949150 - RNA, 19 nt, Homo sapiens
acaaaaaauauucaucugu

SEQ ID NO: 949151 - RNA, 17 nt, Homo sapiens
acaaaagaagagcucac

SEQ ID NO: 949152 - RNA, 20 nt, Homo sapiens
acaaaaggcuggaugugcuu

SEQ ID NO: 949153 - RNA, 21 nt, Homo sapiens
acaaaauauuucuaagcuuau

SEQ ID NO: 949154 - RNA, 17 nt, Homo sapiens
acaaacaaaccaaaaug

SEQ ID NO: 949155 - RNA, 19 nt, Homo sapiens
acaaaccuuuaauauauca

SEQ ID NO: 949156 - RNA, 15 nt, Homo sapiens
acaaagaugugcaaa

SEQ ID NO: 949157 - RNA, 24 nt, Homo sapiens
acaaagcgugguggacaugcacag

SEQ ID NO: 949158 - RNA, 17 nt, Homo sapiens
acaacuuaaugugcugc

SEQ ID NO: 949159 - RNA, 17 nt, Homo sapiens
acaacuuugccuucaaa

SEQ ID NO: 949160 - RNA, 17 nt, Homo sapiens
acaagagacaugagauu

SEQ ID NO: 949161 - RNA, 23 nt, Homo sapiens
acaagaucacaagucagcacuac

SEQ ID NO: 949162 - RNA, 16 nt, Homo sapiens
acaagcaucauggauc

SEQ ID NO: 949163 - RNA, 17 nt, Homo sapiens
acaaguaaccaaggaac

SEQ ID NO: 949164 - RNA, 22 nt, Homo sapiens
acaaguaagagguuaugccaaa

SEQ ID NO: 949165 - RNA, 15 nt, Homo sapiens
acaauauccaaugaa

SEQ ID NO: 949166 - RNA, 17 nt, Homo sapiens
acaaucaucuucuccca

SEQ ID NO: 949167 - RNA, 16 nt, Homo sapiens
acaaugguagcucuga

SEQ ID NO: 949168 - RNA, 16 nt, Homo sapiens
acaauugaacugcuua

SEQ ID NO: 949169 - RNA, 18 nt, Homo sapiens
acaauugaacugcuuauu

SEQ ID NO: 949170 - RNA, 13 nt, Homo sapiens
acaauuuagccag

SEQ ID NO: 949171 - RNA, 15 nt, Homo sapiens
acaauuuucauccca

SEQ ID NO: 949172 - RNA, 13 nt, Homo sapiens
acacaagugcaca

SEQ ID NO: 949173 - RNA, 17 nt, Homo sapiens
acacaaugguagcucug

SEQ ID NO: 949174 - RNA, 11 nt, Homo sapiens
acacacagcac

SEQ ID NO: 949175 - RNA, 12 nt, Homo sapiens
acacacagcagc

SEQ ID NO: 949176 - RNA, 22 nt, Homo sapiens
acacagaucagauuaucugguc

SEQ ID NO: 949177 - RNA, 15 nt, Homo sapiens
acacaggugcacaga

SEQ ID NO: 949178 - RNA, 15 nt, Homo sapiens
acacaugguuuccaa

SEQ ID NO: 949179 - RNA, 19 nt, Homo sapiens
acaccacuuucugcuuucc

SEQ ID NO: 949180 - RNA, 16 nt, Homo sapiens
acaccacuuugucucu

SEQ ID NO: 949181 - RNA, 13 nt, Homo sapiens
acacccaagcaca

SEQ ID NO: 949182 - RNA, 21 nt, Homo sapiens
acacccaagcacaaacugucg

SEQ ID NO: 949183 - RNA, 17 nt, Homo sapiens
acacccuggaguggcau

SEQ ID NO: 949184 - RNA, 18 nt, Homo sapiens
acacccuggaguggcaug

SEQ ID NO: 949185 - RNA, 17 nt, Homo sapiens
acacccuguaccaucca

SEQ ID NO: 949186 - RNA, 21 nt, Homo sapiens
acacccuuugggaaagcucuu

SEQ ID NO: 949187 - RNA, 17 nt, Homo sapiens
acaccuguaaucccagc

SEQ ID NO: 949188 - RNA, 17 nt, Homo sapiens
acacgccuggcuuccag

SEQ ID NO: 949189 - RNA, 22 nt, Homo sapiens
acacguccauguuuauccaugu

SEQ ID NO: 949190 - RNA, 18 nt, Homo sapiens
aguuguauuugaagacug

SEQ ID NO: 949191 - RNA, 12 nt, Homo sapiens
aguugugaaaga

SEQ ID NO: 949192 - RNA, 14 nt, Homo sapiens
aguuguggccucau

SEQ ID NO: 949193 - RNA, 15 nt, Homo sapiens
aguuuaaucuucaca

SEQ ID NO: 949194 - RNA, 23 nt, Homo sapiens
aguuuaaucuucacaauauccaa

SEQ ID NO: 949195 - RNA, 18 nt, Homo sapiens
aguuucaaaauguuaaca

SEQ ID NO: 949196 - RNA, 18 nt, Homo sapiens
aguuucaaaugaguuuaa

SEQ ID NO: 949197 - RNA, 13 nt, Homo sapiens
auaaaaacauaaa

SEQ ID NO: 949198 - RNA, 14 nt, Homo sapiens
auaaaacuguuuau

SEQ ID NO: 949199 - RNA, 18 nt, Homo sapiens
auaaaagagguccauuaa

SEQ ID NO: 949200 - RNA, 20 nt, Homo sapiens
auaaaaucuuuccaucucau

SEQ ID NO: 949201 - RNA, 13 nt, Homo sapiens
auaaaauggacag

SEQ ID NO: 949202 - RNA, 14 nt, Homo sapiens
auaaaauggucaug

SEQ ID NO: 949203 - RNA, 15 nt, Homo sapiens
auaaaccauaaaaua

SEQ ID NO: 949204 - RNA, 22 nt, Homo sapiens
auaaagaaaaaaauaguuuuac

SEQ ID NO: 949205 - RNA, 14 nt, Homo sapiens
auaaauagaugaag

SEQ ID NO: 949206 - RNA, 14 nt, Homo sapiens
auaaauguguaaau

SEQ ID NO: 949207 - RNA, 15 nt, Homo sapiens
auaaauuauuuaacu

SEQ ID NO: 949208 - RNA, 21 nt, Homo sapiens
auaaauuauuuaacuaauuaa

SEQ ID NO: 949209 - RNA, 12 nt, Homo sapiens
auaacacugcuu

SEQ ID NO: 949210 - RNA, 20 nt, Homo sapiens
auaaccuuugaaccaacaau

SEQ ID NO: 949211 - RNA, 15 nt, Homo sapiens
auaacuacauuaaaa

SEQ ID NO: 949212 - RNA, 14 nt, Homo sapiens
auaacuagaucucc

SEQ ID NO: 949213 - RNA, 23 nt, Homo sapiens
auaagaaccuuuugagugccuua

SEQ ID NO: 949214 - RNA, 23 nt, Homo sapiens
auaagcuuccuagaaaguucugu

SEQ ID NO: 949215 - RNA, 16 nt, Homo sapiens
auaauaugcaguuccu

SEQ ID NO: 949216 - RNA, 15 nt, Homo sapiens
auaauuaaaucauag

SEQ ID NO: 949217 - RNA, 17 nt, Homo sapiens
auaauuuagauauucau

SEQ ID NO: 949218 - RNA, 21 nt, Homo sapiens
auaauuucaauguggaccaga

SEQ ID NO: 949219 - RNA, 14 nt, Homo sapiens
auacagagaugaac

SEQ ID NO: 949220 - RNA, 20 nt, Homo sapiens
auacaggcauacacaugcac

SEQ ID NO: 949221 - RNA, 20 nt, Homo sapiens
auacauuguguuuuccuaaa

SEQ ID NO: 949222 - RNA, 16 nt, Homo sapiens
auacuucuaccaacau

SEQ ID NO: 949223 - RNA, 20 nt, Homo sapiens
auagaacugucccacaaaau

SEQ ID NO: 949224 - RNA, 14 nt, Homo sapiens
auagaccaugcaca

SEQ ID NO: 949225 - RNA, 21 nt, Homo sapiens
auagagucaagcucugucacc

SEQ ID NO: 949226 - RNA, 15 nt, Homo sapiens
auagccacuugcuca

SEQ ID NO: 949227 - RNA, 22 nt, Homo sapiens
auagccacuugcucagccauaa

SEQ ID NO: 949228 - RNA, 15 nt, Homo sapiens
auaggaagaaaauuu

SEQ ID NO: 949229 - RNA, 12 nt, Homo sapiens
auagucaauaug

SEQ ID NO: 949230 - RNA, 18 nt, Homo sapiens
auaguccuccaaaacaca

SEQ ID NO: 949231 - RNA, 22 nt, Homo sapiens
auagucuguacuucaguucuca

SEQ ID NO: 949232 - RNA, 23 nt, Homo sapiens
auaguugaugagaauccugacca

SEQ ID NO: 949233 - RNA, 23 nt, Homo sapiens
auauaacuacauuaaaagcuuua

SEQ ID NO: 949234 - RNA, 16 nt, Homo sapiens
auauaacugucuuagu

SEQ ID NO: 949235 - RNA, 15 nt, Homo sapiens
auauaauuacuuaau

SEQ ID NO: 949236 - RNA, 15 nt, Homo sapiens
auauauauauucuca

SEQ ID NO: 949237 - RNA, 18 nt, Homo sapiens
auauaucagugcuccagu

SEQ ID NO: 949238 - RNA, 19 nt, Homo sapiens
auauauuauauauaaucua

SEQ ID NO: 949239 - RNA, 19 nt, Homo sapiens
auauguacaguuauacaua

SEQ ID NO: 949240 - RNA, 14 nt, Homo sapiens
auauguaucuaguc

SEQ ID NO: 949241 - RNA, 22 nt, Homo sapiens
auauuauugcuauauuugcuaa

SEQ ID NO: 949242 - RNA, 21 nt, Homo sapiens
auauuuaggcaugagcucuug

SEQ ID NO: 949243 - RNA, 22 nt, Homo sapiens
auauuuauuugacucagcacug

SEQ ID NO: 949244 - RNA, 19 nt, Homo sapiens
auauuugaaagaagucaaa

SEQ ID NO: 949245 - RNA, 14 nt, Homo sapiens
aucaaaucauucaa

SEQ ID NO: 949246 - RNA, 14 nt, Homo sapiens
aucaacuccagucu

SEQ ID NO: 949247 - RNA, 20 nt, Homo sapiens
aucaacuuaauucuguuaca

SEQ ID NO: 949248 - RNA, 20 nt, Homo sapiens
aucacauguaauccaaagac

SEQ ID NO: 949249 - RNA, 13 nt, Homo sapiens
aucagacauucag

SEQ ID NO: 949250 - RNA, 14 nt, Homo sapiens
aucagaguauguca

SEQ ID NO: 949251 - RNA, 17 nt, Homo sapiens
aucagcauucaaaauag

SEQ ID NO: 949252 - RNA, 22 nt, Homo sapiens
aucagggggcaugaagcacauu

SEQ ID NO: 949253 - RNA, 14 nt, Homo sapiens
aucaguugccaaag

SEQ ID NO: 949254 - RNA, 17 nt, Homo sapiens
aucauaacucacuuuaa

SEQ ID NO: 949255 - RNA, 17 nt, Homo sapiens
aucauggaucaaccaag

SEQ ID NO: 949256 - RNA, 19 nt, Homo sapiens
aucauuuggccgagucagc

SEQ ID NO: 949257 - RNA, 20 nt, Homo sapiens
auccaaugaagaaggucuca

SEQ ID NO: 949258 - RNA, 12 nt, Homo sapiens
auccagcuucau

SEQ ID NO: 949259 - RNA, 16 nt, Homo sapiens
auccaggcacccaaac

SEQ ID NO: 949260 - RNA, 15 nt, Homo sapiens
auccauaucagcucu

SEQ ID NO: 949261 - RNA, 22 nt, Homo sapiens
auccaugcggccuggguguccu

SEQ ID NO: 949262 - RNA, 21 nt, Homo sapiens
aucccacgacauaagcuggua

SEQ ID NO: 949263 - RNA, 23 nt, Homo sapiens
aucccuaugguaucauaucauga

SEQ ID NO: 949264 - RNA, 21 nt, Homo sapiens
auccuggcaaauaauacuaau

SEQ ID NO: 949265 - RNA, 17 nt, Homo sapiens
auccugucccaugggcu

SEQ ID NO: 949266 - RNA, 16 nt, Homo sapiens
auccuuacuagauuca

SEQ ID NO: 949267 - RNA, 14 nt, Homo sapiens
auccuucuaaagug

SEQ ID NO: 949268 - RNA, 14 nt, Homo sapiens
aucuauagcacaua

SEQ ID NO: 949269 - RNA, 17 nt, Homo sapiens
aucuauuuucuauguac

SEQ ID NO: 949270 - RNA, 16 nt, Homo sapiens
aucuccauugcauuca

SEQ ID NO: 949271 - RNA, 22 nt, Homo sapiens
aucucugagaccacagaggcuc

SEQ ID NO: 949272 - RNA, 16 nt, Homo sapiens
aucucuuuagauccaa

SEQ ID NO: 949273 - RNA, 18 nt, Homo sapiens
aucugcaaauaguuucaa

SEQ ID NO: 949274 - RNA, 21 nt, Homo sapiens
aucuggcagacuuacaaagcu

SEQ ID NO: 949275 - RNA, 16 nt, Homo sapiens
aucuguauaucagcuc

SEQ ID NO: 949276 - RNA, 15 nt, Homo sapiens
aucuguuagcauuau

SEQ ID NO: 949277 - RNA, 14 nt, Homo sapiens
aucuguuugauaca

SEQ ID NO: 949278 - RNA, 18 nt, Homo sapiens
aucuguuugauacaguau

SEQ ID NO: 949279 - RNA, 20 nt, Homo sapiens
aucuguuugauacaguauua

SEQ ID NO: 949280 - RNA, 21 nt, Homo sapiens
aucuucacaauauccaaugaa

SEQ ID NO: 949281 - RNA, 17 nt, Homo sapiens
aucuuccauaugcucuu

SEQ ID NO: 949282 - RNA, 19 nt, Homo sapiens
aucuucuaucaaagcacau

SEQ ID NO: 949283 - RNA, 20 nt, Homo sapiens
aucuucucccaagacugcuc

SEQ ID NO: 949284 - RNA, 16 nt, Homo sapiens
aucuucuuacuaagcu

SEQ ID NO: 949285 - RNA, 21 nt, Homo sapiens
aucuugaauuguaaggaauga

SEQ ID NO: 949286 - RNA, 16 nt, Homo sapiens
augaaaggaucucuga

SEQ ID NO: 949287 - RNA, 22 nt, Homo sapiens
augacagaauuugugaauauau

SEQ ID NO: 949288 - RNA, 23 nt, Homo sapiens
augacuccagaauuucccaaagc

SEQ ID NO: 949289 - RNA, 14 nt, Homo sapiens
augacucuucuuau

SEQ ID NO: 949290 - RNA, 16 nt, Homo sapiens
augacuuuacacuaua

SEQ ID NO: 949291 - RNA, 16 nt, Homo sapiens
augagauacauuugau

SEQ ID NO: 949292 - RNA, 20 nt, Homo sapiens
augaugacucuucuuaucac

SEQ ID NO: 949293 - RNA, 23 nt, Homo sapiens
augaugccaugaggaacaaggca

SEQ ID NO: 949294 - RNA, 16 nt, Homo sapiens
augauugugaccucca

SEQ ID NO: 949295 - RNA, 20 nt, Homo sapiens
augcacacauuuaacgacag

SEQ ID NO: 949296 - RNA, 20 nt, Homo sapiens
augcaggauuggaccaugaa

SEQ ID NO: 949297 - RNA, 23 nt, Homo sapiens
augcaggugacauucuaccauga

SEQ ID NO: 949298 - RNA, 19 nt, Homo sapiens
augcaucucuuuagaucca

SEQ ID NO: 949299 - RNA, 22 nt, Homo sapiens
augcaucucuuuagauccaaaa

SEQ ID NO: 949300 - RNA, 21 nt, Homo sapiens
augcccaagagaucugugcca

SEQ ID NO: 949301 - RNA, 19 nt, Homo sapiens
augccuauauccccaaaau

SEQ ID NO: 949302 - RNA, 19 nt, Homo sapiens
augccuuucaaacauugag

SEQ ID NO: 949303 - RNA, 13 nt, Homo sapiens
augcuggcaaagg

SEQ ID NO: 949304 - RNA, 15 nt, Homo sapiens
augcugucccuuacg

SEQ ID NO: 949305 - RNA, 22 nt, Homo sapiens
augcuguucagaaauaugaaaa

SEQ ID NO: 949306 - RNA, 13 nt, Homo sapiens
auggaacuuucau

SEQ ID NO: 949307 - RNA, 16 nt, Homo sapiens
auggaauauacaugua

SEQ ID NO: 949308 - RNA, 21 nt, Homo sapiens
auggacauauucuuuuuggaa

SEQ ID NO: 949309 - RNA, 14 nt, Homo sapiens
auggaucaaccaag

SEQ ID NO: 949310 - RNA, 15 nt, Homo sapiens
auggaucaaccaagu

SEQ ID NO: 949311 - RNA, 14 nt, Homo sapiens
augggaagcauuag

SEQ ID NO: 949312 - RNA, 22 nt, Homo sapiens
augggacggagguccuuuggac

SEQ ID NO: 949313 - RNA, 15 nt, Homo sapiens
auggguuuuacugau

SEQ ID NO: 949314 - RNA, 14 nt, Homo sapiens
augguaacugauga

SEQ ID NO: 949315 - RNA, 17 nt, Homo sapiens
auguaccauguugccca

SEQ ID NO: 949316 - RNA, 20 nt, Homo sapiens
auguacccuacccugcacau

SEQ ID NO: 949317 - RNA, 18 nt, Homo sapiens
auguaguugauguaucca

SEQ ID NO: 949318 - RNA, 13 nt, Homo sapiens
auguauagcuuua

SEQ ID NO: 949319 - RNA, 20 nt, Homo sapiens
auguauuuaaagaacacugc

SEQ ID NO: 949320 - RNA, 18 nt, Homo sapiens
auguauuuuucacaaagg

SEQ ID NO: 949321 - RNA, 14 nt, Homo sapiens
augucaaaauguga

SEQ ID NO: 949322 - RNA, 16 nt, Homo sapiens
augucagugugacuga

SEQ ID NO: 949323 - RNA, 21 nt, Homo sapiens
auguccucacucucgccaucu

SEQ ID NO: 949324 - RNA, 14 nt, Homo sapiens
augucuacugcuug

SEQ ID NO: 949325 - RNA, 15 nt, Homo sapiens
augugcagacacuca

SEQ ID NO: 949326 - RNA, 14 nt, Homo sapiens
auguggaugcucuu

SEQ ID NO: 949327 - RNA, 18 nt, Homo sapiens
auguggggaaaaggcauu

SEQ ID NO: 949328 - RNA, 22 nt, Homo sapiens
auguuaacaacuugaauuacaa

SEQ ID NO: 949329 - RNA, 21 nt, Homo sapiens
auguucagucacaugugcucu

SEQ ID NO: 949330 - RNA, 17 nt, Homo sapiens
auguucuuucacccuuu

SEQ ID NO: 949331 - RNA, 17 nt, Homo sapiens
auguugcacaacacaga

SEQ ID NO: 949332 - RNA, 21 nt, Homo sapiens
auguuuauccauguacuuucc

SEQ ID NO: 949333 - RNA, 20 nt, Homo sapiens
auuaaaaccaucuggcagac

SEQ ID NO: 949334 - RNA, 14 nt, Homo sapiens
auuaaucucuaaaa

SEQ ID NO: 949335 - RNA, 19 nt, Homo sapiens
auuacaggaaguacuggag

SEQ ID NO: 949336 - RNA, 15 nt, Homo sapiens
auuacaggugugagc

SEQ ID NO: 949337 - RNA, 23 nt, Homo sapiens
auuacaggugugagccacagcac

SEQ ID NO: 949338 - RNA, 22 nt, Homo sapiens
auuacagucauuuccuacccuu

SEQ ID NO: 949339 - RNA, 11 nt, Homo sapiens
auuacauuuca

SEQ ID NO: 949340 - RNA, 17 nt, Homo sapiens
auuaccacacucagcua

SEQ ID NO: 949341 - RNA, 19 nt, Homo sapiens
auuacuccauuacuaaaga

SEQ ID NO: 949342 - RNA, 20 nt, Homo sapiens
auuagagcaagaacauucaa

SEQ ID NO: 949343 - RNA, 22 nt, Homo sapiens
auuagccagggugguggugcac

SEQ ID NO: 949344 - RNA, 22 nt, Homo sapiens
auuauaaaaucuuuccaucuca

SEQ ID NO: 949345 - RNA, 14 nt, Homo sapiens
auuauagucuguac

SEQ ID NO: 949346 - RNA, 13 nt, Homo sapiens
auuaucugaacug

SEQ ID NO: 949347 - RNA, 18 nt, Homo sapiens
auuauggugauacuccaa

SEQ ID NO: 949348 - RNA, 15 nt, Homo sapiens
auuauugcuguugcu

SEQ ID NO: 949349 - RNA, 23 nt, Homo sapiens
auuauuugguauguguuuugcuu

SEQ ID NO: 949350 - RNA, 15 nt, Homo sapiens
auucaaaacuuucag

SEQ ID NO: 949351 - RNA, 23 nt, Homo sapiens
auucaauuugcgacugcucugau

SEQ ID NO: 949352 - RNA, 15 nt, Homo sapiens
auucacuuuaccuuc

SEQ ID NO: 949353 - RNA, 18 nt, Homo sapiens
auucagccucgucucuuu

SEQ ID NO: 949354 - RNA, 19 nt, Homo sapiens
auucaguuaucacuacaga

SEQ ID NO: 949355 - RNA, 15 nt, Homo sapiens
auucauaaaaauaac

SEQ ID NO: 949356 - RNA, 19 nt, Homo sapiens
auucauaaugacuuaagca

SEQ ID NO: 949357 - RNA, 13 nt, Homo sapiens
auucauaaugcaa

SEQ ID NO: 949358 - RNA, 17 nt, Homo sapiens
auucauguuuggugggg

SEQ ID NO: 949359 - RNA, 13 nt, Homo sapiens
auuccccccaucu

SEQ ID NO: 949360 - RNA, 16 nt, Homo sapiens
auucuaagauuguaca

SEQ ID NO: 949361 - RNA, 18 nt, Homo sapiens
auucugaaggccuuguua

SEQ ID NO: 949362 - RNA, 20 nt, Homo sapiens
auucugaaggccuuguuaaa

SEQ ID NO: 949363 - RNA, 18 nt, Homo sapiens
auucuguggauucuauau

SEQ ID NO: 949364 - RNA, 14 nt, Homo sapiens
auucuucugacaga

SEQ ID NO: 949365 - RNA, 23 nt, Homo sapiens
auugaaauuuuuaaaucauuuca

SEQ ID NO: 949366 - RNA, 23 nt, Homo sapiens
auugaaugcauacucugugcaag

SEQ ID NO: 949367 - RNA, 18 nt, Homo sapiens
auugagaucagcauucaa

SEQ ID NO: 949368 - RNA, 17 nt, Homo sapiens
auugaggaugucccuga

SEQ ID NO: 949369 - RNA, 15 nt, Homo sapiens
auugauaagaaccuu

SEQ ID NO: 949370 - RNA, 18 nt, Homo sapiens
auugcacccuaaauccac

SEQ ID NO: 949371 - RNA, 19 nt, Homo sapiens
auugcagcuugaagccaau

SEQ ID NO: 949372 - RNA, 17 nt, Homo sapiens
auugcuuuagacaaauu

SEQ ID NO: 949373 - RNA, 23 nt, Homo sapiens
auuggcaauaugaauauauauua

SEQ ID NO: 949374 - RNA, 20 nt, Homo sapiens
auuggccugguauggcugca

SEQ ID NO: 949375 - RNA, 18 nt, Homo sapiens
auuguaaggaaugauuaa

SEQ ID NO: 949376 - RNA, 14 nt, Homo sapiens
auugucaacuugaa

SEQ ID NO: 949377 - RNA, 20 nt, Homo sapiens
auugugccaaagauagcaga

SEQ ID NO: 949378 - RNA, 20 nt, Homo sapiens
auuguguuuuccuaaacaca

SEQ ID NO: 949379 - RNA, 12 nt, Homo sapiens
auuuaacugcau

SEQ ID NO: 949380 - RNA, 20 nt, Homo sapiens
auuuaaucuguacuauccag

SEQ ID NO: 949381 - RNA, 17 nt, Homo sapiens
auuuaccugaagucuuu

SEQ ID NO: 949382 - RNA, 23 nt, Homo sapiens
auuuagauauucauacuuuccaa

SEQ ID NO: 949383 - RNA, 21 nt, Homo sapiens
auuuagauuuuucucaucucc

SEQ ID NO: 949384 - RNA, 17 nt, Homo sapiens
auuuaguuuugucuuuc

SEQ ID NO: 949385 - RNA, 15 nt, Homo sapiens
auuuauaauccacag

SEQ ID NO: 949386 - RNA, 18 nt, Homo sapiens
auuuauguucaucuucaa

SEQ ID NO: 949387 - RNA, 15 nt, Homo sapiens
auuuauuugguguuu

SEQ ID NO: 949388 - RNA, 15 nt, Homo sapiens
auuucaauaacuuag

SEQ ID NO: 949389 - RNA, 20 nt, Homo sapiens
auuucacgggcaacacucac

SEQ ID NO: 949390 - RNA, 23 nt, Homo sapiens
auuucagguuaaauuaaaccaag

SEQ ID NO: 949391 - RNA, 18 nt, Homo sapiens
auuucagucaucaucuca

SEQ ID NO: 949392 - RNA, 13 nt, Homo sapiens
auuucauaacuag

SEQ ID NO: 949393 - RNA, 11 nt, Homo sapiens
auuucaucacu

SEQ ID NO: 949394 - RNA, 11 nt, Homo sapiens
auuuccagggg

SEQ ID NO: 949395 - RNA, 14 nt, Homo sapiens
auuuccuccacauu

SEQ ID NO: 949396 - RNA, 14 nt, Homo sapiens
auuucuuuaauguc

SEQ ID NO: 949397 - RNA, 20 nt, Homo sapiens
auuucuuugauugugaaaca

SEQ ID NO: 949398 - RNA, 21 nt, Homo sapiens
auuugauucuaaauggcuuuu

SEQ ID NO: 949399 - RNA, 16 nt, Homo sapiens
auuugcaaaugcacau

SEQ ID NO: 949400 - RNA, 20 nt, Homo sapiens
auuuuaaaaaauaacauauu

SEQ ID NO: 949401 - RNA, 13 nt, Homo sapiens
auuuuaauaaaga

SEQ ID NO: 949402 - RNA, 19 nt, Homo sapiens
auuuucuacaguacaugac

SEQ ID NO: 949403 - RNA, 13 nt, Homo sapiens
auuuuucacaaag

SEQ ID NO: 949404 - RNA, 21 nt, Homo sapiens
auuuuucagcuacagcaaaua

SEQ ID NO: 949405 - RNA, 20 nt, Homo sapiens
auuuuuguaaauaugacaga

SEQ ID NO: 949406 - RNA, 19 nt, Homo sapiens
caaaaaaaaaaauuacauu

SEQ ID NO: 949407 - RNA, 13 nt, Homo sapiens
caaaaacaacaac

SEQ ID NO: 949408 - RNA, 21 nt, Homo sapiens
caaaaaugugcugccuagaaa

SEQ ID NO: 949409 - RNA, 13 nt, Homo sapiens
caaaacuggauag

SEQ ID NO: 949410 - RNA, 20 nt, Homo sapiens
caaaaguuuaaaaagcucac

SEQ ID NO: 949411 - RNA, 17 nt, Homo sapiens
caaaauauuuauuuguu

SEQ ID NO: 949412 - RNA, 22 nt, Homo sapiens
caaaaugugauucuaugugauu

SEQ ID NO: 949413 - RNA, 23 nt, Homo sapiens
caaaauguggggaaaaggcauuu

SEQ ID NO: 949414 - RNA, 16 nt, Homo sapiens
caaaauuuaauugugu

SEQ ID NO: 949415 - RNA, 16 nt, Homo sapiens
caaacaaaccaaaaug

SEQ ID NO: 949416 - RNA, 13 nt, Homo sapiens
caaacacugugua

SEQ ID NO: 949417 - RNA, 18 nt, Homo sapiens
caaacauugagacugcua

SEQ ID NO: 949418 - RNA, 16 nt, Homo sapiens
caaaccaucauuuaau

SEQ ID NO: 949419 - RNA, 16 nt, Homo sapiens
caaagaaucuaggaaa

SEQ ID NO: 949420 - RNA, 21 nt, Homo sapiens
caaagcgugguggacaugcac

SEQ ID NO: 949421 - RNA, 15 nt, Homo sapiens
caaagcugucacuca

SEQ ID NO: 949422 - RNA, 16 nt, Homo sapiens
caaauaacaguggcaa

SEQ ID NO: 949423 - RNA, 13 nt, Homo sapiens
caaauaguuucaa

SEQ ID NO: 949424 - RNA, 21 nt, Homo sapiens
caaaucucugugcuggccuga

SEQ ID NO: 949425 - RNA, 12 nt, Homo sapiens
caaauguuauag

SEQ ID NO: 949426 - RNA, 22 nt, Homo sapiens
caaauguuguauuucaaaccag

SEQ ID NO: 949427 - RNA, 18 nt, Homo sapiens
caacaacuuaaugugcug

SEQ ID NO: 949428 - RNA, 14 nt, Homo sapiens
caacaagugcucuu

SEQ ID NO: 949429 - RNA, 19 nt, Homo sapiens
caacaagugcucuuuccac

SEQ ID NO: 949430 - RNA, 15 nt, Homo sapiens
caacagaaacuucuc

SEQ ID NO: 949431 - RNA, 19 nt, Homo sapiens
caacagaaacuucucaguu

SEQ ID NO: 949432 - RNA, 16 nt, Homo sapiens
caacagggcaaccaau

SEQ ID NO: 949433 - RNA, 18 nt, Homo sapiens
caacaggguuuuuuucca

SEQ ID NO: 949434 - RNA, 22 nt, Homo sapiens
caaccacugcgaccacaagaag

SEQ ID NO: 949435 - RNA, 17 nt, Homo sapiens
caaccccugcagcuccu

SEQ ID NO: 949436 - RNA, 15 nt, Homo sapiens
caacuccaacaucca

SEQ ID NO: 949437 - RNA, 15 nt, Homo sapiens
caacuugaauuacaa

SEQ ID NO: 949438 - RNA, 22 nt, Homo sapiens
caacuuguuuucccagcaucau

SEQ ID NO: 949439 - RNA, 14 nt, Homo sapiens
caacuuuaccucuu

SEQ ID NO: 949440 - RNA, 20 nt, Homo sapiens
caagagcaaaacucagucuc

SEQ ID NO: 949441 - RNA, 14 nt, Homo sapiens
caagauaaacacaa

SEQ ID NO: 949442 - RNA, 18 nt, Homo sapiens
caagcacaaacugucguc

SEQ ID NO: 949443 - RNA, 15 nt, Homo sapiens
caagcacuaccagua

SEQ ID NO: 949444 - RNA, 14 nt, Homo sapiens
caagcaucauggau

SEQ ID NO: 949445 - RNA, 13 nt, Homo sapiens
caagcauucugug

SEQ ID NO: 949446 - RNA, 17 nt, Homo sapiens
caagccacguugcagaa

SEQ ID NO: 949447 - RNA, 17 nt, Homo sapiens
caagcugugacccucaa

SEQ ID NO: 949448 - RNA, 18 nt, Homo sapiens
caaggaaauuugcaaaua

SEQ ID NO: 949449 - RNA, 16 nt, Homo sapiens
caaggcaaggcuguca

SEQ ID NO: 949450 - RNA, 21 nt, Homo sapiens
caaggcucacaugcuccuugc

SEQ ID NO: 949451 - RNA, 21 nt, Homo sapiens
caaguaagagguuaugccaaa

SEQ ID NO: 949452 - RNA, 15 nt, Homo sapiens
caagucccaucucac

SEQ ID NO: 949453 - RNA, 15 nt, Homo sapiens
caagugcucuuucca

SEQ ID NO: 949454 - RNA, 12 nt, Homo sapiens
caagugugcauu

SEQ ID NO: 949455 - RNA, 19 nt, Homo sapiens
caaguucauucauacucaa

SEQ ID NO: 949456 - RNA, 13 nt, Homo sapiens
caaugacuuuccu

SEQ ID NO: 949457 - RNA, 17 nt, Homo sapiens
caauguaccauguugcc

SEQ ID NO: 949458 - RNA, 23 nt, Homo sapiens
caauuauggagugucaccagcug

SEQ ID NO: 949459 - RNA, 20 nt, Homo sapiens
caauucaguuuuaguuucaa

SEQ ID NO: 949460 - RNA, 15 nt, Homo sapiens
caauuggacaauuau

SEQ ID NO: 949461 - RNA, 20 nt, Homo sapiens
caauugguaauuaaggcauc

SEQ ID NO: 949462 - RNA, 23 nt, Homo sapiens
caauuuagauuuuucucaucucc

SEQ ID NO: 949463 - RNA, 14 nt, Homo sapiens
caauuucuccaaag

SEQ ID NO: 949464 - RNA, 14 nt, Homo sapiens
caauuuucuauuua

SEQ ID NO: 949465 - RNA, 17 nt, Homo sapiens
cacaaaaugcaagguga

SEQ ID NO: 949466 - RNA, 13 nt, Homo sapiens
cacacacagcagc

SEQ ID NO: 949467 - RNA, 22 nt, Homo sapiens
cacacagcacuaacacaugcac

SEQ ID NO: 949468 - RNA, 17 nt, Homo sapiens
cacacgccuggcuucca

SEQ ID NO: 949469 - RNA, 12 nt, Homo sapiens
cacacuguggaa

SEQ ID NO: 949470 - RNA, 22 nt, Homo sapiens
cacagcacuaacacaugcacac

SEQ ID NO: 949471 - RNA, 17 nt, Homo sapiens
cacagcaugaaccuuua

SEQ ID NO: 949472 - RNA, 18 nt, Homo sapiens
cacagccccuugcuucua

SEQ ID NO: 949473 - RNA, 13 nt, Homo sapiens
cacagguguaaau

SEQ ID NO: 949474 - RNA, 19 nt, Homo sapiens
cacaguauuuacugugcua

SEQ ID NO: 949475 - RNA, 20 nt, Homo sapiens
cacaguauuuacugugcuaa

SEQ ID NO: 949476 - RNA, 19 nt, Homo sapiens
cacagugauuagccucguc

SEQ ID NO: 949477 - RNA, 23 nt, Homo sapiens
cacaguuguuaaagucuguucca

SEQ ID NO: 949478 - RNA, 21 nt, Homo sapiens
cacaugcuucuggcaaaucuc

SEQ ID NO: 949479 - RNA, 23 nt, Homo sapiens
cacauguagaauuauaacuaauu

SEQ ID NO: 949480 - RNA, 15 nt, Homo sapiens
caccaaccacugcga

SEQ ID NO: 949481 - RNA, 14 nt, Homo sapiens
caccaccaaccacu

SEQ ID NO: 949482 - RNA, 12 nt, Homo sapiens
caccagguccug

SEQ ID NO: 949483 - RNA, 18 nt, Homo sapiens
cacccaggcuggagugca

SEQ ID NO: 949484 - RNA, 16 nt, Homo sapiens
cacccucuccuuguca

SEQ ID NO: 949485 - RNA, 15 nt, Homo sapiens
caccgccugccccca

SEQ ID NO: 949486 - RNA, 13 nt, Homo sapiens
caccuucuaucua

SEQ ID NO: 949487 - RNA, 16 nt, Homo sapiens
cacgaauauugcugau

SEQ ID NO: 949488 - RNA, 20 nt, Homo sapiens
cacgaggcuuggaccugcug

SEQ ID NO: 949489 - RNA, 21 nt, Homo sapiens
cacuacaaaaagcuagcuuuc

SEQ ID NO: 949490 - RNA, 18 nt, Homo sapiens
cacuaguagagcaaagac

SEQ ID NO: 949491 - RNA, 14 nt, Homo sapiens
cacuagucagaaaa

SEQ ID NO: 949492 - RNA, 19 nt, Homo sapiens
cacuccagaacaaaccucu

SEQ ID NO: 949493 - RNA, 14 nt, Homo sapiens
cacucuaaauggaa

SEQ ID NO: 949494 - RNA, 17 nt, Homo sapiens
cacucuuguugugcucu

SEQ ID NO: 949495 - RNA, 13 nt, Homo sapiens
cacugaacaugcu

SEQ ID NO: 949496 - RNA, 16 nt, Homo sapiens
cacugagucucaugga

SEQ ID NO: 949497 - RNA, 17 nt, Homo sapiens
cacuguagcagguucua

SEQ ID NO: 949498 - RNA, 19 nt, Homo sapiens
cacuguauaccccgugaag

SEQ ID NO: 949499 - RNA, 22 nt, Homo sapiens
cacugucauaaucucuuuccau

SEQ ID NO: 949500 - RNA, 21 nt, Homo sapiens
cacuuaaacucaucuauccag

SEQ ID NO: 949501 - RNA, 18 nt, Homo sapiens
cacuuaucuuggaaucau

SEQ ID NO: 949502 - RNA, 19 nt, Homo sapiens
cacuuaucuuggaaucaug

SEQ ID NO: 949503 - RNA, 14 nt, Homo sapiens
cacuuuaaauauga

SEQ ID NO: 949504 - RNA, 18 nt, Homo sapiens
cacuuuaaguaaaauaua

SEQ ID NO: 949505 - RNA, 15 nt, Homo sapiens
cacuuucgccuccuc

SEQ ID NO: 949506 - RNA, 20 nt, Homo sapiens
cacuuugcuuaagaugcuaa

SEQ ID NO: 949507 - RNA, 16 nt, Homo sapiens
cagaaaaacugaggaa

SEQ ID NO: 949508 - RNA, 15 nt, Homo sapiens
cagaaaauagcuuuu

SEQ ID NO: 949509 - RNA, 14 nt, Homo sapiens
cagaaacuucucag

SEQ ID NO: 949510 - RNA, 14 nt, Homo sapiens
cagaaagccucaga

SEQ ID NO: 949511 - RNA, 16 nt, Homo sapiens
cagaaagccucagagu

SEQ ID NO: 949512 - RNA, 15 nt, Homo sapiens
cagaaauuuucuaca

SEQ ID NO: 949513 - RNA, 18 nt, Homo sapiens
cagaaauuuucuacagua

SEQ ID NO: 949514 - RNA, 16 nt, Homo sapiens
cagaagaaguuaucaa

SEQ ID NO: 949515 - RNA, 22 nt, Homo sapiens
cagaagaaguuaucaacaugca

SEQ ID NO: 949516 - RNA, 19 nt, Homo sapiens
cagaagcaugaucacagcu

SEQ ID NO: 949517 - RNA, 21 nt, Homo sapiens
cagaagcaugaucacagcuca

SEQ ID NO: 949518 - RNA, 20 nt, Homo sapiens
cagaaucacauguaauccaa

SEQ ID NO: 949519 - RNA, 23 nt, Homo sapiens
cagaaucacauguaauccaaaga

SEQ ID NO: 949520 - RNA, 20 nt, Homo sapiens
cagaauccuugucauuuccu

SEQ ID NO: 949521 - RNA, 16 nt, Homo sapiens
acuugugauccuaaaa

SEQ ID NO: 949522 - RNA, 12 nt, Homo sapiens
acuuuaccucuu

SEQ ID NO: 949523 - RNA, 18 nt, Homo sapiens
acuuuauggagaguucag

SEQ ID NO: 949524 - RNA, 17 nt, Homo sapiens
acuuucauucaauuugc

SEQ ID NO: 949525 - RNA, 19 nt, Homo sapiens
acuuucugagauggcuuuu

SEQ ID NO: 949526 - RNA, 12 nt, Homo sapiens
acuuucuucccu

SEQ ID NO: 949527 - RNA, 20 nt, Homo sapiens
acuuuucuuucagccaagaa

SEQ ID NO: 949528 - RNA, 19 nt, Homo sapiens
acuuuuucucgaguccaaa

SEQ ID NO: 949529 - RNA, 14 nt, Homo sapiens
agaaaagacacuuc

SEQ ID NO: 949530 - RNA, 15 nt, Homo sapiens
agaaaagacacuuca

SEQ ID NO: 949531 - RNA, 21 nt, Homo sapiens
agaaacaagguguacaacuuc

SEQ ID NO: 949532 - RNA, 16 nt, Homo sapiens
agaaagauucaauuaa

SEQ ID NO: 949533 - RNA, 15 nt, Homo sapiens
agaaauaaagcacau

SEQ ID NO: 949534 - RNA, 16 nt, Homo sapiens
agaaauccagcuucau

SEQ ID NO: 949535 - RNA, 22 nt, Homo sapiens
agaaauguauaugcuacugugu

SEQ ID NO: 949536 - RNA, 20 nt, Homo sapiens
agaaccaagcacuaccagua

SEQ ID NO: 949537 - RNA, 14 nt, Homo sapiens
agaacgaauuauuu

SEQ ID NO: 949538 - RNA, 16 nt, Homo sapiens
agaacgguuuuuggau

SEQ ID NO: 949539 - RNA, 20 nt, Homo sapiens
agaacuuauucuccaucuca

SEQ ID NO: 949540 - RNA, 20 nt, Homo sapiens
agaagaauugaggauguccc

SEQ ID NO: 949541 - RNA, 17 nt, Homo sapiens
agaagagcucacuaugg

SEQ ID NO: 949542 - RNA, 17 nt, Homo sapiens
agaagaucaaugaucac

SEQ ID NO: 949543 - RNA, 12 nt, Homo sapiens
agaagcacuuga

SEQ ID NO: 949544 - RNA, 20 nt, Homo sapiens
agaagcaugaucacagcuca

SEQ ID NO: 949545 - RNA, 12 nt, Homo sapiens
agaaggcucuau

SEQ ID NO: 949546 - RNA, 18 nt, Homo sapiens
agaaguuaucaacaugca

SEQ ID NO: 949547 - RNA, 19 nt, Homo sapiens
agaauuucccaaagcagug

SEQ ID NO: 949548 - RNA, 15 nt, Homo sapiens
agacagggucucacu

SEQ ID NO: 949549 - RNA, 18 nt, Homo sapiens
agacgugugagagggacg

SEQ ID NO: 949550 - RNA, 17 nt, Homo sapiens
agacucgagagggcuga

SEQ ID NO: 949551 - RNA, 17 nt, Homo sapiens
agacucuggaacccugg

SEQ ID NO: 949552 - RNA, 22 nt, Homo sapiens
agacugagguaaauaaagccac

SEQ ID NO: 949553 - RNA, 20 nt, Homo sapiens
agacuuuuagcgguuugcaa

SEQ ID NO: 949554 - RNA, 14 nt, Homo sapiens
agagaauucacuuu

SEQ ID NO: 949555 - RNA, 22 nt, Homo sapiens
agagagcuuaagugacuuccuc

SEQ ID NO: 949556 - RNA, 21 nt, Homo sapiens
agagagcuucaacuacuucuc

SEQ ID NO: 949557 - RNA, 21 nt, Homo sapiens
agagauggcagagccauccac

SEQ ID NO: 949558 - RNA, 23 nt, Homo sapiens
agagcaaagacuuaaucauauca

SEQ ID NO: 949559 - RNA, 23 nt, Homo sapiens
agagcacacugcacacaugcaca

SEQ ID NO: 949560 - RNA, 21 nt, Homo sapiens
agagcagagcccccauggccu

SEQ ID NO: 949561 - RNA, 20 nt, Homo sapiens
agagccugugugaaaauacu

SEQ ID NO: 949562 - RNA, 21 nt, Homo sapiens
agagcucugucugaauccucg

SEQ ID NO: 949563 - RNA, 13 nt, Homo sapiens
agagcugcuucca

SEQ ID NO: 949564 - RNA, 15 nt, Homo sapiens
agagcugggacucag

SEQ ID NO: 949565 - RNA, 19 nt, Homo sapiens
agagcugggacucaguucu

SEQ ID NO: 949566 - RNA, 20 nt, Homo sapiens
agaggaccccauucugggac

SEQ ID NO: 949567 - RNA, 15 nt, Homo sapiens
agaggcagcuagcca

SEQ ID NO: 949568 - RNA, 19 nt, Homo sapiens
agaggcccaagugcaaaag

SEQ ID NO: 949569 - RNA, 14 nt, Homo sapiens
agagggauggcuca

SEQ ID NO: 949570 - RNA, 21 nt, Homo sapiens
agaggguggagaugucagucu

SEQ ID NO: 949571 - RNA, 22 nt, Homo sapiens
agagguacuaaaaacacuggau

SEQ ID NO: 949572 - RNA, 14 nt, Homo sapiens
agagucacuggaac

SEQ ID NO: 949573 - RNA, 12 nt, Homo sapiens
agagucaucuca

SEQ ID NO: 949574 - RNA, 15 nt, Homo sapiens
agagucauuguuaca

SEQ ID NO: 949575 - RNA, 12 nt, Homo sapiens
agagucugagaa

SEQ ID NO: 949576 - RNA, 17 nt, Homo sapiens
agaguggcuuugucagu

SEQ ID NO: 949577 - RNA, 17 nt, Homo sapiens
agagugugauguucacu

SEQ ID NO: 949578 - RNA, 13 nt, Homo sapiens
agaguugagcaca

SEQ ID NO: 949579 - RNA, 16 nt, Homo sapiens
agauaaaaucuucaac

SEQ ID NO: 949580 - RNA, 19 nt, Homo sapiens
agauaaggcaacaaaaugg

SEQ ID NO: 949581 - RNA, 17 nt, Homo sapiens
agauaccaggcacuuaa

SEQ ID NO: 949582 - RNA, 23 nt, Homo sapiens
agauacuguauaugucaaaaaua

SEQ ID NO: 949583 - RNA, 18 nt, Homo sapiens
agauauucauacuuucca

SEQ ID NO: 949584 - RNA, 17 nt, Homo sapiens
agaucacacacaugcac

SEQ ID NO: 949585 - RNA, 19 nt, Homo sapiens
agaucacacacaugcacac

SEQ ID NO: 949586 - RNA, 13 nt, Homo sapiens
agauccucugaua

SEQ ID NO: 949587 - RNA, 14 nt, Homo sapiens
agaugcuacaguau

SEQ ID NO: 949588 - RNA, 14 nt, Homo sapiens
agauggaauaucaa

SEQ ID NO: 949589 - RNA, 17 nt, Homo sapiens
agauguaccauguuaaa

SEQ ID NO: 949590 - RNA, 14 nt, Homo sapiens
agauuaaucuacca

SEQ ID NO: 949591 - RNA, 15 nt, Homo sapiens
agauucagucuugcc

SEQ ID NO: 949592 - RNA, 21 nt, Homo sapiens
agauuucccuaaaaauuccac

SEQ ID NO: 949593 - RNA, 18 nt, Homo sapiens
agauuuuuaauacguuaa

SEQ ID NO: 949594 - RNA, 11 nt, Homo sapiens
agcaaccagag

SEQ ID NO: 949595 - RNA, 23 nt, Homo sapiens
uaguauucugaucaguugccaaa

SEQ ID NO: 949596 - RNA, 13 nt, Homo sapiens
uaguauuggcaau

SEQ ID NO: 949597 - RNA, 15 nt, Homo sapiens
uagucagaaaauugg

SEQ ID NO: 949598 - RNA, 21 nt, Homo sapiens
uaguccagaaaucuauuacac

SEQ ID NO: 949599 - RNA, 12 nt, Homo sapiens
uagugcauuuag

SEQ ID NO: 949600 - RNA, 19 nt, Homo sapiens
uaguuaauuguggcuuuau

SEQ ID NO: 949601 - RNA, 22 nt, Homo sapiens
uaguuguugaaacaaaacugga

SEQ ID NO: 949602 - RNA, 13 nt, Homo sapiens
uaguuucaggcaa

SEQ ID NO: 949603 - RNA, 20 nt, Homo sapiens
uauaaaagauuccugaaugu

SEQ ID NO: 949604 - RNA, 15 nt, Homo sapiens
uauaaaaucuuucca

SEQ ID NO: 949605 - RNA, 20 nt, Homo sapiens
uauaauauuauacugcuaua

SEQ ID NO: 949606 - RNA, 17 nt, Homo sapiens
uauagaccccaagcauu

SEQ ID NO: 949607 - RNA, 18 nt, Homo sapiens
uaucagaacuccuuucua

SEQ ID NO: 949608 - RNA, 15 nt, Homo sapiens
uaucagaguauguca

SEQ ID NO: 949609 - RNA, 19 nt, Homo sapiens
uaucagugcuccaguauau

SEQ ID NO: 949610 - RNA, 19 nt, Homo sapiens
uauccaaucucaucucuug

SEQ ID NO: 949611 - RNA, 14 nt, Homo sapiens
uauccagucaaaga

SEQ ID NO: 949612 - RNA, 19 nt, Homo sapiens
uauccauguacuuucccug

SEQ ID NO: 949613 - RNA, 22 nt, Homo sapiens
uaucuggguuuuagaaauucua

SEQ ID NO: 949614 - RNA, 23 nt, Homo sapiens
uaugaaagagaaaaugcuuucuc

SEQ ID NO: 949615 - RNA, 18 nt, Homo sapiens
uaugaauaaaauuguuau

SEQ ID NO: 949616 - RNA, 15 nt, Homo sapiens
uaugacauauuacaa

SEQ ID NO: 949617 - RNA, 17 nt, Homo sapiens
uaugaccuaaauccauu

SEQ ID NO: 949618 - RNA, 16 nt, Homo sapiens
uaugcaaccugugcaa

SEQ ID NO: 949619 - RNA, 12 nt, Homo sapiens
uaugccaaaaug

SEQ ID NO: 949620 - RNA, 19 nt, Homo sapiens
uauggguuuuacugauaug

SEQ ID NO: 949621 - RNA, 18 nt, Homo sapiens
uaugguaaagagauguca

SEQ ID NO: 949622 - RNA, 15 nt, Homo sapiens
uaugguaacugauga

SEQ ID NO: 949623 - RNA, 15 nt, Homo sapiens
uauguauaacaagcc

SEQ ID NO: 949624 - RNA, 18 nt, Homo sapiens
uauguauaacaagccaaa

SEQ ID NO: 949625 - RNA, 21 nt, Homo sapiens
uauguauaacaagccaaacau

SEQ ID NO: 949626 - RNA, 20 nt, Homo sapiens
uauguggaguucaucuugaa

SEQ ID NO: 949627 - RNA, 16 nt, Homo sapiens
uaugugguugauaaug

SEQ ID NO: 949628 - RNA, 16 nt, Homo sapiens
uauuacaacacuuuaa

SEQ ID NO: 949629 - RNA, 15 nt, Homo sapiens
uauucacaguaucug

SEQ ID NO: 949630 - RNA, 20 nt, Homo sapiens
uauucaggaccccaucugcu

SEQ ID NO: 949631 - RNA, 17 nt, Homo sapiens
uauuccucacauucaca

SEQ ID NO: 949632 - RNA, 15 nt, Homo sapiens
uauucuccaucucaa

SEQ ID NO: 949633 - RNA, 19 nt, Homo sapiens
uauucuuuuauauaacuac

SEQ ID NO: 949634 - RNA, 23 nt, Homo sapiens
uauucuuuuuggaaauaaaauac

SEQ ID NO: 949635 - RNA, 17 nt, Homo sapiens
uauugaaugcauacucu

SEQ ID NO: 949636 - RNA, 20 nt, Homo sapiens
uauugacgaccuacaucuga

SEQ ID NO: 949637 - RNA, 18 nt, Homo sapiens
uauuggagauuaaucuac

SEQ ID NO: 949638 - RNA, 22 nt, Homo sapiens
uauuguuaaaaccuuacuuaaa

SEQ ID NO: 949639 - RNA, 15 nt, Homo sapiens
uauuuacugugcuaa

SEQ ID NO: 949640 - RNA, 21 nt, Homo sapiens
uauuucuaucugcaaauaguu

SEQ ID NO: 949641 - RNA, 21 nt, Homo sapiens
uauuuucagugcuuugcccuu

SEQ ID NO: 949642 - RNA, 13 nt, Homo sapiens
ucaaaacuuucag

SEQ ID NO: 949643 - RNA, 17 nt, Homo sapiens
ucaaaagcaguauuuca

SEQ ID NO: 949644 - RNA, 13 nt, Homo sapiens
ucaaaaggucuaa

SEQ ID NO: 949645 - RNA, 11 nt, Homo sapiens
ucaaaugcagu

SEQ ID NO: 949646 - RNA, 14 nt, Homo sapiens
ucaaauuuaucucu

SEQ ID NO: 949647 - RNA, 21 nt, Homo sapiens
ucaaccaucucucagcaguua

SEQ ID NO: 949648 - RNA, 17 nt, Homo sapiens
ucaacuauuuuauguca

SEQ ID NO: 949649 - RNA, 21 nt, Homo sapiens
ucaacucacuagaugccaaug

SEQ ID NO: 949650 - RNA, 19 nt, Homo sapiens
ucaacugaugauagacuuc

SEQ ID NO: 949651 - RNA, 16 nt, Homo sapiens
ucaacuguugccagga

SEQ ID NO: 949652 - RNA, 23 nt, Homo sapiens
ucaacuuuugaaauuuaaaaauc

SEQ ID NO: 949653 - RNA, 15 nt, Homo sapiens
ucaagaugugacaug

SEQ ID NO: 949654 - RNA, 13 nt, Homo sapiens
ucaagcaauccac

SEQ ID NO: 949655 - RNA, 19 nt, Homo sapiens
ucaaugcccaacagggcaa

SEQ ID NO: 949656 - RNA, 15 nt, Homo sapiens
ucaauucugauucca

SEQ ID NO: 949657 - RNA, 19 nt, Homo sapiens
ucacaagucagcacuaccu

SEQ ID NO: 949658 - RNA, 14 nt, Homo sapiens
ucacacacaugcac

SEQ ID NO: 949659 - RNA, 16 nt, Homo sapiens
ucacacacaugcacac

SEQ ID NO: 949660 - RNA, 15 nt, Homo sapiens
ucacagaaucuccau

SEQ ID NO: 949661 - RNA, 24 nt, Homo sapiens
ucacauagguguugucaagugaua

SEQ ID NO: 949662 - RNA, 17 nt, Homo sapiens
ucacaugcuucuggcaa

SEQ ID NO: 949663 - RNA, 19 nt, Homo sapiens
ucaccauguugcccaggcu

SEQ ID NO: 949664 - RNA, 23 nt, Homo sapiens
ucaccauuuacgcuacaugugau

SEQ ID NO: 949665 - RNA, 22 nt, Homo sapiens
ucacccaaaacuuuuggcaaau

SEQ ID NO: 949666 - RNA, 14 nt, Homo sapiens
ucacccacugcugc

SEQ ID NO: 949667 - RNA, 19 nt, Homo sapiens
ucacccaggcuggagugca

SEQ ID NO: 949668 - RNA, 15 nt, Homo sapiens
ucaccugaaacacuu

SEQ ID NO: 949669 - RNA, 20 nt, Homo sapiens
ucacgggcaacacucacugc

SEQ ID NO: 949670 - RNA, 20 nt, Homo sapiens
ucacuagaugccaaugacau

SEQ ID NO: 949671 - RNA, 17 nt, Homo sapiens
ucacuauggucaaaaag

SEQ ID NO: 949672 - RNA, 14 nt, Homo sapiens
ucacucuguugacc

SEQ ID NO: 949673 - RNA, 13 nt, Homo sapiens
ucacuggcuuuag

SEQ ID NO: 949674 - RNA, 16 nt, Homo sapiens
ucacuuuaaauaugaa

SEQ ID NO: 949675 - RNA, 18 nt, Homo sapiens
ucagaaaagacacuucaa

SEQ ID NO: 949676 - RNA, 20 nt, Homo sapiens
ucagaacuccuuucuaagga

SEQ ID NO: 949677 - RNA, 18 nt, Homo sapiens
ucagaaggguuaacucaa

SEQ ID NO: 949678 - RNA, 13 nt, Homo sapiens
ucagacauucaga

SEQ ID NO: 949679 - RNA, 18 nt, Homo sapiens
ucagcacagauaaaaagu

SEQ ID NO: 949680 - RNA, 15 nt, Homo sapiens
ucagcacgaauguuc

SEQ ID NO: 949681 - RNA, 22 nt, Homo sapiens
ucagcacguaguuugcauucca

SEQ ID NO: 949682 - RNA, 21 nt, Homo sapiens
ucagcauucaaaauaguucua

SEQ ID NO: 949683 - RNA, 20 nt, Homo sapiens
ucagccuuagcacuauggac

SEQ ID NO: 949684 - RNA, 22 nt, Homo sapiens
ucagccuuagcacuauggacau

SEQ ID NO: 949685 - RNA, 13 nt, Homo sapiens
ucagcgagcauaa

SEQ ID NO: 949686 - RNA, 14 nt, Homo sapiens
ucagcucuugucaa

SEQ ID NO: 949687 - RNA, 21 nt, Homo sapiens
ucaggaagccuccugcugagu

SEQ ID NO: 949688 - RNA, 21 nt, Homo sapiens
ucaggugccuuugaguucuag

SEQ ID NO: 949689 - RNA, 16 nt, Homo sapiens
ucaguaugaagacacu

SEQ ID NO: 949690 - RNA, 21 nt, Homo sapiens
ucagugaauccugaaacuggu

SEQ ID NO: 949691 - RNA, 21 nt, Homo sapiens
ucagugccuuauggaacacuc

SEQ ID NO: 949692 - RNA, 15 nt, Homo sapiens
ucaguugccaaagga

SEQ ID NO: 949693 - RNA, 20 nt, Homo sapiens
ucaguuguggccucauucag

SEQ ID NO: 949694 - RNA, 20 nt, Homo sapiens
ucauaaaguuagaaucuauu

SEQ ID NO: 949695 - RNA, 15 nt, Homo sapiens
ucauaacucacuuua

SEQ ID NO: 949696 - RNA, 14 nt, Homo sapiens
ucauaaugacuuaa

SEQ ID NO: 949697 - RNA, 22 nt, Homo sapiens
ucauaaugacuuaagcacacuu

SEQ ID NO: 949698 - RNA, 23 nt, Homo sapiens
ucauaauuuccaugauacaaaga

SEQ ID NO: 949699 - RNA, 23 nt, Homo sapiens
ucaucagggggcaugaagcacau

SEQ ID NO: 949700 - RNA, 21 nt, Homo sapiens
ucaugccgcugugucuaugaa

SEQ ID NO: 949701 - RNA, 22 nt, Homo sapiens
ucauggaccacuguuucuugcu

SEQ ID NO: 949702 - RNA, 17 nt, Homo sapiens
ucauguguggaaauggg

SEQ ID NO: 949703 - RNA, 19 nt, Homo sapiens
ucauguuucugcaguauuc

SEQ ID NO: 949704 - RNA, 11 nt, Homo sapiens
ucauucuugcc

SEQ ID NO: 949705 - RNA, 19 nt, Homo sapiens
ucauuuaagaaaaaucaua

SEQ ID NO: 949706 - RNA, 20 nt, Homo sapiens
ucauuucauguuagucuuac

SEQ ID NO: 949707 - RNA, 23 nt, Homo sapiens
ucauuuuugcuuuucaaaugaca

SEQ ID NO: 949708 - RNA, 16 nt, Homo sapiens
uccaaaauaaauggac

SEQ ID NO: 949709 - RNA, 19 nt, Homo sapiens
uccaaaauaaauggacuga

SEQ ID NO: 949710 - RNA, 23 nt, Homo sapiens
uccaaaauagucauguuucugca

SEQ ID NO: 949711 - RNA, 11 nt, Homo sapiens
uccaacagggg

SEQ ID NO: 949712 - RNA, 20 nt, Homo sapiens
uccaaggccccaccuucuau

SEQ ID NO: 949713 - RNA, 15 nt, Homo sapiens
uccacacaggcccau

SEQ ID NO: 949714 - RNA, 13 nt, Homo sapiens
uccacagugauua

SEQ ID NO: 949715 - RNA, 21 nt, Homo sapiens
uccacuauaauuuuacaaagu

SEQ ID NO: 949716 - RNA, 15 nt, Homo sapiens
uccacucugcucagg

SEQ ID NO: 949717 - RNA, 21 nt, Homo sapiens
uccacugaaaccucuguucuc

SEQ ID NO: 949718 - RNA, 17 nt, Homo sapiens
uccacuuaucuuggaau

SEQ ID NO: 949719 - RNA, 22 nt, Homo sapiens
uccagaacgcccuguguccaca

SEQ ID NO: 949720 - RNA, 13 nt, Homo sapiens
uccagacuaugca

SEQ ID NO: 949721 - RNA, 15 nt, Homo sapiens
uccagacuaugcagc

SEQ ID NO: 949722 - RNA, 11 nt, Homo sapiens
uccagcacauc

SEQ ID NO: 949723 - RNA, 14 nt, Homo sapiens
uccagcagagccuu

SEQ ID NO: 949724 - RNA, 14 nt, Homo sapiens
uccagccuguuucc

SEQ ID NO: 949725 - RNA, 22 nt, Homo sapiens
uccagcgucugcuguugauucc

SEQ ID NO: 949726 - RNA, 16 nt, Homo sapiens
uuccagcucaguccca

SEQ ID NO: 949727 - RNA, 16 nt, Homo sapiens
uuccaucucauuacag

SEQ ID NO: 949728 - RNA, 19 nt, Homo sapiens
uucccacagccucuuccuc

SEQ ID NO: 949729 - RNA, 22 nt, Homo sapiens
uucccccccaagauagagucaa

SEQ ID NO: 949730 - RNA, 11 nt, Homo sapiens
uuccccggagc

SEQ ID NO: 949731 - RNA, 14 nt, Homo sapiens
uucccugaggaccu

SEQ ID NO: 949732 - RNA, 19 nt, Homo sapiens
uucccuguguacccuccau

SEQ ID NO: 949733 - RNA, 22 nt, Homo sapiens
uucccuguguacccuccaugua

SEQ ID NO: 949734 - RNA, 14 nt, Homo sapiens
uuccuauuugcaca

SEQ ID NO: 949735 - RNA, 21 nt, Homo sapiens
uuccuauuugcacacguccau

SEQ ID NO: 949736 - RNA, 21 nt, Homo sapiens
uuccuccuaaauuuccagggg

SEQ ID NO: 949737 - RNA, 22 nt, Homo sapiens
uuccugaagaauugaaaaacca

SEQ ID NO: 949738 - RNA, 16 nt, Homo sapiens
uuccugaauguaauua

SEQ ID NO: 949739 - RNA, 18 nt, Homo sapiens
uuccugaauguaauuaua

SEQ ID NO: 949740 - RNA, 12 nt, Homo sapiens
uuccuguugcac

SEQ ID NO: 949741 - RNA, 22 nt, Homo sapiens
uuccuugcuuaugagaccaaga

SEQ ID NO: 949742 - RNA, 18 nt, Homo sapiens
uucgaaaacagaugagaa

SEQ ID NO: 949743 - RNA, 21 nt, Homo sapiens
uucgccaaggcucacaugcuc

SEQ ID NO: 949744 - RNA, 23 nt, Homo sapiens
uucgccaaggcucacaugcuccu

SEQ ID NO: 949745 - RNA, 20 nt, Homo sapiens
uucuacucgaguuacagaca

SEQ ID NO: 949746 - RNA, 22 nt, Homo sapiens
uucuacucgaguuacagacaaa

SEQ ID NO: 949747 - RNA, 19 nt, Homo sapiens
uucuagcaguaugugugcu

SEQ ID NO: 949748 - RNA, 12 nt, Homo sapiens
uucuagcuauaa

SEQ ID NO: 949749 - RNA, 21 nt, Homo sapiens
uucucauuuagcauugaaaua

SEQ ID NO: 949750 - RNA, 18 nt, Homo sapiens
uucuccaaagcuugccac

SEQ ID NO: 949751 - RNA, 15 nt, Homo sapiens
uucuccagacuuaaa

SEQ ID NO: 949752 - RNA, 15 nt, Homo sapiens
uucuccuuguacuug

SEQ ID NO: 949753 - RNA, 14 nt, Homo sapiens
uucugaagaucuca

SEQ ID NO: 949754 - RNA, 14 nt, Homo sapiens
uucugagugaaugu

SEQ ID NO: 949755 - RNA, 23 nt, Homo sapiens
uucugcaaaguguaugugaccau

SEQ ID NO: 949756 - RNA, 23 nt, Homo sapiens
uucuguaauggggacacuacaaa

SEQ ID NO: 949757 - RNA, 12 nt, Homo sapiens
uucuuauucacu

SEQ ID NO: 949758 - RNA, 15 nt, Homo sapiens
uucuuggcuuccuuu

SEQ ID NO: 949759 - RNA, 19 nt, Homo sapiens
uucuuuuguaagugcuaca

SEQ ID NO: 949760 - RNA, 19 nt, Homo sapiens
uucuuuuuccccaauaaau

SEQ ID NO: 949761 - RNA, 18 nt, Homo sapiens
uucuuuuucugucuugua

SEQ ID NO: 949762 - RNA, 19 nt, Homo sapiens
uugaaccgucaaugugaaa

SEQ ID NO: 949763 - RNA, 22 nt, Homo sapiens
uugaagacuuuucuuucagcca

SEQ ID NO: 949764 - RNA, 14 nt, Homo sapiens
uugaagucuuguau

SEQ ID NO: 949765 - RNA, 13 nt, Homo sapiens
uugaaugaugcca

SEQ ID NO: 949766 - RNA, 21 nt, Homo sapiens
uugaaugcauacucugugcaa

SEQ ID NO: 949767 - RNA, 17 nt, Homo sapiens
uugaguuacugaucuuc

SEQ ID NO: 949768 - RNA, 14 nt, Homo sapiens
uugaugaagcacau

SEQ ID NO: 949769 - RNA, 20 nt, Homo sapiens
uugauuuacaagcaucaugg

SEQ ID NO: 949770 - RNA, 18 nt, Homo sapiens
uugcaaauuauucuaguc

SEQ ID NO: 949771 - RNA, 20 nt, Homo sapiens
uugcaaauuauucuagucaa

SEQ ID NO: 949772 - RNA, 15 nt, Homo sapiens
uugcacacaugcaca

SEQ ID NO: 949773 - RNA, 20 nt, Homo sapiens
uugcaggaagagaugcucua

SEQ ID NO: 949774 - RNA, 14 nt, Homo sapiens
uugcaguaucagag

SEQ ID NO: 949775 - RNA, 18 nt, Homo sapiens
uugcccacugucugcuac

SEQ ID NO: 949776 - RNA, 20 nt, Homo sapiens
uugcccacugucugcuacca

SEQ ID NO: 949777 - RNA, 11 nt, Homo sapiens
uugcugcaaag

SEQ ID NO: 949778 - RNA, 15 nt, Homo sapiens
uuggaaucaaaagag

SEQ ID NO: 949779 - RNA, 13 nt, Homo sapiens
uuggaaucaugca

SEQ ID NO: 949780 - RNA, 18 nt, Homo sapiens
uuggaaucaugcaaaaaa

SEQ ID NO: 949781 - RNA, 19 nt, Homo sapiens
uuggaaucccacuuaucaa

SEQ ID NO: 949782 - RNA, 15 nt, Homo sapiens
uuggaccacagcaug

SEQ ID NO: 949783 - RNA, 14 nt, Homo sapiens
uuggagaaaggauu

SEQ ID NO: 949784 - RNA, 18 nt, Homo sapiens
uuggagauuaaucuacca

SEQ ID NO: 949785 - RNA, 21 nt, Homo sapiens
uuggauaauaacuagaucucc

SEQ ID NO: 949786 - RNA, 19 nt, Homo sapiens
uuggauggccuccauccag

SEQ ID NO: 949787 - RNA, 23 nt, Homo sapiens
uugggaaaaagugauacuuggau

SEQ ID NO: 949788 - RNA, 22 nt, Homo sapiens
uuggggaugagucaguccuugc

SEQ ID NO: 949789 - RNA, 14 nt, Homo sapiens
uuguaacauuucac

SEQ ID NO: 949790 - RNA, 20 nt, Homo sapiens
uuguaacauuucacaguauu

SEQ ID NO: 949791 - RNA, 15 nt, Homo sapiens
uuguacauauggaaa

SEQ ID NO: 949792 - RNA, 19 nt, Homo sapiens
uuguagagacagggucuca

SEQ ID NO: 949793 - RNA, 21 nt, Homo sapiens
uuguagagacagggucucacu

SEQ ID NO: 949794 - RNA, 14 nt, Homo sapiens
uuguauccuggcaa

SEQ ID NO: 949795 - RNA, 21 nt, Homo sapiens
uugucaacuugaaauguguuc

SEQ ID NO: 949796 - RNA, 19 nt, Homo sapiens
uuguuaaaaccuuacuuaa

SEQ ID NO: 949797 - RNA, 19 nt, Homo sapiens
uuuaaaaaaaauauucugu

SEQ ID NO: 949798 - RNA, 16 nt, Homo sapiens
uuuaaaaaaauaacau

SEQ ID NO: 949799 - RNA, 21 nt, Homo sapiens
uuuaaaaaauaacauauucuu

SEQ ID NO: 949800 - RNA, 19 nt, Homo sapiens
uuuaaaaagcccaaccucu

SEQ ID NO: 949801 - RNA, 13 nt, Homo sapiens
uuuaacugugaac

SEQ ID NO: 949802 - RNA, 13 nt, Homo sapiens
uuuacagcacugu

SEQ ID NO: 949803 - RNA, 14 nt, Homo sapiens
uuuacagcacugua

SEQ ID NO: 949804 - RNA, 22 nt, Homo sapiens
uuuacauccagaguucugugac

SEQ ID NO: 949805 - RNA, 16 nt, Homo sapiens
uuuacauggguucaau

SEQ ID NO: 949806 - RNA, 18 nt, Homo sapiens
uuuaccccucuaccaagc

SEQ ID NO: 949807 - RNA, 13 nt, Homo sapiens
uuuagucugggcu

SEQ ID NO: 949808 - RNA, 23 nt, Homo sapiens
uuuauuaguuaggugugccaaac

SEQ ID NO: 949809 - RNA, 19 nt, Homo sapiens
uuucacaaauauaguugaa

SEQ ID NO: 949810 - RNA, 18 nt, Homo sapiens
uuucaccauguugcccag

SEQ ID NO: 949811 - RNA, 16 nt, Homo sapiens
uuucaccugaaacacu

SEQ ID NO: 949812 - RNA, 16 nt, Homo sapiens
uuucagcuacagcaaa

SEQ ID NO: 949813 - RNA, 11 nt, Homo sapiens
uuucauaccaa

SEQ ID NO: 949814 - RNA, 13 nt, Homo sapiens
uuucauguugcaa

SEQ ID NO: 949815 - RNA, 17 nt, Homo sapiens
uuuccaagggucuuccu

SEQ ID NO: 949816 - RNA, 22 nt, Homo sapiens
uuuccauauaguuuguuuucuu

SEQ ID NO: 949817 - RNA, 11 nt, Homo sapiens
uuuccauuugc

SEQ ID NO: 949818 - RNA, 23 nt, Homo sapiens
uuucccuguguacccuccaugua

SEQ ID NO: 949819 - RNA, 13 nt, Homo sapiens
uuuccuguugcac

SEQ ID NO: 949820 - RNA, 13 nt, Homo sapiens
uuucuuaccaugc

SEQ ID NO: 949821 - RNA, 12 nt, Homo sapiens
uuugaaaacacc

SEQ ID NO: 949822 - RNA, 18 nt, Homo sapiens
uuugaaugcaugugugaa

SEQ ID NO: 949823 - RNA, 12 nt, Homo sapiens
uuugccaaaaac

SEQ ID NO: 949824 - RNA, 20 nt, Homo sapiens
uuugcccacugucugcuacc

SEQ ID NO: 949825 - RNA, 18 nt, Homo sapiens
uuugcuaagugaggauga

SEQ ID NO: 949826 - RNA, 20 nt, Homo sapiens
uuuggaaucccacuuaucaa

SEQ ID NO: 949827 - RNA, 15 nt, Homo sapiens
uuuggagagcugcuu

SEQ ID NO: 949828 - RNA, 13 nt, Homo sapiens
uuuggcucagagu

SEQ ID NO: 949829 - RNA, 22 nt, Homo sapiens
uuuggggcaggggguucuggga

SEQ ID NO: 949830 - RNA, 12 nt, Homo sapiens
uuuguaaccaua

SEQ ID NO: 949831 - RNA, 17 nt, Homo sapiens
uuuuaaaaaguugcaca

SEQ ID NO: 949832 - RNA, 15 nt, Homo sapiens
uuuuaaaucauuuca

SEQ ID NO: 949833 - RNA, 16 nt, Homo sapiens
uuuuacaaaccuuuaa

SEQ ID NO: 949834 - RNA, 20 nt, Homo sapiens
uuuuaccuuucaugugccug

SEQ ID NO: 949835 - RNA, 12 nt, Homo sapiens
uuuuagaguaug

SEQ ID NO: 949836 - RNA, 17 nt, Homo sapiens
uuuuccugugcaaaaau

SEQ ID NO: 949837 - RNA, 11 nt, Homo sapiens
uuuucuuuaaa

SEQ ID NO: 949838 - RNA, 13 nt, Homo sapiens
uuuugaagucuug

SEQ ID NO: 949839 - RNA, 23 nt, Homo sapiens
uuuuggggaggaguugucugucc

SEQ ID NO: 949840 - RNA, 17 nt, Homo sapiens
uguuuugcauggaguau

SEQ ID NO: 949841 - RNA, 15 nt, Homo sapiens
uuaaaaaauaacaua

SEQ ID NO: 949842 - RNA, 20 nt, Homo sapiens
uuaaaauguauuuuucacaa

SEQ ID NO: 949843 - RNA, 13 nt, Homo sapiens
uuaaagagacaaa

SEQ ID NO: 949844 - RNA, 14 nt, Homo sapiens
uuaaaucauagcua

SEQ ID NO: 949845 - RNA, 14 nt, Homo sapiens
uuaagaugggcaua

SEQ ID NO: 949846 - RNA, 20 nt, Homo sapiens
uuaagcacacuugacaucaa

SEQ ID NO: 949847 - RNA, 16 nt, Homo sapiens
uuaagggcagauuaca

SEQ ID NO: 949848 - RNA, 18 nt, Homo sapiens
uuaaucucuaaaauucua

SEQ ID NO: 949849 - RNA, 14 nt, Homo sapiens
uuaaugucaucucu

SEQ ID NO: 949850 - RNA, 14 nt, Homo sapiens
uuaaugugcugcug

SEQ ID NO: 949851 - RNA, 13 nt, Homo sapiens
uuacaaaagaaga

SEQ ID NO: 949852 - RNA, 14 nt, Homo sapiens
uuacaacacuuuaa

SEQ ID NO: 949853 - RNA, 14 nt, Homo sapiens
uuacagauaaccua

SEQ ID NO: 949854 - RNA, 20 nt, Homo sapiens
uuacagcacuguauguguug

SEQ ID NO: 949855 - RNA, 23 nt, Homo sapiens
uuacaugaauacgucuugaucag

SEQ ID NO: 949856 - RNA, 14 nt, Homo sapiens
uuacauuguaguua

SEQ ID NO: 949857 - RNA, 17 nt, Homo sapiens
uuacauuuucuuucaua

SEQ ID NO: 949858 - RNA, 15 nt, Homo sapiens
uuaccaaaacauaag

SEQ ID NO: 949859 - RNA, 14 nt, Homo sapiens
uuaccagaauguug

SEQ ID NO: 949860 - RNA, 14 nt, Homo sapiens
uuaccuuuguuccu

SEQ ID NO: 949861 - RNA, 14 nt, Homo sapiens
uuacuagauucaua

SEQ ID NO: 949862 - RNA, 13 nt, Homo sapiens
uuagagugcacau

SEQ ID NO: 949863 - RNA, 20 nt, Homo sapiens
uuagauauucauacuuucca

SEQ ID NO: 949864 - RNA, 11 nt, Homo sapiens
gaguagcucag

SEQ ID NO: 949865 - RNA, 22 nt, Homo sapiens
gagucauguugaaggugcccaa

SEQ ID NO: 949866 - RNA, 14 nt, Homo sapiens
gagucauuguuaca

SEQ ID NO: 949867 - RNA, 16 nt, Homo sapiens
gagugaagugguguga

SEQ ID NO: 949868 - RNA, 17 nt, Homo sapiens
gaguggcugaccaggcc

SEQ ID NO: 949869 - RNA, 20 nt, Homo sapiens
gagugucaccagcugccaaa

SEQ ID NO: 949870 - RNA, 18 nt, Homo sapiens
gaguuauguggauuucau

SEQ ID NO: 949871 - RNA, 16 nt, Homo sapiens
gaguucaucuugaauu

SEQ ID NO: 949872 - RNA, 15 nt, Homo sapiens
gaguuguuggcaagu

SEQ ID NO: 949873 - RNA, 23 nt, Homo sapiens
gauaaaauaaaaagaugaagcug

SEQ ID NO: 949874 - RNA, 14 nt, Homo sapiens
gauaagacuggaaa

SEQ ID NO: 949875 - RNA, 22 nt, Homo sapiens
gauaaugaucugaaucuguuuc

SEQ ID NO: 949876 - RNA, 13 nt, Homo sapiens
gauacaguauuau

SEQ ID NO: 949877 - RNA, 18 nt, Homo sapiens
gauagaaaagguccaaaa

SEQ ID NO: 949878 - RNA, 19 nt, Homo sapiens
gauagaaaagguccaaaac

SEQ ID NO: 949879 - RNA, 15 nt, Homo sapiens
gauagaucauaacag

SEQ ID NO: 949880 - RNA, 21 nt, Homo sapiens
gauaggaagacgcagagcaaa

SEQ ID NO: 949881 - RNA, 13 nt, Homo sapiens
gauauaauuacuu

SEQ ID NO: 949882 - RNA, 20 nt, Homo sapiens
gauauaauuacuuaauguga

SEQ ID NO: 949883 - RNA, 16 nt, Homo sapiens
gauauaggaaaauaca

SEQ ID NO: 949884 - RNA, 20 nt, Homo sapiens
gauaugguucuuauucacug

SEQ ID NO: 949885 - RNA, 13 nt, Homo sapiens
gaucacagcucac

SEQ ID NO: 949886 - RNA, 18 nt, Homo sapiens
gauccaaaauaaauggac

SEQ ID NO: 949887 - RNA, 16 nt, Homo sapiens
gaucuaagcaguugca

SEQ ID NO: 949888 - RNA, 15 nt, Homo sapiens
gaucucggugcugaa

SEQ ID NO: 949889 - RNA, 20 nt, Homo sapiens
gaucugugccauagaacaag

SEQ ID NO: 949890 - RNA, 19 nt, Homo sapiens
gaugaaaaaauaacacugu

SEQ ID NO: 949891 - RNA, 12 nt, Homo sapiens
gaugaagcacau

SEQ ID NO: 949892 - RNA, 16 nt, Homo sapiens
gaugagaggaaaucac

SEQ ID NO: 949893 - RNA, 21 nt, Homo sapiens
gaugaggaucucuuuuugccc

SEQ ID NO: 949894 - RNA, 16 nt, Homo sapiens
gaugauagaucauaac

SEQ ID NO: 949895 - RNA, 23 nt, Homo sapiens
gaugcagaaauguggaugcucuu

SEQ ID NO: 949896 - RNA, 12 nt, Homo sapiens
gaugcuauuaaa

SEQ ID NO: 949897 - RNA, 16 nt, Homo sapiens
gaugggaucauuauuu

SEQ ID NO: 949898 - RNA, 19 nt, Homo sapiens
gaugucaucacacucucca

SEQ ID NO: 949899 - RNA, 19 nt, Homo sapiens
gaugucccugaagugccag

SEQ ID NO: 949900 - RNA, 13 nt, Homo sapiens
gaugucuguucua

SEQ ID NO: 949901 - RNA, 22 nt, Homo sapiens
gauguuugcuguguuucaaacc

SEQ ID NO: 949902 - RNA, 22 nt, Homo sapiens
gauuacauuguaguuaaacaaa

SEQ ID NO: 949903 - RNA, 16 nt, Homo sapiens
gauuauaaacaacaga

SEQ ID NO: 949904 - RNA, 14 nt, Homo sapiens
gauucauaaugacu

SEQ ID NO: 949905 - RNA, 17 nt, Homo sapiens
gauucuaaaacauucuu

SEQ ID NO: 949906 - RNA, 14 nt, Homo sapiens
gauuuaagcauuuu

SEQ ID NO: 949907 - RNA, 22 nt, Homo sapiens
gauuucaucacuaguaugugug

SEQ ID NO: 949908 - RNA, 16 nt, Homo sapiens
gauuucuguuguuauu

SEQ ID NO: 949909 - RNA, 23 nt, Homo sapiens
gauuuguauuuauauuagagugc

SEQ ID NO: 949910 - RNA, 22 nt, Homo sapiens
gcaaaaaaaaaaauuacauuau

SEQ ID NO: 949911 - RNA, 12 nt, Homo sapiens
gcaaagacuuaa

SEQ ID NO: 949912 - RNA, 15 nt, Homo sapiens
gcaaaguguauguga

SEQ ID NO: 949913 - RNA, 15 nt, Homo sapiens
gcaaaugaaugccuu

SEQ ID NO: 949914 - RNA, 13 nt, Homo sapiens
gcaaccaauaaaa

SEQ ID NO: 949915 - RNA, 19 nt, Homo sapiens
gcaaccaauaaaaguguca

SEQ ID NO: 949916 - RNA, 16 nt, Homo sapiens
gcaaccccugcagcuc

SEQ ID NO: 949917 - RNA, 20 nt, Homo sapiens
gcaaccugugcaaaauaaaa

SEQ ID NO: 949918 - RNA, 14 nt, Homo sapiens
gcaagaacauucaa

SEQ ID NO: 949919 - RNA, 19 nt, Homo sapiens
gcaagcccgucaucuuccc

SEQ ID NO: 949920 - RNA, 17 nt, Homo sapiens
gcacaaagaugugcaaa

SEQ ID NO: 949921 - RNA, 11 nt, Homo sapiens
gcacaaagggc

SEQ ID NO: 949922 - RNA, 17 nt, Homo sapiens
gcacacugcacacaugc

SEQ ID NO: 949923 - RNA, 17 nt, Homo sapiens
gcacaggcaacauuaca

SEQ ID NO: 949924 - RNA, 11 nt, Homo sapiens
gcacaugcaca

SEQ ID NO: 949925 - RNA, 17 nt, Homo sapiens
gcaccagccugagccac

SEQ ID NO: 949926 - RNA, 20 nt, Homo sapiens
gcaccgggcuggccugacac

SEQ ID NO: 949927 - RNA, 20 nt, Homo sapiens
gcaccuucacucuccagggu

SEQ ID NO: 949928 - RNA, 13 nt, Homo sapiens
gcaccuuccuuuc

SEQ ID NO: 949929 - RNA, 19 nt, Homo sapiens
gcaccuugggcacgggaga

SEQ ID NO: 949930 - RNA, 14 nt, Homo sapiens
gcacgaagcaguua

SEQ ID NO: 949931 - RNA, 17 nt, Homo sapiens
gcacuaacacaugcaca

SEQ ID NO: 949932 - RNA, 12 nt, Homo sapiens
gcagaaccaaag

SEQ ID NO: 949933 - RNA, 13 nt, Homo sapiens
gcagaaccaaagc

SEQ ID NO: 949934 - RNA, 18 nt, Homo sapiens
gcagacccuuuucaucuc

SEQ ID NO: 949935 - RNA, 19 nt, Homo sapiens
gcagcaaccagagcacugu

SEQ ID NO: 949936 - RNA, 14 nt, Homo sapiens
gcagccugagcucc

SEQ ID NO: 949937 - RNA, 15 nt, Homo sapiens
gcagcugagauucca

SEQ ID NO: 949938 - RNA, 20 nt, Homo sapiens
gcaggaggccauuccaggag

SEQ ID NO: 949939 - RNA, 21 nt, Homo sapiens
gcaggcccuccgcgggggaca

SEQ ID NO: 949940 - RNA, 18 nt, Homo sapiens
gcaggcgguauccagagg

SEQ ID NO: 949941 - RNA, 23 nt, Homo sapiens
gcaggcuuucugggugugacuga

SEQ ID NO: 949942 - RNA, 14 nt, Homo sapiens
gcaguccagugaga

SEQ ID NO: 949943 - RNA, 21 nt, Homo sapiens
gcaguccugugccucaucacu

SEQ ID NO: 949944 - RNA, 16 nt, Homo sapiens
gcaguuaauucuugcc

SEQ ID NO: 949945 - RNA, 15 nt, Homo sapiens
gcauaccacuugaag

SEQ ID NO: 949946 - RNA, 23 nt, Homo sapiens
gcauacuggacucuucaaaaacu

SEQ ID NO: 949947 - RNA, 22 nt, Homo sapiens
gcauacuucuaaauuauaccau

SEQ ID NO: 949948 - RNA, 14 nt, Homo sapiens
gcauagacaagugu

SEQ ID NO: 949949 - RNA, 19 nt, Homo sapiens
gcaucauguagugcauuua

SEQ ID NO: 949950 - RNA, 13 nt, Homo sapiens
gcaugaagcacau

SEQ ID NO: 949951 - RNA, 21 nt, Homo sapiens
gcauucuuuuggcaguucuga

SEQ ID NO: 949952 - RNA, 18 nt, Homo sapiens
gcauuggcaagaucacag

SEQ ID NO: 949953 - RNA, 20 nt, Homo sapiens
gcauuuuacugucuguaaga

SEQ ID NO: 949954 - RNA, 20 nt, Homo sapiens
gcauuuuguggcugauuuca

SEQ ID NO: 949955 - RNA, 23 nt, Homo sapiens
gccaaccacuuucaccugggaug

SEQ ID NO: 949956 - RNA, 15 nt, Homo sapiens
gccaaggacacugau

SEQ ID NO: 949957 - RNA, 18 nt, Homo sapiens
gccacacguuugccaaau

SEQ ID NO: 949958 - RNA, 11 nt, Homo sapiens
gccacuuuccu

SEQ ID NO: 949959 - RNA, 17 nt, Homo sapiens
gccagauuccccaggaa

SEQ ID NO: 949960 - RNA, 16 nt, Homo sapiens
gccagccguaaugggg

SEQ ID NO: 949961 - RNA, 13 nt, Homo sapiens
gccagcguggcaa

SEQ ID NO: 949962 - RNA, 15 nt, Homo sapiens
gccaggagauggaau

SEQ ID NO: 949963 - RNA, 13 nt, Homo sapiens
gccauagaacaag

SEQ ID NO: 949964 - RNA, 20 nt, Homo sapiens
gcccaacagggcaaccaaua

SEQ ID NO: 949965 - RNA, 10 nt, Homo sapiens
gcccaaccuc

SEQ ID NO: 949966 - RNA, 20 nt, Homo sapiens
gcccaagugcaaaagaaaaa

SEQ ID NO: 949967 - RNA, 17 nt, Homo sapiens
gcccaauuucauaacua

SEQ ID NO: 949968 - RNA, 12 nt, Homo sapiens
gcccagaacggg

SEQ ID NO: 949969 - RNA, 19 nt, Homo sapiens
gcccagacauccugugaug

SEQ ID NO: 949970 - RNA, 20 nt, Homo sapiens
gcccagaggggcggggccag

SEQ ID NO: 949971 - RNA, 20 nt, Homo sapiens
gcccaggggagcguguuccu

SEQ ID NO: 949972 - RNA, 23 nt, Homo sapiens
gcccaugcccuccguccuggcag

SEQ ID NO: 949973 - RNA, 12 nt, Homo sapiens
gcccugcauuca

SEQ ID NO: 949974 - RNA, 16 nt, Homo sapiens
gcccuggccacuggcc

SEQ ID NO: 949975 - RNA, 22 nt, Homo sapiens
gcccuggggucucugagcagug

SEQ ID NO: 949976 - RNA, 18 nt, Homo sapiens
gccgacaucagcccggug

SEQ ID NO: 949977 - RNA, 12 nt, Homo sapiens
gccucacugcau

SEQ ID NO: 949978 - RNA, 20 nt, Homo sapiens
gccuccaagucaugggagaa

SEQ ID NO: 949979 - RNA, 19 nt, Homo sapiens
gccucccuuugugugcaua

SEQ ID NO: 949980 - RNA, 20 nt, Homo sapiens
gccuccugcugaguggucca

SEQ ID NO: 949981 - RNA, 19 nt, Homo sapiens
gccucucugguugccaaau

SEQ ID NO: 949982 - RNA, 19 nt, Homo sapiens
gccugcuagcggcugaaca

SEQ ID NO: 949983 - RNA, 20 nt, Homo sapiens
gccuguucccugaggaccug

SEQ ID NO: 949984 - RNA, 20 nt, Homo sapiens
gccuuacacaaaggggauca

SEQ ID NO: 949985 - RNA, 14 nt, Homo sapiens
gccuucucccucau

SEQ ID NO: 949986 - RNA, 13 nt, Homo sapiens
gccuuuacaugaa

SEQ ID NO: 949987 - RNA, 14 nt, Homo sapiens
gccuuugugcucug

SEQ ID NO: 949988 - RNA, 22 nt, Homo sapiens
gcgauucuccugccucagucuc

SEQ ID NO: 949989 - RNA, 23 nt, Homo sapiens
gcguauccuaugguaacugauga

SEQ ID NO: 949990 - RNA, 22 nt, Homo sapiens
gcuaauuauuuuagcacaaaga

SEQ ID NO: 949991 - RNA, 13 nt, Homo sapiens
gcuacaagggaag

SEQ ID NO: 949992 - RNA, 14 nt, Homo sapiens
gcuaccugcugagc

SEQ ID NO: 949993 - RNA, 20 nt, Homo sapiens
gcuacgguuccauguucacc

SEQ ID NO: 949994 - RNA, 16 nt, Homo sapiens
gcuacugccaaccucg

SEQ ID NO: 949995 - RNA, 14 nt, Homo sapiens
gcuagcuuuccaau

SEQ ID NO: 949996 - RNA, 17 nt, Homo sapiens
gcuaugccuccauuuca

SEQ ID NO: 949997 - RNA, 15 nt, Homo sapiens
ccaacuguaaugcag

SEQ ID NO: 949998 - RNA, 21 nt, Homo sapiens
ccaaguagcugggaccacaag

SEQ ID NO: 949999 - RNA, 21 nt, Homo sapiens
ccaaguguacauuugauuuga

SEQ ID NO: 950000 - RNA, 14 nt, Homo sapiens
ccaauuucauaacu

SEQ ID NO: 950001 - RNA, 16 nt, Homo sapiens
ccacaagugugcauua

SEQ ID NO: 950002 - RNA, 19 nt, Homo sapiens
ccacacagcacaugcacac

SEQ ID NO: 950003 - RNA, 16 nt, Homo sapiens
ccacacggucuucaca

SEQ ID NO: 950004 - RNA, 13 nt, Homo sapiens
ccacacucagcua

SEQ ID NO: 950005 - RNA, 14 nt, Homo sapiens
ccacgacauaagcu

SEQ ID NO: 950006 - RNA, 14 nt, Homo sapiens
ccacugagucucau

SEQ ID NO: 950007 - RNA, 15 nt, Homo sapiens
ccacugcgaccacaa

SEQ ID NO: 950008 - RNA, 19 nt, Homo sapiens
ccacuuaucaaaucauuca

SEQ ID NO: 950009 - RNA, 20 nt, Homo sapiens
ccacuuaucaaaucauucaa

SEQ ID NO: 950010 - RNA, 17 nt, Homo sapiens
ccacuuugguaaugugu

SEQ ID NO: 950011 - RNA, 17 nt, Homo sapiens
ccagaguggaaauucau

SEQ ID NO: 950012 - RNA, 12 nt, Homo sapiens
ccagauacauac

SEQ ID NO: 950013 - RNA, 14 nt, Homo sapiens
ccagaugacacaua

SEQ ID NO: 950014 - RNA, 12 nt, Homo sapiens
ccagcacuuugg

SEQ ID NO: 950015 - RNA, 16 nt, Homo sapiens
ccagcacuuugggagg

SEQ ID NO: 950016 - RNA, 18 nt, Homo sapiens
ccagcauaguucugcaau

SEQ ID NO: 950017 - RNA, 17 nt, Homo sapiens
ccagcguggcaacaggc

SEQ ID NO: 950018 - RNA, 18 nt, Homo sapiens
ccagcguggcaacaggcg

SEQ ID NO: 950019 - RNA, 23 nt, Homo sapiens
ccaggcuggucguaaacaucuca

SEQ ID NO: 950020 - RNA, 24 nt, Homo sapiens
ccagggcucuggcagguggccagg

SEQ ID NO: 950021 - RNA, 18 nt, Homo sapiens
ccagggugguggugcaca

SEQ ID NO: 950022 - RNA, 13 nt, Homo sapiens
ccaguaucuugaa

SEQ ID NO: 950023 - RNA, 15 nt, Homo sapiens
ccagugaacagugug

SEQ ID NO: 950024 - RNA, 20 nt, Homo sapiens
ccaguguccccaggggcaca

SEQ ID NO: 950025 - RNA, 21 nt, Homo sapiens
ccaucuguuugauacaguauu

SEQ ID NO: 950026 - RNA, 10 nt, Homo sapiens
ccaugcucuu

SEQ ID NO: 950027 - RNA, 22 nt, Homo sapiens
ccauggaagcuggcaggagaca

SEQ ID NO: 950028 - RNA, 12 nt, Homo sapiens
ccauucugggac

SEQ ID NO: 950029 - RNA, 13 nt, Homo sapiens
ccauugcauucau

SEQ ID NO: 950030 - RNA, 18 nt, Homo sapiens
ccauuucuuaccaugcau

SEQ ID NO: 950031 - RNA, 23 nt, Homo sapiens
cccaaacccauuuuagagacaga

SEQ ID NO: 950032 - RNA, 15 nt, Homo sapiens
cccaacaagugcucu

SEQ ID NO: 950033 - RNA, 22 nt, Homo sapiens
cccaaggaaaauggacauauuc

SEQ ID NO: 950034 - RNA, 20 nt, Homo sapiens
cccaauuuuaaaaaauaaca

SEQ ID NO: 950035 - RNA, 23 nt, Homo sapiens
cccaccucccgguguaugcagug

SEQ ID NO: 950036 - RNA, 16 nt, Homo sapiens
cccacggguguggcuc

SEQ ID NO: 950037 - RNA, 20 nt, Homo sapiens
cccacuuuuuguuguucauu

SEQ ID NO: 950038 - RNA, 16 nt, Homo sapiens
cccagacauccuguga

SEQ ID NO: 950039 - RNA, 16 nt, Homo sapiens
cccaggcuggucuuga

SEQ ID NO: 950040 - RNA, 21 nt, Homo sapiens
cccaggggaggcacaaagggc

SEQ ID NO: 950041 - RNA, 13 nt, Homo sapiens
cccagggugcagg

SEQ ID NO: 950042 - RNA, 14 nt, Homo sapiens
cccauuucuuacca

SEQ ID NO: 950043 - RNA, 17 nt, Homo sapiens
ccccaagauagagucaa

SEQ ID NO: 950044 - RNA, 15 nt, Homo sapiens
ccccacagauccauc

SEQ ID NO: 950045 - RNA, 19 nt, Homo sapiens
ccccauucuauaaauucaa

SEQ ID NO: 950046 - RNA, 14 nt, Homo sapiens
ccccauucugggac

SEQ ID NO: 950047 - RNA, 19 nt, Homo sapiens
ccccccaagauagagucaa

SEQ ID NO: 950048 - RNA, 19 nt, Homo sapiens
ccccgaggagcccgaaguc

SEQ ID NO: 950049 - RNA, 13 nt, Homo sapiens
cccuacugagaaa

SEQ ID NO: 950050 - RNA, 20 nt, Homo sapiens
cccucauuuaagaaaaauca

SEQ ID NO: 950051 - RNA, 13 nt, Homo sapiens
cccuccauguacc

SEQ ID NO: 950052 - RNA, 14 nt, Homo sapiens
cccucuccuuguca

SEQ ID NO: 950053 - RNA, 14 nt, Homo sapiens
cccugaagugccag

SEQ ID NO: 950054 - RNA, 17 nt, Homo sapiens
cccugacuucccagcug

SEQ ID NO: 950055 - RNA, 12 nt, Homo sapiens
cccugcauucac

SEQ ID NO: 950056 - RNA, 20 nt, Homo sapiens
cccuggaaucagaagcacua

SEQ ID NO: 950057 - RNA, 18 nt, Homo sapiens
cccuggggucucugagca

SEQ ID NO: 950058 - RNA, 15 nt, Homo sapiens
cccuucgcguauuuc

SEQ ID NO: 950059 - RNA, 21 nt, Homo sapiens
cucacgaggcuuggaccugcu

SEQ ID NO: 950060 - RNA, 14 nt, Homo sapiens
cucacuggcuuuag

SEQ ID NO: 950061 - RNA, 13 nt, Homo sapiens
cucacuguagcag

SEQ ID NO: 950062 - RNA, 11 nt, Homo sapiens
cucagcacugu

SEQ ID NO: 950063 - RNA, 21 nt, Homo sapiens
cucagcagccucacugcaucu

SEQ ID NO: 950064 - RNA, 18 nt, Homo sapiens
cucaguguccucaucuau

SEQ ID NO: 950065 - RNA, 20 nt, Homo sapiens
cucaucacugcuccugucac

SEQ ID NO: 950066 - RNA, 13 nt, Homo sapiens
cucaucuauccag

SEQ ID NO: 950067 - RNA, 18 nt, Homo sapiens
cucaugcauagacaagug

SEQ ID NO: 950068 - RNA, 12 nt, Homo sapiens
cucauucuugcc

SEQ ID NO: 950069 - RNA, 15 nt, Homo sapiens
cuccaaccuggaggc

SEQ ID NO: 950070 - RNA, 12 nt, Homo sapiens
cuccaacuccaa

SEQ ID NO: 950071 - RNA, 16 nt, Homo sapiens
cuccagaacaaaccuc

SEQ ID NO: 950072 - RNA, 14 nt, Homo sapiens
cuccagcuccugcc

SEQ ID NO: 950073 - RNA, 22 nt, Homo sapiens
cuccauguaccuuguguacuuu

SEQ ID NO: 950074 - RNA, 16 nt, Homo sapiens
cucccaagacugcucc

SEQ ID NO: 950075 - RNA, 15 nt, Homo sapiens
cuccuccacagucac

SEQ ID NO: 950076 - RNA, 16 nt, Homo sapiens
cuccuccccugcuacc

SEQ ID NO: 950077 - RNA, 16 nt, Homo sapiens
cuccugcgugugccca

SEQ ID NO: 950078 - RNA, 20 nt, Homo sapiens
cuccugcgugugcccacuga

SEQ ID NO: 950079 - RNA, 13 nt, Homo sapiens
cuccuugucacag

SEQ ID NO: 950080 - RNA, 13 nt, Homo sapiens
cucugaaaucagc

SEQ ID NO: 950081 - RNA, 14 nt, Homo sapiens
cucugagaacagac

SEQ ID NO: 950082 - RNA, 16 nt, Homo sapiens
cucugauauacaauua

SEQ ID NO: 950083 - RNA, 19 nt, Homo sapiens
cucugcaccggaccauuga

SEQ ID NO: 950084 - RNA, 18 nt, Homo sapiens
cucugccuuugugcucug

SEQ ID NO: 950085 - RNA, 22 nt, Homo sapiens
cucuucagaauauggacaaaga

SEQ ID NO: 950086 - RNA, 24 nt, Homo sapiens
cucuuccuccccaugucaccacaa

SEQ ID NO: 950087 - RNA, 16 nt, Homo sapiens
cucuuucacccugcca

SEQ ID NO: 950088 - RNA, 17 nt, Homo sapiens
cugaaaccucuguucuc

SEQ ID NO: 950089 - RNA, 22 nt, Homo sapiens
cugaaaccucuguucucaugaa

SEQ ID NO: 950090 - RNA, 18 nt, Homo sapiens
cugaaacuuaacgugauc

SEQ ID NO: 950091 - RNA, 21 nt, Homo sapiens
cugaacaggccgcacaucuca

SEQ ID NO: 950092 - RNA, 18 nt, Homo sapiens
cugaaccguuacaaaaga

SEQ ID NO: 950093 - RNA, 22 nt, Homo sapiens
cugaacugcgccaucaacucca

SEQ ID NO: 950094 - RNA, 16 nt, Homo sapiens
cugaagggacuagcua

SEQ ID NO: 950095 - RNA, 18 nt, Homo sapiens
cugaauagacaguccaua

SEQ ID NO: 950096 - RNA, 21 nt, Homo sapiens
cugacaccugccgcugcuuga

SEQ ID NO: 950097 - RNA, 12 nt, Homo sapiens
cugacucuccag

SEQ ID NO: 950098 - RNA, 22 nt, Homo sapiens
cugacugcugugggcugcucac

SEQ ID NO: 950099 - RNA, 23 nt, Homo sapiens
cugacugcugugggcugcucacu

SEQ ID NO: 950100 - RNA, 17 nt, Homo sapiens
cugagccgaucuggucu

SEQ ID NO: 950101 - RNA, 17 nt, Homo sapiens
cugagucaugucuuucc

SEQ ID NO: 950102 - RNA, 19 nt, Homo sapiens
cugagugagaagauaaaaa

SEQ ID NO: 950103 - RNA, 17 nt, Homo sapiens
cugaucaguugccaaag

SEQ ID NO: 950104 - RNA, 20 nt, Homo sapiens
cugaucucucgugauugaua

SEQ ID NO: 950105 - RNA, 16 nt, Homo sapiens
cugauggugcaaugac

SEQ ID NO: 950106 - RNA, 22 nt, Homo sapiens
cugauucaggagaucacugcuc

SEQ ID NO: 950107 - RNA, 19 nt, Homo sapiens
cugauuugcaaaugcacau

SEQ ID NO: 950108 - RNA, 17 nt, Homo sapiens
cugcaccggaccauuga

SEQ ID NO: 950109 - RNA, 16 nt, Homo sapiens
cugcaucaagauguga

SEQ ID NO: 950110 - RNA, 15 nt, Homo sapiens
cugccgcugccccca

SEQ ID NO: 950111 - RNA, 14 nt, Homo sapiens
cugccuuugugcuc

SEQ ID NO: 950112 - RNA, 21 nt, Homo sapiens
cugcgcuccucugcagccuga

SEQ ID NO: 950113 - RNA, 13 nt, Homo sapiens
cugcucacuggcu

SEQ ID NO: 950114 - RNA, 14 nt, Homo sapiens
cugcuccugucacc

SEQ ID NO: 950115 - RNA, 18 nt, Homo sapiens
cugcucgggaaggccuga

SEQ ID NO: 950116 - RNA, 21 nt, Homo sapiens
cugcugagccagauuccccag

SEQ ID NO: 950117 - RNA, 15 nt, Homo sapiens
cugcugcugcugcug

SEQ ID NO: 950118 - RNA, 14 nt, Homo sapiens
cugcugucauuuua

SEQ ID NO: 950119 - RNA, 20 nt, Homo sapiens
cugcugugggcugcucacug

SEQ ID NO: 950120 - RNA, 19 nt, Homo sapiens
cugcuuagauuucuagcag

SEQ ID NO: 950121 - RNA, 21 nt, Homo sapiens
cugcuuuguuuuggcugcucu

SEQ ID NO: 950122 - RNA, 18 nt, Homo sapiens
cuggaagcuguaugccac

SEQ ID NO: 950123 - RNA, 17 nt, Homo sapiens
cuggaaucagaagcacu

SEQ ID NO: 950124 - RNA, 15 nt, Homo sapiens
cuggauaagucacuu

SEQ ID NO: 950125 - RNA, 22 nt, Homo sapiens
cuggauagaaaaaugcuguuca

SEQ ID NO: 950126 - RNA, 15 nt, Homo sapiens
cuggcaaaucucugu

SEQ ID NO: 950127 - RNA, 20 nt, Homo sapiens
cuggcagaucguggacccuc

SEQ ID NO: 950128 - RNA, 17 nt, Homo sapiens
cuggcuuuacauggguu

SEQ ID NO: 950129 - RNA, 23 nt, Homo sapiens
cuggcuuuacauggguucaauug

SEQ ID NO: 950130 - RNA, 19 nt, Homo sapiens
cugggacucaguucuuggc

SEQ ID NO: 950131 - RNA, 16 nt, Homo sapiens
cugggccaguggaccc

SEQ ID NO: 950132 - RNA, 19 nt, Homo sapiens
cuggggcuuuugugccagg

SEQ ID NO: 950133 - RNA, 24 nt, Homo sapiens
cugguaaauuuuauaaugucauau

SEQ ID NO: 950134 - RNA, 20 nt, Homo sapiens
cuucuuaucacacuugcaaa

SEQ ID NO: 950135 - RNA, 18 nt, Homo sapiens
cuugaacucuuggccuca

SEQ ID NO: 950136 - RNA, 15 nt, Homo sapiens
cuugaagcugcucac

SEQ ID NO: 950137 - RNA, 12 nt, Homo sapiens
cuugaaggcauu

SEQ ID NO: 950138 - RNA, 13 nt, Homo sapiens
cuugauauaauua

SEQ ID NO: 950139 - RNA, 17 nt, Homo sapiens
cuugcaaaugaaugccu

SEQ ID NO: 950140 - RNA, 20 nt, Homo sapiens
cuugcauuaauaauuucaau

SEQ ID NO: 950141 - RNA, 14 nt, Homo sapiens
cuugccacuuucca

SEQ ID NO: 950142 - RNA, 20 nt, Homo sapiens
cuugccacuuuccagccugu

SEQ ID NO: 950143 - RNA, 22 nt, Homo sapiens
cuugccucugcucugugcacuc

SEQ ID NO: 950144 - RNA, 17 nt, Homo sapiens
cuugcugauuugcacac

SEQ ID NO: 950145 - RNA, 15 nt, Homo sapiens
cuuggaaucaugcaa

SEQ ID NO: 950146 - RNA, 17 nt, Homo sapiens
cuuggcuaacauagcac

SEQ ID NO: 950147 - RNA, 19 nt, Homo sapiens
cuugggcuauaaaagauuc

SEQ ID NO: 950148 - RNA, 13 nt, Homo sapiens
cuuggugagaugg

SEQ ID NO: 950149 - RNA, 16 nt, Homo sapiens
cuugucauucugcuaa

SEQ ID NO: 950150 - RNA, 19 nt, Homo sapiens
cuuguuuugaauugucaau

SEQ ID NO: 950151 - RNA, 17 nt, Homo sapiens
cuuuacagauaaccuaa

SEQ ID NO: 950152 - RNA, 14 nt, Homo sapiens
cuuuacagcacugu

SEQ ID NO: 950153 - RNA, 19 nt, Homo sapiens
cuuuagcugcugucuuccc

SEQ ID NO: 950154 - RNA, 14 nt, Homo sapiens
cuuucacacugugg

SEQ ID NO: 950155 - RNA, 15 nt, Homo sapiens
cuuucagaauacaau

SEQ ID NO: 950156 - RNA, 21 nt, Homo sapiens
cuuucaggggcugacucucca

SEQ ID NO: 950157 - RNA, 14 nt, Homo sapiens
cuuucauucaauuu

SEQ ID NO: 950158 - RNA, 16 nt, Homo sapiens
cuuuccuauuugcaca

SEQ ID NO: 950159 - RNA, 23 nt, Homo sapiens
cuuuccuguuucuaucuuucauu

SEQ ID NO: 950160 - RNA, 18 nt, Homo sapiens
cuuucuauuggcauggau

SEQ ID NO: 950161 - RNA, 13 nt, Homo sapiens
cuuucucacaugu

SEQ ID NO: 950162 - RNA, 17 nt, Homo sapiens
cuuucucuucccaugca

SEQ ID NO: 950163 - RNA, 17 nt, Homo sapiens
cuuugccauccuugcac

SEQ ID NO: 950164 - RNA, 12 nt, Homo sapiens
cuuugugcucug

SEQ ID NO: 950165 - RNA, 21 nt, Homo sapiens
cuuuuacaauaaaaaugcugc

SEQ ID NO: 950166 - RNA, 17 nt, Homo sapiens
cuuuucccugcauucac

SEQ ID NO: 950167 - RNA, 18 nt, Homo sapiens
cuuuucgccaaggcucac

SEQ ID NO: 950168 - RNA, 14 nt, Homo sapiens
cuuuuuccaaacaa

SEQ ID NO: 950169 - RNA, 17 nt, Homo sapiens
cuuuuuguuguucauua

SEQ ID NO: 950170 - RNA, 23 nt, Homo sapiens
cuuuuuuuuucaccugaaacacu

SEQ ID NO: 950171 - RNA, 16 nt, Homo sapiens
gaaaaaauaacacugu

SEQ ID NO: 950172 - RNA, 14 nt, Homo sapiens
gaaaauacauugug

SEQ ID NO: 950173 - RNA, 20 nt, Homo sapiens
gaaaauaguccuccaaaaca

SEQ ID NO: 950174 - RNA, 21 nt, Homo sapiens
gaaaauuuccuccacauucau

SEQ ID NO: 950175 - RNA, 17 nt, Homo sapiens
gaaacaaaacuggauag

SEQ ID NO: 950176 - RNA, 21 nt, Homo sapiens
gaaacagaggaccagcacacu

SEQ ID NO: 950177 - RNA, 20 nt, Homo sapiens
gaaacauugcuuuagacaaa

SEQ ID NO: 950178 - RNA, 15 nt, Homo sapiens
gaaaccagugacuca

SEQ ID NO: 950179 - RNA, 23 nt, Homo sapiens
gaaagaggagcgugucucugaac

SEQ ID NO: 950180 - RNA, 19 nt, Homo sapiens
gaaaggacugugugaccuc

SEQ ID NO: 950181 - RNA, 16 nt, Homo sapiens
gaaaggucaccucacu

SEQ ID NO: 950182 - RNA, 14 nt, Homo sapiens
gaaaggucaucuca

SEQ ID NO: 950183 - RNA, 21 nt, Homo sapiens
gaaaucaugccuaguuauuca

SEQ ID NO: 950184 - RNA, 17 nt, Homo sapiens
gaaauuuucuacaguac

SEQ ID NO: 950185 - RNA, 17 nt, Homo sapiens
gaacauguaugauuucu

SEQ ID NO: 950186 - RNA, 17 nt, Homo sapiens
gaaccacauggaacuua

SEQ ID NO: 950187 - RNA, 18 nt, Homo sapiens
gaaccucaaacuggguau

SEQ ID NO: 950188 - RNA, 15 nt, Homo sapiens
gaacuccagagucag

SEQ ID NO: 950189 - RNA, 13 nt, Homo sapiens
gaacugucccaca

SEQ ID NO: 950190 - RNA, 24 nt, Homo sapiens
gaacuuauaacaggaauaagcaaa

SEQ ID NO: 950191 - RNA, 15 nt, Homo sapiens
gaagacuucuaugga

SEQ ID NO: 950192 - RNA, 22 nt, Homo sapiens
gaagagccagccguaaugggga

SEQ ID NO: 950193 - RNA, 17 nt, Homo sapiens
gaagauuauaaaagcca

SEQ ID NO: 950194 - RNA, 14 nt, Homo sapiens
gaagcccacccgcc

SEQ ID NO: 950195 - RNA, 19 nt, Homo sapiens
gaaggagcagucacuggga

SEQ ID NO: 950196 - RNA, 13 nt, Homo sapiens
gaagggcgcagga

SEQ ID NO: 950197 - RNA, 12 nt, Homo sapiens
gaaggugcccaa

SEQ ID NO: 950198 - RNA, 13 nt, Homo sapiens
gaagguugccagg

SEQ ID NO: 950199 - RNA, 22 nt, Homo sapiens
gaagucuucauggucucuucca

SEQ ID NO: 950200 - RNA, 23 nt, Homo sapiens
gaagucuucauggucucuuccag

SEQ ID NO: 950201 - RNA, 17 nt, Homo sapiens
gaaguuaucaacaugca

SEQ ID NO: 950202 - RNA, 19 nt, Homo sapiens
gaaguuaucaacaugcaca

SEQ ID NO: 950203 - RNA, 23 nt, Homo sapiens
gaauaagcaaaauucauaccuga

SEQ ID NO: 950204 - RNA, 15 nt, Homo sapiens
gaauauuauacuucu

SEQ ID NO: 950205 - RNA, 19 nt, Homo sapiens
gaauccaauuaaugauuca

SEQ ID NO: 950206 - RNA, 21 nt, Homo sapiens
gaaucucaauaaaccagugaa

SEQ ID NO: 950207 - RNA, 20 nt, Homo sapiens
gaaugcagcaguaaauccaa

SEQ ID NO: 950208 - RNA, 15 nt, Homo sapiens
gaaugcuggcaaagg

SEQ ID NO: 950209 - RNA, 19 nt, Homo sapiens
gaauguuaacaugcgcauu

SEQ ID NO: 950210 - RNA, 17 nt, Homo sapiens
gaauuauuacacuguaa

SEQ ID NO: 950211 - RNA, 18 nt, Homo sapiens
gaauugaggaugucccug

SEQ ID NO: 950212 - RNA, 15 nt, Homo sapiens
agcuuuccaaugugu

SEQ ID NO: 950213 - RNA, 21 nt, Homo sapiens
agcuuuguuuuuggcauuucg

SEQ ID NO: 950214 - RNA, 20 nt, Homo sapiens
aggaaaacgugaacaaacuu

SEQ ID NO: 950215 - RNA, 17 nt, Homo sapiens
aggaaauaagacuuuua

SEQ ID NO: 950216 - RNA, 12 nt, Homo sapiens
aggaaauuugca

SEQ ID NO: 950217 - RNA, 15 nt, Homo sapiens
aggacacugaugggu

SEQ ID NO: 950218 - RNA, 21 nt, Homo sapiens
aggagaaucgcuugaacccag

SEQ ID NO: 950219 - RNA, 13 nt, Homo sapiens
aggagacuuuaug

SEQ ID NO: 950220 - RNA, 18 nt, Homo sapiens
aggagauggaauaucaau

SEQ ID NO: 950221 - RNA, 15 nt, Homo sapiens
aggagccugggauga

SEQ ID NO: 950222 - RNA, 15 nt, Homo sapiens
aggagugaugggcaa

SEQ ID NO: 950223 - RNA, 17 nt, Homo sapiens
aggagugggucgcccac

SEQ ID NO: 950224 - RNA, 21 nt, Homo sapiens
aggaucuuuguuccucugagc

SEQ ID NO: 950225 - RNA, 21 nt, Homo sapiens
aggauggcguguccccugccu

SEQ ID NO: 950226 - RNA, 17 nt, Homo sapiens
aggauguauaaaauggu

SEQ ID NO: 950227 - RNA, 24 nt, Homo sapiens
aggauucuaccugaacugaaagga

SEQ ID NO: 950228 - RNA, 23 nt, Homo sapiens
aggauuuggguuuggaaauggag

SEQ ID NO: 950229 - RNA, 14 nt, Homo sapiens
aggcacaaagggca

SEQ ID NO: 950230 - RNA, 13 nt, Homo sapiens
aggcagagcucag

SEQ ID NO: 950231 - RNA, 16 nt, Homo sapiens
aggcagggucucacuc

SEQ ID NO: 950232 - RNA, 12 nt, Homo sapiens
aggcaguggcuu

SEQ ID NO: 950233 - RNA, 20 nt, Homo sapiens
aggccacacagcacaugcac

SEQ ID NO: 950234 - RNA, 19 nt, Homo sapiens
aggccccaguuauugugaa

SEQ ID NO: 950235 - RNA, 21 nt, Homo sapiens
aggccgcacaucucacuucag

SEQ ID NO: 950236 - RNA, 19 nt, Homo sapiens
aggccugaaauguuuccag

SEQ ID NO: 950237 - RNA, 21 nt, Homo sapiens
aggccuucagaaaagacacuu

SEQ ID NO: 950238 - RNA, 23 nt, Homo sapiens
aggccuuugcuuuacagcacugu

SEQ ID NO: 950239 - RNA, 16 nt, Homo sapiens
aggcguacacaugcac

SEQ ID NO: 950240 - RNA, 15 nt, Homo sapiens
aggcguagggccagg

SEQ ID NO: 950241 - RNA, 12 nt, Homo sapiens
aggcugcugcug

SEQ ID NO: 950242 - RNA, 21 nt, Homo sapiens
aggcugcuuagauuucuagca

SEQ ID NO: 950243 - RNA, 18 nt, Homo sapiens
agggaaauucacacugug

SEQ ID NO: 950244 - RNA, 20 nt, Homo sapiens
agggaauccauaucagcucu

SEQ ID NO: 950245 - RNA, 24 nt, Homo sapiens
agggacuucccuagaagucuucau

SEQ ID NO: 950246 - RNA, 17 nt, Homo sapiens
agggagacccugggaga

SEQ ID NO: 950247 - RNA, 13 nt, Homo sapiens
agggcaaccaaua

SEQ ID NO: 950248 - RNA, 21 nt, Homo sapiens
agggcaaccaauaaaaguguc

SEQ ID NO: 950249 - RNA, 23 nt, Homo sapiens
agggcaaccaauaaaagugucac

SEQ ID NO: 950250 - RNA, 19 nt, Homo sapiens
agggccaguugguguuccu

SEQ ID NO: 950251 - RNA, 21 nt, Homo sapiens
agggcuaugccuccauuucag

SEQ ID NO: 950252 - RNA, 15 nt, Homo sapiens
aggggcaacugauga

SEQ ID NO: 950253 - RNA, 16 nt, Homo sapiens
aggggcauuaguuuca

SEQ ID NO: 950254 - RNA, 18 nt, Homo sapiens
agggggcaugaagcacau

SEQ ID NO: 950255 - RNA, 22 nt, Homo sapiens
agggucucacuguguugcccag

SEQ ID NO: 950256 - RNA, 12 nt, Homo sapiens
agguaacuucuc

SEQ ID NO: 950257 - RNA, 14 nt, Homo sapiens
agguaauuucuucc

SEQ ID NO: 950258 - RNA, 22 nt, Homo sapiens
agguagcuuguccaaggucuca

SEQ ID NO: 950259 - RNA, 20 nt, Homo sapiens
agguccuucuguagugccau

SEQ ID NO: 950260 - RNA, 22 nt, Homo sapiens
aggugauauauaaucauaucca

SEQ ID NO: 950261 - RNA, 18 nt, Homo sapiens
aggugaugguaacugcac

SEQ ID NO: 950262 - RNA, 11 nt, Homo sapiens
aggugcacaga

SEQ ID NO: 950263 - RNA, 18 nt, Homo sapiens
aggugcauuguccuuuuc

SEQ ID NO: 950264 - RNA, 21 nt, Homo sapiens
agguggggagggccucuggac

SEQ ID NO: 950265 - RNA, 18 nt, Homo sapiens
aggugguccuuccaccuc

SEQ ID NO: 950266 - RNA, 20 nt, Homo sapiens
aggugguccuuccaccucag

SEQ ID NO: 950267 - RNA, 20 nt, Homo sapiens
aggugugaccccaccugcuc

SEQ ID NO: 950268 - RNA, 13 nt, Homo sapiens
aggugugccaaac

SEQ ID NO: 950269 - RNA, 16 nt, Homo sapiens
aggugugccaaacuac

SEQ ID NO: 950270 - RNA, 16 nt, Homo sapiens
agguguugucaaguga

SEQ ID NO: 950271 - RNA, 14 nt, Homo sapiens
agguuaugagaaaa

SEQ ID NO: 950272 - RNA, 14 nt, Homo sapiens
agguuaugccaaaa

SEQ ID NO: 950273 - RNA, 16 nt, Homo sapiens
agguuaugccaaaaug

SEQ ID NO: 950274 - RNA, 12 nt, Homo sapiens
agguugagccaa

SEQ ID NO: 950275 - RNA, 15 nt, Homo sapiens
agguuuccacguaag

SEQ ID NO: 950276 - RNA, 21 nt, Homo sapiens
agguuuuccugaagaauugaa

SEQ ID NO: 950277 - RNA, 15 nt, Homo sapiens
agguuuucuccccca

SEQ ID NO: 950278 - RNA, 19 nt, Homo sapiens
aguaacccugucuaaugaa

SEQ ID NO: 950279 - RNA, 20 nt, Homo sapiens
aguaauucccaucugcuuua

SEQ ID NO: 950280 - RNA, 15 nt, Homo sapiens
aguagagcauaccac

SEQ ID NO: 950281 - RNA, 16 nt, Homo sapiens
aguaggcuaaaaacau

SEQ ID NO: 950282 - RNA, 23 nt, Homo sapiens
aguauaacuuuacagauaaccua

SEQ ID NO: 950283 - RNA, 13 nt, Homo sapiens
aguauauaaccuc

SEQ ID NO: 950284 - RNA, 14 nt, Homo sapiens
aguauauaaccuca

SEQ ID NO: 950285 - RNA, 17 nt, Homo sapiens
aguaucucuacuuuccu

SEQ ID NO: 950286 - RNA, 15 nt, Homo sapiens
aguaugaagacacug

SEQ ID NO: 950287 - RNA, 17 nt, Homo sapiens
aguaugaagacacuguc

SEQ ID NO: 950288 - RNA, 18 nt, Homo sapiens
aguauggccccaccugcu

SEQ ID NO: 950289 - RNA, 20 nt, Homo sapiens
aguauguuggugggaaucaa

SEQ ID NO: 950290 - RNA, 14 nt, Homo sapiens
agucaaagcuuugc

SEQ ID NO: 950291 - RNA, 15 nt, Homo sapiens
agucacaugugcucu

SEQ ID NO: 950292 - RNA, 14 nt, Homo sapiens
agucaucaucucau

SEQ ID NO: 950293 - RNA, 21 nt, Homo sapiens
agucauguuucugcaguauuc

SEQ ID NO: 950294 - RNA, 21 nt, Homo sapiens
aguccagaguacaaauccaag

SEQ ID NO: 950295 - RNA, 13 nt, Homo sapiens
aguccagugagaa

SEQ ID NO: 950296 - RNA, 15 nt, Homo sapiens
agucucuugauucau

SEQ ID NO: 950297 - RNA, 12 nt, Homo sapiens
agucugcugcug

SEQ ID NO: 950298 - RNA, 20 nt, Homo sapiens
agucuguacuucaguucuca

SEQ ID NO: 950299 - RNA, 17 nt, Homo sapiens
agugaaaggucaucuca

SEQ ID NO: 950300 - RNA, 19 nt, Homo sapiens
agugaauccugaaacuggu

SEQ ID NO: 950301 - RNA, 21 nt, Homo sapiens
agugaccaggcucacaacugu

SEQ ID NO: 950302 - RNA, 14 nt, Homo sapiens
agugagauacaaag

SEQ ID NO: 950303 - RNA, 15 nt, Homo sapiens
agugagcaucaugga

SEQ ID NO: 950304 - RNA, 10 nt, Homo sapiens
agugcacaga

SEQ ID NO: 950305 - RNA, 18 nt, Homo sapiens
agugccaaaaacaacaac

SEQ ID NO: 950306 - RNA, 15 nt, Homo sapiens
agugccaugguagaa

SEQ ID NO: 950307 - RNA, 14 nt, Homo sapiens
agugcucuuuccac

SEQ ID NO: 950308 - RNA, 13 nt, Homo sapiens
aguggacagcagc

SEQ ID NO: 950309 - RNA, 17 nt, Homo sapiens
aguggcaugguccugug

SEQ ID NO: 950310 - RNA, 19 nt, Homo sapiens
agugggugggacacagaga

SEQ ID NO: 950311 - RNA, 20 nt, Homo sapiens
agugguguuuagaaugucag

SEQ ID NO: 950312 - RNA, 21 nt, Homo sapiens
agugguguuuagaaugucagu

SEQ ID NO: 950313 - RNA, 20 nt, Homo sapiens
agugucaccagcugccaaaa

SEQ ID NO: 950314 - RNA, 21 nt, Homo sapiens
agugugcauuaccacacucag

SEQ ID NO: 950315 - RNA, 17 nt, Homo sapiens
aguguggcgggaagggu

SEQ ID NO: 950316 - RNA, 15 nt, Homo sapiens
aguuaaugugccaaa

SEQ ID NO: 950317 - RNA, 14 nt, Homo sapiens
aguuaauucuugcc

SEQ ID NO: 950318 - RNA, 17 nt, Homo sapiens
aguuaggugugccaaac

SEQ ID NO: 950319 - RNA, 20 nt, Homo sapiens
augguaaagagaugucaaaa

SEQ ID NO: 950320 - RNA, 14 nt, Homo sapiens
augguaacugcaca

SEQ ID NO: 950321 - RNA, 15 nt, Homo sapiens
augguaucuguuacu

SEQ ID NO: 950322 - RNA, 21 nt, Homo sapiens
augguuuccaagggucuuccu

SEQ ID NO: 950323 - RNA, 13 nt, Homo sapiens
auguaaagucauc

SEQ ID NO: 950324 - RNA, 18 nt, Homo sapiens
auguaaagucaucaucaa

SEQ ID NO: 950325 - RNA, 15 nt, Homo sapiens
auguaaauauuucaa

SEQ ID NO: 950326 - RNA, 15 nt, Homo sapiens
auguaagggcuuuaa

SEQ ID NO: 950327 - RNA, 16 nt, Homo sapiens
auguacacgugcacag

SEQ ID NO: 950328 - RNA, 17 nt, Homo sapiens
auguacacgugcacaga

SEQ ID NO: 950329 - RNA, 20 nt, Homo sapiens
auguaccuuguguacuuucu

SEQ ID NO: 950330 - RNA, 15 nt, Homo sapiens
auguagccagcagaa

SEQ ID NO: 950331 - RNA, 14 nt, Homo sapiens
auguauuuuucaca

SEQ ID NO: 950332 - RNA, 15 nt, Homo sapiens
auguauuuuucacaa

SEQ ID NO: 950333 - RNA, 21 nt, Homo sapiens
augucaaaaauauuuuuaugu

SEQ ID NO: 950334 - RNA, 12 nt, Homo sapiens
augucacugcuu

SEQ ID NO: 950335 - RNA, 15 nt, Homo sapiens
augucagucugucca

SEQ ID NO: 950336 - RNA, 18 nt, Homo sapiens
augucccugaagugccag

SEQ ID NO: 950337 - RNA, 19 nt, Homo sapiens
augucuaaaguuagggcau

SEQ ID NO: 950338 - RNA, 19 nt, Homo sapiens
augucuuuccuauuugcac

SEQ ID NO: 950339 - RNA, 19 nt, Homo sapiens
augugacacugcagcagaa

SEQ ID NO: 950340 - RNA, 23 nt, Homo sapiens
augugguuauuuucuccaugucu

SEQ ID NO: 950341 - RNA, 13 nt, Homo sapiens
ucaacauaugaau

SEQ ID NO: 950342 - RNA, 21 nt, Homo sapiens
ucaacauucccccaacauuac

SEQ ID NO: 950343 - RNA, 16 nt, Homo sapiens
ucaagcuuccugugau

SEQ ID NO: 950344 - RNA, 18 nt, Homo sapiens
ucaagcuuccugugaugg

SEQ ID NO: 950345 - RNA, 18 nt, Homo sapiens
ucaauaaauaugguuuga

SEQ ID NO: 950346 - RNA, 12 nt, Homo sapiens
ucaauucauuaa

SEQ ID NO: 950347 - RNA, 13 nt, Homo sapiens
ucaauuuaaagga

SEQ ID NO: 950348 - RNA, 20 nt, Homo sapiens
ucaauuuuuaacuuaucucc

SEQ ID NO: 950349 - RNA, 18 nt, Homo sapiens
ucacauagguguugucaa

SEQ ID NO: 950350 - RNA, 12 nt, Homo sapiens
ucacaugaugaa

SEQ ID NO: 950351 - RNA, 20 nt, Homo sapiens
ucacccaggcuggagugcag

SEQ ID NO: 950352 - RNA, 18 nt, Homo sapiens
ucaccuagcugcucucua

SEQ ID NO: 950353 - RNA, 21 nt, Homo sapiens
ucacgaggcuuggaccugcug

SEQ ID NO: 950354 - RNA, 20 nt, Homo sapiens
ucacgcucagcacacaugca

SEQ ID NO: 950355 - RNA, 15 nt, Homo sapiens
ucacuacaguuucaa

SEQ ID NO: 950356 - RNA, 14 nt, Homo sapiens
ucacuaguaugugu

SEQ ID NO: 950357 - RNA, 18 nt, Homo sapiens
aauuaaaaccaucuggca

SEQ ID NO: 950358 - RNA, 21 nt, Homo sapiens
aauuaaaccaaggagucugau

SEQ ID NO: 950359 - RNA, 14 nt, Homo sapiens
aauuaaccuuucag

SEQ ID NO: 950360 - RNA, 15 nt, Homo sapiens
aauuacauuaugccc

SEQ ID NO: 950361 - RNA, 12 nt, Homo sapiens
aauuacuuucag

SEQ ID NO: 950362 - RNA, 15 nt, Homo sapiens
aauuauaccaugaga

SEQ ID NO: 950363 - RNA, 14 nt, Homo sapiens
aauuauuacacugu

SEQ ID NO: 950364 - RNA, 18 nt, Homo sapiens
aauucauaucauuuggcc

SEQ ID NO: 950365 - RNA, 12 nt, Homo sapiens
aauucuguuaca

SEQ ID NO: 950366 - RNA, 21 nt, Homo sapiens
aauugggggaggacacauuug

SEQ ID NO: 950367 - RNA, 23 nt, Homo sapiens
aauugggguuguauuuggccauu

SEQ ID NO: 950368 - RNA, 15 nt, Homo sapiens
aauuuaaaaagccca

SEQ ID NO: 950369 - RNA, 19 nt, Homo sapiens
aauuuauuuauguucucaa

SEQ ID NO: 950370 - RNA, 20 nt, Homo sapiens
aauuugccauagcagugcua

SEQ ID NO: 950371 - RNA, 19 nt, Homo sapiens
aauuugcgacugcucugau

SEQ ID NO: 950372 - RNA, 21 nt, Homo sapiens
aauuuuguaguaguugaugac

SEQ ID NO: 950373 - RNA, 23 nt, Homo sapiens
acaaaaggcuggaugugcuuuca

SEQ ID NO: 950374 - RNA, 19 nt, Homo sapiens
acaaaauuuaauuguguaa

SEQ ID NO: 950375 - RNA, 23 nt, Homo sapiens
acaaauuguuaagaguaucaugu

SEQ ID NO: 950376 - RNA, 21 nt, Homo sapiens
acaacaaaccuguuucugcag

SEQ ID NO: 950377 - RNA, 17 nt, Homo sapiens
acaacaaagugcuuccu

SEQ ID NO: 950378 - RNA, 11 nt, Homo sapiens
acaacugccaa

SEQ ID NO: 950379 - RNA, 14 nt, Homo sapiens
acaacuuguuuucc

SEQ ID NO: 950380 - RNA, 14 nt, Homo sapiens
acaagcaucaugga

SEQ ID NO: 950381 - RNA, 12 nt, Homo sapiens
acaagugcacag

SEQ ID NO: 950382 - RNA, 16 nt, Homo sapiens
acaagugcucuuucca

SEQ ID NO: 950383 - RNA, 18 nt, Homo sapiens
acaauauuuauguccuau

SEQ ID NO: 950384 - RNA, 19 nt, Homo sapiens
acaaugauguaaauauuuc

SEQ ID NO: 950385 - RNA, 14 nt, Homo sapiens
acaauuuucauccc

SEQ ID NO: 950386 - RNA, 14 nt, Homo sapiens
acacaagugcacag

SEQ ID NO: 950387 - RNA, 20 nt, Homo sapiens
acacacgcgugcaugcacac

SEQ ID NO: 950388 - RNA, 17 nt, Homo sapiens
acacagcacaugcacac

SEQ ID NO: 950389 - RNA, 18 nt, Homo sapiens
acacaggcccaugcccuc

SEQ ID NO: 950390 - RNA, 15 nt, Homo sapiens
acaccuguaauccca

SEQ ID NO: 950391 - RNA, 15 nt, Homo sapiens
acaccuuucagucuc

SEQ ID NO: 950392 - RNA, 16 nt, Homo sapiens
acacgccuggcuucca

SEQ ID NO: 950393 - RNA, 17 nt, Homo sapiens
acacuacaaauguuaaa

SEQ ID NO: 950394 - RNA, 16 nt, Homo sapiens
acacuaguagagcaaa

SEQ ID NO: 950395 - RNA, 19 nt, Homo sapiens
acacuagucagaaaauugg

SEQ ID NO: 950396 - RNA, 18 nt, Homo sapiens
acacuugcaaaugaaugc

SEQ ID NO: 950397 - RNA, 19 nt, Homo sapiens
acagaaacgagauuugcca

SEQ ID NO: 950398 - RNA, 23 nt, Homo sapiens
acagaagaaacuacccucuggag

SEQ ID NO: 950399 - RNA, 23 nt, Homo sapiens
acagaagaaguuaucaacaugca

SEQ ID NO: 950400 - RNA, 17 nt, Homo sapiens
acagaaggguaaugcgu

SEQ ID NO: 950401 - RNA, 16 nt, Homo sapiens
acagaagguugccagg

SEQ ID NO: 950402 - RNA, 14 nt, Homo sapiens
acagaccagcauag

SEQ ID NO: 950403 - RNA, 13 nt, Homo sapiens
acagauccauccu

SEQ ID NO: 950404 - RNA, 18 nt, Homo sapiens
acagaugauccauuugaa

SEQ ID NO: 950405 - RNA, 16 nt, Homo sapiens
acagcaaauaaaacag

SEQ ID NO: 950406 - RNA, 15 nt, Homo sapiens
acagcacaugcacac

SEQ ID NO: 950407 - RNA, 20 nt, Homo sapiens
acagcacuaacacaugcaca

SEQ ID NO: 950408 - RNA, 22 nt, Homo sapiens
acagcggcccggcccacgcaga

SEQ ID NO: 950409 - RNA, 16 nt, Homo sapiens
acaggcaacauuacaa

SEQ ID NO: 950410 - RNA, 17 nt, Homo sapiens
acaggcaacauuacaaa

SEQ ID NO: 950411 - RNA, 14 nt, Homo sapiens
acaggcauacacau

SEQ ID NO: 950412 - RNA, 17 nt, Homo sapiens
acaggccgcacaucuca

SEQ ID NO: 950413 - RNA, 15 nt, Homo sapiens
acagggcaaccaaua

SEQ ID NO: 950414 - RNA, 19 nt, Homo sapiens
acagucauaauguguugug

SEQ ID NO: 950415 - RNA, 13 nt, Homo sapiens
acagugaaagccc

SEQ ID NO: 950416 - RNA, 18 nt, Homo sapiens
acaguuauacauaccucu

SEQ ID NO: 950417 - RNA, 16 nt, Homo sapiens
acauaaacuuguacuu

SEQ ID NO: 950418 - RNA, 17 nt, Homo sapiens
acauaaagaaacacuuu

SEQ ID NO: 950419 - RNA, 23 nt, Homo sapiens
acauaagccacaggccccaguua

SEQ ID NO: 950420 - RNA, 18 nt, Homo sapiens
acauacacaagugcacag

SEQ ID NO: 950421 - RNA, 15 nt, Homo sapiens
acauacaucuaaguc

SEQ ID NO: 950422 - RNA, 17 nt, Homo sapiens
acauaccuugcuucuuc

SEQ ID NO: 950423 - RNA, 18 nt, Homo sapiens
acauauaucuuauccaau

SEQ ID NO: 950424 - RNA, 19 nt, Homo sapiens
acauauuacaacacuuuaa

SEQ ID NO: 950425 - RNA, 13 nt, Homo sapiens
acaucucacuuca

SEQ ID NO: 950426 - RNA, 19 nt, Homo sapiens
acaucuguauaucagcucu

SEQ ID NO: 950427 - RNA, 18 nt, Homo sapiens
acaugacccggaugaacu

SEQ ID NO: 950428 - RNA, 18 nt, Homo sapiens
acaugagaagaagcacga

SEQ ID NO: 950429 - RNA, 20 nt, Homo sapiens
acaugcacacaggugcacag

SEQ ID NO: 950430 - RNA, 18 nt, Homo sapiens
acaugcacgcuugcacac

SEQ ID NO: 950431 - RNA, 22 nt, Homo sapiens
acaugccccccagauugcugca

SEQ ID NO: 950432 - RNA, 18 nt, Homo sapiens
acaugcuauccaaucuca

SEQ ID NO: 950433 - RNA, 18 nt, Homo sapiens
acaugcucauguguacac

SEQ ID NO: 950434 - RNA, 17 nt, Homo sapiens
acauggcaacaaaggau

SEQ ID NO: 950435 - RNA, 16 nt, Homo sapiens
acauucaaaccaaaua

SEQ ID NO: 950436 - RNA, 17 nt, Homo sapiens
acauuggccgcuucaga

SEQ ID NO: 950437 - RNA, 13 nt, Homo sapiens
acauuuaacgaca

SEQ ID NO: 950438 - RNA, 19 nt, Homo sapiens
acauuuaguuaacacacau

SEQ ID NO: 950439 - RNA, 16 nt, Homo sapiens
accaaaugacaaguca

SEQ ID NO: 950440 - RNA, 14 nt, Homo sapiens
accaagcugugacc

SEQ ID NO: 950441 - RNA, 17 nt, Homo sapiens
aaaaacacuggauucau

SEQ ID NO: 950442 - RNA, 15 nt, Homo sapiens
aaaaaguugcacauu

SEQ ID NO: 950443 - RNA, 19 nt, Homo sapiens
aaaaauauaauuaccugua

SEQ ID NO: 950444 - RNA, 13 nt, Homo sapiens
aaaaaucuagaca

SEQ ID NO: 950445 - RNA, 16 nt, Homo sapiens
aaaaaugaaugacuca

SEQ ID NO: 950446 - RNA, 14 nt, Homo sapiens
aaaaaugugagcua

SEQ ID NO: 950447 - RNA, 21 nt, Homo sapiens
aaaacaauguccuuacuugua

SEQ ID NO: 950448 - RNA, 17 nt, Homo sapiens
aaaacauuuuaaaauca

SEQ ID NO: 950449 - RNA, 18 nt, Homo sapiens
aaaagauuccugaaugua

SEQ ID NO: 950450 - RNA, 19 nt, Homo sapiens
aaaaguaagagagcacagu

SEQ ID NO: 950451 - RNA, 17 nt, Homo sapiens
aaaauaaaauggacaga

SEQ ID NO: 950452 - RNA, 21 nt, Homo sapiens
aaaauaguuuuacauuaacau

SEQ ID NO: 950453 - RNA, 22 nt, Homo sapiens
aaaauauucaucuguugacaau

SEQ ID NO: 950454 - RNA, 23 nt, Homo sapiens
aaaaucaguuuaggacuauuaaa

SEQ ID NO: 950455 - RNA, 14 nt, Homo sapiens
aaaaucauaacuca

SEQ ID NO: 950456 - RNA, 22 nt, Homo sapiens
aaaauccaagcugcucauuuca

SEQ ID NO: 950457 - RNA, 23 nt, Homo sapiens
aaaaucuuucagaauacaauuca

SEQ ID NO: 950458 - RNA, 15 nt, Homo sapiens
aaaaugaaugacuca

SEQ ID NO: 950459 - RNA, 16 nt, Homo sapiens
aaaaugaguuaccuca

SEQ ID NO: 950460 - RNA, 14 nt, Homo sapiens
aaaauggacauauu

SEQ ID NO: 950461 - RNA, 21 nt, Homo sapiens
aaaauggacguguuaugacuc

SEQ ID NO: 950462 - RNA, 18 nt, Homo sapiens
aaaaugguuuacuuaaca

SEQ ID NO: 950463 - RNA, 18 nt, Homo sapiens
aaaauguauuuuucacaa

SEQ ID NO: 950464 - RNA, 22 nt, Homo sapiens
aaaauuagagcaagaacauuca

SEQ ID NO: 950465 - RNA, 18 nt, Homo sapiens
aaacagaagaaguuauca

SEQ ID NO: 950466 - RNA, 21 nt, Homo sapiens
aaacaugaugaguugagcucu

SEQ ID NO: 950467 - RNA, 15 nt, Homo sapiens
aaacauuauugucaa

SEQ ID NO: 950468 - RNA, 15 nt, Homo sapiens
aaaccugugcuuuca

SEQ ID NO: 950469 - RNA, 14 nt, Homo sapiens
aaaccuuacuuaaa

SEQ ID NO: 950470 - RNA, 19 nt, Homo sapiens
aaacuacccucuggagaua

SEQ ID NO: 950471 - RNA, 16 nt, Homo sapiens
aaacuccugaguucaa

SEQ ID NO: 950472 - RNA, 20 nt, Homo sapiens
aaacugauuucccauuuuaa

SEQ ID NO: 950473 - RNA, 21 nt, Homo sapiens
aaacuguacccuauguucacu

SEQ ID NO: 950474 - RNA, 23 nt, Homo sapiens
aaacugucuuuuuccucaaugaa

SEQ ID NO: 950475 - RNA, 15 nt, Homo sapiens
aaacuuguacuuaca

SEQ ID NO: 950476 - RNA, 19 nt, Homo sapiens
aaacuuguacuuacacuga

SEQ ID NO: 950477 - RNA, 18 nt, Homo sapiens
aaagaaauauuaauaugu

SEQ ID NO: 950478 - RNA, 13 nt, Homo sapiens
aaagaacuuuagc

SEQ ID NO: 950479 - RNA, 21 nt, Homo sapiens
aaagagcccaaaugaccaaau

SEQ ID NO: 950480 - RNA, 22 nt, Homo sapiens
aaagauauggaguuauguggau

SEQ ID NO: 950481 - RNA, 22 nt, Homo sapiens
aaggucucauuaucuccaugau

SEQ ID NO: 950482 - RNA, 19 nt, Homo sapiens
aaguaauuguaugugcuug

SEQ ID NO: 950483 - RNA, 14 nt, Homo sapiens
aaguaggaguggcu

SEQ ID NO: 950484 - RNA, 18 nt, Homo sapiens
aaguauucccuucuuucc

SEQ ID NO: 950485 - RNA, 15 nt, Homo sapiens
aagucagcucuuguc

SEQ ID NO: 950486 - RNA, 17 nt, Homo sapiens
aagucauucaguuauca

SEQ ID NO: 950487 - RNA, 13 nt, Homo sapiens
aagugaggaugaa

SEQ ID NO: 950488 - RNA, 22 nt, Homo sapiens
aagugcacagaccacacacagc

SEQ ID NO: 950489 - RNA, 15 nt, Homo sapiens
aagugcucuuuccac

SEQ ID NO: 950490 - RNA, 21 nt, Homo sapiens
aaguguacaauuuucauccca

SEQ ID NO: 950491 - RNA, 24 nt, Homo sapiens
aagugugcauuaccacacucagcu

SEQ ID NO: 950492 - RNA, 18 nt, Homo sapiens
aaguuaucaacaugcaca

SEQ ID NO: 950493 - RNA, 20 nt, Homo sapiens
aaguuauguguuaaauuuag

SEQ ID NO: 950494 - RNA, 19 nt, Homo sapiens
aaguucauucauacucaaa

SEQ ID NO: 950495 - RNA, 15 nt, Homo sapiens
aaguugaucucccca

SEQ ID NO: 950496 - RNA, 17 nt, Homo sapiens
aauaaauaaaaauauuc

SEQ ID NO: 950497 - RNA, 13 nt, Homo sapiens
aauaaccaaaaaa

SEQ ID NO: 950498 - RNA, 19 nt, Homo sapiens
aauaacuagaucuccugua

SEQ ID NO: 950499 - RNA, 15 nt, Homo sapiens
aauaagcuucaucuc

SEQ ID NO: 950500 - RNA, 16 nt, Homo sapiens
aauaaguugacuuuca

SEQ ID NO: 950501 - RNA, 14 nt, Homo sapiens
aauaauuacuuaau

SEQ ID NO: 950502 - RNA, 18 nt, Homo sapiens
aauacagauauaagaaau

SEQ ID NO: 950503 - RNA, 15 nt, Homo sapiens
aauacuacagcauaa

SEQ ID NO: 950504 - RNA, 20 nt, Homo sapiens
aauagcuuaucuuucaaggu

SEQ ID NO: 950505 - RNA, 20 nt, Homo sapiens
aauagguuucaacauaugaa

SEQ ID NO: 950506 - RNA, 23 nt, Homo sapiens
aauaguauucugaucaguugcca

SEQ ID NO: 950507 - RNA, 18 nt, Homo sapiens
aauauacuaaccauuucu

SEQ ID NO: 950508 - RNA, 20 nt, Homo sapiens
aauauagacuggauaaucaa

SEQ ID NO: 950509 - RNA, 15 nt, Homo sapiens
aauauaguagcagga

SEQ ID NO: 950510 - RNA, 18 nt, Homo sapiens
aauaucaagagagguuaa

SEQ ID NO: 950511 - RNA, 18 nt, Homo sapiens
aauaugcaaccugugcaa

SEQ ID NO: 950512 - RNA, 19 nt, Homo sapiens
aauaugguuugaagugaau

SEQ ID NO: 950513 - RNA, 14 nt, Homo sapiens
aauauuauacuucu

SEQ ID NO: 950514 - RNA, 13 nt, Homo sapiens
aauauucugucau

SEQ ID NO: 950515 - RNA, 21 nt, Homo sapiens
aaucacauguaauccaaagac

SEQ ID NO: 950516 - RNA, 21 nt, Homo sapiens
aaucauuucauguuagucuua

SEQ ID NO: 950517 - RNA, 20 nt, Homo sapiens
aauccaagcugcucauuuca

SEQ ID NO: 950518 - RNA, 12 nt, Homo sapiens
aauccauaucag

SEQ ID NO: 950519 - RNA, 14 nt, Homo sapiens
aaucccacuuauca

SEQ ID NO: 950520 - RNA, 22 nt, Homo sapiens
aaucccacuuaucaaaucauuc

SEQ ID NO: 950521 - RNA, 17 nt, Homo sapiens
aaucgaccucacuguca

SEQ ID NO: 950522 - RNA, 22 nt, Homo sapiens
aaucuaccauuuauugaaugca

SEQ ID NO: 950523 - RNA, 11 nt, Homo sapiens
aaucuagacau

SEQ ID NO: 950524 - RNA, 18 nt, Homo sapiens
aaucuccauuucugcuca

SEQ ID NO: 950525 - RNA, 23 nt, Homo sapiens
aaucuguugccacccaggugaug

SEQ ID NO: 950526 - RNA, 22 nt, Homo sapiens
aaugaaaccugugucucugaga

SEQ ID NO: 950527 - RNA, 21 nt, Homo sapiens
aaugaagaaggucucauuauc

SEQ ID NO: 950528 - RNA, 16 nt, Homo sapiens
aaugaaugccuuucaa

SEQ ID NO: 950529 - RNA, 18 nt, Homo sapiens
aaugaccaaauccaugga

SEQ ID NO: 950530 - RNA, 14 nt, Homo sapiens
aaugacucuggaac

SEQ ID NO: 950531 - RNA, 20 nt, Homo sapiens
aaugacuuaagcacacuuga

SEQ ID NO: 950532 - RNA, 16 nt, Homo sapiens
aaugaggaaacugcac

SEQ ID NO: 950533 - RNA, 18 nt, Homo sapiens
aaugagguccuucuguag

SEQ ID NO: 950534 - RNA, 22 nt, Homo sapiens
aaugaguuaccucaugccgcug

SEQ ID NO: 950535 - RNA, 22 nt, Homo sapiens
aaugcaaggugaacaccacuuu

SEQ ID NO: 950536 - RNA, 22 nt, Homo sapiens
aaugcacguuucaaagcuuucc

SEQ ID NO: 950537 - RNA, 16 nt, Homo sapiens
aaugcaguccagugag

SEQ ID NO: 950538 - RNA, 17 nt, Homo sapiens
aaugcaguccagugaga

SEQ ID NO: 950539 - RNA, 20 nt, Homo sapiens
aaugcauacucugugcaagg

SEQ ID NO: 950540 - RNA, 23 nt, Homo sapiens
aaugcccaacagggcaaccaaua

SEQ ID NO: 950541 - RNA, 15 nt, Homo sapiens
aaugcuaaaugcaaa

SEQ ID NO: 950542 - RNA, 19 nt, Homo sapiens
aaugcuuguaauagucugu

SEQ ID NO: 950543 - RNA, 22 nt, Homo sapiens
aaugcuuucucuccucuucucc

SEQ ID NO: 950544 - RNA, 13 nt, Homo sapiens
aauggaaacagcc

SEQ ID NO: 950545 - RNA, 15 nt, Homo sapiens
aauggcuuuuugccg

SEQ ID NO: 950546 - RNA, 20 nt, Homo sapiens
aauggggguauccugugcau

SEQ ID NO: 950547 - RNA, 21 nt, Homo sapiens
aaugguagaacggauaccugc

SEQ ID NO: 950548 - RNA, 18 nt, Homo sapiens
aauguauuuuucacaaag

SEQ ID NO: 950549 - RNA, 20 nt, Homo sapiens
aaugucaagaguauuuauua

SEQ ID NO: 950550 - RNA, 15 nt, Homo sapiens
aaugucuccugccac

SEQ ID NO: 950551 - RNA, 12 nt, Homo sapiens
aaugugccaaaa

SEQ ID NO: 950552 - RNA, 15 nt, Homo sapiens
aauguggaugcucuu

SEQ ID NO: 950553 - RNA, 18 nt, Homo sapiens
aauguggcuccaagcuca

SEQ ID NO: 950554 - RNA, 14 nt, Homo sapiens
aauuaaaaccaucu

SEQ ID NO: 950555 - RNA, 16 nt, Homo sapiens
aauuacaggaaguacu

SEQ ID NO: 950556 - RNA, 22 nt, Homo sapiens
aauuagagcaagaacauucaaa

SEQ ID NO: 950557 - RNA, 16 nt, Homo sapiens
aauuauuuuagcacaa

SEQ ID NO: 950558 - RNA, 21 nt, Homo sapiens
aauucauaaaaauaaccaaaa

SEQ ID NO: 950559 - RNA, 22 nt, Homo sapiens
aauucauaaaaauaaccaaaaa

SEQ ID NO: 950560 - RNA, 18 nt, Homo sapiens
aauucauggaacuuucau

SEQ ID NO: 950561 - RNA, 21 nt, Homo sapiens
aauuccaccaggauuaaucuc

SEQ ID NO: 950562 - RNA, 21 nt, Homo sapiens
aauuccucugugcucuccuag

SEQ ID NO: 950563 - RNA, 19 nt, Homo sapiens
aauugaaccgucaauguga

SEQ ID NO: 950564 - RNA, 20 nt, Homo sapiens
aauugaagaaagucagcucu

SEQ ID NO: 950565 - RNA, 23 nt, Homo sapiens
aauugccccugguugagaaacau

SEQ ID NO: 950566 - RNA, 18 nt, Homo sapiens
aauugcuucacagccuug

SEQ ID NO: 950567 - RNA, 22 nt, Homo sapiens
aauuguagaacauagaugcuac

SEQ ID NO: 950568 - RNA, 19 nt, Homo sapiens
aauuuaauauacugcauau

SEQ ID NO: 950569 - RNA, 20 nt, Homo sapiens
aauuuaggauggaauacuuc

SEQ ID NO: 950570 - RNA, 23 nt, Homo sapiens
aauuucagugaaaugguguauag

SEQ ID NO: 950571 - RNA, 12 nt, Homo sapiens
aauuuccaugau

SEQ ID NO: 950572 - RNA, 18 nt, Homo sapiens
aauuuccuccacauucau

SEQ ID NO: 950573 - RNA, 22 nt, Homo sapiens
aauuuuguaucaccucuucaca

SEQ ID NO: 950574 - RNA, 19 nt, Homo sapiens
acaaaacuuauaauuucca

SEQ ID NO: 950575 - RNA, 14 nt, Homo sapiens
acaaagaugugcaa

SEQ ID NO: 950576 - RNA, 13 nt, Homo sapiens
acaaauuguuaag

SEQ ID NO: 950577 - RNA, 17 nt, Homo sapiens
acaagagcaaaacucag

SEQ ID NO: 950578 - RNA, 21 nt, Homo sapiens
acaagagcaaaacucagucuc

SEQ ID NO: 950579 - RNA, 16 nt, Homo sapiens
acaaggcccuucagcc

SEQ ID NO: 950580 - RNA, 14 nt, Homo sapiens
acaaggcucugcua

SEQ ID NO: 950581 - RNA, 19 nt, Homo sapiens
acaagggguggaagggcag

SEQ ID NO: 950582 - RNA, 15 nt, Homo sapiens
acaagugaaaacuga

SEQ ID NO: 950583 - RNA, 22 nt, Homo sapiens
acaaugguagcucugaagggag

SEQ ID NO: 950584 - RNA, 13 nt, Homo sapiens
acacacagcagcu

SEQ ID NO: 950585 - RNA, 14 nt, Homo sapiens
acacacaugcacac

SEQ ID NO: 950586 - RNA, 23 nt, Homo sapiens
acacagcacuaacacaugcacac

SEQ ID NO: 950587 - RNA, 16 nt, Homo sapiens
acacauaaaucugucu

SEQ ID NO: 950588 - RNA, 12 nt, Homo sapiens
acacaugcacac

SEQ ID NO: 950589 - RNA, 19 nt, Homo sapiens
acacaugguuuccaagggu

SEQ ID NO: 950590 - RNA, 18 nt, Homo sapiens
acacauuuggaccacagc

SEQ ID NO: 950591 - RNA, 14 nt, Homo sapiens
acacggacccugug

SEQ ID NO: 950592 - RNA, 14 nt, Homo sapiens
acacggucuucaca

SEQ ID NO: 950593 - RNA, 17 nt, Homo sapiens
acacugcacacaugcac

SEQ ID NO: 950594 - RNA, 19 nt, Homo sapiens
acacugcacacaugcacac

SEQ ID NO: 950595 - RNA, 16 nt, Homo sapiens
acagaaacuucucagu

SEQ ID NO: 950596 - RNA, 18 nt, Homo sapiens
acagaacagcaaguauga

SEQ ID NO: 950597 - RNA, 23 nt, Homo sapiens
acagaacuuauucuccaucucaa

SEQ ID NO: 950598 - RNA, 20 nt, Homo sapiens
acagaaucuccauuucugcu

SEQ ID NO: 950599 - RNA, 22 nt, Homo sapiens
acagagcaagcgaaagagcaaa

SEQ ID NO: 950600 - RNA, 21 nt, Homo sapiens
acagcacacacaagugcacag

SEQ ID NO: 950601 - RNA, 16 nt, Homo sapiens
acagcacuguaugugu

SEQ ID NO: 950602 - RNA, 23 nt, Homo sapiens
acagcauaggguccacuuuggua

SEQ ID NO: 950603 - RNA, 15 nt, Homo sapiens
acagcuaacauggaa

SEQ ID NO: 950604 - RNA, 18 nt, Homo sapiens
acagcucacuacaguuuc

SEQ ID NO: 950605 - RNA, 19 nt, Homo sapiens
acagcucacuacaguuuca

SEQ ID NO: 950606 - RNA, 20 nt, Homo sapiens
acagcuccuccccugcuacc

SEQ ID NO: 950607 - RNA, 15 nt, Homo sapiens
acaggaucaaaguug

SEQ ID NO: 950608 - RNA, 17 nt, Homo sapiens
acaggauucucuucuca

SEQ ID NO: 950609 - RNA, 22 nt, Homo sapiens
acaggccccaguuauugugaaa

SEQ ID NO: 950610 - RNA, 16 nt, Homo sapiens
acaggccgcacaucuc

SEQ ID NO: 950611 - RNA, 22 nt, Homo sapiens
acaggcuggcaguugguacuga

SEQ ID NO: 950612 - RNA, 15 nt, Homo sapiens
aucacuacagaucuc

SEQ ID NO: 950613 - RNA, 10 nt, Homo sapiens
aucacuugcc

SEQ ID NO: 950614 - RNA, 17 nt, Homo sapiens
aucacuuucauucaauu

SEQ ID NO: 950615 - RNA, 19 nt, Homo sapiens
aucacuuuucagaagacuu

SEQ ID NO: 950616 - RNA, 14 nt, Homo sapiens
aucagaauguuuca

SEQ ID NO: 950617 - RNA, 17 nt, Homo sapiens
aucagacauucagagau

SEQ ID NO: 950618 - RNA, 13 nt, Homo sapiens
aucagaucuuaca

SEQ ID NO: 950619 - RNA, 18 nt, Homo sapiens
aucaguaaucacuuuuca

SEQ ID NO: 950620 - RNA, 16 nt, Homo sapiens
aucagugcuccaguau

SEQ ID NO: 950621 - RNA, 11 nt, Homo sapiens
aucauaacuca

SEQ ID NO: 950622 - RNA, 20 nt, Homo sapiens
aucaugguauucuucugaca

SEQ ID NO: 950623 - RNA, 13 nt, Homo sapiens
aucauuauuucau

SEQ ID NO: 950624 - RNA, 22 nt, Homo sapiens
aucauugagaaauaaagcacau

SEQ ID NO: 950625 - RNA, 23 nt, Homo sapiens
aucauugagaaauaaagcacauu

SEQ ID NO: 950626 - RNA, 24 nt, Homo sapiens
aucauuuggccgagucagcacgua

SEQ ID NO: 950627 - RNA, 16 nt, Homo sapiens
auccaaucucaucucu

SEQ ID NO: 950628 - RNA, 20 nt, Homo sapiens
auccacuacauucugaaggc

SEQ ID NO: 950629 - RNA, 15 nt, Homo sapiens
auccaggcagggaua

SEQ ID NO: 950630 - RNA, 20 nt, Homo sapiens
auccauaucagcucugcaua

SEQ ID NO: 950631 - RNA, 18 nt, Homo sapiens
aucccuaacuaaagggga

SEQ ID NO: 950632 - RNA, 16 nt, Homo sapiens
auccgugacagcacuu

SEQ ID NO: 950633 - RNA, 19 nt, Homo sapiens
auccuggcaaauaauacua

SEQ ID NO: 950634 - RNA, 12 nt, Homo sapiens
auccuguuacuu

SEQ ID NO: 950635 - RNA, 16 nt, Homo sapiens
auccuguuaggggaaa

SEQ ID NO: 950636 - RNA, 21 nt, Homo sapiens
aucguucugggucagcuugaa

SEQ ID NO: 950637 - RNA, 16 nt, Homo sapiens
aucguuucacaucugu

SEQ ID NO: 950638 - RNA, 13 nt, Homo sapiens
aucuacaacauaa

SEQ ID NO: 950639 - RNA, 19 nt, Homo sapiens
aucuacaacauaaugauac

SEQ ID NO: 950640 - RNA, 20 nt, Homo sapiens
aucuagcaagaagauucuaa

SEQ ID NO: 950641 - RNA, 14 nt, Homo sapiens
aucuauuacaccuu

SEQ ID NO: 950642 - RNA, 12 nt, Homo sapiens
aucucauuacag

SEQ ID NO: 950643 - RNA, 17 nt, Homo sapiens
aucuccauuucugcuca

SEQ ID NO: 950644 - RNA, 14 nt, Homo sapiens
aucucuacuuuccu

SEQ ID NO: 950645 - RNA, 15 nt, Homo sapiens
aucugauuugcauau

SEQ ID NO: 950646 - RNA, 23 nt, Homo sapiens
aucugcugcaccuucacucucca

SEQ ID NO: 950647 - RNA, 15 nt, Homo sapiens
aucugcuucuaguga

SEQ ID NO: 950648 - RNA, 17 nt, Homo sapiens
aucuguauaucagcucu

SEQ ID NO: 950649 - RNA, 15 nt, Homo sapiens
aucuguguugucucu

SEQ ID NO: 950650 - RNA, 19 nt, Homo sapiens
aucuguuugauacaguauu

SEQ ID NO: 950651 - RNA, 20 nt, Homo sapiens
aucuucuaucaaagcacaua

SEQ ID NO: 950652 - RNA, 17 nt, Homo sapiens
aucuugaaacacauuua

SEQ ID NO: 950653 - RNA, 18 nt, Homo sapiens
aucuuggaaucaugcaaa

SEQ ID NO: 950654 - RNA, 21 nt, Homo sapiens
aucuuggaaucaugcaaaaaa

SEQ ID NO: 950655 - RNA, 23 nt, Homo sapiens
aucuuuagcaguacccuagccuc

SEQ ID NO: 950656 - RNA, 18 nt, Homo sapiens
augaaaagucauucaguu

SEQ ID NO: 950657 - RNA, 22 nt, Homo sapiens
augaagaaggucucauuaucuc

SEQ ID NO: 950658 - RNA, 11 nt, Homo sapiens
augacacgaau

SEQ ID NO: 950659 - RNA, 15 nt, Homo sapiens
augacaucaacauuc

SEQ ID NO: 950660 - RNA, 21 nt, Homo sapiens
augacccggaugaacucaaug

SEQ ID NO: 950661 - RNA, 21 nt, Homo sapiens
augaccuugaaugaugccaug

SEQ ID NO: 950662 - RNA, 16 nt, Homo sapiens
augagaagaagcacga

SEQ ID NO: 950663 - RNA, 24 nt, Homo sapiens
augagagcagagcccccauggccu

SEQ ID NO: 950664 - RNA, 20 nt, Homo sapiens
augagaggaaaucaccgaaa

SEQ ID NO: 950665 - RNA, 12 nt, Homo sapiens
augauacaaaga

SEQ ID NO: 950666 - RNA, 12 nt, Homo sapiens
augaucacagcu

SEQ ID NO: 950667 - RNA, 23 nt, Homo sapiens
augaugacucuucuuaucacacu

SEQ ID NO: 950668 - RNA, 18 nt, Homo sapiens
augcaaccugugcaaaau

SEQ ID NO: 950669 - RNA, 17 nt, Homo sapiens
augcaagucgccaggca

SEQ ID NO: 950670 - RNA, 18 nt, Homo sapiens
augcacagcuaacaugga

SEQ ID NO: 950671 - RNA, 19 nt, Homo sapiens
augcacagcuaacauggaa

SEQ ID NO: 950672 - RNA, 16 nt, Homo sapiens
augcagaaauguggau

SEQ ID NO: 950673 - RNA, 20 nt, Homo sapiens
augcaguuccugugccucca

SEQ ID NO: 950674 - RNA, 21 nt, Homo sapiens
augccuaguuauucauuguua

SEQ ID NO: 950675 - RNA, 22 nt, Homo sapiens
augccuuguugaugaagcacau

SEQ ID NO: 950676 - RNA, 13 nt, Homo sapiens
augcuuaacauaa

SEQ ID NO: 950677 - RNA, 15 nt, Homo sapiens
auggaaggccagcuu

SEQ ID NO: 950678 - RNA, 19 nt, Homo sapiens
auggaauaucaaugcccaa

SEQ ID NO: 950679 - RNA, 20 nt, Homo sapiens
auggaucaaccaaguuacac

SEQ ID NO: 950680 - RNA, 16 nt, Homo sapiens
auggaugaauucugac

SEQ ID NO: 950681 - RNA, 18 nt, Homo sapiens
auggccuccauccagaaa

SEQ ID NO: 950682 - RNA, 23 nt, Homo sapiens
auggcuugcaguuguuccuccac

SEQ ID NO: 950683 - RNA, 16 nt, Homo sapiens
augggggaaguauucc

SEQ ID NO: 950684 - RNA, 18 nt, Homo sapiens
auggucaugggucugccc

SEQ ID NO: 950685 - RNA, 14 nt, Homo sapiens
auguauaucuguaa

SEQ ID NO: 950686 - RNA, 16 nt, Homo sapiens
auguauuuuucacaaa

SEQ ID NO: 950687 - RNA, 19 nt, Homo sapiens
augucaauuuuuaacuuau

SEQ ID NO: 950688 - RNA, 14 nt, Homo sapiens
augucagucugucc

SEQ ID NO: 950689 - RNA, 18 nt, Homo sapiens
augucauuuuccaaaaau

SEQ ID NO: 950690 - RNA, 16 nt, Homo sapiens
augucuccauuguuaa

SEQ ID NO: 950691 - RNA, 12 nt, Homo sapiens
augucuguuuac

SEQ ID NO: 950692 - RNA, 23 nt, Homo sapiens
auguguaguguugcuauguguac

SEQ ID NO: 950693 - RNA, 18 nt, Homo sapiens
auguuuaagaaaugagaa

SEQ ID NO: 950694 - RNA, 22 nt, Homo sapiens
auuaaaucauagcuaguauaac

SEQ ID NO: 950695 - RNA, 22 nt, Homo sapiens
auuaaauuuuaauguaaaauuc

SEQ ID NO: 950696 - RNA, 22 nt, Homo sapiens
auuaauaaauccuacaguauuu

SEQ ID NO: 950697 - RNA, 13 nt, Homo sapiens
auuaauauguacu

SEQ ID NO: 950698 - RNA, 16 nt, Homo sapiens
auuacauuaugcccuu

SEQ ID NO: 950699 - RNA, 14 nt, Homo sapiens
auuacuuaauguga

SEQ ID NO: 950700 - RNA, 18 nt, Homo sapiens
auuagcuuauuuaaucug

SEQ ID NO: 950701 - RNA, 23 nt, Homo sapiens
auuauaagcugcucccugucuau

SEQ ID NO: 950702 - RNA, 15 nt, Homo sapiens
auuauauauaaucua

SEQ ID NO: 950703 - RNA, 14 nt, Homo sapiens
auuaucuccaugau

SEQ ID NO: 950704 - RNA, 14 nt, Homo sapiens
auuauuaaucucau

SEQ ID NO: 950705 - RNA, 21 nt, Homo sapiens
auucaaaacuuucagcuggag

SEQ ID NO: 950706 - RNA, 16 nt, Homo sapiens
auucaaaauaguucua

SEQ ID NO: 950707 - RNA, 23 nt, Homo sapiens
auucaacagguuuuccugaagaa

SEQ ID NO: 950708 - RNA, 22 nt, Homo sapiens
auucacagcuacgugugccccu

SEQ ID NO: 950709 - RNA, 16 nt, Homo sapiens
auucauaaugacuuaa

SEQ ID NO: 950710 - RNA, 23 nt, Homo sapiens
auucaucuguugacaauuugcca

SEQ ID NO: 950711 - RNA, 17 nt, Homo sapiens
auucauggaacuuucau

SEQ ID NO: 950712 - RNA, 20 nt, Homo sapiens
auucauggaccacuguuucu

SEQ ID NO: 950713 - RNA, 14 nt, Homo sapiens
auucauguacaaug

SEQ ID NO: 950714 - RNA, 16 nt, Homo sapiens
auuccuggaaaacugg

SEQ ID NO: 950715 - RNA, 20 nt, Homo sapiens
auucuagucucugauuugca

SEQ ID NO: 950716 - RNA, 14 nt, Homo sapiens
auucuauaagagac

SEQ ID NO: 950717 - RNA, 20 nt, Homo sapiens
auucugcuaauuuaugaaga

SEQ ID NO: 950718 - RNA, 23 nt, Homo sapiens
auucuuaaauauguggaguucau

SEQ ID NO: 950719 - RNA, 19 nt, Homo sapiens
auucuuccaaguucauuca

SEQ ID NO: 950720 - RNA, 13 nt, Homo sapiens
auugaaaaaccau

SEQ ID NO: 950721 - RNA, 14 nt, Homo sapiens
auugaacuguuuau

SEQ ID NO: 950722 - RNA, 18 nt, Homo sapiens
auugaaugcauacucugu

SEQ ID NO: 950723 - RNA, 15 nt, Homo sapiens
auugcauucauguac

SEQ ID NO: 950724 - RNA, 16 nt, Homo sapiens
auuggagauuaaucua

SEQ ID NO: 950725 - RNA, 16 nt, Homo sapiens
auuguaggaucuuuag

SEQ ID NO: 950726 - RNA, 14 nt, Homo sapiens
auugugcagauauu

SEQ ID NO: 950727 - RNA, 16 nt, Homo sapiens
auuguguaacuguucu

SEQ ID NO: 950728 - RNA, 20 nt, Homo sapiens
auuguuaaaaccuuacuuaa

SEQ ID NO: 950729 - RNA, 15 nt, Homo sapiens
auuguuuaacccugg

SEQ ID NO: 950730 - RNA, 20 nt, Homo sapiens
auuuaaaaagcccaaccucu

SEQ ID NO: 950731 - RNA, 21 nt, Homo sapiens
auuuaaucuguacuauccagu

SEQ ID NO: 950732 - RNA, 16 nt, Homo sapiens
auuuacgcuacaugug

SEQ ID NO: 950733 - RNA, 21 nt, Homo sapiens
auuuaucuuccauaugcucuu

SEQ ID NO: 950734 - RNA, 24 nt, Homo sapiens
auuuauuaguuaggugugccaaac

SEQ ID NO: 950735 - RNA, 21 nt, Homo sapiens
auuucaaaugcaguccaguga

SEQ ID NO: 950736 - RNA, 14 nt, Homo sapiens
auuucaauaacuua

SEQ ID NO: 950737 - RNA, 23 nt, Homo sapiens
auuuccaggggccucccaaggaa

SEQ ID NO: 950738 - RNA, 17 nt, Homo sapiens
auuuccaugauacaaag

SEQ ID NO: 950739 - RNA, 13 nt, Homo sapiens
auuucccuaaaaa

SEQ ID NO: 950740 - RNA, 21 nt, Homo sapiens
auuuccgugagagucaucuca

SEQ ID NO: 950741 - RNA, 21 nt, Homo sapiens
auuucucuuccuaaauuucau

SEQ ID NO: 950742 - RNA, 14 nt, Homo sapiens
auuucuuaccaugc

SEQ ID NO: 950743 - RNA, 20 nt, Homo sapiens
auuucuuaccaugcauuucu

SEQ ID NO: 950744 - RNA, 16 nt, Homo sapiens
cguaucaccugagguu

SEQ ID NO: 950745 - RNA, 13 nt, Homo sapiens
cgugacagcacuu

SEQ ID NO: 950746 - RNA, 18 nt, Homo sapiens
cuaaaauacucaccaaaa

SEQ ID NO: 950747 - RNA, 14 nt, Homo sapiens
cuaaacccaaauaa

SEQ ID NO: 950748 - RNA, 22 nt, Homo sapiens
cuaaaggggacuagacaguuag

SEQ ID NO: 950749 - RNA, 11 nt, Homo sapiens
cuaaauuucca

SEQ ID NO: 950750 - RNA, 21 nt, Homo sapiens
cuaaauuuggggacagauuca

SEQ ID NO: 950751 - RNA, 17 nt, Homo sapiens
cuaaggagcacuagaau

SEQ ID NO: 950752 - RNA, 23 nt, Homo sapiens
cuaagugaggaugaaaaaauaac

SEQ ID NO: 950753 - RNA, 13 nt, Homo sapiens
cuacagcaaauaa

SEQ ID NO: 950754 - RNA, 20 nt, Homo sapiens
cuacaggaaauacagagaug

SEQ ID NO: 950755 - RNA, 22 nt, Homo sapiens
cuacaguacaugacccggauga

SEQ ID NO: 950756 - RNA, 16 nt, Homo sapiens
cuacccucagucuaca

SEQ ID NO: 950757 - RNA, 23 nt, Homo sapiens
cuacccugcacauuguuaugcac

SEQ ID NO: 950758 - RNA, 15 nt, Homo sapiens
cuacucgaguuacag

SEQ ID NO: 950759 - RNA, 15 nt, Homo sapiens
cuacugccaaccucg

SEQ ID NO: 950760 - RNA, 22 nt, Homo sapiens
cuagaaggaugaacaguucucc

SEQ ID NO: 950761 - RNA, 20 nt, Homo sapiens
cuaggaaagaguugagcaca

SEQ ID NO: 950762 - RNA, 15 nt, Homo sapiens
cuaggaagaaucagu

SEQ ID NO: 950763 - RNA, 19 nt, Homo sapiens
cuaggauaaaccaaucauc

SEQ ID NO: 950764 - RNA, 22 nt, Homo sapiens
cuaggauaaaccaaucaucuua

SEQ ID NO: 950765 - RNA, 14 nt, Homo sapiens
cuagucuguuucau

SEQ ID NO: 950766 - RNA, 16 nt, Homo sapiens
cuauaauuuuacaaag

SEQ ID NO: 950767 - RNA, 14 nt, Homo sapiens
cuauacuaccaaaa

SEQ ID NO: 950768 - RNA, 17 nt, Homo sapiens
cuauacuaccaaaagag

SEQ ID NO: 950769 - RNA, 15 nt, Homo sapiens
cuauacuuucucaca

SEQ ID NO: 950770 - RNA, 18 nt, Homo sapiens
cuauacuuucucacaugu

SEQ ID NO: 950771 - RNA, 19 nt, Homo sapiens
cuauguccuggaagugugu

SEQ ID NO: 950772 - RNA, 14 nt, Homo sapiens
cuauugucacauga

SEQ ID NO: 950773 - RNA, 14 nt, Homo sapiens
cucaaugcaugaug

SEQ ID NO: 950774 - RNA, 17 nt, Homo sapiens
cucacaacuguuuuuga

SEQ ID NO: 950775 - RNA, 13 nt, Homo sapiens
cucacaccuguaa

SEQ ID NO: 950776 - RNA, 19 nt, Homo sapiens
cucacaugcuucuggcaaa

SEQ ID NO: 950777 - RNA, 12 nt, Homo sapiens
cucacauucaca

SEQ ID NO: 950778 - RNA, 21 nt, Homo sapiens
cucacgcucagcacacaugca

SEQ ID NO: 950779 - RNA, 22 nt, Homo sapiens
cucacuaguuuuuccugugcaa

SEQ ID NO: 950780 - RNA, 22 nt, Homo sapiens
cucagauuccccccaucuccau

SEQ ID NO: 950781 - RNA, 22 nt, Homo sapiens
cucagcacuguuuucaucacaa

SEQ ID NO: 950782 - RNA, 18 nt, Homo sapiens
cucaguuucucuggagac

SEQ ID NO: 950783 - RNA, 19 nt, Homo sapiens
cucaucacugcuccuguca

SEQ ID NO: 950784 - RNA, 14 nt, Homo sapiens
cucauuaucuccau

SEQ ID NO: 950785 - RNA, 19 nt, Homo sapiens
cucauucuuuucagcuugu

SEQ ID NO: 950786 - RNA, 22 nt, Homo sapiens
cuccaaaaagaaauauuaauau

SEQ ID NO: 950787 - RNA, 12 nt, Homo sapiens
cuccaaaacaca

SEQ ID NO: 950788 - RNA, 12 nt, Homo sapiens
cuccacauucau

SEQ ID NO: 950789 - RNA, 14 nt, Homo sapiens
cuccacauucaugu

SEQ ID NO: 950790 - RNA, 20 nt, Homo sapiens
cuccagaacaaaccucuaua

SEQ ID NO: 950791 - RNA, 15 nt, Homo sapiens
cuccauuacuaaaga

SEQ ID NO: 950792 - RNA, 16 nt, Homo sapiens
cuccauuucugcucag

SEQ ID NO: 950793 - RNA, 20 nt, Homo sapiens
cuccccgccuccucccugcc

SEQ ID NO: 950794 - RNA, 13 nt, Homo sapiens
cucccucauuuaa

SEQ ID NO: 950795 - RNA, 23 nt, Homo sapiens
cucccuucaacuguauaccgugu

SEQ ID NO: 950796 - RNA, 14 nt, Homo sapiens
cuccgcaauucaau

SEQ ID NO: 950797 - RNA, 16 nt, Homo sapiens
cuccuccccucuccua

SEQ ID NO: 950798 - RNA, 15 nt, Homo sapiens
cuccuggcagugacc

SEQ ID NO: 950799 - RNA, 19 nt, Homo sapiens
cuccuuugguuaguguacu

SEQ ID NO: 950800 - RNA, 16 nt, Homo sapiens
cucgaguuacagacaa

SEQ ID NO: 950801 - RNA, 16 nt, Homo sapiens
cucgcugaaagcacua

SEQ ID NO: 950802 - RNA, 19 nt, Homo sapiens
cucguacuuucacaucucu

SEQ ID NO: 950803 - RNA, 12 nt, Homo sapiens
cucgucuuucag

SEQ ID NO: 950804 - RNA, 20 nt, Homo sapiens
cucucauggucaugggucug

SEQ ID NO: 950805 - RNA, 23 nt, Homo sapiens
cucuccugcgugugcccacugaa

SEQ ID NO: 950806 - RNA, 17 nt, Homo sapiens
cucuccuugucacagaa

SEQ ID NO: 950807 - RNA, 21 nt, Homo sapiens
cucuccuuuucuccacuguca

SEQ ID NO: 950808 - RNA, 23 nt, Homo sapiens
cucucugaauacccaaaacacac

SEQ ID NO: 950809 - RNA, 20 nt, Homo sapiens
cucucuuacugcuucaugua

SEQ ID NO: 950810 - RNA, 21 nt, Homo sapiens
cucugagacucgcgacaaugc

SEQ ID NO: 950811 - RNA, 21 nt, Homo sapiens
cucugagaguagagucacugg

SEQ ID NO: 950812 - RNA, 16 nt, Homo sapiens
cucugcccccuccuuu

SEQ ID NO: 950813 - RNA, 15 nt, Homo sapiens
cucugcucugugcac

SEQ ID NO: 950814 - RNA, 16 nt, Homo sapiens
cucuguagauacaggg

SEQ ID NO: 950815 - RNA, 13 nt, Homo sapiens
cucuguguagcaa

SEQ ID NO: 950816 - RNA, 23 nt, Homo sapiens
cucuguuuugcauggaguauuau

SEQ ID NO: 950817 - RNA, 13 nt, Homo sapiens
cucuugucaaaag

SEQ ID NO: 950818 - RNA, 16 nt, Homo sapiens
cucuuguugugcucuu

SEQ ID NO: 950819 - RNA, 14 nt, Homo sapiens
cugaacaugcucau

SEQ ID NO: 950820 - RNA, 21 nt, Homo sapiens
cugaacgacagucccaguucc

SEQ ID NO: 950821 - RNA, 18 nt, Homo sapiens
cugaacugaaaggacugu

SEQ ID NO: 950822 - RNA, 20 nt, Homo sapiens
cugaagucacguagcacaga

SEQ ID NO: 950823 - RNA, 21 nt, Homo sapiens
cugacacaaugguagcucuga

SEQ ID NO: 950824 - RNA, 18 nt, Homo sapiens
cugacaccuuucagucuc

SEQ ID NO: 950825 - RNA, 18 nt, Homo sapiens
cugacagagccauaugua

SEQ ID NO: 950826 - RNA, 21 nt, Homo sapiens
cugacagagcccuaucuaugu

SEQ ID NO: 950827 - RNA, 21 nt, Homo sapiens
cugagaacucaggcuuugagu

SEQ ID NO: 950828 - RNA, 14 nt, Homo sapiens
cugagacccagaga

SEQ ID NO: 950829 - RNA, 13 nt, Homo sapiens
cugagcagugggg

SEQ ID NO: 950830 - RNA, 22 nt, Homo sapiens
cugagcaguuguuauauucauu

SEQ ID NO: 950831 - RNA, 19 nt, Homo sapiens
cugagccgaucuggucucg

SEQ ID NO: 950832 - RNA, 13 nt, Homo sapiens
cugaggaccugcg

SEQ ID NO: 950833 - RNA, 14 nt, Homo sapiens
cugaggguuuccac

SEQ ID NO: 950834 - RNA, 20 nt, Homo sapiens
cugaguguggcgggaagggu

SEQ ID NO: 950835 - RNA, 15 nt, Homo sapiens
cugaucaguugccaa

SEQ ID NO: 950836 - RNA, 14 nt, Homo sapiens
cugauuugcaaaug

SEQ ID NO: 950837 - RNA, 16 nt, Homo sapiens
cugauuugcauauuca

SEQ ID NO: 950838 - RNA, 11 nt, Homo sapiens
cugcacaggcu

SEQ ID NO: 950839 - RNA, 19 nt, Homo sapiens
cugcagcuccucugccuuu

SEQ ID NO: 950840 - RNA, 18 nt, Homo sapiens
cugcagcugagauuccag

SEQ ID NO: 950841 - RNA, 20 nt, Homo sapiens
cugcagcugcuuuugcauuu

SEQ ID NO: 950842 - RNA, 16 nt, Homo sapiens
cugcaggauaaaaugg

SEQ ID NO: 950843 - RNA, 18 nt, Homo sapiens
cugcaucaagaugugaca

SEQ ID NO: 950844 - RNA, 19 nt, Homo sapiens
cugccagagagaccugcug

SEQ ID NO: 950845 - RNA, 19 nt, Homo sapiens
cugccugcagcugagauuc

SEQ ID NO: 950846 - RNA, 15 nt, Homo sapiens
cugcucacugcucac

SEQ ID NO: 950847 - RNA, 14 nt, Homo sapiens
cugcucaugacaca

SEQ ID NO: 950848 - RNA, 18 nt, Homo sapiens
cugcuccugucaccauga

SEQ ID NO: 950849 - RNA, 16 nt, Homo sapiens
cugcuguugauuccac

SEQ ID NO: 950850 - RNA, 20 nt, Homo sapiens
cuggaaggcuuuauucuucc

SEQ ID NO: 950851 - RNA, 22 nt, Homo sapiens
cuggaaguguguguuucuugcu

SEQ ID NO: 950852 - RNA, 19 nt, Homo sapiens
cuggacucuguggggccac

SEQ ID NO: 950853 - RNA, 22 nt, Homo sapiens
cuggagugaaguggugugaucc

SEQ ID NO: 950854 - RNA, 14 nt, Homo sapiens
cuggauaagucacu

SEQ ID NO: 950855 - RNA, 20 nt, Homo sapiens
cuggcacuguggagaccaca

SEQ ID NO: 950856 - RNA, 15 nt, Homo sapiens
cuggcagacuuacaa

SEQ ID NO: 950857 - RNA, 19 nt, Homo sapiens
cuggcagacuuacaaagcu

SEQ ID NO: 950858 - RNA, 17 nt, Homo sapiens
cuggccugaaaccagug

SEQ ID NO: 950859 - RNA, 22 nt, Homo sapiens
cuggcuuuacauggguucaauu

SEQ ID NO: 950860 - RNA, 22 nt, Homo sapiens
cugggaccacaagugugcauua

SEQ ID NO: 950861 - RNA, 21 nt, Homo sapiens
cugggacccacuccgacuccc

SEQ ID NO: 950862 - RNA, 15 nt, Homo sapiens
cugggauuacaggug

SEQ ID NO: 950863 - RNA, 18 nt, Homo sapiens
cugggauuacagguguga

SEQ ID NO: 950864 - RNA, 13 nt, Homo sapiens
cugggcucugggu

SEQ ID NO: 950865 - RNA, 19 nt, Homo sapiens
cuggggcccuuuucuuaca

SEQ ID NO: 950866 - RNA, 23 nt, Homo sapiens
cuggguggauuauaaacaacaga

SEQ ID NO: 950867 - RNA, 21 nt, Homo sapiens
cugguaaauuuuauaauguca

SEQ ID NO: 950868 - RNA, 20 nt, Homo sapiens
cugguacuauugugaccaca

SEQ ID NO: 950869 - RNA, 21 nt, Homo sapiens
cuggucacccccacccccggg

SEQ ID NO: 950870 - RNA, 15 nt, Homo sapiens
cuggucaguugccaa

SEQ ID NO: 950871 - RNA, 16 nt, Homo sapiens
cuggucaguugccaaa

SEQ ID NO: 950872 - RNA, 17 nt, Homo sapiens
cuggucaguugccaaag

SEQ ID NO: 950873 - RNA, 15 nt, Homo sapiens
cuggucaguuuucac

SEQ ID NO: 950874 - RNA, 23 nt, Homo sapiens
cuguaagagguacuaaaaacacu

SEQ ID NO: 950875 - RNA, 23 nt, Homo sapiens
cuguaaucccagcuaccugggag

SEQ ID NO: 950876 - RNA, 16 nt, Homo sapiens
cuguaaugcacuccug

SEQ ID NO: 950877 - RNA, 16 nt, Homo sapiens
cuguaauuuuguagua

SEQ ID NO: 950878 - RNA, 16 nt, Homo sapiens
cuguacaucagacaga

SEQ ID NO: 950879 - RNA, 17 nt, Homo sapiens
cuguacuauccagugag

SEQ ID NO: 950880 - RNA, 13 nt, Homo sapiens
cuguagugccaug

SEQ ID NO: 950881 - RNA, 19 nt, Homo sapiens
cuguauagaccaugcacag

SEQ ID NO: 950882 - RNA, 11 nt, Homo sapiens
cugucaggcag

SEQ ID NO: 950883 - RNA, 13 nt, Homo sapiens
cuguccuggucag

SEQ ID NO: 950884 - RNA, 16 nt, Homo sapiens
cugucuuuuuccucaa

SEQ ID NO: 950885 - RNA, 23 nt, Homo sapiens
cugugaaacuguuuaggauuuuc

SEQ ID NO: 950886 - RNA, 22 nt, Homo sapiens
cugugaucuaagcaguugcaau

SEQ ID NO: 950887 - RNA, 14 nt, Homo sapiens
cuguggauucuaua

SEQ ID NO: 950888 - RNA, 20 nt, Homo sapiens
cugugugaaaauacuggaau

SEQ ID NO: 950889 - RNA, 13 nt, Homo sapiens
cuguucagaaaua

SEQ ID NO: 950890 - RNA, 19 nt, Homo sapiens
cuguuccacuucucuagag

SEQ ID NO: 950891 - RNA, 19 nt, Homo sapiens
cuguucuaaguccacuuaa

SEQ ID NO: 950892 - RNA, 19 nt, Homo sapiens
cuguucucaaaugcuaaau

SEQ ID NO: 950893 - RNA, 22 nt, Homo sapiens
cuguugacaauuugccauagca

SEQ ID NO: 950894 - RNA, 22 nt, Homo sapiens
cuguuuacauccagaguucugu

SEQ ID NO: 950895 - RNA, 12 nt, Homo sapiens
cuguuucuugcu

SEQ ID NO: 950896 - RNA, 19 nt, Homo sapiens
cuguuugauacaguauuau

SEQ ID NO: 950897 - RNA, 24 nt, Homo sapiens
cuguuuuugaagaagggaaauuca

SEQ ID NO: 950898 - RNA, 20 nt, Homo sapiens
cuuaaaagaaaauguucacu

SEQ ID NO: 950899 - RNA, 19 nt, Homo sapiens
cuuaaaccugugcuuucau

SEQ ID NO: 950900 - RNA, 23 nt, Homo sapiens
cuuaaagcuuguuuguucuaguu

SEQ ID NO: 950901 - RNA, 19 nt, Homo sapiens
cuuaaauaauccucuaugu

SEQ ID NO: 950902 - RNA, 23 nt, Homo sapiens
cuuaacuguccaguccagugaug

SEQ ID NO: 950903 - RNA, 20 nt, Homo sapiens
cuuaaggaacagcauuguga

SEQ ID NO: 950904 - RNA, 19 nt, Homo sapiens
cuuaaugugaugcuugaua

SEQ ID NO: 950905 - RNA, 20 nt, Homo sapiens
cuuaauucuguuacacaaua

SEQ ID NO: 950906 - RNA, 20 nt, Homo sapiens
cuuagugaaaggucaucuca

SEQ ID NO: 950907 - RNA, 12 nt, Homo sapiens
cuuagugaaugg

SEQ ID NO: 950908 - RNA, 20 nt, Homo sapiens
cuuauaacaggaauaagcaa

SEQ ID NO: 950909 - RNA, 13 nt, Homo sapiens
cuuauaugugaca

SEQ ID NO: 950910 - RNA, 15 nt, Homo sapiens
cuuauaugugacacu

SEQ ID NO: 950911 - RNA, 19 nt, Homo sapiens
cuuaucuuggaaucaugca

SEQ ID NO: 950912 - RNA, 15 nt, Homo sapiens
cuuauucuccaucuc

SEQ ID NO: 950913 - RNA, 15 nt, Homo sapiens
cuucaacuacuucuc

SEQ ID NO: 950914 - RNA, 21 nt, Homo sapiens
cuucagugccaaaaacaacaa

SEQ ID NO: 950915 - RNA, 17 nt, Homo sapiens
cuucauaaguaguauua

SEQ ID NO: 950916 - RNA, 19 nt, Homo sapiens
cuucccuuaaaucauggua

SEQ ID NO: 950917 - RNA, 13 nt, Homo sapiens
cuuccuaccaaau

SEQ ID NO: 950918 - RNA, 19 nt, Homo sapiens
cuucuccugaccuacuucc

SEQ ID NO: 950919 - RNA, 21 nt, Homo sapiens
cuucuuaucacacuugcaaau

SEQ ID NO: 950920 - RNA, 17 nt, Homo sapiens
cuugaacaaaaucuguu

SEQ ID NO: 950921 - RNA, 14 nt, Homo sapiens
cuugaacucuuggc

SEQ ID NO: 950922 - RNA, 20 nt, Homo sapiens
cuugaagcugcucacugcuc

SEQ ID NO: 950923 - RNA, 16 nt, Homo sapiens
cuugaaugaugccaug

SEQ ID NO: 950924 - RNA, 21 nt, Homo sapiens
cuugaauguccccauucuaua

SEQ ID NO: 950925 - RNA, 17 nt, Homo sapiens
cuugaggcagggucuca

SEQ ID NO: 950926 - RNA, 19 nt, Homo sapiens
cuugaggcagggucucacu

SEQ ID NO: 950927 - RNA, 16 nt, Homo sapiens
cuugauauaauaauua

SEQ ID NO: 950928 - RNA, 20 nt, Homo sapiens
cuugauauaauaauuacuua

SEQ ID NO: 950929 - RNA, 16 nt, Homo sapiens
cuugaucagacauuca

SEQ ID NO: 950930 - RNA, 19 nt, Homo sapiens
cuugauucauaaugacuua

SEQ ID NO: 950931 - RNA, 19 nt, Homo sapiens
cuugauuuacaagcaucau

SEQ ID NO: 950932 - RNA, 22 nt, Homo sapiens
cuugcaaaugaaugccuuucaa

SEQ ID NO: 950933 - RNA, 14 nt, Homo sapiens
cuugcagguggugg

SEQ ID NO: 950934 - RNA, 21 nt, Homo sapiens
cuugcccuuugagaaacccaa

SEQ ID NO: 950935 - RNA, 18 nt, Homo sapiens
cuugcuauguuauuuuca

SEQ ID NO: 950936 - RNA, 15 nt, Homo sapiens
cuugcuucuucacca

SEQ ID NO: 950937 - RNA, 17 nt, Homo sapiens
cuuggaaucaugcaaaa

SEQ ID NO: 950938 - RNA, 21 nt, Homo sapiens
cuuguaccagcccaggcaaua

SEQ ID NO: 950939 - RNA, 19 nt, Homo sapiens
cuuguccaaggucucauga

SEQ ID NO: 950940 - RNA, 22 nt, Homo sapiens
cuuuaaaauguauuuuucacaa

SEQ ID NO: 950941 - RNA, 21 nt, Homo sapiens
cuuuaaauaaaagagguccau

SEQ ID NO: 950942 - RNA, 19 nt, Homo sapiens
cuuuaacauuuuguuucca

SEQ ID NO: 950943 - RNA, 19 nt, Homo sapiens
cuuuaaguaaaauguuuca

SEQ ID NO: 950944 - RNA, 19 nt, Homo sapiens
cuuuaugaaguuaacaguc

SEQ ID NO: 950945 - RNA, 15 nt, Homo sapiens
cuuuccaaugugugc

SEQ ID NO: 950946 - RNA, 13 nt, Homo sapiens
cuuuccagccugu

SEQ ID NO: 950947 - RNA, 17 nt, Homo sapiens
cuuuccugauguugaua

SEQ ID NO: 950948 - RNA, 17 nt, Homo sapiens
cuuucucaugcauagac

SEQ ID NO: 950949 - RNA, 19 nt, Homo sapiens
cuuucuucauguucaguca

SEQ ID NO: 950950 - RNA, 17 nt, Homo sapiens
cuuugccucucuugcca

SEQ ID NO: 950951 - RNA, 21 nt, Homo sapiens
cuuuggggucuacacugcaau

SEQ ID NO: 950952 - RNA, 15 nt, Homo sapiens
cuuugucucugagaa

SEQ ID NO: 950953 - RNA, 12 nt, Homo sapiens
cuuugugcccaa

SEQ ID NO: 950954 - RNA, 12 nt, Homo sapiens
cuuugugugcau

SEQ ID NO: 950955 - RNA, 13 nt, Homo sapiens
cuuuguuccucug

SEQ ID NO: 950956 - RNA, 12 nt, Homo sapiens
cuuuuaaaaacu

SEQ ID NO: 950957 - RNA, 23 nt, Homo sapiens
cuuuuaaaacaauauuuaugucc

SEQ ID NO: 950958 - RNA, 17 nt, Homo sapiens
cuuuuaaugucaucucu

SEQ ID NO: 950959 - RNA, 15 nt, Homo sapiens
cuuuuagcagauaug

SEQ ID NO: 950960 - RNA, 23 nt, Homo sapiens
cuuuuccauuuauuuauucaugu

SEQ ID NO: 950961 - RNA, 18 nt, Homo sapiens
cuuuuccccaauucaugu

SEQ ID NO: 950962 - RNA, 16 nt, Homo sapiens
cuuuucuccacuguca

SEQ ID NO: 950963 - RNA, 24 nt, Homo sapiens
cuuuugcucugauagacaaaauca

SEQ ID NO: 950964 - RNA, 14 nt, Homo sapiens
gaaaacugauuucc

SEQ ID NO: 950965 - RNA, 14 nt, Homo sapiens
gaaaagguccaaaa

SEQ ID NO: 950966 - RNA, 22 nt, Homo sapiens
gaaaaugcuuucucaugcauag

SEQ ID NO: 950967 - RNA, 17 nt, Homo sapiens
gaaaauuuccuccacau

SEQ ID NO: 950968 - RNA, 22 nt, Homo sapiens
gaaaauuuccuccacauucaug

SEQ ID NO: 950969 - RNA, 16 nt, Homo sapiens
gaaacaaggaaggaca

SEQ ID NO: 950970 - RNA, 12 nt, Homo sapiens
gaaacacauuua

SEQ ID NO: 950971 - RNA, 15 nt, Homo sapiens
gaaacuaaggucaga

SEQ ID NO: 950972 - RNA, 22 nt, Homo sapiens
gaaacuuccuuugagaauugug

SEQ ID NO: 950973 - RNA, 21 nt, Homo sapiens
gaaauuucaaaguauguuuca

SEQ ID NO: 950974 - RNA, 17 nt, Homo sapiens
gaaauuuuuaaaucauu

SEQ ID NO: 950975 - RNA, 16 nt, Homo sapiens
gaacaaaaccccagaa

SEQ ID NO: 950976 - RNA, 16 nt, Homo sapiens
gaacaagaacccagca

SEQ ID NO: 950977 - RNA, 23 nt, Homo sapiens
gaacacuaaugaggaaacugcac

SEQ ID NO: 950978 - RNA, 16 nt, Homo sapiens
gaacacugcaguguua

SEQ ID NO: 950979 - RNA, 13 nt, Homo sapiens
gaacugcugcugg

SEQ ID NO: 950980 - RNA, 19 nt, Homo sapiens
gaagaaguuaucaacaugc

SEQ ID NO: 950981 - RNA, 17 nt, Homo sapiens
gaagaauugaaaaacca

SEQ ID NO: 950982 - RNA, 23 nt, Homo sapiens
gaagacacugucaaugagguuau

SEQ ID NO: 950983 - RNA, 21 nt, Homo sapiens
gaagaccuucugaagaucuca

SEQ ID NO: 950984 - RNA, 18 nt, Homo sapiens
gaagcucaacuguugcca

SEQ ID NO: 950985 - RNA, 20 nt, Homo sapiens
gaagcucaacuguugccagg

SEQ ID NO: 950986 - RNA, 15 nt, Homo sapiens
gaagcuguaugccac

SEQ ID NO: 950987 - RNA, 17 nt, Homo sapiens
gaaggagaaccgugaac

SEQ ID NO: 950988 - RNA, 17 nt, Homo sapiens
gaaggagaggauuuggc

SEQ ID NO: 950989 - RNA, 17 nt, Homo sapiens
gaagggacuagcuaucu

SEQ ID NO: 950990 - RNA, 20 nt, Homo sapiens
gaagucugcuuaccaaaaca

SEQ ID NO: 950991 - RNA, 22 nt, Homo sapiens
gaagucugcuuaccaaaacaua

SEQ ID NO: 950992 - RNA, 17 nt, Homo sapiens
gaagugugcugugacaa

SEQ ID NO: 950993 - RNA, 22 nt, Homo sapiens
gaagugugcugugacaagccaa

SEQ ID NO: 950994 - RNA, 15 nt, Homo sapiens
gaaguugcccuccag

SEQ ID NO: 950995 - RNA, 19 nt, Homo sapiens
gaauaaaauuguuauuuca

SEQ ID NO: 950996 - RNA, 16 nt, Homo sapiens
gaauaucaaugcccaa

SEQ ID NO: 950997 - RNA, 15 nt, Homo sapiens
gaauauccuauacug

SEQ ID NO: 950998 - RNA, 12 nt, Homo sapiens
gaauccauauca

SEQ ID NO: 950999 - RNA, 16 nt, Homo sapiens
gaauccauaucagcuc

SEQ ID NO: 951000 - RNA, 19 nt, Homo sapiens
gaaugaaugucagugugac

SEQ ID NO: 951001 - RNA, 22 nt, Homo sapiens
gaaugaaugucagugugacuga

SEQ ID NO: 951002 - RNA, 21 nt, Homo sapiens
gaaugauuaauuaaaacacaa

SEQ ID NO: 951003 - RNA, 14 nt, Homo sapiens
gaaugcauguguga

SEQ ID NO: 951004 - RNA, 18 nt, Homo sapiens
gaauguuuccuguggaaa

SEQ ID NO: 951005 - RNA, 20 nt, Homo sapiens
gaauguuuccuguggaaaua

SEQ ID NO: 951006 - RNA, 20 nt, Homo sapiens
gaauugaaccgucaauguga

SEQ ID NO: 951007 - RNA, 18 nt, Homo sapiens
aaagaugaagcugagaug

SEQ ID NO: 951008 - RNA, 12 nt, Homo sapiens
aaagcagugcau

SEQ ID NO: 951009 - RNA, 13 nt, Homo sapiens
aaagcagugcaug

SEQ ID NO: 951010 - RNA, 23 nt, Homo sapiens
aaagcagugcaugcugucccuua

SEQ ID NO: 951011 - RNA, 19 nt, Homo sapiens
aaagcgugguggacaugca

SEQ ID NO: 951012 - RNA, 21 nt, Homo sapiens
aaagcgugguggacaugcaca

SEQ ID NO: 951013 - RNA, 13 nt, Homo sapiens
aaagcuagcuuuc

SEQ ID NO: 951014 - RNA, 15 nt, Homo sapiens
aaagcugcuauccaa

SEQ ID NO: 951015 - RNA, 21 nt, Homo sapiens
aaaggcuggaugugcuuucau

SEQ ID NO: 951016 - RNA, 16 nt, Homo sapiens
aaagggcgggccuguu

SEQ ID NO: 951017 - RNA, 13 nt, Homo sapiens
aaaggucaucuca

SEQ ID NO: 951018 - RNA, 20 nt, Homo sapiens
aaaguguuuuucuuuaauca

SEQ ID NO: 951019 - RNA, 19 nt, Homo sapiens
aaaguuuaaaaagcucaca

SEQ ID NO: 951020 - RNA, 22 nt, Homo sapiens
aaauaaagccacuuuccucuuc

SEQ ID NO: 951021 - RNA, 16 nt, Homo sapiens
aaauaaauguguaaau

SEQ ID NO: 951022 - RNA, 15 nt, Homo sapiens
aaauaagacaacaga

SEQ ID NO: 951023 - RNA, 12 nt, Homo sapiens
aaauaaugauuu

SEQ ID NO: 951024 - RNA, 15 nt, Homo sapiens
aaauaauugggugac

SEQ ID NO: 951025 - RNA, 12 nt, Homo sapiens
aaauacacuaca

SEQ ID NO: 951026 - RNA, 12 nt, Homo sapiens
aaauagaacgaa

SEQ ID NO: 951027 - RNA, 22 nt, Homo sapiens
aaauaguuuacuucacuuucau

SEQ ID NO: 951028 - RNA, 16 nt, Homo sapiens
aaauauaaacuugugu

SEQ ID NO: 951029 - RNA, 18 nt, Homo sapiens
aaauaugcccaauuucau

SEQ ID NO: 951030 - RNA, 19 nt, Homo sapiens
aaauaugguuugaagugaa

SEQ ID NO: 951031 - RNA, 21 nt, Homo sapiens
aaauauuaucugaacuggacu

SEQ ID NO: 951032 - RNA, 20 nt, Homo sapiens
aaaucaugccuaguuauuca

SEQ ID NO: 951033 - RNA, 15 nt, Homo sapiens
aaaucuguuagcauu

SEQ ID NO: 951034 - RNA, 16 nt, Homo sapiens
aaaucuuuccaucuca

SEQ ID NO: 951035 - RNA, 17 nt, Homo sapiens
aaaugaaugccuuucaa

SEQ ID NO: 951036 - RNA, 16 nt, Homo sapiens
aaaugcaaacacugug

SEQ ID NO: 951037 - RNA, 15 nt, Homo sapiens
aaaugcaaauauugc

SEQ ID NO: 951038 - RNA, 23 nt, Homo sapiens
aaaugcaaggugaacaccacuuu

SEQ ID NO: 951039 - RNA, 20 nt, Homo sapiens
aaaugcaguccagugagaaa

SEQ ID NO: 951040 - RNA, 20 nt, Homo sapiens
aaaugcuauggaaauacauu

SEQ ID NO: 951041 - RNA, 22 nt, Homo sapiens
aaauggagggaggaauuuucau

SEQ ID NO: 951042 - RNA, 16 nt, Homo sapiens
aaauguauccagucug

SEQ ID NO: 951043 - RNA, 17 nt, Homo sapiens
aaauguauuuuucacaa

SEQ ID NO: 951044 - RNA, 22 nt, Homo sapiens
aaauguguucuguaauggggac

SEQ ID NO: 951045 - RNA, 15 nt, Homo sapiens
aaauguuucaaagac

SEQ ID NO: 951046 - RNA, 19 nt, Homo sapiens
aaauguuuuuauggccauu

SEQ ID NO: 951047 - RNA, 23 nt, Homo sapiens
aaauuguagaacauagaugcuac

SEQ ID NO: 951048 - RNA, 13 nt, Homo sapiens
aaauugugccaaa

SEQ ID NO: 951049 - RNA, 19 nt, Homo sapiens
aaauuguuaagaguaucau

SEQ ID NO: 951050 - RNA, 20 nt, Homo sapiens
aaauuuacaguuacugccua

SEQ ID NO: 951051 - RNA, 18 nt, Homo sapiens
aaauuuccuccacauuca

SEQ ID NO: 951052 - RNA, 17 nt, Homo sapiens
aaauuuggggacagauu

SEQ ID NO: 951053 - RNA, 17 nt, Homo sapiens
aaauuuuauaaugucau

SEQ ID NO: 951054 - RNA, 13 nt, Homo sapiens
aacaaaacuggau

SEQ ID NO: 951055 - RNA, 12 nt, Homo sapiens
aacaaagucuuu

SEQ ID NO: 951056 - RNA, 15 nt, Homo sapiens
aacaaguauuggaaa

SEQ ID NO: 951057 - RNA, 18 nt, Homo sapiens
aacaagugcucuuuccac

SEQ ID NO: 951058 - RNA, 13 nt, Homo sapiens
aacaauuuagcca

SEQ ID NO: 951059 - RNA, 23 nt, Homo sapiens
aacacauauugauagaugcaaga

SEQ ID NO: 951060 - RNA, 21 nt, Homo sapiens
aacaccacuuugucucugaga

SEQ ID NO: 951061 - RNA, 13 nt, Homo sapiens
aacacuaccaugc

SEQ ID NO: 951062 - RNA, 14 nt, Homo sapiens
aacacucacuuaau

SEQ ID NO: 951063 - RNA, 20 nt, Homo sapiens
aacacugcaguguuauuuuc

SEQ ID NO: 951064 - RNA, 15 nt, Homo sapiens
aacacuguacugcaa

SEQ ID NO: 951065 - RNA, 15 nt, Homo sapiens
aacacuuaacuaaaa

SEQ ID NO: 951066 - RNA, 18 nt, Homo sapiens
aacagacguuaccaauua

SEQ ID NO: 951067 - RNA, 17 nt, Homo sapiens
aacaggccgcacaucuc

SEQ ID NO: 951068 - RNA, 18 nt, Homo sapiens
aacaggguuucucagccu

SEQ ID NO: 951069 - RNA, 13 nt, Homo sapiens
aacaguccaaacu

SEQ ID NO: 951070 - RNA, 20 nt, Homo sapiens
aacaucuuuuucuacucgag

SEQ ID NO: 951071 - RNA, 15 nt, Homo sapiens
aacaugcucaugugu

SEQ ID NO: 951072 - RNA, 14 nt, Homo sapiens
aacauggaaguacu

SEQ ID NO: 951073 - RNA, 19 nt, Homo sapiens
aacauguggacuuuuacaa

SEQ ID NO: 951074 - RNA, 18 nt, Homo sapiens
aaccacugcgaccacaag

SEQ ID NO: 951075 - RNA, 20 nt, Homo sapiens
aacccaguguucagcauaga

SEQ ID NO: 951076 - RNA, 19 nt, Homo sapiens
aacccuacgaaagcacagu

SEQ ID NO: 951077 - RNA, 19 nt, Homo sapiens
aaccuggguuguugcagag

SEQ ID NO: 951078 - RNA, 17 nt, Homo sapiens
aaccugugcuuucaugu

SEQ ID NO: 951079 - RNA, 18 nt, Homo sapiens
aacgacagucccaguucc

SEQ ID NO: 951080 - RNA, 16 nt, Homo sapiens
aacuaaaauaguuuaa

SEQ ID NO: 951081 - RNA, 19 nt, Homo sapiens
aacuacauuaaaagcuuua

SEQ ID NO: 951082 - RNA, 23 nt, Homo sapiens
aacuacucagccuagcacaggcu

SEQ ID NO: 951083 - RNA, 20 nt, Homo sapiens
aacuagaguauaaaguaauu

SEQ ID NO: 951084 - RNA, 22 nt, Homo sapiens
aacucaacugucuauugucaca

SEQ ID NO: 951085 - RNA, 19 nt, Homo sapiens
aacucaucuauccaggcag

SEQ ID NO: 951086 - RNA, 20 nt, Homo sapiens
aacucauuuacagucauaau

SEQ ID NO: 951087 - RNA, 18 nt, Homo sapiens
aacuccaacauccacucu

SEQ ID NO: 951088 - RNA, 23 nt, Homo sapiens
aacuccaacauccacucucucuu

SEQ ID NO: 951089 - RNA, 18 nt, Homo sapiens
aacuccaggaaaacuguu

SEQ ID NO: 951090 - RNA, 14 nt, Homo sapiens
aacuccugaguuca

SEQ ID NO: 951091 - RNA, 18 nt, Homo sapiens
aacugaugagauacauuu

SEQ ID NO: 951092 - RNA, 18 nt, Homo sapiens
aacugauguauagcuuua

SEQ ID NO: 951093 - RNA, 22 nt, Homo sapiens
aacugcaucaagaugugacaug

SEQ ID NO: 951094 - RNA, 20 nt, Homo sapiens
aacuggagagcuuuacuuug

SEQ ID NO: 951095 - RNA, 18 nt, Homo sapiens
aacuguccaguccaguga

SEQ ID NO: 951096 - RNA, 22 nt, Homo sapiens
aacuguuuuugaagaagggaaa

SEQ ID NO: 951097 - RNA, 13 nt, Homo sapiens
aacuuaacgugau

SEQ ID NO: 951098 - RNA, 18 nt, Homo sapiens
aacuuaacgugaucauca

SEQ ID NO: 951099 - RNA, 20 nt, Homo sapiens
aacuuaaugugcugcugcuu

SEQ ID NO: 951100 - RNA, 23 nt, Homo sapiens
aacuuucaggggcugacucucca

SEQ ID NO: 951101 - RNA, 14 nt, Homo sapiens
aagaacccuucuca

SEQ ID NO: 951102 - RNA, 22 nt, Homo sapiens
aagaaggucucauuaucuccau

SEQ ID NO: 951103 - RNA, 17 nt, Homo sapiens
aagaauagaaaacuggg

SEQ ID NO: 951104 - RNA, 13 nt, Homo sapiens
aagaaugguggga

SEQ ID NO: 951105 - RNA, 19 nt, Homo sapiens
aagaauugaaaaaccauuu

SEQ ID NO: 951106 - RNA, 16 nt, Homo sapiens
aagacacguucuugcc

SEQ ID NO: 951107 - RNA, 21 nt, Homo sapiens
aagacacguucuugccagcuu

SEQ ID NO: 951108 - RNA, 20 nt, Homo sapiens
aagaccuucugaagaucuca

SEQ ID NO: 951109 - RNA, 22 nt, Homo sapiens
aagacugacaaagucauccucc

SEQ ID NO: 951110 - RNA, 23 nt, Homo sapiens
aagacuggaaaauaguccuccaa

SEQ ID NO: 951111 - RNA, 16 nt, Homo sapiens
aagacuuuucuuucag

SEQ ID NO: 951112 - RNA, 13 nt, Homo sapiens
aagagaugucaaa

SEQ ID NO: 951113 - RNA, 14 nt, Homo sapiens
aagagaugucaaaa

SEQ ID NO: 951114 - RNA, 19 nt, Homo sapiens
aagagaugucaaaauguga

SEQ ID NO: 951115 - RNA, 17 nt, Homo sapiens
aagagguaaaaaacugu

SEQ ID NO: 951116 - RNA, 22 nt, Homo sapiens
aagauaaaaucuucaacuaauu

SEQ ID NO: 951117 - RNA, 23 nt, Homo sapiens
aagauauuuuucagcuacagcaa

SEQ ID NO: 951118 - RNA, 11 nt, Homo sapiens
aagauguuggg

SEQ ID NO: 951119 - RNA, 14 nt, Homo sapiens
aagcacaaacuguc

SEQ ID NO: 951120 - RNA, 13 nt, Homo sapiens
aagcacacuugac

SEQ ID NO: 951121 - RNA, 22 nt, Homo sapiens
aagcagugcaugcugucccuua

SEQ ID NO: 951122 - RNA, 18 nt, Homo sapiens
aagcaguuaggcuguaca

SEQ ID NO: 951123 - RNA, 16 nt, Homo sapiens
aagcauucugugcaua

SEQ ID NO: 951124 - RNA, 18 nt, Homo sapiens
aagcccgucaucuucccu

SEQ ID NO: 951125 - RNA, 15 nt, Homo sapiens
aagccuccugcugag

SEQ ID NO: 951126 - RNA, 18 nt, Homo sapiens
aagcgugguggacaugca

SEQ ID NO: 951127 - RNA, 16 nt, Homo sapiens
aagcucuuguguauac

SEQ ID NO: 951128 - RNA, 22 nt, Homo sapiens
aagcugagaugggacaggauca

SEQ ID NO: 951129 - RNA, 17 nt, Homo sapiens
aagcuguuccacuucuc

SEQ ID NO: 951130 - RNA, 14 nt, Homo sapiens
aagcuuuagauuga

SEQ ID NO: 951131 - RNA, 18 nt, Homo sapiens
aaggaauauccagucaaa

SEQ ID NO: 951132 - RNA, 14 nt, Homo sapiens
aaggaguaccaugu

SEQ ID NO: 951133 - RNA, 20 nt, Homo sapiens
aaggcaacauuuccgaagac

SEQ ID NO: 951134 - RNA, 14 nt, Homo sapiens
aaggcacagcauuc

SEQ ID NO: 951135 - RNA, 18 nt, Homo sapiens
aaggcagcucccagguuu

SEQ ID NO: 951136 - RNA, 18 nt, Homo sapiens
aaggcucacaugcuccuu

SEQ ID NO: 951137 - RNA, 20 nt, Homo sapiens
aaggcucuaucugcugggcu

SEQ ID NO: 951138 - RNA, 16 nt, Homo sapiens
aaggucaccucacuca

SEQ ID NO: 951139 - RNA, 16 nt, Homo sapiens
agggugccuucuagcu

SEQ ID NO: 951140 - RNA, 16 nt, Homo sapiens
agguaaagaaaccaug

SEQ ID NO: 951141 - RNA, 23 nt, Homo sapiens
agguaacuucucccuucuccuga

SEQ ID NO: 951142 - RNA, 21 nt, Homo sapiens
agguaccaagaucacaaauag

SEQ ID NO: 951143 - RNA, 16 nt, Homo sapiens
aggucaugcaugccaa

SEQ ID NO: 951144 - RNA, 16 nt, Homo sapiens
agguccugugagcaaa

SEQ ID NO: 951145 - RNA, 21 nt, Homo sapiens
aggugaauaaacacacagauc

SEQ ID NO: 951146 - RNA, 20 nt, Homo sapiens
aggugugagccacagcacuc

SEQ ID NO: 951147 - RNA, 17 nt, Homo sapiens
agguguugucaagugau

SEQ ID NO: 951148 - RNA, 13 nt, Homo sapiens
agguuaugccaaa

SEQ ID NO: 951149 - RNA, 22 nt, Homo sapiens
agguuugguuugguuuuggaca

SEQ ID NO: 951150 - RNA, 14 nt, Homo sapiens
agguuuuucuugcu

SEQ ID NO: 951151 - RNA, 20 nt, Homo sapiens
aguaagagguuaugccaaaa

SEQ ID NO: 951152 - RNA, 15 nt, Homo sapiens
aguaauaacuguuag

SEQ ID NO: 951153 - RNA, 23 nt, Homo sapiens
aguacaggcauagccacuugcuc

SEQ ID NO: 951154 - RNA, 18 nt, Homo sapiens
aguagaauuaucucucau

SEQ ID NO: 951155 - RNA, 15 nt, Homo sapiens
aguagagucacugga

SEQ ID NO: 951156 - RNA, 23 nt, Homo sapiens
aguagcuaggugcacauauacau

SEQ ID NO: 951157 - RNA, 13 nt, Homo sapiens
aguaggaguggcu

SEQ ID NO: 951158 - RNA, 17 nt, Homo sapiens
aguaucauguacuacac

SEQ ID NO: 951159 - RNA, 14 nt, Homo sapiens
aguaugaagacacu

SEQ ID NO: 951160 - RNA, 23 nt, Homo sapiens
aguauucugaucaguugccaaag

SEQ ID NO: 951161 - RNA, 16 nt, Homo sapiens
aguauuuacugugcua

SEQ ID NO: 951162 - RNA, 20 nt, Homo sapiens
agucaagcucugucacccag

SEQ ID NO: 951163 - RNA, 16 nt, Homo sapiens
agucacguagcacaga

SEQ ID NO: 951164 - RNA, 23 nt, Homo sapiens
agucacuuaaacucaucuaucca

SEQ ID NO: 951165 - RNA, 20 nt, Homo sapiens
agucagcggagaggacccca

SEQ ID NO: 951166 - RNA, 22 nt, Homo sapiens
agucccaucucaccucuaggcc

SEQ ID NO: 951167 - RNA, 18 nt, Homo sapiens
agucucauuacagauuua

SEQ ID NO: 951168 - RNA, 16 nt, Homo sapiens
agucucuugauucaua

SEQ ID NO: 951169 - RNA, 18 nt, Homo sapiens
agucugcuuaccaaaaca

SEQ ID NO: 951170 - RNA, 10 nt, Homo sapiens
agucuucuca

SEQ ID NO: 951171 - RNA, 17 nt, Homo sapiens
agucuuuguacagacaa

SEQ ID NO: 951172 - RNA, 12 nt, Homo sapiens
agugaaaacuga

SEQ ID NO: 951173 - RNA, 12 nt, Homo sapiens
agugauccuccc

SEQ ID NO: 951174 - RNA, 14 nt, Homo sapiens
agugaugacggggu

SEQ ID NO: 951175 - RNA, 17 nt, Homo sapiens
agugauggcuuucagga

SEQ ID NO: 951176 - RNA, 14 nt, Homo sapiens
agugccaauccaag

SEQ ID NO: 951177 - RNA, 12 nt, Homo sapiens
agugcuccagua

SEQ ID NO: 951178 - RNA, 22 nt, Homo sapiens
aguggaccuaaagaagccagau

SEQ ID NO: 951179 - RNA, 15 nt, Homo sapiens
agugugacugaucuc

SEQ ID NO: 951180 - RNA, 17 nt, Homo sapiens
aguguguguuucuugcu

SEQ ID NO: 951181 - RNA, 18 nt, Homo sapiens
aguuaaagagacaaauag

SEQ ID NO: 951182 - RNA, 16 nt, Homo sapiens
aguuacuuacugccuu

SEQ ID NO: 951183 - RNA, 17 nt, Homo sapiens
aguuaucaacaugcaca

SEQ ID NO: 951184 - RNA, 18 nt, Homo sapiens
aguuauucauuguuaaua

SEQ ID NO: 951185 - RNA, 19 nt, Homo sapiens
aguuauugugaaaacagaa

SEQ ID NO: 951186 - RNA, 16 nt, Homo sapiens
aguucaagcaauccac

SEQ ID NO: 951187 - RNA, 15 nt, Homo sapiens
aguucaucuugaauu

SEQ ID NO: 951188 - RNA, 17 nt, Homo sapiens
aguucauucauacucaa

SEQ ID NO: 951189 - RNA, 18 nt, Homo sapiens
aguucuauuaucuggguu

SEQ ID NO: 951190 - RNA, 16 nt, Homo sapiens
aguugagcacaggcaa

SEQ ID NO: 951191 - RNA, 23 nt, Homo sapiens
aguugagcacaggcaacauuaca

SEQ ID NO: 951192 - RNA, 19 nt, Homo sapiens
aguugagcucuaucuucau

SEQ ID NO: 951193 - RNA, 21 nt, Homo sapiens
aguugccaaagaaucuaggaa

SEQ ID NO: 951194 - RNA, 21 nt, Homo sapiens
aguuggacaguaagauuuuau

SEQ ID NO: 951195 - RNA, 14 nt, Homo sapiens
aguuggugcucaau

SEQ ID NO: 951196 - RNA, 19 nt, Homo sapiens
aguuguauuuuaauaaaga

SEQ ID NO: 951197 - RNA, 13 nt, Homo sapiens
aguugucuguccu

SEQ ID NO: 951198 - RNA, 18 nt, Homo sapiens
aguuguuccuccacucua

SEQ ID NO: 951199 - RNA, 18 nt, Homo sapiens
aguuuacuucacuuucau

SEQ ID NO: 951200 - RNA, 17 nt, Homo sapiens
aguuucaguggagcuca

SEQ ID NO: 951201 - RNA, 17 nt, Homo sapiens
aguuuccucuguucuca

SEQ ID NO: 951202 - RNA, 14 nt, Homo sapiens
aguuugcauuccag

SEQ ID NO: 951203 - RNA, 19 nt, Homo sapiens
aguuuugucuuucucaggg

SEQ ID NO: 951204 - RNA, 22 nt, Homo sapiens
auaaaaacugcccauuguaacu

SEQ ID NO: 951205 - RNA, 24 nt, Homo sapiens
auaaacacacagaucugcaucuga

SEQ ID NO: 951206 - RNA, 16 nt, Homo sapiens
auaaacuuguacuuac

SEQ ID NO: 951207 - RNA, 17 nt, Homo sapiens
auaaacuuguacuuaca

SEQ ID NO: 951208 - RNA, 14 nt, Homo sapiens
auaaagaguucucc

SEQ ID NO: 951209 - RNA, 16 nt, Homo sapiens
auaaagccacuuuccu

SEQ ID NO: 951210 - RNA, 18 nt, Homo sapiens
auaaagccacuuuccucu

SEQ ID NO: 951211 - RNA, 17 nt, Homo sapiens
auaaaguuagaaucuau

SEQ ID NO: 951212 - RNA, 12 nt, Homo sapiens
auaaauguggau

SEQ ID NO: 951213 - RNA, 20 nt, Homo sapiens
auaaauuauuucaaguuuca

SEQ ID NO: 951214 - RNA, 14 nt, Homo sapiens
auaacaacaacuua

SEQ ID NO: 951215 - RNA, 21 nt, Homo sapiens
auaacacuguacugcaauaag

SEQ ID NO: 951216 - RNA, 15 nt, Homo sapiens
auaaccaacauuuua

SEQ ID NO: 951217 - RNA, 20 nt, Homo sapiens
auaacuggguuggcucucaa

SEQ ID NO: 951218 - RNA, 13 nt, Homo sapiens
auaagacuggaaa

SEQ ID NO: 951219 - RNA, 20 nt, Homo sapiens
auaagcugcucccugucuau

SEQ ID NO: 951220 - RNA, 13 nt, Homo sapiens
auaaguuauccaa

SEQ ID NO: 951221 - RNA, 15 nt, Homo sapiens
auaaucucuuuccau

SEQ ID NO: 951222 - RNA, 17 nt, Homo sapiens
auaaugaucugaaucug

SEQ ID NO: 951223 - RNA, 17 nt, Homo sapiens
auaauuacuuaauguga

SEQ ID NO: 951224 - RNA, 19 nt, Homo sapiens
auaauuagaguuuguguau

SEQ ID NO: 951225 - RNA, 12 nt, Homo sapiens
auacaaugcaug

SEQ ID NO: 951226 - RNA, 13 nt, Homo sapiens
auacagaccucca

SEQ ID NO: 951227 - RNA, 22 nt, Homo sapiens
auacaggcguacacaugcacgc

SEQ ID NO: 951228 - RNA, 12 nt, Homo sapiens
auacaguauuau

SEQ ID NO: 951229 - RNA, 23 nt, Homo sapiens
auacagugaucaguugcucucug

SEQ ID NO: 951230 - RNA, 19 nt, Homo sapiens
auaccaggcagccaaagag

SEQ ID NO: 951231 - RNA, 21 nt, Homo sapiens
auaccaugagaaaucaugccu

SEQ ID NO: 951232 - RNA, 14 nt, Homo sapiens
auaccucugggaaa

SEQ ID NO: 951233 - RNA, 18 nt, Homo sapiens
auacgucuugaucagaca

SEQ ID NO: 951234 - RNA, 22 nt, Homo sapiens
auacgucuugaucagacauuca

SEQ ID NO: 951235 - RNA, 19 nt, Homo sapiens
auacuaaauaaaacaaugu

SEQ ID NO: 951236 - RNA, 14 nt, Homo sapiens
auacucaccaaaau

SEQ ID NO: 951237 - RNA, 18 nt, Homo sapiens
auacucuguguaaucucu

SEQ ID NO: 951238 - RNA, 20 nt, Homo sapiens
auacugaaaaagaaugaaaa

SEQ ID NO: 951239 - RNA, 16 nt, Homo sapiens
auacuggacucuucaa

SEQ ID NO: 951240 - RNA, 22 nt, Homo sapiens
auacuucuuuauucacaguauc

SEQ ID NO: 951241 - RNA, 12 nt, Homo sapiens
auagaaguccau

SEQ ID NO: 951242 - RNA, 12 nt, Homo sapiens
auagaauccaaa

SEQ ID NO: 951243 - RNA, 13 nt, Homo sapiens
auagacaaaauca

SEQ ID NO: 951244 - RNA, 18 nt, Homo sapiens
auagaguuuaacagauau

SEQ ID NO: 951245 - RNA, 22 nt, Homo sapiens
auagauccucugauauacaauu

SEQ ID NO: 951246 - RNA, 15 nt, Homo sapiens
auaggacaaggggug

SEQ ID NO: 951247 - RNA, 19 nt, Homo sapiens
auaguauuggcaauaugaa

SEQ ID NO: 951248 - RNA, 16 nt, Homo sapiens
auaguuauagccagaa

SEQ ID NO: 951249 - RNA, 20 nt, Homo sapiens
auaguugagaugucaagaag

SEQ ID NO: 951250 - RNA, 16 nt, Homo sapiens
auauaaccucaaacaa

SEQ ID NO: 951251 - RNA, 20 nt, Homo sapiens
auauaacugucuuaguacac

SEQ ID NO: 951252 - RNA, 23 nt, Homo sapiens
auauaacugucuuaguacaccau

SEQ ID NO: 951253 - RNA, 15 nt, Homo sapiens
auauaauaauuacuu

SEQ ID NO: 951254 - RNA, 18 nt, Homo sapiens
auauacuaaccauuucuu

SEQ ID NO: 951255 - RNA, 22 nt, Homo sapiens
auaucacucuuguugugcucuu

SEQ ID NO: 951256 - RNA, 11 nt, Homo sapiens
auaucagcucu

SEQ ID NO: 951257 - RNA, 17 nt, Homo sapiens
auaucagcucugcauaa

SEQ ID NO: 951258 - RNA, 23 nt, Homo sapiens
auauccaaugaagaaggucucau

SEQ ID NO: 951259 - RNA, 15 nt, Homo sapiens
auauguggaguucau

SEQ ID NO: 951260 - RNA, 14 nt, Homo sapiens
auauuaauauguac

SEQ ID NO: 951261 - RNA, 21 nt, Homo sapiens
auauucuauguuaucagucuc

SEQ ID NO: 951262 - RNA, 20 nt, Homo sapiens
auauugagaucagcauucaa

SEQ ID NO: 951263 - RNA, 21 nt, Homo sapiens
auauuuauuauuuucauauaa

SEQ ID NO: 951264 - RNA, 16 nt, Homo sapiens
auauuucaauaacuua

SEQ ID NO: 951265 - RNA, 17 nt, Homo sapiens
auauuugaaagaaguca

SEQ ID NO: 951266 - RNA, 12 nt, Homo sapiens
aucaaagcacau

SEQ ID NO: 951267 - RNA, 21 nt, Homo sapiens
aucaacugcaucaagauguga

SEQ ID NO: 951268 - RNA, 15 nt, Homo sapiens
aucaagaugugacau

SEQ ID NO: 951269 - RNA, 14 nt, Homo sapiens
aucacaagucagca

SEQ ID NO: 951270 - RNA, 14 nt, Homo sapiens
aucaccacugacag

SEQ ID NO: 951271 - RNA, 20 nt, Homo sapiens
ccacacuaccaguuucacac

SEQ ID NO: 951272 - RNA, 19 nt, Homo sapiens
ccacagccccuugcuucua

SEQ ID NO: 951273 - RNA, 22 nt, Homo sapiens
ccaccugacacuaaccagaguc

SEQ ID NO: 951274 - RNA, 19 nt, Homo sapiens
ccacgcagagccccggagc

SEQ ID NO: 951275 - RNA, 19 nt, Homo sapiens
ccacuuucaccugggauga

SEQ ID NO: 951276 - RNA, 12 nt, Homo sapiens
ccagagcacugu

SEQ ID NO: 951277 - RNA, 21 nt, Homo sapiens
ccagcaucauguagugcauuu

SEQ ID NO: 951278 - RNA, 15 nt, Homo sapiens
ccagccugggcaaca

SEQ ID NO: 951279 - RNA, 14 nt, Homo sapiens
ccaggaaucuugaa

SEQ ID NO: 951280 - RNA, 18 nt, Homo sapiens
ccaggacaauuagaaaaa

SEQ ID NO: 951281 - RNA, 19 nt, Homo sapiens
ccaggagauggaauaucaa

SEQ ID NO: 951282 - RNA, 19 nt, Homo sapiens
ccaggagcagcgugcagga

SEQ ID NO: 951283 - RNA, 15 nt, Homo sapiens
ccaggcuggagugaa

SEQ ID NO: 951284 - RNA, 19 nt, Homo sapiens
ccaggcuggagugcagaag

SEQ ID NO: 951285 - RNA, 12 nt, Homo sapiens
ccagucaaagac

SEQ ID NO: 951286 - RNA, 21 nt, Homo sapiens
ccaguguccccaggggcacac

SEQ ID NO: 951287 - RNA, 22 nt, Homo sapiens
ccaguuauugugaaaacagaag

SEQ ID NO: 951288 - RNA, 23 nt, Homo sapiens
ccauaauuuuuauuauuaaucuc

SEQ ID NO: 951289 - RNA, 14 nt, Homo sapiens
ccauccucuguuac

SEQ ID NO: 951290 - RNA, 21 nt, Homo sapiens
ccaucguuacccauuucuuac

SEQ ID NO: 951291 - RNA, 19 nt, Homo sapiens
ccaucuccauugcauucau

SEQ ID NO: 951292 - RNA, 22 nt, Homo sapiens
ccaucuccauugcauucaugua

SEQ ID NO: 951293 - RNA, 23 nt, Homo sapiens
ccaucuguuugauacaguauuau

SEQ ID NO: 951294 - RNA, 24 nt, Homo sapiens
ccauucagccucgucucuuuacag

SEQ ID NO: 951295 - RNA, 13 nt, Homo sapiens
ccauuuguaaugu

SEQ ID NO: 951296 - RNA, 17 nt, Homo sapiens
ccauuugugauacuucc

SEQ ID NO: 951297 - RNA, 16 nt, Homo sapiens
cccaaacccuucagug

SEQ ID NO: 951298 - RNA, 16 nt, Homo sapiens
cccaauaggugaucuu

SEQ ID NO: 951299 - RNA, 12 nt, Homo sapiens
cccacaaaauau

SEQ ID NO: 951300 - RNA, 18 nt, Homo sapiens
cccacgccuccauccaca

SEQ ID NO: 951301 - RNA, 16 nt, Homo sapiens
cccacugaacaugcuc

SEQ ID NO: 951302 - RNA, 23 nt, Homo sapiens
cccacuuuuuguuguucauuauu

SEQ ID NO: 951303 - RNA, 18 nt, Homo sapiens
cccagaccuagggauccu

SEQ ID NO: 951304 - RNA, 20 nt, Homo sapiens
cccagcuggagcauugcagc

SEQ ID NO: 951305 - RNA, 16 nt, Homo sapiens
cccaggucacaugcac

SEQ ID NO: 951306 - RNA, 19 nt, Homo sapiens
cccaugugggcugaaggau

SEQ ID NO: 951307 - RNA, 21 nt, Homo sapiens
cccaugugggcugaaggaugg

SEQ ID NO: 951308 - RNA, 22 nt, Homo sapiens
cccauuucuuaccaugcauuuc

SEQ ID NO: 951309 - RNA, 12 nt, Homo sapiens
ccccaccugcuc

SEQ ID NO: 951310 - RNA, 21 nt, Homo sapiens
ccccacuuuuuguuguucauu

SEQ ID NO: 951311 - RNA, 20 nt, Homo sapiens
ccccaucguuacccauuucu

SEQ ID NO: 951312 - RNA, 14 nt, Homo sapiens
cccccgugccaaau

SEQ ID NO: 951313 - RNA, 17 nt, Homo sapiens
cccgagaagcacuugag

SEQ ID NO: 951314 - RNA, 17 nt, Homo sapiens
cccgagggacuccagau

SEQ ID NO: 951315 - RNA, 15 nt, Homo sapiens
cccugggguuuccac

SEQ ID NO: 951316 - RNA, 17 nt, Homo sapiens
cccuuuucccugcauuc

SEQ ID NO: 951317 - RNA, 18 nt, Homo sapiens
ccgcagggcgcuccggca

SEQ ID NO: 951318 - RNA, 15 nt, Homo sapiens
ccggccgcgcaccgc

SEQ ID NO: 951319 - RNA, 16 nt, Homo sapiens
ccgggcuggccugaca

SEQ ID NO: 951320 - RNA, 23 nt, Homo sapiens
ccgggcuggccugacacaauggu

SEQ ID NO: 951321 - RNA, 21 nt, Homo sapiens
ccggugugaggaggggcggga

SEQ ID NO: 951322 - RNA, 11 nt, Homo sapiens
ccgugaacugg

SEQ ID NO: 951323 - RNA, 14 nt, Homo sapiens
ccgugacagcacuu

SEQ ID NO: 951324 - RNA, 14 nt, Homo sapiens
ccuaaccuggguug

SEQ ID NO: 951325 - RNA, 13 nt, Homo sapiens
ccuaaugucugac

SEQ ID NO: 951326 - RNA, 22 nt, Homo sapiens
ccuacccuuuaaagguaacuuc

SEQ ID NO: 951327 - RNA, 17 nt, Homo sapiens
ccucaaaauuaccaaac

SEQ ID NO: 951328 - RNA, 14 nt, Homo sapiens
ccucacucucgcca

SEQ ID NO: 951329 - RNA, 21 nt, Homo sapiens
ccucagcagccucacugcauc

SEQ ID NO: 951330 - RNA, 23 nt, Homo sapiens
ccucauuagauuacauuguaguu

SEQ ID NO: 951331 - RNA, 15 nt, Homo sapiens
ccuccaugauuccaa

SEQ ID NO: 951332 - RNA, 18 nt, Homo sapiens
ccucccuguaaugcacuc

SEQ ID NO: 951333 - RNA, 22 nt, Homo sapiens
ccucccuguaaugcacuccugc

SEQ ID NO: 951334 - RNA, 20 nt, Homo sapiens
ccucccuucuucugagugaa

SEQ ID NO: 951335 - RNA, 15 nt, Homo sapiens
ccuccuaaauuucca

SEQ ID NO: 951336 - RNA, 16 nt, Homo sapiens
ccuccuauaucacucu

SEQ ID NO: 951337 - RNA, 21 nt, Homo sapiens
ccuccuugcugauuugcacac

SEQ ID NO: 951338 - RNA, 20 nt, Homo sapiens
ccucggggcaggaagucccu

SEQ ID NO: 951339 - RNA, 14 nt, Homo sapiens
ccucugcagccuga

SEQ ID NO: 951340 - RNA, 18 nt, Homo sapiens
ccucugccuuugugcucu

SEQ ID NO: 951341 - RNA, 19 nt, Homo sapiens
ccucuggcuccugggccug

SEQ ID NO: 951342 - RNA, 17 nt, Homo sapiens
ccucuucuucuccaaag

SEQ ID NO: 951343 - RNA, 16 nt, Homo sapiens
ccucuuguucauguca

SEQ ID NO: 951344 - RNA, 20 nt, Homo sapiens
ccucuuuuaaugucaucucu

SEQ ID NO: 951345 - RNA, 16 nt, Homo sapiens
ccugaaauguuuccag

SEQ ID NO: 951346 - RNA, 15 nt, Homo sapiens
ccugagguugggagu

SEQ ID NO: 951347 - RNA, 20 nt, Homo sapiens
ccugauuuccauuugcaaca

SEQ ID NO: 951348 - RNA, 13 nt, Homo sapiens
ccugcacaggcug

SEQ ID NO: 951349 - RNA, 15 nt, Homo sapiens
ccugcaggaguuucu

SEQ ID NO: 951350 - RNA, 15 nt, Homo sapiens
ccugccaagagucaa

SEQ ID NO: 951351 - RNA, 14 nt, Homo sapiens
ccugcgcaaagggc

SEQ ID NO: 951352 - RNA, 15 nt, Homo sapiens
ccugcgcaaagggcg

SEQ ID NO: 951353 - RNA, 20 nt, Homo sapiens
ccugcuacugccaaccucgc

SEQ ID NO: 951354 - RNA, 16 nt, Homo sapiens
ccugcuggugggcaug

SEQ ID NO: 951355 - RNA, 19 nt, Homo sapiens
ccugcuucugcugccuguu

SEQ ID NO: 951356 - RNA, 12 nt, Homo sapiens
ccuggaguggca

SEQ ID NO: 951357 - RNA, 21 nt, Homo sapiens
ccuggauuuucuuucuaugua

SEQ ID NO: 951358 - RNA, 21 nt, Homo sapiens
ccuggcuuuuauucauccuca

SEQ ID NO: 951359 - RNA, 22 nt, Homo sapiens
ccugggguccccccucccugua

SEQ ID NO: 951360 - RNA, 14 nt, Homo sapiens
ccuguaaugcacuc

SEQ ID NO: 951361 - RNA, 22 nt, Homo sapiens
ccuguccagcaggggucuccca

SEQ ID NO: 951362 - RNA, 23 nt, Homo sapiens
ccugugaugucaugaaagcaccu

SEQ ID NO: 951363 - RNA, 18 nt, Homo sapiens
ccuguggaaauaugcaac

SEQ ID NO: 951364 - RNA, 20 nt, Homo sapiens
ccuguuaggggaaaauagua

SEQ ID NO: 951365 - RNA, 21 nt, Homo sapiens
ccuguucuuccuaccaaauau

SEQ ID NO: 951366 - RNA, 13 nt, Homo sapiens
ccuuccaccucag

SEQ ID NO: 951367 - RNA, 22 nt, Homo sapiens
ccuucccgcagcaccagccuga

SEQ ID NO: 951368 - RNA, 16 nt, Homo sapiens
ccuucuauacuuucuc

SEQ ID NO: 951369 - RNA, 19 nt, Homo sapiens
ccuucuauacuuucucaca

SEQ ID NO: 951370 - RNA, 13 nt, Homo sapiens
ccuucucccucau

SEQ ID NO: 951371 - RNA, 15 nt, Homo sapiens
ccuugccucugcucu

SEQ ID NO: 951372 - RNA, 16 nt, Homo sapiens
ccuugggaugggcaca

SEQ ID NO: 951373 - RNA, 15 nt, Homo sapiens
ccuuguaugacauau

SEQ ID NO: 951374 - RNA, 15 nt, Homo sapiens
ccuuguguacuuucu

SEQ ID NO: 951375 - RNA, 16 nt, Homo sapiens
ccuuguuaaaauccaa

SEQ ID NO: 951376 - RNA, 15 nt, Homo sapiens
ccuuuagcuuucuaa

SEQ ID NO: 951377 - RNA, 19 nt, Homo sapiens
ccuuuaggccaucucagcu

SEQ ID NO: 951378 - RNA, 19 nt, Homo sapiens
ccuuucaauaggaaaaacu

SEQ ID NO: 951379 - RNA, 14 nt, Homo sapiens
ccuuuccuuuccca

SEQ ID NO: 951380 - RNA, 14 nt, Homo sapiens
ccuuucgucugcca

SEQ ID NO: 951381 - RNA, 18 nt, Homo sapiens
ccuuugcgcucuggguuu

SEQ ID NO: 951382 - RNA, 14 nt, Homo sapiens
ccuuugugcucugu

SEQ ID NO: 951383 - RNA, 14 nt, Homo sapiens
cgaacagcuuauuu

SEQ ID NO: 951384 - RNA, 12 nt, Homo sapiens
cgacagucccag

SEQ ID NO: 951385 - RNA, 13 nt, Homo sapiens
cgagucuggagac

SEQ ID NO: 951386 - RNA, 13 nt, Homo sapiens
cgagugcauuugc

SEQ ID NO: 951387 - RNA, 11 nt, Homo sapiens
cgaguuacaga

SEQ ID NO: 951388 - RNA, 14 nt, Homo sapiens
cgaguuacagacaa

SEQ ID NO: 951389 - RNA, 15 nt, Homo sapiens
cgaguuacagacaaa

SEQ ID NO: 951390 - RNA, 21 nt, Homo sapiens
cgauucuccugccucagucuc

SEQ ID NO: 951391 - RNA, 11 nt, Homo sapiens
cgcacaguauu

SEQ ID NO: 951392 - RNA, 23 nt, Homo sapiens
cgcacccccacuuucgccuccuc

SEQ ID NO: 951393 - RNA, 15 nt, Homo sapiens
cgcaggcaucugauu

SEQ ID NO: 951394 - RNA, 14 nt, Homo sapiens
cgccaugcaugaug

SEQ ID NO: 951395 - RNA, 19 nt, Homo sapiens
cgccccuggacaggcuucg

SEQ ID NO: 951396 - RNA, 19 nt, Homo sapiens
cgcccuguguccacaguga

SEQ ID NO: 951397 - RNA, 20 nt, Homo sapiens
cgcuuaaauaagacaacaga

SEQ ID NO: 951398 - RNA, 13 nt, Homo sapiens
cgcuugcacacau

SEQ ID NO: 951399 - RNA, 17 nt, Homo sapiens
cggagguccuuuggaca

SEQ ID NO: 951400 - RNA, 14 nt, Homo sapiens
cggccucccaaagu

SEQ ID NO: 951401 - RNA, 12 nt, Homo sapiens
cggucuucacaa

SEQ ID NO: 951402 - RNA, 20 nt, Homo sapiens
cgguuaaaacauaagccaca

SEQ ID NO: 951403 - RNA, 17 nt, Homo sapiens
cguaguuugcauuccag

SEQ ID NO: 951404 - RNA, 21 nt, Homo sapiens
gaauuucccaaagcagugcau

SEQ ID NO: 951405 - RNA, 16 nt, Homo sapiens
gaauuuucauugccuu

SEQ ID NO: 951406 - RNA, 22 nt, Homo sapiens
gacaaagcgugguggacaugca

SEQ ID NO: 951407 - RNA, 16 nt, Homo sapiens
gacaccuuucagucuc

SEQ ID NO: 951408 - RNA, 14 nt, Homo sapiens
gacacguucuugcc

SEQ ID NO: 951409 - RNA, 23 nt, Homo sapiens
gacacuucaaugggagugaacau

SEQ ID NO: 951410 - RNA, 16 nt, Homo sapiens
gacagaagguugccag

SEQ ID NO: 951411 - RNA, 17 nt, Homo sapiens
gacaggauggcugugug

SEQ ID NO: 951412 - RNA, 17 nt, Homo sapiens
gacauaaucuaguuuua

SEQ ID NO: 951413 - RNA, 20 nt, Homo sapiens
gacauauuacaacacuuuaa

SEQ ID NO: 951414 - RNA, 18 nt, Homo sapiens
gacccucggggcaggaag

SEQ ID NO: 951415 - RNA, 20 nt, Homo sapiens
gaccuacuuccuccuagcaa

SEQ ID NO: 951416 - RNA, 23 nt, Homo sapiens
gaccuccaccugggagaugcugg

SEQ ID NO: 951417 - RNA, 13 nt, Homo sapiens
gacucugugaucu

SEQ ID NO: 951418 - RNA, 21 nt, Homo sapiens
gacugcuagaaccaagcacua

SEQ ID NO: 951419 - RNA, 12 nt, Homo sapiens
gacugcuuuuag

SEQ ID NO: 951420 - RNA, 14 nt, Homo sapiens
gacugggaagcauu

SEQ ID NO: 951421 - RNA, 17 nt, Homo sapiens
gacuucacaaaaugcaa

SEQ ID NO: 951422 - RNA, 13 nt, Homo sapiens
gacuucgaaaaca

SEQ ID NO: 951423 - RNA, 23 nt, Homo sapiens
gacuucgggggcggcucugggaa

SEQ ID NO: 951424 - RNA, 23 nt, Homo sapiens
gacuuuacuaguggggcaaugac

SEQ ID NO: 951425 - RNA, 19 nt, Homo sapiens
gacuuuauggagaguucag

SEQ ID NO: 951426 - RNA, 19 nt, Homo sapiens
gacuuuccuagacaauaac

SEQ ID NO: 951427 - RNA, 20 nt, Homo sapiens
gagaaacauuauugucaacu

SEQ ID NO: 951428 - RNA, 14 nt, Homo sapiens
gagaaaccucggaa

SEQ ID NO: 951429 - RNA, 15 nt, Homo sapiens
gagaaauugugccaa

SEQ ID NO: 951430 - RNA, 14 nt, Homo sapiens
gagaagcacuugag

SEQ ID NO: 951431 - RNA, 12 nt, Homo sapiens
gagaagccucau

SEQ ID NO: 951432 - RNA, 15 nt, Homo sapiens
gagacagucaggaag

SEQ ID NO: 951433 - RNA, 14 nt, Homo sapiens
gagacuauguguca

SEQ ID NO: 951434 - RNA, 11 nt, Homo sapiens
gagacuuccuu

SEQ ID NO: 951435 - RNA, 15 nt, Homo sapiens
gagacuuggaccugg

SEQ ID NO: 951436 - RNA, 15 nt, Homo sapiens
gagagggauggcuca

SEQ ID NO: 951437 - RNA, 18 nt, Homo sapiens
gagaguggcuuugucagu

SEQ ID NO: 951438 - RNA, 20 nt, Homo sapiens
gagaucacgccauugcacuc

SEQ ID NO: 951439 - RNA, 15 nt, Homo sapiens
gagaugucuguucua

SEQ ID NO: 951440 - RNA, 16 nt, Homo sapiens
gagauuggcuuugccu

SEQ ID NO: 951441 - RNA, 16 nt, Homo sapiens
gagauuugccaaaaac

SEQ ID NO: 951442 - RNA, 23 nt, Homo sapiens
gagcaaagacuuaaucauaucaa

SEQ ID NO: 951443 - RNA, 21 nt, Homo sapiens
gagcaagcgaaagagcaaagu

SEQ ID NO: 951444 - RNA, 17 nt, Homo sapiens
gagcaccagguguuaaa

SEQ ID NO: 951445 - RNA, 20 nt, Homo sapiens
gagcauagguagcuugucca

SEQ ID NO: 951446 - RNA, 20 nt, Homo sapiens
gagcauugcagcuccaggaa

SEQ ID NO: 951447 - RNA, 16 nt, Homo sapiens
gagcccaaaugaccaa

SEQ ID NO: 951448 - RNA, 16 nt, Homo sapiens
gagcccggcagugcac

SEQ ID NO: 951449 - RNA, 12 nt, Homo sapiens
gagcccuuccag

SEQ ID NO: 951450 - RNA, 17 nt, Homo sapiens
gagcugcuuccagugga

SEQ ID NO: 951451 - RNA, 19 nt, Homo sapiens
gagcuuaagugacuuccuc

SEQ ID NO: 951452 - RNA, 21 nt, Homo sapiens
gagcuuaagugacuuccucga

SEQ ID NO: 951453 - RNA, 20 nt, Homo sapiens
gaggaaaagauauggaguua

SEQ ID NO: 951454 - RNA, 19 nt, Homo sapiens
gaggaccugcgcaaagggc

SEQ ID NO: 951455 - RNA, 21 nt, Homo sapiens
gaggaccugcgcaaagggcgg

SEQ ID NO: 951456 - RNA, 23 nt, Homo sapiens
gaggaguugucuguccuggucag

SEQ ID NO: 951457 - RNA, 23 nt, Homo sapiens
gaggccugaaauguuuccaggca

SEQ ID NO: 951458 - RNA, 21 nt, Homo sapiens
gaggccugggugugaccugac

SEQ ID NO: 951459 - RNA, 13 nt, Homo sapiens
gagggaaacaaaa

SEQ ID NO: 951460 - RNA, 18 nt, Homo sapiens
gagggaagcccacccgcc

SEQ ID NO: 951461 - RNA, 23 nt, Homo sapiens
gagggacagcucacgaggcuugg

SEQ ID NO: 951462 - RNA, 17 nt, Homo sapiens
gagggacuucccuagaa

SEQ ID NO: 951463 - RNA, 17 nt, Homo sapiens
gaggucagauggcacaa

SEQ ID NO: 951464 - RNA, 22 nt, Homo sapiens
gagguccuucuguagugccaug

SEQ ID NO: 951465 - RNA, 20 nt, Homo sapiens
gagucaacaggucacuugau

SEQ ID NO: 951466 - RNA, 15 nt, Homo sapiens
gaguccaaaaucauu

SEQ ID NO: 951467 - RNA, 23 nt, Homo sapiens
gagucugagaacccccagaccaa

SEQ ID NO: 951468 - RNA, 18 nt, Homo sapiens
gaguuaaugauggcagag

SEQ ID NO: 951469 - RNA, 16 nt, Homo sapiens
gaguuacagacaaagc

SEQ ID NO: 951470 - RNA, 14 nt, Homo sapiens
gaguucaggagaaa

SEQ ID NO: 951471 - RNA, 21 nt, Homo sapiens
gauaaugcauaaauguuauau

SEQ ID NO: 951472 - RNA, 12 nt, Homo sapiens
gauacauuugau

SEQ ID NO: 951473 - RNA, 14 nt, Homo sapiens
gauagacuucgaaa

SEQ ID NO: 951474 - RNA, 16 nt, Homo sapiens
gauauucauacuuucc

SEQ ID NO: 951475 - RNA, 22 nt, Homo sapiens
gauauuuuucagcuacagcaaa

SEQ ID NO: 951476 - RNA, 16 nt, Homo sapiens
gaucaaaguugaugaa

SEQ ID NO: 951477 - RNA, 17 nt, Homo sapiens
gaucaaccaaguuacac

SEQ ID NO: 951478 - RNA, 16 nt, Homo sapiens
gaucacacacaugcac

SEQ ID NO: 951479 - RNA, 17 nt, Homo sapiens
gaucacacacaugcaca

SEQ ID NO: 951480 - RNA, 18 nt, Homo sapiens
gaucacagcucacuacag

SEQ ID NO: 951481 - RNA, 15 nt, Homo sapiens
gaucagaucuuacaa

SEQ ID NO: 951482 - RNA, 19 nt, Homo sapiens
gaucccagcucacugcagc

SEQ ID NO: 951483 - RNA, 18 nt, Homo sapiens
gaucuccccgaaucucaa

SEQ ID NO: 951484 - RNA, 18 nt, Homo sapiens
gaucugaaucuguuucua

SEQ ID NO: 951485 - RNA, 18 nt, Homo sapiens
gaucugcaucugauagaa

SEQ ID NO: 951486 - RNA, 16 nt, Homo sapiens
gaucugucuuguaaua

SEQ ID NO: 951487 - RNA, 18 nt, Homo sapiens
gaucuuuuugcagacuag

SEQ ID NO: 951488 - RNA, 18 nt, Homo sapiens
gaugaccaaucucuguga

SEQ ID NO: 951489 - RNA, 23 nt, Homo sapiens
gaugacuuucgauuaugcuuugu

SEQ ID NO: 951490 - RNA, 16 nt, Homo sapiens
gaugagucaguccuug

SEQ ID NO: 951491 - RNA, 15 nt, Homo sapiens
gaugaguugagcucu

SEQ ID NO: 951492 - RNA, 21 nt, Homo sapiens
gauggauccgugacagcacuu

SEQ ID NO: 951493 - RNA, 19 nt, Homo sapiens
gaugggguugggcucugcg

SEQ ID NO: 951494 - RNA, 18 nt, Homo sapiens
gaugguaacugcacacau

SEQ ID NO: 951495 - RNA, 16 nt, Homo sapiens
gauguaccauguuaaa

SEQ ID NO: 951496 - RNA, 20 nt, Homo sapiens
gaugucaucacacucuccau

SEQ ID NO: 951497 - RNA, 13 nt, Homo sapiens
gaugugcuuucau

SEQ ID NO: 951498 - RNA, 21 nt, Homo sapiens
gauguuggucaaaugaccuag

SEQ ID NO: 951499 - RNA, 15 nt, Homo sapiens
gauucagucuugccu

SEQ ID NO: 951500 - RNA, 13 nt, Homo sapiens
gauucugcagcug

SEQ ID NO: 951501 - RNA, 18 nt, Homo sapiens
gauucuuuuuucaaugua

SEQ ID NO: 951502 - RNA, 21 nt, Homo sapiens
gauugauuuuuuuucuuuaaa

SEQ ID NO: 951503 - RNA, 13 nt, Homo sapiens
gauugcacuugau

SEQ ID NO: 951504 - RNA, 13 nt, Homo sapiens
gauuucaaaugca

SEQ ID NO: 951505 - RNA, 19 nt, Homo sapiens
gcaaaaaaaaaaaugucaa

SEQ ID NO: 951506 - RNA, 20 nt, Homo sapiens
gcaaaaaaaaaaauuacauu

SEQ ID NO: 951507 - RNA, 21 nt, Homo sapiens
gcaaaaaaaaaaauuacauua

SEQ ID NO: 951508 - RNA, 14 nt, Homo sapiens
gcaaaaaauacccu

SEQ ID NO: 951509 - RNA, 20 nt, Homo sapiens
gcaaaagucauugcugacag

SEQ ID NO: 951510 - RNA, 19 nt, Homo sapiens
gcaaagguauuaguacaau

SEQ ID NO: 951511 - RNA, 17 nt, Homo sapiens
gcaaaguguaugugacc

SEQ ID NO: 951512 - RNA, 17 nt, Homo sapiens
gcaaauguuguauuuca

SEQ ID NO: 951513 - RNA, 16 nt, Homo sapiens
gcaacacucacugccu

SEQ ID NO: 951514 - RNA, 18 nt, Homo sapiens
gcaaccagagcacuguau

SEQ ID NO: 951515 - RNA, 13 nt, Homo sapiens
gcaaggcugcuaa

SEQ ID NO: 951516 - RNA, 23 nt, Homo sapiens
gcaauaccauauggaaugccaaa

SEQ ID NO: 951517 - RNA, 22 nt, Homo sapiens
gcaaucccccaucguuacccau

SEQ ID NO: 951518 - RNA, 21 nt, Homo sapiens
gcaaugaucagacuugauuua

SEQ ID NO: 951519 - RNA, 15 nt, Homo sapiens
gcacaaagaugugca

SEQ ID NO: 951520 - RNA, 18 nt, Homo sapiens
gcacacaggugcacagac

SEQ ID NO: 951521 - RNA, 17 nt, Homo sapiens
gcacacaugguuuccaa

SEQ ID NO: 951522 - RNA, 20 nt, Homo sapiens
gcacacaugguuuccaaggg

SEQ ID NO: 951523 - RNA, 13 nt, Homo sapiens
gcacacauuuaac

SEQ ID NO: 951524 - RNA, 15 nt, Homo sapiens
gcacacccauucaca

SEQ ID NO: 951525 - RNA, 18 nt, Homo sapiens
gcacaccuguaaucccag

SEQ ID NO: 951526 - RNA, 19 nt, Homo sapiens
gcaccacucaagaccaaau

SEQ ID NO: 951527 - RNA, 23 nt, Homo sapiens
gcaccagguguuaaaaaccauua

SEQ ID NO: 951528 - RNA, 18 nt, Homo sapiens
gcaccccuccuccuugcu

SEQ ID NO: 951529 - RNA, 21 nt, Homo sapiens
gcaccgggcuggccugacaca

SEQ ID NO: 951530 - RNA, 16 nt, Homo sapiens
gcaccuucacucucca

SEQ ID NO: 951531 - RNA, 14 nt, Homo sapiens
gcacuaacacaugc

SEQ ID NO: 951532 - RNA, 18 nt, Homo sapiens
gcacuaacacaugcacac

SEQ ID NO: 951533 - RNA, 20 nt, Homo sapiens
gcacuaacacaugcacacac

SEQ ID NO: 951534 - RNA, 14 nt, Homo sapiens
gcacuacaguuuua

SEQ ID NO: 951535 - RNA, 15 nt, Homo sapiens
gcacuagaagcacag

SEQ ID NO: 951536 - RNA, 20 nt, Homo sapiens
uuucuucccccccaagauag

SEQ ID NO: 951537 - RNA, 15 nt, Homo sapiens
uuugaaccugugcaa

SEQ ID NO: 951538 - RNA, 13 nt, Homo sapiens
uuugaagucuugu

SEQ ID NO: 951539 - RNA, 17 nt, Homo sapiens
uuugcacacguccaugu

SEQ ID NO: 951540 - RNA, 19 nt, Homo sapiens
uuugguggggccauccaca

SEQ ID NO: 951541 - RNA, 14 nt, Homo sapiens
uuugguuuuggaca

SEQ ID NO: 951542 - RNA, 12 nt, Homo sapiens
uuugucacugaa

SEQ ID NO: 951543 - RNA, 16 nt, Homo sapiens
uuuuaaugucaucucu

SEQ ID NO: 951544 - RNA, 18 nt, Homo sapiens
uuuuagcgguuugcaaac

SEQ ID NO: 951545 - RNA, 16 nt, Homo sapiens
uuuuaucacuugccgu

SEQ ID NO: 951546 - RNA, 11 nt, Homo sapiens
uuuucaucaca

SEQ ID NO: 951547 - RNA, 14 nt, Homo sapiens
uuuuccaacagggg

SEQ ID NO: 951548 - RNA, 15 nt, Homo sapiens
uuuuccaacaggggc

SEQ ID NO: 951549 - RNA, 22 nt, Homo sapiens
uuuucgccaaggcucacaugcu

SEQ ID NO: 951550 - RNA, 22 nt, Homo sapiens
uuuucuugaggcagggucucac

SEQ ID NO: 951551 - RNA, 19 nt, Homo sapiens
uuuucuuuaaaauguauuu

SEQ ID NO: 951552 - RNA, 14 nt, Homo sapiens
uuuugaaaggcaca

SEQ ID NO: 951553 - RNA, 13 nt, Homo sapiens
uuuuguaagugcu

SEQ ID NO: 951554 - RNA, 22 nt, Homo sapiens
uuuuguagagacagggucucac

SEQ ID NO: 951555 - RNA, 21 nt, Homo sapiens
uuuuguaucaccucuucacaa

SEQ ID NO: 951556 - RNA, 15 nt, Homo sapiens
uuuuguauuauugcu

SEQ ID NO: 951557 - RNA, 22 nt, Homo sapiens
uuuuuuaaaaagaugauuggaa

SEQ ID NO: 951558 - RNA, 18 nt, Homo sapiens
gaauuggaaaggaaaaga

SEQ ID NO: 951559 - RNA, 15 nt, Homo sapiens
gaauuucuuguuucu

SEQ ID NO: 951560 - RNA, 15 nt, Homo sapiens
gacaaauaguaggcu

SEQ ID NO: 951561 - RNA, 19 nt, Homo sapiens
gacagaagaaacuacccuc

SEQ ID NO: 951562 - RNA, 20 nt, Homo sapiens
gacaguuuguaaauguuauu

SEQ ID NO: 951563 - RNA, 14 nt, Homo sapiens
gacauccugugaug

SEQ ID NO: 951564 - RNA, 19 nt, Homo sapiens
gacauuuugggcuggauaa

SEQ ID NO: 951565 - RNA, 18 nt, Homo sapiens
gaccccaccugcucuuuc

SEQ ID NO: 951566 - RNA, 22 nt, Homo sapiens
gaccccgccugcucuuuccucc

SEQ ID NO: 951567 - RNA, 18 nt, Homo sapiens
gacccugaggguuuccac

SEQ ID NO: 951568 - RNA, 18 nt, Homo sapiens
gaccuacuuccuccuagc

SEQ ID NO: 951569 - RNA, 16 nt, Homo sapiens
gaccuggauguuauau

SEQ ID NO: 951570 - RNA, 13 nt, Homo sapiens
gacuacuugauau

SEQ ID NO: 951571 - RNA, 17 nt, Homo sapiens
gacuagugaaaaaucua

SEQ ID NO: 951572 - RNA, 13 nt, Homo sapiens
gacucuccaggga

SEQ ID NO: 951573 - RNA, 15 nt, Homo sapiens
gacucugccuuccag

SEQ ID NO: 951574 - RNA, 16 nt, Homo sapiens
gacucuucgaugugcc

SEQ ID NO: 951575 - RNA, 17 nt, Homo sapiens
gacugcaauuucuccaa

SEQ ID NO: 951576 - RNA, 20 nt, Homo sapiens
gacuuaagcacacuugacau

SEQ ID NO: 951577 - RNA, 14 nt, Homo sapiens
gacuugauuuacaa

SEQ ID NO: 951578 - RNA, 18 nt, Homo sapiens
gacuugauuuacaagcau

SEQ ID NO: 951579 - RNA, 23 nt, Homo sapiens
gacuuuguauaguucacuuacuc

SEQ ID NO: 951580 - RNA, 13 nt, Homo sapiens
gagaaacuuccuu

SEQ ID NO: 951581 - RNA, 19 nt, Homo sapiens
gagaaaguuuaaaauggaa

SEQ ID NO: 951582 - RNA, 16 nt, Homo sapiens
gagaaauaaagcacau

SEQ ID NO: 951583 - RNA, 12 nt, Homo sapiens
gagaagugcagc

SEQ ID NO: 951584 - RNA, 15 nt, Homo sapiens
gagaaugcuggcaaa

SEQ ID NO: 951585 - RNA, 21 nt, Homo sapiens
gagacuaugugucaugauuuc

SEQ ID NO: 951586 - RNA, 17 nt, Homo sapiens
gagacucugugaucuaa

SEQ ID NO: 951587 - RNA, 20 nt, Homo sapiens
gagacucugugaucuaagca

SEQ ID NO: 951588 - RNA, 22 nt, Homo sapiens
gagacucugugaucuaagcagu

SEQ ID NO: 951589 - RNA, 13 nt, Homo sapiens
gagagauggcuca

SEQ ID NO: 951590 - RNA, 16 nt, Homo sapiens
gagagcgccacccgcc

SEQ ID NO: 951591 - RNA, 11 nt, Homo sapiens
gagauuugcca

SEQ ID NO: 951592 - RNA, 16 nt, Homo sapiens
gagcaagaacauucaa

SEQ ID NO: 951593 - RNA, 19 nt, Homo sapiens
gagcaaggcugcuaagugg

SEQ ID NO: 951594 - RNA, 17 nt, Homo sapiens
gagcaagucccaucuca

SEQ ID NO: 951595 - RNA, 12 nt, Homo sapiens
gagcagugcagc

SEQ ID NO: 951596 - RNA, 11 nt, Homo sapiens
gagcagugggg

SEQ ID NO: 951597 - RNA, 17 nt, Homo sapiens
gagcauagguagcuugu

SEQ ID NO: 951598 - RNA, 14 nt, Homo sapiens
gagccugggaugau

SEQ ID NO: 951599 - RNA, 21 nt, Homo sapiens
gagcucuaucuucauguacuc

SEQ ID NO: 951600 - RNA, 18 nt, Homo sapiens
gagcuucaacuacuucuc

SEQ ID NO: 951601 - RNA, 18 nt, Homo sapiens
gaggaugucccugaagug

SEQ ID NO: 951602 - RNA, 14 nt, Homo sapiens
gaggcagcuagcca

SEQ ID NO: 951603 - RNA, 13 nt, Homo sapiens
gaggcagggucuc

SEQ ID NO: 951604 - RNA, 14 nt, Homo sapiens
gaggcaugugauga

SEQ ID NO: 951605 - RNA, 23 nt, Homo sapiens
gaggccaaacacccaagcacaaa

SEQ ID NO: 951606 - RNA, 20 nt, Homo sapiens
gaggccccgccugcucuuuc

SEQ ID NO: 951607 - RNA, 23 nt, Homo sapiens
gaggccugggugugaccugacac

SEQ ID NO: 951608 - RNA, 13 nt, Homo sapiens
gaggccugugcua

SEQ ID NO: 951609 - RNA, 14 nt, Homo sapiens
gaggccugugcuag

SEQ ID NO: 951610 - RNA, 21 nt, Homo sapiens
gaggccuucagaaaagacacu

SEQ ID NO: 951611 - RNA, 20 nt, Homo sapiens
gaggcgcaggacaccaugaa

SEQ ID NO: 951612 - RNA, 19 nt, Homo sapiens
cgcuugcacacaugcacac

SEQ ID NO: 951613 - RNA, 15 nt, Homo sapiens
cggccggccuggggc

SEQ ID NO: 951614 - RNA, 12 nt, Homo sapiens
cgggaagggugg

SEQ ID NO: 951615 - RNA, 21 nt, Homo sapiens
cguaauggggacucuccaggc

SEQ ID NO: 951616 - RNA, 17 nt, Homo sapiens
cguacuuucacaucucu

SEQ ID NO: 951617 - RNA, 18 nt, Homo sapiens
cgucccacugagucucau

SEQ ID NO: 951618 - RNA, 19 nt, Homo sapiens
cgucuugaucagacauuca

SEQ ID NO: 951619 - RNA, 19 nt, Homo sapiens
cgugccaaauccugggcau

SEQ ID NO: 951620 - RNA, 20 nt, Homo sapiens
cguggggguggccacuccug

SEQ ID NO: 951621 - RNA, 11 nt, Homo sapiens
cguggugugag

SEQ ID NO: 951622 - RNA, 22 nt, Homo sapiens
cgugugcccacugaacaugcuc

SEQ ID NO: 951623 - RNA, 15 nt, Homo sapiens
cuaaacuguuuucau

SEQ ID NO: 951624 - RNA, 12 nt, Homo sapiens
cuaaagacagaa

SEQ ID NO: 951625 - RNA, 12 nt, Homo sapiens
cuaacacaugca

SEQ ID NO: 951626 - RNA, 15 nt, Homo sapiens
cuaacacaugcacac

SEQ ID NO: 951627 - RNA, 14 nt, Homo sapiens
cuaacagccagcuu

SEQ ID NO: 951628 - RNA, 22 nt, Homo sapiens
cuaagaaauccagcuucauaau

SEQ ID NO: 951629 - RNA, 13 nt, Homo sapiens
cuaaucugaaugu

SEQ ID NO: 951630 - RNA, 20 nt, Homo sapiens
cuacccucagucuacacuca

SEQ ID NO: 951631 - RNA, 14 nt, Homo sapiens
cuacccugcacauu

SEQ ID NO: 951632 - RNA, 20 nt, Homo sapiens
cuacgugugccccucucaug

SEQ ID NO: 951633 - RNA, 21 nt, Homo sapiens
cuacucagccuagcacaggcu

SEQ ID NO: 951634 - RNA, 17 nt, Homo sapiens
cuacucgaguuacagac

SEQ ID NO: 951635 - RNA, 18 nt, Homo sapiens
cuacucgaguuacagaca

SEQ ID NO: 951636 - RNA, 13 nt, Homo sapiens
cuacuuccuccua

SEQ ID NO: 951637 - RNA, 15 nt, Homo sapiens
cuacuuccuccuagc

SEQ ID NO: 951638 - RNA, 14 nt, Homo sapiens
cuacuucucuugca

SEQ ID NO: 951639 - RNA, 17 nt, Homo sapiens
cuagaaacaaggauucu

SEQ ID NO: 951640 - RNA, 15 nt, Homo sapiens
cuagaaccaagcacu

SEQ ID NO: 951641 - RNA, 19 nt, Homo sapiens
cuagaaccaagcacuacca

SEQ ID NO: 951642 - RNA, 23 nt, Homo sapiens
cuagcauuaaguaaagugaaguc

SEQ ID NO: 951643 - RNA, 23 nt, Homo sapiens
cuaggucugagaacucaggcuuu

SEQ ID NO: 951644 - RNA, 18 nt, Homo sapiens
cuauaagagacaaaguuu

SEQ ID NO: 951645 - RNA, 15 nt, Homo sapiens
cuauaauguuucccu

SEQ ID NO: 951646 - RNA, 18 nt, Homo sapiens
cuauacugguuauaguug

SEQ ID NO: 951647 - RNA, 18 nt, Homo sapiens
cuauauuuauuugacuca

SEQ ID NO: 951648 - RNA, 20 nt, Homo sapiens
cuauauuuauuugacucagc

SEQ ID NO: 951649 - RNA, 20 nt, Homo sapiens
cuauauuugcuaauaccaac

SEQ ID NO: 951650 - RNA, 14 nt, Homo sapiens
cuaucaaagcacau

SEQ ID NO: 951651 - RNA, 15 nt, Homo sapiens
cuaucaaagcacaua

SEQ ID NO: 951652 - RNA, 14 nt, Homo sapiens
cuaucuacaaugug

SEQ ID NO: 951653 - RNA, 14 nt, Homo sapiens
cuaugggugagcau

SEQ ID NO: 951654 - RNA, 16 nt, Homo sapiens
cuaugugggucuguga

SEQ ID NO: 951655 - RNA, 13 nt, Homo sapiens
cuauguguacugu

SEQ ID NO: 951656 - RNA, 12 nt, Homo sapiens
cuauguuugugu

SEQ ID NO: 951657 - RNA, 15 nt, Homo sapiens
cuauuaucuggguuu

SEQ ID NO: 951658 - RNA, 12 nt, Homo sapiens
cuauucauuaca

SEQ ID NO: 951659 - RNA, 15 nt, Homo sapiens
cuauugugaccacag

SEQ ID NO: 951660 - RNA, 21 nt, Homo sapiens
cuauuuuuuacuacauaauua

SEQ ID NO: 951661 - RNA, 15 nt, Homo sapiens
cucaaauaauaauaa

SEQ ID NO: 951662 - RNA, 19 nt, Homo sapiens
cucaacaagugcuccugaa

SEQ ID NO: 951663 - RNA, 16 nt, Homo sapiens
cucaacacaugagaag

SEQ ID NO: 951664 - RNA, 16 nt, Homo sapiens
cucaacucacuagaug

SEQ ID NO: 951665 - RNA, 12 nt, Homo sapiens
cucaaucaugaa

SEQ ID NO: 951666 - RNA, 16 nt, Homo sapiens
cucaaugaaugggaug

SEQ ID NO: 951667 - RNA, 12 nt, Homo sapiens
cucaaugcauga

SEQ ID NO: 951668 - RNA, 15 nt, Homo sapiens
cucaaugcaugauga

SEQ ID NO: 951669 - RNA, 22 nt, Homo sapiens
cucaauucauauuuaugaaucu

SEQ ID NO: 951670 - RNA, 16 nt, Homo sapiens
cucacaucauguaaua

SEQ ID NO: 951671 - RNA, 13 nt, Homo sapiens
cucacaugcuccu

SEQ ID NO: 951672 - RNA, 15 nt, Homo sapiens
cucacauguggcucc

SEQ ID NO: 951673 - RNA, 17 nt, Homo sapiens
cauaaagaaacacuuuc

SEQ ID NO: 951674 - RNA, 23 nt, Homo sapiens
cauaaagcugggaggccaaacac

SEQ ID NO: 951675 - RNA, 14 nt, Homo sapiens
cauaaucucuuucc

SEQ ID NO: 951676 - RNA, 23 nt, Homo sapiens
cauaaucucuuuccaucuuacuu

SEQ ID NO: 951677 - RNA, 18 nt, Homo sapiens
cauaaugacuuaagcaca

SEQ ID NO: 951678 - RNA, 14 nt, Homo sapiens
cauaauuuccauga

SEQ ID NO: 951679 - RNA, 22 nt, Homo sapiens
cauacaucuaagucaguuucac

SEQ ID NO: 951680 - RNA, 21 nt, Homo sapiens
cauacucugugcaaggaaauu

SEQ ID NO: 951681 - RNA, 22 nt, Homo sapiens
cauacucuguguaaucucugau

SEQ ID NO: 951682 - RNA, 14 nt, Homo sapiens
cauauaauuugcca

SEQ ID NO: 951683 - RNA, 12 nt, Homo sapiens
cauaucagcucu

SEQ ID NO: 951684 - RNA, 19 nt, Homo sapiens
cauaucagcucugcauaag

SEQ ID NO: 951685 - RNA, 13 nt, Homo sapiens
cauauggaaaucc

SEQ ID NO: 951686 - RNA, 16 nt, Homo sapiens
cauauggaaugccaaa

SEQ ID NO: 951687 - RNA, 17 nt, Homo sapiens
cauauggaaugccaaaa

SEQ ID NO: 951688 - RNA, 15 nt, Homo sapiens
cauauuagcaucaug

SEQ ID NO: 951689 - RNA, 19 nt, Homo sapiens
cauauugauagaugcaaga

SEQ ID NO: 951690 - RNA, 14 nt, Homo sapiens
cauauuguuugugc

SEQ ID NO: 951691 - RNA, 14 nt, Homo sapiens
caucaagaugugac

SEQ ID NO: 951692 - RNA, 22 nt, Homo sapiens
caucagaaauuuucuacaguac

SEQ ID NO: 951693 - RNA, 22 nt, Homo sapiens
caucagugaauccugaaacugg

SEQ ID NO: 951694 - RNA, 18 nt, Homo sapiens
caucauggaucaaccaag

SEQ ID NO: 951695 - RNA, 19 nt, Homo sapiens
caucauggaucaaccaagu

SEQ ID NO: 951696 - RNA, 15 nt, Homo sapiens
caucauuugcauaug

SEQ ID NO: 951697 - RNA, 19 nt, Homo sapiens
cauccacacacagcagcuc

SEQ ID NO: 951698 - RNA, 20 nt, Homo sapiens
cauccagaguucugugacac

SEQ ID NO: 951699 - RNA, 14 nt, Homo sapiens
caucccggggccau

SEQ ID NO: 951700 - RNA, 20 nt, Homo sapiens
caucuaagucaguuucacau

SEQ ID NO: 951701 - RNA, 22 nt, Homo sapiens
caucucuuguaaauacaugucc

SEQ ID NO: 951702 - RNA, 11 nt, Homo sapiens
caucuuucuaa

SEQ ID NO: 951703 - RNA, 15 nt, Homo sapiens
caugaucacagcuca

SEQ ID NO: 951704 - RNA, 18 nt, Homo sapiens
caugcacacccauucaca

SEQ ID NO: 951705 - RNA, 16 nt, Homo sapiens
caugccuccugcacac

SEQ ID NO: 951706 - RNA, 20 nt, Homo sapiens
cauggaucaaccaaguuaca

SEQ ID NO: 951707 - RNA, 13 nt, Homo sapiens
cauggguuccucc

SEQ ID NO: 951708 - RNA, 15 nt, Homo sapiens
caugguccugugccc

SEQ ID NO: 951709 - RNA, 19 nt, Homo sapiens
cauguacuacacuucugaa

SEQ ID NO: 951710 - RNA, 17 nt, Homo sapiens
cauguacuuucccugug

SEQ ID NO: 951711 - RNA, 20 nt, Homo sapiens
cauguacuuucccuguguac

SEQ ID NO: 951712 - RNA, 21 nt, Homo sapiens
cauguagaauuauaacuaauu

SEQ ID NO: 951713 - RNA, 17 nt, Homo sapiens
cauguauacuccauaga

SEQ ID NO: 951714 - RNA, 19 nt, Homo sapiens
caugucuguuuacacuucu

SEQ ID NO: 951715 - RNA, 20 nt, Homo sapiens
caugucuuuccuauuugcac

SEQ ID NO: 951716 - RNA, 16 nt, Homo sapiens
caugugcagacacuca

SEQ ID NO: 951717 - RNA, 19 nt, Homo sapiens
cauguucaccaagauuugg

SEQ ID NO: 951718 - RNA, 16 nt, Homo sapiens
cauguugaaggugccc

SEQ ID NO: 951719 - RNA, 17 nt, Homo sapiens
cauguugcccagaauuu

SEQ ID NO: 951720 - RNA, 22 nt, Homo sapiens
cauguuuauccauguacuuucc

SEQ ID NO: 951721 - RNA, 23 nt, Homo sapiens
cauguuucuguauuguacaugua

SEQ ID NO: 951722 - RNA, 12 nt, Homo sapiens
cauuaguuucag

SEQ ID NO: 951723 - RNA, 14 nt, Homo sapiens
cauuaucuccauga

SEQ ID NO: 951724 - RNA, 15 nt, Homo sapiens
cauuauucuuucuaa

SEQ ID NO: 951725 - RNA, 18 nt, Homo sapiens
cauuauuuugauugauuu

SEQ ID NO: 951726 - RNA, 15 nt, Homo sapiens
cauucaguuaucacu

SEQ ID NO: 951727 - RNA, 23 nt, Homo sapiens
cauucuuuucagcuuguuucuau

SEQ ID NO: 951728 - RNA, 20 nt, Homo sapiens
cauugagaaauaaagcacau

SEQ ID NO: 951729 - RNA, 11 nt, Homo sapiens
cauugcugaga

SEQ ID NO: 951730 - RNA, 16 nt, Homo sapiens
cauuguuaugcacuuu

SEQ ID NO: 951731 - RNA, 17 nt, Homo sapiens
cauuguuaugcacuuuu

SEQ ID NO: 951732 - RNA, 20 nt, Homo sapiens
cauuucacgggcaacacuca

SEQ ID NO: 951733 - RNA, 14 nt, Homo sapiens
cauuuccuacccuu

SEQ ID NO: 951734 - RNA, 15 nt, Homo sapiens
cauuuggaccacagc

SEQ ID NO: 951735 - RNA, 23 nt, Homo sapiens
cauuuguuguuguuuuuccucaa

SEQ ID NO: 951736 - RNA, 15 nt, Homo sapiens
cauuuuacugucugu

SEQ ID NO: 951737 - RNA, 17 nt, Homo sapiens
ccaaaaucguagguguu

SEQ ID NO: 951738 - RNA, 19 nt, Homo sapiens
ccaaaccugguaaauuuua

SEQ ID NO: 951739 - RNA, 19 nt, Homo sapiens
ccaaagcuugccacuuucc

SEQ ID NO: 951740 - RNA, 16 nt, Homo sapiens
ccaaauaaauguguaa

SEQ ID NO: 951741 - RNA, 18 nt, Homo sapiens
ccaaauaaauguguaaau

SEQ ID NO: 951742 - RNA, 23 nt, Homo sapiens
ccaaaugacaagucacacccucc

SEQ ID NO: 951743 - RNA, 16 nt, Homo sapiens
aguuauguggauuuca

SEQ ID NO: 951744 - RNA, 14 nt, Homo sapiens
aguuauguguuaaa

SEQ ID NO: 951745 - RNA, 18 nt, Homo sapiens
aguucuauuucuaucugc

SEQ ID NO: 951746 - RNA, 19 nt, Homo sapiens
aguucuccuuguacuugaa

SEQ ID NO: 951747 - RNA, 16 nt, Homo sapiens
aguucugaaaacuguu

SEQ ID NO: 951748 - RNA, 19 nt, Homo sapiens
aguugaugaaauaucaaga

SEQ ID NO: 951749 - RNA, 13 nt, Homo sapiens
aguuguuggcaag

SEQ ID NO: 951750 - RNA, 13 nt, Homo sapiens
aguuuccaugugg

SEQ ID NO: 951751 - RNA, 15 nt, Homo sapiens
aguuuucuaaauguu

SEQ ID NO: 951752 - RNA, 19 nt, Homo sapiens
auaaaagugucacuaagaa

SEQ ID NO: 951753 - RNA, 21 nt, Homo sapiens
auaaaauauacaaacaugugg

SEQ ID NO: 951754 - RNA, 19 nt, Homo sapiens
auaaaaucuuuccaucuca

SEQ ID NO: 951755 - RNA, 12 nt, Homo sapiens
auaaaaugaggg

SEQ ID NO: 951756 - RNA, 17 nt, Homo sapiens
auaaagaagaaaauaac

SEQ ID NO: 951757 - RNA, 14 nt, Homo sapiens
auaaagccacuuuc

SEQ ID NO: 951758 - RNA, 15 nt, Homo sapiens
auaaagccacuuucc

SEQ ID NO: 951759 - RNA, 22 nt, Homo sapiens
auaaagcugggaggccaaacac

SEQ ID NO: 951760 - RNA, 21 nt, Homo sapiens
auaaaguaauuguaugugcuu

SEQ ID NO: 951761 - RNA, 15 nt, Homo sapiens
auaaauauucuagca

SEQ ID NO: 951762 - RNA, 17 nt, Homo sapiens
auaaauguguaaaugug

SEQ ID NO: 951763 - RNA, 18 nt, Homo sapiens
auaacaagccaaacauuc

SEQ ID NO: 951764 - RNA, 19 nt, Homo sapiens
auaacaagccaaacauucu

SEQ ID NO: 951765 - RNA, 19 nt, Homo sapiens
auaacacuguacugcaaua

SEQ ID NO: 951766 - RNA, 16 nt, Homo sapiens
auaaccaacauuuuaa

SEQ ID NO: 951767 - RNA, 17 nt, Homo sapiens
uaagacaacagaugugg

SEQ ID NO: 951768 - RNA, 17 nt, Homo sapiens
uaagagguuaugccaaa

SEQ ID NO: 951769 - RNA, 16 nt, Homo sapiens
uaagaguaucauguac

SEQ ID NO: 951770 - RNA, 20 nt, Homo sapiens
uaagcacacuugacaucaac

SEQ ID NO: 951771 - RNA, 16 nt, Homo sapiens
uaagcaguugcaauga

SEQ ID NO: 951772 - RNA, 21 nt, Homo sapiens
uaagccacaggccccaguuau

SEQ ID NO: 951773 - RNA, 13 nt, Homo sapiens
uaagugacuuccu

SEQ ID NO: 951774 - RNA, 17 nt, Homo sapiens
uaaguuucaguggagcu

SEQ ID NO: 951775 - RNA, 21 nt, Homo sapiens
uaauaauaacaacaacuuaau

SEQ ID NO: 951776 - RNA, 14 nt, Homo sapiens
uaauaauuacuuaa

SEQ ID NO: 951777 - RNA, 13 nt, Homo sapiens
uaauagaaaacug

SEQ ID NO: 951778 - RNA, 19 nt, Homo sapiens
ccaucucucagcaguuauu

SEQ ID NO: 951779 - RNA, 20 nt, Homo sapiens
ccaucuggcagacuuacaaa

SEQ ID NO: 951780 - RNA, 15 nt, Homo sapiens
ccaucuguuugauac

SEQ ID NO: 951781 - RNA, 16 nt, Homo sapiens
ccaucuguuugauaca

SEQ ID NO: 951782 - RNA, 17 nt, Homo sapiens
ccaugagaaaucaugcc

SEQ ID NO: 951783 - RNA, 15 nt, Homo sapiens
ccauggccccagcug

SEQ ID NO: 951784 - RNA, 20 nt, Homo sapiens
ccauguugcccagaauuuca

SEQ ID NO: 951785 - RNA, 21 nt, Homo sapiens
ccauguuuauccauguacuuu

SEQ ID NO: 951786 - RNA, 15 nt, Homo sapiens
ccauuauaaaaucuu

SEQ ID NO: 951787 - RNA, 15 nt, Homo sapiens
ccauucagccucguc

SEQ ID NO: 951788 - RNA, 20 nt, Homo sapiens
ccauuucuuaccaugcauuu

SEQ ID NO: 951789 - RNA, 16 nt, Homo sapiens
ccauuugugauacuuc

SEQ ID NO: 951790 - RNA, 14 nt, Homo sapiens
cccaacaagugcuc

SEQ ID NO: 951791 - RNA, 22 nt, Homo sapiens
cccaacaagugcucuuuccacc

SEQ ID NO: 951792 - RNA, 18 nt, Homo sapiens
cccaauuugaauucaauu

SEQ ID NO: 951793 - RNA, 18 nt, Homo sapiens
cccacugaacaugcucau

SEQ ID NO: 951794 - RNA, 19 nt, Homo sapiens
cccacuggaggcaugugau

SEQ ID NO: 951795 - RNA, 20 nt, Homo sapiens
cccacuggaggcaugugaug

SEQ ID NO: 951796 - RNA, 19 nt, Homo sapiens
cccacuuuuuguuguucau

SEQ ID NO: 951797 - RNA, 21 nt, Homo sapiens
cccacuuuuuguuguucauua

SEQ ID NO: 951798 - RNA, 15 nt, Homo sapiens
cccagaccuagggau

SEQ ID NO: 951799 - RNA, 15 nt, Homo sapiens
cccagauugcugcaa

SEQ ID NO: 951800 - RNA, 19 nt, Homo sapiens
cccagcguggggguggcca

SEQ ID NO: 951801 - RNA, 21 nt, Homo sapiens
cccagcugggaagaacaugcu

SEQ ID NO: 951802 - RNA, 16 nt, Homo sapiens
cccauuugggauuuuc

SEQ ID NO: 951803 - RNA, 13 nt, Homo sapiens
ccccacugaagaa

SEQ ID NO: 951804 - RNA, 21 nt, Homo sapiens
ccccaucuccauugcauucau

SEQ ID NO: 951805 - RNA, 16 nt, Homo sapiens
ccccaugucaccacaa

SEQ ID NO: 951806 - RNA, 13 nt, Homo sapiens
ccccccaguggac

SEQ ID NO: 951807 - RNA, 22 nt, Homo sapiens
cccccuuuccaucuguuugaua

SEQ ID NO: 951808 - RNA, 22 nt, Homo sapiens
ccccugcagcuccucugccuuu

SEQ ID NO: 951809 - RNA, 14 nt, Homo sapiens
cccgagaagcacuu

SEQ ID NO: 951810 - RNA, 16 nt, Homo sapiens
cccgagagcugggacu

SEQ ID NO: 951811 - RNA, 19 nt, Homo sapiens
cccgagagcugggacucag

SEQ ID NO: 951812 - RNA, 13 nt, Homo sapiens
cccgccccagaga

SEQ ID NO: 951813 - RNA, 12 nt, Homo sapiens
cccgugccaaau

SEQ ID NO: 951814 - RNA, 14 nt, Homo sapiens
cccuaaaaauucca

SEQ ID NO: 951815 - RNA, 16 nt, Homo sapiens
cccuacgaaagcacag

SEQ ID NO: 951816 - RNA, 18 nt, Homo sapiens
cccuccuccuugcugauu

SEQ ID NO: 951817 - RNA, 13 nt, Homo sapiens
cccucucaugguc

SEQ ID NO: 951818 - RNA, 18 nt, Homo sapiens
cccucuggcacuccagaa

SEQ ID NO: 951819 - RNA, 18 nt, Homo sapiens
cccugaauuuugcuuccu

SEQ ID NO: 951820 - RNA, 16 nt, Homo sapiens
cccugaggguuuccac

SEQ ID NO: 951821 - RNA, 13 nt, Homo sapiens
cccugcuggacca

SEQ ID NO: 951822 - RNA, 19 nt, Homo sapiens
cccuggaaucagaagcacu

SEQ ID NO: 951823 - RNA, 22 nt, Homo sapiens
cccuggacaggcuucgucucag

SEQ ID NO: 951824 - RNA, 17 nt, Homo sapiens
cccuggauaagucacuu

SEQ ID NO: 951825 - RNA, 23 nt, Homo sapiens
cccuuucacacuguggugucucu

SEQ ID NO: 951826 - RNA, 18 nt, Homo sapiens
cccuuugggaaagcucuu

SEQ ID NO: 951827 - RNA, 16 nt, Homo sapiens
ccgagaagcacuugag

SEQ ID NO: 951828 - RNA, 22 nt, Homo sapiens
ccgagagaugacacuagucaga

SEQ ID NO: 951829 - RNA, 21 nt, Homo sapiens
ccgcgcucugccccuccgucc

SEQ ID NO: 951830 - RNA, 20 nt, Homo sapiens
ccgcugugucuaugaacuag

SEQ ID NO: 951831 - RNA, 16 nt, Homo sapiens
ccggcaacucaucuca

SEQ ID NO: 951832 - RNA, 14 nt, Homo sapiens
ccgguuaucaguug

SEQ ID NO: 951833 - RNA, 21 nt, Homo sapiens
ccuaaauagguuuuucuugcu

SEQ ID NO: 951834 - RNA, 19 nt, Homo sapiens
ccuaaggagccugggauga

SEQ ID NO: 951835 - RNA, 18 nt, Homo sapiens
ccuaauuaaacuaugaug

SEQ ID NO: 951836 - RNA, 21 nt, Homo sapiens
ccuaggucauuuguagauaua

SEQ ID NO: 951837 - RNA, 11 nt, Homo sapiens
ccuaucuguaa

SEQ ID NO: 951838 - RNA, 17 nt, Homo sapiens
ccuaugguaacugauga

SEQ ID NO: 951839 - RNA, 15 nt, Homo sapiens
ccuaugguuuugcug

SEQ ID NO: 951840 - RNA, 13 nt, Homo sapiens
ccuauguucacuc

SEQ ID NO: 951841 - RNA, 15 nt, Homo sapiens
ccuauguuuguguau

SEQ ID NO: 951842 - RNA, 16 nt, Homo sapiens
ccuauuucauuaguag

SEQ ID NO: 951843 - RNA, 17 nt, Homo sapiens
ccuauuuuaggcuauua

SEQ ID NO: 951844 - RNA, 15 nt, Homo sapiens
ccucaacucacuaga

SEQ ID NO: 951845 - RNA, 23 nt, Homo sapiens
ccucagucuacacucacaaucau

SEQ ID NO: 951846 - RNA, 15 nt, Homo sapiens
ccucauauacuugaa

SEQ ID NO: 951847 - RNA, 21 nt, Homo sapiens
ccucauauacuugaauauuau

SEQ ID NO: 951848 - RNA, 20 nt, Homo sapiens
ccucauuuaagaaaaaucau

SEQ ID NO: 951849 - RNA, 21 nt, Homo sapiens
ccucauuuaagaaaaaucaua

SEQ ID NO: 951850 - RNA, 13 nt, Homo sapiens
ccuccauccagaa

SEQ ID NO: 951851 - RNA, 11 nt, Homo sapiens
ccuccauuuca

SEQ ID NO: 951852 - RNA, 14 nt, Homo sapiens
ccucccucauuuaa

SEQ ID NO: 951853 - RNA, 15 nt, Homo sapiens
ccucccuucuucuga

SEQ ID NO: 951854 - RNA, 23 nt, Homo sapiens
ccuccugauuucccuaaggagcc

SEQ ID NO: 951855 - RNA, 12 nt, Homo sapiens
ccuccugcugag

SEQ ID NO: 951856 - RNA, 17 nt, Homo sapiens
ccucgcuccaacuccaa

SEQ ID NO: 951857 - RNA, 14 nt, Homo sapiens
ccucuuaagacacu

SEQ ID NO: 951858 - RNA, 13 nt, Homo sapiens
ccugaaaauccaa

SEQ ID NO: 951859 - RNA, 18 nt, Homo sapiens
ccugaaccguuacaaaag

SEQ ID NO: 951860 - RNA, 20 nt, Homo sapiens
ccugaaccguuacaaaagaa

SEQ ID NO: 951861 - RNA, 12 nt, Homo sapiens
ccugaagugaug

SEQ ID NO: 951862 - RNA, 22 nt, Homo sapiens
ccugacacuaaccagagucagc

SEQ ID NO: 951863 - RNA, 16 nt, Homo sapiens
ccugagggaagcccac

SEQ ID NO: 951864 - RNA, 18 nt, Homo sapiens
ccugaguagcugggacua

SEQ ID NO: 951865 - RNA, 12 nt, Homo sapiens
ccugcacaggcu

SEQ ID NO: 951866 - RNA, 21 nt, Homo sapiens
ccugcacauuguuaugcacuu

SEQ ID NO: 951867 - RNA, 20 nt, Homo sapiens
ccugcagcuccucugccuuu

SEQ ID NO: 951868 - RNA, 20 nt, Homo sapiens
ccugccgacggagccacugg

SEQ ID NO: 951869 - RNA, 22 nt, Homo sapiens
ccugcuacaguagcugugggga

SEQ ID NO: 951870 - RNA, 17 nt, Homo sapiens
ccugguuuucauuauuu

SEQ ID NO: 951871 - RNA, 17 nt, Homo sapiens
ccugucaccaugauucu

SEQ ID NO: 951872 - RNA, 22 nt, Homo sapiens
ccugucaccaugauucugucca

SEQ ID NO: 951873 - RNA, 17 nt, Homo sapiens
ccuguggaaauaugcaa

SEQ ID NO: 951874 - RNA, 18 nt, Homo sapiens
ccuuacuagauucauaau

SEQ ID NO: 951875 - RNA, 11 nt, Homo sapiens
ccuucagaaaa

SEQ ID NO: 951876 - RNA, 17 nt, Homo sapiens
ccuucagaaaagacacu

SEQ ID NO: 951877 - RNA, 22 nt, Homo sapiens
ccuucagugccaaaaacaacaa

SEQ ID NO: 951878 - RNA, 15 nt, Homo sapiens
ccuucuccugaccua

SEQ ID NO: 951879 - RNA, 21 nt, Homo sapiens
ccuugagcaagucccaucuca

SEQ ID NO: 951880 - RNA, 12 nt, Homo sapiens
ccuuuacaugaa

SEQ ID NO: 951881 - RNA, 23 nt, Homo sapiens
ccuuucaaauuuaggauggaaua

SEQ ID NO: 951882 - RNA, 20 nt, Homo sapiens
ccuuuccccaccucuuacag

SEQ ID NO: 951883 - RNA, 16 nt, Homo sapiens
ccuuugccuuugccuc

SEQ ID NO: 951884 - RNA, 22 nt, Homo sapiens
ccuuugcuagggggcaaauaca

SEQ ID NO: 951885 - RNA, 13 nt, Homo sapiens
ccuuugcuuuaca

SEQ ID NO: 951886 - RNA, 19 nt, Homo sapiens
ccuuugcuuuacagcacug

SEQ ID NO: 951887 - RNA, 18 nt, Homo sapiens
ccuuugggagcucauucu

SEQ ID NO: 951888 - RNA, 20 nt, Homo sapiens
ccuuugguuaguguacuuug

SEQ ID NO: 951889 - RNA, 16 nt, Homo sapiens
ccuuuugagugccuua

SEQ ID NO: 951890 - RNA, 22 nt, Homo sapiens
ccuuuugcccacugucugcuac

SEQ ID NO: 951891 - RNA, 18 nt, Homo sapiens
cgagacauagaauaguau

SEQ ID NO: 951892 - RNA, 18 nt, Homo sapiens
cgagggacuccagauaca

SEQ ID NO: 951893 - RNA, 17 nt, Homo sapiens
cgaugggaucauuauuu

SEQ ID NO: 951894 - RNA, 21 nt, Homo sapiens
cgcaaccaccaccaaccacug

SEQ ID NO: 951895 - RNA, 17 nt, Homo sapiens
cgcacccuggcuggaau

SEQ ID NO: 951896 - RNA, 22 nt, Homo sapiens
cgcauacaggcguacacaugca

SEQ ID NO: 951897 - RNA, 18 nt, Homo sapiens
cgccaaggcucacaugcu

SEQ ID NO: 951898 - RNA, 19 nt, Homo sapiens
cgccaaggcucacaugcuc

SEQ ID NO: 951899 - RNA, 15 nt, Homo sapiens
cgcccuguguccaca

SEQ ID NO: 951900 - RNA, 14 nt, Homo sapiens
cgccguacaguucu

SEQ ID NO: 951901 - RNA, 17 nt, Homo sapiens
cgcucagcacacaugca

SEQ ID NO: 951902 - RNA, 16 nt, Homo sapiens
cgcugguaacuguuaa

SEQ ID NO: 951903 - RNA, 13 nt, Homo sapiens
cgggguguugcca

SEQ ID NO: 951904 - RNA, 21 nt, Homo sapiens
cguaucaccugagguugggag

SEQ ID NO: 951905 - RNA, 14 nt, Homo sapiens
cguccguccgcccg

SEQ ID NO: 951906 - RNA, 20 nt, Homo sapiens
cgugaucaucaccacugaca

SEQ ID NO: 951907 - RNA, 15 nt, Homo sapiens
cgugcacggggccag

SEQ ID NO: 951908 - RNA, 17 nt, Homo sapiens
cgugccuuccccgugcg

SEQ ID NO: 951909 - RNA, 16 nt, Homo sapiens
cguggagggugcccag

SEQ ID NO: 951910 - RNA, 23 nt, Homo sapiens
cgugguaugagagggauggcuca

SEQ ID NO: 951911 - RNA, 21 nt, Homo sapiens
cguggucccaacuacucagcc

SEQ ID NO: 951912 - RNA, 23 nt, Homo sapiens
uuccagaacgcccuguguccaca

SEQ ID NO: 951913 - RNA, 16 nt, Homo sapiens
uuccccccaucuccau

SEQ ID NO: 951914 - RNA, 19 nt, Homo sapiens
uuccccccaucuccauugc

SEQ ID NO: 951915 - RNA, 19 nt, Homo sapiens
uucccuaaaagaaaaccaa

SEQ ID NO: 951916 - RNA, 19 nt, Homo sapiens
uuccgugagagucaucuca

SEQ ID NO: 951917 - RNA, 20 nt, Homo sapiens
uuccuauuugcacacgucca

SEQ ID NO: 951918 - RNA, 17 nt, Homo sapiens
uuccuccugacacccca

SEQ ID NO: 951919 - RNA, 15 nt, Homo sapiens
uuccugauguugaua

SEQ ID NO: 951920 - RNA, 17 nt, Homo sapiens
uuccugucaauacaggu

SEQ ID NO: 951921 - RNA, 18 nt, Homo sapiens
uuccuucugagucaccua

SEQ ID NO: 951922 - RNA, 19 nt, Homo sapiens
uucgagaccagccugacca

SEQ ID NO: 951923 - RNA, 17 nt, Homo sapiens
uucgcguauuucaggau

SEQ ID NO: 951924 - RNA, 20 nt, Homo sapiens
uucuaaaacauucuuuaaca

SEQ ID NO: 951925 - RNA, 18 nt, Homo sapiens
uucuaaauuauaccauga

SEQ ID NO: 951926 - RNA, 19 nt, Homo sapiens
uucuaaggagcacuagaau

SEQ ID NO: 951927 - RNA, 20 nt, Homo sapiens
uucuauacuuucucacaugu

SEQ ID NO: 951928 - RNA, 23 nt, Homo sapiens
uucuaugagaccucccccaggga

SEQ ID NO: 951929 - RNA, 24 nt, Homo sapiens
uucuauguacuaguacuguguacu

SEQ ID NO: 951930 - RNA, 14 nt, Homo sapiens
uucuauguccaaac

SEQ ID NO: 951931 - RNA, 22 nt, Homo sapiens
uucucaaaugcuaaaugcaaac

SEQ ID NO: 951932 - RNA, 21 nt, Homo sapiens
uucucacauagguguugucaa

SEQ ID NO: 951933 - RNA, 21 nt, Homo sapiens
uucuccaccugaagugaugau

SEQ ID NO: 951934 - RNA, 21 nt, Homo sapiens
uucuccaugucuguaguugcu

SEQ ID NO: 951935 - RNA, 14 nt, Homo sapiens
uucucguacuuuca

SEQ ID NO: 951936 - RNA, 23 nt, Homo sapiens
uucugaauucauaaaaauaacca

SEQ ID NO: 951937 - RNA, 16 nt, Homo sapiens
uucuggaaaugaagga

SEQ ID NO: 951938 - RNA, 18 nt, Homo sapiens
uucugggucagcuugaau

SEQ ID NO: 951939 - RNA, 15 nt, Homo sapiens
uucuguagugccaug

SEQ ID NO: 951940 - RNA, 14 nt, Homo sapiens
uucuguggauucua

SEQ ID NO: 951941 - RNA, 18 nt, Homo sapiens
uucuguggcugccaucag

SEQ ID NO: 951942 - RNA, 22 nt, Homo sapiens
uucuguggcugccaucagaaau

SEQ ID NO: 951943 - RNA, 22 nt, Homo sapiens
uucuuagugaaaggucaucuca

SEQ ID NO: 951944 - RNA, 17 nt, Homo sapiens
uucuuccuaccaaauau

SEQ ID NO: 951945 - RNA, 21 nt, Homo sapiens
uucuugaggcagggucucacu

SEQ ID NO: 951946 - RNA, 21 nt, Homo sapiens
uucuuggaucuuuuugcagac

SEQ ID NO: 951947 - RNA, 23 nt, Homo sapiens
uucuuuaacauacaucuaaguca

SEQ ID NO: 951948 - RNA, 18 nt, Homo sapiens
uugaaaaacacauuguaa

SEQ ID NO: 951949 - RNA, 15 nt, Homo sapiens
uugaaagaagucaaa

SEQ ID NO: 951950 - RNA, 18 nt, Homo sapiens
uugacaaggcucugcuau

SEQ ID NO: 951951 - RNA, 19 nt, Homo sapiens
uugagaaauaaagcacauu

SEQ ID NO: 951952 - RNA, 16 nt, Homo sapiens
uugagacauuugccaa

SEQ ID NO: 951953 - RNA, 17 nt, Homo sapiens
uugagucuaacacacca

SEQ ID NO: 951954 - RNA, 16 nt, Homo sapiens
uugaguggacagcagc

SEQ ID NO: 951955 - RNA, 14 nt, Homo sapiens
uugauccugaguua

SEQ ID NO: 951956 - RNA, 21 nt, Homo sapiens
uugcacaaguacuugagaaua

SEQ ID NO: 951957 - RNA, 14 nt, Homo sapiens
uugcauagugccug

SEQ ID NO: 951958 - RNA, 16 nt, Homo sapiens
uugccacccaggugau

SEQ ID NO: 951959 - RNA, 19 nt, Homo sapiens
uugcccacugucugcuacc

SEQ ID NO: 951960 - RNA, 20 nt, Homo sapiens
uugccuuugguuccccgcga

SEQ ID NO: 951961 - RNA, 19 nt, Homo sapiens
uugcugaccccacuuggac

SEQ ID NO: 951962 - RNA, 16 nt, Homo sapiens
uugcugucccuuuucc

SEQ ID NO: 951963 - RNA, 16 nt, Homo sapiens
uugcuguugcuugaau

SEQ ID NO: 951964 - RNA, 16 nt, Homo sapiens
uugcuuuacagcacug

SEQ ID NO: 951965 - RNA, 17 nt, Homo sapiens
uugcuuuuagcagauau

SEQ ID NO: 951966 - RNA, 12 nt, Homo sapiens
uuggaaauggag

SEQ ID NO: 951967 - RNA, 13 nt, Homo sapiens
uuggaccacagca

SEQ ID NO: 951968 - RNA, 15 nt, Homo sapiens
uuggcaguucugaua

SEQ ID NO: 951969 - RNA, 20 nt, Homo sapiens
uuggcucacaucauguaaua

SEQ ID NO: 951970 - RNA, 17 nt, Homo sapiens
uugguaauuaaggcauc

SEQ ID NO: 951971 - RNA, 12 nt, Homo sapiens
uugguuuuggac

SEQ ID NO: 951972 - RNA, 19 nt, Homo sapiens
uuguaauguagacagacuu

SEQ ID NO: 951973 - RNA, 21 nt, Homo sapiens
uuguagaggggcaacugauga

SEQ ID NO: 951974 - RNA, 19 nt, Homo sapiens
uuguaucaccucuucacaa

SEQ ID NO: 951975 - RNA, 22 nt, Homo sapiens
uugucucucuaaacccaaauaa

SEQ ID NO: 951976 - RNA, 23 nt, Homo sapiens
uugucucucuaaacccaaauaaa

SEQ ID NO: 951977 - RNA, 20 nt, Homo sapiens
uugucuuuuauuuugugucc

SEQ ID NO: 951978 - RNA, 15 nt, Homo sapiens
uuguggcugauuuca

SEQ ID NO: 951979 - RNA, 20 nt, Homo sapiens
uuguuacagguguacuaugg

SEQ ID NO: 951980 - RNA, 12 nt, Homo sapiens
uuguuccuccac

SEQ ID NO: 951981 - RNA, 21 nt, Homo sapiens
uuguugcaguuaauucuugcc

SEQ ID NO: 951982 - RNA, 14 nt, Homo sapiens
uuguuuaacccaaa

SEQ ID NO: 951983 - RNA, 16 nt, Homo sapiens
uuuaagaaaaaucaua

SEQ ID NO: 951984 - RNA, 17 nt, Homo sapiens
uuuacaagcaucaugga

SEQ ID NO: 951985 - RNA, 20 nt, Homo sapiens
uuuagcgguuugcaaacaaa

SEQ ID NO: 951986 - RNA, 13 nt, Homo sapiens
uuuagcguguaaa

SEQ ID NO: 951987 - RNA, 21 nt, Homo sapiens
uuuauaguugagaugucaaga

SEQ ID NO: 951988 - RNA, 21 nt, Homo sapiens
uuuauggagaguucaggagaa

SEQ ID NO: 951989 - RNA, 16 nt, Homo sapiens
uuuauuaccgauaaau

SEQ ID NO: 951990 - RNA, 17 nt, Homo sapiens
uuuauucacaguaucug

SEQ ID NO: 951991 - RNA, 14 nt, Homo sapiens
uuucaacauaugaa

SEQ ID NO: 951992 - RNA, 19 nt, Homo sapiens
uuucagaauauuuucaaaa

SEQ ID NO: 951993 - RNA, 18 nt, Homo sapiens
uuucagugcuuugcccuu

SEQ ID NO: 951994 - RNA, 17 nt, Homo sapiens
uuucauauaauuugcca

SEQ ID NO: 951995 - RNA, 11 nt, Homo sapiens
uuuccaaacaa

SEQ ID NO: 951996 - RNA, 22 nt, Homo sapiens
uuuccaagggucuuccuccuaa

SEQ ID NO: 951997 - RNA, 13 nt, Homo sapiens
cuguuacuccaaa

SEQ ID NO: 951998 - RNA, 12 nt, Homo sapiens
cuguuagcauua

SEQ ID NO: 951999 - RNA, 18 nt, Homo sapiens
cuguucgaguagcucagc

SEQ ID NO: 952000 - RNA, 24 nt, Homo sapiens
cuguugccaggagauggaauauca

SEQ ID NO: 952001 - RNA, 20 nt, Homo sapiens
cuguuuccccaauuccucug

SEQ ID NO: 952002 - RNA, 19 nt, Homo sapiens
cuguuucugcagccacuau

SEQ ID NO: 952003 - RNA, 18 nt, Homo sapiens
cuguuugauacaguauua

SEQ ID NO: 952004 - RNA, 17 nt, Homo sapiens
cuguuuugcauggagua

SEQ ID NO: 952005 - RNA, 17 nt, Homo sapiens
cuuaaaccugugcuuuc

SEQ ID NO: 952006 - RNA, 21 nt, Homo sapiens
cuuaacuguccaguccaguga

SEQ ID NO: 952007 - RNA, 21 nt, Homo sapiens
cuuaagcacacuugacaucaa

SEQ ID NO: 952008 - RNA, 13 nt, Homo sapiens
cuuaagugacuuc

SEQ ID NO: 952009 - RNA, 19 nt, Homo sapiens
cuuacugccuuagucccaa

SEQ ID NO: 952010 - RNA, 16 nt, Homo sapiens
cuuacugcuucaugua

SEQ ID NO: 952011 - RNA, 13 nt, Homo sapiens
cuuagaaagggaa

SEQ ID NO: 952012 - RNA, 12 nt, Homo sapiens
cuuagaaugagg

SEQ ID NO: 952013 - RNA, 19 nt, Homo sapiens
cuuagauuucuagcaguau

SEQ ID NO: 952014 - RNA, 21 nt, Homo sapiens
cuuaguacaccauaaacuggg

SEQ ID NO: 952015 - RNA, 15 nt, Homo sapiens
cuuauaacaggaaua

SEQ ID NO: 952016 - RNA, 16 nt, Homo sapiens
cuuauccccagcuguu

SEQ ID NO: 952017 - RNA, 23 nt, Homo sapiens
cuuaucuuggaaucaugcaaaaa

SEQ ID NO: 952018 - RNA, 17 nt, Homo sapiens
cuuauggaaagguccug

SEQ ID NO: 952019 - RNA, 14 nt, Homo sapiens
cuuaugugacaugg

SEQ ID NO: 952020 - RNA, 18 nt, Homo sapiens
cuuauucacugagucuca

SEQ ID NO: 952021 - RNA, 16 nt, Homo sapiens
cuucaaaaaugugcug

SEQ ID NO: 952022 - RNA, 15 nt, Homo sapiens
cuucaacaugcauau

SEQ ID NO: 952023 - RNA, 20 nt, Homo sapiens
cuucagaauauggacaaaga

SEQ ID NO: 952024 - RNA, 22 nt, Homo sapiens
cuucaguuguggccucauucag

SEQ ID NO: 952025 - RNA, 14 nt, Homo sapiens
cuucaucuggaguc

SEQ ID NO: 952026 - RNA, 21 nt, Homo sapiens
cuucauguucagucacaugug

SEQ ID NO: 952027 - RNA, 23 nt, Homo sapiens
cuuccaaauauuagccaaagagg

SEQ ID NO: 952028 - RNA, 15 nt, Homo sapiens
cuuccaccaaauacu

SEQ ID NO: 952029 - RNA, 20 nt, Homo sapiens
cuuccucggccucccaaagu

SEQ ID NO: 952030 - RNA, 19 nt, Homo sapiens
cuucuaaauuauaccauga

SEQ ID NO: 952031 - RNA, 15 nt, Homo sapiens
cuucuaagggaucca

SEQ ID NO: 952032 - RNA, 23 nt, Homo sapiens
cuucuagugauugugagugccuu

SEQ ID NO: 952033 - RNA, 12 nt, Homo sapiens
cuucuccugacc

SEQ ID NO: 952034 - RNA, 19 nt, Homo sapiens
cuucugaagaucucagaua

SEQ ID NO: 952035 - RNA, 15 nt, Homo sapiens
cuucuguagugccau

SEQ ID NO: 952036 - RNA, 17 nt, Homo sapiens
cuucuguagugccaugg

SEQ ID NO: 952037 - RNA, 22 nt, Homo sapiens
cuucuguucucaaaugcuaaau

SEQ ID NO: 952038 - RNA, 16 nt, Homo sapiens
cuugaacucuuggccu

SEQ ID NO: 952039 - RNA, 15 nt, Homo sapiens
cuugaggcagggucu

SEQ ID NO: 952040 - RNA, 19 nt, Homo sapiens
cuugaguggacagcagcug

SEQ ID NO: 952041 - RNA, 15 nt, Homo sapiens
cuugcacacaugcac

SEQ ID NO: 952042 - RNA, 20 nt, Homo sapiens
cuugccucugcucugugcac

SEQ ID NO: 952043 - RNA, 23 nt, Homo sapiens
cuugccucugcucugugcacuca

SEQ ID NO: 952044 - RNA, 14 nt, Homo sapiens
cuugcucagccaua

SEQ ID NO: 952045 - RNA, 12 nt, Homo sapiens
cuugcuuucaca

SEQ ID NO: 952046 - RNA, 16 nt, Homo sapiens
cuuggaaucaugcaaa

SEQ ID NO: 952047 - RNA, 11 nt, Homo sapiens
cuuggagacag

SEQ ID NO: 952048 - RNA, 20 nt, Homo sapiens
cuuggugucgggcaugacac

SEQ ID NO: 952049 - RNA, 16 nt, Homo sapiens
cuugugauccuaaaau

SEQ ID NO: 952050 - RNA, 18 nt, Homo sapiens
cuuguugaugaagcacau

SEQ ID NO: 952051 - RNA, 14 nt, Homo sapiens
cuuguugugcucuu

SEQ ID NO: 952052 - RNA, 18 nt, Homo sapiens
cuuguuuugaauugucaa

SEQ ID NO: 952053 - RNA, 19 nt, Homo sapiens
cuuuaaaauguauuuuuca

SEQ ID NO: 952054 - RNA, 20 nt, Homo sapiens
cuuuaaaauguauuuuucac

SEQ ID NO: 952055 - RNA, 18 nt, Homo sapiens
cuuuaaagguaacuucuc

SEQ ID NO: 952056 - RNA, 18 nt, Homo sapiens
cuuuagacaaauuguuaa

SEQ ID NO: 952057 - RNA, 17 nt, Homo sapiens
cuuuagcaguacccuag

SEQ ID NO: 952058 - RNA, 15 nt, Homo sapiens
cuuuccuauuugcac

SEQ ID NO: 952059 - RNA, 22 nt, Homo sapiens
cuuuccuguuucuaucuuucau

SEQ ID NO: 952060 - RNA, 22 nt, Homo sapiens
cuuucgccuccuccagcuccug

SEQ ID NO: 952061 - RNA, 14 nt, Homo sapiens
cuuucucacaugug

SEQ ID NO: 952062 - RNA, 17 nt, Homo sapiens
cuuugaaccugugcaau

SEQ ID NO: 952063 - RNA, 24 nt, Homo sapiens
cuuugaaugcaugugugaagauua

SEQ ID NO: 952064 - RNA, 11 nt, Homo sapiens
cuuugccaaau

SEQ ID NO: 952065 - RNA, 13 nt, Homo sapiens
cuuugccuucaaa

SEQ ID NO: 952066 - RNA, 16 nt, Homo sapiens
cuuugguaauguguca

SEQ ID NO: 952067 - RNA, 22 nt, Homo sapiens
cuuugguaaugugucaaagaga

SEQ ID NO: 952068 - RNA, 14 nt, Homo sapiens
cuuuguacugauga

SEQ ID NO: 952069 - RNA, 20 nt, Homo sapiens
cuuuucccguaugcuuucuu

SEQ ID NO: 952070 - RNA, 22 nt, Homo sapiens
cuuuucgccaaggcucacaugc

SEQ ID NO: 952071 - RNA, 19 nt, Homo sapiens
cuuuucuuacaguaacuga

SEQ ID NO: 952072 - RNA, 21 nt, Homo sapiens
cuuuugagugccuuacacaau

SEQ ID NO: 952073 - RNA, 22 nt, Homo sapiens
cuuuugcccacugucugcuacc

SEQ ID NO: 952074 - RNA, 22 nt, Homo sapiens
cuuuuggggaggaguugucugu

SEQ ID NO: 952075 - RNA, 22 nt, Homo sapiens
cuuuugugccaggagugggugg

SEQ ID NO: 952076 - RNA, 16 nt, Homo sapiens
gaaaaaaauaguuuua

SEQ ID NO: 952077 - RNA, 14 nt, Homo sapiens
gaaaaaacauuuua

SEQ ID NO: 952078 - RNA, 16 nt, Homo sapiens
gaaaaaucauaacuca

SEQ ID NO: 952079 - RNA, 19 nt, Homo sapiens
gaaaaaucauaacucacuu

SEQ ID NO: 952080 - RNA, 13 nt, Homo sapiens
gaaaaaugcuguu

SEQ ID NO: 952081 - RNA, 18 nt, Homo sapiens
gaaaaugggaagcauuag

SEQ ID NO: 952082 - RNA, 17 nt, Homo sapiens
gaaacaaaaaauauuca

SEQ ID NO: 952083 - RNA, 18 nt, Homo sapiens
gaaacacacaggccauuu

SEQ ID NO: 952084 - RNA, 22 nt, Homo sapiens
gaaacauuauugucaacuugaa

SEQ ID NO: 952085 - RNA, 18 nt, Homo sapiens
gaaacgcuagaagccuaa

SEQ ID NO: 952086 - RNA, 13 nt, Homo sapiens
gaaacugcacugu

SEQ ID NO: 952087 - RNA, 14 nt, Homo sapiens
gaaacuuacuaaaa

SEQ ID NO: 952088 - RNA, 22 nt, Homo sapiens
gaaagagcuggcaaacugugaa

SEQ ID NO: 952089 - RNA, 22 nt, Homo sapiens
gaaagcguuuuguuaucuucua

SEQ ID NO: 952090 - RNA, 17 nt, Homo sapiens
gaaauaaagaguucucc

SEQ ID NO: 952091 - RNA, 16 nt, Homo sapiens
gaaauaaccugugaau

SEQ ID NO: 952092 - RNA, 14 nt, Homo sapiens
gaaauacacuacaa

SEQ ID NO: 952093 - RNA, 12 nt, Homo sapiens
gaaauaugcaac

SEQ ID NO: 952094 - RNA, 19 nt, Homo sapiens
gaaaucaauuuaaaggaaa

SEQ ID NO: 952095 - RNA, 13 nt, Homo sapiens
gaaauguuuccag

SEQ ID NO: 952096 - RNA, 22 nt, Homo sapiens
gaaauuauuacucugucauaau

SEQ ID NO: 952097 - RNA, 19 nt, Homo sapiens
gaaauucuauaagagacaa

SEQ ID NO: 952098 - RNA, 13 nt, Homo sapiens
gaacaaaaucugu

SEQ ID NO: 952099 - RNA, 21 nt, Homo sapiens
gaacacuaaugaggaaacugc

SEQ ID NO: 952100 - RNA, 19 nt, Homo sapiens
gaacaggccgcacaucuca

SEQ ID NO: 952101 - RNA, 17 nt, Homo sapiens
gaacagguguuccuccu

SEQ ID NO: 952102 - RNA, 15 nt, Homo sapiens
gaaccgucaauguga

SEQ ID NO: 952103 - RNA, 14 nt, Homo sapiens
gaaccucaaacugg

SEQ ID NO: 952104 - RNA, 18 nt, Homo sapiens
gaacuagagacucuguga

SEQ ID NO: 952105 - RNA, 16 nt, Homo sapiens
gaacugaaaggacugu

SEQ ID NO: 952106 - RNA, 22 nt, Homo sapiens
gaagacacguucuugccagcuu

SEQ ID NO: 952107 - RNA, 16 nt, Homo sapiens
cagcuccaaccuggag

SEQ ID NO: 952108 - RNA, 23 nt, Homo sapiens
cagcugccaaaaucguagguguu

SEQ ID NO: 952109 - RNA, 17 nt, Homo sapiens
cagcugcuuuugcauuu

SEQ ID NO: 952110 - RNA, 23 nt, Homo sapiens
cagcuguuuggccaaugugcaua

SEQ ID NO: 952111 - RNA, 22 nt, Homo sapiens
cagcuucauaauuuccaugaua

SEQ ID NO: 952112 - RNA, 14 nt, Homo sapiens
cagcuuggagacag

SEQ ID NO: 952113 - RNA, 23 nt, Homo sapiens
cagcuuuauaacaaauguggcuc

SEQ ID NO: 952114 - RNA, 13 nt, Homo sapiens
caggaaguacugg

SEQ ID NO: 952115 - RNA, 17 nt, Homo sapiens
caggaugcagccuuugc

SEQ ID NO: 952116 - RNA, 18 nt, Homo sapiens
caggauguguggcucauu

SEQ ID NO: 952117 - RNA, 12 nt, Homo sapiens
caggauucuccu

SEQ ID NO: 952118 - RNA, 22 nt, Homo sapiens
caggauucuccuuuuuaccccu

SEQ ID NO: 952119 - RNA, 22 nt, Homo sapiens
caggccuguucccugaggaccu

SEQ ID NO: 952120 - RNA, 19 nt, Homo sapiens
caggcuggucucaaacucc

SEQ ID NO: 952121 - RNA, 15 nt, Homo sapiens
caggcuucgucucag

SEQ ID NO: 952122 - RNA, 17 nt, Homo sapiens
cagggcgcuccggcaga

SEQ ID NO: 952123 - RNA, 21 nt, Homo sapiens
cagggucucacucuguugacc

SEQ ID NO: 952124 - RNA, 23 nt, Homo sapiens
caggucugacaccuuucagucuc

SEQ ID NO: 952125 - RNA, 17 nt, Homo sapiens
cagguguuaaaaaccau

SEQ ID NO: 952126 - RNA, 18 nt, Homo sapiens
caguaaaguucauccuuu

SEQ ID NO: 952127 - RNA, 17 nt, Homo sapiens
caguaacugaguguggc

SEQ ID NO: 952128 - RNA, 19 nt, Homo sapiens
caguauggccccaccugcu

SEQ ID NO: 952129 - RNA, 20 nt, Homo sapiens
caguauggccccaccugcuc

SEQ ID NO: 952130 - RNA, 13 nt, Homo sapiens
cagucauuuccua

SEQ ID NO: 952131 - RNA, 18 nt, Homo sapiens
cagucauuuccuacccuu

SEQ ID NO: 952132 - RNA, 12 nt, Homo sapiens
caguccagugag

SEQ ID NO: 952133 - RNA, 11 nt, Homo sapiens
cagucuucuca

SEQ ID NO: 952134 - RNA, 15 nt, Homo sapiens
cagugaccuuuuaca

SEQ ID NO: 952135 - RNA, 19 nt, Homo sapiens
cagugacucaucuucucac

SEQ ID NO: 952136 - RNA, 16 nt, Homo sapiens
cagugccaaaaacaac

SEQ ID NO: 952137 - RNA, 19 nt, Homo sapiens
cagugccaaaaacaacaac

SEQ ID NO: 952138 - RNA, 15 nt, Homo sapiens
caguugcaaugauca

SEQ ID NO: 952139 - RNA, 18 nt, Homo sapiens
caguuguggccucauuca

SEQ ID NO: 952140 - RNA, 18 nt, Homo sapiens
cauaaaauaggugcauug

SEQ ID NO: 952141 - RNA, 15 nt, Homo sapiens
cauaacucacuuuaa

SEQ ID NO: 952142 - RNA, 14 nt, Homo sapiens
cauaacucugauua

SEQ ID NO: 952143 - RNA, 19 nt, Homo sapiens
cauaaugacuuaagcacac

SEQ ID NO: 952144 - RNA, 20 nt, Homo sapiens
cauaauuagaguuuguguau

SEQ ID NO: 952145 - RNA, 21 nt, Homo sapiens
cauacaggcauacacaugcac

SEQ ID NO: 952146 - RNA, 21 nt, Homo sapiens
cauacaggcguacacaugcac

SEQ ID NO: 952147 - RNA, 20 nt, Homo sapiens
cauacauacacugcauccug

SEQ ID NO: 952148 - RNA, 23 nt, Homo sapiens
cauacuucuaaauuauaccauga

SEQ ID NO: 952149 - RNA, 12 nt, Homo sapiens
cauagcacacau

SEQ ID NO: 952150 - RNA, 18 nt, Homo sapiens
cauagccauucauuuaca

SEQ ID NO: 952151 - RNA, 17 nt, Homo sapiens
cauaguucugcaauaac

SEQ ID NO: 952152 - RNA, 19 nt, Homo sapiens
cauauaguuggugcucaau

SEQ ID NO: 952153 - RNA, 18 nt, Homo sapiens
cauaugugaucugucuug

SEQ ID NO: 952154 - RNA, 20 nt, Homo sapiens
cauaugugaucugucuugua

SEQ ID NO: 952155 - RNA, 21 nt, Homo sapiens
cauauuauagcuccuauuaaa

SEQ ID NO: 952156 - RNA, 16 nt, Homo sapiens
caucaacuccagucuc

SEQ ID NO: 952157 - RNA, 22 nt, Homo sapiens
caucacaggcucugcauacaca

SEQ ID NO: 952158 - RNA, 22 nt, Homo sapiens
cauccuucccgcagcaccagcc

SEQ ID NO: 952159 - RNA, 16 nt, Homo sapiens
caucuccauugcauuc

SEQ ID NO: 952160 - RNA, 14 nt, Homo sapiens
caucucuguagaua

SEQ ID NO: 952161 - RNA, 20 nt, Homo sapiens
caugacacgaauauugcuga

SEQ ID NO: 952162 - RNA, 15 nt, Homo sapiens
caugagaaaucaugc

SEQ ID NO: 952163 - RNA, 23 nt, Homo sapiens
caugagagcagagcccccauggc

SEQ ID NO: 952164 - RNA, 14 nt, Homo sapiens
caugaugacucuuc

SEQ ID NO: 952165 - RNA, 17 nt, Homo sapiens
caugauugugaccucca

SEQ ID NO: 952166 - RNA, 22 nt, Homo sapiens
caugcauccuccccucuccugc

SEQ ID NO: 952167 - RNA, 15 nt, Homo sapiens
caugcucauguguac

SEQ ID NO: 952168 - RNA, 23 nt, Homo sapiens
caugcugcaguggguaguucuaa

SEQ ID NO: 952169 - RNA, 14 nt, Homo sapiens
cauggaaguacuau

SEQ ID NO: 952170 - RNA, 21 nt, Homo sapiens
caugggaaugaaugucagugu

SEQ ID NO: 952171 - RNA, 17 nt, Homo sapiens
cauggguucaauuggac

SEQ ID NO: 952172 - RNA, 16 nt, Homo sapiens
cauguaccuuguguac

SEQ ID NO: 952173 - RNA, 20 nt, Homo sapiens
cauguaccuuguguacuuuc

SEQ ID NO: 952174 - RNA, 17 nt, Homo sapiens
cauguacuacacuucug

SEQ ID NO: 952175 - RNA, 18 nt, Homo sapiens
cauguacuacacuucuga

SEQ ID NO: 952176 - RNA, 18 nt, Homo sapiens
cauguagaggaaaagaua

SEQ ID NO: 952177 - RNA, 18 nt, Homo sapiens
caugucagaaggagacag

SEQ ID NO: 952178 - RNA, 23 nt, Homo sapiens
caugucuacugcuuggauccaua

SEQ ID NO: 952179 - RNA, 16 nt, Homo sapiens
caugugccugaaggcu

SEQ ID NO: 952180 - RNA, 15 nt, Homo sapiens
cauguguagauauua

SEQ ID NO: 952181 - RNA, 14 nt, Homo sapiens
cauguucauucaca

SEQ ID NO: 952182 - RNA, 23 nt, Homo sapiens
cauguugcaaagaacuccagagu

SEQ ID NO: 952183 - RNA, 18 nt, Homo sapiens
cauguuguaacauuucac

SEQ ID NO: 952184 - RNA, 23 nt, Homo sapiens
cauguuucccgcuccaagagaau

SEQ ID NO: 952185 - RNA, 16 nt, Homo sapiens
cauuaccacacucagc

SEQ ID NO: 952186 - RNA, 15 nt, Homo sapiens
cauuagaaaggauuu

SEQ ID NO: 952187 - RNA, 23 nt, Homo sapiens
cauuauaaaaucuuuccaucuca

SEQ ID NO: 952188 - RNA, 14 nt, Homo sapiens
cauucaguuaucac

SEQ ID NO: 952189 - RNA, 20 nt, Homo sapiens
cauucaguuaucacuacaga

SEQ ID NO: 952190 - RNA, 20 nt, Homo sapiens
cauucugaaggccuuguuaa

SEQ ID NO: 952191 - RNA, 21 nt, Homo sapiens
cauuguuaaauguucccuuag

SEQ ID NO: 952192 - RNA, 15 nt, Homo sapiens
cauuuacaacuucca

SEQ ID NO: 952193 - RNA, 14 nt, Homo sapiens
cauuuauuuauuca

SEQ ID NO: 952194 - RNA, 21 nt, Homo sapiens
cauuuauuuauucauguguac

SEQ ID NO: 952195 - RNA, 16 nt, Homo sapiens
cauuucuuaccaugca

SEQ ID NO: 952196 - RNA, 18 nt, Homo sapiens
cauuugauuugauauaca

SEQ ID NO: 952197 - RNA, 21 nt, Homo sapiens
cauuuggccgagucagcacgu

SEQ ID NO: 952198 - RNA, 20 nt, Homo sapiens
cauuugggauuuucuuugcc

SEQ ID NO: 952199 - RNA, 22 nt, Homo sapiens
cauuuguuguuguuuuuccuca

SEQ ID NO: 952200 - RNA, 17 nt, Homo sapiens
ccaaacaauuuagccag

SEQ ID NO: 952201 - RNA, 22 nt, Homo sapiens
ccaaacuguaguaauuguuaca

SEQ ID NO: 952202 - RNA, 17 nt, Homo sapiens
ccaaagagaaaagauua

SEQ ID NO: 952203 - RNA, 18 nt, Homo sapiens
ccaaagcuugccacuuuc

SEQ ID NO: 952204 - RNA, 20 nt, Homo sapiens
ccaaaggaaggcacccuuga

SEQ ID NO: 952205 - RNA, 20 nt, Homo sapiens
ccaaaggaucuuuguuccuc

SEQ ID NO: 952206 - RNA, 15 nt, Homo sapiens
ccaaauaagauauuu

SEQ ID NO: 952207 - RNA, 23 nt, Homo sapiens
ccaacauuacuccauuacuaaag

SEQ ID NO: 952208 - RNA, 16 nt, Homo sapiens
ccaacuacucagccua

SEQ ID NO: 952209 - RNA, 21 nt, Homo sapiens
ccaagaaugucuccauuguua

SEQ ID NO: 952210 - RNA, 15 nt, Homo sapiens
ccaagauagagucaa

SEQ ID NO: 952211 - RNA, 17 nt, Homo sapiens
ccaagaucacaaauagu

SEQ ID NO: 952212 - RNA, 21 nt, Homo sapiens
ccaagcuguuccacuucucua

SEQ ID NO: 952213 - RNA, 15 nt, Homo sapiens
ccaaggaaaauggac

SEQ ID NO: 952214 - RNA, 23 nt, Homo sapiens
ccaaggcauugauugcacuugau

SEQ ID NO: 952215 - RNA, 14 nt, Homo sapiens
ccaauacagucuag

SEQ ID NO: 952216 - RNA, 17 nt, Homo sapiens
ccacacagcacaugcac

SEQ ID NO: 952217 - RNA, 21 nt, Homo sapiens
ccacacccucuccuugucaca

SEQ ID NO: 952218 - RNA, 22 nt, Homo sapiens
ccacacccuggaguggcauggu

SEQ ID NO: 952219 - RNA, 14 nt, Homo sapiens
ccacacguuugcca

SEQ ID NO: 952220 - RNA, 18 nt, Homo sapiens
ccacccugcuucugcugc

SEQ ID NO: 952221 - RNA, 21 nt, Homo sapiens
ccacguugcagaaaaagagcu

SEQ ID NO: 952222 - RNA, 14 nt, Homo sapiens
ccacuacauucuga

SEQ ID NO: 952223 - RNA, 20 nt, Homo sapiens
ccacugaaaccucuguucuc

SEQ ID NO: 952224 - RNA, 16 nt, Homo sapiens
ccacuuugucucugag

SEQ ID NO: 952225 - RNA, 11 nt, Homo sapiens
ccagaccccau

SEQ ID NO: 952226 - RNA, 17 nt, Homo sapiens
ccagaggggcggggcca

SEQ ID NO: 952227 - RNA, 14 nt, Homo sapiens
uccaguuuaaucuu

SEQ ID NO: 952228 - RNA, 13 nt, Homo sapiens
uccauaugcucuu

SEQ ID NO: 952229 - RNA, 20 nt, Homo sapiens
uccauccacacacagcagcu

SEQ ID NO: 952230 - RNA, 18 nt, Homo sapiens
uccauguaccuuguguac

SEQ ID NO: 952231 - RNA, 15 nt, Homo sapiens
uccauuaauacuucc

SEQ ID NO: 952232 - RNA, 21 nt, Homo sapiens
ucccaaguagcugggaccaca

SEQ ID NO: 952233 - RNA, 12 nt, Homo sapiens
ucccacagccuc

SEQ ID NO: 952234 - RNA, 23 nt, Homo sapiens
ucccacuaaguaguauugccuuc

SEQ ID NO: 952235 - RNA, 16 nt, Homo sapiens
ucccacuuaucaaauc

SEQ ID NO: 952236 - RNA, 13 nt, Homo sapiens
ucccaugcaacac

SEQ ID NO: 952237 - RNA, 20 nt, Homo sapiens
uccccauuaguauccuguua

SEQ ID NO: 952238 - RNA, 20 nt, Homo sapiens
ucccccacgccuccauccac

SEQ ID NO: 952239 - RNA, 21 nt, Homo sapiens
ucccccccaagauagagucaa

SEQ ID NO: 952240 - RNA, 21 nt, Homo sapiens
ucccgguguaugcagugguga

SEQ ID NO: 952241 - RNA, 20 nt, Homo sapiens
ucccuaaggagccugggaug

SEQ ID NO: 952242 - RNA, 15 nt, Homo sapiens
uccgugacagcacuu

SEQ ID NO: 952243 - RNA, 14 nt, Homo sapiens
uccuacucugggaa

SEQ ID NO: 952244 - RNA, 22 nt, Homo sapiens
uccucacucucgccaucuggca

SEQ ID NO: 952245 - RNA, 14 nt, Homo sapiens
uccuccacauucau

SEQ ID NO: 952246 - RNA, 19 nt, Homo sapiens
uccuccacauucauguaca

SEQ ID NO: 952247 - RNA, 19 nt, Homo sapiens
uccucccccacgccuccau

SEQ ID NO: 952248 - RNA, 22 nt, Homo sapiens
uccuccggcuggaccugggguc

SEQ ID NO: 952249 - RNA, 15 nt, Homo sapiens
uccucugcagccuga

SEQ ID NO: 952250 - RNA, 14 nt, Homo sapiens
uccucuuccucaaa

SEQ ID NO: 952251 - RNA, 17 nt, Homo sapiens
uccucuuccucaaaggg

SEQ ID NO: 952252 - RNA, 16 nt, Homo sapiens
uccugcgugugcccac

SEQ ID NO: 952253 - RNA, 19 nt, Homo sapiens
uccugugccucaucacugc

SEQ ID NO: 952254 - RNA, 20 nt, Homo sapiens
uccuuaacuguccaguccag

SEQ ID NO: 952255 - RNA, 17 nt, Homo sapiens
uccuuccaccaaauacu

SEQ ID NO: 952256 - RNA, 21 nt, Homo sapiens
uccuucuaaagugcugggauu

SEQ ID NO: 952257 - RNA, 16 nt, Homo sapiens
uccuucuguagugcca

SEQ ID NO: 952258 - RNA, 17 nt, Homo sapiens
uccuucuguagugccau

SEQ ID NO: 952259 - RNA, 23 nt, Homo sapiens
uccuugggcuauaaaagauuccu

SEQ ID NO: 952260 - RNA, 16 nt, Homo sapiens
uccuuuuaaaacaaua

SEQ ID NO: 952261 - RNA, 17 nt, Homo sapiens
uccuuuuuuauugaaua

SEQ ID NO: 952262 - RNA, 19 nt, Homo sapiens
ucgccaaggcucacaugcu

SEQ ID NO: 952263 - RNA, 14 nt, Homo sapiens
ucgcccucucucac

SEQ ID NO: 952264 - RNA, 20 nt, Homo sapiens
ucgggugcccugcauucaca

SEQ ID NO: 952265 - RNA, 13 nt, Homo sapiens
ucguacuuucaca

SEQ ID NO: 952266 - RNA, 18 nt, Homo sapiens
ucgucuuuuuccaaacaa

SEQ ID NO: 952267 - RNA, 13 nt, Homo sapiens
ucuaaaacauucu

SEQ ID NO: 952268 - RNA, 15 nt, Homo sapiens
ucuaaaauagcaccc

SEQ ID NO: 952269 - RNA, 14 nt, Homo sapiens
ucuaaacccaaaua

SEQ ID NO: 952270 - RNA, 21 nt, Homo sapiens
ucuaaauaugcccaauuucau

SEQ ID NO: 952271 - RNA, 16 nt, Homo sapiens
ucuaagcaguugcaau

SEQ ID NO: 952272 - RNA, 15 nt, Homo sapiens
ucuaauguauuucaa

SEQ ID NO: 952273 - RNA, 22 nt, Homo sapiens
ucuacacugcaaucauauguga

SEQ ID NO: 952274 - RNA, 17 nt, Homo sapiens
ucuaccaagcugugacc

SEQ ID NO: 952275 - RNA, 21 nt, Homo sapiens
ucuaccagagcgugcacuugu

SEQ ID NO: 952276 - RNA, 23 nt, Homo sapiens
ucuaccugaacugaaaggacugu

SEQ ID NO: 952277 - RNA, 21 nt, Homo sapiens
ucuacugcuuggauccauaca

SEQ ID NO: 952278 - RNA, 20 nt, Homo sapiens
ucuauaaauucaacacuuau

SEQ ID NO: 952279 - RNA, 15 nt, Homo sapiens
ucuauauccauaacu

SEQ ID NO: 952280 - RNA, 15 nt, Homo sapiens
ucuaucaaagcacau

SEQ ID NO: 952281 - RNA, 18 nt, Homo sapiens
ucuauguagaacuguuca

SEQ ID NO: 952282 - RNA, 12 nt, Homo sapiens
ucuauguccaaa

SEQ ID NO: 952283 - RNA, 13 nt, Homo sapiens
ucuauucauuuga

SEQ ID NO: 952284 - RNA, 16 nt, Homo sapiens
ucuauuuucaaguaca

SEQ ID NO: 952285 - RNA, 17 nt, Homo sapiens
ucucaaacacugcuuaa

SEQ ID NO: 952286 - RNA, 18 nt, Homo sapiens
ucucaauaaaccagugaa

SEQ ID NO: 952287 - RNA, 17 nt, Homo sapiens
ucucaauuuaguauaau

SEQ ID NO: 952288 - RNA, 19 nt, Homo sapiens
ucucacucuguugaccagg

SEQ ID NO: 952289 - RNA, 18 nt, Homo sapiens
ucucacuguguugcccag

SEQ ID NO: 952290 - RNA, 21 nt, Homo sapiens
ucucagccuuagcacuaugga

SEQ ID NO: 952291 - RNA, 24 nt, Homo sapiens
ucucagccuuagcacuauggacau

SEQ ID NO: 952292 - RNA, 16 nt, Homo sapiens
ucucaucuaguuugau

SEQ ID NO: 952293 - RNA, 10 nt, Homo sapiens
ucucaucucc

SEQ ID NO: 952294 - RNA, 18 nt, Homo sapiens
ucuccaaaggaucuuugu

SEQ ID NO: 952295 - RNA, 16 nt, Homo sapiens
ucuccauuucugcuca

SEQ ID NO: 952296 - RNA, 16 nt, Homo sapiens
ucuccuagagcucugu

SEQ ID NO: 952297 - RNA, 22 nt, Homo sapiens
ucuccugcgugugcccacugaa

SEQ ID NO: 952298 - RNA, 19 nt, Homo sapiens
ucuccuuuucuccacuguc

SEQ ID NO: 952299 - RNA, 22 nt, Homo sapiens
ucuccuuuucuccacugucaua

SEQ ID NO: 952300 - RNA, 22 nt, Homo sapiens
ucucgggugcccugcauucaca

SEQ ID NO: 952301 - RNA, 20 nt, Homo sapiens
ucucgucaggaggugccuga

SEQ ID NO: 952302 - RNA, 23 nt, Homo sapiens
ucucuaaaauucuagucucugau

SEQ ID NO: 952303 - RNA, 15 nt, Homo sapiens
ucucuacgcaaaaaa

SEQ ID NO: 952304 - RNA, 18 nt, Homo sapiens
ucucugagaacagacguu

SEQ ID NO: 952305 - RNA, 17 nt, Homo sapiens
ucucugaucacaacuuu

SEQ ID NO: 952306 - RNA, 18 nt, Homo sapiens
ucucuuaaauucauauca

SEQ ID NO: 952307 - RNA, 13 nt, Homo sapiens
ucugaagaucuca

SEQ ID NO: 952308 - RNA, 16 nt, Homo sapiens
ucugaaucuguuucua

SEQ ID NO: 952309 - RNA, 14 nt, Homo sapiens
ucugacagagccau

SEQ ID NO: 952310 - RNA, 20 nt, Homo sapiens
ucugagccaagacugaggua

SEQ ID NO: 952311 - RNA, 21 nt, Homo sapiens
ucugauaagcuuccuagaaag

SEQ ID NO: 952312 - RNA, 14 nt, Homo sapiens
ucugaucaguauug

SEQ ID NO: 952313 - RNA, 14 nt, Homo sapiens
ucugauuugcauau

SEQ ID NO: 952314 - RNA, 13 nt, Homo sapiens
ucugcauaagauu

SEQ ID NO: 952315 - RNA, 12 nt, Homo sapiens
ucugccuuccag

SEQ ID NO: 952316 - RNA, 18 nt, Homo sapiens
ucuggagcuggcacugug

SEQ ID NO: 952317 - RNA, 17 nt, Homo sapiens
ucuggcagacuuacaaa

SEQ ID NO: 952318 - RNA, 21 nt, Homo sapiens
ucuguaucgcugauguucacc

SEQ ID NO: 952319 - RNA, 14 nt, Homo sapiens
ucuguccuggucag

SEQ ID NO: 952320 - RNA, 15 nt, Homo sapiens
ucugucugaauccuc

SEQ ID NO: 952321 - RNA, 22 nt, Homo sapiens
ucugugcccgagguuccuguca

SEQ ID NO: 952322 - RNA, 20 nt, Homo sapiens
ucuguuacccgcagauccug

SEQ ID NO: 952323 - RNA, 17 nt, Homo sapiens
ucuguuguuauuccuau

SEQ ID NO: 952324 - RNA, 20 nt, Homo sapiens
ucuguuuccccucagaacac

SEQ ID NO: 952325 - RNA, 13 nt, Homo sapiens
ucuuacaguauuu

SEQ ID NO: 952326 - RNA, 15 nt, Homo sapiens
ucuuaccaugcauuu

SEQ ID NO: 952327 - RNA, 18 nt, Homo sapiens
ucuuaccaugcauuucuc

SEQ ID NO: 952328 - RNA, 22 nt, Homo sapiens
ucuuaguacaccauaaacuggg

SEQ ID NO: 952329 - RNA, 14 nt, Homo sapiens
ucuuauuuuagaca

SEQ ID NO: 952330 - RNA, 20 nt, Homo sapiens
ucuuauuuuagacaaccaua

SEQ ID NO: 952331 - RNA, 19 nt, Homo sapiens
ucuuccuccugacacccca

SEQ ID NO: 952332 - RNA, 19 nt, Homo sapiens
ucuucuaguuaccacggca

SEQ ID NO: 952333 - RNA, 14 nt, Homo sapiens
ucuucucuuucuca

SEQ ID NO: 952334 - RNA, 16 nt, Homo sapiens
ucuucugagugaaugu

SEQ ID NO: 952335 - RNA, 22 nt, Homo sapiens
ucuucuuaucacacuugcaaau

SEQ ID NO: 952336 - RNA, 20 nt, Homo sapiens
ucuuggaaucaugcaaaaaa

SEQ ID NO: 952337 - RNA, 21 nt, Homo sapiens
ucuuggccucaagcgauccuc

SEQ ID NO: 952338 - RNA, 19 nt, Homo sapiens
ucuuguaaauacauguccc

SEQ ID NO: 952339 - RNA, 14 nt, Homo sapiens
ucuuuagaugcuau

SEQ ID NO: 952340 - RNA, 16 nt, Homo sapiens
ucuuuauucacaguau

SEQ ID NO: 952341 - RNA, 21 nt, Homo sapiens
ucuuucagccaagaauucuua

SEQ ID NO: 952342 - RNA, 22 nt, Homo sapiens
ucuuucagccaagaauucuuaa

SEQ ID NO: 952343 - RNA, 18 nt, Homo sapiens
ucuuuccuacucugggaa

SEQ ID NO: 952344 - RNA, 14 nt, Homo sapiens
ucuuugcagugaag

SEQ ID NO: 952345 - RNA, 15 nt, Homo sapiens
ucuuuucagcuuguu

SEQ ID NO: 952346 - RNA, 23 nt, Homo sapiens
ucuuuuggcaguucugauaagcu

SEQ ID NO: 952347 - RNA, 18 nt, Homo sapiens
ucuuuuuucaauguacug

SEQ ID NO: 952348 - RNA, 19 nt, Homo sapiens
ugaaaaaauaacacuguac

SEQ ID NO: 952349 - RNA, 19 nt, Homo sapiens
ugaaaacaccaagaguaca

SEQ ID NO: 952350 - RNA, 16 nt, Homo sapiens
ugaaaccucuguucuc

SEQ ID NO: 952351 - RNA, 22 nt, Homo sapiens
ugaaacgcaaccaccaccaacc

SEQ ID NO: 952352 - RNA, 15 nt, Homo sapiens
ugaaaggucaucuca

SEQ ID NO: 952353 - RNA, 14 nt, Homo sapiens
ugaaaucagccuug

SEQ ID NO: 952354 - RNA, 16 nt, Homo sapiens
ugaaauucauccucca

SEQ ID NO: 952355 - RNA, 21 nt, Homo sapiens
ugaaauuuuuaaaucauuuca

SEQ ID NO: 952356 - RNA, 19 nt, Homo sapiens
ugaacaccacuuugucucu

SEQ ID NO: 952357 - RNA, 20 nt, Homo sapiens
ugaacaggccgcacaucuca

SEQ ID NO: 952358 - RNA, 12 nt, Homo sapiens
ugaacaguguga

SEQ ID NO: 952359 - RNA, 20 nt, Homo sapiens
uggcagugcagcaaccagag

SEQ ID NO: 952360 - RNA, 18 nt, Homo sapiens
uggcaugggaaugaaugu

SEQ ID NO: 952361 - RNA, 18 nt, Homo sapiens
uggcauuuuggcucagag

SEQ ID NO: 952362 - RNA, 22 nt, Homo sapiens
uggccaucacuuucauucaauu

SEQ ID NO: 952363 - RNA, 18 nt, Homo sapiens
uggccauguucauucaca

SEQ ID NO: 952364 - RNA, 12 nt, Homo sapiens
uggccucaggag

SEQ ID NO: 952365 - RNA, 13 nt, Homo sapiens
uggccugacacaa

SEQ ID NO: 952366 - RNA, 15 nt, Homo sapiens
uggcucaacacauga

SEQ ID NO: 952367 - RNA, 15 nt, Homo sapiens
uggcucacaccugua

SEQ ID NO: 952368 - RNA, 15 nt, Homo sapiens
uggcucagcucucaa

SEQ ID NO: 952369 - RNA, 21 nt, Homo sapiens
uggcugaucauugcaguauca

SEQ ID NO: 952370 - RNA, 12 nt, Homo sapiens
uggcugauuuca

SEQ ID NO: 952371 - RNA, 21 nt, Homo sapiens
uggcuguccucuuaagacacu

SEQ ID NO: 952372 - RNA, 21 nt, Homo sapiens
ugggaacuaaggggguauuua

SEQ ID NO: 952373 - RNA, 16 nt, Homo sapiens
ugggaagaacaugcua

SEQ ID NO: 952374 - RNA, 17 nt, Homo sapiens
ugggauuacagguguga

SEQ ID NO: 952375 - RNA, 16 nt, Homo sapiens
uggggaggaguugucu

SEQ ID NO: 952376 - RNA, 22 nt, Homo sapiens
ugggucucucauaccucuggga

SEQ ID NO: 952377 - RNA, 22 nt, Homo sapiens
uggguggauuauaaacaacaga

SEQ ID NO: 952378 - RNA, 14 nt, Homo sapiens
ugguaaaugucaca

SEQ ID NO: 952379 - RNA, 16 nt, Homo sapiens
ugguaacugcacacau

SEQ ID NO: 952380 - RNA, 19 nt, Homo sapiens
ugguacaacacuugcacaa

SEQ ID NO: 952381 - RNA, 16 nt, Homo sapiens
ugguacuauugugacc

SEQ ID NO: 952382 - RNA, 19 nt, Homo sapiens
uggugaagaauggacuuaa

SEQ ID NO: 952383 - RNA, 15 nt, Homo sapiens
uggugcacaccugua

SEQ ID NO: 952384 - RNA, 19 nt, Homo sapiens
uggugcaguaaccauuuaa

SEQ ID NO: 952385 - RNA, 22 nt, Homo sapiens
ugguggccaucacuuucauuca

SEQ ID NO: 952386 - RNA, 16 nt, Homo sapiens
uggugucccuuucaca

SEQ ID NO: 952387 - RNA, 23 nt, Homo sapiens
uggugugaucccagcucacugca

SEQ ID NO: 952388 - RNA, 22 nt, Homo sapiens
ugguguuuagaaugucaguuga

SEQ ID NO: 952389 - RNA, 15 nt, Homo sapiens
ugguuugcaugacuu

SEQ ID NO: 952390 - RNA, 12 nt, Homo sapiens
ugguuuuggaca

SEQ ID NO: 952391 - RNA, 15 nt, Homo sapiens
uguaaacaucauaaa

SEQ ID NO: 952392 - RNA, 15 nt, Homo sapiens
uguaagaggaugugg

SEQ ID NO: 952393 - RNA, 17 nt, Homo sapiens
uguaagaggaugugguu

SEQ ID NO: 952394 - RNA, 19 nt, Homo sapiens
uguaaucccagcacuuugg

SEQ ID NO: 952395 - RNA, 17 nt, Homo sapiens
uguacaauuuucauccc

SEQ ID NO: 952396 - RNA, 18 nt, Homo sapiens
uguacaauuuucauccca

SEQ ID NO: 952397 - RNA, 21 nt, Homo sapiens
uguacagaaacaacugccaaa

SEQ ID NO: 952398 - RNA, 22 nt, Homo sapiens
uguacagaaacaacugccaaau

SEQ ID NO: 952399 - RNA, 19 nt, Homo sapiens
uguacaguuauacauaccu

SEQ ID NO: 952400 - RNA, 19 nt, Homo sapiens
uguacuuucccuguguacc

SEQ ID NO: 952401 - RNA, 13 nt, Homo sapiens
uguauaacaagcc

SEQ ID NO: 952402 - RNA, 17 nt, Homo sapiens
uguauagaccaugcaca

SEQ ID NO: 952403 - RNA, 23 nt, Homo sapiens
uguauauauuuauuauuuucaua

SEQ ID NO: 952404 - RNA, 17 nt, Homo sapiens
uguauuucaaaaucacc

SEQ ID NO: 952405 - RNA, 15 nt, Homo sapiens
ugucaaggcaguugc

SEQ ID NO: 952406 - RNA, 17 nt, Homo sapiens
ugucacagaaucuccau

SEQ ID NO: 952407 - RNA, 16 nt, Homo sapiens
ugucacaugaugaaua

SEQ ID NO: 952408 - RNA, 15 nt, Homo sapiens
ugucaggcaguagca

SEQ ID NO: 952409 - RNA, 20 nt, Homo sapiens
ugucagucuguccacgugga

SEQ ID NO: 952410 - RNA, 22 nt, Homo sapiens
uguccuuuucuuuucuugaggc

SEQ ID NO: 952411 - RNA, 13 nt, Homo sapiens
ugucucugagaac

SEQ ID NO: 952412 - RNA, 18 nt, Homo sapiens
ugucuuaguacaccauaa

SEQ ID NO: 952413 - RNA, 15 nt, Homo sapiens
ugugaccgggguccu

SEQ ID NO: 952414 - RNA, 13 nt, Homo sapiens
ugugaucuaagca

SEQ ID NO: 952415 - RNA, 19 nt, Homo sapiens
ugugcauacgccucuuguu

SEQ ID NO: 952416 - RNA, 21 nt, Homo sapiens
ugugcgacuucacaaaaugca

SEQ ID NO: 952417 - RNA, 22 nt, Homo sapiens
ugugcuggccugaaaccaguga

SEQ ID NO: 952418 - RNA, 12 nt, Homo sapiens
ugugcuuucaug

SEQ ID NO: 952419 - RNA, 14 nt, Homo sapiens
uguggaaauaugca

SEQ ID NO: 952420 - RNA, 21 nt, Homo sapiens
uguggagugacucaaaucagu

SEQ ID NO: 952421 - RNA, 20 nt, Homo sapiens
uguggcugauuucaaaugca

SEQ ID NO: 952422 - RNA, 20 nt, Homo sapiens
uguguaaacagaagccuguu

SEQ ID NO: 952423 - RNA, 20 nt, Homo sapiens
uguguaacuguucuuugcag

SEQ ID NO: 952424 - RNA, 17 nt, Homo sapiens
uguguacuguauagaca

SEQ ID NO: 952425 - RNA, 18 nt, Homo sapiens
ugugugaaaauacuggaa

SEQ ID NO: 952426 - RNA, 23 nt, Homo sapiens
uguuaucuucuaucaaagcacau

SEQ ID NO: 952427 - RNA, 16 nt, Homo sapiens
uguucagaaauaugaa

SEQ ID NO: 952428 - RNA, 16 nt, Homo sapiens
uguucccugaggaccu

SEQ ID NO: 952429 - RNA, 17 nt, Homo sapiens
uguucuuaaaaccaauu

SEQ ID NO: 952430 - RNA, 16 nt, Homo sapiens
uguucuuugcagugaa

SEQ ID NO: 952431 - RNA, 23 nt, Homo sapiens
uguugauaauaguaaugguucua

SEQ ID NO: 952432 - RNA, 22 nt, Homo sapiens
uguugccagcguggcaacaggc

SEQ ID NO: 952433 - RNA, 18 nt, Homo sapiens
uguuggguggaggaugga

SEQ ID NO: 952434 - RNA, 16 nt, Homo sapiens
uguuguuuuuccucaa

SEQ ID NO: 952435 - RNA, 20 nt, Homo sapiens
uguuuccuguggaaauaugc

SEQ ID NO: 952436 - RNA, 17 nt, Homo sapiens
uguuuuucuuuaaucaa

SEQ ID NO: 952437 - RNA, 13 nt, Homo sapiens
uuaaaaaccauua

SEQ ID NO: 952438 - RNA, 14 nt, Homo sapiens
uuaaaaagcccaac

SEQ ID NO: 952439 - RNA, 21 nt, Homo sapiens
uuaaaacauaagccacaggcc

SEQ ID NO: 952440 - RNA, 13 nt, Homo sapiens
uuaaaaccaucug

SEQ ID NO: 952441 - RNA, 14 nt, Homo sapiens
uuaaaauagucaua

SEQ ID NO: 952442 - RNA, 15 nt, Homo sapiens
uuaaagaacacugca

SEQ ID NO: 952443 - RNA, 18 nt, Homo sapiens
uuaaagcaaaaaacuuca

SEQ ID NO: 952444 - RNA, 14 nt, Homo sapiens
uuaaaucauuucau

SEQ ID NO: 952445 - RNA, 18 nt, Homo sapiens
uuaaauuuagcugcugca

SEQ ID NO: 952446 - RNA, 20 nt, Homo sapiens
uuaacauaaacuuguacuua

SEQ ID NO: 952447 - RNA, 22 nt, Homo sapiens
uuaacgacagaagguugccagg

SEQ ID NO: 952448 - RNA, 13 nt, Homo sapiens
uuaauaaagauuc

SEQ ID NO: 952449 - RNA, 14 nt, Homo sapiens
uuaaugguaucugu

SEQ ID NO: 952450 - RNA, 12 nt, Homo sapiens
uuacacaauggu

SEQ ID NO: 952451 - RNA, 14 nt, Homo sapiens
uuacaggaaaugca

SEQ ID NO: 952452 - RNA, 23 nt, Homo sapiens
uuacauccagaguucugugacac

SEQ ID NO: 952453 - RNA, 20 nt, Homo sapiens
uuacauuguaguuaaacaaa

SEQ ID NO: 952454 - RNA, 13 nt, Homo sapiens
uuaccaaaacaua

SEQ ID NO: 952455 - RNA, 12 nt, Homo sapiens
uuacccauuucu

SEQ ID NO: 952456 - RNA, 18 nt, Homo sapiens
uuagaacaggguuucuca

SEQ ID NO: 952457 - RNA, 20 nt, Homo sapiens
uuagaaugucaguugaucag

SEQ ID NO: 952458 - RNA, 19 nt, Homo sapiens
uuagcacaaagaugugcaa

SEQ ID NO: 952459 - RNA, 22 nt, Homo sapiens
uuaggagaacagguguuccucc

SEQ ID NO: 952460 - RNA, 21 nt, Homo sapiens
uuauaaaaucuuuccaucuca

SEQ ID NO: 952461 - RNA, 16 nt, Homo sapiens
uuaucaacaugcacac

SEQ ID NO: 952462 - RNA, 12 nt, Homo sapiens
uuauccauguac

SEQ ID NO: 952463 - RNA, 21 nt, Homo sapiens
uuaucuagcaagaagauucua

SEQ ID NO: 952464 - RNA, 20 nt, Homo sapiens
uuaugaaguuaacagucuca

SEQ ID NO: 952465 - RNA, 17 nt, Homo sapiens
uuaugacuccagaauuu

SEQ ID NO: 952466 - RNA, 14 nt, Homo sapiens
uuauguaaacauca

SEQ ID NO: 952467 - RNA, 20 nt, Homo sapiens
uuauguggauuucaucacua

SEQ ID NO: 952468 - RNA, 13 nt, Homo sapiens
uuauuaaucucau

SEQ ID NO: 952469 - RNA, 23 nt, Homo sapiens
uuauugaauaacgcacaguauuu

SEQ ID NO: 952470 - RNA, 23 nt, Homo sapiens
uuauugaguaauauuacauuuca

SEQ ID NO: 952471 - RNA, 14 nt, Homo sapiens
uuauuuagcccaua

SEQ ID NO: 952472 - RNA, 18 nt, Homo sapiens
uuauuugacucagcacug

SEQ ID NO: 952473 - RNA, 19 nt, Homo sapiens
uuauuuucuccaugucugu

SEQ ID NO: 952474 - RNA, 14 nt, Homo sapiens
uucaaaacuuucag

SEQ ID NO: 952475 - RNA, 20 nt, Homo sapiens
uucaaacauugagacugcua

SEQ ID NO: 952476 - RNA, 14 nt, Homo sapiens
uucaacauaugaau

SEQ ID NO: 952477 - RNA, 22 nt, Homo sapiens
uucaacgucccccgcucaggug

SEQ ID NO: 952478 - RNA, 20 nt, Homo sapiens
uucaaugaaucaaauccaau

SEQ ID NO: 952479 - RNA, 19 nt, Homo sapiens
uucacaauauccaaugaag

SEQ ID NO: 952480 - RNA, 23 nt, Homo sapiens
uucacaauauccaaugaagaagg

SEQ ID NO: 952481 - RNA, 16 nt, Homo sapiens
uucaccauguugccca

SEQ ID NO: 952482 - RNA, 15 nt, Homo sapiens
uucacucuccagggu

SEQ ID NO: 952483 - RNA, 16 nt, Homo sapiens
uucacugcauguaggu

SEQ ID NO: 952484 - RNA, 15 nt, Homo sapiens
uucagaaaagacacu

SEQ ID NO: 952485 - RNA, 16 nt, Homo sapiens
uucagaaaagacacuu

SEQ ID NO: 952486 - RNA, 14 nt, Homo sapiens
uucagaaauaugaa

SEQ ID NO: 952487 - RNA, 13 nt, Homo sapiens
uucagagauguac

SEQ ID NO: 952488 - RNA, 16 nt, Homo sapiens
uucagccaagaauucu

SEQ ID NO: 952489 - RNA, 19 nt, Homo sapiens
uucagugccaaaaacaaca

SEQ ID NO: 952490 - RNA, 16 nt, Homo sapiens
uucauccaacuggaag

SEQ ID NO: 952491 - RNA, 12 nt, Homo sapiens
aaaaaaugucaa

SEQ ID NO: 952492 - RNA, 21 nt, Homo sapiens
aaaaagcugcuauccaaugau

SEQ ID NO: 952493 - RNA, 20 nt, Homo sapiens
aaaaaggaugcauucccuac

SEQ ID NO: 952494 - RNA, 14 nt, Homo sapiens
aaaaauaaagggaa

SEQ ID NO: 952495 - RNA, 14 nt, Homo sapiens
aaaaauaugugaau

SEQ ID NO: 952496 - RNA, 19 nt, Homo sapiens
aaaacauucuuuaacauac

SEQ ID NO: 952497 - RNA, 14 nt, Homo sapiens
aaaaccuuacuuaa

SEQ ID NO: 952498 - RNA, 20 nt, Homo sapiens
aaaagagcccaaaugaccaa

SEQ ID NO: 952499 - RNA, 18 nt, Homo sapiens
aaaagaugaagcugagau

SEQ ID NO: 952500 - RNA, 16 nt, Homo sapiens
aaaagcugacuacuug

SEQ ID NO: 952501 - RNA, 18 nt, Homo sapiens
aaaagcugcuauccaaug

SEQ ID NO: 952502 - RNA, 22 nt, Homo sapiens
aaaagcugcuauccaaugauau

SEQ ID NO: 952503 - RNA, 16 nt, Homo sapiens
aaaagugucacuaaga

SEQ ID NO: 952504 - RNA, 13 nt, Homo sapiens
aaaauaaauggac

SEQ ID NO: 952505 - RNA, 12 nt, Homo sapiens
aaaauaguagca

SEQ ID NO: 952506 - RNA, 13 nt, Homo sapiens
aaaauaguuuaaa

SEQ ID NO: 952507 - RNA, 21 nt, Homo sapiens
aaaauauagacuggauaauca

SEQ ID NO: 952508 - RNA, 13 nt, Homo sapiens
aaaaucauaacuc

SEQ ID NO: 952509 - RNA, 18 nt, Homo sapiens
aaaaucuuuccaucucau

SEQ ID NO: 952510 - RNA, 14 nt, Homo sapiens
aaaaugaacuguau

SEQ ID NO: 952511 - RNA, 22 nt, Homo sapiens
aaaaugcuguucagaaauauga

SEQ ID NO: 952512 - RNA, 11 nt, Homo sapiens
aaaaugcuuuc

SEQ ID NO: 952513 - RNA, 11 nt, Homo sapiens
aaaauggacau

SEQ ID NO: 952514 - RNA, 17 nt, Homo sapiens
aaaaugggaagcauuag

SEQ ID NO: 952515 - RNA, 16 nt, Homo sapiens
aaaauguauuuuucac

SEQ ID NO: 952516 - RNA, 14 nt, Homo sapiens
aaaauuguuauuuc

SEQ ID NO: 952517 - RNA, 19 nt, Homo sapiens
aaacaguccaaacuguucu

SEQ ID NO: 952518 - RNA, 13 nt, Homo sapiens
aaacauaagccac

SEQ ID NO: 952519 - RNA, 15 nt, Homo sapiens
aaacauaagccacag

SEQ ID NO: 952520 - RNA, 19 nt, Homo sapiens
aaacauaauaucuugaaga

SEQ ID NO: 952521 - RNA, 22 nt, Homo sapiens
aaacauguggcaaccuguucuu

SEQ ID NO: 952522 - RNA, 15 nt, Homo sapiens
aaaccucuguucuca

SEQ ID NO: 952523 - RNA, 15 nt, Homo sapiens
aaacgagauuugcca

SEQ ID NO: 952524 - RNA, 18 nt, Homo sapiens
aaacuacccucuggagau

SEQ ID NO: 952525 - RNA, 21 nt, Homo sapiens
aaacugauguauagcuuuaac

SEQ ID NO: 952526 - RNA, 18 nt, Homo sapiens
aaacugucuuuuuccuca

SEQ ID NO: 952527 - RNA, 13 nt, Homo sapiens
aaacuuguguaug

SEQ ID NO: 952528 - RNA, 23 nt, Homo sapiens
aaacuuuccuguacucacugagu

SEQ ID NO: 952529 - RNA, 19 nt, Homo sapiens
aaagacauuucauccacca

SEQ ID NO: 952530 - RNA, 22 nt, Homo sapiens
aaagagaugucaaaaugugauu

SEQ ID NO: 952531 - RNA, 14 nt, Homo sapiens
aaagagcuaggaaa

SEQ ID NO: 952532 - RNA, 19 nt, Homo sapiens
aaagaggcccaagugcaaa

SEQ ID NO: 952533 - RNA, 20 nt, Homo sapiens
aaagagguaaaaaacuguca

SEQ ID NO: 952534 - RNA, 14 nt, Homo sapiens
aaagaugugcaaag

SEQ ID NO: 952535 - RNA, 14 nt, Homo sapiens
aaagccacuuuccu

SEQ ID NO: 952536 - RNA, 20 nt, Homo sapiens
aaagcugggaggccaaacac

SEQ ID NO: 952537 - RNA, 16 nt, Homo sapiens
aaaggaaaacgugaac

SEQ ID NO: 952538 - RNA, 14 nt, Homo sapiens
aaaggaaaguucua

SEQ ID NO: 952539 - RNA, 20 nt, Homo sapiens
aaaggcuggaugugcuuuca

SEQ ID NO: 952540 - RNA, 16 nt, Homo sapiens
aaagguauguaaacuu

SEQ ID NO: 952541 - RNA, 18 nt, Homo sapiens
aaaguaucucuacuuucc

SEQ ID NO: 952542 - RNA, 19 nt, Homo sapiens
aaagucauucaguuaucac

SEQ ID NO: 952543 - RNA, 21 nt, Homo sapiens
aaaguggugagaggcauccag

SEQ ID NO: 952544 - RNA, 14 nt, Homo sapiens
aaauaaaaauauuc

SEQ ID NO: 952545 - RNA, 16 nt, Homo sapiens
aaauaaagaguucucc

SEQ ID NO: 952546 - RNA, 12 nt, Homo sapiens
aaauaacacugu

SEQ ID NO: 952547 - RNA, 19 nt, Homo sapiens
aaauaacacuguacugcaa

SEQ ID NO: 952548 - RNA, 16 nt, Homo sapiens
aaauaagcuucaucuc

SEQ ID NO: 952549 - RNA, 19 nt, Homo sapiens
aaauaaugauucaauguga

SEQ ID NO: 952550 - RNA, 11 nt, Homo sapiens
aaauacuucua

SEQ ID NO: 952551 - RNA, 14 nt, Homo sapiens
aaauagcaucugcu

SEQ ID NO: 952552 - RNA, 15 nt, Homo sapiens
aaauauaaacuugug

SEQ ID NO: 952553 - RNA, 17 nt, Homo sapiens
aaauauacaaacaugug

SEQ ID NO: 952554 - RNA, 17 nt, Homo sapiens
aaauauguggaguucau

SEQ ID NO: 952555 - RNA, 22 nt, Homo sapiens
aaauauucugucauugguuaca

SEQ ID NO: 952556 - RNA, 16 nt, Homo sapiens
aaauccuguuacuuaa

SEQ ID NO: 952557 - RNA, 22 nt, Homo sapiens
aaaucuuucagaauacaauuca

SEQ ID NO: 952558 - RNA, 21 nt, Homo sapiens
aaaugaacauuuaacuagccu

SEQ ID NO: 952559 - RNA, 16 nt, Homo sapiens
aaaugcaguccaguga

SEQ ID NO: 952560 - RNA, 19 nt, Homo sapiens
aaaugcaguccagugagaa

SEQ ID NO: 952561 - RNA, 12 nt, Homo sapiens
aaaugcuuucuc

SEQ ID NO: 952562 - RNA, 13 nt, Homo sapiens
aaaugcuuucuca

SEQ ID NO: 952563 - RNA, 16 nt, Homo sapiens
aaaugggaagcauuag

SEQ ID NO: 952564 - RNA, 23 nt, Homo sapiens
aaauguaggcuuucauguugcaa

SEQ ID NO: 952565 - RNA, 18 nt, Homo sapiens
aaauguauuuuucacaaa

SEQ ID NO: 952566 - RNA, 13 nt, Homo sapiens
aaaugugauucua

SEQ ID NO: 952567 - RNA, 14 nt, Homo sapiens
aaauucuagucucu

SEQ ID NO: 952568 - RNA, 23 nt, Homo sapiens
aaauuuuuacucaggcuuucuau

SEQ ID NO: 952569 - RNA, 15 nt, Homo sapiens
aacaaacuuacuguc

SEQ ID NO: 952570 - RNA, 23 nt, Homo sapiens
aacaaauguaaauagaacgaauu

SEQ ID NO: 952571 - RNA, 20 nt, Homo sapiens
aacaaauguggcuccaagcu

SEQ ID NO: 952572 - RNA, 14 nt, Homo sapiens
aacaacaacuuaau

SEQ ID NO: 952573 - RNA, 18 nt, Homo sapiens
aacaacaacuuaaugugc

SEQ ID NO: 952574 - RNA, 18 nt, Homo sapiens
aacaacagaaacuucuca

SEQ ID NO: 952575 - RNA, 12 nt, Homo sapiens
aacaagugcucu

SEQ ID NO: 952576 - RNA, 13 nt, Homo sapiens
aacaagugcucuu

SEQ ID NO: 952577 - RNA, 19 nt, Homo sapiens
aacaccuucuuauuauaua

SEQ ID NO: 952578 - RNA, 23 nt, Homo sapiens
aacagaaacgagauuugccaaaa

SEQ ID NO: 952579 - RNA, 14 nt, Homo sapiens
aacagaaacuucuc

SEQ ID NO: 952580 - RNA, 13 nt, Homo sapiens
aacagaacuuauu

SEQ ID NO: 952581 - RNA, 22 nt, Homo sapiens
aacagaccagcauaguucugca

SEQ ID NO: 952582 - RNA, 22 nt, Homo sapiens
accaaucaucuuaacuuggcua

SEQ ID NO: 952583 - RNA, 17 nt, Homo sapiens
accaauggcugcaucaa

SEQ ID NO: 952584 - RNA, 12 nt, Homo sapiens
accacacagcac

SEQ ID NO: 952585 - RNA, 14 nt, Homo sapiens
accaccaaccacug

SEQ ID NO: 952586 - RNA, 18 nt, Homo sapiens
accacuuucaccugggau

SEQ ID NO: 952587 - RNA, 13 nt, Homo sapiens
accagagcacugu

SEQ ID NO: 952588 - RNA, 14 nt, Homo sapiens
accagagcacugua

SEQ ID NO: 952589 - RNA, 18 nt, Homo sapiens
accagaguggaaauucau

SEQ ID NO: 952590 - RNA, 13 nt, Homo sapiens
accagcacacucc

SEQ ID NO: 952591 - RNA, 21 nt, Homo sapiens
accaggaaacuagcuguuuaa

SEQ ID NO: 952592 - RNA, 19 nt, Homo sapiens
accagugacucaucuucuc

SEQ ID NO: 952593 - RNA, 18 nt, Homo sapiens
accauauggaaugccaaa

SEQ ID NO: 952594 - RNA, 15 nt, Homo sapiens
accauauguagcauu

SEQ ID NO: 952595 - RNA, 14 nt, Homo sapiens
accaugcauuucuc

SEQ ID NO: 952596 - RNA, 14 nt, Homo sapiens
accauguugcccag

SEQ ID NO: 952597 - RNA, 20 nt, Homo sapiens
acccaaauaaauguguaaau

SEQ ID NO: 952598 - RNA, 17 nt, Homo sapiens
acccaguguucagcaua

SEQ ID NO: 952599 - RNA, 12 nt, Homo sapiens
accccaccugcu

SEQ ID NO: 952600 - RNA, 21 nt, Homo sapiens
accccacuuuuuguuguucau

SEQ ID NO: 952601 - RNA, 22 nt, Homo sapiens
accccacuuuuuguuguucauu

SEQ ID NO: 952602 - RNA, 20 nt, Homo sapiens
accccgagcacgguugccug

SEQ ID NO: 952603 - RNA, 16 nt, Homo sapiens
acccuauaaaagugau

SEQ ID NO: 952604 - RNA, 14 nt, Homo sapiens
acccucaauucaua

SEQ ID NO: 952605 - RNA, 12 nt, Homo sapiens
acccuccaugua

SEQ ID NO: 952606 - RNA, 16 nt, Homo sapiens
acccucuccuugucac

SEQ ID NO: 952607 - RNA, 15 nt, Homo sapiens
acccucuggagauaa

SEQ ID NO: 952608 - RNA, 21 nt, Homo sapiens
acccuggauaagucacuuaaa

SEQ ID NO: 952609 - RNA, 21 nt, Homo sapiens
acccugugugguauuuuggca

SEQ ID NO: 952610 - RNA, 13 nt, Homo sapiens
accgucaauguga

SEQ ID NO: 952611 - RNA, 11 nt, Homo sapiens
accucccucau

SEQ ID NO: 952612 - RNA, 13 nt, Homo sapiens
accucuauauguu

SEQ ID NO: 952613 - RNA, 17 nt, Homo sapiens
accucuguucucaugaa

SEQ ID NO: 952614 - RNA, 11 nt, Homo sapiens
accugaagucu

SEQ ID NO: 952615 - RNA, 16 nt, Homo sapiens
accugcgcaaagggcg

SEQ ID NO: 952616 - RNA, 17 nt, Homo sapiens
accuguagaaaagugag

SEQ ID NO: 952617 - RNA, 21 nt, Homo sapiens
accuguauagaccaugcacag

SEQ ID NO: 952618 - RNA, 15 nt, Homo sapiens
accuucacucuccag

SEQ ID NO: 952619 - RNA, 21 nt, Homo sapiens
accuuguacagaaccagcacu

SEQ ID NO: 952620 - RNA, 16 nt, Homo sapiens
accuuguguacuuucu

SEQ ID NO: 952621 - RNA, 18 nt, Homo sapiens
accuuguguacuuucuuc

SEQ ID NO: 952622 - RNA, 21 nt, Homo sapiens
accuuuaggccaucucagcuu

SEQ ID NO: 952623 - RNA, 13 nt, Homo sapiens
acgaaagcacagu

SEQ ID NO: 952624 - RNA, 15 nt, Homo sapiens
acgcgugcaugcaca

SEQ ID NO: 952625 - RNA, 19 nt, Homo sapiens
acgcuugcacacaugcaca

SEQ ID NO: 952626 - RNA, 19 nt, Homo sapiens
acggagguccuuuggacag

SEQ ID NO: 952627 - RNA, 18 nt, Homo sapiens
acgggguuacacuguuaa

SEQ ID NO: 952628 - RNA, 18 nt, Homo sapiens
acguggugaaugugcaca

SEQ ID NO: 952629 - RNA, 13 nt, Homo sapiens
acguggugugaga

SEQ ID NO: 952630 - RNA, 19 nt, Homo sapiens
acguguuaugacuccagaa

SEQ ID NO: 952631 - RNA, 14 nt, Homo sapiens
acuaaaauaguuua

SEQ ID NO: 952632 - RNA, 14 nt, Homo sapiens
acuaacacaugcac

SEQ ID NO: 952633 - RNA, 20 nt, Homo sapiens
acuaaugaggaaacugcacu

SEQ ID NO: 952634 - RNA, 22 nt, Homo sapiens
aaaaacagcaggggcauuaguu

SEQ ID NO: 952635 - RNA, 16 nt, Homo sapiens
aaaaagcccaaccucu

SEQ ID NO: 952636 - RNA, 14 nt, Homo sapiens
aaaaagcugcuauc

SEQ ID NO: 952637 - RNA, 20 nt, Homo sapiens
aaaaauaaccaaaaaaugug

SEQ ID NO: 952638 - RNA, 13 nt, Homo sapiens
aaaaauaacugug

SEQ ID NO: 952639 - RNA, 18 nt, Homo sapiens
aaaaauauucuccaugga

SEQ ID NO: 952640 - RNA, 11 nt, Homo sapiens
aaaaauccaua

SEQ ID NO: 952641 - RNA, 14 nt, Homo sapiens
aaaaaugaaugacu

SEQ ID NO: 952642 - RNA, 19 nt, Homo sapiens
aaaacaaacccaaagguag

SEQ ID NO: 952643 - RNA, 17 nt, Homo sapiens
aaaacaauauguuagau

SEQ ID NO: 952644 - RNA, 13 nt, Homo sapiens
aaaacaauguaau

SEQ ID NO: 952645 - RNA, 12 nt, Homo sapiens
aaaacacaacau

SEQ ID NO: 952646 - RNA, 23 nt, Homo sapiens
aaaaccauuauaaaaucuuucca

SEQ ID NO: 952647 - RNA, 22 nt, Homo sapiens
aaaacuggguaugcguuucaug

SEQ ID NO: 952648 - RNA, 18 nt, Homo sapiens
aaaagcugacuacuugau

SEQ ID NO: 952649 - RNA, 14 nt, Homo sapiens
aaaagugucacuaa

SEQ ID NO: 952650 - RNA, 12 nt, Homo sapiens
aaaaguuaacau

SEQ ID NO: 952651 - RNA, 18 nt, Homo sapiens
aaaaguuuaaaaagcuca

SEQ ID NO: 952652 - RNA, 17 nt, Homo sapiens
aaaauaagcuucaucuc

SEQ ID NO: 952653 - RNA, 17 nt, Homo sapiens
aaaauaaguugacuuuc

SEQ ID NO: 952654 - RNA, 16 nt, Homo sapiens
aaaauaauugggugac

SEQ ID NO: 952655 - RNA, 22 nt, Homo sapiens
aaaauaguugcaaagcauuuga

SEQ ID NO: 952656 - RNA, 14 nt, Homo sapiens
aaaaugcuguucag

SEQ ID NO: 952657 - RNA, 21 nt, Homo sapiens
aaaauggaccuaucuguaaga

SEQ ID NO: 952658 - RNA, 14 nt, Homo sapiens
aaacaauuuagcca

SEQ ID NO: 952659 - RNA, 16 nt, Homo sapiens
aaacaauuuagccaga

SEQ ID NO: 952660 - RNA, 15 nt, Homo sapiens
aaacaccacugaaca

SEQ ID NO: 952661 - RNA, 15 nt, Homo sapiens
aaacacccaagcaca

SEQ ID NO: 952662 - RNA, 23 nt, Homo sapiens
aggaucucugagaccacagaggc

SEQ ID NO: 952663 - RNA, 16 nt, Homo sapiens
aggauuugaaaacacc

SEQ ID NO: 952664 - RNA, 14 nt, Homo sapiens
aggcaacauuacaa

SEQ ID NO: 952665 - RNA, 14 nt, Homo sapiens
aggcaggagggcau

SEQ ID NO: 952666 - RNA, 14 nt, Homo sapiens
aggcagggucucac

SEQ ID NO: 952667 - RNA, 15 nt, Homo sapiens
aggcagggucucacu

SEQ ID NO: 952668 - RNA, 19 nt, Homo sapiens
aggcaucugauuugcauau

SEQ ID NO: 952669 - RNA, 12 nt, Homo sapiens
aggccauuccag

SEQ ID NO: 952670 - RNA, 20 nt, Homo sapiens
aggcccaugcccuccguccu

SEQ ID NO: 952671 - RNA, 20 nt, Homo sapiens
aggcuggucuugaacucuug

SEQ ID NO: 952672 - RNA, 19 nt, Homo sapiens
aggcugucaauuacaggaa

SEQ ID NO: 952673 - RNA, 16 nt, Homo sapiens
aggcuuggaccugcug

SEQ ID NO: 952674 - RNA, 22 nt, Homo sapiens
aggcuuggcauaguccaaaauu

SEQ ID NO: 952675 - RNA, 15 nt, Homo sapiens
agggagaagaaagaa

SEQ ID NO: 952676 - RNA, 12 nt, Homo sapiens
agggaggggaag

SEQ ID NO: 952677 - RNA, 21 nt, Homo sapiens
agggcagagucuaccuugaaa

SEQ ID NO: 952678 - RNA, 15 nt, Homo sapiens
agggcaggccuguuc

SEQ ID NO: 952679 - RNA, 13 nt, Homo sapiens
agggccucuggac

SEQ ID NO: 952680 - RNA, 18 nt, Homo sapiens
agggcucacccacugcug

SEQ ID NO: 952681 - RNA, 18 nt, Homo sapiens
aggggagaguaacccugu

SEQ ID NO: 952682 - RNA, 18 nt, Homo sapiens
aggggagaugacauuugc

SEQ ID NO: 952683 - RNA, 14 nt, Homo sapiens
agggucucacugug

SEQ ID NO: 952684 - RNA, 23 nt, Homo sapiens
agggucuuccuccuaaauuucca

SEQ ID NO: 952685 - RNA, 14 nt, Homo sapiens
agggugcuacucau

SEQ ID NO: 952686 - RNA, 16 nt, Homo sapiens
agguaaagucaaagcu

SEQ ID NO: 952687 - RNA, 23 nt, Homo sapiens
agguaaauaaagccacuuuccuc

SEQ ID NO: 952688 - RNA, 21 nt, Homo sapiens
agguaacuucucccuucuccu

SEQ ID NO: 952689 - RNA, 23 nt, Homo sapiens
agguaaguuucaguggagcucag

SEQ ID NO: 952690 - RNA, 14 nt, Homo sapiens
agguccuuuggaca

SEQ ID NO: 952691 - RNA, 22 nt, Homo sapiens
aggucucauuaucuccaugaua

SEQ ID NO: 952692 - RNA, 19 nt, Homo sapiens
aggugugaccccaccugcu

SEQ ID NO: 952693 - RNA, 21 nt, Homo sapiens
agguguuaaaaaccauuauaa

SEQ ID NO: 952694 - RNA, 13 nt, Homo sapiens
agguguugucaag

SEQ ID NO: 952695 - RNA, 23 nt, Homo sapiens
agguuugguuugguuuuggacau

SEQ ID NO: 952696 - RNA, 20 nt, Homo sapiens
aguaacccugucuaaugaaa

SEQ ID NO: 952697 - RNA, 19 nt, Homo sapiens
aguaagagguuaugccaaa

SEQ ID NO: 952698 - RNA, 13 nt, Homo sapiens
aguaauggcagag

SEQ ID NO: 952699 - RNA, 14 nt, Homo sapiens
aguagagucacugg

SEQ ID NO: 952700 - RNA, 17 nt, Homo sapiens
aguaguuuuguucauga

SEQ ID NO: 952701 - RNA, 14 nt, Homo sapiens
aguauaaaaccaug

SEQ ID NO: 952702 - RNA, 19 nt, Homo sapiens
aguauggccccaccugcuc

SEQ ID NO: 952703 - RNA, 17 nt, Homo sapiens
aguaugugugcucuuau

SEQ ID NO: 952704 - RNA, 22 nt, Homo sapiens
aguauucugaucaguugccaaa

SEQ ID NO: 952705 - RNA, 13 nt, Homo sapiens
aguauugagauac

SEQ ID NO: 952706 - RNA, 13 nt, Homo sapiens
agucaaagcuuug

SEQ ID NO: 952707 - RNA, 13 nt, Homo sapiens
agucagcacguag

SEQ ID NO: 952708 - RNA, 13 nt, Homo sapiens
agucaucaucuca

SEQ ID NO: 952709 - RNA, 16 nt, Homo sapiens
agucauuuccuacccu

SEQ ID NO: 952710 - RNA, 14 nt, Homo sapiens
agucugcugcugug

SEQ ID NO: 952711 - RNA, 19 nt, Homo sapiens
agucugcuuaccaaaacau

SEQ ID NO: 952712 - RNA, 23 nt, Homo sapiens
agucugggcuacgguuccauguu

SEQ ID NO: 952713 - RNA, 23 nt, Homo sapiens
agucuuccuccucagucuucuca

SEQ ID NO: 952714 - RNA, 15 nt, Homo sapiens
agugaagauguguaa

SEQ ID NO: 952715 - RNA, 19 nt, Homo sapiens
agugcagaagcaugaucac

SEQ ID NO: 952716 - RNA, 20 nt, Homo sapiens
agugcagaagcaugaucaca

SEQ ID NO: 952717 - RNA, 16 nt, Homo sapiens
agugcagcaaccagag

SEQ ID NO: 952718 - RNA, 22 nt, Homo sapiens
agugcagcaaccagagcacugu

SEQ ID NO: 952719 - RNA, 13 nt, Homo sapiens
aguggcauggucc

SEQ ID NO: 952720 - RNA, 14 nt, Homo sapiens
aguggcuuugucag

SEQ ID NO: 952721 - RNA, 20 nt, Homo sapiens
aguggggcaaugacuuuccu

SEQ ID NO: 952722 - RNA, 18 nt, Homo sapiens
aguguggcgggaagggug

SEQ ID NO: 952723 - RNA, 20 nt, Homo sapiens
aguguugaggaggggagcaa

SEQ ID NO: 952724 - RNA, 21 nt, Homo sapiens
aguguuuguuagagugcacau

SEQ ID NO: 952725 - RNA, 15 nt, Homo sapiens
aguuaccucaugccg

SEQ ID NO: 952726 - RNA, 21 nt, Homo sapiens
aguuaccucaugccgcugugu

SEQ ID NO: 952727 - RNA, 11 nt, Homo sapiens
aguuaggugug

SEQ ID NO: 952728 - RNA, 15 nt, Homo sapiens
aguuaucaacaugca

SEQ ID NO: 952729 - RNA, 21 nt, Homo sapiens
aguuauguggauuucaucacu

SEQ ID NO: 952730 - RNA, 14 nt, Homo sapiens
aguucaucuugaau

SEQ ID NO: 952731 - RNA, 16 nt, Homo sapiens
aguucguaccuggcuu

SEQ ID NO: 952732 - RNA, 16 nt, Homo sapiens
aguugcaaagcauuug

SEQ ID NO: 952733 - RNA, 20 nt, Homo sapiens
aguugccaaagaaucuagga

SEQ ID NO: 952734 - RNA, 15 nt, Homo sapiens
uccccaauuccucug

SEQ ID NO: 952735 - RNA, 15 nt, Homo sapiens
uccccagcugggaag

SEQ ID NO: 952736 - RNA, 12 nt, Homo sapiens
uccccagggugc

SEQ ID NO: 952737 - RNA, 20 nt, Homo sapiens
uccccaguuaaugugccaaa

SEQ ID NO: 952738 - RNA, 15 nt, Homo sapiens
uccccugcuaccugc

SEQ ID NO: 952739 - RNA, 15 nt, Homo sapiens
ucccugaagugccag

SEQ ID NO: 952740 - RNA, 20 nt, Homo sapiens
ucccuguguacccuccaugu

SEQ ID NO: 952741 - RNA, 13 nt, Homo sapiens
uccgcccgcccac

SEQ ID NO: 952742 - RNA, 23 nt, Homo sapiens
uccuagaaaguucuguguaaaca

SEQ ID NO: 952743 - RNA, 23 nt, Homo sapiens
uccuagagagugugauguucacu

SEQ ID NO: 952744 - RNA, 19 nt, Homo sapiens
uccuauuugcacacgucca

SEQ ID NO: 952745 - RNA, 15 nt, Homo sapiens
uccucacucucgcca

SEQ ID NO: 952746 - RNA, 22 nt, Homo sapiens
uccucauauacuugaauauuau

SEQ ID NO: 952747 - RNA, 15 nt, Homo sapiens
uccuccccugcuacc

SEQ ID NO: 952748 - RNA, 17 nt, Homo sapiens
uccuccugacaccccac

SEQ ID NO: 952749 - RNA, 14 nt, Homo sapiens
uccucuaugugguu

SEQ ID NO: 952750 - RNA, 18 nt, Homo sapiens
uccucuccucguccggcc

SEQ ID NO: 952751 - RNA, 16 nt, Homo sapiens
uccucuuaagacacua

SEQ ID NO: 952752 - RNA, 14 nt, Homo sapiens
uccugaauguaauu

SEQ ID NO: 952753 - RNA, 12 nt, Homo sapiens
uccugacacccc

SEQ ID NO: 952754 - RNA, 14 nt, Homo sapiens
uccugaguucaagc

SEQ ID NO: 952755 - RNA, 22 nt, Homo sapiens
uccugccucacaguuguuaaag

SEQ ID NO: 952756 - RNA, 19 nt, Homo sapiens
uccugggccugggcuuuag

SEQ ID NO: 952757 - RNA, 16 nt, Homo sapiens
uccugugccucaucac

SEQ ID NO: 952758 - RNA, 13 nt, Homo sapiens
uccuguuacuuaa

SEQ ID NO: 952759 - RNA, 20 nt, Homo sapiens
uccuugaggaccuccaccug

SEQ ID NO: 952760 - RNA, 18 nt, Homo sapiens
uccuugcugauuugcaca

SEQ ID NO: 952761 - RNA, 22 nt, Homo sapiens
uccuuguaauguagacagacuu

SEQ ID NO: 952762 - RNA, 11 nt, Homo sapiens
uccuuguacuu

SEQ ID NO: 952763 - RNA, 21 nt, Homo sapiens
uccuugucacagaaucuccau

SEQ ID NO: 952764 - RNA, 16 nt, Homo sapiens
uccuuuguacugauga

SEQ ID NO: 952765 - RNA, 13 nt, Homo sapiens
uccuuuugcucug

SEQ ID NO: 952766 - RNA, 15 nt, Homo sapiens
ucgagugcauuugcu

SEQ ID NO: 952767 - RNA, 18 nt, Homo sapiens
ucgggugcccugcauuca

SEQ ID NO: 952768 - RNA, 21 nt, Homo sapiens
ucuaaagcagagauguauuau

SEQ ID NO: 952769 - RNA, 22 nt, Homo sapiens
ucuaaauaauaauaaaacaaca

SEQ ID NO: 952770 - RNA, 20 nt, Homo sapiens
ucuaagaaauccagcuucau

SEQ ID NO: 952771 - RNA, 21 nt, Homo sapiens
ucuaauugcccacccaguaug

SEQ ID NO: 952772 - RNA, 21 nt, Homo sapiens
ucuacacauucggcugaaugu

SEQ ID NO: 952773 - RNA, 17 nt, Homo sapiens
ucuacacucacaaucau

SEQ ID NO: 952774 - RNA, 22 nt, Homo sapiens
ucuacgcaaaaaauaacuacag

SEQ ID NO: 952775 - RNA, 23 nt, Homo sapiens
ucuagaaggaugaacaguucucc

SEQ ID NO: 952776 - RNA, 14 nt, Homo sapiens
ucuauaaaaugagg

SEQ ID NO: 952777 - RNA, 13 nt, Homo sapiens
ucuauaaauucaa

SEQ ID NO: 952778 - RNA, 13 nt, Homo sapiens
ucuauagcacaua

SEQ ID NO: 952779 - RNA, 18 nt, Homo sapiens
ucuauauuuggauucaca

SEQ ID NO: 952780 - RNA, 17 nt, Homo sapiens
ucuauugucacaugaug

SEQ ID NO: 952781 - RNA, 14 nt, Homo sapiens
ucucaaacacugcu

SEQ ID NO: 952782 - RNA, 17 nt, Homo sapiens
ucucaacugagugagca

SEQ ID NO: 952783 - RNA, 23 nt, Homo sapiens
ucucaauuuaguauaauaugcag

SEQ ID NO: 952784 - RNA, 19 nt, Homo sapiens
ucucacuguguugcccagg

SEQ ID NO: 952785 - RNA, 17 nt, Homo sapiens
ucucauuaucuccauga

SEQ ID NO: 952786 - RNA, 13 nt, Homo sapiens
ucucauucuugcc

SEQ ID NO: 952787 - RNA, 14 nt, Homo sapiens
ucucauucuugccc

SEQ ID NO: 952788 - RNA, 19 nt, Homo sapiens
ucuccauccuuaacugucc

SEQ ID NO: 952789 - RNA, 16 nt, Homo sapiens
ucuccauugcauucau

SEQ ID NO: 952790 - RNA, 12 nt, Homo sapiens
ucuccauuucac

SEQ ID NO: 952791 - RNA, 20 nt, Homo sapiens
ucucccaagacugcucccuu

SEQ ID NO: 952792 - RNA, 17 nt, Homo sapiens
ucuccugcgugugccca

SEQ ID NO: 952793 - RNA, 15 nt, Homo sapiens
ucucgccaagccauc

SEQ ID NO: 952794 - RNA, 20 nt, Homo sapiens
ucucgggugcccugcauuca

SEQ ID NO: 952795 - RNA, 15 nt, Homo sapiens
ucucguacuuucaca

SEQ ID NO: 952796 - RNA, 21 nt, Homo sapiens
ucucguucuuuacugggucua

SEQ ID NO: 952797 - RNA, 17 nt, Homo sapiens
ucucuaaaauucuaguc

SEQ ID NO: 952798 - RNA, 14 nt, Homo sapiens
ucucugagaacaga

SEQ ID NO: 952799 - RNA, 21 nt, Homo sapiens
ucucuguggccauuugugaua

SEQ ID NO: 952800 - RNA, 15 nt, Homo sapiens
ucucuguggggucua

SEQ ID NO: 952801 - RNA, 15 nt, Homo sapiens
ucugaccagagcuau

SEQ ID NO: 952802 - RNA, 21 nt, Homo sapiens
ucugagacucgcgacaaugca

SEQ ID NO: 952803 - RNA, 17 nt, Homo sapiens
ucugauuccaaauaagu

SEQ ID NO: 952804 - RNA, 20 nt, Homo sapiens
ucugcaaaguguaugugacc

SEQ ID NO: 952805 - RNA, 13 nt, Homo sapiens
ucugcagccugag

SEQ ID NO: 952806 - RNA, 20 nt, Homo sapiens
ucugcagcugcuuuugcauu

SEQ ID NO: 952807 - RNA, 21 nt, Homo sapiens
ucugccccagcuggagcauug

SEQ ID NO: 952808 - RNA, 16 nt, Homo sapiens
ucugccccuccguccc

SEQ ID NO: 952809 - RNA, 16 nt, Homo sapiens
ucugccuuugugcucu

SEQ ID NO: 952810 - RNA, 22 nt, Homo sapiens
ucugccuuugugcucuguuccu

SEQ ID NO: 952811 - RNA, 12 nt, Homo sapiens
ucugcuuaccaa

SEQ ID NO: 952812 - RNA, 17 nt, Homo sapiens
ucugcuuaccaaaacau

SEQ ID NO: 952813 - RNA, 20 nt, Homo sapiens
ucugcuugucauucugcuaa

SEQ ID NO: 952814 - RNA, 16 nt, Homo sapiens
ucuggagaccaggacu

SEQ ID NO: 952815 - RNA, 23 nt, Homo sapiens
ucugggcuacgguuccauguuca

SEQ ID NO: 952816 - RNA, 21 nt, Homo sapiens
ucuguaaauuuaacugcauau

SEQ ID NO: 952817 - RNA, 21 nt, Homo sapiens
ucuguaacugagcuccuccac

SEQ ID NO: 952818 - RNA, 14 nt, Homo sapiens
ucuguaagagaauu

SEQ ID NO: 952819 - RNA, 21 nt, Homo sapiens
ucuguccccgagccgagcucu

SEQ ID NO: 952820 - RNA, 15 nt, Homo sapiens
ucugugcuggccuga

SEQ ID NO: 952821 - RNA, 13 nt, Homo sapiens
ucuguuacuccaa

SEQ ID NO: 952822 - RNA, 14 nt, Homo sapiens
ucuguuccugucca

SEQ ID NO: 952823 - RNA, 17 nt, Homo sapiens
ucuguuccuguccagca

SEQ ID NO: 952824 - RNA, 14 nt, Homo sapiens
ucuguuucuauguc

SEQ ID NO: 952825 - RNA, 19 nt, Homo sapiens
ucuguuugauacaguauua

SEQ ID NO: 952826 - RNA, 20 nt, Homo sapiens
ucuguuuugcauggaguauu

SEQ ID NO: 952827 - RNA, 22 nt, Homo sapiens
ucuuaauaacuuaccagaaugu

SEQ ID NO: 952828 - RNA, 12 nt, Homo sapiens
ucuuacaguauu

SEQ ID NO: 952829 - RNA, 21 nt, Homo sapiens
ucuuagugaaaggucaucuca

SEQ ID NO: 952830 - RNA, 21 nt, Homo sapiens
uuagugguaaaugucacauug

SEQ ID NO: 952831 - RNA, 15 nt, Homo sapiens
uuaguguacuuugaa

SEQ ID NO: 952832 - RNA, 14 nt, Homo sapiens
uuauaaaaucuuuc

SEQ ID NO: 952833 - RNA, 13 nt, Homo sapiens
uuauacuaauuca

SEQ ID NO: 952834 - RNA, 16 nt, Homo sapiens
uuauagucuguacuuc

SEQ ID NO: 952835 - RNA, 22 nt, Homo sapiens
uuauauaaguuaaagagacaaa

SEQ ID NO: 952836 - RNA, 20 nt, Homo sapiens
uuauauacuggaaauaaccu

SEQ ID NO: 952837 - RNA, 18 nt, Homo sapiens
uuauauauuugaaagaag

SEQ ID NO: 952838 - RNA, 15 nt, Homo sapiens
uuauaucagaguaug

SEQ ID NO: 952839 - RNA, 18 nt, Homo sapiens
uuauccauccucugagau

SEQ ID NO: 952840 - RNA, 14 nt, Homo sapiens
uuaucuccaugaua

SEQ ID NO: 952841 - RNA, 15 nt, Homo sapiens
uuaucuuaucuagca

SEQ ID NO: 952842 - RNA, 13 nt, Homo sapiens
uuaugacuccaga

SEQ ID NO: 952843 - RNA, 15 nt, Homo sapiens
uuauuauuaaucuca

SEQ ID NO: 952844 - RNA, 17 nt, Homo sapiens
uuauucacugagucuca

SEQ ID NO: 952845 - RNA, 15 nt, Homo sapiens
uuauucuccaucuca

SEQ ID NO: 952846 - RNA, 20 nt, Homo sapiens
uuauugaauguuauaucauc

SEQ ID NO: 952847 - RNA, 20 nt, Homo sapiens
uuauuuagcccauaaucucu

SEQ ID NO: 952848 - RNA, 14 nt, Homo sapiens
uuauuuauauauga

SEQ ID NO: 952849 - RNA, 23 nt, Homo sapiens
uucaaaaaauuauuuuaggcaaa

SEQ ID NO: 952850 - RNA, 15 nt, Homo sapiens
uucaaaauguuaaca

SEQ ID NO: 952851 - RNA, 13 nt, Homo sapiens
uucaaugugaauu

SEQ ID NO: 952852 - RNA, 16 nt, Homo sapiens
uucaauucugauucca

SEQ ID NO: 952853 - RNA, 21 nt, Homo sapiens
uucacaaauauaguugaacaa

SEQ ID NO: 952854 - RNA, 14 nt, Homo sapiens
uucacaauauccaa

SEQ ID NO: 952855 - RNA, 22 nt, Homo sapiens
uucacagaggcgguuguaagag

SEQ ID NO: 952856 - RNA, 11 nt, Homo sapiens
uucacaucucu

SEQ ID NO: 952857 - RNA, 15 nt, Homo sapiens
uucacaucucuguag

SEQ ID NO: 952858 - RNA, 21 nt, Homo sapiens
uucacaucuguauaucagcuc

SEQ ID NO: 952859 - RNA, 17 nt, Homo sapiens
uucacgggcaacacuca

SEQ ID NO: 952860 - RNA, 21 nt, Homo sapiens
uucagacacgcacuucugggg

SEQ ID NO: 952861 - RNA, 13 nt, Homo sapiens
uucagcaauuaaa

SEQ ID NO: 952862 - RNA, 16 nt, Homo sapiens
uucagugccaaaaaca

SEQ ID NO: 952863 - RNA, 15 nt, Homo sapiens
cucccuuggauuuuu

SEQ ID NO: 952864 - RNA, 14 nt, Homo sapiens
cuccuaaaacacac

SEQ ID NO: 952865 - RNA, 14 nt, Homo sapiens
cuccuaaauuucca

SEQ ID NO: 952866 - RNA, 16 nt, Homo sapiens
cuccucagcacggugc

SEQ ID NO: 952867 - RNA, 22 nt, Homo sapiens
cuccuccaccccugucauucac

SEQ ID NO: 952868 - RNA, 20 nt, Homo sapiens
cuccucugccuuugugcucu

SEQ ID NO: 952869 - RNA, 18 nt, Homo sapiens
cuccuuuuaaaacaauau

SEQ ID NO: 952870 - RNA, 17 nt, Homo sapiens
cucgcgacaaugcaaac

SEQ ID NO: 952871 - RNA, 20 nt, Homo sapiens
cucuaauagaaguccaugag

SEQ ID NO: 952872 - RNA, 15 nt, Homo sapiens
cucuagagaacaugc

SEQ ID NO: 952873 - RNA, 15 nt, Homo sapiens
cucuauauauacaug

SEQ ID NO: 952874 - RNA, 17 nt, Homo sapiens
cucuauuuuuuacuaca

SEQ ID NO: 952875 - RNA, 11 nt, Homo sapiens
cucuccaggga

SEQ ID NO: 952876 - RNA, 17 nt, Homo sapiens
cucuccuagagcucugu

SEQ ID NO: 952877 - RNA, 14 nt, Homo sapiens
cucucuuaaauuca

SEQ ID NO: 952878 - RNA, 18 nt, Homo sapiens
cucugaagguccaaagag

SEQ ID NO: 952879 - RNA, 16 nt, Homo sapiens
cucugcucugugcacu

SEQ ID NO: 952880 - RNA, 20 nt, Homo sapiens
cucuggagugcuaacuugaa

SEQ ID NO: 952881 - RNA, 22 nt, Homo sapiens
cucuugauucauaaugacuuaa

SEQ ID NO: 952882 - RNA, 14 nt, Homo sapiens
cucuugucaaaagg

SEQ ID NO: 952883 - RNA, 17 nt, Homo sapiens
cugaaaccagugacuca

SEQ ID NO: 952884 - RNA, 21 nt, Homo sapiens
cugaaaccucuguucucauga

SEQ ID NO: 952885 - RNA, 15 nt, Homo sapiens
cugaaauguuuccag

SEQ ID NO: 952886 - RNA, 20 nt, Homo sapiens
cugaacugaaaggacugugu

SEQ ID NO: 952887 - RNA, 20 nt, Homo sapiens
cugaagucuuuguacagaca

SEQ ID NO: 952888 - RNA, 17 nt, Homo sapiens
cugaaucaaagacauuu

SEQ ID NO: 952889 - RNA, 14 nt, Homo sapiens
cugaaugacaucaa

SEQ ID NO: 952890 - RNA, 12 nt, Homo sapiens
cugacuauuuac

SEQ ID NO: 952891 - RNA, 15 nt, Homo sapiens
cugacugaaugcaga

SEQ ID NO: 952892 - RNA, 15 nt, Homo sapiens
cugagaaacuuccuu

SEQ ID NO: 952893 - RNA, 14 nt, Homo sapiens
cugagaagccucau

SEQ ID NO: 952894 - RNA, 15 nt, Homo sapiens
cugagacccagagag

SEQ ID NO: 952895 - RNA, 14 nt, Homo sapiens
cugagugguccaca

SEQ ID NO: 952896 - RNA, 17 nt, Homo sapiens
cugauaagcuuccuaga

SEQ ID NO: 952897 - RNA, 15 nt, Homo sapiens
cugauauacaauuag

SEQ ID NO: 952898 - RNA, 13 nt, Homo sapiens
cugauggugcaau

SEQ ID NO: 952899 - RNA, 15 nt, Homo sapiens
cugauggugcaauga

SEQ ID NO: 952900 - RNA, 13 nt, Homo sapiens
cugauuccaaaua

SEQ ID NO: 952901 - RNA, 17 nt, Homo sapiens
cugauuucaaaugcagu

SEQ ID NO: 952902 - RNA, 19 nt, Homo sapiens
cugcaaaguguaugugacc

SEQ ID NO: 952903 - RNA, 14 nt, Homo sapiens
cugcacacaugcac

SEQ ID NO: 952904 - RNA, 21 nt, Homo sapiens
cugcaccuuccuuucuuccac

SEQ ID NO: 952905 - RNA, 17 nt, Homo sapiens
cugcagaugacuggaaa

SEQ ID NO: 952906 - RNA, 12 nt, Homo sapiens
cugcagcuccuc

SEQ ID NO: 952907 - RNA, 20 nt, Homo sapiens
cugcaucaagaugugacaug

SEQ ID NO: 952908 - RNA, 19 nt, Homo sapiens
cugcaucuuucucuuccca

SEQ ID NO: 952909 - RNA, 22 nt, Homo sapiens
cugccaaccagcuuguccaaca

SEQ ID NO: 952910 - RNA, 18 nt, Homo sapiens
cugcccauuguaacuuau

SEQ ID NO: 952911 - RNA, 19 nt, Homo sapiens
cugcccccucccccgcaga

SEQ ID NO: 952912 - RNA, 13 nt, Homo sapiens
cugccccugcuac

SEQ ID NO: 952913 - RNA, 21 nt, Homo sapiens
cugccgacggagccacugggg

SEQ ID NO: 952914 - RNA, 15 nt, Homo sapiens
cugccuagaaacaga

SEQ ID NO: 952915 - RNA, 13 nt, Homo sapiens
cugccucagucuc

SEQ ID NO: 952916 - RNA, 14 nt, Homo sapiens
cugcugcuggucac

SEQ ID NO: 952917 - RNA, 21 nt, Homo sapiens
cugcuguugauuccacugaaa

SEQ ID NO: 952918 - RNA, 16 nt, Homo sapiens
cugcuguuuuauguca

SEQ ID NO: 952919 - RNA, 18 nt, Homo sapiens
cugcuuagauuucuagca

SEQ ID NO: 952920 - RNA, 13 nt, Homo sapiens
cugcuucauguaa

SEQ ID NO: 952921 - RNA, 20 nt, Homo sapiens
cugcuuuguuuuggcugcuc

SEQ ID NO: 952922 - RNA, 13 nt, Homo sapiens
cuggaaauaaccu

SEQ ID NO: 952923 - RNA, 19 nt, Homo sapiens
cuggaagaacccuucucag

SEQ ID NO: 952924 - RNA, 19 nt, Homo sapiens
cuggacaggcuucgucuca

SEQ ID NO: 952925 - RNA, 23 nt, Homo sapiens
cuggagggaauccauaucagcuc

SEQ ID NO: 952926 - RNA, 18 nt, Homo sapiens
cuggcagcgccucccgcc

SEQ ID NO: 952927 - RNA, 23 nt, Homo sapiens
cuggcagggcaggcagagcucag

SEQ ID NO: 952928 - RNA, 21 nt, Homo sapiens
cuggcaugggaaugaauguca

SEQ ID NO: 952929 - RNA, 15 nt, Homo sapiens
cuggcauugaaaugc

SEQ ID NO: 952930 - RNA, 13 nt, Homo sapiens
cuggccccaggcg

SEQ ID NO: 952931 - RNA, 21 nt, Homo sapiens
cuggccccuaggcugcugcug

SEQ ID NO: 952932 - RNA, 18 nt, Homo sapiens
cuggcuugagugauccuc

SEQ ID NO: 952933 - RNA, 16 nt, Homo sapiens
cugggacucaguucuu

SEQ ID NO: 952934 - RNA, 20 nt, Homo sapiens
cugggauuacaggugugagc

SEQ ID NO: 952935 - RNA, 22 nt, Homo sapiens
cugggugugaccugacaccugc

SEQ ID NO: 952936 - RNA, 17 nt, Homo sapiens
cuguaaugcacuccugc

SEQ ID NO: 952937 - RNA, 23 nt, Homo sapiens
cuguaauggggacacuacaaaaa

SEQ ID NO: 952938 - RNA, 16 nt, Homo sapiens
cuguaccauccaugga

SEQ ID NO: 952939 - RNA, 14 nt, Homo sapiens
cuguacccuauguu

SEQ ID NO: 952940 - RNA, 13 nt, Homo sapiens
cuguacuauccag

SEQ ID NO: 952941 - RNA, 14 nt, Homo sapiens
cuguagugccaugg

SEQ ID NO: 952942 - RNA, 18 nt, Homo sapiens
cuguauagaccaugcaca

SEQ ID NO: 952943 - RNA, 15 nt, Homo sapiens
cuguauaucagcucu

SEQ ID NO: 952944 - RNA, 15 nt, Homo sapiens
cugucacugccaaac

SEQ ID NO: 952945 - RNA, 20 nt, Homo sapiens
cuguccuggucaguuuucac

SEQ ID NO: 952946 - RNA, 14 nt, Homo sapiens
cuguccuucuuaga

SEQ ID NO: 952947 - RNA, 13 nt, Homo sapiens
cugugcauuguag

SEQ ID NO: 952948 - RNA, 21 nt, Homo sapiens
cugugcguuuuagaguaugca

SEQ ID NO: 952949 - RNA, 21 nt, Homo sapiens
cugugguuucucguacuuuca

SEQ ID NO: 952950 - RNA, 17 nt, Homo sapiens
cuguguccucacaugac

SEQ ID NO: 952951 - RNA, 17 nt, Homo sapiens
cugugugguauuuuggc

SEQ ID NO: 952952 - RNA, 13 nt, Homo sapiens
cuguguugucucu

SEQ ID NO: 952953 - RNA, 16 nt, Homo sapiens
cuguuccuguccagca

SEQ ID NO: 952954 - RNA, 14 nt, Homo sapiens
cuguucuaagucca

SEQ ID NO: 952955 - RNA, 19 nt, Homo sapiens
cuguucuuccuaccaaaua

SEQ ID NO: 952956 - RNA, 13 nt, Homo sapiens
cuguucuuugcag

SEQ ID NO: 952957 - RNA, 23 nt, Homo sapiens
cuguugacaauuugccauagcag

SEQ ID NO: 952958 - RNA, 16 nt, Homo sapiens
cuguugauuccacuga

SEQ ID NO: 952959 - RNA, 13 nt, Homo sapiens
cuguugccaggag

SEQ ID NO: 952960 - RNA, 11 nt, Homo sapiens
cuguugcuuga

SEQ ID NO: 952961 - RNA, 14 nt, Homo sapiens
cuguuucuaugucc

SEQ ID NO: 952962 - RNA, 17 nt, Homo sapiens
cuguuucugcagccacu

SEQ ID NO: 952963 - RNA, 20 nt, Homo sapiens
cuuaaauauguggaguucau

SEQ ID NO: 952964 - RNA, 23 nt, Homo sapiens
cuuaacgugaucaucaccacuga

SEQ ID NO: 952965 - RNA, 14 nt, Homo sapiens
cuuaaucauaucaa

SEQ ID NO: 952966 - RNA, 17 nt, Homo sapiens
cuuaauucuguuacaca

SEQ ID NO: 952967 - RNA, 22 nt, Homo sapiens
cuuagagcacuagaagcacagg

SEQ ID NO: 952968 - RNA, 21 nt, Homo sapiens
cuuagcacuauggacauuuug

SEQ ID NO: 952969 - RNA, 12 nt, Homo sapiens
cuuaugugacau

SEQ ID NO: 952970 - RNA, 23 nt, Homo sapiens
cuuauuuaaucuguacuauccag

SEQ ID NO: 952971 - RNA, 17 nt, Homo sapiens
cuuauuucuaacuauua

SEQ ID NO: 952972 - RNA, 12 nt, Homo sapiens
cuucacucucca

SEQ ID NO: 952973 - RNA, 20 nt, Homo sapiens
cuucagaaaagacacuucaa

SEQ ID NO: 952974 - RNA, 22 nt, Homo sapiens
cuucagacacgcacuucugggg

SEQ ID NO: 952975 - RNA, 12 nt, Homo sapiens
cuuccaccucag

SEQ ID NO: 952976 - RNA, 23 nt, Homo sapiens
cuucccacuggaggcaugugaug

SEQ ID NO: 952977 - RNA, 20 nt, Homo sapiens
cuucccaugcaacacccucu

SEQ ID NO: 952978 - RNA, 14 nt, Homo sapiens
cuuccuaccaaaua

SEQ ID NO: 952979 - RNA, 15 nt, Homo sapiens
cuuccuaccaaauau

SEQ ID NO: 952980 - RNA, 16 nt, Homo sapiens
cuuccuccccauguca

SEQ ID NO: 952981 - RNA, 17 nt, Homo sapiens
cuuccuuucuuccacaa

SEQ ID NO: 952982 - RNA, 21 nt, Homo sapiens
cuucgaggagauaaacugaaa

SEQ ID NO: 952983 - RNA, 20 nt, Homo sapiens
cuucuaaagugcugggauua

SEQ ID NO: 952984 - RNA, 19 nt, Homo sapiens
cuucuaucaaagcacauaa

SEQ ID NO: 952985 - RNA, 12 nt, Homo sapiens
cuucucacauag

SEQ ID NO: 952986 - RNA, 14 nt, Homo sapiens
cuucugaagaucuc

SEQ ID NO: 952987 - RNA, 17 nt, Homo sapiens
cuucuggaauacugaaa

SEQ ID NO: 952988 - RNA, 21 nt, Homo sapiens
cuugaacuguggccaccuaga

SEQ ID NO: 952989 - RNA, 16 nt, Homo sapiens
cuugaagaauauuguu

SEQ ID NO: 952990 - RNA, 23 nt, Homo sapiens
ccguggugugaggcccccggagg

SEQ ID NO: 952991 - RNA, 13 nt, Homo sapiens
ccuacaucugaaa

SEQ ID NO: 952992 - RNA, 12 nt, Homo sapiens
ccuaccaaauau

SEQ ID NO: 952993 - RNA, 15 nt, Homo sapiens
ccuacgaaagcacag

SEQ ID NO: 952994 - RNA, 20 nt, Homo sapiens
ccuaggcugcugcugugacc

SEQ ID NO: 952995 - RNA, 20 nt, Homo sapiens
ccuaguaagaacguacuuuc

SEQ ID NO: 952996 - RNA, 14 nt, Homo sapiens
ccuaucaagccuua

SEQ ID NO: 952997 - RNA, 16 nt, Homo sapiens
ccuaugguaucauauc

SEQ ID NO: 952998 - RNA, 19 nt, Homo sapiens
ccuauuuucagauagcaca

SEQ ID NO: 952999 - RNA, 16 nt, Homo sapiens
ccucaauucauauuua

SEQ ID NO: 953000 - RNA, 16 nt, Homo sapiens
ccucacucagcaccac

SEQ ID NO: 953001 - RNA, 21 nt, Homo sapiens
ccucacucucgccaucuggca

SEQ ID NO: 953002 - RNA, 17 nt, Homo sapiens
ccucacugcaucuuucu

SEQ ID NO: 953003 - RNA, 22 nt, Homo sapiens
ccucagcagccucacugcaucu

SEQ ID NO: 953004 - RNA, 18 nt, Homo sapiens
ccucaguguccucaucua

SEQ ID NO: 953005 - RNA, 20 nt, Homo sapiens
ccucauauacuugaauauua

SEQ ID NO: 953006 - RNA, 13 nt, Homo sapiens
ccuccacauucau

SEQ ID NO: 953007 - RNA, 23 nt, Homo sapiens
ccuccacauucauguacaaugau

SEQ ID NO: 953008 - RNA, 13 nt, Homo sapiens
ccucccccgcaga

SEQ ID NO: 953009 - RNA, 19 nt, Homo sapiens
ccucccuguaaugcacucc

SEQ ID NO: 953010 - RNA, 18 nt, Homo sapiens
ccuccggcuggaccuggg

SEQ ID NO: 953011 - RNA, 12 nt, Homo sapiens
ccucucuugcca

SEQ ID NO: 953012 - RNA, 17 nt, Homo sapiens
ccucuucuugcggcacc

SEQ ID NO: 953013 - RNA, 17 nt, Homo sapiens
ccucuuuccccacugaa

SEQ ID NO: 953014 - RNA, 18 nt, Homo sapiens
ccugaaaccagugacuca

SEQ ID NO: 953015 - RNA, 14 nt, Homo sapiens
ccugaagugccagc

SEQ ID NO: 953016 - RNA, 23 nt, Homo sapiens
ccugacugcugugggcugcucac

SEQ ID NO: 953017 - RNA, 18 nt, Homo sapiens
ccugagaagccucauggg

SEQ ID NO: 953018 - RNA, 19 nt, Homo sapiens
ccugaggcaggagggcaug

SEQ ID NO: 953019 - RNA, 13 nt, Homo sapiens
ccugaugcaaggg

SEQ ID NO: 953020 - RNA, 12 nt, Homo sapiens
ccugauuucccu

SEQ ID NO: 953021 - RNA, 14 nt, Homo sapiens
ccugcccuccccca

SEQ ID NO: 953022 - RNA, 14 nt, Homo sapiens
ccuggauguuauau

SEQ ID NO: 953023 - RNA, 21 nt, Homo sapiens
ccuggcgggcagccccugcug

SEQ ID NO: 953024 - RNA, 21 nt, Homo sapiens
ccuggcuggaaugggggccag

SEQ ID NO: 953025 - RNA, 19 nt, Homo sapiens
ccugggccccagaaagccu

SEQ ID NO: 953026 - RNA, 18 nt, Homo sapiens
ccugggugugaccugaca

SEQ ID NO: 953027 - RNA, 18 nt, Homo sapiens
ccugggugugugaagcug

SEQ ID NO: 953028 - RNA, 17 nt, Homo sapiens
ccuguaaugcacuccug

SEQ ID NO: 953029 - RNA, 19 nt, Homo sapiens
ccuguucugugucugcugu

SEQ ID NO: 953030 - RNA, 20 nt, Homo sapiens
ccuuauggacuuuaguauua

SEQ ID NO: 953031 - RNA, 18 nt, Homo sapiens
ccuucagaaaagacacuu

SEQ ID NO: 953032 - RNA, 15 nt, Homo sapiens
ccuucuauacuuucu

SEQ ID NO: 953033 - RNA, 19 nt, Homo sapiens
ccuucucccucaugcauga

SEQ ID NO: 953034 - RNA, 19 nt, Homo sapiens
ccuucugauaagacuggaa

SEQ ID NO: 953035 - RNA, 17 nt, Homo sapiens
ccuugccucugcucugu

SEQ ID NO: 953036 - RNA, 20 nt, Homo sapiens
ccuuguugaugaagcacauu

SEQ ID NO: 953037 - RNA, 22 nt, Homo sapiens
ccuuuacaugaauacgucuuga

SEQ ID NO: 953038 - RNA, 14 nt, Homo sapiens
ccuuucacacugug

SEQ ID NO: 953039 - RNA, 15 nt, Homo sapiens
ccuuuguacugauga

SEQ ID NO: 953040 - RNA, 14 nt, Homo sapiens
ccuuuuacucagcu

SEQ ID NO: 953041 - RNA, 15 nt, Homo sapiens
ccuuuugaagcucaa

SEQ ID NO: 953042 - RNA, 20 nt, Homo sapiens
cgagagcugggacucaguuc

SEQ ID NO: 953043 - RNA, 22 nt, Homo sapiens
cgauggauccgugacagcacuu

SEQ ID NO: 953044 - RNA, 15 nt, Homo sapiens
cgcagcccgggagau

SEQ ID NO: 953045 - RNA, 14 nt, Homo sapiens
cgcugauguucacc

SEQ ID NO: 953046 - RNA, 14 nt, Homo sapiens
cgcuuccuccggcu

SEQ ID NO: 953047 - RNA, 16 nt, Homo sapiens
cgggaagcaaaugcga

SEQ ID NO: 953048 - RNA, 14 nt, Homo sapiens
cgggccuccccggg

SEQ ID NO: 953049 - RNA, 18 nt, Homo sapiens
cguacuuucuguuaucaa

SEQ ID NO: 953050 - RNA, 22 nt, Homo sapiens
cguccauguuuauccauguacu

SEQ ID NO: 953051 - RNA, 16 nt, Homo sapiens
cgucuuuagaugcuau

SEQ ID NO: 953052 - RNA, 13 nt, Homo sapiens
cgugcaugcacac

SEQ ID NO: 953053 - RNA, 13 nt, Homo sapiens
cgugcccccagcg

SEQ ID NO: 953054 - RNA, 19 nt, Homo sapiens
cguguauucaggaccccau

SEQ ID NO: 953055 - RNA, 11 nt, Homo sapiens
cgugugcccac

SEQ ID NO: 953056 - RNA, 19 nt, Homo sapiens
cgugugcccacugaacaug

SEQ ID NO: 953057 - RNA, 14 nt, Homo sapiens
cguguuaugacucc

SEQ ID NO: 953058 - RNA, 14 nt, Homo sapiens
cguuacccauuucu

SEQ ID NO: 953059 - RNA, 15 nt, Homo sapiens
cguucuugccagcuu

SEQ ID NO: 953060 - RNA, 20 nt, Homo sapiens
cuaaaaacacuggauucauu

SEQ ID NO: 953061 - RNA, 17 nt, Homo sapiens
cuaaagugcugggauua

SEQ ID NO: 953062 - RNA, 15 nt, Homo sapiens
cuaaauuuccagggg

SEQ ID NO: 953063 - RNA, 13 nt, Homo sapiens
cuaacacaugcac

SEQ ID NO: 953064 - RNA, 18 nt, Homo sapiens
cuaaccccauucaugaga

SEQ ID NO: 953065 - RNA, 21 nt, Homo sapiens
cuaaccuggguuguugcagag

SEQ ID NO: 953066 - RNA, 23 nt, Homo sapiens
cuaacucuuacggcuaucuaguu

SEQ ID NO: 953067 - RNA, 17 nt, Homo sapiens
cuaagucaguuucacau

SEQ ID NO: 953068 - RNA, 15 nt, Homo sapiens
cuaauagaaaacugu

SEQ ID NO: 953069 - RNA, 17 nt, Homo sapiens
cuaauagaaaacugugg

SEQ ID NO: 953070 - RNA, 16 nt, Homo sapiens
cuacacucacaaucau

SEQ ID NO: 953071 - RNA, 19 nt, Homo sapiens
cuacacucacaaucaucuu

SEQ ID NO: 953072 - RNA, 15 nt, Homo sapiens
cuaccaagcugugac

SEQ ID NO: 953073 - RNA, 21 nt, Homo sapiens
cuaccaguaucuccauccuua

SEQ ID NO: 953074 - RNA, 15 nt, Homo sapiens
cuaccugcugagcca

SEQ ID NO: 953075 - RNA, 14 nt, Homo sapiens
cuacgaaagcacag

SEQ ID NO: 953076 - RNA, 19 nt, Homo sapiens
cuacgguuccauguucacc

SEQ ID NO: 953077 - RNA, 20 nt, Homo sapiens
cuacuagaaaauaccaaaug

SEQ ID NO: 953078 - RNA, 20 nt, Homo sapiens
cuacuugauauaauuacuua

SEQ ID NO: 953079 - RNA, 12 nt, Homo sapiens
cuagaaacagac

SEQ ID NO: 953080 - RNA, 22 nt, Homo sapiens
cuagaaacagaccugcauucaa

SEQ ID NO: 953081 - RNA, 12 nt, Homo sapiens
cuagaagcacag

SEQ ID NO: 953082 - RNA, 14 nt, Homo sapiens
cuagagaacaugcc

SEQ ID NO: 953083 - RNA, 15 nt, Homo sapiens
cuagagaacaugccc

SEQ ID NO: 953084 - RNA, 17 nt, Homo sapiens
cuagagacucugugauc

SEQ ID NO: 953085 - RNA, 19 nt, Homo sapiens
cuagagacucugugaucua

SEQ ID NO: 953086 - RNA, 22 nt, Homo sapiens
cuagauggauauuagaugcccg

SEQ ID NO: 953087 - RNA, 12 nt, Homo sapiens
cuagcuaucucu

SEQ ID NO: 953088 - RNA, 16 nt, Homo sapiens
cuaggugcacauauac

SEQ ID NO: 953089 - RNA, 21 nt, Homo sapiens
cuauaaaaugagggacuuccc

SEQ ID NO: 953090 - RNA, 22 nt, Homo sapiens
cuauaauuuuacaaaguuaaau

SEQ ID NO: 953091 - RNA, 15 nt, Homo sapiens
cuauauguugcugaa

SEQ ID NO: 953092 - RNA, 21 nt, Homo sapiens
cuauauuuggauucacagccu

SEQ ID NO: 953093 - RNA, 13 nt, Homo sapiens
cuaucugcaaaua

SEQ ID NO: 953094 - RNA, 22 nt, Homo sapiens
cuaucuguaagagguacuaaaa

SEQ ID NO: 953095 - RNA, 15 nt, Homo sapiens
cuaugaacuagagac

SEQ ID NO: 953096 - RNA, 18 nt, Homo sapiens
cuaugccuguauuuccaa

SEQ ID NO: 953097 - RNA, 19 nt, Homo sapiens
cuauggaauauacauguaa

SEQ ID NO: 953098 - RNA, 20 nt, Homo sapiens
cuaugguaucauaucaugaa

SEQ ID NO: 953099 - RNA, 15 nt, Homo sapiens
cuauguauuuggaaa

SEQ ID NO: 953100 - RNA, 16 nt, Homo sapiens
cuauguuaucagucuc

SEQ ID NO: 953101 - RNA, 15 nt, Homo sapiens
cuauguucauaaaaa

SEQ ID NO: 953102 - RNA, 18 nt, Homo sapiens
cuauuacaccuuuaucuc

SEQ ID NO: 953103 - RNA, 20 nt, Homo sapiens
cuauuacaccuuuaucucaa

SEQ ID NO: 953104 - RNA, 17 nt, Homo sapiens
cuauuuauguucaucuu

SEQ ID NO: 953105 - RNA, 22 nt, Homo sapiens
cuauuucggaaauacacuacaa

SEQ ID NO: 953106 - RNA, 21 nt, Homo sapiens
cucaaagaggccaguacuuug

SEQ ID NO: 953107 - RNA, 16 nt, Homo sapiens
cucaagaccaaaugga

SEQ ID NO: 953108 - RNA, 12 nt, Homo sapiens
cucaauucauau

SEQ ID NO: 953109 - RNA, 18 nt, Homo sapiens
cucacacgcugccuccuc

SEQ ID NO: 953110 - RNA, 18 nt, Homo sapiens
cucaccaaaauauaguua

SEQ ID NO: 953111 - RNA, 23 nt, Homo sapiens
cucacuauggucaaaaagugaug

SEQ ID NO: 953112 - RNA, 21 nt, Homo sapiens
cucacugccugcagcugagau

SEQ ID NO: 953113 - RNA, 12 nt, Homo sapiens
cucacuggagau

SEQ ID NO: 953114 - RNA, 14 nt, Homo sapiens
cucacuguguugcc

SEQ ID NO: 953115 - RNA, 17 nt, Homo sapiens
cucagcacacaugcauc

SEQ ID NO: 953116 - RNA, 23 nt, Homo sapiens
cucagccuuagcacuauggacau

SEQ ID NO: 953117 - RNA, 17 nt, Homo sapiens
cucagcuuuauaacaaa

SEQ ID NO: 953118 - RNA, 13 nt, Homo sapiens
cucaggcuuucua

SEQ ID NO: 953119 - RNA, 17 nt, Homo sapiens
cucagucuacacucaca

SEQ ID NO: 953120 - RNA, 22 nt, Homo sapiens
cucaugaaggagaggauuuggc

SEQ ID NO: 953121 - RNA, 13 nt, Homo sapiens
cucauuuaagaaa

SEQ ID NO: 953122 - RNA, 16 nt, Homo sapiens
cucauuuagcauugaa

SEQ ID NO: 953123 - RNA, 15 nt, Homo sapiens
cuccaagguggcaua

SEQ ID NO: 953124 - RNA, 13 nt, Homo sapiens
cuccaggcaccgc

SEQ ID NO: 953125 - RNA, 14 nt, Homo sapiens
aacucaaugcauga

SEQ ID NO: 953126 - RNA, 20 nt, Homo sapiens
aacucccaggucacaugcac

SEQ ID NO: 953127 - RNA, 15 nt, Homo sapiens
aacuccugaguucaa

SEQ ID NO: 953128 - RNA, 18 nt, Homo sapiens
aacuccugaguucaagca

SEQ ID NO: 953129 - RNA, 19 nt, Homo sapiens
aacugaugagauacauuug

SEQ ID NO: 953130 - RNA, 19 nt, Homo sapiens
aacuguacccuauguucac

SEQ ID NO: 953131 - RNA, 14 nt, Homo sapiens
aacuguccagucca

SEQ ID NO: 953132 - RNA, 23 nt, Homo sapiens
aacugucgucuuuuuccaaacaa

SEQ ID NO: 953133 - RNA, 13 nt, Homo sapiens
aacuguugccagg

SEQ ID NO: 953134 - RNA, 14 nt, Homo sapiens
aacuguugccagga

SEQ ID NO: 953135 - RNA, 23 nt, Homo sapiens
aacuguugccaggagauggaaua

SEQ ID NO: 953136 - RNA, 14 nt, Homo sapiens
aacuuagaaaggga

SEQ ID NO: 953137 - RNA, 23 nt, Homo sapiens
aacuuagagcacuagaagcacag

SEQ ID NO: 953138 - RNA, 15 nt, Homo sapiens
aacuugaacaccaag

SEQ ID NO: 953139 - RNA, 12 nt, Homo sapiens
aagaaacuaccc

SEQ ID NO: 953140 - RNA, 17 nt, Homo sapiens
aagaaauccagcuucau

SEQ ID NO: 953141 - RNA, 22 nt, Homo sapiens
aagaaaugagaaauugugccaa

SEQ ID NO: 953142 - RNA, 22 nt, Homo sapiens
aagaaugucuccugccacuccu

SEQ ID NO: 953143 - RNA, 22 nt, Homo sapiens
aagaauugaggaugucccugaa

SEQ ID NO: 953144 - RNA, 19 nt, Homo sapiens
aagaccuucugaagaucuc

SEQ ID NO: 953145 - RNA, 17 nt, Homo sapiens
aagacuaucaaagacaa

SEQ ID NO: 953146 - RNA, 21 nt, Homo sapiens
aagagaaacacuaauggccaa

SEQ ID NO: 953147 - RNA, 18 nt, Homo sapiens
aagaggcauucagcaauu

SEQ ID NO: 953148 - RNA, 21 nt, Homo sapiens
aagaggccaguacuuugccau

SEQ ID NO: 953149 - RNA, 21 nt, Homo sapiens
aagaguguguccacugagaag

SEQ ID NO: 953150 - RNA, 11 nt, Homo sapiens
aagaguucucc

SEQ ID NO: 953151 - RNA, 15 nt, Homo sapiens
aagauaaaacuaauu

SEQ ID NO: 953152 - RNA, 21 nt, Homo sapiens
aagaugcuaauagaaaacugu

SEQ ID NO: 953153 - RNA, 23 nt, Homo sapiens
aagauuagcuuuuaaaaacugaa

SEQ ID NO: 953154 - RNA, 17 nt, Homo sapiens
aagcacuaccaguaucu

SEQ ID NO: 953155 - RNA, 15 nt, Homo sapiens
aagcaguugcaauga

SEQ ID NO: 953156 - RNA, 18 nt, Homo sapiens
aagcauccaggcacccaa

SEQ ID NO: 953157 - RNA, 16 nt, Homo sapiens
aagcaugaucacagcu

SEQ ID NO: 953158 - RNA, 9 nt, Homo sapiens
aagcauuag

SEQ ID NO: 953159 - RNA, 15 nt, Homo sapiens
aagcauucugugcau

SEQ ID NO: 953160 - RNA, 16 nt, Homo sapiens
aagccacguugcagaa

SEQ ID NO: 953161 - RNA, 13 nt, Homo sapiens
aagcccaaccucu

SEQ ID NO: 953162 - RNA, 18 nt, Homo sapiens
aagcccccuacugagaaa

SEQ ID NO: 953163 - RNA, 20 nt, Homo sapiens
aagcccgauccacauugcau

SEQ ID NO: 953164 - RNA, 22 nt, Homo sapiens
aagcccugacuauuuacaguag

SEQ ID NO: 953165 - RNA, 13 nt, Homo sapiens
aagcuagcauuaa

SEQ ID NO: 953166 - RNA, 17 nt, Homo sapiens
aagcugcucacugcuca

SEQ ID NO: 953167 - RNA, 15 nt, Homo sapiens
aagcugggaggccaa

SEQ ID NO: 953168 - RNA, 15 nt, Homo sapiens
aagcugucacucaca

SEQ ID NO: 953169 - RNA, 16 nt, Homo sapiens
aagcugugacccucaa

SEQ ID NO: 953170 - RNA, 19 nt, Homo sapiens
aagcuugggacaguuauug

SEQ ID NO: 953171 - RNA, 18 nt, Homo sapiens
aaggaugaacaguucucc

SEQ ID NO: 953172 - RNA, 20 nt, Homo sapiens
aaggcugcuaaguggaagac

SEQ ID NO: 953173 - RNA, 12 nt, Homo sapiens
aagggugcuacu

SEQ ID NO: 953174 - RNA, 12 nt, Homo sapiens
aaggucaucuca

SEQ ID NO: 953175 - RNA, 21 nt, Homo sapiens
aaggucucauuaucuccauga

SEQ ID NO: 953176 - RNA, 16 nt, Homo sapiens
aagguugccagguaaa

SEQ ID NO: 953177 - RNA, 18 nt, Homo sapiens
aaguaauuguaugugcuu

SEQ ID NO: 953178 - RNA, 18 nt, Homo sapiens
aaguagcugggaccacaa

SEQ ID NO: 953179 - RNA, 17 nt, Homo sapiens
aagucacguagcacaga

SEQ ID NO: 953180 - RNA, 16 nt, Homo sapiens
aagucagcacuaccuc

SEQ ID NO: 953181 - RNA, 13 nt, Homo sapiens
aagucccaucuca

SEQ ID NO: 953182 - RNA, 23 nt, Homo sapiens
aaguccgaggccuggcucuggag

SEQ ID NO: 953183 - RNA, 18 nt, Homo sapiens
aaguccuuagaaugaggg

SEQ ID NO: 953184 - RNA, 17 nt, Homo sapiens
aagugagaaaacugaga

SEQ ID NO: 953185 - RNA, 17 nt, Homo sapiens
aagugagauacaaagcu

SEQ ID NO: 953186 - RNA, 17 nt, Homo sapiens
aaguguacaauuuucau

SEQ ID NO: 953187 - RNA, 16 nt, Homo sapiens
aaguuaaagagacaaa

SEQ ID NO: 953188 - RNA, 13 nt, Homo sapiens
aaguuacuguuga

SEQ ID NO: 953189 - RNA, 13 nt, Homo sapiens
aauaaaaggcauu

SEQ ID NO: 953190 - RNA, 11 nt, Homo sapiens
aauaaauggac

SEQ ID NO: 953191 - RNA, 18 nt, Homo sapiens
aauaaauuuguaugcuca

SEQ ID NO: 953192 - RNA, 13 nt, Homo sapiens
aauaacacuguac

SEQ ID NO: 953193 - RNA, 17 nt, Homo sapiens
aauaacacuguacugca

SEQ ID NO: 953194 - RNA, 23 nt, Homo sapiens
aauaaccaguaggauccaaagaa

SEQ ID NO: 953195 - RNA, 19 nt, Homo sapiens
aauaagcguuuaaugguau

SEQ ID NO: 953196 - RNA, 23 nt, Homo sapiens
aauaaguuuuuuuaaaguguuau

SEQ ID NO: 953197 - RNA, 14 nt, Homo sapiens
aauacucaccaaaa

SEQ ID NO: 953198 - RNA, 13 nt, Homo sapiens
aauagaaaacugu

SEQ ID NO: 953199 - RNA, 22 nt, Homo sapiens
aauaggcuuucuguguauauaa

SEQ ID NO: 953200 - RNA, 17 nt, Homo sapiens
aauagguuuuucuugcu

SEQ ID NO: 953201 - RNA, 17 nt, Homo sapiens
aauaguacccaaccaaa

SEQ ID NO: 953202 - RNA, 21 nt, Homo sapiens
aauaguaggcuaaaaacauuu

SEQ ID NO: 953203 - RNA, 20 nt, Homo sapiens
aauauauuuuuaaagcaaaa

SEQ ID NO: 953204 - RNA, 22 nt, Homo sapiens
aauaugcccaauuucauaacua

SEQ ID NO: 953205 - RNA, 16 nt, Homo sapiens
aauauuauacugcuau

SEQ ID NO: 953206 - RNA, 22 nt, Homo sapiens
aaucagugagaagaauagcuua

SEQ ID NO: 953207 - RNA, 18 nt, Homo sapiens
aaucaugccuaguuauuc

SEQ ID NO: 953208 - RNA, 23 nt, Homo sapiens
aaucauugagaaauaaagcacau

SEQ ID NO: 953209 - RNA, 16 nt, Homo sapiens
aauccauaucagcucu

SEQ ID NO: 953210 - RNA, 20 nt, Homo sapiens
aaucccccaucguuacccau

SEQ ID NO: 953211 - RNA, 14 nt, Homo sapiens
aaucguagguguug

SEQ ID NO: 953212 - RNA, 23 nt, Homo sapiens
aaucuauuacaccuuuaucucaa

SEQ ID NO: 953213 - RNA, 20 nt, Homo sapiens
aaucuccauuucugcucaga

SEQ ID NO: 953214 - RNA, 16 nt, Homo sapiens
aaucuguuagcauuau

SEQ ID NO: 953215 - RNA, 21 nt, Homo sapiens
aaucuguuucuauguccaaac

SEQ ID NO: 953216 - RNA, 18 nt, Homo sapiens
aaucuuagugaaugggaa

SEQ ID NO: 953217 - RNA, 22 nt, Homo sapiens
aaucuucacaauauccaaugaa

SEQ ID NO: 953218 - RNA, 21 nt, Homo sapiens
aaucuuuccaucucauuacag

SEQ ID NO: 953219 - RNA, 13 nt, Homo sapiens
aaugaaugacuca

SEQ ID NO: 953220 - RNA, 16 nt, Homo sapiens
aaugacuuaagcacac

SEQ ID NO: 953221 - RNA, 12 nt, Homo sapiens
aaugacuuuccu

SEQ ID NO: 953222 - RNA, 17 nt, Homo sapiens
aaugaggaaacugcacu

SEQ ID NO: 953223 - RNA, 21 nt, Homo sapiens
aaugcaggauuggaccaugaa

SEQ ID NO: 953224 - RNA, 16 nt, Homo sapiens
aaugcauacucugugc

SEQ ID NO: 953225 - RNA, 16 nt, Homo sapiens
aaugcgugcaguuccu

SEQ ID NO: 953226 - RNA, 18 nt, Homo sapiens
aaugcuuucucuccucuu

SEQ ID NO: 953227 - RNA, 12 nt, Homo sapiens
aaugguagcucu

SEQ ID NO: 953228 - RNA, 15 nt, Homo sapiens
aauguaccauguugc

SEQ ID NO: 953229 - RNA, 17 nt, Homo sapiens
aauguaccauguugccc

SEQ ID NO: 953230 - RNA, 15 nt, Homo sapiens
aauguagcauucugu

SEQ ID NO: 953231 - RNA, 22 nt, Homo sapiens
gaauugaagacacguucuugcc

SEQ ID NO: 953232 - RNA, 20 nt, Homo sapiens
gaauuguuauguaaacauca

SEQ ID NO: 953233 - RNA, 18 nt, Homo sapiens
gacaauuugccauagcag

SEQ ID NO: 953234 - RNA, 20 nt, Homo sapiens
gacagaaggcaaaguuucca

SEQ ID NO: 953235 - RNA, 13 nt, Homo sapiens
gacaggaggccau

SEQ ID NO: 953236 - RNA, 14 nt, Homo sapiens
gacaggaggccaug

SEQ ID NO: 953237 - RNA, 15 nt, Homo sapiens
gacaggaggccaugc

SEQ ID NO: 953238 - RNA, 21 nt, Homo sapiens
gacauguauacuccauagaaa

SEQ ID NO: 953239 - RNA, 20 nt, Homo sapiens
gaccacuguuucuugcuugu

SEQ ID NO: 953240 - RNA, 15 nt, Homo sapiens
gaccagcacacuccc

SEQ ID NO: 953241 - RNA, 20 nt, Homo sapiens
gaccauugagacauuugcca

SEQ ID NO: 953242 - RNA, 19 nt, Homo sapiens
gaccccauccagccagggg

SEQ ID NO: 953243 - RNA, 16 nt, Homo sapiens
gaccccauucugggac

SEQ ID NO: 953244 - RNA, 16 nt, Homo sapiens
gacccccgugccaaau

SEQ ID NO: 953245 - RNA, 18 nt, Homo sapiens
gaccccgccugcucuuuc

SEQ ID NO: 953246 - RNA, 13 nt, Homo sapiens
gaccuacuuccuc

SEQ ID NO: 953247 - RNA, 16 nt, Homo sapiens
gaccugcgcaaagggc

SEQ ID NO: 953248 - RNA, 21 nt, Homo sapiens
gaccuggauaauuauaucaga

SEQ ID NO: 953249 - RNA, 18 nt, Homo sapiens
gaccuugaaugaugccau

SEQ ID NO: 953250 - RNA, 19 nt, Homo sapiens
gacuagccugaaaauccaa

SEQ ID NO: 953251 - RNA, 12 nt, Homo sapiens
gacucagcacug

SEQ ID NO: 953252 - RNA, 22 nt, Homo sapiens
gacucagcacuguuuucaucac

SEQ ID NO: 953253 - RNA, 16 nt, Homo sapiens
gacucuguggggccac

SEQ ID NO: 953254 - RNA, 20 nt, Homo sapiens
gacugguauaccuauuucau

SEQ ID NO: 953255 - RNA, 19 nt, Homo sapiens
gagaaauugugccaaagau

SEQ ID NO: 953256 - RNA, 20 nt, Homo sapiens
gagaaucgaccucacuguca

SEQ ID NO: 953257 - RNA, 13 nt, Homo sapiens
gagagaaaacugc

SEQ ID NO: 953258 - RNA, 14 nt, Homo sapiens
gagagaguggcuuu

SEQ ID NO: 953259 - RNA, 19 nt, Homo sapiens
gagagcugggacucaguuc

SEQ ID NO: 953260 - RNA, 21 nt, Homo sapiens
gagagcuuaagugacuuccuc

SEQ ID NO: 953261 - RNA, 23 nt, Homo sapiens
gagaggauuuggcucgcuguggu

SEQ ID NO: 953262 - RNA, 15 nt, Homo sapiens
gagaguugacuuggu

SEQ ID NO: 953263 - RNA, 22 nt, Homo sapiens
gagcaaagcagacuaugcagcu

SEQ ID NO: 953264 - RNA, 20 nt, Homo sapiens
gagcacgaggccuucagaaa

SEQ ID NO: 953265 - RNA, 18 nt, Homo sapiens
gagccagauuucacucuc

SEQ ID NO: 953266 - RNA, 16 nt, Homo sapiens
gagccagccguaaugg

SEQ ID NO: 953267 - RNA, 13 nt, Homo sapiens
gagccaugcucuu

SEQ ID NO: 953268 - RNA, 13 nt, Homo sapiens
gagcucacaccgc

SEQ ID NO: 953269 - RNA, 17 nt, Homo sapiens
gagcuggucaguugcca

SEQ ID NO: 953270 - RNA, 16 nt, Homo sapiens
gaggaaacugcacugu

SEQ ID NO: 953271 - RNA, 21 nt, Homo sapiens
gaggaggggagcaaggcugcu

SEQ ID NO: 953272 - RNA, 16 nt, Homo sapiens
gaggcaggagggcaug

SEQ ID NO: 953273 - RNA, 12 nt, Homo sapiens
gaggccaaacac

SEQ ID NO: 953274 - RNA, 22 nt, Homo sapiens
gaggccaaacacccaagcacaa

SEQ ID NO: 953275 - RNA, 18 nt, Homo sapiens
gagggaauccauaucagc

SEQ ID NO: 953276 - RNA, 23 nt, Homo sapiens
gagggacggcucacgaggcuugg

SEQ ID NO: 953277 - RNA, 23 nt, Homo sapiens
gagggauggcucacgaggcuugg

SEQ ID NO: 953278 - RNA, 15 nt, Homo sapiens
gagguaaaaaacugu

SEQ ID NO: 953279 - RNA, 20 nt, Homo sapiens
gaguguggcuuaguaauaga

SEQ ID NO: 953280 - RNA, 19 nt, Homo sapiens
gaguuuaugggaaugccuu

SEQ ID NO: 953281 - RNA, 18 nt, Homo sapiens
gauacuuuuauuguuaua

SEQ ID NO: 953282 - RNA, 15 nt, Homo sapiens
gauauaagaaauaca

SEQ ID NO: 953283 - RNA, 17 nt, Homo sapiens
gauauaauaauuacuua

SEQ ID NO: 953284 - RNA, 18 nt, Homo sapiens
gauauaggaaaauacauu

SEQ ID NO: 953285 - RNA, 17 nt, Homo sapiens
gauauuauguauagaaa

SEQ ID NO: 953286 - RNA, 18 nt, Homo sapiens
gaucacacacaugcacac

SEQ ID NO: 953287 - RNA, 17 nt, Homo sapiens
gaucagacauucagaga

SEQ ID NO: 953288 - RNA, 13 nt, Homo sapiens
gaucaguugccaa

SEQ ID NO: 953289 - RNA, 15 nt, Homo sapiens
gaucaguugccaaag

SEQ ID NO: 953290 - RNA, 18 nt, Homo sapiens
gauccgugacagcacuuu

SEQ ID NO: 953291 - RNA, 20 nt, Homo sapiens
gauccuggucugcaccucua

SEQ ID NO: 953292 - RNA, 17 nt, Homo sapiens
gaucuaagcaguugcaa

SEQ ID NO: 953293 - RNA, 18 nt, Homo sapiens
gaucucugagaccacaga

SEQ ID NO: 953294 - RNA, 15 nt, Homo sapiens
gaucuuguaaaaaua

SEQ ID NO: 953295 - RNA, 23 nt, Homo sapiens
gauggaauaucaaugcccaacag

SEQ ID NO: 953296 - RNA, 22 nt, Homo sapiens
gaugugggaaaaauaugugaau

SEQ ID NO: 953297 - RNA, 21 nt, Homo sapiens
gauuaauuaaaacacaacauc

SEQ ID NO: 953298 - RNA, 20 nt, Homo sapiens
gauuaauuuguguagauugu

SEQ ID NO: 953299 - RNA, 22 nt, Homo sapiens
gauuagccucgucuuucagcga

SEQ ID NO: 953300 - RNA, 14 nt, Homo sapiens
gauuauucaucaaa

SEQ ID NO: 953301 - RNA, 18 nt, Homo sapiens
gauuccccccaucuccau

SEQ ID NO: 953302 - RNA, 16 nt, Homo sapiens
gauucuaaaacauucu

SEQ ID NO: 953303 - RNA, 20 nt, Homo sapiens
gauugauuuuuuuucuuuaa

SEQ ID NO: 953304 - RNA, 14 nt, Homo sapiens
gauugcugcaaaga

SEQ ID NO: 953305 - RNA, 19 nt, Homo sapiens
gauugugaccuccagaggu

SEQ ID NO: 953306 - RNA, 12 nt, Homo sapiens
gauuuacaagca

SEQ ID NO: 953307 - RNA, 16 nt, Homo sapiens
gauuuuucucaucucc

SEQ ID NO: 953308 - RNA, 19 nt, Homo sapiens
gcaaagggcgggccuguuu

SEQ ID NO: 953309 - RNA, 20 nt, Homo sapiens
gcaaauaauacuaauuuaua

SEQ ID NO: 953310 - RNA, 19 nt, Homo sapiens
gcaagaacauucaaaccaa

SEQ ID NO: 953311 - RNA, 14 nt, Homo sapiens
gcaagcuggaguua

SEQ ID NO: 953312 - RNA, 15 nt, Homo sapiens
gcaagucccaucuca

SEQ ID NO: 953313 - RNA, 15 nt, Homo sapiens
gcaagucgccaggca

SEQ ID NO: 953314 - RNA, 21 nt, Homo sapiens
gcaaucccccaucguuaccca

SEQ ID NO: 953315 - RNA, 12 nt, Homo sapiens
gcaaugacuuuc

SEQ ID NO: 953316 - RNA, 12 nt, Homo sapiens
gcacaaacuguc

SEQ ID NO: 953317 - RNA, 18 nt, Homo sapiens
gcacacacaagugcacag

SEQ ID NO: 953318 - RNA, 20 nt, Homo sapiens
gcacacacaagugcacagag

SEQ ID NO: 953319 - RNA, 16 nt, Homo sapiens
gcacacaggugcacag

SEQ ID NO: 953320 - RNA, 14 nt, Homo sapiens
gcacacaugcacac

SEQ ID NO: 953321 - RNA, 19 nt, Homo sapiens
gcacacugcacacaugcac

SEQ ID NO: 953322 - RNA, 14 nt, Homo sapiens
gcacgguugccuga

SEQ ID NO: 953323 - RNA, 13 nt, Homo sapiens
gcacuugugaucc

SEQ ID NO: 953324 - RNA, 19 nt, Homo sapiens
gcacuuuuccccaauucau

SEQ ID NO: 953325 - RNA, 19 nt, Homo sapiens
gcagacacucaagagcccu

SEQ ID NO: 953326 - RNA, 15 nt, Homo sapiens
gcagacgugguguga

SEQ ID NO: 953327 - RNA, 17 nt, Homo sapiens
gcagagucuaccuugaa

SEQ ID NO: 953328 - RNA, 20 nt, Homo sapiens
gcagauccugucccaugggc

SEQ ID NO: 953329 - RNA, 18 nt, Homo sapiens
gcagauuacagucauuuc

SEQ ID NO: 953330 - RNA, 19 nt, Homo sapiens
gcagcccuaaugucugacc

SEQ ID NO: 953331 - RNA, 11 nt, Homo sapiens
gcagcggcccc

SEQ ID NO: 953332 - RNA, 17 nt, Homo sapiens
gcaggagaaucgcuuga

SEQ ID NO: 953333 - RNA, 20 nt, Homo sapiens
gcagggcagcagggaacaaa

SEQ ID NO: 953334 - RNA, 16 nt, Homo sapiens
gcaggggguucuggga

SEQ ID NO: 953335 - RNA, 17 nt, Homo sapiens
gcaggggguucugggac

SEQ ID NO: 953336 - RNA, 19 nt, Homo sapiens
gcaggucuagaagaacaac

SEQ ID NO: 953337 - RNA, 21 nt, Homo sapiens
gcaguaucagaggguggagau

SEQ ID NO: 953338 - RNA, 14 nt, Homo sapiens
uaaaaccuuacuua

SEQ ID NO: 953339 - RNA, 22 nt, Homo sapiens
uaaaaccuuacuuaaagcuugu

SEQ ID NO: 953340 - RNA, 12 nt, Homo sapiens
uaaaauacucac

SEQ ID NO: 953341 - RNA, 20 nt, Homo sapiens
uaaaauccaagcugcucauu

SEQ ID NO: 953342 - RNA, 21 nt, Homo sapiens
uaaaauguauuuuucacaaag

SEQ ID NO: 953343 - RNA, 13 nt, Homo sapiens
uaaaauuagugag

SEQ ID NO: 953344 - RNA, 16 nt, Homo sapiens
uaaaauucauagcauc

SEQ ID NO: 953345 - RNA, 20 nt, Homo sapiens
uaaacacacagaucugcauc

SEQ ID NO: 953346 - RNA, 17 nt, Homo sapiens
uaaacucaucuauccag

SEQ ID NO: 953347 - RNA, 20 nt, Homo sapiens
uaaacugucuuuuuccucaa

SEQ ID NO: 953348 - RNA, 15 nt, Homo sapiens
uaaagaaacacuuuc

SEQ ID NO: 953349 - RNA, 23 nt, Homo sapiens
uaaagaguucuccuuguacuuga

SEQ ID NO: 953350 - RNA, 17 nt, Homo sapiens
uaaaguuagggcauuuu

SEQ ID NO: 953351 - RNA, 19 nt, Homo sapiens
uaaaucauagcuaguauaa

SEQ ID NO: 953352 - RNA, 23 nt, Homo sapiens
uaaaugcuauggaaauacauuua

SEQ ID NO: 953353 - RNA, 16 nt, Homo sapiens
uaaauguguaaaugug

SEQ ID NO: 953354 - RNA, 13 nt, Homo sapiens
uaaauuauaccau

SEQ ID NO: 953355 - RNA, 11 nt, Homo sapiens
uaacacaugca

SEQ ID NO: 953356 - RNA, 14 nt, Homo sapiens
uaacacaugcacac

SEQ ID NO: 953357 - RNA, 14 nt, Homo sapiens
uaacacuguacugc

SEQ ID NO: 953358 - RNA, 17 nt, Homo sapiens
uaacaugucuaaaguua

SEQ ID NO: 953359 - RNA, 12 nt, Homo sapiens
uaaccccauuca

SEQ ID NO: 953360 - RNA, 13 nt, Homo sapiens
uaacucacuuuaa

SEQ ID NO: 953361 - RNA, 19 nt, Homo sapiens
uaacuguccaguccaguga

SEQ ID NO: 953362 - RNA, 21 nt, Homo sapiens
uaacugucuuaguacaccaua

SEQ ID NO: 953363 - RNA, 18 nt, Homo sapiens
uaagaaauccagcuucau

SEQ ID NO: 953364 - RNA, 19 nt, Homo sapiens
uaagaaauccagcuucaua

SEQ ID NO: 953365 - RNA, 14 nt, Homo sapiens
uaagaggauguggu

SEQ ID NO: 953366 - RNA, 21 nt, Homo sapiens
uaagauauuuuucagcuacag

SEQ ID NO: 953367 - RNA, 14 nt, Homo sapiens
uaagccacaggccc

SEQ ID NO: 953368 - RNA, 19 nt, Homo sapiens
uaagcccccuacugagaaa

SEQ ID NO: 953369 - RNA, 19 nt, Homo sapiens
uaaggaauauccagucaaa

SEQ ID NO: 953370 - RNA, 19 nt, Homo sapiens
uaagggcagauuacaguca

SEQ ID NO: 953371 - RNA, 19 nt, Homo sapiens
uaaguaguauugccuucca

SEQ ID NO: 953372 - RNA, 13 nt, Homo sapiens
uaagucacuuaaa

SEQ ID NO: 953373 - RNA, 17 nt, Homo sapiens
uaagucacuuaaacuca

SEQ ID NO: 953374 - RNA, 18 nt, Homo sapiens
uaagucacuuaaacucau

SEQ ID NO: 953375 - RNA, 14 nt, Homo sapiens
uaaguugcgcuuaa

SEQ ID NO: 953376 - RNA, 16 nt, Homo sapiens
uaauaaugagguccuu

SEQ ID NO: 953377 - RNA, 16 nt, Homo sapiens
uaauacguuaauacgc

SEQ ID NO: 953378 - RNA, 19 nt, Homo sapiens
uaauauaacugucuuagua

SEQ ID NO: 953379 - RNA, 16 nt, Homo sapiens
uaauauguacuuuucc

SEQ ID NO: 953380 - RNA, 14 nt, Homo sapiens
uaauauuacauuuc

SEQ ID NO: 953381 - RNA, 14 nt, Homo sapiens
uaaucuaguuuuau

SEQ ID NO: 953382 - RNA, 18 nt, Homo sapiens
uaaucuuggcccuauuca

SEQ ID NO: 953383 - RNA, 16 nt, Homo sapiens
uaaucuuugagucuaa

SEQ ID NO: 953384 - RNA, 17 nt, Homo sapiens
uaaugacuuaagcacac

SEQ ID NO: 953385 - RNA, 13 nt, Homo sapiens
uaaugcacuccug

SEQ ID NO: 953386 - RNA, 16 nt, Homo sapiens
uaauguaaaauucaua

SEQ ID NO: 953387 - RNA, 19 nt, Homo sapiens
uaauguauuucaaaaucac

SEQ ID NO: 953388 - RNA, 14 nt, Homo sapiens
uaaugugccaaaau

SEQ ID NO: 953389 - RNA, 14 nt, Homo sapiens
uaauuaaaaccauc

SEQ ID NO: 953390 - RNA, 18 nt, Homo sapiens
uaauuagcucucgccuca

SEQ ID NO: 953391 - RNA, 12 nt, Homo sapiens
uaauucagcaau

SEQ ID NO: 953392 - RNA, 22 nt, Homo sapiens
uaauugcauuuuaaauuggccc

SEQ ID NO: 953393 - RNA, 14 nt, Homo sapiens
uaauugcuucacag

SEQ ID NO: 953394 - RNA, 15 nt, Homo sapiens
uaauugugcagauau

SEQ ID NO: 953395 - RNA, 19 nt, Homo sapiens
uaauuuaccugaagucuuu

SEQ ID NO: 953396 - RNA, 22 nt, Homo sapiens
uacaaagcuggguuugauucaa

SEQ ID NO: 953397 - RNA, 22 nt, Homo sapiens
uacaaguuuauguggcacacaa

SEQ ID NO: 953398 - RNA, 21 nt, Homo sapiens
uacaaucuuagugaaugggaa

SEQ ID NO: 953399 - RNA, 21 nt, Homo sapiens
uacaaugauguaaauauuuca

SEQ ID NO: 953400 - RNA, 16 nt, Homo sapiens
uacaauuuucauccca

SEQ ID NO: 953401 - RNA, 14 nt, Homo sapiens
uacaggaaguacug

SEQ ID NO: 953402 - RNA, 20 nt, Homo sapiens
uacauauggaaauccuguua

SEQ ID NO: 953403 - RNA, 14 nt, Homo sapiens
uacauggguucaau

SEQ ID NO: 953404 - RNA, 15 nt, Homo sapiens
uacauuaugcccuug

SEQ ID NO: 953405 - RNA, 13 nt, Homo sapiens
uacauuugaucuu

SEQ ID NO: 953406 - RNA, 14 nt, Homo sapiens
uaccaagaucacaa

SEQ ID NO: 953407 - RNA, 19 nt, Homo sapiens
uaccauauggaaugccaaa

SEQ ID NO: 953408 - RNA, 22 nt, Homo sapiens
uaccauauggaaugccaaaauu

SEQ ID NO: 953409 - RNA, 19 nt, Homo sapiens
uacccgagaagcacuugag

SEQ ID NO: 953410 - RNA, 13 nt, Homo sapiens
uaccucugggaaa

SEQ ID NO: 953411 - RNA, 22 nt, Homo sapiens
uaccugaagucuuuguacagac

SEQ ID NO: 953412 - RNA, 21 nt, Homo sapiens
uacguuaauacgcaggcaucu

SEQ ID NO: 953413 - RNA, 15 nt, Homo sapiens
uacuaaaaacacugg

SEQ ID NO: 953414 - RNA, 23 nt, Homo sapiens
uacuaguggggcaaugacuuucc

SEQ ID NO: 953415 - RNA, 17 nt, Homo sapiens
uacucacugaguaacag

SEQ ID NO: 953416 - RNA, 18 nt, Homo sapiens
uacucgaguuacagacaa

SEQ ID NO: 953417 - RNA, 18 nt, Homo sapiens
uacugccuuagucccaau

SEQ ID NO: 953418 - RNA, 22 nt, Homo sapiens
uacugccuuagucccaauuuga

SEQ ID NO: 953419 - RNA, 19 nt, Homo sapiens
uacuugagaauaaaugagc

SEQ ID NO: 953420 - RNA, 20 nt, Homo sapiens
uacuugauauaauuacuuaa

SEQ ID NO: 953421 - RNA, 13 nt, Homo sapiens
uacuuucacaucu

SEQ ID NO: 953422 - RNA, 23 nt, Homo sapiens
uacuuuccuaauuaaacuaugau

SEQ ID NO: 953423 - RNA, 18 nt, Homo sapiens
uagaaaggggcccauuca

SEQ ID NO: 953424 - RNA, 19 nt, Homo sapiens
uagaacugucccacaaaau

SEQ ID NO: 953425 - RNA, 22 nt, Homo sapiens
uagacaugcacacccauucaca

SEQ ID NO: 953426 - RNA, 16 nt, Homo sapiens
uagacuucgaaaacag

SEQ ID NO: 953427 - RNA, 18 nt, Homo sapiens
uagagcaagaacauucaa

SEQ ID NO: 953428 - RNA, 18 nt, Homo sapiens
uagaggggcaacugauga

SEQ ID NO: 953429 - RNA, 14 nt, Homo sapiens
uagauaagugcuca

SEQ ID NO: 953430 - RNA, 18 nt, Homo sapiens
uagauuuuucucaucucc

SEQ ID NO: 953431 - RNA, 19 nt, Homo sapiens
uagcaaaauauuaucugaa

SEQ ID NO: 953432 - RNA, 12 nt, Homo sapiens
uagcagugcuag

SEQ ID NO: 953433 - RNA, 23 nt, Homo sapiens
uagccagaauguuuccuguggaa

SEQ ID NO: 953434 - RNA, 12 nt, Homo sapiens
gcccaaauggaa

SEQ ID NO: 953435 - RNA, 17 nt, Homo sapiens
gcccaggcuggucuuga

SEQ ID NO: 953436 - RNA, 18 nt, Homo sapiens
gccccagcgagucuggag

SEQ ID NO: 953437 - RNA, 18 nt, Homo sapiens
gccccaguuauugugaaa

SEQ ID NO: 953438 - RNA, 20 nt, Homo sapiens
gcccccacagauccauccuu

SEQ ID NO: 953439 - RNA, 21 nt, Homo sapiens
gcccugcaccuugggcacggg

SEQ ID NO: 953440 - RNA, 16 nt, Homo sapiens
gcccugggguuuccac

SEQ ID NO: 953441 - RNA, 12 nt, Homo sapiens
gccgcugcuuga

SEQ ID NO: 953442 - RNA, 16 nt, Homo sapiens
gccucagaguccugcc

SEQ ID NO: 953443 - RNA, 16 nt, Homo sapiens
gccuccauccacacac

SEQ ID NO: 953444 - RNA, 12 nt, Homo sapiens
gccucccaaagu

SEQ ID NO: 953445 - RNA, 19 nt, Homo sapiens
gccucccgccgccucgggc

SEQ ID NO: 953446 - RNA, 18 nt, Homo sapiens
gccucgaccucccuggcu

SEQ ID NO: 953447 - RNA, 14 nt, Homo sapiens
gccucuuguucaug

SEQ ID NO: 953448 - RNA, 22 nt, Homo sapiens
gccugcagcugagauuccagaa

SEQ ID NO: 953449 - RNA, 12 nt, Homo sapiens
gccugcucuuuc

SEQ ID NO: 953450 - RNA, 22 nt, Homo sapiens
gccugggaugauguuggucaaa

SEQ ID NO: 953451 - RNA, 14 nt, Homo sapiens
gccuguucccugag

SEQ ID NO: 953452 - RNA, 20 nt, Homo sapiens
gccuguuuggugaggaccug

SEQ ID NO: 953453 - RNA, 16 nt, Homo sapiens
gccuuagcacuaugga

SEQ ID NO: 953454 - RNA, 17 nt, Homo sapiens
gccuugaacuguggcca

SEQ ID NO: 953455 - RNA, 18 nt, Homo sapiens
gccuuguccaucugauuc

SEQ ID NO: 953456 - RNA, 19 nt, Homo sapiens
gccuuuaauaauguuauag

SEQ ID NO: 953457 - RNA, 19 nt, Homo sapiens
gccuuugccucucuugcca

SEQ ID NO: 953458 - RNA, 21 nt, Homo sapiens
gccuuugcuuuacagcacugu

SEQ ID NO: 953459 - RNA, 16 nt, Homo sapiens
gcgcaggcugaucacc

SEQ ID NO: 953460 - RNA, 19 nt, Homo sapiens
gcggaaagcagucagcgga

SEQ ID NO: 953461 - RNA, 13 nt, Homo sapiens
gcgguauccagag

SEQ ID NO: 953462 - RNA, 20 nt, Homo sapiens
gcguccuuugaaccugugca

SEQ ID NO: 953463 - RNA, 23 nt, Homo sapiens
gcgugagcuggucaguugccaaa

SEQ ID NO: 953464 - RNA, 14 nt, Homo sapiens
gcgugcaugcacac

SEQ ID NO: 953465 - RNA, 23 nt, Homo sapiens
gcguuucauguagccagcagaac

SEQ ID NO: 953466 - RNA, 12 nt, Homo sapiens
gcuaaaugcaaa

SEQ ID NO: 953467 - RNA, 17 nt, Homo sapiens
gcuaaguggaagacaga

SEQ ID NO: 953468 - RNA, 23 nt, Homo sapiens
gcuaccagggcucacccacugcu

SEQ ID NO: 953469 - RNA, 24 nt, Homo sapiens
gcuagaaccaagcacuaccaguau

SEQ ID NO: 953470 - RNA, 20 nt, Homo sapiens
gcuagaauauccuauacugg

SEQ ID NO: 953471 - RNA, 16 nt, Homo sapiens
gcuauaccagcagaaa

SEQ ID NO: 953472 - RNA, 15 nt, Homo sapiens
gcuauccaaucucau

SEQ ID NO: 953473 - RNA, 21 nt, Homo sapiens
gcuccaagagaauucacuuua

SEQ ID NO: 953474 - RNA, 12 nt, Homo sapiens
gcucgggacugu

SEQ ID NO: 953475 - RNA, 19 nt, Homo sapiens
gcucugagcaguuguuaua

SEQ ID NO: 953476 - RNA, 23 nt, Homo sapiens
gcucugauggcacauuagaugaa

SEQ ID NO: 953477 - RNA, 17 nt, Homo sapiens
gcucugcuggucacugg

SEQ ID NO: 953478 - RNA, 22 nt, Homo sapiens
gcugaacaggccgcacaucuca

SEQ ID NO: 953479 - RNA, 15 nt, Homo sapiens
gcugaacgacagucc

SEQ ID NO: 953480 - RNA, 18 nt, Homo sapiens
gcugcagaugacuggaaa

SEQ ID NO: 953481 - RNA, 21 nt, Homo sapiens
gcugccccaccccuccaugau

SEQ ID NO: 953482 - RNA, 19 nt, Homo sapiens
gcugcuguagcaacagagc

SEQ ID NO: 953483 - RNA, 14 nt, Homo sapiens
gcugcuuagauuuc

SEQ ID NO: 953484 - RNA, 13 nt, Homo sapiens
gcuggaccugggg

SEQ ID NO: 953485 - RNA, 20 nt, Homo sapiens
gcuggagugaagugguguga

SEQ ID NO: 953486 - RNA, 23 nt, Homo sapiens
gcugggaccacaagugugcauua

SEQ ID NO: 953487 - RNA, 20 nt, Homo sapiens
gcuggucucaaacuccugag

SEQ ID NO: 953488 - RNA, 20 nt, Homo sapiens
gcuguaugacugaaguaaua

SEQ ID NO: 953489 - RNA, 19 nt, Homo sapiens
gcuguauuuuugaaauacu

SEQ ID NO: 953490 - RNA, 13 nt, Homo sapiens
gcugugggcugcu

SEQ ID NO: 953491 - RNA, 20 nt, Homo sapiens
gcuuagauuucuagcaguau

SEQ ID NO: 953492 - RNA, 13 nt, Homo sapiens
gcuuaugugacau

SEQ ID NO: 953493 - RNA, 14 nt, Homo sapiens
gcuuauuuaaucug

SEQ ID NO: 953494 - RNA, 17 nt, Homo sapiens
gcuuauuuaaucuguac

SEQ ID NO: 953495 - RNA, 21 nt, Homo sapiens
gcuuccagcagagccuugcag

SEQ ID NO: 953496 - RNA, 23 nt, Homo sapiens
gcuuccuagaaaguucuguguaa

SEQ ID NO: 953497 - RNA, 20 nt, Homo sapiens
gcuuccuuugggagcucauu

SEQ ID NO: 953498 - RNA, 18 nt, Homo sapiens
gcuugaguggacagcagc

SEQ ID NO: 953499 - RNA, 14 nt, Homo sapiens
gcuuguuuguucua

SEQ ID NO: 953500 - RNA, 23 nt, Homo sapiens
gcuuuacagcacuguauguguug

SEQ ID NO: 953501 - RNA, 21 nt, Homo sapiens
gcuuuagcugcugucuucccc

SEQ ID NO: 953502 - RNA, 15 nt, Homo sapiens
gcuuuauugccucug

SEQ ID NO: 953503 - RNA, 19 nt, Homo sapiens
gcuuucauccaacuggaag

SEQ ID NO: 953504 - RNA, 15 nt, Homo sapiens
gcuuuccuguuucca

SEQ ID NO: 953505 - RNA, 20 nt, Homo sapiens
ggaaagcuuaaaacccaaua

SEQ ID NO: 953506 - RNA, 12 nt, Homo sapiens
ggaaauguuucu

SEQ ID NO: 953507 - RNA, 21 nt, Homo sapiens
ggaacaaaacuccagacucuu

SEQ ID NO: 953508 - RNA, 21 nt, Homo sapiens
ggaagaaacacguggucauga

SEQ ID NO: 953509 - RNA, 16 nt, Homo sapiens
ggaagcacugccauua

SEQ ID NO: 953510 - RNA, 18 nt, Homo sapiens
ggaaucagaagcacuagu

SEQ ID NO: 953511 - RNA, 16 nt, Homo sapiens
ggaaugaaugucagug

SEQ ID NO: 953512 - RNA, 21 nt, Homo sapiens
ggacauuuugggcuggauaaa

SEQ ID NO: 953513 - RNA, 19 nt, Homo sapiens
ggacgccagguggaccugu

SEQ ID NO: 953514 - RNA, 21 nt, Homo sapiens
ggagacagucaggaagccucc

SEQ ID NO: 953515 - RNA, 22 nt, Homo sapiens
ggagaguaacccugucuaauga

SEQ ID NO: 953516 - RNA, 17 nt, Homo sapiens
ggagaguuguuggcaag

SEQ ID NO: 953517 - RNA, 22 nt, Homo sapiens
ggagcccugggguuuccacaca

SEQ ID NO: 953518 - RNA, 14 nt, Homo sapiens
ggaguaggcuguau

SEQ ID NO: 953519 - RNA, 22 nt, Homo sapiens
ggaguuucuauagcgagacaua

SEQ ID NO: 953520 - RNA, 20 nt, Homo sapiens
ggaugcauucccuacagauu

SEQ ID NO: 953521 - RNA, 21 nt, Homo sapiens
ggaugcgggcauggcagcccu

SEQ ID NO: 953522 - RNA, 19 nt, Homo sapiens
ggauugucugcugccucca

SEQ ID NO: 953523 - RNA, 20 nt, Homo sapiens
ggcaaaaaaaaaaauuacau

SEQ ID NO: 953524 - RNA, 17 nt, Homo sapiens
ggcaaacuugcaguuua

SEQ ID NO: 953525 - RNA, 13 nt, Homo sapiens
ggcaaaguaaaau

SEQ ID NO: 953526 - RNA, 22 nt, Homo sapiens
ggcaaggcagcucccagguuua

SEQ ID NO: 953527 - RNA, 16 nt, Homo sapiens
ggcagauuacagucau

SEQ ID NO: 953528 - RNA, 19 nt, Homo sapiens
ggcagcuuuuucauaccaa

SEQ ID NO: 953529 - RNA, 20 nt, Homo sapiens
ggcaggagaaucgcuugaac

SEQ ID NO: 953530 - RNA, 21 nt, Homo sapiens
ggcaggggguucugggaccca

SEQ ID NO: 953531 - RNA, 19 nt, Homo sapiens
ggcagggucucacucuguu

SEQ ID NO: 953532 - RNA, 23 nt, Homo sapiens
ggcauaaagcugggaggccaaac

SEQ ID NO: 953533 - RNA, 15 nt, Homo sapiens
ggcaucuccauuuca

SEQ ID NO: 953534 - RNA, 18 nt, Homo sapiens
ggcaugggaaugaauguc

SEQ ID NO: 953535 - RNA, 21 nt, Homo sapiens
ggccaccuagaaaggggccca

SEQ ID NO: 953536 - RNA, 13 nt, Homo sapiens
ugagacauuugcc

SEQ ID NO: 953537 - RNA, 11 nt, Homo sapiens
ugagauuccag

SEQ ID NO: 953538 - RNA, 14 nt, Homo sapiens
ugagcaagucccau

SEQ ID NO: 953539 - RNA, 19 nt, Homo sapiens
ugagcaguuguuauauuca

SEQ ID NO: 953540 - RNA, 23 nt, Homo sapiens
ugagcccaauguauuaugaucuc

SEQ ID NO: 953541 - RNA, 15 nt, Homo sapiens
ugagcuaccaggaag

SEQ ID NO: 953542 - RNA, 16 nt, Homo sapiens
ugagcucucuaauaga

SEQ ID NO: 953543 - RNA, 20 nt, Homo sapiens
ugagguaaauaaagccacuu

SEQ ID NO: 953544 - RNA, 22 nt, Homo sapiens
ugagguccuucuguagugccau

SEQ ID NO: 953545 - RNA, 12 nt, Homo sapiens
ugaggugggggc

SEQ ID NO: 953546 - RNA, 12 nt, Homo sapiens
ugagugccuuac

SEQ ID NO: 953547 - RNA, 15 nt, Homo sapiens
ugaguggacagcagc

SEQ ID NO: 953548 - RNA, 15 nt, Homo sapiens
ugaguuaccucaugc

SEQ ID NO: 953549 - RNA, 15 nt, Homo sapiens
ugauaaugaucugaa

SEQ ID NO: 953550 - RNA, 15 nt, Homo sapiens
ugauacuuccucaua

SEQ ID NO: 953551 - RNA, 17 nt, Homo sapiens
ugauagacaaaaucagu

SEQ ID NO: 953552 - RNA, 15 nt, Homo sapiens
ugauauaauuacuua

SEQ ID NO: 953553 - RNA, 13 nt, Homo sapiens
ugaucccaaagau

SEQ ID NO: 953554 - RNA, 15 nt, Homo sapiens
ugaucccagcucacu

SEQ ID NO: 953555 - RNA, 13 nt, Homo sapiens
ugaugaagcacau

SEQ ID NO: 953556 - RNA, 16 nt, Homo sapiens
ugauuuccauuugcaa

SEQ ID NO: 953557 - RNA, 15 nt, Homo sapiens
ugcaaaugaaugccu

SEQ ID NO: 953558 - RNA, 19 nt, Homo sapiens
ugcaacaggaagacacugg

SEQ ID NO: 953559 - RNA, 15 nt, Homo sapiens
ugcaaccugugcaaa

SEQ ID NO: 953560 - RNA, 16 nt, Homo sapiens
ugcaaccugugcaaaa

SEQ ID NO: 953561 - RNA, 22 nt, Homo sapiens
ugcaaggugaacaccacuuugu

SEQ ID NO: 953562 - RNA, 12 nt, Homo sapiens
ugcacacaugca

SEQ ID NO: 953563 - RNA, 15 nt, Homo sapiens
ugcacacguccaugu

SEQ ID NO: 953564 - RNA, 23 nt, Homo sapiens
ugcacagagcacacugcacacau

SEQ ID NO: 953565 - RNA, 19 nt, Homo sapiens
ugcacaggguccucagcuc

SEQ ID NO: 953566 - RNA, 20 nt, Homo sapiens
ugcacaggguccucagcuca

SEQ ID NO: 953567 - RNA, 18 nt, Homo sapiens
ugcacauuugucacugaa

SEQ ID NO: 953568 - RNA, 13 nt, Homo sapiens
ugcacggggccag

SEQ ID NO: 953569 - RNA, 20 nt, Homo sapiens
ugcacuccagccugggcaac

SEQ ID NO: 953570 - RNA, 17 nt, Homo sapiens
ugcagaagcaugaucac

SEQ ID NO: 953571 - RNA, 23 nt, Homo sapiens
ugcagaagcaugaucacagcuca

SEQ ID NO: 953572 - RNA, 13 nt, Homo sapiens
ugcagacacucaa

SEQ ID NO: 953573 - RNA, 16 nt, Homo sapiens
ugcagaugacuggaaa

SEQ ID NO: 953574 - RNA, 13 nt, Homo sapiens
ugcagcuccucug

SEQ ID NO: 953575 - RNA, 16 nt, Homo sapiens
ugcagcuccucugccu

SEQ ID NO: 953576 - RNA, 16 nt, Homo sapiens
ugcagcuuggagacag

SEQ ID NO: 953577 - RNA, 14 nt, Homo sapiens
ugcaguaaccauuu

SEQ ID NO: 953578 - RNA, 23 nt, Homo sapiens
ugcauacaggcauacacaugcac

SEQ ID NO: 953579 - RNA, 13 nt, Homo sapiens
ugcauacuucuaa

SEQ ID NO: 953580 - RNA, 18 nt, Homo sapiens
ugcaucaaaugcaugcgu

SEQ ID NO: 953581 - RNA, 18 nt, Homo sapiens
ugcaucucuuuagaucca

SEQ ID NO: 953582 - RNA, 15 nt, Homo sapiens
ugcaugacuuuacac

SEQ ID NO: 953583 - RNA, 15 nt, Homo sapiens
ugcauggaguauuau

SEQ ID NO: 953584 - RNA, 15 nt, Homo sapiens
ugcauucacagcuac

SEQ ID NO: 953585 - RNA, 14 nt, Homo sapiens
ugccaaaaacaaca

SEQ ID NO: 953586 - RNA, 21 nt, Homo sapiens
ugccaaaaacuaaaauucaac

SEQ ID NO: 953587 - RNA, 18 nt, Homo sapiens
ugccagagagaccugcug

SEQ ID NO: 953588 - RNA, 21 nt, Homo sapiens
ugccaggagugggugggacac

SEQ ID NO: 953589 - RNA, 15 nt, Homo sapiens
ugccaugguagaaga

SEQ ID NO: 953590 - RNA, 21 nt, Homo sapiens
ugcccaagagaucugugccau

SEQ ID NO: 953591 - RNA, 20 nt, Homo sapiens
ugcccacugaacaugcucau

SEQ ID NO: 953592 - RNA, 22 nt, Homo sapiens
ugcccacugaacaugcucaugu

SEQ ID NO: 953593 - RNA, 22 nt, Homo sapiens
ugcccauuguaacuuauuucag

SEQ ID NO: 953594 - RNA, 20 nt, Homo sapiens
ugccccccagauugcugcaa

SEQ ID NO: 953595 - RNA, 13 nt, Homo sapiens
ugcccgagguucc

SEQ ID NO: 953596 - RNA, 15 nt, Homo sapiens
ugcccuuuugcccac

SEQ ID NO: 953597 - RNA, 14 nt, Homo sapiens
ugccucaucacugc

SEQ ID NO: 953598 - RNA, 17 nt, Homo sapiens
ugccucaucacugcucc

SEQ ID NO: 953599 - RNA, 23 nt, Homo sapiens
ugccuccucagcagccucacugc

SEQ ID NO: 953600 - RNA, 16 nt, Homo sapiens
ugccuggcauauaguu

SEQ ID NO: 953601 - RNA, 19 nt, Homo sapiens
ugccuuagucccaauuuga

SEQ ID NO: 953602 - RNA, 21 nt, Homo sapiens
ugccuucuagcuguguccuca

SEQ ID NO: 953603 - RNA, 18 nt, Homo sapiens
ugcuauguguacugucuu

SEQ ID NO: 953604 - RNA, 23 nt, Homo sapiens
ugcucaccaagcuguuccacuuc

SEQ ID NO: 953605 - RNA, 14 nt, Homo sapiens
ugcucacugcucac

SEQ ID NO: 953606 - RNA, 18 nt, Homo sapiens
ugcucacugcucacacgc

SEQ ID NO: 953607 - RNA, 13 nt, Homo sapiens
ugcucagccauaa

SEQ ID NO: 953608 - RNA, 14 nt, Homo sapiens
ugcucauguguaca

SEQ ID NO: 953609 - RNA, 19 nt, Homo sapiens
ugcucauguguacacacgc

SEQ ID NO: 953610 - RNA, 15 nt, Homo sapiens
ugcuccuugccucug

SEQ ID NO: 953611 - RNA, 14 nt, Homo sapiens
ugcucuccaucucu

SEQ ID NO: 953612 - RNA, 23 nt, Homo sapiens
ugcucucgggugcccugcauuca

SEQ ID NO: 953613 - RNA, 18 nt, Homo sapiens
ugcucugugcacucacgc

SEQ ID NO: 953614 - RNA, 18 nt, Homo sapiens
ugcucuguuuugcaugga

SEQ ID NO: 953615 - RNA, 13 nt, Homo sapiens
ugcucuuuccacc

SEQ ID NO: 953616 - RNA, 21 nt, Homo sapiens
ugcugccagagagaccugcug

SEQ ID NO: 953617 - RNA, 13 nt, Homo sapiens
ugcugcugggaau

SEQ ID NO: 953618 - RNA, 20 nt, Homo sapiens
ugcugggauuacagguguga

SEQ ID NO: 953619 - RNA, 21 nt, Homo sapiens
ugcugugacaagccaauguga

SEQ ID NO: 953620 - RNA, 13 nt, Homo sapiens
ugcuuagauuucu

SEQ ID NO: 953621 - RNA, 13 nt, Homo sapiens
ugcuuccagugga

SEQ ID NO: 953622 - RNA, 20 nt, Homo sapiens
ugcuuugaaugcauguguga

SEQ ID NO: 953623 - RNA, 15 nt, Homo sapiens
ugcuuuuccaucuaa

SEQ ID NO: 953624 - RNA, 14 nt, Homo sapiens
ugcuuuugcauuuc

SEQ ID NO: 953625 - RNA, 14 nt, Homo sapiens
uggaaaccuuuuca

SEQ ID NO: 953626 - RNA, 18 nt, Homo sapiens
uggaaauccuguuacuua

SEQ ID NO: 953627 - RNA, 14 nt, Homo sapiens
uggaaguacauaaa

SEQ ID NO: 953628 - RNA, 21 nt, Homo sapiens
uggaaguguguguuucuugcu

SEQ ID NO: 953629 - RNA, 12 nt, Homo sapiens
uggacagcagcu

SEQ ID NO: 953630 - RNA, 21 nt, Homo sapiens
uggacauuuugggcuggauaa

SEQ ID NO: 953631 - RNA, 19 nt, Homo sapiens
uggaccacagcaugaaccu

SEQ ID NO: 953632 - RNA, 22 nt, Homo sapiens
uggaccacuguuucuugcuugu

SEQ ID NO: 953633 - RNA, 20 nt, Homo sapiens
uggagaaaauggacguguua

SEQ ID NO: 953634 - RNA, 12 nt, Homo sapiens
uggagagcugcu

SEQ ID NO: 953635 - RNA, 14 nt, Homo sapiens
uggagauuaaucua

SEQ ID NO: 953636 - RNA, 18 nt, Homo sapiens
uggagcuggcacugugga

SEQ ID NO: 953637 - RNA, 23 nt, Homo sapiens
uggagugucaccagcugccaaaa

SEQ ID NO: 953638 - RNA, 23 nt, Homo sapiens
uggauaagucacuuaaacucauc

SEQ ID NO: 953639 - RNA, 19 nt, Homo sapiens
uggaucaaccaaguuacac

SEQ ID NO: 953640 - RNA, 19 nt, Homo sapiens
uggauccgugacagcacuu

SEQ ID NO: 953641 - RNA, 22 nt, Homo sapiens
uggaugaaucuugaaacacauu

SEQ ID NO: 953642 - RNA, 22 nt, Homo sapiens
uggauuuucaaaaagccguuga

SEQ ID NO: 953643 - RNA, 21 nt, Homo sapiens
uggccucauucagcagaauga

SEQ ID NO: 953644 - RNA, 15 nt, Homo sapiens
uggcgcacccggcag

SEQ ID NO: 953645 - RNA, 17 nt, Homo sapiens
uggcuaucuacaaugug

SEQ ID NO: 953646 - RNA, 16 nt, Homo sapiens
uggcucacaccuguaa

SEQ ID NO: 953647 - RNA, 20 nt, Homo sapiens
ugggaagaaagauucaauua

SEQ ID NO: 953648 - RNA, 11 nt, Homo sapiens
ugggaauguuc

SEQ ID NO: 953649 - RNA, 16 nt, Homo sapiens
ugggacacagagaccc

SEQ ID NO: 953650 - RNA, 15 nt, Homo sapiens
ugggacucaguucuu

SEQ ID NO: 953651 - RNA, 18 nt, Homo sapiens
ugggagguggugucccuu

SEQ ID NO: 953652 - RNA, 22 nt, Homo sapiens
ugggccagggucucgucaggag

SEQ ID NO: 953653 - RNA, 14 nt, Homo sapiens
uggggacucuccag

SEQ ID NO: 953654 - RNA, 16 nt, Homo sapiens
uggguaggcaugugca

SEQ ID NO: 953655 - RNA, 15 nt, Homo sapiens
ugggugggacacaga

SEQ ID NO: 953656 - RNA, 20 nt, Homo sapiens
ugguaaauuuuauaauguca

SEQ ID NO: 953657 - RNA, 12 nt, Homo sapiens
ugguaacugcac

SEQ ID NO: 953658 - RNA, 19 nt, Homo sapiens
ugguaaucuuuucugaggu

SEQ ID NO: 953659 - RNA, 21 nt, Homo sapiens
ugguagaagaugaaucaguau

SEQ ID NO: 953660 - RNA, 16 nt, Homo sapiens
uggucaguugccaaag

SEQ ID NO: 953661 - RNA, 14 nt, Homo sapiens
ugguggacaugcac

SEQ ID NO: 953662 - RNA, 16 nt, Homo sapiens
ugguggacaugcacag

SEQ ID NO: 953663 - RNA, 20 nt, Homo sapiens
ugguggacaugcacagcuaa

SEQ ID NO: 953664 - RNA, 16 nt, Homo sapiens
ugguggcagugcagca

SEQ ID NO: 953665 - RNA, 17 nt, Homo sapiens
ugguugagaaacauugc

SEQ ID NO: 953666 - RNA, 15 nt, Homo sapiens
ugguuugaagugaau

SEQ ID NO: 953667 - RNA, 17 nt, Homo sapiens
uguaaaaauaaccagua

SEQ ID NO: 953668 - RNA, 21 nt, Homo sapiens
uguaaauaaugcuuaacauaa

SEQ ID NO: 953669 - RNA, 14 nt, Homo sapiens
uguaaauauuucaa

SEQ ID NO: 953670 - RNA, 20 nt, Homo sapiens
uguaaauggaagcacugcca

SEQ ID NO: 953671 - RNA, 17 nt, Homo sapiens
uaucauuuugcacgugc

SEQ ID NO: 953672 - RNA, 22 nt, Homo sapiens
uauccaacaagccagaaucagc

SEQ ID NO: 953673 - RNA, 17 nt, Homo sapiens
uauccauccucugagau

SEQ ID NO: 953674 - RNA, 22 nt, Homo sapiens
uauccuggugucuaguuugcau

SEQ ID NO: 953675 - RNA, 18 nt, Homo sapiens
uaucucuguggggucuau

SEQ ID NO: 953676 - RNA, 16 nt, Homo sapiens
uaucuguuuacaucca

SEQ ID NO: 953677 - RNA, 15 nt, Homo sapiens
uaugaaaagucauuc

SEQ ID NO: 953678 - RNA, 15 nt, Homo sapiens
uaugaagacacuguc

SEQ ID NO: 953679 - RNA, 12 nt, Homo sapiens
uaugcagcucau

SEQ ID NO: 953680 - RNA, 16 nt, Homo sapiens
uaugccuccauuucag

SEQ ID NO: 953681 - RNA, 17 nt, Homo sapiens
uaugcuaugcuauggaa

SEQ ID NO: 953682 - RNA, 19 nt, Homo sapiens
uaugcugucacugccaaac

SEQ ID NO: 953683 - RNA, 16 nt, Homo sapiens
uauguaaacaucauaa

SEQ ID NO: 953684 - RNA, 20 nt, Homo sapiens
uauguacccuacccugcaca

SEQ ID NO: 953685 - RNA, 22 nt, Homo sapiens
uauguacccuacccugcacauu

SEQ ID NO: 953686 - RNA, 13 nt, Homo sapiens
uauguacuuuucc

SEQ ID NO: 953687 - RNA, 19 nt, Homo sapiens
uauguacuuuuccauuuau

SEQ ID NO: 953688 - RNA, 13 nt, Homo sapiens
uaugucauacucu

SEQ ID NO: 953689 - RNA, 19 nt, Homo sapiens
uaugugaauugagcacaua

SEQ ID NO: 953690 - RNA, 13 nt, Homo sapiens
uauguucaucuuc

SEQ ID NO: 953691 - RNA, 12 nt, Homo sapiens
uauuaaucucau

SEQ ID NO: 953692 - RNA, 21 nt, Homo sapiens
uauuacaacacuuuaaguaaa

SEQ ID NO: 953693 - RNA, 19 nt, Homo sapiens
uauuacaccuuuaucucaa

SEQ ID NO: 953694 - RNA, 19 nt, Homo sapiens
uauuagcuuauuuaaucug

SEQ ID NO: 953695 - RNA, 15 nt, Homo sapiens
uauuaguuaggugug

SEQ ID NO: 953696 - RNA, 18 nt, Homo sapiens
uauuauagucuguacuuc

SEQ ID NO: 953697 - RNA, 19 nt, Homo sapiens
uauucuguagccaacuuaa

SEQ ID NO: 953698 - RNA, 12 nt, Homo sapiens
uauugccuucca

SEQ ID NO: 953699 - RNA, 20 nt, Homo sapiens
uauuggagauuaaucuacca

SEQ ID NO: 953700 - RNA, 15 nt, Homo sapiens
uauuguuggcacaga

SEQ ID NO: 953701 - RNA, 15 nt, Homo sapiens
uauuuauuaccgaua

SEQ ID NO: 953702 - RNA, 19 nt, Homo sapiens
uauuucagucaucaucuca

SEQ ID NO: 953703 - RNA, 20 nt, Homo sapiens
uauuucuaagcuuauuucua

SEQ ID NO: 953704 - RNA, 17 nt, Homo sapiens
uauuugacucagcacug

SEQ ID NO: 953705 - RNA, 18 nt, Homo sapiens
uauuugacucagcacugu

SEQ ID NO: 953706 - RNA, 19 nt, Homo sapiens
uauuuuguauuauugcugu

SEQ ID NO: 953707 - RNA, 19 nt, Homo sapiens
uauuuuuuacuacauaauu

SEQ ID NO: 953708 - RNA, 14 nt, Homo sapiens
ucaaaauaguucua

SEQ ID NO: 953709 - RNA, 17 nt, Homo sapiens
ucaaacaaauguaaaua

SEQ ID NO: 953710 - RNA, 19 nt, Homo sapiens
ucaaaccaaauaagauauu

SEQ ID NO: 953711 - RNA, 21 nt, Homo sapiens
ucaaaccugcaaggcaaagua

SEQ ID NO: 953712 - RNA, 18 nt, Homo sapiens
ucaaacuccugaguucaa

SEQ ID NO: 953713 - RNA, 14 nt, Homo sapiens
ucaaaugaguuuaa

SEQ ID NO: 953714 - RNA, 17 nt, Homo sapiens
ucaaaugcaguccagug

SEQ ID NO: 953715 - RNA, 21 nt, Homo sapiens
ucaacgucccccgcucaggug

SEQ ID NO: 953716 - RNA, 18 nt, Homo sapiens
ucaacuguugccaggaga

SEQ ID NO: 953717 - RNA, 13 nt, Homo sapiens
ucaagaugugaca

SEQ ID NO: 953718 - RNA, 21 nt, Homo sapiens
ucaagccaagccuccuguggu

SEQ ID NO: 953719 - RNA, 20 nt, Homo sapiens
ucaagcgauccuccuuccuc

SEQ ID NO: 953720 - RNA, 21 nt, Homo sapiens
ucaagucauuccacacauuuc

SEQ ID NO: 953721 - RNA, 13 nt, Homo sapiens
ucaaguugugaua

SEQ ID NO: 953722 - RNA, 19 nt, Homo sapiens
ucaauaauuauuugucuca

SEQ ID NO: 953723 - RNA, 22 nt, Homo sapiens
ucaauacuuuuguguauucugu

SEQ ID NO: 953724 - RNA, 20 nt, Homo sapiens
ucaauggugagaaacauuau

SEQ ID NO: 953725 - RNA, 18 nt, Homo sapiens
ucaauuacaggaaguacu

SEQ ID NO: 953726 - RNA, 18 nt, Homo sapiens
ucaauuugcgacugcucu

SEQ ID NO: 953727 - RNA, 17 nt, Homo sapiens
ucacaagugaaaacuga

SEQ ID NO: 953728 - RNA, 19 nt, Homo sapiens
ucacaaucaucuucuccca

SEQ ID NO: 953729 - RNA, 13 nt, Homo sapiens
ucacacacaugca

SEQ ID NO: 953730 - RNA, 19 nt, Homo sapiens
ucacauagguguugucaag

SEQ ID NO: 953731 - RNA, 15 nt, Homo sapiens
ucacaucucuguaga

SEQ ID NO: 953732 - RNA, 22 nt, Homo sapiens
ucacaugaugaauaaauagaug

SEQ ID NO: 953733 - RNA, 13 nt, Homo sapiens
ucacaugugcucu

SEQ ID NO: 953734 - RNA, 13 nt, Homo sapiens
ucaccucuucaca

SEQ ID NO: 953735 - RNA, 14 nt, Homo sapiens
ucaccugggaugac

SEQ ID NO: 953736 - RNA, 15 nt, Homo sapiens
ucacgcucagcacac

SEQ ID NO: 953737 - RNA, 17 nt, Homo sapiens
ucacgcucagcacacau

SEQ ID NO: 953738 - RNA, 15 nt, Homo sapiens
ucacuaagaauauaa

SEQ ID NO: 953739 - RNA, 18 nt, Homo sapiens
ucacuauggucaaaaagu

SEQ ID NO: 953740 - RNA, 19 nt, Homo sapiens
ucacuuucauucaauuugc

SEQ ID NO: 953741 - RNA, 14 nt, Homo sapiens
ucacuuuucagaag

SEQ ID NO: 953742 - RNA, 14 nt, Homo sapiens
ucagaaaagacacu

SEQ ID NO: 953743 - RNA, 22 nt, Homo sapiens
ucagaacacccuguaccaucca

SEQ ID NO: 953744 - RNA, 17 nt, Homo sapiens
ucagaaggguuaacuca

SEQ ID NO: 953745 - RNA, 23 nt, Homo sapiens
ucagaaggguuaacucaacuguc

SEQ ID NO: 953746 - RNA, 22 nt, Homo sapiens
ucagaauugaaccgucaaugug

SEQ ID NO: 953747 - RNA, 21 nt, Homo sapiens
ucagacagaaggguaaugcgu

SEQ ID NO: 953748 - RNA, 20 nt, Homo sapiens
ucagagagcuucaacuacuu

SEQ ID NO: 953749 - RNA, 16 nt, Homo sapiens
ucagagauuagucuua

SEQ ID NO: 953750 - RNA, 21 nt, Homo sapiens
ucagauuccccccaucuccau

SEQ ID NO: 953751 - RNA, 17 nt, Homo sapiens
ucagcaaauuuauauca

SEQ ID NO: 953752 - RNA, 23 nt, Homo sapiens
ucagcacguaguuugcauuccag

SEQ ID NO: 953753 - RNA, 14 nt, Homo sapiens
ucagcucuaaagca

SEQ ID NO: 953754 - RNA, 17 nt, Homo sapiens
ucagcuuauaugugaca

SEQ ID NO: 953755 - RNA, 20 nt, Homo sapiens
ucaggaagccuccugcugag

SEQ ID NO: 953756 - RNA, 19 nt, Homo sapiens
ucaggaccccaucugcuga

SEQ ID NO: 953757 - RNA, 20 nt, Homo sapiens
ucagggggcaugaagcacau

SEQ ID NO: 953758 - RNA, 18 nt, Homo sapiens
ucagguaacucauuuaca

SEQ ID NO: 953759 - RNA, 16 nt, Homo sapiens
ucaguauaaaaccaug

SEQ ID NO: 953760 - RNA, 15 nt, Homo sapiens
ucagucaucaucuca

SEQ ID NO: 953761 - RNA, 17 nt, Homo sapiens
ucaguccaauaaauuau

SEQ ID NO: 953762 - RNA, 12 nt, Homo sapiens
ucagucuugccu

SEQ ID NO: 953763 - RNA, 19 nt, Homo sapiens
ucaguuguggccucauuca

SEQ ID NO: 953764 - RNA, 13 nt, Homo sapiens
acuaccaguaucu

SEQ ID NO: 953765 - RNA, 14 nt, Homo sapiens
acuagaagcacagg

SEQ ID NO: 953766 - RNA, 15 nt, Homo sapiens
acuagcuaucucugu

SEQ ID NO: 953767 - RNA, 19 nt, Homo sapiens
acuaguacuguguacugua

SEQ ID NO: 953768 - RNA, 19 nt, Homo sapiens
acucaagagcccuuccagg

SEQ ID NO: 953769 - RNA, 20 nt, Homo sapiens
acucacaaucaucuucuccc

SEQ ID NO: 953770 - RNA, 14 nt, Homo sapiens
acucagcaccacuc

SEQ ID NO: 953771 - RNA, 19 nt, Homo sapiens
acuccagagucaguaguua

SEQ ID NO: 953772 - RNA, 16 nt, Homo sapiens
acucuuguugugcucu

SEQ ID NO: 953773 - RNA, 19 nt, Homo sapiens
acugaaaccucuguucuca

SEQ ID NO: 953774 - RNA, 17 nt, Homo sapiens
acugaaguauacauuua

SEQ ID NO: 953775 - RNA, 22 nt, Homo sapiens
acugagaagaucaaugaucacc

SEQ ID NO: 953776 - RNA, 17 nt, Homo sapiens
acugauguauagcuuua

SEQ ID NO: 953777 - RNA, 17 nt, Homo sapiens
acugcacacaugcacac

SEQ ID NO: 953778 - RNA, 20 nt, Homo sapiens
acugcaucaagaugugacau

SEQ ID NO: 953779 - RNA, 13 nt, Homo sapiens
acugccaaacagu

SEQ ID NO: 953780 - RNA, 20 nt, Homo sapiens
acugcuccuguggccuucca

SEQ ID NO: 953781 - RNA, 19 nt, Homo sapiens
acugcugugggcugcucac

SEQ ID NO: 953782 - RNA, 20 nt, Homo sapiens
acugcugugggcugcucacu

SEQ ID NO: 953783 - RNA, 20 nt, Homo sapiens
acuggaaauaaccugugaau

SEQ ID NO: 953784 - RNA, 17 nt, Homo sapiens
acuggaacacuaaugag

SEQ ID NO: 953785 - RNA, 21 nt, Homo sapiens
acuggaacacuaaugaggaaa

SEQ ID NO: 953786 - RNA, 20 nt, Homo sapiens
acuguaguaauuguuacaau

SEQ ID NO: 953787 - RNA, 15 nt, Homo sapiens
acuguauagacaguu

SEQ ID NO: 953788 - RNA, 16 nt, Homo sapiens
acuguauguguugcac

SEQ ID NO: 953789 - RNA, 19 nt, Homo sapiens
acuguccaguccagugaug

SEQ ID NO: 953790 - RNA, 22 nt, Homo sapiens
acugucgucuuuuuccaaacaa

SEQ ID NO: 953791 - RNA, 21 nt, Homo sapiens
acugucuuaguacaccauaaa

SEQ ID NO: 953792 - RNA, 20 nt, Homo sapiens
acugugcguuuuagaguaug

SEQ ID NO: 953793 - RNA, 22 nt, Homo sapiens
acuguggccucauuagauuaca

SEQ ID NO: 953794 - RNA, 14 nt, Homo sapiens
acuguguugcccag

SEQ ID NO: 953795 - RNA, 12 nt, Homo sapiens
acuguugccagg

SEQ ID NO: 953796 - RNA, 19 nt, Homo sapiens
acuguuuuggguagcugcc

SEQ ID NO: 953797 - RNA, 19 nt, Homo sapiens
acuuaaaccugugcuuuca

SEQ ID NO: 953798 - RNA, 20 nt, Homo sapiens
acuuaaaccugugcuuucau

SEQ ID NO: 953799 - RNA, 23 nt, Homo sapiens
acuuaaacucaucuauccaggca

SEQ ID NO: 953800 - RNA, 18 nt, Homo sapiens
acuuaauucuguuacaca

SEQ ID NO: 953801 - RNA, 17 nt, Homo sapiens
acuuacugccuuagucc

SEQ ID NO: 953802 - RNA, 20 nt, Homo sapiens
acuuaucaaaucauucaaaa

SEQ ID NO: 953803 - RNA, 21 nt, Homo sapiens
acuuauuucagguuaaauuaa

SEQ ID NO: 953804 - RNA, 16 nt, Homo sapiens
acuucaguucucaucu

SEQ ID NO: 953805 - RNA, 20 nt, Homo sapiens
acuucaguucucaucuugua

SEQ ID NO: 953806 - RNA, 15 nt, Homo sapiens
acuuccuccuagcaa

SEQ ID NO: 953807 - RNA, 13 nt, Homo sapiens
acuuccuuugaga

SEQ ID NO: 953808 - RNA, 13 nt, Homo sapiens
acuucucuagaga

SEQ ID NO: 953809 - RNA, 20 nt, Homo sapiens
acuucuguguugugauuccc

SEQ ID NO: 953810 - RNA, 19 nt, Homo sapiens
acuucuuuauucacaguau

SEQ ID NO: 953811 - RNA, 17 nt, Homo sapiens
acuugacaucaacugca

SEQ ID NO: 953812 - RNA, 19 nt, Homo sapiens
acuugauauaauuacuuaa

SEQ ID NO: 953813 - RNA, 21 nt, Homo sapiens
acuugcccuucuauacuuucu

SEQ ID NO: 953814 - RNA, 13 nt, Homo sapiens
acuugcucagcca

SEQ ID NO: 953815 - RNA, 19 nt, Homo sapiens
acuugguagaguuccuuuc

SEQ ID NO: 953816 - RNA, 13 nt, Homo sapiens
acuuucacaucuc

SEQ ID NO: 953817 - RNA, 14 nt, Homo sapiens
acuuucacaucucu

SEQ ID NO: 953818 - RNA, 18 nt, Homo sapiens
acuuucauucaauuugcg

SEQ ID NO: 953819 - RNA, 16 nt, Homo sapiens
acuuucucacaugugg

SEQ ID NO: 953820 - RNA, 16 nt, Homo sapiens
acuuucuugagcacca

SEQ ID NO: 953821 - RNA, 19 nt, Homo sapiens
acuuuuuguuguucauuau

SEQ ID NO: 953822 - RNA, 15 nt, Homo sapiens
agaaaaaacaccacc

SEQ ID NO: 953823 - RNA, 16 nt, Homo sapiens
agaaaaaggaugcauu

SEQ ID NO: 953824 - RNA, 18 nt, Homo sapiens
agaaaaccuguucaggca

SEQ ID NO: 953825 - RNA, 16 nt, Homo sapiens
agaaaaugcuuucuca

SEQ ID NO: 953826 - RNA, 19 nt, Homo sapiens
agaaaauggacguguuaug

SEQ ID NO: 953827 - RNA, 17 nt, Homo sapiens
agaaacacguggucaug

SEQ ID NO: 953828 - RNA, 13 nt, Homo sapiens
agaaaccucggaa

SEQ ID NO: 953829 - RNA, 20 nt, Homo sapiens
agaaacgagauuugccaaaa

SEQ ID NO: 953830 - RNA, 12 nt, Homo sapiens
agaaacuuccuu

SEQ ID NO: 953831 - RNA, 17 nt, Homo sapiens
agaaacuuccuuugaga

SEQ ID NO: 953832 - RNA, 17 nt, Homo sapiens
agaaauuuucuacagua

SEQ ID NO: 953833 - RNA, 15 nt, Homo sapiens
agaaccgugaacugg

SEQ ID NO: 953834 - RNA, 18 nt, Homo sapiens
agaaccuuuugagugccu

SEQ ID NO: 953835 - RNA, 21 nt, Homo sapiens
agaacguacuuucuguuauca

SEQ ID NO: 953836 - RNA, 17 nt, Homo sapiens
agaacuguucauuucca

SEQ ID NO: 953837 - RNA, 14 nt, Homo sapiens
agaagaaacuaccc

SEQ ID NO: 953838 - RNA, 22 nt, Homo sapiens
agaagcuccauggacgugucug

SEQ ID NO: 953839 - RNA, 14 nt, Homo sapiens
agaauagaaaacug

SEQ ID NO: 953840 - RNA, 20 nt, Homo sapiens
agaaucuccauuucugcuca

SEQ ID NO: 953841 - RNA, 14 nt, Homo sapiens
agaaugaaaacaau

SEQ ID NO: 953842 - RNA, 21 nt, Homo sapiens
agaaugagaacauccaucuac

SEQ ID NO: 953843 - RNA, 21 nt, Homo sapiens
agaaugagaccuggagucaug

SEQ ID NO: 953844 - RNA, 14 nt, Homo sapiens
agaaugcuucaagu

SEQ ID NO: 953845 - RNA, 23 nt, Homo sapiens
accugagggaaucaauggcuuuu

SEQ ID NO: 953846 - RNA, 18 nt, Homo sapiens
accugauuuccauuugca

SEQ ID NO: 953847 - RNA, 13 nt, Homo sapiens
accugcauucaac

SEQ ID NO: 953848 - RNA, 23 nt, Homo sapiens
accugcugagccagauuccccag

SEQ ID NO: 953849 - RNA, 18 nt, Homo sapiens
accuggaggcuggaccaa

SEQ ID NO: 953850 - RNA, 21 nt, Homo sapiens
accuggcuugaagcugcucac

SEQ ID NO: 953851 - RNA, 15 nt, Homo sapiens
accuguaaucccagc

SEQ ID NO: 953852 - RNA, 14 nt, Homo sapiens
accugucucagcug

SEQ ID NO: 953853 - RNA, 14 nt, Homo sapiens
accugugcuuucau

SEQ ID NO: 953854 - RNA, 22 nt, Homo sapiens
accuguucuuccuaccaaauau

SEQ ID NO: 953855 - RNA, 21 nt, Homo sapiens
accuuucaggaaaguaucucu

SEQ ID NO: 953856 - RNA, 17 nt, Homo sapiens
accuuugggacuaagcu

SEQ ID NO: 953857 - RNA, 14 nt, Homo sapiens
accuuuuacaaaag

SEQ ID NO: 953858 - RNA, 18 nt, Homo sapiens
accuuuuugaacauguau

SEQ ID NO: 953859 - RNA, 13 nt, Homo sapiens
acgccuccaucca

SEQ ID NO: 953860 - RNA, 16 nt, Homo sapiens
acgcgugcaugcacac

SEQ ID NO: 953861 - RNA, 18 nt, Homo sapiens
acgugcucuucuguucuc

SEQ ID NO: 953862 - RNA, 20 nt, Homo sapiens
acguggcaccuccucggcug

SEQ ID NO: 953863 - RNA, 16 nt, Homo sapiens
acuaauuuauaaucca

SEQ ID NO: 953864 - RNA, 18 nt, Homo sapiens
acuagaugccaaugacau

SEQ ID NO: 953865 - RNA, 22 nt, Homo sapiens
acuaguguucagaauguagcau

SEQ ID NO: 953866 - RNA, 21 nt, Homo sapiens
acuaucauugcccucuucaag

SEQ ID NO: 953867 - RNA, 18 nt, Homo sapiens
acuauuuagauaacaaga

SEQ ID NO: 953868 - RNA, 14 nt, Homo sapiens
acucaaugcaugau

SEQ ID NO: 953869 - RNA, 21 nt, Homo sapiens
acucacauagagguugagcca

SEQ ID NO: 953870 - RNA, 14 nt, Homo sapiens
acucaccaaaauau

SEQ ID NO: 953871 - RNA, 14 nt, Homo sapiens
acucaucuauccag

SEQ ID NO: 953872 - RNA, 14 nt, Homo sapiens
acucugugaucuaa

SEQ ID NO: 953873 - RNA, 17 nt, Homo sapiens
acucuuguugugcucuu

SEQ ID NO: 953874 - RNA, 20 nt, Homo sapiens
acugaagggcuuuggcuuua

SEQ ID NO: 953875 - RNA, 16 nt, Homo sapiens
acugaaguuaucaucc

SEQ ID NO: 953876 - RNA, 20 nt, Homo sapiens
acugaugagauacauuugau

SEQ ID NO: 953877 - RNA, 18 nt, Homo sapiens
acugcagccucgaccucc

SEQ ID NO: 953878 - RNA, 13 nt, Homo sapiens
acugccaaccucg

SEQ ID NO: 953879 - RNA, 22 nt, Homo sapiens
acugccugcagcugagauucca

SEQ ID NO: 953880 - RNA, 23 nt, Homo sapiens
acugccugcagcugagauuccag

SEQ ID NO: 953881 - RNA, 19 nt, Homo sapiens
acugcgccaucaacuccag

SEQ ID NO: 953882 - RNA, 22 nt, Homo sapiens
acuggguggauuauaaacaaca

SEQ ID NO: 953883 - RNA, 17 nt, Homo sapiens
acuggguggcacugcug

SEQ ID NO: 953884 - RNA, 17 nt, Homo sapiens
acuguccaguccaguga

SEQ ID NO: 953885 - RNA, 14 nt, Homo sapiens
acugucccacaaaa

SEQ ID NO: 953886 - RNA, 18 nt, Homo sapiens
acugucuucaacccugcc

SEQ ID NO: 953887 - RNA, 13 nt, Homo sapiens
acugucuuuacaa

SEQ ID NO: 953888 - RNA, 21 nt, Homo sapiens
acugugcuggagaauuccagu

SEQ ID NO: 953889 - RNA, 21 nt, Homo sapiens
acuguuaagaauagaaaacug

SEQ ID NO: 953890 - RNA, 14 nt, Homo sapiens
acuguuaaucaugg

SEQ ID NO: 953891 - RNA, 17 nt, Homo sapiens
acuguuaaucauggguu

SEQ ID NO: 953892 - RNA, 18 nt, Homo sapiens
acuguucgaguagcucag

SEQ ID NO: 953893 - RNA, 17 nt, Homo sapiens
acuguucuuugcaguga

SEQ ID NO: 953894 - RNA, 15 nt, Homo sapiens
acuguuuucaucaca

SEQ ID NO: 953895 - RNA, 16 nt, Homo sapiens
acuuaaaccugugcuu

SEQ ID NO: 953896 - RNA, 20 nt, Homo sapiens
acuuaaacucaucuauccag

SEQ ID NO: 953897 - RNA, 22 nt, Homo sapiens
acuuagagcacuagaagcacag

SEQ ID NO: 953898 - RNA, 13 nt, Homo sapiens
acuucacuuucau

SEQ ID NO: 953899 - RNA, 18 nt, Homo sapiens
acuucuaaauuauaccau

SEQ ID NO: 953900 - RNA, 20 nt, Homo sapiens
acuucuuuauucacaguauc

SEQ ID NO: 953901 - RNA, 22 nt, Homo sapiens
acuugaacaaaaucuguugcca

SEQ ID NO: 953902 - RNA, 18 nt, Homo sapiens
acuuguacuuacacugaa

SEQ ID NO: 953903 - RNA, 19 nt, Homo sapiens
uuagauuuuucucaucucc

SEQ ID NO: 953904 - RNA, 20 nt, Homo sapiens
uuagcacaaagaugugcaaa

SEQ ID NO: 953905 - RNA, 16 nt, Homo sapiens
uuagcccauaaucucu

SEQ ID NO: 953906 - RNA, 21 nt, Homo sapiens
uuagguuuccacguaagucac

SEQ ID NO: 953907 - RNA, 18 nt, Homo sapiens
uuagugccucccagaaca

SEQ ID NO: 953908 - RNA, 19 nt, Homo sapiens
uuauaacaggaauaagcaa

SEQ ID NO: 953909 - RNA, 15 nt, Homo sapiens
uuauacuucuuuauu

SEQ ID NO: 953910 - RNA, 22 nt, Homo sapiens
uuauauacaaagcugucacuca

SEQ ID NO: 953911 - RNA, 13 nt, Homo sapiens
uuauaugugacac

SEQ ID NO: 953912 - RNA, 17 nt, Homo sapiens
uuauaugugacacugca

SEQ ID NO: 953913 - RNA, 15 nt, Homo sapiens
uuaucaaaucauuca

SEQ ID NO: 953914 - RNA, 13 nt, Homo sapiens
uuaucaacaugca

SEQ ID NO: 953915 - RNA, 17 nt, Homo sapiens
uuaucaagcuaccagcu

SEQ ID NO: 953916 - RNA, 13 nt, Homo sapiens
uuauccauguacu

SEQ ID NO: 953917 - RNA, 15 nt, Homo sapiens
uuauccauguacuuu

SEQ ID NO: 953918 - RNA, 16 nt, Homo sapiens
uuauccugugugauua

SEQ ID NO: 953919 - RNA, 17 nt, Homo sapiens
uuaucuguguugucucu

SEQ ID NO: 953920 - RNA, 11 nt, Homo sapiens
uuaugaaucuc

SEQ ID NO: 953921 - RNA, 15 nt, Homo sapiens
uuaugauaaccaaga

SEQ ID NO: 953922 - RNA, 20 nt, Homo sapiens
uuauguucaucuucaaaaaa

SEQ ID NO: 953923 - RNA, 22 nt, Homo sapiens
uuauucauguguacagaaacaa

SEQ ID NO: 953924 - RNA, 18 nt, Homo sapiens
uuauucuuccaaguucau

SEQ ID NO: 953925 - RNA, 16 nt, Homo sapiens
uuauugucaacuugaa

SEQ ID NO: 953926 - RNA, 14 nt, Homo sapiens
uuauuuugauugau

SEQ ID NO: 953927 - RNA, 16 nt, Homo sapiens
uucaaccaacuguaau

SEQ ID NO: 953928 - RNA, 21 nt, Homo sapiens
uucaaccaacuguaaugcagg

SEQ ID NO: 953929 - RNA, 15 nt, Homo sapiens
uucacagauggaauc

SEQ ID NO: 953930 - RNA, 23 nt, Homo sapiens
uucacaucucuguagauacaggg

SEQ ID NO: 953931 - RNA, 21 nt, Homo sapiens
uucaguuguggccucauucag

SEQ ID NO: 953932 - RNA, 13 nt, Homo sapiens
uucauguguacag

SEQ ID NO: 953933 - RNA, 17 nt, Homo sapiens
uucauucacaguuugau

SEQ ID NO: 953934 - RNA, 14 nt, Homo sapiens
uucauucauacuca

SEQ ID NO: 953935 - RNA, 15 nt, Homo sapiens
uucauuuucacauuu

SEQ ID NO: 953936 - RNA, 18 nt, Homo sapiens
uuccacuucucuagagaa

SEQ ID NO: 953937 - RNA, 14 nt, Homo sapiens
uuccauaugcucuu

SEQ ID NO: 953938 - RNA, 19 nt, Homo sapiens
uuccaucuguuugauacag

SEQ ID NO: 953939 - RNA, 14 nt, Homo sapiens
uuccauuugcaaca

SEQ ID NO: 953940 - RNA, 15 nt, Homo sapiens
uuccauuugcaacag

SEQ ID NO: 953941 - RNA, 19 nt, Homo sapiens
uucccucuggcacuccaga

SEQ ID NO: 953942 - RNA, 18 nt, Homo sapiens
uucccuguguacccucca

SEQ ID NO: 953943 - RNA, 19 nt, Homo sapiens
uuccguuuuagaaaaggaa

SEQ ID NO: 953944 - RNA, 12 nt, Homo sapiens
uuccucacauuc

SEQ ID NO: 953945 - RNA, 19 nt, Homo sapiens
uuccugaauuggaaaggaa

SEQ ID NO: 953946 - RNA, 17 nt, Homo sapiens
uuccuuugggagcucau

SEQ ID NO: 953947 - RNA, 18 nt, Homo sapiens
uucgaggagauaaacuga

SEQ ID NO: 953948 - RNA, 20 nt, Homo sapiens
uucgcuggcugaucauugca

SEQ ID NO: 953949 - RNA, 12 nt, Homo sapiens
uucgucugccag

SEQ ID NO: 953950 - RNA, 18 nt, Homo sapiens
uucuaaggagcacuagaa

SEQ ID NO: 953951 - RNA, 12 nt, Homo sapiens
uucuacaguaca

SEQ ID NO: 953952 - RNA, 14 nt, Homo sapiens
uucuagcaguaugu

SEQ ID NO: 953953 - RNA, 16 nt, Homo sapiens
uucuauguagaacugu

SEQ ID NO: 953954 - RNA, 19 nt, Homo sapiens
uucuauguccaaaccuggu

SEQ ID NO: 953955 - RNA, 13 nt, Homo sapiens
uucucagccuuag

SEQ ID NO: 953956 - RNA, 17 nt, Homo sapiens
uucucauuuagcauuga

SEQ ID NO: 953957 - RNA, 15 nt, Homo sapiens
uucuccaugucugua

SEQ ID NO: 953958 - RNA, 13 nt, Homo sapiens
uucugagugaaug

SEQ ID NO: 953959 - RNA, 19 nt, Homo sapiens
uucugggaagaaaguagga

SEQ ID NO: 953960 - RNA, 16 nt, Homo sapiens
uucuuacuuuccugaa

SEQ ID NO: 953961 - RNA, 17 nt, Homo sapiens
uucuuaucacacuugca

SEQ ID NO: 953962 - RNA, 19 nt, Homo sapiens
uucuuauuuagcccauaau

SEQ ID NO: 953963 - RNA, 17 nt, Homo sapiens
uucuugcuuugaaugca

SEQ ID NO: 953964 - RNA, 18 nt, Homo sapiens
uucuuuccuucccaauag

SEQ ID NO: 953965 - RNA, 21 nt, Homo sapiens
uugaaagaagucaaaugaaug

SEQ ID NO: 953966 - RNA, 15 nt, Homo sapiens
uugaaccugugcaau

SEQ ID NO: 953967 - RNA, 23 nt, Homo sapiens
uugaagacuuuucuuucagccaa

SEQ ID NO: 953968 - RNA, 16 nt, Homo sapiens
uugaagauuagcuuuu

SEQ ID NO: 953969 - RNA, 17 nt, Homo sapiens
uugaagauuagcuuuua

SEQ ID NO: 953970 - RNA, 18 nt, Homo sapiens
uugaagcucaacuguugc

SEQ ID NO: 953971 - RNA, 15 nt, Homo sapiens
uugaagucuuguaua

SEQ ID NO: 953972 - RNA, 12 nt, Homo sapiens
uugaauugucaa

SEQ ID NO: 953973 - RNA, 19 nt, Homo sapiens
uugacaauuugccauagca

SEQ ID NO: 953974 - RNA, 14 nt, Homo sapiens
uugacucagcacug

SEQ ID NO: 953975 - RNA, 14 nt, Homo sapiens
uugagaaacccaag

SEQ ID NO: 953976 - RNA, 19 nt, Homo sapiens
uugagacugcuagaaccaa

SEQ ID NO: 953977 - RNA, 19 nt, Homo sapiens
uugagcaagucccaucuca

SEQ ID NO: 953978 - RNA, 15 nt, Homo sapiens
uugaucagacauuca

SEQ ID NO: 953979 - RNA, 17 nt, Homo sapiens
uugaugagaauccugac

SEQ ID NO: 953980 - RNA, 14 nt, Homo sapiens
uugauugcacuuga

SEQ ID NO: 953981 - RNA, 15 nt, Homo sapiens
uugcaaagcauuuga

SEQ ID NO: 953982 - RNA, 21 nt, Homo sapiens
uugcaaauuauucuagucaac

SEQ ID NO: 953983 - RNA, 20 nt, Homo sapiens
uugcacuccagccugggcaa

SEQ ID NO: 953984 - RNA, 11 nt, Homo sapiens
uugccaaaaac

SEQ ID NO: 953985 - RNA, 18 nt, Homo sapiens
uugcccaggcuggucuca

SEQ ID NO: 953986 - RNA, 17 nt, Homo sapiens
uugcccaguucauccca

SEQ ID NO: 953987 - RNA, 15 nt, Homo sapiens
uugcucugauagaca

SEQ ID NO: 953988 - RNA, 21 nt, Homo sapiens
uugcuuccuuugggagcucau

SEQ ID NO: 953989 - RNA, 15 nt, Homo sapiens
uuggaaucaugcaaa

SEQ ID NO: 953990 - RNA, 12 nt, Homo sapiens
uuggaccugcug

SEQ ID NO: 953991 - RNA, 16 nt, Homo sapiens
uuggaucuggcauuga

SEQ ID NO: 953992 - RNA, 15 nt, Homo sapiens
uuggccaaugugcau

SEQ ID NO: 953993 - RNA, 17 nt, Homo sapiens
uugggaaagcucuuguc

SEQ ID NO: 953994 - RNA, 23 nt, Homo sapiens
uuggggacagauucagucuugcc

SEQ ID NO: 953995 - RNA, 16 nt, Homo sapiens
uugggguugguuccua

SEQ ID NO: 953996 - RNA, 14 nt, Homo sapiens
uugggucucucaua

SEQ ID NO: 953997 - RNA, 15 nt, Homo sapiens
uuggugcucaauaaa

SEQ ID NO: 953998 - RNA, 14 nt, Homo sapiens
uugguggggccauc

SEQ ID NO: 953999 - RNA, 16 nt, Homo sapiens
uuguacagacaacaaa

SEQ ID NO: 954000 - RNA, 13 nt, Homo sapiens
uuguacuugaaua

SEQ ID NO: 954001 - RNA, 15 nt, Homo sapiens
uuguaugacauauua

SEQ ID NO: 954002 - RNA, 22 nt, Homo sapiens
uuguauuuuaauaaagauucca

SEQ ID NO: 954003 - RNA, 23 nt, Homo sapiens
uugucucagccgagcccagggga

SEQ ID NO: 954004 - RNA, 15 nt, Homo sapiens
uugugaccacaggcu

SEQ ID NO: 954005 - RNA, 23 nt, Homo sapiens
uuguggcugauuucaaaugcagu

SEQ ID NO: 954006 - RNA, 22 nt, Homo sapiens
uuguguaucuguuuacauccag

SEQ ID NO: 954007 - RNA, 19 nt, Homo sapiens
uuguugaaacaaaacugga

SEQ ID NO: 954008 - RNA, 12 nt, Homo sapiens
uuguuguucacg

SEQ ID NO: 954009 - RNA, 15 nt, Homo sapiens
uuuaaaaaauaacau

SEQ ID NO: 954010 - RNA, 23 nt, Homo sapiens
uuuaaacuaugugggucugugaa

SEQ ID NO: 954011 - RNA, 21 nt, Homo sapiens
uuuaaacuucaggccagaacc

SEQ ID NO: 954012 - RNA, 22 nt, Homo sapiens
uuuaacgacagaagguugccag

SEQ ID NO: 954013 - RNA, 17 nt, Homo sapiens
uuuacagauaaccuaaa

SEQ ID NO: 954014 - RNA, 20 nt, Homo sapiens
uuuaccaaucaacagcaugu

SEQ ID NO: 954015 - RNA, 22 nt, Homo sapiens
uuuacugggucuaaagggcuau

SEQ ID NO: 954016 - RNA, 19 nt, Homo sapiens
uuuacugucuguaagagaa

SEQ ID NO: 954017 - RNA, 15 nt, Homo sapiens
uuuagaguaugcaag

SEQ ID NO: 954018 - RNA, 16 nt, Homo sapiens
uuuagccagaauguuu

SEQ ID NO: 954019 - RNA, 13 nt, Homo sapiens
uuuauauaugaag

SEQ ID NO: 954020 - RNA, 22 nt, Homo sapiens
uuuaucacuugccgugucaucc

SEQ ID NO: 954021 - RNA, 15 nt, Homo sapiens
uuuaugaaguuaaca

SEQ ID NO: 954022 - RNA, 15 nt, Homo sapiens
uuuauguccuauguu

SEQ ID NO: 954023 - RNA, 13 nt, Homo sapiens
uuucaacauauga

SEQ ID NO: 954024 - RNA, 22 nt, Homo sapiens
uuucaauggugagaaacauuau

SEQ ID NO: 954025 - RNA, 11 nt, Homo sapiens
uuucacaaagg

SEQ ID NO: 954026 - RNA, 12 nt, Homo sapiens
uuucacacugug

SEQ ID NO: 954027 - RNA, 21 nt, Homo sapiens
uuucagaauauuuucaaaaua

SEQ ID NO: 954028 - RNA, 19 nt, Homo sapiens
uuucauuaguagcuaggug

SEQ ID NO: 954029 - RNA, 10 nt, Homo sapiens
uuuccaccuu

SEQ ID NO: 954030 - RNA, 18 nt, Homo sapiens
uuuccaggggccucccaa

SEQ ID NO: 954031 - RNA, 18 nt, Homo sapiens
uuuccauuuauuuauuca

SEQ ID NO: 954032 - RNA, 18 nt, Homo sapiens
uuucccgcuccaagagaa

SEQ ID NO: 954033 - RNA, 22 nt, Homo sapiens
uuucccuguguacccuccaugu

SEQ ID NO: 954034 - RNA, 16 nt, Homo sapiens
uuuccuccacauucau

SEQ ID NO: 954035 - RNA, 15 nt, Homo sapiens
uuuccugugcaaaaa

SEQ ID NO: 954036 - RNA, 14 nt, Homo sapiens
uuuccuucccaaua

SEQ ID NO: 954037 - RNA, 15 nt, Homo sapiens
uuucucgaguccaaa

SEQ ID NO: 954038 - RNA, 17 nt, Homo sapiens
uuucucuucccaugcaa

SEQ ID NO: 954039 - RNA, 18 nt, Homo sapiens
uuucuucccccccaagau

SEQ ID NO: 954040 - RNA, 22 nt, Homo sapiens
uuugaagcucaacuguugccag

SEQ ID NO: 954041 - RNA, 15 nt, Homo sapiens
uuugccaccucuaaa

SEQ ID NO: 954042 - RNA, 22 nt, Homo sapiens
uuugcccugucuaauuuugccc

SEQ ID NO: 954043 - RNA, 22 nt, Homo sapiens
uuugcgacugcucugauggcac

SEQ ID NO: 954044 - RNA, 17 nt, Homo sapiens
uuugcuuuacagcacug

SEQ ID NO: 954045 - RNA, 21 nt, Homo sapiens
uuugggucucucauaccucug

SEQ ID NO: 954046 - RNA, 14 nt, Homo sapiens
uuuggugaggaccu

SEQ ID NO: 954047 - RNA, 19 nt, Homo sapiens
uuuguagauguauuuucaa

SEQ ID NO: 954048 - RNA, 13 nt, Homo sapiens
uuugucaguauaa

SEQ ID NO: 954049 - RNA, 21 nt, Homo sapiens
uuuguuguuguuuuuccucaa

SEQ ID NO: 954050 - RNA, 16 nt, Homo sapiens
uuuuaugaacuggaga

SEQ ID NO: 954051 - RNA, 19 nt, Homo sapiens
uuuucaccugaaacacuuu

SEQ ID NO: 954052 - RNA, 18 nt, Homo sapiens
uuuucagugcuuugcccu

SEQ ID NO: 954053 - RNA, 22 nt, Homo sapiens
uuuuccauuuauuuauucaugu

SEQ ID NO: 954054 - RNA, 19 nt, Homo sapiens
uuuucgccaaggcucacau

SEQ ID NO: 954055 - RNA, 13 nt, Homo sapiens
uuuucucaucucc

SEQ ID NO: 954056 - RNA, 15 nt, Homo sapiens
uuuucugaauucaua

SEQ ID NO: 954057 - RNA, 20 nt, Homo sapiens
uuuucugcuaccugguuuuc

SEQ ID NO: 954058 - RNA, 14 nt, Homo sapiens
uuuugaauugucaa

SEQ ID NO: 954059 - RNA, 22 nt, Homo sapiens
uuuugcauuucucuuccuaaau

SEQ ID NO: 954060 - RNA, 15 nt, Homo sapiens
uuuugcucugcucug

SEQ ID NO: 954061 - RNA, 18 nt, Homo sapiens
uuuuggaauaaacugucu

SEQ ID NO: 954062 - RNA, 16 nt, Homo sapiens
uuuuguaucaccucuu

SEQ ID NO: 954063 - RNA, 14 nt, Homo sapiens
uuuuuaaacuaugu

SEQ ID NO: 954064 - RNA, 14 nt, Homo sapiens
uuuuuaacuuaucu

SEQ ID NO: 954065 - RNA, 14 nt, Homo sapiens
cauacucugugcaa

SEQ ID NO: 954066 - RNA, 20 nt, Homo sapiens
cauagaacugucccacaaaa

SEQ ID NO: 954067 - RNA, 16 nt, Homo sapiens
cauagaauaguauucu

SEQ ID NO: 954068 - RNA, 13 nt, Homo sapiens
cauagcagugcua

SEQ ID NO: 954069 - RNA, 15 nt, Homo sapiens
cauagcagugcuagg

SEQ ID NO: 954070 - RNA, 18 nt, Homo sapiens
cauauuacaacacuuuaa

SEQ ID NO: 954071 - RNA, 14 nt, Homo sapiens
caucacacucucca

SEQ ID NO: 954072 - RNA, 18 nt, Homo sapiens
caucacuuucauucaauu

SEQ ID NO: 954073 - RNA, 22 nt, Homo sapiens
caucagggggcaugaagcacau

SEQ ID NO: 954074 - RNA, 13 nt, Homo sapiens
caucagugaaaga

SEQ ID NO: 954075 - RNA, 16 nt, Homo sapiens
caucaugaugcucaug

SEQ ID NO: 954076 - RNA, 22 nt, Homo sapiens
caucauggagggagaagaaaga

SEQ ID NO: 954077 - RNA, 14 nt, Homo sapiens
cauccacacccucu

SEQ ID NO: 954078 - RNA, 16 nt, Homo sapiens
cauccaguaucuugaa

SEQ ID NO: 954079 - RNA, 16 nt, Homo sapiens
cauccucugcuuguca

SEQ ID NO: 954080 - RNA, 21 nt, Homo sapiens
caucgguucaggaggagacag

SEQ ID NO: 954081 - RNA, 19 nt, Homo sapiens
caucuaagucaguuucaca

SEQ ID NO: 954082 - RNA, 15 nt, Homo sapiens
gcuaugcuauggaau

SEQ ID NO: 954083 - RNA, 23 nt, Homo sapiens
gcuaugcuauggaauauacaugu

SEQ ID NO: 954084 - RNA, 15 nt, Homo sapiens
caaguacuugagaau

SEQ ID NO: 954085 - RNA, 21 nt, Homo sapiens
caaguagcugggaccacaagu

SEQ ID NO: 954086 - RNA, 20 nt, Homo sapiens
caaguauuuuaucuguguug

SEQ ID NO: 954087 - RNA, 16 nt, Homo sapiens
caagucaucuggauga

SEQ ID NO: 954088 - RNA, 22 nt, Homo sapiens
caagugugcauuaccacacuca

SEQ ID NO: 954089 - RNA, 20 nt, Homo sapiens
caauaaaagugucacuaaga

SEQ ID NO: 954090 - RNA, 22 nt, Homo sapiens
caauaaggggagaguaacccug

SEQ ID NO: 954091 - RNA, 15 nt, Homo sapiens
caauagaauaccucc

SEQ ID NO: 954092 - RNA, 15 nt, Homo sapiens
caaucaucuuaacuu

SEQ ID NO: 954093 - RNA, 19 nt, Homo sapiens
caaugauguaaauauuuca

SEQ ID NO: 954094 - RNA, 13 nt, Homo sapiens
caaugcaugauga

SEQ ID NO: 954095 - RNA, 14 nt, Homo sapiens
caauuaaugauuca

SEQ ID NO: 954096 - RNA, 23 nt, Homo sapiens
caauuauuucagucaucaucuca

SEQ ID NO: 954097 - RNA, 13 nt, Homo sapiens
caauuauuuugca

SEQ ID NO: 954098 - RNA, 13 nt, Homo sapiens
caauucaguccug

SEQ ID NO: 954099 - RNA, 16 nt, Homo sapiens
caauuccaacuuucag

SEQ ID NO: 954100 - RNA, 19 nt, Homo sapiens
caauucugauuccaaauaa

SEQ ID NO: 954101 - RNA, 14 nt, Homo sapiens
caauugaacugcuu

SEQ ID NO: 954102 - RNA, 16 nt, Homo sapiens
caauuugccauagcag

SEQ ID NO: 954103 - RNA, 15 nt, Homo sapiens
acaggcuucgucuca

SEQ ID NO: 954104 - RNA, 15 nt, Homo sapiens
acaguguuuggacag

SEQ ID NO: 954105 - RNA, 19 nt, Homo sapiens
acauacacaagugcacaga

SEQ ID NO: 954106 - RNA, 16 nt, Homo sapiens
acauauacaucuagca

SEQ ID NO: 954107 - RNA, 14 nt, Homo sapiens
acauauaucugaug

SEQ ID NO: 954108 - RNA, 14 nt, Homo sapiens
acaucaacauuccc

SEQ ID NO: 954109 - RNA, 13 nt, Homo sapiens
acaucaacugcau

SEQ ID NO: 954110 - RNA, 13 nt, Homo sapiens
acauccugugaug

SEQ ID NO: 954111 - RNA, 22 nt, Homo sapiens
acaugagaagaagcacgaagca

SEQ ID NO: 954112 - RNA, 15 nt, Homo sapiens
acaugagacuuuccg

SEQ ID NO: 954113 - RNA, 17 nt, Homo sapiens
acaugcacagcuaacau

SEQ ID NO: 954114 - RNA, 21 nt, Homo sapiens
acaugugcucucgggugcccu

SEQ ID NO: 954115 - RNA, 23 nt, Homo sapiens
acauuagaugaaguuacuguuga

SEQ ID NO: 954116 - RNA, 13 nt, Homo sapiens
acauuaggcugug

SEQ ID NO: 954117 - RNA, 14 nt, Homo sapiens
acauuauccugugu

SEQ ID NO: 954118 - RNA, 18 nt, Homo sapiens
acauuucuaacuaaggac

SEQ ID NO: 954119 - RNA, 14 nt, Homo sapiens
accaaccacugcga

SEQ ID NO: 954120 - RNA, 13 nt, Homo sapiens
accaaucaucuua

SEQ ID NO: 954121 - RNA, 14 nt, Homo sapiens
accaaucucuguga

SEQ ID NO: 954122 - RNA, 17 nt, Homo sapiens
accacaagaaggaugau

SEQ ID NO: 954123 - RNA, 19 nt, Homo sapiens
accacuuucaccugggaug

SEQ ID NO: 954124 - RNA, 19 nt, Homo sapiens
accacuuugucucugagaa

SEQ ID NO: 954125 - RNA, 20 nt, Homo sapiens
accagcagaaaaccuguuca

SEQ ID NO: 954126 - RNA, 14 nt, Homo sapiens
accagcugccaaaa

SEQ ID NO: 954127 - RNA, 21 nt, Homo sapiens
accagcuuguccaacaacucc

SEQ ID NO: 954128 - RNA, 21 nt, Homo sapiens
accaggcaggcacgugcacau

SEQ ID NO: 954129 - RNA, 18 nt, Homo sapiens
accagggcucacccacug

SEQ ID NO: 954130 - RNA, 19 nt, Homo sapiens
accagguaguuuguugcau

SEQ ID NO: 954131 - RNA, 21 nt, Homo sapiens
accauauggaaugccaaaauu

SEQ ID NO: 954132 - RNA, 20 nt, Homo sapiens
accaucuggcagacuuacaa

SEQ ID NO: 954133 - RNA, 21 nt, Homo sapiens
accaucuggcagacuuacaaa

SEQ ID NO: 954134 - RNA, 17 nt, Homo sapiens
accaugagaaaucaugc

SEQ ID NO: 954135 - RNA, 13 nt, Homo sapiens
accaugcauuucu

SEQ ID NO: 954136 - RNA, 17 nt, Homo sapiens
accauggcauaaagcug

SEQ ID NO: 954137 - RNA, 15 nt, Homo sapiens
accauguaaagucau

SEQ ID NO: 954138 - RNA, 19 nt, Homo sapiens
accauugagacauuugcca

SEQ ID NO: 954139 - RNA, 19 nt, Homo sapiens
acccaagucuugagcaaug

SEQ ID NO: 954140 - RNA, 19 nt, Homo sapiens
acccaggcuggagugcaga

SEQ ID NO: 954141 - RNA, 16 nt, Homo sapiens
acccugaggguuucca

SEQ ID NO: 954142 - RNA, 17 nt, Homo sapiens
acccugaggguuuccac

SEQ ID NO: 954143 - RNA, 21 nt, Homo sapiens
acccugucuaaugaaaccugu

SEQ ID NO: 954144 - RNA, 19 nt, Homo sapiens
accgggcuggccugacaca

SEQ ID NO: 954145 - RNA, 19 nt, Homo sapiens
accucacucagcaccacuc

SEQ ID NO: 954146 - RNA, 20 nt, Homo sapiens
accucucuucugcacagcuc

SEQ ID NO: 954147 - RNA, 16 nt, Homo sapiens
accucuucuucuccaa

SEQ ID NO: 954148 - RNA, 16 nt, Homo sapiens
accugauuuccauuug

SEQ ID NO: 954149 - RNA, 20 nt, Homo sapiens
accuggcuugaagcugcuca

SEQ ID NO: 954150 - RNA, 15 nt, Homo sapiens
accugugcaauauga

SEQ ID NO: 954151 - RNA, 17 nt, Homo sapiens
accuucugaagaucuca

SEQ ID NO: 954152 - RNA, 17 nt, Homo sapiens
accuugcauagugccug

SEQ ID NO: 954153 - RNA, 21 nt, Homo sapiens
accuuguguacuuucuucccu

SEQ ID NO: 954154 - RNA, 21 nt, Homo sapiens
accuuucaugugccugaaggc

SEQ ID NO: 954155 - RNA, 16 nt, Homo sapiens
accuuuuugaacaugu

SEQ ID NO: 954156 - RNA, 12 nt, Homo sapiens
acgaaagcacag

SEQ ID NO: 954157 - RNA, 19 nt, Homo sapiens
acgaggcuuggaccugcug

SEQ ID NO: 954158 - RNA, 19 nt, Homo sapiens
acgcaaaaaauaacuacag

SEQ ID NO: 954159 - RNA, 14 nt, Homo sapiens
acgccuccauccac

SEQ ID NO: 954160 - RNA, 13 nt, Homo sapiens
acgcucucugucu

SEQ ID NO: 954161 - RNA, 16 nt, Homo sapiens
acggccgucccugacu

SEQ ID NO: 954162 - RNA, 13 nt, Homo sapiens
acgguugccugag

SEQ ID NO: 954163 - RNA, 21 nt, Homo sapiens
acguggagagaaguugcccuc

SEQ ID NO: 954164 - RNA, 13 nt, Homo sapiens
acguuugccaaau

SEQ ID NO: 954165 - RNA, 19 nt, Homo sapiens
acuaaccagagucagcaca

SEQ ID NO: 954166 - RNA, 18 nt, Homo sapiens
acuaacugcaaaugcauc

SEQ ID NO: 954167 - RNA, 13 nt, Homo sapiens
acuaagaauauaa

SEQ ID NO: 954168 - RNA, 14 nt, Homo sapiens
acuacaaauguuaa

SEQ ID NO: 954169 - RNA, 23 nt, Homo sapiens
acuacucagccuagcacaggcug

SEQ ID NO: 954170 - RNA, 17 nt, Homo sapiens
acuagcaaacaaaaaua

SEQ ID NO: 954171 - RNA, 19 nt, Homo sapiens
acuauugugaccacaggcu

SEQ ID NO: 954172 - RNA, 20 nt, Homo sapiens
acuauugugaccacaggcug

SEQ ID NO: 954173 - RNA, 18 nt, Homo sapiens
acuauuugauaaugcaua

SEQ ID NO: 954174 - RNA, 15 nt, Homo sapiens
acucaaaucaguaua

SEQ ID NO: 954175 - RNA, 22 nt, Homo sapiens
acucagcaccacucaagaccaa

SEQ ID NO: 954176 - RNA, 11 nt, Homo sapiens
acucagcacug

SEQ ID NO: 954177 - RNA, 18 nt, Homo sapiens
acucagcacuguuuucau

SEQ ID NO: 954178 - RNA, 15 nt, Homo sapiens
acucaguucuuggcc

SEQ ID NO: 954179 - RNA, 16 nt, Homo sapiens
acuccaacauccacuc

SEQ ID NO: 954180 - RNA, 19 nt, Homo sapiens
acuccugaguucaagcaau

SEQ ID NO: 954181 - RNA, 22 nt, Homo sapiens
acucugucauaauuaaaucaua

SEQ ID NO: 954182 - RNA, 12 nt, Homo sapiens
acucugugcaag

SEQ ID NO: 954183 - RNA, 22 nt, Homo sapiens
acucugugcaaggaaauuugca

SEQ ID NO: 954184 - RNA, 20 nt, Homo sapiens
acucuguguaaucucugauu

SEQ ID NO: 954185 - RNA, 14 nt, Homo sapiens
acucuucuuaucac

SEQ ID NO: 954186 - RNA, 23 nt, Homo sapiens
acucuucuuaucacacuugcaaa

SEQ ID NO: 954187 - RNA, 14 nt, Homo sapiens
acucuuggccucaa

SEQ ID NO: 954188 - RNA, 23 nt, Homo sapiens
acucuuugcccaguucaucccaa

SEQ ID NO: 954189 - RNA, 20 nt, Homo sapiens
acugaaaccucuguucucau

SEQ ID NO: 954190 - RNA, 21 nt, Homo sapiens
acugaguguggcgggaagggu

SEQ ID NO: 954191 - RNA, 19 nt, Homo sapiens
acugaugagauacauuuga

SEQ ID NO: 954192 - RNA, 20 nt, Homo sapiens
acugcacacaugguuuccaa

SEQ ID NO: 954193 - RNA, 21 nt, Homo sapiens
acugcauccuguaaggucugu

SEQ ID NO: 954194 - RNA, 20 nt, Homo sapiens
acugcaucuuucucuuccca

SEQ ID NO: 954195 - RNA, 16 nt, Homo sapiens
acugccaaccucgcuc

SEQ ID NO: 954196 - RNA, 19 nt, Homo sapiens
acugcuuuuuugauucuga

SEQ ID NO: 954197 - RNA, 23 nt, Homo sapiens
acuggccucccuuugugugcaua

SEQ ID NO: 954198 - RNA, 14 nt, Homo sapiens
acugggaagcauua

SEQ ID NO: 954199 - RNA, 14 nt, Homo sapiens
acuguaucuaaaaa

SEQ ID NO: 954200 - RNA, 21 nt, Homo sapiens
acugucuuuuuccucaaugaa

SEQ ID NO: 954201 - RNA, 15 nt, Homo sapiens
acuguggccucagga

SEQ ID NO: 954202 - RNA, 17 nt, Homo sapiens
acuguucgaguagcuca

SEQ ID NO: 954203 - RNA, 13 nt, Homo sapiens
acuguuucuugcu

SEQ ID NO: 954204 - RNA, 14 nt, Homo sapiens
acuuaaugugcugc

SEQ ID NO: 954205 - RNA, 17 nt, Homo sapiens
acuuaucaaaucauuca

SEQ ID NO: 954206 - RNA, 17 nt, Homo sapiens
acuucacaaaaugcaag

SEQ ID NO: 954207 - RNA, 13 nt, Homo sapiens
acuugaaggcauu

SEQ ID NO: 954208 - RNA, 14 nt, Homo sapiens
acuugaauuacaac

SEQ ID NO: 954209 - RNA, 14 nt, Homo sapiens
acuugcucagccau

SEQ ID NO: 954210 - RNA, 23 nt, Homo sapiens
acuuuaccucuucuucuccaaag

SEQ ID NO: 954211 - RNA, 18 nt, Homo sapiens
acuuuccuguugcacuga

SEQ ID NO: 954212 - RNA, 19 nt, Homo sapiens
acuuugcuuaagaugcuaa

SEQ ID NO: 954213 - RNA, 15 nt, Homo sapiens
acuuugugagccaaa

SEQ ID NO: 954214 - RNA, 19 nt, Homo sapiens
agaaaaaucauaacucacu

SEQ ID NO: 954215 - RNA, 14 nt, Homo sapiens
agaaaaaugcuguu

SEQ ID NO: 954216 - RNA, 20 nt, Homo sapiens
agaaaaugcuuucucaugca

SEQ ID NO: 954217 - RNA, 14 nt, Homo sapiens
agaaaauguucacu

SEQ ID NO: 954218 - RNA, 18 nt, Homo sapiens
agaaaauuuccuccacau

SEQ ID NO: 954219 - RNA, 15 nt, Homo sapiens
agaaacagaccugca

SEQ ID NO: 954220 - RNA, 14 nt, Homo sapiens
agaaacuaaacuaa

SEQ ID NO: 954221 - RNA, 20 nt, Homo sapiens
agaaauuuucuacaguacau

SEQ ID NO: 954222 - RNA, 23 nt, Homo sapiens
agaacaaaccucuauauguugcu

SEQ ID NO: 954223 - RNA, 16 nt, Homo sapiens
agaacuguggcacuua

SEQ ID NO: 954224 - RNA, 13 nt, Homo sapiens
agaacuguucauu

SEQ ID NO: 954225 - RNA, 16 nt, Homo sapiens
agaacuuuagcuauuu

SEQ ID NO: 954226 - RNA, 20 nt, Homo sapiens
agaagagggguauaggacaa

SEQ ID NO: 954227 - RNA, 21 nt, Homo sapiens
agaagaguagauaagugcuca

SEQ ID NO: 954228 - RNA, 16 nt, Homo sapiens
agaaggcacaggugua

SEQ ID NO: 954229 - RNA, 14 nt, Homo sapiens
agaaggcucuaucu

SEQ ID NO: 954230 - RNA, 19 nt, Homo sapiens
agaaggucucauuaucucc

SEQ ID NO: 954231 - RNA, 15 nt, Homo sapiens
agaauacaacuugau

SEQ ID NO: 954232 - RNA, 20 nt, Homo sapiens
agaauccuugucauuuccuc

SEQ ID NO: 954233 - RNA, 13 nt, Homo sapiens
agaaugacucugg

SEQ ID NO: 954234 - RNA, 22 nt, Homo sapiens
agaaugacucuggaaccauccu

SEQ ID NO: 954235 - RNA, 23 nt, Homo sapiens
auuugaauucaauucugauucca

SEQ ID NO: 954236 - RNA, 17 nt, Homo sapiens
auuugacucagcacugu

SEQ ID NO: 954237 - RNA, 19 nt, Homo sapiens
auuugcacacguccauguu

SEQ ID NO: 954238 - RNA, 13 nt, Homo sapiens
auuugccaaaaac

SEQ ID NO: 954239 - RNA, 12 nt, Homo sapiens
auuuggaaucaa

SEQ ID NO: 954240 - RNA, 14 nt, Homo sapiens
auuuggaccacagc

SEQ ID NO: 954241 - RNA, 18 nt, Homo sapiens
auuuuaauguaaaauuca

SEQ ID NO: 954242 - RNA, 15 nt, Homo sapiens
auuuuagcacaaaga

SEQ ID NO: 954243 - RNA, 16 nt, Homo sapiens
auuuuauaaugucaua

SEQ ID NO: 954244 - RNA, 18 nt, Homo sapiens
auuuucuccaugucugua

SEQ ID NO: 954245 - RNA, 19 nt, Homo sapiens
auuuugggcuggauaaaua

SEQ ID NO: 954246 - RNA, 19 nt, Homo sapiens
auuuuggguggccaaagug

SEQ ID NO: 954247 - RNA, 18 nt, Homo sapiens
auuuuguauaaaugggaa

SEQ ID NO: 954248 - RNA, 14 nt, Homo sapiens
auuuuuaccuuuca

SEQ ID NO: 954249 - RNA, 20 nt, Homo sapiens
auuuuuauuauuaaucucau

SEQ ID NO: 954250 - RNA, 18 nt, Homo sapiens
auuuuucugcaccuuccu

SEQ ID NO: 954251 - RNA, 21 nt, Homo sapiens
auuuuucuuuugucuaaaaaa

SEQ ID NO: 954252 - RNA, 19 nt, Homo sapiens
caaaaaaugugagcuauaa

SEQ ID NO: 954253 - RNA, 23 nt, Homo sapiens
caaaaaugugcugccuagaaaca

SEQ ID NO: 954254 - RNA, 12 nt, Homo sapiens
caaaacuuucag

SEQ ID NO: 954255 - RNA, 20 nt, Homo sapiens
caaaaggcuggaugugcuuu

SEQ ID NO: 954256 - RNA, 15 nt, Homo sapiens
caaaauaaaaugagu

SEQ ID NO: 954257 - RNA, 16 nt, Homo sapiens
caaaauaaaaugaguu

SEQ ID NO: 954258 - RNA, 14 nt, Homo sapiens
caaaauaaauggac

SEQ ID NO: 954259 - RNA, 13 nt, Homo sapiens
caaaaucaguuua

SEQ ID NO: 954260 - RNA, 18 nt, Homo sapiens
caaaaugugauucuaugu

SEQ ID NO: 954261 - RNA, 22 nt, Homo sapiens
caaaauguggggaaaaggcauu

SEQ ID NO: 954262 - RNA, 18 nt, Homo sapiens
caaacacccaagcacaaa

SEQ ID NO: 954263 - RNA, 23 nt, Homo sapiens
caaacacugcuuaaggaaaagag

SEQ ID NO: 954264 - RNA, 21 nt, Homo sapiens
caaacucuuugcccaguucau

SEQ ID NO: 954265 - RNA, 14 nt, Homo sapiens
caaagacuuaauca

SEQ ID NO: 954266 - RNA, 13 nt, Homo sapiens
caaagcagugcau

SEQ ID NO: 954267 - RNA, 18 nt, Homo sapiens
caaagcgugguggacaug

SEQ ID NO: 954268 - RNA, 23 nt, Homo sapiens
caaagcgugguggacaugcacag

SEQ ID NO: 954269 - RNA, 16 nt, Homo sapiens
caaagcuuaugugaca

SEQ ID NO: 954270 - RNA, 17 nt, Homo sapiens
caaagcuugggacaguu

SEQ ID NO: 954271 - RNA, 20 nt, Homo sapiens
caaaggaucuuuguuccucu

SEQ ID NO: 954272 - RNA, 18 nt, Homo sapiens
caaagguauuaguacaau

SEQ ID NO: 954273 - RNA, 16 nt, Homo sapiens
caaauauugcuauugu

SEQ ID NO: 954274 - RNA, 22 nt, Homo sapiens
caaaugaaugagcucucuaaua

SEQ ID NO: 954275 - RNA, 11 nt, Homo sapiens
caaaugcaguc

SEQ ID NO: 954276 - RNA, 15 nt, Homo sapiens
caaauuauucuaguc

SEQ ID NO: 954277 - RNA, 17 nt, Homo sapiens
caacauucccccaacau

SEQ ID NO: 954278 - RNA, 13 nt, Homo sapiens
caaccaaguuaca

SEQ ID NO: 954279 - RNA, 21 nt, Homo sapiens
caaccaauaaaagugucacua

SEQ ID NO: 954280 - RNA, 16 nt, Homo sapiens
caaccagagcacugua

SEQ ID NO: 954281 - RNA, 20 nt, Homo sapiens
caacuacuucucuugcauac

SEQ ID NO: 954282 - RNA, 16 nt, Homo sapiens
caacugagauguuaaa

SEQ ID NO: 954283 - RNA, 14 nt, Homo sapiens
caacugccaaauaa

SEQ ID NO: 954284 - RNA, 15 nt, Homo sapiens
caacuguaaugcagg

SEQ ID NO: 954285 - RNA, 21 nt, Homo sapiens
caacuuaaugugcugcugcuu

SEQ ID NO: 954286 - RNA, 15 nt, Homo sapiens
caacuuaauucuguu

SEQ ID NO: 954287 - RNA, 15 nt, Homo sapiens
caacuuguuuuccca

SEQ ID NO: 954288 - RNA, 21 nt, Homo sapiens
caagaaugucuccauuguuaa

SEQ ID NO: 954289 - RNA, 15 nt, Homo sapiens
caagacugcucccuu

SEQ ID NO: 954290 - RNA, 21 nt, Homo sapiens
caagauaggaagaaaauuucc

SEQ ID NO: 954291 - RNA, 22 nt, Homo sapiens
caagauaggaagaaaauuuccu

SEQ ID NO: 954292 - RNA, 17 nt, Homo sapiens
caaggcucacaugcucc

SEQ ID NO: 954293 - RNA, 22 nt, Homo sapiens
caagggacugaaguauacauuu

SEQ ID NO: 954294 - RNA, 17 nt, Homo sapiens
caaggugaacaccacuu

SEQ ID NO: 954295 - RNA, 14 nt, Homo sapiens
caagugaaaacuga

SEQ ID NO: 954296 - RNA, 16 nt, Homo sapiens
caagugcucuuuccac

SEQ ID NO: 954297 - RNA, 18 nt, Homo sapiens
caauauguaacaugucua

SEQ ID NO: 954298 - RNA, 15 nt, Homo sapiens
caaugacauaccuug

SEQ ID NO: 954299 - RNA, 14 nt, Homo sapiens
caaugacuuuccua

SEQ ID NO: 954300 - RNA, 19 nt, Homo sapiens
caaugacuuuccuagacaa

SEQ ID NO: 954301 - RNA, 22 nt, Homo sapiens
caaugauauaggaaaauacauu

SEQ ID NO: 954302 - RNA, 23 nt, Homo sapiens
caaugaucagacuugauuuacaa

SEQ ID NO: 954303 - RNA, 16 nt, Homo sapiens
caaugccauuuugcua

SEQ ID NO: 954304 - RNA, 15 nt, Homo sapiens
caauuaagcagcuug

SEQ ID NO: 954305 - RNA, 22 nt, Homo sapiens
caauuugucuagcaugcugagu

SEQ ID NO: 954306 - RNA, 13 nt, Homo sapiens
caauuuucauccc

SEQ ID NO: 954307 - RNA, 15 nt, Homo sapiens
caauuuuguuuguga

SEQ ID NO: 954308 - RNA, 13 nt, Homo sapiens
cacaaagaugugc

SEQ ID NO: 954309 - RNA, 15 nt, Homo sapiens
cacaaagaugugcaa

SEQ ID NO: 954310 - RNA, 17 nt, Homo sapiens
cacaacuuuucugcuac

SEQ ID NO: 954311 - RNA, 15 nt, Homo sapiens
cacaaguacuugaga

SEQ ID NO: 954312 - RNA, 13 nt, Homo sapiens
cacaagugcacag

SEQ ID NO: 954313 - RNA, 14 nt, Homo sapiens
cacaagugugcauu

SEQ ID NO: 954314 - RNA, 17 nt, Homo sapiens
cacaauauccaaugaag

SEQ ID NO: 954315 - RNA, 18 nt, Homo sapiens
cacacagcacaugcacac

SEQ ID NO: 954316 - RNA, 19 nt, Homo sapiens
cacacggucuucacaaaga

SEQ ID NO: 954317 - RNA, 18 nt, Homo sapiens
cacacugugcguuuuaga

SEQ ID NO: 954318 - RNA, 22 nt, Homo sapiens
cacagaucacacacaugcacac

SEQ ID NO: 954319 - RNA, 15 nt, Homo sapiens
cacagcuaacaugga

SEQ ID NO: 954320 - RNA, 22 nt, Homo sapiens
cacaggccccaguuauugugaa

SEQ ID NO: 954321 - RNA, 14 nt, Homo sapiens
cacaggugcacaga

SEQ ID NO: 954322 - RNA, 13 nt, Homo sapiens
cacaucucacuuc

SEQ ID NO: 954323 - RNA, 15 nt, Homo sapiens
cacaucucuguagau

SEQ ID NO: 954324 - RNA, 16 nt, Homo sapiens
cacaugguuuccaagg

SEQ ID NO: 954325 - RNA, 12 nt, Homo sapiens
cacaugugcucu

SEQ ID NO: 954326 - RNA, 13 nt, Homo sapiens
cacaugugcucuc

SEQ ID NO: 954327 - RNA, 20 nt, Homo sapiens
cacauuggccgcuucagaca

SEQ ID NO: 954328 - RNA, 13 nt, Homo sapiens
cacauuuccacua

SEQ ID NO: 954329 - RNA, 16 nt, Homo sapiens
caccagguccugugag

SEQ ID NO: 954330 - RNA, 23 nt, Homo sapiens
caccaguauggccccaccugcuc

SEQ ID NO: 954331 - RNA, 17 nt, Homo sapiens
caccaugaagacagggu

SEQ ID NO: 954332 - RNA, 13 nt, Homo sapiens
cacccaagcacaa

SEQ ID NO: 954333 - RNA, 12 nt, Homo sapiens
cacccauucaca

SEQ ID NO: 954334 - RNA, 22 nt, Homo sapiens
caccccuccaugauuccaaggg

SEQ ID NO: 954335 - RNA, 13 nt, Homo sapiens
caccugcucuuuc

SEQ ID NO: 954336 - RNA, 17 nt, Homo sapiens
caccuuguacagaacca

SEQ ID NO: 954337 - RNA, 22 nt, Homo sapiens
cacgaauauugcugauggugca

SEQ ID NO: 954338 - RNA, 20 nt, Homo sapiens
cacggccucuggggagaccg

SEQ ID NO: 954339 - RNA, 19 nt, Homo sapiens
cacgggguuacacuguuaa

SEQ ID NO: 954340 - RNA, 17 nt, Homo sapiens
cacuaacacaugcacac

SEQ ID NO: 954341 - RNA, 18 nt, Homo sapiens
cacuaaccccauucauga

SEQ ID NO: 954342 - RNA, 19 nt, Homo sapiens
cacuaaugaggaaacugca

SEQ ID NO: 954343 - RNA, 16 nt, Homo sapiens
cacuacaaaaagcuag

SEQ ID NO: 954344 - RNA, 13 nt, Homo sapiens
cacuagaugccaa

SEQ ID NO: 954345 - RNA, 22 nt, Homo sapiens
cacuaguuuuuccugugcaaaa

SEQ ID NO: 954346 - RNA, 16 nt, Homo sapiens
cacuauggucaaaaag

SEQ ID NO: 954347 - RNA, 17 nt, Homo sapiens
cacuauggucaaaaagu

SEQ ID NO: 954348 - RNA, 18 nt, Homo sapiens
cacugcacacaugcacac

SEQ ID NO: 954349 - RNA, 14 nt, Homo sapiens
cacugcagcagaaa

SEQ ID NO: 954350 - RNA, 14 nt, Homo sapiens
cacuguauaccccg

SEQ ID NO: 954351 - RNA, 17 nt, Homo sapiens
cacuguauguguugcac

SEQ ID NO: 954352 - RNA, 21 nt, Homo sapiens
cacugucauaaucucuuucca

SEQ ID NO: 954353 - RNA, 17 nt, Homo sapiens
cacuguggagaccacac

SEQ ID NO: 954354 - RNA, 14 nt, Homo sapiens
cacuguuucuugcu

SEQ ID NO: 954355 - RNA, 18 nt, Homo sapiens
cacuguuucuugcuugua

SEQ ID NO: 954356 - RNA, 16 nt, Homo sapiens
cacuuaaacucaucua

SEQ ID NO: 954357 - RNA, 13 nt, Homo sapiens
cacuugcucagcc

SEQ ID NO: 954358 - RNA, 20 nt, Homo sapiens
cacuuucaucugagcuuuua

SEQ ID NO: 954359 - RNA, 17 nt, Homo sapiens
cacuuuuuguuguucau

SEQ ID NO: 954360 - RNA, 15 nt, Homo sapiens
cagaaacaacugcca

SEQ ID NO: 954361 - RNA, 15 nt, Homo sapiens
cagaaacuucucagu

SEQ ID NO: 954362 - RNA, 22 nt, Homo sapiens
cagaaagccucagaguccugcc

SEQ ID NO: 954363 - RNA, 13 nt, Homo sapiens
cagaaccaaagca

SEQ ID NO: 954364 - RNA, 23 nt, Homo sapiens
cagaacugaagugugcugugaca

SEQ ID NO: 954365 - RNA, 23 nt, Homo sapiens
cagaagacuucuauggaccacaa

SEQ ID NO: 954366 - RNA, 15 nt, Homo sapiens
cagaagcaugaucac

SEQ ID NO: 954367 - RNA, 19 nt, Homo sapiens
cagaaggcaaaguuuccau

SEQ ID NO: 954368 - RNA, 21 nt, Homo sapiens
gcacucaguguggacugggaa

SEQ ID NO: 954369 - RNA, 22 nt, Homo sapiens
gcacuccagccugggcaacaag

SEQ ID NO: 954370 - RNA, 16 nt, Homo sapiens
gcacuguuucuucuca

SEQ ID NO: 954371 - RNA, 14 nt, Homo sapiens
gcagaaauugaccu

SEQ ID NO: 954372 - RNA, 15 nt, Homo sapiens
gcagacacucaagag

SEQ ID NO: 954373 - RNA, 18 nt, Homo sapiens
gcaggaagucccugagaa

SEQ ID NO: 954374 - RNA, 13 nt, Homo sapiens
gcagggcccugug

SEQ ID NO: 954375 - RNA, 14 nt, Homo sapiens
gcagggcccugugg

SEQ ID NO: 954376 - RNA, 14 nt, Homo sapiens
gcaggggcuuccca

SEQ ID NO: 954377 - RNA, 22 nt, Homo sapiens
gcagucuccgcucccgcagcgg

SEQ ID NO: 954378 - RNA, 11 nt, Homo sapiens
gcagugcagca

SEQ ID NO: 954379 - RNA, 17 nt, Homo sapiens
gcaguuguuauauucau

SEQ ID NO: 954380 - RNA, 13 nt, Homo sapiens
gcauacucugugc

SEQ ID NO: 954381 - RNA, 11 nt, Homo sapiens
gcauacuucua

SEQ ID NO: 954382 - RNA, 16 nt, Homo sapiens
gcaucaagaugugaca

SEQ ID NO: 954383 - RNA, 13 nt, Homo sapiens
gcaucaccuuccu

SEQ ID NO: 954384 - RNA, 21 nt, Homo sapiens
gcaugacacgaauauugcuga

SEQ ID NO: 954385 - RNA, 15 nt, Homo sapiens
gcauuaccacacuca

SEQ ID NO: 954386 - RNA, 18 nt, Homo sapiens
gcauugauugcacuugau

SEQ ID NO: 954387 - RNA, 17 nt, Homo sapiens
gccaaaggaggaaauaa

SEQ ID NO: 954388 - RNA, 16 nt, Homo sapiens
gccaaggcucacaugc

SEQ ID NO: 954389 - RNA, 17 nt, Homo sapiens
gccaccucuaaauaugc

SEQ ID NO: 954390 - RNA, 11 nt, Homo sapiens
gccacuccugg

SEQ ID NO: 954391 - RNA, 11 nt, Homo sapiens
gccacuggccc

SEQ ID NO: 954392 - RNA, 14 nt, Homo sapiens
gccacuuuccucuu

SEQ ID NO: 954393 - RNA, 19 nt, Homo sapiens
gccaugguagaagaauuga

SEQ ID NO: 954394 - RNA, 13 nt, Homo sapiens
gccauuugugaua

SEQ ID NO: 954395 - RNA, 16 nt, Homo sapiens
gcccaguucaucccaa

SEQ ID NO: 954396 - RNA, 15 nt, Homo sapiens
gccccacgugcuccc

SEQ ID NO: 954397 - RNA, 14 nt, Homo sapiens
gccccuccucgggc

SEQ ID NO: 954398 - RNA, 21 nt, Homo sapiens
gccccugcuacugccaaccuc

SEQ ID NO: 954399 - RNA, 14 nt, Homo sapiens
gccccuugcuucua

SEQ ID NO: 954400 - RNA, 15 nt, Homo sapiens
gcccgggaagcaaau

SEQ ID NO: 954401 - RNA, 13 nt, Homo sapiens
gcccugcaccuug

SEQ ID NO: 954402 - RNA, 21 nt, Homo sapiens
gcccuuccucaucuccaugcu

SEQ ID NO: 954403 - RNA, 23 nt, Homo sapiens
gcccuuuucuuacaguaacugag

SEQ ID NO: 954404 - RNA, 14 nt, Homo sapiens
gccgcacccuggcu

SEQ ID NO: 954405 - RNA, 20 nt, Homo sapiens
gccgcugcuugaguggacag

SEQ ID NO: 954406 - RNA, 20 nt, Homo sapiens
gccucccaaggaaaauggac

SEQ ID NO: 954407 - RNA, 13 nt, Homo sapiens
gccucucuugcca

SEQ ID NO: 954408 - RNA, 21 nt, Homo sapiens
gccucuuuuaaugucaucucu

SEQ ID NO: 954409 - RNA, 16 nt, Homo sapiens
gccugaaaccagugac

SEQ ID NO: 954410 - RNA, 21 nt, Homo sapiens
gccugggugugaccugacacc

SEQ ID NO: 954411 - RNA, 15 nt, Homo sapiens
gccuucuaccugcag

SEQ ID NO: 954412 - RNA, 21 nt, Homo sapiens
gccuuguugaugaagcacauu

SEQ ID NO: 954413 - RNA, 12 nt, Homo sapiens
gcgaggggccca

SEQ ID NO: 954414 - RNA, 16 nt, Homo sapiens
gcgagucuggagacca

SEQ ID NO: 954415 - RNA, 21 nt, Homo sapiens
gcgcaggaaccgaggacucca

SEQ ID NO: 954416 - RNA, 15 nt, Homo sapiens
gcuaacaaacugaaa

SEQ ID NO: 954417 - RNA, 18 nt, Homo sapiens
gcuaacauagcacaguau

SEQ ID NO: 954418 - RNA, 14 nt, Homo sapiens
gcuaaucuuuaaua

SEQ ID NO: 954419 - RNA, 20 nt, Homo sapiens
gcuaauuauuuuagcacaaa

SEQ ID NO: 954420 - RNA, 21 nt, Homo sapiens
gcuaugcuauggaauauacau

SEQ ID NO: 954421 - RNA, 21 nt, Homo sapiens
gcuauggaaauaaaaggcauu

SEQ ID NO: 954422 - RNA, 15 nt, Homo sapiens
gcucaauaaauaugg

SEQ ID NO: 954423 - RNA, 20 nt, Homo sapiens
gcucacaccuguaaucccag

SEQ ID NO: 954424 - RNA, 16 nt, Homo sapiens
gcucacuauggucaaa

SEQ ID NO: 954425 - RNA, 14 nt, Homo sapiens
gcucacugcucaca

SEQ ID NO: 954426 - RNA, 17 nt, Homo sapiens
gcucagcacacaugcau

SEQ ID NO: 954427 - RNA, 14 nt, Homo sapiens
gcuccaagagaauu

SEQ ID NO: 954428 - RNA, 14 nt, Homo sapiens
gcuccgggugcgug

SEQ ID NO: 954429 - RNA, 16 nt, Homo sapiens
gcuccugucaccauga

SEQ ID NO: 954430 - RNA, 13 nt, Homo sapiens
gcucuaucugcug

SEQ ID NO: 954431 - RNA, 21 nt, Homo sapiens
gcucugugcacucacgcucag

SEQ ID NO: 954432 - RNA, 13 nt, Homo sapiens
gcugacucuccag

SEQ ID NO: 954433 - RNA, 22 nt, Homo sapiens
gcugagugggagcugucaggca

SEQ ID NO: 954434 - RNA, 18 nt, Homo sapiens
gcugaucauugcaguauc

SEQ ID NO: 954435 - RNA, 17 nt, Homo sapiens
gcugauggugcaaugac

SEQ ID NO: 954436 - RNA, 15 nt, Homo sapiens
gcugccauuaaugaa

SEQ ID NO: 954437 - RNA, 23 nt, Homo sapiens
gcugcuaaguggaagacagagau

SEQ ID NO: 954438 - RNA, 17 nt, Homo sapiens
gcugcucacugcucaca

SEQ ID NO: 954439 - RNA, 20 nt, Homo sapiens
gcugcucuccaucucuugua

SEQ ID NO: 954440 - RNA, 15 nt, Homo sapiens
gcugcugucuucccc

SEQ ID NO: 954441 - RNA, 14 nt, Homo sapiens
gcuggaacccagcu

SEQ ID NO: 954442 - RNA, 13 nt, Homo sapiens
gcuggagugcaga

SEQ ID NO: 954443 - RNA, 19 nt, Homo sapiens
gcuggaugugcuuucaucc

SEQ ID NO: 954444 - RNA, 23 nt, Homo sapiens
gcuguauuuucuuuuauaucugu

SEQ ID NO: 954445 - RNA, 13 nt, Homo sapiens
gcugugaggacag

SEQ ID NO: 954446 - RNA, 12 nt, Homo sapiens
gcuguugcuuga

SEQ ID NO: 954447 - RNA, 16 nt, Homo sapiens
gcuguugcuugaauag

SEQ ID NO: 954448 - RNA, 17 nt, Homo sapiens
gcuuaagugacuuccuc

SEQ ID NO: 954449 - RNA, 21 nt, Homo sapiens
gcuuauaaaaauaaagggaag

SEQ ID NO: 954450 - RNA, 15 nt, Homo sapiens
gcuuauaugugacac

SEQ ID NO: 954451 - RNA, 22 nt, Homo sapiens
gcuugauauaauaauuacuuaa

SEQ ID NO: 954452 - RNA, 12 nt, Homo sapiens
gcuugcacacau

SEQ ID NO: 954453 - RNA, 14 nt, Homo sapiens
gcuugcacacaugc

SEQ ID NO: 954454 - RNA, 15 nt, Homo sapiens
gcuuuacagcacugu

SEQ ID NO: 954455 - RNA, 16 nt, Homo sapiens
gcuuuacagcacugua

SEQ ID NO: 954456 - RNA, 18 nt, Homo sapiens
gcuuuacauggguucaau

SEQ ID NO: 954457 - RNA, 17 nt, Homo sapiens
gcuuugcggcaucucca

SEQ ID NO: 954458 - RNA, 21 nt, Homo sapiens
gcuuugcggcaucuccauuuc

SEQ ID NO: 954459 - RNA, 19 nt, Homo sapiens
gcuuuguuuuuggcauuuc

SEQ ID NO: 954460 - RNA, 12 nt, Homo sapiens
ggaaaacgugaa

SEQ ID NO: 954461 - RNA, 20 nt, Homo sapiens
ggaaacaaggaaggacauuu

SEQ ID NO: 954462 - RNA, 22 nt, Homo sapiens
ggaaagaguugagcacaggcaa

SEQ ID NO: 954463 - RNA, 16 nt, Homo sapiens
ggaaagguccuguggg

SEQ ID NO: 954464 - RNA, 18 nt, Homo sapiens
ggaaaggugacaguauua

SEQ ID NO: 954465 - RNA, 14 nt, Homo sapiens
ggaaauuugcaaau

SEQ ID NO: 954466 - RNA, 23 nt, Homo sapiens
ggaauugaagacacguucuugcc

SEQ ID NO: 954467 - RNA, 15 nt, Homo sapiens
ggacacggacccugu

SEQ ID NO: 954468 - RNA, 18 nt, Homo sapiens
ggacaggauggcugugug

SEQ ID NO: 954469 - RNA, 18 nt, Homo sapiens
ggacauagccugcaaagc

SEQ ID NO: 954470 - RNA, 22 nt, Homo sapiens
ggaccacaagugugcauuacca

SEQ ID NO: 954471 - RNA, 20 nt, Homo sapiens
ggacucaguucuuggccugc

SEQ ID NO: 954472 - RNA, 15 nt, Homo sapiens
ggacuccagauacau

SEQ ID NO: 954473 - RNA, 16 nt, Homo sapiens
ggacugggaagcauua

SEQ ID NO: 954474 - RNA, 16 nt, Homo sapiens
ggagaugacauuugcu

SEQ ID NO: 954475 - RNA, 19 nt, Homo sapiens
ggagcaaggcugcuaagug

SEQ ID NO: 954476 - RNA, 12 nt, Homo sapiens
ggagccagugaa

SEQ ID NO: 954477 - RNA, 13 nt, Homo sapiens
ggagccugggaug

SEQ ID NO: 954478 - RNA, 23 nt, Homo sapiens
ggaguaguugcuacucuucagaa

SEQ ID NO: 954479 - RNA, 12 nt, Homo sapiens
ggaguccagacc

SEQ ID NO: 954480 - RNA, 20 nt, Homo sapiens
ggaguggcugaccaggcccu

SEQ ID NO: 954481 - RNA, 18 nt, Homo sapiens
ggauaauaacuagaucuc

SEQ ID NO: 954482 - RNA, 18 nt, Homo sapiens
ggauccgugacagcacuu

SEQ ID NO: 954483 - RNA, 19 nt, Homo sapiens
ggaugaacucaaugcauga

SEQ ID NO: 954484 - RNA, 20 nt, Homo sapiens
ggaugucccugaagugccag

SEQ ID NO: 954485 - RNA, 22 nt, Homo sapiens
ggcaaaguaaaauuagagcaag

SEQ ID NO: 954486 - RNA, 22 nt, Homo sapiens
ggcaagcuggaguuaauaaucu

SEQ ID NO: 954487 - RNA, 12 nt, Homo sapiens
ggcacaaagggc

SEQ ID NO: 954488 - RNA, 17 nt, Homo sapiens
ggcagagucuaccuuga

SEQ ID NO: 954489 - RNA, 15 nt, Homo sapiens
ggcauacacaugcac

SEQ ID NO: 954490 - RNA, 15 nt, Homo sapiens
ggcaugguccugugc

SEQ ID NO: 954491 - RNA, 20 nt, Homo sapiens
ggccaaacacccaagcacaa

SEQ ID NO: 954492 - RNA, 15 nt, Homo sapiens
ggccaaaguguacaa

SEQ ID NO: 954493 - RNA, 18 nt, Homo sapiens
ggccagagcucccaggac

SEQ ID NO: 954494 - RNA, 16 nt, Homo sapiens
ggccaucacuuucauu

SEQ ID NO: 954495 - RNA, 22 nt, Homo sapiens
ggccccaccuguucuuuccucc

SEQ ID NO: 954496 - RNA, 14 nt, Homo sapiens
ggcccgccaccuug

SEQ ID NO: 954497 - RNA, 18 nt, Homo sapiens
ggcccuccucagcacggu

SEQ ID NO: 954498 - RNA, 19 nt, Homo sapiens
ggcccuguggcuccaggag

SEQ ID NO: 954499 - RNA, 22 nt, Homo sapiens
ggcccuguggcuccaggagcag

SEQ ID NO: 954500 - RNA, 15 nt, Homo sapiens
ggcguacacaugcac

SEQ ID NO: 954501 - RNA, 13 nt, Homo sapiens
ugaacaugcucau

SEQ ID NO: 954502 - RNA, 22 nt, Homo sapiens
ugaacaugcucauguguacaca

SEQ ID NO: 954503 - RNA, 15 nt, Homo sapiens
ugaaccgucaaugug

SEQ ID NO: 954504 - RNA, 18 nt, Homo sapiens
ugaaccguuacaaaagaa

SEQ ID NO: 954505 - RNA, 10 nt, Homo sapiens
ugaaccugug

SEQ ID NO: 954506 - RNA, 14 nt, Homo sapiens
ugaacucuuggccu

SEQ ID NO: 954507 - RNA, 22 nt, Homo sapiens
ugaacuggaaaagaucauugcu

SEQ ID NO: 954508 - RNA, 12 nt, Homo sapiens
ugaagaucucag

SEQ ID NO: 954509 - RNA, 14 nt, Homo sapiens
ugaagauuagcuuu

SEQ ID NO: 954510 - RNA, 15 nt, Homo sapiens
ugaagcugcucacug

SEQ ID NO: 954511 - RNA, 18 nt, Homo sapiens
ugaagguuuauacuaauu

SEQ ID NO: 954512 - RNA, 15 nt, Homo sapiens
ugaaguauacauuua

SEQ ID NO: 954513 - RNA, 21 nt, Homo sapiens
ugaagucugcuuaccaaaaca

SEQ ID NO: 954514 - RNA, 11 nt, Homo sapiens
ugaagucuugu

SEQ ID NO: 954515 - RNA, 18 nt, Homo sapiens
ugaagugaugauggauga

SEQ ID NO: 954516 - RNA, 17 nt, Homo sapiens
ugaagugugcugugaca

SEQ ID NO: 954517 - RNA, 15 nt, Homo sapiens
ugaauauuauacuuc

SEQ ID NO: 954518 - RNA, 18 nt, Homo sapiens
ugaaugaugccaugagga

SEQ ID NO: 954519 - RNA, 15 nt, Homo sapiens
ugaaugcuugccuug

SEQ ID NO: 954520 - RNA, 15 nt, Homo sapiens
ugaaugucaguguga

SEQ ID NO: 954521 - RNA, 17 nt, Homo sapiens
ugaauuguaaggaauga

SEQ ID NO: 954522 - RNA, 16 nt, Homo sapiens
ugacaauuugccauag

SEQ ID NO: 954523 - RNA, 21 nt, Homo sapiens
ugacccuugucccauguggcu

SEQ ID NO: 954524 - RNA, 19 nt, Homo sapiens
ugaccugauuuccauuugc

SEQ ID NO: 954525 - RNA, 14 nt, Homo sapiens
ugacucuggaacca

SEQ ID NO: 954526 - RNA, 17 nt, Homo sapiens
ugacucuucuuaucaca

SEQ ID NO: 954527 - RNA, 21 nt, Homo sapiens
ugacugaaguaauaacugaug

SEQ ID NO: 954528 - RNA, 22 nt, Homo sapiens
ugacuguaagaaacugugcacc

SEQ ID NO: 954529 - RNA, 23 nt, Homo sapiens
ugacuuaagcacacuugacauca

SEQ ID NO: 954530 - RNA, 19 nt, Homo sapiens
ugagaaacauuauugucaa

SEQ ID NO: 954531 - RNA, 18 nt, Homo sapiens
ugagaaaucaugccuagu

SEQ ID NO: 954532 - RNA, 23 nt, Homo sapiens
ugagaagauaaaaacugcccauu

SEQ ID NO: 954533 - RNA, 20 nt, Homo sapiens
ugagaaucgaccucacuguc

SEQ ID NO: 954534 - RNA, 19 nt, Homo sapiens
ugagcauagguagcuuguc

SEQ ID NO: 954535 - RNA, 13 nt, Homo sapiens
ugagcaugaaggg

SEQ ID NO: 954536 - RNA, 12 nt, Homo sapiens
ugagccaaagag

SEQ ID NO: 954537 - RNA, 15 nt, Homo sapiens
ugagccacagcacuc

SEQ ID NO: 954538 - RNA, 23 nt, Homo sapiens
ugagccucaugucugguauauau

SEQ ID NO: 954539 - RNA, 21 nt, Homo sapiens
ugagcuauaauguuucccuca

SEQ ID NO: 954540 - RNA, 18 nt, Homo sapiens
ugagcuggucaguugcca

SEQ ID NO: 954541 - RNA, 17 nt, Homo sapiens
ugaggaaacugcacugu

SEQ ID NO: 954542 - RNA, 23 nt, Homo sapiens
ugaggaugaaaaaauaacacugu

SEQ ID NO: 954543 - RNA, 22 nt, Homo sapiens
ugaggaugucccugaagugcca

SEQ ID NO: 954544 - RNA, 17 nt, Homo sapiens
ugagggaaacaaaauau

SEQ ID NO: 954545 - RNA, 19 nt, Homo sapiens
ugaggucaucccggggcca

SEQ ID NO: 954546 - RNA, 18 nt, Homo sapiens
ugaguaauauuacauuuc

SEQ ID NO: 954547 - RNA, 15 nt, Homo sapiens
ugaguccuggcaugg

SEQ ID NO: 954548 - RNA, 15 nt, Homo sapiens
ugagugaauguuaac

SEQ ID NO: 954549 - RNA, 14 nt, Homo sapiens
ugagugauccuccc

SEQ ID NO: 954550 - RNA, 21 nt, Homo sapiens
ugaguuuaaaaaaauaacauc

SEQ ID NO: 954551 - RNA, 18 nt, Homo sapiens
ugauauaauaauuacuua

SEQ ID NO: 954552 - RNA, 22 nt, Homo sapiens
ugauaugguucuuauucacuga

SEQ ID NO: 954553 - RNA, 14 nt, Homo sapiens
ugaucagaucuuac

SEQ ID NO: 954554 - RNA, 15 nt, Homo sapiens
ugaucagaucuuaca

SEQ ID NO: 954555 - RNA, 18 nt, Homo sapiens
ugaugucaugaaagcacc

SEQ ID NO: 954556 - RNA, 15 nt, Homo sapiens
ugauuaguaugcuau

SEQ ID NO: 954557 - RNA, 14 nt, Homo sapiens
ugauugcacuugau

SEQ ID NO: 954558 - RNA, 17 nt, Homo sapiens
ugauuggugcuuaccuu

SEQ ID NO: 954559 - RNA, 15 nt, Homo sapiens
ugauuuccauuugca

SEQ ID NO: 954560 - RNA, 24 nt, Homo sapiens
ugauuuuguaaaaauaaccaguag

SEQ ID NO: 954561 - RNA, 17 nt, Homo sapiens
ugauuuuuucuuaccuu

SEQ ID NO: 954562 - RNA, 17 nt, Homo sapiens
ugcaaacaaaaugaugg

SEQ ID NO: 954563 - RNA, 15 nt, Homo sapiens
ugcaaagcauuugag

SEQ ID NO: 954564 - RNA, 18 nt, Homo sapiens
ugcaaaguguaugugacc

SEQ ID NO: 954565 - RNA, 13 nt, Homo sapiens
ugcaaaugaaugc

SEQ ID NO: 954566 - RNA, 17 nt, Homo sapiens
ugcaaucauaugugauc

SEQ ID NO: 954567 - RNA, 20 nt, Homo sapiens
ugcaauuugucuagcaugcu

SEQ ID NO: 954568 - RNA, 14 nt, Homo sapiens
ugcacacaugcaca

SEQ ID NO: 954569 - RNA, 18 nt, Homo sapiens
ugcacagaccacacagca

SEQ ID NO: 954570 - RNA, 17 nt, Homo sapiens
ugcaccuucacucucca

SEQ ID NO: 954571 - RNA, 21 nt, Homo sapiens
ugcacgcuugcacacaugcac

SEQ ID NO: 954572 - RNA, 24 nt, Homo sapiens
ugcacucacgcucagcacacaugc

SEQ ID NO: 954573 - RNA, 23 nt, Homo sapiens
ugcagaccucccgcuuuggcuua

SEQ ID NO: 954574 - RNA, 20 nt, Homo sapiens
ugcagcaaccagagcacugu

SEQ ID NO: 954575 - RNA, 16 nt, Homo sapiens
ugcagcugagauucca

SEQ ID NO: 954576 - RNA, 13 nt, Homo sapiens
ugcaggaagggaa

SEQ ID NO: 954577 - RNA, 17 nt, Homo sapiens
ugcaguggugaugccua

SEQ ID NO: 954578 - RNA, 18 nt, Homo sapiens
ugcaucaagaugugacau

SEQ ID NO: 954579 - RNA, 11 nt, Homo sapiens
ugcaugcacac

SEQ ID NO: 954580 - RNA, 20 nt, Homo sapiens
ugcauuaccacacucagcua

SEQ ID NO: 954581 - RNA, 23 nt, Homo sapiens
ugcauuaccacacucagcuaauu

SEQ ID NO: 954582 - RNA, 13 nt, Homo sapiens
ugcauucauguac

SEQ ID NO: 954583 - RNA, 18 nt, Homo sapiens
ugccagcgucgguuaaaa

SEQ ID NO: 954584 - RNA, 13 nt, Homo sapiens
ugccagguaaaga

SEQ ID NO: 954585 - RNA, 14 nt, Homo sapiens
ugccauagaacaag

SEQ ID NO: 954586 - RNA, 20 nt, Homo sapiens
ugccaucagccccugcugcu

SEQ ID NO: 954587 - RNA, 23 nt, Homo sapiens
ugccccugcuacugccaaccucg

SEQ ID NO: 954588 - RNA, 15 nt, Homo sapiens
ugcccugcauucaca

SEQ ID NO: 954589 - RNA, 14 nt, Homo sapiens
ugccucucuugcca

SEQ ID NO: 954590 - RNA, 12 nt, Homo sapiens
ugccucugcucu

SEQ ID NO: 954591 - RNA, 19 nt, Homo sapiens
ugccuggagggaauccaua

SEQ ID NO: 954592 - RNA, 22 nt, Homo sapiens
ugccuuauggaacacucugaga

SEQ ID NO: 954593 - RNA, 21 nt, Homo sapiens
ugccuuguugaugaagcacau

SEQ ID NO: 954594 - RNA, 12 nt, Homo sapiens
ugcgacugcucu

SEQ ID NO: 954595 - RNA, 21 nt, Homo sapiens
ugcgacuucacaaaaugcaag

SEQ ID NO: 954596 - RNA, 13 nt, Homo sapiens
ugcggcaucucca

SEQ ID NO: 954597 - RNA, 15 nt, Homo sapiens
ugcgucccacugagu

SEQ ID NO: 954598 - RNA, 17 nt, Homo sapiens
ugcgugugcccacugaa

SEQ ID NO: 954599 - RNA, 13 nt, Homo sapiens
ugcuaaaugcaaa

SEQ ID NO: 954600 - RNA, 12 nt, Homo sapiens
ugcuacaguauu

SEQ ID NO: 954601 - RNA, 17 nt, Homo sapiens
ugcuacugccaaccucg

SEQ ID NO: 954602 - RNA, 22 nt, Homo sapiens
ugcuagaccugauggaauguua

SEQ ID NO: 954603 - RNA, 14 nt, Homo sapiens
ugcuauacagucua

SEQ ID NO: 954604 - RNA, 17 nt, Homo sapiens
ugcucauuucacuauuc

SEQ ID NO: 954605 - RNA, 16 nt, Homo sapiens
ugcucugugcacucac

SEQ ID NO: 954606 - RNA, 13 nt, Homo sapiens
ugcugccauuaau

SEQ ID NO: 954607 - RNA, 13 nt, Homo sapiens
ugcugcugugacc

SEQ ID NO: 954608 - RNA, 19 nt, Homo sapiens
ugcuguugauuccacugaa

SEQ ID NO: 954609 - RNA, 19 nt, Homo sapiens
ugcuguuuaauuccuggaa

SEQ ID NO: 954610 - RNA, 19 nt, Homo sapiens
ugcuugaguggacagcagc

SEQ ID NO: 954611 - RNA, 23 nt, Homo sapiens
ugcuuucuucauguucagucaca

SEQ ID NO: 954612 - RNA, 22 nt, Homo sapiens
ugcuuuuuaaacugauguauag

SEQ ID NO: 954613 - RNA, 19 nt, Homo sapiens
uggaaauaaaauacuucua

SEQ ID NO: 954614 - RNA, 14 nt, Homo sapiens
uggaaauacauuua

SEQ ID NO: 954615 - RNA, 11 nt, Homo sapiens
uggaaauggag

SEQ ID NO: 954616 - RNA, 18 nt, Homo sapiens
uggaagacagagauggca

SEQ ID NO: 954617 - RNA, 14 nt, Homo sapiens
uggaauaaacuguc

SEQ ID NO: 954618 - RNA, 15 nt, Homo sapiens
uggaauaucaaugcc

SEQ ID NO: 954619 - RNA, 17 nt, Homo sapiens
uggaaucccacuuauca

SEQ ID NO: 954620 - RNA, 12 nt, Homo sapiens
uggaaugccaaa

SEQ ID NO: 954621 - RNA, 13 nt, Homo sapiens
uggaauuucuugu

SEQ ID NO: 954622 - RNA, 18 nt, Homo sapiens
uggacaggcuucgucuca

SEQ ID NO: 954623 - RNA, 16 nt, Homo sapiens
uggacaugcacagcua

SEQ ID NO: 954624 - RNA, 15 nt, Homo sapiens
uggaccacagcauga

SEQ ID NO: 954625 - RNA, 21 nt, Homo sapiens
uggaccaugaaugauaugcua

SEQ ID NO: 954626 - RNA, 20 nt, Homo sapiens
uggacugggaagcauuacuu

SEQ ID NO: 954627 - RNA, 13 nt, Homo sapiens
uggagagaugucu

SEQ ID NO: 954628 - RNA, 17 nt, Homo sapiens
uggagcauugcagcucc

SEQ ID NO: 954629 - RNA, 22 nt, Homo sapiens
uggauaagucacuuaaacucau

SEQ ID NO: 954630 - RNA, 19 nt, Homo sapiens
uggauagaaaaaugcuguu

SEQ ID NO: 954631 - RNA, 21 nt, Homo sapiens
uggauuuagacucauggaaua

SEQ ID NO: 954632 - RNA, 22 nt, Homo sapiens
uggcagagcacacaugugcaca

SEQ ID NO: 954633 - RNA, 21 nt, Homo sapiens
uggcagguggccagggcucca

SEQ ID NO: 954634 - RNA, 22 nt, Homo sapiens
ccagaguggaaauucaugagag

SEQ ID NO: 954635 - RNA, 21 nt, Homo sapiens
ccaggaagaggggcgcugccc

SEQ ID NO: 954636 - RNA, 14 nt, Homo sapiens
ccaggcagggauaa

SEQ ID NO: 954637 - RNA, 20 nt, Homo sapiens
ccaggcagggauaauuaaaa

SEQ ID NO: 954638 - RNA, 17 nt, Homo sapiens
ccaggcuggagugcaga

SEQ ID NO: 954639 - RNA, 20 nt, Homo sapiens
ccagggugcaggcgcgcacc

SEQ ID NO: 954640 - RNA, 16 nt, Homo sapiens
ccagggugguggugca

SEQ ID NO: 954641 - RNA, 17 nt, Homo sapiens
ccauauggaaugccaaa

SEQ ID NO: 954642 - RNA, 16 nt, Homo sapiens
ccauauguagcauuaa

SEQ ID NO: 954643 - RNA, 13 nt, Homo sapiens
ccaucacuuucau

SEQ ID NO: 954644 - RNA, 18 nt, Homo sapiens
ccaucagugaauccugaa

SEQ ID NO: 954645 - RNA, 15 nt, Homo sapiens
ccauccuucccgcag

SEQ ID NO: 954646 - RNA, 14 nt, Homo sapiens
ccaucuccauugca

SEQ ID NO: 954647 - RNA, 17 nt, Homo sapiens
aaaaagaagagguucau

SEQ ID NO: 954648 - RNA, 15 nt, Homo sapiens
aaaaauaacacugua

SEQ ID NO: 954649 - RNA, 14 nt, Homo sapiens
aaaaauaacaucug

SEQ ID NO: 954650 - RNA, 13 nt, Homo sapiens
aaaaaugcuguuc

SEQ ID NO: 954651 - RNA, 12 nt, Homo sapiens
aaaaauuacauu

SEQ ID NO: 954652 - RNA, 24 nt, Homo sapiens
aaaacagaccagcauaguucugca

SEQ ID NO: 954653 - RNA, 18 nt, Homo sapiens
aaaaccuucuauguucau

SEQ ID NO: 954654 - RNA, 17 nt, Homo sapiens
aaaacugcccauuguaa

SEQ ID NO: 954655 - RNA, 14 nt, Homo sapiens
aaaagauuccugaa

SEQ ID NO: 954656 - RNA, 23 nt, Homo sapiens
aaaaguaauguauaucuguaaua

SEQ ID NO: 954657 - RNA, 13 nt, Homo sapiens
aaaauaaccagua

SEQ ID NO: 954658 - RNA, 18 nt, Homo sapiens
aaaauaguuuuacauuaa

SEQ ID NO: 954659 - RNA, 22 nt, Homo sapiens
aaaauauuucuaagcuuauuuc

SEQ ID NO: 954660 - RNA, 17 nt, Homo sapiens
aaaauccaaaaugcaug

SEQ ID NO: 954661 - RNA, 17 nt, Homo sapiens
aaaaucuuuccaucuca

SEQ ID NO: 954662 - RNA, 16 nt, Homo sapiens
aaaaugcugcauucua

SEQ ID NO: 954663 - RNA, 11 nt, Homo sapiens
aaaaugucaag

SEQ ID NO: 954664 - RNA, 13 nt, Homo sapiens
aaaauguuaacaa

SEQ ID NO: 954665 - RNA, 15 nt, Homo sapiens
aaaauucauaccuga

SEQ ID NO: 954666 - RNA, 23 nt, Homo sapiens
aaaauucuagucuguuucauuac

SEQ ID NO: 954667 - RNA, 17 nt, Homo sapiens
aaacaggcugcuuagau

SEQ ID NO: 954668 - RNA, 16 nt, Homo sapiens
aaacauuauugucaac

SEQ ID NO: 954669 - RNA, 15 nt, Homo sapiens
aaacauucuuuaaca

SEQ ID NO: 954670 - RNA, 18 nt, Homo sapiens
aaacauucuuuaacauac

SEQ ID NO: 954671 - RNA, 23 nt, Homo sapiens
aaacccaaauaaauguguaaaug

SEQ ID NO: 954672 - RNA, 19 nt, Homo sapiens
aaacccuacgaaagcacag

SEQ ID NO: 954673 - RNA, 22 nt, Homo sapiens
aaaccucuauauguugcugaaa

SEQ ID NO: 954674 - RNA, 18 nt, Homo sapiens
aaaccugccaagagucaa

SEQ ID NO: 954675 - RNA, 14 nt, Homo sapiens
aaacuaaacuaaaa

SEQ ID NO: 954676 - RNA, 21 nt, Homo sapiens
aaacuaugugggucugugaau

SEQ ID NO: 954677 - RNA, 12 nt, Homo sapiens
aaacugcacugu

SEQ ID NO: 954678 - RNA, 16 nt, Homo sapiens
aaacuuagaaagggaa

SEQ ID NO: 954679 - RNA, 15 nt, Homo sapiens
aaacuuuuggcaaau

SEQ ID NO: 954680 - RNA, 14 nt, Homo sapiens
aaagaaguauauaa

SEQ ID NO: 954681 - RNA, 12 nt, Homo sapiens
aaagaagucaaa

SEQ ID NO: 954682 - RNA, 13 nt, Homo sapiens
aaagauacuguau

SEQ ID NO: 954683 - RNA, 19 nt, Homo sapiens
aaagaucauugcugagaaa

SEQ ID NO: 954684 - RNA, 13 nt, Homo sapiens
aaagcaauuucuc

SEQ ID NO: 954685 - RNA, 14 nt, Homo sapiens
aaagcccaaccucu

SEQ ID NO: 954686 - RNA, 18 nt, Homo sapiens
aaagcuugccacuuucca

SEQ ID NO: 954687 - RNA, 17 nt, Homo sapiens
aaagcuugggacaguua

SEQ ID NO: 954688 - RNA, 13 nt, Homo sapiens
aaaggauuugaaa

SEQ ID NO: 954689 - RNA, 18 nt, Homo sapiens
aaagggagccaugcucuu

SEQ ID NO: 954690 - RNA, 16 nt, Homo sapiens
aaaggggccucuccuu

SEQ ID NO: 954691 - RNA, 16 nt, Homo sapiens
aaaggugacaguauua

SEQ ID NO: 954692 - RNA, 18 nt, Homo sapiens
aaaguaauuguaugugcu

SEQ ID NO: 954693 - RNA, 15 nt, Homo sapiens
aaagucauugcugac

SEQ ID NO: 954694 - RNA, 20 nt, Homo sapiens
aaagugcuuccuuuucagca

SEQ ID NO: 954695 - RNA, 22 nt, Homo sapiens
aaaguguacaauuuucauccca

SEQ ID NO: 954696 - RNA, 16 nt, Homo sapiens
aaagugucacuaagaa

SEQ ID NO: 954697 - RNA, 16 nt, Homo sapiens
aaauaaauggacugaa

SEQ ID NO: 954698 - RNA, 13 nt, Homo sapiens
aaauaacacugua

SEQ ID NO: 954699 - RNA, 15 nt, Homo sapiens
aaauaacacuguacu

SEQ ID NO: 954700 - RNA, 13 nt, Homo sapiens
aaauaaugcuuaa

SEQ ID NO: 954701 - RNA, 15 nt, Homo sapiens
aaauaauuagcuaua

SEQ ID NO: 954702 - RNA, 22 nt, Homo sapiens
aaauagaauauauaaacgauau

SEQ ID NO: 954703 - RNA, 19 nt, Homo sapiens
aaauaugcaaccugugcaa

SEQ ID NO: 954704 - RNA, 20 nt, Homo sapiens
cuaaaaagaauagaaaagaa

SEQ ID NO: 954705 - RNA, 15 nt, Homo sapiens
cuaaaauucuagucu

SEQ ID NO: 954706 - RNA, 22 nt, Homo sapiens
cuaaaguagaauuaucucucau

SEQ ID NO: 954707 - RNA, 20 nt, Homo sapiens
cuaaauaugcccaauuucau

SEQ ID NO: 954708 - RNA, 20 nt, Homo sapiens
cuaacaaacugaaaaaucua

SEQ ID NO: 954709 - RNA, 13 nt, Homo sapiens
cuaaccccauuca

SEQ ID NO: 954710 - RNA, 23 nt, Homo sapiens
cuaagaacuguggucugguguuc

SEQ ID NO: 954711 - RNA, 18 nt, Homo sapiens
cuaagcaguugcaaugau

SEQ ID NO: 954712 - RNA, 24 nt, Homo sapiens
cuaaugaaacaaaaaauauucauc

SEQ ID NO: 954713 - RNA, 15 nt, Homo sapiens
cuaaugaaaccugug

SEQ ID NO: 954714 - RNA, 16 nt, Homo sapiens
cuacauucugaaggcc

SEQ ID NO: 954715 - RNA, 18 nt, Homo sapiens
cuaccagagcgugcacuu

SEQ ID NO: 954716 - RNA, 20 nt, Homo sapiens
cuaccugaacugaaaggacu

SEQ ID NO: 954717 - RNA, 15 nt, Homo sapiens
cuacgaaagcacagu

SEQ ID NO: 954718 - RNA, 15 nt, Homo sapiens
cuagagacucuguga

SEQ ID NO: 954719 - RNA, 12 nt, Homo sapiens
cuagaugccaau

SEQ ID NO: 954720 - RNA, 15 nt, Homo sapiens
cuagcaguaugugug

SEQ ID NO: 954721 - RNA, 13 nt, Homo sapiens
cuagcuauaacaa

SEQ ID NO: 954722 - RNA, 18 nt, Homo sapiens
cuaggaggcuguggguuu

SEQ ID NO: 954723 - RNA, 18 nt, Homo sapiens
cuaggaguacaggcauag

SEQ ID NO: 954724 - RNA, 23 nt, Homo sapiens
cuagguucuacaggaaauacaga

SEQ ID NO: 954725 - RNA, 19 nt, Homo sapiens
cuaguuuuuccugugcaaa

SEQ ID NO: 954726 - RNA, 19 nt, Homo sapiens
cuauacuuucucacaugug

SEQ ID NO: 954727 - RNA, 16 nt, Homo sapiens
cuauauccccaaaaug

SEQ ID NO: 954728 - RNA, 23 nt, Homo sapiens
cuauccaaucucaucucuuguaa

SEQ ID NO: 954729 - RNA, 18 nt, Homo sapiens
cuauccagugagguaauu

SEQ ID NO: 954730 - RNA, 17 nt, Homo sapiens
cuauggaauauacaugu

SEQ ID NO: 954731 - RNA, 14 nt, Homo sapiens
cuauguuuguguau

SEQ ID NO: 954732 - RNA, 13 nt, Homo sapiens
cuauuugcacacg

SEQ ID NO: 954733 - RNA, 21 nt, Homo sapiens
cuauuuuauaagggcacuaac

SEQ ID NO: 954734 - RNA, 19 nt, Homo sapiens
cucaaacuccugaguucaa

SEQ ID NO: 954735 - RNA, 22 nt, Homo sapiens
cucaaagggugccuucuagcug

SEQ ID NO: 954736 - RNA, 14 nt, Homo sapiens
cucaaaugcuaaau

SEQ ID NO: 954737 - RNA, 16 nt, Homo sapiens
cucaacuguugccagg

SEQ ID NO: 954738 - RNA, 18 nt, Homo sapiens
cucaaugcuuuucuagca

SEQ ID NO: 954739 - RNA, 18 nt, Homo sapiens
cucacucagcaccacuca

SEQ ID NO: 954740 - RNA, 14 nt, Homo sapiens
cucacucuguugac

SEQ ID NO: 954741 - RNA, 15 nt, Homo sapiens
cucagcacacaugca

SEQ ID NO: 954742 - RNA, 19 nt, Homo sapiens
cucagcacacaugcauccu

SEQ ID NO: 954743 - RNA, 21 nt, Homo sapiens
cucagcaccacucaagaccaa

SEQ ID NO: 954744 - RNA, 22 nt, Homo sapiens
cucagcaccacucaagaccaaa

SEQ ID NO: 954745 - RNA, 20 nt, Homo sapiens
cucagcacuguuuucaucac

SEQ ID NO: 954746 - RNA, 18 nt, Homo sapiens
cucauuguacaagugaga

SEQ ID NO: 954747 - RNA, 20 nt, Homo sapiens
cuccacauucauguacaaug

SEQ ID NO: 954748 - RNA, 20 nt, Homo sapiens
cuccacggacccauucauac

SEQ ID NO: 954749 - RNA, 17 nt, Homo sapiens
cuccagaacaaaccucu

SEQ ID NO: 954750 - RNA, 18 nt, Homo sapiens
cucccacaucccccgugu

SEQ ID NO: 954751 - RNA, 13 nt, Homo sapiens
cucccccagggag

SEQ ID NO: 954752 - RNA, 16 nt, Homo sapiens
cucccccuccccggca

SEQ ID NO: 954753 - RNA, 22 nt, Homo sapiens
cucccuggacucuguggggcca

SEQ ID NO: 954754 - RNA, 22 nt, Homo sapiens
cucccuguaaugcacuccugcc

SEQ ID NO: 954755 - RNA, 17 nt, Homo sapiens
cucccuuuccuuuccca

SEQ ID NO: 954756 - RNA, 18 nt, Homo sapiens
cuccuaaauuuccagggg

SEQ ID NO: 954757 - RNA, 14 nt, Homo sapiens
cuccugccccggcc

SEQ ID NO: 954758 - RNA, 22 nt, Homo sapiens
cuccuguguuugcaccaaaaua

SEQ ID NO: 954759 - RNA, 23 nt, Homo sapiens
cuccuugccucugcucugugcac

SEQ ID NO: 954760 - RNA, 16 nt, Homo sapiens
cuccuuguacuugaau

SEQ ID NO: 954761 - RNA, 22 nt, Homo sapiens
cuccuugucacagaaucuccau

SEQ ID NO: 954762 - RNA, 16 nt, Homo sapiens
cucuaaaauucuaguc

SEQ ID NO: 954763 - RNA, 17 nt, Homo sapiens
cucuccaggcaccgccu

SEQ ID NO: 954764 - RNA, 18 nt, Homo sapiens
cucuccugcgugugccca

SEQ ID NO: 954765 - RNA, 15 nt, Homo sapiens
cucucgggugcccug

SEQ ID NO: 954766 - RNA, 16 nt, Homo sapiens
cucucuaaacccaaau

SEQ ID NO: 954767 - RNA, 17 nt, Homo sapiens
cucucuaaacccaaaua

SEQ ID NO: 954768 - RNA, 22 nt, Homo sapiens
cucugagaacagacguuaccaa

SEQ ID NO: 954769 - RNA, 19 nt, Homo sapiens
cucugagacucgcgacaau

SEQ ID NO: 954770 - RNA, 21 nt, Homo sapiens
cucuggguuuugggauuuggg

SEQ ID NO: 954771 - RNA, 15 nt, Homo sapiens
cucugugcucuccua

SEQ ID NO: 954772 - RNA, 14 nt, Homo sapiens
cucuguggugauga

SEQ ID NO: 954773 - RNA, 14 nt, Homo sapiens
cucuguuccugucc

SEQ ID NO: 954774 - RNA, 13 nt, Homo sapiens
cucuuaagacacu

SEQ ID NO: 954775 - RNA, 17 nt, Homo sapiens
cucuuguaaauacaugu

SEQ ID NO: 954776 - RNA, 19 nt, Homo sapiens
cucuuguaaauacaugucc

SEQ ID NO: 954777 - RNA, 11 nt, Homo sapiens
cucuuuccacc

SEQ ID NO: 954778 - RNA, 21 nt, Homo sapiens
cucuuugaagguuuauacuaa

SEQ ID NO: 954779 - RNA, 21 nt, Homo sapiens
cucuuugcccaguucauccca

SEQ ID NO: 954780 - RNA, 15 nt, Homo sapiens
cugaaaacaguaaaa

SEQ ID NO: 954781 - RNA, 21 nt, Homo sapiens
cugaaaagaaaugcuaaugua

SEQ ID NO: 954782 - RNA, 21 nt, Homo sapiens
cugaaccguuacaaaagaaga

SEQ ID NO: 954783 - RNA, 12 nt, Homo sapiens
cugaaguaauaa

SEQ ID NO: 954784 - RNA, 18 nt, Homo sapiens
cugaagucuuuguacaga

SEQ ID NO: 954785 - RNA, 21 nt, Homo sapiens
cugaagucuuuguacagacaa

SEQ ID NO: 954786 - RNA, 12 nt, Homo sapiens
cugaagugccag

SEQ ID NO: 954787 - RNA, 20 nt, Homo sapiens
cugaagugugcugugacaag

SEQ ID NO: 954788 - RNA, 22 nt, Homo sapiens
cugaaucaaaagcugaaauucu

SEQ ID NO: 954789 - RNA, 21 nt, Homo sapiens
cugaaucuguuucuaugucca

SEQ ID NO: 954790 - RNA, 13 nt, Homo sapiens
cugagaaacuucc

SEQ ID NO: 954791 - RNA, 18 nt, Homo sapiens
cugagaaacuuccuuuga

SEQ ID NO: 954792 - RNA, 15 nt, Homo sapiens
cugagagucugagaa

SEQ ID NO: 954793 - RNA, 20 nt, Homo sapiens
cugagaugggacaggaucaa

SEQ ID NO: 954794 - RNA, 23 nt, Homo sapiens
cugaggcuggggcuuuugugcca

SEQ ID NO: 954795 - RNA, 23 nt, Homo sapiens
cugagugaauguuaacaugcgca

SEQ ID NO: 954796 - RNA, 22 nt, Homo sapiens
cugagugggagcugucaggcag

SEQ ID NO: 954797 - RNA, 16 nt, Homo sapiens
cugaucaguugccaaa

SEQ ID NO: 954798 - RNA, 16 nt, Homo sapiens
cugcacacaugcacac

SEQ ID NO: 954799 - RNA, 15 nt, Homo sapiens
cugcaucaagaugug

SEQ ID NO: 954800 - RNA, 20 nt, Homo sapiens
cugccgacggagccacuggg

SEQ ID NO: 954801 - RNA, 12 nt, Homo sapiens
cugccgcugcuu

SEQ ID NO: 954802 - RNA, 18 nt, Homo sapiens
cugccugcagcugagauu

SEQ ID NO: 954803 - RNA, 18 nt, Homo sapiens
cugcgugugcccacugaa

SEQ ID NO: 954804 - RNA, 14 nt, Homo sapiens
cugcuaccugcuga

SEQ ID NO: 954805 - RNA, 16 nt, Homo sapiens
cugcucacugcucaca

SEQ ID NO: 954806 - RNA, 17 nt, Homo sapiens
cugcucacugcucacac

SEQ ID NO: 954807 - RNA, 23 nt, Homo sapiens
cugcuuaaaagaaaauguucacu

SEQ ID NO: 954808 - RNA, 22 nt, Homo sapiens
cugcuuuggggcuuaucagaac

SEQ ID NO: 954809 - RNA, 12 nt, Homo sapiens
cuggaaaacugg

SEQ ID NO: 954810 - RNA, 19 nt, Homo sapiens
cuggaaaagaucauugcug

SEQ ID NO: 954811 - RNA, 16 nt, Homo sapiens
cuggaaugggggccag

SEQ ID NO: 954812 - RNA, 22 nt, Homo sapiens
cuggacaggcuucgucucagaa

SEQ ID NO: 954813 - RNA, 16 nt, Homo sapiens
cuggacucuucaaaaa

SEQ ID NO: 954814 - RNA, 19 nt, Homo sapiens
cuggagaaaauggacgugu

SEQ ID NO: 954815 - RNA, 20 nt, Homo sapiens
cuggagugaaguggugugau

SEQ ID NO: 954816 - RNA, 21 nt, Homo sapiens
cuggagugaaguggugugauc

SEQ ID NO: 954817 - RNA, 20 nt, Homo sapiens
cuggcaggagacacuggucu

SEQ ID NO: 954818 - RNA, 20 nt, Homo sapiens
cuggcaugggaaugaauguc

SEQ ID NO: 954819 - RNA, 20 nt, Homo sapiens
cugggaccacaagugugcau

SEQ ID NO: 954820 - RNA, 20 nt, Homo sapiens
cugggccccagaaagccuca

SEQ ID NO: 954821 - RNA, 16 nt, Homo sapiens
cugggccccgccucaa

SEQ ID NO: 954822 - RNA, 21 nt, Homo sapiens
cuggugaggguccucuuccuc

SEQ ID NO: 954823 - RNA, 18 nt, Homo sapiens
cugguggagggugcccag

SEQ ID NO: 954824 - RNA, 23 nt, Homo sapiens
cuguaaucccagcacuuugggag

SEQ ID NO: 954825 - RNA, 17 nt, Homo sapiens
cuguacccuauguucac

SEQ ID NO: 954826 - RNA, 14 nt, Homo sapiens
cuguaggugaaaga

SEQ ID NO: 954827 - RNA, 20 nt, Homo sapiens
cuguaguaauuguuacaauu

SEQ ID NO: 954828 - RNA, 15 nt, Homo sapiens
cuguauaccccguga

SEQ ID NO: 954829 - RNA, 16 nt, Homo sapiens
cuguaugacugaagua

SEQ ID NO: 954830 - RNA, 15 nt, Homo sapiens
cugucaauacagguu

SEQ ID NO: 954831 - RNA, 16 nt, Homo sapiens
cugucaauuacaggaa

SEQ ID NO: 954832 - RNA, 18 nt, Homo sapiens
cuguccucuuaagacacu

SEQ ID NO: 954833 - RNA, 19 nt, Homo sapiens
cugugaccgggguccugag

SEQ ID NO: 954834 - RNA, 16 nt, Homo sapiens
cugugaucuaagcagu

SEQ ID NO: 954835 - RNA, 19 nt, Homo sapiens
cugugccucaucacugcuc

SEQ ID NO: 954836 - RNA, 17 nt, Homo sapiens
cuguguacccuccaugu

SEQ ID NO: 954837 - RNA, 17 nt, Homo sapiens
uuaagcacacuugacau

SEQ ID NO: 954838 - RNA, 19 nt, Homo sapiens
uuaagcccuacgaugggau

SEQ ID NO: 954839 - RNA, 20 nt, Homo sapiens
uuaauacgcaggcaucugau

SEQ ID NO: 954840 - RNA, 12 nt, Homo sapiens
uuaauauacugc

SEQ ID NO: 954841 - RNA, 19 nt, Homo sapiens
uuaauauacugcauauccu

SEQ ID NO: 954842 - RNA, 13 nt, Homo sapiens
uuaaucauaucaa

SEQ ID NO: 954843 - RNA, 20 nt, Homo sapiens
uuacaacacuuuaaguaaaa

SEQ ID NO: 954844 - RNA, 21 nt, Homo sapiens
uuacacgggguuacacuguua

SEQ ID NO: 954845 - RNA, 16 nt, Homo sapiens
uuacaguguuuggaca

SEQ ID NO: 954846 - RNA, 17 nt, Homo sapiens
uuacgacccaggacaau

SEQ ID NO: 954847 - RNA, 12 nt, Homo sapiens
uuacuaaagaca

SEQ ID NO: 954848 - RNA, 12 nt, Homo sapiens
uuagaaagggaa

SEQ ID NO: 954849 - RNA, 15 nt, Homo sapiens
uuagaauacuacagc

SEQ ID NO: 954850 - RNA, 20 nt, Homo sapiens
uuagacaaccauagaacugu

SEQ ID NO: 954851 - RNA, 20 nt, Homo sapiens
uuagagcaagaacauucaaa

SEQ ID NO: 954852 - RNA, 12 nt, Homo sapiens
uuagcacaaaga

SEQ ID NO: 954853 - RNA, 14 nt, Homo sapiens
uuagcaguacccua

SEQ ID NO: 954854 - RNA, 21 nt, Homo sapiens
uuagcaguacccuagccucaa

SEQ ID NO: 954855 - RNA, 18 nt, Homo sapiens
uuaggugugccaaacuac

SEQ ID NO: 954856 - RNA, 13 nt, Homo sapiens
uuaguaugcuaug

SEQ ID NO: 954857 - RNA, 14 nt, Homo sapiens
uuauacuaauucag

SEQ ID NO: 954858 - RNA, 20 nt, Homo sapiens
uuaucauggguaucacauug

SEQ ID NO: 954859 - RNA, 16 nt, Homo sapiens
uuaugauaaccaagaa

SEQ ID NO: 954860 - RNA, 19 nt, Homo sapiens
uuauguggauuucaucacu

SEQ ID NO: 954861 - RNA, 18 nt, Homo sapiens
uuauucacugagucucau

SEQ ID NO: 954862 - RNA, 12 nt, Homo sapiens
uuauucuaguca

SEQ ID NO: 954863 - RNA, 19 nt, Homo sapiens
uuauuugacucagcacugu

SEQ ID NO: 954864 - RNA, 13 nt, Homo sapiens
uuauuuugauuga

SEQ ID NO: 954865 - RNA, 16 nt, Homo sapiens
uucaaaauguuaacaa

SEQ ID NO: 954866 - RNA, 16 nt, Homo sapiens
uucaaagaaaacagac

SEQ ID NO: 954867 - RNA, 14 nt, Homo sapiens
uucaaggaauguua

SEQ ID NO: 954868 - RNA, 15 nt, Homo sapiens
uucaauguacuguau

SEQ ID NO: 954869 - RNA, 17 nt, Homo sapiens
uucaauucugauuccaa

SEQ ID NO: 954870 - RNA, 11 nt, Homo sapiens
uucaauuugcg

SEQ ID NO: 954871 - RNA, 19 nt, Homo sapiens
uucacaaagggaauugccu

SEQ ID NO: 954872 - RNA, 11 nt, Homo sapiens
uucacaguauc

SEQ ID NO: 954873 - RNA, 21 nt, Homo sapiens
uucacauauuuguagcuagaa

SEQ ID NO: 954874 - RNA, 13 nt, Homo sapiens
uucacaucuguau

SEQ ID NO: 954875 - RNA, 15 nt, Homo sapiens
uucagucauaaagag

SEQ ID NO: 954876 - RNA, 16 nt, Homo sapiens
uucagucaucaucuca

SEQ ID NO: 954877 - RNA, 18 nt, Homo sapiens
uucaguuaucacuacaga

SEQ ID NO: 954878 - RNA, 18 nt, Homo sapiens
uucauaauuuccaugaua

SEQ ID NO: 954879 - RNA, 23 nt, Homo sapiens
uucauugccuucucccucaugca

SEQ ID NO: 954880 - RNA, 21 nt, Homo sapiens
uuccaacauuauccuguguga

SEQ ID NO: 954881 - RNA, 21 nt, Homo sapiens
uuccaacccaggucugcuuug

SEQ ID NO: 954882 - RNA, 14 nt, Homo sapiens
uuccacacauuucc

SEQ ID NO: 954883 - RNA, 20 nt, Homo sapiens
uuccacguaagucacugaaa

SEQ ID NO: 954884 - RNA, 14 nt, Homo sapiens
uaauagaaaacugu

SEQ ID NO: 954885 - RNA, 15 nt, Homo sapiens
uaaucaaaugauuca

SEQ ID NO: 954886 - RNA, 13 nt, Homo sapiens
uaaucaccuuucc

SEQ ID NO: 954887 - RNA, 20 nt, Homo sapiens
uaaucucuaaaauucuaguc

SEQ ID NO: 954888 - RNA, 14 nt, Homo sapiens
uaaucucuuuccau

SEQ ID NO: 954889 - RNA, 17 nt, Homo sapiens
uaaucuguacuauccag

SEQ ID NO: 954890 - RNA, 13 nt, Homo sapiens
uaaugucaucucu

SEQ ID NO: 954891 - RNA, 13 nt, Homo sapiens
uaauuaaaucaua

SEQ ID NO: 954892 - RNA, 20 nt, Homo sapiens
uaauuacuuaaugugaugcu

SEQ ID NO: 954893 - RNA, 19 nt, Homo sapiens
uaauuguuacaauuuucua

SEQ ID NO: 954894 - RNA, 13 nt, Homo sapiens
uaauuuuguagua

SEQ ID NO: 954895 - RNA, 23 nt, Homo sapiens
uaauuuuucuuauuuagcccaua

SEQ ID NO: 954896 - RNA, 19 nt, Homo sapiens
uacaaacaaaggauuugaa

SEQ ID NO: 954897 - RNA, 15 nt, Homo sapiens
uacaaguagcuaauu

SEQ ID NO: 954898 - RNA, 16 nt, Homo sapiens
uacaaucuuagugaau

SEQ ID NO: 954899 - RNA, 16 nt, Homo sapiens
uacaaugauguaaaua

SEQ ID NO: 954900 - RNA, 13 nt, Homo sapiens
uacacuacaaaug

SEQ ID NO: 954901 - RNA, 21 nt, Homo sapiens
uacacugcaaucauaugugau

SEQ ID NO: 954902 - RNA, 13 nt, Homo sapiens
uacagacaacaaa

SEQ ID NO: 954903 - RNA, 19 nt, Homo sapiens
uacagacaacaaaccuguu

SEQ ID NO: 954904 - RNA, 22 nt, Homo sapiens
uacaggcauagccacuugcuca

SEQ ID NO: 954905 - RNA, 13 nt, Homo sapiens
uacaguacaugac

SEQ ID NO: 954906 - RNA, 21 nt, Homo sapiens
uacaugacccggaugaacuca

SEQ ID NO: 954907 - RNA, 16 nt, Homo sapiens
uacauuaaaagcuuua

SEQ ID NO: 954908 - RNA, 20 nt, Homo sapiens
uacauuugauuugauauaca

SEQ ID NO: 954909 - RNA, 14 nt, Homo sapiens
uaccaaaacauaag

SEQ ID NO: 954910 - RNA, 17 nt, Homo sapiens
uaccauauguagcauua

SEQ ID NO: 954911 - RNA, 18 nt, Homo sapiens
uaccauauguagcauuaa

SEQ ID NO: 954912 - RNA, 23 nt, Homo sapiens
uacccuccauguaccuuguguac

SEQ ID NO: 954913 - RNA, 15 nt, Homo sapiens
uacccucuggagaua

SEQ ID NO: 954914 - RNA, 20 nt, Homo sapiens
uaccuggcuugaagcugcuc

SEQ ID NO: 954915 - RNA, 13 nt, Homo sapiens
uacgaaagcacag

SEQ ID NO: 954916 - RNA, 14 nt, Homo sapiens
uacgguuccauguu

SEQ ID NO: 954917 - RNA, 18 nt, Homo sapiens
uacuacccucagucuaca

SEQ ID NO: 954918 - RNA, 16 nt, Homo sapiens
uacucgaguuacagac

SEQ ID NO: 954919 - RNA, 13 nt, Homo sapiens
uacucugugcaag

SEQ ID NO: 954920 - RNA, 22 nt, Homo sapiens
uacuuacacugaaauccaaaau

SEQ ID NO: 954921 - RNA, 21 nt, Homo sapiens
uacuucuguguugugauuccc

SEQ ID NO: 954922 - RNA, 21 nt, Homo sapiens
uacuugauauaauuacuuaau

SEQ ID NO: 954923 - RNA, 12 nt, Homo sapiens
uagaaaacuggg

SEQ ID NO: 954924 - RNA, 20 nt, Homo sapiens
uagaacaggguuucucagcc

SEQ ID NO: 954925 - RNA, 21 nt, Homo sapiens
uagaacggauaccugcugcua

SEQ ID NO: 954926 - RNA, 17 nt, Homo sapiens
uagaauaccucccucau

SEQ ID NO: 954927 - RNA, 16 nt, Homo sapiens
uagaaucuauuuucua

SEQ ID NO: 954928 - RNA, 18 nt, Homo sapiens
uagaaugagaacauccau

SEQ ID NO: 954929 - RNA, 19 nt, Homo sapiens
uagaaugagggaaacaaaa

SEQ ID NO: 954930 - RNA, 13 nt, Homo sapiens
uagacaaaaucag

SEQ ID NO: 954931 - RNA, 14 nt, Homo sapiens
uagacaaaaucagu

SEQ ID NO: 954932 - RNA, 19 nt, Homo sapiens
uagacuggauaaucaacau

SEQ ID NO: 954933 - RNA, 16 nt, Homo sapiens
uagagcaaagacuuaa

SEQ ID NO: 954934 - RNA, 19 nt, Homo sapiens
uagagcacuagaagcacag

SEQ ID NO: 954935 - RNA, 18 nt, Homo sapiens
uagagcauaccacuugaa

SEQ ID NO: 954936 - RNA, 22 nt, Homo sapiens
uagagugcccuuaaaauaauga

SEQ ID NO: 954937 - RNA, 21 nt, Homo sapiens
uagaucauaacagaacuuauu

SEQ ID NO: 954938 - RNA, 14 nt, Homo sapiens
uagauccucugaua

SEQ ID NO: 954939 - RNA, 13 nt, Homo sapiens
uagaucuccugua

SEQ ID NO: 954940 - RNA, 16 nt, Homo sapiens
uagaugccaaugacau

SEQ ID NO: 954941 - RNA, 10 nt, Homo sapiens
uagcacacau

SEQ ID NO: 954942 - RNA, 12 nt, Homo sapiens
uagccaaagagg

SEQ ID NO: 954943 - RNA, 16 nt, Homo sapiens
uagccagaauguuucc

SEQ ID NO: 954944 - RNA, 14 nt, Homo sapiens
uagcuauaacaacu

SEQ ID NO: 954945 - RNA, 16 nt, Homo sapiens
uaggccaucucagcuu

SEQ ID NO: 954946 - RNA, 15 nt, Homo sapiens
uagguuuuucuugcu

SEQ ID NO: 954947 - RNA, 16 nt, Homo sapiens
uaguaauggcagagca

SEQ ID NO: 954948 - RNA, 20 nt, Homo sapiens
uaguaugcuaugcuauggaa

SEQ ID NO: 954949 - RNA, 12 nt, Homo sapiens
uaguauuggcaa

SEQ ID NO: 954950 - RNA, 15 nt, Homo sapiens
uaguccuccaaaaca

SEQ ID NO: 954951 - RNA, 17 nt, Homo sapiens
uagucucuugauucaua

SEQ ID NO: 954952 - RNA, 18 nt, Homo sapiens
uagugaaaggucaucuca

SEQ ID NO: 954953 - RNA, 21 nt, Homo sapiens
uaguggggcaaugacuuuccu

SEQ ID NO: 954954 - RNA, 19 nt, Homo sapiens
uaguuacuuacugccuuag

SEQ ID NO: 954955 - RNA, 14 nt, Homo sapiens
uaguucuauuucua

SEQ ID NO: 954956 - RNA, 14 nt, Homo sapiens
uaguugaacaagau

SEQ ID NO: 954957 - RNA, 14 nt, Homo sapiens
uaguuggugcucaa

SEQ ID NO: 954958 - RNA, 14 nt, Homo sapiens
uaguuugcauucca

SEQ ID NO: 954959 - RNA, 20 nt, Homo sapiens
uauaaaaccauguaaaguca

SEQ ID NO: 954960 - RNA, 16 nt, Homo sapiens
uauaaucuaauacuua

SEQ ID NO: 954961 - RNA, 18 nt, Homo sapiens
uauaaucuaauacuuauu

SEQ ID NO: 954962 - RNA, 19 nt, Homo sapiens
uauacaaagcugucacuca

SEQ ID NO: 954963 - RNA, 17 nt, Homo sapiens
uauacauguauagugag

SEQ ID NO: 954964 - RNA, 16 nt, Homo sapiens
uauacuaccaaaagag

SEQ ID NO: 954965 - RNA, 16 nt, Homo sapiens
uauacuugaauauuau

SEQ ID NO: 954966 - RNA, 16 nt, Homo sapiens
uauagaccaugcacag

SEQ ID NO: 954967 - RNA, 19 nt, Homo sapiens
uauauaaucaaaugauuca

SEQ ID NO: 954968 - RNA, 16 nt, Homo sapiens
uauauauacauguaua

SEQ ID NO: 954969 - RNA, 13 nt, Homo sapiens
uauaucaguuuga

SEQ ID NO: 954970 - RNA, 16 nt, Homo sapiens
uauauguacaguuaua

SEQ ID NO: 954971 - RNA, 13 nt, Homo sapiens
uaucaacaugcac

SEQ ID NO: 954972 - RNA, 23 nt, Homo sapiens
uaucaacuuaauucuguuacaca

SEQ ID NO: 954973 - RNA, 16 nt, Homo sapiens
uaucacuacagaucuc

SEQ ID NO: 954974 - RNA, 16 nt, Homo sapiens
uaucagaggguggaga

SEQ ID NO: 954975 - RNA, 13 nt, Homo sapiens
uauccaaucucau

SEQ ID NO: 954976 - RNA, 12 nt, Homo sapiens
uaucugcugcac

SEQ ID NO: 954977 - RNA, 22 nt, Homo sapiens
uaucuugaagacuuuucuuuca

SEQ ID NO: 954978 - RNA, 18 nt, Homo sapiens
uaucuuggaaucaugcaa

SEQ ID NO: 954979 - RNA, 23 nt, Homo sapiens
uaucuuuaggucuuugccuucca

SEQ ID NO: 954980 - RNA, 18 nt, Homo sapiens
uaugacauauuacaacac

SEQ ID NO: 954981 - RNA, 16 nt, Homo sapiens
uaugacuccagaauuu

SEQ ID NO: 954982 - RNA, 15 nt, Homo sapiens
uaugcagcucaucac

SEQ ID NO: 954983 - RNA, 15 nt, Homo sapiens
uaugccuccauuuca

SEQ ID NO: 954984 - RNA, 22 nt, Homo sapiens
uauggaaauccuguuacuuaaa

SEQ ID NO: 954985 - RNA, 15 nt, Homo sapiens
uauggaaugccaaaa

SEQ ID NO: 954986 - RNA, 14 nt, Homo sapiens
uauggagaguucag

SEQ ID NO: 954987 - RNA, 17 nt, Homo sapiens
uauggccccaccugcuc

SEQ ID NO: 954988 - RNA, 18 nt, Homo sapiens
uaugguucuuauucacug

SEQ ID NO: 954989 - RNA, 15 nt, Homo sapiens
uaugucaguccaaua

SEQ ID NO: 954990 - RNA, 14 nt, Homo sapiens
uauguggauuucau

SEQ ID NO: 954991 - RNA, 12 nt, Homo sapiens
uauguguugcac

SEQ ID NO: 954992 - RNA, 21 nt, Homo sapiens
uauuaguuaggugugccaaac

SEQ ID NO: 954993 - RNA, 13 nt, Homo sapiens
uauucauguguac

SEQ ID NO: 954994 - RNA, 22 nt, Homo sapiens
uauucugaucaguugccaaaga

SEQ ID NO: 954995 - RNA, 22 nt, Homo sapiens
uauugaaugcauacucugugca

SEQ ID NO: 954996 - RNA, 20 nt, Homo sapiens
uauuucggaaauacacuaca

SEQ ID NO: 954997 - RNA, 20 nt, Homo sapiens
uauuuuaggcaaaguccaua

SEQ ID NO: 954998 - RNA, 14 nt, Homo sapiens
uauuuucaaaauag

SEQ ID NO: 954999 - RNA, 22 nt, Homo sapiens
ucaaaaaauuauuuuaggcaaa

SEQ ID NO: 955000 - RNA, 22 nt, Homo sapiens
ucaaaugaccuagaaacaagga

SEQ ID NO: 955001 - RNA, 14 nt, Homo sapiens
ucaaaugauucauu

SEQ ID NO: 955002 - RNA, 18 nt, Homo sapiens
ucaaaugcaguccaguga

SEQ ID NO: 955003 - RNA, 17 nt, Homo sapiens
ucaacaggucacuugau

SEQ ID NO: 955004 - RNA, 14 nt, Homo sapiens
ucuaugaacuagag

SEQ ID NO: 955005 - RNA, 21 nt, Homo sapiens
ucuaugaacuagagacucugu

SEQ ID NO: 955006 - RNA, 13 nt, Homo sapiens
ucuaugccuguau

SEQ ID NO: 955007 - RNA, 20 nt, Homo sapiens
ucuauuacaccuuuaucuca

SEQ ID NO: 955008 - RNA, 14 nt, Homo sapiens
ucuauucauuugau

SEQ ID NO: 955009 - RNA, 18 nt, Homo sapiens
ucucaagaucugcuucua

SEQ ID NO: 955010 - RNA, 23 nt, Homo sapiens
ucucacauguggcucccccugaa

SEQ ID NO: 955011 - RNA, 17 nt, Homo sapiens
ucucacuguguugccca

SEQ ID NO: 955012 - RNA, 14 nt, Homo sapiens
ucucauuacagauu

SEQ ID NO: 955013 - RNA, 17 nt, Homo sapiens
ucucauuagcucucauc

SEQ ID NO: 955014 - RNA, 20 nt, Homo sapiens
ucucauuccucuguccccga

SEQ ID NO: 955015 - RNA, 20 nt, Homo sapiens
ucuccacugucauaaucucu

SEQ ID NO: 955016 - RNA, 15 nt, Homo sapiens
ucuccaucaguucac

SEQ ID NO: 955017 - RNA, 21 nt, Homo sapiens
ucuccaugucuguaguugcuu

SEQ ID NO: 955018 - RNA, 21 nt, Homo sapiens
ucuccauugcauucauguacu

SEQ ID NO: 955019 - RNA, 17 nt, Homo sapiens
ucucccaguaauuuuuc

SEQ ID NO: 955020 - RNA, 16 nt, Homo sapiens
ucuccccgaaucucaa

SEQ ID NO: 955021 - RNA, 19 nt, Homo sapiens
ucuccucugggccacugau

SEQ ID NO: 955022 - RNA, 23 nt, Homo sapiens
ucuccugcgugugcccacugaac

SEQ ID NO: 955023 - RNA, 18 nt, Homo sapiens
ucuccuuuucuccacugu

SEQ ID NO: 955024 - RNA, 14 nt, Homo sapiens
ucucgagaggcaau

SEQ ID NO: 955025 - RNA, 17 nt, Homo sapiens
ucucguacuuucacauc

SEQ ID NO: 955026 - RNA, 22 nt, Homo sapiens
ucucgugauugauaagaaccuu

SEQ ID NO: 955027 - RNA, 20 nt, Homo sapiens
ucucuaauagaaguccauga

SEQ ID NO: 955028 - RNA, 17 nt, Homo sapiens
ucucuacuuuccugaug

SEQ ID NO: 955029 - RNA, 15 nt, Homo sapiens
ucucucuuacugcuu

SEQ ID NO: 955030 - RNA, 23 nt, Homo sapiens
ucucuugauucauaaugacuuaa

SEQ ID NO: 955031 - RNA, 20 nt, Homo sapiens
ucugaaucuguuucuauguc

SEQ ID NO: 955032 - RNA, 15 nt, Homo sapiens
ucugaaugacaucaa

SEQ ID NO: 955033 - RNA, 13 nt, Homo sapiens
ucugagcaguugu

SEQ ID NO: 955034 - RNA, 23 nt, Homo sapiens
ucugauggcacauuagaugaagu

SEQ ID NO: 955035 - RNA, 18 nt, Homo sapiens
ucugcaaauaguuucaaa

SEQ ID NO: 955036 - RNA, 15 nt, Homo sapiens
ucugcacagcuccuc

SEQ ID NO: 955037 - RNA, 22 nt, Homo sapiens
ucugcgucccacugagucucau

SEQ ID NO: 955038 - RNA, 15 nt, Homo sapiens
ucugcuguugauucc

SEQ ID NO: 955039 - RNA, 16 nt, Homo sapiens
ucugcuguugauucca

SEQ ID NO: 955040 - RNA, 16 nt, Homo sapiens
ucuggacagaugggug

SEQ ID NO: 955041 - RNA, 21 nt, Homo sapiens
ucuggagauaaaauaaaaaga

SEQ ID NO: 955042 - RNA, 17 nt, Homo sapiens
ucugggacccacuccga

SEQ ID NO: 955043 - RNA, 18 nt, Homo sapiens
ucuguagcaccuugcaua

SEQ ID NO: 955044 - RNA, 15 nt, Homo sapiens
ucuguagugccaugg

SEQ ID NO: 955045 - RNA, 13 nt, Homo sapiens
ucugugaauuucu

SEQ ID NO: 955046 - RNA, 17 nt, Homo sapiens
ucuguucuaaguccacu

SEQ ID NO: 955047 - RNA, 21 nt, Homo sapiens
ucuuacacccgacgcuuacca

SEQ ID NO: 955048 - RNA, 15 nt, Homo sapiens
ucuuaccgaauaagg

SEQ ID NO: 955049 - RNA, 14 nt, Homo sapiens
ucuuacuugcccuu

SEQ ID NO: 955050 - RNA, 15 nt, Homo sapiens
ucuuagguuuccacg

SEQ ID NO: 955051 - RNA, 22 nt, Homo sapiens
ucuuaucacacuugcaaaugaa

SEQ ID NO: 955052 - RNA, 22 nt, Homo sapiens
ucuuauuuagcccauaaucucu

SEQ ID NO: 955053 - RNA, 16 nt, Homo sapiens
ucuuauuuauauauga

SEQ ID NO: 955054 - RNA, 19 nt, Homo sapiens
ucuucacaauauccaauga

SEQ ID NO: 955055 - RNA, 13 nt, Homo sapiens
ucuucagauccug

SEQ ID NO: 955056 - RNA, 16 nt, Homo sapiens
ucuuccauaugcucuu

SEQ ID NO: 955057 - RNA, 14 nt, Homo sapiens
ucuuccuaccaaau

SEQ ID NO: 955058 - RNA, 19 nt, Homo sapiens
ucuucuaucaaagcacaua

SEQ ID NO: 955059 - RNA, 14 nt, Homo sapiens
ucuucugagugaau

SEQ ID NO: 955060 - RNA, 15 nt, Homo sapiens
ucuugaacucuuggc

SEQ ID NO: 955061 - RNA, 16 nt, Homo sapiens
ucuugaucagacauuc

SEQ ID NO: 955062 - RNA, 22 nt, Homo sapiens
ucuuguaccagcccaggcaaua

SEQ ID NO: 955063 - RNA, 22 nt, Homo sapiens
ucuuguguuguuuucucugauc

SEQ ID NO: 955064 - RNA, 14 nt, Homo sapiens
ucuuuauaaaccau

SEQ ID NO: 955065 - RNA, 20 nt, Homo sapiens
ucuuugcccaguucauccca

SEQ ID NO: 955066 - RNA, 18 nt, Homo sapiens
ucuuuuaaugucaucucu

SEQ ID NO: 955067 - RNA, 23 nt, Homo sapiens
ucuuuuuucaauguacuguauug

SEQ ID NO: 955068 - RNA, 19 nt, Homo sapiens
ugaaaaaucuaguauuugu

SEQ ID NO: 955069 - RNA, 16 nt, Homo sapiens
ugaaacacacaggcca

SEQ ID NO: 955070 - RNA, 18 nt, Homo sapiens
ugaaagccuaguccagaa

SEQ ID NO: 955071 - RNA, 21 nt, Homo sapiens
ugaaagcguuuacaugagacu

SEQ ID NO: 955072 - RNA, 18 nt, Homo sapiens
ugaaaggaucucugagac

SEQ ID NO: 955073 - RNA, 16 nt, Homo sapiens
ugaaauucucagaauu

SEQ ID NO: 955074 - RNA, 14 nt, Homo sapiens
ugaaauuuacaguu

SEQ ID NO: 955075 - RNA, 22 nt, Homo sapiens
ugaaauuuuuaaaucauuucau

SEQ ID NO: 955076 - RNA, 18 nt, Homo sapiens
ugaacaagauuucccuaa

SEQ ID NO: 955077 - RNA, 20 nt, Homo sapiens
ugaacaugcucauguguaca

SEQ ID NO: 955078 - RNA, 16 nt, Homo sapiens
ugaaccgucaauguga

SEQ ID NO: 955079 - RNA, 17 nt, Homo sapiens
ugaaccguuacaaaaga

SEQ ID NO: 955080 - RNA, 14 nt, Homo sapiens
ugaacucaaugcau

SEQ ID NO: 955081 - RNA, 23 nt, Homo sapiens
ugaagaaagucagcucuugucaa

SEQ ID NO: 955082 - RNA, 14 nt, Homo sapiens
ugaagaaggucuca

SEQ ID NO: 955083 - RNA, 16 nt, Homo sapiens
ugaagaauauuguuaa

SEQ ID NO: 955084 - RNA, 17 nt, Homo sapiens
ugaagauguuuguguau

SEQ ID NO: 955085 - RNA, 18 nt, Homo sapiens
ugaagauucgcagcauuc

SEQ ID NO: 955086 - RNA, 20 nt, Homo sapiens
ugaagguuuauacuaauuca

SEQ ID NO: 955087 - RNA, 16 nt, Homo sapiens
ugaaguggugugaucc

SEQ ID NO: 955088 - RNA, 20 nt, Homo sapiens
ugaauaagaaaaacaauuga

SEQ ID NO: 955089 - RNA, 18 nt, Homo sapiens
ugaauacgucuugaucag

SEQ ID NO: 955090 - RNA, 18 nt, Homo sapiens
ugaauauauacauaaaaa

SEQ ID NO: 955091 - RNA, 20 nt, Homo sapiens
ugaaucaguaugaagacacu

SEQ ID NO: 955092 - RNA, 19 nt, Homo sapiens
ugaaucuguuucuaugucc

SEQ ID NO: 955093 - RNA, 15 nt, Homo sapiens
ugaaugaugccauga

SEQ ID NO: 955094 - RNA, 18 nt, Homo sapiens
ugacaagccaaugugaau

SEQ ID NO: 955095 - RNA, 11 nt, Homo sapiens
ugacagaugau

SEQ ID NO: 955096 - RNA, 17 nt, Homo sapiens
ugacaucgguucaggag

SEQ ID NO: 955097 - RNA, 19 nt, Homo sapiens
ugaccuugaaugaugccau

SEQ ID NO: 955098 - RNA, 13 nt, Homo sapiens
ugacucagcacug

SEQ ID NO: 955099 - RNA, 21 nt, Homo sapiens
ugacugcugugggcugcucac

SEQ ID NO: 955100 - RNA, 22 nt, Homo sapiens
ugagaacagacguuaccaauua

SEQ ID NO: 955101 - RNA, 16 nt, Homo sapiens
ugagaauuuguuuuca

SEQ ID NO: 955102 - RNA, 14 nt, Homo sapiens
ugagagucugagaa

SEQ ID NO: 955103 - RNA, 14 nt, Homo sapiens
ugagauacauuuga

SEQ ID NO: 955104 - RNA, 16 nt, Homo sapiens
ugagauuguacauuuu

SEQ ID NO: 955105 - RNA, 18 nt, Homo sapiens
ugagcaagucccaucuca

SEQ ID NO: 955106 - RNA, 15 nt, Homo sapiens
ugagcauaccugucu

SEQ ID NO: 955107 - RNA, 22 nt, Homo sapiens
ugagccaaagcuuaugugacau

SEQ ID NO: 955108 - RNA, 21 nt, Homo sapiens
ugagcuggucaguugccaaag

SEQ ID NO: 955109 - RNA, 12 nt, Homo sapiens
ugaggaccugcg

SEQ ID NO: 955110 - RNA, 17 nt, Homo sapiens
ugaggagugaugggcaa

SEQ ID NO: 955111 - RNA, 22 nt, Homo sapiens
ugaggcaggagggcaugugcag

SEQ ID NO: 955112 - RNA, 14 nt, Homo sapiens
ugagugaauguuaa

SEQ ID NO: 955113 - RNA, 20 nt, Homo sapiens
ugagugaauguuaacaugcg

SEQ ID NO: 955114 - RNA, 21 nt, Homo sapiens
ugaguucaagcaauccaccuu

SEQ ID NO: 955115 - RNA, 19 nt, Homo sapiens
ugauauaauaauuacuuaa

SEQ ID NO: 955116 - RNA, 16 nt, Homo sapiens
ugaucaguugccaaag

SEQ ID NO: 955117 - RNA, 18 nt, Homo sapiens
ugaugagauacauuugau

SEQ ID NO: 955118 - RNA, 19 nt, Homo sapiens
ugaugguaacugcacacau

SEQ ID NO: 955119 - RNA, 20 nt, Homo sapiens
ugauuagccucgucuuucag

SEQ ID NO: 955120 - RNA, 20 nt, Homo sapiens
ugauucccagccuguggcag

SEQ ID NO: 955121 - RNA, 17 nt, Homo sapiens
ugauuuacaagcaucau

SEQ ID NO: 955122 - RNA, 12 nt, Homo sapiens
ugcaacacccuc

SEQ ID NO: 955123 - RNA, 16 nt, Homo sapiens
ugcaaggaaauuugca

SEQ ID NO: 955124 - RNA, 18 nt, Homo sapiens
ugcaaggugauauauaau

SEQ ID NO: 955125 - RNA, 20 nt, Homo sapiens
ugcaaggugauauauaauca

SEQ ID NO: 955126 - RNA, 13 nt, Homo sapiens
ugcacacaugcac

SEQ ID NO: 955127 - RNA, 14 nt, Homo sapiens
ugcacacauuuaac

SEQ ID NO: 955128 - RNA, 12 nt, Homo sapiens
ugcacaccugua

SEQ ID NO: 955129 - RNA, 13 nt, Homo sapiens
ugcacaccuguaa

SEQ ID NO: 955130 - RNA, 23 nt, Homo sapiens
ugcacagcuaacauggaaguacu

SEQ ID NO: 955131 - RNA, 17 nt, Homo sapiens
ugcacgcuugcacacau

SEQ ID NO: 955132 - RNA, 17 nt, Homo sapiens
ugcagaaauugaccuga

SEQ ID NO: 955133 - RNA, 14 nt, Homo sapiens
ugcagcucaucacc

SEQ ID NO: 955134 - RNA, 17 nt, Homo sapiens
ugcauacucugugcaag

SEQ ID NO: 955135 - RNA, 20 nt, Homo sapiens
ugcaucucuuuagauccaaa

SEQ ID NO: 955136 - RNA, 15 nt, Homo sapiens
ugcaugaagauucga

SEQ ID NO: 955137 - RNA, 21 nt, Homo sapiens
ugcauucauguacuacccuca

SEQ ID NO: 955138 - RNA, 15 nt, Homo sapiens
ugcauuccagcgucu

SEQ ID NO: 955139 - RNA, 15 nt, Homo sapiens
ugccaaaaacaacaa

SEQ ID NO: 955140 - RNA, 20 nt, Homo sapiens
ugccaaaaacuaaaauucaa

SEQ ID NO: 955141 - RNA, 23 nt, Homo sapiens
ugccagguaaagaaaccauggca

SEQ ID NO: 955142 - RNA, 21 nt, Homo sapiens
ugcccaacagggcaaccaaua

SEQ ID NO: 955143 - RNA, 18 nt, Homo sapiens
ugcccaauuucauaacua

SEQ ID NO: 955144 - RNA, 17 nt, Homo sapiens
ugcccacugaacaugcu

SEQ ID NO: 955145 - RNA, 19 nt, Homo sapiens
ugcccacugaacaugcuca

SEQ ID NO: 955146 - RNA, 14 nt, Homo sapiens
ugcccagaauuuca

SEQ ID NO: 955147 - RNA, 15 nt, Homo sapiens
ugcccaguucauccc

SEQ ID NO: 955148 - RNA, 12 nt, Homo sapiens
ugcccugcauuc

SEQ ID NO: 955149 - RNA, 19 nt, Homo sapiens
ugcccuuaaaauaaugauu

SEQ ID NO: 955150 - RNA, 17 nt, Homo sapiens
ugccuccagacuaugca

SEQ ID NO: 955151 - RNA, 22 nt, Homo sapiens
ugccuucuagcuguguccucac

SEQ ID NO: 955152 - RNA, 14 nt, Homo sapiens
ugcggcaucuccau

SEQ ID NO: 955153 - RNA, 14 nt, Homo sapiens
ugcuaaaaauaacu

SEQ ID NO: 955154 - RNA, 16 nt, Homo sapiens
ugcuaaguggaagaca

SEQ ID NO: 955155 - RNA, 17 nt, Homo sapiens
ugcuaauagaaaacugu

SEQ ID NO: 955156 - RNA, 17 nt, Homo sapiens
ugcuauauuugcuaaua

SEQ ID NO: 955157 - RNA, 21 nt, Homo sapiens
ugcuauccaaucucaucucuu

SEQ ID NO: 955158 - RNA, 22 nt, Homo sapiens
ugcuauggaaauaaaaggcauu

SEQ ID NO: 955159 - RNA, 13 nt, Homo sapiens
ugcucacugcuca

SEQ ID NO: 955160 - RNA, 15 nt, Homo sapiens
ugcucacugcucaca

SEQ ID NO: 955161 - RNA, 16 nt, Homo sapiens
ugcucacuggcuuuag

SEQ ID NO: 955162 - RNA, 19 nt, Homo sapiens
ugcucccugucuauguauu

SEQ ID NO: 955163 - RNA, 24 nt, Homo sapiens
ugcucucgggugcccugcauucac

SEQ ID NO: 955164 - RNA, 12 nt, Homo sapiens
ugcucuuuccac

SEQ ID NO: 955165 - RNA, 21 nt, Homo sapiens
ugcugcaccucucuucugcac

SEQ ID NO: 955166 - RNA, 11 nt, Homo sapiens
ugcugugacaa

SEQ ID NO: 955167 - RNA, 20 nt, Homo sapiens
ugcuuccuuuucagcauggu

SEQ ID NO: 955168 - RNA, 21 nt, Homo sapiens
ugcuugaguggacagcagcug

SEQ ID NO: 955169 - RNA, 19 nt, Homo sapiens
ugcuuugcggcaucuccau

SEQ ID NO: 955170 - RNA, 20 nt, Homo sapiens
ugcuuugggcagaggcagcu

SEQ ID NO: 955171 - RNA, 19 nt, Homo sapiens
uggaaauccuguuacuuaa

SEQ ID NO: 955172 - RNA, 19 nt, Homo sapiens
uggaccacuguuucuugcu

SEQ ID NO: 955173 - RNA, 14 nt, Homo sapiens
uggaccaugaauga

SEQ ID NO: 955174 - RNA, 15 nt, Homo sapiens
uggaccuaucuguaa

SEQ ID NO: 955175 - RNA, 15 nt, Homo sapiens
uggaccugggguccc

SEQ ID NO: 955176 - RNA, 20 nt, Homo sapiens
uggagaaggagaaccgugaa

SEQ ID NO: 955177 - RNA, 23 nt, Homo sapiens
uggagaauuccaguuguauuuga

SEQ ID NO: 955178 - RNA, 21 nt, Homo sapiens
uggagagaaguugcccuccag

SEQ ID NO: 955179 - RNA, 23 nt, Homo sapiens
uggagagaugucuguucuaaguc

SEQ ID NO: 955180 - RNA, 18 nt, Homo sapiens
uggagauuaaucuaccau

SEQ ID NO: 955181 - RNA, 16 nt, Homo sapiens
uggagcuggcacugug

SEQ ID NO: 955182 - RNA, 20 nt, Homo sapiens
uggauaauaacuagaucucc

SEQ ID NO: 955183 - RNA, 20 nt, Homo sapiens
uggauccgugacagcacuuu

SEQ ID NO: 955184 - RNA, 19 nt, Homo sapiens
uggauuuucuuucuaugua

SEQ ID NO: 955185 - RNA, 16 nt, Homo sapiens
uggcagacuuacaaag

SEQ ID NO: 955186 - RNA, 16 nt, Homo sapiens
uggcagcagaauguuc

SEQ ID NO: 955187 - RNA, 14 nt, Homo sapiens
uggcagcgccuccc

SEQ ID NO: 955188 - RNA, 20 nt, Homo sapiens
uggcauuuucuaugguuaca

SEQ ID NO: 955189 - RNA, 22 nt, Homo sapiens
uggcauuuuggcucagagucca

SEQ ID NO: 955190 - RNA, 20 nt, Homo sapiens
uggccaucacuuucauucaa

SEQ ID NO: 955191 - RNA, 21 nt, Homo sapiens
uggccaucacuuucauucaau

SEQ ID NO: 955192 - RNA, 21 nt, Homo sapiens
uggcccgagagcugggacuca

SEQ ID NO: 955193 - RNA, 19 nt, Homo sapiens
uggcccuguuucuccccac

SEQ ID NO: 955194 - RNA, 20 nt, Homo sapiens
uggccucccuuugugugcau

SEQ ID NO: 955195 - RNA, 15 nt, Homo sapiens
uggccugaaaccagu

SEQ ID NO: 955196 - RNA, 14 nt, Homo sapiens
uggcuaacauagca

SEQ ID NO: 955197 - RNA, 18 nt, Homo sapiens
uggcuugaagcugcucac

SEQ ID NO: 955198 - RNA, 19 nt, Homo sapiens
ugggaagaaagauucaauu

SEQ ID NO: 955199 - RNA, 18 nt, Homo sapiens
ugggcaacaagagcaaaa

SEQ ID NO: 955200 - RNA, 23 nt, Homo sapiens
ugggcccugguucccccaggacc

SEQ ID NO: 955201 - RNA, 19 nt, Homo sapiens
ugggcuauaaaagauuccu

SEQ ID NO: 955202 - RNA, 20 nt, Homo sapiens
ugggcucuggguucgggaag

SEQ ID NO: 955203 - RNA, 17 nt, Homo sapiens
ugggcuggagcaguuug

SEQ ID NO: 955204 - RNA, 16 nt, Homo sapiens
uggggcaggggguucu

SEQ ID NO: 955205 - RNA, 22 nt, Homo sapiens
uggggccacacguuugccaaau

SEQ ID NO: 955206 - RNA, 18 nt, Homo sapiens
uggggcucgaugguuacc

SEQ ID NO: 955207 - RNA, 15 nt, Homo sapiens
ugggucagcuugaau

SEQ ID NO: 955208 - RNA, 16 nt, Homo sapiens
ugguaauuaaggcauc

SEQ ID NO: 955209 - RNA, 20 nt, Homo sapiens
ugguauccuuacuagauuca

SEQ ID NO: 955210 - RNA, 16 nt, Homo sapiens
uggucaaucaguguua

SEQ ID NO: 955211 - RNA, 15 nt, Homo sapiens
uggucaguugccaaa

SEQ ID NO: 955212 - RNA, 22 nt, Homo sapiens
ugguccugugccccgaccccac

SEQ ID NO: 955213 - RNA, 22 nt, Homo sapiens
uggugaggguccucuuccucaa

SEQ ID NO: 955214 - RNA, 15 nt, Homo sapiens
uggugcugcucugug

SEQ ID NO: 955215 - RNA, 15 nt, Homo sapiens
uggugucucuugggg

SEQ ID NO: 955216 - RNA, 19 nt, Homo sapiens
uggugugaggcccccggag

SEQ ID NO: 955217 - RNA, 14 nt, Homo sapiens
ugguguucccaaga

SEQ ID NO: 955218 - RNA, 18 nt, Homo sapiens
ugguuaguguacuuugaa

SEQ ID NO: 955219 - RNA, 22 nt, Homo sapiens
uguaaauaaugcuuaacauaaa

SEQ ID NO: 955220 - RNA, 18 nt, Homo sapiens
uguaaugcacuccugccc

SEQ ID NO: 955221 - RNA, 19 nt, Homo sapiens
uguacagaaacaacugcca

SEQ ID NO: 955222 - RNA, 12 nt, Homo sapiens
uguacaucagac

SEQ ID NO: 955223 - RNA, 14 nt, Homo sapiens
uguacccuacccug

SEQ ID NO: 955224 - RNA, 16 nt, Homo sapiens
uguacccuccauguac

SEQ ID NO: 955225 - RNA, 21 nt, Homo sapiens
uguacucauccugaauccuua

SEQ ID NO: 955226 - RNA, 12 nt, Homo sapiens
uguauaaaaugg

SEQ ID NO: 955227 - RNA, 22 nt, Homo sapiens
uguauccuggcaaauaauacua

SEQ ID NO: 955228 - RNA, 19 nt, Homo sapiens
uguaucgcugauguucacc

SEQ ID NO: 955229 - RNA, 23 nt, Homo sapiens
uguaucuaaaaaauaacugugca

SEQ ID NO: 955230 - RNA, 17 nt, Homo sapiens
ugucacuaagaauauaa

SEQ ID NO: 955231 - RNA, 13 nt, Homo sapiens
uguccauaagaga

SEQ ID NO: 955232 - RNA, 17 nt, Homo sapiens
ugucccugaagugccag

SEQ ID NO: 955233 - RNA, 18 nt, Homo sapiens
ugucccugaagugccagc

SEQ ID NO: 955234 - RNA, 21 nt, Homo sapiens
uguccuuuuacucagcuuuau

SEQ ID NO: 955235 - RNA, 16 nt, Homo sapiens
ugucuacugcuuggau

SEQ ID NO: 955236 - RNA, 17 nt, Homo sapiens
ugucuuuccuauuugca

SEQ ID NO: 955237 - RNA, 16 nt, Homo sapiens
ugugaaaacagaagaa

SEQ ID NO: 955238 - RNA, 21 nt, Homo sapiens
ugugaagauuauaaaagccaa

SEQ ID NO: 955239 - RNA, 11 nt, Homo sapiens
ugugagcaaag

SEQ ID NO: 955240 - RNA, 18 nt, Homo sapiens
ugugcaaggaaauuugca

SEQ ID NO: 955241 - RNA, 19 nt, Homo sapiens
ugugcauuaccacacucag

SEQ ID NO: 955242 - RNA, 19 nt, Homo sapiens
ugugccaaaaugucaauuu

SEQ ID NO: 955243 - RNA, 22 nt, Homo sapiens
ugugcccacugaacaugcucau

SEQ ID NO: 955244 - RNA, 17 nt, Homo sapiens
ugugcgacuucacaaaa

SEQ ID NO: 955245 - RNA, 22 nt, Homo sapiens
ugugcucuuauccccagcuguu

SEQ ID NO: 955246 - RNA, 12 nt, Homo sapiens
ugugcuuucauc

SEQ ID NO: 955247 - RNA, 15 nt, Homo sapiens
uguggcugauuucaa

SEQ ID NO: 955248 - RNA, 21 nt, Homo sapiens
ugugggaaguuaccuuuuaua

SEQ ID NO: 955249 - RNA, 17 nt, Homo sapiens
ugugggcagaauccuug

SEQ ID NO: 955250 - RNA, 18 nt, Homo sapiens
uguggugcaguaaccauu

SEQ ID NO: 955251 - RNA, 13 nt, Homo sapiens
uguguuucuugcu

SEQ ID NO: 955252 - RNA, 17 nt, Homo sapiens
uguuaaagucuguucca

SEQ ID NO: 955253 - RNA, 18 nt, Homo sapiens
uguucagaauguagcauu

SEQ ID NO: 955254 - RNA, 16 nt, Homo sapiens
uguucauuauuuugau

SEQ ID NO: 955255 - RNA, 20 nt, Homo sapiens
uguucauuauuuugauugau

SEQ ID NO: 955256 - RNA, 12 nt, Homo sapiens
uguucauucaca

SEQ ID NO: 955257 - RNA, 20 nt, Homo sapiens
uguugaccaggcuggaguga

SEQ ID NO: 955258 - RNA, 17 nt, Homo sapiens
uguugaugaagcacauu

SEQ ID NO: 955259 - RNA, 12 nt, Homo sapiens
uguugauuccac

SEQ ID NO: 955260 - RNA, 19 nt, Homo sapiens
uguuggggggccccacgga

SEQ ID NO: 955261 - RNA, 19 nt, Homo sapiens
uguuuacauuuucuuucau

SEQ ID NO: 955262 - RNA, 21 nt, Homo sapiens
uguuuccuguggaaauaugca

SEQ ID NO: 955263 - RNA, 14 nt, Homo sapiens
uguuucuaugucca

SEQ ID NO: 955264 - RNA, 16 nt, Homo sapiens
uguuucugcaguauuc

SEQ ID NO: 955265 - RNA, 16 nt, Homo sapiens
uguuucuuuauggcca

SEQ ID NO: 955266 - RNA, 16 nt, Homo sapiens
uguuugauacaguauu

SEQ ID NO: 955267 - RNA, 21 nt, Homo sapiens
uguuugguggggccauccaca

SEQ ID NO: 955268 - RNA, 17 nt, Homo sapiens
aacuagagacucuguga

SEQ ID NO: 955269 - RNA, 17 nt, Homo sapiens
aacuauacuaccaaaag

SEQ ID NO: 955270 - RNA, 17 nt, Homo sapiens
aacuaugugggucugug

SEQ ID NO: 955271 - RNA, 18 nt, Homo sapiens
aacucaaugcaugaugac

SEQ ID NO: 955272 - RNA, 18 nt, Homo sapiens
aacucacuagaugccaau

SEQ ID NO: 955273 - RNA, 13 nt, Homo sapiens
aacuccuuucuaa

SEQ ID NO: 955274 - RNA, 19 nt, Homo sapiens
aacucugauuaugaauaca

SEQ ID NO: 955275 - RNA, 22 nt, Homo sapiens
aacucuuacggcuaucuaguug

SEQ ID NO: 955276 - RNA, 22 nt, Homo sapiens
aacucuuugcccaguucauccc

SEQ ID NO: 955277 - RNA, 23 nt, Homo sapiens
aacucuuugcccaguucauccca

SEQ ID NO: 955278 - RNA, 20 nt, Homo sapiens
aacugaagugugcugugaca

SEQ ID NO: 955279 - RNA, 23 nt, Homo sapiens
aacuguugucuaguauacaguga

SEQ ID NO: 955280 - RNA, 17 nt, Homo sapiens
aacuuaauucuguuaca

SEQ ID NO: 955281 - RNA, 17 nt, Homo sapiens
aacuuagaaugcuucaa

SEQ ID NO: 955282 - RNA, 15 nt, Homo sapiens
aacuucaacaugcau

SEQ ID NO: 955283 - RNA, 13 nt, Homo sapiens
aagaaacuacccu

SEQ ID NO: 955284 - RNA, 23 nt, Homo sapiens
aagaacaugcuauccaaucucau

SEQ ID NO: 955285 - RNA, 21 nt, Homo sapiens
aagaaccuuuugagugccuua

SEQ ID NO: 955286 - RNA, 19 nt, Homo sapiens
aagaacguacuuucuguua

SEQ ID NO: 955287 - RNA, 16 nt, Homo sapiens
aagaagagcucacuau

SEQ ID NO: 955288 - RNA, 20 nt, Homo sapiens
aagaaugucuccauuguuaa

SEQ ID NO: 955289 - RNA, 16 nt, Homo sapiens
aagacuugaaggcauu

SEQ ID NO: 955290 - RNA, 19 nt, Homo sapiens
aagagcaaaacucagucuc

SEQ ID NO: 955291 - RNA, 20 nt, Homo sapiens
aagagcaaaacucagucuca

SEQ ID NO: 955292 - RNA, 21 nt, Homo sapiens
aagagcaaacaaaaguucugc

SEQ ID NO: 955293 - RNA, 17 nt, Homo sapiens
aagaguguguccacuga

SEQ ID NO: 955294 - RNA, 13 nt, Homo sapiens
aagaucacaaaua

SEQ ID NO: 955295 - RNA, 12 nt, Homo sapiens
aagaugaagcug

SEQ ID NO: 955296 - RNA, 13 nt, Homo sapiens
aagauucaauuaa

SEQ ID NO: 955297 - RNA, 14 nt, Homo sapiens
aagauuuggugggu

SEQ ID NO: 955298 - RNA, 14 nt, Homo sapiens
aagcaucauggauc

SEQ ID NO: 955299 - RNA, 16 nt, Homo sapiens
aagccacuuuccucuu

SEQ ID NO: 955300 - RNA, 19 nt, Homo sapiens
aagcccuuacuuuccuaau

SEQ ID NO: 955301 - RNA, 19 nt, Homo sapiens
aagccugguccccagaaau

SEQ ID NO: 955302 - RNA, 22 nt, Homo sapiens
aagcgaacaaaaaguaauguau

SEQ ID NO: 955303 - RNA, 16 nt, Homo sapiens
aagcuaggccaaugaa

SEQ ID NO: 955304 - RNA, 17 nt, Homo sapiens
aagcucaacuguugcca

SEQ ID NO: 955305 - RNA, 19 nt, Homo sapiens
aagcuggguuugauucaaa

SEQ ID NO: 955306 - RNA, 13 nt, Homo sapiens
aagcugucacuca

SEQ ID NO: 955307 - RNA, 16 nt, Homo sapiens
aagcuguggugugaaa

SEQ ID NO: 955308 - RNA, 22 nt, Homo sapiens
aagcuguggugugaaaauguau

SEQ ID NO: 955309 - RNA, 17 nt, Homo sapiens
aaggacugaucauuuga

SEQ ID NO: 955310 - RNA, 19 nt, Homo sapiens
aaggagaggauuuggcucg

SEQ ID NO: 955311 - RNA, 15 nt, Homo sapiens
aaggaucucugagac

SEQ ID NO: 955312 - RNA, 19 nt, Homo sapiens
aaggccccaccuucuaucu

SEQ ID NO: 955313 - RNA, 17 nt, Homo sapiens
aagggaagagcauguaa

SEQ ID NO: 955314 - RNA, 20 nt, Homo sapiens
aagggcacuaaccccauuca

SEQ ID NO: 955315 - RNA, 19 nt, Homo sapiens
aagggcaggagcucacacc

SEQ ID NO: 955316 - RNA, 18 nt, Homo sapiens
aaggggagaguaacccug

SEQ ID NO: 955317 - RNA, 12 nt, Homo sapiens
aagggucuuccu

SEQ ID NO: 955318 - RNA, 17 nt, Homo sapiens
aagggugccuucuagcu

SEQ ID NO: 955319 - RNA, 13 nt, Homo sapiens
aagguaauacuuu

SEQ ID NO: 955320 - RNA, 11 nt, Homo sapiens
aagguccaaaa

SEQ ID NO: 955321 - RNA, 23 nt, Homo sapiens
aaggucucauuaucuccaugaua

SEQ ID NO: 955322 - RNA, 14 nt, Homo sapiens
aaguauacauuuag

SEQ ID NO: 955323 - RNA, 16 nt, Homo sapiens
aaguauguugguggga

SEQ ID NO: 955324 - RNA, 20 nt, Homo sapiens
aagucaaagcuuugcccuuu

SEQ ID NO: 955325 - RNA, 21 nt, Homo sapiens
aagucacuuaaacucaucuau

SEQ ID NO: 955326 - RNA, 14 nt, Homo sapiens
aagucccaucucac

SEQ ID NO: 955327 - RNA, 19 nt, Homo sapiens
aagucccugagaagccuca

SEQ ID NO: 955328 - RNA, 13 nt, Homo sapiens
aagucuaugcuua

SEQ ID NO: 955329 - RNA, 14 nt, Homo sapiens
aagucuccuuuugu

SEQ ID NO: 955330 - RNA, 14 nt, Homo sapiens
aagugcuccugaaa

SEQ ID NO: 955331 - RNA, 21 nt, Homo sapiens
aagugcugggauuacaggugu

SEQ ID NO: 955332 - RNA, 16 nt, Homo sapiens
aaguggugugauccca

SEQ ID NO: 955333 - RNA, 14 nt, Homo sapiens
aagugucacuaaga

SEQ ID NO: 955334 - RNA, 20 nt, Homo sapiens
aagugugcugugacaagcca

SEQ ID NO: 955335 - RNA, 15 nt, Homo sapiens
aaguuaucauccuau

SEQ ID NO: 955336 - RNA, 23 nt, Homo sapiens
aaguucauccuuugacugugcug

SEQ ID NO: 955337 - RNA, 22 nt, Homo sapiens
aaguugcgcuuaaauaagacaa

SEQ ID NO: 955338 - RNA, 12 nt, Homo sapiens
aauaaaacaaca

SEQ ID NO: 955339 - RNA, 22 nt, Homo sapiens
aauaaacugucuuuuuccucaa

SEQ ID NO: 955340 - RNA, 14 nt, Homo sapiens
aauaaagacucuug

SEQ ID NO: 955341 - RNA, 18 nt, Homo sapiens
aauaaagccacuuuccuc

SEQ ID NO: 955342 - RNA, 22 nt, Homo sapiens
aauaaauuauuuaacuaauuaa

SEQ ID NO: 955343 - RNA, 15 nt, Homo sapiens
aauaacaacaacuua

SEQ ID NO: 955344 - RNA, 14 nt, Homo sapiens
aauaaugaucuucc

SEQ ID NO: 955345 - RNA, 17 nt, Homo sapiens
aauaaugcuuaacauaa

SEQ ID NO: 955346 - RNA, 21 nt, Homo sapiens
aauagcaaaauauuaucugaa

SEQ ID NO: 955347 - RNA, 20 nt, Homo sapiens
aauagcaauagcauggauag

SEQ ID NO: 955348 - RNA, 19 nt, Homo sapiens
aauagguuucaacauauga

SEQ ID NO: 955349 - RNA, 16 nt, Homo sapiens
aauaguuccauucuau

SEQ ID NO: 955350 - RNA, 16 nt, Homo sapiens
aauaguuuucagucuu

SEQ ID NO: 955351 - RNA, 18 nt, Homo sapiens
aauauaaaauacauaaaa

SEQ ID NO: 955352 - RNA, 16 nt, Homo sapiens
aauauacugcauaucc

SEQ ID NO: 955353 - RNA, 23 nt, Homo sapiens
aauauauauauauaucaguuuga

SEQ ID NO: 955354 - RNA, 14 nt, Homo sapiens
aaaucauaacucac

SEQ ID NO: 955355 - RNA, 19 nt, Homo sapiens
aaaugaccaaauccaugga

SEQ ID NO: 955356 - RNA, 18 nt, Homo sapiens
aaaugcaaacacugugua

SEQ ID NO: 955357 - RNA, 16 nt, Homo sapiens
aaauguauuuuucaca

SEQ ID NO: 955358 - RNA, 19 nt, Homo sapiens
aaauguauuuuucacaaag

SEQ ID NO: 955359 - RNA, 22 nt, Homo sapiens
aaauguugacucuuugggagag

SEQ ID NO: 955360 - RNA, 21 nt, Homo sapiens
aaauguuucuuuauggccauu

SEQ ID NO: 955361 - RNA, 18 nt, Homo sapiens
aaauuaccaaacaaagca

SEQ ID NO: 955362 - RNA, 21 nt, Homo sapiens
aaauuagagcaagaacauuca

SEQ ID NO: 955363 - RNA, 22 nt, Homo sapiens
aaauuagagcaagaacauucaa

SEQ ID NO: 955364 - RNA, 18 nt, Homo sapiens
aaauuauucuagucaacu

SEQ ID NO: 955365 - RNA, 18 nt, Homo sapiens
aaauuccuguugucugac

SEQ ID NO: 955366 - RNA, 15 nt, Homo sapiens
aaauuuaacugcaua

SEQ ID NO: 955367 - RNA, 23 nt, Homo sapiens
aaauuuccaggggccucccaagg

SEQ ID NO: 955368 - RNA, 19 nt, Homo sapiens
aaauuuccuccacauucau

SEQ ID NO: 955369 - RNA, 19 nt, Homo sapiens
aaauuuggggacagauuca

SEQ ID NO: 955370 - RNA, 15 nt, Homo sapiens
aacaaacccaaaggu

SEQ ID NO: 955371 - RNA, 16 nt, Homo sapiens
aacaaagcaauuucuc

SEQ ID NO: 955372 - RNA, 16 nt, Homo sapiens
aacaaggaaggacauu

SEQ ID NO: 955373 - RNA, 17 nt, Homo sapiens
aacaagugcucuuucca

SEQ ID NO: 955374 - RNA, 23 nt, Homo sapiens
aacacuaaugaggaaacugcacu

SEQ ID NO: 955375 - RNA, 16 nt, Homo sapiens
aacacuaauggccaag

SEQ ID NO: 955376 - RNA, 13 nt, Homo sapiens
aacacuuauuuuc

SEQ ID NO: 955377 - RNA, 13 nt, Homo sapiens
aacagcuaaucuu

SEQ ID NO: 955378 - RNA, 18 nt, Homo sapiens
aacagggcaaccaauaaa

SEQ ID NO: 955379 - RNA, 14 nt, Homo sapiens
aacaggucacuuga

SEQ ID NO: 955380 - RNA, 15 nt, Homo sapiens
aacagugaaagcccu

SEQ ID NO: 955381 - RNA, 15 nt, Homo sapiens
aacaguuggcuguau

SEQ ID NO: 955382 - RNA, 19 nt, Homo sapiens
aacauagaugcuacaguau

SEQ ID NO: 955383 - RNA, 22 nt, Homo sapiens
aacauagcacaguauuuacugu

SEQ ID NO: 955384 - RNA, 17 nt, Homo sapiens
aacauauucuugcuuuc

SEQ ID NO: 955385 - RNA, 20 nt, Homo sapiens
aacauccacucucucuuguu

SEQ ID NO: 955386 - RNA, 17 nt, Homo sapiens
aacauuucacaguauuu

SEQ ID NO: 955387 - RNA, 23 nt, Homo sapiens
aaccaagaaugucuccauuguua

SEQ ID NO: 955388 - RNA, 21 nt, Homo sapiens
aaccacuuucaccugggauga

SEQ ID NO: 955389 - RNA, 17 nt, Homo sapiens
aaccaucauuuaauuuc

SEQ ID NO: 955390 - RNA, 23 nt, Homo sapiens
aaccauccuuuggggcagcauuc

SEQ ID NO: 955391 - RNA, 22 nt, Homo sapiens
aaccaucuggcagacuuacaaa

SEQ ID NO: 955392 - RNA, 11 nt, Homo sapiens
aaccauggcau

SEQ ID NO: 955393 - RNA, 16 nt, Homo sapiens
aaccauguaaagucau

SEQ ID NO: 955394 - RNA, 22 nt, Homo sapiens
aacccuggaagcuguaugccac

SEQ ID NO: 955395 - RNA, 18 nt, Homo sapiens
aacgacagaagguugcca

SEQ ID NO: 955396 - RNA, 22 nt, Homo sapiens
aacgccuguaggaagaaaaagg

SEQ ID NO: 955397 - RNA, 12 nt, Homo sapiens
aacguggcugcu

SEQ ID NO: 955398 - RNA, 16 nt, Homo sapiens
aacuacccucuggaga

SEQ ID NO: 955399 - RNA, 16 nt, Homo sapiens
aacuagagacucugug

SEQ ID NO: 955400 - RNA, 13 nt, Homo sapiens
uuuccacuauaau

SEQ ID NO: 955401 - RNA, 13 nt, Homo sapiens
uuuccaugauaca

SEQ ID NO: 955402 - RNA, 14 nt, Homo sapiens
uuuccccaauucau

SEQ ID NO: 955403 - RNA, 14 nt, Homo sapiens
uuucccugcugcuu

SEQ ID NO: 955404 - RNA, 20 nt, Homo sapiens
uuuccgugagagucaucuca

SEQ ID NO: 955405 - RNA, 15 nt, Homo sapiens
uuuccuuugaccucu

SEQ ID NO: 955406 - RNA, 20 nt, Homo sapiens
uuucgccaaggcucacaugc

SEQ ID NO: 955407 - RNA, 16 nt, Homo sapiens
uuucuaaauguuucuu

SEQ ID NO: 955408 - RNA, 13 nt, Homo sapiens
uuucuacucgagu

SEQ ID NO: 955409 - RNA, 15 nt, Homo sapiens
uuucucauucuugcc

SEQ ID NO: 955410 - RNA, 20 nt, Homo sapiens
uuucuccagacuuaaaacau

SEQ ID NO: 955411 - RNA, 14 nt, Homo sapiens
uuucucuuccuaaa

SEQ ID NO: 955412 - RNA, 19 nt, Homo sapiens
uuucuucauguucagucac

SEQ ID NO: 955413 - RNA, 23 nt, Homo sapiens
uuucuucauguucagucacaugu

SEQ ID NO: 955414 - RNA, 18 nt, Homo sapiens
uuucuuuaaugucuaaga

SEQ ID NO: 955415 - RNA, 16 nt, Homo sapiens
uuugacucagcacugu

SEQ ID NO: 955416 - RNA, 16 nt, Homo sapiens
uuugauacaguauuau

SEQ ID NO: 955417 - RNA, 17 nt, Homo sapiens
uuugcauggaguauuau

SEQ ID NO: 955418 - RNA, 13 nt, Homo sapiens
uuuggaaauggag

SEQ ID NO: 955419 - RNA, 13 nt, Homo sapiens
uuuggaccacagc

SEQ ID NO: 955420 - RNA, 16 nt, Homo sapiens
uuuggcucagagucca

SEQ ID NO: 955421 - RNA, 23 nt, Homo sapiens
uuuggggaggaguugucuguccu

SEQ ID NO: 955422 - RNA, 15 nt, Homo sapiens
uuuggugaauaaccu

SEQ ID NO: 955423 - RNA, 16 nt, Homo sapiens
uuuguaaccauaugau

SEQ ID NO: 955424 - RNA, 14 nt, Homo sapiens
uuuuagcacaaaga

SEQ ID NO: 955425 - RNA, 13 nt, Homo sapiens
uuuuauaauguca

SEQ ID NO: 955426 - RNA, 13 nt, Homo sapiens
uuuuaucacuugc

SEQ ID NO: 955427 - RNA, 19 nt, Homo sapiens
uuuucaauguacuguauug

SEQ ID NO: 955428 - RNA, 15 nt, Homo sapiens
uuuucuacaguacau

SEQ ID NO: 955429 - RNA, 20 nt, Homo sapiens
uuuucucucuuacugcuuca

SEQ ID NO: 955430 - RNA, 20 nt, Homo sapiens
uuuuucucgaguccaaaauc

SEQ ID NO: 955431 - RNA, 13 nt, Homo sapiens
uuuuucuucccua

SEQ ID NO: 955432 - RNA, 20 nt, Homo sapiens
uuuuucuuuaaucaaaaguc

SEQ ID NO: 955433 - RNA, 21 nt, Homo sapiens
uuuuuguauuuuggcagagau

SEQ ID NO: 955434 - RNA, 21 nt, Homo sapiens
cccuuggaaaugucacugcuu

SEQ ID NO: 955435 - RNA, 17 nt, Homo sapiens
ccgagccgagcucuccu

SEQ ID NO: 955436 - RNA, 16 nt, Homo sapiens
ccgaggacuccagggg

SEQ ID NO: 955437 - RNA, 12 nt, Homo sapiens
ccgcacaucuca

SEQ ID NO: 955438 - RNA, 18 nt, Homo sapiens
ccggagagagauggcuca

SEQ ID NO: 955439 - RNA, 14 nt, Homo sapiens
ccggcuggaccugg

SEQ ID NO: 955440 - RNA, 14 nt, Homo sapiens
ccuaaacucugaaa

SEQ ID NO: 955441 - RNA, 19 nt, Homo sapiens
ccuagggaauggggaaccc

SEQ ID NO: 955442 - RNA, 18 nt, Homo sapiens
ccucaaugaaugggaugu

SEQ ID NO: 955443 - RNA, 20 nt, Homo sapiens
ccucacucagcaccacucaa

SEQ ID NO: 955444 - RNA, 19 nt, Homo sapiens
ccucaugccgcugugucua

SEQ ID NO: 955445 - RNA, 13 nt, Homo sapiens
ccuccaaaacaca

SEQ ID NO: 955446 - RNA, 12 nt, Homo sapiens
ccuccauuucag

SEQ ID NO: 955447 - RNA, 20 nt, Homo sapiens
ccuccugaguagcugggacu

SEQ ID NO: 955448 - RNA, 16 nt, Homo sapiens
ccucgcuccaacucca

SEQ ID NO: 955449 - RNA, 24 nt, Homo sapiens
ccucgcuccaacuccaacauccac

SEQ ID NO: 955450 - RNA, 12 nt, Homo sapiens
ccucucucuaua

SEQ ID NO: 955451 - RNA, 18 nt, Homo sapiens
ccucugcucugugcacuc

SEQ ID NO: 955452 - RNA, 14 nt, Homo sapiens
ccucugggggccug

SEQ ID NO: 955453 - RNA, 23 nt, Homo sapiens
ccucuucagauccuggucugcac

SEQ ID NO: 955454 - RNA, 14 nt, Homo sapiens
ccugaaacacuuuu

SEQ ID NO: 955455 - RNA, 22 nt, Homo sapiens
ccugaagucuuuguacagacaa

SEQ ID NO: 955456 - RNA, 12 nt, Homo sapiens
ccugaccaaagg

SEQ ID NO: 955457 - RNA, 22 nt, Homo sapiens
ccugagagggagagacugcaau

SEQ ID NO: 955458 - RNA, 13 nt, Homo sapiens
ccugagagucuga

SEQ ID NO: 955459 - RNA, 15 nt, Homo sapiens
ccugaggguuuccac

SEQ ID NO: 955460 - RNA, 21 nt, Homo sapiens
ccugcccccagcgugggggug

SEQ ID NO: 955461 - RNA, 17 nt, Homo sapiens
ccugcccccgcucugcc

SEQ ID NO: 955462 - RNA, 15 nt, Homo sapiens
ccugcccucccccac

SEQ ID NO: 955463 - RNA, 21 nt, Homo sapiens
ccugccgacggagccacuggg

SEQ ID NO: 955464 - RNA, 20 nt, Homo sapiens
ccugccuggcggcagggguc

SEQ ID NO: 955465 - RNA, 15 nt, Homo sapiens
ccugccugugaguga

SEQ ID NO: 955466 - RNA, 18 nt, Homo sapiens
ccugcgcaaagggcgggc

SEQ ID NO: 955467 - RNA, 20 nt, Homo sapiens
ccugcuguggagggugccca

SEQ ID NO: 955468 - RNA, 22 nt, Homo sapiens
ccuggacaggcuucgucucaga

SEQ ID NO: 955469 - RNA, 23 nt, Homo sapiens
ccugggaagagggaaggugcacg

SEQ ID NO: 955470 - RNA, 14 nt, Homo sapiens
ccugggguuuccac

SEQ ID NO: 955471 - RNA, 18 nt, Homo sapiens
ccugguggagggugccca

SEQ ID NO: 955472 - RNA, 20 nt, Homo sapiens
ccuguauagaccaugcacag

SEQ ID NO: 955473 - RNA, 22 nt, Homo sapiens
ccugucuggcagucuggagcaa

SEQ ID NO: 955474 - RNA, 19 nt, Homo sapiens
ccuguucuuccuaccaaau

SEQ ID NO: 955475 - RNA, 14 nt, Homo sapiens
ccuguuuccagggu

SEQ ID NO: 955476 - RNA, 14 nt, Homo sapiens
ccuuaggagcaaaa

SEQ ID NO: 955477 - RNA, 15 nt, Homo sapiens
ccuuaggagcaaaau

SEQ ID NO: 955478 - RNA, 20 nt, Homo sapiens
ccuuccaggcguagggccag

SEQ ID NO: 955479 - RNA, 19 nt, Homo sapiens
ccuucccaauaggugaucu

SEQ ID NO: 955480 - RNA, 16 nt, Homo sapiens
ccuucugaagaucuca

SEQ ID NO: 955481 - RNA, 20 nt, Homo sapiens
ccuuggcgcgcagcccggga

SEQ ID NO: 955482 - RNA, 17 nt, Homo sapiens
ccuugggaugggcacag

SEQ ID NO: 955483 - RNA, 22 nt, Homo sapiens
ccuugugggcagaauccuuguc

SEQ ID NO: 955484 - RNA, 19 nt, Homo sapiens
ccuuguugaugaagcacau

SEQ ID NO: 955485 - RNA, 16 nt, Homo sapiens
ccuuuaggccaucuca

SEQ ID NO: 955486 - RNA, 20 nt, Homo sapiens
ccuuucacacuguggugucu

SEQ ID NO: 955487 - RNA, 12 nt, Homo sapiens
ccuuucugggaa

SEQ ID NO: 955488 - RNA, 20 nt, Homo sapiens
ccuuugcuuuacagcacugu

SEQ ID NO: 955489 - RNA, 16 nt, Homo sapiens
ccuuugggacuaagcu

SEQ ID NO: 955490 - RNA, 14 nt, Homo sapiens
ccuuuuaaaacaau

SEQ ID NO: 955491 - RNA, 15 nt, Homo sapiens
ccuuuuacucagcuu

SEQ ID NO: 955492 - RNA, 18 nt, Homo sapiens
cgaaaucuuagugcccac

SEQ ID NO: 955493 - RNA, 22 nt, Homo sapiens
cgaagaccuucugaagaucuca

SEQ ID NO: 955494 - RNA, 18 nt, Homo sapiens
cgacagaagguugccagg

SEQ ID NO: 955495 - RNA, 18 nt, Homo sapiens
cgacugcucugauggcac

SEQ ID NO: 955496 - RNA, 16 nt, Homo sapiens
cgagaggcaauucagu

SEQ ID NO: 955497 - RNA, 17 nt, Homo sapiens
cgagcaccugugcccau

SEQ ID NO: 955498 - RNA, 15 nt, Homo sapiens
cgagccgagcucucc

SEQ ID NO: 955499 - RNA, 18 nt, Homo sapiens
cgaggccuggcucuggag

SEQ ID NO: 955500 - RNA, 12 nt, Homo sapiens
cgaugugcccag

SEQ ID NO: 955501 - RNA, 21 nt, Homo sapiens
cgcccuguguccacagugauu

SEQ ID NO: 955502 - RNA, 13 nt, Homo sapiens
cgcgcaccgccca

SEQ ID NO: 955503 - RNA, 11 nt, Homo sapiens
cgcguauuuca

SEQ ID NO: 955504 - RNA, 15 nt, Homo sapiens
cgcgugcaugcacac

SEQ ID NO: 955505 - RNA, 23 nt, Homo sapiens
cgcugugguuucucguacuuuca

SEQ ID NO: 955506 - RNA, 18 nt, Homo sapiens
cgcuguguccccgcgggc

SEQ ID NO: 955507 - RNA, 20 nt, Homo sapiens
cuggucaguugccaaaggag

SEQ ID NO: 955508 - RNA, 23 nt, Homo sapiens
cuggugaggguccucuuccucaa

SEQ ID NO: 955509 - RNA, 21 nt, Homo sapiens
cugguucccccaggacccuga

SEQ ID NO: 955510 - RNA, 16 nt, Homo sapiens
cugguugccaaauacu

SEQ ID NO: 955511 - RNA, 15 nt, Homo sapiens
cuguaccauccaugg

SEQ ID NO: 955512 - RNA, 16 nt, Homo sapiens
cuguacucacugagua

SEQ ID NO: 955513 - RNA, 18 nt, Homo sapiens
cuguagauacaggggcaa

SEQ ID NO: 955514 - RNA, 19 nt, Homo sapiens
cugucaauacagguuuuau

SEQ ID NO: 955515 - RNA, 23 nt, Homo sapiens
cugucaggcaguagcagcugugu

SEQ ID NO: 955516 - RNA, 12 nt, Homo sapiens
cuguccacgugg

SEQ ID NO: 955517 - RNA, 22 nt, Homo sapiens
cuguccagcaggggucucccaa

SEQ ID NO: 955518 - RNA, 20 nt, Homo sapiens
cuguccccgagccgagcucu

SEQ ID NO: 955519 - RNA, 18 nt, Homo sapiens
cugucuauugucacauga

SEQ ID NO: 955520 - RNA, 15 nt, Homo sapiens
cugucuuuuuccuca

SEQ ID NO: 955521 - RNA, 20 nt, Homo sapiens
cugugcaaaauaaaaugagu

SEQ ID NO: 955522 - RNA, 15 nt, Homo sapiens
cugugcucuccuaga

SEQ ID NO: 955523 - RNA, 21 nt, Homo sapiens
cuguggaacacuaaagagcua

SEQ ID NO: 955524 - RNA, 17 nt, Homo sapiens
cuguggagggugcccag

SEQ ID NO: 955525 - RNA, 14 nt, Homo sapiens
cuguggccauuugu

SEQ ID NO: 955526 - RNA, 13 nt, Homo sapiens
cuguguccccgcg

SEQ ID NO: 955527 - RNA, 21 nt, Homo sapiens
cuguguugugauuccccggag

SEQ ID NO: 955528 - RNA, 15 nt, Homo sapiens
cuguuacuccaaaaa

SEQ ID NO: 955529 - RNA, 13 nt, Homo sapiens
cuguuagcauuau

SEQ ID NO: 955530 - RNA, 17 nt, Homo sapiens
cuguucgaguagcucag

SEQ ID NO: 955531 - RNA, 14 nt, Homo sapiens
cuguugcuugaaua

SEQ ID NO: 955532 - RNA, 19 nt, Homo sapiens
cuguugcuugaauagcaau

SEQ ID NO: 955533 - RNA, 18 nt, Homo sapiens
cuguuuaauuccuggaaa

SEQ ID NO: 955534 - RNA, 13 nt, Homo sapiens
cuguuucagaaau

SEQ ID NO: 955535 - RNA, 19 nt, Homo sapiens
cuguuuggccaaugugcau

SEQ ID NO: 955536 - RNA, 15 nt, Homo sapiens
cuguuuucaucacaa

SEQ ID NO: 955537 - RNA, 20 nt, Homo sapiens
cuguuuugcauggaguauua

SEQ ID NO: 955538 - RNA, 21 nt, Homo sapiens
cuguuuugcauggaguauuau

SEQ ID NO: 955539 - RNA, 23 nt, Homo sapiens
cuuaaagccuuuuccugaauugg

SEQ ID NO: 955540 - RNA, 18 nt, Homo sapiens
cuuaauuaugcuaacaaa

SEQ ID NO: 955541 - RNA, 14 nt, Homo sapiens
cuuacuagauucau

SEQ ID NO: 955542 - RNA, 21 nt, Homo sapiens
cuuagagcacuagaagcacag

SEQ ID NO: 955543 - RNA, 13 nt, Homo sapiens
cuuaggagcaaaa

SEQ ID NO: 955544 - RNA, 16 nt, Homo sapiens
cuuaguaauagaucac

SEQ ID NO: 955545 - RNA, 15 nt, Homo sapiens
cuuagugugugcaau

SEQ ID NO: 955546 - RNA, 19 nt, Homo sapiens
cuuauaaaaauaaagggaa

SEQ ID NO: 955547 - RNA, 14 nt, Homo sapiens
cuuaugaaaacacc

SEQ ID NO: 955548 - RNA, 19 nt, Homo sapiens
cuuauuuaaucuguacuau

SEQ ID NO: 955549 - RNA, 12 nt, Homo sapiens
cuucaacuaauu

SEQ ID NO: 955550 - RNA, 23 nt, Homo sapiens
cuucaaguuuagugcaugcaucu

SEQ ID NO: 955551 - RNA, 18 nt, Homo sapiens
cuucauaauuuccaugau

SEQ ID NO: 955552 - RNA, 12 nt, Homo sapiens
cuuccacaaaca

SEQ ID NO: 955553 - RNA, 21 nt, Homo sapiens
cuuccuccggcuggaccuggg

SEQ ID NO: 955554 - RNA, 16 nt, Homo sapiens
cuuccucgaggucaua

SEQ ID NO: 955555 - RNA, 21 nt, Homo sapiens
cuucgggggcggcucugggaa

SEQ ID NO: 955556 - RNA, 17 nt, Homo sapiens
cuucuaucaaagcacau

SEQ ID NO: 955557 - RNA, 23 nt, Homo sapiens
cuucucaguagaaaggaacagaa

SEQ ID NO: 955558 - RNA, 18 nt, Homo sapiens
cuucucccaagacugcuc

SEQ ID NO: 955559 - RNA, 18 nt, Homo sapiens
cuucugagugaauguuaa

SEQ ID NO: 955560 - RNA, 18 nt, Homo sapiens
cuucuguuucacaguuca

SEQ ID NO: 955561 - RNA, 14 nt, Homo sapiens
cuucuuacuaagcu

SEQ ID NO: 955562 - RNA, 19 nt, Homo sapiens
cuucuuaucacacuugcaa

SEQ ID NO: 955563 - RNA, 21 nt, Homo sapiens
uucauaaaaauaaccaaaaaa

SEQ ID NO: 955564 - RNA, 14 nt, Homo sapiens
uucauaauuuccau

SEQ ID NO: 955565 - RNA, 16 nt, Homo sapiens
uucauagcauccugau

SEQ ID NO: 955566 - RNA, 22 nt, Homo sapiens
uucaugaaauaaagacucuugg

SEQ ID NO: 955567 - RNA, 20 nt, Homo sapiens
uucaugagaggaacuauacu

SEQ ID NO: 955568 - RNA, 17 nt, Homo sapiens
uucauguguggaaaugg

SEQ ID NO: 955569 - RNA, 19 nt, Homo sapiens
uucauguuagucuuaccga

SEQ ID NO: 955570 - RNA, 21 nt, Homo sapiens
uucauguugcaaagaacucca

SEQ ID NO: 955571 - RNA, 14 nt, Homo sapiens
uucauuauuuugau

SEQ ID NO: 955572 - RNA, 11 nt, Homo sapiens
uucauugccuu

SEQ ID NO: 955573 - RNA, 19 nt, Homo sapiens
uuccaaacaauuuagccag

SEQ ID NO: 955574 - RNA, 20 nt, Homo sapiens
uuccagaacgcccugugucc

SEQ ID NO: 955575 - RNA, 15 nt, Homo sapiens
uuccagcgucugcug

SEQ ID NO: 955576 - RNA, 17 nt, Homo sapiens
uuccauguucaccaaga

SEQ ID NO: 955577 - RNA, 13 nt, Homo sapiens
uucccauggaaug

SEQ ID NO: 955578 - RNA, 20 nt, Homo sapiens
uuccccccaucuccauugca

SEQ ID NO: 955579 - RNA, 21 nt, Homo sapiens
uucccgcagcaccagccugag

SEQ ID NO: 955580 - RNA, 14 nt, Homo sapiens
uucccguaugcuuu

SEQ ID NO: 955581 - RNA, 17 nt, Homo sapiens
uuccuaaacucugaaau

SEQ ID NO: 955582 - RNA, 15 nt, Homo sapiens
uuccuccacauucau

SEQ ID NO: 955583 - RNA, 12 nt, Homo sapiens
uuccuccugaca

SEQ ID NO: 955584 - RNA, 13 nt, Homo sapiens
uuccuccugacac

SEQ ID NO: 955585 - RNA, 16 nt, Homo sapiens
uuccuguuuccagggu

SEQ ID NO: 955586 - RNA, 21 nt, Homo sapiens
uucgcuggcugaucauugcag

SEQ ID NO: 955587 - RNA, 17 nt, Homo sapiens
uucuagcuguguccuca

SEQ ID NO: 955588 - RNA, 14 nt, Homo sapiens
uucuaggcuaccag

SEQ ID NO: 955589 - RNA, 14 nt, Homo sapiens
uucuagucucugau

SEQ ID NO: 955590 - RNA, 11 nt, Homo sapiens
uucuauacugu

SEQ ID NO: 955591 - RNA, 17 nt, Homo sapiens
uucuauacuuucucaca

SEQ ID NO: 955592 - RNA, 21 nt, Homo sapiens
uucuauacuuucucacaugug

SEQ ID NO: 955593 - RNA, 15 nt, Homo sapiens
uucucaguuuuggag

SEQ ID NO: 955594 - RNA, 11 nt, Homo sapiens
uucucaucucc

SEQ ID NO: 955595 - RNA, 14 nt, Homo sapiens
uucucauucuugcc

SEQ ID NO: 955596 - RNA, 16 nt, Homo sapiens
uucuccuuguacuuga

SEQ ID NO: 955597 - RNA, 18 nt, Homo sapiens
uucuccuuguacuugaau

SEQ ID NO: 955598 - RNA, 13 nt, Homo sapiens
uucugaauucaua

SEQ ID NO: 955599 - RNA, 17 nt, Homo sapiens
uucugauaagacuggaa

SEQ ID NO: 955600 - RNA, 21 nt, Homo sapiens
uucugggcugauuugggucuc

SEQ ID NO: 955601 - RNA, 20 nt, Homo sapiens
uucuugcuuugaaugcaugu

SEQ ID NO: 955602 - RNA, 22 nt, Homo sapiens
uucuuugaaauucauccuccac

SEQ ID NO: 955603 - RNA, 18 nt, Homo sapiens
uugaaaugccucuugacc

SEQ ID NO: 955604 - RNA, 19 nt, Homo sapiens
uugaagacacguucuugcc

SEQ ID NO: 955605 - RNA, 13 nt, Homo sapiens
uugaagcugcuca

SEQ ID NO: 955606 - RNA, 13 nt, Homo sapiens
uugaauucaauuc

SEQ ID NO: 955607 - RNA, 18 nt, Homo sapiens
uugacgucucuauucugc

SEQ ID NO: 955608 - RNA, 18 nt, Homo sapiens
uugagaaauaaagcacau

SEQ ID NO: 955609 - RNA, 16 nt, Homo sapiens
uugagccaaugacugu

SEQ ID NO: 955610 - RNA, 15 nt, Homo sapiens
uugauaaugaucuga

SEQ ID NO: 955611 - RNA, 19 nt, Homo sapiens
uugauacuuuuauuguuau

SEQ ID NO: 955612 - RNA, 17 nt, Homo sapiens
uugaucagaucuuacaa

SEQ ID NO: 955613 - RNA, 14 nt, Homo sapiens
uugaucaugcugca

SEQ ID NO: 955614 - RNA, 15 nt, Homo sapiens
uugauguucuuucac

SEQ ID NO: 955615 - RNA, 13 nt, Homo sapiens
uugcacacaugca

SEQ ID NO: 955616 - RNA, 16 nt, Homo sapiens
uugcacacguccaugu

SEQ ID NO: 955617 - RNA, 22 nt, Homo sapiens
uugcacgugcucuucuguucuc

SEQ ID NO: 955618 - RNA, 19 nt, Homo sapiens
uugcagugaagauguguaa

SEQ ID NO: 955619 - RNA, 20 nt, Homo sapiens
uugcagugaagauguguaaa

SEQ ID NO: 955620 - RNA, 13 nt, Homo sapiens
uugccaaaggagg

SEQ ID NO: 955621 - RNA, 21 nt, Homo sapiens
uugcgacugcucugauggcac

SEQ ID NO: 955622 - RNA, 14 nt, Homo sapiens
uuggaccacagcau

SEQ ID NO: 955623 - RNA, 14 nt, Homo sapiens
uuggagacaggauu

SEQ ID NO: 955624 - RNA, 11 nt, Homo sapiens
uuggcauuucg

SEQ ID NO: 955625 - RNA, 19 nt, Homo sapiens
uuggccauguucauucaca

SEQ ID NO: 955626 - RNA, 20 nt, Homo sapiens
uugggcuauaaaagauuccu

SEQ ID NO: 955627 - RNA, 13 nt, Homo sapiens
uugggcucugcgu

SEQ ID NO: 955628 - RNA, 20 nt, Homo sapiens
uugggucuguagcaccuugc

SEQ ID NO: 955629 - RNA, 19 nt, Homo sapiens
uuguauaguucacuuacuc

SEQ ID NO: 955630 - RNA, 20 nt, Homo sapiens
uuguauuccucacauucaca

SEQ ID NO: 955631 - RNA, 18 nt, Homo sapiens
uuguauuuuaauaaagau

SEQ ID NO: 955632 - RNA, 20 nt, Homo sapiens
uugugauaaauuugauccca

SEQ ID NO: 955633 - RNA, 15 nt, Homo sapiens
uuguggccucauuca

SEQ ID NO: 955634 - RNA, 17 nt, Homo sapiens
uuguggccucauucagc

SEQ ID NO: 955635 - RNA, 14 nt, Homo sapiens
uuguuaagaguauc

SEQ ID NO: 955636 - RNA, 23 nt, Homo sapiens
uuguuaugugaauugagcacaua

SEQ ID NO: 955637 - RNA, 18 nt, Homo sapiens
uuguugaugaagcacauu

SEQ ID NO: 955638 - RNA, 15 nt, Homo sapiens
uuguuguucauuauu

SEQ ID NO: 955639 - RNA, 21 nt, Homo sapiens
uuuaaaaaaauaacaucugaa

SEQ ID NO: 955640 - RNA, 20 nt, Homo sapiens
uuuaaaacaauauuuauguc

SEQ ID NO: 955641 - RNA, 16 nt, Homo sapiens
uuuaacaguuaugcuu

SEQ ID NO: 955642 - RNA, 23 nt, Homo sapiens
uuuaacccuggauaagucacuua

SEQ ID NO: 955643 - RNA, 14 nt, Homo sapiens
uuuaaucuucacaa

SEQ ID NO: 955644 - RNA, 12 nt, Homo sapiens
uuuacagcacug

SEQ ID NO: 955645 - RNA, 17 nt, Homo sapiens
uuuagaaauuaugcugu

SEQ ID NO: 955646 - RNA, 22 nt, Homo sapiens
uuuagaguaugcaagaagaaua

SEQ ID NO: 955647 - RNA, 19 nt, Homo sapiens
uuuaggucuuugccuucca

SEQ ID NO: 955648 - RNA, 15 nt, Homo sapiens
uuuauuauuaaucuc

SEQ ID NO: 955649 - RNA, 20 nt, Homo sapiens
uuucaaacauugagacugcu

SEQ ID NO: 955650 - RNA, 20 nt, Homo sapiens
uuucaaaugcaguccaguga

SEQ ID NO: 955651 - RNA, 20 nt, Homo sapiens
uuucaauaguacccaaccaa

SEQ ID NO: 955652 - RNA, 11 nt, Homo sapiens
uuucacaucuc

SEQ ID NO: 955653 - RNA, 18 nt, Homo sapiens
uuucacgggcaacacuca

SEQ ID NO: 955654 - RNA, 22 nt, Homo sapiens
uuucacgggcaacacucacugc

SEQ ID NO: 955655 - RNA, 17 nt, Homo sapiens
uuucagucaucaucuca

SEQ ID NO: 955656 - RNA, 18 nt, Homo sapiens
uuucauccaccaauauca

SEQ ID NO: 955657 - RNA, 21 nt, Homo sapiens
uuuccaacaaacuuacuguca

SEQ ID NO: 955658 - RNA, 18 nt, Homo sapiens
uuucccugcauucaccug

SEQ ID NO: 955659 - RNA, 16 nt, Homo sapiens
uuuccugauguugaua

SEQ ID NO: 955660 - RNA, 17 nt, Homo sapiens
uuuccuuucgucugcca

SEQ ID NO: 955661 - RNA, 18 nt, Homo sapiens
uuucucauuuagcauuga

SEQ ID NO: 955662 - RNA, 20 nt, Homo sapiens
uuucuccaucaguucaccuu

SEQ ID NO: 955663 - RNA, 17 nt, Homo sapiens
uuucucucuuacugcuu

SEQ ID NO: 955664 - RNA, 19 nt, Homo sapiens
uuucucuguggccauuugu

SEQ ID NO: 955665 - RNA, 16 nt, Homo sapiens
agcccccuacugagaa

SEQ ID NO: 955666 - RNA, 17 nt, Homo sapiens
agcccugggguuuccac

SEQ ID NO: 955667 - RNA, 19 nt, Homo sapiens
agccuaucaagccuuaggc

SEQ ID NO: 955668 - RNA, 20 nt, Homo sapiens
agccucaugggagucaggga

SEQ ID NO: 955669 - RNA, 17 nt, Homo sapiens
agccucccaaguagcug

SEQ ID NO: 955670 - RNA, 17 nt, Homo sapiens
agccucuaugugcaagg

SEQ ID NO: 955671 - RNA, 20 nt, Homo sapiens
agccugugugaaaauacugg

SEQ ID NO: 955672 - RNA, 23 nt, Homo sapiens
agccuguuuccccaauuccucug

SEQ ID NO: 955673 - RNA, 22 nt, Homo sapiens
agccuuggccauccuggcucag

SEQ ID NO: 955674 - RNA, 16 nt, Homo sapiens
agcggagaggacccca

SEQ ID NO: 955675 - RNA, 13 nt, Homo sapiens
agcguggggcuaa

SEQ ID NO: 955676 - RNA, 22 nt, Homo sapiens
agcuaacauggaaguacuauaa

SEQ ID NO: 955677 - RNA, 12 nt, Homo sapiens
agcuaccaggaa

SEQ ID NO: 955678 - RNA, 22 nt, Homo sapiens
agcuagccaggacacauuucca

SEQ ID NO: 955679 - RNA, 18 nt, Homo sapiens
agcuauaacaacucuauu

SEQ ID NO: 955680 - RNA, 17 nt, Homo sapiens
agcucaacuguugccag

SEQ ID NO: 955681 - RNA, 18 nt, Homo sapiens
agcucaacuguugccagg

SEQ ID NO: 955682 - RNA, 20 nt, Homo sapiens
agcucacauagauaugacuu

SEQ ID NO: 955683 - RNA, 17 nt, Homo sapiens
agcuccuccccugcuac

SEQ ID NO: 955684 - RNA, 22 nt, Homo sapiens
agcuccucugccuuugugcucu

SEQ ID NO: 955685 - RNA, 17 nt, Homo sapiens
agcucuaaagcagagau

SEQ ID NO: 955686 - RNA, 13 nt, Homo sapiens
agcugcucauuuc

SEQ ID NO: 955687 - RNA, 15 nt, Homo sapiens
agcugcuuccagugg

SEQ ID NO: 955688 - RNA, 18 nt, Homo sapiens
agcuggcaaacugugaau

SEQ ID NO: 955689 - RNA, 14 nt, Homo sapiens
agcuggcacugugg

SEQ ID NO: 955690 - RNA, 16 nt, Homo sapiens
agcugggaccacaagu

SEQ ID NO: 955691 - RNA, 13 nt, Homo sapiens
agcugucaggcag

SEQ ID NO: 955692 - RNA, 10 nt, Homo sapiens
agcugugaaa

SEQ ID NO: 955693 - RNA, 23 nt, Homo sapiens
auaacugaugagauacauuugau

SEQ ID NO: 955694 - RNA, 14 nt, Homo sapiens
auaagcuagcauua

SEQ ID NO: 955695 - RNA, 14 nt, Homo sapiens
auaagucacuuaaa

SEQ ID NO: 955696 - RNA, 17 nt, Homo sapiens
auaagugcucaguauug

SEQ ID NO: 955697 - RNA, 18 nt, Homo sapiens
auaagugcucaguauuga

SEQ ID NO: 955698 - RNA, 23 nt, Homo sapiens
auaauaacaacaacuuaaugugc

SEQ ID NO: 955699 - RNA, 18 nt, Homo sapiens
auaauaaccacgauucca

SEQ ID NO: 955700 - RNA, 15 nt, Homo sapiens
auaauaauuacuuaa

SEQ ID NO: 955701 - RNA, 16 nt, Homo sapiens
auaauaauuacuuaau

SEQ ID NO: 955702 - RNA, 12 nt, Homo sapiens
auaauaugcagu

SEQ ID NO: 955703 - RNA, 20 nt, Homo sapiens
auaaugacuuaagcacacuu

SEQ ID NO: 955704 - RNA, 17 nt, Homo sapiens
auacacaagugcacaga

SEQ ID NO: 955705 - RNA, 22 nt, Homo sapiens
auacaggcauacacaugcacgc

SEQ ID NO: 955706 - RNA, 18 nt, Homo sapiens
auacgacacccaguauuu

SEQ ID NO: 955707 - RNA, 21 nt, Homo sapiens
auacuauguaagggcuuuaaa

SEQ ID NO: 955708 - RNA, 17 nt, Homo sapiens
auagaccccaagcauuc

SEQ ID NO: 955709 - RNA, 18 nt, Homo sapiens
auagcacccuuuguuaau

SEQ ID NO: 955710 - RNA, 16 nt, Homo sapiens
auagccacuugcucag

SEQ ID NO: 955711 - RNA, 19 nt, Homo sapiens
auagccacuugcucagcca

SEQ ID NO: 955712 - RNA, 16 nt, Homo sapiens
auaguccuccaaaaca

SEQ ID NO: 955713 - RNA, 18 nt, Homo sapiens
auaguuacuuacugccuu

SEQ ID NO: 955714 - RNA, 17 nt, Homo sapiens
auaguugauauguaaca

SEQ ID NO: 955715 - RNA, 17 nt, Homo sapiens
auaguuuuacauuaaca

SEQ ID NO: 955716 - RNA, 20 nt, Homo sapiens
auauaauauuauacugcuau

SEQ ID NO: 955717 - RNA, 19 nt, Homo sapiens
auauacagaccuccagauu

SEQ ID NO: 955718 - RNA, 16 nt, Homo sapiens
auauacucaguucuca

SEQ ID NO: 955719 - RNA, 13 nt, Homo sapiens
auauacugcauau

SEQ ID NO: 955720 - RNA, 18 nt, Homo sapiens
auauaguuggugcucaau

SEQ ID NO: 955721 - RNA, 18 nt, Homo sapiens
auaucagaguaugucagu

SEQ ID NO: 955722 - RNA, 14 nt, Homo sapiens
auauuacaacacuu

SEQ ID NO: 955723 - RNA, 19 nt, Homo sapiens
auauuagccaaagaggcau

SEQ ID NO: 955724 - RNA, 21 nt, Homo sapiens
auauucagagauguaccaugu

SEQ ID NO: 955725 - RNA, 17 nt, Homo sapiens
auauugcugauggugca

SEQ ID NO: 955726 - RNA, 20 nt, Homo sapiens
auauuuaggcaugagcucuu

SEQ ID NO: 955727 - RNA, 23 nt, Homo sapiens
auauuucauacugaagacacaga

SEQ ID NO: 955728 - RNA, 20 nt, Homo sapiens
auauuucucauuuagcauug

SEQ ID NO: 955729 - RNA, 11 nt, Homo sapiens
aucaacaugca

SEQ ID NO: 955730 - RNA, 16 nt, Homo sapiens
aucaagaugugacaug

SEQ ID NO: 955731 - RNA, 20 nt, Homo sapiens
aucaaugcccaacagggcaa

SEQ ID NO: 955732 - RNA, 20 nt, Homo sapiens
aucacaagucagcacuaccu

SEQ ID NO: 955733 - RNA, 21 nt, Homo sapiens
aucacaagucagcacuaccuc

SEQ ID NO: 955734 - RNA, 15 nt, Homo sapiens
aucacacacaugcac

SEQ ID NO: 955735 - RNA, 13 nt, Homo sapiens
aucacacucucca

SEQ ID NO: 955736 - RNA, 17 nt, Homo sapiens
aucacugcuccugucac

SEQ ID NO: 955737 - RNA, 22 nt, Homo sapiens
aucagaaauuuucuacaguaca

SEQ ID NO: 955738 - RNA, 14 nt, Homo sapiens
aucagaagcacuag

SEQ ID NO: 955739 - RNA, 21 nt, Homo sapiens
aucagaagcacuagugcugcc

SEQ ID NO: 955740 - RNA, 18 nt, Homo sapiens
aucagacauucagagauu

SEQ ID NO: 955741 - RNA, 21 nt, Homo sapiens
aucagggggcaugaagcacau

SEQ ID NO: 955742 - RNA, 13 nt, Homo sapiens
aucaguugccaaa

SEQ ID NO: 955743 - RNA, 13 nt, Homo sapiens
aucauaugugauc

SEQ ID NO: 955744 - RNA, 20 nt, Homo sapiens
aucauggaucaaccaaguua

SEQ ID NO: 955745 - RNA, 16 nt, Homo sapiens
auccacacacagcagc

SEQ ID NO: 955746 - RNA, 23 nt, Homo sapiens
auccacacccucuccuugucaca

SEQ ID NO: 955747 - RNA, 16 nt, Homo sapiens
auccagaggugaggga

SEQ ID NO: 955748 - RNA, 18 nt, Homo sapiens
auccagaguucugugaca

SEQ ID NO: 955749 - RNA, 19 nt, Homo sapiens
auccaguuuaaucuucaca

SEQ ID NO: 955750 - RNA, 14 nt, Homo sapiens
auccauaucagcuc

SEQ ID NO: 955751 - RNA, 18 nt, Homo sapiens
auccauaucagcucugca

SEQ ID NO: 955752 - RNA, 17 nt, Homo sapiens
auccaugcggccggccu

SEQ ID NO: 955753 - RNA, 15 nt, Homo sapiens
auccauguacuuucc

SEQ ID NO: 955754 - RNA, 18 nt, Homo sapiens
aucccucggucagcaccg

SEQ ID NO: 955755 - RNA, 15 nt, Homo sapiens
auccugaccaaagga

SEQ ID NO: 955756 - RNA, 23 nt, Homo sapiens
auccugauuauugaauguuauau

SEQ ID NO: 955757 - RNA, 15 nt, Homo sapiens
auccuuaacugucca

SEQ ID NO: 955758 - RNA, 14 nt, Homo sapiens
auccuuuugcuuca

SEQ ID NO: 955759 - RNA, 18 nt, Homo sapiens
aucuccauuucugcucag

SEQ ID NO: 955760 - RNA, 18 nt, Homo sapiens
aucucugauuaaauuuaa

SEQ ID NO: 955761 - RNA, 18 nt, Homo sapiens
aucugauuugcauauuca

SEQ ID NO: 955762 - RNA, 22 nt, Homo sapiens
aucuguaaauuuaacugcauau

SEQ ID NO: 955763 - RNA, 15 nt, Homo sapiens
aucuguuacuccaaa

SEQ ID NO: 955764 - RNA, 21 nt, Homo sapiens
aucuucucacauagguguugu

SEQ ID NO: 955765 - RNA, 15 nt, Homo sapiens
aucuuggaaucaugc

SEQ ID NO: 955766 - RNA, 17 nt, Homo sapiens
aucuuuagcaguacccu

SEQ ID NO: 955767 - RNA, 14 nt, Homo sapiens
aucuuuccaucuca

SEQ ID NO: 955768 - RNA, 15 nt, Homo sapiens
aucuuuguuccucug

SEQ ID NO: 955769 - RNA, 18 nt, Homo sapiens
augaaaaaauaacacugu

SEQ ID NO: 955770 - RNA, 16 nt, Homo sapiens
augaaaagucauucag

SEQ ID NO: 955771 - RNA, 21 nt, Homo sapiens
augaaaccugugucucugaga

SEQ ID NO: 955772 - RNA, 16 nt, Homo sapiens
augaagaaggucucau

SEQ ID NO: 955773 - RNA, 11 nt, Homo sapiens
augaagcacau

SEQ ID NO: 955774 - RNA, 22 nt, Homo sapiens
augaauagaaaaaaaacaaacc

SEQ ID NO: 955775 - RNA, 12 nt, Homo sapiens
augagaccuccc

SEQ ID NO: 955776 - RNA, 16 nt, Homo sapiens
augaggaaacugcacu

SEQ ID NO: 955777 - RNA, 23 nt, Homo sapiens
augagguccuucuguagugccau

SEQ ID NO: 955778 - RNA, 13 nt, Homo sapiens
augaguuaccuca

SEQ ID NO: 955779 - RNA, 19 nt, Homo sapiens
augauaaaccugccaagag

SEQ ID NO: 955780 - RNA, 21 nt, Homo sapiens
augauaaaccugccaagaguc

SEQ ID NO: 955781 - RNA, 14 nt, Homo sapiens
augauccauuugaa

SEQ ID NO: 955782 - RNA, 18 nt, Homo sapiens
augcacacaggugcacag

SEQ ID NO: 955783 - RNA, 19 nt, Homo sapiens
augcacacaggugcacaga

SEQ ID NO: 955784 - RNA, 15 nt, Homo sapiens
augcagcucaucacc

SEQ ID NO: 955785 - RNA, 17 nt, Homo sapiens
augcauacucugugcaa

SEQ ID NO: 955786 - RNA, 15 nt, Homo sapiens
augcauaugauauau

SEQ ID NO: 955787 - RNA, 16 nt, Homo sapiens
augcaugaagauucga

SEQ ID NO: 955788 - RNA, 18 nt, Homo sapiens
augcauucccuacagauu

SEQ ID NO: 955789 - RNA, 18 nt, Homo sapiens
augccuccugcacacagc

SEQ ID NO: 955790 - RNA, 23 nt, Homo sapiens
augccuuguugaugaagcacauu

SEQ ID NO: 955791 - RNA, 15 nt, Homo sapiens
augcugccaaccagc

SEQ ID NO: 955792 - RNA, 17 nt, Homo sapiens
augcugguacuauugug

SEQ ID NO: 955793 - RNA, 14 nt, Homo sapiens
augcuguucagaaa

SEQ ID NO: 955794 - RNA, 18 nt, Homo sapiens
auggaaauaaaaggcauu

SEQ ID NO: 955795 - RNA, 20 nt, Homo sapiens
auggaaauccuguuacuuaa

SEQ ID NO: 955796 - RNA, 15 nt, Homo sapiens
auggacauuuugggc

SEQ ID NO: 955797 - RNA, 23 nt, Homo sapiens
auggaccacuguuucuugcuugu

SEQ ID NO: 955798 - RNA, 15 nt, Homo sapiens
auggagggagaagaa

SEQ ID NO: 955799 - RNA, 17 nt, Homo sapiens
auggagggugcccagca

SEQ ID NO: 955800 - RNA, 18 nt, Homo sapiens
auggauuuauaucagcua

SEQ ID NO: 955801 - RNA, 19 nt, Homo sapiens
auggcuucuggucaugaaa

SEQ ID NO: 955802 - RNA, 14 nt, Homo sapiens
auggguaaagcaau

SEQ ID NO: 955803 - RNA, 18 nt, Homo sapiens
augguaaagagaugucaa

SEQ ID NO: 955804 - RNA, 15 nt, Homo sapiens
guauuuggaaaccuu

SEQ ID NO: 955805 - RNA, 18 nt, Homo sapiens
guauuuuuccagaauucu

SEQ ID NO: 955806 - RNA, 14 nt, Homo sapiens
gucaagcucuguca

SEQ ID NO: 955807 - RNA, 23 nt, Homo sapiens
gucaauuuuuaacuuaucuccag

SEQ ID NO: 955808 - RNA, 15 nt, Homo sapiens
gucacaugugcucuc

SEQ ID NO: 955809 - RNA, 14 nt, Homo sapiens
gucagcacuaccuc

SEQ ID NO: 955810 - RNA, 12 nt, Homo sapiens
gucaguugccaa

SEQ ID NO: 955811 - RNA, 12 nt, Homo sapiens
gucaucaucuca

SEQ ID NO: 955812 - RNA, 15 nt, Homo sapiens
gucaucccggggcca

SEQ ID NO: 955813 - RNA, 18 nt, Homo sapiens
gucauuccacacauuucc

SEQ ID NO: 955814 - RNA, 13 nt, Homo sapiens
guccaaggucuca

SEQ ID NO: 955815 - RNA, 21 nt, Homo sapiens
guccacugagaagaucaauga

SEQ ID NO: 955816 - RNA, 14 nt, Homo sapiens
guccagaccugggc

SEQ ID NO: 955817 - RNA, 21 nt, Homo sapiens
guccauguuuauccauguacu

SEQ ID NO: 955818 - RNA, 17 nt, Homo sapiens
gucccugaagugccagc

SEQ ID NO: 955819 - RNA, 16 nt, Homo sapiens
guccucacucucgcca

SEQ ID NO: 955820 - RNA, 17 nt, Homo sapiens
guccuccgguugcauac

SEQ ID NO: 955821 - RNA, 20 nt, Homo sapiens
gucuaccagagcgugcacuu

SEQ ID NO: 955822 - RNA, 19 nt, Homo sapiens
gucucauuaucuccaugau

SEQ ID NO: 955823 - RNA, 13 nt, Homo sapiens
gucucugaacugc

SEQ ID NO: 955824 - RNA, 17 nt, Homo sapiens
gucucugauuugcaaau

SEQ ID NO: 955825 - RNA, 17 nt, Homo sapiens
gucuuaguacaccauaa

SEQ ID NO: 955826 - RNA, 22 nt, Homo sapiens
gucuugaucagacauucagaga

SEQ ID NO: 955827 - RNA, 22 nt, Homo sapiens
gugaaacccuacgaaagcacag

SEQ ID NO: 955828 - RNA, 21 nt, Homo sapiens
gugaaguccacuuauguagac

SEQ ID NO: 955829 - RNA, 20 nt, Homo sapiens
gugaauuuuaaaaugcaaau

SEQ ID NO: 955830 - RNA, 16 nt, Homo sapiens
gugacagcacuuuccu

SEQ ID NO: 955831 - RNA, 22 nt, Homo sapiens
gugaguggggaggagacucagg

SEQ ID NO: 955832 - RNA, 22 nt, Homo sapiens
gugcaaaaauaaaauggacaga

SEQ ID NO: 955833 - RNA, 18 nt, Homo sapiens
gugcaaaauaaaaugagu

SEQ ID NO: 955834 - RNA, 21 nt, Homo sapiens
gugcacagaucacacacaugc

SEQ ID NO: 955835 - RNA, 14 nt, Homo sapiens
gugcagacacucaa

SEQ ID NO: 955836 - RNA, 15 nt, Homo sapiens
gugcagcaaccagag

SEQ ID NO: 955837 - RNA, 16 nt, Homo sapiens
gugcauuuaguuuugu

SEQ ID NO: 955838 - RNA, 23 nt, Homo sapiens
gugccucuuuuaaugucaucucu

SEQ ID NO: 955839 - RNA, 12 nt, Homo sapiens
gugcugugacaa

SEQ ID NO: 955840 - RNA, 15 nt, Homo sapiens
guggaaccuagggaa

SEQ ID NO: 955841 - RNA, 16 nt, Homo sapiens
guggagcugcuuccag

SEQ ID NO: 955842 - RNA, 17 nt, Homo sapiens
guggaucuaaauggaag

SEQ ID NO: 955843 - RNA, 14 nt, Homo sapiens
guggccucauucag

SEQ ID NO: 955844 - RNA, 19 nt, Homo sapiens
guggcugaccaggcccugc

SEQ ID NO: 955845 - RNA, 17 nt, Homo sapiens
guggcugcuucauauga

SEQ ID NO: 955846 - RNA, 19 nt, Homo sapiens
guggggcaaugacuuuccu

SEQ ID NO: 955847 - RNA, 18 nt, Homo sapiens
gugguccuuccaccucag

SEQ ID NO: 955848 - RNA, 9 nt, Homo sapiens
gugguggga

SEQ ID NO: 955849 - RNA, 22 nt, Homo sapiens
gugguuauuuucuccaugucug

SEQ ID NO: 955850 - RNA, 20 nt, Homo sapiens
gugguugauaaugaucugaa

SEQ ID NO: 955851 - RNA, 18 nt, Homo sapiens
guguagcucacacacagu

SEQ ID NO: 955852 - RNA, 13 nt, Homo sapiens
gugucugcacagg

SEQ ID NO: 955853 - RNA, 18 nt, Homo sapiens
gugugaaaauacuggaau

SEQ ID NO: 955854 - RNA, 15 nt, Homo sapiens
gugugaaugcacguu

SEQ ID NO: 955855 - RNA, 14 nt, Homo sapiens
gugugcucuuaucc

SEQ ID NO: 955856 - RNA, 22 nt, Homo sapiens
guguggcaaacuugcaguuuaa

SEQ ID NO: 955857 - RNA, 12 nt, Homo sapiens
guguugcaaauu

SEQ ID NO: 955858 - RNA, 15 nt, Homo sapiens
guguuuauugucaaa

SEQ ID NO: 955859 - RNA, 13 nt, Homo sapiens
guuaacuugcaua

SEQ ID NO: 955860 - RNA, 21 nt, Homo sapiens
guuaauacgcaggcaucugau

SEQ ID NO: 955861 - RNA, 14 nt, Homo sapiens
guuaaugugccaaa

SEQ ID NO: 955862 - RNA, 13 nt, Homo sapiens
guuaauucuugcc

SEQ ID NO: 955863 - RNA, 14 nt, Homo sapiens
guuaauucuugcca

SEQ ID NO: 955864 - RNA, 13 nt, Homo sapiens
guuacccauuucu

SEQ ID NO: 955865 - RNA, 22 nt, Homo sapiens
guuacccauuucuuaccaugca

SEQ ID NO: 955866 - RNA, 17 nt, Homo sapiens
guuacuuacugccuuag

SEQ ID NO: 955867 - RNA, 13 nt, Homo sapiens
guuagcaggaaau

SEQ ID NO: 955868 - RNA, 20 nt, Homo sapiens
guuauuuucuuugaaauuca

SEQ ID NO: 955869 - RNA, 23 nt, Homo sapiens
guucuaaggauggaaaggugaca

SEQ ID NO: 955870 - RNA, 18 nt, Homo sapiens
guucuaauccaagggcca

SEQ ID NO: 955871 - RNA, 17 nt, Homo sapiens
guucuuacuuuccugaa

SEQ ID NO: 955872 - RNA, 15 nt, Homo sapiens
guucuuccuaccaaa

SEQ ID NO: 955873 - RNA, 16 nt, Homo sapiens
guugauaaugaucuga

SEQ ID NO: 955874 - RNA, 16 nt, Homo sapiens
guugaugaaauaucaa

SEQ ID NO: 955875 - RNA, 20 nt, Homo sapiens
guugccaggagauggaauau

SEQ ID NO: 955876 - RNA, 12 nt, Homo sapiens
guugcuugaaua

SEQ ID NO: 955877 - RNA, 19 nt, Homo sapiens
guuggcucacaucauguaa

SEQ ID NO: 955878 - RNA, 20 nt, Homo sapiens
guuggucaaaugaccuagaa

SEQ ID NO: 955879 - RNA, 11 nt, Homo sapiens
guugugcucuu

SEQ ID NO: 955880 - RNA, 14 nt, Homo sapiens
guuguucauuauuu

SEQ ID NO: 955881 - RNA, 20 nt, Homo sapiens
guuuacauccagaguucugu

SEQ ID NO: 955882 - RNA, 16 nt, Homo sapiens
guuuauaacacugcuu

SEQ ID NO: 955883 - RNA, 19 nt, Homo sapiens
guuucaccauguugcccag

SEQ ID NO: 955884 - RNA, 23 nt, Homo sapiens
guuucccgcuccaagagaauuca

SEQ ID NO: 955885 - RNA, 16 nt, Homo sapiens
guuucuauguccaaac

SEQ ID NO: 955886 - RNA, 14 nt, Homo sapiens
guuugaagugaauu

SEQ ID NO: 955887 - RNA, 18 nt, Homo sapiens
guuuugaauugucaauau

SEQ ID NO: 955888 - RNA, 17 nt, Homo sapiens
uaaaaaauaacugugca

SEQ ID NO: 955889 - RNA, 21 nt, Homo sapiens
uaaaaacauaaaauauacaaa

SEQ ID NO: 955890 - RNA, 19 nt, Homo sapiens
uaaaaacugcccauuguaa

SEQ ID NO: 955891 - RNA, 15 nt, Homo sapiens
uaaaaauaaagggaa

SEQ ID NO: 955892 - RNA, 15 nt, Homo sapiens
uaaaaccaucuggca

SEQ ID NO: 955893 - RNA, 17 nt, Homo sapiens
uaaaagagguccauuaa

SEQ ID NO: 955894 - RNA, 21 nt, Homo sapiens
uaaaagcagagagaaguacuu

SEQ ID NO: 955895 - RNA, 13 nt, Homo sapiens
uaaaagcauuuaa

SEQ ID NO: 955896 - RNA, 22 nt, Homo sapiens
uaaaauaaauuuguaugcucaa

SEQ ID NO: 955897 - RNA, 15 nt, Homo sapiens
uaaaauggacagaau

SEQ ID NO: 955898 - RNA, 22 nt, Homo sapiens
uaaaauguauuuuucacaaagg

SEQ ID NO: 955899 - RNA, 12 nt, Homo sapiens
uaaaauucauau

SEQ ID NO: 955900 - RNA, 15 nt, Homo sapiens
uaaaauucuagucuc

SEQ ID NO: 955901 - RNA, 20 nt, Homo sapiens
uaaaccagugaacaguguga

SEQ ID NO: 955902 - RNA, 15 nt, Homo sapiens
uaaacuuguguauga

SEQ ID NO: 955903 - RNA, 13 nt, Homo sapiens
uaaagaaaccaug

SEQ ID NO: 955904 - RNA, 20 nt, Homo sapiens
uaaagaauguuuuggaauaa

SEQ ID NO: 955905 - RNA, 16 nt, Homo sapiens
uaaagcaauacugccg

SEQ ID NO: 955906 - RNA, 19 nt, Homo sapiens
uaaaguucauccuuugacu

SEQ ID NO: 955907 - RNA, 21 nt, Homo sapiens
uaaauaaagaagaaaauaacc

SEQ ID NO: 955908 - RNA, 23 nt, Homo sapiens
uaaauaugguuugaagugaauug

SEQ ID NO: 955909 - RNA, 13 nt, Homo sapiens
uaaauauuucaau

SEQ ID NO: 955910 - RNA, 13 nt, Homo sapiens
uaaaucauuucau

SEQ ID NO: 955911 - RNA, 15 nt, Homo sapiens
uaaauccauuuucua

SEQ ID NO: 955912 - RNA, 18 nt, Homo sapiens
uaaaugcaaacacugugu

SEQ ID NO: 955913 - RNA, 12 nt, Homo sapiens
uaaaugcuuuaa

SEQ ID NO: 955914 - RNA, 12 nt, Homo sapiens
uaaauguuauau

SEQ ID NO: 955915 - RNA, 17 nt, Homo sapiens
uaaauuuaauauacugc

SEQ ID NO: 955916 - RNA, 14 nt, Homo sapiens
uaaauuugauccca

SEQ ID NO: 955917 - RNA, 15 nt, Homo sapiens
uaacaagccaaacau

SEQ ID NO: 955918 - RNA, 13 nt, Homo sapiens
uaacacaugcaca

SEQ ID NO: 955919 - RNA, 19 nt, Homo sapiens
uaacauaaacuuguacuua

SEQ ID NO: 955920 - RNA, 17 nt, Homo sapiens
uaacauggaaguacuau

SEQ ID NO: 955921 - RNA, 22 nt, Homo sapiens
uaaccucaauuuauguuaacag

SEQ ID NO: 955922 - RNA, 14 nt, Homo sapiens
uaacuagaguauaa

SEQ ID NO: 955923 - RNA, 15 nt, Homo sapiens
uaacuagaguauaaa

SEQ ID NO: 955924 - RNA, 12 nt, Homo sapiens
uaacugugaaca

SEQ ID NO: 955925 - RNA, 20 nt, Homo sapiens
uaacuuacaagaauggaauu

SEQ ID NO: 955926 - RNA, 17 nt, Homo sapiens
uaacuucucccuucucc

SEQ ID NO: 955927 - RNA, 20 nt, Homo sapiens
uaacuuggcuaacauagcac

SEQ ID NO: 955928 - RNA, 17 nt, Homo sapiens
uaagaaauguaguugau

SEQ ID NO: 955929 - RNA, 19 nt, Homo sapiens
cagcccagacauccuguga

SEQ ID NO: 955930 - RNA, 21 nt, Homo sapiens
cagccccauccuucccgcagc

SEQ ID NO: 955931 - RNA, 16 nt, Homo sapiens
cagccgagcccagggg

SEQ ID NO: 955932 - RNA, 18 nt, Homo sapiens
cagccucacugcaucuuu

SEQ ID NO: 955933 - RNA, 19 nt, Homo sapiens
cagccucacugcaucuuuc

SEQ ID NO: 955934 - RNA, 21 nt, Homo sapiens
cagcggagaggaccccauucu

SEQ ID NO: 955935 - RNA, 12 nt, Homo sapiens
cagcgugggggu

SEQ ID NO: 955936 - RNA, 21 nt, Homo sapiens
cagcuaagcccccuacugaga

SEQ ID NO: 955937 - RNA, 22 nt, Homo sapiens
cagcuaagcccccuacugagaa

SEQ ID NO: 955938 - RNA, 14 nt, Homo sapiens
ucacucacaaaagg

SEQ ID NO: 955939 - RNA, 16 nt, Homo sapiens
ucacugaaaacaguaa

SEQ ID NO: 955940 - RNA, 21 nt, Homo sapiens
ucacugccugcagcugagauu

SEQ ID NO: 955941 - RNA, 14 nt, Homo sapiens
ucacuggaacacua

SEQ ID NO: 955942 - RNA, 19 nt, Homo sapiens
ucacuggcuuuagcugcug

SEQ ID NO: 955943 - RNA, 21 nt, Homo sapiens
ucacuuaaacucaucuaucca

SEQ ID NO: 955944 - RNA, 17 nt, Homo sapiens
ucacuugaucaugcugc

SEQ ID NO: 955945 - RNA, 15 nt, Homo sapiens
ucagaauguagcauu

SEQ ID NO: 955946 - RNA, 19 nt, Homo sapiens
ucagagacauaaucagcug

SEQ ID NO: 955947 - RNA, 12 nt, Homo sapiens
ucagaguucuca

SEQ ID NO: 955948 - RNA, 14 nt, Homo sapiens
ucagcacacaugca

SEQ ID NO: 955949 - RNA, 15 nt, Homo sapiens
ucagcacacaugcau

SEQ ID NO: 955950 - RNA, 20 nt, Homo sapiens
ucagcacuguuuucaucaca

SEQ ID NO: 955951 - RNA, 17 nt, Homo sapiens
ucagcagccucacugca

SEQ ID NO: 955952 - RNA, 14 nt, Homo sapiens
ucaggguauaguca

SEQ ID NO: 955953 - RNA, 20 nt, Homo sapiens
ucaggugguccuuccaccuc

SEQ ID NO: 955954 - RNA, 18 nt, Homo sapiens
ucaguaaucacuuuucag

SEQ ID NO: 955955 - RNA, 17 nt, Homo sapiens
ucaguaugaagacacug

SEQ ID NO: 955956 - RNA, 14 nt, Homo sapiens
ucagucuacacuca

SEQ ID NO: 955957 - RNA, 12 nt, Homo sapiens
ucaguugccaaa

SEQ ID NO: 955958 - RNA, 15 nt, Homo sapiens
ucaguuucacauauu

SEQ ID NO: 955959 - RNA, 23 nt, Homo sapiens
ucauaaagagguaaaaaacuguc

SEQ ID NO: 955960 - RNA, 23 nt, Homo sapiens
ucauaacagaacuuauucuccau

SEQ ID NO: 955961 - RNA, 21 nt, Homo sapiens
ucauaccaauuccaacuuuca

SEQ ID NO: 955962 - RNA, 15 nt, Homo sapiens
ucaucacacucucca

SEQ ID NO: 955963 - RNA, 18 nt, Homo sapiens
ucaucaccacugacagau

SEQ ID NO: 955964 - RNA, 22 nt, Homo sapiens
ucaucacuuaauuacuuacuca

SEQ ID NO: 955965 - RNA, 15 nt, Homo sapiens
ucauccuauugucuu

SEQ ID NO: 955966 - RNA, 20 nt, Homo sapiens
ucauccuuugacugugcugg

SEQ ID NO: 955967 - RNA, 19 nt, Homo sapiens
ucaucucaaacacugcuua

SEQ ID NO: 955968 - RNA, 15 nt, Homo sapiens
ucaucuuaacuuggc

SEQ ID NO: 955969 - RNA, 17 nt, Homo sapiens
ucaugggucugcccuug

SEQ ID NO: 955970 - RNA, 14 nt, Homo sapiens
ucauguugcaaaga

SEQ ID NO: 955971 - RNA, 13 nt, Homo sapiens
ucauuagauuaca

SEQ ID NO: 955972 - RNA, 15 nt, Homo sapiens
ucauuaucuccauga

SEQ ID NO: 955973 - RNA, 21 nt, Homo sapiens
ucauugagaaauaaagcacau

SEQ ID NO: 955974 - RNA, 13 nt, Homo sapiens
ucauuuagcauug

SEQ ID NO: 955975 - RNA, 13 nt, Homo sapiens
ucauuuccuaccc

SEQ ID NO: 955976 - RNA, 18 nt, Homo sapiens
ucauuucuuauuaaccaa

SEQ ID NO: 955977 - RNA, 23 nt, Homo sapiens
ucauuuguuguuguuuuuccuca

SEQ ID NO: 955978 - RNA, 23 nt, Homo sapiens
uccaaacaauuuagccagaaugu

SEQ ID NO: 955979 - RNA, 20 nt, Homo sapiens
uccaaagaguuucugcaaag

SEQ ID NO: 955980 - RNA, 19 nt, Homo sapiens
uccaaauaaguugcgcuua

SEQ ID NO: 955981 - RNA, 12 nt, Homo sapiens
uccaaccuggag

SEQ ID NO: 955982 - RNA, 17 nt, Homo sapiens
uccaacuccaacaucca

SEQ ID NO: 955983 - RNA, 19 nt, Homo sapiens
uccaacuggaaggcuuuau

SEQ ID NO: 955984 - RNA, 19 nt, Homo sapiens
uccaagcugcucauuucac

SEQ ID NO: 955985 - RNA, 17 nt, Homo sapiens
uccaagucaugggagaa

SEQ ID NO: 955986 - RNA, 15 nt, Homo sapiens
uccacacacagcagc

SEQ ID NO: 955987 - RNA, 12 nt, Homo sapiens
uccacacccgcg

SEQ ID NO: 955988 - RNA, 20 nt, Homo sapiens
uccacguaagucacugaaaa

SEQ ID NO: 955989 - RNA, 17 nt, Homo sapiens
uccagaacgcccugugu

SEQ ID NO: 955990 - RNA, 19 nt, Homo sapiens
uccagacuaugcagcucau

SEQ ID NO: 955991 - RNA, 16 nt, Homo sapiens
uccagaggugagggag

SEQ ID NO: 955992 - RNA, 16 nt, Homo sapiens
uccagaggugauggua

SEQ ID NO: 955993 - RNA, 23 nt, Homo sapiens
uccagaggugaugguaacugcac

SEQ ID NO: 955994 - RNA, 17 nt, Homo sapiens
uccagaguucugugaca

SEQ ID NO: 955995 - RNA, 18 nt, Homo sapiens
uccagaguucugugacac

SEQ ID NO: 955996 - RNA, 23 nt, Homo sapiens
uccagauccucuuuccccacuga

SEQ ID NO: 955997 - RNA, 20 nt, Homo sapiens
uccaggacacacugugagga

SEQ ID NO: 955998 - RNA, 21 nt, Homo sapiens
uccaggagcagcgugcaggag

SEQ ID NO: 955999 - RNA, 15 nt, Homo sapiens
uccaguccagugaug

SEQ ID NO: 956000 - RNA, 12 nt, Homo sapiens
uccauauaguuu

SEQ ID NO: 956001 - RNA, 19 nt, Homo sapiens
uccauccacacacagcagc

SEQ ID NO: 956002 - RNA, 18 nt, Homo sapiens
uccauugcauucauguac

SEQ ID NO: 956003 - RNA, 12 nt, Homo sapiens
ucccaaacccuu

SEQ ID NO: 956004 - RNA, 20 nt, Homo sapiens
ucccaauuugaauucaauuc

SEQ ID NO: 956005 - RNA, 16 nt, Homo sapiens
ucccagcucacugcag

SEQ ID NO: 956006 - RNA, 18 nt, Homo sapiens
ucccaggucacaugcacg

SEQ ID NO: 956007 - RNA, 14 nt, Homo sapiens
ucccaucugcuuua

SEQ ID NO: 956008 - RNA, 22 nt, Homo sapiens
ucccauuuguaauguaucuuau

SEQ ID NO: 956009 - RNA, 14 nt, Homo sapiens
uccccaauucaugu

SEQ ID NO: 956010 - RNA, 23 nt, Homo sapiens
uccccagcugggaagaacaugcu

SEQ ID NO: 956011 - RNA, 21 nt, Homo sapiens
uccccauccccagcugggaag

SEQ ID NO: 956012 - RNA, 21 nt, Homo sapiens
ucccccacggccgucccugac

SEQ ID NO: 956013 - RNA, 22 nt, Homo sapiens
ucccugagaagccucaugggag

SEQ ID NO: 956014 - RNA, 21 nt, Homo sapiens
ucccugcuuggcuuaugaaaa

SEQ ID NO: 956015 - RNA, 21 nt, Homo sapiens
ucccuucugauaagacuggaa

SEQ ID NO: 956016 - RNA, 22 nt, Homo sapiens
uccgccauaaccguccugugac

SEQ ID NO: 956017 - RNA, 19 nt, Homo sapiens
uccgugagagucaucucaa

SEQ ID NO: 956018 - RNA, 14 nt, Homo sapiens
uccuaaauuuccag

SEQ ID NO: 956019 - RNA, 19 nt, Homo sapiens
uccuaggggccgagggaaa

SEQ ID NO: 956020 - RNA, 18 nt, Homo sapiens
uccuauguuuguguauag

SEQ ID NO: 956021 - RNA, 20 nt, Homo sapiens
uccucagcagccucacugca

SEQ ID NO: 956022 - RNA, 21 nt, Homo sapiens
uccucagcagccucacugcau

SEQ ID NO: 956023 - RNA, 18 nt, Homo sapiens
uccucauauacuugaaua

SEQ ID NO: 956024 - RNA, 16 nt, Homo sapiens
uccuccccugcuaccu

SEQ ID NO: 956025 - RNA, 14 nt, Homo sapiens
uccuccgguugcau

SEQ ID NO: 956026 - RNA, 22 nt, Homo sapiens
uccucugagccaagacugaggu

SEQ ID NO: 956027 - RNA, 13 nt, Homo sapiens
uccugacacccca

SEQ ID NO: 956028 - RNA, 14 nt, Homo sapiens
uccugaccuacuuc

SEQ ID NO: 956029 - RNA, 18 nt, Homo sapiens
uccugauuucccuaagga

SEQ ID NO: 956030 - RNA, 23 nt, Homo sapiens
uccugcugcucgggaaggccuga

SEQ ID NO: 956031 - RNA, 14 nt, Homo sapiens
uccuggaaaacugg

SEQ ID NO: 956032 - RNA, 22 nt, Homo sapiens
uccugugcaaaaauaaaaugga

SEQ ID NO: 956033 - RNA, 21 nt, Homo sapiens
uccuguguuugcaccaaaaua

SEQ ID NO: 956034 - RNA, 13 nt, Homo sapiens
uccuguugcacug

SEQ ID NO: 956035 - RNA, 14 nt, Homo sapiens
uccuguugcacuga

SEQ ID NO: 956036 - RNA, 21 nt, Homo sapiens
uccuugcugauuugcacacau

SEQ ID NO: 956037 - RNA, 16 nt, Homo sapiens
ucgccaaggcucacau

SEQ ID NO: 956038 - RNA, 19 nt, Homo sapiens
ucgggggcggcucugggaa

SEQ ID NO: 956039 - RNA, 12 nt, Homo sapiens
ucguuacccauu

SEQ ID NO: 956040 - RNA, 23 nt, Homo sapiens
ucguuacccauuucuuaccaugc

SEQ ID NO: 956041 - RNA, 13 nt, Homo sapiens
ucuaaacuuuccc

SEQ ID NO: 956042 - RNA, 16 nt, Homo sapiens
ucuaaauaugcccaau

SEQ ID NO: 956043 - RNA, 13 nt, Homo sapiens
ucuaagacaauca

SEQ ID NO: 956044 - RNA, 23 nt, Homo sapiens
ucuaaugaaaccugugucucuga

SEQ ID NO: 956045 - RNA, 20 nt, Homo sapiens
ucuacaacauaaugauacug

SEQ ID NO: 956046 - RNA, 23 nt, Homo sapiens
ucuacaguacaugacccggauga

SEQ ID NO: 956047 - RNA, 20 nt, Homo sapiens
ucuacuuuccugauguugau

SEQ ID NO: 956048 - RNA, 12 nt, Homo sapiens
ucuagcaguugu

SEQ ID NO: 956049 - RNA, 18 nt, Homo sapiens
ucuagucucugauuugca

SEQ ID NO: 956050 - RNA, 17 nt, Homo sapiens
ucuaguuaccacggcaa

SEQ ID NO: 956051 - RNA, 14 nt, Homo sapiens
ucuauauuucauau

SEQ ID NO: 956052 - RNA, 22 nt, Homo sapiens
aauauauauuauauauaaucua

SEQ ID NO: 956053 - RNA, 13 nt, Homo sapiens
aauaucaaugccc

SEQ ID NO: 956054 - RNA, 13 nt, Homo sapiens
aauaugaaagccu

SEQ ID NO: 956055 - RNA, 15 nt, Homo sapiens
aauaugaaagccuag

SEQ ID NO: 956056 - RNA, 19 nt, Homo sapiens
aauaugaauauauacauaa

SEQ ID NO: 956057 - RNA, 20 nt, Homo sapiens
aauaugcaaccugugcaaaa

SEQ ID NO: 956058 - RNA, 14 nt, Homo sapiens
aauaugcaguuccu

SEQ ID NO: 956059 - RNA, 14 nt, Homo sapiens
aauauugcugaugg

SEQ ID NO: 956060 - RNA, 21 nt, Homo sapiens
aauauuuuuuucuagcuauaa

SEQ ID NO: 956061 - RNA, 23 nt, Homo sapiens
aaucaguaugaagacacugucaa

SEQ ID NO: 956062 - RNA, 19 nt, Homo sapiens
aaucauaacucacuuuaaa

SEQ ID NO: 956063 - RNA, 17 nt, Homo sapiens
aauccaagcugcucauu

SEQ ID NO: 956064 - RNA, 13 nt, Homo sapiens
aauccauuuucua

SEQ ID NO: 956065 - RNA, 16 nt, Homo sapiens
aaucuacgucuuuauu

SEQ ID NO: 956066 - RNA, 15 nt, Homo sapiens
aaucucauuguacaa

SEQ ID NO: 956067 - RNA, 13 nt, Homo sapiens
aaucucuuuccau

SEQ ID NO: 956068 - RNA, 15 nt, Homo sapiens
aaucuguuucuaugu

SEQ ID NO: 956069 - RNA, 13 nt, Homo sapiens
aaugaacauuuaa

SEQ ID NO: 956070 - RNA, 18 nt, Homo sapiens
aaugaagaaggucucauu

SEQ ID NO: 956071 - RNA, 17 nt, Homo sapiens
aaugaaugucaguguga

SEQ ID NO: 956072 - RNA, 22 nt, Homo sapiens
aaugacucuggaaccauccucu

SEQ ID NO: 956073 - RNA, 19 nt, Homo sapiens
aaugaggaaacugcacugu

SEQ ID NO: 956074 - RNA, 23 nt, Homo sapiens
aaugauauaggaaaauacauugu

SEQ ID NO: 956075 - RNA, 20 nt, Homo sapiens
aaugaucagacuugauuuac

SEQ ID NO: 956076 - RNA, 22 nt, Homo sapiens
aaugaucagacuugauuuacaa

SEQ ID NO: 956077 - RNA, 14 nt, Homo sapiens
aaugaucuuccaaa

SEQ ID NO: 956078 - RNA, 15 nt, Homo sapiens
aaugauucaauguga

SEQ ID NO: 956079 - RNA, 21 nt, Homo sapiens
aaugauucaauuaacauauau

SEQ ID NO: 956080 - RNA, 18 nt, Homo sapiens
aaugcacguuucaaagcu

SEQ ID NO: 956081 - RNA, 18 nt, Homo sapiens
aaugcauacucugugcaa

SEQ ID NO: 956082 - RNA, 22 nt, Homo sapiens
aaugcauuauuuugucauaaaa

SEQ ID NO: 956083 - RNA, 23 nt, Homo sapiens
aaugccuuguugaugaagcacau

SEQ ID NO: 956084 - RNA, 15 nt, Homo sapiens
aaugcugcauucuaa

SEQ ID NO: 956085 - RNA, 16 nt, Homo sapiens
aaugcuuucucaugca

SEQ ID NO: 956086 - RNA, 21 nt, Homo sapiens
aauggccaaguguacauuuga

SEQ ID NO: 956087 - RNA, 17 nt, Homo sapiens
aaugggagugaacauuu

SEQ ID NO: 956088 - RNA, 12 nt, Homo sapiens
aaugguauauaa

SEQ ID NO: 956089 - RNA, 22 nt, Homo sapiens
aauguacagaaaauagcuuuua

SEQ ID NO: 956090 - RNA, 19 nt, Homo sapiens
aauguaccauguugcccag

SEQ ID NO: 956091 - RNA, 15 nt, Homo sapiens
aauguauguauauau

SEQ ID NO: 956092 - RNA, 19 nt, Homo sapiens
aauguauuuuucacaaagg

SEQ ID NO: 956093 - RNA, 12 nt, Homo sapiens
aaugucaucucu

SEQ ID NO: 956094 - RNA, 22 nt, Homo sapiens
aauguggcaguccugugccuca

SEQ ID NO: 956095 - RNA, 12 nt, Homo sapiens
aaugugugcaua

SEQ ID NO: 956096 - RNA, 21 nt, Homo sapiens
aauguucccuuaggagcaaaa

SEQ ID NO: 956097 - RNA, 17 nt, Homo sapiens
aauguuucccucaagaa

SEQ ID NO: 956098 - RNA, 23 nt, Homo sapiens
aauguuuccuguggaaauaugca

SEQ ID NO: 956099 - RNA, 19 nt, Homo sapiens
aauuaaaaaauaguugcaa

SEQ ID NO: 956100 - RNA, 20 nt, Homo sapiens
acgguggcucacaccuguaa

SEQ ID NO: 956101 - RNA, 18 nt, Homo sapiens
acgugucugcacaggguc

SEQ ID NO: 956102 - RNA, 14 nt, Homo sapiens
acuaaaaacacugg

SEQ ID NO: 956103 - RNA, 19 nt, Homo sapiens
acuaaaguagaauuaucuc

SEQ ID NO: 956104 - RNA, 16 nt, Homo sapiens
acuaacacaugcacac

SEQ ID NO: 956105 - RNA, 19 nt, Homo sapiens
acuaaguugcuaaccucaa

SEQ ID NO: 956106 - RNA, 23 nt, Homo sapiens
acuaaugaggaaacugcacuguu

SEQ ID NO: 956107 - RNA, 23 nt, Homo sapiens
acuacuugauauaauuacuuaau

SEQ ID NO: 956108 - RNA, 13 nt, Homo sapiens
acuagaagcacag

SEQ ID NO: 956109 - RNA, 16 nt, Homo sapiens
acuagagacucuguga

SEQ ID NO: 956110 - RNA, 11 nt, Homo sapiens
acuagaucucc

SEQ ID NO: 956111 - RNA, 24 nt, Homo sapiens
acuaguaaucuuggcccuauucau

SEQ ID NO: 956112 - RNA, 19 nt, Homo sapiens
acuaguuuuuccugugcaa

SEQ ID NO: 956113 - RNA, 19 nt, Homo sapiens
acuaucgguucaaguugau

SEQ ID NO: 956114 - RNA, 18 nt, Homo sapiens
acuaugcagcucaucacc

SEQ ID NO: 956115 - RNA, 20 nt, Homo sapiens
acuauggucaaaaagugaug

SEQ ID NO: 956116 - RNA, 14 nt, Homo sapiens
acuauuuacaguag

SEQ ID NO: 956117 - RNA, 17 nt, Homo sapiens
acucaagaccaaaugga

SEQ ID NO: 956118 - RNA, 16 nt, Homo sapiens
acucaaugcaugauga

SEQ ID NO: 956119 - RNA, 12 nt, Homo sapiens
acucagcacugu

SEQ ID NO: 956120 - RNA, 21 nt, Homo sapiens
acuccagaauuucccaaagca

SEQ ID NO: 956121 - RNA, 18 nt, Homo sapiens
acuccagauacauacccc

SEQ ID NO: 956122 - RNA, 16 nt, Homo sapiens
acuccauuacuaaaga

SEQ ID NO: 956123 - RNA, 18 nt, Homo sapiens
acucugucacccuagcua

SEQ ID NO: 956124 - RNA, 22 nt, Homo sapiens
acugaaaacaguaaaacaggcu

SEQ ID NO: 956125 - RNA, 15 nt, Homo sapiens
acugaacaugcucau

SEQ ID NO: 956126 - RNA, 21 nt, Homo sapiens
acugaaguauacauuuaguua

SEQ ID NO: 956127 - RNA, 14 nt, Homo sapiens
acugagucucaugg

SEQ ID NO: 956128 - RNA, 20 nt, Homo sapiens
acugagugagcaucauggag

SEQ ID NO: 956129 - RNA, 21 nt, Homo sapiens
acugauaugguucuuauucac

SEQ ID NO: 956130 - RNA, 15 nt, Homo sapiens
acugauguauagcuu

SEQ ID NO: 956131 - RNA, 18 nt, Homo sapiens
acugcugugggcugcuca

SEQ ID NO: 956132 - RNA, 24 nt, Homo sapiens
acugggucuaaagggcuaugccuc

SEQ ID NO: 956133 - RNA, 16 nt, Homo sapiens
acugucauaaucucuu

SEQ ID NO: 956134 - RNA, 18 nt, Homo sapiens
acuguccaguccagugau

SEQ ID NO: 956135 - RNA, 14 nt, Homo sapiens
acuguguacuguau

SEQ ID NO: 956136 - RNA, 15 nt, Homo sapiens
acuguuaaucauggg

SEQ ID NO: 956137 - RNA, 15 nt, Homo sapiens
acuguucuuugcagu

SEQ ID NO: 956138 - RNA, 16 nt, Homo sapiens
acuguugauccugagu

SEQ ID NO: 956139 - RNA, 19 nt, Homo sapiens
acuguuugaaucuugucuc

SEQ ID NO: 956140 - RNA, 18 nt, Homo sapiens
acuuaaacucaucuaucc

SEQ ID NO: 956141 - RNA, 13 nt, Homo sapiens
acuuaagcacacu

SEQ ID NO: 956142 - RNA, 19 nt, Homo sapiens
acuuaagcacacuugacau

SEQ ID NO: 956143 - RNA, 15 nt, Homo sapiens
acuuaucaaaucauu

SEQ ID NO: 956144 - RNA, 19 nt, Homo sapiens
acuuaucuuggaaucaugc

SEQ ID NO: 956145 - RNA, 22 nt, Homo sapiens
acuucgggggcggcucugggaa

SEQ ID NO: 956146 - RNA, 20 nt, Homo sapiens
acuucuaaauuauaccauga

SEQ ID NO: 956147 - RNA, 15 nt, Homo sapiens
acuucuggaauacug

SEQ ID NO: 956148 - RNA, 17 nt, Homo sapiens
acuugaagaaggaaaga

SEQ ID NO: 956149 - RNA, 22 nt, Homo sapiens
acuugcauauuguuggcacaga

SEQ ID NO: 956150 - RNA, 17 nt, Homo sapiens
acuuggcuaacauagca

SEQ ID NO: 956151 - RNA, 22 nt, Homo sapiens
acuuggcuaacauagcacagua

SEQ ID NO: 956152 - RNA, 19 nt, Homo sapiens
acuuguacuuacacugaaa

SEQ ID NO: 956153 - RNA, 13 nt, Homo sapiens
acuuucagcugga

SEQ ID NO: 956154 - RNA, 23 nt, Homo sapiens
acuuucaggggcugacucuccag

SEQ ID NO: 956155 - RNA, 12 nt, Homo sapiens
acuuucauucaa

SEQ ID NO: 956156 - RNA, 14 nt, Homo sapiens
acuuucauucaauu

SEQ ID NO: 956157 - RNA, 21 nt, Homo sapiens
acuuuccagccuguuucccca

SEQ ID NO: 956158 - RNA, 23 nt, Homo sapiens
acuuuccuaauuaaacuaugaug

SEQ ID NO: 956159 - RNA, 23 nt, Homo sapiens
acuuugccuucaaaaaugugcug

SEQ ID NO: 956160 - RNA, 15 nt, Homo sapiens
acuuugguaaugugu

SEQ ID NO: 956161 - RNA, 17 nt, Homo sapiens
acuuugucucugagaac

SEQ ID NO: 956162 - RNA, 18 nt, Homo sapiens
acuuugugagccaaagcu

SEQ ID NO: 956163 - RNA, 19 nt, Homo sapiens
acuuuuagcgguuugcaaa

SEQ ID NO: 956164 - RNA, 23 nt, Homo sapiens
acuuuuucucgaguccaaaauca

SEQ ID NO: 956165 - RNA, 13 nt, Homo sapiens
agaaaacuguggu

SEQ ID NO: 956166 - RNA, 12 nt, Homo sapiens
agaaaagacacu

SEQ ID NO: 956167 - RNA, 14 nt, Homo sapiens
agaaaauagcuuuu

SEQ ID NO: 956168 - RNA, 15 nt, Homo sapiens
agaaaaucacacuua

SEQ ID NO: 956169 - RNA, 22 nt, Homo sapiens
agaaagaggagcgugucucuga

SEQ ID NO: 956170 - RNA, 22 nt, Homo sapiens
agaaaggcucugaagguccaaa

SEQ ID NO: 956171 - RNA, 13 nt, Homo sapiens
agaaaucaugccu

SEQ ID NO: 956172 - RNA, 17 nt, Homo sapiens
agaacaggguuucucag

SEQ ID NO: 956173 - RNA, 12 nt, Homo sapiens
agaaccaaagca

SEQ ID NO: 956174 - RNA, 22 nt, Homo sapiens
agaacucccaggucacaugcac

SEQ ID NO: 956175 - RNA, 19 nt, Homo sapiens
agaacuccuuucuaaggag

SEQ ID NO: 956176 - RNA, 15 nt, Homo sapiens
agaacuuuagcuauu

SEQ ID NO: 956177 - RNA, 20 nt, Homo sapiens
agaagaaguuaucaacaugc

SEQ ID NO: 956178 - RNA, 23 nt, Homo sapiens
agaagaaguuaucaacaugcaca

SEQ ID NO: 956179 - RNA, 18 nt, Homo sapiens
agaagcacgaagcaguua

SEQ ID NO: 956180 - RNA, 18 nt, Homo sapiens
agaaggcaaaguuuccau

SEQ ID NO: 956181 - RNA, 16 nt, Homo sapiens
agaaggugaacuguua

SEQ ID NO: 956182 - RNA, 15 nt, Homo sapiens
agaagguugccaggu

SEQ ID NO: 956183 - RNA, 13 nt, Homo sapiens
agaaguugcccuc

SEQ ID NO: 956184 - RNA, 14 nt, Homo sapiens
agaauauuguuaaa

SEQ ID NO: 956185 - RNA, 18 nt, Homo sapiens
agaaucgaccucacuguc

SEQ ID NO: 956186 - RNA, 11 nt, Homo sapiens
agaauuaucuc

SEQ ID NO: 956187 - RNA, 15 nt, Homo sapiens
agaauuaucucucau

SEQ ID NO: 956188 - RNA, 18 nt, Homo sapiens
agaauugaaaaaccauuu

SEQ ID NO: 956189 - RNA, 18 nt, Homo sapiens
agacacuaguagagcaaa

SEQ ID NO: 956190 - RNA, 20 nt, Homo sapiens
agacagagauggcagagcca

SEQ ID NO: 956191 - RNA, 14 nt, Homo sapiens
agacagggucucac

SEQ ID NO: 956192 - RNA, 15 nt, Homo sapiens
agacauaaucagcug

SEQ ID NO: 956193 - RNA, 17 nt, Homo sapiens
agacccagagagcuuaa

SEQ ID NO: 956194 - RNA, 22 nt, Homo sapiens
agaccccugggggaggcuucca

SEQ ID NO: 956195 - RNA, 19 nt, Homo sapiens
agaccuucugaagaucuca

SEQ ID NO: 956196 - RNA, 18 nt, Homo sapiens
agacgcagagcaaaugag

SEQ ID NO: 956197 - RNA, 15 nt, Homo sapiens
agacgcagauuucag

SEQ ID NO: 956198 - RNA, 21 nt, Homo sapiens
agacguggugugagagggaca

SEQ ID NO: 956199 - RNA, 12 nt, Homo sapiens
agacgugugaga

SEQ ID NO: 956200 - RNA, 12 nt, Homo sapiens
agacuaugcagc

SEQ ID NO: 956201 - RNA, 21 nt, Homo sapiens
agacuaugugucaugauuuca

SEQ ID NO: 956202 - RNA, 17 nt, Homo sapiens
agacugcuagaaccaag

SEQ ID NO: 956203 - RNA, 22 nt, Homo sapiens
agacuguuugaaucuugucuca

SEQ ID NO: 956204 - RNA, 16 nt, Homo sapiens
agacuuaaucauauca

SEQ ID NO: 956205 - RNA, 13 nt, Homo sapiens
agagacaaauagu

SEQ ID NO: 956206 - RNA, 13 nt, Homo sapiens
agagacagggucu

SEQ ID NO: 956207 - RNA, 12 nt, Homo sapiens
agagaccugcug

SEQ ID NO: 956208 - RNA, 23 nt, Homo sapiens
agagaguggcuuugucaguauaa

SEQ ID NO: 956209 - RNA, 16 nt, Homo sapiens
agagaucagaauugaa

SEQ ID NO: 956210 - RNA, 12 nt, Homo sapiens
agagauggcuca

SEQ ID NO: 956211 - RNA, 17 nt, Homo sapiens
agagcaagaacauucaa

SEQ ID NO: 956212 - RNA, 18 nt, Homo sapiens
agagcccuaucuaugucc

SEQ ID NO: 956213 - RNA, 15 nt, Homo sapiens
agagccugugugaaa

SEQ ID NO: 956214 - RNA, 23 nt, Homo sapiens
agaggacggggagauagaacugu

SEQ ID NO: 956215 - RNA, 15 nt, Homo sapiens
agaggggcaaaaaua

SEQ ID NO: 956216 - RNA, 23 nt, Homo sapiens
agugcucuuuccaccccaaaggg

SEQ ID NO: 956217 - RNA, 18 nt, Homo sapiens
agugggagcugucaggca

SEQ ID NO: 956218 - RNA, 22 nt, Homo sapiens
agugguauccuuacuagauuca

SEQ ID NO: 956219 - RNA, 14 nt, Homo sapiens
agugucacuaagaa

SEQ ID NO: 956220 - RNA, 15 nt, Homo sapiens
agugugauguucacu

SEQ ID NO: 956221 - RNA, 21 nt, Homo sapiens
aguguugaucagaucuuacaa

SEQ ID NO: 956222 - RNA, 17 nt, Homo sapiens
aguguugcuauguguac

SEQ ID NO: 956223 - RNA, 17 nt, Homo sapiens
aguuacuguugauccug

SEQ ID NO: 956224 - RNA, 23 nt, Homo sapiens
aguuagcccggccaaggacacug

SEQ ID NO: 956225 - RNA, 21 nt, Homo sapiens
aguucagccugggugugugaa

SEQ ID NO: 956226 - RNA, 23 nt, Homo sapiens
aguucauccuuugacugugcugg

SEQ ID NO: 956227 - RNA, 17 nt, Homo sapiens
aguuccuuucugggaag

SEQ ID NO: 956228 - RNA, 20 nt, Homo sapiens
aguucuccuuguacuugaau

SEQ ID NO: 956229 - RNA, 21 nt, Homo sapiens
aguugaugaccaaucucugug

SEQ ID NO: 956230 - RNA, 16 nt, Homo sapiens
aguugcacauuaggaa

SEQ ID NO: 956231 - RNA, 15 nt, Homo sapiens
aguuguuauauucau

SEQ ID NO: 956232 - RNA, 22 nt, Homo sapiens
aguuuaaaaaaauaacaucuga

SEQ ID NO: 956233 - RNA, 16 nt, Homo sapiens
aguuucaaaauguuaa

SEQ ID NO: 956234 - RNA, 12 nt, Homo sapiens
aguuucacauau

SEQ ID NO: 956235 - RNA, 12 nt, Homo sapiens
aguuucaggcaa

SEQ ID NO: 956236 - RNA, 15 nt, Homo sapiens
aguuuuacaaaccuu

SEQ ID NO: 956237 - RNA, 20 nt, Homo sapiens
aguuuuuccugugcaaaaau

SEQ ID NO: 956238 - RNA, 14 nt, Homo sapiens
auaaaacagauauu

SEQ ID NO: 956239 - RNA, 15 nt, Homo sapiens
auaaaaucuuuccau

SEQ ID NO: 956240 - RNA, 12 nt, Homo sapiens
auaaagauucca

SEQ ID NO: 956241 - RNA, 21 nt, Homo sapiens
auaaauaaagaagaaaauaac

SEQ ID NO: 956242 - RNA, 20 nt, Homo sapiens
auaaauauguguugguacag

SEQ ID NO: 956243 - RNA, 18 nt, Homo sapiens
auaaauguguaaaugugg

SEQ ID NO: 956244 - RNA, 13 nt, Homo sapiens
auaacaagccaaa

SEQ ID NO: 956245 - RNA, 21 nt, Homo sapiens
auaacccgagggacuccagau

SEQ ID NO: 956246 - RNA, 18 nt, Homo sapiens
auaaccugugaauccaau

SEQ ID NO: 956247 - RNA, 20 nt, Homo sapiens
auaacuuuacagauaaccua

SEQ ID NO: 956248 - RNA, 20 nt, Homo sapiens
auaagacaguugggauccaa

SEQ ID NO: 956249 - RNA, 14 nt, Homo sapiens
auaauaauuacuua

SEQ ID NO: 956250 - RNA, 14 nt, Homo sapiens
auaaucucuuucca

SEQ ID NO: 956251 - RNA, 17 nt, Homo sapiens
auaaugacuuaagcaca

SEQ ID NO: 956252 - RNA, 12 nt, Homo sapiens
auaauguuauag

SEQ ID NO: 956253 - RNA, 18 nt, Homo sapiens
auaauuaaaaccaucugg

SEQ ID NO: 956254 - RNA, 17 nt, Homo sapiens
auaauuacuuaaugugg

SEQ ID NO: 956255 - RNA, 16 nt, Homo sapiens
auacacaagugcacag

SEQ ID NO: 956256 - RNA, 12 nt, Homo sapiens
auacacaugcac

SEQ ID NO: 956257 - RNA, 23 nt, Homo sapiens
auacacuguaucuaaaaaauaac

SEQ ID NO: 956258 - RNA, 20 nt, Homo sapiens
auaccauauggaaugccaaa

SEQ ID NO: 956259 - RNA, 22 nt, Homo sapiens
auaccuugcuucuucaccaguu

SEQ ID NO: 956260 - RNA, 13 nt, Homo sapiens
auacuaaccauuu

SEQ ID NO: 956261 - RNA, 22 nt, Homo sapiens
auacuaauuuauaauccacagu

SEQ ID NO: 956262 - RNA, 23 nt, Homo sapiens
auacucaaagaggccaguacuuu

SEQ ID NO: 956263 - RNA, 15 nt, Homo sapiens
auacucugugcaagg

SEQ ID NO: 956264 - RNA, 18 nt, Homo sapiens
auacugguuauaguugau

SEQ ID NO: 956265 - RNA, 21 nt, Homo sapiens
auacuucuuuauucacaguau

SEQ ID NO: 956266 - RNA, 12 nt, Homo sapiens
auagaacugucc

SEQ ID NO: 956267 - RNA, 13 nt, Homo sapiens
auagacaguuugu

SEQ ID NO: 956268 - RNA, 15 nt, Homo sapiens
auagaccaugcacag

SEQ ID NO: 956269 - RNA, 19 nt, Homo sapiens
auagagucaagcucuguca

SEQ ID NO: 956270 - RNA, 13 nt, Homo sapiens
auagcagugcuag

SEQ ID NO: 956271 - RNA, 20 nt, Homo sapiens
auagcuaguauaacuuuaca

SEQ ID NO: 956272 - RNA, 21 nt, Homo sapiens
auaggccacacagcacaugca

SEQ ID NO: 956273 - RNA, 23 nt, Homo sapiens
auagucauguuucugcaguauuc

SEQ ID NO: 956274 - RNA, 17 nt, Homo sapiens
auaguuuuuaaagaucu

SEQ ID NO: 956275 - RNA, 15 nt, Homo sapiens
auauaaccucaaaca

SEQ ID NO: 956276 - RNA, 16 nt, Homo sapiens
auauaauaauuacuua

SEQ ID NO: 956277 - RNA, 13 nt, Homo sapiens
auauaaucauauc

SEQ ID NO: 956278 - RNA, 13 nt, Homo sapiens
auauaauuacuua

SEQ ID NO: 956279 - RNA, 14 nt, Homo sapiens
auauaauuacuuaa

SEQ ID NO: 956280 - RNA, 15 nt, Homo sapiens
auauacaaacaugug

SEQ ID NO: 956281 - RNA, 15 nt, Homo sapiens
auauacuaaccauuu

SEQ ID NO: 956282 - RNA, 21 nt, Homo sapiens
auauauaucaguuugaucaca

SEQ ID NO: 956283 - RNA, 14 nt, Homo sapiens
auaucagaguaugu

SEQ ID NO: 956284 - RNA, 16 nt, Homo sapiens
auauccagucaaagac

SEQ ID NO: 956285 - RNA, 17 nt, Homo sapiens
auauccaguuuaaucuu

SEQ ID NO: 956286 - RNA, 20 nt, Homo sapiens
auaucuugaagaauauuguu

SEQ ID NO: 956287 - RNA, 16 nt, Homo sapiens
auauggaaauccuguu

SEQ ID NO: 956288 - RNA, 21 nt, Homo sapiens
auaugguucuuauucacugag

SEQ ID NO: 956289 - RNA, 14 nt, Homo sapiens
auauguaacauguc

SEQ ID NO: 956290 - RNA, 15 nt, Homo sapiens
auauguacuuuucca

SEQ ID NO: 956291 - RNA, 14 nt, Homo sapiens
auauguagcauuaa

SEQ ID NO: 956292 - RNA, 13 nt, Homo sapiens
auauguugcugaa

SEQ ID NO: 956293 - RNA, 15 nt, Homo sapiens
auauuuaaaauucau

SEQ ID NO: 956294 - RNA, 23 nt, Homo sapiens
auauuuauuugacucagcacugu

SEQ ID NO: 956295 - RNA, 21 nt, Homo sapiens
auauuucaauaacuuagaaug

SEQ ID NO: 956296 - RNA, 22 nt, Homo sapiens
aucaacauucccccaacauuac

SEQ ID NO: 956297 - RNA, 22 nt, Homo sapiens
aucaauuuaaaggaaaguucua

SEQ ID NO: 956298 - RNA, 17 nt, Homo sapiens
aucacacacaugcacac

SEQ ID NO: 956299 - RNA, 14 nt, Homo sapiens
aucacacucuccau

SEQ ID NO: 956300 - RNA, 20 nt, Homo sapiens
aucacccaaaacuuuuggca

SEQ ID NO: 956301 - RNA, 13 nt, Homo sapiens
aucacugcuccug

SEQ ID NO: 956302 - RNA, 13 nt, Homo sapiens
aucagaagcacua

SEQ ID NO: 956303 - RNA, 13 nt, Homo sapiens
aucagacuugauu

SEQ ID NO: 956304 - RNA, 15 nt, Homo sapiens
aucagaguaugucag

SEQ ID NO: 956305 - RNA, 16 nt, Homo sapiens
aucagcucuaaagcag

SEQ ID NO: 956306 - RNA, 17 nt, Homo sapiens
aucaguaugaagacacu

SEQ ID NO: 956307 - RNA, 21 nt, Homo sapiens
aucauuccccccgugaagucu

SEQ ID NO: 956308 - RNA, 19 nt, Homo sapiens
auccaaauucucugagaug

SEQ ID NO: 956309 - RNA, 18 nt, Homo sapiens
auccaacuggaaggcuuu

SEQ ID NO: 956310 - RNA, 21 nt, Homo sapiens
auccaaugaagaaggucucau

SEQ ID NO: 956311 - RNA, 20 nt, Homo sapiens
auccauacaaaacuaucggu

SEQ ID NO: 956312 - RNA, 21 nt, Homo sapiens
auccauccuuuugcuucaucu

SEQ ID NO: 956313 - RNA, 21 nt, Homo sapiens
aucccacuuaucaaaucauuc

SEQ ID NO: 956314 - RNA, 17 nt, Homo sapiens
aucccagcucacugcag

SEQ ID NO: 956315 - RNA, 12 nt, Homo sapiens
auccccaaaaug

SEQ ID NO: 956316 - RNA, 16 nt, Homo sapiens
auccccagcugggaag

SEQ ID NO: 956317 - RNA, 19 nt, Homo sapiens
auccuaugguaacugauga

SEQ ID NO: 956318 - RNA, 16 nt, Homo sapiens
auccuggcaaauaaua

SEQ ID NO: 956319 - RNA, 18 nt, Homo sapiens
auccuucccgcagcacca

SEQ ID NO: 956320 - RNA, 17 nt, Homo sapiens
aucuaagacaaucacgc

SEQ ID NO: 956321 - RNA, 21 nt, Homo sapiens
aucuccagccaauuucaaaga

SEQ ID NO: 956322 - RNA, 19 nt, Homo sapiens
aucucuaaaauucuagucu

SEQ ID NO: 956323 - RNA, 14 nt, Homo sapiens
aucucuccacugag

SEQ ID NO: 956324 - RNA, 19 nt, Homo sapiens
aucucuuuagauccaaaau

SEQ ID NO: 956325 - RNA, 18 nt, Homo sapiens
aucucuuugaagguuuau

SEQ ID NO: 956326 - RNA, 19 nt, Homo sapiens
aucugcuucuagugauugu

SEQ ID NO: 956327 - RNA, 15 nt, Homo sapiens
aucuggaugaaucuu

SEQ ID NO: 956328 - RNA, 14 nt, Homo sapiens
aucuguaaauuuaa

SEQ ID NO: 956329 - RNA, 15 nt, Homo sapiens
aucuguacuauccag

SEQ ID NO: 956330 - RNA, 14 nt, Homo sapiens
aucuguauaucagc

SEQ ID NO: 956331 - RNA, 18 nt, Homo sapiens
aucuguuucuauguccaa

SEQ ID NO: 956332 - RNA, 15 nt, Homo sapiens
aucuucauguacuca

SEQ ID NO: 956333 - RNA, 17 nt, Homo sapiens
aucuucccuuuccuccc

SEQ ID NO: 956334 - RNA, 23 nt, Homo sapiens
aucuucucacauagguguuguca

SEQ ID NO: 956335 - RNA, 19 nt, Homo sapiens
aucuuuccaucucauuaca

SEQ ID NO: 956336 - RNA, 15 nt, Homo sapiens
aucuuucucuuccca

SEQ ID NO: 956337 - RNA, 21 nt, Homo sapiens
aucuuucugcuccugaucaga

SEQ ID NO: 956338 - RNA, 11 nt, Homo sapiens
augaaaacacc

SEQ ID NO: 956339 - RNA, 18 nt, Homo sapiens
augaaccauuaagaacaa

SEQ ID NO: 956340 - RNA, 18 nt, Homo sapiens
augaacucugcuguuuag

SEQ ID NO: 956341 - RNA, 15 nt, Homo sapiens
augaagaaggucuca

SEQ ID NO: 956342 - RNA, 22 nt, Homo sapiens
augaagacagggucaucgacca

SEQ ID NO: 956343 - RNA, 13 nt, Homo sapiens
augaauacagaua

SEQ ID NO: 956344 - RNA, 22 nt, Homo sapiens
augaauugggggaggacacauu

SEQ ID NO: 956345 - RNA, 16 nt, Homo sapiens
augacaucaacauucc

SEQ ID NO: 956346 - RNA, 20 nt, Homo sapiens
augaccuugaaugaugccau

SEQ ID NO: 956347 - RNA, 16 nt, Homo sapiens
augagaaaucaugccu

SEQ ID NO: 956348 - RNA, 22 nt, Homo sapiens
augagguccuucuguagugcca

SEQ ID NO: 956349 - RNA, 20 nt, Homo sapiens
augauuguuugaaagucugu

SEQ ID NO: 956350 - RNA, 21 nt, Homo sapiens
augcaaaaaaaaaaaugucaa

SEQ ID NO: 956351 - RNA, 19 nt, Homo sapiens
guuaauaaaggaacauuaa

SEQ ID NO: 956352 - RNA, 15 nt, Homo sapiens
guuaccucaugccgc

SEQ ID NO: 956353 - RNA, 22 nt, Homo sapiens
guuaccucaugccgcugugucu

SEQ ID NO: 956354 - RNA, 15 nt, Homo sapiens
guuacuuacugccuu

SEQ ID NO: 956355 - RNA, 16 nt, Homo sapiens
guuaggugugccaaac

SEQ ID NO: 956356 - RNA, 19 nt, Homo sapiens
guuauuggagauuaaucua

SEQ ID NO: 956357 - RNA, 19 nt, Homo sapiens
guuauugugaaaacagaag

SEQ ID NO: 956358 - RNA, 15 nt, Homo sapiens
guucaagcaauccac

SEQ ID NO: 956359 - RNA, 22 nt, Homo sapiens
guuccuccuccccucuccuagc

SEQ ID NO: 956360 - RNA, 18 nt, Homo sapiens
guucuuccuaccaaauau

SEQ ID NO: 956361 - RNA, 18 nt, Homo sapiens
guugacaaggcucugcua

SEQ ID NO: 956362 - RNA, 12 nt, Homo sapiens
guugauccugag

SEQ ID NO: 956363 - RNA, 15 nt, Homo sapiens
guugauuccacugaa

SEQ ID NO: 956364 - RNA, 15 nt, Homo sapiens
guugcugaaacacac

SEQ ID NO: 956365 - RNA, 17 nt, Homo sapiens
guugucuguccugguca

SEQ ID NO: 956366 - RNA, 19 nt, Homo sapiens
guugugaaaauuuaaucuu

SEQ ID NO: 956367 - RNA, 14 nt, Homo sapiens
guugugugugcuuu

SEQ ID NO: 956368 - RNA, 16 nt, Homo sapiens
guuuaacccuggauaa

SEQ ID NO: 956369 - RNA, 16 nt, Homo sapiens
guuuaagaaaugagaa

SEQ ID NO: 956370 - RNA, 19 nt, Homo sapiens
guuuauugucaaaguggug

SEQ ID NO: 956371 - RNA, 18 nt, Homo sapiens
guuucaaaauguuaacaa

SEQ ID NO: 956372 - RNA, 18 nt, Homo sapiens
guuuccccaauuccucug

SEQ ID NO: 956373 - RNA, 14 nt, Homo sapiens
guuuccccucagaa

SEQ ID NO: 956374 - RNA, 18 nt, Homo sapiens
guuuccuuucgucugcca

SEQ ID NO: 956375 - RNA, 13 nt, Homo sapiens
guuugcauuccag

SEQ ID NO: 956376 - RNA, 23 nt, Homo sapiens
guuuucucugaucacaacuuuuc

SEQ ID NO: 956377 - RNA, 22 nt, Homo sapiens
guuuucuuuuucugucuuguag

SEQ ID NO: 956378 - RNA, 16 nt, Homo sapiens
guuuugaauugucaau

SEQ ID NO: 956379 - RNA, 17 nt, Homo sapiens
guuuuuaucauggguau

SEQ ID NO: 956380 - RNA, 22 nt, Homo sapiens
guuuuugaagaagggaaauuca

SEQ ID NO: 956381 - RNA, 12 nt, Homo sapiens
uaaaaacaugau

SEQ ID NO: 956382 - RNA, 22 nt, Homo sapiens
uaaaaaccuucuauguucauaa

SEQ ID NO: 956383 - RNA, 17 nt, Homo sapiens
uaaaaagcccaaccucu

SEQ ID NO: 956384 - RNA, 14 nt, Homo sapiens
uaaaacacaacauc

SEQ ID NO: 956385 - RNA, 24 nt, Homo sapiens
uaaaaccauguaaagucaucauca

SEQ ID NO: 956386 - RNA, 16 nt, Homo sapiens
ggccuaaugcauuauu

SEQ ID NO: 956387 - RNA, 22 nt, Homo sapiens
ggccuuugcuuuacagcacugu

SEQ ID NO: 956388 - RNA, 13 nt, Homo sapiens
ggcugaacaggcc

SEQ ID NO: 956389 - RNA, 14 nt, Homo sapiens
ggcugacucuccag

SEQ ID NO: 956390 - RNA, 20 nt, Homo sapiens
ggcugagccgaucuggucuc

SEQ ID NO: 956391 - RNA, 20 nt, Homo sapiens
ggcugccgugcacggggcca

SEQ ID NO: 956392 - RNA, 22 nt, Homo sapiens
ggcugccgugcacggggccagc

SEQ ID NO: 956393 - RNA, 17 nt, Homo sapiens
ggcugcucuccaucucu

SEQ ID NO: 956394 - RNA, 22 nt, Homo sapiens
ggcuguauuuuugaaauacucu

SEQ ID NO: 956395 - RNA, 15 nt, Homo sapiens
ggcuuaaugagcaua

SEQ ID NO: 956396 - RNA, 22 nt, Homo sapiens
ggcuucccacagccucuuccuc

SEQ ID NO: 956397 - RNA, 15 nt, Homo sapiens
ggcuucuggucauga

SEQ ID NO: 956398 - RNA, 20 nt, Homo sapiens
ggcuuuacauggguucaauu

SEQ ID NO: 956399 - RNA, 23 nt, Homo sapiens
gggagaccgaguguggagcugcu

SEQ ID NO: 956400 - RNA, 21 nt, Homo sapiens
gggagauccgcccugggcucu

SEQ ID NO: 956401 - RNA, 19 nt, Homo sapiens
gggaggaauuuucauugcc

SEQ ID NO: 956402 - RNA, 14 nt, Homo sapiens
gggagucagggagc

SEQ ID NO: 956403 - RNA, 17 nt, Homo sapiens
gggcaacacucacugcc

SEQ ID NO: 956404 - RNA, 13 nt, Homo sapiens
gggcaacugauga

SEQ ID NO: 956405 - RNA, 21 nt, Homo sapiens
gggccaggaaggggacaggau

SEQ ID NO: 956406 - RNA, 17 nt, Homo sapiens
gggccccauggucacag

SEQ ID NO: 956407 - RNA, 16 nt, Homo sapiens
ggggucgcgaugaugg

SEQ ID NO: 956408 - RNA, 18 nt, Homo sapiens
ggguaaugcgugcaguuc

SEQ ID NO: 956409 - RNA, 20 nt, Homo sapiens
gguaaagaaaccauggcaua

SEQ ID NO: 956410 - RNA, 20 nt, Homo sapiens
gguaacucauuuacagucau

SEQ ID NO: 956411 - RNA, 18 nt, Homo sapiens
gguagcugccacuugaac

SEQ ID NO: 956412 - RNA, 12 nt, Homo sapiens
gguagcuugucc

SEQ ID NO: 956413 - RNA, 16 nt, Homo sapiens
gguauguaaacuuucc

SEQ ID NO: 956414 - RNA, 21 nt, Homo sapiens
gguauucagguaacucauuua

SEQ ID NO: 956415 - RNA, 15 nt, Homo sapiens
ggucaaucaguguua

SEQ ID NO: 956416 - RNA, 20 nt, Homo sapiens
ggucaccucacucagcacca

SEQ ID NO: 956417 - RNA, 20 nt, Homo sapiens
gaagaccuucugaagaucuc

SEQ ID NO: 956418 - RNA, 19 nt, Homo sapiens
gaagagcucacuaugguca

SEQ ID NO: 956419 - RNA, 14 nt, Homo sapiens
gaagauuagcuuuu

SEQ ID NO: 956420 - RNA, 22 nt, Homo sapiens
gaagcacuagugcugccauuaa

SEQ ID NO: 956421 - RNA, 19 nt, Homo sapiens
gaagcugcucacugcucac

SEQ ID NO: 956422 - RNA, 16 nt, Homo sapiens
gaaggagccagugaac

SEQ ID NO: 956423 - RNA, 17 nt, Homo sapiens
gaagggcaggagcucac

SEQ ID NO: 956424 - RNA, 16 nt, Homo sapiens
gaagucuuuguacaga

SEQ ID NO: 956425 - RNA, 18 nt, Homo sapiens
gaagucuuuguacagaca

SEQ ID NO: 956426 - RNA, 19 nt, Homo sapiens
gaagugacaccaguucuuu

SEQ ID NO: 956427 - RNA, 23 nt, Homo sapiens
gaagugguguuuagaaugucagu

SEQ ID NO: 956428 - RNA, 23 nt, Homo sapiens
gaaguguguguuucuugcuuuga

SEQ ID NO: 956429 - RNA, 18 nt, Homo sapiens
gaaguuaacagucucauu

SEQ ID NO: 956430 - RNA, 18 nt, Homo sapiens
gaaguuaucaacaugcac

SEQ ID NO: 956431 - RNA, 16 nt, Homo sapiens
gaauaaaauuguuauu

SEQ ID NO: 956432 - RNA, 18 nt, Homo sapiens
gaauaauuuuaacagaca

SEQ ID NO: 956433 - RNA, 15 nt, Homo sapiens
gaauaccucccucau

SEQ ID NO: 956434 - RNA, 23 nt, Homo sapiens
gaauauauauuauauauaaucua

SEQ ID NO: 956435 - RNA, 17 nt, Homo sapiens
gaaucaaagacauuuca

SEQ ID NO: 956436 - RNA, 13 nt, Homo sapiens
gaaucaaauccaa

SEQ ID NO: 956437 - RNA, 19 nt, Homo sapiens
gaaucaguaugaagacacu

SEQ ID NO: 956438 - RNA, 20 nt, Homo sapiens
gaaucuccauuucugcucag

SEQ ID NO: 956439 - RNA, 15 nt, Homo sapiens
gaaugaaaacaauau

SEQ ID NO: 956440 - RNA, 20 nt, Homo sapiens
gaaugaaugucagugugacu

SEQ ID NO: 956441 - RNA, 21 nt, Homo sapiens
caaaucauucaaaacuuucag

SEQ ID NO: 956442 - RNA, 13 nt, Homo sapiens
caaaugaaugagc

SEQ ID NO: 956443 - RNA, 19 nt, Homo sapiens
agaauucacuuuaccuuca

SEQ ID NO: 956444 - RNA, 17 nt, Homo sapiens
agaauugaaaaaccauu

SEQ ID NO: 956445 - RNA, 20 nt, Homo sapiens
agaauugaggaugucccuga

SEQ ID NO: 956446 - RNA, 21 nt, Homo sapiens
agacaaaauuuaauuguguaa

SEQ ID NO: 956447 - RNA, 14 nt, Homo sapiens
agacaaauuguuaa

SEQ ID NO: 956448 - RNA, 19 nt, Homo sapiens
agacacgcacuucuggggc

SEQ ID NO: 956449 - RNA, 15 nt, Homo sapiens
agacacguucuugcc

SEQ ID NO: 956450 - RNA, 15 nt, Homo sapiens
agacagggucaucga

SEQ ID NO: 956451 - RNA, 21 nt, Homo sapiens
agacagggucucacuguguug

SEQ ID NO: 956452 - RNA, 14 nt, Homo sapiens
agacauccugugau

SEQ ID NO: 956453 - RNA, 12 nt, Homo sapiens
agacaugacucu

SEQ ID NO: 956454 - RNA, 13 nt, Homo sapiens
agaccaugcacag

SEQ ID NO: 956455 - RNA, 21 nt, Homo sapiens
agacguggcgugagagggacg

SEQ ID NO: 956456 - RNA, 13 nt, Homo sapiens
agacugaauuuaa

SEQ ID NO: 956457 - RNA, 20 nt, Homo sapiens
agacuuuauggagaguucag

SEQ ID NO: 956458 - RNA, 13 nt, Homo sapiens
agagacagaagaa

SEQ ID NO: 956459 - RNA, 19 nt, Homo sapiens
agagacccccgugccaaau

SEQ ID NO: 956460 - RNA, 20 nt, Homo sapiens
agagaccugcuccagauccu

SEQ ID NO: 956461 - RNA, 13 nt, Homo sapiens
agagacucuguga

SEQ ID NO: 956462 - RNA, 14 nt, Homo sapiens
agagacucugugau

SEQ ID NO: 956463 - RNA, 14 nt, Homo sapiens
agagagauggcuca

SEQ ID NO: 956464 - RNA, 16 nt, Homo sapiens
agagagugaggcauug

SEQ ID NO: 956465 - RNA, 19 nt, Homo sapiens
agagaugucaaaaugugau

SEQ ID NO: 956466 - RNA, 18 nt, Homo sapiens
agagcacuagaagcacag

SEQ ID NO: 956467 - RNA, 13 nt, Homo sapiens
agagcagaaccaa

SEQ ID NO: 956468 - RNA, 15 nt, Homo sapiens
agagcucccaggacg

SEQ ID NO: 956469 - RNA, 20 nt, Homo sapiens
agagcugggacucaguucuu

SEQ ID NO: 956470 - RNA, 13 nt, Homo sapiens
agaggauuuggcu

SEQ ID NO: 956471 - RNA, 20 nt, Homo sapiens
agaggauuuggcucgcugug

SEQ ID NO: 956472 - RNA, 14 nt, Homo sapiens
agaggccugugcua

SEQ ID NO: 956473 - RNA, 17 nt, Homo sapiens
agagucaagcucuguca

SEQ ID NO: 956474 - RNA, 18 nt, Homo sapiens
agaguccaauguaccaug

SEQ ID NO: 956475 - RNA, 15 nt, Homo sapiens
agagucuaccuugaa

SEQ ID NO: 956476 - RNA, 14 nt, Homo sapiens
agauaaaugcuuua

SEQ ID NO: 956477 - RNA, 19 nt, Homo sapiens
agauaagugcucaguauug

SEQ ID NO: 956478 - RNA, 23 nt, Homo sapiens
agaucacgccauugcacuccagc

SEQ ID NO: 956479 - RNA, 13 nt, Homo sapiens
agaugccaaugac

SEQ ID NO: 956480 - RNA, 21 nt, Homo sapiens
agaugucuguucuaaguccac

SEQ ID NO: 956481 - RNA, 17 nt, Homo sapiens
agauucgaacagcuuau

SEQ ID NO: 956482 - RNA, 15 nt, Homo sapiens
agauuugccaaaaac

SEQ ID NO: 956483 - RNA, 20 nt, Homo sapiens
agcaaaauucauaccugacu

SEQ ID NO: 956484 - RNA, 23 nt, Homo sapiens
agcacaggcaacauuacaaacaa

SEQ ID NO: 956485 - RNA, 14 nt, Homo sapiens
agcaccagccugag

SEQ ID NO: 956486 - RNA, 13 nt, Homo sapiens
agcacuauggaca

SEQ ID NO: 956487 - RNA, 13 nt, Homo sapiens
agcauaacacagc

SEQ ID NO: 956488 - RNA, 19 nt, Homo sapiens
agcauaccugucucagcug

SEQ ID NO: 956489 - RNA, 15 nt, Homo sapiens
agcaugaaccuuuag

SEQ ID NO: 956490 - RNA, 16 nt, Homo sapiens
agccaaccacuuucac

SEQ ID NO: 956491 - RNA, 13 nt, Homo sapiens
agccacagugggg

SEQ ID NO: 956492 - RNA, 21 nt, Homo sapiens
agccacaguggggcccauggc

SEQ ID NO: 956493 - RNA, 23 nt, Homo sapiens
agccacuauuguuagucucuuga

SEQ ID NO: 956494 - RNA, 15 nt, Homo sapiens
agccacuuuccucuu

SEQ ID NO: 956495 - RNA, 16 nt, Homo sapiens
agccagggcccgggaa

SEQ ID NO: 956496 - RNA, 22 nt, Homo sapiens
agcccacccgccccagagacug

SEQ ID NO: 956497 - RNA, 13 nt, Homo sapiens
aagugaaaacuga

SEQ ID NO: 956498 - RNA, 21 nt, Homo sapiens
aagugacuuccucgaggucau

SEQ ID NO: 956499 - RNA, 14 nt, Homo sapiens
aagugauguuauag

SEQ ID NO: 956500 - RNA, 20 nt, Homo sapiens
aagugcauaggccacacagc

SEQ ID NO: 956501 - RNA, 15 nt, Homo sapiens
aagugcucaguauug

SEQ ID NO: 956502 - RNA, 23 nt, Homo sapiens
aagugcugggauuacagguguga

SEQ ID NO: 956503 - RNA, 22 nt, Homo sapiens
aagugugcauuaccacacucag

SEQ ID NO: 956504 - RNA, 17 nt, Homo sapiens
aaguguguguuucuugc

SEQ ID NO: 956505 - RNA, 18 nt, Homo sapiens
aaguguguguuucuugcu

SEQ ID NO: 956506 - RNA, 14 nt, Homo sapiens
aaguuaaagagaca

SEQ ID NO: 956507 - RNA, 16 nt, Homo sapiens
aaguucauccuuugac

SEQ ID NO: 956508 - RNA, 11 nt, Homo sapiens
aaguugcccuc

SEQ ID NO: 956509 - RNA, 18 nt, Homo sapiens
aaguuuccuuauuuucau

SEQ ID NO: 956510 - RNA, 15 nt, Homo sapiens
aauaaaagcauuuaa

SEQ ID NO: 956511 - RNA, 14 nt, Homo sapiens
aauaaagccacuuu

SEQ ID NO: 956512 - RNA, 14 nt, Homo sapiens
aauaaauaaucuca

SEQ ID NO: 956513 - RNA, 22 nt, Homo sapiens
aauaaauuuguaugcucaauua

SEQ ID NO: 956514 - RNA, 21 nt, Homo sapiens
aauaacaacaacuuaaugugc

SEQ ID NO: 956515 - RNA, 12 nt, Homo sapiens
aauaacacugua

SEQ ID NO: 956516 - RNA, 19 nt, Homo sapiens
aauaacacuguacugcaau

SEQ ID NO: 956517 - RNA, 14 nt, Homo sapiens
aauaagacaacaga

SEQ ID NO: 956518 - RNA, 12 nt, Homo sapiens
aauaaugaucuu

SEQ ID NO: 956519 - RNA, 13 nt, Homo sapiens
aauaaugauuuaa

SEQ ID NO: 956520 - RNA, 18 nt, Homo sapiens
aauaauuacuuaaugugg

SEQ ID NO: 956521 - RNA, 18 nt, Homo sapiens
aauagaaggauucaguca

SEQ ID NO: 956522 - RNA, 14 nt, Homo sapiens
aauagaauaccucc

SEQ ID NO: 956523 - RNA, 15 nt, Homo sapiens
aauagcaaaagugau

SEQ ID NO: 956524 - RNA, 12 nt, Homo sapiens
aauauacaugua

SEQ ID NO: 956525 - RNA, 22 nt, Homo sapiens
aauauauauauauaucaguuug

SEQ ID NO: 956526 - RNA, 23 nt, Homo sapiens
aauauauauuauauauaaucuaa

SEQ ID NO: 956527 - RNA, 14 nt, Homo sapiens
aauauccagucaaa

SEQ ID NO: 956528 - RNA, 19 nt, Homo sapiens
aauauggacaaagaaggca

SEQ ID NO: 956529 - RNA, 16 nt, Homo sapiens
aauauuauacuucuuu

SEQ ID NO: 956530 - RNA, 17 nt, Homo sapiens
aauauuucaauaacuua

SEQ ID NO: 956531 - RNA, 17 nt, Homo sapiens
aauauuuuuuucuagcu

SEQ ID NO: 956532 - RNA, 13 nt, Homo sapiens
aaucaaaugauuc

SEQ ID NO: 956533 - RNA, 17 nt, Homo sapiens
aaucaacagcaugucua

SEQ ID NO: 956534 - RNA, 16 nt, Homo sapiens
aaucauaacucacuuu

SEQ ID NO: 956535 - RNA, 18 nt, Homo sapiens
aaucauaacucacuuuaa

SEQ ID NO: 956536 - RNA, 13 nt, Homo sapiens
aaucaucuucucc

SEQ ID NO: 956537 - RNA, 12 nt, Homo sapiens
aaucaugcaaaa

SEQ ID NO: 956538 - RNA, 20 nt, Homo sapiens
aauccauaucagcucugcau

SEQ ID NO: 956539 - RNA, 12 nt, Homo sapiens
aauccucuaugu

SEQ ID NO: 956540 - RNA, 18 nt, Homo sapiens
aauccuuuguacugauga

SEQ ID NO: 956541 - RNA, 14 nt, Homo sapiens
aaucuacaacauaa

SEQ ID NO: 956542 - RNA, 14 nt, Homo sapiens
aaucuaccauuuau

SEQ ID NO: 956543 - RNA, 16 nt, Homo sapiens
aaucucauuguacaag

SEQ ID NO: 956544 - RNA, 21 nt, Homo sapiens
aaucucuuugaagguuuauac

SEQ ID NO: 956545 - RNA, 15 nt, Homo sapiens
aaucuguacuaucca

SEQ ID NO: 956546 - RNA, 15 nt, Homo sapiens
aaucuuuccaucuca

SEQ ID NO: 956547 - RNA, 20 nt, Homo sapiens
aaugaagauaaaugcuuuaa

SEQ ID NO: 956548 - RNA, 15 nt, Homo sapiens
aaugaccaaauccau

SEQ ID NO: 956549 - RNA, 20 nt, Homo sapiens
aaugagaaauugugccaaag

SEQ ID NO: 956550 - RNA, 19 nt, Homo sapiens
aaugauacugaauuguuau

SEQ ID NO: 956551 - RNA, 12 nt, Homo sapiens
aaugcacuccug

SEQ ID NO: 956552 - RNA, 20 nt, Homo sapiens
aaugcagcaguaaauccaag

SEQ ID NO: 956553 - RNA, 19 nt, Homo sapiens
aaugccuuucaaacauuga

SEQ ID NO: 956554 - RNA, 21 nt, Homo sapiens
aaugcuauggaaauacauuua

SEQ ID NO: 956555 - RNA, 21 nt, Homo sapiens
aaugcuucaaguuuagugcau

SEQ ID NO: 956556 - RNA, 15 nt, Homo sapiens
aaugcuuucucaugc

SEQ ID NO: 956557 - RNA, 22 nt, Homo sapiens
aaugguuuucuuguguguuuau

SEQ ID NO: 956558 - RNA, 16 nt, Homo sapiens
aauguaggcuuucaug

SEQ ID NO: 956559 - RNA, 23 nt, Homo sapiens
aauguaucuuauuuauauaugaa

SEQ ID NO: 956560 - RNA, 18 nt, Homo sapiens
aaugucagugugacugau

SEQ ID NO: 956561 - RNA, 18 nt, Homo sapiens
aaugucuaagaaauccag

SEQ ID NO: 956562 - RNA, 19 nt, Homo sapiens
aaugucugaccuagccuau

SEQ ID NO: 956563 - RNA, 11 nt, Homo sapiens
aaugugccaaa

SEQ ID NO: 956564 - RNA, 13 nt, Homo sapiens
aauguuauaucau

SEQ ID NO: 956565 - RNA, 22 nt, Homo sapiens
aauguuucccucaagaacaaac

SEQ ID NO: 956566 - RNA, 14 nt, Homo sapiens
aauguuuuucucaa

SEQ ID NO: 956567 - RNA, 15 nt, Homo sapiens
aauuaaacuaugaug

SEQ ID NO: 956568 - RNA, 12 nt, Homo sapiens
aauuaaugauuc

SEQ ID NO: 956569 - RNA, 18 nt, Homo sapiens
aauuacaaccgguuauca

SEQ ID NO: 956570 - RNA, 18 nt, Homo sapiens
aauuauuuaacuaauuaa

SEQ ID NO: 956571 - RNA, 17 nt, Homo sapiens
aauuauuuuagcacaaa

SEQ ID NO: 956572 - RNA, 19 nt, Homo sapiens
aauucauagcauccugauu

SEQ ID NO: 956573 - RNA, 23 nt, Homo sapiens
aauucaucuuucuaacucaagga

SEQ ID NO: 956574 - RNA, 17 nt, Homo sapiens
aauuccuggaaaacugg

SEQ ID NO: 956575 - RNA, 19 nt, Homo sapiens
aauucuguggcugccauca

SEQ ID NO: 956576 - RNA, 14 nt, Homo sapiens
aauugaaaaaccau

SEQ ID NO: 956577 - RNA, 15 nt, Homo sapiens
gagggaaauguuucu

SEQ ID NO: 956578 - RNA, 23 nt, Homo sapiens
gagggacgguucacaaggcuugg

SEQ ID NO: 956579 - RNA, 22 nt, Homo sapiens
gaggggaggauguauaaaaugg

SEQ ID NO: 956580 - RNA, 15 nt, Homo sapiens
gaggggcggggccag

SEQ ID NO: 956581 - RNA, 16 nt, Homo sapiens
gaggggcggggccagg

SEQ ID NO: 956582 - RNA, 14 nt, Homo sapiens
gagguuaugccaaa

SEQ ID NO: 956583 - RNA, 17 nt, Homo sapiens
gagguugcggugagcug

SEQ ID NO: 956584 - RNA, 21 nt, Homo sapiens
gagucaagcucugucacccag

SEQ ID NO: 956585 - RNA, 13 nt, Homo sapiens
gagugaugggcaa

SEQ ID NO: 956586 - RNA, 16 nt, Homo sapiens
gagugcaguggcacaa

SEQ ID NO: 956587 - RNA, 14 nt, Homo sapiens
gagugccaauccaa

SEQ ID NO: 956588 - RNA, 12 nt, Homo sapiens
gauacacuguau

SEQ ID NO: 956589 - RNA, 11 nt, Homo sapiens
gauacaguauu

SEQ ID NO: 956590 - RNA, 23 nt, Homo sapiens
gauauaauaauuacuuaaugugg

SEQ ID NO: 956591 - RNA, 14 nt, Homo sapiens
gauauaauuacuua

SEQ ID NO: 956592 - RNA, 18 nt, Homo sapiens
gauauauguaaauauaca

SEQ ID NO: 956593 - RNA, 15 nt, Homo sapiens
gaucagaauguuuca

SEQ ID NO: 956594 - RNA, 19 nt, Homo sapiens
gaucagacuugauuuacaa

SEQ ID NO: 956595 - RNA, 16 nt, Homo sapiens
gaucagaucuuacaag

SEQ ID NO: 956596 - RNA, 12 nt, Homo sapiens
gaucaguugcca

SEQ ID NO: 956597 - RNA, 14 nt, Homo sapiens
gaucaguugccaaa

SEQ ID NO: 956598 - RNA, 22 nt, Homo sapiens
gaucaucaccacugacagauga

SEQ ID NO: 956599 - RNA, 12 nt, Homo sapiens
gauccauuugaa

SEQ ID NO: 956600 - RNA, 17 nt, Homo sapiens
gauccgugacagcacuu

SEQ ID NO: 956601 - RNA, 23 nt, Homo sapiens
gaugaacucaaugcaugaugacu

SEQ ID NO: 956602 - RNA, 17 nt, Homo sapiens
gaugaaucuugaaacac

SEQ ID NO: 956603 - RNA, 15 nt, Homo sapiens
gaugacacuagucag

SEQ ID NO: 956604 - RNA, 19 nt, Homo sapiens
gaugaccuugaaugaugcc

SEQ ID NO: 956605 - RNA, 19 nt, Homo sapiens
gaugacucuucuuaucaca

SEQ ID NO: 956606 - RNA, 15 nt, Homo sapiens
gaugauccauuugaa

SEQ ID NO: 956607 - RNA, 12 nt, Homo sapiens
gaugcuugauau

SEQ ID NO: 956608 - RNA, 20 nt, Homo sapiens
gaugcuugauauaauaauua

SEQ ID NO: 956609 - RNA, 16 nt, Homo sapiens
gauguaaauauuucaa

SEQ ID NO: 956610 - RNA, 20 nt, Homo sapiens
gauguauaaaauggucaugg

SEQ ID NO: 956611 - RNA, 19 nt, Homo sapiens
gaugucaaaaugugauucu

SEQ ID NO: 956612 - RNA, 19 nt, Homo sapiens
gauguugauaauaguaaug

SEQ ID NO: 956613 - RNA, 20 nt, Homo sapiens
gauuaaauuuaauauacugc

SEQ ID NO: 956614 - RNA, 18 nt, Homo sapiens
gauuaauuaaaacacaac

SEQ ID NO: 956615 - RNA, 11 nt, Homo sapiens
gauucaaugug

SEQ ID NO: 956616 - RNA, 15 nt, Homo sapiens
gauugugagugccuu

SEQ ID NO: 956617 - RNA, 16 nt, Homo sapiens
gauugugagugccuug

SEQ ID NO: 956618 - RNA, 14 nt, Homo sapiens
gauuuccauuugca

SEQ ID NO: 956619 - RNA, 20 nt, Homo sapiens
gauuuccauuugcaacagga

SEQ ID NO: 956620 - RNA, 14 nt, Homo sapiens
gauuugcauauuca

SEQ ID NO: 956621 - RNA, 14 nt, Homo sapiens
gauuugccaaaaac

SEQ ID NO: 956622 - RNA, 21 nt, Homo sapiens
gauuuggguuuggaaauggag

SEQ ID NO: 956623 - RNA, 14 nt, Homo sapiens
gauuuuuaccuuug

SEQ ID NO: 956624 - RNA, 19 nt, Homo sapiens
gcaaaaauaaaauggacag

SEQ ID NO: 956625 - RNA, 15 nt, Homo sapiens
gcaaacacuguguau

SEQ ID NO: 956626 - RNA, 19 nt, Homo sapiens
gcaaauaaaacagugaaag

SEQ ID NO: 956627 - RNA, 16 nt, Homo sapiens
gcaaauaaaagcauuu

SEQ ID NO: 956628 - RNA, 12 nt, Homo sapiens
gcaacauuacaa

SEQ ID NO: 956629 - RNA, 16 nt, Homo sapiens
gcaaccagagcacugu

SEQ ID NO: 956630 - RNA, 16 nt, Homo sapiens
gcaaggcugcccuguc

SEQ ID NO: 956631 - RNA, 16 nt, Homo sapiens
gcaaggggccaggaag

SEQ ID NO: 956632 - RNA, 13 nt, Homo sapiens
gcaauaacaguuu

SEQ ID NO: 956633 - RNA, 16 nt, Homo sapiens
gcaaugacuuuccuag

SEQ ID NO: 956634 - RNA, 15 nt, Homo sapiens
gcaauuagauagaaa

SEQ ID NO: 956635 - RNA, 14 nt, Homo sapiens
gcacaaagaugugc

SEQ ID NO: 956636 - RNA, 18 nt, Homo sapiens
gcacacgccuggcuucca

SEQ ID NO: 956637 - RNA, 15 nt, Homo sapiens
gcacacugcacacau

SEQ ID NO: 956638 - RNA, 17 nt, Homo sapiens
gcacagcuaacauggaa

SEQ ID NO: 956639 - RNA, 20 nt, Homo sapiens
gcacaguauuuacugugcua

SEQ ID NO: 956640 - RNA, 12 nt, Homo sapiens
gcacaugcacac

SEQ ID NO: 956641 - RNA, 18 nt, Homo sapiens
gcacauuguuaugcacuu

SEQ ID NO: 956642 - RNA, 18 nt, Homo sapiens
gcacauuugucacugaau

SEQ ID NO: 956643 - RNA, 17 nt, Homo sapiens
gcaccuucacucuccag

SEQ ID NO: 956644 - RNA, 16 nt, Homo sapiens
gcacuaacacaugcac

SEQ ID NO: 956645 - RNA, 16 nt, Homo sapiens
gcacuauggacauuuu

SEQ ID NO: 956646 - RNA, 20 nt, Homo sapiens
gcacuucuggaauacugaaa

SEQ ID NO: 956647 - RNA, 17 nt, Homo sapiens
gcacuugugauccuaaa

SEQ ID NO: 956648 - RNA, 20 nt, Homo sapiens
gcagaacugaagugugcugu

SEQ ID NO: 956649 - RNA, 20 nt, Homo sapiens
gcagacuagcuaauuagcuc

SEQ ID NO: 956650 - RNA, 16 nt, Homo sapiens
gcagacuuacaaagcu

SEQ ID NO: 956651 - RNA, 17 nt, Homo sapiens
gcagauccugucccaug

SEQ ID NO: 956652 - RNA, 22 nt, Homo sapiens
gcagcaggucuagaagaacaac

SEQ ID NO: 956653 - RNA, 21 nt, Homo sapiens
gcagcccuaaugucugaccua

SEQ ID NO: 956654 - RNA, 16 nt, Homo sapiens
gcaggaagucccugag

SEQ ID NO: 956655 - RNA, 13 nt, Homo sapiens
gcaggaggccauu

SEQ ID NO: 956656 - RNA, 18 nt, Homo sapiens
gcaggucuagaagaacaa

SEQ ID NO: 956657 - RNA, 19 nt, Homo sapiens
gcaguccuccgguugcaua

SEQ ID NO: 956658 - RNA, 20 nt, Homo sapiens
gcaguggggagcgggggcua

SEQ ID NO: 956659 - RNA, 22 nt, Homo sapiens
gcaguguuuguuagagugcaca

SEQ ID NO: 956660 - RNA, 21 nt, Homo sapiens
gcauaaagcugggaggccaaa

SEQ ID NO: 956661 - RNA, 20 nt, Homo sapiens
gcauaccugucucagcuguu

SEQ ID NO: 956662 - RNA, 15 nt, Homo sapiens
gcauacucugugcaa

SEQ ID NO: 956663 - RNA, 13 nt, Homo sapiens
gcauagccauuca

SEQ ID NO: 956664 - RNA, 16 nt, Homo sapiens
gcaucugauuugcaua

SEQ ID NO: 956665 - RNA, 14 nt, Homo sapiens
gcaugaucacagcu

SEQ ID NO: 956666 - RNA, 16 nt, Homo sapiens
gcaugcugagucaugu

SEQ ID NO: 956667 - RNA, 22 nt, Homo sapiens
gcaugguuugcaugacuuuaca

SEQ ID NO: 956668 - RNA, 21 nt, Homo sapiens
gcaugugaugagaggaaauca

SEQ ID NO: 956669 - RNA, 17 nt, Homo sapiens
gcaugugcagacacuca

SEQ ID NO: 956670 - RNA, 17 nt, Homo sapiens
gcauuucucuuccuaaa

SEQ ID NO: 956671 - RNA, 17 nt, Homo sapiens
gccaaggcucacaugcu

SEQ ID NO: 956672 - RNA, 20 nt, Homo sapiens
gccacacagcacaugcacac

SEQ ID NO: 956673 - RNA, 20 nt, Homo sapiens
gccaccuagaaaggggccca

SEQ ID NO: 956674 - RNA, 13 nt, Homo sapiens
gccacuugcucag

SEQ ID NO: 956675 - RNA, 16 nt, Homo sapiens
gccaggacacauuucc

SEQ ID NO: 956676 - RNA, 18 nt, Homo sapiens
gccaugaggaacaaggca

SEQ ID NO: 956677 - RNA, 19 nt, Homo sapiens
gcccaacagggcaaccaau

SEQ ID NO: 956678 - RNA, 18 nt, Homo sapiens
gcccacugaacaugcuca

SEQ ID NO: 956679 - RNA, 16 nt, Homo sapiens
gcccaggggaggcaca

SEQ ID NO: 956680 - RNA, 17 nt, Homo sapiens
gcccaguuagcccggcc

SEQ ID NO: 956681 - RNA, 23 nt, Homo sapiens
gcccauccucucgccaagccauc

SEQ ID NO: 956682 - RNA, 21 nt, Homo sapiens
gccccgccugcucuuuccucc

SEQ ID NO: 956683 - RNA, 13 nt, Homo sapiens
gcccgccaccuug

SEQ ID NO: 956684 - RNA, 13 nt, Homo sapiens
gcccucuguggug

SEQ ID NO: 956685 - RNA, 12 nt, Homo sapiens
gcccuuacuuuc

SEQ ID NO: 956686 - RNA, 15 nt, Homo sapiens
gccgcacaucucacu

SEQ ID NO: 956687 - RNA, 21 nt, Homo sapiens
gccgcuucagacacgcacuuc

SEQ ID NO: 956688 - RNA, 15 nt, Homo sapiens
gccucacugcaucuu

SEQ ID NO: 956689 - RNA, 15 nt, Homo sapiens
gccucccguccgucc

SEQ ID NO: 956690 - RNA, 14 nt, Homo sapiens
gccuccucccugcc

SEQ ID NO: 956691 - RNA, 20 nt, Homo sapiens
gccugaaccguuacaaaaga

SEQ ID NO: 956692 - RNA, 18 nt, Homo sapiens
gccugaaggcuauccacu

SEQ ID NO: 956693 - RNA, 19 nt, Homo sapiens
gccugcgccccccagugga

SEQ ID NO: 956694 - RNA, 21 nt, Homo sapiens
gccugggaugauguuggucaa

SEQ ID NO: 956695 - RNA, 11 nt, Homo sapiens
gccuuacacaa

SEQ ID NO: 956696 - RNA, 23 nt, Homo sapiens
gcgagaggugagcuacuuuguga

SEQ ID NO: 956697 - RNA, 12 nt, Homo sapiens
gcgccacccgcc

SEQ ID NO: 956698 - RNA, 20 nt, Homo sapiens
gcgcuccucugcagccugag

SEQ ID NO: 956699 - RNA, 13 nt, Homo sapiens
gcggaggggcuug

SEQ ID NO: 956700 - RNA, 13 nt, Homo sapiens
gcgggaagggugg

SEQ ID NO: 956701 - RNA, 13 nt, Homo sapiens
gcguagggccagg

SEQ ID NO: 956702 - RNA, 11 nt, Homo sapiens
gcgugcacuug

SEQ ID NO: 956703 - RNA, 22 nt, Homo sapiens
gcuaaguuugucuacacuaaaa

SEQ ID NO: 956704 - RNA, 13 nt, Homo sapiens
gcuaauuagcucu

SEQ ID NO: 956705 - RNA, 13 nt, Homo sapiens
gcuacagcaaaua

SEQ ID NO: 956706 - RNA, 21 nt, Homo sapiens
gcuauccaaugauauaggaaa

SEQ ID NO: 956707 - RNA, 18 nt, Homo sapiens
gcuaugccuccauuucag

SEQ ID NO: 956708 - RNA, 21 nt, Homo sapiens
gcuauuuauguucaucuucaa

SEQ ID NO: 956709 - RNA, 16 nt, Homo sapiens
gcucaacuguugccag

SEQ ID NO: 956710 - RNA, 17 nt, Homo sapiens
gcucaacuguugccagg

SEQ ID NO: 956711 - RNA, 20 nt, Homo sapiens
gcucaacuguugccaggaga

SEQ ID NO: 956712 - RNA, 19 nt, Homo sapiens
gcucacccacugcugcacc

SEQ ID NO: 956713 - RNA, 12 nt, Homo sapiens
gcucaggugccu

SEQ ID NO: 956714 - RNA, 13 nt, Homo sapiens
gcucauguguaca

SEQ ID NO: 956715 - RNA, 21 nt, Homo sapiens
gcuccaacuccaacauccacu

SEQ ID NO: 956716 - RNA, 18 nt, Homo sapiens
gcuccucugcagccugag

SEQ ID NO: 956717 - RNA, 23 nt, Homo sapiens
gcucuaaagcagagauguauuau

SEQ ID NO: 956718 - RNA, 14 nt, Homo sapiens
gcucugaaggucca

SEQ ID NO: 956719 - RNA, 21 nt, Homo sapiens
gcucuguucuucaucgcauuc

SEQ ID NO: 956720 - RNA, 22 nt, Homo sapiens
gcugaaagaaggggugccaaaa

SEQ ID NO: 956721 - RNA, 20 nt, Homo sapiens
gcugacuaaauuuggggaca

SEQ ID NO: 956722 - RNA, 15 nt, Homo sapiens
gcugacuacuugaua

SEQ ID NO: 956723 - RNA, 13 nt, Homo sapiens
gcugauguucacc

SEQ ID NO: 956724 - RNA, 21 nt, Homo sapiens
gcugauuucaaaugcagucca

SEQ ID NO: 956725 - RNA, 18 nt, Homo sapiens
gcugcaucaaaugcaugc

SEQ ID NO: 956726 - RNA, 18 nt, Homo sapiens
gcugcccccacagaucca

SEQ ID NO: 956727 - RNA, 17 nt, Homo sapiens
gcugcuaaguggaagac

SEQ ID NO: 956728 - RNA, 21 nt, Homo sapiens
gcuggagugaaguggugugau

SEQ ID NO: 956729 - RNA, 21 nt, Homo sapiens
gcuggugggggcauccuugag

SEQ ID NO: 956730 - RNA, 17 nt, Homo sapiens
gcugucauuuuaugcua

SEQ ID NO: 956731 - RNA, 14 nt, Homo sapiens
gcuguugcuugaau

SEQ ID NO: 956732 - RNA, 14 nt, Homo sapiens
gcuuauaugugaca

SEQ ID NO: 956733 - RNA, 16 nt, Homo sapiens
gcuuaugagaccaaga

SEQ ID NO: 956734 - RNA, 12 nt, Homo sapiens
gcuuaugugaca

SEQ ID NO: 956735 - RNA, 19 nt, Homo sapiens
gcuuauuaaaaaaguaaac

SEQ ID NO: 956736 - RNA, 23 nt, Homo sapiens
gcuucgaggagauaaacugaaau

SEQ ID NO: 956737 - RNA, 16 nt, Homo sapiens
gcuugccacuuuccag

SEQ ID NO: 956738 - RNA, 17 nt, Homo sapiens
gcuuguuucuauacugu

SEQ ID NO: 956739 - RNA, 14 nt, Homo sapiens
gcuuuacagcacug

SEQ ID NO: 956740 - RNA, 15 nt, Homo sapiens
gcuuugaaugcaugu

SEQ ID NO: 956741 - RNA, 14 nt, Homo sapiens
ggaaaaauguuucc

SEQ ID NO: 956742 - RNA, 17 nt, Homo sapiens
ggaaaagagaaacacua

SEQ ID NO: 956743 - RNA, 14 nt, Homo sapiens
ggaaacaguccaaa

SEQ ID NO: 956744 - RNA, 19 nt, Homo sapiens
ggaaacaguccaaacuguu

SEQ ID NO: 956745 - RNA, 14 nt, Homo sapiens
ggaaacuaagguca

SEQ ID NO: 956746 - RNA, 15 nt, Homo sapiens
ggaaacugcacuguu

SEQ ID NO: 956747 - RNA, 11 nt, Homo sapiens
ggaaauaugca

SEQ ID NO: 956748 - RNA, 18 nt, Homo sapiens
ggaacccucuggggcccu

SEQ ID NO: 956749 - RNA, 16 nt, Homo sapiens
ggaagaauaaaaaaga

SEQ ID NO: 956750 - RNA, 22 nt, Homo sapiens
ggaaggaaaucccaucagugaa

SEQ ID NO: 956751 - RNA, 22 nt, Homo sapiens
ggaauagguuucaacauaugaa

SEQ ID NO: 956752 - RNA, 20 nt, Homo sapiens
ggaauaucaaugcccaacag

SEQ ID NO: 956753 - RNA, 16 nt, Homo sapiens
ggaauauccagucaaa

SEQ ID NO: 956754 - RNA, 20 nt, Homo sapiens
ggaauccauagcggggccca

SEQ ID NO: 956755 - RNA, 16 nt, Homo sapiens
ggaaugggggccaggc

SEQ ID NO: 956756 - RNA, 19 nt, Homo sapiens
ggaauuguugaauguauuc

SEQ ID NO: 956757 - RNA, 17 nt, Homo sapiens
ggaccccaucugcugag

SEQ ID NO: 956758 - RNA, 18 nt, Homo sapiens
ggagacacuggucucaga

SEQ ID NO: 956759 - RNA, 18 nt, Homo sapiens
ggagauaaaauaaaaaga

SEQ ID NO: 956760 - RNA, 19 nt, Homo sapiens
ggagcccugggguuuccac

SEQ ID NO: 956761 - RNA, 15 nt, Homo sapiens
ggagcucacaccgca

SEQ ID NO: 956762 - RNA, 14 nt, Homo sapiens
ggagcugcuuccag

SEQ ID NO: 956763 - RNA, 19 nt, Homo sapiens
ggaggaagauugauuuucu

SEQ ID NO: 956764 - RNA, 15 nt, Homo sapiens
ggaggcacaaagggc

SEQ ID NO: 956765 - RNA, 18 nt, Homo sapiens
ggagucccugcaggugaa

SEQ ID NO: 956766 - RNA, 20 nt, Homo sapiens
ggaucaaaguugaugaaaua

SEQ ID NO: 956767 - RNA, 17 nt, Homo sapiens
ggaucaaccaaguuaca

SEQ ID NO: 956768 - RNA, 20 nt, Homo sapiens
ggaugaaaaaauaacacugu

SEQ ID NO: 956769 - RNA, 22 nt, Homo sapiens
ggaugaaaaaauaacacuguac

SEQ ID NO: 956770 - RNA, 14 nt, Homo sapiens
ggaugcagccuuug

SEQ ID NO: 956771 - RNA, 15 nt, Homo sapiens
ggauguccucacucu

SEQ ID NO: 956772 - RNA, 18 nt, Homo sapiens
ggauuauaaacaacagaa

SEQ ID NO: 956773 - RNA, 17 nt, Homo sapiens
ggcaaaagucauugcug

SEQ ID NO: 956774 - RNA, 19 nt, Homo sapiens
ggcaaguuucaauggugag

SEQ ID NO: 956775 - RNA, 11 nt, Homo sapiens
ggcaccagcaa

SEQ ID NO: 956776 - RNA, 22 nt, Homo sapiens
ggcacuuaggggagaugacauu

SEQ ID NO: 956777 - RNA, 15 nt, Homo sapiens
ggcagaauccuuguc

SEQ ID NO: 956778 - RNA, 14 nt, Homo sapiens
ggcaggagggcaug

SEQ ID NO: 956779 - RNA, 17 nt, Homo sapiens
ggcaggagggcaugugc

SEQ ID NO: 956780 - RNA, 13 nt, Homo sapiens
ggcaguggcagag

SEQ ID NO: 956781 - RNA, 14 nt, Homo sapiens
ggcaugaagcacau

SEQ ID NO: 956782 - RNA, 19 nt, Homo sapiens
ggccacacagcacaugcac

SEQ ID NO: 956783 - RNA, 16 nt, Homo sapiens
ggccacuggcccuguu

SEQ ID NO: 956784 - RNA, 22 nt, Homo sapiens
ggccagggcucuggcagguggc

SEQ ID NO: 956785 - RNA, 21 nt, Homo sapiens
ggccaucacuuucauucaauu

SEQ ID NO: 956786 - RNA, 22 nt, Homo sapiens
ggccccaccugcucuuuccucc

SEQ ID NO: 956787 - RNA, 19 nt, Homo sapiens
ggccccgcaccccuccucc

SEQ ID NO: 956788 - RNA, 20 nt, Homo sapiens
ggcccuuuucuuacaguaac

SEQ ID NO: 956789 - RNA, 18 nt, Homo sapiens
ggccgacaucagcccggu

SEQ ID NO: 956790 - RNA, 13 nt, Homo sapiens
ggccuaguggcuu

SEQ ID NO: 956791 - RNA, 14 nt, Homo sapiens
ggccuggggcugcc

SEQ ID NO: 956792 - RNA, 23 nt, Homo sapiens
ggccugggugugaccugacaccu

SEQ ID NO: 956793 - RNA, 23 nt, Homo sapiens
ggccuugagcaagucccaucuca

SEQ ID NO: 956794 - RNA, 19 nt, Homo sapiens
ggcucacaucauguaauag

SEQ ID NO: 956795 - RNA, 22 nt, Homo sapiens
ggcucacgaggcuuggaccugc

SEQ ID NO: 956796 - RNA, 14 nt, Homo sapiens
ggcucagcucucaa

SEQ ID NO: 956797 - RNA, 19 nt, Homo sapiens
ggcuccaggagcagcgugc

SEQ ID NO: 956798 - RNA, 23 nt, Homo sapiens
ggcucuauuucggaaauacacua

SEQ ID NO: 956799 - RNA, 15 nt, Homo sapiens
ggcugaccaggcccu

SEQ ID NO: 956800 - RNA, 19 nt, Homo sapiens
ggcugauuucaaaugcagu

SEQ ID NO: 956801 - RNA, 13 nt, Homo sapiens
ggcuggagggcug

SEQ ID NO: 956802 - RNA, 18 nt, Homo sapiens
ggcuggaugugcuuucau

SEQ ID NO: 956803 - RNA, 13 nt, Homo sapiens
ggcuggcaguugg

SEQ ID NO: 956804 - RNA, 16 nt, Homo sapiens
ggcuucccacagccuc

SEQ ID NO: 956805 - RNA, 23 nt, Homo sapiens
gggaaggucccgaauggagucca

SEQ ID NO: 956806 - RNA, 22 nt, Homo sapiens
gggaaugaaugucagugugacu

SEQ ID NO: 956807 - RNA, 18 nt, Homo sapiens
gggacucaguucuuggcc

SEQ ID NO: 956808 - RNA, 17 nt, Homo sapiens
gggagacccugggagag

SEQ ID NO: 956809 - RNA, 20 nt, Homo sapiens
gggagauuggcuuugccuuu

SEQ ID NO: 956810 - RNA, 13 nt, Homo sapiens
gggaucauuauuu

SEQ ID NO: 956811 - RNA, 12 nt, Homo sapiens
gggcauguuucu

SEQ ID NO: 956812 - RNA, 22 nt, Homo sapiens
gggcucugccccaccuggagaa

SEQ ID NO: 956813 - RNA, 11 nt, Homo sapiens
gggcugcucac

SEQ ID NO: 956814 - RNA, 17 nt, Homo sapiens
ggggcaaugacuuuccu

SEQ ID NO: 956815 - RNA, 17 nt, Homo sapiens
ggggucccaucagugaa

SEQ ID NO: 956816 - RNA, 16 nt, Homo sapiens
gggucugugaauuucu

SEQ ID NO: 956817 - RNA, 17 nt, Homo sapiens
gggugggccccacagug

SEQ ID NO: 956818 - RNA, 18 nt, Homo sapiens
gguacuaaaaacacugga

SEQ ID NO: 956819 - RNA, 19 nt, Homo sapiens
gguaucugcugccucugaa

SEQ ID NO: 956820 - RNA, 22 nt, Homo sapiens
ggucaaaaagugauggcuuuca

SEQ ID NO: 956821 - RNA, 16 nt, Homo sapiens
ggucaaggcaccagca

SEQ ID NO: 956822 - RNA, 23 nt, Homo sapiens
ggucaauaaccugagggaaucaa

SEQ ID NO: 956823 - RNA, 12 nt, Homo sapiens
ggucacaugcac

SEQ ID NO: 956824 - RNA, 21 nt, Homo sapiens
ggucagcuugaauguccccau

SEQ ID NO: 956825 - RNA, 12 nt, Homo sapiens
ggucaguugcca

SEQ ID NO: 956826 - RNA, 14 nt, Homo sapiens
ggucaguugccaaa

SEQ ID NO: 956827 - RNA, 16 nt, Homo sapiens
gguccuuccaccucag

SEQ ID NO: 956828 - RNA, 22 nt, Homo sapiens
ggucucauuaucuccaugauaa

SEQ ID NO: 956829 - RNA, 16 nt, Homo sapiens
ggugcaguaaccauuu

SEQ ID NO: 956830 - RNA, 12 nt, Homo sapiens
gguggacaugca

SEQ ID NO: 956831 - RNA, 12 nt, Homo sapiens
gguggccacucc

SEQ ID NO: 956832 - RNA, 23 nt, Homo sapiens
gguggucaccagguccugugagc

SEQ ID NO: 956833 - RNA, 15 nt, Homo sapiens
ggugucccuuucaca

SEQ ID NO: 956834 - RNA, 15 nt, Homo sapiens
gguuaaaacauaagc

SEQ ID NO: 956835 - RNA, 18 nt, Homo sapiens
gguucugggacccacucc

SEQ ID NO: 956836 - RNA, 17 nt, Homo sapiens
gguucuuauucacugag

SEQ ID NO: 956837 - RNA, 22 nt, Homo sapiens
gguuuccacguaagucacugaa

SEQ ID NO: 956838 - RNA, 19 nt, Homo sapiens
gguuugcaugacuuuacac

SEQ ID NO: 956839 - RNA, 12 nt, Homo sapiens
guaaaaaacugu

SEQ ID NO: 956840 - RNA, 13 nt, Homo sapiens
guaaaauguuuca

SEQ ID NO: 956841 - RNA, 17 nt, Homo sapiens
guaaacagaagccuguu

SEQ ID NO: 956842 - RNA, 23 nt, Homo sapiens
guaacuucucccuucuccugacc

SEQ ID NO: 956843 - RNA, 16 nt, Homo sapiens
guaaugucauuuucca

SEQ ID NO: 956844 - RNA, 18 nt, Homo sapiens
guacaauuuucaucccac

SEQ ID NO: 956845 - RNA, 21 nt, Homo sapiens
guacccuccauguaccuugug

SEQ ID NO: 956846 - RNA, 18 nt, Homo sapiens
guacuaaaaacacuggau

SEQ ID NO: 956847 - RNA, 11 nt, Homo sapiens
guacuauccag

SEQ ID NO: 956848 - RNA, 20 nt, Homo sapiens
guacuggagaaaauggacgu

SEQ ID NO: 956849 - RNA, 15 nt, Homo sapiens
guagauaagugcuca

SEQ ID NO: 956850 - RNA, 22 nt, Homo sapiens
guagauguauuuucaauaaaga

SEQ ID NO: 956851 - RNA, 16 nt, Homo sapiens
guagcugccacuugaa

SEQ ID NO: 956852 - RNA, 17 nt, Homo sapiens
guaggugaaagaacaag

SEQ ID NO: 956853 - RNA, 15 nt, Homo sapiens
guaguuaagaauucc

SEQ ID NO: 956854 - RNA, 23 nt, Homo sapiens
guaguugcuuugcggcaucucca

SEQ ID NO: 956855 - RNA, 16 nt, Homo sapiens
guaguuugcauuccag

SEQ ID NO: 956856 - RNA, 23 nt, Homo sapiens
guauaaaaccauguaaagucauc

SEQ ID NO: 956857 - RNA, 21 nt, Homo sapiens
guauaacaagccaaacauucu

SEQ ID NO: 956858 - RNA, 17 nt, Homo sapiens
guauagacaguuuguaa

SEQ ID NO: 956859 - RNA, 21 nt, Homo sapiens
guaugcucaauuauuuugcau

SEQ ID NO: 956860 - RNA, 22 nt, Homo sapiens
guauggccccaccugcucuuuc

SEQ ID NO: 956861 - RNA, 15 nt, Homo sapiens
gucacaugaugaaua

SEQ ID NO: 956862 - RNA, 22 nt, Homo sapiens
gucacccaggcuggagugcaga

SEQ ID NO: 956863 - RNA, 15 nt, Homo sapiens
gucacuuaaacucau

SEQ ID NO: 956864 - RNA, 19 nt, Homo sapiens
gucaggaggugccugagag

SEQ ID NO: 956865 - RNA, 18 nt, Homo sapiens
gucauaaucucuuuccau

SEQ ID NO: 956866 - RNA, 17 nt, Homo sapiens
gucaucacacucuccau

SEQ ID NO: 956867 - RNA, 12 nt, Homo sapiens
gucaucaucaag

SEQ ID NO: 956868 - RNA, 16 nt, Homo sapiens
gucaugaauagaaaaa

SEQ ID NO: 956869 - RNA, 13 nt, Homo sapiens
gucaugauuucaa

SEQ ID NO: 956870 - RNA, 22 nt, Homo sapiens
gucauucaguuaucacuacaga

SEQ ID NO: 956871 - RNA, 12 nt, Homo sapiens
gucccaucucac

SEQ ID NO: 956872 - RNA, 17 nt, Homo sapiens
guccucuuaagacacua

SEQ ID NO: 956873 - RNA, 20 nt, Homo sapiens
guccugugagcaaagugcag

SEQ ID NO: 956874 - RNA, 15 nt, Homo sapiens
gucgucuuuuuccaa

SEQ ID NO: 956875 - RNA, 16 nt, Homo sapiens
gucucaugaccaguca

SEQ ID NO: 956876 - RNA, 13 nt, Homo sapiens
gucucauuaucuc

SEQ ID NO: 956877 - RNA, 16 nt, Homo sapiens
gucucuacuaaaaaua

SEQ ID NO: 956878 - RNA, 13 nt, Homo sapiens
gucugguguucca

SEQ ID NO: 956879 - RNA, 16 nt, Homo sapiens
gucuuuguacagacaa

SEQ ID NO: 956880 - RNA, 23 nt, Homo sapiens
gugaacaaacuuagaaagggaag

SEQ ID NO: 956881 - RNA, 23 nt, Homo sapiens
gugagcuauaauguuucccucaa

SEQ ID NO: 956882 - RNA, 12 nt, Homo sapiens
gugaucuaagca

SEQ ID NO: 956883 - RNA, 15 nt, Homo sapiens
gugauguguuuccau

SEQ ID NO: 956884 - RNA, 12 nt, Homo sapiens
gugauuuugccu

SEQ ID NO: 956885 - RNA, 18 nt, Homo sapiens
gugcaaggaaauuugcaa

SEQ ID NO: 956886 - RNA, 13 nt, Homo sapiens
gugcacggggcca

SEQ ID NO: 956887 - RNA, 19 nt, Homo sapiens
gugcagaagcaugaucaca

SEQ ID NO: 956888 - RNA, 23 nt, Homo sapiens
gugccugccugggagacuuccuu

SEQ ID NO: 956889 - RNA, 14 nt, Homo sapiens
gugccuuacacaau

SEQ ID NO: 956890 - RNA, 16 nt, Homo sapiens
gugcgugagcugguca

SEQ ID NO: 956891 - RNA, 23 nt, Homo sapiens
gugcuuguggucacacuguggaa

SEQ ID NO: 956892 - RNA, 21 nt, Homo sapiens
guggagaaauacaucauuugc

SEQ ID NO: 956893 - RNA, 16 nt, Homo sapiens
guggggaaaaggcauu

SEQ ID NO: 956894 - RNA, 12 nt, Homo sapiens
guguaugugacc

SEQ ID NO: 956895 - RNA, 14 nt, Homo sapiens
guguccccugccug

SEQ ID NO: 956896 - RNA, 21 nt, Homo sapiens
gugugcccacugaacaugcuc

SEQ ID NO: 956897 - RNA, 13 nt, Homo sapiens
guuaaaacauaag

SEQ ID NO: 956898 - RNA, 14 nt, Homo sapiens
guuaaagagacaaa

SEQ ID NO: 956899 - RNA, 10 nt, Homo sapiens
guuaaugugc

SEQ ID NO: 956900 - RNA, 16 nt, Homo sapiens
guuaaugugccaaaau

SEQ ID NO: 956901 - RNA, 20 nt, Homo sapiens
guuacagacaaagcguggug

SEQ ID NO: 956902 - RNA, 22 nt, Homo sapiens
guuagaauuagguaauggauau

SEQ ID NO: 956903 - RNA, 16 nt, Homo sapiens
guuaguguacuuugaa

SEQ ID NO: 956904 - RNA, 14 nt, Homo sapiens
guuauaguugauau

SEQ ID NO: 956905 - RNA, 15 nt, Homo sapiens
guuaucaacaugcac

SEQ ID NO: 956906 - RNA, 21 nt, Homo sapiens
guuaugagaaaaaaacagcag

SEQ ID NO: 956907 - RNA, 22 nt, Homo sapiens
guucaggaggagacagucagga

SEQ ID NO: 956908 - RNA, 18 nt, Homo sapiens
guuccauguucaccaaga

SEQ ID NO: 956909 - RNA, 19 nt, Homo sapiens
guuccugucaauacagguu

SEQ ID NO: 956910 - RNA, 14 nt, Homo sapiens
guugcagaaaaaga

SEQ ID NO: 956911 - RNA, 19 nt, Homo sapiens
guugcaguuaauucuugcc

SEQ ID NO: 956912 - RNA, 21 nt, Homo sapiens
guuggcucacaucauguaaua

SEQ ID NO: 956913 - RNA, 23 nt, Homo sapiens
guugucucucuaaacccaaauaa

SEQ ID NO: 956914 - RNA, 13 nt, Homo sapiens
guuuaaucuucac

SEQ ID NO: 956915 - RNA, 21 nt, Homo sapiens
guuuaaugguaucuguuacuc

SEQ ID NO: 956916 - RNA, 20 nt, Homo sapiens
guuuaauuguaggucaauga

SEQ ID NO: 956917 - RNA, 16 nt, Homo sapiens
guuuacaugagacuuu

SEQ ID NO: 956918 - RNA, 17 nt, Homo sapiens
guuuagugcaugcaucu

SEQ ID NO: 956919 - RNA, 13 nt, Homo sapiens
guuucaaaccugc

SEQ ID NO: 956920 - RNA, 13 nt, Homo sapiens
guuucuauacugu

SEQ ID NO: 956921 - RNA, 22 nt, Homo sapiens
guuucuauagcgagacauagaa

SEQ ID NO: 956922 - RNA, 19 nt, Homo sapiens
guuugauucaaagcccuua

SEQ ID NO: 956923 - RNA, 17 nt, Homo sapiens
guuuuauuuuaucacuu

SEQ ID NO: 956924 - RNA, 12 nt, Homo sapiens
uaaaaagcccaa

SEQ ID NO: 956925 - RNA, 12 nt, Homo sapiens
uaaaaaguugca

SEQ ID NO: 956926 - RNA, 17 nt, Homo sapiens
uaaaaauaaccaaaaaa

SEQ ID NO: 956927 - RNA, 13 nt, Homo sapiens
uaaaaauaugaaa

SEQ ID NO: 956928 - RNA, 15 nt, Homo sapiens
uaaaaaugcugcauu

SEQ ID NO: 956929 - RNA, 23 nt, Homo sapiens
uaaaaauucaugucuguauuuca

SEQ ID NO: 956930 - RNA, 16 nt, Homo sapiens
uaaaagcaugucaaca

SEQ ID NO: 956931 - RNA, 22 nt, Homo sapiens
uaaaauagcacccuuuguuaau

SEQ ID NO: 956932 - RNA, 15 nt, Homo sapiens
uaaaauauacaaaca

SEQ ID NO: 956933 - RNA, 18 nt, Homo sapiens
uaaaaucuuuccaucuca

SEQ ID NO: 956934 - RNA, 19 nt, Homo sapiens
uaaaaucuuuccaucucau

SEQ ID NO: 956935 - RNA, 13 nt, Homo sapiens
uaaaauuaugaaa

SEQ ID NO: 956936 - RNA, 17 nt, Homo sapiens
uaaaauuguguucuuaa

SEQ ID NO: 956937 - RNA, 22 nt, Homo sapiens
uaaacccaaauaaauguguaaa

SEQ ID NO: 956938 - RNA, 16 nt, Homo sapiens
uaaacucaucuaucca

SEQ ID NO: 956939 - RNA, 20 nt, Homo sapiens
uaaacugauguauagcuuua

SEQ ID NO: 956940 - RNA, 16 nt, Homo sapiens
uaaacuuuccuguacu

SEQ ID NO: 956941 - RNA, 18 nt, Homo sapiens
uaaagauggggaaacuaa

SEQ ID NO: 956942 - RNA, 17 nt, Homo sapiens
uaaaguucauccuuuga

SEQ ID NO: 956943 - RNA, 13 nt, Homo sapiens
uaaauaaugauuc

SEQ ID NO: 956944 - RNA, 12 nt, Homo sapiens
uaaaucauuuca

SEQ ID NO: 956945 - RNA, 21 nt, Homo sapiens
uaaaucugucugauucuaugc

SEQ ID NO: 956946 - RNA, 15 nt, Homo sapiens
uaaauuauaccauga

SEQ ID NO: 956947 - RNA, 16 nt, Homo sapiens
uaaauuuaacugcaua

SEQ ID NO: 956948 - RNA, 20 nt, Homo sapiens
uaaauuuaauauacugcaua

SEQ ID NO: 956949 - RNA, 14 nt, Homo sapiens
uaacaaauguggcu

SEQ ID NO: 956950 - RNA, 13 nt, Homo sapiens
uaaccaacauuuu

SEQ ID NO: 956951 - RNA, 17 nt, Homo sapiens
uaaccccauucaugaga

SEQ ID NO: 956952 - RNA, 22 nt, Homo sapiens
uaaccuaccacuacauugcaca

SEQ ID NO: 956953 - RNA, 14 nt, Homo sapiens
uaaccucaauuuau

SEQ ID NO: 956954 - RNA, 21 nt, Homo sapiens
uaaccucaauuuauguuaaca

SEQ ID NO: 956955 - RNA, 23 nt, Homo sapiens
uaaccuuucaggaaaguaucucu

SEQ ID NO: 956956 - RNA, 15 nt, Homo sapiens
uaacuaacagcaucc

SEQ ID NO: 956957 - RNA, 15 nt, Homo sapiens
uaacuagagguaaua

SEQ ID NO: 956958 - RNA, 21 nt, Homo sapiens
uaacugcacacaugguuucca

SEQ ID NO: 956959 - RNA, 19 nt, Homo sapiens
uaacuuagaaugcuucaag

SEQ ID NO: 956960 - RNA, 14 nt, Homo sapiens
uaagaaaaaucaua

SEQ ID NO: 956961 - RNA, 17 nt, Homo sapiens
uaagaaaaaucauaacu

SEQ ID NO: 956962 - RNA, 18 nt, Homo sapiens
uaagagguuaugccaaaa

SEQ ID NO: 956963 - RNA, 22 nt, Homo sapiens
uaagcugcucccugucuaugua

SEQ ID NO: 956964 - RNA, 15 nt, Homo sapiens
uaaggaacagcauug

SEQ ID NO: 956965 - RNA, 18 nt, Homo sapiens
uaagguaccaagaucaca

SEQ ID NO: 956966 - RNA, 19 nt, Homo sapiens
uaagucacuuaaacucauc

SEQ ID NO: 956967 - RNA, 23 nt, Homo sapiens
uaagugaggaugaaaaaauaaca

SEQ ID NO: 956968 - RNA, 17 nt, Homo sapiens
uaaguugcuaaccucaa

SEQ ID NO: 956969 - RNA, 16 nt, Homo sapiens
uaauaacuagaucucc

SEQ ID NO: 956970 - RNA, 15 nt, Homo sapiens
uaauaacugaugaga

SEQ ID NO: 956971 - RNA, 13 nt, Homo sapiens
uaauaauuacuua

SEQ ID NO: 956972 - RNA, 15 nt, Homo sapiens
uaauaauuacuuaau

SEQ ID NO: 956973 - RNA, 22 nt, Homo sapiens
uaauauuuuguauuauugcugu

SEQ ID NO: 956974 - RNA, 14 nt, Homo sapiens
uaaucaaaugauuc

SEQ ID NO: 956975 - RNA, 13 nt, Homo sapiens
uaauccucuaugu

SEQ ID NO: 956976 - RNA, 16 nt, Homo sapiens
uaaucugaaugugcaa

SEQ ID NO: 956977 - RNA, 17 nt, Homo sapiens
uaaugaaaccugugucu

SEQ ID NO: 956978 - RNA, 21 nt, Homo sapiens
uaaugacuuaagcacacuuga

SEQ ID NO: 956979 - RNA, 15 nt, Homo sapiens
uaaugauucaaugug

SEQ ID NO: 956980 - RNA, 15 nt, Homo sapiens
uaaugcaauuagaua

SEQ ID NO: 956981 - RNA, 19 nt, Homo sapiens
uaauggcagagcagucuaa

SEQ ID NO: 956982 - RNA, 20 nt, Homo sapiens
uaaugguaucuguuacucca

SEQ ID NO: 956983 - RNA, 22 nt, Homo sapiens
uaauguguugugaaaauuuaau

SEQ ID NO: 956984 - RNA, 11 nt, Homo sapiens
uaauguuauag

SEQ ID NO: 956985 - RNA, 14 nt, Homo sapiens
uaauuaaacuauga

SEQ ID NO: 956986 - RNA, 12 nt, Homo sapiens
uaauuacuuaau

SEQ ID NO: 956987 - RNA, 18 nt, Homo sapiens
uaauuauuuuagcacaaa

SEQ ID NO: 956988 - RNA, 12 nt, Homo sapiens
uaauuuccauga

SEQ ID NO: 956989 - RNA, 22 nt, Homo sapiens
uaauuuuaacagacauguauac

SEQ ID NO: 956990 - RNA, 21 nt, Homo sapiens
uaauuuuuguauuuuggcaga

SEQ ID NO: 956991 - RNA, 22 nt, Homo sapiens
uacaaaaguuuaaaaagcucac

SEQ ID NO: 956992 - RNA, 22 nt, Homo sapiens
uacaaauuuuuacucaggcuuu

SEQ ID NO: 956993 - RNA, 18 nt, Homo sapiens
uacaacacuuuaaguaaa

SEQ ID NO: 956994 - RNA, 15 nt, Homo sapiens
uacaagcaucaugga

SEQ ID NO: 956995 - RNA, 22 nt, Homo sapiens
uacacauacacaagugcacaga

SEQ ID NO: 956996 - RNA, 23 nt, Homo sapiens
uacacugcuccuguggccuucca

SEQ ID NO: 956997 - RNA, 17 nt, Homo sapiens
uacagaaaauagcuuuu

SEQ ID NO: 956998 - RNA, 18 nt, Homo sapiens
uacagaaacaacugccaa

SEQ ID NO: 956999 - RNA, 23 nt, Homo sapiens
uacagacaaagcgugguggacau

SEQ ID NO: 957000 - RNA, 17 nt, Homo sapiens
uacagcaaauguuauag

SEQ ID NO: 957001 - RNA, 11 nt, Homo sapiens
uacagcacugu

SEQ ID NO: 957002 - RNA, 19 nt, Homo sapiens
uacaggcauacacaugcac

SEQ ID NO: 957003 - RNA, 13 nt, Homo sapiens
uacaggugugagc

SEQ ID NO: 957004 - RNA, 16 nt, Homo sapiens
uacagucauaaugugu

SEQ ID NO: 957005 - RNA, 13 nt, Homo sapiens
uacagucauuucc

SEQ ID NO: 957006 - RNA, 19 nt, Homo sapiens
uacaucuuccaucuuacuu

SEQ ID NO: 957007 - RNA, 20 nt, Homo sapiens
uacaugaauacgucuugauc

SEQ ID NO: 957008 - RNA, 13 nt, Homo sapiens
uacauuguaguua

SEQ ID NO: 957009 - RNA, 10 nt, Homo sapiens
uaccaaauau

SEQ ID NO: 957010 - RNA, 13 nt, Homo sapiens
uaccaagcuguga

SEQ ID NO: 957011 - RNA, 17 nt, Homo sapiens
uaccagagcgugcacuu

SEQ ID NO: 957012 - RNA, 15 nt, Homo sapiens
uaccauguugcccag

SEQ ID NO: 957013 - RNA, 18 nt, Homo sapiens
uacccuacccugcacauu

SEQ ID NO: 957014 - RNA, 13 nt, Homo sapiens
uacccuccaugua

SEQ ID NO: 957015 - RNA, 16 nt, Homo sapiens
uaccucccucauuuaa

SEQ ID NO: 957016 - RNA, 21 nt, Homo sapiens
uaccugaacugaaaggacugu

SEQ ID NO: 957017 - RNA, 23 nt, Homo sapiens
uaccugaagucuuuguacagaca

SEQ ID NO: 957018 - RNA, 18 nt, Homo sapiens
uaccuuguguacuuucuu

SEQ ID NO: 957019 - RNA, 22 nt, Homo sapiens
uacgucuugaucagacauucag

SEQ ID NO: 957020 - RNA, 18 nt, Homo sapiens
uacgugaguccuggcaug

SEQ ID NO: 957021 - RNA, 12 nt, Homo sapiens
uacuaaagacag

SEQ ID NO: 957022 - RNA, 20 nt, Homo sapiens
uacuaggaguacaggcauag

SEQ ID NO: 957023 - RNA, 19 nt, Homo sapiens
uacuauguaagggcuuuaa

SEQ ID NO: 957024 - RNA, 17 nt, Homo sapiens
uacuccuuuuaaaacaa

SEQ ID NO: 957025 - RNA, 19 nt, Homo sapiens
uacucgaguuacagacaaa

SEQ ID NO: 957026 - RNA, 16 nt, Homo sapiens
uacucuuuucccaaga

SEQ ID NO: 957027 - RNA, 14 nt, Homo sapiens
uacugaacaguauu

SEQ ID NO: 957028 - RNA, 14 nt, Homo sapiens
uacugaauugucag

SEQ ID NO: 957029 - RNA, 19 nt, Homo sapiens
uacuggagaaaauggacgu

SEQ ID NO: 957030 - RNA, 12 nt, Homo sapiens
uacuuccuccua

SEQ ID NO: 957031 - RNA, 23 nt, Homo sapiens
uacuuccuccuagcaaccaacuu

SEQ ID NO: 957032 - RNA, 21 nt, Homo sapiens
uacuucuaaauuauaccauga

SEQ ID NO: 957033 - RNA, 23 nt, Homo sapiens
uacuucuaaauuauaccaugaga

SEQ ID NO: 957034 - RNA, 12 nt, Homo sapiens
uacuucuuuauu

SEQ ID NO: 957035 - RNA, 19 nt, Homo sapiens
uacuugauauaauuacuua

SEQ ID NO: 957036 - RNA, 23 nt, Homo sapiens
uacuuuccaacauuauccugugu

SEQ ID NO: 957037 - RNA, 19 nt, Homo sapiens
uacuuuccugauguugaua

SEQ ID NO: 957038 - RNA, 18 nt, Homo sapiens
uagaaaaaugcuguucag

SEQ ID NO: 957039 - RNA, 14 nt, Homo sapiens
uagaaaggggccca

SEQ ID NO: 957040 - RNA, 14 nt, Homo sapiens
uagaacaagccaga

SEQ ID NO: 957041 - RNA, 15 nt, Homo sapiens
uagaacaagccagag

SEQ ID NO: 957042 - RNA, 23 nt, Homo sapiens
uagaacaggguuucucagccuua

SEQ ID NO: 957043 - RNA, 16 nt, Homo sapiens
uagaauaccucccuca

SEQ ID NO: 957044 - RNA, 16 nt, Homo sapiens
uagaauagaagaaaga

SEQ ID NO: 957045 - RNA, 18 nt, Homo sapiens
uagaauauccuauacugg

SEQ ID NO: 957046 - RNA, 13 nt, Homo sapiens
uagaauuaucucu

SEQ ID NO: 957047 - RNA, 14 nt, Homo sapiens
uagaccaugcacag

SEQ ID NO: 957048 - RNA, 18 nt, Homo sapiens
uagaccuggauguuauau

SEQ ID NO: 957049 - RNA, 19 nt, Homo sapiens
uagagcaaagacuuaauca

SEQ ID NO: 957050 - RNA, 19 nt, Homo sapiens
uagaguuccuuucugggaa

SEQ ID NO: 957051 - RNA, 12 nt, Homo sapiens
uagaguuugugu

SEQ ID NO: 957052 - RNA, 20 nt, Homo sapiens
uagauaagugcucaguauug

SEQ ID NO: 957053 - RNA, 19 nt, Homo sapiens
uagauccucugauauacaa

SEQ ID NO: 957054 - RNA, 15 nt, Homo sapiens
uagauguauuuucaa

SEQ ID NO: 957055 - RNA, 19 nt, Homo sapiens
uagauguauuuucaauaaa

SEQ ID NO: 957056 - RNA, 21 nt, Homo sapiens
uagauguauuuucaauaaaga

SEQ ID NO: 957057 - RNA, 18 nt, Homo sapiens
uagcacaaagaugugcaa

SEQ ID NO: 957058 - RNA, 15 nt, Homo sapiens
uagcacuauggacau

SEQ ID NO: 957059 - RNA, 19 nt, Homo sapiens
uagcagaggccaauucaau

SEQ ID NO: 957060 - RNA, 16 nt, Homo sapiens
uagcaguacccuagcc

SEQ ID NO: 957061 - RNA, 14 nt, Homo sapiens
uagcaguaugugug

SEQ ID NO: 957062 - RNA, 15 nt, Homo sapiens
uagccacuugcucag

SEQ ID NO: 957063 - RNA, 20 nt, Homo sapiens
uagccacuugcucagccaua

SEQ ID NO: 957064 - RNA, 17 nt, Homo sapiens
uagccuaucaagccuua

SEQ ID NO: 957065 - RNA, 23 nt, Homo sapiens
uagccucaacucacuagaugcca

SEQ ID NO: 957066 - RNA, 20 nt, Homo sapiens
uagccugugauuuugccuug

SEQ ID NO: 957067 - RNA, 21 nt, Homo sapiens
uagcuaauuauuuuagcacaa

SEQ ID NO: 957068 - RNA, 18 nt, Homo sapiens
uagcugggacuagaggca

SEQ ID NO: 957069 - RNA, 15 nt, Homo sapiens
uagcuguguccucac

SEQ ID NO: 957070 - RNA, 17 nt, Homo sapiens
uagcuguguccucacau

SEQ ID NO: 957071 - RNA, 14 nt, Homo sapiens
uagcuuguccaagg

SEQ ID NO: 957072 - RNA, 13 nt, Homo sapiens
uaggcaugugcaa

SEQ ID NO: 957073 - RNA, 14 nt, Homo sapiens
uaggccacacagca

SEQ ID NO: 957074 - RNA, 15 nt, Homo sapiens
uaggccacacagcac

SEQ ID NO: 957075 - RNA, 15 nt, Homo sapiens
uagggccacuuggau

SEQ ID NO: 957076 - RNA, 18 nt, Homo sapiens
uaguacaccauaaacugg

SEQ ID NO: 957077 - RNA, 16 nt, Homo sapiens
uaguacccaaccaaag

SEQ ID NO: 957078 - RNA, 13 nt, Homo sapiens
uaguagagcaaag

SEQ ID NO: 957079 - RNA, 16 nt, Homo sapiens
uaguagagcauaccac

SEQ ID NO: 957080 - RNA, 15 nt, Homo sapiens
uaguauaauaugcag

SEQ ID NO: 957081 - RNA, 16 nt, Homo sapiens
uaguauaauaugcagu

SEQ ID NO: 957082 - RNA, 13 nt, Homo sapiens
uagucaauaugcc

SEQ ID NO: 957083 - RNA, 16 nt, Homo sapiens
uagucuuagguuucca

SEQ ID NO: 957084 - RNA, 17 nt, Homo sapiens
uagugguggcagugcag

SEQ ID NO: 957085 - RNA, 15 nt, Homo sapiens
uagugugugcaauuu

SEQ ID NO: 957086 - RNA, 20 nt, Homo sapiens
uaguugauauguaacaguug

SEQ ID NO: 957087 - RNA, 14 nt, Homo sapiens
uaguuucaggcaag

SEQ ID NO: 957088 - RNA, 19 nt, Homo sapiens
uaguuuuuccugugcaaaa

SEQ ID NO: 957089 - RNA, 13 nt, Homo sapiens
uauaaaaucuuuc

SEQ ID NO: 957090 - RNA, 14 nt, Homo sapiens
uauaaaauuaugaa

SEQ ID NO: 957091 - RNA, 16 nt, Homo sapiens
uauaaaguaauuguau

SEQ ID NO: 957092 - RNA, 14 nt, Homo sapiens
uauaaauguuucau

SEQ ID NO: 957093 - RNA, 13 nt, Homo sapiens
uauaagaaauaca

SEQ ID NO: 957094 - RNA, 15 nt, Homo sapiens
uauaauaauuacuua

SEQ ID NO: 957095 - RNA, 18 nt, Homo sapiens
uauaauauuauacugcua

SEQ ID NO: 957096 - RNA, 15 nt, Homo sapiens
uauaaucauauccag

SEQ ID NO: 957097 - RNA, 14 nt, Homo sapiens
uauacaaacaugug

SEQ ID NO: 957098 - RNA, 18 nt, Homo sapiens
uauacauguauagugagu

SEQ ID NO: 957099 - RNA, 14 nt, Homo sapiens
uauagacaguuugu

SEQ ID NO: 957100 - RNA, 14 nt, Homo sapiens
uauauaaccucaaa

SEQ ID NO: 957101 - RNA, 13 nt, Homo sapiens
uauauauauauca

SEQ ID NO: 957102 - RNA, 14 nt, Homo sapiens
uauauccccaaaau

SEQ ID NO: 957103 - RNA, 11 nt, Homo sapiens
uauaucuguaa

SEQ ID NO: 957104 - RNA, 22 nt, Homo sapiens
uauaucuguaaauuuaacugca

SEQ ID NO: 957105 - RNA, 15 nt, Homo sapiens
uaucaaaucauucaa

SEQ ID NO: 957106 - RNA, 21 nt, Homo sapiens
uaucaaugcccaacagggcaa

SEQ ID NO: 957107 - RNA, 14 nt, Homo sapiens
uaucacacuugcaa

SEQ ID NO: 957108 - RNA, 16 nt, Homo sapiens
uaucacacuugcaaau

SEQ ID NO: 957109 - RNA, 15 nt, Homo sapiens
uaucaccucuucaca

SEQ ID NO: 957110 - RNA, 18 nt, Homo sapiens
uauccacuacauucugaa

SEQ ID NO: 957111 - RNA, 19 nt, Homo sapiens
uauccaguuuaaucuucac

SEQ ID NO: 957112 - RNA, 15 nt, Homo sapiens
uauccuauacugguu

SEQ ID NO: 957113 - RNA, 19 nt, Homo sapiens
uauccuuacuagauucaua

SEQ ID NO: 957114 - RNA, 13 nt, Homo sapiens
uaucuccaugaua

SEQ ID NO: 957115 - RNA, 19 nt, Homo sapiens
uaucugauggcaccuauaa

SEQ ID NO: 957116 - RNA, 13 nt, Homo sapiens
uaugcaaccugug

SEQ ID NO: 957117 - RNA, 14 nt, Homo sapiens
uaugcaaccugugc

SEQ ID NO: 957118 - RNA, 19 nt, Homo sapiens
uaugccuccauuucagaga

SEQ ID NO: 957119 - RNA, 17 nt, Homo sapiens
uaugcuacuguguuaca

SEQ ID NO: 957120 - RNA, 13 nt, Homo sapiens
uaugcuauggaau

SEQ ID NO: 957121 - RNA, 19 nt, Homo sapiens
uauggaaauaaaaggcauu

SEQ ID NO: 957122 - RNA, 16 nt, Homo sapiens
uaugguucuuauucac

SEQ ID NO: 957123 - RNA, 16 nt, Homo sapiens
uauguagaacuguuca

SEQ ID NO: 957124 - RNA, 18 nt, Homo sapiens
uaugugauuaguaugcua

SEQ ID NO: 957125 - RNA, 14 nt, Homo sapiens
uauguuauuuucag

SEQ ID NO: 957126 - RNA, 17 nt, Homo sapiens
uauuaaaguuucauuag

SEQ ID NO: 957127 - RNA, 20 nt, Homo sapiens
uauuacaccuuuaucucaag

SEQ ID NO: 957128 - RNA, 14 nt, Homo sapiens
uauuauuaaucuca

SEQ ID NO: 957129 - RNA, 15 nt, Homo sapiens
uauuauuaaucucau

SEQ ID NO: 957130 - RNA, 17 nt, Homo sapiens
uauucacugagucucau

SEQ ID NO: 957131 - RNA, 15 nt, Homo sapiens
uauucagguaacuca

SEQ ID NO: 957132 - RNA, 22 nt, Homo sapiens
uauucuuccaaguucauucaua

SEQ ID NO: 957133 - RNA, 15 nt, Homo sapiens
uauuggcaauaugaa

SEQ ID NO: 957134 - RNA, 17 nt, Homo sapiens
uauugucacaugaugaa

SEQ ID NO: 957135 - RNA, 17 nt, Homo sapiens
uauuuaggcaugagcuc

SEQ ID NO: 957136 - RNA, 13 nt, Homo sapiens
uauuucaaaauca

SEQ ID NO: 957137 - RNA, 19 nt, Homo sapiens
uauuucaaaccaguuucac

SEQ ID NO: 957138 - RNA, 12 nt, Homo sapiens
uauuucaauaac

SEQ ID NO: 957139 - RNA, 15 nt, Homo sapiens
uauuuccaacaaacu

SEQ ID NO: 957140 - RNA, 19 nt, Homo sapiens
uauuuggaaaccuuuucac

SEQ ID NO: 957141 - RNA, 12 nt, Homo sapiens
uauuuucuccau

SEQ ID NO: 957142 - RNA, 15 nt, Homo sapiens
uauuuugugcaagcu

SEQ ID NO: 957143 - RNA, 21 nt, Homo sapiens
ucaaaaguccuuagaaugagg

SEQ ID NO: 957144 - RNA, 21 nt, Homo sapiens
ucaaaauguuaacaacuugaa

SEQ ID NO: 957145 - RNA, 20 nt, Homo sapiens
ucaaaauuaccaaacaaagc

SEQ ID NO: 957146 - RNA, 13 nt, Homo sapiens
ucaaccaacugua

SEQ ID NO: 957147 - RNA, 18 nt, Homo sapiens
ucaacuccagucucggca

SEQ ID NO: 957148 - RNA, 17 nt, Homo sapiens
ucaacugucuauuguca

SEQ ID NO: 957149 - RNA, 15 nt, Homo sapiens
ucaacuguugccagg

SEQ ID NO: 957150 - RNA, 16 nt, Homo sapiens
ucaagagcccuuccag

SEQ ID NO: 957151 - RNA, 14 nt, Homo sapiens
ucaagaugugacau

SEQ ID NO: 957152 - RNA, 14 nt, Homo sapiens
ucaagcgauccucc

SEQ ID NO: 957153 - RNA, 21 nt, Homo sapiens
ucaauccuaaaagcaugucaa

SEQ ID NO: 957154 - RNA, 18 nt, Homo sapiens
ucaaugugaaauaaagag

SEQ ID NO: 957155 - RNA, 20 nt, Homo sapiens
ucaauucugauuccaaauaa

SEQ ID NO: 957156 - RNA, 13 nt, Homo sapiens
ucacaauauccaa

SEQ ID NO: 957157 - RNA, 21 nt, Homo sapiens
ucacagguugaugcugcacag

SEQ ID NO: 957158 - RNA, 18 nt, Homo sapiens
ucacaguauuuacaagcu

SEQ ID NO: 957159 - RNA, 15 nt, Homo sapiens
ucaccacugacagau

SEQ ID NO: 957160 - RNA, 17 nt, Homo sapiens
ucaccagguccugugag

SEQ ID NO: 957161 - RNA, 16 nt, Homo sapiens
ucacccacugcugcac

SEQ ID NO: 957162 - RNA, 20 nt, Homo sapiens
ucacuacagaucucccagua

SEQ ID NO: 957163 - RNA, 19 nt, Homo sapiens
ucacuacaguuucaacguc

SEQ ID NO: 957164 - RNA, 15 nt, Homo sapiens
ucacuagaugccaau

SEQ ID NO: 957165 - RNA, 18 nt, Homo sapiens
ucacucuuguugugcucu

SEQ ID NO: 957166 - RNA, 15 nt, Homo sapiens
ucacuuuaaauauga

SEQ ID NO: 957167 - RNA, 16 nt, Homo sapiens
ucagaaaagacacuuc

SEQ ID NO: 957168 - RNA, 14 nt, Homo sapiens
ucagaaggagacag

SEQ ID NO: 957169 - RNA, 15 nt, Homo sapiens
ucagaaggcucuauc

SEQ ID NO: 957170 - RNA, 20 nt, Homo sapiens
ucagaaggcucuaucugcug

SEQ ID NO: 957171 - RNA, 14 nt, Homo sapiens
ucagacauucagag

SEQ ID NO: 957172 - RNA, 21 nt, Homo sapiens
ucagaucccucggucagcacc

SEQ ID NO: 957173 - RNA, 15 nt, Homo sapiens
ucagcacagccucac

SEQ ID NO: 957174 - RNA, 21 nt, Homo sapiens
ucagcacguaguuugcauucc

SEQ ID NO: 957175 - RNA, 18 nt, Homo sapiens
ucagcagccucacugcau

SEQ ID NO: 957176 - RNA, 21 nt, Homo sapiens
ucagcuagauuuguguccaca

SEQ ID NO: 957177 - RNA, 13 nt, Homo sapiens
ucagcucugcaua

SEQ ID NO: 957178 - RNA, 14 nt, Homo sapiens
ucaggaggagacag

SEQ ID NO: 957179 - RNA, 12 nt, Homo sapiens
ucaggcuuucua

SEQ ID NO: 957180 - RNA, 19 nt, Homo sapiens
ucagguuaaauuaaaccaa

SEQ ID NO: 957181 - RNA, 15 nt, Homo sapiens
ucaguaugaagacac

SEQ ID NO: 957182 - RNA, 16 nt, Homo sapiens
ucagucuacacucaca

SEQ ID NO: 957183 - RNA, 12 nt, Homo sapiens
ucagucugucca

SEQ ID NO: 957184 - RNA, 21 nt, Homo sapiens
ucagugccaaaaacaacaaca

SEQ ID NO: 957185 - RNA, 18 nt, Homo sapiens
ucagugcuuugcccuuga

SEQ ID NO: 957186 - RNA, 17 nt, Homo sapiens
ucaguguggacugggaa

SEQ ID NO: 957187 - RNA, 13 nt, Homo sapiens
ucaguugccaaag

SEQ ID NO: 957188 - RNA, 22 nt, Homo sapiens
ucaguuguggccucauucagca

SEQ ID NO: 957189 - RNA, 19 nt, Homo sapiens
ucaguuucacauauuugua

SEQ ID NO: 957190 - RNA, 14 nt, Homo sapiens
ucauaaaaauaacc

SEQ ID NO: 957191 - RNA, 20 nt, Homo sapiens
ucauaaaaauaaccaaaaaa

SEQ ID NO: 957192 - RNA, 16 nt, Homo sapiens
ucauaaucucuuucca

SEQ ID NO: 957193 - RNA, 14 nt, Homo sapiens
ucauaauuaaauca

SEQ ID NO: 957194 - RNA, 14 nt, Homo sapiens
ucauaauucauuua

SEQ ID NO: 957195 - RNA, 14 nt, Homo sapiens
ucauacucaaagag

SEQ ID NO: 957196 - RNA, 23 nt, Homo sapiens
ucauacucuguguaaucucugau

SEQ ID NO: 957197 - RNA, 21 nt, Homo sapiens
ucauaguuacuuacugccuua

SEQ ID NO: 957198 - RNA, 15 nt, Homo sapiens
ucauccaacuggaag

SEQ ID NO: 957199 - RNA, 21 nt, Homo sapiens
ucaucucuuguaaauacaugu

SEQ ID NO: 957200 - RNA, 15 nt, Homo sapiens
ucaugagaggaacua

SEQ ID NO: 957201 - RNA, 20 nt, Homo sapiens
ucauggagggagaagaaaga

SEQ ID NO: 957202 - RNA, 18 nt, Homo sapiens
ucaugggucugcccuuga

SEQ ID NO: 957203 - RNA, 19 nt, Homo sapiens
ucauguaauuuuguaucac

SEQ ID NO: 957204 - RNA, 16 nt, Homo sapiens
ucauguucagucacau

SEQ ID NO: 957205 - RNA, 22 nt, Homo sapiens
ucauuacagauuuaguuuacca

SEQ ID NO: 957206 - RNA, 12 nt, Homo sapiens
ucauucugcuaa

SEQ ID NO: 957207 - RNA, 12 nt, Homo sapiens
ucauucuuuaua

SEQ ID NO: 957208 - RNA, 19 nt, Homo sapiens
ucauugccuucucccucau

SEQ ID NO: 957209 - RNA, 14 nt, Homo sapiens
ucauugcugacaga

SEQ ID NO: 957210 - RNA, 23 nt, Homo sapiens
ucauuguuaauauaacugucuua

SEQ ID NO: 957211 - RNA, 18 nt, Homo sapiens
uccaaacuguucugagaa

SEQ ID NO: 957212 - RNA, 13 nt, Homo sapiens
uccaaggucucau

SEQ ID NO: 957213 - RNA, 15 nt, Homo sapiens
uccaaggucucauga

SEQ ID NO: 957214 - RNA, 18 nt, Homo sapiens
uccaauuaaugauucaau

SEQ ID NO: 957215 - RNA, 22 nt, Homo sapiens
uccacacccucuccuugucaca

SEQ ID NO: 957216 - RNA, 17 nt, Homo sapiens
uccacacggucuucaca

SEQ ID NO: 957217 - RNA, 11 nt, Homo sapiens
uccacauucau

SEQ ID NO: 957218 - RNA, 22 nt, Homo sapiens
uccacauucauguacaaugaug

SEQ ID NO: 957219 - RNA, 18 nt, Homo sapiens
uccacguaagucacugaa

SEQ ID NO: 957220 - RNA, 20 nt, Homo sapiens
uccacugagaagaucaauga

SEQ ID NO: 957221 - RNA, 10 nt, Homo sapiens
uccacuguca

SEQ ID NO: 957222 - RNA, 14 nt, Homo sapiens
uccacuucucuaga

SEQ ID NO: 957223 - RNA, 20 nt, Homo sapiens
uccagaacgcccugugucca

SEQ ID NO: 957224 - RNA, 16 nt, Homo sapiens
uccaguuuaaucuuca

SEQ ID NO: 957225 - RNA, 13 nt, Homo sapiens
uccauaucagcuc

SEQ ID NO: 957226 - RNA, 14 nt, Homo sapiens
uccauaucagcucu

SEQ ID NO: 957227 - RNA, 19 nt, Homo sapiens
uccaucuuacuugcccuuc

SEQ ID NO: 957228 - RNA, 21 nt, Homo sapiens
uccauggauaauugcuucaca

SEQ ID NO: 957229 - RNA, 21 nt, Homo sapiens
uccauguaccuuguguacuuu

SEQ ID NO: 957230 - RNA, 12 nt, Homo sapiens
uccaugugaaau

SEQ ID NO: 957231 - RNA, 12 nt, Homo sapiens
uccauguucacc

SEQ ID NO: 957232 - RNA, 19 nt, Homo sapiens
ucccaauuugaauucaauu

SEQ ID NO: 957233 - RNA, 22 nt, Homo sapiens
ucccacuggaggcaugugauga

SEQ ID NO: 957234 - RNA, 22 nt, Homo sapiens
ucccacuuaucaaaucauucaa

SEQ ID NO: 957235 - RNA, 18 nt, Homo sapiens
ucccagaaaaacugagga

SEQ ID NO: 957236 - RNA, 21 nt, Homo sapiens
ucccagcaucauguagugcau

SEQ ID NO: 957237 - RNA, 14 nt, Homo sapiens
ucccagcucacugc

SEQ ID NO: 957238 - RNA, 17 nt, Homo sapiens
ucccaggacgcagggag

SEQ ID NO: 957239 - RNA, 16 nt, Homo sapiens
ucccaggucacaugca

SEQ ID NO: 957240 - RNA, 23 nt, Homo sapiens
ugacaaaaguaagagagcacagu

SEQ ID NO: 957241 - RNA, 19 nt, Homo sapiens
ugacaauuugccauagcag

SEQ ID NO: 957242 - RNA, 18 nt, Homo sapiens
ugacacuagucagaaaau

SEQ ID NO: 957243 - RNA, 12 nt, Homo sapiens
ugacagcacuuu

SEQ ID NO: 957244 - RNA, 23 nt, Homo sapiens
ugacgugaguggggaggagacuc

SEQ ID NO: 957245 - RNA, 15 nt, Homo sapiens
ugacucagcacuguu

SEQ ID NO: 957246 - RNA, 20 nt, Homo sapiens
ugacugaagggacuagcuau

SEQ ID NO: 957247 - RNA, 23 nt, Homo sapiens
ugacugcugugggcugcucacug

SEQ ID NO: 957248 - RNA, 15 nt, Homo sapiens
ugacuuaagcacacu

SEQ ID NO: 957249 - RNA, 17 nt, Homo sapiens
ugacuuucgauuaugcu

SEQ ID NO: 957250 - RNA, 17 nt, Homo sapiens
ugagaaacuuccuuuga

SEQ ID NO: 957251 - RNA, 17 nt, Homo sapiens
ugagaaauaaagcacau

SEQ ID NO: 957252 - RNA, 21 nt, Homo sapiens
ugagaaucgaccucacuguca

SEQ ID NO: 957253 - RNA, 21 nt, Homo sapiens
ugagcacaggcaacauuacaa

SEQ ID NO: 957254 - RNA, 21 nt, Homo sapiens
ugagccaaagcuuaugugaca

SEQ ID NO: 957255 - RNA, 17 nt, Homo sapiens
ugagggaaaacauaaua

SEQ ID NO: 957256 - RNA, 19 nt, Homo sapiens
ugaggguccucuuccucaa

SEQ ID NO: 957257 - RNA, 20 nt, Homo sapiens
ugaggucaucccggggccau

SEQ ID NO: 957258 - RNA, 16 nt, Homo sapiens
ugagguuaugagaaaa

SEQ ID NO: 957259 - RNA, 18 nt, Homo sapiens
ugaguuaccucaugccgc

SEQ ID NO: 957260 - RNA, 14 nt, Homo sapiens
ugaguugagcucua

SEQ ID NO: 957261 - RNA, 14 nt, Homo sapiens
ugauaaaccugcca

SEQ ID NO: 957262 - RNA, 21 nt, Homo sapiens
ugauaaccaagaaugucucca

SEQ ID NO: 957263 - RNA, 14 nt, Homo sapiens
ugauacaguauuau

SEQ ID NO: 957264 - RNA, 16 nt, Homo sapiens
ugauauaauuacuuaa

SEQ ID NO: 957265 - RNA, 14 nt, Homo sapiens
ugaucagacauuca

SEQ ID NO: 957266 - RNA, 20 nt, Homo sapiens
ugaucagacuugauuuacaa

SEQ ID NO: 957267 - RNA, 17 nt, Homo sapiens
ugaucauugcaguauca

SEQ ID NO: 957268 - RNA, 22 nt, Homo sapiens
ugaucuuguaaaaauagcaaaa

SEQ ID NO: 957269 - RNA, 16 nt, Homo sapiens
ugaugaguugagcucu

SEQ ID NO: 957270 - RNA, 23 nt, Homo sapiens
ugauggcacauuagaugaaguua

SEQ ID NO: 957271 - RNA, 21 nt, Homo sapiens
ugauggcggcucacaagugaa

SEQ ID NO: 957272 - RNA, 17 nt, Homo sapiens
ugauguaaauauuucaa

SEQ ID NO: 957273 - RNA, 15 nt, Homo sapiens
ugauuaagcuuuugu

SEQ ID NO: 957274 - RNA, 14 nt, Homo sapiens
ugauuacagcauag

SEQ ID NO: 957275 - RNA, 15 nt, Homo sapiens
ugauuaugaauacag

SEQ ID NO: 957276 - RNA, 23 nt, Homo sapiens
ugauuccaaauaaguugcgcuua

SEQ ID NO: 957277 - RNA, 17 nt, Homo sapiens
ugauucuaugccuguau

SEQ ID NO: 957278 - RNA, 17 nt, Homo sapiens
ugauugcaggaagggaa

SEQ ID NO: 957279 - RNA, 12 nt, Homo sapiens
ugauugugaaac

SEQ ID NO: 957280 - RNA, 21 nt, Homo sapiens
ugauuguuuaauuguagguca

SEQ ID NO: 957281 - RNA, 16 nt, Homo sapiens
ugcaaaaauaaaaugg

SEQ ID NO: 957282 - RNA, 14 nt, Homo sapiens
ugcaaagcauuuga

SEQ ID NO: 957283 - RNA, 12 nt, Homo sapiens
ugcaaugaucag

SEQ ID NO: 957284 - RNA, 18 nt, Homo sapiens
ugcaauuucuccaaagcu

SEQ ID NO: 957285 - RNA, 15 nt, Homo sapiens
ugcacacaugcacac

SEQ ID NO: 957286 - RNA, 20 nt, Homo sapiens
ugcacacauuggccgcuuca

SEQ ID NO: 957287 - RNA, 20 nt, Homo sapiens
ugcacagaccacacacagca

SEQ ID NO: 957288 - RNA, 17 nt, Homo sapiens
ugcacagcuaacaugga

SEQ ID NO: 957289 - RNA, 14 nt, Homo sapiens
ugcacucacgcuca

SEQ ID NO: 957290 - RNA, 15 nt, Homo sapiens
ugcagcaaccagagc

SEQ ID NO: 957291 - RNA, 12 nt, Homo sapiens
ugcagcaguacc

SEQ ID NO: 957292 - RNA, 14 nt, Homo sapiens
ugcagcaguaccau

SEQ ID NO: 957293 - RNA, 22 nt, Homo sapiens
ugcagcccagaacgggccuccc

SEQ ID NO: 957294 - RNA, 17 nt, Homo sapiens
ugcagccucgaccuccc

SEQ ID NO: 957295 - RNA, 16 nt, Homo sapiens
ugcagccuuugccuuu

SEQ ID NO: 957296 - RNA, 19 nt, Homo sapiens
ugcagcugcuuuugcauuu

SEQ ID NO: 957297 - RNA, 13 nt, Homo sapiens
ugcaguccaguga

SEQ ID NO: 957298 - RNA, 14 nt, Homo sapiens
ugcauacacaugcc

SEQ ID NO: 957299 - RNA, 15 nt, Homo sapiens
ugcauacucugugca

SEQ ID NO: 957300 - RNA, 19 nt, Homo sapiens
ugcaucucuuuagauccaa

SEQ ID NO: 957301 - RNA, 18 nt, Homo sapiens
ugcaucuuucucuuccca

SEQ ID NO: 957302 - RNA, 22 nt, Homo sapiens
ugcaucuuucucuucccaugca

SEQ ID NO: 957303 - RNA, 14 nt, Homo sapiens
ugcaugaugacucu

SEQ ID NO: 957304 - RNA, 10 nt, Homo sapiens
ugcaugcaca

SEQ ID NO: 957305 - RNA, 16 nt, Homo sapiens
ugcaugcugucccuua

SEQ ID NO: 957306 - RNA, 13 nt, Homo sapiens
ugcaugugugaag

SEQ ID NO: 957307 - RNA, 22 nt, Homo sapiens
ugcauuguaggaucuuuagcag

SEQ ID NO: 957308 - RNA, 21 nt, Homo sapiens
ugcauuucucguucuuuacug

SEQ ID NO: 957309 - RNA, 17 nt, Homo sapiens
ugccaaauccugggcau

SEQ ID NO: 957310 - RNA, 23 nt, Homo sapiens
ugccacauugaaaaauguccaca

SEQ ID NO: 957311 - RNA, 12 nt, Homo sapiens
ugccacuuucca

SEQ ID NO: 957312 - RNA, 20 nt, Homo sapiens
ugccaggagauggaauauca

SEQ ID NO: 957313 - RNA, 21 nt, Homo sapiens
ugccauagaacaagauaccag

SEQ ID NO: 957314 - RNA, 21 nt, Homo sapiens
ugccauuagacugaauuuaac

SEQ ID NO: 957315 - RNA, 13 nt, Homo sapiens
ugccccuccgucc

SEQ ID NO: 957316 - RNA, 18 nt, Homo sapiens
ugcccuccguccuggcag

SEQ ID NO: 957317 - RNA, 16 nt, Homo sapiens
ugcccucuguggugau

SEQ ID NO: 957318 - RNA, 16 nt, Homo sapiens
ugcccuggccacuggc

SEQ ID NO: 957319 - RNA, 22 nt, Homo sapiens
ugcccuucuauacuuucucaca

SEQ ID NO: 957320 - RNA, 19 nt, Homo sapiens
ugccguccugcaguccuua

SEQ ID NO: 957321 - RNA, 21 nt, Homo sapiens
ugccuagaaacagaccugcau

SEQ ID NO: 957322 - RNA, 22 nt, Homo sapiens
ugccucacaguuguuaaagucu

SEQ ID NO: 957323 - RNA, 13 nt, Homo sapiens
ugccuccauuuca

SEQ ID NO: 957324 - RNA, 17 nt, Homo sapiens
ugccuccauuucagaga

SEQ ID NO: 957325 - RNA, 22 nt, Homo sapiens
ugccucuuuuaaugucaucucu

SEQ ID NO: 957326 - RNA, 15 nt, Homo sapiens
ugccuguauuuccaa

SEQ ID NO: 957327 - RNA, 16 nt, Homo sapiens
ugccuguauuuccaac

SEQ ID NO: 957328 - RNA, 17 nt, Homo sapiens
ugccuuucaaacauuga

SEQ ID NO: 957329 - RNA, 12 nt, Homo sapiens
ugcgagccugua

SEQ ID NO: 957330 - RNA, 13 nt, Homo sapiens
ugcgcucuggguu

SEQ ID NO: 957331 - RNA, 21 nt, Homo sapiens
ugcguuuuagaguaugcaaga

SEQ ID NO: 957332 - RNA, 16 nt, Homo sapiens
ugcuaugcuauggaau

SEQ ID NO: 957333 - RNA, 16 nt, Homo sapiens
ugcucacauacauguc

SEQ ID NO: 957334 - RNA, 20 nt, Homo sapiens
ugcuccaguauauaaccuca

SEQ ID NO: 957335 - RNA, 17 nt, Homo sapiens
ugcuccaguguuuucuu

SEQ ID NO: 957336 - RNA, 15 nt, Homo sapiens
ugcucuccuagagcu

SEQ ID NO: 957337 - RNA, 22 nt, Homo sapiens
ugcuuaacauaaacuuguacuu

SEQ ID NO: 957338 - RNA, 19 nt, Homo sapiens
ugggcaacaagagcaaaac

SEQ ID NO: 957339 - RNA, 19 nt, Homo sapiens
ugggcugcugucauuuuau

SEQ ID NO: 957340 - RNA, 15 nt, Homo sapiens
uggggaaaaggcauu

SEQ ID NO: 957341 - RNA, 19 nt, Homo sapiens
uggggccauccacacccuc

SEQ ID NO: 957342 - RNA, 21 nt, Homo sapiens
ugggggcauccuugaggaccu

SEQ ID NO: 957343 - RNA, 14 nt, Homo sapiens
ugggucccuggaau

SEQ ID NO: 957344 - RNA, 22 nt, Homo sapiens
ugggugugaccugacaccugcc

SEQ ID NO: 957345 - RNA, 14 nt, Homo sapiens
ugguaaaaccuguu

SEQ ID NO: 957346 - RNA, 18 nt, Homo sapiens
ugguaaagagaugucaaa

SEQ ID NO: 957347 - RNA, 15 nt, Homo sapiens
ugguauucuucugac

SEQ ID NO: 957348 - RNA, 16 nt, Homo sapiens
ugguccacauucugcu

SEQ ID NO: 957349 - RNA, 22 nt, Homo sapiens
uggugagaaucgaccucacugu

SEQ ID NO: 957350 - RNA, 12 nt, Homo sapiens
uggugaggaccu

SEQ ID NO: 957351 - RNA, 17 nt, Homo sapiens
uggugcaguaaccauuu

SEQ ID NO: 957352 - RNA, 19 nt, Homo sapiens
ugguggugcacaccuguaa

SEQ ID NO: 957353 - RNA, 20 nt, Homo sapiens
ugguuucucguacuuucaca

SEQ ID NO: 957354 - RNA, 15 nt, Homo sapiens
uguaaaaauagcaaa

SEQ ID NO: 957355 - RNA, 17 nt, Homo sapiens
uguaaaauucauagcau

SEQ ID NO: 957356 - RNA, 22 nt, Homo sapiens
uguaagaaauguauaugcuacu

SEQ ID NO: 957357 - RNA, 16 nt, Homo sapiens
uguacaaugauguaaa

SEQ ID NO: 957358 - RNA, 16 nt, Homo sapiens
uguacacgugcacaga

SEQ ID NO: 957359 - RNA, 20 nt, Homo sapiens
uguacagaaacaacugccaa

SEQ ID NO: 957360 - RNA, 20 nt, Homo sapiens
uguacaguuauacauaccuc

SEQ ID NO: 957361 - RNA, 22 nt, Homo sapiens
uguaccauguugcccagaauuu

SEQ ID NO: 957362 - RNA, 20 nt, Homo sapiens
uguacccuccauguaccuug

SEQ ID NO: 957363 - RNA, 16 nt, Homo sapiens
uguacuaguacugugu

SEQ ID NO: 957364 - RNA, 14 nt, Homo sapiens
uguacuuacacuga

SEQ ID NO: 957365 - RNA, 17 nt, Homo sapiens
uguagauguauuuucaa

SEQ ID NO: 957366 - RNA, 13 nt, Homo sapiens
uguagccagcaga

SEQ ID NO: 957367 - RNA, 16 nt, Homo sapiens
uguauagacaguuugu

SEQ ID NO: 957368 - RNA, 19 nt, Homo sapiens
ugucaacuugaaauguguu

SEQ ID NO: 957369 - RNA, 13 nt, Homo sapiens
ugucaagaguauu

SEQ ID NO: 957370 - RNA, 18 nt, Homo sapiens
ugucaccaugauucuguc

SEQ ID NO: 957371 - RNA, 15 nt, Homo sapiens
ugucauaaucucuuu

SEQ ID NO: 957372 - RNA, 17 nt, Homo sapiens
uguccaacaacuccagg

SEQ ID NO: 957373 - RNA, 14 nt, Homo sapiens
uguccaaggucuca

SEQ ID NO: 957374 - RNA, 14 nt, Homo sapiens
ugucucugaacugc

SEQ ID NO: 957375 - RNA, 21 nt, Homo sapiens
ugucugauucuaugccuguau

SEQ ID NO: 957376 - RNA, 11 nt, Homo sapiens
ugucugcuacc

SEQ ID NO: 957377 - RNA, 16 nt, Homo sapiens
ugugaagguguuucaa

SEQ ID NO: 957378 - RNA, 17 nt, Homo sapiens
ugugaccccaccugcuc

SEQ ID NO: 957379 - RNA, 14 nt, Homo sapiens
ugugcagacacuca

SEQ ID NO: 957380 - RNA, 19 nt, Homo sapiens
ugugcauaaaaguuaacau

SEQ ID NO: 957381 - RNA, 16 nt, Homo sapiens
ugugccuccagacuau

SEQ ID NO: 957382 - RNA, 18 nt, Homo sapiens
uguggacugggaagcauu

SEQ ID NO: 957383 - RNA, 20 nt, Homo sapiens
uguggcucaacacaugagaa

SEQ ID NO: 957384 - RNA, 13 nt, Homo sapiens
uguggcuccagga

SEQ ID NO: 957385 - RNA, 17 nt, Homo sapiens
uguggcugccaucagaa

SEQ ID NO: 957386 - RNA, 17 nt, Homo sapiens
uguguacccuccaugua

SEQ ID NO: 957387 - RNA, 18 nt, Homo sapiens
uguguacccuccauguac

SEQ ID NO: 957388 - RNA, 13 nt, Homo sapiens
ugugugccugccu

SEQ ID NO: 957389 - RNA, 22 nt, Homo sapiens
uguguggcaaacuugcaguuua

SEQ ID NO: 957390 - RNA, 16 nt, Homo sapiens
ugugugguauuuuggc

SEQ ID NO: 957391 - RNA, 22 nt, Homo sapiens
uguuacauguuguauuaguaaa

SEQ ID NO: 957392 - RNA, 19 nt, Homo sapiens
uguuauaucaucaauacuu

SEQ ID NO: 957393 - RNA, 12 nt, Homo sapiens
uguuaugacucc

SEQ ID NO: 957394 - RNA, 22 nt, Homo sapiens
uguuauuuuguauaaaugggaa

SEQ ID NO: 957395 - RNA, 21 nt, Homo sapiens
uguucagucacaugugcucuc

SEQ ID NO: 957396 - RNA, 19 nt, Homo sapiens
uguucccuuaggagcaaaa

SEQ ID NO: 957397 - RNA, 23 nt, Homo sapiens
uguuccuccuccccucuccuagc

SEQ ID NO: 957398 - RNA, 18 nt, Homo sapiens
uguucucaaaugcuaaau

SEQ ID NO: 957399 - RNA, 11 nt, Homo sapiens
uguucugagaa

SEQ ID NO: 957400 - RNA, 21 nt, Homo sapiens
uguuggggggccccacggaga

SEQ ID NO: 957401 - RNA, 22 nt, Homo sapiens
uguuguaacauuucacaguauu

SEQ ID NO: 957402 - RNA, 21 nt, Homo sapiens
uguuuaauuccuggaaaacug

SEQ ID NO: 957403 - RNA, 19 nt, Homo sapiens
uguuuagaaugucaguuga

SEQ ID NO: 957404 - RNA, 14 nt, Homo sapiens
uguuuauccaugua

SEQ ID NO: 957405 - RNA, 15 nt, Homo sapiens
uguuucaaaccugca

SEQ ID NO: 957406 - RNA, 17 nt, Homo sapiens
uguuucccgcuccaaga

SEQ ID NO: 957407 - RNA, 22 nt, Homo sapiens
uguuuccuguggaaauaugcaa

SEQ ID NO: 957408 - RNA, 16 nt, Homo sapiens
uguuuccuuuuaguug

SEQ ID NO: 957409 - RNA, 17 nt, Homo sapiens
uguuugauacaguauua

SEQ ID NO: 957410 - RNA, 21 nt, Homo sapiens
uuaaaaaucuuucagaauaca

SEQ ID NO: 957411 - RNA, 14 nt, Homo sapiens
uuaaaacaugauga

SEQ ID NO: 957412 - RNA, 22 nt, Homo sapiens
uuaaaauaaauuuguaugcuca

SEQ ID NO: 957413 - RNA, 15 nt, Homo sapiens
uuaaaauaguuuucu

SEQ ID NO: 957414 - RNA, 16 nt, Homo sapiens
uuaaaaugaugaagga

SEQ ID NO: 957415 - RNA, 16 nt, Homo sapiens
uuaaaauuagugagau

SEQ ID NO: 957416 - RNA, 20 nt, Homo sapiens
uuaaaggaaaguucuauuau

SEQ ID NO: 957417 - RNA, 16 nt, Homo sapiens
uuaaagucuguuccaa

SEQ ID NO: 957418 - RNA, 20 nt, Homo sapiens
uuaaaguuucauuagucaua

SEQ ID NO: 957419 - RNA, 19 nt, Homo sapiens
uuaaauaauccucuaugug

SEQ ID NO: 957420 - RNA, 18 nt, Homo sapiens
uuaacaacuugaauuaca

SEQ ID NO: 957421 - RNA, 23 nt, Homo sapiens
uuaacgacagaagguugccaggu

SEQ ID NO: 957422 - RNA, 22 nt, Homo sapiens
uuaaucucuaaaauucuagucu

SEQ ID NO: 957423 - RNA, 19 nt, Homo sapiens
uuaaugugaugcuugauau

SEQ ID NO: 957424 - RNA, 16 nt, Homo sapiens
uuaauuaugcuaacaa

SEQ ID NO: 957425 - RNA, 16 nt, Homo sapiens
uuaauuguguaacugu

SEQ ID NO: 957426 - RNA, 12 nt, Homo sapiens
uuacaaacaaag

SEQ ID NO: 957427 - RNA, 16 nt, Homo sapiens
uuacaagcaucaugga

SEQ ID NO: 957428 - RNA, 22 nt, Homo sapiens
uuacagguguacuauggcugua

SEQ ID NO: 957429 - RNA, 19 nt, Homo sapiens
uuacagucauaauguguug

SEQ ID NO: 957430 - RNA, 16 nt, Homo sapiens
uuacauuuucuuucau

SEQ ID NO: 957431 - RNA, 14 nt, Homo sapiens
uuagacaugaaggg

SEQ ID NO: 957432 - RNA, 18 nt, Homo sapiens
uuagagcaagaacauuca

SEQ ID NO: 957433 - RNA, 19 nt, Homo sapiens
uuagagcaagaacauucaa

SEQ ID NO: 957434 - RNA, 15 nt, Homo sapiens
uuagauccaaaauaa

SEQ ID NO: 957435 - RNA, 14 nt, Homo sapiens
uuagauuucuagca

SEQ ID NO: 957436 - RNA, 17 nt, Homo sapiens
uuagccgggccccaugg

SEQ ID NO: 957437 - RNA, 16 nt, Homo sapiens
uuaguacaccauaaac

SEQ ID NO: 957438 - RNA, 23 nt, Homo sapiens
aaacacuuuuucucgaguccaaa

SEQ ID NO: 957439 - RNA, 14 nt, Homo sapiens
aaacauaagccaca

SEQ ID NO: 957440 - RNA, 14 nt, Homo sapiens
aaacauaauaucuu

SEQ ID NO: 957441 - RNA, 21 nt, Homo sapiens
aaacauugcuuuagacaaauu

SEQ ID NO: 957442 - RNA, 23 nt, Homo sapiens
aaaccauuauaaaaucuuuccau

SEQ ID NO: 957443 - RNA, 12 nt, Homo sapiens
aaacccaaauaa

SEQ ID NO: 957444 - RNA, 14 nt, Homo sapiens
aaaccucuguucuc

SEQ ID NO: 957445 - RNA, 16 nt, Homo sapiens
aaaccuguuucugcag

SEQ ID NO: 957446 - RNA, 12 nt, Homo sapiens
aaaccuuacuua

SEQ ID NO: 957447 - RNA, 16 nt, Homo sapiens
aaacuaaggucagaag

SEQ ID NO: 957448 - RNA, 19 nt, Homo sapiens
aaacucaacaagugcuccu

SEQ ID NO: 957449 - RNA, 13 nt, Homo sapiens
aaacucuuggcca

SEQ ID NO: 957450 - RNA, 23 nt, Homo sapiens
aaacucuuugcccaguucauccc

SEQ ID NO: 957451 - RNA, 15 nt, Homo sapiens
aaacugagacccaga

SEQ ID NO: 957452 - RNA, 19 nt, Homo sapiens
aaagaaaccauggcauaaa

SEQ ID NO: 957453 - RNA, 21 nt, Homo sapiens
aaagaaggcacagguguaaau

SEQ ID NO: 957454 - RNA, 13 nt, Homo sapiens
aaagagaugucaa

SEQ ID NO: 957455 - RNA, 13 nt, Homo sapiens
aaagaggcauuca

SEQ ID NO: 957456 - RNA, 15 nt, Homo sapiens
aaagcugacuacuug

SEQ ID NO: 957457 - RNA, 21 nt, Homo sapiens
aaaggaucucugagaccacag

SEQ ID NO: 957458 - RNA, 18 nt, Homo sapiens
aaaguaggaguggcugac

SEQ ID NO: 957459 - RNA, 15 nt, Homo sapiens
aaauaaaauguuuac

SEQ ID NO: 957460 - RNA, 16 nt, Homo sapiens
aaauaacaacugagau

SEQ ID NO: 957461 - RNA, 20 nt, Homo sapiens
aaauacaugucccccuguga

SEQ ID NO: 957462 - RNA, 23 nt, Homo sapiens
aaauagcaucugcucuucucuua

SEQ ID NO: 957463 - RNA, 20 nt, Homo sapiens
aaauaguccuccaaaacaca

SEQ ID NO: 957464 - RNA, 22 nt, Homo sapiens
aaauaguguugaucagaucuua

SEQ ID NO: 957465 - RNA, 14 nt, Homo sapiens
aaauauacaaacau

SEQ ID NO: 957466 - RNA, 18 nt, Homo sapiens
aaauauacaaacaugugg

SEQ ID NO: 957467 - RNA, 16 nt, Homo sapiens
aaauaugcaaccugug

SEQ ID NO: 957468 - RNA, 16 nt, Homo sapiens
aaauauuaauauguac

SEQ ID NO: 957469 - RNA, 12 nt, Homo sapiens
aaauauugcuau

SEQ ID NO: 957470 - RNA, 12 nt, Homo sapiens
aaauauuucaau

SEQ ID NO: 957471 - RNA, 20 nt, Homo sapiens
aaauauuucaauaacuuaga

SEQ ID NO: 957472 - RNA, 20 nt, Homo sapiens
aaaucaugguauucuucuga

SEQ ID NO: 957473 - RNA, 23 nt, Homo sapiens
aaaucauuucauguuagucuuac

SEQ ID NO: 957474 - RNA, 22 nt, Homo sapiens
aaauccagcuucauaauuucca

SEQ ID NO: 957475 - RNA, 17 nt, Homo sapiens
aaaucuguuagcauuau

SEQ ID NO: 957476 - RNA, 15 nt, Homo sapiens
aaaugcaaacacugu

SEQ ID NO: 957477 - RNA, 13 nt, Homo sapiens
aaaugcaagguga

SEQ ID NO: 957478 - RNA, 18 nt, Homo sapiens
aaaugcacauuugucacu

SEQ ID NO: 957479 - RNA, 23 nt, Homo sapiens
aaauggacguguuaugacuccag

SEQ ID NO: 957480 - RNA, 14 nt, Homo sapiens
aaaugggaagcauu

SEQ ID NO: 957481 - RNA, 14 nt, Homo sapiens
aaauguaguugaug

SEQ ID NO: 957482 - RNA, 23 nt, Homo sapiens
aaauguucccuuaggagcaaaau

SEQ ID NO: 957483 - RNA, 13 nt, Homo sapiens
aaauuauaccaug

SEQ ID NO: 957484 - RNA, 23 nt, Homo sapiens
aaauuauuuuaggcaaaguccau

SEQ ID NO: 957485 - RNA, 15 nt, Homo sapiens
aaauuguuauuucaa

SEQ ID NO: 957486 - RNA, 19 nt, Homo sapiens
aaauuuaauauacugcaua

SEQ ID NO: 957487 - RNA, 22 nt, Homo sapiens
aaauuugcaaauauuagcuuau

SEQ ID NO: 957488 - RNA, 16 nt, Homo sapiens
aaauuuguaugcucaa

SEQ ID NO: 957489 - RNA, 21 nt, Homo sapiens
aaauuuuaauguaaaauucau

SEQ ID NO: 957490 - RNA, 13 nt, Homo sapiens
aaauuuuuacuca

SEQ ID NO: 957491 - RNA, 15 nt, Homo sapiens
aacaacagaaacuuc

SEQ ID NO: 957492 - RNA, 18 nt, Homo sapiens
aacaagccacguugcaga

SEQ ID NO: 957493 - RNA, 13 nt, Homo sapiens
aacacaacaucuu

SEQ ID NO: 957494 - RNA, 13 nt, Homo sapiens
aacacaugcacac

SEQ ID NO: 957495 - RNA, 16 nt, Homo sapiens
aacaccaccaaaugac

SEQ ID NO: 957496 - RNA, 22 nt, Homo sapiens
aacaccacuuugucucugagaa

SEQ ID NO: 957497 - RNA, 23 nt, Homo sapiens
aacaccacuuugucucugagaac

SEQ ID NO: 957498 - RNA, 13 nt, Homo sapiens
aacacucacugcc

SEQ ID NO: 957499 - RNA, 19 nt, Homo sapiens
aacacuuuaaguaaaauau

SEQ ID NO: 957500 - RNA, 16 nt, Homo sapiens
aacagaccagcauagu

SEQ ID NO: 957501 - RNA, 15 nt, Homo sapiens
aacagggcaaccaau

SEQ ID NO: 957502 - RNA, 14 nt, Homo sapiens
aacagguguuccuc

SEQ ID NO: 957503 - RNA, 19 nt, Homo sapiens
aacagguuuuccugaagaa

SEQ ID NO: 957504 - RNA, 21 nt, Homo sapiens
aacauguggcaaccuguucuu

SEQ ID NO: 957505 - RNA, 17 nt, Homo sapiens
aacauuuaacuagccuu

SEQ ID NO: 957506 - RNA, 17 nt, Homo sapiens
aaccaccaccaaccacu

SEQ ID NO: 957507 - RNA, 22 nt, Homo sapiens
aacccaauacagucuaguuucc

SEQ ID NO: 957508 - RNA, 13 nt, Homo sapiens
aacccgcucuccc

SEQ ID NO: 957509 - RNA, 12 nt, Homo sapiens
aaccucaaacaa

SEQ ID NO: 957510 - RNA, 16 nt, Homo sapiens
aaccucaaacugggua

SEQ ID NO: 957511 - RNA, 17 nt, Homo sapiens
aaccuggaggcuggacc

SEQ ID NO: 957512 - RNA, 20 nt, Homo sapiens
aaccugugcuuucauguuua

SEQ ID NO: 957513 - RNA, 15 nt, Homo sapiens
aaccuuuaauauauc

SEQ ID NO: 957514 - RNA, 15 nt, Homo sapiens
aacgcccugugucca

SEQ ID NO: 957515 - RNA, 19 nt, Homo sapiens
aacguacuuucuguuauca

SEQ ID NO: 957516 - RNA, 16 nt, Homo sapiens
aacucacuuuaaauau

SEQ ID NO: 957517 - RNA, 16 nt, Homo sapiens
aacugagcuccuccac

SEQ ID NO: 957518 - RNA, 21 nt, Homo sapiens
aacugcuuuguuuuggcugcu

SEQ ID NO: 957519 - RNA, 19 nt, Homo sapiens
aacuguaguaauuguuaca

SEQ ID NO: 957520 - RNA, 10 nt, Homo sapiens
aacugugaac

SEQ ID NO: 957521 - RNA, 15 nt, Homo sapiens
aacuguucuuugcag

SEQ ID NO: 957522 - RNA, 19 nt, Homo sapiens
aacuguucuuugcagugaa

SEQ ID NO: 957523 - RNA, 19 nt, Homo sapiens
aacuuauucuccaucucaa

SEQ ID NO: 957524 - RNA, 23 nt, Homo sapiens
aacuucucccuucuccugaccua

SEQ ID NO: 957525 - RNA, 14 nt, Homo sapiens
aacuugaaaugugu

SEQ ID NO: 957526 - RNA, 19 nt, Homo sapiens
aacuuggcuaacauagcac

SEQ ID NO: 957527 - RNA, 13 nt, Homo sapiens
aacuuuaccucuu

SEQ ID NO: 957528 - RNA, 18 nt, Homo sapiens
aagaaaaaucauaacuca

SEQ ID NO: 957529 - RNA, 20 nt, Homo sapiens
aagaaauauuaauauguacu

SEQ ID NO: 957530 - RNA, 20 nt, Homo sapiens
aagaaauccagcuucauaau

SEQ ID NO: 957531 - RNA, 18 nt, Homo sapiens
aagacaaaauuuaauugu

SEQ ID NO: 957532 - RNA, 22 nt, Homo sapiens
aagagucaacaggucacuugau

SEQ ID NO: 957533 - RNA, 23 nt, Homo sapiens
aagaguucuccuuguacuugaau

SEQ ID NO: 957534 - RNA, 22 nt, Homo sapiens
aagaguuuauaaagcacaguga

SEQ ID NO: 957535 - RNA, 17 nt, Homo sapiens
aagauaaaugcuuuaaa

SEQ ID NO: 957536 - RNA, 18 nt, Homo sapiens
aagaucauugcugagaaa

SEQ ID NO: 957537 - RNA, 17 nt, Homo sapiens
aagaucucggugcugaa

SEQ ID NO: 957538 - RNA, 21 nt, Homo sapiens
aagaugcgcaggcugaucacc

SEQ ID NO: 957539 - RNA, 14 nt, Homo sapiens
aagcaauccaccuu

SEQ ID NO: 957540 - RNA, 18 nt, Homo sapiens
aagcaauccaccuuccuc

SEQ ID NO: 957541 - RNA, 16 nt, Homo sapiens
aagcaguugcaaugau

SEQ ID NO: 957542 - RNA, 18 nt, Homo sapiens
aagcaugaucacagcuca

SEQ ID NO: 957543 - RNA, 13 nt, Homo sapiens
aagcgauccuccu

SEQ ID NO: 957544 - RNA, 22 nt, Homo sapiens
aagcgugguggacaugcacagc

SEQ ID NO: 957545 - RNA, 15 nt, Homo sapiens
aagcuagcuuuccaa

SEQ ID NO: 957546 - RNA, 12 nt, Homo sapiens
aagcugcucacu

SEQ ID NO: 957547 - RNA, 17 nt, Homo sapiens
aagcuggcaggagacac

SEQ ID NO: 957548 - RNA, 23 nt, Homo sapiens
aagcugguugucuuuacaugaaa

SEQ ID NO: 957549 - RNA, 15 nt, Homo sapiens
aagcuguaugccaca

SEQ ID NO: 957550 - RNA, 21 nt, Homo sapiens
aaggaucuccccgaaucucaa

SEQ ID NO: 957551 - RNA, 17 nt, Homo sapiens
aaggauuugaaaacacc

SEQ ID NO: 957552 - RNA, 12 nt, Homo sapiens
aaggcaaggaac

SEQ ID NO: 957553 - RNA, 13 nt, Homo sapiens
aaggcacaggugu

SEQ ID NO: 957554 - RNA, 14 nt, Homo sapiens
aaggcacaggugua

SEQ ID NO: 957555 - RNA, 14 nt, Homo sapiens
aaggcccuucagcc

SEQ ID NO: 957556 - RNA, 21 nt, Homo sapiens
aaggccuuguuaaaauccaag

SEQ ID NO: 957557 - RNA, 20 nt, Homo sapiens
aaggcgugggggacaagaag

SEQ ID NO: 957558 - RNA, 20 nt, Homo sapiens
aaggcugucaauuacaggaa

SEQ ID NO: 957559 - RNA, 15 nt, Homo sapiens
aagggcaggagcuca

SEQ ID NO: 957560 - RNA, 17 nt, Homo sapiens
aagggcaggagcucaca

SEQ ID NO: 957561 - RNA, 21 nt, Homo sapiens
aagggcuaugccuccauuuca

SEQ ID NO: 957562 - RNA, 19 nt, Homo sapiens
aaggggccaggaaggggac

SEQ ID NO: 957563 - RNA, 17 nt, Homo sapiens
aagguaccaagaucaca

SEQ ID NO: 957564 - RNA, 22 nt, Homo sapiens
aaggucccgaauggaguccaga

SEQ ID NO: 957565 - RNA, 17 nt, Homo sapiens
aaggugcaguugcucau

SEQ ID NO: 957566 - RNA, 17 nt, Homo sapiens
aaguaagagagcacagu

SEQ ID NO: 957567 - RNA, 20 nt, Homo sapiens
aaguagcugggaccacaagu

SEQ ID NO: 957568 - RNA, 13 nt, Homo sapiens
aagucaugggaga

SEQ ID NO: 957569 - RNA, 14 nt, Homo sapiens
aagucaugggagaa

SEQ ID NO: 957570 - RNA, 15 nt, Homo sapiens
aagucauugcugaca

SEQ ID NO: 957571 - RNA, 14 nt, Homo sapiens
aaguccacuuaugu

SEQ ID NO: 957572 - RNA, 14 nt, Homo sapiens
aaguccagcucucc

SEQ ID NO: 957573 - RNA, 14 nt, Homo sapiens
agauucagucuugc

SEQ ID NO: 957574 - RNA, 22 nt, Homo sapiens
agcaaagacuuaaucauaucaa

SEQ ID NO: 957575 - RNA, 11 nt, Homo sapiens
agcaaaugcga

SEQ ID NO: 957576 - RNA, 17 nt, Homo sapiens
agcaaccagagcacugu

SEQ ID NO: 957577 - RNA, 19 nt, Homo sapiens
agcaaccagagcacuguau

SEQ ID NO: 957578 - RNA, 15 nt, Homo sapiens
agcaagaacauucaa

SEQ ID NO: 957579 - RNA, 13 nt, Homo sapiens
agcaaggcugcua

SEQ ID NO: 957580 - RNA, 14 nt, Homo sapiens
agcaauuaaagaca

SEQ ID NO: 957581 - RNA, 16 nt, Homo sapiens
agcacacaugugcaca

SEQ ID NO: 957582 - RNA, 15 nt, Homo sapiens
agcaccagguguuaa

SEQ ID NO: 957583 - RNA, 16 nt, Homo sapiens
agcacuaccaguaucu

SEQ ID NO: 957584 - RNA, 19 nt, Homo sapiens
agcacuguauguguugcac

SEQ ID NO: 957585 - RNA, 13 nt, Homo sapiens
agcagaaccaaag

SEQ ID NO: 957586 - RNA, 17 nt, Homo sapiens
agcauaguucugcaaua

SEQ ID NO: 957587 - RNA, 14 nt, Homo sapiens
agcaugauugugac

SEQ ID NO: 957588 - RNA, 17 nt, Homo sapiens
agcaugguuugcaugac

SEQ ID NO: 957589 - RNA, 18 nt, Homo sapiens
agcauucucauuuugcuu

SEQ ID NO: 957590 - RNA, 13 nt, Homo sapiens
agccacagcacuc

SEQ ID NO: 957591 - RNA, 23 nt, Homo sapiens
agccagaagacugacaaagucau

SEQ ID NO: 957592 - RNA, 19 nt, Homo sapiens
agcccauaauggcaaagac

SEQ ID NO: 957593 - RNA, 20 nt, Homo sapiens
agccccaucccaaacccuuc

SEQ ID NO: 957594 - RNA, 21 nt, Homo sapiens
agccuguuuccccaauuccuc

SEQ ID NO: 957595 - RNA, 18 nt, Homo sapiens
agcgaauucccugagaua

SEQ ID NO: 957596 - RNA, 20 nt, Homo sapiens
agcgugcaggagcaaggcug

SEQ ID NO: 957597 - RNA, 16 nt, Homo sapiens
agcuaaacaugcugcc

SEQ ID NO: 957598 - RNA, 21 nt, Homo sapiens
agcuaauuuaaaaacaugaug

SEQ ID NO: 957599 - RNA, 13 nt, Homo sapiens
agcuaccaggaag

SEQ ID NO: 957600 - RNA, 22 nt, Homo sapiens
agcuacuuugugagccaaagcu

SEQ ID NO: 957601 - RNA, 19 nt, Homo sapiens
agcucccaggacgcaggga

SEQ ID NO: 957602 - RNA, 18 nt, Homo sapiens
agcuccuccccugcuacc

SEQ ID NO: 957603 - RNA, 16 nt, Homo sapiens
agcucucaucuaguuu

SEQ ID NO: 957604 - RNA, 14 nt, Homo sapiens
agcucugucaccca

SEQ ID NO: 957605 - RNA, 11 nt, Homo sapiens
agcugccaaaa

SEQ ID NO: 957606 - RNA, 16 nt, Homo sapiens
agcugccaguuuuaca

SEQ ID NO: 957607 - RNA, 16 nt, Homo sapiens
agcugcucauuucacu

SEQ ID NO: 957608 - RNA, 18 nt, Homo sapiens
agcugcuuuugcauuucu

SEQ ID NO: 957609 - RNA, 22 nt, Homo sapiens
agcugggaccacaagugugcau

SEQ ID NO: 957610 - RNA, 18 nt, Homo sapiens
agcuggucaguugccaaa

SEQ ID NO: 957611 - RNA, 20 nt, Homo sapiens
agcuguaaaguugcagguug

SEQ ID NO: 957612 - RNA, 15 nt, Homo sapiens
agcugucaggcagua

SEQ ID NO: 957613 - RNA, 19 nt, Homo sapiens
agcuguuuggccaaugugc

SEQ ID NO: 957614 - RNA, 20 nt, Homo sapiens
agcuuccuagaaaguucugu

SEQ ID NO: 957615 - RNA, 18 nt, Homo sapiens
agcuuguuucuauacugu

SEQ ID NO: 957616 - RNA, 23 nt, Homo sapiens
aggaaauuugcaaauauuagcuu

SEQ ID NO: 957617 - RNA, 17 nt, Homo sapiens
aggaaccgaggacucca

SEQ ID NO: 957618 - RNA, 15 nt, Homo sapiens
aggacacauuuggac

SEQ ID NO: 957619 - RNA, 18 nt, Homo sapiens
aggaccugcgcaaagggc

SEQ ID NO: 957620 - RNA, 15 nt, Homo sapiens
aggagagaaaacugc

SEQ ID NO: 957621 - RNA, 13 nt, Homo sapiens
aggaggcugcuuc

SEQ ID NO: 957622 - RNA, 21 nt, Homo sapiens
aggaucaaaguugaugaaaua

SEQ ID NO: 957623 - RNA, 13 nt, Homo sapiens
aggaugaacaguu

SEQ ID NO: 957624 - RNA, 13 nt, Homo sapiens
aggauugucugcu

SEQ ID NO: 957625 - RNA, 21 nt, Homo sapiens
aggauugucugcugccuccaa

SEQ ID NO: 957626 - RNA, 15 nt, Homo sapiens
aggauuuggcucgcu

SEQ ID NO: 957627 - RNA, 19 nt, Homo sapiens
aggcaagagagcgugccac

SEQ ID NO: 957628 - RNA, 14 nt, Homo sapiens
aggcagcuagccag

SEQ ID NO: 957629 - RNA, 20 nt, Homo sapiens
aggcagggucucacucuguu

SEQ ID NO: 957630 - RNA, 18 nt, Homo sapiens
aggcauccaguaucuuga

SEQ ID NO: 957631 - RNA, 22 nt, Homo sapiens
aggcauccaguaucuugaagac

SEQ ID NO: 957632 - RNA, 12 nt, Homo sapiens
aggcaugugcaa

SEQ ID NO: 957633 - RNA, 20 nt, Homo sapiens
aggcauugauugcacuugau

SEQ ID NO: 957634 - RNA, 20 nt, Homo sapiens
aggccaaacacccaagcaca

SEQ ID NO: 957635 - RNA, 14 nt, Homo sapiens
aggcccacauugcc

SEQ ID NO: 957636 - RNA, 11 nt, Homo sapiens
aggcgccagca

SEQ ID NO: 957637 - RNA, 15 nt, Homo sapiens
aggcucacaacuguu

SEQ ID NO: 957638 - RNA, 16 nt, Homo sapiens
aggcuggaccaacugc

SEQ ID NO: 957639 - RNA, 20 nt, Homo sapiens
aggcuggagugaaguggugu

SEQ ID NO: 957640 - RNA, 16 nt, Homo sapiens
aggcuggagugcagaa

SEQ ID NO: 957641 - RNA, 23 nt, Homo sapiens
aggcuguggugcaguaaccauuu

SEQ ID NO: 957642 - RNA, 14 nt, Homo sapiens
agggaauccauauc

SEQ ID NO: 957643 - RNA, 17 nt, Homo sapiens
agggacuagcuaucucu

SEQ ID NO: 957644 - RNA, 23 nt, Homo sapiens
agggacuucccuagaagucuuca

SEQ ID NO: 957645 - RNA, 14 nt, Homo sapiens
agggagcaccagau

SEQ ID NO: 957646 - RNA, 16 nt, Homo sapiens
agggagccaugcucuu

SEQ ID NO: 957647 - RNA, 15 nt, Homo sapiens
agggagcucuggagu

SEQ ID NO: 957648 - RNA, 23 nt, Homo sapiens
agggcagauuacagucauuuccu

SEQ ID NO: 957649 - RNA, 17 nt, Homo sapiens
agggcaggccuguuccc

SEQ ID NO: 957650 - RNA, 15 nt, Homo sapiens
agggucucacugugu

SEQ ID NO: 957651 - RNA, 16 nt, Homo sapiens
agguaaguuggcucac

SEQ ID NO: 957652 - RNA, 16 nt, Homo sapiens
agguacuaaaaacacu

SEQ ID NO: 957653 - RNA, 23 nt, Homo sapiens
agguagcuuguccaaggucucau

SEQ ID NO: 957654 - RNA, 16 nt, Homo sapiens
aggucauaguuacuua

SEQ ID NO: 957655 - RNA, 15 nt, Homo sapiens
aggucaucccggggc

SEQ ID NO: 957656 - RNA, 17 nt, Homo sapiens
agguccugugagcaaag

SEQ ID NO: 957657 - RNA, 22 nt, Homo sapiens
agguccuucuguagugccaugg

SEQ ID NO: 957658 - RNA, 15 nt, Homo sapiens
aggucucaugaccag

SEQ ID NO: 957659 - RNA, 19 nt, Homo sapiens
aggugaugguaacugcaca

SEQ ID NO: 957660 - RNA, 20 nt, Homo sapiens
aggugcacagaccacacagc

SEQ ID NO: 957661 - RNA, 23 nt, Homo sapiens
aggugggaggaggccugcacagg

SEQ ID NO: 957662 - RNA, 14 nt, Homo sapiens
aggugguccuucca

SEQ ID NO: 957663 - RNA, 23 nt, Homo sapiens
agguuacccgagaagcacuugag

SEQ ID NO: 957664 - RNA, 12 nt, Homo sapiens
agguuccuguca

SEQ ID NO: 957665 - RNA, 19 nt, Homo sapiens
agguuccuuuugaagcuca

SEQ ID NO: 957666 - RNA, 19 nt, Homo sapiens
agguucuaggcuaccagaa

SEQ ID NO: 957667 - RNA, 16 nt, Homo sapiens
aguaagagagcacagu

SEQ ID NO: 957668 - RNA, 17 nt, Homo sapiens
aguaagagguuaugcca

SEQ ID NO: 957669 - RNA, 12 nt, Homo sapiens
aguagagcaaag

SEQ ID NO: 957670 - RNA, 21 nt, Homo sapiens
aguagagucacuggaacacua

SEQ ID NO: 957671 - RNA, 16 nt, Homo sapiens
aguagauaagugcuca

SEQ ID NO: 957672 - RNA, 10 nt, Homo sapiens
aguagcucag

SEQ ID NO: 957673 - RNA, 19 nt, Homo sapiens
aguagcuguggggagcugg

SEQ ID NO: 957674 - RNA, 15 nt, Homo sapiens
aguauaauaugcagu

SEQ ID NO: 957675 - RNA, 19 nt, Homo sapiens
aguauacauuuaguuaaca

SEQ ID NO: 957676 - RNA, 22 nt, Homo sapiens
aguaucauguacuacacuucug

SEQ ID NO: 957677 - RNA, 16 nt, Homo sapiens
aguaucucuacuuucc

SEQ ID NO: 957678 - RNA, 14 nt, Homo sapiens
aguaugaaccacau

SEQ ID NO: 957679 - RNA, 18 nt, Homo sapiens
aguaugaagacacuguca

SEQ ID NO: 957680 - RNA, 21 nt, Homo sapiens
agucaucucaaacacugcuua

SEQ ID NO: 957681 - RNA, 23 nt, Homo sapiens
agucaugucuuuccuauuugcac

SEQ ID NO: 957682 - RNA, 18 nt, Homo sapiens
agucauuuccuacccuuu

SEQ ID NO: 957683 - RNA, 21 nt, Homo sapiens
agucccaauuugaauucaauu

SEQ ID NO: 957684 - RNA, 16 nt, Homo sapiens
aguccuccaaaacaca

SEQ ID NO: 957685 - RNA, 18 nt, Homo sapiens
aguccuccgguugcauac

SEQ ID NO: 957686 - RNA, 22 nt, Homo sapiens
aguccugugccucaucacugcu

SEQ ID NO: 957687 - RNA, 15 nt, Homo sapiens
agucuaaacagaguc

SEQ ID NO: 957688 - RNA, 18 nt, Homo sapiens
agugaaagcccugacuau

SEQ ID NO: 957689 - RNA, 18 nt, Homo sapiens
agugaaaggucaucucau

SEQ ID NO: 957690 - RNA, 22 nt, Homo sapiens
agugaaggucaugcaugccaau

SEQ ID NO: 957691 - RNA, 20 nt, Homo sapiens
agugaauguuaacaugcgca

SEQ ID NO: 957692 - RNA, 13 nt, Homo sapiens
agugagauacaaa

SEQ ID NO: 957693 - RNA, 15 nt, Homo sapiens
agugaugacggggug

SEQ ID NO: 957694 - RNA, 21 nt, Homo sapiens
agugcuccaguauauaaccuc

SEQ ID NO: 957695 - RNA, 13 nt, Homo sapiens
acacgugcacaga

SEQ ID NO: 957696 - RNA, 23 nt, Homo sapiens
acacugcagcagaaaggcucuga

SEQ ID NO: 957697 - RNA, 17 nt, Homo sapiens
acacuguacugcaauaa

SEQ ID NO: 957698 - RNA, 17 nt, Homo sapiens
acacuguggaacacuaa

SEQ ID NO: 957699 - RNA, 19 nt, Homo sapiens
acacuugacaucaacugca

SEQ ID NO: 957700 - RNA, 19 nt, Homo sapiens
acagaaggguaaugcgugc

SEQ ID NO: 957701 - RNA, 17 nt, Homo sapiens
acagaaugagagagaaa

SEQ ID NO: 957702 - RNA, 12 nt, Homo sapiens
acagacaaagcg

SEQ ID NO: 957703 - RNA, 22 nt, Homo sapiens
acagacaaagcgugguggacau

SEQ ID NO: 957704 - RNA, 18 nt, Homo sapiens
acagacaacaaaccuguu

SEQ ID NO: 957705 - RNA, 21 nt, Homo sapiens
acagaccagcauaguucugca

SEQ ID NO: 957706 - RNA, 15 nt, Homo sapiens
acagaccuccagauu

SEQ ID NO: 957707 - RNA, 17 nt, Homo sapiens
acagaguauauauguac

SEQ ID NO: 957708 - RNA, 21 nt, Homo sapiens
acagaucacacacaugcacac

SEQ ID NO: 957709 - RNA, 13 nt, Homo sapiens
acagaucuucaac

SEQ ID NO: 957710 - RNA, 16 nt, Homo sapiens
acagaugauucacaga

SEQ ID NO: 957711 - RNA, 14 nt, Homo sapiens
acagcacaugcaca

SEQ ID NO: 957712 - RNA, 20 nt, Homo sapiens
acagcacuguauguguugca

SEQ ID NO: 957713 - RNA, 19 nt, Homo sapiens
acagcacuuuccuguugca

SEQ ID NO: 957714 - RNA, 12 nt, Homo sapiens
acagcagcucca

SEQ ID NO: 957715 - RNA, 19 nt, Homo sapiens
acagcaugaaccuuuagaa

SEQ ID NO: 957716 - RNA, 21 nt, Homo sapiens
acagccaacacugaaaacacu

SEQ ID NO: 957717 - RNA, 13 nt, Homo sapiens
acagccucuuccu

SEQ ID NO: 957718 - RNA, 20 nt, Homo sapiens
acaggaaguacuggagaaaa

SEQ ID NO: 957719 - RNA, 19 nt, Homo sapiens
acaggcauagccacuugcu

SEQ ID NO: 957720 - RNA, 14 nt, Homo sapiens
acaggcuucgucuc

SEQ ID NO: 957721 - RNA, 16 nt, Homo sapiens
acaggguccucagcuc

SEQ ID NO: 957722 - RNA, 12 nt, Homo sapiens
acagguguaaau

SEQ ID NO: 957723 - RNA, 22 nt, Homo sapiens
acagguuuuauuuuaucacuug

SEQ ID NO: 957724 - RNA, 21 nt, Homo sapiens
acaguuguuaaagucuguucc

SEQ ID NO: 957725 - RNA, 18 nt, Homo sapiens
acauaaagaaacacuuuc

SEQ ID NO: 957726 - RNA, 18 nt, Homo sapiens
acauacgugcauacacau

SEQ ID NO: 957727 - RNA, 19 nt, Homo sapiens
acauagccugcaaagcugg

SEQ ID NO: 957728 - RNA, 17 nt, Homo sapiens
acauagguguugucaag

SEQ ID NO: 957729 - RNA, 19 nt, Homo sapiens
acauauauaugaaugcuug

SEQ ID NO: 957730 - RNA, 18 nt, Homo sapiens
acauauugauagaugcaa

SEQ ID NO: 957731 - RNA, 23 nt, Homo sapiens
acaucaacugcaucaagauguga

SEQ ID NO: 957732 - RNA, 18 nt, Homo sapiens
acaucccuacgugcccac

SEQ ID NO: 957733 - RNA, 17 nt, Homo sapiens
acauccugugaugucau

SEQ ID NO: 957734 - RNA, 14 nt, Homo sapiens
acaucucuguagau

SEQ ID NO: 957735 - RNA, 19 nt, Homo sapiens
acaugaugaguugagcucu

SEQ ID NO: 957736 - RNA, 12 nt, Homo sapiens
acaugugcucuc

SEQ ID NO: 957737 - RNA, 17 nt, Homo sapiens
acauuagaugaaguuac

SEQ ID NO: 957738 - RNA, 19 nt, Homo sapiens
acauugcuuuagacaaauu

SEQ ID NO: 957739 - RNA, 14 nt, Homo sapiens
acauuguuaugcac

SEQ ID NO: 957740 - RNA, 14 nt, Homo sapiens
acauuuaacgacag

SEQ ID NO: 957741 - RNA, 21 nt, Homo sapiens
acauuuagaaccugcauuuaa

SEQ ID NO: 957742 - RNA, 23 nt, Homo sapiens
acauuuccgugagagucaucuca

SEQ ID NO: 957743 - RNA, 12 nt, Homo sapiens
accaaauacuuu

SEQ ID NO: 957744 - RNA, 12 nt, Homo sapiens
accaaccacugc

SEQ ID NO: 957745 - RNA, 16 nt, Homo sapiens
accaauuaagcagcuu

SEQ ID NO: 957746 - RNA, 18 nt, Homo sapiens
accaccaaccacugcgac

SEQ ID NO: 957747 - RNA, 14 nt, Homo sapiens
accacugacagaug

SEQ ID NO: 957748 - RNA, 18 nt, Homo sapiens
accagagcacuguauacc

SEQ ID NO: 957749 - RNA, 20 nt, Homo sapiens
accaguuaugauaaccaaga

SEQ ID NO: 957750 - RNA, 22 nt, Homo sapiens
accaguuuccuuucgucugcca

SEQ ID NO: 957751 - RNA, 22 nt, Homo sapiens
accauaaaauaaauaaucucau

SEQ ID NO: 957752 - RNA, 16 nt, Homo sapiens
accauccucuguuacc

SEQ ID NO: 957753 - RNA, 16 nt, Homo sapiens
acccaagcacaaacug

SEQ ID NO: 957754 - RNA, 15 nt, Homo sapiens
acccauuucuuacca

SEQ ID NO: 957755 - RNA, 13 nt, Homo sapiens
accccaccugcuc

SEQ ID NO: 957756 - RNA, 23 nt, Homo sapiens
accccacuuagccuuucuuuucu

SEQ ID NO: 957757 - RNA, 15 nt, Homo sapiens
accccauucaugaga

SEQ ID NO: 957758 - RNA, 15 nt, Homo sapiens
accccauucugggac

SEQ ID NO: 957759 - RNA, 19 nt, Homo sapiens
accccgucugccccuugac

SEQ ID NO: 957760 - RNA, 23 nt, Homo sapiens
acccuccccauuaguauccuguu

SEQ ID NO: 957761 - RNA, 17 nt, Homo sapiens
acccucuccuugucaca

SEQ ID NO: 957762 - RNA, 19 nt, Homo sapiens
acccucuggagauaaaaua

SEQ ID NO: 957763 - RNA, 16 nt, Homo sapiens
accgccaugcaugaug

SEQ ID NO: 957764 - RNA, 15 nt, Homo sapiens
accuaaaaagaauag

SEQ ID NO: 957765 - RNA, 12 nt, Homo sapiens
accuacuuccuc

SEQ ID NO: 957766 - RNA, 16 nt, Homo sapiens
accuccagaggugaug

SEQ ID NO: 957767 - RNA, 16 nt, Homo sapiens
accucgcuccaacucc

SEQ ID NO: 957768 - RNA, 19 nt, Homo sapiens
accucucuucugcacagcu

SEQ ID NO: 957769 - RNA, 14 nt, Homo sapiens
accugaaacacuuu

SEQ ID NO: 957770 - RNA, 20 nt, Homo sapiens
accugaacugaaaggacugu

SEQ ID NO: 957771 - RNA, 15 nt, Homo sapiens
guugaugaagcacau

SEQ ID NO: 957772 - RNA, 23 nt, Homo sapiens
guugccaggagauggaauaucaa

SEQ ID NO: 957773 - RNA, 20 nt, Homo sapiens
guuggccauguucauucaca

SEQ ID NO: 957774 - RNA, 12 nt, Homo sapiens
guugguguuccu

SEQ ID NO: 957775 - RNA, 15 nt, Homo sapiens
guugucaagugauau

SEQ ID NO: 957776 - RNA, 18 nt, Homo sapiens
guugugugugcuuucuaa

SEQ ID NO: 957777 - RNA, 10 nt, Homo sapiens
guuguucacg

SEQ ID NO: 957778 - RNA, 14 nt, Homo sapiens
guuucaaaccugca

SEQ ID NO: 957779 - RNA, 15 nt, Homo sapiens
guuucaacauaugaa

SEQ ID NO: 957780 - RNA, 13 nt, Homo sapiens
guuucacauauuu

SEQ ID NO: 957781 - RNA, 19 nt, Homo sapiens
guuuccacguaagucacug

SEQ ID NO: 957782 - RNA, 20 nt, Homo sapiens
guuucuauguccaaaccugg

SEQ ID NO: 957783 - RNA, 23 nt, Homo sapiens
guuucucguacuuucacaucucu

SEQ ID NO: 957784 - RNA, 22 nt, Homo sapiens
guuugccaaauuuuccuuccug

SEQ ID NO: 957785 - RNA, 14 nt, Homo sapiens
guuuggaaauggag

SEQ ID NO: 957786 - RNA, 22 nt, Homo sapiens
guuuguaggguggaugggauac

SEQ ID NO: 957787 - RNA, 18 nt, Homo sapiens
guuuuagaguaugcaaga

SEQ ID NO: 957788 - RNA, 19 nt, Homo sapiens
guuuugcauggaguauuau

SEQ ID NO: 957789 - RNA, 23 nt, Homo sapiens
guuuuggguagcugccacuugaa

SEQ ID NO: 957790 - RNA, 13 nt, Homo sapiens
uaaaaaucuuuca

SEQ ID NO: 957791 - RNA, 17 nt, Homo sapiens
uaaaacauaagccacag

SEQ ID NO: 957792 - RNA, 23 nt, Homo sapiens
uaaaaucuuuccaucucauuaca

SEQ ID NO: 957793 - RNA, 12 nt, Homo sapiens
uaaaauguauuu

SEQ ID NO: 957794 - RNA, 18 nt, Homo sapiens
uaaaauguauuuuucaca

SEQ ID NO: 957795 - RNA, 16 nt, Homo sapiens
uaaacagagugcaaag

SEQ ID NO: 957796 - RNA, 13 nt, Homo sapiens
uaaaccauaaaau

SEQ ID NO: 957797 - RNA, 21 nt, Homo sapiens
uaaacugauguauagcuuuaa

SEQ ID NO: 957798 - RNA, 23 nt, Homo sapiens
uaaacuguuuucauguguugcaa

SEQ ID NO: 957799 - RNA, 16 nt, Homo sapiens
uaaagaggcgucuugu

SEQ ID NO: 957800 - RNA, 23 nt, Homo sapiens
uaaagcuuguuuguucuaguuag

SEQ ID NO: 957801 - RNA, 17 nt, Homo sapiens
uaaagguuuauguggaa

SEQ ID NO: 957802 - RNA, 21 nt, Homo sapiens
uaaaguagaauuaucucucau

SEQ ID NO: 957803 - RNA, 22 nt, Homo sapiens
uaaauaaagaagaaaauaaccu

SEQ ID NO: 957804 - RNA, 19 nt, Homo sapiens
uaaauaaagccacuuuccu

SEQ ID NO: 957805 - RNA, 13 nt, Homo sapiens
uaaauaagacaac

SEQ ID NO: 957806 - RNA, 13 nt, Homo sapiens
uaaauaaugcuua

SEQ ID NO: 957807 - RNA, 19 nt, Homo sapiens
uaaauagguuuuucuugcu

SEQ ID NO: 957808 - RNA, 16 nt, Homo sapiens
uaaauaguuuacuuca

SEQ ID NO: 957809 - RNA, 20 nt, Homo sapiens
uaaauauauauauauuucuc

SEQ ID NO: 957810 - RNA, 17 nt, Homo sapiens
uaaaugcaaacacugug

SEQ ID NO: 957811 - RNA, 18 nt, Homo sapiens
uaacaacuugaauuacaa

SEQ ID NO: 957812 - RNA, 20 nt, Homo sapiens
uaacauaaacuuguacuuac

SEQ ID NO: 957813 - RNA, 16 nt, Homo sapiens
uaacauggaaguacua

SEQ ID NO: 957814 - RNA, 21 nt, Homo sapiens
uaacgacagaagguugccagg

SEQ ID NO: 957815 - RNA, 13 nt, Homo sapiens
uaacuagaucucc

SEQ ID NO: 957816 - RNA, 22 nt, Homo sapiens
uaacugcacacaugguuuccaa

SEQ ID NO: 957817 - RNA, 20 nt, Homo sapiens
uaacugucuuaguacaccau

SEQ ID NO: 957818 - RNA, 19 nt, Homo sapiens
uaacuguucuuugcaguga

SEQ ID NO: 957819 - RNA, 22 nt, Homo sapiens
uaagaaccuuuugagugccuua

SEQ ID NO: 957820 - RNA, 18 nt, Homo sapiens
uaagacacuaguagagca

SEQ ID NO: 957821 - RNA, 15 nt, Homo sapiens
uaagcaaaauucaua

SEQ ID NO: 957822 - RNA, 19 nt, Homo sapiens
uaaggaagaauaaaaaaga

SEQ ID NO: 957823 - RNA, 16 nt, Homo sapiens
uaaguccagcucuccc

SEQ ID NO: 957824 - RNA, 16 nt, Homo sapiens
uaagugcucaguauug

SEQ ID NO: 957825 - RNA, 17 nt, Homo sapiens
uaauaauaaaacaacag

SEQ ID NO: 957826 - RNA, 19 nt, Homo sapiens
uaauauaucagugcuccag

SEQ ID NO: 957827 - RNA, 14 nt, Homo sapiens
uaauccucuaugug

SEQ ID NO: 957828 - RNA, 19 nt, Homo sapiens
uaaugacuuaagcacacuu

SEQ ID NO: 957829 - RNA, 16 nt, Homo sapiens
uaaugauucaauguga

SEQ ID NO: 957830 - RNA, 15 nt, Homo sapiens
uaauuaaaacacaac

SEQ ID NO: 957831 - RNA, 17 nt, Homo sapiens
uaauuacauuaaaaugg

SEQ ID NO: 957832 - RNA, 18 nt, Homo sapiens
uaauuacuuaaugugaug

SEQ ID NO: 957833 - RNA, 20 nt, Homo sapiens
uaauuguggaaccuagggaa

SEQ ID NO: 957834 - RNA, 16 nt, Homo sapiens
uacaaauuuuuacuca

SEQ ID NO: 957835 - RNA, 16 nt, Homo sapiens
uacaaccgguuaucag

SEQ ID NO: 957836 - RNA, 19 nt, Homo sapiens
uacaagcaucauggaucaa

SEQ ID NO: 957837 - RNA, 15 nt, Homo sapiens
uacacaagugcacag

SEQ ID NO: 957838 - RNA, 23 nt, Homo sapiens
uacacccaauuuuaaaaaauaac

SEQ ID NO: 957839 - RNA, 15 nt, Homo sapiens
uacaccuuuaucuca

SEQ ID NO: 957840 - RNA, 20 nt, Homo sapiens
uacaccuuuaucucaagaua

SEQ ID NO: 957841 - RNA, 18 nt, Homo sapiens
uacacgggguuacacugu

SEQ ID NO: 957842 - RNA, 19 nt, Homo sapiens
uacacuacaaauguuaaag

SEQ ID NO: 957843 - RNA, 19 nt, Homo sapiens
uacagaaacaacugccaaa

SEQ ID NO: 957844 - RNA, 18 nt, Homo sapiens
uacagauuuaguuuacca

SEQ ID NO: 957845 - RNA, 12 nt, Homo sapiens
uacagcacugua

SEQ ID NO: 957846 - RNA, 17 nt, Homo sapiens
uacagcacuguaugugu

SEQ ID NO: 957847 - RNA, 13 nt, Homo sapiens
uacaggaaguacu

SEQ ID NO: 957848 - RNA, 18 nt, Homo sapiens
uacaggcguacacaugca

SEQ ID NO: 957849 - RNA, 22 nt, Homo sapiens
uacaggugugagccacagcacu

SEQ ID NO: 957850 - RNA, 23 nt, Homo sapiens
uacagguuccuuuugaagcucaa

SEQ ID NO: 957851 - RNA, 22 nt, Homo sapiens
uacauaauuaaauuuuaaugua

SEQ ID NO: 957852 - RNA, 23 nt, Homo sapiens
uacauaccccgaaggucuaggaa

SEQ ID NO: 957853 - RNA, 13 nt, Homo sapiens
uacaucuaaguca

SEQ ID NO: 957854 - RNA, 20 nt, Homo sapiens
uacaucuagcacagcuguga

SEQ ID NO: 957855 - RNA, 17 nt, Homo sapiens
uacauggcuuggcauuu

SEQ ID NO: 957856 - RNA, 19 nt, Homo sapiens
uacauguacacgugcacag

SEQ ID NO: 957857 - RNA, 20 nt, Homo sapiens
uacauguacacgugcacaga

SEQ ID NO: 957858 - RNA, 21 nt, Homo sapiens
uacauuuagaaccugcauuua

SEQ ID NO: 957859 - RNA, 18 nt, Homo sapiens
uaccaacuauuucaauaa

SEQ ID NO: 957860 - RNA, 15 nt, Homo sapiens
uaccaagcugugacc

SEQ ID NO: 957861 - RNA, 11 nt, Homo sapiens
uaccacuugaa

SEQ ID NO: 957862 - RNA, 18 nt, Homo sapiens
uaccagcggggacaccaa

SEQ ID NO: 957863 - RNA, 22 nt, Homo sapiens
uaccaggcaggcacgugcacau

SEQ ID NO: 957864 - RNA, 14 nt, Homo sapiens
uaccaguaucucca

SEQ ID NO: 957865 - RNA, 12 nt, Homo sapiens
uaccauguugcc

SEQ ID NO: 957866 - RNA, 22 nt, Homo sapiens
uaccauguugcccagaauuuca

SEQ ID NO: 957867 - RNA, 11 nt, Homo sapiens
uaccugcugag

SEQ ID NO: 957868 - RNA, 17 nt, Homo sapiens
uacgcaggcaucugauu

SEQ ID NO: 957869 - RNA, 14 nt, Homo sapiens
uacgcucucugucu

SEQ ID NO: 957870 - RNA, 14 nt, Homo sapiens
uacuagauucauaa

SEQ ID NO: 957871 - RNA, 10 nt, Homo sapiens
uacucagcuu

SEQ ID NO: 957872 - RNA, 21 nt, Homo sapiens
uacucgaguuacagacaaagc

SEQ ID NO: 957873 - RNA, 11 nt, Homo sapiens
uacucugucau

SEQ ID NO: 957874 - RNA, 15 nt, Homo sapiens
uacuuaaugugaugc

SEQ ID NO: 957875 - RNA, 11 nt, Homo sapiens
uagaaaacugg

SEQ ID NO: 957876 - RNA, 23 nt, Homo sapiens
uagaacauagaugcuacaguauu

SEQ ID NO: 957877 - RNA, 20 nt, Homo sapiens
uagaauccaauuaaugauuc

SEQ ID NO: 957878 - RNA, 15 nt, Homo sapiens
uagaauuaucucuca

SEQ ID NO: 957879 - RNA, 15 nt, Homo sapiens
uagacuggauaauca

SEQ ID NO: 957880 - RNA, 18 nt, Homo sapiens
uagagacagggucucacu

SEQ ID NO: 957881 - RNA, 15 nt, Homo sapiens
uagagagugugaugu

SEQ ID NO: 957882 - RNA, 19 nt, Homo sapiens
uagagcaagaacauucaaa

SEQ ID NO: 957883 - RNA, 12 nt, Homo sapiens
uagagugcacau

SEQ ID NO: 957884 - RNA, 22 nt, Homo sapiens
uagagugcuuuccuugugaugc

SEQ ID NO: 957885 - RNA, 22 nt, Homo sapiens
uagauacaggggcaaaagucau

SEQ ID NO: 957886 - RNA, 19 nt, Homo sapiens
uagauauucauacuuucca

SEQ ID NO: 957887 - RNA, 20 nt, Homo sapiens
uagaugccaaugacauaccu

SEQ ID NO: 957888 - RNA, 17 nt, Homo sapiens
uagauuucuagcaguau

SEQ ID NO: 957889 - RNA, 17 nt, Homo sapiens
uagcaagaagauucuaa

SEQ ID NO: 957890 - RNA, 22 nt, Homo sapiens
uagcaguaugugugcucuuauc

SEQ ID NO: 957891 - RNA, 22 nt, Homo sapiens
uagcuagaauauccuauacugg

SEQ ID NO: 957892 - RNA, 21 nt, Homo sapiens
uagcuaggugcacauauacau

SEQ ID NO: 957893 - RNA, 17 nt, Homo sapiens
uagcugggaccacaagu

SEQ ID NO: 957894 - RNA, 22 nt, Homo sapiens
uaggauaaaccaaucaucuuaa

SEQ ID NO: 957895 - RNA, 20 nt, Homo sapiens
uaggaugauagaucauaaca

SEQ ID NO: 957896 - RNA, 22 nt, Homo sapiens
uaggccucaguguccucaucua

SEQ ID NO: 957897 - RNA, 14 nt, Homo sapiens
uaggcuaaaaacau

SEQ ID NO: 957898 - RNA, 13 nt, Homo sapiens
uaggcugcugcug

SEQ ID NO: 957899 - RNA, 16 nt, Homo sapiens
uaggcuuucauguugc

SEQ ID NO: 957900 - RNA, 21 nt, Homo sapiens
uagguaaguuggcucacauca

SEQ ID NO: 957901 - RNA, 14 nt, Homo sapiens
uagguucuacagga

SEQ ID NO: 957902 - RNA, 19 nt, Homo sapiens
uaguacaccauaaacuggg

SEQ ID NO: 957903 - RNA, 13 nt, Homo sapiens
agcacaaacuguc

SEQ ID NO: 957904 - RNA, 18 nt, Homo sapiens
agcacaaagaugugcaaa

SEQ ID NO: 957905 - RNA, 17 nt, Homo sapiens
agcacacuugacaucaa

SEQ ID NO: 957906 - RNA, 20 nt, Homo sapiens
agcacagauaaaaaguggaa

SEQ ID NO: 957907 - RNA, 13 nt, Homo sapiens
agcacagccucac

SEQ ID NO: 957908 - RNA, 15 nt, Homo sapiens
agcacagcugugagg

SEQ ID NO: 957909 - RNA, 20 nt, Homo sapiens
agcacauuuaguccaaugaa

SEQ ID NO: 957910 - RNA, 19 nt, Homo sapiens
agcacuaccaguaucucca

SEQ ID NO: 957911 - RNA, 18 nt, Homo sapiens
agcacucggccuaaauag

SEQ ID NO: 957912 - RNA, 20 nt, Homo sapiens
agcacugccauuagacugaa

SEQ ID NO: 957913 - RNA, 18 nt, Homo sapiens
agcacuuuccuguugcac

SEQ ID NO: 957914 - RNA, 20 nt, Homo sapiens
agcagagcccccauggccua

SEQ ID NO: 957915 - RNA, 23 nt, Homo sapiens
agcaggggcauuaguuucaggca

SEQ ID NO: 957916 - RNA, 16 nt, Homo sapiens
agcaguaugugugcuc

SEQ ID NO: 957917 - RNA, 21 nt, Homo sapiens
agcauaaaucuguuagcauua

SEQ ID NO: 957918 - RNA, 17 nt, Homo sapiens
agcaucuauagcacaua

SEQ ID NO: 957919 - RNA, 15 nt, Homo sapiens
agcaugaucacagcu

SEQ ID NO: 957920 - RNA, 19 nt, Homo sapiens
agccaaagcuuaugugaca

SEQ ID NO: 957921 - RNA, 20 nt, Homo sapiens
agccaagaauucuuaaauau

SEQ ID NO: 957922 - RNA, 15 nt, Homo sapiens
agccagaauguuucc

SEQ ID NO: 957923 - RNA, 15 nt, Homo sapiens
agccagauuccccag

SEQ ID NO: 957924 - RNA, 12 nt, Homo sapiens
agcccaaccucu

SEQ ID NO: 957925 - RNA, 20 nt, Homo sapiens
agcccaggggaggcacaaag

SEQ ID NO: 957926 - RNA, 23 nt, Homo sapiens
agcccaggggaggcacaaagggc

SEQ ID NO: 957927 - RNA, 15 nt, Homo sapiens
agccccuugcuucua

SEQ ID NO: 957928 - RNA, 13 nt, Homo sapiens
agccgagcucucc

SEQ ID NO: 957929 - RNA, 14 nt, Homo sapiens
agccuaguccagaa

SEQ ID NO: 957930 - RNA, 16 nt, Homo sapiens
agccuaucaagccuua

SEQ ID NO: 957931 - RNA, 22 nt, Homo sapiens
agcguggggguggccacuccug

SEQ ID NO: 957932 - RNA, 16 nt, Homo sapiens
agcuaguauaacuuua

SEQ ID NO: 957933 - RNA, 18 nt, Homo sapiens
agcuaguauaacuuuaca

SEQ ID NO: 957934 - RNA, 16 nt, Homo sapiens
agcuauuuauguucau

SEQ ID NO: 957935 - RNA, 20 nt, Homo sapiens
agcuauuuauguucaucuuc

SEQ ID NO: 957936 - RNA, 22 nt, Homo sapiens
agcuauuuauguucaucuucaa

SEQ ID NO: 957937 - RNA, 16 nt, Homo sapiens
agcuccuccccugcua

SEQ ID NO: 957938 - RNA, 22 nt, Homo sapiens
agcuccuccccugcuaccugcu

SEQ ID NO: 957939 - RNA, 23 nt, Homo sapiens
agcuccucugccuuugugcucug

SEQ ID NO: 957940 - RNA, 17 nt, Homo sapiens
agcucuccugggccagg

SEQ ID NO: 957941 - RNA, 15 nt, Homo sapiens
agcucugcauaagau

SEQ ID NO: 957942 - RNA, 12 nt, Homo sapiens
agcucugucuga

SEQ ID NO: 957943 - RNA, 16 nt, Homo sapiens
agcugcugucuucccc

SEQ ID NO: 957944 - RNA, 21 nt, Homo sapiens
agcugggaccacaagugugca

SEQ ID NO: 957945 - RNA, 14 nt, Homo sapiens
agcuuaagugacuu

SEQ ID NO: 957946 - RNA, 17 nt, Homo sapiens
agcuuaagugacuuccu

SEQ ID NO: 957947 - RNA, 21 nt, Homo sapiens
agcuucccuuuucucccaaga

SEQ ID NO: 957948 - RNA, 23 nt, Homo sapiens
agcuuguccaacaacuccaggaa

SEQ ID NO: 957949 - RNA, 19 nt, Homo sapiens
agcuuguuguuuuuugcua

SEQ ID NO: 957950 - RNA, 22 nt, Homo sapiens
aggaacagauuuugcuaagaca

SEQ ID NO: 957951 - RNA, 13 nt, Homo sapiens
aggacacauuucc

SEQ ID NO: 957952 - RNA, 18 nt, Homo sapiens
aggacugugugaccuccc

SEQ ID NO: 957953 - RNA, 23 nt, Homo sapiens
aggagacuuuauggagaguucag

SEQ ID NO: 957954 - RNA, 15 nt, Homo sapiens
aggagcaaaauugcc

SEQ ID NO: 957955 - RNA, 22 nt, Homo sapiens
aggagcccgaagucugcugcug

SEQ ID NO: 957956 - RNA, 16 nt, Homo sapiens
aggaggccaugcccac

SEQ ID NO: 957957 - RNA, 14 nt, Homo sapiens
aggaggccauucca

SEQ ID NO: 957958 - RNA, 22 nt, Homo sapiens
aggagggcaugugcagacacuc

SEQ ID NO: 957959 - RNA, 16 nt, Homo sapiens
aggagugaugggcaag

SEQ ID NO: 957960 - RNA, 17 nt, Homo sapiens
aggagugggauuauuca

SEQ ID NO: 957961 - RNA, 14 nt, Homo sapiens
aggaguugucuguc

SEQ ID NO: 957962 - RNA, 15 nt, Homo sapiens
aggaucucugagacc

SEQ ID NO: 957963 - RNA, 17 nt, Homo sapiens
cuugaaugaugccauga

SEQ ID NO: 957964 - RNA, 21 nt, Homo sapiens
cuugagcaagucccaucucac

SEQ ID NO: 957965 - RNA, 21 nt, Homo sapiens
cuugaggaccuccaccuggga

SEQ ID NO: 957966 - RNA, 17 nt, Homo sapiens
cuugaucagacauucag

SEQ ID NO: 957967 - RNA, 12 nt, Homo sapiens
agaaugcugcuu

SEQ ID NO: 957968 - RNA, 21 nt, Homo sapiens
agaauguacagaaaauagcuu

SEQ ID NO: 957969 - RNA, 15 nt, Homo sapiens
agaaugucaguugau

SEQ ID NO: 957970 - RNA, 20 nt, Homo sapiens
agaaugucuccauuguuaaa

SEQ ID NO: 957971 - RNA, 16 nt, Homo sapiens
agacaaauuguuaaga

SEQ ID NO: 957972 - RNA, 23 nt, Homo sapiens
agacacagaaaucuuucacuugu

SEQ ID NO: 957973 - RNA, 15 nt, Homo sapiens
agacacuggucucag

SEQ ID NO: 957974 - RNA, 15 nt, Homo sapiens
agacccagagagcuu

SEQ ID NO: 957975 - RNA, 15 nt, Homo sapiens
agaccccaagcauuc

SEQ ID NO: 957976 - RNA, 16 nt, Homo sapiens
agacgugagagggacg

SEQ ID NO: 957977 - RNA, 21 nt, Homo sapiens
agacguggugugagagggacg

SEQ ID NO: 957978 - RNA, 14 nt, Homo sapiens
agacuaucaaagac

SEQ ID NO: 957979 - RNA, 21 nt, Homo sapiens
agacuugauuuacaagcauca

SEQ ID NO: 957980 - RNA, 15 nt, Homo sapiens
agagaauccaaacuc

SEQ ID NO: 957981 - RNA, 14 nt, Homo sapiens
agagacagggucuc

SEQ ID NO: 957982 - RNA, 16 nt, Homo sapiens
agagacccccgugcca

SEQ ID NO: 957983 - RNA, 20 nt, Homo sapiens
agagacugcaauuucuccaa

SEQ ID NO: 957984 - RNA, 22 nt, Homo sapiens
agagacuguuugaaucuugucu

SEQ ID NO: 957985 - RNA, 16 nt, Homo sapiens
agagaggccugugcua

SEQ ID NO: 957986 - RNA, 20 nt, Homo sapiens
agagaugacacuagucagaa

SEQ ID NO: 957987 - RNA, 19 nt, Homo sapiens
agagcaaaacucagucuca

SEQ ID NO: 957988 - RNA, 20 nt, Homo sapiens
agagcaaaacucagucucaa

SEQ ID NO: 957989 - RNA, 20 nt, Homo sapiens
agagcacauuuaguccaaug

SEQ ID NO: 957990 - RNA, 21 nt, Homo sapiens
agagcacauuuaguccaauga

SEQ ID NO: 957991 - RNA, 19 nt, Homo sapiens
agagcacuagaagcacagg

SEQ ID NO: 957992 - RNA, 15 nt, Homo sapiens
agagcagaaccaaag

SEQ ID NO: 957993 - RNA, 22 nt, Homo sapiens
agagcucacuauggucaaaaag

SEQ ID NO: 957994 - RNA, 19 nt, Homo sapiens
agagcuucaacuacuucuc

SEQ ID NO: 957995 - RNA, 21 nt, Homo sapiens
agaggcucagacucacuguua

SEQ ID NO: 957996 - RNA, 24 nt, Homo sapiens
agagggagcucuggagugcuaacu

SEQ ID NO: 957997 - RNA, 16 nt, Homo sapiens
agaggggcggggccag

SEQ ID NO: 957998 - RNA, 17 nt, Homo sapiens
agaggggcggggccagg

SEQ ID NO: 957999 - RNA, 22 nt, Homo sapiens
agaggguggagaugucagucug

SEQ ID NO: 958000 - RNA, 15 nt, Homo sapiens
agaguaaaucccacg

SEQ ID NO: 958001 - RNA, 14 nt, Homo sapiens
agaguaacccuguc

SEQ ID NO: 958002 - RNA, 14 nt, Homo sapiens
agaguagagucacu

SEQ ID NO: 958003 - RNA, 13 nt, Homo sapiens
agaguaugucagu

SEQ ID NO: 958004 - RNA, 20 nt, Homo sapiens
agagucaacaggucacuuga

SEQ ID NO: 958005 - RNA, 23 nt, Homo sapiens
agagucacuggaacacuaaugag

SEQ ID NO: 958006 - RNA, 20 nt, Homo sapiens
agaguguguccacugagaag

SEQ ID NO: 958007 - RNA, 17 nt, Homo sapiens
agauauucauacuuucc

SEQ ID NO: 958008 - RNA, 18 nt, Homo sapiens
agauauuuuuauauagac

SEQ ID NO: 958009 - RNA, 19 nt, Homo sapiens
agaucacgccauugcacuc

SEQ ID NO: 958010 - RNA, 18 nt, Homo sapiens
agauccucugauauacaa

SEQ ID NO: 958011 - RNA, 15 nt, Homo sapiens
agauccugucccaug

SEQ ID NO: 958012 - RNA, 23 nt, Homo sapiens
agaugaaucaguaugaagacacu

SEQ ID NO: 958013 - RNA, 19 nt, Homo sapiens
agaugacuggaaacaagga

SEQ ID NO: 958014 - RNA, 16 nt, Homo sapiens
agaugcuuaaaaaccu

SEQ ID NO: 958015 - RNA, 16 nt, Homo sapiens
agaugguaaucuuuuc

SEQ ID NO: 958016 - RNA, 15 nt, Homo sapiens
agaugucagucuguc

SEQ ID NO: 958017 - RNA, 12 nt, Homo sapiens
agauuagcuuuu

SEQ ID NO: 958018 - RNA, 22 nt, Homo sapiens
agauucaauuaaguuauuaaca

SEQ ID NO: 958019 - RNA, 17 nt, Homo sapiens
agauuuuucucaucucc

SEQ ID NO: 958020 - RNA, 20 nt, Homo sapiens
agcaaccaacuuuaccucuu

SEQ ID NO: 958021 - RNA, 16 nt, Homo sapiens
agcaagucccaucuca

SEQ ID NO: 958022 - RNA, 20 nt, Homo sapiens
agcacaagaaguuucuucag

SEQ ID NO: 958023 - RNA, 20 nt, Homo sapiens
agcacauaguguuuaaagac

SEQ ID NO: 958024 - RNA, 13 nt, Homo sapiens
agcacaugcacac

SEQ ID NO: 958025 - RNA, 20 nt, Homo sapiens
agcacguaguuugcauucca

SEQ ID NO: 958026 - RNA, 17 nt, Homo sapiens
agcacuaacacaugcac

SEQ ID NO: 958027 - RNA, 14 nt, Homo sapiens
agcacuaccaguau

SEQ ID NO: 958028 - RNA, 17 nt, Homo sapiens
agcacuagaagcacagg

SEQ ID NO: 958029 - RNA, 16 nt, Homo sapiens
agcacuagaaugagaa

SEQ ID NO: 958030 - RNA, 21 nt, Homo sapiens
agcacuagugcugccauuaau

SEQ ID NO: 958031 - RNA, 18 nt, Homo sapiens
agcacuguuuucaucaca

SEQ ID NO: 958032 - RNA, 18 nt, Homo sapiens
agcaguugcaaugaucag

SEQ ID NO: 958033 - RNA, 15 nt, Homo sapiens
agcauaccacuugaa

SEQ ID NO: 958034 - RNA, 20 nt, Homo sapiens
agcaucauggaucaaccaag

SEQ ID NO: 958035 - RNA, 14 nt, Homo sapiens
agcauuauugccaa

SEQ ID NO: 958036 - RNA, 18 nt, Homo sapiens
agcauugugaucaaagac

SEQ ID NO: 958037 - RNA, 23 nt, Homo sapiens
agccaagaauucuuaaauaugug

SEQ ID NO: 958038 - RNA, 19 nt, Homo sapiens
agccccugggaauguucca

SEQ ID NO: 958039 - RNA, 17 nt, Homo sapiens
agcccgucaucuucccu

SEQ ID NO: 958040 - RNA, 15 nt, Homo sapiens
agcccuaaugucuga

SEQ ID NO: 958041 - RNA, 17 nt, Homo sapiens
agcccugacuauuuaca

SEQ ID NO: 958042 - RNA, 19 nt, Homo sapiens
agccugcguggccuggggc

SEQ ID NO: 958043 - RNA, 15 nt, Homo sapiens
agccuguuuccccaa

SEQ ID NO: 958044 - RNA, 15 nt, Homo sapiens
agcgugcaggagcaa

SEQ ID NO: 958045 - RNA, 15 nt, Homo sapiens
agcuaauuagcucuc

SEQ ID NO: 958046 - RNA, 19 nt, Homo sapiens
agcuaccaacuaaguugua

SEQ ID NO: 958047 - RNA, 20 nt, Homo sapiens
agcuaggugcacauauacau

SEQ ID NO: 958048 - RNA, 13 nt, Homo sapiens
agcucaggugccu

SEQ ID NO: 958049 - RNA, 15 nt, Homo sapiens
agcugcucacugcuc

SEQ ID NO: 958050 - RNA, 18 nt, Homo sapiens
agcugcucacugcucaca

SEQ ID NO: 958051 - RNA, 19 nt, Homo sapiens
agcuggucaguugccaaag

SEQ ID NO: 958052 - RNA, 13 nt, Homo sapiens
agcuguguccuca

SEQ ID NO: 958053 - RNA, 17 nt, Homo sapiens
agcuguuagcacguuag

SEQ ID NO: 958054 - RNA, 17 nt, Homo sapiens
agcuguuccacuucucu

SEQ ID NO: 958055 - RNA, 18 nt, Homo sapiens
agcuuaagugacuuccuc

SEQ ID NO: 958056 - RNA, 21 nt, Homo sapiens
agcuuauaaaaauaaagggaa

SEQ ID NO: 958057 - RNA, 20 nt, Homo sapiens
agcuuauuuaaucuguacua

SEQ ID NO: 958058 - RNA, 18 nt, Homo sapiens
agcuucaacuacuucucu

SEQ ID NO: 958059 - RNA, 22 nt, Homo sapiens
agcuucaacuacuucucuugca

SEQ ID NO: 958060 - RNA, 19 nt, Homo sapiens
agcuucauaauuuccauga

SEQ ID NO: 958061 - RNA, 21 nt, Homo sapiens
agcuucauaauuuccaugaua

SEQ ID NO: 958062 - RNA, 16 nt, Homo sapiens
agcuugccacuuucca

SEQ ID NO: 958063 - RNA, 19 nt, Homo sapiens
agcuuguccaaggucucau

SEQ ID NO: 958064 - RNA, 16 nt, Homo sapiens
aggaaacugcacuguu

SEQ ID NO: 958065 - RNA, 14 nt, Homo sapiens
aggaacagaguaua

SEQ ID NO: 958066 - RNA, 19 nt, Homo sapiens
aggaaccucaaacugggua

SEQ ID NO: 958067 - RNA, 20 nt, Homo sapiens
aggaagggaagagcauguaa

SEQ ID NO: 958068 - RNA, 20 nt, Homo sapiens
aggacaggauggcugugugu

SEQ ID NO: 958069 - RNA, 23 nt, Homo sapiens
aggacuaaauaaugaucuuccaa

SEQ ID NO: 958070 - RNA, 24 nt, Homo sapiens
aggagccugggaugauguugguca

SEQ ID NO: 958071 - RNA, 16 nt, Homo sapiens
aggagcuaaacaugcu

SEQ ID NO: 958072 - RNA, 14 nt, Homo sapiens
aggaggccaugccc

SEQ ID NO: 958073 - RNA, 14 nt, Homo sapiens
aggaggggagcaag

SEQ ID NO: 958074 - RNA, 20 nt, Homo sapiens
aggaggguauggugcugcuc

SEQ ID NO: 958075 - RNA, 15 nt, Homo sapiens
aggaggugccugaga

SEQ ID NO: 958076 - RNA, 16 nt, Homo sapiens
aggagucugauugcag

SEQ ID NO: 958077 - RNA, 22 nt, Homo sapiens
aggauccugagccagauuucac

SEQ ID NO: 958078 - RNA, 20 nt, Homo sapiens
aggaucuccccgaaucucaa

SEQ ID NO: 958079 - RNA, 17 nt, Homo sapiens
aggaucuuuguuccucu

SEQ ID NO: 958080 - RNA, 21 nt, Homo sapiens
aggaugucccugaagugccag

SEQ ID NO: 958081 - RNA, 15 nt, Homo sapiens
aggauugagcagcug

SEQ ID NO: 958082 - RNA, 16 nt, Homo sapiens
aggcacagcauucgaa

SEQ ID NO: 958083 - RNA, 20 nt, Homo sapiens
aggcacccaaaccccggggc

SEQ ID NO: 958084 - RNA, 16 nt, Homo sapiens
aggcacuuaaagccuu

SEQ ID NO: 958085 - RNA, 23 nt, Homo sapiens
aggcaggcuuucugggugugacu

SEQ ID NO: 958086 - RNA, 18 nt, Homo sapiens
aggcauagccacuugcuc

SEQ ID NO: 958087 - RNA, 22 nt, Homo sapiens
aggccacacagcacaugcacac

SEQ ID NO: 958088 - RNA, 18 nt, Homo sapiens
aggccauuaggguugccu

SEQ ID NO: 958089 - RNA, 21 nt, Homo sapiens
aggccucaguguccucaucua

SEQ ID NO: 958090 - RNA, 22 nt, Homo sapiens
aggccuuugcuuuacagcacug

SEQ ID NO: 958091 - RNA, 17 nt, Homo sapiens
aggcucugcauacacau

SEQ ID NO: 958092 - RNA, 17 nt, Homo sapiens
agggaaauucacacugu

SEQ ID NO: 958093 - RNA, 15 nt, Homo sapiens
agggcgggccuguuu

SEQ ID NO: 958094 - RNA, 20 nt, Homo sapiens
agggcuaugccuccauuuca

SEQ ID NO: 958095 - RNA, 16 nt, Homo sapiens
aggggcugacucucca

SEQ ID NO: 958096 - RNA, 21 nt, Homo sapiens
aggguaaugcgugcaguuccu

SEQ ID NO: 958097 - RNA, 14 nt, Homo sapiens
agggucucacucug

SEQ ID NO: 958098 - RNA, 16 nt, Homo sapiens
cagaaggguaaugcgu

SEQ ID NO: 958099 - RNA, 22 nt, Homo sapiens
cagaaguaguuuuguucaugaa

SEQ ID NO: 958100 - RNA, 13 nt, Homo sapiens
cagaauacaauuc

SEQ ID NO: 958101 - RNA, 16 nt, Homo sapiens
cagaaugacucuggaa

SEQ ID NO: 958102 - RNA, 19 nt, Homo sapiens
cagaaugacucuggaacca

SEQ ID NO: 958103 - RNA, 15 nt, Homo sapiens
cagacauccugugau

SEQ ID NO: 958104 - RNA, 15 nt, Homo sapiens
cagacauucagagau

SEQ ID NO: 958105 - RNA, 23 nt, Homo sapiens
cagaccccugggggaggcuucca

SEQ ID NO: 958106 - RNA, 13 nt, Homo sapiens
cagaccuagggau

SEQ ID NO: 958107 - RNA, 14 nt, Homo sapiens
cagacgccugauau

SEQ ID NO: 958108 - RNA, 18 nt, Homo sapiens
cagacuaugcagcucauc

SEQ ID NO: 958109 - RNA, 18 nt, Homo sapiens
cagagaugaacaacuuug

SEQ ID NO: 958110 - RNA, 16 nt, Homo sapiens
cagagcacuguauacc

SEQ ID NO: 958111 - RNA, 16 nt, Homo sapiens
cagagcagaaccaaag

SEQ ID NO: 958112 - RNA, 10 nt, Homo sapiens
cagagccauc

SEQ ID NO: 958113 - RNA, 13 nt, Homo sapiens
cagagccauccac

SEQ ID NO: 958114 - RNA, 22 nt, Homo sapiens
cagagcgugcacuugugauccu

SEQ ID NO: 958115 - RNA, 16 nt, Homo sapiens
cagaguacaaauccaa

SEQ ID NO: 958116 - RNA, 20 nt, Homo sapiens
cagaucacacacaugcacac

SEQ ID NO: 958117 - RNA, 22 nt, Homo sapiens
cagaugagaagacuagcagcua

SEQ ID NO: 958118 - RNA, 22 nt, Homo sapiens
cagaugugggaaaaauauguga

SEQ ID NO: 958119 - RNA, 20 nt, Homo sapiens
cagauuccccaggaaucuug

SEQ ID NO: 958120 - RNA, 18 nt, Homo sapiens
cagcaaccagagcacugu

SEQ ID NO: 958121 - RNA, 22 nt, Homo sapiens
cagcaagcccgucaucuucccu

SEQ ID NO: 958122 - RNA, 20 nt, Homo sapiens
cagcaaguaugaaccacaug

SEQ ID NO: 958123 - RNA, 15 nt, Homo sapiens
cagcacacaugcauc

SEQ ID NO: 958124 - RNA, 12 nt, Homo sapiens
cagcacacuccc

SEQ ID NO: 958125 - RNA, 18 nt, Homo sapiens
cagcacuuuccuguugca

SEQ ID NO: 958126 - RNA, 23 nt, Homo sapiens
cagccccccaguguccccagggg

SEQ ID NO: 958127 - RNA, 23 nt, Homo sapiens
cagccucgucucuuuacagaagu

SEQ ID NO: 958128 - RNA, 16 nt, Homo sapiens
cagcuuauaugugaca

SEQ ID NO: 958129 - RNA, 14 nt, Homo sapiens
caggaaauaguguu

SEQ ID NO: 958130 - RNA, 14 nt, Homo sapiens
caggaaguacugga

SEQ ID NO: 958131 - RNA, 22 nt, Homo sapiens
caggaggacauagccugcaaag

SEQ ID NO: 958132 - RNA, 16 nt, Homo sapiens
caggauucucuucuca

SEQ ID NO: 958133 - RNA, 16 nt, Homo sapiens
caggcaguagcagcug

SEQ ID NO: 958134 - RNA, 17 nt, Homo sapiens
caggccgcacaucucac

SEQ ID NO: 958135 - RNA, 21 nt, Homo sapiens
caggccgcacaucucacuuca

SEQ ID NO: 958136 - RNA, 23 nt, Homo sapiens
caggcugccccaccccuccauga

SEQ ID NO: 958137 - RNA, 16 nt, Homo sapiens
caggcuggagugcaga

SEQ ID NO: 958138 - RNA, 18 nt, Homo sapiens
caggcuggucuugaacuc

SEQ ID NO: 958139 - RNA, 13 nt, Homo sapiens
caggcuucgucuc

SEQ ID NO: 958140 - RNA, 14 nt, Homo sapiens
cagggcccuguggc

SEQ ID NO: 958141 - RNA, 16 nt, Homo sapiens
caggggcaaaagucau

SEQ ID NO: 958142 - RNA, 15 nt, Homo sapiens
caggggguucuggga

SEQ ID NO: 958143 - RNA, 22 nt, Homo sapiens
caggguauaccucuaauaaccu

SEQ ID NO: 958144 - RNA, 22 nt, Homo sapiens
caggucacuugaucaugcugca

SEQ ID NO: 958145 - RNA, 23 nt, Homo sapiens
caggucacuugaucaugcugcag

SEQ ID NO: 958146 - RNA, 19 nt, Homo sapiens
cagguggccagggcuccac

SEQ ID NO: 958147 - RNA, 19 nt, Homo sapiens
cagguuuggggaugaguca

SEQ ID NO: 958148 - RNA, 12 nt, Homo sapiens
caguaaauccaa

SEQ ID NO: 958149 - RNA, 15 nt, Homo sapiens
cagucacaugugcuc

SEQ ID NO: 958150 - RNA, 18 nt, Homo sapiens
caguccuccgguugcaua

SEQ ID NO: 958151 - RNA, 15 nt, Homo sapiens
cagugacucaucuuc

SEQ ID NO: 958152 - RNA, 15 nt, Homo sapiens
cagugagaaauuaca

SEQ ID NO: 958153 - RNA, 14 nt, Homo sapiens
caguggagcucaga

SEQ ID NO: 958154 - RNA, 22 nt, Homo sapiens
caguuagcccggccaaggacac

SEQ ID NO: 958155 - RNA, 16 nt, Homo sapiens
caguuauacauaccuc

SEQ ID NO: 958156 - RNA, 19 nt, Homo sapiens
caguuaugauaaccaagaa

SEQ ID NO: 958157 - RNA, 15 nt, Homo sapiens
caguuauugugaaaa

SEQ ID NO: 958158 - RNA, 12 nt, Homo sapiens
caguugccaaag

SEQ ID NO: 958159 - RNA, 19 nt, Homo sapiens
caguuuaaaggggucccau

SEQ ID NO: 958160 - RNA, 17 nt, Homo sapiens
cauaaaaauaaccaaaa

SEQ ID NO: 958161 - RNA, 17 nt, Homo sapiens
cauaaaaguuaacauua

SEQ ID NO: 958162 - RNA, 16 nt, Homo sapiens
cauaaagaaacacuuu

SEQ ID NO: 958163 - RNA, 23 nt, Homo sapiens
cauaaagagguaaaaaacuguca

SEQ ID NO: 958164 - RNA, 17 nt, Homo sapiens
cauaaaucugucugauu

SEQ ID NO: 958165 - RNA, 19 nt, Homo sapiens
cauaaaucuguuagcauua

SEQ ID NO: 958166 - RNA, 20 nt, Homo sapiens
cauaaucucuuugaagguuu

SEQ ID NO: 958167 - RNA, 15 nt, Homo sapiens
cauacucugugcaag

SEQ ID NO: 958168 - RNA, 16 nt, Homo sapiens
cauagugccuggcaua

SEQ ID NO: 958169 - RNA, 14 nt, Homo sapiens
cauauguagcauua

SEQ ID NO: 958170 - RNA, 17 nt, Homo sapiens
cauauuacaacacuuua

SEQ ID NO: 958171 - RNA, 17 nt, Homo sapiens
caucaagaugugacaug

SEQ ID NO: 958172 - RNA, 17 nt, Homo sapiens
caucacugcuccuguca

SEQ ID NO: 958173 - RNA, 22 nt, Homo sapiens
cauccacacccucuccuuguca

SEQ ID NO: 958174 - RNA, 13 nt, Homo sapiens
cauccaguaucuu

SEQ ID NO: 958175 - RNA, 23 nt, Homo sapiens
cauccugauuauugaauguuaua

SEQ ID NO: 958176 - RNA, 22 nt, Homo sapiens
caucuacuccucuacuccaaau

SEQ ID NO: 958177 - RNA, 17 nt, Homo sapiens
caucucuuguaccagcc

SEQ ID NO: 958178 - RNA, 19 nt, Homo sapiens
caucucuuuagauccaaaa

SEQ ID NO: 958179 - RNA, 16 nt, Homo sapiens
caucugcugagcucug

SEQ ID NO: 958180 - RNA, 22 nt, Homo sapiens
caucuuguaaauaaugcuuaac

SEQ ID NO: 958181 - RNA, 17 nt, Homo sapiens
caugaaagcaccugccc

SEQ ID NO: 958182 - RNA, 12 nt, Homo sapiens
caugaagcacau

SEQ ID NO: 958183 - RNA, 18 nt, Homo sapiens
caugaaggagaggauuug

SEQ ID NO: 958184 - RNA, 13 nt, Homo sapiens
caugagaaaucau

SEQ ID NO: 958185 - RNA, 17 nt, Homo sapiens
caugaguuuaugggaau

SEQ ID NO: 958186 - RNA, 16 nt, Homo sapiens
caugauacaaagaucu

SEQ ID NO: 958187 - RNA, 18 nt, Homo sapiens
caugcacacaggugcaca

SEQ ID NO: 958188 - RNA, 17 nt, Homo sapiens
caugcaggugacauucu

SEQ ID NO: 958189 - RNA, 23 nt, Homo sapiens
caugccgcugugucuaugaacua

SEQ ID NO: 958190 - RNA, 18 nt, Homo sapiens
caugcucauguguacaca

SEQ ID NO: 958191 - RNA, 22 nt, Homo sapiens
cauggaaguacuauaauuuacc

SEQ ID NO: 958192 - RNA, 17 nt, Homo sapiens
cauggcuuggcauuuuc

SEQ ID NO: 958193 - RNA, 17 nt, Homo sapiens
caugggaaugaauguca

SEQ ID NO: 958194 - RNA, 22 nt, Homo sapiens
caugucuuuccuauuugcacac

SEQ ID NO: 958195 - RNA, 13 nt, Homo sapiens
cauguguacagaa

SEQ ID NO: 958196 - RNA, 17 nt, Homo sapiens
cauguucagucacaugu

SEQ ID NO: 958197 - RNA, 18 nt, Homo sapiens
cauguuuuugcaaauacu

SEQ ID NO: 958198 - RNA, 22 nt, Homo sapiens
cauuaaauauaaaauacauaaa

SEQ ID NO: 958199 - RNA, 14 nt, Homo sapiens
cauuaccacacuca

SEQ ID NO: 958200 - RNA, 21 nt, Homo sapiens
cauuagaugaaguuacuguug

SEQ ID NO: 958201 - RNA, 18 nt, Homo sapiens
cauuauccugugugauua

SEQ ID NO: 958202 - RNA, 13 nt, Homo sapiens
cauuauugucaac

SEQ ID NO: 958203 - RNA, 15 nt, Homo sapiens
cauucaaaauaguuc

SEQ ID NO: 958204 - RNA, 15 nt, Homo sapiens
cauucaaaccaaaua

SEQ ID NO: 958205 - RNA, 18 nt, Homo sapiens
cauucacagcuacgugug

SEQ ID NO: 958206 - RNA, 13 nt, Homo sapiens
cauucaguuauca

SEQ ID NO: 958207 - RNA, 21 nt, Homo sapiens
cauucauggaccacuguuucu

SEQ ID NO: 958208 - RNA, 19 nt, Homo sapiens
cauucuaugacucuugucu

SEQ ID NO: 958209 - RNA, 15 nt, Homo sapiens
cauugagacauuugc

SEQ ID NO: 958210 - RNA, 20 nt, Homo sapiens
cauuguuacagguguacuau

SEQ ID NO: 958211 - RNA, 18 nt, Homo sapiens
cauuguuaugcacuuuuc

SEQ ID NO: 958212 - RNA, 16 nt, Homo sapiens
cauuucacuauucugu

SEQ ID NO: 958213 - RNA, 20 nt, Homo sapiens
cauuucauugagggaaaaca

SEQ ID NO: 958214 - RNA, 17 nt, Homo sapiens
cauuuccgaagaccuuc

SEQ ID NO: 958215 - RNA, 11 nt, Homo sapiens
cauuucuuaga

SEQ ID NO: 958216 - RNA, 11 nt, Homo sapiens
cauuuuugcuu

SEQ ID NO: 958217 - RNA, 17 nt, Homo sapiens
ccaaacaaagcaaaaaa

SEQ ID NO: 958218 - RNA, 22 nt, Homo sapiens
ccaaagcaugauugugaccucc

SEQ ID NO: 958219 - RNA, 21 nt, Homo sapiens
ccaacacugaaaacacuguga

SEQ ID NO: 958220 - RNA, 16 nt, Homo sapiens
ccaaccucgcccucuc

SEQ ID NO: 958221 - RNA, 18 nt, Homo sapiens
ccaagccuaucauuguag

SEQ ID NO: 958222 - RNA, 17 nt, Homo sapiens
ccaagcugcucauuuca

SEQ ID NO: 958223 - RNA, 12 nt, Homo sapiens
ccaagcugugac

SEQ ID NO: 958224 - RNA, 15 nt, Homo sapiens
ccaauaaaaguguca

SEQ ID NO: 958225 - RNA, 15 nt, Homo sapiens
ccaaucaacagcaug

SEQ ID NO: 958226 - RNA, 18 nt, Homo sapiens
ccaauucauuaugucaau

SEQ ID NO: 958227 - RNA, 14 nt, Homo sapiens
ccacacggucuuca

SEQ ID NO: 958228 - RNA, 15 nt, Homo sapiens
ccacacguuugccaa

SEQ ID NO: 958229 - RNA, 17 nt, Homo sapiens
ccacacuaccaguuuca

SEQ ID NO: 958230 - RNA, 14 nt, Homo sapiens
ggcucacaugcucc

SEQ ID NO: 958231 - RNA, 13 nt, Homo sapiens
ggcuggcggccau

SEQ ID NO: 958232 - RNA, 18 nt, Homo sapiens
ggcuguacgucugguguu

SEQ ID NO: 958233 - RNA, 17 nt, Homo sapiens
ggcuucagccccugggg

SEQ ID NO: 958234 - RNA, 12 nt, Homo sapiens
ggcuucuucaac

SEQ ID NO: 958235 - RNA, 19 nt, Homo sapiens
ggcuuucugggugugacug

SEQ ID NO: 958236 - RNA, 23 nt, Homo sapiens
gggaaaaauaugugaauguguag

SEQ ID NO: 958237 - RNA, 22 nt, Homo sapiens
gggacacggccucuggggagac

SEQ ID NO: 958238 - RNA, 20 nt, Homo sapiens
gggaugagucaguccuugcc

SEQ ID NO: 958239 - RNA, 15 nt, Homo sapiens
gggcacuaaccccau

SEQ ID NO: 958240 - RNA, 23 nt, Homo sapiens
gggccuguuuggugaggaccugc

SEQ ID NO: 958241 - RNA, 22 nt, Homo sapiens
gggcuacgguuccauguucacc

SEQ ID NO: 958242 - RNA, 22 nt, Homo sapiens
gggcuccccuucgcguauuuca

SEQ ID NO: 958243 - RNA, 18 nt, Homo sapiens
gggcuguuuuaagaccag

SEQ ID NO: 958244 - RNA, 17 nt, Homo sapiens
ggggguauccugugcau

SEQ ID NO: 958245 - RNA, 20 nt, Homo sapiens
ggguccacacggucuucaca

SEQ ID NO: 958246 - RNA, 20 nt, Homo sapiens
gggucccaucagugaaagaa

SEQ ID NO: 958247 - RNA, 19 nt, Homo sapiens
gggugccuucuagcugugu

SEQ ID NO: 958248 - RNA, 19 nt, Homo sapiens
gguaacucauuuacaguca

SEQ ID NO: 958249 - RNA, 14 nt, Homo sapiens
gguaaguuggcuca

SEQ ID NO: 958250 - RNA, 20 nt, Homo sapiens
gguaccaagaucacaaauag

SEQ ID NO: 958251 - RNA, 22 nt, Homo sapiens
gguaugguaaagagaugucaaa

SEQ ID NO: 958252 - RNA, 22 nt, Homo sapiens
ggucagcgauuccugccaagua

SEQ ID NO: 958253 - RNA, 15 nt, Homo sapiens
ggucaguugccaaag

SEQ ID NO: 958254 - RNA, 16 nt, Homo sapiens
ggucaucccggggcca

SEQ ID NO: 958255 - RNA, 23 nt, Homo sapiens
gguccaaagaguuucugcaaagu

SEQ ID NO: 958256 - RNA, 19 nt, Homo sapiens
gguccuucuguagugccau

SEQ ID NO: 958257 - RNA, 13 nt, Homo sapiens
gguccuuuggaca

SEQ ID NO: 958258 - RNA, 21 nt, Homo sapiens
ggucucgucaggaggugccug

SEQ ID NO: 958259 - RNA, 23 nt, Homo sapiens
ggugaaacccuacgaaagcacag

SEQ ID NO: 958260 - RNA, 22 nt, Homo sapiens
ggugauauauaaucauauccag

SEQ ID NO: 958261 - RNA, 23 nt, Homo sapiens
gguggguccacacggucuucaca

SEQ ID NO: 958262 - RNA, 14 nt, Homo sapiens
gguguggagugacu

SEQ ID NO: 958263 - RNA, 17 nt, Homo sapiens
gguuacaaggggcugcu

SEQ ID NO: 958264 - RNA, 22 nt, Homo sapiens
gguucacaaagcucggaccugc

SEQ ID NO: 958265 - RNA, 14 nt, Homo sapiens
gguuuucauuauuu

SEQ ID NO: 958266 - RNA, 18 nt, Homo sapiens
guaaagaaaccauggcau

SEQ ID NO: 958267 - RNA, 18 nt, Homo sapiens
guaaauuuuauaauguca

SEQ ID NO: 958268 - RNA, 20 nt, Homo sapiens
guaacucauuuacagucaua

SEQ ID NO: 958269 - RNA, 23 nt, Homo sapiens
guaacugcacacaugguuuccaa

SEQ ID NO: 958270 - RNA, 15 nt, Homo sapiens
guaaguugaagggaa

SEQ ID NO: 958271 - RNA, 20 nt, Homo sapiens
guaaucccagcuaccuggga

SEQ ID NO: 958272 - RNA, 18 nt, Homo sapiens
guaaugcgugcaguuccu

SEQ ID NO: 958273 - RNA, 22 nt, Homo sapiens
guaauugcuuaaaguuuuacca

SEQ ID NO: 958274 - RNA, 15 nt, Homo sapiens
guaauuguuacaauu

SEQ ID NO: 958275 - RNA, 14 nt, Homo sapiens
guacaagugagaaa

SEQ ID NO: 958276 - RNA, 19 nt, Homo sapiens
guacauagcucucauguau

SEQ ID NO: 958277 - RNA, 21 nt, Homo sapiens
guacauauggaaauccuguua

SEQ ID NO: 958278 - RNA, 19 nt, Homo sapiens
guaccaagaucacaaauag

SEQ ID NO: 958279 - RNA, 15 nt, Homo sapiens
guacuucaguucuca

SEQ ID NO: 958280 - RNA, 17 nt, Homo sapiens
guagauauuauguauag

SEQ ID NO: 958281 - RNA, 18 nt, Homo sapiens
guagguaaguuggcucac

SEQ ID NO: 958282 - RNA, 22 nt, Homo sapiens
guauaacaagccaaacauucuu

SEQ ID NO: 958283 - RNA, 16 nt, Homo sapiens
guauaauaugcaguuc

SEQ ID NO: 958284 - RNA, 12 nt, Homo sapiens
guauacauuuag

SEQ ID NO: 958285 - RNA, 13 nt, Homo sapiens
guauaucagcucu

SEQ ID NO: 958286 - RNA, 21 nt, Homo sapiens
guaucauaucaugaauggacu

SEQ ID NO: 958287 - RNA, 21 nt, Homo sapiens
guaucuguuuacauccagagu

SEQ ID NO: 958288 - RNA, 13 nt, Homo sapiens
guaugcuaugcua

SEQ ID NO: 958289 - RNA, 20 nt, Homo sapiens
guauucugaucaguugccaa

SEQ ID NO: 958290 - RNA, 14 nt, Homo sapiens
guauuuugugcaag

SEQ ID NO: 958291 - RNA, 15 nt, Homo sapiens
gucaagaaguuaaau

SEQ ID NO: 958292 - RNA, 16 nt, Homo sapiens
gucacagaaucuccau

SEQ ID NO: 958293 - RNA, 17 nt, Homo sapiens
gucacagaaucuccauu

SEQ ID NO: 958294 - RNA, 18 nt, Homo sapiens
gucaccagguccugugag

SEQ ID NO: 958295 - RNA, 23 nt, Homo sapiens
gucagcacguaguuugcauucca

SEQ ID NO: 958296 - RNA, 17 nt, Homo sapiens
gucauaaucucuuucca

SEQ ID NO: 958297 - RNA, 20 nt, Homo sapiens
gucaucaucaagucaucugg

SEQ ID NO: 958298 - RNA, 16 nt, Homo sapiens
gucaucucaaacacug

SEQ ID NO: 958299 - RNA, 21 nt, Homo sapiens
gucauguuucugcaguauucu

SEQ ID NO: 958300 - RNA, 13 nt, Homo sapiens
gucauucugcuaa

SEQ ID NO: 958301 - RNA, 20 nt, Homo sapiens
guccaacaacuccaggaaaa

SEQ ID NO: 958302 - RNA, 11 nt, Homo sapiens
guccacccgcc

SEQ ID NO: 958303 - RNA, 18 nt, Homo sapiens
guccagcucccuugcuaa

SEQ ID NO: 958304 - RNA, 20 nt, Homo sapiens
gucccaauuugaauucaauu

SEQ ID NO: 958305 - RNA, 22 nt, Homo sapiens
guccccggacgcuggcucggga

SEQ ID NO: 958306 - RNA, 21 nt, Homo sapiens
gucccugagaagccucauggg

SEQ ID NO: 958307 - RNA, 20 nt, Homo sapiens
gucccuggaaucagaagcac

SEQ ID NO: 958308 - RNA, 17 nt, Homo sapiens
guccucugcacugggaa

SEQ ID NO: 958309 - RNA, 16 nt, Homo sapiens
guccucuuaagacacu

SEQ ID NO: 958310 - RNA, 14 nt, Homo sapiens
guccugggcaaagg

SEQ ID NO: 958311 - RNA, 16 nt, Homo sapiens
guccuggucaguuuuc

SEQ ID NO: 958312 - RNA, 18 nt, Homo sapiens
guccuucuguagugccau

SEQ ID NO: 958313 - RNA, 18 nt, Homo sapiens
gucucucuaaacccaaau

SEQ ID NO: 958314 - RNA, 17 nt, Homo sapiens
gucugcuuaccaaaaca

SEQ ID NO: 958315 - RNA, 14 nt, Homo sapiens
gucuggagcaaagc

SEQ ID NO: 958316 - RNA, 17 nt, Homo sapiens
gucuguaagagaauucu

SEQ ID NO: 958317 - RNA, 18 nt, Homo sapiens
gucuuuuuccaaacaauu

SEQ ID NO: 958318 - RNA, 13 nt, Homo sapiens
gugacagcacuuu

SEQ ID NO: 958319 - RNA, 14 nt, Homo sapiens
gugaccgggguccu

SEQ ID NO: 958320 - RNA, 20 nt, Homo sapiens
gugacuuccucgaggucaua

SEQ ID NO: 958321 - RNA, 22 nt, Homo sapiens
gugagccaaagcuuaugugaca

SEQ ID NO: 958322 - RNA, 20 nt, Homo sapiens
gugaggucaucccggggcca

SEQ ID NO: 958323 - RNA, 19 nt, Homo sapiens
gugauaaauuugaucccaa

SEQ ID NO: 958324 - RNA, 16 nt, Homo sapiens
gugaucugucuuguaa

SEQ ID NO: 958325 - RNA, 18 nt, Homo sapiens
gugaugggcaaggggcca

SEQ ID NO: 958326 - RNA, 18 nt, Homo sapiens
gugcaauaugaggccaaa

SEQ ID NO: 958327 - RNA, 14 nt, Homo sapiens
gugcacggggccag

SEQ ID NO: 958328 - RNA, 15 nt, Homo sapiens
gugcacggggccagc

SEQ ID NO: 958329 - RNA, 23 nt, Homo sapiens
gugcagcaaccagagcacuguau

SEQ ID NO: 958330 - RNA, 14 nt, Homo sapiens
gugcauacacaugc

SEQ ID NO: 958331 - RNA, 18 nt, Homo sapiens
gugcauaggccacacagc

SEQ ID NO: 958332 - RNA, 12 nt, Homo sapiens
gugcaugcacac

SEQ ID NO: 958333 - RNA, 15 nt, Homo sapiens
gugcuccugaaagaa

SEQ ID NO: 958334 - RNA, 13 nt, Homo sapiens
gugcucuccuaga

SEQ ID NO: 958335 - RNA, 13 nt, Homo sapiens
gugcucuuuccac

SEQ ID NO: 958336 - RNA, 15 nt, Homo sapiens
gugcugggauuacag

SEQ ID NO: 958337 - RNA, 19 nt, Homo sapiens
gugcugggauuacaggugu

SEQ ID NO: 958338 - RNA, 18 nt, Homo sapiens
guggauuuuuaccuuugu

SEQ ID NO: 958339 - RNA, 17 nt, Homo sapiens
gugguccuuccaccuca

SEQ ID NO: 958340 - RNA, 17 nt, Homo sapiens
guggugagaggcaucca

SEQ ID NO: 958341 - RNA, 20 nt, Homo sapiens
gugguugggaaacucauuua

SEQ ID NO: 958342 - RNA, 18 nt, Homo sapiens
gugucaugauuucaauga

SEQ ID NO: 958343 - RNA, 14 nt, Homo sapiens
gugucgggcaugac

SEQ ID NO: 958344 - RNA, 17 nt, Homo sapiens
gugucuaguuugcauac

SEQ ID NO: 958345 - RNA, 19 nt, Homo sapiens
gugucuaguuugcauacuu

SEQ ID NO: 958346 - RNA, 14 nt, Homo sapiens
gugugcugugacaa

SEQ ID NO: 958347 - RNA, 16 nt, Homo sapiens
guguucgcuggcugau

SEQ ID NO: 958348 - RNA, 18 nt, Homo sapiens
guguugaggaggggagca

SEQ ID NO: 958349 - RNA, 17 nt, Homo sapiens
guguugcuauguguacu

SEQ ID NO: 958350 - RNA, 15 nt, Homo sapiens
guuaacaacuugaau

SEQ ID NO: 958351 - RNA, 12 nt, Homo sapiens
guuaauaaucua

SEQ ID NO: 958352 - RNA, 13 nt, Homo sapiens
guuacgugaauaa

SEQ ID NO: 958353 - RNA, 13 nt, Homo sapiens
guuagucuuaccg

SEQ ID NO: 958354 - RNA, 12 nt, Homo sapiens
guuaucagucuc

SEQ ID NO: 958355 - RNA, 22 nt, Homo sapiens
guuaucuucuaucaaagcacau

SEQ ID NO: 958356 - RNA, 18 nt, Homo sapiens
guucaauuggacaauuau

SEQ ID NO: 958357 - RNA, 15 nt, Homo sapiens
guucagaaauaugaa

SEQ ID NO: 958358 - RNA, 14 nt, Homo sapiens
guucagucacaugu

SEQ ID NO: 958359 - RNA, 21 nt, Homo sapiens
guucagucacaugugcucucg

SEQ ID NO: 958360 - RNA, 15 nt, Homo sapiens
guucuuauucacuga

SEQ ID NO: 958361 - RNA, 21 nt, Homo sapiens
guugauccugaguuacgugaa

SEQ ID NO: 958362 - RNA, 14 nt, Homo sapiens
acuggccaugguga

SEQ ID NO: 958363 - RNA, 20 nt, Homo sapiens
acugggccccacauggcuua

SEQ ID NO: 958364 - RNA, 17 nt, Homo sapiens
acuggggcaagcuccuc

SEQ ID NO: 958365 - RNA, 20 nt, Homo sapiens
acugggugcgucuccaguca

SEQ ID NO: 958366 - RNA, 12 nt, Homo sapiens
acugguccaaaa

SEQ ID NO: 958367 - RNA, 13 nt, Homo sapiens
acuguaagggauu

SEQ ID NO: 958368 - RNA, 17 nt, Homo sapiens
acuguaccgacuuugau

SEQ ID NO: 958369 - RNA, 16 nt, Homo sapiens
acugucucucuucuca

SEQ ID NO: 958370 - RNA, 21 nt, Homo sapiens
acugucugugaacagagagac

SEQ ID NO: 958371 - RNA, 16 nt, Homo sapiens
acugucuuccucaaaa

SEQ ID NO: 958372 - RNA, 15 nt, Homo sapiens
acugugucucaugga

SEQ ID NO: 958373 - RNA, 19 nt, Homo sapiens
acuuaaaugguaauaagca

SEQ ID NO: 958374 - RNA, 13 nt, Homo sapiens
acuuaacuauuaa

SEQ ID NO: 958375 - RNA, 18 nt, Homo sapiens
acuuaacuauuaaggccu

SEQ ID NO: 958376 - RNA, 14 nt, Homo sapiens
acuuagagaaccua

SEQ ID NO: 958377 - RNA, 23 nt, Homo sapiens
acuuaggaaauggcuuugugauu

SEQ ID NO: 958378 - RNA, 14 nt, Homo sapiens
acuucaaaguuaau

SEQ ID NO: 958379 - RNA, 23 nt, Homo sapiens
acuuccaagcuggcuuuucccau

SEQ ID NO: 958380 - RNA, 21 nt, Homo sapiens
acuuccagagaggaccuaucc

SEQ ID NO: 958381 - RNA, 15 nt, Homo sapiens
acuucucgaauugaa

SEQ ID NO: 958382 - RNA, 18 nt, Homo sapiens
acuucucuuaaguggucu

SEQ ID NO: 958383 - RNA, 23 nt, Homo sapiens
acuucugcaacaagcaugcagcu

SEQ ID NO: 958384 - RNA, 13 nt, Homo sapiens
acuucuugaauau

SEQ ID NO: 958385 - RNA, 14 nt, Homo sapiens
acuugaagccaucu

SEQ ID NO: 958386 - RNA, 16 nt, Homo sapiens
acuugaagccaucuaa

SEQ ID NO: 958387 - RNA, 21 nt, Homo sapiens
acuugcccugaacauacacau

SEQ ID NO: 958388 - RNA, 14 nt, Homo sapiens
acuugccucugcac

SEQ ID NO: 958389 - RNA, 17 nt, Homo sapiens
acuugcugcugucuugu

SEQ ID NO: 958390 - RNA, 18 nt, Homo sapiens
acuuggugauuaccugaa

SEQ ID NO: 958391 - RNA, 17 nt, Homo sapiens
acuuuaucuauaucuca

SEQ ID NO: 958392 - RNA, 14 nt, Homo sapiens
acuuucagugcuuu

SEQ ID NO: 958393 - RNA, 14 nt, Homo sapiens
acuuugaguaccaa

SEQ ID NO: 958394 - RNA, 15 nt, Homo sapiens
acuuugggaccugcu

SEQ ID NO: 958395 - RNA, 16 nt, Homo sapiens
acuuugggaccugcuu

SEQ ID NO: 958396 - RNA, 23 nt, Homo sapiens
acuuugggggaggagaacaugag

SEQ ID NO: 958397 - RNA, 17 nt, Homo sapiens
acuuuguguucauuuca

SEQ ID NO: 958398 - RNA, 23 nt, Homo sapiens
acuuuguuugucacaaguggugu

SEQ ID NO: 958399 - RNA, 22 nt, Homo sapiens
acuuuuacacgaccauuugaua

SEQ ID NO: 958400 - RNA, 15 nt, Homo sapiens
acuuuugaccaaaua

SEQ ID NO: 958401 - RNA, 15 nt, Homo sapiens
acuuuugcacauucc

SEQ ID NO: 958402 - RNA, 19 nt, Homo sapiens
acuuuuuuagaaaugcaaa

SEQ ID NO: 958403 - RNA, 20 nt, Homo sapiens
acuuuuuuagaaaugcaaaa

SEQ ID NO: 958404 - RNA, 21 nt, Homo sapiens
agaaaacagcccccacuccag

SEQ ID NO: 958405 - RNA, 15 nt, Homo sapiens
agaaaagaacuggaa

SEQ ID NO: 958406 - RNA, 20 nt, Homo sapiens
agaaaauaugaccagaucag

SEQ ID NO: 958407 - RNA, 22 nt, Homo sapiens
agaaacaccccucugucuagga

SEQ ID NO: 958408 - RNA, 13 nt, Homo sapiens
agaaacaucucaa

SEQ ID NO: 958409 - RNA, 22 nt, Homo sapiens
agaaacuuggaugucacugccu

SEQ ID NO: 958410 - RNA, 19 nt, Homo sapiens
agaaagaauuggccaggca

SEQ ID NO: 958411 - RNA, 15 nt, Homo sapiens
agaaauaaaugaaac

SEQ ID NO: 958412 - RNA, 16 nt, Homo sapiens
agaaaucuaagcugug

SEQ ID NO: 958413 - RNA, 13 nt, Homo sapiens
agaaaugcaaaac

SEQ ID NO: 958414 - RNA, 19 nt, Homo sapiens
agaaaugcugcuggccaaa

SEQ ID NO: 958415 - RNA, 18 nt, Homo sapiens
agaaauggcgucugcucu

SEQ ID NO: 958416 - RNA, 17 nt, Homo sapiens
agaaaugguauguagag

SEQ ID NO: 958417 - RNA, 21 nt, Homo sapiens
agaaauuccauacuucucuca

SEQ ID NO: 958418 - RNA, 14 nt, Homo sapiens
agaacagagugcaa

SEQ ID NO: 958419 - RNA, 12 nt, Homo sapiens
agaaccaaaggg

SEQ ID NO: 958420 - RNA, 13 nt, Homo sapiens
agaaccuuguccc

SEQ ID NO: 958421 - RNA, 21 nt, Homo sapiens
agaacuauugugcucagagac

SEQ ID NO: 958422 - RNA, 20 nt, Homo sapiens
agaacuccaguuuucaaauc

SEQ ID NO: 958423 - RNA, 13 nt, Homo sapiens
agaacugugccac

SEQ ID NO: 958424 - RNA, 16 nt, Homo sapiens
agaacuuuuucacuuc

SEQ ID NO: 958425 - RNA, 15 nt, Homo sapiens
agaagaaacagaagc

SEQ ID NO: 958426 - RNA, 22 nt, Homo sapiens
agaagcuagaaauuuagcaguc

SEQ ID NO: 958427 - RNA, 19 nt, Homo sapiens
agaagcucaucucagucau

SEQ ID NO: 958428 - RNA, 20 nt, Homo sapiens
agaagcuguuguacauuuau

SEQ ID NO: 958429 - RNA, 19 nt, Homo sapiens
agaaggucauaagggagca

SEQ ID NO: 958430 - RNA, 21 nt, Homo sapiens
agaaggugccacuuuacccac

SEQ ID NO: 958431 - RNA, 21 nt, Homo sapiens
agaagucuggcuuugcucuau

SEQ ID NO: 958432 - RNA, 23 nt, Homo sapiens
agaagucugucugucugaugaug

SEQ ID NO: 958433 - RNA, 17 nt, Homo sapiens
agaaguugagagagcaa

SEQ ID NO: 958434 - RNA, 21 nt, Homo sapiens
agaauaaaauuccuaucucau

SEQ ID NO: 958435 - RNA, 17 nt, Homo sapiens
agaauccuguaagcccc

SEQ ID NO: 958436 - RNA, 15 nt, Homo sapiens
agaaugaacacuccc

SEQ ID NO: 958437 - RNA, 15 nt, Homo sapiens
agaauguuccuacuc

SEQ ID NO: 958438 - RNA, 21 nt, Homo sapiens
agaauuuugaguauuccauga

SEQ ID NO: 958439 - RNA, 19 nt, Homo sapiens
agacaauguuuucuucaac

SEQ ID NO: 958440 - RNA, 22 nt, Homo sapiens
agacaccagagcagaugcagag

SEQ ID NO: 958441 - RNA, 20 nt, Homo sapiens
agacauacagcugccuaccu

SEQ ID NO: 958442 - RNA, 14 nt, Homo sapiens
agacaugaaccaag

SEQ ID NO: 958443 - RNA, 14 nt, Homo sapiens
agacauuuacaaag

SEQ ID NO: 958444 - RNA, 20 nt, Homo sapiens
agaccaggacagcagccacu

SEQ ID NO: 958445 - RNA, 17 nt, Homo sapiens
agaccaguacugggaag

SEQ ID NO: 958446 - RNA, 14 nt, Homo sapiens
agacccaguggacu

SEQ ID NO: 958447 - RNA, 14 nt, Homo sapiens
agacccgcccuccc

SEQ ID NO: 958448 - RNA, 14 nt, Homo sapiens
agaccugacguccc

SEQ ID NO: 958449 - RNA, 15 nt, Homo sapiens
agaccugagaaccuu

SEQ ID NO: 958450 - RNA, 16 nt, Homo sapiens
agacguccuccgucca

SEQ ID NO: 958451 - RNA, 22 nt, Homo sapiens
agacuaccggacacucgucacc

SEQ ID NO: 958452 - RNA, 16 nt, Homo sapiens
agacuccuagcugucc

SEQ ID NO: 958453 - RNA, 15 nt, Homo sapiens
agacucuaguauuua

SEQ ID NO: 958454 - RNA, 11 nt, Homo sapiens
agacugugcug

SEQ ID NO: 958455 - RNA, 13 nt, Homo sapiens
agacugugcuguu

SEQ ID NO: 958456 - RNA, 14 nt, Homo sapiens
agagaacucuuuca

SEQ ID NO: 958457 - RNA, 17 nt, Homo sapiens
agagaauaaaaaaugua

SEQ ID NO: 958458 - RNA, 13 nt, Homo sapiens
agagacacuccaa

SEQ ID NO: 958459 - RNA, 13 nt, Homo sapiens
agagacagaggau

SEQ ID NO: 958460 - RNA, 15 nt, Homo sapiens
agagacuccgucuca

SEQ ID NO: 958461 - RNA, 16 nt, Homo sapiens
agagagguuuuucuga

SEQ ID NO: 958462 - RNA, 22 nt, Homo sapiens
agagaguauuuuuauacaaacc

SEQ ID NO: 958463 - RNA, 17 nt, Homo sapiens
agagauuauaacaaauu

SEQ ID NO: 958464 - RNA, 20 nt, Homo sapiens
agagcaagacuccaucucaa

SEQ ID NO: 958465 - RNA, 14 nt, Homo sapiens
agagcagaugcaga

SEQ ID NO: 958466 - RNA, 14 nt, Homo sapiens
agagcagcuggcuc

SEQ ID NO: 958467 - RNA, 15 nt, Homo sapiens
agagcaguuggccaa

SEQ ID NO: 958468 - RNA, 16 nt, Homo sapiens
agagcaugcuauccca

SEQ ID NO: 958469 - RNA, 22 nt, Homo sapiens
agagccaugguguguuuguaau

SEQ ID NO: 958470 - RNA, 14 nt, Homo sapiens
agagcccagucucc

SEQ ID NO: 958471 - RNA, 17 nt, Homo sapiens
agagcccgcagggccau

SEQ ID NO: 958472 - RNA, 19 nt, Homo sapiens
agagccucuggcaucucuu

SEQ ID NO: 958473 - RNA, 15 nt, Homo sapiens
agagcuagcugccac

SEQ ID NO: 958474 - RNA, 13 nt, Homo sapiens
agaggaauccugg

SEQ ID NO: 958475 - RNA, 20 nt, Homo sapiens
agaggccaguugaucugcuc

SEQ ID NO: 958476 - RNA, 16 nt, Homo sapiens
agaggcucuggacagc

SEQ ID NO: 958477 - RNA, 16 nt, Homo sapiens
auaauaagcuaaagag

SEQ ID NO: 958478 - RNA, 16 nt, Homo sapiens
auaauagagauaaguc

SEQ ID NO: 958479 - RNA, 13 nt, Homo sapiens
auaauagcagauu

SEQ ID NO: 958480 - RNA, 20 nt, Homo sapiens
auaauagcagauuucuugcu

SEQ ID NO: 958481 - RNA, 15 nt, Homo sapiens
auaaucuuuagucau

SEQ ID NO: 958482 - RNA, 16 nt, Homo sapiens
auaaugaggaguuuau

SEQ ID NO: 958483 - RNA, 14 nt, Homo sapiens
auaauugucucuga

SEQ ID NO: 958484 - RNA, 20 nt, Homo sapiens
auaauuguuucauucauccu

SEQ ID NO: 958485 - RNA, 20 nt, Homo sapiens
auaauuucuagaaacaaaca

SEQ ID NO: 958486 - RNA, 19 nt, Homo sapiens
auaauuucuauuaauauca

SEQ ID NO: 958487 - RNA, 14 nt, Homo sapiens
auacaaauuccaca

SEQ ID NO: 958488 - RNA, 14 nt, Homo sapiens
auacaacacauuga

SEQ ID NO: 958489 - RNA, 22 nt, Homo sapiens
auacaccagcaauuuagacaaa

SEQ ID NO: 958490 - RNA, 12 nt, Homo sapiens
auacacuugaag

SEQ ID NO: 958491 - RNA, 16 nt, Homo sapiens
auacacuuuguugcaa

SEQ ID NO: 958492 - RNA, 15 nt, Homo sapiens
auacagaguuuuaga

SEQ ID NO: 958493 - RNA, 16 nt, Homo sapiens
auacagaucucagggc

SEQ ID NO: 958494 - RNA, 13 nt, Homo sapiens
auacaugcauaua

SEQ ID NO: 958495 - RNA, 10 nt, Homo sapiens
auaccacagc

SEQ ID NO: 958496 - RNA, 14 nt, Homo sapiens
auaccugcucuugu

SEQ ID NO: 958497 - RNA, 17 nt, Homo sapiens
auacgcucaccuuacag

SEQ ID NO: 958498 - RNA, 16 nt, Homo sapiens
auacuauugccucaua

SEQ ID NO: 958499 - RNA, 12 nt, Homo sapiens
auacuccuugcu

SEQ ID NO: 958500 - RNA, 18 nt, Homo sapiens
auacugaaggaaaaacac

SEQ ID NO: 958501 - RNA, 12 nt, Homo sapiens
auacugugcaua

SEQ ID NO: 958502 - RNA, 14 nt, Homo sapiens
auacuguucacuca

SEQ ID NO: 958503 - RNA, 15 nt, Homo sapiens
auacuguucacucac

SEQ ID NO: 958504 - RNA, 13 nt, Homo sapiens
auacuucauuaaa

SEQ ID NO: 958505 - RNA, 14 nt, Homo sapiens
auagaaauuuugua

SEQ ID NO: 958506 - RNA, 18 nt, Homo sapiens
auagacacugaucuggcu

SEQ ID NO: 958507 - RNA, 16 nt, Homo sapiens
auagacucacauuuac

SEQ ID NO: 958508 - RNA, 19 nt, Homo sapiens
auagauuucuacacugagg

SEQ ID NO: 958509 - RNA, 20 nt, Homo sapiens
auagauuucuacacugaggu

SEQ ID NO: 958510 - RNA, 19 nt, Homo sapiens
auagcgaagaccaguaugg

SEQ ID NO: 958511 - RNA, 22 nt, Homo sapiens
auagcgaagaccaguauggcaa

SEQ ID NO: 958512 - RNA, 18 nt, Homo sapiens
auagcuaauaauaccuug

SEQ ID NO: 958513 - RNA, 13 nt, Homo sapiens
auaguaucuuuaa

SEQ ID NO: 958514 - RNA, 18 nt, Homo sapiens
auagucuuaacuggucuc

SEQ ID NO: 958515 - RNA, 21 nt, Homo sapiens
auauaaaaaagccacuggaau

SEQ ID NO: 958516 - RNA, 17 nt, Homo sapiens
auauagguuugauucaa

SEQ ID NO: 958517 - RNA, 16 nt, Homo sapiens
auauauaguagcauuu

SEQ ID NO: 958518 - RNA, 14 nt, Homo sapiens
auaucaacucugaa

SEQ ID NO: 958519 - RNA, 13 nt, Homo sapiens
auaucaguaccuc

SEQ ID NO: 958520 - RNA, 17 nt, Homo sapiens
auaucaguuacaguggc

SEQ ID NO: 958521 - RNA, 17 nt, Homo sapiens
auaugaggcuugauaau

SEQ ID NO: 958522 - RNA, 16 nt, Homo sapiens
auauggacucugcaca

SEQ ID NO: 958523 - RNA, 19 nt, Homo sapiens
auauuaacgguggugaaaa

SEQ ID NO: 958524 - RNA, 17 nt, Homo sapiens
auauuacugacauuucu

SEQ ID NO: 958525 - RNA, 15 nt, Homo sapiens
auauuagaucaaaua

SEQ ID NO: 958526 - RNA, 16 nt, Homo sapiens
auauugagggagacag

SEQ ID NO: 958527 - RNA, 16 nt, Homo sapiens
auauugugauucugcc

SEQ ID NO: 958528 - RNA, 20 nt, Homo sapiens
auauuuaaaacaaagaagcu

SEQ ID NO: 958529 - RNA, 14 nt, Homo sapiens
auauuuauguagau

SEQ ID NO: 958530 - RNA, 14 nt, Homo sapiens
auauuucccauuug

SEQ ID NO: 958531 - RNA, 19 nt, Homo sapiens
auauuuuaaccugcauaaa

SEQ ID NO: 958532 - RNA, 14 nt, Homo sapiens
aucaacucuaauag

SEQ ID NO: 958533 - RNA, 14 nt, Homo sapiens
aucaagggcuuuau

SEQ ID NO: 958534 - RNA, 22 nt, Homo sapiens
aucaaggucuuuggucuucucc

SEQ ID NO: 958535 - RNA, 11 nt, Homo sapiens
aucacaaugag

SEQ ID NO: 958536 - RNA, 19 nt, Homo sapiens
aucacagucucaguucucu

SEQ ID NO: 958537 - RNA, 19 nt, Homo sapiens
aucacgcuuuccugaaucc

SEQ ID NO: 958538 - RNA, 21 nt, Homo sapiens
aucacgucacugcacuccagc

SEQ ID NO: 958539 - RNA, 22 nt, Homo sapiens
aucacgucacugcacuccagcu

SEQ ID NO: 958540 - RNA, 17 nt, Homo sapiens
aucacuacucagugcau

SEQ ID NO: 958541 - RNA, 16 nt, Homo sapiens
aucacugccacacucu

SEQ ID NO: 958542 - RNA, 21 nt, Homo sapiens
aucacugccacacucuccauc

SEQ ID NO: 958543 - RNA, 22 nt, Homo sapiens
aucacugccacacucuccauca

SEQ ID NO: 958544 - RNA, 20 nt, Homo sapiens
aucacuuucucaguuuucau

SEQ ID NO: 958545 - RNA, 17 nt, Homo sapiens
aucagaacugugccaca

SEQ ID NO: 958546 - RNA, 20 nt, Homo sapiens
aucagaagcucccagcugac

SEQ ID NO: 958547 - RNA, 13 nt, Homo sapiens
aucagaccugguu

SEQ ID NO: 958548 - RNA, 19 nt, Homo sapiens
aucagaguuccuccuacuu

SEQ ID NO: 958549 - RNA, 22 nt, Homo sapiens
aucagauguguguucucaguga

SEQ ID NO: 958550 - RNA, 15 nt, Homo sapiens
aucagcaucacccgg

SEQ ID NO: 958551 - RNA, 23 nt, Homo sapiens
aucagcauuuuagaaacuacaaa

SEQ ID NO: 958552 - RNA, 21 nt, Homo sapiens
aucagccuccgccauuccaag

SEQ ID NO: 958553 - RNA, 22 nt, Homo sapiens
aucaggucauuauuuuuuacaa

SEQ ID NO: 958554 - RNA, 18 nt, Homo sapiens
aucaggugaggugugcuc

SEQ ID NO: 958555 - RNA, 19 nt, Homo sapiens
aucaucaacaagauuuccu

SEQ ID NO: 958556 - RNA, 21 nt, Homo sapiens
aucaucaacaagauuuccuug

SEQ ID NO: 958557 - RNA, 16 nt, Homo sapiens
aucauguccauacacu

SEQ ID NO: 958558 - RNA, 19 nt, Homo sapiens
aucauguccauacacuuug

SEQ ID NO: 958559 - RNA, 14 nt, Homo sapiens
aucauuuacugugu

SEQ ID NO: 958560 - RNA, 13 nt, Homo sapiens
auccaacuccagc

SEQ ID NO: 958561 - RNA, 15 nt, Homo sapiens
auccacaagccauuu

SEQ ID NO: 958562 - RNA, 18 nt, Homo sapiens
auccaccccguugcucaa

SEQ ID NO: 958563 - RNA, 19 nt, Homo sapiens
auccaccccguugcucaag

SEQ ID NO: 958564 - RNA, 17 nt, Homo sapiens
auccaggcaccaggacu

SEQ ID NO: 958565 - RNA, 16 nt, Homo sapiens
auccagugauccuuac

SEQ ID NO: 958566 - RNA, 17 nt, Homo sapiens
auccauaacuuuagucu

SEQ ID NO: 958567 - RNA, 14 nt, Homo sapiens
auccauccauccaa

SEQ ID NO: 958568 - RNA, 20 nt, Homo sapiens
auccauuaccuccauccauc

SEQ ID NO: 958569 - RNA, 13 nt, Homo sapiens
aucccaacuuccu

SEQ ID NO: 958570 - RNA, 18 nt, Homo sapiens
aucccacaucccaguuuc

SEQ ID NO: 958571 - RNA, 17 nt, Homo sapiens
aucccagacucacccca

SEQ ID NO: 958572 - RNA, 22 nt, Homo sapiens
aucccaucgucucggccuucac

SEQ ID NO: 958573 - RNA, 15 nt, Homo sapiens
auccccaaccugcac

SEQ ID NO: 958574 - RNA, 17 nt, Homo sapiens
auccccacccagucuca

SEQ ID NO: 958575 - RNA, 22 nt, Homo sapiens
aucccgggccucagugccccau

SEQ ID NO: 958576 - RNA, 22 nt, Homo sapiens
aucccuccauucauccuuccau

SEQ ID NO: 958577 - RNA, 15 nt, Homo sapiens
auccgagugugauuu

SEQ ID NO: 958578 - RNA, 14 nt, Homo sapiens
auccuauaagcuua

SEQ ID NO: 958579 - RNA, 22 nt, Homo sapiens
auccuuacagcuaucuguagaa

SEQ ID NO: 958580 - RNA, 14 nt, Homo sapiens
auccuugcaggugg

SEQ ID NO: 958581 - RNA, 23 nt, Homo sapiens
auccuugucuuuugagcuauuca

SEQ ID NO: 958582 - RNA, 15 nt, Homo sapiens
aucgcuagacuaaga

SEQ ID NO: 958583 - RNA, 18 nt, Homo sapiens
aucuaaaguaaaaaggga

SEQ ID NO: 958584 - RNA, 20 nt, Homo sapiens
aucuaaaguaaaaagggaau

SEQ ID NO: 958585 - RNA, 23 nt, Homo sapiens
aucuaacagcccugugcagcagc

SEQ ID NO: 958586 - RNA, 13 nt, Homo sapiens
aucuacaagccaa

SEQ ID NO: 958587 - RNA, 12 nt, Homo sapiens
aucuacauucac

SEQ ID NO: 958588 - RNA, 17 nt, Homo sapiens
aucucagucauccugca

SEQ ID NO: 958589 - RNA, 17 nt, Homo sapiens
aucuccauaaacaugaa

SEQ ID NO: 958590 - RNA, 21 nt, Homo sapiens
aucucgcacuacaucugauau

SEQ ID NO: 958591 - RNA, 15 nt, Homo sapiens
aucucuaaagagcau

SEQ ID NO: 958592 - RNA, 19 nt, Homo sapiens
cacaugugacacauaugca

SEQ ID NO: 958593 - RNA, 17 nt, Homo sapiens
cacauugaaacuguauu

SEQ ID NO: 958594 - RNA, 18 nt, Homo sapiens
cacauuggaaugccuugg

SEQ ID NO: 958595 - RNA, 13 nt, Homo sapiens
cacauuguacuua

SEQ ID NO: 958596 - RNA, 21 nt, Homo sapiens
cacauugucaccccaagccau

SEQ ID NO: 958597 - RNA, 15 nt, Homo sapiens
cacauuucuaugcca

SEQ ID NO: 958598 - RNA, 17 nt, Homo sapiens
cacauuucuaugccaaa

SEQ ID NO: 958599 - RNA, 13 nt, Homo sapiens
caccaaagcugcc

SEQ ID NO: 958600 - RNA, 12 nt, Homo sapiens
caccacagcaga

SEQ ID NO: 958601 - RNA, 16 nt, Homo sapiens
caccacauugagauca

SEQ ID NO: 958602 - RNA, 14 nt, Homo sapiens
caccacggcagcuc

SEQ ID NO: 958603 - RNA, 22 nt, Homo sapiens
caccacugaaacccugcacuua

SEQ ID NO: 958604 - RNA, 23 nt, Homo sapiens
caccacuuccgucccauccuugc

SEQ ID NO: 958605 - RNA, 22 nt, Homo sapiens
caccacuuucccacacugugaa

SEQ ID NO: 958606 - RNA, 18 nt, Homo sapiens
caccaggccgugccuugu

SEQ ID NO: 958607 - RNA, 18 nt, Homo sapiens
caccaucuucuauucaaa

SEQ ID NO: 958608 - RNA, 13 nt, Homo sapiens
cacccacauguga

SEQ ID NO: 958609 - RNA, 20 nt, Homo sapiens
cacccaggcuggaguacagu

SEQ ID NO: 958610 - RNA, 12 nt, Homo sapiens
caccccaagaga

SEQ ID NO: 958611 - RNA, 18 nt, Homo sapiens
cacccugcgggccagggu

SEQ ID NO: 958612 - RNA, 20 nt, Homo sapiens
caccgagaauguuguauuca

SEQ ID NO: 958613 - RNA, 12 nt, Homo sapiens
caccgucuuucu

SEQ ID NO: 958614 - RNA, 21 nt, Homo sapiens
caccuaauguuuaugagccag

SEQ ID NO: 958615 - RNA, 22 nt, Homo sapiens
caccuaauguuuaugagccaga

SEQ ID NO: 958616 - RNA, 16 nt, Homo sapiens
caccuagaacacuaac

SEQ ID NO: 958617 - RNA, 15 nt, Homo sapiens
caccuccacccagug

SEQ ID NO: 958618 - RNA, 19 nt, Homo sapiens
caccuggcucucaccucua

SEQ ID NO: 958619 - RNA, 17 nt, Homo sapiens
caccuugugucuguaca

SEQ ID NO: 958620 - RNA, 14 nt, Homo sapiens
caccuuuuaacuca

SEQ ID NO: 958621 - RNA, 15 nt, Homo sapiens
cacgaagacaaccau

SEQ ID NO: 958622 - RNA, 12 nt, Homo sapiens
cacgaugcauuu

SEQ ID NO: 958623 - RNA, 19 nt, Homo sapiens
cacgcaccggaguucugcc

SEQ ID NO: 958624 - RNA, 14 nt, Homo sapiens
cacgcacuggguug

SEQ ID NO: 958625 - RNA, 14 nt, Homo sapiens
cacgccaacagccc

SEQ ID NO: 958626 - RNA, 13 nt, Homo sapiens
cacgcucgcugcc

SEQ ID NO: 958627 - RNA, 20 nt, Homo sapiens
cacgcugcaccuaaagccua

SEQ ID NO: 958628 - RNA, 17 nt, Homo sapiens
cacggcccguggcuguu

SEQ ID NO: 958629 - RNA, 20 nt, Homo sapiens
cacgucacugcacuccagcu

SEQ ID NO: 958630 - RNA, 22 nt, Homo sapiens
cacuaaaaaaccaacaauguga

SEQ ID NO: 958631 - RNA, 19 nt, Homo sapiens
cacuaaaguuacaaacaga

SEQ ID NO: 958632 - RNA, 21 nt, Homo sapiens
cacuagagaaaauaaauucca

SEQ ID NO: 958633 - RNA, 12 nt, Homo sapiens
cacuagcauuuu

SEQ ID NO: 958634 - RNA, 15 nt, Homo sapiens
cacuagcccaaugaa

SEQ ID NO: 958635 - RNA, 17 nt, Homo sapiens
cacuagucucaccagcc

SEQ ID NO: 958636 - RNA, 16 nt, Homo sapiens
cacuaguggcaaauga

SEQ ID NO: 958637 - RNA, 20 nt, Homo sapiens
cacuaugaagguaaagggag

SEQ ID NO: 958638 - RNA, 16 nt, Homo sapiens
cacuauucuugaauua

SEQ ID NO: 958639 - RNA, 18 nt, Homo sapiens
cacucagguggugccccu

SEQ ID NO: 958640 - RNA, 14 nt, Homo sapiens
cacuccacuggccu

SEQ ID NO: 958641 - RNA, 20 nt, Homo sapiens
cacuccgcgccgaugccacc

SEQ ID NO: 958642 - RNA, 21 nt, Homo sapiens
cacuccugcuuaaucuucaaa

SEQ ID NO: 958643 - RNA, 20 nt, Homo sapiens
cacucugaagaauccuguaa

SEQ ID NO: 958644 - RNA, 14 nt, Homo sapiens
cacucuuguaauaa

SEQ ID NO: 958645 - RNA, 14 nt, Homo sapiens
cacugccacacucu

SEQ ID NO: 958646 - RNA, 16 nt, Homo sapiens
cacuucuaaaugcaua

SEQ ID NO: 958647 - RNA, 18 nt, Homo sapiens
cacuucuaaaugcauauc

SEQ ID NO: 958648 - RNA, 13 nt, Homo sapiens
cacuuuacuuuca

SEQ ID NO: 958649 - RNA, 16 nt, Homo sapiens
cacuuuugcacauucc

SEQ ID NO: 958650 - RNA, 16 nt, Homo sapiens
cacuuuuucauaguca

SEQ ID NO: 958651 - RNA, 23 nt, Homo sapiens
cagaaacuccuaauucaaauggc

SEQ ID NO: 958652 - RNA, 12 nt, Homo sapiens
cagaaaugcugc

SEQ ID NO: 958653 - RNA, 15 nt, Homo sapiens
cagaaauggacugga

SEQ ID NO: 958654 - RNA, 21 nt, Homo sapiens
cagaacagagugcaacccagu

SEQ ID NO: 958655 - RNA, 16 nt, Homo sapiens
cagaacauauguugca

SEQ ID NO: 958656 - RNA, 18 nt, Homo sapiens
cagaaggaaccagccaug

SEQ ID NO: 958657 - RNA, 15 nt, Homo sapiens
cagaagugcccuucc

SEQ ID NO: 958658 - RNA, 14 nt, Homo sapiens
cagaaguuccucaa

SEQ ID NO: 958659 - RNA, 19 nt, Homo sapiens
cagaauguaaaauugguaa

SEQ ID NO: 958660 - RNA, 13 nt, Homo sapiens
cagaauugcucaa

SEQ ID NO: 958661 - RNA, 20 nt, Homo sapiens
cagaauuugauuuugaacuu

SEQ ID NO: 958662 - RNA, 12 nt, Homo sapiens
cagacaaaugga

SEQ ID NO: 958663 - RNA, 20 nt, Homo sapiens
cagacacuaacgaaauauca

SEQ ID NO: 958664 - RNA, 20 nt, Homo sapiens
cagacacuggcauggauaua

SEQ ID NO: 958665 - RNA, 16 nt, Homo sapiens
cagaccaguacuggga

SEQ ID NO: 958666 - RNA, 11 nt, Homo sapiens
cagacccagug

SEQ ID NO: 958667 - RNA, 19 nt, Homo sapiens
cagacccuggagagcucac

SEQ ID NO: 958668 - RNA, 21 nt, Homo sapiens
cagacuuuguguucauuucau

SEQ ID NO: 958669 - RNA, 15 nt, Homo sapiens
cagagaaccaaaggg

SEQ ID NO: 958670 - RNA, 19 nt, Homo sapiens
cagagaggcacucagugag

SEQ ID NO: 958671 - RNA, 18 nt, Homo sapiens
cagagaucccacacuacu

SEQ ID NO: 958672 - RNA, 21 nt, Homo sapiens
cagagauggucacaugaccca

SEQ ID NO: 958673 - RNA, 18 nt, Homo sapiens
cagagcagccucauccca

SEQ ID NO: 958674 - RNA, 23 nt, Homo sapiens
cagagccaugucuucucccugga

SEQ ID NO: 958675 - RNA, 16 nt, Homo sapiens
cagagcgcacagggag

SEQ ID NO: 958676 - RNA, 15 nt, Homo sapiens
cagagcgcaccucaa

SEQ ID NO: 958677 - RNA, 19 nt, Homo sapiens
cagagcuaacauaaaggac

SEQ ID NO: 958678 - RNA, 19 nt, Homo sapiens
cagagcucuuuaccaagga

SEQ ID NO: 958679 - RNA, 15 nt, Homo sapiens
cagagcugccugcuc

SEQ ID NO: 958680 - RNA, 14 nt, Homo sapiens
cagaggagugcagc

SEQ ID NO: 958681 - RNA, 23 nt, Homo sapiens
cagaggagugcagccuucuccau

SEQ ID NO: 958682 - RNA, 13 nt, Homo sapiens
cagaggauguggc

SEQ ID NO: 958683 - RNA, 22 nt, Homo sapiens
cagagggagaauccaaggguug

SEQ ID NO: 958684 - RNA, 23 nt, Homo sapiens
cagagucuaggcuaagcacuuua

SEQ ID NO: 958685 - RNA, 12 nt, Homo sapiens
cagagugcaacc

SEQ ID NO: 958686 - RNA, 21 nt, Homo sapiens
cagauagcacugggugugaga

SEQ ID NO: 958687 - RNA, 12 nt, Homo sapiens
cagaucuuucag

SEQ ID NO: 958688 - RNA, 20 nt, Homo sapiens
cagaugugagccaccgugcc

SEQ ID NO: 958689 - RNA, 22 nt, Homo sapiens
cagaugugagccaccgugccug

SEQ ID NO: 958690 - RNA, 15 nt, Homo sapiens
cagauguuugccuca

SEQ ID NO: 958691 - RNA, 20 nt, Homo sapiens
cagauucugccucucuggaa

SEQ ID NO: 958692 - RNA, 19 nt, Homo sapiens
cagcaacuucuucuccauc

SEQ ID NO: 958693 - RNA, 11 nt, Homo sapiens
cagcaaggugg

SEQ ID NO: 958694 - RNA, 17 nt, Homo sapiens
cagcacaaagacacaga

SEQ ID NO: 958695 - RNA, 20 nt, Homo sapiens
cagcacucacacccuaacuc

SEQ ID NO: 958696 - RNA, 18 nt, Homo sapiens
cagcagagaccaccacau

SEQ ID NO: 958697 - RNA, 22 nt, Homo sapiens
cagcagaugcuguugugaagcu

SEQ ID NO: 958698 - RNA, 14 nt, Homo sapiens
cagcaguaccaucu

SEQ ID NO: 958699 - RNA, 15 nt, Homo sapiens
cagcaguaccaucua

SEQ ID NO: 958700 - RNA, 18 nt, Homo sapiens
cagccagacccuggagag

SEQ ID NO: 958701 - RNA, 18 nt, Homo sapiens
cagccagagacagaggau

SEQ ID NO: 958702 - RNA, 19 nt, Homo sapiens
cagccagcucccagccaca

SEQ ID NO: 958703 - RNA, 15 nt, Homo sapiens
cagccaugccagcug

SEQ ID NO: 958704 - RNA, 15 nt, Homo sapiens
cagccccacugccag

SEQ ID NO: 958705 - RNA, 16 nt, Homo sapiens
cagcccccacuccagu

SEQ ID NO: 958706 - RNA, 19 nt, Homo sapiens
cagccccgcgaccaugugg

SEQ ID NO: 958707 - RNA, 21 nt, Homo sapiens
cauaucuaugggaaaaaucua

SEQ ID NO: 958708 - RNA, 20 nt, Homo sapiens
cauaugcccucaucauccca

SEQ ID NO: 958709 - RNA, 17 nt, Homo sapiens
cauauuuaaaacaaaga

SEQ ID NO: 958710 - RNA, 23 nt, Homo sapiens
cauauuuaacaaaauuugaauag

SEQ ID NO: 958711 - RNA, 23 nt, Homo sapiens
cauauuuccuauuguucacuuua

SEQ ID NO: 958712 - RNA, 11 nt, Homo sapiens
caucaaaaaga

SEQ ID NO: 958713 - RNA, 15 nt, Homo sapiens
caucaaaaagaacaa

SEQ ID NO: 958714 - RNA, 18 nt, Homo sapiens
caucaaagaacaaacauc

SEQ ID NO: 958715 - RNA, 11 nt, Homo sapiens
caucaagagaa

SEQ ID NO: 958716 - RNA, 14 nt, Homo sapiens
caucaaggucuuug

SEQ ID NO: 958717 - RNA, 17 nt, Homo sapiens
caucacaggcugugcca

SEQ ID NO: 958718 - RNA, 14 nt, Homo sapiens
caucaccacuguau

SEQ ID NO: 958719 - RNA, 20 nt, Homo sapiens
caucacccucuuccugugau

SEQ ID NO: 958720 - RNA, 11 nt, Homo sapiens
caucaccgcug

SEQ ID NO: 958721 - RNA, 15 nt, Homo sapiens
caucacuaguggcaa

SEQ ID NO: 958722 - RNA, 15 nt, Homo sapiens
caucaggacucugac

SEQ ID NO: 958723 - RNA, 22 nt, Homo sapiens
caucaugcggugggugcugcca

SEQ ID NO: 958724 - RNA, 21 nt, Homo sapiens
cauccacauacccugaccugg

SEQ ID NO: 958725 - RNA, 22 nt, Homo sapiens
cauccaccuucccuucuacaag

SEQ ID NO: 958726 - RNA, 17 nt, Homo sapiens
cauccagaaguuccuca

SEQ ID NO: 958727 - RNA, 14 nt, Homo sapiens
cauccaucuuucca

SEQ ID NO: 958728 - RNA, 20 nt, Homo sapiens
cauccauuaccuccauccau

SEQ ID NO: 958729 - RNA, 14 nt, Homo sapiens
caucccagugcaca

SEQ ID NO: 958730 - RNA, 22 nt, Homo sapiens
cauccccaacugcgacugugac

SEQ ID NO: 958731 - RNA, 20 nt, Homo sapiens
cauccuaugcuuaauaaaag

SEQ ID NO: 958732 - RNA, 13 nt, Homo sapiens
cauccugugccac

SEQ ID NO: 958733 - RNA, 12 nt, Homo sapiens
cauccuugaugc

SEQ ID NO: 958734 - RNA, 21 nt, Homo sapiens
caucgauuuucuauuauggaa

SEQ ID NO: 958735 - RNA, 22 nt, Homo sapiens
caucgcuuuauuggcugagaua

SEQ ID NO: 958736 - RNA, 18 nt, Homo sapiens
caucuaggagcaagguga

SEQ ID NO: 958737 - RNA, 21 nt, Homo sapiens
caucucaauaaagugcuuuaa

SEQ ID NO: 958738 - RNA, 18 nt, Homo sapiens
caucucagucauccugca

SEQ ID NO: 958739 - RNA, 19 nt, Homo sapiens
caucucccagccaagucca

SEQ ID NO: 958740 - RNA, 14 nt, Homo sapiens
caucuccuccuugc

SEQ ID NO: 958741 - RNA, 15 nt, Homo sapiens
caucucugucucaaa

SEQ ID NO: 958742 - RNA, 18 nt, Homo sapiens
caucucuuccccagagag

SEQ ID NO: 958743 - RNA, 18 nt, Homo sapiens
caucuucaggcccagcca

SEQ ID NO: 958744 - RNA, 15 nt, Homo sapiens
caucuucgggaccag

SEQ ID NO: 958745 - RNA, 16 nt, Homo sapiens
caucuuuccuguucca

SEQ ID NO: 958746 - RNA, 20 nt, Homo sapiens
caugaaaaauauugcugaac

SEQ ID NO: 958747 - RNA, 15 nt, Homo sapiens
caugaaaaugacauu

SEQ ID NO: 958748 - RNA, 14 nt, Homo sapiens
caugaaauaaaaua

SEQ ID NO: 958749 - RNA, 21 nt, Homo sapiens
caugaaauaaaauauaucuua

SEQ ID NO: 958750 - RNA, 16 nt, Homo sapiens
caugaaauucuuccua

SEQ ID NO: 958751 - RNA, 18 nt, Homo sapiens
caugaaauucuuccuaau

SEQ ID NO: 958752 - RNA, 18 nt, Homo sapiens
caugacacucuagugacu

SEQ ID NO: 958753 - RNA, 22 nt, Homo sapiens
caugaguagauaauuucagggu

SEQ ID NO: 958754 - RNA, 18 nt, Homo sapiens
caugaguuaucaugaauu

SEQ ID NO: 958755 - RNA, 15 nt, Homo sapiens
caugaucauagcuca

SEQ ID NO: 958756 - RNA, 14 nt, Homo sapiens
caugcaaaugagcu

SEQ ID NO: 958757 - RNA, 19 nt, Homo sapiens
caugcauaaauaugcagug

SEQ ID NO: 958758 - RNA, 20 nt, Homo sapiens
caugccugaggucuaccccu

SEQ ID NO: 958759 - RNA, 15 nt, Homo sapiens
caugccuggagaaac

SEQ ID NO: 958760 - RNA, 15 nt, Homo sapiens
cauggacagcaucaa

SEQ ID NO: 958761 - RNA, 13 nt, Homo sapiens
cauggacauuuag

SEQ ID NO: 958762 - RNA, 20 nt, Homo sapiens
cauggacuuucuugcaugaa

SEQ ID NO: 958763 - RNA, 14 nt, Homo sapiens
cauggccuaugcac

SEQ ID NO: 958764 - RNA, 15 nt, Homo sapiens
cauggccuaugcaca

SEQ ID NO: 958765 - RNA, 19 nt, Homo sapiens
cauggccuaugcacauaug

SEQ ID NO: 958766 - RNA, 12 nt, Homo sapiens
caugguacaaac

SEQ ID NO: 958767 - RNA, 15 nt, Homo sapiens
cauggugcacugagc

SEQ ID NO: 958768 - RNA, 15 nt, Homo sapiens
cauguaaaacaguua

SEQ ID NO: 958769 - RNA, 19 nt, Homo sapiens
cauguaacauacauauucc

SEQ ID NO: 958770 - RNA, 18 nt, Homo sapiens
cauguguaauaugcacaa

SEQ ID NO: 958771 - RNA, 13 nt, Homo sapiens
cauguguauuucc

SEQ ID NO: 958772 - RNA, 18 nt, Homo sapiens
cauuaaaucuugaacuuu

SEQ ID NO: 958773 - RNA, 19 nt, Homo sapiens
cauuaaggggaagaaugaa

SEQ ID NO: 958774 - RNA, 23 nt, Homo sapiens
cauuaaggggaagaaugaaagcu

SEQ ID NO: 958775 - RNA, 13 nt, Homo sapiens
cauuacaguucuu

SEQ ID NO: 958776 - RNA, 15 nt, Homo sapiens
cauuaccuccaucca

SEQ ID NO: 958777 - RNA, 17 nt, Homo sapiens
cauuaccuccauccauc

SEQ ID NO: 958778 - RNA, 12 nt, Homo sapiens
cauucauccuga

SEQ ID NO: 958779 - RNA, 20 nt, Homo sapiens
cauucauccuuccauccauc

SEQ ID NO: 958780 - RNA, 12 nt, Homo sapiens
cauucauugcag

SEQ ID NO: 958781 - RNA, 19 nt, Homo sapiens
cauuccuuagauaccuuga

SEQ ID NO: 958782 - RNA, 13 nt, Homo sapiens
cauucucacauaa

SEQ ID NO: 958783 - RNA, 23 nt, Homo sapiens
cauucugccgcccccuccugaac

SEQ ID NO: 958784 - RNA, 14 nt, Homo sapiens
cauugaaacuguau

SEQ ID NO: 958785 - RNA, 20 nt, Homo sapiens
cauugaagauccgaguguga

SEQ ID NO: 958786 - RNA, 17 nt, Homo sapiens
cauugauuuaauguaau

SEQ ID NO: 958787 - RNA, 21 nt, Homo sapiens
cauugccacggaaacauacag

SEQ ID NO: 958788 - RNA, 21 nt, Homo sapiens
cauugccauagcugacuacaa

SEQ ID NO: 958789 - RNA, 21 nt, Homo sapiens
cauuguccuccuuuucacuuu

SEQ ID NO: 958790 - RNA, 17 nt, Homo sapiens
cauugugcugcaccugg

SEQ ID NO: 958791 - RNA, 18 nt, Homo sapiens
cauuguggacuguaucca

SEQ ID NO: 958792 - RNA, 18 nt, Homo sapiens
cauuucuuugcauuccag

SEQ ID NO: 958793 - RNA, 17 nt, Homo sapiens
cauuugauugucauuuu

SEQ ID NO: 958794 - RNA, 14 nt, Homo sapiens
cauuugcugccauu

SEQ ID NO: 958795 - RNA, 21 nt, Homo sapiens
cauuuguagcucuggaccugu

SEQ ID NO: 958796 - RNA, 21 nt, Homo sapiens
cauuuuaaaaugcuuggguac

SEQ ID NO: 958797 - RNA, 17 nt, Homo sapiens
cauuuuauuaagcuuuu

SEQ ID NO: 958798 - RNA, 23 nt, Homo sapiens
cauuuuuagaacuccaguuuuca

SEQ ID NO: 958799 - RNA, 20 nt, Homo sapiens
cauuuuuauuaaagcauuuc

SEQ ID NO: 958800 - RNA, 16 nt, Homo sapiens
ccaaagaacaggugua

SEQ ID NO: 958801 - RNA, 19 nt, Homo sapiens
ccaaagagggcuuccucua

SEQ ID NO: 958802 - RNA, 23 nt, Homo sapiens
ccaaagucagaauugcucaaaga

SEQ ID NO: 958803 - RNA, 12 nt, Homo sapiens
ccaacaaaaaga

SEQ ID NO: 958804 - RNA, 17 nt, Homo sapiens
ccaacaaaaagaacaaa

SEQ ID NO: 958805 - RNA, 15 nt, Homo sapiens
ccaacaaugugauuu

SEQ ID NO: 958806 - RNA, 12 nt, Homo sapiens
ccaacaugguga

SEQ ID NO: 958807 - RNA, 19 nt, Homo sapiens
ccaacccuaucuccugaca

SEQ ID NO: 958808 - RNA, 17 nt, Homo sapiens
ccaagcgagagcagcug

SEQ ID NO: 958809 - RNA, 22 nt, Homo sapiens
ccaagcuaggcuuaaaccugga

SEQ ID NO: 958810 - RNA, 17 nt, Homo sapiens
ccaagggaaaggggugc

SEQ ID NO: 958811 - RNA, 20 nt, Homo sapiens
ccaaggguaugggaagccau

SEQ ID NO: 958812 - RNA, 21 nt, Homo sapiens
ccaaggguaugggaagccaua

SEQ ID NO: 958813 - RNA, 20 nt, Homo sapiens
ccaaguugcugcaaaauaca

SEQ ID NO: 958814 - RNA, 21 nt, Homo sapiens
ccaaguuguucgggccaagga

SEQ ID NO: 958815 - RNA, 18 nt, Homo sapiens
ccaauuaaaaacaugaau

SEQ ID NO: 958816 - RNA, 18 nt, Homo sapiens
ccaauugcucuuucacag

SEQ ID NO: 958817 - RNA, 22 nt, Homo sapiens
ccacaacccaagcaacauuugu

SEQ ID NO: 958818 - RNA, 15 nt, Homo sapiens
ccacaauccacgcuu

SEQ ID NO: 958819 - RNA, 15 nt, Homo sapiens
ccacacagacuccac

SEQ ID NO: 958820 - RNA, 15 nt, Homo sapiens
ccacacagugcucaa

SEQ ID NO: 958821 - RNA, 23 nt, Homo sapiens
ccacacgcugcaccuaaagccua

SEQ ID NO: 958822 - RNA, 19 nt, Homo sapiens
gcuuccucuagaagccaag

SEQ ID NO: 958823 - RNA, 15 nt, Homo sapiens
gcuucugcacuucau

SEQ ID NO: 958824 - RNA, 15 nt, Homo sapiens
gcuugaagccaaaga

SEQ ID NO: 958825 - RNA, 16 nt, Homo sapiens
gcuugaagccaaagaa

SEQ ID NO: 958826 - RNA, 15 nt, Homo sapiens
gcuugcaugcuugca

SEQ ID NO: 958827 - RNA, 22 nt, Homo sapiens
gcuuguuguuuuuaaguccugu

SEQ ID NO: 958828 - RNA, 15 nt, Homo sapiens
gcuuuacugcaugaa

SEQ ID NO: 958829 - RNA, 14 nt, Homo sapiens
gcuuucacauugua

SEQ ID NO: 958830 - RNA, 13 nt, Homo sapiens
gcuuuccaaagaa

SEQ ID NO: 958831 - RNA, 15 nt, Homo sapiens
gcuuucccacucuca

SEQ ID NO: 958832 - RNA, 16 nt, Homo sapiens
gcuuugaauacuaaau

SEQ ID NO: 958833 - RNA, 20 nt, Homo sapiens
ggaaaaaucuaaaaugugug

SEQ ID NO: 958834 - RNA, 21 nt, Homo sapiens
ggaaaagcauuuuucaauaua

SEQ ID NO: 958835 - RNA, 20 nt, Homo sapiens
ggaaaaguugaugguauuca

SEQ ID NO: 958836 - RNA, 13 nt, Homo sapiens
ggaaaauggugcc

SEQ ID NO: 958837 - RNA, 20 nt, Homo sapiens
ggaaagggagauuccaggga

SEQ ID NO: 958838 - RNA, 14 nt, Homo sapiens
ggaaagugggacag

SEQ ID NO: 958839 - RNA, 20 nt, Homo sapiens
ggaaauagaaagaagccaua

SEQ ID NO: 958840 - RNA, 15 nt, Homo sapiens
ggaaauaucugugaa

SEQ ID NO: 958841 - RNA, 11 nt, Homo sapiens
ggaaaugucac

SEQ ID NO: 958842 - RNA, 12 nt, Homo sapiens
ggaacucuggag

SEQ ID NO: 958843 - RNA, 19 nt, Homo sapiens
ggaacucuggaguucauca

SEQ ID NO: 958844 - RNA, 23 nt, Homo sapiens
ggaacugaaagaauaagaacuuu

SEQ ID NO: 958845 - RNA, 16 nt, Homo sapiens
ggaagacuccuagcug

SEQ ID NO: 958846 - RNA, 22 nt, Homo sapiens
ggaagagcccgcagggccaugc

SEQ ID NO: 958847 - RNA, 20 nt, Homo sapiens
ggaagaucagcgacugccac

SEQ ID NO: 958848 - RNA, 17 nt, Homo sapiens
ggaaggugugcucggug

SEQ ID NO: 958849 - RNA, 22 nt, Homo sapiens
ggaauaucacacucgucuuucc

SEQ ID NO: 958850 - RNA, 22 nt, Homo sapiens
ggaauccuggcagcccagagac

SEQ ID NO: 958851 - RNA, 18 nt, Homo sapiens
ggaaucuuuguaccaaaa

SEQ ID NO: 958852 - RNA, 12 nt, Homo sapiens
ggaaugccuugg

SEQ ID NO: 958853 - RNA, 20 nt, Homo sapiens
ggaauuacgugcucuguggg

SEQ ID NO: 958854 - RNA, 13 nt, Homo sapiens
ggaauucagccau

SEQ ID NO: 958855 - RNA, 17 nt, Homo sapiens
ggacaagcagcuggugc

SEQ ID NO: 958856 - RNA, 17 nt, Homo sapiens
ggacacugucagugcua

SEQ ID NO: 958857 - RNA, 14 nt, Homo sapiens
ggacccuguccaau

SEQ ID NO: 958858 - RNA, 20 nt, Homo sapiens
ggaccuuuguauuaagccaa

SEQ ID NO: 958859 - RNA, 20 nt, Homo sapiens
ggacgcacgcucgcugccau

SEQ ID NO: 958860 - RNA, 22 nt, Homo sapiens
ggacgcacgcucgcugccauca

SEQ ID NO: 958861 - RNA, 17 nt, Homo sapiens
ggacugcaaguggccau

SEQ ID NO: 958862 - RNA, 11 nt, Homo sapiens
ggacuugccuc

SEQ ID NO: 958863 - RNA, 23 nt, Homo sapiens
ggagaaaauuggaacucuacuca

SEQ ID NO: 958864 - RNA, 20 nt, Homo sapiens
ggagaagagcgcaguguuuu

SEQ ID NO: 958865 - RNA, 22 nt, Homo sapiens
ggagaaucgcuugaacccagga

SEQ ID NO: 958866 - RNA, 15 nt, Homo sapiens
ggagagcagcuggcu

SEQ ID NO: 958867 - RNA, 23 nt, Homo sapiens
ggagagcaugcuaucccacggga

SEQ ID NO: 958868 - RNA, 13 nt, Homo sapiens
ggagagcccaguc

SEQ ID NO: 958869 - RNA, 21 nt, Homo sapiens
ggagauauuuuccaacagcuu

SEQ ID NO: 958870 - RNA, 21 nt, Homo sapiens
ggagccaguggggaagugcgu

SEQ ID NO: 958871 - RNA, 15 nt, Homo sapiens
ggaggaugaugccag

SEQ ID NO: 958872 - RNA, 19 nt, Homo sapiens
ggaggcccugcacugccag

SEQ ID NO: 958873 - RNA, 20 nt, Homo sapiens
ggaggcggagguugcaauga

SEQ ID NO: 958874 - RNA, 11 nt, Homo sapiens
ggaggcuuccu

SEQ ID NO: 958875 - RNA, 15 nt, Homo sapiens
ggaggguguggugcu

SEQ ID NO: 958876 - RNA, 14 nt, Homo sapiens
ggaggugcugcucu

SEQ ID NO: 958877 - RNA, 15 nt, Homo sapiens
ggagguugaagccaa

SEQ ID NO: 958878 - RNA, 15 nt, Homo sapiens
ggagugaggaccugu

SEQ ID NO: 958879 - RNA, 13 nt, Homo sapiens
ggaguuacuggau

SEQ ID NO: 958880 - RNA, 13 nt, Homo sapiens
ggauacuggcaca

SEQ ID NO: 958881 - RNA, 16 nt, Homo sapiens
ggauagacgaguugau

SEQ ID NO: 958882 - RNA, 21 nt, Homo sapiens
ggaucagccuccgccauucca

SEQ ID NO: 958883 - RNA, 21 nt, Homo sapiens
ggauggaaagacaaacugcac

SEQ ID NO: 958884 - RNA, 22 nt, Homo sapiens
ggauggaaagacaaacugcaca

SEQ ID NO: 958885 - RNA, 22 nt, Homo sapiens
ggauguuuggaaaaaacucuga

SEQ ID NO: 958886 - RNA, 16 nt, Homo sapiens
ggauuauuuaauaaca

SEQ ID NO: 958887 - RNA, 21 nt, Homo sapiens
ggauuuuaacuuaacugaaau

SEQ ID NO: 958888 - RNA, 15 nt, Homo sapiens
ggcaagagaauugaa

SEQ ID NO: 958889 - RNA, 22 nt, Homo sapiens
ggcaaugcccugugcaugccau

SEQ ID NO: 958890 - RNA, 21 nt, Homo sapiens
ggcacggcccguggcuguuga

SEQ ID NO: 958891 - RNA, 17 nt, Homo sapiens
ggcagagggagaaucca

SEQ ID NO: 958892 - RNA, 14 nt, Homo sapiens
ggcagauugaaaag

SEQ ID NO: 958893 - RNA, 14 nt, Homo sapiens
ggcagcggugggcu

SEQ ID NO: 958894 - RNA, 22 nt, Homo sapiens
ggcagcugcuauccccaucucc

SEQ ID NO: 958895 - RNA, 22 nt, Homo sapiens
ggcaggaaucuauccauugaac

SEQ ID NO: 958896 - RNA, 20 nt, Homo sapiens
ggcaggagaaucucuugaac

SEQ ID NO: 958897 - RNA, 18 nt, Homo sapiens
ggcaggcugggccauguc

SEQ ID NO: 958898 - RNA, 18 nt, Homo sapiens
ggcauaugguccuagaca

SEQ ID NO: 958899 - RNA, 22 nt, Homo sapiens
ggccaacauggugaaacccugu

SEQ ID NO: 958900 - RNA, 23 nt, Homo sapiens
ggccaacauggugaaacccuguc

SEQ ID NO: 958901 - RNA, 15 nt, Homo sapiens
ggccaagccuaucaa

SEQ ID NO: 958902 - RNA, 19 nt, Homo sapiens
ggccaagccuaucaaagga

SEQ ID NO: 958903 - RNA, 17 nt, Homo sapiens
ggccacauagaugcuga

SEQ ID NO: 958904 - RNA, 22 nt, Homo sapiens
ggccagagagggcgugggcgcu

SEQ ID NO: 958905 - RNA, 19 nt, Homo sapiens
ggccauaaacgguuccugg

SEQ ID NO: 958906 - RNA, 14 nt, Homo sapiens
ggccauguccaaag

SEQ ID NO: 958907 - RNA, 15 nt, Homo sapiens
ggccauguccaaaga

SEQ ID NO: 958908 - RNA, 16 nt, Homo sapiens
ggccauguccaaagag

SEQ ID NO: 958909 - RNA, 16 nt, Homo sapiens
ggccauuaccaucucu

SEQ ID NO: 958910 - RNA, 23 nt, Homo sapiens
ggccauuucaccagucacugcca

SEQ ID NO: 958911 - RNA, 16 nt, Homo sapiens
ggcccuggccagaagc

SEQ ID NO: 958912 - RNA, 17 nt, Homo sapiens
ggccuaugcacauaugg

SEQ ID NO: 958913 - RNA, 17 nt, Homo sapiens
ggccuccugggggaccu

SEQ ID NO: 958914 - RNA, 16 nt, Homo sapiens
ggccucucucaaaaga

SEQ ID NO: 958915 - RNA, 15 nt, Homo sapiens
ggccuggccagucaa

SEQ ID NO: 958916 - RNA, 16 nt, Homo sapiens
ggcgucccuuccaacc

SEQ ID NO: 958917 - RNA, 19 nt, Homo sapiens
ggcuaugcgggggugccua

SEQ ID NO: 958918 - RNA, 17 nt, Homo sapiens
ggcucacgccuguaauu

SEQ ID NO: 958919 - RNA, 16 nt, Homo sapiens
ggcuccagccaucuca

SEQ ID NO: 958920 - RNA, 21 nt, Homo sapiens
ggcucccuccuggagcauccc

SEQ ID NO: 958921 - RNA, 15 nt, Homo sapiens
ggcucuaucuuccuc

SEQ ID NO: 958922 - RNA, 13 nt, Homo sapiens
ggcucugaugaaa

SEQ ID NO: 958923 - RNA, 21 nt, Homo sapiens
ggcucugugcagucacuggag

SEQ ID NO: 958924 - RNA, 13 nt, Homo sapiens
ggcugauuuacua

SEQ ID NO: 958925 - RNA, 22 nt, Homo sapiens
ggcugccggcacggcccguggc

SEQ ID NO: 958926 - RNA, 20 nt, Homo sapiens
ggcuggagugcaguggcgcg

SEQ ID NO: 958927 - RNA, 21 nt, Homo sapiens
ggcugggaagacuauggugcu

SEQ ID NO: 958928 - RNA, 18 nt, Homo sapiens
ggcuucacuguauaaaua

SEQ ID NO: 958929 - RNA, 19 nt, Homo sapiens
ggcuuccucuagaagccaa

SEQ ID NO: 958930 - RNA, 13 nt, Homo sapiens
ggcuucugugaug

SEQ ID NO: 958931 - RNA, 15 nt, Homo sapiens
ggcuuggcagccagu

SEQ ID NO: 958932 - RNA, 20 nt, Homo sapiens
ggcuuuaauagucaccuuca

SEQ ID NO: 958933 - RNA, 20 nt, Homo sapiens
ggcuuuacaguguaaacugu

SEQ ID NO: 958934 - RNA, 22 nt, Homo sapiens
ggcuuuccuucuguauucauaa

SEQ ID NO: 958935 - RNA, 17 nt, Homo sapiens
gggaagacuauggugcu

SEQ ID NO: 958936 - RNA, 19 nt, Homo sapiens
uaaaauauuguugaacacu

SEQ ID NO: 958937 - RNA, 17 nt, Homo sapiens
uaaaaucaagucuauaa

SEQ ID NO: 958938 - RNA, 18 nt, Homo sapiens
uaaaaugauaaacaaguc

SEQ ID NO: 958939 - RNA, 22 nt, Homo sapiens
uaaaauucaagugagaaguaaa

SEQ ID NO: 958940 - RNA, 17 nt, Homo sapiens
uaaaauuccuaucucau

SEQ ID NO: 958941 - RNA, 20 nt, Homo sapiens
uaaaauuccucuuacuguaa

SEQ ID NO: 958942 - RNA, 22 nt, Homo sapiens
uaaacacauguucugugccugc

SEQ ID NO: 958943 - RNA, 18 nt, Homo sapiens
uaaacaguuuuuggcaaa

SEQ ID NO: 958944 - RNA, 19 nt, Homo sapiens
uaaaccaaggacugagcac

SEQ ID NO: 958945 - RNA, 13 nt, Homo sapiens
uaaaccaccaucu

SEQ ID NO: 958946 - RNA, 15 nt, Homo sapiens
uaaacgggaacaugc

SEQ ID NO: 958947 - RNA, 16 nt, Homo sapiens
uaaacgguuccuggug

SEQ ID NO: 958948 - RNA, 17 nt, Homo sapiens
uaaacgguuccugguga

SEQ ID NO: 958949 - RNA, 18 nt, Homo sapiens
uaaacgguuccuggugac

SEQ ID NO: 958950 - RNA, 18 nt, Homo sapiens
uaaacuauuagaguauuu

SEQ ID NO: 958951 - RNA, 15 nt, Homo sapiens
uaaacucagaucuga

SEQ ID NO: 958952 - RNA, 11 nt, Homo sapiens
uaaacugugua

SEQ ID NO: 958953 - RNA, 12 nt, Homo sapiens
uaaacuguguau

SEQ ID NO: 958954 - RNA, 14 nt, Homo sapiens
uaaacuuguuugcu

SEQ ID NO: 958955 - RNA, 14 nt, Homo sapiens
uaaagaaugccauu

SEQ ID NO: 958956 - RNA, 21 nt, Homo sapiens
uaaagacugguuuucugccaa

SEQ ID NO: 958957 - RNA, 20 nt, Homo sapiens
uaaagagagaauguagauau

SEQ ID NO: 958958 - RNA, 23 nt, Homo sapiens
uaaagagucuggccuggacccug

SEQ ID NO: 958959 - RNA, 13 nt, Homo sapiens
uaaagcuacugua

SEQ ID NO: 958960 - RNA, 20 nt, Homo sapiens
uaaaguaaauacaugcauau

SEQ ID NO: 958961 - RNA, 16 nt, Homo sapiens
uaaauaaaccacugug

SEQ ID NO: 958962 - RNA, 17 nt, Homo sapiens
uaaauaggaaucauuca

SEQ ID NO: 958963 - RNA, 17 nt, Homo sapiens
uaaauccauccauccaa

SEQ ID NO: 958964 - RNA, 17 nt, Homo sapiens
uaaaugaaacuuggcca

SEQ ID NO: 958965 - RNA, 22 nt, Homo sapiens
uaaaugcuucauuuguauguca

SEQ ID NO: 958966 - RNA, 21 nt, Homo sapiens
uaaauguagcgacugucaaca

SEQ ID NO: 958967 - RNA, 23 nt, Homo sapiens
uaaaugucuucauguugaugugu

SEQ ID NO: 958968 - RNA, 11 nt, Homo sapiens
uaaaugugaca

SEQ ID NO: 958969 - RNA, 16 nt, Homo sapiens
uaaauucaacuuugua

SEQ ID NO: 958970 - RNA, 15 nt, Homo sapiens
uaaauucaugcacuu

SEQ ID NO: 958971 - RNA, 18 nt, Homo sapiens
uaaauuuaaaaaucaaua

SEQ ID NO: 958972 - RNA, 17 nt, Homo sapiens
uaacaagaccucagugc

SEQ ID NO: 958973 - RNA, 19 nt, Homo sapiens
uaacagaaaaaugaaauuu

SEQ ID NO: 958974 - RNA, 22 nt, Homo sapiens
uaacagauggaaaaacugaggc

SEQ ID NO: 958975 - RNA, 19 nt, Homo sapiens
uaacauaaaggacaggcca

SEQ ID NO: 958976 - RNA, 14 nt, Homo sapiens
uaacauagauuuaa

SEQ ID NO: 958977 - RNA, 22 nt, Homo sapiens
uaacaugaaaaacacggcagcu

SEQ ID NO: 958978 - RNA, 20 nt, Homo sapiens
uaacaugaggcccauucuuc

SEQ ID NO: 958979 - RNA, 19 nt, Homo sapiens
uaaccaauccuacuaauaa

SEQ ID NO: 958980 - RNA, 16 nt, Homo sapiens
uaaccauucuacugug

SEQ ID NO: 958981 - RNA, 19 nt, Homo sapiens
uaacccaagacaugacauu

SEQ ID NO: 958982 - RNA, 23 nt, Homo sapiens
uaacucaccagccccacugccag

SEQ ID NO: 958983 - RNA, 15 nt, Homo sapiens
uaacucagacauucc

SEQ ID NO: 958984 - RNA, 16 nt, Homo sapiens
uaacucagacauucca

SEQ ID NO: 958985 - RNA, 13 nt, Homo sapiens
uaacuugcugcuu

SEQ ID NO: 958986 - RNA, 23 nt, Homo sapiens
uaagaaauuccauacuucucuca

SEQ ID NO: 958987 - RNA, 14 nt, Homo sapiens
uaagaauaguagau

SEQ ID NO: 958988 - RNA, 19 nt, Homo sapiens
uaagauauucagaaguaua

SEQ ID NO: 958989 - RNA, 17 nt, Homo sapiens
uaagauuucucuaauau

SEQ ID NO: 958990 - RNA, 15 nt, Homo sapiens
uaagcaaauguuaaa

SEQ ID NO: 958991 - RNA, 15 nt, Homo sapiens
uaagcaagagacaau

SEQ ID NO: 958992 - RNA, 18 nt, Homo sapiens
uaagcagaaagucuucau

SEQ ID NO: 958993 - RNA, 14 nt, Homo sapiens
uaagcagaggaaua

SEQ ID NO: 958994 - RNA, 14 nt, Homo sapiens
uaagcccucaggag

SEQ ID NO: 958995 - RNA, 23 nt, Homo sapiens
uaaggcauguggccuuuaucuca

SEQ ID NO: 958996 - RNA, 16 nt, Homo sapiens
uaaggcuuaggugcca

SEQ ID NO: 958997 - RNA, 23 nt, Homo sapiens
uaaguauuauauaaacugugcca

SEQ ID NO: 958998 - RNA, 23 nt, Homo sapiens
uaaguauuuagaagugugaauuc

SEQ ID NO: 958999 - RNA, 14 nt, Homo sapiens
uaagucucucaggc

SEQ ID NO: 959000 - RNA, 22 nt, Homo sapiens
uaaguggcuuuuuaacaugaaa

SEQ ID NO: 959001 - RNA, 13 nt, Homo sapiens
uaaguguucucau

SEQ ID NO: 959002 - RNA, 15 nt, Homo sapiens
uaaguguucucauga

SEQ ID NO: 959003 - RNA, 15 nt, Homo sapiens
uaaguuaaacaguca

SEQ ID NO: 959004 - RNA, 16 nt, Homo sapiens
uaaguuaucuuugaau

SEQ ID NO: 959005 - RNA, 22 nt, Homo sapiens
uaauaaagaugaguugguucuc

SEQ ID NO: 959006 - RNA, 17 nt, Homo sapiens
uaauaagauggcugugg

SEQ ID NO: 959007 - RNA, 11 nt, Homo sapiens
uaauaagcaau

SEQ ID NO: 959008 - RNA, 18 nt, Homo sapiens
uaauagagauaaguccau

SEQ ID NO: 959009 - RNA, 17 nt, Homo sapiens
uaauagcuacagugcau

SEQ ID NO: 959010 - RNA, 15 nt, Homo sapiens
uaaucaucaaaaaga

SEQ ID NO: 959011 - RNA, 23 nt, Homo sapiens
uaaucuguuuauuuacaagggaa

SEQ ID NO: 959012 - RNA, 18 nt, Homo sapiens
uaaucuucugccuucuca

SEQ ID NO: 959013 - RNA, 21 nt, Homo sapiens
uaaugaaguagaaguuacuua

SEQ ID NO: 959014 - RNA, 19 nt, Homo sapiens
uaaugaaguuaagaaccug

SEQ ID NO: 959015 - RNA, 14 nt, Homo sapiens
uaaugacaagugac

SEQ ID NO: 959016 - RNA, 15 nt, Homo sapiens
uaaugagacaugaau

SEQ ID NO: 959017 - RNA, 20 nt, Homo sapiens
uaaugcuuuucccacucuca

SEQ ID NO: 959018 - RNA, 20 nt, Homo sapiens
uaaugcuuuucuaauuaaua

SEQ ID NO: 959019 - RNA, 18 nt, Homo sapiens
uaauggaugguugaauua

SEQ ID NO: 959020 - RNA, 21 nt, Homo sapiens
uaauggcccuguagcucugaa

SEQ ID NO: 959021 - RNA, 18 nt, Homo sapiens
uaauuaagaaaacuauua

SEQ ID NO: 959022 - RNA, 17 nt, Homo sapiens
uaauuaccaguuuucca

SEQ ID NO: 959023 - RNA, 19 nt, Homo sapiens
uaauuaccaguuuuccaga

SEQ ID NO: 959024 - RNA, 13 nt, Homo sapiens
uaauuauugcacu

SEQ ID NO: 959025 - RNA, 15 nt, Homo sapiens
uaauuggaagugcag

SEQ ID NO: 959026 - RNA, 18 nt, Homo sapiens
uaauuggccaugucgcca

SEQ ID NO: 959027 - RNA, 12 nt, Homo sapiens
uaauugucugua

SEQ ID NO: 959028 - RNA, 19 nt, Homo sapiens
uaauuguuuaaaaugccuc

SEQ ID NO: 959029 - RNA, 14 nt, Homo sapiens
uaauuuuguuguuu

SEQ ID NO: 959030 - RNA, 11 nt, Homo sapiens
uacaaacucau

SEQ ID NO: 959031 - RNA, 22 nt, Homo sapiens
uacaacacauugaaacuguauu

SEQ ID NO: 959032 - RNA, 21 nt, Homo sapiens
uacaaguaauauuauuacuuu

SEQ ID NO: 959033 - RNA, 16 nt, Homo sapiens
uacaagucagcuccag

SEQ ID NO: 959034 - RNA, 19 nt, Homo sapiens
uacaagucagcuccagcuu

SEQ ID NO: 959035 - RNA, 17 nt, Homo sapiens
uacaaugaucaccgacu

SEQ ID NO: 959036 - RNA, 18 nt, Homo sapiens
uacacagaaaugcugcug

SEQ ID NO: 959037 - RNA, 21 nt, Homo sapiens
uacaccagcaauuuagacaaa

SEQ ID NO: 959038 - RNA, 15 nt, Homo sapiens
uacacguguccugua

SEQ ID NO: 959039 - RNA, 18 nt, Homo sapiens
uacacuaaaguuacaaac

SEQ ID NO: 959040 - RNA, 18 nt, Homo sapiens
uacacugauacacuugaa

SEQ ID NO: 959041 - RNA, 14 nt, Homo sapiens
uacacuuuguugca

SEQ ID NO: 959042 - RNA, 13 nt, Homo sapiens
uacagaacacauu

SEQ ID NO: 959043 - RNA, 18 nt, Homo sapiens
uacagacaaagcauaauc

SEQ ID NO: 959044 - RNA, 16 nt, Homo sapiens
uacagcaacaauuuau

SEQ ID NO: 959045 - RNA, 18 nt, Homo sapiens
uacagcuaagcuuccacu

SEQ ID NO: 959046 - RNA, 19 nt, Homo sapiens
uacaggaaauuucuuagga

SEQ ID NO: 959047 - RNA, 14 nt, Homo sapiens
uacagggcuaggca

SEQ ID NO: 959048 - RNA, 13 nt, Homo sapiens
uacagucauucca

SEQ ID NO: 959049 - RNA, 14 nt, Homo sapiens
uacagucauuccaa

SEQ ID NO: 959050 - RNA, 22 nt, Homo sapiens
uacauaacugaaaaugugcuau

SEQ ID NO: 959051 - RNA, 21 nt, Homo sapiens
ucugagcccccacugcuucua

SEQ ID NO: 959052 - RNA, 20 nt, Homo sapiens
ucugaguaagcccucaggag

SEQ ID NO: 959053 - RNA, 14 nt, Homo sapiens
ucugcacaccuacu

SEQ ID NO: 959054 - RNA, 18 nt, Homo sapiens
ucugcagggagcaacucu

SEQ ID NO: 959055 - RNA, 20 nt, Homo sapiens
ucugcagggagcaacucucc

SEQ ID NO: 959056 - RNA, 19 nt, Homo sapiens
ucugcaguccuacucaagc

SEQ ID NO: 959057 - RNA, 16 nt, Homo sapiens
ucugccccagcccaga

SEQ ID NO: 959058 - RNA, 15 nt, Homo sapiens
ucugccuucucagga

SEQ ID NO: 959059 - RNA, 21 nt, Homo sapiens
ucugcugaaucaaaucucuuc

SEQ ID NO: 959060 - RNA, 14 nt, Homo sapiens
ucugcuuacaaaga

SEQ ID NO: 959061 - RNA, 23 nt, Homo sapiens
ucuggaacauggacuuucuugca

SEQ ID NO: 959062 - RNA, 21 nt, Homo sapiens
ucuggagaccguccuggagcu

SEQ ID NO: 959063 - RNA, 15 nt, Homo sapiens
ucuggauucugaauc

SEQ ID NO: 959064 - RNA, 17 nt, Homo sapiens
ucuggauucugaaucuc

SEQ ID NO: 959065 - RNA, 19 nt, Homo sapiens
ucuggcaggaaucuaucca

SEQ ID NO: 959066 - RNA, 20 nt, Homo sapiens
ucuggcaucuuagaccucca

SEQ ID NO: 959067 - RNA, 16 nt, Homo sapiens
ucuggcccuugcuuac

SEQ ID NO: 959068 - RNA, 16 nt, Homo sapiens
ucugggcugggcaccu

SEQ ID NO: 959069 - RNA, 21 nt, Homo sapiens
ucugggguccauucucugagu

SEQ ID NO: 959070 - RNA, 17 nt, Homo sapiens
ucuguaaguguagcuca

SEQ ID NO: 959071 - RNA, 14 nt, Homo sapiens
ucugucaaucacag

SEQ ID NO: 959072 - RNA, 17 nt, Homo sapiens
ucugucaaucacagucu

SEQ ID NO: 959073 - RNA, 16 nt, Homo sapiens
ucugugcagucacugg

SEQ ID NO: 959074 - RNA, 23 nt, Homo sapiens
ucuguggaugaugugauuguccu

SEQ ID NO: 959075 - RNA, 18 nt, Homo sapiens
ucuguuaugcugugacac

SEQ ID NO: 959076 - RNA, 18 nt, Homo sapiens
ucuuaaagacaucuuaau

SEQ ID NO: 959077 - RNA, 18 nt, Homo sapiens
ucuuaauguacacauugc

SEQ ID NO: 959078 - RNA, 19 nt, Homo sapiens
ucuuaguaugugcauuuaa

SEQ ID NO: 959079 - RNA, 16 nt, Homo sapiens
ucuuaucucagucaug

SEQ ID NO: 959080 - RNA, 15 nt, Homo sapiens
ucuuauuuucucaau

SEQ ID NO: 959081 - RNA, 12 nt, Homo sapiens
ucuucaagagcu

SEQ ID NO: 959082 - RNA, 22 nt, Homo sapiens
ucuucaaggaggcccacugugu

SEQ ID NO: 959083 - RNA, 22 nt, Homo sapiens
ucuucacuucuaaaugcauauc

SEQ ID NO: 959084 - RNA, 13 nt, Homo sapiens
ucuucacuugguu

SEQ ID NO: 959085 - RNA, 13 nt, Homo sapiens
ucuucagccauag

SEQ ID NO: 959086 - RNA, 14 nt, Homo sapiens
ucuuccuccaccuc

SEQ ID NO: 959087 - RNA, 19 nt, Homo sapiens
ucuuccucccugggggccc

SEQ ID NO: 959088 - RNA, 19 nt, Homo sapiens
ucuuccucuagacuuggag

SEQ ID NO: 959089 - RNA, 13 nt, Homo sapiens
ucuuccugcaaag

SEQ ID NO: 959090 - RNA, 19 nt, Homo sapiens
ucuucucauucccaugugg

SEQ ID NO: 959091 - RNA, 14 nt, Homo sapiens
ucuucuuacaugca

SEQ ID NO: 959092 - RNA, 18 nt, Homo sapiens
ucuugaucggaaagcucu

SEQ ID NO: 959093 - RNA, 22 nt, Homo sapiens
ucuugcuguaacucagacauuc

SEQ ID NO: 959094 - RNA, 22 nt, Homo sapiens
ucuuggaaaaaaaccacagcca

SEQ ID NO: 959095 - RNA, 15 nt, Homo sapiens
ucuuguucuacugag

SEQ ID NO: 959096 - RNA, 15 nt, Homo sapiens
ucuuuaaccuuguau

SEQ ID NO: 959097 - RNA, 13 nt, Homo sapiens
ucuuuaugaucug

SEQ ID NO: 959098 - RNA, 18 nt, Homo sapiens
ucuuuauguccauaagcu

SEQ ID NO: 959099 - RNA, 19 nt, Homo sapiens
ucuuucagaaagcuuugaa

SEQ ID NO: 959100 - RNA, 16 nt, Homo sapiens
ucuuugcaacugucuc

SEQ ID NO: 959101 - RNA, 24 nt, Homo sapiens
ucuuugcucaacagaacauauguu

SEQ ID NO: 959102 - RNA, 19 nt, Homo sapiens
ucuuuuucagagcuucuca

SEQ ID NO: 959103 - RNA, 16 nt, Homo sapiens
ugaaaagaugguauca

SEQ ID NO: 959104 - RNA, 23 nt, Homo sapiens
ugaaaauuuauuuuuagugauaa

SEQ ID NO: 959105 - RNA, 15 nt, Homo sapiens
ugaaaccccgucucu

SEQ ID NO: 959106 - RNA, 20 nt, Homo sapiens
ugaaacuauuuuaccugaac

SEQ ID NO: 959107 - RNA, 16 nt, Homo sapiens
ugaaagagaguaccau

SEQ ID NO: 959108 - RNA, 18 nt, Homo sapiens
ugaaauaacuaccuucca

SEQ ID NO: 959109 - RNA, 14 nt, Homo sapiens
ugaaauaaguaaau

SEQ ID NO: 959110 - RNA, 15 nt, Homo sapiens
ugaaauuaagcauuu

SEQ ID NO: 959111 - RNA, 17 nt, Homo sapiens
ugaaauucacaguaaua

SEQ ID NO: 959112 - RNA, 20 nt, Homo sapiens
ugaaauuuuagaaauauuca

SEQ ID NO: 959113 - RNA, 14 nt, Homo sapiens
ugaacacagugucu

SEQ ID NO: 959114 - RNA, 11 nt, Homo sapiens
ugaacauacac

SEQ ID NO: 959115 - RNA, 17 nt, Homo sapiens
ugaacauguucuccauu

SEQ ID NO: 959116 - RNA, 23 nt, Homo sapiens
ugaacauuuugcaaaacuuauca

SEQ ID NO: 959117 - RNA, 13 nt, Homo sapiens
ugaaccaagcuau

SEQ ID NO: 959118 - RNA, 19 nt, Homo sapiens
ugaaccagaggguguggcu

SEQ ID NO: 959119 - RNA, 22 nt, Homo sapiens
ugaagaacuggaaccccagcuu

SEQ ID NO: 959120 - RNA, 18 nt, Homo sapiens
ugaagagggagaagcaug

SEQ ID NO: 959121 - RNA, 14 nt, Homo sapiens
ugaagaguuucaca

SEQ ID NO: 959122 - RNA, 17 nt, Homo sapiens
ugaagcugcacaguguu

SEQ ID NO: 959123 - RNA, 16 nt, Homo sapiens
ugaaggcaucaaauaa

SEQ ID NO: 959124 - RNA, 17 nt, Homo sapiens
ugaaggcaucaaauaaa

SEQ ID NO: 959125 - RNA, 14 nt, Homo sapiens
ugaagugaaucuga

SEQ ID NO: 959126 - RNA, 21 nt, Homo sapiens
ugaauacauuaacggugcuaa

SEQ ID NO: 959127 - RNA, 21 nt, Homo sapiens
ugaauauuuguuauguagaua

SEQ ID NO: 959128 - RNA, 14 nt, Homo sapiens
ugaaucuacauuca

SEQ ID NO: 959129 - RNA, 15 nt, Homo sapiens
ugaaucuacauucac

SEQ ID NO: 959130 - RNA, 12 nt, Homo sapiens
ugaaugcuuccu

SEQ ID NO: 959131 - RNA, 18 nt, Homo sapiens
ugaauuauugacacugaa

SEQ ID NO: 959132 - RNA, 13 nt, Homo sapiens
ugaauucaccgug

SEQ ID NO: 959133 - RNA, 14 nt, Homo sapiens
ugaauucauguugg

SEQ ID NO: 959134 - RNA, 22 nt, Homo sapiens
ugaauucggaacuguccuuucc

SEQ ID NO: 959135 - RNA, 19 nt, Homo sapiens
ugaauuuuuaagcugcaaa

SEQ ID NO: 959136 - RNA, 19 nt, Homo sapiens
ugacaaauaagauuaauaa

SEQ ID NO: 959137 - RNA, 13 nt, Homo sapiens
ugacaagugccuu

SEQ ID NO: 959138 - RNA, 16 nt, Homo sapiens
ugacaaucaacucuaa

SEQ ID NO: 959139 - RNA, 21 nt, Homo sapiens
ugacacacaaaucccauuaaa

SEQ ID NO: 959140 - RNA, 15 nt, Homo sapiens
ugacacauaugcacc

SEQ ID NO: 959141 - RNA, 18 nt, Homo sapiens
ugacacuuuaauuaccaa

SEQ ID NO: 959142 - RNA, 18 nt, Homo sapiens
ugacagaagcuucugccc

SEQ ID NO: 959143 - RNA, 14 nt, Homo sapiens
ugacagugccucuu

SEQ ID NO: 959144 - RNA, 21 nt, Homo sapiens
ugaccccauuccugaucccau

SEQ ID NO: 959145 - RNA, 16 nt, Homo sapiens
ugacuuggaguuuuau

SEQ ID NO: 959146 - RNA, 22 nt, Homo sapiens
ugagaaacauuauuagcacuuc

SEQ ID NO: 959147 - RNA, 15 nt, Homo sapiens
ugagaaauggccaaa

SEQ ID NO: 959148 - RNA, 17 nt, Homo sapiens
ugagaaauggccaaaua

SEQ ID NO: 959149 - RNA, 21 nt, Homo sapiens
ugagaacucguucaccuccaa

SEQ ID NO: 959150 - RNA, 14 nt, Homo sapiens
ugagaagccuucag

SEQ ID NO: 959151 - RNA, 12 nt, Homo sapiens
ugagacaggccc

SEQ ID NO: 959152 - RNA, 15 nt, Homo sapiens
ugagaccucaaugaa

SEQ ID NO: 959153 - RNA, 17 nt, Homo sapiens
ugagacuacuuaagaua

SEQ ID NO: 959154 - RNA, 22 nt, Homo sapiens
ugagaugcaggauuucuucaca

SEQ ID NO: 959155 - RNA, 22 nt, Homo sapiens
ugagauggguguacaaacucau

SEQ ID NO: 959156 - RNA, 14 nt, Homo sapiens
ugagaugucuucaa

SEQ ID NO: 959157 - RNA, 14 nt, Homo sapiens
ugagccuugugcau

SEQ ID NO: 959158 - RNA, 23 nt, Homo sapiens
ugagcuagagauaaaacagaauc

SEQ ID NO: 959159 - RNA, 16 nt, Homo sapiens
ugagcugagugcugaa

SEQ ID NO: 959160 - RNA, 22 nt, Homo sapiens
ugagcugcaacuucuuacuucc

SEQ ID NO: 959161 - RNA, 20 nt, Homo sapiens
ugagcugcucauuacaguuc

SEQ ID NO: 959162 - RNA, 21 nt, Homo sapiens
ugagcuggccucucuagcaca

SEQ ID NO: 959163 - RNA, 14 nt, Homo sapiens
ugaggaggagacag

SEQ ID NO: 959164 - RNA, 20 nt, Homo sapiens
ugaggcagauagcacugggu

SEQ ID NO: 959165 - RNA, 17 nt, Homo sapiens
ugaggccuagacucugu

SEQ ID NO: 959166 - RNA, 17 nt, Homo sapiens
uuccuuuaugugaauuu

SEQ ID NO: 959167 - RNA, 15 nt, Homo sapiens
uucggcuaugucuca

SEQ ID NO: 959168 - RNA, 16 nt, Homo sapiens
uucuaaucacaguguu

SEQ ID NO: 959169 - RNA, 15 nt, Homo sapiens
uucuacaguguccua

SEQ ID NO: 959170 - RNA, 13 nt, Homo sapiens
uucuaccugcccu

SEQ ID NO: 959171 - RNA, 13 nt, Homo sapiens
uucuacguuucuu

SEQ ID NO: 959172 - RNA, 21 nt, Homo sapiens
uucuacucaggcugguggaga

SEQ ID NO: 959173 - RNA, 18 nt, Homo sapiens
uucuaggcccauuguccu

SEQ ID NO: 959174 - RNA, 15 nt, Homo sapiens
uucuauuuugugaau

SEQ ID NO: 959175 - RNA, 17 nt, Homo sapiens
uucucagugaaauaacu

SEQ ID NO: 959176 - RNA, 15 nt, Homo sapiens
uucucauucccaugu

SEQ ID NO: 959177 - RNA, 20 nt, Homo sapiens
uucuccaggacaaccugcug

SEQ ID NO: 959178 - RNA, 15 nt, Homo sapiens
uucuccaucaugccc

SEQ ID NO: 959179 - RNA, 23 nt, Homo sapiens
uucuccucccuguuaucugcuag

SEQ ID NO: 959180 - RNA, 15 nt, Homo sapiens
uucucugaucuccau

SEQ ID NO: 959181 - RNA, 23 nt, Homo sapiens
uucucuguuguuugguucaggga

SEQ ID NO: 959182 - RNA, 18 nt, Homo sapiens
uucugaggugcacuggga

SEQ ID NO: 959183 - RNA, 21 nt, Homo sapiens
uucugucagggguuucuucaa

SEQ ID NO: 959184 - RNA, 21 nt, Homo sapiens
uucuuaaccauucuacugugu

SEQ ID NO: 959185 - RNA, 21 nt, Homo sapiens
uucuuaagugcccacauuuga

SEQ ID NO: 959186 - RNA, 14 nt, Homo sapiens
uucuuacaugcauu

SEQ ID NO: 959187 - RNA, 19 nt, Homo sapiens
uucuuacuucccuaaugaa

SEQ ID NO: 959188 - RNA, 17 nt, Homo sapiens
uucuuauuuuuguacuu

SEQ ID NO: 959189 - RNA, 18 nt, Homo sapiens
uucuucaacaugcuccaa

SEQ ID NO: 959190 - RNA, 16 nt, Homo sapiens
uucuugaaccaauaau

SEQ ID NO: 959191 - RNA, 16 nt, Homo sapiens
uucuuguacucuacaa

SEQ ID NO: 959192 - RNA, 22 nt, Homo sapiens
uucuuucgguuuucuuugucag

SEQ ID NO: 959193 - RNA, 19 nt, Homo sapiens
uucuuuuauacugacacaa

SEQ ID NO: 959194 - RNA, 13 nt, Homo sapiens
uucuuuuauguga

SEQ ID NO: 959195 - RNA, 21 nt, Homo sapiens
uugaaaaagggaagccauucc

SEQ ID NO: 959196 - RNA, 14 nt, Homo sapiens
uugaaaagcuauua

SEQ ID NO: 959197 - RNA, 16 nt, Homo sapiens
uugaaacuguauuuac

SEQ ID NO: 959198 - RNA, 19 nt, Homo sapiens
uugaaagagucugggaccc

SEQ ID NO: 959199 - RNA, 13 nt, Homo sapiens
uugaaccaauaau

SEQ ID NO: 959200 - RNA, 18 nt, Homo sapiens
uugaacuaggcugagcaa

SEQ ID NO: 959201 - RNA, 19 nt, Homo sapiens
uugaacuuuaagaagcagu

SEQ ID NO: 959202 - RNA, 14 nt, Homo sapiens
uugaagccaaagaa

SEQ ID NO: 959203 - RNA, 20 nt, Homo sapiens
uugaagggcaagaaauggcg

SEQ ID NO: 959204 - RNA, 14 nt, Homo sapiens
uugaagucuucuaa

SEQ ID NO: 959205 - RNA, 13 nt, Homo sapiens
uugaauagucuca

SEQ ID NO: 959206 - RNA, 16 nt, Homo sapiens
uugaaucuacauucac

SEQ ID NO: 959207 - RNA, 15 nt, Homo sapiens
uugacgcaccugugg

SEQ ID NO: 959208 - RNA, 15 nt, Homo sapiens
uugacugacugagca

SEQ ID NO: 959209 - RNA, 17 nt, Homo sapiens
uugacugccuaugccaa

SEQ ID NO: 959210 - RNA, 20 nt, Homo sapiens
uugacuuagaauaaugaagg

SEQ ID NO: 959211 - RNA, 19 nt, Homo sapiens
uugacuuuuauaaagcaug

SEQ ID NO: 959212 - RNA, 14 nt, Homo sapiens
uugagagacacugg

SEQ ID NO: 959213 - RNA, 16 nt, Homo sapiens
uugagaucacuacuca

SEQ ID NO: 959214 - RNA, 20 nt, Homo sapiens
uugagaucacuacucagugc

SEQ ID NO: 959215 - RNA, 12 nt, Homo sapiens
uugagggccaaa

SEQ ID NO: 959216 - RNA, 18 nt, Homo sapiens
uugagugacagcuuucug

SEQ ID NO: 959217 - RNA, 17 nt, Homo sapiens
uugauagauuucuacac

SEQ ID NO: 959218 - RNA, 22 nt, Homo sapiens
uugaugccuuuuuuuucaugac

SEQ ID NO: 959219 - RNA, 23 nt, Homo sapiens
uugaugccuuuuuuuucaugaca

SEQ ID NO: 959220 - RNA, 21 nt, Homo sapiens
uugauuuuauuuuuucucugu

SEQ ID NO: 959221 - RNA, 18 nt, Homo sapiens
uugcaaagagacauuuca

SEQ ID NO: 959222 - RNA, 14 nt, Homo sapiens
uugcaacagacugu

SEQ ID NO: 959223 - RNA, 13 nt, Homo sapiens
uugcaagugcugg

SEQ ID NO: 959224 - RNA, 12 nt, Homo sapiens
uugcaccacugc

SEQ ID NO: 959225 - RNA, 18 nt, Homo sapiens
uugcacugaggauauuca

SEQ ID NO: 959226 - RNA, 14 nt, Homo sapiens
uugcaugcuugcau

SEQ ID NO: 959227 - RNA, 21 nt, Homo sapiens
uugcauuuugauaaaauuaau

SEQ ID NO: 959228 - RNA, 23 nt, Homo sapiens
uugcccccagauacauggugaug

SEQ ID NO: 959229 - RNA, 20 nt, Homo sapiens
uugcccgaaacuaagccagg

SEQ ID NO: 959230 - RNA, 16 nt, Homo sapiens
uugcgggacagaguag

SEQ ID NO: 959231 - RNA, 16 nt, Homo sapiens
uugcuccgccuggccu

SEQ ID NO: 959232 - RNA, 12 nt, Homo sapiens
uugcugcacuuu

SEQ ID NO: 959233 - RNA, 21 nt, Homo sapiens
uugcugcauugauccaggaga

SEQ ID NO: 959234 - RNA, 17 nt, Homo sapiens
uugcugugcguggaaug

SEQ ID NO: 959235 - RNA, 15 nt, Homo sapiens
uugcuuuuaauucca

SEQ ID NO: 959236 - RNA, 20 nt, Homo sapiens
uugcuuuugacuccaggaac

SEQ ID NO: 959237 - RNA, 21 nt, Homo sapiens
uuggaaauagaaagaagccau

SEQ ID NO: 959238 - RNA, 21 nt, Homo sapiens
uuggaacauacuguucacuca

SEQ ID NO: 959239 - RNA, 13 nt, Homo sapiens
uuggaagucauuu

SEQ ID NO: 959240 - RNA, 20 nt, Homo sapiens
uuggacacuuaguuauuuac

SEQ ID NO: 959241 - RNA, 18 nt, Homo sapiens
uuggacuguaagggauug

SEQ ID NO: 959242 - RNA, 13 nt, Homo sapiens
uuggaggugcugc

SEQ ID NO: 959243 - RNA, 17 nt, Homo sapiens
uuggcuuaaaccagaac

SEQ ID NO: 959244 - RNA, 24 nt, Homo sapiens
uuggcuucugugaugagcugaucu

SEQ ID NO: 959245 - RNA, 20 nt, Homo sapiens
uugguaaaacucacugugau

SEQ ID NO: 959246 - RNA, 18 nt, Homo sapiens
uugguuugcaaccucuuu

SEQ ID NO: 959247 - RNA, 18 nt, Homo sapiens
uugguuuuccuguggcau

SEQ ID NO: 959248 - RNA, 16 nt, Homo sapiens
uuguaaagcccuugca

SEQ ID NO: 959249 - RNA, 14 nt, Homo sapiens
uuguaacucuauga

SEQ ID NO: 959250 - RNA, 14 nt, Homo sapiens
uuguaauaagcaau

SEQ ID NO: 959251 - RNA, 20 nt, Homo sapiens
uuguauaggggcaacuguau

SEQ ID NO: 959252 - RNA, 17 nt, Homo sapiens
uugucaccccaagccau

SEQ ID NO: 959253 - RNA, 18 nt, Homo sapiens
uugucaccccaagccaua

SEQ ID NO: 959254 - RNA, 16 nt, Homo sapiens
uugucauagacuccuu

SEQ ID NO: 959255 - RNA, 20 nt, Homo sapiens
uugugacagagccauggugu

SEQ ID NO: 959256 - RNA, 17 nt, Homo sapiens
uugugagaaacaucuca

SEQ ID NO: 959257 - RNA, 15 nt, Homo sapiens
uugugagccagcagc

SEQ ID NO: 959258 - RNA, 18 nt, Homo sapiens
uugugcaaaauauuugac

SEQ ID NO: 959259 - RNA, 19 nt, Homo sapiens
uugugguaacuugcugcuu

SEQ ID NO: 959260 - RNA, 15 nt, Homo sapiens
uugugucuguacacg

SEQ ID NO: 959261 - RNA, 13 nt, Homo sapiens
uuguguucucaaa

SEQ ID NO: 959262 - RNA, 19 nt, Homo sapiens
uuguuaugcaucauuucag

SEQ ID NO: 959263 - RNA, 23 nt, Homo sapiens
uuguucacacacacucugaagaa

SEQ ID NO: 959264 - RNA, 14 nt, Homo sapiens
uuguucuacugaga

SEQ ID NO: 959265 - RNA, 16 nt, Homo sapiens
uuguuucugcauucau

SEQ ID NO: 959266 - RNA, 12 nt, Homo sapiens
uuguuuugugaa

SEQ ID NO: 959267 - RNA, 13 nt, Homo sapiens
uuuaaaaacucac

SEQ ID NO: 959268 - RNA, 19 nt, Homo sapiens
uuuaaauguaacuugcugu

SEQ ID NO: 959269 - RNA, 23 nt, Homo sapiens
uuuaacacccuuuagaaccuuaa

SEQ ID NO: 959270 - RNA, 17 nt, Homo sapiens
uuuaagauuuuucucaa

SEQ ID NO: 959271 - RNA, 14 nt, Homo sapiens
uuuaauaccagaua

SEQ ID NO: 959272 - RNA, 17 nt, Homo sapiens
uuuaauuuuaaugcugu

SEQ ID NO: 959273 - RNA, 19 nt, Homo sapiens
uuuaccuguauacagugca

SEQ ID NO: 959274 - RNA, 22 nt, Homo sapiens
uuuaccuuucagugcaguuucu

SEQ ID NO: 959275 - RNA, 23 nt, Homo sapiens
uuuacguuugauacaacauuaag

SEQ ID NO: 959276 - RNA, 18 nt, Homo sapiens
uuuacucagaaccugcuc

SEQ ID NO: 959277 - RNA, 23 nt, Homo sapiens
uuuacuugcccugaacauacaca

SEQ ID NO: 959278 - RNA, 17 nt, Homo sapiens
uuuacuuuuaaacugug

SEQ ID NO: 959279 - RNA, 16 nt, Homo sapiens
uuuagaagugugaauu

SEQ ID NO: 959280 - RNA, 14 nt, Homo sapiens
uuuagaucucugaa

SEQ ID NO: 959281 - RNA, 19 nt, Homo sapiens
guaaauagcuaagauauaa

SEQ ID NO: 959282 - RNA, 16 nt, Homo sapiens
guaacauacauauucc

SEQ ID NO: 959283 - RNA, 20 nt, Homo sapiens
guaacccuuuggaauggaga

SEQ ID NO: 959284 - RNA, 21 nt, Homo sapiens
guaagacccuuauugcugucc

SEQ ID NO: 959285 - RNA, 20 nt, Homo sapiens
guaaggcaggcccauucaga

SEQ ID NO: 959286 - RNA, 22 nt, Homo sapiens
guaaggucuucuuguguccuga

SEQ ID NO: 959287 - RNA, 19 nt, Homo sapiens
guaaguuucaggugacaug

SEQ ID NO: 959288 - RNA, 19 nt, Homo sapiens
guaauaauaaaaccaaaga

SEQ ID NO: 959289 - RNA, 18 nt, Homo sapiens
guaauuccagcuacucag

SEQ ID NO: 959290 - RNA, 18 nt, Homo sapiens
guaauuuuucuaagcaua

SEQ ID NO: 959291 - RNA, 11 nt, Homo sapiens
guacaauaaua

SEQ ID NO: 959292 - RNA, 12 nt, Homo sapiens
guacacaacaau

SEQ ID NO: 959293 - RNA, 14 nt, Homo sapiens
guacaccucuugcc

SEQ ID NO: 959294 - RNA, 21 nt, Homo sapiens
guacaguauguuuuacaugua

SEQ ID NO: 959295 - RNA, 21 nt, Homo sapiens
guacaguucugggguacaugu

SEQ ID NO: 959296 - RNA, 17 nt, Homo sapiens
guacucuuuaacauaca

SEQ ID NO: 959297 - RNA, 17 nt, Homo sapiens
guacugugucucaugga

SEQ ID NO: 959298 - RNA, 19 nt, Homo sapiens
guacuguuuuccaguucau

SEQ ID NO: 959299 - RNA, 23 nt, Homo sapiens
guacuuugcugaaugucauuuua

SEQ ID NO: 959300 - RNA, 16 nt, Homo sapiens
guagaaaagaacugga

SEQ ID NO: 959301 - RNA, 20 nt, Homo sapiens
guagcgagcugcucugcuau

SEQ ID NO: 959302 - RNA, 19 nt, Homo sapiens
guagugucacugcuuguua

SEQ ID NO: 959303 - RNA, 22 nt, Homo sapiens
guaguugcaaagagacauuuca

SEQ ID NO: 959304 - RNA, 19 nt, Homo sapiens
guauaaacaguuuuuggca

SEQ ID NO: 959305 - RNA, 16 nt, Homo sapiens
guauaaauuuuuaccu

SEQ ID NO: 959306 - RNA, 15 nt, Homo sapiens
guauaauagagauaa

SEQ ID NO: 959307 - RNA, 23 nt, Homo sapiens
guauauuugauugaauaaugcca

SEQ ID NO: 959308 - RNA, 18 nt, Homo sapiens
guaucauguauggugaua

SEQ ID NO: 959309 - RNA, 15 nt, Homo sapiens
guaugggaagccaua

SEQ ID NO: 959310 - RNA, 19 nt, Homo sapiens
guaugucuuggacacugua

SEQ ID NO: 959311 - RNA, 15 nt, Homo sapiens
guauguguaccuaag

SEQ ID NO: 959312 - RNA, 20 nt, Homo sapiens
guauuccaugagcugcucau

SEQ ID NO: 959313 - RNA, 16 nt, Homo sapiens
guauuuuuaaaggcau

SEQ ID NO: 959314 - RNA, 15 nt, Homo sapiens
gucaagcuggugcua

SEQ ID NO: 959315 - RNA, 16 nt, Homo sapiens
gucaaucacagucuca

SEQ ID NO: 959316 - RNA, 15 nt, Homo sapiens
gucaaugaccauuca

SEQ ID NO: 959317 - RNA, 17 nt, Homo sapiens
gucacauggccuaugca

SEQ ID NO: 959318 - RNA, 18 nt, Homo sapiens
gucacauggccuaugcac

SEQ ID NO: 959319 - RNA, 18 nt, Homo sapiens
gucagaccaguacuggga

SEQ ID NO: 959320 - RNA, 23 nt, Homo sapiens
gucagacuuuguguucauuucau

SEQ ID NO: 959321 - RNA, 13 nt, Homo sapiens
gucagagcuaaac

SEQ ID NO: 959322 - RNA, 18 nt, Homo sapiens
gucagcagaugcuguugu

SEQ ID NO: 959323 - RNA, 21 nt, Homo sapiens
gucagcuacuaaugauguuuu

SEQ ID NO: 959324 - RNA, 14 nt, Homo sapiens
gucagcugcucccu

SEQ ID NO: 959325 - RNA, 13 nt, Homo sapiens
gucaguguucuua

SEQ ID NO: 959326 - RNA, 17 nt, Homo sapiens
gucaucccagugcacau

SEQ ID NO: 959327 - RNA, 20 nt, Homo sapiens
guccaaccagaaacaccccu

SEQ ID NO: 959328 - RNA, 16 nt, Homo sapiens
gucccaaccccagugg

SEQ ID NO: 959329 - RNA, 18 nt, Homo sapiens
gucccauccccacauccc

SEQ ID NO: 959330 - RNA, 23 nt, Homo sapiens
guccccauacuccuaugaucuga

SEQ ID NO: 959331 - RNA, 15 nt, Homo sapiens
gucccgguaccuucc

SEQ ID NO: 959332 - RNA, 16 nt, Homo sapiens
guccuccuuuucacuu

SEQ ID NO: 959333 - RNA, 15 nt, Homo sapiens
guccuggugucucca

SEQ ID NO: 959334 - RNA, 18 nt, Homo sapiens
guccuuuuucacuuugaa

SEQ ID NO: 959335 - RNA, 11 nt, Homo sapiens
gucuagucaag

SEQ ID NO: 959336 - RNA, 19 nt, Homo sapiens
gucuauauuuuaaccugca

SEQ ID NO: 959337 - RNA, 18 nt, Homo sapiens
gucuccagucaucuguaa

SEQ ID NO: 959338 - RNA, 15 nt, Homo sapiens
gucugccccacccuc

SEQ ID NO: 959339 - RNA, 18 nt, Homo sapiens
gucugcuuugguacuaau

SEQ ID NO: 959340 - RNA, 18 nt, Homo sapiens
gucugggcugggcaccug

SEQ ID NO: 959341 - RNA, 19 nt, Homo sapiens
gucugggugcuacugggga

SEQ ID NO: 959342 - RNA, 15 nt, Homo sapiens
gucuguacacguguc

SEQ ID NO: 959343 - RNA, 20 nt, Homo sapiens
cagcacgaguggccaguuca

SEQ ID NO: 959344 - RNA, 14 nt, Homo sapiens
cagcaguuguucca

SEQ ID NO: 959345 - RNA, 19 nt, Homo sapiens
cagcauuuuagaaacuaca

SEQ ID NO: 959346 - RNA, 17 nt, Homo sapiens
cagcccaaucugccaga

SEQ ID NO: 959347 - RNA, 15 nt, Homo sapiens
cagcccccacuccag

SEQ ID NO: 959348 - RNA, 16 nt, Homo sapiens
cagcccugcucauucc

SEQ ID NO: 959349 - RNA, 22 nt, Homo sapiens
cagccuccuuuguguguauuca

SEQ ID NO: 959350 - RNA, 19 nt, Homo sapiens
cagccuggggaacagagca

SEQ ID NO: 959351 - RNA, 15 nt, Homo sapiens
cagccuuagcucucc

SEQ ID NO: 959352 - RNA, 22 nt, Homo sapiens
cagcgaccucaaguguccugaa

SEQ ID NO: 959353 - RNA, 13 nt, Homo sapiens
cagcgacugccac

SEQ ID NO: 959354 - RNA, 13 nt, Homo sapiens
cagcuccagugcc

SEQ ID NO: 959355 - RNA, 15 nt, Homo sapiens
cagcuccagugccag

SEQ ID NO: 959356 - RNA, 16 nt, Homo sapiens
cagcuccagugccagc

SEQ ID NO: 959357 - RNA, 17 nt, Homo sapiens
cagcuccagugccagca

SEQ ID NO: 959358 - RNA, 23 nt, Homo sapiens
cagcucccugaggaccaccuccu

SEQ ID NO: 959359 - RNA, 17 nt, Homo sapiens
cagcucuccaccagcug

SEQ ID NO: 959360 - RNA, 23 nt, Homo sapiens
cagcucuccgccaauuucucuca

SEQ ID NO: 959361 - RNA, 22 nt, Homo sapiens
cagcucuuuauuacauagcucu

SEQ ID NO: 959362 - RNA, 14 nt, Homo sapiens
cagcuggugcucca

SEQ ID NO: 959363 - RNA, 13 nt, Homo sapiens
cagcuucagguua

SEQ ID NO: 959364 - RNA, 18 nt, Homo sapiens
cagcuuccuguuacugag

SEQ ID NO: 959365 - RNA, 13 nt, Homo sapiens
cagcuuucuggga

SEQ ID NO: 959366 - RNA, 21 nt, Homo sapiens
caggaaagcuggugucugauu

SEQ ID NO: 959367 - RNA, 19 nt, Homo sapiens
caggaaauaaauuguaaaa

SEQ ID NO: 959368 - RNA, 17 nt, Homo sapiens
caggaacaaacagggcu

SEQ ID NO: 959369 - RNA, 15 nt, Homo sapiens
caggaagccagagcc

SEQ ID NO: 959370 - RNA, 21 nt, Homo sapiens
caggaauaggcauuugccuaa

SEQ ID NO: 959371 - RNA, 12 nt, Homo sapiens
caggaccacaga

SEQ ID NO: 959372 - RNA, 22 nt, Homo sapiens
caggacuguuuuauaaacugcu

SEQ ID NO: 959373 - RNA, 13 nt, Homo sapiens
caggagaaucgcu

SEQ ID NO: 959374 - RNA, 22 nt, Homo sapiens
caggagugugaggaggagacag

SEQ ID NO: 959375 - RNA, 18 nt, Homo sapiens
caggaguuacuggauuug

SEQ ID NO: 959376 - RNA, 19 nt, Homo sapiens
caggaguucaauaaauguc

SEQ ID NO: 959377 - RNA, 22 nt, Homo sapiens
caggauacuggcacagagguag

SEQ ID NO: 959378 - RNA, 20 nt, Homo sapiens
caggcacacacagccccuau

SEQ ID NO: 959379 - RNA, 15 nt, Homo sapiens
caggccaaagugccg

SEQ ID NO: 959380 - RNA, 19 nt, Homo sapiens
caggccacccaaaggagcu

SEQ ID NO: 959381 - RNA, 16 nt, Homo sapiens
caggccucaccauucc

SEQ ID NO: 959382 - RNA, 18 nt, Homo sapiens
caggcucucgcacaccuc

SEQ ID NO: 959383 - RNA, 23 nt, Homo sapiens
caggcugcccgccgccccuccac

SEQ ID NO: 959384 - RNA, 17 nt, Homo sapiens
caggcugggccaugucc

SEQ ID NO: 959385 - RNA, 22 nt, Homo sapiens
cagggacacacagccuagcaca

SEQ ID NO: 959386 - RNA, 15 nt, Homo sapiens
cagggaguccagggu

SEQ ID NO: 959387 - RNA, 22 nt, Homo sapiens
cagggaguccaggguuucucug

SEQ ID NO: 959388 - RNA, 19 nt, Homo sapiens
cagggagugcacauaucca

SEQ ID NO: 959389 - RNA, 13 nt, Homo sapiens
cagggcacuacau

SEQ ID NO: 959390 - RNA, 14 nt, Homo sapiens
cagggcacuacaua

SEQ ID NO: 959391 - RNA, 20 nt, Homo sapiens
cagggcuggcuccugaucca

SEQ ID NO: 959392 - RNA, 20 nt, Homo sapiens
cagggcugggccagugcauc

SEQ ID NO: 959393 - RNA, 21 nt, Homo sapiens
cagggucugggcugggcaccu

SEQ ID NO: 959394 - RNA, 15 nt, Homo sapiens
caggguucucuuagc

SEQ ID NO: 959395 - RNA, 13 nt, Homo sapiens
cagguaguacugg

SEQ ID NO: 959396 - RNA, 16 nt, Homo sapiens
cagguaguacugggaa

SEQ ID NO: 959397 - RNA, 16 nt, Homo sapiens
caguaaaauacuauug

SEQ ID NO: 959398 - RNA, 22 nt, Homo sapiens
caguaaagcacuugcaaccguc

SEQ ID NO: 959399 - RNA, 12 nt, Homo sapiens
caguacauuuaa

SEQ ID NO: 959400 - RNA, 16 nt, Homo sapiens
caguaccuagcuggcu

SEQ ID NO: 959401 - RNA, 18 nt, Homo sapiens
caguagaacugucuguga

SEQ ID NO: 959402 - RNA, 16 nt, Homo sapiens
caguaucccacaucca

SEQ ID NO: 959403 - RNA, 17 nt, Homo sapiens
caguaucccacauccaa

SEQ ID NO: 959404 - RNA, 18 nt, Homo sapiens
caguaucccacauccaac

SEQ ID NO: 959405 - RNA, 22 nt, Homo sapiens
caguauggcaaaauuagucuug

SEQ ID NO: 959406 - RNA, 18 nt, Homo sapiens
cagucaccucacaaaccu

SEQ ID NO: 959407 - RNA, 22 nt, Homo sapiens
cagucaguuugcacaacaagau

SEQ ID NO: 959408 - RNA, 19 nt, Homo sapiens
cagucauccugcaggcaca

SEQ ID NO: 959409 - RNA, 16 nt, Homo sapiens
cagucauuccaagaac

SEQ ID NO: 959410 - RNA, 11 nt, Homo sapiens
cagucuucagc

SEQ ID NO: 959411 - RNA, 18 nt, Homo sapiens
cagugaaauaacuaccuu

SEQ ID NO: 959412 - RNA, 13 nt, Homo sapiens
cagugcaguuucu

SEQ ID NO: 959413 - RNA, 21 nt, Homo sapiens
cagugcauagcgaagaccagu

SEQ ID NO: 959414 - RNA, 23 nt, Homo sapiens
cagugccaggccagugaccucau

SEQ ID NO: 959415 - RNA, 23 nt, Homo sapiens
cagugccccagggaguccagggu

SEQ ID NO: 959416 - RNA, 13 nt, Homo sapiens
cagugcccuaggc

SEQ ID NO: 959417 - RNA, 13 nt, Homo sapiens
caguggauucuca

SEQ ID NO: 959418 - RNA, 14 nt, Homo sapiens
caguggauucucau

SEQ ID NO: 959419 - RNA, 13 nt, Homo sapiens
cagugugcuccag

SEQ ID NO: 959420 - RNA, 16 nt, Homo sapiens
caguguuuccacacuu

SEQ ID NO: 959421 - RNA, 23 nt, Homo sapiens
caguuacaguggcaguauugaca

SEQ ID NO: 959422 - RNA, 14 nt, Homo sapiens
caguucaagacuua

SEQ ID NO: 959423 - RNA, 13 nt, Homo sapiens
caguucuaaccuc

SEQ ID NO: 959424 - RNA, 15 nt, Homo sapiens
caguucuaaccuccu

SEQ ID NO: 959425 - RNA, 14 nt, Homo sapiens
caguucucccaucc

SEQ ID NO: 959426 - RNA, 20 nt, Homo sapiens
caguucugagcaccguguca

SEQ ID NO: 959427 - RNA, 14 nt, Homo sapiens
caguugcugugaac

SEQ ID NO: 959428 - RNA, 14 nt, Homo sapiens
caguuuuaccucuu

SEQ ID NO: 959429 - RNA, 20 nt, Homo sapiens
caguuuuaccucuucucucu

SEQ ID NO: 959430 - RNA, 13 nt, Homo sapiens
auuuuguaacuuu

SEQ ID NO: 959431 - RNA, 22 nt, Homo sapiens
auuuuuauaauucagaagacua

SEQ ID NO: 959432 - RNA, 19 nt, Homo sapiens
auuuuuaucuauccuaugu

SEQ ID NO: 959433 - RNA, 14 nt, Homo sapiens
auuuuuccacuuaa

SEQ ID NO: 959434 - RNA, 19 nt, Homo sapiens
auuuuuggugggaauccaa

SEQ ID NO: 959435 - RNA, 18 nt, Homo sapiens
auuuuuugucugugauaa

SEQ ID NO: 959436 - RNA, 19 nt, Homo sapiens
caaaaaacaacacagucua

SEQ ID NO: 959437 - RNA, 14 nt, Homo sapiens
caaaaacagaauuu

SEQ ID NO: 959438 - RNA, 13 nt, Homo sapiens
caaaaaccaaaug

SEQ ID NO: 959439 - RNA, 22 nt, Homo sapiens
caaaaaucuguguaacuguaaa

SEQ ID NO: 959440 - RNA, 20 nt, Homo sapiens
caaaaauguguaagaacaac

SEQ ID NO: 959441 - RNA, 20 nt, Homo sapiens
caaaacucacuaaguuuacu

SEQ ID NO: 959442 - RNA, 12 nt, Homo sapiens
caaaaucucuac

SEQ ID NO: 959443 - RNA, 21 nt, Homo sapiens
caaaauuaagcaaauguuaaa

SEQ ID NO: 959444 - RNA, 17 nt, Homo sapiens
caaacaaguaugaaucu

SEQ ID NO: 959445 - RNA, 19 nt, Homo sapiens
caaacacucaguccacugu

SEQ ID NO: 959446 - RNA, 23 nt, Homo sapiens
caaacaugcggugccaugaaggg

SEQ ID NO: 959447 - RNA, 11 nt, Homo sapiens
caaaccucaua

SEQ ID NO: 959448 - RNA, 13 nt, Homo sapiens
caaacgcugaaaa

SEQ ID NO: 959449 - RNA, 17 nt, Homo sapiens
caaacguacaagucagu

SEQ ID NO: 959450 - RNA, 19 nt, Homo sapiens
caaacucuucccucucuca

SEQ ID NO: 959451 - RNA, 18 nt, Homo sapiens
caaacuuuguuugucaca

SEQ ID NO: 959452 - RNA, 22 nt, Homo sapiens
caaagaaaaugaaaugcauauu

SEQ ID NO: 959453 - RNA, 22 nt, Homo sapiens
caaagaacaaacauccuugcaa

SEQ ID NO: 959454 - RNA, 14 nt, Homo sapiens
caaagacuguaaau

SEQ ID NO: 959455 - RNA, 14 nt, Homo sapiens
caaagcaucccucu

SEQ ID NO: 959456 - RNA, 18 nt, Homo sapiens
caaagccucaauuacuaa

SEQ ID NO: 959457 - RNA, 19 nt, Homo sapiens
caaagcuuuggcugagacc

SEQ ID NO: 959458 - RNA, 20 nt, Homo sapiens
caaaggaaguccaaccugag

SEQ ID NO: 959459 - RNA, 14 nt, Homo sapiens
caaaguacucuuua

SEQ ID NO: 959460 - RNA, 17 nt, Homo sapiens
caaaguacuugucauag

SEQ ID NO: 959461 - RNA, 17 nt, Homo sapiens
caaagucguuucaacuc

SEQ ID NO: 959462 - RNA, 17 nt, Homo sapiens
caaauaaaauaaaugaa

SEQ ID NO: 959463 - RNA, 15 nt, Homo sapiens
caaauauaagacauu

SEQ ID NO: 959464 - RNA, 20 nt, Homo sapiens
caaaucucuuccacaugggu

SEQ ID NO: 959465 - RNA, 17 nt, Homo sapiens
caaaucugauggccuua

SEQ ID NO: 959466 - RNA, 22 nt, Homo sapiens
caaaugaccuuccaaguaagca

SEQ ID NO: 959467 - RNA, 16 nt, Homo sapiens
caaauucauggugcac

SEQ ID NO: 959468 - RNA, 22 nt, Homo sapiens
caacaauuauuugaagauuuaa

SEQ ID NO: 959469 - RNA, 18 nt, Homo sapiens
caacacggagcagggaga

SEQ ID NO: 959470 - RNA, 15 nt, Homo sapiens
caacagacuguugag

SEQ ID NO: 959471 - RNA, 15 nt, Homo sapiens
caacaugcuccaaau

SEQ ID NO: 959472 - RNA, 18 nt, Homo sapiens
caacauggugaaacccug

SEQ ID NO: 959473 - RNA, 12 nt, Homo sapiens
caaccccagugg

SEQ ID NO: 959474 - RNA, 16 nt, Homo sapiens
caaccuguuaccuacu

SEQ ID NO: 959475 - RNA, 18 nt, Homo sapiens
caacugucucucuucuca

SEQ ID NO: 959476 - RNA, 15 nt, Homo sapiens
caagaaaaacaacuu

SEQ ID NO: 959477 - RNA, 13 nt, Homo sapiens
caagaacacugga

SEQ ID NO: 959478 - RNA, 12 nt, Homo sapiens
caagacugagcc

SEQ ID NO: 959479 - RNA, 21 nt, Homo sapiens
caagagaacucgcgcucagua

SEQ ID NO: 959480 - RNA, 20 nt, Homo sapiens
caagagaugggaaugaggug

SEQ ID NO: 959481 - RNA, 13 nt, Homo sapiens
caagagcugagaa

SEQ ID NO: 959482 - RNA, 23 nt, Homo sapiens
caagaguucuaaauacaggaaau

SEQ ID NO: 959483 - RNA, 21 nt, Homo sapiens
caagaugugaauuauugacac

SEQ ID NO: 959484 - RNA, 17 nt, Homo sapiens
caagauugcaccacugc

SEQ ID NO: 959485 - RNA, 16 nt, Homo sapiens
caagcagcuggugcuc

SEQ ID NO: 959486 - RNA, 18 nt, Homo sapiens
caagcaggugaacuggga

SEQ ID NO: 959487 - RNA, 16 nt, Homo sapiens
caagccaggaccugcu

SEQ ID NO: 959488 - RNA, 18 nt, Homo sapiens
caagccgggaaugagcuu

SEQ ID NO: 959489 - RNA, 19 nt, Homo sapiens
caaggacguggaugacccu

SEQ ID NO: 959490 - RNA, 16 nt, Homo sapiens
caaggacuccauugga

SEQ ID NO: 959491 - RNA, 13 nt, Homo sapiens
caaggacucuucc

SEQ ID NO: 959492 - RNA, 16 nt, Homo sapiens
caaggaguguaaaaug

SEQ ID NO: 959493 - RNA, 17 nt, Homo sapiens
caagugaggagugccag

SEQ ID NO: 959494 - RNA, 12 nt, Homo sapiens
caaguguucacu

SEQ ID NO: 959495 - RNA, 18 nt, Homo sapiens
caaguugcuuuuaccuga

SEQ ID NO: 959496 - RNA, 22 nt, Homo sapiens
caauaaaaacaacuuucacuuc

SEQ ID NO: 959497 - RNA, 18 nt, Homo sapiens
caauaaagcacugagcaa

SEQ ID NO: 959498 - RNA, 12 nt, Homo sapiens
caauaaauuaca

SEQ ID NO: 959499 - RNA, 20 nt, Homo sapiens
caauaaccgcuugguuugca

SEQ ID NO: 959500 - RNA, 15 nt, Homo sapiens
caauaagaaacaguu

SEQ ID NO: 959501 - RNA, 16 nt, Homo sapiens
caauaauaaauccuca

SEQ ID NO: 959502 - RNA, 21 nt, Homo sapiens
caauacccuuuuaaguuuaaa

SEQ ID NO: 959503 - RNA, 20 nt, Homo sapiens
caauagggugcaguuuucca

SEQ ID NO: 959504 - RNA, 14 nt, Homo sapiens
caauauaaucugaa

SEQ ID NO: 959505 - RNA, 16 nt, Homo sapiens
caauauauugaacuuu

SEQ ID NO: 959506 - RNA, 14 nt, Homo sapiens
caaugauaaugcua

SEQ ID NO: 959507 - RNA, 15 nt, Homo sapiens
caaugauaaugcuaa

SEQ ID NO: 959508 - RNA, 17 nt, Homo sapiens
caauggcuuguucauca

SEQ ID NO: 959509 - RNA, 17 nt, Homo sapiens
caauggucucagccuag

SEQ ID NO: 959510 - RNA, 17 nt, Homo sapiens
caauguggcaaacugaa

SEQ ID NO: 959511 - RNA, 15 nt, Homo sapiens
caauuaguggucaua

SEQ ID NO: 959512 - RNA, 19 nt, Homo sapiens
caauuauuugaagauuuaa

SEQ ID NO: 959513 - RNA, 23 nt, Homo sapiens
caauugguaaaacucacugugau

SEQ ID NO: 959514 - RNA, 18 nt, Homo sapiens
caauuuccucuccacugc

SEQ ID NO: 959515 - RNA, 12 nt, Homo sapiens
cacaaacuccau

SEQ ID NO: 959516 - RNA, 17 nt, Homo sapiens
cacaauuaugugcaaag

SEQ ID NO: 959517 - RNA, 14 nt, Homo sapiens
cacacacgaugcau

SEQ ID NO: 959518 - RNA, 14 nt, Homo sapiens
cacacagacuccac

SEQ ID NO: 959519 - RNA, 16 nt, Homo sapiens
cacaccacaaauggga

SEQ ID NO: 959520 - RNA, 16 nt, Homo sapiens
cacacccgugagaaau

SEQ ID NO: 959521 - RNA, 20 nt, Homo sapiens
cacaccucacgcucuggaca

SEQ ID NO: 959522 - RNA, 14 nt, Homo sapiens
cacacgaugcauuu

SEQ ID NO: 959523 - RNA, 17 nt, Homo sapiens
cacacgaugcauuuaau

SEQ ID NO: 959524 - RNA, 22 nt, Homo sapiens
cacacugggugcgucuccaguc

SEQ ID NO: 959525 - RNA, 14 nt, Homo sapiens
cacagaaggaauaa

SEQ ID NO: 959526 - RNA, 19 nt, Homo sapiens
cacagaaggaauaagguca

SEQ ID NO: 959527 - RNA, 18 nt, Homo sapiens
cacagagcaaguccucac

SEQ ID NO: 959528 - RNA, 23 nt, Homo sapiens
cacagagcuccuggcccuggcca

SEQ ID NO: 959529 - RNA, 15 nt, Homo sapiens
cacagaggagugcag

SEQ ID NO: 959530 - RNA, 18 nt, Homo sapiens
cacagcauguguauuucc

SEQ ID NO: 959531 - RNA, 17 nt, Homo sapiens
cacagccacuaagauaa

SEQ ID NO: 959532 - RNA, 11 nt, Homo sapiens
cacagccagag

SEQ ID NO: 959533 - RNA, 17 nt, Homo sapiens
cacagcccugcucauuc

SEQ ID NO: 959534 - RNA, 20 nt, Homo sapiens
cacagcuggagaaauggcau

SEQ ID NO: 959535 - RNA, 16 nt, Homo sapiens
cacaggcugugccaac

SEQ ID NO: 959536 - RNA, 18 nt, Homo sapiens
cacaggcugugccaacau

SEQ ID NO: 959537 - RNA, 17 nt, Homo sapiens
cacagggagugcacaua

SEQ ID NO: 959538 - RNA, 14 nt, Homo sapiens
cacaguagaacugu

SEQ ID NO: 959539 - RNA, 14 nt, Homo sapiens
cacauauacaaaug

SEQ ID NO: 959540 - RNA, 13 nt, Homo sapiens
cacauaugcaccu

SEQ ID NO: 959541 - RNA, 16 nt, Homo sapiens
cacauggccuaugcac

SEQ ID NO: 959542 - RNA, 18 nt, Homo sapiens
cacauggccuaugcacau

SEQ ID NO: 959543 - RNA, 19 nt, Homo sapiens
cacaugucuuguacaugug

SEQ ID NO: 959544 - RNA, 20 nt, Homo sapiens
cacaugucuuguacaugugu

SEQ ID NO: 959545 - RNA, 16 nt, Homo sapiens
cccaucuucgggacca

SEQ ID NO: 959546 - RNA, 18 nt, Homo sapiens
cccaugggggcacuugag

SEQ ID NO: 959547 - RNA, 20 nt, Homo sapiens
cccauuugugccagaggaau

SEQ ID NO: 959548 - RNA, 22 nt, Homo sapiens
cccauuuuuccuuuugccgacc

SEQ ID NO: 959549 - RNA, 23 nt, Homo sapiens
ccccaagagaacucgcgcucagu

SEQ ID NO: 959550 - RNA, 21 nt, Homo sapiens
ccccacaagccaggaccugcu

SEQ ID NO: 959551 - RNA, 11 nt, Homo sapiens
ccccacuuuga

SEQ ID NO: 959552 - RNA, 21 nt, Homo sapiens
ccccagcauucucaggcacca

SEQ ID NO: 959553 - RNA, 16 nt, Homo sapiens
cccccaaaucaagcag

SEQ ID NO: 959554 - RNA, 21 nt, Homo sapiens
cccccaucuucgggaccagga

SEQ ID NO: 959555 - RNA, 17 nt, Homo sapiens
ccccccaacuccaggaa

SEQ ID NO: 959556 - RNA, 23 nt, Homo sapiens
ccccgccugagucagugcucuca

SEQ ID NO: 959557 - RNA, 13 nt, Homo sapiens
ccccucucaccaa

SEQ ID NO: 959558 - RNA, 20 nt, Homo sapiens
ccccucuucugagcacagau

SEQ ID NO: 959559 - RNA, 13 nt, Homo sapiens
ccccuuucccacc

SEQ ID NO: 959560 - RNA, 17 nt, Homo sapiens
cccgcagggccaugcag

SEQ ID NO: 959561 - RNA, 14 nt, Homo sapiens
cccgcccaugcugu

SEQ ID NO: 959562 - RNA, 20 nt, Homo sapiens
cccuaggaaacucacacucc

SEQ ID NO: 959563 - RNA, 22 nt, Homo sapiens
cccuaugaaaaauguguuccau

SEQ ID NO: 959564 - RNA, 12 nt, Homo sapiens
cccucacuggcu

SEQ ID NO: 959565 - RNA, 19 nt, Homo sapiens
cccuccauucauccuucca

SEQ ID NO: 959566 - RNA, 22 nt, Homo sapiens
cccuccauucauccuuccaucc

SEQ ID NO: 959567 - RNA, 17 nt, Homo sapiens
cccucgucccauccagc

SEQ ID NO: 959568 - RNA, 15 nt, Homo sapiens
cccucuuccugugau

SEQ ID NO: 959569 - RNA, 16 nt, Homo sapiens
cccucuuccugugauc

SEQ ID NO: 959570 - RNA, 23 nt, Homo sapiens
cccugccuguuaaggaaacuuua

SEQ ID NO: 959571 - RNA, 16 nt, Homo sapiens
cccugcgggccagggu

SEQ ID NO: 959572 - RNA, 20 nt, Homo sapiens
cccugcucaguaaagcacuu

SEQ ID NO: 959573 - RNA, 18 nt, Homo sapiens
cccuggguuucaugagcu

SEQ ID NO: 959574 - RNA, 17 nt, Homo sapiens
cccugucucuacuaaaa

SEQ ID NO: 959575 - RNA, 13 nt, Homo sapiens
cccugucuggaac

SEQ ID NO: 959576 - RNA, 14 nt, Homo sapiens
cccuuccagugccc

SEQ ID NO: 959577 - RNA, 22 nt, Homo sapiens
cccuuuauuacaagaaggaaca

SEQ ID NO: 959578 - RNA, 22 nt, Homo sapiens
cccuuuuguauucucuuccuca

SEQ ID NO: 959579 - RNA, 15 nt, Homo sapiens
ccgaggggagggcag

SEQ ID NO: 959580 - RNA, 21 nt, Homo sapiens
ccgagucagacuuuguguuca

SEQ ID NO: 959581 - RNA, 21 nt, Homo sapiens
ccggaguucugcccaugggaa

SEQ ID NO: 959582 - RNA, 13 nt, Homo sapiens
ccgggaaugagcu

SEQ ID NO: 959583 - RNA, 17 nt, Homo sapiens
ccguggcugauggugug

SEQ ID NO: 959584 - RNA, 22 nt, Homo sapiens
ccuaaccuuggugccugaucca

SEQ ID NO: 959585 - RNA, 22 nt, Homo sapiens
ccuaagagacugcguucugcaa

SEQ ID NO: 959586 - RNA, 22 nt, Homo sapiens
agaccucagugccuuccuguuu

SEQ ID NO: 959587 - RNA, 12 nt, Homo sapiens
agaccugggauu

SEQ ID NO: 959588 - RNA, 14 nt, Homo sapiens
agacuaagaauuag

SEQ ID NO: 959589 - RNA, 21 nt, Homo sapiens
agacuauggugcugccuugcu

SEQ ID NO: 959590 - RNA, 14 nt, Homo sapiens
agacuccaucucaa

SEQ ID NO: 959591 - RNA, 18 nt, Homo sapiens
agacucugucuaccuggu

SEQ ID NO: 959592 - RNA, 20 nt, Homo sapiens
agacugaccauauugugcuu

SEQ ID NO: 959593 - RNA, 12 nt, Homo sapiens
agacugauuucu

SEQ ID NO: 959594 - RNA, 23 nt, Homo sapiens
agacugcuagcuuucuccuuacc

SEQ ID NO: 959595 - RNA, 17 nt, Homo sapiens
agacugguuuucugcca

SEQ ID NO: 959596 - RNA, 19 nt, Homo sapiens
agacugguuuucugccaau

SEQ ID NO: 959597 - RNA, 19 nt, Homo sapiens
agacuguggcuagugacaa

SEQ ID NO: 959598 - RNA, 19 nt, Homo sapiens
agacuguugaguuaugaua

SEQ ID NO: 959599 - RNA, 18 nt, Homo sapiens
agacuguugccacuuaac

SEQ ID NO: 959600 - RNA, 13 nt, Homo sapiens
agacuugggaugg

SEQ ID NO: 959601 - RNA, 20 nt, Homo sapiens
agagaauccauccaaaguuc

SEQ ID NO: 959602 - RNA, 15 nt, Homo sapiens
agagacuguuugaau

SEQ ID NO: 959603 - RNA, 18 nt, Homo sapiens
agagagauuccaucucaa

SEQ ID NO: 959604 - RNA, 20 nt, Homo sapiens
agagagccauuuugugaaug

SEQ ID NO: 959605 - RNA, 20 nt, Homo sapiens
agagauacauguugccucac

SEQ ID NO: 959606 - RNA, 19 nt, Homo sapiens
agagcaagacuccaucuca

SEQ ID NO: 959607 - RNA, 13 nt, Homo sapiens
agagcagcuggau

SEQ ID NO: 959608 - RNA, 17 nt, Homo sapiens
agagcagucacaacaga

SEQ ID NO: 959609 - RNA, 18 nt, Homo sapiens
agagcaguggccaggcca

SEQ ID NO: 959610 - RNA, 17 nt, Homo sapiens
agagcaugauacaaauu

SEQ ID NO: 959611 - RNA, 11 nt, Homo sapiens
agagcaugcua

SEQ ID NO: 959612 - RNA, 18 nt, Homo sapiens
agagccucuggcaucucu

SEQ ID NO: 959613 - RNA, 17 nt, Homo sapiens
agagccuuuugugcaaa

SEQ ID NO: 959614 - RNA, 20 nt, Homo sapiens
agagcgcaguguuuugcaag

SEQ ID NO: 959615 - RNA, 22 nt, Homo sapiens
agagcucuuuaccaaggaugaa

SEQ ID NO: 959616 - RNA, 22 nt, Homo sapiens
agaggacgcacgcucgcugcca

SEQ ID NO: 959617 - RNA, 13 nt, Homo sapiens
agaggcacucagu

SEQ ID NO: 959618 - RNA, 17 nt, Homo sapiens
agaggcaucgccugcag

SEQ ID NO: 959619 - RNA, 18 nt, Homo sapiens
agagggaggucacuggaa

SEQ ID NO: 959620 - RNA, 13 nt, Homo sapiens
agagggcuuccuc

SEQ ID NO: 959621 - RNA, 18 nt, Homo sapiens
agagguagcgagcugcuc

SEQ ID NO: 959622 - RNA, 17 nt, Homo sapiens
agaggucagcacacauu

SEQ ID NO: 959623 - RNA, 14 nt, Homo sapiens
agaguaaagcaacu

SEQ ID NO: 959624 - RNA, 12 nt, Homo sapiens
agagucagcucu

SEQ ID NO: 959625 - RNA, 23 nt, Homo sapiens
agagucuaggcuaagcacuuuau

SEQ ID NO: 959626 - RNA, 22 nt, Homo sapiens
agaguguuggaagucauuugau

SEQ ID NO: 959627 - RNA, 14 nt, Homo sapiens
agauaauuggcaac

SEQ ID NO: 959628 - RNA, 14 nt, Homo sapiens
agauagacaaucac

SEQ ID NO: 959629 - RNA, 18 nt, Homo sapiens
uaagaguaaaauuccucu

SEQ ID NO: 959630 - RNA, 21 nt, Homo sapiens
uaagauaaauucaugcacuuu

SEQ ID NO: 959631 - RNA, 20 nt, Homo sapiens
uaagauauucagaaguauau

SEQ ID NO: 959632 - RNA, 23 nt, Homo sapiens
uaagauuuuuuaaauugucauaa

SEQ ID NO: 959633 - RNA, 20 nt, Homo sapiens
uaagcaguauauuaguauua

SEQ ID NO: 959634 - RNA, 22 nt, Homo sapiens
uaagcauuuugguuggauuucu

SEQ ID NO: 959635 - RNA, 14 nt, Homo sapiens
uaagcuuccacuua

SEQ ID NO: 959636 - RNA, 18 nt, Homo sapiens
uaagggacauuucuauaa

SEQ ID NO: 959637 - RNA, 16 nt, Homo sapiens
uaaguucuuaugagga

SEQ ID NO: 959638 - RNA, 13 nt, Homo sapiens
uaauaaaaccaaa

SEQ ID NO: 959639 - RNA, 17 nt, Homo sapiens
uaauaacuguguacugu

SEQ ID NO: 959640 - RNA, 22 nt, Homo sapiens
uaauaagagaauguuccuacuc

SEQ ID NO: 959641 - RNA, 15 nt, Homo sapiens
uaauaagcuaaagag

SEQ ID NO: 959642 - RNA, 13 nt, Homo sapiens
uaauauuugcaca

SEQ ID NO: 959643 - RNA, 17 nt, Homo sapiens
uaauauuuuccuaguag

SEQ ID NO: 959644 - RNA, 20 nt, Homo sapiens
uaauauuuuuguauuucucu

SEQ ID NO: 959645 - RNA, 20 nt, Homo sapiens
uaaucaagagaaacuucaaa

SEQ ID NO: 959646 - RNA, 14 nt, Homo sapiens
uaaucacaguguug

SEQ ID NO: 959647 - RNA, 19 nt, Homo sapiens
uaaucccuuugucugucaa

SEQ ID NO: 959648 - RNA, 19 nt, Homo sapiens
uaauccugaauguaaacaa

SEQ ID NO: 959649 - RNA, 14 nt, Homo sapiens
uaaucgcuaaucag

SEQ ID NO: 959650 - RNA, 22 nt, Homo sapiens
uaaucuguuuauuuacaaggga

SEQ ID NO: 959651 - RNA, 21 nt, Homo sapiens
uaaucuucugccuucucauga

SEQ ID NO: 959652 - RNA, 15 nt, Homo sapiens
uaaugaaauggagga

SEQ ID NO: 959653 - RNA, 16 nt, Homo sapiens
uaaugaaggacaguga

SEQ ID NO: 959654 - RNA, 16 nt, Homo sapiens
uaaugagacugaccau

SEQ ID NO: 959655 - RNA, 18 nt, Homo sapiens
uaauguacacauugcauu

SEQ ID NO: 959656 - RNA, 16 nt, Homo sapiens
uaauguguauucauuu

SEQ ID NO: 959657 - RNA, 21 nt, Homo sapiens
uaauguugacuuuaauacucu

SEQ ID NO: 959658 - RNA, 15 nt, Homo sapiens
uaauuaccaguuuuc

SEQ ID NO: 959659 - RNA, 15 nt, Homo sapiens
uaauuacucuaacaa

SEQ ID NO: 959660 - RNA, 13 nt, Homo sapiens
uaauuaguuccag

SEQ ID NO: 959661 - RNA, 22 nt, Homo sapiens
uaauuauauuuuaaauacccau

SEQ ID NO: 959662 - RNA, 12 nt, Homo sapiens
uaauuauugcuu

SEQ ID NO: 959663 - RNA, 12 nt, Homo sapiens
uaauuauuuucc

SEQ ID NO: 959664 - RNA, 19 nt, Homo sapiens
uaauuccacaggucaucag

SEQ ID NO: 959665 - RNA, 17 nt, Homo sapiens
uaauucccgccuuaugc

SEQ ID NO: 959666 - RNA, 15 nt, Homo sapiens
uaauugccagcaaau

SEQ ID NO: 959667 - RNA, 15 nt, Homo sapiens
uaauuggucauguga

SEQ ID NO: 959668 - RNA, 13 nt, Homo sapiens
uaauuuauuucca

SEQ ID NO: 959669 - RNA, 12 nt, Homo sapiens
uaauuucagggu

SEQ ID NO: 959670 - RNA, 18 nt, Homo sapiens
uaauuucagggugcagcc

SEQ ID NO: 959671 - RNA, 17 nt, Homo sapiens
uaauuuccuuuuugaca

SEQ ID NO: 959672 - RNA, 15 nt, Homo sapiens
uaauuuuauuauagu

SEQ ID NO: 959673 - RNA, 18 nt, Homo sapiens
uacaaaauauagcuuuca

SEQ ID NO: 959674 - RNA, 16 nt, Homo sapiens
uacaaaccuaccaaaa

SEQ ID NO: 959675 - RNA, 22 nt, Homo sapiens
uacaaacuuggacaacacggag

SEQ ID NO: 959676 - RNA, 18 nt, Homo sapiens
uacaaacuuuguuuguca

SEQ ID NO: 959677 - RNA, 20 nt, Homo sapiens
uacaaacuuuuaagauuucu

SEQ ID NO: 959678 - RNA, 20 nt, Homo sapiens
uacaacaccagcaacauuau

SEQ ID NO: 959679 - RNA, 15 nt, Homo sapiens
uacaacugauugcaa

SEQ ID NO: 959680 - RNA, 18 nt, Homo sapiens
uacaagggaagauuuaug

SEQ ID NO: 959681 - RNA, 20 nt, Homo sapiens
uacaauuuuuuaucaugcau

SEQ ID NO: 959682 - RNA, 14 nt, Homo sapiens
uacacauugcauuu

SEQ ID NO: 959683 - RNA, 15 nt, Homo sapiens
uacacugauacacuu

SEQ ID NO: 959684 - RNA, 13 nt, Homo sapiens
uacagaguuuuag

SEQ ID NO: 959685 - RNA, 21 nt, Homo sapiens
uacagauagaaaauaugauau

SEQ ID NO: 959686 - RNA, 22 nt, Homo sapiens
uacaggugcgcgccaccgugcc

SEQ ID NO: 959687 - RNA, 22 nt, Homo sapiens
uacagugagccaagauugcacc

SEQ ID NO: 959688 - RNA, 16 nt, Homo sapiens
uacauauauaccacau

SEQ ID NO: 959689 - RNA, 20 nt, Homo sapiens
uacauauuccugguguagca

SEQ ID NO: 959690 - RNA, 16 nt, Homo sapiens
uacaugcuggggucaa

SEQ ID NO: 959691 - RNA, 11 nt, Homo sapiens
uacauguuaag

SEQ ID NO: 959692 - RNA, 12 nt, Homo sapiens
uacauucacuuu

SEQ ID NO: 959693 - RNA, 15 nt, Homo sapiens
uacauugugcugcac

SEQ ID NO: 959694 - RNA, 22 nt, Homo sapiens
uacauuguucuuauucuggcau

SEQ ID NO: 959695 - RNA, 19 nt, Homo sapiens
uaccacuugugauucaaac

SEQ ID NO: 959696 - RNA, 16 nt, Homo sapiens
uaccauucacuacuca

SEQ ID NO: 959697 - RNA, 19 nt, Homo sapiens
uacccaccuagaacacuaa

SEQ ID NO: 959698 - RNA, 16 nt, Homo sapiens
uacccauacacccccu

SEQ ID NO: 959699 - RNA, 22 nt, Homo sapiens
uacccuauucuauccaucuccu

SEQ ID NO: 959700 - RNA, 13 nt, Homo sapiens
uaccggauucucu

SEQ ID NO: 959701 - RNA, 17 nt, Homo sapiens
uaccuacagagcagcca

SEQ ID NO: 959702 - RNA, 20 nt, Homo sapiens
uaccucaaagggcaguuuug

SEQ ID NO: 959703 - RNA, 14 nt, Homo sapiens
uaccuccauccauc

SEQ ID NO: 959704 - RNA, 16 nt, Homo sapiens
uaccuuaauuauugca

SEQ ID NO: 959705 - RNA, 19 nt, Homo sapiens
uaccuuuuuauuugcaugu

SEQ ID NO: 959706 - RNA, 15 nt, Homo sapiens
uacgcacguggagcu

SEQ ID NO: 959707 - RNA, 20 nt, Homo sapiens
uacgguggucggugggaccc

SEQ ID NO: 959708 - RNA, 19 nt, Homo sapiens
uacuaaaaaguauaaaaua

SEQ ID NO: 959709 - RNA, 20 nt, Homo sapiens
uacuaagaguaaagcaacuc

SEQ ID NO: 959710 - RNA, 18 nt, Homo sapiens
uacuaaugccucuucauu

SEQ ID NO: 959711 - RNA, 17 nt, Homo sapiens
uacuagauugugauccc

SEQ ID NO: 959712 - RNA, 14 nt, Homo sapiens
uacuagcacuuuga

SEQ ID NO: 959713 - RNA, 18 nt, Homo sapiens
uacuaguccugacacuga

SEQ ID NO: 959714 - RNA, 13 nt, Homo sapiens
uacucaacccauu

SEQ ID NO: 959715 - RNA, 14 nt, Homo sapiens
uacucagcuuuuuc

SEQ ID NO: 959716 - RNA, 24 nt, Homo sapiens
uacucuuucugcuuacaaagacaa

SEQ ID NO: 959717 - RNA, 18 nt, Homo sapiens
uacugaaggaaaaacaca

SEQ ID NO: 959718 - RNA, 15 nt, Homo sapiens
uacugaugacagugu

SEQ ID NO: 959719 - RNA, 16 nt, Homo sapiens
uacugcccacuuguca

SEQ ID NO: 959720 - RNA, 12 nt, Homo sapiens
uacugcugugaa

SEQ ID NO: 959721 - RNA, 19 nt, Homo sapiens
uacuugucauagacuccuu

SEQ ID NO: 959722 - RNA, 17 nt, Homo sapiens
uacuuuucuuuccucag

SEQ ID NO: 959723 - RNA, 22 nt, Homo sapiens
uagaaaacagcccccacuccag

SEQ ID NO: 959724 - RNA, 20 nt, Homo sapiens
uagaaaauaaaacugagcua

SEQ ID NO: 959725 - RNA, 13 nt, Homo sapiens
uagaaaugagauc

SEQ ID NO: 959726 - RNA, 12 nt, Homo sapiens
uagaaaugcuac

SEQ ID NO: 959727 - RNA, 19 nt, Homo sapiens
uagaaccuuaaagaaccau

SEQ ID NO: 959728 - RNA, 17 nt, Homo sapiens
uagaacuccaguuuuca

SEQ ID NO: 959729 - RNA, 11 nt, Homo sapiens
uagaagccaag

SEQ ID NO: 959730 - RNA, 20 nt, Homo sapiens
uagaagccaagggaaagggg

SEQ ID NO: 959731 - RNA, 20 nt, Homo sapiens
uagaagccaguacagagaaa

SEQ ID NO: 959732 - RNA, 14 nt, Homo sapiens
uagaauaagccuuc

SEQ ID NO: 959733 - RNA, 13 nt, Homo sapiens
uagaauacauuaa

SEQ ID NO: 959734 - RNA, 14 nt, Homo sapiens
uagaaugcauguaa

SEQ ID NO: 959735 - RNA, 17 nt, Homo sapiens
uagaauuuugaguauuc

SEQ ID NO: 959736 - RNA, 20 nt, Homo sapiens
uagacaaaccaucuccuccu

SEQ ID NO: 959737 - RNA, 14 nt, Homo sapiens
uagacaaaguacau

SEQ ID NO: 959738 - RNA, 19 nt, Homo sapiens
uagacagguguuacuuaca

SEQ ID NO: 959739 - RNA, 14 nt, Homo sapiens
uagacuagcaaucu

SEQ ID NO: 959740 - RNA, 15 nt, Homo sapiens
uagacucacauuuac

SEQ ID NO: 959741 - RNA, 24 nt, Homo sapiens
uagacuccuuugcuaaugcuaugc

SEQ ID NO: 959742 - RNA, 23 nt, Homo sapiens
uagagaaguccaagcaacagccu

SEQ ID NO: 959743 - RNA, 16 nt, Homo sapiens
uagagacuucacccgg

SEQ ID NO: 959744 - RNA, 18 nt, Homo sapiens
uagagaggacaauacugg

SEQ ID NO: 959745 - RNA, 21 nt, Homo sapiens
uagagaggacaauacuggggu

SEQ ID NO: 959746 - RNA, 13 nt, Homo sapiens
uagagaguggcaa

SEQ ID NO: 959747 - RNA, 14 nt, Homo sapiens
uagaucaagcauua

SEQ ID NO: 959748 - RNA, 15 nt, Homo sapiens
uagauuuaagugaau

SEQ ID NO: 959749 - RNA, 21 nt, Homo sapiens
uagcaaaggaaaaauugauga

SEQ ID NO: 959750 - RNA, 22 nt, Homo sapiens
uagcagauuucuugcuucauau

SEQ ID NO: 959751 - RNA, 13 nt, Homo sapiens
uagcaucuucuca

SEQ ID NO: 959752 - RNA, 18 nt, Homo sapiens
uagcaucuucucauuccc

SEQ ID NO: 959753 - RNA, 22 nt, Homo sapiens
uagcaugaaauaaaauauaucu

SEQ ID NO: 959754 - RNA, 15 nt, Homo sapiens
uagcauguaugaaug

SEQ ID NO: 959755 - RNA, 21 nt, Homo sapiens
uagcauuuucuugaaccaaua

SEQ ID NO: 959756 - RNA, 20 nt, Homo sapiens
uagccaaaccaggacccugu

SEQ ID NO: 959757 - RNA, 16 nt, Homo sapiens
uagcccgcuagcauua

SEQ ID NO: 959758 - RNA, 20 nt, Homo sapiens
uagccuauuaaacuauuuua

SEQ ID NO: 959759 - RNA, 13 nt, Homo sapiens
uagcuaagauaua

SEQ ID NO: 959760 - RNA, 18 nt, Homo sapiens
uagcucacugcagccuca

SEQ ID NO: 959761 - RNA, 14 nt, Homo sapiens
uagcuccuguuguc

SEQ ID NO: 959762 - RNA, 20 nt, Homo sapiens
uagcucucccaacucuugca

SEQ ID NO: 959763 - RNA, 23 nt, Homo sapiens
uagcucucccaacucuugcacag

SEQ ID NO: 959764 - RNA, 18 nt, Homo sapiens
uaggaagggaucugagaa

SEQ ID NO: 959765 - RNA, 19 nt, Homo sapiens
uaggaauguccaccaugaa

SEQ ID NO: 959766 - RNA, 17 nt, Homo sapiens
uaggauacguacaccuc

SEQ ID NO: 959767 - RNA, 17 nt, Homo sapiens
uaggcuauuaaaaaagu

SEQ ID NO: 959768 - RNA, 21 nt, Homo sapiens
uagggacugccaggcuguuuc

SEQ ID NO: 959769 - RNA, 22 nt, Homo sapiens
uagggcagccgaguggaggaaa

SEQ ID NO: 959770 - RNA, 16 nt, Homo sapiens
uagguagaacacugcu

SEQ ID NO: 959771 - RNA, 22 nt, Homo sapiens
uagguaggugguuuuauuucaa

SEQ ID NO: 959772 - RNA, 23 nt, Homo sapiens
uagguccuuguuguuucuugccu

SEQ ID NO: 959773 - RNA, 12 nt, Homo sapiens
uaggugagacag

SEQ ID NO: 959774 - RNA, 22 nt, Homo sapiens
uaggugccaggcuguaagcauu

SEQ ID NO: 959775 - RNA, 19 nt, Homo sapiens
uagguuugauucaacacuu

SEQ ID NO: 959776 - RNA, 14 nt, Homo sapiens
uaguaacaauacau

SEQ ID NO: 959777 - RNA, 12 nt, Homo sapiens
uaguaacauuca

SEQ ID NO: 959778 - RNA, 19 nt, Homo sapiens
uaguagauguggccuuuga

SEQ ID NO: 959779 - RNA, 14 nt, Homo sapiens
uaguagcauuucaa

SEQ ID NO: 959780 - RNA, 12 nt, Homo sapiens
uagucacauggc

SEQ ID NO: 959781 - RNA, 22 nt, Homo sapiens
uagucacauggccuaugcacau

SEQ ID NO: 959782 - RNA, 15 nt, Homo sapiens
uagucaguugcucau

SEQ ID NO: 959783 - RNA, 15 nt, Homo sapiens
uaguccaucuccagc

SEQ ID NO: 959784 - RNA, 15 nt, Homo sapiens
uagucccagcuacuu

SEQ ID NO: 959785 - RNA, 17 nt, Homo sapiens
uagugacuuccugguga

SEQ ID NO: 959786 - RNA, 13 nt, Homo sapiens
uaguggucuuugu

SEQ ID NO: 959787 - RNA, 17 nt, Homo sapiens
uaguguaacuugcuuaa

SEQ ID NO: 959788 - RNA, 16 nt, Homo sapiens
uaguuaaagaaaggaa

SEQ ID NO: 959789 - RNA, 17 nt, Homo sapiens
uaguuacuaaacaugua

SEQ ID NO: 959790 - RNA, 13 nt, Homo sapiens
uaguuccaguuuc

SEQ ID NO: 959791 - RNA, 20 nt, Homo sapiens
uaguugcguggacucugcac

SEQ ID NO: 959792 - RNA, 13 nt, Homo sapiens
uaguuuccuuuag

SEQ ID NO: 959793 - RNA, 14 nt, Homo sapiens
uaguuuuacuuuua

SEQ ID NO: 959794 - RNA, 23 nt, Homo sapiens
uauaaaauaguaugaaaauggaa

SEQ ID NO: 959795 - RNA, 19 nt, Homo sapiens
uauaaaguauaacuauaaa

SEQ ID NO: 959796 - RNA, 20 nt, Homo sapiens
uauaacaauucaguaacaaa

SEQ ID NO: 959797 - RNA, 11 nt, Homo sapiens
uauaagacauu

SEQ ID NO: 959798 - RNA, 19 nt, Homo sapiens
uauaaugaacacgugggua

SEQ ID NO: 959799 - RNA, 22 nt, Homo sapiens
uauaauucagaagacuacuaua

SEQ ID NO: 959800 - RNA, 19 nt, Homo sapiens
uauacuuaagaauacacag

SEQ ID NO: 959801 - RNA, 17 nt, Homo sapiens
uauacuuuaguagacau

SEQ ID NO: 959802 - RNA, 22 nt, Homo sapiens
uauagcaauacuucagugagau

SEQ ID NO: 959803 - RNA, 21 nt, Homo sapiens
uauagugacccacccuagauc

SEQ ID NO: 959804 - RNA, 15 nt, Homo sapiens
uauauacacauacau

SEQ ID NO: 959805 - RNA, 12 nt, Homo sapiens
uauauacuuaag

SEQ ID NO: 959806 - RNA, 13 nt, Homo sapiens
uauauaguagcau

SEQ ID NO: 959807 - RNA, 20 nt, Homo sapiens
uauauauuuucauccuauaa

SEQ ID NO: 959808 - RNA, 17 nt, Homo sapiens
uauaucuguacagauca

SEQ ID NO: 959809 - RNA, 13 nt, Homo sapiens
uauauucccacau

SEQ ID NO: 959810 - RNA, 18 nt, Homo sapiens
uauauuguauaggggcaa

SEQ ID NO: 959811 - RNA, 15 nt, Homo sapiens
uauauuucuggugaa

SEQ ID NO: 959812 - RNA, 21 nt, Homo sapiens
uauauuuugugugaaauugca

SEQ ID NO: 959813 - RNA, 20 nt, Homo sapiens
uaucaggaaauaucugugaa

SEQ ID NO: 959814 - RNA, 12 nt, Homo sapiens
uaucaugugauu

SEQ ID NO: 959815 - RNA, 23 nt, Homo sapiens
uauccaagacuuagagcugggaa

SEQ ID NO: 959816 - RNA, 12 nt, Homo sapiens
uauccaucuccu

SEQ ID NO: 959817 - RNA, 22 nt, Homo sapiens
uaucccacauccaacuccagca

SEQ ID NO: 959818 - RNA, 14 nt, Homo sapiens
uauccuauguuaaa

SEQ ID NO: 959819 - RNA, 14 nt, Homo sapiens
uaucucauuacuua

SEQ ID NO: 959820 - RNA, 15 nt, Homo sapiens
uaucucccacaaaua

SEQ ID NO: 959821 - RNA, 23 nt, Homo sapiens
uaucuccugacagaaggugccac

SEQ ID NO: 959822 - RNA, 23 nt, Homo sapiens
uaucucuaaaugugacaugcaaa

SEQ ID NO: 959823 - RNA, 13 nt, Homo sapiens
uaucuguucuguu

SEQ ID NO: 959824 - RNA, 22 nt, Homo sapiens
uaucuucagcccaggcuuuugc

SEQ ID NO: 959825 - RNA, 14 nt, Homo sapiens
uaucuuuaccuccu

SEQ ID NO: 959826 - RNA, 20 nt, Homo sapiens
uaugaaaauauagacauucu

SEQ ID NO: 959827 - RNA, 23 nt, Homo sapiens
uaugaaaauauagacauucucac

SEQ ID NO: 959828 - RNA, 19 nt, Homo sapiens
uaugaucuggcccuugcuu

SEQ ID NO: 959829 - RNA, 12 nt, Homo sapiens
uaugcagugaua

SEQ ID NO: 959830 - RNA, 15 nt, Homo sapiens
uaugcauaccuggau

SEQ ID NO: 959831 - RNA, 16 nt, Homo sapiens
uaugccuuaagccaau

SEQ ID NO: 959832 - RNA, 19 nt, Homo sapiens
uaugcucauugaacuuuaa

SEQ ID NO: 959833 - RNA, 12 nt, Homo sapiens
uauggacucugc

SEQ ID NO: 959834 - RNA, 14 nt, Homo sapiens
uauggacucugcac

SEQ ID NO: 959835 - RNA, 19 nt, Homo sapiens
uauggcuucacauucauug

SEQ ID NO: 959836 - RNA, 16 nt, Homo sapiens
uauggguugcauuugg

SEQ ID NO: 959837 - RNA, 22 nt, Homo sapiens
uauggugccgaauugucuuugg

SEQ ID NO: 959838 - RNA, 14 nt, Homo sapiens
uauguaaauagcua

SEQ ID NO: 959839 - RNA, 14 nt, Homo sapiens
uaugucuuggacac

SEQ ID NO: 959840 - RNA, 19 nt, Homo sapiens
uaugucuuggacacuguac

SEQ ID NO: 959841 - RNA, 12 nt, Homo sapiens
uauguugcaaga

SEQ ID NO: 959842 - RNA, 15 nt, Homo sapiens
uauuaacggugguga

SEQ ID NO: 959843 - RNA, 14 nt, Homo sapiens
uauuaacuacugaa

SEQ ID NO: 959844 - RNA, 20 nt, Homo sapiens
uauuaaggccuuuuccacac

SEQ ID NO: 959845 - RNA, 17 nt, Homo sapiens
uauuaauauuugcacau

SEQ ID NO: 959846 - RNA, 23 nt, Homo sapiens
uauuaaucaagagaaacuucaaa

SEQ ID NO: 959847 - RNA, 21 nt, Homo sapiens
uauuaaucauacaaacucuca

SEQ ID NO: 959848 - RNA, 14 nt, Homo sapiens
uauuacauugcugc

SEQ ID NO: 959849 - RNA, 19 nt, Homo sapiens
uauuauugauucacuuacu

SEQ ID NO: 959850 - RNA, 15 nt, Homo sapiens
uauucagauugggaa

SEQ ID NO: 959851 - RNA, 17 nt, Homo sapiens
uauucauggauggcuca

SEQ ID NO: 959852 - RNA, 18 nt, Homo sapiens
uauuccuuugcauauuau

SEQ ID NO: 959853 - RNA, 20 nt, Homo sapiens
uauucuauaaaacucugcau

SEQ ID NO: 959854 - RNA, 21 nt, Homo sapiens
uauugaacuuuuguacugaau

SEQ ID NO: 959855 - RNA, 19 nt, Homo sapiens
uauugacacugaacuuaau

SEQ ID NO: 959856 - RNA, 17 nt, Homo sapiens
uauugugaaguacauau

SEQ ID NO: 959857 - RNA, 14 nt, Homo sapiens
uauuguugcaauau

SEQ ID NO: 959858 - RNA, 14 nt, Homo sapiens
uauuuaaucuuaau

SEQ ID NO: 959859 - RNA, 21 nt, Homo sapiens
ucauguugauguguccgugaa

SEQ ID NO: 959860 - RNA, 22 nt, Homo sapiens
ucauguuugaaucuacauucac

SEQ ID NO: 959861 - RNA, 13 nt, Homo sapiens
ucauuacaguucu

SEQ ID NO: 959862 - RNA, 22 nt, Homo sapiens
ucauuauucuuuuucaguuuua

SEQ ID NO: 959863 - RNA, 22 nt, Homo sapiens
ucauuauuuuuuacaauggcca

SEQ ID NO: 959864 - RNA, 22 nt, Homo sapiens
ucauucuuuuauacucagcuuu

SEQ ID NO: 959865 - RNA, 14 nt, Homo sapiens
ucauuuugcacuga

SEQ ID NO: 959866 - RNA, 15 nt, Homo sapiens
uccaaagaggcugcc

SEQ ID NO: 959867 - RNA, 22 nt, Homo sapiens
uccaaagaggcugccccucuca

SEQ ID NO: 959868 - RNA, 17 nt, Homo sapiens
uccaaaggucugauguc

SEQ ID NO: 959869 - RNA, 16 nt, Homo sapiens
uccaaaugaacuugca

SEQ ID NO: 959870 - RNA, 22 nt, Homo sapiens
uccaaaugccauccagaugugu

SEQ ID NO: 959871 - RNA, 15 nt, Homo sapiens
uccaacaucccuuau

SEQ ID NO: 959872 - RNA, 23 nt, Homo sapiens
uccaacaucccuuauaccacugu

SEQ ID NO: 959873 - RNA, 12 nt, Homo sapiens
uccaacauguga

SEQ ID NO: 959874 - RNA, 22 nt, Homo sapiens
uccaaccugagaaauggccaaa

SEQ ID NO: 959875 - RNA, 19 nt, Homo sapiens
uccaaccugccugugcaug

SEQ ID NO: 959876 - RNA, 20 nt, Homo sapiens
uccaaccugccugugcauga

SEQ ID NO: 959877 - RNA, 18 nt, Homo sapiens
uccaagcauuucaugaaa

SEQ ID NO: 959878 - RNA, 20 nt, Homo sapiens
uccaauugcucuuucacagg

SEQ ID NO: 959879 - RNA, 17 nt, Homo sapiens
ucggauacacacucgaa

SEQ ID NO: 959880 - RNA, 18 nt, Homo sapiens
ucggcccuguuccccaag

SEQ ID NO: 959881 - RNA, 14 nt, Homo sapiens
ucggugggacccug

SEQ ID NO: 959882 - RNA, 19 nt, Homo sapiens
ucgguuguucuuuccucac

SEQ ID NO: 959883 - RNA, 22 nt, Homo sapiens
ucgucuuucccuuuaccacugu

SEQ ID NO: 959884 - RNA, 18 nt, Homo sapiens
ucuaaaaugugugccaga

SEQ ID NO: 959885 - RNA, 16 nt, Homo sapiens
ucuaaagagcaucuga

SEQ ID NO: 959886 - RNA, 23 nt, Homo sapiens
ucuaaaugcauauccugagccau

SEQ ID NO: 959887 - RNA, 20 nt, Homo sapiens
ucuaaccgaauauucaugga

SEQ ID NO: 959888 - RNA, 16 nt, Homo sapiens
ucuacaaaauauagcu

SEQ ID NO: 959889 - RNA, 14 nt, Homo sapiens
ucuacaacauagca

SEQ ID NO: 959890 - RNA, 15 nt, Homo sapiens
ucuacaauacaacac

SEQ ID NO: 959891 - RNA, 18 nt, Homo sapiens
ucuacaggaaucaaaaga

SEQ ID NO: 959892 - RNA, 14 nt, Homo sapiens
ucuacauucacuuu

SEQ ID NO: 959893 - RNA, 18 nt, Homo sapiens
ucuacuuuaaauugugga

SEQ ID NO: 959894 - RNA, 20 nt, Homo sapiens
ucuagacuagcaaucucuuc

SEQ ID NO: 959895 - RNA, 20 nt, Homo sapiens
ucuagagcuuaaugcuacau

SEQ ID NO: 959896 - RNA, 13 nt, Homo sapiens
ucuagcacacuuu

SEQ ID NO: 959897 - RNA, 22 nt, Homo sapiens
ucuaggcaggcaagagaauuga

SEQ ID NO: 959898 - RNA, 20 nt, Homo sapiens
ucuagguccccauacuccua

SEQ ID NO: 959899 - RNA, 15 nt, Homo sapiens
ucuagucugcuuugg

SEQ ID NO: 959900 - RNA, 23 nt, Homo sapiens
ucuauaucucauuucauucucac

SEQ ID NO: 959901 - RNA, 14 nt, Homo sapiens
ucuauuaacuacca

SEQ ID NO: 959902 - RNA, 13 nt, Homo sapiens
ucuauuuugugaa

SEQ ID NO: 959903 - RNA, 15 nt, Homo sapiens
ucucaagcuaguguu

SEQ ID NO: 959904 - RNA, 17 nt, Homo sapiens
ucucaaugaaccauaaa

SEQ ID NO: 959905 - RNA, 17 nt, Homo sapiens
ucucacagcaaaccucu

SEQ ID NO: 959906 - RNA, 13 nt, Homo sapiens
ucucagaccccac

SEQ ID NO: 959907 - RNA, 21 nt, Homo sapiens
ucucagugaaauaacuaccuu

SEQ ID NO: 959908 - RNA, 18 nt, Homo sapiens
ucucauauaagacaaaua

SEQ ID NO: 959909 - RNA, 16 nt, Homo sapiens
ucucauugacuuuuau

SEQ ID NO: 959910 - RNA, 17 nt, Homo sapiens
ucuccaacaucccuuau

SEQ ID NO: 959911 - RNA, 14 nt, Homo sapiens
ucuccacugugcuu

SEQ ID NO: 959912 - RNA, 20 nt, Homo sapiens
ucuccagcaauaauguuuuc

SEQ ID NO: 959913 - RNA, 13 nt, Homo sapiens
ucucccucucagu

SEQ ID NO: 959914 - RNA, 22 nt, Homo sapiens
ucuccggaggagacacaguuac

SEQ ID NO: 959915 - RNA, 12 nt, Homo sapiens
ucuccuacuuag

SEQ ID NO: 959916 - RNA, 22 nt, Homo sapiens
ucuccuucaccccuauggugcu

SEQ ID NO: 959917 - RNA, 23 nt, Homo sapiens
ucucuaaccgaauauucauggau

SEQ ID NO: 959918 - RNA, 13 nt, Homo sapiens
ucucuagcacaau

SEQ ID NO: 959919 - RNA, 13 nt, Homo sapiens
ucucuuccccaga

SEQ ID NO: 959920 - RNA, 13 nt, Homo sapiens
ucucuucugccuu

SEQ ID NO: 959921 - RNA, 17 nt, Homo sapiens
ucucuugauucugggau

SEQ ID NO: 959922 - RNA, 15 nt, Homo sapiens
ucugaagacagucuu

SEQ ID NO: 959923 - RNA, 14 nt, Homo sapiens
ucugaguaagcccu

SEQ ID NO: 959924 - RNA, 21 nt, Homo sapiens
ucugaugaaguuguacaacac

SEQ ID NO: 959925 - RNA, 19 nt, Homo sapiens
ucugaugucccagugcuca

SEQ ID NO: 959926 - RNA, 14 nt, Homo sapiens
ucugaugucuccac

SEQ ID NO: 959927 - RNA, 20 nt, Homo sapiens
ucugauuuuggccaucagga

SEQ ID NO: 959928 - RNA, 21 nt, Homo sapiens
ucugcaaaggcgucugaaugu

SEQ ID NO: 959929 - RNA, 22 nt, Homo sapiens
ucugcacggugggagaccugcu

SEQ ID NO: 959930 - RNA, 23 nt, Homo sapiens
ucugcacggugggagaccugcug

SEQ ID NO: 959931 - RNA, 12 nt, Homo sapiens
ucugcacuucau

SEQ ID NO: 959932 - RNA, 16 nt, Homo sapiens
ucugcaguccuacuca

SEQ ID NO: 959933 - RNA, 14 nt, Homo sapiens
ucugcaguuuaaca

SEQ ID NO: 959934 - RNA, 14 nt, Homo sapiens
ucugccaucuuuag

SEQ ID NO: 959935 - RNA, 16 nt, Homo sapiens
ucugccccacccucaa

SEQ ID NO: 959936 - RNA, 18 nt, Homo sapiens
ucugccccaccuugccag

SEQ ID NO: 959937 - RNA, 22 nt, Homo sapiens
ucugccugaaggcucacaccuc

SEQ ID NO: 959938 - RNA, 23 nt, Homo sapiens
ucugccuuaaacacacauugcag

SEQ ID NO: 959939 - RNA, 13 nt, Homo sapiens
ucugcggaucuca

SEQ ID NO: 959940 - RNA, 18 nt, Homo sapiens
ucugcgucgucaccaaau

SEQ ID NO: 959941 - RNA, 22 nt, Homo sapiens
ucugcuaauucgagucauggcu

SEQ ID NO: 959942 - RNA, 16 nt, Homo sapiens
ucugcucucauauaag

SEQ ID NO: 959943 - RNA, 16 nt, Homo sapiens
ucugcugggcucugcc

SEQ ID NO: 959944 - RNA, 14 nt, Homo sapiens
ucugcuguucagga

SEQ ID NO: 959945 - RNA, 15 nt, Homo sapiens
ucuggaaacugugaa

SEQ ID NO: 959946 - RNA, 16 nt, Homo sapiens
ucuggaaagaggcucu

SEQ ID NO: 959947 - RNA, 19 nt, Homo sapiens
ucuggaauuucaaaccauu

SEQ ID NO: 959948 - RNA, 15 nt, Homo sapiens
ucuggaccccaaaga

SEQ ID NO: 959949 - RNA, 15 nt, Homo sapiens
ucuggaccucugggu

SEQ ID NO: 959950 - RNA, 13 nt, Homo sapiens
ucuggcaucucuu

SEQ ID NO: 959951 - RNA, 22 nt, Homo sapiens
ucuggcaucucuuucugcaaag

SEQ ID NO: 959952 - RNA, 13 nt, Homo sapiens
ucuggcccagaaa

SEQ ID NO: 959953 - RNA, 14 nt, Homo sapiens
ucuggcuuugcucu

SEQ ID NO: 959954 - RNA, 22 nt, Homo sapiens
ucuggggcgcggccacagggga

SEQ ID NO: 959955 - RNA, 20 nt, Homo sapiens
ucuggggugcugagugagcu

SEQ ID NO: 959956 - RNA, 16 nt, Homo sapiens
ucuguaaacuguguau

SEQ ID NO: 959957 - RNA, 13 nt, Homo sapiens
ucuguacagauca

SEQ ID NO: 959958 - RNA, 16 nt, Homo sapiens
ucuguaggaaccgugg

SEQ ID NO: 959959 - RNA, 18 nt, Homo sapiens
ucuguccuuuaugauccc

SEQ ID NO: 959960 - RNA, 13 nt, Homo sapiens
ucugucuaccugg

SEQ ID NO: 959961 - RNA, 18 nt, Homo sapiens
ucugugugugauuugcua

SEQ ID NO: 959962 - RNA, 20 nt, Homo sapiens
ucuguuaauagucaucacau

SEQ ID NO: 959963 - RNA, 19 nt, Homo sapiens
ucuguuugggggaauuugu

SEQ ID NO: 959964 - RNA, 21 nt, Homo sapiens
ucuuaacuggucuccuugcuu

SEQ ID NO: 959965 - RNA, 22 nt, Homo sapiens
ucuuaaguggucuagucaagga

SEQ ID NO: 959966 - RNA, 13 nt, Homo sapiens
ucuuacaugcauu

SEQ ID NO: 959967 - RNA, 16 nt, Homo sapiens
ucuuacaugcauuuga

SEQ ID NO: 959968 - RNA, 20 nt, Homo sapiens
ucuuacuucccuaaugaagu

SEQ ID NO: 959969 - RNA, 20 nt, Homo sapiens
ucuuagaagcacuacaccuu

SEQ ID NO: 959970 - RNA, 13 nt, Homo sapiens
ucuuagcuauguu

SEQ ID NO: 959971 - RNA, 14 nt, Homo sapiens
ucuucaauggaaua

SEQ ID NO: 959972 - RNA, 18 nt, Homo sapiens
ugaaaauauagacauucu

SEQ ID NO: 959973 - RNA, 13 nt, Homo sapiens
ugaaaaugacauu

SEQ ID NO: 959974 - RNA, 17 nt, Homo sapiens
ugaaacgucauguguuu

SEQ ID NO: 959975 - RNA, 16 nt, Homo sapiens
ugaaacguuuaugcuu

SEQ ID NO: 959976 - RNA, 14 nt, Homo sapiens
ugaaacuaacagau

SEQ ID NO: 959977 - RNA, 23 nt, Homo sapiens
ugaaacuaacagauaagcaagag

SEQ ID NO: 959978 - RNA, 23 nt, Homo sapiens
ugaaaguagagcuagcugccacu

SEQ ID NO: 959979 - RNA, 15 nt, Homo sapiens
ugaaaguuaacauua

SEQ ID NO: 959980 - RNA, 15 nt, Homo sapiens
ugaaauaacuaccuu

SEQ ID NO: 959981 - RNA, 19 nt, Homo sapiens
ugaaauauuuucuacuuua

SEQ ID NO: 959982 - RNA, 15 nt, Homo sapiens
ugaaaugaaaacaug

SEQ ID NO: 959983 - RNA, 16 nt, Homo sapiens
ugaaauguucugucaa

SEQ ID NO: 959984 - RNA, 16 nt, Homo sapiens
ugaaauuuaagcacaa

SEQ ID NO: 959985 - RNA, 13 nt, Homo sapiens
ugaacacaguguc

SEQ ID NO: 959986 - RNA, 20 nt, Homo sapiens
ugaacaccuauugcacuugg

SEQ ID NO: 959987 - RNA, 14 nt, Homo sapiens
ugaaccauggugaa

SEQ ID NO: 959988 - RNA, 15 nt, Homo sapiens
ugaagcuaaugucac

SEQ ID NO: 959989 - RNA, 16 nt, Homo sapiens
ugaaggaaaaacacaa

SEQ ID NO: 959990 - RNA, 15 nt, Homo sapiens
ugaaggcccugcuga

SEQ ID NO: 959991 - RNA, 22 nt, Homo sapiens
ugaagguaacuagaaagugagu

SEQ ID NO: 959992 - RNA, 22 nt, Homo sapiens
ugaaguuauggcuucacauuca

SEQ ID NO: 959993 - RNA, 14 nt, Homo sapiens
ugaauacuugcuau

SEQ ID NO: 959994 - RNA, 23 nt, Homo sapiens
ugaauagccuggccaccagccau

SEQ ID NO: 959995 - RNA, 13 nt, Homo sapiens
ugaauagucucau

SEQ ID NO: 959996 - RNA, 22 nt, Homo sapiens
ugaauauaaauuuguguucuca

SEQ ID NO: 959997 - RNA, 13 nt, Homo sapiens
ugaauauguagua

SEQ ID NO: 959998 - RNA, 14 nt, Homo sapiens
ugaauuauuguuau

SEQ ID NO: 959999 - RNA, 14 nt, Homo sapiens
ugaauuggcuaugc

SEQ ID NO: 960000 - RNA, 20 nt, Homo sapiens
ugacaagugacuuauuugcu

SEQ ID NO: 960001 - RNA, 15 nt, Homo sapiens
ugacaagugccuuca

SEQ ID NO: 960002 - RNA, 15 nt, Homo sapiens
ugacacaaagcuucu

SEQ ID NO: 960003 - RNA, 13 nt, Homo sapiens
ugacacauaugca

SEQ ID NO: 960004 - RNA, 16 nt, Homo sapiens
ugacacauaugcaccu

SEQ ID NO: 960005 - RNA, 18 nt, Homo sapiens
ugacaccacuuagauuua

SEQ ID NO: 960006 - RNA, 17 nt, Homo sapiens
ugacagaaggugccacu

SEQ ID NO: 960007 - RNA, 15 nt, Homo sapiens
ugacauaaguaacuu

SEQ ID NO: 960008 - RNA, 20 nt, Homo sapiens
ugacauucacuuccagagag

SEQ ID NO: 960009 - RNA, 17 nt, Homo sapiens
ugaccaaacagccaaga

SEQ ID NO: 960010 - RNA, 18 nt, Homo sapiens
ugaccaagacugagccag

SEQ ID NO: 960011 - RNA, 22 nt, Homo sapiens
ugaccacucuucuuuaagccau

SEQ ID NO: 960012 - RNA, 17 nt, Homo sapiens
ugacccagggacucucc

SEQ ID NO: 960013 - RNA, 12 nt, Homo sapiens
ugaccccagugu

SEQ ID NO: 960014 - RNA, 23 nt, Homo sapiens
ugaccccuguccccacacugacc

SEQ ID NO: 960015 - RNA, 22 nt, Homo sapiens
ugaccuaccucaaagggcaguu

SEQ ID NO: 960016 - RNA, 15 nt, Homo sapiens
ugaccuguguucccu

SEQ ID NO: 960017 - RNA, 11 nt, Homo sapiens
ugacuaaagag

SEQ ID NO: 960018 - RNA, 13 nt, Homo sapiens
ugacucugagcua

SEQ ID NO: 960019 - RNA, 18 nt, Homo sapiens
ugagaaaagccucuccag

SEQ ID NO: 960020 - RNA, 22 nt, Homo sapiens
ugagaaacuuugaucucugcuu

SEQ ID NO: 960021 - RNA, 18 nt, Homo sapiens
ugagagaauaaaaacuuc

SEQ ID NO: 960022 - RNA, 12 nt, Homo sapiens
ugagaguauuua

SEQ ID NO: 960023 - RNA, 15 nt, Homo sapiens
ugagaucacuacuca

SEQ ID NO: 960024 - RNA, 15 nt, Homo sapiens
ugagccugaaaaccu

SEQ ID NO: 960025 - RNA, 17 nt, Homo sapiens
ugagccugaaccuuaau

SEQ ID NO: 960026 - RNA, 18 nt, Homo sapiens
ugagcuugauuaaaucaa

SEQ ID NO: 960027 - RNA, 13 nt, Homo sapiens
ugaggagugccag

SEQ ID NO: 960028 - RNA, 18 nt, Homo sapiens
ugaggagugccagcucaa

SEQ ID NO: 960029 - RNA, 21 nt, Homo sapiens
ugaggcccauucuucacucug

SEQ ID NO: 960030 - RNA, 13 nt, Homo sapiens
ugaggcuccgccc

SEQ ID NO: 960031 - RNA, 19 nt, Homo sapiens
ugaguaaacugagacuuaa

SEQ ID NO: 960032 - RNA, 18 nt, Homo sapiens
ugaguaagcccucaggag

SEQ ID NO: 960033 - RNA, 15 nt, Homo sapiens
ugagucaaagacuua

SEQ ID NO: 960034 - RNA, 21 nt, Homo sapiens
ugagucagagccaugucuucu

SEQ ID NO: 960035 - RNA, 17 nt, Homo sapiens
ugaguuacuucccuuag

SEQ ID NO: 960036 - RNA, 15 nt, Homo sapiens
ugauacaaauuccac

SEQ ID NO: 960037 - RNA, 14 nt, Homo sapiens
ugauacaacauuaa

SEQ ID NO: 960038 - RNA, 16 nt, Homo sapiens
ugauagaaaagugugg

SEQ ID NO: 960039 - RNA, 19 nt, Homo sapiens
ugauagauguagucuugac

SEQ ID NO: 960040 - RNA, 19 nt, Homo sapiens
ugauauuuucacacuggua

SEQ ID NO: 960041 - RNA, 19 nt, Homo sapiens
ugaucacuuuugcacauuc

SEQ ID NO: 960042 - RNA, 13 nt, Homo sapiens
ugaucucugggag

SEQ ID NO: 960043 - RNA, 22 nt, Homo sapiens
ugaugaaagugcuucauugacu

SEQ ID NO: 960044 - RNA, 18 nt, Homo sapiens
ugaugaauaaaaugaagg

SEQ ID NO: 960045 - RNA, 16 nt, Homo sapiens
ugaugcaagccagcuu

SEQ ID NO: 960046 - RNA, 14 nt, Homo sapiens
ugauggacacucca

SEQ ID NO: 960047 - RNA, 20 nt, Homo sapiens
ugaugggccacaacugucuu

SEQ ID NO: 960048 - RNA, 23 nt, Homo sapiens
ugaugguguggccuguggcuguc

SEQ ID NO: 960049 - RNA, 20 nt, Homo sapiens
ugauguacagauucuuucag

SEQ ID NO: 960050 - RNA, 21 nt, Homo sapiens
ugauugggaaaacauuugcug

SEQ ID NO: 960051 - RNA, 23 nt, Homo sapiens
ugcaaaauauuugacuauucugu

SEQ ID NO: 960052 - RNA, 13 nt, Homo sapiens
ugcaaagcaacua

SEQ ID NO: 960053 - RNA, 19 nt, Homo sapiens
ugcaaaggcgucugaaugu

SEQ ID NO: 960054 - RNA, 21 nt, Homo sapiens
ugcaaccucuuugcucaacag

SEQ ID NO: 960055 - RNA, 22 nt, Homo sapiens
ugcaacugggucugacaugaac

SEQ ID NO: 960056 - RNA, 23 nt, Homo sapiens
ugcaaguggccauuaccaucucu

SEQ ID NO: 960057 - RNA, 12 nt, Homo sapiens
ugcacaaggugg

SEQ ID NO: 960058 - RNA, 18 nt, Homo sapiens
ugcacagaagcacaugca

SEQ ID NO: 960059 - RNA, 21 nt, Homo sapiens
ugcacagcuaaguguggagcu

SEQ ID NO: 960060 - RNA, 21 nt, Homo sapiens
ugcacaggcagauguuugccu

SEQ ID NO: 960061 - RNA, 12 nt, Homo sapiens
ugcaccuaccca

SEQ ID NO: 960062 - RNA, 17 nt, Homo sapiens
uuuguacauagcaaaua

SEQ ID NO: 960063 - RNA, 21 nt, Homo sapiens
uuuguagcuggggcuuugaug

SEQ ID NO: 960064 - RNA, 17 nt, Homo sapiens
uuugucuuggauauaua

SEQ ID NO: 960065 - RNA, 13 nt, Homo sapiens
uuugugagccagc

SEQ ID NO: 960066 - RNA, 20 nt, Homo sapiens
uuugugggauuuuaguaaga

SEQ ID NO: 960067 - RNA, 15 nt, Homo sapiens
uuuguugagcaugac

SEQ ID NO: 960068 - RNA, 17 nt, Homo sapiens
uuuguuugccaggacau

SEQ ID NO: 960069 - RNA, 17 nt, Homo sapiens
uuuuaaaacccauuuaa

SEQ ID NO: 960070 - RNA, 13 nt, Homo sapiens
uuuuaaauuguca

SEQ ID NO: 960071 - RNA, 19 nt, Homo sapiens
uuuuaauuacugcuauaaa

SEQ ID NO: 960072 - RNA, 15 nt, Homo sapiens
uuuuaauuuacuugu

SEQ ID NO: 960073 - RNA, 17 nt, Homo sapiens
uuuuacuucucuauaca

SEQ ID NO: 960074 - RNA, 15 nt, Homo sapiens
uuuuagccacucaaa

SEQ ID NO: 960075 - RNA, 22 nt, Homo sapiens
uuuuauggacaguaaguccagu

SEQ ID NO: 960076 - RNA, 19 nt, Homo sapiens
uuuucaagcaaaacaguuc

SEQ ID NO: 960077 - RNA, 13 nt, Homo sapiens
uuuucacuuugaa

SEQ ID NO: 960078 - RNA, 13 nt, Homo sapiens
uuuucagggcugg

SEQ ID NO: 960079 - RNA, 17 nt, Homo sapiens
uuuucaguuuuaccucu

SEQ ID NO: 960080 - RNA, 11 nt, Homo sapiens
uuuuccagaac

SEQ ID NO: 960081 - RNA, 12 nt, Homo sapiens
uuuuccuauaau

SEQ ID NO: 960082 - RNA, 15 nt, Homo sapiens
uuuucucugcauuua

SEQ ID NO: 960083 - RNA, 14 nt, Homo sapiens
uuuugcaugcaugc

SEQ ID NO: 960084 - RNA, 11 nt, Homo sapiens
uuuugcugcua

SEQ ID NO: 960085 - RNA, 14 nt, Homo sapiens
uuuuggaaagucag

SEQ ID NO: 960086 - RNA, 23 nt, Homo sapiens
uuuuggcaaugacucaaagucug

SEQ ID NO: 960087 - RNA, 15 nt, Homo sapiens
uuuuuccccaaaguc

SEQ ID NO: 960088 - RNA, 19 nt, Homo sapiens
uuuuucucuuugugguuuc

SEQ ID NO: 960089 - RNA, 13 nt, Homo sapiens
uuuuuguuauuaa

SEQ ID NO: 960090 - RNA, 15 nt, Homo sapiens
uauuuacaagggaag

SEQ ID NO: 960091 - RNA, 16 nt, Homo sapiens
uauuuauguguucaca

SEQ ID NO: 960092 - RNA, 20 nt, Homo sapiens
uauuuccuuuaugugaauuu

SEQ ID NO: 960093 - RNA, 16 nt, Homo sapiens
uauuuggaaugaagga

SEQ ID NO: 960094 - RNA, 11 nt, Homo sapiens
uauuugucauu

SEQ ID NO: 960095 - RNA, 23 nt, Homo sapiens
uauuuuaaauuauggaacugcua

SEQ ID NO: 960096 - RNA, 17 nt, Homo sapiens
uauuuugaauauguaaa

SEQ ID NO: 960097 - RNA, 14 nt, Homo sapiens
uauuuuucaggaaa

SEQ ID NO: 960098 - RNA, 14 nt, Homo sapiens
uauuuuuuuuacug

SEQ ID NO: 960099 - RNA, 23 nt, Homo sapiens
ucaaaaaccauauuugcauucca

SEQ ID NO: 960100 - RNA, 21 nt, Homo sapiens
ucaaaaguugguguugacaua

SEQ ID NO: 960101 - RNA, 16 nt, Homo sapiens
ucaaacgacagaggag

SEQ ID NO: 960102 - RNA, 17 nt, Homo sapiens
ucaaagcagaagucugg

SEQ ID NO: 960103 - RNA, 16 nt, Homo sapiens
ucaaaggagcuuucuc

SEQ ID NO: 960104 - RNA, 17 nt, Homo sapiens
ucaaaggagcuuucuca

SEQ ID NO: 960105 - RNA, 14 nt, Homo sapiens
ucaaagggaaacuu

SEQ ID NO: 960106 - RNA, 22 nt, Homo sapiens
ucaaaguuuugaaaagcuauua

SEQ ID NO: 960107 - RNA, 22 nt, Homo sapiens
ucaaauacacauuugcuacugu

SEQ ID NO: 960108 - RNA, 19 nt, Homo sapiens
ucaaauucuucugaacuca

SEQ ID NO: 960109 - RNA, 13 nt, Homo sapiens
uugauaccuguag

SEQ ID NO: 960110 - RNA, 14 nt, Homo sapiens
uugaucucugcuua

SEQ ID NO: 960111 - RNA, 14 nt, Homo sapiens
uugaugguauucau

SEQ ID NO: 960112 - RNA, 14 nt, Homo sapiens
uugauggucucaag

SEQ ID NO: 960113 - RNA, 22 nt, Homo sapiens
uugauugggaaaacauuugcug

SEQ ID NO: 960114 - RNA, 19 nt, Homo sapiens
uugcaagacccucccaugg

SEQ ID NO: 960115 - RNA, 15 nt, Homo sapiens
uugcacuagagaaaa

SEQ ID NO: 960116 - RNA, 17 nt, Homo sapiens
uugcauacccaaaccag

SEQ ID NO: 960117 - RNA, 19 nt, Homo sapiens
uugcauuccagaaccaaau

SEQ ID NO: 960118 - RNA, 12 nt, Homo sapiens
uugccacuuaac

SEQ ID NO: 960119 - RNA, 17 nt, Homo sapiens
uugccaggacaugcaau

SEQ ID NO: 960120 - RNA, 18 nt, Homo sapiens
uugccauuuguagcuuug

SEQ ID NO: 960121 - RNA, 19 nt, Homo sapiens
uugcccccagauacauggu

SEQ ID NO: 960122 - RNA, 17 nt, Homo sapiens
uugcguggacucugcac

SEQ ID NO: 960123 - RNA, 15 nt, Homo sapiens
uugcuaccucaaggg

SEQ ID NO: 960124 - RNA, 14 nt, Homo sapiens
uugcucaaagggaa

SEQ ID NO: 960125 - RNA, 20 nt, Homo sapiens
uugcuccagauucugaugca

SEQ ID NO: 960126 - RNA, 23 nt, Homo sapiens
uugcugacaaccauuaaagucag

SEQ ID NO: 960127 - RNA, 22 nt, Homo sapiens
uugcuguaacucagacauucca

SEQ ID NO: 960128 - RNA, 17 nt, Homo sapiens
uugcuuuugacuccagg

SEQ ID NO: 960129 - RNA, 20 nt, Homo sapiens
uuggaaaaaaaccacagcca

SEQ ID NO: 960130 - RNA, 17 nt, Homo sapiens
uuggaaaaaacucugaa

SEQ ID NO: 960131 - RNA, 19 nt, Homo sapiens
uuggacuguaagggauuga

SEQ ID NO: 960132 - RNA, 15 nt, Homo sapiens
uuggccugcugugau

SEQ ID NO: 960133 - RNA, 15 nt, Homo sapiens
uuggcuucugugaug

SEQ ID NO: 960134 - RNA, 14 nt, Homo sapiens
uugggcaugccauu

SEQ ID NO: 960135 - RNA, 15 nt, Homo sapiens
uugggcucugaugaa

SEQ ID NO: 960136 - RNA, 10 nt, Homo sapiens
uuggggacuc

SEQ ID NO: 960137 - RNA, 16 nt, Homo sapiens
uuggggccaccaaagc

SEQ ID NO: 960138 - RNA, 13 nt, Homo sapiens
aaaacauuugcug

SEQ ID NO: 960139 - RNA, 10 nt, Homo sapiens
aaaacauuuu

SEQ ID NO: 960140 - RNA, 22 nt, Homo sapiens
aaaaccaaguaucacacuuuaa

SEQ ID NO: 960141 - RNA, 21 nt, Homo sapiens
aaaaccccaucuuuacuaaaa

SEQ ID NO: 960142 - RNA, 15 nt, Homo sapiens
aaaagaaugacuaua

SEQ ID NO: 960143 - RNA, 14 nt, Homo sapiens
aaaagaucuugaau

SEQ ID NO: 960144 - RNA, 18 nt, Homo sapiens
aaaagcaccacuguucug

SEQ ID NO: 960145 - RNA, 13 nt, Homo sapiens
aaaagccagccag

SEQ ID NO: 960146 - RNA, 20 nt, Homo sapiens
aaaaggaaagcuguguuuau

SEQ ID NO: 960147 - RNA, 23 nt, Homo sapiens
aaaagggaauuaugaguuuuuca

SEQ ID NO: 960148 - RNA, 14 nt, Homo sapiens
aaaaguaaugacuu

SEQ ID NO: 960149 - RNA, 20 nt, Homo sapiens
aaaagucccucccugccuga

SEQ ID NO: 960150 - RNA, 19 nt, Homo sapiens
aaaaguugguguugacaua

SEQ ID NO: 960151 - RNA, 19 nt, Homo sapiens
aaaauagccuauccuuaau

SEQ ID NO: 960152 - RNA, 16 nt, Homo sapiens
aaaauaguaaagccaa

SEQ ID NO: 960153 - RNA, 17 nt, Homo sapiens
aaaauauguaauuucaa

SEQ ID NO: 960154 - RNA, 17 nt, Homo sapiens
aaaaugauaaacaaguc

SEQ ID NO: 960155 - RNA, 19 nt, Homo sapiens
aaaaugugcuauacugcau

SEQ ID NO: 960156 - RNA, 12 nt, Homo sapiens
aaaauguuuaau

SEQ ID NO: 960157 - RNA, 13 nt, Homo sapiens
aaaauuaugucca

SEQ ID NO: 960158 - RNA, 15 nt, Homo sapiens
aaaauucaaccacag

SEQ ID NO: 960159 - RNA, 18 nt, Homo sapiens
aaaauuccucuuacugua

SEQ ID NO: 960160 - RNA, 14 nt, Homo sapiens
aaaauuugucuuaa

SEQ ID NO: 960161 - RNA, 18 nt, Homo sapiens
aaaauuuuguauguuaaa

SEQ ID NO: 960162 - RNA, 22 nt, Homo sapiens
aaacagccuucuagcacacuuu

SEQ ID NO: 960163 - RNA, 22 nt, Homo sapiens
aaacagcuuccuguuacugaga

SEQ ID NO: 960164 - RNA, 16 nt, Homo sapiens
aaacaggaacaaucca

SEQ ID NO: 960165 - RNA, 18 nt, Homo sapiens
aaacauaaucuucugccu

SEQ ID NO: 960166 - RNA, 16 nt, Homo sapiens
aaacauccuugcaaau

SEQ ID NO: 960167 - RNA, 21 nt, Homo sapiens
aaacaucuaauaaguauauaa

SEQ ID NO: 960168 - RNA, 14 nt, Homo sapiens
aaacauguauguaa

SEQ ID NO: 960169 - RNA, 12 nt, Homo sapiens
aaaccaacaaaa

SEQ ID NO: 960170 - RNA, 15 nt, Homo sapiens
aaaccaaguaucaca

SEQ ID NO: 960171 - RNA, 16 nt, Homo sapiens
aaaccaccaucuucua

SEQ ID NO: 960172 - RNA, 17 nt, Homo sapiens
aaaccaccgugaaccag

SEQ ID NO: 960173 - RNA, 17 nt, Homo sapiens
aaaccaggaacucugga

SEQ ID NO: 960174 - RNA, 23 nt, Homo sapiens
aaacccaagugccuucagaggau

SEQ ID NO: 960175 - RNA, 13 nt, Homo sapiens
aaaccccgucucu

SEQ ID NO: 960176 - RNA, 22 nt, Homo sapiens
aaacccuauacaaguuguucua

SEQ ID NO: 960177 - RNA, 13 nt, Homo sapiens
aaacccucuccau

SEQ ID NO: 960178 - RNA, 17 nt, Homo sapiens
aaacccugcugaacaca

SEQ ID NO: 960179 - RNA, 16 nt, Homo sapiens
aaacccuuauacucac

SEQ ID NO: 960180 - RNA, 17 nt, Homo sapiens
aaacggaggccagagag

SEQ ID NO: 960181 - RNA, 17 nt, Homo sapiens
aaacguuaguuaauccc

SEQ ID NO: 960182 - RNA, 12 nt, Homo sapiens
aaacuaagccag

SEQ ID NO: 960183 - RNA, 13 nt, Homo sapiens
aaacuaagccagg

SEQ ID NO: 960184 - RNA, 18 nt, Homo sapiens
aaacucagaucugaucaa

SEQ ID NO: 960185 - RNA, 20 nt, Homo sapiens
aaacugaagcugcacagugu

SEQ ID NO: 960186 - RNA, 15 nt, Homo sapiens
aaacuguauuuacuu

SEQ ID NO: 960187 - RNA, 13 nt, Homo sapiens
aaacuuacuuugg

SEQ ID NO: 960188 - RNA, 22 nt, Homo sapiens
aaacuuaucacgccuacuuaag

SEQ ID NO: 960189 - RNA, 22 nt, Homo sapiens
aaacuuauuugcugcagaauuu

SEQ ID NO: 960190 - RNA, 19 nt, Homo sapiens
aaacuuggaugucacugcc

SEQ ID NO: 960191 - RNA, 20 nt, Homo sapiens
aaacuuggaugucacugccu

SEQ ID NO: 960192 - RNA, 18 nt, Homo sapiens
aaagaaaggaacuaaguc

SEQ ID NO: 960193 - RNA, 12 nt, Homo sapiens
aaagaaauggaa

SEQ ID NO: 960194 - RNA, 17 nt, Homo sapiens
aaagagacuccgucuca

SEQ ID NO: 960195 - RNA, 22 nt, Homo sapiens
aaagaggcugccccucucacca

SEQ ID NO: 960196 - RNA, 17 nt, Homo sapiens
aaagagggcuuccucua

SEQ ID NO: 960197 - RNA, 20 nt, Homo sapiens
aaagaucuugaauagucuca

SEQ ID NO: 960198 - RNA, 22 nt, Homo sapiens
aaagaucuugaauagucucauc

SEQ ID NO: 960199 - RNA, 22 nt, Homo sapiens
aaagcacuccugcuuaaucuuc

SEQ ID NO: 960200 - RNA, 13 nt, Homo sapiens
aaagcauaaagcu

SEQ ID NO: 960201 - RNA, 12 nt, Homo sapiens
aaagcuacugua

SEQ ID NO: 960202 - RNA, 17 nt, Homo sapiens
aaagcucaaaguaugca

SEQ ID NO: 960203 - RNA, 15 nt, Homo sapiens
aaagcucacuguagc

SEQ ID NO: 960204 - RNA, 15 nt, Homo sapiens
aaagcugcccacugu

SEQ ID NO: 960205 - RNA, 24 nt, Homo sapiens
aaagcuguuccuugguccuaguaa

SEQ ID NO: 960206 - RNA, 22 nt, Homo sapiens
aaagggauguuauuauccuugg

SEQ ID NO: 960207 - RNA, 16 nt, Homo sapiens
aaaguaaaauaguuua

SEQ ID NO: 960208 - RNA, 17 nt, Homo sapiens
aaaguaaauacaugcau

SEQ ID NO: 960209 - RNA, 19 nt, Homo sapiens
aaagucccucccugccuga

SEQ ID NO: 960210 - RNA, 19 nt, Homo sapiens
aaagugcugagauugcaga

SEQ ID NO: 960211 - RNA, 18 nt, Homo sapiens
aaagugcuucauugacua

SEQ ID NO: 960212 - RNA, 13 nt, Homo sapiens
aaagugugugauu

SEQ ID NO: 960213 - RNA, 13 nt, Homo sapiens
aaauaaaacugag

SEQ ID NO: 960214 - RNA, 12 nt, Homo sapiens
aaauaacuaccu

SEQ ID NO: 960215 - RNA, 15 nt, Homo sapiens
aaauacacauuugcu

SEQ ID NO: 960216 - RNA, 19 nt, Homo sapiens
aaauacagcugcacugagg

SEQ ID NO: 960217 - RNA, 20 nt, Homo sapiens
aaauagaaaauaugaccaga

SEQ ID NO: 960218 - RNA, 14 nt, Homo sapiens
aaauaggugagaua

SEQ ID NO: 960219 - RNA, 13 nt, Homo sapiens
aaauagucacuca

SEQ ID NO: 960220 - RNA, 23 nt, Homo sapiens
aaauaguuuaucauuuacugugu

SEQ ID NO: 960221 - RNA, 16 nt, Homo sapiens
aaauauaagacauuug

SEQ ID NO: 960222 - RNA, 19 nt, Homo sapiens
aaauauagacauucucaca

SEQ ID NO: 960223 - RNA, 17 nt, Homo sapiens
aaauaugccuaguaaca

SEQ ID NO: 960224 - RNA, 19 nt, Homo sapiens
aaauaugcuauauauuagg

SEQ ID NO: 960225 - RNA, 23 nt, Homo sapiens
aaauauuucccauuugugccaga

SEQ ID NO: 960226 - RNA, 19 nt, Homo sapiens
aaauauuucucaacugagg

SEQ ID NO: 960227 - RNA, 16 nt, Homo sapiens
aaaucauucagaucau

SEQ ID NO: 960228 - RNA, 16 nt, Homo sapiens
aaauccacaagccauu

SEQ ID NO: 960229 - RNA, 20 nt, Homo sapiens
aaaucucgcacuacaucuga

SEQ ID NO: 960230 - RNA, 19 nt, Homo sapiens
aaaucucuuccacaugggu

SEQ ID NO: 960231 - RNA, 19 nt, Homo sapiens
aaaucuucccaugcauucu

SEQ ID NO: 960232 - RNA, 13 nt, Homo sapiens
aaaugacauuaaa

SEQ ID NO: 960233 - RNA, 11 nt, Homo sapiens
aaaugcauucg

SEQ ID NO: 960234 - RNA, 19 nt, Homo sapiens
aaaugccugcuuugaauaa

SEQ ID NO: 960235 - RNA, 22 nt, Homo sapiens
aaaugcuacgcacguggagcug

SEQ ID NO: 960236 - RNA, 20 nt, Homo sapiens
aaaugcugugaaugcagaau

SEQ ID NO: 960237 - RNA, 17 nt, Homo sapiens
aaauggaaacaccacug

SEQ ID NO: 960238 - RNA, 15 nt, Homo sapiens
aaauggccaaauaua

SEQ ID NO: 960239 - RNA, 21 nt, Homo sapiens
aaauguggaauugacugccua

SEQ ID NO: 960240 - RNA, 17 nt, Homo sapiens
aaauuaagaaaucauuc

SEQ ID NO: 960241 - RNA, 19 nt, Homo sapiens
aaauuauaucaaggucuca

SEQ ID NO: 960242 - RNA, 15 nt, Homo sapiens
aaauucaaaccauuu

SEQ ID NO: 960243 - RNA, 15 nt, Homo sapiens
aaauucaacuuugua

SEQ ID NO: 960244 - RNA, 13 nt, Homo sapiens
aaauucauuauuc

SEQ ID NO: 960245 - RNA, 13 nt, Homo sapiens
aaauuccuaucuc

SEQ ID NO: 960246 - RNA, 14 nt, Homo sapiens
aaauuccuaucuca

SEQ ID NO: 960247 - RNA, 14 nt, Homo sapiens
aaauugccaagaaa

SEQ ID NO: 960248 - RNA, 23 nt, Homo sapiens
aaauugccaagaaaaacaacuuu

SEQ ID NO: 960249 - RNA, 22 nt, Homo sapiens
aaauuguacaagauaaguucca

SEQ ID NO: 960250 - RNA, 18 nt, Homo sapiens
aaauuuaauaccagauac

SEQ ID NO: 960251 - RNA, 15 nt, Homo sapiens
aaauuuuuauguaau

SEQ ID NO: 960252 - RNA, 23 nt, Homo sapiens
aacaaaaaucuguguaacuguaa

SEQ ID NO: 960253 - RNA, 18 nt, Homo sapiens
cccagagguaacagaaca

SEQ ID NO: 960254 - RNA, 15 nt, Homo sapiens
cccagagguggaugu

SEQ ID NO: 960255 - RNA, 13 nt, Homo sapiens
cccagagugagcu

SEQ ID NO: 960256 - RNA, 23 nt, Homo sapiens
cccagagugagcuuuagcucucu

SEQ ID NO: 960257 - RNA, 19 nt, Homo sapiens
cccagauuccccuguguca

SEQ ID NO: 960258 - RNA, 24 nt, Homo sapiens
cccagcaaaggggagucucagcuu

SEQ ID NO: 960259 - RNA, 15 nt, Homo sapiens
cccagcauccagcug

SEQ ID NO: 960260 - RNA, 18 nt, Homo sapiens
cccagccaggcagggggc

SEQ ID NO: 960261 - RNA, 14 nt, Homo sapiens
cccagccaugccag

SEQ ID NO: 960262 - RNA, 22 nt, Homo sapiens
cccagcccucggguccauagag

SEQ ID NO: 960263 - RNA, 19 nt, Homo sapiens
cccagccuccccgugccaa

SEQ ID NO: 960264 - RNA, 18 nt, Homo sapiens
cccagcugccuagauuca

SEQ ID NO: 960265 - RNA, 14 nt, Homo sapiens
cccaggcugucacc

SEQ ID NO: 960266 - RNA, 15 nt, Homo sapiens
cccagggaacagcca

SEQ ID NO: 960267 - RNA, 17 nt, Homo sapiens
cccagggcacuacauaa

SEQ ID NO: 960268 - RNA, 24 nt, Homo sapiens
cccagggcacuacauaauugcugu

SEQ ID NO: 960269 - RNA, 23 nt, Homo sapiens
cccagguggcccuaaaggacucu

SEQ ID NO: 960270 - RNA, 18 nt, Homo sapiens
cccaguggacucuuccac

SEQ ID NO: 960271 - RNA, 21 nt, Homo sapiens
cccaguucaucaccauuuccu

SEQ ID NO: 960272 - RNA, 12 nt, Homo sapiens
cccauacugguu

SEQ ID NO: 960273 - RNA, 17 nt, Homo sapiens
cccauuucaauuccugu

SEQ ID NO: 960274 - RNA, 16 nt, Homo sapiens
cccauuugucccagac

SEQ ID NO: 960275 - RNA, 15 nt, Homo sapiens
ccccaacuccaggaa

SEQ ID NO: 960276 - RNA, 15 nt, Homo sapiens
ccccaccacauagca

SEQ ID NO: 960277 - RNA, 21 nt, Homo sapiens
ccccaccuuugggaucagccu

SEQ ID NO: 960278 - RNA, 12 nt, Homo sapiens
ccccacuuugaa

SEQ ID NO: 960279 - RNA, 14 nt, Homo sapiens
ccccagagcucuuu

SEQ ID NO: 960280 - RNA, 13 nt, Homo sapiens
ccccaucugucca

SEQ ID NO: 960281 - RNA, 18 nt, Homo sapiens
ccccucaguguugucacc

SEQ ID NO: 960282 - RNA, 12 nt, Homo sapiens
ccccucaugccu

SEQ ID NO: 960283 - RNA, 15 nt, Homo sapiens
ccccuccuccaggga

SEQ ID NO: 960284 - RNA, 21 nt, Homo sapiens
ccccucucccuugggcucuga

SEQ ID NO: 960285 - RNA, 16 nt, Homo sapiens
ccccugugucauccca

SEQ ID NO: 960286 - RNA, 22 nt, Homo sapiens
ccccuuccagaucacugccaca

SEQ ID NO: 960287 - RNA, 17 nt, Homo sapiens
cccgccaugcucaggag

SEQ ID NO: 960288 - RNA, 14 nt, Homo sapiens
cccgcuagcauuag

SEQ ID NO: 960289 - RNA, 23 nt, Homo sapiens
cccgggagacugaacugcagggu

SEQ ID NO: 960290 - RNA, 16 nt, Homo sapiens
cccgggggugaagggg

SEQ ID NO: 960291 - RNA, 13 nt, Homo sapiens
cccuacaccaagu

SEQ ID NO: 960292 - RNA, 16 nt, Homo sapiens
cccuagccaaugucuc

SEQ ID NO: 960293 - RNA, 12 nt, Homo sapiens
cccuauggugcu

SEQ ID NO: 960294 - RNA, 16 nt, Homo sapiens
cccucaacugaagggg

SEQ ID NO: 960295 - RNA, 20 nt, Homo sapiens
cccucaggagccucugcucc

SEQ ID NO: 960296 - RNA, 11 nt, Homo sapiens
cccucaugcaa

SEQ ID NO: 960297 - RNA, 15 nt, Homo sapiens
cccuccagccagaga

SEQ ID NO: 960298 - RNA, 21 nt, Homo sapiens
cccucuccuucuccuagcucu

SEQ ID NO: 960299 - RNA, 18 nt, Homo sapiens
cccucugcuguucaggau

SEQ ID NO: 960300 - RNA, 12 nt, Homo sapiens
cccucuucugag

SEQ ID NO: 960301 - RNA, 13 nt, Homo sapiens
cccucuucugagc

SEQ ID NO: 960302 - RNA, 23 nt, Homo sapiens
cccugcagaugccacccuagcca

SEQ ID NO: 960303 - RNA, 15 nt, Homo sapiens
cccugcucauccacu

SEQ ID NO: 960304 - RNA, 16 nt, Homo sapiens
cccugcugagaucugc

SEQ ID NO: 960305 - RNA, 16 nt, Homo sapiens
cccuguagcucugaau

SEQ ID NO: 960306 - RNA, 23 nt, Homo sapiens
cccuguccggaaugccacccaca

SEQ ID NO: 960307 - RNA, 18 nt, Homo sapiens
cccuuaacugcauccagc

SEQ ID NO: 960308 - RNA, 20 nt, Homo sapiens
cccuuaauuauuaacaaagu

SEQ ID NO: 960309 - RNA, 14 nt, Homo sapiens
cccuuauacagugg

SEQ ID NO: 960310 - RNA, 11 nt, Homo sapiens
cccuucacugu

SEQ ID NO: 960311 - RNA, 16 nt, Homo sapiens
cccuucacugucacca

SEQ ID NO: 960312 - RNA, 13 nt, Homo sapiens
cccuuccagauca

SEQ ID NO: 960313 - RNA, 15 nt, Homo sapiens
cccuugagaagccaa

SEQ ID NO: 960314 - RNA, 17 nt, Homo sapiens
cccuugucgugggaugg

SEQ ID NO: 960315 - RNA, 15 nt, Homo sapiens
ccgaaacuaagccag

SEQ ID NO: 960316 - RNA, 16 nt, Homo sapiens
ccgacccacugaccca

SEQ ID NO: 960317 - RNA, 16 nt, Homo sapiens
ccgagcuguggacaaa

SEQ ID NO: 960318 - RNA, 19 nt, Homo sapiens
ccgcaagaaagcaugacuu

SEQ ID NO: 960319 - RNA, 16 nt, Homo sapiens
ccgcagggccaugcag

SEQ ID NO: 960320 - RNA, 12 nt, Homo sapiens
ccgccacuccag

SEQ ID NO: 960321 - RNA, 19 nt, Homo sapiens
ccgccacugggccugucac

SEQ ID NO: 960322 - RNA, 22 nt, Homo sapiens
ccggaagucaucccagugcaca

SEQ ID NO: 960323 - RNA, 14 nt, Homo sapiens
ccgucuugaucgga

SEQ ID NO: 960324 - RNA, 13 nt, Homo sapiens
ccgugccaaaaau

SEQ ID NO: 960325 - RNA, 21 nt, Homo sapiens
ccgugccaaaaaucuuuucau

SEQ ID NO: 960326 - RNA, 14 nt, Homo sapiens
ccgugcguggcacu

SEQ ID NO: 960327 - RNA, 15 nt, Homo sapiens
ccuaaccccuuccag

SEQ ID NO: 960328 - RNA, 19 nt, Homo sapiens
ccuaaggacaagacacuga

SEQ ID NO: 960329 - RNA, 20 nt, Homo sapiens
ccuaauucaauccuacuuuu

SEQ ID NO: 960330 - RNA, 19 nt, Homo sapiens
ccuacagcuacauugagau

SEQ ID NO: 960331 - RNA, 22 nt, Homo sapiens
ccuacaggugcuguucagugcc

SEQ ID NO: 960332 - RNA, 23 nt, Homo sapiens
ccuacauugugcugcaccugguc

SEQ ID NO: 960333 - RNA, 15 nt, Homo sapiens
ccuaccaaaauggaa

SEQ ID NO: 960334 - RNA, 15 nt, Homo sapiens
ccuacccaauuugau

SEQ ID NO: 960335 - RNA, 16 nt, Homo sapiens
ccuacuuugacuuuuu

SEQ ID NO: 960336 - RNA, 19 nt, Homo sapiens
ccuacuuuucuuuccucag

SEQ ID NO: 960337 - RNA, 17 nt, Homo sapiens
ccuagaacacuaacuca

SEQ ID NO: 960338 - RNA, 18 nt, Homo sapiens
ccuaggaggaaaauucca

SEQ ID NO: 960339 - RNA, 20 nt, Homo sapiens
ccuaucagaguugcugcaaa

SEQ ID NO: 960340 - RNA, 16 nt, Homo sapiens
ccuaugcacauaugga

SEQ ID NO: 960341 - RNA, 20 nt, Homo sapiens
ccuaugggucuaggacacag

SEQ ID NO: 960342 - RNA, 21 nt, Homo sapiens
ccuauugugacagagccaugg

SEQ ID NO: 960343 - RNA, 14 nt, Homo sapiens
ccuauuguucacuu

SEQ ID NO: 960344 - RNA, 15 nt, Homo sapiens
ccuauuguucacuuu

SEQ ID NO: 960345 - RNA, 17 nt, Homo sapiens
ccuauuguucacuuuau

SEQ ID NO: 960346 - RNA, 17 nt, Homo sapiens
ccucaaaugcggggugg

SEQ ID NO: 960347 - RNA, 17 nt, Homo sapiens
ccucaacugaaggggug

SEQ ID NO: 960348 - RNA, 23 nt, Homo sapiens
ccucaaucacacugaagccacag

SEQ ID NO: 960349 - RNA, 19 nt, Homo sapiens
ccucacgcucuggacauga

SEQ ID NO: 960350 - RNA, 21 nt, Homo sapiens
ccucagaaagggauugcuuug

SEQ ID NO: 960351 - RNA, 18 nt, Homo sapiens
ccucagguaguacuggga

SEQ ID NO: 960352 - RNA, 15 nt, Homo sapiens
ccucaguuaaaucuc

SEQ ID NO: 960353 - RNA, 22 nt, Homo sapiens
ccucauaaaaaucuagcacacu

SEQ ID NO: 960354 - RNA, 13 nt, Homo sapiens
ccucaugcccagc

SEQ ID NO: 960355 - RNA, 22 nt, Homo sapiens
ccucauuuaaguaaaagguuag

SEQ ID NO: 960356 - RNA, 12 nt, Homo sapiens
ccuccaagcaca

SEQ ID NO: 960357 - RNA, 13 nt, Homo sapiens
ccuccaagcauuu

SEQ ID NO: 960358 - RNA, 20 nt, Homo sapiens
ccucccaaagugcugagauu

SEQ ID NO: 960359 - RNA, 12 nt, Homo sapiens
ccuccugaaccg

SEQ ID NO: 960360 - RNA, 16 nt, Homo sapiens
ccuccuguauuccuga

SEQ ID NO: 960361 - RNA, 12 nt, Homo sapiens
ccucuaaugaga

SEQ ID NO: 960362 - RNA, 15 nt, Homo sapiens
ccucuaguaguauau

SEQ ID NO: 960363 - RNA, 21 nt, Homo sapiens
ccucuauuuuaauuacugcua

SEQ ID NO: 960364 - RNA, 21 nt, Homo sapiens
ccucucccccuccuccaggga

SEQ ID NO: 960365 - RNA, 20 nt, Homo sapiens
ccucucccuugggcucugau

SEQ ID NO: 960366 - RNA, 16 nt, Homo sapiens
ccucugcuguucagga

SEQ ID NO: 960367 - RNA, 15 nt, Homo sapiens
ccucuggacagccag

SEQ ID NO: 960368 - RNA, 20 nt, Homo sapiens
cuggaaaccacacuucuuga

SEQ ID NO: 960369 - RNA, 17 nt, Homo sapiens
cuggacagcagaagccu

SEQ ID NO: 960370 - RNA, 16 nt, Homo sapiens
cuggacaguaucccac

SEQ ID NO: 960371 - RNA, 20 nt, Homo sapiens
cuggagaagaauggcuuuca

SEQ ID NO: 960372 - RNA, 22 nt, Homo sapiens
cuggagcccccagcagaggcag

SEQ ID NO: 960373 - RNA, 17 nt, Homo sapiens
cuggagcucaucugcaa

SEQ ID NO: 960374 - RNA, 16 nt, Homo sapiens
cuggauggcaccucag

SEQ ID NO: 960375 - RNA, 12 nt, Homo sapiens
cuggauggggca

SEQ ID NO: 960376 - RNA, 14 nt, Homo sapiens
cuggauugggagac

SEQ ID NO: 960377 - RNA, 20 nt, Homo sapiens
cuggcagaucaugaagccca

SEQ ID NO: 960378 - RNA, 13 nt, Homo sapiens
cuggccaccagcc

SEQ ID NO: 960379 - RNA, 21 nt, Homo sapiens
cuggcccuugcuuaccucuca

SEQ ID NO: 960380 - RNA, 14 nt, Homo sapiens
cuggcuaacugaug

SEQ ID NO: 960381 - RNA, 14 nt, Homo sapiens
cuggcugagguucc

SEQ ID NO: 960382 - RNA, 16 nt, Homo sapiens
cugggacaaccucauc

SEQ ID NO: 960383 - RNA, 13 nt, Homo sapiens
cugggaggggcaa

SEQ ID NO: 960384 - RNA, 13 nt, Homo sapiens
cugggccaugucc

SEQ ID NO: 960385 - RNA, 16 nt, Homo sapiens
cugggccauguccaaa

SEQ ID NO: 960386 - RNA, 14 nt, Homo sapiens
cugggcucaagcaa

SEQ ID NO: 960387 - RNA, 19 nt, Homo sapiens
cuggggaaacaacauuuau

SEQ ID NO: 960388 - RNA, 16 nt, Homo sapiens
cugggggugucccugg

SEQ ID NO: 960389 - RNA, 14 nt, Homo sapiens
cugggguugagggc

SEQ ID NO: 960390 - RNA, 22 nt, Homo sapiens
cuggguugcugcuguccagugc

SEQ ID NO: 960391 - RNA, 23 nt, Homo sapiens
cuggguugcugcuguccagugcc

SEQ ID NO: 960392 - RNA, 16 nt, Homo sapiens
cugguauauccaaaag

SEQ ID NO: 960393 - RNA, 20 nt, Homo sapiens
cugguauuguuuacguuuga

SEQ ID NO: 960394 - RNA, 16 nt, Homo sapiens
cuggugaaaaaagcca

SEQ ID NO: 960395 - RNA, 16 nt, Homo sapiens
cuggugggcggggcca

SEQ ID NO: 960396 - RNA, 15 nt, Homo sapiens
cugguuuucugccaa

SEQ ID NO: 960397 - RNA, 17 nt, Homo sapiens
cugguuuucugccaaug

SEQ ID NO: 960398 - RNA, 15 nt, Homo sapiens
cuguaaacuguguau

SEQ ID NO: 960399 - RNA, 20 nt, Homo sapiens
cuguaaggcaggcccauuca

SEQ ID NO: 960400 - RNA, 14 nt, Homo sapiens
cuguaauuccagcu

SEQ ID NO: 960401 - RNA, 20 nt, Homo sapiens
cuguacaaaauaacucucca

SEQ ID NO: 960402 - RNA, 16 nt, Homo sapiens
cuguaccgacuuugau

SEQ ID NO: 960403 - RNA, 21 nt, Homo sapiens
cuguagucccagcuacuuggg

SEQ ID NO: 960404 - RNA, 23 nt, Homo sapiens
cuguaguugcguggacucugcac

SEQ ID NO: 960405 - RNA, 23 nt, Homo sapiens
cuguauaauagagauaaguccau

SEQ ID NO: 960406 - RNA, 22 nt, Homo sapiens
cuguauguaaacuguuacugaa

SEQ ID NO: 960407 - RNA, 13 nt, Homo sapiens
cugucaaaugugu

SEQ ID NO: 960408 - RNA, 21 nt, Homo sapiens
cugucacccuccaccgagcca

SEQ ID NO: 960409 - RNA, 16 nt, Homo sapiens
cugucacucugugccu

SEQ ID NO: 960410 - RNA, 11 nt, Homo sapiens
cugucuaggac

SEQ ID NO: 960411 - RNA, 13 nt, Homo sapiens
cugucucuacuaa

SEQ ID NO: 960412 - RNA, 21 nt, Homo sapiens
cugugaagucaagaaucacuu

SEQ ID NO: 960413 - RNA, 17 nt, Homo sapiens
cugugauaacagaguga

SEQ ID NO: 960414 - RNA, 16 nt, Homo sapiens
cugugcaucaguggga

SEQ ID NO: 960415 - RNA, 10 nt, Homo sapiens
cugugccuga

SEQ ID NO: 960416 - RNA, 16 nt, Homo sapiens
cuguggagucaaggau

SEQ ID NO: 960417 - RNA, 16 nt, Homo sapiens
cuguggcauuuccaaa

SEQ ID NO: 960418 - RNA, 13 nt, Homo sapiens
cuguggccuucag

SEQ ID NO: 960419 - RNA, 19 nt, Homo sapiens
cugugguggccgugccuga

SEQ ID NO: 960420 - RNA, 23 nt, Homo sapiens
cuguuccccaaggacucuuccac

SEQ ID NO: 960421 - RNA, 22 nt, Homo sapiens
cuguucggaagggguuccucaa

SEQ ID NO: 960422 - RNA, 18 nt, Homo sapiens
cuguugcuuaaaccacuu

SEQ ID NO: 960423 - RNA, 16 nt, Homo sapiens
cuguugguuagauuca

SEQ ID NO: 960424 - RNA, 23 nt, Homo sapiens
cuguuuccuuuuacaauuguuga

SEQ ID NO: 960425 - RNA, 17 nt, Homo sapiens
cuguuuuuuuugcugcu

SEQ ID NO: 960426 - RNA, 22 nt, Homo sapiens
cuuaaaacaaauucauuauucu

SEQ ID NO: 960427 - RNA, 11 nt, Homo sapiens
cuuaaacacau

SEQ ID NO: 960428 - RNA, 24 nt, Homo sapiens
cuuaaaccagaacccaguguuucc

SEQ ID NO: 960429 - RNA, 21 nt, Homo sapiens
cuuaaauauauaauguugcca

SEQ ID NO: 960430 - RNA, 14 nt, Homo sapiens
cuuaacaaagccuu

SEQ ID NO: 960431 - RNA, 15 nt, Homo sapiens
cuuaacaaagccuuu

SEQ ID NO: 960432 - RNA, 13 nt, Homo sapiens
cuuaagaauacac

SEQ ID NO: 960433 - RNA, 15 nt, Homo sapiens
cuuaagaauacacag

SEQ ID NO: 960434 - RNA, 18 nt, Homo sapiens
cuuaagaauacacaggau

SEQ ID NO: 960435 - RNA, 12 nt, Homo sapiens
cuuaagcaaagg

SEQ ID NO: 960436 - RNA, 22 nt, Homo sapiens
cuuaagcaaaggggacagcugu

SEQ ID NO: 960437 - RNA, 21 nt, Homo sapiens
cuuaagggaacugaaucacuu

SEQ ID NO: 960438 - RNA, 20 nt, Homo sapiens
cuuaagggguaucauguaug

SEQ ID NO: 960439 - RNA, 13 nt, Homo sapiens
cuuaaguuuuaga

SEQ ID NO: 960440 - RNA, 21 nt, Homo sapiens
cuuaaguuuuagaaaugagaa

SEQ ID NO: 960441 - RNA, 23 nt, Homo sapiens
cuuaauaaaagaacaugcuugaa

SEQ ID NO: 960442 - RNA, 18 nt, Homo sapiens
cuuaaugcuacaugugag

SEQ ID NO: 960443 - RNA, 21 nt, Homo sapiens
cuuacuucccuaaugaaguua

SEQ ID NO: 960444 - RNA, 14 nt, Homo sapiens
cuuagagauugcau

SEQ ID NO: 960445 - RNA, 12 nt, Homo sapiens
cuuagauuuccc

SEQ ID NO: 960446 - RNA, 18 nt, Homo sapiens
cuuagcaacucagagaaa

SEQ ID NO: 960447 - RNA, 18 nt, Homo sapiens
cuuaguuauuuaccaaag

SEQ ID NO: 960448 - RNA, 13 nt, Homo sapiens
cuuauaacugucu

SEQ ID NO: 960449 - RNA, 13 nt, Homo sapiens
cuuaucaauggca

SEQ ID NO: 960450 - RNA, 23 nt, Homo sapiens
cuuaucgggcuccagccaucuca

SEQ ID NO: 960451 - RNA, 18 nt, Homo sapiens
cuuaucuuacaauauuga

SEQ ID NO: 960452 - RNA, 16 nt, Homo sapiens
cuuauuugcugcagaa

SEQ ID NO: 960453 - RNA, 21 nt, Homo sapiens
cuucaaaauaaaaaguaauga

SEQ ID NO: 960454 - RNA, 18 nt, Homo sapiens
cuucaagagccucuggca

SEQ ID NO: 960455 - RNA, 21 nt, Homo sapiens
cuucaaucuucauuuuggagg

SEQ ID NO: 960456 - RNA, 14 nt, Homo sapiens
cuucaauggaauac

SEQ ID NO: 960457 - RNA, 13 nt, Homo sapiens
cuucacagaacac

SEQ ID NO: 960458 - RNA, 20 nt, Homo sapiens
cuucacaguagagccagcuu

SEQ ID NO: 960459 - RNA, 20 nt, Homo sapiens
cuucagcacaaagacacaga

SEQ ID NO: 960460 - RNA, 13 nt, Homo sapiens
cuucagccauagu

SEQ ID NO: 960461 - RNA, 21 nt, Homo sapiens
cuucagcuucccgaguagcug

SEQ ID NO: 960462 - RNA, 21 nt, Homo sapiens
cuucaggaucaaguccuaguu

SEQ ID NO: 960463 - RNA, 22 nt, Homo sapiens
cuucauagacuugaauaacucu

SEQ ID NO: 960464 - RNA, 21 nt, Homo sapiens
cuucaucuggcaacaucuuua

SEQ ID NO: 960465 - RNA, 18 nt, Homo sapiens
cuuccacaauggucucag

SEQ ID NO: 960466 - RNA, 20 nt, Homo sapiens
cuuccacaugggugcauuug

SEQ ID NO: 960467 - RNA, 14 nt, Homo sapiens
cuuccacucuggaa

SEQ ID NO: 960468 - RNA, 20 nt, Homo sapiens
cuuccaggauggauguuggg

SEQ ID NO: 960469 - RNA, 19 nt, Homo sapiens
cuuccagggauuugccuca

SEQ ID NO: 960470 - RNA, 21 nt, Homo sapiens
cuuccagggauuugccucacc

SEQ ID NO: 960471 - RNA, 18 nt, Homo sapiens
cuuccauacacagaggag

SEQ ID NO: 960472 - RNA, 13 nt, Homo sapiens
cuuccccagagag

SEQ ID NO: 960473 - RNA, 14 nt, Homo sapiens
cuucccuaaugaag

SEQ ID NO: 960474 - RNA, 19 nt, Homo sapiens
cuucccuuuauuacaagaa

SEQ ID NO: 960475 - RNA, 18 nt, Homo sapiens
cuuccgcuuggagcuauu

SEQ ID NO: 960476 - RNA, 22 nt, Homo sapiens
cuuccuaaugucagaacagagu

SEQ ID NO: 960477 - RNA, 12 nt, Homo sapiens
cuuccuagguca

SEQ ID NO: 960478 - RNA, 12 nt, Homo sapiens
cuuccugugauc

SEQ ID NO: 960479 - RNA, 15 nt, Homo sapiens
cuuccugugauccac

SEQ ID NO: 960480 - RNA, 20 nt, Homo sapiens
cuuccugugauccacccaac

SEQ ID NO: 960481 - RNA, 23 nt, Homo sapiens
cuuccuuuuauuccucacucggg

SEQ ID NO: 960482 - RNA, 13 nt, Homo sapiens
cuucuaccuggaa

SEQ ID NO: 960483 - RNA, 11 nt, Homo sapiens
agcccagugag

SEQ ID NO: 960484 - RNA, 13 nt, Homo sapiens
agccccacugcca

SEQ ID NO: 960485 - RNA, 14 nt, Homo sapiens
agccccacugccag

SEQ ID NO: 960486 - RNA, 19 nt, Homo sapiens
agccccaggccccagcugg

SEQ ID NO: 960487 - RNA, 16 nt, Homo sapiens
agcccccgccccagag

SEQ ID NO: 960488 - RNA, 18 nt, Homo sapiens
agccccgccccguuguga

SEQ ID NO: 960489 - RNA, 23 nt, Homo sapiens
agccccuccaaaggucugauguc

SEQ ID NO: 960490 - RNA, 22 nt, Homo sapiens
agccccugggcccaguaccuag

SEQ ID NO: 960491 - RNA, 18 nt, Homo sapiens
agcccuaaccccuuccag

SEQ ID NO: 960492 - RNA, 18 nt, Homo sapiens
agcccugaccccagugua

SEQ ID NO: 960493 - RNA, 22 nt, Homo sapiens
agcccugcucuggggugcugag

SEQ ID NO: 960494 - RNA, 12 nt, Homo sapiens
agccuagacaac

SEQ ID NO: 960495 - RNA, 20 nt, Homo sapiens
agccuagagaccauguugac

SEQ ID NO: 960496 - RNA, 16 nt, Homo sapiens
agccuagcacagcagc

SEQ ID NO: 960497 - RNA, 21 nt, Homo sapiens
agccucagcggacaagcagcu

SEQ ID NO: 960498 - RNA, 22 nt, Homo sapiens
agccucagcggacaagcagcug

SEQ ID NO: 960499 - RNA, 20 nt, Homo sapiens
agccuccccgugccaaaaau

SEQ ID NO: 960500 - RNA, 20 nt, Homo sapiens
agccucguuucugcuuucag

SEQ ID NO: 960501 - RNA, 12 nt, Homo sapiens
agccugcauuga

SEQ ID NO: 960502 - RNA, 20 nt, Homo sapiens
agccugcauugagcuugcau

SEQ ID NO: 960503 - RNA, 18 nt, Homo sapiens
agccuggccaccagccau

SEQ ID NO: 960504 - RNA, 19 nt, Homo sapiens
agccuggggaacagagcaa

SEQ ID NO: 960505 - RNA, 14 nt, Homo sapiens
agccugggggacag

SEQ ID NO: 960506 - RNA, 21 nt, Homo sapiens
agccuguccugguacagcagg

SEQ ID NO: 960507 - RNA, 23 nt, Homo sapiens
agccuucaaauuauaaaccaagg

SEQ ID NO: 960508 - RNA, 18 nt, Homo sapiens
agccuucccaacaugccu

SEQ ID NO: 960509 - RNA, 13 nt, Homo sapiens
agcgcacagggag

SEQ ID NO: 960510 - RNA, 14 nt, Homo sapiens
agcggugggcugcc

SEQ ID NO: 960511 - RNA, 21 nt, Homo sapiens
agcuaaaccaaggacugagca

SEQ ID NO: 960512 - RNA, 16 nt, Homo sapiens
agcuaaacuccuuccu

SEQ ID NO: 960513 - RNA, 22 nt, Homo sapiens
agcuaaugucacaauuaugugc

SEQ ID NO: 960514 - RNA, 16 nt, Homo sapiens
agcuaccuuccugugu

SEQ ID NO: 960515 - RNA, 16 nt, Homo sapiens
agcuacuaaugauguu

SEQ ID NO: 960516 - RNA, 20 nt, Homo sapiens
agcuacuggacuaugcugau

SEQ ID NO: 960517 - RNA, 22 nt, Homo sapiens
agcuacuguagaaacaaagggu

SEQ ID NO: 960518 - RNA, 19 nt, Homo sapiens
agcuauauucugagacuuu

SEQ ID NO: 960519 - RNA, 19 nt, Homo sapiens
agcuaugaguugaaauguu

SEQ ID NO: 960520 - RNA, 21 nt, Homo sapiens
agcuaugaucagaagacuuua

SEQ ID NO: 960521 - RNA, 16 nt, Homo sapiens
agcuauuagccaggau

SEQ ID NO: 960522 - RNA, 18 nt, Homo sapiens
agcucccgagcuacucuc

SEQ ID NO: 960523 - RNA, 12 nt, Homo sapiens
agcucgagcaaa

SEQ ID NO: 960524 - RNA, 15 nt, Homo sapiens
agcucucccagugaa

SEQ ID NO: 960525 - RNA, 19 nt, Homo sapiens
agcucucugacgcuuguga

SEQ ID NO: 960526 - RNA, 23 nt, Homo sapiens
aggugauuuguaugcucauugaa

SEQ ID NO: 960527 - RNA, 19 nt, Homo sapiens
aggugcguguucagcagaa

SEQ ID NO: 960528 - RNA, 18 nt, Homo sapiens
agguggaaaauggugccu

SEQ ID NO: 960529 - RNA, 13 nt, Homo sapiens
agguuagcacagc

SEQ ID NO: 960530 - RNA, 17 nt, Homo sapiens
agguuccuuuuucaaaa

SEQ ID NO: 960531 - RNA, 19 nt, Homo sapiens
agguuguuaauguacaaaa

SEQ ID NO: 960532 - RNA, 20 nt, Homo sapiens
agguuugauucaacacuuaa

SEQ ID NO: 960533 - RNA, 19 nt, Homo sapiens
agguuuucuucacugccag

SEQ ID NO: 960534 - RNA, 20 nt, Homo sapiens
agguuuuuauuuuuccuaca

SEQ ID NO: 960535 - RNA, 17 nt, Homo sapiens
aguaacauucauguucu

SEQ ID NO: 960536 - RNA, 14 nt, Homo sapiens
aguaagauaucuca

SEQ ID NO: 960537 - RNA, 18 nt, Homo sapiens
aguaauauuauuacuuua

SEQ ID NO: 960538 - RNA, 16 nt, Homo sapiens
aguaauuucaguguaa

SEQ ID NO: 960539 - RNA, 13 nt, Homo sapiens
aguacuugucaua

SEQ ID NO: 960540 - RNA, 15 nt, Homo sapiens
aguagaaaaggaucu

SEQ ID NO: 960541 - RNA, 15 nt, Homo sapiens
aguaggauccaguga

SEQ ID NO: 960542 - RNA, 17 nt, Homo sapiens
aguauaauguuuauuaa

SEQ ID NO: 960543 - RNA, 14 nt, Homo sapiens
aguaucuugggugu

SEQ ID NO: 960544 - RNA, 20 nt, Homo sapiens
aguauuauauaaacugugcc

SEQ ID NO: 960545 - RNA, 21 nt, Homo sapiens
aguauuccaugagcugcucau

SEQ ID NO: 960546 - RNA, 19 nt, Homo sapiens
aguauuugguuuuccauuc

SEQ ID NO: 960547 - RNA, 21 nt, Homo sapiens
agucacauggccuaugcacau

SEQ ID NO: 960548 - RNA, 22 nt, Homo sapiens
agucacauggccuaugcacaua

SEQ ID NO: 960549 - RNA, 14 nt, Homo sapiens
agucaccugcccca

SEQ ID NO: 960550 - RNA, 16 nt, Homo sapiens
agucacugcucuucag

SEQ ID NO: 960551 - RNA, 22 nt, Homo sapiens
agucagacuuuguguucauuuc

SEQ ID NO: 960552 - RNA, 15 nt, Homo sapiens
agucagugcucucag

SEQ ID NO: 960553 - RNA, 14 nt, Homo sapiens
agucaguugcauuc

SEQ ID NO: 960554 - RNA, 17 nt, Homo sapiens
agucauuccaagaacua

SEQ ID NO: 960555 - RNA, 22 nt, Homo sapiens
agucauuugauagaaagaugag

SEQ ID NO: 960556 - RNA, 17 nt, Homo sapiens
aguccaaaccacuccac

SEQ ID NO: 960557 - RNA, 21 nt, Homo sapiens
agucccucaugcaaaucaauu

SEQ ID NO: 960558 - RNA, 23 nt, Homo sapiens
agucuacucuuucugcuuacaaa

SEQ ID NO: 960559 - RNA, 17 nt, Homo sapiens
agucugaggcaggagaa

SEQ ID NO: 960560 - RNA, 17 nt, Homo sapiens
agucuucuuugugccug

SEQ ID NO: 960561 - RNA, 22 nt, Homo sapiens
agucuuggaaaaaaaccacagc

SEQ ID NO: 960562 - RNA, 18 nt, Homo sapiens
agucuuguuuuuuauuca

SEQ ID NO: 960563 - RNA, 21 nt, Homo sapiens
agucuuguuuuuuauucagau

SEQ ID NO: 960564 - RNA, 22 nt, Homo sapiens
agucuuuauguccauaagcuac

SEQ ID NO: 960565 - RNA, 12 nt, Homo sapiens
agucuuugcuca

SEQ ID NO: 960566 - RNA, 14 nt, Homo sapiens
agucuuugcucagu

SEQ ID NO: 960567 - RNA, 22 nt, Homo sapiens
agugaauacauuaacggugcua

SEQ ID NO: 960568 - RNA, 13 nt, Homo sapiens
agugaaucugauu

SEQ ID NO: 960569 - RNA, 21 nt, Homo sapiens
agugacagcuuucugggaugu

SEQ ID NO: 960570 - RNA, 15 nt, Homo sapiens
agugacccacccuag

SEQ ID NO: 960571 - RNA, 16 nt, Homo sapiens
agugacuuugagcuga

SEQ ID NO: 960572 - RNA, 19 nt, Homo sapiens
agugacuuugagcugagug

SEQ ID NO: 960573 - RNA, 16 nt, Homo sapiens
agugagaggcaaacca

SEQ ID NO: 960574 - RNA, 14 nt, Homo sapiens
agugagcuggugac

SEQ ID NO: 960575 - RNA, 18 nt, Homo sapiens
agugauagaaaagugugg

SEQ ID NO: 960576 - RNA, 17 nt, Homo sapiens
agugauauuguggguaa

SEQ ID NO: 960577 - RNA, 22 nt, Homo sapiens
agugcaaaagugaaacauacaa

SEQ ID NO: 960578 - RNA, 21 nt, Homo sapiens
agugcaggguggacaucaccu

SEQ ID NO: 960579 - RNA, 19 nt, Homo sapiens
agugcaguggcaugaucau

SEQ ID NO: 960580 - RNA, 15 nt, Homo sapiens
agugccaggccagug

SEQ ID NO: 960581 - RNA, 13 nt, Homo sapiens
agugcccuuccug

SEQ ID NO: 960582 - RNA, 14 nt, Homo sapiens
agugcucucagcug

SEQ ID NO: 960583 - RNA, 17 nt, Homo sapiens
agugcuucauugacuaa

SEQ ID NO: 960584 - RNA, 16 nt, Homo sapiens
aguggauuacugccau

SEQ ID NO: 960585 - RNA, 13 nt, Homo sapiens
aguggauucccag

SEQ ID NO: 960586 - RNA, 17 nt, Homo sapiens
aguggccauuaccaucu

SEQ ID NO: 960587 - RNA, 20 nt, Homo sapiens
aguggcgcgaucucggcuca

SEQ ID NO: 960588 - RNA, 12 nt, Homo sapiens
aguggggugcug

SEQ ID NO: 960589 - RNA, 17 nt, Homo sapiens
aguguaaaauguauauu

SEQ ID NO: 960590 - RNA, 17 nt, Homo sapiens
aguguccuaagugcuaa

SEQ ID NO: 960591 - RNA, 16 nt, Homo sapiens
agugucuccaccuaca

SEQ ID NO: 960592 - RNA, 22 nt, Homo sapiens
agugugggugacagcaugguaa

SEQ ID NO: 960593 - RNA, 14 nt, Homo sapiens
aguuaagaaccuga

SEQ ID NO: 960594 - RNA, 21 nt, Homo sapiens
aguuaccuacaagaacaauga

SEQ ID NO: 960595 - RNA, 20 nt, Homo sapiens
aguuauggcuucacauucau

SEQ ID NO: 960596 - RNA, 19 nt, Homo sapiens
aguucugagcaccguguca

SEQ ID NO: 960597 - RNA, 14 nt, Homo sapiens
aguucuggaccugg

SEQ ID NO: 960598 - RNA, 15 nt, Homo sapiens
aguucuugugccaua

SEQ ID NO: 960599 - RNA, 19 nt, Homo sapiens
aguugaaauguucugucaa

SEQ ID NO: 960600 - RNA, 17 nt, Homo sapiens
aguugacugacugagca

SEQ ID NO: 960601 - RNA, 20 nt, Homo sapiens
aguugagggcagcuccagug

SEQ ID NO: 960602 - RNA, 17 nt, Homo sapiens
aguugggcucgcacugc

SEQ ID NO: 960603 - RNA, 20 nt, Homo sapiens
aguugggcucgcacugccca

SEQ ID NO: 960604 - RNA, 23 nt, Homo sapiens
aguugugaucuguuguaauauca

SEQ ID NO: 960605 - RNA, 14 nt, Homo sapiens
aguuguuccaggga

SEQ ID NO: 960606 - RNA, 17 nt, Homo sapiens
aguuuaguucuguugac

SEQ ID NO: 960607 - RNA, 17 nt, Homo sapiens
aguuucccguccaucuc

SEQ ID NO: 960608 - RNA, 22 nt, Homo sapiens
aguuuuaccucuucucucucag

SEQ ID NO: 960609 - RNA, 21 nt, Homo sapiens
aguuuuggcaaggcugacaga

SEQ ID NO: 960610 - RNA, 22 nt, Homo sapiens
aguuuuucaauuaguaacauuc

SEQ ID NO: 960611 - RNA, 14 nt, Homo sapiens
auaaaaaguucuca

SEQ ID NO: 960612 - RNA, 22 nt, Homo sapiens
auaaaagaaauaaaccaaagga

SEQ ID NO: 960613 - RNA, 14 nt, Homo sapiens
auaaaagaucuuga

SEQ ID NO: 960614 - RNA, 23 nt, Homo sapiens
auaaaagaucuugaauagucuca

SEQ ID NO: 960615 - RNA, 20 nt, Homo sapiens
auaaaauguuucauuaugca

SEQ ID NO: 960616 - RNA, 11 nt, Homo sapiens
auaaaauuccu

SEQ ID NO: 960617 - RNA, 18 nt, Homo sapiens
auaaaauuccuaucucau

SEQ ID NO: 960618 - RNA, 23 nt, Homo sapiens
auaaacaacgcauugccacggaa

SEQ ID NO: 960619 - RNA, 20 nt, Homo sapiens
auaaacgguuccuggugacu

SEQ ID NO: 960620 - RNA, 23 nt, Homo sapiens
auaaacgguuccuggugacuccu

SEQ ID NO: 960621 - RNA, 22 nt, Homo sapiens
auaaacuagauauuagguccau

SEQ ID NO: 960622 - RNA, 16 nt, Homo sapiens
auaaacucauuuaucu

SEQ ID NO: 960623 - RNA, 20 nt, Homo sapiens
auaaacugugccaauacaga

SEQ ID NO: 960624 - RNA, 15 nt, Homo sapiens
auaaaggacaggcca

SEQ ID NO: 960625 - RNA, 15 nt, Homo sapiens
auaaauggguguaua

SEQ ID NO: 960626 - RNA, 17 nt, Homo sapiens
auaaauuguagggcuuu

SEQ ID NO: 960627 - RNA, 15 nt, Homo sapiens
auaagaaacaugaug

SEQ ID NO: 960628 - RNA, 20 nt, Homo sapiens
auaagaaacaugaugugaga

SEQ ID NO: 960629 - RNA, 17 nt, Homo sapiens
auaagaggugaucucug

SEQ ID NO: 960630 - RNA, 14 nt, Homo sapiens
auaagcaaacuuau

SEQ ID NO: 960631 - RNA, 18 nt, Homo sapiens
auaagcccaguucaucac

SEQ ID NO: 960632 - RNA, 21 nt, Homo sapiens
auaaggacucacacaaauuaa

SEQ ID NO: 960633 - RNA, 13 nt, Homo sapiens
auaagucuuucau

SEQ ID NO: 960634 - RNA, 14 nt, Homo sapiens
auaauaaaaccaaa

SEQ ID NO: 960635 - RNA, 18 nt, Homo sapiens
auaauaaaugcccucuuc

SEQ ID NO: 960636 - RNA, 14 nt, Homo sapiens
auaauucaagucag

SEQ ID NO: 960637 - RNA, 17 nt, Homo sapiens
auaauuguuucauucau

SEQ ID NO: 960638 - RNA, 13 nt, Homo sapiens
auaauuucagggu

SEQ ID NO: 960639 - RNA, 14 nt, Homo sapiens
auaauuuuugcaga

SEQ ID NO: 960640 - RNA, 18 nt, Homo sapiens
cuaaaaaugagcuugauu

SEQ ID NO: 960641 - RNA, 13 nt, Homo sapiens
cuaaaaguacaaa

SEQ ID NO: 960642 - RNA, 13 nt, Homo sapiens
cuaaaauucuguc

SEQ ID NO: 960643 - RNA, 16 nt, Homo sapiens
cuaaaggacucuccag

SEQ ID NO: 960644 - RNA, 18 nt, Homo sapiens
cuaaaguaaaaagggaau

SEQ ID NO: 960645 - RNA, 18 nt, Homo sapiens
cuaaaguuacaaacagac

SEQ ID NO: 960646 - RNA, 20 nt, Homo sapiens
cuaaaguuacaaacagacca

SEQ ID NO: 960647 - RNA, 14 nt, Homo sapiens
cuaaauacaggaaa

SEQ ID NO: 960648 - RNA, 17 nt, Homo sapiens
cuaaaugugacaugcaa

SEQ ID NO: 960649 - RNA, 15 nt, Homo sapiens
cuaaauuauagugua

SEQ ID NO: 960650 - RNA, 14 nt, Homo sapiens
cuaacauagauuua

SEQ ID NO: 960651 - RNA, 16 nt, Homo sapiens
cuaaccccuuccagau

SEQ ID NO: 960652 - RNA, 22 nt, Homo sapiens
cuaacccuuugugugcucucca

SEQ ID NO: 960653 - RNA, 21 nt, Homo sapiens
cuaaccgaauauucauggaug

SEQ ID NO: 960654 - RNA, 22 nt, Homo sapiens
cuaaccuuggugccugauccau

SEQ ID NO: 960655 - RNA, 13 nt, Homo sapiens
cuaagcacuuuau

SEQ ID NO: 960656 - RNA, 17 nt, Homo sapiens
cuaagcccccacacaga

SEQ ID NO: 960657 - RNA, 21 nt, Homo sapiens
cuaagccuguugcugaaguca

SEQ ID NO: 960658 - RNA, 20 nt, Homo sapiens
cuaauguaccaaugaugaau

SEQ ID NO: 960659 - RNA, 23 nt, Homo sapiens
cuaaugugccccauguccaaguc

SEQ ID NO: 960660 - RNA, 22 nt, Homo sapiens
cuaauguugacuuuaauacucu

SEQ ID NO: 960661 - RNA, 23 nt, Homo sapiens
cuaauuccuggcaugacacucua

SEQ ID NO: 960662 - RNA, 16 nt, Homo sapiens
cuaauuguaagugaaa

SEQ ID NO: 960663 - RNA, 11 nt, Homo sapiens
cuacaagccaa

SEQ ID NO: 960664 - RNA, 16 nt, Homo sapiens
cuacaagucagcucca

SEQ ID NO: 960665 - RNA, 19 nt, Homo sapiens
cuacaauacaacacauuga

SEQ ID NO: 960666 - RNA, 20 nt, Homo sapiens
cuacacugauacacuugaag

SEQ ID NO: 960667 - RNA, 22 nt, Homo sapiens
cuacagagucuggugaagcuca

SEQ ID NO: 960668 - RNA, 16 nt, Homo sapiens
cuacagcuacauugag

SEQ ID NO: 960669 - RNA, 19 nt, Homo sapiens
cuacagcuacauugagaua

SEQ ID NO: 960670 - RNA, 13 nt, Homo sapiens
cuacauucacuuc

SEQ ID NO: 960671 - RNA, 13 nt, Homo sapiens
cuacauucacuuu

SEQ ID NO: 960672 - RNA, 15 nt, Homo sapiens
cuaccaggaugcuaa

SEQ ID NO: 960673 - RNA, 11 nt, Homo sapiens
cuaccaggugg

SEQ ID NO: 960674 - RNA, 21 nt, Homo sapiens
cuaccagguguucuacacuca

SEQ ID NO: 960675 - RNA, 18 nt, Homo sapiens
cuacccuauucuauccau

SEQ ID NO: 960676 - RNA, 21 nt, Homo sapiens
cuaccucagaaagauuugaug

SEQ ID NO: 960677 - RNA, 15 nt, Homo sapiens
cuacggguaggucua

SEQ ID NO: 960678 - RNA, 19 nt, Homo sapiens
cuacucaggcugguggaga

SEQ ID NO: 960679 - RNA, 14 nt, Homo sapiens
cuacucucuugcca

SEQ ID NO: 960680 - RNA, 20 nt, Homo sapiens
cuacucuuucugcuuacaaa

SEQ ID NO: 960681 - RNA, 18 nt, Homo sapiens
cuacuuuucuuuccucag

SEQ ID NO: 960682 - RNA, 13 nt, Homo sapiens
cuagaaacaaaca

SEQ ID NO: 960683 - RNA, 17 nt, Homo sapiens
cuagaacacuaacucac

SEQ ID NO: 960684 - RNA, 18 nt, Homo sapiens
cuagagaaaauaaauucc

SEQ ID NO: 960685 - RNA, 21 nt, Homo sapiens
cuagcacuuugggagacugaa

SEQ ID NO: 960686 - RNA, 16 nt, Homo sapiens
cuagcauuuucuugaa

SEQ ID NO: 960687 - RNA, 22 nt, Homo sapiens
cuagcauuuucuugaaccaaua

SEQ ID NO: 960688 - RNA, 14 nt, Homo sapiens
cuaggaagcagcug

SEQ ID NO: 960689 - RNA, 18 nt, Homo sapiens
cuaggcugcccacucucc

SEQ ID NO: 960690 - RNA, 17 nt, Homo sapiens
cuagguagaacacugcu

SEQ ID NO: 960691 - RNA, 16 nt, Homo sapiens
cuaguccugacacuga

SEQ ID NO: 960692 - RNA, 22 nt, Homo sapiens
cuaguuugugagaaacaucuca

SEQ ID NO: 960693 - RNA, 12 nt, Homo sapiens
cuauacaaguug

SEQ ID NO: 960694 - RNA, 15 nt, Homo sapiens
cuauacacacacaca

SEQ ID NO: 960695 - RNA, 18 nt, Homo sapiens
cuauagcacugagcucac

SEQ ID NO: 960696 - RNA, 23 nt, Homo sapiens
cuauagcaucuucucauucccau

SEQ ID NO: 960697 - RNA, 22 nt, Homo sapiens
cuaucacuuuaaauacuauuau

SEQ ID NO: 960698 - RNA, 13 nt, Homo sapiens
cuaucuccugaca

SEQ ID NO: 960699 - RNA, 20 nt, Homo sapiens
cuaucugcuguauauggaau

SEQ ID NO: 960700 - RNA, 22 nt, Homo sapiens
cuaugaaaaauguguuccauug

SEQ ID NO: 960701 - RNA, 19 nt, Homo sapiens
cuaugauauuuucugugcc

SEQ ID NO: 960702 - RNA, 22 nt, Homo sapiens
cuaugauauuuucugugccuga

SEQ ID NO: 960703 - RNA, 18 nt, Homo sapiens
cuaugaucagaagacuuu

SEQ ID NO: 960704 - RNA, 23 nt, Homo sapiens
cuaugcacauauggacucugcac

SEQ ID NO: 960705 - RNA, 18 nt, Homo sapiens
cuaugcauuaagaguaaa

SEQ ID NO: 960706 - RNA, 22 nt, Homo sapiens
cuaugcgggggugccuaaggag

SEQ ID NO: 960707 - RNA, 14 nt, Homo sapiens
cuaugcugugcucc

SEQ ID NO: 960708 - RNA, 16 nt, Homo sapiens
cuauuaaacuauuuua

SEQ ID NO: 960709 - RNA, 13 nt, Homo sapiens
cuauuaacuacca

SEQ ID NO: 960710 - RNA, 20 nt, Homo sapiens
cuauuaauaucaacucugaa

SEQ ID NO: 960711 - RNA, 13 nt, Homo sapiens
cuauuaauauuca

SEQ ID NO: 960712 - RNA, 19 nt, Homo sapiens
cuauuauggaaaacugugu

SEQ ID NO: 960713 - RNA, 16 nt, Homo sapiens
cuauucauggcuaccu

SEQ ID NO: 960714 - RNA, 18 nt, Homo sapiens
cuauucauggcuaccuca

SEQ ID NO: 960715 - RNA, 19 nt, Homo sapiens
cuauucauggcuaccucag

SEQ ID NO: 960716 - RNA, 23 nt, Homo sapiens
cuauucuauaaaacucugcaugu

SEQ ID NO: 960717 - RNA, 16 nt, Homo sapiens
cuauuguucacuuuau

SEQ ID NO: 960718 - RNA, 21 nt, Homo sapiens
cuauuugcaccuuaaaagaca

SEQ ID NO: 960719 - RNA, 14 nt, Homo sapiens
cuauuuucagagca

SEQ ID NO: 960720 - RNA, 19 nt, Homo sapiens
cucaaacguacaagucagu

SEQ ID NO: 960721 - RNA, 21 nt, Homo sapiens
cucaacugccuacuccaaaau

SEQ ID NO: 960722 - RNA, 22 nt, Homo sapiens
cucaaucacacugaagccacag

SEQ ID NO: 960723 - RNA, 17 nt, Homo sapiens
cucaaucacugcucccc

SEQ ID NO: 960724 - RNA, 22 nt, Homo sapiens
cucaaucuccucucucuuuccu

SEQ ID NO: 960725 - RNA, 21 nt, Homo sapiens
cucaauguuuagcagauuuaa

SEQ ID NO: 960726 - RNA, 20 nt, Homo sapiens
cucacacaaauuaaaauaca

SEQ ID NO: 960727 - RNA, 20 nt, Homo sapiens
cucaccagccccacugccag

SEQ ID NO: 960728 - RNA, 23 nt, Homo sapiens
cucaccagcccugaccccagugu

SEQ ID NO: 960729 - RNA, 23 nt, Homo sapiens
cucacucuucaaggaggcccacu

SEQ ID NO: 960730 - RNA, 13 nt, Homo sapiens
cucagaaagggau

SEQ ID NO: 960731 - RNA, 15 nt, Homo sapiens
cucagauuuccacag

SEQ ID NO: 960732 - RNA, 17 nt, Homo sapiens
cucagcaauagggugca

SEQ ID NO: 960733 - RNA, 22 nt, Homo sapiens
cucagcccgccuucaggcugcc

SEQ ID NO: 960734 - RNA, 17 nt, Homo sapiens
cucaggagucugaggca

SEQ ID NO: 960735 - RNA, 17 nt, Homo sapiens
cucagguaguacuggga

SEQ ID NO: 960736 - RNA, 18 nt, Homo sapiens
cucagguaguacugggaa

SEQ ID NO: 960737 - RNA, 22 nt, Homo sapiens
cucagguuuguuuugugaauuu

SEQ ID NO: 960738 - RNA, 16 nt, Homo sapiens
cucaguaaguuggcaa

SEQ ID NO: 960739 - RNA, 15 nt, Homo sapiens
cucagucaugcauaa

SEQ ID NO: 960740 - RNA, 18 nt, Homo sapiens
cucagucaugcauaaaua

SEQ ID NO: 960741 - RNA, 23 nt, Homo sapiens
cucaguguugucaccagaucuga

SEQ ID NO: 960742 - RNA, 21 nt, Homo sapiens
cucaguucucuugcuuucaca

SEQ ID NO: 960743 - RNA, 20 nt, Homo sapiens
cucaguucuuccuccaccuc

SEQ ID NO: 960744 - RNA, 20 nt, Homo sapiens
cucauaaaaaucuagcacac

SEQ ID NO: 960745 - RNA, 21 nt, Homo sapiens
cucauaaguaaguuuggcaag

SEQ ID NO: 960746 - RNA, 15 nt, Homo sapiens
cucauauaagacaaa

SEQ ID NO: 960747 - RNA, 12 nt, Homo sapiens
cucaucugcaaa

SEQ ID NO: 960748 - RNA, 17 nt, Homo sapiens
cucaugguccuuggagg

SEQ ID NO: 960749 - RNA, 16 nt, Homo sapiens
cucauuucauucucac

SEQ ID NO: 960750 - RNA, 24 nt, Homo sapiens
cuccaaccacugugccacugacuu

SEQ ID NO: 960751 - RNA, 14 nt, Homo sapiens
cuccaagcauuuca

SEQ ID NO: 960752 - RNA, 19 nt, Homo sapiens
cuccacagcgagggcagcu

SEQ ID NO: 960753 - RNA, 22 nt, Homo sapiens
cuccacaucugccuuaaaacca

SEQ ID NO: 960754 - RNA, 12 nt, Homo sapiens
ccaaauagcaaa

SEQ ID NO: 960755 - RNA, 21 nt, Homo sapiens
ccaacacugucacuagucuca

SEQ ID NO: 960756 - RNA, 11 nt, Homo sapiens
ccaacauguga

SEQ ID NO: 960757 - RNA, 21 nt, Homo sapiens
ccaacaugugauguguugcuc

SEQ ID NO: 960758 - RNA, 13 nt, Homo sapiens
ccaaccccagugg

SEQ ID NO: 960759 - RNA, 20 nt, Homo sapiens
ccaaccccaguggauucuca

SEQ ID NO: 960760 - RNA, 18 nt, Homo sapiens
ccaagaacuauaaacuua

SEQ ID NO: 960761 - RNA, 18 nt, Homo sapiens
ccaagacaugacauucuu

SEQ ID NO: 960762 - RNA, 16 nt, Homo sapiens
ccaagacucuuuauga

SEQ ID NO: 960763 - RNA, 23 nt, Homo sapiens
ccaagacucuuuaugaucuggcc

SEQ ID NO: 960764 - RNA, 22 nt, Homo sapiens
ccaagagaacucgcgcucagua

SEQ ID NO: 960765 - RNA, 16 nt, Homo sapiens
ccaagcacagagccug

SEQ ID NO: 960766 - RNA, 23 nt, Homo sapiens
ccaagcagaauucugcaugguga

SEQ ID NO: 960767 - RNA, 15 nt, Homo sapiens
ccaagggaaaggggu

SEQ ID NO: 960768 - RNA, 16 nt, Homo sapiens
ccaaggguaugggaag

SEQ ID NO: 960769 - RNA, 20 nt, Homo sapiens
ccaagugaggagugccagcu

SEQ ID NO: 960770 - RNA, 19 nt, Homo sapiens
ccacaauggucucagccua

SEQ ID NO: 960771 - RNA, 12 nt, Homo sapiens
ccacaccacagc

SEQ ID NO: 960772 - RNA, 18 nt, Homo sapiens
ccacacuuaaauucucua

SEQ ID NO: 960773 - RNA, 16 nt, Homo sapiens
ccacaguaauugguca

SEQ ID NO: 960774 - RNA, 11 nt, Homo sapiens
ccacaucccag

SEQ ID NO: 960775 - RNA, 15 nt, Homo sapiens
ccaccaaaacugcuc

SEQ ID NO: 960776 - RNA, 16 nt, Homo sapiens
ccaccaaaacugcucc

SEQ ID NO: 960777 - RNA, 13 nt, Homo sapiens
ccaccaccaggac

SEQ ID NO: 960778 - RNA, 11 nt, Homo sapiens
ccaccagcugg

SEQ ID NO: 960779 - RNA, 19 nt, Homo sapiens
ccaccauaugaauuguaca

SEQ ID NO: 960780 - RNA, 19 nt, Homo sapiens
ccacccaacccuaucuccu

SEQ ID NO: 960781 - RNA, 13 nt, Homo sapiens
ccacccacaugug

SEQ ID NO: 960782 - RNA, 22 nt, Homo sapiens
ccacccugcgggccaggguccu

SEQ ID NO: 960783 - RNA, 16 nt, Homo sapiens
ccaccgugccuggcca

SEQ ID NO: 960784 - RNA, 13 nt, Homo sapiens
ccaccuguacugu

SEQ ID NO: 960785 - RNA, 21 nt, Homo sapiens
ccacgcagaggacgcacgcuc

SEQ ID NO: 960786 - RNA, 14 nt, Homo sapiens
ccacgguaggcuag

SEQ ID NO: 960787 - RNA, 11 nt, Homo sapiens
ccacuccaguu

SEQ ID NO: 960788 - RNA, 15 nt, Homo sapiens
ccacucccugggaca

SEQ ID NO: 960789 - RNA, 23 nt, Homo sapiens
ccacugugcuuucagaagugccc

SEQ ID NO: 960790 - RNA, 14 nt, Homo sapiens
ccacuguguuccuu

SEQ ID NO: 960791 - RNA, 14 nt, Homo sapiens
ccacuuucccacac

SEQ ID NO: 960792 - RNA, 16 nt, Homo sapiens
ccacuuugaguaccaa

SEQ ID NO: 960793 - RNA, 12 nt, Homo sapiens
ccagaacacucu

SEQ ID NO: 960794 - RNA, 22 nt, Homo sapiens
ccagacauuuacaaaguuguuu

SEQ ID NO: 960795 - RNA, 23 nt, Homo sapiens
ccagacccaguggacucuuccac

SEQ ID NO: 960796 - RNA, 19 nt, Homo sapiens
ccagagaggaccuauccca

SEQ ID NO: 960797 - RNA, 18 nt, Homo sapiens
ccagagauggucacauga

SEQ ID NO: 960798 - RNA, 22 nt, Homo sapiens
ccagagccagaaagggugccag

SEQ ID NO: 960799 - RNA, 15 nt, Homo sapiens
ccagagcugccugcu

SEQ ID NO: 960800 - RNA, 12 nt, Homo sapiens
ccagagguugug

SEQ ID NO: 960801 - RNA, 18 nt, Homo sapiens
ccagauaacucucuuucc

SEQ ID NO: 960802 - RNA, 19 nt, Homo sapiens
ccagaugcccuguugguuu

SEQ ID NO: 960803 - RNA, 20 nt, Homo sapiens
ccagauucugccucucugga

SEQ ID NO: 960804 - RNA, 19 nt, Homo sapiens
ccagcaauaggguggcaca

SEQ ID NO: 960805 - RNA, 17 nt, Homo sapiens
ccagcaauuuagacaaa

SEQ ID NO: 960806 - RNA, 19 nt, Homo sapiens
ccagcauccccaacugcga

SEQ ID NO: 960807 - RNA, 14 nt, Homo sapiens
ccagcaucuggaag

SEQ ID NO: 960808 - RNA, 18 nt, Homo sapiens
ccagcuacucaggagucu

SEQ ID NO: 960809 - RNA, 17 nt, Homo sapiens
ccagcuccaugcuccag

SEQ ID NO: 960810 - RNA, 14 nt, Homo sapiens
ccagcuuauaguca

SEQ ID NO: 960811 - RNA, 15 nt, Homo sapiens
ccaggaaagagcagu

SEQ ID NO: 960812 - RNA, 14 nt, Homo sapiens
ccaggaagagcuga

SEQ ID NO: 960813 - RNA, 16 nt, Homo sapiens
ccaggacagcagccac

SEQ ID NO: 960814 - RNA, 19 nt, Homo sapiens
ccaggaccacagagcuccu

SEQ ID NO: 960815 - RNA, 20 nt, Homo sapiens
ccaggagauggguccagggg

SEQ ID NO: 960816 - RNA, 19 nt, Homo sapiens
ccaggaucaugguguaaua

SEQ ID NO: 960817 - RNA, 20 nt, Homo sapiens
ccaggccacccaaaggagcu

SEQ ID NO: 960818 - RNA, 20 nt, Homo sapiens
ccaggcgggcggcacgccaa

SEQ ID NO: 960819 - RNA, 13 nt, Homo sapiens
ccaggcuggagac

SEQ ID NO: 960820 - RNA, 13 nt, Homo sapiens
ccagggaaggugg

SEQ ID NO: 960821 - RNA, 14 nt, Homo sapiens
ccagggugugaaca

SEQ ID NO: 960822 - RNA, 14 nt, Homo sapiens
ccagguguucuaca

SEQ ID NO: 960823 - RNA, 19 nt, Homo sapiens
ccagguguucuacacucau

SEQ ID NO: 960824 - RNA, 14 nt, Homo sapiens
ccagguuagcacag

SEQ ID NO: 960825 - RNA, 19 nt, Homo sapiens
ccagucuuccugacacuuu

SEQ ID NO: 960826 - RNA, 13 nt, Homo sapiens
ccaguggacucuu

SEQ ID NO: 960827 - RNA, 23 nt, Homo sapiens
ccagugucauuucucauccacau

SEQ ID NO: 960828 - RNA, 15 nt, Homo sapiens
ccauaaugagaugug

SEQ ID NO: 960829 - RNA, 12 nt, Homo sapiens
ccauaccacagc

SEQ ID NO: 960830 - RNA, 14 nt, Homo sapiens
ccauacgagcaccu

SEQ ID NO: 960831 - RNA, 21 nt, Homo sapiens
cgcagaacuaccagguggcaa

SEQ ID NO: 960832 - RNA, 16 nt, Homo sapiens
cgcauccuaugcuuaa

SEQ ID NO: 960833 - RNA, 19 nt, Homo sapiens
cgccaaucccgccaugcuc

SEQ ID NO: 960834 - RNA, 15 nt, Homo sapiens
cgccaggaagccaga

SEQ ID NO: 960835 - RNA, 18 nt, Homo sapiens
cgccaugaucagacauac

SEQ ID NO: 960836 - RNA, 14 nt, Homo sapiens
cgccauuccaaguc

SEQ ID NO: 960837 - RNA, 16 nt, Homo sapiens
cgccccuuccuagguc

SEQ ID NO: 960838 - RNA, 20 nt, Homo sapiens
cgccuuaugccucagucuau

SEQ ID NO: 960839 - RNA, 22 nt, Homo sapiens
cgccuuaugccucagucuauuc

SEQ ID NO: 960840 - RNA, 14 nt, Homo sapiens
cgcgcacuccagcg

SEQ ID NO: 960841 - RNA, 16 nt, Homo sapiens
cgcgugccguggcacc

SEQ ID NO: 960842 - RNA, 19 nt, Homo sapiens
cgcugaagcgccuccccca

SEQ ID NO: 960843 - RNA, 19 nt, Homo sapiens
cgcuuggagcuauuuucca

SEQ ID NO: 960844 - RNA, 15 nt, Homo sapiens
cggaauucagccaug

SEQ ID NO: 960845 - RNA, 23 nt, Homo sapiens
cggacgcaccugggacccugcac

SEQ ID NO: 960846 - RNA, 15 nt, Homo sapiens
cggacgccaccugcg

SEQ ID NO: 960847 - RNA, 17 nt, Homo sapiens
cggacugucaguucucu

SEQ ID NO: 960848 - RNA, 15 nt, Homo sapiens
cggcuacucuggaau

SEQ ID NO: 960849 - RNA, 12 nt, Homo sapiens
cgggaaaggagc

SEQ ID NO: 960850 - RNA, 13 nt, Homo sapiens
cgggaaaggagcu

SEQ ID NO: 960851 - RNA, 14 nt, Homo sapiens
cgggagccauguca

SEQ ID NO: 960852 - RNA, 22 nt, Homo sapiens
cgggaggguuccgccacuccag

SEQ ID NO: 960853 - RNA, 17 nt, Homo sapiens
cgucauguguuuugcca

SEQ ID NO: 960854 - RNA, 15 nt, Homo sapiens
cgucccauccagcua

SEQ ID NO: 960855 - RNA, 21 nt, Homo sapiens
cgucccauccagcuaccacca

SEQ ID NO: 960856 - RNA, 13 nt, Homo sapiens
cguccuccgucca

SEQ ID NO: 960857 - RNA, 13 nt, Homo sapiens
cguccuggagcug

SEQ ID NO: 960858 - RNA, 14 nt, Homo sapiens
cgucgucaccaaau

SEQ ID NO: 960859 - RNA, 15 nt, Homo sapiens
cgugacaagugccuu

SEQ ID NO: 960860 - RNA, 13 nt, Homo sapiens
cgugcguggcacu

SEQ ID NO: 960861 - RNA, 19 nt, Homo sapiens
cgugcuacugcacuccagc

SEQ ID NO: 960862 - RNA, 22 nt, Homo sapiens
cgugcucugugggucuccccca

SEQ ID NO: 960863 - RNA, 17 nt, Homo sapiens
cguggacucugcacaug

SEQ ID NO: 960864 - RNA, 22 nt, Homo sapiens
cguggacucugcacaugucuug

SEQ ID NO: 960865 - RNA, 20 nt, Homo sapiens
cguggaugcgcagugccuug

SEQ ID NO: 960866 - RNA, 23 nt, Homo sapiens
cgugguaugucugccauguugcc

SEQ ID NO: 960867 - RNA, 18 nt, Homo sapiens
cguguuucugacucugag

SEQ ID NO: 960868 - RNA, 13 nt, Homo sapiens
cguuguguuguug

SEQ ID NO: 960869 - RNA, 16 nt, Homo sapiens
cauuaaggaauuugau

SEQ ID NO: 960870 - RNA, 13 nt, Homo sapiens
cauuacacacaaa

SEQ ID NO: 960871 - RNA, 16 nt, Homo sapiens
cauuacaguucuuucc

SEQ ID NO: 960872 - RNA, 15 nt, Homo sapiens
cauuauaagcuauga

SEQ ID NO: 960873 - RNA, 18 nt, Homo sapiens
cauuaucauaugaacuug

SEQ ID NO: 960874 - RNA, 13 nt, Homo sapiens
cauuauuagcacu

SEQ ID NO: 960875 - RNA, 14 nt, Homo sapiens
cauuauuuggcuua

SEQ ID NO: 960876 - RNA, 19 nt, Homo sapiens
cauuauuuuuuacaauggc

SEQ ID NO: 960877 - RNA, 13 nt, Homo sapiens
cauucacuuccag

SEQ ID NO: 960878 - RNA, 18 nt, Homo sapiens
cauucagagcuauggugc

SEQ ID NO: 960879 - RNA, 14 nt, Homo sapiens
cauucauccuucca

SEQ ID NO: 960880 - RNA, 19 nt, Homo sapiens
cauuccaaggguaugggaa

SEQ ID NO: 960881 - RNA, 17 nt, Homo sapiens
cauuccgagauuuuaaa

SEQ ID NO: 960882 - RNA, 12 nt, Homo sapiens
cauuccuaacac

SEQ ID NO: 960883 - RNA, 15 nt, Homo sapiens
cauugaaacuguauu

SEQ ID NO: 960884 - RNA, 21 nt, Homo sapiens
cauugaagauccgagugugau

SEQ ID NO: 960885 - RNA, 18 nt, Homo sapiens
cauugcacauaagcuucc

SEQ ID NO: 960886 - RNA, 13 nt, Homo sapiens
cauuguacuuaaa

SEQ ID NO: 960887 - RNA, 12 nt, Homo sapiens
cauuguauccuc

SEQ ID NO: 960888 - RNA, 19 nt, Homo sapiens
cauugucgcucagcaauag

SEQ ID NO: 960889 - RNA, 14 nt, Homo sapiens
cauuguugucaagg

SEQ ID NO: 960890 - RNA, 20 nt, Homo sapiens
cauuuaaaaggacugcugau

SEQ ID NO: 960891 - RNA, 17 nt, Homo sapiens
cauuuaauaaagaugag

SEQ ID NO: 960892 - RNA, 17 nt, Homo sapiens
cauuucaauuccuguga

SEQ ID NO: 960893 - RNA, 16 nt, Homo sapiens
cauuucccaucugcac

SEQ ID NO: 960894 - RNA, 18 nt, Homo sapiens
cauuucugaggugcacug

SEQ ID NO: 960895 - RNA, 22 nt, Homo sapiens
cauuucugaggugcacugggag

SEQ ID NO: 960896 - RNA, 13 nt, Homo sapiens
cauuugaacaugu

SEQ ID NO: 960897 - RNA, 13 nt, Homo sapiens
cauuugauuguca

SEQ ID NO: 960898 - RNA, 11 nt, Homo sapiens
cauuuggucuc

SEQ ID NO: 960899 - RNA, 14 nt, Homo sapiens
cauuuggucucagg

SEQ ID NO: 960900 - RNA, 21 nt, Homo sapiens
cauuuguagcuuugcccauug

SEQ ID NO: 960901 - RNA, 21 nt, Homo sapiens
cauuuguaugucaaagcuuug

SEQ ID NO: 960902 - RNA, 22 nt, Homo sapiens
cauuuuaaguuuguaguaaaag

SEQ ID NO: 960903 - RNA, 18 nt, Homo sapiens
cauuuuucucuugccauu

SEQ ID NO: 960904 - RNA, 16 nt, Homo sapiens
cauuuuuugucuguga

SEQ ID NO: 960905 - RNA, 14 nt, Homo sapiens
ccaaaccacuccac

SEQ ID NO: 960906 - RNA, 20 nt, Homo sapiens
ccaaacucuucccucucuca

SEQ ID NO: 960907 - RNA, 15 nt, Homo sapiens
ccaaaguaacugaau

SEQ ID NO: 960908 - RNA, 23 nt, Homo sapiens
cagggcacuacauaauugcuguu

SEQ ID NO: 960909 - RNA, 15 nt, Homo sapiens
cagggccacauagau

SEQ ID NO: 960910 - RNA, 21 nt, Homo sapiens
cagggcucgggagccauguca

SEQ ID NO: 960911 - RNA, 15 nt, Homo sapiens
cagggcugugcuuga

SEQ ID NO: 960912 - RNA, 23 nt, Homo sapiens
caggggucauagagcccagugag

SEQ ID NO: 960913 - RNA, 17 nt, Homo sapiens
caggguaaacuagcaau

SEQ ID NO: 960914 - RNA, 15 nt, Homo sapiens
cagggucuugcucug

SEQ ID NO: 960915 - RNA, 18 nt, Homo sapiens
caggguucaucugaagau

SEQ ID NO: 960916 - RNA, 19 nt, Homo sapiens
cagguaguauuacaccacc

SEQ ID NO: 960917 - RNA, 14 nt, Homo sapiens
caggugauucuguu

SEQ ID NO: 960918 - RNA, 23 nt, Homo sapiens
caggugauuuguaugcucauuga

SEQ ID NO: 960919 - RNA, 18 nt, Homo sapiens
cagguucucuuagagcca

SEQ ID NO: 960920 - RNA, 20 nt, Homo sapiens
cagguuuucuguuucugugu

SEQ ID NO: 960921 - RNA, 19 nt, Homo sapiens
caguaaaauacuauugccu

SEQ ID NO: 960922 - RNA, 15 nt, Homo sapiens
caguagagccagcuu

SEQ ID NO: 960923 - RNA, 23 nt, Homo sapiens
caguaucacgauuugcaggauuc

SEQ ID NO: 960924 - RNA, 17 nt, Homo sapiens
caguauuuuguguccuc

SEQ ID NO: 960925 - RNA, 13 nt, Homo sapiens
cagucauccugca

SEQ ID NO: 960926 - RNA, 22 nt, Homo sapiens
cagucucuucgaggcuuuacag

SEQ ID NO: 960927 - RNA, 21 nt, Homo sapiens
cagugaaaaagauguacagaa

SEQ ID NO: 960928 - RNA, 15 nt, Homo sapiens
cagugaacauuccca

SEQ ID NO: 960929 - RNA, 20 nt, Homo sapiens
cagugagccuccugugccug

SEQ ID NO: 960930 - RNA, 14 nt, Homo sapiens
cagugcaguuucuu

SEQ ID NO: 960931 - RNA, 22 nt, Homo sapiens
cagugcaguuucuuuucacauu

SEQ ID NO: 960932 - RNA, 18 nt, Homo sapiens
cagugccaggccagugac

SEQ ID NO: 960933 - RNA, 15 nt, Homo sapiens
caguggacucuucca

SEQ ID NO: 960934 - RNA, 16 nt, Homo sapiens
caguggacucuuccac

SEQ ID NO: 960935 - RNA, 20 nt, Homo sapiens
caguggcaugaucauagcuc

SEQ ID NO: 960936 - RNA, 16 nt, Homo sapiens
caguggugacauaguc

SEQ ID NO: 960937 - RNA, 19 nt, Homo sapiens
cagugguuuuauacugaag

SEQ ID NO: 960938 - RNA, 14 nt, Homo sapiens
caguguacccuccu

SEQ ID NO: 960939 - RNA, 16 nt, Homo sapiens
cagugucuccaccuac

SEQ ID NO: 960940 - RNA, 18 nt, Homo sapiens
caguguuuccacacuuaa

SEQ ID NO: 960941 - RNA, 15 nt, Homo sapiens
caguucaagacuuag

SEQ ID NO: 960942 - RNA, 12 nt, Homo sapiens
caguucagauaa

SEQ ID NO: 960943 - RNA, 12 nt, Homo sapiens
caguucuacuca

SEQ ID NO: 960944 - RNA, 20 nt, Homo sapiens
caguucucagaaaugucaug

SEQ ID NO: 960945 - RNA, 13 nt, Homo sapiens
caguuucucagaa

SEQ ID NO: 960946 - RNA, 23 nt, Homo sapiens
caguuuuguacauagcaaauaaa

SEQ ID NO: 960947 - RNA, 17 nt, Homo sapiens
auacaaaccuaccaaaa

SEQ ID NO: 960948 - RNA, 13 nt, Homo sapiens
auacaaacucuca

SEQ ID NO: 960949 - RNA, 19 nt, Homo sapiens
auacaacauuaaggaauuu

SEQ ID NO: 960950 - RNA, 22 nt, Homo sapiens
auacaacauuaaggaauuugau

SEQ ID NO: 960951 - RNA, 16 nt, Homo sapiens
auacacauacauauau

SEQ ID NO: 960952 - RNA, 14 nt, Homo sapiens
auacacauauacaa

SEQ ID NO: 960953 - RNA, 15 nt, Homo sapiens
auacacauauacaaa

SEQ ID NO: 960954 - RNA, 21 nt, Homo sapiens
auacagaguuuuagaaaugag

SEQ ID NO: 960955 - RNA, 15 nt, Homo sapiens
auacagcugcacuga

SEQ ID NO: 960956 - RNA, 17 nt, Homo sapiens
auaccauucacuacuca

SEQ ID NO: 960957 - RNA, 19 nt, Homo sapiens
auacccaggaagagcugac

SEQ ID NO: 960958 - RNA, 15 nt, Homo sapiens
auacuauugccucau

SEQ ID NO: 960959 - RNA, 17 nt, Homo sapiens
auacuuuuuguuuauuu

SEQ ID NO: 960960 - RNA, 13 nt, Homo sapiens
auagacauucuca

SEQ ID NO: 960961 - RNA, 21 nt, Homo sapiens
auagagauagcuacaguguaa

SEQ ID NO: 960962 - RNA, 22 nt, Homo sapiens
auaggaugcuugggaagacucc

SEQ ID NO: 960963 - RNA, 19 nt, Homo sapiens
auagggugcaguuuuccag

SEQ ID NO: 960964 - RNA, 13 nt, Homo sapiens
auaguagcauuuc

SEQ ID NO: 960965 - RNA, 18 nt, Homo sapiens
auaguaugaaaauggaaa

SEQ ID NO: 960966 - RNA, 14 nt, Homo sapiens
auagucaaguccac

SEQ ID NO: 960967 - RNA, 22 nt, Homo sapiens
auagucccauuuuucucuugcc

SEQ ID NO: 960968 - RNA, 17 nt, Homo sapiens
auagugcacuagcauuu

SEQ ID NO: 960969 - RNA, 18 nt, Homo sapiens
auagugcacuagcauuuu

SEQ ID NO: 960970 - RNA, 15 nt, Homo sapiens
auaguggaucacuca

SEQ ID NO: 960971 - RNA, 21 nt, Homo sapiens
auaguguagaaaagaacugga

SEQ ID NO: 960972 - RNA, 18 nt, Homo sapiens
auauaaaguacaucucua

SEQ ID NO: 960973 - RNA, 14 nt, Homo sapiens
auauaauccuguga

SEQ ID NO: 960974 - RNA, 16 nt, Homo sapiens
auauaauguugccagc

SEQ ID NO: 960975 - RNA, 16 nt, Homo sapiens
auauaauuuauuucca

SEQ ID NO: 960976 - RNA, 14 nt, Homo sapiens
auauacacauauac

SEQ ID NO: 960977 - RNA, 16 nt, Homo sapiens
auauagacauucucac

SEQ ID NO: 960978 - RNA, 12 nt, Homo sapiens
auauauacacau

SEQ ID NO: 960979 - RNA, 13 nt, Homo sapiens
auauauaugcaua

SEQ ID NO: 960980 - RNA, 12 nt, Homo sapiens
auauauugaacu

SEQ ID NO: 960981 - RNA, 16 nt, Homo sapiens
auaucaguaccucuca

SEQ ID NO: 960982 - RNA, 16 nt, Homo sapiens
auaucuaugcugagua

SEQ ID NO: 960983 - RNA, 11 nt, Homo sapiens
auaugacaaag

SEQ ID NO: 960984 - RNA, 20 nt, Homo sapiens
auaugcaauguauagugucu

SEQ ID NO: 960985 - RNA, 12 nt, Homo sapiens
auaugcccucau

SEQ ID NO: 960986 - RNA, 19 nt, Homo sapiens
auaugcccucaucauccca

SEQ ID NO: 960987 - RNA, 20 nt, Homo sapiens
auaugcccucaucaucccag

SEQ ID NO: 960988 - RNA, 19 nt, Homo sapiens
auauguaagugguuuuuau

SEQ ID NO: 960989 - RNA, 22 nt, Homo sapiens
auauuaggacuaaggaacuaaa

SEQ ID NO: 960990 - RNA, 17 nt, Homo sapiens
auauuauugauucacuu

SEQ ID NO: 960991 - RNA, 16 nt, Homo sapiens
auauucuacuaugcau

SEQ ID NO: 960992 - RNA, 14 nt, Homo sapiens
auauugaagacauu

SEQ ID NO: 960993 - RNA, 15 nt, Homo sapiens
auauugaauguuaaa

SEQ ID NO: 960994 - RNA, 23 nt, Homo sapiens
auauugauugggaaaacauuugc

SEQ ID NO: 960995 - RNA, 21 nt, Homo sapiens
auauuguggguaacgugagaa

SEQ ID NO: 960996 - RNA, 18 nt, Homo sapiens
auauuguugaacacuuga

SEQ ID NO: 960997 - RNA, 14 nt, Homo sapiens
auauuuaucuuuca

SEQ ID NO: 960998 - RNA, 22 nt, Homo sapiens
auauuugcauuccagaaccaaa

SEQ ID NO: 960999 - RNA, 17 nt, Homo sapiens
auauuugcuaugaagcg

SEQ ID NO: 961000 - RNA, 14 nt, Homo sapiens
auauuuucugugcc

SEQ ID NO: 961001 - RNA, 19 nt, Homo sapiens
aucaagcaauccagccuca

SEQ ID NO: 961002 - RNA, 22 nt, Homo sapiens
aucaagcuuuuaaaaacuagag

SEQ ID NO: 961003 - RNA, 22 nt, Homo sapiens
aucaaguccuaguuguucagca

SEQ ID NO: 961004 - RNA, 23 nt, Homo sapiens
aucaauaguugaauuagugagua

SEQ ID NO: 961005 - RNA, 24 nt, Homo sapiens
aucaauauuuuuauaucaugcaaa

SEQ ID NO: 961006 - RNA, 19 nt, Homo sapiens
aucaaucugcaguuuaaca

SEQ ID NO: 961007 - RNA, 21 nt, Homo sapiens
aucacacugaagccacagcug

SEQ ID NO: 961008 - RNA, 20 nt, Homo sapiens
aucacacuuuaauguacaug

SEQ ID NO: 961009 - RNA, 22 nt, Homo sapiens
aucaccaaucauaguguaccca

SEQ ID NO: 961010 - RNA, 23 nt, Homo sapiens
aucaccaucaauuuuaguuguca

SEQ ID NO: 961011 - RNA, 15 nt, Homo sapiens
aucagagggugacug

SEQ ID NO: 961012 - RNA, 22 nt, Homo sapiens
aucagcaucacccgggaacuuu

SEQ ID NO: 961013 - RNA, 20 nt, Homo sapiens
aucaggaaauaucugugaag

SEQ ID NO: 961014 - RNA, 16 nt, Homo sapiens
aucaguaccucucaag

SEQ ID NO: 961015 - RNA, 13 nt, Homo sapiens
aucagucaugugu

SEQ ID NO: 961016 - RNA, 22 nt, Homo sapiens
aucaguuacaguggcaguauug

SEQ ID NO: 961017 - RNA, 21 nt, Homo sapiens
aucaguucuacggaucaucaa

SEQ ID NO: 961018 - RNA, 18 nt, Homo sapiens
aucaucaaaaagaacaac

SEQ ID NO: 961019 - RNA, 23 nt, Homo sapiens
aucaucccaggggagaacuacau

SEQ ID NO: 961020 - RNA, 17 nt, Homo sapiens
cacugaagccacagcug

SEQ ID NO: 961021 - RNA, 15 nt, Homo sapiens
cacugcacuccagcu

SEQ ID NO: 961022 - RNA, 14 nt, Homo sapiens
cacugcaugcagaa

SEQ ID NO: 961023 - RNA, 14 nt, Homo sapiens
cacugccagcaucu

SEQ ID NO: 961024 - RNA, 23 nt, Homo sapiens
cacugcgcccuuaacugcaucca

SEQ ID NO: 961025 - RNA, 20 nt, Homo sapiens
cacuggacuccggggcccca

SEQ ID NO: 961026 - RNA, 18 nt, Homo sapiens
cacuggcagcaucuucac

SEQ ID NO: 961027 - RNA, 17 nt, Homo sapiens
cacugggccugucacug

SEQ ID NO: 961028 - RNA, 18 nt, Homo sapiens
cacuguaccgacuuugau

SEQ ID NO: 961029 - RNA, 20 nt, Homo sapiens
cacuuaacuccuuuuccacu

SEQ ID NO: 961030 - RNA, 20 nt, Homo sapiens
cacuuacugacuuugcauuu

SEQ ID NO: 961031 - RNA, 23 nt, Homo sapiens
cacuucagcugggucacauccau

SEQ ID NO: 961032 - RNA, 23 nt, Homo sapiens
cacuuggggguaaaggucugugg

SEQ ID NO: 961033 - RNA, 20 nt, Homo sapiens
cacuugguucuuguacucua

SEQ ID NO: 961034 - RNA, 15 nt, Homo sapiens
cacuuuaauguacau

SEQ ID NO: 961035 - RNA, 20 nt, Homo sapiens
cacuuucccacacugugaac

SEQ ID NO: 961036 - RNA, 16 nt, Homo sapiens
cacuuuguugcaagau

SEQ ID NO: 961037 - RNA, 12 nt, Homo sapiens
cagaaacaucuc

SEQ ID NO: 961038 - RNA, 21 nt, Homo sapiens
cagaaaguaucacaaauggaa

SEQ ID NO: 961039 - RNA, 14 nt, Homo sapiens
cagaaagucuucau

SEQ ID NO: 961040 - RNA, 23 nt, Homo sapiens
cagaacacauuucucugaucucc

SEQ ID NO: 961041 - RNA, 15 nt, Homo sapiens
cagaaccugcuccug

SEQ ID NO: 961042 - RNA, 20 nt, Homo sapiens
cagaaccugcuccuggagua

SEQ ID NO: 961043 - RNA, 14 nt, Homo sapiens
cagaagccuuggaa

SEQ ID NO: 961044 - RNA, 18 nt, Homo sapiens
cagaagcggagagccugg

SEQ ID NO: 961045 - RNA, 22 nt, Homo sapiens
cagaaggugccacuuuacccac

SEQ ID NO: 961046 - RNA, 21 nt, Homo sapiens
cagaaugcucagggucacuga

SEQ ID NO: 961047 - RNA, 12 nt, Homo sapiens
cagaauugcuca

SEQ ID NO: 961048 - RNA, 12 nt, Homo sapiens
cagacauuccaa

SEQ ID NO: 961049 - RNA, 16 nt, Homo sapiens
cagaccacgaguucau

SEQ ID NO: 961050 - RNA, 14 nt, Homo sapiens
cagaccaguacugg

SEQ ID NO: 961051 - RNA, 12 nt, Homo sapiens
cagacccagugg

SEQ ID NO: 961052 - RNA, 20 nt, Homo sapiens
cagaccugugugugccucca

SEQ ID NO: 961053 - RNA, 17 nt, Homo sapiens
cagacguugccugagaa

SEQ ID NO: 961054 - RNA, 18 nt, Homo sapiens
cagacuggucuugaacuc

SEQ ID NO: 961055 - RNA, 19 nt, Homo sapiens
cagacugugcaauacuuag

SEQ ID NO: 961056 - RNA, 17 nt, Homo sapiens
cagagacacuguugaua

SEQ ID NO: 961057 - RNA, 19 nt, Homo sapiens
cagagaggaccuaucccaa

SEQ ID NO: 961058 - RNA, 16 nt, Homo sapiens
cagagcaaguccucac

SEQ ID NO: 961059 - RNA, 20 nt, Homo sapiens
cagagcgccaggaagccaga

SEQ ID NO: 961060 - RNA, 14 nt, Homo sapiens
uuuauaucaugcaa

SEQ ID NO: 961061 - RNA, 20 nt, Homo sapiens
uuuauaugauuaaauuauca

SEQ ID NO: 961062 - RNA, 14 nt, Homo sapiens
uuuaucuauuggcc

SEQ ID NO: 961063 - RNA, 17 nt, Homo sapiens
uuuauuaaaauauuuca

SEQ ID NO: 961064 - RNA, 19 nt, Homo sapiens
uuuauuacauugcugccuu

SEQ ID NO: 961065 - RNA, 21 nt, Homo sapiens
uuuauuccaaaugccauccag

SEQ ID NO: 961066 - RNA, 13 nt, Homo sapiens
uuucaaagugaua

SEQ ID NO: 961067 - RNA, 14 nt, Homo sapiens
uuucaaaucauucc

SEQ ID NO: 961068 - RNA, 19 nt, Homo sapiens
uuucaacugucuuccucaa

SEQ ID NO: 961069 - RNA, 16 nt, Homo sapiens
uuucacauuguacuua

SEQ ID NO: 961070 - RNA, 18 nt, Homo sapiens
uuucacuuguguuuuaaa

SEQ ID NO: 961071 - RNA, 18 nt, Homo sapiens
uuucaggaguuacuggau

SEQ ID NO: 961072 - RNA, 15 nt, Homo sapiens
uuucauccuugacua

SEQ ID NO: 961073 - RNA, 20 nt, Homo sapiens
uuucauguaacauacauauu

SEQ ID NO: 961074 - RNA, 18 nt, Homo sapiens
uuucauuaaagaauguuu

SEQ ID NO: 961075 - RNA, 14 nt, Homo sapiens
uuuccauauagcuc

SEQ ID NO: 961076 - RNA, 23 nt, Homo sapiens
uuucccugcagaccucaagccau

SEQ ID NO: 961077 - RNA, 22 nt, Homo sapiens
uuuccucuccacacagugcuca

SEQ ID NO: 961078 - RNA, 18 nt, Homo sapiens
uuuccuuuuugacacuga

SEQ ID NO: 961079 - RNA, 19 nt, Homo sapiens
uuucuauuuuguuggauga

SEQ ID NO: 961080 - RNA, 13 nt, Homo sapiens
uuucucucagauu

SEQ ID NO: 961081 - RNA, 19 nt, Homo sapiens
uuucucuguaaacuuccaa

SEQ ID NO: 961082 - RNA, 16 nt, Homo sapiens
uuucugaauugcacau

SEQ ID NO: 961083 - RNA, 14 nt, Homo sapiens
uuucugcagggaug

SEQ ID NO: 961084 - RNA, 17 nt, Homo sapiens
uuucugcauagagucuu

SEQ ID NO: 961085 - RNA, 18 nt, Homo sapiens
uuucuguagcaccagaga

SEQ ID NO: 961086 - RNA, 13 nt, Homo sapiens
uuucugugucuua

SEQ ID NO: 961087 - RNA, 21 nt, Homo sapiens
uuugaauguuuucaaaaccaa

SEQ ID NO: 961088 - RNA, 23 nt, Homo sapiens
uuugaauguuuucaaaaccaagu

SEQ ID NO: 961089 - RNA, 12 nt, Homo sapiens
uuugacacugaa

SEQ ID NO: 961090 - RNA, 20 nt, Homo sapiens
uuugacuuaagaaagcaaaa

SEQ ID NO: 961091 - RNA, 18 nt, Homo sapiens
uuugagcugagugcugaa

SEQ ID NO: 961092 - RNA, 18 nt, Homo sapiens
uuugagcuuuaucucuaa

SEQ ID NO: 961093 - RNA, 15 nt, Homo sapiens
uuugcaacugucucu

SEQ ID NO: 961094 - RNA, 17 nt, Homo sapiens
uuugcaugcaugcaaau

SEQ ID NO: 961095 - RNA, 17 nt, Homo sapiens
uuugcucaacagaacau

SEQ ID NO: 961096 - RNA, 14 nt, Homo sapiens
uuugcugguuucau

SEQ ID NO: 961097 - RNA, 21 nt, Homo sapiens
uuuggaaguuuagcucugaga

SEQ ID NO: 961098 - RNA, 14 nt, Homo sapiens
uuugggaccugcuu

SEQ ID NO: 961099 - RNA, 17 nt, Homo sapiens
uuuguaaagcccuugca

SEQ ID NO: 961100 - RNA, 22 nt, Homo sapiens
uuuguauucucuuccucaucca

SEQ ID NO: 961101 - RNA, 12 nt, Homo sapiens
uuugucugugau

SEQ ID NO: 961102 - RNA, 23 nt, Homo sapiens
uuugugaaaugaaaacauguaau

SEQ ID NO: 961103 - RNA, 21 nt, Homo sapiens
uuuguuugccaggacaugcaa

SEQ ID NO: 961104 - RNA, 17 nt, Homo sapiens
uuuuaagaagacauacu

SEQ ID NO: 961105 - RNA, 18 nt, Homo sapiens
uuuuacuucucuauacaa

SEQ ID NO: 961106 - RNA, 20 nt, Homo sapiens
uuuuauacaaaccuaccaaa

SEQ ID NO: 961107 - RNA, 21 nt, Homo sapiens
uuuuauacuuuugaccaaaua

SEQ ID NO: 961108 - RNA, 16 nt, Homo sapiens
uuuuauaucaugcaaa

SEQ ID NO: 961109 - RNA, 14 nt, Homo sapiens
uuuuauugccuuga

SEQ ID NO: 961110 - RNA, 13 nt, Homo sapiens
uuuucaaggcauu

SEQ ID NO: 961111 - RNA, 20 nt, Homo sapiens
uuuucaauuaguaacauuca

SEQ ID NO: 961112 - RNA, 16 nt, Homo sapiens
uuuucacacugguaaa

SEQ ID NO: 961113 - RNA, 21 nt, Homo sapiens
uuuucacguaucuuccaagua

SEQ ID NO: 961114 - RNA, 21 nt, Homo sapiens
uuuucauccuauaagcuuaaa

SEQ ID NO: 961115 - RNA, 12 nt, Homo sapiens
uuuuccaggaau

SEQ ID NO: 961116 - RNA, 15 nt, Homo sapiens
uuuucccucuucacu

SEQ ID NO: 961117 - RNA, 17 nt, Homo sapiens
uuuucguauuucaaaua

SEQ ID NO: 961118 - RNA, 22 nt, Homo sapiens
uuuucuacuuuaaauuguggau

SEQ ID NO: 961119 - RNA, 12 nt, Homo sapiens
uuuucucuugcc

SEQ ID NO: 961120 - RNA, 13 nt, Homo sapiens
uuuucugaagaca

SEQ ID NO: 961121 - RNA, 14 nt, Homo sapiens
uuuugguaucuuca

SEQ ID NO: 961122 - RNA, 11 nt, Homo sapiens
uuuugugaauu

SEQ ID NO: 961123 - RNA, 19 nt, Homo sapiens
uuuuuaaaguuucuugcau

SEQ ID NO: 961124 - RNA, 13 nt, Homo sapiens
uuuuuaauuggcc

SEQ ID NO: 961125 - RNA, 13 nt, Homo sapiens
uuuuuauaauuca

SEQ ID NO: 961126 - RNA, 23 nt, Homo sapiens
uuuuuccuacagcuacauugaga

SEQ ID NO: 961127 - RNA, 18 nt, Homo sapiens
uuuuugcugcugccucuu

SEQ ID NO: 961128 - RNA, 18 nt, Homo sapiens
uuuuugggggaaggucag

SEQ ID NO: 961129 - RNA, 17 nt, Homo sapiens
uuccuuuuugacacuga

SEQ ID NO: 961130 - RNA, 19 nt, Homo sapiens
uuccuuuuugacacugaaa

SEQ ID NO: 961131 - RNA, 19 nt, Homo sapiens
uucggaagggguuccucaa

SEQ ID NO: 961132 - RNA, 12 nt, Homo sapiens
uucguauuucaa

SEQ ID NO: 961133 - RNA, 17 nt, Homo sapiens
uucuaaccuccuaagca

SEQ ID NO: 961134 - RNA, 14 nt, Homo sapiens
uucuagucacuucc

SEQ ID NO: 961135 - RNA, 15 nt, Homo sapiens
uucuauuauggaaaa

SEQ ID NO: 961136 - RNA, 13 nt, Homo sapiens
uucuauuucauau

SEQ ID NO: 961137 - RNA, 19 nt, Homo sapiens
uucucagaaaugucaugau

SEQ ID NO: 961138 - RNA, 16 nt, Homo sapiens
uucucaucccaaccuc

SEQ ID NO: 961139 - RNA, 19 nt, Homo sapiens
uucucgugguagaagccag

SEQ ID NO: 961140 - RNA, 20 nt, Homo sapiens
uucucgugguagaagccagu

SEQ ID NO: 961141 - RNA, 15 nt, Homo sapiens
uucucucagauuucc

SEQ ID NO: 961142 - RNA, 21 nt, Homo sapiens
uucucuuaaguggucuaguca

SEQ ID NO: 961143 - RNA, 17 nt, Homo sapiens
uucucuuucuuuuacug

SEQ ID NO: 961144 - RNA, 13 nt, Homo sapiens
uucugaaacacac

SEQ ID NO: 961145 - RNA, 16 nt, Homo sapiens
uucugagcuccugucc

SEQ ID NO: 961146 - RNA, 16 nt, Homo sapiens
uucugcacuucauauc

SEQ ID NO: 961147 - RNA, 23 nt, Homo sapiens
uucugcagggaugauaguggaau

SEQ ID NO: 961148 - RNA, 16 nt, Homo sapiens
uucugcagucaucucc

SEQ ID NO: 961149 - RNA, 19 nt, Homo sapiens
uucugccaaugaccaaaca

SEQ ID NO: 961150 - RNA, 20 nt, Homo sapiens
uucugccgcccccuccugaa

SEQ ID NO: 961151 - RNA, 17 nt, Homo sapiens
uucugccuucucaggaa

SEQ ID NO: 961152 - RNA, 14 nt, Homo sapiens
uucugcucugccau

SEQ ID NO: 961153 - RNA, 15 nt, Homo sapiens
uucuguagcaccaga

SEQ ID NO: 961154 - RNA, 21 nt, Homo sapiens
uucuuccuaaugucagaacag

SEQ ID NO: 961155 - RNA, 21 nt, Homo sapiens
uucuucuauauaugaaccuau

SEQ ID NO: 961156 - RNA, 15 nt, Homo sapiens
uucuucucuuauccu

SEQ ID NO: 961157 - RNA, 21 nt, Homo sapiens
uucuugccugaacuccugcca

SEQ ID NO: 961158 - RNA, 13 nt, Homo sapiens
uucuuuccucaca

SEQ ID NO: 961159 - RNA, 21 nt, Homo sapiens
uugaaacuuugggaaaacaug

SEQ ID NO: 961160 - RNA, 23 nt, Homo sapiens
uugaaaugagaaacuuugaucuc

SEQ ID NO: 961161 - RNA, 20 nt, Homo sapiens
uugaaaugaguaaaaacuag

SEQ ID NO: 961162 - RNA, 14 nt, Homo sapiens
uugaagagauuuua

SEQ ID NO: 961163 - RNA, 17 nt, Homo sapiens
uugaagauuauaugaag

SEQ ID NO: 961164 - RNA, 21 nt, Homo sapiens
uugaagcucgugacaagugcc

SEQ ID NO: 961165 - RNA, 19 nt, Homo sapiens
uugaaggcccugcugaguc

SEQ ID NO: 961166 - RNA, 22 nt, Homo sapiens
uugaaggguguugcacccuuuu

SEQ ID NO: 961167 - RNA, 13 nt, Homo sapiens
uugaaguggagcc

SEQ ID NO: 961168 - RNA, 15 nt, Homo sapiens
uugaauagucucauc

SEQ ID NO: 961169 - RNA, 12 nt, Homo sapiens
uugacacugaac

SEQ ID NO: 961170 - RNA, 16 nt, Homo sapiens
uugacauacauucccu

SEQ ID NO: 961171 - RNA, 18 nt, Homo sapiens
uugaccauauagauuuua

SEQ ID NO: 961172 - RNA, 22 nt, Homo sapiens
uugagaagccuucagcuccagg

SEQ ID NO: 961173 - RNA, 12 nt, Homo sapiens
uugagaaugagu

SEQ ID NO: 961174 - RNA, 18 nt, Homo sapiens
uugagcugagugcugaaa

SEQ ID NO: 961175 - RNA, 23 nt, Homo sapiens
uugaggucaaguaagaagacaug

SEQ ID NO: 961176 - RNA, 13 nt, Homo sapiens
uugaggugcaagg

SEQ ID NO: 961177 - RNA, 11 nt, Homo sapiens
uugaguaccaa

SEQ ID NO: 961178 - RNA, 15 nt, Homo sapiens
uugaguaccuacugu

SEQ ID NO: 961179 - RNA, 21 nt, Homo sapiens
uugaguaccuacugugugcca

SEQ ID NO: 961180 - RNA, 22 nt, Homo sapiens
uugaguuuuuccucccagugag

SEQ ID NO: 961181 - RNA, 13 nt, Homo sapiens
uugauagauuucu

SEQ ID NO: 961182 - RNA, 21 nt, Homo sapiens
uugauagauuucuacacugag

SEQ ID NO: 961183 - RNA, 19 nt, Homo sapiens
uugaugaauaaaaugaagg

SEQ ID NO: 961184 - RNA, 19 nt, Homo sapiens
uugauugucagcuacuaau

SEQ ID NO: 961185 - RNA, 23 nt, Homo sapiens
uugcaaccucuuugcucaacaga

SEQ ID NO: 961186 - RNA, 21 nt, Homo sapiens
uugcaauaacagcugcaauuc

SEQ ID NO: 961187 - RNA, 22 nt, Homo sapiens
uugcacauucccuggccgcuuc

SEQ ID NO: 961188 - RNA, 23 nt, Homo sapiens
uugcagguggggguugcuguaua

SEQ ID NO: 961189 - RNA, 10 nt, Homo sapiens
uugcauuugg

SEQ ID NO: 961190 - RNA, 19 nt, Homo sapiens
uugccacggaaacauacag

SEQ ID NO: 961191 - RNA, 20 nt, Homo sapiens
uugccauagcugacuacaaa

SEQ ID NO: 961192 - RNA, 21 nt, Homo sapiens
uugcccugaacauacacaugc

SEQ ID NO: 961193 - RNA, 14 nt, Homo sapiens
uugccucauauugu

SEQ ID NO: 961194 - RNA, 16 nt, Homo sapiens
uugccucguguaacau

SEQ ID NO: 961195 - RNA, 20 nt, Homo sapiens
uugccugucaaguuguacau

SEQ ID NO: 961196 - RNA, 20 nt, Homo sapiens
uugcucaacagaacauaugu

SEQ ID NO: 961197 - RNA, 13 nt, Homo sapiens
uugcugaugaaag

SEQ ID NO: 961198 - RNA, 18 nt, Homo sapiens
uuggaaaaaaaccacagc

SEQ ID NO: 961199 - RNA, 22 nt, Homo sapiens
uuggagaaccagggcucuucuc

SEQ ID NO: 961200 - RNA, 20 nt, Homo sapiens
uuggaugucacugccugaca

SEQ ID NO: 961201 - RNA, 18 nt, Homo sapiens
uuggauucuaaauacaug

SEQ ID NO: 961202 - RNA, 23 nt, Homo sapiens
uuggcugggaagacuauggugcu

SEQ ID NO: 961203 - RNA, 13 nt, Homo sapiens
uugggaccugcuu

SEQ ID NO: 961204 - RNA, 22 nt, Homo sapiens
uugggaggcugaggcaggagaa

SEQ ID NO: 961205 - RNA, 12 nt, Homo sapiens
uugggaguugua

SEQ ID NO: 961206 - RNA, 15 nt, Homo sapiens
uugggcucgcacugc

SEQ ID NO: 961207 - RNA, 21 nt, Homo sapiens
uuggggaggggccucccugug

SEQ ID NO: 961208 - RNA, 16 nt, Homo sapiens
uugguacuauggugug

SEQ ID NO: 961209 - RNA, 17 nt, Homo sapiens
uuggucacaaagcuauu

SEQ ID NO: 961210 - RNA, 17 nt, Homo sapiens
uuggugcuuuucacuug

SEQ ID NO: 961211 - RNA, 15 nt, Homo sapiens
uugguguugacauac

SEQ ID NO: 961212 - RNA, 15 nt, Homo sapiens
uugguuucacagaua

SEQ ID NO: 961213 - RNA, 22 nt, Homo sapiens
uugguuuuauuuuauacuugcc

SEQ ID NO: 961214 - RNA, 12 nt, Homo sapiens
uuguaacuaaua

SEQ ID NO: 961215 - RNA, 16 nt, Homo sapiens
uuguaagaguguagaa

SEQ ID NO: 961216 - RNA, 22 nt, Homo sapiens
uuguaagaguguagaagcauuc

SEQ ID NO: 961217 - RNA, 22 nt, Homo sapiens
uuguaauaauaaaaccaaagaa

SEQ ID NO: 961218 - RNA, 14 nt, Homo sapiens
uuguacuaaucuga

SEQ ID NO: 961219 - RNA, 15 nt, Homo sapiens
uuguauuaagccaau

SEQ ID NO: 961220 - RNA, 20 nt, Homo sapiens
uugucagcaauaauauguga

SEQ ID NO: 961221 - RNA, 14 nt, Homo sapiens
uugucugguccuga

SEQ ID NO: 961222 - RNA, 13 nt, Homo sapiens
uugugagaaacau

SEQ ID NO: 961223 - RNA, 15 nt, Homo sapiens
uugugcaaagccaaa

SEQ ID NO: 961224 - RNA, 16 nt, Homo sapiens
uugugcuccaaacaaa

SEQ ID NO: 961225 - RNA, 21 nt, Homo sapiens
uugugcugcaccuggucauac

SEQ ID NO: 961226 - RNA, 23 nt, Homo sapiens
uugugugcucuccauucugcucc

SEQ ID NO: 961227 - RNA, 19 nt, Homo sapiens
uuguugcaagaugugaauu

SEQ ID NO: 961228 - RNA, 21 nt, Homo sapiens
uuguuucaaaugaaacuuuaa

SEQ ID NO: 961229 - RNA, 20 nt, Homo sapiens
uuuaaaaauguuuuccccaa

SEQ ID NO: 961230 - RNA, 12 nt, Homo sapiens
uuuaaaacacac

SEQ ID NO: 961231 - RNA, 14 nt, Homo sapiens
uuuaaccuaugaua

SEQ ID NO: 961232 - RNA, 11 nt, Homo sapiens
uuuaagccaua

SEQ ID NO: 961233 - RNA, 17 nt, Homo sapiens
uuuaaggggaucuaaaa

SEQ ID NO: 961234 - RNA, 18 nt, Homo sapiens
uuuaagugcguguguaga

SEQ ID NO: 961235 - RNA, 21 nt, Homo sapiens
uuuaaugaugccauggcaacu

SEQ ID NO: 961236 - RNA, 19 nt, Homo sapiens
uuuaauguaauagggaaaa

SEQ ID NO: 961237 - RNA, 21 nt, Homo sapiens
uuuaauguacuugucaccuga

SEQ ID NO: 961238 - RNA, 23 nt, Homo sapiens
uuuacauguauuuaaaguagcau

SEQ ID NO: 961239 - RNA, 16 nt, Homo sapiens
uuuagaaaugcaaaau

SEQ ID NO: 961240 - RNA, 20 nt, Homo sapiens
uuuagcagauuuaagauaug

SEQ ID NO: 961241 - RNA, 19 nt, Homo sapiens
uuuagccacucaaagucaa

SEQ ID NO: 961242 - RNA, 22 nt, Homo sapiens
uuuauaauucagaagacuacua

SEQ ID NO: 961243 - RNA, 15 nt, Homo sapiens
uuaacggugcuaaaa

SEQ ID NO: 961244 - RNA, 19 nt, Homo sapiens
uuaacucaccucucaaggu

SEQ ID NO: 961245 - RNA, 13 nt, Homo sapiens
uuaagaaauucca

SEQ ID NO: 961246 - RNA, 20 nt, Homo sapiens
uuaagauguggaacaacagc

SEQ ID NO: 961247 - RNA, 18 nt, Homo sapiens
uuaagcauuuugaaacaa

SEQ ID NO: 961248 - RNA, 23 nt, Homo sapiens
uuaaggauaaaucauaaagucag

SEQ ID NO: 961249 - RNA, 14 nt, Homo sapiens
uuaaguaccaaugg

SEQ ID NO: 961250 - RNA, 16 nt, Homo sapiens
uuaagugaauacauua

SEQ ID NO: 961251 - RNA, 20 nt, Homo sapiens
uuaagugacuauagaaugca

SEQ ID NO: 961252 - RNA, 17 nt, Homo sapiens
uuaagugagcagaacag

SEQ ID NO: 961253 - RNA, 21 nt, Homo sapiens
uuaauaagaaacaugauguga

SEQ ID NO: 961254 - RNA, 16 nt, Homo sapiens
uuaauaccagcuuaaa

SEQ ID NO: 961255 - RNA, 13 nt, Homo sapiens
uuaauauaguuua

SEQ ID NO: 961256 - RNA, 20 nt, Homo sapiens
uuaauauuuuccuaguagau

SEQ ID NO: 961257 - RNA, 20 nt, Homo sapiens
uuaauauuuuuccacuuaaa

SEQ ID NO: 961258 - RNA, 17 nt, Homo sapiens
uuaauuacaacugcuau

SEQ ID NO: 961259 - RNA, 20 nt, Homo sapiens
uuaauugaaauaccuauuca

SEQ ID NO: 961260 - RNA, 19 nt, Homo sapiens
uuaauuuccuuuuugacac

SEQ ID NO: 961261 - RNA, 21 nt, Homo sapiens
uuacaaacuuuguuugucaca

SEQ ID NO: 961262 - RNA, 22 nt, Homo sapiens
uuacaaugaucaccgacugaaa

SEQ ID NO: 961263 - RNA, 19 nt, Homo sapiens
uuacaguggcaguauugac

SEQ ID NO: 961264 - RNA, 18 nt, Homo sapiens
uuaccacugugguuuuga

SEQ ID NO: 961265 - RNA, 17 nt, Homo sapiens
uuaccuacaagaacaau

SEQ ID NO: 961266 - RNA, 14 nt, Homo sapiens
uuacgcccaucuca

SEQ ID NO: 961267 - RNA, 21 nt, Homo sapiens
uuacuaaacauguauguaaau

SEQ ID NO: 961268 - RNA, 16 nt, Homo sapiens
uuacucuaacaaacaa

SEQ ID NO: 961269 - RNA, 18 nt, Homo sapiens
uuacucuuuccuauuuca

SEQ ID NO: 961270 - RNA, 17 nt, Homo sapiens
uuacuuaauugccagca

SEQ ID NO: 961271 - RNA, 23 nt, Homo sapiens
uuagaaaugagaaaaauacagag

SEQ ID NO: 961272 - RNA, 19 nt, Homo sapiens
uuagaaaugagaucuagag

SEQ ID NO: 961273 - RNA, 23 nt, Homo sapiens
uuagaauauccaugaccuaguuu

SEQ ID NO: 961274 - RNA, 17 nt, Homo sapiens
uuagaguugcucuacaa

SEQ ID NO: 961275 - RNA, 20 nt, Homo sapiens
uuagcuccauaaaguacaaa

SEQ ID NO: 961276 - RNA, 12 nt, Homo sapiens
uuagcucugaga

SEQ ID NO: 961277 - RNA, 20 nt, Homo sapiens
uuaggagcagcucuucagca

SEQ ID NO: 961278 - RNA, 16 nt, Homo sapiens
uuaguaugugcauuua

SEQ ID NO: 961279 - RNA, 18 nt, Homo sapiens
uuaguggauggaauauca

SEQ ID NO: 961280 - RNA, 13 nt, Homo sapiens
uuauaacucugua

SEQ ID NO: 961281 - RNA, 14 nt, Homo sapiens
uuauacaccagcaa

SEQ ID NO: 961282 - RNA, 22 nt, Homo sapiens
uuauacucaccugcguuuucau

SEQ ID NO: 961283 - RNA, 18 nt, Homo sapiens
uuauagcaacaacaauug

SEQ ID NO: 961284 - RNA, 22 nt, Homo sapiens
uuauagcaacaacaauugguaa

SEQ ID NO: 961285 - RNA, 16 nt, Homo sapiens
uuauaguaaugugacu

SEQ ID NO: 961286 - RNA, 24 nt, Homo sapiens
uuauagucaauggcuuguucauca

SEQ ID NO: 961287 - RNA, 13 nt, Homo sapiens
uuauaucaugcaa

SEQ ID NO: 961288 - RNA, 19 nt, Homo sapiens
uuauauguagccuuuacug

SEQ ID NO: 961289 - RNA, 16 nt, Homo sapiens
uuaucaugcauguccu

SEQ ID NO: 961290 - RNA, 19 nt, Homo sapiens
uuaucauuaaaaauuaccu

SEQ ID NO: 961291 - RNA, 16 nt, Homo sapiens
uuaucauuuacugugu

SEQ ID NO: 961292 - RNA, 21 nt, Homo sapiens
uuauccaccaagaacauaaga

SEQ ID NO: 961293 - RNA, 17 nt, Homo sapiens
uuaucgaaauaacaaug

SEQ ID NO: 961294 - RNA, 21 nt, Homo sapiens
uuaucuauuccugaaauuucu

SEQ ID NO: 961295 - RNA, 22 nt, Homo sapiens
uuaucucuaaaugugacaugca

SEQ ID NO: 961296 - RNA, 18 nt, Homo sapiens
uuaugaguuuuucaauua

SEQ ID NO: 961297 - RNA, 20 nt, Homo sapiens
uuaugaucuggcccuugcuu

SEQ ID NO: 961298 - RNA, 16 nt, Homo sapiens
uuaugcuaugaagagu

SEQ ID NO: 961299 - RNA, 16 nt, Homo sapiens
uuauggaaaacugugu

SEQ ID NO: 961300 - RNA, 15 nt, Homo sapiens
uuauggcuucacauu

SEQ ID NO: 961301 - RNA, 17 nt, Homo sapiens
uuauguagguaagacug

SEQ ID NO: 961302 - RNA, 17 nt, Homo sapiens
uuauucaguaacuguca

SEQ ID NO: 961303 - RNA, 15 nt, Homo sapiens
uuauucauaauguga

SEQ ID NO: 961304 - RNA, 23 nt, Homo sapiens
uuauuugcuaccacagcaacuau

SEQ ID NO: 961305 - RNA, 22 nt, Homo sapiens
uucaaaucacauggaacuuuag

SEQ ID NO: 961306 - RNA, 20 nt, Homo sapiens
uucaaauucuucugaacuca

SEQ ID NO: 961307 - RNA, 21 nt, Homo sapiens
uucaagcaaaacaguucucag

SEQ ID NO: 961308 - RNA, 20 nt, Homo sapiens
uucaagcaaaaugcuuacag

SEQ ID NO: 961309 - RNA, 23 nt, Homo sapiens
uucaagcaaaaugcuuacagggc

SEQ ID NO: 961310 - RNA, 19 nt, Homo sapiens
uucaaguuuuaaaguucau

SEQ ID NO: 961311 - RNA, 23 nt, Homo sapiens
uucacaccucacgcucuggacau

SEQ ID NO: 961312 - RNA, 16 nt, Homo sapiens
uucacagauaacauaa

SEQ ID NO: 961313 - RNA, 16 nt, Homo sapiens
uucacagcacuuacaa

SEQ ID NO: 961314 - RNA, 11 nt, Homo sapiens
uucacauucau

SEQ ID NO: 961315 - RNA, 23 nt, Homo sapiens
uucacguggccuccgcagugucu

SEQ ID NO: 961316 - RNA, 23 nt, Homo sapiens
uucacuuguguuuuaaaauaagg

SEQ ID NO: 961317 - RNA, 23 nt, Homo sapiens
uucacuuuuggcaaugacucaaa

SEQ ID NO: 961318 - RNA, 12 nt, Homo sapiens
uucagaagugcc

SEQ ID NO: 961319 - RNA, 19 nt, Homo sapiens
uucagagcuucucacagca

SEQ ID NO: 961320 - RNA, 12 nt, Homo sapiens
uucagaguauau

SEQ ID NO: 961321 - RNA, 19 nt, Homo sapiens
uucagcacaaagacacaga

SEQ ID NO: 961322 - RNA, 14 nt, Homo sapiens
uucagcuccaggga

SEQ ID NO: 961323 - RNA, 23 nt, Homo sapiens
uucagugcaguuucuuuucacau

SEQ ID NO: 961324 - RNA, 14 nt, Homo sapiens
uucauaacaucgaa

SEQ ID NO: 961325 - RNA, 18 nt, Homo sapiens
uucauaccuucugaugaa

SEQ ID NO: 961326 - RNA, 22 nt, Homo sapiens
uucauggugcacugagcugcaa

SEQ ID NO: 961327 - RNA, 21 nt, Homo sapiens
uucauuccuaacacagcaugu

SEQ ID NO: 961328 - RNA, 23 nt, Homo sapiens
uucauuccuaacacagcaugugu

SEQ ID NO: 961329 - RNA, 14 nt, Homo sapiens
uucauuucauuuca

SEQ ID NO: 961330 - RNA, 16 nt, Homo sapiens
uuccaagaacuauaaa

SEQ ID NO: 961331 - RNA, 19 nt, Homo sapiens
uuccaccaggccgugccuu

SEQ ID NO: 961332 - RNA, 14 nt, Homo sapiens
uuccagagccagaa

SEQ ID NO: 961333 - RNA, 16 nt, Homo sapiens
uuccagaucacugcca

SEQ ID NO: 961334 - RNA, 15 nt, Homo sapiens
uuccagaucuuucag

SEQ ID NO: 961335 - RNA, 18 nt, Homo sapiens
uuccagugucauuucuca

SEQ ID NO: 961336 - RNA, 20 nt, Homo sapiens
uuccauauagcucgagcaaa

SEQ ID NO: 961337 - RNA, 16 nt, Homo sapiens
uuccaugaguuaucau

SEQ ID NO: 961338 - RNA, 17 nt, Homo sapiens
uuccaugguuaccugac

SEQ ID NO: 961339 - RNA, 14 nt, Homo sapiens
uucccaacaugccu

SEQ ID NO: 961340 - RNA, 15 nt, Homo sapiens
uucccaauaucaugu

SEQ ID NO: 961341 - RNA, 19 nt, Homo sapiens
uucccaauaucaugugauu

SEQ ID NO: 961342 - RNA, 18 nt, Homo sapiens
uucccacacugugaacua

SEQ ID NO: 961343 - RNA, 13 nt, Homo sapiens
uucccauguggaa

SEQ ID NO: 961344 - RNA, 17 nt, Homo sapiens
uuccccugugucauccc

SEQ ID NO: 961345 - RNA, 13 nt, Homo sapiens
uucccuccccaga

SEQ ID NO: 961346 - RNA, 18 nt, Homo sapiens
uucccuuuaccacugugg

SEQ ID NO: 961347 - RNA, 21 nt, Homo sapiens
uuccuaggaggaaaauuccau

SEQ ID NO: 961348 - RNA, 12 nt, Homo sapiens
uuccuaggucau

SEQ ID NO: 961349 - RNA, 13 nt, Homo sapiens
uuccucagaucau

SEQ ID NO: 961350 - RNA, 15 nt, Homo sapiens
uuccuccuacuuaca

SEQ ID NO: 961351 - RNA, 14 nt, Homo sapiens
uuccucuuacugua

SEQ ID NO: 961352 - RNA, 22 nt, Homo sapiens
uuccugaccuccgccauccacc

SEQ ID NO: 961353 - RNA, 16 nt, Homo sapiens
uuccugauaacauuau

SEQ ID NO: 961354 - RNA, 19 nt, Homo sapiens
uuccugguguagcacuuaa

SEQ ID NO: 961355 - RNA, 13 nt, Homo sapiens
uuccugugaucca

SEQ ID NO: 961356 - RNA, 14 nt, Homo sapiens
uuccuuaugacuca

SEQ ID NO: 961357 - RNA, 12 nt, Homo sapiens
uggggcucucuc

SEQ ID NO: 961358 - RNA, 21 nt, Homo sapiens
uggggucuuugugguagcuua

SEQ ID NO: 961359 - RNA, 18 nt, Homo sapiens
ugggguuucuggggucca

SEQ ID NO: 961360 - RNA, 19 nt, Homo sapiens
ugggucagagcuaaacucc

SEQ ID NO: 961361 - RNA, 16 nt, Homo sapiens
ugggugggaguguuga

SEQ ID NO: 961362 - RNA, 16 nt, Homo sapiens
uggguguacaaacuca

SEQ ID NO: 961363 - RNA, 19 nt, Homo sapiens
uggucauaaaauagaauaa

SEQ ID NO: 961364 - RNA, 15 nt, Homo sapiens
uggucggugggaccc

SEQ ID NO: 961365 - RNA, 15 nt, Homo sapiens
uggucugcuccgccu

SEQ ID NO: 961366 - RNA, 12 nt, Homo sapiens
uggugaccaccc

SEQ ID NO: 961367 - RNA, 17 nt, Homo sapiens
uggugcacugagcugca

SEQ ID NO: 961368 - RNA, 19 nt, Homo sapiens
ugguggcucacgccuguaa

SEQ ID NO: 961369 - RNA, 20 nt, Homo sapiens
uggugggccucggguccagc

SEQ ID NO: 961370 - RNA, 18 nt, Homo sapiens
ugguuauccaauugcucu

SEQ ID NO: 961371 - RNA, 22 nt, Homo sapiens
ugguucaauuucagaaguaaug

SEQ ID NO: 961372 - RNA, 20 nt, Homo sapiens
ugguuuuauuucaaagggaa

SEQ ID NO: 961373 - RNA, 13 nt, Homo sapiens
uguaaaaauguua

SEQ ID NO: 961374 - RNA, 21 nt, Homo sapiens
uguaaaauguuuaauggugaa

SEQ ID NO: 961375 - RNA, 15 nt, Homo sapiens
uguaaacacauguuc

SEQ ID NO: 961376 - RNA, 13 nt, Homo sapiens
uguaaacugugua

SEQ ID NO: 961377 - RNA, 14 nt, Homo sapiens
uguaaagauauugu

SEQ ID NO: 961378 - RNA, 17 nt, Homo sapiens
uguaaaguagaauaagc

SEQ ID NO: 961379 - RNA, 21 nt, Homo sapiens
uguaacaagaaaguggucugu

SEQ ID NO: 961380 - RNA, 21 nt, Homo sapiens
uguaacccccaguucaagacu

SEQ ID NO: 961381 - RNA, 17 nt, Homo sapiens
uguaacuuaacuauuaa

SEQ ID NO: 961382 - RNA, 18 nt, Homo sapiens
uguaagaaggcaauauua

SEQ ID NO: 961383 - RNA, 19 nt, Homo sapiens
uguaauaauaaaaccaaag

SEQ ID NO: 961384 - RNA, 14 nt, Homo sapiens
uguaauauuuugcu

SEQ ID NO: 961385 - RNA, 19 nt, Homo sapiens
uguacacuaccaaacacuc

SEQ ID NO: 961386 - RNA, 22 nt, Homo sapiens
uguacauguguagccugugcau

SEQ ID NO: 961387 - RNA, 20 nt, Homo sapiens
uguagaaaauaaaacugagc

SEQ ID NO: 961388 - RNA, 15 nt, Homo sapiens
uguagagaugggaug

SEQ ID NO: 961389 - RNA, 21 nt, Homo sapiens
uguauauuuuguaguuaauau

SEQ ID NO: 961390 - RNA, 22 nt, Homo sapiens
uguauauuuuuaaagaauguua

SEQ ID NO: 961391 - RNA, 14 nt, Homo sapiens
uguaugacuaaaga

SEQ ID NO: 961392 - RNA, 11 nt, Homo sapiens
uguauguuaaa

SEQ ID NO: 961393 - RNA, 17 nt, Homo sapiens
uguauucucuuccucau

SEQ ID NO: 961394 - RNA, 17 nt, Homo sapiens
uguauuuccagugcaau

SEQ ID NO: 961395 - RNA, 21 nt, Homo sapiens
ugucaaaugugucucacaucu

SEQ ID NO: 961396 - RNA, 20 nt, Homo sapiens
ugucaagcugcucugagcca

SEQ ID NO: 961397 - RNA, 17 nt, Homo sapiens
ugucacuagucucacca

SEQ ID NO: 961398 - RNA, 12 nt, Homo sapiens
ugucagcaauaa

SEQ ID NO: 961399 - RNA, 20 nt, Homo sapiens
ugucaggcaugaagaagcca

SEQ ID NO: 961400 - RNA, 18 nt, Homo sapiens
ugucagggguuucuucaa

SEQ ID NO: 961401 - RNA, 18 nt, Homo sapiens
ugucaguucuaaccuccu

SEQ ID NO: 961402 - RNA, 20 nt, Homo sapiens
ugucaugacggggacagagu

SEQ ID NO: 961403 - RNA, 15 nt, Homo sapiens
uguccagugccuaca

SEQ ID NO: 961404 - RNA, 19 nt, Homo sapiens
uguccuuuuucacuuugaa

SEQ ID NO: 961405 - RNA, 18 nt, Homo sapiens
ugucuauuaucacauuaa

SEQ ID NO: 961406 - RNA, 20 nt, Homo sapiens
ugucucaaaggagcuuucuc

SEQ ID NO: 961407 - RNA, 20 nt, Homo sapiens
ugucucaguuuucacugucg

SEQ ID NO: 961408 - RNA, 21 nt, Homo sapiens
ugucucccuucgacauugagc

SEQ ID NO: 961409 - RNA, 16 nt, Homo sapiens
ugucuguccuuuauga

SEQ ID NO: 961410 - RNA, 15 nt, Homo sapiens
ugucuucaauggaau

SEQ ID NO: 961411 - RNA, 19 nt, Homo sapiens
ugucuuggacacuguacaa

SEQ ID NO: 961412 - RNA, 14 nt, Homo sapiens
ugucuuuggugcuu

SEQ ID NO: 961413 - RNA, 16 nt, Homo sapiens
ugucuuuggugcuuuu

SEQ ID NO: 961414 - RNA, 12 nt, Homo sapiens
ugugaacccugg

SEQ ID NO: 961415 - RNA, 23 nt, Homo sapiens
ugugaauagccuggccaccagcc

SEQ ID NO: 961416 - RNA, 13 nt, Homo sapiens
ugugacacauaug

SEQ ID NO: 961417 - RNA, 11 nt, Homo sapiens
ugugagccagc

SEQ ID NO: 961418 - RNA, 20 nt, Homo sapiens
ugugauggacacuccaggga

SEQ ID NO: 961419 - RNA, 13 nt, Homo sapiens
ugugcaugccaug

SEQ ID NO: 961420 - RNA, 17 nt, Homo sapiens
ugugccaauacagacaa

SEQ ID NO: 961421 - RNA, 23 nt, Homo sapiens
ugugcccacgaagacaaccauca

SEQ ID NO: 961422 - RNA, 14 nt, Homo sapiens
ugugcuuccuccug

SEQ ID NO: 961423 - RNA, 22 nt, Homo sapiens
uguggauaaggcuuaggugcca

SEQ ID NO: 961424 - RNA, 15 nt, Homo sapiens
uguggcagugguuuu

SEQ ID NO: 961425 - RNA, 23 nt, Homo sapiens
uguggcccucuggauccagccau

SEQ ID NO: 961426 - RNA, 15 nt, Homo sapiens
uguggccucaagcaa

SEQ ID NO: 961427 - RNA, 13 nt, Homo sapiens
ugugggacugaga

SEQ ID NO: 961428 - RNA, 13 nt, Homo sapiens
uguggguguccug

SEQ ID NO: 961429 - RNA, 15 nt, Homo sapiens
uguguaccuaaggga

SEQ ID NO: 961430 - RNA, 22 nt, Homo sapiens
uguguauauauaguagcauuuc

SEQ ID NO: 961431 - RNA, 9 nt, Homo sapiens
uguguauga

SEQ ID NO: 961432 - RNA, 19 nt, Homo sapiens
uguguauuuccagugcaau

SEQ ID NO: 961433 - RNA, 12 nt, Homo sapiens
ugugucuguaca

SEQ ID NO: 961434 - RNA, 16 nt, Homo sapiens
ugugucuguacacgug

SEQ ID NO: 961435 - RNA, 12 nt, Homo sapiens
ugugugugccuc

SEQ ID NO: 961436 - RNA, 16 nt, Homo sapiens
uguuaaaauggggaua

SEQ ID NO: 961437 - RNA, 15 nt, Homo sapiens
uguuaaggaaacucu

SEQ ID NO: 961438 - RNA, 13 nt, Homo sapiens
uguuaccuacuuu

SEQ ID NO: 961439 - RNA, 17 nt, Homo sapiens
uguucacugcuccuugc

SEQ ID NO: 961440 - RNA, 17 nt, Homo sapiens
uguucauggacuauucc

SEQ ID NO: 961441 - RNA, 22 nt, Homo sapiens
uguucccccuaaacauggcugu

SEQ ID NO: 961442 - RNA, 13 nt, Homo sapiens
uguuccucuagua

SEQ ID NO: 961443 - RNA, 20 nt, Homo sapiens
uguuccucuaguaguauauu

SEQ ID NO: 961444 - RNA, 13 nt, Homo sapiens
uguucucacuuau

SEQ ID NO: 961445 - RNA, 21 nt, Homo sapiens
uguucucagugaaauaacuac

SEQ ID NO: 961446 - RNA, 16 nt, Homo sapiens
uguucuggaagccaua

SEQ ID NO: 961447 - RNA, 15 nt, Homo sapiens
uguugaacacuugaa

SEQ ID NO: 961448 - RNA, 12 nt, Homo sapiens
uguugacauaca

SEQ ID NO: 961449 - RNA, 10 nt, Homo sapiens
uguugccagc

SEQ ID NO: 961450 - RNA, 15 nt, Homo sapiens
uguugggaaaguauu

SEQ ID NO: 961451 - RNA, 14 nt, Homo sapiens
uguugucaccagau

SEQ ID NO: 961452 - RNA, 14 nt, Homo sapiens
uguuuaauggguau

SEQ ID NO: 961453 - RNA, 23 nt, Homo sapiens
uguuuauuccaaaugccauccag

SEQ ID NO: 961454 - RNA, 14 nt, Homo sapiens
uguuuccacacuua

SEQ ID NO: 961455 - RNA, 14 nt, Homo sapiens
uguuuccagaauug

SEQ ID NO: 961456 - RNA, 18 nt, Homo sapiens
uguuuccuaggaggaaaa

SEQ ID NO: 961457 - RNA, 18 nt, Homo sapiens
uguuucugucaagcuggu

SEQ ID NO: 961458 - RNA, 17 nt, Homo sapiens
uguuuguuucuguagaa

SEQ ID NO: 961459 - RNA, 19 nt, Homo sapiens
uguuuuaaaauacucucau

SEQ ID NO: 961460 - RNA, 14 nt, Homo sapiens
uguuuuccuauaau

SEQ ID NO: 961461 - RNA, 18 nt, Homo sapiens
uguuuucuucaacaugcu

SEQ ID NO: 961462 - RNA, 12 nt, Homo sapiens
uguuuuguggau

SEQ ID NO: 961463 - RNA, 20 nt, Homo sapiens
uuaaaaacuagagcacagaa

SEQ ID NO: 961464 - RNA, 15 nt, Homo sapiens
uuaaaaagaaugacg

SEQ ID NO: 961465 - RNA, 16 nt, Homo sapiens
uuaaaaauguauguug

SEQ ID NO: 961466 - RNA, 16 nt, Homo sapiens
uuaaaaucaugauccu

SEQ ID NO: 961467 - RNA, 14 nt, Homo sapiens
uuaaaaugugaaga

SEQ ID NO: 961468 - RNA, 21 nt, Homo sapiens
uuaaagacaggagacaaaaga

SEQ ID NO: 961469 - RNA, 18 nt, Homo sapiens
uuaaagacguucccuuuu

SEQ ID NO: 961470 - RNA, 23 nt, Homo sapiens
uuaaauaaaauuuuuauguaauu

SEQ ID NO: 961471 - RNA, 21 nt, Homo sapiens
uuaaauuucuccaguggauuc

SEQ ID NO: 961472 - RNA, 14 nt, Homo sapiens
uuaacggugcuaaa

SEQ ID NO: 961473 - RNA, 14 nt, Homo sapiens
ugcuaaaacagcuu

SEQ ID NO: 961474 - RNA, 21 nt, Homo sapiens
ugcuaaagaaaggaacuaagu

SEQ ID NO: 961475 - RNA, 17 nt, Homo sapiens
ugcuaaugcuaugcaaa

SEQ ID NO: 961476 - RNA, 20 nt, Homo sapiens
ugcuagauuuagcacaguau

SEQ ID NO: 961477 - RNA, 17 nt, Homo sapiens
ugcuauacacacacaca

SEQ ID NO: 961478 - RNA, 16 nt, Homo sapiens
ugcuauuuaacauuuu

SEQ ID NO: 961479 - RNA, 23 nt, Homo sapiens
ugcuauuuauuuuccuaaagaga

SEQ ID NO: 961480 - RNA, 22 nt, Homo sapiens
ugcucaagccggaaacucggca

SEQ ID NO: 961481 - RNA, 17 nt, Homo sapiens
ugcucauauugugauuc

SEQ ID NO: 961482 - RNA, 17 nt, Homo sapiens
ugcucauugaacuuuaa

SEQ ID NO: 961483 - RNA, 12 nt, Homo sapiens
ugcucugccauc

SEQ ID NO: 961484 - RNA, 14 nt, Homo sapiens
ugcucugccccacc

SEQ ID NO: 961485 - RNA, 13 nt, Homo sapiens
ugcucugccucag

SEQ ID NO: 961486 - RNA, 16 nt, Homo sapiens
ugcucuucagccauag

SEQ ID NO: 961487 - RNA, 18 nt, Homo sapiens
ugcugacaacuuagcuca

SEQ ID NO: 961488 - RNA, 16 nt, Homo sapiens
ugcugcauugauccag

SEQ ID NO: 961489 - RNA, 22 nt, Homo sapiens
ugcugccuuuguugaggugcaa

SEQ ID NO: 961490 - RNA, 20 nt, Homo sapiens
ugcuggggcccuaccagcag

SEQ ID NO: 961491 - RNA, 15 nt, Homo sapiens
ugcuguaugugagcu

SEQ ID NO: 961492 - RNA, 15 nt, Homo sapiens
ugcugucauuagucu

SEQ ID NO: 961493 - RNA, 20 nt, Homo sapiens
ugcuguccuguuucugucaa

SEQ ID NO: 961494 - RNA, 14 nt, Homo sapiens
ugcugugauuccac

SEQ ID NO: 961495 - RNA, 19 nt, Homo sapiens
ugcuguuaauauaguuuag

SEQ ID NO: 961496 - RNA, 14 nt, Homo sapiens
ugcuguucagugcc

SEQ ID NO: 961497 - RNA, 14 nt, Homo sapiens
ugcuguugggauau

SEQ ID NO: 961498 - RNA, 19 nt, Homo sapiens
ugcuguugggauauaguca

SEQ ID NO: 961499 - RNA, 15 nt, Homo sapiens
ugcuguugugaagcu

SEQ ID NO: 961500 - RNA, 19 nt, Homo sapiens
ugcuuagucccucaugcaa

SEQ ID NO: 961501 - RNA, 16 nt, Homo sapiens
ugcuuccugacaauca

SEQ ID NO: 961502 - RNA, 20 nt, Homo sapiens
ugcuuccugcuguaugugag

SEQ ID NO: 961503 - RNA, 18 nt, Homo sapiens
ugcuuccugucugaguaa

SEQ ID NO: 961504 - RNA, 23 nt, Homo sapiens
ugcuugaaaugagaaacuuugau

SEQ ID NO: 961505 - RNA, 13 nt, Homo sapiens
ugcuuggcacuua

SEQ ID NO: 961506 - RNA, 16 nt, Homo sapiens
ugcuugggaagacucc

SEQ ID NO: 961507 - RNA, 21 nt, Homo sapiens
ugcuuucagaagugcccuucc

SEQ ID NO: 961508 - RNA, 16 nt, Homo sapiens
ugcuuugugagccagc

SEQ ID NO: 961509 - RNA, 16 nt, Homo sapiens
uggaaaaaaaccacag

SEQ ID NO: 961510 - RNA, 14 nt, Homo sapiens
uggaaaacuguguu

SEQ ID NO: 961511 - RNA, 20 nt, Homo sapiens
uggaaaagaaaagaaaugaa

SEQ ID NO: 961512 - RNA, 19 nt, Homo sapiens
uggaaaaggaagacuagag

SEQ ID NO: 961513 - RNA, 15 nt, Homo sapiens
uggaaacaccacugc

SEQ ID NO: 961514 - RNA, 21 nt, Homo sapiens
uggaaauagaaagaagccaua

SEQ ID NO: 961515 - RNA, 20 nt, Homo sapiens
uggaaauuugggagagccau

SEQ ID NO: 961516 - RNA, 14 nt, Homo sapiens
uggaacucuacuca

SEQ ID NO: 961517 - RNA, 20 nt, Homo sapiens
uggaaguuuagcucugagaa

SEQ ID NO: 961518 - RNA, 13 nt, Homo sapiens
uggaauacaguca

SEQ ID NO: 961519 - RNA, 18 nt, Homo sapiens
uggaauacagucauucca

SEQ ID NO: 961520 - RNA, 20 nt, Homo sapiens
uggaauauaucaguaccucu

SEQ ID NO: 961521 - RNA, 14 nt, Homo sapiens
uggaaugaaaacuu

SEQ ID NO: 961522 - RNA, 14 nt, Homo sapiens
uggaaugcccuuca

SEQ ID NO: 961523 - RNA, 22 nt, Homo sapiens
uggaauugacugccuaugccaa

SEQ ID NO: 961524 - RNA, 17 nt, Homo sapiens
uggaauuuggacaagug

SEQ ID NO: 961525 - RNA, 21 nt, Homo sapiens
uggacaagugcuguugggaua

SEQ ID NO: 961526 - RNA, 18 nt, Homo sapiens
uggacaguuuuaagcaga

SEQ ID NO: 961527 - RNA, 21 nt, Homo sapiens
uggaccaauagggcugagcuc

SEQ ID NO: 961528 - RNA, 14 nt, Homo sapiens
uggaccaugccaga

SEQ ID NO: 961529 - RNA, 16 nt, Homo sapiens
uggaccugggcaugac

SEQ ID NO: 961530 - RNA, 15 nt, Homo sapiens
uggacucugcacaug

SEQ ID NO: 961531 - RNA, 13 nt, Homo sapiens
uggacucuuccac

SEQ ID NO: 961532 - RNA, 16 nt, Homo sapiens
uggagcacaaaauuca

SEQ ID NO: 961533 - RNA, 17 nt, Homo sapiens
uggagccccaggggaca

SEQ ID NO: 961534 - RNA, 11 nt, Homo sapiens
uggaggggugu

SEQ ID NO: 961535 - RNA, 16 nt, Homo sapiens
uggaguaaguauuuag

SEQ ID NO: 961536 - RNA, 17 nt, Homo sapiens
uggaucacucaccauuc

SEQ ID NO: 961537 - RNA, 13 nt, Homo sapiens
uggaucagcauuu

SEQ ID NO: 961538 - RNA, 16 nt, Homo sapiens
uggauccugggucaaa

SEQ ID NO: 961539 - RNA, 23 nt, Homo sapiens
uggauccugggucaaaaaaaaga

SEQ ID NO: 961540 - RNA, 12 nt, Homo sapiens
uggaugaucucc

SEQ ID NO: 961541 - RNA, 21 nt, Homo sapiens
uggauucaauuuuaaggcaua

SEQ ID NO: 961542 - RNA, 15 nt, Homo sapiens
uggauucucauugcc

SEQ ID NO: 961543 - RNA, 20 nt, Homo sapiens
uggauuucauuaucauauga

SEQ ID NO: 961544 - RNA, 14 nt, Homo sapiens
uggcacagaagcuc

SEQ ID NO: 961545 - RNA, 19 nt, Homo sapiens
uggcagucugaauuuuuaa

SEQ ID NO: 961546 - RNA, 19 nt, Homo sapiens
uggcauacugagaauauac

SEQ ID NO: 961547 - RNA, 17 nt, Homo sapiens
uggccaaauagcaaaga

SEQ ID NO: 961548 - RNA, 11 nt, Homo sapiens
uggccaugaau

SEQ ID NO: 961549 - RNA, 18 nt, Homo sapiens
uggccauggugacauugu

SEQ ID NO: 961550 - RNA, 13 nt, Homo sapiens
uggcccuaaagga

SEQ ID NO: 961551 - RNA, 22 nt, Homo sapiens
uggccuauccgcugccagccuu

SEQ ID NO: 961552 - RNA, 22 nt, Homo sapiens
uggccuaugcacauauggacuc

SEQ ID NO: 961553 - RNA, 21 nt, Homo sapiens
uggccuccgcagugucuccac

SEQ ID NO: 961554 - RNA, 12 nt, Homo sapiens
uggccuuugaau

SEQ ID NO: 961555 - RNA, 21 nt, Homo sapiens
uggcgcuuagagaggacaaua

SEQ ID NO: 961556 - RNA, 16 nt, Homo sapiens
uggcucaacauugugu

SEQ ID NO: 961557 - RNA, 23 nt, Homo sapiens
uggcucuggugugaaguuugcuu

SEQ ID NO: 961558 - RNA, 17 nt, Homo sapiens
uggcugagguuccucug

SEQ ID NO: 961559 - RNA, 18 nt, Homo sapiens
uggcugauuuacuaacag

SEQ ID NO: 961560 - RNA, 19 nt, Homo sapiens
uggcuguuaacccacugca

SEQ ID NO: 961561 - RNA, 19 nt, Homo sapiens
uggcuguugacgcaccugu

SEQ ID NO: 961562 - RNA, 24 nt, Homo sapiens
uggcuuauuucuaugacaaauuca

SEQ ID NO: 961563 - RNA, 14 nt, Homo sapiens
uggcuuguucauca

SEQ ID NO: 961564 - RNA, 21 nt, Homo sapiens
uggcuuguucaucauccagau

SEQ ID NO: 961565 - RNA, 16 nt, Homo sapiens
ugggaaaacauuugcu

SEQ ID NO: 961566 - RNA, 23 nt, Homo sapiens
ugggaaccccuuucccaccccaa

SEQ ID NO: 961567 - RNA, 17 nt, Homo sapiens
ugggaacugaauugugu

SEQ ID NO: 961568 - RNA, 18 nt, Homo sapiens
ugggaagacuauggugcu

SEQ ID NO: 961569 - RNA, 23 nt, Homo sapiens
ugggaagccauauucacaccuca

SEQ ID NO: 961570 - RNA, 19 nt, Homo sapiens
ugggaaugaaauuaacaca

SEQ ID NO: 961571 - RNA, 14 nt, Homo sapiens
ugggacagcuugua

SEQ ID NO: 961572 - RNA, 14 nt, Homo sapiens
ugggagcugccaag

SEQ ID NO: 961573 - RNA, 18 nt, Homo sapiens
ugggaggagggagaggga

SEQ ID NO: 961574 - RNA, 21 nt, Homo sapiens
ugggaguuauaggucauggga

SEQ ID NO: 961575 - RNA, 15 nt, Homo sapiens
ugggaguuguaguua

SEQ ID NO: 961576 - RNA, 23 nt, Homo sapiens
ugggauuacaggcaugagccauu

SEQ ID NO: 961577 - RNA, 20 nt, Homo sapiens
ugggauugcuaaaacagcuu

SEQ ID NO: 961578 - RNA, 14 nt, Homo sapiens
ugggauuugagaua

SEQ ID NO: 961579 - RNA, 18 nt, Homo sapiens
ugggccauguccaaagag

SEQ ID NO: 961580 - RNA, 23 nt, Homo sapiens
ugggcucugccuuaaacacacau

SEQ ID NO: 961581 - RNA, 19 nt, Homo sapiens
ugggcugugggcaagccua

SEQ ID NO: 961582 - RNA, 22 nt, Homo sapiens
uggggaccucugggcagcuccu

SEQ ID NO: 961583 - RNA, 15 nt, Homo sapiens
uggggagauggaguu

SEQ ID NO: 961584 - RNA, 17 nt, Homo sapiens
uggggcacagaugccug

SEQ ID NO: 961585 - RNA, 19 nt, Homo sapiens
uggggcaggccaccuggcu

SEQ ID NO: 961586 - RNA, 22 nt, Homo sapiens
uggggccaccaaagcugcccac

SEQ ID NO: 961587 - RNA, 17 nt, Homo sapiens
uggggccuugaugacug

SEQ ID NO: 961588 - RNA, 14 nt, Homo sapiens
gcuuugguacuaau

SEQ ID NO: 961589 - RNA, 17 nt, Homo sapiens
gcuuuucccacucucau

SEQ ID NO: 961590 - RNA, 14 nt, Homo sapiens
gcuuuucuggaauu

SEQ ID NO: 961591 - RNA, 21 nt, Homo sapiens
ggaaaaaaauaguaaagccaa

SEQ ID NO: 961592 - RNA, 15 nt, Homo sapiens
ggaaaacagaccugu

SEQ ID NO: 961593 - RNA, 24 nt, Homo sapiens
ggaaaauaaacugacacuuauuaa

SEQ ID NO: 961594 - RNA, 16 nt, Homo sapiens
ggaaaauggccaugca

SEQ ID NO: 961595 - RNA, 15 nt, Homo sapiens
ggaaaccacacuucu

SEQ ID NO: 961596 - RNA, 22 nt, Homo sapiens
ggaaagaugguguggguguccu

SEQ ID NO: 961597 - RNA, 17 nt, Homo sapiens
ggaaagggcagggccaa

SEQ ID NO: 961598 - RNA, 16 nt, Homo sapiens
ggaaauaucugugaag

SEQ ID NO: 961599 - RNA, 13 nt, Homo sapiens
ggaacauacuguu

SEQ ID NO: 961600 - RNA, 16 nt, Homo sapiens
ggaacaucacauuccu

SEQ ID NO: 961601 - RNA, 23 nt, Homo sapiens
ggaacucugcuugauuuuugccu

SEQ ID NO: 961602 - RNA, 20 nt, Homo sapiens
ggaacugaauuguguuuuca

SEQ ID NO: 961603 - RNA, 18 nt, Homo sapiens
ggaagaaugaacacuccc

SEQ ID NO: 961604 - RNA, 20 nt, Homo sapiens
ggaaguuuagcucugagaac

SEQ ID NO: 961605 - RNA, 16 nt, Homo sapiens
ggaauacagucauucc

SEQ ID NO: 961606 - RNA, 17 nt, Homo sapiens
ggaauacagucauucca

SEQ ID NO: 961607 - RNA, 18 nt, Homo sapiens
ggaauauaucaguaccuc

SEQ ID NO: 961608 - RNA, 23 nt, Homo sapiens
ggaaugaguugaggccacugugu

SEQ ID NO: 961609 - RNA, 16 nt, Homo sapiens
ggaauuccagugccag

SEQ ID NO: 961610 - RNA, 22 nt, Homo sapiens
ggaauuccagugccaggccagu

SEQ ID NO: 961611 - RNA, 19 nt, Homo sapiens
ggacaaagaaauuccccaa

SEQ ID NO: 961612 - RNA, 14 nt, Homo sapiens
ggacaagacacuga

SEQ ID NO: 961613 - RNA, 20 nt, Homo sapiens
ggacaagugcuguugggaua

SEQ ID NO: 961614 - RNA, 13 nt, Homo sapiens
ggacacagaccca

SEQ ID NO: 961615 - RNA, 16 nt, Homo sapiens
ggacaguaucccacau

SEQ ID NO: 961616 - RNA, 18 nt, Homo sapiens
ggacccagggaacagcca

SEQ ID NO: 961617 - RNA, 22 nt, Homo sapiens
ggaccccugaaacuggaccugc

SEQ ID NO: 961618 - RNA, 16 nt, Homo sapiens
ggaccugagaccugaa

SEQ ID NO: 961619 - RNA, 14 nt, Homo sapiens
ggaccugcugugug

SEQ ID NO: 961620 - RNA, 15 nt, Homo sapiens
ggacggcaggcucac

SEQ ID NO: 961621 - RNA, 15 nt, Homo sapiens
ggacuguaagggauu

SEQ ID NO: 961622 - RNA, 13 nt, Homo sapiens
ggacugugccuga

SEQ ID NO: 961623 - RNA, 18 nt, Homo sapiens
ggagaacaugcuggugaa

SEQ ID NO: 961624 - RNA, 17 nt, Homo sapiens
ggagaagcaugaaaaag

SEQ ID NO: 961625 - RNA, 17 nt, Homo sapiens
ggagacaaaucucagaa

SEQ ID NO: 961626 - RNA, 18 nt, Homo sapiens
ggagcucaucugcaaaag

SEQ ID NO: 961627 - RNA, 19 nt, Homo sapiens
ggagcuucuuguuuccuug

SEQ ID NO: 961628 - RNA, 15 nt, Homo sapiens
ggaggcccugcacug

SEQ ID NO: 961629 - RNA, 13 nt, Homo sapiens
ggaguagugucac

SEQ ID NO: 961630 - RNA, 18 nt, Homo sapiens
ggaguguaaaauguauau

SEQ ID NO: 961631 - RNA, 13 nt, Homo sapiens
ggaguguacuggc

SEQ ID NO: 961632 - RNA, 19 nt, Homo sapiens
ggauaaaucauaaagucag

SEQ ID NO: 961633 - RNA, 16 nt, Homo sapiens
ggauccagagagcagc

SEQ ID NO: 961634 - RNA, 15 nt, Homo sapiens
ggauccugggucaaa

SEQ ID NO: 961635 - RNA, 15 nt, Homo sapiens
ggaugcgcagugccu

SEQ ID NO: 961636 - RNA, 14 nt, Homo sapiens
ggauggcaccucag

SEQ ID NO: 961637 - RNA, 19 nt, Homo sapiens
gccaaucccgccaugcuca

SEQ ID NO: 961638 - RNA, 23 nt, Homo sapiens
gccaauuuccucuccacugcugg

SEQ ID NO: 961639 - RNA, 15 nt, Homo sapiens
gccaauuucucucag

SEQ ID NO: 961640 - RNA, 21 nt, Homo sapiens
gccaauuucucucagauuucc

SEQ ID NO: 961641 - RNA, 23 nt, Homo sapiens
gccacacccaggggaaggcccug

SEQ ID NO: 961642 - RNA, 22 nt, Homo sapiens
gccaccuggcucucaccucuag

SEQ ID NO: 961643 - RNA, 19 nt, Homo sapiens
gccacuccccuccacucuc

SEQ ID NO: 961644 - RNA, 21 nt, Homo sapiens
gccacugggccugucacugau

SEQ ID NO: 961645 - RNA, 23 nt, Homo sapiens
gccagaccagcaggcuggccuau

SEQ ID NO: 961646 - RNA, 21 nt, Homo sapiens
gccagaggaauccuggcagcc

SEQ ID NO: 961647 - RNA, 14 nt, Homo sapiens
gccagcucauucuc

SEQ ID NO: 961648 - RNA, 22 nt, Homo sapiens
gccagcuuacuagcacuuugag

SEQ ID NO: 961649 - RNA, 15 nt, Homo sapiens
gccagcuuauaguca

SEQ ID NO: 961650 - RNA, 21 nt, Homo sapiens
gccagcuuggggccaccaaag

SEQ ID NO: 961651 - RNA, 14 nt, Homo sapiens
gccaggaagccaga

SEQ ID NO: 961652 - RNA, 20 nt, Homo sapiens
gccaggaccacagagcuccu

SEQ ID NO: 961653 - RNA, 18 nt, Homo sapiens
gccaggcaugguggcuca

SEQ ID NO: 961654 - RNA, 17 nt, Homo sapiens
gccaggcuguaagcauu

SEQ ID NO: 961655 - RNA, 17 nt, Homo sapiens
gccaggggcugguggga

SEQ ID NO: 961656 - RNA, 15 nt, Homo sapiens
gccaguccugcuacc

SEQ ID NO: 961657 - RNA, 21 nt, Homo sapiens
gccauaaacgguuccugguga

SEQ ID NO: 961658 - RNA, 17 nt, Homo sapiens
gccaucaccgcugggug

SEQ ID NO: 961659 - RNA, 19 nt, Homo sapiens
gccauccagaugugugcaa

SEQ ID NO: 961660 - RNA, 21 nt, Homo sapiens
gccaucuaaaguaaaaaggga

SEQ ID NO: 961661 - RNA, 16 nt, Homo sapiens
gccaucucuuccucau

SEQ ID NO: 961662 - RNA, 14 nt, Homo sapiens
gccaugauguauau

SEQ ID NO: 961663 - RNA, 15 nt, Homo sapiens
gccaugauguauauc

SEQ ID NO: 961664 - RNA, 22 nt, Homo sapiens
gccaugauguauauccauauaa

SEQ ID NO: 961665 - RNA, 20 nt, Homo sapiens
gccaugcucaggagccacca

SEQ ID NO: 961666 - RNA, 22 nt, Homo sapiens
gccauuccaagucaacacucuu

SEQ ID NO: 961667 - RNA, 22 nt, Homo sapiens
gccauuuuuugucugugauaac

SEQ ID NO: 961668 - RNA, 20 nt, Homo sapiens
gcccaagugaggagugccag

SEQ ID NO: 961669 - RNA, 13 nt, Homo sapiens
gcccacauacugu

SEQ ID NO: 961670 - RNA, 17 nt, Homo sapiens
gcccaccgaggugcuau

SEQ ID NO: 961671 - RNA, 19 nt, Homo sapiens
gcccagaccacugucucca

SEQ ID NO: 961672 - RNA, 15 nt, Homo sapiens
gcccagacccagugg

SEQ ID NO: 961673 - RNA, 23 nt, Homo sapiens
gcccagagugagcuuuagcucuc

SEQ ID NO: 961674 - RNA, 17 nt, Homo sapiens
gcccagcccauggagau

SEQ ID NO: 961675 - RNA, 15 nt, Homo sapiens
gcccagggcaucuug

SEQ ID NO: 961676 - RNA, 19 nt, Homo sapiens
gcccagugcauaugcaaug

SEQ ID NO: 961677 - RNA, 12 nt, Homo sapiens
gccccacuuuga

SEQ ID NO: 961678 - RNA, 17 nt, Homo sapiens
gcccccacuccagucca

SEQ ID NO: 961679 - RNA, 13 nt, Homo sapiens
gcccccagcagag

SEQ ID NO: 961680 - RNA, 21 nt, Homo sapiens
gccccccccuugaaucugcag

SEQ ID NO: 961681 - RNA, 17 nt, Homo sapiens
gccccgcgaccaugugg

SEQ ID NO: 961682 - RNA, 16 nt, Homo sapiens
gccccuacccuggacu

SEQ ID NO: 961683 - RNA, 19 nt, Homo sapiens
gccccugcgggcuguggug

SEQ ID NO: 961684 - RNA, 15 nt, Homo sapiens
gcccgcuagcauuag

SEQ ID NO: 961685 - RNA, 17 nt, Homo sapiens
gcccuaaccccuuccag

SEQ ID NO: 961686 - RNA, 21 nt, Homo sapiens
gcccucaucaucaacgucuca

SEQ ID NO: 961687 - RNA, 21 nt, Homo sapiens
gcccuccccuccggacuggug

SEQ ID NO: 961688 - RNA, 18 nt, Homo sapiens
gcccugcagcccaccaga

SEQ ID NO: 961689 - RNA, 19 nt, Homo sapiens
gcccugcagcccaccagac

SEQ ID NO: 961690 - RNA, 23 nt, Homo sapiens
gcccugggcugggugcugggaag

SEQ ID NO: 961691 - RNA, 19 nt, Homo sapiens
gcccuuggcuucugugaug

SEQ ID NO: 961692 - RNA, 23 nt, Homo sapiens
gccgaauugucuuuggugcuuuu

SEQ ID NO: 961693 - RNA, 19 nt, Homo sapiens
gccgagccugcacuggggc

SEQ ID NO: 961694 - RNA, 22 nt, Homo sapiens
gccgggaaugagcuugugugcc

SEQ ID NO: 961695 - RNA, 17 nt, Homo sapiens
gccgugccugagcugca

SEQ ID NO: 961696 - RNA, 14 nt, Homo sapiens
gccuagcgaucucu

SEQ ID NO: 961697 - RNA, 22 nt, Homo sapiens
gccuagcgaucucuccuggccu

SEQ ID NO: 961698 - RNA, 22 nt, Homo sapiens
gccucagagcagccucauccca

SEQ ID NO: 961699 - RNA, 12 nt, Homo sapiens
gccucaucccag

SEQ ID NO: 961700 - RNA, 21 nt, Homo sapiens
gccuccacagcgagggcagcu

SEQ ID NO: 961701 - RNA, 22 nt, Homo sapiens
gccuccugcccugcuaaagaca

SEQ ID NO: 961702 - RNA, 16 nt, Homo sapiens
gccuccugggggaccu

SEQ ID NO: 961703 - RNA, 19 nt, Homo sapiens
gccucgcauccuaugcuua

SEQ ID NO: 961704 - RNA, 20 nt, Homo sapiens
gccucugcuccccugugaac

SEQ ID NO: 961705 - RNA, 16 nt, Homo sapiens
gccucuggacagccag

SEQ ID NO: 961706 - RNA, 21 nt, Homo sapiens
gccucuggucccagcauccag

SEQ ID NO: 961707 - RNA, 14 nt, Homo sapiens
gccugacauucacu

SEQ ID NO: 961708 - RNA, 15 nt, Homo sapiens
gccugagggcaguac

SEQ ID NO: 961709 - RNA, 13 nt, Homo sapiens
gccugcaaacugg

SEQ ID NO: 961710 - RNA, 11 nt, Homo sapiens
gccugcacugg

SEQ ID NO: 961711 - RNA, 17 nt, Homo sapiens
gccugcaggacuuugcg

SEQ ID NO: 961712 - RNA, 18 nt, Homo sapiens
gccugcuggccgacccac

SEQ ID NO: 961713 - RNA, 22 nt, Homo sapiens
gccuggacacuguaccgacuuu

SEQ ID NO: 961714 - RNA, 14 nt, Homo sapiens
gccuggccaccagc

SEQ ID NO: 961715 - RNA, 16 nt, Homo sapiens
gccuggccaccagcca

SEQ ID NO: 961716 - RNA, 21 nt, Homo sapiens
gccugggaggggcaauccuca

SEQ ID NO: 961717 - RNA, 20 nt, Homo sapiens
gccuggggcagaaagccaca

SEQ ID NO: 961718 - RNA, 21 nt, Homo sapiens
gccuggguugcugcuguccag

SEQ ID NO: 961719 - RNA, 13 nt, Homo sapiens
gccuguaauccca

SEQ ID NO: 961720 - RNA, 19 nt, Homo sapiens
gccuuaaacacacauugca

SEQ ID NO: 961721 - RNA, 14 nt, Homo sapiens
gccuuaagcaaauu

SEQ ID NO: 961722 - RNA, 21 nt, Homo sapiens
gccuuaaguggcagaauauaa

SEQ ID NO: 961723 - RNA, 16 nt, Homo sapiens
gccuuacgauggcaau

SEQ ID NO: 961724 - RNA, 19 nt, Homo sapiens
gccuucuagcacacuuuuu

SEQ ID NO: 961725 - RNA, 20 nt, Homo sapiens
gccuucuccaucaugcccag

SEQ ID NO: 961726 - RNA, 18 nt, Homo sapiens
gccuugggcuccugauga

SEQ ID NO: 961727 - RNA, 22 nt, Homo sapiens
gccuuguuugaguuuuuccucc

SEQ ID NO: 961728 - RNA, 14 nt, Homo sapiens
gcgaccauguggcc

SEQ ID NO: 961729 - RNA, 20 nt, Homo sapiens
gcgcaguguuuugcaagugc

SEQ ID NO: 961730 - RNA, 19 nt, Homo sapiens
gcgcccagccuacauucac

SEQ ID NO: 961731 - RNA, 21 nt, Homo sapiens
gcgcccuuggcuucugugaug

SEQ ID NO: 961732 - RNA, 15 nt, Homo sapiens
gcgcggccacagggg

SEQ ID NO: 961733 - RNA, 18 nt, Homo sapiens
gcggccauaagaggugau

SEQ ID NO: 961734 - RNA, 15 nt, Homo sapiens
gcggcgucccuucca

SEQ ID NO: 961735 - RNA, 22 nt, Homo sapiens
gcgguggcucacgccuguaauc

SEQ ID NO: 961736 - RNA, 14 nt, Homo sapiens
gcguagacaggugu

SEQ ID NO: 961737 - RNA, 13 nt, Homo sapiens
gcguauauacuua

SEQ ID NO: 961738 - RNA, 21 nt, Homo sapiens
gcgucagaccaguacugggaa

SEQ ID NO: 961739 - RNA, 14 nt, Homo sapiens
gcguggcacucgcu

SEQ ID NO: 961740 - RNA, 24 nt, Homo sapiens
gcguucugcaagcaucaguucuac

SEQ ID NO: 961741 - RNA, 14 nt, Homo sapiens
gcguuuucauuugu

SEQ ID NO: 961742 - RNA, 23 nt, Homo sapiens
gcuaaggaugguuuuaucuuccc

SEQ ID NO: 961743 - RNA, 15 nt, Homo sapiens
gcuaaguguggagcu

SEQ ID NO: 961744 - RNA, 20 nt, Homo sapiens
gcuaauuguacuaaucugag

SEQ ID NO: 961745 - RNA, 20 nt, Homo sapiens
gcuacagaugguagaacuaa

SEQ ID NO: 961746 - RNA, 19 nt, Homo sapiens
gcuaccuacaugcugaaaa

SEQ ID NO: 961747 - RNA, 17 nt, Homo sapiens
gcuacuggggaaacugg

SEQ ID NO: 961748 - RNA, 20 nt, Homo sapiens
gcuagggagacgccauguga

SEQ ID NO: 961749 - RNA, 16 nt, Homo sapiens
gcuaucuguagaauua

SEQ ID NO: 961750 - RNA, 13 nt, Homo sapiens
gaccacugucucc

SEQ ID NO: 961751 - RNA, 15 nt, Homo sapiens
gaccagaagccuugg

SEQ ID NO: 961752 - RNA, 20 nt, Homo sapiens
gacccaguggacucuuccac

SEQ ID NO: 961753 - RNA, 17 nt, Homo sapiens
gaccccagcauucucag

SEQ ID NO: 961754 - RNA, 16 nt, Homo sapiens
gacccccccccaacuc

SEQ ID NO: 961755 - RNA, 16 nt, Homo sapiens
gacccuccccuaguca

SEQ ID NO: 961756 - RNA, 21 nt, Homo sapiens
gacccuccuccacuccaccuc

SEQ ID NO: 961757 - RNA, 17 nt, Homo sapiens
gacccugccacagccag

SEQ ID NO: 961758 - RNA, 12 nt, Homo sapiens
gacccuggucuc

SEQ ID NO: 961759 - RNA, 20 nt, Homo sapiens
gacccuuuggggguugaaua

SEQ ID NO: 961760 - RNA, 18 nt, Homo sapiens
gaccuaaagcaagccuga

SEQ ID NO: 961761 - RNA, 21 nt, Homo sapiens
gaccuaucccaaauguggaau

SEQ ID NO: 961762 - RNA, 14 nt, Homo sapiens
gaccucaagugucc

SEQ ID NO: 961763 - RNA, 17 nt, Homo sapiens
gaccuugugaucugccc

SEQ ID NO: 961764 - RNA, 15 nt, Homo sapiens
gacgcuugugacagu

SEQ ID NO: 961765 - RNA, 15 nt, Homo sapiens
gacuaagcauugagc

SEQ ID NO: 961766 - RNA, 20 nt, Homo sapiens
gacuacauuugugaacaaaa

SEQ ID NO: 961767 - RNA, 13 nt, Homo sapiens
gacuccaucucaa

SEQ ID NO: 961768 - RNA, 16 nt, Homo sapiens
gacucuccagccaccc

SEQ ID NO: 961769 - RNA, 10 nt, Homo sapiens
gacucugcac

SEQ ID NO: 961770 - RNA, 16 nt, Homo sapiens
gacucugcacaugucu

SEQ ID NO: 961771 - RNA, 18 nt, Homo sapiens
gacucugcacaugucuug

SEQ ID NO: 961772 - RNA, 17 nt, Homo sapiens
gacucuuccugcaaagg

SEQ ID NO: 961773 - RNA, 16 nt, Homo sapiens
gacugcucauacccag

SEQ ID NO: 961774 - RNA, 17 nt, Homo sapiens
gacugugcaauacuuag

SEQ ID NO: 961775 - RNA, 16 nt, Homo sapiens
gacuguugccacuuaa

SEQ ID NO: 961776 - RNA, 14 nt, Homo sapiens
gacuuccacuuugu

SEQ ID NO: 961777 - RNA, 19 nt, Homo sapiens
gacuuccgagcuaugucag

SEQ ID NO: 961778 - RNA, 18 nt, Homo sapiens
gacuugaaugcacuuuug

SEQ ID NO: 961779 - RNA, 12 nt, Homo sapiens
gacuugaucacu

SEQ ID NO: 961780 - RNA, 19 nt, Homo sapiens
gacuuuacgcccaucucag

SEQ ID NO: 961781 - RNA, 22 nt, Homo sapiens
gacuuugagcugagugcugaaa

SEQ ID NO: 961782 - RNA, 17 nt, Homo sapiens
gacuuugauagauuucu

SEQ ID NO: 961783 - RNA, 23 nt, Homo sapiens
gagaaaaaacauugcccagggau

SEQ ID NO: 961784 - RNA, 17 nt, Homo sapiens
gagaaaagccucuccag

SEQ ID NO: 961785 - RNA, 14 nt, Homo sapiens
gagaacucuuucau

SEQ ID NO: 961786 - RNA, 22 nt, Homo sapiens
gagaagcaccagcaauucucuu

SEQ ID NO: 961787 - RNA, 22 nt, Homo sapiens
gagaagccuucagcuccaggga

SEQ ID NO: 961788 - RNA, 20 nt, Homo sapiens
gagaagcucugaagaacucu

SEQ ID NO: 961789 - RNA, 22 nt, Homo sapiens
gagaaugaucaaggaucuggac

SEQ ID NO: 961790 - RNA, 16 nt, Homo sapiens
gagaauguuguauuca

SEQ ID NO: 961791 - RNA, 14 nt, Homo sapiens
gagacaacagguaa

SEQ ID NO: 961792 - RNA, 14 nt, Homo sapiens
gagacaguugcccg

SEQ ID NO: 961793 - RNA, 13 nt, Homo sapiens
gagacccugccac

SEQ ID NO: 961794 - RNA, 20 nt, Homo sapiens
gagaccguccuggagcugga

SEQ ID NO: 961795 - RNA, 14 nt, Homo sapiens
gagacgccauguga

SEQ ID NO: 961796 - RNA, 14 nt, Homo sapiens
gagacuccgucuca

SEQ ID NO: 961797 - RNA, 16 nt, Homo sapiens
gagacuguuugaaugu

SEQ ID NO: 961798 - RNA, 20 nt, Homo sapiens
gagagcaaauaaagaccuga

SEQ ID NO: 961799 - RNA, 20 nt, Homo sapiens
gagagcagcuggcucuccac

SEQ ID NO: 961800 - RNA, 14 nt, Homo sapiens
gagagcccagucuc

SEQ ID NO: 961801 - RNA, 16 nt, Homo sapiens
gagaggcaggcauaga

SEQ ID NO: 961802 - RNA, 16 nt, Homo sapiens
gagauaagucuuucau

SEQ ID NO: 961803 - RNA, 15 nt, Homo sapiens
gagauaauuguuuca

SEQ ID NO: 961804 - RNA, 23 nt, Homo sapiens
gagauauguugaauuaacauaau

SEQ ID NO: 961805 - RNA, 20 nt, Homo sapiens
gagaucacuacucagugcau

SEQ ID NO: 961806 - RNA, 13 nt, Homo sapiens
gagaugaauugca

SEQ ID NO: 961807 - RNA, 17 nt, Homo sapiens
gagaugggauggcaaau

SEQ ID NO: 961808 - RNA, 19 nt, Homo sapiens
gagauggucacaugaccca

SEQ ID NO: 961809 - RNA, 13 nt, Homo sapiens
gagcaagacucca

SEQ ID NO: 961810 - RNA, 15 nt, Homo sapiens
gagcaagacugucuc

SEQ ID NO: 961811 - RNA, 16 nt, Homo sapiens
gagcaagacugucuca

SEQ ID NO: 961812 - RNA, 14 nt, Homo sapiens
gagcagccaggugg

SEQ ID NO: 961813 - RNA, 22 nt, Homo sapiens
gagcagccucaucccaggcagu

SEQ ID NO: 961814 - RNA, 18 nt, Homo sapiens
gagcagcucuucagcaca

SEQ ID NO: 961815 - RNA, 15 nt, Homo sapiens
gagccaccgugccug

SEQ ID NO: 961816 - RNA, 21 nt, Homo sapiens
gagccagcuuggggccaccaa

SEQ ID NO: 961817 - RNA, 12 nt, Homo sapiens
gagccaugucau

SEQ ID NO: 961818 - RNA, 24 nt, Homo sapiens
gagcccagggcaucuugcuggcua

SEQ ID NO: 961819 - RNA, 20 nt, Homo sapiens
gagcccgcagggccaugcag

SEQ ID NO: 961820 - RNA, 13 nt, Homo sapiens
gagcugagugcug

SEQ ID NO: 961821 - RNA, 22 nt, Homo sapiens
gagcuggggguccacacaucuc

SEQ ID NO: 961822 - RNA, 14 nt, Homo sapiens
gagcuuagauuucc

SEQ ID NO: 961823 - RNA, 19 nt, Homo sapiens
cugcacaugucuuguacau

SEQ ID NO: 961824 - RNA, 17 nt, Homo sapiens
cugcacuaaaacccauc

SEQ ID NO: 961825 - RNA, 15 nt, Homo sapiens
cugcacuggggccac

SEQ ID NO: 961826 - RNA, 18 nt, Homo sapiens
cugcagaccucaagccau

SEQ ID NO: 961827 - RNA, 16 nt, Homo sapiens
cugcagagauuucuca

SEQ ID NO: 961828 - RNA, 21 nt, Homo sapiens
cugcagaugccacccuagcca

SEQ ID NO: 961829 - RNA, 20 nt, Homo sapiens
cugcagcccaccagacguca

SEQ ID NO: 961830 - RNA, 15 nt, Homo sapiens
cugcaggauggacug

SEQ ID NO: 961831 - RNA, 17 nt, Homo sapiens
cugcaggcuuugccauu

SEQ ID NO: 961832 - RNA, 14 nt, Homo sapiens
cugcaguccuacuc

SEQ ID NO: 961833 - RNA, 11 nt, Homo sapiens
cugccaagagu

SEQ ID NO: 961834 - RNA, 17 nt, Homo sapiens
cugccacucugccccuu

SEQ ID NO: 961835 - RNA, 13 nt, Homo sapiens
cugccagcaucug

SEQ ID NO: 961836 - RNA, 17 nt, Homo sapiens
cugccaucaccgcuggg

SEQ ID NO: 961837 - RNA, 17 nt, Homo sapiens
cugccaucuagccagcc

SEQ ID NO: 961838 - RNA, 17 nt, Homo sapiens
cugccaugacagaggcu

SEQ ID NO: 961839 - RNA, 21 nt, Homo sapiens
cugccauuacagagguauuaa

SEQ ID NO: 961840 - RNA, 21 nt, Homo sapiens
cugccauuuuuugucugugau

SEQ ID NO: 961841 - RNA, 15 nt, Homo sapiens
cugccccagauuuac

SEQ ID NO: 961842 - RNA, 15 nt, Homo sapiens
cugccgucugugcuu

SEQ ID NO: 961843 - RNA, 16 nt, Homo sapiens
cugccugggguggaca

SEQ ID NO: 961844 - RNA, 14 nt, Homo sapiens
cugccugugcauga

SEQ ID NO: 961845 - RNA, 22 nt, Homo sapiens
cugccugugcaugaccugauca

SEQ ID NO: 961846 - RNA, 14 nt, Homo sapiens
cugccuucucagga

SEQ ID NO: 961847 - RNA, 21 nt, Homo sapiens
cugccuuuguugaggugcaag

SEQ ID NO: 961848 - RNA, 13 nt, Homo sapiens
cugcgaccuugca

SEQ ID NO: 961849 - RNA, 16 nt, Homo sapiens
cugcgggccagggucc

SEQ ID NO: 961850 - RNA, 17 nt, Homo sapiens
cugcuaaagacagugcg

SEQ ID NO: 961851 - RNA, 22 nt, Homo sapiens
cugcuauaugccuuaagccaau

SEQ ID NO: 961852 - RNA, 18 nt, Homo sapiens
cugcucaggguucaucug

SEQ ID NO: 961853 - RNA, 20 nt, Homo sapiens
cugcucaggguucaucugaa

SEQ ID NO: 961854 - RNA, 13 nt, Homo sapiens
cugcucugagcca

SEQ ID NO: 961855 - RNA, 12 nt, Homo sapiens
cugcucugcuau

SEQ ID NO: 961856 - RNA, 18 nt, Homo sapiens
cugcugaacacagugucu

SEQ ID NO: 961857 - RNA, 20 nt, Homo sapiens
cugcugggcucugccuuaaa

SEQ ID NO: 961858 - RNA, 22 nt, Homo sapiens
cugcugggggcagcaguaccau

SEQ ID NO: 961859 - RNA, 23 nt, Homo sapiens
cugcugggggcagcaguaccauc

SEQ ID NO: 961860 - RNA, 13 nt, Homo sapiens
cugcuucauggga

SEQ ID NO: 961861 - RNA, 20 nt, Homo sapiens
cugcuucaugggaaaacaga

SEQ ID NO: 961862 - RNA, 15 nt, Homo sapiens
cugcuucugcacuuc

SEQ ID NO: 961863 - RNA, 16 nt, Homo sapiens
cugcuucugcacuuca

SEQ ID NO: 961864 - RNA, 22 nt, Homo sapiens
cugcuugauuuuaauacauuga

SEQ ID NO: 961865 - RNA, 15 nt, Homo sapiens
cugcuuugugagcca

SEQ ID NO: 961866 - RNA, 21 nt, Homo sapiens
cuggaauuguggcuauccuga

SEQ ID NO: 961867 - RNA, 22 nt, Homo sapiens
cuggacggcaggcucacugcca

SEQ ID NO: 961868 - RNA, 16 nt, Homo sapiens
cuggagaaauggcauc

SEQ ID NO: 961869 - RNA, 20 nt, Homo sapiens
cuggagaccguccuggagcu

SEQ ID NO: 961870 - RNA, 13 nt, Homo sapiens
cuggagagcucac

SEQ ID NO: 961871 - RNA, 14 nt, Homo sapiens
cuggaugucuccau

SEQ ID NO: 961872 - RNA, 15 nt, Homo sapiens
cuggcaugacacucu

SEQ ID NO: 961873 - RNA, 16 nt, Homo sapiens
cuggcaugacacucua

SEQ ID NO: 961874 - RNA, 12 nt, Homo sapiens
cuggccaugaau

SEQ ID NO: 961875 - RNA, 20 nt, Homo sapiens
cuggccccacaagccaggac

SEQ ID NO: 961876 - RNA, 18 nt, Homo sapiens
cuggccuauguggucuaa

SEQ ID NO: 961877 - RNA, 16 nt, Homo sapiens
cuggcgacugccccug

SEQ ID NO: 961878 - RNA, 17 nt, Homo sapiens
cuggcgccccuuccuag

SEQ ID NO: 961879 - RNA, 17 nt, Homo sapiens
cuggcuuugcucuauua

SEQ ID NO: 961880 - RNA, 16 nt, Homo sapiens
cugggagcagcucugu

SEQ ID NO: 961881 - RNA, 22 nt, Homo sapiens
cugggagcagcucugugacucc

SEQ ID NO: 961882 - RNA, 22 nt, Homo sapiens
cugggauuucucccucucagug

SEQ ID NO: 961883 - RNA, 17 nt, Homo sapiens
cugggcacgcacugggu

SEQ ID NO: 961884 - RNA, 23 nt, Homo sapiens
cugggcccaguaccuagcuggcu

SEQ ID NO: 961885 - RNA, 14 nt, Homo sapiens
cugggccgggaccc

SEQ ID NO: 961886 - RNA, 16 nt, Homo sapiens
cugggcggcugugcuu

SEQ ID NO: 961887 - RNA, 17 nt, Homo sapiens
cugggcugccaccagcc

SEQ ID NO: 961888 - RNA, 19 nt, Homo sapiens
cuggggcagaaagccacaa

SEQ ID NO: 961889 - RNA, 16 nt, Homo sapiens
cuggggcauccugugc

SEQ ID NO: 961890 - RNA, 20 nt, Homo sapiens
cuggggugcugagugagcug

SEQ ID NO: 961891 - RNA, 22 nt, Homo sapiens
cuggguuccuccucuccuacuc

SEQ ID NO: 961892 - RNA, 16 nt, Homo sapiens
cugguccugaucccag

SEQ ID NO: 961893 - RNA, 21 nt, Homo sapiens
cuggugaccacccaccaccug

SEQ ID NO: 961894 - RNA, 12 nt, Homo sapiens
cuggugacuccu

SEQ ID NO: 961895 - RNA, 18 nt, Homo sapiens
cuggugagguugaggaau

SEQ ID NO: 961896 - RNA, 13 nt, Homo sapiens
cuggugggacagu

SEQ ID NO: 961897 - RNA, 21 nt, Homo sapiens
cuggugugcagggugaagcag

SEQ ID NO: 961898 - RNA, 18 nt, Homo sapiens
cugguguuuuaugggcca

SEQ ID NO: 961899 - RNA, 14 nt, Homo sapiens
cugguucuugcaaa

SEQ ID NO: 961900 - RNA, 19 nt, Homo sapiens
cuguaacucagacauucca

SEQ ID NO: 961901 - RNA, 21 nt, Homo sapiens
cuguaaucccagcacuuuggg

SEQ ID NO: 961902 - RNA, 15 nt, Homo sapiens
guuugacauuugucu

SEQ ID NO: 961903 - RNA, 17 nt, Homo sapiens
guuuggaaaaguggcgu

SEQ ID NO: 961904 - RNA, 22 nt, Homo sapiens
guuuguggggcacagaugccug

SEQ ID NO: 961905 - RNA, 22 nt, Homo sapiens
guuuguuggaaaguaacuguga

SEQ ID NO: 961906 - RNA, 14 nt, Homo sapiens
guuuuaaaguucau

SEQ ID NO: 961907 - RNA, 13 nt, Homo sapiens
guuuuaacugaau

SEQ ID NO: 961908 - RNA, 19 nt, Homo sapiens
guuuugaaaaaauuacuca

SEQ ID NO: 961909 - RNA, 19 nt, Homo sapiens
guuuuggggacucauuuca

SEQ ID NO: 961910 - RNA, 16 nt, Homo sapiens
uaaaaaacuucaugua

SEQ ID NO: 961911 - RNA, 15 nt, Homo sapiens
uaaaaaaucaugcca

SEQ ID NO: 961912 - RNA, 19 nt, Homo sapiens
uaaaaaaugucucauguca

SEQ ID NO: 961913 - RNA, 22 nt, Homo sapiens
uaaaaacuuccuucaaucuuca

SEQ ID NO: 961914 - RNA, 19 nt, Homo sapiens
uaaaaaucauugauuguca

SEQ ID NO: 961915 - RNA, 20 nt, Homo sapiens
uaaaaaucuagcacacucuu

SEQ ID NO: 961916 - RNA, 19 nt, Homo sapiens
uaaaaauguuacgugaaga

SEQ ID NO: 961917 - RNA, 18 nt, Homo sapiens
uaaaaauucaaccacaga

SEQ ID NO: 961918 - RNA, 16 nt, Homo sapiens
uaaaacagaaucuucu

SEQ ID NO: 961919 - RNA, 23 nt, Homo sapiens
uaaaacauuagucaguugcucau

SEQ ID NO: 961920 - RNA, 20 nt, Homo sapiens
uaaaacauugaauuguagua

SEQ ID NO: 961921 - RNA, 13 nt, Homo sapiens
uaaaaccaaagag

SEQ ID NO: 961922 - RNA, 17 nt, Homo sapiens
uaaaacggugcugugag

SEQ ID NO: 961923 - RNA, 14 nt, Homo sapiens
uaaaagacagcuag

SEQ ID NO: 961924 - RNA, 15 nt, Homo sapiens
uaaaagaucuugaau

SEQ ID NO: 961925 - RNA, 17 nt, Homo sapiens
uaaaagaucuugaauag

SEQ ID NO: 961926 - RNA, 24 nt, Homo sapiens
uaaaagguauacuuuaguagacau

SEQ ID NO: 961927 - RNA, 19 nt, Homo sapiens
uaaaaguaaauucauguaa

SEQ ID NO: 961928 - RNA, 14 nt, Homo sapiens
uaaaauaaaugaaa

SEQ ID NO: 961929 - RNA, 15 nt, Homo sapiens
uaaaauaguaugaaa

SEQ ID NO: 961930 - RNA, 12 nt, Homo sapiens
uaaaaugauaaa

SEQ ID NO: 961931 - RNA, 19 nt, Homo sapiens
uaaaaugccccacauuuua

SEQ ID NO: 961932 - RNA, 11 nt, Homo sapiens
uaaaauggagg

SEQ ID NO: 961933 - RNA, 18 nt, Homo sapiens
uaaacaagggucaauuca

SEQ ID NO: 961934 - RNA, 15 nt, Homo sapiens
uaaagaaaggaacua

SEQ ID NO: 961935 - RNA, 22 nt, Homo sapiens
uaaagaaccaucagcaucaccc

SEQ ID NO: 961936 - RNA, 18 nt, Homo sapiens
uaaagacuuguauagcau

SEQ ID NO: 961937 - RNA, 16 nt, Homo sapiens
uaaagcuacuguagaa

SEQ ID NO: 961938 - RNA, 21 nt, Homo sapiens
uaaaggacaggccacaccaca

SEQ ID NO: 961939 - RNA, 17 nt, Homo sapiens
uaaaggagguagcuguc

SEQ ID NO: 961940 - RNA, 16 nt, Homo sapiens
uaaaguaaaaagggaa

SEQ ID NO: 961941 - RNA, 17 nt, Homo sapiens
uaaaguaaauacaugca

SEQ ID NO: 961942 - RNA, 21 nt, Homo sapiens
uaaaguauauuuaacucauaa

SEQ ID NO: 961943 - RNA, 17 nt, Homo sapiens
uaaaguggaaguaugua

SEQ ID NO: 961944 - RNA, 18 nt, Homo sapiens
uaaauaaaccacugugcg

SEQ ID NO: 961945 - RNA, 18 nt, Homo sapiens
uaaauacccaucuucauu

SEQ ID NO: 961946 - RNA, 19 nt, Homo sapiens
uaaauacuauuauuugcua

SEQ ID NO: 961947 - RNA, 12 nt, Homo sapiens
uaaauagcuaag

SEQ ID NO: 961948 - RNA, 23 nt, Homo sapiens
uaaauagugucauauaaacucau

SEQ ID NO: 961949 - RNA, 18 nt, Homo sapiens
uaaauauuuauguagaug

SEQ ID NO: 961950 - RNA, 13 nt, Homo sapiens
uaaaugacuugga

SEQ ID NO: 961951 - RNA, 15 nt, Homo sapiens
uaaauguuaccucua

SEQ ID NO: 961952 - RNA, 15 nt, Homo sapiens
uaaauuauaguguag

SEQ ID NO: 961953 - RNA, 14 nt, Homo sapiens
uaaauuuguguucu

SEQ ID NO: 961954 - RNA, 19 nt, Homo sapiens
uaacaaacaagagaagcuu

SEQ ID NO: 961955 - RNA, 16 nt, Homo sapiens
uaacagaaaaaugaaa

SEQ ID NO: 961956 - RNA, 21 nt, Homo sapiens
uaacagauggaaaaacugagg

SEQ ID NO: 961957 - RNA, 21 nt, Homo sapiens
uaacauagauuuaagugaaua

SEQ ID NO: 961958 - RNA, 14 nt, Homo sapiens
uaacaucugaccug

SEQ ID NO: 961959 - RNA, 23 nt, Homo sapiens
uaacauggugaaaccccgucucu

SEQ ID NO: 961960 - RNA, 23 nt, Homo sapiens
uaacauuaaugccugcuuuuugg

SEQ ID NO: 961961 - RNA, 17 nt, Homo sapiens
uaaccauucuacugugu

SEQ ID NO: 961962 - RNA, 23 nt, Homo sapiens
uaaccccugcgcucucuuugcaa

SEQ ID NO: 961963 - RNA, 23 nt, Homo sapiens
uaaccccuuccagaucacugcca

SEQ ID NO: 961964 - RNA, 22 nt, Homo sapiens
uaacccuuugugugcucuccau

SEQ ID NO: 961965 - RNA, 21 nt, Homo sapiens
uaacuaccaugucuuaaaauc

SEQ ID NO: 961966 - RNA, 22 nt, Homo sapiens
uaacucaccagccccacugcca

SEQ ID NO: 961967 - RNA, 17 nt, Homo sapiens
uaacucagacauuccaa

SEQ ID NO: 961968 - RNA, 14 nt, Homo sapiens
uaacugcauccagc

SEQ ID NO: 961969 - RNA, 20 nt, Homo sapiens
uaacugggguugagggccaa

SEQ ID NO: 961970 - RNA, 23 nt, Homo sapiens
uaacuguuaaggagcuucaggga

SEQ ID NO: 961971 - RNA, 18 nt, Homo sapiens
uaagaacuuuuucacuuc

SEQ ID NO: 961972 - RNA, 13 nt, Homo sapiens
uaagaauaccaca

SEQ ID NO: 961973 - RNA, 16 nt, Homo sapiens
uaagacccagcauuuu

SEQ ID NO: 961974 - RNA, 15 nt, Homo sapiens
uaagagacacuccaa

SEQ ID NO: 961975 - RNA, 18 nt, Homo sapiens
uaagagcuuaagaaccau

SEQ ID NO: 961976 - RNA, 17 nt, Homo sapiens
uaagaguaaaauuccuc

SEQ ID NO: 961977 - RNA, 17 nt, Homo sapiens
uaagcaaacuuauuugc

SEQ ID NO: 961978 - RNA, 19 nt, Homo sapiens
uaagcaaauugcuuuuuuc

SEQ ID NO: 961979 - RNA, 14 nt, Homo sapiens
uaagcaaauuuugu

SEQ ID NO: 961980 - RNA, 18 nt, Homo sapiens
uaaggacaagacacugag

SEQ ID NO: 961981 - RNA, 22 nt, Homo sapiens
uaaguaaaauccccuucgcuga

SEQ ID NO: 961982 - RNA, 19 nt, Homo sapiens
uaaguccuguauauguaug

SEQ ID NO: 961983 - RNA, 18 nt, Homo sapiens
uauaaauuuuuaccuguu

SEQ ID NO: 961984 - RNA, 14 nt, Homo sapiens
uauaagcaacuuca

SEQ ID NO: 961985 - RNA, 15 nt, Homo sapiens
uauaauguugccagc

SEQ ID NO: 961986 - RNA, 19 nt, Homo sapiens
uauacaaguuguucuagua

SEQ ID NO: 961987 - RNA, 13 nt, Homo sapiens
uauacacauacau

SEQ ID NO: 961988 - RNA, 17 nt, Homo sapiens
uauacaccagcaauuua

SEQ ID NO: 961989 - RNA, 21 nt, Homo sapiens
uauacuuuaguagacauuuau

SEQ ID NO: 961990 - RNA, 17 nt, Homo sapiens
uauagacauucucacau

SEQ ID NO: 961991 - RNA, 15 nt, Homo sapiens
uauagcaucuucuca

SEQ ID NO: 961992 - RNA, 21 nt, Homo sapiens
uauagcaucuucucauuccca

SEQ ID NO: 961993 - RNA, 22 nt, Homo sapiens
uauauaauuuuaugguggaaaa

SEQ ID NO: 961994 - RNA, 19 nt, Homo sapiens
uaucaaaaaguacaauaau

SEQ ID NO: 961995 - RNA, 20 nt, Homo sapiens
uaucaaaaaguacaauaaua

SEQ ID NO: 961996 - RNA, 22 nt, Homo sapiens
uaucaaaauagucuaaggccau

SEQ ID NO: 961997 - RNA, 12 nt, Homo sapiens
uaucaaagucau

SEQ ID NO: 961998 - RNA, 13 nt, Homo sapiens
uaucaagcuuuua

SEQ ID NO: 961999 - RNA, 16 nt, Homo sapiens
uaucacgccuacuuaa

SEQ ID NO: 962000 - RNA, 19 nt, Homo sapiens
uaucaggaaauaucuguga

SEQ ID NO: 962001 - RNA, 20 nt, Homo sapiens
uaucagguguauaaauguac

SEQ ID NO: 962002 - RNA, 16 nt, Homo sapiens
uaucaguaccucucaa

SEQ ID NO: 962003 - RNA, 14 nt, Homo sapiens
uaucauaugaacuu

SEQ ID NO: 962004 - RNA, 15 nt, Homo sapiens
uauccaauugcucuu

SEQ ID NO: 962005 - RNA, 16 nt, Homo sapiens
uauccauugaacuaaa

SEQ ID NO: 962006 - RNA, 22 nt, Homo sapiens
uauccugcgaccuugcaaccuc

SEQ ID NO: 962007 - RNA, 22 nt, Homo sapiens
uauccuggugccccccaccccu

SEQ ID NO: 962008 - RNA, 21 nt, Homo sapiens
uaucgaaauaacaauguuaag

SEQ ID NO: 962009 - RNA, 15 nt, Homo sapiens
uaucuguacagauca

SEQ ID NO: 962010 - RNA, 22 nt, Homo sapiens
uaucuucccuuuauuacaagaa

SEQ ID NO: 962011 - RNA, 19 nt, Homo sapiens
uaugaaagaccuuagacau

SEQ ID NO: 962012 - RNA, 22 nt, Homo sapiens
uaugaaagaccuuagacauaaa

SEQ ID NO: 962013 - RNA, 20 nt, Homo sapiens
uaugaauaaagaaugccauu

SEQ ID NO: 962014 - RNA, 22 nt, Homo sapiens
uaugacuaaagagagaauguag

SEQ ID NO: 962015 - RNA, 16 nt, Homo sapiens
uaugauauauugcugu

SEQ ID NO: 962016 - RNA, 11 nt, Homo sapiens
uaugaugcuaa

SEQ ID NO: 962017 - RNA, 17 nt, Homo sapiens
uaugccaauaaaguuug

SEQ ID NO: 962018 - RNA, 19 nt, Homo sapiens
uaugccucucuacagucuc

SEQ ID NO: 962019 - RNA, 15 nt, Homo sapiens
uaugccuuaagccaa

SEQ ID NO: 962020 - RNA, 15 nt, Homo sapiens
uaugcucauugaacu

SEQ ID NO: 962021 - RNA, 21 nt, Homo sapiens
uaugcugaucuuuuaaaauca

SEQ ID NO: 962022 - RNA, 15 nt, Homo sapiens
uaugcuguugucuua

SEQ ID NO: 962023 - RNA, 19 nt, Homo sapiens
uauggaauuccagugccag

SEQ ID NO: 962024 - RNA, 13 nt, Homo sapiens
uaugggaagccau

SEQ ID NO: 962025 - RNA, 14 nt, Homo sapiens
uaugggaagccaua

SEQ ID NO: 962026 - RNA, 15 nt, Homo sapiens
uaugguugacacuag

SEQ ID NO: 962027 - RNA, 21 nt, Homo sapiens
uauguaaaaccaacaaaaaga

SEQ ID NO: 962028 - RNA, 21 nt, Homo sapiens
uauguaaauagcuaagauaua

SEQ ID NO: 962029 - RNA, 20 nt, Homo sapiens
uaugucuuggacacuguaca

SEQ ID NO: 962030 - RNA, 16 nt, Homo sapiens
uaugugcuauacacac

SEQ ID NO: 962031 - RNA, 21 nt, Homo sapiens
uauuaaaauuuuuugauguca

SEQ ID NO: 962032 - RNA, 13 nt, Homo sapiens
uauuaaacaaagu

SEQ ID NO: 962033 - RNA, 15 nt, Homo sapiens
uauuaaucauacaaa

SEQ ID NO: 962034 - RNA, 14 nt, Homo sapiens
uauuagaaugcaug

SEQ ID NO: 962035 - RNA, 18 nt, Homo sapiens
uauuagguccauucauua

SEQ ID NO: 962036 - RNA, 14 nt, Homo sapiens
uauuccaaaugcca

SEQ ID NO: 962037 - RNA, 13 nt, Homo sapiens
uauucuacuaugc

SEQ ID NO: 962038 - RNA, 15 nt, Homo sapiens
uauucuagccugcau

SEQ ID NO: 962039 - RNA, 14 nt, Homo sapiens
uauugaaauucuau

SEQ ID NO: 962040 - RNA, 13 nt, Homo sapiens
uauugacacugaa

SEQ ID NO: 962041 - RNA, 22 nt, Homo sapiens
uauugugacagagccauggugu

SEQ ID NO: 962042 - RNA, 14 nt, Homo sapiens
uauuguucacuuua

SEQ ID NO: 962043 - RNA, 13 nt, Homo sapiens
uauuuaauuuuga

SEQ ID NO: 962044 - RNA, 22 nt, Homo sapiens
uauuuauguuguugaacuaaua

SEQ ID NO: 962045 - RNA, 17 nt, Homo sapiens
uauuuauucuuuaacug

SEQ ID NO: 962046 - RNA, 19 nt, Homo sapiens
uauuuauugaguaccuacu

SEQ ID NO: 962047 - RNA, 17 nt, Homo sapiens
uauuucaggaaggucuu

SEQ ID NO: 962048 - RNA, 17 nt, Homo sapiens
uauuucauauuaugaaa

SEQ ID NO: 962049 - RNA, 18 nt, Homo sapiens
uauuucauauuaugaaag

SEQ ID NO: 962050 - RNA, 21 nt, Homo sapiens
uauuuccauagcuuuuggcug

SEQ ID NO: 962051 - RNA, 13 nt, Homo sapiens
uauuugcuaugaa

SEQ ID NO: 962052 - RNA, 12 nt, Homo sapiens
uauuuuaaauac

SEQ ID NO: 962053 - RNA, 19 nt, Homo sapiens
uauuuuuauaucaugcaaa

SEQ ID NO: 962054 - RNA, 14 nt, Homo sapiens
ucaaaaagaacaac

SEQ ID NO: 962055 - RNA, 22 nt, Homo sapiens
ucaaaaagaacaacauaucuca

SEQ ID NO: 962056 - RNA, 18 nt, Homo sapiens
ucaaaaagaacuaaauau

SEQ ID NO: 962057 - RNA, 14 nt, Homo sapiens
ucaaaaaguacaau

SEQ ID NO: 962058 - RNA, 19 nt, Homo sapiens
ucaaaaccaaguaucacac

SEQ ID NO: 962059 - RNA, 22 nt, Homo sapiens
ucaaaagguauuauacauguga

SEQ ID NO: 962060 - RNA, 23 nt, Homo sapiens
ucaaaaguugguguugacauaca

SEQ ID NO: 962061 - RNA, 19 nt, Homo sapiens
ucaaaaguuuuuucuaagu

SEQ ID NO: 962062 - RNA, 15 nt, Homo sapiens
ucaaaauaaugaagu

SEQ ID NO: 962063 - RNA, 20 nt, Homo sapiens
ucaaaauggacguacugguu

SEQ ID NO: 962064 - RNA, 18 nt, Homo sapiens
ucaaaggagcuuucucaa

SEQ ID NO: 962065 - RNA, 19 nt, Homo sapiens
uccauuuuuuuucaaacaa

SEQ ID NO: 962066 - RNA, 15 nt, Homo sapiens
ucccaaagcaucccu

SEQ ID NO: 962067 - RNA, 16 nt, Homo sapiens
ucccaaauguggaauu

SEQ ID NO: 962068 - RNA, 16 nt, Homo sapiens
ucccaaccccagugga

SEQ ID NO: 962069 - RNA, 22 nt, Homo sapiens
ucccaaccccaguggauucuca

SEQ ID NO: 962070 - RNA, 17 nt, Homo sapiens
ucccaacucuugcacag

SEQ ID NO: 962071 - RNA, 15 nt, Homo sapiens
ucccacacugugaac

SEQ ID NO: 962072 - RNA, 19 nt, Homo sapiens
ucccacccacaugugacac

SEQ ID NO: 962073 - RNA, 20 nt, Homo sapiens
ucccacccacaugugacaca

SEQ ID NO: 962074 - RNA, 21 nt, Homo sapiens
ucccacccacaugugacacau

SEQ ID NO: 962075 - RNA, 21 nt, Homo sapiens
ucccacgggaaaggagcugcu

SEQ ID NO: 962076 - RNA, 13 nt, Homo sapiens
ucccagccaaguc

SEQ ID NO: 962077 - RNA, 15 nt, Homo sapiens
ucccaguuucucaga

SEQ ID NO: 962078 - RNA, 14 nt, Homo sapiens
ucccauccuugaug

SEQ ID NO: 962079 - RNA, 21 nt, Homo sapiens
ucccauuuuucucuugccauu

SEQ ID NO: 962080 - RNA, 17 nt, Homo sapiens
uccccaaaggcauccau

SEQ ID NO: 962081 - RNA, 17 nt, Homo sapiens
uccccacgaacuggccu

SEQ ID NO: 962082 - RNA, 20 nt, Homo sapiens
uccccacuucucucucccca

SEQ ID NO: 962083 - RNA, 13 nt, Homo sapiens
ucccccagcacuu

SEQ ID NO: 962084 - RNA, 12 nt, Homo sapiens
uccccuguguca

SEQ ID NO: 962085 - RNA, 14 nt, Homo sapiens
ucccgagcuacucu

SEQ ID NO: 962086 - RNA, 19 nt, Homo sapiens
ucccgagcuacucucuugc

SEQ ID NO: 962087 - RNA, 16 nt, Homo sapiens
ucccgguucaccuugc

SEQ ID NO: 962088 - RNA, 18 nt, Homo sapiens
ucccguacaaacuuggac

SEQ ID NO: 962089 - RNA, 20 nt, Homo sapiens
ucccuccauucauccuucca

SEQ ID NO: 962090 - RNA, 21 nt, Homo sapiens
ucccucccaggacucugaccc

SEQ ID NO: 962091 - RNA, 15 nt, Homo sapiens
ucccugcagaccuca

SEQ ID NO: 962092 - RNA, 17 nt, Homo sapiens
ucccugcagaugccacc

SEQ ID NO: 962093 - RNA, 18 nt, Homo sapiens
ucccuggacaggcagccu

SEQ ID NO: 962094 - RNA, 14 nt, Homo sapiens
ucccuggagcugcu

SEQ ID NO: 962095 - RNA, 19 nt, Homo sapiens
ucccuguuaucugcuagau

SEQ ID NO: 962096 - RNA, 22 nt, Homo sapiens
ucccuucgacauugagccuucg

SEQ ID NO: 962097 - RNA, 18 nt, Homo sapiens
ucccuugggcucugauga

SEQ ID NO: 962098 - RNA, 22 nt, Homo sapiens
ucccuuugucugucaaucacag

SEQ ID NO: 962099 - RNA, 17 nt, Homo sapiens
uccggaggcugaggcag

SEQ ID NO: 962100 - RNA, 15 nt, Homo sapiens
uccguagacuguuua

SEQ ID NO: 962101 - RNA, 13 nt, Homo sapiens
uccuaauucaauc

SEQ ID NO: 962102 - RNA, 18 nt, Homo sapiens
uccuacacuauugaccag

SEQ ID NO: 962103 - RNA, 16 nt, Homo sapiens
uccuacucacacuuca

SEQ ID NO: 962104 - RNA, 21 nt, Homo sapiens
uccuacuuagggaagaaaaag

SEQ ID NO: 962105 - RNA, 22 nt, Homo sapiens
uccucaaauuuuuugacuuuuu

SEQ ID NO: 962106 - RNA, 19 nt, Homo sapiens
uccucagguaguacuggga

SEQ ID NO: 962107 - RNA, 20 nt, Homo sapiens
uccucaguaugugggggcuu

SEQ ID NO: 962108 - RNA, 20 nt, Homo sapiens
uccucccuuccuuuucccug

SEQ ID NO: 962109 - RNA, 22 nt, Homo sapiens
uccucucccccuccuccaggga

SEQ ID NO: 962110 - RNA, 19 nt, Homo sapiens
uccucuccuccagcccaga

SEQ ID NO: 962111 - RNA, 21 nt, Homo sapiens
uccucuggcuuucccaggaga

SEQ ID NO: 962112 - RNA, 18 nt, Homo sapiens
uccugaaccgcacagcuc

SEQ ID NO: 962113 - RNA, 22 nt, Homo sapiens
uccugaaggaaaauaaacugac

SEQ ID NO: 962114 - RNA, 13 nt, Homo sapiens
uccugacugaaag

SEQ ID NO: 962115 - RNA, 20 nt, Homo sapiens
uccugacugaaaguaggggg

SEQ ID NO: 962116 - RNA, 15 nt, Homo sapiens
ucuucugagcacaga

SEQ ID NO: 962117 - RNA, 17 nt, Homo sapiens
ucuugaauagacuucca

SEQ ID NO: 962118 - RNA, 21 nt, Homo sapiens
ucuugaucggaaagcucuucc

SEQ ID NO: 962119 - RNA, 17 nt, Homo sapiens
ucuugguaauccccuaa

SEQ ID NO: 962120 - RNA, 21 nt, Homo sapiens
ucuugugguaacuugcugcuu

SEQ ID NO: 962121 - RNA, 19 nt, Homo sapiens
ucuuuaaaaacucacuuac

SEQ ID NO: 962122 - RNA, 12 nt, Homo sapiens
ucuuucacuuca

SEQ ID NO: 962123 - RNA, 15 nt, Homo sapiens
ucuuucauccuugac

SEQ ID NO: 962124 - RNA, 16 nt, Homo sapiens
ucuuuccucuuucugc

SEQ ID NO: 962125 - RNA, 20 nt, Homo sapiens
ucuuuccugaaccaugugga

SEQ ID NO: 962126 - RNA, 18 nt, Homo sapiens
ucuuucugcuuacaaaga

SEQ ID NO: 962127 - RNA, 14 nt, Homo sapiens
ucuuugcauuccag

SEQ ID NO: 962128 - RNA, 15 nt, Homo sapiens
ucuuugcucaacaga

SEQ ID NO: 962129 - RNA, 17 nt, Homo sapiens
ucuuuggaggugcugcu

SEQ ID NO: 962130 - RNA, 21 nt, Homo sapiens
ucuuugugccugaguggccug

SEQ ID NO: 962131 - RNA, 23 nt, Homo sapiens
ucuuuuugguagaugcugggcuc

SEQ ID NO: 962132 - RNA, 12 nt, Homo sapiens
ugaaaaaagcca

SEQ ID NO: 962133 - RNA, 20 nt, Homo sapiens
ugaaaaaucuuaaguaccaa

SEQ ID NO: 962134 - RNA, 17 nt, Homo sapiens
ugaaaagaugguaucau

SEQ ID NO: 962135 - RNA, 19 nt, Homo sapiens
ugaaaauauagacauucuc

SEQ ID NO: 962136 - RNA, 11 nt, Homo sapiens
ugaaacuaaga

SEQ ID NO: 962137 - RNA, 19 nt, Homo sapiens
ugaaacucauagacacuga

SEQ ID NO: 962138 - RNA, 21 nt, Homo sapiens
ugaaacucauagacacugauc

SEQ ID NO: 962139 - RNA, 18 nt, Homo sapiens
ugaaagagucugggaccc

SEQ ID NO: 962140 - RNA, 17 nt, Homo sapiens
ugaaaguauaaugcagu

SEQ ID NO: 962141 - RNA, 19 nt, Homo sapiens
ugaaauugcauacuuugua

SEQ ID NO: 962142 - RNA, 11 nt, Homo sapiens
ugaacacuccc

SEQ ID NO: 962143 - RNA, 12 nt, Homo sapiens
ugaacacucccc

SEQ ID NO: 962144 - RNA, 14 nt, Homo sapiens
ugaaccgcacagcu

SEQ ID NO: 962145 - RNA, 16 nt, Homo sapiens
ugaaccgcacagcuca

SEQ ID NO: 962146 - RNA, 13 nt, Homo sapiens
ugaacuaaugaca

SEQ ID NO: 962147 - RNA, 13 nt, Homo sapiens
ugaacuccugcca

SEQ ID NO: 962148 - RNA, 16 nt, Homo sapiens
ugaacuuuuguacuga

SEQ ID NO: 962149 - RNA, 17 nt, Homo sapiens
ugaagacccuaucuccc

SEQ ID NO: 962150 - RNA, 21 nt, Homo sapiens
ugaagauauucuacuaugcau

SEQ ID NO: 962151 - RNA, 18 nt, Homo sapiens
ugaagaucucacucugcc

SEQ ID NO: 962152 - RNA, 17 nt, Homo sapiens
ugaagcagaaauguacu

SEQ ID NO: 962153 - RNA, 13 nt, Homo sapiens
ugaagccaaagaa

SEQ ID NO: 962154 - RNA, 18 nt, Homo sapiens
ugaagcuaaugucacaau

SEQ ID NO: 962155 - RNA, 14 nt, Homo sapiens
ugaaguacauauua

SEQ ID NO: 962156 - RNA, 14 nt, Homo sapiens
ugaaguuuuacugu

SEQ ID NO: 962157 - RNA, 15 nt, Homo sapiens
ugaauaaauguguug

SEQ ID NO: 962158 - RNA, 18 nt, Homo sapiens
ugaaucaaaucucuucca

SEQ ID NO: 962159 - RNA, 21 nt, Homo sapiens
ugaaucagauguguguucuca

SEQ ID NO: 962160 - RNA, 21 nt, Homo sapiens
ugaaucaugagccugcuggaa

SEQ ID NO: 962161 - RNA, 18 nt, Homo sapiens
ugaauccaaacuaaucca

SEQ ID NO: 962162 - RNA, 18 nt, Homo sapiens
ugaaugaguaaacugaga

SEQ ID NO: 962163 - RNA, 18 nt, Homo sapiens
ugaaugcacuuuugcuca

SEQ ID NO: 962164 - RNA, 14 nt, Homo sapiens
ugaaugguggugga

SEQ ID NO: 962165 - RNA, 20 nt, Homo sapiens
ugaauguuuucaaaaccaag

SEQ ID NO: 962166 - RNA, 15 nt, Homo sapiens
ugaauucauaucgcc

SEQ ID NO: 962167 - RNA, 21 nt, Homo sapiens
ugaauuuaucagcguauuuca

SEQ ID NO: 962168 - RNA, 18 nt, Homo sapiens
ugaauuuggggcuacuua

SEQ ID NO: 962169 - RNA, 16 nt, Homo sapiens
ugacaacuuagcucag

SEQ ID NO: 962170 - RNA, 14 nt, Homo sapiens
ugacaaucaacucu

SEQ ID NO: 962171 - RNA, 23 nt, Homo sapiens
ugacaaucaacucuaauagugcu

SEQ ID NO: 962172 - RNA, 19 nt, Homo sapiens
ugacaauugggagcugcca

SEQ ID NO: 962173 - RNA, 22 nt, Homo sapiens
ugacagagcucuggguugugca

SEQ ID NO: 962174 - RNA, 19 nt, Homo sapiens
ugacagauauuuuaucuau

SEQ ID NO: 962175 - RNA, 15 nt, Homo sapiens
ugacauaauaaagua

SEQ ID NO: 962176 - RNA, 17 nt, Homo sapiens
ugacauucuuagcugua

SEQ ID NO: 962177 - RNA, 19 nt, Homo sapiens
ugacauucuuagcuguaac

SEQ ID NO: 962178 - RNA, 21 nt, Homo sapiens
ugacccaggccuggccaguca

SEQ ID NO: 962179 - RNA, 13 nt, Homo sapiens
ugaccccauuccu

SEQ ID NO: 962180 - RNA, 21 nt, Homo sapiens
ugacccuaugggucuaggaca

SEQ ID NO: 962181 - RNA, 15 nt, Homo sapiens
ugaccuaguuuucca

SEQ ID NO: 962182 - RNA, 12 nt, Homo sapiens
aaaaaaagggag

SEQ ID NO: 962183 - RNA, 11 nt, Homo sapiens
aaaaaauuacu

SEQ ID NO: 962184 - RNA, 12 nt, Homo sapiens
aaaaaccacagc

SEQ ID NO: 962185 - RNA, 12 nt, Homo sapiens
aaaaacucugaa

SEQ ID NO: 962186 - RNA, 15 nt, Homo sapiens
aaaaaggucuuuaaa

SEQ ID NO: 962187 - RNA, 13 nt, Homo sapiens
aaaaagugucuca

SEQ ID NO: 962188 - RNA, 22 nt, Homo sapiens
aaaaauauaaaguacaucucua

SEQ ID NO: 962189 - RNA, 15 nt, Homo sapiens
aaaaauauugcugaa

SEQ ID NO: 962190 - RNA, 13 nt, Homo sapiens
aaaaaucaauaaa

SEQ ID NO: 962191 - RNA, 15 nt, Homo sapiens
aaaaaucuuuaggga

SEQ ID NO: 962192 - RNA, 22 nt, Homo sapiens
aaaaauguuuuuagaacaugua

SEQ ID NO: 962193 - RNA, 13 nt, Homo sapiens
aaaaauuacucaa

SEQ ID NO: 962194 - RNA, 18 nt, Homo sapiens
aaaaccaacaaugugauu

SEQ ID NO: 962195 - RNA, 13 nt, Homo sapiens
aaaaccacuuuuu

SEQ ID NO: 962196 - RNA, 19 nt, Homo sapiens
cuuuuuuuaaguguucugu

SEQ ID NO: 962197 - RNA, 20 nt, Homo sapiens
gaaaaaaugcagggugauuu

SEQ ID NO: 962198 - RNA, 17 nt, Homo sapiens
gaaaaagcaaguguuca

SEQ ID NO: 962199 - RNA, 12 nt, Homo sapiens
gaaaaaucucau

SEQ ID NO: 962200 - RNA, 14 nt, Homo sapiens
gaaaagaaagugaa

SEQ ID NO: 962201 - RNA, 17 nt, Homo sapiens
gaaaagcuauuagccag

SEQ ID NO: 962202 - RNA, 15 nt, Homo sapiens
gaaaaggagcuucag

SEQ ID NO: 962203 - RNA, 19 nt, Homo sapiens
gaaaaggagcuucaguauu

SEQ ID NO: 962204 - RNA, 14 nt, Homo sapiens
gaaaauaaacugac

SEQ ID NO: 962205 - RNA, 16 nt, Homo sapiens
gaaaauggccaugcag

SEQ ID NO: 962206 - RNA, 11 nt, Homo sapiens
gaaaauuccau

SEQ ID NO: 962207 - RNA, 22 nt, Homo sapiens
gaaaauugggcaugccauuaca

SEQ ID NO: 962208 - RNA, 15 nt, Homo sapiens
gaaacaaacaucuaa

SEQ ID NO: 962209 - RNA, 14 nt, Homo sapiens
gaaacgucaugugu

SEQ ID NO: 962210 - RNA, 14 nt, Homo sapiens
gaaacuaagccagg

SEQ ID NO: 962211 - RNA, 21 nt, Homo sapiens
gaaacugugaagaucucacuc

SEQ ID NO: 962212 - RNA, 19 nt, Homo sapiens
gaaacuuuaaaagacugaa

SEQ ID NO: 962213 - RNA, 19 nt, Homo sapiens
gaaacuuuaauccaaagaa

SEQ ID NO: 962214 - RNA, 22 nt, Homo sapiens
gaaagagcagucagaguccagu

SEQ ID NO: 962215 - RNA, 20 nt, Homo sapiens
gaaagcccucaugugcagua

SEQ ID NO: 962216 - RNA, 19 nt, Homo sapiens
gaaagcucacuguagcuuu

SEQ ID NO: 962217 - RNA, 23 nt, Homo sapiens
gaaagcuuacauuuuccugagac

SEQ ID NO: 962218 - RNA, 16 nt, Homo sapiens
gaaaguaacugugaga

SEQ ID NO: 962219 - RNA, 14 nt, Homo sapiens
gaaauaaaaugaua

SEQ ID NO: 962220 - RNA, 14 nt, Homo sapiens
gaaauauauuacuu

SEQ ID NO: 962221 - RNA, 20 nt, Homo sapiens
gaaauccguucuauuuugug

SEQ ID NO: 962222 - RNA, 14 nt, Homo sapiens
gaaaugaauagacu

SEQ ID NO: 962223 - RNA, 18 nt, Homo sapiens
gaaaugagaaacuuugau

SEQ ID NO: 962224 - RNA, 17 nt, Homo sapiens
gaaaugcauauuugcaa

SEQ ID NO: 962225 - RNA, 20 nt, Homo sapiens
gaaaugccugcuuugaauaa

SEQ ID NO: 962226 - RNA, 20 nt, Homo sapiens
gaaauuauuuuucaggaaaa

SEQ ID NO: 962227 - RNA, 16 nt, Homo sapiens
gaaauuccuguacugu

SEQ ID NO: 962228 - RNA, 11 nt, Homo sapiens
gaacaaaucag

SEQ ID NO: 962229 - RNA, 22 nt, Homo sapiens
gaacacuaacucaccagcccca

SEQ ID NO: 962230 - RNA, 20 nt, Homo sapiens
gaacacuugaagccaucuaa

SEQ ID NO: 962231 - RNA, 21 nt, Homo sapiens
gaacaguaaagaaagcagaau

SEQ ID NO: 962232 - RNA, 16 nt, Homo sapiens
gaacauagaacucugg

SEQ ID NO: 962233 - RNA, 17 nt, Homo sapiens
gaacauguuuaaugggu

SEQ ID NO: 962234 - RNA, 15 nt, Homo sapiens
gaacauucgaggugu

SEQ ID NO: 962235 - RNA, 12 nt, Homo sapiens
gaaccagcccca

SEQ ID NO: 962236 - RNA, 14 nt, Homo sapiens
gaacccaagugccu

SEQ ID NO: 962237 - RNA, 18 nt, Homo sapiens
gaacccaguguuuccaca

SEQ ID NO: 962238 - RNA, 19 nt, Homo sapiens
gaaccccacgcccugucua

SEQ ID NO: 962239 - RNA, 16 nt, Homo sapiens
gaaccccuuucccacc

SEQ ID NO: 962240 - RNA, 19 nt, Homo sapiens
gaaccuugucccagccagu

SEQ ID NO: 962241 - RNA, 21 nt, Homo sapiens
gaaccuugucccagccaguga

SEQ ID NO: 962242 - RNA, 14 nt, Homo sapiens
gaacuaaauaugca

SEQ ID NO: 962243 - RNA, 19 nt, Homo sapiens
gaacuacuuuuggugcuua

SEQ ID NO: 962244 - RNA, 17 nt, Homo sapiens
gaacuauauuaguaugu

SEQ ID NO: 962245 - RNA, 22 nt, Homo sapiens
gaacucagagaugaacaucuaa

SEQ ID NO: 962246 - RNA, 16 nt, Homo sapiens
gaacucuggaguucau

SEQ ID NO: 962247 - RNA, 23 nt, Homo sapiens
gaacuggaaaccaggaacucugg

SEQ ID NO: 962248 - RNA, 12 nt, Homo sapiens
gaacugugccac

SEQ ID NO: 962249 - RNA, 20 nt, Homo sapiens
gaacuuuuuuagaaaugcaa

SEQ ID NO: 962250 - RNA, 16 nt, Homo sapiens
gaagaaaauagucagu

SEQ ID NO: 962251 - RNA, 21 nt, Homo sapiens
gaagaacuggaaccccagcuu

SEQ ID NO: 962252 - RNA, 17 nt, Homo sapiens
gaagaagugagcagugu

SEQ ID NO: 962253 - RNA, 16 nt, Homo sapiens
gaagacaaccaucaca

SEQ ID NO: 962254 - RNA, 20 nt, Homo sapiens
gaagaccggcugguggagcu

SEQ ID NO: 962255 - RNA, 21 nt, Homo sapiens
gaagacuauggugcugccuug

SEQ ID NO: 962256 - RNA, 20 nt, Homo sapiens
gaagagggagaagcaugaaa

SEQ ID NO: 962257 - RNA, 18 nt, Homo sapiens
gaagagguauuacugaca

SEQ ID NO: 962258 - RNA, 16 nt, Homo sapiens
gaagaguuauaaagua

SEQ ID NO: 962259 - RNA, 12 nt, Homo sapiens
gaagcacuacac

SEQ ID NO: 962260 - RNA, 23 nt, Homo sapiens
gaagcagggaauuccugggguaa

SEQ ID NO: 962261 - RNA, 12 nt, Homo sapiens
gaagccaaagaa

SEQ ID NO: 962262 - RNA, 15 nt, Homo sapiens
gaagccagagcccca

SEQ ID NO: 962263 - RNA, 13 nt, Homo sapiens
gaagccauauuca

SEQ ID NO: 962264 - RNA, 12 nt, Homo sapiens
gaagcucaucuc

SEQ ID NO: 962265 - RNA, 18 nt, Homo sapiens
gaagcuguuguacauuua

SEQ ID NO: 962266 - RNA, 18 nt, Homo sapiens
gaaggacuugacugggga

SEQ ID NO: 962267 - RNA, 13 nt, Homo sapiens
gaaggcaagagau

SEQ ID NO: 962268 - RNA, 21 nt, Homo sapiens
gaagguaauguuuaauguuga

SEQ ID NO: 962269 - RNA, 16 nt, Homo sapiens
gaagguauaugccaaa

SEQ ID NO: 962270 - RNA, 14 nt, Homo sapiens
gaaguauguauauu

SEQ ID NO: 962271 - RNA, 21 nt, Homo sapiens
augcuccaucccaaccaggca

SEQ ID NO: 962272 - RNA, 22 nt, Homo sapiens
augcugaaaaauauagccuuua

SEQ ID NO: 962273 - RNA, 15 nt, Homo sapiens
augcuuccugacaau

SEQ ID NO: 962274 - RNA, 15 nt, Homo sapiens
augcuugacccugaa

SEQ ID NO: 962275 - RNA, 13 nt, Homo sapiens
augcuuuucccac

SEQ ID NO: 962276 - RNA, 20 nt, Homo sapiens
auggaaagacaaacugcaca

SEQ ID NO: 962277 - RNA, 19 nt, Homo sapiens
auggaauacagucauucca

SEQ ID NO: 962278 - RNA, 21 nt, Homo sapiens
auggcauaugguccuagacaa

SEQ ID NO: 962279 - RNA, 18 nt, Homo sapiens
auggcaucauuauaagcu

SEQ ID NO: 962280 - RNA, 13 nt, Homo sapiens
auggcaucuucaa

SEQ ID NO: 962281 - RNA, 20 nt, Homo sapiens
auggcucaagucugcacaga

SEQ ID NO: 962282 - RNA, 18 nt, Homo sapiens
auggcuuguucaucaucc

SEQ ID NO: 962283 - RNA, 19 nt, Homo sapiens
auggcuuugugauucaauc

SEQ ID NO: 962284 - RNA, 15 nt, Homo sapiens
augggaagcagggaa

SEQ ID NO: 962285 - RNA, 14 nt, Homo sapiens
auggggcacccugg

SEQ ID NO: 962286 - RNA, 15 nt, Homo sapiens
auggggcgagccagg

SEQ ID NO: 962287 - RNA, 15 nt, Homo sapiens
augggggcaucucuu

SEQ ID NO: 962288 - RNA, 16 nt, Homo sapiens
augguaauaagcacug

SEQ ID NO: 962289 - RNA, 16 nt, Homo sapiens
augguacaaaccaaau

SEQ ID NO: 962290 - RNA, 17 nt, Homo sapiens
auggucgauauacaauu

SEQ ID NO: 962291 - RNA, 23 nt, Homo sapiens
augguucccaauaucaugugauu

SEQ ID NO: 962292 - RNA, 15 nt, Homo sapiens
augguucuccaagaa

SEQ ID NO: 962293 - RNA, 20 nt, Homo sapiens
auguaacaacaauuauuuga

SEQ ID NO: 962294 - RNA, 12 nt, Homo sapiens
auguaagcacuc

SEQ ID NO: 962295 - RNA, 13 nt, Homo sapiens
auguacacuacca

SEQ ID NO: 962296 - RNA, 20 nt, Homo sapiens
auguagaggcuuguuuaccu

SEQ ID NO: 962297 - RNA, 22 nt, Homo sapiens
auguagccuuuacuguuugaua

SEQ ID NO: 962298 - RNA, 14 nt, Homo sapiens
augucaaagcuuug

SEQ ID NO: 962299 - RNA, 21 nt, Homo sapiens
augucaguacuauucagguaa

SEQ ID NO: 962300 - RNA, 15 nt, Homo sapiens
auguccaaguccaac

SEQ ID NO: 962301 - RNA, 14 nt, Homo sapiens
augucuauguagcu

SEQ ID NO: 962302 - RNA, 15 nt, Homo sapiens
augucuauucagcuu

SEQ ID NO: 962303 - RNA, 22 nt, Homo sapiens
augucuccacuuucacccgcag

SEQ ID NO: 962304 - RNA, 17 nt, Homo sapiens
augucuuggacacugua

SEQ ID NO: 962305 - RNA, 23 nt, Homo sapiens
augugaagagggagaagcaugaa

SEQ ID NO: 962306 - RNA, 20 nt, Homo sapiens
augugaauuauugacacuga

SEQ ID NO: 962307 - RNA, 21 nt, Homo sapiens
augugaauuauugacacugaa

SEQ ID NO: 962308 - RNA, 17 nt, Homo sapiens
augugauggacacucca

SEQ ID NO: 962309 - RNA, 18 nt, Homo sapiens
auguggaauugacugccu

SEQ ID NO: 962310 - RNA, 15 nt, Homo sapiens
auguggcccucugga

SEQ ID NO: 962311 - RNA, 20 nt, Homo sapiens
auguggcuacugacauaucu

SEQ ID NO: 962312 - RNA, 21 nt, Homo sapiens
cuuaacaaagccuuugcuuug

SEQ ID NO: 962313 - RNA, 18 nt, Homo sapiens
cuuaacagcccagcacuu

SEQ ID NO: 962314 - RNA, 14 nt, Homo sapiens
cuuaaccauucuac

SEQ ID NO: 962315 - RNA, 22 nt, Homo sapiens
cuuaacuccuuuuccacuuuaa

SEQ ID NO: 962316 - RNA, 17 nt, Homo sapiens
cuuaacucugaugguuc

SEQ ID NO: 962317 - RNA, 15 nt, Homo sapiens
cuuaagagugcugug

SEQ ID NO: 962318 - RNA, 22 nt, Homo sapiens
cuuaagucucagacugauuucu

SEQ ID NO: 962319 - RNA, 19 nt, Homo sapiens
cuuaauaaaauaaacuaga

SEQ ID NO: 962320 - RNA, 15 nt, Homo sapiens
cuuaauaccaaacau

SEQ ID NO: 962321 - RNA, 15 nt, Homo sapiens
cuuaaucuguuuauu

SEQ ID NO: 962322 - RNA, 13 nt, Homo sapiens
cuuacaacccagg

SEQ ID NO: 962323 - RNA, 23 nt, Homo sapiens
cuuacauguuuguuucuguagaa

SEQ ID NO: 962324 - RNA, 17 nt, Homo sapiens
cuuacuaaugugcccca

SEQ ID NO: 962325 - RNA, 15 nt, Homo sapiens
cuuacuucuuagcac

SEQ ID NO: 962326 - RNA, 20 nt, Homo sapiens
cuuagagaaccuauagcauc

SEQ ID NO: 962327 - RNA, 14 nt, Homo sapiens
cuuagugauugaga

SEQ ID NO: 962328 - RNA, 22 nt, Homo sapiens
cuuaucucagucaugcauaaau

SEQ ID NO: 962329 - RNA, 17 nt, Homo sapiens
cuuauuaaucauacaaa

SEQ ID NO: 962330 - RNA, 21 nt, Homo sapiens
cuuauucuuugaguaauguga

SEQ ID NO: 962331 - RNA, 19 nt, Homo sapiens
cuucaaaguuaaugggaug

SEQ ID NO: 962332 - RNA, 13 nt, Homo sapiens
cuucaaugcugca

SEQ ID NO: 962333 - RNA, 18 nt, Homo sapiens
cuucaaugcugcaggaug

SEQ ID NO: 962334 - RNA, 15 nt, Homo sapiens
cuucacaaucuguca

SEQ ID NO: 962335 - RNA, 18 nt, Homo sapiens
cuucaccccuauggugcu

SEQ ID NO: 962336 - RNA, 19 nt, Homo sapiens
cuucaccccuauggugcuc

SEQ ID NO: 962337 - RNA, 12 nt, Homo sapiens
cuucacugccag

SEQ ID NO: 962338 - RNA, 16 nt, Homo sapiens
cuucacuguauaaaua

SEQ ID NO: 962339 - RNA, 20 nt, Homo sapiens
cuucagaggauaaauaucaa

SEQ ID NO: 962340 - RNA, 21 nt, Homo sapiens
cuucagaggauaaauaucaau

SEQ ID NO: 962341 - RNA, 14 nt, Homo sapiens
cuucagcacaaaga

SEQ ID NO: 962342 - RNA, 22 nt, Homo sapiens
cuucagcugggucacauccauc

SEQ ID NO: 962343 - RNA, 14 nt, Homo sapiens
cuucaguuaugauu

SEQ ID NO: 962344 - RNA, 22 nt, Homo sapiens
cuucauuugacacaaagcuucu

SEQ ID NO: 962345 - RNA, 18 nt, Homo sapiens
cuuccaaaugucccucca

SEQ ID NO: 962346 - RNA, 22 nt, Homo sapiens
cuuccacaauggucucagccua

SEQ ID NO: 962347 - RNA, 19 nt, Homo sapiens
cuuccacucuggaaccuua

SEQ ID NO: 962348 - RNA, 19 nt, Homo sapiens
cuuccacuuugaguaccaa

SEQ ID NO: 962349 - RNA, 16 nt, Homo sapiens
cuuccagugaacauuc

SEQ ID NO: 962350 - RNA, 19 nt, Homo sapiens
cuuccauccaucuuuccau

SEQ ID NO: 962351 - RNA, 15 nt, Homo sapiens
cuucccccaccacca

SEQ ID NO: 962352 - RNA, 15 nt, Homo sapiens
cuuccugacacuuua

SEQ ID NO: 962353 - RNA, 14 nt, Homo sapiens
cuuccuguguccug

SEQ ID NO: 962354 - RNA, 17 nt, Homo sapiens
cuucgaguggccagcuu

SEQ ID NO: 962355 - RNA, 15 nt, Homo sapiens
cuucuagaaucucgu

SEQ ID NO: 962356 - RNA, 19 nt, Homo sapiens
cuucuaggcccauuguccu

SEQ ID NO: 962357 - RNA, 17 nt, Homo sapiens
cuucuauucaaaugaag

SEQ ID NO: 962358 - RNA, 15 nt, Homo sapiens
cuucuauuuggggcu

SEQ ID NO: 962359 - RNA, 21 nt, Homo sapiens
cuucucaagaccgaguguaca

SEQ ID NO: 962360 - RNA, 20 nt, Homo sapiens
cuucucagauuucugaggaa

SEQ ID NO: 962361 - RNA, 15 nt, Homo sapiens
cuucucaugauccaa

SEQ ID NO: 962362 - RNA, 22 nt, Homo sapiens
cuucucgaauugaagcaaguga

SEQ ID NO: 962363 - RNA, 17 nt, Homo sapiens
cuucucuccacaguguu

SEQ ID NO: 962364 - RNA, 18 nt, Homo sapiens
cuucucuccacaguguug

SEQ ID NO: 962365 - RNA, 15 nt, Homo sapiens
cuucugagcacagau

SEQ ID NO: 962366 - RNA, 18 nt, Homo sapiens
cuucuguauucauaagau

SEQ ID NO: 962367 - RNA, 16 nt, Homo sapiens
cuucuuaaccauucua

SEQ ID NO: 962368 - RNA, 17 nt, Homo sapiens
cuucuuccuauuguaau

SEQ ID NO: 962369 - RNA, 13 nt, Homo sapiens
cuucuugcucccc

SEQ ID NO: 962370 - RNA, 16 nt, Homo sapiens
cuucuugcugaucaga

SEQ ID NO: 962371 - RNA, 19 nt, Homo sapiens
cuucuuugauaauguuaaa

SEQ ID NO: 962372 - RNA, 20 nt, Homo sapiens
cuugaacucuugaccucagg

SEQ ID NO: 962373 - RNA, 11 nt, Homo sapiens
cuugaagccaa

SEQ ID NO: 962374 - RNA, 12 nt, Homo sapiens
cuugaagccaaa

SEQ ID NO: 962375 - RNA, 15 nt, Homo sapiens
cuugaagccaaagaa

SEQ ID NO: 962376 - RNA, 12 nt, Homo sapiens
cuugaagccauc

SEQ ID NO: 962377 - RNA, 14 nt, Homo sapiens
cuugaauagucuca

SEQ ID NO: 962378 - RNA, 17 nt, Homo sapiens
cuugaauucauguuggu

SEQ ID NO: 962379 - RNA, 19 nt, Homo sapiens
cuugacgaauauugcuuac

SEQ ID NO: 962380 - RNA, 12 nt, Homo sapiens
cuugaugauuga

SEQ ID NO: 962381 - RNA, 20 nt, Homo sapiens
cuugccauuuguagcuuugc

SEQ ID NO: 962382 - RNA, 17 nt, Homo sapiens
cuugccugaacuccugc

SEQ ID NO: 962383 - RNA, 15 nt, Homo sapiens
cuugcuuaccucuca

SEQ ID NO: 962384 - RNA, 21 nt, Homo sapiens
cuuggaggcuuuuauggggcc

SEQ ID NO: 962385 - RNA, 18 nt, Homo sapiens
cuuggcuggggaggacca

SEQ ID NO: 962386 - RNA, 17 nt, Homo sapiens
cuugggagaggggcgca

SEQ ID NO: 962387 - RNA, 16 nt, Homo sapiens
cuuggggccaccaaag

SEQ ID NO: 962388 - RNA, 17 nt, Homo sapiens
auuuuaaggcauauuua

SEQ ID NO: 962389 - RNA, 20 nt, Homo sapiens
auuuuacagagcgcaccuca

SEQ ID NO: 962390 - RNA, 17 nt, Homo sapiens
auuuuacaugacagaua

SEQ ID NO: 962391 - RNA, 18 nt, Homo sapiens
auuuuaguaagaagacua

SEQ ID NO: 962392 - RNA, 14 nt, Homo sapiens
auuuuauacuugcc

SEQ ID NO: 962393 - RNA, 22 nt, Homo sapiens
auuuuauaugcuuacugauaua

SEQ ID NO: 962394 - RNA, 19 nt, Homo sapiens
auuuucaucaaaaccaaga

SEQ ID NO: 962395 - RNA, 23 nt, Homo sapiens
auuuucccagucugugaagucaa

SEQ ID NO: 962396 - RNA, 19 nt, Homo sapiens
auuuuccugagaccucaau

SEQ ID NO: 962397 - RNA, 21 nt, Homo sapiens
auuuuccuggugccaauuuca

SEQ ID NO: 962398 - RNA, 20 nt, Homo sapiens
auuuucuccuugguuugcua

SEQ ID NO: 962399 - RNA, 21 nt, Homo sapiens
auuuuuaauguuuguacacaa

SEQ ID NO: 962400 - RNA, 21 nt, Homo sapiens
auuuuuauacaaaccuaccaa

SEQ ID NO: 962401 - RNA, 16 nt, Homo sapiens
auuuuuguacauguuc

SEQ ID NO: 962402 - RNA, 22 nt, Homo sapiens
auuuuuucagacugugcaauac

SEQ ID NO: 962403 - RNA, 23 nt, Homo sapiens
auuuuuucucuguaaacuuccaa

SEQ ID NO: 962404 - RNA, 13 nt, Homo sapiens
auuuuuugacuuu

SEQ ID NO: 962405 - RNA, 12 nt, Homo sapiens
caaaaaaucugu

SEQ ID NO: 962406 - RNA, 17 nt, Homo sapiens
caaaaauaaacgaacuc

SEQ ID NO: 962407 - RNA, 12 nt, Homo sapiens
caaaacagccug

SEQ ID NO: 962408 - RNA, 14 nt, Homo sapiens
caaaacaguucuca

SEQ ID NO: 962409 - RNA, 21 nt, Homo sapiens
caaaaccucauuuaaguaaaa

SEQ ID NO: 962410 - RNA, 23 nt, Homo sapiens
caaaacuuaucacgccuacuuaa

SEQ ID NO: 962411 - RNA, 21 nt, Homo sapiens
caaaauauuuggaaugaagga

SEQ ID NO: 962412 - RNA, 15 nt, Homo sapiens
caaaaugauuuugaa

SEQ ID NO: 962413 - RNA, 21 nt, Homo sapiens
caaaauggacguacugguuua

SEQ ID NO: 962414 - RNA, 12 nt, Homo sapiens
caaacaucuaau

SEQ ID NO: 962415 - RNA, 21 nt, Homo sapiens
caaacaugcggugccaugaag

SEQ ID NO: 962416 - RNA, 15 nt, Homo sapiens
caaaccaucuccucc

SEQ ID NO: 962417 - RNA, 15 nt, Homo sapiens
caaaccauugcucuu

SEQ ID NO: 962418 - RNA, 15 nt, Homo sapiens
caaacugcuucccuu

SEQ ID NO: 962419 - RNA, 20 nt, Homo sapiens
caaagaaaaaaaaaaaagcc

SEQ ID NO: 962420 - RNA, 23 nt, Homo sapiens
caaagauuauuccugguaaagga

SEQ ID NO: 962421 - RNA, 16 nt, Homo sapiens
caaaggagcuuucuca

SEQ ID NO: 962422 - RNA, 21 nt, Homo sapiens
caaaggcauccauagugcacu

SEQ ID NO: 962423 - RNA, 15 nt, Homo sapiens
caaagggcaguuuug

SEQ ID NO: 962424 - RNA, 17 nt, Homo sapiens
caaaggggacagcugug

SEQ ID NO: 962425 - RNA, 23 nt, Homo sapiens
caaaggugugcuuccugcuguau

SEQ ID NO: 962426 - RNA, 11 nt, Homo sapiens
caaaguaccuu

SEQ ID NO: 962427 - RNA, 15 nt, Homo sapiens
caaaguacuugucau

SEQ ID NO: 962428 - RNA, 12 nt, Homo sapiens
caaauaaacuca

SEQ ID NO: 962429 - RNA, 23 nt, Homo sapiens
caaauaauuccauuccaguuuuu

SEQ ID NO: 962430 - RNA, 13 nt, Homo sapiens
caaaucauuccuu

SEQ ID NO: 962431 - RNA, 17 nt, Homo sapiens
caaauccacaagccauu

SEQ ID NO: 962432 - RNA, 14 nt, Homo sapiens
caaaucucuuccac

SEQ ID NO: 962433 - RNA, 14 nt, Homo sapiens
caaaugccauccag

SEQ ID NO: 962434 - RNA, 20 nt, Homo sapiens
caaauuaaaacaaauauaca

SEQ ID NO: 962435 - RNA, 18 nt, Homo sapiens
caaauucuucugaacuca

SEQ ID NO: 962436 - RNA, 21 nt, Homo sapiens
caacaagauuuccuugugcaa

SEQ ID NO: 962437 - RNA, 22 nt, Homo sapiens
caacaggauuacaguguagcua

SEQ ID NO: 962438 - RNA, 15 nt, Homo sapiens
caacagucaccucac

SEQ ID NO: 962439 - RNA, 20 nt, Homo sapiens
caacauauauuuauugagua

SEQ ID NO: 962440 - RNA, 11 nt, Homo sapiens
caacauugugu

SEQ ID NO: 962441 - RNA, 13 nt, Homo sapiens
caaccagaccacu

SEQ ID NO: 962442 - RNA, 18 nt, Homo sapiens
caacccuaucuccugaca

SEQ ID NO: 962443 - RNA, 20 nt, Homo sapiens
caacccuucuggaaacugug

SEQ ID NO: 962444 - RNA, 13 nt, Homo sapiens
caaccucuuugcu

SEQ ID NO: 962445 - RNA, 17 nt, Homo sapiens
caaccucuuuuuccucc

SEQ ID NO: 962446 - RNA, 13 nt, Homo sapiens
caaccuuccagcu

SEQ ID NO: 962447 - RNA, 11 nt, Homo sapiens
caacuaccuga

SEQ ID NO: 962448 - RNA, 15 nt, Homo sapiens
caacucuccacucca

SEQ ID NO: 962449 - RNA, 14 nt, Homo sapiens
caacucuugcacag

SEQ ID NO: 962450 - RNA, 23 nt, Homo sapiens
caacugaccugaccccauuccug

SEQ ID NO: 962451 - RNA, 14 nt, Homo sapiens
caacugauugcaac

SEQ ID NO: 962452 - RNA, 15 nt, Homo sapiens
caacugauugcaaca

SEQ ID NO: 962453 - RNA, 15 nt, Homo sapiens
caacugcgacuguga

SEQ ID NO: 962454 - RNA, 19 nt, Homo sapiens
caacugggucugacaugaa

SEQ ID NO: 962455 - RNA, 18 nt, Homo sapiens
caacuguccacgcgugcc

SEQ ID NO: 962456 - RNA, 23 nt, Homo sapiens
caacugucuuagacugcuagcuu

SEQ ID NO: 962457 - RNA, 14 nt, Homo sapiens
caacuucauuugac

SEQ ID NO: 962458 - RNA, 17 nt, Homo sapiens
caacuucgugcucaggu

SEQ ID NO: 962459 - RNA, 14 nt, Homo sapiens
caagaaagcucacu

SEQ ID NO: 962460 - RNA, 18 nt, Homo sapiens
caagacacugaggagaua

SEQ ID NO: 962461 - RNA, 19 nt, Homo sapiens
caagacuuagagcugggaa

SEQ ID NO: 962462 - RNA, 21 nt, Homo sapiens
caagacuuuugucugaucaag

SEQ ID NO: 962463 - RNA, 15 nt, Homo sapiens
cugguuuaaccuccu

SEQ ID NO: 962464 - RNA, 23 nt, Homo sapiens
cugguuuguggggcacagaugcc

SEQ ID NO: 962465 - RNA, 16 nt, Homo sapiens
cugguuuucugccaau

SEQ ID NO: 962466 - RNA, 23 nt, Homo sapiens
cuguaaaauggaggccauugugu

SEQ ID NO: 962467 - RNA, 16 nt, Homo sapiens
cuguaaacuuccaagc

SEQ ID NO: 962468 - RNA, 20 nt, Homo sapiens
cuguaacuuccaaauaaaua

SEQ ID NO: 962469 - RNA, 12 nt, Homo sapiens
cuguaagcauuc

SEQ ID NO: 962470 - RNA, 13 nt, Homo sapiens
cuguaagcauucu

SEQ ID NO: 962471 - RNA, 22 nt, Homo sapiens
cuguaaggcaggcccauucaga

SEQ ID NO: 962472 - RNA, 21 nt, Homo sapiens
cuguacagaaaguaucacaaa

SEQ ID NO: 962473 - RNA, 22 nt, Homo sapiens
cuguauaaguuauuuuuguaca

SEQ ID NO: 962474 - RNA, 19 nt, Homo sapiens
cuguauauuuaucuuucaa

SEQ ID NO: 962475 - RNA, 19 nt, Homo sapiens
cugucaaucacagucucag

SEQ ID NO: 962476 - RNA, 18 nt, Homo sapiens
cugucacuagucucacca

SEQ ID NO: 962477 - RNA, 14 nt, Homo sapiens
cugucauugcacau

SEQ ID NO: 962478 - RNA, 16 nt, Homo sapiens
cuguccccacacugac

SEQ ID NO: 962479 - RNA, 13 nt, Homo sapiens
cugucuuccucaa

SEQ ID NO: 962480 - RNA, 18 nt, Homo sapiens
cugugaaauucacaguaa

SEQ ID NO: 962481 - RNA, 21 nt, Homo sapiens
cugugacucccccucuuucac

SEQ ID NO: 962482 - RNA, 15 nt, Homo sapiens
cugugcaugaccuga

SEQ ID NO: 962483 - RNA, 13 nt, Homo sapiens
cugugcaugccau

SEQ ID NO: 962484 - RNA, 19 nt, Homo sapiens
cugugcauugacaucacag

SEQ ID NO: 962485 - RNA, 21 nt, Homo sapiens
cugugccucgcauccuaugcu

SEQ ID NO: 962486 - RNA, 18 nt, Homo sapiens
cugugcuucgguaggcga

SEQ ID NO: 962487 - RNA, 16 nt, Homo sapiens
cuguggggccugaugg

SEQ ID NO: 962488 - RNA, 13 nt, Homo sapiens
cuguguauuccaa

SEQ ID NO: 962489 - RNA, 21 nt, Homo sapiens
cugugucggauacacacucga

SEQ ID NO: 962490 - RNA, 13 nt, Homo sapiens
cuguuaauaguca

SEQ ID NO: 962491 - RNA, 14 nt, Homo sapiens
cuguuaauagucau

SEQ ID NO: 962492 - RNA, 13 nt, Homo sapiens
cuguuaccauuca

SEQ ID NO: 962493 - RNA, 19 nt, Homo sapiens
cuguuacugaaauugguau

SEQ ID NO: 962494 - RNA, 15 nt, Homo sapiens
cuguuaucugcuaga

SEQ ID NO: 962495 - RNA, 19 nt, Homo sapiens
cuguuaucugcuagaucua

SEQ ID NO: 962496 - RNA, 20 nt, Homo sapiens
cuguugaccugugcaccuac

SEQ ID NO: 962497 - RNA, 21 nt, Homo sapiens
cuguugauuaucuucagccca

SEQ ID NO: 962498 - RNA, 14 nt, Homo sapiens
cuuaaaaaaaccau

SEQ ID NO: 962499 - RNA, 19 nt, Homo sapiens
cuuaaaagguuaaauuuca

SEQ ID NO: 962500 - RNA, 16 nt, Homo sapiens
cuuaaaccuaccuccc

SEQ ID NO: 962501 - RNA, 22 nt, Homo sapiens
cuuaaacgaagaguucccuuga

SEQ ID NO: 962502 - RNA, 20 nt, Homo sapiens
cuuaaagggcccaaugaauu

SEQ ID NO: 962503 - RNA, 18 nt, Homo sapiens
aacucugggcugccaugu

SEQ ID NO: 962504 - RNA, 13 nt, Homo sapiens
aacugauugcaac

SEQ ID NO: 962505 - RNA, 14 nt, Homo sapiens
aacugggguugagg

SEQ ID NO: 962506 - RNA, 20 nt, Homo sapiens
aacuuggaugucacugccug

SEQ ID NO: 962507 - RNA, 18 nt, Homo sapiens
aacuuguggccucaagca

SEQ ID NO: 962508 - RNA, 20 nt, Homo sapiens
aacuuguggccucaagcaau

SEQ ID NO: 962509 - RNA, 19 nt, Homo sapiens
aacuuguuugcugugaaca

SEQ ID NO: 962510 - RNA, 17 nt, Homo sapiens
aacuuugacuuugccca

SEQ ID NO: 962511 - RNA, 16 nt, Homo sapiens
aagaaaaaucucauua

SEQ ID NO: 962512 - RNA, 12 nt, Homo sapiens
aagaaaugcaaa

SEQ ID NO: 962513 - RNA, 22 nt, Homo sapiens
aagaaauuccuuccuuaccuga

SEQ ID NO: 962514 - RNA, 15 nt, Homo sapiens
aagaaccauugauuu

SEQ ID NO: 962515 - RNA, 18 nt, Homo sapiens
aagaacuaaauaugcaau

SEQ ID NO: 962516 - RNA, 22 nt, Homo sapiens
aagaacuauugugcucagagac

SEQ ID NO: 962517 - RNA, 22 nt, Homo sapiens
aagaaggaaaaaauaaaagauc

SEQ ID NO: 962518 - RNA, 15 nt, Homo sapiens
aagaaggcaauauua

SEQ ID NO: 962519 - RNA, 16 nt, Homo sapiens
aagaagugagcagugu

SEQ ID NO: 962520 - RNA, 13 nt, Homo sapiens
aagaauaccugag

SEQ ID NO: 962521 - RNA, 15 nt, Homo sapiens
aagaauggcuuucaa

SEQ ID NO: 962522 - RNA, 22 nt, Homo sapiens
aagacaaggcuggcaaacccuc

SEQ ID NO: 962523 - RNA, 22 nt, Homo sapiens
aagacauaacguuuuuccuuua

SEQ ID NO: 962524 - RNA, 13 nt, Homo sapiens
aagacaugaacca

SEQ ID NO: 962525 - RNA, 16 nt, Homo sapiens
aagaccagccuggcca

SEQ ID NO: 962526 - RNA, 15 nt, Homo sapiens
aagacuccaucucaa

SEQ ID NO: 962527 - RNA, 14 nt, Homo sapiens
aagacucuuuauga

SEQ ID NO: 962528 - RNA, 18 nt, Homo sapiens
aagacugguuuucugcca

SEQ ID NO: 962529 - RNA, 19 nt, Homo sapiens
aagacuuuugucugaucaa

SEQ ID NO: 962530 - RNA, 13 nt, Homo sapiens
aagagacacucca

SEQ ID NO: 962531 - RNA, 13 nt, Homo sapiens
aagagaguaccau

SEQ ID NO: 962532 - RNA, 17 nt, Homo sapiens
aagagaugaauugcauu

SEQ ID NO: 962533 - RNA, 22 nt, Homo sapiens
aagagcagugguaagaauagua

SEQ ID NO: 962534 - RNA, 21 nt, Homo sapiens
aagagggcuuccucuagaagc

SEQ ID NO: 962535 - RNA, 22 nt, Homo sapiens
aagaguauuuuaagaagacaua

SEQ ID NO: 962536 - RNA, 19 nt, Homo sapiens
aagagucuggccuggaccc

SEQ ID NO: 962537 - RNA, 21 nt, Homo sapiens
aagagucuuguuuuuuauuca

SEQ ID NO: 962538 - RNA, 15 nt, Homo sapiens
aagauaauuuacuua

SEQ ID NO: 962539 - RNA, 20 nt, Homo sapiens
aagauauguaacaacaauua

SEQ ID NO: 962540 - RNA, 23 nt, Homo sapiens
aagaucagcgacugccacaucau

SEQ ID NO: 962541 - RNA, 19 nt, Homo sapiens
aagaucuugaauagucuca

SEQ ID NO: 962542 - RNA, 20 nt, Homo sapiens
aagaugguguggguguccug

SEQ ID NO: 962543 - RNA, 20 nt, Homo sapiens
aagauucuggggcuguguua

SEQ ID NO: 962544 - RNA, 23 nt, Homo sapiens
aagauuuuccauuguauccucuu

SEQ ID NO: 962545 - RNA, 17 nt, Homo sapiens
uguccaaagaggcugcc

SEQ ID NO: 962546 - RNA, 14 nt, Homo sapiens
uguccauaaauaaa

SEQ ID NO: 962547 - RNA, 18 nt, Homo sapiens
uguccauaagcuacgggu

SEQ ID NO: 962548 - RNA, 17 nt, Homo sapiens
ugucccaaccccagugg

SEQ ID NO: 962549 - RNA, 15 nt, Homo sapiens
ugucccuguagcuca

SEQ ID NO: 962550 - RNA, 16 nt, Homo sapiens
ugucgccaccacuucc

SEQ ID NO: 962551 - RNA, 21 nt, Homo sapiens
ugucucaaaggagcuuucuca

SEQ ID NO: 962552 - RNA, 16 nt, Homo sapiens
ugucucaaauucaugg

SEQ ID NO: 962553 - RNA, 13 nt, Homo sapiens
ugucucaguuuuc

SEQ ID NO: 962554 - RNA, 19 nt, Homo sapiens
ugucuccaucucugucuca

SEQ ID NO: 962555 - RNA, 13 nt, Homo sapiens
ugucucuaccuaa

SEQ ID NO: 962556 - RNA, 21 nt, Homo sapiens
ugucugaguaagcccucagga

SEQ ID NO: 962557 - RNA, 19 nt, Homo sapiens
ugucugggugcuacugggg

SEQ ID NO: 962558 - RNA, 18 nt, Homo sapiens
ugucuuggacacuguaca

SEQ ID NO: 962559 - RNA, 18 nt, Homo sapiens
ugucuuuguucugugauu

SEQ ID NO: 962560 - RNA, 14 nt, Homo sapiens
ugugaaguacauau

SEQ ID NO: 962561 - RNA, 18 nt, Homo sapiens
ugugaaguuugcuuugua

SEQ ID NO: 962562 - RNA, 13 nt, Homo sapiens
ugugaauggauug

SEQ ID NO: 962563 - RNA, 20 nt, Homo sapiens
ugugaauuauugacacugaa

SEQ ID NO: 962564 - RNA, 15 nt, Homo sapiens
ugugacacauaugca

SEQ ID NO: 962565 - RNA, 20 nt, Homo sapiens
ugugacucccccucuuucac

SEQ ID NO: 962566 - RNA, 14 nt, Homo sapiens
ugugacuucuugca

SEQ ID NO: 962567 - RNA, 19 nt, Homo sapiens
ugugagaggcgugauaucu

SEQ ID NO: 962568 - RNA, 14 nt, Homo sapiens
ugugauucugccuu

SEQ ID NO: 962569 - RNA, 23 nt, Homo sapiens
ugugcagggugaagcagcucauu

SEQ ID NO: 962570 - RNA, 22 nt, Homo sapiens
ugugccccauguccaaguccaa

SEQ ID NO: 962571 - RNA, 16 nt, Homo sapiens
ugugccccuucacuca

SEQ ID NO: 962572 - RNA, 18 nt, Homo sapiens
ugcccccagccccggggu

SEQ ID NO: 962573 - RNA, 14 nt, Homo sapiens
ugccccucucacca

SEQ ID NO: 962574 - RNA, 19 nt, Homo sapiens
ugcccguguaguccccaac

SEQ ID NO: 962575 - RNA, 21 nt, Homo sapiens
ugccucagacguugccugaga

SEQ ID NO: 962576 - RNA, 16 nt, Homo sapiens
ugccucagccuuccaa

SEQ ID NO: 962577 - RNA, 22 nt, Homo sapiens
ugccugaaggcucacaccucau

SEQ ID NO: 962578 - RNA, 13 nt, Homo sapiens
ugccugagcugca

SEQ ID NO: 962579 - RNA, 16 nt, Homo sapiens
ugccuggacacuguac

SEQ ID NO: 962580 - RNA, 11 nt, Homo sapiens
ugccugggaag

SEQ ID NO: 962581 - RNA, 21 nt, Homo sapiens
ugccugugcaugaccugauca

SEQ ID NO: 962582 - RNA, 22 nt, Homo sapiens
ugccuucagaggauaaauauca

SEQ ID NO: 962583 - RNA, 13 nt, Homo sapiens
ugccuucucagga

SEQ ID NO: 962584 - RNA, 14 nt, Homo sapiens
ugccuucucaggaa

SEQ ID NO: 962585 - RNA, 14 nt, Homo sapiens
ugccuucucaugau

SEQ ID NO: 962586 - RNA, 14 nt, Homo sapiens
ugccuucuggccuu

SEQ ID NO: 962587 - RNA, 18 nt, Homo sapiens
ugccuuucgaggccugaa

SEQ ID NO: 962588 - RNA, 22 nt, Homo sapiens
ugcgccaaucccgccaugcuca

SEQ ID NO: 962589 - RNA, 17 nt, Homo sapiens
ugcgcucucuuugcaac

SEQ ID NO: 962590 - RNA, 17 nt, Homo sapiens
ugcgucgucaccaaauc

SEQ ID NO: 962591 - RNA, 14 nt, Homo sapiens
ugcguggacucugc

SEQ ID NO: 962592 - RNA, 15 nt, Homo sapiens
ugcguggacucugca

SEQ ID NO: 962593 - RNA, 16 nt, Homo sapiens
ugcuaacauagauuua

SEQ ID NO: 962594 - RNA, 20 nt, Homo sapiens
ugcuaccacagcaacuauau

SEQ ID NO: 962595 - RNA, 15 nt, Homo sapiens
ugcuagaagcuguaa

SEQ ID NO: 962596 - RNA, 21 nt, Homo sapiens
ugcuauaugccuuaagccaau

SEQ ID NO: 962597 - RNA, 16 nt, Homo sapiens
ugcuauccccaucucc

SEQ ID NO: 962598 - RNA, 21 nt, Homo sapiens
ugcuauccccaucucccugcc

SEQ ID NO: 962599 - RNA, 19 nt, Homo sapiens
ugcuaugaagcguugaugg

SEQ ID NO: 962600 - RNA, 14 nt, Homo sapiens
ugcuaugcaaaaaa

SEQ ID NO: 962601 - RNA, 19 nt, Homo sapiens
ugcuauuuauuuuccuaaa

SEQ ID NO: 962602 - RNA, 23 nt, Homo sapiens
ugcucaaggccagcuuauaguca

SEQ ID NO: 962603 - RNA, 12 nt, Homo sapiens
ugcucaccagcc

SEQ ID NO: 962604 - RNA, 15 nt, Homo sapiens
ugcucagagacacug

SEQ ID NO: 962605 - RNA, 19 nt, Homo sapiens
ugcucaggagccaccagca

SEQ ID NO: 962606 - RNA, 16 nt, Homo sapiens
ugcuccuccuacccuu

SEQ ID NO: 962607 - RNA, 19 nt, Homo sapiens
ugcuccuccuccuguauuc

SEQ ID NO: 962608 - RNA, 20 nt, Homo sapiens
ugcucuccauucugcuccuu

SEQ ID NO: 962609 - RNA, 13 nt, Homo sapiens
ugcucugagccac

SEQ ID NO: 962610 - RNA, 19 nt, Homo sapiens
ugcucugccccaccuugcc

SEQ ID NO: 962611 - RNA, 11 nt, Homo sapiens
ugcucugcuau

SEQ ID NO: 962612 - RNA, 19 nt, Homo sapiens
ugcugaaauaaaaugauaa

SEQ ID NO: 962613 - RNA, 22 nt, Homo sapiens
ugcugaaucaaaucucuuccac

SEQ ID NO: 962614 - RNA, 17 nt, Homo sapiens
ugcugagguacagaagc

SEQ ID NO: 962615 - RNA, 14 nt, Homo sapiens
ugcugagugagcug

SEQ ID NO: 962616 - RNA, 14 nt, Homo sapiens
ugcugaugggccag

SEQ ID NO: 962617 - RNA, 23 nt, Homo sapiens
ugcugaugggccagcaggagcca

SEQ ID NO: 962618 - RNA, 15 nt, Homo sapiens
ugcuggaagcccagc

SEQ ID NO: 962619 - RNA, 22 nt, Homo sapiens
ugcuggagucuccugaggacac

SEQ ID NO: 962620 - RNA, 17 nt, Homo sapiens
ugcuguaacucagacau

SEQ ID NO: 962621 - RNA, 22 nt, Homo sapiens
ugcuguaacucagacauuccaa

SEQ ID NO: 962622 - RNA, 13 nt, Homo sapiens
ugcugucugggug

SEQ ID NO: 962623 - RNA, 23 nt, Homo sapiens
ugcugucugggugcuacugggga

SEQ ID NO: 962624 - RNA, 14 nt, Homo sapiens
ugcugugaacaauu

SEQ ID NO: 962625 - RNA, 20 nt, Homo sapiens
ugcugugugacccugggcaa

SEQ ID NO: 962626 - RNA, 22 nt, Homo sapiens
ugcuuaaaagguuaaauuucaa

SEQ ID NO: 962627 - RNA, 12 nt, Homo sapiens
ugcuuagcugua

SEQ ID NO: 962628 - RNA, 17 nt, Homo sapiens
ugcuuagucccucaugc

SEQ ID NO: 962629 - RNA, 17 nt, Homo sapiens
ugcuucauaugacaaag

SEQ ID NO: 962630 - RNA, 14 nt, Homo sapiens
ugcuuccugucuua

SEQ ID NO: 962631 - RNA, 20 nt, Homo sapiens
ugcuucucaucccaaccucu

SEQ ID NO: 962632 - RNA, 20 nt, Homo sapiens
ugcuuucacauuguacuuaa

SEQ ID NO: 962633 - RNA, 16 nt, Homo sapiens
ugcuuucccacucuca

SEQ ID NO: 962634 - RNA, 15 nt, Homo sapiens
ugcuuucugguggug

SEQ ID NO: 962635 - RNA, 17 nt, Homo sapiens
ugcuuuucccacucuca

SEQ ID NO: 962636 - RNA, 15 nt, Homo sapiens
uggaaaaaaaccaca

SEQ ID NO: 962637 - RNA, 19 nt, Homo sapiens
uggaaaaaaaccacagcca

SEQ ID NO: 962638 - RNA, 15 nt, Homo sapiens
uggaaaacuguguug

SEQ ID NO: 962639 - RNA, 22 nt, Homo sapiens
uggaaaagcaacuucauuugac

SEQ ID NO: 962640 - RNA, 21 nt, Homo sapiens
uggaaaaggagcuucaguauu

SEQ ID NO: 962641 - RNA, 21 nt, Homo sapiens
uggaaagacaaacugcacagg

SEQ ID NO: 962642 - RNA, 19 nt, Homo sapiens
uggaaauugcaguaacaaa

SEQ ID NO: 962643 - RNA, 14 nt, Homo sapiens
uggaaccccagcuu

SEQ ID NO: 962644 - RNA, 15 nt, Homo sapiens
uggaagggcguucua

SEQ ID NO: 962645 - RNA, 20 nt, Homo sapiens
uggaaugcccuucacuguca

SEQ ID NO: 962646 - RNA, 15 nt, Homo sapiens
uggaauggaagaacc

SEQ ID NO: 962647 - RNA, 15 nt, Homo sapiens
uggacagccagugac

SEQ ID NO: 962648 - RNA, 22 nt, Homo sapiens
uggacaggcgccuggugugagg

SEQ ID NO: 962649 - RNA, 13 nt, Homo sapiens
uggacaugauuua

SEQ ID NO: 962650 - RNA, 22 nt, Homo sapiens
uggacaugggccagguuuuuca

SEQ ID NO: 962651 - RNA, 14 nt, Homo sapiens
uggacucugcacau

SEQ ID NO: 962652 - RNA, 16 nt, Homo sapiens
uggacuuucuugcaug

SEQ ID NO: 962653 - RNA, 17 nt, Homo sapiens
uggacuuucuugcauga

SEQ ID NO: 962654 - RNA, 18 nt, Homo sapiens
uggacuuucuugcaugaa

SEQ ID NO: 962655 - RNA, 22 nt, Homo sapiens
uggagaaccagggcucuucuca

SEQ ID NO: 962656 - RNA, 23 nt, Homo sapiens
uggagaaccagggcucuucucag

SEQ ID NO: 962657 - RNA, 17 nt, Homo sapiens
uggagacaaggugcuaa

SEQ ID NO: 962658 - RNA, 21 nt, Homo sapiens
uggagcccuaaccccuuccag

SEQ ID NO: 962659 - RNA, 22 nt, Homo sapiens
uggagcccuaaccccuuccaga

SEQ ID NO: 962660 - RNA, 14 nt, Homo sapiens
guguaauaugcaca

SEQ ID NO: 962661 - RNA, 20 nt, Homo sapiens
guguagaaaagaacuggaaa

SEQ ID NO: 962662 - RNA, 21 nt, Homo sapiens
gugucccuggccccacaagcc

SEQ ID NO: 962663 - RNA, 15 nt, Homo sapiens
gugucucacaucuac

SEQ ID NO: 962664 - RNA, 18 nt, Homo sapiens
gugucuccagccuggcuc

SEQ ID NO: 962665 - RNA, 20 nt, Homo sapiens
gugucuguacacguguccug

SEQ ID NO: 962666 - RNA, 19 nt, Homo sapiens
gugugcuccagauggugcu

SEQ ID NO: 962667 - RNA, 14 nt, Homo sapiens
guguggcuuuccag

SEQ ID NO: 962668 - RNA, 19 nt, Homo sapiens
guguguguuuagugauaga

SEQ ID NO: 962669 - RNA, 18 nt, Homo sapiens
guuaaaugguuauccaau

SEQ ID NO: 962670 - RNA, 21 nt, Homo sapiens
guuaaccccugcgcucucuuu

SEQ ID NO: 962671 - RNA, 18 nt, Homo sapiens
guuaacguauauugcugu

SEQ ID NO: 962672 - RNA, 18 nt, Homo sapiens
guuaaguaucagcuacaa

SEQ ID NO: 962673 - RNA, 16 nt, Homo sapiens
guuaauaccagcuuaa

SEQ ID NO: 962674 - RNA, 22 nt, Homo sapiens
guuacuaaaauuuacacaucuu

SEQ ID NO: 962675 - RNA, 19 nt, Homo sapiens
guuagauaugauaguauaa

SEQ ID NO: 962676 - RNA, 13 nt, Homo sapiens
guuaugcaucauu

SEQ ID NO: 962677 - RNA, 21 nt, Homo sapiens
guucaccuccaagcauuucau

SEQ ID NO: 962678 - RNA, 14 nt, Homo sapiens
guucacugcuccuu

SEQ ID NO: 962679 - RNA, 21 nt, Homo sapiens
guucacugcuccuugcugcau

SEQ ID NO: 962680 - RNA, 12 nt, Homo sapiens
guucagcagaac

SEQ ID NO: 962681 - RNA, 17 nt, Homo sapiens
guuccaaauacugcuua

SEQ ID NO: 962682 - RNA, 17 nt, Homo sapiens
guucccauuucagcuga

SEQ ID NO: 962683 - RNA, 19 nt, Homo sapiens
guuccuccucuccuacucg

SEQ ID NO: 962684 - RNA, 12 nt, Homo sapiens
guuccuuauaua

SEQ ID NO: 962685 - RNA, 22 nt, Homo sapiens
guucugcaagcaucaguucuac

SEQ ID NO: 962686 - RNA, 21 nt, Homo sapiens
guucugcugaaucaaaucucu

SEQ ID NO: 962687 - RNA, 18 nt, Homo sapiens
guucuggaccugggcaug

SEQ ID NO: 962688 - RNA, 16 nt, Homo sapiens
guucuuguguaccuac

SEQ ID NO: 962689 - RNA, 22 nt, Homo sapiens
guugaaaccaccgugaaccaga

SEQ ID NO: 962690 - RNA, 20 nt, Homo sapiens
guugaaauguucugucaaau

SEQ ID NO: 962691 - RNA, 14 nt, Homo sapiens
guugaauaaaugaa

SEQ ID NO: 962692 - RNA, 16 nt, Homo sapiens
guugcaagaugugaau

SEQ ID NO: 962693 - RNA, 17 nt, Homo sapiens
guugcagccagggcugu

SEQ ID NO: 962694 - RNA, 20 nt, Homo sapiens
guugcguggacucugcacau

SEQ ID NO: 962695 - RNA, 17 nt, Homo sapiens
guuguuaauguacaaaa

SEQ ID NO: 962696 - RNA, 20 nt, Homo sapiens
guuuaaaaagaaaaaaugca

SEQ ID NO: 962697 - RNA, 20 nt, Homo sapiens
guuuaaauucuaguguccau

SEQ ID NO: 962698 - RNA, 15 nt, Homo sapiens
guuuagcagauuuaa

SEQ ID NO: 962699 - RNA, 14 nt, Homo sapiens
guuuaugagccaga

SEQ ID NO: 962700 - RNA, 15 nt, Homo sapiens
guuuauguagucagu

SEQ ID NO: 962701 - RNA, 23 nt, Homo sapiens
guuuccuaggaggaaaauuccau

SEQ ID NO: 962702 - RNA, 16 nt, Homo sapiens
guuucuuagcuuuuua

SEQ ID NO: 962703 - RNA, 12 nt, Homo sapiens
guuucuuucuag

SEQ ID NO: 962704 - RNA, 18 nt, Homo sapiens
guuugaagauuauaugaa

SEQ ID NO: 962705 - RNA, 20 nt, Homo sapiens
guuuggcaaugcuaauucaa

SEQ ID NO: 962706 - RNA, 16 nt, Homo sapiens
guuuggugaacuauau

SEQ ID NO: 962707 - RNA, 20 nt, Homo sapiens
guuuguaauaauaaaaccaa

SEQ ID NO: 962708 - RNA, 21 nt, Homo sapiens
guuuguaauaauaaaaccaaa

SEQ ID NO: 962709 - RNA, 17 nt, Homo sapiens
guuugugagaaacaucu

SEQ ID NO: 962710 - RNA, 18 nt, Homo sapiens
guuuuauuucaaagggaa

SEQ ID NO: 962711 - RNA, 23 nt, Homo sapiens
guuuuccaguucaucgauuuucu

SEQ ID NO: 962712 - RNA, 18 nt, Homo sapiens
guuuuccccaaaccauaa

SEQ ID NO: 962713 - RNA, 18 nt, Homo sapiens
guuuuuuuuaaucaucaa

SEQ ID NO: 962714 - RNA, 19 nt, Homo sapiens
uaaaaaaccaacaauguga

SEQ ID NO: 962715 - RNA, 21 nt, Homo sapiens
uaaaaaccugcuuggugugua

SEQ ID NO: 962716 - RNA, 23 nt, Homo sapiens
uaaaaacuuccuucaaucuucau

SEQ ID NO: 962717 - RNA, 16 nt, Homo sapiens
uaaaaaggaacaaaua

SEQ ID NO: 962718 - RNA, 18 nt, Homo sapiens
uaaaaaguucucauugaa

SEQ ID NO: 962719 - RNA, 21 nt, Homo sapiens
uaaaaaucuagcacacucuuc

SEQ ID NO: 962720 - RNA, 15 nt, Homo sapiens
uaaaaauuaugucca

SEQ ID NO: 962721 - RNA, 19 nt, Homo sapiens
uaaaacauugaaugaaacu

SEQ ID NO: 962722 - RNA, 12 nt, Homo sapiens
uaaaaccaaaga

SEQ ID NO: 962723 - RNA, 20 nt, Homo sapiens
uaaaacucacugugaucaau

SEQ ID NO: 962724 - RNA, 16 nt, Homo sapiens
uaaaagaucuugaaua

SEQ ID NO: 962725 - RNA, 22 nt, Homo sapiens
uaaaagguuaaauauugucaua

SEQ ID NO: 962726 - RNA, 13 nt, Homo sapiens
uaaaauaaacuag

SEQ ID NO: 962727 - RNA, 19 nt, Homo sapiens
uaaaauaaacuagauauua

SEQ ID NO: 962728 - RNA, 22 nt, Homo sapiens
uaaaauaacaguaugugggaua

SEQ ID NO: 962729 - RNA, 16 nt, Homo sapiens
uaaaauacuauugccu

SEQ ID NO: 962730 - RNA, 14 nt, Homo sapiens
uaaaaugauuuaca

SEQ ID NO: 962731 - RNA, 16 nt, Homo sapiens
uaaaauggcauuuagc

SEQ ID NO: 962732 - RNA, 15 nt, Homo sapiens
uaaaauuugucuuaa

SEQ ID NO: 962733 - RNA, 20 nt, Homo sapiens
uaaacaagggucaauucaaa

SEQ ID NO: 962734 - RNA, 11 nt, Homo sapiens
uaaaccaaaaa

SEQ ID NO: 962735 - RNA, 14 nt, Homo sapiens
uaaaccaaggacug

SEQ ID NO: 962736 - RNA, 13 nt, Homo sapiens
uaaacgggaacau

SEQ ID NO: 962737 - RNA, 21 nt, Homo sapiens
uaaacucaaccuaacacauua

SEQ ID NO: 962738 - RNA, 13 nt, Homo sapiens
uaaagcagaggau

SEQ ID NO: 962739 - RNA, 17 nt, Homo sapiens
uaaaggaaccauuccuu

SEQ ID NO: 962740 - RNA, 18 nt, Homo sapiens
uaaaguauaauguuuauu

SEQ ID NO: 962741 - RNA, 16 nt, Homo sapiens
uaaaguaugcauuauu

SEQ ID NO: 962742 - RNA, 16 nt, Homo sapiens
uaaauaccauucacua

SEQ ID NO: 962743 - RNA, 13 nt, Homo sapiens
uaaauaugcagug

SEQ ID NO: 962744 - RNA, 16 nt, Homo sapiens
uaaauaugcagugaua

SEQ ID NO: 962745 - RNA, 17 nt, Homo sapiens
uaaaucccacaucccag

SEQ ID NO: 962746 - RNA, 21 nt, Homo sapiens
uaaauccucagguaguacugg

SEQ ID NO: 962747 - RNA, 16 nt, Homo sapiens
uaaauccuugaugauu

SEQ ID NO: 962748 - RNA, 16 nt, Homo sapiens
uaaaugugauucaccu

SEQ ID NO: 962749 - RNA, 14 nt, Homo sapiens
uaaauuauugcugu

SEQ ID NO: 962750 - RNA, 16 nt, Homo sapiens
uaaauugcaucacugu

SEQ ID NO: 962751 - RNA, 20 nt, Homo sapiens
uaaauuuguaaguuucaggu

SEQ ID NO: 962752 - RNA, 20 nt, Homo sapiens
uaaauuuguguucucaaaua

SEQ ID NO: 962753 - RNA, 21 nt, Homo sapiens
uaaauuuuaaguacuuugcug

SEQ ID NO: 962754 - RNA, 17 nt, Homo sapiens
uaaauuuuagaucuuuc

SEQ ID NO: 962755 - RNA, 22 nt, Homo sapiens
cuguaguugcguggacucugca

SEQ ID NO: 962756 - RNA, 19 nt, Homo sapiens
cuguauuuuuaaauugcca

SEQ ID NO: 962757 - RNA, 23 nt, Homo sapiens
cugucaccacccugcucauccac

SEQ ID NO: 962758 - RNA, 21 nt, Homo sapiens
cugucacuagucucaccagcc

SEQ ID NO: 962759 - RNA, 23 nt, Homo sapiens
cugucacugaugguggcucuggu

SEQ ID NO: 962760 - RNA, 12 nt, Homo sapiens
cugucaguucuc

SEQ ID NO: 962761 - RNA, 16 nt, Homo sapiens
cuguccagguagaaaa

SEQ ID NO: 962762 - RNA, 14 nt, Homo sapiens
cuguccagugccua

SEQ ID NO: 962763 - RNA, 15 nt, Homo sapiens
cuguccccacacuga

SEQ ID NO: 962764 - RNA, 16 nt, Homo sapiens
cugucccuguagcuca

SEQ ID NO: 962765 - RNA, 18 nt, Homo sapiens
cuguccuguuucugucaa

SEQ ID NO: 962766 - RNA, 17 nt, Homo sapiens
cuguccuuuaugauccc

SEQ ID NO: 962767 - RNA, 20 nt, Homo sapiens
cugugaaauucacaguaaua

SEQ ID NO: 962768 - RNA, 16 nt, Homo sapiens
cugugaacccacugaa

SEQ ID NO: 962769 - RNA, 15 nt, Homo sapiens
cugugaagaucucac

SEQ ID NO: 962770 - RNA, 16 nt, Homo sapiens
cugugauuuaugccaa

SEQ ID NO: 962771 - RNA, 15 nt, Homo sapiens
cugugcagucacugg

SEQ ID NO: 962772 - RNA, 17 nt, Homo sapiens
cugugccacaaugcagu

SEQ ID NO: 962773 - RNA, 13 nt, Homo sapiens
cugugccugcuca

SEQ ID NO: 962774 - RNA, 10 nt, Homo sapiens
cuguggcauu

SEQ ID NO: 962775 - RNA, 14 nt, Homo sapiens
cugugucucaugga

SEQ ID NO: 962776 - RNA, 17 nt, Homo sapiens
cugugugugauuugcua

SEQ ID NO: 962777 - RNA, 14 nt, Homo sapiens
cuguguugccacag

SEQ ID NO: 962778 - RNA, 20 nt, Homo sapiens
cuguuaccauucacaauaaa

SEQ ID NO: 962779 - RNA, 22 nt, Homo sapiens
cuguuccccaaggacucuucca

SEQ ID NO: 962780 - RNA, 13 nt, Homo sapiens
cuguucugcugaa

SEQ ID NO: 962781 - RNA, 21 nt, Homo sapiens
cuguuugcugugcguggaaug

SEQ ID NO: 962782 - RNA, 18 nt, Homo sapiens
cuguuuucugaaacacac

SEQ ID NO: 962783 - RNA, 20 nt, Homo sapiens
cuuaacuauaaggugccuca

SEQ ID NO: 962784 - RNA, 16 nt, Homo sapiens
cuuaagagacacucca

SEQ ID NO: 962785 - RNA, 20 nt, Homo sapiens
cuuaagugcccacauuugau

SEQ ID NO: 962786 - RNA, 17 nt, Homo sapiens
cuuaauaccaaacaugc

SEQ ID NO: 962787 - RNA, 23 nt, Homo sapiens
cuuaauucccgccuuaugccuca

SEQ ID NO: 962788 - RNA, 23 nt, Homo sapiens
cuuaauuuccuuuuugacacuga

SEQ ID NO: 962789 - RNA, 22 nt, Homo sapiens
cuuacauuuuccugagaccuca

SEQ ID NO: 962790 - RNA, 14 nt, Homo sapiens
cuuaccgcucuguu

SEQ ID NO: 962791 - RNA, 21 nt, Homo sapiens
cuuacuaaaaaguauaaaaua

SEQ ID NO: 962792 - RNA, 15 nt, Homo sapiens
cuuagagaggacaau

SEQ ID NO: 962793 - RNA, 11 nt, Homo sapiens
cuuaggugcca

SEQ ID NO: 962794 - RNA, 19 nt, Homo sapiens
cuuaguaguggguuucuau

SEQ ID NO: 962795 - RNA, 18 nt, Homo sapiens
cuuaguaugugcauuuaa

SEQ ID NO: 962796 - RNA, 15 nt, Homo sapiens
cuuauaccacugugu

SEQ ID NO: 962797 - RNA, 14 nt, Homo sapiens
cuuaucaacaacuu

SEQ ID NO: 962798 - RNA, 21 nt, Homo sapiens
cuuauccuccaccgucuuucu

SEQ ID NO: 962799 - RNA, 13 nt, Homo sapiens
cuuauuucuauga

SEQ ID NO: 962800 - RNA, 16 nt, Homo sapiens
cuucaagagcugagaa

SEQ ID NO: 962801 - RNA, 16 nt, Homo sapiens
cuucaaucuuaaaaca

SEQ ID NO: 962802 - RNA, 23 nt, Homo sapiens
cuucacauaggaagggaucugag

SEQ ID NO: 962803 - RNA, 12 nt, Homo sapiens
cuucacauucau

SEQ ID NO: 962804 - RNA, 23 nt, Homo sapiens
cuucagaagucacacauuacaaa

SEQ ID NO: 962805 - RNA, 19 nt, Homo sapiens
gaaaaguguccuucuugcu

SEQ ID NO: 962806 - RNA, 15 nt, Homo sapiens
gaaaaguguggcuug

SEQ ID NO: 962807 - RNA, 23 nt, Homo sapiens
gaaaaguguguauauauuuugug

SEQ ID NO: 962808 - RNA, 18 nt, Homo sapiens
gaaaauauagacauucuc

SEQ ID NO: 962809 - RNA, 12 nt, Homo sapiens
gaaaauauuuca

SEQ ID NO: 962810 - RNA, 17 nt, Homo sapiens
gaaaaugaaaugcauau

SEQ ID NO: 962811 - RNA, 15 nt, Homo sapiens
gaaaauggugccugg

SEQ ID NO: 962812 - RNA, 16 nt, Homo sapiens
gaaacaugaugugaga

SEQ ID NO: 962813 - RNA, 17 nt, Homo sapiens
gaaaccaggaacucugg

SEQ ID NO: 962814 - RNA, 14 nt, Homo sapiens
gaaaccccgucucu

SEQ ID NO: 962815 - RNA, 18 nt, Homo sapiens
gaaacuaagccaggccug

SEQ ID NO: 962816 - RNA, 14 nt, Homo sapiens
gaaacucacacucc

SEQ ID NO: 962817 - RNA, 16 nt, Homo sapiens
gaaacucacacucccc

SEQ ID NO: 962818 - RNA, 21 nt, Homo sapiens
gaaacucuuaucucagucaug

SEQ ID NO: 962819 - RNA, 15 nt, Homo sapiens
gaaagagaguaccau

SEQ ID NO: 962820 - RNA, 17 nt, Homo sapiens
gaaagcuggugucugau

SEQ ID NO: 962821 - RNA, 23 nt, Homo sapiens
gaaaggggccccaccggggucua

SEQ ID NO: 962822 - RNA, 15 nt, Homo sapiens
gaaauaucugugaag

SEQ ID NO: 962823 - RNA, 18 nt, Homo sapiens
gaaaucucuaccugggug

SEQ ID NO: 962824 - RNA, 16 nt, Homo sapiens
gaaaucuuucucccuc

SEQ ID NO: 962825 - RNA, 22 nt, Homo sapiens
gaaaucuuucucccucaacuga

SEQ ID NO: 962826 - RNA, 12 nt, Homo sapiens
gaaaugcaaaac

SEQ ID NO: 962827 - RNA, 21 nt, Homo sapiens
gaaauguuccuuuuaauggau

SEQ ID NO: 962828 - RNA, 11 nt, Homo sapiens
gaaauuaacac

SEQ ID NO: 962829 - RNA, 20 nt, Homo sapiens
gaaauuccauacuucucuca

SEQ ID NO: 962830 - RNA, 13 nt, Homo sapiens
gaacaaacagggc

SEQ ID NO: 962831 - RNA, 14 nt, Homo sapiens
gaacaacauaucuc

SEQ ID NO: 962832 - RNA, 14 nt, Homo sapiens
gaacaaugcuauaa

SEQ ID NO: 962833 - RNA, 18 nt, Homo sapiens
gaacacagugucuguuca

SEQ ID NO: 962834 - RNA, 19 nt, Homo sapiens
gaacacuaacucaccagcc

SEQ ID NO: 962835 - RNA, 23 nt, Homo sapiens
gaacacucuuagcuauguugaca

SEQ ID NO: 962836 - RNA, 12 nt, Homo sapiens
gaacacuugaag

SEQ ID NO: 962837 - RNA, 15 nt, Homo sapiens
gaacagcuucagguu

SEQ ID NO: 962838 - RNA, 18 nt, Homo sapiens
gaacagguaguauuacac

SEQ ID NO: 962839 - RNA, 14 nt, Homo sapiens
gaacaucacauucc

SEQ ID NO: 962840 - RNA, 20 nt, Homo sapiens
gaacaugcccccugcagaca

SEQ ID NO: 962841 - RNA, 12 nt, Homo sapiens
gaaccaauaaug

SEQ ID NO: 962842 - RNA, 14 nt, Homo sapiens
gaaccaauaaugua

SEQ ID NO: 962843 - RNA, 20 nt, Homo sapiens
gaaccacggaggaugaugcc

SEQ ID NO: 962844 - RNA, 15 nt, Homo sapiens
gaacccuuguccucc

SEQ ID NO: 962845 - RNA, 23 nt, Homo sapiens
gaaccgugguaugucugccaugu

SEQ ID NO: 962846 - RNA, 14 nt, Homo sapiens
gaaccuuaaugugg

SEQ ID NO: 962847 - RNA, 16 nt, Homo sapiens
gaacgucagccagcuc

SEQ ID NO: 962848 - RNA, 14 nt, Homo sapiens
gaacuaccaggugg

SEQ ID NO: 962849 - RNA, 15 nt, Homo sapiens
gaacucuuucauccc

SEQ ID NO: 962850 - RNA, 16 nt, Homo sapiens
gaacugaagaccucca

SEQ ID NO: 962851 - RNA, 16 nt, Homo sapiens
gaacugaaucacuuaa

SEQ ID NO: 962852 - RNA, 17 nt, Homo sapiens
gaacugaaucacuuaaa

SEQ ID NO: 962853 - RNA, 23 nt, Homo sapiens
gaacuuuaagaagcaguguuuua

SEQ ID NO: 962854 - RNA, 22 nt, Homo sapiens
gaacuuuuuuagaaaugcaaaa

SEQ ID NO: 962855 - RNA, 16 nt, Homo sapiens
gaagaauggcuuucaa

SEQ ID NO: 962856 - RNA, 23 nt, Homo sapiens
gaagaccuccacauuaaguggcu

SEQ ID NO: 962857 - RNA, 15 nt, Homo sapiens
gaagacuauggugcu

SEQ ID NO: 962858 - RNA, 18 nt, Homo sapiens
gaagacucgcccucgcca

SEQ ID NO: 962859 - RNA, 23 nt, Homo sapiens
gaagagcccgcagggccaugcag

SEQ ID NO: 962860 - RNA, 13 nt, Homo sapiens
gaagagggucccu

SEQ ID NO: 962861 - RNA, 17 nt, Homo sapiens
gaagauuauaugaaguu

SEQ ID NO: 962862 - RNA, 16 nt, Homo sapiens
gaagcacgauccgcca

SEQ ID NO: 962863 - RNA, 18 nt, Homo sapiens
gaagccauauaugaccag

SEQ ID NO: 962864 - RNA, 19 nt, Homo sapiens
gaagccauauucacaccuc

SEQ ID NO: 962865 - RNA, 23 nt, Homo sapiens
gaagccccauguguaccuacaga

SEQ ID NO: 962866 - RNA, 21 nt, Homo sapiens
gaagcugcaggcuuugccauu

SEQ ID NO: 962867 - RNA, 16 nt, Homo sapiens
gaaggcuucucuccac

SEQ ID NO: 962868 - RNA, 17 nt, Homo sapiens
gaagggcguucuaggua

SEQ ID NO: 962869 - RNA, 20 nt, Homo sapiens
gaccuggcccccucaguguu

SEQ ID NO: 962870 - RNA, 12 nt, Homo sapiens
gaccuguguucc

SEQ ID NO: 962871 - RNA, 14 nt, Homo sapiens
gacgccaugugaug

SEQ ID NO: 962872 - RNA, 22 nt, Homo sapiens
gacggcgugccuggacacugua

SEQ ID NO: 962873 - RNA, 22 nt, Homo sapiens
gacgggguuucaccauguuggc

SEQ ID NO: 962874 - RNA, 20 nt, Homo sapiens
gacgguaaguguucucauga

SEQ ID NO: 962875 - RNA, 16 nt, Homo sapiens
gacguccuccguccau

SEQ ID NO: 962876 - RNA, 17 nt, Homo sapiens
gacuagaggcuugcaua

SEQ ID NO: 962877 - RNA, 12 nt, Homo sapiens
gacucacacaaa

SEQ ID NO: 962878 - RNA, 22 nt, Homo sapiens
gacuccggggccccacuggcug

SEQ ID NO: 962879 - RNA, 16 nt, Homo sapiens
gacucugucuaccugg

SEQ ID NO: 962880 - RNA, 11 nt, Homo sapiens
gacucuuccac

SEQ ID NO: 962881 - RNA, 22 nt, Homo sapiens
gacugccuucuccaucaugccc

SEQ ID NO: 962882 - RNA, 16 nt, Homo sapiens
gacuggggauggcgca

SEQ ID NO: 962883 - RNA, 16 nt, Homo sapiens
gacugguuuucugcca

SEQ ID NO: 962884 - RNA, 14 nt, Homo sapiens
gacugucuuucaga

SEQ ID NO: 962885 - RNA, 16 nt, Homo sapiens
gacuuagagcugggaa

SEQ ID NO: 962886 - RNA, 24 nt, Homo sapiens
gacuugaucacuuuugcacauucc

SEQ ID NO: 962887 - RNA, 20 nt, Homo sapiens
gacuuggcuggggaggacca

SEQ ID NO: 962888 - RNA, 15 nt, Homo sapiens
gacuuugagcugagu

SEQ ID NO: 962889 - RNA, 20 nt, Homo sapiens
gacuuugagcugagugcuga

SEQ ID NO: 962890 - RNA, 21 nt, Homo sapiens
gacuuugagcugagugcugaa

SEQ ID NO: 962891 - RNA, 21 nt, Homo sapiens
gagaaaaaugcuccccacagc

SEQ ID NO: 962892 - RNA, 14 nt, Homo sapiens
gagaaaagccucuc

SEQ ID NO: 962893 - RNA, 21 nt, Homo sapiens
gagaaaauuggaacucuacuc

SEQ ID NO: 962894 - RNA, 21 nt, Homo sapiens
gagaaacuuugaucucugcuu

SEQ ID NO: 962895 - RNA, 19 nt, Homo sapiens
gagaagaaguggcugccac

SEQ ID NO: 962896 - RNA, 18 nt, Homo sapiens
gagaagauuuuauucuua

SEQ ID NO: 962897 - RNA, 20 nt, Homo sapiens
gagaagcugcaggcuuugcc

SEQ ID NO: 962898 - RNA, 16 nt, Homo sapiens
gagaauccauccaaag

SEQ ID NO: 962899 - RNA, 19 nt, Homo sapiens
gagacaauguuuucuucaa

SEQ ID NO: 962900 - RNA, 11 nt, Homo sapiens
gagacacucca

SEQ ID NO: 962901 - RNA, 18 nt, Homo sapiens
gagacagcgcuaaggaug

SEQ ID NO: 962902 - RNA, 20 nt, Homo sapiens
gagaccauguugacuuuccu

SEQ ID NO: 962903 - RNA, 17 nt, Homo sapiens
gagagcaugcuauccca

SEQ ID NO: 962904 - RNA, 17 nt, Homo sapiens
gagagcccagucucccu

SEQ ID NO: 962905 - RNA, 13 nt, Homo sapiens
gagagcucaccau

SEQ ID NO: 962906 - RNA, 13 nt, Homo sapiens
gagaggcaggcau

SEQ ID NO: 962907 - RNA, 22 nt, Homo sapiens
gagaggcccugggguucucccc

SEQ ID NO: 962908 - RNA, 20 nt, Homo sapiens
gagaucacgucacugcacuc

SEQ ID NO: 962909 - RNA, 21 nt, Homo sapiens
gagaugcuucucuccuugccc

SEQ ID NO: 962910 - RNA, 12 nt, Homo sapiens
gagauggucaca

SEQ ID NO: 962911 - RNA, 23 nt, Homo sapiens
gagcaaaagccucagaaagggau

SEQ ID NO: 962912 - RNA, 21 nt, Homo sapiens
gagcaaauaaagaccugagaa

SEQ ID NO: 962913 - RNA, 15 nt, Homo sapiens
gagcaaguccucacu

SEQ ID NO: 962914 - RNA, 18 nt, Homo sapiens
gagcaaguccucacucuu

SEQ ID NO: 962915 - RNA, 17 nt, Homo sapiens
gagcagggagagcucac

SEQ ID NO: 962916 - RNA, 17 nt, Homo sapiens
gagcaguggccaggcca

SEQ ID NO: 962917 - RNA, 16 nt, Homo sapiens
gagccaagauugcacc

SEQ ID NO: 962918 - RNA, 21 nt, Homo sapiens
gagccaagauugcaccacugc

SEQ ID NO: 962919 - RNA, 19 nt, Homo sapiens
gagccagaaagggugccag

SEQ ID NO: 962920 - RNA, 16 nt, Homo sapiens
gagccaggaccacaga

SEQ ID NO: 962921 - RNA, 15 nt, Homo sapiens
gagccugcauuuccu

SEQ ID NO: 962922 - RNA, 13 nt, Homo sapiens
gagcgcacaggga

SEQ ID NO: 962923 - RNA, 19 nt, Homo sapiens
gagcuauuuuccucuggcc

SEQ ID NO: 962924 - RNA, 20 nt, Homo sapiens
gagcucuggguugugcacau

SEQ ID NO: 962925 - RNA, 13 nt, Homo sapiens
gagcugcucugcu

SEQ ID NO: 962926 - RNA, 20 nt, Homo sapiens
gagcuggccucucuagcaca

SEQ ID NO: 962927 - RNA, 16 nt, Homo sapiens
gagcuguuaccauuca

SEQ ID NO: 962928 - RNA, 17 nt, Homo sapiens
gagcuuucucaaugucu

SEQ ID NO: 962929 - RNA, 15 nt, Homo sapiens
gagcuuuucuggaau

SEQ ID NO: 962930 - RNA, 21 nt, Homo sapiens
gaggaauaacaucaccacugu

SEQ ID NO: 962931 - RNA, 16 nt, Homo sapiens
auguggauaacuuuac

SEQ ID NO: 962932 - RNA, 17 nt, Homo sapiens
auguggccuuuaucuca

SEQ ID NO: 962933 - RNA, 18 nt, Homo sapiens
auguuaaggaaacucuua

SEQ ID NO: 962934 - RNA, 11 nt, Homo sapiens
auguuaugcug

SEQ ID NO: 962935 - RNA, 15 nt, Homo sapiens
auguucuagucugcu

SEQ ID NO: 962936 - RNA, 16 nt, Homo sapiens
auguuuagcagauuua

SEQ ID NO: 962937 - RNA, 17 nt, Homo sapiens
auguuuccugcucuucc

SEQ ID NO: 962938 - RNA, 19 nt, Homo sapiens
auguuuccugcucuucccu

SEQ ID NO: 962939 - RNA, 21 nt, Homo sapiens
auguuuggaaaaaacucugaa

SEQ ID NO: 962940 - RNA, 14 nt, Homo sapiens
auguuuucuaguca

SEQ ID NO: 962941 - RNA, 21 nt, Homo sapiens
auguuuucuagucacuuccuc

SEQ ID NO: 962942 - RNA, 14 nt, Homo sapiens
auuaaaaaacuuca

SEQ ID NO: 962943 - RNA, 19 nt, Homo sapiens
auuaaagaauguuuuggaa

SEQ ID NO: 962944 - RNA, 19 nt, Homo sapiens
auuaaagcauuuccuacca

SEQ ID NO: 962945 - RNA, 15 nt, Homo sapiens
auuaacaaagugcca

SEQ ID NO: 962946 - RNA, 17 nt, Homo sapiens
auuaacauaauauaugu

SEQ ID NO: 962947 - RNA, 17 nt, Homo sapiens
auuaagcaaauguuaaa

SEQ ID NO: 962948 - RNA, 12 nt, Homo sapiens
auuaagcaugaa

SEQ ID NO: 962949 - RNA, 14 nt, Homo sapiens
auuaauagccaaag

SEQ ID NO: 962950 - RNA, 13 nt, Homo sapiens
auuaauauuugca

SEQ ID NO: 962951 - RNA, 23 nt, Homo sapiens
auuaauuuggagcacaaaauuca

SEQ ID NO: 962952 - RNA, 12 nt, Homo sapiens
auuacauagcuc

SEQ ID NO: 962953 - RNA, 18 nt, Homo sapiens
auuacauugcugccuuug

SEQ ID NO: 962954 - RNA, 14 nt, Homo sapiens
auuaccuccaucca

SEQ ID NO: 962955 - RNA, 13 nt, Homo sapiens
auuagaaugcaug

SEQ ID NO: 962956 - RNA, 14 nt, Homo sapiens
auuagaaugcaugu

SEQ ID NO: 962957 - RNA, 15 nt, Homo sapiens
auuagaaugcaugua

SEQ ID NO: 962958 - RNA, 17 nt, Homo sapiens
auuagaaugcauguaag

SEQ ID NO: 962959 - RNA, 24 nt, Homo sapiens
auuauaguaacuauaagauacaau

SEQ ID NO: 962960 - RNA, 12 nt, Homo sapiens
auuauauagaaa

SEQ ID NO: 962961 - RNA, 18 nt, Homo sapiens
auuauauuuuaaauaccc

SEQ ID NO: 962962 - RNA, 20 nt, Homo sapiens
auuaugucucuucugagcua

SEQ ID NO: 962963 - RNA, 14 nt, Homo sapiens
auuauugacacuga

SEQ ID NO: 962964 - RNA, 15 nt, Homo sapiens
auuauuuaauaacau

SEQ ID NO: 962965 - RNA, 15 nt, Homo sapiens
auuauuuuucaggaa

SEQ ID NO: 962966 - RNA, 23 nt, Homo sapiens
auucaaaaguauugaaagccaac

SEQ ID NO: 962967 - RNA, 18 nt, Homo sapiens
auucaaauggcuuaagca

SEQ ID NO: 962968 - RNA, 15 nt, Homo sapiens
auucaauccuacuuu

SEQ ID NO: 962969 - RNA, 20 nt, Homo sapiens
auucacaauaaaagcuuaaa

SEQ ID NO: 962970 - RNA, 13 nt, Homo sapiens
auucacaccucac

SEQ ID NO: 962971 - RNA, 14 nt, Homo sapiens
auucacuuacugac

SEQ ID NO: 962972 - RNA, 22 nt, Homo sapiens
auucagccaugaaacugacuca

SEQ ID NO: 962973 - RNA, 16 nt, Homo sapiens
auucagguaacacuag

SEQ ID NO: 962974 - RNA, 23 nt, Homo sapiens
auucagugagggucuucuuacau

SEQ ID NO: 962975 - RNA, 16 nt, Homo sapiens
auucauccugaccaag

SEQ ID NO: 962976 - RNA, 17 nt, Homo sapiens
auucauccugaccaaga

SEQ ID NO: 962977 - RNA, 14 nt, Homo sapiens
auucauccuuccau

SEQ ID NO: 962978 - RNA, 22 nt, Homo sapiens
auucauccuuccauccaucuuu

SEQ ID NO: 962979 - RNA, 16 nt, Homo sapiens
auucauggcuaccuca

SEQ ID NO: 962980 - RNA, 17 nt, Homo sapiens
auucauggcuaccucag

SEQ ID NO: 962981 - RNA, 13 nt, Homo sapiens
auuccaagucaac

SEQ ID NO: 962982 - RNA, 23 nt, Homo sapiens
auuccagcugucacucugugccu

SEQ ID NO: 962983 - RNA, 17 nt, Homo sapiens
auuccauacuucucuca

SEQ ID NO: 962984 - RNA, 15 nt, Homo sapiens
auuccaugagcugcu

SEQ ID NO: 962985 - RNA, 14 nt, Homo sapiens
auucccaagcuuuu

SEQ ID NO: 962986 - RNA, 12 nt, Homo sapiens
auucccaugugg

SEQ ID NO: 962987 - RNA, 14 nt, Homo sapiens
auucccauguggaa

SEQ ID NO: 962988 - RNA, 13 nt, Homo sapiens
auuccuaucucau

SEQ ID NO: 962989 - RNA, 15 nt, Homo sapiens
auuccuggcaugaca

SEQ ID NO: 962990 - RNA, 23 nt, Homo sapiens
auucuaacccaagacaugacauu

SEQ ID NO: 962991 - RNA, 19 nt, Homo sapiens
auucuacuaugcauuaaau

SEQ ID NO: 962992 - RNA, 20 nt, Homo sapiens
auucucccaaaguaccuuga

SEQ ID NO: 962993 - RNA, 18 nt, Homo sapiens
auucuggaccucuggguu

SEQ ID NO: 962994 - RNA, 17 nt, Homo sapiens
auucuuccuaaugucag

SEQ ID NO: 962995 - RNA, 20 nt, Homo sapiens
auugaaagagucugggaccc

SEQ ID NO: 962996 - RNA, 16 nt, Homo sapiens
auugaaguauuuugcu

SEQ ID NO: 962997 - RNA, 21 nt, Homo sapiens
auugagaucacuacucagugc

SEQ ID NO: 962998 - RNA, 18 nt, Homo sapiens
auugaggaaaaauauucc

SEQ ID NO: 962999 - RNA, 23 nt, Homo sapiens
auugccauagcugacuacaaauu

SEQ ID NO: 963000 - RNA, 13 nt, Homo sapiens
auugccucugaaa

SEQ ID NO: 963001 - RNA, 20 nt, Homo sapiens
auugcucugccccaccuugc

SEQ ID NO: 963002 - RNA, 21 nt, Homo sapiens
auugcuguccuggaggggcug

SEQ ID NO: 963003 - RNA, 13 nt, Homo sapiens
auuggcugagaua

SEQ ID NO: 963004 - RNA, 17 nt, Homo sapiens
auugggaaaacauuugc

SEQ ID NO: 963005 - RNA, 20 nt, Homo sapiens
auuguaacuaauacuacugu

SEQ ID NO: 963006 - RNA, 12 nt, Homo sapiens
auugucacccca

SEQ ID NO: 963007 - RNA, 16 nt, Homo sapiens
auugugaaguacauau

SEQ ID NO: 963008 - RNA, 18 nt, Homo sapiens
auuguggguaacgugaga

SEQ ID NO: 963009 - RNA, 19 nt, Homo sapiens
auuguuucauucauccuga

SEQ ID NO: 963010 - RNA, 21 nt, Homo sapiens
auuguuuuguggauaauugaa

SEQ ID NO: 963011 - RNA, 13 nt, Homo sapiens
auuuaagauaugu

SEQ ID NO: 963012 - RNA, 18 nt, Homo sapiens
auuuaaucuuaaucuguu

SEQ ID NO: 963013 - RNA, 12 nt, Homo sapiens
auuuaccaaagc

SEQ ID NO: 963014 - RNA, 20 nt, Homo sapiens
auuuauacaccagcaauuua

SEQ ID NO: 963015 - RNA, 22 nt, Homo sapiens
auuuaucguauagguugaugaa

SEQ ID NO: 963016 - RNA, 18 nt, Homo sapiens
auuuauuuuccuaaagag

SEQ ID NO: 963017 - RNA, 22 nt, Homo sapiens
auuuauuuuuuguuuguuuauu

SEQ ID NO: 963018 - RNA, 18 nt, Homo sapiens
auuucaaaccauugcucu

SEQ ID NO: 963019 - RNA, 13 nt, Homo sapiens
auuucaaagggaa

SEQ ID NO: 963020 - RNA, 14 nt, Homo sapiens
auuucaccacugaa

SEQ ID NO: 963021 - RNA, 16 nt, Homo sapiens
auuucaccagucacug

SEQ ID NO: 963022 - RNA, 22 nt, Homo sapiens
auuucagggucuuggcugccug

SEQ ID NO: 963023 - RNA, 13 nt, Homo sapiens
auuucauuaucau

SEQ ID NO: 963024 - RNA, 22 nt, Homo sapiens
auuucauuaucauaugaacuug

SEQ ID NO: 963025 - RNA, 23 nt, Homo sapiens
auuuccaccaggccgugccuugu

SEQ ID NO: 963026 - RNA, 20 nt, Homo sapiens
auuuccauugcuuauuaugu

SEQ ID NO: 963027 - RNA, 15 nt, Homo sapiens
auuuccuaaggcaug

SEQ ID NO: 963028 - RNA, 18 nt, Homo sapiens
auuuccuuuuugacacug

SEQ ID NO: 963029 - RNA, 23 nt, Homo sapiens
agcagccugccaagaauuuuauu

SEQ ID NO: 963030 - RNA, 13 nt, Homo sapiens
agcagcucuguga

SEQ ID NO: 963031 - RNA, 13 nt, Homo sapiens
agcaggagccagc

SEQ ID NO: 963032 - RNA, 14 nt, Homo sapiens
agcaggagccagcc

SEQ ID NO: 963033 - RNA, 20 nt, Homo sapiens
agcagucagaguccagugcu

SEQ ID NO: 963034 - RNA, 13 nt, Homo sapiens
agcauccagcugc

SEQ ID NO: 963035 - RNA, 23 nt, Homo sapiens
agcaucuaucucaucuaucucaa

SEQ ID NO: 963036 - RNA, 22 nt, Homo sapiens
agcaucuucacuucuaaaugca

SEQ ID NO: 963037 - RNA, 21 nt, Homo sapiens
agcaugauacaaauuccacag

SEQ ID NO: 963038 - RNA, 15 nt, Homo sapiens
agcaugcagcuuugc

SEQ ID NO: 963039 - RNA, 15 nt, Homo sapiens
agcauggacauuuag

SEQ ID NO: 963040 - RNA, 19 nt, Homo sapiens
agcauguaacuggccuuac

SEQ ID NO: 963041 - RNA, 22 nt, Homo sapiens
agcauguguauuuccagugcaa

SEQ ID NO: 963042 - RNA, 14 nt, Homo sapiens
agcauugagcauaa

SEQ ID NO: 963043 - RNA, 15 nt, Homo sapiens
agccaagauugcacc

SEQ ID NO: 963044 - RNA, 19 nt, Homo sapiens
agccaauauuuacucauca

SEQ ID NO: 963045 - RNA, 18 nt, Homo sapiens
agccacaaacuccaucca

SEQ ID NO: 963046 - RNA, 18 nt, Homo sapiens
agccacgcagugccugga

SEQ ID NO: 963047 - RNA, 16 nt, Homo sapiens
agccagagacagagga

SEQ ID NO: 963048 - RNA, 16 nt, Homo sapiens
agccagccaagcuuua

SEQ ID NO: 963049 - RNA, 16 nt, Homo sapiens
agccagcucccagcca

SEQ ID NO: 963050 - RNA, 20 nt, Homo sapiens
agccagcuuacuagcacuuu

SEQ ID NO: 963051 - RNA, 22 nt, Homo sapiens
agccaggccugggggcagccuc

SEQ ID NO: 963052 - RNA, 20 nt, Homo sapiens
agccauaguggaucacucac

SEQ ID NO: 963053 - RNA, 19 nt, Homo sapiens
agccauauuugauaguaua

SEQ ID NO: 963054 - RNA, 15 nt, Homo sapiens
agccauuuugugaau

SEQ ID NO: 963055 - RNA, 18 nt, Homo sapiens
agcccaagcuucccucca

SEQ ID NO: 963056 - RNA, 17 nt, Homo sapiens
agcccccaaaacagccu

SEQ ID NO: 963057 - RNA, 14 nt, Homo sapiens
agcccccacuccag

SEQ ID NO: 963058 - RNA, 14 nt, Homo sapiens
agcccccucuuccu

SEQ ID NO: 963059 - RNA, 16 nt, Homo sapiens
agccccggcaagccac

SEQ ID NO: 963060 - RNA, 19 nt, Homo sapiens
agcccugcagcccaccaga

SEQ ID NO: 963061 - RNA, 18 nt, Homo sapiens
agcccuugagaagccaac

SEQ ID NO: 963062 - RNA, 13 nt, Homo sapiens
agccuacauucac

SEQ ID NO: 963063 - RNA, 17 nt, Homo sapiens
agccuacccuauucuau

SEQ ID NO: 963064 - RNA, 19 nt, Homo sapiens
agccuagcacagcagcuua

SEQ ID NO: 963065 - RNA, 17 nt, Homo sapiens
agccuaggcccucauga

SEQ ID NO: 963066 - RNA, 14 nt, Homo sapiens
agccuauaguaaau

SEQ ID NO: 963067 - RNA, 15 nt, Homo sapiens
agccuaucaaaggaa

SEQ ID NO: 963068 - RNA, 18 nt, Homo sapiens
agccuccccgugccaaaa

SEQ ID NO: 963069 - RNA, 23 nt, Homo sapiens
agccugaaacucauagacacuga

SEQ ID NO: 963070 - RNA, 13 nt, Homo sapiens
agccugcacuggg

SEQ ID NO: 963071 - RNA, 18 nt, Homo sapiens
agccugcccucacucccu

SEQ ID NO: 963072 - RNA, 20 nt, Homo sapiens
agccugcuuugcuuuacugc

SEQ ID NO: 963073 - RNA, 22 nt, Homo sapiens
agccuggccccaggccccagac

SEQ ID NO: 963074 - RNA, 18 nt, Homo sapiens
agccuggcucuaucuucc

SEQ ID NO: 963075 - RNA, 20 nt, Homo sapiens
agccuggcucuaucuuccuc

SEQ ID NO: 963076 - RNA, 11 nt, Homo sapiens
agccugucacc

SEQ ID NO: 963077 - RNA, 15 nt, Homo sapiens
agccuguugcugaag

SEQ ID NO: 963078 - RNA, 15 nt, Homo sapiens
agccuucuccaggac

SEQ ID NO: 963079 - RNA, 21 nt, Homo sapiens
agccuuuuuuccugggccaga

SEQ ID NO: 963080 - RNA, 18 nt, Homo sapiens
agcgcaguguuuugcaag

SEQ ID NO: 963081 - RNA, 22 nt, Homo sapiens
agcuaauggcgaucaucuuugc

SEQ ID NO: 963082 - RNA, 13 nt, Homo sapiens
agcuacuaaugau

SEQ ID NO: 963083 - RNA, 13 nt, Homo sapiens
agcucaggugccu

SEQ ID NO: 963084 - RNA, 16 nt, Homo sapiens
agcucaucugcaaaag

SEQ ID NO: 963085 - RNA, 13 nt, Homo sapiens
agcuccagugcca

SEQ ID NO: 963086 - RNA, 18 nt, Homo sapiens
agcuccuguccccugcua

SEQ ID NO: 963087 - RNA, 15 nt, Homo sapiens
agcucuccaccagcu

SEQ ID NO: 963088 - RNA, 18 nt, Homo sapiens
agcucugauugcagcaca

SEQ ID NO: 963089 - RNA, 19 nt, Homo sapiens
agcucuggaggugcugcuc

SEQ ID NO: 963090 - RNA, 20 nt, Homo sapiens
agcucuucagcacaaagaca

SEQ ID NO: 963091 - RNA, 19 nt, Homo sapiens
agcucuuuauuacauagcu

SEQ ID NO: 963092 - RNA, 17 nt, Homo sapiens
agcugagugcugaaaua

SEQ ID NO: 963093 - RNA, 14 nt, Homo sapiens
agcugcagcucucc

SEQ ID NO: 963094 - RNA, 22 nt, Homo sapiens
agcugccacuuucacguggccu

SEQ ID NO: 963095 - RNA, 15 nt, Homo sapiens
agcugcucugagcca

SEQ ID NO: 963096 - RNA, 17 nt, Homo sapiens
agcugcucugagccaca

SEQ ID NO: 963097 - RNA, 18 nt, Homo sapiens
agcuggccuggacaguau

SEQ ID NO: 963098 - RNA, 14 nt, Homo sapiens
agcuggccuuugua

SEQ ID NO: 963099 - RNA, 21 nt, Homo sapiens
agcuggccuuuguaagugcag

SEQ ID NO: 963100 - RNA, 15 nt, Homo sapiens
agcugguggacccag

SEQ ID NO: 963101 - RNA, 20 nt, Homo sapiens
agcuguaacuuaacuauuaa

SEQ ID NO: 963102 - RNA, 13 nt, Homo sapiens
agcugugucugcc

SEQ ID NO: 963103 - RNA, 14 nt, Homo sapiens
agcuuagauuuccc

SEQ ID NO: 963104 - RNA, 22 nt, Homo sapiens
agcuuucccugccucucaucaa

SEQ ID NO: 963105 - RNA, 21 nt, Homo sapiens
agcuuuggaaguuuagcucug

SEQ ID NO: 963106 - RNA, 15 nt, Homo sapiens
agcuuuggaccuaau

SEQ ID NO: 963107 - RNA, 18 nt, Homo sapiens
agcuuuucauaauaucua

SEQ ID NO: 963108 - RNA, 13 nt, Homo sapiens
aggaaacaguucu

SEQ ID NO: 963109 - RNA, 15 nt, Homo sapiens
aggaaaggccugagg

SEQ ID NO: 963110 - RNA, 23 nt, Homo sapiens
aggaaauuacugcccacuuguca

SEQ ID NO: 963111 - RNA, 15 nt, Homo sapiens
aggaacaaacagggc

SEQ ID NO: 963112 - RNA, 14 nt, Homo sapiens
aggaacuaagucag

SEQ ID NO: 963113 - RNA, 14 nt, Homo sapiens
aggaacucaaauaa

SEQ ID NO: 963114 - RNA, 15 nt, Homo sapiens
aggaagaaugaaacu

SEQ ID NO: 963115 - RNA, 21 nt, Homo sapiens
ccucagccuuccaacuagcug

SEQ ID NO: 963116 - RNA, 17 nt, Homo sapiens
ccucagcucaaugcagu

SEQ ID NO: 963117 - RNA, 15 nt, Homo sapiens
ccucagguaguacug

SEQ ID NO: 963118 - RNA, 15 nt, Homo sapiens
ccucaggugcugucc

SEQ ID NO: 963119 - RNA, 13 nt, Homo sapiens
ccucagugccuuc

SEQ ID NO: 963120 - RNA, 13 nt, Homo sapiens
ccucaugagcuga

SEQ ID NO: 963121 - RNA, 18 nt, Homo sapiens
ccucaugauauguccuca

SEQ ID NO: 963122 - RNA, 15 nt, Homo sapiens
ccuccagcauuuaaa

SEQ ID NO: 963123 - RNA, 10 nt, Homo sapiens
ccuccaggga

SEQ ID NO: 963124 - RNA, 14 nt, Homo sapiens
ccuccuccagggaa

SEQ ID NO: 963125 - RNA, 17 nt, Homo sapiens
ccuccuccccuagggaa

SEQ ID NO: 963126 - RNA, 19 nt, Homo sapiens
ccuccugaguaauaagcau

SEQ ID NO: 963127 - RNA, 23 nt, Homo sapiens
ccuccugggcccacaacagcgug

SEQ ID NO: 963128 - RNA, 21 nt, Homo sapiens
ccucuagguccccauacuccu

SEQ ID NO: 963129 - RNA, 12 nt, Homo sapiens
ccucucaccaaa

SEQ ID NO: 963130 - RNA, 18 nt, Homo sapiens
ccucuccacacagugcuc

SEQ ID NO: 963131 - RNA, 11 nt, Homo sapiens
ccucucuagca

SEQ ID NO: 963132 - RNA, 23 nt, Homo sapiens
ccucuggauccagccaugccuga

SEQ ID NO: 963133 - RNA, 20 nt, Homo sapiens
ccucuuuuuccuccuggaca

SEQ ID NO: 963134 - RNA, 16 nt, Homo sapiens
ccugaaauaauuugag

SEQ ID NO: 963135 - RNA, 17 nt, Homo sapiens
ccugaagcugaccaaca

SEQ ID NO: 963136 - RNA, 20 nt, Homo sapiens
ccugaaggaaaauaaacuga

SEQ ID NO: 963137 - RNA, 22 nt, Homo sapiens
ccugaaggguugacuuuaccca

SEQ ID NO: 963138 - RNA, 18 nt, Homo sapiens
ccugacccagggacucuc

SEQ ID NO: 963139 - RNA, 20 nt, Homo sapiens
ccugacccagggacucucca

SEQ ID NO: 963140 - RNA, 12 nt, Homo sapiens
ccugaccccagu

SEQ ID NO: 963141 - RNA, 13 nt, Homo sapiens
ccugagagucagc

SEQ ID NO: 963142 - RNA, 22 nt, Homo sapiens
ccugagauccugcacaaggugg

SEQ ID NO: 963143 - RNA, 18 nt, Homo sapiens
ccugagcaaaaagaccag

SEQ ID NO: 963144 - RNA, 17 nt, Homo sapiens
ccugaugaaaaauaugu

SEQ ID NO: 963145 - RNA, 15 nt, Homo sapiens
ccugcaaacugggaa

SEQ ID NO: 963146 - RNA, 17 nt, Homo sapiens
ccugcaaagggaacuga

SEQ ID NO: 963147 - RNA, 14 nt, Homo sapiens
ccugcacaaggugg

SEQ ID NO: 963148 - RNA, 13 nt, Homo sapiens
ccugcacugccag

SEQ ID NO: 963149 - RNA, 14 nt, Homo sapiens
ccugcagaccucaa

SEQ ID NO: 963150 - RNA, 17 nt, Homo sapiens
ccugcagcccaccagac

SEQ ID NO: 963151 - RNA, 17 nt, Homo sapiens
ccugcaggcaggaacaa

SEQ ID NO: 963152 - RNA, 14 nt, Homo sapiens
ccugccacagccag

SEQ ID NO: 963153 - RNA, 15 nt, Homo sapiens
ccugccaggcacaca

SEQ ID NO: 963154 - RNA, 14 nt, Homo sapiens
ccugccugccgucu

SEQ ID NO: 963155 - RNA, 15 nt, Homo sapiens
ccugcuacaccuauu

SEQ ID NO: 963156 - RNA, 20 nt, Homo sapiens
ccugcucuaaggcaguagaa

SEQ ID NO: 963157 - RNA, 14 nt, Homo sapiens
ccugcugagaucug

SEQ ID NO: 963158 - RNA, 22 nt, Homo sapiens
ccugcugccggaagucauccca

SEQ ID NO: 963159 - RNA, 19 nt, Homo sapiens
ccugcugcgucagaccagu

SEQ ID NO: 963160 - RNA, 10 nt, Homo sapiens
ccugcuggag

SEQ ID NO: 963161 - RNA, 14 nt, Homo sapiens
ccuggacacuguac

SEQ ID NO: 963162 - RNA, 18 nt, Homo sapiens
ccuggagacaaggugcua

SEQ ID NO: 963163 - RNA, 21 nt, Homo sapiens
ccuggccaccagccauccucc

SEQ ID NO: 963164 - RNA, 18 nt, Homo sapiens
ccuggccuggcacacauc

SEQ ID NO: 963165 - RNA, 18 nt, Homo sapiens
ccugggaggguguggugc

SEQ ID NO: 963166 - RNA, 14 nt, Homo sapiens
ccugggcagggcag

SEQ ID NO: 963167 - RNA, 23 nt, Homo sapiens
ccugggcuuggccugcugugauu

SEQ ID NO: 963168 - RNA, 17 nt, Homo sapiens
ccuggugugcaggguga

SEQ ID NO: 963169 - RNA, 21 nt, Homo sapiens
ccuguaaggcaggcccauuca

SEQ ID NO: 963170 - RNA, 12 nt, Homo sapiens
ccugugacaugg

SEQ ID NO: 963171 - RNA, 20 nt, Homo sapiens
ccuguggcugucggugggac

SEQ ID NO: 963172 - RNA, 22 nt, Homo sapiens
ccuguggguguucuuuccugcc

SEQ ID NO: 963173 - RNA, 18 nt, Homo sapiens
ccugugugggacugagau

SEQ ID NO: 963174 - RNA, 20 nt, Homo sapiens
ccuguguuccucaaucacac

SEQ ID NO: 963175 - RNA, 19 nt, Homo sapiens
ccuguuccccaaggacucu

SEQ ID NO: 963176 - RNA, 17 nt, Homo sapiens
ccuguuugaaaguaaaa

SEQ ID NO: 963177 - RNA, 22 nt, Homo sapiens
ccuuaagcaaauuuuguauuau

SEQ ID NO: 963178 - RNA, 21 nt, Homo sapiens
ccuuaagccaauauuuacuca

SEQ ID NO: 963179 - RNA, 18 nt, Homo sapiens
ccuuaagggguaucaugu

SEQ ID NO: 963180 - RNA, 13 nt, Homo sapiens
ccuuaaguauuau

SEQ ID NO: 963181 - RNA, 16 nt, Homo sapiens
ccuuacaaguuagaaa

SEQ ID NO: 963182 - RNA, 14 nt, Homo sapiens
ccuuagagguccuc

SEQ ID NO: 963183 - RNA, 17 nt, Homo sapiens
ccuuagauaccuugaaa

SEQ ID NO: 963184 - RNA, 13 nt, Homo sapiens
ccuucaaugcugc

SEQ ID NO: 963185 - RNA, 16 nt, Homo sapiens
ccuucacaaucuguca

SEQ ID NO: 963186 - RNA, 21 nt, Homo sapiens
ccuucaucuuccuguguccug

SEQ ID NO: 963187 - RNA, 15 nt, Homo sapiens
ccuuccacucuggaa

SEQ ID NO: 963188 - RNA, 16 nt, Homo sapiens
ccuuccgcuuggagcu

SEQ ID NO: 963189 - RNA, 14 nt, Homo sapiens
ccuuccuggccuga

SEQ ID NO: 963190 - RNA, 15 nt, Homo sapiens
ccuuccuguguaugc

SEQ ID NO: 963191 - RNA, 13 nt, Homo sapiens
ccuuccuuaccug

SEQ ID NO: 963192 - RNA, 21 nt, Homo sapiens
cuagggagacgccaugugaug

SEQ ID NO: 963193 - RNA, 18 nt, Homo sapiens
cuagugacuuccugguga

SEQ ID NO: 963194 - RNA, 19 nt, Homo sapiens
cuauaaaacucugcaugua

SEQ ID NO: 963195 - RNA, 19 nt, Homo sapiens
cuauaaagcuuuuguucac

SEQ ID NO: 963196 - RNA, 13 nt, Homo sapiens
cuauauugguuua

SEQ ID NO: 963197 - RNA, 15 nt, Homo sapiens
cuaucccucuccuaa

SEQ ID NO: 963198 - RNA, 20 nt, Homo sapiens
cuaugaucagaagacuuuaa

SEQ ID NO: 963199 - RNA, 21 nt, Homo sapiens
cuaugccaagucccuggaaaa

SEQ ID NO: 963200 - RNA, 19 nt, Homo sapiens
cuauggugcucagcccuga

SEQ ID NO: 963201 - RNA, 21 nt, Homo sapiens
cuaugguguguuguaucuuug

SEQ ID NO: 963202 - RNA, 17 nt, Homo sapiens
cuauguaauggugguca

SEQ ID NO: 963203 - RNA, 15 nt, Homo sapiens
cuauuccauauuaaa

SEQ ID NO: 963204 - RNA, 13 nt, Homo sapiens
cuauucuauccau

SEQ ID NO: 963205 - RNA, 17 nt, Homo sapiens
cuauuuaaguggacugu

SEQ ID NO: 963206 - RNA, 15 nt, Homo sapiens
cuauuugccaugggc

SEQ ID NO: 963207 - RNA, 19 nt, Homo sapiens
cuauuuggggcuugaugac

SEQ ID NO: 963208 - RNA, 21 nt, Homo sapiens
cucaaacccuguggggccuga

SEQ ID NO: 963209 - RNA, 11 nt, Homo sapiens
cucaaagggaa

SEQ ID NO: 963210 - RNA, 13 nt, Homo sapiens
cucaacauugugu

SEQ ID NO: 963211 - RNA, 19 nt, Homo sapiens
cucaacugccuacuccaaa

SEQ ID NO: 963212 - RNA, 18 nt, Homo sapiens
cucaacugggugacaagg

SEQ ID NO: 963213 - RNA, 12 nt, Homo sapiens
cucaacuuuaag

SEQ ID NO: 963214 - RNA, 17 nt, Homo sapiens
cucaacuuuaagauaga

SEQ ID NO: 963215 - RNA, 24 nt, Homo sapiens
cucaaguuggaguugacugcucau

SEQ ID NO: 963216 - RNA, 17 nt, Homo sapiens
cucaauaaagugcuuua

SEQ ID NO: 963217 - RNA, 19 nt, Homo sapiens
cucaaucacacugaagcca

SEQ ID NO: 963218 - RNA, 22 nt, Homo sapiens
cucacacaaauuaaaauacagc

SEQ ID NO: 963219 - RNA, 14 nt, Homo sapiens
cucacauaagccca

SEQ ID NO: 963220 - RNA, 19 nt, Homo sapiens
cucacauaagcccaguuca

SEQ ID NO: 963221 - RNA, 20 nt, Homo sapiens
cucacauaagcccaguucau

SEQ ID NO: 963222 - RNA, 15 nt, Homo sapiens
cucaccagccccacu

SEQ ID NO: 963223 - RNA, 14 nt, Homo sapiens
cucacugcuaucug

SEQ ID NO: 963224 - RNA, 13 nt, Homo sapiens
cucagaaccugcu

SEQ ID NO: 963225 - RNA, 17 nt, Homo sapiens
cucagaaccuuguccca

SEQ ID NO: 963226 - RNA, 13 nt, Homo sapiens
cucagacauucca

SEQ ID NO: 963227 - RNA, 14 nt, Homo sapiens
cucagacauuccaa

SEQ ID NO: 963228 - RNA, 19 nt, Homo sapiens
cucagacuggagggcaagg

SEQ ID NO: 963229 - RNA, 14 nt, Homo sapiens
cucagcggugccac

SEQ ID NO: 963230 - RNA, 18 nt, Homo sapiens
cucagcuuugagaagccu

SEQ ID NO: 963231 - RNA, 15 nt, Homo sapiens
cucaguaaaaguaaa

SEQ ID NO: 963232 - RNA, 21 nt, Homo sapiens
cucaguaaacgggaacaugcc

SEQ ID NO: 963233 - RNA, 21 nt, Homo sapiens
cucagugcauagcgaagacca

SEQ ID NO: 963234 - RNA, 20 nt, Homo sapiens
cucaguucuacacugauaca

SEQ ID NO: 963235 - RNA, 19 nt, Homo sapiens
cucaguucucuugcuuuca

SEQ ID NO: 963236 - RNA, 13 nt, Homo sapiens
cucaguucuuccu

SEQ ID NO: 963237 - RNA, 21 nt, Homo sapiens
cucaucaacugaaugagguca

SEQ ID NO: 963238 - RNA, 20 nt, Homo sapiens
cucaugccuguaaucccagc

SEQ ID NO: 963239 - RNA, 22 nt, Homo sapiens
cuccaacaucccuuauaccacu

SEQ ID NO: 963240 - RNA, 15 nt, Homo sapiens
cuccacacagugcuc

SEQ ID NO: 963241 - RNA, 18 nt, Homo sapiens
cuccacccagugauccca

SEQ ID NO: 963242 - RNA, 23 nt, Homo sapiens
cuccaccuacaccccugugcucc

SEQ ID NO: 963243 - RNA, 16 nt, Homo sapiens
cuccacuccaccucca

SEQ ID NO: 963244 - RNA, 15 nt, Homo sapiens
cuccagauggugcua

SEQ ID NO: 963245 - RNA, 12 nt, Homo sapiens
cuccagccagag

SEQ ID NO: 963246 - RNA, 14 nt, Homo sapiens
cuccagccaucuca

SEQ ID NO: 963247 - RNA, 19 nt, Homo sapiens
cuccagcccagacccagug

SEQ ID NO: 963248 - RNA, 21 nt, Homo sapiens
cuccagccugacuuggggaga

SEQ ID NO: 963249 - RNA, 21 nt, Homo sapiens
cuccagccugggggacagaaa

SEQ ID NO: 963250 - RNA, 20 nt, Homo sapiens
cuccagcuugggcaacagag

SEQ ID NO: 963251 - RNA, 16 nt, Homo sapiens
cuccaguaacagccua

SEQ ID NO: 963252 - RNA, 15 nt, Homo sapiens
cuccauaaacaugaa

SEQ ID NO: 963253 - RNA, 17 nt, Homo sapiens
cuccauauuuauuuaaa

SEQ ID NO: 963254 - RNA, 12 nt, Homo sapiens
cuccaucaugcc

SEQ ID NO: 963255 - RNA, 16 nt, Homo sapiens
cuccaucucaaaaaag

SEQ ID NO: 963256 - RNA, 13 nt, Homo sapiens
cuccauucauccu

SEQ ID NO: 963257 - RNA, 20 nt, Homo sapiens
cuccauuuaccaguaacuua

SEQ ID NO: 963258 - RNA, 16 nt, Homo sapiens
cucccaacacugucac

SEQ ID NO: 963259 - RNA, 21 nt, Homo sapiens
cucccacucuccuaggcauuc

SEQ ID NO: 963260 - RNA, 14 nt, Homo sapiens
cucccagcugacca

SEQ ID NO: 963261 - RNA, 18 nt, Homo sapiens
cuccccaucuguccagcu

SEQ ID NO: 963262 - RNA, 19 nt, Homo sapiens
cucccccuccuccagggaa

SEQ ID NO: 963263 - RNA, 18 nt, Homo sapiens
cuccccugccacacugau

SEQ ID NO: 963264 - RNA, 17 nt, Homo sapiens
cucccuaggcugcccac

SEQ ID NO: 963265 - RNA, 21 nt, Homo sapiens
cucccuaggcugcccacucuc

SEQ ID NO: 963266 - RNA, 18 nt, Homo sapiens
cucccuccagacaaugcc

SEQ ID NO: 963267 - RNA, 18 nt, Homo sapiens
cucccugaagaccaaaau

SEQ ID NO: 963268 - RNA, 18 nt, Homo sapiens
cucccuguuaucugcuag

SEQ ID NO: 963269 - RNA, 19 nt, Homo sapiens
cuccucaccucaugcccac

SEQ ID NO: 963270 - RNA, 15 nt, Homo sapiens
cuccuguggagucaa

SEQ ID NO: 963271 - RNA, 20 nt, Homo sapiens
cucgcuagguagaacacugc

SEQ ID NO: 963272 - RNA, 17 nt, Homo sapiens
cucggacaccaagcaga

SEQ ID NO: 963273 - RNA, 19 nt, Homo sapiens
cucuaauguaccaaugaug

SEQ ID NO: 963274 - RNA, 14 nt, Homo sapiens
cucuagaaugagca

SEQ ID NO: 963275 - RNA, 19 nt, Homo sapiens
cucuagguccccauacucc

SEQ ID NO: 963276 - RNA, 13 nt, Homo sapiens
cucuaucuuccuc

SEQ ID NO: 963277 - RNA, 20 nt, Homo sapiens
cucucaaaagagaaaaacaa

SEQ ID NO: 963278 - RNA, 18 nt, Homo sapiens
cucucaguucuacacuga

SEQ ID NO: 963279 - RNA, 19 nt, Homo sapiens
cucucauauaagacaaaua

SEQ ID NO: 963280 - RNA, 23 nt, Homo sapiens
cucuccaaccacugugccacuga

SEQ ID NO: 963281 - RNA, 15 nt, Homo sapiens
cucuccaucucccaa

SEQ ID NO: 963282 - RNA, 17 nt, Homo sapiens
cucuccauucugcuccu

SEQ ID NO: 963283 - RNA, 18 nt, Homo sapiens
cucuccauucugcuccuu

SEQ ID NO: 963284 - RNA, 17 nt, Homo sapiens
cucucccaacucuugca

SEQ ID NO: 963285 - RNA, 18 nt, Homo sapiens
cucucccaacucuugcac

SEQ ID NO: 963286 - RNA, 17 nt, Homo sapiens
cucuccucgguucaagg

SEQ ID NO: 963287 - RNA, 20 nt, Homo sapiens
cucucucuagaaugagcaag

SEQ ID NO: 963288 - RNA, 22 nt, Homo sapiens
cucugagucagugguuauuuga

SEQ ID NO: 963289 - RNA, 22 nt, Homo sapiens
cucugaucuccauaaacaugaa

SEQ ID NO: 963290 - RNA, 14 nt, Homo sapiens
cucugcacaugucu

SEQ ID NO: 963291 - RNA, 15 nt, Homo sapiens
cucugcaccuuugca

SEQ ID NO: 963292 - RNA, 17 nt, Homo sapiens
cucugcaguccuacuca

SEQ ID NO: 963293 - RNA, 18 nt, Homo sapiens
cucuggacagccagugac

SEQ ID NO: 963294 - RNA, 22 nt, Homo sapiens
cucuggaccugucucuaccuaa

SEQ ID NO: 963295 - RNA, 14 nt, Homo sapiens
cucuggaguucauc

SEQ ID NO: 963296 - RNA, 21 nt, Homo sapiens
cucugggaaguggucagcgca

SEQ ID NO: 963297 - RNA, 21 nt, Homo sapiens
cucugggggagugcagggugg

SEQ ID NO: 963298 - RNA, 16 nt, Homo sapiens
cucuggguugugcaca

SEQ ID NO: 963299 - RNA, 15 nt, Homo sapiens
cucuguaaacuucca

SEQ ID NO: 963300 - RNA, 15 nt, Homo sapiens
cucuguuaacaucua

SEQ ID NO: 963301 - RNA, 20 nt, Homo sapiens
cucuucagccauaguggauc

SEQ ID NO: 963302 - RNA, 14 nt, Homo sapiens
cucuucccaucugu

SEQ ID NO: 963303 - RNA, 22 nt, Homo sapiens
cucuuccccagagaggcacuca

SEQ ID NO: 963304 - RNA, 20 nt, Homo sapiens
cucuucucuugagcaguuag

SEQ ID NO: 963305 - RNA, 16 nt, Homo sapiens
cucuugccagcauuuu

SEQ ID NO: 963306 - RNA, 14 nt, Homo sapiens
cucuugcuuucaca

SEQ ID NO: 963307 - RNA, 19 nt, Homo sapiens
cucuuguaauaaaaugucu

SEQ ID NO: 963308 - RNA, 14 nt, Homo sapiens
uaagugugccaaau

SEQ ID NO: 963309 - RNA, 14 nt, Homo sapiens
uaaguguggagcug

SEQ ID NO: 963310 - RNA, 20 nt, Homo sapiens
uaaguucaggcagcacauca

SEQ ID NO: 963311 - RNA, 19 nt, Homo sapiens
uaaguuucacagcacuuac

SEQ ID NO: 963312 - RNA, 17 nt, Homo sapiens
uaaguuucaggugacau

SEQ ID NO: 963313 - RNA, 17 nt, Homo sapiens
uaauaaauuuucuaaaa

SEQ ID NO: 963314 - RNA, 14 nt, Homo sapiens
uaauaacagcagug

SEQ ID NO: 963315 - RNA, 19 nt, Homo sapiens
uaauaagcaaucaagguua

SEQ ID NO: 963316 - RNA, 14 nt, Homo sapiens
uaauacuacugugu

SEQ ID NO: 963317 - RNA, 12 nt, Homo sapiens
uaauagucauca

SEQ ID NO: 963318 - RNA, 17 nt, Homo sapiens
uaauauccaagacuuag

SEQ ID NO: 963319 - RNA, 16 nt, Homo sapiens
uaauauuauuacuuua

SEQ ID NO: 963320 - RNA, 19 nt, Homo sapiens
uaauauuuuccuaguagau

SEQ ID NO: 963321 - RNA, 16 nt, Homo sapiens
uaaucaauauaaucug

SEQ ID NO: 963322 - RNA, 15 nt, Homo sapiens
uaaucagucauuucu

SEQ ID NO: 963323 - RNA, 12 nt, Homo sapiens
uaaucauacaaa

SEQ ID NO: 963324 - RNA, 14 nt, Homo sapiens
uaaucccagcacuu

SEQ ID NO: 963325 - RNA, 16 nt, Homo sapiens
uaaugaugaacuuaua

SEQ ID NO: 963326 - RNA, 19 nt, Homo sapiens
uaaugcuuucccacucuca

SEQ ID NO: 963327 - RNA, 22 nt, Homo sapiens
uaaugcuuucccacucucaggg

SEQ ID NO: 963328 - RNA, 14 nt, Homo sapiens
uaauggaauuuaga

SEQ ID NO: 963329 - RNA, 23 nt, Homo sapiens
uaauggaugguugaauuaacuuc

SEQ ID NO: 963330 - RNA, 19 nt, Homo sapiens
uaauggguaugcucagguc

SEQ ID NO: 963331 - RNA, 14 nt, Homo sapiens
uaauguacaugggc

SEQ ID NO: 963332 - RNA, 14 nt, Homo sapiens
uaaugugacuugga

SEQ ID NO: 963333 - RNA, 17 nt, Homo sapiens
uaauguggccauuucac

SEQ ID NO: 963334 - RNA, 18 nt, Homo sapiens
uaauuaccaaccuguuac

SEQ ID NO: 963335 - RNA, 17 nt, Homo sapiens
uaauuacucuaacaaac

SEQ ID NO: 963336 - RNA, 14 nt, Homo sapiens
uaauucagcucuuc

SEQ ID NO: 963337 - RNA, 17 nt, Homo sapiens
uaauugcuguucugcug

SEQ ID NO: 963338 - RNA, 16 nt, Homo sapiens
uaauuuaacacccuuu

SEQ ID NO: 963339 - RNA, 21 nt, Homo sapiens
uaauuuccuuuuugacacuga

SEQ ID NO: 963340 - RNA, 21 nt, Homo sapiens
uacaaaauauagcuuucauaa

SEQ ID NO: 963341 - RNA, 16 nt, Homo sapiens
uacaacauuaaggaau

SEQ ID NO: 963342 - RNA, 20 nt, Homo sapiens
uagccuuuaaaucauuuuua

SEQ ID NO: 963343 - RNA, 19 nt, Homo sapiens
uagcgacugucaacagcgu

SEQ ID NO: 963344 - RNA, 15 nt, Homo sapiens
uagcucagucaucaa

SEQ ID NO: 963345 - RNA, 14 nt, Homo sapiens
uagcucgagcaaaa

SEQ ID NO: 963346 - RNA, 16 nt, Homo sapiens
uagcugacuacaaauu

SEQ ID NO: 963347 - RNA, 23 nt, Homo sapiens
uagcuguccuuuuuccucuccac

SEQ ID NO: 963348 - RNA, 22 nt, Homo sapiens
uagcuucugcuuuucugcccug

SEQ ID NO: 963349 - RNA, 18 nt, Homo sapiens
uaggaaaaaaauaguaaa

SEQ ID NO: 963350 - RNA, 17 nt, Homo sapiens
uaggaggaaaauuccau

SEQ ID NO: 963351 - RNA, 18 nt, Homo sapiens
uaggaugagguuucuuca

SEQ ID NO: 963352 - RNA, 21 nt, Homo sapiens
uaggaugcuugggaagacucc

SEQ ID NO: 963353 - RNA, 12 nt, Homo sapiens
uaggcagaucac

SEQ ID NO: 963354 - RNA, 17 nt, Homo sapiens
uaggcuaagcacuuuau

SEQ ID NO: 963355 - RNA, 14 nt, Homo sapiens
uagggaacugggga

SEQ ID NO: 963356 - RNA, 15 nt, Homo sapiens
uagguagaacacugc

SEQ ID NO: 963357 - RNA, 18 nt, Homo sapiens
uagguuaaaaaaaaaagu

SEQ ID NO: 963358 - RNA, 16 nt, Homo sapiens
uagucaaggaaccuca

SEQ ID NO: 963359 - RNA, 19 nt, Homo sapiens
uagucacauggccuaugca

SEQ ID NO: 963360 - RNA, 20 nt, Homo sapiens
uagucacauggccuaugcac

SEQ ID NO: 963361 - RNA, 19 nt, Homo sapiens
uagucccagcuacuccgga

SEQ ID NO: 963362 - RNA, 15 nt, Homo sapiens
uaguccugacacuga

SEQ ID NO: 963363 - RNA, 14 nt, Homo sapiens
uagucucaccagcc

SEQ ID NO: 963364 - RNA, 19 nt, Homo sapiens
uagucuuaacuggucuccu

SEQ ID NO: 963365 - RNA, 21 nt, Homo sapiens
uagucuugacgaauauugcuu

SEQ ID NO: 963366 - RNA, 14 nt, Homo sapiens
uagugcacuagcau

SEQ ID NO: 963367 - RNA, 14 nt, Homo sapiens
uaguguccauaaau

SEQ ID NO: 963368 - RNA, 18 nt, Homo sapiens
uagugucuauuaucacau

SEQ ID NO: 963369 - RNA, 22 nt, Homo sapiens
uaguuacuaaacauguauguaa

SEQ ID NO: 963370 - RNA, 16 nt, Homo sapiens
uaguuguagacaaagu

SEQ ID NO: 963371 - RNA, 13 nt, Homo sapiens
uaguuuaucauuu

SEQ ID NO: 963372 - RNA, 20 nt, Homo sapiens
uaguuuaucauuuacugugu

SEQ ID NO: 963373 - RNA, 20 nt, Homo sapiens
uauaaaaaagccacuggaau

SEQ ID NO: 963374 - RNA, 19 nt, Homo sapiens
uauaaauuuguguucucaa

SEQ ID NO: 963375 - RNA, 17 nt, Homo sapiens
ucaaauacacauuugcu

SEQ ID NO: 963376 - RNA, 18 nt, Homo sapiens
ucaaauacacauuugcua

SEQ ID NO: 963377 - RNA, 21 nt, Homo sapiens
ucaaauacacauuugcuacug

SEQ ID NO: 963378 - RNA, 18 nt, Homo sapiens
ucaaauuuuaucaugcca

SEQ ID NO: 963379 - RNA, 22 nt, Homo sapiens
ucaacccuucuggaaacuguga

SEQ ID NO: 963380 - RNA, 14 nt, Homo sapiens
ucaacgucucagcc

SEQ ID NO: 963381 - RNA, 15 nt, Homo sapiens
ucaagaauaaucacg

SEQ ID NO: 963382 - RNA, 17 nt, Homo sapiens
ucaagacuuagcuccug

SEQ ID NO: 963383 - RNA, 20 nt, Homo sapiens
ucaagaguccggauuucuaa

SEQ ID NO: 963384 - RNA, 18 nt, Homo sapiens
ucaagcaauccagccuca

SEQ ID NO: 963385 - RNA, 16 nt, Homo sapiens
ucaagccuuccaggga

SEQ ID NO: 963386 - RNA, 16 nt, Homo sapiens
ucaagcuggugcuacu

SEQ ID NO: 963387 - RNA, 23 nt, Homo sapiens
ucaagcuggugcuacuguuugau

SEQ ID NO: 963388 - RNA, 22 nt, Homo sapiens
ucaagcuuuuaaaaacuagagc

SEQ ID NO: 963389 - RNA, 20 nt, Homo sapiens
ucaaggaauaauucaaguca

SEQ ID NO: 963390 - RNA, 20 nt, Homo sapiens
ucaaggaggcccacuguguc

SEQ ID NO: 963391 - RNA, 12 nt, Homo sapiens
ucaaggcauuua

SEQ ID NO: 963392 - RNA, 16 nt, Homo sapiens
ucaaggucacuguuuc

SEQ ID NO: 963393 - RNA, 23 nt, Homo sapiens
ucaaggugggccuugcuaccuca

SEQ ID NO: 963394 - RNA, 15 nt, Homo sapiens
ucaagucugcacaga

SEQ ID NO: 963395 - RNA, 13 nt, Homo sapiens
ucaaguguccuga

SEQ ID NO: 963396 - RNA, 20 nt, Homo sapiens
ucaaguucagcccaccaucu

SEQ ID NO: 963397 - RNA, 22 nt, Homo sapiens
ucaaguucuggaccugggcaug

SEQ ID NO: 963398 - RNA, 22 nt, Homo sapiens
ucaaucugcaguuuaacaaaau

SEQ ID NO: 963399 - RNA, 23 nt, Homo sapiens
ucaauggcuuguucaucauccag

SEQ ID NO: 963400 - RNA, 13 nt, Homo sapiens
ucaaugugcauaa

SEQ ID NO: 963401 - RNA, 17 nt, Homo sapiens
ucaauguuuagcagauu

SEQ ID NO: 963402 - RNA, 13 nt, Homo sapiens
ucacaaauggaau

SEQ ID NO: 963403 - RNA, 17 nt, Homo sapiens
ucacaauuaugugcaaa

SEQ ID NO: 963404 - RNA, 14 nt, Homo sapiens
ucacacccuaacuc

SEQ ID NO: 963405 - RNA, 16 nt, Homo sapiens
ucacacugaagccaca

SEQ ID NO: 963406 - RNA, 13 nt, Homo sapiens
ucacauccauccc

SEQ ID NO: 963407 - RNA, 19 nt, Homo sapiens
ucacauccaucccuccauu

SEQ ID NO: 963408 - RNA, 21 nt, Homo sapiens
aguuugugagaaacaucucaa

SEQ ID NO: 963409 - RNA, 16 nt, Homo sapiens
aguuuuaaacccaaaa

SEQ ID NO: 963410 - RNA, 20 nt, Homo sapiens
aguuuuagaaaugagaucua

SEQ ID NO: 963411 - RNA, 15 nt, Homo sapiens
aguuuuccaggaaua

SEQ ID NO: 963412 - RNA, 19 nt, Homo sapiens
aguuuuccuacacuugaga

SEQ ID NO: 963413 - RNA, 19 nt, Homo sapiens
aguuuuccuucuguuaaaa

SEQ ID NO: 963414 - RNA, 20 nt, Homo sapiens
aguuuugcuuuaguacaaua

SEQ ID NO: 963415 - RNA, 19 nt, Homo sapiens
aguuuuuguaaagcccuug

SEQ ID NO: 963416 - RNA, 22 nt, Homo sapiens
auaaaacguuaguuaaucccuu

SEQ ID NO: 963417 - RNA, 15 nt, Homo sapiens
auaaaagaucuugaa

SEQ ID NO: 963418 - RNA, 17 nt, Homo sapiens
auaaaauagaaacauuu

SEQ ID NO: 963419 - RNA, 16 nt, Homo sapiens
auaaaccaaaggaaaa

SEQ ID NO: 963420 - RNA, 18 nt, Homo sapiens
auaaacgaauucugucuc

SEQ ID NO: 963421 - RNA, 16 nt, Homo sapiens
auaaacucauuuaacu

SEQ ID NO: 963422 - RNA, 20 nt, Homo sapiens
auaaacugacuaaacuuaca

SEQ ID NO: 963423 - RNA, 12 nt, Homo sapiens
auaaagaacaau

SEQ ID NO: 963424 - RNA, 14 nt, Homo sapiens
auaaagcauguuca

SEQ ID NO: 963425 - RNA, 14 nt, Homo sapiens
auaaauacguguca

SEQ ID NO: 963426 - RNA, 15 nt, Homo sapiens
auaaauacgugucaa

SEQ ID NO: 963427 - RNA, 13 nt, Homo sapiens
auaaauauuucuc

SEQ ID NO: 963428 - RNA, 21 nt, Homo sapiens
auaaauauuucucaacugagg

SEQ ID NO: 963429 - RNA, 20 nt, Homo sapiens
auaaaucauucuuacuaaaa

SEQ ID NO: 963430 - RNA, 22 nt, Homo sapiens
auaaauccucagguaguacugg

SEQ ID NO: 963431 - RNA, 22 nt, Homo sapiens
auaaauuuaaacuuacaaacuu

SEQ ID NO: 963432 - RNA, 15 nt, Homo sapiens
auaacaucaccacug

SEQ ID NO: 963433 - RNA, 23 nt, Homo sapiens
auaacgcacaacuucgugcucag

SEQ ID NO: 963434 - RNA, 13 nt, Homo sapiens
auaagacauuugu

SEQ ID NO: 963435 - RNA, 15 nt, Homo sapiens
agacaaagccuuaag

SEQ ID NO: 963436 - RNA, 12 nt, Homo sapiens
agacaagcauuu

SEQ ID NO: 963437 - RNA, 22 nt, Homo sapiens
agacaagcccuugagaagccaa

SEQ ID NO: 963438 - RNA, 11 nt, Homo sapiens
agacagaggaa

SEQ ID NO: 963439 - RNA, 23 nt, Homo sapiens
agacaguuuugcuuuaguacaau

SEQ ID NO: 963440 - RNA, 15 nt, Homo sapiens
agacauauaccaaaa

SEQ ID NO: 963441 - RNA, 15 nt, Homo sapiens
agacauggaccucca

SEQ ID NO: 963442 - RNA, 12 nt, Homo sapiens
agacauuccaag

SEQ ID NO: 963443 - RNA, 20 nt, Homo sapiens
agaccaagacuuuugucuga

SEQ ID NO: 963444 - RNA, 13 nt, Homo sapiens
agaccaguacugg

SEQ ID NO: 963445 - RNA, 11 nt, Homo sapiens
agacccagugg

SEQ ID NO: 963446 - RNA, 22 nt, Homo sapiens
agacccuuauugcuguccugga

SEQ ID NO: 963447 - RNA, 18 nt, Homo sapiens
agaccggcugguggagcu

SEQ ID NO: 963448 - RNA, 20 nt, Homo sapiens
agaccguccuggagcuggag

SEQ ID NO: 963449 - RNA, 14 nt, Homo sapiens
agaccucaagccau

SEQ ID NO: 963450 - RNA, 20 nt, Homo sapiens
agaccugguucccgccuccc

SEQ ID NO: 963451 - RNA, 21 nt, Homo sapiens
agacguccuccguccauauca

SEQ ID NO: 963452 - RNA, 17 nt, Homo sapiens
agacucugucuaccugg

SEQ ID NO: 963453 - RNA, 23 nt, Homo sapiens
agacucuuuuuuugagugacagc

SEQ ID NO: 963454 - RNA, 19 nt, Homo sapiens
agacuggggcauccugugc

SEQ ID NO: 963455 - RNA, 17 nt, Homo sapiens
agacugggggcaggaug

SEQ ID NO: 963456 - RNA, 20 nt, Homo sapiens
agacuguggcuagugacaaa

SEQ ID NO: 963457 - RNA, 20 nt, Homo sapiens
agacuuuguguucauuucau

SEQ ID NO: 963458 - RNA, 18 nt, Homo sapiens
agagaaaauaaauuccaa

SEQ ID NO: 963459 - RNA, 14 nt, Homo sapiens
agagaaccaaaggg

SEQ ID NO: 963460 - RNA, 19 nt, Homo sapiens
agagaacucgcgcucagua

SEQ ID NO: 963461 - RNA, 12 nt, Homo sapiens
agagaaggcagg

SEQ ID NO: 963462 - RNA, 14 nt, Homo sapiens
agagaauguauuug

SEQ ID NO: 963463 - RNA, 21 nt, Homo sapiens
agagacacugggacacuguca

SEQ ID NO: 963464 - RNA, 22 nt, Homo sapiens
agagacacugggacacugucag

SEQ ID NO: 963465 - RNA, 12 nt, Homo sapiens
agagaguaccau

SEQ ID NO: 963466 - RNA, 17 nt, Homo sapiens
agagauaagucuuucau

SEQ ID NO: 963467 - RNA, 15 nt, Homo sapiens
agagcagaugcagag

SEQ ID NO: 963468 - RNA, 17 nt, Homo sapiens
agagcagccucauccca

SEQ ID NO: 963469 - RNA, 18 nt, Homo sapiens
agagcagccucaucccag

SEQ ID NO: 963470 - RNA, 17 nt, Homo sapiens
agagccauaugcccuca

SEQ ID NO: 963471 - RNA, 14 nt, Homo sapiens
agagcuauggugag

SEQ ID NO: 963472 - RNA, 16 nt, Homo sapiens
agagcugguggaccca

SEQ ID NO: 963473 - RNA, 22 nt, Homo sapiens
agaggaaaccaguuuggugaua

SEQ ID NO: 963474 - RNA, 21 nt, Homo sapiens
agaggaaaugucacagaagca

SEQ ID NO: 963475 - RNA, 22 nt, Homo sapiens
agaggaauaacaucaccacugu

SEQ ID NO: 963476 - RNA, 13 nt, Homo sapiens
agaggcaccugcu

SEQ ID NO: 963477 - RNA, 21 nt, Homo sapiens
agagguagucucacugcuuga

SEQ ID NO: 963478 - RNA, 17 nt, Homo sapiens
agaguaacucaguaauu

SEQ ID NO: 963479 - RNA, 17 nt, Homo sapiens
agaguccagugcucugc

SEQ ID NO: 963480 - RNA, 21 nt, Homo sapiens
agagucuggccuggacccuga

SEQ ID NO: 963481 - RNA, 20 nt, Homo sapiens
agagucuuguuuuuuauuca

SEQ ID NO: 963482 - RNA, 18 nt, Homo sapiens
agaguguggguccuucaa

SEQ ID NO: 963483 - RNA, 18 nt, Homo sapiens
agauaaauucaugcacuu

SEQ ID NO: 963484 - RNA, 22 nt, Homo sapiens
agauaauuggcaacugggugaa

SEQ ID NO: 963485 - RNA, 15 nt, Homo sapiens
agauaauuguuucau

SEQ ID NO: 963486 - RNA, 15 nt, Homo sapiens
agauacuuaauuccc

SEQ ID NO: 963487 - RNA, 15 nt, Homo sapiens
agauagcuacagugu

SEQ ID NO: 963488 - RNA, 21 nt, Homo sapiens
agauauguauucuuuucucag

SEQ ID NO: 963489 - RNA, 19 nt, Homo sapiens
agauauuagguccauucau

SEQ ID NO: 963490 - RNA, 20 nt, Homo sapiens
agaucaagaaaaaaagggag

SEQ ID NO: 963491 - RNA, 14 nt, Homo sapiens
agaucaagcauuac

SEQ ID NO: 963492 - RNA, 18 nt, Homo sapiens
agaucacgucacugcacu

SEQ ID NO: 963493 - RNA, 15 nt, Homo sapiens
agaucacugccacac

SEQ ID NO: 963494 - RNA, 13 nt, Homo sapiens
agauccaauuccc

SEQ ID NO: 963495 - RNA, 18 nt, Homo sapiens
agaucgugcuacugcacu

SEQ ID NO: 963496 - RNA, 16 nt, Homo sapiens
agaucucugaagccac

SEQ ID NO: 963497 - RNA, 13 nt, Homo sapiens
agaucuuccccaa

SEQ ID NO: 963498 - RNA, 13 nt, Homo sapiens
agaucuugaauag

SEQ ID NO: 963499 - RNA, 19 nt, Homo sapiens
agaucuugaauagucucau

SEQ ID NO: 963500 - RNA, 18 nt, Homo sapiens
agaugaauggucuggcaa

SEQ ID NO: 963501 - RNA, 18 nt, Homo sapiens
agaugcuguugugaagcu

SEQ ID NO: 963502 - RNA, 22 nt, Homo sapiens
agauggaaaaacugaggcuuag

SEQ ID NO: 963503 - RNA, 14 nt, Homo sapiens
agauggaguucuug

SEQ ID NO: 963504 - RNA, 21 nt, Homo sapiens
agauggaguucuugugccaua

SEQ ID NO: 963505 - RNA, 18 nt, Homo sapiens
agaugguguggguguccu

SEQ ID NO: 963506 - RNA, 22 nt, Homo sapiens
agaugguguggguguccugccu

SEQ ID NO: 963507 - RNA, 20 nt, Homo sapiens
agauguggcuacugacauau

SEQ ID NO: 963508 - RNA, 19 nt, Homo sapiens
agauguguguucucaguga

SEQ ID NO: 963509 - RNA, 19 nt, Homo sapiens
agauguucccccaucucgc

SEQ ID NO: 963510 - RNA, 20 nt, Homo sapiens
agauguucccccaucucgcu

SEQ ID NO: 963511 - RNA, 12 nt, Homo sapiens
agauuaacaaca

SEQ ID NO: 963512 - RNA, 20 nt, Homo sapiens
agauuagaagacaacaggca

SEQ ID NO: 963513 - RNA, 17 nt, Homo sapiens
agauuccccugugucau

SEQ ID NO: 963514 - RNA, 16 nt, Homo sapiens
agauucuaaagcucaa

SEQ ID NO: 963515 - RNA, 20 nt, Homo sapiens
agauugacuaacucaaauac

SEQ ID NO: 963516 - RNA, 15 nt, Homo sapiens
agauugcaccacugc

SEQ ID NO: 963517 - RNA, 16 nt, Homo sapiens
agauuuaagaauaccu

SEQ ID NO: 963518 - RNA, 13 nt, Homo sapiens
agauuuaucucug

SEQ ID NO: 963519 - RNA, 14 nt, Homo sapiens
agauuuccacagag

SEQ ID NO: 963520 - RNA, 15 nt, Homo sapiens
agauuuccacagaga

SEQ ID NO: 963521 - RNA, 19 nt, Homo sapiens
agauuuuauucuuauuuca

SEQ ID NO: 963522 - RNA, 15 nt, Homo sapiens
agcaaaacaguucuc

SEQ ID NO: 963523 - RNA, 17 nt, Homo sapiens
aaauaaagauauuguuc

SEQ ID NO: 963524 - RNA, 16 nt, Homo sapiens
aaauaccaacuguaca

SEQ ID NO: 963525 - RNA, 14 nt, Homo sapiens
aaauacgugucaaa

SEQ ID NO: 963526 - RNA, 15 nt, Homo sapiens
aaauagacaaaaagu

SEQ ID NO: 963527 - RNA, 22 nt, Homo sapiens
aaauauauaugcauaccuggau

SEQ ID NO: 963528 - RNA, 12 nt, Homo sapiens
aaauaugcagug

SEQ ID NO: 963529 - RNA, 22 nt, Homo sapiens
aaauaugugcuugaaaugagaa

SEQ ID NO: 963530 - RNA, 20 nt, Homo sapiens
aaauauugucauaggauuaa

SEQ ID NO: 963531 - RNA, 13 nt, Homo sapiens
aaauauuucucaa

SEQ ID NO: 963532 - RNA, 18 nt, Homo sapiens
aaauauuugcuaugaagc

SEQ ID NO: 963533 - RNA, 16 nt, Homo sapiens
aaauauuuggaaugaa

SEQ ID NO: 963534 - RNA, 18 nt, Homo sapiens
aaaucaugccaguauuuu

SEQ ID NO: 963535 - RNA, 13 nt, Homo sapiens
aaauccucaggug

SEQ ID NO: 963536 - RNA, 23 nt, Homo sapiens
aaaucucuacugcuuuggauccu

SEQ ID NO: 963537 - RNA, 13 nt, Homo sapiens
aaaucucuuccac

SEQ ID NO: 963538 - RNA, 23 nt, Homo sapiens
aaaucugaauaaauaauucuuuc

SEQ ID NO: 963539 - RNA, 22 nt, Homo sapiens
aaaucuuaaaugagaccaaagu

SEQ ID NO: 963540 - RNA, 20 nt, Homo sapiens
aaaugaggugccacccagua

SEQ ID NO: 963541 - RNA, 16 nt, Homo sapiens
aaaugauaaacaaguc

SEQ ID NO: 963542 - RNA, 19 nt, Homo sapiens
aaaugaugcgcaucaaugu

SEQ ID NO: 963543 - RNA, 22 nt, Homo sapiens
aaaugcauauuugcaaagugua

SEQ ID NO: 963544 - RNA, 21 nt, Homo sapiens
aaauggucacguuuggugcuu

SEQ ID NO: 963545 - RNA, 21 nt, Homo sapiens
aaaugguuaaauuuuacauga

SEQ ID NO: 963546 - RNA, 21 nt, Homo sapiens
aaauguauuagaagauuuuag

SEQ ID NO: 963547 - RNA, 20 nt, Homo sapiens
aaaugucccuccaacacaga

SEQ ID NO: 963548 - RNA, 21 nt, Homo sapiens
aaaugugaagauggacuucau

SEQ ID NO: 963549 - RNA, 22 nt, Homo sapiens
aaauguguauuuuucaaggcau

SEQ ID NO: 963550 - RNA, 23 nt, Homo sapiens
aaauguguauuuuucaaggcauu

SEQ ID NO: 963551 - RNA, 19 nt, Homo sapiens
aaauguguuccauugccau

SEQ ID NO: 963552 - RNA, 13 nt, Homo sapiens
aaauguuacguga

SEQ ID NO: 963553 - RNA, 13 nt, Homo sapiens
aaauguucuguca

SEQ ID NO: 963554 - RNA, 14 nt, Homo sapiens
aaauguucugucaa

SEQ ID NO: 963555 - RNA, 16 nt, Homo sapiens
aaauuaaaucugaaua

SEQ ID NO: 963556 - RNA, 20 nt, Homo sapiens
aaauuacugcccacuuguca

SEQ ID NO: 963557 - RNA, 19 nt, Homo sapiens
aaauuauugcuguauguaa

SEQ ID NO: 963558 - RNA, 20 nt, Homo sapiens
aaauucauggugcacugagc

SEQ ID NO: 963559 - RNA, 19 nt, Homo sapiens
aaauuccaaauucauggca

SEQ ID NO: 963560 - RNA, 11 nt, Homo sapiens
aaauuccccaa

SEQ ID NO: 963561 - RNA, 15 nt, Homo sapiens
aaauuccuaucucau

SEQ ID NO: 963562 - RNA, 18 nt, Homo sapiens
aaauuccucuuacuguaa

SEQ ID NO: 963563 - RNA, 17 nt, Homo sapiens
aaauucgacaacuugua

SEQ ID NO: 963564 - RNA, 16 nt, Homo sapiens
aaauucugucaggggu

SEQ ID NO: 963565 - RNA, 16 nt, Homo sapiens
aaauugggcaugccau

SEQ ID NO: 963566 - RNA, 15 nt, Homo sapiens
aaauuuaaaauucaa

SEQ ID NO: 963567 - RNA, 14 nt, Homo sapiens
aaauuucaccacug

SEQ ID NO: 963568 - RNA, 16 nt, Homo sapiens
aacaaaaacagaauuu

SEQ ID NO: 963569 - RNA, 12 nt, Homo sapiens
aacaaaaaccaa

SEQ ID NO: 963570 - RNA, 22 nt, Homo sapiens
aacaaaguuucagaguauauug

SEQ ID NO: 963571 - RNA, 12 nt, Homo sapiens
aacaacauaucu

SEQ ID NO: 963572 - RNA, 13 nt, Homo sapiens
aacaacuaccuga

SEQ ID NO: 963573 - RNA, 16 nt, Homo sapiens
aacaauggaguauucu

SEQ ID NO: 963574 - RNA, 24 nt, Homo sapiens
aacaauugguaaaacucacuguga

SEQ ID NO: 963575 - RNA, 15 nt, Homo sapiens
aacacucuucuugag

SEQ ID NO: 963576 - RNA, 17 nt, Homo sapiens
aacacucuucuugagca

SEQ ID NO: 963577 - RNA, 16 nt, Homo sapiens
aacacuugaagccauc

SEQ ID NO: 963578 - RNA, 15 nt, Homo sapiens
aacagauaagcaaga

SEQ ID NO: 963579 - RNA, 22 nt, Homo sapiens
aacaguucucagaaaugucaug

SEQ ID NO: 963580 - RNA, 17 nt, Homo sapiens
aacauaaaggacaggcc

SEQ ID NO: 963581 - RNA, 21 nt, Homo sapiens
aacauggacuuucuugcauga

SEQ ID NO: 963582 - RNA, 23 nt, Homo sapiens
aacauguaauaaaaaguauaugu

SEQ ID NO: 963583 - RNA, 12 nt, Homo sapiens
aacauguacaaa

SEQ ID NO: 963584 - RNA, 14 nt, Homo sapiens
aacauguauguaaa

SEQ ID NO: 963585 - RNA, 22 nt, Homo sapiens
aacauuauguggcccucuggau

SEQ ID NO: 963586 - RNA, 20 nt, Homo sapiens
aacauuauuagcacuucccg

SEQ ID NO: 963587 - RNA, 19 nt, Homo sapiens
aaccaacaaugugauuuau

SEQ ID NO: 963588 - RNA, 16 nt, Homo sapiens
aaccacauugaagaau

SEQ ID NO: 963589 - RNA, 21 nt, Homo sapiens
aaccacauuuagaaauguuua

SEQ ID NO: 963590 - RNA, 19 nt, Homo sapiens
aaccacggaggaugaugcc

SEQ ID NO: 963591 - RNA, 14 nt, Homo sapiens
aaccacugugccac

SEQ ID NO: 963592 - RNA, 18 nt, Homo sapiens
aaccacugugccacugac

SEQ ID NO: 963593 - RNA, 22 nt, Homo sapiens
aaccaggaacucuggaguucau

SEQ ID NO: 963594 - RNA, 17 nt, Homo sapiens
aaccaggacccugucca

SEQ ID NO: 963595 - RNA, 14 nt, Homo sapiens
aaccaguuuaucca

SEQ ID NO: 963596 - RNA, 21 nt, Homo sapiens
aacccacugaaccuucugagc

SEQ ID NO: 963597 - RNA, 20 nt, Homo sapiens
aacccaguguuuccacacuu

SEQ ID NO: 963598 - RNA, 22 nt, Homo sapiens
aacccauuccaguacaguauuc

SEQ ID NO: 963599 - RNA, 13 nt, Homo sapiens
aaccccaguggau

SEQ ID NO: 963600 - RNA, 18 nt, Homo sapiens
aaccccaguggauucuca

SEQ ID NO: 963601 - RNA, 19 nt, Homo sapiens
aacccuaucuccugacaga

SEQ ID NO: 963602 - RNA, 20 nt, Homo sapiens
aacccuucuggaaacuguga

SEQ ID NO: 963603 - RNA, 20 nt, Homo sapiens
aacccuuugugugcucucca

SEQ ID NO: 963604 - RNA, 12 nt, Homo sapiens
aaccuaccuccc

SEQ ID NO: 963605 - RNA, 20 nt, Homo sapiens
aaccucauaaaaaucuagca

SEQ ID NO: 963606 - RNA, 13 nt, Homo sapiens
aaccucucgccau

SEQ ID NO: 963607 - RNA, 15 nt, Homo sapiens
aaccucuuugcucaa

SEQ ID NO: 963608 - RNA, 23 nt, Homo sapiens
aaccugaauauaaauuuguguuc

SEQ ID NO: 963609 - RNA, 20 nt, Homo sapiens
aaccugcacggggcauuccu

SEQ ID NO: 963610 - RNA, 20 nt, Homo sapiens
aaccugcagccccucaugcc

SEQ ID NO: 963611 - RNA, 21 nt, Homo sapiens
aaccuggaaucuacaagccaa

SEQ ID NO: 963612 - RNA, 21 nt, Homo sapiens
aaccuuaaagaaccaucagca

SEQ ID NO: 963613 - RNA, 17 nt, Homo sapiens
aaccuuaaauauauaau

SEQ ID NO: 963614 - RNA, 23 nt, Homo sapiens
aaccuuuuuuaagauuuuucuca

SEQ ID NO: 963615 - RNA, 19 nt, Homo sapiens
aacggcuuggcagccaguc

SEQ ID NO: 963616 - RNA, 19 nt, Homo sapiens
aacgguuccuggugacucc

SEQ ID NO: 963617 - RNA, 19 nt, Homo sapiens
aacuaaaacuugaggcaga

SEQ ID NO: 963618 - RNA, 15 nt, Homo sapiens
aacuaagaaauggca

SEQ ID NO: 963619 - RNA, 15 nt, Homo sapiens
aacuauuaaggccuu

SEQ ID NO: 963620 - RNA, 13 nt, Homo sapiens
aacucacacuccc

SEQ ID NO: 963621 - RNA, 20 nt, Homo sapiens
aacucaccagccccacugcc

SEQ ID NO: 963622 - RNA, 15 nt, Homo sapiens
aacucagacauucca

SEQ ID NO: 963623 - RNA, 16 nt, Homo sapiens
aacucagacauuccaa

SEQ ID NO: 963624 - RNA, 19 nt, Homo sapiens
aacuccuuuuccacuuuaa

SEQ ID NO: 963625 - RNA, 16 nt, Homo sapiens
aacucuugaccucagg

SEQ ID NO: 963626 - RNA, 13 nt, Homo sapiens
aacucuugcacag

SEQ ID NO: 963627 - RNA, 13 nt, Homo sapiens
aacugaacacugc

SEQ ID NO: 963628 - RNA, 14 nt, Homo sapiens
aacugaaucacuua

SEQ ID NO: 963629 - RNA, 16 nt, Homo sapiens
aacugaaucacuuaaa

SEQ ID NO: 963630 - RNA, 21 nt, Homo sapiens
aacugcuucccuuacuuugcu

SEQ ID NO: 963631 - RNA, 23 nt, Homo sapiens
aacuggggaaugggguauggaag

SEQ ID NO: 963632 - RNA, 16 nt, Homo sapiens
aacuguagcugccaug

SEQ ID NO: 963633 - RNA, 14 nt, Homo sapiens
aacuuaagcaaagg

SEQ ID NO: 963634 - RNA, 18 nt, Homo sapiens
aacuuauuugcugcagaa

SEQ ID NO: 963635 - RNA, 14 nt, Homo sapiens
aacuucauuugaca

SEQ ID NO: 963636 - RNA, 16 nt, Homo sapiens
aacuucgugcucaggu

SEQ ID NO: 963637 - RNA, 20 nt, Homo sapiens
uccaccuuguuacacauuau

SEQ ID NO: 963638 - RNA, 17 nt, Homo sapiens
uccacucguguguuucu

SEQ ID NO: 963639 - RNA, 20 nt, Homo sapiens
uccacucuacuaaugccucu

SEQ ID NO: 963640 - RNA, 14 nt, Homo sapiens
uccacucucuacca

SEQ ID NO: 963641 - RNA, 17 nt, Homo sapiens
uccacuuugaguaccaa

SEQ ID NO: 963642 - RNA, 18 nt, Homo sapiens
uccagagacaacagguaa

SEQ ID NO: 963643 - RNA, 17 nt, Homo sapiens
uccagaucacugccaca

SEQ ID NO: 963644 - RNA, 22 nt, Homo sapiens
uccagcacaucccccucuccuc

SEQ ID NO: 963645 - RNA, 16 nt, Homo sapiens
uccagcaguuguucca

SEQ ID NO: 963646 - RNA, 20 nt, Homo sapiens
uccagccuggggaacagagc

SEQ ID NO: 963647 - RNA, 17 nt, Homo sapiens
uccagcuaccaccacgg

SEQ ID NO: 963648 - RNA, 19 nt, Homo sapiens
uccaggaauaggcauuugc

SEQ ID NO: 963649 - RNA, 21 nt, Homo sapiens
uccagguuauugcaauaaagu

SEQ ID NO: 963650 - RNA, 22 nt, Homo sapiens
uccagucuuccugacacuuuaa

SEQ ID NO: 963651 - RNA, 14 nt, Homo sapiens
uccagugcaauugu

SEQ ID NO: 963652 - RNA, 16 nt, Homo sapiens
uccauaaacaugaaaa

SEQ ID NO: 963653 - RNA, 17 nt, Homo sapiens
uccauaaauccuugaug

SEQ ID NO: 963654 - RNA, 15 nt, Homo sapiens
uccauacuucucuca

SEQ ID NO: 963655 - RNA, 13 nt, Homo sapiens
uccauagugcacu

SEQ ID NO: 963656 - RNA, 20 nt, Homo sapiens
uccauauaacaauucaguaa

SEQ ID NO: 963657 - RNA, 20 nt, Homo sapiens
uccauauagcucgagcaaaa

SEQ ID NO: 963658 - RNA, 16 nt, Homo sapiens
uccauccauccuucca

SEQ ID NO: 963659 - RNA, 20 nt, Homo sapiens
uccauccaucuuuccaucca

SEQ ID NO: 963660 - RNA, 16 nt, Homo sapiens
uccaucccuccauuca

SEQ ID NO: 963661 - RNA, 15 nt, Homo sapiens
uccaucgccuugcag

SEQ ID NO: 963662 - RNA, 14 nt, Homo sapiens
ucccaaggcugcca

SEQ ID NO: 963663 - RNA, 14 nt, Homo sapiens
ucccaccugcaucu

SEQ ID NO: 963664 - RNA, 17 nt, Homo sapiens
ucccagacucaccccau

SEQ ID NO: 963665 - RNA, 16 nt, Homo sapiens
ucccagauacacuaaa

SEQ ID NO: 963666 - RNA, 15 nt, Homo sapiens
ucccagcuacuuggg

SEQ ID NO: 963667 - RNA, 13 nt, Homo sapiens
ucccauccuugau

SEQ ID NO: 963668 - RNA, 14 nt, Homo sapiens
ucccauguggaaca

SEQ ID NO: 963669 - RNA, 11 nt, Homo sapiens
auaagcaagag

SEQ ID NO: 963670 - RNA, 14 nt, Homo sapiens
auaagcaugguguc

SEQ ID NO: 963671 - RNA, 14 nt, Homo sapiens
auaagcccaguuca

SEQ ID NO: 963672 - RNA, 19 nt, Homo sapiens
auaagucaauuccuagaag

SEQ ID NO: 963673 - RNA, 17 nt, Homo sapiens
auaagugcccucuccca

SEQ ID NO: 963674 - RNA, 13 nt, Homo sapiens
auaauaaaaccaa

SEQ ID NO: 963675 - RNA, 15 nt, Homo sapiens
auaauaaaaccaaag

SEQ ID NO: 963676 - RNA, 13 nt, Homo sapiens
auaaucuucugcc

SEQ ID NO: 963677 - RNA, 14 nt, Homo sapiens
auaaugaacacgug

SEQ ID NO: 963678 - RNA, 13 nt, Homo sapiens
auacaaguaauau

SEQ ID NO: 963679 - RNA, 13 nt, Homo sapiens
auacacagaggag

SEQ ID NO: 963680 - RNA, 12 nt, Homo sapiens
auacacauacau

SEQ ID NO: 963681 - RNA, 14 nt, Homo sapiens
auacaccagcaauu

SEQ ID NO: 963682 - RNA, 14 nt, Homo sapiens
auacaugcauauaa

SEQ ID NO: 963683 - RNA, 23 nt, Homo sapiens
auacauucccucuaauuugaacu

SEQ ID NO: 963684 - RNA, 21 nt, Homo sapiens
auaccaacuguacaaaauaac

SEQ ID NO: 963685 - RNA, 22 nt, Homo sapiens
auaccugcucuuguucuacuga

SEQ ID NO: 963686 - RNA, 17 nt, Homo sapiens
auacgauuugagccuga

SEQ ID NO: 963687 - RNA, 22 nt, Homo sapiens
auacuacugugugugcauugaa

SEQ ID NO: 963688 - RNA, 15 nt, Homo sapiens
auacuagauguuaag

SEQ ID NO: 963689 - RNA, 14 nt, Homo sapiens
auacuauugccuca

SEQ ID NO: 963690 - RNA, 18 nt, Homo sapiens
auacuguggccugaaaua

SEQ ID NO: 963691 - RNA, 19 nt, Homo sapiens
auacuuagagaaccuauag

SEQ ID NO: 963692 - RNA, 13 nt, Homo sapiens
auacuugccauca

SEQ ID NO: 963693 - RNA, 20 nt, Homo sapiens
auagaacucugggcugccau

SEQ ID NO: 963694 - RNA, 12 nt, Homo sapiens
auagaggcuagc

SEQ ID NO: 963695 - RNA, 12 nt, Homo sapiens
auagaggcuucu

SEQ ID NO: 963696 - RNA, 17 nt, Homo sapiens
auagauuucuacacuga

SEQ ID NO: 963697 - RNA, 18 nt, Homo sapiens
auagcaucuucucauucc

SEQ ID NO: 963698 - RNA, 20 nt, Homo sapiens
auaggaauguccaccaugaa

SEQ ID NO: 963699 - RNA, 15 nt, Homo sapiens
auaggagaggaugag

SEQ ID NO: 963700 - RNA, 15 nt, Homo sapiens
auaggagugaauaca

SEQ ID NO: 963701 - RNA, 21 nt, Homo sapiens
auaggguggcacagaagcuca

SEQ ID NO: 963702 - RNA, 15 nt, Homo sapiens
auagucacauggccu

SEQ ID NO: 963703 - RNA, 23 nt, Homo sapiens
auagucacauggccuaugcacau

SEQ ID NO: 963704 - RNA, 14 nt, Homo sapiens
auagucucucucuu

SEQ ID NO: 963705 - RNA, 18 nt, Homo sapiens
auagucucugcccucaua

SEQ ID NO: 963706 - RNA, 21 nt, Homo sapiens
auagugggguuccaugaguua

SEQ ID NO: 963707 - RNA, 19 nt, Homo sapiens
auauaaauuuguguucuca

SEQ ID NO: 963708 - RNA, 19 nt, Homo sapiens
auauaauucccaagcuuuu

SEQ ID NO: 963709 - RNA, 12 nt, Homo sapiens
auauaccaaauu

SEQ ID NO: 963710 - RNA, 20 nt, Homo sapiens
auauaccacauuuucuuuau

SEQ ID NO: 963711 - RNA, 15 nt, Homo sapiens
auauacuaguccuga

SEQ ID NO: 963712 - RNA, 13 nt, Homo sapiens
auauauuuauuga

SEQ ID NO: 963713 - RNA, 13 nt, Homo sapiens
auaucagaacugu

SEQ ID NO: 963714 - RNA, 14 nt, Homo sapiens
auaucaugcaaaau

SEQ ID NO: 963715 - RNA, 18 nt, Homo sapiens
auauccaggcaccaggac

SEQ ID NO: 963716 - RNA, 17 nt, Homo sapiens
auaugaagaacugagga

SEQ ID NO: 963717 - RNA, 20 nt, Homo sapiens
auaugcauaccuggauuucc

SEQ ID NO: 963718 - RNA, 17 nt, Homo sapiens
auauggacucugcacau

SEQ ID NO: 963719 - RNA, 21 nt, Homo sapiens
auauggacucugcacaugaau

SEQ ID NO: 963720 - RNA, 21 nt, Homo sapiens
auaugguccuagacaaaccau

SEQ ID NO: 963721 - RNA, 14 nt, Homo sapiens
auauguaguauaau

SEQ ID NO: 963722 - RNA, 19 nt, Homo sapiens
auauguuuuaaaauacucu

SEQ ID NO: 963723 - RNA, 19 nt, Homo sapiens
auauuaguauguaugugua

SEQ ID NO: 963724 - RNA, 13 nt, Homo sapiens
auauuauaacucu

SEQ ID NO: 963725 - RNA, 13 nt, Homo sapiens
auauuauugauuc

SEQ ID NO: 963726 - RNA, 22 nt, Homo sapiens
auauuccugguguagcacuuaa

SEQ ID NO: 963727 - RNA, 16 nt, Homo sapiens
auauuccugugacuuc

SEQ ID NO: 963728 - RNA, 16 nt, Homo sapiens
auauuuaaaacaaaga

SEQ ID NO: 963729 - RNA, 14 nt, Homo sapiens
auauuuaaucuuaa

SEQ ID NO: 963730 - RNA, 15 nt, Homo sapiens
auauuuaucuuucaa

SEQ ID NO: 963731 - RNA, 18 nt, Homo sapiens
auauuucauuuagcuuuu

SEQ ID NO: 963732 - RNA, 17 nt, Homo sapiens
auauuuccuaaggcaug

SEQ ID NO: 963733 - RNA, 23 nt, Homo sapiens
auauuuccuauuguucacuuuau

SEQ ID NO: 963734 - RNA, 17 nt, Homo sapiens
auauuuggaaugaagga

SEQ ID NO: 963735 - RNA, 16 nt, Homo sapiens
auauuuuuccacuuaa

SEQ ID NO: 963736 - RNA, 17 nt, Homo sapiens
auauuuuuccacuuaaa

SEQ ID NO: 963737 - RNA, 15 nt, Homo sapiens
aucaaagaacaaaca

SEQ ID NO: 963738 - RNA, 15 nt, Homo sapiens
aucaaaucucuucca

SEQ ID NO: 963739 - RNA, 17 nt, Homo sapiens
aucaaaucucuuccaca

SEQ ID NO: 963740 - RNA, 22 nt, Homo sapiens
aucaauauuuuuauaucaugca

SEQ ID NO: 963741 - RNA, 16 nt, Homo sapiens
aucaaucugcaguuua

SEQ ID NO: 963742 - RNA, 20 nt, Homo sapiens
aucacccucuuccugugauc

SEQ ID NO: 963743 - RNA, 18 nt, Homo sapiens
aucacgaggucaggagau

SEQ ID NO: 963744 - RNA, 18 nt, Homo sapiens
aucacuacucagugcaua

SEQ ID NO: 963745 - RNA, 14 nt, Homo sapiens
aucacugccacacu

SEQ ID NO: 963746 - RNA, 13 nt, Homo sapiens
aucagacauacag

SEQ ID NO: 963747 - RNA, 12 nt, Homo sapiens
aucagaguugcu

SEQ ID NO: 963748 - RNA, 21 nt, Homo sapiens
aucaggacucugacgucucuu

SEQ ID NO: 963749 - RNA, 15 nt, Homo sapiens
aucaggucauuauuu

SEQ ID NO: 963750 - RNA, 21 nt, Homo sapiens
aucagugaaaaagauguacag

SEQ ID NO: 963751 - RNA, 13 nt, Homo sapiens
aucauaaagucag

SEQ ID NO: 963752 - RNA, 17 nt, Homo sapiens
aucauacaaacucucac

SEQ ID NO: 963753 - RNA, 13 nt, Homo sapiens
aucaucaaaaaga

SEQ ID NO: 963754 - RNA, 19 nt, Homo sapiens
aucauccagaaguuccuca

SEQ ID NO: 963755 - RNA, 14 nt, Homo sapiens
aucauucuccuugc

SEQ ID NO: 963756 - RNA, 23 nt, Homo sapiens
auccaagacuuagagcugggaau

SEQ ID NO: 963757 - RNA, 23 nt, Homo sapiens
auccaagcaucccuuugcccaga

SEQ ID NO: 963758 - RNA, 18 nt, Homo sapiens
auccaauucccaccacua

SEQ ID NO: 963759 - RNA, 18 nt, Homo sapiens
auccaccaagaacauaag

SEQ ID NO: 963760 - RNA, 16 nt, Homo sapiens
auccacccaacccuau

SEQ ID NO: 963761 - RNA, 21 nt, Homo sapiens
auccacccaacccuaucuccu

SEQ ID NO: 963762 - RNA, 22 nt, Homo sapiens
auccacccaacccuaucuccug

SEQ ID NO: 963763 - RNA, 16 nt, Homo sapiens
auccacccaccucagc

SEQ ID NO: 963764 - RNA, 21 nt, Homo sapiens
auccaccccguugcucaagcc

SEQ ID NO: 963765 - RNA, 18 nt, Homo sapiens
auccagaugugugcaaug

SEQ ID NO: 963766 - RNA, 20 nt, Homo sapiens
auccaggaucaugagacauu

SEQ ID NO: 963767 - RNA, 19 nt, Homo sapiens
auccaucccuccauucauc

SEQ ID NO: 963768 - RNA, 18 nt, Homo sapiens
auccauugaacuaaaaua

SEQ ID NO: 963769 - RNA, 14 nt, Homo sapiens
aucccaaaugugga

SEQ ID NO: 963770 - RNA, 15 nt, Homo sapiens
aucccaaauguggaa

SEQ ID NO: 963771 - RNA, 15 nt, Homo sapiens
aucccaagucauuuc

SEQ ID NO: 963772 - RNA, 12 nt, Homo sapiens
aucccacaucca

SEQ ID NO: 963773 - RNA, 13 nt, Homo sapiens
aucccacauccca

SEQ ID NO: 963774 - RNA, 22 nt, Homo sapiens
aucccacgggaaaggagcugcu

SEQ ID NO: 963775 - RNA, 20 nt, Homo sapiens
aucguugcccccauuucuga

SEQ ID NO: 963776 - RNA, 15 nt, Homo sapiens
aucuagagcuuaaug

SEQ ID NO: 963777 - RNA, 19 nt, Homo sapiens
aucuagccuaaaguauaca

SEQ ID NO: 963778 - RNA, 14 nt, Homo sapiens
aucuccagcaugua

SEQ ID NO: 963779 - RNA, 23 nt, Homo sapiens
aucucuaaaugugacaugcaaag

SEQ ID NO: 963780 - RNA, 21 nt, Homo sapiens
aucucugccucucccaggcug

SEQ ID NO: 963781 - RNA, 13 nt, Homo sapiens
aucucugucucaa

SEQ ID NO: 963782 - RNA, 17 nt, Homo sapiens
aucugauguaacaaggu

SEQ ID NO: 963783 - RNA, 23 nt, Homo sapiens
aucugauuuguaacccacugaga

SEQ ID NO: 963784 - RNA, 22 nt, Homo sapiens
aucugcagggagcaacucucca

SEQ ID NO: 963785 - RNA, 23 nt, Homo sapiens
aucuggcccuugcuuaccucuca

SEQ ID NO: 963786 - RNA, 16 nt, Homo sapiens
aucuuaaaacaaauuc

SEQ ID NO: 963787 - RNA, 20 nt, Homo sapiens
aucuuaaaugagaccaaagu

SEQ ID NO: 963788 - RNA, 17 nt, Homo sapiens
aucuuaacaaagccuuu

SEQ ID NO: 963789 - RNA, 14 nt, Homo sapiens
aucuuagugccuga

SEQ ID NO: 963790 - RNA, 19 nt, Homo sapiens
aucuuccccaagagggacu

SEQ ID NO: 963791 - RNA, 22 nt, Homo sapiens
aucuucccuuuauuacaagaag

SEQ ID NO: 963792 - RNA, 16 nt, Homo sapiens
aucuucgggaccagga

SEQ ID NO: 963793 - RNA, 22 nt, Homo sapiens
aucuucgggaccaggauuugca

SEQ ID NO: 963794 - RNA, 15 nt, Homo sapiens
aucuuuagggaauga

SEQ ID NO: 963795 - RNA, 14 nt, Homo sapiens
aucuuucauccuug

SEQ ID NO: 963796 - RNA, 15 nt, Homo sapiens
aucuuuguaccaaaa

SEQ ID NO: 963797 - RNA, 20 nt, Homo sapiens
aucuuuucuaaucacagugu

SEQ ID NO: 963798 - RNA, 19 nt, Homo sapiens
augaaauggaggaucucua

SEQ ID NO: 963799 - RNA, 14 nt, Homo sapiens
augaaauuaacaca

SEQ ID NO: 963800 - RNA, 22 nt, Homo sapiens
augaacuugcacuuguuauauu

SEQ ID NO: 963801 - RNA, 22 nt, Homo sapiens
augaagguaacuagaaagugag

SEQ ID NO: 963802 - RNA, 15 nt, Homo sapiens
augaauagacuaucu

SEQ ID NO: 963803 - RNA, 13 nt, Homo sapiens
augaauuauuaua

SEQ ID NO: 963804 - RNA, 18 nt, Homo sapiens
augacagugacacccaga

SEQ ID NO: 963805 - RNA, 20 nt, Homo sapiens
augaccagaagccuuggaac

SEQ ID NO: 963806 - RNA, 18 nt, Homo sapiens
augaccugaucauuacau

SEQ ID NO: 963807 - RNA, 18 nt, Homo sapiens
augacugccuugccuccu

SEQ ID NO: 963808 - RNA, 17 nt, Homo sapiens
augacuuuuauacuauu

SEQ ID NO: 963809 - RNA, 22 nt, Homo sapiens
augagaaacuuugaucucugcu

SEQ ID NO: 963810 - RNA, 17 nt, Homo sapiens
augagaguuccuucuca

SEQ ID NO: 963811 - RNA, 13 nt, Homo sapiens
augagaugugagc

SEQ ID NO: 963812 - RNA, 23 nt, Homo sapiens
augagccauuuuuugagucuccu

SEQ ID NO: 963813 - RNA, 17 nt, Homo sapiens
augagcuauccuuucaa

SEQ ID NO: 963814 - RNA, 16 nt, Homo sapiens
augaggugccacccag

SEQ ID NO: 963815 - RNA, 15 nt, Homo sapiens
augagugauccugcc

SEQ ID NO: 963816 - RNA, 16 nt, Homo sapiens
augaguugaggccacu

SEQ ID NO: 963817 - RNA, 20 nt, Homo sapiens
augaguugaggccacugugu

SEQ ID NO: 963818 - RNA, 18 nt, Homo sapiens
augaucagaagacuuuaa

SEQ ID NO: 963819 - RNA, 11 nt, Homo sapiens
augaugccaug

SEQ ID NO: 963820 - RNA, 15 nt, Homo sapiens
augaugccauggcaa

SEQ ID NO: 963821 - RNA, 17 nt, Homo sapiens
augaugugaguauuuag

SEQ ID NO: 963822 - RNA, 21 nt, Homo sapiens
augauucuuuguuacaggcac

SEQ ID NO: 963823 - RNA, 12 nt, Homo sapiens
augcaagugcaa

SEQ ID NO: 963824 - RNA, 19 nt, Homo sapiens
augcagaccucaugcccag

SEQ ID NO: 963825 - RNA, 13 nt, Homo sapiens
augcagcuuugca

SEQ ID NO: 963826 - RNA, 21 nt, Homo sapiens
augcauaaauaugcagugaua

SEQ ID NO: 963827 - RNA, 23 nt, Homo sapiens
augcauguuuccugcucuucccu

SEQ ID NO: 963828 - RNA, 15 nt, Homo sapiens
augcauuuaauaaag

SEQ ID NO: 963829 - RNA, 20 nt, Homo sapiens
augccaauaaaguuugccca

SEQ ID NO: 963830 - RNA, 21 nt, Homo sapiens
augccaauaaaguuugcccau

SEQ ID NO: 963831 - RNA, 14 nt, Homo sapiens
augccacccuagcc

SEQ ID NO: 963832 - RNA, 15 nt, Homo sapiens
augccacccuagcca

SEQ ID NO: 963833 - RNA, 22 nt, Homo sapiens
augccauccagaugugugcaau

SEQ ID NO: 963834 - RNA, 17 nt, Homo sapiens
augccucucuacagucu

SEQ ID NO: 963835 - RNA, 22 nt, Homo sapiens
augccuuaaaccuaccucccac

SEQ ID NO: 963836 - RNA, 12 nt, Homo sapiens
augccuuacucu

SEQ ID NO: 963837 - RNA, 14 nt, Homo sapiens
augcgggggugccu

SEQ ID NO: 963838 - RNA, 14 nt, Homo sapiens
augcuaacaaagac

SEQ ID NO: 963839 - RNA, 17 nt, Homo sapiens
augcuaauuuuauuaua

SEQ ID NO: 963840 - RNA, 19 nt, Homo sapiens
augcugagguacagaagcc

SEQ ID NO: 963841 - RNA, 18 nt, Homo sapiens
augcuuucccacucucag

SEQ ID NO: 963842 - RNA, 18 nt, Homo sapiens
augcuuuucccacucuca

SEQ ID NO: 963843 - RNA, 17 nt, Homo sapiens
auggaaaaacugaggcu

SEQ ID NO: 963844 - RNA, 20 nt, Homo sapiens
auggaaguuuuccuacacuu

SEQ ID NO: 963845 - RNA, 12 nt, Homo sapiens
auggacucugca

SEQ ID NO: 963846 - RNA, 22 nt, Homo sapiens
auggacuggagcucaucugcaa

SEQ ID NO: 963847 - RNA, 23 nt, Homo sapiens
auggacuggagcucaucugcaaa

SEQ ID NO: 963848 - RNA, 18 nt, Homo sapiens
auggaguucuugugccau

SEQ ID NO: 963849 - RNA, 17 nt, Homo sapiens
auggcaaaauuagucuu

SEQ ID NO: 963850 - RNA, 17 nt, Homo sapiens
auggcaaaugcugugaa

SEQ ID NO: 963851 - RNA, 18 nt, Homo sapiens
auggcaauuggcaucauu

SEQ ID NO: 963852 - RNA, 13 nt, Homo sapiens
auggcacaaacac

SEQ ID NO: 963853 - RNA, 15 nt, Homo sapiens
auggcagaagacacc

SEQ ID NO: 963854 - RNA, 14 nt, Homo sapiens
auggcagccuacuc

SEQ ID NO: 963855 - RNA, 14 nt, Homo sapiens
auggcauauggucc

SEQ ID NO: 963856 - RNA, 14 nt, Homo sapiens
auggcauccaagac

SEQ ID NO: 963857 - RNA, 12 nt, Homo sapiens
auggccaugcag

SEQ ID NO: 963858 - RNA, 14 nt, Homo sapiens
augggauggcaaau

SEQ ID NO: 963859 - RNA, 20 nt, Homo sapiens
augggcucuccggggccauu

SEQ ID NO: 963860 - RNA, 16 nt, Homo sapiens
auggggcaggccaccu

SEQ ID NO: 963861 - RNA, 16 nt, Homo sapiens
auggggcccuguccag

SEQ ID NO: 963862 - RNA, 19 nt, Homo sapiens
auggggcccuguccaggua

SEQ ID NO: 963863 - RNA, 17 nt, Homo sapiens
augggucuaggacacag

SEQ ID NO: 963864 - RNA, 15 nt, Homo sapiens
auggguugcauuugg

SEQ ID NO: 963865 - RNA, 16 nt, Homo sapiens
auggugaaacccuguc

SEQ ID NO: 963866 - RNA, 14 nt, Homo sapiens
auggugaagugcuu

SEQ ID NO: 963867 - RNA, 15 nt, Homo sapiens
auggugacagucucc

SEQ ID NO: 963868 - RNA, 14 nt, Homo sapiens
auggugcucagccc

SEQ ID NO: 963869 - RNA, 18 nt, Homo sapiens
augguguaauaagacaua

SEQ ID NO: 963870 - RNA, 21 nt, Homo sapiens
augguguggccuguggcuguc

SEQ ID NO: 963871 - RNA, 22 nt, Homo sapiens
auguaugucuuggacacuguac

SEQ ID NO: 963872 - RNA, 16 nt, Homo sapiens
auguauguguaccuaa

SEQ ID NO: 963873 - RNA, 20 nt, Homo sapiens
augucacugccugacauuca

SEQ ID NO: 963874 - RNA, 21 nt, Homo sapiens
augucacugccugacauucac

SEQ ID NO: 963875 - RNA, 19 nt, Homo sapiens
augucacuucccugcuuaa

SEQ ID NO: 963876 - RNA, 18 nt, Homo sapiens
gaaguuugcuuuguacug

SEQ ID NO: 963877 - RNA, 12 nt, Homo sapiens
gaauaagccuuc

SEQ ID NO: 963878 - RNA, 13 nt, Homo sapiens
gaauaggcauuug

SEQ ID NO: 963879 - RNA, 15 nt, Homo sapiens
gaaucagaccugguu

SEQ ID NO: 963880 - RNA, 22 nt, Homo sapiens
gaaucagcauuuagucuugcca

SEQ ID NO: 963881 - RNA, 20 nt, Homo sapiens
gaaucccacccacaugugac

SEQ ID NO: 963882 - RNA, 22 nt, Homo sapiens
gaaucccuuugcaccugagacc

SEQ ID NO: 963883 - RNA, 16 nt, Homo sapiens
gaauccuggcagccca

SEQ ID NO: 963884 - RNA, 22 nt, Homo sapiens
gaaucuggcaggaaucuaucca

SEQ ID NO: 963885 - RNA, 21 nt, Homo sapiens
gaaugagcuugugugcccuga

SEQ ID NO: 963886 - RNA, 18 nt, Homo sapiens
gaaugcaacuccauuuac

SEQ ID NO: 963887 - RNA, 21 nt, Homo sapiens
gaaugugucugcguuccuguu

SEQ ID NO: 963888 - RNA, 14 nt, Homo sapiens
gaauuuggggcuuc

SEQ ID NO: 963889 - RNA, 20 nt, Homo sapiens
gaauuuuugcuaugcuguaa

SEQ ID NO: 963890 - RNA, 22 nt, Homo sapiens
gaauuuuuuuguaauaagcaau

SEQ ID NO: 963891 - RNA, 22 nt, Homo sapiens
gacaaauauuccuuugcauauu

SEQ ID NO: 963892 - RNA, 15 nt, Homo sapiens
gacaacuuagcucag

SEQ ID NO: 963893 - RNA, 16 nt, Homo sapiens
gacaagacacugagga

SEQ ID NO: 963894 - RNA, 22 nt, Homo sapiens
gacaagagaugggaaugaggug

SEQ ID NO: 963895 - RNA, 15 nt, Homo sapiens
gacaagcagcuggug

SEQ ID NO: 963896 - RNA, 12 nt, Homo sapiens
gacaagggauuu

SEQ ID NO: 963897 - RNA, 14 nt, Homo sapiens
gacaauacuggggu

SEQ ID NO: 963898 - RNA, 13 nt, Homo sapiens
gacaaucacuaca

SEQ ID NO: 963899 - RNA, 21 nt, Homo sapiens
gacacauuaaugauaaacuca

SEQ ID NO: 963900 - RNA, 19 nt, Homo sapiens
gacacauuggaaugccuug

SEQ ID NO: 963901 - RNA, 24 nt, Homo sapiens
gacacccuucucccacucuccuag

SEQ ID NO: 963902 - RNA, 21 nt, Homo sapiens
gacacugaaaguuuuguaaaa

SEQ ID NO: 963903 - RNA, 16 nt, Homo sapiens
gacacugccuggggug

SEQ ID NO: 963904 - RNA, 17 nt, Homo sapiens
gacagaaggugccacuu

SEQ ID NO: 963905 - RNA, 18 nt, Homo sapiens
gacagcaucccuucccac

SEQ ID NO: 963906 - RNA, 15 nt, Homo sapiens
gacagccugcagcag

SEQ ID NO: 963907 - RNA, 16 nt, Homo sapiens
gacagcugugugacau

SEQ ID NO: 963908 - RNA, 18 nt, Homo sapiens
gacaggcuccucugggga

SEQ ID NO: 963909 - RNA, 20 nt, Homo sapiens
gacaguccaaaccacuccac

SEQ ID NO: 963910 - RNA, 15 nt, Homo sapiens
gacagugccucuucc

SEQ ID NO: 963911 - RNA, 20 nt, Homo sapiens
gacauaaaggaaaagacaca

SEQ ID NO: 963912 - RNA, 23 nt, Homo sapiens
gacauacauucccucuaauuuga

SEQ ID NO: 963913 - RNA, 14 nt, Homo sapiens
gacauggaccucca

SEQ ID NO: 963914 - RNA, 17 nt, Homo sapiens
gaccaccaccaggacug

SEQ ID NO: 963915 - RNA, 18 nt, Homo sapiens
gaccacugcuggaccaag

SEQ ID NO: 963916 - RNA, 15 nt, Homo sapiens
cuugguguaauuuga

SEQ ID NO: 963917 - RNA, 15 nt, Homo sapiens
cuuguaguaugcuua

SEQ ID NO: 963918 - RNA, 22 nt, Homo sapiens
cuugugucuuuggaggugcugc

SEQ ID NO: 963919 - RNA, 22 nt, Homo sapiens
cuuguucaucauccagaugugg

SEQ ID NO: 963920 - RNA, 16 nt, Homo sapiens
cuuguuguuucuugcc

SEQ ID NO: 963921 - RNA, 18 nt, Homo sapiens
cuuguuguuucuugccug

SEQ ID NO: 963922 - RNA, 14 nt, Homo sapiens
cuuuaccuuuucag

SEQ ID NO: 963923 - RNA, 22 nt, Homo sapiens
cuuuauaaauuuuuauaauuca

SEQ ID NO: 963924 - RNA, 21 nt, Homo sapiens
cuuucagaaagcuuugaauac

SEQ ID NO: 963925 - RNA, 14 nt, Homo sapiens
cuuucagugcuuuu

SEQ ID NO: 963926 - RNA, 11 nt, Homo sapiens
cuuucauguca

SEQ ID NO: 963927 - RNA, 20 nt, Homo sapiens
cuuuccauccauuaccucca

SEQ ID NO: 963928 - RNA, 18 nt, Homo sapiens
cuuucccacacugugaac

SEQ ID NO: 963929 - RNA, 16 nt, Homo sapiens
cuuuccucagaucauc

SEQ ID NO: 963930 - RNA, 13 nt, Homo sapiens
cuuuccuguucca

SEQ ID NO: 963931 - RNA, 18 nt, Homo sapiens
cuuuccuguuccagagag

SEQ ID NO: 963932 - RNA, 22 nt, Homo sapiens
cuuucuacaacugauugcaaca

SEQ ID NO: 963933 - RNA, 21 nt, Homo sapiens
cuuucucgugguagaagccag

SEQ ID NO: 963934 - RNA, 23 nt, Homo sapiens
cuuucucgugguagaagccagua

SEQ ID NO: 963935 - RNA, 22 nt, Homo sapiens
cuuucugggaugucacagucca

SEQ ID NO: 963936 - RNA, 22 nt, Homo sapiens
cuuugaauauguaguaucuaua

SEQ ID NO: 963937 - RNA, 15 nt, Homo sapiens
cuuugagcugagugc

SEQ ID NO: 963938 - RNA, 22 nt, Homo sapiens
cuuugagcugagugcugaaaua

SEQ ID NO: 963939 - RNA, 14 nt, Homo sapiens
cuuugauguuccuu

SEQ ID NO: 963940 - RNA, 22 nt, Homo sapiens
cuuugcuaaugcuaugcaaaaa

SEQ ID NO: 963941 - RNA, 20 nt, Homo sapiens
cuuugcugaaugucauuuua

SEQ ID NO: 963942 - RNA, 19 nt, Homo sapiens
cuuuggaccuaauccaagc

SEQ ID NO: 963943 - RNA, 17 nt, Homo sapiens
cuuuggccccacuuuga

SEQ ID NO: 963944 - RNA, 18 nt, Homo sapiens
cuuugggauucuuuccau

SEQ ID NO: 963945 - RNA, 16 nt, Homo sapiens
cuuuggugcuuuucac

SEQ ID NO: 963946 - RNA, 18 nt, Homo sapiens
cuuuguaagaguguagaa

SEQ ID NO: 963947 - RNA, 15 nt, Homo sapiens
cuuuguaagugcagg

SEQ ID NO: 963948 - RNA, 19 nt, Homo sapiens
cuuugucugucaaucacag

SEQ ID NO: 963949 - RNA, 13 nt, Homo sapiens
cuuugugcugcgc

SEQ ID NO: 963950 - RNA, 15 nt, Homo sapiens
cuuugugguagcuua

SEQ ID NO: 963951 - RNA, 19 nt, Homo sapiens
cuuuuauacucagcuuucu

SEQ ID NO: 963952 - RNA, 14 nt, Homo sapiens
cuuuuauagaggcu

SEQ ID NO: 963953 - RNA, 15 nt, Homo sapiens
cuuuucuuuccucag

SEQ ID NO: 963954 - RNA, 13 nt, Homo sapiens
cuuuuguacugaa

SEQ ID NO: 963955 - RNA, 19 nt, Homo sapiens
augugggggaggagggaga

SEQ ID NO: 963956 - RNA, 21 nt, Homo sapiens
auguguccgugaaaguuguga

SEQ ID NO: 963957 - RNA, 13 nt, Homo sapiens
auguuaaagggau

SEQ ID NO: 963958 - RNA, 15 nt, Homo sapiens
auguuaagaguacua

SEQ ID NO: 963959 - RNA, 19 nt, Homo sapiens
auguucugucaaauguguc

SEQ ID NO: 963960 - RNA, 19 nt, Homo sapiens
auguugauguguccgugaa

SEQ ID NO: 963961 - RNA, 16 nt, Homo sapiens
auguuuucaaaaccaa

SEQ ID NO: 963962 - RNA, 20 nt, Homo sapiens
auguuuuuuuaaaccucaua

SEQ ID NO: 963963 - RNA, 16 nt, Homo sapiens
auuaaagcauuuccua

SEQ ID NO: 963964 - RNA, 11 nt, Homo sapiens
auuaaagucag

SEQ ID NO: 963965 - RNA, 18 nt, Homo sapiens
auuaacgguggugaaaag

SEQ ID NO: 963966 - RNA, 24 nt, Homo sapiens
auuaaggccuuuuccacacgcauu

SEQ ID NO: 963967 - RNA, 14 nt, Homo sapiens
auuaagugacuaua

SEQ ID NO: 963968 - RNA, 14 nt, Homo sapiens
auuaaguggcuuuu

SEQ ID NO: 963969 - RNA, 17 nt, Homo sapiens
auuaaucauacaaacuc

SEQ ID NO: 963970 - RNA, 14 nt, Homo sapiens
auuaauguuuucaa

SEQ ID NO: 963971 - RNA, 17 nt, Homo sapiens
auuaauucagcucuuca

SEQ ID NO: 963972 - RNA, 15 nt, Homo sapiens
auuacaguguagcua

SEQ ID NO: 963973 - RNA, 16 nt, Homo sapiens
auuacauggcuguggu

SEQ ID NO: 963974 - RNA, 15 nt, Homo sapiens
auuaccuccauccau

SEQ ID NO: 963975 - RNA, 19 nt, Homo sapiens
auuacugcccacuugucaa

SEQ ID NO: 963976 - RNA, 19 nt, Homo sapiens
auuagaaaauuuuauggac

SEQ ID NO: 963977 - RNA, 16 nt, Homo sapiens
auuagaauauccauga

SEQ ID NO: 963978 - RNA, 17 nt, Homo sapiens
auuagaauauccaugac

SEQ ID NO: 963979 - RNA, 19 nt, Homo sapiens
auuagcccgcuagcauuag

SEQ ID NO: 963980 - RNA, 14 nt, Homo sapiens
auuaguaacauuca

SEQ ID NO: 963981 - RNA, 21 nt, Homo sapiens
auuauagaauucuguacuuga

SEQ ID NO: 963982 - RNA, 16 nt, Homo sapiens
auuauauauacuauau

SEQ ID NO: 963983 - RNA, 23 nt, Homo sapiens
auuauaugaaguuuaaauucuag

SEQ ID NO: 963984 - RNA, 14 nt, Homo sapiens
auuauuaacaaagu

SEQ ID NO: 963985 - RNA, 15 nt, Homo sapiens
auuauucuucuuuau

SEQ ID NO: 963986 - RNA, 22 nt, Homo sapiens
auuauuugcuauggcaggauaa

SEQ ID NO: 963987 - RNA, 20 nt, Homo sapiens
auuauuugucauucauucaa

SEQ ID NO: 963988 - RNA, 14 nt, Homo sapiens
auucaaaaguauug

SEQ ID NO: 963989 - RNA, 21 nt, Homo sapiens
auucaaagcauggacauuuag

SEQ ID NO: 963990 - RNA, 17 nt, Homo sapiens
auucaauuaguggucau

SEQ ID NO: 963991 - RNA, 21 nt, Homo sapiens
auucaauuaguggucauaaaa

SEQ ID NO: 963992 - RNA, 12 nt, Homo sapiens
auucacauuuag

SEQ ID NO: 963993 - RNA, 16 nt, Homo sapiens
auucaccgugaaauag

SEQ ID NO: 963994 - RNA, 23 nt, Homo sapiens
auucagagcuauggugcuugcug

SEQ ID NO: 963995 - RNA, 14 nt, Homo sapiens
auuccaagaacuau

SEQ ID NO: 963996 - RNA, 13 nt, Homo sapiens
auuccagugccag

SEQ ID NO: 963997 - RNA, 18 nt, Homo sapiens
auucccaccacuaaaaaa

SEQ ID NO: 963998 - RNA, 19 nt, Homo sapiens
auuccuauuggaaacagag

SEQ ID NO: 963999 - RNA, 16 nt, Homo sapiens
auuccugaucccaugg

SEQ ID NO: 964000 - RNA, 16 nt, Homo sapiens
auuccuggcucuaccc

SEQ ID NO: 964001 - RNA, 13 nt, Homo sapiens
auuccugugacuu

SEQ ID NO: 964002 - RNA, 16 nt, Homo sapiens
auuccuuagauaccuu

SEQ ID NO: 964003 - RNA, 23 nt, Homo sapiens
auucgaaugacgguaaguguucu

SEQ ID NO: 964004 - RNA, 15 nt, Homo sapiens
auucuauccaucucc

SEQ ID NO: 964005 - RNA, 21 nt, Homo sapiens
auucucccaaaguaccuugaa

SEQ ID NO: 964006 - RNA, 20 nt, Homo sapiens
auucucuaaccgaauauuca

SEQ ID NO: 964007 - RNA, 14 nt, Homo sapiens
auucugaugcauac

SEQ ID NO: 964008 - RNA, 21 nt, Homo sapiens
auucugauuauugaguuccag

SEQ ID NO: 964009 - RNA, 17 nt, Homo sapiens
auucuggaccucugggu

SEQ ID NO: 964010 - RNA, 22 nt, Homo sapiens
auucuggcaucuuagaccucca

SEQ ID NO: 964011 - RNA, 23 nt, Homo sapiens
auucuguggugggaacauucgag

SEQ ID NO: 964012 - RNA, 22 nt, Homo sapiens
auucuuccuaaugucagaacag

SEQ ID NO: 964013 - RNA, 16 nt, Homo sapiens
auucuuggaccaugcc

SEQ ID NO: 964014 - RNA, 14 nt, Homo sapiens
auucuuuguuacag

SEQ ID NO: 964015 - RNA, 19 nt, Homo sapiens
auucuuuuucaguuuuacc

SEQ ID NO: 964016 - RNA, 12 nt, Homo sapiens
auugaagacauu

SEQ ID NO: 964017 - RNA, 13 nt, Homo sapiens
auugaauuaucuu

SEQ ID NO: 964018 - RNA, 16 nt, Homo sapiens
auugagaucacuacuc

SEQ ID NO: 964019 - RNA, 20 nt, Homo sapiens
auugauucacuuacugacuu

SEQ ID NO: 964020 - RNA, 21 nt, Homo sapiens
auugcaccauacuccuugcuu

SEQ ID NO: 964021 - RNA, 15 nt, Homo sapiens
auugcauacuuugua

SEQ ID NO: 964022 - RNA, 19 nt, Homo sapiens
auugccacggaaacauaca

SEQ ID NO: 964023 - RNA, 12 nt, Homo sapiens
auugccagcaaa

SEQ ID NO: 964024 - RNA, 18 nt, Homo sapiens
auugccuugagguacuuu

SEQ ID NO: 964025 - RNA, 14 nt, Homo sapiens
auugcuaaaacagc

SEQ ID NO: 964026 - RNA, 16 nt, Homo sapiens
auuggaacucuacuca

SEQ ID NO: 964027 - RNA, 13 nt, Homo sapiens
auugggcaugcca

SEQ ID NO: 964028 - RNA, 12 nt, Homo sapiens
auugguaaaaac

SEQ ID NO: 964029 - RNA, 21 nt, Homo sapiens
auuguacuuaaaccuccugcu

SEQ ID NO: 964030 - RNA, 16 nt, Homo sapiens
caagagcugagaaaca

SEQ ID NO: 964031 - RNA, 21 nt, Homo sapiens
caagaggggguggaggggugu

SEQ ID NO: 964032 - RNA, 17 nt, Homo sapiens
caagaguucuaaauaca

SEQ ID NO: 964033 - RNA, 20 nt, Homo sapiens
caagauggacacgagccaca

SEQ ID NO: 964034 - RNA, 21 nt, Homo sapiens
caagauggggcgagccaggac

SEQ ID NO: 964035 - RNA, 16 nt, Homo sapiens
caagauugcaccacug

SEQ ID NO: 964036 - RNA, 20 nt, Homo sapiens
caagauugcaccacugcucu

SEQ ID NO: 964037 - RNA, 22 nt, Homo sapiens
caagauuggucucccauaugca

SEQ ID NO: 964038 - RNA, 22 nt, Homo sapiens
caagcugcucugagccacagug

SEQ ID NO: 964039 - RNA, 15 nt, Homo sapiens
caaggaauaauucaa

SEQ ID NO: 964040 - RNA, 15 nt, Homo sapiens
caaggacucuuccac

SEQ ID NO: 964041 - RNA, 19 nt, Homo sapiens
caaggguaugggaagccau

SEQ ID NO: 964042 - RNA, 21 nt, Homo sapiens
caagggucaauuguaacuaau

SEQ ID NO: 964043 - RNA, 23 nt, Homo sapiens
caaggugggccuugcuaccucaa

SEQ ID NO: 964044 - RNA, 21 nt, Homo sapiens
caaguauguuuguacaguaug

SEQ ID NO: 964045 - RNA, 15 nt, Homo sapiens
caagucaacacucuu

SEQ ID NO: 964046 - RNA, 14 nt, Homo sapiens
caagucagcuccag

SEQ ID NO: 964047 - RNA, 22 nt, Homo sapiens
caagucccuggaaaaggagcuu

SEQ ID NO: 964048 - RNA, 18 nt, Homo sapiens
caagugaggagugccagc

SEQ ID NO: 964049 - RNA, 21 nt, Homo sapiens
caagugaggagugccagcuca

SEQ ID NO: 964050 - RNA, 13 nt, Homo sapiens
caagugccuucac

SEQ ID NO: 964051 - RNA, 20 nt, Homo sapiens
caagugguguuuauugcaau

SEQ ID NO: 964052 - RNA, 13 nt, Homo sapiens
caaguuguuuaaa

SEQ ID NO: 964053 - RNA, 18 nt, Homo sapiens
caauacuuagagaaccua

SEQ ID NO: 964054 - RNA, 13 nt, Homo sapiens
caauaucauguga

SEQ ID NO: 964055 - RNA, 15 nt, Homo sapiens
caauaucaugugauu

SEQ ID NO: 964056 - RNA, 21 nt, Homo sapiens
caauauuuuuauaucaugcaa

SEQ ID NO: 964057 - RNA, 22 nt, Homo sapiens
caauauuuuuauaucaugcaaa

SEQ ID NO: 964058 - RNA, 12 nt, Homo sapiens
caaucuguaaac

SEQ ID NO: 964059 - RNA, 19 nt, Homo sapiens
caaucuuaaaacaaauuca

SEQ ID NO: 964060 - RNA, 19 nt, Homo sapiens
caaugaucaccgacugaaa

SEQ ID NO: 964061 - RNA, 20 nt, Homo sapiens
caaugcccugugcaugccau

SEQ ID NO: 964062 - RNA, 11 nt, Homo sapiens
caaugcuauaa

SEQ ID NO: 964063 - RNA, 21 nt, Homo sapiens
caauggcuuguucaucaucca

SEQ ID NO: 964064 - RNA, 15 nt, Homo sapiens
caaugguugaugaua

SEQ ID NO: 964065 - RNA, 11 nt, Homo sapiens
caaugucuucc

SEQ ID NO: 964066 - RNA, 16 nt, Homo sapiens
caauuauuugaagauu

SEQ ID NO: 964067 - RNA, 18 nt, Homo sapiens
caauuauuugaagauuua

SEQ ID NO: 964068 - RNA, 15 nt, Homo sapiens
caauucccaccacua

SEQ ID NO: 964069 - RNA, 14 nt, Homo sapiens
caauuccugugauu

SEQ ID NO: 964070 - RNA, 17 nt, Homo sapiens
aaaaccaucuugugucu

SEQ ID NO: 964071 - RNA, 20 nt, Homo sapiens
aaaaccccaucuuuacuaaa

SEQ ID NO: 964072 - RNA, 14 nt, Homo sapiens
aaaacucacuguga

SEQ ID NO: 964073 - RNA, 15 nt, Homo sapiens
aaaacucugcaugua

SEQ ID NO: 964074 - RNA, 17 nt, Homo sapiens
aaaacuguguugccaca

SEQ ID NO: 964075 - RNA, 21 nt, Homo sapiens
aaaagaucuugaauagucuca

SEQ ID NO: 964076 - RNA, 14 nt, Homo sapiens
aaaagcagcuacca

SEQ ID NO: 964077 - RNA, 16 nt, Homo sapiens
aaaaggauaguaagca

SEQ ID NO: 964078 - RNA, 12 nt, Homo sapiens
aaaaggucuuua

SEQ ID NO: 964079 - RNA, 20 nt, Homo sapiens
aaaagguuaaauauugucau

SEQ ID NO: 964080 - RNA, 21 nt, Homo sapiens
aaaaguugguguugacauaca

SEQ ID NO: 964081 - RNA, 19 nt, Homo sapiens
aaaauaaaagaucuugaau

SEQ ID NO: 964082 - RNA, 23 nt, Homo sapiens
aaaauaaaauguuucauuaugca

SEQ ID NO: 964083 - RNA, 17 nt, Homo sapiens
aaaauacagauuugaau

SEQ ID NO: 964084 - RNA, 16 nt, Homo sapiens
aaaauauagacauucu

SEQ ID NO: 964085 - RNA, 12 nt, Homo sapiens
aaaauauauaca

SEQ ID NO: 964086 - RNA, 18 nt, Homo sapiens
aaaaucccaagucauuuc

SEQ ID NO: 964087 - RNA, 21 nt, Homo sapiens
aaaaugacauuaaaugcaaua

SEQ ID NO: 964088 - RNA, 14 nt, Homo sapiens
aaaaugauuuacau

SEQ ID NO: 964089 - RNA, 21 nt, Homo sapiens
aaaaugcuauuguugcaauau

SEQ ID NO: 964090 - RNA, 19 nt, Homo sapiens
aaaauggaggccauugugu

SEQ ID NO: 964091 - RNA, 21 nt, Homo sapiens
aaaauggucacguuuggugcu

SEQ ID NO: 964092 - RNA, 16 nt, Homo sapiens
aaaauguaauuacuua

SEQ ID NO: 964093 - RNA, 22 nt, Homo sapiens
aaaauguguuccauugccauag

SEQ ID NO: 964094 - RNA, 20 nt, Homo sapiens
aaaauuauuuauuguuacag

SEQ ID NO: 964095 - RNA, 20 nt, Homo sapiens
aaaauucuauguuaauuaca

SEQ ID NO: 964096 - RNA, 20 nt, Homo sapiens
aaaauuggaacucuacucaa

SEQ ID NO: 964097 - RNA, 13 nt, Homo sapiens
aaacaacauuuau

SEQ ID NO: 964098 - RNA, 13 nt, Homo sapiens
aaacaacuuugua

SEQ ID NO: 964099 - RNA, 21 nt, Homo sapiens
aaacacacgagcaaacccaga

SEQ ID NO: 964100 - RNA, 17 nt, Homo sapiens
aaacacccaauaccuua

SEQ ID NO: 964101 - RNA, 21 nt, Homo sapiens
aaacacccgacgucauguauu

SEQ ID NO: 964102 - RNA, 23 nt, Homo sapiens
aaacacucuugaauagacuucca

SEQ ID NO: 964103 - RNA, 20 nt, Homo sapiens
aaacagccaagauuuuccuc

SEQ ID NO: 964104 - RNA, 21 nt, Homo sapiens
aaacagggcugccuucuggcc

SEQ ID NO: 964105 - RNA, 22 nt, Homo sapiens
aaacagggcugccuucuggccu

SEQ ID NO: 964106 - RNA, 15 nt, Homo sapiens
aaaccaacaaaaaga

SEQ ID NO: 964107 - RNA, 17 nt, Homo sapiens
aaaccaaggacugagca

SEQ ID NO: 964108 - RNA, 21 nt, Homo sapiens
aaaccacuuuuuuuuccccaa

SEQ ID NO: 964109 - RNA, 22 nt, Homo sapiens
aaaccauaaaacccuauacaag

SEQ ID NO: 964110 - RNA, 19 nt, Homo sapiens
aaaccccaucuuuacuaaa

SEQ ID NO: 964111 - RNA, 21 nt, Homo sapiens
aaaccccccagagcucuuuac

SEQ ID NO: 964112 - RNA, 18 nt, Homo sapiens
aaaccccuucuuuacuuc

SEQ ID NO: 964113 - RNA, 11 nt, Homo sapiens
aaaccuaccaa

SEQ ID NO: 964114 - RNA, 16 nt, Homo sapiens
aaaccuaggucuccag

SEQ ID NO: 964115 - RNA, 14 nt, Homo sapiens
aaaccuccugcugu

SEQ ID NO: 964116 - RNA, 22 nt, Homo sapiens
aaaccuggaaucuacaagccaa

SEQ ID NO: 964117 - RNA, 19 nt, Homo sapiens
aaacuccacaucugccuua

SEQ ID NO: 964118 - RNA, 12 nt, Homo sapiens
aaacucucacca

SEQ ID NO: 964119 - RNA, 14 nt, Homo sapiens
aaacugucuugccc

SEQ ID NO: 964120 - RNA, 14 nt, Homo sapiens
aaacuguguugcca

SEQ ID NO: 964121 - RNA, 15 nt, Homo sapiens
aaacuguuacugaaa

SEQ ID NO: 964122 - RNA, 18 nt, Homo sapiens
aaacuuggacaacacgga

SEQ ID NO: 964123 - RNA, 19 nt, Homo sapiens
aaagaaauaaaccaaagga

SEQ ID NO: 964124 - RNA, 22 nt, Homo sapiens
aaagaauuggccaggcauggug

SEQ ID NO: 964125 - RNA, 20 nt, Homo sapiens
aaagacagcuagauuuugcu

SEQ ID NO: 964126 - RNA, 14 nt, Homo sapiens
aaagaccugagaac

SEQ ID NO: 964127 - RNA, 22 nt, Homo sapiens
aaagaccuuagacauaaaguaa

SEQ ID NO: 964128 - RNA, 13 nt, Homo sapiens
aaagagcagucag

SEQ ID NO: 964129 - RNA, 16 nt, Homo sapiens
aaagauauuguaucuc

SEQ ID NO: 964130 - RNA, 19 nt, Homo sapiens
aaagaucuugaauagucuc

SEQ ID NO: 964131 - RNA, 13 nt, Homo sapiens
aaagaugagaucg

SEQ ID NO: 964132 - RNA, 10 nt, Homo sapiens
aaagcauuuc

SEQ ID NO: 964133 - RNA, 23 nt, Homo sapiens
aaagccuacccuauucuauccau

SEQ ID NO: 964134 - RNA, 12 nt, Homo sapiens
aaagccuagaca

SEQ ID NO: 964135 - RNA, 15 nt, Homo sapiens
aaagcuacuguagaa

SEQ ID NO: 964136 - RNA, 21 nt, Homo sapiens
aaagcuggugucugauuuugg

SEQ ID NO: 964137 - RNA, 18 nt, Homo sapiens
aaagcuuuggcugagacc

SEQ ID NO: 964138 - RNA, 22 nt, Homo sapiens
aaaggaaauaagagcagucaca

SEQ ID NO: 964139 - RNA, 15 nt, Homo sapiens
aaaggacaggccaca

SEQ ID NO: 964140 - RNA, 16 nt, Homo sapiens
aaaggacucuccagcc

SEQ ID NO: 964141 - RNA, 12 nt, Homo sapiens
aaaggagcugcu

SEQ ID NO: 964142 - RNA, 13 nt, Homo sapiens
aucaugaagccca

SEQ ID NO: 964143 - RNA, 20 nt, Homo sapiens
aucaugaagcccaaccugca

SEQ ID NO: 964144 - RNA, 17 nt, Homo sapiens
auccaacuccagcaacu

SEQ ID NO: 964145 - RNA, 23 nt, Homo sapiens
auccaaggguugagagccagugg

SEQ ID NO: 964146 - RNA, 19 nt, Homo sapiens
auccaccaagaacauaaga

SEQ ID NO: 964147 - RNA, 23 nt, Homo sapiens
auccaccgccacugggccuguca

SEQ ID NO: 964148 - RNA, 19 nt, Homo sapiens
auccagccaugccugaggu

SEQ ID NO: 964149 - RNA, 13 nt, Homo sapiens
auccagccucaug

SEQ ID NO: 964150 - RNA, 17 nt, Homo sapiens
auccagccucaugggaa

SEQ ID NO: 964151 - RNA, 22 nt, Homo sapiens
auccauagugcacuagcauuuu

SEQ ID NO: 964152 - RNA, 18 nt, Homo sapiens
auccauauaacaauucag

SEQ ID NO: 964153 - RNA, 18 nt, Homo sapiens
auccauauuuccuauugu

SEQ ID NO: 964154 - RNA, 13 nt, Homo sapiens
auccauccaaagg

SEQ ID NO: 964155 - RNA, 13 nt, Homo sapiens
auccaucccucca

SEQ ID NO: 964156 - RNA, 14 nt, Homo sapiens
auccauccuuccaa

SEQ ID NO: 964157 - RNA, 18 nt, Homo sapiens
auccaucuuuccauccau

SEQ ID NO: 964158 - RNA, 16 nt, Homo sapiens
auccaugcuucucauc

SEQ ID NO: 964159 - RNA, 14 nt, Homo sapiens
auccauuaccucca

SEQ ID NO: 964160 - RNA, 15 nt, Homo sapiens
auccauuaccuccau

SEQ ID NO: 964161 - RNA, 15 nt, Homo sapiens
aucccacauccaacu

SEQ ID NO: 964162 - RNA, 17 nt, Homo sapiens
aucccacccacauguga

SEQ ID NO: 964163 - RNA, 21 nt, Homo sapiens
aucccauggccaggugguugu

SEQ ID NO: 964164 - RNA, 22 nt, Homo sapiens
auccccaacugcgacugugacc

SEQ ID NO: 964165 - RNA, 14 nt, Homo sapiens
auccccacccaguc

SEQ ID NO: 964166 - RNA, 18 nt, Homo sapiens
auccccacccagucucau

SEQ ID NO: 964167 - RNA, 17 nt, Homo sapiens
auccccuggcuccagag

SEQ ID NO: 964168 - RNA, 14 nt, Homo sapiens
aucccuccauucau

SEQ ID NO: 964169 - RNA, 14 nt, Homo sapiens
aucccucuaaugag

SEQ ID NO: 964170 - RNA, 18 nt, Homo sapiens
aucccuuugcaccugaga

SEQ ID NO: 964171 - RNA, 18 nt, Homo sapiens
auccucaaacgacagagg

SEQ ID NO: 964172 - RNA, 21 nt, Homo sapiens
auccucagguaguacugggaa

SEQ ID NO: 964173 - RNA, 23 nt, Homo sapiens
auccucucccccuccuccaggga

SEQ ID NO: 964174 - RNA, 18 nt, Homo sapiens
auccugcagggcuucucc

SEQ ID NO: 964175 - RNA, 16 nt, Homo sapiens
auccugcccaggccag

SEQ ID NO: 964176 - RNA, 17 nt, Homo sapiens
auccugggggccugggu

SEQ ID NO: 964177 - RNA, 19 nt, Homo sapiens
auccugggggccuggguug

SEQ ID NO: 964178 - RNA, 23 nt, Homo sapiens
auccuuacagcuaucuguagaau

SEQ ID NO: 964179 - RNA, 19 nt, Homo sapiens
aucgagaccauccuggcua

SEQ ID NO: 964180 - RNA, 21 nt, Homo sapiens
aucgaggugaaaggcucagua

SEQ ID NO: 964181 - RNA, 16 nt, Homo sapiens
aucggaauucagccau

SEQ ID NO: 964182 - RNA, 18 nt, Homo sapiens
aucggccaucaagggaag

SEQ ID NO: 964183 - RNA, 16 nt, Homo sapiens
ugcacggugggagacc

SEQ ID NO: 964184 - RNA, 23 nt, Homo sapiens
ugcacuaaaucagagacaaaaua

SEQ ID NO: 964185 - RNA, 21 nt, Homo sapiens
ugcacuccagccugggggaca

SEQ ID NO: 964186 - RNA, 13 nt, Homo sapiens
ugcagagagccau

SEQ ID NO: 964187 - RNA, 17 nt, Homo sapiens
ugcagccccucaugccu

SEQ ID NO: 964188 - RNA, 17 nt, Homo sapiens
ugcaggauuucuucaca

SEQ ID NO: 964189 - RNA, 21 nt, Homo sapiens
ugcagguuuucuucacugcca

SEQ ID NO: 964190 - RNA, 12 nt, Homo sapiens
ugcagucacugg

SEQ ID NO: 964191 - RNA, 14 nt, Homo sapiens
ugcaguccuacuca

SEQ ID NO: 964192 - RNA, 17 nt, Homo sapiens
ugcaguguggaguucac

SEQ ID NO: 964193 - RNA, 15 nt, Homo sapiens
ugcaguucugagcac

SEQ ID NO: 964194 - RNA, 18 nt, Homo sapiens
ugcauaauaagcuaaaga

SEQ ID NO: 964195 - RNA, 14 nt, Homo sapiens
ugcauuuaauuaga

SEQ ID NO: 964196 - RNA, 19 nt, Homo sapiens
ugcauuuauuauucucaaa

SEQ ID NO: 964197 - RNA, 14 nt, Homo sapiens
ugcauuuuuauuaa

SEQ ID NO: 964198 - RNA, 20 nt, Homo sapiens
ugccaaacacauuuacccuu

SEQ ID NO: 964199 - RNA, 16 nt, Homo sapiens
ugccacaucauugaag

SEQ ID NO: 964200 - RNA, 16 nt, Homo sapiens
ugccacuaaacuacau

SEQ ID NO: 964201 - RNA, 17 nt, Homo sapiens
ugccacuuuacccaccu

SEQ ID NO: 964202 - RNA, 18 nt, Homo sapiens
ugccagacauggaccucc

SEQ ID NO: 964203 - RNA, 20 nt, Homo sapiens
ugccaggcuguaagcauucu

SEQ ID NO: 964204 - RNA, 18 nt, Homo sapiens
ugccauagcugacuacaa

SEQ ID NO: 964205 - RNA, 14 nt, Homo sapiens
ugccaucaccgcug

SEQ ID NO: 964206 - RNA, 20 nt, Homo sapiens
ugccauuuuuugucugugau

SEQ ID NO: 964207 - RNA, 16 nt, Homo sapiens
ugcccaguacauuuaa

SEQ ID NO: 964208 - RNA, 15 nt, Homo sapiens
ugcccauugucuuau

SEQ ID NO: 964209 - RNA, 20 nt, Homo sapiens
ugccccagggaguccagggu

SEQ ID NO: 964210 - RNA, 16 nt, Homo sapiens
cugcgggucauauuca

SEQ ID NO: 964211 - RNA, 21 nt, Homo sapiens
cugcguccuccucaccucaug

SEQ ID NO: 964212 - RNA, 12 nt, Homo sapiens
cugcguuuucau

SEQ ID NO: 964213 - RNA, 20 nt, Homo sapiens
cugcuacaccuauuauccca

SEQ ID NO: 964214 - RNA, 24 nt, Homo sapiens
cugcucaggguucaucugaagauu

SEQ ID NO: 964215 - RNA, 17 nt, Homo sapiens
cugcuccuggaguacac

SEQ ID NO: 964216 - RNA, 21 nt, Homo sapiens
cugcugcccccaccccgggga

SEQ ID NO: 964217 - RNA, 22 nt, Homo sapiens
cugcugccggaagucaucccag

SEQ ID NO: 964218 - RNA, 16 nt, Homo sapiens
cugcuguaugugagcu

SEQ ID NO: 964219 - RNA, 19 nt, Homo sapiens
cugcugugauuccacuaca

SEQ ID NO: 964220 - RNA, 15 nt, Homo sapiens
cugcuuacuugguga

SEQ ID NO: 964221 - RNA, 20 nt, Homo sapiens
cugcuugauuuuaauacauu

SEQ ID NO: 964222 - RNA, 17 nt, Homo sapiens
cuggaaaaggagcuuca

SEQ ID NO: 964223 - RNA, 18 nt, Homo sapiens
cuggaaaaggagcuucag

SEQ ID NO: 964224 - RNA, 19 nt, Homo sapiens
cuggaaauugcaguaacaa

SEQ ID NO: 964225 - RNA, 20 nt, Homo sapiens
cuggaagaagugagcagugu

SEQ ID NO: 964226 - RNA, 12 nt, Homo sapiens
cuggaagaugua

SEQ ID NO: 964227 - RNA, 14 nt, Homo sapiens
cuggaaugaguuga

SEQ ID NO: 964228 - RNA, 20 nt, Homo sapiens
cuggaaugaguugaggccac

SEQ ID NO: 964229 - RNA, 21 nt, Homo sapiens
cuggaauuuggacaagugcug

SEQ ID NO: 964230 - RNA, 21 nt, Homo sapiens
cuggacaaagaaauuccccaa

SEQ ID NO: 964231 - RNA, 21 nt, Homo sapiens
cuggacaguaucccacaucca

SEQ ID NO: 964232 - RNA, 21 nt, Homo sapiens
cuggacuaugcugaugggcca

SEQ ID NO: 964233 - RNA, 21 nt, Homo sapiens
cuggagccaucucuuccucau

SEQ ID NO: 964234 - RNA, 21 nt, Homo sapiens
cuggagcccuaaccccuucca

SEQ ID NO: 964235 - RNA, 18 nt, Homo sapiens
cuggagcucaucugcaaa

SEQ ID NO: 964236 - RNA, 12 nt, Homo sapiens
cuggaggaccag

SEQ ID NO: 964237 - RNA, 14 nt, Homo sapiens
cuggaggugcugcu

SEQ ID NO: 964238 - RNA, 15 nt, Homo sapiens
cuggaguacaccaac

SEQ ID NO: 964239 - RNA, 17 nt, Homo sapiens
cuggagugcaguggcau

SEQ ID NO: 964240 - RNA, 17 nt, Homo sapiens
cuggauggcccauagac

SEQ ID NO: 964241 - RNA, 18 nt, Homo sapiens
cuggauggggcaggccac

SEQ ID NO: 964242 - RNA, 14 nt, Homo sapiens
cuggcacagaggua

SEQ ID NO: 964243 - RNA, 20 nt, Homo sapiens
cuggccaagcgagagcagcu

SEQ ID NO: 964244 - RNA, 21 nt, Homo sapiens
cuggccacaguaauuggucau

SEQ ID NO: 964245 - RNA, 18 nt, Homo sapiens
cuggccauggccugcaaa

SEQ ID NO: 964246 - RNA, 16 nt, Homo sapiens
cuggcccccucagugu

SEQ ID NO: 964247 - RNA, 15 nt, Homo sapiens
cuggcccuggccaga

SEQ ID NO: 964248 - RNA, 16 nt, Homo sapiens
cuggcccuugcuuacc

SEQ ID NO: 964249 - RNA, 15 nt, Homo sapiens
cuggccugagaguca

SEQ ID NO: 964250 - RNA, 20 nt, Homo sapiens
cuggcuccagagauggucac

SEQ ID NO: 964251 - RNA, 15 nt, Homo sapiens
cuggcucuaccuucc

SEQ ID NO: 964252 - RNA, 18 nt, Homo sapiens
cuggcugagguuccucug

SEQ ID NO: 964253 - RNA, 18 nt, Homo sapiens
cugggacaccauuaccaa

SEQ ID NO: 964254 - RNA, 19 nt, Homo sapiens
cugggaggguguggugcuu

SEQ ID NO: 964255 - RNA, 17 nt, Homo sapiens
cugggccauguccaaag

SEQ ID NO: 964256 - RNA, 16 nt, Homo sapiens
cuggggcaagcuccuc

SEQ ID NO: 964257 - RNA, 15 nt, Homo sapiens
cuggggccacccagc

SEQ ID NO: 964258 - RNA, 14 nt, Homo sapiens
cuggggccugggac

SEQ ID NO: 964259 - RNA, 16 nt, Homo sapiens
cuggggccugggacaa

SEQ ID NO: 964260 - RNA, 17 nt, Homo sapiens
cuggggccugggacaac

SEQ ID NO: 964261 - RNA, 16 nt, Homo sapiens
cugggguccauucucu

SEQ ID NO: 964262 - RNA, 21 nt, Homo sapiens
cugggguuggacuguaaggga

SEQ ID NO: 964263 - RNA, 19 nt, Homo sapiens
cuggguggacuuugggacc

SEQ ID NO: 964264 - RNA, 21 nt, Homo sapiens
cuggguugggggcuagggaga

SEQ ID NO: 964265 - RNA, 18 nt, Homo sapiens
cuggguuucuagagguca

SEQ ID NO: 964266 - RNA, 15 nt, Homo sapiens
cuggucccagcaucc

SEQ ID NO: 964267 - RNA, 15 nt, Homo sapiens
cuggugggacagugg

SEQ ID NO: 964268 - RNA, 15 nt, Homo sapiens
cugguguagcacuua

SEQ ID NO: 964269 - RNA, 23 nt, Homo sapiens
cuguaaacuguguauuccaagac

SEQ ID NO: 964270 - RNA, 14 nt, Homo sapiens
cuguaaacuuccaa

SEQ ID NO: 964271 - RNA, 18 nt, Homo sapiens
cuguaacucagacauucc

SEQ ID NO: 964272 - RNA, 17 nt, Homo sapiens
cuguaaucccagcacuu

SEQ ID NO: 964273 - RNA, 19 nt, Homo sapiens
cuguaauuccagcuacuca

SEQ ID NO: 964274 - RNA, 17 nt, Homo sapiens
cuguaauucuagcacuu

SEQ ID NO: 964275 - RNA, 17 nt, Homo sapiens
cuguaccgacuuugaua

SEQ ID NO: 964276 - RNA, 21 nt, Homo sapiens
cuguagcaccagagaauccau

SEQ ID NO: 964277 - RNA, 18 nt, Homo sapiens
cuguagucccagcuacuu

SEQ ID NO: 964278 - RNA, 19 nt, Homo sapiens
cuuuaauuaccaguuuucc

SEQ ID NO: 964279 - RNA, 17 nt, Homo sapiens
cuuuaccuuuucagggc

SEQ ID NO: 964280 - RNA, 13 nt, Homo sapiens
cuuuacuucccag

SEQ ID NO: 964281 - RNA, 17 nt, Homo sapiens
cuuuaguagacauuuau

SEQ ID NO: 964282 - RNA, 19 nt, Homo sapiens
cuuuaugaucuggcccuug

SEQ ID NO: 964283 - RNA, 13 nt, Homo sapiens
cuuuaugcacauu

SEQ ID NO: 964284 - RNA, 14 nt, Homo sapiens
cuuuauuaaguaaa

SEQ ID NO: 964285 - RNA, 17 nt, Homo sapiens
cuuuauuggcugagaua

SEQ ID NO: 964286 - RNA, 13 nt, Homo sapiens
cuuucaauacucu

SEQ ID NO: 964287 - RNA, 21 nt, Homo sapiens
cuuuccauccauuaccuccau

SEQ ID NO: 964288 - RNA, 15 nt, Homo sapiens
cuuucccacucucag

SEQ ID NO: 964289 - RNA, 15 nt, Homo sapiens
cuuuccugaaccaug

SEQ ID NO: 964290 - RNA, 16 nt, Homo sapiens
cuuuccugaauccaaa

SEQ ID NO: 964291 - RNA, 17 nt, Homo sapiens
cuuuccugaauccaaac

SEQ ID NO: 964292 - RNA, 20 nt, Homo sapiens
cuuucugcuuacaaagacaa

SEQ ID NO: 964293 - RNA, 21 nt, Homo sapiens
cuuugagaagccuucagcucc

SEQ ID NO: 964294 - RNA, 18 nt, Homo sapiens
cuuugagcugagugcuga

SEQ ID NO: 964295 - RNA, 22 nt, Homo sapiens
cuuugauagauuucuacacuga

SEQ ID NO: 964296 - RNA, 16 nt, Homo sapiens
cuuugcauauuauaaa

SEQ ID NO: 964297 - RNA, 19 nt, Homo sapiens
cuuugcuaaugcuaugcaa

SEQ ID NO: 964298 - RNA, 14 nt, Homo sapiens
cuuugcugccugag

SEQ ID NO: 964299 - RNA, 18 nt, Homo sapiens
cuuuggccccacuuugaa

SEQ ID NO: 964300 - RNA, 14 nt, Homo sapiens
cuuugggaccugcu

SEQ ID NO: 964301 - RNA, 15 nt, Homo sapiens
cuuugggaucagccu

SEQ ID NO: 964302 - RNA, 21 nt, Homo sapiens
cuuuguaagagcaaaagccuc

SEQ ID NO: 964303 - RNA, 18 nt, Homo sapiens
cuuuguauuguauauuac

SEQ ID NO: 964304 - RNA, 20 nt, Homo sapiens
cuuuguugcaagaugugaau

SEQ ID NO: 964305 - RNA, 21 nt, Homo sapiens
cuuuucagggcuggcuccuga

SEQ ID NO: 964306 - RNA, 18 nt, Homo sapiens
cuuuucauuaaagaaugu

SEQ ID NO: 964307 - RNA, 19 nt, Homo sapiens
cuuuuccacacgcauuaau

SEQ ID NO: 964308 - RNA, 14 nt, Homo sapiens
cuuuuccacuuuaa

SEQ ID NO: 964309 - RNA, 15 nt, Homo sapiens
cuuuucccacucuca

SEQ ID NO: 964310 - RNA, 16 nt, Homo sapiens
cuuuucccacucucau

SEQ ID NO: 964311 - RNA, 14 nt, Homo sapiens
cuuuucccauuuca

SEQ ID NO: 964312 - RNA, 20 nt, Homo sapiens
cuuuucuaaucacaguguug

SEQ ID NO: 964313 - RNA, 22 nt, Homo sapiens
cuuuucuuuuuuuuuuacuuuu

SEQ ID NO: 964314 - RNA, 13 nt, Homo sapiens
cuuuugacuccag

SEQ ID NO: 964315 - RNA, 20 nt, Homo sapiens
cuuuugccgaccccaagagu

SEQ ID NO: 964316 - RNA, 21 nt, Homo sapiens
cuuuugcucauggugaauaua

SEQ ID NO: 964317 - RNA, 22 nt, Homo sapiens
cuuuugugcaaagccaaaaccu

SEQ ID NO: 964318 - RNA, 21 nt, Homo sapiens
cuuuuuuuucaugacauaaua

SEQ ID NO: 964319 - RNA, 21 nt, Homo sapiens
gaaaaaaaaaagaaaugcaaa

SEQ ID NO: 964320 - RNA, 13 nt, Homo sapiens
gaaaaaaagggag

SEQ ID NO: 964321 - RNA, 14 nt, Homo sapiens
gaaaaaacuuugac

SEQ ID NO: 964322 - RNA, 20 nt, Homo sapiens
gaaaaagcaaguguucacug

SEQ ID NO: 964323 - RNA, 22 nt, Homo sapiens
gaaaaauauaauguugauaaua

SEQ ID NO: 964324 - RNA, 14 nt, Homo sapiens
gaaaacauguuaau

SEQ ID NO: 964325 - RNA, 14 nt, Homo sapiens
gaaaagaacuggaa

SEQ ID NO: 964326 - RNA, 23 nt, Homo sapiens
gaaaagcuauuagccaggaucau

SEQ ID NO: 964327 - RNA, 23 nt, Homo sapiens
gaaaaggagcuucaguauugugg

SEQ ID NO: 964328 - RNA, 18 nt, Homo sapiens
gaaaaguccacauaaccc

SEQ ID NO: 964329 - RNA, 14 nt, Homo sapiens
gaagugagcagugu

SEQ ID NO: 964330 - RNA, 19 nt, Homo sapiens
gaaguuaaaaugauuuaca

SEQ ID NO: 964331 - RNA, 15 nt, Homo sapiens
gaaguuaagaaccug

SEQ ID NO: 964332 - RNA, 12 nt, Homo sapiens
gaauaaugaagg

SEQ ID NO: 964333 - RNA, 13 nt, Homo sapiens
gaauaaugaaggu

SEQ ID NO: 964334 - RNA, 15 nt, Homo sapiens
gaauagccuggccac

SEQ ID NO: 964335 - RNA, 13 nt, Homo sapiens
gaauagucucauc

SEQ ID NO: 964336 - RNA, 17 nt, Homo sapiens
gaaucaaaucucuucca

SEQ ID NO: 964337 - RNA, 14 nt, Homo sapiens
gaaucuacauucac

SEQ ID NO: 964338 - RNA, 21 nt, Homo sapiens
gaaucuauccauugaacuaaa

SEQ ID NO: 964339 - RNA, 20 nt, Homo sapiens
gaaucucuucacuacccuga

SEQ ID NO: 964340 - RNA, 15 nt, Homo sapiens
gaaugaacacucccc

SEQ ID NO: 964341 - RNA, 18 nt, Homo sapiens
gaaugagaguuccuucuc

SEQ ID NO: 964342 - RNA, 20 nt, Homo sapiens
gaauggucuggcaauauucu

SEQ ID NO: 964343 - RNA, 17 nt, Homo sapiens
gaauguuuucaaaacca

SEQ ID NO: 964344 - RNA, 14 nt, Homo sapiens
gaauuaugggagaa

SEQ ID NO: 964345 - RNA, 14 nt, Homo sapiens
gaauucauguuggu

SEQ ID NO: 964346 - RNA, 14 nt, Homo sapiens
gaauugacugccua

SEQ ID NO: 964347 - RNA, 12 nt, Homo sapiens
gaauugcucaaa

SEQ ID NO: 964348 - RNA, 19 nt, Homo sapiens
gacaaagccucaauuacua

SEQ ID NO: 964349 - RNA, 22 nt, Homo sapiens
gacaagcccuugagaagccaac

SEQ ID NO: 964350 - RNA, 19 nt, Homo sapiens
gacacauaugcaccuugug

SEQ ID NO: 964351 - RNA, 21 nt, Homo sapiens
gacaccagagcagaugcagag

SEQ ID NO: 964352 - RNA, 22 nt, Homo sapiens
gacaccagagcagaugcagaga

SEQ ID NO: 964353 - RNA, 20 nt, Homo sapiens
gacacucuagugacuuccug

SEQ ID NO: 964354 - RNA, 23 nt, Homo sapiens
gacagaaggugccacuuuaccca

SEQ ID NO: 964355 - RNA, 17 nt, Homo sapiens
gacagcagaagccucca

SEQ ID NO: 964356 - RNA, 15 nt, Homo sapiens
gacagcuuucuggga

SEQ ID NO: 964357 - RNA, 18 nt, Homo sapiens
gacaggccacaccacagc

SEQ ID NO: 964358 - RNA, 18 nt, Homo sapiens
gacagucucccccaaaca

SEQ ID NO: 964359 - RNA, 22 nt, Homo sapiens
gacaguuuugcuuuaguacaau

SEQ ID NO: 964360 - RNA, 22 nt, Homo sapiens
gacauaauaacagcaguggagu

SEQ ID NO: 964361 - RNA, 14 nt, Homo sapiens
gacaugacauucuu

SEQ ID NO: 964362 - RNA, 13 nt, Homo sapiens
gacauggaccucc

SEQ ID NO: 964363 - RNA, 15 nt, Homo sapiens
gacaugugaaaccuu

SEQ ID NO: 964364 - RNA, 16 nt, Homo sapiens
gacaugugaaaccuuu

SEQ ID NO: 964365 - RNA, 17 nt, Homo sapiens
gacauucuuagcuguaa

SEQ ID NO: 964366 - RNA, 20 nt, Homo sapiens
gaccaagacugagccagcuu

SEQ ID NO: 964367 - RNA, 16 nt, Homo sapiens
gaccacagagcuccug

SEQ ID NO: 964368 - RNA, 16 nt, Homo sapiens
gaccaccacauugaga

SEQ ID NO: 964369 - RNA, 13 nt, Homo sapiens
gaccaccaccagg

SEQ ID NO: 964370 - RNA, 16 nt, Homo sapiens
gaccagacacugccug

SEQ ID NO: 964371 - RNA, 17 nt, Homo sapiens
gaccaggauuugcacag

SEQ ID NO: 964372 - RNA, 15 nt, Homo sapiens
gaccaguacugggaa

SEQ ID NO: 964373 - RNA, 20 nt, Homo sapiens
gacccaggccuggccaguca

SEQ ID NO: 964374 - RNA, 15 nt, Homo sapiens
gaccccucuccucaa

SEQ ID NO: 964375 - RNA, 19 nt, Homo sapiens
gaccccucuccucaaggga

SEQ ID NO: 964376 - RNA, 15 nt, Homo sapiens
gacccugaggcccug

SEQ ID NO: 964377 - RNA, 15 nt, Homo sapiens
gaccuagagacuuca

SEQ ID NO: 964378 - RNA, 18 nt, Homo sapiens
gaccucaaguguccugaa

SEQ ID NO: 964379 - RNA, 19 nt, Homo sapiens
gaccucaaugaagcagaaa

SEQ ID NO: 964380 - RNA, 21 nt, Homo sapiens
gaccuggauggggcaggccac

SEQ ID NO: 964381 - RNA, 22 nt, Homo sapiens
gaccuggccccaggcugucacc

SEQ ID NO: 964382 - RNA, 20 nt, Homo sapiens
gugcuccuccuuggugccug

SEQ ID NO: 964383 - RNA, 22 nt, Homo sapiens
gugcucucagcuggcagugcaa

SEQ ID NO: 964384 - RNA, 18 nt, Homo sapiens
gugcugagugagcuggug

SEQ ID NO: 964385 - RNA, 16 nt, Homo sapiens
guggaaauaauuugaa

SEQ ID NO: 964386 - RNA, 17 nt, Homo sapiens
guggaauugacugccua

SEQ ID NO: 964387 - RNA, 18 nt, Homo sapiens
guggagcugcugguguuu

SEQ ID NO: 964388 - RNA, 22 nt, Homo sapiens
guggcauaaauugcaucacugu

SEQ ID NO: 964389 - RNA, 20 nt, Homo sapiens
guggcaugaucauagcucac

SEQ ID NO: 964390 - RNA, 10 nt, Homo sapiens
guggccacag

SEQ ID NO: 964391 - RNA, 21 nt, Homo sapiens
guggcuggcucuaccuuccug

SEQ ID NO: 964392 - RNA, 16 nt, Homo sapiens
guggcugucgguggga

SEQ ID NO: 964393 - RNA, 23 nt, Homo sapiens
gugggauggggacauuugaacau

SEQ ID NO: 964394 - RNA, 22 nt, Homo sapiens
gugggcgcuugcaccacuuccg

SEQ ID NO: 964395 - RNA, 23 nt, Homo sapiens
guggguaacgugagaagauagaa

SEQ ID NO: 964396 - RNA, 19 nt, Homo sapiens
gugggugcugccaugacag

SEQ ID NO: 964397 - RNA, 14 nt, Homo sapiens
guggucccugagga

SEQ ID NO: 964398 - RNA, 17 nt, Homo sapiens
gugguggcuagagggaa

SEQ ID NO: 964399 - RNA, 17 nt, Homo sapiens
gugguguuuauugcaau

SEQ ID NO: 964400 - RNA, 18 nt, Homo sapiens
gugguugucuuauugcac

SEQ ID NO: 964401 - RNA, 20 nt, Homo sapiens
guguaaaaaaaccaccaaaa

SEQ ID NO: 964402 - RNA, 20 nt, Homo sapiens
guguaagaacaacuaccuga

SEQ ID NO: 964403 - RNA, 16 nt, Homo sapiens
uggagguugaagccaa

SEQ ID NO: 964404 - RNA, 17 nt, Homo sapiens
uggaguucuugugccau

SEQ ID NO: 964405 - RNA, 21 nt, Homo sapiens
uggaucacucaccauucccag

SEQ ID NO: 964406 - RNA, 16 nt, Homo sapiens
uggaucagcauuuuag

SEQ ID NO: 964407 - RNA, 19 nt, Homo sapiens
uggauccagccaugccuga

SEQ ID NO: 964408 - RNA, 17 nt, Homo sapiens
uggaugcgcagugccuu

SEQ ID NO: 964409 - RNA, 15 nt, Homo sapiens
uggaugucacugccu

SEQ ID NO: 964410 - RNA, 14 nt, Homo sapiens
uggauguucacugc

SEQ ID NO: 964411 - RNA, 19 nt, Homo sapiens
uggcaaacccucccagaaa

SEQ ID NO: 964412 - RNA, 13 nt, Homo sapiens
uggcaauuggcau

SEQ ID NO: 964413 - RNA, 12 nt, Homo sapiens
uggcagaugucu

SEQ ID NO: 964414 - RNA, 17 nt, Homo sapiens
uggcaggaaucuaucca

SEQ ID NO: 964415 - RNA, 19 nt, Homo sapiens
uggcauaugguccuagaca

SEQ ID NO: 964416 - RNA, 12 nt, Homo sapiens
uggccaagccua

SEQ ID NO: 964417 - RNA, 18 nt, Homo sapiens
uggccaguccacccugcc

SEQ ID NO: 964418 - RNA, 13 nt, Homo sapiens
uggccaguucauu

SEQ ID NO: 964419 - RNA, 14 nt, Homo sapiens
uggccccacuuuga

SEQ ID NO: 964420 - RNA, 22 nt, Homo sapiens
uggcccuauuuaaggcagauuu

SEQ ID NO: 964421 - RNA, 17 nt, Homo sapiens
uggcccuugcuuaccuc

SEQ ID NO: 964422 - RNA, 20 nt, Homo sapiens
uggccgcggagccugcauuu

SEQ ID NO: 964423 - RNA, 13 nt, Homo sapiens
uggccuaugcaca

SEQ ID NO: 964424 - RNA, 14 nt, Homo sapiens
uggccuaugcacau

SEQ ID NO: 964425 - RNA, 14 nt, Homo sapiens
uggccucucuagca

SEQ ID NO: 964426 - RNA, 18 nt, Homo sapiens
uggccugcaaacugggaa

SEQ ID NO: 964427 - RNA, 19 nt, Homo sapiens
uggccugcugugauuccac

SEQ ID NO: 964428 - RNA, 18 nt, Homo sapiens
uggccuggcacacaucag

SEQ ID NO: 964429 - RNA, 14 nt, Homo sapiens
uggccuuguaagac

SEQ ID NO: 964430 - RNA, 19 nt, Homo sapiens
uggcuaccucagaaagauu

SEQ ID NO: 964431 - RNA, 21 nt, Homo sapiens
uggcuaugcaguacauuguau

SEQ ID NO: 964432 - RNA, 15 nt, Homo sapiens
aacaaauaauuuaga

SEQ ID NO: 964433 - RNA, 20 nt, Homo sapiens
aacacacgagcaaacccaga

SEQ ID NO: 964434 - RNA, 21 nt, Homo sapiens
aacacagcauguguauuucca

SEQ ID NO: 964435 - RNA, 17 nt, Homo sapiens
aacacagucuacucuuu

SEQ ID NO: 964436 - RNA, 21 nt, Homo sapiens
aacacagucuacucuuucugc

SEQ ID NO: 964437 - RNA, 19 nt, Homo sapiens
aacacauguucugugccug

SEQ ID NO: 964438 - RNA, 22 nt, Homo sapiens
aacacauugaaacuguauuuac

SEQ ID NO: 964439 - RNA, 21 nt, Homo sapiens
aacacauuucucugaucucca

SEQ ID NO: 964440 - RNA, 21 nt, Homo sapiens
aacaccaggauuuaaguuuca

SEQ ID NO: 964441 - RNA, 14 nt, Homo sapiens
aacacuaacuuaau

SEQ ID NO: 964442 - RNA, 19 nt, Homo sapiens
aacacugucacuagucuca

SEQ ID NO: 964443 - RNA, 20 nt, Homo sapiens
aacacugucacuagucucac

SEQ ID NO: 964444 - RNA, 16 nt, Homo sapiens
aacagaaaaaugaaau

SEQ ID NO: 964445 - RNA, 17 nt, Homo sapiens
aacagaauuaaguggau

SEQ ID NO: 964446 - RNA, 14 nt, Homo sapiens
aacagagugcaacc

SEQ ID NO: 964447 - RNA, 16 nt, Homo sapiens
aacagcaguggaguaa

SEQ ID NO: 964448 - RNA, 17 nt, Homo sapiens
aacagcccccacuccag

SEQ ID NO: 964449 - RNA, 20 nt, Homo sapiens
aacaggaucucaaacuugau

SEQ ID NO: 964450 - RNA, 20 nt, Homo sapiens
aacaggauuacaguguagcu

SEQ ID NO: 964451 - RNA, 21 nt, Homo sapiens
aacaggauuacaguguagcua

SEQ ID NO: 964452 - RNA, 19 nt, Homo sapiens
aacaguacugguuacuuuc

SEQ ID NO: 964453 - RNA, 17 nt, Homo sapiens
aacaguuuaacagaaaa

SEQ ID NO: 964454 - RNA, 15 nt, Homo sapiens
aacauacuguucacu

SEQ ID NO: 964455 - RNA, 13 nt, Homo sapiens
aacaucaccacug

SEQ ID NO: 964456 - RNA, 20 nt, Homo sapiens
aacaucccuuauaccacugu

SEQ ID NO: 964457 - RNA, 20 nt, Homo sapiens
aacaugaaaaacacggcagc

SEQ ID NO: 964458 - RNA, 17 nt, Homo sapiens
aacaugaaucaagcaau

SEQ ID NO: 964459 - RNA, 22 nt, Homo sapiens
aacauggccugcugggcccaag

SEQ ID NO: 964460 - RNA, 21 nt, Homo sapiens
aacauggcuguuaacccacug

SEQ ID NO: 964461 - RNA, 13 nt, Homo sapiens
aacaugguacaaa

SEQ ID NO: 964462 - RNA, 19 nt, Homo sapiens
aaccaaaucuuaaaugaga

SEQ ID NO: 964463 - RNA, 17 nt, Homo sapiens
aaccaagaccuuucugc

SEQ ID NO: 964464 - RNA, 15 nt, Homo sapiens
aaccacacuucuuga

SEQ ID NO: 964465 - RNA, 11 nt, Homo sapiens
aaccaccaaaa

SEQ ID NO: 964466 - RNA, 19 nt, Homo sapiens
aaccagaaacaccccucug

SEQ ID NO: 964467 - RNA, 14 nt, Homo sapiens
aaccagaccacuca

SEQ ID NO: 964468 - RNA, 21 nt, Homo sapiens
aaccagaggaagaaaaugagc

SEQ ID NO: 964469 - RNA, 18 nt, Homo sapiens
aaccaggcaccucuuccu

SEQ ID NO: 964470 - RNA, 19 nt, Homo sapiens
aaccauggugaagugcuug

SEQ ID NO: 964471 - RNA, 14 nt, Homo sapiens
aaccauucuacugu

SEQ ID NO: 964472 - RNA, 18 nt, Homo sapiens
aaccauucuacuguguca

SEQ ID NO: 964473 - RNA, 22 nt, Homo sapiens
aaccccuuccagaucacugcca

SEQ ID NO: 964474 - RNA, 17 nt, Homo sapiens
aacccuaucuccugaca

SEQ ID NO: 964475 - RNA, 20 nt, Homo sapiens
aacccugcugaacacagugu

SEQ ID NO: 964476 - RNA, 14 nt, Homo sapiens
aacccuuauacuca

SEQ ID NO: 964477 - RNA, 23 nt, Homo sapiens
aaccucagggcucccaggggucu

SEQ ID NO: 964478 - RNA, 20 nt, Homo sapiens
aaccuccgccucccggguuc

SEQ ID NO: 964479 - RNA, 15 nt, Homo sapiens
aaccugaauggucug

SEQ ID NO: 964480 - RNA, 13 nt, Homo sapiens
aaccugcucuccu

SEQ ID NO: 964481 - RNA, 23 nt, Homo sapiens
aaccugcucuccucuucuacuca

SEQ ID NO: 964482 - RNA, 20 nt, Homo sapiens
aaccuggaaucuacaagcca

SEQ ID NO: 964483 - RNA, 13 nt, Homo sapiens
aaccuuccagcuc

SEQ ID NO: 964484 - RNA, 16 nt, Homo sapiens
aacgcguaucuaggcu

SEQ ID NO: 964485 - RNA, 15 nt, Homo sapiens
aacuaaccagcauuc

SEQ ID NO: 964486 - RNA, 16 nt, Homo sapiens
aacuaaugacaaguga

SEQ ID NO: 964487 - RNA, 14 nt, Homo sapiens
aacuaccaugucuu

SEQ ID NO: 964488 - RNA, 14 nt, Homo sapiens
aacuaccuuccacu

SEQ ID NO: 964489 - RNA, 21 nt, Homo sapiens
aacuagaaggcuucucuccac

SEQ ID NO: 964490 - RNA, 16 nt, Homo sapiens
aacuagagcacagaag

SEQ ID NO: 964491 - RNA, 20 nt, Homo sapiens
aacuagagcacagaaggaau

SEQ ID NO: 964492 - RNA, 22 nt, Homo sapiens
aacuagcaaugccugagccuga

SEQ ID NO: 964493 - RNA, 12 nt, Homo sapiens
aacuagccaaac

SEQ ID NO: 964494 - RNA, 18 nt, Homo sapiens
aacuagccaaaccaggac

SEQ ID NO: 964495 - RNA, 18 nt, Homo sapiens
aacuauaagauacaauaa

SEQ ID NO: 964496 - RNA, 22 nt, Homo sapiens
aacucucaccaugaugugaaga

SEQ ID NO: 964497 - RNA, 23 nt, Homo sapiens
aacucugcuugauuuuugccucu

SEQ ID NO: 964498 - RNA, 17 nt, Homo sapiens
aacucugggcugccaug

SEQ ID NO: 964499 - RNA, 13 nt, Homo sapiens
aacucuuaucuca

SEQ ID NO: 964500 - RNA, 21 nt, Homo sapiens
aacugaaaugccugcuuugaa

SEQ ID NO: 964501 - RNA, 21 nt, Homo sapiens
aacugaaggggugcacccacc

SEQ ID NO: 964502 - RNA, 19 nt, Homo sapiens
aacugagguucuugggaua

SEQ ID NO: 964503 - RNA, 23 nt, Homo sapiens
aacugguauuguuuacguuugau

SEQ ID NO: 964504 - RNA, 15 nt, Homo sapiens
aacugucuuccucaa

SEQ ID NO: 964505 - RNA, 22 nt, Homo sapiens
aacuguuaaggagcuucaggga

SEQ ID NO: 964506 - RNA, 16 nt, Homo sapiens
aacuuagagauugcau

SEQ ID NO: 964507 - RNA, 16 nt, Homo sapiens
aacuucauuugacaca

SEQ ID NO: 964508 - RNA, 23 nt, Homo sapiens
aacuuuguaaccagaauuauaca

SEQ ID NO: 964509 - RNA, 15 nt, Homo sapiens
aagaaaaaaagggag

SEQ ID NO: 964510 - RNA, 15 nt, Homo sapiens
aagaaaauagucagu

SEQ ID NO: 964511 - RNA, 13 nt, Homo sapiens
aagaaaaucacuu

SEQ ID NO: 964512 - RNA, 14 nt, Homo sapiens
aagaaagccuaaaa

SEQ ID NO: 964513 - RNA, 19 nt, Homo sapiens
aagaaaucuuucucccuca

SEQ ID NO: 964514 - RNA, 18 nt, Homo sapiens
aagaaaugcauguuuccu

SEQ ID NO: 964515 - RNA, 22 nt, Homo sapiens
aagaaauuccauacuucucuca

SEQ ID NO: 964516 - RNA, 12 nt, Homo sapiens
aagaagacauga

SEQ ID NO: 964517 - RNA, 13 nt, Homo sapiens
aagaaggaacaau

SEQ ID NO: 964518 - RNA, 13 nt, Homo sapiens
aagaauggcuuuc

SEQ ID NO: 964519 - RNA, 13 nt, Homo sapiens
aagaauuggccag

SEQ ID NO: 964520 - RNA, 15 nt, Homo sapiens
aagacaaacugcaca

SEQ ID NO: 964521 - RNA, 15 nt, Homo sapiens
aagacaaccaucaca

SEQ ID NO: 964522 - RNA, 13 nt, Homo sapiens
aagacaagcauuu

SEQ ID NO: 964523 - RNA, 19 nt, Homo sapiens
aagacaucuuaauccugaa

SEQ ID NO: 964524 - RNA, 15 nt, Homo sapiens
aagacaugacauucu

SEQ ID NO: 964525 - RNA, 17 nt, Homo sapiens
aagaccagccuggccaa

SEQ ID NO: 964526 - RNA, 20 nt, Homo sapiens
aagaccggcugguggagcug

SEQ ID NO: 964527 - RNA, 19 nt, Homo sapiens
aagacugguuuucugccaa

SEQ ID NO: 964528 - RNA, 21 nt, Homo sapiens
aagagaacucgcgcucaguaa

SEQ ID NO: 964529 - RNA, 13 nt, Homo sapiens
aagagaugaauug

SEQ ID NO: 964530 - RNA, 23 nt, Homo sapiens
aagagcagucacaacagagugaa

SEQ ID NO: 964531 - RNA, 13 nt, Homo sapiens
aagagcugaccca

SEQ ID NO: 964532 - RNA, 16 nt, Homo sapiens
aagagcuuaagaacca

SEQ ID NO: 964533 - RNA, 15 nt, Homo sapiens
aagagcuugcuccag

SEQ ID NO: 964534 - RNA, 13 nt, Homo sapiens
aagagggcuuccu

SEQ ID NO: 964535 - RNA, 21 nt, Homo sapiens
aagagggucuuccuaagaaga

SEQ ID NO: 964536 - RNA, 18 nt, Homo sapiens
aagauaaauucaugcacu

SEQ ID NO: 964537 - RNA, 20 nt, Homo sapiens
aagaucagcgacugccacau

SEQ ID NO: 964538 - RNA, 16 nt, Homo sapiens
aagaugaaggcaucaa

SEQ ID NO: 964539 - RNA, 18 nt, Homo sapiens
aagauggggcgagccagg

SEQ ID NO: 964540 - RNA, 22 nt, Homo sapiens
aagauuugaugggccacaacug

SEQ ID NO: 964541 - RNA, 15 nt, Homo sapiens
aagauuuuauucuua

SEQ ID NO: 964542 - RNA, 15 nt, Homo sapiens
aagcaaaaucuaaaa

SEQ ID NO: 964543 - RNA, 16 nt, Homo sapiens
aagcaaaaugcuuaca

SEQ ID NO: 964544 - RNA, 14 nt, Homo sapiens
aagcaaauuuugua

SEQ ID NO: 964545 - RNA, 17 nt, Homo sapiens
aagcaaugguugaugau

SEQ ID NO: 964546 - RNA, 18 nt, Homo sapiens
aagcaaugguugaugaua

SEQ ID NO: 964547 - RNA, 19 nt, Homo sapiens
cuccugggcucaagcaauc

SEQ ID NO: 964548 - RNA, 12 nt, Homo sapiens
cuccuugcugca

SEQ ID NO: 964549 - RNA, 16 nt, Homo sapiens
cuccuugcugcauuga

SEQ ID NO: 964550 - RNA, 17 nt, Homo sapiens
cuccuuuuccacuuuaa

SEQ ID NO: 964551 - RNA, 18 nt, Homo sapiens
cuccuuuucccaaagcau

SEQ ID NO: 964552 - RNA, 21 nt, Homo sapiens
cucgcacaccucugcaccuuu

SEQ ID NO: 964553 - RNA, 22 nt, Homo sapiens
cucgccagcucauucucaccaa

SEQ ID NO: 964554 - RNA, 10 nt, Homo sapiens
cucgcugcca

SEQ ID NO: 964555 - RNA, 18 nt, Homo sapiens
cucgcugccaucaccgcu

SEQ ID NO: 964556 - RNA, 18 nt, Homo sapiens
cucggagaagagcgcagu

SEQ ID NO: 964557 - RNA, 12 nt, Homo sapiens
cucguggcuguc

SEQ ID NO: 964558 - RNA, 17 nt, Homo sapiens
cucuaacaaacaagaga

SEQ ID NO: 964559 - RNA, 16 nt, Homo sapiens
cucuacuaaugccucu

SEQ ID NO: 964560 - RNA, 20 nt, Homo sapiens
cucuagugacuuccugguga

SEQ ID NO: 964561 - RNA, 22 nt, Homo sapiens
cucuauacaaaaugauuuugaa

SEQ ID NO: 964562 - RNA, 21 nt, Homo sapiens
cucucaccagauaaguccuuu

SEQ ID NO: 964563 - RNA, 14 nt, Homo sapiens
cucucagauuucca

SEQ ID NO: 964564 - RNA, 20 nt, Homo sapiens
cucucccaacucuugcacag

SEQ ID NO: 964565 - RNA, 17 nt, Homo sapiens
cucuccucuucuacuca

SEQ ID NO: 964566 - RNA, 19 nt, Homo sapiens
cucucuggaaggagacuga

SEQ ID NO: 964567 - RNA, 19 nt, Homo sapiens
cucucuuuccuccacccau

SEQ ID NO: 964568 - RNA, 14 nt, Homo sapiens
cucugaagccacaa

SEQ ID NO: 964569 - RNA, 19 nt, Homo sapiens
cucugaagcuaauuguacu

SEQ ID NO: 964570 - RNA, 16 nt, Homo sapiens
cucugauugcagcaca

SEQ ID NO: 964571 - RNA, 12 nt, Homo sapiens
cucugcacaugu

SEQ ID NO: 964572 - RNA, 20 nt, Homo sapiens
cucugcacaugucuuguaca

SEQ ID NO: 964573 - RNA, 15 nt, Homo sapiens
cucugccuuaaacac

SEQ ID NO: 964574 - RNA, 21 nt, Homo sapiens
cucugccuuaaacacacauug

SEQ ID NO: 964575 - RNA, 22 nt, Homo sapiens
cucugccuuaaacacacauugc

SEQ ID NO: 964576 - RNA, 15 nt, Homo sapiens
cucugggaguaauac

SEQ ID NO: 964577 - RNA, 22 nt, Homo sapiens
cucuggucccagcauccagcug

SEQ ID NO: 964578 - RNA, 17 nt, Homo sapiens
cucuguggaugauguga

SEQ ID NO: 964579 - RNA, 13 nt, Homo sapiens
cucuuagagccau

SEQ ID NO: 964580 - RNA, 21 nt, Homo sapiens
cucuuaucucagucaugcaua

SEQ ID NO: 964581 - RNA, 17 nt, Homo sapiens
cucuucagcacaaagac

SEQ ID NO: 964582 - RNA, 13 nt, Homo sapiens
cucuuccugugau

SEQ ID NO: 964583 - RNA, 14 nt, Homo sapiens
cucuuccugugauc

SEQ ID NO: 964584 - RNA, 15 nt, Homo sapiens
cucuuccugugaucc

SEQ ID NO: 964585 - RNA, 14 nt, Homo sapiens
cucuuuaguguucu

SEQ ID NO: 964586 - RNA, 18 nt, Homo sapiens
cucuuucugcucugccau

SEQ ID NO: 964587 - RNA, 19 nt, Homo sapiens
cucuuuuuuugagugacag

SEQ ID NO: 964588 - RNA, 20 nt, Homo sapiens
cugaaaagaugguaucauau

SEQ ID NO: 964589 - RNA, 20 nt, Homo sapiens
cugaaauauuuucuacuuua

SEQ ID NO: 964590 - RNA, 11 nt, Homo sapiens
cugaacacugc

SEQ ID NO: 964591 - RNA, 13 nt, Homo sapiens
cugaagaccucca

SEQ ID NO: 964592 - RNA, 14 nt, Homo sapiens
cugaagaccuccac

SEQ ID NO: 964593 - RNA, 23 nt, Homo sapiens
cugaagcugaccaacacuacaga

SEQ ID NO: 964594 - RNA, 22 nt, Homo sapiens
cugaauuuuuaaaacccauuua

SEQ ID NO: 964595 - RNA, 22 nt, Homo sapiens
cugaccauauugugcuucacag

SEQ ID NO: 964596 - RNA, 13 nt, Homo sapiens
cugaccccagugu

SEQ ID NO: 964597 - RNA, 14 nt, Homo sapiens
cugaccccauuccu

SEQ ID NO: 964598 - RNA, 23 nt, Homo sapiens
cugaccugugcacaccccacucc

SEQ ID NO: 964599 - RNA, 14 nt, Homo sapiens
cugagacugugcug

SEQ ID NO: 964600 - RNA, 18 nt, Homo sapiens
cugagcaaaaagaccagc

SEQ ID NO: 964601 - RNA, 19 nt, Homo sapiens
cugagcaaaaagaccagcc

SEQ ID NO: 964602 - RNA, 16 nt, Homo sapiens
cugagcagccucugga

SEQ ID NO: 964603 - RNA, 16 nt, Homo sapiens
cugagcugcagcucuc

SEQ ID NO: 964604 - RNA, 22 nt, Homo sapiens
cugaggaauuucaccuguaaac

SEQ ID NO: 964605 - RNA, 18 nt, Homo sapiens
cugaggagauacugaaca

SEQ ID NO: 964606 - RNA, 22 nt, Homo sapiens
cugaggucaucggcguggccca

SEQ ID NO: 964607 - RNA, 16 nt, Homo sapiens
cugagucagagccaug

SEQ ID NO: 964608 - RNA, 13 nt, Homo sapiens
cugagugcugaaa

SEQ ID NO: 964609 - RNA, 16 nt, Homo sapiens
cugaucauuacauggc

SEQ ID NO: 964610 - RNA, 17 nt, Homo sapiens
cugaucugcggaucuca

SEQ ID NO: 964611 - RNA, 22 nt, Homo sapiens
cugaugaaaaauaugugcuuga

SEQ ID NO: 964612 - RNA, 15 nt, Homo sapiens
cugaugauacaugca

SEQ ID NO: 964613 - RNA, 20 nt, Homo sapiens
cugaugguguggccuguggc

SEQ ID NO: 964614 - RNA, 19 nt, Homo sapiens
cugaugucccagugcucac

SEQ ID NO: 964615 - RNA, 17 nt, Homo sapiens
cugcacaugucuuguac

SEQ ID NO: 964616 - RNA, 18 nt, Homo sapiens
cugcacaugucuuguaca

SEQ ID NO: 964617 - RNA, 23 nt, Homo sapiens
cugcacaugucuuguacaugugu

SEQ ID NO: 964618 - RNA, 16 nt, Homo sapiens
cugcaccccugggcca

SEQ ID NO: 964619 - RNA, 14 nt, Homo sapiens
cugcaccuuugcac

SEQ ID NO: 964620 - RNA, 15 nt, Homo sapiens
cugcaccuuugcacg

SEQ ID NO: 964621 - RNA, 22 nt, Homo sapiens
cugcacggugggagaccugcug

SEQ ID NO: 964622 - RNA, 23 nt, Homo sapiens
cugcacugaggcagcgaccucaa

SEQ ID NO: 964623 - RNA, 17 nt, Homo sapiens
cugcacugccagcaucu

SEQ ID NO: 964624 - RNA, 13 nt, Homo sapiens
cugcacugugaac

SEQ ID NO: 964625 - RNA, 20 nt, Homo sapiens
cugcagaaaauuaauugaaa

SEQ ID NO: 964626 - RNA, 19 nt, Homo sapiens
cugcagcaggccacugggg

SEQ ID NO: 964627 - RNA, 16 nt, Homo sapiens
cugcaguccuacucaa

SEQ ID NO: 964628 - RNA, 16 nt, Homo sapiens
cugcaguucuacucag

SEQ ID NO: 964629 - RNA, 13 nt, Homo sapiens
cugccaaacacau

SEQ ID NO: 964630 - RNA, 18 nt, Homo sapiens
cugccacagccagaggag

SEQ ID NO: 964631 - RNA, 14 nt, Homo sapiens
cugccagacaugga

SEQ ID NO: 964632 - RNA, 12 nt, Homo sapiens
cugccagccuug

SEQ ID NO: 964633 - RNA, 19 nt, Homo sapiens
cugccaggaguagugagcu

SEQ ID NO: 964634 - RNA, 21 nt, Homo sapiens
cugccauaaauauuucucaac

SEQ ID NO: 964635 - RNA, 14 nt, Homo sapiens
cugccauguugccc

SEQ ID NO: 964636 - RNA, 17 nt, Homo sapiens
cugccauguugccccuu

SEQ ID NO: 964637 - RNA, 23 nt, Homo sapiens
cugccccagcacucacacccuaa

SEQ ID NO: 964638 - RNA, 15 nt, Homo sapiens
cugccccucucacca

SEQ ID NO: 964639 - RNA, 17 nt, Homo sapiens
cugccccucucaccaaa

SEQ ID NO: 964640 - RNA, 18 nt, Homo sapiens
cugccccugccccaaguc

SEQ ID NO: 964641 - RNA, 13 nt, Homo sapiens
cugccuagauuca

SEQ ID NO: 964642 - RNA, 23 nt, Homo sapiens
cugccugaaggcucacaccucau

SEQ ID NO: 964643 - RNA, 20 nt, Homo sapiens
cugccuggggggcaggguua

SEQ ID NO: 964644 - RNA, 18 nt, Homo sapiens
cugccuucucaugaucca

SEQ ID NO: 964645 - RNA, 16 nt, Homo sapiens
cugcucagcagagccu

SEQ ID NO: 964646 - RNA, 15 nt, Homo sapiens
cugcucauauuguga

SEQ ID NO: 964647 - RNA, 13 nt, Homo sapiens
cugcucccuggca

SEQ ID NO: 964648 - RNA, 22 nt, Homo sapiens
cugcuccuccccuuucacaggu

SEQ ID NO: 964649 - RNA, 14 nt, Homo sapiens
cugcucugcuauau

SEQ ID NO: 964650 - RNA, 17 nt, Homo sapiens
cugcucuuguucuacug

SEQ ID NO: 964651 - RNA, 16 nt, Homo sapiens
cugcugaacacagugu

SEQ ID NO: 964652 - RNA, 23 nt, Homo sapiens
cugcugaauuuggggcuacuuau

SEQ ID NO: 964653 - RNA, 16 nt, Homo sapiens
cugcugccugcugaga

SEQ ID NO: 964654 - RNA, 15 nt, Homo sapiens
cugcuggccaugaau

SEQ ID NO: 964655 - RNA, 14 nt, Homo sapiens
cugcugucuuguug

SEQ ID NO: 964656 - RNA, 20 nt, Homo sapiens
cugcuuaaauuucuccagug

SEQ ID NO: 964657 - RNA, 13 nt, Homo sapiens
cugcuuacuaaug

SEQ ID NO: 964658 - RNA, 15 nt, Homo sapiens
cugcuucaugggaaa

SEQ ID NO: 964659 - RNA, 10 nt, Homo sapiens
cugcuuccag

SEQ ID NO: 964660 - RNA, 13 nt, Homo sapiens
cugcuuccugucu

SEQ ID NO: 964661 - RNA, 18 nt, Homo sapiens
cugcuuguuaugcaucau

SEQ ID NO: 964662 - RNA, 14 nt, Homo sapiens
gagacagccucagc

SEQ ID NO: 964663 - RNA, 17 nt, Homo sapiens
gagacggaguuucacuc

SEQ ID NO: 964664 - RNA, 12 nt, Homo sapiens
gagagacacugg

SEQ ID NO: 964665 - RNA, 14 nt, Homo sapiens
gagagaugguguuu

SEQ ID NO: 964666 - RNA, 12 nt, Homo sapiens
gagagauguuuu

SEQ ID NO: 964667 - RNA, 15 nt, Homo sapiens
gagagcucacagacu

SEQ ID NO: 964668 - RNA, 23 nt, Homo sapiens
gagaggaccuaucccaaaugugg

SEQ ID NO: 964669 - RNA, 18 nt, Homo sapiens
gagagggaggucacugga

SEQ ID NO: 964670 - RNA, 23 nt, Homo sapiens
gagaggguguuggucagucuaca

SEQ ID NO: 964671 - RNA, 11 nt, Homo sapiens
gagaguaccau

SEQ ID NO: 964672 - RNA, 22 nt, Homo sapiens
gagaucacgucacugcacucca

SEQ ID NO: 964673 - RNA, 19 nt, Homo sapiens
gagaucgugcuacugcacu

SEQ ID NO: 964674 - RNA, 20 nt, Homo sapiens
gagaugcuucucuccuugcc

SEQ ID NO: 964675 - RNA, 16 nt, Homo sapiens
gagauggguccagggg

SEQ ID NO: 964676 - RNA, 14 nt, Homo sapiens
gagcaaaaagacca

SEQ ID NO: 964677 - RNA, 13 nt, Homo sapiens
gagcaaaagccuc

SEQ ID NO: 964678 - RNA, 19 nt, Homo sapiens
gagcaaauaaagaccugag

SEQ ID NO: 964679 - RNA, 14 nt, Homo sapiens
gagcaacucuccac

SEQ ID NO: 964680 - RNA, 21 nt, Homo sapiens
gagcacggacugucaguucuc

SEQ ID NO: 964681 - RNA, 21 nt, Homo sapiens
gagccacaagcugcacuguga

SEQ ID NO: 964682 - RNA, 18 nt, Homo sapiens
gagccaccagcaaagcgc

SEQ ID NO: 964683 - RNA, 17 nt, Homo sapiens
gagccacgcagugccug

SEQ ID NO: 964684 - RNA, 13 nt, Homo sapiens
gagccagcagcga

SEQ ID NO: 964685 - RNA, 20 nt, Homo sapiens
gagccagcuuggggccacca

SEQ ID NO: 964686 - RNA, 21 nt, Homo sapiens
gagccccaggggacaagggau

SEQ ID NO: 964687 - RNA, 18 nt, Homo sapiens
gagccuggggcacuccuc

SEQ ID NO: 964688 - RNA, 20 nt, Homo sapiens
gagccuucucagaagcacag

SEQ ID NO: 964689 - RNA, 21 nt, Homo sapiens
gagcucacaugggacugggau

SEQ ID NO: 964690 - RNA, 19 nt, Homo sapiens
gagcugagugcugaaauaa

SEQ ID NO: 964691 - RNA, 16 nt, Homo sapiens
gagcugcucuccuauc

SEQ ID NO: 964692 - RNA, 17 nt, Homo sapiens
gagcugcucugcuauau

SEQ ID NO: 964693 - RNA, 19 nt, Homo sapiens
gagcuugcaugcuugcaua

SEQ ID NO: 964694 - RNA, 14 nt, Homo sapiens
gagcuugcuccaga

SEQ ID NO: 964695 - RNA, 17 nt, Homo sapiens
gaggacaauacuggggu

SEQ ID NO: 964696 - RNA, 15 nt, Homo sapiens
gaggagguuucugca

SEQ ID NO: 964697 - RNA, 16 nt, Homo sapiens
gaggaugugucucccu

SEQ ID NO: 964698 - RNA, 12 nt, Homo sapiens
gaggcacuucca

SEQ ID NO: 964699 - RNA, 17 nt, Homo sapiens
gaggcauacacacagca

SEQ ID NO: 964700 - RNA, 15 nt, Homo sapiens
gaggccgaggccaug

SEQ ID NO: 964701 - RNA, 15 nt, Homo sapiens
gaggccugcacagcu

SEQ ID NO: 964702 - RNA, 14 nt, Homo sapiens
gaggcgcggaguga

SEQ ID NO: 964703 - RNA, 16 nt, Homo sapiens
gaggcugccccucuca

SEQ ID NO: 964704 - RNA, 20 nt, Homo sapiens
gaggcugccccucucaccaa

SEQ ID NO: 964705 - RNA, 15 nt, Homo sapiens
gaggcuuuacagugu

SEQ ID NO: 964706 - RNA, 15 nt, Homo sapiens
gagggagagggaggu

SEQ ID NO: 964707 - RNA, 17 nt, Homo sapiens
gagggauuuucacagug

SEQ ID NO: 964708 - RNA, 21 nt, Homo sapiens
gagggccagguuagcacagcg

SEQ ID NO: 964709 - RNA, 20 nt, Homo sapiens
gagggcugcaguucuacuca

SEQ ID NO: 964710 - RNA, 22 nt, Homo sapiens
gagggcuuccucuagaagccaa

SEQ ID NO: 964711 - RNA, 23 nt, Homo sapiens
gagggcuuccucuagaagccaag

SEQ ID NO: 964712 - RNA, 17 nt, Homo sapiens
gagggggacuaaacuca

SEQ ID NO: 964713 - RNA, 17 nt, Homo sapiens
gaggguggcugccuccu

SEQ ID NO: 964714 - RNA, 17 nt, Homo sapiens
gaggucagcacacauua

SEQ ID NO: 964715 - RNA, 23 nt, Homo sapiens
gaggucaggaguugaagaccagc

SEQ ID NO: 964716 - RNA, 16 nt, Homo sapiens
gaggugccacccagua

SEQ ID NO: 964717 - RNA, 23 nt, Homo sapiens
gagguggaaaauggugccuggag

SEQ ID NO: 964718 - RNA, 22 nt, Homo sapiens
gagguggauguuaugaacagcu

SEQ ID NO: 964719 - RNA, 14 nt, Homo sapiens
gaguaauaagcaug

SEQ ID NO: 964720 - RNA, 20 nt, Homo sapiens
gaguaccuacugugugccag

SEQ ID NO: 964721 - RNA, 15 nt, Homo sapiens
gaguagaaaauguga

SEQ ID NO: 964722 - RNA, 19 nt, Homo sapiens
gaguauuccaugagcugcu

SEQ ID NO: 964723 - RNA, 19 nt, Homo sapiens
gagucucauuugggcuaga

SEQ ID NO: 964724 - RNA, 15 nt, Homo sapiens
gagugacagcuuucu

SEQ ID NO: 964725 - RNA, 16 nt, Homo sapiens
gaguggcccaccgugg

SEQ ID NO: 964726 - RNA, 20 nt, Homo sapiens
gaguuacuggauuuguuguu

SEQ ID NO: 964727 - RNA, 21 nt, Homo sapiens
gaguuaguggauuacugccau

SEQ ID NO: 964728 - RNA, 22 nt, Homo sapiens
gaguucuugugccauagucaca

SEQ ID NO: 964729 - RNA, 22 nt, Homo sapiens
gaguugauuuccucccucugcc

SEQ ID NO: 964730 - RNA, 19 nt, Homo sapiens
gaguuucacaaauccuuca

SEQ ID NO: 964731 - RNA, 22 nt, Homo sapiens
gaguuugacuuagaauaaugaa

SEQ ID NO: 964732 - RNA, 21 nt, Homo sapiens
gaguuugagcugccuucccua

SEQ ID NO: 964733 - RNA, 20 nt, Homo sapiens
gaguuuuuccucccagugag

SEQ ID NO: 964734 - RNA, 14 nt, Homo sapiens
gauaaaauuaauuu

SEQ ID NO: 964735 - RNA, 16 nt, Homo sapiens
gauaacauaaauaaaa

SEQ ID NO: 964736 - RNA, 19 nt, Homo sapiens
gauaauuguuucauucauc

SEQ ID NO: 964737 - RNA, 20 nt, Homo sapiens
gauacaugguugugaccuga

SEQ ID NO: 964738 - RNA, 15 nt, Homo sapiens
gauacuguaauacuu

SEQ ID NO: 964739 - RNA, 18 nt, Homo sapiens
gauagaacaaugcuauaa

SEQ ID NO: 964740 - RNA, 15 nt, Homo sapiens
gauagggaacugggg

SEQ ID NO: 964741 - RNA, 16 nt, Homo sapiens
gauagggaacugggga

SEQ ID NO: 964742 - RNA, 23 nt, Homo sapiens
gauaucaggaaauaucugugaag

SEQ ID NO: 964743 - RNA, 16 nt, Homo sapiens
gauauugaauguuaaa

SEQ ID NO: 964744 - RNA, 17 nt, Homo sapiens
gauauuuucacacuggu

SEQ ID NO: 964745 - RNA, 18 nt, Homo sapiens
gaucagagcgcacaggga

SEQ ID NO: 964746 - RNA, 21 nt, Homo sapiens
gaucagccuccgccauuccaa

SEQ ID NO: 964747 - RNA, 16 nt, Homo sapiens
gaucaucuuuccuguu

SEQ ID NO: 964748 - RNA, 20 nt, Homo sapiens
gaucaucuuuccuguuccag

SEQ ID NO: 964749 - RNA, 15 nt, Homo sapiens
gauccagccaugccu

SEQ ID NO: 964750 - RNA, 18 nt, Homo sapiens
gaucggcggccacugcgc

SEQ ID NO: 964751 - RNA, 13 nt, Homo sapiens
gaucuaguucuca

SEQ ID NO: 964752 - RNA, 22 nt, Homo sapiens
gaucuaguucucaaucacugcu

SEQ ID NO: 964753 - RNA, 15 nt, Homo sapiens
gaucucaaacuugau

SEQ ID NO: 964754 - RNA, 22 nt, Homo sapiens
gaucugagucagagccaugucu

SEQ ID NO: 964755 - RNA, 18 nt, Homo sapiens
gaucuuaacaaagccuuu

SEQ ID NO: 964756 - RNA, 9 nt, Homo sapiens
gaucuugaa

SEQ ID NO: 964757 - RNA, 18 nt, Homo sapiens
gaucuugaauagucucau

SEQ ID NO: 964758 - RNA, 18 nt, Homo sapiens
gaucuuucugcaggaaau

SEQ ID NO: 964759 - RNA, 18 nt, Homo sapiens
gaugaaaaauugcugacu

SEQ ID NO: 964760 - RNA, 22 nt, Homo sapiens
gaugaaccugagcgggugccga

SEQ ID NO: 964761 - RNA, 17 nt, Homo sapiens
gaugaaggggcucuuca

SEQ ID NO: 964762 - RNA, 15 nt, Homo sapiens
gaugaauugcauuau

SEQ ID NO: 964763 - RNA, 16 nt, Homo sapiens
gaugaugacugaaaau

SEQ ID NO: 964764 - RNA, 11 nt, Homo sapiens
gaugcauuuaa

SEQ ID NO: 964765 - RNA, 20 nt, Homo sapiens
gaugccaauuuccucuccac

SEQ ID NO: 964766 - RNA, 16 nt, Homo sapiens
gauggggacauuugaa

SEQ ID NO: 964767 - RNA, 14 nt, Homo sapiens
gauggguccagggg

SEQ ID NO: 964768 - RNA, 19 nt, Homo sapiens
gauguaccaggcucucgca

SEQ ID NO: 964769 - RNA, 14 nt, Homo sapiens
gaugucacugccug

SEQ ID NO: 964770 - RNA, 19 nt, Homo sapiens
gaugucauggagugacaga

SEQ ID NO: 964771 - RNA, 16 nt, Homo sapiens
gaugucuauguagcug

SEQ ID NO: 964772 - RNA, 17 nt, Homo sapiens
gaugugagccaccgugc

SEQ ID NO: 964773 - RNA, 18 nt, Homo sapiens
gauguuccuuccaguguc

SEQ ID NO: 964774 - RNA, 17 nt, Homo sapiens
gauuaagggacauuucu

SEQ ID NO: 964775 - RNA, 20 nt, Homo sapiens
gauucaacacuuaagucuca

SEQ ID NO: 964776 - RNA, 20 nt, Homo sapiens
cagcaacuucuucuccaucc

SEQ ID NO: 964777 - RNA, 18 nt, Homo sapiens
cagcaauagggugcaguu

SEQ ID NO: 964778 - RNA, 14 nt, Homo sapiens
cagcacauugucac

SEQ ID NO: 964779 - RNA, 21 nt, Homo sapiens
cagcagaagccuccaagcaca

SEQ ID NO: 964780 - RNA, 15 nt, Homo sapiens
cagcagaugcuguug

SEQ ID NO: 964781 - RNA, 16 nt, Homo sapiens
cagcagccucccugaa

SEQ ID NO: 964782 - RNA, 17 nt, Homo sapiens
cagcagcucauagaauu

SEQ ID NO: 964783 - RNA, 21 nt, Homo sapiens
cagcauuuucacauuuugccu

SEQ ID NO: 964784 - RNA, 19 nt, Homo sapiens
cagccagugaggaugacag

SEQ ID NO: 964785 - RNA, 20 nt, Homo sapiens
cagccaugaaacugacucau

SEQ ID NO: 964786 - RNA, 21 nt, Homo sapiens
cagcccagagacuuuguagau

SEQ ID NO: 964787 - RNA, 21 nt, Homo sapiens
cagcccagccccuccaaaggu

SEQ ID NO: 964788 - RNA, 17 nt, Homo sapiens
cagcccccacuccaguc

SEQ ID NO: 964789 - RNA, 15 nt, Homo sapiens
cagccccucaugccu

SEQ ID NO: 964790 - RNA, 13 nt, Homo sapiens
cagccuagcacag

SEQ ID NO: 964791 - RNA, 18 nt, Homo sapiens
cagccuccgccauuccaa

SEQ ID NO: 964792 - RNA, 21 nt, Homo sapiens
cagccuggccaacauggugaa

SEQ ID NO: 964793 - RNA, 22 nt, Homo sapiens
cagccuugcaucaagggcuuua

SEQ ID NO: 964794 - RNA, 13 nt, Homo sapiens
cagcgaccucaag

SEQ ID NO: 964795 - RNA, 17 nt, Homo sapiens
cagcuaaguguggagcu

SEQ ID NO: 964796 - RNA, 18 nt, Homo sapiens
cagcuaaguguggagcug

SEQ ID NO: 964797 - RNA, 15 nt, Homo sapiens
cagcuacaauuguaa

SEQ ID NO: 964798 - RNA, 15 nt, Homo sapiens
cagcugagacaggcc

SEQ ID NO: 964799 - RNA, 12 nt, Homo sapiens
cagcugcacuga

SEQ ID NO: 964800 - RNA, 16 nt, Homo sapiens
cagcugcgcuugcuuu

SEQ ID NO: 964801 - RNA, 16 nt, Homo sapiens
cagcuucaacuuuucu

SEQ ID NO: 964802 - RNA, 19 nt, Homo sapiens
cagcuucccgaguagcugg

SEQ ID NO: 964803 - RNA, 16 nt, Homo sapiens
cagcuuucugggaugu

SEQ ID NO: 964804 - RNA, 14 nt, Homo sapiens
caggaaauuucuua

SEQ ID NO: 964805 - RNA, 15 nt, Homo sapiens
caggacaaccugcug

SEQ ID NO: 964806 - RNA, 15 nt, Homo sapiens
caggacugugccuga

SEQ ID NO: 964807 - RNA, 18 nt, Homo sapiens
caggacugugccugaaca

SEQ ID NO: 964808 - RNA, 17 nt, Homo sapiens
caggagacaaaagagca

SEQ ID NO: 964809 - RNA, 19 nt, Homo sapiens
caggagauggguccagggg

SEQ ID NO: 964810 - RNA, 17 nt, Homo sapiens
caggagcaggcacgggu

SEQ ID NO: 964811 - RNA, 13 nt, Homo sapiens
caggaucaccucc

SEQ ID NO: 964812 - RNA, 15 nt, Homo sapiens
caggaucauggugua

SEQ ID NO: 964813 - RNA, 15 nt, Homo sapiens
caggcacacacagcc

SEQ ID NO: 964814 - RNA, 12 nt, Homo sapiens
caggcacgggug

SEQ ID NO: 964815 - RNA, 15 nt, Homo sapiens
caggcagggucuguu

SEQ ID NO: 964816 - RNA, 18 nt, Homo sapiens
caggcauagaggcuucuc

SEQ ID NO: 964817 - RNA, 18 nt, Homo sapiens
caggccagugaccucauu

SEQ ID NO: 964818 - RNA, 18 nt, Homo sapiens
caggccuuaccgcucugu

SEQ ID NO: 964819 - RNA, 20 nt, Homo sapiens
caggcuggaguacaguggca

SEQ ID NO: 964820 - RNA, 18 nt, Homo sapiens
caggcugggccaugucca

SEQ ID NO: 964821 - RNA, 19 nt, Homo sapiens
caggcugggccauguccaa

SEQ ID NO: 964822 - RNA, 20 nt, Homo sapiens
caggcugggccauguccaaa

SEQ ID NO: 964823 - RNA, 22 nt, Homo sapiens
caggcuguaagcauucugagcu

SEQ ID NO: 964824 - RNA, 18 nt, Homo sapiens
cagggaacagccacuccc

SEQ ID NO: 964825 - RNA, 15 nt, Homo sapiens
cagggcacuacauaa

SEQ ID NO: 964826 - RNA, 20 nt, Homo sapiens
cagggccuccugggggaccu

SEQ ID NO: 964827 - RNA, 19 nt, Homo sapiens
cagggcugggccagugcau

SEQ ID NO: 964828 - RNA, 23 nt, Homo sapiens
caggggaaggcccugaggcggag

SEQ ID NO: 964829 - RNA, 14 nt, Homo sapiens
caggggacaaggga

SEQ ID NO: 964830 - RNA, 16 nt, Homo sapiens
cagggucuugcuguaa

SEQ ID NO: 964831 - RNA, 17 nt, Homo sapiens
cagggugaagcagcuca

SEQ ID NO: 964832 - RNA, 21 nt, Homo sapiens
cagggugcagcccaaucugcc

SEQ ID NO: 964833 - RNA, 21 nt, Homo sapiens
cagggugggcuuguggggccu

SEQ ID NO: 964834 - RNA, 20 nt, Homo sapiens
caggguuaggaaucucuuca

SEQ ID NO: 964835 - RNA, 15 nt, Homo sapiens
cagguaaaacagggc

SEQ ID NO: 964836 - RNA, 21 nt, Homo sapiens
cagguaggauacguacaccuc

SEQ ID NO: 964837 - RNA, 21 nt, Homo sapiens
cagguaggucggcacuuggac

SEQ ID NO: 964838 - RNA, 19 nt, Homo sapiens
caggucauuauuuuuuaca

SEQ ID NO: 964839 - RNA, 20 nt, Homo sapiens
caggucuccggaggagacac

SEQ ID NO: 964840 - RNA, 18 nt, Homo sapiens
cagguguauaaauguaca

SEQ ID NO: 964841 - RNA, 20 nt, Homo sapiens
cagguuuucuucacugccag

SEQ ID NO: 964842 - RNA, 13 nt, Homo sapiens
caguaaacgggaa

SEQ ID NO: 964843 - RNA, 15 nt, Homo sapiens
caguaccaucuacau

SEQ ID NO: 964844 - RNA, 23 nt, Homo sapiens
caguagcagguaaggaaagggcu

SEQ ID NO: 964845 - RNA, 14 nt, Homo sapiens
caguagcccagagu

SEQ ID NO: 964846 - RNA, 20 nt, Homo sapiens
caguaugugggggcuucauc

SEQ ID NO: 964847 - RNA, 15 nt, Homo sapiens
caguauuguggggcu

SEQ ID NO: 964848 - RNA, 13 nt, Homo sapiens
cagucacaacaga

SEQ ID NO: 964849 - RNA, 19 nt, Homo sapiens
cagucacaacagagugaaa

SEQ ID NO: 964850 - RNA, 21 nt, Homo sapiens
cagucagaguccagugcucug

SEQ ID NO: 964851 - RNA, 11 nt, Homo sapiens
cagucaucucc

SEQ ID NO: 964852 - RNA, 14 nt, Homo sapiens
cagucuuugcucag

SEQ ID NO: 964853 - RNA, 17 nt, Homo sapiens
cagugacuuugagcuga

SEQ ID NO: 964854 - RNA, 16 nt, Homo sapiens
cagugauauggcagaa

SEQ ID NO: 964855 - RNA, 13 nt, Homo sapiens
cagugcauaugca

SEQ ID NO: 964856 - RNA, 15 nt, Homo sapiens
cagugccuauugaua

SEQ ID NO: 964857 - RNA, 15 nt, Homo sapiens
cagugcucaccagcc

SEQ ID NO: 964858 - RNA, 14 nt, Homo sapiens
caguggacucuucc

SEQ ID NO: 964859 - RNA, 15 nt, Homo sapiens
cagugucauuucuca

SEQ ID NO: 964860 - RNA, 21 nt, Homo sapiens
cagugugcuccagauggugcu

SEQ ID NO: 964861 - RNA, 22 nt, Homo sapiens
caguguugugccccuucacuca

SEQ ID NO: 964862 - RNA, 12 nt, Homo sapiens
caguucaucacc

SEQ ID NO: 964863 - RNA, 22 nt, Homo sapiens
caguuccacuggggcaagcucc

SEQ ID NO: 964864 - RNA, 18 nt, Homo sapiens
caguucuacacugauaca

SEQ ID NO: 964865 - RNA, 15 nt, Homo sapiens
caguugcauucauua

SEQ ID NO: 964866 - RNA, 15 nt, Homo sapiens
caguuguuccaggga

SEQ ID NO: 964867 - RNA, 19 nt, Homo sapiens
caguuucuuagcuuuuuaa

SEQ ID NO: 964868 - RNA, 20 nt, Homo sapiens
caguuuuccagaacacucuu

SEQ ID NO: 964869 - RNA, 20 nt, Homo sapiens
caguuuuguacauagcaaau

SEQ ID NO: 964870 - RNA, 13 nt, Homo sapiens
cauaaagcauuuu

SEQ ID NO: 964871 - RNA, 16 nt, Homo sapiens
cauaagcccaguucau

SEQ ID NO: 964872 - RNA, 17 nt, Homo sapiens
cauaauaagcuaaagag

SEQ ID NO: 964873 - RNA, 20 nt, Homo sapiens
cauaauagcuacagugcaua

SEQ ID NO: 964874 - RNA, 13 nt, Homo sapiens
cauacacuuuguu

SEQ ID NO: 964875 - RNA, 11 nt, Homo sapiens
cauaccacagc

SEQ ID NO: 964876 - RNA, 15 nt, Homo sapiens
cauaccacagcaucc

SEQ ID NO: 964877 - RNA, 16 nt, Homo sapiens
cauaccuucugaugaa

SEQ ID NO: 964878 - RNA, 15 nt, Homo sapiens
cauacuguucacuca

SEQ ID NO: 964879 - RNA, 14 nt, Homo sapiens
cauacuucucucag

SEQ ID NO: 964880 - RNA, 23 nt, Homo sapiens
cauagagaugagcccacccugcu

SEQ ID NO: 964881 - RNA, 16 nt, Homo sapiens
cauagcugacuacaaa

SEQ ID NO: 964882 - RNA, 22 nt, Homo sapiens
cauagucacauggccuaugcac

SEQ ID NO: 964883 - RNA, 17 nt, Homo sapiens
cauagucauugugguuu

SEQ ID NO: 964884 - RNA, 16 nt, Homo sapiens
cauaguggaucacuca

SEQ ID NO: 964885 - RNA, 14 nt, Homo sapiens
cauauaacaauuca

SEQ ID NO: 964886 - RNA, 19 nt, Homo sapiens
cauauaugugaucugggca

SEQ ID NO: 964887 - RNA, 14 nt, Homo sapiens
cauaucagaacugu

SEQ ID NO: 964888 - RNA, 11 nt, Homo sapiens
cauaucuccau

SEQ ID NO: 964889 - RNA, 16 nt, Homo sapiens
cauauggacucugcac

SEQ ID NO: 964890 - RNA, 19 nt, Homo sapiens
cauauggacucugcacaug

SEQ ID NO: 964891 - RNA, 21 nt, Homo sapiens
cauauuccugguguagcacuu

SEQ ID NO: 964892 - RNA, 23 nt, Homo sapiens
caucacccgggaacuuuuuuaga

SEQ ID NO: 964893 - RNA, 16 nt, Homo sapiens
caucacccucuuccug

SEQ ID NO: 964894 - RNA, 19 nt, Homo sapiens
caucacccucuuccuguga

SEQ ID NO: 964895 - RNA, 14 nt, Homo sapiens
cauccagaugugug

SEQ ID NO: 964896 - RNA, 15 nt, Homo sapiens
cauccauccaaaggc

SEQ ID NO: 964897 - RNA, 17 nt, Homo sapiens
cauccaucuuuccaucc

SEQ ID NO: 964898 - RNA, 24 nt, Homo sapiens
cauccaucuuuccauccauuaccu

SEQ ID NO: 964899 - RNA, 15 nt, Homo sapiens
cauccccacccaguc

SEQ ID NO: 964900 - RNA, 15 nt, Homo sapiens
cauccuuccauccau

SEQ ID NO: 964901 - RNA, 15 nt, Homo sapiens
cauccuuucuuuuaa

SEQ ID NO: 964902 - RNA, 16 nt, Homo sapiens
caucuaaaguaaaaag

SEQ ID NO: 964903 - RNA, 20 nt, Homo sapiens
caucucaaaaaaacaaguua

SEQ ID NO: 964904 - RNA, 13 nt, Homo sapiens
caucucuauuuag

SEQ ID NO: 964905 - RNA, 16 nt, Homo sapiens
caucucuuucugcaaa

SEQ ID NO: 964906 - RNA, 12 nt, Homo sapiens
caucuggagacc

SEQ ID NO: 964907 - RNA, 15 nt, Homo sapiens
caucuuagaccucca

SEQ ID NO: 964908 - RNA, 21 nt, Homo sapiens
caucuucucauucccaugugg

SEQ ID NO: 964909 - RNA, 15 nt, Homo sapiens
caucuuuucuaauca

SEQ ID NO: 964910 - RNA, 14 nt, Homo sapiens
caugaaaacacuug

SEQ ID NO: 964911 - RNA, 15 nt, Homo sapiens
caugaaaauaccauu

SEQ ID NO: 964912 - RNA, 19 nt, Homo sapiens
caugaaucaagcaauccag

SEQ ID NO: 964913 - RNA, 16 nt, Homo sapiens
caugacacucuaguga

SEQ ID NO: 964914 - RNA, 19 nt, Homo sapiens
caugagcugcucauuacag

SEQ ID NO: 964915 - RNA, 16 nt, Homo sapiens
caugauacaaauucca

SEQ ID NO: 964916 - RNA, 14 nt, Homo sapiens
caugauaggauuug

SEQ ID NO: 964917 - RNA, 16 nt, Homo sapiens
caugaucauagcucac

SEQ ID NO: 964918 - RNA, 19 nt, Homo sapiens
caugauggcuguagcuguu

SEQ ID NO: 964919 - RNA, 10 nt, Homo sapiens
caugcaaaau

SEQ ID NO: 964920 - RNA, 16 nt, Homo sapiens
caugcagaaacuugga

SEQ ID NO: 964921 - RNA, 18 nt, Homo sapiens
caugcauguccuguaaag

SEQ ID NO: 964922 - RNA, 16 nt, Homo sapiens
caugcucaggagccac

SEQ ID NO: 964923 - RNA, 21 nt, Homo sapiens
caugcucaggagccaccagca

SEQ ID NO: 964924 - RNA, 22 nt, Homo sapiens
caugcuggggcccuaccagcag

SEQ ID NO: 964925 - RNA, 23 nt, Homo sapiens
caugcuugcauaagagcuuaaga

SEQ ID NO: 964926 - RNA, 16 nt, Homo sapiens
cauggaauaaaccauu

SEQ ID NO: 964927 - RNA, 17 nt, Homo sapiens
cauggaauaaaccauuu

SEQ ID NO: 964928 - RNA, 14 nt, Homo sapiens
cauggcuaccucag

SEQ ID NO: 964929 - RNA, 17 nt, Homo sapiens
cauggcuguuaacccac

SEQ ID NO: 964930 - RNA, 21 nt, Homo sapiens
cauggcuuagagaggcuugaa

SEQ ID NO: 964931 - RNA, 22 nt, Homo sapiens
cauguaaggucuucuugugucc

SEQ ID NO: 964932 - RNA, 11 nt, Homo sapiens
cauguacaaaa

SEQ ID NO: 964933 - RNA, 22 nt, Homo sapiens
cauguaugucuuggacacugua

SEQ ID NO: 964934 - RNA, 15 nt, Homo sapiens
cauguccaaguccaa

SEQ ID NO: 964935 - RNA, 22 nt, Homo sapiens
cauguccauacacuuuguugca

SEQ ID NO: 964936 - RNA, 18 nt, Homo sapiens
caugucuuguacaugugu

SEQ ID NO: 964937 - RNA, 22 nt, Homo sapiens
caugugacacauaugcaccuug

SEQ ID NO: 964938 - RNA, 23 nt, Homo sapiens
cauguguaccuacagagcagcca

SEQ ID NO: 964939 - RNA, 13 nt, Homo sapiens
cauuacauggcug

SEQ ID NO: 964940 - RNA, 16 nt, Homo sapiens
cauuaccuccauccau

SEQ ID NO: 964941 - RNA, 16 nt, Homo sapiens
cauuagagaguggcaa

SEQ ID NO: 964942 - RNA, 17 nt, Homo sapiens
cauucaauuagugguca

SEQ ID NO: 964943 - RNA, 19 nt, Homo sapiens
cauucagagcuauggugcu

SEQ ID NO: 964944 - RNA, 15 nt, Homo sapiens
cauucauccuuccau

SEQ ID NO: 964945 - RNA, 17 nt, Homo sapiens
cauucauguucuagucu

SEQ ID NO: 964946 - RNA, 14 nt, Homo sapiens
cauugaacuuuaag

SEQ ID NO: 964947 - RNA, 22 nt, Homo sapiens
cauugaagaauguuagaguaau

SEQ ID NO: 964948 - RNA, 12 nt, Homo sapiens
cauugagaucac

SEQ ID NO: 964949 - RNA, 15 nt, Homo sapiens
cauugcacauaagcu

SEQ ID NO: 964950 - RNA, 14 nt, Homo sapiens
cauuguauucuguu

SEQ ID NO: 964951 - RNA, 19 nt, Homo sapiens
cauugucaccccaagccau

SEQ ID NO: 964952 - RNA, 17 nt, Homo sapiens
cauuuagucuugccagg

SEQ ID NO: 964953 - RNA, 20 nt, Homo sapiens
cauuucauuaagguuccagu

SEQ ID NO: 964954 - RNA, 21 nt, Homo sapiens
cauuuccucgcagccucucag

SEQ ID NO: 964955 - RNA, 21 nt, Homo sapiens
cauuucuucucguuuucacag

SEQ ID NO: 964956 - RNA, 17 nt, Homo sapiens
cauuucuuugcauucca

SEQ ID NO: 964957 - RNA, 14 nt, Homo sapiens
cauuugaacauguu

SEQ ID NO: 964958 - RNA, 14 nt, Homo sapiens
cauuugauggccac

SEQ ID NO: 964959 - RNA, 15 nt, Homo sapiens
cauuugccuaauucc

SEQ ID NO: 964960 - RNA, 12 nt, Homo sapiens
cauuuguagcuu

SEQ ID NO: 964961 - RNA, 18 nt, Homo sapiens
cauuuuagaaacuacaaa

SEQ ID NO: 964962 - RNA, 17 nt, Homo sapiens
cauuuuauguuaaggga

SEQ ID NO: 964963 - RNA, 14 nt, Homo sapiens
cauuuuuugucugu

SEQ ID NO: 964964 - RNA, 18 nt, Homo sapiens
cauuuuuuugcaugcaug

SEQ ID NO: 964965 - RNA, 13 nt, Homo sapiens
ccaaaaacauuug

SEQ ID NO: 964966 - RNA, 16 nt, Homo sapiens
ccaaaaauacagccua

SEQ ID NO: 964967 - RNA, 13 nt, Homo sapiens
ccaaacaaaauag

SEQ ID NO: 964968 - RNA, 20 nt, Homo sapiens
ccaaagaaauggaaauugau

SEQ ID NO: 964969 - RNA, 16 nt, Homo sapiens
ccaaaguacagaauuu

SEQ ID NO: 964970 - RNA, 16 nt, Homo sapiens
ccaaauccacaagcca

SEQ ID NO: 964971 - RNA, 20 nt, Homo sapiens
ccaaaugccauccagaugug

SEQ ID NO: 964972 - RNA, 16 nt, Homo sapiens
ccaacaugugaugugu

SEQ ID NO: 964973 - RNA, 10 nt, Homo sapiens
ccaaccucag

SEQ ID NO: 964974 - RNA, 23 nt, Homo sapiens
ccaacgcgccucgccggaucuga

SEQ ID NO: 964975 - RNA, 20 nt, Homo sapiens
ccaacuccaggaaagagcag

SEQ ID NO: 964976 - RNA, 14 nt, Homo sapiens
ccaacucuugcaca

SEQ ID NO: 964977 - RNA, 19 nt, Homo sapiens
ccaagaaagcucacuguag

SEQ ID NO: 964978 - RNA, 15 nt, Homo sapiens
ccaagacaugacauu

SEQ ID NO: 964979 - RNA, 20 nt, Homo sapiens
ccaagacuuuugucugauca

SEQ ID NO: 964980 - RNA, 15 nt, Homo sapiens
ccaagagugaaggga

SEQ ID NO: 964981 - RNA, 13 nt, Homo sapiens
ccaagcauuucau

SEQ ID NO: 964982 - RNA, 14 nt, Homo sapiens
ccaagccuccacag

SEQ ID NO: 964983 - RNA, 14 nt, Homo sapiens
ccaagcgagagcag

SEQ ID NO: 964984 - RNA, 15 nt, Homo sapiens
ccaaggacucuucca

SEQ ID NO: 964985 - RNA, 14 nt, Homo sapiens
ccaaggagccagug

SEQ ID NO: 964986 - RNA, 22 nt, Homo sapiens
ccaaggcugagacagugaauuu

SEQ ID NO: 964987 - RNA, 23 nt, Homo sapiens
ccaaggcugccagacauggaccu

SEQ ID NO: 964988 - RNA, 17 nt, Homo sapiens
ccaagucuccaccccuu

SEQ ID NO: 964989 - RNA, 21 nt, Homo sapiens
ccaauuucucucagauuucca

SEQ ID NO: 964990 - RNA, 19 nt, Homo sapiens
ccacaaacuccauccagau

SEQ ID NO: 964991 - RNA, 20 nt, Homo sapiens
ccacaagcugcacugugaac

SEQ ID NO: 964992 - RNA, 15 nt, Homo sapiens
ccacaccacagcaga

SEQ ID NO: 964993 - RNA, 14 nt, Homo sapiens
ccacacucuccauc

SEQ ID NO: 964994 - RNA, 23 nt, Homo sapiens
ccacacugauggcucaagacaag

SEQ ID NO: 964995 - RNA, 14 nt, Homo sapiens
ccacacuucuugaa

SEQ ID NO: 964996 - RNA, 18 nt, Homo sapiens
ccacagccacuaagauaa

SEQ ID NO: 964997 - RNA, 13 nt, Homo sapiens
ccacagcccugcu

SEQ ID NO: 964998 - RNA, 18 nt, Homo sapiens
ccacauccaacuccagca

SEQ ID NO: 964999 - RNA, 19 nt, Homo sapiens
ccacauugagaucacuacu

SEQ ID NO: 965000 - RNA, 13 nt, Homo sapiens
ccaccacauagca

SEQ ID NO: 965001 - RNA, 20 nt, Homo sapiens
ccaccaccaaaacugcuccu

SEQ ID NO: 965002 - RNA, 21 nt, Homo sapiens
ccaccaccugaagcugaccaa

SEQ ID NO: 965003 - RNA, 20 nt, Homo sapiens
ccacccauaauaagagaaug

SEQ ID NO: 965004 - RNA, 14 nt, Homo sapiens
ccaccccaagagaa

SEQ ID NO: 965005 - RNA, 13 nt, Homo sapiens
ccacccugcucau

SEQ ID NO: 965006 - RNA, 15 nt, Homo sapiens
ccaccuggcucucac

SEQ ID NO: 965007 - RNA, 20 nt, Homo sapiens
ccaccuuugggaucagccuc

SEQ ID NO: 965008 - RNA, 18 nt, Homo sapiens
ccacgaagacaaccauca

SEQ ID NO: 965009 - RNA, 19 nt, Homo sapiens
ccacgcgugccguggcacc

SEQ ID NO: 965010 - RNA, 19 nt, Homo sapiens
ccacggaggaugaugccag

SEQ ID NO: 965011 - RNA, 22 nt, Homo sapiens
ccacuccugaccccucuccuca

SEQ ID NO: 965012 - RNA, 16 nt, Homo sapiens
ccacucucuaccagau

SEQ ID NO: 965013 - RNA, 18 nt, Homo sapiens
ccacucucuaccagauaa

SEQ ID NO: 965014 - RNA, 14 nt, Homo sapiens
ccacugugcuuuca

SEQ ID NO: 965015 - RNA, 12 nt, Homo sapiens
ccacugugguuu

SEQ ID NO: 965016 - RNA, 19 nt, Homo sapiens
ccacugugguuuugacuua

SEQ ID NO: 965017 - RNA, 21 nt, Homo sapiens
ccacuguuucucuugagcugg

SEQ ID NO: 965018 - RNA, 17 nt, Homo sapiens
ccagaaggaaccagcca

SEQ ID NO: 965019 - RNA, 18 nt, Homo sapiens
ccagaaggaaccagccau

SEQ ID NO: 965020 - RNA, 15 nt, Homo sapiens
ccagaaguuccucaa

SEQ ID NO: 965021 - RNA, 16 nt, Homo sapiens
ccagacaaaauuugag

SEQ ID NO: 965022 - RNA, 19 nt, Homo sapiens
ccagacauuuguuucugua

SEQ ID NO: 965023 - RNA, 22 nt, Homo sapiens
ccagaccuagcaggcuguucca

SEQ ID NO: 965024 - RNA, 17 nt, Homo sapiens
ccagagccagaaagggu

SEQ ID NO: 965025 - RNA, 20 nt, Homo sapiens
ccagagccagaaagggugcc

SEQ ID NO: 965026 - RNA, 17 nt, Homo sapiens
ccagagguugugcacug

SEQ ID NO: 965027 - RNA, 22 nt, Homo sapiens
ccagagucuaggcuaagcacuu

SEQ ID NO: 965028 - RNA, 14 nt, Homo sapiens
ccagaucacugcca

SEQ ID NO: 965029 - RNA, 17 nt, Homo sapiens
ccagaucacugccacac

SEQ ID NO: 965030 - RNA, 19 nt, Homo sapiens
ccagcacgaguggccaguu

SEQ ID NO: 965031 - RNA, 16 nt, Homo sapiens
ccagcacuuugggagg

SEQ ID NO: 965032 - RNA, 21 nt, Homo sapiens
ccagcaggagccagccaaggc

SEQ ID NO: 965033 - RNA, 21 nt, Homo sapiens
ccagcauucucaggcaccagu

SEQ ID NO: 965034 - RNA, 14 nt, Homo sapiens
ccagccaagcuuua

SEQ ID NO: 965035 - RNA, 17 nt, Homo sapiens
ccagcccagacccagug

SEQ ID NO: 965036 - RNA, 15 nt, Homo sapiens
ccagccccacuccuc

SEQ ID NO: 965037 - RNA, 21 nt, Homo sapiens
ccagccccacugccagcagca

SEQ ID NO: 965038 - RNA, 20 nt, Homo sapiens
ccagccuggccaacauggca

SEQ ID NO: 965039 - RNA, 17 nt, Homo sapiens
ccagcucccagccacau

SEQ ID NO: 965040 - RNA, 19 nt, Homo sapiens
ccagcuggguggacuuugg

SEQ ID NO: 965041 - RNA, 12 nt, Homo sapiens
ccagcugucacu

SEQ ID NO: 965042 - RNA, 13 nt, Homo sapiens
ccagcuuacuagc

SEQ ID NO: 965043 - RNA, 18 nt, Homo sapiens
ccagcuuacuagcacuuu

SEQ ID NO: 965044 - RNA, 17 nt, Homo sapiens
ccagcuuauagucauau

SEQ ID NO: 965045 - RNA, 19 nt, Homo sapiens
ccagcuuucccugccucuc

SEQ ID NO: 965046 - RNA, 13 nt, Homo sapiens
ccaggaccacaga

SEQ ID NO: 965047 - RNA, 23 nt, Homo sapiens
ccaggacucugaccccagcauuc

SEQ ID NO: 965048 - RNA, 18 nt, Homo sapiens
ccaggagcaggcacgggu

SEQ ID NO: 965049 - RNA, 15 nt, Homo sapiens
ccaggaucauggugu

SEQ ID NO: 965050 - RNA, 23 nt, Homo sapiens
ccaggaugcuaaagaugaugaug

SEQ ID NO: 965051 - RNA, 15 nt, Homo sapiens
ccaggcuccagcaca

SEQ ID NO: 965052 - RNA, 17 nt, Homo sapiens
ccaggcuggaguacagu

SEQ ID NO: 965053 - RNA, 13 nt, Homo sapiens
ccaggcugucacc

SEQ ID NO: 965054 - RNA, 14 nt, Homo sapiens
ccagggaacagcca

SEQ ID NO: 965055 - RNA, 21 nt, Homo sapiens
ccagggcugccccuaaucucu

SEQ ID NO: 965056 - RNA, 19 nt, Homo sapiens
ccagguagaaaagaaaugg

SEQ ID NO: 965057 - RNA, 20 nt, Homo sapiens
ccaggucuccggaggagaca

SEQ ID NO: 965058 - RNA, 22 nt, Homo sapiens
ccaguaaaauacuauugccuca

SEQ ID NO: 965059 - RNA, 14 nt, Homo sapiens
ccaguaaagccuua

SEQ ID NO: 965060 - RNA, 19 nt, Homo sapiens
ccagucuguugaguuaguu

SEQ ID NO: 965061 - RNA, 16 nt, Homo sapiens
ccagugccagcaauag

SEQ ID NO: 965062 - RNA, 15 nt, Homo sapiens
ccagugccaggccag

SEQ ID NO: 965063 - RNA, 17 nt, Homo sapiens
ccaguggggaagugcgu

SEQ ID NO: 965064 - RNA, 13 nt, Homo sapiens
ccaguuacuugcu

SEQ ID NO: 965065 - RNA, 20 nt, Homo sapiens
ccauaaacgguuccugguga

SEQ ID NO: 965066 - RNA, 22 nt, Homo sapiens
ccauaaacgguuccuggugacu

SEQ ID NO: 965067 - RNA, 14 nt, Homo sapiens
ccauaaaguacaaa

SEQ ID NO: 965068 - RNA, 21 nt, Homo sapiens
ccauacacccccucuucugag

SEQ ID NO: 965069 - RNA, 13 nt, Homo sapiens
ccauacuucucuc

SEQ ID NO: 965070 - RNA, 15 nt, Homo sapiens
ccauagucacauggc

SEQ ID NO: 965071 - RNA, 16 nt, Homo sapiens
ccauagucacauggcc

SEQ ID NO: 965072 - RNA, 20 nt, Homo sapiens
ccauagugcacuagcauuuu

SEQ ID NO: 965073 - RNA, 23 nt, Homo sapiens
ccauauaacaauucaguaacaaa

SEQ ID NO: 965074 - RNA, 14 nt, Homo sapiens
ccaucagugaaaaa

SEQ ID NO: 965075 - RNA, 23 nt, Homo sapiens
ccaucagugaaaaagauguacag

SEQ ID NO: 965076 - RNA, 19 nt, Homo sapiens
ccauccaccccguugcuca

SEQ ID NO: 965077 - RNA, 17 nt, Homo sapiens
ccaucucccaaggcugc

SEQ ID NO: 965078 - RNA, 16 nt, Homo sapiens
ccaucugcagcaagac

SEQ ID NO: 965079 - RNA, 23 nt, Homo sapiens
ccaucuugugguaacuugcugcu

SEQ ID NO: 965080 - RNA, 21 nt, Homo sapiens
ccaugcguguuucugacucug

SEQ ID NO: 965081 - RNA, 16 nt, Homo sapiens
ccauggugacauugug

SEQ ID NO: 965082 - RNA, 21 nt, Homo sapiens
ccauguccaaagaggcugccc

SEQ ID NO: 965083 - RNA, 14 nt, Homo sapiens
ccauucacuacuca

SEQ ID NO: 965084 - RNA, 19 nt, Homo sapiens
ccauucauccuuccaucca

SEQ ID NO: 965085 - RNA, 16 nt, Homo sapiens
ccauuccugaucccau

SEQ ID NO: 965086 - RNA, 20 nt, Homo sapiens
ccauugauuuaauguaauag

SEQ ID NO: 965087 - RNA, 21 nt, Homo sapiens
ccauuuauuauuuuguaacuu

SEQ ID NO: 965088 - RNA, 15 nt, Homo sapiens
ccauuugggugggag

SEQ ID NO: 965089 - RNA, 16 nt, Homo sapiens
cccaaccccaguggau

SEQ ID NO: 965090 - RNA, 23 nt, Homo sapiens
cccaaccugcacggggcauuccu

SEQ ID NO: 965091 - RNA, 13 nt, Homo sapiens
cccaagcaggugg

SEQ ID NO: 965092 - RNA, 18 nt, Homo sapiens
cccaaggcucaugguccu

SEQ ID NO: 965093 - RNA, 22 nt, Homo sapiens
cccaagugaggagugccagcuc

SEQ ID NO: 965094 - RNA, 22 nt, Homo sapiens
cccacacugaccuguguucccu

SEQ ID NO: 965095 - RNA, 19 nt, Homo sapiens
cccacaugugacacauaug

SEQ ID NO: 965096 - RNA, 17 nt, Homo sapiens
cccacccacaugugaca

SEQ ID NO: 965097 - RNA, 16 nt, Homo sapiens
cccaccgguccagcug

SEQ ID NO: 965098 - RNA, 14 nt, Homo sapiens
cccacuccagucca

SEQ ID NO: 965099 - RNA, 13 nt, Homo sapiens
cccacugccagca

SEQ ID NO: 965100 - RNA, 21 nt, Homo sapiens
cccagaaggaaccagccauga

SEQ ID NO: 965101 - RNA, 15 nt, Homo sapiens
cccagauacauggug

SEQ ID NO: 965102 - RNA, 18 nt, Homo sapiens
cccagccauccagggggc

SEQ ID NO: 965103 - RNA, 13 nt, Homo sapiens
cccagcugaccag

SEQ ID NO: 965104 - RNA, 19 nt, Homo sapiens
cccagcuuugcugccugag

SEQ ID NO: 965105 - RNA, 17 nt, Homo sapiens
cccaggauacuggcaca

SEQ ID NO: 965106 - RNA, 21 nt, Homo sapiens
cccaggcagugggucuucccu

SEQ ID NO: 965107 - RNA, 15 nt, Homo sapiens
cccaggccccagcug

SEQ ID NO: 965108 - RNA, 18 nt, Homo sapiens
cccaggcuggagugcagu

SEQ ID NO: 965109 - RNA, 19 nt, Homo sapiens
cccaggcuggagugcagug

SEQ ID NO: 965110 - RNA, 19 nt, Homo sapiens
cccaucgucucggccuuca

SEQ ID NO: 965111 - RNA, 14 nt, Homo sapiens
cccaucguugcccc

SEQ ID NO: 965112 - RNA, 21 nt, Homo sapiens
cccauuucaauuccugugauu

SEQ ID NO: 965113 - RNA, 22 nt, Homo sapiens
ccccacacugaccuguguuccc

SEQ ID NO: 965114 - RNA, 16 nt, Homo sapiens
ccccaccaccacuuac

SEQ ID NO: 965115 - RNA, 11 nt, Homo sapiens
ccccacuccag

SEQ ID NO: 965116 - RNA, 13 nt, Homo sapiens
ccccagaccagga

SEQ ID NO: 965117 - RNA, 19 nt, Homo sapiens
ccccagauacauggugaug

SEQ ID NO: 965118 - RNA, 15 nt, Homo sapiens
ccccagccugggcca

SEQ ID NO: 965119 - RNA, 16 nt, Homo sapiens
ccccagggacugcaag

SEQ ID NO: 965120 - RNA, 16 nt, Homo sapiens
ccccaguggauucuca

SEQ ID NO: 965121 - RNA, 20 nt, Homo sapiens
cccccaggcuggagugcagu

SEQ ID NO: 965122 - RNA, 16 nt, Homo sapiens
ccccuacugcugugaa

SEQ ID NO: 965123 - RNA, 13 nt, Homo sapiens
ccccuccacucuc

SEQ ID NO: 965124 - RNA, 17 nt, Homo sapiens
ccccugaauuaagcaga

SEQ ID NO: 965125 - RNA, 21 nt, Homo sapiens
ccccugcucaguaaagcacuu

SEQ ID NO: 965126 - RNA, 15 nt, Homo sapiens
ccccuuuagaucucu

SEQ ID NO: 965127 - RNA, 15 nt, Homo sapiens
cccgucgugcuuccu

SEQ ID NO: 965128 - RNA, 13 nt, Homo sapiens
cccuacugcugug

SEQ ID NO: 965129 - RNA, 15 nt, Homo sapiens
cccuaucucccacaa

SEQ ID NO: 965130 - RNA, 15 nt, Homo sapiens
cccuccacccaucca

SEQ ID NO: 965131 - RNA, 16 nt, Homo sapiens
cccuccagacaaugcc

SEQ ID NO: 965132 - RNA, 16 nt, Homo sapiens
cccucggguccauaga

SEQ ID NO: 965133 - RNA, 23 nt, Homo sapiens
cccucuuccuacuggucucucua

SEQ ID NO: 965134 - RNA, 17 nt, Homo sapiens
cccucuuucacuucaua

SEQ ID NO: 965135 - RNA, 14 nt, Homo sapiens
cccucuuugcugca

SEQ ID NO: 965136 - RNA, 20 nt, Homo sapiens
cccuguccuaugacuugauc

SEQ ID NO: 965137 - RNA, 18 nt, Homo sapiens
cccuguggggccugaugg

SEQ ID NO: 965138 - RNA, 19 nt, Homo sapiens
cccuucaaugcugcaggau

SEQ ID NO: 965139 - RNA, 11 nt, Homo sapiens
cccuugcacag

SEQ ID NO: 965140 - RNA, 23 nt, Homo sapiens
cccuuuugggccuagaauucuga

SEQ ID NO: 965141 - RNA, 22 nt, Homo sapiens
ccgaauugucuuuggugcuuuu

SEQ ID NO: 965142 - RNA, 16 nt, Homo sapiens
ccgaugaacaaguuua

SEQ ID NO: 965143 - RNA, 19 nt, Homo sapiens
ccgcaccauaaugagaugu

SEQ ID NO: 965144 - RNA, 22 nt, Homo sapiens
ccgcaccauaaugagaugugag

SEQ ID NO: 965145 - RNA, 13 nt, Homo sapiens
ccgcaucaccuca

SEQ ID NO: 965146 - RNA, 12 nt, Homo sapiens
ccgccauccacc

SEQ ID NO: 965147 - RNA, 17 nt, Homo sapiens
ccggcggcuacucugga

SEQ ID NO: 965148 - RNA, 18 nt, Homo sapiens
ccggcugguggagcugcu

SEQ ID NO: 965149 - RNA, 13 nt, Homo sapiens
ccgggcauggugg

SEQ ID NO: 965150 - RNA, 13 nt, Homo sapiens
ccuaaaggacucu

SEQ ID NO: 965151 - RNA, 11 nt, Homo sapiens
ccuaacacauu

SEQ ID NO: 965152 - RNA, 20 nt, Homo sapiens
ccuaacuuuucuacguauaa

SEQ ID NO: 965153 - RNA, 13 nt, Homo sapiens
ccuacccaguucc

SEQ ID NO: 965154 - RNA, 13 nt, Homo sapiens
ccuacccuuccag

SEQ ID NO: 965155 - RNA, 21 nt, Homo sapiens
ccuagcuggcucugugagggu

SEQ ID NO: 965156 - RNA, 18 nt, Homo sapiens
ccuauagcacugagcuca

SEQ ID NO: 965157 - RNA, 17 nt, Homo sapiens
ccuauagcaucuucuca

SEQ ID NO: 965158 - RNA, 13 nt, Homo sapiens
ccuaugcuuaaua

SEQ ID NO: 965159 - RNA, 19 nt, Homo sapiens
ccucaaaugcggggugggg

SEQ ID NO: 965160 - RNA, 23 nt, Homo sapiens
ccucacaaaccugaauggucuga

SEQ ID NO: 965161 - RNA, 15 nt, Homo sapiens
ccucagaaagggauu

SEQ ID NO: 965162 - RNA, 17 nt, Homo sapiens
ccucagagcuaacauaa

SEQ ID NO: 965163 - RNA, 15 nt, Homo sapiens
cuguuuccugggcac

SEQ ID NO: 965164 - RNA, 16 nt, Homo sapiens
cuguuugaagaaaaua

SEQ ID NO: 965165 - RNA, 18 nt, Homo sapiens
cuguuuuuuuugcugcua

SEQ ID NO: 965166 - RNA, 23 nt, Homo sapiens
cuguuuuuuuugcugcuaaagaa

SEQ ID NO: 965167 - RNA, 15 nt, Homo sapiens
cuuaaaacaaauuca

SEQ ID NO: 965168 - RNA, 14 nt, Homo sapiens
cuuaaacacacauu

SEQ ID NO: 965169 - RNA, 17 nt, Homo sapiens
cuuaaaugagaccaaag

SEQ ID NO: 965170 - RNA, 11 nt, Homo sapiens
cuuaacagccc

SEQ ID NO: 965171 - RNA, 21 nt, Homo sapiens
cuuaacuggucuccuugcuuc

SEQ ID NO: 965172 - RNA, 21 nt, Homo sapiens
cuuaagagacacuccaaaccu

SEQ ID NO: 965173 - RNA, 22 nt, Homo sapiens
cuuaaguauuauauaaacugug

SEQ ID NO: 965174 - RNA, 20 nt, Homo sapiens
cuuaauaaaagaacaugcuu

SEQ ID NO: 965175 - RNA, 19 nt, Homo sapiens
cuuaauaacuguguacugu

SEQ ID NO: 965176 - RNA, 14 nt, Homo sapiens
cuuacagucccaga

SEQ ID NO: 965177 - RNA, 16 nt, Homo sapiens
cuuagaauaaugaagg

SEQ ID NO: 965178 - RNA, 22 nt, Homo sapiens
cuuagagaggacaauacugggg

SEQ ID NO: 965179 - RNA, 15 nt, Homo sapiens
cuuagggaagaaaaa

SEQ ID NO: 965180 - RNA, 17 nt, Homo sapiens
cuuagucccucaugcaa

SEQ ID NO: 965181 - RNA, 18 nt, Homo sapiens
cuuauauaauaacaauug

SEQ ID NO: 965182 - RNA, 18 nt, Homo sapiens
cuuauucuuugaguaaug

SEQ ID NO: 965183 - RNA, 19 nt, Homo sapiens
cuuauuuucucaaucuccu

SEQ ID NO: 965184 - RNA, 20 nt, Homo sapiens
cuucaaagccuucucccuag

SEQ ID NO: 965185 - RNA, 21 nt, Homo sapiens
cuucaggguaaacuagcaaug

SEQ ID NO: 965186 - RNA, 22 nt, Homo sapiens
cuucagguuaucgaaauaacaa

SEQ ID NO: 965187 - RNA, 20 nt, Homo sapiens
cuucaguauuguggggcuca

SEQ ID NO: 965188 - RNA, 14 nt, Homo sapiens
cuucauguugaugu

SEQ ID NO: 965189 - RNA, 17 nt, Homo sapiens
cuucauuuccaccaggc

SEQ ID NO: 965190 - RNA, 14 nt, Homo sapiens
cuuccaaacucuuc

SEQ ID NO: 965191 - RNA, 14 nt, Homo sapiens
cuuccaacauguga

SEQ ID NO: 965192 - RNA, 17 nt, Homo sapiens
cuuccagaucacugcca

SEQ ID NO: 965193 - RNA, 15 nt, Homo sapiens
cuucccaacaugccu

SEQ ID NO: 965194 - RNA, 13 nt, Homo sapiens
cuucccaugcauu

SEQ ID NO: 965195 - RNA, 17 nt, Homo sapiens
cuuccccaaugcuccau

SEQ ID NO: 965196 - RNA, 21 nt, Homo sapiens
cuucccucucugaugucccag

SEQ ID NO: 965197 - RNA, 14 nt, Homo sapiens
cuucccuugccucg

SEQ ID NO: 965198 - RNA, 18 nt, Homo sapiens
cuuccucuagaagccaag

SEQ ID NO: 965199 - RNA, 22 nt, Homo sapiens
cuuccugcaaagggaacugaag

SEQ ID NO: 965200 - RNA, 14 nt, Homo sapiens
cuuccugugaucca

SEQ ID NO: 965201 - RNA, 17 nt, Homo sapiens
cuuccuuaccugaaagg

SEQ ID NO: 965202 - RNA, 14 nt, Homo sapiens
cuucuauuaaucaa

SEQ ID NO: 965203 - RNA, 21 nt, Homo sapiens
cuucuauuuggggcuugauga

SEQ ID NO: 965204 - RNA, 17 nt, Homo sapiens
cuucucccacucuccua

SEQ ID NO: 965205 - RNA, 21 nt, Homo sapiens
cuucucucucaggccaccaca

SEQ ID NO: 965206 - RNA, 15 nt, Homo sapiens
cuucugccuucucag

SEQ ID NO: 965207 - RNA, 14 nt, Homo sapiens
cuucuuauuaauca

SEQ ID NO: 965208 - RNA, 16 nt, Homo sapiens
cuugaauagucucauc

SEQ ID NO: 965209 - RNA, 20 nt, Homo sapiens
cuugaaugcacuuuugcuca

SEQ ID NO: 965210 - RNA, 20 nt, Homo sapiens
cuugaccucaggugauccac

SEQ ID NO: 965211 - RNA, 13 nt, Homo sapiens
cuugacuggggau

SEQ ID NO: 965212 - RNA, 20 nt, Homo sapiens
cuugagccgggccccugggc

SEQ ID NO: 965213 - RNA, 22 nt, Homo sapiens
cuugaucacuuuugcacauucc

SEQ ID NO: 965214 - RNA, 21 nt, Homo sapiens
cuugaucuuaacaaagccuuu

SEQ ID NO: 965215 - RNA, 19 nt, Homo sapiens
cuugcacccaggcccagcu

SEQ ID NO: 965216 - RNA, 18 nt, Homo sapiens
cuugcacuuguuauauua

SEQ ID NO: 965217 - RNA, 20 nt, Homo sapiens
cuugcaugcuugcauaagag

SEQ ID NO: 965218 - RNA, 13 nt, Homo sapiens
cuugccagcauuu

SEQ ID NO: 965219 - RNA, 15 nt, Homo sapiens
cuugcucaaagggaa

SEQ ID NO: 965220 - RNA, 22 nt, Homo sapiens
cuugcuuuaccuuuucagggcu

SEQ ID NO: 965221 - RNA, 16 nt, Homo sapiens
cuuggaaaaaaaccac

SEQ ID NO: 965222 - RNA, 12 nt, Homo sapiens
cuuggaacauac

SEQ ID NO: 965223 - RNA, 16 nt, Homo sapiens
cuuggaccaugccaga

SEQ ID NO: 965224 - RNA, 18 nt, Homo sapiens
cuuggaugucacugccug

SEQ ID NO: 965225 - RNA, 16 nt, Homo sapiens
cuuguaaagacugguu

SEQ ID NO: 965226 - RNA, 16 nt, Homo sapiens
cuuguaguaugcuuaa

SEQ ID NO: 965227 - RNA, 18 nt, Homo sapiens
cuuguauagcaugaaaua

SEQ ID NO: 965228 - RNA, 14 nt, Homo sapiens
cuugucuucuggua

SEQ ID NO: 965229 - RNA, 11 nt, Homo sapiens
cuugugcaugu

SEQ ID NO: 965230 - RNA, 22 nt, Homo sapiens
cuuguggcuucucucucuagca

SEQ ID NO: 965231 - RNA, 14 nt, Homo sapiens
cuuguggguccaug

SEQ ID NO: 965232 - RNA, 14 nt, Homo sapiens
cuugugugcccuga

SEQ ID NO: 965233 - RNA, 15 nt, Homo sapiens
cuuguucuacugaga

SEQ ID NO: 965234 - RNA, 14 nt, Homo sapiens
cuuuaaaaugccaa

SEQ ID NO: 965235 - RNA, 21 nt, Homo sapiens
cuuuauaaaacauguacaaaa

SEQ ID NO: 965236 - RNA, 22 nt, Homo sapiens
cuuuaucaaaaaguacaauaau

SEQ ID NO: 965237 - RNA, 18 nt, Homo sapiens
cuuuccauaaauccuuga

SEQ ID NO: 965238 - RNA, 14 nt, Homo sapiens
cuuucccacucuca

SEQ ID NO: 965239 - RNA, 20 nt, Homo sapiens
cuuucccuaauacaggguug

SEQ ID NO: 965240 - RNA, 19 nt, Homo sapiens
cuuuccucagaucauccag

SEQ ID NO: 965241 - RNA, 20 nt, Homo sapiens
cuuuccuccacccauaauaa

SEQ ID NO: 965242 - RNA, 15 nt, Homo sapiens
cuuucugaauugcac

SEQ ID NO: 965243 - RNA, 20 nt, Homo sapiens
cuuucugcaggaaauaguca

SEQ ID NO: 965244 - RNA, 15 nt, Homo sapiens
cuuugacuuugccca

SEQ ID NO: 965245 - RNA, 20 nt, Homo sapiens
cuuugagcugagugcugaaa

SEQ ID NO: 965246 - RNA, 17 nt, Homo sapiens
cuuugaguagauccauu

SEQ ID NO: 965247 - RNA, 15 nt, Homo sapiens
cuuugccucccucag

SEQ ID NO: 965248 - RNA, 14 nt, Homo sapiens
cuuugccugucaag

SEQ ID NO: 965249 - RNA, 22 nt, Homo sapiens
cuuuggcccuauuuaaggcaga

SEQ ID NO: 965250 - RNA, 20 nt, Homo sapiens
cuuuggugcuuuucacuugu

SEQ ID NO: 965251 - RNA, 15 nt, Homo sapiens
cuuuguucugugauu

SEQ ID NO: 965252 - RNA, 14 nt, Homo sapiens
cuuuguuugucaca

SEQ ID NO: 965253 - RNA, 22 nt, Homo sapiens
cuuuuaaaaacuagagcacaga

SEQ ID NO: 965254 - RNA, 22 nt, Homo sapiens
cuuuuaauggaugguugaauua

SEQ ID NO: 965255 - RNA, 13 nt, Homo sapiens
cuuuuaauucaaa

SEQ ID NO: 965256 - RNA, 16 nt, Homo sapiens
cuuuuauaaagcaugu

SEQ ID NO: 965257 - RNA, 18 nt, Homo sapiens
cuuuucagaagcaagcca

SEQ ID NO: 965258 - RNA, 17 nt, Homo sapiens
cuuuucccacuccaagc

SEQ ID NO: 965259 - RNA, 19 nt, Homo sapiens
cuuuucuaaucacaguguu

SEQ ID NO: 965260 - RNA, 21 nt, Homo sapiens
cuuuugagcuauucaccucag

SEQ ID NO: 965261 - RNA, 18 nt, Homo sapiens
cuuuugcuugauccagaa

SEQ ID NO: 965262 - RNA, 15 nt, Homo sapiens
cuuuuucacuuugaa

SEQ ID NO: 965263 - RNA, 14 nt, Homo sapiens
cuuuuugacacuga

SEQ ID NO: 965264 - RNA, 15 nt, Homo sapiens
cuuuuugacacugaa

SEQ ID NO: 965265 - RNA, 20 nt, Homo sapiens
cuuuuuuagaaaugcaaaau

SEQ ID NO: 965266 - RNA, 14 nt, Homo sapiens
cuuuuuuuguaugu

SEQ ID NO: 965267 - RNA, 21 nt, Homo sapiens
cuuuuuuuuccccaaguauua

SEQ ID NO: 965268 - RNA, 17 nt, Homo sapiens
gaaaaaaaagugucuca

SEQ ID NO: 965269 - RNA, 17 nt, Homo sapiens
gaaaaaagguuacuuug

SEQ ID NO: 965270 - RNA, 13 nt, Homo sapiens
gaaaacauuugcu

SEQ ID NO: 965271 - RNA, 16 nt, Homo sapiens
gaaaaggaagacuaga

SEQ ID NO: 965272 - RNA, 18 nt, Homo sapiens
gaaaaggggacaguuuuu

SEQ ID NO: 965273 - RNA, 16 nt, Homo sapiens
gaaaauauggguugca

SEQ ID NO: 965274 - RNA, 14 nt, Homo sapiens
gaaaauggccaugc

SEQ ID NO: 965275 - RNA, 19 nt, Homo sapiens
gaaaauuggaacucuacuc

SEQ ID NO: 965276 - RNA, 14 nt, Homo sapiens
gaaacaacauuuau

SEQ ID NO: 965277 - RNA, 18 nt, Homo sapiens
gaaacaccacugcuaggg

SEQ ID NO: 965278 - RNA, 18 nt, Homo sapiens
gaaacaccccucugucua

SEQ ID NO: 965279 - RNA, 12 nt, Homo sapiens
gaaacaguucuc

SEQ ID NO: 965280 - RNA, 14 nt, Homo sapiens
gaaacaugauguga

SEQ ID NO: 965281 - RNA, 21 nt, Homo sapiens
gaaacauuauuagcacuuccc

SEQ ID NO: 965282 - RNA, 21 nt, Homo sapiens
gaaaccccuucuuuacuuccc

SEQ ID NO: 965283 - RNA, 15 nt, Homo sapiens
gaaacucacacuccc

SEQ ID NO: 965284 - RNA, 17 nt, Homo sapiens
gaaacuggaccugcaua

SEQ ID NO: 965285 - RNA, 17 nt, Homo sapiens
gaaacugugaagaucuc

SEQ ID NO: 965286 - RNA, 16 nt, Homo sapiens
gaaacuuuaauccaaa

SEQ ID NO: 965287 - RNA, 16 nt, Homo sapiens
gaaagaugucuaugua

SEQ ID NO: 965288 - RNA, 20 nt, Homo sapiens
gaaagauuugaugggccaca

SEQ ID NO: 965289 - RNA, 13 nt, Homo sapiens
gaaagcccuucuc

SEQ ID NO: 965290 - RNA, 13 nt, Homo sapiens
gaaaggagcugcu

SEQ ID NO: 965291 - RNA, 13 nt, Homo sapiens
gaaaggggcccca

SEQ ID NO: 965292 - RNA, 22 nt, Homo sapiens
gaaauaagugcccucucccacc

SEQ ID NO: 965293 - RNA, 14 nt, Homo sapiens
gaaauaucugugaa

SEQ ID NO: 965294 - RNA, 17 nt, Homo sapiens
gaaaucuuucucccuca

SEQ ID NO: 965295 - RNA, 9 nt, Homo sapiens
gaaaugcaa

SEQ ID NO: 965296 - RNA, 11 nt, Homo sapiens
gaaaugcaaaa

SEQ ID NO: 965297 - RNA, 17 nt, Homo sapiens
gaaaugccugcuuugaa

SEQ ID NO: 965298 - RNA, 17 nt, Homo sapiens
gaaauguucugucaaau

SEQ ID NO: 965299 - RNA, 18 nt, Homo sapiens
gaaauugcauacuuugua

SEQ ID NO: 965300 - RNA, 21 nt, Homo sapiens
gaaauuuuguaagaaggcaau

SEQ ID NO: 965301 - RNA, 15 nt, Homo sapiens
gaacaaaaagguaaa

SEQ ID NO: 965302 - RNA, 15 nt, Homo sapiens
gaacaacauaucuca

SEQ ID NO: 965303 - RNA, 14 nt, Homo sapiens
gaacaacuaccuga

SEQ ID NO: 965304 - RNA, 17 nt, Homo sapiens
gaacaauccauaacuuu

SEQ ID NO: 965305 - RNA, 19 nt, Homo sapiens
gaacaccuauugcacuugg

SEQ ID NO: 965306 - RNA, 18 nt, Homo sapiens
gaacacgagacagcuugg

SEQ ID NO: 965307 - RNA, 14 nt, Homo sapiens
gaacacguggguau

SEQ ID NO: 965308 - RNA, 13 nt, Homo sapiens
gaacagagugcaa

SEQ ID NO: 965309 - RNA, 15 nt, Homo sapiens
gaacagagugcaacc

SEQ ID NO: 965310 - RNA, 18 nt, Homo sapiens
gaacagagugcaacccag

SEQ ID NO: 965311 - RNA, 17 nt, Homo sapiens
gaacagccacuccccuc

SEQ ID NO: 965312 - RNA, 13 nt, Homo sapiens
gaacagguucuua

SEQ ID NO: 965313 - RNA, 20 nt, Homo sapiens
gaacaguaaagaaagcagaa

SEQ ID NO: 965314 - RNA, 15 nt, Homo sapiens
gaacauauguugcaa

SEQ ID NO: 965315 - RNA, 15 nt, Homo sapiens
gaacauggacuuucu

SEQ ID NO: 965316 - RNA, 23 nt, Homo sapiens
gaacauggacuuucuugcaugaa

SEQ ID NO: 965317 - RNA, 21 nt, Homo sapiens
gaaccacggaggaugaugcca

SEQ ID NO: 965318 - RNA, 17 nt, Homo sapiens
gaaccagggcucuucuc

SEQ ID NO: 965319 - RNA, 21 nt, Homo sapiens
gaaccauguggauaacuuuac

SEQ ID NO: 965320 - RNA, 16 nt, Homo sapiens
gaacuaaaauucuguc

SEQ ID NO: 965321 - RNA, 18 nt, Homo sapiens
gaacuagccaaaccagga

SEQ ID NO: 965322 - RNA, 17 nt, Homo sapiens
gaacuuaauaacugugu

SEQ ID NO: 965323 - RNA, 22 nt, Homo sapiens
gaacuugcgaguccaaggccag

SEQ ID NO: 965324 - RNA, 18 nt, Homo sapiens
gaacuuuaagaagcagug

SEQ ID NO: 965325 - RNA, 21 nt, Homo sapiens
gaacuuuuuuagaaaugcaaa

SEQ ID NO: 965326 - RNA, 16 nt, Homo sapiens
gaagagcgcaguguuu

SEQ ID NO: 965327 - RNA, 21 nt, Homo sapiens
gaagagcgcaguguuuugcaa

SEQ ID NO: 965328 - RNA, 14 nt, Homo sapiens
gaagagggucccuc

SEQ ID NO: 965329 - RNA, 17 nt, Homo sapiens
gaagaguuauaaaguau

SEQ ID NO: 965330 - RNA, 22 nt, Homo sapiens
gaagaugaauggucuggcaaua

SEQ ID NO: 965331 - RNA, 16 nt, Homo sapiens
gaagcagaaauguacu

SEQ ID NO: 965332 - RNA, 17 nt, Homo sapiens
gaagcagaaauguacuu

SEQ ID NO: 965333 - RNA, 13 nt, Homo sapiens
gaagcaguauuuu

SEQ ID NO: 965334 - RNA, 18 nt, Homo sapiens
gaagcauuccuucuuuga

SEQ ID NO: 965335 - RNA, 13 nt, Homo sapiens
gaagcucccagcu

SEQ ID NO: 965336 - RNA, 19 nt, Homo sapiens
gaagcugcaggcuuugcca

SEQ ID NO: 965337 - RNA, 19 nt, Homo sapiens
gaaggagaaguaagaggcu

SEQ ID NO: 965338 - RNA, 19 nt, Homo sapiens
gaaggcaagagggggugga

SEQ ID NO: 965339 - RNA, 22 nt, Homo sapiens
gaaggccuuucuucuguguuaa

SEQ ID NO: 965340 - RNA, 18 nt, Homo sapiens
gaaggcuuugccaugggc

SEQ ID NO: 965341 - RNA, 20 nt, Homo sapiens
gaagggaauuaaaaagaaga

SEQ ID NO: 965342 - RNA, 20 nt, Homo sapiens
gaagguaacuagaaagugag

SEQ ID NO: 965343 - RNA, 16 nt, Homo sapiens
gaagguucucugugcu

SEQ ID NO: 965344 - RNA, 20 nt, Homo sapiens
gaagguucucugugcuccuc

SEQ ID NO: 965345 - RNA, 20 nt, Homo sapiens
gaaguagguggcuugagcua

SEQ ID NO: 965346 - RNA, 18 nt, Homo sapiens
gaagucuggcuuugcucu

SEQ ID NO: 965347 - RNA, 18 nt, Homo sapiens
gaagucuucuaacucugu

SEQ ID NO: 965348 - RNA, 12 nt, Homo sapiens
gaaguuccucaa

SEQ ID NO: 965349 - RNA, 22 nt, Homo sapiens
gaauaaaacguuaguuaauccc

SEQ ID NO: 965350 - RNA, 15 nt, Homo sapiens
gaauaaaaugaaggu

SEQ ID NO: 965351 - RNA, 19 nt, Homo sapiens
gaauaaaauuccuaucuca

SEQ ID NO: 965352 - RNA, 20 nt, Homo sapiens
gaauaaaauuccuaucucau

SEQ ID NO: 965353 - RNA, 22 nt, Homo sapiens
gaauaaugcuaccaggaugcua

SEQ ID NO: 965354 - RNA, 13 nt, Homo sapiens
gaauacugugcau

SEQ ID NO: 965355 - RNA, 14 nt, Homo sapiens
gaauacugugcaua

SEQ ID NO: 965356 - RNA, 20 nt, Homo sapiens
gaauagacuaucuagaacuu

SEQ ID NO: 965357 - RNA, 17 nt, Homo sapiens
gaauagccuggccacca

SEQ ID NO: 965358 - RNA, 19 nt, Homo sapiens
gaauauaaauuuguguucu

SEQ ID NO: 965359 - RNA, 20 nt, Homo sapiens
gaauaucagaaguauaucug

SEQ ID NO: 965360 - RNA, 17 nt, Homo sapiens
gaauaugguggaaaaua

SEQ ID NO: 965361 - RNA, 18 nt, Homo sapiens
gaaucaaaucucuuccac

SEQ ID NO: 965362 - RNA, 21 nt, Homo sapiens
gaaucaugagccugcuggaag

SEQ ID NO: 965363 - RNA, 15 nt, Homo sapiens
gaauccaagccucca

SEQ ID NO: 965364 - RNA, 23 nt, Homo sapiens
gaaucccagauaugguugcacaa

SEQ ID NO: 965365 - RNA, 17 nt, Homo sapiens
gaaucuuuguaccaaaa

SEQ ID NO: 965366 - RNA, 13 nt, Homo sapiens
gaaugaaacugau

SEQ ID NO: 965367 - RNA, 13 nt, Homo sapiens
gaaugaacacucc

SEQ ID NO: 965368 - RNA, 14 nt, Homo sapiens
gaaugaacacuccc

SEQ ID NO: 965369 - RNA, 19 nt, Homo sapiens
gaauggaaaggauggagca

SEQ ID NO: 965370 - RNA, 18 nt, Homo sapiens
gaauggaaggcuuugcca

SEQ ID NO: 965371 - RNA, 13 nt, Homo sapiens
gaauggucuuucu

SEQ ID NO: 965372 - RNA, 19 nt, Homo sapiens
gaauguuuucaaaaccaag

SEQ ID NO: 965373 - RNA, 20 nt, Homo sapiens
gaauguuuucaaaaccaagu

SEQ ID NO: 965374 - RNA, 23 nt, Homo sapiens
gaauucucaagaccugaguauuu

SEQ ID NO: 965375 - RNA, 12 nt, Homo sapiens
gaauuguguuuu

SEQ ID NO: 965376 - RNA, 16 nt, Homo sapiens
gacaacugcucccacc

SEQ ID NO: 965377 - RNA, 17 nt, Homo sapiens
gacaaggagacugccuu

SEQ ID NO: 965378 - RNA, 19 nt, Homo sapiens
gacaagugacuuauuugcu

SEQ ID NO: 965379 - RNA, 22 nt, Homo sapiens
gacaagugacuuauuugcucau

SEQ ID NO: 965380 - RNA, 15 nt, Homo sapiens
gacacauaugcaccu

SEQ ID NO: 965381 - RNA, 16 nt, Homo sapiens
gacaccauuaccaaaa

SEQ ID NO: 965382 - RNA, 23 nt, Homo sapiens
gacacuuaguuauuuaccaaagc

SEQ ID NO: 965383 - RNA, 17 nt, Homo sapiens
gacaggccacaccacag

SEQ ID NO: 965384 - RNA, 17 nt, Homo sapiens
gacagugccucuuccag

SEQ ID NO: 965385 - RNA, 17 nt, Homo sapiens
gacauuguggacuguau

SEQ ID NO: 965386 - RNA, 20 nt, Homo sapiens
gaccaagacuuuugucugau

SEQ ID NO: 965387 - RNA, 22 nt, Homo sapiens
gaccacagaaguggaauuugaa

SEQ ID NO: 965388 - RNA, 11 nt, Homo sapiens
gaccacugucu

SEQ ID NO: 965389 - RNA, 16 nt, Homo sapiens
gaccagaaauucccuu

SEQ ID NO: 965390 - RNA, 18 nt, Homo sapiens
gaccaugguauauuccua

SEQ ID NO: 965391 - RNA, 13 nt, Homo sapiens
gaccauguggcca

SEQ ID NO: 965392 - RNA, 16 nt, Homo sapiens
gacccagggacucucc

SEQ ID NO: 965393 - RNA, 21 nt, Homo sapiens
gaccccaagaguuuugggagu

SEQ ID NO: 965394 - RNA, 11 nt, Homo sapiens
gaccccagugu

SEQ ID NO: 965395 - RNA, 24 nt, Homo sapiens
gacccuuguggguccaugcuaaca

SEQ ID NO: 965396 - RNA, 15 nt, Homo sapiens
gaccucaagccauca

SEQ ID NO: 965397 - RNA, 11 nt, Homo sapiens
gaccucugggc

SEQ ID NO: 965398 - RNA, 14 nt, Homo sapiens
gaccugagaaccuu

SEQ ID NO: 965399 - RNA, 22 nt, Homo sapiens
gacgugcugggcggcugugcuu

SEQ ID NO: 965400 - RNA, 14 nt, Homo sapiens
gacuaaggaacuaa

SEQ ID NO: 965401 - RNA, 18 nt, Homo sapiens
gacuagaggcuugcauaa

SEQ ID NO: 965402 - RNA, 17 nt, Homo sapiens
gacuauggugcugccuu

SEQ ID NO: 965403 - RNA, 13 nt, Homo sapiens
gacucgccagcuc

SEQ ID NO: 965404 - RNA, 12 nt, Homo sapiens
gacucugacccc

SEQ ID NO: 965405 - RNA, 22 nt, Homo sapiens
gacucugaccccagcauucuca

SEQ ID NO: 965406 - RNA, 15 nt, Homo sapiens
gacucugcacauguc

SEQ ID NO: 965407 - RNA, 20 nt, Homo sapiens
gacucugcacaugucuugua

SEQ ID NO: 965408 - RNA, 22 nt, Homo sapiens
gacucuuuuuuugagugacagc

SEQ ID NO: 965409 - RNA, 17 nt, Homo sapiens
gacugccccugccuuuu

SEQ ID NO: 965410 - RNA, 21 nt, Homo sapiens
gacugccuugccuccucagua

SEQ ID NO: 965411 - RNA, 17 nt, Homo sapiens
gacuggagcucaucugc

SEQ ID NO: 965412 - RNA, 14 nt, Homo sapiens
gacugucaguucuc

SEQ ID NO: 965413 - RNA, 11 nt, Homo sapiens
gacugugccug

SEQ ID NO: 965414 - RNA, 14 nt, Homo sapiens
gacuuccuggugag

SEQ ID NO: 965415 - RNA, 16 nt, Homo sapiens
gacuucuaccugcccu

SEQ ID NO: 965416 - RNA, 17 nt, Homo sapiens
gacuucucggaauucau

SEQ ID NO: 965417 - RNA, 19 nt, Homo sapiens
gacuuuguguucauuucau

SEQ ID NO: 965418 - RNA, 13 nt, Homo sapiens
gagaaauggccaa

SEQ ID NO: 965419 - RNA, 14 nt, Homo sapiens
gagaaauggccaaa

SEQ ID NO: 965420 - RNA, 20 nt, Homo sapiens
gagaagccuucagcuccagg

SEQ ID NO: 965421 - RNA, 19 nt, Homo sapiens
gagaagggggucucuguua

SEQ ID NO: 965422 - RNA, 13 nt, Homo sapiens
gagacaaaucuca

SEQ ID NO: 965423 - RNA, 18 nt, Homo sapiens
gagacaggccccugaguc

SEQ ID NO: 965424 - RNA, 16 nt, Homo sapiens
gagaccccagucguga

SEQ ID NO: 965425 - RNA, 10 nt, Homo sapiens
gagaccucaa

SEQ ID NO: 965426 - RNA, 18 nt, Homo sapiens
gagacugcguucugcaag

SEQ ID NO: 965427 - RNA, 18 nt, Homo sapiens
gagaggcacucagugagc

SEQ ID NO: 965428 - RNA, 14 nt, Homo sapiens
gagaguuccuucuc

SEQ ID NO: 965429 - RNA, 22 nt, Homo sapiens
gagauacauguugccucaccag

SEQ ID NO: 965430 - RNA, 19 nt, Homo sapiens
gagauacugaacauuuugc

SEQ ID NO: 965431 - RNA, 14 nt, Homo sapiens
gagaucacuacuca

SEQ ID NO: 965432 - RNA, 13 nt, Homo sapiens
gagauccugcaca

SEQ ID NO: 965433 - RNA, 20 nt, Homo sapiens
gagaucgugcuacugcacuc

SEQ ID NO: 965434 - RNA, 21 nt, Homo sapiens
gagaucgugcuacugcacucc

SEQ ID NO: 965435 - RNA, 20 nt, Homo sapiens
gagaugagugauccugccuc

SEQ ID NO: 965436 - RNA, 21 nt, Homo sapiens
gagaugcaggauuucuucaca

SEQ ID NO: 965437 - RNA, 13 nt, Homo sapiens
gagauggaguucu

SEQ ID NO: 965438 - RNA, 19 nt, Homo sapiens
gagaugguucccaauauca

SEQ ID NO: 965439 - RNA, 16 nt, Homo sapiens
gagcacagaaggaaua

SEQ ID NO: 965440 - RNA, 13 nt, Homo sapiens
gagcagaacaggu

SEQ ID NO: 965441 - RNA, 18 nt, Homo sapiens
gagcagccucuggacagc

SEQ ID NO: 965442 - RNA, 22 nt, Homo sapiens
gagcagcucuucagcacaaaga

SEQ ID NO: 965443 - RNA, 18 nt, Homo sapiens
gagcaugacagccugcag

SEQ ID NO: 965444 - RNA, 13 nt, Homo sapiens
gagccaugucaug

SEQ ID NO: 965445 - RNA, 17 nt, Homo sapiens
gagccauuuugugaaug

SEQ ID NO: 965446 - RNA, 21 nt, Homo sapiens
gagccccuuugccugucaagu

SEQ ID NO: 965447 - RNA, 16 nt, Homo sapiens
gagccuccugugccug

SEQ ID NO: 965448 - RNA, 18 nt, Homo sapiens
gagccugcccucacuccc

SEQ ID NO: 965449 - RNA, 16 nt, Homo sapiens
gagcuaaacuccuucc

SEQ ID NO: 965450 - RNA, 16 nt, Homo sapiens
gagcuaacauaaagga

SEQ ID NO: 965451 - RNA, 17 nt, Homo sapiens
gagcuauggugaggugu

SEQ ID NO: 965452 - RNA, 11 nt, Homo sapiens
gagcuccgccu

SEQ ID NO: 965453 - RNA, 15 nt, Homo sapiens
gagcugagugcugaa

SEQ ID NO: 965454 - RNA, 22 nt, Homo sapiens
gagcugccaagagugaagggaa

SEQ ID NO: 965455 - RNA, 14 nt, Homo sapiens
gagcuggaggugga

SEQ ID NO: 965456 - RNA, 22 nt, Homo sapiens
gagcuggccucucuagcacaau

SEQ ID NO: 965457 - RNA, 18 nt, Homo sapiens
gagcuguaaaaauguuac

SEQ ID NO: 965458 - RNA, 20 nt, Homo sapiens
gaggaaaaauauuccuguga

SEQ ID NO: 965459 - RNA, 22 nt, Homo sapiens
gaggacccgugugacucgccag

SEQ ID NO: 965460 - RNA, 22 nt, Homo sapiens
gaggacgcacgcucgcugccau

SEQ ID NO: 965461 - RNA, 12 nt, Homo sapiens
gaggagugcagc

SEQ ID NO: 965462 - RNA, 15 nt, Homo sapiens
gaggaugacagugac

SEQ ID NO: 965463 - RNA, 16 nt, Homo sapiens
gaggaugaugccaguu

SEQ ID NO: 965464 - RNA, 20 nt, Homo sapiens
gaggcaggagaaucgcuuga

SEQ ID NO: 965465 - RNA, 21 nt, Homo sapiens
gaggccucaggugcuguccau

SEQ ID NO: 965466 - RNA, 20 nt, Homo sapiens
gaggcggagguugcaaugag

SEQ ID NO: 965467 - RNA, 17 nt, Homo sapiens
gaggcugaggcacuggc

SEQ ID NO: 965468 - RNA, 21 nt, Homo sapiens
gaggcuucuccgccagccucc

SEQ ID NO: 965469 - RNA, 21 nt, Homo sapiens
gagggaagaaugaacacuccc

SEQ ID NO: 965470 - RNA, 23 nt, Homo sapiens
gagggaagaaugaacacucccca

SEQ ID NO: 965471 - RNA, 22 nt, Homo sapiens
gagggccaaaauauuuggaaug

SEQ ID NO: 965472 - RNA, 19 nt, Homo sapiens
gaggguaaauaaaccacug

SEQ ID NO: 965473 - RNA, 15 nt, Homo sapiens
gagggucuucuuaca

SEQ ID NO: 965474 - RNA, 12 nt, Homo sapiens
gaggucacugga

SEQ ID NO: 965475 - RNA, 23 nt, Homo sapiens
gagguccccucgucccauccagc

SEQ ID NO: 965476 - RNA, 15 nt, Homo sapiens
gaggugggaggugga

SEQ ID NO: 965477 - RNA, 17 nt, Homo sapiens
gagguguggauaaggcu

SEQ ID NO: 965478 - RNA, 15 nt, Homo sapiens
gaguaaaauucaguu

SEQ ID NO: 965479 - RNA, 23 nt, Homo sapiens
gaguaagcccucaggagccucug

SEQ ID NO: 965480 - RNA, 18 nt, Homo sapiens
gagucauggcuaauuuaa

SEQ ID NO: 965481 - RNA, 21 nt, Homo sapiens
gagucauggcuaauuuaacac

SEQ ID NO: 965482 - RNA, 22 nt, Homo sapiens
gagucuaggcuaagcacuuuau

SEQ ID NO: 965483 - RNA, 17 nt, Homo sapiens
gagucucauuugggcua

SEQ ID NO: 965484 - RNA, 14 nt, Homo sapiens
gagugcaacccagu

SEQ ID NO: 965485 - RNA, 16 nt, Homo sapiens
gagugcaguggcgcga

SEQ ID NO: 965486 - RNA, 13 nt, Homo sapiens
gaguggccagcuu

SEQ ID NO: 965487 - RNA, 15 nt, Homo sapiens
gaguuaaaucucaaa

SEQ ID NO: 965488 - RNA, 15 nt, Homo sapiens
gaguuccuucucacu

SEQ ID NO: 965489 - RNA, 13 nt, Homo sapiens
gaguugacugcuc

SEQ ID NO: 965490 - RNA, 21 nt, Homo sapiens
gaguuuugcuuuugacuccag

SEQ ID NO: 965491 - RNA, 23 nt, Homo sapiens
gauaaaacacuaacuuaaugugu

SEQ ID NO: 965492 - RNA, 13 nt, Homo sapiens
gauaaaacagaau

SEQ ID NO: 965493 - RNA, 18 nt, Homo sapiens
gauacacuugaaggacca

SEQ ID NO: 965494 - RNA, 20 nt, Homo sapiens
gauacuuuaguacaauuuca

SEQ ID NO: 965495 - RNA, 12 nt, Homo sapiens
gauauaccaaau

SEQ ID NO: 965496 - RNA, 16 nt, Homo sapiens
gauauauaggcuauuu

SEQ ID NO: 965497 - RNA, 21 nt, Homo sapiens
gauauuguggguaacgugaga

SEQ ID NO: 965498 - RNA, 14 nt, Homo sapiens
gauauuuuaucuau

SEQ ID NO: 965499 - RNA, 12 nt, Homo sapiens
gaucacugccac

SEQ ID NO: 965500 - RNA, 14 nt, Homo sapiens
gaucacugccacac

SEQ ID NO: 965501 - RNA, 18 nt, Homo sapiens
gaucacuuuugcacauuc

SEQ ID NO: 965502 - RNA, 19 nt, Homo sapiens
gaucacuuuugcacauucc

SEQ ID NO: 965503 - RNA, 17 nt, Homo sapiens
gaucagcgacugccaca

SEQ ID NO: 965504 - RNA, 21 nt, Homo sapiens
gaucauuacauggcugugguu

SEQ ID NO: 965505 - RNA, 21 nt, Homo sapiens
gaucgucccauccccacaucc

SEQ ID NO: 965506 - RNA, 20 nt, Homo sapiens
gaucgugcuacugcacucca

SEQ ID NO: 965507 - RNA, 19 nt, Homo sapiens
gaucuggcccuugcuuacc

SEQ ID NO: 965508 - RNA, 17 nt, Homo sapiens
gaugaaauuauuuguca

SEQ ID NO: 965509 - RNA, 21 nt, Homo sapiens
gaugaaguuguacaacaccag

SEQ ID NO: 965510 - RNA, 17 nt, Homo sapiens
gaugaauaaaaugaagg

SEQ ID NO: 965511 - RNA, 18 nt, Homo sapiens
gaugacugccuugccucc

SEQ ID NO: 965512 - RNA, 15 nt, Homo sapiens
gaugcagcacugcgc

SEQ ID NO: 965513 - RNA, 21 nt, Homo sapiens
gaugccauggcaacuuagaga

SEQ ID NO: 965514 - RNA, 18 nt, Homo sapiens
gaugcccacauacugucu

SEQ ID NO: 965515 - RNA, 22 nt, Homo sapiens
gaugcuggacacccucuuccca

SEQ ID NO: 965516 - RNA, 18 nt, Homo sapiens
gauggcccauagaccuga

SEQ ID NO: 965517 - RNA, 22 nt, Homo sapiens
gaugggauggcaaaugcuguga

SEQ ID NO: 965518 - RNA, 17 nt, Homo sapiens
gaugguucccaauauca

SEQ ID NO: 965519 - RNA, 15 nt, Homo sapiens
gaugucuucaaugga

SEQ ID NO: 965520 - RNA, 22 nt, Homo sapiens
gaugugaauuauugacacugaa

SEQ ID NO: 965521 - RNA, 17 nt, Homo sapiens
gauuaacaacaggaaau

SEQ ID NO: 965522 - RNA, 22 nt, Homo sapiens
gauuauuuaauaacauuaccuu

SEQ ID NO: 965523 - RNA, 14 nt, Homo sapiens
gauugaagucuucu

SEQ ID NO: 965524 - RNA, 24 nt, Homo sapiens
gauugagaaauguguagcugcaaa

SEQ ID NO: 965525 - RNA, 21 nt, Homo sapiens
gauuguaaaaaaaaaugccuu

SEQ ID NO: 965526 - RNA, 23 nt, Homo sapiens
gauuuacuaacaguaacugccau

SEQ ID NO: 965527 - RNA, 18 nt, Homo sapiens
gauuuauaacgcacaacu

SEQ ID NO: 965528 - RNA, 13 nt, Homo sapiens
gauuugcacagaa

SEQ ID NO: 965529 - RNA, 11 nt, Homo sapiens
gauuugccuca

SEQ ID NO: 965530 - RNA, 18 nt, Homo sapiens
gauuuugaagagauuuua

SEQ ID NO: 965531 - RNA, 11 nt, Homo sapiens
gcaaaagugaa

SEQ ID NO: 965532 - RNA, 15 nt, Homo sapiens
gcaaaccucuccuca

SEQ ID NO: 965533 - RNA, 13 nt, Homo sapiens
gcaaaguacuugu

SEQ ID NO: 965534 - RNA, 13 nt, Homo sapiens
gcaaauguuaaaa

SEQ ID NO: 965535 - RNA, 17 nt, Homo sapiens
gcaacaauuuaugaauu

SEQ ID NO: 965536 - RNA, 22 nt, Homo sapiens
gcaaccucuuugcucaacagaa

SEQ ID NO: 965537 - RNA, 15 nt, Homo sapiens
gcaacuaggccuuca

SEQ ID NO: 965538 - RNA, 23 nt, Homo sapiens
gcaacugggucugacaugaacac

SEQ ID NO: 965539 - RNA, 15 nt, Homo sapiens
gcaacuguaugaaaa

SEQ ID NO: 965540 - RNA, 11 nt, Homo sapiens
gcaagccagac

SEQ ID NO: 965541 - RNA, 20 nt, Homo sapiens
gcaaguggccauuaccaucu

SEQ ID NO: 965542 - RNA, 17 nt, Homo sapiens
gcaaguguucacugcuc

SEQ ID NO: 965543 - RNA, 21 nt, Homo sapiens
gcaauagggugcaguuuucca

SEQ ID NO: 965544 - RNA, 18 nt, Homo sapiens
gcacaauuugcacuaaau

SEQ ID NO: 965545 - RNA, 20 nt, Homo sapiens
gcacacauuauuuggcuuaa

SEQ ID NO: 965546 - RNA, 21 nt, Homo sapiens
gcacaccucugcaccuuugca

SEQ ID NO: 965547 - RNA, 23 nt, Homo sapiens
gcacauauccaggcaccaggacu

SEQ ID NO: 965548 - RNA, 15 nt, Homo sapiens
gcacaugucuuguac

SEQ ID NO: 965549 - RNA, 20 nt, Homo sapiens
gcacaugucuuguacaugug

SEQ ID NO: 965550 - RNA, 22 nt, Homo sapiens
gcacauugucaccccaagccau

SEQ ID NO: 965551 - RNA, 16 nt, Homo sapiens
gcacccuggacaaaga

SEQ ID NO: 965552 - RNA, 16 nt, Homo sapiens
gcaccugacuuggcug

SEQ ID NO: 965553 - RNA, 14 nt, Homo sapiens
gcaccuuugcacgu

SEQ ID NO: 965554 - RNA, 16 nt, Homo sapiens
gcacuaaaucagagac

SEQ ID NO: 965555 - RNA, 13 nt, Homo sapiens
gcacuagcauuuu

SEQ ID NO: 965556 - RNA, 13 nt, Homo sapiens
gcacuggggccac

SEQ ID NO: 965557 - RNA, 20 nt, Homo sapiens
gcagaaacuuggaugucacu

SEQ ID NO: 965558 - RNA, 16 nt, Homo sapiens
gcagaccucaagccau

SEQ ID NO: 965559 - RNA, 20 nt, Homo sapiens
gcagagaaccaaaggggcca

SEQ ID NO: 965560 - RNA, 22 nt, Homo sapiens
gcagagagccauuuugugaaug

SEQ ID NO: 965561 - RNA, 13 nt, Homo sapiens
gcagaggacgcac

SEQ ID NO: 965562 - RNA, 16 nt, Homo sapiens
gcagauagcacugggu

SEQ ID NO: 965563 - RNA, 15 nt, Homo sapiens
gcagaugggaacuga

SEQ ID NO: 965564 - RNA, 21 nt, Homo sapiens
gcagauugaaaaggacaccuu

SEQ ID NO: 965565 - RNA, 15 nt, Homo sapiens
gcagcccaaucugcc

SEQ ID NO: 965566 - RNA, 22 nt, Homo sapiens
gcagccccucaugccuggagaa

SEQ ID NO: 965567 - RNA, 13 nt, Homo sapiens
gcagcgaccucaa

SEQ ID NO: 965568 - RNA, 15 nt, Homo sapiens
gcagcuaaaaaugca

SEQ ID NO: 965569 - RNA, 16 nt, Homo sapiens
gcagcuccagugccag

SEQ ID NO: 965570 - RNA, 17 nt, Homo sapiens
gcagcucuccaccagcu

SEQ ID NO: 965571 - RNA, 17 nt, Homo sapiens
gcaggagaaucgcuuga

SEQ ID NO: 965572 - RNA, 14 nt, Homo sapiens
gcaggcacaugagg

SEQ ID NO: 965573 - RNA, 19 nt, Homo sapiens
gcaggcugggccaugucca

SEQ ID NO: 965574 - RNA, 23 nt, Homo sapiens
gcaggcugggccauguccaaaga

SEQ ID NO: 965575 - RNA, 20 nt, Homo sapiens
gcagggcugggccagugcau

SEQ ID NO: 965576 - RNA, 12 nt, Homo sapiens
gcagucacugga

SEQ ID NO: 965577 - RNA, 16 nt, Homo sapiens
gcagugugaauagccu

SEQ ID NO: 965578 - RNA, 13 nt, Homo sapiens
gcaguucuacuca

SEQ ID NO: 965579 - RNA, 21 nt, Homo sapiens
gcaguuuugcuaucugggcug

SEQ ID NO: 965580 - RNA, 23 nt, Homo sapiens
gcauaccuggauuuccuuggcuu

SEQ ID NO: 965581 - RNA, 20 nt, Homo sapiens
gcauagcaaaugacauaagc

SEQ ID NO: 965582 - RNA, 20 nt, Homo sapiens
gcauagcaguauauguuaau

SEQ ID NO: 965583 - RNA, 22 nt, Homo sapiens
gcaucagugggaucccagacau

SEQ ID NO: 965584 - RNA, 20 nt, Homo sapiens
gcaucuucugguuuaaacuu

SEQ ID NO: 965585 - RNA, 16 nt, Homo sapiens
gcaucuugcuggcuac

SEQ ID NO: 965586 - RNA, 22 nt, Homo sapiens
gcaugaucuuucugcaggaaau

SEQ ID NO: 965587 - RNA, 22 nt, Homo sapiens
gcaugcuggggcccuaccagca

SEQ ID NO: 965588 - RNA, 19 nt, Homo sapiens
gcauguggccuuuaucuca

SEQ ID NO: 965589 - RNA, 21 nt, Homo sapiens
gcauguuuccugcucuucccu

SEQ ID NO: 965590 - RNA, 21 nt, Homo sapiens
gcauuuaaaaggacugcugau

SEQ ID NO: 965591 - RNA, 16 nt, Homo sapiens
gcauuuagucuugcca

SEQ ID NO: 965592 - RNA, 13 nt, Homo sapiens
gccaaaccaggac

SEQ ID NO: 965593 - RNA, 20 nt, Homo sapiens
gccaagggaaaggggugcuu

SEQ ID NO: 965594 - RNA, 19 nt, Homo sapiens
gccaaugccccacuggcag

SEQ ID NO: 965595 - RNA, 20 nt, Homo sapiens
gccaauuaaaaacaugaauu

SEQ ID NO: 965596 - RNA, 17 nt, Homo sapiens
gccacaaacuccaucca

SEQ ID NO: 965597 - RNA, 20 nt, Homo sapiens
gccacaauccacgcuucucc

SEQ ID NO: 965598 - RNA, 22 nt, Homo sapiens
gccacagcugcuguucucagga

SEQ ID NO: 965599 - RNA, 16 nt, Homo sapiens
gccacucaguucuucc

SEQ ID NO: 965600 - RNA, 15 nt, Homo sapiens
gccagacauggaccu

SEQ ID NO: 965601 - RNA, 13 nt, Homo sapiens
gccagagccucug

SEQ ID NO: 965602 - RNA, 16 nt, Homo sapiens
gccagcaggagccagc

SEQ ID NO: 965603 - RNA, 15 nt, Homo sapiens
gccagcuucacucuc

SEQ ID NO: 965604 - RNA, 22 nt, Homo sapiens
gccagcuuggggccaccaaagc

SEQ ID NO: 965605 - RNA, 15 nt, Homo sapiens
gccaggagcaggcac

SEQ ID NO: 965606 - RNA, 17 nt, Homo sapiens
gccaggaggccugcuag

SEQ ID NO: 965607 - RNA, 22 nt, Homo sapiens
gccaguacagagaaauucugug

SEQ ID NO: 965608 - RNA, 21 nt, Homo sapiens
gccaguuccucccaucuucag

SEQ ID NO: 965609 - RNA, 17 nt, Homo sapiens
gccaguugaucugcucu

SEQ ID NO: 965610 - RNA, 20 nt, Homo sapiens
gccauaguggaucacucacc

SEQ ID NO: 965611 - RNA, 12 nt, Homo sapiens
gccauaugcccu

SEQ ID NO: 965612 - RNA, 23 nt, Homo sapiens
gccauaugcccucaucaucccag

SEQ ID NO: 965613 - RNA, 18 nt, Homo sapiens
gccauauucacaccucac

SEQ ID NO: 965614 - RNA, 21 nt, Homo sapiens
gccaugagguucggcacccag

SEQ ID NO: 965615 - RNA, 22 nt, Homo sapiens
gccaugcagaccucaugcccag

SEQ ID NO: 965616 - RNA, 14 nt, Homo sapiens
gccauguccaaaga

SEQ ID NO: 965617 - RNA, 15 nt, Homo sapiens
gccauguccaaagag

SEQ ID NO: 965618 - RNA, 21 nt, Homo sapiens
gccauucacuucauaauccag

SEQ ID NO: 965619 - RNA, 15 nt, Homo sapiens
gcccacgcagaggac

SEQ ID NO: 965620 - RNA, 23 nt, Homo sapiens
gcccagccccuacugcugugaac

SEQ ID NO: 965621 - RNA, 19 nt, Homo sapiens
gcccaggcuggagugcagu

SEQ ID NO: 965622 - RNA, 16 nt, Homo sapiens
gcccagugcauaugca

SEQ ID NO: 965623 - RNA, 12 nt, Homo sapiens
gcccauccugcc

SEQ ID NO: 965624 - RNA, 19 nt, Homo sapiens
gccccagggaguccagggu

SEQ ID NO: 965625 - RNA, 15 nt, Homo sapiens
gccccauuccuugcg

SEQ ID NO: 965626 - RNA, 15 nt, Homo sapiens
gcccccgccccagag

SEQ ID NO: 965627 - RNA, 17 nt, Homo sapiens
gccccuccacccaucca

SEQ ID NO: 965628 - RNA, 14 nt, Homo sapiens
gccccucucaccaa

SEQ ID NO: 965629 - RNA, 17 nt, Homo sapiens
gccccugccccaagucc

SEQ ID NO: 965630 - RNA, 16 nt, Homo sapiens
gccccuucaaaccuca

SEQ ID NO: 965631 - RNA, 16 nt, Homo sapiens
gccccuuugccuguca

SEQ ID NO: 965632 - RNA, 17 nt, Homo sapiens
gccccuuugccugucaa

SEQ ID NO: 965633 - RNA, 21 nt, Homo sapiens
gcccuaaccccuuccagauca

SEQ ID NO: 965634 - RNA, 16 nt, Homo sapiens
gcccuacucccugcag

SEQ ID NO: 965635 - RNA, 11 nt, Homo sapiens
gcccucaggag

SEQ ID NO: 965636 - RNA, 17 nt, Homo sapiens
gcccuuccaaacucuuc

SEQ ID NO: 965637 - RNA, 16 nt, Homo sapiens
gcccuugagaagccaa

SEQ ID NO: 965638 - RNA, 21 nt, Homo sapiens
gccggaaaaggcgcaucuaac

SEQ ID NO: 965639 - RNA, 22 nt, Homo sapiens
gccgggacccagggcccucggu

SEQ ID NO: 965640 - RNA, 17 nt, Homo sapiens
gccguggacuggcucau

SEQ ID NO: 965641 - RNA, 13 nt, Homo sapiens
gccuaaacuuaau

SEQ ID NO: 965642 - RNA, 19 nt, Homo sapiens
gccuacacccgucuugggg

SEQ ID NO: 965643 - RNA, 12 nt, Homo sapiens
gccuacagccag

SEQ ID NO: 965644 - RNA, 12 nt, Homo sapiens
gccuacauucac

SEQ ID NO: 965645 - RNA, 18 nt, Homo sapiens
gccuacuuaagagugcug

SEQ ID NO: 965646 - RNA, 19 nt, Homo sapiens
gccuacuuaagagugcugu

SEQ ID NO: 965647 - RNA, 22 nt, Homo sapiens
gccucaguuuuccuucuguuaa

SEQ ID NO: 965648 - RNA, 22 nt, Homo sapiens
gccuccccauuucccaucugca

SEQ ID NO: 965649 - RNA, 17 nt, Homo sapiens
gccuccccgugccaaaa

SEQ ID NO: 965650 - RNA, 21 nt, Homo sapiens
gccugaauuggcuaugcagua

SEQ ID NO: 965651 - RNA, 22 nt, Homo sapiens
gccugacuuggggagauggagu

SEQ ID NO: 965652 - RNA, 20 nt, Homo sapiens
gccugagaggcaggcauaga

SEQ ID NO: 965653 - RNA, 14 nt, Homo sapiens
gccugaggcuguaa

SEQ ID NO: 965654 - RNA, 17 nt, Homo sapiens
gccugagucagugcucu

SEQ ID NO: 965655 - RNA, 15 nt, Homo sapiens
gccugauccaucccc

SEQ ID NO: 965656 - RNA, 14 nt, Homo sapiens
gccugcuuugaaua

SEQ ID NO: 965657 - RNA, 19 nt, Homo sapiens
gccuggacacuguaccgac

SEQ ID NO: 965658 - RNA, 15 nt, Homo sapiens
gccuggaggugggca

SEQ ID NO: 965659 - RNA, 17 nt, Homo sapiens
gccuggccagcacccca

SEQ ID NO: 965660 - RNA, 22 nt, Homo sapiens
gccugguucaaaguaaagcaga

SEQ ID NO: 965661 - RNA, 13 nt, Homo sapiens
gccugugcaugua

SEQ ID NO: 965662 - RNA, 20 nt, Homo sapiens
gccugugcauguaugucuug

SEQ ID NO: 965663 - RNA, 21 nt, Homo sapiens
gccuuacaaacucacuaugaa

SEQ ID NO: 965664 - RNA, 10 nt, Homo sapiens
gccuuauauu

SEQ ID NO: 965665 - RNA, 21 nt, Homo sapiens
gccuucccaaguugugcuuga

SEQ ID NO: 965666 - RNA, 13 nt, Homo sapiens
gccuucucaggaa

SEQ ID NO: 965667 - RNA, 13 nt, Homo sapiens
gccuuuaucucaa

SEQ ID NO: 965668 - RNA, 20 nt, Homo sapiens
gccuuuuuuccugggccaga

SEQ ID NO: 965669 - RNA, 11 nt, Homo sapiens
gcgaguguuuc

SEQ ID NO: 965670 - RNA, 18 nt, Homo sapiens
gcgccagccucagacugg

SEQ ID NO: 965671 - RNA, 16 nt, Homo sapiens
gcgccaggaagccaga

SEQ ID NO: 965672 - RNA, 17 nt, Homo sapiens
gcgcggcgagggcaaag

SEQ ID NO: 965673 - RNA, 19 nt, Homo sapiens
gcgucugccccacccucaa

SEQ ID NO: 965674 - RNA, 15 nt, Homo sapiens
gcgugccguggcacc

SEQ ID NO: 965675 - RNA, 17 nt, Homo sapiens
gcgugggcgcuugcacc

SEQ ID NO: 965676 - RNA, 19 nt, Homo sapiens
gcguguguagaguuaagaa

SEQ ID NO: 965677 - RNA, 22 nt, Homo sapiens
gcguguuucugacucugagcua

SEQ ID NO: 965678 - RNA, 20 nt, Homo sapiens
gcuaaaccaaggacugagca

SEQ ID NO: 965679 - RNA, 19 nt, Homo sapiens
gcuaauuguacuaaucuga

SEQ ID NO: 965680 - RNA, 23 nt, Homo sapiens
gcuaccagguguucuacacucau

SEQ ID NO: 965681 - RNA, 22 nt, Homo sapiens
gcuagacuaccggacacucguc

SEQ ID NO: 965682 - RNA, 17 nt, Homo sapiens
gcuagguagaacacugc

SEQ ID NO: 965683 - RNA, 18 nt, Homo sapiens
gcuauaaaugauuauuua

SEQ ID NO: 965684 - RNA, 20 nt, Homo sapiens
gcuauaugccuuaagccaau

SEQ ID NO: 965685 - RNA, 21 nt, Homo sapiens
gcuauauucugagacuuugaa

SEQ ID NO: 965686 - RNA, 11 nt, Homo sapiens
gcuauggugcu

SEQ ID NO: 965687 - RNA, 12 nt, Homo sapiens
gcucaaagggaa

SEQ ID NO: 965688 - RNA, 20 nt, Homo sapiens
gcucaagcaauccuccugcc

SEQ ID NO: 965689 - RNA, 20 nt, Homo sapiens
gcucacaugggacugggaua

SEQ ID NO: 965690 - RNA, 12 nt, Homo sapiens
gcucaccagccc

SEQ ID NO: 965691 - RNA, 20 nt, Homo sapiens
gcucacgccuguaauucuag

SEQ ID NO: 965692 - RNA, 17 nt, Homo sapiens
gcucaggguucaucuga

SEQ ID NO: 965693 - RNA, 22 nt, Homo sapiens
gcucaguaaacgggaacaugcc

SEQ ID NO: 965694 - RNA, 23 nt, Homo sapiens
gcucaguaaacgggaacaugccc

SEQ ID NO: 965695 - RNA, 18 nt, Homo sapiens
gcuccagauucugaugca

SEQ ID NO: 965696 - RNA, 13 nt, Homo sapiens
gcuccagcacauc

SEQ ID NO: 965697 - RNA, 19 nt, Homo sapiens
gcuccagggaauccaagcc

SEQ ID NO: 965698 - RNA, 20 nt, Homo sapiens
gcuccucagagcgccaggaa

SEQ ID NO: 965699 - RNA, 22 nt, Homo sapiens
gcuccuccccuuccucuugucu

SEQ ID NO: 965700 - RNA, 17 nt, Homo sapiens
gcuccuugcugcauuga

SEQ ID NO: 965701 - RNA, 19 nt, Homo sapiens
gcucucccaacucuugcac

SEQ ID NO: 965702 - RNA, 23 nt, Homo sapiens
gcucuccggggccauuugcaaua

SEQ ID NO: 965703 - RNA, 14 nt, Homo sapiens
gcucucucuagaau

SEQ ID NO: 965704 - RNA, 21 nt, Homo sapiens
gcucucugacgcuugugacag

SEQ ID NO: 965705 - RNA, 17 nt, Homo sapiens
gcucugauugcagcaca

SEQ ID NO: 965706 - RNA, 17 nt, Homo sapiens
gcucuggguugugcaca

SEQ ID NO: 965707 - RNA, 13 nt, Homo sapiens
gcucuucagcaca

SEQ ID NO: 965708 - RNA, 16 nt, Homo sapiens
gcugaaauaaaaugau

SEQ ID NO: 965709 - RNA, 15 nt, Homo sapiens
gcugaaugucauuuu

SEQ ID NO: 965710 - RNA, 18 nt, Homo sapiens
gcugacagagcucugggu

SEQ ID NO: 965711 - RNA, 20 nt, Homo sapiens
gcugagcaaucugacccuau

SEQ ID NO: 965712 - RNA, 17 nt, Homo sapiens
gcugaggcccagugcau

SEQ ID NO: 965713 - RNA, 18 nt, Homo sapiens
gcugagggccugcuggag

SEQ ID NO: 965714 - RNA, 18 nt, Homo sapiens
gcugagguuccucugccu

SEQ ID NO: 965715 - RNA, 20 nt, Homo sapiens
gcugauuuucaucaaaacca

SEQ ID NO: 965716 - RNA, 21 nt, Homo sapiens
gcugcagcucuccaccagcug

SEQ ID NO: 965717 - RNA, 14 nt, Homo sapiens
gcugcccaccugcc

SEQ ID NO: 965718 - RNA, 13 nt, Homo sapiens
gcugcccacuguu

SEQ ID NO: 965719 - RNA, 19 nt, Homo sapiens
gcugcuuccugucugagua

SEQ ID NO: 965720 - RNA, 23 nt, Homo sapiens
gcuggaggccucaggugcugucc

SEQ ID NO: 965721 - RNA, 22 nt, Homo sapiens
gcuggagguggaaaauggugcc

SEQ ID NO: 965722 - RNA, 20 nt, Homo sapiens
gcuggaguacaguggcacga

SEQ ID NO: 965723 - RNA, 20 nt, Homo sapiens
gcuggagugcaguggcgcga

SEQ ID NO: 965724 - RNA, 16 nt, Homo sapiens
gcuggccucucuagca

SEQ ID NO: 965725 - RNA, 14 nt, Homo sapiens
gcugggcaccugac

SEQ ID NO: 965726 - RNA, 18 nt, Homo sapiens
gcugggcaugguggcgca

SEQ ID NO: 965727 - RNA, 15 nt, Homo sapiens
gcugggccagugcau

SEQ ID NO: 965728 - RNA, 11 nt, Homo sapiens
gcuggggcuuu

SEQ ID NO: 965729 - RNA, 15 nt, Homo sapiens
gcugggucacaucca

SEQ ID NO: 965730 - RNA, 19 nt, Homo sapiens
gcuggugggacagugguga

SEQ ID NO: 965731 - RNA, 21 nt, Homo sapiens
gcuguaaaaauguuacgugaa

SEQ ID NO: 965732 - RNA, 17 nt, Homo sapiens
gcugugcaucaguggga

SEQ ID NO: 965733 - RNA, 14 nt, Homo sapiens
gcuguucugcugaa

SEQ ID NO: 965734 - RNA, 12 nt, Homo sapiens
gcuuagauuucc

SEQ ID NO: 965735 - RNA, 18 nt, Homo sapiens
gcuuccuccgcucugggu

SEQ ID NO: 965736 - RNA, 15 nt, Homo sapiens
gcuucuaccuggaaa

SEQ ID NO: 965737 - RNA, 20 nt, Homo sapiens
gcuucucacagcaaaccucu

SEQ ID NO: 965738 - RNA, 21 nt, Homo sapiens
gcuucucagauuucugaggaa

SEQ ID NO: 965739 - RNA, 18 nt, Homo sapiens
gcuucuuugccucccuca

SEQ ID NO: 965740 - RNA, 13 nt, Homo sapiens
gcuugaagccaaa

SEQ ID NO: 965741 - RNA, 14 nt, Homo sapiens
gcuugaagccaaag

SEQ ID NO: 965742 - RNA, 14 nt, Homo sapiens
gcuugggcauugaa

SEQ ID NO: 965743 - RNA, 16 nt, Homo sapiens
gcuuucccacucucag

SEQ ID NO: 965744 - RNA, 22 nt, Homo sapiens
gcuuucugccaucuagccagcc

SEQ ID NO: 965745 - RNA, 22 nt, Homo sapiens
gcuuugauguuccuuccagugu

SEQ ID NO: 965746 - RNA, 12 nt, Homo sapiens
gcuuugcccauu

SEQ ID NO: 965747 - RNA, 16 nt, Homo sapiens
gcuuuucccacucuca

SEQ ID NO: 965748 - RNA, 13 nt, Homo sapiens
gcuuuucuguauu

SEQ ID NO: 965749 - RNA, 19 nt, Homo sapiens
ggaaaaaauaaaagaucuu

SEQ ID NO: 965750 - RNA, 22 nt, Homo sapiens
ggaaaaaauaaaagaucuugaa

SEQ ID NO: 965751 - RNA, 22 nt, Homo sapiens
ggaaaacuguguugccacagua

SEQ ID NO: 965752 - RNA, 21 nt, Homo sapiens
ggaaaccaguuuggugauaua

SEQ ID NO: 965753 - RNA, 17 nt, Homo sapiens
ggaaacucacacucccc

SEQ ID NO: 965754 - RNA, 21 nt, Homo sapiens
ggaaagagcagucagagucca

SEQ ID NO: 965755 - RNA, 23 nt, Homo sapiens
ggaaagaggcucuggacagcaga

SEQ ID NO: 965756 - RNA, 18 nt, Homo sapiens
ggaaauugcaguaacaaa

SEQ ID NO: 965757 - RNA, 12 nt, Homo sapiens
ggaacaauccau

SEQ ID NO: 965758 - RNA, 21 nt, Homo sapiens
ggaagaccggcugguggagcu

SEQ ID NO: 965759 - RNA, 11 nt, Homo sapiens
ggaagccagag

SEQ ID NO: 965760 - RNA, 20 nt, Homo sapiens
ggaagccccugggcccagua

SEQ ID NO: 965761 - RNA, 16 nt, Homo sapiens
ggaauaacuuuuacac

SEQ ID NO: 965762 - RNA, 20 nt, Homo sapiens
ggaauccaagccuccacagc

SEQ ID NO: 965763 - RNA, 16 nt, Homo sapiens
ggaauuacgugcucug

SEQ ID NO: 965764 - RNA, 21 nt, Homo sapiens
ggaauugcuggaggaaccaga

SEQ ID NO: 965765 - RNA, 20 nt, Homo sapiens
ggacaccacgauucucccaa

SEQ ID NO: 965766 - RNA, 17 nt, Homo sapiens
ggacaccauuaccaaaa

SEQ ID NO: 965767 - RNA, 18 nt, Homo sapiens
ggacaccuuuuaacucac

SEQ ID NO: 965768 - RNA, 11 nt, Homo sapiens
ggacacuguac

SEQ ID NO: 965769 - RNA, 23 nt, Homo sapiens
ggacagaaagagacuccgucuca

SEQ ID NO: 965770 - RNA, 14 nt, Homo sapiens
ggacaguggugaca

SEQ ID NO: 965771 - RNA, 17 nt, Homo sapiens
ggacauuugaacauguu

SEQ ID NO: 965772 - RNA, 17 nt, Homo sapiens
ggaccaggccauucugc

SEQ ID NO: 965773 - RNA, 18 nt, Homo sapiens
ggacccugagaagccagu

SEQ ID NO: 965774 - RNA, 23 nt, Homo sapiens
ggacgcacgcucgcugccaucac

SEQ ID NO: 965775 - RNA, 23 nt, Homo sapiens
ggacgccugcaggagagagcagc

SEQ ID NO: 965776 - RNA, 20 nt, Homo sapiens
ggacuaugcugaugggccag

SEQ ID NO: 965777 - RNA, 11 nt, Homo sapiens
ggacucuccaa

SEQ ID NO: 965778 - RNA, 13 nt, Homo sapiens
ggacucugcacau

SEQ ID NO: 965779 - RNA, 12 nt, Homo sapiens
ggacucuuccac

SEQ ID NO: 965780 - RNA, 11 nt, Homo sapiens
ggacugagaug

SEQ ID NO: 965781 - RNA, 14 nt, Homo sapiens
ggacuguaagggau

SEQ ID NO: 965782 - RNA, 21 nt, Homo sapiens
ggacuucaagccccaccacau

SEQ ID NO: 965783 - RNA, 23 nt, Homo sapiens
ggagaagcugcaggcuuugccau

SEQ ID NO: 965784 - RNA, 22 nt, Homo sapiens
ggagaauaaaauuccuaucuca

SEQ ID NO: 965785 - RNA, 16 nt, Homo sapiens
ggagacaaggugcuaa

SEQ ID NO: 965786 - RNA, 16 nt, Homo sapiens
ggagacgccaugugau

SEQ ID NO: 965787 - RNA, 15 nt, Homo sapiens
ggagagacaggcagc

SEQ ID NO: 965788 - RNA, 16 nt, Homo sapiens
ggagcacggacuguca

SEQ ID NO: 965789 - RNA, 20 nt, Homo sapiens
ggagcagggagagcucacca

SEQ ID NO: 965790 - RNA, 13 nt, Homo sapiens
ggagccaccagca

SEQ ID NO: 965791 - RNA, 22 nt, Homo sapiens
ggagccccaggggacaagggau

SEQ ID NO: 965792 - RNA, 12 nt, Homo sapiens
ggagcucagagc

SEQ ID NO: 965793 - RNA, 18 nt, Homo sapiens
ggagcuuucucaaugucu

SEQ ID NO: 965794 - RNA, 16 nt, Homo sapiens
ggaggaaagcuugaag

SEQ ID NO: 965795 - RNA, 14 nt, Homo sapiens
ggaggagcagcagc

SEQ ID NO: 965796 - RNA, 14 nt, Homo sapiens
ggaggccauugugu

SEQ ID NO: 965797 - RNA, 15 nt, Homo sapiens
ggagguauaugauga

SEQ ID NO: 965798 - RNA, 21 nt, Homo sapiens
ggagguuacagugagccaaga

SEQ ID NO: 965799 - RNA, 13 nt, Homo sapiens
ggaguaaaauuca

SEQ ID NO: 965800 - RNA, 16 nt, Homo sapiens
ggaguugacugcucau

SEQ ID NO: 965801 - RNA, 22 nt, Homo sapiens
ggaucacucaccauucccagau

SEQ ID NO: 965802 - RNA, 17 nt, Homo sapiens
ggaucaugguguaauaa

SEQ ID NO: 965803 - RNA, 12 nt, Homo sapiens
ggaucugaggga

SEQ ID NO: 965804 - RNA, 21 nt, Homo sapiens
ggauguuaugaacagcugugu

SEQ ID NO: 965805 - RNA, 17 nt, Homo sapiens
ggauuacaguguagcua

SEQ ID NO: 965806 - RNA, 16 nt, Homo sapiens
ggauucugaaucucaa

SEQ ID NO: 965807 - RNA, 17 nt, Homo sapiens
ggcaaaaacaaaacucu

SEQ ID NO: 965808 - RNA, 14 nt, Homo sapiens
ggcaacuguaugaa

SEQ ID NO: 965809 - RNA, 18 nt, Homo sapiens
ggcaacuuagagauugca

SEQ ID NO: 965810 - RNA, 18 nt, Homo sapiens
ggcaagagaugaauugca

SEQ ID NO: 965811 - RNA, 15 nt, Homo sapiens
ggcacaaacaccuua

SEQ ID NO: 965812 - RNA, 16 nt, Homo sapiens
ggcacgccaacagccc

SEQ ID NO: 965813 - RNA, 17 nt, Homo sapiens
ggcagcaguaccaucua

SEQ ID NO: 965814 - RNA, 22 nt, Homo sapiens
ggcaggaagggaagcguauaua

SEQ ID NO: 965815 - RNA, 18 nt, Homo sapiens
ggcaggcccauucagagc

SEQ ID NO: 965816 - RNA, 15 nt, Homo sapiens
ggcaggcugggccau

SEQ ID NO: 965817 - RNA, 22 nt, Homo sapiens
ggcagguaggucggcacuugga

SEQ ID NO: 965818 - RNA, 16 nt, Homo sapiens
ggcaguagaacuccag

SEQ ID NO: 965819 - RNA, 20 nt, Homo sapiens
ggcaucucuuccccagagag

SEQ ID NO: 965820 - RNA, 13 nt, Homo sapiens
ggccaccacugca

SEQ ID NO: 965821 - RNA, 17 nt, Homo sapiens
ggccauaaacgguuccu

SEQ ID NO: 965822 - RNA, 22 nt, Homo sapiens
ggccauggaagguucucugugc

SEQ ID NO: 965823 - RNA, 21 nt, Homo sapiens
ggcccaagugaggagugccag

SEQ ID NO: 965824 - RNA, 13 nt, Homo sapiens
ggcccgccucucc

SEQ ID NO: 965825 - RNA, 16 nt, Homo sapiens
ggccgugagggguccc

SEQ ID NO: 965826 - RNA, 22 nt, Homo sapiens
ggccuccuuggcaaugcauuug

SEQ ID NO: 965827 - RNA, 16 nt, Homo sapiens
ggccugacugcucaga

SEQ ID NO: 965828 - RNA, 17 nt, Homo sapiens
ggccugcaaacugggaa

SEQ ID NO: 965829 - RNA, 15 nt, Homo sapiens
ggccuggacaguauc

SEQ ID NO: 965830 - RNA, 13 nt, Homo sapiens
ggcgccuguaauu

SEQ ID NO: 965831 - RNA, 20 nt, Homo sapiens
ggcggguggaucacgagguc

SEQ ID NO: 965832 - RNA, 14 nt, Homo sapiens
ggcgucaccaucca

SEQ ID NO: 965833 - RNA, 13 nt, Homo sapiens
ggcgugggcgcuu

SEQ ID NO: 965834 - RNA, 15 nt, Homo sapiens
ggcuaagcacuuuau

SEQ ID NO: 965835 - RNA, 21 nt, Homo sapiens
ggcuaccucagaaagauuuga

SEQ ID NO: 965836 - RNA, 15 nt, Homo sapiens
ggcucaacauugugu

SEQ ID NO: 965837 - RNA, 14 nt, Homo sapiens
ggcuccucagagcg

SEQ ID NO: 965838 - RNA, 17 nt, Homo sapiens
ggcugaugguguggccu

SEQ ID NO: 965839 - RNA, 17 nt, Homo sapiens
ggcugcaguucuacuca

SEQ ID NO: 965840 - RNA, 17 nt, Homo sapiens
ggcugccccucucacca

SEQ ID NO: 965841 - RNA, 20 nt, Homo sapiens
ggcugcugaaacucauuuga

SEQ ID NO: 965842 - RNA, 20 nt, Homo sapiens
ggcuggagugcaguggcaug

SEQ ID NO: 965843 - RNA, 17 nt, Homo sapiens
ggcuggcuccugaucca

SEQ ID NO: 965844 - RNA, 11 nt, Homo sapiens
ggcugggcuag

SEQ ID NO: 965845 - RNA, 13 nt, Homo sapiens
ggcugugccaaca

SEQ ID NO: 965846 - RNA, 17 nt, Homo sapiens
ggcuguguuaugaaaau

SEQ ID NO: 965847 - RNA, 17 nt, Homo sapiens
ggcuguuaacccacugc

SEQ ID NO: 965848 - RNA, 20 nt, Homo sapiens
ggcuguugacgcaccugugg

SEQ ID NO: 965849 - RNA, 17 nt, Homo sapiens
ggcuuaaaccuggaauc

SEQ ID NO: 965850 - RNA, 13 nt, Homo sapiens
ggcuucacauuca

SEQ ID NO: 965851 - RNA, 14 nt, Homo sapiens
ggcuucacauucau

SEQ ID NO: 965852 - RNA, 13 nt, Homo sapiens
ggcuugaagccaa

SEQ ID NO: 965853 - RNA, 14 nt, Homo sapiens
gggaaaagggucca

SEQ ID NO: 965854 - RNA, 22 nt, Homo sapiens
gggaaggucagcccagccccuc

SEQ ID NO: 965855 - RNA, 14 nt, Homo sapiens
gggaaguaacagac

SEQ ID NO: 965856 - RNA, 23 nt, Homo sapiens
gggaauacugugcauaagccauu

SEQ ID NO: 965857 - RNA, 21 nt, Homo sapiens
gggaaugagaguuccuucuca

SEQ ID NO: 965858 - RNA, 22 nt, Homo sapiens
gggagaugcuucucuccuugcc

SEQ ID NO: 965859 - RNA, 20 nt, Homo sapiens
gggaggcggagguugcaaug

SEQ ID NO: 965860 - RNA, 23 nt, Homo sapiens
gggaggguggugggcccagacca

SEQ ID NO: 965861 - RNA, 15 nt, Homo sapiens
gggagugugucugcu

SEQ ID NO: 965862 - RNA, 20 nt, Homo sapiens
gggcacuacauaauugcugu

SEQ ID NO: 965863 - RNA, 16 nt, Homo sapiens
gggccauguccaaaga

SEQ ID NO: 965864 - RNA, 14 nt, Homo sapiens
gggccuacacccgu

SEQ ID NO: 965865 - RNA, 22 nt, Homo sapiens
gggccugcugcgucagaccagu

SEQ ID NO: 965866 - RNA, 21 nt, Homo sapiens
gggccugggacuuccaugccu

SEQ ID NO: 965867 - RNA, 16 nt, Homo sapiens
gggcgaguacugggac

SEQ ID NO: 965868 - RNA, 21 nt, Homo sapiens
gggcggcaggaccagccagca

SEQ ID NO: 965869 - RNA, 15 nt, Homo sapiens
gggcuccagccaucu

SEQ ID NO: 965870 - RNA, 17 nt, Homo sapiens
ggggacaagggauuuga

SEQ ID NO: 965871 - RNA, 15 nt, Homo sapiens
ggggacugucuuuca

SEQ ID NO: 965872 - RNA, 16 nt, Homo sapiens
ggggccauuugcaaua

SEQ ID NO: 965873 - RNA, 18 nt, Homo sapiens
ggggccgggcgcgguggc

SEQ ID NO: 965874 - RNA, 16 nt, Homo sapiens
ggggccugaggucauc

SEQ ID NO: 965875 - RNA, 21 nt, Homo sapiens
gggggcggggaguauugaaug

SEQ ID NO: 965876 - RNA, 23 nt, Homo sapiens
gggguaccuuaagagacacucca

SEQ ID NO: 965877 - RNA, 20 nt, Homo sapiens
ggguggacaucaccuuggag

SEQ ID NO: 965878 - RNA, 21 nt, Homo sapiens
ggguggacauucagcagagug

SEQ ID NO: 965879 - RNA, 21 nt, Homo sapiens
ggguuccuccucuccuacucg

SEQ ID NO: 965880 - RNA, 17 nt, Homo sapiens
gguaaaaaguggcugcg

SEQ ID NO: 965881 - RNA, 17 nt, Homo sapiens
gguaaaacucacuguga

SEQ ID NO: 965882 - RNA, 19 nt, Homo sapiens
gguaaaacucacugugauc

SEQ ID NO: 965883 - RNA, 19 nt, Homo sapiens
gguaaagggaggacagcuu

SEQ ID NO: 965884 - RNA, 12 nt, Homo sapiens
gguaaaguauca

SEQ ID NO: 965885 - RNA, 14 nt, Homo sapiens
gguaaauguuaccu

SEQ ID NO: 965886 - RNA, 15 nt, Homo sapiens
gguaaggaaagggcu

SEQ ID NO: 965887 - RNA, 14 nt, Homo sapiens
gguagcgagcugcu

SEQ ID NO: 965888 - RNA, 13 nt, Homo sapiens
gguaguacuggga

SEQ ID NO: 965889 - RNA, 21 nt, Homo sapiens
ggucaagagaguucugaccug

SEQ ID NO: 965890 - RNA, 16 nt, Homo sapiens
ggucaaguaagaagac

SEQ ID NO: 965891 - RNA, 18 nt, Homo sapiens
ggucauuauuuuuuacaa

SEQ ID NO: 965892 - RNA, 13 nt, Homo sapiens
gguccugauccca

SEQ ID NO: 965893 - RNA, 15 nt, Homo sapiens
ggucuguuggggucu

SEQ ID NO: 965894 - RNA, 20 nt, Homo sapiens
ggugaaaaaagccagccaga

SEQ ID NO: 965895 - RNA, 22 nt, Homo sapiens
ggugaaacuaacagauaagcaa

SEQ ID NO: 965896 - RNA, 19 nt, Homo sapiens
ggugaugggcucccucccc

SEQ ID NO: 965897 - RNA, 15 nt, Homo sapiens
ggugcagggacccga

SEQ ID NO: 965898 - RNA, 21 nt, Homo sapiens
ggugcaguuuuccaggaauag

SEQ ID NO: 965899 - RNA, 16 nt, Homo sapiens
ggugcucacgacucuu

SEQ ID NO: 965900 - RNA, 17 nt, Homo sapiens
ggugcuucucagauuuc

SEQ ID NO: 965901 - RNA, 22 nt, Homo sapiens
gguggcccuaaaggacucucca

SEQ ID NO: 965902 - RNA, 17 nt, Homo sapiens
ggugggacccguggcug

SEQ ID NO: 965903 - RNA, 17 nt, Homo sapiens
ggugggacucguggcug

SEQ ID NO: 965904 - RNA, 20 nt, Homo sapiens
ggugggauuccacucgugug

SEQ ID NO: 965905 - RNA, 20 nt, Homo sapiens
ggugguggaaggguagagag

SEQ ID NO: 965906 - RNA, 21 nt, Homo sapiens
ggugguuuuauuucaaaggga

SEQ ID NO: 965907 - RNA, 22 nt, Homo sapiens
ggugguuuuauuucaaagggaa

SEQ ID NO: 965908 - RNA, 11 nt, Homo sapiens
ggugucauauu

SEQ ID NO: 965909 - RNA, 14 nt, Homo sapiens
gguguuuuaugggc

SEQ ID NO: 965910 - RNA, 17 nt, Homo sapiens
gguguuuuaugggccac

SEQ ID NO: 965911 - RNA, 19 nt, Homo sapiens
gguuaaaaaaaaaagucac

SEQ ID NO: 965912 - RNA, 23 nt, Homo sapiens
gguuaaggccagggccucuccaa

SEQ ID NO: 965913 - RNA, 15 nt, Homo sapiens
gguuaaggccugaau

SEQ ID NO: 965914 - RNA, 17 nt, Homo sapiens
gguucucuuagagccau

SEQ ID NO: 965915 - RNA, 14 nt, Homo sapiens
gguuuagauccaau

SEQ ID NO: 965916 - RNA, 15 nt, Homo sapiens
gguuucuggggucca

SEQ ID NO: 965917 - RNA, 14 nt, Homo sapiens
gguuucuucaagag

SEQ ID NO: 965918 - RNA, 13 nt, Homo sapiens
guaaaaagggaau

SEQ ID NO: 965919 - RNA, 12 nt, Homo sapiens
guaaaacagggc

SEQ ID NO: 965920 - RNA, 14 nt, Homo sapiens
guaaaacauuuuua

SEQ ID NO: 965921 - RNA, 19 nt, Homo sapiens
guaaaauguuuaaugguga

SEQ ID NO: 965922 - RNA, 20 nt, Homo sapiens
guaaacuucugcaacaagca

SEQ ID NO: 965923 - RNA, 23 nt, Homo sapiens
guaaaguuuccgugcguggcacu

SEQ ID NO: 965924 - RNA, 20 nt, Homo sapiens
guaacuuauuuuaaauaugc

SEQ ID NO: 965925 - RNA, 14 nt, Homo sapiens
guaagaaggcaaua

SEQ ID NO: 965926 - RNA, 13 nt, Homo sapiens
guaaggagcuaaa

SEQ ID NO: 965927 - RNA, 13 nt, Homo sapiens
guaauaagcaauc

SEQ ID NO: 965928 - RNA, 14 nt, Homo sapiens
guaaugaaauggag

SEQ ID NO: 965929 - RNA, 18 nt, Homo sapiens
guacagaaagcugccugg

SEQ ID NO: 965930 - RNA, 18 nt, Homo sapiens
guacagagaaauucugug

SEQ ID NO: 965931 - RNA, 19 nt, Homo sapiens
guacagcagggucuugcug

SEQ ID NO: 965932 - RNA, 20 nt, Homo sapiens
guacaguauguuuuacaugu

SEQ ID NO: 965933 - RNA, 13 nt, Homo sapiens
guaccgacuuuga

SEQ ID NO: 965934 - RNA, 20 nt, Homo sapiens
guaccuacagagcagccagg

SEQ ID NO: 965935 - RNA, 21 nt, Homo sapiens
guagaaaauaaaacugagcua

SEQ ID NO: 965936 - RNA, 20 nt, Homo sapiens
guagacagguguuacuuaca

SEQ ID NO: 965937 - RNA, 19 nt, Homo sapiens
guagcucuggaccugucuc

SEQ ID NO: 965938 - RNA, 18 nt, Homo sapiens
guagcugggauuacaggc

SEQ ID NO: 965939 - RNA, 13 nt, Homo sapiens
guagguaagggcc

SEQ ID NO: 965940 - RNA, 14 nt, Homo sapiens
guauaaauguacau

SEQ ID NO: 965941 - RNA, 19 nt, Homo sapiens
guauaaugcaguacauuaa

SEQ ID NO: 965942 - RNA, 22 nt, Homo sapiens
guauacuuuaguagacauuuau

SEQ ID NO: 965943 - RNA, 13 nt, Homo sapiens
guauagugucuau

SEQ ID NO: 965944 - RNA, 19 nt, Homo sapiens
guauauauaguagcauuuc

SEQ ID NO: 965945 - RNA, 18 nt, Homo sapiens
guauauuacaaugaucac

SEQ ID NO: 965946 - RNA, 19 nt, Homo sapiens
guauauuuaauuuugacau

SEQ ID NO: 965947 - RNA, 23 nt, Homo sapiens
guauccugcgaccuugcaaccuc

SEQ ID NO: 965948 - RNA, 18 nt, Homo sapiens
guaucuuccaaguacuca

SEQ ID NO: 965949 - RNA, 15 nt, Homo sapiens
guaugcaaucuuaau

SEQ ID NO: 965950 - RNA, 15 nt, Homo sapiens
guauuaaacucuaau

SEQ ID NO: 965951 - RNA, 17 nt, Homo sapiens
guauuuaggcagauuga

SEQ ID NO: 965952 - RNA, 19 nt, Homo sapiens
guauuuccagugcaauugu

SEQ ID NO: 965953 - RNA, 21 nt, Homo sapiens
guauuuucaugaaaauaccau

SEQ ID NO: 965954 - RNA, 16 nt, Homo sapiens
gucaacagcgugcagg

SEQ ID NO: 965955 - RNA, 17 nt, Homo sapiens
gucaacuuauucuuuga

SEQ ID NO: 965956 - RNA, 12 nt, Homo sapiens
gucaaggaauaa

SEQ ID NO: 965957 - RNA, 15 nt, Homo sapiens
gucaauuguaacuaa

SEQ ID NO: 965958 - RNA, 15 nt, Homo sapiens
gucacagaagcagcu

SEQ ID NO: 965959 - RNA, 19 nt, Homo sapiens
gucacagaagcagcuaaac

SEQ ID NO: 965960 - RNA, 13 nt, Homo sapiens
gucacaugaccca

SEQ ID NO: 965961 - RNA, 23 nt, Homo sapiens
gucacauggccuaugcacauaug

SEQ ID NO: 965962 - RNA, 12 nt, Homo sapiens
gucaccagagac

SEQ ID NO: 965963 - RNA, 14 nt, Homo sapiens
gucaccagaucuga

SEQ ID NO: 965964 - RNA, 16 nt, Homo sapiens
gucaccccaagccaua

SEQ ID NO: 965965 - RNA, 10 nt, Homo sapiens
gucacuggaa

SEQ ID NO: 965966 - RNA, 21 nt, Homo sapiens
gucauagacuccuuugcuaau

SEQ ID NO: 965967 - RNA, 16 nt, Homo sapiens
ugccuugcuucuguau

SEQ ID NO: 965968 - RNA, 22 nt, Homo sapiens
ugcggcaaaaggaaagcugugu

SEQ ID NO: 965969 - RNA, 17 nt, Homo sapiens
ugcggugccaugaaggg

SEQ ID NO: 965970 - RNA, 21 nt, Homo sapiens
ugcgucagaccaguacuggga

SEQ ID NO: 965971 - RNA, 16 nt, Homo sapiens
ugcgucgucaccaaau

SEQ ID NO: 965972 - RNA, 16 nt, Homo sapiens
ugcguggacucugcac

SEQ ID NO: 965973 - RNA, 18 nt, Homo sapiens
ugcuaacaaagacaaaag

SEQ ID NO: 965974 - RNA, 17 nt, Homo sapiens
ugcuaccaggaugcuaa

SEQ ID NO: 965975 - RNA, 12 nt, Homo sapiens
ugcuacugcacu

SEQ ID NO: 965976 - RNA, 19 nt, Homo sapiens
ugcuacuggggaaacuggc

SEQ ID NO: 965977 - RNA, 18 nt, Homo sapiens
ugcuagaggaagucccag

SEQ ID NO: 965978 - RNA, 23 nt, Homo sapiens
ugcuaggggagagcucuccuuag

SEQ ID NO: 965979 - RNA, 19 nt, Homo sapiens
ugcuauaauauauaaugaa

SEQ ID NO: 965980 - RNA, 18 nt, Homo sapiens
ugcuauacugcauacuuu

SEQ ID NO: 965981 - RNA, 13 nt, Homo sapiens
ugcucaaagggaa

SEQ ID NO: 965982 - RNA, 16 nt, Homo sapiens
ugcucauauugugauu

SEQ ID NO: 965983 - RNA, 16 nt, Homo sapiens
ugcucauugaacuuua

SEQ ID NO: 965984 - RNA, 18 nt, Homo sapiens
ugcucauugaacuuuaag

SEQ ID NO: 965985 - RNA, 14 nt, Homo sapiens
ugcuccccugugaa

SEQ ID NO: 965986 - RNA, 22 nt, Homo sapiens
ugcucuccucuucuacucacuu

SEQ ID NO: 965987 - RNA, 13 nt, Homo sapiens
ugcucugccaucu

SEQ ID NO: 965988 - RNA, 19 nt, Homo sapiens
ugcucuguccccaaaggac

SEQ ID NO: 965989 - RNA, 22 nt, Homo sapiens
ugcugacaaccauuaaagucag

SEQ ID NO: 965990 - RNA, 19 nt, Homo sapiens
ugcugacaacuuagcucag

SEQ ID NO: 965991 - RNA, 17 nt, Homo sapiens
ugcugcaccuggucaua

SEQ ID NO: 965992 - RNA, 13 nt, Homo sapiens
ugcugcagagaaa

SEQ ID NO: 965993 - RNA, 10 nt, Homo sapiens
ugcugcugaa

SEQ ID NO: 965994 - RNA, 20 nt, Homo sapiens
ugcuggccaaauagcaaaga

SEQ ID NO: 965995 - RNA, 21 nt, Homo sapiens
ugcuggggagacaaaucucag

SEQ ID NO: 965996 - RNA, 16 nt, Homo sapiens
ugcuggugccugccac

SEQ ID NO: 965997 - RNA, 16 nt, Homo sapiens
ugcuguccaggcagcu

SEQ ID NO: 965998 - RNA, 22 nt, Homo sapiens
ugcugugcguggaaugcccuuc

SEQ ID NO: 965999 - RNA, 20 nt, Homo sapiens
ugcuguuuuuuuugcugcua

SEQ ID NO: 966000 - RNA, 20 nt, Homo sapiens
ugcuuaccucucagccuuag

SEQ ID NO: 966001 - RNA, 15 nt, Homo sapiens
ugcuugaacuaggcu

SEQ ID NO: 966002 - RNA, 15 nt, Homo sapiens
ugcuuugugagccag

SEQ ID NO: 966003 - RNA, 20 nt, Homo sapiens
ugcuuuguuaucaaauggac

SEQ ID NO: 966004 - RNA, 15 nt, Homo sapiens
ugcuuuuacuucucu

SEQ ID NO: 966005 - RNA, 23 nt, Homo sapiens
uggaaaaaaacaaaaacagaauu

SEQ ID NO: 966006 - RNA, 15 nt, Homo sapiens
uggaaaaaacucuga

SEQ ID NO: 966007 - RNA, 16 nt, Homo sapiens
uggaaaaaacucugaa

SEQ ID NO: 966008 - RNA, 19 nt, Homo sapiens
uggaaaagaacuguacugu

SEQ ID NO: 966009 - RNA, 14 nt, Homo sapiens
uggaaaaggaagac

SEQ ID NO: 966010 - RNA, 19 nt, Homo sapiens
uggaaaaugccaugaauua

SEQ ID NO: 966011 - RNA, 16 nt, Homo sapiens
uggaaaguaacuguga

SEQ ID NO: 966012 - RNA, 22 nt, Homo sapiens
uggaaauagaaagaagccauau

SEQ ID NO: 966013 - RNA, 21 nt, Homo sapiens
uggaaauuccuguacuguguc

SEQ ID NO: 966014 - RNA, 13 nt, Homo sapiens
uggaacauggacu

SEQ ID NO: 966015 - RNA, 19 nt, Homo sapiens
uggaauacagucauuccaa

SEQ ID NO: 966016 - RNA, 20 nt, Homo sapiens
uggaauauuaaaaaacuuca

SEQ ID NO: 966017 - RNA, 15 nt, Homo sapiens
uggaauugacugccu

SEQ ID NO: 966018 - RNA, 22 nt, Homo sapiens
uggacacggaucugcugggcuc

SEQ ID NO: 966019 - RNA, 10 nt, Homo sapiens
uggacacugu

SEQ ID NO: 966020 - RNA, 19 nt, Homo sapiens
uggacacuuaguuauuuac

SEQ ID NO: 966021 - RNA, 15 nt, Homo sapiens
uggacagcaaggugg

SEQ ID NO: 966022 - RNA, 17 nt, Homo sapiens
uggacaggcagccuccu

SEQ ID NO: 966023 - RNA, 14 nt, Homo sapiens
uggaccaggccauu

SEQ ID NO: 966024 - RNA, 11 nt, Homo sapiens
uggaccugcau

SEQ ID NO: 966025 - RNA, 22 nt, Homo sapiens
uggacguacugguuuaaccucc

SEQ ID NO: 966026 - RNA, 14 nt, Homo sapiens
uggacuaugcugau

SEQ ID NO: 966027 - RNA, 17 nt, Homo sapiens
uggacucugcacauguc

SEQ ID NO: 966028 - RNA, 19 nt, Homo sapiens
uggagacccugccacagcc

SEQ ID NO: 966029 - RNA, 23 nt, Homo sapiens
uggagacccugccacagccagag

SEQ ID NO: 966030 - RNA, 20 nt, Homo sapiens
uggagaccguccuggagcug

SEQ ID NO: 966031 - RNA, 23 nt, Homo sapiens
uggagauuuaucucuguuuccuu

SEQ ID NO: 966032 - RNA, 21 nt, Homo sapiens
uggagcuaauggcgaucaucu

SEQ ID NO: 966033 - RNA, 20 nt, Homo sapiens
uggaggaccagauugcucug

SEQ ID NO: 966034 - RNA, 19 nt, Homo sapiens
uggaggaggaaggcaagag

SEQ ID NO: 966035 - RNA, 11 nt, Homo sapiens
uggaggcuucc

SEQ ID NO: 966036 - RNA, 16 nt, Homo sapiens
uggaggugcugcucua

SEQ ID NO: 966037 - RNA, 20 nt, Homo sapiens
uggaggugggcaaagggaag

SEQ ID NO: 966038 - RNA, 18 nt, Homo sapiens
uggagugcaguggcauga

SEQ ID NO: 966039 - RNA, 12 nt, Homo sapiens
uggaguugacug

SEQ ID NO: 966040 - RNA, 16 nt, Homo sapiens
uggaguugacugcuca

SEQ ID NO: 966041 - RNA, 15 nt, Homo sapiens
uggaguuucucuguu

SEQ ID NO: 966042 - RNA, 21 nt, Homo sapiens
uggaugacccuccccuaguca

SEQ ID NO: 966043 - RNA, 16 nt, Homo sapiens
uggauggcaccucagg

SEQ ID NO: 966044 - RNA, 16 nt, Homo sapiens
uggaugucacugccug

SEQ ID NO: 966045 - RNA, 13 nt, Homo sapiens
uggcaaacccucc

SEQ ID NO: 966046 - RNA, 20 nt, Homo sapiens
uggcacagaagcucaucuca

SEQ ID NO: 966047 - RNA, 22 nt, Homo sapiens
uggcacauggguggacacggau

SEQ ID NO: 966048 - RNA, 17 nt, Homo sapiens
uggcaccaggcgcugcc

SEQ ID NO: 966049 - RNA, 21 nt, Homo sapiens
uggcagcaucuucacuucuaa

SEQ ID NO: 966050 - RNA, 17 nt, Homo sapiens
uggcauauauguucaaa

SEQ ID NO: 966051 - RNA, 21 nt, Homo sapiens
uggcauauauguucaaauuca

SEQ ID NO: 966052 - RNA, 15 nt, Homo sapiens
uggcauaugguccua

SEQ ID NO: 966053 - RNA, 21 nt, Homo sapiens
uggcauccaagacucuuuaug

SEQ ID NO: 966054 - RNA, 22 nt, Homo sapiens
uggcauccaagacucuuuauga

SEQ ID NO: 966055 - RNA, 12 nt, Homo sapiens
uggccaagcaga

SEQ ID NO: 966056 - RNA, 20 nt, Homo sapiens
uggccacaguaauuggucau

SEQ ID NO: 966057 - RNA, 19 nt, Homo sapiens
uggccagacuggucuugaa

SEQ ID NO: 966058 - RNA, 17 nt, Homo sapiens
uggccauuaccaucucu

SEQ ID NO: 966059 - RNA, 22 nt, Homo sapiens
uggcccauggcuguugguggga

SEQ ID NO: 966060 - RNA, 16 nt, Homo sapiens
uggccccacuuugaag

SEQ ID NO: 966061 - RNA, 20 nt, Homo sapiens
uggcccccucaguguuguca

SEQ ID NO: 966062 - RNA, 23 nt, Homo sapiens
uggcccuuaauuauuaacaaagu

SEQ ID NO: 966063 - RNA, 19 nt, Homo sapiens
uggcccuugcuuaccucuc

SEQ ID NO: 966064 - RNA, 16 nt, Homo sapiens
uggccuauccgcugcc

SEQ ID NO: 966065 - RNA, 16 nt, Homo sapiens
uggccuaugcacauau

SEQ ID NO: 966066 - RNA, 18 nt, Homo sapiens
uggccuaugcacauaugg

SEQ ID NO: 966067 - RNA, 21 nt, Homo sapiens
uggccugcugugauuccacua

SEQ ID NO: 966068 - RNA, 20 nt, Homo sapiens
uggccuggacaguaucccac

SEQ ID NO: 966069 - RNA, 12 nt, Homo sapiens
uggccuggcaca

SEQ ID NO: 966070 - RNA, 15 nt, Homo sapiens
uggccuuuaucucaa

SEQ ID NO: 966071 - RNA, 22 nt, Homo sapiens
uggcgccccuuccuaggucaug

SEQ ID NO: 966072 - RNA, 22 nt, Homo sapiens
uggcggcugugcaucaguggga

SEQ ID NO: 966073 - RNA, 16 nt, Homo sapiens
uggcgggcaccuguag

SEQ ID NO: 966074 - RNA, 15 nt, Homo sapiens
uggcucaagucugca

SEQ ID NO: 966075 - RNA, 22 nt, Homo sapiens
uggcuccaggccaaagugccgg

SEQ ID NO: 966076 - RNA, 14 nt, Homo sapiens
uggcucuaucuucc

SEQ ID NO: 966077 - RNA, 18 nt, Homo sapiens
uggcuggcucuaccuucc

SEQ ID NO: 966078 - RNA, 20 nt, Homo sapiens
uggcugucaaugggaccugu

SEQ ID NO: 966079 - RNA, 15 nt, Homo sapiens
uggcugugaaauuca

SEQ ID NO: 966080 - RNA, 17 nt, Homo sapiens
uggcuuaaaccagaacc

SEQ ID NO: 966081 - RNA, 18 nt, Homo sapiens
gucauauauaucacccag

SEQ ID NO: 966082 - RNA, 21 nt, Homo sapiens
gucaugacggggacagaguga

SEQ ID NO: 966083 - RNA, 16 nt, Homo sapiens
gucaugcuuuugcuau

SEQ ID NO: 966084 - RNA, 23 nt, Homo sapiens
gucauuaauggcauaugguccua

SEQ ID NO: 966085 - RNA, 14 nt, Homo sapiens
gucauucauucaag

SEQ ID NO: 966086 - RNA, 16 nt, Homo sapiens
guccaaguccaaccug

SEQ ID NO: 966087 - RNA, 16 nt, Homo sapiens
guccacccugccugcc

SEQ ID NO: 966088 - RNA, 11 nt, Homo sapiens
guccauucucu

SEQ ID NO: 966089 - RNA, 13 nt, Homo sapiens
gucccucccugcc

SEQ ID NO: 966090 - RNA, 23 nt, Homo sapiens
gucccuguuuauuccaaaugcca

SEQ ID NO: 966091 - RNA, 17 nt, Homo sapiens
guccggaaugccaccca

SEQ ID NO: 966092 - RNA, 13 nt, Homo sapiens
guccugacacuga

SEQ ID NO: 966093 - RNA, 19 nt, Homo sapiens
guccuggaaaucgagguga

SEQ ID NO: 966094 - RNA, 21 nt, Homo sapiens
guccuugugaguccaucuaac

SEQ ID NO: 966095 - RNA, 20 nt, Homo sapiens
gucuacaaacugaacacugc

SEQ ID NO: 966096 - RNA, 21 nt, Homo sapiens
gucuacaaacugaacacugca

SEQ ID NO: 966097 - RNA, 15 nt, Homo sapiens
gucucauuugggcua

SEQ ID NO: 966098 - RNA, 18 nt, Homo sapiens
gucuccaucucugucuca

SEQ ID NO: 966099 - RNA, 18 nt, Homo sapiens
gucucucuucucagagug

SEQ ID NO: 966100 - RNA, 21 nt, Homo sapiens
gucugaguaagcccucaggag

SEQ ID NO: 966101 - RNA, 19 nt, Homo sapiens
gucugccccacccucaaac

SEQ ID NO: 966102 - RNA, 14 nt, Homo sapiens
gucuuauccuccac

SEQ ID NO: 966103 - RNA, 18 nt, Homo sapiens
gucuuccaauuaaugcuu

SEQ ID NO: 966104 - RNA, 11 nt, Homo sapiens
gucuugccagg

SEQ ID NO: 966105 - RNA, 19 nt, Homo sapiens
gucuuggaaaaaaaccaca

SEQ ID NO: 966106 - RNA, 18 nt, Homo sapiens
gucuuggacacuguacaa

SEQ ID NO: 966107 - RNA, 17 nt, Homo sapiens
gucuuguguauuugucu

SEQ ID NO: 966108 - RNA, 17 nt, Homo sapiens
gucuuguugauuuccuc

SEQ ID NO: 966109 - RNA, 21 nt, Homo sapiens
gugaaaaaucuuaaguaccaa

SEQ ID NO: 966110 - RNA, 13 nt, Homo sapiens
gugaaacauacaa

SEQ ID NO: 966111 - RNA, 15 nt, Homo sapiens
gugaaaggcucagua

SEQ ID NO: 966112 - RNA, 16 nt, Homo sapiens
gugaagugaaucugau

SEQ ID NO: 966113 - RNA, 18 nt, Homo sapiens
gugaauuauugacacuga

SEQ ID NO: 966114 - RNA, 13 nt, Homo sapiens
gugacacauaugc

SEQ ID NO: 966115 - RNA, 18 nt, Homo sapiens
gugacagcuuucugggau

SEQ ID NO: 966116 - RNA, 14 nt, Homo sapiens
gugaggccugcaca

SEQ ID NO: 966117 - RNA, 22 nt, Homo sapiens
gugaggccugcacagcuaagug

SEQ ID NO: 966118 - RNA, 21 nt, Homo sapiens
gugauauuuucacacugguaa

SEQ ID NO: 966119 - RNA, 16 nt, Homo sapiens
gugauucuguuugccu

SEQ ID NO: 966120 - RNA, 17 nt, Homo sapiens
gugcacauuucuuugca

SEQ ID NO: 966121 - RNA, 22 nt, Homo sapiens
gugcacauuucuuugcauucca

SEQ ID NO: 966122 - RNA, 13 nt, Homo sapiens
gugccguggcacc

SEQ ID NO: 966123 - RNA, 20 nt, Homo sapiens
gugcugagugagcuggugac

SEQ ID NO: 966124 - RNA, 15 nt, Homo sapiens
gugcuguugggauau

SEQ ID NO: 966125 - RNA, 15 nt, Homo sapiens
gugcuucacaguaga

SEQ ID NO: 966126 - RNA, 16 nt, Homo sapiens
gugcuugcuggugccu

SEQ ID NO: 966127 - RNA, 19 nt, Homo sapiens
gugcuuggucuguuugacu

SEQ ID NO: 966128 - RNA, 23 nt, Homo sapiens
guggagacccugccacagccaga

SEQ ID NO: 966129 - RNA, 16 nt, Homo sapiens
guggagcugcuggugu

SEQ ID NO: 966130 - RNA, 13 nt, Homo sapiens
guggaggcuuccu

SEQ ID NO: 966131 - RNA, 12 nt, Homo sapiens
guggaugacccu

SEQ ID NO: 966132 - RNA, 14 nt, Homo sapiens
guggccuguggcug

SEQ ID NO: 966133 - RNA, 21 nt, Homo sapiens
gugggauggcauuuggucuca

SEQ ID NO: 966134 - RNA, 20 nt, Homo sapiens
gugggauggggacauuugaa

SEQ ID NO: 966135 - RNA, 21 nt, Homo sapiens
gugggcucugugcagucacug

SEQ ID NO: 966136 - RNA, 23 nt, Homo sapiens
gugguagaagccaguacagagaa

SEQ ID NO: 966137 - RNA, 16 nt, Homo sapiens
gugguaugucugccau

SEQ ID NO: 966138 - RNA, 13 nt, Homo sapiens
guggucgguggga

SEQ ID NO: 966139 - RNA, 14 nt, Homo sapiens
guguagccugugca

SEQ ID NO: 966140 - RNA, 16 nt, Homo sapiens
gugucaggcaugaaga

SEQ ID NO: 966141 - RNA, 20 nt, Homo sapiens
guguccgugaaaguugugau

SEQ ID NO: 966142 - RNA, 10 nt, Homo sapiens
gugucuccca

SEQ ID NO: 966143 - RNA, 17 nt, Homo sapiens
gugucugccaaacacau

SEQ ID NO: 966144 - RNA, 15 nt, Homo sapiens
guguguucucaguga

SEQ ID NO: 966145 - RNA, 22 nt, Homo sapiens
guguuccauugccauagcugac

SEQ ID NO: 966146 - RNA, 15 nt, Homo sapiens
guguucucagugaaa

SEQ ID NO: 966147 - RNA, 14 nt, Homo sapiens
guguuuauugcaau

SEQ ID NO: 966148 - RNA, 17 nt, Homo sapiens
guuaaauuuuacaugac

SEQ ID NO: 966149 - RNA, 24 nt, Homo sapiens
guuaauauuuauuaagugacuaua

SEQ ID NO: 966150 - RNA, 22 nt, Homo sapiens
guuaaugcuuuucccacucuca

SEQ ID NO: 966151 - RNA, 14 nt, Homo sapiens
guuaauguacaaaa

SEQ ID NO: 966152 - RNA, 15 nt, Homo sapiens
guuaccuacuuugac

SEQ ID NO: 966153 - RNA, 12 nt, Homo sapiens
guuacgugaaga

SEQ ID NO: 966154 - RNA, 19 nt, Homo sapiens
guuacuuaauugccagcaa

SEQ ID NO: 966155 - RNA, 16 nt, Homo sapiens
guuagaacuagccaaa

SEQ ID NO: 966156 - RNA, 12 nt, Homo sapiens
guuaucugcuag

SEQ ID NO: 966157 - RNA, 17 nt, Homo sapiens
guuaugcaucauuucag

SEQ ID NO: 966158 - RNA, 23 nt, Homo sapiens
guuauuugaaaauuugauuuuga

SEQ ID NO: 966159 - RNA, 22 nt, Homo sapiens
guucaaauucaaaccauuuuua

SEQ ID NO: 966160 - RNA, 20 nt, Homo sapiens
guucaauaaagcacugagca

SEQ ID NO: 966161 - RNA, 18 nt, Homo sapiens
guucaggcagcacaucaa

SEQ ID NO: 966162 - RNA, 15 nt, Homo sapiens
guuccagauguggau

SEQ ID NO: 966163 - RNA, 19 nt, Homo sapiens
guucccccuaaacauggcu

SEQ ID NO: 966164 - RNA, 15 nt, Homo sapiens
guuccgccacuccag

SEQ ID NO: 966165 - RNA, 16 nt, Homo sapiens
guuccgccacuccagu

SEQ ID NO: 966166 - RNA, 23 nt, Homo sapiens
guuccguccaaguugcugcaaaa

SEQ ID NO: 966167 - RNA, 21 nt, Homo sapiens
guuccuaagccuguugcugaa

SEQ ID NO: 966168 - RNA, 18 nt, Homo sapiens
guuccucuuggugucaua

SEQ ID NO: 966169 - RNA, 15 nt, Homo sapiens
guuccuggugacucc

SEQ ID NO: 966170 - RNA, 16 nt, Homo sapiens
guuccuggugacuccu

SEQ ID NO: 966171 - RNA, 22 nt, Homo sapiens
guuccuuccaggugauucuguu

SEQ ID NO: 966172 - RNA, 22 nt, Homo sapiens
guucuacugagaaaagccucuc

SEQ ID NO: 966173 - RNA, 13 nt, Homo sapiens
guucucacuggga

SEQ ID NO: 966174 - RNA, 15 nt, Homo sapiens
guucugcccauggga

SEQ ID NO: 966175 - RNA, 18 nt, Homo sapiens
guucuucaccuccugcca

SEQ ID NO: 966176 - RNA, 13 nt, Homo sapiens
guucuugggauac

SEQ ID NO: 966177 - RNA, 14 nt, Homo sapiens
guugaacacuugaa

SEQ ID NO: 966178 - RNA, 15 nt, Homo sapiens
guugacuuuacccau

SEQ ID NO: 966179 - RNA, 21 nt, Homo sapiens
guugaguuaugauaacaccag

SEQ ID NO: 966180 - RNA, 20 nt, Homo sapiens
guugcaauaucuacauucua

SEQ ID NO: 966181 - RNA, 18 nt, Homo sapiens
guugcugcuguccagugc

SEQ ID NO: 966182 - RNA, 16 nt, Homo sapiens
guugcuuuuacuucuc

SEQ ID NO: 966183 - RNA, 16 nt, Homo sapiens
guuggaaaguaacugu

SEQ ID NO: 966184 - RNA, 18 nt, Homo sapiens
guuggucagucuacaaac

SEQ ID NO: 966185 - RNA, 14 nt, Homo sapiens
guuguagcauuuaa

SEQ ID NO: 966186 - RNA, 18 nt, Homo sapiens
guuuaauggguaugcuca

SEQ ID NO: 966187 - RNA, 22 nt, Homo sapiens
guuuacaauaggaguggugauu

SEQ ID NO: 966188 - RNA, 13 nt, Homo sapiens
guuuagcucugag

SEQ ID NO: 966189 - RNA, 13 nt, Homo sapiens
guuuaucauuuac

SEQ ID NO: 966190 - RNA, 21 nt, Homo sapiens
guuucaugggccccuucaaac

SEQ ID NO: 966191 - RNA, 18 nt, Homo sapiens
guuuccaugguuaccuga

SEQ ID NO: 966192 - RNA, 23 nt, Homo sapiens
guuucugaaaagaugguaucaua

SEQ ID NO: 966193 - RNA, 13 nt, Homo sapiens
guuucugucaagc

SEQ ID NO: 966194 - RNA, 17 nt, Homo sapiens
guuugaaucuacauuca

SEQ ID NO: 966195 - RNA, 23 nt, Homo sapiens
guuugaaucuacauucacuuuuu

SEQ ID NO: 966196 - RNA, 22 nt, Homo sapiens
ucccauuucaauuccugugauu

SEQ ID NO: 966197 - RNA, 19 nt, Homo sapiens
uccccaaggacucuuccac

SEQ ID NO: 966198 - RNA, 14 nt, Homo sapiens
uccccacaucccau

SEQ ID NO: 966199 - RNA, 16 nt, Homo sapiens
uccccacccagucuca

SEQ ID NO: 966200 - RNA, 19 nt, Homo sapiens
uccccacccauaccacagc

SEQ ID NO: 966201 - RNA, 23 nt, Homo sapiens
uccccagccuccccgugccaaaa

SEQ ID NO: 966202 - RNA, 19 nt, Homo sapiens
ucccccaccgguccagcug

SEQ ID NO: 966203 - RNA, 22 nt, Homo sapiens
ucccccuaaacauggcuguuaa

SEQ ID NO: 966204 - RNA, 21 nt, Homo sapiens
ucccccucaauagaucuccag

SEQ ID NO: 966205 - RNA, 14 nt, Homo sapiens
uccccgugccaaaa

SEQ ID NO: 966206 - RNA, 21 nt, Homo sapiens
uccccgugccaaaaaucuuuu

SEQ ID NO: 966207 - RNA, 16 nt, Homo sapiens
uccccuagucacucau

SEQ ID NO: 966208 - RNA, 16 nt, Homo sapiens
uccccucucagaacau

SEQ ID NO: 966209 - RNA, 17 nt, Homo sapiens
uccccugcuacaccuau

SEQ ID NO: 966210 - RNA, 13 nt, Homo sapiens
ucccuccaccuca

SEQ ID NO: 966211 - RNA, 13 nt, Homo sapiens
ucccucugcagaa

SEQ ID NO: 966212 - RNA, 20 nt, Homo sapiens
ucccugaggaccaccuccua

SEQ ID NO: 966213 - RNA, 15 nt, Homo sapiens
ucccugcagaugcca

SEQ ID NO: 966214 - RNA, 18 nt, Homo sapiens
ucccuggaaaaggagcuu

SEQ ID NO: 966215 - RNA, 20 nt, Homo sapiens
ucccuugggcucugaugaaa

SEQ ID NO: 966216 - RNA, 13 nt, Homo sapiens
uccgccauuccaa

SEQ ID NO: 966217 - RNA, 17 nt, Homo sapiens
uccuaagcaacuaggcc

SEQ ID NO: 966218 - RNA, 23 nt, Homo sapiens
uccuaagccuguugcugaaguca

SEQ ID NO: 966219 - RNA, 12 nt, Homo sapiens
uccuaaggcaug

SEQ ID NO: 966220 - RNA, 13 nt, Homo sapiens
uccuacacuugag

SEQ ID NO: 966221 - RNA, 14 nt, Homo sapiens
uccuaccagcaaag

SEQ ID NO: 966222 - RNA, 14 nt, Homo sapiens
uccuacccuuccag

SEQ ID NO: 966223 - RNA, 20 nt, Homo sapiens
uccuacuggucucucuaugc

SEQ ID NO: 966224 - RNA, 19 nt, Homo sapiens
uccuagcucucccagugaa

SEQ ID NO: 966225 - RNA, 19 nt, Homo sapiens
uccuaggaggaaaauucca

SEQ ID NO: 966226 - RNA, 15 nt, Homo sapiens
uccuaggucaugccu

SEQ ID NO: 966227 - RNA, 21 nt, Homo sapiens
uccuauccuuggagagcagcu

SEQ ID NO: 966228 - RNA, 18 nt, Homo sapiens
uccuauuguucacuuuau

SEQ ID NO: 966229 - RNA, 13 nt, Homo sapiens
uccucacucuuca

SEQ ID NO: 966230 - RNA, 20 nt, Homo sapiens
uccucagguaguacugggaa

SEQ ID NO: 966231 - RNA, 21 nt, Homo sapiens
uccucaggugauuuguaugcu

SEQ ID NO: 966232 - RNA, 13 nt, Homo sapiens
uccuccacuccac

SEQ ID NO: 966233 - RNA, 22 nt, Homo sapiens
uccuccagcccagacccagugg

SEQ ID NO: 966234 - RNA, 17 nt, Homo sapiens
uccuccguccauaucag

SEQ ID NO: 966235 - RNA, 19 nt, Homo sapiens
uccuccugcuucaugggaa

SEQ ID NO: 966236 - RNA, 14 nt, Homo sapiens
uccucgcagccucu

SEQ ID NO: 966237 - RNA, 14 nt, Homo sapiens
uccucggacaccaa

SEQ ID NO: 966238 - RNA, 15 nt, Homo sapiens
uccucgguucaaggu

SEQ ID NO: 966239 - RNA, 14 nt, Homo sapiens
uccucucugcacac

SEQ ID NO: 966240 - RNA, 16 nt, Homo sapiens
uccucuuggugucaua

SEQ ID NO: 966241 - RNA, 14 nt, Homo sapiens
uccugaaagcuuac

SEQ ID NO: 966242 - RNA, 19 nt, Homo sapiens
uccugaauccaaacuaauc

SEQ ID NO: 966243 - RNA, 15 nt, Homo sapiens
uccugacacuuuaau

SEQ ID NO: 966244 - RNA, 19 nt, Homo sapiens
uccugacagaaggugccac

SEQ ID NO: 966245 - RNA, 20 nt, Homo sapiens
uccugaguuacuucccuuag

SEQ ID NO: 966246 - RNA, 13 nt, Homo sapiens
uccuggaggacca

SEQ ID NO: 966247 - RNA, 22 nt, Homo sapiens
uccuggcacaguuuuuguaaag

SEQ ID NO: 966248 - RNA, 18 nt, Homo sapiens
uccuggcaugacacucua

SEQ ID NO: 966249 - RNA, 22 nt, Homo sapiens
uccugggcucaagcaauccucc

SEQ ID NO: 966250 - RNA, 14 nt, Homo sapiens
uccugggggaccuu

SEQ ID NO: 966251 - RNA, 17 nt, Homo sapiens
uccuggucccuuuuuga

SEQ ID NO: 966252 - RNA, 16 nt, Homo sapiens
uccuguauuccugacc

SEQ ID NO: 966253 - RNA, 16 nt, Homo sapiens
uccugugaaaauauga

SEQ ID NO: 966254 - RNA, 15 nt, Homo sapiens
uccuguguaugcuga

SEQ ID NO: 966255 - RNA, 19 nt, Homo sapiens
uccuguuagcauaauguga

SEQ ID NO: 966256 - RNA, 21 nt, Homo sapiens
uccuguuuuucacauuuuccu

SEQ ID NO: 966257 - RNA, 16 nt, Homo sapiens
uccuuagcauucauaa

SEQ ID NO: 966258 - RNA, 14 nt, Homo sapiens
uccuucaaacaaug

SEQ ID NO: 966259 - RNA, 21 nt, Homo sapiens
uccuucaccccuauggugcuc

SEQ ID NO: 966260 - RNA, 18 nt, Homo sapiens
uccuucuguauucauaag

SEQ ID NO: 966261 - RNA, 13 nt, Homo sapiens
uccuucuuugaua

SEQ ID NO: 966262 - RNA, 14 nt, Homo sapiens
uccuugcgccucag

SEQ ID NO: 966263 - RNA, 23 nt, Homo sapiens
uccuugugcaaaauauuugacua

SEQ ID NO: 966264 - RNA, 13 nt, Homo sapiens
uccuuuaugaucc

SEQ ID NO: 966265 - RNA, 22 nt, Homo sapiens
uccuuuccauaaauccuugaug

SEQ ID NO: 966266 - RNA, 20 nt, Homo sapiens
uccuuuuaaaaaccuagguc

SEQ ID NO: 966267 - RNA, 14 nt, Homo sapiens
uccuuuucuucacc

SEQ ID NO: 966268 - RNA, 16 nt, Homo sapiens
uccuuuuucacuuuga

SEQ ID NO: 966269 - RNA, 16 nt, Homo sapiens
uccuuuuugacacuga

SEQ ID NO: 966270 - RNA, 18 nt, Homo sapiens
ucgagaccauccuggcua

SEQ ID NO: 966271 - RNA, 16 nt, Homo sapiens
ucgagcaaaauucaaa

SEQ ID NO: 966272 - RNA, 18 nt, Homo sapiens
ucgaggugaaaggcucag

SEQ ID NO: 966273 - RNA, 18 nt, Homo sapiens
ucgauuuucuauuaugga

SEQ ID NO: 966274 - RNA, 15 nt, Homo sapiens
ucgcacuacaucuga

SEQ ID NO: 966275 - RNA, 22 nt, Homo sapiens
ucgcacugcccacaugggaccu

SEQ ID NO: 966276 - RNA, 22 nt, Homo sapiens
ucgccaccacuuccagagccag

SEQ ID NO: 966277 - RNA, 20 nt, Homo sapiens
ucgccaugaucagacauaca

SEQ ID NO: 966278 - RNA, 21 nt, Homo sapiens
ucgcccaggcuggagugcagu

SEQ ID NO: 966279 - RNA, 14 nt, Homo sapiens
ucgcugccaucacc

SEQ ID NO: 966280 - RNA, 18 nt, Homo sapiens
ucggauacacacucgaau

SEQ ID NO: 966281 - RNA, 22 nt, Homo sapiens
ucggaucucacaggcugagaac

SEQ ID NO: 966282 - RNA, 16 nt, Homo sapiens
ucgggagccaugucau

SEQ ID NO: 966283 - RNA, 12 nt, Homo sapiens
ucggugggaccc

SEQ ID NO: 966284 - RNA, 22 nt, Homo sapiens
ucggugggacucguggcuguca

SEQ ID NO: 966285 - RNA, 18 nt, Homo sapiens
ucgugacaagugccuuca

SEQ ID NO: 966286 - RNA, 13 nt, Homo sapiens
ucuaaaagcuuuc

SEQ ID NO: 966287 - RNA, 14 nt, Homo sapiens
ucuaaauacaggaa

SEQ ID NO: 966288 - RNA, 20 nt, Homo sapiens
ucuaagcauauucaaaaggg

SEQ ID NO: 966289 - RNA, 14 nt, Homo sapiens
ucuaaggagagcuc

SEQ ID NO: 966290 - RNA, 22 nt, Homo sapiens
ucuacugcuuuggauccugggu

SEQ ID NO: 966291 - RNA, 17 nt, Homo sapiens
ucuagcacacucuucuc

SEQ ID NO: 966292 - RNA, 15 nt, Homo sapiens
ucuaggacugcagug

SEQ ID NO: 966293 - RNA, 16 nt, Homo sapiens
ucuaggagaugcuuuc

SEQ ID NO: 966294 - RNA, 17 nt, Homo sapiens
ucuaggcuaagcacuuu

SEQ ID NO: 966295 - RNA, 20 nt, Homo sapiens
ucuauaaaaauacuacaaua

SEQ ID NO: 966296 - RNA, 20 nt, Homo sapiens
ucuaugaacuuagaguuuac

SEQ ID NO: 966297 - RNA, 12 nt, Homo sapiens
ucuauuaaucaa

SEQ ID NO: 966298 - RNA, 12 nt, Homo sapiens
ucuauucuagcc

SEQ ID NO: 966299 - RNA, 22 nt, Homo sapiens
ucuauuuggggcuugaugacuu

SEQ ID NO: 966300 - RNA, 22 nt, Homo sapiens
ucucaaauucauggugcacuga

SEQ ID NO: 966301 - RNA, 19 nt, Homo sapiens
ucucaagcuaguguuucua

SEQ ID NO: 966302 - RNA, 15 nt, Homo sapiens
ucucagaagcacaga

SEQ ID NO: 966303 - RNA, 17 nt, Homo sapiens
ucucagauuuccacaga

SEQ ID NO: 966304 - RNA, 22 nt, Homo sapiens
ucucaggggaaggauuugcauu

SEQ ID NO: 966305 - RNA, 19 nt, Homo sapiens
ucuccaggacaaccugcug

SEQ ID NO: 966306 - RNA, 13 nt, Homo sapiens
ucuccaguggauu

SEQ ID NO: 966307 - RNA, 14 nt, Homo sapiens
ucuccaguggauuc

SEQ ID NO: 966308 - RNA, 15 nt, Homo sapiens
ucucccagccaaguc

SEQ ID NO: 966309 - RNA, 18 nt, Homo sapiens
ucucccuugggcucugau

SEQ ID NO: 966310 - RNA, 22 nt, Homo sapiens
ucuccuuuaauauacuccuuaa

SEQ ID NO: 966311 - RNA, 20 nt, Homo sapiens
ucucggcuuauggcaaccuc

SEQ ID NO: 966312 - RNA, 12 nt, Homo sapiens
ucucuacugcuu

SEQ ID NO: 966313 - RNA, 22 nt, Homo sapiens
ucucuagcacaauuugcacuaa

SEQ ID NO: 966314 - RNA, 17 nt, Homo sapiens
ucucucaggcucucuga

SEQ ID NO: 966315 - RNA, 16 nt, Homo sapiens
ucucucaguucuacac

SEQ ID NO: 966316 - RNA, 19 nt, Homo sapiens
ucucuccacugugcuuuca

SEQ ID NO: 966317 - RNA, 14 nt, Homo sapiens
ucucuccagccuga

SEQ ID NO: 966318 - RNA, 23 nt, Homo sapiens
ucucuccccauccccacccaguc

SEQ ID NO: 966319 - RNA, 13 nt, Homo sapiens
ucucugucucaaa

SEQ ID NO: 966320 - RNA, 15 nt, Homo sapiens
ucucuuagcaacuca

SEQ ID NO: 966321 - RNA, 19 nt, Homo sapiens
ucucuugccauuuguagcu

SEQ ID NO: 966322 - RNA, 14 nt, Homo sapiens
ucucuuucugcaaa

SEQ ID NO: 966323 - RNA, 16 nt, Homo sapiens
ucugaagaauccugua

SEQ ID NO: 966324 - RNA, 23 nt, Homo sapiens
ucugaagaauccuguaagccccu

SEQ ID NO: 966325 - RNA, 14 nt, Homo sapiens
ucugaauugcacau

SEQ ID NO: 966326 - RNA, 21 nt, Homo sapiens
ucugaauugcacaugugagca

SEQ ID NO: 966327 - RNA, 15 nt, Homo sapiens
ucugagcuauuucau

SEQ ID NO: 966328 - RNA, 17 nt, Homo sapiens
ucugaggugcacuggga

SEQ ID NO: 966329 - RNA, 19 nt, Homo sapiens
ucugaguaagcccucagga

SEQ ID NO: 966330 - RNA, 19 nt, Homo sapiens
ucugauugcagcacagagc

SEQ ID NO: 966331 - RNA, 22 nt, Homo sapiens
ucugauuuguaacccacugaga

SEQ ID NO: 966332 - RNA, 20 nt, Homo sapiens
ucugcaaaaggccucuugua

SEQ ID NO: 966333 - RNA, 14 nt, Homo sapiens
ucugcccucauaga

SEQ ID NO: 966334 - RNA, 22 nt, Homo sapiens
ucugcuguuuuuuuugcugcua

SEQ ID NO: 966335 - RNA, 23 nt, Homo sapiens
ucugcuguuuuuuuugcugcuaa

SEQ ID NO: 966336 - RNA, 22 nt, Homo sapiens
ucuggaaagaggcucuggacag

SEQ ID NO: 966337 - RNA, 13 nt, Homo sapiens
ucuggaaccuuau

SEQ ID NO: 966338 - RNA, 18 nt, Homo sapiens
ucuggauccagccaugcc

SEQ ID NO: 966339 - RNA, 18 nt, Homo sapiens
ucuggcaucuuagaccuc

SEQ ID NO: 966340 - RNA, 23 nt, Homo sapiens
ucugggaguuauaggucauggga

SEQ ID NO: 966341 - RNA, 15 nt, Homo sapiens
ucugggcagcuccug

SEQ ID NO: 966342 - RNA, 17 nt, Homo sapiens
ucuggggggauauuucc

SEQ ID NO: 966343 - RNA, 23 nt, Homo sapiens
ucugggguccauucucugaguca

SEQ ID NO: 966344 - RNA, 16 nt, Homo sapiens
ucuggucccagcaucc

SEQ ID NO: 966345 - RNA, 18 nt, Homo sapiens
ucugugcagucacuggag

SEQ ID NO: 966346 - RNA, 19 nt, Homo sapiens
ucuguuaacaucuagccua

SEQ ID NO: 966347 - RNA, 12 nt, Homo sapiens
ucuguuugaaac

SEQ ID NO: 966348 - RNA, 14 nt, Homo sapiens
ucuuaaaacaaauu

SEQ ID NO: 966349 - RNA, 14 nt, Homo sapiens
ucuuaaguggucua

SEQ ID NO: 966350 - RNA, 16 nt, Homo sapiens
ucuuaauccugaaugu

SEQ ID NO: 966351 - RNA, 14 nt, Homo sapiens
ucuuacaugcauuu

SEQ ID NO: 966352 - RNA, 14 nt, Homo sapiens
ucuuauuaaucaua

SEQ ID NO: 966353 - RNA, 18 nt, Homo sapiens
ucuucacuucuaaaugca

SEQ ID NO: 966354 - RNA, 21 nt, Homo sapiens
ucuucacuucuaaaugcauau

SEQ ID NO: 966355 - RNA, 14 nt, Homo sapiens
ucuucaggcccagc

SEQ ID NO: 966356 - RNA, 17 nt, Homo sapiens
ucuuccaacaugugaug

SEQ ID NO: 966357 - RNA, 14 nt, Homo sapiens
ucuucccaucuguu

SEQ ID NO: 966358 - RNA, 14 nt, Homo sapiens
ucuucccaugcauu

SEQ ID NO: 966359 - RNA, 15 nt, Homo sapiens
ucuucccccaccacc

SEQ ID NO: 966360 - RNA, 22 nt, Homo sapiens
ucuuccuacuggucucucuaug

SEQ ID NO: 966361 - RNA, 14 nt, Homo sapiens
ucuuccugacacuu

SEQ ID NO: 966362 - RNA, 18 nt, Homo sapiens
ucuucuuuaagccauaga

SEQ ID NO: 966363 - RNA, 13 nt, Homo sapiens
ucuugaauagucu

SEQ ID NO: 966364 - RNA, 15 nt, Homo sapiens
ucuugaauagucuca

SEQ ID NO: 966365 - RNA, 24 nt, Homo sapiens
ucuugcacagucacugcucuucag

SEQ ID NO: 966366 - RNA, 24 nt, Homo sapiens
ucuugcuguaacucagacauucca

SEQ ID NO: 966367 - RNA, 18 nt, Homo sapiens
ucuuggaaaaaaaccaca

SEQ ID NO: 966368 - RNA, 19 nt, Homo sapiens
ucuuggaaaaaaaccacag

SEQ ID NO: 966369 - RNA, 20 nt, Homo sapiens
ucuuggaaaaaaaccacagc

SEQ ID NO: 966370 - RNA, 23 nt, Homo sapiens
ucuuuaauuuauaucagguguau

SEQ ID NO: 966371 - RNA, 14 nt, Homo sapiens
ucuuuacucugcau

SEQ ID NO: 966372 - RNA, 19 nt, Homo sapiens
ucuuucugaauugcacaug

SEQ ID NO: 966373 - RNA, 14 nt, Homo sapiens
ucuuuguaccaaaa

SEQ ID NO: 966374 - RNA, 13 nt, Homo sapiens
ucuuugugugaca

SEQ ID NO: 966375 - RNA, 15 nt, Homo sapiens
ucuuugugugacaug

SEQ ID NO: 966376 - RNA, 16 nt, Homo sapiens
ucuuuuaaaaucauga

SEQ ID NO: 966377 - RNA, 17 nt, Homo sapiens
ucuuuuuuugagugaca

SEQ ID NO: 966378 - RNA, 13 nt, Homo sapiens
ugaaaagugugua

SEQ ID NO: 966379 - RNA, 23 nt, Homo sapiens
ugaaaauaaaaugacgucacaag

SEQ ID NO: 966380 - RNA, 21 nt, Homo sapiens
ugaaaauauagacauucucac

SEQ ID NO: 966381 - RNA, 15 nt, Homo sapiens
ugaaaaugacauuaa

SEQ ID NO: 966382 - RNA, 20 nt, Homo sapiens
ugaaaauugggcaugccauu

SEQ ID NO: 966383 - RNA, 20 nt, Homo sapiens
ugaaaccaccgugaaccaga

SEQ ID NO: 966384 - RNA, 20 nt, Homo sapiens
ugaaagaccuuagacauaaa

SEQ ID NO: 966385 - RNA, 22 nt, Homo sapiens
ugaaagccaacaacucugccuu

SEQ ID NO: 966386 - RNA, 13 nt, Homo sapiens
ugaaagugcauuu

SEQ ID NO: 966387 - RNA, 20 nt, Homo sapiens
ugaaauaaaaugauaaacaa

SEQ ID NO: 966388 - RNA, 12 nt, Homo sapiens
ugaaaugcauau

SEQ ID NO: 966389 - RNA, 22 nt, Homo sapiens
ugaaauggaggaucucuaaaga

SEQ ID NO: 966390 - RNA, 19 nt, Homo sapiens
ugaaauuauuugucauuca

SEQ ID NO: 966391 - RNA, 13 nt, Homo sapiens
ugaaauucuuccu

SEQ ID NO: 966392 - RNA, 16 nt, Homo sapiens
ugaaauugcuuugcug

SEQ ID NO: 966393 - RNA, 20 nt, Homo sapiens
ugaaauuuuaaccuaugaua

SEQ ID NO: 966394 - RNA, 17 nt, Homo sapiens
ugaacaccuauugcacu

SEQ ID NO: 966395 - RNA, 21 nt, Homo sapiens
ugaacacuugaagccaucuaa

SEQ ID NO: 966396 - RNA, 22 nt, Homo sapiens
ugaacacuugaagccaucuaaa

SEQ ID NO: 966397 - RNA, 11 nt, Homo sapiens
ugaacauuuca

SEQ ID NO: 966398 - RNA, 18 nt, Homo sapiens
ugaaccgcacagcucagg

SEQ ID NO: 966399 - RNA, 14 nt, Homo sapiens
ugaacuaaugacaa

SEQ ID NO: 966400 - RNA, 17 nt, Homo sapiens
ugaacuaggcugagcaa

SEQ ID NO: 966401 - RNA, 23 nt, Homo sapiens
ugaagaaaauagucaguguucuu

SEQ ID NO: 966402 - RNA, 21 nt, Homo sapiens
ugaagcaagugaggccugaca

SEQ ID NO: 966403 - RNA, 20 nt, Homo sapiens
ugaaguuaagaaccugaaua

SEQ ID NO: 966404 - RNA, 23 nt, Homo sapiens
ugaaguuauggcuucacauucau

SEQ ID NO: 966405 - RNA, 17 nt, Homo sapiens
ugaaguuuuacugucua

SEQ ID NO: 966406 - RNA, 23 nt, Homo sapiens
ugaauacgcuaauaagugacaaa

SEQ ID NO: 966407 - RNA, 15 nt, Homo sapiens
ugaauagacuaucua

SEQ ID NO: 966408 - RNA, 19 nt, Homo sapiens
ugaaucacuuaaaugucac

SEQ ID NO: 966409 - RNA, 17 nt, Homo sapiens
ugaaucuauaaguagua

SEQ ID NO: 966410 - RNA, 17 nt, Homo sapiens
ugaauuauugacacuga

SEQ ID NO: 966411 - RNA, 12 nt, Homo sapiens
ugaauugcacau

SEQ ID NO: 966412 - RNA, 13 nt, Homo sapiens
ugacaauaagaaa

SEQ ID NO: 966413 - RNA, 18 nt, Homo sapiens
ugacaaucaacucuaaua

SEQ ID NO: 966414 - RNA, 14 nt, Homo sapiens
ugacacauaugcac

SEQ ID NO: 966415 - RNA, 10 nt, Homo sapiens
ugacacugaa

SEQ ID NO: 966416 - RNA, 20 nt, Homo sapiens
ugacagcaugguaaugaagg

SEQ ID NO: 966417 - RNA, 16 nt, Homo sapiens
ugacagccugcagcag

SEQ ID NO: 966418 - RNA, 15 nt, Homo sapiens
ugacagucuccccca

SEQ ID NO: 966419 - RNA, 17 nt, Homo sapiens
ugacauuaaaugcaaua

SEQ ID NO: 966420 - RNA, 23 nt, Homo sapiens
ugaccacucuucuuuaagccaua

SEQ ID NO: 966421 - RNA, 13 nt, Homo sapiens
ugaccagaagccu

SEQ ID NO: 966422 - RNA, 21 nt, Homo sapiens
ugacccacccuagaucuuccc

SEQ ID NO: 966423 - RNA, 21 nt, Homo sapiens
ugacccagggacucuccaaac

SEQ ID NO: 966424 - RNA, 14 nt, Homo sapiens
ugaccccugcucag

SEQ ID NO: 966425 - RNA, 22 nt, Homo sapiens
ugaccccuguccccacacugac

SEQ ID NO: 966426 - RNA, 17 nt, Homo sapiens
ugacccuccccuaguca

SEQ ID NO: 966427 - RNA, 17 nt, Homo sapiens
ugaccuccgccauccac

SEQ ID NO: 966428 - RNA, 21 nt, Homo sapiens
ugaccugcugaccugugcaca

SEQ ID NO: 966429 - RNA, 18 nt, Homo sapiens
ugacgcuugugacagugc

SEQ ID NO: 966430 - RNA, 19 nt, Homo sapiens
ugacuacauagucaagucc

SEQ ID NO: 966431 - RNA, 18 nt, Homo sapiens
ugacuuaagaaagcaaaa

SEQ ID NO: 966432 - RNA, 15 nt, Homo sapiens
ugagaaacaucucaa

SEQ ID NO: 966433 - RNA, 19 nt, Homo sapiens
ugagaagccuucagcucca

SEQ ID NO: 966434 - RNA, 22 nt, Homo sapiens
ugagaauacauaaacaacgcau

SEQ ID NO: 966435 - RNA, 20 nt, Homo sapiens
ugagacaguuucuuagcuuu

SEQ ID NO: 966436 - RNA, 18 nt, Homo sapiens
ugagaccugaaggguuga

SEQ ID NO: 966437 - RNA, 21 nt, Homo sapiens
ugagaccugggauuugagaua

SEQ ID NO: 966438 - RNA, 13 nt, Homo sapiens
ugagacugugcug

SEQ ID NO: 966439 - RNA, 14 nt, Homo sapiens
ugagaucacuacuc

SEQ ID NO: 966440 - RNA, 12 nt, Homo sapiens
ugagauccugca

SEQ ID NO: 966441 - RNA, 15 nt, Homo sapiens
ugagaugguucccaa

SEQ ID NO: 966442 - RNA, 13 nt, Homo sapiens
ugagaugucuuca

SEQ ID NO: 966443 - RNA, 16 nt, Homo sapiens
ugagaugugagccuug

SEQ ID NO: 966444 - RNA, 22 nt, Homo sapiens
ugagcagccucuggacagccag

SEQ ID NO: 966445 - RNA, 14 nt, Homo sapiens
ugagcauaaaucaa

SEQ ID NO: 966446 - RNA, 17 nt, Homo sapiens
ugagccaagauugcacc

SEQ ID NO: 966447 - RNA, 19 nt, Homo sapiens
ugagccccacagcccugcu

SEQ ID NO: 966448 - RNA, 19 nt, Homo sapiens
ugagcugguaggauguaag

SEQ ID NO: 966449 - RNA, 19 nt, Homo sapiens
ugagcuguaaaaauguuac

SEQ ID NO: 966450 - RNA, 16 nt, Homo sapiens
ugaggaaaauucuuaa

SEQ ID NO: 966451 - RNA, 13 nt, Homo sapiens
ugaggaccaccuc

SEQ ID NO: 966452 - RNA, 22 nt, Homo sapiens
ugaggacccgugugacucgcca

SEQ ID NO: 966453 - RNA, 13 nt, Homo sapiens
ugaggaggacaaa

SEQ ID NO: 966454 - RNA, 19 nt, Homo sapiens
ugaggaggagacagccuca

SEQ ID NO: 966455 - RNA, 17 nt, Homo sapiens
ugaggagugccagcuca

SEQ ID NO: 966456 - RNA, 22 nt, Homo sapiens
ugaggaugacagugacacccag

SEQ ID NO: 966457 - RNA, 13 nt, Homo sapiens
ugaggcaggagaa

SEQ ID NO: 966458 - RNA, 13 nt, Homo sapiens
ugaggcaugacua

SEQ ID NO: 966459 - RNA, 18 nt, Homo sapiens
ugaggccuagacucuguc

SEQ ID NO: 966460 - RNA, 17 nt, Homo sapiens
ugagggcagacuggggc

SEQ ID NO: 966461 - RNA, 17 nt, Homo sapiens
ugaggugccacccagua

SEQ ID NO: 966462 - RNA, 16 nt, Homo sapiens
ugagguucuugggaua

SEQ ID NO: 966463 - RNA, 16 nt, Homo sapiens
ugaguaccuacugugu

SEQ ID NO: 966464 - RNA, 24 nt, Homo sapiens
ugaguauuccaugagcugcucauu

SEQ ID NO: 966465 - RNA, 13 nt, Homo sapiens
ugagucagugcuc

SEQ ID NO: 966466 - RNA, 18 nt, Homo sapiens
ugaguccaucuaacauca

SEQ ID NO: 966467 - RNA, 17 nt, Homo sapiens
ugauacuuuaguacaau

SEQ ID NO: 966468 - RNA, 15 nt, Homo sapiens
ugauagggaacuggg

SEQ ID NO: 966469 - RNA, 13 nt, Homo sapiens
ugauauaccaaau

SEQ ID NO: 966470 - RNA, 21 nt, Homo sapiens
ugaucagacauacagcugccu

SEQ ID NO: 966471 - RNA, 23 nt, Homo sapiens
ugauccacuuugggggaggagaa

SEQ ID NO: 966472 - RNA, 17 nt, Homo sapiens
ugaucggaaagcucuuc

SEQ ID NO: 966473 - RNA, 15 nt, Homo sapiens
ugaucuguaccauga

SEQ ID NO: 966474 - RNA, 19 nt, Homo sapiens
ugaucuuaacaaagccuuu

SEQ ID NO: 966475 - RNA, 19 nt, Homo sapiens
ugaugaaaaauaugugcuu

SEQ ID NO: 966476 - RNA, 18 nt, Homo sapiens
ugaugaaagugcuucauu

SEQ ID NO: 966477 - RNA, 19 nt, Homo sapiens
ugaugaaguuguacaacac

SEQ ID NO: 966478 - RNA, 20 nt, Homo sapiens
ugaugaggaaggacuugacu

SEQ ID NO: 966479 - RNA, 15 nt, Homo sapiens
ugauggccaccagcu

SEQ ID NO: 966480 - RNA, 21 nt, Homo sapiens
ugaugggccacaacugucuua

SEQ ID NO: 966481 - RNA, 13 nt, Homo sapiens
ugauuaucuucag

SEQ ID NO: 966482 - RNA, 15 nt, Homo sapiens
ugauucaacacuuaa

SEQ ID NO: 966483 - RNA, 16 nt, Homo sapiens
ugauucaacacuuaag

SEQ ID NO: 966484 - RNA, 18 nt, Homo sapiens
ugauuuuuuuuauugccu

SEQ ID NO: 966485 - RNA, 13 nt, Homo sapiens
ugcaaaacuuuag

SEQ ID NO: 966486 - RNA, 18 nt, Homo sapiens
ugcaaaauauuugacuau

SEQ ID NO: 966487 - RNA, 13 nt, Homo sapiens
ugcaacagacugu

SEQ ID NO: 966488 - RNA, 19 nt, Homo sapiens
ugcaacccagucacacugu

SEQ ID NO: 966489 - RNA, 21 nt, Homo sapiens
ugcaacuucuuacuucccuaa

SEQ ID NO: 966490 - RNA, 23 nt, Homo sapiens
ugcaagugcuggagucuccugag

SEQ ID NO: 966491 - RNA, 15 nt, Homo sapiens
ugcaauaacagcugc

SEQ ID NO: 966492 - RNA, 17 nt, Homo sapiens
ugcaauaacagcugcaa

SEQ ID NO: 966493 - RNA, 17 nt, Homo sapiens
ugcacaagcacuaucac

SEQ ID NO: 966494 - RNA, 19 nt, Homo sapiens
ugcacagucacugcucuuc

SEQ ID NO: 966495 - RNA, 13 nt, Homo sapiens
ugcacaugaaucc

SEQ ID NO: 966496 - RNA, 20 nt, Homo sapiens
ugcacaugucuuguacaugu

SEQ ID NO: 966497 - RNA, 23 nt, Homo sapiens
ugcacaugugagcaugucacuuc

SEQ ID NO: 966498 - RNA, 14 nt, Homo sapiens
ugcaccacugcucu

SEQ ID NO: 966499 - RNA, 16 nt, Homo sapiens
ugcacugccagcaucu

SEQ ID NO: 966500 - RNA, 14 nt, Homo sapiens
ugcacuggggccac

SEQ ID NO: 966501 - RNA, 14 nt, Homo sapiens
ugcagucacuggag

SEQ ID NO: 966502 - RNA, 13 nt, Homo sapiens
ugcagucaucucc

SEQ ID NO: 966503 - RNA, 15 nt, Homo sapiens
ugcaguucuacucag

SEQ ID NO: 966504 - RNA, 19 nt, Homo sapiens
ugcauaaauaugcagugau

SEQ ID NO: 966505 - RNA, 21 nt, Homo sapiens
ugcauaaauaugcagugauau

SEQ ID NO: 966506 - RNA, 14 nt, Homo sapiens
ugcauauuugcaaa

SEQ ID NO: 966507 - RNA, 21 nt, Homo sapiens
ugcaucacauauucauauugu

SEQ ID NO: 966508 - RNA, 15 nt, Homo sapiens
ugcaucauccuugca

SEQ ID NO: 966509 - RNA, 15 nt, Homo sapiens
ugcaugaccugauca

SEQ ID NO: 966510 - RNA, 14 nt, Homo sapiens
ugcaugcuugcaua

SEQ ID NO: 966511 - RNA, 22 nt, Homo sapiens
ugcauuuccucgcagccucuca

SEQ ID NO: 966512 - RNA, 10 nt, Homo sapiens
ugccaaaaau

SEQ ID NO: 966513 - RNA, 15 nt, Homo sapiens
ugccaaaaaucuuuu

SEQ ID NO: 966514 - RNA, 19 nt, Homo sapiens
ugccaauacagacaaagca

SEQ ID NO: 966515 - RNA, 22 nt, Homo sapiens
ugccacaaugcaguucugagca

SEQ ID NO: 966516 - RNA, 14 nt, Homo sapiens
ugccacccacaucu

SEQ ID NO: 966517 - RNA, 17 nt, Homo sapiens
ugccacccacaucuucc

SEQ ID NO: 966518 - RNA, 15 nt, Homo sapiens
ugccaccuucaaguu

SEQ ID NO: 966519 - RNA, 14 nt, Homo sapiens
ugccagacauggac

SEQ ID NO: 966520 - RNA, 16 nt, Homo sapiens
ugccagggcagggucu

SEQ ID NO: 966521 - RNA, 12 nt, Homo sapiens
ugccaucuucag

SEQ ID NO: 966522 - RNA, 13 nt, Homo sapiens
ugccaugugaaga

SEQ ID NO: 966523 - RNA, 14 nt, Homo sapiens
ugccauuacauugc

SEQ ID NO: 966524 - RNA, 17 nt, Homo sapiens
ugcccccaccccgggga

SEQ ID NO: 966525 - RNA, 12 nt, Homo sapiens
ugccccugccuu

SEQ ID NO: 966526 - RNA, 18 nt, Homo sapiens
ugccccuuccacuuugag

SEQ ID NO: 966527 - RNA, 17 nt, Homo sapiens
ugcccugugcaugccau

SEQ ID NO: 966528 - RNA, 18 nt, Homo sapiens
ugcccugugcaugccaug

SEQ ID NO: 966529 - RNA, 16 nt, Homo sapiens
ugcccuguguacuucc

SEQ ID NO: 966530 - RNA, 22 nt, Homo sapiens
ugcccuguugguuucacagaua

SEQ ID NO: 966531 - RNA, 22 nt, Homo sapiens
ugccggugagacccauggcugu

SEQ ID NO: 966532 - RNA, 13 nt, Homo sapiens
ugccuacagccag

SEQ ID NO: 966533 - RNA, 19 nt, Homo sapiens
ugccuaguaacacauaugu

SEQ ID NO: 966534 - RNA, 21 nt, Homo sapiens
ugccuaugccaagucccugga

SEQ ID NO: 966535 - RNA, 18 nt, Homo sapiens
ugccuauuuguguggaca

SEQ ID NO: 966536 - RNA, 15 nt, Homo sapiens
ugccucuggucccag

SEQ ID NO: 966537 - RNA, 21 nt, Homo sapiens
ugccugugugggacugagaug

SEQ ID NO: 966538 - RNA, 18 nt, Homo sapiens
ugccuuaaaaccaaagag

SEQ ID NO: 966539 - RNA, 15 nt, Homo sapiens
ugccuuaagccaaua

SEQ ID NO: 966540 - RNA, 18 nt, Homo sapiens
ugccuucucaugauccaa

SEQ ID NO: 966541 - RNA, 16 nt, Homo sapiens
ugccuugccuccucag

SEQ ID NO: 966542 - RNA, 15 nt, Homo sapiens
uggcuuaagcaauaa

SEQ ID NO: 966543 - RNA, 17 nt, Homo sapiens
ugggaaacccucuccau

SEQ ID NO: 966544 - RNA, 12 nt, Homo sapiens
ugggaagccaua

SEQ ID NO: 966545 - RNA, 14 nt, Homo sapiens
ugggauggggacau

SEQ ID NO: 966546 - RNA, 22 nt, Homo sapiens
ugggauuagcccgcuagcauua

SEQ ID NO: 966547 - RNA, 21 nt, Homo sapiens
ugggcaacagagcaagacucc

SEQ ID NO: 966548 - RNA, 17 nt, Homo sapiens
ugggcacacacacccgc

SEQ ID NO: 966549 - RNA, 13 nt, Homo sapiens
ugggcaugacauc

SEQ ID NO: 966550 - RNA, 15 nt, Homo sapiens
ugggccacaacuguc

SEQ ID NO: 966551 - RNA, 13 nt, Homo sapiens
ugggcucgcacug

SEQ ID NO: 966552 - RNA, 14 nt, Homo sapiens
ugggcugcuggcca

SEQ ID NO: 966553 - RNA, 20 nt, Homo sapiens
ugggcuuucaaaaaccauau

SEQ ID NO: 966554 - RNA, 20 nt, Homo sapiens
uggggaaaauggccaugcag

SEQ ID NO: 966555 - RNA, 23 nt, Homo sapiens
uggggaccaaaucaaaugaauga

SEQ ID NO: 966556 - RNA, 17 nt, Homo sapiens
uggggagacaaaucuca

SEQ ID NO: 966557 - RNA, 21 nt, Homo sapiens
uggggauccccgccuggccag

SEQ ID NO: 966558 - RNA, 12 nt, Homo sapiens
uggggccaccaa

SEQ ID NO: 966559 - RNA, 11 nt, Homo sapiens
uggggccauaa

SEQ ID NO: 966560 - RNA, 20 nt, Homo sapiens
uggggcggguggggccauaa

SEQ ID NO: 966561 - RNA, 15 nt, Homo sapiens
uggggcucucucuuc

SEQ ID NO: 966562 - RNA, 19 nt, Homo sapiens
ugggguaaaguaucacuuu

SEQ ID NO: 966563 - RNA, 11 nt, Homo sapiens
ugggguugagg

SEQ ID NO: 966564 - RNA, 15 nt, Homo sapiens
uggguccaugcuaac

SEQ ID NO: 966565 - RNA, 22 nt, Homo sapiens
ugggugugcccacgaagacaac

SEQ ID NO: 966566 - RNA, 20 nt, Homo sapiens
uggguugacuccugagcaua

SEQ ID NO: 966567 - RNA, 23 nt, Homo sapiens
ugguaaacaguuuggaaaagugg

SEQ ID NO: 966568 - RNA, 19 nt, Homo sapiens
ugguaaugaaggacaguga

SEQ ID NO: 966569 - RNA, 21 nt, Homo sapiens
uggucaagauuuugaaugcuu

SEQ ID NO: 966570 - RNA, 23 nt, Homo sapiens
uggucaagggcugucauugcaca

SEQ ID NO: 966571 - RNA, 15 nt, Homo sapiens
uggucacaaagcuau

SEQ ID NO: 966572 - RNA, 23 nt, Homo sapiens
uggucacaugaugugcauagaga

SEQ ID NO: 966573 - RNA, 20 nt, Homo sapiens
uggucuaagguucagccuga

SEQ ID NO: 966574 - RNA, 11 nt, Homo sapiens
uggucucagcc

SEQ ID NO: 966575 - RNA, 23 nt, Homo sapiens
uggucugaagaaggaaggccuga

SEQ ID NO: 966576 - RNA, 19 nt, Homo sapiens
uggucuuucugaauugcac

SEQ ID NO: 966577 - RNA, 21 nt, Homo sapiens
uggucuuucugaauugcacau

SEQ ID NO: 966578 - RNA, 14 nt, Homo sapiens
uggugacaguccaa

SEQ ID NO: 966579 - RNA, 21 nt, Homo sapiens
uggugucccgguaccuuccau

SEQ ID NO: 966580 - RNA, 22 nt, Homo sapiens
uguaaaaaaaaaugccuuugag

SEQ ID NO: 966581 - RNA, 19 nt, Homo sapiens
uguaaaaauguuacgugaa

SEQ ID NO: 966582 - RNA, 22 nt, Homo sapiens
uguaaaauggaggccauugugu

SEQ ID NO: 966583 - RNA, 21 nt, Homo sapiens
uguaaacuaguuacuaaacau

SEQ ID NO: 966584 - RNA, 20 nt, Homo sapiens
uguaaaguagaauaagccuu

SEQ ID NO: 966585 - RNA, 17 nt, Homo sapiens
uguaaccagaauuauac

SEQ ID NO: 966586 - RNA, 12 nt, Homo sapiens
uguaagaacaac

SEQ ID NO: 966587 - RNA, 14 nt, Homo sapiens
uguaagagugauuu

SEQ ID NO: 966588 - RNA, 14 nt, Homo sapiens
uguaagauuuucca

SEQ ID NO: 966589 - RNA, 18 nt, Homo sapiens
uguaagcauucugagcug

SEQ ID NO: 966590 - RNA, 13 nt, Homo sapiens
uguaauaagcaau

SEQ ID NO: 966591 - RNA, 15 nt, Homo sapiens
uguaauaagcaauca

SEQ ID NO: 966592 - RNA, 20 nt, Homo sapiens
uguaauaauaaaaccaaaga

SEQ ID NO: 966593 - RNA, 15 nt, Homo sapiens
uguacacaacaaucc

SEQ ID NO: 966594 - RNA, 19 nt, Homo sapiens
uguacagaaaguaucacaa

SEQ ID NO: 966595 - RNA, 17 nt, Homo sapiens
uguacagauucuuucag

SEQ ID NO: 966596 - RNA, 15 nt, Homo sapiens
uguaccaaugaugaa

SEQ ID NO: 966597 - RNA, 14 nt, Homo sapiens
uguaccaggcucuc

SEQ ID NO: 966598 - RNA, 20 nt, Homo sapiens
uguacgacacggguggggaa

SEQ ID NO: 966599 - RNA, 19 nt, Homo sapiens
uguagaaaagaacuggaaa

SEQ ID NO: 966600 - RNA, 16 nt, Homo sapiens
uguagacaaaguacau

SEQ ID NO: 966601 - RNA, 22 nt, Homo sapiens
uguagacuguggcuagugacaa

SEQ ID NO: 966602 - RNA, 17 nt, Homo sapiens
uguagauauugugaagu

SEQ ID NO: 966603 - RNA, 13 nt, Homo sapiens
uguagaugugcau

SEQ ID NO: 966604 - RNA, 14 nt, Homo sapiens
uguagcagucuuca

SEQ ID NO: 966605 - RNA, 19 nt, Homo sapiens
uguagcuggggcuuugaug

SEQ ID NO: 966606 - RNA, 13 nt, Homo sapiens
uguauauaagcaa

SEQ ID NO: 966607 - RNA, 18 nt, Homo sapiens
uguauucagaggcaguga

SEQ ID NO: 966608 - RNA, 20 nt, Homo sapiens
uguauuuccagugcaauugu

SEQ ID NO: 966609 - RNA, 17 nt, Homo sapiens
ugucaaucacagucuca

SEQ ID NO: 966610 - RNA, 18 nt, Homo sapiens
ugucacccugcagagcua

SEQ ID NO: 966611 - RNA, 16 nt, Homo sapiens
ugucacucugugccuu

SEQ ID NO: 966612 - RNA, 19 nt, Homo sapiens
ugucacugccugacauuca

SEQ ID NO: 966613 - RNA, 20 nt, Homo sapiens
ugucagcuacuaaugauguu

SEQ ID NO: 966614 - RNA, 20 nt, Homo sapiens
ugucagugacuuugagcuga

SEQ ID NO: 966615 - RNA, 11 nt, Homo sapiens
ugucaguucuc

SEQ ID NO: 966616 - RNA, 20 nt, Homo sapiens
ugucaguuuuguacauagca

SEQ ID NO: 966617 - RNA, 18 nt, Homo sapiens
ugucaucacuaguggcaa

SEQ ID NO: 966618 - RNA, 16 nt, Homo sapiens
ugucauuuuuaucuau

SEQ ID NO: 966619 - RNA, 11 nt, Homo sapiens
uguccaaagag

SEQ ID NO: 966620 - RNA, 15 nt, Homo sapiens
uguccaaguccaacc

SEQ ID NO: 966621 - RNA, 14 nt, Homo sapiens
uguccaggcagcuc

SEQ ID NO: 966622 - RNA, 19 nt, Homo sapiens
ugucccccuuuagaucucu

SEQ ID NO: 966623 - RNA, 12 nt, Homo sapiens
uguccuuuauga

SEQ ID NO: 966624 - RNA, 15 nt, Homo sapiens
uguccuuuaugaucc

SEQ ID NO: 966625 - RNA, 13 nt, Homo sapiens
ugucgccaaaaau

SEQ ID NO: 966626 - RNA, 13 nt, Homo sapiens
ugucgccaccacu

SEQ ID NO: 966627 - RNA, 21 nt, Homo sapiens
ugucuccuccccuucccccac

SEQ ID NO: 966628 - RNA, 16 nt, Homo sapiens
ugucucuucugagcua

SEQ ID NO: 966629 - RNA, 21 nt, Homo sapiens
ugucuguaauaauagacugua

SEQ ID NO: 966630 - RNA, 16 nt, Homo sapiens
ugucuucauguugaug

SEQ ID NO: 966631 - RNA, 23 nt, Homo sapiens
ugucuuguugcggauggauggaa

SEQ ID NO: 966632 - RNA, 20 nt, Homo sapiens
ugugaaauucacaguaauau

SEQ ID NO: 966633 - RNA, 19 nt, Homo sapiens
ugugaaguuugcuuuguac

SEQ ID NO: 966634 - RNA, 16 nt, Homo sapiens
ugugaauuauugacac

SEQ ID NO: 966635 - RNA, 14 nt, Homo sapiens
ugugacacauaugc

SEQ ID NO: 966636 - RNA, 23 nt, Homo sapiens
ugugacuauucauggcuaccuca

SEQ ID NO: 966637 - RNA, 16 nt, Homo sapiens
ugugagaaacaucuca

SEQ ID NO: 966638 - RNA, 17 nt, Homo sapiens
ugugagaaacaucucaa

SEQ ID NO: 966639 - RNA, 20 nt, Homo sapiens
ugugaucuguuguaauauca

SEQ ID NO: 966640 - RNA, 19 nt, Homo sapiens
ugugauucaaucuguaaac

SEQ ID NO: 966641 - RNA, 23 nt, Homo sapiens
ugugauugaaggugauaagggaa

SEQ ID NO: 966642 - RNA, 17 nt, Homo sapiens
ugugcauguaugucuug

SEQ ID NO: 966643 - RNA, 14 nt, Homo sapiens
ugugccaauacaga

SEQ ID NO: 966644 - RNA, 15 nt, Homo sapiens
ugugccccaugucca

SEQ ID NO: 966645 - RNA, 22 nt, Homo sapiens
ugugcuccuccuacccuuccag

SEQ ID NO: 966646 - RNA, 13 nt, Homo sapiens
ugugcuggggucu

SEQ ID NO: 966647 - RNA, 18 nt, Homo sapiens
uguggaauugacugccua

SEQ ID NO: 966648 - RNA, 22 nt, Homo sapiens
uguggcauaaauugcaucacug

SEQ ID NO: 966649 - RNA, 15 nt, Homo sapiens
uguggccacaaucca

SEQ ID NO: 966650 - RNA, 17 nt, Homo sapiens
ugugggacugagaugca

SEQ ID NO: 966651 - RNA, 18 nt, Homo sapiens
ugugguggccgugccuga

SEQ ID NO: 966652 - RNA, 13 nt, Homo sapiens
uguguaauaugca

SEQ ID NO: 966653 - RNA, 21 nt, Homo sapiens
uguguacaguugguucauccc

SEQ ID NO: 966654 - RNA, 16 nt, Homo sapiens
uguguaccuaagggag

SEQ ID NO: 966655 - RNA, 18 nt, Homo sapiens
uguguauuuccagugcaa

SEQ ID NO: 966656 - RNA, 18 nt, Homo sapiens
uguguccugaaacgcucc

SEQ ID NO: 966657 - RNA, 13 nt, Homo sapiens
uguguccugauga

SEQ ID NO: 966658 - RNA, 13 nt, Homo sapiens
uguguugccacag

SEQ ID NO: 966659 - RNA, 21 nt, Homo sapiens
uguguuuauauggaagaaagu

SEQ ID NO: 966660 - RNA, 22 nt, Homo sapiens
uguguuuuaaaauaaggauuuu

SEQ ID NO: 966661 - RNA, 22 nt, Homo sapiens
uguuaaggaaacucuuaucuca

SEQ ID NO: 966662 - RNA, 22 nt, Homo sapiens
uguuaaugcuuucccacucuca

SEQ ID NO: 966663 - RNA, 23 nt, Homo sapiens
uguuaaugcuuuucccacucuca

SEQ ID NO: 966664 - RNA, 15 nt, Homo sapiens
uguuaccauucacaa

SEQ ID NO: 966665 - RNA, 13 nt, Homo sapiens
uguuaucugcuag

SEQ ID NO: 966666 - RNA, 20 nt, Homo sapiens
uguucccuccccgaucaucu

SEQ ID NO: 966667 - RNA, 19 nt, Homo sapiens
uguuccucuuggugucaua

SEQ ID NO: 966668 - RNA, 14 nt, Homo sapiens
uguucuacugagaa

SEQ ID NO: 966669 - RNA, 14 nt, Homo sapiens
uguugacauacauu

SEQ ID NO: 966670 - RNA, 15 nt, Homo sapiens
uguugggccagguag

SEQ ID NO: 966671 - RNA, 14 nt, Homo sapiens
uguuggugggaccc

SEQ ID NO: 966672 - RNA, 18 nt, Homo sapiens
uguugucaccagaucuga

SEQ ID NO: 966673 - RNA, 18 nt, Homo sapiens
uguuguuugguucaggga

SEQ ID NO: 966674 - RNA, 18 nt, Homo sapiens
uguuuacguuugauacaa

SEQ ID NO: 966675 - RNA, 14 nt, Homo sapiens
uguuuaugagccag

SEQ ID NO: 966676 - RNA, 17 nt, Homo sapiens
uguuuauuuacaaggga

SEQ ID NO: 966677 - RNA, 17 nt, Homo sapiens
uguuucaguucagauaa

SEQ ID NO: 966678 - RNA, 20 nt, Homo sapiens
uguuucuugccugaacuccu

SEQ ID NO: 966679 - RNA, 13 nt, Homo sapiens
uguuucuugcugc

SEQ ID NO: 966680 - RNA, 16 nt, Homo sapiens
uguuuggaaaagacag

SEQ ID NO: 966681 - RNA, 18 nt, Homo sapiens
uguuuucuucguggauug

SEQ ID NO: 966682 - RNA, 14 nt, Homo sapiens
uuaaaaacaugaau

SEQ ID NO: 966683 - RNA, 13 nt, Homo sapiens
uuaaaacaaagaa

SEQ ID NO: 966684 - RNA, 16 nt, Homo sapiens
uuaaaacagacacugg

SEQ ID NO: 966685 - RNA, 16 nt, Homo sapiens
uuaaaauaaugaacac

SEQ ID NO: 966686 - RNA, 12 nt, Homo sapiens
uuaaacugugua

SEQ ID NO: 966687 - RNA, 15 nt, Homo sapiens
uuaaaguucauugca

SEQ ID NO: 966688 - RNA, 18 nt, Homo sapiens
uuaaauccugaagagcau

SEQ ID NO: 966689 - RNA, 23 nt, Homo sapiens
uuaaauguuuuuuuuaaucauca

SEQ ID NO: 966690 - RNA, 17 nt, Homo sapiens
uuaaauuuaauaccaga

SEQ ID NO: 966691 - RNA, 16 nt, Homo sapiens
uuaacaaaauuugaau

SEQ ID NO: 966692 - RNA, 21 nt, Homo sapiens
uuaacagauggaaaaacugag

SEQ ID NO: 966693 - RNA, 18 nt, Homo sapiens
uuaacccacugcaugcag

SEQ ID NO: 966694 - RNA, 18 nt, Homo sapiens
uuaaccugcauaaaaagg

SEQ ID NO: 966695 - RNA, 17 nt, Homo sapiens
uuaacggugcuaaaaau

SEQ ID NO: 966696 - RNA, 22 nt, Homo sapiens
uuaacuucagcauccaaguuua

SEQ ID NO: 966697 - RNA, 13 nt, Homo sapiens
uuaagaagacaua

SEQ ID NO: 966698 - RNA, 14 nt, Homo sapiens
uuaagagacacucc

SEQ ID NO: 966699 - RNA, 15 nt, Homo sapiens
uuaagcuuuggggaa

SEQ ID NO: 966700 - RNA, 21 nt, Homo sapiens
uuaaggaaacucuuaucucag

SEQ ID NO: 966701 - RNA, 13 nt, Homo sapiens
uuaaguggcagaa

SEQ ID NO: 966702 - RNA, 23 nt, Homo sapiens
uuaaguucaggcagcacaucaau

SEQ ID NO: 966703 - RNA, 17 nt, Homo sapiens
uuaaguuugacuacaua

SEQ ID NO: 966704 - RNA, 21 nt, Homo sapiens
uuaauaaaagaacaugcuuga

SEQ ID NO: 966705 - RNA, 16 nt, Homo sapiens
uuaauacauugaucag

SEQ ID NO: 966706 - RNA, 19 nt, Homo sapiens
uuaauagccaaagauuuca

SEQ ID NO: 966707 - RNA, 20 nt, Homo sapiens
uuaauagcuuuagggguaca

SEQ ID NO: 966708 - RNA, 17 nt, Homo sapiens
uuaauaucaacucugaa

SEQ ID NO: 966709 - RNA, 20 nt, Homo sapiens
uuaaucccuuugucugucaa

SEQ ID NO: 966710 - RNA, 15 nt, Homo sapiens
uuaaugagacaugaa

SEQ ID NO: 966711 - RNA, 20 nt, Homo sapiens
uuaaugccugcuuuuuggaa

SEQ ID NO: 966712 - RNA, 15 nt, Homo sapiens
uuaauguguauucau

SEQ ID NO: 966713 - RNA, 13 nt, Homo sapiens
uuaauuauugcuu

SEQ ID NO: 966714 - RNA, 22 nt, Homo sapiens
uuaauuuccuuuuugacacuga

SEQ ID NO: 966715 - RNA, 13 nt, Homo sapiens
uuaauuuguccuu

SEQ ID NO: 966716 - RNA, 23 nt, Homo sapiens
uuacaacuugaaauugcuuugcu

SEQ ID NO: 966717 - RNA, 19 nt, Homo sapiens
uuacacagaaaugcugcug

SEQ ID NO: 966718 - RNA, 23 nt, Homo sapiens
uuacagugagccaagauugcacc

SEQ ID NO: 966719 - RNA, 17 nt, Homo sapiens
uuacaguggcaguauug

SEQ ID NO: 966720 - RNA, 22 nt, Homo sapiens
uuacauagcucugaaguuaaaa

SEQ ID NO: 966721 - RNA, 19 nt, Homo sapiens
uuacauaggccgagcugug

SEQ ID NO: 966722 - RNA, 20 nt, Homo sapiens
uuaccacugugguuuugacu

SEQ ID NO: 966723 - RNA, 22 nt, Homo sapiens
uuacccuaaagugcaaaaguga

SEQ ID NO: 966724 - RNA, 17 nt, Homo sapiens
uuacccucuuugcugca

SEQ ID NO: 966725 - RNA, 14 nt, Homo sapiens
uuaccuccauccau

SEQ ID NO: 966726 - RNA, 22 nt, Homo sapiens
uuacuaaugugccccaugucca

SEQ ID NO: 966727 - RNA, 15 nt, Homo sapiens
uuacugagaugucuu

SEQ ID NO: 966728 - RNA, 16 nt, Homo sapiens
uuacuucccuaaugaa

SEQ ID NO: 966729 - RNA, 21 nt, Homo sapiens
uuagauaaauuguagggcuuu

SEQ ID NO: 966730 - RNA, 19 nt, Homo sapiens
uuagaucaaauaguugcau

SEQ ID NO: 966731 - RNA, 18 nt, Homo sapiens
uuaggugagacaguugcc

SEQ ID NO: 966732 - RNA, 15 nt, Homo sapiens
uuaggugucuguccu

SEQ ID NO: 966733 - RNA, 21 nt, Homo sapiens
uuaggugucuguccuuuauga

SEQ ID NO: 966734 - RNA, 22 nt, Homo sapiens
uuaguaaaggaaccauuccuuu

SEQ ID NO: 966735 - RNA, 13 nt, Homo sapiens
uuaguaacauuca

SEQ ID NO: 966736 - RNA, 14 nt, Homo sapiens
uuaguaacauucau

SEQ ID NO: 966737 - RNA, 19 nt, Homo sapiens
uuagucaccugccccagca

SEQ ID NO: 966738 - RNA, 19 nt, Homo sapiens
uuagucuuaauguacacau

SEQ ID NO: 966739 - RNA, 21 nt, Homo sapiens
uuagucuuggaaaaaaaccac

SEQ ID NO: 966740 - RNA, 20 nt, Homo sapiens
uuaguggcucaacauugugu

SEQ ID NO: 966741 - RNA, 13 nt, Homo sapiens
uuauaauuggaag

SEQ ID NO: 966742 - RNA, 18 nt, Homo sapiens
uuauacaaaccuaccaaa

SEQ ID NO: 966743 - RNA, 15 nt, Homo sapiens
uuauagucaauggcu

SEQ ID NO: 966744 - RNA, 16 nt, Homo sapiens
uuauauuauugauuca

SEQ ID NO: 966745 - RNA, 22 nt, Homo sapiens
uuauauuuccuuuaugugaauu

SEQ ID NO: 966746 - RNA, 12 nt, Homo sapiens
uuaucauaugcu

SEQ ID NO: 966747 - RNA, 21 nt, Homo sapiens
uuaucaugcauguccuguaaa

SEQ ID NO: 966748 - RNA, 23 nt, Homo sapiens
uuaucgggcuccagccaucucau

SEQ ID NO: 966749 - RNA, 15 nt, Homo sapiens
uuaucuuuauaugaa

SEQ ID NO: 966750 - RNA, 21 nt, Homo sapiens
uuaugaaaauauagacauucu

SEQ ID NO: 966751 - RNA, 22 nt, Homo sapiens
uuaugaccaugguauauuccua

SEQ ID NO: 966752 - RNA, 19 nt, Homo sapiens
uuaugucucuucugagcua

SEQ ID NO: 966753 - RNA, 19 nt, Homo sapiens
uuauuaaaaauguauauga

SEQ ID NO: 966754 - RNA, 15 nt, Homo sapiens
uuauuacauagcucu

SEQ ID NO: 966755 - RNA, 17 nt, Homo sapiens
uuauucauaaugugaga

SEQ ID NO: 966756 - RNA, 15 nt, Homo sapiens
uuauucuucuuuaug

SEQ ID NO: 966757 - RNA, 22 nt, Homo sapiens
uuauugaaagagucugggaccc

SEQ ID NO: 966758 - RNA, 17 nt, Homo sapiens
uuauugauucacuuacu

SEQ ID NO: 966759 - RNA, 14 nt, Homo sapiens
uuauuuuuucagac

SEQ ID NO: 966760 - RNA, 19 nt, Homo sapiens
uucaaaaccaaguaucaca

SEQ ID NO: 966761 - RNA, 13 nt, Homo sapiens
uucaaaauguauu

SEQ ID NO: 966762 - RNA, 13 nt, Homo sapiens
uucaaaccauuuu

SEQ ID NO: 966763 - RNA, 19 nt, Homo sapiens
uucaaagggaaacuuuaau

SEQ ID NO: 966764 - RNA, 17 nt, Homo sapiens
uucaaauuauaaaccaa

SEQ ID NO: 966765 - RNA, 16 nt, Homo sapiens
uucaagcaaaacaguu

SEQ ID NO: 966766 - RNA, 14 nt, Homo sapiens
uucaaucuguaaac

SEQ ID NO: 966767 - RNA, 16 nt, Homo sapiens
uucacaaauccuucaa

SEQ ID NO: 966768 - RNA, 20 nt, Homo sapiens
uucacacacacucugaagaa

SEQ ID NO: 966769 - RNA, 14 nt, Homo sapiens
uucacauuguacuu

SEQ ID NO: 966770 - RNA, 16 nt, Homo sapiens
uucacauuguacuuaa

SEQ ID NO: 966771 - RNA, 23 nt, Homo sapiens
uucacauuugaaauaaaguaauu

SEQ ID NO: 966772 - RNA, 19 nt, Homo sapiens
uucaccuccaagcauuuca

SEQ ID NO: 966773 - RNA, 16 nt, Homo sapiens
uucacugcgaagaccc

SEQ ID NO: 966774 - RNA, 15 nt, Homo sapiens
uucacugucaccacc

SEQ ID NO: 966775 - RNA, 18 nt, Homo sapiens
uucacugucgacauuuuc

SEQ ID NO: 966776 - RNA, 10 nt, Homo sapiens
uucacuuuga

SEQ ID NO: 966777 - RNA, 18 nt, Homo sapiens
uucagacugugcaauacu

SEQ ID NO: 966778 - RNA, 16 nt, Homo sapiens
uucagaggauaaauau

SEQ ID NO: 966779 - RNA, 18 nt, Homo sapiens
uucagcauggacagcauc

SEQ ID NO: 966780 - RNA, 14 nt, Homo sapiens
uucagggucucccc

SEQ ID NO: 966781 - RNA, 21 nt, Homo sapiens
uucaguucagauaauuggcaa

SEQ ID NO: 966782 - RNA, 17 nt, Homo sapiens
uucauagggauggcagu

SEQ ID NO: 966783 - RNA, 15 nt, Homo sapiens
uucauccuugacuaa

SEQ ID NO: 966784 - RNA, 17 nt, Homo sapiens
uucauggcuuuucuggu

SEQ ID NO: 966785 - RNA, 17 nt, Homo sapiens
uucaugggaaaacagac

SEQ ID NO: 966786 - RNA, 23 nt, Homo sapiens
uucaugggccccuucaaaccuca

SEQ ID NO: 966787 - RNA, 18 nt, Homo sapiens
uucauggugcacugagcu

SEQ ID NO: 966788 - RNA, 23 nt, Homo sapiens
uucauuaaaguauauuuaacuca

SEQ ID NO: 966789 - RNA, 13 nt, Homo sapiens
uuccaaacaucca

SEQ ID NO: 966790 - RNA, 21 nt, Homo sapiens
uuccaaauugcccuaugcugu

SEQ ID NO: 966791 - RNA, 18 nt, Homo sapiens
uuccacuuugaguaccaa

SEQ ID NO: 966792 - RNA, 19 nt, Homo sapiens
uuccagugaacauucccag

SEQ ID NO: 966793 - RNA, 16 nt, Homo sapiens
uuccauacuucucuca

SEQ ID NO: 966794 - RNA, 19 nt, Homo sapiens
uuccauccauuaccuccau

SEQ ID NO: 966795 - RNA, 18 nt, Homo sapiens
uucccaauaucaugugau

SEQ ID NO: 966796 - RNA, 22 nt, Homo sapiens
uucccacacugugaacuaauga

SEQ ID NO: 966797 - RNA, 17 nt, Homo sapiens
uucccaucugcaccccu

SEQ ID NO: 966798 - RNA, 17 nt, Homo sapiens
uucccauuugugccaga

SEQ ID NO: 966799 - RNA, 19 nt, Homo sapiens
uucccccaccgguccagcu

SEQ ID NO: 966800 - RNA, 14 nt, Homo sapiens
uucccgaugaacaa

SEQ ID NO: 966801 - RNA, 14 nt, Homo sapiens
uucccuaaugaagu

SEQ ID NO: 966802 - RNA, 23 nt, Homo sapiens
uucccuaggaaacucacacuccc

SEQ ID NO: 966803 - RNA, 23 nt, Homo sapiens
uucccugcuuccaggaaacucca

SEQ ID NO: 966804 - RNA, 13 nt, Homo sapiens
uuccuaaggcaug

SEQ ID NO: 966805 - RNA, 12 nt, Homo sapiens
uuccucuaguag

SEQ ID NO: 966806 - RNA, 18 nt, Homo sapiens
uuccugggguaaaguauc

SEQ ID NO: 966807 - RNA, 11 nt, Homo sapiens
uuccugugauu

SEQ ID NO: 966808 - RNA, 12 nt, Homo sapiens
uuccuucaaugu

SEQ ID NO: 966809 - RNA, 18 nt, Homo sapiens
uuccuucaaugugcauaa

SEQ ID NO: 966810 - RNA, 21 nt, Homo sapiens
uuccuuccagugucauuucuc

SEQ ID NO: 966811 - RNA, 15 nt, Homo sapiens
uuccuuggcuuuaug

SEQ ID NO: 966812 - RNA, 12 nt, Homo sapiens
uucgguuucaaa

SEQ ID NO: 966813 - RNA, 14 nt, Homo sapiens
uucuaaaugcauau

SEQ ID NO: 966814 - RNA, 23 nt, Homo sapiens
uucuaacccaagacaugacauuc

SEQ ID NO: 966815 - RNA, 21 nt, Homo sapiens
uucuaagagcgaacuucacau

SEQ ID NO: 966816 - RNA, 22 nt, Homo sapiens
uucuacaacugauugcaacaga

SEQ ID NO: 966817 - RNA, 15 nt, Homo sapiens
uucuagaaacaaaca

SEQ ID NO: 966818 - RNA, 15 nt, Homo sapiens
uucuaugcauuaaga

SEQ ID NO: 966819 - RNA, 18 nt, Homo sapiens
uucuauucuagccugcau

SEQ ID NO: 966820 - RNA, 19 nt, Homo sapiens
uucuccaucccucuaauga

SEQ ID NO: 966821 - RNA, 21 nt, Homo sapiens
uucuccaucccucuaaugaga

SEQ ID NO: 966822 - RNA, 13 nt, Homo sapiens
uucuccuacuuag

SEQ ID NO: 966823 - RNA, 18 nt, Homo sapiens
uucuccuuaccgucuuga

SEQ ID NO: 966824 - RNA, 16 nt, Homo sapiens
uucucguuuucacagg

SEQ ID NO: 966825 - RNA, 17 nt, Homo sapiens
uucucuugagcuggccu

SEQ ID NO: 966826 - RNA, 20 nt, Homo sapiens
uucucuugccauuuguagcu

SEQ ID NO: 966827 - RNA, 20 nt, Homo sapiens
uucugaaaagaugguaucau

SEQ ID NO: 966828 - RNA, 20 nt, Homo sapiens
uucugauacuuuaguacaau

SEQ ID NO: 966829 - RNA, 15 nt, Homo sapiens
uucugcccaugggaa

SEQ ID NO: 966830 - RNA, 19 nt, Homo sapiens
uucugccuucucaugaucc

SEQ ID NO: 966831 - RNA, 16 nt, Homo sapiens
uucuggaccugggcau

SEQ ID NO: 966832 - RNA, 23 nt, Homo sapiens
uucugucaaaugugucucacauc

SEQ ID NO: 966833 - RNA, 13 nt, Homo sapiens
uucugucuuccua

SEQ ID NO: 966834 - RNA, 14 nt, Homo sapiens
uucuuaguucauau

SEQ ID NO: 966835 - RNA, 17 nt, Homo sapiens
uucuuauuaaucauaca

SEQ ID NO: 966836 - RNA, 15 nt, Homo sapiens
uucuucauguacaga

SEQ ID NO: 966837 - RNA, 18 nt, Homo sapiens
uucuuccaacaugugaug

SEQ ID NO: 966838 - RNA, 15 nt, Homo sapiens
uucuugcaugaauca

SEQ ID NO: 966839 - RNA, 14 nt, Homo sapiens
uucuuugcauucca

SEQ ID NO: 966840 - RNA, 19 nt, Homo sapiens
uucuuugcccagacauuua

SEQ ID NO: 966841 - RNA, 16 nt, Homo sapiens
uucuuuuauacugaca

SEQ ID NO: 966842 - RNA, 16 nt, Homo sapiens
uugaaaauaaccuaau

SEQ ID NO: 966843 - RNA, 12 nt, Homo sapiens
uugaaaguaaaa

SEQ ID NO: 966844 - RNA, 20 nt, Homo sapiens
uugaacucuuagugauugag

SEQ ID NO: 966845 - RNA, 18 nt, Homo sapiens
uugaacuuuauaaaacau

SEQ ID NO: 966846 - RNA, 13 nt, Homo sapiens
uugaagccaaaga

SEQ ID NO: 966847 - RNA, 14 nt, Homo sapiens
uugaaugcacuuuu

SEQ ID NO: 966848 - RNA, 18 nt, Homo sapiens
uugacaauugggagcugc

SEQ ID NO: 966849 - RNA, 18 nt, Homo sapiens
uugacacugaaaguuuug

SEQ ID NO: 966850 - RNA, 20 nt, Homo sapiens
uugacguuucuucuuucuag

SEQ ID NO: 966851 - RNA, 13 nt, Homo sapiens
uugagagacacug

SEQ ID NO: 966852 - RNA, 14 nt, Homo sapiens
uugagagccagugg

SEQ ID NO: 966853 - RNA, 16 nt, Homo sapiens
uugagagccaguggcg

SEQ ID NO: 966854 - RNA, 16 nt, Homo sapiens
uugagauauaguucac

SEQ ID NO: 966855 - RNA, 16 nt, Homo sapiens
uugagcugagugcuga

SEQ ID NO: 966856 - RNA, 22 nt, Homo sapiens
uugaggaaaaauauuccuguga

SEQ ID NO: 966857 - RNA, 16 nt, Homo sapiens
uugaguaaugugacua

SEQ ID NO: 966858 - RNA, 14 nt, Homo sapiens
uugauccaggagau

SEQ ID NO: 966859 - RNA, 19 nt, Homo sapiens
uugaucuuaacaaagccuu

SEQ ID NO: 966860 - RNA, 22 nt, Homo sapiens
uugauggauuaauuaaauaagu

SEQ ID NO: 966861 - RNA, 14 nt, Homo sapiens
uugauucaacacuu

SEQ ID NO: 966862 - RNA, 17 nt, Homo sapiens
uugcaagaugugaauua

SEQ ID NO: 966863 - RNA, 20 nt, Homo sapiens
uugcaagaugugaauuauug

SEQ ID NO: 966864 - RNA, 17 nt, Homo sapiens
uugcacagaagcacaug

SEQ ID NO: 966865 - RNA, 12 nt, Homo sapiens
uugcaugcaugc

SEQ ID NO: 966866 - RNA, 18 nt, Homo sapiens
uugccacggaaacauaca

SEQ ID NO: 966867 - RNA, 22 nt, Homo sapiens
uugccagcgauuuuaguucaau

SEQ ID NO: 966868 - RNA, 18 nt, Homo sapiens
uugccccuuccacuuuga

SEQ ID NO: 966869 - RNA, 23 nt, Homo sapiens
uugcccugaacauacacaugcug

SEQ ID NO: 966870 - RNA, 14 nt, Homo sapiens
uugcuaugaagcgu

SEQ ID NO: 966871 - RNA, 21 nt, Homo sapiens
uugcucaguguccagcuucca

SEQ ID NO: 966872 - RNA, 19 nt, Homo sapiens
uugcucuacaaugacacac

SEQ ID NO: 966873 - RNA, 18 nt, Homo sapiens
uugcuguaacucagacau

SEQ ID NO: 966874 - RNA, 16 nt, Homo sapiens
uugcuguucugcugaa

SEQ ID NO: 966875 - RNA, 15 nt, Homo sapiens
uugcuuacuggugag

SEQ ID NO: 966876 - RNA, 20 nt, Homo sapiens
uugcuuuaccuuuucagggc

SEQ ID NO: 966877 - RNA, 22 nt, Homo sapiens
uuggaaaaaaaccacagccacu

SEQ ID NO: 966878 - RNA, 13 nt, Homo sapiens
uuggaaacagaga

SEQ ID NO: 966879 - RNA, 13 nt, Homo sapiens
uuggaaugaagga

SEQ ID NO: 966880 - RNA, 22 nt, Homo sapiens
uuggagagcagcuggcucucca

SEQ ID NO: 966881 - RNA, 19 nt, Homo sapiens
uuggaggcagggcugggaa

SEQ ID NO: 966882 - RNA, 18 nt, Homo sapiens
uuggaugauugugugacu

SEQ ID NO: 966883 - RNA, 12 nt, Homo sapiens
uuggcaaugcau

SEQ ID NO: 966884 - RNA, 16 nt, Homo sapiens
uuggccccacuuugaa

SEQ ID NO: 966885 - RNA, 17 nt, Homo sapiens
uugggaaaacauuugcu

SEQ ID NO: 966886 - RNA, 14 nt, Homo sapiens
uugggagcugccaa

SEQ ID NO: 966887 - RNA, 14 nt, Homo sapiens
uugggcaacagagc

SEQ ID NO: 966888 - RNA, 13 nt, Homo sapiens
uugggcacagucc

SEQ ID NO: 966889 - RNA, 13 nt, Homo sapiens
uugggcaugccau

SEQ ID NO: 966890 - RNA, 12 nt, Homo sapiens
uugggcucugau

SEQ ID NO: 966891 - RNA, 14 nt, Homo sapiens
uugggcuggaugau

SEQ ID NO: 966892 - RNA, 21 nt, Homo sapiens
uuggggaaaauggccaugcag

SEQ ID NO: 966893 - RNA, 15 nt, Homo sapiens
uuggggccaccaaag

SEQ ID NO: 966894 - RNA, 13 nt, Homo sapiens
uuggggucucuuu

SEQ ID NO: 966895 - RNA, 22 nt, Homo sapiens
uugguaagauugcacuguucug

SEQ ID NO: 966896 - RNA, 23 nt, Homo sapiens
uuggugaaucgguuguucuuucc

SEQ ID NO: 966897 - RNA, 21 nt, Homo sapiens
uuggugcacagacaagcccuu

SEQ ID NO: 966898 - RNA, 16 nt, Homo sapiens
uuguacagaauauuuc

SEQ ID NO: 966899 - RNA, 18 nt, Homo sapiens
uuguccugagauggaaaa

SEQ ID NO: 966900 - RNA, 16 nt, Homo sapiens
uugugauuucuuuaaa

SEQ ID NO: 966901 - RNA, 17 nt, Homo sapiens
uuguggguccaugcuaa

SEQ ID NO: 966902 - RNA, 13 nt, Homo sapiens
uuguuaaugcuuu

SEQ ID NO: 966903 - RNA, 19 nt, Homo sapiens
uuguucaaaauaaugaagu

SEQ ID NO: 966904 - RNA, 17 nt, Homo sapiens
uuguuggaaaguaacug

SEQ ID NO: 966905 - RNA, 15 nt, Homo sapiens
uuguuggaugaaauu

SEQ ID NO: 966906 - RNA, 15 nt, Homo sapiens
uuguuguucuuucag

SEQ ID NO: 966907 - RNA, 20 nt, Homo sapiens
uuguuuguccuuuauguauu

SEQ ID NO: 966908 - RNA, 20 nt, Homo sapiens
uuguuuuuaaguccuguaua

SEQ ID NO: 966909 - RNA, 12 nt, Homo sapiens
uuuaaaacaaag

SEQ ID NO: 966910 - RNA, 13 nt, Homo sapiens
uuuaaaacaaaga

SEQ ID NO: 966911 - RNA, 13 nt, Homo sapiens
uuuaaaauuucau

SEQ ID NO: 966912 - RNA, 15 nt, Homo sapiens
uuuaaauucuagugu

SEQ ID NO: 966913 - RNA, 17 nt, Homo sapiens
uuuaauauacuccuuaa

SEQ ID NO: 966914 - RNA, 13 nt, Homo sapiens
uuuaauuuugaca

SEQ ID NO: 966915 - RNA, 19 nt, Homo sapiens
uuuacaagggcauaaagua

SEQ ID NO: 966916 - RNA, 17 nt, Homo sapiens
uuuacaguaaauguuac

SEQ ID NO: 966917 - RNA, 17 nt, Homo sapiens
uuuacucaucaggucau

SEQ ID NO: 966918 - RNA, 14 nt, Homo sapiens
uuuagaaacuacaa

SEQ ID NO: 966919 - RNA, 18 nt, Homo sapiens
uuuagagauuauaacaaa

SEQ ID NO: 966920 - RNA, 18 nt, Homo sapiens
uuuagccauuuucuuuaa

SEQ ID NO: 966921 - RNA, 14 nt, Homo sapiens
uuuaguaguuuaau

SEQ ID NO: 966922 - RNA, 13 nt, Homo sapiens
uuuagucaucgaa

SEQ ID NO: 966923 - RNA, 18 nt, Homo sapiens
uuuauagaggcuagcuuc

SEQ ID NO: 966924 - RNA, 23 nt, Homo sapiens
uuuauguaaaaccaacaaaaaga

SEQ ID NO: 966925 - RNA, 12 nt, Homo sapiens
uuuauuacaacu

SEQ ID NO: 966926 - RNA, 20 nt, Homo sapiens
uuuauugaguaccuacugug

SEQ ID NO: 966927 - RNA, 20 nt, Homo sapiens
uuuauuggcugagauaugaa

SEQ ID NO: 966928 - RNA, 14 nt, Homo sapiens
uuuauuuccacuaa

SEQ ID NO: 966929 - RNA, 22 nt, Homo sapiens
uuucaaaagguauuauacaugu

SEQ ID NO: 966930 - RNA, 13 nt, Homo sapiens
uuucaccuguaaa

SEQ ID NO: 966931 - RNA, 14 nt, Homo sapiens
uuucaggauauaau

SEQ ID NO: 966932 - RNA, 14 nt, Homo sapiens
uuucaugacauaau

SEQ ID NO: 966933 - RNA, 21 nt, Homo sapiens
uuuccacacuuaaauucucua

SEQ ID NO: 966934 - RNA, 22 nt, Homo sapiens
uuuccauauagcucgagcaaaa

SEQ ID NO: 966935 - RNA, 17 nt, Homo sapiens
uuuccgugcguggcacu

SEQ ID NO: 966936 - RNA, 16 nt, Homo sapiens
uuuccuaggaggaaaa

SEQ ID NO: 966937 - RNA, 21 nt, Homo sapiens
uuuccuaggaggaaaauucca

SEQ ID NO: 966938 - RNA, 16 nt, Homo sapiens
uuuccuuuaugugaau

SEQ ID NO: 966939 - RNA, 17 nt, Homo sapiens
uuuccuuuaugugaauu

SEQ ID NO: 966940 - RNA, 16 nt, Homo sapiens
uuucuaaagacuugua

SEQ ID NO: 966941 - RNA, 15 nt, Homo sapiens
uuucucccccuaguu

SEQ ID NO: 966942 - RNA, 18 nt, Homo sapiens
uuucucucagauuuccac

SEQ ID NO: 966943 - RNA, 17 nt, Homo sapiens
uuucugacucugagcua

SEQ ID NO: 966944 - RNA, 20 nt, Homo sapiens
uuucugaggugcacugggag

SEQ ID NO: 966945 - RNA, 19 nt, Homo sapiens
uuucugcgggucauauuca

SEQ ID NO: 966946 - RNA, 22 nt, Homo sapiens
uuucuggugaaaaaagccagcc

SEQ ID NO: 966947 - RNA, 21 nt, Homo sapiens
uuucuugcuucauaugacaaa

SEQ ID NO: 966948 - RNA, 18 nt, Homo sapiens
uuugaaacaaaguacucu

SEQ ID NO: 966949 - RNA, 14 nt, Homo sapiens
uuugaauacuaaau

SEQ ID NO: 966950 - RNA, 15 nt, Homo sapiens
uuugaauucugugau

SEQ ID NO: 966951 - RNA, 19 nt, Homo sapiens
uuugacuuugcccaggcau

SEQ ID NO: 966952 - RNA, 17 nt, Homo sapiens
uuugagagaaauaugaa

SEQ ID NO: 966953 - RNA, 21 nt, Homo sapiens
uuugauaccuguaguggaacu

SEQ ID NO: 966954 - RNA, 22 nt, Homo sapiens
uuugcaacugucucucuucuca

SEQ ID NO: 966955 - RNA, 11 nt, Homo sapiens
uuugcacagaa

SEQ ID NO: 966956 - RNA, 15 nt, Homo sapiens
uuugcaugcaugcaa

SEQ ID NO: 966957 - RNA, 18 nt, Homo sapiens
uuugccaggacaugcaau

SEQ ID NO: 966958 - RNA, 15 nt, Homo sapiens
uuugccucauaauag

SEQ ID NO: 966959 - RNA, 14 nt, Homo sapiens
uuuggcaaugcuaa

SEQ ID NO: 966960 - RNA, 17 nt, Homo sapiens
uuuggccccacuuugaa

SEQ ID NO: 966961 - RNA, 15 nt, Homo sapiens
uuuggcgaaucucaa

SEQ ID NO: 966962 - RNA, 19 nt, Homo sapiens
uuuggcuuaaaccagaacc

SEQ ID NO: 966963 - RNA, 21 nt, Homo sapiens
uuugggagcacggacugucag

SEQ ID NO: 966964 - RNA, 17 nt, Homo sapiens
uuuggggacucauuuca

SEQ ID NO: 966965 - RNA, 12 nt, Homo sapiens
uuugguacuaau

SEQ ID NO: 966966 - RNA, 17 nt, Homo sapiens
uuuguagcguacaucaa

SEQ ID NO: 966967 - RNA, 19 nt, Homo sapiens
uuuguagcucuggaccugu

SEQ ID NO: 966968 - RNA, 12 nt, Homo sapiens
uuuuaaaacaca

SEQ ID NO: 966969 - RNA, 17 nt, Homo sapiens
uuuuaacucaccucuca

SEQ ID NO: 966970 - RNA, 15 nt, Homo sapiens
uuuuaagcugcaaau

SEQ ID NO: 966971 - RNA, 13 nt, Homo sapiens
uuuuaauggaugg

SEQ ID NO: 966972 - RNA, 15 nt, Homo sapiens
uuuuacuacaguaaa

SEQ ID NO: 966973 - RNA, 15 nt, Homo sapiens
uuuuagaaaugagau

SEQ ID NO: 966974 - RNA, 13 nt, Homo sapiens
uuuuaguugucaa

SEQ ID NO: 966975 - RNA, 14 nt, Homo sapiens
uuuuauauuuucac

SEQ ID NO: 966976 - RNA, 13 nt, Homo sapiens
uuuucaaaaccaa

SEQ ID NO: 966977 - RNA, 17 nt, Homo sapiens
uuuucacuuuauugcua

SEQ ID NO: 966978 - RNA, 20 nt, Homo sapiens
uuuucagacugugcaauacu

SEQ ID NO: 966979 - RNA, 11 nt, Homo sapiens
uuuucugcuaa

SEQ ID NO: 966980 - RNA, 16 nt, Homo sapiens
uuuucuucuugggaua

SEQ ID NO: 966981 - RNA, 13 nt, Homo sapiens
uuuugcaagugcu

SEQ ID NO: 966982 - RNA, 18 nt, Homo sapiens
uuuugguugggaaugagg

SEQ ID NO: 966983 - RNA, 23 nt, Homo sapiens
uuuugugacagagagagauucca

SEQ ID NO: 966984 - RNA, 12 nt, Homo sapiens
uuuuguguccuc

SEQ ID NO: 966985 - RNA, 18 nt, Homo sapiens
uuuuuccucccagugaga

SEQ ID NO: 966986 - RNA, 15 nt, Homo sapiens
uuuuuggaaagucag

SEQ ID NO: 966987 - RNA, 17 nt, Homo sapiens
cacaugugacacauaug

SEQ ID NO: 966988 - RNA, 22 nt, Homo sapiens
cacauugucaccccaagccaua

SEQ ID NO: 966989 - RNA, 20 nt, Homo sapiens
cacauuucuuugcauuccag

SEQ ID NO: 966990 - RNA, 14 nt, Homo sapiens
caccaaagcugccc

SEQ ID NO: 966991 - RNA, 15 nt, Homo sapiens
caccaaguuaccuac

SEQ ID NO: 966992 - RNA, 17 nt, Homo sapiens
caccaaucauaguguac

SEQ ID NO: 966993 - RNA, 23 nt, Homo sapiens
caccaccuggggagagccugcuu

SEQ ID NO: 966994 - RNA, 15 nt, Homo sapiens
caccagcaacauuau

SEQ ID NO: 966995 - RNA, 20 nt, Homo sapiens
caccaugaugugaagaguuu

SEQ ID NO: 966996 - RNA, 17 nt, Homo sapiens
cacccaccaccugaagc

SEQ ID NO: 966997 - RNA, 19 nt, Homo sapiens
cacccagagggaguagaau

SEQ ID NO: 966998 - RNA, 21 nt, Homo sapiens
caccccaagagaacucgcgcu

SEQ ID NO: 966999 - RNA, 14 nt, Homo sapiens
cacccccgugucca

SEQ ID NO: 967000 - RNA, 21 nt, Homo sapiens
caccccggggacccugugaca

SEQ ID NO: 967001 - RNA, 17 nt, Homo sapiens
caccccuauggugcuca

SEQ ID NO: 967002 - RNA, 16 nt, Homo sapiens
cacccucuuccuguga

SEQ ID NO: 967003 - RNA, 14 nt, Homo sapiens
cacccugcgggcca

SEQ ID NO: 967004 - RNA, 22 nt, Homo sapiens
caccucacgcucuggacaugau

SEQ ID NO: 967005 - RNA, 13 nt, Homo sapiens
caccuggccaagc

SEQ ID NO: 967006 - RNA, 17 nt, Homo sapiens
caccuugccuugcuguu

SEQ ID NO: 967007 - RNA, 13 nt, Homo sapiens
caccuuugcacgu

SEQ ID NO: 967008 - RNA, 15 nt, Homo sapiens
caccuuugccauuga

SEQ ID NO: 967009 - RNA, 16 nt, Homo sapiens
cacgaccauuugauag

SEQ ID NO: 967010 - RNA, 14 nt, Homo sapiens
cacgagcaaaccca

SEQ ID NO: 967011 - RNA, 11 nt, Homo sapiens
cacgaugcauu

SEQ ID NO: 967012 - RNA, 14 nt, Homo sapiens
cacgaugcauuuaa

SEQ ID NO: 967013 - RNA, 20 nt, Homo sapiens
cacgaugcauuuaauaaaga

SEQ ID NO: 967014 - RNA, 13 nt, Homo sapiens
cacgccuacuuaa

SEQ ID NO: 967015 - RNA, 15 nt, Homo sapiens
cacgcucgcugccau

SEQ ID NO: 967016 - RNA, 14 nt, Homo sapiens
cacggcagcucucc

SEQ ID NO: 967017 - RNA, 19 nt, Homo sapiens
cacggcuaggaagcagcug

SEQ ID NO: 967018 - RNA, 15 nt, Homo sapiens
cacggugggagaccu

SEQ ID NO: 967019 - RNA, 19 nt, Homo sapiens
cacggugggagaccugcug

SEQ ID NO: 967020 - RNA, 13 nt, Homo sapiens
cacguguccugua

SEQ ID NO: 967021 - RNA, 22 nt, Homo sapiens
cacuaacuuaauguguauucau

SEQ ID NO: 967022 - RNA, 23 nt, Homo sapiens
cacuaagauaaauucaugcacuu

SEQ ID NO: 967023 - RNA, 15 nt, Homo sapiens
cacuagaaugcaagu

SEQ ID NO: 967024 - RNA, 16 nt, Homo sapiens
cacuagaaugcaagua

SEQ ID NO: 967025 - RNA, 19 nt, Homo sapiens
cacuagaggaaaccaguuu

SEQ ID NO: 967026 - RNA, 18 nt, Homo sapiens
cacuagggcagccgagug

SEQ ID NO: 967027 - RNA, 13 nt, Homo sapiens
cacuaucacuuua

SEQ ID NO: 967028 - RNA, 22 nt, Homo sapiens
cacucacucucccccuccucuu

SEQ ID NO: 967029 - RNA, 15 nt, Homo sapiens
cacucaguucuuccu

SEQ ID NO: 967030 - RNA, 23 nt, Homo sapiens
cacucgucuuucccuuuaccacu

SEQ ID NO: 967031 - RNA, 20 nt, Homo sapiens
cacucuacuaaugccucuuc

SEQ ID NO: 967032 - RNA, 17 nt, Homo sapiens
cacucucccuggagcug

SEQ ID NO: 967033 - RNA, 15 nt, Homo sapiens
cacucuucuugagca

SEQ ID NO: 967034 - RNA, 21 nt, Homo sapiens
cacugaaacugguugaagggu

SEQ ID NO: 967035 - RNA, 19 nt, Homo sapiens
cacugaggagauacugaac

SEQ ID NO: 967036 - RNA, 20 nt, Homo sapiens
cacugcccacaugggaccug

SEQ ID NO: 967037 - RNA, 16 nt, Homo sapiens
cacugggacacuguca

SEQ ID NO: 967038 - RNA, 20 nt, Homo sapiens
cacuguacaagguaccccuu

SEQ ID NO: 967039 - RNA, 22 nt, Homo sapiens
cacugucaccacccugcucauc

SEQ ID NO: 967040 - RNA, 15 nt, Homo sapiens
cacuuaaccauucca

SEQ ID NO: 967041 - RNA, 12 nt, Homo sapiens
cacuuacaauuu

SEQ ID NO: 967042 - RNA, 13 nt, Homo sapiens
cacuuaguuauuu

SEQ ID NO: 967043 - RNA, 14 nt, Homo sapiens
cacuuccagagcca

SEQ ID NO: 967044 - RNA, 23 nt, Homo sapiens
cacuuccagagccagaaagggug

SEQ ID NO: 967045 - RNA, 21 nt, Homo sapiens
cacuucucucuccccaucccc

SEQ ID NO: 967046 - RNA, 21 nt, Homo sapiens
cacuuuaauuaccaaccuguu

SEQ ID NO: 967047 - RNA, 23 nt, Homo sapiens
cacuuuaucuauaucucauuuca

SEQ ID NO: 967048 - RNA, 22 nt, Homo sapiens
cacuuuguugcaagaugugaau

SEQ ID NO: 967049 - RNA, 15 nt, Homo sapiens
cacuuuucccacucc

SEQ ID NO: 967050 - RNA, 19 nt, Homo sapiens
cagaaaaaaaagugucuca

SEQ ID NO: 967051 - RNA, 15 nt, Homo sapiens
cagaaacuuggaugu

SEQ ID NO: 967052 - RNA, 20 nt, Homo sapiens
cagaaagagacuccgucuca

SEQ ID NO: 967053 - RNA, 14 nt, Homo sapiens
cagaaagcuuugaa

SEQ ID NO: 967054 - RNA, 21 nt, Homo sapiens
cagaaagcuuugaauacuaaa

SEQ ID NO: 967055 - RNA, 19 nt, Homo sapiens
cagaacagcuucagguuau

SEQ ID NO: 967056 - RNA, 18 nt, Homo sapiens
cagaacucccauuacaac

SEQ ID NO: 967057 - RNA, 15 nt, Homo sapiens
cagaagcaagccaga

SEQ ID NO: 967058 - RNA, 18 nt, Homo sapiens
cagaagccccauguguac

SEQ ID NO: 967059 - RNA, 18 nt, Homo sapiens
cagaagcucccagcugac

SEQ ID NO: 967060 - RNA, 18 nt, Homo sapiens
cagaauuuggguugacuc

SEQ ID NO: 967061 - RNA, 20 nt, Homo sapiens
cagacaaaauuugagaauac

SEQ ID NO: 967062 - RNA, 19 nt, Homo sapiens
cagacaaagcauaaucaau

SEQ ID NO: 967063 - RNA, 17 nt, Homo sapiens
cagaccaguacugggaa

SEQ ID NO: 967064 - RNA, 22 nt, Homo sapiens
cagacccaguggacucuuccac

SEQ ID NO: 967065 - RNA, 20 nt, Homo sapiens
cagacuaaaggauccagaga

SEQ ID NO: 967066 - RNA, 14 nt, Homo sapiens
cagacugugcaaua

SEQ ID NO: 967067 - RNA, 20 nt, Homo sapiens
cagacugugcaauacuuaga

SEQ ID NO: 967068 - RNA, 15 nt, Homo sapiens
cagacuuaacagccc

SEQ ID NO: 967069 - RNA, 19 nt, Homo sapiens
cagacuuuguguucauuuc

SEQ ID NO: 967070 - RNA, 18 nt, Homo sapiens
cagagaaacuuaagcaaa

SEQ ID NO: 967071 - RNA, 15 nt, Homo sapiens
cagagaaauucugug

SEQ ID NO: 967072 - RNA, 22 nt, Homo sapiens
cagagagaggggagaagccugg

SEQ ID NO: 967073 - RNA, 23 nt, Homo sapiens
cagagagccauuuugugaaugga

SEQ ID NO: 967074 - RNA, 20 nt, Homo sapiens
cagagcaagacuccaucuca

SEQ ID NO: 967075 - RNA, 14 nt, Homo sapiens
cagagcaagacugu

SEQ ID NO: 967076 - RNA, 18 nt, Homo sapiens
cagagcaagacugucuca

SEQ ID NO: 967077 - RNA, 23 nt, Homo sapiens
caguuuuaccucuucucucucag

SEQ ID NO: 967078 - RNA, 14 nt, Homo sapiens
caguuuuuggcaaa

SEQ ID NO: 967079 - RNA, 19 nt, Homo sapiens
caguuuuuggcaaaaaaca

SEQ ID NO: 967080 - RNA, 20 nt, Homo sapiens
cauaaacgguuccuggugac

SEQ ID NO: 967081 - RNA, 21 nt, Homo sapiens
cauaaacgguuccuggugacu

SEQ ID NO: 967082 - RNA, 16 nt, Homo sapiens
cauaaaggacaggcca

SEQ ID NO: 967083 - RNA, 18 nt, Homo sapiens
cauaaauaaaguuucagc

SEQ ID NO: 967084 - RNA, 16 nt, Homo sapiens
cauaaauccuugauga

SEQ ID NO: 967085 - RNA, 17 nt, Homo sapiens
cauaagaggugaucucu

SEQ ID NO: 967086 - RNA, 22 nt, Homo sapiens
cauaauugcuguucugcugaau

SEQ ID NO: 967087 - RNA, 15 nt, Homo sapiens
cauaauuuaaaaaua

SEQ ID NO: 967088 - RNA, 16 nt, Homo sapiens
cauacacuuauuggaa

SEQ ID NO: 967089 - RNA, 13 nt, Homo sapiens
cauagaggcuucu

SEQ ID NO: 967090 - RNA, 18 nt, Homo sapiens
cauagcgaagaccaguau

SEQ ID NO: 967091 - RNA, 20 nt, Homo sapiens
cauagguuaaaaaaaaaagu

SEQ ID NO: 967092 - RNA, 18 nt, Homo sapiens
cauaguggaucacucacc

SEQ ID NO: 967093 - RNA, 13 nt, Homo sapiens
cauauaaacucau

SEQ ID NO: 967094 - RNA, 15 nt, Homo sapiens
cauauccugagccau

SEQ ID NO: 967095 - RNA, 14 nt, Homo sapiens
cauaugcccucauc

SEQ ID NO: 967096 - RNA, 14 nt, Homo sapiens
cauauguugcaaga

SEQ ID NO: 967097 - RNA, 14 nt, Homo sapiens
cauauuuaaaacaa

SEQ ID NO: 967098 - RNA, 20 nt, Homo sapiens
cauauuuuuuuuacugucag

SEQ ID NO: 967099 - RNA, 19 nt, Homo sapiens
caucaaauaaacucaaagu

SEQ ID NO: 967100 - RNA, 17 nt, Homo sapiens
caucaacagcagggugg

SEQ ID NO: 967101 - RNA, 21 nt, Homo sapiens
caucaaugauaaugcuaauuu

SEQ ID NO: 967102 - RNA, 11 nt, Homo sapiens
caucaccacug

SEQ ID NO: 967103 - RNA, 21 nt, Homo sapiens
caucacccucuuccugugauc

SEQ ID NO: 967104 - RNA, 23 nt, Homo sapiens
caucagcucccugaggaccaccu

SEQ ID NO: 967105 - RNA, 16 nt, Homo sapiens
ccaaggacucuuccac

SEQ ID NO: 967106 - RNA, 19 nt, Homo sapiens
ccaaggaggggcuguaaaa

SEQ ID NO: 967107 - RNA, 18 nt, Homo sapiens
ccaaggguugagagccag

SEQ ID NO: 967108 - RNA, 14 nt, Homo sapiens
ccaagguaggcaga

SEQ ID NO: 967109 - RNA, 22 nt, Homo sapiens
ccaaguuaccuacaagaacaau

SEQ ID NO: 967110 - RNA, 18 nt, Homo sapiens
ccaauagggcugagcucu

SEQ ID NO: 967111 - RNA, 19 nt, Homo sapiens
ccaauagggcugagcucuc

SEQ ID NO: 967112 - RNA, 11 nt, Homo sapiens
ccaauaucaug

SEQ ID NO: 967113 - RNA, 16 nt, Homo sapiens
ccaauugcucuuucac

SEQ ID NO: 967114 - RNA, 22 nt, Homo sapiens
ccaauuucucucagauuuccac

SEQ ID NO: 967115 - RNA, 20 nt, Homo sapiens
ccacaaccuuccagcuccau

SEQ ID NO: 967116 - RNA, 19 nt, Homo sapiens
ccacaagccaggaccugcu

SEQ ID NO: 967117 - RNA, 13 nt, Homo sapiens
ccacaagccauuu

SEQ ID NO: 967118 - RNA, 14 nt, Homo sapiens
ccacaauggucuca

SEQ ID NO: 967119 - RNA, 14 nt, Homo sapiens
ccacacuuuguaca

SEQ ID NO: 967120 - RNA, 22 nt, Homo sapiens
ccacagauuuauacaaggguua

SEQ ID NO: 967121 - RNA, 19 nt, Homo sapiens
ccacagccacuaagauaaa

SEQ ID NO: 967122 - RNA, 18 nt, Homo sapiens
ccacagcugcuguucuca

SEQ ID NO: 967123 - RNA, 17 nt, Homo sapiens
ccacaggucaucagaug

SEQ ID NO: 967124 - RNA, 23 nt, Homo sapiens
ccacaucugccuuaaaaccaaag

SEQ ID NO: 967125 - RNA, 19 nt, Homo sapiens
ccacaugggugcauuugua

SEQ ID NO: 967126 - RNA, 19 nt, Homo sapiens
ccacaugugacacauaugc

SEQ ID NO: 967127 - RNA, 20 nt, Homo sapiens
ccacaugugacacauaugca

SEQ ID NO: 967128 - RNA, 22 nt, Homo sapiens
ccacaugugacacauaugcacc

SEQ ID NO: 967129 - RNA, 18 nt, Homo sapiens
ccaccaaagcugcccacu

SEQ ID NO: 967130 - RNA, 16 nt, Homo sapiens
ccacccauaccacagc

SEQ ID NO: 967131 - RNA, 21 nt, Homo sapiens
ccacccuagccaaugucuccu

SEQ ID NO: 967132 - RNA, 21 nt, Homo sapiens
ccaccuacuuuucuuuccuca

SEQ ID NO: 967133 - RNA, 17 nt, Homo sapiens
ccacgauucucccaaag

SEQ ID NO: 967134 - RNA, 14 nt, Homo sapiens
ccacgcccugucua

SEQ ID NO: 967135 - RNA, 18 nt, Homo sapiens
ccacggacgccaccugcg

SEQ ID NO: 967136 - RNA, 20 nt, Homo sapiens
ccacgggaaaggagcugcuu

SEQ ID NO: 967137 - RNA, 12 nt, Homo sapiens
ccuacagagcag

SEQ ID NO: 967138 - RNA, 15 nt, Homo sapiens
ccuacagagcagcca

SEQ ID NO: 967139 - RNA, 20 nt, Homo sapiens
ccuacagcuacauugagaua

SEQ ID NO: 967140 - RNA, 14 nt, Homo sapiens
ccuaccagcagcug

SEQ ID NO: 967141 - RNA, 19 nt, Homo sapiens
ccuacuagucaccagagac

SEQ ID NO: 967142 - RNA, 19 nt, Homo sapiens
ccuacuuugacuuuuugca

SEQ ID NO: 967143 - RNA, 15 nt, Homo sapiens
ccuagacaaaccauc

SEQ ID NO: 967144 - RNA, 23 nt, Homo sapiens
ccuagggaauggucccagcacga

SEQ ID NO: 967145 - RNA, 23 nt, Homo sapiens
ccuaguuugugagaaacaucuca

SEQ ID NO: 967146 - RNA, 12 nt, Homo sapiens
ccuauaagcuua

SEQ ID NO: 967147 - RNA, 19 nt, Homo sapiens
ccuauagcacugagcucac

SEQ ID NO: 967148 - RNA, 18 nt, Homo sapiens
ccuauagcaucuucucau

SEQ ID NO: 967149 - RNA, 22 nt, Homo sapiens
ccuauagcaucuucucauuccc

SEQ ID NO: 967150 - RNA, 18 nt, Homo sapiens
ccuaucagaagcucccag

SEQ ID NO: 967151 - RNA, 12 nt, Homo sapiens
ccuauuugccau

SEQ ID NO: 967152 - RNA, 18 nt, Homo sapiens
ccucaagggccaggacuu

SEQ ID NO: 967153 - RNA, 22 nt, Homo sapiens
ccucacaaaccugaauggucug

SEQ ID NO: 967154 - RNA, 23 nt, Homo sapiens
ccucacauuuggaugauugucau

SEQ ID NO: 967155 - RNA, 14 nt, Homo sapiens
ccucagaaagggau

SEQ ID NO: 967156 - RNA, 20 nt, Homo sapiens
ccucagcggacaagcagcug

SEQ ID NO: 967157 - RNA, 20 nt, Homo sapiens
ccucagugccccauucucac

SEQ ID NO: 967158 - RNA, 16 nt, Homo sapiens
ccucaugauauguccu

SEQ ID NO: 967159 - RNA, 16 nt, Homo sapiens
ccuccaaaggucugau

SEQ ID NO: 967160 - RNA, 22 nt, Homo sapiens
ccuccaaggaggggcuguaaaa

SEQ ID NO: 967161 - RNA, 12 nt, Homo sapiens
ccuccaguucau

SEQ ID NO: 967162 - RNA, 14 nt, Homo sapiens
ccuccauuccccac

SEQ ID NO: 967163 - RNA, 15 nt, Homo sapiens
ccuccucaguaugug

SEQ ID NO: 967164 - RNA, 20 nt, Homo sapiens
ccuccucgugaaagugcauu

SEQ ID NO: 967165 - RNA, 20 nt, Homo sapiens
ccuccucugccuacagccag

SEQ ID NO: 967166 - RNA, 19 nt, Homo sapiens
ccuccugaaccgcacagcu

SEQ ID NO: 967167 - RNA, 12 nt, Homo sapiens
ccucggugggag

SEQ ID NO: 967168 - RNA, 15 nt, Homo sapiens
ccucuagaagccaag

SEQ ID NO: 967169 - RNA, 14 nt, Homo sapiens
ccucuaguaguaua

SEQ ID NO: 967170 - RNA, 19 nt, Homo sapiens
ccucucagaacauacugau

SEQ ID NO: 967171 - RNA, 23 nt, Homo sapiens
ccucuccuacucggcucugcagu

SEQ ID NO: 967172 - RNA, 17 nt, Homo sapiens
ccucuccuuugugacuu

SEQ ID NO: 967173 - RNA, 23 nt, Homo sapiens
ccucucuagcacaauuugcacua

SEQ ID NO: 967174 - RNA, 12 nt, Homo sapiens
ccucucuggaaa

SEQ ID NO: 967175 - RNA, 19 nt, Homo sapiens
ccucuggacagccagugac

SEQ ID NO: 967176 - RNA, 13 nt, Homo sapiens
ccucuucuacuca

SEQ ID NO: 967177 - RNA, 10 nt, Homo sapiens
ccucuugccu

SEQ ID NO: 967178 - RNA, 22 nt, Homo sapiens
ccugacagaaggugccacuuua

SEQ ID NO: 967179 - RNA, 14 nt, Homo sapiens
ccugagauccugca

SEQ ID NO: 967180 - RNA, 20 nt, Homo sapiens
ccugagcaaaaagaccagcc

SEQ ID NO: 967181 - RNA, 13 nt, Homo sapiens
ccugagcuaaaua

SEQ ID NO: 967182 - RNA, 15 nt, Homo sapiens
ccugaggaccaccuc

SEQ ID NO: 967183 - RNA, 22 nt, Homo sapiens
ccugaguaauaagcaugguguc

SEQ ID NO: 967184 - RNA, 15 nt, Homo sapiens
ccugagucagugcuc

SEQ ID NO: 967185 - RNA, 19 nt, Homo sapiens
ccugcagaccucaagccau

SEQ ID NO: 967186 - RNA, 14 nt, Homo sapiens
ccugccauagucuu

SEQ ID NO: 967187 - RNA, 17 nt, Homo sapiens
ccugccccagcacucac

SEQ ID NO: 967188 - RNA, 23 nt, Homo sapiens
ccugccucccacuucacugcgaa

SEQ ID NO: 967189 - RNA, 14 nt, Homo sapiens
ccugcuccuggagu

SEQ ID NO: 967190 - RNA, 16 nt, Homo sapiens
ccugcucuucccucau

SEQ ID NO: 967191 - RNA, 18 nt, Homo sapiens
ccugcugaacacaguguc

SEQ ID NO: 967192 - RNA, 18 nt, Homo sapiens
ccugcugccugcugagau

SEQ ID NO: 967193 - RNA, 16 nt, Homo sapiens
ccugcugggggcagca

SEQ ID NO: 967194 - RNA, 22 nt, Homo sapiens
ccugcugggggcagcaguacca

SEQ ID NO: 967195 - RNA, 18 nt, Homo sapiens
ccuggaaucuacaagcca

SEQ ID NO: 967196 - RNA, 17 nt, Homo sapiens
ccuggauugggagaccu

SEQ ID NO: 967197 - RNA, 15 nt, Homo sapiens
ccuggcacacaucag

SEQ ID NO: 967198 - RNA, 18 nt, Homo sapiens
ccuggccaacauggcaaa

SEQ ID NO: 967199 - RNA, 13 nt, Homo sapiens
ccugggaacauca

SEQ ID NO: 967200 - RNA, 17 nt, Homo sapiens
ccuggggcagaaagcca

SEQ ID NO: 967201 - RNA, 12 nt, Homo sapiens
ccugggggccug

SEQ ID NO: 967202 - RNA, 15 nt, Homo sapiens
ccugguauauccaaa

SEQ ID NO: 967203 - RNA, 15 nt, Homo sapiens
ccuguagcucaguca

SEQ ID NO: 967204 - RNA, 15 nt, Homo sapiens
ccuguagucccagcu

SEQ ID NO: 967205 - RNA, 14 nt, Homo sapiens
ccugucaaauauca

SEQ ID NO: 967206 - RNA, 23 nt, Homo sapiens
ccuguuaccuacuuugacuuuuu

SEQ ID NO: 967207 - RNA, 12 nt, Homo sapiens
ccuguuccccaa

SEQ ID NO: 967208 - RNA, 22 nt, Homo sapiens
ccuguuccccaaggacucuucc

SEQ ID NO: 967209 - RNA, 19 nt, Homo sapiens
ccuguuuuaccguugcuaa

SEQ ID NO: 967210 - RNA, 15 nt, Homo sapiens
ccuuaaaccuaccuc

SEQ ID NO: 967211 - RNA, 14 nt, Homo sapiens
ucaacaacuuguga

SEQ ID NO: 967212 - RNA, 18 nt, Homo sapiens
ucaacacuuaagucucag

SEQ ID NO: 967213 - RNA, 17 nt, Homo sapiens
ucaaccacagauuuaua

SEQ ID NO: 967214 - RNA, 18 nt, Homo sapiens
ucaacccauuguugucaa

SEQ ID NO: 967215 - RNA, 17 nt, Homo sapiens
ucaagaaaaaaagggag

SEQ ID NO: 967216 - RNA, 13 nt, Homo sapiens
ucaagcacuccua

SEQ ID NO: 967217 - RNA, 20 nt, Homo sapiens
ucaagcuggaagaagugagc

SEQ ID NO: 967218 - RNA, 21 nt, Homo sapiens
ucaagcuggaagaagugagca

SEQ ID NO: 967219 - RNA, 19 nt, Homo sapiens
ucaaggcaguagaacucca

SEQ ID NO: 967220 - RNA, 13 nt, Homo sapiens
ucaaggugggccu

SEQ ID NO: 967221 - RNA, 11 nt, Homo sapiens
ucaaguaauau

SEQ ID NO: 967222 - RNA, 18 nt, Homo sapiens
ucaauaaagcacugagca

SEQ ID NO: 967223 - RNA, 15 nt, Homo sapiens
ucaauagaucuccag

SEQ ID NO: 967224 - RNA, 23 nt, Homo sapiens
ucaaucuagaacuuuucuauuaa

SEQ ID NO: 967225 - RNA, 16 nt, Homo sapiens
ucaauggcuuguucau

SEQ ID NO: 967226 - RNA, 12 nt, Homo sapiens
ucaaugggaccu

SEQ ID NO: 967227 - RNA, 13 nt, Homo sapiens
ucaaugggaccug

SEQ ID NO: 967228 - RNA, 13 nt, Homo sapiens
ucaaugucuuccc

SEQ ID NO: 967229 - RNA, 13 nt, Homo sapiens
ucaauuacuaauu

SEQ ID NO: 967230 - RNA, 13 nt, Homo sapiens
ucacaaagcuauu

SEQ ID NO: 967231 - RNA, 23 nt, Homo sapiens
ucacaagugguguuuauugcaau

SEQ ID NO: 967232 - RNA, 16 nt, Homo sapiens
ucacaauuaugugcaa

SEQ ID NO: 967233 - RNA, 16 nt, Homo sapiens
ucacacauuacaaagu

SEQ ID NO: 967234 - RNA, 17 nt, Homo sapiens
ucacacauuacaaaguu

SEQ ID NO: 967235 - RNA, 17 nt, Homo sapiens
ucacacugaagccacag

SEQ ID NO: 967236 - RNA, 18 nt, Homo sapiens
ucacagucucaguucucu

SEQ ID NO: 967237 - RNA, 22 nt, Homo sapiens
ucacauauucauauuguucaau

SEQ ID NO: 967238 - RNA, 20 nt, Homo sapiens
ucacauggccuaugcacaua

SEQ ID NO: 967239 - RNA, 23 nt, Homo sapiens
ucacauggccuaugcacauaugg

SEQ ID NO: 967240 - RNA, 16 nt, Homo sapiens
ucacauucauugcagu

SEQ ID NO: 967241 - RNA, 16 nt, Homo sapiens
ucacauuucuaugcca

SEQ ID NO: 967242 - RNA, 18 nt, Homo sapiens
ucacauuuuccuuuucaa

SEQ ID NO: 967243 - RNA, 15 nt, Homo sapiens
ucacauuuugccuuu

SEQ ID NO: 967244 - RNA, 21 nt, Homo sapiens
ucaccaaucauaguguaccca

SEQ ID NO: 967245 - RNA, 15 nt, Homo sapiens
ucaccacccugcuca

SEQ ID NO: 967246 - RNA, 13 nt, Homo sapiens
ucaccagaucuga

SEQ ID NO: 967247 - RNA, 18 nt, Homo sapiens
ucaccagccccacugcca

SEQ ID NO: 967248 - RNA, 19 nt, Homo sapiens
ucaccagccccacugccag

SEQ ID NO: 967249 - RNA, 23 nt, Homo sapiens
ucaccaugaugugaagaguuuca

SEQ ID NO: 967250 - RNA, 15 nt, Homo sapiens
ucaccccaagccaua

SEQ ID NO: 967251 - RNA, 17 nt, Homo sapiens
ucaccccuauggugcuc

SEQ ID NO: 967252 - RNA, 18 nt, Homo sapiens
ucaccuccaagcauuuca

SEQ ID NO: 967253 - RNA, 19 nt, Homo sapiens
ucaccuccaagcauuucau

SEQ ID NO: 967254 - RNA, 14 nt, Homo sapiens
ucacgccuacuuaa

SEQ ID NO: 967255 - RNA, 14 nt, Homo sapiens
ucacucauccaucc

SEQ ID NO: 967256 - RNA, 15 nt, Homo sapiens
ucacucauccauccc

SEQ ID NO: 967257 - RNA, 18 nt, Homo sapiens
ucacuccccacaucccau

SEQ ID NO: 967258 - RNA, 15 nt, Homo sapiens
ucacucuucaaggag

SEQ ID NO: 967259 - RNA, 14 nt, Homo sapiens
ucacugaaccacug

SEQ ID NO: 967260 - RNA, 18 nt, Homo sapiens
ucacugccugacauucac

SEQ ID NO: 967261 - RNA, 21 nt, Homo sapiens
ucacuggagguugaagccaag

SEQ ID NO: 967262 - RNA, 15 nt, Homo sapiens
ucagaaagauuugau

SEQ ID NO: 967263 - RNA, 23 nt, Homo sapiens
ucagaaagauuugaugggccaca

SEQ ID NO: 967264 - RNA, 16 nt, Homo sapiens
ucagaagugcccuucc

SEQ ID NO: 967265 - RNA, 12 nt, Homo sapiens
ucagacauacag

SEQ ID NO: 967266 - RNA, 18 nt, Homo sapiens
ucagaccaguacugggaa

SEQ ID NO: 967267 - RNA, 12 nt, Homo sapiens
ucagagcuaaac

SEQ ID NO: 967268 - RNA, 23 nt, Homo sapiens
ucagaugcuugcggcaaaaggaa

SEQ ID NO: 967269 - RNA, 21 nt, Homo sapiens
ucagcaaguuagaacuagcca

SEQ ID NO: 967270 - RNA, 12 nt, Homo sapiens
ucagcacaaaga

SEQ ID NO: 967271 - RNA, 16 nt, Homo sapiens
ucagcagugaaguaua

SEQ ID NO: 967272 - RNA, 22 nt, Homo sapiens
ucagcccagccccuccaaaggu

SEQ ID NO: 967273 - RNA, 21 nt, Homo sapiens
ucagccuagagaccauguuga

SEQ ID NO: 967274 - RNA, 17 nt, Homo sapiens
ucagccuaggcccucau

SEQ ID NO: 967275 - RNA, 19 nt, Homo sapiens
ucaggaaauaucugugaag

SEQ ID NO: 967276 - RNA, 17 nt, Homo sapiens
ucaggagaucgagacca

SEQ ID NO: 967277 - RNA, 16 nt, Homo sapiens
ucaggcagcacaucaa

SEQ ID NO: 967278 - RNA, 21 nt, Homo sapiens
ucagggacuugaaugcacuuu

SEQ ID NO: 967279 - RNA, 21 nt, Homo sapiens
ucagggggucuggaaagaagg

SEQ ID NO: 967280 - RNA, 16 nt, Homo sapiens
ucagguaguacuggga

SEQ ID NO: 967281 - RNA, 17 nt, Homo sapiens
ucagguaguacugggaa

SEQ ID NO: 967282 - RNA, 12 nt, Homo sapiens
ucaggugacaug

SEQ ID NO: 967283 - RNA, 12 nt, Homo sapiens
ucagguggugcc

SEQ ID NO: 967284 - RNA, 21 nt, Homo sapiens
ucagguuuguuuugugaauuu

SEQ ID NO: 967285 - RNA, 16 nt, Homo sapiens
ucaguaaaugugauuc

SEQ ID NO: 967286 - RNA, 15 nt, Homo sapiens
ucaguaagucucaua

SEQ ID NO: 967287 - RNA, 13 nt, Homo sapiens
ucaguauuguggg

SEQ ID NO: 967288 - RNA, 22 nt, Homo sapiens
ucagucauuucuucauguacag

SEQ ID NO: 967289 - RNA, 16 nt, Homo sapiens
ucagugugaugaauca

SEQ ID NO: 967290 - RNA, 21 nt, Homo sapiens
ucaguuacaguggcaguauug

SEQ ID NO: 967291 - RNA, 16 nt, Homo sapiens
ucaguuugacuacucu

SEQ ID NO: 967292 - RNA, 21 nt, Homo sapiens
ucauagucauugugguuuaga

SEQ ID NO: 967293 - RNA, 23 nt, Homo sapiens
ucaucaacgucucagcccuucag

SEQ ID NO: 967294 - RNA, 14 nt, Homo sapiens
ucaucaggucauua

SEQ ID NO: 967295 - RNA, 20 nt, Homo sapiens
ucaucaucccaggggagaac

SEQ ID NO: 967296 - RNA, 22 nt, Homo sapiens
ucauccacucuacuaaugccuc

SEQ ID NO: 967297 - RNA, 15 nt, Homo sapiens
ucauccugauacugu

SEQ ID NO: 967298 - RNA, 21 nt, Homo sapiens
ucaucuauuuuuggcagucug

SEQ ID NO: 967299 - RNA, 23 nt, Homo sapiens
ucaucuuagugccugagaguauu

SEQ ID NO: 967300 - RNA, 18 nt, Homo sapiens
ucaucuuccuguguccug

SEQ ID NO: 967301 - RNA, 19 nt, Homo sapiens
ucaugagcuuggacagcaa

SEQ ID NO: 967302 - RNA, 17 nt, Homo sapiens
ucaugauccaacuaaug

SEQ ID NO: 967303 - RNA, 16 nt, Homo sapiens
ucaugccuggagaaac

SEQ ID NO: 967304 - RNA, 22 nt, Homo sapiens
ucaugccuggagaaaccuucag

SEQ ID NO: 967305 - RNA, 15 nt, Homo sapiens
ucauggugcacugag

SEQ ID NO: 967306 - RNA, 21 nt, Homo sapiens
ucaugucuccucaugucuuau

SEQ ID NO: 967307 - RNA, 13 nt, Homo sapiens
uccacaagccauu

SEQ ID NO: 967308 - RNA, 14 nt, Homo sapiens
uccacagagacugu

SEQ ID NO: 967309 - RNA, 16 nt, Homo sapiens
uccacccagugauccc

SEQ ID NO: 967310 - RNA, 17 nt, Homo sapiens
uccacccagugauccca

SEQ ID NO: 967311 - RNA, 18 nt, Homo sapiens
uccacccuguccuaugac

SEQ ID NO: 967312 - RNA, 15 nt, Homo sapiens
uccaccuuguuacac

SEQ ID NO: 967313 - RNA, 22 nt, Homo sapiens
uccacuccugaccccucuccuc

SEQ ID NO: 967314 - RNA, 21 nt, Homo sapiens
uccagacaaugccagcauaaa

SEQ ID NO: 967315 - RNA, 14 nt, Homo sapiens
uccagagaugguca

SEQ ID NO: 967316 - RNA, 15 nt, Homo sapiens
uccagagauggucac

SEQ ID NO: 967317 - RNA, 16 nt, Homo sapiens
uccagaugugugcaau

SEQ ID NO: 967318 - RNA, 14 nt, Homo sapiens
uccagccugaacag

SEQ ID NO: 967319 - RNA, 16 nt, Homo sapiens
uccagccugggggaca

SEQ ID NO: 967320 - RNA, 20 nt, Homo sapiens
uccagcucuuuauuacauag

SEQ ID NO: 967321 - RNA, 20 nt, Homo sapiens
uccagcuugggcaacagagc

SEQ ID NO: 967322 - RNA, 22 nt, Homo sapiens
uccaggaauaggcauuugccua

SEQ ID NO: 967323 - RNA, 16 nt, Homo sapiens
uccaggccaaagugcc

SEQ ID NO: 967324 - RNA, 16 nt, Homo sapiens
uccagggacacacagc

SEQ ID NO: 967325 - RNA, 14 nt, Homo sapiens
uccaguacaguauu

SEQ ID NO: 967326 - RNA, 15 nt, Homo sapiens
uccaguacaguauuc

SEQ ID NO: 967327 - RNA, 16 nt, Homo sapiens
uccaguacaguauucu

SEQ ID NO: 967328 - RNA, 11 nt, Homo sapiens
uccagugccag

SEQ ID NO: 967329 - RNA, 23 nt, Homo sapiens
uccagugccaggccagugaccuc

SEQ ID NO: 967330 - RNA, 15 nt, Homo sapiens
uccauaaaguacaaa

SEQ ID NO: 967331 - RNA, 15 nt, Homo sapiens
uccauacacuuuguu

SEQ ID NO: 967332 - RNA, 14 nt, Homo sapiens
uccauagugcacua

SEQ ID NO: 967333 - RNA, 18 nt, Homo sapiens
uccauagugcacuagcau

SEQ ID NO: 967334 - RNA, 14 nt, Homo sapiens
uccauauaacaauu

SEQ ID NO: 967335 - RNA, 18 nt, Homo sapiens
uccauauaacaauucagu

SEQ ID NO: 967336 - RNA, 24 nt, Homo sapiens
uccauauaacaauucaguaacaaa

SEQ ID NO: 967337 - RNA, 14 nt, Homo sapiens
uccauauagcaaua

SEQ ID NO: 967338 - RNA, 16 nt, Homo sapiens
uccauccuuccaacau

SEQ ID NO: 967339 - RNA, 18 nt, Homo sapiens
uccauuaccuccauccau

SEQ ID NO: 967340 - RNA, 21 nt, Homo sapiens
uccauuccugaguuacuuccc

SEQ ID NO: 967341 - RNA, 13 nt, Homo sapiens
uccauucucugag

SEQ ID NO: 967342 - RNA, 14 nt, Homo sapiens
ucccaacucuugca

SEQ ID NO: 967343 - RNA, 21 nt, Homo sapiens
ucccaacucuugcacagucac

SEQ ID NO: 967344 - RNA, 14 nt, Homo sapiens
ucccaauaucaugu

SEQ ID NO: 967345 - RNA, 20 nt, Homo sapiens
ucccaauuaagaaauuccau

SEQ ID NO: 967346 - RNA, 17 nt, Homo sapiens
ucccacauccaacucca

SEQ ID NO: 967347 - RNA, 18 nt, Homo sapiens
ucccacaugggcccaggc

SEQ ID NO: 967348 - RNA, 16 nt, Homo sapiens
ucccacccacauguga

SEQ ID NO: 967349 - RNA, 17 nt, Homo sapiens
ucccacccacaugugac

SEQ ID NO: 967350 - RNA, 22 nt, Homo sapiens
ucccaccccaaccugcucuccu

SEQ ID NO: 967351 - RNA, 12 nt, Homo sapiens
ucccacucucau

SEQ ID NO: 967352 - RNA, 18 nt, Homo sapiens
ucccagaaacaucucugg

SEQ ID NO: 967353 - RNA, 21 nt, Homo sapiens
ucccagcacgaguggccaguu

SEQ ID NO: 967354 - RNA, 12 nt, Homo sapiens
ucccagcccagc

SEQ ID NO: 967355 - RNA, 15 nt, Homo sapiens
ucccagcugaccaga

SEQ ID NO: 967356 - RNA, 14 nt, Homo sapiens
ucccaggacucuga

SEQ ID NO: 967357 - RNA, 23 nt, Homo sapiens
ucccaggccagcaagcucuucac

SEQ ID NO: 967358 - RNA, 22 nt, Homo sapiens
ucccauuaaaaaugagauuucu

SEQ ID NO: 967359 - RNA, 20 nt, Homo sapiens
ucccauuuccugagaccaca

SEQ ID NO: 967360 - RNA, 15 nt, Homo sapiens
uccccaaaccauaaa

SEQ ID NO: 967361 - RNA, 14 nt, Homo sapiens
uccccacacugacc

SEQ ID NO: 967362 - RNA, 17 nt, Homo sapiens
uccccacccagucucau

SEQ ID NO: 967363 - RNA, 19 nt, Homo sapiens
uccccacccagucucaugu

SEQ ID NO: 967364 - RNA, 18 nt, Homo sapiens
uccccacccauaccacag

SEQ ID NO: 967365 - RNA, 23 nt, Homo sapiens
ucccccaccgguccagcuggccu

SEQ ID NO: 967366 - RNA, 14 nt, Homo sapiens
ucccccucuuucac

SEQ ID NO: 967367 - RNA, 17 nt, Homo sapiens
ucccccugcuugucuuc

SEQ ID NO: 967368 - RNA, 13 nt, Homo sapiens
uccccgugccaaa

SEQ ID NO: 967369 - RNA, 20 nt, Homo sapiens
uccccuccacucucuaccag

SEQ ID NO: 967370 - RNA, 24 nt, Homo sapiens
uccccugcuacaccuauuauccca

SEQ ID NO: 967371 - RNA, 15 nt, Homo sapiens
uccccuuucacaggu

SEQ ID NO: 967372 - RNA, 21 nt, Homo sapiens
ucccgagcuacucucuugcca

SEQ ID NO: 967373 - RNA, 20 nt, Homo sapiens
ucccgaguagcugggauuac

SEQ ID NO: 967374 - RNA, 14 nt, Homo sapiens
ucccgccaugcuca

SEQ ID NO: 967375 - RNA, 15 nt, Homo sapiens
ucccuaggaaacuca

SEQ ID NO: 967376 - RNA, 22 nt, Homo sapiens
ucccuaggaaacucacacuccc

SEQ ID NO: 967377 - RNA, 18 nt, Homo sapiens
ucccucccaggacucuga

SEQ ID NO: 967378 - RNA, 16 nt, Homo sapiens
ucccuucgacauugag

SEQ ID NO: 967379 - RNA, 12 nt, Homo sapiens
ucccuugagggc

SEQ ID NO: 967380 - RNA, 23 nt, Homo sapiens
ucccuugauggucucaagcuaug

SEQ ID NO: 967381 - RNA, 14 nt, Homo sapiens
uccggaggagacac

SEQ ID NO: 967382 - RNA, 20 nt, Homo sapiens
uccggauuucuaacaguccu

SEQ ID NO: 967383 - RNA, 21 nt, Homo sapiens
uccggcaaugcccugugcaug

SEQ ID NO: 967384 - RNA, 21 nt, Homo sapiens
uccguucuauuuugugaauuu

SEQ ID NO: 967385 - RNA, 12 nt, Homo sapiens
uccuacacuuga

SEQ ID NO: 967386 - RNA, 18 nt, Homo sapiens
uccuacuggucucucuau

SEQ ID NO: 967387 - RNA, 13 nt, Homo sapiens
uccuauaagcuua

SEQ ID NO: 967388 - RNA, 17 nt, Homo sapiens
uccuccaccgucuuucu

SEQ ID NO: 967389 - RNA, 21 nt, Homo sapiens
uccuccagcccagacccagug

SEQ ID NO: 967390 - RNA, 14 nt, Homo sapiens
uccucccagugaga

SEQ ID NO: 967391 - RNA, 11 nt, Homo sapiens
uccuccccaaa

SEQ ID NO: 967392 - RNA, 16 nt, Homo sapiens
uccuccguccauauca

SEQ ID NO: 967393 - RNA, 14 nt, Homo sapiens
uccuccuacuuaca

SEQ ID NO: 967394 - RNA, 14 nt, Homo sapiens
uccuccugccucag

SEQ ID NO: 967395 - RNA, 17 nt, Homo sapiens
uccucgugaaagugcau

SEQ ID NO: 967396 - RNA, 19 nt, Homo sapiens
uccucucccauccuugaug

SEQ ID NO: 967397 - RNA, 14 nt, Homo sapiens
uccucuugugauuu

SEQ ID NO: 967398 - RNA, 13 nt, Homo sapiens
uccugaaaguguu

SEQ ID NO: 967399 - RNA, 17 nt, Homo sapiens
uccugaagagcauuugg

SEQ ID NO: 967400 - RNA, 14 nt, Homo sapiens
uccugccuacccag

SEQ ID NO: 967401 - RNA, 18 nt, Homo sapiens
uccugcuuaaucuucaaa

SEQ ID NO: 967402 - RNA, 20 nt, Homo sapiens
ucuucaugaguagugggcua

SEQ ID NO: 967403 - RNA, 18 nt, Homo sapiens
ucuuccaacaugugaugu

SEQ ID NO: 967404 - RNA, 21 nt, Homo sapiens
ucuucccucacuuuucccagg

SEQ ID NO: 967405 - RNA, 21 nt, Homo sapiens
ucuucccucauuaaauugcuu

SEQ ID NO: 967406 - RNA, 19 nt, Homo sapiens
ucuucuauuaaucaagaga

SEQ ID NO: 967407 - RNA, 12 nt, Homo sapiens
ucuucucauucc

SEQ ID NO: 967408 - RNA, 14 nt, Homo sapiens
ucuucucguuuuca

SEQ ID NO: 967409 - RNA, 15 nt, Homo sapiens
ucuucucguuuucac

SEQ ID NO: 967410 - RNA, 16 nt, Homo sapiens
ucuucugagcacagau

SEQ ID NO: 967411 - RNA, 12 nt, Homo sapiens
ucuucuggucug

SEQ ID NO: 967412 - RNA, 19 nt, Homo sapiens
ucuucuuacaugcauuuga

SEQ ID NO: 967413 - RNA, 19 nt, Homo sapiens
ucuucuuguguccugauga

SEQ ID NO: 967414 - RNA, 11 nt, Homo sapiens
ucuucuuuaug

SEQ ID NO: 967415 - RNA, 16 nt, Homo sapiens
ucuugaauagucucau

SEQ ID NO: 967416 - RNA, 13 nt, Homo sapiens
ucuuggacacugu

SEQ ID NO: 967417 - RNA, 20 nt, Homo sapiens
ucuugugguaacuugcugcu

SEQ ID NO: 967418 - RNA, 12 nt, Homo sapiens
ucuuuaugaucu

SEQ ID NO: 967419 - RNA, 17 nt, Homo sapiens
ucuuuccauuaugauuc

SEQ ID NO: 967420 - RNA, 16 nt, Homo sapiens
ucuuuccugaaccaug

SEQ ID NO: 967421 - RNA, 22 nt, Homo sapiens
ucuuuuuuuuuaaguucuuaug

SEQ ID NO: 967422 - RNA, 19 nt, Homo sapiens
ugaaaaagauguacagaac

SEQ ID NO: 967423 - RNA, 16 nt, Homo sapiens
ugaaaaauaugugcuu

SEQ ID NO: 967424 - RNA, 20 nt, Homo sapiens
ugaaaaauguguuccauugc

SEQ ID NO: 967425 - RNA, 16 nt, Homo sapiens
ugaaaagaaucagcau

SEQ ID NO: 967426 - RNA, 16 nt, Homo sapiens
ugaaaauaauggaauu

SEQ ID NO: 967427 - RNA, 14 nt, Homo sapiens
uugguaagauugca

SEQ ID NO: 967428 - RNA, 14 nt, Homo sapiens
uuggugcuuuucac

SEQ ID NO: 967429 - RNA, 21 nt, Homo sapiens
uugguucaauaaagcacugag

SEQ ID NO: 967430 - RNA, 15 nt, Homo sapiens
uuguaagaguguaga

SEQ ID NO: 967431 - RNA, 21 nt, Homo sapiens
uuguaauauuuugcugcugaa

SEQ ID NO: 967432 - RNA, 19 nt, Homo sapiens
uuguacaaaauuaagcaaa

SEQ ID NO: 967433 - RNA, 18 nt, Homo sapiens
uuguacuaaucugagauu

SEQ ID NO: 967434 - RNA, 17 nt, Homo sapiens
uuguagacaaaguacau

SEQ ID NO: 967435 - RNA, 21 nt, Homo sapiens
uuguagggcuuuagcuuucuu

SEQ ID NO: 967436 - RNA, 19 nt, Homo sapiens
uuguauuuuauuguuucuu

SEQ ID NO: 967437 - RNA, 20 nt, Homo sapiens
uuguccuuuuucacuuugaa

SEQ ID NO: 967438 - RNA, 15 nt, Homo sapiens
uugucuuauugcacc

SEQ ID NO: 967439 - RNA, 21 nt, Homo sapiens
uugugcuucacaguagagcca

SEQ ID NO: 967440 - RNA, 15 nt, Homo sapiens
uuguguccugaugaa

SEQ ID NO: 967441 - RNA, 13 nt, Homo sapiens
uuguucacacaca

SEQ ID NO: 967442 - RNA, 13 nt, Homo sapiens
uuguucauccuuu

SEQ ID NO: 967443 - RNA, 12 nt, Homo sapiens
uuguugaacacu

SEQ ID NO: 967444 - RNA, 15 nt, Homo sapiens
uuguugaacacuuga

SEQ ID NO: 967445 - RNA, 20 nt, Homo sapiens
uuguugcaauaucuacauuc

SEQ ID NO: 967446 - RNA, 15 nt, Homo sapiens
uuguuguuucuugcc

SEQ ID NO: 967447 - RNA, 14 nt, Homo sapiens
uuguuucuguagaa

SEQ ID NO: 967448 - RNA, 14 nt, Homo sapiens
uuguuucuugccug

SEQ ID NO: 967449 - RNA, 17 nt, Homo sapiens
uuguuugccaggacaug

SEQ ID NO: 967450 - RNA, 13 nt, Homo sapiens
uuguuuuguggau

SEQ ID NO: 967451 - RNA, 16 nt, Homo sapiens
uuuaaaaaaugucucu

SEQ ID NO: 967452 - RNA, 18 nt, Homo sapiens
uuuaaacuuguuugcugu

SEQ ID NO: 967453 - RNA, 17 nt, Homo sapiens
uuuaaagccauucugau

SEQ ID NO: 967454 - RNA, 14 nt, Homo sapiens
uuuaaaguaugcau

SEQ ID NO: 967455 - RNA, 16 nt, Homo sapiens
uuuaacauacaaucau

SEQ ID NO: 967456 - RNA, 18 nt, Homo sapiens
uuuaacauuuuacaguaa

SEQ ID NO: 967457 - RNA, 17 nt, Homo sapiens
uuuaagcuucaguugcu

SEQ ID NO: 967458 - RNA, 18 nt, Homo sapiens
uuuaaggcaauauauaau

SEQ ID NO: 967459 - RNA, 13 nt, Homo sapiens
uuuaaguacuuug

SEQ ID NO: 967460 - RNA, 17 nt, Homo sapiens
uuuaauccaaagaaaga

SEQ ID NO: 967461 - RNA, 13 nt, Homo sapiens
uuuacuauuuuag

SEQ ID NO: 967462 - RNA, 22 nt, Homo sapiens
uuuacuugcccugaacauacac

SEQ ID NO: 967463 - RNA, 15 nt, Homo sapiens
uuuagaucucugaag

SEQ ID NO: 967464 - RNA, 15 nt, Homo sapiens
uuuagcacaguauuu

SEQ ID NO: 967465 - RNA, 13 nt, Homo sapiens
uuuagcagucaga

SEQ ID NO: 967466 - RNA, 12 nt, Homo sapiens
uuuagcucugag

SEQ ID NO: 967467 - RNA, 12 nt, Homo sapiens
uuuaguggcuca

SEQ ID NO: 967468 - RNA, 14 nt, Homo sapiens
uuuauaaacagaaa

SEQ ID NO: 967469 - RNA, 17 nt, Homo sapiens
uuuauaucaugcaaaau

SEQ ID NO: 967470 - RNA, 15 nt, Homo sapiens
uuuauguaaaaccaa

SEQ ID NO: 967471 - RNA, 14 nt, Homo sapiens
uuuauguacuaaau

SEQ ID NO: 967472 - RNA, 16 nt, Homo sapiens
uuuauuaauauuugca

SEQ ID NO: 967473 - RNA, 17 nt, Homo sapiens
uuuauuaugcaaccagu

SEQ ID NO: 967474 - RNA, 16 nt, Homo sapiens
uuuauuuccacuaaaa

SEQ ID NO: 967475 - RNA, 13 nt, Homo sapiens
uuucaaaaaccau

SEQ ID NO: 967476 - RNA, 14 nt, Homo sapiens
uuucaaaaugauag

SEQ ID NO: 967477 - RNA, 12 nt, Homo sapiens
uuucaaagggaa

SEQ ID NO: 967478 - RNA, 20 nt, Homo sapiens
uuucaacucuuaaagacauc

SEQ ID NO: 967479 - RNA, 16 nt, Homo sapiens
uuucacuucuuccuau

SEQ ID NO: 967480 - RNA, 17 nt, Homo sapiens
uuucacuuuauugcuau

SEQ ID NO: 967481 - RNA, 17 nt, Homo sapiens
uuucagaagcaagccag

SEQ ID NO: 967482 - RNA, 12 nt, Homo sapiens
uuucagggcugg

SEQ ID NO: 967483 - RNA, 18 nt, Homo sapiens
uuucaggguccaaacaaa

SEQ ID NO: 967484 - RNA, 16 nt, Homo sapiens
uuucaguaagucucau

SEQ ID NO: 967485 - RNA, 19 nt, Homo sapiens
uuucagugcuuuuacuauc

SEQ ID NO: 967486 - RNA, 13 nt, Homo sapiens
uuucauacacuua

SEQ ID NO: 967487 - RNA, 22 nt, Homo sapiens
uuucauuccuaacacagcaugu

SEQ ID NO: 967488 - RNA, 19 nt, Homo sapiens
uuuccauccauuaccucca

SEQ ID NO: 967489 - RNA, 23 nt, Homo sapiens
uuucccuaggaaacucacacucc

SEQ ID NO: 967490 - RNA, 21 nt, Homo sapiens
uuucuacuuuaaauuguggau

SEQ ID NO: 967491 - RNA, 21 nt, Homo sapiens
uuucuauuauggaaaacugug

SEQ ID NO: 967492 - RNA, 15 nt, Homo sapiens
uuucuggcucuccca

SEQ ID NO: 967493 - RNA, 14 nt, Homo sapiens
uuucugugucuuaa

SEQ ID NO: 967494 - RNA, 18 nt, Homo sapiens
uuugaaaaaauuacucaa

SEQ ID NO: 967495 - RNA, 16 nt, Homo sapiens
uuugaacaaagcucaa

SEQ ID NO: 967496 - RNA, 16 nt, Homo sapiens
uuugacuccaggaaca

SEQ ID NO: 967497 - RNA, 19 nt, Homo sapiens
uuugagcugagugcugaaa

SEQ ID NO: 967498 - RNA, 17 nt, Homo sapiens
uuugaggugaggguugg

SEQ ID NO: 967499 - RNA, 19 nt, Homo sapiens
uuugauagaaagaugagau

SEQ ID NO: 967500 - RNA, 16 nt, Homo sapiens
uuugauuuugauuuua

SEQ ID NO: 967501 - RNA, 14 nt, Homo sapiens
uuugcacaugggau

SEQ ID NO: 967502 - RNA, 20 nt, Homo sapiens
uuugccccuuccacuuugag

SEQ ID NO: 967503 - RNA, 15 nt, Homo sapiens
uuugcuccagaacac

SEQ ID NO: 967504 - RNA, 16 nt, Homo sapiens
uuugcuuuaguacaau

SEQ ID NO: 967505 - RNA, 22 nt, Homo sapiens
uuuggaaguuuagcucugagaa

SEQ ID NO: 967506 - RNA, 22 nt, Homo sapiens
uuuggauucuaaauacaugcca

SEQ ID NO: 967507 - RNA, 21 nt, Homo sapiens
uuuggcacuugccauuccaaa

SEQ ID NO: 967508 - RNA, 15 nt, Homo sapiens
uuuggggggcagaga

SEQ ID NO: 967509 - RNA, 16 nt, Homo sapiens
uuuggggggcagagaa

SEQ ID NO: 967510 - RNA, 18 nt, Homo sapiens
uuugggguaauacuucca

SEQ ID NO: 967511 - RNA, 21 nt, Homo sapiens
uuuguaaagcccuugcacagc

SEQ ID NO: 967512 - RNA, 17 nt, Homo sapiens
uuuguaacccacugaga

SEQ ID NO: 967513 - RNA, 19 nt, Homo sapiens
uuuguaauaauaaaaccaa

SEQ ID NO: 967514 - RNA, 16 nt, Homo sapiens
uccuggaguacaccaa

SEQ ID NO: 967515 - RNA, 16 nt, Homo sapiens
uccuggcaugacacuc

SEQ ID NO: 967516 - RNA, 17 nt, Homo sapiens
uccuggcaugacacucu

SEQ ID NO: 967517 - RNA, 13 nt, Homo sapiens
uccuggccugaga

SEQ ID NO: 967518 - RNA, 18 nt, Homo sapiens
uccuggugccaauuucaa

SEQ ID NO: 967519 - RNA, 13 nt, Homo sapiens
uccugugccacua

SEQ ID NO: 967520 - RNA, 23 nt, Homo sapiens
uccuguggguguucuuuccugcc

SEQ ID NO: 967521 - RNA, 14 nt, Homo sapiens
uccuguguccugaa

SEQ ID NO: 967522 - RNA, 16 nt, Homo sapiens
uccuuaaaaauguaug

SEQ ID NO: 967523 - RNA, 12 nt, Homo sapiens
uccuuaaguauu

SEQ ID NO: 967524 - RNA, 14 nt, Homo sapiens
uccuuaggccucug

SEQ ID NO: 967525 - RNA, 17 nt, Homo sapiens
uccuuaggccucugaga

SEQ ID NO: 967526 - RNA, 15 nt, Homo sapiens
uccuucaaucuucau

SEQ ID NO: 967527 - RNA, 23 nt, Homo sapiens
uccuucaccccuauggugcucag

SEQ ID NO: 967528 - RNA, 13 nt, Homo sapiens
uccuuccauccau

SEQ ID NO: 967529 - RNA, 11 nt, Homo sapiens
uccuugcaaau

SEQ ID NO: 967530 - RNA, 20 nt, Homo sapiens
uccuuuaccuuucagugcag

SEQ ID NO: 967531 - RNA, 20 nt, Homo sapiens
uccuuucuuuuaaugaugcc

SEQ ID NO: 967532 - RNA, 18 nt, Homo sapiens
uccuuuucacuuuauugc

SEQ ID NO: 967533 - RNA, 15 nt, Homo sapiens
uccuuuuccacuuua

SEQ ID NO: 967534 - RNA, 22 nt, Homo sapiens
uccuuuucccaaagcaucccuc

SEQ ID NO: 967535 - RNA, 12 nt, Homo sapiens
ucgcaacugucc

SEQ ID NO: 967536 - RNA, 17 nt, Homo sapiens
ucggagcggcgucccuu

SEQ ID NO: 967537 - RNA, 21 nt, Homo sapiens
acccugcucauccacucuacu

SEQ ID NO: 967538 - RNA, 21 nt, Homo sapiens
acccugguuauugauguggcc

SEQ ID NO: 967539 - RNA, 16 nt, Homo sapiens
acccuguccuaugacu

SEQ ID NO: 967540 - RNA, 21 nt, Homo sapiens
acccuguccuaugacuugauc

SEQ ID NO: 967541 - RNA, 22 nt, Homo sapiens
acccuguuuuaccguugcuaag

SEQ ID NO: 967542 - RNA, 10 nt, Homo sapiens
acccuuccag

SEQ ID NO: 967543 - RNA, 19 nt, Homo sapiens
acccuucuggaaacuguga

SEQ ID NO: 967544 - RNA, 20 nt, Homo sapiens
acccuuuggccccacuuuga

SEQ ID NO: 967545 - RNA, 21 nt, Homo sapiens
accgcugggugguuuuuuccc

SEQ ID NO: 967546 - RNA, 14 nt, Homo sapiens
accgguccagcugg

SEQ ID NO: 967547 - RNA, 22 nt, Homo sapiens
accguggaggaggaaggcaaga

SEQ ID NO: 967548 - RNA, 17 nt, Homo sapiens
accuaaagcaagccuga

SEQ ID NO: 967549 - RNA, 17 nt, Homo sapiens
accuaagggaguagugu

SEQ ID NO: 967550 - RNA, 21 nt, Homo sapiens
accuaauguuuaugagccaga

SEQ ID NO: 967551 - RNA, 14 nt, Homo sapiens
accuacagagcagc

SEQ ID NO: 967552 - RNA, 12 nt, Homo sapiens
accuaccaaaau

SEQ ID NO: 967553 - RNA, 21 nt, Homo sapiens
accuacuuugacuuuuugcau

SEQ ID NO: 967554 - RNA, 18 nt, Homo sapiens
accuagaacacuaacuca

SEQ ID NO: 967555 - RNA, 17 nt, Homo sapiens
accuauagcaucuucuc

SEQ ID NO: 967556 - RNA, 12 nt, Homo sapiens
accucaagccau

SEQ ID NO: 967557 - RNA, 19 nt, Homo sapiens
accucagccucccaaagug

SEQ ID NO: 967558 - RNA, 17 nt, Homo sapiens
accuccacccacugucc

SEQ ID NO: 967559 - RNA, 13 nt, Homo sapiens
accuccucauggc

SEQ ID NO: 967560 - RNA, 17 nt, Homo sapiens
accucuucuuucccucc

SEQ ID NO: 967561 - RNA, 13 nt, Homo sapiens
accugagaaccuu

SEQ ID NO: 967562 - RNA, 23 nt, Homo sapiens
accugcugccggaagucauccca

SEQ ID NO: 967563 - RNA, 16 nt, Homo sapiens
accugcuuugugagcc

SEQ ID NO: 967564 - RNA, 20 nt, Homo sapiens
accuggaaucuacaagccaa

SEQ ID NO: 967565 - RNA, 16 nt, Homo sapiens
accuggggagagccug

SEQ ID NO: 967566 - RNA, 13 nt, Homo sapiens
accuguaguccca

SEQ ID NO: 967567 - RNA, 16 nt, Homo sapiens
accuguagucccagcu

SEQ ID NO: 967568 - RNA, 20 nt, Homo sapiens
accuuaaagaaccaucagca

SEQ ID NO: 967569 - RNA, 17 nt, Homo sapiens
accuuaagagacacucc

SEQ ID NO: 967570 - RNA, 16 nt, Homo sapiens
accuuccacucuggaa

SEQ ID NO: 967571 - RNA, 20 nt, Homo sapiens
accuucugaugaaguuguac

SEQ ID NO: 967572 - RNA, 23 nt, Homo sapiens
accuuggaagggcguucuaggua

SEQ ID NO: 967573 - RNA, 22 nt, Homo sapiens
accuuuuauacuuuugaccaaa

SEQ ID NO: 967574 - RNA, 15 nt, Homo sapiens
accuuuuuauuugca

SEQ ID NO: 967575 - RNA, 16 nt, Homo sapiens
accuuuuuauuugcau

SEQ ID NO: 967576 - RNA, 13 nt, Homo sapiens
acgauuauaguaa

SEQ ID NO: 967577 - RNA, 17 nt, Homo sapiens
acgcacgcucgcugcca

SEQ ID NO: 967578 - RNA, 18 nt, Homo sapiens
acgcacgcucgcugccau

SEQ ID NO: 967579 - RNA, 20 nt, Homo sapiens
acgcacgcucgcugccauca

SEQ ID NO: 967580 - RNA, 17 nt, Homo sapiens
acgccacucccugggac

SEQ ID NO: 967581 - RNA, 15 nt, Homo sapiens
acgcccuucaaugcu

SEQ ID NO: 967582 - RNA, 22 nt, Homo sapiens
acgccuacuuaagagugcugug

SEQ ID NO: 967583 - RNA, 17 nt, Homo sapiens
acgcuaaagagcccuug

SEQ ID NO: 967584 - RNA, 23 nt, Homo sapiens
acgcuccuuugugugugugucag

SEQ ID NO: 967585 - RNA, 16 nt, Homo sapiens
acgcucgcugccauca

SEQ ID NO: 967586 - RNA, 21 nt, Homo sapiens
acggaguuucacucuugucac

SEQ ID NO: 967587 - RNA, 21 nt, Homo sapiens
acggaucugcugggcucugcc

SEQ ID NO: 967588 - RNA, 16 nt, Homo sapiens
acggcggcaguauuga

SEQ ID NO: 967589 - RNA, 13 nt, Homo sapiens
acggcuuacaugu

SEQ ID NO: 967590 - RNA, 16 nt, Homo sapiens
acgguaaguguucuca

SEQ ID NO: 967591 - RNA, 23 nt, Homo sapiens
acgguaaguguucucaugaagca

SEQ ID NO: 967592 - RNA, 17 nt, Homo sapiens
acggugcccauccugcc

SEQ ID NO: 967593 - RNA, 18 nt, Homo sapiens
acggugggagaccugcug

SEQ ID NO: 967594 - RNA, 13 nt, Homo sapiens
acguacugguuua

SEQ ID NO: 967595 - RNA, 14 nt, Homo sapiens
acgucacugcacuc

SEQ ID NO: 967596 - RNA, 19 nt, Homo sapiens
acguccuccguccauauca

SEQ ID NO: 967597 - RNA, 15 nt, Homo sapiens
acguucaaacaggcc

SEQ ID NO: 967598 - RNA, 23 nt, Homo sapiens
acuaaacaauaagcaagagacaa

SEQ ID NO: 967599 - RNA, 12 nt, Homo sapiens
acuaaacucaac

SEQ ID NO: 967600 - RNA, 16 nt, Homo sapiens
acuaaaucaaucugca

SEQ ID NO: 967601 - RNA, 23 nt, Homo sapiens
acuaaaucaaucugcaguuuaac

SEQ ID NO: 967602 - RNA, 20 nt, Homo sapiens
acuaacgaaauaucaaaguc

SEQ ID NO: 967603 - RNA, 23 nt, Homo sapiens
acuaacucaaauacacauuugcu

SEQ ID NO: 967604 - RNA, 19 nt, Homo sapiens
acuaagauaaauucaugca

SEQ ID NO: 967605 - RNA, 20 nt, Homo sapiens
acuaagauaaauucaugcac

SEQ ID NO: 967606 - RNA, 18 nt, Homo sapiens
acuacaggaggaaugcac

SEQ ID NO: 967607 - RNA, 14 nt, Homo sapiens
acuacaucugauau

SEQ ID NO: 967608 - RNA, 21 nt, Homo sapiens
acuagagaaaauaaauuccaa

SEQ ID NO: 967609 - RNA, 21 nt, Homo sapiens
acuagcccaaugaaaugaauu

SEQ ID NO: 967610 - RNA, 13 nt, Homo sapiens
acuaggccuucag

SEQ ID NO: 967611 - RNA, 20 nt, Homo sapiens
acuauagaaugcaacuccau

SEQ ID NO: 967612 - RNA, 15 nt, Homo sapiens
acuauauuaguaugu

SEQ ID NO: 967613 - RNA, 11 nt, Homo sapiens
acuauggugcu

SEQ ID NO: 967614 - RNA, 22 nt, Homo sapiens
acuaugguguguuguaucuuug

SEQ ID NO: 967615 - RNA, 18 nt, Homo sapiens
acuauucauggcuaccuc

SEQ ID NO: 967616 - RNA, 18 nt, Homo sapiens
acucaaauacacauuugc

SEQ ID NO: 967617 - RNA, 19 nt, Homo sapiens
acucaacccauuguuguca

SEQ ID NO: 967618 - RNA, 17 nt, Homo sapiens
acucagaaccugcuccu

SEQ ID NO: 967619 - RNA, 15 nt, Homo sapiens
acucagacauuccaa

SEQ ID NO: 967620 - RNA, 20 nt, Homo sapiens
acucaucuuagugccugaga

SEQ ID NO: 967621 - RNA, 20 nt, Homo sapiens
acuccacuggccuccuggca

SEQ ID NO: 967622 - RNA, 21 nt, Homo sapiens
acuccaggaacaaaaagguaa

SEQ ID NO: 967623 - RNA, 14 nt, Homo sapiens
acuccuuugcuaau

SEQ ID NO: 967624 - RNA, 14 nt, Homo sapiens
acucuacuaaugcc

SEQ ID NO: 967625 - RNA, 16 nt, Homo sapiens
acucucccuggagcug

SEQ ID NO: 967626 - RNA, 14 nt, Homo sapiens
acucucuaccagau

SEQ ID NO: 967627 - RNA, 20 nt, Homo sapiens
acucugccuuuaugaugcua

SEQ ID NO: 967628 - RNA, 22 nt, Homo sapiens
acucugcuugauuuuugccucu

SEQ ID NO: 967629 - RNA, 23 nt, Homo sapiens
acucuguuugaagaaaauaguca

SEQ ID NO: 967630 - RNA, 15 nt, Homo sapiens
acucuuaaagacauc

SEQ ID NO: 967631 - RNA, 22 nt, Homo sapiens
acucuucaaggaggcccacugu

SEQ ID NO: 967632 - RNA, 12 nt, Homo sapiens
acugaacacugc

SEQ ID NO: 967633 - RNA, 20 nt, Homo sapiens
acugaacuuaauaacugugu

SEQ ID NO: 967634 - RNA, 21 nt, Homo sapiens
acugaacuuaauaacugugua

SEQ ID NO: 967635 - RNA, 15 nt, Homo sapiens
acugaaucacuuaaa

SEQ ID NO: 967636 - RNA, 14 nt, Homo sapiens
acugaaugagguca

SEQ ID NO: 967637 - RNA, 20 nt, Homo sapiens
acugacacaagaauggucuu

SEQ ID NO: 967638 - RNA, 20 nt, Homo sapiens
acugaccauauugugcuuca

SEQ ID NO: 967639 - RNA, 14 nt, Homo sapiens
acugaccuaccuca

SEQ ID NO: 967640 - RNA, 17 nt, Homo sapiens
acugacugagcaggcug

SEQ ID NO: 967641 - RNA, 19 nt, Homo sapiens
acugagcaggcuguggggu

SEQ ID NO: 967642 - RNA, 15 nt, Homo sapiens
acugaggaauuucac

SEQ ID NO: 967643 - RNA, 20 nt, Homo sapiens
acugaggcagcgaccucaag

SEQ ID NO: 967644 - RNA, 19 nt, Homo sapiens
acugcagcaggccacuggg

SEQ ID NO: 967645 - RNA, 16 nt, Homo sapiens
acugcaugaaugaaac

SEQ ID NO: 967646 - RNA, 18 nt, Homo sapiens
acugccuaugccaagucc

SEQ ID NO: 967647 - RNA, 17 nt, Homo sapiens
acugcuggggagacaaa

SEQ ID NO: 967648 - RNA, 23 nt, Homo sapiens
acugcuggggagacaaaucucag

SEQ ID NO: 967649 - RNA, 12 nt, Homo sapiens
acuggacuaugc

SEQ ID NO: 967650 - RNA, 17 nt, Homo sapiens
acuggagcucaucugca

SEQ ID NO: 967651 - RNA, 14 nt, Homo sapiens
agguggcaaaguac

SEQ ID NO: 967652 - RNA, 20 nt, Homo sapiens
agguggcaaaguacuuguca

SEQ ID NO: 967653 - RNA, 15 nt, Homo sapiens
agguucagccugaaa

SEQ ID NO: 967654 - RNA, 22 nt, Homo sapiens
agguucuucagaagucacacau

SEQ ID NO: 967655 - RNA, 15 nt, Homo sapiens
agguucuugggauac

SEQ ID NO: 967656 - RNA, 14 nt, Homo sapiens
agguugaagccaag

SEQ ID NO: 967657 - RNA, 13 nt, Homo sapiens
aguaaaaagggaa

SEQ ID NO: 967658 - RNA, 15 nt, Homo sapiens
aguaaauagugucau

SEQ ID NO: 967659 - RNA, 19 nt, Homo sapiens
aguaaauguguuucuugcu

SEQ ID NO: 967660 - RNA, 23 nt, Homo sapiens
aguaacugugagaacccaguuuc

SEQ ID NO: 967661 - RNA, 15 nt, Homo sapiens
aguaagaagacauga

SEQ ID NO: 967662 - RNA, 14 nt, Homo sapiens
aguaagaauaccac

SEQ ID NO: 967663 - RNA, 16 nt, Homo sapiens
aguaagaauaccacau

SEQ ID NO: 967664 - RNA, 16 nt, Homo sapiens
aguaagacccagcauu

SEQ ID NO: 967665 - RNA, 15 nt, Homo sapiens
aguaagauaucucaa

SEQ ID NO: 967666 - RNA, 17 nt, Homo sapiens
aguacaccaaccagacc

SEQ ID NO: 967667 - RNA, 12 nt, Homo sapiens
aguacaucucua

SEQ ID NO: 967668 - RNA, 13 nt, Homo sapiens
aguagaacugucu

SEQ ID NO: 967669 - RNA, 23 nt, Homo sapiens
aguagaaguuacuuaauugccag

SEQ ID NO: 967670 - RNA, 13 nt, Homo sapiens
aguagacauuuau

SEQ ID NO: 967671 - RNA, 22 nt, Homo sapiens
aguagaucuauauuagaucaaa

SEQ ID NO: 967672 - RNA, 20 nt, Homo sapiens
aguagcccagagugagcuuu

SEQ ID NO: 967673 - RNA, 18 nt, Homo sapiens
aguauaaugcaguacauu

SEQ ID NO: 967674 - RNA, 15 nt, Homo sapiens
aguauacaacugccu

SEQ ID NO: 967675 - RNA, 14 nt, Homo sapiens
aguaucccacaucc

SEQ ID NO: 967676 - RNA, 13 nt, Homo sapiens
aguaugaaucuag

SEQ ID NO: 967677 - RNA, 16 nt, Homo sapiens
aguauuccaugagcug

SEQ ID NO: 967678 - RNA, 21 nt, Homo sapiens
aguauuugguuuuccauuccu

SEQ ID NO: 967679 - RNA, 15 nt, Homo sapiens
agucaacacucuucu

SEQ ID NO: 967680 - RNA, 17 nt, Homo sapiens
agucaagaaucacuugc

SEQ ID NO: 967681 - RNA, 22 nt, Homo sapiens
agucacaacagagugaaaaauc

SEQ ID NO: 967682 - RNA, 19 nt, Homo sapiens
agucacauggccuaugcac

SEQ ID NO: 967683 - RNA, 19 nt, Homo sapiens
agucaccaaauagugugaa

SEQ ID NO: 967684 - RNA, 20 nt, Homo sapiens
agucacugcucuucagccau

SEQ ID NO: 967685 - RNA, 18 nt, Homo sapiens
agucauauauaucaccca

SEQ ID NO: 967686 - RNA, 21 nt, Homo sapiens
agucaucacauuucuaugcca

SEQ ID NO: 967687 - RNA, 16 nt, Homo sapiens
agucaucccagugcac

SEQ ID NO: 967688 - RNA, 21 nt, Homo sapiens
agucauugucgcucagcaaua

SEQ ID NO: 967689 - RNA, 15 nt, Homo sapiens
aguccaaccugccug

SEQ ID NO: 967690 - RNA, 17 nt, Homo sapiens
aguccaguaaagccuua

SEQ ID NO: 967691 - RNA, 23 nt, Homo sapiens
aguccaucuccagcauguaacug

SEQ ID NO: 967692 - RNA, 22 nt, Homo sapiens
agucccgggucucaacuuuaag

SEQ ID NO: 967693 - RNA, 22 nt, Homo sapiens
aguccggcuaaguggagcucag

SEQ ID NO: 967694 - RNA, 15 nt, Homo sapiens
aguccucacucuuca

SEQ ID NO: 967695 - RNA, 13 nt, Homo sapiens
aguccugacacug

SEQ ID NO: 967696 - RNA, 22 nt, Homo sapiens
aguccugcuaccucccuugccu

SEQ ID NO: 967697 - RNA, 19 nt, Homo sapiens
agucuaggcuaagcacuuu

SEQ ID NO: 967698 - RNA, 14 nt, Homo sapiens
agucucaguucucu

SEQ ID NO: 967699 - RNA, 17 nt, Homo sapiens
agucuuguuuuuuauuc

SEQ ID NO: 967700 - RNA, 22 nt, Homo sapiens
agugaaguuuuacugucuauua

SEQ ID NO: 967701 - RNA, 23 nt, Homo sapiens
agugaauacauuaacggugcuaa

SEQ ID NO: 967702 - RNA, 12 nt, Homo sapiens
agugaucccaau

SEQ ID NO: 967703 - RNA, 21 nt, Homo sapiens
agugcacauggcagcgguggg

SEQ ID NO: 967704 - RNA, 19 nt, Homo sapiens
agugcaggaaaccgaguag

SEQ ID NO: 967705 - RNA, 13 nt, Homo sapiens
agugcccuaggcc

SEQ ID NO: 967706 - RNA, 17 nt, Homo sapiens
agugccuauugauacuu

SEQ ID NO: 967707 - RNA, 21 nt, Homo sapiens
agugcugaaauaaaaugauaa

SEQ ID NO: 967708 - RNA, 22 nt, Homo sapiens
agugcugaaauaaaaugauaaa

SEQ ID NO: 967709 - RNA, 15 nt, Homo sapiens
aguggccuguagucc

SEQ ID NO: 967710 - RNA, 21 nt, Homo sapiens
aguggccuguaguccaucucc

SEQ ID NO: 967711 - RNA, 19 nt, Homo sapiens
aguggcgugggagccagcc

SEQ ID NO: 967712 - RNA, 15 nt, Homo sapiens
agugggaucccagac

SEQ ID NO: 967713 - RNA, 15 nt, Homo sapiens
agugggucuucccuc

SEQ ID NO: 967714 - RNA, 17 nt, Homo sapiens
aguggucuuuguaagag

SEQ ID NO: 967715 - RNA, 15 nt, Homo sapiens
aguguagacuguggc

SEQ ID NO: 967716 - RNA, 18 nt, Homo sapiens
agugucacugcuuguuau

SEQ ID NO: 967717 - RNA, 20 nt, Homo sapiens
aguguccccuuauacagugg

SEQ ID NO: 967718 - RNA, 22 nt, Homo sapiens
agugugcuccagauggugcuag

SEQ ID NO: 967719 - RNA, 15 nt, Homo sapiens
aguuaaacagucagu

SEQ ID NO: 967720 - RNA, 13 nt, Homo sapiens
aguuaagaaccug

SEQ ID NO: 967721 - RNA, 21 nt, Homo sapiens
aguuaaucccuuugucuguca

SEQ ID NO: 967722 - RNA, 16 nt, Homo sapiens
aguuacacagaaaugc

SEQ ID NO: 967723 - RNA, 17 nt, Homo sapiens
aguuagaacuagccaaa

SEQ ID NO: 967724 - RNA, 16 nt, Homo sapiens
aguuaucuuugaauau

SEQ ID NO: 967725 - RNA, 17 nt, Homo sapiens
aguucaggcagcacauc

SEQ ID NO: 967726 - RNA, 14 nt, Homo sapiens
aguucaucaccauu

SEQ ID NO: 967727 - RNA, 20 nt, Homo sapiens
aguucaucggaauucagcca

SEQ ID NO: 967728 - RNA, 20 nt, Homo sapiens
aguucucuugcuuucacauu

SEQ ID NO: 967729 - RNA, 18 nt, Homo sapiens
aguugcguggacucugca

SEQ ID NO: 967730 - RNA, 21 nt, Homo sapiens
aguugcguggacucugcacau

SEQ ID NO: 967731 - RNA, 16 nt, Homo sapiens
aguuggccaagcagaa

SEQ ID NO: 967732 - RNA, 11 nt, Homo sapiens
aguugggaugc

SEQ ID NO: 967733 - RNA, 23 nt, Homo sapiens
aguuuaggaguaagagucuuguu

SEQ ID NO: 967734 - RNA, 14 nt, Homo sapiens
aguuuaugauggaa

SEQ ID NO: 967735 - RNA, 14 nt, Homo sapiens
aguuucaggugaca

SEQ ID NO: 967736 - RNA, 13 nt, Homo sapiens
aguuucaguuugu

SEQ ID NO: 967737 - RNA, 13 nt, Homo sapiens
aguuuuaccucuu

SEQ ID NO: 967738 - RNA, 17 nt, Homo sapiens
aguuuuagaaaugagaa

SEQ ID NO: 967739 - RNA, 21 nt, Homo sapiens
aguuuuguacauagcaaauaa

SEQ ID NO: 967740 - RNA, 20 nt, Homo sapiens
aguuuuuggcaaaaaacaac

SEQ ID NO: 967741 - RNA, 16 nt, Homo sapiens
auaaaacacuaacuua

SEQ ID NO: 967742 - RNA, 13 nt, Homo sapiens
auaaaacggugcu

SEQ ID NO: 967743 - RNA, 18 nt, Homo sapiens
auaaaacucugcauguag

SEQ ID NO: 967744 - RNA, 17 nt, Homo sapiens
auaaaauguaauuacuu

SEQ ID NO: 967745 - RNA, 16 nt, Homo sapiens
auaaaauuccuaucuc

SEQ ID NO: 967746 - RNA, 17 nt, Homo sapiens
auaaaauuuuuauguaa

SEQ ID NO: 967747 - RNA, 15 nt, Homo sapiens
auaaacugugccaau

SEQ ID NO: 967748 - RNA, 20 nt, Homo sapiens
auaaacuuaaagcuacugua

SEQ ID NO: 967749 - RNA, 23 nt, Homo sapiens
auaaaggacaggccacaccacag

SEQ ID NO: 967750 - RNA, 15 nt, Homo sapiens
auaaagugcuuuaaa

SEQ ID NO: 967751 - RNA, 15 nt, Homo sapiens
auaaauaaaguuuca

SEQ ID NO: 967752 - RNA, 14 nt, Homo sapiens
auaaauaugcagug

SEQ ID NO: 967753 - RNA, 23 nt, Homo sapiens
auaaauccucagguaguacuggg

SEQ ID NO: 967754 - RNA, 14 nt, Homo sapiens
auaacaauguuaag

SEQ ID NO: 967755 - RNA, 17 nt, Homo sapiens
auaacaccagugggaau

SEQ ID NO: 967756 - RNA, 11 nt, Homo sapiens
auaacuaccuu

SEQ ID NO: 967757 - RNA, 16 nt, Homo sapiens
auaacuagacguucaa

SEQ ID NO: 967758 - RNA, 14 nt, Homo sapiens
auaacucuccagua

SEQ ID NO: 967759 - RNA, 18 nt, Homo sapiens
auaacugaaaaugugcua

SEQ ID NO: 967760 - RNA, 13 nt, Homo sapiens
auaagacauaacg

SEQ ID NO: 967761 - RNA, 14 nt, Homo sapiens
auaagcaagagaca

SEQ ID NO: 967762 - RNA, 18 nt, Homo sapiens
auaagcuaaagaggcuga

SEQ ID NO: 967763 - RNA, 19 nt, Homo sapiens
auaaggugccucaguuuuc

SEQ ID NO: 967764 - RNA, 20 nt, Homo sapiens
auaaguuauuuuuguacaug

SEQ ID NO: 967765 - RNA, 14 nt, Homo sapiens
auaauaacagcagu

SEQ ID NO: 967766 - RNA, 17 nt, Homo sapiens
caaacuuuguuugucac

SEQ ID NO: 967767 - RNA, 20 nt, Homo sapiens
caaagaaaaauaacccuuug

SEQ ID NO: 967768 - RNA, 13 nt, Homo sapiens
caaagaggcugcc

SEQ ID NO: 967769 - RNA, 17 nt, Homo sapiens
caaagaggcugccccuc

SEQ ID NO: 967770 - RNA, 13 nt, Homo sapiens
caaagaugcccca

SEQ ID NO: 967771 - RNA, 18 nt, Homo sapiens
caaagcauggacauuuag

SEQ ID NO: 967772 - RNA, 17 nt, Homo sapiens
caaaggagcuuucucaa

SEQ ID NO: 967773 - RNA, 23 nt, Homo sapiens
caaagggaacugaagaccuccac

SEQ ID NO: 967774 - RNA, 12 nt, Homo sapiens
caaaggugugcu

SEQ ID NO: 967775 - RNA, 14 nt, Homo sapiens
caaagucguuucaa

SEQ ID NO: 967776 - RNA, 15 nt, Homo sapiens
caaauaaagaccuga

SEQ ID NO: 967777 - RNA, 21 nt, Homo sapiens
caaauaaagaccugagaaccu

SEQ ID NO: 967778 - RNA, 15 nt, Homo sapiens
caaauacacauuugc

SEQ ID NO: 967779 - RNA, 16 nt, Homo sapiens
caaauacacauuugcu

SEQ ID NO: 967780 - RNA, 13 nt, Homo sapiens
caaauagcaaaga

SEQ ID NO: 967781 - RNA, 14 nt, Homo sapiens
caaauaggaugcuu

SEQ ID NO: 967782 - RNA, 14 nt, Homo sapiens
caaaugaaacuuua

SEQ ID NO: 967783 - RNA, 19 nt, Homo sapiens
caaauggcuuaagcaauaa

SEQ ID NO: 967784 - RNA, 14 nt, Homo sapiens
caacaaaaagaaca

SEQ ID NO: 967785 - RNA, 15 nt, Homo sapiens
caacaaaaagaacaa

SEQ ID NO: 967786 - RNA, 18 nt, Homo sapiens
caacaaaaagaacaaauc

SEQ ID NO: 967787 - RNA, 23 nt, Homo sapiens
caacaauccuucuauucuagccu

SEQ ID NO: 967788 - RNA, 17 nt, Homo sapiens
caacaaugugauuuaua

SEQ ID NO: 967789 - RNA, 21 nt, Homo sapiens
caacacugucacuagucucac

SEQ ID NO: 967790 - RNA, 20 nt, Homo sapiens
caacagaacauauguugcaa

SEQ ID NO: 967791 - RNA, 19 nt, Homo sapiens
caacagcaagucacccauc

SEQ ID NO: 967792 - RNA, 20 nt, Homo sapiens
caacagcaagucacccauca

SEQ ID NO: 967793 - RNA, 11 nt, Homo sapiens
caacaggaaau

SEQ ID NO: 967794 - RNA, 18 nt, Homo sapiens
caacagguaaaacagggc

SEQ ID NO: 967795 - RNA, 21 nt, Homo sapiens
caacauggcaaaaccccaucu

SEQ ID NO: 967796 - RNA, 18 nt, Homo sapiens
caacccagggugugaaca

SEQ ID NO: 967797 - RNA, 15 nt, Homo sapiens
caaccucaucugcac

SEQ ID NO: 967798 - RNA, 20 nt, Homo sapiens
caaccugcacggggcauucc

SEQ ID NO: 967799 - RNA, 16 nt, Homo sapiens
caaccugccugugcau

SEQ ID NO: 967800 - RNA, 18 nt, Homo sapiens
caaccugccugugcauga

SEQ ID NO: 967801 - RNA, 12 nt, Homo sapiens
caacuaccugag

SEQ ID NO: 967802 - RNA, 22 nt, Homo sapiens
caacucugccuuuaugaugcua

SEQ ID NO: 967803 - RNA, 22 nt, Homo sapiens
caacugaccugaccccauuccu

SEQ ID NO: 967804 - RNA, 22 nt, Homo sapiens
caacugucuuagacugcuagcu

SEQ ID NO: 967805 - RNA, 16 nt, Homo sapiens
caacugugugauuaaa

SEQ ID NO: 967806 - RNA, 23 nt, Homo sapiens
caacuuguaacucuaugaacuua

SEQ ID NO: 967807 - RNA, 16 nt, Homo sapiens
caagaaaaaaagggag

SEQ ID NO: 967808 - RNA, 21 nt, Homo sapiens
caagacuccaucucaaaaaag

SEQ ID NO: 967809 - RNA, 21 nt, Homo sapiens
caagagaauuuggggcuucca

SEQ ID NO: 967810 - RNA, 16 nt, Homo sapiens
caagaguucuaaauac

SEQ ID NO: 967811 - RNA, 15 nt, Homo sapiens
caagcacaggagaac

SEQ ID NO: 967812 - RNA, 17 nt, Homo sapiens
caagcagucaguuugca

SEQ ID NO: 967813 - RNA, 22 nt, Homo sapiens
caagccagcuuacuagcacuuu

SEQ ID NO: 967814 - RNA, 23 nt, Homo sapiens
caagcuaugaucagaagacuuua

SEQ ID NO: 967815 - RNA, 15 nt, Homo sapiens
caagcucuucacuga

SEQ ID NO: 967816 - RNA, 21 nt, Homo sapiens
caagcuuuugcuugauccaga

SEQ ID NO: 967817 - RNA, 15 nt, Homo sapiens
caaggaagaccggcu

SEQ ID NO: 967818 - RNA, 18 nt, Homo sapiens
caaggcuuugguuuccaa

SEQ ID NO: 967819 - RNA, 21 nt, Homo sapiens
caaggcuuugguuuccaaguc

SEQ ID NO: 967820 - RNA, 19 nt, Homo sapiens
caagggggacugucuuuca

SEQ ID NO: 967821 - RNA, 17 nt, Homo sapiens
caagucagccuagagac

SEQ ID NO: 967822 - RNA, 18 nt, Homo sapiens
caaguccucacucuucaa

SEQ ID NO: 967823 - RNA, 16 nt, Homo sapiens
caagucuauaauccua

SEQ ID NO: 967824 - RNA, 19 nt, Homo sapiens
caaguguccugaaagcuua

SEQ ID NO: 967825 - RNA, 19 nt, Homo sapiens
caaguguucacugcuccuu

SEQ ID NO: 967826 - RNA, 20 nt, Homo sapiens
caaguuguucgggccaagga

SEQ ID NO: 967827 - RNA, 19 nt, Homo sapiens
caauaaaaacaacuuucac

SEQ ID NO: 967828 - RNA, 16 nt, Homo sapiens
caauaaaguuugccca

SEQ ID NO: 967829 - RNA, 14 nt, Homo sapiens
caauagaucuccag

SEQ ID NO: 967830 - RNA, 14 nt, Homo sapiens
caauaucaugugau

SEQ ID NO: 967831 - RNA, 16 nt, Homo sapiens
caauauuuacucauca

SEQ ID NO: 967832 - RNA, 18 nt, Homo sapiens
caauauuuuuauaucaug

SEQ ID NO: 967833 - RNA, 14 nt, Homo sapiens
caaucuuugacaau

SEQ ID NO: 967834 - RNA, 21 nt, Homo sapiens
caaugcacccccaaccuccau

SEQ ID NO: 967835 - RNA, 22 nt, Homo sapiens
caaugcacccccaaccuccauc

SEQ ID NO: 967836 - RNA, 16 nt, Homo sapiens
caaugcuccaucccaa

SEQ ID NO: 967837 - RNA, 15 nt, Homo sapiens
caauggucucagccu

SEQ ID NO: 967838 - RNA, 19 nt, Homo sapiens
caaugguugaugauacuuc

SEQ ID NO: 967839 - RNA, 22 nt, Homo sapiens
caaugugauuuauaacgcacaa

SEQ ID NO: 967840 - RNA, 19 nt, Homo sapiens
caauguuuagcagauuuaa

SEQ ID NO: 967841 - RNA, 16 nt, Homo sapiens
caauuaguaacauuca

SEQ ID NO: 967842 - RNA, 17 nt, Homo sapiens
caauugucgaaaagagu

SEQ ID NO: 967843 - RNA, 21 nt, Homo sapiens
caauuguuauguguuuagaau

SEQ ID NO: 967844 - RNA, 13 nt, Homo sapiens
caauuuagacaaa

SEQ ID NO: 967845 - RNA, 14 nt, Homo sapiens
caauuucuaaauac

SEQ ID NO: 967846 - RNA, 18 nt, Homo sapiens
cacaaacccugcugaaca

SEQ ID NO: 967847 - RNA, 13 nt, Homo sapiens
cacaaagacacag

SEQ ID NO: 967848 - RNA, 22 nt, Homo sapiens
cacaaugagaaaaauaaaugga

SEQ ID NO: 967849 - RNA, 20 nt, Homo sapiens
cacacaaaaaaucaaguuga

SEQ ID NO: 967850 - RNA, 13 nt, Homo sapiens
cacacacacacga

SEQ ID NO: 967851 - RNA, 13 nt, Homo sapiens
cacacacacucug

SEQ ID NO: 967852 - RNA, 15 nt, Homo sapiens
cacacgaugcauuua

SEQ ID NO: 967853 - RNA, 16 nt, Homo sapiens
cacacgaugcauuuaa

SEQ ID NO: 967854 - RNA, 22 nt, Homo sapiens
cacacucuucucuugagcaguu

SEQ ID NO: 967855 - RNA, 23 nt, Homo sapiens
cacacugguaaauguuaccucua

SEQ ID NO: 967856 - RNA, 13 nt, Homo sapiens
cacacuucuugaa

SEQ ID NO: 967857 - RNA, 20 nt, Homo sapiens
cacacuucuugaaacagccu

SEQ ID NO: 967858 - RNA, 16 nt, Homo sapiens
cacagaagcacaugca

SEQ ID NO: 967859 - RNA, 15 nt, Homo sapiens
cacagacacuaacga

SEQ ID NO: 967860 - RNA, 17 nt, Homo sapiens
cacagaggagugcagcc

SEQ ID NO: 967861 - RNA, 14 nt, Homo sapiens
cacagcaaaccucu

SEQ ID NO: 967862 - RNA, 15 nt, Homo sapiens
cacagcaacuauaua

SEQ ID NO: 967863 - RNA, 15 nt, Homo sapiens
cacagccuagcacag

SEQ ID NO: 967864 - RNA, 21 nt, Homo sapiens
cacagcgcuggccccagcaug

SEQ ID NO: 967865 - RNA, 16 nt, Homo sapiens
cacaggaauucucaag

SEQ ID NO: 967866 - RNA, 15 nt, Homo sapiens
cacagugcucaaggc

SEQ ID NO: 967867 - RNA, 13 nt, Homo sapiens
cacagugugcucc

SEQ ID NO: 967868 - RNA, 18 nt, Homo sapiens
cacaguguugcauaugag

SEQ ID NO: 967869 - RNA, 19 nt, Homo sapiens
cacauaagcccaguucauc

SEQ ID NO: 967870 - RNA, 13 nt, Homo sapiens
cacauauggacuc

SEQ ID NO: 967871 - RNA, 18 nt, Homo sapiens
cacauauggacucugcac

SEQ ID NO: 967872 - RNA, 22 nt, Homo sapiens
cacauauggacucugcacauga

SEQ ID NO: 967873 - RNA, 17 nt, Homo sapiens
cacaucccaucgucucg

SEQ ID NO: 967874 - RNA, 16 nt, Homo sapiens
cacaucuuguaacuua

SEQ ID NO: 967875 - RNA, 23 nt, Homo sapiens
cacaugaaucccacccacaugug

SEQ ID NO: 967876 - RNA, 17 nt, Homo sapiens
cacaugcaccuacccau

SEQ ID NO: 967877 - RNA, 18 nt, Homo sapiens
cacaugcaccuacccaua

SEQ ID NO: 967878 - RNA, 15 nt, Homo sapiens
cacauggccuaugca

SEQ ID NO: 967879 - RNA, 21 nt, Homo sapiens
cacauggccuaugcacauaug

SEQ ID NO: 967880 - RNA, 22 nt, Homo sapiens
cacaugucuuguacauguguag

SEQ ID NO: 967881 - RNA, 17 nt, Homo sapiens
gauugugugacuauuca

SEQ ID NO: 967882 - RNA, 14 nt, Homo sapiens
gauuuccuuggcuu

SEQ ID NO: 967883 - RNA, 19 nt, Homo sapiens
gauuuccuugugcaaaaua

SEQ ID NO: 967884 - RNA, 15 nt, Homo sapiens
gauuucuuaguucau

SEQ ID NO: 967885 - RNA, 23 nt, Homo sapiens
gauuuuauguuuaaaauggcauu

SEQ ID NO: 967886 - RNA, 22 nt, Homo sapiens
gauuuuuuuuucauacacuuau

SEQ ID NO: 967887 - RNA, 16 nt, Homo sapiens
gcaaaaccucauuuaa

SEQ ID NO: 967888 - RNA, 17 nt, Homo sapiens
gcaaaauauuugacuau

SEQ ID NO: 967889 - RNA, 20 nt, Homo sapiens
gcaaaaugaaaaugucaaua

SEQ ID NO: 967890 - RNA, 21 nt, Homo sapiens
gcaaaggggacagcuguguga

SEQ ID NO: 967891 - RNA, 22 nt, Homo sapiens
gcaaagugaaaguaacuguuaa

SEQ ID NO: 967892 - RNA, 20 nt, Homo sapiens
gcaaauaaaauaaaugaaau

SEQ ID NO: 967893 - RNA, 12 nt, Homo sapiens
gcaacagacugu

SEQ ID NO: 967894 - RNA, 15 nt, Homo sapiens
gcaacagagcaagac

SEQ ID NO: 967895 - RNA, 21 nt, Homo sapiens
gcaacagagcaagacuccauc

SEQ ID NO: 967896 - RNA, 16 nt, Homo sapiens
gcaacagcuaggaaau

SEQ ID NO: 967897 - RNA, 17 nt, Homo sapiens
gcaacauuuguauggau

SEQ ID NO: 967898 - RNA, 16 nt, Homo sapiens
gcaacuaggccuucag

SEQ ID NO: 967899 - RNA, 18 nt, Homo sapiens
gcaacuaggccuucagua

SEQ ID NO: 967900 - RNA, 20 nt, Homo sapiens
gcaacugucucucuucucag

SEQ ID NO: 967901 - RNA, 13 nt, Homo sapiens
gcaagacugucuc

SEQ ID NO: 967902 - RNA, 14 nt, Homo sapiens
gcaagagaugaauu

SEQ ID NO: 967903 - RNA, 14 nt, Homo sapiens
gcaagagcaccugg

SEQ ID NO: 967904 - RNA, 16 nt, Homo sapiens
gcaauguauagugucu

SEQ ID NO: 967905 - RNA, 22 nt, Homo sapiens
gcacaaacaccuuaagcaauau

SEQ ID NO: 967906 - RNA, 13 nt, Homo sapiens
gcacaaagacaca

SEQ ID NO: 967907 - RNA, 17 nt, Homo sapiens
gcacaaagacacagacu

SEQ ID NO: 967908 - RNA, 17 nt, Homo sapiens
gcacacccuccagagac

SEQ ID NO: 967909 - RNA, 22 nt, Homo sapiens
gcacacccuccagagacaacag

SEQ ID NO: 967910 - RNA, 18 nt, Homo sapiens
gcacagaagcucaucuca

SEQ ID NO: 967911 - RNA, 16 nt, Homo sapiens
gcacagacaagcccuu

SEQ ID NO: 967912 - RNA, 14 nt, Homo sapiens
gcacaggcagaugu

SEQ ID NO: 967913 - RNA, 21 nt, Homo sapiens
gcacauauccaggcaccagga

SEQ ID NO: 967914 - RNA, 21 nt, Homo sapiens
gcacauauggacucugcacau

SEQ ID NO: 967915 - RNA, 17 nt, Homo sapiens
gcacaugcaccuaccca

SEQ ID NO: 967916 - RNA, 20 nt, Homo sapiens
gcaccugggacccugcacag

SEQ ID NO: 967917 - RNA, 17 nt, Homo sapiens
gcacgcucgcugccauc

SEQ ID NO: 967918 - RNA, 23 nt, Homo sapiens
gcacuagagaaaauaaauuccaa

SEQ ID NO: 967919 - RNA, 12 nt, Homo sapiens
gcacuagcauuu

SEQ ID NO: 967920 - RNA, 19 nt, Homo sapiens
gcacucacacccuaacuca

SEQ ID NO: 967921 - RNA, 18 nt, Homo sapiens
gcacucuguauauuugau

SEQ ID NO: 967922 - RNA, 20 nt, Homo sapiens
gcacugaggcagcgaccuca

SEQ ID NO: 967923 - RNA, 19 nt, Homo sapiens
gcacuggggccacccagcc

SEQ ID NO: 967924 - RNA, 15 nt, Homo sapiens
gcacuuauugaauau

SEQ ID NO: 967925 - RNA, 14 nt, Homo sapiens
gcacuucauaucca

SEQ ID NO: 967926 - RNA, 13 nt, Homo sapiens
gcagaaagccaca

SEQ ID NO: 967927 - RNA, 14 nt, Homo sapiens
gcagagaaccaaag

SEQ ID NO: 967928 - RNA, 16 nt, Homo sapiens
gcagagaccaccacau

SEQ ID NO: 967929 - RNA, 18 nt, Homo sapiens
gcagagcaaagugcggug

SEQ ID NO: 967930 - RNA, 17 nt, Homo sapiens
gcagaggacgcacgcuc

SEQ ID NO: 967931 - RNA, 14 nt, Homo sapiens
gcagauaacaaaau

SEQ ID NO: 967932 - RNA, 19 nt, Homo sapiens
gcagaugccacccuagcca

SEQ ID NO: 967933 - RNA, 18 nt, Homo sapiens
gcagaugcuguugugaag

SEQ ID NO: 967934 - RNA, 15 nt, Homo sapiens
gcagcaguaccaucu

SEQ ID NO: 967935 - RNA, 20 nt, Homo sapiens
gcagcgcgugcggugcaaag

SEQ ID NO: 967936 - RNA, 13 nt, Homo sapiens
gcagcuggugcuc

SEQ ID NO: 967937 - RNA, 15 nt, Homo sapiens
gcaggaaaaguugau

SEQ ID NO: 967938 - RNA, 15 nt, Homo sapiens
gcaggcugggccaug

SEQ ID NO: 967939 - RNA, 18 nt, Homo sapiens
gcaggcugggccaugucc

SEQ ID NO: 967940 - RNA, 19 nt, Homo sapiens
gcagggugaagcagcucau

SEQ ID NO: 967941 - RNA, 23 nt, Homo sapiens
gcaguauggaauuccagugccag

SEQ ID NO: 967942 - RNA, 13 nt, Homo sapiens
gcagucacuggag

SEQ ID NO: 967943 - RNA, 15 nt, Homo sapiens
gcagugagcugagau

SEQ ID NO: 967944 - RNA, 16 nt, Homo sapiens
gcagugagcugagauc

SEQ ID NO: 967945 - RNA, 22 nt, Homo sapiens
gcagugaugacuugcuguccag

SEQ ID NO: 967946 - RNA, 16 nt, Homo sapiens
gcauaaauaugcagug

SEQ ID NO: 967947 - RNA, 19 nt, Homo sapiens
gcauaaauaugcagugaua

SEQ ID NO: 967948 - RNA, 20 nt, Homo sapiens
gcauaaauaugcagugauau

SEQ ID NO: 967949 - RNA, 18 nt, Homo sapiens
gcauaaucaauauaaucu

SEQ ID NO: 967950 - RNA, 21 nt, Homo sapiens
gcauaggucucuuugcuuucu

SEQ ID NO: 967951 - RNA, 12 nt, Homo sapiens
gcauauggugcu

SEQ ID NO: 967952 - RNA, 16 nt, Homo sapiens
gcauccuaugcuuaau

SEQ ID NO: 967953 - RNA, 19 nt, Homo sapiens
gcaugcagaaacuuggaug

SEQ ID NO: 967954 - RNA, 15 nt, Homo sapiens
gcaugguaaugaagg

SEQ ID NO: 967955 - RNA, 13 nt, Homo sapiens
gcauuauuuuaua

SEQ ID NO: 967956 - RNA, 14 nt, Homo sapiens
gcauugacaucaca

SEQ ID NO: 967957 - RNA, 15 nt, Homo sapiens
gcauugacaucacag

SEQ ID NO: 967958 - RNA, 18 nt, Homo sapiens
gcauuuagucuugccagg

SEQ ID NO: 967959 - RNA, 13 nt, Homo sapiens
gccaaaaauacag

SEQ ID NO: 967960 - RNA, 20 nt, Homo sapiens
gccaaaagucccucccugcc

SEQ ID NO: 967961 - RNA, 20 nt, Homo sapiens
gccaagguaggcagaucacc

SEQ ID NO: 967962 - RNA, 18 nt, Homo sapiens
gccaauaauaaaugcccu

SEQ ID NO: 967963 - RNA, 20 nt, Homo sapiens
gccaauacagacaaagcaua

SEQ ID NO: 967964 - RNA, 17 nt, Homo sapiens
gccacaguagaacuguc

SEQ ID NO: 967965 - RNA, 19 nt, Homo sapiens
gccacauggcgcaugaagg

SEQ ID NO: 967966 - RNA, 14 nt, Homo sapiens
gccacccuagccaa

SEQ ID NO: 967967 - RNA, 16 nt, Homo sapiens
gccacuuuacccaccu

SEQ ID NO: 967968 - RNA, 17 nt, Homo sapiens
gccagacaaaauuugag

SEQ ID NO: 967969 - RNA, 20 nt, Homo sapiens
gccagacuuaaaaaaaccau

SEQ ID NO: 967970 - RNA, 18 nt, Homo sapiens
gccagcucccagccacau

SEQ ID NO: 967971 - RNA, 22 nt, Homo sapiens
gccagguaggauacguacaccu

SEQ ID NO: 967972 - RNA, 22 nt, Homo sapiens
gccagugguguuacacauugag

SEQ ID NO: 967973 - RNA, 18 nt, Homo sapiens
gccaguuacuugcuuuac

SEQ ID NO: 967974 - RNA, 14 nt, Homo sapiens
gccauaagagguga

SEQ ID NO: 967975 - RNA, 22 nt, Homo sapiens
gccauaagaggugaucucuggg

SEQ ID NO: 967976 - RNA, 19 nt, Homo sapiens
gccauagucuuaacugguc

SEQ ID NO: 967977 - RNA, 21 nt, Homo sapiens
gccaugcagaccucaugccca

SEQ ID NO: 967978 - RNA, 16 nt, Homo sapiens
gccauggaauaaacca

SEQ ID NO: 967979 - RNA, 13 nt, Homo sapiens
gccauguccaaag

SEQ ID NO: 967980 - RNA, 22 nt, Homo sapiens
gcccaagcuucccuccaucccc

SEQ ID NO: 967981 - RNA, 14 nt, Homo sapiens
gcccagacccagug

SEQ ID NO: 967982 - RNA, 19 nt, Homo sapiens
gcccagccccuacugcugu

SEQ ID NO: 967983 - RNA, 16 nt, Homo sapiens
gcccaggccagcacuu

SEQ ID NO: 967984 - RNA, 20 nt, Homo sapiens
gcccaggcuggagugcagug

SEQ ID NO: 967985 - RNA, 15 nt, Homo sapiens
gcccauggagauuga

SEQ ID NO: 967986 - RNA, 20 nt, Homo sapiens
gcccauggagauugaccugg

SEQ ID NO: 967987 - RNA, 22 nt, Homo sapiens
gcccauugucuuauuggcacau

SEQ ID NO: 967988 - RNA, 12 nt, Homo sapiens
gccccacugcca

SEQ ID NO: 967989 - RNA, 15 nt, Homo sapiens
gccccagcuggagaa

SEQ ID NO: 967990 - RNA, 14 nt, Homo sapiens
gcccccacuccagu

SEQ ID NO: 967991 - RNA, 20 nt, Homo sapiens
gcccccagauacauggugau

SEQ ID NO: 967992 - RNA, 14 nt, Homo sapiens
gcccccgcuguguc

SEQ ID NO: 967993 - RNA, 15 nt, Homo sapiens
gcccccucuccuucu

SEQ ID NO: 967994 - RNA, 20 nt, Homo sapiens
gccccggcaagccacaggaa

SEQ ID NO: 967995 - RNA, 13 nt, Homo sapiens
gccccuacugcug

SEQ ID NO: 967996 - RNA, 14 nt, Homo sapiens
guccacacaucucc

SEQ ID NO: 967997 - RNA, 21 nt, Homo sapiens
guccacgcgugccguggcacc

SEQ ID NO: 967998 - RNA, 23 nt, Homo sapiens
guccaggggucugucugcuuugg

SEQ ID NO: 967999 - RNA, 22 nt, Homo sapiens
guccauacacuuuguugcaaga

SEQ ID NO: 968000 - RNA, 20 nt, Homo sapiens
gucccauuuuucucuugcca

SEQ ID NO: 968001 - RNA, 15 nt, Homo sapiens
gucccucccugccug

SEQ ID NO: 968002 - RNA, 15 nt, Homo sapiens
guccuagacaaacca

SEQ ID NO: 968003 - RNA, 15 nt, Homo sapiens
guccucacucuucaa

SEQ ID NO: 968004 - RNA, 19 nt, Homo sapiens
guccuuguuguuucuugcc

SEQ ID NO: 968005 - RNA, 14 nt, Homo sapiens
guccuuucauuugu

SEQ ID NO: 968006 - RNA, 16 nt, Homo sapiens
gucuauuaauauucag

SEQ ID NO: 968007 - RNA, 12 nt, Homo sapiens
gucucaccagcc

SEQ ID NO: 968008 - RNA, 20 nt, Homo sapiens
gucucccccaaacauggccu

SEQ ID NO: 968009 - RNA, 17 nt, Homo sapiens
gucucuaccuaaggaca

SEQ ID NO: 968010 - RNA, 19 nt, Homo sapiens
gucucuacuaaaaguacaa

SEQ ID NO: 968011 - RNA, 19 nt, Homo sapiens
gucugcgucgucaccaaau

SEQ ID NO: 968012 - RNA, 19 nt, Homo sapiens
gucugguugggcagccaga

SEQ ID NO: 968013 - RNA, 20 nt, Homo sapiens
gucuguuuauuaacuacuga

SEQ ID NO: 968014 - RNA, 15 nt, Homo sapiens
gucuuaauguacaca

SEQ ID NO: 968015 - RNA, 19 nt, Homo sapiens
gucuucuaacucugucuca

SEQ ID NO: 968016 - RNA, 15 nt, Homo sapiens
gucuuggacacugua

SEQ ID NO: 968017 - RNA, 17 nt, Homo sapiens
gucuuuugagcuauuca

SEQ ID NO: 968018 - RNA, 17 nt, Homo sapiens
gugaaauuaagcauuuu

SEQ ID NO: 968019 - RNA, 19 nt, Homo sapiens
gugaagaguuucacaaauc

SEQ ID NO: 968020 - RNA, 12 nt, Homo sapiens
gugaagcagcuc

SEQ ID NO: 968021 - RNA, 11 nt, Homo sapiens
gugaaucugau

SEQ ID NO: 968022 - RNA, 12 nt, Homo sapiens
gugacagucucc

SEQ ID NO: 968023 - RNA, 17 nt, Homo sapiens
gugacaugugaaaccuu

SEQ ID NO: 968024 - RNA, 16 nt, Homo sapiens
gugacccgaccuggcc

SEQ ID NO: 968025 - RNA, 20 nt, Homo sapiens
gugagcuguaaaaauguuac

SEQ ID NO: 968026 - RNA, 12 nt, Homo sapiens
gugagggguccc

SEQ ID NO: 968027 - RNA, 15 nt, Homo sapiens
gugagggugcugacu

SEQ ID NO: 968028 - RNA, 17 nt, Homo sapiens
gugauuuggaagagagg

SEQ ID NO: 968029 - RNA, 20 nt, Homo sapiens
gugcaaaagugaaacauaca

SEQ ID NO: 968030 - RNA, 13 nt, Homo sapiens
gugccuggagcua

SEQ ID NO: 968031 - RNA, 19 nt, Homo sapiens
gugcgcgccaccgugccug

SEQ ID NO: 968032 - RNA, 15 nt, Homo sapiens
gugcuauacacacac

SEQ ID NO: 968033 - RNA, 15 nt, Homo sapiens
gugcucaaggccagc

SEQ ID NO: 968034 - RNA, 13 nt, Homo sapiens
gugcucaccagcc

SEQ ID NO: 968035 - RNA, 16 nt, Homo sapiens
gugcuccaagcacagg

SEQ ID NO: 968036 - RNA, 18 nt, Homo sapiens
gugcuccagauggugcua

SEQ ID NO: 968037 - RNA, 24 nt, Homo sapiens
gugcucugccucagacguugccug

SEQ ID NO: 968038 - RNA, 20 nt, Homo sapiens
gugcugacaacuuagcucag

SEQ ID NO: 968039 - RNA, 12 nt, Homo sapiens
gugcugcaccug

SEQ ID NO: 968040 - RNA, 19 nt, Homo sapiens
gugcugccuugcuucugua

SEQ ID NO: 968041 - RNA, 18 nt, Homo sapiens
gugcuugagagacacugg

SEQ ID NO: 968042 - RNA, 15 nt, Homo sapiens
gugcuugagccagga

SEQ ID NO: 968043 - RNA, 20 nt, Homo sapiens
guggaugaagacccuaucuc

SEQ ID NO: 968044 - RNA, 18 nt, Homo sapiens
guggcacagaagcucauc

SEQ ID NO: 968045 - RNA, 14 nt, Homo sapiens
guggcccucuggau

SEQ ID NO: 968046 - RNA, 14 nt, Homo sapiens
guggccgugccuga

SEQ ID NO: 968047 - RNA, 16 nt, Homo sapiens
guggcucaacauugug

SEQ ID NO: 968048 - RNA, 22 nt, Homo sapiens
guggcugcugaaacucauuuga

SEQ ID NO: 968049 - RNA, 18 nt, Homo sapiens
guggcuuuuuaacaugaa

SEQ ID NO: 968050 - RNA, 23 nt, Homo sapiens
gugggcucugugcagucacugga

SEQ ID NO: 968051 - RNA, 14 nt, Homo sapiens
gugggcugccccau

SEQ ID NO: 968052 - RNA, 16 nt, Homo sapiens
gugguccccguuccac

SEQ ID NO: 968053 - RNA, 22 nt, Homo sapiens
gugguuuuauacugaaggaaaa

SEQ ID NO: 968054 - RNA, 15 nt, Homo sapiens
guguaaaaaaaccac

SEQ ID NO: 968055 - RNA, 16 nt, Homo sapiens
guguaaaauguauauu

SEQ ID NO: 968056 - RNA, 20 nt, Homo sapiens
guguaacccccaguucaaga

SEQ ID NO: 968057 - RNA, 14 nt, Homo sapiens
guguauucauuuua

SEQ ID NO: 968058 - RNA, 14 nt, Homo sapiens
gugucacccugcag

SEQ ID NO: 968059 - RNA, 14 nt, Homo sapiens
gugucuuaauuguc

SEQ ID NO: 968060 - RNA, 20 nt, Homo sapiens
gugugacucgccagcucauu

SEQ ID NO: 968061 - RNA, 12 nt, Homo sapiens
gugugauuugcu

SEQ ID NO: 968062 - RNA, 18 nt, Homo sapiens
gugugcuuccugcuguau

SEQ ID NO: 968063 - RNA, 14 nt, Homo sapiens
guguggagcuguau

SEQ ID NO: 968064 - RNA, 11 nt, Homo sapiens
gugugguggcu

SEQ ID NO: 968065 - RNA, 13 nt, Homo sapiens
gugugucagcuga

SEQ ID NO: 968066 - RNA, 21 nt, Homo sapiens
guguugugccccuucacucau

SEQ ID NO: 968067 - RNA, 14 nt, Homo sapiens
guuaaauauuguca

SEQ ID NO: 968068 - RNA, 19 nt, Homo sapiens
guuacuggauuuguuguuc

SEQ ID NO: 968069 - RNA, 16 nt, Homo sapiens
guuauguuguaauauu

SEQ ID NO: 968070 - RNA, 18 nt, Homo sapiens
guuauuuuuucagacugu

SEQ ID NO: 968071 - RNA, 15 nt, Homo sapiens
guucaauaaagcacu

SEQ ID NO: 968072 - RNA, 22 nt, Homo sapiens
guuccacuggggcaagcuccuc

SEQ ID NO: 968073 - RNA, 14 nt, Homo sapiens
guuccuccuacuua

SEQ ID NO: 968074 - RNA, 12 nt, Homo sapiens
guuccuggugac

SEQ ID NO: 968075 - RNA, 16 nt, Homo sapiens
guuccuuccaguguca

SEQ ID NO: 968076 - RNA, 14 nt, Homo sapiens
guucuaacagugaa

SEQ ID NO: 968077 - RNA, 19 nt, Homo sapiens
guucuaagcccccacacag

SEQ ID NO: 968078 - RNA, 13 nt, Homo sapiens
guucuacacugau

SEQ ID NO: 968079 - RNA, 14 nt, Homo sapiens
guucugugaccacu

SEQ ID NO: 968080 - RNA, 18 nt, Homo sapiens
guucuguugaccugugca

SEQ ID NO: 968081 - RNA, 14 nt, Homo sapiens
guugaggugcaagg

SEQ ID NO: 968082 - RNA, 17 nt, Homo sapiens
guugauguguccgugaa

SEQ ID NO: 968083 - RNA, 21 nt, Homo sapiens
guugcccgaaacuaagccagg

SEQ ID NO: 968084 - RNA, 14 nt, Homo sapiens
guugguucaucccu

SEQ ID NO: 968085 - RNA, 15 nt, Homo sapiens
guugugagcuuugaa

SEQ ID NO: 968086 - RNA, 21 nt, Homo sapiens
guuguguuauagggcacacau

SEQ ID NO: 968087 - RNA, 13 nt, Homo sapiens
guuguuucuugcc

SEQ ID NO: 968088 - RNA, 16 nt, Homo sapiens
guuuaacauacaauca

SEQ ID NO: 968089 - RNA, 11 nt, Homo sapiens
guuuauuccaa

SEQ ID NO: 968090 - RNA, 19 nt, Homo sapiens
guuucaccguguuagccag

SEQ ID NO: 968091 - RNA, 24 nt, Homo sapiens
guuucuugccugaacuccugccau

SEQ ID NO: 968092 - RNA, 16 nt, Homo sapiens
guuugauauaccaaau

SEQ ID NO: 968093 - RNA, 14 nt, Homo sapiens
guuugcugugaaca

SEQ ID NO: 968094 - RNA, 21 nt, Homo sapiens
guuuguccuuuuucacuuuga

SEQ ID NO: 968095 - RNA, 13 nt, Homo sapiens
guuuuacuuuuaa

SEQ ID NO: 968096 - RNA, 12 nt, Homo sapiens
guuuucauuugu

SEQ ID NO: 968097 - RNA, 12 nt, Homo sapiens
guuuucuccucu

SEQ ID NO: 968098 - RNA, 19 nt, Homo sapiens
guuuucuugcucaaaggga

SEQ ID NO: 968099 - RNA, 23 nt, Homo sapiens
guuuuguugagcaugacagccug

SEQ ID NO: 968100 - RNA, 17 nt, Homo sapiens
guuuuucugaagacagu

SEQ ID NO: 968101 - RNA, 16 nt, Homo sapiens
guuuuuuuugcugcua

SEQ ID NO: 968102 - RNA, 23 nt, Homo sapiens
uaaaaaaaaauuguaucucauua

SEQ ID NO: 968103 - RNA, 20 nt, Homo sapiens
uaaaaacuaacagcuacaaa

SEQ ID NO: 968104 - RNA, 18 nt, Homo sapiens
uaaaaaucacuuucauaa

SEQ ID NO: 968105 - RNA, 16 nt, Homo sapiens
uaaaaaucuagcacac

SEQ ID NO: 968106 - RNA, 20 nt, Homo sapiens
uaaaaauuuauacaccagca

SEQ ID NO: 968107 - RNA, 13 nt, Homo sapiens
uaaaacagaaucu

SEQ ID NO: 968108 - RNA, 16 nt, Homo sapiens
uaaaacucacugugau

SEQ ID NO: 968109 - RNA, 18 nt, Homo sapiens
uaaaacucacugugauca

SEQ ID NO: 968110 - RNA, 19 nt, Homo sapiens
uaaaauacuauugccucau

SEQ ID NO: 968111 - RNA, 22 nt, Homo sapiens
uaaaauagaaacauuuguaugg

SEQ ID NO: 968112 - RNA, 14 nt, Homo sapiens
uacauaaggcugga

SEQ ID NO: 968113 - RNA, 19 nt, Homo sapiens
uacauaauugcuguucugc

SEQ ID NO: 968114 - RNA, 17 nt, Homo sapiens
uacaucccgggccucag

SEQ ID NO: 968115 - RNA, 17 nt, Homo sapiens
uacaucucuacuaaaaa

SEQ ID NO: 968116 - RNA, 19 nt, Homo sapiens
uacaucuuuucuaaucaca

SEQ ID NO: 968117 - RNA, 20 nt, Homo sapiens
uacaugagaaagaugucuau

SEQ ID NO: 968118 - RNA, 14 nt, Homo sapiens
uacaugcauauaau

SEQ ID NO: 968119 - RNA, 16 nt, Homo sapiens
uacauguguagccugu

SEQ ID NO: 968120 - RNA, 17 nt, Homo sapiens
uacauuaacggugcuaa

SEQ ID NO: 968121 - RNA, 12 nt, Homo sapiens
uacauucacuuc

SEQ ID NO: 968122 - RNA, 18 nt, Homo sapiens
uaccaaaguaacugaauu

SEQ ID NO: 968123 - RNA, 19 nt, Homo sapiens
uaccaaauccacaagccau

SEQ ID NO: 968124 - RNA, 9 nt, Homo sapiens
uaccacagc

SEQ ID NO: 968125 - RNA, 13 nt, Homo sapiens
uaccacagcaucc

SEQ ID NO: 968126 - RNA, 18 nt, Homo sapiens
uaccacauuuucuuuauc

SEQ ID NO: 968127 - RNA, 15 nt, Homo sapiens
uaccagcauacgcuc

SEQ ID NO: 968128 - RNA, 19 nt, Homo sapiens
uacccauuugggugggagu

SEQ ID NO: 968129 - RNA, 21 nt, Homo sapiens
uacccuuuggccccacuuuga

SEQ ID NO: 968130 - RNA, 13 nt, Homo sapiens
uaccuaaggacaa

SEQ ID NO: 968131 - RNA, 21 nt, Homo sapiens
uaccuaaggacaagacacuga

SEQ ID NO: 968132 - RNA, 17 nt, Homo sapiens
uaccucaaagggcaguu

SEQ ID NO: 968133 - RNA, 11 nt, Homo sapiens
uaccucaaggg

SEQ ID NO: 968134 - RNA, 17 nt, Homo sapiens
uaccucaagggggacug

SEQ ID NO: 968135 - RNA, 16 nt, Homo sapiens
uaccucucagccuuag

SEQ ID NO: 968136 - RNA, 18 nt, Homo sapiens
uaccucuucucucucagu

SEQ ID NO: 968137 - RNA, 17 nt, Homo sapiens
uaccuguauacagugca

SEQ ID NO: 968138 - RNA, 19 nt, Homo sapiens
uaccuuaagagacacucca

SEQ ID NO: 968139 - RNA, 21 nt, Homo sapiens
uaccuuccuguguaugcugag

SEQ ID NO: 968140 - RNA, 15 nt, Homo sapiens
uaccuugaacucuua

SEQ ID NO: 968141 - RNA, 15 nt, Homo sapiens
uaccuuguuccaaau

SEQ ID NO: 968142 - RNA, 14 nt, Homo sapiens
uaccuuuucagggc

SEQ ID NO: 968143 - RNA, 19 nt, Homo sapiens
uacuaacaguaacugccau

SEQ ID NO: 968144 - RNA, 17 nt, Homo sapiens
uacuauaaagcuuuugu

SEQ ID NO: 968145 - RNA, 15 nt, Homo sapiens
uacucagaaccugcu

SEQ ID NO: 968146 - RNA, 17 nt, Homo sapiens
uacuccuaugaucugag

SEQ ID NO: 968147 - RNA, 20 nt, Homo sapiens
uacucuuucugcuuacaaag

SEQ ID NO: 968148 - RNA, 22 nt, Homo sapiens
uacugggacaccauuaccaaaa

SEQ ID NO: 968149 - RNA, 16 nt, Homo sapiens
uacugugugaucuuca

SEQ ID NO: 968150 - RNA, 19 nt, Homo sapiens
uacuuaagagugcugugua

SEQ ID NO: 968151 - RNA, 20 nt, Homo sapiens
uacuuauuguauuuaugugu

SEQ ID NO: 968152 - RNA, 20 nt, Homo sapiens
uacuugucaccugagugaug

SEQ ID NO: 968153 - RNA, 22 nt, Homo sapiens
uacuuuuuuguuaauaagcaaa

SEQ ID NO: 968154 - RNA, 15 nt, Homo sapiens
uagaaaagugaauug

SEQ ID NO: 968155 - RNA, 13 nt, Homo sapiens
uagaaaaugugac

SEQ ID NO: 968156 - RNA, 19 nt, Homo sapiens
uagaaagcauuuugggauc

SEQ ID NO: 968157 - RNA, 11 nt, Homo sapiens
uagaaaugcaa

SEQ ID NO: 968158 - RNA, 13 nt, Homo sapiens
uagaaaugcaaaa

SEQ ID NO: 968159 - RNA, 20 nt, Homo sapiens
uagaacuuuauuaaguaaaa

SEQ ID NO: 968160 - RNA, 19 nt, Homo sapiens
uagaacuuuucuauuaacu

SEQ ID NO: 968161 - RNA, 21 nt, Homo sapiens
uagaagcuguaacagaauaca

SEQ ID NO: 968162 - RNA, 19 nt, Homo sapiens
uagaauuuugaguauucca

SEQ ID NO: 968163 - RNA, 15 nt, Homo sapiens
uagacaaaaaguaua

SEQ ID NO: 968164 - RNA, 21 nt, Homo sapiens
uagacuaccggacacucguca

SEQ ID NO: 968165 - RNA, 19 nt, Homo sapiens
uagagaaguuacacagaaa

SEQ ID NO: 968166 - RNA, 14 nt, Homo sapiens
uagagaugagccca

SEQ ID NO: 968167 - RNA, 12 nt, Homo sapiens
uagagauugcau

SEQ ID NO: 968168 - RNA, 15 nt, Homo sapiens
uagagcuagcugcca

SEQ ID NO: 968169 - RNA, 18 nt, Homo sapiens
uagaguguagacuguggc

SEQ ID NO: 968170 - RNA, 21 nt, Homo sapiens
uagaguuuacuauuuuagcag

SEQ ID NO: 968171 - RNA, 19 nt, Homo sapiens
uagaucaagcauuacacac

SEQ ID NO: 968172 - RNA, 21 nt, Homo sapiens
uagauccaauucccaccacua

SEQ ID NO: 968173 - RNA, 22 nt, Homo sapiens
uagaucuaguucucaaucacug

SEQ ID NO: 968174 - RNA, 17 nt, Homo sapiens
uagauguagucuugacg

SEQ ID NO: 968175 - RNA, 18 nt, Homo sapiens
uagauguggccuuugaau

SEQ ID NO: 968176 - RNA, 13 nt, Homo sapiens
uagauucagggaa

SEQ ID NO: 968177 - RNA, 21 nt, Homo sapiens
uagauucuuaauucaugagga

SEQ ID NO: 968178 - RNA, 15 nt, Homo sapiens
uagcacaguauuuaa

SEQ ID NO: 968179 - RNA, 19 nt, Homo sapiens
uagcacugggugugagaau

SEQ ID NO: 968180 - RNA, 20 nt, Homo sapiens
uagcagaguuaaaucucaaa

SEQ ID NO: 968181 - RNA, 21 nt, Homo sapiens
uagcagauuucuugcuucaua

SEQ ID NO: 968182 - RNA, 14 nt, Homo sapiens
uagcauguuccucc

SEQ ID NO: 968183 - RNA, 20 nt, Homo sapiens
uagcauguuccuccuuuucu

SEQ ID NO: 968184 - RNA, 21 nt, Homo sapiens
uagccacagcugcuguucuca

SEQ ID NO: 968185 - RNA, 22 nt, Homo sapiens
uagccagccccucuuccccaau

SEQ ID NO: 968186 - RNA, 16 nt, Homo sapiens
uagcgaagaccaguau

SEQ ID NO: 968187 - RNA, 23 nt, Homo sapiens
uagcuaaauaaauggguguauau

SEQ ID NO: 968188 - RNA, 20 nt, Homo sapiens
uagcucaaauaggucaucau

SEQ ID NO: 968189 - RNA, 19 nt, Homo sapiens
uagcuccauaaaguacaaa

SEQ ID NO: 968190 - RNA, 22 nt, Homo sapiens
uagcuccauaaaguacaaauga

SEQ ID NO: 968191 - RNA, 22 nt, Homo sapiens
uagcucucucuagaaugagcaa

SEQ ID NO: 968192 - RNA, 16 nt, Homo sapiens
uagcucugaaugcuau

SEQ ID NO: 968193 - RNA, 17 nt, Homo sapiens
uagcugucuccaaaaau

SEQ ID NO: 968194 - RNA, 23 nt, Homo sapiens
uagcugucuccaaaaaugcuauu

SEQ ID NO: 968195 - RNA, 11 nt, Homo sapiens
uagcuguucua

SEQ ID NO: 968196 - RNA, 21 nt, Homo sapiens
uaggaaaauauggguugcauu

SEQ ID NO: 968197 - RNA, 17 nt, Homo sapiens
uaggaaaguuucuucaa

SEQ ID NO: 968198 - RNA, 15 nt, Homo sapiens
uaggaaauaucauua

SEQ ID NO: 968199 - RNA, 18 nt, Homo sapiens
uaggaauguccaccauga

SEQ ID NO: 968200 - RNA, 16 nt, Homo sapiens
uaggaggaaacaguuc

SEQ ID NO: 968201 - RNA, 15 nt, Homo sapiens
uaggaugcuugggaa

SEQ ID NO: 968202 - RNA, 16 nt, Homo sapiens
uaggcauucuggaccu

SEQ ID NO: 968203 - RNA, 19 nt, Homo sapiens
uagguccccauacuccuau

SEQ ID NO: 968204 - RNA, 13 nt, Homo sapiens
uaggucggcacuu

SEQ ID NO: 968205 - RNA, 17 nt, Homo sapiens
uaguaacuauaagauac

SEQ ID NO: 968206 - RNA, 17 nt, Homo sapiens
uaguaauaagauggcug

SEQ ID NO: 968207 - RNA, 13 nt, Homo sapiens
uaguacugggaau

SEQ ID NO: 968208 - RNA, 15 nt, Homo sapiens
uaguauaaaaaaugg

SEQ ID NO: 968209 - RNA, 21 nt, Homo sapiens
uagucacauggccuaugcaca

SEQ ID NO: 968210 - RNA, 23 nt, Homo sapiens
uagucacauggccuaugcacaua

SEQ ID NO: 968211 - RNA, 15 nt, Homo sapiens
uagucaccuucauga

SEQ ID NO: 968212 - RNA, 17 nt, Homo sapiens
uagucccagcuacuccg

SEQ ID NO: 968213 - RNA, 23 nt, Homo sapiens
uagucccauuuuucucuugccau

SEQ ID NO: 968214 - RNA, 15 nt, Homo sapiens
uagucucuccccugg

SEQ ID NO: 968215 - RNA, 15 nt, Homo sapiens
uagucugcuuuggua

SEQ ID NO: 968216 - RNA, 19 nt, Homo sapiens
uagucugugggagugagag

SEQ ID NO: 968217 - RNA, 21 nt, Homo sapiens
uagucuuggaaaaaaaccaca

SEQ ID NO: 968218 - RNA, 22 nt, Homo sapiens
uagucuuggaagcuguuuggaa

SEQ ID NO: 968219 - RNA, 21 nt, Homo sapiens
uagugugaaauauauuacuua

SEQ ID NO: 968220 - RNA, 18 nt, Homo sapiens
uaguuacuaaacauguau

SEQ ID NO: 968221 - RNA, 22 nt, Homo sapiens
uaguucaauauuuguuacuguu

SEQ ID NO: 968222 - RNA, 19 nt, Homo sapiens
uaguugcguggacucugca

SEQ ID NO: 968223 - RNA, 22 nt, Homo sapiens
uaguugcguggacucugcacau

SEQ ID NO: 968224 - RNA, 18 nt, Homo sapiens
uauaaagaacuuguguag

SEQ ID NO: 968225 - RNA, 14 nt, Homo sapiens
uauaaagauuuucu

SEQ ID NO: 968226 - RNA, 15 nt, Homo sapiens
ugagggccugcugga

SEQ ID NO: 968227 - RNA, 17 nt, Homo sapiens
ugagguuucuucagggu

SEQ ID NO: 968228 - RNA, 18 nt, Homo sapiens
ugaguauuccaugagcug

SEQ ID NO: 968229 - RNA, 16 nt, Homo sapiens
ugagugucuagcaaag

SEQ ID NO: 968230 - RNA, 22 nt, Homo sapiens
ugaguugcacuuauugaccauu

SEQ ID NO: 968231 - RNA, 14 nt, Homo sapiens
ugauaacagaguga

SEQ ID NO: 968232 - RNA, 15 nt, Homo sapiens
ugauagauguagucu

SEQ ID NO: 968233 - RNA, 14 nt, Homo sapiens
ugauauauugcugu

SEQ ID NO: 968234 - RNA, 15 nt, Homo sapiens
ugauauguccucaga

SEQ ID NO: 968235 - RNA, 17 nt, Homo sapiens
ugaucagugggccucca

SEQ ID NO: 968236 - RNA, 17 nt, Homo sapiens
ugaucauuacauggcug

SEQ ID NO: 968237 - RNA, 14 nt, Homo sapiens
ugaucggaaagcuc

SEQ ID NO: 968238 - RNA, 18 nt, Homo sapiens
ugaucuccauaaacauga

SEQ ID NO: 968239 - RNA, 13 nt, Homo sapiens
ugaugauacuucc

SEQ ID NO: 968240 - RNA, 16 nt, Homo sapiens
ugauggccaccagcuu

SEQ ID NO: 968241 - RNA, 23 nt, Homo sapiens
ugaugggaaauuauuuuucagga

SEQ ID NO: 968242 - RNA, 22 nt, Homo sapiens
ugaugggccagcaggagccagc

SEQ ID NO: 968243 - RNA, 21 nt, Homo sapiens
ugauggucucaagcuaugauc

SEQ ID NO: 968244 - RNA, 15 nt, Homo sapiens
ugauugaagucuucu

SEQ ID NO: 968245 - RNA, 17 nt, Homo sapiens
ugauuggaccaggccau

SEQ ID NO: 968246 - RNA, 23 nt, Homo sapiens
ugauuggaccaggccauucugcc

SEQ ID NO: 968247 - RNA, 20 nt, Homo sapiens
ugauugggaaaacauuugcu

SEQ ID NO: 968248 - RNA, 17 nt, Homo sapiens
ugauugucagcuacuaa

SEQ ID NO: 968249 - RNA, 22 nt, Homo sapiens
ugauuucuuauuauuauauguu

SEQ ID NO: 968250 - RNA, 19 nt, Homo sapiens
ugcaaagcuuuggcugaga

SEQ ID NO: 968251 - RNA, 17 nt, Homo sapiens
ugcaaaguguauuagga

SEQ ID NO: 968252 - RNA, 22 nt, Homo sapiens
ugcaacccagucacacuguggc

SEQ ID NO: 968253 - RNA, 14 nt, Homo sapiens
ugcacaagcacuau

SEQ ID NO: 968254 - RNA, 22 nt, Homo sapiens
ugcacaagguggaguguacugg

SEQ ID NO: 968255 - RNA, 18 nt, Homo sapiens
ugcacacagaaugcucag

SEQ ID NO: 968256 - RNA, 23 nt, Homo sapiens
ugcacaggcagauguuugccuca

SEQ ID NO: 968257 - RNA, 17 nt, Homo sapiens
ugcacagucacugcucu

SEQ ID NO: 968258 - RNA, 20 nt, Homo sapiens
ugcacagucacugcucuuca

SEQ ID NO: 968259 - RNA, 22 nt, Homo sapiens
ugcacauauggacucugcacau

SEQ ID NO: 968260 - RNA, 23 nt, Homo sapiens
ugcacaugucuuguacaugugua

SEQ ID NO: 968261 - RNA, 21 nt, Homo sapiens
ugcacauuucuuugcauucca

SEQ ID NO: 968262 - RNA, 20 nt, Homo sapiens
ugcaccacuuccgucccauc

SEQ ID NO: 968263 - RNA, 14 nt, Homo sapiens
ugcacccaccuguu

SEQ ID NO: 968264 - RNA, 13 nt, Homo sapiens
ugcaccuacccau

SEQ ID NO: 968265 - RNA, 21 nt, Homo sapiens
ugcaccuugugucuguacacg

SEQ ID NO: 968266 - RNA, 22 nt, Homo sapiens
ugcaccuugugucuguacacgu

SEQ ID NO: 968267 - RNA, 13 nt, Homo sapiens
ugcaccuuugcac

SEQ ID NO: 968268 - RNA, 22 nt, Homo sapiens
ugcacuccagccugggggacag

SEQ ID NO: 968269 - RNA, 20 nt, Homo sapiens
ugcacuccagcuugggcaac

SEQ ID NO: 968270 - RNA, 15 nt, Homo sapiens
ugcacuuguuauauu

SEQ ID NO: 968271 - RNA, 21 nt, Homo sapiens
ugcacuuuuagaaaugcauau

SEQ ID NO: 968272 - RNA, 20 nt, Homo sapiens
ugcagaugccacccuagcca

SEQ ID NO: 968273 - RNA, 17 nt, Homo sapiens
ugcagcagcuucccuug

SEQ ID NO: 968274 - RNA, 15 nt, Homo sapiens
ugcagcucuccacca

SEQ ID NO: 968275 - RNA, 22 nt, Homo sapiens
ugcaggcaggaacaaacagggc

SEQ ID NO: 968276 - RNA, 19 nt, Homo sapiens
ugcaguacauuaauauuca

SEQ ID NO: 968277 - RNA, 14 nt, Homo sapiens
ugcagucaucuccc

SEQ ID NO: 968278 - RNA, 14 nt, Homo sapiens
ugcaguucuacuca

SEQ ID NO: 968279 - RNA, 22 nt, Homo sapiens
ugcauagcgaagaccaguaugg

SEQ ID NO: 968280 - RNA, 22 nt, Homo sapiens
ugcauauuauaaaggauaaaga

SEQ ID NO: 968281 - RNA, 21 nt, Homo sapiens
ugcaucaagggcuuuaucaaa

SEQ ID NO: 968282 - RNA, 22 nt, Homo sapiens
ugcauucauuuuuauagcaaca

SEQ ID NO: 968283 - RNA, 20 nt, Homo sapiens
ugcauuuaaaacagacacug

SEQ ID NO: 968284 - RNA, 21 nt, Homo sapiens
ugcauuuuuauuaaagcauuu

SEQ ID NO: 968285 - RNA, 15 nt, Homo sapiens
ugccaauacagacaa

SEQ ID NO: 968286 - RNA, 17 nt, Homo sapiens
ugccacggaaacauaca

SEQ ID NO: 968287 - RNA, 19 nt, Homo sapiens
ugccacuuuacccaccuag

SEQ ID NO: 968288 - RNA, 16 nt, Homo sapiens
ugccagacauggaccu

SEQ ID NO: 968289 - RNA, 18 nt, Homo sapiens
ugccaggcuguaagcauu

SEQ ID NO: 968290 - RNA, 15 nt, Homo sapiens
ugccauggaucugau

SEQ ID NO: 968291 - RNA, 11 nt, Homo sapiens
ugccaugucug

SEQ ID NO: 968292 - RNA, 16 nt, Homo sapiens
ugcccacgcagaggac

SEQ ID NO: 968293 - RNA, 17 nt, Homo sapiens
ugcccauccugacugaa

SEQ ID NO: 968294 - RNA, 18 nt, Homo sapiens
ugcccauccugacugaaa

SEQ ID NO: 968295 - RNA, 20 nt, Homo sapiens
ugcccauccugccauccuca

SEQ ID NO: 968296 - RNA, 18 nt, Homo sapiens
ugcccccucccacccugc

SEQ ID NO: 968297 - RNA, 16 nt, Homo sapiens
ugcccugaacauacac

SEQ ID NO: 968298 - RNA, 15 nt, Homo sapiens
ugcccuucacuguca

SEQ ID NO: 968299 - RNA, 14 nt, Homo sapiens
ugccgucugugcuu

SEQ ID NO: 968300 - RNA, 15 nt, Homo sapiens
ugccuacagccaggu

SEQ ID NO: 968301 - RNA, 15 nt, Homo sapiens
ugccuaguaacacau

SEQ ID NO: 968302 - RNA, 16 nt, Homo sapiens
ugccucccacuucacu

SEQ ID NO: 968303 - RNA, 20 nt, Homo sapiens
ugccucccucugcuguguuc

SEQ ID NO: 968304 - RNA, 14 nt, Homo sapiens
ugccuggacacugu

SEQ ID NO: 968305 - RNA, 15 nt, Homo sapiens
ugccuggacacugua

SEQ ID NO: 968306 - RNA, 20 nt, Homo sapiens
ugccugggguggacauucag

SEQ ID NO: 968307 - RNA, 18 nt, Homo sapiens
ugccuggguugcugcugu

SEQ ID NO: 968308 - RNA, 21 nt, Homo sapiens
ugccuguuaaggaaacuuuau

SEQ ID NO: 968309 - RNA, 19 nt, Homo sapiens
ugccuuucuacaacugauu

SEQ ID NO: 968310 - RNA, 20 nt, Homo sapiens
ugcgaagacccucuugccca

SEQ ID NO: 968311 - RNA, 16 nt, Homo sapiens
ugcgccaaucccgcca

SEQ ID NO: 968312 - RNA, 16 nt, Homo sapiens
ugcggauggauggaag

SEQ ID NO: 968313 - RNA, 17 nt, Homo sapiens
ugcuaacaaagacaaaa

SEQ ID NO: 968314 - RNA, 18 nt, Homo sapiens
ugcuaagugcuuauuaca

SEQ ID NO: 968315 - RNA, 18 nt, Homo sapiens
ugcuaccacagcaacuau

SEQ ID NO: 968316 - RNA, 15 nt, Homo sapiens
ugcuaucaccaauca

SEQ ID NO: 968317 - RNA, 12 nt, Homo sapiens
ugcuaucugggc

SEQ ID NO: 968318 - RNA, 18 nt, Homo sapiens
ugcucaggagccaccagc

SEQ ID NO: 968319 - RNA, 18 nt, Homo sapiens
ugcucaggguucaucuga

SEQ ID NO: 968320 - RNA, 20 nt, Homo sapiens
ugcucaguguccagcuucca

SEQ ID NO: 968321 - RNA, 14 nt, Homo sapiens
ugcuccagggcuuu

SEQ ID NO: 968322 - RNA, 14 nt, Homo sapiens
ugcuccccugccac

SEQ ID NO: 968323 - RNA, 15 nt, Homo sapiens
ugcugaaugucauuu

SEQ ID NO: 968324 - RNA, 15 nt, Homo sapiens
ugcugaggcccagug

SEQ ID NO: 968325 - RNA, 17 nt, Homo sapiens
ugcugaggcccagugca

SEQ ID NO: 968326 - RNA, 23 nt, Homo sapiens
ugcugaggcccagugcauaugca

SEQ ID NO: 968327 - RNA, 17 nt, Homo sapiens
ugcugccaugacagagg

SEQ ID NO: 968328 - RNA, 15 nt, Homo sapiens
ugcugcgucagacca

SEQ ID NO: 968329 - RNA, 14 nt, Homo sapiens
ugcuguacaaaagc

SEQ ID NO: 968330 - RNA, 19 nt, Homo sapiens
ugcuguaugugagcuguaa

SEQ ID NO: 968331 - RNA, 18 nt, Homo sapiens
ugcuguccagugccuaca

SEQ ID NO: 968332 - RNA, 20 nt, Homo sapiens
ugcugugccucgcauccuau

SEQ ID NO: 968333 - RNA, 14 nt, Homo sapiens
ugcuguuguucucg

SEQ ID NO: 968334 - RNA, 21 nt, Homo sapiens
ugcuuaaaagguuaaauuuca

SEQ ID NO: 968335 - RNA, 13 nt, Homo sapiens
ugcuuacaaagac

SEQ ID NO: 968336 - RNA, 19 nt, Homo sapiens
ugcuuaccucucagccuua

SEQ ID NO: 968337 - RNA, 19 nt, Homo sapiens
ugcuuaguauugacacucu

SEQ ID NO: 968338 - RNA, 19 nt, Homo sapiens
ugcuucacaguagagccag

SEQ ID NO: 968339 - RNA, 22 nt, Homo sapiens
ugcuucacaguagagccagcuu

SEQ ID NO: 968340 - RNA, 16 nt, Homo sapiens
auucuauccaucuccu

SEQ ID NO: 968341 - RNA, 13 nt, Homo sapiens
auucucugaguca

SEQ ID NO: 968342 - RNA, 21 nt, Homo sapiens
auucugccgcccccuccugaa

SEQ ID NO: 968343 - RNA, 16 nt, Homo sapiens
auucuggaccucuggg

SEQ ID NO: 968344 - RNA, 18 nt, Homo sapiens
auucuuuagagauuauaa

SEQ ID NO: 968345 - RNA, 22 nt, Homo sapiens
auucuuuagagauuauaacaaa

SEQ ID NO: 968346 - RNA, 21 nt, Homo sapiens
auugaagccaacaaaccuucc

SEQ ID NO: 968347 - RNA, 12 nt, Homo sapiens
auugaaugaaac

SEQ ID NO: 968348 - RNA, 12 nt, Homo sapiens
auugacacugaa

SEQ ID NO: 968349 - RNA, 20 nt, Homo sapiens
auugagaucacuacucagug

SEQ ID NO: 968350 - RNA, 14 nt, Homo sapiens
auugauccaggaga

SEQ ID NO: 968351 - RNA, 15 nt, Homo sapiens
auugcaacagacugu

SEQ ID NO: 968352 - RNA, 13 nt, Homo sapiens
auugcagcacaga

SEQ ID NO: 968353 - RNA, 14 nt, Homo sapiens
auugcauacuuugu

SEQ ID NO: 968354 - RNA, 14 nt, Homo sapiens
auuggaagugcagu

SEQ ID NO: 968355 - RNA, 15 nt, Homo sapiens
auuggccuguucccc

SEQ ID NO: 968356 - RNA, 19 nt, Homo sapiens
auugucagcuacuaaugau

SEQ ID NO: 968357 - RNA, 22 nt, Homo sapiens
auugucauaggauuaagcaguu

SEQ ID NO: 968358 - RNA, 22 nt, Homo sapiens
auugucuagugaggaagacaag

SEQ ID NO: 968359 - RNA, 17 nt, Homo sapiens
auugugaaccaugguga

SEQ ID NO: 968360 - RNA, 17 nt, Homo sapiens
auuguuaucuuuaccuc

SEQ ID NO: 968361 - RNA, 16 nt, Homo sapiens
auuguugaacacuuga

SEQ ID NO: 968362 - RNA, 13 nt, Homo sapiens
auuguuucauuca

SEQ ID NO: 968363 - RNA, 14 nt, Homo sapiens
auuuaaaaacauuu

SEQ ID NO: 968364 - RNA, 20 nt, Homo sapiens
auuuaaaaggacugcugauu

SEQ ID NO: 968365 - RNA, 14 nt, Homo sapiens
auuuacaagggaag

SEQ ID NO: 968366 - RNA, 14 nt, Homo sapiens
auuuacuaaaucaa

SEQ ID NO: 968367 - RNA, 16 nt, Homo sapiens
auuuacuaacaguaac

SEQ ID NO: 968368 - RNA, 13 nt, Homo sapiens
auuuacuggaccc

SEQ ID NO: 968369 - RNA, 21 nt, Homo sapiens
auuuagaccccccaccugugu

SEQ ID NO: 968370 - RNA, 22 nt, Homo sapiens
auuucaaaguuuuguuguacuu

SEQ ID NO: 968371 - RNA, 15 nt, Homo sapiens
auuucagcugaucag

SEQ ID NO: 968372 - RNA, 11 nt, Homo sapiens
auuucagggug

SEQ ID NO: 968373 - RNA, 16 nt, Homo sapiens
auuucauuuagcuuuu

SEQ ID NO: 968374 - RNA, 18 nt, Homo sapiens
auuucccugcagaccuca

SEQ ID NO: 968375 - RNA, 23 nt, Homo sapiens
auuucccuuccaaagagggaugu

SEQ ID NO: 968376 - RNA, 22 nt, Homo sapiens
auuuccuauuguucacuuuauu

SEQ ID NO: 968377 - RNA, 18 nt, Homo sapiens
auuuccugauaacauuau

SEQ ID NO: 968378 - RNA, 13 nt, Homo sapiens
auuuccuuuaugu

SEQ ID NO: 968379 - RNA, 19 nt, Homo sapiens
auuuccuuuuugacacuga

SEQ ID NO: 968380 - RNA, 15 nt, Homo sapiens
auuucugaacaguac

SEQ ID NO: 968381 - RNA, 17 nt, Homo sapiens
auuucuuaugugacauu

SEQ ID NO: 968382 - RNA, 19 nt, Homo sapiens
auuucuuauuauuauaugu

SEQ ID NO: 968383 - RNA, 23 nt, Homo sapiens
auuucuuuauggucgauauacaa

SEQ ID NO: 968384 - RNA, 14 nt, Homo sapiens
auuugaagauuuaa

SEQ ID NO: 968385 - RNA, 19 nt, Homo sapiens
auuugaggucaaguaagaa

SEQ ID NO: 968386 - RNA, 20 nt, Homo sapiens
auuuguaugcucauugaacu

SEQ ID NO: 968387 - RNA, 17 nt, Homo sapiens
auuuguguaacugaaag

SEQ ID NO: 968388 - RNA, 16 nt, Homo sapiens
auuuuaagaagacaua

SEQ ID NO: 968389 - RNA, 15 nt, Homo sapiens
auuuuaauacauuga

SEQ ID NO: 968390 - RNA, 17 nt, Homo sapiens
auuuuaauuacugcuau

SEQ ID NO: 968391 - RNA, 15 nt, Homo sapiens
auuuuacuacaguaa

SEQ ID NO: 968392 - RNA, 12 nt, Homo sapiens
auuuuacuguau

SEQ ID NO: 968393 - RNA, 15 nt, Homo sapiens
auuuuagaaaacacc

SEQ ID NO: 968394 - RNA, 24 nt, Homo sapiens
auuuucaagaauaaucacgcuuuc

SEQ ID NO: 968395 - RNA, 16 nt, Homo sapiens
auuuucaucaaaacca

SEQ ID NO: 968396 - RNA, 15 nt, Homo sapiens
auuuuccaggcuucu

SEQ ID NO: 968397 - RNA, 19 nt, Homo sapiens
auuuucuaauguugacuuu

SEQ ID NO: 968398 - RNA, 16 nt, Homo sapiens
auuuugaguauuccau

SEQ ID NO: 968399 - RNA, 16 nt, Homo sapiens
auuuuggcgaaucuca

SEQ ID NO: 968400 - RNA, 18 nt, Homo sapiens
auuuuguaccaaguaaau

SEQ ID NO: 968401 - RNA, 15 nt, Homo sapiens
auuuuguauguuaaa

SEQ ID NO: 968402 - RNA, 22 nt, Homo sapiens
auuuugugaauuugggacauaa

SEQ ID NO: 968403 - RNA, 20 nt, Homo sapiens
auuuuguguaaaaaaaccac

SEQ ID NO: 968404 - RNA, 17 nt, Homo sapiens
auuuuuaagcugcaaau

SEQ ID NO: 968405 - RNA, 16 nt, Homo sapiens
auuuuuaccuguuuaa

SEQ ID NO: 968406 - RNA, 14 nt, Homo sapiens
auuuuuauuacaac

SEQ ID NO: 968407 - RNA, 15 nt, Homo sapiens
auuuuucaaguauac

SEQ ID NO: 968408 - RNA, 15 nt, Homo sapiens
auuuuuccacuuaaa

SEQ ID NO: 968409 - RNA, 23 nt, Homo sapiens
auuuuuuuucuuccaacauguga

SEQ ID NO: 968410 - RNA, 17 nt, Homo sapiens
caaaaacagaauuugag

SEQ ID NO: 968411 - RNA, 10 nt, Homo sapiens
caaaaaccaa

SEQ ID NO: 968412 - RNA, 14 nt, Homo sapiens
caaaaagaccagcc

SEQ ID NO: 968413 - RNA, 20 nt, Homo sapiens
caaaaccaaguaucacacuu

SEQ ID NO: 968414 - RNA, 14 nt, Homo sapiens
caaaaccuguauua

SEQ ID NO: 968415 - RNA, 19 nt, Homo sapiens
caaaagagaaaaacaaaac

SEQ ID NO: 968416 - RNA, 22 nt, Homo sapiens
caaaauacagauuugaauagca

SEQ ID NO: 968417 - RNA, 17 nt, Homo sapiens
caaaauauagcuuucau

SEQ ID NO: 968418 - RNA, 19 nt, Homo sapiens
caaacaugcggugccauga

SEQ ID NO: 968419 - RNA, 18 nt, Homo sapiens
caaacgggauacaggaga

SEQ ID NO: 968420 - RNA, 18 nt, Homo sapiens
caaacucauccucuuuua

SEQ ID NO: 968421 - RNA, 15 nt, Homo sapiens
caaacugaggaauuu

SEQ ID NO: 968422 - RNA, 23 nt, Homo sapiens
caaacugggaaccccuuucccac

SEQ ID NO: 968423 - RNA, 16 nt, Homo sapiens
caaacuuuguuuguca

SEQ ID NO: 968424 - RNA, 20 nt, Homo sapiens
caaagaaauuccccaagcac

SEQ ID NO: 968425 - RNA, 15 nt, Homo sapiens
caaagacacagacuu

SEQ ID NO: 968426 - RNA, 16 nt, Homo sapiens
caaagacacagacuug

SEQ ID NO: 968427 - RNA, 20 nt, Homo sapiens
caaagaggcugccccucuca

SEQ ID NO: 968428 - RNA, 22 nt, Homo sapiens
caaagcaucccucuuagucuag

SEQ ID NO: 968429 - RNA, 13 nt, Homo sapiens
caaagccaaaacc

SEQ ID NO: 968430 - RNA, 14 nt, Homo sapiens
caaagccuuacaaa

SEQ ID NO: 968431 - RNA, 14 nt, Homo sapiens
caaaggagcuuucu

SEQ ID NO: 968432 - RNA, 17 nt, Homo sapiens
caaagggaacagugaau

SEQ ID NO: 968433 - RNA, 17 nt, Homo sapiens
caaaguaccuugaacuc

SEQ ID NO: 968434 - RNA, 21 nt, Homo sapiens
caaagugccagagucuaggcu

SEQ ID NO: 968435 - RNA, 23 nt, Homo sapiens
caaagugccagagucuaggcuaa

SEQ ID NO: 968436 - RNA, 14 nt, Homo sapiens
caaauaaaauauca

SEQ ID NO: 968437 - RNA, 17 nt, Homo sapiens
caaauaauuccauucca

SEQ ID NO: 968438 - RNA, 17 nt, Homo sapiens
caaauacacauuugcua

SEQ ID NO: 968439 - RNA, 18 nt, Homo sapiens
caaauauaagacauuugu

SEQ ID NO: 968440 - RNA, 22 nt, Homo sapiens
caaauccuucaaaauaaaaagu

SEQ ID NO: 968441 - RNA, 15 nt, Homo sapiens
caaaugaaauguaug

SEQ ID NO: 968442 - RNA, 14 nt, Homo sapiens
caaaugaacuugca

SEQ ID NO: 968443 - RNA, 13 nt, Homo sapiens
caaauucauggca

SEQ ID NO: 968444 - RNA, 21 nt, Homo sapiens
caaauucauggugcacugagc

SEQ ID NO: 968445 - RNA, 16 nt, Homo sapiens
caaauuuuucaaauca

SEQ ID NO: 968446 - RNA, 15 nt, Homo sapiens
caacaauugguaaaa

SEQ ID NO: 968447 - RNA, 10 nt, Homo sapiens
caacacuuaa

SEQ ID NO: 968448 - RNA, 20 nt, Homo sapiens
caacagcuaggaaauaucau

SEQ ID NO: 968449 - RNA, 23 nt, Homo sapiens
caacagcuuuucgucuucagugu

SEQ ID NO: 968450 - RNA, 22 nt, Homo sapiens
caaccaguuuauccaccaagaa

SEQ ID NO: 968451 - RNA, 13 nt, Homo sapiens
caacccuaucucc

SEQ ID NO: 968452 - RNA, 14 nt, Homo sapiens
caaccuuccagcuc

SEQ ID NO: 968453 - RNA, 14 nt, Homo sapiens
caacuaaugccuua

SEQ ID NO: 968454 - RNA, 18 nt, Homo sapiens
caacuaaugccuuacucu

SEQ ID NO: 968455 - RNA, 15 nt, Homo sapiens
caacuagcugggacu

SEQ ID NO: 968456 - RNA, 19 nt, Homo sapiens
auuucucauugacuuuuau

SEQ ID NO: 968457 - RNA, 19 nt, Homo sapiens
auuucuccucccuuccuuu

SEQ ID NO: 968458 - RNA, 16 nt, Homo sapiens
auuucucucagauuuc

SEQ ID NO: 968459 - RNA, 20 nt, Homo sapiens
auuucugaggugcacuggga

SEQ ID NO: 968460 - RNA, 11 nt, Homo sapiens
auuucuuugca

SEQ ID NO: 968461 - RNA, 13 nt, Homo sapiens
auuugacuauucu

SEQ ID NO: 968462 - RNA, 22 nt, Homo sapiens
auuugggcuagacuaccggaca

SEQ ID NO: 968463 - RNA, 17 nt, Homo sapiens
auuugucauucauucaa

SEQ ID NO: 968464 - RNA, 16 nt, Homo sapiens
auuuuaauacauugau

SEQ ID NO: 968465 - RNA, 15 nt, Homo sapiens
auuuuaauagcuuua

SEQ ID NO: 968466 - RNA, 16 nt, Homo sapiens
auuuuacaagggcaua

SEQ ID NO: 968467 - RNA, 23 nt, Homo sapiens
auuuuacaauuuuuuaucaugca

SEQ ID NO: 968468 - RNA, 21 nt, Homo sapiens
auuuuacuacaguaaauggca

SEQ ID NO: 968469 - RNA, 17 nt, Homo sapiens
auuuuaugagacagggu

SEQ ID NO: 968470 - RNA, 13 nt, Homo sapiens
auuuucaucaaaa

SEQ ID NO: 968471 - RNA, 14 nt, Homo sapiens
auuuucuacuuuaa

SEQ ID NO: 968472 - RNA, 14 nt, Homo sapiens
auuuugaguauucc

SEQ ID NO: 968473 - RNA, 17 nt, Homo sapiens
auuuugcacugaggaua

SEQ ID NO: 968474 - RNA, 24 nt, Homo sapiens
cagagcaagagauaagucuuucau

SEQ ID NO: 968475 - RNA, 15 nt, Homo sapiens
cagagcagaugcaga

SEQ ID NO: 968476 - RNA, 12 nt, Homo sapiens
cagagccagaaa

SEQ ID NO: 968477 - RNA, 16 nt, Homo sapiens
cagagcuccucacuua

SEQ ID NO: 968478 - RNA, 20 nt, Homo sapiens
cagagcucuggguugugcac

SEQ ID NO: 968479 - RNA, 21 nt, Homo sapiens
cagagcucuggguugugcaca

SEQ ID NO: 968480 - RNA, 22 nt, Homo sapiens
cagagcugguggacccagggaa

SEQ ID NO: 968481 - RNA, 20 nt, Homo sapiens
cagaggaugcaacaaaugug

SEQ ID NO: 968482 - RNA, 22 nt, Homo sapiens
cagaggaugcaacaaauguggc

SEQ ID NO: 968483 - RNA, 14 nt, Homo sapiens
cagaggauguggcc

SEQ ID NO: 968484 - RNA, 17 nt, Homo sapiens
cagaguccagugcucug

SEQ ID NO: 968485 - RNA, 19 nt, Homo sapiens
cagagugagggaaugguag

SEQ ID NO: 968486 - RNA, 15 nt, Homo sapiens
cagaguuauggugcc

SEQ ID NO: 968487 - RNA, 12 nt, Homo sapiens
cagaguuuucau

SEQ ID NO: 968488 - RNA, 20 nt, Homo sapiens
cagauagcacugggugugag

SEQ ID NO: 968489 - RNA, 14 nt, Homo sapiens
cagaucugauuugu

SEQ ID NO: 968490 - RNA, 16 nt, Homo sapiens
cagaugguagaacuaa

SEQ ID NO: 968491 - RNA, 20 nt, Homo sapiens
cagaugguagaacuaaacaa

SEQ ID NO: 968492 - RNA, 20 nt, Homo sapiens
cagauguguguucucaguga

SEQ ID NO: 968493 - RNA, 13 nt, Homo sapiens
cagauucuuucag

SEQ ID NO: 968494 - RNA, 16 nt, Homo sapiens
cagauuuacuaaauca

SEQ ID NO: 968495 - RNA, 15 nt, Homo sapiens
cagauuuucagcaaa

SEQ ID NO: 968496 - RNA, 18 nt, Homo sapiens
cagcaauaggguggcaca

SEQ ID NO: 968497 - RNA, 19 nt, Homo sapiens
cagcacagagcaguggcca

SEQ ID NO: 968498 - RNA, 17 nt, Homo sapiens
caucauuucaggaguua

SEQ ID NO: 968499 - RNA, 20 nt, Homo sapiens
cauccaaaguucccuaugaa

SEQ ID NO: 968500 - RNA, 18 nt, Homo sapiens
cauccagaugugugcaau

SEQ ID NO: 968501 - RNA, 22 nt, Homo sapiens
cauccauagugcacuagcauuu

SEQ ID NO: 968502 - RNA, 19 nt, Homo sapiens
cauccaucccuccauucau

SEQ ID NO: 968503 - RNA, 22 nt, Homo sapiens
caucccaggggagaacuacauu

SEQ ID NO: 968504 - RNA, 14 nt, Homo sapiens
caucccuccauuca

SEQ ID NO: 968505 - RNA, 17 nt, Homo sapiens
caucccuuuuucugcua

SEQ ID NO: 968506 - RNA, 18 nt, Homo sapiens
caucccuuuuucugcuaa

SEQ ID NO: 968507 - RNA, 18 nt, Homo sapiens
caucggaauucagccaug

SEQ ID NO: 968508 - RNA, 21 nt, Homo sapiens
caucuaaaguaaaaagggaau

SEQ ID NO: 968509 - RNA, 17 nt, Homo sapiens
caucuacaucuccuuca

SEQ ID NO: 968510 - RNA, 19 nt, Homo sapiens
caucucuaaggagagcucu

SEQ ID NO: 968511 - RNA, 12 nt, Homo sapiens
caucugcaaaag

SEQ ID NO: 968512 - RNA, 20 nt, Homo sapiens
caucugcacggugggagacc

SEQ ID NO: 968513 - RNA, 13 nt, Homo sapiens
caucuucuagaau

SEQ ID NO: 968514 - RNA, 23 nt, Homo sapiens
caucuugugguaacuugcugcuu

SEQ ID NO: 968515 - RNA, 21 nt, Homo sapiens
caucuuuucuaaucacagugu

SEQ ID NO: 968516 - RNA, 15 nt, Homo sapiens
caugaaaaacacggc

SEQ ID NO: 968517 - RNA, 12 nt, Homo sapiens
caugaagcccaa

SEQ ID NO: 968518 - RNA, 22 nt, Homo sapiens
caugaaucccacccacauguga

SEQ ID NO: 968519 - RNA, 23 nt, Homo sapiens
caugaaucccacccacaugugac

SEQ ID NO: 968520 - RNA, 19 nt, Homo sapiens
caugacauucuuagcugua

SEQ ID NO: 968521 - RNA, 13 nt, Homo sapiens
caugacggggaca

SEQ ID NO: 968522 - RNA, 15 nt, Homo sapiens
caugcaaaauauguu

SEQ ID NO: 968523 - RNA, 15 nt, Homo sapiens
caugggaaaacagac

SEQ ID NO: 968524 - RNA, 23 nt, Homo sapiens
caugggagggggcuugaagccaa

SEQ ID NO: 968525 - RNA, 21 nt, Homo sapiens
caugggccccuucaaaccuca

SEQ ID NO: 968526 - RNA, 18 nt, Homo sapiens
caugguuaccugaccuaa

SEQ ID NO: 968527 - RNA, 15 nt, Homo sapiens
cauguaaaauguuua

SEQ ID NO: 968528 - RNA, 17 nt, Homo sapiens
cauguaugucuuggaca

SEQ ID NO: 968529 - RNA, 15 nt, Homo sapiens
caugucaugugagug

SEQ ID NO: 968530 - RNA, 16 nt, Homo sapiens
caugucuauucagcuu

SEQ ID NO: 968531 - RNA, 19 nt, Homo sapiens
caugugacacauaugcacc

SEQ ID NO: 968532 - RNA, 16 nt, Homo sapiens
caugugagcaugucac

SEQ ID NO: 968533 - RNA, 17 nt, Homo sapiens
caugugauguguugcuc

SEQ ID NO: 968534 - RNA, 17 nt, Homo sapiens
caugugccaucucuaca

SEQ ID NO: 968535 - RNA, 19 nt, Homo sapiens
cauguggccuuuaucucaa

SEQ ID NO: 968536 - RNA, 16 nt, Homo sapiens
cauguguaccuacaga

SEQ ID NO: 968537 - RNA, 18 nt, Homo sapiens
cauguguagccugugcau

SEQ ID NO: 968538 - RNA, 21 nt, Homo sapiens
cauguucccccuaaacauggc

SEQ ID NO: 968539 - RNA, 15 nt, Homo sapiens
cauguucuggcagca

SEQ ID NO: 968540 - RNA, 20 nt, Homo sapiens
cauguuuguuucuguagaaa

SEQ ID NO: 968541 - RNA, 20 nt, Homo sapiens
cauuaauuaguuccaguuuc

SEQ ID NO: 968542 - RNA, 13 nt, Homo sapiens
cauuaccaucucu

SEQ ID NO: 968543 - RNA, 18 nt, Homo sapiens
cauuagagaguggcaaua

SEQ ID NO: 968544 - RNA, 15 nt, Homo sapiens
cauuauuagcacuuc

SEQ ID NO: 968545 - RNA, 17 nt, Homo sapiens
cauuauucaagaaugaa

SEQ ID NO: 968546 - RNA, 22 nt, Homo sapiens
cauuauuuggcuuaaaccagaa

SEQ ID NO: 968547 - RNA, 14 nt, Homo sapiens
cauucccaugugga

SEQ ID NO: 968548 - RNA, 21 nt, Homo sapiens
cauuccucacgcccuucaaug

SEQ ID NO: 968549 - RNA, 14 nt, Homo sapiens
cauuccugauccca

SEQ ID NO: 968550 - RNA, 14 nt, Homo sapiens
cauucgagguguca

SEQ ID NO: 968551 - RNA, 13 nt, Homo sapiens
cauucuacugugu

SEQ ID NO: 968552 - RNA, 16 nt, Homo sapiens
cauucucaggcaccag

SEQ ID NO: 968553 - RNA, 13 nt, Homo sapiens
cauucucugaguc

SEQ ID NO: 968554 - RNA, 13 nt, Homo sapiens
cauucugcuccuu

SEQ ID NO: 968555 - RNA, 20 nt, Homo sapiens
cauucuucacucuguuugaa

SEQ ID NO: 968556 - RNA, 18 nt, Homo sapiens
cauugagaucacuacuca

SEQ ID NO: 968557 - RNA, 19 nt, Homo sapiens
cauugagaucacuacucag

SEQ ID NO: 968558 - RNA, 21 nt, Homo sapiens
cauugguacacguguaacaag

SEQ ID NO: 968559 - RNA, 20 nt, Homo sapiens
cauugucaccccaagccaua

SEQ ID NO: 968560 - RNA, 21 nt, Homo sapiens
cauuuaugauuuaauaaaaua

SEQ ID NO: 968561 - RNA, 22 nt, Homo sapiens
cauuucauuaagguuccaguua

SEQ ID NO: 968562 - RNA, 20 nt, Homo sapiens
cauuugauggccaccagcuu

SEQ ID NO: 968563 - RNA, 22 nt, Homo sapiens
cauuuggagagggggccuggga

SEQ ID NO: 968564 - RNA, 14 nt, Homo sapiens
cauuuguagcuuug

SEQ ID NO: 968565 - RNA, 16 nt, Homo sapiens
cauuuguuaaugcuuu

SEQ ID NO: 968566 - RNA, 19 nt, Homo sapiens
cauuuuccugagaccucaa

SEQ ID NO: 968567 - RNA, 12 nt, Homo sapiens
ccaaaacagccu

SEQ ID NO: 968568 - RNA, 20 nt, Homo sapiens
ccaaaggcauccauagugca

SEQ ID NO: 968569 - RNA, 10 nt, Homo sapiens
ccaaaggggc

SEQ ID NO: 968570 - RNA, 18 nt, Homo sapiens
ccaaaguaacugaauuau

SEQ ID NO: 968571 - RNA, 17 nt, Homo sapiens
ccaaauacugcuuagca

SEQ ID NO: 968572 - RNA, 14 nt, Homo sapiens
ccaaauaguuauuu

SEQ ID NO: 968573 - RNA, 18 nt, Homo sapiens
ccaaauccacaagccauu

SEQ ID NO: 968574 - RNA, 22 nt, Homo sapiens
ccaaauguggaauugacugccu

SEQ ID NO: 968575 - RNA, 13 nt, Homo sapiens
ccaacaacucugc

SEQ ID NO: 968576 - RNA, 21 nt, Homo sapiens
ccaacuaaugccuuacucuuc

SEQ ID NO: 968577 - RNA, 13 nt, Homo sapiens
ccaacuccaggaa

SEQ ID NO: 968578 - RNA, 17 nt, Homo sapiens
ccaagauugcaccacug

SEQ ID NO: 968579 - RNA, 12 nt, Homo sapiens
ccaagcauuuca

SEQ ID NO: 968580 - RNA, 16 nt, Homo sapiens
ccaagccauagucucu

SEQ ID NO: 968581 - RNA, 21 nt, Homo sapiens
auauucauaccuucugaugaa

SEQ ID NO: 968582 - RNA, 21 nt, Homo sapiens
auauuccugguguagcacuua

SEQ ID NO: 968583 - RNA, 14 nt, Homo sapiens
auauucuacuaugc

SEQ ID NO: 968584 - RNA, 17 nt, Homo sapiens
auauuguauaggggcaa

SEQ ID NO: 968585 - RNA, 14 nt, Homo sapiens
auauuguuuuacaa

SEQ ID NO: 968586 - RNA, 21 nt, Homo sapiens
auauuuauuuauguguucaca

SEQ ID NO: 968587 - RNA, 23 nt, Homo sapiens
auauuugcacaugggauugcuaa

SEQ ID NO: 968588 - RNA, 17 nt, Homo sapiens
auauuuuagccacucaa

SEQ ID NO: 968589 - RNA, 23 nt, Homo sapiens
auauuuuggggggcagagaauaa

SEQ ID NO: 968590 - RNA, 17 nt, Homo sapiens
aucaaagaacaaacauc

SEQ ID NO: 968591 - RNA, 22 nt, Homo sapiens
aucaaaucucuuccacaugggu

SEQ ID NO: 968592 - RNA, 18 nt, Homo sapiens
aucaagaaaaaaagggag

SEQ ID NO: 968593 - RNA, 16 nt, Homo sapiens
aucaagagaaacuuca

SEQ ID NO: 968594 - RNA, 18 nt, Homo sapiens
aucaauaaaaauuucaaa

SEQ ID NO: 968595 - RNA, 18 nt, Homo sapiens
aucaauggcacgcuccug

SEQ ID NO: 968596 - RNA, 20 nt, Homo sapiens
aucaauuacugguccaaaag

SEQ ID NO: 968597 - RNA, 17 nt, Homo sapiens
aucacauuccucugccc

SEQ ID NO: 968598 - RNA, 14 nt, Homo sapiens
aucacccucuuccu

SEQ ID NO: 968599 - RNA, 23 nt, Homo sapiens
aucacgucacugcacuccagcuu

SEQ ID NO: 968600 - RNA, 14 nt, Homo sapiens
aucacuaguggcaa

SEQ ID NO: 968601 - RNA, 19 nt, Homo sapiens
aucacugccacacucucca

SEQ ID NO: 968602 - RNA, 20 nt, Homo sapiens
aucacugccacacucuccau

SEQ ID NO: 968603 - RNA, 16 nt, Homo sapiens
aucacuuaaaugucac

SEQ ID NO: 968604 - RNA, 19 nt, Homo sapiens
aucacuuuugcacauuccc

SEQ ID NO: 968605 - RNA, 20 nt, Homo sapiens
aucagaguuccuccuacuua

SEQ ID NO: 968606 - RNA, 16 nt, Homo sapiens
aucagauaccuguggg

SEQ ID NO: 968607 - RNA, 19 nt, Homo sapiens
aucagccuccgccauucca

SEQ ID NO: 968608 - RNA, 20 nt, Homo sapiens
aucagccuccgccauuccaa

SEQ ID NO: 968609 - RNA, 22 nt, Homo sapiens
aucagggacuugaaugcacuuu

SEQ ID NO: 968610 - RNA, 23 nt, Homo sapiens
aucagucauuucuucauguacag

SEQ ID NO: 968611 - RNA, 14 nt, Homo sapiens
aucaucccagggga

SEQ ID NO: 968612 - RNA, 15 nt, Homo sapiens
aucaucuuuccuguu

SEQ ID NO: 968613 - RNA, 14 nt, Homo sapiens
aucaugagacauua

SEQ ID NO: 968614 - RNA, 20 nt, Homo sapiens
aucaugauccuuguguucag

SEQ ID NO: 968615 - RNA, 23 nt, Homo sapiens
aucauguauggugauagguaucu

SEQ ID NO: 968616 - RNA, 23 nt, Homo sapiens
auccaaaaauguguaagaacaac

SEQ ID NO: 968617 - RNA, 14 nt, Homo sapiens
auccacaagccauu

SEQ ID NO: 968618 - RNA, 20 nt, Homo sapiens
auccauccccagaccaggac

SEQ ID NO: 968619 - RNA, 18 nt, Homo sapiens
auccauuaccuccaucca

SEQ ID NO: 968620 - RNA, 15 nt, Homo sapiens
auccauugaacuaaa

SEQ ID NO: 968621 - RNA, 12 nt, Homo sapiens
auccccaucucc

SEQ ID NO: 968622 - RNA, 13 nt, Homo sapiens
aucccuuccccag

SEQ ID NO: 968623 - RNA, 23 nt, Homo sapiens
aucccuuugucugucaaucacag

SEQ ID NO: 968624 - RNA, 12 nt, Homo sapiens
auccucucucuc

SEQ ID NO: 968625 - RNA, 13 nt, Homo sapiens
auccuuauuccuc

SEQ ID NO: 968626 - RNA, 16 nt, Homo sapiens
auccuucagcacagga

SEQ ID NO: 968627 - RNA, 23 nt, Homo sapiens
aucgccugaguugcuuuuacuuc

SEQ ID NO: 968628 - RNA, 17 nt, Homo sapiens
aucguuuuuguuuacug

SEQ ID NO: 968629 - RNA, 17 nt, Homo sapiens
aucuagcacacucuucu

SEQ ID NO: 968630 - RNA, 14 nt, Homo sapiens
aucuaguucucaau

SEQ ID NO: 968631 - RNA, 19 nt, Homo sapiens
aucuaguucucaaucacug

SEQ ID NO: 968632 - RNA, 20 nt, Homo sapiens
aucuaguucucaaucacugc

SEQ ID NO: 968633 - RNA, 18 nt, Homo sapiens
aucuauauuucuggugaa

SEQ ID NO: 968634 - RNA, 14 nt, Homo sapiens
aucuaugcugagua

SEQ ID NO: 968635 - RNA, 19 nt, Homo sapiens
aucucaauaaagugcuuua

SEQ ID NO: 968636 - RNA, 22 nt, Homo sapiens
aucucaaugaaccauaaauuca

SEQ ID NO: 968637 - RNA, 13 nt, Homo sapiens
aucucagaaccuu

SEQ ID NO: 968638 - RNA, 20 nt, Homo sapiens
aucucagaaccuugucccag

SEQ ID NO: 968639 - RNA, 13 nt, Homo sapiens
aucucagcuuuga

SEQ ID NO: 968640 - RNA, 19 nt, Homo sapiens
aucucagguugucuaagug

SEQ ID NO: 968641 - RNA, 18 nt, Homo sapiens
aucucauuucauucucac

SEQ ID NO: 968642 - RNA, 21 nt, Homo sapiens
aucuccucucucuuuccucca

SEQ ID NO: 968643 - RNA, 13 nt, Homo sapiens
aucuccugacaga

SEQ ID NO: 968644 - RNA, 21 nt, Homo sapiens
aucuccugacagaaggugcca

SEQ ID NO: 968645 - RNA, 16 nt, Homo sapiens
aucuccuguggaguca

SEQ ID NO: 968646 - RNA, 20 nt, Homo sapiens
aucuccuucaccccuauggu

SEQ ID NO: 968647 - RNA, 20 nt, Homo sapiens
aucucggcucacugcaagcu

SEQ ID NO: 968648 - RNA, 17 nt, Homo sapiens
aucucggcuuauggcaa

SEQ ID NO: 968649 - RNA, 14 nt, Homo sapiens
aucucuaccugggu

SEQ ID NO: 968650 - RNA, 16 nt, Homo sapiens
aucucugcuuacuaau

SEQ ID NO: 968651 - RNA, 16 nt, Homo sapiens
aucucuuccacauggg

SEQ ID NO: 968652 - RNA, 13 nt, Homo sapiens
aucugcaguuuaa

SEQ ID NO: 968653 - RNA, 15 nt, Homo sapiens
aucugcaguuuaaca

SEQ ID NO: 968654 - RNA, 18 nt, Homo sapiens
aucugggcugugggcaag

SEQ ID NO: 968655 - RNA, 22 nt, Homo sapiens
aucuguuuauuuacaagggaag

SEQ ID NO: 968656 - RNA, 18 nt, Homo sapiens
aucuuaaaacaaauucau

SEQ ID NO: 968657 - RNA, 14 nt, Homo sapiens
aucuuaaaugagac

SEQ ID NO: 968658 - RNA, 23 nt, Homo sapiens
aucuucagcccaggcuuuugcua

SEQ ID NO: 968659 - RNA, 23 nt, Homo sapiens
aucuucccuuuauuacaagaagg

SEQ ID NO: 968660 - RNA, 14 nt, Homo sapiens
aucuucucauuccc

SEQ ID NO: 968661 - RNA, 22 nt, Homo sapiens
aucuuguuuugaaaauaaccua

SEQ ID NO: 968662 - RNA, 13 nt, Homo sapiens
aucuuuagggaau

SEQ ID NO: 968663 - RNA, 16 nt, Homo sapiens
aucuuuucauuaaaga

SEQ ID NO: 968664 - RNA, 23 nt, Homo sapiens
augaaaaauauugcugaacuacu

SEQ ID NO: 968665 - RNA, 17 nt, Homo sapiens
augaaaaugucaauacu

SEQ ID NO: 968666 - RNA, 21 nt, Homo sapiens
augaaaauuuauuuuuaguga

SEQ ID NO: 968667 - RNA, 16 nt, Homo sapiens
augaaacgucaugugu

SEQ ID NO: 968668 - RNA, 19 nt, Homo sapiens
augaaacuauuuuaccuga

SEQ ID NO: 968669 - RNA, 18 nt, Homo sapiens
augaaacugacucaucag

SEQ ID NO: 968670 - RNA, 18 nt, Homo sapiens
augaaagaaaauugaguu

SEQ ID NO: 968671 - RNA, 16 nt, Homo sapiens
augaaauuauuuguca

SEQ ID NO: 968672 - RNA, 16 nt, Homo sapiens
augaacacuacagaua

SEQ ID NO: 968673 - RNA, 18 nt, Homo sapiens
augaagaaaaucacuuag

SEQ ID NO: 968674 - RNA, 14 nt, Homo sapiens
augaagaagccacu

SEQ ID NO: 968675 - RNA, 13 nt, Homo sapiens
augaagcaugcua

SEQ ID NO: 968676 - RNA, 12 nt, Homo sapiens
augaaugaaacu

SEQ ID NO: 968677 - RNA, 22 nt, Homo sapiens
augacacacaaaucccauuaaa

SEQ ID NO: 968678 - RNA, 12 nt, Homo sapiens
augacuaaagag

SEQ ID NO: 968679 - RNA, 23 nt, Homo sapiens
augacuaaagagagaauguagau

SEQ ID NO: 968680 - RNA, 16 nt, Homo sapiens
augagaguuccuucuc

SEQ ID NO: 968681 - RNA, 17 nt, Homo sapiens
augagcaagacugggcc

SEQ ID NO: 968682 - RNA, 16 nt, Homo sapiens
augagcccacccugcu

SEQ ID NO: 968683 - RNA, 20 nt, Homo sapiens
augaguaaacugagacuuaa

SEQ ID NO: 968684 - RNA, 14 nt, Homo sapiens
augauaaacaaguc

SEQ ID NO: 968685 - RNA, 19 nt, Homo sapiens
augaucagacauacagcug

SEQ ID NO: 968686 - RNA, 15 nt, Homo sapiens
augaugacugaaaau

SEQ ID NO: 968687 - RNA, 19 nt, Homo sapiens
augauuuuuuuuucauaca

SEQ ID NO: 968688 - RNA, 9 nt, Homo sapiens
augcaaaac

SEQ ID NO: 968689 - RNA, 14 nt, Homo sapiens
augcaagccagcuu

SEQ ID NO: 968690 - RNA, 16 nt, Homo sapiens
augcaaguauccugcg

SEQ ID NO: 968691 - RNA, 19 nt, Homo sapiens
augcaccacggcagcucuc

SEQ ID NO: 968692 - RNA, 13 nt, Homo sapiens
augcaccuaccca

SEQ ID NO: 968693 - RNA, 14 nt, Homo sapiens
augcaucauuucag

SEQ ID NO: 968694 - RNA, 22 nt, Homo sapiens
augcauuugauggccaccagcu

SEQ ID NO: 968695 - RNA, 20 nt, Homo sapiens
augccacccacaucuuccau

SEQ ID NO: 968696 - RNA, 14 nt, Homo sapiens
augcccacauacug

SEQ ID NO: 968697 - RNA, 17 nt, Homo sapiens
augcccacauacugucu

SEQ ID NO: 968698 - RNA, 17 nt, Homo sapiens
augcccugugcaugcca

SEQ ID NO: 968699 - RNA, 17 nt, Homo sapiens
augcccuucacugucac

SEQ ID NO: 968700 - RNA, 18 nt, Homo sapiens
augcucagggucacugaa

SEQ ID NO: 968701 - RNA, 18 nt, Homo sapiens
augcugaaaaauauagcc

SEQ ID NO: 968702 - RNA, 20 nt, Homo sapiens
augcugggccauugugauug

SEQ ID NO: 968703 - RNA, 20 nt, Homo sapiens
augcugggcucaucuucuag

SEQ ID NO: 968704 - RNA, 23 nt, Homo sapiens
augcuuggguacacuucucuuaa

SEQ ID NO: 968705 - RNA, 17 nt, Homo sapiens
augcuuucccacucuca

SEQ ID NO: 968706 - RNA, 19 nt, Homo sapiens
augcuuuucccacucucau

SEQ ID NO: 968707 - RNA, 12 nt, Homo sapiens
auggaaacacca

SEQ ID NO: 968708 - RNA, 22 nt, Homo sapiens
auggaagguucucugugcuccu

SEQ ID NO: 968709 - RNA, 16 nt, Homo sapiens
auggaauaucagaagu

SEQ ID NO: 968710 - RNA, 13 nt, Homo sapiens
auggacucugcac

SEQ ID NO: 968711 - RNA, 21 nt, Homo sapiens
auggaggaucucuaaagagca

SEQ ID NO: 968712 - RNA, 17 nt, Homo sapiens
auggaugguugaauuaa

SEQ ID NO: 968713 - RNA, 23 nt, Homo sapiens
auggcaaaaccccaucuuuacua

SEQ ID NO: 968714 - RNA, 13 nt, Homo sapiens
auggcaaaauuag

SEQ ID NO: 968715 - RNA, 18 nt, Homo sapiens
auggcauauauguucaaa

SEQ ID NO: 968716 - RNA, 17 nt, Homo sapiens
auggccugcaaacuggg

SEQ ID NO: 968717 - RNA, 22 nt, Homo sapiens
auggcuuauuucuaugacaaau

SEQ ID NO: 968718 - RNA, 16 nt, Homo sapiens
auggcuucacauucau

SEQ ID NO: 968719 - RNA, 18 nt, Homo sapiens
augggaccuguggcuguc

SEQ ID NO: 968720 - RNA, 23 nt, Homo sapiens
augggagggggcuugaagccaaa

SEQ ID NO: 968721 - RNA, 13 nt, Homo sapiens
augggauugcuaa

SEQ ID NO: 968722 - RNA, 15 nt, Homo sapiens
augggcacacacacc

SEQ ID NO: 968723 - RNA, 18 nt, Homo sapiens
augggcuucacuguauaa

SEQ ID NO: 968724 - RNA, 18 nt, Homo sapiens
augggggcuuuccaaaga

SEQ ID NO: 968725 - RNA, 23 nt, Homo sapiens
auggucucagccuaggcccucau

SEQ ID NO: 968726 - RNA, 19 nt, Homo sapiens
auggugaaaccccgucucu

SEQ ID NO: 968727 - RNA, 19 nt, Homo sapiens
auggugcacugagcugcaa

SEQ ID NO: 968728 - RNA, 19 nt, Homo sapiens
augguggaaaagaacugua

SEQ ID NO: 968729 - RNA, 20 nt, Homo sapiens
augguuacuucuucucuuag

SEQ ID NO: 968730 - RNA, 21 nt, Homo sapiens
auguaaagauauuuuuaucuu

SEQ ID NO: 968731 - RNA, 12 nt, Homo sapiens
auguaagccugg

SEQ ID NO: 968732 - RNA, 24 nt, Homo sapiens
auguaaggucuucuuguguccuga

SEQ ID NO: 968733 - RNA, 13 nt, Homo sapiens
auguacuugucac

SEQ ID NO: 968734 - RNA, 21 nt, Homo sapiens
auguacuuuuuaaaucauguu

SEQ ID NO: 968735 - RNA, 21 nt, Homo sapiens
auguaguaguuugggugugua

SEQ ID NO: 968736 - RNA, 14 nt, Homo sapiens
auguauauucccac

SEQ ID NO: 968737 - RNA, 14 nt, Homo sapiens
augucacugccuga

SEQ ID NO: 968738 - RNA, 14 nt, Homo sapiens
augucaguacuauu

SEQ ID NO: 968739 - RNA, 11 nt, Homo sapiens
auguccaaaga

SEQ ID NO: 968740 - RNA, 18 nt, Homo sapiens
augucccuccaacacaga

SEQ ID NO: 968741 - RNA, 21 nt, Homo sapiens
augucccuccaacacagaucc

SEQ ID NO: 968742 - RNA, 15 nt, Homo sapiens
augucuauguagcug

SEQ ID NO: 968743 - RNA, 19 nt, Homo sapiens
augucuauguagcugaaaa

SEQ ID NO: 968744 - RNA, 13 nt, Homo sapiens
augucucauguca

SEQ ID NO: 968745 - RNA, 14 nt, Homo sapiens
augucuccaucucu

SEQ ID NO: 968746 - RNA, 22 nt, Homo sapiens
augucuccaucucugucucaaa

SEQ ID NO: 968747 - RNA, 18 nt, Homo sapiens
augucugccauguugccc

SEQ ID NO: 968748 - RNA, 22 nt, Homo sapiens
augucuguagcuccucaacuca

SEQ ID NO: 968749 - RNA, 21 nt, Homo sapiens
augucuucaauggaauacagu

SEQ ID NO: 968750 - RNA, 20 nt, Homo sapiens
augucuuggacacuguacaa

SEQ ID NO: 968751 - RNA, 17 nt, Homo sapiens
augucuuguacaugugu

SEQ ID NO: 968752 - RNA, 20 nt, Homo sapiens
augugaagaguuucacaaau

SEQ ID NO: 968753 - RNA, 18 nt, Homo sapiens
augugagauuacuuuguc

SEQ ID NO: 968754 - RNA, 18 nt, Homo sapiens
augugagccuugugcaug

SEQ ID NO: 968755 - RNA, 22 nt, Homo sapiens
augugauucaccucuucuuucc

SEQ ID NO: 968756 - RNA, 19 nt, Homo sapiens
augugcuauacacacacac

SEQ ID NO: 968757 - RNA, 14 nt, Homo sapiens
auguggaacaggau

SEQ ID NO: 968758 - RNA, 19 nt, Homo sapiens
auguggcccucuggaucca

SEQ ID NO: 968759 - RNA, 15 nt, Homo sapiens
auguggcccuggcug

SEQ ID NO: 968760 - RNA, 22 nt, Homo sapiens
auguguaagaacaacuaccuga

SEQ ID NO: 968761 - RNA, 18 nt, Homo sapiens
auguguagccugugcaug

SEQ ID NO: 968762 - RNA, 21 nt, Homo sapiens
auguguauuuuucaaggcauu

SEQ ID NO: 968763 - RNA, 16 nt, Homo sapiens
augugucucacaucua

SEQ ID NO: 968764 - RNA, 18 nt, Homo sapiens
auguuaaagagaaugagu

SEQ ID NO: 968765 - RNA, 16 nt, Homo sapiens
auguugggaaaguauu

SEQ ID NO: 968766 - RNA, 12 nt, Homo sapiens
auguuguaauau

SEQ ID NO: 968767 - RNA, 17 nt, Homo sapiens
auguuuagcagauuuaa

SEQ ID NO: 968768 - RNA, 15 nt, Homo sapiens
auguuuaugagccag

SEQ ID NO: 968769 - RNA, 17 nt, Homo sapiens
auguuuucaaaaccaag

SEQ ID NO: 968770 - RNA, 13 nt, Homo sapiens
auuaaaauuccaa

SEQ ID NO: 968771 - RNA, 21 nt, Homo sapiens
auuaaauuuuagaucuuucaa

SEQ ID NO: 968772 - RNA, 21 nt, Homo sapiens
auuaacuacugaauaaugcua

SEQ ID NO: 968773 - RNA, 20 nt, Homo sapiens
auuaagcagaaagucuucau

SEQ ID NO: 968774 - RNA, 22 nt, Homo sapiens
auuaagugacuauagaaugcaa

SEQ ID NO: 968775 - RNA, 23 nt, Homo sapiens
auuaaguggcuuuuuaacaugaa

SEQ ID NO: 968776 - RNA, 18 nt, Homo sapiens
auuaauaucaacucugaa

SEQ ID NO: 968777 - RNA, 18 nt, Homo sapiens
auuaauauccaagacuua

SEQ ID NO: 968778 - RNA, 16 nt, Homo sapiens
auuaauauuugcacau

SEQ ID NO: 968779 - RNA, 23 nt, Homo sapiens
auuaauuacucuaacaaacaaga

SEQ ID NO: 968780 - RNA, 17 nt, Homo sapiens
auuacaggcaugagcca

SEQ ID NO: 968781 - RNA, 19 nt, Homo sapiens
auuacaggcaugagccauu

SEQ ID NO: 968782 - RNA, 23 nt, Homo sapiens
auuaccuccauccauccuuccaa

SEQ ID NO: 968783 - RNA, 12 nt, Homo sapiens
auuaccuucuau

SEQ ID NO: 968784 - RNA, 16 nt, Homo sapiens
auuacugguccaaaag

SEQ ID NO: 968785 - RNA, 24 nt, Homo sapiens
auuagaagacaacaggcauagcaa

SEQ ID NO: 968786 - RNA, 15 nt, Homo sapiens
auuaggcaagaauaa

SEQ ID NO: 968787 - RNA, 22 nt, Homo sapiens
auuagucuuggaaaaaaaccac

SEQ ID NO: 968788 - RNA, 21 nt, Homo sapiens
auuaucauaugaacuugucag

SEQ ID NO: 968789 - RNA, 13 nt, Homo sapiens
auuauugacacug

SEQ ID NO: 968790 - RNA, 19 nt, Homo sapiens
auuauugacacugaacuua

SEQ ID NO: 968791 - RNA, 14 nt, Homo sapiens
auucacaguaauau

SEQ ID NO: 968792 - RNA, 16 nt, Homo sapiens
auucacuucauaaucc

SEQ ID NO: 968793 - RNA, 18 nt, Homo sapiens
auucagcucuucagagau

SEQ ID NO: 968794 - RNA, 22 nt, Homo sapiens
auucagcuuuucauaauaucua

SEQ ID NO: 968795 - RNA, 18 nt, Homo sapiens
auucauccuuccauccau

SEQ ID NO: 968796 - RNA, 13 nt, Homo sapiens
auuccaaaugcca

SEQ ID NO: 968797 - RNA, 15 nt, Homo sapiens
auuccagcugucacu

SEQ ID NO: 968798 - RNA, 17 nt, Homo sapiens
auuccaguacaguauuc

SEQ ID NO: 968799 - RNA, 17 nt, Homo sapiens
auuccagugccaggcca

SEQ ID NO: 968800 - RNA, 18 nt, Homo sapiens
auucccaagcuuuuggag

SEQ ID NO: 968801 - RNA, 16 nt, Homo sapiens
auuccccugugucauc

SEQ ID NO: 968802 - RNA, 19 nt, Homo sapiens
auucccuggccgcuucucc

SEQ ID NO: 968803 - RNA, 22 nt, Homo sapiens
auuccugaccuccgccauccac

SEQ ID NO: 968804 - RNA, 14 nt, Homo sapiens
auuccugcuucucu

SEQ ID NO: 968805 - RNA, 21 nt, Homo sapiens
auuccugguguagcacuuaac

SEQ ID NO: 968806 - RNA, 18 nt, Homo sapiens
auuccuuagauaccuuga

SEQ ID NO: 968807 - RNA, 15 nt, Homo sapiens
auuccuuugcauauu

SEQ ID NO: 968808 - RNA, 18 nt, Homo sapiens
auucuaacccaagacaug

SEQ ID NO: 968809 - RNA, 12 nt, Homo sapiens
auucuacugugu

SEQ ID NO: 968810 - RNA, 19 nt, Homo sapiens
cacccuguuccugcugcug

SEQ ID NO: 968811 - RNA, 15 nt, Homo sapiens
caccuauuaucccag

SEQ ID NO: 968812 - RNA, 18 nt, Homo sapiens
caccucaagacccccauu

SEQ ID NO: 968813 - RNA, 15 nt, Homo sapiens
caccucuuccuugau

SEQ ID NO: 968814 - RNA, 17 nt, Homo sapiens
caccucuuccuugaugu

SEQ ID NO: 968815 - RNA, 12 nt, Homo sapiens
caccugcaucug

SEQ ID NO: 968816 - RNA, 19 nt, Homo sapiens
caccugggacccugcacag

SEQ ID NO: 968817 - RNA, 19 nt, Homo sapiens
caccuugccagggcagggu

SEQ ID NO: 968818 - RNA, 23 nt, Homo sapiens
caccuuggggccuugaugacugc

SEQ ID NO: 968819 - RNA, 18 nt, Homo sapiens
caccuuguuacacauuau

SEQ ID NO: 968820 - RNA, 13 nt, Homo sapiens
cacgccuguaauu

SEQ ID NO: 968821 - RNA, 16 nt, Homo sapiens
cacgcucgcugccauc

SEQ ID NO: 968822 - RNA, 20 nt, Homo sapiens
cacggaggaugaugccaguu

SEQ ID NO: 968823 - RNA, 19 nt, Homo sapiens
cacggccaccacugcagcc

SEQ ID NO: 968824 - RNA, 23 nt, Homo sapiens
cacuacauaauugcuguucugcu

SEQ ID NO: 968825 - RNA, 20 nt, Homo sapiens
cacuaccaaacacucagucc

SEQ ID NO: 968826 - RNA, 22 nt, Homo sapiens
cacuagagaaaauaaauuccaa

SEQ ID NO: 968827 - RNA, 13 nt, Homo sapiens
cacuccccuaggg

SEQ ID NO: 968828 - RNA, 23 nt, Homo sapiens
cacucucauuuguuaaugcuuuc

SEQ ID NO: 968829 - RNA, 22 nt, Homo sapiens
cacucucuaccagauaacugag

SEQ ID NO: 968830 - RNA, 15 nt, Homo sapiens
cacucuggaaccuua

SEQ ID NO: 968831 - RNA, 20 nt, Homo sapiens
cacugaggcagcgaccucaa

SEQ ID NO: 968832 - RNA, 19 nt, Homo sapiens
cacugccaggccagccucc

SEQ ID NO: 968833 - RNA, 20 nt, Homo sapiens
cacugcuccuugcugcauug

SEQ ID NO: 968834 - RNA, 19 nt, Homo sapiens
cacuggagguugaagccaa

SEQ ID NO: 968835 - RNA, 11 nt, Homo sapiens
cacuguacaag

SEQ ID NO: 968836 - RNA, 17 nt, Homo sapiens
cacugugaacuaaugac

SEQ ID NO: 968837 - RNA, 14 nt, Homo sapiens
cacugugcuuucag

SEQ ID NO: 968838 - RNA, 19 nt, Homo sapiens
cacugugguuuugacuuaa

SEQ ID NO: 968839 - RNA, 20 nt, Homo sapiens
cacuuagaauccgaagggaa

SEQ ID NO: 968840 - RNA, 21 nt, Homo sapiens
cacuuauaagugagaacaugc

SEQ ID NO: 968841 - RNA, 13 nt, Homo sapiens
cacuucauaucca

SEQ ID NO: 968842 - RNA, 20 nt, Homo sapiens
cacuuccguagacuguuuag

SEQ ID NO: 968843 - RNA, 18 nt, Homo sapiens
cacuuucccacacuguga

SEQ ID NO: 968844 - RNA, 14 nt, Homo sapiens
cagaaagauuugau

SEQ ID NO: 968845 - RNA, 13 nt, Homo sapiens
cagaaagccacaa

SEQ ID NO: 968846 - RNA, 22 nt, Homo sapiens
cagaaagggauugcuuugcauu

SEQ ID NO: 968847 - RNA, 20 nt, Homo sapiens
cagaaaguaucacaaaugga

SEQ ID NO: 968848 - RNA, 18 nt, Homo sapiens
cagaacacgagacagcuu

SEQ ID NO: 968849 - RNA, 13 nt, Homo sapiens
cagaacccagugu

SEQ ID NO: 968850 - RNA, 12 nt, Homo sapiens
cagaaccugcuc

SEQ ID NO: 968851 - RNA, 15 nt, Homo sapiens
cagaagcucaucuca

SEQ ID NO: 968852 - RNA, 14 nt, Homo sapiens
cagaaggaaccagc

SEQ ID NO: 968853 - RNA, 14 nt, Homo sapiens
cagaaggugccacu

SEQ ID NO: 968854 - RNA, 17 nt, Homo sapiens
cagaauauaauucccaa

SEQ ID NO: 968855 - RNA, 21 nt, Homo sapiens
cagaaucaagcuuuugcuuga

SEQ ID NO: 968856 - RNA, 17 nt, Homo sapiens
cagaauguaaaauuggu

SEQ ID NO: 968857 - RNA, 14 nt, Homo sapiens
cagaauuaagugga

SEQ ID NO: 968858 - RNA, 16 nt, Homo sapiens
cagaauuauacaguaa

SEQ ID NO: 968859 - RNA, 22 nt, Homo sapiens
cagacauaaaggaaaagacaca

SEQ ID NO: 968860 - RNA, 16 nt, Homo sapiens
cagaccacugucucca

SEQ ID NO: 968861 - RNA, 13 nt, Homo sapiens
cagaccucaugcc

SEQ ID NO: 968862 - RNA, 13 nt, Homo sapiens
cagacguugccug

SEQ ID NO: 968863 - RNA, 18 nt, Homo sapiens
cagacugugcaauacuua

SEQ ID NO: 968864 - RNA, 17 nt, Homo sapiens
cagagaaaaaugcuccc

SEQ ID NO: 968865 - RNA, 15 nt, Homo sapiens
cagagaccaccacau

SEQ ID NO: 968866 - RNA, 18 nt, Homo sapiens
cagagaugaacaucuaac

SEQ ID NO: 968867 - RNA, 15 nt, Homo sapiens
cagagauguuaucaa

SEQ ID NO: 968868 - RNA, 15 nt, Homo sapiens
cagagcaagacuguc

SEQ ID NO: 968869 - RNA, 22 nt, Homo sapiens
cagagcagaugcagagagccau

SEQ ID NO: 968870 - RNA, 22 nt, Homo sapiens
cagagccucguuucugcuuuca

SEQ ID NO: 968871 - RNA, 21 nt, Homo sapiens
cagagcgccaggaagccagag

SEQ ID NO: 968872 - RNA, 21 nt, Homo sapiens
cagaggaagaaaaugagccau

SEQ ID NO: 968873 - RNA, 16 nt, Homo sapiens
cagaggaauccuggca

SEQ ID NO: 968874 - RNA, 22 nt, Homo sapiens
cagagucuucuuugugccugag

SEQ ID NO: 968875 - RNA, 16 nt, Homo sapiens
cagagugcaacccagu

SEQ ID NO: 968876 - RNA, 21 nt, Homo sapiens
cagaucaagaaaaaaagggag

SEQ ID NO: 968877 - RNA, 22 nt, Homo sapiens
cagaucaagaaaaaaagggaga

SEQ ID NO: 968878 - RNA, 19 nt, Homo sapiens
cagaucacugccacacucu

SEQ ID NO: 968879 - RNA, 16 nt, Homo sapiens
cagaucuuggacucau

SEQ ID NO: 968880 - RNA, 17 nt, Homo sapiens
cagauggaaaaacugag

SEQ ID NO: 968881 - RNA, 19 nt, Homo sapiens
cagaugugugcaauguggc

SEQ ID NO: 968882 - RNA, 16 nt, Homo sapiens
cagauguguguucuca

SEQ ID NO: 968883 - RNA, 12 nt, Homo sapiens
aaaaaaccacag

SEQ ID NO: 968884 - RNA, 21 nt, Homo sapiens
aaaaacacccgacgucaugua

SEQ ID NO: 968885 - RNA, 13 nt, Homo sapiens
aaaaacucacuua

SEQ ID NO: 968886 - RNA, 15 nt, Homo sapiens
aaaaacuuacuuugg

SEQ ID NO: 968887 - RNA, 14 nt, Homo sapiens
aaaaagugucucaa

SEQ ID NO: 968888 - RNA, 14 nt, Homo sapiens
aaaaauaaaagauc

SEQ ID NO: 968889 - RNA, 23 nt, Homo sapiens
aaaaauauuguuucugcauucau

SEQ ID NO: 968890 - RNA, 14 nt, Homo sapiens
aaaaauguaccaaa

SEQ ID NO: 968891 - RNA, 21 nt, Homo sapiens
aaaaauguaucugugugugau

SEQ ID NO: 968892 - RNA, 18 nt, Homo sapiens
aaaaaugucucaugucaa

SEQ ID NO: 968893 - RNA, 14 nt, Homo sapiens
aaaaauuuacuuga

SEQ ID NO: 968894 - RNA, 16 nt, Homo sapiens
aaaacacuaacuuaau

SEQ ID NO: 968895 - RNA, 12 nt, Homo sapiens
aaaacagaauuu

SEQ ID NO: 968896 - RNA, 16 nt, Homo sapiens
aaaacagaauuugaga

SEQ ID NO: 968897 - RNA, 13 nt, Homo sapiens
aaaacaguucuca

SEQ ID NO: 968898 - RNA, 21 nt, Homo sapiens
aaaacaguucucagaaauguc

SEQ ID NO: 968899 - RNA, 13 nt, Homo sapiens
aaaacauguuaau

SEQ ID NO: 968900 - RNA, 15 nt, Homo sapiens
aaaacauuaccaucc

SEQ ID NO: 968901 - RNA, 23 nt, Homo sapiens
aaaaccaacaaaaagaacaaauc

SEQ ID NO: 968902 - RNA, 15 nt, Homo sapiens
aaaaccaacaaugug

SEQ ID NO: 968903 - RNA, 15 nt, Homo sapiens
aaaaccacagccacu

SEQ ID NO: 968904 - RNA, 13 nt, Homo sapiens
aaaaccaccaaaa

SEQ ID NO: 968905 - RNA, 12 nt, Homo sapiens
aaaaccacuuuu

SEQ ID NO: 968906 - RNA, 15 nt, Homo sapiens
aaaacucacugugau

SEQ ID NO: 968907 - RNA, 12 nt, Homo sapiens
aaaacuuccuau

SEQ ID NO: 968908 - RNA, 21 nt, Homo sapiens
aaaacuuuaggcccugcccca

SEQ ID NO: 968909 - RNA, 22 nt, Homo sapiens
aaaagaucuugaauagucucau

SEQ ID NO: 968910 - RNA, 15 nt, Homo sapiens
aaaagccacuggaau

SEQ ID NO: 968911 - RNA, 22 nt, Homo sapiens
aaaagcuauuagccaggaucau

SEQ ID NO: 968912 - RNA, 18 nt, Homo sapiens
aaaaguaaauucauguaa

SEQ ID NO: 968913 - RNA, 13 nt, Homo sapiens
aaaagugucucaa

SEQ ID NO: 968914 - RNA, 18 nt, Homo sapiens
aaaagugucucaaaggag

SEQ ID NO: 968915 - RNA, 18 nt, Homo sapiens
aaaauaaaagaucuugaa

SEQ ID NO: 968916 - RNA, 12 nt, Homo sapiens
aaaauaaucaug

SEQ ID NO: 968917 - RNA, 17 nt, Homo sapiens
aaaauacuauugccuca

SEQ ID NO: 968918 - RNA, 21 nt, Homo sapiens
aaaauaugugcuugaaaugag

SEQ ID NO: 968919 - RNA, 17 nt, Homo sapiens
aaaauauuccugugacu

SEQ ID NO: 968920 - RNA, 15 nt, Homo sapiens
aaaauauuguuucug

SEQ ID NO: 968921 - RNA, 14 nt, Homo sapiens
aaaaucuagcacac

SEQ ID NO: 968922 - RNA, 20 nt, Homo sapiens
aaaaucuagcacacucuucu

SEQ ID NO: 968923 - RNA, 16 nt, Homo sapiens
aaaaucucauuauuuc

SEQ ID NO: 968924 - RNA, 15 nt, Homo sapiens
aaaaugaaaauucua

SEQ ID NO: 968925 - RNA, 23 nt, Homo sapiens
aaaaugaaaauucuaacccaaga

SEQ ID NO: 968926 - RNA, 13 nt, Homo sapiens
aaaaugacauuaa

SEQ ID NO: 968927 - RNA, 12 nt, Homo sapiens
aaaaugccuuug

SEQ ID NO: 968928 - RNA, 23 nt, Homo sapiens
aaaaugugacccuccaaauggag

SEQ ID NO: 968929 - RNA, 22 nt, Homo sapiens
aaaauguuuuccccaaaccaua

SEQ ID NO: 968930 - RNA, 21 nt, Homo sapiens
aaaauuaguugggcauggugg

SEQ ID NO: 968931 - RNA, 14 nt, Homo sapiens
aaaauucaaccaca

SEQ ID NO: 968932 - RNA, 16 nt, Homo sapiens
aaacaaaaaagacuug

SEQ ID NO: 968933 - RNA, 13 nt, Homo sapiens
aaacaaauucauu

SEQ ID NO: 968934 - RNA, 13 nt, Homo sapiens
aaacacauuuacc

SEQ ID NO: 968935 - RNA, 16 nt, Homo sapiens
aaacaccaggauuuaa

SEQ ID NO: 968936 - RNA, 17 nt, Homo sapiens
aaacaugcggugccaug

SEQ ID NO: 968937 - RNA, 19 nt, Homo sapiens
aaacauguuaaugacaaua

SEQ ID NO: 968938 - RNA, 17 nt, Homo sapiens
aaacauuuuaucauuaa

SEQ ID NO: 968939 - RNA, 17 nt, Homo sapiens
aaaccagaacccagugu

SEQ ID NO: 968940 - RNA, 21 nt, Homo sapiens
aaaccauaaaacccuauacaa

SEQ ID NO: 968941 - RNA, 13 nt, Homo sapiens
aaaccuaccaaaa

SEQ ID NO: 968942 - RNA, 16 nt, Homo sapiens
aaacuaguuacuaaac

SEQ ID NO: 968943 - RNA, 12 nt, Homo sapiens
aaacucuucccu

SEQ ID NO: 968944 - RNA, 15 nt, Homo sapiens
aaacugaacacugca

SEQ ID NO: 968945 - RNA, 23 nt, Homo sapiens
aaacugcuucccuuacuuugcug

SEQ ID NO: 968946 - RNA, 19 nt, Homo sapiens
aaacuguuugacuucucaa

SEQ ID NO: 968947 - RNA, 17 nt, Homo sapiens
aaacuuaaagcuacugu

SEQ ID NO: 968948 - RNA, 18 nt, Homo sapiens
aaacuuggaugucacugc

SEQ ID NO: 968949 - RNA, 21 nt, Homo sapiens
aaacuuggaugucacugccug

SEQ ID NO: 968950 - RNA, 23 nt, Homo sapiens
aaacuuggaugucacugccugac

SEQ ID NO: 968951 - RNA, 17 nt, Homo sapiens
aaacuuuguuugucaca

SEQ ID NO: 968952 - RNA, 15 nt, Homo sapiens
aaagaaaugguaugu

SEQ ID NO: 968953 - RNA, 22 nt, Homo sapiens
aaagaaguaugguaaucuuuac

SEQ ID NO: 968954 - RNA, 15 nt, Homo sapiens
aaagaggcugccccu

SEQ ID NO: 968955 - RNA, 21 nt, Homo sapiens
aaagaucuugaauagucucau

SEQ ID NO: 968956 - RNA, 18 nt, Homo sapiens
aaagaugagaucggagac

SEQ ID NO: 968957 - RNA, 17 nt, Homo sapiens
aaagauuguuggaugaa

SEQ ID NO: 968958 - RNA, 22 nt, Homo sapiens
aaagcaaguguucacugcuccu

SEQ ID NO: 968959 - RNA, 17 nt, Homo sapiens
aaagcaucuaucucauc

SEQ ID NO: 968960 - RNA, 17 nt, Homo sapiens
aaagccagccaagcuuu

SEQ ID NO: 968961 - RNA, 18 nt, Homo sapiens
aaagccucagaaagggau

SEQ ID NO: 968962 - RNA, 13 nt, Homo sapiens
aaaggaacaaaua

SEQ ID NO: 968963 - RNA, 22 nt, Homo sapiens
aaaggacaggccacaccacagc

SEQ ID NO: 968964 - RNA, 15 nt, Homo sapiens
aaaggagcuuucuca

SEQ ID NO: 968965 - RNA, 17 nt, Homo sapiens
aaagggaagccauuccg

SEQ ID NO: 968966 - RNA, 17 nt, Homo sapiens
aaaguaaauucauguaa

SEQ ID NO: 968967 - RNA, 13 nt, Homo sapiens
aaaguaacugaau

SEQ ID NO: 968968 - RNA, 13 nt, Homo sapiens
aaaguaaugacuu

SEQ ID NO: 968969 - RNA, 22 nt, Homo sapiens
aaaguagucucuccccuggcca

SEQ ID NO: 968970 - RNA, 16 nt, Homo sapiens
aaaguauaaaauagua

SEQ ID NO: 968971 - RNA, 18 nt, Homo sapiens
aaaguccagguuagcaca

SEQ ID NO: 968972 - RNA, 19 nt, Homo sapiens
aaagucugucuuuccugaa

SEQ ID NO: 968973 - RNA, 13 nt, Homo sapiens
aaagugcuuuaaa

SEQ ID NO: 968974 - RNA, 20 nt, Homo sapiens
aaaguugugaucuguuguaa

SEQ ID NO: 968975 - RNA, 17 nt, Homo sapiens
aaauaaaagaucuugaa

SEQ ID NO: 968976 - RNA, 14 nt, Homo sapiens
aauacagauuugaa

SEQ ID NO: 968977 - RNA, 15 nt, Homo sapiens
aauacuacaauaguu

SEQ ID NO: 968978 - RNA, 21 nt, Homo sapiens
aauacuuaccgagucagacuu

SEQ ID NO: 968979 - RNA, 22 nt, Homo sapiens
aauagacuaucuagaacuugag

SEQ ID NO: 968980 - RNA, 21 nt, Homo sapiens
aauagucuaaggccauggcau

SEQ ID NO: 968981 - RNA, 20 nt, Homo sapiens
aauauaaacaggaucucaaa

SEQ ID NO: 968982 - RNA, 15 nt, Homo sapiens
aauauaaauguugcu

SEQ ID NO: 968983 - RNA, 22 nt, Homo sapiens
aauauaaauuuguguucucaaa

SEQ ID NO: 968984 - RNA, 13 nt, Homo sapiens
aauauauaauuga

SEQ ID NO: 968985 - RNA, 20 nt, Homo sapiens
aauauauauuaagugugcca

SEQ ID NO: 968986 - RNA, 20 nt, Homo sapiens
aauaucaaauaaaauaucau

SEQ ID NO: 968987 - RNA, 19 nt, Homo sapiens
aauaucaacucugaagcua

SEQ ID NO: 968988 - RNA, 13 nt, Homo sapiens
aauaugcagugau

SEQ ID NO: 968989 - RNA, 22 nt, Homo sapiens
aauauguaauuucaaaauacau

SEQ ID NO: 968990 - RNA, 12 nt, Homo sapiens
aauauuuugcug

SEQ ID NO: 968991 - RNA, 17 nt, Homo sapiens
aauauuuugcugcugaa

SEQ ID NO: 968992 - RNA, 18 nt, Homo sapiens
aauauuuuuccacuuaaa

SEQ ID NO: 968993 - RNA, 13 nt, Homo sapiens
aaucacagucuca

SEQ ID NO: 968994 - RNA, 21 nt, Homo sapiens
aaucagcacauugucacccca

SEQ ID NO: 968995 - RNA, 14 nt, Homo sapiens
aaucaucaaaaaga

SEQ ID NO: 968996 - RNA, 14 nt, Homo sapiens
aaucaucaagagaa

SEQ ID NO: 968997 - RNA, 21 nt, Homo sapiens
aaucaugugaaauuuaggcag

SEQ ID NO: 968998 - RNA, 19 nt, Homo sapiens
aaucauuucuagauuauaa

SEQ ID NO: 968999 - RNA, 15 nt, Homo sapiens
aauccacaagccauu

SEQ ID NO: 969000 - RNA, 16 nt, Homo sapiens
aauccaccugccuugg

SEQ ID NO: 969001 - RNA, 16 nt, Homo sapiens
aaucccccagcacuuc

SEQ ID NO: 969002 - RNA, 22 nt, Homo sapiens
aauccuacuuuucgaacaccaa

SEQ ID NO: 969003 - RNA, 15 nt, Homo sapiens
aauccugaagagcau

SEQ ID NO: 969004 - RNA, 14 nt, Homo sapiens
aaucuagaacuuuu

SEQ ID NO: 969005 - RNA, 15 nt, Homo sapiens
aaucuauccauugaa

SEQ ID NO: 969006 - RNA, 21 nt, Homo sapiens
aaucuauccauugaacuaaaa

SEQ ID NO: 969007 - RNA, 22 nt, Homo sapiens
aaucuccucucucuuuccucca

SEQ ID NO: 969008 - RNA, 21 nt, Homo sapiens
aaucuggcaggaaucuaucca

SEQ ID NO: 969009 - RNA, 20 nt, Homo sapiens
aaucuucugccuucucauga

SEQ ID NO: 969010 - RNA, 16 nt, Homo sapiens
aaugaaaauucuaacc

SEQ ID NO: 969011 - RNA, 13 nt, Homo sapiens
aaugaaacuuuaa

SEQ ID NO: 969012 - RNA, 13 nt, Homo sapiens
aaugaacacuccc

SEQ ID NO: 969013 - RNA, 23 nt, Homo sapiens
aaugagaaacuuugaucucugcu

SEQ ID NO: 969014 - RNA, 14 nt, Homo sapiens
aaugagacugacca

SEQ ID NO: 969015 - RNA, 19 nt, Homo sapiens
aaugagcucugaaaucuuc

SEQ ID NO: 969016 - RNA, 20 nt, Homo sapiens
aaugaggcagauagcacugg

SEQ ID NO: 969017 - RNA, 9 nt, Homo sapiens
aaugcaaaa

SEQ ID NO: 969018 - RNA, 18 nt, Homo sapiens
aaugcauuugauggccac

SEQ ID NO: 969019 - RNA, 12 nt, Homo sapiens
aaugccauccag

SEQ ID NO: 969020 - RNA, 16 nt, Homo sapiens
aaugccccacauuuua

SEQ ID NO: 969021 - RNA, 19 nt, Homo sapiens
aaugcugcaggauggacug

SEQ ID NO: 969022 - RNA, 17 nt, Homo sapiens
aaugcuucauuauucaa

SEQ ID NO: 969023 - RNA, 16 nt, Homo sapiens
aauggaauacagucau

SEQ ID NO: 969024 - RNA, 17 nt, Homo sapiens
aauggaggccauugugu

SEQ ID NO: 969025 - RNA, 20 nt, Homo sapiens
aauggcauaugguccuagac

SEQ ID NO: 969026 - RNA, 17 nt, Homo sapiens
aauggcuuaagcaauaa

SEQ ID NO: 969027 - RNA, 14 nt, Homo sapiens
aauggucucagccu

SEQ ID NO: 969028 - RNA, 16 nt, Homo sapiens
aauguaauuauuuucc

SEQ ID NO: 969029 - RNA, 20 nt, Homo sapiens
aauguaguuagcuccauaaa

SEQ ID NO: 969030 - RNA, 21 nt, Homo sapiens
aauguaucugugugugauuug

SEQ ID NO: 969031 - RNA, 21 nt, Homo sapiens
aauguaugcauucacauuuag

SEQ ID NO: 969032 - RNA, 17 nt, Homo sapiens
aauguccuuucauuugu

SEQ ID NO: 969033 - RNA, 15 nt, Homo sapiens
aaugucucaugucaa

SEQ ID NO: 969034 - RNA, 21 nt, Homo sapiens
aauguggcugcugaaacucau

SEQ ID NO: 969035 - RNA, 13 nt, Homo sapiens
aauguuaccucua

SEQ ID NO: 969036 - RNA, 12 nt, Homo sapiens
aauguugccagc

SEQ ID NO: 969037 - RNA, 19 nt, Homo sapiens
aauguuuucaaaaccaagu

SEQ ID NO: 969038 - RNA, 19 nt, Homo sapiens
aauguuuucaaaagguauu

SEQ ID NO: 969039 - RNA, 20 nt, Homo sapiens
aauuaaaauacagcugcacu

SEQ ID NO: 969040 - RNA, 18 nt, Homo sapiens
aauuaaaguggaccaaua

SEQ ID NO: 969041 - RNA, 18 nt, Homo sapiens
aauuacucaaccaaucca

SEQ ID NO: 969042 - RNA, 13 nt, Homo sapiens
aauuaugaccaug

SEQ ID NO: 969043 - RNA, 22 nt, Homo sapiens
aauuauuauauacauacugcau

SEQ ID NO: 969044 - RNA, 20 nt, Homo sapiens
aauuauugacacugaacuua

SEQ ID NO: 969045 - RNA, 18 nt, Homo sapiens
aauuauugcuguauguaa

SEQ ID NO: 969046 - RNA, 12 nt, Homo sapiens
aauuauuugaag

SEQ ID NO: 969047 - RNA, 22 nt, Homo sapiens
aauucaaugccgcaacauauag

SEQ ID NO: 969048 - RNA, 14 nt, Homo sapiens
aauucauccuuaca

SEQ ID NO: 969049 - RNA, 16 nt, Homo sapiens
aauucaucuucagucu

SEQ ID NO: 969050 - RNA, 11 nt, Homo sapiens
aauuccagcua

SEQ ID NO: 969051 - RNA, 23 nt, Homo sapiens
aauuccagugccaggccagugac

SEQ ID NO: 969052 - RNA, 14 nt, Homo sapiens
aauucccaagcuuu

SEQ ID NO: 969053 - RNA, 21 nt, Homo sapiens
aauuccuagaaguugagagag

SEQ ID NO: 969054 - RNA, 16 nt, Homo sapiens
aauuccucuuacugua

SEQ ID NO: 969055 - RNA, 19 nt, Homo sapiens
aauuccugccaugccccag

SEQ ID NO: 969056 - RNA, 13 nt, Homo sapiens
aauuccugugauu

SEQ ID NO: 969057 - RNA, 22 nt, Homo sapiens
aauucucuaaccgaauauucau

SEQ ID NO: 969058 - RNA, 18 nt, Homo sapiens
aauugcucuuucacaggu

SEQ ID NO: 969059 - RNA, 20 nt, Homo sapiens
aauugucuuuguucugugau

SEQ ID NO: 969060 - RNA, 21 nt, Homo sapiens
aauugucuuuguucugugauu

SEQ ID NO: 969061 - RNA, 18 nt, Homo sapiens
aauuguuucauucauccu

SEQ ID NO: 969062 - RNA, 11 nt, Homo sapiens
aauuucagggu

SEQ ID NO: 969063 - RNA, 20 nt, Homo sapiens
aauuuccuuuuugacacuga

SEQ ID NO: 969064 - RNA, 20 nt, Homo sapiens
aauuucucucagauuuccac

SEQ ID NO: 969065 - RNA, 22 nt, Homo sapiens
aauuuggguugacuccugagca

SEQ ID NO: 969066 - RNA, 13 nt, Homo sapiens
aauuugucuuaaa

SEQ ID NO: 969067 - RNA, 22 nt, Homo sapiens
aauuuguguguuuuuagcugug

SEQ ID NO: 969068 - RNA, 17 nt, Homo sapiens
aauuuguuuuagccauu

SEQ ID NO: 969069 - RNA, 18 nt, Homo sapiens
aauuuuaaguacuuugcu

SEQ ID NO: 969070 - RNA, 14 nt, Homo sapiens
aauuuuaguuguca

SEQ ID NO: 969071 - RNA, 20 nt, Homo sapiens
aauuuuuaaaacccauuuaa

SEQ ID NO: 969072 - RNA, 16 nt, Homo sapiens
aauuuuugcugaugaa

SEQ ID NO: 969073 - RNA, 14 nt, Homo sapiens
acaaaaaccaaaug

SEQ ID NO: 969074 - RNA, 15 nt, Homo sapiens
acaaaagucugucuu

SEQ ID NO: 969075 - RNA, 19 nt, Homo sapiens
acaaaauagccuauccuua

SEQ ID NO: 969076 - RNA, 13 nt, Homo sapiens
acaaaauauagcu

SEQ ID NO: 969077 - RNA, 16 nt, Homo sapiens
acaaacaagagaagcu

SEQ ID NO: 969078 - RNA, 16 nt, Homo sapiens
acaaaccuaccaaaau

SEQ ID NO: 969079 - RNA, 13 nt, Homo sapiens
acaaacucucacc

SEQ ID NO: 969080 - RNA, 18 nt, Homo sapiens
acaaagccuuugcuuugu

SEQ ID NO: 969081 - RNA, 16 nt, Homo sapiens
acaaauuuuucaaauc

SEQ ID NO: 969082 - RNA, 22 nt, Homo sapiens
acaaauuuuucaaaucauuccu

SEQ ID NO: 969083 - RNA, 16 nt, Homo sapiens
acaacaauccuucuau

SEQ ID NO: 969084 - RNA, 23 nt, Homo sapiens
acaacaggcauagcaaaugacau

SEQ ID NO: 969085 - RNA, 13 nt, Homo sapiens
acaacauaucuca

SEQ ID NO: 969086 - RNA, 15 nt, Homo sapiens
acaacauaucucagg

SEQ ID NO: 969087 - RNA, 21 nt, Homo sapiens
acaagaaaauguauccaagga

SEQ ID NO: 969088 - RNA, 16 nt, Homo sapiens
acaagaauggucuuuc

SEQ ID NO: 969089 - RNA, 20 nt, Homo sapiens
acaagucaguaggacuccuu

SEQ ID NO: 969090 - RNA, 13 nt, Homo sapiens
acaauaaaagcuu

SEQ ID NO: 969091 - RNA, 15 nt, Homo sapiens
aaauaaaaugacguc

SEQ ID NO: 969092 - RNA, 21 nt, Homo sapiens
aaauaaaaugauaaacaaguc

SEQ ID NO: 969093 - RNA, 16 nt, Homo sapiens
aaauaaauacguguca

SEQ ID NO: 969094 - RNA, 16 nt, Homo sapiens
aaauaacuaccuucca

SEQ ID NO: 969095 - RNA, 17 nt, Homo sapiens
aaauaagagcagucaca

SEQ ID NO: 969096 - RNA, 12 nt, Homo sapiens
aaauaauuugaa

SEQ ID NO: 969097 - RNA, 20 nt, Homo sapiens
aaauaauuuuauuaugcaac

SEQ ID NO: 969098 - RNA, 16 nt, Homo sapiens
aaauacuauugccuca

SEQ ID NO: 969099 - RNA, 22 nt, Homo sapiens
aaauacugcuuagcauuuugca

SEQ ID NO: 969100 - RNA, 16 nt, Homo sapiens
aaauaguugcauagca

SEQ ID NO: 969101 - RNA, 18 nt, Homo sapiens
aaauaucaaagucauuaa

SEQ ID NO: 969102 - RNA, 17 nt, Homo sapiens
aaauaucauaaagcauu

SEQ ID NO: 969103 - RNA, 12 nt, Homo sapiens
aaauauugucau

SEQ ID NO: 969104 - RNA, 19 nt, Homo sapiens
aaauauuguugaacacuug

SEQ ID NO: 969105 - RNA, 13 nt, Homo sapiens
aaauauuucccau

SEQ ID NO: 969106 - RNA, 18 nt, Homo sapiens
aaaucaauacacuaguug

SEQ ID NO: 969107 - RNA, 14 nt, Homo sapiens
aaaucagagacaaa

SEQ ID NO: 969108 - RNA, 23 nt, Homo sapiens
aaauccucagguaguacugggaa

SEQ ID NO: 969109 - RNA, 15 nt, Homo sapiens
aaaucucuuccacau

SEQ ID NO: 969110 - RNA, 15 nt, Homo sapiens
aaaucuuuagggaau

SEQ ID NO: 969111 - RNA, 14 nt, Homo sapiens
aaaugaacauuuca

SEQ ID NO: 969112 - RNA, 20 nt, Homo sapiens
aaaugcauauccugagccau

SEQ ID NO: 969113 - RNA, 14 nt, Homo sapiens
aaaugccauccaga

SEQ ID NO: 969114 - RNA, 14 nt, Homo sapiens
aaauggacuuucag

SEQ ID NO: 969115 - RNA, 16 nt, Homo sapiens
aaauggaggaauauga

SEQ ID NO: 969116 - RNA, 12 nt, Homo sapiens
aaauggucccaa

SEQ ID NO: 969117 - RNA, 15 nt, Homo sapiens
aaauguacauuucca

SEQ ID NO: 969118 - RNA, 18 nt, Homo sapiens
aaauguagcgacugucaa

SEQ ID NO: 969119 - RNA, 18 nt, Homo sapiens
aaauguauaaauauacag

SEQ ID NO: 969120 - RNA, 15 nt, Homo sapiens
aaaugucucauguca

SEQ ID NO: 969121 - RNA, 18 nt, Homo sapiens
aaaugucuucauguugau

SEQ ID NO: 969122 - RNA, 17 nt, Homo sapiens
aaauguguauaaaguaa

SEQ ID NO: 969123 - RNA, 20 nt, Homo sapiens
aaaugugucucacaucuaca

SEQ ID NO: 969124 - RNA, 14 nt, Homo sapiens
aaaugugugccaga

SEQ ID NO: 969125 - RNA, 21 nt, Homo sapiens
aaauguucauggacuauucca

SEQ ID NO: 969126 - RNA, 12 nt, Homo sapiens
aaauuaagcauu

SEQ ID NO: 969127 - RNA, 23 nt, Homo sapiens
aaauuaauugaaauaccuauuca

SEQ ID NO: 969128 - RNA, 19 nt, Homo sapiens
aaauuagcugggcauggug

SEQ ID NO: 969129 - RNA, 16 nt, Homo sapiens
aaauuagucuuggaaa

SEQ ID NO: 969130 - RNA, 16 nt, Homo sapiens
aaauuauaaaccaagg

SEQ ID NO: 969131 - RNA, 17 nt, Homo sapiens
aaauuaugaccauggua

SEQ ID NO: 969132 - RNA, 19 nt, Homo sapiens
aaauuccauacuucucuca

SEQ ID NO: 969133 - RNA, 22 nt, Homo sapiens
aaauuccccaagcaccuucccc

SEQ ID NO: 969134 - RNA, 14 nt, Homo sapiens
aaauugcaguaaca

SEQ ID NO: 969135 - RNA, 11 nt, Homo sapiens
aaauugcugac

SEQ ID NO: 969136 - RNA, 24 nt, Homo sapiens
aaauuuaagugcguguguagaguu

SEQ ID NO: 969137 - RNA, 14 nt, Homo sapiens
aaauuuaauaccag

SEQ ID NO: 969138 - RNA, 20 nt, Homo sapiens
aaauuucuuaggaacucaaa

SEQ ID NO: 969139 - RNA, 13 nt, Homo sapiens
aaauuuguaaguu

SEQ ID NO: 969140 - RNA, 14 nt, Homo sapiens
aaauuuuaaccuau

SEQ ID NO: 969141 - RNA, 18 nt, Homo sapiens
aaauuuuagaucuuucaa

SEQ ID NO: 969142 - RNA, 15 nt, Homo sapiens
aaauuuuuaccuguu

SEQ ID NO: 969143 - RNA, 20 nt, Homo sapiens
aaauuuuucaaaucauuccu

SEQ ID NO: 969144 - RNA, 12 nt, Homo sapiens
aacaaacagggc

SEQ ID NO: 969145 - RNA, 18 nt, Homo sapiens
aacaaacauccuugcaaa

SEQ ID NO: 969146 - RNA, 14 nt, Homo sapiens
aacaacauaucuca

SEQ ID NO: 969147 - RNA, 15 nt, Homo sapiens
aacaaguaugaaucu

SEQ ID NO: 969148 - RNA, 20 nt, Homo sapiens
aacaaucuauggcuuauuuc

SEQ ID NO: 969149 - RNA, 21 nt, Homo sapiens
aacaauguaaaccaccaucuu

SEQ ID NO: 969150 - RNA, 17 nt, Homo sapiens
aacaauuuuuuccccaa

SEQ ID NO: 969151 - RNA, 22 nt, Homo sapiens
aacacagauccgcaagaguaaa

SEQ ID NO: 969152 - RNA, 22 nt, Homo sapiens
aacaccaaaaaugaugcgcauc

SEQ ID NO: 969153 - RNA, 15 nt, Homo sapiens
aacacccgacgucau

SEQ ID NO: 969154 - RNA, 22 nt, Homo sapiens
aacacggagcagggagagcuca

SEQ ID NO: 969155 - RNA, 18 nt, Homo sapiens
aacacguggguauuuaau

SEQ ID NO: 969156 - RNA, 14 nt, Homo sapiens
aacacucaguccac

SEQ ID NO: 969157 - RNA, 21 nt, Homo sapiens
aacagagcaagacuccaucuc

SEQ ID NO: 969158 - RNA, 17 nt, Homo sapiens
aacagagugauuuguaa

SEQ ID NO: 969159 - RNA, 21 nt, Homo sapiens
aacagccuaucuuugugugac

SEQ ID NO: 969160 - RNA, 19 nt, Homo sapiens
aacaguaaagaaagcagaa

SEQ ID NO: 969161 - RNA, 13 nt, Homo sapiens
aacauguacaaaa

SEQ ID NO: 969162 - RNA, 18 nt, Homo sapiens
aacauuaaggaauuugau

SEQ ID NO: 969163 - RNA, 20 nt, Homo sapiens
aacauuugagauauguugaa

SEQ ID NO: 969164 - RNA, 14 nt, Homo sapiens
aaccaacaaaaaga

SEQ ID NO: 969165 - RNA, 22 nt, Homo sapiens
aaccaacaaaaagaacaaauca

SEQ ID NO: 969166 - RNA, 14 nt, Homo sapiens
aaccaacaauguga

SEQ ID NO: 969167 - RNA, 15 nt, Homo sapiens
aaccaaggacugagc

SEQ ID NO: 969168 - RNA, 14 nt, Homo sapiens
aaccacacuugaaa

SEQ ID NO: 969169 - RNA, 17 nt, Homo sapiens
aaccacuccacuggccu

SEQ ID NO: 969170 - RNA, 19 nt, Homo sapiens
aaccagaacccaguguuuc

SEQ ID NO: 969171 - RNA, 17 nt, Homo sapiens
aaccagggcucuucuca

SEQ ID NO: 969172 - RNA, 23 nt, Homo sapiens
aacccauuccaguacaguauucu

SEQ ID NO: 969173 - RNA, 12 nt, Homo sapiens
aaccccagugga

SEQ ID NO: 969174 - RNA, 17 nt, Homo sapiens
aacccccaguucaagac

SEQ ID NO: 969175 - RNA, 16 nt, Homo sapiens
aaccccgucucuacua

SEQ ID NO: 969176 - RNA, 23 nt, Homo sapiens
aaccccugcgcucucuuugcaac

SEQ ID NO: 969177 - RNA, 12 nt, Homo sapiens
aaccccuuccag

SEQ ID NO: 969178 - RNA, 23 nt, Homo sapiens
aaccccuuccagaucacugccac

SEQ ID NO: 969179 - RNA, 14 nt, Homo sapiens
aaccccuucuuuac

SEQ ID NO: 969180 - RNA, 22 nt, Homo sapiens
aacccugcugaacacagugucu

SEQ ID NO: 969181 - RNA, 20 nt, Homo sapiens
aacccuguggggccugaugg

SEQ ID NO: 969182 - RNA, 19 nt, Homo sapiens
aacccuuugugugcucucc

SEQ ID NO: 969183 - RNA, 19 nt, Homo sapiens
aaccgaguagaaaauguga

SEQ ID NO: 969184 - RNA, 11 nt, Homo sapiens
aaccucagggc

SEQ ID NO: 969185 - RNA, 22 nt, Homo sapiens
aaccucagggcucccagggguc

SEQ ID NO: 969186 - RNA, 21 nt, Homo sapiens
aaccugcagccccucaugccu

SEQ ID NO: 969187 - RNA, 17 nt, Homo sapiens
aaccugccugugcauga

SEQ ID NO: 969188 - RNA, 22 nt, Homo sapiens
aaccuuaaagaaccaucagcau

SEQ ID NO: 969189 - RNA, 12 nt, Homo sapiens
aaccuuauucca

SEQ ID NO: 969190 - RNA, 20 nt, Homo sapiens
aaccuuguauaaauuauuca

SEQ ID NO: 969191 - RNA, 21 nt, Homo sapiens
aacgaauggucuuugcuccag

SEQ ID NO: 969192 - RNA, 21 nt, Homo sapiens
aacuaagaaaauucuauguua

SEQ ID NO: 969193 - RNA, 13 nt, Homo sapiens
aacuaccaggugg

SEQ ID NO: 969194 - RNA, 14 nt, Homo sapiens
aacuagcaaugccu

SEQ ID NO: 969195 - RNA, 17 nt, Homo sapiens
aacuagcaaugccugag

SEQ ID NO: 969196 - RNA, 14 nt, Homo sapiens
aacuauaagauaca

SEQ ID NO: 969197 - RNA, 17 nt, Homo sapiens
aacuauaagauacaaua

SEQ ID NO: 969198 - RNA, 14 nt, Homo sapiens
aacuauugugcuca

SEQ ID NO: 969199 - RNA, 18 nt, Homo sapiens
aacucaaauaaaaugccc

SEQ ID NO: 969200 - RNA, 18 nt, Homo sapiens
aacucaaggauaccuucu

SEQ ID NO: 969201 - RNA, 21 nt, Homo sapiens
aacucaccagccccacugcca

SEQ ID NO: 969202 - RNA, 12 nt, Homo sapiens
aacucacuguga

SEQ ID NO: 969203 - RNA, 14 nt, Homo sapiens
aacucacugugauc

SEQ ID NO: 969204 - RNA, 17 nt, Homo sapiens
aacucuacucaacccau

SEQ ID NO: 969205 - RNA, 15 nt, Homo sapiens
aacucuaugaacuua

SEQ ID NO: 969206 - RNA, 23 nt, Homo sapiens
acaauacugggguuggacuguaa

SEQ ID NO: 969207 - RNA, 16 nt, Homo sapiens
acaauaguucuguggg

SEQ ID NO: 969208 - RNA, 14 nt, Homo sapiens
acaauggaguauuc

SEQ ID NO: 969209 - RNA, 14 nt, Homo sapiens
acaauggucucagc

SEQ ID NO: 969210 - RNA, 18 nt, Homo sapiens
acaauggucucagccuag

SEQ ID NO: 969211 - RNA, 20 nt, Homo sapiens
acaauuauuugaagauuuaa

SEQ ID NO: 969212 - RNA, 17 nt, Homo sapiens
acaauucaguaacaaag

SEQ ID NO: 969213 - RNA, 16 nt, Homo sapiens
acacacgaugcauuua

SEQ ID NO: 969214 - RNA, 17 nt, Homo sapiens
acacacgaugcauuuaa

SEQ ID NO: 969215 - RNA, 16 nt, Homo sapiens
acacagccuagcacag

SEQ ID NO: 969216 - RNA, 20 nt, Homo sapiens
acacauugcauuuugauaaa

SEQ ID NO: 969217 - RNA, 16 nt, Homo sapiens
acaccaaaaaugaugc

SEQ ID NO: 969218 - RNA, 23 nt, Homo sapiens
acacccccucuucugagcacaga

SEQ ID NO: 969219 - RNA, 14 nt, Homo sapiens
acacccucuuccca

SEQ ID NO: 969220 - RNA, 22 nt, Homo sapiens
acacccuucucccacucuccua

SEQ ID NO: 969221 - RNA, 20 nt, Homo sapiens
acaccucuccuuugugacuu

SEQ ID NO: 969222 - RNA, 17 nt, Homo sapiens
acacgagcaaacccaga

SEQ ID NO: 969223 - RNA, 14 nt, Homo sapiens
acacgaugcauuua

SEQ ID NO: 969224 - RNA, 14 nt, Homo sapiens
acacuaacucacca

SEQ ID NO: 969225 - RNA, 23 nt, Homo sapiens
acacuaacuuaauguguauucau

SEQ ID NO: 969226 - RNA, 22 nt, Homo sapiens
acacuguaccgacuuugauaga

SEQ ID NO: 969227 - RNA, 18 nt, Homo sapiens
acacugucacuagucuca

SEQ ID NO: 969228 - RNA, 21 nt, Homo sapiens
acacugugaacuaaugacaag

SEQ ID NO: 969229 - RNA, 21 nt, Homo sapiens
acagaaagagacuccgucuca

SEQ ID NO: 969230 - RNA, 22 nt, Homo sapiens
acagaagcagcuaaaccaagga

SEQ ID NO: 969231 - RNA, 14 nt, Homo sapiens
acagacaaagcaua

SEQ ID NO: 969232 - RNA, 20 nt, Homo sapiens
acagacacuggcauggauau

SEQ ID NO: 969233 - RNA, 20 nt, Homo sapiens
acagagcaagacuccaucuc

SEQ ID NO: 969234 - RNA, 21 nt, Homo sapiens
acagagcaagacuccaucuca

SEQ ID NO: 969235 - RNA, 18 nt, Homo sapiens
acagagcaagacugucuc

SEQ ID NO: 969236 - RNA, 12 nt, Homo sapiens
acagagcuccug

SEQ ID NO: 969237 - RNA, 23 nt, Homo sapiens
acagcagagaccaccacauugag

SEQ ID NO: 969238 - RNA, 13 nt, Homo sapiens
acagcaguggagu

SEQ ID NO: 969239 - RNA, 19 nt, Homo sapiens
acagcaucccuucccacau

SEQ ID NO: 969240 - RNA, 20 nt, Homo sapiens
acagccacuccccuccacuc

SEQ ID NO: 969241 - RNA, 21 nt, Homo sapiens
acagcccaggauacuggcaca

SEQ ID NO: 969242 - RNA, 19 nt, Homo sapiens
acagcccccacuccagucc

SEQ ID NO: 969243 - RNA, 12 nt, Homo sapiens
acagcccugcuc

SEQ ID NO: 969244 - RNA, 18 nt, Homo sapiens
acagcuaaguguggagcu

SEQ ID NO: 969245 - RNA, 22 nt, Homo sapiens
acagcuugggaauccugcuaaa

SEQ ID NO: 969246 - RNA, 14 nt, Homo sapiens
acaggaggaaugca

SEQ ID NO: 969247 - RNA, 16 nt, Homo sapiens
acaggccacaccacag

SEQ ID NO: 969248 - RNA, 20 nt, Homo sapiens
acaggcugagaacucguuca

SEQ ID NO: 969249 - RNA, 17 nt, Homo sapiens
acagggucuugcucugu

SEQ ID NO: 969250 - RNA, 19 nt, Homo sapiens
acagggucuugcucugucc

SEQ ID NO: 969251 - RNA, 18 nt, Homo sapiens
acagguguauauaagcaa

SEQ ID NO: 969252 - RNA, 22 nt, Homo sapiens
acaguaacugccauuuuuuguc

SEQ ID NO: 969253 - RNA, 15 nt, Homo sapiens
acaguagaacugucu

SEQ ID NO: 969254 - RNA, 21 nt, Homo sapiens
acaguaucccacauccaacuc

SEQ ID NO: 969255 - RNA, 20 nt, Homo sapiens
acagugaaguuuuacugucu

SEQ ID NO: 969256 - RNA, 15 nt, Homo sapiens
acagugacacccaga

SEQ ID NO: 969257 - RNA, 15 nt, Homo sapiens
acaguggcaguauug

SEQ ID NO: 969258 - RNA, 15 nt, Homo sapiens
acagugggcugcuag

SEQ ID NO: 969259 - RNA, 13 nt, Homo sapiens
acagugugcucca

SEQ ID NO: 969260 - RNA, 18 nt, Homo sapiens
acaguugguucaucccuu

SEQ ID NO: 969261 - RNA, 13 nt, Homo sapiens
acauacugucuaa

SEQ ID NO: 969262 - RNA, 16 nt, Homo sapiens
acauacuguucacuca

SEQ ID NO: 969263 - RNA, 12 nt, Homo sapiens
acauaugcaccu

SEQ ID NO: 969264 - RNA, 16 nt, Homo sapiens
acauauguugcaagac

SEQ ID NO: 969265 - RNA, 22 nt, Homo sapiens
acauauuaggaaaauauggguu

SEQ ID NO: 969266 - RNA, 16 nt, Homo sapiens
acauccaacuccagca

SEQ ID NO: 969267 - RNA, 22 nt, Homo sapiens
acaucucaauaaagugcuuuaa

SEQ ID NO: 969268 - RNA, 16 nt, Homo sapiens
acaucuuuauugaaau

SEQ ID NO: 969269 - RNA, 19 nt, Homo sapiens
acaugaacacuuuuuauca

SEQ ID NO: 969270 - RNA, 20 nt, Homo sapiens
acaugacccaggccuggcca

SEQ ID NO: 969271 - RNA, 14 nt, Homo sapiens
acaugaugugagau

SEQ ID NO: 969272 - RNA, 15 nt, Homo sapiens
acaugcaccuaccca

SEQ ID NO: 969273 - RNA, 20 nt, Homo sapiens
acaugcggugccaugaaggg

SEQ ID NO: 969274 - RNA, 22 nt, Homo sapiens
acaugcugggccauugugauug

SEQ ID NO: 969275 - RNA, 15 nt, Homo sapiens
acaugcuugaauauc

SEQ ID NO: 969276 - RNA, 16 nt, Homo sapiens
acauggccuaugcaca

SEQ ID NO: 969277 - RNA, 17 nt, Homo sapiens
acaugugacacauaugc

SEQ ID NO: 969278 - RNA, 21 nt, Homo sapiens
acauguuaaugacaauauucc

SEQ ID NO: 969279 - RNA, 15 nt, Homo sapiens
acauguucugugccu

SEQ ID NO: 969280 - RNA, 14 nt, Homo sapiens
acauguugccucac

SEQ ID NO: 969281 - RNA, 14 nt, Homo sapiens
acauuaacggugcu

SEQ ID NO: 969282 - RNA, 16 nt, Homo sapiens
acauuaacggugcuaa

SEQ ID NO: 969283 - RNA, 16 nt, Homo sapiens
acauuaaggaauuuga

SEQ ID NO: 969284 - RNA, 17 nt, Homo sapiens
acauucacuuccagaga

SEQ ID NO: 969285 - RNA, 21 nt, Homo sapiens
acauugaagguauaugccaaa

SEQ ID NO: 969286 - RNA, 21 nt, Homo sapiens
acauugucaccccaagccaua

SEQ ID NO: 969287 - RNA, 17 nt, Homo sapiens
acauuucuaugccaaac

SEQ ID NO: 969288 - RNA, 14 nt, Homo sapiens
acauuuuacuacag

SEQ ID NO: 969289 - RNA, 15 nt, Homo sapiens
accaaaaaugaugcg

SEQ ID NO: 969290 - RNA, 15 nt, Homo sapiens
accaaccugcucugu

SEQ ID NO: 969291 - RNA, 13 nt, Homo sapiens
accaaccuguuac

SEQ ID NO: 969292 - RNA, 15 nt, Homo sapiens
accaacuguacaaaa

SEQ ID NO: 969293 - RNA, 11 nt, Homo sapiens
accaagcuaua

SEQ ID NO: 969294 - RNA, 15 nt, Homo sapiens
accaaguaucacacu

SEQ ID NO: 969295 - RNA, 19 nt, Homo sapiens
accaauagggcugagcucu

SEQ ID NO: 969296 - RNA, 15 nt, Homo sapiens
accacacuucuugaa

SEQ ID NO: 969297 - RNA, 17 nt, Homo sapiens
accacagcagagaccac

SEQ ID NO: 969298 - RNA, 16 nt, Homo sapiens
accacggcagcucucc

SEQ ID NO: 969299 - RNA, 15 nt, Homo sapiens
accacuccacuggcc

SEQ ID NO: 969300 - RNA, 16 nt, Homo sapiens
accacugugguuuuga

SEQ ID NO: 969301 - RNA, 15 nt, Homo sapiens
accagagacuuuagg

SEQ ID NO: 969302 - RNA, 15 nt, Homo sapiens
accagcaacauuaua

SEQ ID NO: 969303 - RNA, 20 nt, Homo sapiens
accagcccugaccccagugu

SEQ ID NO: 969304 - RNA, 23 nt, Homo sapiens
accauauugugcuucacaguaga

SEQ ID NO: 969305 - RNA, 20 nt, Homo sapiens
accauguggauaacuuuaca

SEQ ID NO: 969306 - RNA, 20 nt, Homo sapiens
accauguugacuuuccucau

SEQ ID NO: 969307 - RNA, 15 nt, Homo sapiens
accauucuacugugu

SEQ ID NO: 969308 - RNA, 20 nt, Homo sapiens
acccaagugccucaccucga

SEQ ID NO: 969309 - RNA, 12 nt, Homo sapiens
acccaauaccuu

SEQ ID NO: 969310 - RNA, 21 nt, Homo sapiens
acccacaugugacacauaugc

SEQ ID NO: 969311 - RNA, 12 nt, Homo sapiens
acccaccucagc

SEQ ID NO: 969312 - RNA, 12 nt, Homo sapiens
acccagccaggc

SEQ ID NO: 969313 - RNA, 18 nt, Homo sapiens
acccagggaacagccacu

SEQ ID NO: 969314 - RNA, 23 nt, Homo sapiens
acccauaauaagagaauguuccu

SEQ ID NO: 969315 - RNA, 22 nt, Homo sapiens
accccaagaguuuugggaguug

SEQ ID NO: 969316 - RNA, 22 nt, Homo sapiens
accccagcauucucaggcacca

SEQ ID NO: 969317 - RNA, 17 nt, Homo sapiens
accccagucgugaugug

SEQ ID NO: 969318 - RNA, 13 nt, Homo sapiens
accccugcucagu

SEQ ID NO: 969319 - RNA, 22 nt, Homo sapiens
acccgccgcugccaccaucucc

SEQ ID NO: 969320 - RNA, 16 nt, Homo sapiens
acccuaaagugcaaaa

SEQ ID NO: 969321 - RNA, 21 nt, Homo sapiens
aacucucaccaugaugugaag

SEQ ID NO: 969322 - RNA, 15 nt, Homo sapiens
aacucuccacuccau

SEQ ID NO: 969323 - RNA, 17 nt, Homo sapiens
aacugaaaugccugcuu

SEQ ID NO: 969324 - RNA, 21 nt, Homo sapiens
aacugcucccaccuccugaca

SEQ ID NO: 969325 - RNA, 14 nt, Homo sapiens
aacugucucucuuc

SEQ ID NO: 969326 - RNA, 17 nt, Homo sapiens
aacugucucucuucuca

SEQ ID NO: 969327 - RNA, 17 nt, Homo sapiens
aacugucuuccucaaaa

SEQ ID NO: 969328 - RNA, 17 nt, Homo sapiens
aacugugaagaucucac

SEQ ID NO: 969329 - RNA, 21 nt, Homo sapiens
aacugugccaauacagacaaa

SEQ ID NO: 969330 - RNA, 13 nt, Homo sapiens
aacuguguugcca

SEQ ID NO: 969331 - RNA, 17 nt, Homo sapiens
aacuuauaggugaauga

SEQ ID NO: 969332 - RNA, 21 nt, Homo sapiens
aacuuauucuuugaguaaugu

SEQ ID NO: 969333 - RNA, 18 nt, Homo sapiens
aacuucaaauagcaauaa

SEQ ID NO: 969334 - RNA, 17 nt, Homo sapiens
aacuugcacuuguuaua

SEQ ID NO: 969335 - RNA, 12 nt, Homo sapiens
aacuugcugcuu

SEQ ID NO: 969336 - RNA, 20 nt, Homo sapiens
aacuugcugugucugaggua

SEQ ID NO: 969337 - RNA, 16 nt, Homo sapiens
aacuuuaucauaugcu

SEQ ID NO: 969338 - RNA, 21 nt, Homo sapiens
aagaagccauauaugaccaga

SEQ ID NO: 969339 - RNA, 15 nt, Homo sapiens
aagaauacacaggau

SEQ ID NO: 969340 - RNA, 16 nt, Homo sapiens
aagaaugaacacuccc

SEQ ID NO: 969341 - RNA, 12 nt, Homo sapiens
aagacaaagccu

SEQ ID NO: 969342 - RNA, 22 nt, Homo sapiens
aagaccggcugguggagcugcu

SEQ ID NO: 969343 - RNA, 13 nt, Homo sapiens
aagacugucucaa

SEQ ID NO: 969344 - RNA, 14 nt, Homo sapiens
aagagaaacuucaa

SEQ ID NO: 969345 - RNA, 20 nt, Homo sapiens
aagagaauuuggggcuucca

SEQ ID NO: 969346 - RNA, 18 nt, Homo sapiens
aagaggcugccccucuca

SEQ ID NO: 969347 - RNA, 15 nt, Homo sapiens
aagagucugucucaa

SEQ ID NO: 969348 - RNA, 16 nt, Homo sapiens
aagagucugucucaaa

SEQ ID NO: 969349 - RNA, 22 nt, Homo sapiens
aagaguucccuugaaacuuugg

SEQ ID NO: 969350 - RNA, 12 nt, Homo sapiens
aagauacaauaa

SEQ ID NO: 969351 - RNA, 15 nt, Homo sapiens
aagaugaugauguua

SEQ ID NO: 969352 - RNA, 16 nt, Homo sapiens
aagaugggucacugaa

SEQ ID NO: 969353 - RNA, 17 nt, Homo sapiens
aagaugucuauguagcu

SEQ ID NO: 969354 - RNA, 13 nt, Homo sapiens
aagauuaaauggg

SEQ ID NO: 969355 - RNA, 23 nt, Homo sapiens
aagauuauuuuuuaaaaagguaa

SEQ ID NO: 969356 - RNA, 15 nt, Homo sapiens
aagauugcaccacug

SEQ ID NO: 969357 - RNA, 21 nt, Homo sapiens
aagauuuuuuaaauugucaua

SEQ ID NO: 969358 - RNA, 17 nt, Homo sapiens
aagcaaaacucacuaag

SEQ ID NO: 969359 - RNA, 14 nt, Homo sapiens
aagcaaacuuauuu

SEQ ID NO: 969360 - RNA, 20 nt, Homo sapiens
aagcaauccaccugccuugg

SEQ ID NO: 969361 - RNA, 14 nt, Homo sapiens
aagcacuacaccuu

SEQ ID NO: 969362 - RNA, 18 nt, Homo sapiens
aagcacuacaccuugccu

SEQ ID NO: 969363 - RNA, 14 nt, Homo sapiens
aagcagaugggaac

SEQ ID NO: 969364 - RNA, 17 nt, Homo sapiens
aagcagaugggaacuga

SEQ ID NO: 969365 - RNA, 16 nt, Homo sapiens
aagcagucaguuugca

SEQ ID NO: 969366 - RNA, 19 nt, Homo sapiens
aagcauucugagcugggcu

SEQ ID NO: 969367 - RNA, 21 nt, Homo sapiens
aagccacaaauaggaugcuug

SEQ ID NO: 969368 - RNA, 17 nt, Homo sapiens
aagccaggaccugcugu

SEQ ID NO: 969369 - RNA, 14 nt, Homo sapiens
aagccauuaugaua

SEQ ID NO: 969370 - RNA, 17 nt, Homo sapiens
aagccucagaaagggau

SEQ ID NO: 969371 - RNA, 18 nt, Homo sapiens
aagccucuccagcaauaa

SEQ ID NO: 969372 - RNA, 18 nt, Homo sapiens
aagcuaaugucacaauua

SEQ ID NO: 969373 - RNA, 14 nt, Homo sapiens
aagcuacuguagaa

SEQ ID NO: 969374 - RNA, 17 nt, Homo sapiens
aagcucaauucaaguga

SEQ ID NO: 969375 - RNA, 23 nt, Homo sapiens
aagcucaucucagucauccugca

SEQ ID NO: 969376 - RNA, 21 nt, Homo sapiens
aagcucccagcugaccagaca

SEQ ID NO: 969377 - RNA, 19 nt, Homo sapiens
aagcucgugacaagugccu

SEQ ID NO: 969378 - RNA, 16 nt, Homo sapiens
aagcugcccacuguuu

SEQ ID NO: 969379 - RNA, 19 nt, Homo sapiens
aagcuggcuuuucccauuu

SEQ ID NO: 969380 - RNA, 23 nt, Homo sapiens
aagcuggugucugauuuuggcca

SEQ ID NO: 969381 - RNA, 17 nt, Homo sapiens
aagcuguuguacauuua

SEQ ID NO: 969382 - RNA, 20 nt, Homo sapiens
aaggacaccuuuuaacucac

SEQ ID NO: 969383 - RNA, 12 nt, Homo sapiens
aaggaccugaga

SEQ ID NO: 969384 - RNA, 22 nt, Homo sapiens
aaggacuccauuggaucugcaa

SEQ ID NO: 969385 - RNA, 15 nt, Homo sapiens
aaggcaguagaacuc

SEQ ID NO: 969386 - RNA, 22 nt, Homo sapiens
aaggcauguggccuuuaucuca

SEQ ID NO: 969387 - RNA, 16 nt, Homo sapiens
aaggcccugcugaguc

SEQ ID NO: 969388 - RNA, 17 nt, Homo sapiens
aaggcccugcugaguca

SEQ ID NO: 969389 - RNA, 20 nt, Homo sapiens
aaggcugagacagugaauuu

SEQ ID NO: 969390 - RNA, 20 nt, Homo sapiens
aaggcuggauggcaccucag

SEQ ID NO: 969391 - RNA, 20 nt, Homo sapiens
aaggcuucucuccacagugu

SEQ ID NO: 969392 - RNA, 17 nt, Homo sapiens
aagggaauacugugcau

SEQ ID NO: 969393 - RNA, 23 nt, Homo sapiens
aagggaauacugugcauaagcca

SEQ ID NO: 969394 - RNA, 19 nt, Homo sapiens
aagggagcgcucucuugau

SEQ ID NO: 969395 - RNA, 13 nt, Homo sapiens
aagguaaauccca

SEQ ID NO: 969396 - RNA, 13 nt, Homo sapiens
aaggucacuguuu

SEQ ID NO: 969397 - RNA, 21 nt, Homo sapiens
aaggucauaagggagcaugau

SEQ ID NO: 969398 - RNA, 17 nt, Homo sapiens
aaggugaguuugagcug

SEQ ID NO: 969399 - RNA, 12 nt, Homo sapiens
aaggugccacuu

SEQ ID NO: 969400 - RNA, 14 nt, Homo sapiens
aaggugccacuuua

SEQ ID NO: 969401 - RNA, 12 nt, Homo sapiens
aaggugugcucg

SEQ ID NO: 969402 - RNA, 11 nt, Homo sapiens
aagguucucug

SEQ ID NO: 969403 - RNA, 21 nt, Homo sapiens
aaguaacugugagaacccagu

SEQ ID NO: 969404 - RNA, 23 nt, Homo sapiens
aaguaagcagaugggaacugaau

SEQ ID NO: 969405 - RNA, 16 nt, Homo sapiens
aaguagaaguuacuua

SEQ ID NO: 969406 - RNA, 14 nt, Homo sapiens
aagucaacacucuu

SEQ ID NO: 969407 - RNA, 17 nt, Homo sapiens
aagucacuuaacuauaa

SEQ ID NO: 969408 - RNA, 20 nt, Homo sapiens
aagucugucugucugaugau

SEQ ID NO: 969409 - RNA, 17 nt, Homo sapiens
aagugacuuauuugcuc

SEQ ID NO: 969410 - RNA, 16 nt, Homo sapiens
aagugaggagugccag

SEQ ID NO: 969411 - RNA, 19 nt, Homo sapiens
aagugaggagugccagcuc

SEQ ID NO: 969412 - RNA, 12 nt, Homo sapiens
aagugcagucag

SEQ ID NO: 969413 - RNA, 16 nt, Homo sapiens
aagugcuguugggaua

SEQ ID NO: 969414 - RNA, 16 nt, Homo sapiens
aaguggggucuggccu

SEQ ID NO: 969415 - RNA, 19 nt, Homo sapiens
aaguguaaaaaaugucuca

SEQ ID NO: 969416 - RNA, 22 nt, Homo sapiens
aaguucccuaugaaaaaugugu

SEQ ID NO: 969417 - RNA, 13 nt, Homo sapiens
aaguugugcuuga

SEQ ID NO: 969418 - RNA, 17 nt, Homo sapiens
aaguuuagcucugagaa

SEQ ID NO: 969419 - RNA, 14 nt, Homo sapiens
aaguuuuacugucu

SEQ ID NO: 969420 - RNA, 14 nt, Homo sapiens
aauaaaaaucacuu

SEQ ID NO: 969421 - RNA, 16 nt, Homo sapiens
aauaaaagaucuugaa

SEQ ID NO: 969422 - RNA, 14 nt, Homo sapiens
aauaaaauaucaua

SEQ ID NO: 969423 - RNA, 19 nt, Homo sapiens
aauaaaauuccuaucucau

SEQ ID NO: 969424 - RNA, 18 nt, Homo sapiens
aauaacucuccaguaaca

SEQ ID NO: 969425 - RNA, 16 nt, Homo sapiens
aauaagaaacaugaug

SEQ ID NO: 969426 - RNA, 12 nt, Homo sapiens
aauaaugaagua

SEQ ID NO: 969427 - RNA, 12 nt, Homo sapiens
aauaaugcuuuu

SEQ ID NO: 969428 - RNA, 13 nt, Homo sapiens
aauaauucaaguc

SEQ ID NO: 969429 - RNA, 15 nt, Homo sapiens
aauacaaguaauauu

SEQ ID NO: 969430 - RNA, 14 nt, Homo sapiens
aauacagucauucc

SEQ ID NO: 969431 - RNA, 13 nt, Homo sapiens
aauacuuacuucu

SEQ ID NO: 969432 - RNA, 14 nt, Homo sapiens
aauagacaaaaagu

SEQ ID NO: 969433 - RNA, 16 nt, Homo sapiens
aauagacuaucuagaa

SEQ ID NO: 969434 - RNA, 10 nt, Homo sapiens
aauagaucuc

SEQ ID NO: 969435 - RNA, 24 nt, Homo sapiens
aauaggagaggaugagagcccaga

SEQ ID NO: 969436 - RNA, 23 nt, Homo sapiens
aauauagcuuucauaacaucgaa

SEQ ID NO: 969437 - RNA, 16 nt, Homo sapiens
acccuagggauuugca

SEQ ID NO: 969438 - RNA, 21 nt, Homo sapiens
acccuagggauuugcacuaaa

SEQ ID NO: 969439 - RNA, 17 nt, Homo sapiens
acccuccuccacuccac

SEQ ID NO: 969440 - RNA, 23 nt, Homo sapiens
acccugaaauauuuucuacuuua

SEQ ID NO: 969441 - RNA, 17 nt, Homo sapiens
acccuggucucaucagu

SEQ ID NO: 969442 - RNA, 18 nt, Homo sapiens
acccugguuauugaugug

SEQ ID NO: 969443 - RNA, 19 nt, Homo sapiens
acccuguggggccugaugg

SEQ ID NO: 969444 - RNA, 18 nt, Homo sapiens
acccuucucccacucucc

SEQ ID NO: 969445 - RNA, 21 nt, Homo sapiens
acccuucuggaaacugugaag

SEQ ID NO: 969446 - RNA, 20 nt, Homo sapiens
acccuuuggggguugaauag

SEQ ID NO: 969447 - RNA, 16 nt, Homo sapiens
accgcuugguuugcaa

SEQ ID NO: 969448 - RNA, 16 nt, Homo sapiens
accggcugguggagcu

SEQ ID NO: 969449 - RNA, 18 nt, Homo sapiens
accggcugguggagcugc

SEQ ID NO: 969450 - RNA, 19 nt, Homo sapiens
accggcugguggagcugcu

SEQ ID NO: 969451 - RNA, 11 nt, Homo sapiens
accgucuuucu

SEQ ID NO: 969452 - RNA, 13 nt, Homo sapiens
accguugcuaaga

SEQ ID NO: 969453 - RNA, 12 nt, Homo sapiens
accuacagagca

SEQ ID NO: 969454 - RNA, 19 nt, Homo sapiens
accuacagagcagccaggu

SEQ ID NO: 969455 - RNA, 20 nt, Homo sapiens
accuauuaucccagcugccu

SEQ ID NO: 969456 - RNA, 17 nt, Homo sapiens
accucaaguguccugaa

SEQ ID NO: 969457 - RNA, 20 nt, Homo sapiens
accuccaagcauuucaugaa

SEQ ID NO: 969458 - RNA, 12 nt, Homo sapiens
accuccacaccc

SEQ ID NO: 969459 - RNA, 16 nt, Homo sapiens
accuccacccagugau

SEQ ID NO: 969460 - RNA, 20 nt, Homo sapiens
accuccacccagugauccca

SEQ ID NO: 969461 - RNA, 19 nt, Homo sapiens
accuccaucgccuugcagg

SEQ ID NO: 969462 - RNA, 21 nt, Homo sapiens
accucuagguccccauacucc

SEQ ID NO: 969463 - RNA, 17 nt, Homo sapiens
accucugggcagcuccu

SEQ ID NO: 969464 - RNA, 18 nt, Homo sapiens
accucugggcagcuccug

SEQ ID NO: 969465 - RNA, 14 nt, Homo sapiens
accucuuccuugau

SEQ ID NO: 969466 - RNA, 12 nt, Homo sapiens
accucuugccuc

SEQ ID NO: 969467 - RNA, 17 nt, Homo sapiens
accugagaaauggccaa

SEQ ID NO: 969468 - RNA, 18 nt, Homo sapiens
accugagaaauggccaaa

SEQ ID NO: 969469 - RNA, 15 nt, Homo sapiens
accugccacucugcc

SEQ ID NO: 969470 - RNA, 16 nt, Homo sapiens
accugccccagcacuc

SEQ ID NO: 969471 - RNA, 23 nt, Homo sapiens
accugcucuuguucuacugagaa

SEQ ID NO: 969472 - RNA, 20 nt, Homo sapiens
accugcuuugugagccagca

SEQ ID NO: 969473 - RNA, 16 nt, Homo sapiens
accuggccccaggcug

SEQ ID NO: 969474 - RNA, 21 nt, Homo sapiens
accuggccccaggcugucacc

SEQ ID NO: 969475 - RNA, 21 nt, Homo sapiens
accugguagaucaagcauuac

SEQ ID NO: 969476 - RNA, 15 nt, Homo sapiens
accugugcaccuacc

SEQ ID NO: 969477 - RNA, 20 nt, Homo sapiens
accugugggggaagaucagc

SEQ ID NO: 969478 - RNA, 12 nt, Homo sapiens
accuuacaggga

SEQ ID NO: 969479 - RNA, 15 nt, Homo sapiens
accuuagacauaaag

SEQ ID NO: 969480 - RNA, 18 nt, Homo sapiens
accuuggugccugaucca

SEQ ID NO: 969481 - RNA, 17 nt, Homo sapiens
accuugucccagccagu

SEQ ID NO: 969482 - RNA, 14 nt, Homo sapiens
acgaauucugucuc

SEQ ID NO: 969483 - RNA, 11 nt, Homo sapiens
acgaugcauuu

SEQ ID NO: 969484 - RNA, 17 nt, Homo sapiens
acgauggcaauuggcau

SEQ ID NO: 969485 - RNA, 20 nt, Homo sapiens
acgcgguuccagauguggau

SEQ ID NO: 969486 - RNA, 17 nt, Homo sapiens
acgcgugccguggcacc

SEQ ID NO: 969487 - RNA, 13 nt, Homo sapiens
acgcucgcugcca

SEQ ID NO: 969488 - RNA, 18 nt, Homo sapiens
acgcucgcugccaucacc

SEQ ID NO: 969489 - RNA, 14 nt, Homo sapiens
acgcuugugacagu

SEQ ID NO: 969490 - RNA, 15 nt, Homo sapiens
acggaggaugaugcc

SEQ ID NO: 969491 - RNA, 16 nt, Homo sapiens
acggccaccacugcag

SEQ ID NO: 969492 - RNA, 17 nt, Homo sapiens
acgggaaaggagcugcu

SEQ ID NO: 969493 - RNA, 22 nt, Homo sapiens
acguuuauaaacagaaauggaa

SEQ ID NO: 969494 - RNA, 12 nt, Homo sapiens
acguuugauaca

SEQ ID NO: 969495 - RNA, 17 nt, Homo sapiens
acuaaacauguauguaa

SEQ ID NO: 969496 - RNA, 13 nt, Homo sapiens
acuaaaggcaucc

SEQ ID NO: 969497 - RNA, 13 nt, Homo sapiens
acuaaaugaacau

SEQ ID NO: 969498 - RNA, 17 nt, Homo sapiens
acuaacagauaagcaag

SEQ ID NO: 969499 - RNA, 14 nt, Homo sapiens
acuaauacuacugu

SEQ ID NO: 969500 - RNA, 16 nt, Homo sapiens
acuaauacuacugugu

SEQ ID NO: 969501 - RNA, 15 nt, Homo sapiens
acuaaugacaaguga

SEQ ID NO: 969502 - RNA, 16 nt, Homo sapiens
acuaaugccucuucau

SEQ ID NO: 969503 - RNA, 21 nt, Homo sapiens
acuacaccuggcugagguucc

SEQ ID NO: 969504 - RNA, 15 nt, Homo sapiens
acuacuguccaauca

SEQ ID NO: 969505 - RNA, 18 nt, Homo sapiens
acuagaggcuugcauaau

SEQ ID NO: 969506 - RNA, 18 nt, Homo sapiens
acuagccaaaccaggacc

SEQ ID NO: 969507 - RNA, 21 nt, Homo sapiens
acuagccagacaaaauuugag

SEQ ID NO: 969508 - RNA, 16 nt, Homo sapiens
acuagucucaccagcc

SEQ ID NO: 969509 - RNA, 19 nt, Homo sapiens
acuaguggcaaaugaccuu

SEQ ID NO: 969510 - RNA, 19 nt, Homo sapiens
acuaugaagguaaagggag

SEQ ID NO: 969511 - RNA, 13 nt, Homo sapiens
acucaacccauug

SEQ ID NO: 969512 - RNA, 12 nt, Homo sapiens
acucacacuccc

SEQ ID NO: 969513 - RNA, 23 nt, Homo sapiens
acucacuaugaagguaaagggag

SEQ ID NO: 969514 - RNA, 21 nt, Homo sapiens
acucacucucccccuccucuu

SEQ ID NO: 969515 - RNA, 20 nt, Homo sapiens
acucacuuuucccacuccaa

SEQ ID NO: 969516 - RNA, 15 nt, Homo sapiens
acucagaaccugcuc

SEQ ID NO: 969517 - RNA, 23 nt, Homo sapiens
acucagauugagcccuacauugu

SEQ ID NO: 969518 - RNA, 23 nt, Homo sapiens
acucagcuuuuucguauuucaaa

SEQ ID NO: 969519 - RNA, 14 nt, Homo sapiens
acucagguggugcc

SEQ ID NO: 969520 - RNA, 16 nt, Homo sapiens
acucaguaauuucaaa

SEQ ID NO: 969521 - RNA, 20 nt, Homo sapiens
acucaguaauuucaaaauac

SEQ ID NO: 969522 - RNA, 20 nt, Homo sapiens
acucaucaccccucuucccc

SEQ ID NO: 969523 - RNA, 18 nt, Homo sapiens
acucaucuuagugccuga

SEQ ID NO: 969524 - RNA, 16 nt, Homo sapiens
acuccaaaauguuggu

SEQ ID NO: 969525 - RNA, 19 nt, Homo sapiens
acuccacccuccuacaggu

SEQ ID NO: 969526 - RNA, 20 nt, Homo sapiens
acuccugaccccucuccuca

SEQ ID NO: 969527 - RNA, 12 nt, Homo sapiens
acucgccagcuc

SEQ ID NO: 969528 - RNA, 18 nt, Homo sapiens
acucgcccucgccagugg

SEQ ID NO: 969529 - RNA, 12 nt, Homo sapiens
acucgcuguaug

SEQ ID NO: 969530 - RNA, 22 nt, Homo sapiens
acucuacaaaauauagcuuuca

SEQ ID NO: 969531 - RNA, 15 nt, Homo sapiens
acucuccuaggcauu

SEQ ID NO: 969532 - RNA, 15 nt, Homo sapiens
acucucuaccagaua

SEQ ID NO: 969533 - RNA, 20 nt, Homo sapiens
acucucuguuuuaguguuua

SEQ ID NO: 969534 - RNA, 11 nt, Homo sapiens
acucugaagaa

SEQ ID NO: 969535 - RNA, 18 nt, Homo sapiens
acucugaagaauccugua

SEQ ID NO: 969536 - RNA, 11 nt, Homo sapiens
acucugacccc

SEQ ID NO: 969537 - RNA, 14 nt, Homo sapiens
acucugcacauguc

SEQ ID NO: 969538 - RNA, 15 nt, Homo sapiens
acucugcacaugucu

SEQ ID NO: 969539 - RNA, 18 nt, Homo sapiens
acucugcacaugucuugu

SEQ ID NO: 969540 - RNA, 14 nt, Homo sapiens
acucuuccaccucc

SEQ ID NO: 969541 - RNA, 17 nt, Homo sapiens
acucuucccucucucac

SEQ ID NO: 969542 - RNA, 13 nt, Homo sapiens
acugaacacugca

SEQ ID NO: 969543 - RNA, 16 nt, Homo sapiens
acugaagcugcacagu

SEQ ID NO: 969544 - RNA, 14 nt, Homo sapiens
acugaauaauauca

SEQ ID NO: 969545 - RNA, 16 nt, Homo sapiens
acugaaugaauccauu

SEQ ID NO: 969546 - RNA, 22 nt, Homo sapiens
acugaauuuggaggcuggagua

SEQ ID NO: 969547 - RNA, 21 nt, Homo sapiens
acugacacaagaauggucuuu

SEQ ID NO: 969548 - RNA, 12 nt, Homo sapiens
acugaccuaccu

SEQ ID NO: 969549 - RNA, 15 nt, Homo sapiens
acugauacacuugaa

SEQ ID NO: 969550 - RNA, 16 nt, Homo sapiens
acugauacacuugaag

SEQ ID NO: 969551 - RNA, 12 nt, Homo sapiens
acugaugguuca

SEQ ID NO: 969552 - RNA, 21 nt, Homo sapiens
acugccuucuccaucaugccc

SEQ ID NO: 969553 - RNA, 23 nt, Homo sapiens
aauauauauuaagugugccaaau

SEQ ID NO: 969554 - RNA, 20 nt, Homo sapiens
aauaucagaaguauaucugu

SEQ ID NO: 969555 - RNA, 17 nt, Homo sapiens
aauaucauaaagcauuu

SEQ ID NO: 969556 - RNA, 14 nt, Homo sapiens
aauauccaagacuu

SEQ ID NO: 969557 - RNA, 13 nt, Homo sapiens
aauaucugugaag

SEQ ID NO: 969558 - RNA, 20 nt, Homo sapiens
aauaugacggaagaacauag

SEQ ID NO: 969559 - RNA, 17 nt, Homo sapiens
aauaugcuuauaaccua

SEQ ID NO: 969560 - RNA, 16 nt, Homo sapiens
aauauuauuacuuuau

SEQ ID NO: 969561 - RNA, 16 nt, Homo sapiens
aauauuccugugacuu

SEQ ID NO: 969562 - RNA, 19 nt, Homo sapiens
aauauugcugaacuacuuu

SEQ ID NO: 969563 - RNA, 17 nt, Homo sapiens
aauauuugcacauggga

SEQ ID NO: 969564 - RNA, 15 nt, Homo sapiens
aauauuugcuaugaa

SEQ ID NO: 969565 - RNA, 23 nt, Homo sapiens
aauauuuuuauaucaugcaaaau

SEQ ID NO: 969566 - RNA, 23 nt, Homo sapiens
aauauuuuuguauuucucuauuu

SEQ ID NO: 969567 - RNA, 18 nt, Homo sapiens
aaucaagcuuuugcuuga

SEQ ID NO: 969568 - RNA, 12 nt, Homo sapiens
aaucaaucugca

SEQ ID NO: 969569 - RNA, 18 nt, Homo sapiens
aaucaccauguaagcacu

SEQ ID NO: 969570 - RNA, 14 nt, Homo sapiens
aaucagagacaaaa

SEQ ID NO: 969571 - RNA, 16 nt, Homo sapiens
aaucagcauuuagucu

SEQ ID NO: 969572 - RNA, 18 nt, Homo sapiens
aaucaguaaauaguguca

SEQ ID NO: 969573 - RNA, 20 nt, Homo sapiens
aaucaugauccuuguguuca

SEQ ID NO: 969574 - RNA, 18 nt, Homo sapiens
aauccaaagaaagauuaa

SEQ ID NO: 969575 - RNA, 21 nt, Homo sapiens
aauccaggcuuuauguacaaa

SEQ ID NO: 969576 - RNA, 23 nt, Homo sapiens
aaucccagauaugguugcacaaa

SEQ ID NO: 969577 - RNA, 22 nt, Homo sapiens
aauccucagguaguacugggaa

SEQ ID NO: 969578 - RNA, 19 nt, Homo sapiens
aauccuucuauucuagccu

SEQ ID NO: 969579 - RNA, 21 nt, Homo sapiens
aaucuaguugguugaugccuu

SEQ ID NO: 969580 - RNA, 19 nt, Homo sapiens
aaucucuacugcuuuggau

SEQ ID NO: 969581 - RNA, 14 nt, Homo sapiens
aaucugccagacuu

SEQ ID NO: 969582 - RNA, 22 nt, Homo sapiens
aaucuguuuauuuacaagggaa

SEQ ID NO: 969583 - RNA, 23 nt, Homo sapiens
aaucuguuuauuuacaagggaag

SEQ ID NO: 969584 - RNA, 21 nt, Homo sapiens
aaucuucugccuucucaugau

SEQ ID NO: 969585 - RNA, 13 nt, Homo sapiens
aaugacagccuuu

SEQ ID NO: 969586 - RNA, 20 nt, Homo sapiens
aaugaccuuccaaguaagca

SEQ ID NO: 969587 - RNA, 16 nt, Homo sapiens
aaugacgucacaagac

SEQ ID NO: 969588 - RNA, 18 nt, Homo sapiens
aaugacuauauaauuuau

SEQ ID NO: 969589 - RNA, 14 nt, Homo sapiens
aaugacucaaaguc

SEQ ID NO: 969590 - RNA, 13 nt, Homo sapiens
aaugaguaaaaac

SEQ ID NO: 969591 - RNA, 17 nt, Homo sapiens
aaugaguugaggccacu

SEQ ID NO: 969592 - RNA, 21 nt, Homo sapiens
aaugaguugaggccacugugu

SEQ ID NO: 969593 - RNA, 20 nt, Homo sapiens
aaugauuaaauuaugaagcu

SEQ ID NO: 969594 - RNA, 16 nt, Homo sapiens
aaugcagaauguaaaa

SEQ ID NO: 969595 - RNA, 22 nt, Homo sapiens
aaugcauauuugcaaaguguau

SEQ ID NO: 969596 - RNA, 14 nt, Homo sapiens
aaugcauguuuccu

SEQ ID NO: 969597 - RNA, 13 nt, Homo sapiens
aaugccagcauaa

SEQ ID NO: 969598 - RNA, 14 nt, Homo sapiens
aaugcccugugcau

SEQ ID NO: 969599 - RNA, 20 nt, Homo sapiens
aaugcuacgcacguggagcu

SEQ ID NO: 969600 - RNA, 12 nt, Homo sapiens
aaugcuccccac

SEQ ID NO: 969601 - RNA, 18 nt, Homo sapiens
aaugcuuucccacucuca

SEQ ID NO: 969602 - RNA, 20 nt, Homo sapiens
aaugcuuuucccacucucau

SEQ ID NO: 969603 - RNA, 15 nt, Homo sapiens
aauggacguacuggu

SEQ ID NO: 969604 - RNA, 12 nt, Homo sapiens
aauggacuggag

SEQ ID NO: 969605 - RNA, 19 nt, Homo sapiens
aauggcaguguuuuuauga

SEQ ID NO: 969606 - RNA, 13 nt, Homo sapiens
aauggccaugcag

SEQ ID NO: 969607 - RNA, 17 nt, Homo sapiens
aauggugguggaagggu

SEQ ID NO: 969608 - RNA, 17 nt, Homo sapiens
aaugguuaaauuuuaca

SEQ ID NO: 969609 - RNA, 23 nt, Homo sapiens
aaugguuaaauuuuacaugacag

SEQ ID NO: 969610 - RNA, 21 nt, Homo sapiens
aauguacacuaccaaacacuc

SEQ ID NO: 969611 - RNA, 19 nt, Homo sapiens
aaugucaauacuuacuucu

SEQ ID NO: 969612 - RNA, 22 nt, Homo sapiens
aaugucucaugucaaugaccau

SEQ ID NO: 969613 - RNA, 20 nt, Homo sapiens
aaugugaagauggacuucau

SEQ ID NO: 969614 - RNA, 12 nt, Homo sapiens
aaugugccccau

SEQ ID NO: 969615 - RNA, 20 nt, Homo sapiens
aauguggaauugacugccua

SEQ ID NO: 969616 - RNA, 13 nt, Homo sapiens
aauguguauucau

SEQ ID NO: 969617 - RNA, 20 nt, Homo sapiens
aauguguauuuuucaaggca

SEQ ID NO: 969618 - RNA, 15 nt, Homo sapiens
aauguucauggacua

SEQ ID NO: 969619 - RNA, 22 nt, Homo sapiens
aauuaaaaauaccaacuguaca

SEQ ID NO: 969620 - RNA, 14 nt, Homo sapiens
aauuaaaucugaau

SEQ ID NO: 969621 - RNA, 15 nt, Homo sapiens
aauuacucuaacaaa

SEQ ID NO: 969622 - RNA, 14 nt, Homo sapiens
aauuacugcuauaa

SEQ ID NO: 969623 - RNA, 17 nt, Homo sapiens
aauuaggaaguguuucc

SEQ ID NO: 969624 - RNA, 23 nt, Homo sapiens
aauuagucuuggaaaaaaaccac

SEQ ID NO: 969625 - RNA, 17 nt, Homo sapiens
aauucaaaaagaacuaa

SEQ ID NO: 969626 - RNA, 22 nt, Homo sapiens
aauucaguaacaaagguuuaaa

SEQ ID NO: 969627 - RNA, 14 nt, Homo sapiens
aauucccaccacua

SEQ ID NO: 969628 - RNA, 16 nt, Homo sapiens
aauuccuguacugugu

SEQ ID NO: 969629 - RNA, 23 nt, Homo sapiens
aauucuaacccagguauccaaaa

SEQ ID NO: 969630 - RNA, 18 nt, Homo sapiens
aauucugauugauuugau

SEQ ID NO: 969631 - RNA, 16 nt, Homo sapiens
aauucuuagucaagga

SEQ ID NO: 969632 - RNA, 18 nt, Homo sapiens
aauugaaaaguacaacua

SEQ ID NO: 969633 - RNA, 21 nt, Homo sapiens
aauugauucuuagacauugca

SEQ ID NO: 969634 - RNA, 14 nt, Homo sapiens
aauugccagcaaau

SEQ ID NO: 969635 - RNA, 19 nt, Homo sapiens
aauuggccaugucgccaaa

SEQ ID NO: 969636 - RNA, 22 nt, Homo sapiens
aauuuaaaaaauauauaugcau

SEQ ID NO: 969637 - RNA, 12 nt, Homo sapiens
aauuuacuugau

SEQ ID NO: 969638 - RNA, 20 nt, Homo sapiens
aauuuauacaccagcaauuu

SEQ ID NO: 969639 - RNA, 21 nt, Homo sapiens
aauuuauaucagguguauaaa

SEQ ID NO: 969640 - RNA, 15 nt, Homo sapiens
aauuucagggugcag

SEQ ID NO: 969641 - RNA, 12 nt, Homo sapiens
aauuucauucaa

SEQ ID NO: 969642 - RNA, 14 nt, Homo sapiens
aauuuccucuccac

SEQ ID NO: 969643 - RNA, 13 nt, Homo sapiens
aauuugauuugaa

SEQ ID NO: 969644 - RNA, 21 nt, Homo sapiens
aauuuggagcacaaaauucaa

SEQ ID NO: 969645 - RNA, 17 nt, Homo sapiens
aauuugggagagccaua

SEQ ID NO: 969646 - RNA, 20 nt, Homo sapiens
aauuugggagagccauacau

SEQ ID NO: 969647 - RNA, 13 nt, Homo sapiens
aauuuuaaccuau

SEQ ID NO: 969648 - RNA, 15 nt, Homo sapiens
aauuuuacuuaucau

SEQ ID NO: 969649 - RNA, 17 nt, Homo sapiens
aauuuucccucuucacu

SEQ ID NO: 969650 - RNA, 18 nt, Homo sapiens
aauuuucuaaaagcuuuc

SEQ ID NO: 969651 - RNA, 20 nt, Homo sapiens
aauuuugaguauuccaugag

SEQ ID NO: 969652 - RNA, 17 nt, Homo sapiens
aauuuuuaagcugcaaa

SEQ ID NO: 969653 - RNA, 18 nt, Homo sapiens
aauuuuuaagcugcaaau

SEQ ID NO: 969654 - RNA, 13 nt, Homo sapiens
acaaaaacagaau

SEQ ID NO: 969655 - RNA, 22 nt, Homo sapiens
acaaaaagaacaaaucagcuua

SEQ ID NO: 969656 - RNA, 16 nt, Homo sapiens
acaaaauaauaccuua

SEQ ID NO: 969657 - RNA, 15 nt, Homo sapiens
acaaaaugauuuuga

SEQ ID NO: 969658 - RNA, 17 nt, Homo sapiens
acaaaauucaaagcaug

SEQ ID NO: 969659 - RNA, 20 nt, Homo sapiens
acaaaauuugagaauacaua

SEQ ID NO: 969660 - RNA, 11 nt, Homo sapiens
acaaacagggc

SEQ ID NO: 969661 - RNA, 15 nt, Homo sapiens
acaaaccuaccaaaa

SEQ ID NO: 969662 - RNA, 18 nt, Homo sapiens
acaaacugaacacugcag

SEQ ID NO: 969663 - RNA, 14 nt, Homo sapiens
acaaacugucuaaa

SEQ ID NO: 969664 - RNA, 19 nt, Homo sapiens
acaaacuuuguuugucaca

SEQ ID NO: 969665 - RNA, 16 nt, Homo sapiens
acaaagccucaauuac

SEQ ID NO: 969666 - RNA, 17 nt, Homo sapiens
acaaauaagauuaauaa

SEQ ID NO: 969667 - RNA, 13 nt, Homo sapiens
acaaauauacauu

SEQ ID NO: 969668 - RNA, 20 nt, Homo sapiens
acugcuagcuuucuccuuac

SEQ ID NO: 969669 - RNA, 24 nt, Homo sapiens
acugcuagcuuucuccuuaccguc

SEQ ID NO: 969670 - RNA, 19 nt, Homo sapiens
acugcuaggggagagcucu

SEQ ID NO: 969671 - RNA, 21 nt, Homo sapiens
acugcucagaacuugcugcug

SEQ ID NO: 969672 - RNA, 22 nt, Homo sapiens
acuggaaccccagcuucccucc

SEQ ID NO: 969673 - RNA, 16 nt, Homo sapiens
acuggagccaucucuu

SEQ ID NO: 969674 - RNA, 21 nt, Homo sapiens
acuggcacagagguagucuca

SEQ ID NO: 969675 - RNA, 16 nt, Homo sapiens
acuggcagcaucuuca

SEQ ID NO: 969676 - RNA, 21 nt, Homo sapiens
acuggcuuaccuccucauggc

SEQ ID NO: 969677 - RNA, 20 nt, Homo sapiens
acugggugaaucuggcagga

SEQ ID NO: 969678 - RNA, 18 nt, Homo sapiens
acuguaguucacuguaga

SEQ ID NO: 969679 - RNA, 17 nt, Homo sapiens
acuguauuuacuuguua

SEQ ID NO: 969680 - RNA, 16 nt, Homo sapiens
acuguggccugaaaua

SEQ ID NO: 969681 - RNA, 18 nt, Homo sapiens
acuguggcuagugacaaa

SEQ ID NO: 969682 - RNA, 16 nt, Homo sapiens
acuguucacucacucu

SEQ ID NO: 969683 - RNA, 23 nt, Homo sapiens
acuguugagaggguuacuuacau

SEQ ID NO: 969684 - RNA, 23 nt, Homo sapiens
acuuaagggaacugaaucacuua

SEQ ID NO: 969685 - RNA, 14 nt, Homo sapiens
acuuacaacccagg

SEQ ID NO: 969686 - RNA, 20 nt, Homo sapiens
acuuagaauccgaagggaau

SEQ ID NO: 969687 - RNA, 23 nt, Homo sapiens
acuuagcuauauucugagacuuu

SEQ ID NO: 969688 - RNA, 18 nt, Homo sapiens
acuuaguuauuuaccaaa

SEQ ID NO: 969689 - RNA, 21 nt, Homo sapiens
acuuauaagugagaacaugca

SEQ ID NO: 969690 - RNA, 22 nt, Homo sapiens
acuuauuggaacucugcuugau

SEQ ID NO: 969691 - RNA, 17 nt, Homo sapiens
acuucagugagauuaag

SEQ ID NO: 969692 - RNA, 14 nt, Homo sapiens
acuucauaauccag

SEQ ID NO: 969693 - RNA, 13 nt, Homo sapiens
acuuccacuuugu

SEQ ID NO: 969694 - RNA, 16 nt, Homo sapiens
acuucccuaaugaagu

SEQ ID NO: 969695 - RNA, 21 nt, Homo sapiens
acuucuuacuucccuaaugaa

SEQ ID NO: 969696 - RNA, 21 nt, Homo sapiens
acuucuuaguaugugcauuua

SEQ ID NO: 969697 - RNA, 16 nt, Homo sapiens
acuugccucugcacac

SEQ ID NO: 969698 - RNA, 22 nt, Homo sapiens
acuugcugcuucugcacuucau

SEQ ID NO: 969699 - RNA, 23 nt, Homo sapiens
acuugcuuuaccuuuucagggcu

SEQ ID NO: 969700 - RNA, 14 nt, Homo sapiens
acuuggagauuuau

SEQ ID NO: 969701 - RNA, 19 nt, Homo sapiens
acuuggaugucacugccug

SEQ ID NO: 969702 - RNA, 20 nt, Homo sapiens
acuuggggguaaaggucugu

SEQ ID NO: 969703 - RNA, 20 nt, Homo sapiens
acuuggugauuaccugaaag

SEQ ID NO: 969704 - RNA, 21 nt, Homo sapiens
acuugucagugggaaacaaac

SEQ ID NO: 969705 - RNA, 18 nt, Homo sapiens
acuugucauagacuccuu

SEQ ID NO: 969706 - RNA, 19 nt, Homo sapiens
acuuguggccucaagcaau

SEQ ID NO: 969707 - RNA, 19 nt, Homo sapiens
acuuguuugcugugaacaa

SEQ ID NO: 969708 - RNA, 22 nt, Homo sapiens
acuuucagugcuuuuacuaucu

SEQ ID NO: 969709 - RNA, 17 nt, Homo sapiens
acuuucccacacuguga

SEQ ID NO: 969710 - RNA, 18 nt, Homo sapiens
acuuugacuuugcccagg

SEQ ID NO: 969711 - RNA, 17 nt, Homo sapiens
acuuugaucucugcuua

SEQ ID NO: 969712 - RNA, 13 nt, Homo sapiens
acuuuugcacauu

SEQ ID NO: 969713 - RNA, 15 nt, Homo sapiens
acuuuuugcauuuaa

SEQ ID NO: 969714 - RNA, 21 nt, Homo sapiens
acuuuuuuagaaaugcaaaau

SEQ ID NO: 969715 - RNA, 14 nt, Homo sapiens
agaaaaacaacuuu

SEQ ID NO: 969716 - RNA, 20 nt, Homo sapiens
agaaaacacccaauaccuua

SEQ ID NO: 969717 - RNA, 15 nt, Homo sapiens
agaaaacauaaucuu

SEQ ID NO: 969718 - RNA, 16 nt, Homo sapiens
agaaaagaacuggaaa

SEQ ID NO: 969719 - RNA, 23 nt, Homo sapiens
agaaacaccccucugucuaggac

SEQ ID NO: 969720 - RNA, 12 nt, Homo sapiens
agaaacaucuca

SEQ ID NO: 969721 - RNA, 15 nt, Homo sapiens
agaaaccacuagaaa

SEQ ID NO: 969722 - RNA, 12 nt, Homo sapiens
agaaagucuuca

SEQ ID NO: 969723 - RNA, 12 nt, Homo sapiens
agaaaugaauag

SEQ ID NO: 969724 - RNA, 15 nt, Homo sapiens
agaaauggcaucauu

SEQ ID NO: 969725 - RNA, 22 nt, Homo sapiens
agaaauggccaaauauauuucc

SEQ ID NO: 969726 - RNA, 22 nt, Homo sapiens
agaaaugguauguagagcuuag

SEQ ID NO: 969727 - RNA, 14 nt, Homo sapiens
agaaauguacuuag

SEQ ID NO: 969728 - RNA, 13 nt, Homo sapiens
agaaauuccccaa

SEQ ID NO: 969729 - RNA, 20 nt, Homo sapiens
agaaauuccuuccuuaccug

SEQ ID NO: 969730 - RNA, 15 nt, Homo sapiens
agaacaaugcuauaa

SEQ ID NO: 969731 - RNA, 19 nt, Homo sapiens
agaacauauguugcaagac

SEQ ID NO: 969732 - RNA, 17 nt, Homo sapiens
agaaccuuaaagaacca

SEQ ID NO: 969733 - RNA, 18 nt, Homo sapiens
agaacucgcgcucaguaa

SEQ ID NO: 969734 - RNA, 14 nt, Homo sapiens
agaacugucuguga

SEQ ID NO: 969735 - RNA, 17 nt, Homo sapiens
agaagagugcugucauu

SEQ ID NO: 969736 - RNA, 23 nt, Homo sapiens
agaagcacgauccgccaaugcac

SEQ ID NO: 969737 - RNA, 13 nt, Homo sapiens
agaagcacuacac

SEQ ID NO: 969738 - RNA, 17 nt, Homo sapiens
agaagccaagcgcucau

SEQ ID NO: 969739 - RNA, 18 nt, Homo sapiens
agaagccaguggacaguu

SEQ ID NO: 969740 - RNA, 14 nt, Homo sapiens
agaagcucaucuca

SEQ ID NO: 969741 - RNA, 20 nt, Homo sapiens
agaaggucauaagggagcau

SEQ ID NO: 969742 - RNA, 23 nt, Homo sapiens
agaaguuacacagaaaugcugcu

SEQ ID NO: 969743 - RNA, 18 nt, Homo sapiens
agaauaaaaacuuccuuc

SEQ ID NO: 969744 - RNA, 23 nt, Homo sapiens
agaauccauccaaaguucccuau

SEQ ID NO: 969745 - RNA, 15 nt, Homo sapiens
agaaucccuuugcac

SEQ ID NO: 969746 - RNA, 18 nt, Homo sapiens
agaaucucuugaaccugg

SEQ ID NO: 969747 - RNA, 19 nt, Homo sapiens
agaaucuuguuuugaaaau

SEQ ID NO: 969748 - RNA, 12 nt, Homo sapiens
agaaugcaugua

SEQ ID NO: 969749 - RNA, 14 nt, Homo sapiens
agaauuauacagua

SEQ ID NO: 969750 - RNA, 16 nt, Homo sapiens
agacaaaauauuuccc

SEQ ID NO: 969751 - RNA, 21 nt, Homo sapiens
agacccaguggacucuuccac

SEQ ID NO: 969752 - RNA, 15 nt, Homo sapiens
agaccccagucguga

SEQ ID NO: 969753 - RNA, 20 nt, Homo sapiens
agacccuccuauucuauaaa

SEQ ID NO: 969754 - RNA, 19 nt, Homo sapiens
agaccggcugguggagcug

SEQ ID NO: 969755 - RNA, 15 nt, Homo sapiens
agaccucaagccauc

SEQ ID NO: 969756 - RNA, 20 nt, Homo sapiens
agaccuguguuaaugcuuug

SEQ ID NO: 969757 - RNA, 16 nt, Homo sapiens
agacuacauuugugaa

SEQ ID NO: 969758 - RNA, 20 nt, Homo sapiens
agacuaccggacacucguca

SEQ ID NO: 969759 - RNA, 13 nt, Homo sapiens
agacucacauuua

SEQ ID NO: 969760 - RNA, 19 nt, Homo sapiens
agacuccuuugcuaaugcu

SEQ ID NO: 969761 - RNA, 16 nt, Homo sapiens
agacucuuuaugaucu

SEQ ID NO: 969762 - RNA, 23 nt, Homo sapiens
agacugccuucuccaucaugccc

SEQ ID NO: 969763 - RNA, 10 nt, Homo sapiens
agacugugca

SEQ ID NO: 969764 - RNA, 17 nt, Homo sapiens
agacuguugccacuuaa

SEQ ID NO: 969765 - RNA, 21 nt, Homo sapiens
agacuucuuccucuagacuug

SEQ ID NO: 969766 - RNA, 14 nt, Homo sapiens
agagacuccgucuc

SEQ ID NO: 969767 - RNA, 18 nt, Homo sapiens
agagcaagacugucucaa

SEQ ID NO: 969768 - RNA, 23 nt, Homo sapiens
agagcaaguccucacucuucaag

SEQ ID NO: 969769 - RNA, 13 nt, Homo sapiens
agagcccuugccu

SEQ ID NO: 969770 - RNA, 14 nt, Homo sapiens
agagcccuugccuc

SEQ ID NO: 969771 - RNA, 19 nt, Homo sapiens
agagcccuugccuccccau

SEQ ID NO: 969772 - RNA, 13 nt, Homo sapiens
agagccucugggc

SEQ ID NO: 969773 - RNA, 23 nt, Homo sapiens
agagcuauggugagguguggaua

SEQ ID NO: 969774 - RNA, 15 nt, Homo sapiens
agagcuuagauuucc

SEQ ID NO: 969775 - RNA, 23 nt, Homo sapiens
agagcuucucacagcaaaccucu

SEQ ID NO: 969776 - RNA, 13 nt, Homo sapiens
agaggagugcagc

SEQ ID NO: 969777 - RNA, 17 nt, Homo sapiens
agaggcugccccucuca

SEQ ID NO: 969778 - RNA, 18 nt, Homo sapiens
agaggcugccccucucac

SEQ ID NO: 969779 - RNA, 16 nt, Homo sapiens
agagggaggucacugg

SEQ ID NO: 969780 - RNA, 18 nt, Homo sapiens
agaggggauucacaaggu

SEQ ID NO: 969781 - RNA, 19 nt, Homo sapiens
agagugcaacccagucaca

SEQ ID NO: 969782 - RNA, 18 nt, Homo sapiens
acaaauguggccaagccu

SEQ ID NO: 969783 - RNA, 13 nt, Homo sapiens
acaacagagugaa

SEQ ID NO: 969784 - RNA, 20 nt, Homo sapiens
acaacagguaaaacagggcc

SEQ ID NO: 969785 - RNA, 11 nt, Homo sapiens
acaacauuaag

SEQ ID NO: 969786 - RNA, 13 nt, Homo sapiens
acaacugauugca

SEQ ID NO: 969787 - RNA, 14 nt, Homo sapiens
acaacugugugauu

SEQ ID NO: 969788 - RNA, 13 nt, Homo sapiens
acaagaacaauga

SEQ ID NO: 969789 - RNA, 15 nt, Homo sapiens
acaagaccucagugc

SEQ ID NO: 969790 - RNA, 13 nt, Homo sapiens
acaagagaagcuu

SEQ ID NO: 969791 - RNA, 11 nt, Homo sapiens
acaagcagcug

SEQ ID NO: 969792 - RNA, 19 nt, Homo sapiens
acaagcagcuggugcucca

SEQ ID NO: 969793 - RNA, 19 nt, Homo sapiens
acaagugacuuauuugcuc

SEQ ID NO: 969794 - RNA, 18 nt, Homo sapiens
acaauacaacacauugaa

SEQ ID NO: 969795 - RNA, 21 nt, Homo sapiens
acaauauuccagaucuuucag

SEQ ID NO: 969796 - RNA, 23 nt, Homo sapiens
acaaucaacucuaauagugcuua

SEQ ID NO: 969797 - RNA, 17 nt, Homo sapiens
acacaaaggaaguccaa

SEQ ID NO: 969798 - RNA, 14 nt, Homo sapiens
acacacacgaugca

SEQ ID NO: 969799 - RNA, 16 nt, Homo sapiens
acacacauugcagcuu

SEQ ID NO: 969800 - RNA, 19 nt, Homo sapiens
acacacgagcaaacccaga

SEQ ID NO: 969801 - RNA, 13 nt, Homo sapiens
acacauaugcacc

SEQ ID NO: 969802 - RNA, 13 nt, Homo sapiens
acacauguucugu

SEQ ID NO: 969803 - RNA, 20 nt, Homo sapiens
acaccacagcagagaccacc

SEQ ID NO: 969804 - RNA, 20 nt, Homo sapiens
acaccaggauuuaaguuuca

SEQ ID NO: 969805 - RNA, 16 nt, Homo sapiens
acacgaugcauuuaau

SEQ ID NO: 969806 - RNA, 22 nt, Homo sapiens
acacuaacgaaauaucaaaguc

SEQ ID NO: 969807 - RNA, 15 nt, Homo sapiens
acacuaacucaccag

SEQ ID NO: 969808 - RNA, 19 nt, Homo sapiens
acacucaucuuagugccug

SEQ ID NO: 969809 - RNA, 18 nt, Homo sapiens
acacucuagugacuuccu

SEQ ID NO: 969810 - RNA, 23 nt, Homo sapiens
acacucugccugaaggcucacac

SEQ ID NO: 969811 - RNA, 16 nt, Homo sapiens
acacugaccuguguuc

SEQ ID NO: 969812 - RNA, 18 nt, Homo sapiens
acacugauacacuugaag

SEQ ID NO: 969813 - RNA, 14 nt, Homo sapiens
acacugcuaauaau

SEQ ID NO: 969814 - RNA, 17 nt, Homo sapiens
acacugggacacuguca

SEQ ID NO: 969815 - RNA, 11 nt, Homo sapiens
acacugugaac

SEQ ID NO: 969816 - RNA, 16 nt, Homo sapiens
acacuuuaauguacau

SEQ ID NO: 969817 - RNA, 20 nt, Homo sapiens
acagaaagagacuccgucuc

SEQ ID NO: 969818 - RNA, 17 nt, Homo sapiens
acagaacauauguugca

SEQ ID NO: 969819 - RNA, 16 nt, Homo sapiens
acagaccugugugugc

SEQ ID NO: 969820 - RNA, 19 nt, Homo sapiens
acagacuuaacagcccagc

SEQ ID NO: 969821 - RNA, 22 nt, Homo sapiens
acagagagagauuccaucucaa

SEQ ID NO: 969822 - RNA, 21 nt, Homo sapiens
acagagaucccacacuacuuc

SEQ ID NO: 969823 - RNA, 16 nt, Homo sapiens
acagagcaaguccuca

SEQ ID NO: 969824 - RNA, 14 nt, Homo sapiens
acagagcuccuggc

SEQ ID NO: 969825 - RNA, 15 nt, Homo sapiens
acagaggagugcagc

SEQ ID NO: 969826 - RNA, 17 nt, Homo sapiens
acagagugcaacccagu

SEQ ID NO: 969827 - RNA, 18 nt, Homo sapiens
acagcagccacucaguuc

SEQ ID NO: 969828 - RNA, 23 nt, Homo sapiens
acagcagccacucaguucuuccu

SEQ ID NO: 969829 - RNA, 20 nt, Homo sapiens
acagcagggucuugcuguaa

SEQ ID NO: 969830 - RNA, 23 nt, Homo sapiens
acagcaguggaguaaguauuuag

SEQ ID NO: 969831 - RNA, 16 nt, Homo sapiens
acagcaugguaaugaa

SEQ ID NO: 969832 - RNA, 13 nt, Homo sapiens
acagcauguguau

SEQ ID NO: 969833 - RNA, 12 nt, Homo sapiens
acagccagugac

SEQ ID NO: 969834 - RNA, 20 nt, Homo sapiens
acagccuucuagcacacuuu

SEQ ID NO: 969835 - RNA, 18 nt, Homo sapiens
acagcgagggcagcugcu

SEQ ID NO: 969836 - RNA, 17 nt, Homo sapiens
acagcgcuaaggauggu

SEQ ID NO: 969837 - RNA, 17 nt, Homo sapiens
acagcguguaaacacau

SEQ ID NO: 969838 - RNA, 21 nt, Homo sapiens
acagcuuccuguuacugagau

SEQ ID NO: 969839 - RNA, 16 nt, Homo sapiens
acaggagaacaugcug

SEQ ID NO: 969840 - RNA, 20 nt, Homo sapiens
acaggcagauguuugccuca

SEQ ID NO: 969841 - RNA, 21 nt, Homo sapiens
acaggcagauguuugccucau

SEQ ID NO: 969842 - RNA, 15 nt, Homo sapiens
acagggagugcacau

SEQ ID NO: 969843 - RNA, 17 nt, Homo sapiens
acagguucuuaaaaagg

SEQ ID NO: 969844 - RNA, 16 nt, Homo sapiens
acaguaucccacaucc

SEQ ID NO: 969845 - RNA, 16 nt, Homo sapiens
acagucaccucacaaa

SEQ ID NO: 969846 - RNA, 22 nt, Homo sapiens
acagucacugcucuucagccau

SEQ ID NO: 969847 - RNA, 17 nt, Homo sapiens
acagucccagauacacu

SEQ ID NO: 969848 - RNA, 14 nt, Homo sapiens
acagugccucuucc

SEQ ID NO: 969849 - RNA, 20 nt, Homo sapiens
acaguggcaguauugacaau

SEQ ID NO: 969850 - RNA, 14 nt, Homo sapiens
acaguucucagaaa

SEQ ID NO: 969851 - RNA, 21 nt, Homo sapiens
acaguuuccaaauugcccuau

SEQ ID NO: 969852 - RNA, 17 nt, Homo sapiens
acauaaauaaaaauuca

SEQ ID NO: 969853 - RNA, 20 nt, Homo sapiens
acauaacguuuuuccuuuaa

SEQ ID NO: 969854 - RNA, 13 nt, Homo sapiens
acauacaaaauaa

SEQ ID NO: 969855 - RNA, 16 nt, Homo sapiens
acauauggacucugca

SEQ ID NO: 969856 - RNA, 17 nt, Homo sapiens
acauauggacucugcac

SEQ ID NO: 969857 - RNA, 20 nt, Homo sapiens
acauauggacucugcacaug

SEQ ID NO: 969858 - RNA, 23 nt, Homo sapiens
acauauuccugguguagcacuua

SEQ ID NO: 969859 - RNA, 22 nt, Homo sapiens
acaucaauuucuaaauacuuuu

SEQ ID NO: 969860 - RNA, 15 nt, Homo sapiens
acauccaacuccagc

SEQ ID NO: 969861 - RNA, 17 nt, Homo sapiens
acauccaacuccagcaa

SEQ ID NO: 969862 - RNA, 22 nt, Homo sapiens
acauccaucccuccauucaucc

SEQ ID NO: 969863 - RNA, 23 nt, Homo sapiens
acauccuuucuuuuaaugaugcc
